United States Patent 7,655,785 (BIOINFORMATICALLY DETECTABLE GROUP OF NOVEL REGULATORY OLIGONUCLEOTIDES AND USES THEREOF) - sequence listing, part 26

SEQ ID NO: 1055386 - RNA, 16 nt, Homo sapiens
ucacaaaccaugcaaa

SEQ ID NO: 1055387 - RNA, 19 nt, Homo sapiens
ucacaaccacucauucaaa

SEQ ID NO: 1055388 - RNA, 18 nt, Homo sapiens
ucacaagaagaccagacu

SEQ ID NO: 1055389 - RNA, 13 nt, Homo sapiens
ucacaagaauuua

SEQ ID NO: 1055390 - RNA, 18 nt, Homo sapiens
ucacaaggcauucaagug

SEQ ID NO: 1055391 - RNA, 21 nt, Homo sapiens
ucacaagugaaaaacauccag

SEQ ID NO: 1055392 - RNA, 20 nt, Homo sapiens
ucacaauaaaaauggcucag

SEQ ID NO: 1055393 - RNA, 13 nt, Homo sapiens
ucacaauacuguu

SEQ ID NO: 1055394 - RNA, 15 nt, Homo sapiens
ucacaccauugcacu

SEQ ID NO: 1055395 - RNA, 19 nt, Homo sapiens
ucacaccgcgucuggugac

SEQ ID NO: 1055396 - RNA, 19 nt, Homo sapiens
ucacacgggggcagcugau

SEQ ID NO: 1055397 - RNA, 12 nt, Homo sapiens
ucacacugagga

SEQ ID NO: 1055398 - RNA, 21 nt, Homo sapiens
ucacacuuccaccagccugca

SEQ ID NO: 1055399 - RNA, 22 nt, Homo sapiens
ucacagaaaguucuuaaacuca

SEQ ID NO: 1055400 - RNA, 19 nt, Homo sapiens
ucacagaacuauguacuuu

SEQ ID NO: 1055401 - RNA, 17 nt, Homo sapiens
ucacagacaccagcaaa

SEQ ID NO: 1055402 - RNA, 21 nt, Homo sapiens
ucacagacaccagcaaagcaa

SEQ ID NO: 1055403 - RNA, 16 nt, Homo sapiens
ucacagacccacaaga

SEQ ID NO: 1055404 - RNA, 21 nt, Homo sapiens
ucacagagauaauucuagcuu

SEQ ID NO: 1055405 - RNA, 16 nt, Homo sapiens
ucacagagugcauugu

SEQ ID NO: 1055406 - RNA, 18 nt, Homo sapiens
ucacagagugcauuguga

SEQ ID NO: 1055407 - RNA, 16 nt, Homo sapiens
ucacagaugugugauu

SEQ ID NO: 1055408 - RNA, 14 nt, Homo sapiens
ucacagccucugaa

SEQ ID NO: 1055409 - RNA, 16 nt, Homo sapiens
ucacagcuccucccac

SEQ ID NO: 1055410 - RNA, 23 nt, Homo sapiens
ucacaggaaguagaggaggccac

SEQ ID NO: 1055411 - RNA, 12 nt, Homo sapiens
ucacagggccaa

SEQ ID NO: 1055412 - RNA, 18 nt, Homo sapiens
ucacagugggagccaggg

SEQ ID NO: 1055413 - RNA, 19 nt, Homo sapiens
ucacaguguguuugugauu

SEQ ID NO: 1055414 - RNA, 19 nt, Homo sapiens
ucacaguuagguagcuuua

SEQ ID NO: 1055415 - RNA, 13 nt, Homo sapiens
ucacaucuuggca

SEQ ID NO: 1055416 - RNA, 15 nt, Homo sapiens
ucacauggcugucga

SEQ ID NO: 1055417 - RNA, 19 nt, Homo sapiens
ucaccaaaucagcugcuac

SEQ ID NO: 1055418 - RNA, 18 nt, Homo sapiens
ucaccacaccaaaccucu

SEQ ID NO: 1055419 - RNA, 22 nt, Homo sapiens
ucaccacagggauccccaggau

SEQ ID NO: 1055420 - RNA, 17 nt, Homo sapiens
ucaccacaugugcacau

SEQ ID NO: 1055421 - RNA, 14 nt, Homo sapiens
ugcuuuaggcucac

SEQ ID NO: 1055422 - RNA, 14 nt, Homo sapiens
ugcuuugaagcagu

SEQ ID NO: 1055423 - RNA, 14 nt, Homo sapiens
ugcuuugcacuuuu

SEQ ID NO: 1055424 - RNA, 15 nt, Homo sapiens
ugcuuugcacuuuuc

SEQ ID NO: 1055425 - RNA, 19 nt, Homo sapiens
ugcuuugcagccccacaga

SEQ ID NO: 1055426 - RNA, 14 nt, Homo sapiens
uggaaaaggaagac

SEQ ID NO: 1055427 - RNA, 21 nt, Homo sapiens
uggaaagcagguggcaucucu

SEQ ID NO: 1055428 - RNA, 18 nt, Homo sapiens
uggaaagcauauacuaua

SEQ ID NO: 1055429 - RNA, 18 nt, Homo sapiens
uggaaagcaucaccucag

SEQ ID NO: 1055430 - RNA, 22 nt, Homo sapiens
uggaaagcaucaccucaggcca

SEQ ID NO: 1055431 - RNA, 20 nt, Homo sapiens
uggaaagccucugcugccau

SEQ ID NO: 1055432 - RNA, 15 nt, Homo sapiens
uggaaaggggggagc

SEQ ID NO: 1055433 - RNA, 13 nt, Homo sapiens
uggaaagucacag

SEQ ID NO: 1055434 - RNA, 19 nt, Homo sapiens
uggaaauagugauuuccac

SEQ ID NO: 1055435 - RNA, 19 nt, Homo sapiens
uggaacagauucacacugu

SEQ ID NO: 1055436 - RNA, 21 nt, Homo sapiens
uggaacaggcucagaucucau

SEQ ID NO: 1055437 - RNA, 15 nt, Homo sapiens
uggaacucaaggaaa

SEQ ID NO: 1055438 - RNA, 21 nt, Homo sapiens
uggaacuuuuauuacuggggu

SEQ ID NO: 1055439 - RNA, 14 nt, Homo sapiens
uggaagaaauuccu

SEQ ID NO: 1055440 - RNA, 15 nt, Homo sapiens
uggaagaggggacag

SEQ ID NO: 1055441 - RNA, 23 nt, Homo sapiens
uggaagaggggacaggucccuca

SEQ ID NO: 1055442 - RNA, 18 nt, Homo sapiens
uggaagauugagagccca

SEQ ID NO: 1055443 - RNA, 15 nt, Homo sapiens
uggaagcucugaagu

SEQ ID NO: 1055444 - RNA, 22 nt, Homo sapiens
uggaagcucugaagucacauca

SEQ ID NO: 1055445 - RNA, 17 nt, Homo sapiens
uggaagcugucauaaaa

SEQ ID NO: 1055446 - RNA, 22 nt, Homo sapiens
uggaaguaaccauuugcacugg

SEQ ID NO: 1055447 - RNA, 15 nt, Homo sapiens
uggaagugugugauc

SEQ ID NO: 1055448 - RNA, 18 nt, Homo sapiens
uggaauauguaaauagaa

SEQ ID NO: 1055449 - RNA, 13 nt, Homo sapiens
uggaaucuuguaa

SEQ ID NO: 1055450 - RNA, 18 nt, Homo sapiens
uggaaugcuucuucucag

SEQ ID NO: 1055451 - RNA, 21 nt, Homo sapiens
uggaaugggcagcucaucucu

SEQ ID NO: 1055452 - RNA, 13 nt, Homo sapiens
uggaauguaauca

SEQ ID NO: 1055453 - RNA, 23 nt, Homo sapiens
uggaauuuucucacgcaggagcc

SEQ ID NO: 1055454 - RNA, 12 nt, Homo sapiens
uggacagaagca

SEQ ID NO: 1055455 - RNA, 17 nt, Homo sapiens
uggacagaagcagcucu

SEQ ID NO: 1055456 - RNA, 16 nt, Homo sapiens
uggacauagagaggga

SEQ ID NO: 1055457 - RNA, 24 nt, Homo sapiens
uggacaucauguuuucuggugaug

SEQ ID NO: 1055458 - RNA, 12 nt, Homo sapiens
uggaccacugca

SEQ ID NO: 1055459 - RNA, 18 nt, Homo sapiens
uggaccccaucugugaau

SEQ ID NO: 1055460 - RNA, 19 nt, Homo sapiens
uggacccugaggcccagag

SEQ ID NO: 1055461 - RNA, 21 nt, Homo sapiens
uggaccugcccugggccacac

SEQ ID NO: 1055462 - RNA, 15 nt, Homo sapiens
uggaccuguucaaaa

SEQ ID NO: 1055463 - RNA, 19 nt, Homo sapiens
uggacucaguuuucuugca

SEQ ID NO: 1055464 - RNA, 18 nt, Homo sapiens
uggacucuacacugugaa

SEQ ID NO: 1055465 - RNA, 15 nt, Homo sapiens
uggacucugcacaug

SEQ ID NO: 1055466 - RNA, 22 nt, Homo sapiens
uggacugaguuuauacucaccu

SEQ ID NO: 1055467 - RNA, 19 nt, Homo sapiens
uggacuuccacugccaucc

SEQ ID NO: 1055468 - RNA, 12 nt, Homo sapiens
uggacuuguaua

SEQ ID NO: 1055469 - RNA, 23 nt, Homo sapiens
uggagaaacccuugaaaagacau

SEQ ID NO: 1055470 - RNA, 22 nt, Homo sapiens
uggagaaacuguagucucagga

SEQ ID NO: 1055471 - RNA, 16 nt, Homo sapiens
uggagaaagcacugac

SEQ ID NO: 1055472 - RNA, 22 nt, Homo sapiens
uggagaaauuccuugauucaca

SEQ ID NO: 1055473 - RNA, 13 nt, Homo sapiens
uggagaagccauu

SEQ ID NO: 1055474 - RNA, 13 nt, Homo sapiens
uggagaagcuccc

SEQ ID NO: 1055475 - RNA, 22 nt, Homo sapiens
uggagacaagggcaucaucuau

SEQ ID NO: 1055476 - RNA, 22 nt, Homo sapiens
uggagagcacaccuaucuuagu

SEQ ID NO: 1055477 - RNA, 11 nt, Homo sapiens
uggagccagac

SEQ ID NO: 1055478 - RNA, 19 nt, Homo sapiens
uggagcccauccagucucc

SEQ ID NO: 1055479 - RNA, 16 nt, Homo sapiens
uggagcucagguccca

SEQ ID NO: 1055480 - RNA, 17 nt, Homo sapiens
uggaggagaaggacauu

SEQ ID NO: 1055481 - RNA, 19 nt, Homo sapiens
uggaggccggaaucucagc

SEQ ID NO: 1055482 - RNA, 20 nt, Homo sapiens
uggagggcacauuccuugcc

SEQ ID NO: 1055483 - RNA, 19 nt, Homo sapiens
uggagggcuagaaccugga

SEQ ID NO: 1055484 - RNA, 19 nt, Homo sapiens
uggagggcuagaaucugga

SEQ ID NO: 1055485 - RNA, 18 nt, Homo sapiens
uggaggucaggaguuuga

SEQ ID NO: 1055486 - RNA, 23 nt, Homo sapiens
uggaggucaggaguuugagacca

SEQ ID NO: 1055487 - RNA, 21 nt, Homo sapiens
uggagguuuguuuagaagaag

SEQ ID NO: 1055488 - RNA, 15 nt, Homo sapiens
uggaguaacacaaag

SEQ ID NO: 1055489 - RNA, 22 nt, Homo sapiens
uggaguccccucaccuccucua

SEQ ID NO: 1055490 - RNA, 18 nt, Homo sapiens
uggaguccgacaaagcua

SEQ ID NO: 1055491 - RNA, 17 nt, Homo sapiens
uggaguucuugugccau

SEQ ID NO: 1055492 - RNA, 15 nt, Homo sapiens
uggauaaaaugaggu

SEQ ID NO: 1055493 - RNA, 19 nt, Homo sapiens
uggauaugaaacuuaggaa

SEQ ID NO: 1055494 - RNA, 22 nt, Homo sapiens
uggauauuaaaaaucuguaaau

SEQ ID NO: 1055495 - RNA, 16 nt, Homo sapiens
uggaucaucuauugcu

SEQ ID NO: 1055496 - RNA, 17 nt, Homo sapiens
uggaucuaccagcauaa

SEQ ID NO: 1055497 - RNA, 18 nt, Homo sapiens
uggaucuccauucucuca

SEQ ID NO: 1055498 - RNA, 13 nt, Homo sapiens
uggaugauucaga

SEQ ID NO: 1055499 - RNA, 13 nt, Homo sapiens
uggaugcuccuuc

SEQ ID NO: 1055500 - RNA, 20 nt, Homo sapiens
uggaugggggaaauggugcc

SEQ ID NO: 1055501 - RNA, 13 nt, Homo sapiens
uggauguucugac

SEQ ID NO: 1055502 - RNA, 22 nt, Homo sapiens
uggauguucugacccugcuuca

SEQ ID NO: 1055503 - RNA, 20 nt, Homo sapiens
uggauuaaacuuaaucuaaa

SEQ ID NO: 1055504 - RNA, 14 nt, Homo sapiens
uggauuauuuagau

SEQ ID NO: 1055505 - RNA, 16 nt, Homo sapiens
uggauugacucugcau

SEQ ID NO: 1055506 - RNA, 12 nt, Homo sapiens
uggauugagggu

SEQ ID NO: 1055507 - RNA, 17 nt, Homo sapiens
uggauuugccugugcca

SEQ ID NO: 1055508 - RNA, 17 nt, Homo sapiens
uggauuuucaucagggg

SEQ ID NO: 1055509 - RNA, 19 nt, Homo sapiens
uggcaaagaugaucaguau

SEQ ID NO: 1055510 - RNA, 17 nt, Homo sapiens
uggcaaagguggcucuc

SEQ ID NO: 1055511 - RNA, 18 nt, Homo sapiens
uggcaacaacaaagccaa

SEQ ID NO: 1055512 - RNA, 17 nt, Homo sapiens
uggcaacaucuugcaaa

SEQ ID NO: 1055513 - RNA, 12 nt, Homo sapiens
uggcaagagccc

SEQ ID NO: 1055514 - RNA, 17 nt, Homo sapiens
uggcaagaucauagcuc

SEQ ID NO: 1055515 - RNA, 15 nt, Homo sapiens
uggcaaggugacauu

SEQ ID NO: 1055516 - RNA, 20 nt, Homo sapiens
uggcaaugaaaaauucucag

SEQ ID NO: 1055517 - RNA, 15 nt, Homo sapiens
uggcacugccaugca

SEQ ID NO: 1055518 - RNA, 12 nt, Homo sapiens
uggcacuuugaa

SEQ ID NO: 1055519 - RNA, 23 nt, Homo sapiens
uggcagaaugcuagcucugagcc

SEQ ID NO: 1055520 - RNA, 20 nt, Homo sapiens
uggcagcagaguguggccuu

SEQ ID NO: 1055521 - RNA, 21 nt, Homo sapiens
uggcagcaucuucacuucuaa

SEQ ID NO: 1055522 - RNA, 14 nt, Homo sapiens
uggcaggaccagga

SEQ ID NO: 1055523 - RNA, 21 nt, Homo sapiens
uggcagugggagcugccuguu

SEQ ID NO: 1055524 - RNA, 14 nt, Homo sapiens
uggcaugccuucca

SEQ ID NO: 1055525 - RNA, 16 nt, Homo sapiens
uggcauggccaccacc

SEQ ID NO: 1055526 - RNA, 21 nt, Homo sapiens
uggcauugucccugugccuaa

SEQ ID NO: 1055527 - RNA, 15 nt, Homo sapiens
uggcauuuucacuuu

SEQ ID NO: 1055528 - RNA, 19 nt, Homo sapiens
uggccaagcaauuccucug

SEQ ID NO: 1055529 - RNA, 22 nt, Homo sapiens
uggccaagcaauuccucugaac

SEQ ID NO: 1055530 - RNA, 22 nt, Homo sapiens
uggccagccuggaucuccucaa

SEQ ID NO: 1055531 - RNA, 21 nt, Homo sapiens
uggcccccacccaguccugca

SEQ ID NO: 1055532 - RNA, 20 nt, Homo sapiens
uggcccccacccucugccac

SEQ ID NO: 1055533 - RNA, 23 nt, Homo sapiens
uggcccucaguuucccuaucucg

SEQ ID NO: 1055534 - RNA, 21 nt, Homo sapiens
uggccgaaaaggauaugcagu

SEQ ID NO: 1055535 - RNA, 14 nt, Homo sapiens
uggccggagucagu

SEQ ID NO: 1055536 - RNA, 22 nt, Homo sapiens
uggccgggugcgguggcucacg

SEQ ID NO: 1055537 - RNA, 13 nt, Homo sapiens
uggccuaugcaca

SEQ ID NO: 1055538 - RNA, 14 nt, Homo sapiens
uggccuaugcacau

SEQ ID NO: 1055539 - RNA, 15 nt, Homo sapiens
uggccuccuaugccu

SEQ ID NO: 1055540 - RNA, 21 nt, Homo sapiens
ugggaagaccagcuuugcagu

SEQ ID NO: 1055541 - RNA, 20 nt, Homo sapiens
ugggaauguauuauucugca

SEQ ID NO: 1055542 - RNA, 12 nt, Homo sapiens
ugggacacaguu

SEQ ID NO: 1055543 - RNA, 14 nt, Homo sapiens
ugggacauugccuu

SEQ ID NO: 1055544 - RNA, 16 nt, Homo sapiens
ugggaccacagacuca

SEQ ID NO: 1055545 - RNA, 14 nt, Homo sapiens
ugggacccuugaga

SEQ ID NO: 1055546 - RNA, 12 nt, Homo sapiens
ugggacugagau

SEQ ID NO: 1055547 - RNA, 16 nt, Homo sapiens
ugggacuggggcugaa

SEQ ID NO: 1055548 - RNA, 15 nt, Homo sapiens
ugggacuuccuugcu

SEQ ID NO: 1055549 - RNA, 18 nt, Homo sapiens
ugggagaaucacuugaac

SEQ ID NO: 1055550 - RNA, 18 nt, Homo sapiens
ugggagacugcugaguca

SEQ ID NO: 1055551 - RNA, 14 nt, Homo sapiens
ugggagcacuuugu

SEQ ID NO: 1055552 - RNA, 17 nt, Homo sapiens
ugggaggcuguggagcc

SEQ ID NO: 1055553 - RNA, 14 nt, Homo sapiens
ugggaggcuucccc

SEQ ID NO: 1055554 - RNA, 14 nt, Homo sapiens
ugggagucaucuca

SEQ ID NO: 1055555 - RNA, 21 nt, Homo sapiens
ugggagugcccccaacagcac

SEQ ID NO: 1055556 - RNA, 17 nt, Homo sapiens
ugggaucugucacacca

SEQ ID NO: 1055557 - RNA, 15 nt, Homo sapiens
ugggauggauuucca

SEQ ID NO: 1055558 - RNA, 16 nt, Homo sapiens
ugggauguccacagau

SEQ ID NO: 1055559 - RNA, 21 nt, Homo sapiens
ugggauguccacagaugccuc

SEQ ID NO: 1055560 - RNA, 15 nt, Homo sapiens
ugggauuacagggau

SEQ ID NO: 1055561 - RNA, 17 nt, Homo sapiens
ugggauuacagguguga

SEQ ID NO: 1055562 - RNA, 19 nt, Homo sapiens
ugggauuacaggugugaac

SEQ ID NO: 1055563 - RNA, 16 nt, Homo sapiens
ugggauugugguacaa

SEQ ID NO: 1055564 - RNA, 18 nt, Homo sapiens
ugggcaacagagcaagau

SEQ ID NO: 1055565 - RNA, 21 nt, Homo sapiens
ugggcaacauugcuggcugga

SEQ ID NO: 1055566 - RNA, 21 nt, Homo sapiens
ugggcacaguuugguccguua

SEQ ID NO: 1055567 - RNA, 16 nt, Homo sapiens
ugggcaccccacugca

SEQ ID NO: 1055568 - RNA, 14 nt, Homo sapiens
ugggcagaaagugg

SEQ ID NO: 1055569 - RNA, 21 nt, Homo sapiens
ugggcagagcagagaccaucc

SEQ ID NO: 1055570 - RNA, 18 nt, Homo sapiens
ugggcagcauagcaagac

SEQ ID NO: 1055571 - RNA, 16 nt, Homo sapiens
ugggcagcucaucucu

SEQ ID NO: 1055572 - RNA, 21 nt, Homo sapiens
ugggcaggugguggcacugag

SEQ ID NO: 1055573 - RNA, 11 nt, Homo sapiens
ugggcuucuag

SEQ ID NO: 1055574 - RNA, 20 nt, Homo sapiens
uggggaaacagaugccucag

SEQ ID NO: 1055575 - RNA, 15 nt, Homo sapiens
uggggaaguguucca

SEQ ID NO: 1055576 - RNA, 23 nt, Homo sapiens
uggggacagagcagaacuuucac

SEQ ID NO: 1055577 - RNA, 19 nt, Homo sapiens
uggggacaucucuuugaau

SEQ ID NO: 1055578 - RNA, 23 nt, Homo sapiens
uggggacggggggccccagucag

SEQ ID NO: 1055579 - RNA, 19 nt, Homo sapiens
uggggagaaaagacaugaa

SEQ ID NO: 1055580 - RNA, 22 nt, Homo sapiens
uggggagaaaagacaugaauau

SEQ ID NO: 1055581 - RNA, 14 nt, Homo sapiens
uggggagucaggga

SEQ ID NO: 1055582 - RNA, 16 nt, Homo sapiens
uggggauaugauuuaa

SEQ ID NO: 1055583 - RNA, 19 nt, Homo sapiens
uggggaugguccacuguca

SEQ ID NO: 1055584 - RNA, 18 nt, Homo sapiens
uggggaugucucucauga

SEQ ID NO: 1055585 - RNA, 16 nt, Homo sapiens
uggggcaggcagugau

SEQ ID NO: 1055586 - RNA, 22 nt, Homo sapiens
uggggcaggucacuuuaccucu

SEQ ID NO: 1055587 - RNA, 15 nt, Homo sapiens
uggggcucucucuuc

SEQ ID NO: 1055588 - RNA, 21 nt, Homo sapiens
uggggcuggaugucuccaucu

SEQ ID NO: 1055589 - RNA, 18 nt, Homo sapiens
uggggcuuuuacaccagu

SEQ ID NO: 1055590 - RNA, 23 nt, Homo sapiens
ugggggaaaguguugaccacaga

SEQ ID NO: 1055591 - RNA, 14 nt, Homo sapiens
ugggggaguggaau

SEQ ID NO: 1055592 - RNA, 22 nt, Homo sapiens
ugggggaucacagccucugaaa

SEQ ID NO: 1055593 - RNA, 20 nt, Homo sapiens
ugggguaggaggaugggcuc

SEQ ID NO: 1055594 - RNA, 23 nt, Homo sapiens
uggggucagagacugcuguguuu

SEQ ID NO: 1055595 - RNA, 16 nt, Homo sapiens
uggggugggcacauug

SEQ ID NO: 1055596 - RNA, 18 nt, Homo sapiens
ugggguggggauagggag

SEQ ID NO: 1055597 - RNA, 18 nt, Homo sapiens
uggguacuuguggacaca

SEQ ID NO: 1055598 - RNA, 23 nt, Homo sapiens
ugggucagaguuccgacugccau

SEQ ID NO: 1055599 - RNA, 22 nt, Homo sapiens
uggguccucgcugcuggcugcu

SEQ ID NO: 1055600 - RNA, 19 nt, Homo sapiens
uggguccugggucuuucau

SEQ ID NO: 1055601 - RNA, 15 nt, Homo sapiens
ugggucuucccugua

SEQ ID NO: 1055602 - RNA, 21 nt, Homo sapiens
ugggucuucccuguaugauuc

SEQ ID NO: 1055603 - RNA, 14 nt, Homo sapiens
ugggugaagacaga

SEQ ID NO: 1055604 - RNA, 16 nt, Homo sapiens
ugggugacaaagugag

SEQ ID NO: 1055605 - RNA, 20 nt, Homo sapiens
ugggugacagagcaagugag

SEQ ID NO: 1055606 - RNA, 22 nt, Homo sapiens
ugggugagagugagacucaguc

SEQ ID NO: 1055607 - RNA, 17 nt, Homo sapiens
ugggugcaugaucuuga

SEQ ID NO: 1055608 - RNA, 12 nt, Homo sapiens
ugggugggacca

SEQ ID NO: 1055609 - RNA, 20 nt, Homo sapiens
ugggugucaagagggucuga

SEQ ID NO: 1055610 - RNA, 21 nt, Homo sapiens
uggguuagggaaaacauucca

SEQ ID NO: 1055611 - RNA, 18 nt, Homo sapiens
uggguugagccucagaau

SEQ ID NO: 1055612 - RNA, 21 nt, Homo sapiens
uggguuggugcacagugauuu

SEQ ID NO: 1055613 - RNA, 23 nt, Homo sapiens
uggguuuugaacauaaagccuug

SEQ ID NO: 1055614 - RNA, 18 nt, Homo sapiens
ugguaaacauucucucag

SEQ ID NO: 1055615 - RNA, 20 nt, Homo sapiens
ugguaacuguuaaauugcug

SEQ ID NO: 1055616 - RNA, 14 nt, Homo sapiens
ugguaagcaccagg

SEQ ID NO: 1055617 - RNA, 18 nt, Homo sapiens
ugguacuuuuaugaugua

SEQ ID NO: 1055618 - RNA, 15 nt, Homo sapiens
ugguagaaaggcagu

SEQ ID NO: 1055619 - RNA, 19 nt, Homo sapiens
ugguagaaaggcaguucag

SEQ ID NO: 1055620 - RNA, 22 nt, Homo sapiens
ugguagaacguaaccacggaaa

SEQ ID NO: 1055621 - RNA, 19 nt, Homo sapiens
ugguagcgggcgccuguag

SEQ ID NO: 1055622 - RNA, 21 nt, Homo sapiens
ugguauaaacguccuacugua

SEQ ID NO: 1055623 - RNA, 22 nt, Homo sapiens
ugguauaaacguccuacuguau

SEQ ID NO: 1055624 - RNA, 22 nt, Homo sapiens
ugguauccugugacauguaaca

SEQ ID NO: 1055625 - RNA, 19 nt, Homo sapiens
uggucaauccgaaguauga

SEQ ID NO: 1055626 - RNA, 20 nt, Homo sapiens
uggucagaacagagccuuug

SEQ ID NO: 1055627 - RNA, 23 nt, Homo sapiens
uggucaggauuccuguugccuuu

SEQ ID NO: 1055628 - RNA, 11 nt, Homo sapiens
ugguccagaau

SEQ ID NO: 1055629 - RNA, 14 nt, Homo sapiens
ugguccaggguuga

SEQ ID NO: 1055630 - RNA, 18 nt, Homo sapiens
ugguccgaagucuuccau

SEQ ID NO: 1055631 - RNA, 15 nt, Homo sapiens
ugguccucuugccuc

SEQ ID NO: 1055632 - RNA, 20 nt, Homo sapiens
ugguccugacucaacauguu

SEQ ID NO: 1055633 - RNA, 13 nt, Homo sapiens
uggucuccucuca

SEQ ID NO: 1055634 - RNA, 22 nt, Homo sapiens
uggucugcaggcagggcugacu

SEQ ID NO: 1055635 - RNA, 20 nt, Homo sapiens
uggucuuuccuaucauggag

SEQ ID NO: 1055636 - RNA, 14 nt, Homo sapiens
uggugaaaugcaga

SEQ ID NO: 1055637 - RNA, 14 nt, Homo sapiens
uggugacaguccaa

SEQ ID NO: 1055638 - RNA, 21 nt, Homo sapiens
uggugagaacuacucagggaa

SEQ ID NO: 1055639 - RNA, 14 nt, Homo sapiens
uggugaggcaauaa

SEQ ID NO: 1055640 - RNA, 18 nt, Homo sapiens
uggugcccuguucucuac

SEQ ID NO: 1055641 - RNA, 14 nt, Homo sapiens
uggugcugacaaag

SEQ ID NO: 1055642 - RNA, 13 nt, Homo sapiens
uggugcuggauau

SEQ ID NO: 1055643 - RNA, 15 nt, Homo sapiens
ugguggaucugucca

SEQ ID NO: 1055644 - RNA, 13 nt, Homo sapiens
ugguggcacugag

SEQ ID NO: 1055645 - RNA, 18 nt, Homo sapiens
ugguggcagugccuguaa

SEQ ID NO: 1055646 - RNA, 16 nt, Homo sapiens
ugguggguucagggga

SEQ ID NO: 1055647 - RNA, 13 nt, Homo sapiens
uggugugaccuga

SEQ ID NO: 1055648 - RNA, 13 nt, Homo sapiens
uggugugcuguau

SEQ ID NO: 1055649 - RNA, 21 nt, Homo sapiens
ugguguucaaaaaaacacuag

SEQ ID NO: 1055650 - RNA, 16 nt, Homo sapiens
ugguguugacauacau

SEQ ID NO: 1055651 - RNA, 17 nt, Homo sapiens
ugguguugacaugugcu

SEQ ID NO: 1055652 - RNA, 18 nt, Homo sapiens
ugguguuuacccaguauu

SEQ ID NO: 1055653 - RNA, 20 nt, Homo sapiens
ugguuaauaaguuucacuga

SEQ ID NO: 1055654 - RNA, 17 nt, Homo sapiens
ugguuacaaucauugcu

SEQ ID NO: 1055655 - RNA, 14 nt, Homo sapiens
ugguuacaguuuga

SEQ ID NO: 1055656 - RNA, 16 nt, Homo sapiens
ugguuauaaaagugau

SEQ ID NO: 1055657 - RNA, 17 nt, Homo sapiens
ugguuccaagcccugga

SEQ ID NO: 1055658 - RNA, 19 nt, Homo sapiens
ugguucccccacugaucac

SEQ ID NO: 1055659 - RNA, 20 nt, Homo sapiens
ugguugaaaccccaucucua

SEQ ID NO: 1055660 - RNA, 16 nt, Homo sapiens
ugguuuaugucaucau

SEQ ID NO: 1055661 - RNA, 18 nt, Homo sapiens
ugguuucaauaaaccuaa

SEQ ID NO: 1055662 - RNA, 22 nt, Homo sapiens
ugguuuuuaaaaaacugcugac

SEQ ID NO: 1055663 - RNA, 18 nt, Homo sapiens
uguaaaagagucaucugg

SEQ ID NO: 1055664 - RNA, 19 nt, Homo sapiens
uguaaacauaauucuugua

SEQ ID NO: 1055665 - RNA, 13 nt, Homo sapiens
uguaaacugugua

SEQ ID NO: 1055666 - RNA, 12 nt, Homo sapiens
uguaaacuugua

SEQ ID NO: 1055667 - RNA, 17 nt, Homo sapiens
uguaaauacacauagca

SEQ ID NO: 1055668 - RNA, 19 nt, Homo sapiens
uguaaauauuacacaucaa

SEQ ID NO: 1055669 - RNA, 13 nt, Homo sapiens
uguaacugcugaa

SEQ ID NO: 1055670 - RNA, 14 nt, Homo sapiens
uguaagaaacacac

SEQ ID NO: 1055671 - RNA, 17 nt, Homo sapiens
uguaauaaaacauguuc

SEQ ID NO: 1055672 - RNA, 18 nt, Homo sapiens
uguaaucccagcacuuug

SEQ ID NO: 1055673 - RNA, 19 nt, Homo sapiens
uguaaucccagcacuuugg

SEQ ID NO: 1055674 - RNA, 19 nt, Homo sapiens
uguaauuguuguuuguaug

SEQ ID NO: 1055675 - RNA, 20 nt, Homo sapiens
uguaauuugugauacaaugc

SEQ ID NO: 1055676 - RNA, 19 nt, Homo sapiens
uguacaaaaguuucauccu

SEQ ID NO: 1055677 - RNA, 20 nt, Homo sapiens
uguacaacuuuuuaccuagu

SEQ ID NO: 1055678 - RNA, 16 nt, Homo sapiens
uguacaccaauauuca

SEQ ID NO: 1055679 - RNA, 17 nt, Homo sapiens
uguacagaugaaugaua

SEQ ID NO: 1055680 - RNA, 14 nt, Homo sapiens
uguacagucuugua

SEQ ID NO: 1055681 - RNA, 16 nt, Homo sapiens
uguacaguuugcugua

SEQ ID NO: 1055682 - RNA, 22 nt, Homo sapiens
uguacaguuuuuauugcuuguu

SEQ ID NO: 1055683 - RNA, 16 nt, Homo sapiens
uguacauagccuauau

SEQ ID NO: 1055684 - RNA, 12 nt, Homo sapiens
uguaccagagaa

SEQ ID NO: 1055685 - RNA, 14 nt, Homo sapiens
uguaccugugcacg

SEQ ID NO: 1055686 - RNA, 15 nt, Homo sapiens
uguacuaagcaguaa

SEQ ID NO: 1055687 - RNA, 21 nt, Homo sapiens
uguacuacaucuaguuaauca

SEQ ID NO: 1055688 - RNA, 23 nt, Homo sapiens
gaccuuccugccaccagucacug

SEQ ID NO: 1055689 - RNA, 22 nt, Homo sapiens
gaccuucuaggaagcuccaguu

SEQ ID NO: 1055690 - RNA, 12 nt, Homo sapiens
gaccuugcacaa

SEQ ID NO: 1055691 - RNA, 18 nt, Homo sapiens
gaccuuggaucagaugaa

SEQ ID NO: 1055692 - RNA, 23 nt, Homo sapiens
gaccuuguuguuguuaaauauca

SEQ ID NO: 1055693 - RNA, 12 nt, Homo sapiens
gaccuuugcacg

SEQ ID NO: 1055694 - RNA, 16 nt, Homo sapiens
gaccuuuggagaccau

SEQ ID NO: 1055695 - RNA, 14 nt, Homo sapiens
gacgaaccuugaaa

SEQ ID NO: 1055696 - RNA, 15 nt, Homo sapiens
gacgacucugaccuc

SEQ ID NO: 1055697 - RNA, 22 nt, Homo sapiens
gacggcgugccuggacacugua

SEQ ID NO: 1055698 - RNA, 22 nt, Homo sapiens
gacgugauucaauucaacacuc

SEQ ID NO: 1055699 - RNA, 23 nt, Homo sapiens
gacuaagccuaccugcucuccaa

SEQ ID NO: 1055700 - RNA, 17 nt, Homo sapiens
gacuacaggcacccacc

SEQ ID NO: 1055701 - RNA, 14 nt, Homo sapiens
gacuagaaccugga

SEQ ID NO: 1055702 - RNA, 18 nt, Homo sapiens
gacuagaggcuugcauaa

SEQ ID NO: 1055703 - RNA, 16 nt, Homo sapiens
gacuaggugcuugcuu

SEQ ID NO: 1055704 - RNA, 17 nt, Homo sapiens
gacuaugaaugggcaaa

SEQ ID NO: 1055705 - RNA, 19 nt, Homo sapiens
gacuaugaggaauauuugc

SEQ ID NO: 1055706 - RNA, 16 nt, Homo sapiens
gacuauggaaauguag

SEQ ID NO: 1055707 - RNA, 18 nt, Homo sapiens
gacuauguuucuauucua

SEQ ID NO: 1055708 - RNA, 20 nt, Homo sapiens
gacuauuauagaauggaacu

SEQ ID NO: 1055709 - RNA, 12 nt, Homo sapiens
gacuauuuccac

SEQ ID NO: 1055710 - RNA, 12 nt, Homo sapiens
gacucaagcaag

SEQ ID NO: 1055711 - RNA, 17 nt, Homo sapiens
gacucacaagaagacca

SEQ ID NO: 1055712 - RNA, 16 nt, Homo sapiens
gacucaucauuuccau

SEQ ID NO: 1055713 - RNA, 14 nt, Homo sapiens
gacucauuacuacu

SEQ ID NO: 1055714 - RNA, 21 nt, Homo sapiens
gacucauuuuaaaaaauggaa

SEQ ID NO: 1055715 - RNA, 13 nt, Homo sapiens
gacuccaguuaaa

SEQ ID NO: 1055716 - RNA, 16 nt, Homo sapiens
gacuccgucucaaaaa

SEQ ID NO: 1055717 - RNA, 19 nt, Homo sapiens
gacuccuaugaucucaggu

SEQ ID NO: 1055718 - RNA, 13 nt, Homo sapiens
gacuccucaaaag

SEQ ID NO: 1055719 - RNA, 17 nt, Homo sapiens
gacuccugccgcaguga

SEQ ID NO: 1055720 - RNA, 20 nt, Homo sapiens
gacuccugccgcagugauca

SEQ ID NO: 1055721 - RNA, 13 nt, Homo sapiens
gacuccugugcaa

SEQ ID NO: 1055722 - RNA, 17 nt, Homo sapiens
gacuccugugcaacuuu

SEQ ID NO: 1055723 - RNA, 17 nt, Homo sapiens
gacucuacagaggccau

SEQ ID NO: 1055724 - RNA, 14 nt, Homo sapiens
gacucucagcagcu

SEQ ID NO: 1055725 - RNA, 19 nt, Homo sapiens
gacucuccaaauagcauua

SEQ ID NO: 1055726 - RNA, 16 nt, Homo sapiens
gacucugcacaugucu

SEQ ID NO: 1055727 - RNA, 14 nt, Homo sapiens
gacugaaacuggaa

SEQ ID NO: 1055728 - RNA, 14 nt, Homo sapiens
gacugaauuacucu

SEQ ID NO: 1055729 - RNA, 20 nt, Homo sapiens
gacugaccccagugguaucc

SEQ ID NO: 1055730 - RNA, 22 nt, Homo sapiens
gacugagagacaggacuagcug

SEQ ID NO: 1055731 - RNA, 14 nt, Homo sapiens
gacugauggugaaa

SEQ ID NO: 1055732 - RNA, 23 nt, Homo sapiens
gacugauguuacaucacaguguu

SEQ ID NO: 1055733 - RNA, 14 nt, Homo sapiens
gacugcaacaggcu

SEQ ID NO: 1055734 - RNA, 22 nt, Homo sapiens
gacugcacagcguccuguccac

SEQ ID NO: 1055735 - RNA, 18 nt, Homo sapiens
gacugccaugcuagacaa

SEQ ID NO: 1055736 - RNA, 21 nt, Homo sapiens
gacugccaugcuagacaagcu

SEQ ID NO: 1055737 - RNA, 14 nt, Homo sapiens
gacugcugagucaa

SEQ ID NO: 1055738 - RNA, 15 nt, Homo sapiens
gacuggaaccaggga

SEQ ID NO: 1055739 - RNA, 14 nt, Homo sapiens
gacuggcacacugg

SEQ ID NO: 1055740 - RNA, 17 nt, Homo sapiens
gacuggcacacuggccu

SEQ ID NO: 1055741 - RNA, 16 nt, Homo sapiens
gacuggcuuuuauuaa

SEQ ID NO: 1055742 - RNA, 20 nt, Homo sapiens
gacuggguuuugugauugcc

SEQ ID NO: 1055743 - RNA, 13 nt, Homo sapiens
gacuguagaagaa

SEQ ID NO: 1055744 - RNA, 20 nt, Homo sapiens
gacugucaguaggcuggaag

SEQ ID NO: 1055745 - RNA, 14 nt, Homo sapiens
gacugucuuucaga

SEQ ID NO: 1055746 - RNA, 16 nt, Homo sapiens
gacuguggccuguuaa

SEQ ID NO: 1055747 - RNA, 14 nt, Homo sapiens
gacuguugcucaaa

SEQ ID NO: 1055748 - RNA, 20 nt, Homo sapiens
gacuuaaacagcagauuuca

SEQ ID NO: 1055749 - RNA, 22 nt, Homo sapiens
gacuucagcucagagagcacca

SEQ ID NO: 1055750 - RNA, 17 nt, Homo sapiens
gacuuccuuacuaagca

SEQ ID NO: 1055751 - RNA, 20 nt, Homo sapiens
gacuucucugccaccaucaa

SEQ ID NO: 1055752 - RNA, 20 nt, Homo sapiens
gacuucugucuucacaacag

SEQ ID NO: 1055753 - RNA, 19 nt, Homo sapiens
gacuucuuuuacucaugau

SEQ ID NO: 1055754 - RNA, 20 nt, Homo sapiens
gacuugacagaacacugucu

SEQ ID NO: 1055755 - RNA, 21 nt, Homo sapiens
gacuuggcaacagaagugguu

SEQ ID NO: 1055756 - RNA, 17 nt, Homo sapiens
gacuuuguauagaaggu

SEQ ID NO: 1055757 - RNA, 22 nt, Homo sapiens
gacuuuguucacuagacugugc

SEQ ID NO: 1055758 - RNA, 17 nt, Homo sapiens
gagaaaaaaacuucuuu

SEQ ID NO: 1055759 - RNA, 20 nt, Homo sapiens
gagaaaaagccuccagucca

SEQ ID NO: 1055760 - RNA, 14 nt, Homo sapiens
gagaaaagccucuc

SEQ ID NO: 1055761 - RNA, 16 nt, Homo sapiens
gaggucacauucagga

SEQ ID NO: 1055762 - RNA, 17 nt, Homo sapiens
gaggugagggaagccug

SEQ ID NO: 1055763 - RNA, 20 nt, Homo sapiens
gagguggaggcugcagugag

SEQ ID NO: 1055764 - RNA, 18 nt, Homo sapiens
gagguggagguugcagug

SEQ ID NO: 1055765 - RNA, 19 nt, Homo sapiens
gagguggagguugcaguga

SEQ ID NO: 1055766 - RNA, 20 nt, Homo sapiens
gagguggggcuggaugucuc

SEQ ID NO: 1055767 - RNA, 16 nt, Homo sapiens
gaggugucuuaagccu

SEQ ID NO: 1055768 - RNA, 16 nt, Homo sapiens
gaguaacacaaaguga

SEQ ID NO: 1055769 - RNA, 16 nt, Homo sapiens
gaguaagaaaugcugc

SEQ ID NO: 1055770 - RNA, 16 nt, Homo sapiens
gaguaauucauuauua

SEQ ID NO: 1055771 - RNA, 16 nt, Homo sapiens
gaguacagugagccaa

SEQ ID NO: 1055772 - RNA, 19 nt, Homo sapiens
gaguacuggcugauggagu

SEQ ID NO: 1055773 - RNA, 14 nt, Homo sapiens
gaguauaauauuca

SEQ ID NO: 1055774 - RNA, 12 nt, Homo sapiens
gaguauaugcac

SEQ ID NO: 1055775 - RNA, 18 nt, Homo sapiens
gagucaaugugcagugua

SEQ ID NO: 1055776 - RNA, 23 nt, Homo sapiens
gagucacccaugaagacaggaca

SEQ ID NO: 1055777 - RNA, 12 nt, Homo sapiens
gagucacugccu

SEQ ID NO: 1055778 - RNA, 20 nt, Homo sapiens
gagucaggccuuaauuuuca

SEQ ID NO: 1055779 - RNA, 23 nt, Homo sapiens
gaguccacucccagugcuugcaa

SEQ ID NO: 1055780 - RNA, 16 nt, Homo sapiens
gaguccuccuguccag

SEQ ID NO: 1055781 - RNA, 16 nt, Homo sapiens
gaguccuuucuuccau

SEQ ID NO: 1055782 - RNA, 17 nt, Homo sapiens
gagucgggacuaaccca

SEQ ID NO: 1055783 - RNA, 22 nt, Homo sapiens
gagucuagccuggacaacacag

SEQ ID NO: 1055784 - RNA, 15 nt, Homo sapiens
gagugagaugccugc

SEQ ID NO: 1055785 - RNA, 15 nt, Homo sapiens
gagugcaaugaauga

SEQ ID NO: 1055786 - RNA, 19 nt, Homo sapiens
gagugcauugugaggguua

SEQ ID NO: 1055787 - RNA, 17 nt, Homo sapiens
gagugcccccaacagca

SEQ ID NO: 1055788 - RNA, 22 nt, Homo sapiens
gagugccguaacaacugugguc

SEQ ID NO: 1055789 - RNA, 20 nt, Homo sapiens
gagugccuggccaaagggau

SEQ ID NO: 1055790 - RNA, 13 nt, Homo sapiens
gaguggacuggag

SEQ ID NO: 1055791 - RNA, 14 nt, Homo sapiens
gaguggaucuccaa

SEQ ID NO: 1055792 - RNA, 21 nt, Homo sapiens
gaguggcucacccuguccaga

SEQ ID NO: 1055793 - RNA, 15 nt, Homo sapiens
gagugggcuaagcac

SEQ ID NO: 1055794 - RNA, 23 nt, Homo sapiens
gaguguagaucagagcagcagug

SEQ ID NO: 1055795 - RNA, 16 nt, Homo sapiens
gaguguaguaaagccg

SEQ ID NO: 1055796 - RNA, 21 nt, Homo sapiens
gaguuaauauauagaagggua

SEQ ID NO: 1055797 - RNA, 17 nt, Homo sapiens
gaguuaccacaccccau

SEQ ID NO: 1055798 - RNA, 11 nt, Homo sapiens
gaguuaccuac

SEQ ID NO: 1055799 - RNA, 17 nt, Homo sapiens
gaguuacuuccuaucaa

SEQ ID NO: 1055800 - RNA, 18 nt, Homo sapiens
gaguuaggcuauucacaa

SEQ ID NO: 1055801 - RNA, 17 nt, Homo sapiens
gaguuauauguucacug

SEQ ID NO: 1055802 - RNA, 13 nt, Homo sapiens
gaguucacuucau

SEQ ID NO: 1055803 - RNA, 19 nt, Homo sapiens
gaguucaguggcacucaac

SEQ ID NO: 1055804 - RNA, 20 nt, Homo sapiens
gaguucauacccuguuacca

SEQ ID NO: 1055805 - RNA, 13 nt, Homo sapiens
gaguucuccagac

SEQ ID NO: 1055806 - RNA, 22 nt, Homo sapiens
gaguucuugugccauagucaca

SEQ ID NO: 1055807 - RNA, 21 nt, Homo sapiens
gaguuugggaacugcaauaac

SEQ ID NO: 1055808 - RNA, 14 nt, Homo sapiens
gaguuuuguauuca

SEQ ID NO: 1055809 - RNA, 14 nt, Homo sapiens
gauaaaugccucau

SEQ ID NO: 1055810 - RNA, 14 nt, Homo sapiens
gauaacaaccugga

SEQ ID NO: 1055811 - RNA, 17 nt, Homo sapiens
gauaacuugagcaccgu

SEQ ID NO: 1055812 - RNA, 21 nt, Homo sapiens
gauaagagggcacacacugug

SEQ ID NO: 1055813 - RNA, 19 nt, Homo sapiens
gauaagguaccuuucacau

SEQ ID NO: 1055814 - RNA, 20 nt, Homo sapiens
gauaaguaaguuugauuuca

SEQ ID NO: 1055815 - RNA, 21 nt, Homo sapiens
gauaaucucuuuaaauggcuu

SEQ ID NO: 1055816 - RNA, 23 nt, Homo sapiens
gauacacugaaguuaacagagac

SEQ ID NO: 1055817 - RNA, 20 nt, Homo sapiens
gauacagguauucugcugau

SEQ ID NO: 1055818 - RNA, 17 nt, Homo sapiens
gauacccagagcauuac

SEQ ID NO: 1055819 - RNA, 13 nt, Homo sapiens
gauagaaccugga

SEQ ID NO: 1055820 - RNA, 21 nt, Homo sapiens
gauagcuucaccccaauccca

SEQ ID NO: 1055821 - RNA, 14 nt, Homo sapiens
gauaggaaugugaa

SEQ ID NO: 1055822 - RNA, 19 nt, Homo sapiens
gauagggagcagaugcaau

SEQ ID NO: 1055823 - RNA, 21 nt, Homo sapiens
gauagguuaccaguaacggaa

SEQ ID NO: 1055824 - RNA, 14 nt, Homo sapiens
gauaguccaaagac

SEQ ID NO: 1055825 - RNA, 13 nt, Homo sapiens
gauaguuuugcca

SEQ ID NO: 1055826 - RNA, 15 nt, Homo sapiens
gauauaaaagacuga

SEQ ID NO: 1055827 - RNA, 19 nt, Homo sapiens
gauaugaugucccuaugga

SEQ ID NO: 1055828 - RNA, 17 nt, Homo sapiens
gauauguucaacuggag

SEQ ID NO: 1055829 - RNA, 18 nt, Homo sapiens
gauauuaacaacaauaac

SEQ ID NO: 1055830 - RNA, 16 nt, Homo sapiens
gauauuagucuugggg

SEQ ID NO: 1055831 - RNA, 13 nt, Homo sapiens
gauauugcagcuu

SEQ ID NO: 1055832 - RNA, 19 nt, Homo sapiens
gauauuugaagcaucacau

SEQ ID NO: 1055833 - RNA, 15 nt, Homo sapiens
gauauuuuucaugau

SEQ ID NO: 1055834 - RNA, 21 nt, Homo sapiens
gaucaagucaccggagcuuuc

SEQ ID NO: 1055835 - RNA, 23 nt, Homo sapiens
gaucacagccucugaaaaccaau

SEQ ID NO: 1055836 - RNA, 16 nt, Homo sapiens
gaucacguugcaaugg

SEQ ID NO: 1055837 - RNA, 14 nt, Homo sapiens
gaucagaugaacuc

SEQ ID NO: 1055838 - RNA, 19 nt, Homo sapiens
gaucagauugcaugugacu

SEQ ID NO: 1055839 - RNA, 15 nt, Homo sapiens
gaucaggcacagugg

SEQ ID NO: 1055840 - RNA, 18 nt, Homo sapiens
cucacugaaaccaggugg

SEQ ID NO: 1055841 - RNA, 17 nt, Homo sapiens
cucacugcaagcacugc

SEQ ID NO: 1055842 - RNA, 20 nt, Homo sapiens
cucacuugaaugugucacua

SEQ ID NO: 1055843 - RNA, 23 nt, Homo sapiens
cucagagaauuucuaccauuuca

SEQ ID NO: 1055844 - RNA, 17 nt, Homo sapiens
cucagaucacuacugca

SEQ ID NO: 1055845 - RNA, 23 nt, Homo sapiens
cucagauggauugauaauugcau

SEQ ID NO: 1055846 - RNA, 13 nt, Homo sapiens
cucagcaaaagau

SEQ ID NO: 1055847 - RNA, 23 nt, Homo sapiens
cucagcacuuuggacauggcuca

SEQ ID NO: 1055848 - RNA, 14 nt, Homo sapiens
cucagcauaccugc

SEQ ID NO: 1055849 - RNA, 21 nt, Homo sapiens
cucagcauaccugcuggugca

SEQ ID NO: 1055850 - RNA, 18 nt, Homo sapiens
cucagccaagcacagugg

SEQ ID NO: 1055851 - RNA, 14 nt, Homo sapiens
cucuacaaaaagca

SEQ ID NO: 1055852 - RNA, 20 nt, Homo sapiens
cucuaccagacuguguauuc

SEQ ID NO: 1055853 - RNA, 17 nt, Homo sapiens
cucuacuccuaccucag

SEQ ID NO: 1055854 - RNA, 18 nt, Homo sapiens
cucuacuccuaccucagc

SEQ ID NO: 1055855 - RNA, 14 nt, Homo sapiens
cucuacucuaggga

SEQ ID NO: 1055856 - RNA, 21 nt, Homo sapiens
cucuacucuagggaaaaacca

SEQ ID NO: 1055857 - RNA, 16 nt, Homo sapiens
cucuacuuaaugagau

SEQ ID NO: 1055858 - RNA, 18 nt, Homo sapiens
cucuagagaaaagucuac

SEQ ID NO: 1055859 - RNA, 17 nt, Homo sapiens
cucuagggcaguggagu

SEQ ID NO: 1055860 - RNA, 21 nt, Homo sapiens
cucuauagacucuaggacaua

SEQ ID NO: 1055861 - RNA, 21 nt, Homo sapiens
cucuaugguguggcaaagccu

SEQ ID NO: 1055862 - RNA, 13 nt, Homo sapiens
cucuauuaucuca

SEQ ID NO: 1055863 - RNA, 19 nt, Homo sapiens
cucuauugcugcucucuca

SEQ ID NO: 1055864 - RNA, 19 nt, Homo sapiens
cucucaacccaggagcauc

SEQ ID NO: 1055865 - RNA, 21 nt, Homo sapiens
cucucaauuuuugguugaaua

SEQ ID NO: 1055866 - RNA, 22 nt, Homo sapiens
cucucacuccaggacaguggag

SEQ ID NO: 1055867 - RNA, 23 nt, Homo sapiens
cucucaggaucaagaaaguguug

SEQ ID NO: 1055868 - RNA, 21 nt, Homo sapiens
cucucaggcaugccuguguga

SEQ ID NO: 1055869 - RNA, 17 nt, Homo sapiens
cucucaggugaccaaaa

SEQ ID NO: 1055870 - RNA, 21 nt, Homo sapiens
cucucagucucugagcaguga

SEQ ID NO: 1055871 - RNA, 18 nt, Homo sapiens
cucuccaaauagcauuag

SEQ ID NO: 1055872 - RNA, 18 nt, Homo sapiens
cucuccaagucucagugg

SEQ ID NO: 1055873 - RNA, 21 nt, Homo sapiens
cucucccagucuacccagaga

SEQ ID NO: 1055874 - RNA, 17 nt, Homo sapiens
cucuccccagcaaguga

SEQ ID NO: 1055875 - RNA, 17 nt, Homo sapiens
cucuccccugauuacac

SEQ ID NO: 1055876 - RNA, 18 nt, Homo sapiens
cucucccgccagacuguu

SEQ ID NO: 1055877 - RNA, 15 nt, Homo sapiens
cucuccgaccagaca

SEQ ID NO: 1055878 - RNA, 17 nt, Homo sapiens
cucuccuccauguugcc

SEQ ID NO: 1055879 - RNA, 16 nt, Homo sapiens
cucuccuuuggccauu

SEQ ID NO: 1055880 - RNA, 23 nt, Homo sapiens
cucucgcaagggaaguccuugca

SEQ ID NO: 1055881 - RNA, 11 nt, Homo sapiens
cucucucauga

SEQ ID NO: 1055882 - RNA, 15 nt, Homo sapiens
cucucuccacccuau

SEQ ID NO: 1055883 - RNA, 18 nt, Homo sapiens
cucugaagcauguuucau

SEQ ID NO: 1055884 - RNA, 12 nt, Homo sapiens
cucugaagucac

SEQ ID NO: 1055885 - RNA, 17 nt, Homo sapiens
cucugaccugcacuggg

SEQ ID NO: 1055886 - RNA, 21 nt, Homo sapiens
cucugagcagugcuugaauga

SEQ ID NO: 1055887 - RNA, 15 nt, Homo sapiens
cucugagcugugcag

SEQ ID NO: 1055888 - RNA, 21 nt, Homo sapiens
cucugaggacacuaaccacgc

SEQ ID NO: 1055889 - RNA, 15 nt, Homo sapiens
cucugagggcuuccu

SEQ ID NO: 1055890 - RNA, 15 nt, Homo sapiens
cucugauacccagag

SEQ ID NO: 1055891 - RNA, 13 nt, Homo sapiens
cucugaucccucu

SEQ ID NO: 1055892 - RNA, 23 nt, Homo sapiens
cucugcaaugggcacugggauga

SEQ ID NO: 1055893 - RNA, 22 nt, Homo sapiens
cucugcacaagcugcacccuca

SEQ ID NO: 1055894 - RNA, 17 nt, Homo sapiens
cucugcaucacccacag

SEQ ID NO: 1055895 - RNA, 17 nt, Homo sapiens
cucugccuccucuucaa

SEQ ID NO: 1055896 - RNA, 22 nt, Homo sapiens
cucugccugaagucacacagug

SEQ ID NO: 1055897 - RNA, 23 nt, Homo sapiens
cucugcgaauauacuaaacauca

SEQ ID NO: 1055898 - RNA, 13 nt, Homo sapiens
cucugcugaucuc

SEQ ID NO: 1055899 - RNA, 20 nt, Homo sapiens
cucugcugaucucaguuucc

SEQ ID NO: 1055900 - RNA, 21 nt, Homo sapiens
cucugcugcagcggccacacu

SEQ ID NO: 1055901 - RNA, 24 nt, Homo sapiens
cucugcugccgccccacccagaug

SEQ ID NO: 1055902 - RNA, 17 nt, Homo sapiens
cucuggaaaaugugacc

SEQ ID NO: 1055903 - RNA, 18 nt, Homo sapiens
cucuggaaaaugugaccc

SEQ ID NO: 1055904 - RNA, 20 nt, Homo sapiens
cucuggaauuugcaagucau

SEQ ID NO: 1055905 - RNA, 21 nt, Homo sapiens
cucuggacacagccccaugua

SEQ ID NO: 1055906 - RNA, 15 nt, Homo sapiens
cucuggaccagccug

SEQ ID NO: 1055907 - RNA, 19 nt, Homo sapiens
cucuggaccagccuguugg

SEQ ID NO: 1055908 - RNA, 20 nt, Homo sapiens
cucuggagcaauguugcuua

SEQ ID NO: 1055909 - RNA, 23 nt, Homo sapiens
cucuggccucagccgacugcaca

SEQ ID NO: 1055910 - RNA, 14 nt, Homo sapiens
cucugggagacuuu

SEQ ID NO: 1055911 - RNA, 16 nt, Homo sapiens
cucugggccaagucaa

SEQ ID NO: 1055912 - RNA, 21 nt, Homo sapiens
cucugggccaagucaaagaca

SEQ ID NO: 1055913 - RNA, 10 nt, Homo sapiens
cucuguccag

SEQ ID NO: 1055914 - RNA, 18 nt, Homo sapiens
cucugucucaguccauga

SEQ ID NO: 1055915 - RNA, 21 nt, Homo sapiens
cucugugaacgauuuagaaag

SEQ ID NO: 1055916 - RNA, 12 nt, Homo sapiens
cucugugcuuug

SEQ ID NO: 1055917 - RNA, 14 nt, Homo sapiens
cucugugucaggug

SEQ ID NO: 1055918 - RNA, 22 nt, Homo sapiens
cucuuaagcuuccgccgucuca

SEQ ID NO: 1055919 - RNA, 16 nt, Homo sapiens
cucuuaaugcuguguu

SEQ ID NO: 1055920 - RNA, 13 nt, Homo sapiens
cucuuacauugaa

SEQ ID NO: 1055921 - RNA, 16 nt, Homo sapiens
cucuuacauugaaugu

SEQ ID NO: 1055922 - RNA, 14 nt, Homo sapiens
cucuuacugcaaau

SEQ ID NO: 1055923 - RNA, 15 nt, Homo sapiens
cucuuagcacacuca

SEQ ID NO: 1055924 - RNA, 18 nt, Homo sapiens
cucuuauagaaaguucaa

SEQ ID NO: 1055925 - RNA, 13 nt, Homo sapiens
cucuuauugcaaa

SEQ ID NO: 1055926 - RNA, 18 nt, Homo sapiens
cucuucaauauuugugua

SEQ ID NO: 1055927 - RNA, 14 nt, Homo sapiens
cucuucacagucac

SEQ ID NO: 1055928 - RNA, 22 nt, Homo sapiens
cucuucagguucuuagugucac

SEQ ID NO: 1055929 - RNA, 12 nt, Homo sapiens
cucuuccaucau

SEQ ID NO: 1055930 - RNA, 23 nt, Homo sapiens
cucuuccccucucagagcuacuu

SEQ ID NO: 1055931 - RNA, 20 nt, Homo sapiens
cucuuccuggucugaacucc

SEQ ID NO: 1055932 - RNA, 23 nt, Homo sapiens
cucuucucuuccuguaacacaag

SEQ ID NO: 1055933 - RNA, 13 nt, Homo sapiens
cucuugaaucucu

SEQ ID NO: 1055934 - RNA, 21 nt, Homo sapiens
cucuugagccugggaggucaa

SEQ ID NO: 1055935 - RNA, 13 nt, Homo sapiens
cucuugcacucaa

SEQ ID NO: 1055936 - RNA, 10 nt, Homo sapiens
cucuugcccu

SEQ ID NO: 1055937 - RNA, 14 nt, Homo sapiens
cucuuggcagucac

SEQ ID NO: 1055938 - RNA, 20 nt, Homo sapiens
cucuugggaagaccagcuuu

SEQ ID NO: 1055939 - RNA, 20 nt, Homo sapiens
cucuugggcugagacuggau

SEQ ID NO: 1055940 - RNA, 17 nt, Homo sapiens
cucuuggguucaaguga

SEQ ID NO: 1055941 - RNA, 14 nt, Homo sapiens
cucuuggucuuccc

SEQ ID NO: 1055942 - RNA, 21 nt, Homo sapiens
cucuuguauaugaugaucugg

SEQ ID NO: 1055943 - RNA, 17 nt, Homo sapiens
cucuuuaaauggcuuua

SEQ ID NO: 1055944 - RNA, 12 nt, Homo sapiens
cucuuuagccag

SEQ ID NO: 1055945 - RNA, 15 nt, Homo sapiens
cucuuuccuuccuuc

SEQ ID NO: 1055946 - RNA, 15 nt, Homo sapiens
cucuuucuacucuga

SEQ ID NO: 1055947 - RNA, 22 nt, Homo sapiens
cucuuuggcuccccuguaccuu

SEQ ID NO: 1055948 - RNA, 19 nt, Homo sapiens
cucuuuugaauccaugcuu

SEQ ID NO: 1055949 - RNA, 13 nt, Homo sapiens
cucuuuugagcua

SEQ ID NO: 1055950 - RNA, 16 nt, Homo sapiens
cugaaaacaagccaug

SEQ ID NO: 1055951 - RNA, 11 nt, Homo sapiens
cugaaaaccaa

SEQ ID NO: 1055952 - RNA, 17 nt, Homo sapiens
cugaaaauacuuaggaa

SEQ ID NO: 1055953 - RNA, 15 nt, Homo sapiens
cugaaaaucuaauau

SEQ ID NO: 1055954 - RNA, 13 nt, Homo sapiens
cugaaaaucugga

SEQ ID NO: 1055955 - RNA, 12 nt, Homo sapiens
cugaaacugcag

SEQ ID NO: 1055956 - RNA, 15 nt, Homo sapiens
cugaaagaagacauc

SEQ ID NO: 1055957 - RNA, 20 nt, Homo sapiens
cugaacaaucaaagcacuug

SEQ ID NO: 1055958 - RNA, 15 nt, Homo sapiens
cugaacauugcauau

SEQ ID NO: 1055959 - RNA, 15 nt, Homo sapiens
cugaacccauuuuga

SEQ ID NO: 1055960 - RNA, 22 nt, Homo sapiens
cugaacuaauaaaucuguugcc

SEQ ID NO: 1055961 - RNA, 21 nt, Homo sapiens
cugaacuuuaucuguucuguu

SEQ ID NO: 1055962 - RNA, 15 nt, Homo sapiens
cugaagaacaguaac

SEQ ID NO: 1055963 - RNA, 21 nt, Homo sapiens
cugaagauggcauccugugaa

SEQ ID NO: 1055964 - RNA, 15 nt, Homo sapiens
cugaaggacugugac

SEQ ID NO: 1055965 - RNA, 19 nt, Homo sapiens
cugaaggagccccauuccu

SEQ ID NO: 1055966 - RNA, 15 nt, Homo sapiens
cugaagggguucuca

SEQ ID NO: 1055967 - RNA, 16 nt, Homo sapiens
cugaaguaagcaaaga

SEQ ID NO: 1055968 - RNA, 14 nt, Homo sapiens
cugaagucacauca

SEQ ID NO: 1055969 - RNA, 17 nt, Homo sapiens
cugaagugaacuaugaa

SEQ ID NO: 1055970 - RNA, 12 nt, Homo sapiens
cugaagugcuua

SEQ ID NO: 1055971 - RNA, 13 nt, Homo sapiens
cugaagugcuuag

SEQ ID NO: 1055972 - RNA, 20 nt, Homo sapiens
cugaaguucagcugcauaca

SEQ ID NO: 1055973 - RNA, 14 nt, Homo sapiens
cugaauaaauaccu

SEQ ID NO: 1055974 - RNA, 16 nt, Homo sapiens
cugaauaaauaccucu

SEQ ID NO: 1055975 - RNA, 17 nt, Homo sapiens
cugaauacaaagugaug

SEQ ID NO: 1055976 - RNA, 16 nt, Homo sapiens
cugaauaugcugcuca

SEQ ID NO: 1055977 - RNA, 21 nt, Homo sapiens
cugaaugcaccauggucaaaa

SEQ ID NO: 1055978 - RNA, 12 nt, Homo sapiens
cugaauguucug

SEQ ID NO: 1055979 - RNA, 20 nt, Homo sapiens
cugaauucuuuuucauuuga

SEQ ID NO: 1055980 - RNA, 19 nt, Homo sapiens
cugaauuuggccugcacua

SEQ ID NO: 1055981 - RNA, 15 nt, Homo sapiens
cugacaguaaaucuc

SEQ ID NO: 1055982 - RNA, 16 nt, Homo sapiens
cugacauccccacuca

SEQ ID NO: 1055983 - RNA, 15 nt, Homo sapiens
cugaccaagagagaa

SEQ ID NO: 1055984 - RNA, 20 nt, Homo sapiens
cugaccaauauuguacaguu

SEQ ID NO: 1055985 - RNA, 21 nt, Homo sapiens
cugaccaauauuguacaguuu

SEQ ID NO: 1055986 - RNA, 13 nt, Homo sapiens
cugacccaugcaa

SEQ ID NO: 1055987 - RNA, 13 nt, Homo sapiens
cugaccccaaaga

SEQ ID NO: 1055988 - RNA, 21 nt, Homo sapiens
cugaccuccuuacauaugcaa

SEQ ID NO: 1055989 - RNA, 17 nt, Homo sapiens
cugaccucgugauccac

SEQ ID NO: 1055990 - RNA, 20 nt, Homo sapiens
cugaccuggaaagaaaaagc

SEQ ID NO: 1055991 - RNA, 14 nt, Homo sapiens
cugaccuguguucc

SEQ ID NO: 1055992 - RNA, 16 nt, Homo sapiens
cugaccuguguucccu

SEQ ID NO: 1055993 - RNA, 14 nt, Homo sapiens
cugaccuugcacaa

SEQ ID NO: 1055994 - RNA, 18 nt, Homo sapiens
gccucaagucacucccaa

SEQ ID NO: 1055995 - RNA, 14 nt, Homo sapiens
gccucaaugugacc

SEQ ID NO: 1055996 - RNA, 20 nt, Homo sapiens
gccucacccaggcaucugcu

SEQ ID NO: 1055997 - RNA, 21 nt, Homo sapiens
gccucagggacgacucugacc

SEQ ID NO: 1055998 - RNA, 15 nt, Homo sapiens
gccucagucccccaa

SEQ ID NO: 1055999 - RNA, 23 nt, Homo sapiens
gccucauuauuuuucacugcccc

SEQ ID NO: 1056000 - RNA, 21 nt, Homo sapiens
gccucauugaugucaaaaacu

SEQ ID NO: 1056001 - RNA, 19 nt, Homo sapiens
gccuccaccaccacuggcc

SEQ ID NO: 1056002 - RNA, 23 nt, Homo sapiens
gccuccaccccccagaaccuguc

SEQ ID NO: 1056003 - RNA, 17 nt, Homo sapiens
gccucccaaagugcuga

SEQ ID NO: 1056004 - RNA, 20 nt, Homo sapiens
gccucccaggagaaucacuu

SEQ ID NO: 1056005 - RNA, 19 nt, Homo sapiens
gccuccccacaggagcccu

SEQ ID NO: 1056006 - RNA, 21 nt, Homo sapiens
gccuccucucucaaacugggg

SEQ ID NO: 1056007 - RNA, 15 nt, Homo sapiens
gccuccugcaccgag

SEQ ID NO: 1056008 - RNA, 21 nt, Homo sapiens
gccuccuggaaaaaacaaaaa

SEQ ID NO: 1056009 - RNA, 15 nt, Homo sapiens
gccucgaaaaccauc

SEQ ID NO: 1056010 - RNA, 15 nt, Homo sapiens
gccucucccaucacu

SEQ ID NO: 1056011 - RNA, 19 nt, Homo sapiens
gccucucucuugcuuacaa

SEQ ID NO: 1056012 - RNA, 19 nt, Homo sapiens
gccucuuuucucugugcuu

SEQ ID NO: 1056013 - RNA, 19 nt, Homo sapiens
gccugaaccuuccaucucg

SEQ ID NO: 1056014 - RNA, 21 nt, Homo sapiens
gccugaagucccagcauugau

SEQ ID NO: 1056015 - RNA, 23 nt, Homo sapiens
gccugagaacaccagagaccuca

SEQ ID NO: 1056016 - RNA, 17 nt, Homo sapiens
gccugagguuugccagc

SEQ ID NO: 1056017 - RNA, 18 nt, Homo sapiens
gccugagucuccugugcc

SEQ ID NO: 1056018 - RNA, 16 nt, Homo sapiens
gccugauccagccucu

SEQ ID NO: 1056019 - RNA, 18 nt, Homo sapiens
gccugccccccucaucuc

SEQ ID NO: 1056020 - RNA, 24 nt, Homo sapiens
gccugcgcagcuuggauggagacu

SEQ ID NO: 1056021 - RNA, 22 nt, Homo sapiens
gccuggacuguuuucucucggc

SEQ ID NO: 1056022 - RNA, 22 nt, Homo sapiens
gccuggaguaacacaaagugaa

SEQ ID NO: 1056023 - RNA, 22 nt, Homo sapiens
gccuggcccaccuuccccagaa

SEQ ID NO: 1056024 - RNA, 17 nt, Homo sapiens
gccuggccccucagggu

SEQ ID NO: 1056025 - RNA, 15 nt, Homo sapiens
gccuggcuccaaacc

SEQ ID NO: 1056026 - RNA, 15 nt, Homo sapiens
gccugggaucccuca

SEQ ID NO: 1056027 - RNA, 16 nt, Homo sapiens
gccugggggauguacc

SEQ ID NO: 1056028 - RNA, 17 nt, Homo sapiens
gccuggggucugacaau

SEQ ID NO: 1056029 - RNA, 23 nt, Homo sapiens
gccugggucccacucaggugaaa

SEQ ID NO: 1056030 - RNA, 14 nt, Homo sapiens
gccugggugacaga

SEQ ID NO: 1056031 - RNA, 14 nt, Homo sapiens
gccugguggcagcu

SEQ ID NO: 1056032 - RNA, 13 nt, Homo sapiens
gccuggugugauu

SEQ ID NO: 1056033 - RNA, 19 nt, Homo sapiens
gccuguaaucccagcuacu

SEQ ID NO: 1056034 - RNA, 13 nt, Homo sapiens
gccuguaguccca

SEQ ID NO: 1056035 - RNA, 20 nt, Homo sapiens
gccuguaugcaacaggcacu

SEQ ID NO: 1056036 - RNA, 20 nt, Homo sapiens
gccuguuauaacucugcacu

SEQ ID NO: 1056037 - RNA, 18 nt, Homo sapiens
gccuuagucucaguuugu

SEQ ID NO: 1056038 - RNA, 15 nt, Homo sapiens
gccuucacuuuacaa

SEQ ID NO: 1056039 - RNA, 20 nt, Homo sapiens
gccuucauaagccuaccaau

SEQ ID NO: 1056040 - RNA, 23 nt, Homo sapiens
gccuuccacuuggcuacacaggg

SEQ ID NO: 1056041 - RNA, 19 nt, Homo sapiens
gccuucccaggaguacacc

SEQ ID NO: 1056042 - RNA, 20 nt, Homo sapiens
gccuuccccugggcccugac

SEQ ID NO: 1056043 - RNA, 14 nt, Homo sapiens
gccuuccucugcag

SEQ ID NO: 1056044 - RNA, 17 nt, Homo sapiens
gccuuccugcccuacag

SEQ ID NO: 1056045 - RNA, 16 nt, Homo sapiens
gccuucuccacuggcc

SEQ ID NO: 1056046 - RNA, 19 nt, Homo sapiens
gccuucugaggacauucca

SEQ ID NO: 1056047 - RNA, 18 nt, Homo sapiens
gccuucuuauugcuuuua

SEQ ID NO: 1056048 - RNA, 16 nt, Homo sapiens
gccuugaaaccaccuu

SEQ ID NO: 1056049 - RNA, 14 nt, Homo sapiens
gccuugcauugccu

SEQ ID NO: 1056050 - RNA, 15 nt, Homo sapiens
gccuuggcuucaggg

SEQ ID NO: 1056051 - RNA, 18 nt, Homo sapiens
gccuugggcuccugauga

SEQ ID NO: 1056052 - RNA, 18 nt, Homo sapiens
gccuuuaaaucugugaug

SEQ ID NO: 1056053 - RNA, 20 nt, Homo sapiens
gccuuuauauccaaaauaaa

SEQ ID NO: 1056054 - RNA, 20 nt, Homo sapiens
gccuuugaauaaaaaugcac

SEQ ID NO: 1056055 - RNA, 14 nt, Homo sapiens
gccuuugcuugaaa

SEQ ID NO: 1056056 - RNA, 19 nt, Homo sapiens
gccuuugucagaacuagaa

SEQ ID NO: 1056057 - RNA, 14 nt, Homo sapiens
gccuuuuguguuuu

SEQ ID NO: 1056058 - RNA, 15 nt, Homo sapiens
gcgaaaccccaucuc

SEQ ID NO: 1056059 - RNA, 18 nt, Homo sapiens
gcgaccccgucacagccu

SEQ ID NO: 1056060 - RNA, 20 nt, Homo sapiens
gcgagcccugguggcagugg

SEQ ID NO: 1056061 - RNA, 17 nt, Homo sapiens
gcgagucuuacuuugag

SEQ ID NO: 1056062 - RNA, 16 nt, Homo sapiens
gcgagugcucauuuca

SEQ ID NO: 1056063 - RNA, 15 nt, Homo sapiens
gcgcaagcugggagc

SEQ ID NO: 1056064 - RNA, 22 nt, Homo sapiens
gcgcacuuuccuccuggcagaa

SEQ ID NO: 1056065 - RNA, 21 nt, Homo sapiens
gcgccaagcaaccugggucca

SEQ ID NO: 1056066 - RNA, 19 nt, Homo sapiens
gcgccagaacccagauuuc

SEQ ID NO: 1056067 - RNA, 18 nt, Homo sapiens
gcgcccagccucaucucu

SEQ ID NO: 1056068 - RNA, 17 nt, Homo sapiens
gcgcccaguccuuccac

SEQ ID NO: 1056069 - RNA, 21 nt, Homo sapiens
gcgcccaugaugggagggauu

SEQ ID NO: 1056070 - RNA, 16 nt, Homo sapiens
gcgccgugaguucuca

SEQ ID NO: 1056071 - RNA, 15 nt, Homo sapiens
gcgccucggguccca

SEQ ID NO: 1056072 - RNA, 22 nt, Homo sapiens
gcgcgagccaugauguggagug

SEQ ID NO: 1056073 - RNA, 14 nt, Homo sapiens
gcgcgguggcucac

SEQ ID NO: 1056074 - RNA, 14 nt, Homo sapiens
gcggacaucagcug

SEQ ID NO: 1056075 - RNA, 20 nt, Homo sapiens
gcggagaaccuugugccugg

SEQ ID NO: 1056076 - RNA, 16 nt, Homo sapiens
gcggcauuaaagccau

SEQ ID NO: 1056077 - RNA, 13 nt, Homo sapiens
gcggcuggcagcc

SEQ ID NO: 1056078 - RNA, 17 nt, Homo sapiens
gcgggccaaggacugcc

SEQ ID NO: 1056079 - RNA, 18 nt, Homo sapiens
gcgggccagccaggcggg

SEQ ID NO: 1056080 - RNA, 23 nt, Homo sapiens
gcuuuguuaucuuccacuggaaa

SEQ ID NO: 1056081 - RNA, 23 nt, Homo sapiens
gcuuuguugaaugaagcagagaa

SEQ ID NO: 1056082 - RNA, 14 nt, Homo sapiens
gcuuuguugcccag

SEQ ID NO: 1056083 - RNA, 23 nt, Homo sapiens
gcuuuuaaugcuccaaaugcuga

SEQ ID NO: 1056084 - RNA, 21 nt, Homo sapiens
gcuuuuccacugccugggaug

SEQ ID NO: 1056085 - RNA, 16 nt, Homo sapiens
gcuuuuccucccucag

SEQ ID NO: 1056086 - RNA, 16 nt, Homo sapiens
gcuuuuccugauguuc

SEQ ID NO: 1056087 - RNA, 14 nt, Homo sapiens
gcuuuugugcauua

SEQ ID NO: 1056088 - RNA, 14 nt, Homo sapiens
gcuuuuuuacacaa

SEQ ID NO: 1056089 - RNA, 20 nt, Homo sapiens
gcuuuuuuccuccuguguac

SEQ ID NO: 1056090 - RNA, 15 nt, Homo sapiens
ggaaaacaagcauuc

SEQ ID NO: 1056091 - RNA, 19 nt, Homo sapiens
ggaaaagggucuugggaaa

SEQ ID NO: 1056092 - RNA, 15 nt, Homo sapiens
ggaaaauaccccauc

SEQ ID NO: 1056093 - RNA, 16 nt, Homo sapiens
ggaaaauauccauccu

SEQ ID NO: 1056094 - RNA, 12 nt, Homo sapiens
ggaaaaugagua

SEQ ID NO: 1056095 - RNA, 12 nt, Homo sapiens
ggaaaaugugac

SEQ ID NO: 1056096 - RNA, 17 nt, Homo sapiens
ggaaaauuucacauuaa

SEQ ID NO: 1056097 - RNA, 22 nt, Homo sapiens
ggaaaauuuuaaaaauacagau

SEQ ID NO: 1056098 - RNA, 14 nt, Homo sapiens
ggaaaccacagcug

SEQ ID NO: 1056099 - RNA, 18 nt, Homo sapiens
ggaaaccugcccugccug

SEQ ID NO: 1056100 - RNA, 19 nt, Homo sapiens
ggaaacuguacuacaucua

SEQ ID NO: 1056101 - RNA, 17 nt, Homo sapiens
ggaaagaaaaagcaaua

SEQ ID NO: 1056102 - RNA, 14 nt, Homo sapiens
ggaaaggauucaug

SEQ ID NO: 1056103 - RNA, 16 nt, Homo sapiens
ggaaaggcuccaggag

SEQ ID NO: 1056104 - RNA, 22 nt, Homo sapiens
ggaaagggugcugcuucccucu

SEQ ID NO: 1056105 - RNA, 18 nt, Homo sapiens
ggaaaguaaauauuucag

SEQ ID NO: 1056106 - RNA, 21 nt, Homo sapiens
ggaaauguaacuugaagcagc

SEQ ID NO: 1056107 - RNA, 12 nt, Homo sapiens
ggaacaaucuaa

SEQ ID NO: 1056108 - RNA, 22 nt, Homo sapiens
ggaacacccgacuccucaaaag

SEQ ID NO: 1056109 - RNA, 18 nt, Homo sapiens
ggaacagaaggaugaaug

SEQ ID NO: 1056110 - RNA, 17 nt, Homo sapiens
ggaaccacgucugcuaa

SEQ ID NO: 1056111 - RNA, 13 nt, Homo sapiens
ggaaccaugaaga

SEQ ID NO: 1056112 - RNA, 18 nt, Homo sapiens
ggaacuaagaaagcccuu

SEQ ID NO: 1056113 - RNA, 14 nt, Homo sapiens
ggaacucaguguga

SEQ ID NO: 1056114 - RNA, 19 nt, Homo sapiens
ggaacucuggcuuccaggu

SEQ ID NO: 1056115 - RNA, 20 nt, Homo sapiens
ggaacucuggcuuccaggua

SEQ ID NO: 1056116 - RNA, 16 nt, Homo sapiens
ggaagaaauuccugua

SEQ ID NO: 1056117 - RNA, 22 nt, Homo sapiens
ggaagaacccucaggucacaag

SEQ ID NO: 1056118 - RNA, 15 nt, Homo sapiens
ggaagacaaugugaa

SEQ ID NO: 1056119 - RNA, 23 nt, Homo sapiens
ggaagaccagcuuugcagugaca

SEQ ID NO: 1056120 - RNA, 21 nt, Homo sapiens
ggaagcaacaggaaucaagag

SEQ ID NO: 1056121 - RNA, 17 nt, Homo sapiens
ggaagccggcggcccaa

SEQ ID NO: 1056122 - RNA, 22 nt, Homo sapiens
ggaagccucccacgacugcccg

SEQ ID NO: 1056123 - RNA, 13 nt, Homo sapiens
ggaagcuagcucc

SEQ ID NO: 1056124 - RNA, 16 nt, Homo sapiens
ggaagcuccacuguca

SEQ ID NO: 1056125 - RNA, 17 nt, Homo sapiens
ggaagcuccacugucac

SEQ ID NO: 1056126 - RNA, 19 nt, Homo sapiens
ggaagcucugaagucacau

SEQ ID NO: 1056127 - RNA, 21 nt, Homo sapiens
ggaagcuuucugucuccuuaa

SEQ ID NO: 1056128 - RNA, 16 nt, Homo sapiens
ggaaguaacauuugcc

SEQ ID NO: 1056129 - RNA, 17 nt, Homo sapiens
ggaaguaacauuugccu

SEQ ID NO: 1056130 - RNA, 18 nt, Homo sapiens
ggaaguaaccauuugcac

SEQ ID NO: 1056131 - RNA, 19 nt, Homo sapiens
ggaaguaaccauuugcacu

SEQ ID NO: 1056132 - RNA, 16 nt, Homo sapiens
ggaagugggacuggca

SEQ ID NO: 1056133 - RNA, 23 nt, Homo sapiens
ggaauaaaaugacacaacuuguc

SEQ ID NO: 1056134 - RNA, 22 nt, Homo sapiens
ggaauaaauugcuccuugacau

SEQ ID NO: 1056135 - RNA, 11 nt, Homo sapiens
ggaauaaucuc

SEQ ID NO: 1056136 - RNA, 16 nt, Homo sapiens
ggaauaauuauuuauu

SEQ ID NO: 1056137 - RNA, 16 nt, Homo sapiens
ggaauaugagcuuuau

SEQ ID NO: 1056138 - RNA, 17 nt, Homo sapiens
ggaauccagacccggcu

SEQ ID NO: 1056139 - RNA, 19 nt, Homo sapiens
ggaaugcuucuucucaggc

SEQ ID NO: 1056140 - RNA, 21 nt, Homo sapiens
ggaauuacaggcacauaccac

SEQ ID NO: 1056141 - RNA, 23 nt, Homo sapiens
ggaauugcuuuuaaaauacauuu

SEQ ID NO: 1056142 - RNA, 21 nt, Homo sapiens
ggaauugugugauguuuaaca

SEQ ID NO: 1056143 - RNA, 23 nt, Homo sapiens
ggaauuuugaaaaaaaauuucaa

SEQ ID NO: 1056144 - RNA, 14 nt, Homo sapiens
ggacaaacagcuca

SEQ ID NO: 1056145 - RNA, 18 nt, Homo sapiens
ggacaaaccgagugcaau

SEQ ID NO: 1056146 - RNA, 16 nt, Homo sapiens
ggacaaccucauuuua

SEQ ID NO: 1056147 - RNA, 21 nt, Homo sapiens
ggacaacucagucccuaaaaa

SEQ ID NO: 1056148 - RNA, 17 nt, Homo sapiens
ggacaaggcuagaucau

SEQ ID NO: 1056149 - RNA, 19 nt, Homo sapiens
ggacaccccuuauccagga

SEQ ID NO: 1056150 - RNA, 20 nt, Homo sapiens
ggacacguggugcauuuugc

SEQ ID NO: 1056151 - RNA, 14 nt, Homo sapiens
ggacacuccagugc

SEQ ID NO: 1056152 - RNA, 21 nt, Homo sapiens
ggacacugugcccagcccgga

SEQ ID NO: 1056153 - RNA, 12 nt, Homo sapiens
ggacagagccau

SEQ ID NO: 1056154 - RNA, 13 nt, Homo sapiens
ggacagguggugc

SEQ ID NO: 1056155 - RNA, 22 nt, Homo sapiens
ggacaucagcuggucaaacaaa

SEQ ID NO: 1056156 - RNA, 15 nt, Homo sapiens
ggacaugaaacucca

SEQ ID NO: 1056157 - RNA, 13 nt, Homo sapiens
ggaccaauaccuc

SEQ ID NO: 1056158 - RNA, 14 nt, Homo sapiens
ggaccacaguaaca

SEQ ID NO: 1056159 - RNA, 16 nt, Homo sapiens
ggcauuuucacuuuug

SEQ ID NO: 1056160 - RNA, 15 nt, Homo sapiens
ggccaaaccucuguu

SEQ ID NO: 1056161 - RNA, 15 nt, Homo sapiens
ggccaaccuccccaa

SEQ ID NO: 1056162 - RNA, 17 nt, Homo sapiens
ggccaagacuuggcaac

SEQ ID NO: 1056163 - RNA, 22 nt, Homo sapiens
ggccaagcauuucuagcaguga

SEQ ID NO: 1056164 - RNA, 22 nt, Homo sapiens
ggccaaggagggugagugcaag

SEQ ID NO: 1056165 - RNA, 19 nt, Homo sapiens
ggccaauaaauaugauguu

SEQ ID NO: 1056166 - RNA, 20 nt, Homo sapiens
ggccaauaaauaugauguua

SEQ ID NO: 1056167 - RNA, 19 nt, Homo sapiens
ggccaaugggagagcucuu

SEQ ID NO: 1056168 - RNA, 18 nt, Homo sapiens
ggccacaccgagacacca

SEQ ID NO: 1056169 - RNA, 19 nt, Homo sapiens
ggccagagggagugacaga

SEQ ID NO: 1056170 - RNA, 11 nt, Homo sapiens
ggccagcacca

SEQ ID NO: 1056171 - RNA, 13 nt, Homo sapiens
ggccagccaguga

SEQ ID NO: 1056172 - RNA, 22 nt, Homo sapiens
ggccagccccucccaccacagc

SEQ ID NO: 1056173 - RNA, 15 nt, Homo sapiens
ggccaggauggcacu

SEQ ID NO: 1056174 - RNA, 11 nt, Homo sapiens
ggccaguguga

SEQ ID NO: 1056175 - RNA, 23 nt, Homo sapiens
ggccauuccaacagcucaagucu

SEQ ID NO: 1056176 - RNA, 19 nt, Homo sapiens
ggcccacagcaggugcuga

SEQ ID NO: 1056177 - RNA, 24 nt, Homo sapiens
ggcccacguagggcggcacucaca

SEQ ID NO: 1056178 - RNA, 17 nt, Homo sapiens
ggcccacuucaccguac

SEQ ID NO: 1056179 - RNA, 22 nt, Homo sapiens
ggcccagagggccugcaaggga

SEQ ID NO: 1056180 - RNA, 23 nt, Homo sapiens
ggcccguccggcaguucugggug

SEQ ID NO: 1056181 - RNA, 22 nt, Homo sapiens
ggcccgugggagucaucucaac

SEQ ID NO: 1056182 - RNA, 23 nt, Homo sapiens
ggcccucuaccccugaucugaca

SEQ ID NO: 1056183 - RNA, 17 nt, Homo sapiens
ggcccuucacugccuuu

SEQ ID NO: 1056184 - RNA, 20 nt, Homo sapiens
ggccgaaaaggauaugcagu

SEQ ID NO: 1056185 - RNA, 13 nt, Homo sapiens
ggccgagaagcca

SEQ ID NO: 1056186 - RNA, 18 nt, Homo sapiens
ggccggagucagugccag

SEQ ID NO: 1056187 - RNA, 15 nt, Homo sapiens
ggccggccgggugcu

SEQ ID NO: 1056188 - RNA, 13 nt, Homo sapiens
ggccgucuucacu

SEQ ID NO: 1056189 - RNA, 23 nt, Homo sapiens
ggccuaacccucagaaacacugg

SEQ ID NO: 1056190 - RNA, 23 nt, Homo sapiens
ggccuacaugguugaaaccccau

SEQ ID NO: 1056191 - RNA, 16 nt, Homo sapiens
ggccuagggcccagga

SEQ ID NO: 1056192 - RNA, 14 nt, Homo sapiens
ggccucagucucua

SEQ ID NO: 1056193 - RNA, 15 nt, Homo sapiens
ggccugcacuggugu

SEQ ID NO: 1056194 - RNA, 16 nt, Homo sapiens
ggccugcccucaggga

SEQ ID NO: 1056195 - RNA, 23 nt, Homo sapiens
ggccuggaccugcccugggccac

SEQ ID NO: 1056196 - RNA, 23 nt, Homo sapiens
ggccuggaguaacacaaagugaa

SEQ ID NO: 1056197 - RNA, 17 nt, Homo sapiens
ggccuggcaagugggug

SEQ ID NO: 1056198 - RNA, 14 nt, Homo sapiens
ggccugugugugaa

SEQ ID NO: 1056199 - RNA, 22 nt, Homo sapiens
ggccuuaauuuucaguauaauu

SEQ ID NO: 1056200 - RNA, 16 nt, Homo sapiens
ggccuugcuaccucaa

SEQ ID NO: 1056201 - RNA, 22 nt, Homo sapiens
ggcgaacccugggccauccuca

SEQ ID NO: 1056202 - RNA, 23 nt, Homo sapiens
ggcgaacccugggccauccucac

SEQ ID NO: 1056203 - RNA, 20 nt, Homo sapiens
ggcgacagagggagacucca

SEQ ID NO: 1056204 - RNA, 13 nt, Homo sapiens
ggcgacaguuuuc

SEQ ID NO: 1056205 - RNA, 20 nt, Homo sapiens
ggcgaccccgucacagccuc

SEQ ID NO: 1056206 - RNA, 20 nt, Homo sapiens
ggcgaugugcaaguguaugc

SEQ ID NO: 1056207 - RNA, 17 nt, Homo sapiens
ggcgccaucgccaagua

SEQ ID NO: 1056208 - RNA, 16 nt, Homo sapiens
ggcgcccugcaccuga

SEQ ID NO: 1056209 - RNA, 15 nt, Homo sapiens
ggcgucugucuucaa

SEQ ID NO: 1056210 - RNA, 12 nt, Homo sapiens
ggcgugaucuug

SEQ ID NO: 1056211 - RNA, 15 nt, Homo sapiens
ggcuaaaaccaucau

SEQ ID NO: 1056212 - RNA, 20 nt, Homo sapiens
ggcuaaauugaaaccuggaa

SEQ ID NO: 1056213 - RNA, 21 nt, Homo sapiens
ggcuaacuauauuugcuuuuu

SEQ ID NO: 1056214 - RNA, 16 nt, Homo sapiens
ggcuaagaguguccua

SEQ ID NO: 1056215 - RNA, 21 nt, Homo sapiens
ggcuaauucccagagugugaa

SEQ ID NO: 1056216 - RNA, 22 nt, Homo sapiens
ggcuacaaggacccagccugag

SEQ ID NO: 1056217 - RNA, 14 nt, Homo sapiens
ggcuacacagggau

SEQ ID NO: 1056218 - RNA, 17 nt, Homo sapiens
ggcuagaaccuggagaa

SEQ ID NO: 1056219 - RNA, 13 nt, Homo sapiens
ggcuagaucauga

SEQ ID NO: 1056220 - RNA, 16 nt, Homo sapiens
ggcuaucguuagugcu

SEQ ID NO: 1056221 - RNA, 15 nt, Homo sapiens
ggcucaacauugugu

SEQ ID NO: 1056222 - RNA, 21 nt, Homo sapiens
ggcucaaggaaaggggguccc

SEQ ID NO: 1056223 - RNA, 15 nt, Homo sapiens
ggcucacaccuguaa

SEQ ID NO: 1056224 - RNA, 11 nt, Homo sapiens
ggcucagagau

SEQ ID NO: 1056225 - RNA, 13 nt, Homo sapiens
ggcucaugaccug

SEQ ID NO: 1056226 - RNA, 13 nt, Homo sapiens
ggcucccaugacc

SEQ ID NO: 1056227 - RNA, 21 nt, Homo sapiens
ggcucccucuuggucuuccca

SEQ ID NO: 1056228 - RNA, 21 nt, Homo sapiens
ggcuccugugcuuucccugaa

SEQ ID NO: 1056229 - RNA, 21 nt, Homo sapiens
ggcucuaacaaugacauuuau

SEQ ID NO: 1056230 - RNA, 17 nt, Homo sapiens
ggcucucauggggucca

SEQ ID NO: 1056231 - RNA, 19 nt, Homo sapiens
guucugaauaugcugcuca

SEQ ID NO: 1056232 - RNA, 22 nt, Homo sapiens
guucugagauuauuuuaaucua

SEQ ID NO: 1056233 - RNA, 13 nt, Homo sapiens
guucugcacagcu

SEQ ID NO: 1056234 - RNA, 14 nt, Homo sapiens
guucuggaugcauu

SEQ ID NO: 1056235 - RNA, 16 nt, Homo sapiens
guucuuaauugcacuc

SEQ ID NO: 1056236 - RNA, 19 nt, Homo sapiens
guucuuaugccauguuaau

SEQ ID NO: 1056237 - RNA, 23 nt, Homo sapiens
guucuucccuuuuacauacugcu

SEQ ID NO: 1056238 - RNA, 18 nt, Homo sapiens
guucuucuuggucucagu

SEQ ID NO: 1056239 - RNA, 16 nt, Homo sapiens
guucuuggaucugcca

SEQ ID NO: 1056240 - RNA, 18 nt, Homo sapiens
guucuuugucacagggac

SEQ ID NO: 1056241 - RNA, 19 nt, Homo sapiens
guugaaaaaguucugcaga

SEQ ID NO: 1056242 - RNA, 14 nt, Homo sapiens
guugaaagcuguau

SEQ ID NO: 1056243 - RNA, 18 nt, Homo sapiens
guugagccccaaguccug

SEQ ID NO: 1056244 - RNA, 22 nt, Homo sapiens
guugagcuucauauaccagcaa

SEQ ID NO: 1056245 - RNA, 20 nt, Homo sapiens
guugauaaauuccacuggac

SEQ ID NO: 1056246 - RNA, 19 nt, Homo sapiens
guugaugguagguggcaca

SEQ ID NO: 1056247 - RNA, 21 nt, Homo sapiens
guugauguaaccgauucaucu

SEQ ID NO: 1056248 - RNA, 19 nt, Homo sapiens
guugauucagcucugcaag

SEQ ID NO: 1056249 - RNA, 14 nt, Homo sapiens
guugcacugauauu

SEQ ID NO: 1056250 - RNA, 15 nt, Homo sapiens
guugcaugauguauu

SEQ ID NO: 1056251 - RNA, 19 nt, Homo sapiens
guugcugugugguuuggug

SEQ ID NO: 1056252 - RNA, 16 nt, Homo sapiens
guugcuuuuacuucuc

SEQ ID NO: 1056253 - RNA, 18 nt, Homo sapiens
guugcuuuugugaacuuu

SEQ ID NO: 1056254 - RNA, 14 nt, Homo sapiens
guuggaaauauuca

SEQ ID NO: 1056255 - RNA, 20 nt, Homo sapiens
guuggaagugagggucagag

SEQ ID NO: 1056256 - RNA, 22 nt, Homo sapiens
guuggcgggggcuuggcugugc

SEQ ID NO: 1056257 - RNA, 18 nt, Homo sapiens
guuggcugggaacucacc

SEQ ID NO: 1056258 - RNA, 13 nt, Homo sapiens
guuggcuuucccu

SEQ ID NO: 1056259 - RNA, 15 nt, Homo sapiens
guugggagcacugga

SEQ ID NO: 1056260 - RNA, 16 nt, Homo sapiens
guuggucccccuucca

SEQ ID NO: 1056261 - RNA, 13 nt, Homo sapiens
guugguguucuca

SEQ ID NO: 1056262 - RNA, 12 nt, Homo sapiens
guugguuuugac

SEQ ID NO: 1056263 - RNA, 14 nt, Homo sapiens
guugucauugcugu

SEQ ID NO: 1056264 - RNA, 18 nt, Homo sapiens
guugugaaugucauucac

SEQ ID NO: 1056265 - RNA, 19 nt, Homo sapiens
guuguuaauaaaaguacau

SEQ ID NO: 1056266 - RNA, 22 nt, Homo sapiens
guuguuugauucagacagcugc

SEQ ID NO: 1056267 - RNA, 22 nt, Homo sapiens
guuuacaagcccccccuuccac

SEQ ID NO: 1056268 - RNA, 15 nt, Homo sapiens
guuuacagcacuacu

SEQ ID NO: 1056269 - RNA, 19 nt, Homo sapiens
guuuacuuaucuuaugcca

SEQ ID NO: 1056270 - RNA, 18 nt, Homo sapiens
guuuagcccaaaaccaag

SEQ ID NO: 1056271 - RNA, 15 nt, Homo sapiens
guuuauagaccagaa

SEQ ID NO: 1056272 - RNA, 13 nt, Homo sapiens
guuuaugucauca

SEQ ID NO: 1056273 - RNA, 20 nt, Homo sapiens
guuucaaguacuguaacugu

SEQ ID NO: 1056274 - RNA, 18 nt, Homo sapiens
guuucacacuagucacau

SEQ ID NO: 1056275 - RNA, 21 nt, Homo sapiens
guuucagggcuaacgaccaca

SEQ ID NO: 1056276 - RNA, 22 nt, Homo sapiens
guuucauauugaugugugucua

SEQ ID NO: 1056277 - RNA, 20 nt, Homo sapiens
guuucccccuucuacauuuc

SEQ ID NO: 1056278 - RNA, 14 nt, Homo sapiens
guuucccuaucucg

SEQ ID NO: 1056279 - RNA, 15 nt, Homo sapiens
guuucccuaucucga

SEQ ID NO: 1056280 - RNA, 16 nt, Homo sapiens
guuuccucauuccuga

SEQ ID NO: 1056281 - RNA, 17 nt, Homo sapiens
guuuccuggcacugcuu

SEQ ID NO: 1056282 - RNA, 20 nt, Homo sapiens
guuucgaaguugaugcaauc

SEQ ID NO: 1056283 - RNA, 21 nt, Homo sapiens
guuucuccagagggaauugca

SEQ ID NO: 1056284 - RNA, 16 nt, Homo sapiens
guuucuggcagccagu

SEQ ID NO: 1056285 - RNA, 11 nt, Homo sapiens
guuucuuccaa

SEQ ID NO: 1056286 - RNA, 23 nt, Homo sapiens
guuucuuucuaguggucuuugua

SEQ ID NO: 1056287 - RNA, 13 nt, Homo sapiens
guuugagaccagc

SEQ ID NO: 1056288 - RNA, 14 nt, Homo sapiens
guuugaguuacuau

SEQ ID NO: 1056289 - RNA, 15 nt, Homo sapiens
guuugcuguuugcaa

SEQ ID NO: 1056290 - RNA, 16 nt, Homo sapiens
guuugcuuagcauucc

SEQ ID NO: 1056291 - RNA, 15 nt, Homo sapiens
guuuggccaucucug

SEQ ID NO: 1056292 - RNA, 14 nt, Homo sapiens
guuuguggccucag

SEQ ID NO: 1056293 - RNA, 22 nt, Homo sapiens
guuuguugaugugaaacauuau

SEQ ID NO: 1056294 - RNA, 13 nt, Homo sapiens
guuuuaacucuau

SEQ ID NO: 1056295 - RNA, 18 nt, Homo sapiens
guuuuaaguuguuugcau

SEQ ID NO: 1056296 - RNA, 23 nt, Homo sapiens
guuuuaccaucugcauccagccu

SEQ ID NO: 1056297 - RNA, 19 nt, Homo sapiens
guuuuacugugaaacuggc

SEQ ID NO: 1056298 - RNA, 18 nt, Homo sapiens
guuuucagcccaucuccu

SEQ ID NO: 1056299 - RNA, 16 nt, Homo sapiens
guuuucuucugugauu

SEQ ID NO: 1056300 - RNA, 15 nt, Homo sapiens
guuuuguaccaacac

SEQ ID NO: 1056301 - RNA, 18 nt, Homo sapiens
guuuuguaccaacacaca

SEQ ID NO: 1056302 - RNA, 15 nt, Homo sapiens
guuuuguauucucug

SEQ ID NO: 1056303 - RNA, 19 nt, Homo sapiens
guuuuguggaggagcucag

SEQ ID NO: 1056304 - RNA, 17 nt, Homo sapiens
guuuuguuugcuaucuu

SEQ ID NO: 1056305 - RNA, 18 nt, Homo sapiens
guuuuuaaaaguuucaau

SEQ ID NO: 1056306 - RNA, 15 nt, Homo sapiens
guuuuuaagccuuaa

SEQ ID NO: 1056307 - RNA, 23 nt, Homo sapiens
guuuuuauggcuuuugugcauua

SEQ ID NO: 1056308 - RNA, 22 nt, Homo sapiens
guuuuucuucaacaucaauguu

SEQ ID NO: 1056309 - RNA, 23 nt, Homo sapiens
guuuuuggaauuaugucugcuga

SEQ ID NO: 1056310 - RNA, 15 nt, Homo sapiens
guuuuuggagggguu

SEQ ID NO: 1056311 - RNA, 17 nt, Homo sapiens
guuuuuguuuuuuucca

SEQ ID NO: 1056312 - RNA, 13 nt, Homo sapiens
guuuuuucacuau

SEQ ID NO: 1056313 - RNA, 20 nt, Homo sapiens
guuuuuucaucauaacauaa

SEQ ID NO: 1056314 - RNA, 12 nt, Homo sapiens
guuuuuuuccaa

SEQ ID NO: 1056315 - RNA, 20 nt, Homo sapiens
uaaaaaaaaaaaccaaaacu

SEQ ID NO: 1056316 - RNA, 12 nt, Homo sapiens
uaaaaaacaguc

SEQ ID NO: 1056317 - RNA, 23 nt, Homo sapiens
uaaaaagugccuguagaugacau

SEQ ID NO: 1056318 - RNA, 12 nt, Homo sapiens
uaaaaaguucca

SEQ ID NO: 1056319 - RNA, 20 nt, Homo sapiens
uaaaaauagaagaauacaaa

SEQ ID NO: 1056320 - RNA, 12 nt, Homo sapiens
uaaaaaugcaaa

SEQ ID NO: 1056321 - RNA, 18 nt, Homo sapiens
uaaaaauggauacuggug

SEQ ID NO: 1056322 - RNA, 20 nt, Homo sapiens
uaaagaaaaucucugugaaa

SEQ ID NO: 1056323 - RNA, 20 nt, Homo sapiens
uaaagaaauauauaugauau

SEQ ID NO: 1056324 - RNA, 21 nt, Homo sapiens
uaaagacagggaagagcagaa

SEQ ID NO: 1056325 - RNA, 14 nt, Homo sapiens
uaaagaccugagaa

SEQ ID NO: 1056326 - RNA, 12 nt, Homo sapiens
uaaagacuguag

SEQ ID NO: 1056327 - RNA, 19 nt, Homo sapiens
uaaagagagaauguagaua

SEQ ID NO: 1056328 - RNA, 20 nt, Homo sapiens
uaaagagagaauguagauau

SEQ ID NO: 1056329 - RNA, 16 nt, Homo sapiens
uaaagaugaucuacuc

SEQ ID NO: 1056330 - RNA, 17 nt, Homo sapiens
uaaagaugaucuacuca

SEQ ID NO: 1056331 - RNA, 18 nt, Homo sapiens
uaaagaugaucuacucag

SEQ ID NO: 1056332 - RNA, 18 nt, Homo sapiens
uaaagcaauaugcauuua

SEQ ID NO: 1056333 - RNA, 14 nt, Homo sapiens
uaaagcacaugccu

SEQ ID NO: 1056334 - RNA, 18 nt, Homo sapiens
uaaagcauuccccaaaga

SEQ ID NO: 1056335 - RNA, 12 nt, Homo sapiens
uaaagccuucaa

SEQ ID NO: 1056336 - RNA, 22 nt, Homo sapiens
uaaagccuuggauguauauguc

SEQ ID NO: 1056337 - RNA, 18 nt, Homo sapiens
uaaagcucaucagcuauc

SEQ ID NO: 1056338 - RNA, 19 nt, Homo sapiens
uaaagcuuugucuuuuugu

SEQ ID NO: 1056339 - RNA, 15 nt, Homo sapiens
uaaagcuuugugcag

SEQ ID NO: 1056340 - RNA, 21 nt, Homo sapiens
uaaaggauucuguaugccaag

SEQ ID NO: 1056341 - RNA, 17 nt, Homo sapiens
uaaagguccuggcaaag

SEQ ID NO: 1056342 - RNA, 14 nt, Homo sapiens
uaaaguacagacuu

SEQ ID NO: 1056343 - RNA, 15 nt, Homo sapiens
uaaaguaugugcaua

SEQ ID NO: 1056344 - RNA, 19 nt, Homo sapiens
uaaaguauguuauugcaua

SEQ ID NO: 1056345 - RNA, 20 nt, Homo sapiens
uaaaguauguuauugcauaa

SEQ ID NO: 1056346 - RNA, 21 nt, Homo sapiens
uaaaguauuauuuauuugaau

SEQ ID NO: 1056347 - RNA, 16 nt, Homo sapiens
uaaagucacagaauua

SEQ ID NO: 1056348 - RNA, 20 nt, Homo sapiens
uaaagugaauaaccacuuaa

SEQ ID NO: 1056349 - RNA, 14 nt, Homo sapiens
uaaagugacagaug

SEQ ID NO: 1056350 - RNA, 23 nt, Homo sapiens
uaaagugucaccccucacuguga

SEQ ID NO: 1056351 - RNA, 21 nt, Homo sapiens
uaaauaaauguaucuuauuca

SEQ ID NO: 1056352 - RNA, 21 nt, Homo sapiens
uaaauaaccggggauucugua

SEQ ID NO: 1056353 - RNA, 15 nt, Homo sapiens
uaaauacagucuucc

SEQ ID NO: 1056354 - RNA, 17 nt, Homo sapiens
uaaauaccagacacgua

SEQ ID NO: 1056355 - RNA, 23 nt, Homo sapiens
uaaauaccugcccugacaugcac

SEQ ID NO: 1056356 - RNA, 23 nt, Homo sapiens
uaaauacugcaauuaaagugaua

SEQ ID NO: 1056357 - RNA, 12 nt, Homo sapiens
uaaauacuguuu

SEQ ID NO: 1056358 - RNA, 15 nt, Homo sapiens
uaaauagcauucucu

SEQ ID NO: 1056359 - RNA, 16 nt, Homo sapiens
uaaauauagagaugug

SEQ ID NO: 1056360 - RNA, 17 nt, Homo sapiens
uaaauaugcagugauau

SEQ ID NO: 1056361 - RNA, 23 nt, Homo sapiens
uaaauauuacacaucaagcgaug

SEQ ID NO: 1056362 - RNA, 21 nt, Homo sapiens
uaaauauuagaagccugcaga

SEQ ID NO: 1056363 - RNA, 13 nt, Homo sapiens
uaaaucaagagcu

SEQ ID NO: 1056364 - RNA, 17 nt, Homo sapiens
uaaauccauccauccaa

SEQ ID NO: 1056365 - RNA, 16 nt, Homo sapiens
uaaauccaugcaccua

SEQ ID NO: 1056366 - RNA, 13 nt, Homo sapiens
uaaaucuaugaag

SEQ ID NO: 1056367 - RNA, 16 nt, Homo sapiens
uaaaugcaauauguau

SEQ ID NO: 1056368 - RNA, 12 nt, Homo sapiens
uaaaugcauuag

SEQ ID NO: 1056369 - RNA, 23 nt, Homo sapiens
uaaaugcuauuuuuuauuuuacu

SEQ ID NO: 1056370 - RNA, 22 nt, Homo sapiens
uaaaugcucaucugguaacuca

SEQ ID NO: 1056371 - RNA, 17 nt, Homo sapiens
uaaaugggggugcauuu

SEQ ID NO: 1056372 - RNA, 16 nt, Homo sapiens
uaaauggguagagaaa

SEQ ID NO: 1056373 - RNA, 16 nt, Homo sapiens
uaaauguaucauagaa

SEQ ID NO: 1056374 - RNA, 23 nt, Homo sapiens
uaaaugucuucuguauucacuua

SEQ ID NO: 1056375 - RNA, 14 nt, Homo sapiens
uaaaugugcuuaug

SEQ ID NO: 1056376 - RNA, 16 nt, Homo sapiens
uaaauuaaaagcccua

SEQ ID NO: 1056377 - RNA, 20 nt, Homo sapiens
uaaauuacuuuuucauucuu

SEQ ID NO: 1056378 - RNA, 14 nt, Homo sapiens
uaaauuaguauuua

SEQ ID NO: 1056379 - RNA, 17 nt, Homo sapiens
uaaauuauuaguuuaca

SEQ ID NO: 1056380 - RNA, 22 nt, Homo sapiens
uaaauuauuuauuuauggagga

SEQ ID NO: 1056381 - RNA, 22 nt, Homo sapiens
uaaauuauuuuaaaaacuaaaa

SEQ ID NO: 1056382 - RNA, 22 nt, Homo sapiens
uaaauuccacacuaccacauua

SEQ ID NO: 1056383 - RNA, 20 nt, Homo sapiens
uaaauucccuggccuuucau

SEQ ID NO: 1056384 - RNA, 20 nt, Homo sapiens
uaaauucuauaggaacauau

SEQ ID NO: 1056385 - RNA, 15 nt, Homo sapiens
uaaauugauguugcu

SEQ ID NO: 1056386 - RNA, 13 nt, Homo sapiens
uaaauugcagaug

SEQ ID NO: 1056387 - RNA, 20 nt, Homo sapiens
uaaauuuguaaguuucaggu

SEQ ID NO: 1056388 - RNA, 20 nt, Homo sapiens
uaaauuuguguucucaaaua

SEQ ID NO: 1056389 - RNA, 15 nt, Homo sapiens
uaacaaaacacucgg

SEQ ID NO: 1056390 - RNA, 19 nt, Homo sapiens
uaacaacaauaacacuguc

SEQ ID NO: 1056391 - RNA, 23 nt, Homo sapiens
uaacacauuaucgggagcagugu

SEQ ID NO: 1056392 - RNA, 23 nt, Homo sapiens
uaacaccagacagacaacacugg

SEQ ID NO: 1056393 - RNA, 14 nt, Homo sapiens
uaacaccaugauua

SEQ ID NO: 1056394 - RNA, 19 nt, Homo sapiens
uaacaccaugauuaaccac

SEQ ID NO: 1056395 - RNA, 15 nt, Homo sapiens
uaacagaccacugua

SEQ ID NO: 1056396 - RNA, 15 nt, Homo sapiens
uaacagaugcaaugu

SEQ ID NO: 1056397 - RNA, 13 nt, Homo sapiens
uaacagauguuga

SEQ ID NO: 1056398 - RNA, 14 nt, Homo sapiens
uaacagauguugaa

SEQ ID NO: 1056399 - RNA, 18 nt, Homo sapiens
uaacagcugucuauguau

SEQ ID NO: 1056400 - RNA, 19 nt, Homo sapiens
uaacauggacugcuucauc

SEQ ID NO: 1056401 - RNA, 15 nt, Homo sapiens
uaacauggugugcuu

SEQ ID NO: 1056402 - RNA, 22 nt, Homo sapiens
uaacauuaccuuacuguggagg

SEQ ID NO: 1056403 - RNA, 12 nt, Homo sapiens
uaacauuugccu

SEQ ID NO: 1056404 - RNA, 13 nt, Homo sapiens
uaacauuugccuu

SEQ ID NO: 1056405 - RNA, 15 nt, Homo sapiens
uaaccacaucaauau

SEQ ID NO: 1056406 - RNA, 19 nt, Homo sapiens
uaaccaguguuguggauuu

SEQ ID NO: 1056407 - RNA, 14 nt, Homo sapiens
uaaccauuugcacu

SEQ ID NO: 1056408 - RNA, 15 nt, Homo sapiens
uaaccccuggcaacc

SEQ ID NO: 1056409 - RNA, 18 nt, Homo sapiens
uaacccuaggcaucacau

SEQ ID NO: 1056410 - RNA, 17 nt, Homo sapiens
uaacccuuaucaccagc

SEQ ID NO: 1056411 - RNA, 14 nt, Homo sapiens
uaaccucaguguca

SEQ ID NO: 1056412 - RNA, 12 nt, Homo sapiens
uaaccuggugcu

SEQ ID NO: 1056413 - RNA, 21 nt, Homo sapiens
uaaccuucuggcuuccuucuc

SEQ ID NO: 1056414 - RNA, 18 nt, Homo sapiens
uaacgucuguaagcugaa

SEQ ID NO: 1056415 - RNA, 21 nt, Homo sapiens
uaacuaaaagguaugcaauca

SEQ ID NO: 1056416 - RNA, 20 nt, Homo sapiens
uaacuaccuaaacauguuau

SEQ ID NO: 1056417 - RNA, 20 nt, Homo sapiens
uaaguacuauguaucaauga

SEQ ID NO: 1056418 - RNA, 23 nt, Homo sapiens
uaaguacuauguaucaaugagua

SEQ ID NO: 1056419 - RNA, 20 nt, Homo sapiens
uaaguaguugguuuccuuca

SEQ ID NO: 1056420 - RNA, 22 nt, Homo sapiens
uaaguaguugguuuccuucaca

SEQ ID NO: 1056421 - RNA, 14 nt, Homo sapiens
uaagugacuugccc

SEQ ID NO: 1056422 - RNA, 14 nt, Homo sapiens
uaagugcaugacau

SEQ ID NO: 1056423 - RNA, 19 nt, Homo sapiens
uaaguuacacauuuuucag

SEQ ID NO: 1056424 - RNA, 17 nt, Homo sapiens
uaaguuccacugagcuc

SEQ ID NO: 1056425 - RNA, 14 nt, Homo sapiens
uaaguuuaucuuuc

SEQ ID NO: 1056426 - RNA, 15 nt, Homo sapiens
uaaguuucucagcuc

SEQ ID NO: 1056427 - RNA, 18 nt, Homo sapiens
uaaguuucucagcuccca

SEQ ID NO: 1056428 - RNA, 21 nt, Homo sapiens
uaaguuugaaggaaacaguua

SEQ ID NO: 1056429 - RNA, 21 nt, Homo sapiens
uaaguuuugaaauaagaaagu

SEQ ID NO: 1056430 - RNA, 14 nt, Homo sapiens
uaauaacagugcau

SEQ ID NO: 1056431 - RNA, 13 nt, Homo sapiens
uaauaacuuuucu

SEQ ID NO: 1056432 - RNA, 15 nt, Homo sapiens
uaauaagcuaaagag

SEQ ID NO: 1056433 - RNA, 16 nt, Homo sapiens
uaauaaguuucacuga

SEQ ID NO: 1056434 - RNA, 22 nt, Homo sapiens
uaauacuauauuuauacuguau

SEQ ID NO: 1056435 - RNA, 18 nt, Homo sapiens
uaauacuccuaagacuua

SEQ ID NO: 1056436 - RNA, 11 nt, Homo sapiens
uaauacuguau

SEQ ID NO: 1056437 - RNA, 14 nt, Homo sapiens
uaauagacuuccca

SEQ ID NO: 1056438 - RNA, 13 nt, Homo sapiens
uaauauggcaaaa

SEQ ID NO: 1056439 - RNA, 16 nt, Homo sapiens
uaauaugguaaugcac

SEQ ID NO: 1056440 - RNA, 18 nt, Homo sapiens
uaauaugguguacauucu

SEQ ID NO: 1056441 - RNA, 15 nt, Homo sapiens
uaauauugugcaaac

SEQ ID NO: 1056442 - RNA, 13 nt, Homo sapiens
uaaucaacugggc

SEQ ID NO: 1056443 - RNA, 22 nt, Homo sapiens
uaaucaaugaaguagcugagaa

SEQ ID NO: 1056444 - RNA, 17 nt, Homo sapiens
uaaucacucagugauug

SEQ ID NO: 1056445 - RNA, 21 nt, Homo sapiens
uaaucagacaaaguaauuccu

SEQ ID NO: 1056446 - RNA, 22 nt, Homo sapiens
uaaucagguccucagagaauuu

SEQ ID NO: 1056447 - RNA, 18 nt, Homo sapiens
uaauccagaaaaacugug

SEQ ID NO: 1056448 - RNA, 17 nt, Homo sapiens
uaauccaucacuagcca

SEQ ID NO: 1056449 - RNA, 13 nt, Homo sapiens
uaaucccagcacu

SEQ ID NO: 1056450 - RNA, 15 nt, Homo sapiens
uaaucucacuacaca

SEQ ID NO: 1056451 - RNA, 21 nt, Homo sapiens
uaaucugagaggccacagugc

SEQ ID NO: 1056452 - RNA, 16 nt, Homo sapiens
uaaucuguacaaugaa

SEQ ID NO: 1056453 - RNA, 13 nt, Homo sapiens
uaaucuguagggc

SEQ ID NO: 1056454 - RNA, 19 nt, Homo sapiens
uaaucuuccauacuucuuc

SEQ ID NO: 1056455 - RNA, 19 nt, Homo sapiens
uaaucuucuuaugcaauuu

SEQ ID NO: 1056456 - RNA, 19 nt, Homo sapiens
uaaugaaguuaagaaccug

SEQ ID NO: 1056457 - RNA, 18 nt, Homo sapiens
uaaugaauuuuuaugaua

SEQ ID NO: 1056458 - RNA, 19 nt, Homo sapiens
uaaugccauuaucccugaa

SEQ ID NO: 1056459 - RNA, 16 nt, Homo sapiens
uaaugguugacugggu

SEQ ID NO: 1056460 - RNA, 19 nt, Homo sapiens
uaauguauuuguuugcaau

SEQ ID NO: 1056461 - RNA, 17 nt, Homo sapiens
uaaugucucuacaauuu

SEQ ID NO: 1056462 - RNA, 22 nt, Homo sapiens
uaauguguacauuagucauuca

SEQ ID NO: 1056463 - RNA, 15 nt, Homo sapiens
uaauguuaauucagc

SEQ ID NO: 1056464 - RNA, 22 nt, Homo sapiens
uaauguuacugaucaugcauug

SEQ ID NO: 1056465 - RNA, 14 nt, Homo sapiens
uaauuaauauucau

SEQ ID NO: 1056466 - RNA, 18 nt, Homo sapiens
uaauuaccaaccuguuac

SEQ ID NO: 1056467 - RNA, 20 nt, Homo sapiens
uaauuaggcaaagacaggag

SEQ ID NO: 1056468 - RNA, 20 nt, Homo sapiens
uaauuaucgggaacaguguu

SEQ ID NO: 1056469 - RNA, 16 nt, Homo sapiens
uaauuauuuugacaaa

SEQ ID NO: 1056470 - RNA, 16 nt, Homo sapiens
uaauucaaaagaucaa

SEQ ID NO: 1056471 - RNA, 16 nt, Homo sapiens
uaauucauggcauuga

SEQ ID NO: 1056472 - RNA, 16 nt, Homo sapiens
uaauucuagcuuugag

SEQ ID NO: 1056473 - RNA, 16 nt, Homo sapiens
uaauucucaugugauc

SEQ ID NO: 1056474 - RNA, 17 nt, Homo sapiens
uaauucuguacauagcc

SEQ ID NO: 1056475 - RNA, 14 nt, Homo sapiens
uaauugauuucaag

SEQ ID NO: 1056476 - RNA, 20 nt, Homo sapiens
uaauugcacguguguauugc

SEQ ID NO: 1056477 - RNA, 16 nt, Homo sapiens
uaauugcuuacauuuu

SEQ ID NO: 1056478 - RNA, 14 nt, Homo sapiens
uaauugugaauuag

SEQ ID NO: 1056479 - RNA, 13 nt, Homo sapiens
uaauuguguguca

SEQ ID NO: 1056480 - RNA, 19 nt, Homo sapiens
uaauugugugucacaagaa

SEQ ID NO: 1056481 - RNA, 15 nt, Homo sapiens
uaauuuaaucuucca

SEQ ID NO: 1056482 - RNA, 17 nt, Homo sapiens
uaauuucaggaauugaa

SEQ ID NO: 1056483 - RNA, 20 nt, Homo sapiens
uaauuuuaaccaguucuguc

SEQ ID NO: 1056484 - RNA, 13 nt, Homo sapiens
uaauuuuugcaaa

SEQ ID NO: 1056485 - RNA, 16 nt, Homo sapiens
uacaaaaacacagcaa

SEQ ID NO: 1056486 - RNA, 15 nt, Homo sapiens
uacaaaagcauguga

SEQ ID NO: 1056487 - RNA, 23 nt, Homo sapiens
uacaaacaauggaaacugaaugc

SEQ ID NO: 1056488 - RNA, 12 nt, Homo sapiens
uacaaacauguu

SEQ ID NO: 1056489 - RNA, 16 nt, Homo sapiens
uacaacaccuuuuuca

SEQ ID NO: 1056490 - RNA, 21 nt, Homo sapiens
uacaacugaguccuuaaacag

SEQ ID NO: 1056491 - RNA, 22 nt, Homo sapiens
uacaagaaaaaaugaauuuugu

SEQ ID NO: 1056492 - RNA, 14 nt, Homo sapiens
uacaagcaaugccu

SEQ ID NO: 1056493 - RNA, 19 nt, Homo sapiens
uacaaucagccacauucua

SEQ ID NO: 1056494 - RNA, 19 nt, Homo sapiens
uacaaugcauucugaggua

SEQ ID NO: 1056495 - RNA, 17 nt, Homo sapiens
uacaauugaaaugacua

SEQ ID NO: 1056496 - RNA, 13 nt, Homo sapiens
uacaauugugagc

SEQ ID NO: 1056497 - RNA, 20 nt, Homo sapiens
uacacacacacacacagcca

SEQ ID NO: 1056498 - RNA, 22 nt, Homo sapiens
uacacacacacacacagccaca

SEQ ID NO: 1056499 - RNA, 15 nt, Homo sapiens
uacacagaucacagc

SEQ ID NO: 1056500 - RNA, 20 nt, Homo sapiens
uacacaggaggcugaggcag

SEQ ID NO: 1056501 - RNA, 18 nt, Homo sapiens
uacacauacaggauuuga

SEQ ID NO: 1056502 - RNA, 23 nt, Homo sapiens
uacacauacauguaaaauauguc

SEQ ID NO: 1056503 - RNA, 20 nt, Homo sapiens
uacacauuuuucagauauaa

SEQ ID NO: 1056504 - RNA, 19 nt, Homo sapiens
uacacgagguaugaggucu

SEQ ID NO: 1056505 - RNA, 21 nt, Homo sapiens
uacacggaggucucuguaaaa

SEQ ID NO: 1056506 - RNA, 20 nt, Homo sapiens
uacacuccagccugagcaac

SEQ ID NO: 1056507 - RNA, 23 nt, Homo sapiens
uacacucuuauagaaaguucaaa

SEQ ID NO: 1056508 - RNA, 20 nt, Homo sapiens
uacagaaucaaaugcaauuu

SEQ ID NO: 1056509 - RNA, 14 nt, Homo sapiens
uacagaggacagua

SEQ ID NO: 1056510 - RNA, 14 nt, Homo sapiens
uacagaggucucug

SEQ ID NO: 1056511 - RNA, 13 nt, Homo sapiens
uacagauagucaa

SEQ ID NO: 1056512 - RNA, 15 nt, Homo sapiens
uacagaugaaugaua

SEQ ID NO: 1056513 - RNA, 21 nt, Homo sapiens
uacagcuggguggcacugcca

SEQ ID NO: 1056514 - RNA, 21 nt, Homo sapiens
uacaggaagcaccccaugcca

SEQ ID NO: 1056515 - RNA, 20 nt, Homo sapiens
uacaggggcccgccaccaca

SEQ ID NO: 1056516 - RNA, 16 nt, Homo sapiens
uacaggugaagcacca

SEQ ID NO: 1056517 - RNA, 21 nt, Homo sapiens
uagagacaggguuuugccaug

SEQ ID NO: 1056518 - RNA, 16 nt, Homo sapiens
uagagagcuguuccca

SEQ ID NO: 1056519 - RNA, 20 nt, Homo sapiens
uagagaucuauguacuguaa

SEQ ID NO: 1056520 - RNA, 22 nt, Homo sapiens
uagagauggggucucacagugu

SEQ ID NO: 1056521 - RNA, 22 nt, Homo sapiens
uagagaugggguuucacugugu

SEQ ID NO: 1056522 - RNA, 18 nt, Homo sapiens
uagagauuugguguacaa

SEQ ID NO: 1056523 - RNA, 20 nt, Homo sapiens
uagagcaggcguucagcuca

SEQ ID NO: 1056524 - RNA, 21 nt, Homo sapiens
uagaggacuucuggcagggaa

SEQ ID NO: 1056525 - RNA, 21 nt, Homo sapiens
uagagguagguaggaucaucc

SEQ ID NO: 1056526 - RNA, 16 nt, Homo sapiens
uagaguaucacuccca

SEQ ID NO: 1056527 - RNA, 14 nt, Homo sapiens
uagagucaucucca

SEQ ID NO: 1056528 - RNA, 23 nt, Homo sapiens
uagauaaaagaaccgagcaauuu

SEQ ID NO: 1056529 - RNA, 21 nt, Homo sapiens
uagauaaauaaauauaugauu

SEQ ID NO: 1056530 - RNA, 17 nt, Homo sapiens
uagauauaacacuaugu

SEQ ID NO: 1056531 - RNA, 22 nt, Homo sapiens
uagauauaacacuauguuuauu

SEQ ID NO: 1056532 - RNA, 13 nt, Homo sapiens
uagaucuuucuag

SEQ ID NO: 1056533 - RNA, 14 nt, Homo sapiens
uagauuaaacaaac

SEQ ID NO: 1056534 - RNA, 22 nt, Homo sapiens
uagauugagaaguuuuguacag

SEQ ID NO: 1056535 - RNA, 17 nt, Homo sapiens
uagauuucuacacugag

SEQ ID NO: 1056536 - RNA, 14 nt, Homo sapiens
uagcaaaauugagg

SEQ ID NO: 1056537 - RNA, 18 nt, Homo sapiens
uagcaaccuccacauguu

SEQ ID NO: 1056538 - RNA, 16 nt, Homo sapiens
uagcaauugacuguca

SEQ ID NO: 1056539 - RNA, 16 nt, Homo sapiens
uagcacagacccugcc

SEQ ID NO: 1056540 - RNA, 18 nt, Homo sapiens
uagcaccuccacauaccu

SEQ ID NO: 1056541 - RNA, 22 nt, Homo sapiens
uagcagauacagggaugaggca

SEQ ID NO: 1056542 - RNA, 22 nt, Homo sapiens
uagcagcagggagggcuucugc

SEQ ID NO: 1056543 - RNA, 18 nt, Homo sapiens
uagcauacgguaugauau

SEQ ID NO: 1056544 - RNA, 16 nt, Homo sapiens
uagcaugacguguggu

SEQ ID NO: 1056545 - RNA, 15 nt, Homo sapiens
uagccaaguguggua

SEQ ID NO: 1056546 - RNA, 20 nt, Homo sapiens
uagccaaugcuuacugcgcu

SEQ ID NO: 1056547 - RNA, 19 nt, Homo sapiens
uagccacugaucauuuuua

SEQ ID NO: 1056548 - RNA, 23 nt, Homo sapiens
uagccaggguggucuugaucucc

SEQ ID NO: 1056549 - RNA, 14 nt, Homo sapiens
uagccaucuugauc

SEQ ID NO: 1056550 - RNA, 20 nt, Homo sapiens
uagccuaauacaacauguag

SEQ ID NO: 1056551 - RNA, 17 nt, Homo sapiens
uagccucgcucuuggca

SEQ ID NO: 1056552 - RNA, 16 nt, Homo sapiens
uagccucuccaggaau

SEQ ID NO: 1056553 - RNA, 19 nt, Homo sapiens
uaucuagcaaucacaacac

SEQ ID NO: 1056554 - RNA, 13 nt, Homo sapiens
uaucuaucuuaua

SEQ ID NO: 1056555 - RNA, 14 nt, Homo sapiens
uaucucacuugugc

SEQ ID NO: 1056556 - RNA, 17 nt, Homo sapiens
uaucucucagugaacug

SEQ ID NO: 1056557 - RNA, 14 nt, Homo sapiens
uaucugaguugacu

SEQ ID NO: 1056558 - RNA, 14 nt, Homo sapiens
uaucugauuuccua

SEQ ID NO: 1056559 - RNA, 21 nt, Homo sapiens
uaucugcucuuaggugcuucu

SEQ ID NO: 1056560 - RNA, 15 nt, Homo sapiens
uaucugggauucuac

SEQ ID NO: 1056561 - RNA, 15 nt, Homo sapiens
uaucugucauacauc

SEQ ID NO: 1056562 - RNA, 11 nt, Homo sapiens
uaucugugaaa

SEQ ID NO: 1056563 - RNA, 22 nt, Homo sapiens
uaucugugaaaugcuggcauuu

SEQ ID NO: 1056564 - RNA, 11 nt, Homo sapiens
uaucugugaua

SEQ ID NO: 1056565 - RNA, 17 nt, Homo sapiens
uaucugugauuagccau

SEQ ID NO: 1056566 - RNA, 15 nt, Homo sapiens
uaucuuaguugguau

SEQ ID NO: 1056567 - RNA, 15 nt, Homo sapiens
uaucuucuccaggau

SEQ ID NO: 1056568 - RNA, 14 nt, Homo sapiens
uaucuuucgugaua

SEQ ID NO: 1056569 - RNA, 18 nt, Homo sapiens
uaugaaagcacugcauga

SEQ ID NO: 1056570 - RNA, 14 nt, Homo sapiens
uaugaacuacaaag

SEQ ID NO: 1056571 - RNA, 21 nt, Homo sapiens
uaugaagugacucucacaaga

SEQ ID NO: 1056572 - RNA, 16 nt, Homo sapiens
uaugaaucacaguauu

SEQ ID NO: 1056573 - RNA, 13 nt, Homo sapiens
uaugaccacuggg

SEQ ID NO: 1056574 - RNA, 13 nt, Homo sapiens
uaugagggccacg

SEQ ID NO: 1056575 - RNA, 16 nt, Homo sapiens
uaugagucaaugugca

SEQ ID NO: 1056576 - RNA, 16 nt, Homo sapiens
uaugaugucccuaugg

SEQ ID NO: 1056577 - RNA, 18 nt, Homo sapiens
uaugauguguugugauag

SEQ ID NO: 1056578 - RNA, 15 nt, Homo sapiens
uaugauugugcacau

SEQ ID NO: 1056579 - RNA, 23 nt, Homo sapiens
uaugcaauauaucuaaauugaau

SEQ ID NO: 1056580 - RNA, 14 nt, Homo sapiens
uaugcacauaugga

SEQ ID NO: 1056581 - RNA, 21 nt, Homo sapiens
uaugcaccuugugucuguaca

SEQ ID NO: 1056582 - RNA, 16 nt, Homo sapiens
uaugcacgugugcaca

SEQ ID NO: 1056583 - RNA, 15 nt, Homo sapiens
uaugcaggacugauc

SEQ ID NO: 1056584 - RNA, 12 nt, Homo sapiens
uaugcaguaugc

SEQ ID NO: 1056585 - RNA, 12 nt, Homo sapiens
uaugcauaucag

SEQ ID NO: 1056586 - RNA, 20 nt, Homo sapiens
uaugcaugaaguaauaugca

SEQ ID NO: 1056587 - RNA, 18 nt, Homo sapiens
uaugccauagcaagauug

SEQ ID NO: 1056588 - RNA, 21 nt, Homo sapiens
uaugccauggaggcacuaaca

SEQ ID NO: 1056589 - RNA, 14 nt, Homo sapiens
uaugcccagcguuu

SEQ ID NO: 1056590 - RNA, 16 nt, Homo sapiens
uaugcggucuagggaa

SEQ ID NO: 1056591 - RNA, 16 nt, Homo sapiens
uaugcuaccuacugau

SEQ ID NO: 1056592 - RNA, 22 nt, Homo sapiens
uaugcucagggucaauuucuuu

SEQ ID NO: 1056593 - RNA, 16 nt, Homo sapiens
uaugcuuacugauaua

SEQ ID NO: 1056594 - RNA, 19 nt, Homo sapiens
uaugcuuggcuaacuauau

SEQ ID NO: 1056595 - RNA, 16 nt, Homo sapiens
uauggaacucucucca

SEQ ID NO: 1056596 - RNA, 16 nt, Homo sapiens
uauggaauacaguguu

SEQ ID NO: 1056597 - RNA, 14 nt, Homo sapiens
uauggacucugcac

SEQ ID NO: 1056598 - RNA, 23 nt, Homo sapiens
uauggagcuuuuccugauguucc

SEQ ID NO: 1056599 - RNA, 23 nt, Homo sapiens
uauggauucagaauauacuaaau

SEQ ID NO: 1056600 - RNA, 16 nt, Homo sapiens
uauggcacccaugcac

SEQ ID NO: 1056601 - RNA, 18 nt, Homo sapiens
uauggcacccaugcaccu

SEQ ID NO: 1056602 - RNA, 13 nt, Homo sapiens
uauggcacuggca

SEQ ID NO: 1056603 - RNA, 16 nt, Homo sapiens
uauggccucaagauca

SEQ ID NO: 1056604 - RNA, 21 nt, Homo sapiens
uaugggccaagcccagcuuaa

SEQ ID NO: 1056605 - RNA, 21 nt, Homo sapiens
uaugggcuuuguuaucuucca

SEQ ID NO: 1056606 - RNA, 20 nt, Homo sapiens
uaugggggcacugaggacca

SEQ ID NO: 1056607 - RNA, 18 nt, Homo sapiens
uauggguuggacaaccuc

SEQ ID NO: 1056608 - RNA, 22 nt, Homo sapiens
uaugguaggaacugcugggcuu

SEQ ID NO: 1056609 - RNA, 14 nt, Homo sapiens
uaugguucucaggc

SEQ ID NO: 1056610 - RNA, 15 nt, Homo sapiens
uaugguucucaggcc

SEQ ID NO: 1056611 - RNA, 17 nt, Homo sapiens
uaugguucucucgcaag

SEQ ID NO: 1056612 - RNA, 16 nt, Homo sapiens
uauguaagagcaccuu

SEQ ID NO: 1056613 - RNA, 22 nt, Homo sapiens
uauguaauuuuauuuacauucu

SEQ ID NO: 1056614 - RNA, 13 nt, Homo sapiens
uauguacuaagca

SEQ ID NO: 1056615 - RNA, 16 nt, Homo sapiens
uauguacuaagcagua

SEQ ID NO: 1056616 - RNA, 12 nt, Homo sapiens
uauguagauaac

SEQ ID NO: 1056617 - RNA, 22 nt, Homo sapiens
uauguagcaaaauacaugacau

SEQ ID NO: 1056618 - RNA, 16 nt, Homo sapiens
uauguauauacauuua

SEQ ID NO: 1056619 - RNA, 22 nt, Homo sapiens
uaugucaggcaaagugcugcug

SEQ ID NO: 1056620 - RNA, 20 nt, Homo sapiens
uaugucuuggacacuguaca

SEQ ID NO: 1056621 - RNA, 21 nt, Homo sapiens
uaugugaaauguauagcugcu

SEQ ID NO: 1056622 - RNA, 23 nt, Homo sapiens
uaugugaguguguccaagugugu

SEQ ID NO: 1056623 - RNA, 16 nt, Homo sapiens
uaugugcgugugugca

SEQ ID NO: 1056624 - RNA, 19 nt, Homo sapiens
uaugugcgugugugcaagu

SEQ ID NO: 1056625 - RNA, 23 nt, Homo sapiens
uauguggaagugugggucugugu

SEQ ID NO: 1056626 - RNA, 14 nt, Homo sapiens
uauguggcuguauc

SEQ ID NO: 1056627 - RNA, 17 nt, Homo sapiens
uaugugggggucugugu

SEQ ID NO: 1056628 - RNA, 20 nt, Homo sapiens
uaugugggugggaccacaga

SEQ ID NO: 1056629 - RNA, 18 nt, Homo sapiens
uaugugugaggagcugcu

SEQ ID NO: 1056630 - RNA, 13 nt, Homo sapiens
uauguguguauau

SEQ ID NO: 1056631 - RNA, 17 nt, Homo sapiens
uauguuauuugcucuaa

SEQ ID NO: 1056632 - RNA, 12 nt, Homo sapiens
uauguugcccag

SEQ ID NO: 1056633 - RNA, 17 nt, Homo sapiens
uauguugcccagugugu

SEQ ID NO: 1056634 - RNA, 20 nt, Homo sapiens
uauguuuacauaucaccuca

SEQ ID NO: 1056635 - RNA, 20 nt, Homo sapiens
uauuaaaauaaauguuguuu

SEQ ID NO: 1056636 - RNA, 17 nt, Homo sapiens
uauuaacuuuaauucuc

SEQ ID NO: 1056637 - RNA, 18 nt, Homo sapiens
uauuacaagccuacauga

SEQ ID NO: 1056638 - RNA, 21 nt, Homo sapiens
uauuacaauuuuugaacaacu

SEQ ID NO: 1056639 - RNA, 18 nt, Homo sapiens
uauuacacauuuauguaa

SEQ ID NO: 1056640 - RNA, 13 nt, Homo sapiens
uauuaccaugaga

SEQ ID NO: 1056641 - RNA, 22 nt, Homo sapiens
uauuacuuauuuuugacagugu

SEQ ID NO: 1056642 - RNA, 15 nt, Homo sapiens
uauuagaugugauuu

SEQ ID NO: 1056643 - RNA, 15 nt, Homo sapiens
uauuaguacugcucu

SEQ ID NO: 1056644 - RNA, 14 nt, Homo sapiens
uauuaugcccaguu

SEQ ID NO: 1056645 - RNA, 20 nt, Homo sapiens
uauuauuccagaucugcagu

SEQ ID NO: 1056646 - RNA, 17 nt, Homo sapiens
uauuauucuucauaaca

SEQ ID NO: 1056647 - RNA, 13 nt, Homo sapiens
uauucaauggaaa

SEQ ID NO: 1056648 - RNA, 19 nt, Homo sapiens
uauucauccuaaaaaguuc

SEQ ID NO: 1056649 - RNA, 12 nt, Homo sapiens
uauuccagagac

SEQ ID NO: 1056650 - RNA, 16 nt, Homo sapiens
uauuccauugugugag

SEQ ID NO: 1056651 - RNA, 12 nt, Homo sapiens
uauucccaugag

SEQ ID NO: 1056652 - RNA, 19 nt, Homo sapiens
uauucccuucuaaccugaa

SEQ ID NO: 1056653 - RNA, 13 nt, Homo sapiens
uauuccugcauuu

SEQ ID NO: 1056654 - RNA, 12 nt, Homo sapiens
uauucucaagaa

SEQ ID NO: 1056655 - RNA, 23 nt, Homo sapiens
uauucucaguguagggcagagag

SEQ ID NO: 1056656 - RNA, 21 nt, Homo sapiens
uauucugccaaaccuguguag

SEQ ID NO: 1056657 - RNA, 17 nt, Homo sapiens
uauucugguuacugugg

SEQ ID NO: 1056658 - RNA, 13 nt, Homo sapiens
uauugaaucuaca

SEQ ID NO: 1056659 - RNA, 14 nt, Homo sapiens
uauugagcauguga

SEQ ID NO: 1056660 - RNA, 18 nt, Homo sapiens
uauugcuagccaucuuga

SEQ ID NO: 1056661 - RNA, 17 nt, Homo sapiens
uauugcugaaugacuac

SEQ ID NO: 1056662 - RNA, 15 nt, Homo sapiens
uauuggacagucuca

SEQ ID NO: 1056663 - RNA, 15 nt, Homo sapiens
uauuguaaacaugug

SEQ ID NO: 1056664 - RNA, 14 nt, Homo sapiens
uauugugaucuauc

SEQ ID NO: 1056665 - RNA, 16 nt, Homo sapiens
uauugugccaauaugu

SEQ ID NO: 1056666 - RNA, 13 nt, Homo sapiens
uauugugccucag

SEQ ID NO: 1056667 - RNA, 13 nt, Homo sapiens
uauuguggcacaa

SEQ ID NO: 1056668 - RNA, 14 nt, Homo sapiens
uauuguggugccac

SEQ ID NO: 1056669 - RNA, 16 nt, Homo sapiens
uauuguuucaauugca

SEQ ID NO: 1056670 - RNA, 23 nt, Homo sapiens
uauuuaaacaugguuacaaucau

SEQ ID NO: 1056671 - RNA, 17 nt, Homo sapiens
uauuuaccagaccacaa

SEQ ID NO: 1056672 - RNA, 19 nt, Homo sapiens
ugagggugacuauggagcu

SEQ ID NO: 1056673 - RNA, 12 nt, Homo sapiens
ugagguaaccuc

SEQ ID NO: 1056674 - RNA, 22 nt, Homo sapiens
ugagguugggguguacuaguua

SEQ ID NO: 1056675 - RNA, 16 nt, Homo sapiens
ugaguaaugguuacua

SEQ ID NO: 1056676 - RNA, 17 nt, Homo sapiens
ugaguagggacucaggg

SEQ ID NO: 1056677 - RNA, 18 nt, Homo sapiens
ugaguagggacucagggc

SEQ ID NO: 1056678 - RNA, 17 nt, Homo sapiens
ugagucaaugugcagug

SEQ ID NO: 1056679 - RNA, 11 nt, Homo sapiens
ugagugcaagg

SEQ ID NO: 1056680 - RNA, 15 nt, Homo sapiens
ugaguggacuggagu

SEQ ID NO: 1056681 - RNA, 23 nt, Homo sapiens
ugagugguguguguuaucagaua

SEQ ID NO: 1056682 - RNA, 15 nt, Homo sapiens
ugaguguaaguguga

SEQ ID NO: 1056683 - RNA, 14 nt, Homo sapiens
ugaguuaaagcagu

SEQ ID NO: 1056684 - RNA, 15 nt, Homo sapiens
ugaguuaaauuauac

SEQ ID NO: 1056685 - RNA, 13 nt, Homo sapiens
ugaguuacccugg

SEQ ID NO: 1056686 - RNA, 16 nt, Homo sapiens
ugaguuauuuugcuaa

SEQ ID NO: 1056687 - RNA, 22 nt, Homo sapiens
ugaguucuggaagggacuuuag

SEQ ID NO: 1056688 - RNA, 21 nt, Homo sapiens
ugaguugguguugacaugugc

SEQ ID NO: 1056689 - RNA, 13 nt, Homo sapiens
ugaguuucucuca

SEQ ID NO: 1056690 - RNA, 23 nt, Homo sapiens
ugauaaguucuuaugccauguua

SEQ ID NO: 1056691 - RNA, 21 nt, Homo sapiens
ugauacaaauugcagacugug

SEQ ID NO: 1056692 - RNA, 23 nt, Homo sapiens
ugauacagugaagauacaggaca

SEQ ID NO: 1056693 - RNA, 19 nt, Homo sapiens
ugauauggcagaagacacc

SEQ ID NO: 1056694 - RNA, 23 nt, Homo sapiens
ugauaugucagggcgugggacau

SEQ ID NO: 1056695 - RNA, 20 nt, Homo sapiens
ugauauguugguagauucua

SEQ ID NO: 1056696 - RNA, 15 nt, Homo sapiens
ugauauugcauaugc

SEQ ID NO: 1056697 - RNA, 17 nt, Homo sapiens
ugauauugcauaugcau

SEQ ID NO: 1056698 - RNA, 11 nt, Homo sapiens
ugaucaaguca

SEQ ID NO: 1056699 - RNA, 17 nt, Homo sapiens
ugaucaauaaaauguga

SEQ ID NO: 1056700 - RNA, 19 nt, Homo sapiens
ugaucacggcucacugcag

SEQ ID NO: 1056701 - RNA, 17 nt, Homo sapiens
ugauccggggguccagg

SEQ ID NO: 1056702 - RNA, 16 nt, Homo sapiens
ugauccguuccauugc

SEQ ID NO: 1056703 - RNA, 14 nt, Homo sapiens
ugauccugugaagu

SEQ ID NO: 1056704 - RNA, 17 nt, Homo sapiens
ugauccuuuuauguuau

SEQ ID NO: 1056705 - RNA, 21 nt, Homo sapiens
ugaucgcgccacuacacucca

SEQ ID NO: 1056706 - RNA, 12 nt, Homo sapiens
ugaucuguguuu

SEQ ID NO: 1056707 - RNA, 22 nt, Homo sapiens
ugaucuucagggaacugcauag

SEQ ID NO: 1056708 - RNA, 14 nt, Homo sapiens
ugaucuuugcagac

SEQ ID NO: 1056709 - RNA, 17 nt, Homo sapiens
ugaugaaaacuuucuaa

SEQ ID NO: 1056710 - RNA, 17 nt, Homo sapiens
ugaugaggcagaugccu

SEQ ID NO: 1056711 - RNA, 13 nt, Homo sapiens
ugaugaucuuugc

SEQ ID NO: 1056712 - RNA, 22 nt, Homo sapiens
ugaugaugggaauugugugaug

SEQ ID NO: 1056713 - RNA, 23 nt, Homo sapiens
ugaugcugggauuuacacuugag

SEQ ID NO: 1056714 - RNA, 15 nt, Homo sapiens
ugauggcaccacugc

SEQ ID NO: 1056715 - RNA, 16 nt, Homo sapiens
ugauggccaggccaga

SEQ ID NO: 1056716 - RNA, 13 nt, Homo sapiens
ugauggugcugac

SEQ ID NO: 1056717 - RNA, 23 nt, Homo sapiens
ugauguauaaagcaacuguuaug

SEQ ID NO: 1056718 - RNA, 13 nt, Homo sapiens
ugaugucauguca

SEQ ID NO: 1056719 - RNA, 16 nt, Homo sapiens
ugaugucuccacuuuc

SEQ ID NO: 1056720 - RNA, 14 nt, Homo sapiens
ugauguggcaauaa

SEQ ID NO: 1056721 - RNA, 15 nt, Homo sapiens
ugauguuccacucca

SEQ ID NO: 1056722 - RNA, 20 nt, Homo sapiens
ugauguuuguggccucagaa

SEQ ID NO: 1056723 - RNA, 15 nt, Homo sapiens
ugauuacuaugcucu

SEQ ID NO: 1056724 - RNA, 20 nt, Homo sapiens
ugauuaguaaagaaaugaca

SEQ ID NO: 1056725 - RNA, 17 nt, Homo sapiens
ugauucauuuucugccu

SEQ ID NO: 1056726 - RNA, 18 nt, Homo sapiens
ugauuccaccuacaugag

SEQ ID NO: 1056727 - RNA, 16 nt, Homo sapiens
ugauucugucaauguc

SEQ ID NO: 1056728 - RNA, 22 nt, Homo sapiens
ugauuucagcaccuacagugua

SEQ ID NO: 1056729 - RNA, 16 nt, Homo sapiens
ugcaaaaggacucuca

SEQ ID NO: 1056730 - RNA, 22 nt, Homo sapiens
ugcaaacaggcuguucaccacc

SEQ ID NO: 1056731 - RNA, 19 nt, Homo sapiens
ugcaaagauuugcuuuaau

SEQ ID NO: 1056732 - RNA, 12 nt, Homo sapiens
ugcaaagccaua

SEQ ID NO: 1056733 - RNA, 20 nt, Homo sapiens
ugcaaaguucccuacuuccu

SEQ ID NO: 1056734 - RNA, 17 nt, Homo sapiens
ugcaaauccuaugugau

SEQ ID NO: 1056735 - RNA, 18 nt, Homo sapiens
ugcaaauccuaugugauu

SEQ ID NO: 1056736 - RNA, 19 nt, Homo sapiens
ugcaaauccuaugugauuu

SEQ ID NO: 1056737 - RNA, 14 nt, Homo sapiens
ugcaacaacaugua

SEQ ID NO: 1056738 - RNA, 14 nt, Homo sapiens
ugcaacaggcacuc

SEQ ID NO: 1056739 - RNA, 19 nt, Homo sapiens
ugcaacaggcuugugcaac

SEQ ID NO: 1056740 - RNA, 16 nt, Homo sapiens
ugcaaccaacugcugc

SEQ ID NO: 1056741 - RNA, 16 nt, Homo sapiens
ugcaacccuuaccccu

SEQ ID NO: 1056742 - RNA, 17 nt, Homo sapiens
ugcaagagacucuggcc

SEQ ID NO: 1056743 - RNA, 14 nt, Homo sapiens
ugcaagauucugaa

SEQ ID NO: 1056744 - RNA, 18 nt, Homo sapiens
ugcaagugucugugugca

SEQ ID NO: 1056745 - RNA, 19 nt, Homo sapiens
ugcaagugucugugugcaa

SEQ ID NO: 1056746 - RNA, 19 nt, Homo sapiens
ugcaagugugugcaugugu

SEQ ID NO: 1056747 - RNA, 21 nt, Homo sapiens
ugcaagugugugcaugugugc

SEQ ID NO: 1056748 - RNA, 19 nt, Homo sapiens
ugcaauaauacuucucaaa

SEQ ID NO: 1056749 - RNA, 20 nt, Homo sapiens
ugcaaugacucaggacaucc

SEQ ID NO: 1056750 - RNA, 20 nt, Homo sapiens
ugcacaaaaagaugcaucua

SEQ ID NO: 1056751 - RNA, 13 nt, Homo sapiens
ugcacacuuugcc

SEQ ID NO: 1056752 - RNA, 14 nt, Homo sapiens
ugcacacuuugcca

SEQ ID NO: 1056753 - RNA, 21 nt, Homo sapiens
ugcacagaucugcuugaucaa

SEQ ID NO: 1056754 - RNA, 14 nt, Homo sapiens
ugcacagggagacg

SEQ ID NO: 1056755 - RNA, 21 nt, Homo sapiens
ugcacagggcagcugggccca

SEQ ID NO: 1056756 - RNA, 21 nt, Homo sapiens
ugcacauacgcaccacaucuc

SEQ ID NO: 1056757 - RNA, 20 nt, Homo sapiens
ugcacaugucuuguacaugu

SEQ ID NO: 1056758 - RNA, 16 nt, Homo sapiens
ugcaccaacuuugaag

SEQ ID NO: 1056759 - RNA, 12 nt, Homo sapiens
ugcaccacugca

SEQ ID NO: 1056760 - RNA, 15 nt, Homo sapiens
ugcacccacccagga

SEQ ID NO: 1056761 - RNA, 22 nt, Homo sapiens
ugcacccaccuuucugcacaua

SEQ ID NO: 1056762 - RNA, 16 nt, Homo sapiens
ugcaccugccagccug

SEQ ID NO: 1056763 - RNA, 20 nt, Homo sapiens
ugcaccuuaccaacuuucug

SEQ ID NO: 1056764 - RNA, 21 nt, Homo sapiens
ugcaccuugugucuguacacg

SEQ ID NO: 1056765 - RNA, 19 nt, Homo sapiens
ugcacguuaugguguuucu

SEQ ID NO: 1056766 - RNA, 23 nt, Homo sapiens
ugcacuacucccucaaagcacac

SEQ ID NO: 1056767 - RNA, 13 nt, Homo sapiens
ugcacuacuccuc

SEQ ID NO: 1056768 - RNA, 23 nt, Homo sapiens
ugcacuacuccucugcagugccu

SEQ ID NO: 1056769 - RNA, 20 nt, Homo sapiens
ugcacuccagccugagcgac

SEQ ID NO: 1056770 - RNA, 21 nt, Homo sapiens
ugcacucuaacccuaggcauc

SEQ ID NO: 1056771 - RNA, 14 nt, Homo sapiens
ugcacuuauucuca

SEQ ID NO: 1056772 - RNA, 12 nt, Homo sapiens
ugcacuuucuau

SEQ ID NO: 1056773 - RNA, 24 nt, Homo sapiens
ugcacuuuguucuggcucuuccag

SEQ ID NO: 1056774 - RNA, 17 nt, Homo sapiens
ugcacuuuuaaaccucu

SEQ ID NO: 1056775 - RNA, 18 nt, Homo sapiens
ugcacuuuuaaaccucuc

SEQ ID NO: 1056776 - RNA, 23 nt, Homo sapiens
ugcacuuuuccguuucagcggaa

SEQ ID NO: 1056777 - RNA, 13 nt, Homo sapiens
ugcagaaggccaa

SEQ ID NO: 1056778 - RNA, 17 nt, Homo sapiens
ugcagaauccaaaguaa

SEQ ID NO: 1056779 - RNA, 16 nt, Homo sapiens
ugcagagggacagaug

SEQ ID NO: 1056780 - RNA, 13 nt, Homo sapiens
ugcagaguacugg

SEQ ID NO: 1056781 - RNA, 17 nt, Homo sapiens
ugcagagugcccagaac

SEQ ID NO: 1056782 - RNA, 18 nt, Homo sapiens
ugcagagugcccagaacu

SEQ ID NO: 1056783 - RNA, 14 nt, Homo sapiens
ugcagaugacaaaa

SEQ ID NO: 1056784 - RNA, 19 nt, Homo sapiens
ugcagcauuuuguauuugu

SEQ ID NO: 1056785 - RNA, 18 nt, Homo sapiens
ugcagccacugugcugaa

SEQ ID NO: 1056786 - RNA, 14 nt, Homo sapiens
ugcagcccaugccc

SEQ ID NO: 1056787 - RNA, 17 nt, Homo sapiens
ugcagccccacagacaa

SEQ ID NO: 1056788 - RNA, 19 nt, Homo sapiens
ugcagccgugaucaaggga

SEQ ID NO: 1056789 - RNA, 17 nt, Homo sapiens
ugcagccuuugccuccc

SEQ ID NO: 1056790 - RNA, 16 nt, Homo sapiens
ugcaggaccucaggug

SEQ ID NO: 1056791 - RNA, 21 nt, Homo sapiens
ugcaggagucccugccaucau

SEQ ID NO: 1056792 - RNA, 22 nt, Homo sapiens
ugcagggaagccccacuugaag

SEQ ID NO: 1056793 - RNA, 19 nt, Homo sapiens
ugcaggggggcaguaacuc

SEQ ID NO: 1056794 - RNA, 20 nt, Homo sapiens
ugcagguugggaaugaggcu

SEQ ID NO: 1056795 - RNA, 16 nt, Homo sapiens
ugcaguaaacuuuuaa

SEQ ID NO: 1056796 - RNA, 22 nt, Homo sapiens
ugcaguagagucaucuccauca

SEQ ID NO: 1056797 - RNA, 16 nt, Homo sapiens
ugcaguauaaauaacu

SEQ ID NO: 1056798 - RNA, 19 nt, Homo sapiens
ugcagucaucuugaccaag

SEQ ID NO: 1056799 - RNA, 22 nt, Homo sapiens
ugcagucauuaugagaggcaau

SEQ ID NO: 1056800 - RNA, 13 nt, Homo sapiens
ugcagugagccaa

SEQ ID NO: 1056801 - RNA, 11 nt, Homo sapiens
cucccuuugaa

SEQ ID NO: 1056802 - RNA, 13 nt, Homo sapiens
cuccgaggccagu

SEQ ID NO: 1056803 - RNA, 16 nt, Homo sapiens
cuccggccugaugaca

SEQ ID NO: 1056804 - RNA, 18 nt, Homo sapiens
cuccguuuggcagugcaa

SEQ ID NO: 1056805 - RNA, 14 nt, Homo sapiens
cuccuaucuguguu

SEQ ID NO: 1056806 - RNA, 12 nt, Homo sapiens
cuccucaaaagc

SEQ ID NO: 1056807 - RNA, 13 nt, Homo sapiens
cuccucaggguug

SEQ ID NO: 1056808 - RNA, 17 nt, Homo sapiens
cuccuccagaccauuca

SEQ ID NO: 1056809 - RNA, 20 nt, Homo sapiens
cuccuccccaaggagacaca

SEQ ID NO: 1056810 - RNA, 13 nt, Homo sapiens
cuccucgcaagcu

SEQ ID NO: 1056811 - RNA, 18 nt, Homo sapiens
cuccucugugaagcauuc

SEQ ID NO: 1056812 - RNA, 14 nt, Homo sapiens
cuccugaagccaca

SEQ ID NO: 1056813 - RNA, 20 nt, Homo sapiens
cuccugaccucaaguaaucc

SEQ ID NO: 1056814 - RNA, 17 nt, Homo sapiens
cuccugaccucagguga

SEQ ID NO: 1056815 - RNA, 16 nt, Homo sapiens
cuccugaccugaggcu

SEQ ID NO: 1056816 - RNA, 17 nt, Homo sapiens
cuccugagccacucaga

SEQ ID NO: 1056817 - RNA, 13 nt, Homo sapiens
cuccugcagggau

SEQ ID NO: 1056818 - RNA, 22 nt, Homo sapiens
cuccugccauaggguccugaau

SEQ ID NO: 1056819 - RNA, 18 nt, Homo sapiens
cuccugcccaccugucaa

SEQ ID NO: 1056820 - RNA, 19 nt, Homo sapiens
cuccugcgcgcaugugcgc

SEQ ID NO: 1056821 - RNA, 19 nt, Homo sapiens
cuccugcucauauugugau

SEQ ID NO: 1056822 - RNA, 16 nt, Homo sapiens
cuccuggucuugagau

SEQ ID NO: 1056823 - RNA, 18 nt, Homo sapiens
cuccugucccucauccau

SEQ ID NO: 1056824 - RNA, 17 nt, Homo sapiens
cuccugugcuacuuugc

SEQ ID NO: 1056825 - RNA, 18 nt, Homo sapiens
cuccugugcuuucccuga

SEQ ID NO: 1056826 - RNA, 23 nt, Homo sapiens
cuccugugucuguguauauuaca

SEQ ID NO: 1056827 - RNA, 15 nt, Homo sapiens
cuccuguuuuuugau

SEQ ID NO: 1056828 - RNA, 19 nt, Homo sapiens
cuccuguuuuuugaugcuu

SEQ ID NO: 1056829 - RNA, 20 nt, Homo sapiens
cuccuucaccuuugucccca

SEQ ID NO: 1056830 - RNA, 18 nt, Homo sapiens
cuccuuccuugaccagca

SEQ ID NO: 1056831 - RNA, 19 nt, Homo sapiens
cuccuuguaaagacuguag

SEQ ID NO: 1056832 - RNA, 14 nt, Homo sapiens
cuccuuugcacuga

SEQ ID NO: 1056833 - RNA, 13 nt, Homo sapiens
cuccuuugcuuaa

SEQ ID NO: 1056834 - RNA, 20 nt, Homo sapiens
cuccuuuggaaugcuguauu

SEQ ID NO: 1056835 - RNA, 17 nt, Homo sapiens
cucgaaaaccaucacau

SEQ ID NO: 1056836 - RNA, 16 nt, Homo sapiens
cucgaccucccaaagu

SEQ ID NO: 1056837 - RNA, 22 nt, Homo sapiens
cucgaggcggaucuuuggacag

SEQ ID NO: 1056838 - RNA, 21 nt, Homo sapiens
cucgcaagggaaguccuugca

SEQ ID NO: 1056839 - RNA, 14 nt, Homo sapiens
cucgcccgcccacu

SEQ ID NO: 1056840 - RNA, 13 nt, Homo sapiens
cucggaggcugcc

SEQ ID NO: 1056841 - RNA, 22 nt, Homo sapiens
cucgggucccagaugucugcag

SEQ ID NO: 1056842 - RNA, 22 nt, Homo sapiens
cucgguucaaaaccuugcacag

SEQ ID NO: 1056843 - RNA, 20 nt, Homo sapiens
cucgugguaggacuguagaa

SEQ ID NO: 1056844 - RNA, 14 nt, Homo sapiens
cucuaaaaauccau

SEQ ID NO: 1056845 - RNA, 16 nt, Homo sapiens
cucuaacaaugacauu

SEQ ID NO: 1056846 - RNA, 18 nt, Homo sapiens
cucuaacaaugacauuua

SEQ ID NO: 1056847 - RNA, 20 nt, Homo sapiens
cucuaacucagaaacaucag

SEQ ID NO: 1056848 - RNA, 18 nt, Homo sapiens
aucacgagaucaagagau

SEQ ID NO: 1056849 - RNA, 17 nt, Homo sapiens
aucacgcagaucacuaa

SEQ ID NO: 1056850 - RNA, 19 nt, Homo sapiens
aucacgcuuuccugaaucc

SEQ ID NO: 1056851 - RNA, 17 nt, Homo sapiens
aucacggcucacugcag

SEQ ID NO: 1056852 - RNA, 22 nt, Homo sapiens
aucacggcucacugcagccuca

SEQ ID NO: 1056853 - RNA, 23 nt, Homo sapiens
aucacggcucacugcagccucaa

SEQ ID NO: 1056854 - RNA, 22 nt, Homo sapiens
aucacuuccuauaugcacuuau

SEQ ID NO: 1056855 - RNA, 17 nt, Homo sapiens
aucacuugcacuccgga

SEQ ID NO: 1056856 - RNA, 16 nt, Homo sapiens
aucagaaacuugugaa

SEQ ID NO: 1056857 - RNA, 17 nt, Homo sapiens
aucagaaggacauggug

SEQ ID NO: 1056858 - RNA, 13 nt, Homo sapiens
aucagacuaguga

SEQ ID NO: 1056859 - RNA, 22 nt, Homo sapiens
aucagaggccuauaaugaagcu

SEQ ID NO: 1056860 - RNA, 13 nt, Homo sapiens
aucagaugaacuc

SEQ ID NO: 1056861 - RNA, 23 nt, Homo sapiens
aucagcaacaaccagcaucccuu

SEQ ID NO: 1056862 - RNA, 13 nt, Homo sapiens
aucagcacuccuc

SEQ ID NO: 1056863 - RNA, 18 nt, Homo sapiens
aucagccugucucuucca

SEQ ID NO: 1056864 - RNA, 19 nt, Homo sapiens
aucagccugucucuuccau

SEQ ID NO: 1056865 - RNA, 18 nt, Homo sapiens
aucagcgccgcaccagcc

SEQ ID NO: 1056866 - RNA, 15 nt, Homo sapiens
aucagcuaaguugca

SEQ ID NO: 1056867 - RNA, 21 nt, Homo sapiens
aucagcuccagcugcucuguc

SEQ ID NO: 1056868 - RNA, 18 nt, Homo sapiens
aucaggacagguggugca

SEQ ID NO: 1056869 - RNA, 16 nt, Homo sapiens
aucaggcucugccuca

SEQ ID NO: 1056870 - RNA, 15 nt, Homo sapiens
aucagggacaggaug

SEQ ID NO: 1056871 - RNA, 17 nt, Homo sapiens
aucagggaggucauuuu

SEQ ID NO: 1056872 - RNA, 14 nt, Homo sapiens
aucaguagccagca

SEQ ID NO: 1056873 - RNA, 16 nt, Homo sapiens
aucagucauaacuaaa

SEQ ID NO: 1056874 - RNA, 13 nt, Homo sapiens
aucaguccaaagg

SEQ ID NO: 1056875 - RNA, 17 nt, Homo sapiens
aucaguccaaagggcau

SEQ ID NO: 1056876 - RNA, 22 nt, Homo sapiens
aucaguccucgcggcucuccag

SEQ ID NO: 1056877 - RNA, 16 nt, Homo sapiens
aucagucuauccacag

SEQ ID NO: 1056878 - RNA, 17 nt, Homo sapiens
aucagucuauccacaga

SEQ ID NO: 1056879 - RNA, 19 nt, Homo sapiens
aucagugaauaaaccauca

SEQ ID NO: 1056880 - RNA, 20 nt, Homo sapiens
aucagugcuccuguaaguca

SEQ ID NO: 1056881 - RNA, 16 nt, Homo sapiens
aucauaauucagcucu

SEQ ID NO: 1056882 - RNA, 16 nt, Homo sapiens
aucaucaucauucuca

SEQ ID NO: 1056883 - RNA, 13 nt, Homo sapiens
aucaucauucuca

SEQ ID NO: 1056884 - RNA, 17 nt, Homo sapiens
aucauccuuuccagcau

SEQ ID NO: 1056885 - RNA, 18 nt, Homo sapiens
aucaucuagggaguauga

SEQ ID NO: 1056886 - RNA, 20 nt, Homo sapiens
aucaugaaaaugucuauuca

SEQ ID NO: 1056887 - RNA, 16 nt, Homo sapiens
aucaugcugucuuuac

SEQ ID NO: 1056888 - RNA, 14 nt, Homo sapiens
aucauuccuugaga

SEQ ID NO: 1056889 - RNA, 16 nt, Homo sapiens
aucauuuuaagugcau

SEQ ID NO: 1056890 - RNA, 17 nt, Homo sapiens
aucauuuuaagugcaug

SEQ ID NO: 1056891 - RNA, 18 nt, Homo sapiens
aucauuuucugcauuuaa

SEQ ID NO: 1056892 - RNA, 16 nt, Homo sapiens
auccaagaaucaguga

SEQ ID NO: 1056893 - RNA, 20 nt, Homo sapiens
auccacucuucuagggauau

SEQ ID NO: 1056894 - RNA, 14 nt, Homo sapiens
auccacuucucuca

SEQ ID NO: 1056895 - RNA, 19 nt, Homo sapiens
auccagauagguuaccagu

SEQ ID NO: 1056896 - RNA, 16 nt, Homo sapiens
auccagcuaugaauau

SEQ ID NO: 1056897 - RNA, 19 nt, Homo sapiens
auccagguaauccaagaua

SEQ ID NO: 1056898 - RNA, 17 nt, Homo sapiens
auccaugaaccaagacc

SEQ ID NO: 1056899 - RNA, 19 nt, Homo sapiens
auccauggggcugauugua

SEQ ID NO: 1056900 - RNA, 23 nt, Homo sapiens
auccauuuccaaaccuccacugc

SEQ ID NO: 1056901 - RNA, 20 nt, Homo sapiens
auccauuugcguuccaugau

SEQ ID NO: 1056902 - RNA, 12 nt, Homo sapiens
aucccaagagaa

SEQ ID NO: 1056903 - RNA, 13 nt, Homo sapiens
aucccacugggag

SEQ ID NO: 1056904 - RNA, 12 nt, Homo sapiens
aucccagcacuu

SEQ ID NO: 1056905 - RNA, 15 nt, Homo sapiens
aucccagcacuuugg

SEQ ID NO: 1056906 - RNA, 23 nt, Homo sapiens
aucccagcuggccuguaauccca

SEQ ID NO: 1056907 - RNA, 21 nt, Homo sapiens
aucccaggggaccacaccucc

SEQ ID NO: 1056908 - RNA, 22 nt, Homo sapiens
auccccaacugcgacugugacc

SEQ ID NO: 1056909 - RNA, 19 nt, Homo sapiens
aucccccagccucaagucu

SEQ ID NO: 1056910 - RNA, 23 nt, Homo sapiens
auccccccgccaaaagcugcuca

SEQ ID NO: 1056911 - RNA, 17 nt, Homo sapiens
auccccuggacugggag

SEQ ID NO: 1056912 - RNA, 17 nt, Homo sapiens
auccccuuuguguagaa

SEQ ID NO: 1056913 - RNA, 16 nt, Homo sapiens
aucccguguugccaug

SEQ ID NO: 1056914 - RNA, 13 nt, Homo sapiens
aucccuacuguaa

SEQ ID NO: 1056915 - RNA, 18 nt, Homo sapiens
aucccucgggugugcuau

SEQ ID NO: 1056916 - RNA, 16 nt, Homo sapiens
aucccuuaccucggug

SEQ ID NO: 1056917 - RNA, 16 nt, Homo sapiens
aucccuuuccaaaggc

SEQ ID NO: 1056918 - RNA, 19 nt, Homo sapiens
auccgaaccuccucuguga

SEQ ID NO: 1056919 - RNA, 22 nt, Homo sapiens
auccgaggcagggucaggagag

SEQ ID NO: 1056920 - RNA, 21 nt, Homo sapiens
auccgucuaguuaacauuuca

SEQ ID NO: 1056921 - RNA, 16 nt, Homo sapiens
auccuaaauaauguua

SEQ ID NO: 1056922 - RNA, 20 nt, Homo sapiens
auccuacaaggcuggcagug

SEQ ID NO: 1056923 - RNA, 12 nt, Homo sapiens
auccuaccccac

SEQ ID NO: 1056924 - RNA, 14 nt, Homo sapiens
auccuagcacuuug

SEQ ID NO: 1056925 - RNA, 15 nt, Homo sapiens
auccuagcacuuugg

SEQ ID NO: 1056926 - RNA, 13 nt, Homo sapiens
auccuagugcuuu

SEQ ID NO: 1056927 - RNA, 20 nt, Homo sapiens
auccuauggcagagcauuca

SEQ ID NO: 1056928 - RNA, 21 nt, Homo sapiens
auccuauucucgggcugagaa

SEQ ID NO: 1056929 - RNA, 17 nt, Homo sapiens
auccucacccagcaccc

SEQ ID NO: 1056930 - RNA, 14 nt, Homo sapiens
auccucccaccuca

SEQ ID NO: 1056931 - RNA, 21 nt, Homo sapiens
auccucucccauggagacaag

SEQ ID NO: 1056932 - RNA, 15 nt, Homo sapiens
auccucuuccucuga

SEQ ID NO: 1056933 - RNA, 17 nt, Homo sapiens
auccugaccuugcacaa

SEQ ID NO: 1056934 - RNA, 21 nt, Homo sapiens
auccuggccaacauggugaaa

SEQ ID NO: 1056935 - RNA, 19 nt, Homo sapiens
auccuggcccucuguguug

SEQ ID NO: 1056936 - RNA, 21 nt, Homo sapiens
auccugguugguguugcagaa

SEQ ID NO: 1056937 - RNA, 18 nt, Homo sapiens
auccugguuucaaugacg

SEQ ID NO: 1056938 - RNA, 18 nt, Homo sapiens
auccugucuuuaaggaaa

SEQ ID NO: 1056939 - RNA, 21 nt, Homo sapiens
auccuugugaaccccaaagug

SEQ ID NO: 1056940 - RNA, 15 nt, Homo sapiens
auccuuucuauugaa

SEQ ID NO: 1056941 - RNA, 19 nt, Homo sapiens
auccuuuuaaaucuugaua

SEQ ID NO: 1056942 - RNA, 18 nt, Homo sapiens
aucgagaccaucuuggcc

SEQ ID NO: 1056943 - RNA, 22 nt, Homo sapiens
aucgaggaaccagagccaugga

SEQ ID NO: 1056944 - RNA, 17 nt, Homo sapiens
aucgaugcagugcuucc

SEQ ID NO: 1056945 - RNA, 17 nt, Homo sapiens
aucgauuugcacccacc

SEQ ID NO: 1056946 - RNA, 19 nt, Homo sapiens
aucgcagcuucagcaucuc

SEQ ID NO: 1056947 - RNA, 15 nt, Homo sapiens
aucgcuccucuccag

SEQ ID NO: 1056948 - RNA, 15 nt, Homo sapiens
aucugugccugagaa

SEQ ID NO: 1056949 - RNA, 22 nt, Homo sapiens
aucuguugcaaacucagccuca

SEQ ID NO: 1056950 - RNA, 20 nt, Homo sapiens
aucuguuugaucccuguuac

SEQ ID NO: 1056951 - RNA, 14 nt, Homo sapiens
aucuuaaaugccag

SEQ ID NO: 1056952 - RNA, 21 nt, Homo sapiens
aucuuaauuuugguuguauuc

SEQ ID NO: 1056953 - RNA, 15 nt, Homo sapiens
aucuuacuguaccug

SEQ ID NO: 1056954 - RNA, 23 nt, Homo sapiens
aucuuagcuucuauuauagccac

SEQ ID NO: 1056955 - RNA, 19 nt, Homo sapiens
aucuucaaagcuugaagau

SEQ ID NO: 1056956 - RNA, 17 nt, Homo sapiens
aucuucacaaaacacuu

SEQ ID NO: 1056957 - RNA, 18 nt, Homo sapiens
aucuuccaaggguacuaa

SEQ ID NO: 1056958 - RNA, 21 nt, Homo sapiens
aucuuccaaggguacuaagga

SEQ ID NO: 1056959 - RNA, 22 nt, Homo sapiens
aucuuccaaggguacuaaggaa

SEQ ID NO: 1056960 - RNA, 15 nt, Homo sapiens
aucuucccacagugg

SEQ ID NO: 1056961 - RNA, 15 nt, Homo sapiens
aucuugauaccaccu

SEQ ID NO: 1056962 - RNA, 18 nt, Homo sapiens
aucuugaucuguguuuua

SEQ ID NO: 1056963 - RNA, 16 nt, Homo sapiens
aucuuggggacaucuc

SEQ ID NO: 1056964 - RNA, 15 nt, Homo sapiens
aucuuguuuuuccac

SEQ ID NO: 1056965 - RNA, 23 nt, Homo sapiens
aucuuguuuuuccacuacugcua

SEQ ID NO: 1056966 - RNA, 12 nt, Homo sapiens
aucuuuacuacu

SEQ ID NO: 1056967 - RNA, 23 nt, Homo sapiens
aucuuuaggagacuaauggaaau

SEQ ID NO: 1056968 - RNA, 22 nt, Homo sapiens
aucuuucacacuuccaccagcc

SEQ ID NO: 1056969 - RNA, 21 nt, Homo sapiens
aucuuucaggacucuaccuca

SEQ ID NO: 1056970 - RNA, 19 nt, Homo sapiens
aucuuuccuaggcagauca

SEQ ID NO: 1056971 - RNA, 18 nt, Homo sapiens
aucuuucuuuaccugaga

SEQ ID NO: 1056972 - RNA, 20 nt, Homo sapiens
aucuuuggacagaagcagcu

SEQ ID NO: 1056973 - RNA, 23 nt, Homo sapiens
aucuuuggacagaagcagcucuu

SEQ ID NO: 1056974 - RNA, 15 nt, Homo sapiens
aucuuuucacaaaua

SEQ ID NO: 1056975 - RNA, 14 nt, Homo sapiens
aucuuuugugagau

SEQ ID NO: 1056976 - RNA, 19 nt, Homo sapiens
aucuuuuuuuuauuccaca

SEQ ID NO: 1056977 - RNA, 20 nt, Homo sapiens
augaaaaaaaguacauguau

SEQ ID NO: 1056978 - RNA, 20 nt, Homo sapiens
augaaaaauaagucacuuau

SEQ ID NO: 1056979 - RNA, 20 nt, Homo sapiens
augaaaagauuaugaucuca

SEQ ID NO: 1056980 - RNA, 22 nt, Homo sapiens
augaaaagauuaugaucucaga

SEQ ID NO: 1056981 - RNA, 21 nt, Homo sapiens
augaaaagcugaauccagauc

SEQ ID NO: 1056982 - RNA, 17 nt, Homo sapiens
augaaaaugaaucuuca

SEQ ID NO: 1056983 - RNA, 13 nt, Homo sapiens
augaaaaugucag

SEQ ID NO: 1056984 - RNA, 19 nt, Homo sapiens
augaaacaccuucucugga

SEQ ID NO: 1056985 - RNA, 16 nt, Homo sapiens
augaaacauguucuca

SEQ ID NO: 1056986 - RNA, 19 nt, Homo sapiens
augaaacccccacacacac

SEQ ID NO: 1056987 - RNA, 14 nt, Homo sapiens
augaaauuacuuau

SEQ ID NO: 1056988 - RNA, 20 nt, Homo sapiens
augaaauuguaaaaccuguc

SEQ ID NO: 1056989 - RNA, 20 nt, Homo sapiens
augaacaaauugaacucuuu

SEQ ID NO: 1056990 - RNA, 17 nt, Homo sapiens
augaacauauuguugaa

SEQ ID NO: 1056991 - RNA, 15 nt, Homo sapiens
augaacucuuaauca

SEQ ID NO: 1056992 - RNA, 16 nt, Homo sapiens
augaagcaaacacauu

SEQ ID NO: 1056993 - RNA, 20 nt, Homo sapiens
augaagcaagccccacuuau

SEQ ID NO: 1056994 - RNA, 23 nt, Homo sapiens
augaagcagcuuuaaacaaauuc

SEQ ID NO: 1056995 - RNA, 20 nt, Homo sapiens
augaaguguguuuccuucag

SEQ ID NO: 1056996 - RNA, 18 nt, Homo sapiens
augaauauuuuguaacua

SEQ ID NO: 1056997 - RNA, 20 nt, Homo sapiens
augaauauuuuguaacuauu

SEQ ID NO: 1056998 - RNA, 21 nt, Homo sapiens
augaauauuuuugucauuaaa

SEQ ID NO: 1056999 - RNA, 17 nt, Homo sapiens
augaaucaaagacaugg

SEQ ID NO: 1057000 - RNA, 22 nt, Homo sapiens
augaaucaaucaauucauaucu

SEQ ID NO: 1057001 - RNA, 14 nt, Homo sapiens
augaaugaauggcu

SEQ ID NO: 1057002 - RNA, 17 nt, Homo sapiens
augaaugggagugaggg

SEQ ID NO: 1057003 - RNA, 19 nt, Homo sapiens
augaauugcauuuuacuuu

SEQ ID NO: 1057004 - RNA, 12 nt, Homo sapiens
augacaaaaagc

SEQ ID NO: 1057005 - RNA, 14 nt, Homo sapiens
augacaaagaguag

SEQ ID NO: 1057006 - RNA, 20 nt, Homo sapiens
augacaucacuuguacaaaa

SEQ ID NO: 1057007 - RNA, 14 nt, Homo sapiens
augacaucucaggg

SEQ ID NO: 1057008 - RNA, 18 nt, Homo sapiens
augacaucucaggggcca

SEQ ID NO: 1057009 - RNA, 17 nt, Homo sapiens
augacauucaugccugg

SEQ ID NO: 1057010 - RNA, 13 nt, Homo sapiens
augaccuggaaau

SEQ ID NO: 1057011 - RNA, 22 nt, Homo sapiens
augacggcucaugccuguaauc

SEQ ID NO: 1057012 - RNA, 12 nt, Homo sapiens
augacuaaagag

SEQ ID NO: 1057013 - RNA, 13 nt, Homo sapiens
augacucacauga

SEQ ID NO: 1057014 - RNA, 20 nt, Homo sapiens
augagaaaguucucauuuaa

SEQ ID NO: 1057015 - RNA, 19 nt, Homo sapiens
augagaaauuuuguugaua

SEQ ID NO: 1057016 - RNA, 21 nt, Homo sapiens
augagaaggcagccaccagcg

SEQ ID NO: 1057017 - RNA, 22 nt, Homo sapiens
augagaauuugagugcucugau

SEQ ID NO: 1057018 - RNA, 14 nt, Homo sapiens
augagagaacugga

SEQ ID NO: 1057019 - RNA, 18 nt, Homo sapiens
augagagaauaagucaug

SEQ ID NO: 1057020 - RNA, 23 nt, Homo sapiens
augagaguuucuguuaaucaugu

SEQ ID NO: 1057021 - RNA, 18 nt, Homo sapiens
augagaucuaggugagga

SEQ ID NO: 1057022 - RNA, 19 nt, Homo sapiens
augagauguuaaauacuuu

SEQ ID NO: 1057023 - RNA, 24 nt, Homo sapiens
augagcauccucucucacauggaa

SEQ ID NO: 1057024 - RNA, 15 nt, Homo sapiens
augagcccuagaaga

SEQ ID NO: 1057025 - RNA, 20 nt, Homo sapiens
augagccuggcaagaaugug

SEQ ID NO: 1057026 - RNA, 24 nt, Homo sapiens
augaggccacugcugcuucuccau

SEQ ID NO: 1057027 - RNA, 13 nt, Homo sapiens
augagggaaaaug

SEQ ID NO: 1057028 - RNA, 20 nt, Homo sapiens
augagguacucuccuggaaa

SEQ ID NO: 1057029 - RNA, 16 nt, Homo sapiens
augaguaacaggaaaa

SEQ ID NO: 1057030 - RNA, 13 nt, Homo sapiens
augaguacccaaa

SEQ ID NO: 1057031 - RNA, 17 nt, Homo sapiens
augaguccccugugaga

SEQ ID NO: 1057032 - RNA, 20 nt, Homo sapiens
augaguggagguuaaggcug

SEQ ID NO: 1057033 - RNA, 16 nt, Homo sapiens
augauaacugcaauuu

SEQ ID NO: 1057034 - RNA, 15 nt, Homo sapiens
augauacaguugcau

SEQ ID NO: 1057035 - RNA, 14 nt, Homo sapiens
augauagcuacugu

SEQ ID NO: 1057036 - RNA, 22 nt, Homo sapiens
augauccuaggcauuugcugaa

SEQ ID NO: 1057037 - RNA, 15 nt, Homo sapiens
augaucgcuaucuag

SEQ ID NO: 1057038 - RNA, 23 nt, Homo sapiens
augaucuagagccaguuacuuug

SEQ ID NO: 1057039 - RNA, 15 nt, Homo sapiens
augaucuagguuuaa

SEQ ID NO: 1057040 - RNA, 19 nt, Homo sapiens
augaucuagguuuaacuca

SEQ ID NO: 1057041 - RNA, 12 nt, Homo sapiens
augaucucaggu

SEQ ID NO: 1057042 - RNA, 19 nt, Homo sapiens
augaugagcuccucuuccu

SEQ ID NO: 1057043 - RNA, 12 nt, Homo sapiens
augaugaucugg

SEQ ID NO: 1057044 - RNA, 23 nt, Homo sapiens
augauucacccccaaacagugac

SEQ ID NO: 1057045 - RNA, 19 nt, Homo sapiens
augauuccaccuacaugag

SEQ ID NO: 1057046 - RNA, 14 nt, Homo sapiens
augauugugcacau

SEQ ID NO: 1057047 - RNA, 21 nt, Homo sapiens
augauuuacucaauaucugaa

SEQ ID NO: 1057048 - RNA, 17 nt, Homo sapiens
augcaaaguacauguau

SEQ ID NO: 1057049 - RNA, 15 nt, Homo sapiens
augcaaaucaauuac

SEQ ID NO: 1057050 - RNA, 16 nt, Homo sapiens
augcaacaacauguau

SEQ ID NO: 1057051 - RNA, 18 nt, Homo sapiens
augcaaccuuuggaugca

SEQ ID NO: 1057052 - RNA, 21 nt, Homo sapiens
augcaagcaagaaacacuggg

SEQ ID NO: 1057053 - RNA, 22 nt, Homo sapiens
augcaaggaaggaaagaaagaa

SEQ ID NO: 1057054 - RNA, 22 nt, Homo sapiens
augcaaggggaaaaucucagca

SEQ ID NO: 1057055 - RNA, 13 nt, Homo sapiens
augcacacaaaac

SEQ ID NO: 1057056 - RNA, 18 nt, Homo sapiens
augcaccuugugucugua

SEQ ID NO: 1057057 - RNA, 20 nt, Homo sapiens
augcacuuccuuaccuagug

SEQ ID NO: 1057058 - RNA, 17 nt, Homo sapiens
augcagaguugacauga

SEQ ID NO: 1057059 - RNA, 13 nt, Homo sapiens
augcagcaucuaa

SEQ ID NO: 1057060 - RNA, 21 nt, Homo sapiens
augcagcucacuacccuauuc

SEQ ID NO: 1057061 - RNA, 18 nt, Homo sapiens
augcagugauauggcaga

SEQ ID NO: 1057062 - RNA, 16 nt, Homo sapiens
augcaguuuuccuuaa

SEQ ID NO: 1057063 - RNA, 14 nt, Homo sapiens
augcauacacacac

SEQ ID NO: 1057064 - RNA, 13 nt, Homo sapiens
augcauacaguaa

SEQ ID NO: 1057065 - RNA, 17 nt, Homo sapiens
augcauggaaauucccu

SEQ ID NO: 1057066 - RNA, 16 nt, Homo sapiens
augcauguacccuaag

SEQ ID NO: 1057067 - RNA, 22 nt, Homo sapiens
augcaugugaagaaaggguguu

SEQ ID NO: 1057068 - RNA, 15 nt, Homo sapiens
augcauugcuaaaau

SEQ ID NO: 1057069 - RNA, 15 nt, Homo sapiens
augccaaauguucca

SEQ ID NO: 1057070 - RNA, 18 nt, Homo sapiens
augccaaccggucaccca

SEQ ID NO: 1057071 - RNA, 17 nt, Homo sapiens
augccaagacaugauua

SEQ ID NO: 1057072 - RNA, 22 nt, Homo sapiens
augccacacggcucucaccagu

SEQ ID NO: 1057073 - RNA, 18 nt, Homo sapiens
augccaccgcuuccggcu

SEQ ID NO: 1057074 - RNA, 20 nt, Homo sapiens
augccagaaugacuucugac

SEQ ID NO: 1057075 - RNA, 18 nt, Homo sapiens
augccagcuuaucucagg

SEQ ID NO: 1057076 - RNA, 21 nt, Homo sapiens
augccccccucaaaccuccuc

SEQ ID NO: 1057077 - RNA, 19 nt, Homo sapiens
augcccuguaccugugcac

SEQ ID NO: 1057078 - RNA, 17 nt, Homo sapiens
augccuguaaucccagc

SEQ ID NO: 1057079 - RNA, 19 nt, Homo sapiens
augccuucacuuuacaaau

SEQ ID NO: 1057080 - RNA, 22 nt, Homo sapiens
augccuuccagcacccugcaaa

SEQ ID NO: 1057081 - RNA, 18 nt, Homo sapiens
augcgagugcucauuuca

SEQ ID NO: 1057082 - RNA, 15 nt, Homo sapiens
augcgcacugcauuc

SEQ ID NO: 1057083 - RNA, 14 nt, Homo sapiens
augcggucuaggga

SEQ ID NO: 1057084 - RNA, 15 nt, Homo sapiens
augcguuuaaucaca

SEQ ID NO: 1057085 - RNA, 21 nt, Homo sapiens
augcuacaagacgggcaaaau

SEQ ID NO: 1057086 - RNA, 17 nt, Homo sapiens
augcucugcauguuaca

SEQ ID NO: 1057087 - RNA, 16 nt, Homo sapiens
augcugaacauugcau

SEQ ID NO: 1057088 - RNA, 16 nt, Homo sapiens
augcugacccaugcaa

SEQ ID NO: 1057089 - RNA, 21 nt, Homo sapiens
augcugauguccucaccacau

SEQ ID NO: 1057090 - RNA, 15 nt, Homo sapiens
augcugcuguuuaca

SEQ ID NO: 1057091 - RNA, 19 nt, Homo sapiens
augcugcuuguuggcucca

SEQ ID NO: 1057092 - RNA, 15 nt, Homo sapiens
augcuggcauuugca

SEQ ID NO: 1057093 - RNA, 23 nt, Homo sapiens
augcuggcauuugcaccuaccuc

SEQ ID NO: 1057094 - RNA, 15 nt, Homo sapiens
augcuguuccaccuc

SEQ ID NO: 1057095 - RNA, 14 nt, Homo sapiens
augcuuacaaaguc

SEQ ID NO: 1057096 - RNA, 15 nt, Homo sapiens
augcuuccugacaau

SEQ ID NO: 1057097 - RNA, 15 nt, Homo sapiens
augcuuguacauaau

SEQ ID NO: 1057098 - RNA, 21 nt, Homo sapiens
augcuuugccccugagacaaa

SEQ ID NO: 1057099 - RNA, 17 nt, Homo sapiens
auggaaaagggagauuc

SEQ ID NO: 1057100 - RNA, 18 nt, Homo sapiens
auggaaacugaaugcucc

SEQ ID NO: 1057101 - RNA, 20 nt, Homo sapiens
auggaaagaaucuaauagag

SEQ ID NO: 1057102 - RNA, 19 nt, Homo sapiens
auggaauaaacuccauuua

SEQ ID NO: 1057103 - RNA, 14 nt, Homo sapiens
auggaauuacaugu

SEQ ID NO: 1057104 - RNA, 20 nt, Homo sapiens
auggaauuuuucauugauau

SEQ ID NO: 1057105 - RNA, 23 nt, Homo sapiens
auggacaccccuuauccaggacu

SEQ ID NO: 1057106 - RNA, 18 nt, Homo sapiens
auggacauaagacagaca

SEQ ID NO: 1057107 - RNA, 13 nt, Homo sapiens
auggacucugcac

SEQ ID NO: 1057108 - RNA, 17 nt, Homo sapiens
auggagcaggacucuau

SEQ ID NO: 1057109 - RNA, 18 nt, Homo sapiens
auggaggaaagugauauc

SEQ ID NO: 1057110 - RNA, 16 nt, Homo sapiens
auggagugaccauagc

SEQ ID NO: 1057111 - RNA, 21 nt, Homo sapiens
auggagugaccauagcuccuu

SEQ ID NO: 1057112 - RNA, 20 nt, Homo sapiens
auggagugggugucucugca

SEQ ID NO: 1057113 - RNA, 21 nt, Homo sapiens
auggagugggugucucugcau

SEQ ID NO: 1057114 - RNA, 13 nt, Homo sapiens
auggaguuucccu

SEQ ID NO: 1057115 - RNA, 17 nt, Homo sapiens
auggaucuuaaagcauu

SEQ ID NO: 1057116 - RNA, 18 nt, Homo sapiens
auggaucuuaaagcauuc

SEQ ID NO: 1057117 - RNA, 18 nt, Homo sapiens
auggauguuuuagccauu

SEQ ID NO: 1057118 - RNA, 16 nt, Homo sapiens
auggauuugaugcugu

SEQ ID NO: 1057119 - RNA, 18 nt, Homo sapiens
auggcaaaaacaaagguc

SEQ ID NO: 1057120 - RNA, 16 nt, Homo sapiens
auggcacccaugcacc

SEQ ID NO: 1057121 - RNA, 17 nt, Homo sapiens
auggcacccaugcaccu

SEQ ID NO: 1057122 - RNA, 14 nt, Homo sapiens
auggcauugaacug

SEQ ID NO: 1057123 - RNA, 13 nt, Homo sapiens
auggccacuguga

SEQ ID NO: 1057124 - RNA, 14 nt, Homo sapiens
auggccaggccaga

SEQ ID NO: 1057125 - RNA, 20 nt, Homo sapiens
auggccccggugcggcugca

SEQ ID NO: 1057126 - RNA, 19 nt, Homo sapiens
auggccccugccuucccag

SEQ ID NO: 1057127 - RNA, 16 nt, Homo sapiens
auggccuuugcuugaa

SEQ ID NO: 1057128 - RNA, 14 nt, Homo sapiens
auggcgugaucucg

SEQ ID NO: 1057129 - RNA, 16 nt, Homo sapiens
auggcuaccaaaaaga

SEQ ID NO: 1057130 - RNA, 21 nt, Homo sapiens
auggcucagaugccacuucaa

SEQ ID NO: 1057131 - RNA, 14 nt, Homo sapiens
auggcuccagaaau

SEQ ID NO: 1057132 - RNA, 16 nt, Homo sapiens
auggcucuacuuucag

SEQ ID NO: 1057133 - RNA, 22 nt, Homo sapiens
auggcuguaaaucuauuggcca

SEQ ID NO: 1057134 - RNA, 16 nt, Homo sapiens
auggcuuuugugcauu

SEQ ID NO: 1057135 - RNA, 18 nt, Homo sapiens
augggaaggguccaucuc

SEQ ID NO: 1057136 - RNA, 20 nt, Homo sapiens
augggaaggguccaucucag

SEQ ID NO: 1057137 - RNA, 19 nt, Homo sapiens
augggagaaucacuugaac

SEQ ID NO: 1057138 - RNA, 15 nt, Homo sapiens
augggaugaugauuc

SEQ ID NO: 1057139 - RNA, 20 nt, Homo sapiens
augggcaaauuaaggcauaa

SEQ ID NO: 1057140 - RNA, 19 nt, Homo sapiens
augggcagagcccaaggga

SEQ ID NO: 1057141 - RNA, 15 nt, Homo sapiens
augggcagcucaucu

SEQ ID NO: 1057142 - RNA, 17 nt, Homo sapiens
augggcagcucaucucu

SEQ ID NO: 1057143 - RNA, 18 nt, Homo sapiens
auggggagaaaagacaug

SEQ ID NO: 1057144 - RNA, 18 nt, Homo sapiens
auggguccauuuugcccu

SEQ ID NO: 1057145 - RNA, 20 nt, Homo sapiens
auggguuagggaaaacauuc

SEQ ID NO: 1057146 - RNA, 23 nt, Homo sapiens
auggguuagggaaaacauuccau

SEQ ID NO: 1057147 - RNA, 15 nt, Homo sapiens
auggguugcauuugg

SEQ ID NO: 1057148 - RNA, 18 nt, Homo sapiens
augguaaaaccccaucuc

SEQ ID NO: 1057149 - RNA, 16 nt, Homo sapiens
augguaaaaguuacuu

SEQ ID NO: 1057150 - RNA, 18 nt, Homo sapiens
augguagcauacuuuaua

SEQ ID NO: 1057151 - RNA, 20 nt, Homo sapiens
augguagugggugccuguaa

SEQ ID NO: 1057152 - RNA, 14 nt, Homo sapiens
auggucaaguauua

SEQ ID NO: 1057153 - RNA, 17 nt, Homo sapiens
auggucauagcccagau

SEQ ID NO: 1057154 - RNA, 21 nt, Homo sapiens
auggugaaaccccgucuguac

SEQ ID NO: 1057155 - RNA, 19 nt, Homo sapiens
auggugaaaccucaucucu

SEQ ID NO: 1057156 - RNA, 22 nt, Homo sapiens
auggugagaugcagcuggaaaa

SEQ ID NO: 1057157 - RNA, 19 nt, Homo sapiens
auggugcacugagcugcaa

SEQ ID NO: 1057158 - RNA, 19 nt, Homo sapiens
augguggacucgccuguaa

SEQ ID NO: 1057159 - RNA, 23 nt, Homo sapiens
augguggagggccacaugggagg

SEQ ID NO: 1057160 - RNA, 15 nt, Homo sapiens
augguggcaccagcg

SEQ ID NO: 1057161 - RNA, 17 nt, Homo sapiens
augguggccuggggcuu

SEQ ID NO: 1057162 - RNA, 14 nt, Homo sapiens
augguguguuaaag

SEQ ID NO: 1057163 - RNA, 21 nt, Homo sapiens
augguuucaauaaaccuaaua

SEQ ID NO: 1057164 - RNA, 13 nt, Homo sapiens
augguuucuccag

SEQ ID NO: 1057165 - RNA, 15 nt, Homo sapiens
auguaaaaugcaaaa

SEQ ID NO: 1057166 - RNA, 20 nt, Homo sapiens
auguaaacauaauucuugua

SEQ ID NO: 1057167 - RNA, 14 nt, Homo sapiens
auguaaacugugca

SEQ ID NO: 1057168 - RNA, 13 nt, Homo sapiens
auguaaauacugu

SEQ ID NO: 1057169 - RNA, 15 nt, Homo sapiens
auguaagcucuacug

SEQ ID NO: 1057170 - RNA, 16 nt, Homo sapiens
auguaaucucaccuca

SEQ ID NO: 1057171 - RNA, 15 nt, Homo sapiens
auguaccagcaucuc

SEQ ID NO: 1057172 - RNA, 16 nt, Homo sapiens
auguaccccaauuuac

SEQ ID NO: 1057173 - RNA, 22 nt, Homo sapiens
auguacccuaaggucauuacca

SEQ ID NO: 1057174 - RNA, 21 nt, Homo sapiens
auguagcaaaacgcauggagu

SEQ ID NO: 1057175 - RNA, 17 nt, Homo sapiens
auguaguuuuccauccu

SEQ ID NO: 1057176 - RNA, 16 nt, Homo sapiens
auguauccccacuuau

SEQ ID NO: 1057177 - RNA, 19 nt, Homo sapiens
auguauuuaaccagucuuc

SEQ ID NO: 1057178 - RNA, 21 nt, Homo sapiens
auguauuuauauuuugugcua

SEQ ID NO: 1057179 - RNA, 20 nt, Homo sapiens
auguauuuguuugcaauuuu

SEQ ID NO: 1057180 - RNA, 20 nt, Homo sapiens
augucaccguggaccuuccu

SEQ ID NO: 1057181 - RNA, 17 nt, Homo sapiens
augucagaaaccaguua

SEQ ID NO: 1057182 - RNA, 14 nt, Homo sapiens
augucagacuggcu

SEQ ID NO: 1057183 - RNA, 17 nt, Homo sapiens
augucagcaucagcuca

SEQ ID NO: 1057184 - RNA, 12 nt, Homo sapiens
augucagcuuau

SEQ ID NO: 1057185 - RNA, 21 nt, Homo sapiens
augucaggcaaagugcugcug

SEQ ID NO: 1057186 - RNA, 20 nt, Homo sapiens
augucaguggaagaagcaga

SEQ ID NO: 1057187 - RNA, 19 nt, Homo sapiens
augucauuguucuugugaa

SEQ ID NO: 1057188 - RNA, 16 nt, Homo sapiens
augucauuuccuucaa

SEQ ID NO: 1057189 - RNA, 22 nt, Homo sapiens
auguccaagaagcccaggaaag

SEQ ID NO: 1057190 - RNA, 22 nt, Homo sapiens
augucccuauggaagcauauug

SEQ ID NO: 1057191 - RNA, 23 nt, Homo sapiens
augucccuugcugugagcaagaa

SEQ ID NO: 1057192 - RNA, 21 nt, Homo sapiens
augucccuuucuuggccaguu

SEQ ID NO: 1057193 - RNA, 19 nt, Homo sapiens
augucguuugaaucacagu

SEQ ID NO: 1057194 - RNA, 21 nt, Homo sapiens
augucguuugaaucacaguau

SEQ ID NO: 1057195 - RNA, 23 nt, Homo sapiens
augucuaagguccccacugccug

SEQ ID NO: 1057196 - RNA, 18 nt, Homo sapiens
augucuagccacugauca

SEQ ID NO: 1057197 - RNA, 15 nt, Homo sapiens
augucuauucagcuu

SEQ ID NO: 1057198 - RNA, 16 nt, Homo sapiens
augucuauucagcuuc

SEQ ID NO: 1057199 - RNA, 14 nt, Homo sapiens
augucuccaucucu

SEQ ID NO: 1057200 - RNA, 13 nt, Homo sapiens
augucucucauga

SEQ ID NO: 1057201 - RNA, 17 nt, Homo sapiens
augucucuucugagcua

SEQ ID NO: 1057202 - RNA, 16 nt, Homo sapiens
augucuguuaacuuaa

SEQ ID NO: 1057203 - RNA, 20 nt, Homo sapiens
augucuuaaucaugagauaa

SEQ ID NO: 1057204 - RNA, 20 nt, Homo sapiens
augucuuuccuuuugcucuu

SEQ ID NO: 1057205 - RNA, 22 nt, Homo sapiens
augugaauaaauucuauaggaa

SEQ ID NO: 1057206 - RNA, 16 nt, Homo sapiens
augugaaucaugguuu

SEQ ID NO: 1057207 - RNA, 15 nt, Homo sapiens
augugauccuuuuau

SEQ ID NO: 1057208 - RNA, 17 nt, Homo sapiens
augugcaaguguaugca

SEQ ID NO: 1057209 - RNA, 11 nt, Homo sapiens
augugcaauaa

SEQ ID NO: 1057210 - RNA, 11 nt, Homo sapiens
augugcaauau

SEQ ID NO: 1057211 - RNA, 14 nt, Homo sapiens
augugcacaugcac

SEQ ID NO: 1057212 - RNA, 19 nt, Homo sapiens
augugcagguuuugaaaau

SEQ ID NO: 1057213 - RNA, 15 nt, Homo sapiens
augugcuguguaaag

SEQ ID NO: 1057214 - RNA, 17 nt, Homo sapiens
auguggaaaaaugagag

SEQ ID NO: 1057215 - RNA, 18 nt, Homo sapiens
augugggagggagcagac

SEQ ID NO: 1057216 - RNA, 21 nt, Homo sapiens
augugggggucuguguguuua

SEQ ID NO: 1057217 - RNA, 16 nt, Homo sapiens
augugggugggaccac

SEQ ID NO: 1057218 - RNA, 19 nt, Homo sapiens
augugggugggaccacaga

SEQ ID NO: 1057219 - RNA, 17 nt, Homo sapiens
augugggugucagucag

SEQ ID NO: 1057220 - RNA, 18 nt, Homo sapiens
auguguagccugugcaug

SEQ ID NO: 1057221 - RNA, 14 nt, Homo sapiens
augugugaggagcu

SEQ ID NO: 1057222 - RNA, 14 nt, Homo sapiens
augugugagugugu

SEQ ID NO: 1057223 - RNA, 16 nt, Homo sapiens
augugugauucacagu

SEQ ID NO: 1057224 - RNA, 12 nt, Homo sapiens
augugugugcaa

SEQ ID NO: 1057225 - RNA, 16 nt, Homo sapiens
auguguguguguugug

SEQ ID NO: 1057226 - RNA, 17 nt, Homo sapiens
auguguuuuaauuccaa

SEQ ID NO: 1057227 - RNA, 16 nt, Homo sapiens
auguguuuuuuuacau

SEQ ID NO: 1057228 - RNA, 20 nt, Homo sapiens
auguuaauuauuuugacaaa

SEQ ID NO: 1057229 - RNA, 21 nt, Homo sapiens
auguuacucaugacuccuuuc

SEQ ID NO: 1057230 - RNA, 16 nt, Homo sapiens
auguuacugaccagca

SEQ ID NO: 1057231 - RNA, 23 nt, Homo sapiens
auguuaggaaaauuucacauuaa

SEQ ID NO: 1057232 - RNA, 13 nt, Homo sapiens
auguuaugcauaa

SEQ ID NO: 1057233 - RNA, 15 nt, Homo sapiens
auguuauuugcucua

SEQ ID NO: 1057234 - RNA, 20 nt, Homo sapiens
auguucaacuauuaauggau

SEQ ID NO: 1057235 - RNA, 14 nt, Homo sapiens
auguuccucaaaag

SEQ ID NO: 1057236 - RNA, 20 nt, Homo sapiens
auguucugggacacaguuca

SEQ ID NO: 1057237 - RNA, 20 nt, Homo sapiens
auguugaugaaaaauagcaa

SEQ ID NO: 1057238 - RNA, 20 nt, Homo sapiens
auguugcccaguguguuucu

SEQ ID NO: 1057239 - RNA, 15 nt, Homo sapiens
auguuuaugagccag

SEQ ID NO: 1057240 - RNA, 15 nt, Homo sapiens
auguuucgcugauau

SEQ ID NO: 1057241 - RNA, 19 nt, Homo sapiens
auguuucgcugauauaugu

SEQ ID NO: 1057242 - RNA, 23 nt, Homo sapiens
auguuucgugaaguauacuguau

SEQ ID NO: 1057243 - RNA, 13 nt, Homo sapiens
auguuucuauucu

SEQ ID NO: 1057244 - RNA, 17 nt, Homo sapiens
auguuugcuauugacaa

SEQ ID NO: 1057245 - RNA, 13 nt, Homo sapiens
auguuugucagau

SEQ ID NO: 1057246 - RNA, 15 nt, Homo sapiens
auguuuugacaugaa

SEQ ID NO: 1057247 - RNA, 20 nt, Homo sapiens
auguuuuuaaacagugucau

SEQ ID NO: 1057248 - RNA, 13 nt, Homo sapiens
auuaaaacaaauc

SEQ ID NO: 1057249 - RNA, 22 nt, Homo sapiens
auuaaaauaagcacugugcuaa

SEQ ID NO: 1057250 - RNA, 21 nt, Homo sapiens
auuaaacugaaucacaaugua

SEQ ID NO: 1057251 - RNA, 20 nt, Homo sapiens
auuaacaacaauaacacugu

SEQ ID NO: 1057252 - RNA, 14 nt, Homo sapiens
auuaaccuggugcu

SEQ ID NO: 1057253 - RNA, 12 nt, Homo sapiens
auuaacuugagu

SEQ ID NO: 1057254 - RNA, 20 nt, Homo sapiens
auuaacuuuuauaaacuuua

SEQ ID NO: 1057255 - RNA, 16 nt, Homo sapiens
auuaaguacaugguca

SEQ ID NO: 1057256 - RNA, 22 nt, Homo sapiens
auuaagugacuguucaagagca

SEQ ID NO: 1057257 - RNA, 17 nt, Homo sapiens
auuaaucaucuauaaag

SEQ ID NO: 1057258 - RNA, 22 nt, Homo sapiens
auuaaugacaaaggcacugagg

SEQ ID NO: 1057259 - RNA, 18 nt, Homo sapiens
auuaauuaucuaguuuaa

SEQ ID NO: 1057260 - RNA, 19 nt, Homo sapiens
auuaauuccaacuguacuu

SEQ ID NO: 1057261 - RNA, 16 nt, Homo sapiens
auuaauugugugucac

SEQ ID NO: 1057262 - RNA, 23 nt, Homo sapiens
auuacaagcgugagccacugcac

SEQ ID NO: 1057263 - RNA, 14 nt, Homo sapiens
auuacaauugugag

SEQ ID NO: 1057264 - RNA, 21 nt, Homo sapiens
auuacacaucaagcgaugaaa

SEQ ID NO: 1057265 - RNA, 13 nt, Homo sapiens
auuacacauuuau

SEQ ID NO: 1057266 - RNA, 16 nt, Homo sapiens
auuacaggcacccacc

SEQ ID NO: 1057267 - RNA, 19 nt, Homo sapiens
auuacauauuugcauaugu

SEQ ID NO: 1057268 - RNA, 21 nt, Homo sapiens
auuacccccucauuguuuauu

SEQ ID NO: 1057269 - RNA, 19 nt, Homo sapiens
auuaccuaguagucauuuc

SEQ ID NO: 1057270 - RNA, 14 nt, Homo sapiens
auuaccuugugcua

SEQ ID NO: 1057271 - RNA, 19 nt, Homo sapiens
auuacuaaaguacagacau

SEQ ID NO: 1057272 - RNA, 17 nt, Homo sapiens
auuacuacucagccuuc

SEQ ID NO: 1057273 - RNA, 16 nt, Homo sapiens
auuacugguccaaaag

SEQ ID NO: 1057274 - RNA, 17 nt, Homo sapiens
auuagccaaguguggua

SEQ ID NO: 1057275 - RNA, 20 nt, Homo sapiens
auuagccagucuuuacagcu

SEQ ID NO: 1057276 - RNA, 19 nt, Homo sapiens
auuagccuaugugcaugca

SEQ ID NO: 1057277 - RNA, 22 nt, Homo sapiens
auuaguccuugcuuggcugcuu

SEQ ID NO: 1057278 - RNA, 15 nt, Homo sapiens
auuauaaaggccagc

SEQ ID NO: 1057279 - RNA, 18 nt, Homo sapiens
auuauagugacaaugaag

SEQ ID NO: 1057280 - RNA, 17 nt, Homo sapiens
auuaucacgcagaucac

SEQ ID NO: 1057281 - RNA, 20 nt, Homo sapiens
auuaucacuuuaaagcccuu

SEQ ID NO: 1057282 - RNA, 13 nt, Homo sapiens
auuaucaugcaaa

SEQ ID NO: 1057283 - RNA, 14 nt, Homo sapiens
auuauccuugcuau

SEQ ID NO: 1057284 - RNA, 23 nt, Homo sapiens
auuaucucaaaacugcacuguca

SEQ ID NO: 1057285 - RNA, 14 nt, Homo sapiens
auuaugacaguuau

SEQ ID NO: 1057286 - RNA, 17 nt, Homo sapiens
auuauguacucuacuga

SEQ ID NO: 1057287 - RNA, 20 nt, Homo sapiens
auuaugucucuucugagcua

SEQ ID NO: 1057288 - RNA, 18 nt, Homo sapiens
auuauuacuggcaaaaac

SEQ ID NO: 1057289 - RNA, 21 nt, Homo sapiens
auuauucugauuccacuuuua

SEQ ID NO: 1057290 - RNA, 15 nt, Homo sapiens
auuauugugccucag

SEQ ID NO: 1057291 - RNA, 17 nt, Homo sapiens
auuauuuuaagcacuug

SEQ ID NO: 1057292 - RNA, 14 nt, Homo sapiens
auuauuuuaaucua

SEQ ID NO: 1057293 - RNA, 13 nt, Homo sapiens
auuauuuuuacag

SEQ ID NO: 1057294 - RNA, 19 nt, Homo sapiens
auuauuuuucacugcccca

SEQ ID NO: 1057295 - RNA, 18 nt, Homo sapiens
auuauuuuuccacuuugu

SEQ ID NO: 1057296 - RNA, 17 nt, Homo sapiens
auucaaacugccuauau

SEQ ID NO: 1057297 - RNA, 18 nt, Homo sapiens
auucaaauuuuaucucca

SEQ ID NO: 1057298 - RNA, 13 nt, Homo sapiens
auucaaguguaca

SEQ ID NO: 1057299 - RNA, 19 nt, Homo sapiens
auucacaagacccaaaagg

SEQ ID NO: 1057300 - RNA, 12 nt, Homo sapiens
auucacaaugaa

SEQ ID NO: 1057301 - RNA, 13 nt, Homo sapiens
auucacaguguga

SEQ ID NO: 1057302 - RNA, 20 nt, Homo sapiens
auucacccccaaacagugac

SEQ ID NO: 1057303 - RNA, 21 nt, Homo sapiens
auucacccccaaacagugaca

SEQ ID NO: 1057304 - RNA, 20 nt, Homo sapiens
auucagauggcaauuucacu

SEQ ID NO: 1057305 - RNA, 13 nt, Homo sapiens
auucagcaagaca

SEQ ID NO: 1057306 - RNA, 23 nt, Homo sapiens
auucagugcuguacuugaugaca

SEQ ID NO: 1057307 - RNA, 22 nt, Homo sapiens
auucauauuuacuucuuauaca

SEQ ID NO: 1057308 - RNA, 17 nt, Homo sapiens
auucaucucaaggaaua

SEQ ID NO: 1057309 - RNA, 10 nt, Homo sapiens
auucauucca

SEQ ID NO: 1057310 - RNA, 18 nt, Homo sapiens
auucauuuauucauucau

SEQ ID NO: 1057311 - RNA, 16 nt, Homo sapiens
auucauuucaaaggga

SEQ ID NO: 1057312 - RNA, 17 nt, Homo sapiens
auucauuuucugccuau

SEQ ID NO: 1057313 - RNA, 20 nt, Homo sapiens
auucauuuuuuucacuggag

SEQ ID NO: 1057314 - RNA, 14 nt, Homo sapiens
auuccaacagcuca

SEQ ID NO: 1057315 - RNA, 15 nt, Homo sapiens
auuccacacccucac

SEQ ID NO: 1057316 - RNA, 23 nt, Homo sapiens
auuccacacccucacugcuguag

SEQ ID NO: 1057317 - RNA, 14 nt, Homo sapiens
auuccacacuacca

SEQ ID NO: 1057318 - RNA, 13 nt, Homo sapiens
auuccacuggacu

SEQ ID NO: 1057319 - RNA, 18 nt, Homo sapiens
auuccacuuuuauucauu

SEQ ID NO: 1057320 - RNA, 13 nt, Homo sapiens
auucccaccaagg

SEQ ID NO: 1057321 - RNA, 21 nt, Homo sapiens
auucccaucauacacuuccuu

SEQ ID NO: 1057322 - RNA, 16 nt, Homo sapiens
auucccuccugcuacu

SEQ ID NO: 1057323 - RNA, 14 nt, Homo sapiens
auuccgucuuaaaa

SEQ ID NO: 1057324 - RNA, 20 nt, Homo sapiens
auuccuauauaguuuauuga

SEQ ID NO: 1057325 - RNA, 20 nt, Homo sapiens
auuccuuagcuuagaccuca

SEQ ID NO: 1057326 - RNA, 14 nt, Homo sapiens
auuccuuagucuca

SEQ ID NO: 1057327 - RNA, 14 nt, Homo sapiens
auuccuugcacaua

SEQ ID NO: 1057328 - RNA, 20 nt, Homo sapiens
auucgaaccaggaaauggaa

SEQ ID NO: 1057329 - RNA, 21 nt, Homo sapiens
auucgcugcaaccuguugaua

SEQ ID NO: 1057330 - RNA, 17 nt, Homo sapiens
auucgcugugucagcau

SEQ ID NO: 1057331 - RNA, 12 nt, Homo sapiens
auucgugcagca

SEQ ID NO: 1057332 - RNA, 16 nt, Homo sapiens
auucuacacagagcag

SEQ ID NO: 1057333 - RNA, 20 nt, Homo sapiens
auucuaccgugguacacagu

SEQ ID NO: 1057334 - RNA, 18 nt, Homo sapiens
auucuacugaacacuuca

SEQ ID NO: 1057335 - RNA, 13 nt, Homo sapiens
auucuaggcaucc

SEQ ID NO: 1057336 - RNA, 11 nt, Homo sapiens
auucuaugagg

SEQ ID NO: 1057337 - RNA, 14 nt, Homo sapiens
auucucaccaggaa

SEQ ID NO: 1057338 - RNA, 18 nt, Homo sapiens
auucucaggccaucauca

SEQ ID NO: 1057339 - RNA, 22 nt, Homo sapiens
auucucaggccaucaucagugg

SEQ ID NO: 1057340 - RNA, 22 nt, Homo sapiens
auucucaguguagggcagagag

SEQ ID NO: 1057341 - RNA, 14 nt, Homo sapiens
auucucaugugauc

SEQ ID NO: 1057342 - RNA, 21 nt, Homo sapiens
auucucaugugauccuuuuau

SEQ ID NO: 1057343 - RNA, 16 nt, Homo sapiens
auucucauuugucaca

SEQ ID NO: 1057344 - RNA, 18 nt, Homo sapiens
auucucugagcugugcag

SEQ ID NO: 1057345 - RNA, 13 nt, Homo sapiens
auucucugaguca

SEQ ID NO: 1057346 - RNA, 19 nt, Homo sapiens
auucucugucucauccauc

SEQ ID NO: 1057347 - RNA, 17 nt, Homo sapiens
auucugaaucaagguga

SEQ ID NO: 1057348 - RNA, 14 nt, Homo sapiens
auucugacucauau

SEQ ID NO: 1057349 - RNA, 23 nt, Homo sapiens
auucugagguaaccucauuauca

SEQ ID NO: 1057350 - RNA, 16 nt, Homo sapiens
caccccucacucuggc

SEQ ID NO: 1057351 - RNA, 23 nt, Homo sapiens
caccccugugcuccgugccucca

SEQ ID NO: 1057352 - RNA, 19 nt, Homo sapiens
cucugcuugauuuuugccu

SEQ ID NO: 1057353 - RNA, 20 nt, Homo sapiens
cucugcuuucccuuuuccau

SEQ ID NO: 1057354 - RNA, 15 nt, Homo sapiens
cucuggacacagccc

SEQ ID NO: 1057355 - RNA, 20 nt, Homo sapiens
cucuggacaggcauguucuc

SEQ ID NO: 1057356 - RNA, 11 nt, Homo sapiens
cucuggaccag

SEQ ID NO: 1057357 - RNA, 16 nt, Homo sapiens
cucuggaccagccugu

SEQ ID NO: 1057358 - RNA, 15 nt, Homo sapiens
cucuggauggcacca

SEQ ID NO: 1057359 - RNA, 15 nt, Homo sapiens
cucuggcgacaguuu

SEQ ID NO: 1057360 - RNA, 17 nt, Homo sapiens
cucugggccaagucaaa

SEQ ID NO: 1057361 - RNA, 21 nt, Homo sapiens
cucuggggucuuuuuaugcau

SEQ ID NO: 1057362 - RNA, 14 nt, Homo sapiens
cucugguccauaga

SEQ ID NO: 1057363 - RNA, 16 nt, Homo sapiens
cucuggugacaccagc

SEQ ID NO: 1057364 - RNA, 13 nt, Homo sapiens
cucuguauguacu

SEQ ID NO: 1057365 - RNA, 23 nt, Homo sapiens
cucugucuugggcguuugaacuc

SEQ ID NO: 1057366 - RNA, 15 nt, Homo sapiens
cucuguuguccuccc

SEQ ID NO: 1057367 - RNA, 18 nt, Homo sapiens
cucuguuuucaugcuauu

SEQ ID NO: 1057368 - RNA, 16 nt, Homo sapiens
cucuuaaguuucucag

SEQ ID NO: 1057369 - RNA, 20 nt, Homo sapiens
cucuuaaguuucucagcucc

SEQ ID NO: 1057370 - RNA, 16 nt, Homo sapiens
cucuuagaaaaaccac

SEQ ID NO: 1057371 - RNA, 12 nt, Homo sapiens
cucuuagcacac

SEQ ID NO: 1057372 - RNA, 12 nt, Homo sapiens
cucuuaucucag

SEQ ID NO: 1057373 - RNA, 12 nt, Homo sapiens
cucuucaaggac

SEQ ID NO: 1057374 - RNA, 16 nt, Homo sapiens
cucuucaaucucuugc

SEQ ID NO: 1057375 - RNA, 21 nt, Homo sapiens
cucuucccauaccacccaaug

SEQ ID NO: 1057376 - RNA, 16 nt, Homo sapiens
cucuucugccuucuca

SEQ ID NO: 1057377 - RNA, 22 nt, Homo sapiens
cucuucuucuuucuacaguauu

SEQ ID NO: 1057378 - RNA, 22 nt, Homo sapiens
cucuucuuuuggcuuccaugau

SEQ ID NO: 1057379 - RNA, 16 nt, Homo sapiens
cucuugaagacacuga

SEQ ID NO: 1057380 - RNA, 17 nt, Homo sapiens
cucuugaagacacugaa

SEQ ID NO: 1057381 - RNA, 20 nt, Homo sapiens
cucuugagggagcuuagcca

SEQ ID NO: 1057382 - RNA, 12 nt, Homo sapiens
cucuugcucaaa

SEQ ID NO: 1057383 - RNA, 20 nt, Homo sapiens
cucuuguuucuuuucacaua

SEQ ID NO: 1057384 - RNA, 12 nt, Homo sapiens
cucuuuaacuuc

SEQ ID NO: 1057385 - RNA, 15 nt, Homo sapiens
cucuuuaaugucaca

SEQ ID NO: 1057386 - RNA, 12 nt, Homo sapiens
cucuuucacuuc

SEQ ID NO: 1057387 - RNA, 12 nt, Homo sapiens
cucuuucgccaa

SEQ ID NO: 1057388 - RNA, 17 nt, Homo sapiens
cucuuuuagcugaugaa

SEQ ID NO: 1057389 - RNA, 17 nt, Homo sapiens
cucuuuugaauccaugc

SEQ ID NO: 1057390 - RNA, 14 nt, Homo sapiens
cucuuuugagcuaa

SEQ ID NO: 1057391 - RNA, 15 nt, Homo sapiens
cucuuuuucuagucu

SEQ ID NO: 1057392 - RNA, 19 nt, Homo sapiens
cugaaaacacugugcacau

SEQ ID NO: 1057393 - RNA, 14 nt, Homo sapiens
cugaaaaccucucc

SEQ ID NO: 1057394 - RNA, 22 nt, Homo sapiens
cugaaaagaucugaagguccca

SEQ ID NO: 1057395 - RNA, 18 nt, Homo sapiens
cugaaaaucgaguuuuuc

SEQ ID NO: 1057396 - RNA, 17 nt, Homo sapiens
cugaaaauuaacacugc

SEQ ID NO: 1057397 - RNA, 21 nt, Homo sapiens
cugaaagaacauggacuugua

SEQ ID NO: 1057398 - RNA, 17 nt, Homo sapiens
cugaaagagaaaucaau

SEQ ID NO: 1057399 - RNA, 16 nt, Homo sapiens
cugaaagaucuuucag

SEQ ID NO: 1057400 - RNA, 15 nt, Homo sapiens
cugaaagccauuugu

SEQ ID NO: 1057401 - RNA, 13 nt, Homo sapiens
cugaaaguacaaa

SEQ ID NO: 1057402 - RNA, 12 nt, Homo sapiens
cugaaagugaaa

SEQ ID NO: 1057403 - RNA, 18 nt, Homo sapiens
cacccgccgccuccugca

SEQ ID NO: 1057404 - RNA, 18 nt, Homo sapiens
cacccuccaccucuucac

SEQ ID NO: 1057405 - RNA, 14 nt, Homo sapiens
cacccucuccagau

SEQ ID NO: 1057406 - RNA, 23 nt, Homo sapiens
cacccuggaaucaagaugucaga

SEQ ID NO: 1057407 - RNA, 16 nt, Homo sapiens
cacccuggaggauuuc

SEQ ID NO: 1057408 - RNA, 21 nt, Homo sapiens
cacccuguccaaacugccuaa

SEQ ID NO: 1057409 - RNA, 21 nt, Homo sapiens
cacccuuccccuccuucuccc

SEQ ID NO: 1057410 - RNA, 18 nt, Homo sapiens
caccuauaaaacagguca

SEQ ID NO: 1057411 - RNA, 22 nt, Homo sapiens
caccuauauagaugcagcauuu

SEQ ID NO: 1057412 - RNA, 23 nt, Homo sapiens
caccucacacuccuccaaggcac

SEQ ID NO: 1057413 - RNA, 21 nt, Homo sapiens
caccuccccagccuuugauca

SEQ ID NO: 1057414 - RNA, 16 nt, Homo sapiens
caccuccucauguaca

SEQ ID NO: 1057415 - RNA, 11 nt, Homo sapiens
caccucuccaa

SEQ ID NO: 1057416 - RNA, 22 nt, Homo sapiens
caccucucuccuuugcugaggc

SEQ ID NO: 1057417 - RNA, 19 nt, Homo sapiens
caccucugcacaagcugca

SEQ ID NO: 1057418 - RNA, 17 nt, Homo sapiens
caccugaaugugucugc

SEQ ID NO: 1057419 - RNA, 16 nt, Homo sapiens
caccugccauuugcac

SEQ ID NO: 1057420 - RNA, 23 nt, Homo sapiens
caccugcucuucuaccauuugaa

SEQ ID NO: 1057421 - RNA, 23 nt, Homo sapiens
caccuggaaagcauauacuauau

SEQ ID NO: 1057422 - RNA, 22 nt, Homo sapiens
caccuguagucccagcuacuca

SEQ ID NO: 1057423 - RNA, 14 nt, Homo sapiens
caccuugacagggc

SEQ ID NO: 1057424 - RNA, 23 nt, Homo sapiens
caccuugcggggauaaagagaga

SEQ ID NO: 1057425 - RNA, 12 nt, Homo sapiens
cacgagaucaag

SEQ ID NO: 1057426 - RNA, 16 nt, Homo sapiens
cacgagaucaagagau

SEQ ID NO: 1057427 - RNA, 15 nt, Homo sapiens
cacgaucucaguuca

SEQ ID NO: 1057428 - RNA, 20 nt, Homo sapiens
cacgcacacacacaaacaca

SEQ ID NO: 1057429 - RNA, 11 nt, Homo sapiens
cacggcugcug

SEQ ID NO: 1057430 - RNA, 18 nt, Homo sapiens
cacguacacacacauaca

SEQ ID NO: 1057431 - RNA, 20 nt, Homo sapiens
cacguagggcggcacucaca

SEQ ID NO: 1057432 - RNA, 14 nt, Homo sapiens
cacgucauguuucu

SEQ ID NO: 1057433 - RNA, 12 nt, Homo sapiens
cacgucugcuaa

SEQ ID NO: 1057434 - RNA, 13 nt, Homo sapiens
cacgucugcuaac

SEQ ID NO: 1057435 - RNA, 20 nt, Homo sapiens
cacgugagaucauucacuca

SEQ ID NO: 1057436 - RNA, 15 nt, Homo sapiens
cacgugcucucugga

SEQ ID NO: 1057437 - RNA, 16 nt, Homo sapiens
cacgugucucagacug

SEQ ID NO: 1057438 - RNA, 13 nt, Homo sapiens
cacguguguauug

SEQ ID NO: 1057439 - RNA, 17 nt, Homo sapiens
cacguuaugguguuucu

SEQ ID NO: 1057440 - RNA, 19 nt, Homo sapiens
cacuaaauucgagaagcaa

SEQ ID NO: 1057441 - RNA, 16 nt, Homo sapiens
cacuaaccacgcugga

SEQ ID NO: 1057442 - RNA, 16 nt, Homo sapiens
cacuaaggugugcucu

SEQ ID NO: 1057443 - RNA, 11 nt, Homo sapiens
cacuaauuccu

SEQ ID NO: 1057444 - RNA, 19 nt, Homo sapiens
cacuacacuccagccugag

SEQ ID NO: 1057445 - RNA, 14 nt, Homo sapiens
cacuacauuacuuc

SEQ ID NO: 1057446 - RNA, 21 nt, Homo sapiens
cacuacucccucaaagcacac

SEQ ID NO: 1057447 - RNA, 23 nt, Homo sapiens
cacuauagccuaggugacagagu

SEQ ID NO: 1057448 - RNA, 14 nt, Homo sapiens
cacuauaucuguau

SEQ ID NO: 1057449 - RNA, 21 nt, Homo sapiens
cacuaugaaucuauuauacug

SEQ ID NO: 1057450 - RNA, 22 nt, Homo sapiens
cacuaugaggaauaauuauuua

SEQ ID NO: 1057451 - RNA, 21 nt, Homo sapiens
cacucacacggacacucaaaa

SEQ ID NO: 1057452 - RNA, 22 nt, Homo sapiens
cacucacgaauauuaugcccag

SEQ ID NO: 1057453 - RNA, 21 nt, Homo sapiens
cacucacuccacaacccaaga

SEQ ID NO: 1057454 - RNA, 22 nt, Homo sapiens
cacucagauggaaccgcaggaa

SEQ ID NO: 1057455 - RNA, 20 nt, Homo sapiens
cacucagugauugcaauuug

SEQ ID NO: 1057456 - RNA, 18 nt, Homo sapiens
cacucauccccucacuug

SEQ ID NO: 1057457 - RNA, 13 nt, Homo sapiens
cacuccagccuga

SEQ ID NO: 1057458 - RNA, 19 nt, Homo sapiens
cacuccaggacaguggaga

SEQ ID NO: 1057459 - RNA, 13 nt, Homo sapiens
cacuccagugcca

SEQ ID NO: 1057460 - RNA, 15 nt, Homo sapiens
cacucccagugcuug

SEQ ID NO: 1057461 - RNA, 14 nt, Homo sapiens
cacuccccucaaaa

SEQ ID NO: 1057462 - RNA, 16 nt, Homo sapiens
cacucccuggcucuca

SEQ ID NO: 1057463 - RNA, 22 nt, Homo sapiens
cacuccucaucaucacucaucu

SEQ ID NO: 1057464 - RNA, 13 nt, Homo sapiens
cacuccugaaccc

SEQ ID NO: 1057465 - RNA, 13 nt, Homo sapiens
cacuccugaccaa

SEQ ID NO: 1057466 - RNA, 15 nt, Homo sapiens
cacuccuuugcuuaa

SEQ ID NO: 1057467 - RNA, 13 nt, Homo sapiens
cacucuacccuau

SEQ ID NO: 1057468 - RNA, 23 nt, Homo sapiens
cacucuccaaacagucaccauac

SEQ ID NO: 1057469 - RNA, 18 nt, Homo sapiens
cacugaaaacaucuggaa

SEQ ID NO: 1057470 - RNA, 14 nt, Homo sapiens
cacugagcugaggg

SEQ ID NO: 1057471 - RNA, 15 nt, Homo sapiens
cacugauaaaaccau

SEQ ID NO: 1057472 - RNA, 13 nt, Homo sapiens
cacugauauccuc

SEQ ID NO: 1057473 - RNA, 12 nt, Homo sapiens
cacugcaagcac

SEQ ID NO: 1057474 - RNA, 15 nt, Homo sapiens
cacugcaagcacugc

SEQ ID NO: 1057475 - RNA, 15 nt, Homo sapiens
cacugcacagagcuc

SEQ ID NO: 1057476 - RNA, 14 nt, Homo sapiens
cacugcaggcauca

SEQ ID NO: 1057477 - RNA, 16 nt, Homo sapiens
cacugcccaaagugcu

SEQ ID NO: 1057478 - RNA, 19 nt, Homo sapiens
cacugccccagacacagug

SEQ ID NO: 1057479 - RNA, 22 nt, Homo sapiens
cacugccucucccuggcccuca

SEQ ID NO: 1057480 - RNA, 22 nt, Homo sapiens
cacugccuggcccaaaacgucu

SEQ ID NO: 1057481 - RNA, 16 nt, Homo sapiens
cacugcugccucuuga

SEQ ID NO: 1057482 - RNA, 23 nt, Homo sapiens
cacugcuugaggaaaacaagcau

SEQ ID NO: 1057483 - RNA, 15 nt, Homo sapiens
cacuggagcugucuu

SEQ ID NO: 1057484 - RNA, 14 nt, Homo sapiens
cacuggaugcagaa

SEQ ID NO: 1057485 - RNA, 13 nt, Homo sapiens
cacuggcauuguc

SEQ ID NO: 1057486 - RNA, 15 nt, Homo sapiens
cacuggccggaguca

SEQ ID NO: 1057487 - RNA, 17 nt, Homo sapiens
cacugggacuugcaaaa

SEQ ID NO: 1057488 - RNA, 17 nt, Homo sapiens
cacugggagaggugcca

SEQ ID NO: 1057489 - RNA, 20 nt, Homo sapiens
cacuggguucccauucugag

SEQ ID NO: 1057490 - RNA, 13 nt, Homo sapiens
cacuggguugacu

SEQ ID NO: 1057491 - RNA, 18 nt, Homo sapiens
cacuguaagacucauucc

SEQ ID NO: 1057492 - RNA, 20 nt, Homo sapiens
cacuguacaagguaccccuu

SEQ ID NO: 1057493 - RNA, 20 nt, Homo sapiens
cacuguacucugcacuggug

SEQ ID NO: 1057494 - RNA, 16 nt, Homo sapiens
cacugucacccuccac

SEQ ID NO: 1057495 - RNA, 16 nt, Homo sapiens
cacugucucugcugca

SEQ ID NO: 1057496 - RNA, 23 nt, Homo sapiens
cacugugaagagaaccauaucaa

SEQ ID NO: 1057497 - RNA, 19 nt, Homo sapiens
cacugugccaugugccagg

SEQ ID NO: 1057498 - RNA, 19 nt, Homo sapiens
cacuguuaauauucuauua

SEQ ID NO: 1057499 - RNA, 14 nt, Homo sapiens
cacuguugcccagg

SEQ ID NO: 1057500 - RNA, 17 nt, Homo sapiens
cacuguugcccaggcug

SEQ ID NO: 1057501 - RNA, 16 nt, Homo sapiens
cacuguuugcccagug

SEQ ID NO: 1057502 - RNA, 14 nt, Homo sapiens
cacuuacagaauua

SEQ ID NO: 1057503 - RNA, 18 nt, Homo sapiens
cacuuagcuaucagaaga

SEQ ID NO: 1057504 - RNA, 17 nt, Homo sapiens
cacuuauacccaugaac

SEQ ID NO: 1057505 - RNA, 19 nt, Homo sapiens
cacuuauacccaugaacuu

SEQ ID NO: 1057506 - RNA, 20 nt, Homo sapiens
cacuuauaggaauugaccca

SEQ ID NO: 1057507 - RNA, 14 nt, Homo sapiens
cacuuccaccagcc

SEQ ID NO: 1057508 - RNA, 21 nt, Homo sapiens
cacuucccacuauugcuugca

SEQ ID NO: 1057509 - RNA, 20 nt, Homo sapiens
cacuuccugcugcgaaagac

SEQ ID NO: 1057510 - RNA, 14 nt, Homo sapiens
cacuuccuuggaaa

SEQ ID NO: 1057511 - RNA, 12 nt, Homo sapiens
cacuucucucag

SEQ ID NO: 1057512 - RNA, 14 nt, Homo sapiens
cacuucucucagga

SEQ ID NO: 1057513 - RNA, 15 nt, Homo sapiens
cacuugaacccagga

SEQ ID NO: 1057514 - RNA, 16 nt, Homo sapiens
cacuugaagaugcugc

SEQ ID NO: 1057515 - RNA, 13 nt, Homo sapiens
cacuugagaggau

SEQ ID NO: 1057516 - RNA, 18 nt, Homo sapiens
cacuugcacgcccaugug

SEQ ID NO: 1057517 - RNA, 14 nt, Homo sapiens
cacuuggaacacaa

SEQ ID NO: 1057518 - RNA, 23 nt, Homo sapiens
cacuuucauaguuauuguuucug

SEQ ID NO: 1057519 - RNA, 18 nt, Homo sapiens
cacuuuggacauggcuca

SEQ ID NO: 1057520 - RNA, 19 nt, Homo sapiens
cacuuugggaggcugaggc

SEQ ID NO: 1057521 - RNA, 19 nt, Homo sapiens
cacuuuugaagcaauauca

SEQ ID NO: 1057522 - RNA, 15 nt, Homo sapiens
cacuuuuucauuugc

SEQ ID NO: 1057523 - RNA, 22 nt, Homo sapiens
cagaaaaaaaaaaaaaagccuu

SEQ ID NO: 1057524 - RNA, 23 nt, Homo sapiens
cagaaaaaaaaaaaaaagccuuu

SEQ ID NO: 1057525 - RNA, 16 nt, Homo sapiens
cagaaaaacucuggga

SEQ ID NO: 1057526 - RNA, 17 nt, Homo sapiens
cagaaaaacugugggua

SEQ ID NO: 1057527 - RNA, 20 nt, Homo sapiens
cagaaaccaguuaugugaau

SEQ ID NO: 1057528 - RNA, 18 nt, Homo sapiens
cagaaagcagauaccuca

SEQ ID NO: 1057529 - RNA, 15 nt, Homo sapiens
cagaaagcauuacau

SEQ ID NO: 1057530 - RNA, 18 nt, Homo sapiens
cagaaaguggccaugcca

SEQ ID NO: 1057531 - RNA, 15 nt, Homo sapiens
cagaaaguuaugaaa

SEQ ID NO: 1057532 - RNA, 18 nt, Homo sapiens
cagaaauacauauuucca

SEQ ID NO: 1057533 - RNA, 21 nt, Homo sapiens
cagaaaucuagaagacuguca

SEQ ID NO: 1057534 - RNA, 23 nt, Homo sapiens
cagaaaugagaucaggcucugcc

SEQ ID NO: 1057535 - RNA, 22 nt, Homo sapiens
cagaaaugcugccugccugucu

SEQ ID NO: 1057536 - RNA, 15 nt, Homo sapiens
cagaaauuguaucuu

SEQ ID NO: 1057537 - RNA, 13 nt, Homo sapiens
cagaacacugucu

SEQ ID NO: 1057538 - RNA, 17 nt, Homo sapiens
cagaacccagauuuccu

SEQ ID NO: 1057539 - RNA, 17 nt, Homo sapiens
cagaaccccuacaugaa

SEQ ID NO: 1057540 - RNA, 22 nt, Homo sapiens
cagaaccuguccuugcacacuc

SEQ ID NO: 1057541 - RNA, 16 nt, Homo sapiens
cagaacgagacuccac

SEQ ID NO: 1057542 - RNA, 22 nt, Homo sapiens
cagaacugcagucagcaugaau

SEQ ID NO: 1057543 - RNA, 16 nt, Homo sapiens
cauauaccagcaauau

SEQ ID NO: 1057544 - RNA, 19 nt, Homo sapiens
cauauaggacacacauaga

SEQ ID NO: 1057545 - RNA, 14 nt, Homo sapiens
cauauauaugucag

SEQ ID NO: 1057546 - RNA, 15 nt, Homo sapiens
cauauauuuguauga

SEQ ID NO: 1057547 - RNA, 18 nt, Homo sapiens
cauaucaguugagcuuca

SEQ ID NO: 1057548 - RNA, 18 nt, Homo sapiens
cauauccaacaugugcuc

SEQ ID NO: 1057549 - RNA, 14 nt, Homo sapiens
cauaugaauaacau

SEQ ID NO: 1057550 - RNA, 22 nt, Homo sapiens
cauaugaccucaugcaucucca

SEQ ID NO: 1057551 - RNA, 18 nt, Homo sapiens
cauaugauugugcacaua

SEQ ID NO: 1057552 - RNA, 15 nt, Homo sapiens
cauauggacucugca

SEQ ID NO: 1057553 - RNA, 16 nt, Homo sapiens
cauauggacucugcac

SEQ ID NO: 1057554 - RNA, 23 nt, Homo sapiens
cauauggaggaggcucuggaguc

SEQ ID NO: 1057555 - RNA, 19 nt, Homo sapiens
cauauguaaggaagucaga

SEQ ID NO: 1057556 - RNA, 14 nt, Homo sapiens
cauauguaugacuc

SEQ ID NO: 1057557 - RNA, 16 nt, Homo sapiens
cauauuaccacagaca

SEQ ID NO: 1057558 - RNA, 17 nt, Homo sapiens
cauauuccuuucuauca

SEQ ID NO: 1057559 - RNA, 17 nt, Homo sapiens
cauauugugauucugcc

SEQ ID NO: 1057560 - RNA, 21 nt, Homo sapiens
cauauuuucuuuaaaagacaa

SEQ ID NO: 1057561 - RNA, 20 nt, Homo sapiens
caucaaacacaaugccucau

SEQ ID NO: 1057562 - RNA, 19 nt, Homo sapiens
caucaaauggaagacacau

SEQ ID NO: 1057563 - RNA, 24 nt, Homo sapiens
caucaaauggaagacacauugaaa

SEQ ID NO: 1057564 - RNA, 23 nt, Homo sapiens
caucaauugaauggucagcguug

SEQ ID NO: 1057565 - RNA, 18 nt, Homo sapiens
caucacauuuuugugugg

SEQ ID NO: 1057566 - RNA, 22 nt, Homo sapiens
caucaccuugauaaugggauga

SEQ ID NO: 1057567 - RNA, 18 nt, Homo sapiens
caucacuuaacugauguu

SEQ ID NO: 1057568 - RNA, 23 nt, Homo sapiens
caucacuucccauuuuauggaau

SEQ ID NO: 1057569 - RNA, 17 nt, Homo sapiens
caucacuucccuacaug

SEQ ID NO: 1057570 - RNA, 14 nt, Homo sapiens
caucagcauaccuu

SEQ ID NO: 1057571 - RNA, 20 nt, Homo sapiens
caucagcuugcccuguuaaa

SEQ ID NO: 1057572 - RNA, 20 nt, Homo sapiens
caugggcuaaugaagaucau

SEQ ID NO: 1057573 - RNA, 15 nt, Homo sapiens
cauggugcacugagc

SEQ ID NO: 1057574 - RNA, 12 nt, Homo sapiens
cauguacaugaa

SEQ ID NO: 1057575 - RNA, 22 nt, Homo sapiens
cauguaugucuuggacacugua

SEQ ID NO: 1057576 - RNA, 12 nt, Homo sapiens
caugucacugug

SEQ ID NO: 1057577 - RNA, 20 nt, Homo sapiens
caugucccaaaccagacacc

SEQ ID NO: 1057578 - RNA, 16 nt, Homo sapiens
caugucuauucagcuu

SEQ ID NO: 1057579 - RNA, 18 nt, Homo sapiens
caugucuuguacaugugu

SEQ ID NO: 1057580 - RNA, 23 nt, Homo sapiens
caugugacaaagggccagcaguc

SEQ ID NO: 1057581 - RNA, 22 nt, Homo sapiens
caugugccagguuuuuggucug

SEQ ID NO: 1057582 - RNA, 18 nt, Homo sapiens
caugugcccccucuacca

SEQ ID NO: 1057583 - RNA, 15 nt, Homo sapiens
caugugcucagggaa

SEQ ID NO: 1057584 - RNA, 16 nt, Homo sapiens
cauguggaagcacuuu

SEQ ID NO: 1057585 - RNA, 19 nt, Homo sapiens
cauguggaagcacuuuaag

SEQ ID NO: 1057586 - RNA, 20 nt, Homo sapiens
cauguggcauguucaucgua

SEQ ID NO: 1057587 - RNA, 14 nt, Homo sapiens
cauguguacuuaau

SEQ ID NO: 1057588 - RNA, 21 nt, Homo sapiens
caugugugcgagugugugcau

SEQ ID NO: 1057589 - RNA, 17 nt, Homo sapiens
cauguguguaagugugu

SEQ ID NO: 1057590 - RNA, 19 nt, Homo sapiens
cauguguuuuaauuccaau

SEQ ID NO: 1057591 - RNA, 21 nt, Homo sapiens
cauguuaggaaaauuucacau

SEQ ID NO: 1057592 - RNA, 16 nt, Homo sapiens
cauguucacugcaaug

SEQ ID NO: 1057593 - RNA, 20 nt, Homo sapiens
cauuaaaacaaauccauaau

SEQ ID NO: 1057594 - RNA, 15 nt, Homo sapiens
cauuaaacugaauca

SEQ ID NO: 1057595 - RNA, 20 nt, Homo sapiens
cauuaauaauaaauucccug

SEQ ID NO: 1057596 - RNA, 13 nt, Homo sapiens
cauuaaugcaaug

SEQ ID NO: 1057597 - RNA, 15 nt, Homo sapiens
cauuaauguuaauuc

SEQ ID NO: 1057598 - RNA, 23 nt, Homo sapiens
cauuacagagaggagaaacacau

SEQ ID NO: 1057599 - RNA, 12 nt, Homo sapiens
cauuacagggaa

SEQ ID NO: 1057600 - RNA, 20 nt, Homo sapiens
cauuacagggaaugccugag

SEQ ID NO: 1057601 - RNA, 21 nt, Homo sapiens
cauuacgcuaguuaucaugca

SEQ ID NO: 1057602 - RNA, 17 nt, Homo sapiens
cauuagaacaaaggaca

SEQ ID NO: 1057603 - RNA, 12 nt, Homo sapiens
cauuagaccaag

SEQ ID NO: 1057604 - RNA, 23 nt, Homo sapiens
cauuaguuguuagugauggagcu

SEQ ID NO: 1057605 - RNA, 14 nt, Homo sapiens
cauuauaugcacua

SEQ ID NO: 1057606 - RNA, 15 nt, Homo sapiens
cauuaucauguguaa

SEQ ID NO: 1057607 - RNA, 20 nt, Homo sapiens
cauuauccuugcuaugauga

SEQ ID NO: 1057608 - RNA, 19 nt, Homo sapiens
cauuaucuagauacuguau

SEQ ID NO: 1057609 - RNA, 12 nt, Homo sapiens
cauuaucuauga

SEQ ID NO: 1057610 - RNA, 13 nt, Homo sapiens
cauuaucuaugau

SEQ ID NO: 1057611 - RNA, 16 nt, Homo sapiens
cauuaugagaggcaau

SEQ ID NO: 1057612 - RNA, 17 nt, Homo sapiens
cauuauguaauguccuu

SEQ ID NO: 1057613 - RNA, 23 nt, Homo sapiens
cauuauuuuauuauaacauccac

SEQ ID NO: 1057614 - RNA, 14 nt, Homo sapiens
cauucaacagauca

SEQ ID NO: 1057615 - RNA, 22 nt, Homo sapiens
cauucaauguuuaugcaaggaa

SEQ ID NO: 1057616 - RNA, 22 nt, Homo sapiens
cauucacagcaagucacuggcc

SEQ ID NO: 1057617 - RNA, 19 nt, Homo sapiens
cauucacccagacagcucc

SEQ ID NO: 1057618 - RNA, 12 nt, Homo sapiens
cauucacucaua

SEQ ID NO: 1057619 - RNA, 9 nt, Homo sapiens
cauucaguc

SEQ ID NO: 1057620 - RNA, 19 nt, Homo sapiens
cauucaguuaaaaauccag

SEQ ID NO: 1057621 - RNA, 21 nt, Homo sapiens
cauucaugacugaacugaaaa

SEQ ID NO: 1057622 - RNA, 19 nt, Homo sapiens
cauucauuccauucuggaa

SEQ ID NO: 1057623 - RNA, 13 nt, Homo sapiens
cauuccaagacag

SEQ ID NO: 1057624 - RNA, 18 nt, Homo sapiens
cauuccagacugcuucca

SEQ ID NO: 1057625 - RNA, 15 nt, Homo sapiens
cauucccaucuguca

SEQ ID NO: 1057626 - RNA, 15 nt, Homo sapiens
cauucucuuguuauu

SEQ ID NO: 1057627 - RNA, 14 nt, Homo sapiens
cauucugacaucuu

SEQ ID NO: 1057628 - RNA, 11 nt, Homo sapiens
cauucugacca

SEQ ID NO: 1057629 - RNA, 17 nt, Homo sapiens
cauucugccugcccagg

SEQ ID NO: 1057630 - RNA, 20 nt, Homo sapiens
cauucuguggccagccaaaa

SEQ ID NO: 1057631 - RNA, 18 nt, Homo sapiens
cauucuuuaucuugacau

SEQ ID NO: 1057632 - RNA, 18 nt, Homo sapiens
cauugaaagggaguauua

SEQ ID NO: 1057633 - RNA, 22 nt, Homo sapiens
cauugaaaugcacagaucugcu

SEQ ID NO: 1057634 - RNA, 16 nt, Homo sapiens
cauugacaagaacuga

SEQ ID NO: 1057635 - RNA, 17 nt, Homo sapiens
cauugagucauuauccu

SEQ ID NO: 1057636 - RNA, 13 nt, Homo sapiens
cauugcacaggga

SEQ ID NO: 1057637 - RNA, 22 nt, Homo sapiens
cauugcccccagggcacuucac

SEQ ID NO: 1057638 - RNA, 17 nt, Homo sapiens
cauugcuuuccacugag

SEQ ID NO: 1057639 - RNA, 21 nt, Homo sapiens
cauuggguccugggucuuuca

SEQ ID NO: 1057640 - RNA, 22 nt, Homo sapiens
cauuggguccugggucuuucau

SEQ ID NO: 1057641 - RNA, 14 nt, Homo sapiens
cauuguaaaccaca

SEQ ID NO: 1057642 - RNA, 12 nt, Homo sapiens
cauugucccuga

SEQ ID NO: 1057643 - RNA, 16 nt, Homo sapiens
cauuguggucacagga

SEQ ID NO: 1057644 - RNA, 20 nt, Homo sapiens
cauuguuccugcgcugcaaa

SEQ ID NO: 1057645 - RNA, 21 nt, Homo sapiens
cauuuaaauuagauaacaaaa

SEQ ID NO: 1057646 - RNA, 21 nt, Homo sapiens
cauuuacaggucuucucucca

SEQ ID NO: 1057647 - RNA, 12 nt, Homo sapiens
cauuuacuuaac

SEQ ID NO: 1057648 - RNA, 18 nt, Homo sapiens
cauuuagaacuugcagcu

SEQ ID NO: 1057649 - RNA, 22 nt, Homo sapiens
cauuuagaggacauucuggaaa

SEQ ID NO: 1057650 - RNA, 21 nt, Homo sapiens
cauuucaaauacaucuuugau

SEQ ID NO: 1057651 - RNA, 17 nt, Homo sapiens
cauuucaggggucguca

SEQ ID NO: 1057652 - RNA, 15 nt, Homo sapiens
cauuuccaugcauaa

SEQ ID NO: 1057653 - RNA, 13 nt, Homo sapiens
cauuucccugugc

SEQ ID NO: 1057654 - RNA, 22 nt, Homo sapiens
cauuuccuuuuccuucaagccu

SEQ ID NO: 1057655 - RNA, 18 nt, Homo sapiens
cauuucuagcagugauga

SEQ ID NO: 1057656 - RNA, 22 nt, Homo sapiens
cauuucuauuucuccuccaugg

SEQ ID NO: 1057657 - RNA, 14 nt, Homo sapiens
cauuugaaagaaag

SEQ ID NO: 1057658 - RNA, 23 nt, Homo sapiens
cauuugaaaucuaugaaauauca

SEQ ID NO: 1057659 - RNA, 21 nt, Homo sapiens
cauuugacugaagaugcagcu

SEQ ID NO: 1057660 - RNA, 15 nt, Homo sapiens
cauuugcauuugcuc

SEQ ID NO: 1057661 - RNA, 12 nt, Homo sapiens
cauuugccuugu

SEQ ID NO: 1057662 - RNA, 19 nt, Homo sapiens
cauuugcuggagcucugcc

SEQ ID NO: 1057663 - RNA, 23 nt, Homo sapiens
cauuugugugugugcaagugugu

SEQ ID NO: 1057664 - RNA, 18 nt, Homo sapiens
cauuuuaaaaaauggaac

SEQ ID NO: 1057665 - RNA, 12 nt, Homo sapiens
cauuuucacuuu

SEQ ID NO: 1057666 - RNA, 12 nt, Homo sapiens
cauuuuguauaa

SEQ ID NO: 1057667 - RNA, 15 nt, Homo sapiens
cauuuuuuaaaugca

SEQ ID NO: 1057668 - RNA, 15 nt, Homo sapiens
ccaaaacuaauuucc

SEQ ID NO: 1057669 - RNA, 19 nt, Homo sapiens
ccaaaagcugcucagggaa

SEQ ID NO: 1057670 - RNA, 22 nt, Homo sapiens
ccaaaagggccauguuucaaga

SEQ ID NO: 1057671 - RNA, 12 nt, Homo sapiens
ccaaacagugac

SEQ ID NO: 1057672 - RNA, 14 nt, Homo sapiens
ccaaaccacuccac

SEQ ID NO: 1057673 - RNA, 13 nt, Homo sapiens
ccaaagagacugg

SEQ ID NO: 1057674 - RNA, 15 nt, Homo sapiens
ccaaagccagaccag

SEQ ID NO: 1057675 - RNA, 18 nt, Homo sapiens
ccaaaggauaaguguccc

SEQ ID NO: 1057676 - RNA, 20 nt, Homo sapiens
ccaaaguaucaggacgagaa

SEQ ID NO: 1057677 - RNA, 13 nt, Homo sapiens
ccaaagugcugcg

SEQ ID NO: 1057678 - RNA, 12 nt, Homo sapiens
ccaaaguguccc

SEQ ID NO: 1057679 - RNA, 13 nt, Homo sapiens
ccaaaguguuaau

SEQ ID NO: 1057680 - RNA, 23 nt, Homo sapiens
ccaaauaaacucuaaacauuaau

SEQ ID NO: 1057681 - RNA, 15 nt, Homo sapiens
ccaaaucagcugcua

SEQ ID NO: 1057682 - RNA, 22 nt, Homo sapiens
ccaaaugcugacccaugcaaua

SEQ ID NO: 1057683 - RNA, 19 nt, Homo sapiens
ccaaauuucauaccuauca

SEQ ID NO: 1057684 - RNA, 12 nt, Homo sapiens
ccaacaccacag

SEQ ID NO: 1057685 - RNA, 13 nt, Homo sapiens
ccaacaccacaga

SEQ ID NO: 1057686 - RNA, 15 nt, Homo sapiens
ccaacacccugucua

SEQ ID NO: 1057687 - RNA, 21 nt, Homo sapiens
ccaacacugcugcuccagugc

SEQ ID NO: 1057688 - RNA, 21 nt, Homo sapiens
ccaacagaagcuuccauucca

SEQ ID NO: 1057689 - RNA, 18 nt, Homo sapiens
ccaacagucaaaacagag

SEQ ID NO: 1057690 - RNA, 17 nt, Homo sapiens
ccaaccccccaccugcc

SEQ ID NO: 1057691 - RNA, 17 nt, Homo sapiens
ccaaccggucacccagg

SEQ ID NO: 1057692 - RNA, 15 nt, Homo sapiens
ccaacgacaaagcca

SEQ ID NO: 1057693 - RNA, 18 nt, Homo sapiens
ccaacgucugugccauuu

SEQ ID NO: 1057694 - RNA, 21 nt, Homo sapiens
ccaacuucuucagagcugaca

SEQ ID NO: 1057695 - RNA, 21 nt, Homo sapiens
ccaacuugagggcccagagca

SEQ ID NO: 1057696 - RNA, 13 nt, Homo sapiens
ccaacuuuugcau

SEQ ID NO: 1057697 - RNA, 19 nt, Homo sapiens
ccaagaacagucaaaccca

SEQ ID NO: 1057698 - RNA, 16 nt, Homo sapiens
ccaagacacagaucac

SEQ ID NO: 1057699 - RNA, 20 nt, Homo sapiens
ccaagacucugaaaucucag

SEQ ID NO: 1057700 - RNA, 18 nt, Homo sapiens
ccaagcaggaaccccagg

SEQ ID NO: 1057701 - RNA, 16 nt, Homo sapiens
ccaagcaggaagcuca

SEQ ID NO: 1057702 - RNA, 19 nt, Homo sapiens
ccaagcaggaagcucagac

SEQ ID NO: 1057703 - RNA, 23 nt, Homo sapiens
ccaagcccuggagccaacugcug

SEQ ID NO: 1057704 - RNA, 16 nt, Homo sapiens
ccaagcuccucaauca

SEQ ID NO: 1057705 - RNA, 12 nt, Homo sapiens
ccaagcucugcu

SEQ ID NO: 1057706 - RNA, 19 nt, Homo sapiens
ccaagcucuguccaaucag

SEQ ID NO: 1057707 - RNA, 21 nt, Homo sapiens
ccaagcugggccccagcccac

SEQ ID NO: 1057708 - RNA, 21 nt, Homo sapiens
ccaaggagggugagugcaagg

SEQ ID NO: 1057709 - RNA, 16 nt, Homo sapiens
ccaaggcucugagcaa

SEQ ID NO: 1057710 - RNA, 19 nt, Homo sapiens
ccaaggcuggagugcagug

SEQ ID NO: 1057711 - RNA, 17 nt, Homo sapiens
ccaaguccagauuuaca

SEQ ID NO: 1057712 - RNA, 22 nt, Homo sapiens
ccaaguccagauuuacacuggg

SEQ ID NO: 1057713 - RNA, 14 nt, Homo sapiens
ccaagucuuuccua

SEQ ID NO: 1057714 - RNA, 15 nt, Homo sapiens
ccaagugugaacaaa

SEQ ID NO: 1057715 - RNA, 17 nt, Homo sapiens
ccaagugugugugcgug

SEQ ID NO: 1057716 - RNA, 13 nt, Homo sapiens
ccaauacccagac

SEQ ID NO: 1057717 - RNA, 17 nt, Homo sapiens
ccaauauuuaccagacc

SEQ ID NO: 1057718 - RNA, 16 nt, Homo sapiens
ccaauauuuguagaag

SEQ ID NO: 1057719 - RNA, 18 nt, Homo sapiens
ccaaucccagcuaccuca

SEQ ID NO: 1057720 - RNA, 14 nt, Homo sapiens
ccaaucucauggag

SEQ ID NO: 1057721 - RNA, 22 nt, Homo sapiens
ccaaugaggucugaaauggagg

SEQ ID NO: 1057722 - RNA, 13 nt, Homo sapiens
ccaaugaugguca

SEQ ID NO: 1057723 - RNA, 14 nt, Homo sapiens
ccaaugauggucac

SEQ ID NO: 1057724 - RNA, 19 nt, Homo sapiens
ccaaugccugcauggauac

SEQ ID NO: 1057725 - RNA, 19 nt, Homo sapiens
ccaauguuuagcaaauaca

SEQ ID NO: 1057726 - RNA, 17 nt, Homo sapiens
ccaauuccaaagccaga

SEQ ID NO: 1057727 - RNA, 18 nt, Homo sapiens
ccacaaauagugcucgcu

SEQ ID NO: 1057728 - RNA, 17 nt, Homo sapiens
ccacaaaucaguauaug

SEQ ID NO: 1057729 - RNA, 21 nt, Homo sapiens
ccacaacuauauuaucaugca

SEQ ID NO: 1057730 - RNA, 14 nt, Homo sapiens
ccacaagaccaucu

SEQ ID NO: 1057731 - RNA, 18 nt, Homo sapiens
ccacaaguccuuguucca

SEQ ID NO: 1057732 - RNA, 22 nt, Homo sapiens
ccacaauuccuccucuggccac

SEQ ID NO: 1057733 - RNA, 19 nt, Homo sapiens
ccacacaaacguauguaaa

SEQ ID NO: 1057734 - RNA, 14 nt, Homo sapiens
ccacacacagcugg

SEQ ID NO: 1057735 - RNA, 15 nt, Homo sapiens
ccacacccagcucag

SEQ ID NO: 1057736 - RNA, 22 nt, Homo sapiens
ccacacccuggaggauuucauc

SEQ ID NO: 1057737 - RNA, 22 nt, Homo sapiens
ccacaccggccuugcauugccu

SEQ ID NO: 1057738 - RNA, 18 nt, Homo sapiens
ccacaccuccacaguuca

SEQ ID NO: 1057739 - RNA, 16 nt, Homo sapiens
ccacacucaccucuaa

SEQ ID NO: 1057740 - RNA, 18 nt, Homo sapiens
ccacacuguacucugcac

SEQ ID NO: 1057741 - RNA, 21 nt, Homo sapiens
ccacacuuguuccagcucuuu

SEQ ID NO: 1057742 - RNA, 22 nt, Homo sapiens
ccacagaggacucacuugccca

SEQ ID NO: 1057743 - RNA, 15 nt, Homo sapiens
ccacagaugccucca

SEQ ID NO: 1057744 - RNA, 20 nt, Homo sapiens
ccacagcagcugaacagcca

SEQ ID NO: 1057745 - RNA, 14 nt, Homo sapiens
ccacagcaggugcu

SEQ ID NO: 1057746 - RNA, 20 nt, Homo sapiens
ccacagccaaacuaggacac

SEQ ID NO: 1057747 - RNA, 19 nt, Homo sapiens
ccacagccgcagcuguaag

SEQ ID NO: 1057748 - RNA, 21 nt, Homo sapiens
ccacaggagugggaaaacacu

SEQ ID NO: 1057749 - RNA, 19 nt, Homo sapiens
ccacagggucugcacucua

SEQ ID NO: 1057750 - RNA, 20 nt, Homo sapiens
ccacagugacuccacucuga

SEQ ID NO: 1057751 - RNA, 17 nt, Homo sapiens
ccacaguucaguggcag

SEQ ID NO: 1057752 - RNA, 22 nt, Homo sapiens
ccacaguucaguggcagggcuc

SEQ ID NO: 1057753 - RNA, 22 nt, Homo sapiens
ccacaucaauauugucauuccu

SEQ ID NO: 1057754 - RNA, 17 nt, Homo sapiens
ccacaucuugcucugcu

SEQ ID NO: 1057755 - RNA, 21 nt, Homo sapiens
ccacaucuugcucugcugaca

SEQ ID NO: 1057756 - RNA, 15 nt, Homo sapiens
ccacaugccaagcac

SEQ ID NO: 1057757 - RNA, 13 nt, Homo sapiens
ccaggagacaguu

SEQ ID NO: 1057758 - RNA, 15 nt, Homo sapiens
ccaggagcagccaca

SEQ ID NO: 1057759 - RNA, 16 nt, Homo sapiens
ccaggaguacacccca

SEQ ID NO: 1057760 - RNA, 23 nt, Homo sapiens
ccaggaguacaccccaacagcac

SEQ ID NO: 1057761 - RNA, 22 nt, Homo sapiens
ccaggaguucgaggcugcaguc

SEQ ID NO: 1057762 - RNA, 17 nt, Homo sapiens
ccaggaguuugagacca

SEQ ID NO: 1057763 - RNA, 15 nt, Homo sapiens
ccaggauagugggca

SEQ ID NO: 1057764 - RNA, 18 nt, Homo sapiens
ccaggcaacuugggaacu

SEQ ID NO: 1057765 - RNA, 17 nt, Homo sapiens
ccaggcacgguggcuga

SEQ ID NO: 1057766 - RNA, 16 nt, Homo sapiens
ccaggcagucgggggc

SEQ ID NO: 1057767 - RNA, 23 nt, Homo sapiens
ccaggcaucugcuuuacucugga

SEQ ID NO: 1057768 - RNA, 16 nt, Homo sapiens
ccaggcgaugugcaag

SEQ ID NO: 1057769 - RNA, 14 nt, Homo sapiens
ccaggcgggcucaa

SEQ ID NO: 1057770 - RNA, 16 nt, Homo sapiens
ccaggcugcucagggc

SEQ ID NO: 1057771 - RNA, 20 nt, Homo sapiens
ccaggcuggagugcaaugac

SEQ ID NO: 1057772 - RNA, 19 nt, Homo sapiens
ccaggcuggccagcauggu

SEQ ID NO: 1057773 - RNA, 18 nt, Homo sapiens
ccaggcuggcgugcagug

SEQ ID NO: 1057774 - RNA, 21 nt, Homo sapiens
ccaggcuucacccugaauggu

SEQ ID NO: 1057775 - RNA, 21 nt, Homo sapiens
ccagggccugagccaagcuag

SEQ ID NO: 1057776 - RNA, 18 nt, Homo sapiens
ccagggcucuaauguguc

SEQ ID NO: 1057777 - RNA, 22 nt, Homo sapiens
ccaggugcuaggaacacuccuu

SEQ ID NO: 1057778 - RNA, 22 nt, Homo sapiens
ccagguguucuacacucaucuu

SEQ ID NO: 1057779 - RNA, 21 nt, Homo sapiens
ccaguaaaugggggugcauuu

SEQ ID NO: 1057780 - RNA, 16 nt, Homo sapiens
ccaguacgugcuaaca

SEQ ID NO: 1057781 - RNA, 19 nt, Homo sapiens
ccaguauaugcugauggac

SEQ ID NO: 1057782 - RNA, 22 nt, Homo sapiens
ccaguauuuuuauuucuuuaau

SEQ ID NO: 1057783 - RNA, 19 nt, Homo sapiens
ccaguccagauauuucaca

SEQ ID NO: 1057784 - RNA, 20 nt, Homo sapiens
ccaguccagauauuucacau

SEQ ID NO: 1057785 - RNA, 19 nt, Homo sapiens
ccagucccagcuaacucug

SEQ ID NO: 1057786 - RNA, 15 nt, Homo sapiens
ccagugaaccaaaga

SEQ ID NO: 1057787 - RNA, 16 nt, Homo sapiens
ccagugaaccaaagag

SEQ ID NO: 1057788 - RNA, 16 nt, Homo sapiens
ccagugagcuuaucau

SEQ ID NO: 1057789 - RNA, 16 nt, Homo sapiens
ccaguguuguggauuu

SEQ ID NO: 1057790 - RNA, 18 nt, Homo sapiens
ccaguucccagaaggcau

SEQ ID NO: 1057791 - RNA, 15 nt, Homo sapiens
ccaguucugucuuca

SEQ ID NO: 1057792 - RNA, 22 nt, Homo sapiens
ccaguugucuauucauugacug

SEQ ID NO: 1057793 - RNA, 21 nt, Homo sapiens
ccaguuuaaccugaugcaguc

SEQ ID NO: 1057794 - RNA, 13 nt, Homo sapiens
ccaguuugcaauu

SEQ ID NO: 1057795 - RNA, 23 nt, Homo sapiens
ccauaaacacccaugaaucaaag

SEQ ID NO: 1057796 - RNA, 13 nt, Homo sapiens
ccauaaaggcaua

SEQ ID NO: 1057797 - RNA, 13 nt, Homo sapiens
ccauaacagccaa

SEQ ID NO: 1057798 - RNA, 17 nt, Homo sapiens
ccauagaggugagggaa

SEQ ID NO: 1057799 - RNA, 13 nt, Homo sapiens
ccauagauggguc

SEQ ID NO: 1057800 - RNA, 19 nt, Homo sapiens
ccauagcaagauugcuuaa

SEQ ID NO: 1057801 - RNA, 16 nt, Homo sapiens
ccauagcuuccaugag

SEQ ID NO: 1057802 - RNA, 22 nt, Homo sapiens
ccauaggcccagugagaugcau

SEQ ID NO: 1057803 - RNA, 22 nt, Homo sapiens
ccauaggguccugaauguuuca

SEQ ID NO: 1057804 - RNA, 15 nt, Homo sapiens
ccauagucacauggc

SEQ ID NO: 1057805 - RNA, 16 nt, Homo sapiens
ccauagucacauggcc

SEQ ID NO: 1057806 - RNA, 13 nt, Homo sapiens
cuccccaccuuca

SEQ ID NO: 1057807 - RNA, 13 nt, Homo sapiens
cuccccacucuag

SEQ ID NO: 1057808 - RNA, 15 nt, Homo sapiens
cuccccacucuaggg

SEQ ID NO: 1057809 - RNA, 13 nt, Homo sapiens
cuccccacugccu

SEQ ID NO: 1057810 - RNA, 14 nt, Homo sapiens
cuccccagagcacu

SEQ ID NO: 1057811 - RNA, 23 nt, Homo sapiens
cuccccagcccuggcucugcaau

SEQ ID NO: 1057812 - RNA, 21 nt, Homo sapiens
cuccccaguucauugcacuuu

SEQ ID NO: 1057813 - RNA, 23 nt, Homo sapiens
cuccccaguucauugcacuuuga

SEQ ID NO: 1057814 - RNA, 15 nt, Homo sapiens
cucccccaggugcag

SEQ ID NO: 1057815 - RNA, 13 nt, Homo sapiens
cucccuaccaccu

SEQ ID NO: 1057816 - RNA, 18 nt, Homo sapiens
cucccuccagacaaugcc

SEQ ID NO: 1057817 - RNA, 16 nt, Homo sapiens
cucccucucacugucu

SEQ ID NO: 1057818 - RNA, 22 nt, Homo sapiens
cucccucucucuucugcuccac

SEQ ID NO: 1057819 - RNA, 14 nt, Homo sapiens
cucccuuacccucc

SEQ ID NO: 1057820 - RNA, 17 nt, Homo sapiens
cucccuuggguucugau

SEQ ID NO: 1057821 - RNA, 23 nt, Homo sapiens
cuccggguuugagauggacacac

SEQ ID NO: 1057822 - RNA, 19 nt, Homo sapiens
cuccguggcaucaccuuag

SEQ ID NO: 1057823 - RNA, 21 nt, Homo sapiens
cuccuacccuuccagugcccu

SEQ ID NO: 1057824 - RNA, 21 nt, Homo sapiens
cuccuagggccacugaagaua

SEQ ID NO: 1057825 - RNA, 13 nt, Homo sapiens
cuccuauacucua

SEQ ID NO: 1057826 - RNA, 15 nt, Homo sapiens
cuccucaaucauagc

SEQ ID NO: 1057827 - RNA, 17 nt, Homo sapiens
cuccucaaucauagcca

SEQ ID NO: 1057828 - RNA, 18 nt, Homo sapiens
cuccuccaaaggcccccu

SEQ ID NO: 1057829 - RNA, 20 nt, Homo sapiens
cuccuccugcccaccuguca

SEQ ID NO: 1057830 - RNA, 22 nt, Homo sapiens
cuccucuccagcccugcagcua

SEQ ID NO: 1057831 - RNA, 14 nt, Homo sapiens
cuccucugcagcuc

SEQ ID NO: 1057832 - RNA, 18 nt, Homo sapiens
cuccucugcagugccuug

SEQ ID NO: 1057833 - RNA, 15 nt, Homo sapiens
cuccugaagccacag

SEQ ID NO: 1057834 - RNA, 19 nt, Homo sapiens
cuccugaguagcuggauua

SEQ ID NO: 1057835 - RNA, 15 nt, Homo sapiens
cuccugccgcaguga

SEQ ID NO: 1057836 - RNA, 18 nt, Homo sapiens
cuccugggcuaagugauc

SEQ ID NO: 1057837 - RNA, 13 nt, Homo sapiens
cuccugggcucag

SEQ ID NO: 1057838 - RNA, 14 nt, Homo sapiens
cuccuguacacuga

SEQ ID NO: 1057839 - RNA, 18 nt, Homo sapiens
cuccugugucuugcaaug

SEQ ID NO: 1057840 - RNA, 15 nt, Homo sapiens
cuccuguucgccucc

SEQ ID NO: 1057841 - RNA, 14 nt, Homo sapiens
cuccuucaaugcaa

SEQ ID NO: 1057842 - RNA, 23 nt, Homo sapiens
cuccuuccugucuuccugcauuc

SEQ ID NO: 1057843 - RNA, 22 nt, Homo sapiens
cuccuuggauguagucaguuag

SEQ ID NO: 1057844 - RNA, 14 nt, Homo sapiens
cuccuugguauuuc

SEQ ID NO: 1057845 - RNA, 14 nt, Homo sapiens
cuccuuggugccug

SEQ ID NO: 1057846 - RNA, 19 nt, Homo sapiens
cucgaacucccgaccucag

SEQ ID NO: 1057847 - RNA, 23 nt, Homo sapiens
cucgaggagguaaugaauuaaag

SEQ ID NO: 1057848 - RNA, 20 nt, Homo sapiens
cucgauuauucccuguacaa

SEQ ID NO: 1057849 - RNA, 21 nt, Homo sapiens
cucggagaagagcuguucaca

SEQ ID NO: 1057850 - RNA, 16 nt, Homo sapiens
cucggccucccaaagu

SEQ ID NO: 1057851 - RNA, 17 nt, Homo sapiens
cucggccucccaaagug

SEQ ID NO: 1057852 - RNA, 20 nt, Homo sapiens
cucguauaugucucaggucc

SEQ ID NO: 1057853 - RNA, 22 nt, Homo sapiens
cucguauguguguuuaccuaaa

SEQ ID NO: 1057854 - RNA, 18 nt, Homo sapiens
cucguuucaaaaacacag

SEQ ID NO: 1057855 - RNA, 12 nt, Homo sapiens
cucuaacuucaa

SEQ ID NO: 1057856 - RNA, 19 nt, Homo sapiens
cucuaagccacucuuccaa

SEQ ID NO: 1057857 - RNA, 16 nt, Homo sapiens
cucuaagggaccucaa

SEQ ID NO: 1057858 - RNA, 21 nt, Homo sapiens
cucuaaguuccacugagcucc

SEQ ID NO: 1057859 - RNA, 18 nt, Homo sapiens
cucuaaugugucucucac

SEQ ID NO: 1057860 - RNA, 14 nt, Homo sapiens
cucuacacugugaa

SEQ ID NO: 1057861 - RNA, 19 nt, Homo sapiens
cucuacaucuucugccuua

SEQ ID NO: 1057862 - RNA, 12 nt, Homo sapiens
cucuacccugag

SEQ ID NO: 1057863 - RNA, 16 nt, Homo sapiens
cucuacuacaugugac

SEQ ID NO: 1057864 - RNA, 21 nt, Homo sapiens
cucuacugaaaguacaaaaau

SEQ ID NO: 1057865 - RNA, 19 nt, Homo sapiens
cucuaugccagcucagucc

SEQ ID NO: 1057866 - RNA, 14 nt, Homo sapiens
cucuauugcugcuc

SEQ ID NO: 1057867 - RNA, 21 nt, Homo sapiens
cucuauuuguaauugaacuua

SEQ ID NO: 1057868 - RNA, 17 nt, Homo sapiens
cucucaauuucuggaaa

SEQ ID NO: 1057869 - RNA, 18 nt, Homo sapiens
cucucaccucuaacauca

SEQ ID NO: 1057870 - RNA, 22 nt, Homo sapiens
cucucacggcuuguaaauguga

SEQ ID NO: 1057871 - RNA, 15 nt, Homo sapiens
cucucaucaacugaa

SEQ ID NO: 1057872 - RNA, 19 nt, Homo sapiens
cucucaugggguccaaguu

SEQ ID NO: 1057873 - RNA, 21 nt, Homo sapiens
cucucauuucuggaaagugca

SEQ ID NO: 1057874 - RNA, 13 nt, Homo sapiens
cucuccaaacagu

SEQ ID NO: 1057875 - RNA, 21 nt, Homo sapiens
cucuccaaccuaacuggcuua

SEQ ID NO: 1057876 - RNA, 13 nt, Homo sapiens
cucucccauccag

SEQ ID NO: 1057877 - RNA, 18 nt, Homo sapiens
cucuccccacugcucauu

SEQ ID NO: 1057878 - RNA, 16 nt, Homo sapiens
cucuccccucaaaguc

SEQ ID NO: 1057879 - RNA, 19 nt, Homo sapiens
cucucccucuucucaagug

SEQ ID NO: 1057880 - RNA, 14 nt, Homo sapiens
cucuccucuugcca

SEQ ID NO: 1057881 - RNA, 19 nt, Homo sapiens
cucuccuuuggccauucca

SEQ ID NO: 1057882 - RNA, 15 nt, Homo sapiens
cucucuaguuuccag

SEQ ID NO: 1057883 - RNA, 14 nt, Homo sapiens
cucucuggcccucu

SEQ ID NO: 1057884 - RNA, 22 nt, Homo sapiens
cucucuuuuuggaggugcuuaa

SEQ ID NO: 1057885 - RNA, 14 nt, Homo sapiens
cucugaaaccagug

SEQ ID NO: 1057886 - RNA, 17 nt, Homo sapiens
cucugaaaccaguguua

SEQ ID NO: 1057887 - RNA, 20 nt, Homo sapiens
cucugaaccccucccuccau

SEQ ID NO: 1057888 - RNA, 16 nt, Homo sapiens
cucugaagcauguuuc

SEQ ID NO: 1057889 - RNA, 23 nt, Homo sapiens
cucugaagucacaucacaggaca

SEQ ID NO: 1057890 - RNA, 19 nt, Homo sapiens
cucugaccuaucacuucca

SEQ ID NO: 1057891 - RNA, 15 nt, Homo sapiens
cucugagaucuaagg

SEQ ID NO: 1057892 - RNA, 20 nt, Homo sapiens
cucugagcacccaagccagg

SEQ ID NO: 1057893 - RNA, 13 nt, Homo sapiens
cucugcacaagcu

SEQ ID NO: 1057894 - RNA, 20 nt, Homo sapiens
cucugcagcccucagauuau

SEQ ID NO: 1057895 - RNA, 17 nt, Homo sapiens
cucugcagcucagggac

SEQ ID NO: 1057896 - RNA, 20 nt, Homo sapiens
cucugcccugcccuagcucc

SEQ ID NO: 1057897 - RNA, 14 nt, Homo sapiens
cucugccugaaguc

SEQ ID NO: 1057898 - RNA, 14 nt, Homo sapiens
cucugcugaucuca

SEQ ID NO: 1057899 - RNA, 14 nt, Homo sapiens
gaugucccuaugga

SEQ ID NO: 1057900 - RNA, 22 nt, Homo sapiens
gaugucgcccuacucaccugag

SEQ ID NO: 1057901 - RNA, 17 nt, Homo sapiens
gaugucuccacuuucac

SEQ ID NO: 1057902 - RNA, 20 nt, Homo sapiens
gaugugauuuaauaguguua

SEQ ID NO: 1057903 - RNA, 16 nt, Homo sapiens
gaugugcaaguguaug

SEQ ID NO: 1057904 - RNA, 18 nt, Homo sapiens
gauguuugaggcuuucag

SEQ ID NO: 1057905 - RNA, 23 nt, Homo sapiens
gauuaaacgugcagacuaugcaa

SEQ ID NO: 1057906 - RNA, 19 nt, Homo sapiens
gauuacaggcgugagccac

SEQ ID NO: 1057907 - RNA, 17 nt, Homo sapiens
gauuacucuuugagaua

SEQ ID NO: 1057908 - RNA, 19 nt, Homo sapiens
gauuacugcccaauaugca

SEQ ID NO: 1057909 - RNA, 18 nt, Homo sapiens
gauuagcucuggaccagc

SEQ ID NO: 1057910 - RNA, 18 nt, Homo sapiens
gauuauagugacaaugaa

SEQ ID NO: 1057911 - RNA, 12 nt, Homo sapiens
gauuauucugau

SEQ ID NO: 1057912 - RNA, 21 nt, Homo sapiens
gauuauuggaaauuuguuaua

SEQ ID NO: 1057913 - RNA, 15 nt, Homo sapiens
gauuauuuuaaucua

SEQ ID NO: 1057914 - RNA, 13 nt, Homo sapiens
gauucacacuguc

SEQ ID NO: 1057915 - RNA, 20 nt, Homo sapiens
gauucacugcauggcuccca

SEQ ID NO: 1057916 - RNA, 13 nt, Homo sapiens
gauucauauugaa

SEQ ID NO: 1057917 - RNA, 23 nt, Homo sapiens
gauuccaggcgaugugcaagugu

SEQ ID NO: 1057918 - RNA, 14 nt, Homo sapiens
gauucgaaacucca

SEQ ID NO: 1057919 - RNA, 20 nt, Homo sapiens
gauucgugacaacaugcgac

SEQ ID NO: 1057920 - RNA, 17 nt, Homo sapiens
gauucuaaugucuucau

SEQ ID NO: 1057921 - RNA, 18 nt, Homo sapiens
gauucuaaugucuucauu

SEQ ID NO: 1057922 - RNA, 21 nt, Homo sapiens
gauucuaugaggcaaccacag

SEQ ID NO: 1057923 - RNA, 15 nt, Homo sapiens
gauucuucugccuca

SEQ ID NO: 1057924 - RNA, 18 nt, Homo sapiens
gauucuugacauucacuu

SEQ ID NO: 1057925 - RNA, 16 nt, Homo sapiens
gauugaacaagagcuu

SEQ ID NO: 1057926 - RNA, 16 nt, Homo sapiens
gauugaccuuugcacg

SEQ ID NO: 1057927 - RNA, 22 nt, Homo sapiens
gauugaguuuucuucugugauu

SEQ ID NO: 1057928 - RNA, 22 nt, Homo sapiens
gauugcagguggaacucaguca

SEQ ID NO: 1057929 - RNA, 23 nt, Homo sapiens
gauugcccauccaucugcuuaca

SEQ ID NO: 1057930 - RNA, 11 nt, Homo sapiens
gauugcuaaau

SEQ ID NO: 1057931 - RNA, 21 nt, Homo sapiens
gauuguaaaaaaaaaugccuu

SEQ ID NO: 1057932 - RNA, 20 nt, Homo sapiens
gauuguaacguugcuguggg

SEQ ID NO: 1057933 - RNA, 20 nt, Homo sapiens
gauugugccacuucacucca

SEQ ID NO: 1057934 - RNA, 19 nt, Homo sapiens
gauugugguacaaucucaa

SEQ ID NO: 1057935 - RNA, 19 nt, Homo sapiens
gauuguuuuugcucaaggc

SEQ ID NO: 1057936 - RNA, 17 nt, Homo sapiens
gauuuaaagcacaugcc

SEQ ID NO: 1057937 - RNA, 21 nt, Homo sapiens
gauuucagaucauauuucaca

SEQ ID NO: 1057938 - RNA, 14 nt, Homo sapiens
gauuuccacaguga

SEQ ID NO: 1057939 - RNA, 15 nt, Homo sapiens
gauuucuguuuagau

SEQ ID NO: 1057940 - RNA, 21 nt, Homo sapiens
gauuucuuccagaaggcaaaa

SEQ ID NO: 1057941 - RNA, 20 nt, Homo sapiens
gauuuuaaaaagucuucacu

SEQ ID NO: 1057942 - RNA, 20 nt, Homo sapiens
gauuuuacauguggcccaac

SEQ ID NO: 1057943 - RNA, 15 nt, Homo sapiens
gauuuuaugcuuuaa

SEQ ID NO: 1057944 - RNA, 16 nt, Homo sapiens
gauuuuaugcuuuaaa

SEQ ID NO: 1057945 - RNA, 17 nt, Homo sapiens
gauuuuuagcuuuacaa

SEQ ID NO: 1057946 - RNA, 22 nt, Homo sapiens
gauuuuuuuuucauacacuuau

SEQ ID NO: 1057947 - RNA, 20 nt, Homo sapiens
gcaaaaaaauuaaauuauuu

SEQ ID NO: 1057948 - RNA, 21 nt, Homo sapiens
gcaaaaaaauuaaauuauuua

SEQ ID NO: 1057949 - RNA, 20 nt, Homo sapiens
gcaaaaagucuacauacuuu

SEQ ID NO: 1057950 - RNA, 15 nt, Homo sapiens
gcaaaaauauaccuu

SEQ ID NO: 1057951 - RNA, 12 nt, Homo sapiens
gcaaaaccaaau

SEQ ID NO: 1057952 - RNA, 19 nt, Homo sapiens
gcaaaaccacuagaacucu

SEQ ID NO: 1057953 - RNA, 23 nt, Homo sapiens
gcaaaauucccagggaagugcuc

SEQ ID NO: 1057954 - RNA, 22 nt, Homo sapiens
gcaaaauuugaugccaggacac

SEQ ID NO: 1057955 - RNA, 18 nt, Homo sapiens
gcaaacucacugcucaag

SEQ ID NO: 1057956 - RNA, 18 nt, Homo sapiens
gcaaagauuugcuuuaau

SEQ ID NO: 1057957 - RNA, 21 nt, Homo sapiens
gcaaagcaccagcuucuccag

SEQ ID NO: 1057958 - RNA, 17 nt, Homo sapiens
gcaaagccuucauugcc

SEQ ID NO: 1057959 - RNA, 19 nt, Homo sapiens
gcaaagggcugaaagccau

SEQ ID NO: 1057960 - RNA, 17 nt, Homo sapiens
gcaaagguaauaauaca

SEQ ID NO: 1057961 - RNA, 14 nt, Homo sapiens
gcaaaguacaugua

SEQ ID NO: 1057962 - RNA, 21 nt, Homo sapiens
gcaaauccuugauacugcuca

SEQ ID NO: 1057963 - RNA, 19 nt, Homo sapiens
gcaaaucuaugagauuuug

SEQ ID NO: 1057964 - RNA, 17 nt, Homo sapiens
gcaaaugaauggcucac

SEQ ID NO: 1057965 - RNA, 18 nt, Homo sapiens
gcaaauguuucugcagua

SEQ ID NO: 1057966 - RNA, 24 nt, Homo sapiens
gcaacagauggauagucuguccaa

SEQ ID NO: 1057967 - RNA, 13 nt, Homo sapiens
gcaacagcacugg

SEQ ID NO: 1057968 - RNA, 12 nt, Homo sapiens
gcaacaguuuuu

SEQ ID NO: 1057969 - RNA, 23 nt, Homo sapiens
gcaacauguguacuuaauuucuu

SEQ ID NO: 1057970 - RNA, 20 nt, Homo sapiens
gcaaccagaggaaacuugca

SEQ ID NO: 1057971 - RNA, 19 nt, Homo sapiens
gcaacccaaauguucauca

SEQ ID NO: 1057972 - RNA, 17 nt, Homo sapiens
gcaaccuccacauguuc

SEQ ID NO: 1057973 - RNA, 19 nt, Homo sapiens
gcaaccuuuggaugcacuu

SEQ ID NO: 1057974 - RNA, 23 nt, Homo sapiens
gcaacgcaggcccccaggugcca

SEQ ID NO: 1057975 - RNA, 16 nt, Homo sapiens
gcaacggggaggccaa

SEQ ID NO: 1057976 - RNA, 20 nt, Homo sapiens
gcaacugaauaaauaccucu

SEQ ID NO: 1057977 - RNA, 14 nt, Homo sapiens
gcaacuggcucaaa

SEQ ID NO: 1057978 - RNA, 23 nt, Homo sapiens
gcaacuuaagcugggauaaucac

SEQ ID NO: 1057979 - RNA, 19 nt, Homo sapiens
gcaacuuguucguggguca

SEQ ID NO: 1057980 - RNA, 18 nt, Homo sapiens
gcaagagacucuggccuc

SEQ ID NO: 1057981 - RNA, 22 nt, Homo sapiens
gcaagaucauagcucauugcaa

SEQ ID NO: 1057982 - RNA, 19 nt, Homo sapiens
gcaagauuccaaguucuca

SEQ ID NO: 1057983 - RNA, 23 nt, Homo sapiens
gcaagauuccaaguucucaccuc

SEQ ID NO: 1057984 - RNA, 15 nt, Homo sapiens
gcaagcuauucaaug

SEQ ID NO: 1057985 - RNA, 17 nt, Homo sapiens
gcaaggacacagaugaa

SEQ ID NO: 1057986 - RNA, 22 nt, Homo sapiens
gcaaggacugcagggacugcca

SEQ ID NO: 1057987 - RNA, 19 nt, Homo sapiens
gcaaggagaccaccaacag

SEQ ID NO: 1057988 - RNA, 18 nt, Homo sapiens
gcaaguaaguaugaagga

SEQ ID NO: 1057989 - RNA, 15 nt, Homo sapiens
gcaaguacaauguua

SEQ ID NO: 1057990 - RNA, 21 nt, Homo sapiens
gcaaguaugugagugugucca

SEQ ID NO: 1057991 - RNA, 20 nt, Homo sapiens
gcaaguauguuuuagcaugu

SEQ ID NO: 1057992 - RNA, 14 nt, Homo sapiens
gcaagucaggacau

SEQ ID NO: 1057993 - RNA, 19 nt, Homo sapiens
gcaagugucugugugcaag

SEQ ID NO: 1057994 - RNA, 19 nt, Homo sapiens
gcaaguguguaugugcgug

SEQ ID NO: 1057995 - RNA, 15 nt, Homo sapiens
gcaagugugugcaca

SEQ ID NO: 1057996 - RNA, 18 nt, Homo sapiens
gcaagugugugcaugugu

SEQ ID NO: 1057997 - RNA, 18 nt, Homo sapiens
gcaauaaaaaucauagua

SEQ ID NO: 1057998 - RNA, 16 nt, Homo sapiens
gcaauaaaauguauuu

SEQ ID NO: 1057999 - RNA, 14 nt, Homo sapiens
gcaauaaauaccag

SEQ ID NO: 1058000 - RNA, 12 nt, Homo sapiens
gcaauacaaaga

SEQ ID NO: 1058001 - RNA, 15 nt, Homo sapiens
gcaauaguguguucu

SEQ ID NO: 1058002 - RNA, 11 nt, Homo sapiens
gcaaucacaac

SEQ ID NO: 1058003 - RNA, 23 nt, Homo sapiens
gcaaucugcccauucaucuucau

SEQ ID NO: 1058004 - RNA, 22 nt, Homo sapiens
gcaaucuguguucgauggcuca

SEQ ID NO: 1058005 - RNA, 15 nt, Homo sapiens
gcaaugacaucucag

SEQ ID NO: 1058006 - RNA, 13 nt, Homo sapiens
gcaaugacucagg

SEQ ID NO: 1058007 - RNA, 22 nt, Homo sapiens
gcaaugccaaucuucaguauuu

SEQ ID NO: 1058008 - RNA, 23 nt, Homo sapiens
gcaauuauagaguaucacuccca

SEQ ID NO: 1058009 - RNA, 14 nt, Homo sapiens
gcaauuccucugaa

SEQ ID NO: 1058010 - RNA, 17 nt, Homo sapiens
gcaauucuccugccuca

SEQ ID NO: 1058011 - RNA, 14 nt, Homo sapiens
gcaauugacuguca

SEQ ID NO: 1058012 - RNA, 16 nt, Homo sapiens
gcaauuucacugaugu

SEQ ID NO: 1058013 - RNA, 13 nt, Homo sapiens
gcaauuuuuccau

SEQ ID NO: 1058014 - RNA, 16 nt, Homo sapiens
gcacaaggcugaccaa

SEQ ID NO: 1058015 - RNA, 18 nt, Homo sapiens
gcacaaggcugaccaaga

SEQ ID NO: 1058016 - RNA, 22 nt, Homo sapiens
gcacaauuuuaauucaaaagau

SEQ ID NO: 1058017 - RNA, 19 nt, Homo sapiens
gcacacacacacaucucau

SEQ ID NO: 1058018 - RNA, 19 nt, Homo sapiens
gcacacacuguguacagua

SEQ ID NO: 1058019 - RNA, 20 nt, Homo sapiens
gcacacuagccucuccagga

SEQ ID NO: 1058020 - RNA, 20 nt, Homo sapiens
gcacacuuaugggccaagcc

SEQ ID NO: 1058021 - RNA, 16 nt, Homo sapiens
gcacagaccaguuuca

SEQ ID NO: 1058022 - RNA, 19 nt, Homo sapiens
gcacagacccugcccugug

SEQ ID NO: 1058023 - RNA, 18 nt, Homo sapiens
gcacagggaacaagcauu

SEQ ID NO: 1058024 - RNA, 19 nt, Homo sapiens
gcacaggucccacugcccu

SEQ ID NO: 1058025 - RNA, 17 nt, Homo sapiens
gcacauacgcaccacau

SEQ ID NO: 1058026 - RNA, 17 nt, Homo sapiens
gcacauccuaugcaaua

SEQ ID NO: 1058027 - RNA, 22 nt, Homo sapiens
gcacauuagccuaugugcaugc

SEQ ID NO: 1058028 - RNA, 22 nt, Homo sapiens
gcacauugaaagagaaccaguu

SEQ ID NO: 1058029 - RNA, 22 nt, Homo sapiens
gcacauuuaugaaucacaguau

SEQ ID NO: 1058030 - RNA, 16 nt, Homo sapiens
gcaccaauaaagccuu

SEQ ID NO: 1058031 - RNA, 20 nt, Homo sapiens
gcaccacugcacuccagccu

SEQ ID NO: 1058032 - RNA, 14 nt, Homo sapiens
gcaccagggcucac

SEQ ID NO: 1058033 - RNA, 18 nt, Homo sapiens
gcaccccacacuggagcc

SEQ ID NO: 1058034 - RNA, 15 nt, Homo sapiens
gcacccccuggagag

SEQ ID NO: 1058035 - RNA, 15 nt, Homo sapiens
gcauuugauuuugcc

SEQ ID NO: 1058036 - RNA, 19 nt, Homo sapiens
gcauuugucaacaaaguca

SEQ ID NO: 1058037 - RNA, 21 nt, Homo sapiens
gcauuugucaaugacaguuuc

SEQ ID NO: 1058038 - RNA, 20 nt, Homo sapiens
gcauuugugcccacucucca

SEQ ID NO: 1058039 - RNA, 15 nt, Homo sapiens
gcauuuucacuuuug

SEQ ID NO: 1058040 - RNA, 10 nt, Homo sapiens
gcauuuugcu

SEQ ID NO: 1058041 - RNA, 16 nt, Homo sapiens
gcauuuugcuauugua

SEQ ID NO: 1058042 - RNA, 19 nt, Homo sapiens
gccaaaagcugcucaggga

SEQ ID NO: 1058043 - RNA, 20 nt, Homo sapiens
gccaaacccaugaggcaaug

SEQ ID NO: 1058044 - RNA, 18 nt, Homo sapiens
gccaaacccuugucagug

SEQ ID NO: 1058045 - RNA, 22 nt, Homo sapiens
gccaaagaccaaauuccuuggc

SEQ ID NO: 1058046 - RNA, 15 nt, Homo sapiens
gccaaagauaaucuc

SEQ ID NO: 1058047 - RNA, 16 nt, Homo sapiens
gccaaagauaaucucu

SEQ ID NO: 1058048 - RNA, 22 nt, Homo sapiens
gccaaagccaauaacacacagc

SEQ ID NO: 1058049 - RNA, 14 nt, Homo sapiens
gccaacacccaucu

SEQ ID NO: 1058050 - RNA, 14 nt, Homo sapiens
gccaacauggugaa

SEQ ID NO: 1058051 - RNA, 18 nt, Homo sapiens
gccaaccggucacccagg

SEQ ID NO: 1058052 - RNA, 19 nt, Homo sapiens
gccaaccggucacccagga

SEQ ID NO: 1058053 - RNA, 19 nt, Homo sapiens
gccaaccucuggagcaaug

SEQ ID NO: 1058054 - RNA, 12 nt, Homo sapiens
gccaacuuuguu

SEQ ID NO: 1058055 - RNA, 18 nt, Homo sapiens
gccaagaaucaagcuaga

SEQ ID NO: 1058056 - RNA, 18 nt, Homo sapiens
gccaagaggcuguuccca

SEQ ID NO: 1058057 - RNA, 22 nt, Homo sapiens
gccaagaucacgccauugcacu

SEQ ID NO: 1058058 - RNA, 20 nt, Homo sapiens
gccaagaucgcgccacugca

SEQ ID NO: 1058059 - RNA, 22 nt, Homo sapiens
gccaagauugcgccauugcacu

SEQ ID NO: 1058060 - RNA, 17 nt, Homo sapiens
gccaagcuccucaauca

SEQ ID NO: 1058061 - RNA, 21 nt, Homo sapiens
gccaaggagggugagugcaag

SEQ ID NO: 1058062 - RNA, 20 nt, Homo sapiens
gccaaggcuggagugcagug

SEQ ID NO: 1058063 - RNA, 12 nt, Homo sapiens
gccaagggauga

SEQ ID NO: 1058064 - RNA, 18 nt, Homo sapiens
gccaaguaagaaagugaa

SEQ ID NO: 1058065 - RNA, 18 nt, Homo sapiens
gccaauauuucugauaua

SEQ ID NO: 1058066 - RNA, 19 nt, Homo sapiens
gccacaaaacugacaguaa

SEQ ID NO: 1058067 - RNA, 15 nt, Homo sapiens
gccacacacacagaa

SEQ ID NO: 1058068 - RNA, 19 nt, Homo sapiens
gccacacggcucucaccag

SEQ ID NO: 1058069 - RNA, 16 nt, Homo sapiens
gccacagaagccagga

SEQ ID NO: 1058070 - RNA, 21 nt, Homo sapiens
gccacagaggacucacuugcc

SEQ ID NO: 1058071 - RNA, 11 nt, Homo sapiens
gccacagccau

SEQ ID NO: 1058072 - RNA, 20 nt, Homo sapiens
gccacaggcauuuccugcuu

SEQ ID NO: 1058073 - RNA, 19 nt, Homo sapiens
gccacagggccuuuggcag

SEQ ID NO: 1058074 - RNA, 22 nt, Homo sapiens
gccacaguuuccucaucugucc

SEQ ID NO: 1058075 - RNA, 14 nt, Homo sapiens
gccacauuuuagcc

SEQ ID NO: 1058076 - RNA, 18 nt, Homo sapiens
gccaccagacugacaaau

SEQ ID NO: 1058077 - RNA, 17 nt, Homo sapiens
gccaccagucacugucc

SEQ ID NO: 1058078 - RNA, 11 nt, Homo sapiens
gccaccucucc

SEQ ID NO: 1058079 - RNA, 19 nt, Homo sapiens
gccaccucucccucaacaa

SEQ ID NO: 1058080 - RNA, 24 nt, Homo sapiens
gccacguaugguggcucaugucua

SEQ ID NO: 1058081 - RNA, 22 nt, Homo sapiens
gccacgugggcaaacaggcagu

SEQ ID NO: 1058082 - RNA, 21 nt, Homo sapiens
gccacucaggaggcugaggca

SEQ ID NO: 1058083 - RNA, 19 nt, Homo sapiens
gccacucaggggucauuca

SEQ ID NO: 1058084 - RNA, 22 nt, Homo sapiens
gccacugagaagugcacuuuaa

SEQ ID NO: 1058085 - RNA, 15 nt, Homo sapiens
gccacuucacuuuuu

SEQ ID NO: 1058086 - RNA, 20 nt, Homo sapiens
gccacuuucuacaggccagc

SEQ ID NO: 1058087 - RNA, 16 nt, Homo sapiens
gccagaagggggccau

SEQ ID NO: 1058088 - RNA, 17 nt, Homo sapiens
gccagaggaacugucca

SEQ ID NO: 1058089 - RNA, 22 nt, Homo sapiens
gccagaguauuggucuccucuc

SEQ ID NO: 1058090 - RNA, 19 nt, Homo sapiens
gccagaguggccuggccag

SEQ ID NO: 1058091 - RNA, 13 nt, Homo sapiens
gccagaguuccug

SEQ ID NO: 1058092 - RNA, 17 nt, Homo sapiens
gccagauggacuccagc

SEQ ID NO: 1058093 - RNA, 14 nt, Homo sapiens
gccagcaaugacau

SEQ ID NO: 1058094 - RNA, 24 nt, Homo sapiens
gccagcaccugcgggagcugcacu

SEQ ID NO: 1058095 - RNA, 17 nt, Homo sapiens
gccagccgugaugcuca

SEQ ID NO: 1058096 - RNA, 22 nt, Homo sapiens
gccagcugcugcuggaucacag

SEQ ID NO: 1058097 - RNA, 22 nt, Homo sapiens
gccaggaacuguguguguugca

SEQ ID NO: 1058098 - RNA, 21 nt, Homo sapiens
gccaggacaugcagcccagaa

SEQ ID NO: 1058099 - RNA, 11 nt, Homo sapiens
gccaggagcuc

SEQ ID NO: 1058100 - RNA, 13 nt, Homo sapiens
gccaggcagaucc

SEQ ID NO: 1058101 - RNA, 15 nt, Homo sapiens
gccaggccaccagga

SEQ ID NO: 1058102 - RNA, 23 nt, Homo sapiens
gccaggccagagggagugacaga

SEQ ID NO: 1058103 - RNA, 21 nt, Homo sapiens
gccaggccucuuggcagucac

SEQ ID NO: 1058104 - RNA, 21 nt, Homo sapiens
gccagggcuauagcucaggac

SEQ ID NO: 1058105 - RNA, 21 nt, Homo sapiens
gccaguggcuggaucugugag

SEQ ID NO: 1058106 - RNA, 15 nt, Homo sapiens
gccagugugggaaug

SEQ ID NO: 1058107 - RNA, 15 nt, Homo sapiens
gccaguuauggcuau

SEQ ID NO: 1058108 - RNA, 22 nt, Homo sapiens
gccauaaaaauaaaucaguuca

SEQ ID NO: 1058109 - RNA, 19 nt, Homo sapiens
gccauaauuacuaugucau

SEQ ID NO: 1058110 - RNA, 14 nt, Homo sapiens
gccauaggguccug

SEQ ID NO: 1058111 - RNA, 16 nt, Homo sapiens
gccauauaaguuugaa

SEQ ID NO: 1058112 - RNA, 21 nt, Homo sapiens
gccauauaaguuugaaggaaa

SEQ ID NO: 1058113 - RNA, 21 nt, Homo sapiens
gccauccucacaugugacaaa

SEQ ID NO: 1058114 - RNA, 14 nt, Homo sapiens
gccauccucaccca

SEQ ID NO: 1058115 - RNA, 15 nt, Homo sapiens
gccauccucacccag

SEQ ID NO: 1058116 - RNA, 23 nt, Homo sapiens
gccauggaagguucucugugcuc

SEQ ID NO: 1058117 - RNA, 23 nt, Homo sapiens
gccauguuucaagaaaauggauu

SEQ ID NO: 1058118 - RNA, 23 nt, Homo sapiens
gccauugaauuugccuuccucau

SEQ ID NO: 1058119 - RNA, 20 nt, Homo sapiens
gccauuugacuaauaauacu

SEQ ID NO: 1058120 - RNA, 16 nt, Homo sapiens
gcccaagagaugaaga

SEQ ID NO: 1058121 - RNA, 17 nt, Homo sapiens
gcccaagggcuccagac

SEQ ID NO: 1058122 - RNA, 13 nt, Homo sapiens
gcccacaucccag

SEQ ID NO: 1058123 - RNA, 19 nt, Homo sapiens
gcccacccuccugucuucc

SEQ ID NO: 1058124 - RNA, 16 nt, Homo sapiens
gcccacuucugccaua

SEQ ID NO: 1058125 - RNA, 21 nt, Homo sapiens
gcccagaacuggacucaggau

SEQ ID NO: 1058126 - RNA, 22 nt, Homo sapiens
gcccagauucuaccacacagca

SEQ ID NO: 1058127 - RNA, 22 nt, Homo sapiens
gcccagcggccccucccacaca

SEQ ID NO: 1058128 - RNA, 15 nt, Homo sapiens
gcccagcugcaccug

SEQ ID NO: 1058129 - RNA, 21 nt, Homo sapiens
gcccaggaaaggcuccaggag

SEQ ID NO: 1058130 - RNA, 22 nt, Homo sapiens
gcccaggaucaagucacucauc

SEQ ID NO: 1058131 - RNA, 20 nt, Homo sapiens
gcccaggaucagauugcaug

SEQ ID NO: 1058132 - RNA, 17 nt, Homo sapiens
gcccaggauggcuuuga

SEQ ID NO: 1058133 - RNA, 15 nt, Homo sapiens
gcccaggcaggccac

SEQ ID NO: 1058134 - RNA, 18 nt, Homo sapiens
gcccaggcuggagugcaa

SEQ ID NO: 1058135 - RNA, 20 nt, Homo sapiens
gcccaggcuggagugcaaug

SEQ ID NO: 1058136 - RNA, 20 nt, Homo sapiens
gcccaggcuggagugcagug

SEQ ID NO: 1058137 - RNA, 20 nt, Homo sapiens
gcccaggcuggcgugcagug

SEQ ID NO: 1058138 - RNA, 20 nt, Homo sapiens
gcccagggaagccaaaagau

SEQ ID NO: 1058139 - RNA, 19 nt, Homo sapiens
gcccaguccuggccuggcu

SEQ ID NO: 1058140 - RNA, 18 nt, Homo sapiens
gcccaguuucacugccau

SEQ ID NO: 1058141 - RNA, 18 nt, Homo sapiens
gcccaucaauuauagaaa

SEQ ID NO: 1058142 - RNA, 23 nt, Homo sapiens
gcccaucccuggaaggugcuguu

SEQ ID NO: 1058143 - RNA, 23 nt, Homo sapiens
gcccaugugugagugugugcaag

SEQ ID NO: 1058144 - RNA, 16 nt, Homo sapiens
gcccauuucuccauac

SEQ ID NO: 1058145 - RNA, 16 nt, Homo sapiens
gccccaaccugcugaa

SEQ ID NO: 1058146 - RNA, 13 nt, Homo sapiens
gccccacuugaag

SEQ ID NO: 1058147 - RNA, 23 nt, Homo sapiens
gccccagagcuguuuauggccuc

SEQ ID NO: 1058148 - RNA, 18 nt, Homo sapiens
gccccagccuucuuugcu

SEQ ID NO: 1058149 - RNA, 22 nt, Homo sapiens
gccccagucagccucucuccca

SEQ ID NO: 1058150 - RNA, 22 nt, Homo sapiens
gccccaugcugcccgcuucuca

SEQ ID NO: 1058151 - RNA, 17 nt, Homo sapiens
gcccccaggcugcugga

SEQ ID NO: 1058152 - RNA, 21 nt, Homo sapiens
gcccccgagcugggggccaug

SEQ ID NO: 1058153 - RNA, 16 nt, Homo sapiens
gcccccuccucuccca

SEQ ID NO: 1058154 - RNA, 20 nt, Homo sapiens
gcccccuucucccacacugc

SEQ ID NO: 1058155 - RNA, 13 nt, Homo sapiens
gccccucauuuau

SEQ ID NO: 1058156 - RNA, 14 nt, Homo sapiens
gccccucugaccug

SEQ ID NO: 1058157 - RNA, 16 nt, Homo sapiens
gccccugcacaaagcc

SEQ ID NO: 1058158 - RNA, 18 nt, Homo sapiens
gccccuggcucugaccga

SEQ ID NO: 1058159 - RNA, 16 nt, Homo sapiens
gcccgcugaguggacu

SEQ ID NO: 1058160 - RNA, 17 nt, Homo sapiens
gcccggaguggacugau

SEQ ID NO: 1058161 - RNA, 17 nt, Homo sapiens
gcccuagagcacacugu

SEQ ID NO: 1058162 - RNA, 11 nt, Homo sapiens
gcccucaggag

SEQ ID NO: 1058163 - RNA, 19 nt, Homo sapiens
gcccucccccagcaguuga

SEQ ID NO: 1058164 - RNA, 17 nt, Homo sapiens
gcccucuucauuuagcc

SEQ ID NO: 1058165 - RNA, 12 nt, Homo sapiens
gcccucuuccau

SEQ ID NO: 1058166 - RNA, 19 nt, Homo sapiens
gcccugacaugcacaccuc

SEQ ID NO: 1058167 - RNA, 11 nt, Homo sapiens
gcccugaccuc

SEQ ID NO: 1058168 - RNA, 20 nt, Homo sapiens
gcccuggcugaccccaaaga

SEQ ID NO: 1058169 - RNA, 12 nt, Homo sapiens
gcccugggaugu

SEQ ID NO: 1058170 - RNA, 14 nt, Homo sapiens
gcccugucagugca

SEQ ID NO: 1058171 - RNA, 23 nt, Homo sapiens
gcccugugggcccccaaauggaa

SEQ ID NO: 1058172 - RNA, 14 nt, Homo sapiens
gcccuuaaggacaa

SEQ ID NO: 1058173 - RNA, 18 nt, Homo sapiens
gcccuuaaggacaaaaau

SEQ ID NO: 1058174 - RNA, 15 nt, Homo sapiens
gcccuucaugcauuu

SEQ ID NO: 1058175 - RNA, 22 nt, Homo sapiens
gcccuucucucauuauuucucu

SEQ ID NO: 1058176 - RNA, 21 nt, Homo sapiens
gcccuugaagauaucuugaaa

SEQ ID NO: 1058177 - RNA, 17 nt, Homo sapiens
gcuuucauguuauuaaa

SEQ ID NO: 1058178 - RNA, 16 nt, Homo sapiens
gcuuucccugaacugg

SEQ ID NO: 1058179 - RNA, 16 nt, Homo sapiens
gcuuucuacccagcga

SEQ ID NO: 1058180 - RNA, 12 nt, Homo sapiens
gcuuucuaugua

SEQ ID NO: 1058181 - RNA, 21 nt, Homo sapiens
gcuuucuccauuguaaaccac

SEQ ID NO: 1058182 - RNA, 15 nt, Homo sapiens
gcuuugaaaauucag

SEQ ID NO: 1058183 - RNA, 12 nt, Homo sapiens
gcuuugcaguga

SEQ ID NO: 1058184 - RNA, 18 nt, Homo sapiens
gcuuugcuucaaauccau

SEQ ID NO: 1058185 - RNA, 15 nt, Homo sapiens
gcuuugguaaucucu

SEQ ID NO: 1058186 - RNA, 21 nt, Homo sapiens
gcuuuuaugauauauauaugc

SEQ ID NO: 1058187 - RNA, 15 nt, Homo sapiens
gcuuuucacugcugc

SEQ ID NO: 1058188 - RNA, 21 nt, Homo sapiens
gcuuuuccuauuuguuuucau

SEQ ID NO: 1058189 - RNA, 14 nt, Homo sapiens
gcuuuuccucccuu

SEQ ID NO: 1058190 - RNA, 18 nt, Homo sapiens
gcuuuugaaaaacaaaca

SEQ ID NO: 1058191 - RNA, 19 nt, Homo sapiens
gcuuuugguuauaaugugu

SEQ ID NO: 1058192 - RNA, 21 nt, Homo sapiens
ggaaaaaucuuggauuaugaa

SEQ ID NO: 1058193 - RNA, 13 nt, Homo sapiens
ggaaaagcaaaac

SEQ ID NO: 1058194 - RNA, 19 nt, Homo sapiens
ggaaaagcaaaacuguagg

SEQ ID NO: 1058195 - RNA, 20 nt, Homo sapiens
ggaaaagcugcugacagugu

SEQ ID NO: 1058196 - RNA, 20 nt, Homo sapiens
ggaaaauaaaucaaugcuau

SEQ ID NO: 1058197 - RNA, 18 nt, Homo sapiens
ggaaaauauguaacugga

SEQ ID NO: 1058198 - RNA, 12 nt, Homo sapiens
ggaaaaugcauu

SEQ ID NO: 1058199 - RNA, 23 nt, Homo sapiens
ggaaacaauauaaccacaaagca

SEQ ID NO: 1058200 - RNA, 20 nt, Homo sapiens
ggaaacagcuaaugggacac

SEQ ID NO: 1058201 - RNA, 19 nt, Homo sapiens
ggaaacuggaugaggucau

SEQ ID NO: 1058202 - RNA, 20 nt, Homo sapiens
ggaaacuggaugaggucaua

SEQ ID NO: 1058203 - RNA, 20 nt, Homo sapiens
ggaaacuguaugaaugucug

SEQ ID NO: 1058204 - RNA, 20 nt, Homo sapiens
ggaaagacauccauaaagaa

SEQ ID NO: 1058205 - RNA, 14 nt, Homo sapiens
ggaaagauuacuuu

SEQ ID NO: 1058206 - RNA, 12 nt, Homo sapiens
ggaaagcauaua

SEQ ID NO: 1058207 - RNA, 22 nt, Homo sapiens
ggaaagcaucaccucaggccag

SEQ ID NO: 1058208 - RNA, 17 nt, Homo sapiens
ggaaaggggcaggccag

SEQ ID NO: 1058209 - RNA, 22 nt, Homo sapiens
ggaaaguaaauauuucaggcau

SEQ ID NO: 1058210 - RNA, 12 nt, Homo sapiens
ggaaagucacag

SEQ ID NO: 1058211 - RNA, 12 nt, Homo sapiens
cugccucagguu

SEQ ID NO: 1058212 - RNA, 23 nt, Homo sapiens
cugccuccauucugaccauuuca

SEQ ID NO: 1058213 - RNA, 16 nt, Homo sapiens
cugccugggaguuuug

SEQ ID NO: 1058214 - RNA, 17 nt, Homo sapiens
cugccugucugaagcca

SEQ ID NO: 1058215 - RNA, 19 nt, Homo sapiens
cugccuguuauaacucugc

SEQ ID NO: 1058216 - RNA, 20 nt, Homo sapiens
cugccuuccacaauucacua

SEQ ID NO: 1058217 - RNA, 16 nt, Homo sapiens
cugcgugccuguggaa

SEQ ID NO: 1058218 - RNA, 17 nt, Homo sapiens
cugcgugguugaugauc

SEQ ID NO: 1058219 - RNA, 17 nt, Homo sapiens
cugcuacuuaauuccuu

SEQ ID NO: 1058220 - RNA, 17 nt, Homo sapiens
cugcuagggaauaucaa

SEQ ID NO: 1058221 - RNA, 16 nt, Homo sapiens
cugcucaagaagacau

SEQ ID NO: 1058222 - RNA, 15 nt, Homo sapiens
cugcucauauuguga

SEQ ID NO: 1058223 - RNA, 12 nt, Homo sapiens
cugcuccagcug

SEQ ID NO: 1058224 - RNA, 14 nt, Homo sapiens
cugcuccagugcag

SEQ ID NO: 1058225 - RNA, 23 nt, Homo sapiens
cugcuccgugcuuguuugcucac

SEQ ID NO: 1058226 - RNA, 18 nt, Homo sapiens
cugcucuccgaccagaca

SEQ ID NO: 1058227 - RNA, 17 nt, Homo sapiens
cugcucugaggcuucca

SEQ ID NO: 1058228 - RNA, 22 nt, Homo sapiens
cugcucuggaaaaugugaccca

SEQ ID NO: 1058229 - RNA, 15 nt, Homo sapiens
cugcucuuaggugcu

SEQ ID NO: 1058230 - RNA, 14 nt, Homo sapiens
cugcucuuguucua

SEQ ID NO: 1058231 - RNA, 17 nt, Homo sapiens
cugcucuuguucuacug

SEQ ID NO: 1058232 - RNA, 13 nt, Homo sapiens
cugcugacagugu

SEQ ID NO: 1058233 - RNA, 18 nt, Homo sapiens
cugcugaccauuugguca

SEQ ID NO: 1058234 - RNA, 13 nt, Homo sapiens
cugcugaccucca

SEQ ID NO: 1058235 - RNA, 16 nt, Homo sapiens
cugcugcuccagugca

SEQ ID NO: 1058236 - RNA, 18 nt, Homo sapiens
cugcugcuccagugcagg

SEQ ID NO: 1058237 - RNA, 23 nt, Homo sapiens
cugcuguuguugaaauugauguu

SEQ ID NO: 1058238 - RNA, 19 nt, Homo sapiens
cugcuuaacccauggaucc

SEQ ID NO: 1058239 - RNA, 22 nt, Homo sapiens
cugcuuaacccauggauccuga

SEQ ID NO: 1058240 - RNA, 16 nt, Homo sapiens
cugcuuagacauaaca

SEQ ID NO: 1058241 - RNA, 20 nt, Homo sapiens
cugcuucaugacauuccuaa

SEQ ID NO: 1058242 - RNA, 11 nt, Homo sapiens
cugcuucucac

SEQ ID NO: 1058243 - RNA, 16 nt, Homo sapiens
cugcuucugauaugca

SEQ ID NO: 1058244 - RNA, 17 nt, Homo sapiens
cugcuugaacccaggag

SEQ ID NO: 1058245 - RNA, 22 nt, Homo sapiens
cugcuugaggaaaacaagcauu

SEQ ID NO: 1058246 - RNA, 16 nt, Homo sapiens
cugcuuguuggcucca

SEQ ID NO: 1058247 - RNA, 18 nt, Homo sapiens
cugcuuuucacugcugca

SEQ ID NO: 1058248 - RNA, 23 nt, Homo sapiens
cuggaaaagggucuugggaaaua

SEQ ID NO: 1058249 - RNA, 15 nt, Homo sapiens
cuggaaaaugaaucc

SEQ ID NO: 1058250 - RNA, 20 nt, Homo sapiens
cuggaaaggcucagucucag

SEQ ID NO: 1058251 - RNA, 23 nt, Homo sapiens
cuggaacagauucacacugucug

SEQ ID NO: 1058252 - RNA, 16 nt, Homo sapiens
cuggaagcauggagca

SEQ ID NO: 1058253 - RNA, 23 nt, Homo sapiens
cuggaaggagugagaggggacaa

SEQ ID NO: 1058254 - RNA, 13 nt, Homo sapiens
cuggaaggcuucc

SEQ ID NO: 1058255 - RNA, 14 nt, Homo sapiens
cuggaaggugcugu

SEQ ID NO: 1058256 - RNA, 12 nt, Homo sapiens
cuggaaguagaa

SEQ ID NO: 1058257 - RNA, 15 nt, Homo sapiens
cuggaaucucaaaag

SEQ ID NO: 1058258 - RNA, 12 nt, Homo sapiens
cuggaaucugaa

SEQ ID NO: 1058259 - RNA, 20 nt, Homo sapiens
cuggaauguaaucaauguuu

SEQ ID NO: 1058260 - RNA, 14 nt, Homo sapiens
cuggacaacacagc

SEQ ID NO: 1058261 - RNA, 22 nt, Homo sapiens
cuggacaccgggccaguaucua

SEQ ID NO: 1058262 - RNA, 15 nt, Homo sapiens
cuggaccacugggca

SEQ ID NO: 1058263 - RNA, 21 nt, Homo sapiens
cuggaccugcccugggccaca

SEQ ID NO: 1058264 - RNA, 17 nt, Homo sapiens
cuggagcaucugacuca

SEQ ID NO: 1058265 - RNA, 16 nt, Homo sapiens
cuggagccaacugcug

SEQ ID NO: 1058266 - RNA, 20 nt, Homo sapiens
cuggagcccauccagucucc

SEQ ID NO: 1058267 - RNA, 22 nt, Homo sapiens
cuggaggacggccggcucucua

SEQ ID NO: 1058268 - RNA, 20 nt, Homo sapiens
cuggaguggaguggcgugau

SEQ ID NO: 1058269 - RNA, 16 nt, Homo sapiens
cuggaguguggcugag

SEQ ID NO: 1058270 - RNA, 15 nt, Homo sapiens
cuggaucuaccagca

SEQ ID NO: 1058271 - RNA, 22 nt, Homo sapiens
cuggaugguucccagaggguuu

SEQ ID NO: 1058272 - RNA, 14 nt, Homo sapiens
cuggaugucuccau

SEQ ID NO: 1058273 - RNA, 21 nt, Homo sapiens
cuggaugucugggugaccuca

SEQ ID NO: 1058274 - RNA, 21 nt, Homo sapiens
cuggcaaugaaaaauucucag

SEQ ID NO: 1058275 - RNA, 13 nt, Homo sapiens
cuggcacacuggc

SEQ ID NO: 1058276 - RNA, 18 nt, Homo sapiens
cuggcaccaccaggcacc

SEQ ID NO: 1058277 - RNA, 19 nt, Homo sapiens
cuggcacugaauuaaucau

SEQ ID NO: 1058278 - RNA, 15 nt, Homo sapiens
cuggcagcucuccag

SEQ ID NO: 1058279 - RNA, 19 nt, Homo sapiens
cuggcauuugcaccuaccu

SEQ ID NO: 1058280 - RNA, 16 nt, Homo sapiens
cuggccaccugaggug

SEQ ID NO: 1058281 - RNA, 12 nt, Homo sapiens
cuggccacugca

SEQ ID NO: 1058282 - RNA, 16 nt, Homo sapiens
cuggccccuagaauca

SEQ ID NO: 1058283 - RNA, 22 nt, Homo sapiens
cuggccucagccgacugcacag

SEQ ID NO: 1058284 - RNA, 23 nt, Homo sapiens
cuggccuggaucuccccacucua

SEQ ID NO: 1058285 - RNA, 15 nt, Homo sapiens
cuggcgccucugcaa

SEQ ID NO: 1058286 - RNA, 20 nt, Homo sapiens
cuggcgugcaguggugcgau

SEQ ID NO: 1058287 - RNA, 22 nt, Homo sapiens
cuggcuagaguccucacuccca

SEQ ID NO: 1058288 - RNA, 13 nt, Homo sapiens
cuggcucaucucu

SEQ ID NO: 1058289 - RNA, 23 nt, Homo sapiens
cuggcucccucuuggucuuccca

SEQ ID NO: 1058290 - RNA, 18 nt, Homo sapiens
cuggcugaaggacuguga

SEQ ID NO: 1058291 - RNA, 19 nt, Homo sapiens
cuggcugaccccaaagagc

SEQ ID NO: 1058292 - RNA, 14 nt, Homo sapiens
cuggcugauuauca

SEQ ID NO: 1058293 - RNA, 18 nt, Homo sapiens
cuggcuuacuuccuaguc

SEQ ID NO: 1058294 - RNA, 15 nt, Homo sapiens
cuggcuucagccucc

SEQ ID NO: 1058295 - RNA, 18 nt, Homo sapiens
cugggacacuuaacagau

SEQ ID NO: 1058296 - RNA, 16 nt, Homo sapiens
cugggaccacacagac

SEQ ID NO: 1058297 - RNA, 13 nt, Homo sapiens
cugggaccacaga

SEQ ID NO: 1058298 - RNA, 19 nt, Homo sapiens
cugggacuaaguguaccag

SEQ ID NO: 1058299 - RNA, 17 nt, Homo sapiens
cugggagagccuuccag

SEQ ID NO: 1058300 - RNA, 16 nt, Homo sapiens
cugggagcagcucugu

SEQ ID NO: 1058301 - RNA, 22 nt, Homo sapiens
cugggaggccaggauggcacug

SEQ ID NO: 1058302 - RNA, 17 nt, Homo sapiens
cugggaggcggagagua

SEQ ID NO: 1058303 - RNA, 22 nt, Homo sapiens
cugggauauuuccauauggcaa

SEQ ID NO: 1058304 - RNA, 15 nt, Homo sapiens
cugggauguuuugag

SEQ ID NO: 1058305 - RNA, 23 nt, Homo sapiens
cugggauuacaggcgugagccac

SEQ ID NO: 1058306 - RNA, 14 nt, Homo sapiens
cugggcacagucag

SEQ ID NO: 1058307 - RNA, 13 nt, Homo sapiens
cugggcauugcuu

SEQ ID NO: 1058308 - RNA, 20 nt, Homo sapiens
cugggccaaguuccucuagu

SEQ ID NO: 1058309 - RNA, 16 nt, Homo sapiens
cugggcccaagacaga

SEQ ID NO: 1058310 - RNA, 18 nt, Homo sapiens
cugggcucccuugugcgu

SEQ ID NO: 1058311 - RNA, 17 nt, Homo sapiens
cugggcugaacacucca

SEQ ID NO: 1058312 - RNA, 15 nt, Homo sapiens
cugggcuugucugua

SEQ ID NO: 1058313 - RNA, 19 nt, Homo sapiens
cuggggaagcugugaaaga

SEQ ID NO: 1058314 - RNA, 15 nt, Homo sapiens
cuggggcaaugggag

SEQ ID NO: 1058315 - RNA, 11 nt, Homo sapiens
ggaaaucacac

SEQ ID NO: 1058316 - RNA, 19 nt, Homo sapiens
ggaaauggcuugaagccaa

SEQ ID NO: 1058317 - RNA, 22 nt, Homo sapiens
ggaaccacgucugcuaacuugg

SEQ ID NO: 1058318 - RNA, 13 nt, Homo sapiens
ggaaccacugcac

SEQ ID NO: 1058319 - RNA, 16 nt, Homo sapiens
ggaacccucuaaggga

SEQ ID NO: 1058320 - RNA, 20 nt, Homo sapiens
ggaacccugcuugcacuuug

SEQ ID NO: 1058321 - RNA, 21 nt, Homo sapiens
ggaacuagagggauacacuga

SEQ ID NO: 1058322 - RNA, 13 nt, Homo sapiens
ggaacucucucca

SEQ ID NO: 1058323 - RNA, 23 nt, Homo sapiens
ggaacucugcuugauuuuugccu

SEQ ID NO: 1058324 - RNA, 13 nt, Homo sapiens
ggaacugcaauaa

SEQ ID NO: 1058325 - RNA, 19 nt, Homo sapiens
ggaagaaacaaaguugaac

SEQ ID NO: 1058326 - RNA, 12 nt, Homo sapiens
ggaagaccaaga

SEQ ID NO: 1058327 - RNA, 20 nt, Homo sapiens
ggaagaccagcuuugcagug

SEQ ID NO: 1058328 - RNA, 18 nt, Homo sapiens
ggaagagcugcaacggaa

SEQ ID NO: 1058329 - RNA, 17 nt, Homo sapiens
ggaagagggugauugcu

SEQ ID NO: 1058330 - RNA, 24 nt, Homo sapiens
ggaagagugguuaagacuacugaa

SEQ ID NO: 1058331 - RNA, 13 nt, Homo sapiens
ggaagaucuuaaa

SEQ ID NO: 1058332 - RNA, 21 nt, Homo sapiens
ggaagccaaaccucugugagc

SEQ ID NO: 1058333 - RNA, 16 nt, Homo sapiens
ggaagcugucccucac

SEQ ID NO: 1058334 - RNA, 11 nt, Homo sapiens
ggaagggucaa

SEQ ID NO: 1058335 - RNA, 19 nt, Homo sapiens
ggaaggucccuuguuucca

SEQ ID NO: 1058336 - RNA, 14 nt, Homo sapiens
ggaagguucucugu

SEQ ID NO: 1058337 - RNA, 19 nt, Homo sapiens
ggaagguucuggugugaac

SEQ ID NO: 1058338 - RNA, 16 nt, Homo sapiens
ggaaguccucugggua

SEQ ID NO: 1058339 - RNA, 17 nt, Homo sapiens
ggaagugaggaagccag

SEQ ID NO: 1058340 - RNA, 21 nt, Homo sapiens
ggaaguuuuguggaggagcuc

SEQ ID NO: 1058341 - RNA, 17 nt, Homo sapiens
ggaauaaacuccauuua

SEQ ID NO: 1058342 - RNA, 18 nt, Homo sapiens
ggaauaaagcccuugaac

SEQ ID NO: 1058343 - RNA, 13 nt, Homo sapiens
ggaauaaauaugc

SEQ ID NO: 1058344 - RNA, 12 nt, Homo sapiens
ggaauaauguaa

SEQ ID NO: 1058345 - RNA, 22 nt, Homo sapiens
ggaauauuugcaagacauagaa

SEQ ID NO: 1058346 - RNA, 20 nt, Homo sapiens
ggaaugguuauaaaagugau

SEQ ID NO: 1058347 - RNA, 12 nt, Homo sapiens
ggaauuaccuua

SEQ ID NO: 1058348 - RNA, 16 nt, Homo sapiens
ggaauuauucccauga

SEQ ID NO: 1058349 - RNA, 20 nt, Homo sapiens
ggaauuuccucuauugaugu

SEQ ID NO: 1058350 - RNA, 14 nt, Homo sapiens
ggacaaacugccag

SEQ ID NO: 1058351 - RNA, 17 nt, Homo sapiens
ggacaaacugccaguuu

SEQ ID NO: 1058352 - RNA, 23 nt, Homo sapiens
ggacaaggaugaucuaggaagac

SEQ ID NO: 1058353 - RNA, 13 nt, Homo sapiens
ggacaauaaucuc

SEQ ID NO: 1058354 - RNA, 18 nt, Homo sapiens
ggacaccuuuuaacucac

SEQ ID NO: 1058355 - RNA, 12 nt, Homo sapiens
ggacacguggug

SEQ ID NO: 1058356 - RNA, 13 nt, Homo sapiens
ggacagaagcagc

SEQ ID NO: 1058357 - RNA, 21 nt, Homo sapiens
ggacagaucaauggcgcagug

SEQ ID NO: 1058358 - RNA, 22 nt, Homo sapiens
ggacagaucaauggcgcagugc

SEQ ID NO: 1058359 - RNA, 12 nt, Homo sapiens
ggacagaugacc

SEQ ID NO: 1058360 - RNA, 15 nt, Homo sapiens
ggacagggaggugac

SEQ ID NO: 1058361 - RNA, 13 nt, Homo sapiens
ggacauaagacag

SEQ ID NO: 1058362 - RNA, 19 nt, Homo sapiens
ggacauggccccugugagu

SEQ ID NO: 1058363 - RNA, 19 nt, Homo sapiens
ggaccaaaccuagccccuu

SEQ ID NO: 1058364 - RNA, 14 nt, Homo sapiens
ggaccaacccuguu

SEQ ID NO: 1058365 - RNA, 12 nt, Homo sapiens
ggaccacugcau

SEQ ID NO: 1058366 - RNA, 22 nt, Homo sapiens
ggaccaggacuauagcccaggu

SEQ ID NO: 1058367 - RNA, 15 nt, Homo sapiens
ggaccccaucuguga

SEQ ID NO: 1058368 - RNA, 17 nt, Homo sapiens
ggaccccaucugugaau

SEQ ID NO: 1058369 - RNA, 14 nt, Homo sapiens
ggaccccugcccuu

SEQ ID NO: 1058370 - RNA, 20 nt, Homo sapiens
ggaccuuguuguuguuaaau

SEQ ID NO: 1058371 - RNA, 13 nt, Homo sapiens
ggacuacaggcac

SEQ ID NO: 1058372 - RNA, 17 nt, Homo sapiens
ggacuacaggcacccac

SEQ ID NO: 1058373 - RNA, 12 nt, Homo sapiens
ggacuacuccaa

SEQ ID NO: 1058374 - RNA, 18 nt, Homo sapiens
ggacuaggagcacuguag

SEQ ID NO: 1058375 - RNA, 10 nt, Homo sapiens
ggacuauuau

SEQ ID NO: 1058376 - RNA, 21 nt, Homo sapiens
ggacuccagacucucugugaa

SEQ ID NO: 1058377 - RNA, 20 nt, Homo sapiens
ggacucgccuguaaucucac

SEQ ID NO: 1058378 - RNA, 11 nt, Homo sapiens
ggacugagaug

SEQ ID NO: 1058379 - RNA, 14 nt, Homo sapiens
ggacugauaaucuc

SEQ ID NO: 1058380 - RNA, 22 nt, Homo sapiens
ggacugaucgauuugcacccac

SEQ ID NO: 1058381 - RNA, 14 nt, Homo sapiens
ggacuucagcucag

SEQ ID NO: 1058382 - RNA, 16 nt, Homo sapiens
ggacuuccuugcucuc

SEQ ID NO: 1058383 - RNA, 16 nt, Homo sapiens
ggacuuuucgaccaau

SEQ ID NO: 1058384 - RNA, 15 nt, Homo sapiens
ggagaaaaaaacuuc

SEQ ID NO: 1058385 - RNA, 13 nt, Homo sapiens
ggagaaacuggaa

SEQ ID NO: 1058386 - RNA, 22 nt, Homo sapiens
ggagaaauaugguacucauuaa

SEQ ID NO: 1058387 - RNA, 14 nt, Homo sapiens
ggagaacuauccaa

SEQ ID NO: 1058388 - RNA, 18 nt, Homo sapiens
ggagaagaagucagagag

SEQ ID NO: 1058389 - RNA, 18 nt, Homo sapiens
ggagaagcucacccaaua

SEQ ID NO: 1058390 - RNA, 20 nt, Homo sapiens
ggagaaguaauccuagggaa

SEQ ID NO: 1058391 - RNA, 16 nt, Homo sapiens
ggagaaucgcuuaaac

SEQ ID NO: 1058392 - RNA, 22 nt, Homo sapiens
ggagacaauaacuccagugaug

SEQ ID NO: 1058393 - RNA, 12 nt, Homo sapiens
ggagacacugau

SEQ ID NO: 1058394 - RNA, 15 nt, Homo sapiens
ggagacuagauuuau

SEQ ID NO: 1058395 - RNA, 13 nt, Homo sapiens
ggagagcccuuca

SEQ ID NO: 1058396 - RNA, 16 nt, Homo sapiens
ggagagcuggagccug

SEQ ID NO: 1058397 - RNA, 13 nt, Homo sapiens
ggagaggggcaca

SEQ ID NO: 1058398 - RNA, 16 nt, Homo sapiens
ggagaguucaauggcu

SEQ ID NO: 1058399 - RNA, 21 nt, Homo sapiens
ggagaucgcaucauugcacuc

SEQ ID NO: 1058400 - RNA, 14 nt, Homo sapiens
ggagcaaauguuuc

SEQ ID NO: 1058401 - RNA, 15 nt, Homo sapiens
ggagcaaauguuucu

SEQ ID NO: 1058402 - RNA, 13 nt, Homo sapiens
ggagcacuggguu

SEQ ID NO: 1058403 - RNA, 16 nt, Homo sapiens
ggagcagcaucucuga

SEQ ID NO: 1058404 - RNA, 17 nt, Homo sapiens
ggagccaacugcugcuu

SEQ ID NO: 1058405 - RNA, 20 nt, Homo sapiens
ggagccugggcauccucagg

SEQ ID NO: 1058406 - RNA, 15 nt, Homo sapiens
ggagcuaacacuggc

SEQ ID NO: 1058407 - RNA, 23 nt, Homo sapiens
ggagcucuucaggccucccucuc

SEQ ID NO: 1058408 - RNA, 12 nt, Homo sapiens
ggaggagcagug

SEQ ID NO: 1058409 - RNA, 21 nt, Homo sapiens
ggaggccagccagugaccuga

SEQ ID NO: 1058410 - RNA, 14 nt, Homo sapiens
ggaggccauugugu

SEQ ID NO: 1058411 - RNA, 21 nt, Homo sapiens
ggaggcuccagagggcacucu

SEQ ID NO: 1058412 - RNA, 21 nt, Homo sapiens
ggaggcuugccccacccaaca

SEQ ID NO: 1058413 - RNA, 16 nt, Homo sapiens
ggagggaagcacugcc

SEQ ID NO: 1058414 - RNA, 17 nt, Homo sapiens
ggagggagagaauuuua

SEQ ID NO: 1058415 - RNA, 14 nt, Homo sapiens
ggaggggugguccu

SEQ ID NO: 1058416 - RNA, 16 nt, Homo sapiens
ggagggugagugcaag

SEQ ID NO: 1058417 - RNA, 17 nt, Homo sapiens
ggaguaaucuguguaca

SEQ ID NO: 1058418 - RNA, 22 nt, Homo sapiens
ggaguaaucuguguacaaagaa

SEQ ID NO: 1058419 - RNA, 22 nt, Homo sapiens
ggaguacaccccaacagcaccc

SEQ ID NO: 1058420 - RNA, 20 nt, Homo sapiens
ggagucagagguuucaguga

SEQ ID NO: 1058421 - RNA, 13 nt, Homo sapiens
ggagucaucucaa

SEQ ID NO: 1058422 - RNA, 20 nt, Homo sapiens
ggagugacggucccacacug

SEQ ID NO: 1058423 - RNA, 20 nt, Homo sapiens
ggagugcccccaacagcacc

SEQ ID NO: 1058424 - RNA, 16 nt, Homo sapiens
ggagugggugucucug

SEQ ID NO: 1058425 - RNA, 18 nt, Homo sapiens
ggaguguggccacguggg

SEQ ID NO: 1058426 - RNA, 18 nt, Homo sapiens
ggauaucaaaggacaaag

SEQ ID NO: 1058427 - RNA, 20 nt, Homo sapiens
ggauaucaauuaauuugaaa

SEQ ID NO: 1058428 - RNA, 21 nt, Homo sapiens
ggauauuuccauauggcaaua

SEQ ID NO: 1058429 - RNA, 15 nt, Homo sapiens
ggaucaagucacuca

SEQ ID NO: 1058430 - RNA, 18 nt, Homo sapiens
ggaucccagcagugaugu

SEQ ID NO: 1058431 - RNA, 15 nt, Homo sapiens
ggauccuagccuuau

SEQ ID NO: 1058432 - RNA, 21 nt, Homo sapiens
ggauccuauucucaccaggaa

SEQ ID NO: 1058433 - RNA, 13 nt, Homo sapiens
ggaucuuuggaca

SEQ ID NO: 1058434 - RNA, 22 nt, Homo sapiens
ggaugaaggccucccugucuaa

SEQ ID NO: 1058435 - RNA, 12 nt, Homo sapiens
ggaugaauggaa

SEQ ID NO: 1058436 - RNA, 16 nt, Homo sapiens
ggaugagagggugcua

SEQ ID NO: 1058437 - RNA, 21 nt, Homo sapiens
ggaugccaaccggucacccag

SEQ ID NO: 1058438 - RNA, 22 nt, Homo sapiens
ggaugccaaccggucacccagg

SEQ ID NO: 1058439 - RNA, 13 nt, Homo sapiens
ggauggcacuguu

SEQ ID NO: 1058440 - RNA, 21 nt, Homo sapiens
ggauggggcagucucugccca

SEQ ID NO: 1058441 - RNA, 16 nt, Homo sapiens
ggauguaccagcaucu

SEQ ID NO: 1058442 - RNA, 17 nt, Homo sapiens
ggaugucacagggccaa

SEQ ID NO: 1058443 - RNA, 14 nt, Homo sapiens
ggauguccacagau

SEQ ID NO: 1058444 - RNA, 12 nt, Homo sapiens
ggaugucuuccu

SEQ ID NO: 1058445 - RNA, 15 nt, Homo sapiens
ggaugucuuccuugg

SEQ ID NO: 1058446 - RNA, 17 nt, Homo sapiens
ggaugugucacuguugg

SEQ ID NO: 1058447 - RNA, 13 nt, Homo sapiens
ggauuauuaacua

SEQ ID NO: 1058448 - RNA, 17 nt, Homo sapiens
ggauugaccuuugcacg

SEQ ID NO: 1058449 - RNA, 14 nt, Homo sapiens
ggauugacucugca

SEQ ID NO: 1058450 - RNA, 15 nt, Homo sapiens
ggauugacucugcau

SEQ ID NO: 1058451 - RNA, 21 nt, Homo sapiens
ggauugcuacuguccuaccca

SEQ ID NO: 1058452 - RNA, 17 nt, Homo sapiens
ggauugcuaugaaugau

SEQ ID NO: 1058453 - RNA, 17 nt, Homo sapiens
ggauuugccugugccac

SEQ ID NO: 1058454 - RNA, 17 nt, Homo sapiens
ggcaaaauaaagugaca

SEQ ID NO: 1058455 - RNA, 14 nt, Homo sapiens
ggcaaacaggcagu

SEQ ID NO: 1058456 - RNA, 17 nt, Homo sapiens
ggcaaagccuucauugc

SEQ ID NO: 1058457 - RNA, 19 nt, Homo sapiens
ggcaaagguggcucuccag

SEQ ID NO: 1058458 - RNA, 23 nt, Homo sapiens
ggcaacaauacaugcugcuaauu

SEQ ID NO: 1058459 - RNA, 14 nt, Homo sapiens
ggcaacaaugagca

SEQ ID NO: 1058460 - RNA, 20 nt, Homo sapiens
ggcaacacagcgagacuccg

SEQ ID NO: 1058461 - RNA, 20 nt, Homo sapiens
ggcaacaguacuucaaacag

SEQ ID NO: 1058462 - RNA, 22 nt, Homo sapiens
ggcaaccacaggcagcauuuag

SEQ ID NO: 1058463 - RNA, 22 nt, Homo sapiens
ggcaaccuugucucuaugccag

SEQ ID NO: 1058464 - RNA, 21 nt, Homo sapiens
ggcaagaagcacagguccuga

SEQ ID NO: 1058465 - RNA, 14 nt, Homo sapiens
ggcugaacccugug

SEQ ID NO: 1058466 - RNA, 18 nt, Homo sapiens
ggcugaaccgagcuggag

SEQ ID NO: 1058467 - RNA, 17 nt, Homo sapiens
ggcugaaggacugugac

SEQ ID NO: 1058468 - RNA, 19 nt, Homo sapiens
ggcugaaggacugugacag

SEQ ID NO: 1058469 - RNA, 12 nt, Homo sapiens
ggcugacaucug

SEQ ID NO: 1058470 - RNA, 22 nt, Homo sapiens
ggcugaccuuccucgcagagag

SEQ ID NO: 1058471 - RNA, 14 nt, Homo sapiens
ggcugagcucuuau

SEQ ID NO: 1058472 - RNA, 17 nt, Homo sapiens
ggcugcaaucacacuga

SEQ ID NO: 1058473 - RNA, 21 nt, Homo sapiens
ggcugcagcagaggcacuggg

SEQ ID NO: 1058474 - RNA, 11 nt, Homo sapiens
ggcugccuugu

SEQ ID NO: 1058475 - RNA, 15 nt, Homo sapiens
ggcugcugaccucca

SEQ ID NO: 1058476 - RNA, 17 nt, Homo sapiens
ggcuggaaucuggagag

SEQ ID NO: 1058477 - RNA, 16 nt, Homo sapiens
ggcuggagcccaggga

SEQ ID NO: 1058478 - RNA, 20 nt, Homo sapiens
ggcuggagugcaaugacaca

SEQ ID NO: 1058479 - RNA, 16 nt, Homo sapiens
ggcuggagugcagugg

SEQ ID NO: 1058480 - RNA, 11 nt, Homo sapiens
ggcuggcacug

SEQ ID NO: 1058481 - RNA, 19 nt, Homo sapiens
ggcugggaacucaccuggg

SEQ ID NO: 1058482 - RNA, 19 nt, Homo sapiens
ggcugggagacagagucag

SEQ ID NO: 1058483 - RNA, 22 nt, Homo sapiens
ggcugguuuuguaagaugcugg

SEQ ID NO: 1058484 - RNA, 18 nt, Homo sapiens
ggcuguauuuaauggcau

SEQ ID NO: 1058485 - RNA, 17 nt, Homo sapiens
ggcuuaaugcuucuuuc

SEQ ID NO: 1058486 - RNA, 19 nt, Homo sapiens
ggcuuaaugcuucuuucau

SEQ ID NO: 1058487 - RNA, 16 nt, Homo sapiens
ggcuugauauuuucca

SEQ ID NO: 1058488 - RNA, 14 nt, Homo sapiens
ggcuugcagugcgc

SEQ ID NO: 1058489 - RNA, 14 nt, Homo sapiens
ggcuuuaccuuuau

SEQ ID NO: 1058490 - RNA, 14 nt, Homo sapiens
ggcuuuuauugcca

SEQ ID NO: 1058491 - RNA, 13 nt, Homo sapiens
ggcuuuugugcau

SEQ ID NO: 1058492 - RNA, 17 nt, Homo sapiens
gggaaaagggaaccauu

SEQ ID NO: 1058493 - RNA, 18 nt, Homo sapiens
gggaaaauaccccaucau

SEQ ID NO: 1058494 - RNA, 22 nt, Homo sapiens
gggaaaccaguguagccuugcc

SEQ ID NO: 1058495 - RNA, 21 nt, Homo sapiens
gggaaaggauauuuucuucca

SEQ ID NO: 1058496 - RNA, 15 nt, Homo sapiens
gggaaaggccagugu

SEQ ID NO: 1058497 - RNA, 22 nt, Homo sapiens
gggaacaaggguggcaucccag

SEQ ID NO: 1058498 - RNA, 21 nt, Homo sapiens
gggaaccaugaagacaggaug

SEQ ID NO: 1058499 - RNA, 21 nt, Homo sapiens
gggaaccauugagcuuggcaa

SEQ ID NO: 1058500 - RNA, 21 nt, Homo sapiens
gggaagaccagcuuugcagug

SEQ ID NO: 1058501 - RNA, 17 nt, Homo sapiens
gggaagccccacuugaa

SEQ ID NO: 1058502 - RNA, 22 nt, Homo sapiens
gggaagcgaugaauuuggagac

SEQ ID NO: 1058503 - RNA, 18 nt, Homo sapiens
gggaaguaacauuugccu

SEQ ID NO: 1058504 - RNA, 12 nt, Homo sapiens
gggaaugccuga

SEQ ID NO: 1058505 - RNA, 17 nt, Homo sapiens
gggaauugaggucugcu

SEQ ID NO: 1058506 - RNA, 19 nt, Homo sapiens
gggacaauacagaacccau

SEQ ID NO: 1058507 - RNA, 20 nt, Homo sapiens
gggacagagcagaacuuuca

SEQ ID NO: 1058508 - RNA, 15 nt, Homo sapiens
gggacagagccaugc

SEQ ID NO: 1058509 - RNA, 18 nt, Homo sapiens
gggacagggcucgccuca

SEQ ID NO: 1058510 - RNA, 22 nt, Homo sapiens
gggaccaacugggcccaagaca

SEQ ID NO: 1058511 - RNA, 15 nt, Homo sapiens
gguccacgggacgau

SEQ ID NO: 1058512 - RNA, 15 nt, Homo sapiens
gguccaucucagaga

SEQ ID NO: 1058513 - RNA, 19 nt, Homo sapiens
ggucccaggcagagaauca

SEQ ID NO: 1058514 - RNA, 20 nt, Homo sapiens
ggucccauuucucacugaga

SEQ ID NO: 1058515 - RNA, 21 nt, Homo sapiens
ggucccauuucucacugagaa

SEQ ID NO: 1058516 - RNA, 17 nt, Homo sapiens
gguccgaagucuuccau

SEQ ID NO: 1058517 - RNA, 22 nt, Homo sapiens
gguccuugcaccccucacucug

SEQ ID NO: 1058518 - RNA, 12 nt, Homo sapiens
gguccuugcccu

SEQ ID NO: 1058519 - RNA, 20 nt, Homo sapiens
ggucucacaguguugcccag

SEQ ID NO: 1058520 - RNA, 21 nt, Homo sapiens
ggucucauuuagaacuugcag

SEQ ID NO: 1058521 - RNA, 20 nt, Homo sapiens
ggucuccucagccuccucau

SEQ ID NO: 1058522 - RNA, 16 nt, Homo sapiens
ggucuccucugcagcu

SEQ ID NO: 1058523 - RNA, 16 nt, Homo sapiens
ggucucgaacuccuga

SEQ ID NO: 1058524 - RNA, 14 nt, Homo sapiens
ggucugugugauga

SEQ ID NO: 1058525 - RNA, 23 nt, Homo sapiens
ggucuguuguaggguugccagau

SEQ ID NO: 1058526 - RNA, 16 nt, Homo sapiens
ggucuuauuuguaaag

SEQ ID NO: 1058527 - RNA, 18 nt, Homo sapiens
ggucuuguuaagugcagu

SEQ ID NO: 1058528 - RNA, 19 nt, Homo sapiens
ggugaaaccucaucucuac

SEQ ID NO: 1058529 - RNA, 20 nt, Homo sapiens
ggugaaccuuaguaccuaaa

SEQ ID NO: 1058530 - RNA, 14 nt, Homo sapiens
ggugacagagcaag

SEQ ID NO: 1058531 - RNA, 20 nt, Homo sapiens
ggugacaguccaaaccacuc

SEQ ID NO: 1058532 - RNA, 16 nt, Homo sapiens
ggugaccucacuuuag

SEQ ID NO: 1058533 - RNA, 14 nt, Homo sapiens
ggugagaugcagcu

SEQ ID NO: 1058534 - RNA, 13 nt, Homo sapiens
ggugaggaccacu

SEQ ID NO: 1058535 - RNA, 14 nt, Homo sapiens
ggugaggcaauaaa

SEQ ID NO: 1058536 - RNA, 17 nt, Homo sapiens
ggugaggggcuggcacu

SEQ ID NO: 1058537 - RNA, 14 nt, Homo sapiens
ggugauacccaagu

SEQ ID NO: 1058538 - RNA, 22 nt, Homo sapiens
ggugauuacauaaucuguacaa

SEQ ID NO: 1058539 - RNA, 23 nt, Homo sapiens
ggugcagguugggaaugaggcuu

SEQ ID NO: 1058540 - RNA, 18 nt, Homo sapiens
ggugcaguugacagcagg

SEQ ID NO: 1058541 - RNA, 21 nt, Homo sapiens
ggugcguguuuccugugcaag

SEQ ID NO: 1058542 - RNA, 20 nt, Homo sapiens
ggugcuaucgcaccacugug

SEQ ID NO: 1058543 - RNA, 13 nt, Homo sapiens
gguggagggccac

SEQ ID NO: 1058544 - RNA, 16 nt, Homo sapiens
gguggaucuguccaag

SEQ ID NO: 1058545 - RNA, 17 nt, Homo sapiens
gguggcccuugcaguuc

SEQ ID NO: 1058546 - RNA, 19 nt, Homo sapiens
gguggcccuugcaguucag

SEQ ID NO: 1058547 - RNA, 22 nt, Homo sapiens
gguggccucuccuuguggccug

SEQ ID NO: 1058548 - RNA, 17 nt, Homo sapiens
gguggcucacgccugua

SEQ ID NO: 1058549 - RNA, 16 nt, Homo sapiens
gguggcucuccaguua

SEQ ID NO: 1058550 - RNA, 18 nt, Homo sapiens
ggugggaccacagacuca

SEQ ID NO: 1058551 - RNA, 20 nt, Homo sapiens
ggugggcuucccaguggcug

SEQ ID NO: 1058552 - RNA, 16 nt, Homo sapiens
ggugguaagcaccagg

SEQ ID NO: 1058553 - RNA, 18 nt, Homo sapiens
gguguacacggaggucuc

SEQ ID NO: 1058554 - RNA, 14 nt, Homo sapiens
guaguaucaaugau

SEQ ID NO: 1058555 - RNA, 20 nt, Homo sapiens
guaguuuuauuacacauuua

SEQ ID NO: 1058556 - RNA, 16 nt, Homo sapiens
guauaaauuuacuuuu

SEQ ID NO: 1058557 - RNA, 15 nt, Homo sapiens
guauaguuguggaca

SEQ ID NO: 1058558 - RNA, 14 nt, Homo sapiens
guauauacauuuau

SEQ ID NO: 1058559 - RNA, 15 nt, Homo sapiens
guauaugucaucuca

SEQ ID NO: 1058560 - RNA, 13 nt, Homo sapiens
guauauuuuggga

SEQ ID NO: 1058561 - RNA, 15 nt, Homo sapiens
guaucaacacuguua

SEQ ID NO: 1058562 - RNA, 18 nt, Homo sapiens
guaucaaccaaauggagu

SEQ ID NO: 1058563 - RNA, 13 nt, Homo sapiens
guaucacucccac

SEQ ID NO: 1058564 - RNA, 17 nt, Homo sapiens
guaucagcacuccucau

SEQ ID NO: 1058565 - RNA, 15 nt, Homo sapiens
guaucaggacccaga

SEQ ID NO: 1058566 - RNA, 18 nt, Homo sapiens
guaucccaugagccucag

SEQ ID NO: 1058567 - RNA, 13 nt, Homo sapiens
guauccugugaca

SEQ ID NO: 1058568 - RNA, 17 nt, Homo sapiens
guauccugugacaugua

SEQ ID NO: 1058569 - RNA, 14 nt, Homo sapiens
guaucgauguuaug

SEQ ID NO: 1058570 - RNA, 15 nt, Homo sapiens
guaugaaugcagugg

SEQ ID NO: 1058571 - RNA, 15 nt, Homo sapiens
guaugaggcauuugu

SEQ ID NO: 1058572 - RNA, 17 nt, Homo sapiens
guaugaucacggcucac

SEQ ID NO: 1058573 - RNA, 21 nt, Homo sapiens
guaugccuuuaaaucugugau

SEQ ID NO: 1058574 - RNA, 18 nt, Homo sapiens
guauguauccccacuuau

SEQ ID NO: 1058575 - RNA, 19 nt, Homo sapiens
guaugucuuggacacugua

SEQ ID NO: 1058576 - RNA, 16 nt, Homo sapiens
guaugugcacugucac

SEQ ID NO: 1058577 - RNA, 23 nt, Homo sapiens
guauguuugggagacugcugagu

SEQ ID NO: 1058578 - RNA, 19 nt, Homo sapiens
guauuaggugucauuucca

SEQ ID NO: 1058579 - RNA, 18 nt, Homo sapiens
guauuaugucucuucuga

SEQ ID NO: 1058580 - RNA, 13 nt, Homo sapiens
guauucauugaag

SEQ ID NO: 1058581 - RNA, 21 nt, Homo sapiens
guauucuagugaaugaaucuc

SEQ ID NO: 1058582 - RNA, 22 nt, Homo sapiens
guauucuuaaauucauuuuaau

SEQ ID NO: 1058583 - RNA, 15 nt, Homo sapiens
guauucuucaaccuc

SEQ ID NO: 1058584 - RNA, 18 nt, Homo sapiens
guauugaaauguuugcau

SEQ ID NO: 1058585 - RNA, 18 nt, Homo sapiens
guauugcuaaucauuaag

SEQ ID NO: 1058586 - RNA, 17 nt, Homo sapiens
guauuuaccacagcagc

SEQ ID NO: 1058587 - RNA, 17 nt, Homo sapiens
guauuuaggcagauuga

SEQ ID NO: 1058588 - RNA, 19 nt, Homo sapiens
guauuugccuucuccacuu

SEQ ID NO: 1058589 - RNA, 23 nt, Homo sapiens
guauuuuauuacaucuuucacau

SEQ ID NO: 1058590 - RNA, 19 nt, Homo sapiens
gucaaaaggaagucucuag

SEQ ID NO: 1058591 - RNA, 20 nt, Homo sapiens
gucaaaccgcacucacccau

SEQ ID NO: 1058592 - RNA, 11 nt, Homo sapiens
gucaaacugua

SEQ ID NO: 1058593 - RNA, 20 nt, Homo sapiens
gucaacaaagucacccacuu

SEQ ID NO: 1058594 - RNA, 19 nt, Homo sapiens
gucaacuucaacauuuaca

SEQ ID NO: 1058595 - RNA, 23 nt, Homo sapiens
gucaacuucuggcuccucaaaca

SEQ ID NO: 1058596 - RNA, 18 nt, Homo sapiens
gucaauccgaaguaugag

SEQ ID NO: 1058597 - RNA, 12 nt, Homo sapiens
gucaaugaacuu

SEQ ID NO: 1058598 - RNA, 12 nt, Homo sapiens
gucaaugugcag

SEQ ID NO: 1058599 - RNA, 14 nt, Homo sapiens
gucaaugugcagug

SEQ ID NO: 1058600 - RNA, 19 nt, Homo sapiens
gucacagccucaagucacu

SEQ ID NO: 1058601 - RNA, 19 nt, Homo sapiens
gucacagccuccucugucu

SEQ ID NO: 1058602 - RNA, 17 nt, Homo sapiens
gucacauggccuaugca

SEQ ID NO: 1058603 - RNA, 17 nt, Homo sapiens
gucaccauacacacugu

SEQ ID NO: 1058604 - RNA, 15 nt, Homo sapiens
gucacgcuucuucuu

SEQ ID NO: 1058605 - RNA, 13 nt, Homo sapiens
aaacuucagggau

SEQ ID NO: 1058606 - RNA, 20 nt, Homo sapiens
aaacuugaaucaaagcaguu

SEQ ID NO: 1058607 - RNA, 12 nt, Homo sapiens
aaacuugacagu

SEQ ID NO: 1058608 - RNA, 13 nt, Homo sapiens
aaacuuuacuaag

SEQ ID NO: 1058609 - RNA, 17 nt, Homo sapiens
aaacuuuggcuuauaaa

SEQ ID NO: 1058610 - RNA, 20 nt, Homo sapiens
aaacuuuucuaauacucuac

SEQ ID NO: 1058611 - RNA, 14 nt, Homo sapiens
aaagaaauagccaa

SEQ ID NO: 1058612 - RNA, 18 nt, Homo sapiens
aaagaaauuguauuauca

SEQ ID NO: 1058613 - RNA, 22 nt, Homo sapiens
aaagaagaaacgucuaugugua

SEQ ID NO: 1058614 - RNA, 17 nt, Homo sapiens
aaagaaggaagugaaga

SEQ ID NO: 1058615 - RNA, 14 nt, Homo sapiens
aaagaaguggggac

SEQ ID NO: 1058616 - RNA, 14 nt, Homo sapiens
aaagaauacagaaa

SEQ ID NO: 1058617 - RNA, 13 nt, Homo sapiens
aaagacaagcugc

SEQ ID NO: 1058618 - RNA, 9 nt, Homo sapiens
aaagacaga

SEQ ID NO: 1058619 - RNA, 17 nt, Homo sapiens
aaagacauccauaaaga

SEQ ID NO: 1058620 - RNA, 20 nt, Homo sapiens
aaagacauucugacaucuua

SEQ ID NO: 1058621 - RNA, 18 nt, Homo sapiens
aaagaccaaauuccuugg

SEQ ID NO: 1058622 - RNA, 15 nt, Homo sapiens
aaagaccauuuuucc

SEQ ID NO: 1058623 - RNA, 14 nt, Homo sapiens
aaagaccuaugagc

SEQ ID NO: 1058624 - RNA, 15 nt, Homo sapiens
aaagacguucccuuu

SEQ ID NO: 1058625 - RNA, 17 nt, Homo sapiens
aaagacuguacaaagua

SEQ ID NO: 1058626 - RNA, 14 nt, Homo sapiens
aaagacuguagaag

SEQ ID NO: 1058627 - RNA, 21 nt, Homo sapiens
aaagacuguagaagaaagagc

SEQ ID NO: 1058628 - RNA, 15 nt, Homo sapiens
aaagagagagugugu

SEQ ID NO: 1058629 - RNA, 19 nt, Homo sapiens
aaagagagucgcaucucag

SEQ ID NO: 1058630 - RNA, 16 nt, Homo sapiens
aaagaggacaggcuac

SEQ ID NO: 1058631 - RNA, 23 nt, Homo sapiens
aaagaggagagaggaagcucucu

SEQ ID NO: 1058632 - RNA, 22 nt, Homo sapiens
aaagaguccuauuugcacugua

SEQ ID NO: 1058633 - RNA, 18 nt, Homo sapiens
aaagauauaaaugccaaa

SEQ ID NO: 1058634 - RNA, 21 nt, Homo sapiens
aaagaugaucuacucagaaau

SEQ ID NO: 1058635 - RNA, 17 nt, Homo sapiens
aaagauguagauuuauu

SEQ ID NO: 1058636 - RNA, 20 nt, Homo sapiens
aaagcaagacuguugcucaa

SEQ ID NO: 1058637 - RNA, 15 nt, Homo sapiens
aaagcacaguuugaa

SEQ ID NO: 1058638 - RNA, 15 nt, Homo sapiens
aaagcaccuuagcug

SEQ ID NO: 1058639 - RNA, 23 nt, Homo sapiens
aaagcacgugucucagacugcau

SEQ ID NO: 1058640 - RNA, 15 nt, Homo sapiens
aaagcacugacuucu

SEQ ID NO: 1058641 - RNA, 16 nt, Homo sapiens
aaagcagaacagugau

SEQ ID NO: 1058642 - RNA, 18 nt, Homo sapiens
aaagcagacccaccuccc

SEQ ID NO: 1058643 - RNA, 16 nt, Homo sapiens
aaagcagggacuugaa

SEQ ID NO: 1058644 - RNA, 13 nt, Homo sapiens
aaagcaucaccuc

SEQ ID NO: 1058645 - RNA, 13 nt, Homo sapiens
aaagcaugucuca

SEQ ID NO: 1058646 - RNA, 14 nt, Homo sapiens
aaagcaugugagac

SEQ ID NO: 1058647 - RNA, 22 nt, Homo sapiens
aaagcauuacauuuccaaauga

SEQ ID NO: 1058648 - RNA, 18 nt, Homo sapiens
aaagcauucaauuuauuc

SEQ ID NO: 1058649 - RNA, 17 nt, Homo sapiens
aaagcauuguaacuuau

SEQ ID NO: 1058650 - RNA, 12 nt, Homo sapiens
aaagccaaaaac

SEQ ID NO: 1058651 - RNA, 18 nt, Homo sapiens
aaagccaaacucugccag

SEQ ID NO: 1058652 - RNA, 15 nt, Homo sapiens
aaagccaccacauuu

SEQ ID NO: 1058653 - RNA, 12 nt, Homo sapiens
aaagccagugac

SEQ ID NO: 1058654 - RNA, 18 nt, Homo sapiens
aaagcccaaccuccugac

SEQ ID NO: 1058655 - RNA, 15 nt, Homo sapiens
aaagcccuuccaugu

SEQ ID NO: 1058656 - RNA, 17 nt, Homo sapiens
aaagccuagaagagcuu

SEQ ID NO: 1058657 - RNA, 17 nt, Homo sapiens
aaagccucagccauuca

SEQ ID NO: 1058658 - RNA, 13 nt, Homo sapiens
aaagccuccucau

SEQ ID NO: 1058659 - RNA, 20 nt, Homo sapiens
aaagccugccucuuccagga

SEQ ID NO: 1058660 - RNA, 23 nt, Homo sapiens
aaagccuuuuccagaagaucuga

SEQ ID NO: 1058661 - RNA, 13 nt, Homo sapiens
aaagcgccccggg

SEQ ID NO: 1058662 - RNA, 17 nt, Homo sapiens
aaagcggacaucagcug

SEQ ID NO: 1058663 - RNA, 21 nt, Homo sapiens
aaagcggacaucagcugguca

SEQ ID NO: 1058664 - RNA, 15 nt, Homo sapiens
aaagcuaaauuccac

SEQ ID NO: 1058665 - RNA, 14 nt, Homo sapiens
aaagcuacuugaag

SEQ ID NO: 1058666 - RNA, 23 nt, Homo sapiens
aaagcucacuaagaagcuugaau

SEQ ID NO: 1058667 - RNA, 13 nt, Homo sapiens
aaagcugcugaca

SEQ ID NO: 1058668 - RNA, 17 nt, Homo sapiens
aaagcugcugacagugu

SEQ ID NO: 1058669 - RNA, 21 nt, Homo sapiens
aaagcuggugucugauuuugg

SEQ ID NO: 1058670 - RNA, 19 nt, Homo sapiens
aaaggaaaauaguaauguu

SEQ ID NO: 1058671 - RNA, 14 nt, Homo sapiens
aaaggaagacuaga

SEQ ID NO: 1058672 - RNA, 19 nt, Homo sapiens
aaaggaagcuccacuguca

SEQ ID NO: 1058673 - RNA, 21 nt, Homo sapiens
aaaggaagcuccacugucacc

SEQ ID NO: 1058674 - RNA, 19 nt, Homo sapiens
aaaggacagaguaugaaca

SEQ ID NO: 1058675 - RNA, 15 nt, Homo sapiens
aaaggaccaguaugc

SEQ ID NO: 1058676 - RNA, 21 nt, Homo sapiens
aaaggagccaauugauuucaa

SEQ ID NO: 1058677 - RNA, 13 nt, Homo sapiens
aaaggaggggaua

SEQ ID NO: 1058678 - RNA, 16 nt, Homo sapiens
aaaggagggucaggaa

SEQ ID NO: 1058679 - RNA, 20 nt, Homo sapiens
aaaggcaaaugcccaaggga

SEQ ID NO: 1058680 - RNA, 17 nt, Homo sapiens
aaaggccaucagagcaa

SEQ ID NO: 1058681 - RNA, 21 nt, Homo sapiens
aaaggcuagguacacagcucu

SEQ ID NO: 1058682 - RNA, 20 nt, Homo sapiens
aaaggcugagaacacuguga

SEQ ID NO: 1058683 - RNA, 19 nt, Homo sapiens
aaaggcugggaccacguga

SEQ ID NO: 1058684 - RNA, 18 nt, Homo sapiens
aaagggauaguccaaaga

SEQ ID NO: 1058685 - RNA, 22 nt, Homo sapiens
aaagggccaauaaauaugaugu

SEQ ID NO: 1058686 - RNA, 16 nt, Homo sapiens
aaaggugaccaaugau

SEQ ID NO: 1058687 - RNA, 16 nt, Homo sapiens
aaagguugaagcacca

SEQ ID NO: 1058688 - RNA, 13 nt, Homo sapiens
aaaguacauguau

SEQ ID NO: 1058689 - RNA, 14 nt, Homo sapiens
aaaguacuucucca

SEQ ID NO: 1058690 - RNA, 21 nt, Homo sapiens
aaaguaucccggaagcucaca

SEQ ID NO: 1058691 - RNA, 22 nt, Homo sapiens
aaaguccaauuccaaagccaga

SEQ ID NO: 1058692 - RNA, 14 nt, Homo sapiens
aaagugacacagca

SEQ ID NO: 1058693 - RNA, 21 nt, Homo sapiens
aaagugacucacuuaucccaa

SEQ ID NO: 1058694 - RNA, 12 nt, Homo sapiens
aaagugcaauua

SEQ ID NO: 1058695 - RNA, 14 nt, Homo sapiens
aaagugcugagauu

SEQ ID NO: 1058696 - RNA, 19 nt, Homo sapiens
aaaguguaauagcauacau

SEQ ID NO: 1058697 - RNA, 20 nt, Homo sapiens
aaaguuacugauucacugca

SEQ ID NO: 1058698 - RNA, 21 nt, Homo sapiens
aaaguuacugauucacugcau

SEQ ID NO: 1058699 - RNA, 21 nt, Homo sapiens
aaaguuccaugaauucuugau

SEQ ID NO: 1058700 - RNA, 23 nt, Homo sapiens
aaaguucccuacuuccugugacu

SEQ ID NO: 1058701 - RNA, 16 nt, Homo sapiens
aaaguuggugucaaug

SEQ ID NO: 1058702 - RNA, 16 nt, Homo sapiens
aaauaaaauacuaaac

SEQ ID NO: 1058703 - RNA, 18 nt, Homo sapiens
aaauaaagaaauugcaau

SEQ ID NO: 1058704 - RNA, 17 nt, Homo sapiens
aaauaaaguaucaugca

SEQ ID NO: 1058705 - RNA, 16 nt, Homo sapiens
aaauaaaucaguucau

SEQ ID NO: 1058706 - RNA, 23 nt, Homo sapiens
aaauaacuaaaagguaugcaauc

SEQ ID NO: 1058707 - RNA, 22 nt, Homo sapiens
aaauacaauagagccacuaaga

SEQ ID NO: 1058708 - RNA, 14 nt, Homo sapiens
aaauacacaacaca

SEQ ID NO: 1058709 - RNA, 14 nt, Homo sapiens
aaauacacauagca

SEQ ID NO: 1058710 - RNA, 17 nt, Homo sapiens
aaauacagauagauaua

SEQ ID NO: 1058711 - RNA, 21 nt, Homo sapiens
aaauacagucuuccauuugca

SEQ ID NO: 1058712 - RNA, 16 nt, Homo sapiens
aaauacauauuuccaa

SEQ ID NO: 1058713 - RNA, 17 nt, Homo sapiens
aaauacccacuaacaaa

SEQ ID NO: 1058714 - RNA, 22 nt, Homo sapiens
aaauacuuaggaaggauccgca

SEQ ID NO: 1058715 - RNA, 19 nt, Homo sapiens
aaauaguuuaugauuccac

SEQ ID NO: 1058716 - RNA, 16 nt, Homo sapiens
aaauaguuuggauuac

SEQ ID NO: 1058717 - RNA, 14 nt, Homo sapiens
aaauauaauugaca

SEQ ID NO: 1058718 - RNA, 19 nt, Homo sapiens
aaauauacacacagcagua

SEQ ID NO: 1058719 - RNA, 12 nt, Homo sapiens
aaauaugaagcu

SEQ ID NO: 1058720 - RNA, 20 nt, Homo sapiens
aaauauggaacuucuaauau

SEQ ID NO: 1058721 - RNA, 17 nt, Homo sapiens
aaauauuacacaucaag

SEQ ID NO: 1058722 - RNA, 13 nt, Homo sapiens
aaauauuccugca

SEQ ID NO: 1058723 - RNA, 18 nt, Homo sapiens
aaauauugcuucaauaau

SEQ ID NO: 1058724 - RNA, 19 nt, Homo sapiens
aaauauuuacauaugaaau

SEQ ID NO: 1058725 - RNA, 15 nt, Homo sapiens
aaauauuuaugagaa

SEQ ID NO: 1058726 - RNA, 23 nt, Homo sapiens
aaauauuuaugagaaaguucuca

SEQ ID NO: 1058727 - RNA, 16 nt, Homo sapiens
aaauauuuccuuaaac

SEQ ID NO: 1058728 - RNA, 12 nt, Homo sapiens
aaauauuugaca

SEQ ID NO: 1058729 - RNA, 20 nt, Homo sapiens
aaauauuuugcggcauuaaa

SEQ ID NO: 1058730 - RNA, 16 nt, Homo sapiens
aaauauuuuugcugua

SEQ ID NO: 1058731 - RNA, 13 nt, Homo sapiens
aaaucaagagcuu

SEQ ID NO: 1058732 - RNA, 16 nt, Homo sapiens
aaaucaaugucacuua

SEQ ID NO: 1058733 - RNA, 19 nt, Homo sapiens
aaaucaauuauugaaacag

SEQ ID NO: 1058734 - RNA, 22 nt, Homo sapiens
aaaucacacagccaagccaguc

SEQ ID NO: 1058735 - RNA, 20 nt, Homo sapiens
aaaucaccacaccaaaccuc

SEQ ID NO: 1058736 - RNA, 19 nt, Homo sapiens
aaaucacgaccacugauag

SEQ ID NO: 1058737 - RNA, 17 nt, Homo sapiens
aaaucagcugcuacuac

SEQ ID NO: 1058738 - RNA, 10 nt, Homo sapiens
aaauccacua

SEQ ID NO: 1058739 - RNA, 23 nt, Homo sapiens
aaauccacuagcaccgaccccac

SEQ ID NO: 1058740 - RNA, 17 nt, Homo sapiens
aaaucccuccuucaucc

SEQ ID NO: 1058741 - RNA, 15 nt, Homo sapiens
aaauccuuccaugaa

SEQ ID NO: 1058742 - RNA, 21 nt, Homo sapiens
aaauccuuuuaaaucuugaua

SEQ ID NO: 1058743 - RNA, 12 nt, Homo sapiens
aaaucuagaaga

SEQ ID NO: 1058744 - RNA, 15 nt, Homo sapiens
aaaucuaggauuauu

SEQ ID NO: 1058745 - RNA, 12 nt, Homo sapiens
aaaucuaugaaa

SEQ ID NO: 1058746 - RNA, 16 nt, Homo sapiens
aaaucucagcaaugau

SEQ ID NO: 1058747 - RNA, 21 nt, Homo sapiens
aaaucucagcaaugauuacuc

SEQ ID NO: 1058748 - RNA, 13 nt, Homo sapiens
aaaucugugccug

SEQ ID NO: 1058749 - RNA, 15 nt, Homo sapiens
aaaucuugacuacag

SEQ ID NO: 1058750 - RNA, 17 nt, Homo sapiens
aggugucuuaagccuuu

SEQ ID NO: 1058751 - RNA, 16 nt, Homo sapiens
aggugugaacagggaa

SEQ ID NO: 1058752 - RNA, 14 nt, Homo sapiens
aggugugacuugaa

SEQ ID NO: 1058753 - RNA, 15 nt, Homo sapiens
aggugugacuugaac

SEQ ID NO: 1058754 - RNA, 16 nt, Homo sapiens
agguguucaagaccag

SEQ ID NO: 1058755 - RNA, 22 nt, Homo sapiens
agguguucaagaccagccugac

SEQ ID NO: 1058756 - RNA, 16 nt, Homo sapiens
agguuaaggugcaaua

SEQ ID NO: 1058757 - RNA, 14 nt, Homo sapiens
agguuggcaaaaag

SEQ ID NO: 1058758 - RNA, 12 nt, Homo sapiens
agguuggcagua

SEQ ID NO: 1058759 - RNA, 18 nt, Homo sapiens
agguuuaacucagaucac

SEQ ID NO: 1058760 - RNA, 13 nt, Homo sapiens
agguuuacauuca

SEQ ID NO: 1058761 - RNA, 17 nt, Homo sapiens
agguuuaggucaagaag

SEQ ID NO: 1058762 - RNA, 18 nt, Homo sapiens
agguuugagaagcacugu

SEQ ID NO: 1058763 - RNA, 22 nt, Homo sapiens
agguuuuuggucugacccacug

SEQ ID NO: 1058764 - RNA, 16 nt, Homo sapiens
aguaaaaaucaauacc

SEQ ID NO: 1058765 - RNA, 18 nt, Homo sapiens
aguaaaaccacagcaguu

SEQ ID NO: 1058766 - RNA, 13 nt, Homo sapiens
aguaaaucucaca

SEQ ID NO: 1058767 - RNA, 13 nt, Homo sapiens
aguaacauuugcc

SEQ ID NO: 1058768 - RNA, 14 nt, Homo sapiens
aguaacauuugccu

SEQ ID NO: 1058769 - RNA, 17 nt, Homo sapiens
aguaacggaacaguauc

SEQ ID NO: 1058770 - RNA, 15 nt, Homo sapiens
aguaacugagauuac

SEQ ID NO: 1058771 - RNA, 20 nt, Homo sapiens
aguaagaaaacaucacugaa

SEQ ID NO: 1058772 - RNA, 17 nt, Homo sapiens
aguaagcaaagacuuuc

SEQ ID NO: 1058773 - RNA, 16 nt, Homo sapiens
aguaaguggugagaac

SEQ ID NO: 1058774 - RNA, 16 nt, Homo sapiens
aguaaucuguguacaa

SEQ ID NO: 1058775 - RNA, 18 nt, Homo sapiens
aguaaucuguguacaaag

SEQ ID NO: 1058776 - RNA, 15 nt, Homo sapiens
aguaaugagcaugau

SEQ ID NO: 1058777 - RNA, 20 nt, Homo sapiens
aguaauuuuaaguaauuuca

SEQ ID NO: 1058778 - RNA, 21 nt, Homo sapiens
aguacaccccaacagcacccu

SEQ ID NO: 1058779 - RNA, 17 nt, Homo sapiens
aguacaggcagcacaga

SEQ ID NO: 1058780 - RNA, 20 nt, Homo sapiens
aguacauggucaaguauuaa

SEQ ID NO: 1058781 - RNA, 18 nt, Homo sapiens
aguacguugugcauuugg

SEQ ID NO: 1058782 - RNA, 14 nt, Homo sapiens
aguacuggcauggu

SEQ ID NO: 1058783 - RNA, 22 nt, Homo sapiens
aguacuguaacugugucaugau

SEQ ID NO: 1058784 - RNA, 11 nt, Homo sapiens
aguacuugaaa

SEQ ID NO: 1058785 - RNA, 15 nt, Homo sapiens
aguacuuuaccuccu

SEQ ID NO: 1058786 - RNA, 17 nt, Homo sapiens
aguagaaagcauaacaa

SEQ ID NO: 1058787 - RNA, 22 nt, Homo sapiens
aguagaaagcauaacaaaaaga

SEQ ID NO: 1058788 - RNA, 16 nt, Homo sapiens
aguagaagauuugaug

SEQ ID NO: 1058789 - RNA, 17 nt, Homo sapiens
aguagaauagugguugc

SEQ ID NO: 1058790 - RNA, 14 nt, Homo sapiens
aguagaauccuaaa

SEQ ID NO: 1058791 - RNA, 15 nt, Homo sapiens
aguagacaagcaauu

SEQ ID NO: 1058792 - RNA, 18 nt, Homo sapiens
aguagacuauaagcagaa

SEQ ID NO: 1058793 - RNA, 19 nt, Homo sapiens
aguagcaaguucuagagaa

SEQ ID NO: 1058794 - RNA, 21 nt, Homo sapiens
aguagcuggauuacaggcaug

SEQ ID NO: 1058795 - RNA, 14 nt, Homo sapiens
aguagcugggacua

SEQ ID NO: 1058796 - RNA, 20 nt, Homo sapiens
aguagcugggacuacaggca

SEQ ID NO: 1058797 - RNA, 18 nt, Homo sapiens
aguagcuugggacaaauc

SEQ ID NO: 1058798 - RNA, 15 nt, Homo sapiens
aguaggaagacuuug

SEQ ID NO: 1058799 - RNA, 18 nt, Homo sapiens
aguaggaagacuuuggaa

SEQ ID NO: 1058800 - RNA, 18 nt, Homo sapiens
aguaggugugacuugaac

SEQ ID NO: 1058801 - RNA, 17 nt, Homo sapiens
aguaguugacagugcua

SEQ ID NO: 1058802 - RNA, 22 nt, Homo sapiens
aguauaaauaaaaugagcaaaa

SEQ ID NO: 1058803 - RNA, 17 nt, Homo sapiens
aguauaaauaacuaaug

SEQ ID NO: 1058804 - RNA, 15 nt, Homo sapiens
aguauaaauuuacuu

SEQ ID NO: 1058805 - RNA, 21 nt, Homo sapiens
aguauauuuauagucacaaga

SEQ ID NO: 1058806 - RNA, 21 nt, Homo sapiens
aguaucaggucucccacgugg

SEQ ID NO: 1058807 - RNA, 13 nt, Homo sapiens
aguauccacuuug

SEQ ID NO: 1058808 - RNA, 13 nt, Homo sapiens
aguaucuauuucu

SEQ ID NO: 1058809 - RNA, 16 nt, Homo sapiens
aguaugaggcauuugu

SEQ ID NO: 1058810 - RNA, 14 nt, Homo sapiens
aguaugagggaaaa

SEQ ID NO: 1058811 - RNA, 19 nt, Homo sapiens
aguaugagucaaugugcag

SEQ ID NO: 1058812 - RNA, 21 nt, Homo sapiens
aguauuauaggccaaacuggc

SEQ ID NO: 1058813 - RNA, 16 nt, Homo sapiens
aguauucuugucaaaa

SEQ ID NO: 1058814 - RNA, 22 nt, Homo sapiens
aguauuugcugaauggggaccu

SEQ ID NO: 1058815 - RNA, 21 nt, Homo sapiens
aguauuuuccuccaggcaaaa

SEQ ID NO: 1058816 - RNA, 22 nt, Homo sapiens
agucaaaacagagaugugauaa

SEQ ID NO: 1058817 - RNA, 20 nt, Homo sapiens
agucaauuaaaggcuuucag

SEQ ID NO: 1058818 - RNA, 17 nt, Homo sapiens
agucacaucucuuccuc

SEQ ID NO: 1058819 - RNA, 19 nt, Homo sapiens
agucacauggccuaugcac

SEQ ID NO: 1058820 - RNA, 22 nt, Homo sapiens
agucacauggccuaugcacaua

SEQ ID NO: 1058821 - RNA, 18 nt, Homo sapiens
agucacuaguuguaauuu

SEQ ID NO: 1058822 - RNA, 21 nt, Homo sapiens
agucacuuugccagagccuga

SEQ ID NO: 1058823 - RNA, 17 nt, Homo sapiens
agucagagcuugaagaa

SEQ ID NO: 1058824 - RNA, 14 nt, Homo sapiens
agucagugcaaaug

SEQ ID NO: 1058825 - RNA, 15 nt, Homo sapiens
agucauauaccuaua

SEQ ID NO: 1058826 - RNA, 21 nt, Homo sapiens
agucauccaaucuaaccacau

SEQ ID NO: 1058827 - RNA, 15 nt, Homo sapiens
agucauccugccaac

SEQ ID NO: 1058828 - RNA, 14 nt, Homo sapiens
agucaucucaacca

SEQ ID NO: 1058829 - RNA, 20 nt, Homo sapiens
agucaugaagcccaagugaa

SEQ ID NO: 1058830 - RNA, 20 nt, Homo sapiens
agucaugcaaaggcugggac

SEQ ID NO: 1058831 - RNA, 19 nt, Homo sapiens
agucauuugcugagcaugu

SEQ ID NO: 1058832 - RNA, 20 nt, Homo sapiens
aguccaaggaaaccacagcu

SEQ ID NO: 1058833 - RNA, 20 nt, Homo sapiens
aguccaauuccaaagccaga

SEQ ID NO: 1058834 - RNA, 20 nt, Homo sapiens
aguccaauuccuugcacaua

SEQ ID NO: 1058835 - RNA, 18 nt, Homo sapiens
aguccacugcugaggaca

SEQ ID NO: 1058836 - RNA, 15 nt, Homo sapiens
aguccagauuuacac

SEQ ID NO: 1058837 - RNA, 12 nt, Homo sapiens
aguccagucucu

SEQ ID NO: 1058838 - RNA, 16 nt, Homo sapiens
agucccagcuacuuga

SEQ ID NO: 1058839 - RNA, 17 nt, Homo sapiens
agucccugccaucaugu

SEQ ID NO: 1058840 - RNA, 18 nt, Homo sapiens
aguccgacaaagcuacuu

SEQ ID NO: 1058841 - RNA, 19 nt, Homo sapiens
aguccucguagccaucucu

SEQ ID NO: 1058842 - RNA, 17 nt, Homo sapiens
aguccuguuugcaggga

SEQ ID NO: 1058843 - RNA, 19 nt, Homo sapiens
aguccuguuugcagggaag

SEQ ID NO: 1058844 - RNA, 23 nt, Homo sapiens
agucgugccuguuugcuuagcau

SEQ ID NO: 1058845 - RNA, 21 nt, Homo sapiens
agucuaaggaugcuaaaccuu

SEQ ID NO: 1058846 - RNA, 21 nt, Homo sapiens
agucuagccuggacaacacag

SEQ ID NO: 1058847 - RNA, 18 nt, Homo sapiens
agucucugcccaaacaua

SEQ ID NO: 1058848 - RNA, 11 nt, Homo sapiens
agucucugugc

SEQ ID NO: 1058849 - RNA, 18 nt, Homo sapiens
agucucugugcuuugacu

SEQ ID NO: 1058850 - RNA, 21 nt, Homo sapiens
agucucugugcuuugacucac

SEQ ID NO: 1058851 - RNA, 22 nt, Homo sapiens
agucucuuuaaucuucaguuuu

SEQ ID NO: 1058852 - RNA, 19 nt, Homo sapiens
agucugauuaaagguggug

SEQ ID NO: 1058853 - RNA, 13 nt, Homo sapiens
agucuggcucugu

SEQ ID NO: 1058854 - RNA, 16 nt, Homo sapiens
agucugucucugucau

SEQ ID NO: 1058855 - RNA, 15 nt, Homo sapiens
agucuuauuuauuca

SEQ ID NO: 1058856 - RNA, 19 nt, Homo sapiens
agucuucucauagcauuaa

SEQ ID NO: 1058857 - RNA, 20 nt, Homo sapiens
agucuucucauagcauuaac

SEQ ID NO: 1058858 - RNA, 17 nt, Homo sapiens
agucuugaaacaagcaa

SEQ ID NO: 1058859 - RNA, 20 nt, Homo sapiens
agucuugggucuaugccuug

SEQ ID NO: 1058860 - RNA, 16 nt, Homo sapiens
agucuuguauuaaguu

SEQ ID NO: 1058861 - RNA, 19 nt, Homo sapiens
agucuugucauugccagcu

SEQ ID NO: 1058862 - RNA, 22 nt, Homo sapiens
agucuuuacagcugagcacauu

SEQ ID NO: 1058863 - RNA, 20 nt, Homo sapiens
agugaaagcaucacuuggga

SEQ ID NO: 1058864 - RNA, 16 nt, Homo sapiens
agugaaagccagauuc

SEQ ID NO: 1058865 - RNA, 16 nt, Homo sapiens
agugaaauauaugcua

SEQ ID NO: 1058866 - RNA, 12 nt, Homo sapiens
agugaaauuacu

SEQ ID NO: 1058867 - RNA, 19 nt, Homo sapiens
agugaacaaauuuacagag

SEQ ID NO: 1058868 - RNA, 20 nt, Homo sapiens
agugaacaaauuuacagaga

SEQ ID NO: 1058869 - RNA, 16 nt, Homo sapiens
agugaagaugccagug

SEQ ID NO: 1058870 - RNA, 17 nt, Homo sapiens
agugaagugaagagagg

SEQ ID NO: 1058871 - RNA, 21 nt, Homo sapiens
agugaauuagugucaugucag

SEQ ID NO: 1058872 - RNA, 14 nt, Homo sapiens
agugacacagcagc

SEQ ID NO: 1058873 - RNA, 15 nt, Homo sapiens
agugacacagcagcu

SEQ ID NO: 1058874 - RNA, 18 nt, Homo sapiens
agugacagggaagcuaca

SEQ ID NO: 1058875 - RNA, 20 nt, Homo sapiens
agugacaucucuuugauguc

SEQ ID NO: 1058876 - RNA, 12 nt, Homo sapiens
agugacauuugu

SEQ ID NO: 1058877 - RNA, 13 nt, Homo sapiens
agugagagggcau

SEQ ID NO: 1058878 - RNA, 15 nt, Homo sapiens
agugagcugauauca

SEQ ID NO: 1058879 - RNA, 21 nt, Homo sapiens
agugauaucccccagccucaa

SEQ ID NO: 1058880 - RNA, 22 nt, Homo sapiens
agugauaucccccagccucaag

SEQ ID NO: 1058881 - RNA, 16 nt, Homo sapiens
agugauucuccugccu

SEQ ID NO: 1058882 - RNA, 16 nt, Homo sapiens
agugauucuugugccu

SEQ ID NO: 1058883 - RNA, 17 nt, Homo sapiens
agugcaaauuugauaca

SEQ ID NO: 1058884 - RNA, 17 nt, Homo sapiens
agugcaacagcacuggc

SEQ ID NO: 1058885 - RNA, 18 nt, Homo sapiens
agugcaacagcacuggcu

SEQ ID NO: 1058886 - RNA, 19 nt, Homo sapiens
agugcaagccccugcucca

SEQ ID NO: 1058887 - RNA, 17 nt, Homo sapiens
agugcaaugcacgaucu

SEQ ID NO: 1058888 - RNA, 19 nt, Homo sapiens
agugcacuuuaagaggugg

SEQ ID NO: 1058889 - RNA, 19 nt, Homo sapiens
agugcaguggcgugaucuc

SEQ ID NO: 1058890 - RNA, 18 nt, Homo sapiens
agugccaauauuucugau

SEQ ID NO: 1058891 - RNA, 16 nt, Homo sapiens
agugccacucauuccu

SEQ ID NO: 1058892 - RNA, 16 nt, Homo sapiens
agugcccccaacagca

SEQ ID NO: 1058893 - RNA, 12 nt, Homo sapiens
agugcugagauu

SEQ ID NO: 1058894 - RNA, 13 nt, Homo sapiens
auaacuauggaau

SEQ ID NO: 1058895 - RNA, 18 nt, Homo sapiens
auaacucugcacuacucc

SEQ ID NO: 1058896 - RNA, 18 nt, Homo sapiens
auaacugaaaaugugcua

SEQ ID NO: 1058897 - RNA, 21 nt, Homo sapiens
auaacuuaaaaaaaugacaga

SEQ ID NO: 1058898 - RNA, 20 nt, Homo sapiens
auaacuuuucuaaagccuua

SEQ ID NO: 1058899 - RNA, 19 nt, Homo sapiens
auaagagaaucaacauuuc

SEQ ID NO: 1058900 - RNA, 17 nt, Homo sapiens
auaagaggugcuacuga

SEQ ID NO: 1058901 - RNA, 15 nt, Homo sapiens
auaagauuuaauuca

SEQ ID NO: 1058902 - RNA, 16 nt, Homo sapiens
auaagcacugugcuaa

SEQ ID NO: 1058903 - RNA, 20 nt, Homo sapiens
auaagcagucauccucagau

SEQ ID NO: 1058904 - RNA, 23 nt, Homo sapiens
auaagcagucauccucagaucau

SEQ ID NO: 1058905 - RNA, 13 nt, Homo sapiens
auaagcuacaugu

SEQ ID NO: 1058906 - RNA, 21 nt, Homo sapiens
auaagcucaauuuaauuuugc

SEQ ID NO: 1058907 - RNA, 19 nt, Homo sapiens
auaagcuuuuaaugcucca

SEQ ID NO: 1058908 - RNA, 14 nt, Homo sapiens
auaaguuuacugaa

SEQ ID NO: 1058909 - RNA, 21 nt, Homo sapiens
auaauaaaacuaaacuuucau

SEQ ID NO: 1058910 - RNA, 14 nt, Homo sapiens
auaauaaaaggaaa

SEQ ID NO: 1058911 - RNA, 17 nt, Homo sapiens
auaauaaagaucaugua

SEQ ID NO: 1058912 - RNA, 15 nt, Homo sapiens
auaauaauugaucaa

SEQ ID NO: 1058913 - RNA, 12 nt, Homo sapiens
auaauacuguau

SEQ ID NO: 1058914 - RNA, 21 nt, Homo sapiens
auaauagacuucccacucuag

SEQ ID NO: 1058915 - RNA, 16 nt, Homo sapiens
auaauaugcugccaaa

SEQ ID NO: 1058916 - RNA, 18 nt, Homo sapiens
auaaucacaacccuucag

SEQ ID NO: 1058917 - RNA, 15 nt, Homo sapiens
auaaucacauuauca

SEQ ID NO: 1058918 - RNA, 16 nt, Homo sapiens
auaaucccagcacuuu

SEQ ID NO: 1058919 - RNA, 13 nt, Homo sapiens
auaaucuucugcc

SEQ ID NO: 1058920 - RNA, 15 nt, Homo sapiens
auaaugcuacugucu

SEQ ID NO: 1058921 - RNA, 18 nt, Homo sapiens
auaaugguugacuggguu

SEQ ID NO: 1058922 - RNA, 19 nt, Homo sapiens
auaaugguugacuggguuu

SEQ ID NO: 1058923 - RNA, 16 nt, Homo sapiens
auaauguuacauuauu

SEQ ID NO: 1058924 - RNA, 17 nt, Homo sapiens
auaauguuacauuauua

SEQ ID NO: 1058925 - RNA, 15 nt, Homo sapiens
auaauuaguuccuca

SEQ ID NO: 1058926 - RNA, 23 nt, Homo sapiens
auaauucagcucuugagagcauu

SEQ ID NO: 1058927 - RNA, 16 nt, Homo sapiens
auaauucuacuuugag

SEQ ID NO: 1058928 - RNA, 15 nt, Homo sapiens
auaauuuaacuucag

SEQ ID NO: 1058929 - RNA, 22 nt, Homo sapiens
auacaaaaauaccuacugcuga

SEQ ID NO: 1058930 - RNA, 18 nt, Homo sapiens
auacaaaaauuagcugga

SEQ ID NO: 1058931 - RNA, 21 nt, Homo sapiens
auacaaacauguuccugggau

SEQ ID NO: 1058932 - RNA, 13 nt, Homo sapiens
auacaacauguag

SEQ ID NO: 1058933 - RNA, 19 nt, Homo sapiens
auacaagaaagcaaugcca

SEQ ID NO: 1058934 - RNA, 18 nt, Homo sapiens
auacaauuagccaggugu

SEQ ID NO: 1058935 - RNA, 12 nt, Homo sapiens
auacacacucaa

SEQ ID NO: 1058936 - RNA, 17 nt, Homo sapiens
auacacacuguugucaa

SEQ ID NO: 1058937 - RNA, 22 nt, Homo sapiens
auacagaacccauuccauuuau

SEQ ID NO: 1058938 - RNA, 16 nt, Homo sapiens
auacagauagauauau

SEQ ID NO: 1058939 - RNA, 13 nt, Homo sapiens
auacagccugcaa

SEQ ID NO: 1058940 - RNA, 19 nt, Homo sapiens
auacaggccucaaggggaa

SEQ ID NO: 1058941 - RNA, 23 nt, Homo sapiens
auacagguauucugcugaugcua

SEQ ID NO: 1058942 - RNA, 18 nt, Homo sapiens
auacaguacaggcagcac

SEQ ID NO: 1058943 - RNA, 14 nt, Homo sapiens
auacaguaucucag

SEQ ID NO: 1058944 - RNA, 16 nt, Homo sapiens
auacauccuagugaau

SEQ ID NO: 1058945 - RNA, 19 nt, Homo sapiens
auacauuaucucacuugug

SEQ ID NO: 1058946 - RNA, 18 nt, Homo sapiens
auaccagugaaccaaaga

SEQ ID NO: 1058947 - RNA, 19 nt, Homo sapiens
auaccagugaaccaaagag

SEQ ID NO: 1058948 - RNA, 21 nt, Homo sapiens
auacccaaguuauugggaugu

SEQ ID NO: 1058949 - RNA, 14 nt, Homo sapiens
auacccaugaacuu

SEQ ID NO: 1058950 - RNA, 14 nt, Homo sapiens
auaccuacugcuga

SEQ ID NO: 1058951 - RNA, 21 nt, Homo sapiens
auaccucaacccccauuucua

SEQ ID NO: 1058952 - RNA, 14 nt, Homo sapiens
auaccugcucuugu

SEQ ID NO: 1058953 - RNA, 16 nt, Homo sapiens
auaccugggauacugu

SEQ ID NO: 1058954 - RNA, 19 nt, Homo sapiens
auaccuucuuaaguuuuca

SEQ ID NO: 1058955 - RNA, 21 nt, Homo sapiens
auacgccuguaguccuagcca

SEQ ID NO: 1058956 - RNA, 14 nt, Homo sapiens
auacgguaugauau

SEQ ID NO: 1058957 - RNA, 20 nt, Homo sapiens
auacguuugaaauaguugau

SEQ ID NO: 1058958 - RNA, 18 nt, Homo sapiens
auacuaaaaaucaugaga

SEQ ID NO: 1058959 - RNA, 14 nt, Homo sapiens
auacuacacauuca

SEQ ID NO: 1058960 - RNA, 17 nt, Homo sapiens
auacucuucaaggacuu

SEQ ID NO: 1058961 - RNA, 20 nt, Homo sapiens
auacugaggaaugucuuuca

SEQ ID NO: 1058962 - RNA, 18 nt, Homo sapiens
auacugccagaugcugau

SEQ ID NO: 1058963 - RNA, 17 nt, Homo sapiens
auacuggcuaacagaug

SEQ ID NO: 1058964 - RNA, 22 nt, Homo sapiens
auacuguauuaagagugaaaau

SEQ ID NO: 1058965 - RNA, 13 nt, Homo sapiens
auacuuuacaaag

SEQ ID NO: 1058966 - RNA, 16 nt, Homo sapiens
auacuuugucugaaaa

SEQ ID NO: 1058967 - RNA, 22 nt, Homo sapiens
auacuuuuugcauauguaagga

SEQ ID NO: 1058968 - RNA, 17 nt, Homo sapiens
auagaacugaaugagaa

SEQ ID NO: 1058969 - RNA, 19 nt, Homo sapiens
auagaagcaaaugacaaaa

SEQ ID NO: 1058970 - RNA, 18 nt, Homo sapiens
auagaauaaaauauaauu

SEQ ID NO: 1058971 - RNA, 17 nt, Homo sapiens
auagaauuaacacauga

SEQ ID NO: 1058972 - RNA, 20 nt, Homo sapiens
auagagaucauccuuuccag

SEQ ID NO: 1058973 - RNA, 15 nt, Homo sapiens
auagagccacguaug

SEQ ID NO: 1058974 - RNA, 20 nt, Homo sapiens
auagauauaugcucugcaug

SEQ ID NO: 1058975 - RNA, 13 nt, Homo sapiens
auagcaagacaca

SEQ ID NO: 1058976 - RNA, 15 nt, Homo sapiens
auagcaccuccacau

SEQ ID NO: 1058977 - RNA, 20 nt, Homo sapiens
auagcaccuccacauaccug

SEQ ID NO: 1058978 - RNA, 18 nt, Homo sapiens
auagcagauuguguaaca

SEQ ID NO: 1058979 - RNA, 18 nt, Homo sapiens
auagcaguugaaacaaga

SEQ ID NO: 1058980 - RNA, 23 nt, Homo sapiens
auagcaguugaaacaagaagcca

SEQ ID NO: 1058981 - RNA, 23 nt, Homo sapiens
auagccaacugcuguucauguua

SEQ ID NO: 1058982 - RNA, 13 nt, Homo sapiens
auagcccagacac

SEQ ID NO: 1058983 - RNA, 19 nt, Homo sapiens
auagcuaauuuuugcaaau

SEQ ID NO: 1058984 - RNA, 14 nt, Homo sapiens
auagcuuccaugag

SEQ ID NO: 1058985 - RNA, 12 nt, Homo sapiens
auaggaguucac

SEQ ID NO: 1058986 - RNA, 17 nt, Homo sapiens
auaggaguucacuucau

SEQ ID NO: 1058987 - RNA, 18 nt, Homo sapiens
auaggcauuugauuuugc

SEQ ID NO: 1058988 - RNA, 14 nt, Homo sapiens
auaggcccagugag

SEQ ID NO: 1058989 - RNA, 21 nt, Homo sapiens
auagggaaguaacauuugccu

SEQ ID NO: 1058990 - RNA, 13 nt, Homo sapiens
auaggucacuggc

SEQ ID NO: 1058991 - RNA, 20 nt, Homo sapiens
auaggugcuacaaaaacaca

SEQ ID NO: 1058992 - RNA, 17 nt, Homo sapiens
auaguaugaaugcagug

SEQ ID NO: 1058993 - RNA, 22 nt, Homo sapiens
auaguauugugcauagagccac

SEQ ID NO: 1058994 - RNA, 17 nt, Homo sapiens
auagucccagcuacuca

SEQ ID NO: 1058995 - RNA, 14 nt, Homo sapiens
auagucgcagcuac

SEQ ID NO: 1058996 - RNA, 15 nt, Homo sapiens
auaguggcaagauca

SEQ ID NO: 1058997 - RNA, 20 nt, Homo sapiens
auagugggcaccccacugca

SEQ ID NO: 1058998 - RNA, 15 nt, Homo sapiens
auaguggugugauuu

SEQ ID NO: 1058999 - RNA, 12 nt, Homo sapiens
auaguguccaaa

SEQ ID NO: 1059000 - RNA, 16 nt, Homo sapiens
auaguguuggaaaaug

SEQ ID NO: 1059001 - RNA, 16 nt, Homo sapiens
auaguucccuagucua

SEQ ID NO: 1059002 - RNA, 22 nt, Homo sapiens
auaguucccuagucuauucauu

SEQ ID NO: 1059003 - RNA, 14 nt, Homo sapiens
auaguugugcaugc

SEQ ID NO: 1059004 - RNA, 17 nt, Homo sapiens
auaguuugcuguugcau

SEQ ID NO: 1059005 - RNA, 18 nt, Homo sapiens
auauaaauuauuaguuua

SEQ ID NO: 1059006 - RNA, 17 nt, Homo sapiens
auauaaauuuucccaaa

SEQ ID NO: 1059007 - RNA, 13 nt, Homo sapiens
auauaagcucaau

SEQ ID NO: 1059008 - RNA, 22 nt, Homo sapiens
auauaauacuauauuuauacug

SEQ ID NO: 1059009 - RNA, 13 nt, Homo sapiens
auauaauacugua

SEQ ID NO: 1059010 - RNA, 10 nt, Homo sapiens
auauacaaau

SEQ ID NO: 1059011 - RNA, 19 nt, Homo sapiens
auauacagcaggugcucaa

SEQ ID NO: 1059012 - RNA, 16 nt, Homo sapiens
auauacaguaacuuua

SEQ ID NO: 1059013 - RNA, 19 nt, Homo sapiens
auauacaguaacuuuaugu

SEQ ID NO: 1059014 - RNA, 22 nt, Homo sapiens
auauagagggcuuaugauucag

SEQ ID NO: 1059015 - RNA, 17 nt, Homo sapiens
auauaguggacaguaac

SEQ ID NO: 1059016 - RNA, 19 nt, Homo sapiens
auauauauuuuugugcaca

SEQ ID NO: 1059017 - RNA, 23 nt, Homo sapiens
auauaugauauauaaaugugauu

SEQ ID NO: 1059018 - RNA, 15 nt, Homo sapiens
auauaugauuagcca

SEQ ID NO: 1059019 - RNA, 16 nt, Homo sapiens
auauauggggggccaa

SEQ ID NO: 1059020 - RNA, 14 nt, Homo sapiens
auauauuaagugac

SEQ ID NO: 1059021 - RNA, 18 nt, Homo sapiens
auauauuaugauugcaua

SEQ ID NO: 1059022 - RNA, 21 nt, Homo sapiens
auauauuuuugguugucaaua

SEQ ID NO: 1059023 - RNA, 22 nt, Homo sapiens
auaucaauuaauuugaaaacau

SEQ ID NO: 1059024 - RNA, 16 nt, Homo sapiens
auaucaucagcauacc

SEQ ID NO: 1059025 - RNA, 22 nt, Homo sapiens
auaucauuuauuuuuuacauua

SEQ ID NO: 1059026 - RNA, 21 nt, Homo sapiens
auaucccacugggagcacuuu

SEQ ID NO: 1059027 - RNA, 16 nt, Homo sapiens
auaucccuuacuccag

SEQ ID NO: 1059028 - RNA, 20 nt, Homo sapiens
auaucugcuguccagacagc

SEQ ID NO: 1059029 - RNA, 15 nt, Homo sapiens
auaucuugaaacaua

SEQ ID NO: 1059030 - RNA, 15 nt, Homo sapiens
auaugaaacauuuaa

SEQ ID NO: 1059031 - RNA, 16 nt, Homo sapiens
auaugaacggugagca

SEQ ID NO: 1059032 - RNA, 14 nt, Homo sapiens
auaugaaguguuag

SEQ ID NO: 1059033 - RNA, 13 nt, Homo sapiens
auaugagcuuuau

SEQ ID NO: 1059034 - RNA, 20 nt, Homo sapiens
auaugauauauaaaugugau

SEQ ID NO: 1059035 - RNA, 20 nt, Homo sapiens
auaugaugaucuggauccac

SEQ ID NO: 1059036 - RNA, 16 nt, Homo sapiens
auaugauugugcacau

SEQ ID NO: 1059037 - RNA, 12 nt, Homo sapiens
auaugcaaugug

SEQ ID NO: 1059038 - RNA, 21 nt, Homo sapiens
auaugcacaauagcaguugaa

SEQ ID NO: 1059039 - RNA, 15 nt, Homo sapiens
auccgggaucaaagu

SEQ ID NO: 1059040 - RNA, 15 nt, Homo sapiens
auccuaacacauuau

SEQ ID NO: 1059041 - RNA, 14 nt, Homo sapiens
auccuaaucaucca

SEQ ID NO: 1059042 - RNA, 22 nt, Homo sapiens
auccuacaaggcuggcagugac

SEQ ID NO: 1059043 - RNA, 13 nt, Homo sapiens
auccuacuucucc

SEQ ID NO: 1059044 - RNA, 14 nt, Homo sapiens
auccuaggcauuug

SEQ ID NO: 1059045 - RNA, 23 nt, Homo sapiens
auccuaucagccugucucuucca

SEQ ID NO: 1059046 - RNA, 14 nt, Homo sapiens
auccuauggcagag

SEQ ID NO: 1059047 - RNA, 14 nt, Homo sapiens
auccuaugugauuu

SEQ ID NO: 1059048 - RNA, 22 nt, Homo sapiens
auccucaugaggcuucucagcc

SEQ ID NO: 1059049 - RNA, 15 nt, Homo sapiens
auccucccaccucag

SEQ ID NO: 1059050 - RNA, 23 nt, Homo sapiens
auccugagcagugccagcuuucu

SEQ ID NO: 1059051 - RNA, 14 nt, Homo sapiens
auccugcaauucca

SEQ ID NO: 1059052 - RNA, 18 nt, Homo sapiens
auccugucccaccaugca

SEQ ID NO: 1059053 - RNA, 11 nt, Homo sapiens
auccugugaag

SEQ ID NO: 1059054 - RNA, 18 nt, Homo sapiens
auccuguuuuuaaaccau

SEQ ID NO: 1059055 - RNA, 18 nt, Homo sapiens
auccuuaaugcagagcua

SEQ ID NO: 1059056 - RNA, 17 nt, Homo sapiens
auccuuccucauuugca

SEQ ID NO: 1059057 - RNA, 16 nt, Homo sapiens
auccuugaauguucuc

SEQ ID NO: 1059058 - RNA, 20 nt, Homo sapiens
auccuugauaaaugccucau

SEQ ID NO: 1059059 - RNA, 23 nt, Homo sapiens
aucgccugaguugcuuuuacuuc

SEQ ID NO: 1059060 - RNA, 15 nt, Homo sapiens
aucgcugucaucuca

SEQ ID NO: 1059061 - RNA, 16 nt, Homo sapiens
aucggaagcagugccu

SEQ ID NO: 1059062 - RNA, 17 nt, Homo sapiens
aucggagacagugaucu

SEQ ID NO: 1059063 - RNA, 17 nt, Homo sapiens
aucguggagacagggca

SEQ ID NO: 1059064 - RNA, 17 nt, Homo sapiens
aucguucucugccucac

SEQ ID NO: 1059065 - RNA, 17 nt, Homo sapiens
aucuaaggaugucacag

SEQ ID NO: 1059066 - RNA, 20 nt, Homo sapiens
aucuaaggaugucacagggc

SEQ ID NO: 1059067 - RNA, 16 nt, Homo sapiens
aucuaaugugaaguag

SEQ ID NO: 1059068 - RNA, 18 nt, Homo sapiens
aucuacaaaaaacaacaa

SEQ ID NO: 1059069 - RNA, 17 nt, Homo sapiens
aucuacacuccagugag

SEQ ID NO: 1059070 - RNA, 15 nt, Homo sapiens
aucuaccugccucag

SEQ ID NO: 1059071 - RNA, 14 nt, Homo sapiens
aucuagaagacugu

SEQ ID NO: 1059072 - RNA, 17 nt, Homo sapiens
aucuagaagacugucag

SEQ ID NO: 1059073 - RNA, 19 nt, Homo sapiens
aucuaggaagacuuuggaa

SEQ ID NO: 1059074 - RNA, 15 nt, Homo sapiens
aucuagguucaggaa

SEQ ID NO: 1059075 - RNA, 19 nt, Homo sapiens
aucuauaaagaagaacuug

SEQ ID NO: 1059076 - RNA, 13 nt, Homo sapiens
aucuauacauacc

SEQ ID NO: 1059077 - RNA, 14 nt, Homo sapiens
aucuaucaacuaua

SEQ ID NO: 1059078 - RNA, 14 nt, Homo sapiens
aucuaucugcuuau

SEQ ID NO: 1059079 - RNA, 16 nt, Homo sapiens
aucuauuucugagaag

SEQ ID NO: 1059080 - RNA, 14 nt, Homo sapiens
aucucaaaacugca

SEQ ID NO: 1059081 - RNA, 17 nt, Homo sapiens
aucucaaccauccccuc

SEQ ID NO: 1059082 - RNA, 14 nt, Homo sapiens
aucucaauuugcag

SEQ ID NO: 1059083 - RNA, 12 nt, Homo sapiens
aucucagugcag

SEQ ID NO: 1059084 - RNA, 17 nt, Homo sapiens
aucucauagguugccaa

SEQ ID NO: 1059085 - RNA, 16 nt, Homo sapiens
aucucauggcagcuaa

SEQ ID NO: 1059086 - RNA, 22 nt, Homo sapiens
aucucauuggacccuuccaugg

SEQ ID NO: 1059087 - RNA, 18 nt, Homo sapiens
aucuccaagaccagagau

SEQ ID NO: 1059088 - RNA, 20 nt, Homo sapiens
aucuccaguagaaagcauaa

SEQ ID NO: 1059089 - RNA, 15 nt, Homo sapiens
aucuccauucucuca

SEQ ID NO: 1059090 - RNA, 13 nt, Homo sapiens
aucuccugaccuc

SEQ ID NO: 1059091 - RNA, 19 nt, Homo sapiens
aucuccugugcauggguga

SEQ ID NO: 1059092 - RNA, 16 nt, Homo sapiens
aucucuaauauggcaa

SEQ ID NO: 1059093 - RNA, 13 nt, Homo sapiens
aucucucuacucc

SEQ ID NO: 1059094 - RNA, 18 nt, Homo sapiens
aucucugaauuugagaua

SEQ ID NO: 1059095 - RNA, 17 nt, Homo sapiens
aucucugaggccucaga

SEQ ID NO: 1059096 - RNA, 22 nt, Homo sapiens
aucucugucccacuuggcauca

SEQ ID NO: 1059097 - RNA, 17 nt, Homo sapiens
aucucugugaaaccccu

SEQ ID NO: 1059098 - RNA, 19 nt, Homo sapiens
aucucuugcacucaaagcu

SEQ ID NO: 1059099 - RNA, 21 nt, Homo sapiens
aucucuuuugaauccaugcuu

SEQ ID NO: 1059100 - RNA, 17 nt, Homo sapiens
aucugaaugugccucuc

SEQ ID NO: 1059101 - RNA, 20 nt, Homo sapiens
aucugaguugacuugacaga

SEQ ID NO: 1059102 - RNA, 16 nt, Homo sapiens
aucugccaagcuccuc

SEQ ID NO: 1059103 - RNA, 17 nt, Homo sapiens
aucugccaagcuccuca

SEQ ID NO: 1059104 - RNA, 14 nt, Homo sapiens
aucugcgugacaau

SEQ ID NO: 1059105 - RNA, 15 nt, Homo sapiens
aucugcgugacaaua

SEQ ID NO: 1059106 - RNA, 18 nt, Homo sapiens
aucugcuguccagacagc

SEQ ID NO: 1059107 - RNA, 22 nt, Homo sapiens
aucugcuuuugguuauaaugug

SEQ ID NO: 1059108 - RNA, 14 nt, Homo sapiens
aucuggaaccauca

SEQ ID NO: 1059109 - RNA, 17 nt, Homo sapiens
aucuggagaaccucauc

SEQ ID NO: 1059110 - RNA, 14 nt, Homo sapiens
aucugggaaaauac

SEQ ID NO: 1059111 - RNA, 19 nt, Homo sapiens
aucugggggaguggaauag

SEQ ID NO: 1059112 - RNA, 13 nt, Homo sapiens
aucugggugcaug

SEQ ID NO: 1059113 - RNA, 22 nt, Homo sapiens
aucuggucaaccuccuggacau

SEQ ID NO: 1059114 - RNA, 16 nt, Homo sapiens
aucugucacaccagcc

SEQ ID NO: 1059115 - RNA, 14 nt, Homo sapiens
aucuguccaaggaa

SEQ ID NO: 1059116 - RNA, 22 nt, Homo sapiens
aucugugcaaauccuugauacu

SEQ ID NO: 1059117 - RNA, 19 nt, Homo sapiens
aucuguguucgauggcuca

SEQ ID NO: 1059118 - RNA, 20 nt, Homo sapiens
aucuguuaccagaggacaaa

SEQ ID NO: 1059119 - RNA, 15 nt, Homo sapiens
aucuuaaagcauucc

SEQ ID NO: 1059120 - RNA, 12 nt, Homo sapiens
aucuuacuguac

SEQ ID NO: 1059121 - RNA, 14 nt, Homo sapiens
aucuuagugccuga

SEQ ID NO: 1059122 - RNA, 15 nt, Homo sapiens
aucuuauauaguuua

SEQ ID NO: 1059123 - RNA, 16 nt, Homo sapiens
aucuucaagaccaaag

SEQ ID NO: 1059124 - RNA, 12 nt, Homo sapiens
aucuucacaaaa

SEQ ID NO: 1059125 - RNA, 15 nt, Homo sapiens
aucuucugccuuagu

SEQ ID NO: 1059126 - RNA, 21 nt, Homo sapiens
aucuucuuccaagaaaugcaa

SEQ ID NO: 1059127 - RNA, 14 nt, Homo sapiens
aucuugaucugugu

SEQ ID NO: 1059128 - RNA, 16 nt, Homo sapiens
aucuugaucuguguuu

SEQ ID NO: 1059129 - RNA, 15 nt, Homo sapiens
aucuugccugcauga

SEQ ID NO: 1059130 - RNA, 17 nt, Homo sapiens
aucuugcuuuuuuucac

SEQ ID NO: 1059131 - RNA, 22 nt, Homo sapiens
aucuuguuuuuccacuacugcu

SEQ ID NO: 1059132 - RNA, 18 nt, Homo sapiens
aucuuuaaaauacacacu

SEQ ID NO: 1059133 - RNA, 21 nt, Homo sapiens
aucuuuaaaauacacacucaa

SEQ ID NO: 1059134 - RNA, 13 nt, Homo sapiens
aucuuucuaggag

SEQ ID NO: 1059135 - RNA, 13 nt, Homo sapiens
aucuuugauacuu

SEQ ID NO: 1059136 - RNA, 11 nt, Homo sapiens
aucuuuggaca

SEQ ID NO: 1059137 - RNA, 14 nt, Homo sapiens
aucuuuggacagaa

SEQ ID NO: 1059138 - RNA, 15 nt, Homo sapiens
aucuuuuaagcccau

SEQ ID NO: 1059139 - RNA, 12 nt, Homo sapiens
aucuuuuccacu

SEQ ID NO: 1059140 - RNA, 23 nt, Homo sapiens
aucuuuuuuuuauuccacaucua

SEQ ID NO: 1059141 - RNA, 18 nt, Homo sapiens
augaaaagauuaugaucu

SEQ ID NO: 1059142 - RNA, 14 nt, Homo sapiens
augaaaaugaaucu

SEQ ID NO: 1059143 - RNA, 16 nt, Homo sapiens
augaaaauuaggauuu

SEQ ID NO: 1059144 - RNA, 14 nt, Homo sapiens
augaaacauguucu

SEQ ID NO: 1059145 - RNA, 16 nt, Homo sapiens
augaaagggcaaagac

SEQ ID NO: 1059146 - RNA, 16 nt, Homo sapiens
augaaauaucaugcuc

SEQ ID NO: 1059147 - RNA, 15 nt, Homo sapiens
augaaauaucuguau

SEQ ID NO: 1059148 - RNA, 15 nt, Homo sapiens
augaaaugcucuccu

SEQ ID NO: 1059149 - RNA, 16 nt, Homo sapiens
augaaauguaaauacu

SEQ ID NO: 1059150 - RNA, 21 nt, Homo sapiens
augaaaugucuggucugucca

SEQ ID NO: 1059151 - RNA, 15 nt, Homo sapiens
augaacccccaugau

SEQ ID NO: 1059152 - RNA, 22 nt, Homo sapiens
augaacgaauuaauuaccuggc

SEQ ID NO: 1059153 - RNA, 16 nt, Homo sapiens
augaacucuuaaucaa

SEQ ID NO: 1059154 - RNA, 17 nt, Homo sapiens
augaacuggaccugcac

SEQ ID NO: 1059155 - RNA, 17 nt, Homo sapiens
augaacuuaaaaugaaa

SEQ ID NO: 1059156 - RNA, 12 nt, Homo sapiens
augaacuuucuc

SEQ ID NO: 1059157 - RNA, 17 nt, Homo sapiens
augaagaugggcuucau

SEQ ID NO: 1059158 - RNA, 16 nt, Homo sapiens
augaagcuuuauacgu

SEQ ID NO: 1059159 - RNA, 19 nt, Homo sapiens
augaaucaaagacauggaa

SEQ ID NO: 1059160 - RNA, 18 nt, Homo sapiens
augaaucauugauugaau

SEQ ID NO: 1059161 - RNA, 22 nt, Homo sapiens
augaaucucaagauucaguaga

SEQ ID NO: 1059162 - RNA, 19 nt, Homo sapiens
augaaugaggucccaggca

SEQ ID NO: 1059163 - RNA, 12 nt, Homo sapiens
augaaugaucuu

SEQ ID NO: 1059164 - RNA, 12 nt, Homo sapiens
augaaugcacac

SEQ ID NO: 1059165 - RNA, 12 nt, Homo sapiens
augaaugcagug

SEQ ID NO: 1059166 - RNA, 19 nt, Homo sapiens
augaauucugucauuucaa

SEQ ID NO: 1059167 - RNA, 11 nt, Homo sapiens
augaauucuua

SEQ ID NO: 1059168 - RNA, 19 nt, Homo sapiens
augaauuuuuuucaucuuc

SEQ ID NO: 1059169 - RNA, 16 nt, Homo sapiens
augacaaaaagccuuu

SEQ ID NO: 1059170 - RNA, 16 nt, Homo sapiens
augacaaaggcacuga

SEQ ID NO: 1059171 - RNA, 13 nt, Homo sapiens
augacacaguugg

SEQ ID NO: 1059172 - RNA, 15 nt, Homo sapiens
augacaucucagggg

SEQ ID NO: 1059173 - RNA, 15 nt, Homo sapiens
augacauugcuaaga

SEQ ID NO: 1059174 - RNA, 16 nt, Homo sapiens
augacccaaagaccaa

SEQ ID NO: 1059175 - RNA, 22 nt, Homo sapiens
augaccuuggacaaucaugaaa

SEQ ID NO: 1059176 - RNA, 17 nt, Homo sapiens
augaccuuguugcauga

SEQ ID NO: 1059177 - RNA, 15 nt, Homo sapiens
augaccuuugucuca

SEQ ID NO: 1059178 - RNA, 16 nt, Homo sapiens
augacggcucaugccu

SEQ ID NO: 1059179 - RNA, 15 nt, Homo sapiens
augacguccucucaa

SEQ ID NO: 1059180 - RNA, 15 nt, Homo sapiens
augacuaaagacaua

SEQ ID NO: 1059181 - RNA, 23 nt, Homo sapiens
augacuaaagagagaauguagau

SEQ ID NO: 1059182 - RNA, 16 nt, Homo sapiens
augacugaugacauau

SEQ ID NO: 1059183 - RNA, 14 nt, Homo sapiens
augacuuacuguac

SEQ ID NO: 1059184 - RNA, 16 nt, Homo sapiens
augacuuuauugcauc

SEQ ID NO: 1059185 - RNA, 16 nt, Homo sapiens
augagaaacucuugag

SEQ ID NO: 1059186 - RNA, 20 nt, Homo sapiens
auggugcaaauccuacugaa

SEQ ID NO: 1059187 - RNA, 15 nt, Homo sapiens
auggugcacugagcu

SEQ ID NO: 1059188 - RNA, 18 nt, Homo sapiens
augguguaauaagacaua

SEQ ID NO: 1059189 - RNA, 15 nt, Homo sapiens
augguuaaauaucac

SEQ ID NO: 1059190 - RNA, 19 nt, Homo sapiens
augguuuuccaucuuaucu

SEQ ID NO: 1059191 - RNA, 17 nt, Homo sapiens
auguaaacccucaaggg

SEQ ID NO: 1059192 - RNA, 23 nt, Homo sapiens
auguaacauguaggaaguaggaa

SEQ ID NO: 1059193 - RNA, 14 nt, Homo sapiens
auguaacuacagga

SEQ ID NO: 1059194 - RNA, 17 nt, Homo sapiens
auguaagcauaacuuau

SEQ ID NO: 1059195 - RNA, 17 nt, Homo sapiens
auguaauaaugugaauc

SEQ ID NO: 1059196 - RNA, 21 nt, Homo sapiens
auguaauugaauaaaguugaa

SEQ ID NO: 1059197 - RNA, 18 nt, Homo sapiens
auguacaugaagaagcua

SEQ ID NO: 1059198 - RNA, 21 nt, Homo sapiens
auguacaugaagaagcuaaau

SEQ ID NO: 1059199 - RNA, 14 nt, Homo sapiens
auguaccagcaucu

SEQ ID NO: 1059200 - RNA, 21 nt, Homo sapiens
auguaguuuuccauccuucaa

SEQ ID NO: 1059201 - RNA, 20 nt, Homo sapiens
auguaucccaacuccuauaa

SEQ ID NO: 1059202 - RNA, 13 nt, Homo sapiens
auguaugcagcua

SEQ ID NO: 1059203 - RNA, 22 nt, Homo sapiens
auguaugucuuggacacuguac

SEQ ID NO: 1059204 - RNA, 14 nt, Homo sapiens
auguaugugcacug

SEQ ID NO: 1059205 - RNA, 18 nt, Homo sapiens
auguauguuuacauauca

SEQ ID NO: 1059206 - RNA, 22 nt, Homo sapiens
augucacagggccaacuugagg

SEQ ID NO: 1059207 - RNA, 19 nt, Homo sapiens
augucagaguagaagauuu

SEQ ID NO: 1059208 - RNA, 15 nt, Homo sapiens
augucaguggaagaa

SEQ ID NO: 1059209 - RNA, 18 nt, Homo sapiens
augucccuucucaugccu

SEQ ID NO: 1059210 - RNA, 22 nt, Homo sapiens
augucuaagguccccacugccu

SEQ ID NO: 1059211 - RNA, 14 nt, Homo sapiens
augucuagcuuuca

SEQ ID NO: 1059212 - RNA, 17 nt, Homo sapiens
augucuauaaucccagc

SEQ ID NO: 1059213 - RNA, 20 nt, Homo sapiens
augucucuuuaaugucacag

SEQ ID NO: 1059214 - RNA, 17 nt, Homo sapiens
augucugcagcccucag

SEQ ID NO: 1059215 - RNA, 14 nt, Homo sapiens
augucuggucuguc

SEQ ID NO: 1059216 - RNA, 23 nt, Homo sapiens
augucugugggcaggaagugaag

SEQ ID NO: 1059217 - RNA, 21 nt, Homo sapiens
augucuuccuuggagggggga

SEQ ID NO: 1059218 - RNA, 22 nt, Homo sapiens
augucuuuuuuuuaaugugcug

SEQ ID NO: 1059219 - RNA, 13 nt, Homo sapiens
augugaacauuua

SEQ ID NO: 1059220 - RNA, 19 nt, Homo sapiens
augugacaaagggccagca

SEQ ID NO: 1059221 - RNA, 17 nt, Homo sapiens
augugacaccccggggg

SEQ ID NO: 1059222 - RNA, 15 nt, Homo sapiens
augugacuggcagua

SEQ ID NO: 1059223 - RNA, 22 nt, Homo sapiens
augugauaaaaccccaucucua

SEQ ID NO: 1059224 - RNA, 17 nt, Homo sapiens
augugauauguaccuaa

SEQ ID NO: 1059225 - RNA, 10 nt, Homo sapiens
augugcaaua

SEQ ID NO: 1059226 - RNA, 11 nt, Homo sapiens
augugccaagg

SEQ ID NO: 1059227 - RNA, 17 nt, Homo sapiens
augugccgaaugugcag

SEQ ID NO: 1059228 - RNA, 21 nt, Homo sapiens
augugcucagggaauaaucca

SEQ ID NO: 1059229 - RNA, 22 nt, Homo sapiens
augugcugaaugguuuucaaaa

SEQ ID NO: 1059230 - RNA, 13 nt, Homo sapiens
augugcuguguaa

SEQ ID NO: 1059231 - RNA, 21 nt, Homo sapiens
auguggaagaacuuaggcauc

SEQ ID NO: 1059232 - RNA, 21 nt, Homo sapiens
augugggguccccaucauccc

SEQ ID NO: 1059233 - RNA, 21 nt, Homo sapiens
augugggugucagucagggac

SEQ ID NO: 1059234 - RNA, 19 nt, Homo sapiens
auguguauguacguuugua

SEQ ID NO: 1059235 - RNA, 21 nt, Homo sapiens
augugucacuacucacagucu

SEQ ID NO: 1059236 - RNA, 12 nt, Homo sapiens
augugugauuca

SEQ ID NO: 1059237 - RNA, 13 nt, Homo sapiens
augugugauucac

SEQ ID NO: 1059238 - RNA, 16 nt, Homo sapiens
augugugcgagugugu

SEQ ID NO: 1059239 - RNA, 19 nt, Homo sapiens
auguguguguauguuugca

SEQ ID NO: 1059240 - RNA, 20 nt, Homo sapiens
auguguuuaaauacugcaau

SEQ ID NO: 1059241 - RNA, 23 nt, Homo sapiens
auguuaaaucaauaaagaccacu

SEQ ID NO: 1059242 - RNA, 18 nt, Homo sapiens
auguuacaccagccuuuc

SEQ ID NO: 1059243 - RNA, 19 nt, Homo sapiens
auguuagggugcucuggaa

SEQ ID NO: 1059244 - RNA, 14 nt, Homo sapiens
auguucaguguaau

SEQ ID NO: 1059245 - RNA, 15 nt, Homo sapiens
auguuccacuaaccc

SEQ ID NO: 1059246 - RNA, 24 nt, Homo sapiens
auguucccaguucaacucauggag

SEQ ID NO: 1059247 - RNA, 21 nt, Homo sapiens
auguucuauuucagugccaau

SEQ ID NO: 1059248 - RNA, 15 nt, Homo sapiens
auguucugacauuaa

SEQ ID NO: 1059249 - RNA, 13 nt, Homo sapiens
auguucugcuuuc

SEQ ID NO: 1059250 - RNA, 15 nt, Homo sapiens
auguugaugaaaaau

SEQ ID NO: 1059251 - RNA, 16 nt, Homo sapiens
auguugcccagugugu

SEQ ID NO: 1059252 - RNA, 15 nt, Homo sapiens
auguugcucagucuc

SEQ ID NO: 1059253 - RNA, 18 nt, Homo sapiens
auguuggcugggaacuca

SEQ ID NO: 1059254 - RNA, 15 nt, Homo sapiens
auguugguguuccac

SEQ ID NO: 1059255 - RNA, 13 nt, Homo sapiens
auguuucaaaaaa

SEQ ID NO: 1059256 - RNA, 20 nt, Homo sapiens
auguuucacauaaaaccuca

SEQ ID NO: 1059257 - RNA, 13 nt, Homo sapiens
auguuucagacca

SEQ ID NO: 1059258 - RNA, 18 nt, Homo sapiens
auguuugcacacuugugu

SEQ ID NO: 1059259 - RNA, 22 nt, Homo sapiens
auguuugcuauugacaagucau

SEQ ID NO: 1059260 - RNA, 16 nt, Homo sapiens
auguuuguccugaaca

SEQ ID NO: 1059261 - RNA, 20 nt, Homo sapiens
auguuuuuuuucugcuggaa

SEQ ID NO: 1059262 - RNA, 17 nt, Homo sapiens
auuaaaauaaauguugu

SEQ ID NO: 1059263 - RNA, 12 nt, Homo sapiens
auuaaacauucu

SEQ ID NO: 1059264 - RNA, 15 nt, Homo sapiens
auuaaacguaugcau

SEQ ID NO: 1059265 - RNA, 22 nt, Homo sapiens
auuaaacugaaucacaauguaa

SEQ ID NO: 1059266 - RNA, 18 nt, Homo sapiens
auuaaagguggugccaau

SEQ ID NO: 1059267 - RNA, 12 nt, Homo sapiens
auuaaagugaua

SEQ ID NO: 1059268 - RNA, 13 nt, Homo sapiens
auuaaauuaggaa

SEQ ID NO: 1059269 - RNA, 13 nt, Homo sapiens
auuaacaaacauc

SEQ ID NO: 1059270 - RNA, 16 nt, Homo sapiens
auuaaccacuucagcu

SEQ ID NO: 1059271 - RNA, 22 nt, Homo sapiens
auuaacuccuccugagcucuga

SEQ ID NO: 1059272 - RNA, 21 nt, Homo sapiens
auuaacuuuuuaaaacacaac

SEQ ID NO: 1059273 - RNA, 20 nt, Homo sapiens
auuaagaauugguugccaua

SEQ ID NO: 1059274 - RNA, 16 nt, Homo sapiens
auuaagcccucuucca

SEQ ID NO: 1059275 - RNA, 17 nt, Homo sapiens
auuaagcccucuuccau

SEQ ID NO: 1059276 - RNA, 20 nt, Homo sapiens
auuaauaaaagaguuaacau

SEQ ID NO: 1059277 - RNA, 12 nt, Homo sapiens
auuaauucaccu

SEQ ID NO: 1059278 - RNA, 19 nt, Homo sapiens
auuaauuguuuugcacuuu

SEQ ID NO: 1059279 - RNA, 18 nt, Homo sapiens
auuacaggcgugagccac

SEQ ID NO: 1059280 - RNA, 23 nt, Homo sapiens
auuacaggugugaaccaccacac

SEQ ID NO: 1059281 - RNA, 14 nt, Homo sapiens
auuacaucuuucac

SEQ ID NO: 1059282 - RNA, 16 nt, Homo sapiens
auuacauggcaguguu

SEQ ID NO: 1059283 - RNA, 17 nt, Homo sapiens
auuacauggcucuaaaa

SEQ ID NO: 1059284 - RNA, 18 nt, Homo sapiens
auuacccucaggacaaug

SEQ ID NO: 1059285 - RNA, 22 nt, Homo sapiens
auuaccuugugcuaauccucuu

SEQ ID NO: 1059286 - RNA, 13 nt, Homo sapiens
auuacgugcaaua

SEQ ID NO: 1059287 - RNA, 19 nt, Homo sapiens
auuacgugcaauacuucaa

SEQ ID NO: 1059288 - RNA, 15 nt, Homo sapiens
auuacugguccaaaa

SEQ ID NO: 1059289 - RNA, 19 nt, Homo sapiens
auuacuuuuccacaaauca

SEQ ID NO: 1059290 - RNA, 22 nt, Homo sapiens
auuagaagccugcagaauccag

SEQ ID NO: 1059291 - RNA, 17 nt, Homo sapiens
auuagaaggcaaguuuc

SEQ ID NO: 1059292 - RNA, 17 nt, Homo sapiens
auuagaauauccaugac

SEQ ID NO: 1059293 - RNA, 15 nt, Homo sapiens
auuagaaucugagua

SEQ ID NO: 1059294 - RNA, 16 nt, Homo sapiens
auuagaccaagcuugu

SEQ ID NO: 1059295 - RNA, 13 nt, Homo sapiens
auuagacuccucc

SEQ ID NO: 1059296 - RNA, 16 nt, Homo sapiens
auuagaugaacucaac

SEQ ID NO: 1059297 - RNA, 13 nt, Homo sapiens
auuagccauuuga

SEQ ID NO: 1059298 - RNA, 18 nt, Homo sapiens
auuagccgggcauggugg

SEQ ID NO: 1059299 - RNA, 13 nt, Homo sapiens
auuaguggcacuu

SEQ ID NO: 1059300 - RNA, 12 nt, Homo sapiens
auuauaacuuaa

SEQ ID NO: 1059301 - RNA, 12 nt, Homo sapiens
auuauacuguau

SEQ ID NO: 1059302 - RNA, 13 nt, Homo sapiens
auuauagaaugga

SEQ ID NO: 1059303 - RNA, 22 nt, Homo sapiens
auuauaggcaugagccaccacg

SEQ ID NO: 1059304 - RNA, 16 nt, Homo sapiens
auuauaugcacuagca

SEQ ID NO: 1059305 - RNA, 16 nt, Homo sapiens
auuauauuguuaauca

SEQ ID NO: 1059306 - RNA, 13 nt, Homo sapiens
auuaucaacagca

SEQ ID NO: 1059307 - RNA, 15 nt, Homo sapiens
auuaucagaugcuuu

SEQ ID NO: 1059308 - RNA, 18 nt, Homo sapiens
auuaucgggaacaguguu

SEQ ID NO: 1059309 - RNA, 17 nt, Homo sapiens
auuaucgggagcagugu

SEQ ID NO: 1059310 - RNA, 19 nt, Homo sapiens
auuaucuaaaaucugcuag

SEQ ID NO: 1059311 - RNA, 18 nt, Homo sapiens
auuaucuagauacuguau

SEQ ID NO: 1059312 - RNA, 15 nt, Homo sapiens
auuauguauguuuac

SEQ ID NO: 1059313 - RNA, 15 nt, Homo sapiens
auuaugugaaaugua

SEQ ID NO: 1059314 - RNA, 18 nt, Homo sapiens
auuauguuugccacuuug

SEQ ID NO: 1059315 - RNA, 13 nt, Homo sapiens
auuauuacuguuu

SEQ ID NO: 1059316 - RNA, 18 nt, Homo sapiens
auuauuauucuucauaac

SEQ ID NO: 1059317 - RNA, 13 nt, Homo sapiens
auuauucccauga

SEQ ID NO: 1059318 - RNA, 15 nt, Homo sapiens
auuauucccauucua

SEQ ID NO: 1059319 - RNA, 11 nt, Homo sapiens
auuauucugau

SEQ ID NO: 1059320 - RNA, 22 nt, Homo sapiens
auuauuucacuuuagaugcuga

SEQ ID NO: 1059321 - RNA, 16 nt, Homo sapiens
auuauuuucacuguag

SEQ ID NO: 1059322 - RNA, 18 nt, Homo sapiens
auuauuuuucacugcccc

SEQ ID NO: 1059323 - RNA, 23 nt, Homo sapiens
auucaaaagcacuuugugcugug

SEQ ID NO: 1059324 - RNA, 20 nt, Homo sapiens
auucaaaagguuauauacca

SEQ ID NO: 1059325 - RNA, 15 nt, Homo sapiens
auucaaauggacaaa

SEQ ID NO: 1059326 - RNA, 20 nt, Homo sapiens
auucaaauuuuaucuccaga

SEQ ID NO: 1059327 - RNA, 21 nt, Homo sapiens
auucaacccuggagaguucaa

SEQ ID NO: 1059328 - RNA, 17 nt, Homo sapiens
auucacaaaauuuccac

SEQ ID NO: 1059329 - RNA, 14 nt, Homo sapiens
auucaccaauauca

SEQ ID NO: 1059330 - RNA, 15 nt, Homo sapiens
auucacccuguccaa

SEQ ID NO: 1059331 - RNA, 20 nt, Homo sapiens
cuaccaacgaaagacgugau

SEQ ID NO: 1059332 - RNA, 12 nt, Homo sapiens
cuaccacaugcc

SEQ ID NO: 1059333 - RNA, 21 nt, Homo sapiens
cuaccacaugccaagcacugu

SEQ ID NO: 1059334 - RNA, 14 nt, Homo sapiens
cuaccacucaggaa

SEQ ID NO: 1059335 - RNA, 22 nt, Homo sapiens
cuaccacugucuucuucagggu

SEQ ID NO: 1059336 - RNA, 13 nt, Homo sapiens
cuaccagcauaaa

SEQ ID NO: 1059337 - RNA, 18 nt, Homo sapiens
cuaccauuugaauuugug

SEQ ID NO: 1059338 - RNA, 17 nt, Homo sapiens
cuacccaugacuuuaua

SEQ ID NO: 1059339 - RNA, 18 nt, Homo sapiens
cuaccccugaucugacau

SEQ ID NO: 1059340 - RNA, 23 nt, Homo sapiens
cuacccuuccagugcccuaggcc

SEQ ID NO: 1059341 - RNA, 22 nt, Homo sapiens
cuacccuuccucaccacuuccc

SEQ ID NO: 1059342 - RNA, 21 nt, Homo sapiens
cuaccucaaccaaugccaaaa

SEQ ID NO: 1059343 - RNA, 12 nt, Homo sapiens
cuaccucaaggg

SEQ ID NO: 1059344 - RNA, 22 nt, Homo sapiens
cuaccuugguucccccacugau

SEQ ID NO: 1059345 - RNA, 18 nt, Homo sapiens
cuacuaauccucucugca

SEQ ID NO: 1059346 - RNA, 19 nt, Homo sapiens
cuacucaagaggcugaggc

SEQ ID NO: 1059347 - RNA, 19 nt, Homo sapiens
cuacucccucaaagcacac

SEQ ID NO: 1059348 - RNA, 15 nt, Homo sapiens
cuacuccucugcagu

SEQ ID NO: 1059349 - RNA, 20 nt, Homo sapiens
cuacuccuuguaaagacugu

SEQ ID NO: 1059350 - RNA, 14 nt, Homo sapiens
cuacucugugccag

SEQ ID NO: 1059351 - RNA, 16 nt, Homo sapiens
cuacugauuguuucau

SEQ ID NO: 1059352 - RNA, 18 nt, Homo sapiens
cuacuguaauuugugaua

SEQ ID NO: 1059353 - RNA, 15 nt, Homo sapiens
cuacuuaaugagaua

SEQ ID NO: 1059354 - RNA, 17 nt, Homo sapiens
cuacuucuuuugcucuu

SEQ ID NO: 1059355 - RNA, 21 nt, Homo sapiens
cuacuuuaagcacuacauaaa

SEQ ID NO: 1059356 - RNA, 18 nt, Homo sapiens
cuacuuuucuuuccucag

SEQ ID NO: 1059357 - RNA, 17 nt, Homo sapiens
cuacuuuuuuuugacau

SEQ ID NO: 1059358 - RNA, 19 nt, Homo sapiens
cuagaaaggaagacagauu

SEQ ID NO: 1059359 - RNA, 16 nt, Homo sapiens
cuagaaauacauggac

SEQ ID NO: 1059360 - RNA, 19 nt, Homo sapiens
cuagaaccaagaagggcua

SEQ ID NO: 1059361 - RNA, 17 nt, Homo sapiens
cuagaagaugaauacaa

SEQ ID NO: 1059362 - RNA, 18 nt, Homo sapiens
cuagaaggccacauguca

SEQ ID NO: 1059363 - RNA, 13 nt, Homo sapiens
cuagaagggcuag

SEQ ID NO: 1059364 - RNA, 18 nt, Homo sapiens
cuagaaguuacugaaugc

SEQ ID NO: 1059365 - RNA, 19 nt, Homo sapiens
cuagacucaagguucccag

SEQ ID NO: 1059366 - RNA, 12 nt, Homo sapiens
cuagacuuucug

SEQ ID NO: 1059367 - RNA, 17 nt, Homo sapiens
cuagagaaaagucuacc

SEQ ID NO: 1059368 - RNA, 17 nt, Homo sapiens
cuagaguucuccagaca

SEQ ID NO: 1059369 - RNA, 15 nt, Homo sapiens
cuagauacugaaugu

SEQ ID NO: 1059370 - RNA, 13 nt, Homo sapiens
cuagauacuguau

SEQ ID NO: 1059371 - RNA, 17 nt, Homo sapiens
cuagaugauugauuacc

SEQ ID NO: 1059372 - RNA, 16 nt, Homo sapiens
cuagauuuucuacuuu

SEQ ID NO: 1059373 - RNA, 18 nt, Homo sapiens
cuagauuuucuacuuuau

SEQ ID NO: 1059374 - RNA, 22 nt, Homo sapiens
cuagcaaccuccacauguucaa

SEQ ID NO: 1059375 - RNA, 22 nt, Homo sapiens
cuagcaccagggacuaugaaug

SEQ ID NO: 1059376 - RNA, 16 nt, Homo sapiens
cuagcacuuggagcca

SEQ ID NO: 1059377 - RNA, 23 nt, Homo sapiens
cuagcagaaaucuagaagacugu

SEQ ID NO: 1059378 - RNA, 12 nt, Homo sapiens
cuagcaucucau

SEQ ID NO: 1059379 - RNA, 15 nt, Homo sapiens
cuagcgucaguauuu

SEQ ID NO: 1059380 - RNA, 17 nt, Homo sapiens
cuagcugcaagugacau

SEQ ID NO: 1059381 - RNA, 15 nt, Homo sapiens
cuagcuggauuuccu

SEQ ID NO: 1059382 - RNA, 13 nt, Homo sapiens
cuaggagcacugu

SEQ ID NO: 1059383 - RNA, 17 nt, Homo sapiens
cuaggcauuugcugaau

SEQ ID NO: 1059384 - RNA, 17 nt, Homo sapiens
cuagggaaggguggugg

SEQ ID NO: 1059385 - RNA, 18 nt, Homo sapiens
cuaggggagucccugugg

SEQ ID NO: 1059386 - RNA, 17 nt, Homo sapiens
cuagguaggggcccacu

SEQ ID NO: 1059387 - RNA, 20 nt, Homo sapiens
cuagguucuaaaaauuguga

SEQ ID NO: 1059388 - RNA, 16 nt, Homo sapiens
cuagucucccucacag

SEQ ID NO: 1059389 - RNA, 19 nt, Homo sapiens
cuagucugcuagccaggau

SEQ ID NO: 1059390 - RNA, 13 nt, Homo sapiens
cuagugcugugaa

SEQ ID NO: 1059391 - RNA, 15 nt, Homo sapiens
cuaguuaacauuuca

SEQ ID NO: 1059392 - RNA, 14 nt, Homo sapiens
cuaguuaucaugca

SEQ ID NO: 1059393 - RNA, 17 nt, Homo sapiens
cuaguuaucaugcaugu

SEQ ID NO: 1059394 - RNA, 13 nt, Homo sapiens
cuaguucuaccuc

SEQ ID NO: 1059395 - RNA, 12 nt, Homo sapiens
cuaguugcuugu

SEQ ID NO: 1059396 - RNA, 23 nt, Homo sapiens
cuaguuguaauuuuuuuguggga

SEQ ID NO: 1059397 - RNA, 23 nt, Homo sapiens
cuaguugugaccuuaguguuucu

SEQ ID NO: 1059398 - RNA, 16 nt, Homo sapiens
cuauaacuauguugau

SEQ ID NO: 1059399 - RNA, 13 nt, Homo sapiens
cuauagcucagga

SEQ ID NO: 1059400 - RNA, 17 nt, Homo sapiens
cuauaggaacauaugaa

SEQ ID NO: 1059401 - RNA, 18 nt, Homo sapiens
cuauaguccagcuuuguu

SEQ ID NO: 1059402 - RNA, 19 nt, Homo sapiens
cuauauaaaaaacauaaua

SEQ ID NO: 1059403 - RNA, 18 nt, Homo sapiens
cuauauacuauaugauuc

SEQ ID NO: 1059404 - RNA, 13 nt, Homo sapiens
cuauauccaugua

SEQ ID NO: 1059405 - RNA, 16 nt, Homo sapiens
cuauauggcagugucu

SEQ ID NO: 1059406 - RNA, 18 nt, Homo sapiens
cuauauuaucaugcaaau

SEQ ID NO: 1059407 - RNA, 21 nt, Homo sapiens
cuaucauuuuuguacaguuug

SEQ ID NO: 1059408 - RNA, 18 nt, Homo sapiens
cuaucccuuuccaaaggc

SEQ ID NO: 1059409 - RNA, 14 nt, Homo sapiens
cuaucgcaccacug

SEQ ID NO: 1059410 - RNA, 18 nt, Homo sapiens
cuaucuucuuucacauau

SEQ ID NO: 1059411 - RNA, 18 nt, Homo sapiens
cuaucuuugccacccuca

SEQ ID NO: 1059412 - RNA, 21 nt, Homo sapiens
cuaucuuuuuuuuauuccaca

SEQ ID NO: 1059413 - RNA, 21 nt, Homo sapiens
cuaugaaaacagcuaucucac

SEQ ID NO: 1059414 - RNA, 21 nt, Homo sapiens
cuaugaaauaucaugcuccau

SEQ ID NO: 1059415 - RNA, 19 nt, Homo sapiens
cuaugaaugauacccugaa

SEQ ID NO: 1059416 - RNA, 16 nt, Homo sapiens
cuaugaggcaaccaca

SEQ ID NO: 1059417 - RNA, 19 nt, Homo sapiens
cuaugauauuuucugugcc

SEQ ID NO: 1059418 - RNA, 22 nt, Homo sapiens
cuaugauauuuucugugccuga

SEQ ID NO: 1059419 - RNA, 23 nt, Homo sapiens
cuaugcacauauggacucugcac

SEQ ID NO: 1059420 - RNA, 12 nt, Homo sapiens
cuaugcauuuga

SEQ ID NO: 1059421 - RNA, 13 nt, Homo sapiens
cuaugccuugaaa

SEQ ID NO: 1059422 - RNA, 18 nt, Homo sapiens
cuauggaaauguaggcca

SEQ ID NO: 1059423 - RNA, 16 nt, Homo sapiens
cuauggcacccaugca

SEQ ID NO: 1059424 - RNA, 11 nt, Homo sapiens
cuaugggacuc

SEQ ID NO: 1059425 - RNA, 18 nt, Homo sapiens
cuauggugagaugcagcu

SEQ ID NO: 1059426 - RNA, 14 nt, Homo sapiens
cuauguaacaugua

SEQ ID NO: 1059427 - RNA, 13 nt, Homo sapiens
cuauguacuguaa

SEQ ID NO: 1059428 - RNA, 15 nt, Homo sapiens
cuauguacuguaaua

SEQ ID NO: 1059429 - RNA, 14 nt, Homo sapiens
cuauguuauauuga

SEQ ID NO: 1059430 - RNA, 16 nt, Homo sapiens
cuauuacaccaaauaa

SEQ ID NO: 1059431 - RNA, 16 nt, Homo sapiens
cuauuacgugcaauac

SEQ ID NO: 1059432 - RNA, 17 nt, Homo sapiens
cuauuauacuguauuaa

SEQ ID NO: 1059433 - RNA, 23 nt, Homo sapiens
cuauuauagaauggaacucaagg

SEQ ID NO: 1059434 - RNA, 12 nt, Homo sapiens
cuauuaucucaa

SEQ ID NO: 1059435 - RNA, 17 nt, Homo sapiens
cuauucaaacagucuca

SEQ ID NO: 1059436 - RNA, 16 nt, Homo sapiens
cuauucauugacugau

SEQ ID NO: 1059437 - RNA, 13 nt, Homo sapiens
cuauucucaccag

SEQ ID NO: 1059438 - RNA, 12 nt, Homo sapiens
cuauugcugcuc

SEQ ID NO: 1059439 - RNA, 18 nt, Homo sapiens
cuauugcugcucucucac

SEQ ID NO: 1059440 - RNA, 18 nt, Homo sapiens
cuauugcuggcaaagaca

SEQ ID NO: 1059441 - RNA, 15 nt, Homo sapiens
cuauuguuacucugg

SEQ ID NO: 1059442 - RNA, 22 nt, Homo sapiens
cuauuuccuucuccuccugucu

SEQ ID NO: 1059443 - RNA, 19 nt, Homo sapiens
cuauuucugaagaggcuuc

SEQ ID NO: 1059444 - RNA, 15 nt, Homo sapiens
cuauuuuauucccuu

SEQ ID NO: 1059445 - RNA, 14 nt, Homo sapiens
cuauuuucauugua

SEQ ID NO: 1059446 - RNA, 23 nt, Homo sapiens
cuauuuuuauuuguuugugcauu

SEQ ID NO: 1059447 - RNA, 19 nt, Homo sapiens
cuauuuuuuuucuguuaua

SEQ ID NO: 1059448 - RNA, 21 nt, Homo sapiens
cucaaaagcugggcagguugg

SEQ ID NO: 1059449 - RNA, 17 nt, Homo sapiens
cucaaaaugacagccau

SEQ ID NO: 1059450 - RNA, 20 nt, Homo sapiens
cucaaauauuugcuaugaag

SEQ ID NO: 1059451 - RNA, 18 nt, Homo sapiens
cucaaaugacccaaagac

SEQ ID NO: 1059452 - RNA, 18 nt, Homo sapiens
cucaaaugcacaucucau

SEQ ID NO: 1059453 - RNA, 22 nt, Homo sapiens
cucaacaagggagagaccucau

SEQ ID NO: 1059454 - RNA, 17 nt, Homo sapiens
cucaacacccaacuguc

SEQ ID NO: 1059455 - RNA, 23 nt, Homo sapiens
cucaacauuguguucccauuuca

SEQ ID NO: 1059456 - RNA, 18 nt, Homo sapiens
cucaaccaaugccaaaaa

SEQ ID NO: 1059457 - RNA, 15 nt, Homo sapiens
cucaagaucaaugaa

SEQ ID NO: 1059458 - RNA, 16 nt, Homo sapiens
cucaagggaugucuca

SEQ ID NO: 1059459 - RNA, 23 nt, Homo sapiens
cucaaggguuauagacugccaug

SEQ ID NO: 1059460 - RNA, 19 nt, Homo sapiens
cucaagucuucccugauca

SEQ ID NO: 1059461 - RNA, 22 nt, Homo sapiens
cucaagugauucuccugccuca

SEQ ID NO: 1059462 - RNA, 19 nt, Homo sapiens
cucaauaaaugauucuuag

SEQ ID NO: 1059463 - RNA, 13 nt, Homo sapiens
cucaauaauuucc

SEQ ID NO: 1059464 - RNA, 12 nt, Homo sapiens
cucaauucuucc

SEQ ID NO: 1059465 - RNA, 20 nt, Homo sapiens
cucaauuuuuuucaccucuu

SEQ ID NO: 1059466 - RNA, 12 nt, Homo sapiens
cucacaaacagu

SEQ ID NO: 1059467 - RNA, 15 nt, Homo sapiens
cucacaagaagacca

SEQ ID NO: 1059468 - RNA, 16 nt, Homo sapiens
cucacaagaagaccag

SEQ ID NO: 1059469 - RNA, 19 nt, Homo sapiens
cucacaagaagaccagacu

SEQ ID NO: 1059470 - RNA, 19 nt, Homo sapiens
cucacaauuccaaacauac

SEQ ID NO: 1059471 - RNA, 20 nt, Homo sapiens
cucacacgcgaaaguaucac

SEQ ID NO: 1059472 - RNA, 13 nt, Homo sapiens
cucacagugacau

SEQ ID NO: 1059473 - RNA, 14 nt, Homo sapiens
cucacaguguugcc

SEQ ID NO: 1059474 - RNA, 16 nt, Homo sapiens
cucacaugugacaaag

SEQ ID NO: 1059475 - RNA, 17 nt, Homo sapiens
cucaccccccacacuca

SEQ ID NO: 1059476 - RNA, 20 nt, Homo sapiens
cucuagccugggccacaggg

SEQ ID NO: 1059477 - RNA, 22 nt, Homo sapiens
cucuagccugggccacagggcg

SEQ ID NO: 1059478 - RNA, 21 nt, Homo sapiens
cucuagugucuuuugccuuua

SEQ ID NO: 1059479 - RNA, 18 nt, Homo sapiens
cucuaguuuccagaggcu

SEQ ID NO: 1059480 - RNA, 20 nt, Homo sapiens
cucuaugaaaauuauaucuc

SEQ ID NO: 1059481 - RNA, 12 nt, Homo sapiens
cucuauggugug

SEQ ID NO: 1059482 - RNA, 19 nt, Homo sapiens
cucuauugauguacagucu

SEQ ID NO: 1059483 - RNA, 15 nt, Homo sapiens
cucuauuuagcauga

SEQ ID NO: 1059484 - RNA, 15 nt, Homo sapiens
cucucaauaugcuua

SEQ ID NO: 1059485 - RNA, 17 nt, Homo sapiens
cucucacuauaccagua

SEQ ID NO: 1059486 - RNA, 17 nt, Homo sapiens
cucucagugaacuguga

SEQ ID NO: 1059487 - RNA, 18 nt, Homo sapiens
cucucagugaacugugag

SEQ ID NO: 1059488 - RNA, 19 nt, Homo sapiens
cucuccaaacagucaccau

SEQ ID NO: 1059489 - RNA, 18 nt, Homo sapiens
cucucccaggacccauca

SEQ ID NO: 1059490 - RNA, 20 nt, Homo sapiens
cucuccccucagagugcaag

SEQ ID NO: 1059491 - RNA, 19 nt, Homo sapiens
cucuccuugcuacccagaa

SEQ ID NO: 1059492 - RNA, 18 nt, Homo sapiens
cucucuauagcaccaggg

SEQ ID NO: 1059493 - RNA, 13 nt, Homo sapiens
cucucucaugaua

SEQ ID NO: 1059494 - RNA, 23 nt, Homo sapiens
cucucugggccucaguuuuccca

SEQ ID NO: 1059495 - RNA, 14 nt, Homo sapiens
cucucuuacauuga

SEQ ID NO: 1059496 - RNA, 19 nt, Homo sapiens
cucugaaaucucagaauuc

SEQ ID NO: 1059497 - RNA, 22 nt, Homo sapiens
cucugaagaguggguuucacaa

SEQ ID NO: 1059498 - RNA, 11 nt, Homo sapiens
cucugaaguca

SEQ ID NO: 1059499 - RNA, 20 nt, Homo sapiens
cucugaaugaaccuucuggc

SEQ ID NO: 1059500 - RNA, 19 nt, Homo sapiens
cucugaauuugagauacaa

SEQ ID NO: 1059501 - RNA, 18 nt, Homo sapiens
cucugacucagggcuccu

SEQ ID NO: 1059502 - RNA, 14 nt, Homo sapiens
cucugagaucuaag

SEQ ID NO: 1059503 - RNA, 16 nt, Homo sapiens
cucugaggcuguagga

SEQ ID NO: 1059504 - RNA, 15 nt, Homo sapiens
cucugaucaaguauu

SEQ ID NO: 1059505 - RNA, 21 nt, Homo sapiens
cucugcaaugggcacugggau

SEQ ID NO: 1059506 - RNA, 13 nt, Homo sapiens
cucugcacauguc

SEQ ID NO: 1059507 - RNA, 18 nt, Homo sapiens
cucugcacaugucuugua

SEQ ID NO: 1059508 - RNA, 17 nt, Homo sapiens
cucugcagcccucagau

SEQ ID NO: 1059509 - RNA, 14 nt, Homo sapiens
cucugcugaaggaa

SEQ ID NO: 1059510 - RNA, 11 nt, Homo sapiens
cucuggaccaa

SEQ ID NO: 1059511 - RNA, 13 nt, Homo sapiens
cucuggaccagcc

SEQ ID NO: 1059512 - RNA, 16 nt, Homo sapiens
cucuggagcaauguug

SEQ ID NO: 1059513 - RNA, 22 nt, Homo sapiens
cucuggcaucucuuucugcaaa

SEQ ID NO: 1059514 - RNA, 23 nt, Homo sapiens
cucuggccaggauggaggggugg

SEQ ID NO: 1059515 - RNA, 17 nt, Homo sapiens
cucuggcgacaguuuuc

SEQ ID NO: 1059516 - RNA, 16 nt, Homo sapiens
cucuggcucucauggg

SEQ ID NO: 1059517 - RNA, 22 nt, Homo sapiens
cucuggcucucaugggguccaa

SEQ ID NO: 1059518 - RNA, 16 nt, Homo sapiens
cucugggucugaguca

SEQ ID NO: 1059519 - RNA, 16 nt, Homo sapiens
cucuggucugggugcc

SEQ ID NO: 1059520 - RNA, 11 nt, Homo sapiens
cucuguaaaac

SEQ ID NO: 1059521 - RNA, 15 nt, Homo sapiens
cucuguccaaucagg

SEQ ID NO: 1059522 - RNA, 13 nt, Homo sapiens
cucugucuucuuu

SEQ ID NO: 1059523 - RNA, 14 nt, Homo sapiens
cucugugaccaaug

SEQ ID NO: 1059524 - RNA, 13 nt, Homo sapiens
cucugugcuuuga

SEQ ID NO: 1059525 - RNA, 18 nt, Homo sapiens
cucugugcuuugacucac

SEQ ID NO: 1059526 - RNA, 18 nt, Homo sapiens
cucugugggcuccaugua

SEQ ID NO: 1059527 - RNA, 22 nt, Homo sapiens
cucuguuucgguugacccaggu

SEQ ID NO: 1059528 - RNA, 20 nt, Homo sapiens
cucuuaagaaaaugaugcug

SEQ ID NO: 1059529 - RNA, 19 nt, Homo sapiens
cucuuauagaaaguucaaa

SEQ ID NO: 1059530 - RNA, 17 nt, Homo sapiens
cucuuauccaacaucaa

SEQ ID NO: 1059531 - RNA, 15 nt, Homo sapiens
cucuucaacugacca

SEQ ID NO: 1059532 - RNA, 19 nt, Homo sapiens
cucuucaacugaccagccu

SEQ ID NO: 1059533 - RNA, 19 nt, Homo sapiens
cucuucagaaaacccuuuu

SEQ ID NO: 1059534 - RNA, 20 nt, Homo sapiens
cucuuccaaaggcauaagac

SEQ ID NO: 1059535 - RNA, 18 nt, Homo sapiens
cucuuccccuugcccuug

SEQ ID NO: 1059536 - RNA, 19 nt, Homo sapiens
cucuuccuacccuuccuca

SEQ ID NO: 1059537 - RNA, 21 nt, Homo sapiens
cucuucugacuacugggcaaa

SEQ ID NO: 1059538 - RNA, 13 nt, Homo sapiens
cucuucuguggac

SEQ ID NO: 1059539 - RNA, 14 nt, Homo sapiens
cucuugaaccacag

SEQ ID NO: 1059540 - RNA, 10 nt, Homo sapiens
cucuugccuc

SEQ ID NO: 1059541 - RNA, 19 nt, Homo sapiens
cucuuggcuccacugggau

SEQ ID NO: 1059542 - RNA, 13 nt, Homo sapiens
cucuuggguucaa

SEQ ID NO: 1059543 - RNA, 20 nt, Homo sapiens
cucuuggguucaagugauuc

SEQ ID NO: 1059544 - RNA, 16 nt, Homo sapiens
cucuuguccuagcuug

SEQ ID NO: 1059545 - RNA, 15 nt, Homo sapiens
cucuuuaaucuucag

SEQ ID NO: 1059546 - RNA, 15 nt, Homo sapiens
cucuuuccuugcuca

SEQ ID NO: 1059547 - RNA, 24 nt, Homo sapiens
cucuuuggaaacaauaugcaaugu

SEQ ID NO: 1059548 - RNA, 14 nt, Homo sapiens
cucuuuuagcugau

SEQ ID NO: 1059549 - RNA, 17 nt, Homo sapiens
cucuuuucaaaacauuu

SEQ ID NO: 1059550 - RNA, 19 nt, Homo sapiens
cugaaaaccaauguucucu

SEQ ID NO: 1059551 - RNA, 16 nt, Homo sapiens
cugaaaauauaaccag

SEQ ID NO: 1059552 - RNA, 13 nt, Homo sapiens
cugaaaauucugu

SEQ ID NO: 1059553 - RNA, 16 nt, Homo sapiens
cugaaauauacacaca

SEQ ID NO: 1059554 - RNA, 21 nt, Homo sapiens
cugaacaaaauguaaagccag

SEQ ID NO: 1059555 - RNA, 17 nt, Homo sapiens
cugaacauguacacugg

SEQ ID NO: 1059556 - RNA, 18 nt, Homo sapiens
cugaaccaucccugaugu

SEQ ID NO: 1059557 - RNA, 15 nt, Homo sapiens
cugaaccuuccaucu

SEQ ID NO: 1059558 - RNA, 18 nt, Homo sapiens
cugaacgcguguguacac

SEQ ID NO: 1059559 - RNA, 23 nt, Homo sapiens
cugaacgcuucugcuuaaucuga

SEQ ID NO: 1059560 - RNA, 20 nt, Homo sapiens
cugaacugaaaacaagccau

SEQ ID NO: 1059561 - RNA, 14 nt, Homo sapiens
cugaacugggaccu

SEQ ID NO: 1059562 - RNA, 20 nt, Homo sapiens
cugaagaacaguaacugcca

SEQ ID NO: 1059563 - RNA, 22 nt, Homo sapiens
cugaagaacaguaacugccauc

SEQ ID NO: 1059564 - RNA, 22 nt, Homo sapiens
cugaagagcuauuauauaaaaa

SEQ ID NO: 1059565 - RNA, 22 nt, Homo sapiens
cugaagcaggagaaucacuuga

SEQ ID NO: 1059566 - RNA, 16 nt, Homo sapiens
cugaagccaaagccaa

SEQ ID NO: 1059567 - RNA, 20 nt, Homo sapiens
cugaagcugccugcuuuuca

SEQ ID NO: 1059568 - RNA, 20 nt, Homo sapiens
cugaaggggaggucacagcc

SEQ ID NO: 1059569 - RNA, 22 nt, Homo sapiens
cugaaguuagggaugacuguga

SEQ ID NO: 1059570 - RNA, 14 nt, Homo sapiens
cugaaguuucacau

SEQ ID NO: 1059571 - RNA, 20 nt, Homo sapiens
cugaaguuucacaugagcua

SEQ ID NO: 1059572 - RNA, 15 nt, Homo sapiens
cugaauaaacaggaa

SEQ ID NO: 1059573 - RNA, 13 nt, Homo sapiens
cugaauacauucu

SEQ ID NO: 1059574 - RNA, 23 nt, Homo sapiens
cugaauagcagaagguugcaccu

SEQ ID NO: 1059575 - RNA, 22 nt, Homo sapiens
cugaauaugcugcucaucccca

SEQ ID NO: 1059576 - RNA, 23 nt, Homo sapiens
cugaaucuggaccccaucuguga

SEQ ID NO: 1059577 - RNA, 18 nt, Homo sapiens
cugaaugccucaauguga

SEQ ID NO: 1059578 - RNA, 21 nt, Homo sapiens
cugaaugguuccaugccugag

SEQ ID NO: 1059579 - RNA, 15 nt, Homo sapiens
cugaaugguuuucaa

SEQ ID NO: 1059580 - RNA, 20 nt, Homo sapiens
cugaauguauugaacuugga

SEQ ID NO: 1059581 - RNA, 20 nt, Homo sapiens
cugaauguuagauaguuacu

SEQ ID NO: 1059582 - RNA, 20 nt, Homo sapiens
cugaauucuuuccccaaaga

SEQ ID NO: 1059583 - RNA, 18 nt, Homo sapiens
cugacacacagcucuguc

SEQ ID NO: 1059584 - RNA, 18 nt, Homo sapiens
cugacaccuuugcaggca

SEQ ID NO: 1059585 - RNA, 22 nt, Homo sapiens
cugacagaaagcagauaccuca

SEQ ID NO: 1059586 - RNA, 13 nt, Homo sapiens
cugacaugcacac

SEQ ID NO: 1059587 - RNA, 11 nt, Homo sapiens
cugaccaaaac

SEQ ID NO: 1059588 - RNA, 16 nt, Homo sapiens
cugaccaaaacaaaca

SEQ ID NO: 1059589 - RNA, 13 nt, Homo sapiens
cugacccacugcu

SEQ ID NO: 1059590 - RNA, 14 nt, Homo sapiens
cugaccccaaagag

SEQ ID NO: 1059591 - RNA, 15 nt, Homo sapiens
cugaccuccacagcu

SEQ ID NO: 1059592 - RNA, 13 nt, Homo sapiens
cugaccugucuca

SEQ ID NO: 1059593 - RNA, 15 nt, Homo sapiens
cugaccuugugaucu

SEQ ID NO: 1059594 - RNA, 14 nt, Homo sapiens
cugacggugcaguc

SEQ ID NO: 1059595 - RNA, 22 nt, Homo sapiens
cugacuccuuagagacaucaaa

SEQ ID NO: 1059596 - RNA, 17 nt, Homo sapiens
cugagaaaacuaaguca

SEQ ID NO: 1059597 - RNA, 18 nt, Homo sapiens
cugagaaagacuauucaa

SEQ ID NO: 1059598 - RNA, 17 nt, Homo sapiens
cugagaacacugugaaa

SEQ ID NO: 1059599 - RNA, 18 nt, Homo sapiens
cugagacaaagcaaugga

SEQ ID NO: 1059600 - RNA, 14 nt, Homo sapiens
cugagagacaggac

SEQ ID NO: 1059601 - RNA, 13 nt, Homo sapiens
cugagagugaagu

SEQ ID NO: 1059602 - RNA, 16 nt, Homo sapiens
cugagcaaagcauuga

SEQ ID NO: 1059603 - RNA, 22 nt, Homo sapiens
cugagcaaagcauugagcaaag

SEQ ID NO: 1059604 - RNA, 13 nt, Homo sapiens
cugagcaggauuu

SEQ ID NO: 1059605 - RNA, 22 nt, Homo sapiens
cugagcagugcuugaaugaagu

SEQ ID NO: 1059606 - RNA, 23 nt, Homo sapiens
cugagcagugcuugaaugaaguu

SEQ ID NO: 1059607 - RNA, 15 nt, Homo sapiens
cugagccccuacccc

SEQ ID NO: 1059608 - RNA, 15 nt, Homo sapiens
cugaggaaugucuuu

SEQ ID NO: 1059609 - RNA, 20 nt, Homo sapiens
cugaggcgggagaaucaugu

SEQ ID NO: 1059610 - RNA, 15 nt, Homo sapiens
cugagggcauugcuu

SEQ ID NO: 1059611 - RNA, 21 nt, Homo sapiens
cugaggggggccgugcccagg

SEQ ID NO: 1059612 - RNA, 12 nt, Homo sapiens
cugaggugggag

SEQ ID NO: 1059613 - RNA, 17 nt, Homo sapiens
cugaguaaucgcuuaaa

SEQ ID NO: 1059614 - RNA, 19 nt, Homo sapiens
cugaguacguugugcauuu

SEQ ID NO: 1059615 - RNA, 15 nt, Homo sapiens
cugaguauaaauuua

SEQ ID NO: 1059616 - RNA, 18 nt, Homo sapiens
cugaguauaaauuuacuu

SEQ ID NO: 1059617 - RNA, 18 nt, Homo sapiens
cugagugggggaucacag

SEQ ID NO: 1059618 - RNA, 19 nt, Homo sapiens
cugaguuauuuugcuaaac

SEQ ID NO: 1059619 - RNA, 21 nt, Homo sapiens
cugaguuugcuguuugcaauu

SEQ ID NO: 1059620 - RNA, 20 nt, Homo sapiens
cugauaaccacuccuaauau

SEQ ID NO: 1059621 - RNA, 15 nt, Homo sapiens
cuggcucaaagacaa

SEQ ID NO: 1059622 - RNA, 13 nt, Homo sapiens
cuggcucagggag

SEQ ID NO: 1059623 - RNA, 12 nt, Homo sapiens
cuggcuccaaac

SEQ ID NO: 1059624 - RNA, 16 nt, Homo sapiens
cuggcuccaaacccuc

SEQ ID NO: 1059625 - RNA, 14 nt, Homo sapiens
cuggcucucagaag

SEQ ID NO: 1059626 - RNA, 12 nt, Homo sapiens
cuggcucuccaa

SEQ ID NO: 1059627 - RNA, 14 nt, Homo sapiens
cuggcucucuccag

SEQ ID NO: 1059628 - RNA, 18 nt, Homo sapiens
cuggcugagcugaaccca

SEQ ID NO: 1059629 - RNA, 23 nt, Homo sapiens
cuggcugcaaaggguaucaggug

SEQ ID NO: 1059630 - RNA, 19 nt, Homo sapiens
cuggcugcccuggcccuga

SEQ ID NO: 1059631 - RNA, 14 nt, Homo sapiens
cugggaaagacauc

SEQ ID NO: 1059632 - RNA, 21 nt, Homo sapiens
cugggaaaggaaagaagaaau

SEQ ID NO: 1059633 - RNA, 16 nt, Homo sapiens
cugggaacuuccucag

SEQ ID NO: 1059634 - RNA, 15 nt, Homo sapiens
cugggagacuuugaa

SEQ ID NO: 1059635 - RNA, 21 nt, Homo sapiens
cugggauauuuccauauggca

SEQ ID NO: 1059636 - RNA, 21 nt, Homo sapiens
cugggauccuaagggcucacc

SEQ ID NO: 1059637 - RNA, 22 nt, Homo sapiens
cugggauuacagggaugagcca

SEQ ID NO: 1059638 - RNA, 15 nt, Homo sapiens
cugggauuacaggug

SEQ ID NO: 1059639 - RNA, 14 nt, Homo sapiens
cugggcaacacagc

SEQ ID NO: 1059640 - RNA, 20 nt, Homo sapiens
cugggcacugguaaucccaa

SEQ ID NO: 1059641 - RNA, 17 nt, Homo sapiens
cugggcauagaugcagg

SEQ ID NO: 1059642 - RNA, 22 nt, Homo sapiens
cugggccaaguuccucuagugc

SEQ ID NO: 1059643 - RNA, 13 nt, Homo sapiens
cugggcccagaag

SEQ ID NO: 1059644 - RNA, 13 nt, Homo sapiens
cugggcugaggca

SEQ ID NO: 1059645 - RNA, 13 nt, Homo sapiens
cugggcuguggua

SEQ ID NO: 1059646 - RNA, 22 nt, Homo sapiens
cuggggagccagggcuauggga

SEQ ID NO: 1059647 - RNA, 21 nt, Homo sapiens
cuggggaugucucucaugacc

SEQ ID NO: 1059648 - RNA, 19 nt, Homo sapiens
cuggggcaggucacuuuac

SEQ ID NO: 1059649 - RNA, 21 nt, Homo sapiens
cuggggccgaaagaacagucc

SEQ ID NO: 1059650 - RNA, 21 nt, Homo sapiens
cuggggucuccuauacucuau

SEQ ID NO: 1059651 - RNA, 22 nt, Homo sapiens
cugggucuuucugacaucagca

SEQ ID NO: 1059652 - RNA, 12 nt, Homo sapiens
cuggguggacau

SEQ ID NO: 1059653 - RNA, 15 nt, Homo sapiens
cuggguggguggugg

SEQ ID NO: 1059654 - RNA, 15 nt, Homo sapiens
cugguagcucaggug

SEQ ID NO: 1059655 - RNA, 16 nt, Homo sapiens
cugguauguguggaug

SEQ ID NO: 1059656 - RNA, 23 nt, Homo sapiens
cuggucagucugcccuugucacu

SEQ ID NO: 1059657 - RNA, 16 nt, Homo sapiens
cuggucccacucaguc

SEQ ID NO: 1059658 - RNA, 15 nt, Homo sapiens
cuggucucaaacucc

SEQ ID NO: 1059659 - RNA, 23 nt, Homo sapiens
cuggucucaaacuccugggcuca

SEQ ID NO: 1059660 - RNA, 13 nt, Homo sapiens
cuggucuugugga

SEQ ID NO: 1059661 - RNA, 15 nt, Homo sapiens
cuggugacccaguca

SEQ ID NO: 1059662 - RNA, 16 nt, Homo sapiens
cuggugacccagucag

SEQ ID NO: 1059663 - RNA, 18 nt, Homo sapiens
cuggugcagucauuauga

SEQ ID NO: 1059664 - RNA, 14 nt, Homo sapiens
cugguggucaggga

SEQ ID NO: 1059665 - RNA, 16 nt, Homo sapiens
cuggugugaagguccu

SEQ ID NO: 1059666 - RNA, 15 nt, Homo sapiens
cuggugugaccugag

SEQ ID NO: 1059667 - RNA, 23 nt, Homo sapiens
cuggugugugccucauugcuugg

SEQ ID NO: 1059668 - RNA, 15 nt, Homo sapiens
cugguuagaaaugca

SEQ ID NO: 1059669 - RNA, 13 nt, Homo sapiens
cugguuagguaga

SEQ ID NO: 1059670 - RNA, 17 nt, Homo sapiens
cugguuagguagaggga

SEQ ID NO: 1059671 - RNA, 14 nt, Homo sapiens
cugguucugaugau

SEQ ID NO: 1059672 - RNA, 21 nt, Homo sapiens
cugguuguugccaaacagcca

SEQ ID NO: 1059673 - RNA, 15 nt, Homo sapiens
cuguaaacuguguau

SEQ ID NO: 1059674 - RNA, 23 nt, Homo sapiens
cuguaaacuguguauuccaagac

SEQ ID NO: 1059675 - RNA, 14 nt, Homo sapiens
cuguaaacuuccaa

SEQ ID NO: 1059676 - RNA, 15 nt, Homo sapiens
cuguaacaugcaauu

SEQ ID NO: 1059677 - RNA, 18 nt, Homo sapiens
cuguaaucccagcacuuu

SEQ ID NO: 1059678 - RNA, 14 nt, Homo sapiens
cuguaaucccagcu

SEQ ID NO: 1059679 - RNA, 23 nt, Homo sapiens
cuguaaucccagcuauuugggag

SEQ ID NO: 1059680 - RNA, 16 nt, Homo sapiens
cuguaaucucacuaca

SEQ ID NO: 1059681 - RNA, 23 nt, Homo sapiens
cuguaauuccagcacuuugggag

SEQ ID NO: 1059682 - RNA, 17 nt, Homo sapiens
cuguacaaaguagaagu

SEQ ID NO: 1059683 - RNA, 17 nt, Homo sapiens
cuguacauagccuauau

SEQ ID NO: 1059684 - RNA, 16 nt, Homo sapiens
cuguaccgacuuugau

SEQ ID NO: 1059685 - RNA, 18 nt, Homo sapiens
cuguaccugugcacguug

SEQ ID NO: 1059686 - RNA, 17 nt, Homo sapiens
cuguacuaaaaauacaa

SEQ ID NO: 1059687 - RNA, 14 nt, Homo sapiens
cuguagaaaugaug

SEQ ID NO: 1059688 - RNA, 21 nt, Homo sapiens
cuguagaugacauggugaaaa

SEQ ID NO: 1059689 - RNA, 18 nt, Homo sapiens
cuguagcauuacaguggg

SEQ ID NO: 1059690 - RNA, 16 nt, Homo sapiens
cuguaggggcaaaaau

SEQ ID NO: 1059691 - RNA, 17 nt, Homo sapiens
cuguaguaaauggcaau

SEQ ID NO: 1059692 - RNA, 15 nt, Homo sapiens
cuguaguagcccuuu

SEQ ID NO: 1059693 - RNA, 21 nt, Homo sapiens
cuguagucccagcuacucggg

SEQ ID NO: 1059694 - RNA, 15 nt, Homo sapiens
cuguagucucaggac

SEQ ID NO: 1059695 - RNA, 21 nt, Homo sapiens
cuguagugagauagcauugug

SEQ ID NO: 1059696 - RNA, 21 nt, Homo sapiens
cuguaguuuuaucacauguau

SEQ ID NO: 1059697 - RNA, 12 nt, Homo sapiens
cuguaugccaag

SEQ ID NO: 1059698 - RNA, 17 nt, Homo sapiens
cuguaugucucguggua

SEQ ID NO: 1059699 - RNA, 13 nt, Homo sapiens
cuguauucacuua

SEQ ID NO: 1059700 - RNA, 14 nt, Homo sapiens
cuguauucacuuau

SEQ ID NO: 1059701 - RNA, 12 nt, Homo sapiens
cuguauuugcca

SEQ ID NO: 1059702 - RNA, 21 nt, Homo sapiens
cuguauuuugaugauugcuau

SEQ ID NO: 1059703 - RNA, 12 nt, Homo sapiens
cugucaaacaaa

SEQ ID NO: 1059704 - RNA, 21 nt, Homo sapiens
cugucaaacaaagccagaagc

SEQ ID NO: 1059705 - RNA, 14 nt, Homo sapiens
cugucacaccagcc

SEQ ID NO: 1059706 - RNA, 12 nt, Homo sapiens
cuguccagagag

SEQ ID NO: 1059707 - RNA, 17 nt, Homo sapiens
cuguccaguucccagaa

SEQ ID NO: 1059708 - RNA, 17 nt, Homo sapiens
cuguccccacacugacc

SEQ ID NO: 1059709 - RNA, 12 nt, Homo sapiens
cuguccuaggcc

SEQ ID NO: 1059710 - RNA, 17 nt, Homo sapiens
cuguccuugcacacucc

SEQ ID NO: 1059711 - RNA, 14 nt, Homo sapiens
cugucgcccagucu

SEQ ID NO: 1059712 - RNA, 23 nt, Homo sapiens
cugucucaaauaaauaaauauga

SEQ ID NO: 1059713 - RNA, 17 nt, Homo sapiens
cugucucaccauguaca

SEQ ID NO: 1059714 - RNA, 20 nt, Homo sapiens
cugucuccuuaacacugagc

SEQ ID NO: 1059715 - RNA, 17 nt, Homo sapiens
cugucuccuuucucagc

SEQ ID NO: 1059716 - RNA, 16 nt, Homo sapiens
cugucucgaugcaaug

SEQ ID NO: 1059717 - RNA, 22 nt, Homo sapiens
cugucucuacuaaaaauacaau

SEQ ID NO: 1059718 - RNA, 17 nt, Homo sapiens
cugucucugucauggua

SEQ ID NO: 1059719 - RNA, 14 nt, Homo sapiens
cugucugacaaccu

SEQ ID NO: 1059720 - RNA, 23 nt, Homo sapiens
cugucugaguaagcccucaggag

SEQ ID NO: 1059721 - RNA, 17 nt, Homo sapiens
cugugaaaccccuaugu

SEQ ID NO: 1059722 - RNA, 20 nt, Homo sapiens
cugugaaagaaccaaaagag

SEQ ID NO: 1059723 - RNA, 18 nt, Homo sapiens
cugugaccaggaaggaag

SEQ ID NO: 1059724 - RNA, 15 nt, Homo sapiens
cugugacugauauga

SEQ ID NO: 1059725 - RNA, 13 nt, Homo sapiens
cugugacuuugcc

SEQ ID NO: 1059726 - RNA, 22 nt, Homo sapiens
cugugaggccccuggacaagca

SEQ ID NO: 1059727 - RNA, 21 nt, Homo sapiens
cugugcaugguggcaccagcg

SEQ ID NO: 1059728 - RNA, 18 nt, Homo sapiens
cugugcccucagauuccg

SEQ ID NO: 1059729 - RNA, 19 nt, Homo sapiens
cugugcuccgugccuccac

SEQ ID NO: 1059730 - RNA, 19 nt, Homo sapiens
cugugcugguguccugacc

SEQ ID NO: 1059731 - RNA, 17 nt, Homo sapiens
cuguggaccacugcaug

SEQ ID NO: 1059732 - RNA, 14 nt, Homo sapiens
cuguggccugggca

SEQ ID NO: 1059733 - RNA, 15 nt, Homo sapiens
cuguggcugcuagca

SEQ ID NO: 1059734 - RNA, 15 nt, Homo sapiens
cuguggcuucuuaau

SEQ ID NO: 1059735 - RNA, 19 nt, Homo sapiens
cuguggggaucucaggggc

SEQ ID NO: 1059736 - RNA, 16 nt, Homo sapiens
cugugggggugagggu

SEQ ID NO: 1059737 - RNA, 18 nt, Homo sapiens
cuguguacacgugacaga

SEQ ID NO: 1059738 - RNA, 14 nt, Homo sapiens
cuguguaggcauuu

SEQ ID NO: 1059739 - RNA, 17 nt, Homo sapiens
cuguguauucauucuca

SEQ ID NO: 1059740 - RNA, 15 nt, Homo sapiens
cuguguauucuagug

SEQ ID NO: 1059741 - RNA, 13 nt, Homo sapiens
cugugugacauca

SEQ ID NO: 1059742 - RNA, 23 nt, Homo sapiens
cugugugaccucaggccagugug

SEQ ID NO: 1059743 - RNA, 19 nt, Homo sapiens
cugugugaugaacuuucuc

SEQ ID NO: 1059744 - RNA, 16 nt, Homo sapiens
cugugugcaagugugu

SEQ ID NO: 1059745 - RNA, 12 nt, Homo sapiens
cugugugccauu

SEQ ID NO: 1059746 - RNA, 23 nt, Homo sapiens
cugugugccauuuuaagaguuac

SEQ ID NO: 1059747 - RNA, 15 nt, Homo sapiens
cuguguggacuguga

SEQ ID NO: 1059748 - RNA, 23 nt, Homo sapiens
cuguguggacugugaugccacac

SEQ ID NO: 1059749 - RNA, 17 nt, Homo sapiens
cuguguguacuaauaca

SEQ ID NO: 1059750 - RNA, 21 nt, Homo sapiens
cugugugugaugugcauggga

SEQ ID NO: 1059751 - RNA, 17 nt, Homo sapiens
cuguguucgauggcuca

SEQ ID NO: 1059752 - RNA, 13 nt, Homo sapiens
cuguuaccagagg

SEQ ID NO: 1059753 - RNA, 17 nt, Homo sapiens
cuguuacuuaccuaaac

SEQ ID NO: 1059754 - RNA, 22 nt, Homo sapiens
cuguuacuugaaauaccaguga

SEQ ID NO: 1059755 - RNA, 20 nt, Homo sapiens
cuguuauuaacaaacaucac

SEQ ID NO: 1059756 - RNA, 20 nt, Homo sapiens
cuguucaagagcacacuugg

SEQ ID NO: 1059757 - RNA, 23 nt, Homo sapiens
cuguucaguguaaauaguuacuc

SEQ ID NO: 1059758 - RNA, 17 nt, Homo sapiens
cuguucauguuacucau

SEQ ID NO: 1059759 - RNA, 22 nt, Homo sapiens
cuguucccaccaggcugcucag

SEQ ID NO: 1059760 - RNA, 20 nt, Homo sapiens
cuguucucauuuuauugcua

SEQ ID NO: 1059761 - RNA, 19 nt, Homo sapiens
cuguucucuuccacucucc

SEQ ID NO: 1059762 - RNA, 18 nt, Homo sapiens
cuguucugccuuccgcag

SEQ ID NO: 1059763 - RNA, 22 nt, Homo sapiens
cuguucuugcuacccaugacuu

SEQ ID NO: 1059764 - RNA, 14 nt, Homo sapiens
cuguucuuucuggc

SEQ ID NO: 1059765 - RNA, 15 nt, Homo sapiens
cuguugcauuguaau

SEQ ID NO: 1059766 - RNA, 17 nt, Homo sapiens
cuguuggcaaggugaca

SEQ ID NO: 1059767 - RNA, 23 nt, Homo sapiens
cuguuggcguggggccuuuguca

SEQ ID NO: 1059768 - RNA, 13 nt, Homo sapiens
cuguuuaacauuu

SEQ ID NO: 1059769 - RNA, 14 nt, Homo sapiens
cuguuuaacauuuc

SEQ ID NO: 1059770 - RNA, 19 nt, Homo sapiens
cuguuuaacauuuccucag

SEQ ID NO: 1059771 - RNA, 19 nt, Homo sapiens
cuguuuauagaauaaggga

SEQ ID NO: 1059772 - RNA, 17 nt, Homo sapiens
cuguuucugcuugcucu

SEQ ID NO: 1059773 - RNA, 15 nt, Homo sapiens
cuguuugucuucucc

SEQ ID NO: 1059774 - RNA, 19 nt, Homo sapiens
cuguuuucuuuugguaaag

SEQ ID NO: 1059775 - RNA, 23 nt, Homo sapiens
cuuaaaauagaaauaagugguua

SEQ ID NO: 1059776 - RNA, 17 nt, Homo sapiens
cuuaaaauauauuucag

SEQ ID NO: 1059777 - RNA, 13 nt, Homo sapiens
cuuaaaaugaaag

SEQ ID NO: 1059778 - RNA, 13 nt, Homo sapiens
cuuaaaauuguau

SEQ ID NO: 1059779 - RNA, 23 nt, Homo sapiens
cuuaaaggaagguucugguguga

SEQ ID NO: 1059780 - RNA, 21 nt, Homo sapiens
cuuaaaggcaccaucuaauag

SEQ ID NO: 1059781 - RNA, 16 nt, Homo sapiens
cuuaaaggcuguggua

SEQ ID NO: 1059782 - RNA, 19 nt, Homo sapiens
cuuaaauaaacucaaugag

SEQ ID NO: 1059783 - RNA, 23 nt, Homo sapiens
cuuaaauuuugugauauggagcc

SEQ ID NO: 1059784 - RNA, 15 nt, Homo sapiens
cuuaacauucauaga

SEQ ID NO: 1059785 - RNA, 20 nt, Homo sapiens
cuuaacguuagaccacaaau

SEQ ID NO: 1059786 - RNA, 18 nt, Homo sapiens
cuuaagaacugcuuucuu

SEQ ID NO: 1059787 - RNA, 16 nt, Homo sapiens
cuuaagccuuuugcuc

SEQ ID NO: 1059788 - RNA, 13 nt, Homo sapiens
cuuaagcugggau

SEQ ID NO: 1059789 - RNA, 17 nt, Homo sapiens
cuuaaguagauaaggaa

SEQ ID NO: 1059790 - RNA, 14 nt, Homo sapiens
cuuaauauguuaac

SEQ ID NO: 1059791 - RNA, 15 nt, Homo sapiens
cuuaaucaugagaua

SEQ ID NO: 1059792 - RNA, 14 nt, Homo sapiens
cuuaaucuuuucac

SEQ ID NO: 1059793 - RNA, 17 nt, Homo sapiens
cuuaaucuuuucacaaa

SEQ ID NO: 1059794 - RNA, 20 nt, Homo sapiens
cuuaaugaaugaaugaauuc

SEQ ID NO: 1059795 - RNA, 18 nt, Homo sapiens
cuuacacuuuaugcacaa

SEQ ID NO: 1059796 - RNA, 18 nt, Homo sapiens
cuuacaggccuugcucac

SEQ ID NO: 1059797 - RNA, 17 nt, Homo sapiens
cuuacccucaccuguca

SEQ ID NO: 1059798 - RNA, 15 nt, Homo sapiens
cuuacuguacaugaa

SEQ ID NO: 1059799 - RNA, 15 nt, Homo sapiens
cuuacuuaguguuau

SEQ ID NO: 1059800 - RNA, 22 nt, Homo sapiens
cuuagaaaugaaggcagaaaaa

SEQ ID NO: 1059801 - RNA, 14 nt, Homo sapiens
cuuagaaauuguaa

SEQ ID NO: 1059802 - RNA, 13 nt, Homo sapiens
cuuagacaguccc

SEQ ID NO: 1059803 - RNA, 16 nt, Homo sapiens
cuuagacagucccugc

SEQ ID NO: 1059804 - RNA, 14 nt, Homo sapiens
cuuagacauaacaa

SEQ ID NO: 1059805 - RNA, 23 nt, Homo sapiens
cuuagauuagcucuggaccagcc

SEQ ID NO: 1059806 - RNA, 16 nt, Homo sapiens
cuuagcagcuaucucu

SEQ ID NO: 1059807 - RNA, 11 nt, Homo sapiens
cuuagcucaca

SEQ ID NO: 1059808 - RNA, 16 nt, Homo sapiens
cuuagcugucugcuca

SEQ ID NO: 1059809 - RNA, 20 nt, Homo sapiens
cuuagggcaucgaucuuccu

SEQ ID NO: 1059810 - RNA, 21 nt, Homo sapiens
cuuaggugcuucuucacuuca

SEQ ID NO: 1059811 - RNA, 21 nt, Homo sapiens
cuuaguguacaugaaagcgua

SEQ ID NO: 1059812 - RNA, 12 nt, Homo sapiens
cuuaguucucac

SEQ ID NO: 1059813 - RNA, 13 nt, Homo sapiens
cuuaguugcugua

SEQ ID NO: 1059814 - RNA, 14 nt, Homo sapiens
cuuauaaaaucaaa

SEQ ID NO: 1059815 - RNA, 14 nt, Homo sapiens
cuuauacccaugaa

SEQ ID NO: 1059816 - RNA, 17 nt, Homo sapiens
cuuauaucaucagcaua

SEQ ID NO: 1059817 - RNA, 14 nt, Homo sapiens
cuuauauucaucca

SEQ ID NO: 1059818 - RNA, 23 nt, Homo sapiens
cuuaucaacauuuguuccaugag

SEQ ID NO: 1059819 - RNA, 15 nt, Homo sapiens
cuuaucccaagagaa

SEQ ID NO: 1059820 - RNA, 15 nt, Homo sapiens
cuuauccuguucucu

SEQ ID NO: 1059821 - RNA, 22 nt, Homo sapiens
cuuaucucagucaugcauaaau

SEQ ID NO: 1059822 - RNA, 22 nt, Homo sapiens
cuuaucucggggagaaaugcaa

SEQ ID NO: 1059823 - RNA, 22 nt, Homo sapiens
cuuaucugugcgugaaacacac

SEQ ID NO: 1059824 - RNA, 15 nt, Homo sapiens
cuuaugaaacuaaga

SEQ ID NO: 1059825 - RNA, 13 nt, Homo sapiens
cuuauuaggauuc

SEQ ID NO: 1059826 - RNA, 14 nt, Homo sapiens
cuuauuguaccucu

SEQ ID NO: 1059827 - RNA, 17 nt, Homo sapiens
cuuauuguuccaagaca

SEQ ID NO: 1059828 - RNA, 16 nt, Homo sapiens
cuuauuuaaugaaaga

SEQ ID NO: 1059829 - RNA, 17 nt, Homo sapiens
cuucaaccucauugaca

SEQ ID NO: 1059830 - RNA, 21 nt, Homo sapiens
cuucaagaccuucaccaaaca

SEQ ID NO: 1059831 - RNA, 16 nt, Homo sapiens
cuucaaguuagcucag

SEQ ID NO: 1059832 - RNA, 19 nt, Homo sapiens
cuucaaguuagcucaggag

SEQ ID NO: 1059833 - RNA, 22 nt, Homo sapiens
cuucaaugcaaaguacauguau

SEQ ID NO: 1059834 - RNA, 14 nt, Homo sapiens
cuucacaacagauu

SEQ ID NO: 1059835 - RNA, 14 nt, Homo sapiens
cuucacaguguuuc

SEQ ID NO: 1059836 - RNA, 15 nt, Homo sapiens
cuucacaugcaucaa

SEQ ID NO: 1059837 - RNA, 17 nt, Homo sapiens
cuucacccuggagccca

SEQ ID NO: 1059838 - RNA, 15 nt, Homo sapiens
cuucaccucacugaa

SEQ ID NO: 1059839 - RNA, 23 nt, Homo sapiens
cuucacggaaagugccugcaaaa

SEQ ID NO: 1059840 - RNA, 15 nt, Homo sapiens
cuucacucaaucucu

SEQ ID NO: 1059841 - RNA, 23 nt, Homo sapiens
cuucacuguccuccaagccagcg

SEQ ID NO: 1059842 - RNA, 23 nt, Homo sapiens
cuucagagacuaucugauuuccu

SEQ ID NO: 1059843 - RNA, 23 nt, Homo sapiens
cuucagagacuucguaauuaaag

SEQ ID NO: 1059844 - RNA, 17 nt, Homo sapiens
cuucagauacaaacugc

SEQ ID NO: 1059845 - RNA, 17 nt, Homo sapiens
cuucagcuguacauacu

SEQ ID NO: 1059846 - RNA, 19 nt, Homo sapiens
cuucagcuguacauacuca

SEQ ID NO: 1059847 - RNA, 17 nt, Homo sapiens
cuucagcuuuccugagc

SEQ ID NO: 1059848 - RNA, 10 nt, Homo sapiens
cuucagggcg

SEQ ID NO: 1059849 - RNA, 17 nt, Homo sapiens
cuucagggcgcacagca

SEQ ID NO: 1059850 - RNA, 23 nt, Homo sapiens
cuucaggggcacuucauugagag

SEQ ID NO: 1059851 - RNA, 23 nt, Homo sapiens
cuucaggguccugagauuuacac

SEQ ID NO: 1059852 - RNA, 17 nt, Homo sapiens
cuucagucuuuuccaug

SEQ ID NO: 1059853 - RNA, 21 nt, Homo sapiens
cuucauccucugagugugacc

SEQ ID NO: 1059854 - RNA, 22 nt, Homo sapiens
cuucauccucugagugugacca

SEQ ID NO: 1059855 - RNA, 14 nt, Homo sapiens
cuucaucuucucag

SEQ ID NO: 1059856 - RNA, 14 nt, Homo sapiens
cuucaugcauggaa

SEQ ID NO: 1059857 - RNA, 13 nt, Homo sapiens
cuucauuaccuca

SEQ ID NO: 1059858 - RNA, 20 nt, Homo sapiens
cuuccaacguggcccagaga

SEQ ID NO: 1059859 - RNA, 19 nt, Homo sapiens
cuuccaaggguacuaagga

SEQ ID NO: 1059860 - RNA, 23 nt, Homo sapiens
cuuccacaccuagcaucucauga

SEQ ID NO: 1059861 - RNA, 19 nt, Homo sapiens
cuuccagcacccugcaaaa

SEQ ID NO: 1059862 - RNA, 18 nt, Homo sapiens
cuuccagugcaacacuga

SEQ ID NO: 1059863 - RNA, 20 nt, Homo sapiens
cuuccagugcccuaggccug

SEQ ID NO: 1059864 - RNA, 16 nt, Homo sapiens
cuuccauaauguauaa

SEQ ID NO: 1059865 - RNA, 12 nt, Homo sapiens
cuuccaugagaa

SEQ ID NO: 1059866 - RNA, 11 nt, Homo sapiens
cuuccauuugc

SEQ ID NO: 1059867 - RNA, 12 nt, Homo sapiens
cuuccauuugcu

SEQ ID NO: 1059868 - RNA, 16 nt, Homo sapiens
cuuccauuugugugug

SEQ ID NO: 1059869 - RNA, 21 nt, Homo sapiens
cuuccauuugugugugugcaa

SEQ ID NO: 1059870 - RNA, 20 nt, Homo sapiens
cuucccaggaguacacccca

SEQ ID NO: 1059871 - RNA, 21 nt, Homo sapiens
cuucccaguggcugcugccca

SEQ ID NO: 1059872 - RNA, 13 nt, Homo sapiens
cuuccccucucag

SEQ ID NO: 1059873 - RNA, 13 nt, Homo sapiens
cuuccccuugccc

SEQ ID NO: 1059874 - RNA, 19 nt, Homo sapiens
cuuccccuugcccuugccc

SEQ ID NO: 1059875 - RNA, 19 nt, Homo sapiens
cuucccgaaccccaaggag

SEQ ID NO: 1059876 - RNA, 20 nt, Homo sapiens
cuucccuaaaaucagggaau

SEQ ID NO: 1059877 - RNA, 15 nt, Homo sapiens
cuucccuacauggag

SEQ ID NO: 1059878 - RNA, 20 nt, Homo sapiens
cuucccucaugcuguuccac

SEQ ID NO: 1059879 - RNA, 17 nt, Homo sapiens
cuucccucucaugacuu

SEQ ID NO: 1059880 - RNA, 18 nt, Homo sapiens
cuucccugacucuucaag

SEQ ID NO: 1059881 - RNA, 13 nt, Homo sapiens
cuucccugcauuu

SEQ ID NO: 1059882 - RNA, 16 nt, Homo sapiens
cuucccuguccuguag

SEQ ID NO: 1059883 - RNA, 16 nt, Homo sapiens
cuuccuacccuuccuc

SEQ ID NO: 1059884 - RNA, 17 nt, Homo sapiens
cuuccucacaccacaaa

SEQ ID NO: 1059885 - RNA, 14 nt, Homo sapiens
cuuccucacaccag

SEQ ID NO: 1059886 - RNA, 16 nt, Homo sapiens
cuuccucagcuguaga

SEQ ID NO: 1059887 - RNA, 16 nt, Homo sapiens
cuuccugccaccaguc

SEQ ID NO: 1059888 - RNA, 20 nt, Homo sapiens
cuuccuggcuccaacacugc

SEQ ID NO: 1059889 - RNA, 12 nt, Homo sapiens
cuuccuguaaca

SEQ ID NO: 1059890 - RNA, 15 nt, Homo sapiens
cuuccuguccagaga

SEQ ID NO: 1059891 - RNA, 18 nt, Homo sapiens
cuuccuuuugagggagca

SEQ ID NO: 1059892 - RNA, 14 nt, Homo sapiens
cuucgacucaggau

SEQ ID NO: 1059893 - RNA, 15 nt, Homo sapiens
cuucgaggcccagcg

SEQ ID NO: 1059894 - RNA, 16 nt, Homo sapiens
cuucgcaucaaaagac

SEQ ID NO: 1059895 - RNA, 18 nt, Homo sapiens
cuucgcaucaaaagacaa

SEQ ID NO: 1059896 - RNA, 18 nt, Homo sapiens
cuucuaaaugaagugcaa

SEQ ID NO: 1059897 - RNA, 20 nt, Homo sapiens
cuucuaaaugaagugcaaau

SEQ ID NO: 1059898 - RNA, 18 nt, Homo sapiens
cuucuagcgucagugcug

SEQ ID NO: 1059899 - RNA, 22 nt, Homo sapiens
cuucuaggacgccacccagcaa

SEQ ID NO: 1059900 - RNA, 13 nt, Homo sapiens
cuucuauuagcca

SEQ ID NO: 1059901 - RNA, 18 nt, Homo sapiens
cuucuauuccauggcuaa

SEQ ID NO: 1059902 - RNA, 20 nt, Homo sapiens
cuucucaauaaucaaugaag

SEQ ID NO: 1059903 - RNA, 14 nt, Homo sapiens
cuucucagcuccca

SEQ ID NO: 1059904 - RNA, 14 nt, Homo sapiens
cuucucauagcauu

SEQ ID NO: 1059905 - RNA, 17 nt, Homo sapiens
cuucuccaaaugagauc

SEQ ID NO: 1059906 - RNA, 15 nt, Homo sapiens
cuucucccacacugc

SEQ ID NO: 1059907 - RNA, 11 nt, Homo sapiens
cuucucccacc

SEQ ID NO: 1059908 - RNA, 15 nt, Homo sapiens
cuucuccccauucug

SEQ ID NO: 1059909 - RNA, 16 nt, Homo sapiens
cuucucguuaaggaga

SEQ ID NO: 1059910 - RNA, 17 nt, Homo sapiens
cuucucuucacagucac

SEQ ID NO: 1059911 - RNA, 19 nt, Homo sapiens
uaaaaaucaugagauccuu

SEQ ID NO: 1059912 - RNA, 14 nt, Homo sapiens
uaaaaaugcaacuu

SEQ ID NO: 1059913 - RNA, 21 nt, Homo sapiens
uaaaaauggcucagaugccac

SEQ ID NO: 1059914 - RNA, 13 nt, Homo sapiens
uaaaacaguccuu

SEQ ID NO: 1059915 - RNA, 16 nt, Homo sapiens
uaaaacauguuugcac

SEQ ID NO: 1059916 - RNA, 13 nt, Homo sapiens
uaaaacauuauga

SEQ ID NO: 1059917 - RNA, 15 nt, Homo sapiens
uaaaacauuuucaca

SEQ ID NO: 1059918 - RNA, 15 nt, Homo sapiens
uaaaaccacagcagu

SEQ ID NO: 1059919 - RNA, 18 nt, Homo sapiens
uaaaaccaucauaguaca

SEQ ID NO: 1059920 - RNA, 23 nt, Homo sapiens
uaaaacgcaugugcagcuauuua

SEQ ID NO: 1059921 - RNA, 16 nt, Homo sapiens
uaaaagaaaucuucau

SEQ ID NO: 1059922 - RNA, 19 nt, Homo sapiens
uaaaagaaccgagcaauuu

SEQ ID NO: 1059923 - RNA, 21 nt, Homo sapiens
uaaaagaauaaaauugcacuu

SEQ ID NO: 1059924 - RNA, 20 nt, Homo sapiens
uaaaagaguuaacaucccau

SEQ ID NO: 1059925 - RNA, 14 nt, Homo sapiens
uaaaagcacacuca

SEQ ID NO: 1059926 - RNA, 22 nt, Homo sapiens
uaaaagcacacucauccccuca

SEQ ID NO: 1059927 - RNA, 15 nt, Homo sapiens
uaaaagugcuuuaug

SEQ ID NO: 1059928 - RNA, 22 nt, Homo sapiens
uaaaauaaauaaaugcaauaug

SEQ ID NO: 1059929 - RNA, 15 nt, Homo sapiens
uaaaauacacacuca

SEQ ID NO: 1059930 - RNA, 16 nt, Homo sapiens
uaaaauacacacucaa

SEQ ID NO: 1059931 - RNA, 14 nt, Homo sapiens
uaaaauagccauaa

SEQ ID NO: 1059932 - RNA, 14 nt, Homo sapiens
uaaaauauggcuau

SEQ ID NO: 1059933 - RNA, 22 nt, Homo sapiens
uaaaauauuuuuaugugcaaua

SEQ ID NO: 1059934 - RNA, 14 nt, Homo sapiens
uaaaaucuaauuca

SEQ ID NO: 1059935 - RNA, 21 nt, Homo sapiens
uaaaaucuuuucuauuuuccc

SEQ ID NO: 1059936 - RNA, 18 nt, Homo sapiens
uaaaaugaaauacuaaau

SEQ ID NO: 1059937 - RNA, 20 nt, Homo sapiens
uaaaaugaaauuacuacaaa

SEQ ID NO: 1059938 - RNA, 21 nt, Homo sapiens
uaaaaugauuuuaucugugaa

SEQ ID NO: 1059939 - RNA, 23 nt, Homo sapiens
uaaaaugcaacauguguacuuaa

SEQ ID NO: 1059940 - RNA, 11 nt, Homo sapiens
uaaaaugcaga

SEQ ID NO: 1059941 - RNA, 19 nt, Homo sapiens
uaaaauguaugaccacugg

SEQ ID NO: 1059942 - RNA, 12 nt, Homo sapiens
uaaaauguuuaa

SEQ ID NO: 1059943 - RNA, 14 nt, Homo sapiens
uaaaauugcacuuu

SEQ ID NO: 1059944 - RNA, 14 nt, Homo sapiens
uaaaauuuaacuca

SEQ ID NO: 1059945 - RNA, 13 nt, Homo sapiens
uaaaauuucaaca

SEQ ID NO: 1059946 - RNA, 15 nt, Homo sapiens
uaaaauuucacuuaa

SEQ ID NO: 1059947 - RNA, 14 nt, Homo sapiens
uaaacaaauaacaa

SEQ ID NO: 1059948 - RNA, 14 nt, Homo sapiens
uaaacaaauguaug

SEQ ID NO: 1059949 - RNA, 23 nt, Homo sapiens
uaaacaaauguaugauuacauca

SEQ ID NO: 1059950 - RNA, 22 nt, Homo sapiens
uaaacaagaaucagucuaucca

SEQ ID NO: 1059951 - RNA, 21 nt, Homo sapiens
uaaacaccauagggacccauu

SEQ ID NO: 1059952 - RNA, 18 nt, Homo sapiens
uaaacacggggcuugcaa

SEQ ID NO: 1059953 - RNA, 22 nt, Homo sapiens
uaaacagaggaguacaggugaa

SEQ ID NO: 1059954 - RNA, 19 nt, Homo sapiens
uaaacagauggcacuuuga

SEQ ID NO: 1059955 - RNA, 20 nt, Homo sapiens
uaaacagugagccugaauuu

SEQ ID NO: 1059956 - RNA, 21 nt, Homo sapiens
uaaacauccuucaagaacucu

SEQ ID NO: 1059957 - RNA, 13 nt, Homo sapiens
uaaacauguguuu

SEQ ID NO: 1059958 - RNA, 18 nt, Homo sapiens
uaaacauuaguguucaua

SEQ ID NO: 1059959 - RNA, 15 nt, Homo sapiens
uaaacauucuaucua

SEQ ID NO: 1059960 - RNA, 17 nt, Homo sapiens
uaaacauugaaguaaug

SEQ ID NO: 1059961 - RNA, 22 nt, Homo sapiens
uaaacauugguaagaaugagcu

SEQ ID NO: 1059962 - RNA, 22 nt, Homo sapiens
uaaacauugguucuuguauuaa

SEQ ID NO: 1059963 - RNA, 15 nt, Homo sapiens
uaaaccaaaaacuga

SEQ ID NO: 1059964 - RNA, 17 nt, Homo sapiens
uaaaccaucaucuugcc

SEQ ID NO: 1059965 - RNA, 17 nt, Homo sapiens
uaaacucaauaaguuua

SEQ ID NO: 1059966 - RNA, 13 nt, Homo sapiens
uaaacucagaaua

SEQ ID NO: 1059967 - RNA, 21 nt, Homo sapiens
uaaacucagaauauacccauc

SEQ ID NO: 1059968 - RNA, 15 nt, Homo sapiens
uaaacugaaucacaa

SEQ ID NO: 1059969 - RNA, 14 nt, Homo sapiens
uaaacuguacaugu

SEQ ID NO: 1059970 - RNA, 11 nt, Homo sapiens
uaaacugugua

SEQ ID NO: 1059971 - RNA, 12 nt, Homo sapiens
uaaacuguguau

SEQ ID NO: 1059972 - RNA, 21 nt, Homo sapiens
uaaacuuaccugggcauucuu

SEQ ID NO: 1059973 - RNA, 20 nt, Homo sapiens
uaaacuuacuuaguguuaug

SEQ ID NO: 1059974 - RNA, 14 nt, Homo sapiens
uaaacuucagggau

SEQ ID NO: 1059975 - RNA, 16 nt, Homo sapiens
uaaacuugucagggua

SEQ ID NO: 1059976 - RNA, 15 nt, Homo sapiens
uaaagagaacucugg

SEQ ID NO: 1059977 - RNA, 20 nt, Homo sapiens
uaaagaucgcccccaccucc

SEQ ID NO: 1059978 - RNA, 21 nt, Homo sapiens
uaaagcacccuguaucacaga

SEQ ID NO: 1059979 - RNA, 17 nt, Homo sapiens
uaaagccagccaugcau

SEQ ID NO: 1059980 - RNA, 20 nt, Homo sapiens
uaaagcccaaccuccugacc

SEQ ID NO: 1059981 - RNA, 13 nt, Homo sapiens
uaaagcccuugaa

SEQ ID NO: 1059982 - RNA, 14 nt, Homo sapiens
uaaagcccuugaac

SEQ ID NO: 1059983 - RNA, 23 nt, Homo sapiens
uaaagcccuuuauuuauaauaca

SEQ ID NO: 1059984 - RNA, 14 nt, Homo sapiens
uaaagccuccucau

SEQ ID NO: 1059985 - RNA, 22 nt, Homo sapiens
uaaagcugccggcacagaacuu

SEQ ID NO: 1059986 - RNA, 16 nt, Homo sapiens
uaaagcuuugugcaga

SEQ ID NO: 1059987 - RNA, 22 nt, Homo sapiens
uaaagggagauaacaaucugua

SEQ ID NO: 1059988 - RNA, 17 nt, Homo sapiens
uaaaguacagacuuuuu

SEQ ID NO: 1059989 - RNA, 13 nt, Homo sapiens
uaaaguacuaaga

SEQ ID NO: 1059990 - RNA, 16 nt, Homo sapiens
uaaaguauauauuuau

SEQ ID NO: 1059991 - RNA, 16 nt, Homo sapiens
uaaaguaugugcauau

SEQ ID NO: 1059992 - RNA, 15 nt, Homo sapiens
uaaaguguuugccuc

SEQ ID NO: 1059993 - RNA, 18 nt, Homo sapiens
uaaauaaaguaucaugca

SEQ ID NO: 1059994 - RNA, 16 nt, Homo sapiens
uaaauaaauguaaaua

SEQ ID NO: 1059995 - RNA, 19 nt, Homo sapiens
uaaauaauguuaucugugu

SEQ ID NO: 1059996 - RNA, 23 nt, Homo sapiens
uaaauacacaacacacacacucu

SEQ ID NO: 1059997 - RNA, 12 nt, Homo sapiens
uaaauacagaca

SEQ ID NO: 1059998 - RNA, 12 nt, Homo sapiens
uaaauaccucuu

SEQ ID NO: 1059999 - RNA, 15 nt, Homo sapiens
uaaauagaccucuca

SEQ ID NO: 1060000 - RNA, 21 nt, Homo sapiens
uaaauagaguauaugcacuuu

SEQ ID NO: 1060001 - RNA, 17 nt, Homo sapiens
uaaauagcuauauccau

SEQ ID NO: 1060002 - RNA, 23 nt, Homo sapiens
uaaauagcuauauccauguacug

SEQ ID NO: 1060003 - RNA, 12 nt, Homo sapiens
uaaauagcucag

SEQ ID NO: 1060004 - RNA, 22 nt, Homo sapiens
uaaauaguuacuccagugccaa

SEQ ID NO: 1060005 - RNA, 16 nt, Homo sapiens
uaaauaugaagcucac

SEQ ID NO: 1060006 - RNA, 13 nt, Homo sapiens
uaaauaugagaua

SEQ ID NO: 1060007 - RNA, 21 nt, Homo sapiens
uaaauaugccuaaaauacuua

SEQ ID NO: 1060008 - RNA, 17 nt, Homo sapiens
uaaauauguacacaagu

SEQ ID NO: 1060009 - RNA, 17 nt, Homo sapiens
uaaauauuacacaucaa

SEQ ID NO: 1060010 - RNA, 13 nt, Homo sapiens
uaaauauuucaag

SEQ ID NO: 1060011 - RNA, 18 nt, Homo sapiens
uaaaucaaauauauguca

SEQ ID NO: 1060012 - RNA, 14 nt, Homo sapiens
uaaaucaaugcuau

SEQ ID NO: 1060013 - RNA, 15 nt, Homo sapiens
uaaaucaaugcuaua

SEQ ID NO: 1060014 - RNA, 19 nt, Homo sapiens
uaaaucaaugucacuuaaa

SEQ ID NO: 1060015 - RNA, 15 nt, Homo sapiens
uaaaugaagugcaaa

SEQ ID NO: 1060016 - RNA, 21 nt, Homo sapiens
uaaaugauucuuagugacuuu

SEQ ID NO: 1060017 - RNA, 20 nt, Homo sapiens
uaaauggacaaaugcuuaug

SEQ ID NO: 1060018 - RNA, 19 nt, Homo sapiens
uaaaugggggugcauuuga

SEQ ID NO: 1060019 - RNA, 22 nt, Homo sapiens
uaaaugguaguaaucacaguug

SEQ ID NO: 1060020 - RNA, 21 nt, Homo sapiens
uaaauguaaauauguacacaa

SEQ ID NO: 1060021 - RNA, 14 nt, Homo sapiens
uaaauguaucuuau

SEQ ID NO: 1060022 - RNA, 20 nt, Homo sapiens
uaaauguaucuuauucacau

SEQ ID NO: 1060023 - RNA, 22 nt, Homo sapiens
uaaaugucucuuuaaugucaca

SEQ ID NO: 1060024 - RNA, 22 nt, Homo sapiens
uaaaugucuucuguauucacuu

SEQ ID NO: 1060025 - RNA, 12 nt, Homo sapiens
uaaaugugaaug

SEQ ID NO: 1060026 - RNA, 21 nt, Homo sapiens
uaaaugugaaugaugauccua

SEQ ID NO: 1060027 - RNA, 19 nt, Homo sapiens
uaaauguuuuucuauguag

SEQ ID NO: 1060028 - RNA, 22 nt, Homo sapiens
uaaauuauacuggagaagucuu

SEQ ID NO: 1060029 - RNA, 22 nt, Homo sapiens
uaaauucgagaagcaaucugcc

SEQ ID NO: 1060030 - RNA, 19 nt, Homo sapiens
uaaauugcuccuugacauu

SEQ ID NO: 1060031 - RNA, 20 nt, Homo sapiens
uaaauuguuuuuacugauga

SEQ ID NO: 1060032 - RNA, 13 nt, Homo sapiens
uaaauuuauuuca

SEQ ID NO: 1060033 - RNA, 15 nt, Homo sapiens
uaaauuucaucucag

SEQ ID NO: 1060034 - RNA, 17 nt, Homo sapiens
uaaauuugguucuaggc

SEQ ID NO: 1060035 - RNA, 14 nt, Homo sapiens
uaaauuuguguucu

SEQ ID NO: 1060036 - RNA, 16 nt, Homo sapiens
uaaauuuguguucuca

SEQ ID NO: 1060037 - RNA, 14 nt, Homo sapiens
uaaauuuugugaua

SEQ ID NO: 1060038 - RNA, 17 nt, Homo sapiens
uaacaaacaucacucug

SEQ ID NO: 1060039 - RNA, 19 nt, Homo sapiens
uaacaaacuacauguaauc

SEQ ID NO: 1060040 - RNA, 16 nt, Homo sapiens
uaacaaagaacaagca

SEQ ID NO: 1060041 - RNA, 12 nt, Homo sapiens
uaacaaccugga

SEQ ID NO: 1060042 - RNA, 14 nt, Homo sapiens
uaacaaguggguga

SEQ ID NO: 1060043 - RNA, 21 nt, Homo sapiens
uaacaauaacuacuguguucc

SEQ ID NO: 1060044 - RNA, 11 nt, Homo sapiens
uaacaaugaag

SEQ ID NO: 1060045 - RNA, 20 nt, Homo sapiens
uaacaaugacauuuauauca

SEQ ID NO: 1060046 - RNA, 14 nt, Homo sapiens
uaacaauguuaagg

SEQ ID NO: 1060047 - RNA, 17 nt, Homo sapiens
uaacacaagccacagaa

SEQ ID NO: 1060048 - RNA, 18 nt, Homo sapiens
uaacacaagccacagaag

SEQ ID NO: 1060049 - RNA, 19 nt, Homo sapiens
uaacacaaguccugugaau

SEQ ID NO: 1060050 - RNA, 13 nt, Homo sapiens
uaacacacagcua

SEQ ID NO: 1060051 - RNA, 13 nt, Homo sapiens
uaacaccugaugu

SEQ ID NO: 1060052 - RNA, 14 nt, Homo sapiens
uaacagaaauguac

SEQ ID NO: 1060053 - RNA, 22 nt, Homo sapiens
uaacagauuugcauaugucuau

SEQ ID NO: 1060054 - RNA, 22 nt, Homo sapiens
uaacaggcucaauauuccugaa

SEQ ID NO: 1060055 - RNA, 23 nt, Homo sapiens
uaacagggucucuagugcuguga

SEQ ID NO: 1060056 - RNA, 20 nt, Homo sapiens
uacuuugugaauagaacucu

SEQ ID NO: 1060057 - RNA, 12 nt, Homo sapiens
uagaaaaaccac

SEQ ID NO: 1060058 - RNA, 16 nt, Homo sapiens
uagaaaagggaacuga

SEQ ID NO: 1060059 - RNA, 18 nt, Homo sapiens
uagaaagaaacaaccugc

SEQ ID NO: 1060060 - RNA, 18 nt, Homo sapiens
uagaaagaaacugcucua

SEQ ID NO: 1060061 - RNA, 20 nt, Homo sapiens
uagaaagcauaacaaaaaga

SEQ ID NO: 1060062 - RNA, 14 nt, Homo sapiens
uagaaaguucaaaa

SEQ ID NO: 1060063 - RNA, 22 nt, Homo sapiens
uagaacaaaggacagaguauga

SEQ ID NO: 1060064 - RNA, 18 nt, Homo sapiens
uagaacuauuaaaacagc

SEQ ID NO: 1060065 - RNA, 18 nt, Homo sapiens
uagaacucuccaucuuau

SEQ ID NO: 1060066 - RNA, 19 nt, Homo sapiens
uagaacucugaaaugaaga

SEQ ID NO: 1060067 - RNA, 23 nt, Homo sapiens
uagaacucugggcugccauguga

SEQ ID NO: 1060068 - RNA, 14 nt, Homo sapiens
uagaagacugucag

SEQ ID NO: 1060069 - RNA, 18 nt, Homo sapiens
uagaagauuuuaugcugc

SEQ ID NO: 1060070 - RNA, 17 nt, Homo sapiens
uagaagucuuagaugua

SEQ ID NO: 1060071 - RNA, 17 nt, Homo sapiens
uagaaguuacugaaugc

SEQ ID NO: 1060072 - RNA, 20 nt, Homo sapiens
uagaauauuuauuaccucug

SEQ ID NO: 1060073 - RNA, 17 nt, Homo sapiens
uagaaucugaguauaaa

SEQ ID NO: 1060074 - RNA, 15 nt, Homo sapiens
uagaauuaauggaau

SEQ ID NO: 1060075 - RNA, 18 nt, Homo sapiens
uagacacguguuguucca

SEQ ID NO: 1060076 - RNA, 22 nt, Homo sapiens
uagacaguaugagucaaugugc

SEQ ID NO: 1060077 - RNA, 22 nt, Homo sapiens
uagacaugucuagccacugauc

SEQ ID NO: 1060078 - RNA, 21 nt, Homo sapiens
uagacccugcauuuauagcau

SEQ ID NO: 1060079 - RNA, 19 nt, Homo sapiens
uagacuucugcuuuccaca

SEQ ID NO: 1060080 - RNA, 18 nt, Homo sapiens
uagagaauaccaguguua

SEQ ID NO: 1060081 - RNA, 19 nt, Homo sapiens
uagagaccgagccucuguc

SEQ ID NO: 1060082 - RNA, 19 nt, Homo sapiens
uagagaugugucuauggcu

SEQ ID NO: 1060083 - RNA, 15 nt, Homo sapiens
uagagauuuggugua

SEQ ID NO: 1060084 - RNA, 19 nt, Homo sapiens
uagagcagccacaaccaaa

SEQ ID NO: 1060085 - RNA, 20 nt, Homo sapiens
uagagcagcccuggagucau

SEQ ID NO: 1060086 - RNA, 18 nt, Homo sapiens
uagagccagggucucacu

SEQ ID NO: 1060087 - RNA, 18 nt, Homo sapiens
uagaggcugggggcucca

SEQ ID NO: 1060088 - RNA, 16 nt, Homo sapiens
uagagggggucucaga

SEQ ID NO: 1060089 - RNA, 15 nt, Homo sapiens
uagagguacuuucca

SEQ ID NO: 1060090 - RNA, 14 nt, Homo sapiens
uagaguauaugcac

SEQ ID NO: 1060091 - RNA, 22 nt, Homo sapiens
uagaguaucacucccacuuccu

SEQ ID NO: 1060092 - RNA, 13 nt, Homo sapiens
uagaguguuauca

SEQ ID NO: 1060093 - RNA, 17 nt, Homo sapiens
uagaguuaacaaugaua

SEQ ID NO: 1060094 - RNA, 22 nt, Homo sapiens
uagaguucuccagacaggguuc

SEQ ID NO: 1060095 - RNA, 12 nt, Homo sapiens
uagauacuguau

SEQ ID NO: 1060096 - RNA, 20 nt, Homo sapiens
uagaucccccagacuuuaca

SEQ ID NO: 1060097 - RNA, 12 nt, Homo sapiens
uagaucuagaaa

SEQ ID NO: 1060098 - RNA, 22 nt, Homo sapiens
uagauucccaucauacacuucc

SEQ ID NO: 1060099 - RNA, 20 nt, Homo sapiens
uagcaaaauacaugacauuu

SEQ ID NO: 1060100 - RNA, 14 nt, Homo sapiens
uagcaaacuuugua

SEQ ID NO: 1060101 - RNA, 20 nt, Homo sapiens
uagcaaacuuuguaugucau

SEQ ID NO: 1060102 - RNA, 21 nt, Homo sapiens
uagcaaccuccacauguucaa

SEQ ID NO: 1060103 - RNA, 20 nt, Homo sapiens
uagcacuggccugcacggug

SEQ ID NO: 1060104 - RNA, 11 nt, Homo sapiens
uagcacuuccc

SEQ ID NO: 1060105 - RNA, 14 nt, Homo sapiens
uagcagacaguguu

SEQ ID NO: 1060106 - RNA, 18 nt, Homo sapiens
uagcagggaaacagcuaa

SEQ ID NO: 1060107 - RNA, 13 nt, Homo sapiens
uagcaugaggcca

SEQ ID NO: 1060108 - RNA, 13 nt, Homo sapiens
uagcauguuugcu

SEQ ID NO: 1060109 - RNA, 16 nt, Homo sapiens
uagcauuaacuaaucu

SEQ ID NO: 1060110 - RNA, 16 nt, Homo sapiens
uagcauugagugcuuu

SEQ ID NO: 1060111 - RNA, 18 nt, Homo sapiens
uagcauuugucaacaaag

SEQ ID NO: 1060112 - RNA, 16 nt, Homo sapiens
uagccgaaaugaucuu

SEQ ID NO: 1060113 - RNA, 17 nt, Homo sapiens
uagccgaccucagccuu

SEQ ID NO: 1060114 - RNA, 22 nt, Homo sapiens
uagccucgccgucugugaauug

SEQ ID NO: 1060115 - RNA, 17 nt, Homo sapiens
uagcggucaauuugccu

SEQ ID NO: 1060116 - RNA, 19 nt, Homo sapiens
uagcuaauuuuugcaaaua

SEQ ID NO: 1060117 - RNA, 23 nt, Homo sapiens
uagcuauauccauguacuguagu

SEQ ID NO: 1060118 - RNA, 14 nt, Homo sapiens
uagcucacaccuga

SEQ ID NO: 1060119 - RNA, 20 nt, Homo sapiens
uagcucaggaccugggaccu

SEQ ID NO: 1060120 - RNA, 14 nt, Homo sapiens
uagcucaucuuaga

SEQ ID NO: 1060121 - RNA, 19 nt, Homo sapiens
uagcugaguuuaacaugug

SEQ ID NO: 1060122 - RNA, 18 nt, Homo sapiens
uagcuugggacaaaucaa

SEQ ID NO: 1060123 - RNA, 23 nt, Homo sapiens
uagcuuuaaaaccugugugccau

SEQ ID NO: 1060124 - RNA, 13 nt, Homo sapiens
uagcuuuacaaau

SEQ ID NO: 1060125 - RNA, 16 nt, Homo sapiens
uagcuuuagggcaaua

SEQ ID NO: 1060126 - RNA, 15 nt, Homo sapiens
uagcuuuauucuuca

SEQ ID NO: 1060127 - RNA, 21 nt, Homo sapiens
uagcuuucaauuccguagcca

SEQ ID NO: 1060128 - RNA, 14 nt, Homo sapiens
uaggaaaauuucac

SEQ ID NO: 1060129 - RNA, 16 nt, Homo sapiens
uaggaacacuccuuca

SEQ ID NO: 1060130 - RNA, 20 nt, Homo sapiens
uaggaaguauggcaugaaca

SEQ ID NO: 1060131 - RNA, 17 nt, Homo sapiens
uaggaccaauaccuccu

SEQ ID NO: 1060132 - RNA, 15 nt, Homo sapiens
uaggagacuaaugga

SEQ ID NO: 1060133 - RNA, 23 nt, Homo sapiens
uaggagccugcuggucacagccu

SEQ ID NO: 1060134 - RNA, 19 nt, Homo sapiens
uaggaggaugggcucgccc

SEQ ID NO: 1060135 - RNA, 15 nt, Homo sapiens
uaggaguucacuuca

SEQ ID NO: 1060136 - RNA, 20 nt, Homo sapiens
uaggcaggaccaugggacca

SEQ ID NO: 1060137 - RNA, 12 nt, Homo sapiens
uaggcagggaag

SEQ ID NO: 1060138 - RNA, 15 nt, Homo sapiens
uaggcauuugcugaa

SEQ ID NO: 1060139 - RNA, 20 nt, Homo sapiens
uagggaaguaacauuugccu

SEQ ID NO: 1060140 - RNA, 14 nt, Homo sapiens
uagggagaaaccaa

SEQ ID NO: 1060141 - RNA, 17 nt, Homo sapiens
uagggaugacugugauu

SEQ ID NO: 1060142 - RNA, 23 nt, Homo sapiens
uagggcaacaauacaugcugcua

SEQ ID NO: 1060143 - RNA, 19 nt, Homo sapiens
uagggcaauauugccaugg

SEQ ID NO: 1060144 - RNA, 15 nt, Homo sapiens
uaggguccaccagga

SEQ ID NO: 1060145 - RNA, 23 nt, Homo sapiens
uagguagaggaauaaaaugaaau

SEQ ID NO: 1060146 - RNA, 20 nt, Homo sapiens
uaggugacagagugagacuc

SEQ ID NO: 1060147 - RNA, 17 nt, Homo sapiens
uaggugucuguuuccca

SEQ ID NO: 1060148 - RNA, 14 nt, Homo sapiens
uagguuuacauuca

SEQ ID NO: 1060149 - RNA, 20 nt, Homo sapiens
uagguuuacauucaucucau

SEQ ID NO: 1060150 - RNA, 14 nt, Homo sapiens
uagguuuuguacaa

SEQ ID NO: 1060151 - RNA, 23 nt, Homo sapiens
uagguuuuuuuccuucugaagug

SEQ ID NO: 1060152 - RNA, 13 nt, Homo sapiens
uaguaaaucuccc

SEQ ID NO: 1060153 - RNA, 14 nt, Homo sapiens
uaguaacauagaca

SEQ ID NO: 1060154 - RNA, 20 nt, Homo sapiens
uaguaaugcuacgugugauu

SEQ ID NO: 1060155 - RNA, 15 nt, Homo sapiens
uaguaugaaugcagu

SEQ ID NO: 1060156 - RNA, 17 nt, Homo sapiens
uaguaugaggcauuugu

SEQ ID NO: 1060157 - RNA, 22 nt, Homo sapiens
uagucacagagauaauucuagc

SEQ ID NO: 1060158 - RNA, 19 nt, Homo sapiens
uagucacauggccuaugca

SEQ ID NO: 1060159 - RNA, 16 nt, Homo sapiens
uaguccaaagacuuaa

SEQ ID NO: 1060160 - RNA, 14 nt, Homo sapiens
uaguccaauuccuu

SEQ ID NO: 1060161 - RNA, 17 nt, Homo sapiens
uagucgaacaauucaua

SEQ ID NO: 1060162 - RNA, 14 nt, Homo sapiens
uagucgguucugua

SEQ ID NO: 1060163 - RNA, 18 nt, Homo sapiens
uagugacccggaggccac

SEQ ID NO: 1060164 - RNA, 18 nt, Homo sapiens
uagugaucacagcagcuu

SEQ ID NO: 1060165 - RNA, 23 nt, Homo sapiens
uagugauuuccacagugacucca

SEQ ID NO: 1060166 - RNA, 14 nt, Homo sapiens
uagugccaacauuu

SEQ ID NO: 1060167 - RNA, 13 nt, Homo sapiens
uagugcugugaaa

SEQ ID NO: 1060168 - RNA, 21 nt, Homo sapiens
uagugggcaccccacugcaau

SEQ ID NO: 1060169 - RNA, 14 nt, Homo sapiens
uaguguacuuggag

SEQ ID NO: 1060170 - RNA, 22 nt, Homo sapiens
uaguguuggaaaaugugcaaua

SEQ ID NO: 1060171 - RNA, 15 nt, Homo sapiens
uaguuacuauaugcc

SEQ ID NO: 1060172 - RNA, 15 nt, Homo sapiens
uaguucauccaaucc

SEQ ID NO: 1060173 - RNA, 23 nt, Homo sapiens
uaguugaucuacaaaggccaugg

SEQ ID NO: 1060174 - RNA, 22 nt, Homo sapiens
uaguugcguggacucugcacau

SEQ ID NO: 1060175 - RNA, 17 nt, Homo sapiens
uaguugguuuccuucac

SEQ ID NO: 1060176 - RNA, 22 nt, Homo sapiens
uaguuguaauuuuuuuguggga

SEQ ID NO: 1060177 - RNA, 17 nt, Homo sapiens
uaguuuaugauuccacc

SEQ ID NO: 1060178 - RNA, 20 nt, Homo sapiens
uaguuucccuugcaugguuu

SEQ ID NO: 1060179 - RNA, 17 nt, Homo sapiens
uaguuuggauuacuuaa

SEQ ID NO: 1060180 - RNA, 14 nt, Homo sapiens
uaguuuuacuuuua

SEQ ID NO: 1060181 - RNA, 20 nt, Homo sapiens
uaguuuugucaaacuguaga

SEQ ID NO: 1060182 - RNA, 20 nt, Homo sapiens
uauaaaccgaucuucgugau

SEQ ID NO: 1060183 - RNA, 23 nt, Homo sapiens
uauaaaccgaucuucgugauacu

SEQ ID NO: 1060184 - RNA, 23 nt, Homo sapiens
uauaaagauacagaacucuuuca

SEQ ID NO: 1060185 - RNA, 15 nt, Homo sapiens
uauaaagauggcuga

SEQ ID NO: 1060186 - RNA, 14 nt, Homo sapiens
uauaaauaacuaau

SEQ ID NO: 1060187 - RNA, 21 nt, Homo sapiens
uauaaaugugauugcagcuuu

SEQ ID NO: 1060188 - RNA, 18 nt, Homo sapiens
uauaaauuuguguucuca

SEQ ID NO: 1060189 - RNA, 19 nt, Homo sapiens
uauaaauuuguguucucaa

SEQ ID NO: 1060190 - RNA, 20 nt, Homo sapiens
uauaaauuuuauaacagaau

SEQ ID NO: 1060191 - RNA, 15 nt, Homo sapiens
uauaacaaacuacau

SEQ ID NO: 1060192 - RNA, 14 nt, Homo sapiens
uauaacagaauuaa

SEQ ID NO: 1060193 - RNA, 22 nt, Homo sapiens
uauaaccacaaagcacaguuug

SEQ ID NO: 1060194 - RNA, 14 nt, Homo sapiens
uauaacgucaugug

SEQ ID NO: 1060195 - RNA, 12 nt, Homo sapiens
uauaacucugca

SEQ ID NO: 1060196 - RNA, 12 nt, Homo sapiens
uauaacuugucu

SEQ ID NO: 1060197 - RNA, 21 nt, Homo sapiens
uauaagaagcuuucaguauua

SEQ ID NO: 1060198 - RNA, 17 nt, Homo sapiens
uauaaucccagcacuuu

SEQ ID NO: 1060199 - RNA, 12 nt, Homo sapiens
uauaaucuacuc

SEQ ID NO: 1060200 - RNA, 18 nt, Homo sapiens
ucacaaccaccuaaucag

SEQ ID NO: 1060201 - RNA, 15 nt, Homo sapiens
ucacaagaagaccag

SEQ ID NO: 1060202 - RNA, 14 nt, Homo sapiens
ucacaagaauuuaa

SEQ ID NO: 1060203 - RNA, 11 nt, Homo sapiens
ucacaccagcc

SEQ ID NO: 1060204 - RNA, 20 nt, Homo sapiens
ucacaccugacucugaaauc

SEQ ID NO: 1060205 - RNA, 19 nt, Homo sapiens
ucacacgguuugaagccug

SEQ ID NO: 1060206 - RNA, 19 nt, Homo sapiens
ucacacuuccaccagccug

SEQ ID NO: 1060207 - RNA, 18 nt, Homo sapiens
ucacagaagcacagcacc

SEQ ID NO: 1060208 - RNA, 13 nt, Homo sapiens
ucacagacuggca

SEQ ID NO: 1060209 - RNA, 12 nt, Homo sapiens
ucacagccucaa

SEQ ID NO: 1060210 - RNA, 18 nt, Homo sapiens
ucacagccucaagucacu

SEQ ID NO: 1060211 - RNA, 14 nt, Homo sapiens
ucacagcuacacag

SEQ ID NO: 1060212 - RNA, 16 nt, Homo sapiens
ucacagcugcuuucug

SEQ ID NO: 1060213 - RNA, 23 nt, Homo sapiens
ucacaggugggaucggcacucag

SEQ ID NO: 1060214 - RNA, 16 nt, Homo sapiens
ucacaguguugcccag

SEQ ID NO: 1060215 - RNA, 14 nt, Homo sapiens
ucacauccuguguu

SEQ ID NO: 1060216 - RNA, 16 nt, Homo sapiens
ucacaucugcaucuua

SEQ ID NO: 1060217 - RNA, 15 nt, Homo sapiens
ucacaugaugcauac

SEQ ID NO: 1060218 - RNA, 17 nt, Homo sapiens
ucacauggccuaugcac

SEQ ID NO: 1060219 - RNA, 19 nt, Homo sapiens
ucacauuuauucugcucac

SEQ ID NO: 1060220 - RNA, 11 nt, Homo sapiens
ucacauuugcg

SEQ ID NO: 1060221 - RNA, 18 nt, Homo sapiens
ucaccaaaucagcugcua

SEQ ID NO: 1060222 - RNA, 20 nt, Homo sapiens
ucaccaacccagagaaccug

SEQ ID NO: 1060223 - RNA, 20 nt, Homo sapiens
ucaccagaauaaacccagcu

SEQ ID NO: 1060224 - RNA, 14 nt, Homo sapiens
ucaccagagcauuu

SEQ ID NO: 1060225 - RNA, 18 nt, Homo sapiens
ucaccagagcauuuccaa

SEQ ID NO: 1060226 - RNA, 16 nt, Homo sapiens
ucaccauaaaaaggaa

SEQ ID NO: 1060227 - RNA, 18 nt, Homo sapiens
ucaccaucagucaaugaa

SEQ ID NO: 1060228 - RNA, 15 nt, Homo sapiens
ucaccauguacauag

SEQ ID NO: 1060229 - RNA, 16 nt, Homo sapiens
ucaccauugcugucaa

SEQ ID NO: 1060230 - RNA, 14 nt, Homo sapiens
ucacccaggaggau

SEQ ID NO: 1060231 - RNA, 17 nt, Homo sapiens
ucacccccaaacaguga

SEQ ID NO: 1060232 - RNA, 18 nt, Homo sapiens
ucaccccugcccugggau

SEQ ID NO: 1060233 - RNA, 13 nt, Homo sapiens
ucacccuaaggaa

SEQ ID NO: 1060234 - RNA, 14 nt, Homo sapiens
ucacccuaccugug

SEQ ID NO: 1060235 - RNA, 18 nt, Homo sapiens
ucacccuguccaaacugc

SEQ ID NO: 1060236 - RNA, 21 nt, Homo sapiens
ucacccuguccagaccuuuga

SEQ ID NO: 1060237 - RNA, 16 nt, Homo sapiens
ucaccgacaacaugcu

SEQ ID NO: 1060238 - RNA, 23 nt, Homo sapiens
ucaccuccggucgugucucuggu

SEQ ID NO: 1060239 - RNA, 14 nt, Homo sapiens
ucaccucucaaggu

SEQ ID NO: 1060240 - RNA, 22 nt, Homo sapiens
ucaccuggggcugcuggccuga

SEQ ID NO: 1060241 - RNA, 17 nt, Homo sapiens
ucaccuguuacuugaaa

SEQ ID NO: 1060242 - RNA, 17 nt, Homo sapiens
ucaccuuaggcagggaa

SEQ ID NO: 1060243 - RNA, 19 nt, Homo sapiens
ucacgaauauuaugcccag

SEQ ID NO: 1060244 - RNA, 17 nt, Homo sapiens
ucacgaguucaggagau

SEQ ID NO: 1060245 - RNA, 19 nt, Homo sapiens
ucacgccuguaaucccagc

SEQ ID NO: 1060246 - RNA, 15 nt, Homo sapiens
ucacgucacacuugg

SEQ ID NO: 1060247 - RNA, 19 nt, Homo sapiens
ucacuaaacucucauuucu

SEQ ID NO: 1060248 - RNA, 21 nt, Homo sapiens
ucacuaagaagcuugaaucua

SEQ ID NO: 1060249 - RNA, 17 nt, Homo sapiens
ucacuaauacuaauuca

SEQ ID NO: 1060250 - RNA, 13 nt, Homo sapiens
ucacuauggugcc

SEQ ID NO: 1060251 - RNA, 18 nt, Homo sapiens
ucacucaaucucugauuc

SEQ ID NO: 1060252 - RNA, 15 nt, Homo sapiens
ucacucaucugccaa

SEQ ID NO: 1060253 - RNA, 19 nt, Homo sapiens
ucacuccacaacccaagaa

SEQ ID NO: 1060254 - RNA, 23 nt, Homo sapiens
ucacucucugaagaugaucauuu

SEQ ID NO: 1060255 - RNA, 18 nt, Homo sapiens
ucacugaaaacaucugga

SEQ ID NO: 1060256 - RNA, 20 nt, Homo sapiens
ucacugaaaacaucuggaag

SEQ ID NO: 1060257 - RNA, 17 nt, Homo sapiens
ucacugaaaccaggugg

SEQ ID NO: 1060258 - RNA, 15 nt, Homo sapiens
ucacugaacuuugcu

SEQ ID NO: 1060259 - RNA, 14 nt, Homo sapiens
ucacugcaaccucc

SEQ ID NO: 1060260 - RNA, 21 nt, Homo sapiens
ucacugccauauacucuucaa

SEQ ID NO: 1060261 - RNA, 16 nt, Homo sapiens
ucacugcuguagacau

SEQ ID NO: 1060262 - RNA, 13 nt, Homo sapiens
ucacuggaacuca

SEQ ID NO: 1060263 - RNA, 19 nt, Homo sapiens
ucacuggaacucaguguga

SEQ ID NO: 1060264 - RNA, 17 nt, Homo sapiens
ucacuggaccacugggc

SEQ ID NO: 1060265 - RNA, 21 nt, Homo sapiens
ucacuggccacaguuguuuga

SEQ ID NO: 1060266 - RNA, 20 nt, Homo sapiens
ucacuggguucccauucuga

SEQ ID NO: 1060267 - RNA, 18 nt, Homo sapiens
ucacuguuggauguuaca

SEQ ID NO: 1060268 - RNA, 22 nt, Homo sapiens
ucacuuaacugauguuacugaa

SEQ ID NO: 1060269 - RNA, 12 nt, Homo sapiens
ucacuucacccu

SEQ ID NO: 1060270 - RNA, 19 nt, Homo sapiens
ucacuucauagcucaccag

SEQ ID NO: 1060271 - RNA, 16 nt, Homo sapiens
ucacuuuaaagcccuu

SEQ ID NO: 1060272 - RNA, 17 nt, Homo sapiens
ucacuuuaaagcccuuu

SEQ ID NO: 1060273 - RNA, 16 nt, Homo sapiens
ucacuuuagaugcuga

SEQ ID NO: 1060274 - RNA, 17 nt, Homo sapiens
ucacuuuuacuacccca

SEQ ID NO: 1060275 - RNA, 18 nt, Homo sapiens
ucacuuuuuuucuuuucu

SEQ ID NO: 1060276 - RNA, 22 nt, Homo sapiens
ucagaaaaaaaaaaaaaagccu

SEQ ID NO: 1060277 - RNA, 23 nt, Homo sapiens
ucagaaauuuaauucauguuucu

SEQ ID NO: 1060278 - RNA, 14 nt, Homo sapiens
ucagaacaaaguga

SEQ ID NO: 1060279 - RNA, 18 nt, Homo sapiens
ucagaacuagaauuugau

SEQ ID NO: 1060280 - RNA, 22 nt, Homo sapiens
ucagaagaaagaaucuuuccau

SEQ ID NO: 1060281 - RNA, 16 nt, Homo sapiens
ucagaagccuagggga

SEQ ID NO: 1060282 - RNA, 18 nt, Homo sapiens
ucagaaggauggcauuuu

SEQ ID NO: 1060283 - RNA, 19 nt, Homo sapiens
ucagaaguuucucagcucc

SEQ ID NO: 1060284 - RNA, 20 nt, Homo sapiens
ucagaaucacuucugagaac

SEQ ID NO: 1060285 - RNA, 16 nt, Homo sapiens
ucagagacuaucugau

SEQ ID NO: 1060286 - RNA, 14 nt, Homo sapiens
ucagagagcucacu

SEQ ID NO: 1060287 - RNA, 15 nt, Homo sapiens
ucagagcuacuuggg

SEQ ID NO: 1060288 - RNA, 17 nt, Homo sapiens
ucagagcugacacagga

SEQ ID NO: 1060289 - RNA, 12 nt, Homo sapiens
ucagagugcaag

SEQ ID NO: 1060290 - RNA, 13 nt, Homo sapiens
ucagagugcaagc

SEQ ID NO: 1060291 - RNA, 16 nt, Homo sapiens
ucagaguugugcacau

SEQ ID NO: 1060292 - RNA, 23 nt, Homo sapiens
ucagauauaaaagacugaccaau

SEQ ID NO: 1060293 - RNA, 17 nt, Homo sapiens
ucagaucacuacugcag

SEQ ID NO: 1060294 - RNA, 14 nt, Homo sapiens
ucagaucauuauca

SEQ ID NO: 1060295 - RNA, 12 nt, Homo sapiens
ucagaucucaug

SEQ ID NO: 1060296 - RNA, 16 nt, Homo sapiens
ucagaucucaugggau

SEQ ID NO: 1060297 - RNA, 17 nt, Homo sapiens
ucagaucucuaacuuca

SEQ ID NO: 1060298 - RNA, 16 nt, Homo sapiens
ucagaugaacucuuag

SEQ ID NO: 1060299 - RNA, 19 nt, Homo sapiens
ucagauggaaccgcaggaa

SEQ ID NO: 1060300 - RNA, 18 nt, Homo sapiens
ucagauggacaagauuac

SEQ ID NO: 1060301 - RNA, 18 nt, Homo sapiens
ucagauuccgcaccaaua

SEQ ID NO: 1060302 - RNA, 16 nt, Homo sapiens
ucagauugcaugugac

SEQ ID NO: 1060303 - RNA, 13 nt, Homo sapiens
ucagcaaugauua

SEQ ID NO: 1060304 - RNA, 14 nt, Homo sapiens
ucagcacuccucau

SEQ ID NO: 1060305 - RNA, 14 nt, Homo sapiens
ucagcaucuguccu

SEQ ID NO: 1060306 - RNA, 17 nt, Homo sapiens
ucagcaucuguccucau

SEQ ID NO: 1060307 - RNA, 16 nt, Homo sapiens
ucagccagccuccagc

SEQ ID NO: 1060308 - RNA, 14 nt, Homo sapiens
ucagccauucacug

SEQ ID NO: 1060309 - RNA, 22 nt, Homo sapiens
ucagcccagccccuccaaaggu

SEQ ID NO: 1060310 - RNA, 15 nt, Homo sapiens
ucagccccucuugcc

SEQ ID NO: 1060311 - RNA, 14 nt, Homo sapiens
ucagccucccaaag

SEQ ID NO: 1060312 - RNA, 22 nt, Homo sapiens
ucagccuuucuaaaaguugcau

SEQ ID NO: 1060313 - RNA, 15 nt, Homo sapiens
ucagcggccccuuga

SEQ ID NO: 1060314 - RNA, 20 nt, Homo sapiens
ucagcuccuucaaugcaaag

SEQ ID NO: 1060315 - RNA, 15 nt, Homo sapiens
ucagcugaaccuggg

SEQ ID NO: 1060316 - RNA, 14 nt, Homo sapiens
ucagcuggaucucc

SEQ ID NO: 1060317 - RNA, 15 nt, Homo sapiens
ucagcuggaucucca

SEQ ID NO: 1060318 - RNA, 21 nt, Homo sapiens
ucagcuggaucuccauucucu

SEQ ID NO: 1060319 - RNA, 14 nt, Homo sapiens
ucagcuggcacugu

SEQ ID NO: 1060320 - RNA, 15 nt, Homo sapiens
ucagcuggcacuguc

SEQ ID NO: 1060321 - RNA, 23 nt, Homo sapiens
ucagcugggaugacuggcuuuga

SEQ ID NO: 1060322 - RNA, 20 nt, Homo sapiens
ucaggaaggaugagcauuua

SEQ ID NO: 1060323 - RNA, 21 nt, Homo sapiens
ucaggacacuaauacaccagg

SEQ ID NO: 1060324 - RNA, 16 nt, Homo sapiens
ucaggaccugggaccu

SEQ ID NO: 1060325 - RNA, 23 nt, Homo sapiens
ucaggagaggggcagaacagccg

SEQ ID NO: 1060326 - RNA, 18 nt, Homo sapiens
ucaggaguuccuaaccag

SEQ ID NO: 1060327 - RNA, 13 nt, Homo sapiens
ucaggcagcucaa

SEQ ID NO: 1060328 - RNA, 18 nt, Homo sapiens
ucaggccaggugcagugg

SEQ ID NO: 1060329 - RNA, 18 nt, Homo sapiens
ucaggccauugucccuga

SEQ ID NO: 1060330 - RNA, 14 nt, Homo sapiens
ucagggacagagcc

SEQ ID NO: 1060331 - RNA, 20 nt, Homo sapiens
ucagggagaguuugggaacu

SEQ ID NO: 1060332 - RNA, 18 nt, Homo sapiens
ucagggcagggcucugau

SEQ ID NO: 1060333 - RNA, 18 nt, Homo sapiens
ucagggcugagaggagaa

SEQ ID NO: 1060334 - RNA, 14 nt, Homo sapiens
ucagggcugugauc

SEQ ID NO: 1060335 - RNA, 15 nt, Homo sapiens
ucaggggacuugaau

SEQ ID NO: 1060336 - RNA, 16 nt, Homo sapiens
ucagguauguugccuu

SEQ ID NO: 1060337 - RNA, 17 nt, Homo sapiens
ucaggucccaggccagc

SEQ ID NO: 1060338 - RNA, 12 nt, Homo sapiens
ucaggugacaug

SEQ ID NO: 1060339 - RNA, 21 nt, Homo sapiens
ucaggugauccaccugccucg

SEQ ID NO: 1060340 - RNA, 20 nt, Homo sapiens
ucagguuguaguaaagaaau

SEQ ID NO: 1060341 - RNA, 18 nt, Homo sapiens
ucaguaagacgacaagga

SEQ ID NO: 1060342 - RNA, 20 nt, Homo sapiens
ucaguaagacgacaaggaaa

SEQ ID NO: 1060343 - RNA, 15 nt, Homo sapiens
ucaguaauaacucua

SEQ ID NO: 1060344 - RNA, 17 nt, Homo sapiens
ucaguccaaagggcaug

SEQ ID NO: 1060345 - RNA, 19 nt, Homo sapiens
uuuuaguagagaugggguu

SEQ ID NO: 1060346 - RNA, 12 nt, Homo sapiens
uuuuauauccac

SEQ ID NO: 1060347 - RNA, 19 nt, Homo sapiens
uuuuauggcuuuugugcau

SEQ ID NO: 1060348 - RNA, 22 nt, Homo sapiens
uuuuauuugagacagagucuca

SEQ ID NO: 1060349 - RNA, 23 nt, Homo sapiens
uuuuauuuuuagacagagucuca

SEQ ID NO: 1060350 - RNA, 14 nt, Homo sapiens
uuuucacaaauaaa

SEQ ID NO: 1060351 - RNA, 15 nt, Homo sapiens
uuuucccucgcuggg

SEQ ID NO: 1060352 - RNA, 12 nt, Homo sapiens
uuuuccuauaau

SEQ ID NO: 1060353 - RNA, 18 nt, Homo sapiens
uuuuccuggcucaucucu

SEQ ID NO: 1060354 - RNA, 13 nt, Homo sapiens
uuuuccuucucau

SEQ ID NO: 1060355 - RNA, 21 nt, Homo sapiens
uuuucuaagguucucauagga

SEQ ID NO: 1060356 - RNA, 14 nt, Homo sapiens
uuuucuauuauuaa

SEQ ID NO: 1060357 - RNA, 12 nt, Homo sapiens
uuuugacaucaa

SEQ ID NO: 1060358 - RNA, 17 nt, Homo sapiens
uuuugagcuaaucuuca

SEQ ID NO: 1060359 - RNA, 14 nt, Homo sapiens
uuuugagggagcaa

SEQ ID NO: 1060360 - RNA, 14 nt, Homo sapiens
uuuugauagcuuua

SEQ ID NO: 1060361 - RNA, 18 nt, Homo sapiens
uuuugcacacuuugccau

SEQ ID NO: 1060362 - RNA, 13 nt, Homo sapiens
uuuugcuguagaa

SEQ ID NO: 1060363 - RNA, 22 nt, Homo sapiens
uuuuggaggguccuccacaaua

SEQ ID NO: 1060364 - RNA, 13 nt, Homo sapiens
uuuuggccaaagu

SEQ ID NO: 1060365 - RNA, 19 nt, Homo sapiens
uuuugguauuacacuguau

SEQ ID NO: 1060366 - RNA, 16 nt, Homo sapiens
uuuugguugcuuuaau

SEQ ID NO: 1060367 - RNA, 15 nt, Homo sapiens
uuuuguauaauugua

SEQ ID NO: 1060368 - RNA, 13 nt, Homo sapiens
uuuuguuaccuuu

SEQ ID NO: 1060369 - RNA, 18 nt, Homo sapiens
uuuuuaaaaaacugcuga

SEQ ID NO: 1060370 - RNA, 19 nt, Homo sapiens
uuuuuaauuuuuugucaag

SEQ ID NO: 1060371 - RNA, 20 nt, Homo sapiens
uuuuuagcugguggcaauaa

SEQ ID NO: 1060372 - RNA, 22 nt, Homo sapiens
uuuuuaucuccccuucacaugc

SEQ ID NO: 1060373 - RNA, 20 nt, Homo sapiens
uuuuuauggaggcuuugcau

SEQ ID NO: 1060374 - RNA, 23 nt, Homo sapiens
uuuuuccuuccuuaucacugaca

SEQ ID NO: 1060375 - RNA, 19 nt, Homo sapiens
uuuuuccuuugaacuuuga

SEQ ID NO: 1060376 - RNA, 16 nt, Homo sapiens
uuuuucuaagguucuc

SEQ ID NO: 1060377 - RNA, 13 nt, Homo sapiens
uuuuucuccagcu

SEQ ID NO: 1060378 - RNA, 20 nt, Homo sapiens
uuuuugccuucauuaccuuu

SEQ ID NO: 1060379 - RNA, 23 nt, Homo sapiens
uuuuuggaauuaugucugcugaa

SEQ ID NO: 1060380 - RNA, 13 nt, Homo sapiens
uuuuuguguggau

SEQ ID NO: 1060381 - RNA, 21 nt, Homo sapiens
uuuuuguuucuuccaaagcac

SEQ ID NO: 1060382 - RNA, 19 nt, Homo sapiens
uuuuuuaaauaaaagcagc

SEQ ID NO: 1060383 - RNA, 14 nt, Homo sapiens
uuuuuuacacaaau

SEQ ID NO: 1060384 - RNA, 20 nt, Homo sapiens
uuuuuuauaaucaagccuaa

SEQ ID NO: 1060385 - RNA, 13 nt, Homo sapiens
uuuuuucaccaau

SEQ ID NO: 1060386 - RNA, 12 nt, Homo sapiens
uuuuuugauuga

SEQ ID NO: 1060387 - RNA, 20 nt, Homo sapiens
ucaaguugugcuuguuuaca

SEQ ID NO: 1060388 - RNA, 15 nt, Homo sapiens
ucaauaaucaaugaa

SEQ ID NO: 1060389 - RNA, 13 nt, Homo sapiens
ucaauaggcaaag

SEQ ID NO: 1060390 - RNA, 14 nt, Homo sapiens
ucaauauuccugaa

SEQ ID NO: 1060391 - RNA, 16 nt, Homo sapiens
ucaauccgaaguauga

SEQ ID NO: 1060392 - RNA, 16 nt, Homo sapiens
ucaaucucugauucug

SEQ ID NO: 1060393 - RNA, 16 nt, Homo sapiens
ucaauguaguuuucca

SEQ ID NO: 1060394 - RNA, 21 nt, Homo sapiens
ucaauguuucuuuuaucacga

SEQ ID NO: 1060395 - RNA, 16 nt, Homo sapiens
ucaauucagugcugua

SEQ ID NO: 1060396 - RNA, 23 nt, Homo sapiens
ucaauuuaaacccauuuuaguca

SEQ ID NO: 1060397 - RNA, 15 nt, Homo sapiens
ucaauuuaaauaacc

SEQ ID NO: 1060398 - RNA, 16 nt, Homo sapiens
ucaauuuaauuuugca

SEQ ID NO: 1060399 - RNA, 18 nt, Homo sapiens
ucaauuuguaauugcuua

SEQ ID NO: 1060400 - RNA, 19 nt, Homo sapiens
ucacaaaucuuaacuugaa

SEQ ID NO: 1060401 - RNA, 16 nt, Homo sapiens
ucacaagaagaccaga

SEQ ID NO: 1060402 - RNA, 20 nt, Homo sapiens
ucacaagaauuuaaaacgca

SEQ ID NO: 1060403 - RNA, 19 nt, Homo sapiens
ucacaaguuacagcuguga

SEQ ID NO: 1060404 - RNA, 22 nt, Homo sapiens
ucacaauaaaaauggcucagau

SEQ ID NO: 1060405 - RNA, 18 nt, Homo sapiens
ucacaauacucaaaagag

SEQ ID NO: 1060406 - RNA, 21 nt, Homo sapiens
ucacaaucaucaucauucuca

SEQ ID NO: 1060407 - RNA, 22 nt, Homo sapiens
ucacaaucaucaucauucucau

SEQ ID NO: 1060408 - RNA, 13 nt, Homo sapiens
ucacaaugaaaug

SEQ ID NO: 1060409 - RNA, 17 nt, Homo sapiens
ucacacagagaggcaga

SEQ ID NO: 1060410 - RNA, 22 nt, Homo sapiens
ucacaccacaaaucugaaugug

SEQ ID NO: 1060411 - RNA, 23 nt, Homo sapiens
ucacaccaggcuugccugcaggc

SEQ ID NO: 1060412 - RNA, 14 nt, Homo sapiens
ucacaccugaccaa

SEQ ID NO: 1060413 - RNA, 12 nt, Homo sapiens
ucacaccuguaa

SEQ ID NO: 1060414 - RNA, 16 nt, Homo sapiens
ucacacuuccaccagc

SEQ ID NO: 1060415 - RNA, 17 nt, Homo sapiens
ucacacuuccaccagcc

SEQ ID NO: 1060416 - RNA, 19 nt, Homo sapiens
ucacagacaccagcaaagc

SEQ ID NO: 1060417 - RNA, 19 nt, Homo sapiens
ucacagacuggcaacaaga

SEQ ID NO: 1060418 - RNA, 20 nt, Homo sapiens
ucacagcaagucacuggcca

SEQ ID NO: 1060419 - RNA, 22 nt, Homo sapiens
ucacagcacagagaagacaaaa

SEQ ID NO: 1060420 - RNA, 18 nt, Homo sapiens
ucacagccacuugggaua

SEQ ID NO: 1060421 - RNA, 18 nt, Homo sapiens
ucacagcuaacaauugug

SEQ ID NO: 1060422 - RNA, 11 nt, Homo sapiens
ucacagcugcu

SEQ ID NO: 1060423 - RNA, 18 nt, Homo sapiens
ucacagcuucagccagga

SEQ ID NO: 1060424 - RNA, 16 nt, Homo sapiens
ucacagggacugaaaa

SEQ ID NO: 1060425 - RNA, 20 nt, Homo sapiens
ucacagggccccagaaggca

SEQ ID NO: 1060426 - RNA, 18 nt, Homo sapiens
ucacaguugacaaaaagc

SEQ ID NO: 1060427 - RNA, 21 nt, Homo sapiens
ucacaguuuugguugcuuuaa

SEQ ID NO: 1060428 - RNA, 18 nt, Homo sapiens
ucacaugagcuauuucca

SEQ ID NO: 1060429 - RNA, 20 nt, Homo sapiens
ucacauggccuaugcacaua

SEQ ID NO: 1060430 - RNA, 17 nt, Homo sapiens
ucacaugucaguaccuu

SEQ ID NO: 1060431 - RNA, 16 nt, Homo sapiens
ucacauuaucaucuga

SEQ ID NO: 1060432 - RNA, 17 nt, Homo sapiens
ucacauuaucaucugaa

SEQ ID NO: 1060433 - RNA, 23 nt, Homo sapiens
ucacauuccaagccucaugucca

SEQ ID NO: 1060434 - RNA, 20 nt, Homo sapiens
ucacauucuuauaaauauga

SEQ ID NO: 1060435 - RNA, 23 nt, Homo sapiens
ucacauuggcuauuuaaagacaa

SEQ ID NO: 1060436 - RNA, 18 nt, Homo sapiens
ucacauuuuccuuuucaa

SEQ ID NO: 1060437 - RNA, 13 nt, Homo sapiens
ucaccaaggcuga

SEQ ID NO: 1060438 - RNA, 17 nt, Homo sapiens
ucaccacaccaaaccuc

SEQ ID NO: 1060439 - RNA, 16 nt, Homo sapiens
ucaccaccaucuccag

SEQ ID NO: 1060440 - RNA, 13 nt, Homo sapiens
ucaccacuucccu

SEQ ID NO: 1060441 - RNA, 15 nt, Homo sapiens
ucaccagagcauuuc

SEQ ID NO: 1060442 - RNA, 16 nt, Homo sapiens
ucaccaggucagggag

SEQ ID NO: 1060443 - RNA, 19 nt, Homo sapiens
ucaccaguguccccuccac

SEQ ID NO: 1060444 - RNA, 17 nt, Homo sapiens
ucaccauguacauagcu

SEQ ID NO: 1060445 - RNA, 19 nt, Homo sapiens
ucaccauuuggcaaugcca

SEQ ID NO: 1060446 - RNA, 20 nt, Homo sapiens
ucaccauuuggcaaugccau

SEQ ID NO: 1060447 - RNA, 14 nt, Homo sapiens
ucacccaaugcaua

SEQ ID NO: 1060448 - RNA, 21 nt, Homo sapiens
ucacccaggcuggagugcaau

SEQ ID NO: 1060449 - RNA, 12 nt, Homo sapiens
ucacccugcuac

SEQ ID NO: 1060450 - RNA, 14 nt, Homo sapiens
ucacccuguccaaa

SEQ ID NO: 1060451 - RNA, 17 nt, Homo sapiens
ucaccgaggacaugaaa

SEQ ID NO: 1060452 - RNA, 14 nt, Homo sapiens
ucaccggagcuuuc

SEQ ID NO: 1060453 - RNA, 22 nt, Homo sapiens
ucaccggagcuuucaaagaagg

SEQ ID NO: 1060454 - RNA, 21 nt, Homo sapiens
ucaccguggaccuuccugcca

SEQ ID NO: 1060455 - RNA, 18 nt, Homo sapiens
ucaccucacacuccucca

SEQ ID NO: 1060456 - RNA, 13 nt, Homo sapiens
ugccaccagucac

SEQ ID NO: 1060457 - RNA, 18 nt, Homo sapiens
ugccacccucaugcugug

SEQ ID NO: 1060458 - RNA, 21 nt, Homo sapiens
ugccacgccgcccuaaaagca

SEQ ID NO: 1060459 - RNA, 20 nt, Homo sapiens
ugccagaugcugauguucag

SEQ ID NO: 1060460 - RNA, 15 nt, Homo sapiens
ugccagcaacugaau

SEQ ID NO: 1060461 - RNA, 18 nt, Homo sapiens
ugccagcaaugacaucuc

SEQ ID NO: 1060462 - RNA, 19 nt, Homo sapiens
ugccagcaaugacaucuca

SEQ ID NO: 1060463 - RNA, 17 nt, Homo sapiens
ugccagccgugaugcuc

SEQ ID NO: 1060464 - RNA, 15 nt, Homo sapiens
ugccagcucccaugu

SEQ ID NO: 1060465 - RNA, 16 nt, Homo sapiens
ugccagcuuaucucag

SEQ ID NO: 1060466 - RNA, 14 nt, Homo sapiens
ugccagggagacag

SEQ ID NO: 1060467 - RNA, 17 nt, Homo sapiens
ugccagguccuugcccu

SEQ ID NO: 1060468 - RNA, 14 nt, Homo sapiens
ugccaguugaucaa

SEQ ID NO: 1060469 - RNA, 18 nt, Homo sapiens
ugccauauucuguuggcc

SEQ ID NO: 1060470 - RNA, 23 nt, Homo sapiens
ugccauggaggcaugccaaaugu

SEQ ID NO: 1060471 - RNA, 21 nt, Homo sapiens
ugcccaagucuuuccuaccuu

SEQ ID NO: 1060472 - RNA, 15 nt, Homo sapiens
ugcccaauaugcagu

SEQ ID NO: 1060473 - RNA, 20 nt, Homo sapiens
ugcccacgcuggagugcagu

SEQ ID NO: 1060474 - RNA, 21 nt, Homo sapiens
ugcccaggcuggagugcaaug

SEQ ID NO: 1060475 - RNA, 12 nt, Homo sapiens
ugcccagugugu

SEQ ID NO: 1060476 - RNA, 19 nt, Homo sapiens
ugcccaguguuugugcaag

SEQ ID NO: 1060477 - RNA, 18 nt, Homo sapiens
ugccccagaaaaauaacu

SEQ ID NO: 1060478 - RNA, 17 nt, Homo sapiens
ugccccaugccugucca

SEQ ID NO: 1060479 - RNA, 20 nt, Homo sapiens
ugcccccaccacggccacug

SEQ ID NO: 1060480 - RNA, 16 nt, Homo sapiens
ugcccccagggcacuu

SEQ ID NO: 1060481 - RNA, 22 nt, Homo sapiens
ugccccucccagaacacacucc

SEQ ID NO: 1060482 - RNA, 20 nt, Homo sapiens
ugccccugagacaaauggag

SEQ ID NO: 1060483 - RNA, 18 nt, Homo sapiens
ugcccggcaggguccuag

SEQ ID NO: 1060484 - RNA, 21 nt, Homo sapiens
ugcccgguuuuucucuucaau

SEQ ID NO: 1060485 - RNA, 16 nt, Homo sapiens
ugcccucaggggacuu

SEQ ID NO: 1060486 - RNA, 17 nt, Homo sapiens
ugcccuccaagaccuuc

SEQ ID NO: 1060487 - RNA, 16 nt, Homo sapiens
ugcccugggaugucca

SEQ ID NO: 1060488 - RNA, 20 nt, Homo sapiens
ugcccugggauguccacaga

SEQ ID NO: 1060489 - RNA, 14 nt, Homo sapiens
ugccgaaugugcag

SEQ ID NO: 1060490 - RNA, 19 nt, Homo sapiens
ugccggccggggcugagac

SEQ ID NO: 1060491 - RNA, 18 nt, Homo sapiens
ugccuaucuucuuucaca

SEQ ID NO: 1060492 - RNA, 20 nt, Homo sapiens
ugccuauucccacaccucca

SEQ ID NO: 1060493 - RNA, 20 nt, Homo sapiens
ugccucaagccccagagugg

SEQ ID NO: 1060494 - RNA, 22 nt, Homo sapiens
ugccucauuaccuugugcuaau

SEQ ID NO: 1060495 - RNA, 12 nt, Homo sapiens
ugccucauuuua

SEQ ID NO: 1060496 - RNA, 20 nt, Homo sapiens
ugccucccuuaaucugccag

SEQ ID NO: 1060497 - RNA, 16 nt, Homo sapiens
ugccuccugccugccc

SEQ ID NO: 1060498 - RNA, 18 nt, Homo sapiens
ugccucgaacuggcugca

SEQ ID NO: 1060499 - RNA, 17 nt, Homo sapiens
ugccucucgguggccag

SEQ ID NO: 1060500 - RNA, 22 nt, Homo sapiens
ugccucugagggaaagcccaga

SEQ ID NO: 1060501 - RNA, 15 nt, Homo sapiens
ugccucuguauuuaa

SEQ ID NO: 1060502 - RNA, 13 nt, Homo sapiens
ugccugacauuug

SEQ ID NO: 1060503 - RNA, 23 nt, Homo sapiens
ugccugccccaaacaaauaugca

SEQ ID NO: 1060504 - RNA, 23 nt, Homo sapiens
ugccugcuuuucacugcugcaag

SEQ ID NO: 1060505 - RNA, 13 nt, Homo sapiens
ugccugggaugau

SEQ ID NO: 1060506 - RNA, 16 nt, Homo sapiens
ugccugguggcagcug

SEQ ID NO: 1060507 - RNA, 20 nt, Homo sapiens
ugccuguuauaacucugcac

SEQ ID NO: 1060508 - RNA, 22 nt, Homo sapiens
ugccuguucaguuacagaaagu

SEQ ID NO: 1060509 - RNA, 14 nt, Homo sapiens
ugccuuaacuggag

SEQ ID NO: 1060510 - RNA, 18 nt, Homo sapiens
ugccuuccagcacccugc

SEQ ID NO: 1060511 - RNA, 15 nt, Homo sapiens
ugccuucucaggaaa

SEQ ID NO: 1060512 - RNA, 20 nt, Homo sapiens
ugccuucuuauugcuuuuau

SEQ ID NO: 1060513 - RNA, 18 nt, Homo sapiens
ugccuugcuaaaagauua

SEQ ID NO: 1060514 - RNA, 16 nt, Homo sapiens
ugccuuggcuucaggg

SEQ ID NO: 1060515 - RNA, 16 nt, Homo sapiens
ugccuuggcuuugcca

SEQ ID NO: 1060516 - RNA, 22 nt, Homo sapiens
ugccuugugaauuugcugcuau

SEQ ID NO: 1060517 - RNA, 20 nt, Homo sapiens
ugccuuuccauaaucacuca

SEQ ID NO: 1060518 - RNA, 22 nt, Homo sapiens
ugccuuuggauugacucugcau

SEQ ID NO: 1060519 - RNA, 20 nt, Homo sapiens
ugccuuuugcaccccuccca

SEQ ID NO: 1060520 - RNA, 17 nt, Homo sapiens
ugcgaauaagcuuuuaa

SEQ ID NO: 1060521 - RNA, 13 nt, Homo sapiens
ugcgacugaugaa

SEQ ID NO: 1060522 - RNA, 17 nt, Homo sapiens
ugcgagugcucauuuca

SEQ ID NO: 1060523 - RNA, 16 nt, Homo sapiens
ugcgagugugugcaug

SEQ ID NO: 1060524 - RNA, 19 nt, Homo sapiens
ugcgcacaaggcugaccaa

SEQ ID NO: 1060525 - RNA, 18 nt, Homo sapiens
ugcgcccaguccuuccac

SEQ ID NO: 1060526 - RNA, 15 nt, Homo sapiens
ugcgcgcaugugcgc

SEQ ID NO: 1060527 - RNA, 19 nt, Homo sapiens
ugcgcgcaugugcgcacac

SEQ ID NO: 1060528 - RNA, 15 nt, Homo sapiens
ugcgcucccaccuca

SEQ ID NO: 1060529 - RNA, 20 nt, Homo sapiens
ugcggaaugaaccacaucuu

SEQ ID NO: 1060530 - RNA, 17 nt, Homo sapiens
ugcguaacuggcugugu

SEQ ID NO: 1060531 - RNA, 14 nt, Homo sapiens
ugcguggacucugc

SEQ ID NO: 1060532 - RNA, 15 nt, Homo sapiens
ugcguggacucugca

SEQ ID NO: 1060533 - RNA, 23 nt, Homo sapiens
ugcuaaacgcacacaguaucuag

SEQ ID NO: 1060534 - RNA, 12 nt, Homo sapiens
ugcuaacaaugc

SEQ ID NO: 1060535 - RNA, 22 nt, Homo sapiens
ugcuaacuagcuuggaaacugg

SEQ ID NO: 1060536 - RNA, 22 nt, Homo sapiens
ugcuaagaagcgagcacugacc

SEQ ID NO: 1060537 - RNA, 23 nt, Homo sapiens
ugcuaauauauguauaugcaaua

SEQ ID NO: 1060538 - RNA, 13 nt, Homo sapiens
ugcuacccagaaa

SEQ ID NO: 1060539 - RNA, 24 nt, Homo sapiens
ugcuacugauuguuucauugcgaa

SEQ ID NO: 1060540 - RNA, 17 nt, Homo sapiens
ugcuacuuaauuccuuu

SEQ ID NO: 1060541 - RNA, 12 nt, Homo sapiens
ugcuagagccag

SEQ ID NO: 1060542 - RNA, 14 nt, Homo sapiens
ugcuaggucucgga

SEQ ID NO: 1060543 - RNA, 18 nt, Homo sapiens
ugcuauacugcauacuuu

SEQ ID NO: 1060544 - RNA, 14 nt, Homo sapiens
ugcuauaucaguuu

SEQ ID NO: 1060545 - RNA, 15 nt, Homo sapiens
ugcuaucgcaccacu

SEQ ID NO: 1060546 - RNA, 16 nt, Homo sapiens
ugcuaucgccaucaca

SEQ ID NO: 1060547 - RNA, 16 nt, Homo sapiens
ugcuaugaaugauacc

SEQ ID NO: 1060548 - RNA, 16 nt, Homo sapiens
ugcuauugacaaguca

SEQ ID NO: 1060549 - RNA, 21 nt, Homo sapiens
ugcuauuguagagccagaggu

SEQ ID NO: 1060550 - RNA, 15 nt, Homo sapiens
ugcuauuucacucua

SEQ ID NO: 1060551 - RNA, 12 nt, Homo sapiens
ugcuauuugccu

SEQ ID NO: 1060552 - RNA, 16 nt, Homo sapiens
ugcucagggaaaagca

SEQ ID NO: 1060553 - RNA, 20 nt, Homo sapiens
ugcucaucugguaacucaac

SEQ ID NO: 1060554 - RNA, 21 nt, Homo sapiens
ugcucccagcagcccuaagga

SEQ ID NO: 1060555 - RNA, 20 nt, Homo sapiens
ugcuccguaugccaagagga

SEQ ID NO: 1060556 - RNA, 22 nt, Homo sapiens
ugcucucgcaccuuuccaaagu

SEQ ID NO: 1060557 - RNA, 21 nt, Homo sapiens
ugcucucucacucccccauga

SEQ ID NO: 1060558 - RNA, 19 nt, Homo sapiens
ugcucugguuugagcaauu

SEQ ID NO: 1060559 - RNA, 17 nt, Homo sapiens
ugcucuuaaguugugga

SEQ ID NO: 1060560 - RNA, 20 nt, Homo sapiens
ugcucuugggaagaccagcu

SEQ ID NO: 1060561 - RNA, 13 nt, Homo sapiens
ugcugaagggcag

SEQ ID NO: 1060562 - RNA, 11 nt, Homo sapiens
ugcugacaaag

SEQ ID NO: 1060563 - RNA, 11 nt, Homo sapiens
ugcugaccucu

SEQ ID NO: 1060564 - RNA, 20 nt, Homo sapiens
ugcugagaccccccaccacc

SEQ ID NO: 1060565 - RNA, 18 nt, Homo sapiens
ugcugcccgcucugcaga

SEQ ID NO: 1060566 - RNA, 17 nt, Homo sapiens
ugcugcuggaucacagc

SEQ ID NO: 1060567 - RNA, 19 nt, Homo sapiens
ugcugcuggaucacagcug

SEQ ID NO: 1060568 - RNA, 14 nt, Homo sapiens
ugcuggacacuaca

SEQ ID NO: 1060569 - RNA, 19 nt, Homo sapiens
ugcuggagaaaaaacacac

SEQ ID NO: 1060570 - RNA, 23 nt, Homo sapiens
ugcuggagaaaaaacacacuccu

SEQ ID NO: 1060571 - RNA, 22 nt, Homo sapiens
ugcuggagagguuaaggugcaa

SEQ ID NO: 1060572 - RNA, 17 nt, Homo sapiens
ugcuggagucgggacua

SEQ ID NO: 1060573 - RNA, 15 nt, Homo sapiens
ugcuggaucacagcu

SEQ ID NO: 1060574 - RNA, 13 nt, Homo sapiens
ugcuggcauuugc

SEQ ID NO: 1060575 - RNA, 14 nt, Homo sapiens
ugcuggcucucaga

SEQ ID NO: 1060576 - RNA, 21 nt, Homo sapiens
ugcugggagaggggguagcua

SEQ ID NO: 1060577 - RNA, 20 nt, Homo sapiens
ugcugguguccugaccaccc

SEQ ID NO: 1060578 - RNA, 21 nt, Homo sapiens
ugcuguagacauuugcuauga

SEQ ID NO: 1060579 - RNA, 18 nt, Homo sapiens
ugcugucccaaacaugca

SEQ ID NO: 1060580 - RNA, 13 nt, Homo sapiens
ugcugugcacauu

SEQ ID NO: 1060581 - RNA, 21 nt, Homo sapiens
ugcugugugacucaaaccaaa

SEQ ID NO: 1060582 - RNA, 15 nt, Homo sapiens
ugcuuaaucugagaa

SEQ ID NO: 1060583 - RNA, 14 nt, Homo sapiens
ugcuuaaucuugcu

SEQ ID NO: 1060584 - RNA, 18 nt, Homo sapiens
ugcuuaaugguagcaacu

SEQ ID NO: 1060585 - RNA, 20 nt, Homo sapiens
ugcuuacaauucccugcugu

SEQ ID NO: 1060586 - RNA, 13 nt, Homo sapiens
ugcuuacuuugca

SEQ ID NO: 1060587 - RNA, 13 nt, Homo sapiens
uggcccccagugg

SEQ ID NO: 1060588 - RNA, 23 nt, Homo sapiens
uggcccccgagcugggggccaug

SEQ ID NO: 1060589 - RNA, 16 nt, Homo sapiens
uggcccccuguccucu

SEQ ID NO: 1060590 - RNA, 15 nt, Homo sapiens
uggccccuucacuuc

SEQ ID NO: 1060591 - RNA, 14 nt, Homo sapiens
uggcccuucuugcc

SEQ ID NO: 1060592 - RNA, 14 nt, Homo sapiens
uguaacaucaggga

SEQ ID NO: 1060593 - RNA, 14 nt, Homo sapiens
uguaacccgcucau

SEQ ID NO: 1060594 - RNA, 21 nt, Homo sapiens
uguaaccuugucgacaaagag

SEQ ID NO: 1060595 - RNA, 21 nt, Homo sapiens
uguaacuauaguccagcuuug

SEQ ID NO: 1060596 - RNA, 21 nt, Homo sapiens
uguaacugacugccuugcuaa

SEQ ID NO: 1060597 - RNA, 19 nt, Homo sapiens
uguaagaaacacacugagg

SEQ ID NO: 1060598 - RNA, 15 nt, Homo sapiens
uguaagacucauucc

SEQ ID NO: 1060599 - RNA, 22 nt, Homo sapiens
uguaagcccugcuuagcucauc

SEQ ID NO: 1060600 - RNA, 15 nt, Homo sapiens
uguaagcuguuuauu

SEQ ID NO: 1060601 - RNA, 18 nt, Homo sapiens
uguaagguggucacuguu

SEQ ID NO: 1060602 - RNA, 16 nt, Homo sapiens
uguaaguaaugauaca

SEQ ID NO: 1060603 - RNA, 14 nt, Homo sapiens
uguaaguuuaccua

SEQ ID NO: 1060604 - RNA, 17 nt, Homo sapiens
uguaaguuuaugcauac

SEQ ID NO: 1060605 - RNA, 17 nt, Homo sapiens
uguaaguuucaggugac

SEQ ID NO: 1060606 - RNA, 14 nt, Homo sapiens
uguaaucauauaau

SEQ ID NO: 1060607 - RNA, 22 nt, Homo sapiens
uguaaugguaucuuaaagugug

SEQ ID NO: 1060608 - RNA, 22 nt, Homo sapiens
uguaauuucuuugccuguucag

SEQ ID NO: 1060609 - RNA, 14 nt, Homo sapiens
uguacaaagaaaua

SEQ ID NO: 1060610 - RNA, 20 nt, Homo sapiens
uguacacagaaauacaguua

SEQ ID NO: 1060611 - RNA, 19 nt, Homo sapiens
uguacagugaaaagucucc

SEQ ID NO: 1060612 - RNA, 17 nt, Homo sapiens
uguacauggaauaacau

SEQ ID NO: 1060613 - RNA, 17 nt, Homo sapiens
uguacauuagucauuca

SEQ ID NO: 1060614 - RNA, 10 nt, Homo sapiens
uguacauuuc

SEQ ID NO: 1060615 - RNA, 13 nt, Homo sapiens
uguaccauguaca

SEQ ID NO: 1060616 - RNA, 19 nt, Homo sapiens
uguacccuuccuacagaua

SEQ ID NO: 1060617 - RNA, 18 nt, Homo sapiens
uguacgucugacaggcaa

SEQ ID NO: 1060618 - RNA, 15 nt, Homo sapiens
uguacucuacugaua

SEQ ID NO: 1060619 - RNA, 21 nt, Homo sapiens
uguacuguaauagugugauua

SEQ ID NO: 1060620 - RNA, 10 nt, Homo sapiens
uguacuugug

SEQ ID NO: 1060621 - RNA, 19 nt, Homo sapiens
uguacuuuaaaaagaugua

SEQ ID NO: 1060622 - RNA, 18 nt, Homo sapiens
uguacuuuguacaaagac

SEQ ID NO: 1060623 - RNA, 20 nt, Homo sapiens
uguagaagaaagagcaacaa

SEQ ID NO: 1060624 - RNA, 22 nt, Homo sapiens
uguaggaagucauccugccaac

SEQ ID NO: 1060625 - RNA, 13 nt, Homo sapiens
uguagggaacucu

SEQ ID NO: 1060626 - RNA, 15 nt, Homo sapiens
uguagggcauaauga

SEQ ID NO: 1060627 - RNA, 16 nt, Homo sapiens
uguaguaaacuauuua

SEQ ID NO: 1060628 - RNA, 18 nt, Homo sapiens
uguaguccuagccacuca

SEQ ID NO: 1060629 - RNA, 15 nt, Homo sapiens
uguauagacaucugc

SEQ ID NO: 1060630 - RNA, 15 nt, Homo sapiens
uguauagaccuaaaa

SEQ ID NO: 1060631 - RNA, 18 nt, Homo sapiens
uguaucaaaugugacauu

SEQ ID NO: 1060632 - RNA, 17 nt, Homo sapiens
uguaucagcacuccuca

SEQ ID NO: 1060633 - RNA, 18 nt, Homo sapiens
uguaucagcacuccucau

SEQ ID NO: 1060634 - RNA, 17 nt, Homo sapiens
uguaucauuugaacaac

SEQ ID NO: 1060635 - RNA, 14 nt, Homo sapiens
uguauccauccaug

SEQ ID NO: 1060636 - RNA, 23 nt, Homo sapiens
uguauccccccccuguauaguua

SEQ ID NO: 1060637 - RNA, 17 nt, Homo sapiens
uguaucggagacaguga

SEQ ID NO: 1060638 - RNA, 18 nt, Homo sapiens
uguaucggagacagugau

SEQ ID NO: 1060639 - RNA, 16 nt, Homo sapiens
uguaucuuauucacau

SEQ ID NO: 1060640 - RNA, 21 nt, Homo sapiens
uguaugauccuaaugaaugca

SEQ ID NO: 1060641 - RNA, 18 nt, Homo sapiens
uguauguacguuuguaug

SEQ ID NO: 1060642 - RNA, 22 nt, Homo sapiens
uguaugugcgugugugcaagug

SEQ ID NO: 1060643 - RNA, 18 nt, Homo sapiens
uguauguuccucuaugaa

SEQ ID NO: 1060644 - RNA, 22 nt, Homo sapiens
uguauguuuacauaucaccuca

SEQ ID NO: 1060645 - RNA, 18 nt, Homo sapiens
uguauuaaagacagaggc

SEQ ID NO: 1060646 - RNA, 16 nt, Homo sapiens
uguauucacuuauaug

SEQ ID NO: 1060647 - RNA, 16 nt, Homo sapiens
uguauucuucaaccuc

SEQ ID NO: 1060648 - RNA, 15 nt, Homo sapiens
uguauuuaacugccu

SEQ ID NO: 1060649 - RNA, 16 nt, Homo sapiens
uguauuuuaugaucuu

SEQ ID NO: 1060650 - RNA, 17 nt, Homo sapiens
uguauuuuuguacccuu

SEQ ID NO: 1060651 - RNA, 21 nt, Homo sapiens
ugucaagaugaugaugaucuu

SEQ ID NO: 1060652 - RNA, 12 nt, Homo sapiens
ugucacagggac

SEQ ID NO: 1060653 - RNA, 18 nt, Homo sapiens
ugucacuguuccuuguca

SEQ ID NO: 1060654 - RNA, 20 nt, Homo sapiens
ugucagcuacuaaugauguu

SEQ ID NO: 1060655 - RNA, 16 nt, Homo sapiens
ugucagcuuccaaaca

SEQ ID NO: 1060656 - RNA, 21 nt, Homo sapiens
ugucauauggaagaguuaaaa

SEQ ID NO: 1060657 - RNA, 17 nt, Homo sapiens
ugucaucagccugugua

SEQ ID NO: 1060658 - RNA, 16 nt, Homo sapiens
ugucaucauacaugac

SEQ ID NO: 1060659 - RNA, 23 nt, Homo sapiens
ugucauuuuuauaaaacuuugaa

SEQ ID NO: 1060660 - RNA, 16 nt, Homo sapiens
uguccacagaugccuc

SEQ ID NO: 1060661 - RNA, 18 nt, Homo sapiens
uguccaugugugugcaag

SEQ ID NO: 1060662 - RNA, 18 nt, Homo sapiens
ugucccaaacaugcacuu

SEQ ID NO: 1060663 - RNA, 22 nt, Homo sapiens
ugucccaaaccagacaccugga

SEQ ID NO: 1060664 - RNA, 21 nt, Homo sapiens
ugucccacuaucugggugcau

SEQ ID NO: 1060665 - RNA, 18 nt, Homo sapiens
ugucccauuagcaaaaau

SEQ ID NO: 1060666 - RNA, 16 nt, Homo sapiens
uguccccuccacuguc

SEQ ID NO: 1060667 - RNA, 17 nt, Homo sapiens
uguccccuccacuguca

SEQ ID NO: 1060668 - RNA, 23 nt, Homo sapiens
ugucccucaaaugacccaaagac

SEQ ID NO: 1060669 - RNA, 14 nt, Homo sapiens
ugucccucugcuac

SEQ ID NO: 1060670 - RNA, 16 nt, Homo sapiens
ugucccugcacuugca

SEQ ID NO: 1060671 - RNA, 23 nt, Homo sapiens
ugucccuuucuuggccaguuauc

SEQ ID NO: 1060672 - RNA, 17 nt, Homo sapiens
uguccuacccacccucc

SEQ ID NO: 1060673 - RNA, 17 nt, Homo sapiens
uguccuacucuguguca

SEQ ID NO: 1060674 - RNA, 16 nt, Homo sapiens
uguccucaccacaugc

SEQ ID NO: 1060675 - RNA, 17 nt, Homo sapiens
uguccucccuuguggcu

SEQ ID NO: 1060676 - RNA, 22 nt, Homo sapiens
ugucgugaugaaaacuuucuaa

SEQ ID NO: 1060677 - RNA, 20 nt, Homo sapiens
ugucuaacuggggauauaau

SEQ ID NO: 1060678 - RNA, 16 nt, Homo sapiens
ugucuaauaguuauuc

SEQ ID NO: 1060679 - RNA, 18 nt, Homo sapiens
ugucuacguuaccaggca

SEQ ID NO: 1060680 - RNA, 13 nt, Homo sapiens
ugucuauucuugu

SEQ ID NO: 1060681 - RNA, 13 nt, Homo sapiens
ugucucacagccc

SEQ ID NO: 1060682 - RNA, 16 nt, Homo sapiens
ugucucacugaaacau

SEQ ID NO: 1060683 - RNA, 18 nt, Homo sapiens
ugucucagacugcaugua

SEQ ID NO: 1060684 - RNA, 19 nt, Homo sapiens
ugucucaggccacaccggc

SEQ ID NO: 1060685 - RNA, 12 nt, Homo sapiens
ugucucagggug

SEQ ID NO: 1060686 - RNA, 18 nt, Homo sapiens
ugucucccagcucagggc

SEQ ID NO: 1060687 - RNA, 16 nt, Homo sapiens
ugucuccuuaacacug

SEQ ID NO: 1060688 - RNA, 18 nt, Homo sapiens
ugucuccuuaacacugag

SEQ ID NO: 1060689 - RNA, 18 nt, Homo sapiens
ugucuccuuucucuuaug

SEQ ID NO: 1060690 - RNA, 21 nt, Homo sapiens
ugucucggagggauuccccua

SEQ ID NO: 1060691 - RNA, 17 nt, Homo sapiens
ugucucuagccacuuug

SEQ ID NO: 1060692 - RNA, 11 nt, Homo sapiens
ugucucugcau

SEQ ID NO: 1060693 - RNA, 14 nt, Homo sapiens
ugucugacaaccuc

SEQ ID NO: 1060694 - RNA, 21 nt, Homo sapiens
ugucugauuggcucacccaag

SEQ ID NO: 1060695 - RNA, 17 nt, Homo sapiens
ugucugauuuuggccau

SEQ ID NO: 1060696 - RNA, 15 nt, Homo sapiens
ugucugugugcaagu

SEQ ID NO: 1060697 - RNA, 22 nt, Homo sapiens
ugucuuacagagaaaagacaua

SEQ ID NO: 1060698 - RNA, 18 nt, Homo sapiens
ugucuucauagcagauuu

SEQ ID NO: 1060699 - RNA, 20 nt, Homo sapiens
ugucuuccugcauucaccca

SEQ ID NO: 1060700 - RNA, 15 nt, Homo sapiens
ugucuucuuugccca

SEQ ID NO: 1060701 - RNA, 19 nt, Homo sapiens
ugucuuggacacuguacaa

SEQ ID NO: 1060702 - RNA, 22 nt, Homo sapiens
ugucuugggaauuuucuuccaa

SEQ ID NO: 1060703 - RNA, 19 nt, Homo sapiens
ugucuuuauaaucuacucc

SEQ ID NO: 1060704 - RNA, 13 nt, Homo sapiens
ugucuuucacuga

SEQ ID NO: 1060705 - RNA, 19 nt, Homo sapiens
ugucuuucagccaagccaa

SEQ ID NO: 1060706 - RNA, 18 nt, Homo sapiens
ugucuuuguucugugauu

SEQ ID NO: 1060707 - RNA, 23 nt, Homo sapiens
ugugaaacuggauuaaacuuaau

SEQ ID NO: 1060708 - RNA, 23 nt, Homo sapiens
ugugaaaggaagcuccacuguca

SEQ ID NO: 1060709 - RNA, 12 nt, Homo sapiens
ugugaaagucag

SEQ ID NO: 1060710 - RNA, 20 nt, Homo sapiens
ugugaaaguuacaaauugcu

SEQ ID NO: 1060711 - RNA, 17 nt, Homo sapiens
ugugaagaaaggguguu

SEQ ID NO: 1060712 - RNA, 14 nt, Homo sapiens
ugugaaguacauau

SEQ ID NO: 1060713 - RNA, 18 nt, Homo sapiens
ugugaauagaacucugaa

SEQ ID NO: 1060714 - RNA, 14 nt, Homo sapiens
ugugaaugaucucu

SEQ ID NO: 1060715 - RNA, 17 nt, Homo sapiens
ugugaauuagacuugua

SEQ ID NO: 1060716 - RNA, 18 nt, Homo sapiens
ugugacaauggcaacaau

SEQ ID NO: 1060717 - RNA, 13 nt, Homo sapiens
ugugacacauaug

SEQ ID NO: 1060718 - RNA, 18 nt, Homo sapiens
ugugaccaggaaggaagu

SEQ ID NO: 1060719 - RNA, 18 nt, Homo sapiens
ugugaccuuaguguuucu

SEQ ID NO: 1060720 - RNA, 19 nt, Homo sapiens
ugugacuccucaggguuga

SEQ ID NO: 1060721 - RNA, 21 nt, Homo sapiens
ugugacuuaaugccacuaaau

SEQ ID NO: 1060722 - RNA, 20 nt, Homo sapiens
ugugacuucuccaggucuca

SEQ ID NO: 1060723 - RNA, 17 nt, Homo sapiens
ugugaguguaaguguga

SEQ ID NO: 1060724 - RNA, 18 nt, Homo sapiens
ugugagugugugcaagua

SEQ ID NO: 1060725 - RNA, 16 nt, Homo sapiens
ugugauggcaaagaag

SEQ ID NO: 1060726 - RNA, 19 nt, Homo sapiens
ugugaugugcaugggagca

SEQ ID NO: 1060727 - RNA, 14 nt, Homo sapiens
ugugauguguccug

SEQ ID NO: 1060728 - RNA, 17 nt, Homo sapiens
ugugauucacaguguga

SEQ ID NO: 1060729 - RNA, 15 nt, Homo sapiens
ugugcaccuuuacac

SEQ ID NO: 1060730 - RNA, 20 nt, Homo sapiens
ugugcagguuuugaaaaugu

SEQ ID NO: 1060731 - RNA, 23 nt, Homo sapiens
ugugcaguccugggauguggcug

SEQ ID NO: 1060732 - RNA, 21 nt, Homo sapiens
ugugcaguggcccccacagaa

SEQ ID NO: 1060733 - RNA, 17 nt, Homo sapiens
ugugcauauuguacacu

SEQ ID NO: 1060734 - RNA, 17 nt, Homo sapiens
ugugcauguaugucuug

SEQ ID NO: 1060735 - RNA, 16 nt, Homo sapiens
ugugccccaugccugu

SEQ ID NO: 1060736 - RNA, 22 nt, Homo sapiens
gucuuggcucacugcaacuucu

SEQ ID NO: 1060737 - RNA, 14 nt, Homo sapiens
gucuuggcuuucau

SEQ ID NO: 1060738 - RNA, 15 nt, Homo sapiens
gucuuuacagaauca

SEQ ID NO: 1060739 - RNA, 13 nt, Homo sapiens
gucuuucugacau

SEQ ID NO: 1060740 - RNA, 23 nt, Homo sapiens
gucuuugaagugacuucacagag

SEQ ID NO: 1060741 - RNA, 17 nt, Homo sapiens
gucuuuguucugugauu

SEQ ID NO: 1060742 - RNA, 17 nt, Homo sapiens
gucuuuucaucugggaa

SEQ ID NO: 1060743 - RNA, 13 nt, Homo sapiens
gucuuuugaauau

SEQ ID NO: 1060744 - RNA, 17 nt, Homo sapiens
gugaaaauccaucucau

SEQ ID NO: 1060745 - RNA, 17 nt, Homo sapiens
gugaaaccucaucucua

SEQ ID NO: 1060746 - RNA, 15 nt, Homo sapiens
gugaaagaggcagcu

SEQ ID NO: 1060747 - RNA, 19 nt, Homo sapiens
gugaaagcacggacucuua

SEQ ID NO: 1060748 - RNA, 21 nt, Homo sapiens
gugaaagcccagccaucauga

SEQ ID NO: 1060749 - RNA, 20 nt, Homo sapiens
gugaaagcuauaucaaucuc

SEQ ID NO: 1060750 - RNA, 17 nt, Homo sapiens
gugaaaguuaauccacu

SEQ ID NO: 1060751 - RNA, 20 nt, Homo sapiens
gugaaauaagccagacauca

SEQ ID NO: 1060752 - RNA, 14 nt, Homo sapiens
gugaaaugcuggca

SEQ ID NO: 1060753 - RNA, 20 nt, Homo sapiens
gugaaaugcuggcauuugca

SEQ ID NO: 1060754 - RNA, 16 nt, Homo sapiens
gugaaauuacuucugg

SEQ ID NO: 1060755 - RNA, 15 nt, Homo sapiens
gugaacacaucagcu

SEQ ID NO: 1060756 - RNA, 21 nt, Homo sapiens
gugaaccgaggggcucaggaa

SEQ ID NO: 1060757 - RNA, 20 nt, Homo sapiens
gugaacucagccaagcacag

SEQ ID NO: 1060758 - RNA, 18 nt, Homo sapiens
gugaagggagagccagcu

SEQ ID NO: 1060759 - RNA, 16 nt, Homo sapiens
gugaaguauacuguau

SEQ ID NO: 1060760 - RNA, 16 nt, Homo sapiens
gugaauaaaccaucau

SEQ ID NO: 1060761 - RNA, 23 nt, Homo sapiens
gugaauaaaccaucaucuugcca

SEQ ID NO: 1060762 - RNA, 13 nt, Homo sapiens
gugaauuagcuca

SEQ ID NO: 1060763 - RNA, 16 nt, Homo sapiens
gugaauuagcucacuu

SEQ ID NO: 1060764 - RNA, 23 nt, Homo sapiens
gugaauuuuucucuaacucagaa

SEQ ID NO: 1060765 - RNA, 13 nt, Homo sapiens
gugacaacaugcg

SEQ ID NO: 1060766 - RNA, 13 nt, Homo sapiens
gugacacagcagc

SEQ ID NO: 1060767 - RNA, 20 nt, Homo sapiens
gugacagaccacaucuuuau

SEQ ID NO: 1060768 - RNA, 14 nt, Homo sapiens
gugacagugccugg

SEQ ID NO: 1060769 - RNA, 16 nt, Homo sapiens
gugacaucaguggcau

SEQ ID NO: 1060770 - RNA, 17 nt, Homo sapiens
gugacaugugaaaccuu

SEQ ID NO: 1060771 - RNA, 19 nt, Homo sapiens
gugacauuuauuuuucuca

SEQ ID NO: 1060772 - RNA, 17 nt, Homo sapiens
gugacauuuccaugcau

SEQ ID NO: 1060773 - RNA, 23 nt, Homo sapiens
gugaccaacuagacauucugucg

SEQ ID NO: 1060774 - RNA, 21 nt, Homo sapiens
gugaccucugccugaagucac

SEQ ID NO: 1060775 - RNA, 14 nt, Homo sapiens
gugacuaugaacuu

SEQ ID NO: 1060776 - RNA, 19 nt, Homo sapiens
gugacucagaugucucugg

SEQ ID NO: 1060777 - RNA, 21 nt, Homo sapiens
gugacuucuccaggucucacg

SEQ ID NO: 1060778 - RNA, 14 nt, Homo sapiens
gugagaccuggcag

SEQ ID NO: 1060779 - RNA, 14 nt, Homo sapiens
gugagaucaugcca

SEQ ID NO: 1060780 - RNA, 15 nt, Homo sapiens
gugagcacuaaggug

SEQ ID NO: 1060781 - RNA, 21 nt, Homo sapiens
gugagcacuaaggugugcucu

SEQ ID NO: 1060782 - RNA, 16 nt, Homo sapiens
gugagcggagaucgca

SEQ ID NO: 1060783 - RNA, 23 nt, Homo sapiens
gugaggaaagauuuuuguuguua

SEQ ID NO: 1060784 - RNA, 14 nt, Homo sapiens
gugaggcauugcac

SEQ ID NO: 1060785 - RNA, 23 nt, Homo sapiens
gugagggauaguggggucagggc

SEQ ID NO: 1060786 - RNA, 12 nt, Homo sapiens
gugagggguccc

SEQ ID NO: 1060787 - RNA, 16 nt, Homo sapiens
gugagugugugcaagu

SEQ ID NO: 1060788 - RNA, 13 nt, Homo sapiens
gugauccacccac

SEQ ID NO: 1060789 - RNA, 18 nt, Homo sapiens
gugauccacccaccucag

SEQ ID NO: 1060790 - RNA, 16 nt, Homo sapiens
gugaucugaacagaaa

SEQ ID NO: 1060791 - RNA, 14 nt, Homo sapiens
gugaugcccaaaga

SEQ ID NO: 1060792 - RNA, 14 nt, Homo sapiens
guuaaagugaauaa

SEQ ID NO: 1060793 - RNA, 16 nt, Homo sapiens
guuaaccucaguguca

SEQ ID NO: 1060794 - RNA, 23 nt, Homo sapiens
guuaagcauuaccacucaggcau

SEQ ID NO: 1060795 - RNA, 16 nt, Homo sapiens
guuaagugaaugucua

SEQ ID NO: 1060796 - RNA, 14 nt, Homo sapiens
guuaaucacaggau

SEQ ID NO: 1060797 - RNA, 21 nt, Homo sapiens
guuaaucauccaucacuuccc

SEQ ID NO: 1060798 - RNA, 17 nt, Homo sapiens
guuaaucauguauuaaa

SEQ ID NO: 1060799 - RNA, 11 nt, Homo sapiens
guuaaugccau

SEQ ID NO: 1060800 - RNA, 16 nt, Homo sapiens
guuaauuauuuugaca

SEQ ID NO: 1060801 - RNA, 16 nt, Homo sapiens
guuaauucagcacuga

SEQ ID NO: 1060802 - RNA, 12 nt, Homo sapiens
guuacaccagaa

SEQ ID NO: 1060803 - RNA, 16 nt, Homo sapiens
guuacaccagaaccug

SEQ ID NO: 1060804 - RNA, 21 nt, Homo sapiens
guuacagugaugcugugcuau

SEQ ID NO: 1060805 - RNA, 17 nt, Homo sapiens
guuaccaugucacugug

SEQ ID NO: 1060806 - RNA, 15 nt, Homo sapiens
guuaccuacuuugac

SEQ ID NO: 1060807 - RNA, 21 nt, Homo sapiens
guuaccugaaaacacugugca

SEQ ID NO: 1060808 - RNA, 13 nt, Homo sapiens
guuacucaugacu

SEQ ID NO: 1060809 - RNA, 20 nt, Homo sapiens
guuacucuguaaaugaaaaa

SEQ ID NO: 1060810 - RNA, 15 nt, Homo sapiens
guuacugaccagcaa

SEQ ID NO: 1060811 - RNA, 14 nt, Homo sapiens
guuacugucuucag

SEQ ID NO: 1060812 - RNA, 17 nt, Homo sapiens
guuacuuaccacagacu

SEQ ID NO: 1060813 - RNA, 20 nt, Homo sapiens
guuacuugaaauaccaguga

SEQ ID NO: 1060814 - RNA, 21 nt, Homo sapiens
guuacuugaaauaccagugaa

SEQ ID NO: 1060815 - RNA, 21 nt, Homo sapiens
guuagaggccagccuggcgaa

SEQ ID NO: 1060816 - RNA, 23 nt, Homo sapiens
guuaggaaaauuucacauuaaua

SEQ ID NO: 1060817 - RNA, 18 nt, Homo sapiens
guuauaaaucaaugucac

SEQ ID NO: 1060818 - RNA, 19 nt, Homo sapiens
guuauaaaucaaugucacu

SEQ ID NO: 1060819 - RNA, 20 nt, Homo sapiens
guuauaaaucaaugucacuu

SEQ ID NO: 1060820 - RNA, 23 nt, Homo sapiens
guuauaaaucaaugucacuuaaa

SEQ ID NO: 1060821 - RNA, 19 nt, Homo sapiens
guuauagauauguagauaa

SEQ ID NO: 1060822 - RNA, 14 nt, Homo sapiens
guuaugguguuucu

SEQ ID NO: 1060823 - RNA, 16 nt, Homo sapiens
guuauuaacagcugau

SEQ ID NO: 1060824 - RNA, 19 nt, Homo sapiens
guuauuuagggaacugcuu

SEQ ID NO: 1060825 - RNA, 21 nt, Homo sapiens
guuauuuagggaacugcuuga

SEQ ID NO: 1060826 - RNA, 14 nt, Homo sapiens
guuauuuuccauuu

SEQ ID NO: 1060827 - RNA, 18 nt, Homo sapiens
guucaaaaccuugcacag

SEQ ID NO: 1060828 - RNA, 13 nt, Homo sapiens
guucaaugaucua

SEQ ID NO: 1060829 - RNA, 23 nt, Homo sapiens
guucaauucucauuugucacaca

SEQ ID NO: 1060830 - RNA, 12 nt, Homo sapiens
guucaccagccu

SEQ ID NO: 1060831 - RNA, 16 nt, Homo sapiens
guucacucccaaccug

SEQ ID NO: 1060832 - RNA, 16 nt, Homo sapiens
guucagauugcuuuga

SEQ ID NO: 1060833 - RNA, 16 nt, Homo sapiens
guucagggcugugauc

SEQ ID NO: 1060834 - RNA, 21 nt, Homo sapiens
guucaguggcagggcucagga

SEQ ID NO: 1060835 - RNA, 19 nt, Homo sapiens
guucauauuggacugauaa

SEQ ID NO: 1060836 - RNA, 21 nt, Homo sapiens
guuccaccuccccucagacua

SEQ ID NO: 1060837 - RNA, 17 nt, Homo sapiens
guuccagauagcagggc

SEQ ID NO: 1060838 - RNA, 13 nt, Homo sapiens
guuccccacugac

SEQ ID NO: 1060839 - RNA, 13 nt, Homo sapiens
guuccccucugcu

SEQ ID NO: 1060840 - RNA, 16 nt, Homo sapiens
guucccuauuuugcca

SEQ ID NO: 1060841 - RNA, 15 nt, Homo sapiens
guuccuauugucauu

SEQ ID NO: 1060842 - RNA, 18 nt, Homo sapiens
guuccuucacauccugug

SEQ ID NO: 1060843 - RNA, 15 nt, Homo sapiens
guucuacccaggugc

SEQ ID NO: 1060844 - RNA, 22 nt, Homo sapiens
guucuacugagaaaagccucuc

SEQ ID NO: 1060845 - RNA, 21 nt, Homo sapiens
guucuauauaaaaaacauaau

SEQ ID NO: 1060846 - RNA, 21 nt, Homo sapiens
guucucucuuaguaacauaga

SEQ ID NO: 1060847 - RNA, 12 nt, Homo sapiens
guucucuuccac

SEQ ID NO: 1060848 - RNA, 13 nt, Homo sapiens
guucucuuccacu

SEQ ID NO: 1060849 - RNA, 20 nt, Homo sapiens
guucucuucuuuaaagggau

SEQ ID NO: 1060850 - RNA, 21 nt, Homo sapiens
guucucuucuuuaaagggaug

SEQ ID NO: 1060851 - RNA, 15 nt, Homo sapiens
guucugucugugucu

SEQ ID NO: 1060852 - RNA, 13 nt, Homo sapiens
guucuuaguguca

SEQ ID NO: 1060853 - RNA, 14 nt, Homo sapiens
uaaucaagccucug

SEQ ID NO: 1060854 - RNA, 14 nt, Homo sapiens
uaaucaaugaagua

SEQ ID NO: 1060855 - RNA, 21 nt, Homo sapiens
uaaucagugucucacacuggc

SEQ ID NO: 1060856 - RNA, 21 nt, Homo sapiens
uaauccagcgacaauuugaau

SEQ ID NO: 1060857 - RNA, 10 nt, Homo sapiens
uaaucccagc

SEQ ID NO: 1060858 - RNA, 14 nt, Homo sapiens
uaaucccagcacuu

SEQ ID NO: 1060859 - RNA, 15 nt, Homo sapiens
uaaucccagcacuuu

SEQ ID NO: 1060860 - RNA, 20 nt, Homo sapiens
uaaucccagcuacuugggag

SEQ ID NO: 1060861 - RNA, 15 nt, Homo sapiens
uaaucccagcuauuu

SEQ ID NO: 1060862 - RNA, 19 nt, Homo sapiens
uaaucccagcuggccugua

SEQ ID NO: 1060863 - RNA, 23 nt, Homo sapiens
uaaucccgauucacccuguccaa

SEQ ID NO: 1060864 - RNA, 13 nt, Homo sapiens
uaaucucucagcu

SEQ ID NO: 1060865 - RNA, 16 nt, Homo sapiens
uaaucuggacuccucu

SEQ ID NO: 1060866 - RNA, 22 nt, Homo sapiens
uaaugaaauaauguacaucugg

SEQ ID NO: 1060867 - RNA, 14 nt, Homo sapiens
uaaugaacauguga

SEQ ID NO: 1060868 - RNA, 23 nt, Homo sapiens
uaaugaauaaacauuuguagcau

SEQ ID NO: 1060869 - RNA, 13 nt, Homo sapiens
uaaugaaugcaua

SEQ ID NO: 1060870 - RNA, 18 nt, Homo sapiens
uaaugauuguuugucaau

SEQ ID NO: 1060871 - RNA, 19 nt, Homo sapiens
uaaugauuguuugucaaua

SEQ ID NO: 1060872 - RNA, 17 nt, Homo sapiens
uaaugcuacgugugauu

SEQ ID NO: 1060873 - RNA, 20 nt, Homo sapiens
uaaugcuacugucucacuga

SEQ ID NO: 1060874 - RNA, 22 nt, Homo sapiens
uaauggaauauguaaauagaaa

SEQ ID NO: 1060875 - RNA, 14 nt, Homo sapiens
uaauggacuuucag

SEQ ID NO: 1060876 - RNA, 16 nt, Homo sapiens
uaauggccggcuggaa

SEQ ID NO: 1060877 - RNA, 14 nt, Homo sapiens
uaauguacaucugg

SEQ ID NO: 1060878 - RNA, 21 nt, Homo sapiens
uaauguguuuuuaauuaucua

SEQ ID NO: 1060879 - RNA, 20 nt, Homo sapiens
uaauguuaauucagcacuga

SEQ ID NO: 1060880 - RNA, 14 nt, Homo sapiens
uaauguuacugauc

SEQ ID NO: 1060881 - RNA, 22 nt, Homo sapiens
uaauguuguaauucaugccagg

SEQ ID NO: 1060882 - RNA, 18 nt, Homo sapiens
uaauuaaaggagaagauu

SEQ ID NO: 1060883 - RNA, 15 nt, Homo sapiens
uaauuaaaugcucau

SEQ ID NO: 1060884 - RNA, 16 nt, Homo sapiens
uaauuaccaaccuguu

SEQ ID NO: 1060885 - RNA, 14 nt, Homo sapiens
uaauuacuauguca

SEQ ID NO: 1060886 - RNA, 17 nt, Homo sapiens
uaauuagggguugcuaa

SEQ ID NO: 1060887 - RNA, 14 nt, Homo sapiens
uaauucagcacuga

SEQ ID NO: 1060888 - RNA, 13 nt, Homo sapiens
uaauucauggcau

SEQ ID NO: 1060889 - RNA, 14 nt, Homo sapiens
uaauuccaauauga

SEQ ID NO: 1060890 - RNA, 15 nt, Homo sapiens
uaauuccagcacuuu

SEQ ID NO: 1060891 - RNA, 18 nt, Homo sapiens
uaauucucaugugauccu

SEQ ID NO: 1060892 - RNA, 12 nt, Homo sapiens
uaauucugcaga

SEQ ID NO: 1060893 - RNA, 14 nt, Homo sapiens
uaauucugcugucu

SEQ ID NO: 1060894 - RNA, 20 nt, Homo sapiens
uaauucuuauuuaaguuauu

SEQ ID NO: 1060895 - RNA, 21 nt, Homo sapiens
uaauugauuauucugauucca

SEQ ID NO: 1060896 - RNA, 13 nt, Homo sapiens
uaauugauuucaa

SEQ ID NO: 1060897 - RNA, 16 nt, Homo sapiens
uaauugcacgugugua

SEQ ID NO: 1060898 - RNA, 21 nt, Homo sapiens
uaauuuaucuugucucugggc

SEQ ID NO: 1060899 - RNA, 13 nt, Homo sapiens
uaauuucaugaaa

SEQ ID NO: 1060900 - RNA, 17 nt, Homo sapiens
uaauuuccucugacaug

SEQ ID NO: 1060901 - RNA, 17 nt, Homo sapiens
uaauuuccuggugugaa

SEQ ID NO: 1060902 - RNA, 14 nt, Homo sapiens
uacaaaaacacagc

SEQ ID NO: 1060903 - RNA, 16 nt, Homo sapiens
uacaaaaauaccuacu

SEQ ID NO: 1060904 - RNA, 22 nt, Homo sapiens
uacaaaaauaccuacugcugag

SEQ ID NO: 1060905 - RNA, 20 nt, Homo sapiens
uacaaaaugacauuuugcca

SEQ ID NO: 1060906 - RNA, 16 nt, Homo sapiens
uacaacuucagcagua

SEQ ID NO: 1060907 - RNA, 23 nt, Homo sapiens
uacaacuuuuuaccuaguacaag

SEQ ID NO: 1060908 - RNA, 14 nt, Homo sapiens
uacaagaaagcaau

SEQ ID NO: 1060909 - RNA, 14 nt, Homo sapiens
uacaagcgugagcc

SEQ ID NO: 1060910 - RNA, 21 nt, Homo sapiens
uacaagucaucauaauucagc

SEQ ID NO: 1060911 - RNA, 18 nt, Homo sapiens
uacaaucucaaauucuca

SEQ ID NO: 1060912 - RNA, 12 nt, Homo sapiens
uacaauugucau

SEQ ID NO: 1060913 - RNA, 13 nt, Homo sapiens
uacaauuugccau

SEQ ID NO: 1060914 - RNA, 15 nt, Homo sapiens
uacacacuguuguca

SEQ ID NO: 1060915 - RNA, 17 nt, Homo sapiens
uacacagaucacagcuu

SEQ ID NO: 1060916 - RNA, 22 nt, Homo sapiens
uacacaguggccaagcggccau

SEQ ID NO: 1060917 - RNA, 13 nt, Homo sapiens
uacacauacaugu

SEQ ID NO: 1060918 - RNA, 15 nt, Homo sapiens
uacaccccaacagca

SEQ ID NO: 1060919 - RNA, 21 nt, Homo sapiens
uacaccuaacucaccuaacuc

SEQ ID NO: 1060920 - RNA, 18 nt, Homo sapiens
uacacgggacugacgcaa

SEQ ID NO: 1060921 - RNA, 13 nt, Homo sapiens
uacacgugacaga

SEQ ID NO: 1060922 - RNA, 12 nt, Homo sapiens
uacacuaugaag

SEQ ID NO: 1060923 - RNA, 19 nt, Homo sapiens
aagauagguuugagggcau

SEQ ID NO: 1060924 - RNA, 22 nt, Homo sapiens
aagaucaaaauaaaaagugaca

SEQ ID NO: 1060925 - RNA, 18 nt, Homo sapiens
aagauccgagucuaccca

SEQ ID NO: 1060926 - RNA, 23 nt, Homo sapiens
aagauccuaccccaauuccuugu

SEQ ID NO: 1060927 - RNA, 20 nt, Homo sapiens
aagaugcuucucacugccau

SEQ ID NO: 1060928 - RNA, 17 nt, Homo sapiens
aagauggaaaucacauu

SEQ ID NO: 1060929 - RNA, 21 nt, Homo sapiens
aagauggaagcuuccagucca

SEQ ID NO: 1060930 - RNA, 18 nt, Homo sapiens
aagauggcauccugugaa

SEQ ID NO: 1060931 - RNA, 21 nt, Homo sapiens
aagauggcugugccucugccu

SEQ ID NO: 1060932 - RNA, 22 nt, Homo sapiens
aagaugguauauuugguacugu

SEQ ID NO: 1060933 - RNA, 20 nt, Homo sapiens
aagauuauagaaguagcaaa

SEQ ID NO: 1060934 - RNA, 14 nt, Homo sapiens
aagauucaguuuca

SEQ ID NO: 1060935 - RNA, 20 nt, Homo sapiens
aagauucauauuuacuucuu

SEQ ID NO: 1060936 - RNA, 21 nt, Homo sapiens
aagauucauauuuacuucuua

SEQ ID NO: 1060937 - RNA, 20 nt, Homo sapiens
aagauugcgccauugcacuc

SEQ ID NO: 1060938 - RNA, 22 nt, Homo sapiens
aagcaaacacuuacagaauuau

SEQ ID NO: 1060939 - RNA, 18 nt, Homo sapiens
aagcaacagacuucucaa

SEQ ID NO: 1060940 - RNA, 15 nt, Homo sapiens
aagcaagugguggga

SEQ ID NO: 1060941 - RNA, 20 nt, Homo sapiens
aagcaauuauugugccucag

SEQ ID NO: 1060942 - RNA, 19 nt, Homo sapiens
aagcacauaugaacuggac

SEQ ID NO: 1060943 - RNA, 23 nt, Homo sapiens
aagcaccuagccucgcucuuggc

SEQ ID NO: 1060944 - RNA, 12 nt, Homo sapiens
aagcacuugugg

SEQ ID NO: 1060945 - RNA, 15 nt, Homo sapiens
aagcagagcuuccuc

SEQ ID NO: 1060946 - RNA, 18 nt, Homo sapiens
aagcagccaagcuccuug

SEQ ID NO: 1060947 - RNA, 20 nt, Homo sapiens
aagcaguaagcuaucuucaa

SEQ ID NO: 1060948 - RNA, 13 nt, Homo sapiens
aagcauaacuuau

SEQ ID NO: 1060949 - RNA, 16 nt, Homo sapiens
aagcauauuguuauua

SEQ ID NO: 1060950 - RNA, 20 nt, Homo sapiens
aagcaucauuauuugcagag

SEQ ID NO: 1060951 - RNA, 20 nt, Homo sapiens
aagcaucugagcuaacuuau

SEQ ID NO: 1060952 - RNA, 17 nt, Homo sapiens
aagcauuaacuucucug

SEQ ID NO: 1060953 - RNA, 11 nt, Homo sapiens
aagcauuguuu

SEQ ID NO: 1060954 - RNA, 15 nt, Homo sapiens
aagcauuuacuuuga

SEQ ID NO: 1060955 - RNA, 22 nt, Homo sapiens
aagcauuucuagcagugaugaa

SEQ ID NO: 1060956 - RNA, 23 nt, Homo sapiens
aagcauuuuauaaaucgcuuuug

SEQ ID NO: 1060957 - RNA, 21 nt, Homo sapiens
aagccaagucagcuuugccuu

SEQ ID NO: 1060958 - RNA, 19 nt, Homo sapiens
aagccaauaacacacagcu

SEQ ID NO: 1060959 - RNA, 15 nt, Homo sapiens
aagccacacucuggg

SEQ ID NO: 1060960 - RNA, 15 nt, Homo sapiens
aagccacucuuccaa

SEQ ID NO: 1060961 - RNA, 15 nt, Homo sapiens
aagccagugacucca

SEQ ID NO: 1060962 - RNA, 22 nt, Homo sapiens
aagccaucaaacacaaugccuc

SEQ ID NO: 1060963 - RNA, 18 nt, Homo sapiens
aagcccaugaguccuuga

SEQ ID NO: 1060964 - RNA, 18 nt, Homo sapiens
aagcccauucauuccauu

SEQ ID NO: 1060965 - RNA, 16 nt, Homo sapiens
aagcccccccuuccac

SEQ ID NO: 1060966 - RNA, 20 nt, Homo sapiens
aagcccgcggggacauuggg

SEQ ID NO: 1060967 - RNA, 16 nt, Homo sapiens
aagcccuccaaaagca

SEQ ID NO: 1060968 - RNA, 20 nt, Homo sapiens
aagcccuccaaaagcacuua

SEQ ID NO: 1060969 - RNA, 23 nt, Homo sapiens
aagcccuggagccaacugcugcu

SEQ ID NO: 1060970 - RNA, 13 nt, Homo sapiens
aagccgagcucuc

SEQ ID NO: 1060971 - RNA, 20 nt, Homo sapiens
aagccuagcccuucucucau

SEQ ID NO: 1060972 - RNA, 18 nt, Homo sapiens
aagccucagccauucacu

SEQ ID NO: 1060973 - RNA, 22 nt, Homo sapiens
aagccugcagucaucuugacca

SEQ ID NO: 1060974 - RNA, 22 nt, Homo sapiens
aagccuuaucaagugucuucca

SEQ ID NO: 1060975 - RNA, 16 nt, Homo sapiens
aagccuuggauguaua

SEQ ID NO: 1060976 - RNA, 21 nt, Homo sapiens
aagccuuuagagccagcccau

SEQ ID NO: 1060977 - RNA, 18 nt, Homo sapiens
aagccuuuugcucacaaa

SEQ ID NO: 1060978 - RNA, 17 nt, Homo sapiens
aagcgauucuucugccu

SEQ ID NO: 1060979 - RNA, 15 nt, Homo sapiens
aagcguaauuuugcc

SEQ ID NO: 1060980 - RNA, 17 nt, Homo sapiens
aagcgugagccacugca

SEQ ID NO: 1060981 - RNA, 18 nt, Homo sapiens
aagcgugagccacugcac

SEQ ID NO: 1060982 - RNA, 20 nt, Homo sapiens
aagcuaaaauuagaugaacu

SEQ ID NO: 1060983 - RNA, 14 nt, Homo sapiens
aagcucauccauuu

SEQ ID NO: 1060984 - RNA, 18 nt, Homo sapiens
aagcucaucucagcuccu

SEQ ID NO: 1060985 - RNA, 12 nt, Homo sapiens
aagcuccacugu

SEQ ID NO: 1060986 - RNA, 12 nt, Homo sapiens
aagcuccuagca

SEQ ID NO: 1060987 - RNA, 23 nt, Homo sapiens
aagcucugcuccucuccccagca

SEQ ID NO: 1060988 - RNA, 21 nt, Homo sapiens
aagcucuggugacaccagccu

SEQ ID NO: 1060989 - RNA, 17 nt, Homo sapiens
aagcugaauccagauca

SEQ ID NO: 1060990 - RNA, 20 nt, Homo sapiens
aagcugagcaccaggggaug

SEQ ID NO: 1060991 - RNA, 17 nt, Homo sapiens
aagcugccugcuuuuca

SEQ ID NO: 1060992 - RNA, 23 nt, Homo sapiens
aagcugcucagggaaaagcagcu

SEQ ID NO: 1060993 - RNA, 22 nt, Homo sapiens
aagcugugaaagaaccaaaaga

SEQ ID NO: 1060994 - RNA, 19 nt, Homo sapiens
aagcuguuuccauagggug

SEQ ID NO: 1060995 - RNA, 16 nt, Homo sapiens
aagcuuccauaguggu

SEQ ID NO: 1060996 - RNA, 22 nt, Homo sapiens
aagcuuccauuccaagccugac

SEQ ID NO: 1060997 - RNA, 22 nt, Homo sapiens
aagcuuucauguaaacugugca

SEQ ID NO: 1060998 - RNA, 14 nt, Homo sapiens
aaggaaacuccuga

SEQ ID NO: 1060999 - RNA, 22 nt, Homo sapiens
aaggaaacuguacuacaucuag

SEQ ID NO: 1061000 - RNA, 16 nt, Homo sapiens
aaggaagcuccacugu

SEQ ID NO: 1061001 - RNA, 14 nt, Homo sapiens
aaggaauccacucc

SEQ ID NO: 1061002 - RNA, 19 nt, Homo sapiens
aaggaauuggcauguguau

SEQ ID NO: 1061003 - RNA, 15 nt, Homo sapiens
aaggacacagaugaa

SEQ ID NO: 1061004 - RNA, 19 nt, Homo sapiens
aaggacagaguaugaacac

SEQ ID NO: 1061005 - RNA, 18 nt, Homo sapiens
aaggacuccacccauccu

SEQ ID NO: 1061006 - RNA, 20 nt, Homo sapiens
aaggacucuccaaauagcau

SEQ ID NO: 1061007 - RNA, 23 nt, Homo sapiens
aaggacuuuccuuccuccaucuc

SEQ ID NO: 1061008 - RNA, 21 nt, Homo sapiens
aaggacuuucugaagccucac

SEQ ID NO: 1061009 - RNA, 17 nt, Homo sapiens
aaggagaacuauccaaa

SEQ ID NO: 1061010 - RNA, 16 nt, Homo sapiens
aaggagcucacugugg

SEQ ID NO: 1061011 - RNA, 19 nt, Homo sapiens
aaggagggagcuacucuca

SEQ ID NO: 1061012 - RNA, 18 nt, Homo sapiens
aaggagggugagugcaag

SEQ ID NO: 1061013 - RNA, 16 nt, Homo sapiens
aaggaguaaucugugu

SEQ ID NO: 1061014 - RNA, 14 nt, Homo sapiens
aaggauacuuuaca

SEQ ID NO: 1061015 - RNA, 21 nt, Homo sapiens
aaggauauaaaaggcaaauac

SEQ ID NO: 1061016 - RNA, 17 nt, Homo sapiens
aaggauaugcaguaugc

SEQ ID NO: 1061017 - RNA, 15 nt, Homo sapiens
aaggaucucucagga

SEQ ID NO: 1061018 - RNA, 16 nt, Homo sapiens
aaggaugagcauuuag

SEQ ID NO: 1061019 - RNA, 19 nt, Homo sapiens
aaggaugaucuaggaagac

SEQ ID NO: 1061020 - RNA, 18 nt, Homo sapiens
aaggauggagccagcucu

SEQ ID NO: 1061021 - RNA, 23 nt, Homo sapiens
aaggauggagccagcucugcauu

SEQ ID NO: 1061022 - RNA, 14 nt, Homo sapiens
aaggcaaauacaau

SEQ ID NO: 1061023 - RNA, 17 nt, Homo sapiens
aaggcaccugaaugugu

SEQ ID NO: 1061024 - RNA, 18 nt, Homo sapiens
aaggcacuaaaaagagcu

SEQ ID NO: 1061025 - RNA, 16 nt, Homo sapiens
aaggcagccaccagcg

SEQ ID NO: 1061026 - RNA, 17 nt, Homo sapiens
aaggcaggugccuccag

SEQ ID NO: 1061027 - RNA, 15 nt, Homo sapiens
aaggcauuucuauca

SEQ ID NO: 1061028 - RNA, 15 nt, Homo sapiens
aaggccacaugucac

SEQ ID NO: 1061029 - RNA, 18 nt, Homo sapiens
aaggcccauaucugugaa

SEQ ID NO: 1061030 - RNA, 17 nt, Homo sapiens
aaggccgagaagcaaga

SEQ ID NO: 1061031 - RNA, 13 nt, Homo sapiens
aaggccucugugg

SEQ ID NO: 1061032 - RNA, 19 nt, Homo sapiens
aaggcggguggaucacuug

SEQ ID NO: 1061033 - RNA, 20 nt, Homo sapiens
aaggcggguggaucacuuga

SEQ ID NO: 1061034 - RNA, 20 nt, Homo sapiens
aaggcguggagcugccugau

SEQ ID NO: 1061035 - RNA, 17 nt, Homo sapiens
aaggcucagucucagga

SEQ ID NO: 1061036 - RNA, 15 nt, Homo sapiens
aaggcucccuguccu

SEQ ID NO: 1061037 - RNA, 22 nt, Homo sapiens
aaggcucugagcaaauguggcu

SEQ ID NO: 1061038 - RNA, 12 nt, Homo sapiens
aaggcugaccaa

SEQ ID NO: 1061039 - RNA, 18 nt, Homo sapiens
aaggcugagaacacugug

SEQ ID NO: 1061040 - RNA, 14 nt, Homo sapiens
aaggcugagcucuu

SEQ ID NO: 1061041 - RNA, 23 nt, Homo sapiens
aaggcuuacacccacaguggaaa

SEQ ID NO: 1061042 - RNA, 13 nt, Homo sapiens
aaggcuuggcaca

SEQ ID NO: 1061043 - RNA, 19 nt, Homo sapiens
aagggaauguaacugcuga

SEQ ID NO: 1061044 - RNA, 14 nt, Homo sapiens
aagggagaaaauaa

SEQ ID NO: 1061045 - RNA, 18 nt, Homo sapiens
aagggaugucucacaucc

SEQ ID NO: 1061046 - RNA, 21 nt, Homo sapiens
aagggcaaaauucccagggaa

SEQ ID NO: 1061047 - RNA, 18 nt, Homo sapiens
aagggcagcuccacaggg

SEQ ID NO: 1061048 - RNA, 9 nt, Homo sapiens
aagggccag

SEQ ID NO: 1061049 - RNA, 22 nt, Homo sapiens
aagggccagcuggaggugaaga

SEQ ID NO: 1061050 - RNA, 22 nt, Homo sapiens
aagggcccagauucuaccacac

SEQ ID NO: 1061051 - RNA, 19 nt, Homo sapiens
aagggcuuggacucaagca

SEQ ID NO: 1061052 - RNA, 23 nt, Homo sapiens
aaggggccucaccgagugggggc

SEQ ID NO: 1061053 - RNA, 13 nt, Homo sapiens
aagggguucucac

SEQ ID NO: 1061054 - RNA, 21 nt, Homo sapiens
aaggguuauagacugccaugc

SEQ ID NO: 1061055 - RNA, 22 nt, Homo sapiens
aagguaccccgauggccaagca

SEQ ID NO: 1061056 - RNA, 18 nt, Homo sapiens
aaggucacauugugccuu

SEQ ID NO: 1061057 - RNA, 22 nt, Homo sapiens
aaggucggaccagcuuuuccca

SEQ ID NO: 1061058 - RNA, 15 nt, Homo sapiens
aaggucuucagccau

SEQ ID NO: 1061059 - RNA, 15 nt, Homo sapiens
aaggugaccuugcaa

SEQ ID NO: 1061060 - RNA, 22 nt, Homo sapiens
aagguggauuuucaucaggggc

SEQ ID NO: 1061061 - RNA, 21 nt, Homo sapiens
aagguggggauugcccaucca

SEQ ID NO: 1061062 - RNA, 13 nt, Homo sapiens
aaggugucuuccu

SEQ ID NO: 1061063 - RNA, 15 nt, Homo sapiens
aagguucacucucaa

SEQ ID NO: 1061064 - RNA, 17 nt, Homo sapiens
aagguuccaacuggaaa

SEQ ID NO: 1061065 - RNA, 22 nt, Homo sapiens
aagguuccaacuggaaacccuu

SEQ ID NO: 1061066 - RNA, 14 nt, Homo sapiens
aagguucccagaga

SEQ ID NO: 1061067 - RNA, 14 nt, Homo sapiens
aagguucucugugc

SEQ ID NO: 1061068 - RNA, 18 nt, Homo sapiens
aagguuugagaagcacug

SEQ ID NO: 1061069 - RNA, 12 nt, Homo sapiens
aaguaaaaccac

SEQ ID NO: 1061070 - RNA, 13 nt, Homo sapiens
aaguaaaaccaca

SEQ ID NO: 1061071 - RNA, 15 nt, Homo sapiens
aaguaacauuugccu

SEQ ID NO: 1061072 - RNA, 16 nt, Homo sapiens
aaguaaccauuugcac

SEQ ID NO: 1061073 - RNA, 15 nt, Homo sapiens
aaguaaguaccacuc

SEQ ID NO: 1061074 - RNA, 18 nt, Homo sapiens
aaguaauccaccugccuc

SEQ ID NO: 1061075 - RNA, 20 nt, Homo sapiens
aaguaauuccucucacuaaa

SEQ ID NO: 1061076 - RNA, 24 nt, Homo sapiens
aaguaauuccuguauucuacagca

SEQ ID NO: 1061077 - RNA, 14 nt, Homo sapiens
aaguaauugugaaa

SEQ ID NO: 1061078 - RNA, 12 nt, Homo sapiens
aaguacauguau

SEQ ID NO: 1061079 - RNA, 18 nt, Homo sapiens
aaguacuucuccacccug

SEQ ID NO: 1061080 - RNA, 20 nt, Homo sapiens
aaguagcaaaaaguauugaa

SEQ ID NO: 1061081 - RNA, 23 nt, Homo sapiens
aaguaggcaggaccaugggacca

SEQ ID NO: 1061082 - RNA, 14 nt, Homo sapiens
aaguagggacuucu

SEQ ID NO: 1061083 - RNA, 18 nt, Homo sapiens
aaguagggacuucugucu

SEQ ID NO: 1061084 - RNA, 18 nt, Homo sapiens
aaguagguuuacauucau

SEQ ID NO: 1061085 - RNA, 15 nt, Homo sapiens
aaguagugugcaguu

SEQ ID NO: 1061086 - RNA, 17 nt, Homo sapiens
aaguaucccuacuguaa

SEQ ID NO: 1061087 - RNA, 12 nt, Homo sapiens
aaguauuagcca

SEQ ID NO: 1061088 - RNA, 19 nt, Homo sapiens
aagucaaaugugugcuuug

SEQ ID NO: 1061089 - RNA, 14 nt, Homo sapiens
aagucaaccugccu

SEQ ID NO: 1061090 - RNA, 15 nt, Homo sapiens
aagucaccuccuuaa

SEQ ID NO: 1061091 - RNA, 15 nt, Homo sapiens
aagucagaaagugca

SEQ ID NO: 1061092 - RNA, 22 nt, Homo sapiens
aagucagugcccaacuguuaua

SEQ ID NO: 1061093 - RNA, 16 nt, Homo sapiens
aagucauaccaaugaa

SEQ ID NO: 1061094 - RNA, 20 nt, Homo sapiens
aagucaugaagcccaaguga

SEQ ID NO: 1061095 - RNA, 17 nt, Homo sapiens
aagucaugugcauuucc

SEQ ID NO: 1061096 - RNA, 18 nt, Homo sapiens
aagucauuuuaacuuuau

SEQ ID NO: 1061097 - RNA, 15 nt, Homo sapiens
aaguccaauuccaaa

SEQ ID NO: 1061098 - RNA, 16 nt, Homo sapiens
aaguccagauuuacac

SEQ ID NO: 1061099 - RNA, 20 nt, Homo sapiens
aaguccagauuuacacuggg

SEQ ID NO: 1061100 - RNA, 22 nt, Homo sapiens
aaguccagauuuacacugggag

SEQ ID NO: 1061101 - RNA, 19 nt, Homo sapiens
aaguccccgaguuucccca

SEQ ID NO: 1061102 - RNA, 19 nt, Homo sapiens
aaguccuacaagcuaaaau

SEQ ID NO: 1061103 - RNA, 17 nt, Homo sapiens
aaguccuucaccucacu

SEQ ID NO: 1061104 - RNA, 13 nt, Homo sapiens
aaguccuuuaugu

SEQ ID NO: 1061105 - RNA, 13 nt, Homo sapiens
aagucuccaguca

SEQ ID NO: 1061106 - RNA, 14 nt, Homo sapiens
aagucucuuuauau

SEQ ID NO: 1061107 - RNA, 16 nt, Homo sapiens
aagucuuagacuugaa

SEQ ID NO: 1061108 - RNA, 17 nt, Homo sapiens
aagucuuauuuccucaa

SEQ ID NO: 1061109 - RNA, 22 nt, Homo sapiens
aagucuuccauagagacuuugu

SEQ ID NO: 1061110 - RNA, 21 nt, Homo sapiens
aagucuuugguaaauggcaaa

SEQ ID NO: 1061111 - RNA, 13 nt, Homo sapiens
aagugaacuauga

SEQ ID NO: 1061112 - RNA, 14 nt, Homo sapiens
aagugaacuaugaa

SEQ ID NO: 1061113 - RNA, 13 nt, Homo sapiens
aagugacacagca

SEQ ID NO: 1061114 - RNA, 13 nt, Homo sapiens
aagugacuauuca

SEQ ID NO: 1061115 - RNA, 13 nt, Homo sapiens
aagugacucucac

SEQ ID NO: 1061116 - RNA, 19 nt, Homo sapiens
aagugagacuccgucacaa

SEQ ID NO: 1061117 - RNA, 22 nt, Homo sapiens
aagugauaucccccagccucaa

SEQ ID NO: 1061118 - RNA, 16 nt, Homo sapiens
aagugcaaauuugaua

SEQ ID NO: 1061119 - RNA, 17 nt, Homo sapiens
aagugcagucugaucca

SEQ ID NO: 1061120 - RNA, 17 nt, Homo sapiens
aagugccacucauuccu

SEQ ID NO: 1061121 - RNA, 20 nt, Homo sapiens
aagugcugcgauuacaggca

SEQ ID NO: 1061122 - RNA, 13 nt, Homo sapiens
aagugggugaaug

SEQ ID NO: 1061123 - RNA, 20 nt, Homo sapiens
aaguggucgcuuacuuugag

SEQ ID NO: 1061124 - RNA, 15 nt, Homo sapiens
aaguguaaauccuuu

SEQ ID NO: 1061125 - RNA, 22 nt, Homo sapiens
aaguguaagaaacacacugagg

SEQ ID NO: 1061126 - RNA, 21 nt, Homo sapiens
aaguguaugcacgugugcaca

SEQ ID NO: 1061127 - RNA, 21 nt, Homo sapiens
aaguguccccuauggggaugg

SEQ ID NO: 1061128 - RNA, 15 nt, Homo sapiens
aagugugugaucugu

SEQ ID NO: 1061129 - RNA, 13 nt, Homo sapiens
aagugugugcaca

SEQ ID NO: 1061130 - RNA, 13 nt, Homo sapiens
aaguguguuuccu

SEQ ID NO: 1061131 - RNA, 11 nt, Homo sapiens
aaguguuccag

SEQ ID NO: 1061132 - RNA, 15 nt, Homo sapiens
aaguguuucuguuau

SEQ ID NO: 1061133 - RNA, 15 nt, Homo sapiens
aaguuacagcuguga

SEQ ID NO: 1061134 - RNA, 19 nt, Homo sapiens
aaguuagggaugacuguga

SEQ ID NO: 1061135 - RNA, 18 nt, Homo sapiens
aaguuauacuguggcuau

SEQ ID NO: 1061136 - RNA, 22 nt, Homo sapiens
aaguuauacuguggcuaugcaa

SEQ ID NO: 1061137 - RNA, 20 nt, Homo sapiens
aaguuaucagacacucuggc

SEQ ID NO: 1061138 - RNA, 16 nt, Homo sapiens
aaguuauugauguuuu

SEQ ID NO: 1061139 - RNA, 13 nt, Homo sapiens
aaguucaagagaa

SEQ ID NO: 1061140 - RNA, 22 nt, Homo sapiens
aaguucccuacuuccugugacu

SEQ ID NO: 1061141 - RNA, 20 nt, Homo sapiens
aaguugaagcuaagauuuag

SEQ ID NO: 1061142 - RNA, 14 nt, Homo sapiens
aaguugacaccuuu

SEQ ID NO: 1061143 - RNA, 14 nt, Homo sapiens
aaguugcuaauaca

SEQ ID NO: 1061144 - RNA, 14 nt, Homo sapiens
aaguuggcuucuaa

SEQ ID NO: 1061145 - RNA, 13 nt, Homo sapiens
aaguuguuugcau

SEQ ID NO: 1061146 - RNA, 19 nt, Homo sapiens
aaguuuaugcauacaguaa

SEQ ID NO: 1061147 - RNA, 21 nt, Homo sapiens
aaguuucacuccggagugaga

SEQ ID NO: 1061148 - RNA, 23 nt, Homo sapiens
aaguuuucagaaccucuucccca

SEQ ID NO: 1061149 - RNA, 20 nt, Homo sapiens
aaguuuuucagaaagcauua

SEQ ID NO: 1061150 - RNA, 14 nt, Homo sapiens
aauaaaaacugacu

SEQ ID NO: 1061151 - RNA, 14 nt, Homo sapiens
aauaaaaaugcacg

SEQ ID NO: 1061152 - RNA, 17 nt, Homo sapiens
aauaaaaggucggacca

SEQ ID NO: 1061153 - RNA, 13 nt, Homo sapiens
aauaaaauaauuc

SEQ ID NO: 1061154 - RNA, 22 nt, Homo sapiens
aauaaaaugaaguggugagcuu

SEQ ID NO: 1061155 - RNA, 16 nt, Homo sapiens
aauaaaaugagcaaaa

SEQ ID NO: 1061156 - RNA, 23 nt, Homo sapiens
aauaaaauuuaacucacacugcc

SEQ ID NO: 1061157 - RNA, 15 nt, Homo sapiens
aauaaacccuuccug

SEQ ID NO: 1061158 - RNA, 17 nt, Homo sapiens
aauaaacucaaugagcu

SEQ ID NO: 1061159 - RNA, 17 nt, Homo sapiens
aauaaagaaauugcaau

SEQ ID NO: 1061160 - RNA, 16 nt, Homo sapiens
aauaaagcaacagacu

SEQ ID NO: 1061161 - RNA, 16 nt, Homo sapiens
aauaaauaaaugcaau

SEQ ID NO: 1061162 - RNA, 14 nt, Homo sapiens
aauaaauaucugua

SEQ ID NO: 1061163 - RNA, 15 nt, Homo sapiens
aauaaauucauacau

SEQ ID NO: 1061164 - RNA, 13 nt, Homo sapiens
aauaacauguaau

SEQ ID NO: 1061165 - RNA, 20 nt, Homo sapiens
aauaauaagaggugcuacug

SEQ ID NO: 1061166 - RNA, 19 nt, Homo sapiens
aauaauacaccagagauaa

SEQ ID NO: 1061167 - RNA, 20 nt, Homo sapiens
aauaauacaguaucucaggg

SEQ ID NO: 1061168 - RNA, 18 nt, Homo sapiens
aauaauaugcugccaaau

SEQ ID NO: 1061169 - RNA, 18 nt, Homo sapiens
aauaaucauucuuauuuc

SEQ ID NO: 1061170 - RNA, 13 nt, Homo sapiens
aauaauccagaaa

SEQ ID NO: 1061171 - RNA, 18 nt, Homo sapiens
aauaaugcacuuccuuac

SEQ ID NO: 1061172 - RNA, 16 nt, Homo sapiens
aauaauguguacauua

SEQ ID NO: 1061173 - RNA, 15 nt, Homo sapiens
aauaauugauuucaa

SEQ ID NO: 1061174 - RNA, 15 nt, Homo sapiens
aauaauuguuccaaa

SEQ ID NO: 1061175 - RNA, 18 nt, Homo sapiens
aauacaauaaguuaacua

SEQ ID NO: 1061176 - RNA, 21 nt, Homo sapiens
aauacaauagagccacuaaga

SEQ ID NO: 1061177 - RNA, 17 nt, Homo sapiens
aauacaauuagccaggu

SEQ ID NO: 1061178 - RNA, 17 nt, Homo sapiens
aauacacacucaaauca

SEQ ID NO: 1061179 - RNA, 16 nt, Homo sapiens
aauacacuaauuccuu

SEQ ID NO: 1061180 - RNA, 21 nt, Homo sapiens
aauacagacuacuucuucccc

SEQ ID NO: 1061181 - RNA, 24 nt, Homo sapiens
aauacagcagugucaucagaagau

SEQ ID NO: 1061182 - RNA, 20 nt, Homo sapiens
aauacauaaaguaugugcau

SEQ ID NO: 1061183 - RNA, 15 nt, Homo sapiens
aauacauaagaccau

SEQ ID NO: 1061184 - RNA, 15 nt, Homo sapiens
aauacauauuuccaa

SEQ ID NO: 1061185 - RNA, 21 nt, Homo sapiens
aauacaugaaaugucuggucu

SEQ ID NO: 1061186 - RNA, 15 nt, Homo sapiens
aauaccuacugcuga

SEQ ID NO: 1061187 - RNA, 20 nt, Homo sapiens
aauaccugcccugacaugca

SEQ ID NO: 1061188 - RNA, 20 nt, Homo sapiens
aauacugauguuccuaguga

SEQ ID NO: 1061189 - RNA, 21 nt, Homo sapiens
aauacugcagagggacagaug

SEQ ID NO: 1061190 - RNA, 14 nt, Homo sapiens
aauacuguguuuca

SEQ ID NO: 1061191 - RNA, 18 nt, Homo sapiens
aauacuucucaaaccugu

SEQ ID NO: 1061192 - RNA, 16 nt, Homo sapiens
aauagaaccacuauga

SEQ ID NO: 1061193 - RNA, 22 nt, Homo sapiens
aauagaaggauguacauuucca

SEQ ID NO: 1061194 - RNA, 21 nt, Homo sapiens
aauagaauauaauuaucggaa

SEQ ID NO: 1061195 - RNA, 13 nt, Homo sapiens
aauagccauaaag

SEQ ID NO: 1061196 - RNA, 15 nt, Homo sapiens
aauagccucccugua

SEQ ID NO: 1061197 - RNA, 18 nt, Homo sapiens
aauagcuauauccaugua

SEQ ID NO: 1061198 - RNA, 21 nt, Homo sapiens
aauagcugggacuacaggugu

SEQ ID NO: 1061199 - RNA, 23 nt, Homo sapiens
aauagcugggacuacagguguga

SEQ ID NO: 1061200 - RNA, 24 nt, Homo sapiens
aauaggagaggaugagagcccaga

SEQ ID NO: 1061201 - RNA, 16 nt, Homo sapiens
aauagggaaguaacag

SEQ ID NO: 1061202 - RNA, 19 nt, Homo sapiens
aauagggaaguaacaguaa

SEQ ID NO: 1061203 - RNA, 23 nt, Homo sapiens
aauaguaaaagauaacaagaucu

SEQ ID NO: 1061204 - RNA, 12 nt, Homo sapiens
aauaguauuuau

SEQ ID NO: 1061205 - RNA, 15 nt, Homo sapiens
aauagugauuuccac

SEQ ID NO: 1061206 - RNA, 19 nt, Homo sapiens
aauaguucccuagucuauu

SEQ ID NO: 1061207 - RNA, 16 nt, Homo sapiens
aauauaaaaguaaaua

SEQ ID NO: 1061208 - RNA, 13 nt, Homo sapiens
aauauaauacugu

SEQ ID NO: 1061209 - RNA, 14 nt, Homo sapiens
aauauacauucaaa

SEQ ID NO: 1061210 - RNA, 18 nt, Homo sapiens
aauauacauucaaacuua

SEQ ID NO: 1061211 - RNA, 12 nt, Homo sapiens
aauauacuguaa

SEQ ID NO: 1061212 - RNA, 18 nt, Homo sapiens
aauauaguaccugaaaaa

SEQ ID NO: 1061213 - RNA, 19 nt, Homo sapiens
aauauagugacuaugaacu

SEQ ID NO: 1061214 - RNA, 15 nt, Homo sapiens
aauauauuuuaucug

SEQ ID NO: 1061215 - RNA, 22 nt, Homo sapiens
aauaucacaucacuuaacugau

SEQ ID NO: 1061216 - RNA, 15 nt, Homo sapiens
aauaucaugcuccau

SEQ ID NO: 1061217 - RNA, 19 nt, Homo sapiens
aauaucugggauucuacuu

SEQ ID NO: 1061218 - RNA, 18 nt, Homo sapiens
aauaugagauaaugcagu

SEQ ID NO: 1061219 - RNA, 16 nt, Homo sapiens
agauuccgcaccaaua

SEQ ID NO: 1061220 - RNA, 17 nt, Homo sapiens
agauuccgcaccaauaa

SEQ ID NO: 1061221 - RNA, 16 nt, Homo sapiens
agauucuccugugcua

SEQ ID NO: 1061222 - RNA, 13 nt, Homo sapiens
agauugauacuuu

SEQ ID NO: 1061223 - RNA, 18 nt, Homo sapiens
agauuuacacugggagag

SEQ ID NO: 1061224 - RNA, 14 nt, Homo sapiens
agauuucagaucau

SEQ ID NO: 1061225 - RNA, 15 nt, Homo sapiens
agauuuuaugcugcu

SEQ ID NO: 1061226 - RNA, 20 nt, Homo sapiens
agauuuugcaaucuguguuc

SEQ ID NO: 1061227 - RNA, 16 nt, Homo sapiens
agcaaaaaguauugaa

SEQ ID NO: 1061228 - RNA, 13 nt, Homo sapiens
agcaaaaccaaau

SEQ ID NO: 1061229 - RNA, 17 nt, Homo sapiens
agcaaaacgcauggagu

SEQ ID NO: 1061230 - RNA, 17 nt, Homo sapiens
agcaaaacuccaucuca

SEQ ID NO: 1061231 - RNA, 20 nt, Homo sapiens
agcaaaauacaugacauuua

SEQ ID NO: 1061232 - RNA, 14 nt, Homo sapiens
agcaaaaugugaua

SEQ ID NO: 1061233 - RNA, 15 nt, Homo sapiens
agcaaacacauuaag

SEQ ID NO: 1061234 - RNA, 15 nt, Homo sapiens
agcaaaggcugagaa

SEQ ID NO: 1061235 - RNA, 13 nt, Homo sapiens
agcaaagggcuca

SEQ ID NO: 1061236 - RNA, 20 nt, Homo sapiens
agcaaauaauuuccuggugu

SEQ ID NO: 1061237 - RNA, 20 nt, Homo sapiens
agcaaaugcuauuugauaac

SEQ ID NO: 1061238 - RNA, 18 nt, Homo sapiens
agcaaauguuaugcauaa

SEQ ID NO: 1061239 - RNA, 21 nt, Homo sapiens
agcaacacucuauauuuagau

SEQ ID NO: 1061240 - RNA, 19 nt, Homo sapiens
agcaaccuccacauguuca

SEQ ID NO: 1061241 - RNA, 17 nt, Homo sapiens
agcaagcucccaaggga

SEQ ID NO: 1061242 - RNA, 21 nt, Homo sapiens
agcaagugcuggagucgggac

SEQ ID NO: 1061243 - RNA, 15 nt, Homo sapiens
agcaauaaaaugcua

SEQ ID NO: 1061244 - RNA, 16 nt, Homo sapiens
agcaauaugcauuuaa

SEQ ID NO: 1061245 - RNA, 20 nt, Homo sapiens
agcaaucucggcucauugaa

SEQ ID NO: 1061246 - RNA, 18 nt, Homo sapiens
agcaaugacaucucaggg

SEQ ID NO: 1061247 - RNA, 14 nt, Homo sapiens
agcaaugauuacuc

SEQ ID NO: 1061248 - RNA, 18 nt, Homo sapiens
agcaauuccucugaacaa

SEQ ID NO: 1061249 - RNA, 24 nt, Homo sapiens
agcaauuuaauauuuugcacaguu

SEQ ID NO: 1061250 - RNA, 13 nt, Homo sapiens
agcacacuguagc

SEQ ID NO: 1061251 - RNA, 11 nt, Homo sapiens
agcacaggugg

SEQ ID NO: 1061252 - RNA, 14 nt, Homo sapiens
agcaccagggacua

SEQ ID NO: 1061253 - RNA, 16 nt, Homo sapiens
agcaccccucucugca

SEQ ID NO: 1061254 - RNA, 19 nt, Homo sapiens
agcaccccugucucuagcc

SEQ ID NO: 1061255 - RNA, 14 nt, Homo sapiens
agcacccucuccag

SEQ ID NO: 1061256 - RNA, 19 nt, Homo sapiens
agcacccucuccagaugag

SEQ ID NO: 1061257 - RNA, 16 nt, Homo sapiens
agcacccugcaaaaug

SEQ ID NO: 1061258 - RNA, 19 nt, Homo sapiens
agcaccuacaguguacagu

SEQ ID NO: 1061259 - RNA, 18 nt, Homo sapiens
agcaccuuagacaguccc

SEQ ID NO: 1061260 - RNA, 21 nt, Homo sapiens
agcaccuuagacagucccugc

SEQ ID NO: 1061261 - RNA, 22 nt, Homo sapiens
agcaccuucccucucaccaucc

SEQ ID NO: 1061262 - RNA, 17 nt, Homo sapiens
agcacuaaagcagugga

SEQ ID NO: 1061263 - RNA, 17 nt, Homo sapiens
agcacuacauaaacuga

SEQ ID NO: 1061264 - RNA, 21 nt, Homo sapiens
agcacucccaagucuacagag

SEQ ID NO: 1061265 - RNA, 17 nt, Homo sapiens
agcacugagcaaagcau

SEQ ID NO: 1061266 - RNA, 15 nt, Homo sapiens
agcacuguccaguau

SEQ ID NO: 1061267 - RNA, 15 nt, Homo sapiens
agcacuuuggacaug

SEQ ID NO: 1061268 - RNA, 22 nt, Homo sapiens
agcagaaaucuagaagacuguc

SEQ ID NO: 1061269 - RNA, 23 nt, Homo sapiens
agcagaaaucuagaagacuguca

SEQ ID NO: 1061270 - RNA, 15 nt, Homo sapiens
agcagaacugaaccg

SEQ ID NO: 1061271 - RNA, 15 nt, Homo sapiens
agcagagaacuggaa

SEQ ID NO: 1061272 - RNA, 16 nt, Homo sapiens
agcagaggcacugggg

SEQ ID NO: 1061273 - RNA, 21 nt, Homo sapiens
agcagaugagaaacucuugag

SEQ ID NO: 1061274 - RNA, 19 nt, Homo sapiens
agcuaagaaauaaaacugu

SEQ ID NO: 1061275 - RNA, 18 nt, Homo sapiens
agcuaagccacauggcug

SEQ ID NO: 1061276 - RNA, 19 nt, Homo sapiens
agcuacacagaucacagcu

SEQ ID NO: 1061277 - RNA, 13 nt, Homo sapiens
agcuaccaggugu

SEQ ID NO: 1061278 - RNA, 14 nt, Homo sapiens
agcuaccagguguu

SEQ ID NO: 1061279 - RNA, 16 nt, Homo sapiens
agcuaccucaaacuuc

SEQ ID NO: 1061280 - RNA, 20 nt, Homo sapiens
agcuaccucacuaugcugcu

SEQ ID NO: 1061281 - RNA, 19 nt, Homo sapiens
agcuacucagaagccugag

SEQ ID NO: 1061282 - RNA, 19 nt, Homo sapiens
agcuagaggaaccaacccc

SEQ ID NO: 1061283 - RNA, 20 nt, Homo sapiens
agcuaucucucagugaacug

SEQ ID NO: 1061284 - RNA, 23 nt, Homo sapiens
agcuaucucucagugaacuguga

SEQ ID NO: 1061285 - RNA, 24 nt, Homo sapiens
agcuauuuaaaaaaaaaagaggaa

SEQ ID NO: 1061286 - RNA, 14 nt, Homo sapiens
agcuauuuccauuc

SEQ ID NO: 1061287 - RNA, 21 nt, Homo sapiens
agcucaagucuucccugauca

SEQ ID NO: 1061288 - RNA, 10 nt, Homo sapiens
agcucaccag

SEQ ID NO: 1061289 - RNA, 14 nt, Homo sapiens
agcucacccacccc

SEQ ID NO: 1061290 - RNA, 16 nt, Homo sapiens
agcucaccucucccuu

SEQ ID NO: 1061291 - RNA, 17 nt, Homo sapiens
agcucacuacccuauuc

SEQ ID NO: 1061292 - RNA, 20 nt, Homo sapiens
agcucacuguggugucugug

SEQ ID NO: 1061293 - RNA, 14 nt, Homo sapiens
agcucacuguucua

SEQ ID NO: 1061294 - RNA, 16 nt, Homo sapiens
agcucagcgccagccu

SEQ ID NO: 1061295 - RNA, 15 nt, Homo sapiens
agcucaggcacacuu

SEQ ID NO: 1061296 - RNA, 22 nt, Homo sapiens
agcucaggugucccugcacuug

SEQ ID NO: 1061297 - RNA, 12 nt, Homo sapiens
agcucaguuuau

SEQ ID NO: 1061298 - RNA, 12 nt, Homo sapiens
agcucaucucag

SEQ ID NO: 1061299 - RNA, 15 nt, Homo sapiens
agcucauuucacuuu

SEQ ID NO: 1061300 - RNA, 21 nt, Homo sapiens
agcucccaagggauggugccc

SEQ ID NO: 1061301 - RNA, 12 nt, Homo sapiens
agcucccaugua

SEQ ID NO: 1061302 - RNA, 16 nt, Homo sapiens
agcucccauuucuacu

SEQ ID NO: 1061303 - RNA, 19 nt, Homo sapiens
agcucccauuucuacucuc

SEQ ID NO: 1061304 - RNA, 19 nt, Homo sapiens
agcuccccauuacccucag

SEQ ID NO: 1061305 - RNA, 17 nt, Homo sapiens
agcuccgccucccgggu

SEQ ID NO: 1061306 - RNA, 19 nt, Homo sapiens
agcuccucgagggcaggga

SEQ ID NO: 1061307 - RNA, 16 nt, Homo sapiens
agcuccuucaaugcaa

SEQ ID NO: 1061308 - RNA, 22 nt, Homo sapiens
agcucuccccucagagugcaag

SEQ ID NO: 1061309 - RNA, 15 nt, Homo sapiens
agcucugccuguuag

SEQ ID NO: 1061310 - RNA, 19 nt, Homo sapiens
agcucugcuccucucccca

SEQ ID NO: 1061311 - RNA, 15 nt, Homo sapiens
agcucuggcuuccag

SEQ ID NO: 1061312 - RNA, 17 nt, Homo sapiens
agcucuuccgaaaacca

SEQ ID NO: 1061313 - RNA, 18 nt, Homo sapiens
agcucuugaagacacuga

SEQ ID NO: 1061314 - RNA, 20 nt, Homo sapiens
agcucuuggcuccacuggga

SEQ ID NO: 1061315 - RNA, 19 nt, Homo sapiens
agcugagaaaacuaaguca

SEQ ID NO: 1061316 - RNA, 20 nt, Homo sapiens
agcugagaaaacuaagucag

SEQ ID NO: 1061317 - RNA, 16 nt, Homo sapiens
agcugagggcauugcu

SEQ ID NO: 1061318 - RNA, 14 nt, Homo sapiens
agcugaguguagug

SEQ ID NO: 1061319 - RNA, 23 nt, Homo sapiens
agcugauacaaauugcagacugu

SEQ ID NO: 1061320 - RNA, 21 nt, Homo sapiens
agcugauugggcaccugacca

SEQ ID NO: 1061321 - RNA, 13 nt, Homo sapiens
agcugcacccuca

SEQ ID NO: 1061322 - RNA, 13 nt, Homo sapiens
agcugccugguau

SEQ ID NO: 1061323 - RNA, 18 nt, Homo sapiens
agcugcgccugcgcugca

SEQ ID NO: 1061324 - RNA, 11 nt, Homo sapiens
agcugcucagg

SEQ ID NO: 1061325 - RNA, 16 nt, Homo sapiens
agcugcucccaaauaa

SEQ ID NO: 1061326 - RNA, 18 nt, Homo sapiens
agcugcugcuggaucaca

SEQ ID NO: 1061327 - RNA, 22 nt, Homo sapiens
agcuggaagggucaacaucuuu

SEQ ID NO: 1061328 - RNA, 23 nt, Homo sapiens
agcuggaagggucaacaucuuuu

SEQ ID NO: 1061329 - RNA, 17 nt, Homo sapiens
agcuggaugugguggca

SEQ ID NO: 1061330 - RNA, 14 nt, Homo sapiens
agcuggcaaaggug

SEQ ID NO: 1061331 - RNA, 19 nt, Homo sapiens
agcuggcaaagguggcucu

SEQ ID NO: 1061332 - RNA, 15 nt, Homo sapiens
agcuggccuguaauc

SEQ ID NO: 1061333 - RNA, 20 nt, Homo sapiens
agcuggcuuuucccauuuca

SEQ ID NO: 1061334 - RNA, 17 nt, Homo sapiens
agcugggauaaucacau

SEQ ID NO: 1061335 - RNA, 17 nt, Homo sapiens
agcuggguguguuggca

SEQ ID NO: 1061336 - RNA, 15 nt, Homo sapiens
agcuggugagugaug

SEQ ID NO: 1061337 - RNA, 19 nt, Homo sapiens
agcuggugguuucacggug

SEQ ID NO: 1061338 - RNA, 19 nt, Homo sapiens
agcugguugggaagacaug

SEQ ID NO: 1061339 - RNA, 17 nt, Homo sapiens
agcuguauuuugaugau

SEQ ID NO: 1061340 - RNA, 23 nt, Homo sapiens
agcuguauuuugaugauugcuau

SEQ ID NO: 1061341 - RNA, 15 nt, Homo sapiens
agcugucauaaaaag

SEQ ID NO: 1061342 - RNA, 17 nt, Homo sapiens
agcuguccccugaccca

SEQ ID NO: 1061343 - RNA, 19 nt, Homo sapiens
agcugucccucacuguuga

SEQ ID NO: 1061344 - RNA, 13 nt, Homo sapiens
agcugucugcuca

SEQ ID NO: 1061345 - RNA, 20 nt, Homo sapiens
agcuguuuaugcauagauaa

SEQ ID NO: 1061346 - RNA, 16 nt, Homo sapiens
agcuguuuucccugac

SEQ ID NO: 1061347 - RNA, 14 nt, Homo sapiens
agcuucaaacugca

SEQ ID NO: 1061348 - RNA, 20 nt, Homo sapiens
agcuucaccagagcauuucc

SEQ ID NO: 1061349 - RNA, 12 nt, Homo sapiens
agcuuccaugag

SEQ ID NO: 1061350 - RNA, 16 nt, Homo sapiens
agcuuccgccgucuca

SEQ ID NO: 1061351 - RNA, 21 nt, Homo sapiens
agcuucuauuagccagucuuu

SEQ ID NO: 1061352 - RNA, 14 nt, Homo sapiens
agcuucucaauuuc

SEQ ID NO: 1061353 - RNA, 18 nt, Homo sapiens
agcuucugggaccauaag

SEQ ID NO: 1061354 - RNA, 21 nt, Homo sapiens
agcuucuuaaaugagaaggaa

SEQ ID NO: 1061355 - RNA, 17 nt, Homo sapiens
auucugcaagcuuuuca

SEQ ID NO: 1061356 - RNA, 18 nt, Homo sapiens
auucugcugaugcuacug

SEQ ID NO: 1061357 - RNA, 17 nt, Homo sapiens
auucuggaaaagcaaaa

SEQ ID NO: 1061358 - RNA, 18 nt, Homo sapiens
auucuguuggccagugug

SEQ ID NO: 1061359 - RNA, 14 nt, Homo sapiens
auucuuaaauucau

SEQ ID NO: 1061360 - RNA, 20 nt, Homo sapiens
auucuucaaccucauugaca

SEQ ID NO: 1061361 - RNA, 13 nt, Homo sapiens
auucuuccugcuu

SEQ ID NO: 1061362 - RNA, 13 nt, Homo sapiens
auucuucugcuuc

SEQ ID NO: 1061363 - RNA, 12 nt, Homo sapiens
auucuucuguac

SEQ ID NO: 1061364 - RNA, 19 nt, Homo sapiens
auucuuguauauuauggaa

SEQ ID NO: 1061365 - RNA, 22 nt, Homo sapiens
auucuuugaccucaaccuguga

SEQ ID NO: 1061366 - RNA, 15 nt, Homo sapiens
auucuuugaccuguu

SEQ ID NO: 1061367 - RNA, 14 nt, Homo sapiens
auugaaaauaugau

SEQ ID NO: 1061368 - RNA, 17 nt, Homo sapiens
auugaaagcuuuuguua

SEQ ID NO: 1061369 - RNA, 19 nt, Homo sapiens
auugaaagggaguauuaca

SEQ ID NO: 1061370 - RNA, 21 nt, Homo sapiens
auugaaagggaguauuacaaa

SEQ ID NO: 1061371 - RNA, 18 nt, Homo sapiens
auugaaauguuugcauaa

SEQ ID NO: 1061372 - RNA, 22 nt, Homo sapiens
auugaacuuucacauagcacag

SEQ ID NO: 1061373 - RNA, 21 nt, Homo sapiens
auugaauguuuccaaccugga

SEQ ID NO: 1061374 - RNA, 17 nt, Homo sapiens
auugaccuuugcacgaa

SEQ ID NO: 1061375 - RNA, 12 nt, Homo sapiens
auugacucugca

SEQ ID NO: 1061376 - RNA, 18 nt, Homo sapiens
caacagaaucagaucuga

SEQ ID NO: 1061377 - RNA, 13 nt, Homo sapiens
caacagagcaaga

SEQ ID NO: 1061378 - RNA, 16 nt, Homo sapiens
caacagauuauuaccu

SEQ ID NO: 1061379 - RNA, 11 nt, Homo sapiens
caacagcacuu

SEQ ID NO: 1061380 - RNA, 18 nt, Homo sapiens
caacagugagucugucag

SEQ ID NO: 1061381 - RNA, 12 nt, Homo sapiens
caacaguuccuu

SEQ ID NO: 1061382 - RNA, 20 nt, Homo sapiens
caacaucacaccauugcacu

SEQ ID NO: 1061383 - RNA, 16 nt, Homo sapiens
caacauccuuaaguca

SEQ ID NO: 1061384 - RNA, 16 nt, Homo sapiens
caacauguguacuuaa

SEQ ID NO: 1061385 - RNA, 14 nt, Homo sapiens
caaugcauugcuaa

SEQ ID NO: 1061386 - RNA, 23 nt, Homo sapiens
caaugccaaaaaaagacagggcu

SEQ ID NO: 1061387 - RNA, 11 nt, Homo sapiens
cccuuuuccau

SEQ ID NO: 1061388 - RNA, 19 nt, Homo sapiens
cccuuuuucuccagcuggg

SEQ ID NO: 1061389 - RNA, 18 nt, Homo sapiens
ccgaaaaggauaugcagu

SEQ ID NO: 1061390 - RNA, 13 nt, Homo sapiens
ccgaaaucagaag

SEQ ID NO: 1061391 - RNA, 14 nt, Homo sapiens
ccgaccacaccaga

SEQ ID NO: 1061392 - RNA, 17 nt, Homo sapiens
ccgacuccucaaaagca

SEQ ID NO: 1061393 - RNA, 19 nt, Homo sapiens
ccgacuuuccauugauuca

SEQ ID NO: 1061394 - RNA, 15 nt, Homo sapiens
ccgagaagccagugc

SEQ ID NO: 1061395 - RNA, 20 nt, Homo sapiens
ccgagcugggggccaugagc

SEQ ID NO: 1061396 - RNA, 18 nt, Homo sapiens
ccgagucugucucuguca

SEQ ID NO: 1061397 - RNA, 21 nt, Homo sapiens
ccgauaucaaaaagacugugg

SEQ ID NO: 1061398 - RNA, 23 nt, Homo sapiens
ccgcaacaguuuuuuaugcuaau

SEQ ID NO: 1061399 - RNA, 17 nt, Homo sapiens
ccgccagcgaacuugac

SEQ ID NO: 1061400 - RNA, 14 nt, Homo sapiens
ccgcucuggaccaa

SEQ ID NO: 1061401 - RNA, 23 nt, Homo sapiens
ccgcucuugggaaauaugucaaa

SEQ ID NO: 1061402 - RNA, 19 nt, Homo sapiens
ccggccaggccaccuccag

SEQ ID NO: 1061403 - RNA, 13 nt, Homo sapiens
ccggccauucucc

SEQ ID NO: 1061404 - RNA, 23 nt, Homo sapiens
ccggcgaaauaaaaucagaguug

SEQ ID NO: 1061405 - RNA, 12 nt, Homo sapiens
ccggcucugcac

SEQ ID NO: 1061406 - RNA, 12 nt, Homo sapiens
ccggcucuuucc

SEQ ID NO: 1061407 - RNA, 17 nt, Homo sapiens
ccgggaaaagggaacca

SEQ ID NO: 1061408 - RNA, 18 nt, Homo sapiens
ccgggaacaaaaugaugu

SEQ ID NO: 1061409 - RNA, 20 nt, Homo sapiens
ccgggaagagggugauugcu

SEQ ID NO: 1061410 - RNA, 21 nt, Homo sapiens
ccgggugggcggcacagccuu

SEQ ID NO: 1061411 - RNA, 17 nt, Homo sapiens
ccggucaugguggugca

SEQ ID NO: 1061412 - RNA, 19 nt, Homo sapiens
ccggucuaaagugagcucu

SEQ ID NO: 1061413 - RNA, 12 nt, Homo sapiens
ccguacauucaa

SEQ ID NO: 1061414 - RNA, 16 nt, Homo sapiens
ccguaccccacccuca

SEQ ID NO: 1061415 - RNA, 12 nt, Homo sapiens
ccguagauuccc

SEQ ID NO: 1061416 - RNA, 23 nt, Homo sapiens
ccgucagccaaauguaauugaau

SEQ ID NO: 1061417 - RNA, 13 nt, Homo sapiens
ccguccacagggc

SEQ ID NO: 1061418 - RNA, 17 nt, Homo sapiens
ccgucgaggggcucuca

SEQ ID NO: 1061419 - RNA, 15 nt, Homo sapiens
ccguuaaaaaaucaa

SEQ ID NO: 1061420 - RNA, 20 nt, Homo sapiens
ccguuauuauaauuguauca

SEQ ID NO: 1061421 - RNA, 18 nt, Homo sapiens
ccuaaaacaaaagcucau

SEQ ID NO: 1061422 - RNA, 16 nt, Homo sapiens
ccuaaaagcacacuca

SEQ ID NO: 1061423 - RNA, 17 nt, Homo sapiens
ccuaaaagcacacucau

SEQ ID NO: 1061424 - RNA, 18 nt, Homo sapiens
ccuaaaauggugauaucc

SEQ ID NO: 1061425 - RNA, 17 nt, Homo sapiens
ccuaaacuguacaugug

SEQ ID NO: 1061426 - RNA, 22 nt, Homo sapiens
ccuaaaucugccuuuucaucua

SEQ ID NO: 1061427 - RNA, 22 nt, Homo sapiens
ccuaagcccuccgccauucuca

SEQ ID NO: 1061428 - RNA, 23 nt, Homo sapiens
ccuaaggucauuaccacaggcca

SEQ ID NO: 1061429 - RNA, 22 nt, Homo sapiens
ccuaauaaacauccuucaagaa

SEQ ID NO: 1061430 - RNA, 23 nt, Homo sapiens
ccuaaugaaggaguucacuguaa

SEQ ID NO: 1061431 - RNA, 17 nt, Homo sapiens
ccuaauuccacacccuc

SEQ ID NO: 1061432 - RNA, 23 nt, Homo sapiens
ccuacaguugaaaaacagcugag

SEQ ID NO: 1061433 - RNA, 16 nt, Homo sapiens
ccuacaugacacaguu

SEQ ID NO: 1061434 - RNA, 21 nt, Homo sapiens
ccuacccccuaagagccauuu

SEQ ID NO: 1061435 - RNA, 13 nt, Homo sapiens
ccuacccuuccag

SEQ ID NO: 1061436 - RNA, 15 nt, Homo sapiens
ccuaccuucauuuca

SEQ ID NO: 1061437 - RNA, 17 nt, Homo sapiens
ccuacugcaucgaguca

SEQ ID NO: 1061438 - RNA, 19 nt, Homo sapiens
ccuacuuuucuuuccucag

SEQ ID NO: 1061439 - RNA, 20 nt, Homo sapiens
ccuacuuuucuuuccucaga

SEQ ID NO: 1061440 - RNA, 23 nt, Homo sapiens
ccuagaagggcuagaaccuggag

SEQ ID NO: 1061441 - RNA, 16 nt, Homo sapiens
ccuagauucuacauau

SEQ ID NO: 1061442 - RNA, 19 nt, Homo sapiens
ccuagcaccuggcuaguuu

SEQ ID NO: 1061443 - RNA, 20 nt, Homo sapiens
ccuagcacuuugggaggcca

SEQ ID NO: 1061444 - RNA, 19 nt, Homo sapiens
ccuagccagcacuuguaua

SEQ ID NO: 1061445 - RNA, 16 nt, Homo sapiens
ccuagcccuucucuca

SEQ ID NO: 1061446 - RNA, 22 nt, Homo sapiens
ccuagcugggaaggugaccaca

SEQ ID NO: 1061447 - RNA, 22 nt, Homo sapiens
ccuagcuuagagccucccucaa

SEQ ID NO: 1061448 - RNA, 17 nt, Homo sapiens
ccuaggauaucuucucc

SEQ ID NO: 1061449 - RNA, 18 nt, Homo sapiens
ccuagggccugguccaug

SEQ ID NO: 1061450 - RNA, 17 nt, Homo sapiens
ccugagcagugccagcu

SEQ ID NO: 1061451 - RNA, 18 nt, Homo sapiens
ccugaggcuccugugcua

SEQ ID NO: 1061452 - RNA, 11 nt, Homo sapiens
ccugaggucag

SEQ ID NO: 1061453 - RNA, 15 nt, Homo sapiens
ccugagguuugccag

SEQ ID NO: 1061454 - RNA, 20 nt, Homo sapiens
ccugauaacaaccuggagac

SEQ ID NO: 1061455 - RNA, 13 nt, Homo sapiens
ccugcaauuccac

SEQ ID NO: 1061456 - RNA, 17 nt, Homo sapiens
ccugcaccccugcaguu

SEQ ID NO: 1061457 - RNA, 21 nt, Homo sapiens
ccugcaguuauuaacacuaac

SEQ ID NO: 1061458 - RNA, 16 nt, Homo sapiens
ccugcauucacccaga

SEQ ID NO: 1061459 - RNA, 18 nt, Homo sapiens
ccugccaccagucacugu

SEQ ID NO: 1061460 - RNA, 21 nt, Homo sapiens
ccugccaggauuaaaagccau

SEQ ID NO: 1061461 - RNA, 18 nt, Homo sapiens
ccugccaggcacacugag

SEQ ID NO: 1061462 - RNA, 12 nt, Homo sapiens
ccugccaggcag

SEQ ID NO: 1061463 - RNA, 22 nt, Homo sapiens
ccugccccaaacaaauaugcaa

SEQ ID NO: 1061464 - RNA, 16 nt, Homo sapiens
ccugcccuagcuccac

SEQ ID NO: 1061465 - RNA, 21 nt, Homo sapiens
ccugccugcaucugugaaaag

SEQ ID NO: 1061466 - RNA, 14 nt, Homo sapiens
ccugccuggacugu

SEQ ID NO: 1061467 - RNA, 18 nt, Homo sapiens
ccugccugucugaagcca

SEQ ID NO: 1061468 - RNA, 23 nt, Homo sapiens
ccugcgcccaccccgcucugcau

SEQ ID NO: 1061469 - RNA, 23 nt, Homo sapiens
ccugcgcgcaugugcgcacacac

SEQ ID NO: 1061470 - RNA, 20 nt, Homo sapiens
ccugcugacaauuucccaca

SEQ ID NO: 1061471 - RNA, 23 nt, Homo sapiens
ccugcugcaucuucccacagugg

SEQ ID NO: 1061472 - RNA, 21 nt, Homo sapiens
ccugcugcuguguuuuugcua

SEQ ID NO: 1061473 - RNA, 23 nt, Homo sapiens
ccugcugucgucuuagcaagaag

SEQ ID NO: 1061474 - RNA, 15 nt, Homo sapiens
ccugcuuaaugaaaa

SEQ ID NO: 1061475 - RNA, 11 nt, Homo sapiens
ccugcuugcaa

SEQ ID NO: 1061476 - RNA, 17 nt, Homo sapiens
ccugcuugcaaauccac

SEQ ID NO: 1061477 - RNA, 22 nt, Homo sapiens
ccugcuuggguggagaagccau

SEQ ID NO: 1061478 - RNA, 18 nt, Homo sapiens
ccugcuuuacuuugccca

SEQ ID NO: 1061479 - RNA, 20 nt, Homo sapiens
ccuggaaagaaaaagcaaua

SEQ ID NO: 1061480 - RNA, 16 nt, Homo sapiens
ccuggacacucagacc

SEQ ID NO: 1061481 - RNA, 22 nt, Homo sapiens
ccuggacaguuuucugcuuuaa

SEQ ID NO: 1061482 - RNA, 17 nt, Homo sapiens
ccuggagaguucaaugg

SEQ ID NO: 1061483 - RNA, 19 nt, Homo sapiens
ccuggagcccauccagucu

SEQ ID NO: 1061484 - RNA, 16 nt, Homo sapiens
ccuggaucuaccagca

SEQ ID NO: 1061485 - RNA, 17 nt, Homo sapiens
ccuggaucuaccagcau

SEQ ID NO: 1061486 - RNA, 14 nt, Homo sapiens
ccuggaucuccuca

SEQ ID NO: 1061487 - RNA, 22 nt, Homo sapiens
ccuggcagccacaacugcaguc

SEQ ID NO: 1061488 - RNA, 23 nt, Homo sapiens
ccuggcauuauguccacugugua

SEQ ID NO: 1061489 - RNA, 16 nt, Homo sapiens
ccuggccaaagggaua

SEQ ID NO: 1061490 - RNA, 17 nt, Homo sapiens
ccuggccaggagcucuu

SEQ ID NO: 1061491 - RNA, 21 nt, Homo sapiens
ccuggccaggcugcacacauu

SEQ ID NO: 1061492 - RNA, 15 nt, Homo sapiens
ccuggccgaugguac

SEQ ID NO: 1061493 - RNA, 18 nt, Homo sapiens
ccuggccuggcacacauc

SEQ ID NO: 1061494 - RNA, 14 nt, Homo sapiens
ccuggcucaucucu

SEQ ID NO: 1061495 - RNA, 21 nt, Homo sapiens
ccuggcuccaacacugcugcu

SEQ ID NO: 1061496 - RNA, 20 nt, Homo sapiens
ccuggcugaaggacugugac

SEQ ID NO: 1061497 - RNA, 12 nt, Homo sapiens
ccuggcuggcau

SEQ ID NO: 1061498 - RNA, 21 nt, Homo sapiens
ccuggcuggcauggaggguga

SEQ ID NO: 1061499 - RNA, 17 nt, Homo sapiens
ccugggaccuccccuga

SEQ ID NO: 1061500 - RNA, 18 nt, Homo sapiens
ccugggaggaaauuugaa

SEQ ID NO: 1061501 - RNA, 22 nt, Homo sapiens
ccugggaucugcucgucaucau

SEQ ID NO: 1061502 - RNA, 15 nt, Homo sapiens
ccugggauguccaca

SEQ ID NO: 1061503 - RNA, 14 nt, Homo sapiens
ccugggcaauguga

SEQ ID NO: 1061504 - RNA, 16 nt, Homo sapiens
ccugggcccuuccuau

SEQ ID NO: 1061505 - RNA, 18 nt, Homo sapiens
ccuggggaagcugugaaa

SEQ ID NO: 1061506 - RNA, 18 nt, Homo sapiens
ccuggggagccagggcua

SEQ ID NO: 1061507 - RNA, 16 nt, Homo sapiens
ccugggggugccagga

SEQ ID NO: 1061508 - RNA, 17 nt, Homo sapiens
ccuggucaacaugguga

SEQ ID NO: 1061509 - RNA, 19 nt, Homo sapiens
ccuggucaacauggugaaa

SEQ ID NO: 1061510 - RNA, 13 nt, Homo sapiens
ccugguccaugau

SEQ ID NO: 1061511 - RNA, 18 nt, Homo sapiens
ccuggucccuuggagaca

SEQ ID NO: 1061512 - RNA, 15 nt, Homo sapiens
ccuggugauguguuu

SEQ ID NO: 1061513 - RNA, 15 nt, Homo sapiens
ccuggugcugcugcu

SEQ ID NO: 1061514 - RNA, 15 nt, Homo sapiens
ccugguggucaggga

SEQ ID NO: 1061515 - RNA, 15 nt, Homo sapiens
ccugguucugaugau

SEQ ID NO: 1061516 - RNA, 12 nt, Homo sapiens
ccuguaacacaa

SEQ ID NO: 1061517 - RNA, 18 nt, Homo sapiens
ccuguaaucccagcacuu

SEQ ID NO: 1061518 - RNA, 15 nt, Homo sapiens
ccuguaaucccagcu

SEQ ID NO: 1061519 - RNA, 16 nt, Homo sapiens
ccuuuccauaaggaau

SEQ ID NO: 1061520 - RNA, 19 nt, Homo sapiens
ccuuuccuuccaucccuac

SEQ ID NO: 1061521 - RNA, 14 nt, Homo sapiens
ccuuucucauccca

SEQ ID NO: 1061522 - RNA, 19 nt, Homo sapiens
ccuuucucuaaaacugccu

SEQ ID NO: 1061523 - RNA, 15 nt, Homo sapiens
ccuuugagacaguuu

SEQ ID NO: 1061524 - RNA, 21 nt, Homo sapiens
ccuuugagcccacaaagccuu

SEQ ID NO: 1061525 - RNA, 23 nt, Homo sapiens
ccuuuggagcuuuuuucuuuaag

SEQ ID NO: 1061526 - RNA, 14 nt, Homo sapiens
ccuuugucaucauu

SEQ ID NO: 1061527 - RNA, 13 nt, Homo sapiens
ccuuuguugcaca

SEQ ID NO: 1061528 - RNA, 17 nt, Homo sapiens
ccuuuuacauacugcug

SEQ ID NO: 1061529 - RNA, 13 nt, Homo sapiens
ccuuuuuaaggaa

SEQ ID NO: 1061530 - RNA, 23 nt, Homo sapiens
ccuuuuuaaggaaggcacuaaaa

SEQ ID NO: 1061531 - RNA, 14 nt, Homo sapiens
ccuuuuuuaaggaa

SEQ ID NO: 1061532 - RNA, 14 nt, Homo sapiens
cgaaaaccaucaca

SEQ ID NO: 1061533 - RNA, 15 nt, Homo sapiens
cgaaaaggauaugca

SEQ ID NO: 1061534 - RNA, 15 nt, Homo sapiens
cgaaaaguugguguc

SEQ ID NO: 1061535 - RNA, 20 nt, Homo sapiens
cgaaaccccaucucuacuaa

SEQ ID NO: 1061536 - RNA, 20 nt, Homo sapiens
cgaaauaacaauguuaagga

SEQ ID NO: 1061537 - RNA, 18 nt, Homo sapiens
cgaaugguuccauucucu

SEQ ID NO: 1061538 - RNA, 18 nt, Homo sapiens
cgaccgcccccuccucua

SEQ ID NO: 1061539 - RNA, 17 nt, Homo sapiens
cgagacuccgucucaaa

SEQ ID NO: 1061540 - RNA, 20 nt, Homo sapiens
cgagaggugguuacaccaga

SEQ ID NO: 1061541 - RNA, 21 nt, Homo sapiens
cgagaucgcgccacugcacuc

SEQ ID NO: 1061542 - RNA, 20 nt, Homo sapiens
cgagauugcaccacugcacu

SEQ ID NO: 1061543 - RNA, 15 nt, Homo sapiens
cgagcagaugaugcc

SEQ ID NO: 1061544 - RNA, 17 nt, Homo sapiens
cgagcagaugaugccaa

SEQ ID NO: 1061545 - RNA, 21 nt, Homo sapiens
cgagcaugccuggauggggcu

SEQ ID NO: 1061546 - RNA, 15 nt, Homo sapiens
cgagccuggcuccaa

SEQ ID NO: 1061547 - RNA, 14 nt, Homo sapiens
cgaggaaacucaga

SEQ ID NO: 1061548 - RNA, 21 nt, Homo sapiens
cgaggacauucucugaccuac

SEQ ID NO: 1061549 - RNA, 13 nt, Homo sapiens
cgaggggcgcgau

SEQ ID NO: 1061550 - RNA, 18 nt, Homo sapiens
cgagggucaggacuguga

SEQ ID NO: 1061551 - RNA, 20 nt, Homo sapiens
cgaucuggguucacugcaac

SEQ ID NO: 1061552 - RNA, 21 nt, Homo sapiens
cgaucuuccucacaccacaaa

SEQ ID NO: 1061553 - RNA, 17 nt, Homo sapiens
cgaugcagugcuuccaa

SEQ ID NO: 1061554 - RNA, 12 nt, Homo sapiens
cgauguaugcag

SEQ ID NO: 1061555 - RNA, 19 nt, Homo sapiens
cgauugcaggagucccugc

SEQ ID NO: 1061556 - RNA, 14 nt, Homo sapiens
cgcaaauucgcaaa

SEQ ID NO: 1061557 - RNA, 13 nt, Homo sapiens
cgcaacaguuuuu

SEQ ID NO: 1061558 - RNA, 21 nt, Homo sapiens
cgcacaaggcugaccaagaga

SEQ ID NO: 1061559 - RNA, 18 nt, Homo sapiens
cgcaccaauaaagccuuc

SEQ ID NO: 1061560 - RNA, 18 nt, Homo sapiens
cgcagauguccuugaugc

SEQ ID NO: 1061561 - RNA, 16 nt, Homo sapiens
cgcagggguugcagug

SEQ ID NO: 1061562 - RNA, 15 nt, Homo sapiens
cgcaucaaaagacaa

SEQ ID NO: 1061563 - RNA, 16 nt, Homo sapiens
cgcaucaggccuggca

SEQ ID NO: 1061564 - RNA, 11 nt, Homo sapiens
cgcaugugcag

SEQ ID NO: 1061565 - RNA, 16 nt, Homo sapiens
cgcaugugcagcuauu

SEQ ID NO: 1061566 - RNA, 16 nt, Homo sapiens
cgccaagcaaccuggg

SEQ ID NO: 1061567 - RNA, 23 nt, Homo sapiens
cgccagauucuuuccugaggcug

SEQ ID NO: 1061568 - RNA, 20 nt, Homo sapiens
cgcccaggcuggagugcaau

SEQ ID NO: 1061569 - RNA, 20 nt, Homo sapiens
cgcccaggcuggagugcagu

SEQ ID NO: 1061570 - RNA, 21 nt, Homo sapiens
cgcccaugugugagugugugc

SEQ ID NO: 1061571 - RNA, 19 nt, Homo sapiens
cgccccucaccaacccaga

SEQ ID NO: 1061572 - RNA, 20 nt, Homo sapiens
cgccuccccuuugugacuuc

SEQ ID NO: 1061573 - RNA, 21 nt, Homo sapiens
cgccugcccgucucucuccca

SEQ ID NO: 1061574 - RNA, 19 nt, Homo sapiens
cgcuagacgcuucauccca

SEQ ID NO: 1061575 - RNA, 16 nt, Homo sapiens
cgcuagaguucuccag

SEQ ID NO: 1061576 - RNA, 22 nt, Homo sapiens
cgcucuuggcagguacucagcg

SEQ ID NO: 1061577 - RNA, 22 nt, Homo sapiens
cgcugagcgaggagaugcuccu

SEQ ID NO: 1061578 - RNA, 22 nt, Homo sapiens
cgcugggauccgggaucaaagu

SEQ ID NO: 1061579 - RNA, 18 nt, Homo sapiens
cgcugugucagcauagaa

SEQ ID NO: 1061580 - RNA, 11 nt, Homo sapiens
cggaagccaaa

SEQ ID NO: 1061581 - RNA, 19 nt, Homo sapiens
cggaagcccuugccugaaa

SEQ ID NO: 1061582 - RNA, 14 nt, Homo sapiens
cggacaaguuuuaa

SEQ ID NO: 1061583 - RNA, 20 nt, Homo sapiens
cggagcuugcagugagccga

SEQ ID NO: 1061584 - RNA, 15 nt, Homo sapiens
cggaggccacaugag

SEQ ID NO: 1061585 - RNA, 16 nt, Homo sapiens
cggaguucaguuuuac

SEQ ID NO: 1061586 - RNA, 14 nt, Homo sapiens
cggaucucuggagu

SEQ ID NO: 1061587 - RNA, 13 nt, Homo sapiens
cggcacagccuuc

SEQ ID NO: 1061588 - RNA, 18 nt, Homo sapiens
cggcucaugccuguaauc

SEQ ID NO: 1061589 - RNA, 14 nt, Homo sapiens
cgggagacucugaa

SEQ ID NO: 1061590 - RNA, 14 nt, Homo sapiens
cgggagcugcacua

SEQ ID NO: 1061591 - RNA, 19 nt, Homo sapiens
cgggcacucagaagacacu

SEQ ID NO: 1061592 - RNA, 20 nt, Homo sapiens
cggggguucauaggucacug

SEQ ID NO: 1061593 - RNA, 12 nt, Homo sapiens
cgggugugcuau

SEQ ID NO: 1061594 - RNA, 15 nt, Homo sapiens
cggguuacuuucaca

SEQ ID NO: 1061595 - RNA, 14 nt, Homo sapiens
cccucccuuugaaa

SEQ ID NO: 1061596 - RNA, 18 nt, Homo sapiens
cccuccguggcaucaccu

SEQ ID NO: 1061597 - RNA, 16 nt, Homo sapiens
cccuccugucuuccca

SEQ ID NO: 1061598 - RNA, 17 nt, Homo sapiens
cccuccuugggcacuuu

SEQ ID NO: 1061599 - RNA, 22 nt, Homo sapiens
cccuccuuuggaaugcuguauu

SEQ ID NO: 1061600 - RNA, 17 nt, Homo sapiens
cccucgcucagagggau

SEQ ID NO: 1061601 - RNA, 19 nt, Homo sapiens
cccucuccucucuuccucc

SEQ ID NO: 1061602 - RNA, 15 nt, Homo sapiens
cccucugccuuugaa

SEQ ID NO: 1061603 - RNA, 16 nt, Homo sapiens
cccucugcugaucuca

SEQ ID NO: 1061604 - RNA, 15 nt, Homo sapiens
cccucugucuuguga

SEQ ID NO: 1061605 - RNA, 22 nt, Homo sapiens
cccucuugaagggggauaugaa

SEQ ID NO: 1061606 - RNA, 22 nt, Homo sapiens
cccucuuuucugaucugcaguu

SEQ ID NO: 1061607 - RNA, 17 nt, Homo sapiens
cccugaacacugugaca

SEQ ID NO: 1061608 - RNA, 22 nt, Homo sapiens
cccugaaguaagcaaagacuuu

SEQ ID NO: 1061609 - RNA, 11 nt, Homo sapiens
cccugaccucc

SEQ ID NO: 1061610 - RNA, 16 nt, Homo sapiens
cccugagacaaaugga

SEQ ID NO: 1061611 - RNA, 18 nt, Homo sapiens
cccugagacaaauggagg

SEQ ID NO: 1061612 - RNA, 18 nt, Homo sapiens
cccugagcuuucugcuau

SEQ ID NO: 1061613 - RNA, 16 nt, Homo sapiens
cccugaggcucaggga

SEQ ID NO: 1061614 - RNA, 18 nt, Homo sapiens
cccugaguggaucuccaa

SEQ ID NO: 1061615 - RNA, 14 nt, Homo sapiens
cccugaucaaguca

SEQ ID NO: 1061616 - RNA, 19 nt, Homo sapiens
cccugauuguguauauuca

SEQ ID NO: 1061617 - RNA, 14 nt, Homo sapiens
cccugcacaaagcc

SEQ ID NO: 1061618 - RNA, 15 nt, Homo sapiens
cccugcacuccagcc

SEQ ID NO: 1061619 - RNA, 16 nt, Homo sapiens
cccugcagucacagcu

SEQ ID NO: 1061620 - RNA, 17 nt, Homo sapiens
cccugcaguuugagaca

SEQ ID NO: 1061621 - RNA, 19 nt, Homo sapiens
cccugcauugcugagucaa

SEQ ID NO: 1061622 - RNA, 12 nt, Homo sapiens
cccugcauuuau

SEQ ID NO: 1061623 - RNA, 17 nt, Homo sapiens
cccugcauuucugaguu

SEQ ID NO: 1061624 - RNA, 13 nt, Homo sapiens
cccugcccggcug

SEQ ID NO: 1061625 - RNA, 19 nt, Homo sapiens
cccugcuaaggaguucuca

SEQ ID NO: 1061626 - RNA, 20 nt, Homo sapiens
cccugcuucaauacccaaau

SEQ ID NO: 1061627 - RNA, 16 nt, Homo sapiens
cccugcuugcacuuug

SEQ ID NO: 1061628 - RNA, 21 nt, Homo sapiens
cccuggaaggugcuguuaucc

SEQ ID NO: 1061629 - RNA, 19 nt, Homo sapiens
cccuggaccucagagguga

SEQ ID NO: 1061630 - RNA, 20 nt, Homo sapiens
cccuggagcccauccagucu

SEQ ID NO: 1061631 - RNA, 14 nt, Homo sapiens
cccuggagugcagu

SEQ ID NO: 1061632 - RNA, 20 nt, Homo sapiens
cccuggaucuaccagcauaa

SEQ ID NO: 1061633 - RNA, 15 nt, Homo sapiens
cccuggccuagcaua

SEQ ID NO: 1061634 - RNA, 21 nt, Homo sapiens
cccuggcugaccccaaagagc

SEQ ID NO: 1061635 - RNA, 22 nt, Homo sapiens
cccugggcaaaugaauggcuca

SEQ ID NO: 1061636 - RNA, 14 nt, Homo sapiens
cccugggcaucaga

SEQ ID NO: 1061637 - RNA, 14 nt, Homo sapiens
cccugucucaaaaa

SEQ ID NO: 1061638 - RNA, 18 nt, Homo sapiens
cccugucucuagccacuu

SEQ ID NO: 1061639 - RNA, 24 nt, Homo sapiens
cccugugaguuuguacagucuugc

SEQ ID NO: 1061640 - RNA, 20 nt, Homo sapiens
cccugugcugacggaagcca

SEQ ID NO: 1061641 - RNA, 16 nt, Homo sapiens
cccuguuucucuugaa

SEQ ID NO: 1061642 - RNA, 16 nt, Homo sapiens
cccuuaggacaggguc

SEQ ID NO: 1061643 - RNA, 16 nt, Homo sapiens
cccuucaugcauggaa

SEQ ID NO: 1061644 - RNA, 14 nt, Homo sapiens
cccuugccacccca

SEQ ID NO: 1061645 - RNA, 21 nt, Homo sapiens
cccuuggaggcugucuucuca

SEQ ID NO: 1061646 - RNA, 21 nt, Homo sapiens
cccuugugcgugggugaagcc

SEQ ID NO: 1061647 - RNA, 23 nt, Homo sapiens
cccuuguggaaccaaauguaucc

SEQ ID NO: 1061648 - RNA, 19 nt, Homo sapiens
cccuuuacucauagcacuu

SEQ ID NO: 1061649 - RNA, 20 nt, Homo sapiens
cccuuuauucauccuaaaaa

SEQ ID NO: 1061650 - RNA, 11 nt, Homo sapiens
cccuuucacaa

SEQ ID NO: 1061651 - RNA, 17 nt, Homo sapiens
cccuuucagaugucuuc

SEQ ID NO: 1061652 - RNA, 19 nt, Homo sapiens
cccuuugugacuucaagaa

SEQ ID NO: 1061653 - RNA, 13 nt, Homo sapiens
cccuuuuacauac

SEQ ID NO: 1061654 - RNA, 18 nt, Homo sapiens
cccuuuuacauacugcug

SEQ ID NO: 1061655 - RNA, 22 nt, Homo sapiens
cccuuuuuuggcugcugaaggc

SEQ ID NO: 1061656 - RNA, 19 nt, Homo sapiens
ccgaaaaggauaugcagua

SEQ ID NO: 1061657 - RNA, 17 nt, Homo sapiens
ccgaauagcugggacua

SEQ ID NO: 1061658 - RNA, 18 nt, Homo sapiens
ccgacugccaucuuggac

SEQ ID NO: 1061659 - RNA, 13 nt, Homo sapiens
ccgagacauggcu

SEQ ID NO: 1061660 - RNA, 20 nt, Homo sapiens
ccgagagagauggaauaaag

SEQ ID NO: 1061661 - RNA, 17 nt, Homo sapiens
ccgagccaggaacugug

SEQ ID NO: 1061662 - RNA, 17 nt, Homo sapiens
ccgagccuggcuccaaa

SEQ ID NO: 1061663 - RNA, 19 nt, Homo sapiens
ccgagcucuccuuguuacc

SEQ ID NO: 1061664 - RNA, 23 nt, Homo sapiens
ccgagcugggggccaugagcucc

SEQ ID NO: 1061665 - RNA, 17 nt, Homo sapiens
ccgaggacaguggcaga

SEQ ID NO: 1061666 - RNA, 20 nt, Homo sapiens
ccgaggacaguggcagacag

SEQ ID NO: 1061667 - RNA, 16 nt, Homo sapiens
ccgaggggcucaggaa

SEQ ID NO: 1061668 - RNA, 16 nt, Homo sapiens
ccgagucugucucugu

SEQ ID NO: 1061669 - RNA, 11 nt, Homo sapiens
ccgagugcaau

SEQ ID NO: 1061670 - RNA, 12 nt, Homo sapiens
ccgagugcaaug

SEQ ID NO: 1061671 - RNA, 15 nt, Homo sapiens
ccgaugguacuauuu

SEQ ID NO: 1061672 - RNA, 15 nt, Homo sapiens
ccgcagugaucaaag

SEQ ID NO: 1061673 - RNA, 18 nt, Homo sapiens
ccgcauuuggauuggaug

SEQ ID NO: 1061674 - RNA, 22 nt, Homo sapiens
ccgccagcgaacuugacaauug

SEQ ID NO: 1061675 - RNA, 21 nt, Homo sapiens
ccgccauugccaccaggagaa

SEQ ID NO: 1061676 - RNA, 20 nt, Homo sapiens
ccgcccuaaaagcacacuca

SEQ ID NO: 1061677 - RNA, 17 nt, Homo sapiens
ccgcgaguuuuccccac

SEQ ID NO: 1061678 - RNA, 23 nt, Homo sapiens
ccgcuccagggguggcuggagac

SEQ ID NO: 1061679 - RNA, 15 nt, Homo sapiens
ccgcuuggcacauga

SEQ ID NO: 1061680 - RNA, 22 nt, Homo sapiens
ccggaagcucacagugacauua

SEQ ID NO: 1061681 - RNA, 19 nt, Homo sapiens
ccggagggcccugagcuga

SEQ ID NO: 1061682 - RNA, 19 nt, Homo sapiens
ccggcacccugauccucac

SEQ ID NO: 1061683 - RNA, 16 nt, Homo sapiens
ccggcgccccugccac

SEQ ID NO: 1061684 - RNA, 22 nt, Homo sapiens
ccgggaagcggagguugcaggg

SEQ ID NO: 1061685 - RNA, 21 nt, Homo sapiens
ccgggagggugcggcugugca

SEQ ID NO: 1061686 - RNA, 21 nt, Homo sapiens
ccggggauucuguacaugcau

SEQ ID NO: 1061687 - RNA, 16 nt, Homo sapiens
ccggggcuccacugaa

SEQ ID NO: 1061688 - RNA, 13 nt, Homo sapiens
ccggggguccagg

SEQ ID NO: 1061689 - RNA, 17 nt, Homo sapiens
ccguaacaacugugguc

SEQ ID NO: 1061690 - RNA, 19 nt, Homo sapiens
ccgucaauaggcaaagggg

SEQ ID NO: 1061691 - RNA, 15 nt, Homo sapiens
ccguguaaaccaaag

SEQ ID NO: 1061692 - RNA, 14 nt, Homo sapiens
ccuaaaaacacaga

SEQ ID NO: 1061693 - RNA, 21 nt, Homo sapiens
ccuaaaaguuacuuaccacag

SEQ ID NO: 1061694 - RNA, 23 nt, Homo sapiens
ccuaaagaccgggaaaagggaac

SEQ ID NO: 1061695 - RNA, 19 nt, Homo sapiens
ccuaaauaauguuaucugu

SEQ ID NO: 1061696 - RNA, 17 nt, Homo sapiens
ccuaagacuuauguauu

SEQ ID NO: 1061697 - RNA, 18 nt, Homo sapiens
ccuaagcagaccacugau

SEQ ID NO: 1061698 - RNA, 18 nt, Homo sapiens
ccuaaggacacacuaauc

SEQ ID NO: 1061699 - RNA, 20 nt, Homo sapiens
ccuaaguauaaaugguuguc

SEQ ID NO: 1061700 - RNA, 16 nt, Homo sapiens
ccuaaguccuuuaugu

SEQ ID NO: 1061701 - RNA, 13 nt, Homo sapiens
ccuaauacaacau

SEQ ID NO: 1061702 - RNA, 17 nt, Homo sapiens
ccuaauacaacauguag

SEQ ID NO: 1061703 - RNA, 21 nt, Homo sapiens
ccuacaccucuugcauuccau

SEQ ID NO: 1061704 - RNA, 21 nt, Homo sapiens
ccuaccucacagagugcauug

SEQ ID NO: 1061705 - RNA, 23 nt, Homo sapiens
uuaaagccugaguuugcuuucaa

SEQ ID NO: 1061706 - RNA, 20 nt, Homo sapiens
uuaaagccuuuagagccagc

SEQ ID NO: 1061707 - RNA, 20 nt, Homo sapiens
uuaaaggaacagagugagag

SEQ ID NO: 1061708 - RNA, 22 nt, Homo sapiens
uuaaaggcugugguaguacucc

SEQ ID NO: 1061709 - RNA, 16 nt, Homo sapiens
uuaaaguauucuucuc

SEQ ID NO: 1061710 - RNA, 11 nt, Homo sapiens
uuaaagugaua

SEQ ID NO: 1061711 - RNA, 22 nt, Homo sapiens
uuaaaguucucaaugcaaccau

SEQ ID NO: 1061712 - RNA, 17 nt, Homo sapiens
uuaaauaaaucauaaaa

SEQ ID NO: 1061713 - RNA, 20 nt, Homo sapiens
uuaaauaagauuuaauucac

SEQ ID NO: 1061714 - RNA, 17 nt, Homo sapiens
uuaaauacagucuucca

SEQ ID NO: 1061715 - RNA, 12 nt, Homo sapiens
uuaaauaguaaa

SEQ ID NO: 1061716 - RNA, 16 nt, Homo sapiens
uuaaaucaaaagggag

SEQ ID NO: 1061717 - RNA, 21 nt, Homo sapiens
uuaaaucaacgaguacuucaa

SEQ ID NO: 1061718 - RNA, 23 nt, Homo sapiens
uuaaaucaauaaagaccacuuua

SEQ ID NO: 1061719 - RNA, 18 nt, Homo sapiens
uuaaauguccguguaaaa

SEQ ID NO: 1061720 - RNA, 19 nt, Homo sapiens
uuaaauuauuuuuguucau

SEQ ID NO: 1061721 - RNA, 15 nt, Homo sapiens
uuaaauugcugugua

SEQ ID NO: 1061722 - RNA, 15 nt, Homo sapiens
uuaacaacaauaaca

SEQ ID NO: 1061723 - RNA, 21 nt, Homo sapiens
uuaacagaugcaaugugcuac

SEQ ID NO: 1061724 - RNA, 19 nt, Homo sapiens
uuaaccugccagggagaca

SEQ ID NO: 1061725 - RNA, 14 nt, Homo sapiens
uuaacucagaucac

SEQ ID NO: 1061726 - RNA, 18 nt, Homo sapiens
uuaacucuaucugucaua

SEQ ID NO: 1061727 - RNA, 21 nt, Homo sapiens
uuaacugguauauacauauau

SEQ ID NO: 1061728 - RNA, 21 nt, Homo sapiens
uuaacuuccaauuuacauacu

SEQ ID NO: 1061729 - RNA, 16 nt, Homo sapiens
uuaagaaccugaauau

SEQ ID NO: 1061730 - RNA, 13 nt, Homo sapiens
uuaagaacuuuaa

SEQ ID NO: 1061731 - RNA, 22 nt, Homo sapiens
uuaagagggaacuuagcagaga

SEQ ID NO: 1061732 - RNA, 18 nt, Homo sapiens
uuaagauaguuuugccag

SEQ ID NO: 1061733 - RNA, 12 nt, Homo sapiens
uuaagcauuguu

SEQ ID NO: 1061734 - RNA, 22 nt, Homo sapiens
uuaagcugggauaaucacauua

SEQ ID NO: 1061735 - RNA, 17 nt, Homo sapiens
uuaagcuuaugucagac

SEQ ID NO: 1061736 - RNA, 19 nt, Homo sapiens
uuaagcuuccgccgucuca

SEQ ID NO: 1061737 - RNA, 17 nt, Homo sapiens
uuaaggaaggcacuaaa

SEQ ID NO: 1061738 - RNA, 23 nt, Homo sapiens
uuaaguaucuuuuuucaaaaaca

SEQ ID NO: 1061739 - RNA, 21 nt, Homo sapiens
uuaagucuuaucaagcagcca

SEQ ID NO: 1061740 - RNA, 12 nt, Homo sapiens
uuaagugacuug

SEQ ID NO: 1061741 - RNA, 13 nt, Homo sapiens
uuaagugugcuua

SEQ ID NO: 1061742 - RNA, 16 nt, Homo sapiens
uuaaguugauggugau

SEQ ID NO: 1061743 - RNA, 17 nt, Homo sapiens
uuaaguugauggugaug

SEQ ID NO: 1061744 - RNA, 21 nt, Homo sapiens
uuaaguuguugauguuuuaac

SEQ ID NO: 1061745 - RNA, 22 nt, Homo sapiens
uuaauaaaccauuuuuacuugg

SEQ ID NO: 1061746 - RNA, 24 nt, Homo sapiens
uuaauaaauuaaaacaugcacaaa

SEQ ID NO: 1061747 - RNA, 13 nt, Homo sapiens
uuaauaaugugua

SEQ ID NO: 1061748 - RNA, 16 nt, Homo sapiens
uuaauacacacaguua

SEQ ID NO: 1061749 - RNA, 20 nt, Homo sapiens
uuaauacagggcauuuuggu

SEQ ID NO: 1061750 - RNA, 17 nt, Homo sapiens
uucaaacugcaugauuc

SEQ ID NO: 1061751 - RNA, 19 nt, Homo sapiens
uucaaacugcaugauucau

SEQ ID NO: 1061752 - RNA, 18 nt, Homo sapiens
uucaaacuuccagugcaa

SEQ ID NO: 1061753 - RNA, 17 nt, Homo sapiens
uucaaauuuuaucucca

SEQ ID NO: 1061754 - RNA, 20 nt, Homo sapiens
uucaacaaccggccaccaga

SEQ ID NO: 1061755 - RNA, 15 nt, Homo sapiens
uucaagaaagcuuca

SEQ ID NO: 1061756 - RNA, 16 nt, Homo sapiens
uucaagccuuagauaa

SEQ ID NO: 1061757 - RNA, 18 nt, Homo sapiens
uucaaguuagcucaggag

SEQ ID NO: 1061758 - RNA, 14 nt, Homo sapiens
uucaaguuugucac

SEQ ID NO: 1061759 - RNA, 23 nt, Homo sapiens
uucaauaaaccuaauaaucugaa

SEQ ID NO: 1061760 - RNA, 21 nt, Homo sapiens
uucaauaaaguaucuacaugc

SEQ ID NO: 1061761 - RNA, 15 nt, Homo sapiens
uucaauaaauuguaa

SEQ ID NO: 1061762 - RNA, 18 nt, Homo sapiens
uucaaugaucuagguuua

SEQ ID NO: 1061763 - RNA, 18 nt, Homo sapiens
uucaaugcaaaguacaug

SEQ ID NO: 1061764 - RNA, 17 nt, Homo sapiens
uucaauguaguuuucca

SEQ ID NO: 1061765 - RNA, 15 nt, Homo sapiens
uucaauucucaaaag

SEQ ID NO: 1061766 - RNA, 16 nt, Homo sapiens
uucacaagacccaaaa

SEQ ID NO: 1061767 - RNA, 14 nt, Homo sapiens
uucacacaauacaa

SEQ ID NO: 1061768 - RNA, 19 nt, Homo sapiens
uucacaccgcugcacucaa

SEQ ID NO: 1061769 - RNA, 14 nt, Homo sapiens
uucacacuaagaaa

SEQ ID NO: 1061770 - RNA, 15 nt, Homo sapiens
uucacagagugugcu

SEQ ID NO: 1061771 - RNA, 13 nt, Homo sapiens
uucacagccagac

SEQ ID NO: 1061772 - RNA, 12 nt, Homo sapiens
uucacaguguga

SEQ ID NO: 1061773 - RNA, 18 nt, Homo sapiens
uucacauaaaaccucauu

SEQ ID NO: 1061774 - RNA, 19 nt, Homo sapiens
uucacaugagcuauuucca

SEQ ID NO: 1061775 - RNA, 19 nt, Homo sapiens
uucacauucccaucuguca

SEQ ID NO: 1061776 - RNA, 23 nt, Homo sapiens
uucaccaauauuucucagacauc

SEQ ID NO: 1061777 - RNA, 18 nt, Homo sapiens
uucaccacaugugcacau

SEQ ID NO: 1061778 - RNA, 18 nt, Homo sapiens
uucaccaccaucuccagc

SEQ ID NO: 1061779 - RNA, 19 nt, Homo sapiens
uucaccauguuggccaggc

SEQ ID NO: 1061780 - RNA, 13 nt, Homo sapiens
uucaccuugggau

SEQ ID NO: 1061781 - RNA, 20 nt, Homo sapiens
uucacuccagccugggugac

SEQ ID NO: 1061782 - RNA, 12 nt, Homo sapiens
uucacucccacc

SEQ ID NO: 1061783 - RNA, 18 nt, Homo sapiens
uucacuguaagacucauu

SEQ ID NO: 1061784 - RNA, 18 nt, Homo sapiens
uucacuguagaaugauuu

SEQ ID NO: 1061785 - RNA, 14 nt, Homo sapiens
uucacuguugaaaa

SEQ ID NO: 1061786 - RNA, 14 nt, Homo sapiens
uucacuuauugacu

SEQ ID NO: 1061787 - RNA, 16 nt, Homo sapiens
uucacuuauugacuau

SEQ ID NO: 1061788 - RNA, 13 nt, Homo sapiens
uucacuucagagc

SEQ ID NO: 1061789 - RNA, 17 nt, Homo sapiens
uucacuucaucuucuca

SEQ ID NO: 1061790 - RNA, 13 nt, Homo sapiens
uucacuuuacaaa

SEQ ID NO: 1061791 - RNA, 21 nt, Homo sapiens
uucacuuuuuacagugcuauu

SEQ ID NO: 1061792 - RNA, 13 nt, Homo sapiens
uucagaaagaagu

SEQ ID NO: 1061793 - RNA, 18 nt, Homo sapiens
uucagaaccauccauagu

SEQ ID NO: 1061794 - RNA, 17 nt, Homo sapiens
uucagaagguugcucua

SEQ ID NO: 1061795 - RNA, 12 nt, Homo sapiens
uucagacuguuu

SEQ ID NO: 1061796 - RNA, 22 nt, Homo sapiens
uucagagggcguguuguuuuac

SEQ ID NO: 1061797 - RNA, 16 nt, Homo sapiens
uucagauacaaacugc

SEQ ID NO: 1061798 - RNA, 17 nt, Homo sapiens
uucagaucauauuucac

SEQ ID NO: 1061799 - RNA, 21 nt, Homo sapiens
uucagauggcaauuucacuga

SEQ ID NO: 1061800 - RNA, 14 nt, Homo sapiens
uucagauuugccuu

SEQ ID NO: 1061801 - RNA, 22 nt, Homo sapiens
uucagauuuuaaaaagucuuca

SEQ ID NO: 1061802 - RNA, 19 nt, Homo sapiens
uucagcagacuaugaauau

SEQ ID NO: 1061803 - RNA, 20 nt, Homo sapiens
uucagccuagccgaccucag

SEQ ID NO: 1061804 - RNA, 16 nt, Homo sapiens
uucagcucuguuuuac

SEQ ID NO: 1061805 - RNA, 13 nt, Homo sapiens
uucagcugcauac

SEQ ID NO: 1061806 - RNA, 22 nt, Homo sapiens
uucagcuguacuucgucuucua

SEQ ID NO: 1061807 - RNA, 16 nt, Homo sapiens
uucaggacucuaccuc

SEQ ID NO: 1061808 - RNA, 20 nt, Homo sapiens
uucaggacuuaacggcucca

SEQ ID NO: 1061809 - RNA, 14 nt, Homo sapiens
uucaggauacaugu

SEQ ID NO: 1061810 - RNA, 14 nt, Homo sapiens
uucaggcaggccaa

SEQ ID NO: 1061811 - RNA, 20 nt, Homo sapiens
uucagggaagaagcauacaa

SEQ ID NO: 1061812 - RNA, 18 nt, Homo sapiens
uucagguacuaaauaccu

SEQ ID NO: 1061813 - RNA, 18 nt, Homo sapiens
uucagugcuguacuugau

SEQ ID NO: 1061814 - RNA, 16 nt, Homo sapiens
uucagugcuucgcaga

SEQ ID NO: 1061815 - RNA, 14 nt, Homo sapiens
uucaguggcagcug

SEQ ID NO: 1061816 - RNA, 16 nt, Homo sapiens
uucaguggugugaucu

SEQ ID NO: 1061817 - RNA, 23 nt, Homo sapiens
uucaguggugugaucuuggcuca

SEQ ID NO: 1061818 - RNA, 18 nt, Homo sapiens
uucaguuuuaccagauga

SEQ ID NO: 1061819 - RNA, 16 nt, Homo sapiens
uucauaagguaauuca

SEQ ID NO: 1061820 - RNA, 12 nt, Homo sapiens
uucauacaaggc

SEQ ID NO: 1061821 - RNA, 13 nt, Homo sapiens
uucauacagcauu

SEQ ID NO: 1061822 - RNA, 16 nt, Homo sapiens
uucauacagcauuaca

SEQ ID NO: 1061823 - RNA, 20 nt, Homo sapiens
uucaucagacuccugugcaa

SEQ ID NO: 1061824 - RNA, 15 nt, Homo sapiens
uucauccguguaacc

SEQ ID NO: 1061825 - RNA, 20 nt, Homo sapiens
uucauccuaaaaaguuccau

SEQ ID NO: 1061826 - RNA, 19 nt, Homo sapiens
uucaucuaaucuuaccagu

SEQ ID NO: 1061827 - RNA, 14 nt, Homo sapiens
uucaucuaauguga

SEQ ID NO: 1061828 - RNA, 15 nt, Homo sapiens
uucaucuucaccaga

SEQ ID NO: 1061829 - RNA, 14 nt, Homo sapiens
uucaugcauggaaa

SEQ ID NO: 1061830 - RNA, 12 nt, Homo sapiens
uucaugccagcu

SEQ ID NO: 1061831 - RNA, 19 nt, Homo sapiens
uucauggugaaaauguacu

SEQ ID NO: 1061832 - RNA, 15 nt, Homo sapiens
uucauguaacuagaa

SEQ ID NO: 1061833 - RNA, 15 nt, Homo sapiens
uucauguuugcuuca

SEQ ID NO: 1061834 - RNA, 13 nt, Homo sapiens
uucauugcacuuu

SEQ ID NO: 1061835 - RNA, 16 nt, Homo sapiens
uucauuguaugaugug

SEQ ID NO: 1061836 - RNA, 19 nt, Homo sapiens
uucauuucagauaaacaac

SEQ ID NO: 1061837 - RNA, 13 nt, Homo sapiens
uuccaaacauaca

SEQ ID NO: 1061838 - RNA, 13 nt, Homo sapiens
uuccaaagccaga

SEQ ID NO: 1061839 - RNA, 13 nt, Homo sapiens
uuccaaaggccau

SEQ ID NO: 1061840 - RNA, 14 nt, Homo sapiens
uuccaaauucacaa

SEQ ID NO: 1061841 - RNA, 14 nt, Homo sapiens
uuccaacaccacag

SEQ ID NO: 1061842 - RNA, 16 nt, Homo sapiens
uuccaacguggcccag

SEQ ID NO: 1061843 - RNA, 17 nt, Homo sapiens
uuccacaaguuaaauaa

SEQ ID NO: 1061844 - RNA, 13 nt, Homo sapiens
uugagacagaguu

SEQ ID NO: 1061845 - RNA, 15 nt, Homo sapiens
uugagacugauucag

SEQ ID NO: 1061846 - RNA, 18 nt, Homo sapiens
uugagaguugcuggugua

SEQ ID NO: 1061847 - RNA, 17 nt, Homo sapiens
uugagaucauugcaaac

SEQ ID NO: 1061848 - RNA, 13 nt, Homo sapiens
uugagccucagaa

SEQ ID NO: 1061849 - RNA, 17 nt, Homo sapiens
uugagccuuaaaaccca

SEQ ID NO: 1061850 - RNA, 18 nt, Homo sapiens
uugagguaggagaauugc

SEQ ID NO: 1061851 - RNA, 23 nt, Homo sapiens
uugaggucaaguaagaagacaug

SEQ ID NO: 1061852 - RNA, 16 nt, Homo sapiens
uugauaaaugccucau

SEQ ID NO: 1061853 - RNA, 23 nt, Homo sapiens
uugauaagagggcacacacugug

SEQ ID NO: 1061854 - RNA, 16 nt, Homo sapiens
uugauaguauugugca

SEQ ID NO: 1061855 - RNA, 19 nt, Homo sapiens
uugauauaaauaaaacauu

SEQ ID NO: 1061856 - RNA, 21 nt, Homo sapiens
uugaucuucagggaacugcau

SEQ ID NO: 1061857 - RNA, 18 nt, Homo sapiens
uugaugauaaacacugag

SEQ ID NO: 1061858 - RNA, 19 nt, Homo sapiens
uugaugauuaauucaccuu

SEQ ID NO: 1061859 - RNA, 22 nt, Homo sapiens
uugauggauuaauuaaauaagu

SEQ ID NO: 1061860 - RNA, 17 nt, Homo sapiens
uugaugugaaacauuau

SEQ ID NO: 1061861 - RNA, 13 nt, Homo sapiens
uugauuaccuagu

SEQ ID NO: 1061862 - RNA, 19 nt, Homo sapiens
uugauugucagcuacuaau

SEQ ID NO: 1061863 - RNA, 10 nt, Homo sapiens
uugauuucaa

SEQ ID NO: 1061864 - RNA, 21 nt, Homo sapiens
uugauuuuauuuuuucucugu

SEQ ID NO: 1061865 - RNA, 14 nt, Homo sapiens
uugauuuugcaaau

SEQ ID NO: 1061866 - RNA, 16 nt, Homo sapiens
uugcaaauacauggau

SEQ ID NO: 1061867 - RNA, 13 nt, Homo sapiens
uugcaaauccacu

SEQ ID NO: 1061868 - RNA, 15 nt, Homo sapiens
uugcaacuuagcuca

SEQ ID NO: 1061869 - RNA, 15 nt, Homo sapiens
uugcaagacauagaa

SEQ ID NO: 1061870 - RNA, 21 nt, Homo sapiens
uugcaagauuccaaguucuca

SEQ ID NO: 1061871 - RNA, 22 nt, Homo sapiens
uugcaagauuccaaguucucac

SEQ ID NO: 1061872 - RNA, 19 nt, Homo sapiens
uugcaauuuuuccaugaag

SEQ ID NO: 1061873 - RNA, 21 nt, Homo sapiens
uugcacacuccccugcacugg

SEQ ID NO: 1061874 - RNA, 13 nt, Homo sapiens
uugcacauaguag

SEQ ID NO: 1061875 - RNA, 15 nt, Homo sapiens
uugcaccaacuuuga

SEQ ID NO: 1061876 - RNA, 21 nt, Homo sapiens
uugcaccacugcacuccaguc

SEQ ID NO: 1061877 - RNA, 16 nt, Homo sapiens
uugcacgcccaugugu

SEQ ID NO: 1061878 - RNA, 18 nt, Homo sapiens
uugcagaguccugcacag

SEQ ID NO: 1061879 - RNA, 16 nt, Homo sapiens
uugcagauccuugaua

SEQ ID NO: 1061880 - RNA, 20 nt, Homo sapiens
uugcagcuggacuucuccac

SEQ ID NO: 1061881 - RNA, 20 nt, Homo sapiens
uugcagcuuauauucaucca

SEQ ID NO: 1061882 - RNA, 15 nt, Homo sapiens
uugcaggacccugau

SEQ ID NO: 1061883 - RNA, 13 nt, Homo sapiens
uugcauaugcaua

SEQ ID NO: 1061884 - RNA, 16 nt, Homo sapiens
uugcauaugucuauau

SEQ ID NO: 1061885 - RNA, 15 nt, Homo sapiens
uugcaucguggagac

SEQ ID NO: 1061886 - RNA, 24 nt, Homo sapiens
uugcaugggcuaaugaagaucaua

SEQ ID NO: 1061887 - RNA, 22 nt, Homo sapiens
uugccaaacagccacacugugg

SEQ ID NO: 1061888 - RNA, 13 nt, Homo sapiens
uugcccacaaugc

SEQ ID NO: 1061889 - RNA, 20 nt, Homo sapiens
uugcccaggcuggucucaaa

SEQ ID NO: 1061890 - RNA, 18 nt, Homo sapiens
uugcccagggacuuccuc

SEQ ID NO: 1061891 - RNA, 15 nt, Homo sapiens
uugccccugagacaa

SEQ ID NO: 1061892 - RNA, 20 nt, Homo sapiens
uugccccugagacaaaugga

SEQ ID NO: 1061893 - RNA, 17 nt, Homo sapiens
uugccuccucacccacc

SEQ ID NO: 1061894 - RNA, 20 nt, Homo sapiens
uugccugcaugaaacauguu

SEQ ID NO: 1061895 - RNA, 13 nt, Homo sapiens
uugccuucuccac

SEQ ID NO: 1061896 - RNA, 21 nt, Homo sapiens
uugccuuuccauaaucacuca

SEQ ID NO: 1061897 - RNA, 17 nt, Homo sapiens
uugcgauggcgugggcu

SEQ ID NO: 1061898 - RNA, 15 nt, Homo sapiens
uugcuaaaagauuau

SEQ ID NO: 1061899 - RNA, 17 nt, Homo sapiens
uugcuaacaaugcucug

SEQ ID NO: 1061900 - RNA, 14 nt, Homo sapiens
uugcucacagcuga

SEQ ID NO: 1061901 - RNA, 15 nt, Homo sapiens
uugcucacagcugau

SEQ ID NO: 1061902 - RNA, 16 nt, Homo sapiens
uugcucuuucaucucu

SEQ ID NO: 1061903 - RNA, 17 nt, Homo sapiens
uugcugaaaaugguauu

SEQ ID NO: 1061904 - RNA, 14 nt, Homo sapiens
uugcuggacuguca

SEQ ID NO: 1061905 - RNA, 21 nt, Homo sapiens
uugcuguaaacuuguagcauu

SEQ ID NO: 1061906 - RNA, 14 nt, Homo sapiens
uugcuguguaucug

SEQ ID NO: 1061907 - RNA, 17 nt, Homo sapiens
uugcuuacuuuggaaua

SEQ ID NO: 1061908 - RNA, 17 nt, Homo sapiens
uugcuuauguaaucuca

SEQ ID NO: 1061909 - RNA, 16 nt, Homo sapiens
uugcuucucucucuaa

SEQ ID NO: 1061910 - RNA, 20 nt, Homo sapiens
uugcuucuucccaauugcuu

SEQ ID NO: 1061911 - RNA, 24 nt, Homo sapiens
uugcuugguggaugaaaugucagu

SEQ ID NO: 1061912 - RNA, 17 nt, Homo sapiens
uugcuuuugugaacuuu

SEQ ID NO: 1061913 - RNA, 15 nt, Homo sapiens
uuggaaaaugugcaa

SEQ ID NO: 1061914 - RNA, 17 nt, Homo sapiens
uuggaaaaugugcaaua

SEQ ID NO: 1061915 - RNA, 19 nt, Homo sapiens
uuggaaacaauaugcaaug

SEQ ID NO: 1061916 - RNA, 22 nt, Homo sapiens
uuggaaauagaaauuuccagag

SEQ ID NO: 1061917 - RNA, 12 nt, Homo sapiens
uuggaaaucaca

SEQ ID NO: 1061918 - RNA, 14 nt, Homo sapiens
uuggaacagaaugu

SEQ ID NO: 1061919 - RNA, 18 nt, Homo sapiens
uuggaagcugucauaaaa

SEQ ID NO: 1061920 - RNA, 19 nt, Homo sapiens
uuggaagugugugaucugu

SEQ ID NO: 1061921 - RNA, 13 nt, Homo sapiens
uuggaauucucuc

SEQ ID NO: 1061922 - RNA, 19 nt, Homo sapiens
uuggaauuuguaaccucag

SEQ ID NO: 1061923 - RNA, 22 nt, Homo sapiens
uuggacaaaccgagugcaauga

SEQ ID NO: 1061924 - RNA, 14 nt, Homo sapiens
uuggacaaccucau

SEQ ID NO: 1061925 - RNA, 17 nt, Homo sapiens
uuggacugauaaucucu

SEQ ID NO: 1061926 - RNA, 12 nt, Homo sapiens
aaaaaacagagg

SEQ ID NO: 1061927 - RNA, 18 nt, Homo sapiens
aaaaaaccuucagugaaa

SEQ ID NO: 1061928 - RNA, 20 nt, Homo sapiens
aaaaaauuaaauugcagaug

SEQ ID NO: 1061929 - RNA, 11 nt, Homo sapiens
aaaaacaaagg

SEQ ID NO: 1061930 - RNA, 13 nt, Homo sapiens
aaaaacacagaca

SEQ ID NO: 1061931 - RNA, 16 nt, Homo sapiens
aaaaaccaaaacugug

SEQ ID NO: 1061932 - RNA, 18 nt, Homo sapiens
aaaaaccaauagcuuuaa

SEQ ID NO: 1061933 - RNA, 17 nt, Homo sapiens
aaaaaccccaaacuguu

SEQ ID NO: 1061934 - RNA, 23 nt, Homo sapiens
aaaaaccucuaugcaaucugagu

SEQ ID NO: 1061935 - RNA, 17 nt, Homo sapiens
aaaaaccugcaguuuug

SEQ ID NO: 1061936 - RNA, 18 nt, Homo sapiens
aaaaacuccccuuccuca

SEQ ID NO: 1061937 - RNA, 12 nt, Homo sapiens
aaaaacuuccau

SEQ ID NO: 1061938 - RNA, 22 nt, Homo sapiens
aaaaagaagaacuauaugugaa

SEQ ID NO: 1061939 - RNA, 14 nt, Homo sapiens
aaaaagacaacuca

SEQ ID NO: 1061940 - RNA, 22 nt, Homo sapiens
aaaaagccuccaguccaaggaa

SEQ ID NO: 1061941 - RNA, 16 nt, Homo sapiens
aaaaaggaugcacaga

SEQ ID NO: 1061942 - RNA, 14 nt, Homo sapiens
aaaaagucauccaa

SEQ ID NO: 1061943 - RNA, 20 nt, Homo sapiens
aaaaagucuacauacuuuca

SEQ ID NO: 1061944 - RNA, 16 nt, Homo sapiens
aaaaaguuaaacauug

SEQ ID NO: 1061945 - RNA, 16 nt, Homo sapiens
aaaaaguucagcauga

SEQ ID NO: 1061946 - RNA, 21 nt, Homo sapiens
aaaaaucaugagauccuuuaa

SEQ ID NO: 1061947 - RNA, 19 nt, Homo sapiens
aaaaauccauaaaauccuu

SEQ ID NO: 1061948 - RNA, 14 nt, Homo sapiens
aaaaaugacuaaaa

SEQ ID NO: 1061949 - RNA, 17 nt, Homo sapiens
aaaaaugaugggacaau

SEQ ID NO: 1061950 - RNA, 12 nt, Homo sapiens
aaaaaugccaag

SEQ ID NO: 1061951 - RNA, 13 nt, Homo sapiens
aaaaaugcugaac

SEQ ID NO: 1061952 - RNA, 21 nt, Homo sapiens
aaaaaugguuuaaauggucaa

SEQ ID NO: 1061953 - RNA, 22 nt, Homo sapiens
aaaaaugugcaaaacagcguuu

SEQ ID NO: 1061954 - RNA, 13 nt, Homo sapiens
aaaacaaauccau

SEQ ID NO: 1061955 - RNA, 20 nt, Homo sapiens
aaaacaauuguaauaaugcu

SEQ ID NO: 1061956 - RNA, 17 nt, Homo sapiens
aaaacacaaaaguuucu

SEQ ID NO: 1061957 - RNA, 13 nt, Homo sapiens
aaaacacacuccu

SEQ ID NO: 1061958 - RNA, 21 nt, Homo sapiens
aaaacacacuccuuugcuuaa

SEQ ID NO: 1061959 - RNA, 11 nt, Homo sapiens
aaaacacugcc

SEQ ID NO: 1061960 - RNA, 11 nt, Homo sapiens
aaaacacugug

SEQ ID NO: 1061961 - RNA, 23 nt, Homo sapiens
aaaacagaacaucauuagaacaa

SEQ ID NO: 1061962 - RNA, 11 nt, Homo sapiens
aaaacaucacu

SEQ ID NO: 1061963 - RNA, 23 nt, Homo sapiens
aaaaccaccaccaucaccagaca

SEQ ID NO: 1061964 - RNA, 17 nt, Homo sapiens
aaaaccacuagaacucu

SEQ ID NO: 1061965 - RNA, 17 nt, Homo sapiens
aaaaccagcgugugacu

SEQ ID NO: 1061966 - RNA, 19 nt, Homo sapiens
aaaaccaggccuuaucucc

SEQ ID NO: 1061967 - RNA, 23 nt, Homo sapiens
aaaaccccaucucuacaaaaagc

SEQ ID NO: 1061968 - RNA, 18 nt, Homo sapiens
aaaaccccaucucuacua

SEQ ID NO: 1061969 - RNA, 18 nt, Homo sapiens
aaaaccugugugccauuu

SEQ ID NO: 1061970 - RNA, 14 nt, Homo sapiens
aaaaccuuccccag

SEQ ID NO: 1061971 - RNA, 12 nt, Homo sapiens
cugugcaaguca

SEQ ID NO: 1061972 - RNA, 22 nt, Homo sapiens
cugugcaguggcccccacagaa

SEQ ID NO: 1061973 - RNA, 18 nt, Homo sapiens
cugugccuaacaccagcg

SEQ ID NO: 1061974 - RNA, 17 nt, Homo sapiens
cugugccucugccuguc

SEQ ID NO: 1061975 - RNA, 20 nt, Homo sapiens
cugugccuuggugugcugua

SEQ ID NO: 1061976 - RNA, 16 nt, Homo sapiens
cugugcugguguccug

SEQ ID NO: 1061977 - RNA, 15 nt, Homo sapiens
cugugcuuucccuga

SEQ ID NO: 1061978 - RNA, 15 nt, Homo sapiens
cugugcuuugacuca

SEQ ID NO: 1061979 - RNA, 16 nt, Homo sapiens
cuguggaagaggccaa

SEQ ID NO: 1061980 - RNA, 22 nt, Homo sapiens
cuguggagguauugccuuguga

SEQ ID NO: 1061981 - RNA, 18 nt, Homo sapiens
cuguggaugauaaaacac

SEQ ID NO: 1061982 - RNA, 17 nt, Homo sapiens
cuguggccuguguccca

SEQ ID NO: 1061983 - RNA, 21 nt, Homo sapiens
cugugguuuuucuaauggacu

SEQ ID NO: 1061984 - RNA, 21 nt, Homo sapiens
cuguguaaaacuauauucuca

SEQ ID NO: 1061985 - RNA, 21 nt, Homo sapiens
cuguguacagaauucugcuac

SEQ ID NO: 1061986 - RNA, 15 nt, Homo sapiens
cuguguagugauuug

SEQ ID NO: 1061987 - RNA, 15 nt, Homo sapiens
cugugucguagccaa

SEQ ID NO: 1061988 - RNA, 20 nt, Homo sapiens
cugugucuugcaauggcagc

SEQ ID NO: 1061989 - RNA, 15 nt, Homo sapiens
cugugugaaggugaa

SEQ ID NO: 1061990 - RNA, 14 nt, Homo sapiens
cugugugacucaaa

SEQ ID NO: 1061991 - RNA, 20 nt, Homo sapiens
cugugugcaagugugugcac

SEQ ID NO: 1061992 - RNA, 23 nt, Homo sapiens
cugugugcaagugugugcacaug

SEQ ID NO: 1061993 - RNA, 17 nt, Homo sapiens
cuguguuccuggcaaua

SEQ ID NO: 1061994 - RNA, 21 nt, Homo sapiens
cuguguucgacucagccucag

SEQ ID NO: 1061995 - RNA, 20 nt, Homo sapiens
cuguguuucuuuugguucca

SEQ ID NO: 1061996 - RNA, 15 nt, Homo sapiens
cuguuaccagaggac

SEQ ID NO: 1061997 - RNA, 20 nt, Homo sapiens
cuguuaccugaucaaugaca

SEQ ID NO: 1061998 - RNA, 14 nt, Homo sapiens
cuguuauagagggu

SEQ ID NO: 1061999 - RNA, 18 nt, Homo sapiens
cuguuauuaacaaacauc

SEQ ID NO: 1062000 - RNA, 13 nt, Homo sapiens
cuguucacagcca

SEQ ID NO: 1062001 - RNA, 17 nt, Homo sapiens
cuguucucugcccucca

SEQ ID NO: 1062002 - RNA, 18 nt, Homo sapiens
cuguucugucucauauga

SEQ ID NO: 1062003 - RNA, 13 nt, Homo sapiens
cuguucuguggaa

SEQ ID NO: 1062004 - RNA, 19 nt, Homo sapiens
cuguugagacugauucaga

SEQ ID NO: 1062005 - RNA, 16 nt, Homo sapiens
cuguugaggguccuca

SEQ ID NO: 1062006 - RNA, 12 nt, Homo sapiens
cuguugcucaaa

SEQ ID NO: 1062007 - RNA, 13 nt, Homo sapiens
cuguugcuuacaa

SEQ ID NO: 1062008 - RNA, 19 nt, Homo sapiens
cuguuggccagugugacaa

SEQ ID NO: 1062009 - RNA, 15 nt, Homo sapiens
cuguugucaaaaagu

SEQ ID NO: 1062010 - RNA, 20 nt, Homo sapiens
cuguugucaaaaaguuccau

SEQ ID NO: 1062011 - RNA, 15 nt, Homo sapiens
cuguugucauugcug

SEQ ID NO: 1062012 - RNA, 15 nt, Homo sapiens
cuguuuaaaguguca

SEQ ID NO: 1062013 - RNA, 19 nt, Homo sapiens
cuguuuccauagggugaca

SEQ ID NO: 1062014 - RNA, 22 nt, Homo sapiens
cuguuucugggcugucuauucu

SEQ ID NO: 1062015 - RNA, 16 nt, Homo sapiens
cuguuuguagacuuaa

SEQ ID NO: 1062016 - RNA, 20 nt, Homo sapiens
cuguuuuagauaucccuuac

SEQ ID NO: 1062017 - RNA, 16 nt, Homo sapiens
cuguuuuauauucaac

SEQ ID NO: 1062018 - RNA, 15 nt, Homo sapiens
cuguuuucucucggc

SEQ ID NO: 1062019 - RNA, 15 nt, Homo sapiens
cuguuuuuuccugag

SEQ ID NO: 1062020 - RNA, 19 nt, Homo sapiens
cuguuuuuugaugcuuggc

SEQ ID NO: 1062021 - RNA, 16 nt, Homo sapiens
cuuaaaaaauguccau

SEQ ID NO: 1062022 - RNA, 18 nt, Homo sapiens
cuuaaaagaacauguaua

SEQ ID NO: 1062023 - RNA, 17 nt, Homo sapiens
cuuaaaauaaaaugcag

SEQ ID NO: 1062024 - RNA, 20 nt, Homo sapiens
cuuaaaauagaaauauauua

SEQ ID NO: 1062025 - RNA, 20 nt, Homo sapiens
cuuaaacagcagauuucaga

SEQ ID NO: 1062026 - RNA, 23 nt, Homo sapiens
cuuaaacuguguggacugugaug

SEQ ID NO: 1062027 - RNA, 14 nt, Homo sapiens
cuuaaagauuuauc

SEQ ID NO: 1062028 - RNA, 19 nt, Homo sapiens
cuuaaagauuuaucaaauc

SEQ ID NO: 1062029 - RNA, 23 nt, Homo sapiens
cuuaaauaauaaacaguggaaua

SEQ ID NO: 1062030 - RNA, 17 nt, Homo sapiens
cuuaacagaugcaaugu

SEQ ID NO: 1062031 - RNA, 18 nt, Homo sapiens
cuuaacccacaguucucc

SEQ ID NO: 1062032 - RNA, 16 nt, Homo sapiens
cuuaacgcagcacuua

SEQ ID NO: 1062033 - RNA, 18 nt, Homo sapiens
cuuaagaaaaugaugcug

SEQ ID NO: 1062034 - RNA, 19 nt, Homo sapiens
cuuaagacuuuugggacau

SEQ ID NO: 1062035 - RNA, 17 nt, Homo sapiens
cuuaagagaugccucau

SEQ ID NO: 1062036 - RNA, 20 nt, Homo sapiens
cuuaagcuuccgccgucuca

SEQ ID NO: 1062037 - RNA, 17 nt, Homo sapiens
cuuaaggagguguuccu

SEQ ID NO: 1062038 - RNA, 23 nt, Homo sapiens
cuuaaguuguggagagugcaaca

SEQ ID NO: 1062039 - RNA, 17 nt, Homo sapiens
cuuaauaacaacagauc

SEQ ID NO: 1062040 - RNA, 11 nt, Homo sapiens
cuuaaucacac

SEQ ID NO: 1062041 - RNA, 16 nt, Homo sapiens
cuuaaucuuuucacaa

SEQ ID NO: 1062042 - RNA, 22 nt, Homo sapiens
cuuaauggcucaugaccuggaa

SEQ ID NO: 1062043 - RNA, 14 nt, Homo sapiens
cuuaauuuucagua

SEQ ID NO: 1062044 - RNA, 14 nt, Homo sapiens
cuuacaaacaugug

SEQ ID NO: 1062045 - RNA, 15 nt, Homo sapiens
cuuacaauucccugc

SEQ ID NO: 1062046 - RNA, 20 nt, Homo sapiens
cuuacacuuuaugcacaaaa

SEQ ID NO: 1062047 - RNA, 20 nt, Homo sapiens
cuuacauuugaaaucuauga

SEQ ID NO: 1062048 - RNA, 15 nt, Homo sapiens
cuuaccaacuuucug

SEQ ID NO: 1062049 - RNA, 18 nt, Homo sapiens
cuuaccagaagcuuccau

SEQ ID NO: 1062050 - RNA, 18 nt, Homo sapiens
cuuacccuccuccagacc

SEQ ID NO: 1062051 - RNA, 19 nt, Homo sapiens
cuuaccuagauucuacaua

SEQ ID NO: 1062052 - RNA, 16 nt, Homo sapiens
cuuaccucacagugau

SEQ ID NO: 1062053 - RNA, 21 nt, Homo sapiens
cuuacugcaaccuuugccucc

SEQ ID NO: 1062054 - RNA, 17 nt, Homo sapiens
cuuacuuuggaauacau

SEQ ID NO: 1062055 - RNA, 21 nt, Homo sapiens
cuuagacacguguuguuccac

SEQ ID NO: 1062056 - RNA, 20 nt, Homo sapiens
cuuagaguuaccacacccca

SEQ ID NO: 1062057 - RNA, 20 nt, Homo sapiens
cuuagauuagcucuggacca

SEQ ID NO: 1062058 - RNA, 18 nt, Homo sapiens
cuuagcacacucacagau

SEQ ID NO: 1062059 - RNA, 22 nt, Homo sapiens
aaagcaaacacuuacagaauua

SEQ ID NO: 1062060 - RNA, 13 nt, Homo sapiens
aaagcaaauguga

SEQ ID NO: 1062061 - RNA, 16 nt, Homo sapiens
aaagcaaugcacuccu

SEQ ID NO: 1062062 - RNA, 12 nt, Homo sapiens
aaagcacacuca

SEQ ID NO: 1062063 - RNA, 23 nt, Homo sapiens
aaagcacuuggacucuugcucuu

SEQ ID NO: 1062064 - RNA, 16 nt, Homo sapiens
aaagcagauaccucac

SEQ ID NO: 1062065 - RNA, 19 nt, Homo sapiens
aaagcagguggcaucucua

SEQ ID NO: 1062066 - RNA, 14 nt, Homo sapiens
aaagcauccaugug

SEQ ID NO: 1062067 - RNA, 22 nt, Homo sapiens
aaagcauccauguguggacuca

SEQ ID NO: 1062068 - RNA, 20 nt, Homo sapiens
aaagcauguggcauguucau

SEQ ID NO: 1062069 - RNA, 15 nt, Homo sapiens
aaagccaacagucaa

SEQ ID NO: 1062070 - RNA, 13 nt, Homo sapiens
aaagccacacucu

SEQ ID NO: 1062071 - RNA, 14 nt, Homo sapiens
aaagccaccacauu

SEQ ID NO: 1062072 - RNA, 19 nt, Homo sapiens
aaagccaccucucccucaa

SEQ ID NO: 1062073 - RNA, 15 nt, Homo sapiens
aaagccaucaaacac

SEQ ID NO: 1062074 - RNA, 14 nt, Homo sapiens
aaagcccuugaacc

SEQ ID NO: 1062075 - RNA, 15 nt, Homo sapiens
aaagcccuugaacca

SEQ ID NO: 1062076 - RNA, 17 nt, Homo sapiens
aaagcccuugaaccagc

SEQ ID NO: 1062077 - RNA, 23 nt, Homo sapiens
aaagccuuaucaagugucuucca

SEQ ID NO: 1062078 - RNA, 17 nt, Homo sapiens
aaagccuuuuccagaag

SEQ ID NO: 1062079 - RNA, 20 nt, Homo sapiens
aaagcuacuugaaggacaca

SEQ ID NO: 1062080 - RNA, 13 nt, Homo sapiens
aaagcucaucuca

SEQ ID NO: 1062081 - RNA, 20 nt, Homo sapiens
aaagcucuauuaagauuucc

SEQ ID NO: 1062082 - RNA, 13 nt, Homo sapiens
aaagcugccugua

SEQ ID NO: 1062083 - RNA, 12 nt, Homo sapiens
aaagcugcucag

SEQ ID NO: 1062084 - RNA, 14 nt, Homo sapiens
aaagcugcucaggg

SEQ ID NO: 1062085 - RNA, 18 nt, Homo sapiens
aaagcuucuaucccagga

SEQ ID NO: 1062086 - RNA, 17 nt, Homo sapiens
aaaggacuccacccauc

SEQ ID NO: 1062087 - RNA, 16 nt, Homo sapiens
aaaggagaacuaucca

SEQ ID NO: 1062088 - RNA, 17 nt, Homo sapiens
aaaggagaacuauccaa

SEQ ID NO: 1062089 - RNA, 13 nt, Homo sapiens
aaaggcacaguga

SEQ ID NO: 1062090 - RNA, 14 nt, Homo sapiens
aaaggccaggguca

SEQ ID NO: 1062091 - RNA, 17 nt, Homo sapiens
aaagggagcacuggguu

SEQ ID NO: 1062092 - RNA, 17 nt, Homo sapiens
aaagggcugaaagccau

SEQ ID NO: 1062093 - RNA, 14 nt, Homo sapiens
aaagguccuggcaa

SEQ ID NO: 1062094 - RNA, 16 nt, Homo sapiens
aaagguggugccaauu

SEQ ID NO: 1062095 - RNA, 16 nt, Homo sapiens
aaagguuacccuguaa

SEQ ID NO: 1062096 - RNA, 13 nt, Homo sapiens
aaaguagccacgu

SEQ ID NO: 1062097 - RNA, 23 nt, Homo sapiens
aaagucagugcccaacuguuaua

SEQ ID NO: 1062098 - RNA, 14 nt, Homo sapiens
aaagucaucaaaga

SEQ ID NO: 1062099 - RNA, 19 nt, Homo sapiens
aaaguccaauuccaaagcc

SEQ ID NO: 1062100 - RNA, 15 nt, Homo sapiens
aaaguccacaguuua

SEQ ID NO: 1062101 - RNA, 18 nt, Homo sapiens
aaagucuacauacuuuca

SEQ ID NO: 1062102 - RNA, 21 nt, Homo sapiens
aaagucuaccccugcuaagga

SEQ ID NO: 1062103 - RNA, 22 nt, Homo sapiens
aaagucuuugaagugacuucac

SEQ ID NO: 1062104 - RNA, 14 nt, Homo sapiens
aaagugacuauuca

SEQ ID NO: 1062105 - RNA, 23 nt, Homo sapiens
aaagugacucacuuaucccaaga

SEQ ID NO: 1062106 - RNA, 19 nt, Homo sapiens
aaagugagacuccgucaca

SEQ ID NO: 1062107 - RNA, 9 nt, Homo sapiens
aaagugaug

SEQ ID NO: 1062108 - RNA, 18 nt, Homo sapiens
aaagugcauuaaacugaa

SEQ ID NO: 1062109 - RNA, 12 nt, Homo sapiens
aaagugcugcug

SEQ ID NO: 1062110 - RNA, 19 nt, Homo sapiens
aaaguguguuucuauguga

SEQ ID NO: 1062111 - RNA, 17 nt, Homo sapiens
aaaguguugaccacaga

SEQ ID NO: 1062112 - RNA, 15 nt, Homo sapiens
aaaguuaaaagcaaa

SEQ ID NO: 1062113 - RNA, 16 nt, Homo sapiens
aaaguuccaugaauuc

SEQ ID NO: 1062114 - RNA, 22 nt, Homo sapiens
aaaguuccaugaauucuugauu

SEQ ID NO: 1062115 - RNA, 17 nt, Homo sapiens
aaaguuucucuuuucaa

SEQ ID NO: 1062116 - RNA, 12 nt, Homo sapiens
aaaguuugcuca

SEQ ID NO: 1062117 - RNA, 14 nt, Homo sapiens
aaaguuugcucaag

SEQ ID NO: 1062118 - RNA, 15 nt, Homo sapiens
aaauaaaaaccaaga

SEQ ID NO: 1062119 - RNA, 13 nt, Homo sapiens
aaauaaaaauucc

SEQ ID NO: 1062120 - RNA, 13 nt, Homo sapiens
aaauaaaacuguu

SEQ ID NO: 1062121 - RNA, 21 nt, Homo sapiens
aaauaacuaggcguggacuua

SEQ ID NO: 1062122 - RNA, 15 nt, Homo sapiens
aaauaagaaugauuu

SEQ ID NO: 1062123 - RNA, 23 nt, Homo sapiens
aaauaagacggauuuauuuuucc

SEQ ID NO: 1062124 - RNA, 17 nt, Homo sapiens
aaauaagccagacauca

SEQ ID NO: 1062125 - RNA, 19 nt, Homo sapiens
aaauaauaaacaguggaau

SEQ ID NO: 1062126 - RNA, 22 nt, Homo sapiens
aaauacaguucugaauaugcug

SEQ ID NO: 1062127 - RNA, 17 nt, Homo sapiens
aaauaccagugaaccaa

SEQ ID NO: 1062128 - RNA, 19 nt, Homo sapiens
aaauaccagugaaccaaag

SEQ ID NO: 1062129 - RNA, 20 nt, Homo sapiens
aaauaccagugaaccaaaga

SEQ ID NO: 1062130 - RNA, 15 nt, Homo sapiens
aaauacucaugugua

SEQ ID NO: 1062131 - RNA, 15 nt, Homo sapiens
aaauacuguguuuca

SEQ ID NO: 1062132 - RNA, 15 nt, Homo sapiens
aaauagaaacuugcu

SEQ ID NO: 1062133 - RNA, 17 nt, Homo sapiens
aaauagagccugaggga

SEQ ID NO: 1062134 - RNA, 19 nt, Homo sapiens
aaauagcuauauccaugua

SEQ ID NO: 1062135 - RNA, 15 nt, Homo sapiens
aaauauaauaugcac

SEQ ID NO: 1062136 - RNA, 13 nt, Homo sapiens
aaauauacauuca

SEQ ID NO: 1062137 - RNA, 15 nt, Homo sapiens
aaauauauaugauau

SEQ ID NO: 1062138 - RNA, 14 nt, Homo sapiens
aaauauauuucaga

SEQ ID NO: 1062139 - RNA, 20 nt, Homo sapiens
aaauaugauuuuauuugaca

SEQ ID NO: 1062140 - RNA, 12 nt, Homo sapiens
aaauaugcagug

SEQ ID NO: 1062141 - RNA, 11 nt, Homo sapiens
aaauauguaac

SEQ ID NO: 1062142 - RNA, 17 nt, Homo sapiens
aaauauuagaugugauu

SEQ ID NO: 1062143 - RNA, 20 nt, Homo sapiens
aaauauuauugguguuuacc

SEQ ID NO: 1062144 - RNA, 22 nt, Homo sapiens
aaauauuauugguguuuaccca

SEQ ID NO: 1062145 - RNA, 12 nt, Homo sapiens
aaauauuucagg

SEQ ID NO: 1062146 - RNA, 18 nt, Homo sapiens
aaauauuugacaggcuua

SEQ ID NO: 1062147 - RNA, 21 nt, Homo sapiens
aaauauuuucauacagcauua

SEQ ID NO: 1062148 - RNA, 19 nt, Homo sapiens
aaaucaaauaugcaaagca

SEQ ID NO: 1062149 - RNA, 15 nt, Homo sapiens
aaaucaaugucacuu

SEQ ID NO: 1062150 - RNA, 23 nt, Homo sapiens
aaaucauaguuuaaacugcauua

SEQ ID NO: 1062151 - RNA, 22 nt, Homo sapiens
aaauccaucuaaauaccugccc

SEQ ID NO: 1062152 - RNA, 15 nt, Homo sapiens
aaaucccuccuucau

SEQ ID NO: 1062153 - RNA, 21 nt, Homo sapiens
aaauccgaaccuccucuguga

SEQ ID NO: 1062154 - RNA, 23 nt, Homo sapiens
aaaucggaucuggggcucuggga

SEQ ID NO: 1062155 - RNA, 16 nt, Homo sapiens
aaaucuagaagacugu

SEQ ID NO: 1062156 - RNA, 16 nt, Homo sapiens
aaaucuauagaacuga

SEQ ID NO: 1062157 - RNA, 18 nt, Homo sapiens
aaaucuaugaaauaucau

SEQ ID NO: 1062158 - RNA, 23 nt, Homo sapiens
aaaucucacuuuucuccaugagu

SEQ ID NO: 1062159 - RNA, 13 nt, Homo sapiens
aaaucucuaauau

SEQ ID NO: 1062160 - RNA, 12 nt, Homo sapiens
aaaucuguaaau

SEQ ID NO: 1062161 - RNA, 17 nt, Homo sapiens
aaaucugugccugagaa

SEQ ID NO: 1062162 - RNA, 22 nt, Homo sapiens
aaaucuuaaaagcccuaaguga

SEQ ID NO: 1062163 - RNA, 14 nt, Homo sapiens
aaaucuugcaacug

SEQ ID NO: 1062164 - RNA, 19 nt, Homo sapiens
aaaucuuguuggcaaauca

SEQ ID NO: 1062165 - RNA, 15 nt, Homo sapiens
aaaugaaagcaugug

SEQ ID NO: 1062166 - RNA, 21 nt, Homo sapiens
aaaugaagguuaggauuuaac

SEQ ID NO: 1062167 - RNA, 17 nt, Homo sapiens
aaaugaaguauuucuca

SEQ ID NO: 1062168 - RNA, 20 nt, Homo sapiens
gcccaugugugagugugugc

SEQ ID NO: 1062169 - RNA, 22 nt, Homo sapiens
gcccauuaggucuggcaugccc

SEQ ID NO: 1062170 - RNA, 16 nt, Homo sapiens
gccccaaaaccacagc

SEQ ID NO: 1062171 - RNA, 23 nt, Homo sapiens
gccccagauaccagccccuguau

SEQ ID NO: 1062172 - RNA, 18 nt, Homo sapiens
gccccaucagcuccagcu

SEQ ID NO: 1062173 - RNA, 15 nt, Homo sapiens
gccccaugccugucc

SEQ ID NO: 1062174 - RNA, 13 nt, Homo sapiens
gcccccaacagca

SEQ ID NO: 1062175 - RNA, 19 nt, Homo sapiens
gcccccagggcacuucaca

SEQ ID NO: 1062176 - RNA, 18 nt, Homo sapiens
gcccccauuguggucaca

SEQ ID NO: 1062177 - RNA, 13 nt, Homo sapiens
gcccccccuucca

SEQ ID NO: 1062178 - RNA, 20 nt, Homo sapiens
gcccccgagcugggggccau

SEQ ID NO: 1062179 - RNA, 16 nt, Homo sapiens
gcccccuccucuagcu

SEQ ID NO: 1062180 - RNA, 16 nt, Homo sapiens
gccccgccgccuggua

SEQ ID NO: 1062181 - RNA, 20 nt, Homo sapiens
gccccgucuguggcuuucag

SEQ ID NO: 1062182 - RNA, 12 nt, Homo sapiens
gccccucuccca

SEQ ID NO: 1062183 - RNA, 19 nt, Homo sapiens
gccccucugaccugcacug

SEQ ID NO: 1062184 - RNA, 17 nt, Homo sapiens
gccccucugcccagcuu

SEQ ID NO: 1062185 - RNA, 15 nt, Homo sapiens
gccccugcccggcug

SEQ ID NO: 1062186 - RNA, 20 nt, Homo sapiens
gccccuguaacccuacucuc

SEQ ID NO: 1062187 - RNA, 21 nt, Homo sapiens
gccccuguucucuuccacucu

SEQ ID NO: 1062188 - RNA, 22 nt, Homo sapiens
gccccuguucucuuccacucuc

SEQ ID NO: 1062189 - RNA, 14 nt, Homo sapiens
gcccgagccaggaa

SEQ ID NO: 1062190 - RNA, 16 nt, Homo sapiens
gcccggggcagcugcc

SEQ ID NO: 1062191 - RNA, 16 nt, Homo sapiens
gcccuaaaagcacacu

SEQ ID NO: 1062192 - RNA, 20 nt, Homo sapiens
gcccuaaaagcacacucauc

SEQ ID NO: 1062193 - RNA, 21 nt, Homo sapiens
gcccuaccugauuggugcaac

SEQ ID NO: 1062194 - RNA, 14 nt, Homo sapiens
gcccucagauuccg

SEQ ID NO: 1062195 - RNA, 21 nt, Homo sapiens
gcccuccacgccggcucuucc

SEQ ID NO: 1062196 - RNA, 15 nt, Homo sapiens
gcccucccuuggaaa

SEQ ID NO: 1062197 - RNA, 14 nt, Homo sapiens
gcccuccgccauuc

SEQ ID NO: 1062198 - RNA, 23 nt, Homo sapiens
gcccucuaugguguggcaaagcc

SEQ ID NO: 1062199 - RNA, 18 nt, Homo sapiens
gcccugcaccugacagcu

SEQ ID NO: 1062200 - RNA, 17 nt, Homo sapiens
gcccugcaccugugcag

SEQ ID NO: 1062201 - RNA, 12 nt, Homo sapiens
gcccugcuccuc

SEQ ID NO: 1062202 - RNA, 14 nt, Homo sapiens
gcccuggauccauc

SEQ ID NO: 1062203 - RNA, 18 nt, Homo sapiens
gcccuggccucugcucaa

SEQ ID NO: 1062204 - RNA, 20 nt, Homo sapiens
gcccuggcuggaguucagug

SEQ ID NO: 1062205 - RNA, 21 nt, Homo sapiens
gcucacccaagcaaggccaaa

SEQ ID NO: 1062206 - RNA, 20 nt, Homo sapiens
gcucacgccuguaauuccag

SEQ ID NO: 1062207 - RNA, 17 nt, Homo sapiens
gcucacgucacacuugg

SEQ ID NO: 1062208 - RNA, 14 nt, Homo sapiens
gcucacugcagccu

SEQ ID NO: 1062209 - RNA, 20 nt, Homo sapiens
gcucacuguggugucugugu

SEQ ID NO: 1062210 - RNA, 18 nt, Homo sapiens
gcucacuguucuauucau

SEQ ID NO: 1062211 - RNA, 17 nt, Homo sapiens
gcucacuuggugauaug

SEQ ID NO: 1062212 - RNA, 17 nt, Homo sapiens
gcucagaucucauggga

SEQ ID NO: 1062213 - RNA, 14 nt, Homo sapiens
gcucagcacuuugg

SEQ ID NO: 1062214 - RNA, 19 nt, Homo sapiens
gcucagcccugacuggugc

SEQ ID NO: 1062215 - RNA, 14 nt, Homo sapiens
gcucagcgccagcc

SEQ ID NO: 1062216 - RNA, 16 nt, Homo sapiens
gcucaggaccaggcaa

SEQ ID NO: 1062217 - RNA, 22 nt, Homo sapiens
gcucaggaggcuuggaaagcau

SEQ ID NO: 1062218 - RNA, 18 nt, Homo sapiens
gcucagggaaaagcagcu

SEQ ID NO: 1062219 - RNA, 19 nt, Homo sapiens
gcucagggaauaauccaga

SEQ ID NO: 1062220 - RNA, 15 nt, Homo sapiens
gcucagucucaggag

SEQ ID NO: 1062221 - RNA, 18 nt, Homo sapiens
gcucauauuguucccuau

SEQ ID NO: 1062222 - RNA, 10 nt, Homo sapiens
gcucaugccc

SEQ ID NO: 1062223 - RNA, 20 nt, Homo sapiens
gcucauugcaagcucaagug

SEQ ID NO: 1062224 - RNA, 12 nt, Homo sapiens
gcucauuucacu

SEQ ID NO: 1062225 - RNA, 11 nt, Homo sapiens
gcucauuucag

SEQ ID NO: 1062226 - RNA, 21 nt, Homo sapiens
gcuccacacccucucccagga

SEQ ID NO: 1062227 - RNA, 12 nt, Homo sapiens
gcuccacucuga

SEQ ID NO: 1062228 - RNA, 20 nt, Homo sapiens
gcuccauguagaagccacua

SEQ ID NO: 1062229 - RNA, 15 nt, Homo sapiens
gcucccaagggaugg

SEQ ID NO: 1062230 - RNA, 23 nt, Homo sapiens
gcucccaagggauggugcccugu

SEQ ID NO: 1062231 - RNA, 18 nt, Homo sapiens
gcucccgcccgugguguu

SEQ ID NO: 1062232 - RNA, 17 nt, Homo sapiens
gcucccuaggagaccaa

SEQ ID NO: 1062233 - RNA, 17 nt, Homo sapiens
gcucccugcccugaccu

SEQ ID NO: 1062234 - RNA, 14 nt, Homo sapiens
gcucccuguccuag

SEQ ID NO: 1062235 - RNA, 17 nt, Homo sapiens
gcucccuguucuugggu

SEQ ID NO: 1062236 - RNA, 13 nt, Homo sapiens
gcuccugcuccac

SEQ ID NO: 1062237 - RNA, 15 nt, Homo sapiens
gcuccuucuguccua

SEQ ID NO: 1062238 - RNA, 14 nt, Homo sapiens
gcuccuugacuccu

SEQ ID NO: 1062239 - RNA, 15 nt, Homo sapiens
gcucgagcaguccug

SEQ ID NO: 1062240 - RNA, 16 nt, Homo sapiens
gcucgcuuugagugac

SEQ ID NO: 1062241 - RNA, 20 nt, Homo sapiens
gcucuaacaaugacauuuau

SEQ ID NO: 1062242 - RNA, 14 nt, Homo sapiens
gcucuacaucuucu

SEQ ID NO: 1062243 - RNA, 22 nt, Homo sapiens
gcucuagagaaaagucuacccc

SEQ ID NO: 1062244 - RNA, 17 nt, Homo sapiens
gcucuauguuuguauau

SEQ ID NO: 1062245 - RNA, 16 nt, Homo sapiens
gcucucacuccaggac

SEQ ID NO: 1062246 - RNA, 18 nt, Homo sapiens
gcucucacuccaggacag

SEQ ID NO: 1062247 - RNA, 12 nt, Homo sapiens
gcucucagcuca

SEQ ID NO: 1062248 - RNA, 16 nt, Homo sapiens
gcucucauggggucca

SEQ ID NO: 1062249 - RNA, 18 nt, Homo sapiens
gcucucuauagcaccagg

SEQ ID NO: 1062250 - RNA, 17 nt, Homo sapiens
gcucugaccgaaacagc

SEQ ID NO: 1062251 - RNA, 20 nt, Homo sapiens
gcucugcagacugcugcuag

SEQ ID NO: 1062252 - RNA, 14 nt, Homo sapiens
gcucugccucccau

SEQ ID NO: 1062253 - RNA, 21 nt, Homo sapiens
gcucugcgccgagccucagaa

SEQ ID NO: 1062254 - RNA, 16 nt, Homo sapiens
gcucugcugacagaca

SEQ ID NO: 1062255 - RNA, 17 nt, Homo sapiens
gcucugggauagcugac

SEQ ID NO: 1062256 - RNA, 14 nt, Homo sapiens
gcucugucacccag

SEQ ID NO: 1062257 - RNA, 20 nt, Homo sapiens
gcucugucuucuuugcccac

SEQ ID NO: 1062258 - RNA, 13 nt, Homo sapiens
gcucuuaggugcu

SEQ ID NO: 1062259 - RNA, 14 nt, Homo sapiens
gcucuucugcccaa

SEQ ID NO: 1062260 - RNA, 11 nt, Homo sapiens
gcucuugcccu

SEQ ID NO: 1062261 - RNA, 19 nt, Homo sapiens
gcucuuggcuccacuggga

SEQ ID NO: 1062262 - RNA, 17 nt, Homo sapiens
gcucuugggaaauaugu

SEQ ID NO: 1062263 - RNA, 22 nt, Homo sapiens
gcugaacgcguguguacacggg

SEQ ID NO: 1062264 - RNA, 21 nt, Homo sapiens
gcugaaggaaaccagugcaac

SEQ ID NO: 1062265 - RNA, 22 nt, Homo sapiens
gcugaaugacggcaaacucagu

SEQ ID NO: 1062266 - RNA, 15 nt, Homo sapiens
gcugacggaagccaa

SEQ ID NO: 1062267 - RNA, 14 nt, Homo sapiens
gcugagaacacugu

SEQ ID NO: 1062268 - RNA, 19 nt, Homo sapiens
gcugagauuauaggcauga

SEQ ID NO: 1062269 - RNA, 23 nt, Homo sapiens
gcugagcagguguucuucauuac

SEQ ID NO: 1062270 - RNA, 14 nt, Homo sapiens
gcugaggacacuca

SEQ ID NO: 1062271 - RNA, 16 nt, Homo sapiens
gcugaggcaagagaau

SEQ ID NO: 1062272 - RNA, 18 nt, Homo sapiens
gcugaggccucucauucc

SEQ ID NO: 1062273 - RNA, 23 nt, Homo sapiens
gcugaggcggguggaucaccuga

SEQ ID NO: 1062274 - RNA, 16 nt, Homo sapiens
gcugagggaccagcca

SEQ ID NO: 1062275 - RNA, 23 nt, Homo sapiens
gcugagggugagugggugaauaa

SEQ ID NO: 1062276 - RNA, 22 nt, Homo sapiens
gcugauacaaauugcagacugu

SEQ ID NO: 1062277 - RNA, 12 nt, Homo sapiens
gcugcaaucaca

SEQ ID NO: 1062278 - RNA, 14 nt, Homo sapiens
gcugcagaaggcca

SEQ ID NO: 1062279 - RNA, 20 nt, Homo sapiens
gcugcagugacgugcaccug

SEQ ID NO: 1062280 - RNA, 12 nt, Homo sapiens
gcugcauaguau

SEQ ID NO: 1062281 - RNA, 15 nt, Homo sapiens
gcugcauaguauucc

SEQ ID NO: 1062282 - RNA, 20 nt, Homo sapiens
gcugccccaaccugcugaag

SEQ ID NO: 1062283 - RNA, 22 nt, Homo sapiens
gcugcccuggcccugaggugug

SEQ ID NO: 1062284 - RNA, 20 nt, Homo sapiens
gcugccuaguuaccaugaac

SEQ ID NO: 1062285 - RNA, 15 nt, Homo sapiens
gcugccucacuuccu

SEQ ID NO: 1062286 - RNA, 11 nt, Homo sapiens
gcugccucuug

SEQ ID NO: 1062287 - RNA, 20 nt, Homo sapiens
gcugccugguauauccaaaa

SEQ ID NO: 1062288 - RNA, 20 nt, Homo sapiens
gcugcugacccagccuguuu

SEQ ID NO: 1062289 - RNA, 15 nt, Homo sapiens
gcugcuugcugcuca

SEQ ID NO: 1062290 - RNA, 20 nt, Homo sapiens
gcuggagcauaguggcaaga

SEQ ID NO: 1062291 - RNA, 20 nt, Homo sapiens
gcuggagccuggugcccuaa

SEQ ID NO: 1062292 - RNA, 15 nt, Homo sapiens
gcuggaggcacccau

SEQ ID NO: 1062293 - RNA, 14 nt, Homo sapiens
gcuggcgugcagug

SEQ ID NO: 1062294 - RNA, 21 nt, Homo sapiens
gcugggauguuucugucacau

SEQ ID NO: 1062295 - RNA, 18 nt, Homo sapiens
gcugggcagaaggccaag

SEQ ID NO: 1062296 - RNA, 12 nt, Homo sapiens
gcugggcagcua

SEQ ID NO: 1062297 - RNA, 14 nt, Homo sapiens
gcuggggagggaga

SEQ ID NO: 1062298 - RNA, 17 nt, Homo sapiens
gcuggguggcacugcca

SEQ ID NO: 1062299 - RNA, 14 nt, Homo sapiens
gcugguggcaauaa

SEQ ID NO: 1062300 - RNA, 17 nt, Homo sapiens
gcuguaaggcaugaagg

SEQ ID NO: 1062301 - RNA, 16 nt, Homo sapiens
gcuguacuugaugaca

SEQ ID NO: 1062302 - RNA, 13 nt, Homo sapiens
gcugucaucucag

SEQ ID NO: 1062303 - RNA, 17 nt, Homo sapiens
gcugugaaagaaccaaa

SEQ ID NO: 1062304 - RNA, 20 nt, Homo sapiens
gcugugaucggccuggggaa

SEQ ID NO: 1062305 - RNA, 21 nt, Homo sapiens
gcugugguagggggugucuca

SEQ ID NO: 1062306 - RNA, 15 nt, Homo sapiens
gcuguucaccaccau

SEQ ID NO: 1062307 - RNA, 13 nt, Homo sapiens
gcuguugcauggg

SEQ ID NO: 1062308 - RNA, 20 nt, Homo sapiens
gcuguuguguuguuguuauu

SEQ ID NO: 1062309 - RNA, 15 nt, Homo sapiens
gcuuacaaaugucua

SEQ ID NO: 1062310 - RNA, 19 nt, Homo sapiens
gcuuacacggaugccuucc

SEQ ID NO: 1062311 - RNA, 21 nt, Homo sapiens
gcuuaccagaagcuuccauag

SEQ ID NO: 1062312 - RNA, 13 nt, Homo sapiens
gcuuacugcgcua

SEQ ID NO: 1062313 - RNA, 13 nt, Homo sapiens
gcuuagaccucag

SEQ ID NO: 1062314 - RNA, 21 nt, Homo sapiens
gcuuagacuaaggccauuauu

SEQ ID NO: 1062315 - RNA, 16 nt, Homo sapiens
gcuuagccuccugacc

SEQ ID NO: 1062316 - RNA, 14 nt, Homo sapiens
gcuuagcuugaggg

SEQ ID NO: 1062317 - RNA, 14 nt, Homo sapiens
gcuuaggauguuuu

SEQ ID NO: 1062318 - RNA, 16 nt, Homo sapiens
gcuuaguuaucagcuu

SEQ ID NO: 1062319 - RNA, 14 nt, Homo sapiens
gcuuauaaaaucaa

SEQ ID NO: 1062320 - RNA, 21 nt, Homo sapiens
gcuuaucaguaguaucaauga

SEQ ID NO: 1062321 - RNA, 20 nt, Homo sapiens
gcuuauucaucuguuuuucu

SEQ ID NO: 1062322 - RNA, 18 nt, Homo sapiens
gcuucaccagagcauuuc

SEQ ID NO: 1062323 - RNA, 14 nt, Homo sapiens
gcuucagcaucucc

SEQ ID NO: 1062324 - RNA, 15 nt, Homo sapiens
gcuucagcaucuccu

SEQ ID NO: 1062325 - RNA, 18 nt, Homo sapiens
gcuucaguggcagcugcu

SEQ ID NO: 1062326 - RNA, 18 nt, Homo sapiens
gcuucaguuuuacucugc

SEQ ID NO: 1062327 - RNA, 16 nt, Homo sapiens
aacccaggagcaucca

SEQ ID NO: 1062328 - RNA, 14 nt, Homo sapiens
aaccccuucuuuac

SEQ ID NO: 1062329 - RNA, 22 nt, Homo sapiens
aacccugcguggggacagggcu

SEQ ID NO: 1062330 - RNA, 20 nt, Homo sapiens
aacccuggagaguucaaugg

SEQ ID NO: 1062331 - RNA, 22 nt, Homo sapiens
aacccuggaucaguccuuugau

SEQ ID NO: 1062332 - RNA, 20 nt, Homo sapiens
aacccuucagauuugccuua

SEQ ID NO: 1062333 - RNA, 19 nt, Homo sapiens
aacccuuuugucugccucu

SEQ ID NO: 1062334 - RNA, 22 nt, Homo sapiens
aaccgaugcuccagccaacccc

SEQ ID NO: 1062335 - RNA, 14 nt, Homo sapiens
aaccgauucaucuc

SEQ ID NO: 1062336 - RNA, 17 nt, Homo sapiens
aaccgcaggaagcugcu

SEQ ID NO: 1062337 - RNA, 20 nt, Homo sapiens
aaccguuuccuuucauuuac

SEQ ID NO: 1062338 - RNA, 23 nt, Homo sapiens
aaccuaugauauuuucugugccu

SEQ ID NO: 1062339 - RNA, 12 nt, Homo sapiens
aaccucauucuc

SEQ ID NO: 1062340 - RNA, 14 nt, Homo sapiens
aaccuccacauguu

SEQ ID NO: 1062341 - RNA, 13 nt, Homo sapiens
aaccuccacugcu

SEQ ID NO: 1062342 - RNA, 16 nt, Homo sapiens
aaccucccccaggugc

SEQ ID NO: 1062343 - RNA, 13 nt, Homo sapiens
aaccucuaugcaa

SEQ ID NO: 1062344 - RNA, 19 nt, Homo sapiens
aaccucugagucaccaucu

SEQ ID NO: 1062345 - RNA, 13 nt, Homo sapiens
aaccugcucuccu

SEQ ID NO: 1062346 - RNA, 21 nt, Homo sapiens
aaccuggagagcuagaaccua

SEQ ID NO: 1062347 - RNA, 22 nt, Homo sapiens
aaccuggaggggcuagaaccua

SEQ ID NO: 1062348 - RNA, 23 nt, Homo sapiens
aaccuguaaagcaggugcccagg

SEQ ID NO: 1062349 - RNA, 20 nt, Homo sapiens
aaccuucauccuagcacuaa

SEQ ID NO: 1062350 - RNA, 22 nt, Homo sapiens
gcuuggaaaggaccaguaugcu

SEQ ID NO: 1062351 - RNA, 18 nt, Homo sapiens
gcuuggcugugcccucag

SEQ ID NO: 1062352 - RNA, 21 nt, Homo sapiens
gcuuguaaaauuucacuuaau

SEQ ID NO: 1062353 - RNA, 20 nt, Homo sapiens
gcuuguaaauagcucaggug

SEQ ID NO: 1062354 - RNA, 21 nt, Homo sapiens
gcuuguaaugguucuuuacac

SEQ ID NO: 1062355 - RNA, 20 nt, Homo sapiens
gcuuguacagaagagacagu

SEQ ID NO: 1062356 - RNA, 21 nt, Homo sapiens
gcuuguuuacagcacuacucu

SEQ ID NO: 1062357 - RNA, 17 nt, Homo sapiens
gcuuuaaacucagggac

SEQ ID NO: 1062358 - RNA, 22 nt, Homo sapiens
gcuuuaaacucagggacagagc

SEQ ID NO: 1062359 - RNA, 23 nt, Homo sapiens
gcuuuaauuguuaagauaugaug

SEQ ID NO: 1062360 - RNA, 13 nt, Homo sapiens
gcuuuaauuucau

SEQ ID NO: 1062361 - RNA, 13 nt, Homo sapiens
gcuuuagggcaau

SEQ ID NO: 1062362 - RNA, 19 nt, Homo sapiens
gcuuuauacguguagcuau

SEQ ID NO: 1062363 - RNA, 19 nt, Homo sapiens
gcuuuccguggcacugcau

SEQ ID NO: 1062364 - RNA, 23 nt, Homo sapiens
gcuuucugucuccuuaacacuga

SEQ ID NO: 1062365 - RNA, 12 nt, Homo sapiens
gcuuucuucuac

SEQ ID NO: 1062366 - RNA, 19 nt, Homo sapiens
gcuuugacucaccuguuac

SEQ ID NO: 1062367 - RNA, 14 nt, Homo sapiens
gcuuugcacuuuuc

SEQ ID NO: 1062368 - RNA, 15 nt, Homo sapiens
gcuuugcagugacag

SEQ ID NO: 1062369 - RNA, 18 nt, Homo sapiens
gcuuuuccugauguucca

SEQ ID NO: 1062370 - RNA, 19 nt, Homo sapiens
ggaaaaaccaauagcuuua

SEQ ID NO: 1062371 - RNA, 13 nt, Homo sapiens
ggaaaacaguauu

SEQ ID NO: 1062372 - RNA, 17 nt, Homo sapiens
ggaaaagaaacacgcac

SEQ ID NO: 1062373 - RNA, 16 nt, Homo sapiens
ggaaaagaggaguuuc

SEQ ID NO: 1062374 - RNA, 14 nt, Homo sapiens
ggaaaaucucagca

SEQ ID NO: 1062375 - RNA, 17 nt, Homo sapiens
ggaaaaugugacccaga

SEQ ID NO: 1062376 - RNA, 22 nt, Homo sapiens
ggaaaaugugcaauaugugaug

SEQ ID NO: 1062377 - RNA, 14 nt, Homo sapiens
ggaaaccaguguag

SEQ ID NO: 1062378 - RNA, 22 nt, Homo sapiens
ggaaacugaucauuaaagccug

SEQ ID NO: 1062379 - RNA, 14 nt, Homo sapiens
ggaaagaugagcuu

SEQ ID NO: 1062380 - RNA, 16 nt, Homo sapiens
ggaaagcaucaccuca

SEQ ID NO: 1062381 - RNA, 13 nt, Homo sapiens
ggaaagccaguga

SEQ ID NO: 1062382 - RNA, 17 nt, Homo sapiens
ggaaagggauaguccaa

SEQ ID NO: 1062383 - RNA, 15 nt, Homo sapiens
ggaaagguaguguau

SEQ ID NO: 1062384 - RNA, 17 nt, Homo sapiens
ggaaaguaaauauuuca

SEQ ID NO: 1062385 - RNA, 23 nt, Homo sapiens
ggaaaguaaauauuucaggcaua

SEQ ID NO: 1062386 - RNA, 21 nt, Homo sapiens
ggaaauauuaagaaagacuau

SEQ ID NO: 1062387 - RNA, 16 nt, Homo sapiens
ggaacaagccuaaaaa

SEQ ID NO: 1062388 - RNA, 13 nt, Homo sapiens
ggaacacaaugac

SEQ ID NO: 1062389 - RNA, 18 nt, Homo sapiens
ggaacacugcacucuuaa

SEQ ID NO: 1062390 - RNA, 13 nt, Homo sapiens
ggaacagaauguu

SEQ ID NO: 1062391 - RNA, 15 nt, Homo sapiens
ggaacaugcguguga

SEQ ID NO: 1062392 - RNA, 22 nt, Homo sapiens
ggaacuagagggauacacugaa

SEQ ID NO: 1062393 - RNA, 18 nt, Homo sapiens
ggaacuagccaccaacuc

SEQ ID NO: 1062394 - RNA, 14 nt, Homo sapiens
ggaacucucuccac

SEQ ID NO: 1062395 - RNA, 23 nt, Homo sapiens
ggaacugggccaacucaccugag

SEQ ID NO: 1062396 - RNA, 10 nt, Homo sapiens
ggaacuuccu

SEQ ID NO: 1062397 - RNA, 17 nt, Homo sapiens
ggaagaguguacugggg

SEQ ID NO: 1062398 - RNA, 14 nt, Homo sapiens
ggaagcgagcuuug

SEQ ID NO: 1062399 - RNA, 23 nt, Homo sapiens
ggaagcgagcuuugcugggagag

SEQ ID NO: 1062400 - RNA, 21 nt, Homo sapiens
ggaagcuccgcuuucuaccca

SEQ ID NO: 1062401 - RNA, 17 nt, Homo sapiens
ggaagcucugaagucac

SEQ ID NO: 1062402 - RNA, 21 nt, Homo sapiens
ggaagcuuccaguccaaucuc

SEQ ID NO: 1062403 - RNA, 14 nt, Homo sapiens
ggaaggagugagau

SEQ ID NO: 1062404 - RNA, 13 nt, Homo sapiens
ggaagggacacca

SEQ ID NO: 1062405 - RNA, 17 nt, Homo sapiens
ggaagggggcugggaca

SEQ ID NO: 1062406 - RNA, 17 nt, Homo sapiens
ggaagguucuacgccag

SEQ ID NO: 1062407 - RNA, 15 nt, Homo sapiens
ggaaguaccaagaac

SEQ ID NO: 1062408 - RNA, 17 nt, Homo sapiens
ggaagucagcaugccuc

SEQ ID NO: 1062409 - RNA, 16 nt, Homo sapiens
ggaagucgagggaugg

SEQ ID NO: 1062410 - RNA, 23 nt, Homo sapiens
ggaagugaagagggagaagggau

SEQ ID NO: 1062411 - RNA, 20 nt, Homo sapiens
ggaagugggacuggcacuau

SEQ ID NO: 1062412 - RNA, 15 nt, Homo sapiens
ggaaguguaacagcu

SEQ ID NO: 1062413 - RNA, 17 nt, Homo sapiens
ggaagugugugaucugu

SEQ ID NO: 1062414 - RNA, 15 nt, Homo sapiens
ggaaguucaacuucc

SEQ ID NO: 1062415 - RNA, 12 nt, Homo sapiens
ggaaguuuucag

SEQ ID NO: 1062416 - RNA, 15 nt, Homo sapiens
ggaauaaggccuuaa

SEQ ID NO: 1062417 - RNA, 12 nt, Homo sapiens
ggaauaaucucc

SEQ ID NO: 1062418 - RNA, 21 nt, Homo sapiens
ggaauauaaggaaagcaauaa

SEQ ID NO: 1062419 - RNA, 21 nt, Homo sapiens
ggaauccuggggaacauagaa

SEQ ID NO: 1062420 - RNA, 11 nt, Homo sapiens
ggaaugggcug

SEQ ID NO: 1062421 - RNA, 13 nt, Homo sapiens
ggaauucaucucu

SEQ ID NO: 1062422 - RNA, 19 nt, Homo sapiens
ggaauuucuguucuuccau

SEQ ID NO: 1062423 - RNA, 21 nt, Homo sapiens
ggacaaaccgagugcaaugaa

SEQ ID NO: 1062424 - RNA, 14 nt, Homo sapiens
ggacaaagccuuug

SEQ ID NO: 1062425 - RNA, 20 nt, Homo sapiens
ggacaaggaugaucuaggaa

SEQ ID NO: 1062426 - RNA, 15 nt, Homo sapiens
ggacaccaagccuug

SEQ ID NO: 1062427 - RNA, 20 nt, Homo sapiens
ggacaccccuuauccaggac

SEQ ID NO: 1062428 - RNA, 18 nt, Homo sapiens
ggacacuaauacaccagg

SEQ ID NO: 1062429 - RNA, 18 nt, Homo sapiens
ggacaggauaagagggau

SEQ ID NO: 1062430 - RNA, 15 nt, Homo sapiens
ggacaggcauguucu

SEQ ID NO: 1062431 - RNA, 17 nt, Homo sapiens
ggacaguccugggagaa

SEQ ID NO: 1062432 - RNA, 12 nt, Homo sapiens
ggacauggcuca

SEQ ID NO: 1062433 - RNA, 20 nt, Homo sapiens
ggacauugccuuuucuagcc

SEQ ID NO: 1062434 - RNA, 18 nt, Homo sapiens
ggacauuuuuucagucau

SEQ ID NO: 1062435 - RNA, 13 nt, Homo sapiens
ggaccacaccucc

SEQ ID NO: 1062436 - RNA, 15 nt, Homo sapiens
ggacccagccugaga

SEQ ID NO: 1062437 - RNA, 12 nt, Homo sapiens
ggaccucaggug

SEQ ID NO: 1062438 - RNA, 19 nt, Homo sapiens
ggaccuuccugccaccagu

SEQ ID NO: 1062439 - RNA, 19 nt, Homo sapiens
ggacgagacccuacaggag

SEQ ID NO: 1062440 - RNA, 20 nt, Homo sapiens
ggacuaaguguaccagagaa

SEQ ID NO: 1062441 - RNA, 22 nt, Homo sapiens
ggacucaaugcacugacauugu

SEQ ID NO: 1062442 - RNA, 21 nt, Homo sapiens
ggacuccccaggccaggccac

SEQ ID NO: 1062443 - RNA, 19 nt, Homo sapiens
ggacugaagggguucucac

SEQ ID NO: 1062444 - RNA, 22 nt, Homo sapiens
ggacuggaucccagcagugaug

SEQ ID NO: 1062445 - RNA, 15 nt, Homo sapiens
ggacuggcacuauuu

SEQ ID NO: 1062446 - RNA, 12 nt, Homo sapiens
ggacuuccuccc

SEQ ID NO: 1062447 - RNA, 13 nt, Homo sapiens
ggacuuccuugcu

SEQ ID NO: 1062448 - RNA, 17 nt, Homo sapiens
ggacuucuggcagggaa

SEQ ID NO: 1062449 - RNA, 18 nt, Homo sapiens
ggacuuuuauugugaauu

SEQ ID NO: 1062450 - RNA, 17 nt, Homo sapiens
ggagaaaugacuuugaa

SEQ ID NO: 1062451 - RNA, 12 nt, Homo sapiens
ggagaagccauu

SEQ ID NO: 1062452 - RNA, 16 nt, Homo sapiens
ggagaagccguggccu

SEQ ID NO: 1062453 - RNA, 15 nt, Homo sapiens
ggagaaucacuugaa

SEQ ID NO: 1062454 - RNA, 16 nt, Homo sapiens
ggagaauugcuugaac

SEQ ID NO: 1062455 - RNA, 19 nt, Homo sapiens
ggagacacuggccccucaa

SEQ ID NO: 1062456 - RNA, 17 nt, Homo sapiens
ggagaccuggcacugga

SEQ ID NO: 1062457 - RNA, 21 nt, Homo sapiens
ggagacuagauuuaugaauac

SEQ ID NO: 1062458 - RNA, 15 nt, Homo sapiens
ggagacucguggacu

SEQ ID NO: 1062459 - RNA, 13 nt, Homo sapiens
ggagagaacugaa

SEQ ID NO: 1062460 - RNA, 14 nt, Homo sapiens
ggagagaacugaau

SEQ ID NO: 1062461 - RNA, 14 nt, Homo sapiens
ggagagaaguuucu

SEQ ID NO: 1062462 - RNA, 15 nt, Homo sapiens
ggagagagugcuauu

SEQ ID NO: 1062463 - RNA, 23 nt, Homo sapiens
ggagagcccggcgccccugccac

SEQ ID NO: 1062464 - RNA, 16 nt, Homo sapiens
ggagaggagcgggacc

SEQ ID NO: 1062465 - RNA, 18 nt, Homo sapiens
ggagaggucgugaggcca

SEQ ID NO: 1062466 - RNA, 11 nt, Homo sapiens
ggagaguucaa

SEQ ID NO: 1062467 - RNA, 14 nt, Homo sapiens
ggagaugggaugcu

SEQ ID NO: 1062468 - RNA, 12 nt, Homo sapiens
ggagcacugggu

SEQ ID NO: 1062469 - RNA, 19 nt, Homo sapiens
ggagcaugggccuggccac

SEQ ID NO: 1062470 - RNA, 16 nt, Homo sapiens
ggagccaaguccagau

SEQ ID NO: 1062471 - RNA, 21 nt, Homo sapiens
ggagccuggcuccguccagga

SEQ ID NO: 1062472 - RNA, 20 nt, Homo sapiens
ggagcugggcagaaggccaa

SEQ ID NO: 1062473 - RNA, 19 nt, Homo sapiens
ggaggaagugauaguuucu

SEQ ID NO: 1062474 - RNA, 15 nt, Homo sapiens
ggaggaccagagcua

SEQ ID NO: 1062475 - RNA, 19 nt, Homo sapiens
ggaggccagccagugaccu

SEQ ID NO: 1062476 - RNA, 13 nt, Homo sapiens
ggaggcugcagug

SEQ ID NO: 1062477 - RNA, 18 nt, Homo sapiens
ggaggcuuccccucacua

SEQ ID NO: 1062478 - RNA, 20 nt, Homo sapiens
ggaggugaccccagguuucu

SEQ ID NO: 1062479 - RNA, 22 nt, Homo sapiens
ggaggugcuuaagcagaagcau

SEQ ID NO: 1062480 - RNA, 20 nt, Homo sapiens
aagacauaaauuacuuuuuc

SEQ ID NO: 1062481 - RNA, 22 nt, Homo sapiens
aagacauaacguuuuuccuuua

SEQ ID NO: 1062482 - RNA, 16 nt, Homo sapiens
aagacauccugagcag

SEQ ID NO: 1062483 - RNA, 12 nt, Homo sapiens
aagacaugauua

SEQ ID NO: 1062484 - RNA, 17 nt, Homo sapiens
aagaccacacauuugug

SEQ ID NO: 1062485 - RNA, 16 nt, Homo sapiens
aagaccagcuuugcag

SEQ ID NO: 1062486 - RNA, 13 nt, Homo sapiens
aagacuacugaag

SEQ ID NO: 1062487 - RNA, 17 nt, Homo sapiens
aagacuauauuguacac

SEQ ID NO: 1062488 - RNA, 15 nt, Homo sapiens
aagacucauuacuac

SEQ ID NO: 1062489 - RNA, 22 nt, Homo sapiens
aagacucuacccauauuacaga

SEQ ID NO: 1062490 - RNA, 21 nt, Homo sapiens
aagacugaguacguugugcau

SEQ ID NO: 1062491 - RNA, 22 nt, Homo sapiens
aagacugaguacguugugcauu

SEQ ID NO: 1062492 - RNA, 15 nt, Homo sapiens
aagacuguugcucaa

SEQ ID NO: 1062493 - RNA, 19 nt, Homo sapiens
aagacuuuggaaagacuuu

SEQ ID NO: 1062494 - RNA, 22 nt, Homo sapiens
aagagaauauuagcuuuacugu

SEQ ID NO: 1062495 - RNA, 22 nt, Homo sapiens
acuuuguuuagcccaaaaccaa

SEQ ID NO: 1062496 - RNA, 15 nt, Homo sapiens
acuuuuaaguacuua

SEQ ID NO: 1062497 - RNA, 22 nt, Homo sapiens
acuuuuaaguugcugaugaacu

SEQ ID NO: 1062498 - RNA, 14 nt, Homo sapiens
acuuuuaauuaaau

SEQ ID NO: 1062499 - RNA, 18 nt, Homo sapiens
acuuuuuaccuaguacaa

SEQ ID NO: 1062500 - RNA, 16 nt, Homo sapiens
agaaaaaaacuucuuu

SEQ ID NO: 1062501 - RNA, 15 nt, Homo sapiens
agaaaaaacacacuc

SEQ ID NO: 1062502 - RNA, 16 nt, Homo sapiens
agaaaaaacacacucc

SEQ ID NO: 1062503 - RNA, 17 nt, Homo sapiens
agaaaaaggaugcacag

SEQ ID NO: 1062504 - RNA, 12 nt, Homo sapiens
agaaaaauuauu

SEQ ID NO: 1062505 - RNA, 19 nt, Homo sapiens
agaaaagcaguggcuccau

SEQ ID NO: 1062506 - RNA, 15 nt, Homo sapiens
agaaaagccucucca

SEQ ID NO: 1062507 - RNA, 21 nt, Homo sapiens
agaaaaguagguuuacauuca

SEQ ID NO: 1062508 - RNA, 18 nt, Homo sapiens
agaaaagugaaugcucaa

SEQ ID NO: 1062509 - RNA, 21 nt, Homo sapiens
agaaaauaguuuggauuacuu

SEQ ID NO: 1062510 - RNA, 13 nt, Homo sapiens
agaaaauucuaaa

SEQ ID NO: 1062511 - RNA, 13 nt, Homo sapiens
agaaacacugggc

SEQ ID NO: 1062512 - RNA, 15 nt, Homo sapiens
agaaaccuaaaauaa

SEQ ID NO: 1062513 - RNA, 21 nt, Homo sapiens
agaaaccuuauuguaccucuc

SEQ ID NO: 1062514 - RNA, 22 nt, Homo sapiens
agaaaccuucauccuagcacua

SEQ ID NO: 1062515 - RNA, 19 nt, Homo sapiens
agaaacguuuggaacaauc

SEQ ID NO: 1062516 - RNA, 19 nt, Homo sapiens
agaaacugcucuaauauca

SEQ ID NO: 1062517 - RNA, 12 nt, Homo sapiens
agaaacuuuauu

SEQ ID NO: 1062518 - RNA, 23 nt, Homo sapiens
agaaagcaaaugugaccuguguc

SEQ ID NO: 1062519 - RNA, 23 nt, Homo sapiens
agaaagccgggcaugacggcuca

SEQ ID NO: 1062520 - RNA, 20 nt, Homo sapiens
agaaagccuucauaagccua

SEQ ID NO: 1062521 - RNA, 15 nt, Homo sapiens
agaaagcucaucuca

SEQ ID NO: 1062522 - RNA, 14 nt, Homo sapiens
agaaaguacuucuc

SEQ ID NO: 1062523 - RNA, 22 nt, Homo sapiens
agaaaguacuucuccacccugc

SEQ ID NO: 1062524 - RNA, 18 nt, Homo sapiens
agaaauaaaaauaccucu

SEQ ID NO: 1062525 - RNA, 19 nt, Homo sapiens
agaaauaaaaauaccucuu

SEQ ID NO: 1062526 - RNA, 20 nt, Homo sapiens
agaaauaauaugcauuguca

SEQ ID NO: 1062527 - RNA, 13 nt, Homo sapiens
agaaauacuuuca

SEQ ID NO: 1062528 - RNA, 23 nt, Homo sapiens
agaaaucauaguuuaaacugcau

SEQ ID NO: 1062529 - RNA, 16 nt, Homo sapiens
agaaaucugugccuga

SEQ ID NO: 1062530 - RNA, 19 nt, Homo sapiens
agaaaucugugccugagaa

SEQ ID NO: 1062531 - RNA, 18 nt, Homo sapiens
agaaaugaugauguggaa

SEQ ID NO: 1062532 - RNA, 12 nt, Homo sapiens
agaaauguacaa

SEQ ID NO: 1062533 - RNA, 15 nt, Homo sapiens
agaaauugcaauaac

SEQ ID NO: 1062534 - RNA, 16 nt, Homo sapiens
agaaauuuaaaagaca

SEQ ID NO: 1062535 - RNA, 16 nt, Homo sapiens
agaacaacuacuguga

SEQ ID NO: 1062536 - RNA, 18 nt, Homo sapiens
agaacaccagagaccuca

SEQ ID NO: 1062537 - RNA, 13 nt, Homo sapiens
agaacaguuugua

SEQ ID NO: 1062538 - RNA, 17 nt, Homo sapiens
agaacauggacuuguau

SEQ ID NO: 1062539 - RNA, 14 nt, Homo sapiens
agaaccaaaagaga

SEQ ID NO: 1062540 - RNA, 12 nt, Homo sapiens
agaaccaaaggg

SEQ ID NO: 1062541 - RNA, 17 nt, Homo sapiens
agaaccacucauaauuc

SEQ ID NO: 1062542 - RNA, 16 nt, Homo sapiens
agaacuauaugugaau

SEQ ID NO: 1062543 - RNA, 12 nt, Homo sapiens
agaacuauccaa

SEQ ID NO: 1062544 - RNA, 18 nt, Homo sapiens
agaacucugggcugcuac

SEQ ID NO: 1062545 - RNA, 15 nt, Homo sapiens
agaacugaagcucuu

SEQ ID NO: 1062546 - RNA, 18 nt, Homo sapiens
agaacugaauaaacagga

SEQ ID NO: 1062547 - RNA, 13 nt, Homo sapiens
agaacugagcucc

SEQ ID NO: 1062548 - RNA, 19 nt, Homo sapiens
agaacugcuugaacccagg

SEQ ID NO: 1062549 - RNA, 23 nt, Homo sapiens
agaacuggaaagacauagccaac

SEQ ID NO: 1062550 - RNA, 14 nt, Homo sapiens
agaacuugaccccc

SEQ ID NO: 1062551 - RNA, 16 nt, Homo sapiens
uacagcacuacucugu

SEQ ID NO: 1062552 - RNA, 24 nt, Homo sapiens
uacagcagcaugcauucauaacag

SEQ ID NO: 1062553 - RNA, 14 nt, Homo sapiens
uacagccaaagaua

SEQ ID NO: 1062554 - RNA, 19 nt, Homo sapiens
uacagcuuugugacuguau

SEQ ID NO: 1062555 - RNA, 17 nt, Homo sapiens
uacaggaagcaccccau

SEQ ID NO: 1062556 - RNA, 15 nt, Homo sapiens
uacaggagugagcac

SEQ ID NO: 1062557 - RNA, 19 nt, Homo sapiens
uacaggccauacuuuacaa

SEQ ID NO: 1062558 - RNA, 20 nt, Homo sapiens
uacaggccuugcucacagcu

SEQ ID NO: 1062559 - RNA, 17 nt, Homo sapiens
uacaggugugagucacc

SEQ ID NO: 1062560 - RNA, 15 nt, Homo sapiens
uacagucugucauga

SEQ ID NO: 1062561 - RNA, 22 nt, Homo sapiens
uacagugaugcugugcuaugaa

SEQ ID NO: 1062562 - RNA, 16 nt, Homo sapiens
uacaguguauguacua

SEQ ID NO: 1062563 - RNA, 18 nt, Homo sapiens
uacaguugaaagcuguau

SEQ ID NO: 1062564 - RNA, 18 nt, Homo sapiens
uacaguugcauguuauau

SEQ ID NO: 1062565 - RNA, 15 nt, Homo sapiens
uacauaaaguaugug

SEQ ID NO: 1062566 - RNA, 22 nt, Homo sapiens
uacauaacugaaaaugugcuau

SEQ ID NO: 1062567 - RNA, 14 nt, Homo sapiens
uacauaaucuguac

SEQ ID NO: 1062568 - RNA, 17 nt, Homo sapiens
uacauaaugcgugcaua

SEQ ID NO: 1062569 - RNA, 20 nt, Homo sapiens
uacauacaggccauacuuua

SEQ ID NO: 1062570 - RNA, 13 nt, Homo sapiens
uacauacugcugu

SEQ ID NO: 1062571 - RNA, 17 nt, Homo sapiens
uacauauuuguggaaua

SEQ ID NO: 1062572 - RNA, 14 nt, Homo sapiens
uacaucuuucacau

SEQ ID NO: 1062573 - RNA, 13 nt, Homo sapiens
uacaugcauuuga

SEQ ID NO: 1062574 - RNA, 16 nt, Homo sapiens
uacaugcuuugugaac

SEQ ID NO: 1062575 - RNA, 16 nt, Homo sapiens
uacauguguagccugu

SEQ ID NO: 1062576 - RNA, 16 nt, Homo sapiens
uacauucaacagauca

SEQ ID NO: 1062577 - RNA, 16 nt, Homo sapiens
uacauucugcuuucau

SEQ ID NO: 1062578 - RNA, 13 nt, Homo sapiens
uacauucuugcua

SEQ ID NO: 1062579 - RNA, 14 nt, Homo sapiens
uacauucuugcuaa

SEQ ID NO: 1062580 - RNA, 20 nt, Homo sapiens
uacauucuugcuaauucuca

SEQ ID NO: 1062581 - RNA, 19 nt, Homo sapiens
uacauucuuuaucuugaca

SEQ ID NO: 1062582 - RNA, 20 nt, Homo sapiens
uacauucuuuaucuugacau

SEQ ID NO: 1062583 - RNA, 15 nt, Homo sapiens
uacauuuaauacagc

SEQ ID NO: 1062584 - RNA, 16 nt, Homo sapiens
uacauuuccaaauuca

SEQ ID NO: 1062585 - RNA, 19 nt, Homo sapiens
uacauuuccaaauucacaa

SEQ ID NO: 1062586 - RNA, 17 nt, Homo sapiens
uacauuucccugugcug

SEQ ID NO: 1062587 - RNA, 18 nt, Homo sapiens
uacauuucccugugcuga

SEQ ID NO: 1062588 - RNA, 19 nt, Homo sapiens
uacauuuggccucugcccu

SEQ ID NO: 1062589 - RNA, 16 nt, Homo sapiens
uaccaaaauuauuuca

SEQ ID NO: 1062590 - RNA, 14 nt, Homo sapiens
uaccaaugcaugca

SEQ ID NO: 1062591 - RNA, 12 nt, Homo sapiens
uaccacaguguc

SEQ ID NO: 1062592 - RNA, 18 nt, Homo sapiens
uaccacaugccaagcacu

SEQ ID NO: 1062593 - RNA, 16 nt, Homo sapiens
uaccacugcacccagc

SEQ ID NO: 1062594 - RNA, 20 nt, Homo sapiens
uaccagacgguucaccagcc

SEQ ID NO: 1062595 - RNA, 22 nt, Homo sapiens
uaccagacuguguauucauuga

SEQ ID NO: 1062596 - RNA, 15 nt, Homo sapiens
uaccagcaucuccca

SEQ ID NO: 1062597 - RNA, 21 nt, Homo sapiens
uaccaguauaauugaguuuuc

SEQ ID NO: 1062598 - RNA, 16 nt, Homo sapiens
uaccagugaaccaaag

SEQ ID NO: 1062599 - RNA, 18 nt, Homo sapiens
uaccagugaaccaaagag

SEQ ID NO: 1062600 - RNA, 15 nt, Homo sapiens
uaccaucugcaucca

SEQ ID NO: 1062601 - RNA, 22 nt, Homo sapiens
uacccaagcaaaaucauggaau

SEQ ID NO: 1062602 - RNA, 20 nt, Homo sapiens
uacccagagaauauauacau

SEQ ID NO: 1062603 - RNA, 13 nt, Homo sapiens
uaccccugaucug

SEQ ID NO: 1062604 - RNA, 22 nt, Homo sapiens
uaccccugcuaaggaguucuca

SEQ ID NO: 1062605 - RNA, 15 nt, Homo sapiens
uacccucccuuugaa

SEQ ID NO: 1062606 - RNA, 18 nt, Homo sapiens
uacccugcgauuuugccu

SEQ ID NO: 1062607 - RNA, 18 nt, Homo sapiens
uacccuguaacaugcaau

SEQ ID NO: 1062608 - RNA, 22 nt, Homo sapiens
uaccgauguuaauuauuuugac

SEQ ID NO: 1062609 - RNA, 17 nt, Homo sapiens
uaccguguugguuuuga

SEQ ID NO: 1062610 - RNA, 17 nt, Homo sapiens
uaccuaccacagugucu

SEQ ID NO: 1062611 - RNA, 14 nt, Homo sapiens
uaccuacugcugag

SEQ ID NO: 1062612 - RNA, 20 nt, Homo sapiens
uaccuagagcaggcacuuga

SEQ ID NO: 1062613 - RNA, 21 nt, Homo sapiens
uaccuagcaaagcuccugccu

SEQ ID NO: 1062614 - RNA, 18 nt, Homo sapiens
uaccuaguacaaggcaac

SEQ ID NO: 1062615 - RNA, 18 nt, Homo sapiens
uaccuaguagucauuuca

SEQ ID NO: 1062616 - RNA, 13 nt, Homo sapiens
uaccucagguugc

SEQ ID NO: 1062617 - RNA, 17 nt, Homo sapiens
uaccucugauaccucaa

SEQ ID NO: 1062618 - RNA, 19 nt, Homo sapiens
uaccucugaucaaguauuu

SEQ ID NO: 1062619 - RNA, 16 nt, Homo sapiens
uaccucuuaacaauuu

SEQ ID NO: 1062620 - RNA, 14 nt, Homo sapiens
uaccugacacuccc

SEQ ID NO: 1062621 - RNA, 16 nt, Homo sapiens
uaccugaucaaugaca

SEQ ID NO: 1062622 - RNA, 15 nt, Homo sapiens
uaccugcccugacau

SEQ ID NO: 1062623 - RNA, 12 nt, Homo sapiens
uaccugccucag

SEQ ID NO: 1062624 - RNA, 19 nt, Homo sapiens
uaccuggcccugugccuug

SEQ ID NO: 1062625 - RNA, 14 nt, Homo sapiens
uaccugggugauua

SEQ ID NO: 1062626 - RNA, 22 nt, Homo sapiens
uaccuuaaaauguaaaacaaaa

SEQ ID NO: 1062627 - RNA, 23 nt, Homo sapiens
uaccuuagauuagcucuggacca

SEQ ID NO: 1062628 - RNA, 17 nt, Homo sapiens
uaccuugagccaguaau

SEQ ID NO: 1062629 - RNA, 13 nt, Homo sapiens
uaccuugugcuaa

SEQ ID NO: 1062630 - RNA, 23 nt, Homo sapiens
uaccuuuguaacggcucuuagca

SEQ ID NO: 1062631 - RNA, 19 nt, Homo sapiens
uaccuuuuuauuugcaugu

SEQ ID NO: 1062632 - RNA, 17 nt, Homo sapiens
uacgcauggcuuccucc

SEQ ID NO: 1062633 - RNA, 15 nt, Homo sapiens
uacgucaaagcagua

SEQ ID NO: 1062634 - RNA, 15 nt, Homo sapiens
uacguuaccaggcag

SEQ ID NO: 1062635 - RNA, 19 nt, Homo sapiens
uacguuugaaauaguugau

SEQ ID NO: 1062636 - RNA, 16 nt, Homo sapiens
uacuaaaaauacagaa

SEQ ID NO: 1062637 - RNA, 12 nt, Homo sapiens
uacuaauccagc

SEQ ID NO: 1062638 - RNA, 13 nt, Homo sapiens
uacuaaucuuucu

SEQ ID NO: 1062639 - RNA, 13 nt, Homo sapiens
uacuaauugucua

SEQ ID NO: 1062640 - RNA, 18 nt, Homo sapiens
agaugggaugcuugccua

SEQ ID NO: 1062641 - RNA, 22 nt, Homo sapiens
agaugggggaaagcacaggugg

SEQ ID NO: 1062642 - RNA, 16 nt, Homo sapiens
agauguauauauuucc

SEQ ID NO: 1062643 - RNA, 16 nt, Homo sapiens
agaugugucuauggcu

SEQ ID NO: 1062644 - RNA, 22 nt, Homo sapiens
agaugugugauucacaguguga

SEQ ID NO: 1062645 - RNA, 20 nt, Homo sapiens
agauguucagauugcuuuga

SEQ ID NO: 1062646 - RNA, 19 nt, Homo sapiens
agauguucuaagucuuucc

SEQ ID NO: 1062647 - RNA, 23 nt, Homo sapiens
agauuaagagauggguuugacaa

SEQ ID NO: 1062648 - RNA, 19 nt, Homo sapiens
agauuacuuuuucuuuaug

SEQ ID NO: 1062649 - RNA, 19 nt, Homo sapiens
agauuagucucuucugugu

SEQ ID NO: 1062650 - RNA, 22 nt, Homo sapiens
agauuauagaaguagcaaaaag

SEQ ID NO: 1062651 - RNA, 12 nt, Homo sapiens
agauuaucuggg

SEQ ID NO: 1062652 - RNA, 22 nt, Homo sapiens
agauuauuuuuaaauaauuuaa

SEQ ID NO: 1062653 - RNA, 14 nt, Homo sapiens
agauucacacuguc

SEQ ID NO: 1062654 - RNA, 22 nt, Homo sapiens
agauucagguauguugccuuua

SEQ ID NO: 1062655 - RNA, 22 nt, Homo sapiens
agauucauuauuuuuccacuuu

SEQ ID NO: 1062656 - RNA, 22 nt, Homo sapiens
agauuccugguuaaauuugaau

SEQ ID NO: 1062657 - RNA, 14 nt, Homo sapiens
agauucuaccacac

SEQ ID NO: 1062658 - RNA, 23 nt, Homo sapiens
agauugaucaaaguguaaacacc

SEQ ID NO: 1062659 - RNA, 17 nt, Homo sapiens
agauugcaccacugcac

SEQ ID NO: 1062660 - RNA, 17 nt, Homo sapiens
agauugcgccauugcac

SEQ ID NO: 1062661 - RNA, 22 nt, Homo sapiens
agauugugccacuucacuccag

SEQ ID NO: 1062662 - RNA, 15 nt, Homo sapiens
agauuuaaagcacau

SEQ ID NO: 1062663 - RNA, 16 nt, Homo sapiens
agauuuaaagcacaug

SEQ ID NO: 1062664 - RNA, 17 nt, Homo sapiens
agauuuaacaauuccaa

SEQ ID NO: 1062665 - RNA, 22 nt, Homo sapiens
agauuuaauccuagagauuugg

SEQ ID NO: 1062666 - RNA, 13 nt, Homo sapiens
agauuugccuuau

SEQ ID NO: 1062667 - RNA, 18 nt, Homo sapiens
agauuuuguauucagggg

SEQ ID NO: 1062668 - RNA, 13 nt, Homo sapiens
agcaaacuaagcc

SEQ ID NO: 1062669 - RNA, 12 nt, Homo sapiens
agcaaagacuuu

SEQ ID NO: 1062670 - RNA, 14 nt, Homo sapiens
agcaaagagugggc

SEQ ID NO: 1062671 - RNA, 16 nt, Homo sapiens
agcaaaggcugagaac

SEQ ID NO: 1062672 - RNA, 23 nt, Homo sapiens
agcaaaggcugagaacacuguga

SEQ ID NO: 1062673 - RNA, 17 nt, Homo sapiens
agcaaaguuuuaccugu

SEQ ID NO: 1062674 - RNA, 20 nt, Homo sapiens
agcaaauguuucugcaguag

SEQ ID NO: 1062675 - RNA, 24 nt, Homo sapiens
agcaacagauggauagucugucca

SEQ ID NO: 1062676 - RNA, 17 nt, Homo sapiens
agcaaccuccacauguu

SEQ ID NO: 1062677 - RNA, 16 nt, Homo sapiens
agcaacucuaagacua

SEQ ID NO: 1062678 - RNA, 21 nt, Homo sapiens
agcaacucugagaucuaagga

SEQ ID NO: 1062679 - RNA, 22 nt, Homo sapiens
agcaacugaauaaauaccucuu

SEQ ID NO: 1062680 - RNA, 17 nt, Homo sapiens
agcaacuguuaugaaau

SEQ ID NO: 1062681 - RNA, 14 nt, Homo sapiens
agcaagacacaucc

SEQ ID NO: 1062682 - RNA, 18 nt, Homo sapiens
agcaagccgagcucuccu

SEQ ID NO: 1062683 - RNA, 16 nt, Homo sapiens
agcaagucacuggcca

SEQ ID NO: 1062684 - RNA, 14 nt, Homo sapiens
agcaauacaaagac

SEQ ID NO: 1062685 - RNA, 18 nt, Homo sapiens
agcaauacagacuacuuc

SEQ ID NO: 1062686 - RNA, 22 nt, Homo sapiens
agcaauauaucugaagagcuau

SEQ ID NO: 1062687 - RNA, 17 nt, Homo sapiens
agcaaugacaucucagg

SEQ ID NO: 1062688 - RNA, 14 nt, Homo sapiens
agcaaugaugucca

SEQ ID NO: 1062689 - RNA, 19 nt, Homo sapiens
agcaaugcccguaaugcuu

SEQ ID NO: 1062690 - RNA, 19 nt, Homo sapiens
agcaauuauugugccucag

SEQ ID NO: 1062691 - RNA, 22 nt, Homo sapiens
agcaauuuaauauuuugcacag

SEQ ID NO: 1062692 - RNA, 19 nt, Homo sapiens
agcacaagugguagguuaa

SEQ ID NO: 1062693 - RNA, 14 nt, Homo sapiens
agcacacacuuuug

SEQ ID NO: 1062694 - RNA, 17 nt, Homo sapiens
agcacacuuaugggcca

SEQ ID NO: 1062695 - RNA, 18 nt, Homo sapiens
agcacagcacccauggga

SEQ ID NO: 1062696 - RNA, 23 nt, Homo sapiens
agcacaggugggcuucccagugg

SEQ ID NO: 1062697 - RNA, 19 nt, Homo sapiens
agcacauucuggcucaggg

SEQ ID NO: 1062698 - RNA, 13 nt, Homo sapiens
agcaccaagcuca

SEQ ID NO: 1062699 - RNA, 15 nt, Homo sapiens
agcaccacccuaguc

SEQ ID NO: 1062700 - RNA, 16 nt, Homo sapiens
agcaccauaacuuugu

SEQ ID NO: 1062701 - RNA, 14 nt, Homo sapiens
agcaccauuaacuc

SEQ ID NO: 1062702 - RNA, 15 nt, Homo sapiens
agcacccaagccagg

SEQ ID NO: 1062703 - RNA, 14 nt, Homo sapiens
agcaccccuugccg

SEQ ID NO: 1062704 - RNA, 15 nt, Homo sapiens
agcacguggagcucu

SEQ ID NO: 1062705 - RNA, 13 nt, Homo sapiens
agcacgugucuca

SEQ ID NO: 1062706 - RNA, 22 nt, Homo sapiens
agcacugcccaaagugcuucca

SEQ ID NO: 1062707 - RNA, 14 nt, Homo sapiens
agcagaaaugccuu

SEQ ID NO: 1062708 - RNA, 15 nt, Homo sapiens
agcagaagcacauau

SEQ ID NO: 1062709 - RNA, 20 nt, Homo sapiens
agcagaagcacauaugaacu

SEQ ID NO: 1062710 - RNA, 23 nt, Homo sapiens
agcagaccaccccgccugcccuc

SEQ ID NO: 1062711 - RNA, 15 nt, Homo sapiens
uauaguccagcuuug

SEQ ID NO: 1062712 - RNA, 15 nt, Homo sapiens
uauagugacaaugaa

SEQ ID NO: 1062713 - RNA, 21 nt, Homo sapiens
uauagugucuugggaauuuuc

SEQ ID NO: 1062714 - RNA, 16 nt, Homo sapiens
uauaguuuauugacaa

SEQ ID NO: 1062715 - RNA, 21 nt, Homo sapiens
uauaguuuauugacaauaauu

SEQ ID NO: 1062716 - RNA, 18 nt, Homo sapiens
uauaguuugcuguugcau

SEQ ID NO: 1062717 - RNA, 19 nt, Homo sapiens
uauauaauaaagcuacuga

SEQ ID NO: 1062718 - RNA, 17 nt, Homo sapiens
uauauagguugugcaaa

SEQ ID NO: 1062719 - RNA, 13 nt, Homo sapiens
uauauauucccaa

SEQ ID NO: 1062720 - RNA, 20 nt, Homo sapiens
uauauauuucuuuguuauca

SEQ ID NO: 1062721 - RNA, 20 nt, Homo sapiens
uauauauuuuugugcacauu

SEQ ID NO: 1062722 - RNA, 14 nt, Homo sapiens
uauaucaaucucuc

SEQ ID NO: 1062723 - RNA, 17 nt, Homo sapiens
uauaucaaucucucuua

SEQ ID NO: 1062724 - RNA, 19 nt, Homo sapiens
uauaucaguccucuuucaa

SEQ ID NO: 1062725 - RNA, 13 nt, Homo sapiens
uauaucaucagca

SEQ ID NO: 1062726 - RNA, 15 nt, Homo sapiens
uauaucccauugaaa

SEQ ID NO: 1062727 - RNA, 11 nt, Homo sapiens
uauaugcucug

SEQ ID NO: 1062728 - RNA, 13 nt, Homo sapiens
uauauguacuugu

SEQ ID NO: 1062729 - RNA, 13 nt, Homo sapiens
uauauguaugugu

SEQ ID NO: 1062730 - RNA, 16 nt, Homo sapiens
uauauuaugauugcau

SEQ ID NO: 1062731 - RNA, 16 nt, Homo sapiens
uauauucauccaugcc

SEQ ID NO: 1062732 - RNA, 19 nt, Homo sapiens
uauauuugaaguggagcca

SEQ ID NO: 1062733 - RNA, 22 nt, Homo sapiens
uauauuuuuuaaaauaacuuca

SEQ ID NO: 1062734 - RNA, 15 nt, Homo sapiens
uaucaaaaaguauua

SEQ ID NO: 1062735 - RNA, 16 nt, Homo sapiens
uaucaaaaaguauuaa

SEQ ID NO: 1062736 - RNA, 21 nt, Homo sapiens
uaucaaauauuagaugugauu

SEQ ID NO: 1062737 - RNA, 14 nt, Homo sapiens
uaucaacagcauuu

SEQ ID NO: 1062738 - RNA, 16 nt, Homo sapiens
uaucaaguguauuuga

SEQ ID NO: 1062739 - RNA, 16 nt, Homo sapiens
uaucaaucaguauaau

SEQ ID NO: 1062740 - RNA, 22 nt, Homo sapiens
uaucaccagagagggacugaca

SEQ ID NO: 1062741 - RNA, 17 nt, Homo sapiens
uaucaccgugggcuccc

SEQ ID NO: 1062742 - RNA, 15 nt, Homo sapiens
uaucaccucauggcc

SEQ ID NO: 1062743 - RNA, 14 nt, Homo sapiens
uaucacgauauuau

SEQ ID NO: 1062744 - RNA, 18 nt, Homo sapiens
uaucacucccacuuccuu

SEQ ID NO: 1062745 - RNA, 18 nt, Homo sapiens
uaucacuuccacugcacc

SEQ ID NO: 1062746 - RNA, 13 nt, Homo sapiens
uaucaguccaaag

SEQ ID NO: 1062747 - RNA, 21 nt, Homo sapiens
uaucaguugagcuucauauac

SEQ ID NO: 1062748 - RNA, 19 nt, Homo sapiens
uaucauuuucugcauuuaa

SEQ ID NO: 1062749 - RNA, 14 nt, Homo sapiens
uauccaacaugugc

SEQ ID NO: 1062750 - RNA, 13 nt, Homo sapiens
uauccaccaccuc

SEQ ID NO: 1062751 - RNA, 24 nt, Homo sapiens
uauccacuuaccuagauucuacau

SEQ ID NO: 1062752 - RNA, 18 nt, Homo sapiens
uaucccauugaaacaaaa

SEQ ID NO: 1062753 - RNA, 19 nt, Homo sapiens
uauccuguuuuuaaaccau

SEQ ID NO: 1062754 - RNA, 13 nt, Homo sapiens
uaucgaucucuua

SEQ ID NO: 1062755 - RNA, 17 nt, Homo sapiens
uaucuccagauggaaug

SEQ ID NO: 1062756 - RNA, 16 nt, Homo sapiens
uaucugaaaugugaua

SEQ ID NO: 1062757 - RNA, 14 nt, Homo sapiens
uaucugaggucaca

SEQ ID NO: 1062758 - RNA, 20 nt, Homo sapiens
uaucuggggaaaucaaaaca

SEQ ID NO: 1062759 - RNA, 21 nt, Homo sapiens
uaucugggugcaugaucuuga

SEQ ID NO: 1062760 - RNA, 18 nt, Homo sapiens
uaucugugaauucagauu

SEQ ID NO: 1062761 - RNA, 14 nt, Homo sapiens
uaucuguucuugcu

SEQ ID NO: 1062762 - RNA, 13 nt, Homo sapiens
uaucuuaugccac

SEQ ID NO: 1062763 - RNA, 22 nt, Homo sapiens
uaucuugaaacauagagaucua

SEQ ID NO: 1062764 - RNA, 22 nt, Homo sapiens
uaucuugcuuuuuuucaccaau

SEQ ID NO: 1062765 - RNA, 17 nt, Homo sapiens
uaucuuguuuuuccacu

SEQ ID NO: 1062766 - RNA, 18 nt, Homo sapiens
uaucuuugccacccucau

SEQ ID NO: 1062767 - RNA, 17 nt, Homo sapiens
uaucuuuuugcuuacag

SEQ ID NO: 1062768 - RNA, 19 nt, Homo sapiens
uaugaaaauacaacuuaaa

SEQ ID NO: 1062769 - RNA, 20 nt, Homo sapiens
uaugaagugacucucacaag

SEQ ID NO: 1062770 - RNA, 17 nt, Homo sapiens
uaugaaucacaguauug

SEQ ID NO: 1062771 - RNA, 15 nt, Homo sapiens
uaugacaucagcaau

SEQ ID NO: 1062772 - RNA, 23 nt, Homo sapiens
uaugaggaugcagagucagcaga

SEQ ID NO: 1062773 - RNA, 17 nt, Homo sapiens
uaugagucaaugugcag

SEQ ID NO: 1062774 - RNA, 21 nt, Homo sapiens
uaugaguuuuugauagcuuua

SEQ ID NO: 1062775 - RNA, 15 nt, Homo sapiens
uaugauauugcagcu

SEQ ID NO: 1062776 - RNA, 15 nt, Homo sapiens
uaugaugcuguugcc

SEQ ID NO: 1062777 - RNA, 14 nt, Homo sapiens
uaugcagaauguuu

SEQ ID NO: 1062778 - RNA, 19 nt, Homo sapiens
uaugcagcuaucuggucaa

SEQ ID NO: 1062779 - RNA, 12 nt, Homo sapiens
uaugccauagca

SEQ ID NO: 1062780 - RNA, 13 nt, Homo sapiens
uaugccuucuuau

SEQ ID NO: 1062781 - RNA, 14 nt, Homo sapiens
uaugcuacuacaaa

SEQ ID NO: 1062782 - RNA, 16 nt, Homo sapiens
uaugcugcucaucccc

SEQ ID NO: 1062783 - RNA, 22 nt, Homo sapiens
uaugcuuucuauuuugagauca

SEQ ID NO: 1062784 - RNA, 17 nt, Homo sapiens
uauggcucacuaugaau

SEQ ID NO: 1062785 - RNA, 22 nt, Homo sapiens
ucaagugauucuccugccucag

SEQ ID NO: 1062786 - RNA, 13 nt, Homo sapiens
ucaagugccuuaa

SEQ ID NO: 1062787 - RNA, 14 nt, Homo sapiens
ucaaguguauuuga

SEQ ID NO: 1062788 - RNA, 18 nt, Homo sapiens
ucaaguuugaacucugua

SEQ ID NO: 1062789 - RNA, 18 nt, Homo sapiens
ucaauaaauuguaauugu

SEQ ID NO: 1062790 - RNA, 19 nt, Homo sapiens
ucaaucaucugugugaaaa

SEQ ID NO: 1062791 - RNA, 22 nt, Homo sapiens
ucaauccaagagucugaugauu

SEQ ID NO: 1062792 - RNA, 15 nt, Homo sapiens
ucaauccucuaagcu

SEQ ID NO: 1062793 - RNA, 18 nt, Homo sapiens
ucaaucucugauucuguc

SEQ ID NO: 1062794 - RNA, 22 nt, Homo sapiens
ucaaugaucuagguuuaacuca

SEQ ID NO: 1062795 - RNA, 14 nt, Homo sapiens
ucaaugguaugcaa

SEQ ID NO: 1062796 - RNA, 16 nt, Homo sapiens
ucaauguaccugugug

SEQ ID NO: 1062797 - RNA, 18 nt, Homo sapiens
ucaauuaaaggcuuucag

SEQ ID NO: 1062798 - RNA, 17 nt, Homo sapiens
ucaauucagugcuguac

SEQ ID NO: 1062799 - RNA, 20 nt, Homo sapiens
ucaauuccaccugcaaucaa

SEQ ID NO: 1062800 - RNA, 15 nt, Homo sapiens
ucaauuccguagcca

SEQ ID NO: 1062801 - RNA, 21 nt, Homo sapiens
ucaauucuauuacgugcaaua

SEQ ID NO: 1062802 - RNA, 17 nt, Homo sapiens
ucaauuucccugacucc

SEQ ID NO: 1062803 - RNA, 22 nt, Homo sapiens
ucaauuucuggaaaacugccuu

SEQ ID NO: 1062804 - RNA, 23 nt, Homo sapiens
ucacaaaacacuucgagcacugu

SEQ ID NO: 1062805 - RNA, 13 nt, Homo sapiens
ucacaaacaguug

SEQ ID NO: 1062806 - RNA, 20 nt, Homo sapiens
ucacaacagaaaacccaaaa

SEQ ID NO: 1062807 - RNA, 14 nt, Homo sapiens
ucacaacagaucaa

SEQ ID NO: 1062808 - RNA, 20 nt, Homo sapiens
ucacaacauuuacuuaacag

SEQ ID NO: 1062809 - RNA, 23 nt, Homo sapiens
ucacaauccuguggaucugggca

SEQ ID NO: 1062810 - RNA, 18 nt, Homo sapiens
ucacacaauacaauaagu

SEQ ID NO: 1062811 - RNA, 11 nt, Homo sapiens
ucacacacagg

SEQ ID NO: 1062812 - RNA, 21 nt, Homo sapiens
ucacacagccaagccagucaa

SEQ ID NO: 1062813 - RNA, 14 nt, Homo sapiens
ucacaccacaaauc

SEQ ID NO: 1062814 - RNA, 18 nt, Homo sapiens
ucacacgggggcagcuga

SEQ ID NO: 1062815 - RNA, 23 nt, Homo sapiens
ucacacugggacuugcaaaaagg

SEQ ID NO: 1062816 - RNA, 15 nt, Homo sapiens
ucacagagugcauug

SEQ ID NO: 1062817 - RNA, 15 nt, Homo sapiens
ucacagagugugcug

SEQ ID NO: 1062818 - RNA, 18 nt, Homo sapiens
ucacagagugugcuggag

SEQ ID NO: 1062819 - RNA, 18 nt, Homo sapiens
ucacagaugugugauuca

SEQ ID NO: 1062820 - RNA, 22 nt, Homo sapiens
ucacagcccugcuuaccagaua

SEQ ID NO: 1062821 - RNA, 19 nt, Homo sapiens
ucacagccucaagucacuc

SEQ ID NO: 1062822 - RNA, 16 nt, Homo sapiens
ucacagcuacacagau

SEQ ID NO: 1062823 - RNA, 22 nt, Homo sapiens
ucacagcugauugggcaccuga

SEQ ID NO: 1062824 - RNA, 12 nt, Homo sapiens
ucacagcugcuu

SEQ ID NO: 1062825 - RNA, 19 nt, Homo sapiens
ucacaggacucugccuccu

SEQ ID NO: 1062826 - RNA, 21 nt, Homo sapiens
ucacaggcagguccaggguuu

SEQ ID NO: 1062827 - RNA, 15 nt, Homo sapiens
ucacagguugaccaa

SEQ ID NO: 1062828 - RNA, 20 nt, Homo sapiens
ucacaguuuugguugcuuua

SEQ ID NO: 1062829 - RNA, 15 nt, Homo sapiens
ucacauagcacagaa

SEQ ID NO: 1062830 - RNA, 11 nt, Homo sapiens
ucacaugacca

SEQ ID NO: 1062831 - RNA, 18 nt, Homo sapiens
ucacauggccuaugcaca

SEQ ID NO: 1062832 - RNA, 22 nt, Homo sapiens
ucacauggccuaugcacauaug

SEQ ID NO: 1062833 - RNA, 23 nt, Homo sapiens
ucacauggccuaugcacauaugg

SEQ ID NO: 1062834 - RNA, 14 nt, Homo sapiens
ucacaugugacaaa

SEQ ID NO: 1062835 - RNA, 18 nt, Homo sapiens
ucacauuaauauuugcug

SEQ ID NO: 1062836 - RNA, 14 nt, Homo sapiens
ucacauucaggaag

SEQ ID NO: 1062837 - RNA, 17 nt, Homo sapiens
ucacauuccaagccuca

SEQ ID NO: 1062838 - RNA, 18 nt, Homo sapiens
ucacauucgaguguuuca

SEQ ID NO: 1062839 - RNA, 19 nt, Homo sapiens
ucacauucgaguguuucag

SEQ ID NO: 1062840 - RNA, 14 nt, Homo sapiens
ucacauugugccuu

SEQ ID NO: 1062841 - RNA, 18 nt, Homo sapiens
ucacauuuauucugcuca

SEQ ID NO: 1062842 - RNA, 19 nt, Homo sapiens
ucaccaacgucugugccau

SEQ ID NO: 1062843 - RNA, 12 nt, Homo sapiens
ucaccaagccca

SEQ ID NO: 1062844 - RNA, 15 nt, Homo sapiens
ucaccaagcccaguu

SEQ ID NO: 1062845 - RNA, 16 nt, Homo sapiens
ucaccacaugugcaca

SEQ ID NO: 1062846 - RNA, 15 nt, Homo sapiens
ucaccagauuugcua

SEQ ID NO: 1062847 - RNA, 12 nt, Homo sapiens
ucaccagugucc

SEQ ID NO: 1062848 - RNA, 16 nt, Homo sapiens
ucaccaguuuccaggu

SEQ ID NO: 1062849 - RNA, 17 nt, Homo sapiens
ucaccauacacacuguu

SEQ ID NO: 1062850 - RNA, 14 nt, Homo sapiens
ucaccaucugugca

SEQ ID NO: 1062851 - RNA, 20 nt, Homo sapiens
ucaccauguacauagcuuga

SEQ ID NO: 1062852 - RNA, 21 nt, Homo sapiens
ucacccagcuaaucuguaggg

SEQ ID NO: 1062853 - RNA, 19 nt, Homo sapiens
ucacccaggcuggagugca

SEQ ID NO: 1062854 - RNA, 20 nt, Homo sapiens
ucacccaggcuggagugcaa

SEQ ID NO: 1062855 - RNA, 17 nt, Homo sapiens
ucaccccaguggccacu

SEQ ID NO: 1062856 - RNA, 22 nt, Homo sapiens
ucacccccucgggucuccucac

SEQ ID NO: 1062857 - RNA, 14 nt, Homo sapiens
ucaccgacaacaug

SEQ ID NO: 1062858 - RNA, 14 nt, Homo sapiens
ucaccgugagcagc

SEQ ID NO: 1062859 - RNA, 21 nt, Homo sapiens
ucaccuacauuugagaauuau

SEQ ID NO: 1062860 - RNA, 14 nt, Homo sapiens
ucaccucacugaaa

SEQ ID NO: 1062861 - RNA, 12 nt, Homo sapiens
ucaccucaggcc

SEQ ID NO: 1062862 - RNA, 19 nt, Homo sapiens
ucaccuugggaugaugccu

SEQ ID NO: 1062863 - RNA, 19 nt, Homo sapiens
ucacgccauugcacuccag

SEQ ID NO: 1062864 - RNA, 14 nt, Homo sapiens
ucacuaauacuaau

SEQ ID NO: 1062865 - RNA, 10 nt, Homo sapiens
ucacuauaua

SEQ ID NO: 1062866 - RNA, 12 nt, Homo sapiens
ucacucugaauc

SEQ ID NO: 1062867 - RNA, 18 nt, Homo sapiens
ucacucuuccugcaagga

SEQ ID NO: 1062868 - RNA, 22 nt, Homo sapiens
ucacugaagaaaccuucagauu

SEQ ID NO: 1062869 - RNA, 18 nt, Homo sapiens
ucacugcaacuucugccu

SEQ ID NO: 1062870 - RNA, 13 nt, Homo sapiens
agcuacuaaugau

SEQ ID NO: 1062871 - RNA, 19 nt, Homo sapiens
agcuacuugaaggacacaa

SEQ ID NO: 1062872 - RNA, 18 nt, Homo sapiens
agcuaggccuggccagau

SEQ ID NO: 1062873 - RNA, 15 nt, Homo sapiens
agcuagugcauugga

SEQ ID NO: 1062874 - RNA, 17 nt, Homo sapiens
agcuaguggcuucaaaa

SEQ ID NO: 1062875 - RNA, 14 nt, Homo sapiens
agcuauauccaugu

SEQ ID NO: 1062876 - RNA, 14 nt, Homo sapiens
agcuaugaauauag

SEQ ID NO: 1062877 - RNA, 20 nt, Homo sapiens
agcuaugaucgcgccacuac

SEQ ID NO: 1062878 - RNA, 21 nt, Homo sapiens
agcuauggugagaugcagcug

SEQ ID NO: 1062879 - RNA, 13 nt, Homo sapiens
agcuauguauuaa

SEQ ID NO: 1062880 - RNA, 20 nt, Homo sapiens
agcuauuuaagaaaaguauc

SEQ ID NO: 1062881 - RNA, 16 nt, Homo sapiens
agcuauuuaucuguag

SEQ ID NO: 1062882 - RNA, 20 nt, Homo sapiens
agcuauuuaucuguaguaaa

SEQ ID NO: 1062883 - RNA, 19 nt, Homo sapiens
agcucaagucuucccugau

SEQ ID NO: 1062884 - RNA, 19 nt, Homo sapiens
agcucaauuuaauuuugca

SEQ ID NO: 1062885 - RNA, 12 nt, Homo sapiens
agcucaccagcc

SEQ ID NO: 1062886 - RNA, 21 nt, Homo sapiens
agcucaccccuggaggacggc

SEQ ID NO: 1062887 - RNA, 21 nt, Homo sapiens
agcucacuaagaagcuugaau

SEQ ID NO: 1062888 - RNA, 19 nt, Homo sapiens
agcucagaaacgaaaucua

SEQ ID NO: 1062889 - RNA, 15 nt, Homo sapiens
agcucagaaggcucu

SEQ ID NO: 1062890 - RNA, 21 nt, Homo sapiens
agcucagagaggcuagaugau

SEQ ID NO: 1062891 - RNA, 20 nt, Homo sapiens
agcucagcauuuccacacca

SEQ ID NO: 1062892 - RNA, 15 nt, Homo sapiens
agcucagcccacccc

SEQ ID NO: 1062893 - RNA, 11 nt, Homo sapiens
agcucagggac

SEQ ID NO: 1062894 - RNA, 12 nt, Homo sapiens
agcucagguggg

SEQ ID NO: 1062895 - RNA, 13 nt, Homo sapiens
agcucaucucagc

SEQ ID NO: 1062896 - RNA, 11 nt, Homo sapiens
agcucaugccc

SEQ ID NO: 1062897 - RNA, 19 nt, Homo sapiens
agcuccacacccucuccca

SEQ ID NO: 1062898 - RNA, 22 nt, Homo sapiens
agcuccacacccucucccagga

SEQ ID NO: 1062899 - RNA, 15 nt, Homo sapiens
agcuccacucugacu

SEQ ID NO: 1062900 - RNA, 18 nt, Homo sapiens
agcuccacuuucagugaa

SEQ ID NO: 1062901 - RNA, 20 nt, Homo sapiens
agcuccgccccuugaacaug

SEQ ID NO: 1062902 - RNA, 19 nt, Homo sapiens
agcuccuucucucuuacau

SEQ ID NO: 1062903 - RNA, 16 nt, Homo sapiens
agcucgcauuugucaa

SEQ ID NO: 1062904 - RNA, 15 nt, Homo sapiens
agcucgguggaccca

SEQ ID NO: 1062905 - RNA, 13 nt, Homo sapiens
agcucuacucugg

SEQ ID NO: 1062906 - RNA, 23 nt, Homo sapiens
agcucugaaaccaguguuaggga

SEQ ID NO: 1062907 - RNA, 18 nt, Homo sapiens
agcucuggugacaccagc

SEQ ID NO: 1062908 - RNA, 21 nt, Homo sapiens
agcucuggugacaccagccuu

SEQ ID NO: 1062909 - RNA, 14 nt, Homo sapiens
agcucuggugaccu

SEQ ID NO: 1062910 - RNA, 14 nt, Homo sapiens
agcucuguuuucau

SEQ ID NO: 1062911 - RNA, 19 nt, Homo sapiens
agcucuugaagacacugaa

SEQ ID NO: 1062912 - RNA, 22 nt, Homo sapiens
agcugaagaacuuggcacacuc

SEQ ID NO: 1062913 - RNA, 23 nt, Homo sapiens
agcugaagaacuuggcacacucu

SEQ ID NO: 1062914 - RNA, 14 nt, Homo sapiens
agcugacaucucag

SEQ ID NO: 1062915 - RNA, 17 nt, Homo sapiens
agcugagaaaacuaagu

SEQ ID NO: 1062916 - RNA, 20 nt, Homo sapiens
agcugagauugcaccacugc

SEQ ID NO: 1062917 - RNA, 23 nt, Homo sapiens
agcugagauugcaccacugcacu

SEQ ID NO: 1062918 - RNA, 13 nt, Homo sapiens
agcugagcaggga

SEQ ID NO: 1062919 - RNA, 21 nt, Homo sapiens
agcugaguaggaggccuccac

SEQ ID NO: 1062920 - RNA, 13 nt, Homo sapiens
agcugcaccugcc

SEQ ID NO: 1062921 - RNA, 18 nt, Homo sapiens
agcugcauccuccaagaa

SEQ ID NO: 1062922 - RNA, 19 nt, Homo sapiens
agcugcccuccuuguccac

SEQ ID NO: 1062923 - RNA, 18 nt, Homo sapiens
agcugccugggaucccuc

SEQ ID NO: 1062924 - RNA, 14 nt, Homo sapiens
agcugcuacaaaga

SEQ ID NO: 1062925 - RNA, 21 nt, Homo sapiens
agcugcuacaaagaagacaug

SEQ ID NO: 1062926 - RNA, 13 nt, Homo sapiens
agcugcucaggga

SEQ ID NO: 1062927 - RNA, 13 nt, Homo sapiens
agcugcucuggaa

SEQ ID NO: 1062928 - RNA, 16 nt, Homo sapiens
agcugcuggcuugcag

SEQ ID NO: 1062929 - RNA, 14 nt, Homo sapiens
agcuggaagcacau

SEQ ID NO: 1062930 - RNA, 21 nt, Homo sapiens
ugcauggauguuuuagccauu

SEQ ID NO: 1062931 - RNA, 18 nt, Homo sapiens
ugcaugggcuaaugaaga

SEQ ID NO: 1062932 - RNA, 19 nt, Homo sapiens
ugcauguaccauuugcaug

SEQ ID NO: 1062933 - RNA, 21 nt, Homo sapiens
ugcauguuacauaagauaaau

SEQ ID NO: 1062934 - RNA, 22 nt, Homo sapiens
ugcauguuuuccagcuccucau

SEQ ID NO: 1062935 - RNA, 14 nt, Homo sapiens
ugcauuaucuauga

SEQ ID NO: 1062936 - RNA, 16 nt, Homo sapiens
ugcauucacccagaca

SEQ ID NO: 1062937 - RNA, 23 nt, Homo sapiens
ugcauucugagguaaccucauua

SEQ ID NO: 1062938 - RNA, 17 nt, Homo sapiens
ugcauuuaauuuauuga

SEQ ID NO: 1062939 - RNA, 14 nt, Homo sapiens
ugcauuugcacuau

SEQ ID NO: 1062940 - RNA, 16 nt, Homo sapiens
ugcauuugcagugcau

SEQ ID NO: 1062941 - RNA, 10 nt, Homo sapiens
ugccaaaaaa

SEQ ID NO: 1062942 - RNA, 15 nt, Homo sapiens
auuccuagaaguuga

SEQ ID NO: 1062943 - RNA, 16 nt, Homo sapiens
auuccugagccagugu

SEQ ID NO: 1062944 - RNA, 15 nt, Homo sapiens
auuccuguagcaucu

SEQ ID NO: 1062945 - RNA, 15 nt, Homo sapiens
auuccuuagucucaa

SEQ ID NO: 1062946 - RNA, 12 nt, Homo sapiens
auuccuugcaca

SEQ ID NO: 1062947 - RNA, 19 nt, Homo sapiens
auuccuuggcaugccuucc

SEQ ID NO: 1062948 - RNA, 23 nt, Homo sapiens
auuccuuggcaugccuuccagca

SEQ ID NO: 1062949 - RNA, 16 nt, Homo sapiens
auucuaaaggcuugau

SEQ ID NO: 1062950 - RNA, 20 nt, Homo sapiens
auucuaaaugaauguuuaca

SEQ ID NO: 1062951 - RNA, 16 nt, Homo sapiens
auucuaaugucuucau

SEQ ID NO: 1062952 - RNA, 18 nt, Homo sapiens
auucuauuacgugcaaua

SEQ ID NO: 1062953 - RNA, 19 nt, Homo sapiens
auucuauuacgugcaauac

SEQ ID NO: 1062954 - RNA, 22 nt, Homo sapiens
auucucacacacauacauaccu

SEQ ID NO: 1062955 - RNA, 13 nt, Homo sapiens
auucucaccagga

SEQ ID NO: 1062956 - RNA, 17 nt, Homo sapiens
auucucauuugucacac

SEQ ID NO: 1062957 - RNA, 16 nt, Homo sapiens
auucucgggcugagaa

SEQ ID NO: 1062958 - RNA, 14 nt, Homo sapiens
auucucuccuguac

SEQ ID NO: 1062959 - RNA, 15 nt, Homo sapiens
auucucuuacugcuu

SEQ ID NO: 1062960 - RNA, 19 nt, Homo sapiens
auucucuuguuauugcauc

SEQ ID NO: 1062961 - RNA, 15 nt, Homo sapiens
auucugaccauuuca

SEQ ID NO: 1062962 - RNA, 15 nt, Homo sapiens
auucugcaagcuuuu

SEQ ID NO: 1062963 - RNA, 19 nt, Homo sapiens
auucugccaaaccugugua

SEQ ID NO: 1062964 - RNA, 22 nt, Homo sapiens
auucugccuccauucugaccau

SEQ ID NO: 1062965 - RNA, 15 nt, Homo sapiens
auucugcugaugcua

SEQ ID NO: 1062966 - RNA, 14 nt, Homo sapiens
auucugcugucuca

SEQ ID NO: 1062967 - RNA, 16 nt, Homo sapiens
auucugucaaugucuu

SEQ ID NO: 1062968 - RNA, 14 nt, Homo sapiens
auucugucauuuca

SEQ ID NO: 1062969 - RNA, 17 nt, Homo sapiens
auucuguuuauagaaua

SEQ ID NO: 1062970 - RNA, 15 nt, Homo sapiens
auucuuagugacuuu

SEQ ID NO: 1062971 - RNA, 19 nt, Homo sapiens
auucuuauuaggauuccac

SEQ ID NO: 1062972 - RNA, 19 nt, Homo sapiens
auucuucaaccucauugac

SEQ ID NO: 1062973 - RNA, 15 nt, Homo sapiens
auucuugacauucac

SEQ ID NO: 1062974 - RNA, 15 nt, Homo sapiens
auucuuguaguuuac

SEQ ID NO: 1062975 - RNA, 20 nt, Homo sapiens
auucuuguaguuuaccucuu

SEQ ID NO: 1062976 - RNA, 20 nt, Homo sapiens
auucuuuaaauuucaucuca

SEQ ID NO: 1062977 - RNA, 19 nt, Homo sapiens
auucuuuauacaacagugc

SEQ ID NO: 1062978 - RNA, 17 nt, Homo sapiens
auugaaaggcauucucu

SEQ ID NO: 1062979 - RNA, 23 nt, Homo sapiens
auugaacucuuugaaugacaaag

SEQ ID NO: 1062980 - RNA, 18 nt, Homo sapiens
auugaacuuucacauagc

SEQ ID NO: 1062981 - RNA, 13 nt, Homo sapiens
auugaagaugaac

SEQ ID NO: 1062982 - RNA, 13 nt, Homo sapiens
auugaaggugcug

SEQ ID NO: 1062983 - RNA, 12 nt, Homo sapiens
auugaaguaaug

SEQ ID NO: 1062984 - RNA, 16 nt, Homo sapiens
auugaaguauuuugcu

SEQ ID NO: 1062985 - RNA, 16 nt, Homo sapiens
auugaaguuuugacau

SEQ ID NO: 1062986 - RNA, 19 nt, Homo sapiens
auugaaguuuugacaucaa

SEQ ID NO: 1062987 - RNA, 21 nt, Homo sapiens
auugaaucccuuaaacucagg

SEQ ID NO: 1062988 - RNA, 20 nt, Homo sapiens
auugaauuugccuuccucau

SEQ ID NO: 1062989 - RNA, 17 nt, Homo sapiens
auugacuaucaaacuga

SEQ ID NO: 1062990 - RNA, 19 nt, Homo sapiens
auugagaaagaaacuaaua

SEQ ID NO: 1062991 - RNA, 16 nt, Homo sapiens
auugaggacuauggaa

SEQ ID NO: 1062992 - RNA, 15 nt, Homo sapiens
auugcaaagguucca

SEQ ID NO: 1062993 - RNA, 13 nt, Homo sapiens
auugcaauaacug

SEQ ID NO: 1062994 - RNA, 19 nt, Homo sapiens
auugcagaggggcccauga

SEQ ID NO: 1062995 - RNA, 15 nt, Homo sapiens
auugcagaguacugg

SEQ ID NO: 1062996 - RNA, 18 nt, Homo sapiens
auugcaugugacucugaa

SEQ ID NO: 1062997 - RNA, 14 nt, Homo sapiens
auugcuaugaauga

SEQ ID NO: 1062998 - RNA, 22 nt, Homo sapiens
auugcuaugaaugauacccuga

SEQ ID NO: 1062999 - RNA, 16 nt, Homo sapiens
auugcuuacacggaug

SEQ ID NO: 1063000 - RNA, 18 nt, Homo sapiens
auugcuucaauaauauua

SEQ ID NO: 1063001 - RNA, 22 nt, Homo sapiens
auugcuugaguuauauguucac

SEQ ID NO: 1063002 - RNA, 12 nt, Homo sapiens
auugcuugcaca

SEQ ID NO: 1063003 - RNA, 14 nt, Homo sapiens
auugcuuuacuguc

SEQ ID NO: 1063004 - RNA, 17 nt, Homo sapiens
auugcuuugcacuuuuc

SEQ ID NO: 1063005 - RNA, 19 nt, Homo sapiens
auuggaccauccuauuuaa

SEQ ID NO: 1063006 - RNA, 15 nt, Homo sapiens
auuggaccuguucaa

SEQ ID NO: 1063007 - RNA, 20 nt, Homo sapiens
auuggguccugggucuuuca

SEQ ID NO: 1063008 - RNA, 15 nt, Homo sapiens
auuggucuccucuca

SEQ ID NO: 1063009 - RNA, 12 nt, Homo sapiens
auuggugcauuu

SEQ ID NO: 1063010 - RNA, 18 nt, Homo sapiens
auuguaacaauagcacaa

SEQ ID NO: 1063011 - RNA, 15 nt, Homo sapiens
auuguaagaaauacu

SEQ ID NO: 1063012 - RNA, 18 nt, Homo sapiens
auuguacaugguacgaau

SEQ ID NO: 1063013 - RNA, 21 nt, Homo sapiens
auuguauuuaccuucuaccuc

SEQ ID NO: 1063014 - RNA, 14 nt, Homo sapiens
auuguauuuaguua

SEQ ID NO: 1063015 - RNA, 21 nt, Homo sapiens
auuguccccuaaaccaaaaac

SEQ ID NO: 1063016 - RNA, 17 nt, Homo sapiens
auugucuguauuugccg

SEQ ID NO: 1063017 - RNA, 11 nt, Homo sapiens
auugugcacau

SEQ ID NO: 1063018 - RNA, 20 nt, Homo sapiens
auugugccccugcacuccag

SEQ ID NO: 1063019 - RNA, 12 nt, Homo sapiens
auugugccugua

SEQ ID NO: 1063020 - RNA, 11 nt, Homo sapiens
auugugcucaa

SEQ ID NO: 1063021 - RNA, 15 nt, Homo sapiens
auuguuccaagacau

SEQ ID NO: 1063022 - RNA, 18 nt, Homo sapiens
auuguuccugcgcugcaa

SEQ ID NO: 1063023 - RNA, 17 nt, Homo sapiens
auuguugguuaucuuaa

SEQ ID NO: 1063024 - RNA, 18 nt, Homo sapiens
auuuaaaaaaaaaccuga

SEQ ID NO: 1063025 - RNA, 20 nt, Homo sapiens
auuuaaaacgcaugugcagc

SEQ ID NO: 1063026 - RNA, 16 nt, Homo sapiens
auuuaaaaugagaucg

SEQ ID NO: 1063027 - RNA, 19 nt, Homo sapiens
auuuaacagaaauguacag

SEQ ID NO: 1063028 - RNA, 16 nt, Homo sapiens
auuuaacuuguuucca

SEQ ID NO: 1063029 - RNA, 16 nt, Homo sapiens
auuuaauauuuugcac

SEQ ID NO: 1063030 - RNA, 18 nt, Homo sapiens
auuuacagccucacuuga

SEQ ID NO: 1063031 - RNA, 12 nt, Homo sapiens
auuuacagugaa

SEQ ID NO: 1063032 - RNA, 15 nt, Homo sapiens
auuuacagugaaaau

SEQ ID NO: 1063033 - RNA, 20 nt, Homo sapiens
auuuacauacucugcuuaga

SEQ ID NO: 1063034 - RNA, 12 nt, Homo sapiens
auuuacauucuu

SEQ ID NO: 1063035 - RNA, 11 nt, Homo sapiens
auuuacugugg

SEQ ID NO: 1063036 - RNA, 19 nt, Homo sapiens
auuuacuguggcuucuuaa

SEQ ID NO: 1063037 - RNA, 12 nt, Homo sapiens
auuuagaacuug

SEQ ID NO: 1063038 - RNA, 12 nt, Homo sapiens
auuuagaacuuu

SEQ ID NO: 1063039 - RNA, 17 nt, Homo sapiens
auuuagacucaucuuac

SEQ ID NO: 1063040 - RNA, 18 nt, Homo sapiens
auuuagauauaacacuau

SEQ ID NO: 1063041 - RNA, 19 nt, Homo sapiens
auuuaguguuuuuaccucu

SEQ ID NO: 1063042 - RNA, 22 nt, Homo sapiens
auuuaguuugauuauucagugu

SEQ ID NO: 1063043 - RNA, 13 nt, Homo sapiens
auuuauaacucau

SEQ ID NO: 1063044 - RNA, 23 nt, Homo sapiens
auuuaucagaaauuauacuauau

SEQ ID NO: 1063045 - RNA, 12 nt, Homo sapiens
auuuaucugugu

SEQ ID NO: 1063046 - RNA, 15 nt, Homo sapiens
auuuaugagucucaa

SEQ ID NO: 1063047 - RNA, 19 nt, Homo sapiens
auuuauggucaacacuuaa

SEQ ID NO: 1063048 - RNA, 15 nt, Homo sapiens
auuuaugguucucag

SEQ ID NO: 1063049 - RNA, 21 nt, Homo sapiens
auuuaugguucucaggccuga

SEQ ID NO: 1063050 - RNA, 13 nt, Homo sapiens
auuuauguuuauu

SEQ ID NO: 1063051 - RNA, 14 nt, Homo sapiens
auuuauuaccucug

SEQ ID NO: 1063052 - RNA, 13 nt, Homo sapiens
auuuauucugcuc

SEQ ID NO: 1063053 - RNA, 13 nt, Homo sapiens
auuucaaaacaca

SEQ ID NO: 1063054 - RNA, 20 nt, Homo sapiens
auuucaaaugugcugucaaa

SEQ ID NO: 1063055 - RNA, 13 nt, Homo sapiens
auuucacauuaau

SEQ ID NO: 1063056 - RNA, 22 nt, Homo sapiens
auuucagaucauauuucacaau

SEQ ID NO: 1063057 - RNA, 12 nt, Homo sapiens
auuucaggcaua

SEQ ID NO: 1063058 - RNA, 18 nt, Homo sapiens
auuucauaccuaucaucu

SEQ ID NO: 1063059 - RNA, 21 nt, Homo sapiens
auuuccacaaaaucuguccaa

SEQ ID NO: 1063060 - RNA, 16 nt, Homo sapiens
auuuccuaaugucaga

SEQ ID NO: 1063061 - RNA, 22 nt, Homo sapiens
auuuccuacgggcuguguucca

SEQ ID NO: 1063062 - RNA, 18 nt, Homo sapiens
auuuccuacuaaccuguu

SEQ ID NO: 1063063 - RNA, 23 nt, Homo sapiens
auuuccuuaaacuguguggacug

SEQ ID NO: 1063064 - RNA, 14 nt, Homo sapiens
auuucuacucuuaa

SEQ ID NO: 1063065 - RNA, 19 nt, Homo sapiens
auuucuauuuuuguagaag

SEQ ID NO: 1063066 - RNA, 17 nt, Homo sapiens
auuucucaaaugcacau

SEQ ID NO: 1063067 - RNA, 21 nt, Homo sapiens
auuucucaaaugcacaucuca

SEQ ID NO: 1063068 - RNA, 20 nt, Homo sapiens
auuucucccagcucuagaca

SEQ ID NO: 1063069 - RNA, 16 nt, Homo sapiens
auuucucucugacccu

SEQ ID NO: 1063070 - RNA, 18 nt, Homo sapiens
auuucuuacaggcacaaa

SEQ ID NO: 1063071 - RNA, 19 nt, Homo sapiens
auuucuuuauguaaucuau

SEQ ID NO: 1063072 - RNA, 11 nt, Homo sapiens
auuucuuugcc

SEQ ID NO: 1063073 - RNA, 15 nt, Homo sapiens
auuucuuuguuauca

SEQ ID NO: 1063074 - RNA, 19 nt, Homo sapiens
auuugaagcaucacauaaa

SEQ ID NO: 1063075 - RNA, 18 nt, Homo sapiens
auuugaccacggacucca

SEQ ID NO: 1063076 - RNA, 17 nt, Homo sapiens
caaauaauuuguauacc

SEQ ID NO: 1063077 - RNA, 22 nt, Homo sapiens
caaauacauggauaacacauuu

SEQ ID NO: 1063078 - RNA, 20 nt, Homo sapiens
caaauagaauuugagcauca

SEQ ID NO: 1063079 - RNA, 15 nt, Homo sapiens
caaauauuccagaga

SEQ ID NO: 1063080 - RNA, 17 nt, Homo sapiens
caaauauuuauaagcua

SEQ ID NO: 1063081 - RNA, 18 nt, Homo sapiens
caaaucagccaugugcug

SEQ ID NO: 1063082 - RNA, 21 nt, Homo sapiens
caaaucagugugaggagguag

SEQ ID NO: 1063083 - RNA, 15 nt, Homo sapiens
caaaugacccaaaga

SEQ ID NO: 1063084 - RNA, 11 nt, Homo sapiens
caaaugagauc

SEQ ID NO: 1063085 - RNA, 16 nt, Homo sapiens
caaaugcacaucucau

SEQ ID NO: 1063086 - RNA, 16 nt, Homo sapiens
caaaugccacacauca

SEQ ID NO: 1063087 - RNA, 16 nt, Homo sapiens
caaaugcccaagggaa

SEQ ID NO: 1063088 - RNA, 16 nt, Homo sapiens
caaaugcuuuuccuca

SEQ ID NO: 1063089 - RNA, 15 nt, Homo sapiens
caaauggaagacaca

SEQ ID NO: 1063090 - RNA, 19 nt, Homo sapiens
caaauggacauaagacaga

SEQ ID NO: 1063091 - RNA, 19 nt, Homo sapiens
caaauguauccaucuugaa

SEQ ID NO: 1063092 - RNA, 17 nt, Homo sapiens
caaauguuuugacauga

SEQ ID NO: 1063093 - RNA, 15 nt, Homo sapiens
caaauuaaggcauaa

SEQ ID NO: 1063094 - RNA, 18 nt, Homo sapiens
caaauuagguuuuguaca

SEQ ID NO: 1063095 - RNA, 21 nt, Homo sapiens
caaauucauggugcacugagc

SEQ ID NO: 1063096 - RNA, 21 nt, Homo sapiens
caaauucuacugaacacuuca

SEQ ID NO: 1063097 - RNA, 16 nt, Homo sapiens
caaauugcagacugug

SEQ ID NO: 1063098 - RNA, 11 nt, Homo sapiens
caaauuucaca

SEQ ID NO: 1063099 - RNA, 19 nt, Homo sapiens
caacaaagccaacagucaa

SEQ ID NO: 1063100 - RNA, 18 nt, Homo sapiens
uggaaauagugauuucca

SEQ ID NO: 1063101 - RNA, 13 nt, Homo sapiens
uggaacaccuccu

SEQ ID NO: 1063102 - RNA, 20 nt, Homo sapiens
uggaacagauucacacuguc

SEQ ID NO: 1063103 - RNA, 15 nt, Homo sapiens
uggaacagucuuccc

SEQ ID NO: 1063104 - RNA, 23 nt, Homo sapiens
uggaaccaacacuaacauauaau

SEQ ID NO: 1063105 - RNA, 16 nt, Homo sapiens
uggaacucaaggaaau

SEQ ID NO: 1063106 - RNA, 15 nt, Homo sapiens
uggaacucaguguga

SEQ ID NO: 1063107 - RNA, 22 nt, Homo sapiens
uggaagacagagaccuccugcc

SEQ ID NO: 1063108 - RNA, 13 nt, Homo sapiens
uggaagaccccac

SEQ ID NO: 1063109 - RNA, 19 nt, Homo sapiens
uggaagaggggacaggucc

SEQ ID NO: 1063110 - RNA, 15 nt, Homo sapiens
uggaagcacagcuuc

SEQ ID NO: 1063111 - RNA, 17 nt, Homo sapiens
uggaagcucugaaguca

SEQ ID NO: 1063112 - RNA, 14 nt, Homo sapiens
uggaagcugucaua

SEQ ID NO: 1063113 - RNA, 18 nt, Homo sapiens
uggaagcugucauaaaaa

SEQ ID NO: 1063114 - RNA, 12 nt, Homo sapiens
uggaagggucaa

SEQ ID NO: 1063115 - RNA, 18 nt, Homo sapiens
uggaagugugggucugug

SEQ ID NO: 1063116 - RNA, 20 nt, Homo sapiens
uggaauaaagucacagaauu

SEQ ID NO: 1063117 - RNA, 20 nt, Homo sapiens
uggaauaacucuguggcauu

SEQ ID NO: 1063118 - RNA, 23 nt, Homo sapiens
uggaauacauuucuccuuugaua

SEQ ID NO: 1063119 - RNA, 13 nt, Homo sapiens
uggaaugcuguau

SEQ ID NO: 1063120 - RNA, 20 nt, Homo sapiens
uggaaugcuucuucucaggc

SEQ ID NO: 1063121 - RNA, 16 nt, Homo sapiens
uggaaugguaggauau

SEQ ID NO: 1063122 - RNA, 18 nt, Homo sapiens
uggaauuacaggcacaua

SEQ ID NO: 1063123 - RNA, 13 nt, Homo sapiens
uggaauugugcug

SEQ ID NO: 1063124 - RNA, 20 nt, Homo sapiens
uggaauuugcaagucauggc

SEQ ID NO: 1063125 - RNA, 16 nt, Homo sapiens
uggaauuuuucauuga

SEQ ID NO: 1063126 - RNA, 20 nt, Homo sapiens
uggacaaaccgagugcaaug

SEQ ID NO: 1063127 - RNA, 22 nt, Homo sapiens
uggacaaucaugaaauaugcau

SEQ ID NO: 1063128 - RNA, 17 nt, Homo sapiens
uggacacgucggacagc

SEQ ID NO: 1063129 - RNA, 15 nt, Homo sapiens
uggacauaagacaga

SEQ ID NO: 1063130 - RNA, 22 nt, Homo sapiens
uggaccaauagggcugagcucu

SEQ ID NO: 1063131 - RNA, 15 nt, Homo sapiens
uggaccacugcauga

SEQ ID NO: 1063132 - RNA, 22 nt, Homo sapiens
uggaccaggaagcccugaaucc

SEQ ID NO: 1063133 - RNA, 14 nt, Homo sapiens
uggaccccaucugu

SEQ ID NO: 1063134 - RNA, 19 nt, Homo sapiens
uggaccuauguccuaagga

SEQ ID NO: 1063135 - RNA, 23 nt, Homo sapiens
uggaccugucacgauugucauca

SEQ ID NO: 1063136 - RNA, 16 nt, Homo sapiens
uggacucaguuuucuu

SEQ ID NO: 1063137 - RNA, 14 nt, Homo sapiens
uggacucugcacau

SEQ ID NO: 1063138 - RNA, 16 nt, Homo sapiens
uggacugauaaucucu

SEQ ID NO: 1063139 - RNA, 11 nt, Homo sapiens
uggacugggag

SEQ ID NO: 1063140 - RNA, 15 nt, Homo sapiens
uggacugucauagaa

SEQ ID NO: 1063141 - RNA, 19 nt, Homo sapiens
uggagaaacuguagucuca

SEQ ID NO: 1063142 - RNA, 22 nt, Homo sapiens
uggagaaauaaaaauaccucuu

SEQ ID NO: 1063143 - RNA, 13 nt, Homo sapiens
uggagaaccucau

SEQ ID NO: 1063144 - RNA, 15 nt, Homo sapiens
uggagagaacugaau

SEQ ID NO: 1063145 - RNA, 13 nt, Homo sapiens
uggagauagggaa

SEQ ID NO: 1063146 - RNA, 23 nt, Homo sapiens
uggagcccaggaguuugaggcug

SEQ ID NO: 1063147 - RNA, 14 nt, Homo sapiens
uggagcugccugau

SEQ ID NO: 1063148 - RNA, 18 nt, Homo sapiens
uggaggaaagugauaucc

SEQ ID NO: 1063149 - RNA, 19 nt, Homo sapiens
uggaggacuagaaccugga

SEQ ID NO: 1063150 - RNA, 20 nt, Homo sapiens
uggaggccggaaucucagcc

SEQ ID NO: 1063151 - RNA, 15 nt, Homo sapiens
uggaggcugcaguga

SEQ ID NO: 1063152 - RNA, 19 nt, Homo sapiens
uggaggcugcagugagcug

SEQ ID NO: 1063153 - RNA, 20 nt, Homo sapiens
uggaggcugucuucucaggc

SEQ ID NO: 1063154 - RNA, 16 nt, Homo sapiens
uggagggacaugacua

SEQ ID NO: 1063155 - RNA, 20 nt, Homo sapiens
uggagggguguggcuccuuc

SEQ ID NO: 1063156 - RNA, 20 nt, Homo sapiens
uggaggucacauucaggaag

SEQ ID NO: 1063157 - RNA, 16 nt, Homo sapiens
uggaguauuggggucu

SEQ ID NO: 1063158 - RNA, 18 nt, Homo sapiens
uggaguccgaugauucuc

SEQ ID NO: 1063159 - RNA, 15 nt, Homo sapiens
uggauagucugucca

SEQ ID NO: 1063160 - RNA, 18 nt, Homo sapiens
uggauauuauucuuguag

SEQ ID NO: 1063161 - RNA, 16 nt, Homo sapiens
uggaucagaugaacuc

SEQ ID NO: 1063162 - RNA, 20 nt, Homo sapiens
uggaucaguccuuugaucag

SEQ ID NO: 1063163 - RNA, 14 nt, Homo sapiens
uggaucuaccagca

SEQ ID NO: 1063164 - RNA, 15 nt, Homo sapiens
uggaucuaccagcau

SEQ ID NO: 1063165 - RNA, 16 nt, Homo sapiens
uggaucuaccccagga

SEQ ID NO: 1063166 - RNA, 16 nt, Homo sapiens
uggaucuguccaagga

SEQ ID NO: 1063167 - RNA, 12 nt, Homo sapiens
uggaucugugag

SEQ ID NO: 1063168 - RNA, 20 nt, Homo sapiens
uggaugcagccucacagucc

SEQ ID NO: 1063169 - RNA, 16 nt, Homo sapiens
uggauguggggucccc

SEQ ID NO: 1063170 - RNA, 15 nt, Homo sapiens
uggauuaugaaguga

SEQ ID NO: 1063171 - RNA, 13 nt, Homo sapiens
uggauucagaaua

SEQ ID NO: 1063172 - RNA, 23 nt, Homo sapiens
uggauucauuacagcuuaaucaa

SEQ ID NO: 1063173 - RNA, 15 nt, Homo sapiens
uggauucgugacaac

SEQ ID NO: 1063174 - RNA, 20 nt, Homo sapiens
uggauucuucccacacagaa

SEQ ID NO: 1063175 - RNA, 23 nt, Homo sapiens
uggauuuggguuggaagugaggg

SEQ ID NO: 1063176 - RNA, 21 nt, Homo sapiens
uggauuuuacauguggcccaa

SEQ ID NO: 1063177 - RNA, 13 nt, Homo sapiens
uggauuuugucaa

SEQ ID NO: 1063178 - RNA, 19 nt, Homo sapiens
uggcaaacuucagacugaa

SEQ ID NO: 1063179 - RNA, 18 nt, Homo sapiens
uggcaaggacacagauga

SEQ ID NO: 1063180 - RNA, 19 nt, Homo sapiens
uggcaauuucacugaugua

SEQ ID NO: 1063181 - RNA, 19 nt, Homo sapiens
uggcacacaccuguagucc

SEQ ID NO: 1063182 - RNA, 12 nt, Homo sapiens
uggcacacuggg

SEQ ID NO: 1063183 - RNA, 18 nt, Homo sapiens
uggcacauccuaugcaau

SEQ ID NO: 1063184 - RNA, 23 nt, Homo sapiens
uggcacaugacaacuuugccagc

SEQ ID NO: 1063185 - RNA, 12 nt, Homo sapiens
uggcaccagcag

SEQ ID NO: 1063186 - RNA, 23 nt, Homo sapiens
uggcacugcugugcugugcccaa

SEQ ID NO: 1063187 - RNA, 17 nt, Homo sapiens
uggcacuuauaaccaaa

SEQ ID NO: 1063188 - RNA, 10 nt, Homo sapiens
uggcacuuug

SEQ ID NO: 1063189 - RNA, 14 nt, Homo sapiens
uggcagccaguacc

SEQ ID NO: 1063190 - RNA, 21 nt, Homo sapiens
uggcagcgccucaucuucaac

SEQ ID NO: 1063191 - RNA, 17 nt, Homo sapiens
uggcagcgcggggagcc

SEQ ID NO: 1063192 - RNA, 13 nt, Homo sapiens
uggcagcucagag

SEQ ID NO: 1063193 - RNA, 14 nt, Homo sapiens
uggcagcucuccag

SEQ ID NO: 1063194 - RNA, 18 nt, Homo sapiens
uggcagcucuccagucag

SEQ ID NO: 1063195 - RNA, 19 nt, Homo sapiens
uggcauacgccuguagucc

SEQ ID NO: 1063196 - RNA, 16 nt, Homo sapiens
uggcaucccaguggcc

SEQ ID NO: 1063197 - RNA, 15 nt, Homo sapiens
uggcaugccuuccag

SEQ ID NO: 1063198 - RNA, 17 nt, Homo sapiens
uggcaugccuuccagca

SEQ ID NO: 1063199 - RNA, 19 nt, Homo sapiens
uggcauuccuucugaccac

SEQ ID NO: 1063200 - RNA, 14 nt, Homo sapiens
uggccaaagaccaa

SEQ ID NO: 1063201 - RNA, 19 nt, Homo sapiens
uggccacagaggacucacu

SEQ ID NO: 1063202 - RNA, 21 nt, Homo sapiens
uggccaggcugcacacauucu

SEQ ID NO: 1063203 - RNA, 18 nt, Homo sapiens
uggccauuccaacagcuc

SEQ ID NO: 1063204 - RNA, 19 nt, Homo sapiens
uggcccaacacaauucuuc

SEQ ID NO: 1063205 - RNA, 13 nt, Homo sapiens
uggcccacgcacu

SEQ ID NO: 1063206 - RNA, 16 nt, Homo sapiens
uggcccacgcacuucg

SEQ ID NO: 1063207 - RNA, 17 nt, Homo sapiens
uggcccagagaagccaa

SEQ ID NO: 1063208 - RNA, 23 nt, Homo sapiens
uggcccagccggccucucuggcc

SEQ ID NO: 1063209 - RNA, 14 nt, Homo sapiens
uggcccucuguguu

SEQ ID NO: 1063210 - RNA, 22 nt, Homo sapiens
uggcccuuucaacaaugucuuu

SEQ ID NO: 1063211 - RNA, 22 nt, Homo sapiens
uggccgaucggggcacugcagg

SEQ ID NO: 1063212 - RNA, 14 nt, Homo sapiens
uggccggcuggaaa

SEQ ID NO: 1063213 - RNA, 19 nt, Homo sapiens
uggccuaaaaaugcaacuu

SEQ ID NO: 1063214 - RNA, 15 nt, Homo sapiens
uggccuagucccuuc

SEQ ID NO: 1063215 - RNA, 18 nt, Homo sapiens
uggccuaugcacauaugg

SEQ ID NO: 1063216 - RNA, 22 nt, Homo sapiens
uggccuaugcacauauggacuc

SEQ ID NO: 1063217 - RNA, 15 nt, Homo sapiens
uggccucccaacuca

SEQ ID NO: 1063218 - RNA, 13 nt, Homo sapiens
uggccuggcacac

SEQ ID NO: 1063219 - RNA, 23 nt, Homo sapiens
uggccuggggcaggucacuuuac

SEQ ID NO: 1063220 - RNA, 16 nt, Homo sapiens
uggccuggggcuucug

SEQ ID NO: 1063221 - RNA, 17 nt, Homo sapiens
cauucugacucauaucc

SEQ ID NO: 1063222 - RNA, 18 nt, Homo sapiens
cauucugcaagcacaucu

SEQ ID NO: 1063223 - RNA, 17 nt, Homo sapiens
cauucuggaaaagcaaa

SEQ ID NO: 1063224 - RNA, 19 nt, Homo sapiens
cauucuguggccagccaaa

SEQ ID NO: 1063225 - RNA, 23 nt, Homo sapiens
cauucuuguuuuaagugccuuua

SEQ ID NO: 1063226 - RNA, 12 nt, Homo sapiens
cauucuuuuaua

SEQ ID NO: 1063227 - RNA, 20 nt, Homo sapiens
cauugaaagagaaccaguuu

SEQ ID NO: 1063228 - RNA, 10 nt, Homo sapiens
cauugaacaa

SEQ ID NO: 1063229 - RNA, 23 nt, Homo sapiens
cauugaauguagagaauguagcc

SEQ ID NO: 1063230 - RNA, 18 nt, Homo sapiens
cauugacugauggugaaa

SEQ ID NO: 1063231 - RNA, 14 nt, Homo sapiens
cauugaucugggau

SEQ ID NO: 1063232 - RNA, 13 nt, Homo sapiens
cauugcaagcuca

SEQ ID NO: 1063233 - RNA, 22 nt, Homo sapiens
cauugcaagcuucuuuuaguug

SEQ ID NO: 1063234 - RNA, 18 nt, Homo sapiens
cauugccuuuucuagccc

SEQ ID NO: 1063235 - RNA, 15 nt, Homo sapiens
cauugcuuuccacug

SEQ ID NO: 1063236 - RNA, 19 nt, Homo sapiens
cauuggaccuguucaaaaa

SEQ ID NO: 1063237 - RNA, 21 nt, Homo sapiens
cauuggaccuuuccugaggaa

SEQ ID NO: 1063238 - RNA, 16 nt, Homo sapiens
cauuggcuaauugcac

SEQ ID NO: 1063239 - RNA, 13 nt, Homo sapiens
cauuguaguuaau

SEQ ID NO: 1063240 - RNA, 18 nt, Homo sapiens
cauuuaaaaaaaaucccu

SEQ ID NO: 1063241 - RNA, 18 nt, Homo sapiens
cauuuaaauuuuacccuu

SEQ ID NO: 1063242 - RNA, 11 nt, Homo sapiens
cauuuacugug

SEQ ID NO: 1063243 - RNA, 13 nt, Homo sapiens
cauuuacuguggc

SEQ ID NO: 1063244 - RNA, 19 nt, Homo sapiens
cauuuacuguggcuucuua

SEQ ID NO: 1063245 - RNA, 20 nt, Homo sapiens
cauuuacuguggcuucuuaa

SEQ ID NO: 1063246 - RNA, 15 nt, Homo sapiens
cauuuagaacuugca

SEQ ID NO: 1063247 - RNA, 16 nt, Homo sapiens
cauuuagcacauacua

SEQ ID NO: 1063248 - RNA, 22 nt, Homo sapiens
cauuuaguuugauuauucagug

SEQ ID NO: 1063249 - RNA, 13 nt, Homo sapiens
cauuuauagcaua

SEQ ID NO: 1063250 - RNA, 14 nt, Homo sapiens
cauuuaucccucaa

SEQ ID NO: 1063251 - RNA, 21 nt, Homo sapiens
cauuuaugauuuaauaaaaua

SEQ ID NO: 1063252 - RNA, 20 nt, Homo sapiens
cauuuauuauuucaauguga

SEQ ID NO: 1063253 - RNA, 22 nt, Homo sapiens
cauuucauuguaugauguguug

SEQ ID NO: 1063254 - RNA, 17 nt, Homo sapiens
cauuuccaaauucacaa

SEQ ID NO: 1063255 - RNA, 20 nt, Homo sapiens
cauuuccaacaccacagaca

SEQ ID NO: 1063256 - RNA, 12 nt, Homo sapiens
cauuucuacucu

SEQ ID NO: 1063257 - RNA, 16 nt, Homo sapiens
cauuucugagaucaaa

SEQ ID NO: 1063258 - RNA, 16 nt, Homo sapiens
cauuugaaaucuauga

SEQ ID NO: 1063259 - RNA, 20 nt, Homo sapiens
cauuugaguugcccaucuug

SEQ ID NO: 1063260 - RNA, 13 nt, Homo sapiens
cauuugcaccuac

SEQ ID NO: 1063261 - RNA, 15 nt, Homo sapiens
cauuugcaccuaccu

SEQ ID NO: 1063262 - RNA, 13 nt, Homo sapiens
cauuugcacuauu

SEQ ID NO: 1063263 - RNA, 14 nt, Homo sapiens
cauuugcauuugcu

SEQ ID NO: 1063264 - RNA, 18 nt, Homo sapiens
cauuugcuuacuuugcau

SEQ ID NO: 1063265 - RNA, 23 nt, Homo sapiens
cauuugcuuacuuugcauuugug

SEQ ID NO: 1063266 - RNA, 11 nt, Homo sapiens
cauuugugccc

SEQ ID NO: 1063267 - RNA, 15 nt, Homo sapiens
cauuugugucaaugg

SEQ ID NO: 1063268 - RNA, 16 nt, Homo sapiens
cauuugugugugugca

SEQ ID NO: 1063269 - RNA, 14 nt, Homo sapiens
cauuuguuccauga

SEQ ID NO: 1063270 - RNA, 22 nt, Homo sapiens
cauuuuacccuuggcucaaucc

SEQ ID NO: 1063271 - RNA, 20 nt, Homo sapiens
cauuuuauaagcuacauguu

SEQ ID NO: 1063272 - RNA, 13 nt, Homo sapiens
cauuuucacuuuu

SEQ ID NO: 1063273 - RNA, 17 nt, Homo sapiens
cauuuucugccacccaa

SEQ ID NO: 1063274 - RNA, 14 nt, Homo sapiens
cauuuugcaaaauu

SEQ ID NO: 1063275 - RNA, 19 nt, Homo sapiens
cauuuugcaaaauuuccag

SEQ ID NO: 1063276 - RNA, 18 nt, Homo sapiens
cauuuugcccuuccauag

SEQ ID NO: 1063277 - RNA, 13 nt, Homo sapiens
cauuuugcucaac

SEQ ID NO: 1063278 - RNA, 22 nt, Homo sapiens
cauuuuggaaguuuucaggacu

SEQ ID NO: 1063279 - RNA, 21 nt, Homo sapiens
cauuuuggggugaagauucag

SEQ ID NO: 1063280 - RNA, 15 nt, Homo sapiens
cauuuuuaaaaugca

SEQ ID NO: 1063281 - RNA, 16 nt, Homo sapiens
cauuuuugaaaccaaa

SEQ ID NO: 1063282 - RNA, 17 nt, Homo sapiens
cauuuuugugcuuuuau

SEQ ID NO: 1063283 - RNA, 19 nt, Homo sapiens
cauuuuuucagucauauaa

SEQ ID NO: 1063284 - RNA, 21 nt, Homo sapiens
cauuuuuuuucagcagacuau

SEQ ID NO: 1063285 - RNA, 15 nt, Homo sapiens
ccaaaaaaaguucag

SEQ ID NO: 1063286 - RNA, 19 nt, Homo sapiens
ccaaaaaaauacugccaga

SEQ ID NO: 1063287 - RNA, 15 nt, Homo sapiens
ccaaaaaaguuacaa

SEQ ID NO: 1063288 - RNA, 20 nt, Homo sapiens
ccaaaaagggauccguacau

SEQ ID NO: 1063289 - RNA, 17 nt, Homo sapiens
ccaaaaauaugguugau

SEQ ID NO: 1063290 - RNA, 12 nt, Homo sapiens
ccaaaaccagaa

SEQ ID NO: 1063291 - RNA, 14 nt, Homo sapiens
ccaaaacuccugcc

SEQ ID NO: 1063292 - RNA, 13 nt, Homo sapiens
ccaaaagcacuua

SEQ ID NO: 1063293 - RNA, 18 nt, Homo sapiens
ccaaaauaaaaccagcuc

SEQ ID NO: 1063294 - RNA, 22 nt, Homo sapiens
ccaaaauccccuucucaucacu

SEQ ID NO: 1063295 - RNA, 22 nt, Homo sapiens
ccaaacccaugaggcaauguca

SEQ ID NO: 1063296 - RNA, 17 nt, Homo sapiens
ccaaaccuccaaaacuc

SEQ ID NO: 1063297 - RNA, 17 nt, Homo sapiens
ccaaaccuccacugcug

SEQ ID NO: 1063298 - RNA, 14 nt, Homo sapiens
ccaaacucugccag

SEQ ID NO: 1063299 - RNA, 15 nt, Homo sapiens
ccaaacucugccagc

SEQ ID NO: 1063300 - RNA, 17 nt, Homo sapiens
ccaaacuugacaguaaa

SEQ ID NO: 1063301 - RNA, 17 nt, Homo sapiens
ccaaagaccaauauuca

SEQ ID NO: 1063302 - RNA, 20 nt, Homo sapiens
ccaaagccaauaacacacag

SEQ ID NO: 1063303 - RNA, 18 nt, Homo sapiens
ccaaagccagaccagaag

SEQ ID NO: 1063304 - RNA, 18 nt, Homo sapiens
ccaaaggcauaagacccu

SEQ ID NO: 1063305 - RNA, 10 nt, Homo sapiens
ccaaaggggc

SEQ ID NO: 1063306 - RNA, 18 nt, Homo sapiens
ccaaaggucauccuuaau

SEQ ID NO: 1063307 - RNA, 14 nt, Homo sapiens
ccaaaguaaauguc

SEQ ID NO: 1063308 - RNA, 17 nt, Homo sapiens
ccaaagugcugggauua

SEQ ID NO: 1063309 - RNA, 14 nt, Homo sapiens
ccaaagugguauag

SEQ ID NO: 1063310 - RNA, 18 nt, Homo sapiens
ccaaaguuugcucaagga

SEQ ID NO: 1063311 - RNA, 14 nt, Homo sapiens
ccaaauaaacucca

SEQ ID NO: 1063312 - RNA, 17 nt, Homo sapiens
ccaaauauuccagagac

SEQ ID NO: 1063313 - RNA, 12 nt, Homo sapiens
ccaaaugagauc

SEQ ID NO: 1063314 - RNA, 19 nt, Homo sapiens
ccaaaugcauggugcaguu

SEQ ID NO: 1063315 - RNA, 14 nt, Homo sapiens
ccaaauuacgugua

SEQ ID NO: 1063316 - RNA, 12 nt, Homo sapiens
ccaaauugcagc

SEQ ID NO: 1063317 - RNA, 16 nt, Homo sapiens
ccaaauuuguauuuaa

SEQ ID NO: 1063318 - RNA, 10 nt, Homo sapiens
ccaacagcac

SEQ ID NO: 1063319 - RNA, 15 nt, Homo sapiens
ccaacagcacccucu

SEQ ID NO: 1063320 - RNA, 22 nt, Homo sapiens
ccaacaggagcugggauccuaa

SEQ ID NO: 1063321 - RNA, 21 nt, Homo sapiens
ccaacaugaaaacaauucuua

SEQ ID NO: 1063322 - RNA, 14 nt, Homo sapiens
ccaacaugugcuca

SEQ ID NO: 1063323 - RNA, 14 nt, Homo sapiens
ccaaccuccugacc

SEQ ID NO: 1063324 - RNA, 13 nt, Homo sapiens
ccaacucuugcag

SEQ ID NO: 1063325 - RNA, 21 nt, Homo sapiens
ccaacuuccuguugauguuca

SEQ ID NO: 1063326 - RNA, 23 nt, Homo sapiens
ccaacuuguaaauacaccaccuc

SEQ ID NO: 1063327 - RNA, 22 nt, Homo sapiens
ccaacuuuguggaugucuuccu

SEQ ID NO: 1063328 - RNA, 14 nt, Homo sapiens
ccaagaaaugcaaa

SEQ ID NO: 1063329 - RNA, 18 nt, Homo sapiens
ccaagaaugagaagaaug

SEQ ID NO: 1063330 - RNA, 18 nt, Homo sapiens
ccaagagucugaugauuu

SEQ ID NO: 1063331 - RNA, 15 nt, Homo sapiens
ccaagcccccuccuu

SEQ ID NO: 1063332 - RNA, 16 nt, Homo sapiens
ccaaggagaugaagca

SEQ ID NO: 1063333 - RNA, 14 nt, Homo sapiens
ccaaggagggugag

SEQ ID NO: 1063334 - RNA, 20 nt, Homo sapiens
ccaaggagggugagugcaag

SEQ ID NO: 1063335 - RNA, 12 nt, Homo sapiens
ccaaguagcuag

SEQ ID NO: 1063336 - RNA, 15 nt, Homo sapiens
ccaagucaugugcau

SEQ ID NO: 1063337 - RNA, 14 nt, Homo sapiens
ccaaguuuauauac

SEQ ID NO: 1063338 - RNA, 22 nt, Homo sapiens
ccaauaaagccuucaaacuccc

SEQ ID NO: 1063339 - RNA, 12 nt, Homo sapiens
ccaauaccuccu

SEQ ID NO: 1063340 - RNA, 21 nt, Homo sapiens
ccaauaccuccuccagaucag

SEQ ID NO: 1063341 - RNA, 17 nt, Homo sapiens
ccaauaggcauuugauu

SEQ ID NO: 1063342 - RNA, 14 nt, Homo sapiens
ccaaucauuuuaau

SEQ ID NO: 1063343 - RNA, 17 nt, Homo sapiens
ccaauccuggacaugaa

SEQ ID NO: 1063344 - RNA, 13 nt, Homo sapiens
ccaaugcaugcag

SEQ ID NO: 1063345 - RNA, 23 nt, Homo sapiens
ccaaugcugucugguugcgccau

SEQ ID NO: 1063346 - RNA, 17 nt, Homo sapiens
ccaaugcuuacugcgcu

SEQ ID NO: 1063347 - RNA, 17 nt, Homo sapiens
ccaauggcaacaucuug

SEQ ID NO: 1063348 - RNA, 22 nt, Homo sapiens
ccaauggcaacaucuugcaaaa

SEQ ID NO: 1063349 - RNA, 15 nt, Homo sapiens
ccaauuuacuugcca

SEQ ID NO: 1063350 - RNA, 23 nt, Homo sapiens
ccaauuuucuggaauacaugaaa

SEQ ID NO: 1063351 - RNA, 13 nt, Homo sapiens
ccacaaaacugac

SEQ ID NO: 1063352 - RNA, 17 nt, Homo sapiens
ccacaaagagauuauuu

SEQ ID NO: 1063353 - RNA, 11 nt, Homo sapiens
ccacaaauagu

SEQ ID NO: 1063354 - RNA, 23 nt, Homo sapiens
ccacaaaucaguauauggcuuuu

SEQ ID NO: 1063355 - RNA, 13 nt, Homo sapiens
ccacaaaucugaa

SEQ ID NO: 1063356 - RNA, 18 nt, Homo sapiens
ccacacacacacacaugc

SEQ ID NO: 1063357 - RNA, 20 nt, Homo sapiens
ccacacacacacacaugcau

SEQ ID NO: 1063358 - RNA, 15 nt, Homo sapiens
ccacacagcagcagu

SEQ ID NO: 1063359 - RNA, 19 nt, Homo sapiens
ccacaccgagacaccaccu

SEQ ID NO: 1063360 - RNA, 21 nt, Homo sapiens
aaacugccuuggcuucagggg

SEQ ID NO: 1063361 - RNA, 21 nt, Homo sapiens
aaacugcugucccaaacaugc

SEQ ID NO: 1063362 - RNA, 12 nt, Homo sapiens
aaacugugcacc

SEQ ID NO: 1063363 - RNA, 15 nt, Homo sapiens
aaacuuaacauucau

SEQ ID NO: 1063364 - RNA, 13 nt, Homo sapiens
aaacuucuuuaaa

SEQ ID NO: 1063365 - RNA, 19 nt, Homo sapiens
aaacuuggaauucucucac

SEQ ID NO: 1063366 - RNA, 19 nt, Homo sapiens
aaacuuucacaccccagac

SEQ ID NO: 1063367 - RNA, 11 nt, Homo sapiens
aaacuuucuaa

SEQ ID NO: 1063368 - RNA, 21 nt, Homo sapiens
aaacuuugauaggauguggau

SEQ ID NO: 1063369 - RNA, 13 nt, Homo sapiens
aaagaaaaaaagu

SEQ ID NO: 1063370 - RNA, 15 nt, Homo sapiens
aaagaaacacgcacu

SEQ ID NO: 1063371 - RNA, 17 nt, Homo sapiens
aaagaaacuuuauucaa

SEQ ID NO: 1063372 - RNA, 13 nt, Homo sapiens
aaagaaccaaaag

SEQ ID NO: 1063373 - RNA, 16 nt, Homo sapiens
aaagaagaaaccuuca

SEQ ID NO: 1063374 - RNA, 22 nt, Homo sapiens
aaagaaggaauucuaggcaucc

SEQ ID NO: 1063375 - RNA, 13 nt, Homo sapiens
aaagaagguuuca

SEQ ID NO: 1063376 - RNA, 20 nt, Homo sapiens
aaagacaauucuuuauacaa

SEQ ID NO: 1063377 - RNA, 19 nt, Homo sapiens
aaagacccaacauuacuaa

SEQ ID NO: 1063378 - RNA, 14 nt, Homo sapiens
aaagaccugagaac

SEQ ID NO: 1063379 - RNA, 17 nt, Homo sapiens
aaagacuaugaggaaua

SEQ ID NO: 1063380 - RNA, 18 nt, Homo sapiens
aaagacugagcucaaggu

SEQ ID NO: 1063381 - RNA, 14 nt, Homo sapiens
aaagacugcauuua

SEQ ID NO: 1063382 - RNA, 20 nt, Homo sapiens
aaagacuguacaaaguagaa

SEQ ID NO: 1063383 - RNA, 11 nt, Homo sapiens
aaagacuguag

SEQ ID NO: 1063384 - RNA, 21 nt, Homo sapiens
aaagagacuggagcaucugac

SEQ ID NO: 1063385 - RNA, 18 nt, Homo sapiens
aaagagagucgcaucuca

SEQ ID NO: 1063386 - RNA, 21 nt, Homo sapiens
aaagagcaacaauccaucucu

SEQ ID NO: 1063387 - RNA, 16 nt, Homo sapiens
aaagagccuggagaag

SEQ ID NO: 1063388 - RNA, 15 nt, Homo sapiens
aaagaguaggaagac

SEQ ID NO: 1063389 - RNA, 23 nt, Homo sapiens
aaagauaaucucucagcuuuuaa

SEQ ID NO: 1063390 - RNA, 13 nt, Homo sapiens
aaagauacaguua

SEQ ID NO: 1063391 - RNA, 19 nt, Homo sapiens
aaagaugaccuuugucuca

SEQ ID NO: 1063392 - RNA, 21 nt, Homo sapiens
aaagaugagcuuuucuaggcu

SEQ ID NO: 1063393 - RNA, 19 nt, Homo sapiens
aaagauguuugucagauau

SEQ ID NO: 1063394 - RNA, 20 nt, Homo sapiens
aaagauuucuugaguuuugu

SEQ ID NO: 1063395 - RNA, 19 nt, Homo sapiens
aaagcaacagacuucucaa

SEQ ID NO: 1063396 - RNA, 14 nt, Homo sapiens
aaagcaauaaccuc

SEQ ID NO: 1063397 - RNA, 13 nt, Homo sapiens
aaagcacaggugg

SEQ ID NO: 1063398 - RNA, 12 nt, Homo sapiens
aaagcacagugu

SEQ ID NO: 1063399 - RNA, 21 nt, Homo sapiens
aaagcacccuguaucacagac

SEQ ID NO: 1063400 - RNA, 11 nt, Homo sapiens
aaagcacugac

SEQ ID NO: 1063401 - RNA, 20 nt, Homo sapiens
aaagcacugaccugucaugc

SEQ ID NO: 1063402 - RNA, 12 nt, Homo sapiens
aaagcagcaucu

SEQ ID NO: 1063403 - RNA, 19 nt, Homo sapiens
aaagcagcucaaaggcaca

SEQ ID NO: 1063404 - RNA, 17 nt, Homo sapiens
aaagcagggacuugaac

SEQ ID NO: 1063405 - RNA, 19 nt, Homo sapiens
aaagcagggacuugaaccc

SEQ ID NO: 1063406 - RNA, 15 nt, Homo sapiens
aaagcaggugcccag

SEQ ID NO: 1063407 - RNA, 20 nt, Homo sapiens
aaagcaguggcuccauuggu

SEQ ID NO: 1063408 - RNA, 21 nt, Homo sapiens
aaagcaucugagcuaacuuau

SEQ ID NO: 1063409 - RNA, 20 nt, Homo sapiens
aaagcauuacauuuccaaau

SEQ ID NO: 1063410 - RNA, 22 nt, Homo sapiens
aaagccacacucugggcuccag

SEQ ID NO: 1063411 - RNA, 17 nt, Homo sapiens
aaagccaccacauuuag

SEQ ID NO: 1063412 - RNA, 21 nt, Homo sapiens
aaagccaccagacugacaaau

SEQ ID NO: 1063413 - RNA, 15 nt, Homo sapiens
aaagcccauucauuc

SEQ ID NO: 1063414 - RNA, 13 nt, Homo sapiens
aaagcccuuccau

SEQ ID NO: 1063415 - RNA, 21 nt, Homo sapiens
aaagccucagccauucacugc

SEQ ID NO: 1063416 - RNA, 19 nt, Homo sapiens
aaagccuccaguccaagga

SEQ ID NO: 1063417 - RNA, 17 nt, Homo sapiens
aaagccuccucaucccg

SEQ ID NO: 1063418 - RNA, 17 nt, Homo sapiens
aaagccugccucuucca

SEQ ID NO: 1063419 - RNA, 17 nt, Homo sapiens
aaagccuucaaacuccc

SEQ ID NO: 1063420 - RNA, 17 nt, Homo sapiens
aaagccuucauugccuu

SEQ ID NO: 1063421 - RNA, 17 nt, Homo sapiens
aaagcguuugcauuugc

SEQ ID NO: 1063422 - RNA, 17 nt, Homo sapiens
aaagcuaaaguaucugu

SEQ ID NO: 1063423 - RNA, 22 nt, Homo sapiens
aaagcucacuaagaagcuugaa

SEQ ID NO: 1063424 - RNA, 11 nt, Homo sapiens
aaagcuucccc

SEQ ID NO: 1063425 - RNA, 16 nt, Homo sapiens
aaagcuuugugcagau

SEQ ID NO: 1063426 - RNA, 14 nt, Homo sapiens
aaaggaaaugauug

SEQ ID NO: 1063427 - RNA, 13 nt, Homo sapiens
aaaggaagacaga

SEQ ID NO: 1063428 - RNA, 14 nt, Homo sapiens
aaaggaauccacuc

SEQ ID NO: 1063429 - RNA, 21 nt, Homo sapiens
aaaggacaccuuuuaacucac

SEQ ID NO: 1063430 - RNA, 15 nt, Homo sapiens
aaaggacucuccaaa

SEQ ID NO: 1063431 - RNA, 14 nt, Homo sapiens
aaaggacuugacuu

SEQ ID NO: 1063432 - RNA, 18 nt, Homo sapiens
aaaggagaacuauccaaa

SEQ ID NO: 1063433 - RNA, 18 nt, Homo sapiens
aaaggaugcacagaguug

SEQ ID NO: 1063434 - RNA, 11 nt, Homo sapiens
aaaggcaguuc

SEQ ID NO: 1063435 - RNA, 22 nt, Homo sapiens
aaaggcauaagacccuaagccu

SEQ ID NO: 1063436 - RNA, 10 nt, Homo sapiens
aaaggccagu

SEQ ID NO: 1063437 - RNA, 22 nt, Homo sapiens
aaaggcccccuacgccaaucaa

SEQ ID NO: 1063438 - RNA, 15 nt, Homo sapiens
aaaggcucagucuca

SEQ ID NO: 1063439 - RNA, 22 nt, Homo sapiens
aaaggcuuccccaccacacuuu

SEQ ID NO: 1063440 - RNA, 21 nt, Homo sapiens
aaagggaagucuagaguuccu

SEQ ID NO: 1063441 - RNA, 16 nt, Homo sapiens
aaagggauaguccaaa

SEQ ID NO: 1063442 - RNA, 16 nt, Homo sapiens
aaagggccauguuuca

SEQ ID NO: 1063443 - RNA, 23 nt, Homo sapiens
aaagguauuaaauugauguugcu

SEQ ID NO: 1063444 - RNA, 21 nt, Homo sapiens
aaagguccaauaaaaugccuc

SEQ ID NO: 1063445 - RNA, 23 nt, Homo sapiens
aaagguccaauaaaaugccucaa

SEQ ID NO: 1063446 - RNA, 16 nt, Homo sapiens
aaagguucacucucaa

SEQ ID NO: 1063447 - RNA, 22 nt, Homo sapiens
aaagguugacaauaaaugugcu

SEQ ID NO: 1063448 - RNA, 16 nt, Homo sapiens
aaagguugagauguaa

SEQ ID NO: 1063449 - RNA, 13 nt, Homo sapiens
aaaguaaggugca

SEQ ID NO: 1063450 - RNA, 14 nt, Homo sapiens
aaaguacaaaaauu

SEQ ID NO: 1063451 - RNA, 16 nt, Homo sapiens
aaaguauaacugaguu

SEQ ID NO: 1063452 - RNA, 18 nt, Homo sapiens
aaaguaucaccagggugc

SEQ ID NO: 1063453 - RNA, 12 nt, Homo sapiens
aaaguaucuaca

SEQ ID NO: 1063454 - RNA, 18 nt, Homo sapiens
aaaguauuaucagaugcu

SEQ ID NO: 1063455 - RNA, 19 nt, Homo sapiens
aaaguauucuucucuuccu

SEQ ID NO: 1063456 - RNA, 21 nt, Homo sapiens
aaagucuggcuaugcucacag

SEQ ID NO: 1063457 - RNA, 14 nt, Homo sapiens
aaagugacauuugu

SEQ ID NO: 1063458 - RNA, 15 nt, Homo sapiens
aaagugacuauucag

SEQ ID NO: 1063459 - RNA, 14 nt, Homo sapiens
cugccauccucacc

SEQ ID NO: 1063460 - RNA, 15 nt, Homo sapiens
cugccaugccagcuu

SEQ ID NO: 1063461 - RNA, 22 nt, Homo sapiens
cugccauucacuucauaaucca

SEQ ID NO: 1063462 - RNA, 18 nt, Homo sapiens
cugccauuucugagauca

SEQ ID NO: 1063463 - RNA, 20 nt, Homo sapiens
cugccccaaacaaauaugca

SEQ ID NO: 1063464 - RNA, 21 nt, Homo sapiens
cugccccaaacaaauaugcaa

SEQ ID NO: 1063465 - RNA, 21 nt, Homo sapiens
cugccccuggcucugaccgaa

SEQ ID NO: 1063466 - RNA, 23 nt, Homo sapiens
cugccccuguucucuuccacucu

SEQ ID NO: 1063467 - RNA, 22 nt, Homo sapiens
cugcccgggaaggucaccagca

SEQ ID NO: 1063468 - RNA, 22 nt, Homo sapiens
cugcccgucucucucccaugga

SEQ ID NO: 1063469 - RNA, 16 nt, Homo sapiens
cugcccugacaugcac

SEQ ID NO: 1063470 - RNA, 15 nt, Homo sapiens
cugccuccucuucaa

SEQ ID NO: 1063471 - RNA, 13 nt, Homo sapiens
cugccucugagau

SEQ ID NO: 1063472 - RNA, 16 nt, Homo sapiens
cugccugaagucacac

SEQ ID NO: 1063473 - RNA, 17 nt, Homo sapiens
cugccugaagucacaca

SEQ ID NO: 1063474 - RNA, 17 nt, Homo sapiens
cugccuggaguccuuga

SEQ ID NO: 1063475 - RNA, 16 nt, Homo sapiens
cugccugguauaucca

SEQ ID NO: 1063476 - RNA, 12 nt, Homo sapiens
cugccuguaacu

SEQ ID NO: 1063477 - RNA, 18 nt, Homo sapiens
cugccuugaagccacuga

SEQ ID NO: 1063478 - RNA, 13 nt, Homo sapiens
cugcgacugauga

SEQ ID NO: 1063479 - RNA, 14 nt, Homo sapiens
cugcggcuguguag

SEQ ID NO: 1063480 - RNA, 22 nt, Homo sapiens
cugcgucgaagcuuugaaggcc

SEQ ID NO: 1063481 - RNA, 15 nt, Homo sapiens
cugcuacaacuucag

SEQ ID NO: 1063482 - RNA, 12 nt, Homo sapiens
cugcuaccucac

SEQ ID NO: 1063483 - RNA, 14 nt, Homo sapiens
cugcucagggcugg

SEQ ID NO: 1063484 - RNA, 13 nt, Homo sapiens
cugcuccacccuu

SEQ ID NO: 1063485 - RNA, 15 nt, Homo sapiens
cugcuccagugcagg

SEQ ID NO: 1063486 - RNA, 16 nt, Homo sapiens
cugcuccagugcagga

SEQ ID NO: 1063487 - RNA, 21 nt, Homo sapiens
cugcucccaaauaaacuccag

SEQ ID NO: 1063488 - RNA, 19 nt, Homo sapiens
cugcucccccugguggugg

SEQ ID NO: 1063489 - RNA, 18 nt, Homo sapiens
cugcucggccgucuucac

SEQ ID NO: 1063490 - RNA, 24 nt, Homo sapiens
cugcucguugccugccacugagca

SEQ ID NO: 1063491 - RNA, 21 nt, Homo sapiens
cugcucugaggcuuccagaga

SEQ ID NO: 1063492 - RNA, 18 nt, Homo sapiens
cugcugaaacaacaaaua

SEQ ID NO: 1063493 - RNA, 14 nt, Homo sapiens
cugcugacaguguu

SEQ ID NO: 1063494 - RNA, 14 nt, Homo sapiens
cugcugaccuccac

SEQ ID NO: 1063495 - RNA, 18 nt, Homo sapiens
cugcugagagggcugcug

SEQ ID NO: 1063496 - RNA, 22 nt, Homo sapiens
cugcugagagggcugcugacca

SEQ ID NO: 1063497 - RNA, 23 nt, Homo sapiens
cugcugagagggcugcugaccau

SEQ ID NO: 1063498 - RNA, 18 nt, Homo sapiens
cugcugagugcaccacuu

SEQ ID NO: 1063499 - RNA, 22 nt, Homo sapiens
cugcugaucucaguuuccuggc

SEQ ID NO: 1063500 - RNA, 23 nt, Homo sapiens
cugcuggagaaaaaacacacucc

SEQ ID NO: 1063501 - RNA, 23 nt, Homo sapiens
cugcuggcagaaagcaaauguga

SEQ ID NO: 1063502 - RNA, 16 nt, Homo sapiens
cugcuggcugcucccc

SEQ ID NO: 1063503 - RNA, 19 nt, Homo sapiens
cugcuguucauguuacuca

SEQ ID NO: 1063504 - RNA, 16 nt, Homo sapiens
cugcuucaaauauuuc

SEQ ID NO: 1063505 - RNA, 19 nt, Homo sapiens
cugcuucacaaaccuugcu

SEQ ID NO: 1063506 - RNA, 17 nt, Homo sapiens
cugcuuccagugaggcu

SEQ ID NO: 1063507 - RNA, 22 nt, Homo sapiens
cugcuucuuuucacuucagagc

SEQ ID NO: 1063508 - RNA, 15 nt, Homo sapiens
cugcuugaacccagg

SEQ ID NO: 1063509 - RNA, 21 nt, Homo sapiens
cugcuuggguggagaagccau

SEQ ID NO: 1063510 - RNA, 22 nt, Homo sapiens
cugcuuggguggagaagccauu

SEQ ID NO: 1063511 - RNA, 17 nt, Homo sapiens
cugcuuuacuuugccca

SEQ ID NO: 1063512 - RNA, 15 nt, Homo sapiens
ccauagagacuuugu

SEQ ID NO: 1063513 - RNA, 20 nt, Homo sapiens
ccauagcaagauugcuuaaa

SEQ ID NO: 1063514 - RNA, 19 nt, Homo sapiens
ccauagggacccauucuac

SEQ ID NO: 1063515 - RNA, 21 nt, Homo sapiens
ccauagggacccauucuacac

SEQ ID NO: 1063516 - RNA, 16 nt, Homo sapiens
ccauaucuacccagaa

SEQ ID NO: 1063517 - RNA, 17 nt, Homo sapiens
ccauauucauguaaaca

SEQ ID NO: 1063518 - RNA, 11 nt, Homo sapiens
ccaucaaacac

SEQ ID NO: 1063519 - RNA, 12 nt, Homo sapiens
ccauccagguuc

SEQ ID NO: 1063520 - RNA, 18 nt, Homo sapiens
ccauccccuggacuggga

SEQ ID NO: 1063521 - RNA, 19 nt, Homo sapiens
ccauccccuggacugggag

SEQ ID NO: 1063522 - RNA, 19 nt, Homo sapiens
ccauccuaccaaugcaugc

SEQ ID NO: 1063523 - RNA, 20 nt, Homo sapiens
ccauccucacaugugacaaa

SEQ ID NO: 1063524 - RNA, 11 nt, Homo sapiens
ccauccucacc

SEQ ID NO: 1063525 - RNA, 23 nt, Homo sapiens
ccauccuugugaaccccaaagug

SEQ ID NO: 1063526 - RNA, 20 nt, Homo sapiens
ccaucguuuucuucacuguc

SEQ ID NO: 1063527 - RNA, 19 nt, Homo sapiens
ccaucucuacaaaaagcau

SEQ ID NO: 1063528 - RNA, 22 nt, Homo sapiens
ccaucucuacugaaaguacaaa

SEQ ID NO: 1063529 - RNA, 13 nt, Homo sapiens
ccaucucuuuacc

SEQ ID NO: 1063530 - RNA, 13 nt, Homo sapiens
ccaucugcuuaca

SEQ ID NO: 1063531 - RNA, 19 nt, Homo sapiens
ccaucugcuuacaauuccc

SEQ ID NO: 1063532 - RNA, 17 nt, Homo sapiens
ccaucugggcuucacag

SEQ ID NO: 1063533 - RNA, 22 nt, Homo sapiens
ccaucuuuugugagauguaauu

SEQ ID NO: 1063534 - RNA, 23 nt, Homo sapiens
ccaucuuuugugagauguaauug

SEQ ID NO: 1063535 - RNA, 23 nt, Homo sapiens
ccaugaaaaugcaacaacaugua

SEQ ID NO: 1063536 - RNA, 20 nt, Homo sapiens
ccaugaacacguuuuuucac

SEQ ID NO: 1063537 - RNA, 15 nt, Homo sapiens
ccaugaagacaggau

SEQ ID NO: 1063538 - RNA, 15 nt, Homo sapiens
ccaugacccaggcug

SEQ ID NO: 1063539 - RNA, 10 nt, Homo sapiens
ccaugccacc

SEQ ID NO: 1063540 - RNA, 21 nt, Homo sapiens
ccaugccaucucaaccucuuc

SEQ ID NO: 1063541 - RNA, 16 nt, Homo sapiens
ccaugcugaccugugu

SEQ ID NO: 1063542 - RNA, 19 nt, Homo sapiens
ccaugcugcccgcuucuca

SEQ ID NO: 1063543 - RNA, 14 nt, Homo sapiens
ccauggacacucca

SEQ ID NO: 1063544 - RNA, 17 nt, Homo sapiens
ccauggacccaauauuu

SEQ ID NO: 1063545 - RNA, 22 nt, Homo sapiens
ccauggagacaagggcaucauc

SEQ ID NO: 1063546 - RNA, 14 nt, Homo sapiens
ccauggauccugaa

SEQ ID NO: 1063547 - RNA, 19 nt, Homo sapiens
ccauggcaccuucagacuu

SEQ ID NO: 1063548 - RNA, 15 nt, Homo sapiens
ccauggggaagggau

SEQ ID NO: 1063549 - RNA, 21 nt, Homo sapiens
ccaugggguccuaccaauaga

SEQ ID NO: 1063550 - RNA, 16 nt, Homo sapiens
ccauguacaugaagaa

SEQ ID NO: 1063551 - RNA, 21 nt, Homo sapiens
ccaugucuuuggacaaccaug

SEQ ID NO: 1063552 - RNA, 20 nt, Homo sapiens
ccaugugugagugugugcaa

SEQ ID NO: 1063553 - RNA, 15 nt, Homo sapiens
ccaugugugugcaag

SEQ ID NO: 1063554 - RNA, 23 nt, Homo sapiens
ccaugugugugcaagugugugca

SEQ ID NO: 1063555 - RNA, 23 nt, Homo sapiens
ccauuaaagucgagcuuuucuaa

SEQ ID NO: 1063556 - RNA, 15 nt, Homo sapiens
ccauuagaagauauu

SEQ ID NO: 1063557 - RNA, 14 nt, Homo sapiens
ccauucaucuucau

SEQ ID NO: 1063558 - RNA, 18 nt, Homo sapiens
ccauuccauuuaucuuuc

SEQ ID NO: 1063559 - RNA, 11 nt, Homo sapiens
ccauucucuga

SEQ ID NO: 1063560 - RNA, 22 nt, Homo sapiens
ccauucuggaagugacuuuggc

SEQ ID NO: 1063561 - RNA, 21 nt, Homo sapiens
ccauugaauuugccuuccuca

SEQ ID NO: 1063562 - RNA, 15 nt, Homo sapiens
ccauugguguugaca

SEQ ID NO: 1063563 - RNA, 20 nt, Homo sapiens
ccauuguuccugcgcugcaa

SEQ ID NO: 1063564 - RNA, 16 nt, Homo sapiens
ccauuguuugaaacaa

SEQ ID NO: 1063565 - RNA, 20 nt, Homo sapiens
ccauuugugugugugcaagu

SEQ ID NO: 1063566 - RNA, 21 nt, Homo sapiens
ccauuuguuggggcaguggua

SEQ ID NO: 1063567 - RNA, 14 nt, Homo sapiens
ccauuuugcaaaau

SEQ ID NO: 1063568 - RNA, 19 nt, Homo sapiens
ccauuuuggaaguuuucag

SEQ ID NO: 1063569 - RNA, 17 nt, Homo sapiens
cccaaacaugcacuucc

SEQ ID NO: 1063570 - RNA, 19 nt, Homo sapiens
cccaaagugcugagauuau

SEQ ID NO: 1063571 - RNA, 23 nt, Homo sapiens
cccaacagcacuuagguuuuccu

SEQ ID NO: 1063572 - RNA, 23 nt, Homo sapiens
cccaagaggucaaggcugcagug

SEQ ID NO: 1063573 - RNA, 21 nt, Homo sapiens
cccaagcaaaaucauggaaug

SEQ ID NO: 1063574 - RNA, 11 nt, Homo sapiens
cccaagggaaa

SEQ ID NO: 1063575 - RNA, 18 nt, Homo sapiens
cccaagugaaaucaaagg

SEQ ID NO: 1063576 - RNA, 16 nt, Homo sapiens
cccaaguuccacugcu

SEQ ID NO: 1063577 - RNA, 17 nt, Homo sapiens
cccaaguuguggugcug

SEQ ID NO: 1063578 - RNA, 17 nt, Homo sapiens
cccaauauuuaccagac

SEQ ID NO: 1063579 - RNA, 22 nt, Homo sapiens
cccaauggcaacaucuugcaaa

SEQ ID NO: 1063580 - RNA, 17 nt, Homo sapiens
cccaauuuacuugccau

SEQ ID NO: 1063581 - RNA, 22 nt, Homo sapiens
cccacacuccauggagucugga

SEQ ID NO: 1063582 - RNA, 13 nt, Homo sapiens
cccacaguggaaa

SEQ ID NO: 1063583 - RNA, 15 nt, Homo sapiens
cccaccaucaugucu

SEQ ID NO: 1063584 - RNA, 15 nt, Homo sapiens
cccacccaacuaauu

SEQ ID NO: 1063585 - RNA, 11 nt, Homo sapiens
cccacccaguc

SEQ ID NO: 1063586 - RNA, 17 nt, Homo sapiens
cccacccccuucucugc

SEQ ID NO: 1063587 - RNA, 14 nt, Homo sapiens
cccaccuggccacc

SEQ ID NO: 1063588 - RNA, 22 nt, Homo sapiens
cccaccuucuucagccaccucu

SEQ ID NO: 1063589 - RNA, 19 nt, Homo sapiens
cccacgcuggagugcagug

SEQ ID NO: 1063590 - RNA, 22 nt, Homo sapiens
cccacugaguuugcuguuugca

SEQ ID NO: 1063591 - RNA, 16 nt, Homo sapiens
cccacugccucagguu

SEQ ID NO: 1063592 - RNA, 16 nt, Homo sapiens
cccacugcucugguua

SEQ ID NO: 1063593 - RNA, 13 nt, Homo sapiens
cccacugcuucua

SEQ ID NO: 1063594 - RNA, 20 nt, Homo sapiens
cccacugggagcacuuugua

SEQ ID NO: 1063595 - RNA, 19 nt, Homo sapiens
cccacuuggcaucauucac

SEQ ID NO: 1063596 - RNA, 12 nt, Homo sapiens
cccagacagcuc

SEQ ID NO: 1063597 - RNA, 20 nt, Homo sapiens
cccagagaggguggugaccu

SEQ ID NO: 1063598 - RNA, 21 nt, Homo sapiens
cccagaggcucagcacuuugg

SEQ ID NO: 1063599 - RNA, 18 nt, Homo sapiens
cccagaguccucuaugaa

SEQ ID NO: 1063600 - RNA, 21 nt, Homo sapiens
cccagauagcuggcugggugg

SEQ ID NO: 1063601 - RNA, 12 nt, Homo sapiens
cccagauccuca

SEQ ID NO: 1063602 - RNA, 12 nt, Homo sapiens
cccagcacuuug

SEQ ID NO: 1063603 - RNA, 13 nt, Homo sapiens
cccagcacuuugg

SEQ ID NO: 1063604 - RNA, 21 nt, Homo sapiens
cccagcaggacagugacccca

SEQ ID NO: 1063605 - RNA, 20 nt, Homo sapiens
cccagccaaacccugucuga

SEQ ID NO: 1063606 - RNA, 23 nt, Homo sapiens
cccagccaucugcccaggggugc

SEQ ID NO: 1063607 - RNA, 21 nt, Homo sapiens
cccagcccccacagugcuguc

SEQ ID NO: 1063608 - RNA, 21 nt, Homo sapiens
cccagccccuucugacccaug

SEQ ID NO: 1063609 - RNA, 16 nt, Homo sapiens
cccagcuaacucugac

SEQ ID NO: 1063610 - RNA, 15 nt, Homo sapiens
cccagcuacuuuaac

SEQ ID NO: 1063611 - RNA, 20 nt, Homo sapiens
cccagcucugguccauagag

SEQ ID NO: 1063612 - RNA, 18 nt, Homo sapiens
cccagcugggcucugcca

SEQ ID NO: 1063613 - RNA, 16 nt, Homo sapiens
cccaggaacugggcca

SEQ ID NO: 1063614 - RNA, 23 nt, Homo sapiens
cccaggagguggagguugcagug

SEQ ID NO: 1063615 - RNA, 21 nt, Homo sapiens
cccaggagguggcuauggcca

SEQ ID NO: 1063616 - RNA, 16 nt, Homo sapiens
cccaggaguguggcca

SEQ ID NO: 1063617 - RNA, 19 nt, Homo sapiens
cccaggaucagauugcaug

SEQ ID NO: 1063618 - RNA, 23 nt, Homo sapiens
cccaggccaguaagggaaauaga

SEQ ID NO: 1063619 - RNA, 22 nt, Homo sapiens
cccaggcccagaccuucuagga

SEQ ID NO: 1063620 - RNA, 19 nt, Homo sapiens
cccaggccgggguggagca

SEQ ID NO: 1063621 - RNA, 19 nt, Homo sapiens
cccaggcuggagugcaaug

SEQ ID NO: 1063622 - RNA, 15 nt, Homo sapiens
cccaggcugggcaag

SEQ ID NO: 1063623 - RNA, 19 nt, Homo sapiens
cccaggcuuuugaaaaaca

SEQ ID NO: 1063624 - RNA, 15 nt, Homo sapiens
cccagggacuuccuc

SEQ ID NO: 1063625 - RNA, 20 nt, Homo sapiens
cccaggguugaggggaccaa

SEQ ID NO: 1063626 - RNA, 19 nt, Homo sapiens
cccaguucauugcacuuug

SEQ ID NO: 1063627 - RNA, 14 nt, Homo sapiens
cccauagcuuccau

SEQ ID NO: 1063628 - RNA, 16 nt, Homo sapiens
cccaucauacacuucc

SEQ ID NO: 1063629 - RNA, 23 nt, Homo sapiens
cccaucauucaugcuacugccaa

SEQ ID NO: 1063630 - RNA, 13 nt, Homo sapiens
cccauccuuguga

SEQ ID NO: 1063631 - RNA, 13 nt, Homo sapiens
cccaucucuacaa

SEQ ID NO: 1063632 - RNA, 13 nt, Homo sapiens
cccaucugggagu

SEQ ID NO: 1063633 - RNA, 18 nt, Homo sapiens
cccaugagguacagcaga

SEQ ID NO: 1063634 - RNA, 17 nt, Homo sapiens
cccaugggaagggucca

SEQ ID NO: 1063635 - RNA, 14 nt, Homo sapiens
cccaugugugagug

SEQ ID NO: 1063636 - RNA, 21 nt, Homo sapiens
cccauuguuccugcgcugcaa

SEQ ID NO: 1063637 - RNA, 17 nt, Homo sapiens
cccauuucaauuccugu

SEQ ID NO: 1063638 - RNA, 22 nt, Homo sapiens
cccaagggccuggccugagcug

SEQ ID NO: 1063639 - RNA, 16 nt, Homo sapiens
cccaagggcuccagac

SEQ ID NO: 1063640 - RNA, 18 nt, Homo sapiens
cccaaugcacacaaaaca

SEQ ID NO: 1063641 - RNA, 16 nt, Homo sapiens
cccaauuuacuugcca

SEQ ID NO: 1063642 - RNA, 20 nt, Homo sapiens
cccacaagugccacugcccg

SEQ ID NO: 1063643 - RNA, 22 nt, Homo sapiens
cccacacccuggaggauuucau

SEQ ID NO: 1063644 - RNA, 15 nt, Homo sapiens
cccacaccguguaaa

SEQ ID NO: 1063645 - RNA, 22 nt, Homo sapiens
cccacacugaccuguguucccu

SEQ ID NO: 1063646 - RNA, 23 nt, Homo sapiens
cccacagcaggugcugagcaaag

SEQ ID NO: 1063647 - RNA, 23 nt, Homo sapiens
cccacaugugacacauaugcacc

SEQ ID NO: 1063648 - RNA, 19 nt, Homo sapiens
cccaccagcaauacaaaga

SEQ ID NO: 1063649 - RNA, 14 nt, Homo sapiens
cccacccacaugug

SEQ ID NO: 1063650 - RNA, 17 nt, Homo sapiens
cccacccacaugugaca

SEQ ID NO: 1063651 - RNA, 16 nt, Homo sapiens
cccaccccacaauucc

SEQ ID NO: 1063652 - RNA, 21 nt, Homo sapiens
cccacccuccuuucaccacau

SEQ ID NO: 1063653 - RNA, 14 nt, Homo sapiens
cccacccugggacc

SEQ ID NO: 1063654 - RNA, 19 nt, Homo sapiens
cccaccugucaaacaaagc

SEQ ID NO: 1063655 - RNA, 21 nt, Homo sapiens
cccacgacugcccggcagggu

SEQ ID NO: 1063656 - RNA, 20 nt, Homo sapiens
cccacguagggcggcacuca

SEQ ID NO: 1063657 - RNA, 21 nt, Homo sapiens
cccacguagggcggcacucac

SEQ ID NO: 1063658 - RNA, 13 nt, Homo sapiens
cccacugagauuu

SEQ ID NO: 1063659 - RNA, 14 nt, Homo sapiens
cccacugcucauuu

SEQ ID NO: 1063660 - RNA, 17 nt, Homo sapiens
cccagaaaaggacagaa

SEQ ID NO: 1063661 - RNA, 14 nt, Homo sapiens
cccagaauagcuuu

SEQ ID NO: 1063662 - RNA, 22 nt, Homo sapiens
cccagaccuuuuauccacuuac

SEQ ID NO: 1063663 - RNA, 12 nt, Homo sapiens
cccagagcagga

SEQ ID NO: 1063664 - RNA, 19 nt, Homo sapiens
cccagagguaacagaacag

SEQ ID NO: 1063665 - RNA, 21 nt, Homo sapiens
cccagagugugaaacuuccua

SEQ ID NO: 1063666 - RNA, 23 nt, Homo sapiens
cccagauguuuuacgucugggag

SEQ ID NO: 1063667 - RNA, 12 nt, Homo sapiens
cccagauugcaa

SEQ ID NO: 1063668 - RNA, 12 nt, Homo sapiens
cccagauuuccu

SEQ ID NO: 1063669 - RNA, 19 nt, Homo sapiens
cccagccccuccaaagguc

SEQ ID NO: 1063670 - RNA, 14 nt, Homo sapiens
cccagccucuaggg

SEQ ID NO: 1063671 - RNA, 18 nt, Homo sapiens
cccagcuaccucaaccaa

SEQ ID NO: 1063672 - RNA, 20 nt, Homo sapiens
cccagcuacucaggagguug

SEQ ID NO: 1063673 - RNA, 12 nt, Homo sapiens
cccagcuacucg

SEQ ID NO: 1063674 - RNA, 15 nt, Homo sapiens
cccagcuacucggga

SEQ ID NO: 1063675 - RNA, 13 nt, Homo sapiens
cccagcuacuuga

SEQ ID NO: 1063676 - RNA, 17 nt, Homo sapiens
cccagcuccccaagaaa

SEQ ID NO: 1063677 - RNA, 11 nt, Homo sapiens
cccagcucucg

SEQ ID NO: 1063678 - RNA, 21 nt, Homo sapiens
cccagcuuaauggcucaugac

SEQ ID NO: 1063679 - RNA, 19 nt, Homo sapiens
cccagcuugggcccagcug

SEQ ID NO: 1063680 - RNA, 15 nt, Homo sapiens
cccaggagcagcauc

SEQ ID NO: 1063681 - RNA, 23 nt, Homo sapiens
cccaggaggucgaccccaaagcc

SEQ ID NO: 1063682 - RNA, 13 nt, Homo sapiens
cccaggaguacac

SEQ ID NO: 1063683 - RNA, 17 nt, Homo sapiens
cccaggcaccugcauuu

SEQ ID NO: 1063684 - RNA, 19 nt, Homo sapiens
cccaggcaucugcuuuacu

SEQ ID NO: 1063685 - RNA, 20 nt, Homo sapiens
cccaggcuggagugcaaugg

SEQ ID NO: 1063686 - RNA, 22 nt, Homo sapiens
cccaggcuuuugaaaaacaaac

SEQ ID NO: 1063687 - RNA, 17 nt, Homo sapiens
cccagggaagccaaaag

SEQ ID NO: 1063688 - RNA, 16 nt, Homo sapiens
cccagggagaggccau

SEQ ID NO: 1063689 - RNA, 18 nt, Homo sapiens
cccaggguagcccgccug

SEQ ID NO: 1063690 - RNA, 22 nt, Homo sapiens
cccaggugguuauggagagggu

SEQ ID NO: 1063691 - RNA, 23 nt, Homo sapiens
cccagguuucuggucucuaggcu

SEQ ID NO: 1063692 - RNA, 19 nt, Homo sapiens
cccagucuggaaugcagug

SEQ ID NO: 1063693 - RNA, 15 nt, Homo sapiens
cccagugccaagcac

SEQ ID NO: 1063694 - RNA, 10 nt, Homo sapiens
cccagugugu

SEQ ID NO: 1063695 - RNA, 14 nt, Homo sapiens
cccaguguguuucu

SEQ ID NO: 1063696 - RNA, 21 nt, Homo sapiens
cccaguguguuucugaucuga

SEQ ID NO: 1063697 - RNA, 14 nt, Homo sapiens
cccaguuagcacca

SEQ ID NO: 1063698 - RNA, 21 nt, Homo sapiens
cccaguucauugcacuuugau

SEQ ID NO: 1063699 - RNA, 15 nt, Homo sapiens
cccauaucugugaaa

SEQ ID NO: 1063700 - RNA, 17 nt, Homo sapiens
cccauaucugugaaaug

SEQ ID NO: 1063701 - RNA, 12 nt, Homo sapiens
cccaucauccca

SEQ ID NO: 1063702 - RNA, 22 nt, Homo sapiens
cccaucauucaugcuacugcca

SEQ ID NO: 1063703 - RNA, 14 nt, Homo sapiens
cccauccagugucu

SEQ ID NO: 1063704 - RNA, 22 nt, Homo sapiens
cccauccaucugcuuacaauuc

SEQ ID NO: 1063705 - RNA, 12 nt, Homo sapiens
cccaucuaugag

SEQ ID NO: 1063706 - RNA, 15 nt, Homo sapiens
cccaucucuacugaa

SEQ ID NO: 1063707 - RNA, 23 nt, Homo sapiens
cccaucuuguuucacacuaguca

SEQ ID NO: 1063708 - RNA, 16 nt, Homo sapiens
cccaugaguccuugaa

SEQ ID NO: 1063709 - RNA, 15 nt, Homo sapiens
cccauggacacucca

SEQ ID NO: 1063710 - RNA, 23 nt, Homo sapiens
cccauggagacagaaaguagaau

SEQ ID NO: 1063711 - RNA, 21 nt, Homo sapiens
cccauggcuuuagcuaccuca

SEQ ID NO: 1063712 - RNA, 23 nt, Homo sapiens
cccauguauuuaucucuauuuaa

SEQ ID NO: 1063713 - RNA, 17 nt, Homo sapiens
cccauuccuauuucuua

SEQ ID NO: 1063714 - RNA, 19 nt, Homo sapiens
cccauucuacacagagcag

SEQ ID NO: 1063715 - RNA, 23 nt, Homo sapiens
cccauuggacacguggugcauuu

SEQ ID NO: 1063716 - RNA, 21 nt, Homo sapiens
cccauuucaauuccugugauu

SEQ ID NO: 1063717 - RNA, 14 nt, Homo sapiens
cccauuuugcaaaa

SEQ ID NO: 1063718 - RNA, 13 nt, Homo sapiens
ccccacacucacu

SEQ ID NO: 1063719 - RNA, 22 nt, Homo sapiens
ccccacacugaccuguguuccc

SEQ ID NO: 1063720 - RNA, 19 nt, Homo sapiens
ccccaccacuguuggucca

SEQ ID NO: 1063721 - RNA, 23 nt, Homo sapiens
ccccacgagggucaggacuguga

SEQ ID NO: 1063722 - RNA, 11 nt, Homo sapiens
ccccacugaca

SEQ ID NO: 1063723 - RNA, 23 nt, Homo sapiens
ccccagaaccuguccuugcacac

SEQ ID NO: 1063724 - RNA, 14 nt, Homo sapiens
ccccagagcuguuu

SEQ ID NO: 1063725 - RNA, 19 nt, Homo sapiens
ccccagaggccucucucuc

SEQ ID NO: 1063726 - RNA, 19 nt, Homo sapiens
ccccagaggcucagcacuu

SEQ ID NO: 1063727 - RNA, 20 nt, Homo sapiens
ccccagaggcucagcacuuu

SEQ ID NO: 1063728 - RNA, 15 nt, Homo sapiens
ccccagaucugcucc

SEQ ID NO: 1063729 - RNA, 12 nt, Homo sapiens
ccccagcucaau

SEQ ID NO: 1063730 - RNA, 15 nt, Homo sapiens
ccccaguucugcucc

SEQ ID NO: 1063731 - RNA, 14 nt, Homo sapiens
ccccaucugugaau

SEQ ID NO: 1063732 - RNA, 15 nt, Homo sapiens
ccccaugccugucca

SEQ ID NO: 1063733 - RNA, 20 nt, Homo sapiens
cccccaaauaagaagggaug

SEQ ID NO: 1063734 - RNA, 21 nt, Homo sapiens
cccccauuguggucacaggaa

SEQ ID NO: 1063735 - RNA, 22 nt, Homo sapiens
cccccauuguggucacaggaag

SEQ ID NO: 1063736 - RNA, 13 nt, Homo sapiens
ccccccaguggac

SEQ ID NO: 1063737 - RNA, 14 nt, Homo sapiens
cccccuccugcaag

SEQ ID NO: 1063738 - RNA, 12 nt, Homo sapiens
cccccugcauuc

SEQ ID NO: 1063739 - RNA, 13 nt, Homo sapiens
ccccggaacaagc

SEQ ID NO: 1063740 - RNA, 15 nt, Homo sapiens
ccccgucacagccuc

SEQ ID NO: 1063741 - RNA, 21 nt, Homo sapiens
ccccgucgaggggcucucagc

SEQ ID NO: 1063742 - RNA, 20 nt, Homo sapiens
ccccgugaggaugucacuca

SEQ ID NO: 1063743 - RNA, 19 nt, Homo sapiens
aaguugcaccaacuuugaa

SEQ ID NO: 1063744 - RNA, 17 nt, Homo sapiens
aaguugcugaugaacuc

SEQ ID NO: 1063745 - RNA, 20 nt, Homo sapiens
aaguugcugaugaacucuua

SEQ ID NO: 1063746 - RNA, 17 nt, Homo sapiens
aaguuguggugcugaca

SEQ ID NO: 1063747 - RNA, 14 nt, Homo sapiens
aaguuguugauguu

SEQ ID NO: 1063748 - RNA, 19 nt, Homo sapiens
aaguuuacaaucaaaggaa

SEQ ID NO: 1063749 - RNA, 18 nt, Homo sapiens
aaguuuaugcauacagua

SEQ ID NO: 1063750 - RNA, 11 nt, Homo sapiens
aaguuucacau

SEQ ID NO: 1063751 - RNA, 22 nt, Homo sapiens
aaguuucaucagucaaugagga

SEQ ID NO: 1063752 - RNA, 18 nt, Homo sapiens
aaguuucucagcucccau

SEQ ID NO: 1063753 - RNA, 13 nt, Homo sapiens
aaguuugagauca

SEQ ID NO: 1063754 - RNA, 21 nt, Homo sapiens
aaguuugucacuaaacucuca

SEQ ID NO: 1063755 - RNA, 16 nt, Homo sapiens
aaguuuuauacuugau

SEQ ID NO: 1063756 - RNA, 13 nt, Homo sapiens
aaguuuucaggac

SEQ ID NO: 1063757 - RNA, 19 nt, Homo sapiens
aaguuuugacaucaaugau

SEQ ID NO: 1063758 - RNA, 22 nt, Homo sapiens
aauaaaaauggcucagaugcca

SEQ ID NO: 1063759 - RNA, 11 nt, Homo sapiens
aauaaaacugu

SEQ ID NO: 1063760 - RNA, 18 nt, Homo sapiens
aauaaaaugaaauacuaa

SEQ ID NO: 1063761 - RNA, 16 nt, Homo sapiens
aauaaaauuuaacuca

SEQ ID NO: 1063762 - RNA, 18 nt, Homo sapiens
aauaaaauuuaggaccaa

SEQ ID NO: 1063763 - RNA, 17 nt, Homo sapiens
aauaaacugcuuugcaa

SEQ ID NO: 1063764 - RNA, 20 nt, Homo sapiens
aauaaacuguguuuacucag

SEQ ID NO: 1063765 - RNA, 15 nt, Homo sapiens
aauaaagaccugaga

SEQ ID NO: 1063766 - RNA, 20 nt, Homo sapiens
aauaaagaugcccacugagg

SEQ ID NO: 1063767 - RNA, 20 nt, Homo sapiens
aauaaagcccuugaaccagc

SEQ ID NO: 1063768 - RNA, 17 nt, Homo sapiens
aauaaaguauagguuua

SEQ ID NO: 1063769 - RNA, 15 nt, Homo sapiens
aauaaauaaucugua

SEQ ID NO: 1063770 - RNA, 16 nt, Homo sapiens
aauaaauguacauuaa

SEQ ID NO: 1063771 - RNA, 14 nt, Homo sapiens
aauaaaugugcuua

SEQ ID NO: 1063772 - RNA, 14 nt, Homo sapiens
aauaaauugcuccu

SEQ ID NO: 1063773 - RNA, 19 nt, Homo sapiens
aauaacaacagaucugcag

SEQ ID NO: 1063774 - RNA, 12 nt, Homo sapiens
aauaacacuguc

SEQ ID NO: 1063775 - RNA, 14 nt, Homo sapiens
aauaaccacuuaaa

SEQ ID NO: 1063776 - RNA, 23 nt, Homo sapiens
aauaacuaaaagguaugcaauca

SEQ ID NO: 1063777 - RNA, 17 nt, Homo sapiens
aauaacuuauaucauca

SEQ ID NO: 1063778 - RNA, 21 nt, Homo sapiens
aauaacuuuucuaaagccuua

SEQ ID NO: 1063779 - RNA, 12 nt, Homo sapiens
aauaagauuuaa

SEQ ID NO: 1063780 - RNA, 15 nt, Homo sapiens
aauaauaaaucuggu

SEQ ID NO: 1063781 - RNA, 14 nt, Homo sapiens
aauaauaccuaagc

SEQ ID NO: 1063782 - RNA, 14 nt, Homo sapiens
aauaauauuagcuu

SEQ ID NO: 1063783 - RNA, 20 nt, Homo sapiens
aauaaucacgcuuuccugaa

SEQ ID NO: 1063784 - RNA, 21 nt, Homo sapiens
aauaaugaguuagaacuauua

SEQ ID NO: 1063785 - RNA, 22 nt, Homo sapiens
aauaaugaguuagaacuauuaa

SEQ ID NO: 1063786 - RNA, 14 nt, Homo sapiens
aauaauguacaucu

SEQ ID NO: 1063787 - RNA, 14 nt, Homo sapiens
aauaauugauuuca

SEQ ID NO: 1063788 - RNA, 15 nt, Homo sapiens
aauacaaacaaugga

SEQ ID NO: 1063789 - RNA, 17 nt, Homo sapiens
aauacagaacccauucc

SEQ ID NO: 1063790 - RNA, 17 nt, Homo sapiens
aauacagggcaugcauu

SEQ ID NO: 1063791 - RNA, 21 nt, Homo sapiens
aauacagucuuccauuugcaa

SEQ ID NO: 1063792 - RNA, 24 nt, Homo sapiens
aauacauaaaguaugugcauauuu

SEQ ID NO: 1063793 - RNA, 15 nt, Homo sapiens
aauacaugcaucuca

SEQ ID NO: 1063794 - RNA, 20 nt, Homo sapiens
aauacaugcugcuaauucaa

SEQ ID NO: 1063795 - RNA, 18 nt, Homo sapiens
aauaccagugaaccaaag

SEQ ID NO: 1063796 - RNA, 20 nt, Homo sapiens
aauacuauauuuauacugua

SEQ ID NO: 1063797 - RNA, 16 nt, Homo sapiens
aauacucaaaagagag

SEQ ID NO: 1063798 - RNA, 14 nt, Homo sapiens
aauacuccuaagac

SEQ ID NO: 1063799 - RNA, 21 nt, Homo sapiens
aauacugccagaugcugaugu

SEQ ID NO: 1063800 - RNA, 14 nt, Homo sapiens
aauagaacagagaa

SEQ ID NO: 1063801 - RNA, 23 nt, Homo sapiens
aauagcauacaucaauggugugu

SEQ ID NO: 1063802 - RNA, 13 nt, Homo sapiens
aauagccaaucau

SEQ ID NO: 1063803 - RNA, 21 nt, Homo sapiens
aauagccuaauacaacaugua

SEQ ID NO: 1063804 - RNA, 14 nt, Homo sapiens
aauaggcauuugau

SEQ ID NO: 1063805 - RNA, 15 nt, Homo sapiens
aauagugguugccaa

SEQ ID NO: 1063806 - RNA, 14 nt, Homo sapiens
aauaguuuacaugu

SEQ ID NO: 1063807 - RNA, 16 nt, Homo sapiens
aauaguuuacauguag

SEQ ID NO: 1063808 - RNA, 18 nt, Homo sapiens
aauaguuuugauccuaaa

SEQ ID NO: 1063809 - RNA, 19 nt, Homo sapiens
aauaguuuugauccuaaau

SEQ ID NO: 1063810 - RNA, 22 nt, Homo sapiens
aauauaaaaggcaaauguguac

SEQ ID NO: 1063811 - RNA, 22 nt, Homo sapiens
aauauaaauuuguguucucaaa

SEQ ID NO: 1063812 - RNA, 19 nt, Homo sapiens
aauauaauaugcacacagu

SEQ ID NO: 1063813 - RNA, 14 nt, Homo sapiens
aauauacccaucca

SEQ ID NO: 1063814 - RNA, 22 nt, Homo sapiens
aauauagagggcuuaugauuca

SEQ ID NO: 1063815 - RNA, 21 nt, Homo sapiens
aauauaugcaucccuggugaa

SEQ ID NO: 1063816 - RNA, 16 nt, Homo sapiens
aauaucugaaauguga

SEQ ID NO: 1063817 - RNA, 19 nt, Homo sapiens
aauaucuugaaacauagag

SEQ ID NO: 1063818 - RNA, 19 nt, Homo sapiens
aauaugccuuuuugaagca

SEQ ID NO: 1063819 - RNA, 17 nt, Homo sapiens
aauaugguguacauucu

SEQ ID NO: 1063820 - RNA, 18 nt, Homo sapiens
aauauuagaagccugcag

SEQ ID NO: 1063821 - RNA, 23 nt, Homo sapiens
aauauuaucacgcagaucacuaa

SEQ ID NO: 1063822 - RNA, 19 nt, Homo sapiens
aauauucuauaugaauuua

SEQ ID NO: 1063823 - RNA, 23 nt, Homo sapiens
aauauuguccauuguccaauccu

SEQ ID NO: 1063824 - RNA, 19 nt, Homo sapiens
aauauuuaaacagcagugu

SEQ ID NO: 1063825 - RNA, 17 nt, Homo sapiens
aauauuuauuaccucug

SEQ ID NO: 1063826 - RNA, 18 nt, Homo sapiens
aauauuugacaggcuuau

SEQ ID NO: 1063827 - RNA, 18 nt, Homo sapiens
aauauuugcugacagcug

SEQ ID NO: 1063828 - RNA, 14 nt, Homo sapiens
aauauuuguagaag

SEQ ID NO: 1063829 - RNA, 23 nt, Homo sapiens
aauauuuucauacagcauuacaa

SEQ ID NO: 1063830 - RNA, 20 nt, Homo sapiens
aauauuuuguaacuauuaca

SEQ ID NO: 1063831 - RNA, 17 nt, Homo sapiens
aauauuuuuaugugcaa

SEQ ID NO: 1063832 - RNA, 19 nt, Homo sapiens
aauauuuuuaugugcaaua

SEQ ID NO: 1063833 - RNA, 21 nt, Homo sapiens
aauauuuuucuguagugugaa

SEQ ID NO: 1063834 - RNA, 19 nt, Homo sapiens
aauauuuuuggucauugua

SEQ ID NO: 1063835 - RNA, 11 nt, Homo sapiens
aaucaaagcaa

SEQ ID NO: 1063836 - RNA, 13 nt, Homo sapiens
aaucaaagcagau

SEQ ID NO: 1063837 - RNA, 13 nt, Homo sapiens
aaucaaauagcau

SEQ ID NO: 1063838 - RNA, 20 nt, Homo sapiens
aaucaaauaugcaaagcacu

SEQ ID NO: 1063839 - RNA, 12 nt, Homo sapiens
aaucaacauuuc

SEQ ID NO: 1063840 - RNA, 12 nt, Homo sapiens
aaucaagggcaa

SEQ ID NO: 1063841 - RNA, 21 nt, Homo sapiens
aaucaauaaagaccacuuuac

SEQ ID NO: 1063842 - RNA, 18 nt, Homo sapiens
aaucacaauguaaauauu

SEQ ID NO: 1063843 - RNA, 18 nt, Homo sapiens
aaucacacagccaagcca

SEQ ID NO: 1063844 - RNA, 23 nt, Homo sapiens
aaucacacgucuggcuucacaga

SEQ ID NO: 1063845 - RNA, 14 nt, Homo sapiens
aaucacucagugau

SEQ ID NO: 1063846 - RNA, 15 nt, Homo sapiens
aaucacucagugauu

SEQ ID NO: 1063847 - RNA, 19 nt, Homo sapiens
aaucacuuuugaagcaaua

SEQ ID NO: 1063848 - RNA, 17 nt, Homo sapiens
aaucagaacuguuggca

SEQ ID NO: 1063849 - RNA, 14 nt, Homo sapiens
aaucagaugcagcu

SEQ ID NO: 1063850 - RNA, 20 nt, Homo sapiens
aaucagcugcuacuacuccu

SEQ ID NO: 1063851 - RNA, 20 nt, Homo sapiens
aaucagucuauccacagaga

SEQ ID NO: 1063852 - RNA, 13 nt, Homo sapiens
aaucagugcuccu

SEQ ID NO: 1063853 - RNA, 16 nt, Homo sapiens
aaucauacuuagcaaa

SEQ ID NO: 1063854 - RNA, 22 nt, Homo sapiens
aaucauagccaagaucccaucu

SEQ ID NO: 1063855 - RNA, 23 nt, Homo sapiens
aaucaucuauaaagaagaacuug

SEQ ID NO: 1063856 - RNA, 24 nt, Homo sapiens
aaucaucuauaaagaagaacuugc

SEQ ID NO: 1063857 - RNA, 22 nt, Homo sapiens
aaucaugagauccuuuaaaucc

SEQ ID NO: 1063858 - RNA, 14 nt, Homo sapiens
aauccacugugacu

SEQ ID NO: 1063859 - RNA, 19 nt, Homo sapiens
aauccagcuacgaauauag

SEQ ID NO: 1063860 - RNA, 20 nt, Homo sapiens
aauccaggcgugguggcaca

SEQ ID NO: 1063861 - RNA, 21 nt, Homo sapiens
aauccaggcgugguggcacac

SEQ ID NO: 1063862 - RNA, 24 nt, Homo sapiens
aauccauucuuaaaguacuuguua

SEQ ID NO: 1063863 - RNA, 14 nt, Homo sapiens
aaucccagcacuuu

SEQ ID NO: 1063864 - RNA, 16 nt, Homo sapiens
aaucccagcuaccuca

SEQ ID NO: 1063865 - RNA, 17 nt, Homo sapiens
aauccccacccugggcu

SEQ ID NO: 1063866 - RNA, 19 nt, Homo sapiens
aauccccacccugggcucu

SEQ ID NO: 1063867 - RNA, 20 nt, Homo sapiens
aaucccuagucuucaagcag

SEQ ID NO: 1063868 - RNA, 14 nt, Homo sapiens
aaucccuccuucau

SEQ ID NO: 1063869 - RNA, 17 nt, Homo sapiens
aaucccuggcaaaggga

SEQ ID NO: 1063870 - RNA, 17 nt, Homo sapiens
aauccuaaauaauguua

SEQ ID NO: 1063871 - RNA, 13 nt, Homo sapiens
aauccuagcacuu

SEQ ID NO: 1063872 - RNA, 14 nt, Homo sapiens
aauccuuccaugaa

SEQ ID NO: 1063873 - RNA, 19 nt, Homo sapiens
aauccuuuacuguuaguca

SEQ ID NO: 1063874 - RNA, 20 nt, Homo sapiens
aauccuuuuaaaucuugaua

SEQ ID NO: 1063875 - RNA, 23 nt, Homo sapiens
aaucuaccaacgaaagacgugau

SEQ ID NO: 1063876 - RNA, 20 nt, Homo sapiens
aaucuauguauauacauuua

SEQ ID NO: 1063877 - RNA, 15 nt, Homo sapiens
aaucucagccagccu

SEQ ID NO: 1063878 - RNA, 18 nt, Homo sapiens
aaucucagccagccucca

SEQ ID NO: 1063879 - RNA, 16 nt, Homo sapiens
aaucucuccauucccg

SEQ ID NO: 1063880 - RNA, 18 nt, Homo sapiens
aaucucugaauuugagau

SEQ ID NO: 1063881 - RNA, 13 nt, Homo sapiens
aaucugaccaaaa

SEQ ID NO: 1063882 - RNA, 14 nt, Homo sapiens
aaucugaccaaaac

SEQ ID NO: 1063883 - RNA, 23 nt, Homo sapiens
aaucugagaggccacagugcaau

SEQ ID NO: 1063884 - RNA, 22 nt, Homo sapiens
aaucugaguagagcagccacaa

SEQ ID NO: 1063885 - RNA, 22 nt, Homo sapiens
aaucuggaccccaucugugaau

SEQ ID NO: 1063886 - RNA, 14 nt, Homo sapiens
aaucuguaucugua

SEQ ID NO: 1063887 - RNA, 18 nt, Homo sapiens
acaucuuggucagauuug

SEQ ID NO: 1063888 - RNA, 23 nt, Homo sapiens
acaucuuggucagauuugaacuc

SEQ ID NO: 1063889 - RNA, 11 nt, Homo sapiens
acaucuuucac

SEQ ID NO: 1063890 - RNA, 16 nt, Homo sapiens
acaucuuucacacuuc

SEQ ID NO: 1063891 - RNA, 21 nt, Homo sapiens
acaucuuucacacuuccacca

SEQ ID NO: 1063892 - RNA, 14 nt, Homo sapiens
acaucuuucacauu

SEQ ID NO: 1063893 - RNA, 19 nt, Homo sapiens
acaucuuuuacauucugca

SEQ ID NO: 1063894 - RNA, 23 nt, Homo sapiens
acaugaaucccacccacauguga

SEQ ID NO: 1063895 - RNA, 15 nt, Homo sapiens
acaugacaacuuugc

SEQ ID NO: 1063896 - RNA, 18 nt, Homo sapiens
acaugaucuucuuuauaa

SEQ ID NO: 1063897 - RNA, 15 nt, Homo sapiens
acaugcacaccuccc

SEQ ID NO: 1063898 - RNA, 13 nt, Homo sapiens
acaugcacucagc

SEQ ID NO: 1063899 - RNA, 21 nt, Homo sapiens
acaugcacucagcucuuggcu

SEQ ID NO: 1063900 - RNA, 14 nt, Homo sapiens
acaugccaagcacu

SEQ ID NO: 1063901 - RNA, 16 nt, Homo sapiens
acaugccaagcacugu

SEQ ID NO: 1063902 - RNA, 17 nt, Homo sapiens
acaugcucaaugacucu

SEQ ID NO: 1063903 - RNA, 16 nt, Homo sapiens
acaugcuugcauuaua

SEQ ID NO: 1063904 - RNA, 16 nt, Homo sapiens
acauggaacgcuuuca

SEQ ID NO: 1063905 - RNA, 18 nt, Homo sapiens
acauggaauaacauguaa

SEQ ID NO: 1063906 - RNA, 19 nt, Homo sapiens
acauggccuuggagggcau

SEQ ID NO: 1063907 - RNA, 21 nt, Homo sapiens
acauggcuaaagaagguuuca

SEQ ID NO: 1063908 - RNA, 16 nt, Homo sapiens
acauggcuugccacag

SEQ ID NO: 1063909 - RNA, 10 nt, Homo sapiens
acaugggagc

SEQ ID NO: 1063910 - RNA, 20 nt, Homo sapiens
acauggugaaaccucaucuc

SEQ ID NO: 1063911 - RNA, 11 nt, Homo sapiens
acaugugacuc

SEQ ID NO: 1063912 - RNA, 15 nt, Homo sapiens
acaugugacuggcag

SEQ ID NO: 1063913 - RNA, 20 nt, Homo sapiens
acauguguagccugugcaug

SEQ ID NO: 1063914 - RNA, 21 nt, Homo sapiens
acauuacagggaaugccugag

SEQ ID NO: 1063915 - RNA, 21 nt, Homo sapiens
acauuacuucaaacugagauc

SEQ ID NO: 1063916 - RNA, 15 nt, Homo sapiens
acauuagccuaugug

SEQ ID NO: 1063917 - RNA, 22 nt, Homo sapiens
acauuaucgggagcagugucuu

SEQ ID NO: 1063918 - RNA, 14 nt, Homo sapiens
acauuaugccuuaa

SEQ ID NO: 1063919 - RNA, 15 nt, Homo sapiens
acauucacacagaga

SEQ ID NO: 1063920 - RNA, 20 nt, Homo sapiens
acauuccaaugcauugcuaa

SEQ ID NO: 1063921 - RNA, 18 nt, Homo sapiens
acauucucugaccuacuc

SEQ ID NO: 1063922 - RNA, 20 nt, Homo sapiens
acauucucugaccuacucga

SEQ ID NO: 1063923 - RNA, 14 nt, Homo sapiens
acauucuguuaauc

SEQ ID NO: 1063924 - RNA, 21 nt, Homo sapiens
acauucuuccugauuauuuuc

SEQ ID NO: 1063925 - RNA, 11 nt, Homo sapiens
acauugaacaa

SEQ ID NO: 1063926 - RNA, 17 nt, Homo sapiens
acauugauuggcauauu

SEQ ID NO: 1063927 - RNA, 19 nt, Homo sapiens
acauugauuggcauauuaa

SEQ ID NO: 1063928 - RNA, 16 nt, Homo sapiens
acauugcuuuacuguc

SEQ ID NO: 1063929 - RNA, 18 nt, Homo sapiens
acauuggagccugggcau

SEQ ID NO: 1063930 - RNA, 23 nt, Homo sapiens
acauuggguccugggucuuucau

SEQ ID NO: 1063931 - RNA, 12 nt, Homo sapiens
acauugugccuu

SEQ ID NO: 1063932 - RNA, 23 nt, Homo sapiens
acauuguguucccauuucagcug

SEQ ID NO: 1063933 - RNA, 20 nt, Homo sapiens
acauuuaucaaucaguauaa

SEQ ID NO: 1063934 - RNA, 23 nt, Homo sapiens
acauuuauguaauuuuauuuaca

SEQ ID NO: 1063935 - RNA, 16 nt, Homo sapiens
acauuucccugugcug

SEQ ID NO: 1063936 - RNA, 17 nt, Homo sapiens
acauuuccucagucaag

SEQ ID NO: 1063937 - RNA, 14 nt, Homo sapiens
acauuuguuccaug

SEQ ID NO: 1063938 - RNA, 19 nt, Homo sapiens
acauuuuacccacacacag

SEQ ID NO: 1063939 - RNA, 21 nt, Homo sapiens
acauuuugccaaaauuauuaa

SEQ ID NO: 1063940 - RNA, 23 nt, Homo sapiens
acauuuuuaagugcugcauuuaa

SEQ ID NO: 1063941 - RNA, 21 nt, Homo sapiens
acauuuuuucagucauauaaa

SEQ ID NO: 1063942 - RNA, 17 nt, Homo sapiens
accaaaacugugcagag

SEQ ID NO: 1063943 - RNA, 23 nt, Homo sapiens
accaaagagacuggagcaucuga

SEQ ID NO: 1063944 - RNA, 17 nt, Homo sapiens
accaaaggccaggguca

SEQ ID NO: 1063945 - RNA, 14 nt, Homo sapiens
accaaaucacugaa

SEQ ID NO: 1063946 - RNA, 18 nt, Homo sapiens
accaaaugcuuuuccuca

SEQ ID NO: 1063947 - RNA, 13 nt, Homo sapiens
accaaauuuguau

SEQ ID NO: 1063948 - RNA, 12 nt, Homo sapiens
accaacuuucug

SEQ ID NO: 1063949 - RNA, 16 nt, Homo sapiens
accaagcucuguccaa

SEQ ID NO: 1063950 - RNA, 17 nt, Homo sapiens
accaaggaacaggaaac

SEQ ID NO: 1063951 - RNA, 21 nt, Homo sapiens
accaaggaccccucaccuugc

SEQ ID NO: 1063952 - RNA, 23 nt, Homo sapiens
accaaggggugggccacagccau

SEQ ID NO: 1063953 - RNA, 23 nt, Homo sapiens
accaaguuauaaaucaaugucac

SEQ ID NO: 1063954 - RNA, 15 nt, Homo sapiens
accaauaaagccuuc

SEQ ID NO: 1063955 - RNA, 13 nt, Homo sapiens
accaauaccuccu

SEQ ID NO: 1063956 - RNA, 13 nt, Homo sapiens
accaauagcuuua

SEQ ID NO: 1063957 - RNA, 20 nt, Homo sapiens
accacaaaucugaaugugcc

SEQ ID NO: 1063958 - RNA, 18 nt, Homo sapiens
accacaaggcuguugcau

SEQ ID NO: 1063959 - RNA, 18 nt, Homo sapiens
accacacagacaggguuu

SEQ ID NO: 1063960 - RNA, 15 nt, Homo sapiens
accacaccaaaccuc

SEQ ID NO: 1063961 - RNA, 21 nt, Homo sapiens
accacacgcccccacaggcuc

SEQ ID NO: 1063962 - RNA, 20 nt, Homo sapiens
accacacuuuccgcuuucac

SEQ ID NO: 1063963 - RNA, 17 nt, Homo sapiens
accacagguucaugcca

SEQ ID NO: 1063964 - RNA, 13 nt, Homo sapiens
accacagugucug

SEQ ID NO: 1063965 - RNA, 11 nt, Homo sapiens
accacaugcca

SEQ ID NO: 1063966 - RNA, 15 nt, Homo sapiens
accacaugugcacau

SEQ ID NO: 1063967 - RNA, 18 nt, Homo sapiens
accacaugugcacaugca

SEQ ID NO: 1063968 - RNA, 18 nt, Homo sapiens
accacuacaugcagccca

SEQ ID NO: 1063969 - RNA, 21 nt, Homo sapiens
accacucaggccaacaagcca

SEQ ID NO: 1063970 - RNA, 20 nt, Homo sapiens
accacucuuccugaguucag

SEQ ID NO: 1063971 - RNA, 21 nt, Homo sapiens
accacucuuccugaguucagu

SEQ ID NO: 1063972 - RNA, 18 nt, Homo sapiens
accacugcacccagcuaa

SEQ ID NO: 1063973 - RNA, 14 nt, Homo sapiens
accacuuaucacau

SEQ ID NO: 1063974 - RNA, 14 nt, Homo sapiens
accacuucagcuga

SEQ ID NO: 1063975 - RNA, 15 nt, Homo sapiens
accagaaccuggaca

SEQ ID NO: 1063976 - RNA, 16 nt, Homo sapiens
accagacacguacaaa

SEQ ID NO: 1063977 - RNA, 19 nt, Homo sapiens
accagacgguucaccagcc

SEQ ID NO: 1063978 - RNA, 23 nt, Homo sapiens
accagagaagggcuuggacucaa

SEQ ID NO: 1063979 - RNA, 19 nt, Homo sapiens
accagagauaauaugagaa

SEQ ID NO: 1063980 - RNA, 13 nt, Homo sapiens
accagagcauuuc

SEQ ID NO: 1063981 - RNA, 15 nt, Homo sapiens
accagagcauuucca

SEQ ID NO: 1063982 - RNA, 20 nt, Homo sapiens
accagaugucgcccuacuca

SEQ ID NO: 1063983 - RNA, 13 nt, Homo sapiens
accagauuugcua

SEQ ID NO: 1063984 - RNA, 18 nt, Homo sapiens
accagccauacuuaucuc

SEQ ID NO: 1063985 - RNA, 13 nt, Homo sapiens
accagcccacccc

SEQ ID NO: 1063986 - RNA, 18 nt, Homo sapiens
accagcgugugacuacuc

SEQ ID NO: 1063987 - RNA, 20 nt, Homo sapiens
accaggacucccuccucacc

SEQ ID NO: 1063988 - RNA, 14 nt, Homo sapiens
accaggcugcucag

SEQ ID NO: 1063989 - RNA, 20 nt, Homo sapiens
accaggguugaccccagagg

SEQ ID NO: 1063990 - RNA, 13 nt, Homo sapiens
accaguguagccu

SEQ ID NO: 1063991 - RNA, 22 nt, Homo sapiens
accaguguccccuccacuguca

SEQ ID NO: 1063992 - RNA, 23 nt, Homo sapiens
accaguguccccuccacugucac

SEQ ID NO: 1063993 - RNA, 21 nt, Homo sapiens
accaguguuauuaaugacaaa

SEQ ID NO: 1063994 - RNA, 15 nt, Homo sapiens
accaguuaugugaau

SEQ ID NO: 1063995 - RNA, 21 nt, Homo sapiens
accaguuggagcagaugccuc

SEQ ID NO: 1063996 - RNA, 14 nt, Homo sapiens
accauacacacugu

SEQ ID NO: 1063997 - RNA, 11 nt, Homo sapiens
accaucugcau

SEQ ID NO: 1063998 - RNA, 16 nt, Homo sapiens
accaugaagacaggau

SEQ ID NO: 1063999 - RNA, 22 nt, Homo sapiens
accaugagaccacuguuaucaa

SEQ ID NO: 1064000 - RNA, 20 nt, Homo sapiens
accaugauuaaccacuucag

SEQ ID NO: 1064001 - RNA, 21 nt, Homo sapiens
accauggugaauuaaucacuu

SEQ ID NO: 1064002 - RNA, 13 nt, Homo sapiens
accauguacauga

SEQ ID NO: 1064003 - RNA, 14 nt, Homo sapiens
accaugucacugug

SEQ ID NO: 1064004 - RNA, 21 nt, Homo sapiens
accauuaacuccuccugagcu

SEQ ID NO: 1064005 - RNA, 18 nt, Homo sapiens
accauuagcauuugucaa

SEQ ID NO: 1064006 - RNA, 20 nt, Homo sapiens
accauucaggucuuucuuuc

SEQ ID NO: 1064007 - RNA, 16 nt, Homo sapiens
accauuuguauccacu

SEQ ID NO: 1064008 - RNA, 17 nt, Homo sapiens
accauuuuuuaaggaaa

SEQ ID NO: 1064009 - RNA, 10 nt, Homo sapiens
acccaagggc

SEQ ID NO: 1064010 - RNA, 18 nt, Homo sapiens
acccaauaguuguugauu

SEQ ID NO: 1064011 - RNA, 15 nt, Homo sapiens
acccaaugauucagc

SEQ ID NO: 1064012 - RNA, 21 nt, Homo sapiens
acccacaugugacacauaugc

SEQ ID NO: 1064013 - RNA, 23 nt, Homo sapiens
acccacaugugacacauaugcac

SEQ ID NO: 1064014 - RNA, 15 nt, Homo sapiens
acccaccaccaugcc

SEQ ID NO: 1064015 - RNA, 14 nt, Homo sapiens
acccaccaugucug

SEQ ID NO: 1064016 - RNA, 12 nt, Homo sapiens
acccaccucagc

SEQ ID NO: 1064017 - RNA, 20 nt, Homo sapiens
acccaccuuucugcacauaa

SEQ ID NO: 1064018 - RNA, 14 nt, Homo sapiens
acccacuaacaaag

SEQ ID NO: 1064019 - RNA, 20 nt, Homo sapiens
acccagagaaccugcuuuac

SEQ ID NO: 1064020 - RNA, 15 nt, Homo sapiens
acccagauuuccuaa

SEQ ID NO: 1064021 - RNA, 19 nt, Homo sapiens
acccagauuuccuaacucu

SEQ ID NO: 1064022 - RNA, 16 nt, Homo sapiens
acccagccucuaggga

SEQ ID NO: 1064023 - RNA, 20 nt, Homo sapiens
acccaggacuuccauuugcu

SEQ ID NO: 1064024 - RNA, 19 nt, Homo sapiens
acccaggcuggagugcaau

SEQ ID NO: 1064025 - RNA, 14 nt, Homo sapiens
acccaguauuccau

SEQ ID NO: 1064026 - RNA, 22 nt, Homo sapiens
acccagucagaguugugcacau

SEQ ID NO: 1064027 - RNA, 22 nt, Homo sapiens
acccauccuaccaaugcaugca

SEQ ID NO: 1064028 - RNA, 22 nt, Homo sapiens
acccaugggcucugacagaaag

SEQ ID NO: 1064029 - RNA, 13 nt, Homo sapiens
acccauuagccau

SEQ ID NO: 1064030 - RNA, 22 nt, Homo sapiens
acccauuuucgcuauaaauaaa

SEQ ID NO: 1064031 - RNA, 14 nt, Homo sapiens
agaaaaaaacuucu

SEQ ID NO: 1064032 - RNA, 12 nt, Homo sapiens
agaaaaaagaga

SEQ ID NO: 1064033 - RNA, 23 nt, Homo sapiens
agaaaaaucuuuguuacucugua

SEQ ID NO: 1064034 - RNA, 13 nt, Homo sapiens
agaaaaauuaauu

SEQ ID NO: 1064035 - RNA, 20 nt, Homo sapiens
agaaaacgucuugcuuggga

SEQ ID NO: 1064036 - RNA, 15 nt, Homo sapiens
agaaaacuguuaaua

SEQ ID NO: 1064037 - RNA, 12 nt, Homo sapiens
agaaaagacaug

SEQ ID NO: 1064038 - RNA, 16 nt, Homo sapiens
agaaaagcaguggcuc

SEQ ID NO: 1064039 - RNA, 19 nt, Homo sapiens
agaaaaguagguuuacauu

SEQ ID NO: 1064040 - RNA, 16 nt, Homo sapiens
agaaaagugggccagu

SEQ ID NO: 1064041 - RNA, 18 nt, Homo sapiens
agaaaagugggccagugu

SEQ ID NO: 1064042 - RNA, 16 nt, Homo sapiens
agaaaaugagacaaaa

SEQ ID NO: 1064043 - RNA, 16 nt, Homo sapiens
agaaaaugauugcuua

SEQ ID NO: 1064044 - RNA, 14 nt, Homo sapiens
agaaaauugcacaa

SEQ ID NO: 1064045 - RNA, 21 nt, Homo sapiens
agaaacacuaaagcauucaau

SEQ ID NO: 1064046 - RNA, 19 nt, Homo sapiens
agaaacugagaccaaagaa

SEQ ID NO: 1064047 - RNA, 13 nt, Homo sapiens
agaaacugcucua

SEQ ID NO: 1064048 - RNA, 17 nt, Homo sapiens
agaaagaaacaaccugc

SEQ ID NO: 1064049 - RNA, 15 nt, Homo sapiens
agaaagacuaucuaa

SEQ ID NO: 1064050 - RNA, 14 nt, Homo sapiens
agaaagacuauuca

SEQ ID NO: 1064051 - RNA, 22 nt, Homo sapiens
agaaagacuuaucaacauuugu

SEQ ID NO: 1064052 - RNA, 23 nt, Homo sapiens
agaaagcacgugucucagacugc

SEQ ID NO: 1064053 - RNA, 13 nt, Homo sapiens
agaaagcacugac

SEQ ID NO: 1064054 - RNA, 21 nt, Homo sapiens
agaaagcauccuaaauauauc

SEQ ID NO: 1064055 - RNA, 12 nt, Homo sapiens
agaaagccucag

SEQ ID NO: 1064056 - RNA, 15 nt, Homo sapiens
agaaagccuucauaa

SEQ ID NO: 1064057 - RNA, 14 nt, Homo sapiens
agaaagcucaucuc

SEQ ID NO: 1064058 - RNA, 22 nt, Homo sapiens
agaaaggagaacuauccaaaac

SEQ ID NO: 1064059 - RNA, 12 nt, Homo sapiens
agaaaggcauga

SEQ ID NO: 1064060 - RNA, 16 nt, Homo sapiens
agaaaggggcccaguc

SEQ ID NO: 1064061 - RNA, 14 nt, Homo sapiens
agaaaguacuucuu

SEQ ID NO: 1064062 - RNA, 18 nt, Homo sapiens
agaaaguucuuaaacuca

SEQ ID NO: 1064063 - RNA, 14 nt, Homo sapiens
agaaauaauaugca

SEQ ID NO: 1064064 - RNA, 15 nt, Homo sapiens
agaaauaauaugcau

SEQ ID NO: 1064065 - RNA, 12 nt, Homo sapiens
agaaauagugug

SEQ ID NO: 1064066 - RNA, 17 nt, Homo sapiens
agaaaucauaguuuaaa

SEQ ID NO: 1064067 - RNA, 18 nt, Homo sapiens
agaaaucuagaagacugu

SEQ ID NO: 1064068 - RNA, 14 nt, Homo sapiens
agaaaugagaucag

SEQ ID NO: 1064069 - RNA, 12 nt, Homo sapiens
agaaaugcugcc

SEQ ID NO: 1064070 - RNA, 16 nt, Homo sapiens
agaaauuaaguaucug

SEQ ID NO: 1064071 - RNA, 22 nt, Homo sapiens
agaaauuaaguaucugacaucu

SEQ ID NO: 1064072 - RNA, 23 nt, Homo sapiens
agaaauuccaggaaaaucugcac

SEQ ID NO: 1064073 - RNA, 13 nt, Homo sapiens
agaaauuccugua

SEQ ID NO: 1064074 - RNA, 22 nt, Homo sapiens
agaacaaaggacagaguaugaa

SEQ ID NO: 1064075 - RNA, 15 nt, Homo sapiens
agaacaacuacugug

SEQ ID NO: 1064076 - RNA, 20 nt, Homo sapiens
agaacaagaccccgucucaa

SEQ ID NO: 1064077 - RNA, 17 nt, Homo sapiens
agaacaguaacugccau

SEQ ID NO: 1064078 - RNA, 18 nt, Homo sapiens
agaaccagagcucagaga

SEQ ID NO: 1064079 - RNA, 15 nt, Homo sapiens
agaacccagauuucc

SEQ ID NO: 1064080 - RNA, 17 nt, Homo sapiens
agaacccagauuuccua

SEQ ID NO: 1064081 - RNA, 14 nt, Homo sapiens
agaaccgagcaaag

SEQ ID NO: 1064082 - RNA, 20 nt, Homo sapiens
agaaccuggacauuggccag

SEQ ID NO: 1064083 - RNA, 23 nt, Homo sapiens
agaaccuggagagcuagaaccua

SEQ ID NO: 1064084 - RNA, 23 nt, Homo sapiens
agaaccuggcagguuagaaccua

SEQ ID NO: 1064085 - RNA, 21 nt, Homo sapiens
agaaccuugugccuggcucag

SEQ ID NO: 1064086 - RNA, 18 nt, Homo sapiens
agaacgagacuccaccuc

SEQ ID NO: 1064087 - RNA, 20 nt, Homo sapiens
agaacgagacuccaccucaa

SEQ ID NO: 1064088 - RNA, 21 nt, Homo sapiens
agaacuaagaugaucaucucc

SEQ ID NO: 1064089 - RNA, 11 nt, Homo sapiens
agaacucugcc

SEQ ID NO: 1064090 - RNA, 19 nt, Homo sapiens
agaacuugcagcugauguu

SEQ ID NO: 1064091 - RNA, 18 nt, Homo sapiens
agaacuuggcacacucuc

SEQ ID NO: 1064092 - RNA, 19 nt, Homo sapiens
agaagaaaccuucauccua

SEQ ID NO: 1064093 - RNA, 24 nt, Homo sapiens
agaagaaacgucuauguguacaga

SEQ ID NO: 1064094 - RNA, 20 nt, Homo sapiens
agaagacauccugagcagug

SEQ ID NO: 1064095 - RNA, 19 nt, Homo sapiens
agaagacuauauuguacac

SEQ ID NO: 1064096 - RNA, 14 nt, Homo sapiens
agaagagacaggag

SEQ ID NO: 1064097 - RNA, 14 nt, Homo sapiens
agaagagacuggga

SEQ ID NO: 1064098 - RNA, 13 nt, Homo sapiens
agaagaggagaaa

SEQ ID NO: 1064099 - RNA, 13 nt, Homo sapiens
agaagaugaauga

SEQ ID NO: 1064100 - RNA, 13 nt, Homo sapiens
agaagaugaucag

SEQ ID NO: 1064101 - RNA, 18 nt, Homo sapiens
agaagauuuuaugcugcu

SEQ ID NO: 1064102 - RNA, 13 nt, Homo sapiens
agaagcagcucuu

SEQ ID NO: 1064103 - RNA, 16 nt, Homo sapiens
agaagcauacaacuuu

SEQ ID NO: 1064104 - RNA, 13 nt, Homo sapiens
agaagccagcuuu

SEQ ID NO: 1064105 - RNA, 22 nt, Homo sapiens
agaagccagugcggcagguuca

SEQ ID NO: 1064106 - RNA, 23 nt, Homo sapiens
agaagccucacugcaagcacugc

SEQ ID NO: 1064107 - RNA, 20 nt, Homo sapiens
agaagcuguuguacauuuau

SEQ ID NO: 1064108 - RNA, 18 nt, Homo sapiens
agaagcuuaagugggcag

SEQ ID NO: 1064109 - RNA, 18 nt, Homo sapiens
agaaggcucuucugacua

SEQ ID NO: 1064110 - RNA, 21 nt, Homo sapiens
agaagggcagcuccacagggc

SEQ ID NO: 1064111 - RNA, 22 nt, Homo sapiens
agaagggcagcuccacagggca

SEQ ID NO: 1064112 - RNA, 15 nt, Homo sapiens
agaagguugugauga

SEQ ID NO: 1064113 - RNA, 16 nt, Homo sapiens
agaagguugugaugaa

SEQ ID NO: 1064114 - RNA, 19 nt, Homo sapiens
agaagguugugaugaagaa

SEQ ID NO: 1064115 - RNA, 22 nt, Homo sapiens
agaagugaaaaucuacacucca

SEQ ID NO: 1064116 - RNA, 23 nt, Homo sapiens
agaagugauuagaggcagaucug

SEQ ID NO: 1064117 - RNA, 19 nt, Homo sapiens
agaaguuuuuguacuguaa

SEQ ID NO: 1064118 - RNA, 19 nt, Homo sapiens
agaauaccccucaacucau

SEQ ID NO: 1064119 - RNA, 14 nt, Homo sapiens
agaauagcuuugaa

SEQ ID NO: 1064120 - RNA, 18 nt, Homo sapiens
agaauaguucccuagucu

SEQ ID NO: 1064121 - RNA, 13 nt, Homo sapiens
agaauauacuaaa

SEQ ID NO: 1064122 - RNA, 13 nt, Homo sapiens
agaauaucuggga

SEQ ID NO: 1064123 - RNA, 19 nt, Homo sapiens
agaauauuuauuaccucug

SEQ ID NO: 1064124 - RNA, 13 nt, Homo sapiens
agaaucacuugaa

SEQ ID NO: 1064125 - RNA, 22 nt, Homo sapiens
agaaucagucuauccacagaga

SEQ ID NO: 1064126 - RNA, 18 nt, Homo sapiens
agaaucauuaauacaaag

SEQ ID NO: 1064127 - RNA, 23 nt, Homo sapiens
agaauccaguuugcaauuacuuu

SEQ ID NO: 1064128 - RNA, 21 nt, Homo sapiens
agaaucccuaagccuagcugg

SEQ ID NO: 1064129 - RNA, 19 nt, Homo sapiens
agaaucccuggcaaaggga

SEQ ID NO: 1064130 - RNA, 18 nt, Homo sapiens
agaaucuguuaccagagg

SEQ ID NO: 1064131 - RNA, 16 nt, Homo sapiens
agaaugcccagugacc

SEQ ID NO: 1064132 - RNA, 18 nt, Homo sapiens
agaaugcugaaaccaagg

SEQ ID NO: 1064133 - RNA, 13 nt, Homo sapiens
agaauggaacuca

SEQ ID NO: 1064134 - RNA, 15 nt, Homo sapiens
agaauggaaggugga

SEQ ID NO: 1064135 - RNA, 16 nt, Homo sapiens
agaaugucugaucuaa

SEQ ID NO: 1064136 - RNA, 15 nt, Homo sapiens
agaauuaacacauga

SEQ ID NO: 1064137 - RNA, 14 nt, Homo sapiens
agaauuaguggcac

SEQ ID NO: 1064138 - RNA, 23 nt, Homo sapiens
agaauuccuuuucuaacucuccc

SEQ ID NO: 1064139 - RNA, 16 nt, Homo sapiens
agaauucuuacauguu

SEQ ID NO: 1064140 - RNA, 21 nt, Homo sapiens
agaauuuaaaacgcaugugca

SEQ ID NO: 1064141 - RNA, 21 nt, Homo sapiens
agaauuuauucaauuccucug

SEQ ID NO: 1064142 - RNA, 12 nt, Homo sapiens
agacaaacugca

SEQ ID NO: 1064143 - RNA, 17 nt, Homo sapiens
agacaaaguaauuccuc

SEQ ID NO: 1064144 - RNA, 18 nt, Homo sapiens
agacaaauacucaugugu

SEQ ID NO: 1064145 - RNA, 14 nt, Homo sapiens
agacaacacuggga

SEQ ID NO: 1064146 - RNA, 18 nt, Homo sapiens
agacaacagcccugucuc

SEQ ID NO: 1064147 - RNA, 22 nt, Homo sapiens
agacaacccugcaaaggacugu

SEQ ID NO: 1064148 - RNA, 17 nt, Homo sapiens
agacacaggcccggcuc

SEQ ID NO: 1064149 - RNA, 22 nt, Homo sapiens
agacaccagagcagaugcagag

SEQ ID NO: 1064150 - RNA, 15 nt, Homo sapiens
agacacuauuuaucu

SEQ ID NO: 1064151 - RNA, 23 nt, Homo sapiens
agacacucccacuuggcaucauu

SEQ ID NO: 1064152 - RNA, 16 nt, Homo sapiens
agacagaaaacauguu

SEQ ID NO: 1064153 - RNA, 22 nt, Homo sapiens
agacagaaagcagaacagugau

SEQ ID NO: 1064154 - RNA, 18 nt, Homo sapiens
agacagacaacacuggga

SEQ ID NO: 1064155 - RNA, 20 nt, Homo sapiens
agacagaguuuucacucuua

SEQ ID NO: 1064156 - RNA, 19 nt, Homo sapiens
agacagauuuaaagcacau

SEQ ID NO: 1064157 - RNA, 20 nt, Homo sapiens
agacagauuuaaagcacaug

SEQ ID NO: 1064158 - RNA, 15 nt, Homo sapiens
agacagcuucucauc

SEQ ID NO: 1064159 - RNA, 19 nt, Homo sapiens
agacaggaagguggugcuu

SEQ ID NO: 1064160 - RNA, 16 nt, Homo sapiens
agacaggcccaagaga

SEQ ID NO: 1064161 - RNA, 19 nt, Homo sapiens
agacaggguuucacugugu

SEQ ID NO: 1064162 - RNA, 18 nt, Homo sapiens
agacaggguuuugccaug

SEQ ID NO: 1064163 - RNA, 19 nt, Homo sapiens
agacaggguuuugccaugu

SEQ ID NO: 1064164 - RNA, 23 nt, Homo sapiens
agacagucccugccaauggacua

SEQ ID NO: 1064165 - RNA, 13 nt, Homo sapiens
agacagugggaaa

SEQ ID NO: 1064166 - RNA, 14 nt, Homo sapiens
agacauaacaaaac

SEQ ID NO: 1064167 - RNA, 17 nt, Homo sapiens
agacauacuaaccagca

SEQ ID NO: 1064168 - RNA, 17 nt, Homo sapiens
agacauacuccuuccau

SEQ ID NO: 1064169 - RNA, 12 nt, Homo sapiens
agacaucaucaa

SEQ ID NO: 1064170 - RNA, 17 nt, Homo sapiens
agacauccugagcagug

SEQ ID NO: 1064171 - RNA, 14 nt, Homo sapiens
agacaugaaccaag

SEQ ID NO: 1064172 - RNA, 16 nt, Homo sapiens
agacaugaaugcacac

SEQ ID NO: 1064173 - RNA, 18 nt, Homo sapiens
agacaugagugcgugcuc

SEQ ID NO: 1064174 - RNA, 21 nt, Homo sapiens
agacaugagugcgugcucagu

SEQ ID NO: 1064175 - RNA, 18 nt, Homo sapiens
agacauggagacuccugc

SEQ ID NO: 1064176 - RNA, 13 nt, Homo sapiens
agcuggccuguaa

SEQ ID NO: 1064177 - RNA, 18 nt, Homo sapiens
agcugggacuacaggcac

SEQ ID NO: 1064178 - RNA, 22 nt, Homo sapiens
agcugggagcacaggcacugca

SEQ ID NO: 1064179 - RNA, 23 nt, Homo sapiens
agcugggauaaucacauuaucau

SEQ ID NO: 1064180 - RNA, 17 nt, Homo sapiens
agcugggcucugcaauu

SEQ ID NO: 1064181 - RNA, 22 nt, Homo sapiens
agcuggggaccugguacccucc

SEQ ID NO: 1064182 - RNA, 13 nt, Homo sapiens
agcugggggacac

SEQ ID NO: 1064183 - RNA, 16 nt, Homo sapiens
agcugggggacacuuu

SEQ ID NO: 1064184 - RNA, 20 nt, Homo sapiens
agcugggggccaugagcucc

SEQ ID NO: 1064185 - RNA, 16 nt, Homo sapiens
agcugguggcaauaaa

SEQ ID NO: 1064186 - RNA, 21 nt, Homo sapiens
agcugguggcaauaaauauua

SEQ ID NO: 1064187 - RNA, 18 nt, Homo sapiens
agcugguuggagagcuag

SEQ ID NO: 1064188 - RNA, 21 nt, Homo sapiens
agcuguaguagcccuuucugu

SEQ ID NO: 1064189 - RNA, 19 nt, Homo sapiens
agcuguggccagcuuguua

SEQ ID NO: 1064190 - RNA, 17 nt, Homo sapiens
agcuguucugucccuug

SEQ ID NO: 1064191 - RNA, 15 nt, Homo sapiens
agcuguugccucagu

SEQ ID NO: 1064192 - RNA, 17 nt, Homo sapiens
agcuguuuauggccuca

SEQ ID NO: 1064193 - RNA, 18 nt, Homo sapiens
agcuguuuauggccucag

SEQ ID NO: 1064194 - RNA, 13 nt, Homo sapiens
agcuuaagaauuu

SEQ ID NO: 1064195 - RNA, 15 nt, Homo sapiens
agcuuagagccuccc

SEQ ID NO: 1064196 - RNA, 22 nt, Homo sapiens
agcuuagccaaugugggagcag

SEQ ID NO: 1064197 - RNA, 21 nt, Homo sapiens
agcuucagaaguuuggcaaua

SEQ ID NO: 1064198 - RNA, 22 nt, Homo sapiens
agcuucccgaguaacugagauu

SEQ ID NO: 1064199 - RNA, 17 nt, Homo sapiens
agcuucucuccacugaa

SEQ ID NO: 1064200 - RNA, 14 nt, Homo sapiens
agcuucucugugaa

SEQ ID NO: 1064201 - RNA, 13 nt, Homo sapiens
agcuucuguccug

SEQ ID NO: 1064202 - RNA, 13 nt, Homo sapiens
agcuugaugccag

SEQ ID NO: 1064203 - RNA, 16 nt, Homo sapiens
agcuugcgcauucuca

SEQ ID NO: 1064204 - RNA, 14 nt, Homo sapiens
agcuuggaaacugg

SEQ ID NO: 1064205 - RNA, 18 nt, Homo sapiens
agcuuuacaaauauguca

SEQ ID NO: 1064206 - RNA, 19 nt, Homo sapiens
agcuuucugcuaucaaaga

SEQ ID NO: 1064207 - RNA, 16 nt, Homo sapiens
agcuuugaaaauucag

SEQ ID NO: 1064208 - RNA, 18 nt, Homo sapiens
agcuuugguaaucucugu

SEQ ID NO: 1064209 - RNA, 22 nt, Homo sapiens
agcuuuucaaaauuggacuuaa

SEQ ID NO: 1064210 - RNA, 14 nt, Homo sapiens
agcuuuugcuucau

SEQ ID NO: 1064211 - RNA, 15 nt, Homo sapiens
aggaaaaacaaacua

SEQ ID NO: 1064212 - RNA, 19 nt, Homo sapiens
aggaaaagcggacaucagc

SEQ ID NO: 1064213 - RNA, 20 nt, Homo sapiens
aggaaaagcggacaucagcu

SEQ ID NO: 1064214 - RNA, 14 nt, Homo sapiens
aggaaacaacagcu

SEQ ID NO: 1064215 - RNA, 13 nt, Homo sapiens
aggaaacaauaua

SEQ ID NO: 1064216 - RNA, 14 nt, Homo sapiens
aggaaacaauauaa

SEQ ID NO: 1064217 - RNA, 12 nt, Homo sapiens
aggaaacaguua

SEQ ID NO: 1064218 - RNA, 12 nt, Homo sapiens
aggaaacuugca

SEQ ID NO: 1064219 - RNA, 22 nt, Homo sapiens
aggaaacuugcauacagagaca

SEQ ID NO: 1064220 - RNA, 20 nt, Homo sapiens
aggaaauaccaaaugcauug

SEQ ID NO: 1064221 - RNA, 22 nt, Homo sapiens
aggaaaucaaauaugcaaagca

SEQ ID NO: 1064222 - RNA, 13 nt, Homo sapiens
aggaacacuccuu

SEQ ID NO: 1064223 - RNA, 13 nt, Homo sapiens
aggaacacugcac

SEQ ID NO: 1064224 - RNA, 15 nt, Homo sapiens
aggaacauacuucag

SEQ ID NO: 1064225 - RNA, 14 nt, Homo sapiens
aggaagacgugugg

SEQ ID NO: 1064226 - RNA, 14 nt, Homo sapiens
aggaagcauucaga

SEQ ID NO: 1064227 - RNA, 17 nt, Homo sapiens
aggaagcuagguugaaa

SEQ ID NO: 1064228 - RNA, 20 nt, Homo sapiens
aggaagcucagacugguuga

SEQ ID NO: 1064229 - RNA, 17 nt, Homo sapiens
aggaagcuccacuguca

SEQ ID NO: 1064230 - RNA, 22 nt, Homo sapiens
aggaagcuccacugucacccuc

SEQ ID NO: 1064231 - RNA, 14 nt, Homo sapiens
aggaagcuccaguu

SEQ ID NO: 1064232 - RNA, 16 nt, Homo sapiens
aggaaggcagagaccu

SEQ ID NO: 1064233 - RNA, 15 nt, Homo sapiens
aggaagguggugcuu

SEQ ID NO: 1064234 - RNA, 16 nt, Homo sapiens
aggaaguaugguuuua

SEQ ID NO: 1064235 - RNA, 13 nt, Homo sapiens
aggaauauuugca

SEQ ID NO: 1064236 - RNA, 13 nt, Homo sapiens
aggaaucauguca

SEQ ID NO: 1064237 - RNA, 20 nt, Homo sapiens
aggaauuggcauguguaugu

SEQ ID NO: 1064238 - RNA, 15 nt, Homo sapiens
aggacaaagugccca

SEQ ID NO: 1064239 - RNA, 15 nt, Homo sapiens
aggacaagggaaaug

SEQ ID NO: 1064240 - RNA, 22 nt, Homo sapiens
aggacaccuuuuaacucaccuc

SEQ ID NO: 1064241 - RNA, 21 nt, Homo sapiens
aggacagggaggugaccccag

SEQ ID NO: 1064242 - RNA, 17 nt, Homo sapiens
aggacaguggcagacag

SEQ ID NO: 1064243 - RNA, 20 nt, Homo sapiens
aggacauccccccgccaaaa

SEQ ID NO: 1064244 - RNA, 13 nt, Homo sapiens
aggacauggacaa

SEQ ID NO: 1064245 - RNA, 13 nt, Homo sapiens
aggaccacuccug

SEQ ID NO: 1064246 - RNA, 20 nt, Homo sapiens
aggaccaggcaaugugacuu

SEQ ID NO: 1064247 - RNA, 16 nt, Homo sapiens
aggacccugggaccac

SEQ ID NO: 1064248 - RNA, 13 nt, Homo sapiens
aggacuguagaaa

SEQ ID NO: 1064249 - RNA, 21 nt, Homo sapiens
aggacuguuuuauaaacugcu

SEQ ID NO: 1064250 - RNA, 19 nt, Homo sapiens
aggacuugugucucugugc

SEQ ID NO: 1064251 - RNA, 17 nt, Homo sapiens
aggacuuuuauugugaa

SEQ ID NO: 1064252 - RNA, 17 nt, Homo sapiens
aggagaaaggggcccca

SEQ ID NO: 1064253 - RNA, 14 nt, Homo sapiens
aggagaaggggaag

SEQ ID NO: 1064254 - RNA, 14 nt, Homo sapiens
aggagaaucacuug

SEQ ID NO: 1064255 - RNA, 21 nt, Homo sapiens
aggagacuuuacauggaugcc

SEQ ID NO: 1064256 - RNA, 23 nt, Homo sapiens
aggagaggcaacaggaggcauuc

SEQ ID NO: 1064257 - RNA, 18 nt, Homo sapiens
aggagaggggcacagggu

SEQ ID NO: 1064258 - RNA, 22 nt, Homo sapiens
aggagaggggcagaacagccgc

SEQ ID NO: 1064259 - RNA, 13 nt, Homo sapiens
aggagcagugcag

SEQ ID NO: 1064260 - RNA, 18 nt, Homo sapiens
aggagcagugcaggcaca

SEQ ID NO: 1064261 - RNA, 20 nt, Homo sapiens
aggagcggccagaagaucua

SEQ ID NO: 1064262 - RNA, 14 nt, Homo sapiens
aggagcucacugug

SEQ ID NO: 1064263 - RNA, 22 nt, Homo sapiens
aggaggagaaaucucacuuuuc

SEQ ID NO: 1064264 - RNA, 17 nt, Homo sapiens
aggaggccccuggccca

SEQ ID NO: 1064265 - RNA, 22 nt, Homo sapiens
aggagggaugcugccugaguca

SEQ ID NO: 1064266 - RNA, 14 nt, Homo sapiens
aggagggcacugga

SEQ ID NO: 1064267 - RNA, 16 nt, Homo sapiens
aggagggcagcagggu

SEQ ID NO: 1064268 - RNA, 16 nt, Homo sapiens
aggagggcccuaccug

SEQ ID NO: 1064269 - RNA, 19 nt, Homo sapiens
aggagguuuggggucugcc

SEQ ID NO: 1064270 - RNA, 22 nt, Homo sapiens
aggagguuuggggucugccacc

SEQ ID NO: 1064271 - RNA, 21 nt, Homo sapiens
aggaguacaccccaacagcac

SEQ ID NO: 1064272 - RNA, 15 nt, Homo sapiens
aggagucccugccau

SEQ ID NO: 1064273 - RNA, 22 nt, Homo sapiens
aggagugggaaaacacugccau

SEQ ID NO: 1064274 - RNA, 17 nt, Homo sapiens
aggaguucaaugaucua

SEQ ID NO: 1064275 - RNA, 19 nt, Homo sapiens
aggaguucacuucaucuuc

SEQ ID NO: 1064276 - RNA, 13 nt, Homo sapiens
aggaguuccuuga

SEQ ID NO: 1064277 - RNA, 15 nt, Homo sapiens
aggauaagagggauu

SEQ ID NO: 1064278 - RNA, 14 nt, Homo sapiens
aggauaucuuggcu

SEQ ID NO: 1064279 - RNA, 12 nt, Homo sapiens
aggauaugcagu

SEQ ID NO: 1064280 - RNA, 17 nt, Homo sapiens
aggauauuuucuuccaa

SEQ ID NO: 1064281 - RNA, 22 nt, Homo sapiens
aggaucaagucacucaucucag

SEQ ID NO: 1064282 - RNA, 21 nt, Homo sapiens
aggaugaaagugaccauguuu

SEQ ID NO: 1064283 - RNA, 20 nt, Homo sapiens
aggaugaauguaugugcacu

SEQ ID NO: 1064284 - RNA, 21 nt, Homo sapiens
aggaugagcauuuagggcaag

SEQ ID NO: 1064285 - RNA, 15 nt, Homo sapiens
aggaugcccacuucc

SEQ ID NO: 1064286 - RNA, 14 nt, Homo sapiens
aggauggcaaagag

SEQ ID NO: 1064287 - RNA, 16 nt, Homo sapiens
aggaugggaaggaggg

SEQ ID NO: 1064288 - RNA, 14 nt, Homo sapiens
aggaugggcacugc

SEQ ID NO: 1064289 - RNA, 16 nt, Homo sapiens
aggauguuuuucauga

SEQ ID NO: 1064290 - RNA, 15 nt, Homo sapiens
aggauuaaaagccau

SEQ ID NO: 1064291 - RNA, 21 nt, Homo sapiens
aggauuaaugguccugugaug

SEQ ID NO: 1064292 - RNA, 17 nt, Homo sapiens
aggauugaccuuugcac

SEQ ID NO: 1064293 - RNA, 21 nt, Homo sapiens
aggauuuggggcagagggaca

SEQ ID NO: 1064294 - RNA, 15 nt, Homo sapiens
aggauuuugauccaa

SEQ ID NO: 1064295 - RNA, 13 nt, Homo sapiens
aggcaaagacagg

SEQ ID NO: 1064296 - RNA, 16 nt, Homo sapiens
aggcaaaggcucucac

SEQ ID NO: 1064297 - RNA, 21 nt, Homo sapiens
aggcaaaggcucucacuccag

SEQ ID NO: 1064298 - RNA, 14 nt, Homo sapiens
aggcaaauacaaua

SEQ ID NO: 1064299 - RNA, 19 nt, Homo sapiens
aggcaaaugcccaagggaa

SEQ ID NO: 1064300 - RNA, 14 nt, Homo sapiens
aggcaaauguguac

SEQ ID NO: 1064301 - RNA, 15 nt, Homo sapiens
aggcaaccagaggaa

SEQ ID NO: 1064302 - RNA, 13 nt, Homo sapiens
aggcaacugcauu

SEQ ID NO: 1064303 - RNA, 16 nt, Homo sapiens
aggcacauaccacugc

SEQ ID NO: 1064304 - RNA, 18 nt, Homo sapiens
aggcaccuuaguggcuuu

SEQ ID NO: 1064305 - RNA, 15 nt, Homo sapiens
aggcagaaagcaaaa

SEQ ID NO: 1064306 - RNA, 20 nt, Homo sapiens
aggcagagaaucauacuuag

SEQ ID NO: 1064307 - RNA, 15 nt, Homo sapiens
aggcagcagugugag

SEQ ID NO: 1064308 - RNA, 17 nt, Homo sapiens
aggcagcugacacaucu

SEQ ID NO: 1064309 - RNA, 18 nt, Homo sapiens
aggcagcuguugcaguga

SEQ ID NO: 1064310 - RNA, 16 nt, Homo sapiens
aggcaggagaaucacu

SEQ ID NO: 1064311 - RNA, 14 nt, Homo sapiens
aggcauaguuuuua

SEQ ID NO: 1064312 - RNA, 22 nt, Homo sapiens
aggcaugagggaucacagggcc

SEQ ID NO: 1064313 - RNA, 14 nt, Homo sapiens
aggcauucuggagu

SEQ ID NO: 1064314 - RNA, 16 nt, Homo sapiens
aggcauugcacaggga

SEQ ID NO: 1064315 - RNA, 13 nt, Homo sapiens
aggccaagcauuu

SEQ ID NO: 1064316 - RNA, 23 nt, Homo sapiens
aggccaagcauuucuagcaguga

SEQ ID NO: 1064317 - RNA, 14 nt, Homo sapiens
aggccacaugucac

SEQ ID NO: 1064318 - RNA, 21 nt, Homo sapiens
aggccagagggagugacagag

SEQ ID NO: 1064319 - RNA, 16 nt, Homo sapiens
aggccagcaagcucuu

SEQ ID NO: 1064320 - RNA, 17 nt, Homo sapiens
aggccagcaccaucucu

SEQ ID NO: 1064321 - RNA, 15 nt, Homo sapiens
cacacacaccacaca

SEQ ID NO: 1064322 - RNA, 22 nt, Homo sapiens
cacacagaaaauauacuguaaa

SEQ ID NO: 1064323 - RNA, 13 nt, Homo sapiens
cacacagcuaaca

SEQ ID NO: 1064324 - RNA, 22 nt, Homo sapiens
cacacccagcccacuucugcca

SEQ ID NO: 1064325 - RNA, 17 nt, Homo sapiens
cacaccuagcaucucau

SEQ ID NO: 1064326 - RNA, 22 nt, Homo sapiens
cacaccuuauauuuacguauga

SEQ ID NO: 1064327 - RNA, 21 nt, Homo sapiens
cacacgccucccacugggguc

SEQ ID NO: 1064328 - RNA, 16 nt, Homo sapiens
cacacgcgugcacaca

SEQ ID NO: 1064329 - RNA, 14 nt, Homo sapiens
cacacguacuuaaa

SEQ ID NO: 1064330 - RNA, 16 nt, Homo sapiens
cacacuccaagauaug

SEQ ID NO: 1064331 - RNA, 17 nt, Homo sapiens
cacacugagcugagggg

SEQ ID NO: 1064332 - RNA, 20 nt, Homo sapiens
cacacugaggaacucacaau

SEQ ID NO: 1064333 - RNA, 18 nt, Homo sapiens
cacacugaggcagggaag

SEQ ID NO: 1064334 - RNA, 23 nt, Homo sapiens
cacacugggugcccaagcucaga

SEQ ID NO: 1064335 - RNA, 16 nt, Homo sapiens
cacacuguacucugca

SEQ ID NO: 1064336 - RNA, 14 nt, Homo sapiens
cacacuuccugucc

SEQ ID NO: 1064337 - RNA, 14 nt, Homo sapiens
cacacuuggaugca

SEQ ID NO: 1064338 - RNA, 19 nt, Homo sapiens
cacagaaagacugagcuca

SEQ ID NO: 1064339 - RNA, 12 nt, Homo sapiens
cacagacagggu

SEQ ID NO: 1064340 - RNA, 16 nt, Homo sapiens
cacagacccacaagag

SEQ ID NO: 1064341 - RNA, 20 nt, Homo sapiens
cacagagcaggacugcacag

SEQ ID NO: 1064342 - RNA, 17 nt, Homo sapiens
cacagaggacucacuug

SEQ ID NO: 1064343 - RNA, 19 nt, Homo sapiens
cacagaggacucacuugcc

SEQ ID NO: 1064344 - RNA, 16 nt, Homo sapiens
cacagaggaucugcuu

SEQ ID NO: 1064345 - RNA, 13 nt, Homo sapiens
cacagaggcugcc

SEQ ID NO: 1064346 - RNA, 14 nt, Homo sapiens
cacagaguuguuac

SEQ ID NO: 1064347 - RNA, 19 nt, Homo sapiens
cacagauccccccacaaag

SEQ ID NO: 1064348 - RNA, 16 nt, Homo sapiens
cacagaugugugauuc

SEQ ID NO: 1064349 - RNA, 15 nt, Homo sapiens
cacagcagcaguuac

SEQ ID NO: 1064350 - RNA, 16 nt, Homo sapiens
cacagcaggugcugag

SEQ ID NO: 1064351 - RNA, 18 nt, Homo sapiens
cacagcaucauuuugcau

SEQ ID NO: 1064352 - RNA, 21 nt, Homo sapiens
cacagcaucauuuugcauuca

SEQ ID NO: 1064353 - RNA, 11 nt, Homo sapiens
cacagccaaac

SEQ ID NO: 1064354 - RNA, 17 nt, Homo sapiens
cacagccuccccugcca

SEQ ID NO: 1064355 - RNA, 20 nt, Homo sapiens
cacagcgagacuccgucuca

SEQ ID NO: 1064356 - RNA, 22 nt, Homo sapiens
cacagcuacacagaucacagcu

SEQ ID NO: 1064357 - RNA, 20 nt, Homo sapiens
cacagcugaacuuguugaga

SEQ ID NO: 1064358 - RNA, 23 nt, Homo sapiens
cacagcugagagacuuuuaauca

SEQ ID NO: 1064359 - RNA, 20 nt, Homo sapiens
cacagcugcuggagacuccu

SEQ ID NO: 1064360 - RNA, 14 nt, Homo sapiens
cacagcuuuuuacc

SEQ ID NO: 1064361 - RNA, 23 nt, Homo sapiens
cacaggaugaaggcaaugccauc

SEQ ID NO: 1064362 - RNA, 16 nt, Homo sapiens
cacaggcagcauuuag

SEQ ID NO: 1064363 - RNA, 15 nt, Homo sapiens
cacagggacugaaaa

SEQ ID NO: 1064364 - RNA, 22 nt, Homo sapiens
cacagggcgagacuccgucuca

SEQ ID NO: 1064365 - RNA, 16 nt, Homo sapiens
cacagucacauuccaa

SEQ ID NO: 1064366 - RNA, 11 nt, Homo sapiens
cacagugucug

SEQ ID NO: 1064367 - RNA, 18 nt, Homo sapiens
cacaguuagguagcuuua

SEQ ID NO: 1064368 - RNA, 19 nt, Homo sapiens
cacauacacacauauguca

SEQ ID NO: 1064369 - RNA, 13 nt, Homo sapiens
cacauacauguaa

SEQ ID NO: 1064370 - RNA, 21 nt, Homo sapiens
cacauacauguaaaauauguc

SEQ ID NO: 1064371 - RNA, 17 nt, Homo sapiens
cacauacuugagacugu

SEQ ID NO: 1064372 - RNA, 12 nt, Homo sapiens
cacauagcacag

SEQ ID NO: 1064373 - RNA, 23 nt, Homo sapiens
cacauaguagguacccaauucaa

SEQ ID NO: 1064374 - RNA, 13 nt, Homo sapiens
cacauauggacuc

SEQ ID NO: 1064375 - RNA, 15 nt, Homo sapiens
cacaucaagcgauga

SEQ ID NO: 1064376 - RNA, 20 nt, Homo sapiens
cacauccuaugcaauauauc

SEQ ID NO: 1064377 - RNA, 21 nt, Homo sapiens
cacauccucugucuauuugag

SEQ ID NO: 1064378 - RNA, 16 nt, Homo sapiens
cacaucuaaccucauc

SEQ ID NO: 1064379 - RNA, 14 nt, Homo sapiens
cacaugaauccaua

SEQ ID NO: 1064380 - RNA, 23 nt, Homo sapiens
cacaugaaucccacccacaugug

SEQ ID NO: 1064381 - RNA, 17 nt, Homo sapiens
cacaugaccacauagca

SEQ ID NO: 1064382 - RNA, 15 nt, Homo sapiens
cacaugcacacacac

SEQ ID NO: 1064383 - RNA, 18 nt, Homo sapiens
cacaugccaagcacugug

SEQ ID NO: 1064384 - RNA, 18 nt, Homo sapiens
cacauggccuaugcacau

SEQ ID NO: 1064385 - RNA, 21 nt, Homo sapiens
cacauggccuaugcacauaug

SEQ ID NO: 1064386 - RNA, 17 nt, Homo sapiens
cacaugucaguaccuuc

SEQ ID NO: 1064387 - RNA, 14 nt, Homo sapiens
cacaugugcacaug

SEQ ID NO: 1064388 - RNA, 17 nt, Homo sapiens
cacaugugcacaugcac

SEQ ID NO: 1064389 - RNA, 16 nt, Homo sapiens
cacauguucaacuauu

SEQ ID NO: 1064390 - RNA, 17 nt, Homo sapiens
cacauucgaguguuuca

SEQ ID NO: 1064391 - RNA, 23 nt, Homo sapiens
cacauucuuaacacauguccuug

SEQ ID NO: 1064392 - RNA, 12 nt, Homo sapiens
cacauucuuaga

SEQ ID NO: 1064393 - RNA, 20 nt, Homo sapiens
cacauuuacaaaauuacaca

SEQ ID NO: 1064394 - RNA, 14 nt, Homo sapiens
cacauuugauucug

SEQ ID NO: 1064395 - RNA, 15 nt, Homo sapiens
caccaaaaagggauc

SEQ ID NO: 1064396 - RNA, 13 nt, Homo sapiens
caccaaagcuggc

SEQ ID NO: 1064397 - RNA, 22 nt, Homo sapiens
caccaacauugcuugugccaca

SEQ ID NO: 1064398 - RNA, 21 nt, Homo sapiens
caccaacccagagaaccugcu

SEQ ID NO: 1064399 - RNA, 16 nt, Homo sapiens
caccaauaaagccuuc

SEQ ID NO: 1064400 - RNA, 19 nt, Homo sapiens
caccaauauuucucagaca

SEQ ID NO: 1064401 - RNA, 18 nt, Homo sapiens
caccaauccccgccacag

SEQ ID NO: 1064402 - RNA, 13 nt, Homo sapiens
caccacacauaca

SEQ ID NO: 1064403 - RNA, 14 nt, Homo sapiens
caccacaugugcac

SEQ ID NO: 1064404 - RNA, 21 nt, Homo sapiens
caccagaggcugcagaaggcc

SEQ ID NO: 1064405 - RNA, 15 nt, Homo sapiens
caccagcaccaacac

SEQ ID NO: 1064406 - RNA, 13 nt, Homo sapiens
caccagcagccug

SEQ ID NO: 1064407 - RNA, 21 nt, Homo sapiens
caccagccauacuuaucucuc

SEQ ID NO: 1064408 - RNA, 16 nt, Homo sapiens
caccaguuccuuucaa

SEQ ID NO: 1064409 - RNA, 22 nt, Homo sapiens
caccaguuggagcagaugccuc

SEQ ID NO: 1064410 - RNA, 16 nt, Homo sapiens
caccauccuauugcaa

SEQ ID NO: 1064411 - RNA, 19 nt, Homo sapiens
caccaucucuuuaccuccu

SEQ ID NO: 1064412 - RNA, 21 nt, Homo sapiens
caccaugacccucuuccucau

SEQ ID NO: 1064413 - RNA, 18 nt, Homo sapiens
caccauuuuccugccuca

SEQ ID NO: 1064414 - RNA, 13 nt, Homo sapiens
cacccagcaaaga

SEQ ID NO: 1064415 - RNA, 23 nt, Homo sapiens
cacccagcucagcauuuccacac

SEQ ID NO: 1064416 - RNA, 23 nt, Homo sapiens
cacccaguccucccagcugccau

SEQ ID NO: 1064417 - RNA, 15 nt, Homo sapiens
cacccaugaaucaaa

SEQ ID NO: 1064418 - RNA, 17 nt, Homo sapiens
cacccaugaaucaaaga

SEQ ID NO: 1064419 - RNA, 13 nt, Homo sapiens
cacccaugcaccu

SEQ ID NO: 1064420 - RNA, 12 nt, Homo sapiens
caccccaacagc

SEQ ID NO: 1064421 - RNA, 22 nt, Homo sapiens
caccccaugcuguugauugcua

SEQ ID NO: 1064422 - RNA, 23 nt, Homo sapiens
caccccccagaaccuguccuugc

SEQ ID NO: 1064423 - RNA, 18 nt, Homo sapiens
caccccgccugcccucau

SEQ ID NO: 1064424 - RNA, 22 nt, Homo sapiens
cacccucccccgccacuccuga

SEQ ID NO: 1064425 - RNA, 22 nt, Homo sapiens
cacccuccuuucaccacaugug

SEQ ID NO: 1064426 - RNA, 22 nt, Homo sapiens
cacccugcuacacauacaggau

SEQ ID NO: 1064427 - RNA, 21 nt, Homo sapiens
cacccuggaggauuucaucuc

SEQ ID NO: 1064428 - RNA, 21 nt, Homo sapiens
caccgaccccaccaccugguu

SEQ ID NO: 1064429 - RNA, 22 nt, Homo sapiens
caccuaauguuuaugagccaga

SEQ ID NO: 1064430 - RNA, 13 nt, Homo sapiens
caccuagacugua

SEQ ID NO: 1064431 - RNA, 15 nt, Homo sapiens
caccuagcaucucau

SEQ ID NO: 1064432 - RNA, 12 nt, Homo sapiens
caccuagcuuua

SEQ ID NO: 1064433 - RNA, 22 nt, Homo sapiens
caccuauuuaagagggaacuua

SEQ ID NO: 1064434 - RNA, 12 nt, Homo sapiens
caccucacugaa

SEQ ID NO: 1064435 - RNA, 11 nt, Homo sapiens
caccuccucau

SEQ ID NO: 1064436 - RNA, 13 nt, Homo sapiens
caccucugcacaa

SEQ ID NO: 1064437 - RNA, 16 nt, Homo sapiens
caccucugcacaagcu

SEQ ID NO: 1064438 - RNA, 13 nt, Homo sapiens
caccucuguuucc

SEQ ID NO: 1064439 - RNA, 15 nt, Homo sapiens
caccugacagcuuua

SEQ ID NO: 1064440 - RNA, 15 nt, Homo sapiens
caccugaccaaucag

SEQ ID NO: 1064441 - RNA, 21 nt, Homo sapiens
caccugguuccggcucugcac

SEQ ID NO: 1064442 - RNA, 14 nt, Homo sapiens
caccugugaguuua

SEQ ID NO: 1064443 - RNA, 16 nt, Homo sapiens
caccuuaguggcuuuu

SEQ ID NO: 1064444 - RNA, 22 nt, Homo sapiens
caccuuugcaggcaugcaugug

SEQ ID NO: 1064445 - RNA, 13 nt, Homo sapiens
cacgaacuggccu

SEQ ID NO: 1064446 - RNA, 22 nt, Homo sapiens
cacgaucucgacucacugcaac

SEQ ID NO: 1064447 - RNA, 16 nt, Homo sapiens
cacgccuguaauccca

SEQ ID NO: 1064448 - RNA, 22 nt, Homo sapiens
cacgccuguaaucccagcacuu

SEQ ID NO: 1064449 - RNA, 17 nt, Homo sapiens
cacggcaaaaugucauu

SEQ ID NO: 1064450 - RNA, 20 nt, Homo sapiens
cacggccacuggccaucucc

SEQ ID NO: 1064451 - RNA, 15 nt, Homo sapiens
cacgggacugacgca

SEQ ID NO: 1064452 - RNA, 20 nt, Homo sapiens
cacggucuguucuugaagca

SEQ ID NO: 1064453 - RNA, 18 nt, Homo sapiens
cacgucuggcuucacaga

SEQ ID NO: 1064454 - RNA, 19 nt, Homo sapiens
cacguggaggaaugcuccc

SEQ ID NO: 1064455 - RNA, 13 nt, Homo sapiens
cacguguccugua

SEQ ID NO: 1064456 - RNA, 16 nt, Homo sapiens
cacuaaaagaucgcag

SEQ ID NO: 1064457 - RNA, 16 nt, Homo sapiens
cacuaaagcauucaau

SEQ ID NO: 1064458 - RNA, 16 nt, Homo sapiens
cacuaacaaacucuga

SEQ ID NO: 1064459 - RNA, 18 nt, Homo sapiens
cacuaauggggcggugag

SEQ ID NO: 1064460 - RNA, 13 nt, Homo sapiens
cacuaccacauua

SEQ ID NO: 1064461 - RNA, 14 nt, Homo sapiens
cacuagacugugcc

SEQ ID NO: 1064462 - RNA, 18 nt, Homo sapiens
cacuaggguccaccagga

SEQ ID NO: 1064463 - RNA, 20 nt, Homo sapiens
cacuauaauguaagcucuac

SEQ ID NO: 1064464 - RNA, 18 nt, Homo sapiens
cacuaucugggugcauga

SEQ ID NO: 1064465 - RNA, 22 nt, Homo sapiens
cacuaucugggugcaugaucuu

SEQ ID NO: 1064466 - RNA, 18 nt, Homo sapiens
cagucagaguugugcaca

SEQ ID NO: 1064467 - RNA, 14 nt, Homo sapiens
cagucaucuugacc

SEQ ID NO: 1064468 - RNA, 15 nt, Homo sapiens
cagucaucuugacca

SEQ ID NO: 1064469 - RNA, 12 nt, Homo sapiens
caguccaaggaa

SEQ ID NO: 1064470 - RNA, 11 nt, Homo sapiens
caguccacugc

SEQ ID NO: 1064471 - RNA, 14 nt, Homo sapiens
caguccacugcuga

SEQ ID NO: 1064472 - RNA, 16 nt, Homo sapiens
caguccauagcagaga

SEQ ID NO: 1064473 - RNA, 18 nt, Homo sapiens
cagucccuaaaaacacag

SEQ ID NO: 1064474 - RNA, 23 nt, Homo sapiens
caguccugggagaaccucaggcu

SEQ ID NO: 1064475 - RNA, 12 nt, Homo sapiens
caguccuuccac

SEQ ID NO: 1064476 - RNA, 20 nt, Homo sapiens
cagucuauauguuuguauaa

SEQ ID NO: 1064477 - RNA, 19 nt, Homo sapiens
cagugaaagacaagcugca

SEQ ID NO: 1064478 - RNA, 22 nt, Homo sapiens
cagugaaagacaagcugcaaau

SEQ ID NO: 1064479 - RNA, 14 nt, Homo sapiens
cagugaaccaaaga

SEQ ID NO: 1064480 - RNA, 21 nt, Homo sapiens
cagugaaugauucaguguuaa

SEQ ID NO: 1064481 - RNA, 18 nt, Homo sapiens
cagugacuccacucugag

SEQ ID NO: 1064482 - RNA, 18 nt, Homo sapiens
cagugagaaaaagcuccu

SEQ ID NO: 1064483 - RNA, 17 nt, Homo sapiens
cagugagaagccagcuu

SEQ ID NO: 1064484 - RNA, 17 nt, Homo sapiens
cagugagccaagaucac

SEQ ID NO: 1064485 - RNA, 19 nt, Homo sapiens
cagugagccgagauugugc

SEQ ID NO: 1064486 - RNA, 15 nt, Homo sapiens
cagugagccgucauc

SEQ ID NO: 1064487 - RNA, 19 nt, Homo sapiens
cagugagcuuggaaaggac

SEQ ID NO: 1064488 - RNA, 17 nt, Homo sapiens
cagugagucucuucaga

SEQ ID NO: 1064489 - RNA, 16 nt, Homo sapiens
cagugauauggcagaa

SEQ ID NO: 1064490 - RNA, 13 nt, Homo sapiens
cagugaucuccau

SEQ ID NO: 1064491 - RNA, 20 nt, Homo sapiens
cagugaugcuggaugcuccu

SEQ ID NO: 1064492 - RNA, 17 nt, Homo sapiens
cagugaugcugugcuau

SEQ ID NO: 1064493 - RNA, 17 nt, Homo sapiens
cagugcaacagcacugg

SEQ ID NO: 1064494 - RNA, 13 nt, Homo sapiens
cagugcauuugcc

SEQ ID NO: 1064495 - RNA, 15 nt, Homo sapiens
cagugcauuugccuu

SEQ ID NO: 1064496 - RNA, 22 nt, Homo sapiens
cagugccagcaaugacaucuca

SEQ ID NO: 1064497 - RNA, 13 nt, Homo sapiens
cagugcccuaggc

SEQ ID NO: 1064498 - RNA, 15 nt, Homo sapiens
cagugccuuccauaa

SEQ ID NO: 1064499 - RNA, 16 nt, Homo sapiens
cagugccuuccauaau

SEQ ID NO: 1064500 - RNA, 20 nt, Homo sapiens
cagugcuccuguaagucaaa

SEQ ID NO: 1064501 - RNA, 15 nt, Homo sapiens
cagugcuguacuuga

SEQ ID NO: 1064502 - RNA, 22 nt, Homo sapiens
cagugcuguacuugaugacaga

SEQ ID NO: 1064503 - RNA, 17 nt, Homo sapiens
cagugcuucagccugag

SEQ ID NO: 1064504 - RNA, 14 nt, Homo sapiens
caguggaacuaaga

SEQ ID NO: 1064505 - RNA, 13 nt, Homo sapiens
caguggacaccau

SEQ ID NO: 1064506 - RNA, 19 nt, Homo sapiens
caguggcuucaucugucaa

SEQ ID NO: 1064507 - RNA, 20 nt, Homo sapiens
caguggugaagaaaacuccu

SEQ ID NO: 1064508 - RNA, 13 nt, Homo sapiens
caguguacaugga

SEQ ID NO: 1064509 - RNA, 15 nt, Homo sapiens
caguguccaaagcag

SEQ ID NO: 1064510 - RNA, 15 nt, Homo sapiens
cagugucuuccauaa

SEQ ID NO: 1064511 - RNA, 22 nt, Homo sapiens
caguguggcccagggaagccaa

SEQ ID NO: 1064512 - RNA, 20 nt, Homo sapiens
caguguguuucugaucugau

SEQ ID NO: 1064513 - RNA, 11 nt, Homo sapiens
caguguugccc

SEQ ID NO: 1064514 - RNA, 11 nt, Homo sapiens
caguguuuaca

SEQ ID NO: 1064515 - RNA, 19 nt, Homo sapiens
caguguuugcaaugguguu

SEQ ID NO: 1064516 - RNA, 19 nt, Homo sapiens
caguuacagaaaguggugc

SEQ ID NO: 1064517 - RNA, 16 nt, Homo sapiens
caguuccuuucaaugg

SEQ ID NO: 1064518 - RNA, 23 nt, Homo sapiens
caguuggauuuauucugccaaac

SEQ ID NO: 1064519 - RNA, 15 nt, Homo sapiens
caguuucccuaucuc

SEQ ID NO: 1064520 - RNA, 16 nt, Homo sapiens
caguuugucacaugaa

SEQ ID NO: 1064521 - RNA, 21 nt, Homo sapiens
caguuuuaucuuuaaucuccu

SEQ ID NO: 1064522 - RNA, 14 nt, Homo sapiens
caguuuuccaugaa

SEQ ID NO: 1064523 - RNA, 20 nt, Homo sapiens
cauaaaaauaaaucaguuca

SEQ ID NO: 1064524 - RNA, 14 nt, Homo sapiens
cauaaaauguuaag

SEQ ID NO: 1064525 - RNA, 17 nt, Homo sapiens
cauaaacacccaugaau

SEQ ID NO: 1064526 - RNA, 22 nt, Homo sapiens
cauaaacacccaugaaucaaag

SEQ ID NO: 1064527 - RNA, 20 nt, Homo sapiens
cauaaaccucaaguuauuca

SEQ ID NO: 1064528 - RNA, 16 nt, Homo sapiens
cauaaaguaugugcau

SEQ ID NO: 1064529 - RNA, 17 nt, Homo sapiens
cauaaaguaugugcaua

SEQ ID NO: 1064530 - RNA, 16 nt, Homo sapiens
cauaaagugucuauaa

SEQ ID NO: 1064531 - RNA, 13 nt, Homo sapiens
cauaacaaaaaga

SEQ ID NO: 1064532 - RNA, 19 nt, Homo sapiens
cauaaccccggaagccaaa

SEQ ID NO: 1064533 - RNA, 19 nt, Homo sapiens
cauaaccgcugauucucag

SEQ ID NO: 1064534 - RNA, 18 nt, Homo sapiens
cauaagugcaugacauau

SEQ ID NO: 1064535 - RNA, 23 nt, Homo sapiens
cauaaguuuacugaaucuucaag

SEQ ID NO: 1064536 - RNA, 16 nt, Homo sapiens
cauaauaaauaucugu

SEQ ID NO: 1064537 - RNA, 16 nt, Homo sapiens
cauaauauuucuuaaa

SEQ ID NO: 1064538 - RNA, 12 nt, Homo sapiens
cauaaucuguac

SEQ ID NO: 1064539 - RNA, 14 nt, Homo sapiens
cauaaucuguacaa

SEQ ID NO: 1064540 - RNA, 22 nt, Homo sapiens
cauaauuuguacauauguaaaa

SEQ ID NO: 1064541 - RNA, 23 nt, Homo sapiens
cauacaauuauuuuuacaguucu

SEQ ID NO: 1064542 - RNA, 18 nt, Homo sapiens
cauacaauuccaaacaca

SEQ ID NO: 1064543 - RNA, 22 nt, Homo sapiens
cauacacacacacgcgugcaca

SEQ ID NO: 1064544 - RNA, 14 nt, Homo sapiens
cauacacagccugg

SEQ ID NO: 1064545 - RNA, 16 nt, Homo sapiens
cauacacuuauuggaa

SEQ ID NO: 1064546 - RNA, 22 nt, Homo sapiens
cauaccaaugaaaaaauguaua

SEQ ID NO: 1064547 - RNA, 15 nt, Homo sapiens
cauacccuguuacca

SEQ ID NO: 1064548 - RNA, 21 nt, Homo sapiens
cauaccuggcccugugccuug

SEQ ID NO: 1064549 - RNA, 22 nt, Homo sapiens
cauacgguaugauauugcagcu

SEQ ID NO: 1064550 - RNA, 13 nt, Homo sapiens
cauacuuaucucu

SEQ ID NO: 1064551 - RNA, 21 nt, Homo sapiens
cauagaaauuacacccaaaga

SEQ ID NO: 1064552 - RNA, 13 nt, Homo sapiens
cauagagaucuau

SEQ ID NO: 1064553 - RNA, 17 nt, Homo sapiens
cauagaguucagacuuu

SEQ ID NO: 1064554 - RNA, 19 nt, Homo sapiens
cauagcaagacacaucccu

SEQ ID NO: 1064555 - RNA, 17 nt, Homo sapiens
cauagcaagauugcuua

SEQ ID NO: 1064556 - RNA, 15 nt, Homo sapiens
cauagcagugcuuga

SEQ ID NO: 1064557 - RNA, 19 nt, Homo sapiens
cauagccaagaucccaucu

SEQ ID NO: 1064558 - RNA, 18 nt, Homo sapiens
cauagcuugauaaagggc

SEQ ID NO: 1064559 - RNA, 14 nt, Homo sapiens
cauaggccaugaaa

SEQ ID NO: 1064560 - RNA, 23 nt, Homo sapiens
cauaggcugacuuuugcagaugg

SEQ ID NO: 1064561 - RNA, 15 nt, Homo sapiens
cauagggccuccuua

SEQ ID NO: 1064562 - RNA, 17 nt, Homo sapiens
cauaguaguaugaugau

SEQ ID NO: 1064563 - RNA, 16 nt, Homo sapiens
cauaguucucuuuaag

SEQ ID NO: 1064564 - RNA, 18 nt, Homo sapiens
cauaguugugcaugccug

SEQ ID NO: 1064565 - RNA, 18 nt, Homo sapiens
cauauaaagcacuauaca

SEQ ID NO: 1064566 - RNA, 19 nt, Homo sapiens
cauauaauguuguuauuua

SEQ ID NO: 1064567 - RNA, 12 nt, Homo sapiens
cauauaccagca

SEQ ID NO: 1064568 - RNA, 13 nt, Homo sapiens
cauaucaaaaagu

SEQ ID NO: 1064569 - RNA, 13 nt, Homo sapiens
cauaucagucucu

SEQ ID NO: 1064570 - RNA, 14 nt, Homo sapiens
cauauccaacaugu

SEQ ID NO: 1064571 - RNA, 15 nt, Homo sapiens
cauauccugagccau

SEQ ID NO: 1064572 - RNA, 11 nt, Homo sapiens
cauaugaacug

SEQ ID NO: 1064573 - RNA, 14 nt, Homo sapiens
cauaugaccucaug

SEQ ID NO: 1064574 - RNA, 20 nt, Homo sapiens
cauauggacucugcacauga

SEQ ID NO: 1064575 - RNA, 17 nt, Homo sapiens
cauauguaccauguaca

SEQ ID NO: 1064576 - RNA, 20 nt, Homo sapiens
cauaugugaauauggacuca

SEQ ID NO: 1064577 - RNA, 14 nt, Homo sapiens
cauauuguuauuau

SEQ ID NO: 1064578 - RNA, 23 nt, Homo sapiens
caucaacaagaguugucuugucc

SEQ ID NO: 1064579 - RNA, 20 nt, Homo sapiens
caucaagaauggggaucaca

SEQ ID NO: 1064580 - RNA, 24 nt, Homo sapiens
caucaagaauggggaucacagaga

SEQ ID NO: 1064581 - RNA, 18 nt, Homo sapiens
caucaaggcacugccuga

SEQ ID NO: 1064582 - RNA, 19 nt, Homo sapiens
caucaaugcugaguuaaua

SEQ ID NO: 1064583 - RNA, 16 nt, Homo sapiens
caucacacaacucagc

SEQ ID NO: 1064584 - RNA, 16 nt, Homo sapiens
caucacaggacacggg

SEQ ID NO: 1064585 - RNA, 23 nt, Homo sapiens
caucacccacagccgcagcugua

SEQ ID NO: 1064586 - RNA, 20 nt, Homo sapiens
caucacuagccaugauaacu

SEQ ID NO: 1064587 - RNA, 14 nt, Homo sapiens
caucacugaaaugc

SEQ ID NO: 1064588 - RNA, 15 nt, Homo sapiens
caucagcauaccuuu

SEQ ID NO: 1064589 - RNA, 20 nt, Homo sapiens
caucagcugcugaaacaaca

SEQ ID NO: 1064590 - RNA, 15 nt, Homo sapiens
caucagucaaugaau

SEQ ID NO: 1064591 - RNA, 17 nt, Homo sapiens
caucaucaguggagcca

SEQ ID NO: 1064592 - RNA, 11 nt, Homo sapiens
caucaucccag

SEQ ID NO: 1064593 - RNA, 19 nt, Homo sapiens
caucaucuccugccuuccu

SEQ ID NO: 1064594 - RNA, 21 nt, Homo sapiens
caucauggauucauuacagcu

SEQ ID NO: 1064595 - RNA, 13 nt, Homo sapiens
caucauuuccauu

SEQ ID NO: 1064596 - RNA, 19 nt, Homo sapiens
cauccaacauuaaaagcca

SEQ ID NO: 1064597 - RNA, 17 nt, Homo sapiens
cauccaaugcucaagaa

SEQ ID NO: 1064598 - RNA, 19 nt, Homo sapiens
cauccaaugcucaagaaac

SEQ ID NO: 1064599 - RNA, 14 nt, Homo sapiens
cauccacugugcca

SEQ ID NO: 1064600 - RNA, 16 nt, Homo sapiens
cauccaucaucaugug

SEQ ID NO: 1064601 - RNA, 21 nt, Homo sapiens
cauccauuuauuuggcaucug

SEQ ID NO: 1064602 - RNA, 17 nt, Homo sapiens
caucccagcugcuccca

SEQ ID NO: 1064603 - RNA, 13 nt, Homo sapiens
caucccaggaucg

SEQ ID NO: 1064604 - RNA, 22 nt, Homo sapiens
cauccccaacugcgacugugac

SEQ ID NO: 1064605 - RNA, 17 nt, Homo sapiens
cauccccuggacuggga

SEQ ID NO: 1064606 - RNA, 19 nt, Homo sapiens
caucccucgggugugcuau

SEQ ID NO: 1064607 - RNA, 20 nt, Homo sapiens
cauccucagguggucaggcg

SEQ ID NO: 1064608 - RNA, 17 nt, Homo sapiens
cauccuccacaauagca

SEQ ID NO: 1064609 - RNA, 19 nt, Homo sapiens
cauccugaccuugcacaaa

SEQ ID NO: 1064610 - RNA, 20 nt, Homo sapiens
cauccuggccaacaugguga

SEQ ID NO: 1064611 - RNA, 19 nt, Homo sapiens
cccggagguugggugggcc

SEQ ID NO: 1064612 - RNA, 14 nt, Homo sapiens
cccgggcugccugg

SEQ ID NO: 1064613 - RNA, 22 nt, Homo sapiens
cccgucauguuccucaaaagca

SEQ ID NO: 1064614 - RNA, 14 nt, Homo sapiens
cccuaaaccaaaaa

SEQ ID NO: 1064615 - RNA, 17 nt, Homo sapiens
cccuaaaucuugacuac

SEQ ID NO: 1064616 - RNA, 19 nt, Homo sapiens
cccuaaccucugagucacc

SEQ ID NO: 1064617 - RNA, 13 nt, Homo sapiens
cccuaaguuuuau

SEQ ID NO: 1064618 - RNA, 11 nt, Homo sapiens
cccuacaugga

SEQ ID NO: 1064619 - RNA, 14 nt, Homo sapiens
cccuagucuauuca

SEQ ID NO: 1064620 - RNA, 23 nt, Homo sapiens
cccuaucucgaacauggaacuca

SEQ ID NO: 1064621 - RNA, 19 nt, Homo sapiens
cccuaugugggugggacca

SEQ ID NO: 1064622 - RNA, 21 nt, Homo sapiens
cccuauugcugcuugaggcaa

SEQ ID NO: 1064623 - RNA, 23 nt, Homo sapiens
cccucaacaccucugcacaagcu

SEQ ID NO: 1064624 - RNA, 15 nt, Homo sapiens
cccucacuguugaau

SEQ ID NO: 1064625 - RNA, 14 nt, Homo sapiens
cccucagagugcaa

SEQ ID NO: 1064626 - RNA, 16 nt, Homo sapiens
cccuccagacaaugcc

SEQ ID NO: 1064627 - RNA, 22 nt, Homo sapiens
cccucccacugccaaagaacuu

SEQ ID NO: 1064628 - RNA, 14 nt, Homo sapiens
cccuccuacccugc

SEQ ID NO: 1064629 - RNA, 20 nt, Homo sapiens
cccuccuccagaccauucag

SEQ ID NO: 1064630 - RNA, 12 nt, Homo sapiens
cccuccuguaaa

SEQ ID NO: 1064631 - RNA, 13 nt, Homo sapiens
cccuccuucaucc

SEQ ID NO: 1064632 - RNA, 20 nt, Homo sapiens
cccucgcucagagggauccu

SEQ ID NO: 1064633 - RNA, 20 nt, Homo sapiens
cccucguuaaucacaggauc

SEQ ID NO: 1064634 - RNA, 17 nt, Homo sapiens
cccucucccgccagacu

SEQ ID NO: 1064635 - RNA, 14 nt, Homo sapiens
cccucucuugcacc

SEQ ID NO: 1064636 - RNA, 15 nt, Homo sapiens
cccucugcugaucuc

SEQ ID NO: 1064637 - RNA, 22 nt, Homo sapiens
cccucuuaacgcagcacuuaga

SEQ ID NO: 1064638 - RNA, 19 nt, Homo sapiens
cccucuugaaucucugaau

SEQ ID NO: 1064639 - RNA, 22 nt, Homo sapiens
cccucuugauguggugaggcag

SEQ ID NO: 1064640 - RNA, 23 nt, Homo sapiens
cccucuuguuuucacuucacuuu

SEQ ID NO: 1064641 - RNA, 17 nt, Homo sapiens
cccucuuucacuucaua

SEQ ID NO: 1064642 - RNA, 23 nt, Homo sapiens
cccucuuuucugaucugcaguuu

SEQ ID NO: 1064643 - RNA, 15 nt, Homo sapiens
cccugacaugcacac

SEQ ID NO: 1064644 - RNA, 15 nt, Homo sapiens
cccugcccugaccuc

SEQ ID NO: 1064645 - RNA, 20 nt, Homo sapiens
cccugcucaguaaagcacuu

SEQ ID NO: 1064646 - RNA, 11 nt, Homo sapiens
cccugcuccac

SEQ ID NO: 1064647 - RNA, 20 nt, Homo sapiens
cccuggcugaccccaaagag

SEQ ID NO: 1064648 - RNA, 15 nt, Homo sapiens
cccuggcugcccugg

SEQ ID NO: 1064649 - RNA, 14 nt, Homo sapiens
cccugggaccacag

SEQ ID NO: 1064650 - RNA, 14 nt, Homo sapiens
cccuggugaaggau

SEQ ID NO: 1064651 - RNA, 11 nt, Homo sapiens
cccuguacaau

SEQ ID NO: 1064652 - RNA, 17 nt, Homo sapiens
cccuguaccugugcacg

SEQ ID NO: 1064653 - RNA, 17 nt, Homo sapiens
cccugucuaaaaauuca

SEQ ID NO: 1064654 - RNA, 15 nt, Homo sapiens
cccugucucuagcca

SEQ ID NO: 1064655 - RNA, 13 nt, Homo sapiens
cccuuaaggacaa

SEQ ID NO: 1064656 - RNA, 16 nt, Homo sapiens
cccuuaucaccagcug

SEQ ID NO: 1064657 - RNA, 14 nt, Homo sapiens
cccuucacacaacu

SEQ ID NO: 1064658 - RNA, 14 nt, Homo sapiens
cccuuccagugccc

SEQ ID NO: 1064659 - RNA, 19 nt, Homo sapiens
cccuuccuacagauaguca

SEQ ID NO: 1064660 - RNA, 18 nt, Homo sapiens
cccuugaggaaacaacag

SEQ ID NO: 1064661 - RNA, 15 nt, Homo sapiens
cccuuggcugugagg

SEQ ID NO: 1064662 - RNA, 18 nt, Homo sapiens
cccuuuccagauauucaa

SEQ ID NO: 1064663 - RNA, 13 nt, Homo sapiens
cccuuugugacuu

SEQ ID NO: 1064664 - RNA, 19 nt, Homo sapiens
cccuuuucuguauguccuu

SEQ ID NO: 1064665 - RNA, 23 nt, Homo sapiens
cccuuuugggccuagaauucuga

SEQ ID NO: 1064666 - RNA, 18 nt, Homo sapiens
ccgaaaaauccucuuccu

SEQ ID NO: 1064667 - RNA, 16 nt, Homo sapiens
ccgaaguaugagggaa

SEQ ID NO: 1064668 - RNA, 14 nt, Homo sapiens
ccgaagucuuccau

SEQ ID NO: 1064669 - RNA, 13 nt, Homo sapiens
ccgaaugugcagg

SEQ ID NO: 1064670 - RNA, 18 nt, Homo sapiens
ccgacaaccgaugcucca

SEQ ID NO: 1064671 - RNA, 15 nt, Homo sapiens
ccgacuccacuuuca

SEQ ID NO: 1064672 - RNA, 21 nt, Homo sapiens
ccgacugcuagggaguggucu

SEQ ID NO: 1064673 - RNA, 13 nt, Homo sapiens
ccgaggacaugaa

SEQ ID NO: 1064674 - RNA, 16 nt, Homo sapiens
ccgaguaacugagauu

SEQ ID NO: 1064675 - RNA, 17 nt, Homo sapiens
ccgagugcaaugaauga

SEQ ID NO: 1064676 - RNA, 17 nt, Homo sapiens
ccgcaaaccacacugga

SEQ ID NO: 1064677 - RNA, 19 nt, Homo sapiens
ccgcaccaauaaagccuuc

SEQ ID NO: 1064678 - RNA, 14 nt, Homo sapiens
ccgcagaagcagac

SEQ ID NO: 1064679 - RNA, 18 nt, Homo sapiens
ccgccuccaaaugccaac

SEQ ID NO: 1064680 - RNA, 23 nt, Homo sapiens
ccgcgugaucaaagccacacucu

SEQ ID NO: 1064681 - RNA, 12 nt, Homo sapiens
ccggaagccaaa

SEQ ID NO: 1064682 - RNA, 21 nt, Homo sapiens
ccggacuccugccgcagugau

SEQ ID NO: 1064683 - RNA, 18 nt, Homo sapiens
ccggaugcuucuccauga

SEQ ID NO: 1064684 - RNA, 13 nt, Homo sapiens
ccggccaccagau

SEQ ID NO: 1064685 - RNA, 19 nt, Homo sapiens
ccggccuccugucccucau

SEQ ID NO: 1064686 - RNA, 12 nt, Homo sapiens
ccggcugcgugg

SEQ ID NO: 1064687 - RNA, 15 nt, Homo sapiens
ccgggagacucugaa

SEQ ID NO: 1064688 - RNA, 20 nt, Homo sapiens
ccgggucaucuguaccucug

SEQ ID NO: 1064689 - RNA, 12 nt, Homo sapiens
ccguaacaacug

SEQ ID NO: 1064690 - RNA, 12 nt, Homo sapiens
ccgucucaagga

SEQ ID NO: 1064691 - RNA, 16 nt, Homo sapiens
ccgucuguacuaaaaa

SEQ ID NO: 1064692 - RNA, 22 nt, Homo sapiens
ccgucuguggcuuucagccucu

SEQ ID NO: 1064693 - RNA, 19 nt, Homo sapiens
ccgugaggaugucacucag

SEQ ID NO: 1064694 - RNA, 18 nt, Homo sapiens
ccguggcuaagagugucc

SEQ ID NO: 1064695 - RNA, 15 nt, Homo sapiens
ccuaaaaaguuccau

SEQ ID NO: 1064696 - RNA, 13 nt, Homo sapiens
ccuaaaagcacac

SEQ ID NO: 1064697 - RNA, 14 nt, Homo sapiens
ccuaaaauuugccc

SEQ ID NO: 1064698 - RNA, 18 nt, Homo sapiens
ccuaaacuauaugccaua

SEQ ID NO: 1064699 - RNA, 22 nt, Homo sapiens
ccuaaaucaaguuggcuucuaa

SEQ ID NO: 1064700 - RNA, 15 nt, Homo sapiens
ccuaaccucauuccc

SEQ ID NO: 1064701 - RNA, 18 nt, Homo sapiens
ccuaacuggcuuacuucc

SEQ ID NO: 1064702 - RNA, 23 nt, Homo sapiens
ccuaagccaugggagacacugau

SEQ ID NO: 1064703 - RNA, 15 nt, Homo sapiens
ccuaaggaucucuca

SEQ ID NO: 1064704 - RNA, 18 nt, Homo sapiens
ccuaaggaucucucagga

SEQ ID NO: 1064705 - RNA, 20 nt, Homo sapiens
ccuaaucaggcugagguguc

SEQ ID NO: 1064706 - RNA, 18 nt, Homo sapiens
ccuaaugaaugcauaaaa

SEQ ID NO: 1064707 - RNA, 16 nt, Homo sapiens
ccuaaugcugcagauu

SEQ ID NO: 1064708 - RNA, 21 nt, Homo sapiens
ccuacaaggcuggcagugaca

SEQ ID NO: 1064709 - RNA, 23 nt, Homo sapiens
ccuacaaggcuggcagugacaga

SEQ ID NO: 1064710 - RNA, 17 nt, Homo sapiens
ccuacagaggucucugc

SEQ ID NO: 1064711 - RNA, 20 nt, Homo sapiens
ccuaccacugucuucuucag

SEQ ID NO: 1064712 - RNA, 15 nt, Homo sapiens
ccuacugaaugcucu

SEQ ID NO: 1064713 - RNA, 11 nt, Homo sapiens
ccuacugcuga

SEQ ID NO: 1064714 - RNA, 23 nt, Homo sapiens
ccuacuguucggacaaaaaaagu

SEQ ID NO: 1064715 - RNA, 16 nt, Homo sapiens
ccuacuuugacuuuuu

SEQ ID NO: 1064716 - RNA, 19 nt, Homo sapiens
ccuacuuugacuuuuugca

SEQ ID NO: 1064717 - RNA, 15 nt, Homo sapiens
ccuagagcacacugu

SEQ ID NO: 1064718 - RNA, 20 nt, Homo sapiens
ccuagcaaccuccacauguu

SEQ ID NO: 1064719 - RNA, 23 nt, Homo sapiens
ccuagcaaggcaugauguuaacc

SEQ ID NO: 1064720 - RNA, 17 nt, Homo sapiens
ccuagcacacacuuuug

SEQ ID NO: 1064721 - RNA, 17 nt, Homo sapiens
ccuagcccuucucucau

SEQ ID NO: 1064722 - RNA, 19 nt, Homo sapiens
ccuagccucgcucuuggca

SEQ ID NO: 1064723 - RNA, 21 nt, Homo sapiens
ccuaggaauucccagcccaaa

SEQ ID NO: 1064724 - RNA, 17 nt, Homo sapiens
ccuaggaguauccucau

SEQ ID NO: 1064725 - RNA, 23 nt, Homo sapiens
ccuagucuacuugaggcugcaau

SEQ ID NO: 1064726 - RNA, 13 nt, Homo sapiens
ccuagucuauuca

SEQ ID NO: 1064727 - RNA, 13 nt, Homo sapiens
ccuauaaauauua

SEQ ID NO: 1064728 - RNA, 20 nt, Homo sapiens
ccuauagucccagcuacuca

SEQ ID NO: 1064729 - RNA, 13 nt, Homo sapiens
ccuauaugcacuu

SEQ ID NO: 1064730 - RNA, 19 nt, Homo sapiens
ccuauauguaguauaaaga

SEQ ID NO: 1064731 - RNA, 23 nt, Homo sapiens
ccuaucagaaguuucucagcucc

SEQ ID NO: 1064732 - RNA, 23 nt, Homo sapiens
ccuaucuaacccucccauggcac

SEQ ID NO: 1064733 - RNA, 22 nt, Homo sapiens
ccuaugugggugggaccacaga

SEQ ID NO: 1064734 - RNA, 23 nt, Homo sapiens
ccuauguuuuuguucaaagccag

SEQ ID NO: 1064735 - RNA, 18 nt, Homo sapiens
ccucaaaaugacagccau

SEQ ID NO: 1064736 - RNA, 13 nt, Homo sapiens
ccucaaacaacac

SEQ ID NO: 1064737 - RNA, 13 nt, Homo sapiens
ccucaaagcacac

SEQ ID NO: 1064738 - RNA, 15 nt, Homo sapiens
ccucaaagucugcaa

SEQ ID NO: 1064739 - RNA, 20 nt, Homo sapiens
ccucaaaugacccaaagacc

SEQ ID NO: 1064740 - RNA, 20 nt, Homo sapiens
ccucaaccaaugccaaaaaa

SEQ ID NO: 1064741 - RNA, 18 nt, Homo sapiens
ccucaagggccaggacuu

SEQ ID NO: 1064742 - RNA, 15 nt, Homo sapiens
ccucaaggggccauc

SEQ ID NO: 1064743 - RNA, 19 nt, Homo sapiens
ccucacacugggacuugca

SEQ ID NO: 1064744 - RNA, 23 nt, Homo sapiens
ccucacagaagcugcuuaaccca

SEQ ID NO: 1064745 - RNA, 20 nt, Homo sapiens
ccucacagagugcauuguga

SEQ ID NO: 1064746 - RNA, 23 nt, Homo sapiens
ccucacagagugcauugugaggg

SEQ ID NO: 1064747 - RNA, 11 nt, Homo sapiens
ccucacaucuu

SEQ ID NO: 1064748 - RNA, 14 nt, Homo sapiens
ccucacaucuuuca

SEQ ID NO: 1064749 - RNA, 17 nt, Homo sapiens
ccucacaucuuucacac

SEQ ID NO: 1064750 - RNA, 18 nt, Homo sapiens
ccucaccaacccagagaa

SEQ ID NO: 1064751 - RNA, 22 nt, Homo sapiens
ccucacugcuguagacauuugc

SEQ ID NO: 1064752 - RNA, 23 nt, Homo sapiens
ccucacugcuguagacauuugcu

SEQ ID NO: 1064753 - RNA, 13 nt, Homo sapiens
ccucagagugcaa

SEQ ID NO: 1064754 - RNA, 14 nt, Homo sapiens
ccucagagugcaag

SEQ ID NO: 1064755 - RNA, 15 nt, Homo sapiens
ccucaggggacuuga

SEQ ID NO: 1064756 - RNA, 17 nt, Homo sapiens
gaaaucuagaagacugu

SEQ ID NO: 1064757 - RNA, 19 nt, Homo sapiens
gaaaucuaugaaauaucau

SEQ ID NO: 1064758 - RNA, 14 nt, Homo sapiens
gaaaugcagaguca

SEQ ID NO: 1064759 - RNA, 11 nt, Homo sapiens
gaaauuacuuc

SEQ ID NO: 1064760 - RNA, 20 nt, Homo sapiens
gaaauuuaauucauguuucu

SEQ ID NO: 1064761 - RNA, 20 nt, Homo sapiens
gaacaaagugagacagucca

SEQ ID NO: 1064762 - RNA, 22 nt, Homo sapiens
gaacaacuaggcuucagcauau

SEQ ID NO: 1064763 - RNA, 17 nt, Homo sapiens
gaacaaucaaagcacuu

SEQ ID NO: 1064764 - RNA, 15 nt, Homo sapiens
gaacacaaggucauu

SEQ ID NO: 1064765 - RNA, 14 nt, Homo sapiens
gaacaccuccucaa

SEQ ID NO: 1064766 - RNA, 14 nt, Homo sapiens
gaacacgcuuucac

SEQ ID NO: 1064767 - RNA, 22 nt, Homo sapiens
gaacacguuuuuucacuauuaa

SEQ ID NO: 1064768 - RNA, 17 nt, Homo sapiens
gaacagaaggaugaaug

SEQ ID NO: 1064769 - RNA, 19 nt, Homo sapiens
gaacagaagggcuaacuca

SEQ ID NO: 1064770 - RNA, 15 nt, Homo sapiens
gaacaguccauugaa

SEQ ID NO: 1064771 - RNA, 15 nt, Homo sapiens
gaacagugcuugcca

SEQ ID NO: 1064772 - RNA, 16 nt, Homo sapiens
gaacauagaacucugg

SEQ ID NO: 1064773 - RNA, 16 nt, Homo sapiens
gaacaucaucaaggca

SEQ ID NO: 1064774 - RNA, 23 nt, Homo sapiens
gaacauuccuuagucucaagggc

SEQ ID NO: 1064775 - RNA, 15 nt, Homo sapiens
gaacauugcauauaa

SEQ ID NO: 1064776 - RNA, 18 nt, Homo sapiens
gaacauugcauauaacuu

SEQ ID NO: 1064777 - RNA, 15 nt, Homo sapiens
gaaccaauauuugua

SEQ ID NO: 1064778 - RNA, 16 nt, Homo sapiens
gaaccacgucugcuaa

SEQ ID NO: 1064779 - RNA, 18 nt, Homo sapiens
gaaccaggcaacuuggga

SEQ ID NO: 1064780 - RNA, 20 nt, Homo sapiens
gaacccucaggucacaagag

SEQ ID NO: 1064781 - RNA, 21 nt, Homo sapiens
gaacccugggccauccucaca

SEQ ID NO: 1064782 - RNA, 13 nt, Homo sapiens
gaacccugugcug

SEQ ID NO: 1064783 - RNA, 15 nt, Homo sapiens
gaacccuuguccucc

SEQ ID NO: 1064784 - RNA, 21 nt, Homo sapiens
gaaccgagcaauuuucugcua

SEQ ID NO: 1064785 - RNA, 16 nt, Homo sapiens
gaaccuggaacuugga

SEQ ID NO: 1064786 - RNA, 16 nt, Homo sapiens
gaaccuguccuugcac

SEQ ID NO: 1064787 - RNA, 15 nt, Homo sapiens
gaacgcguguguaca

SEQ ID NO: 1064788 - RNA, 17 nt, Homo sapiens
gaacgguaaauuucugu

SEQ ID NO: 1064789 - RNA, 20 nt, Homo sapiens
gaacguuuuuccuguucuua

SEQ ID NO: 1064790 - RNA, 13 nt, Homo sapiens
gaacuagaaccug

SEQ ID NO: 1064791 - RNA, 13 nt, Homo sapiens
gaacuagacuccc

SEQ ID NO: 1064792 - RNA, 22 nt, Homo sapiens
gaacucauuccugccugucucc

SEQ ID NO: 1064793 - RNA, 12 nt, Homo sapiens
gaacucugagca

SEQ ID NO: 1064794 - RNA, 21 nt, Homo sapiens
gaacucuucaaucucuugcac

SEQ ID NO: 1064795 - RNA, 18 nt, Homo sapiens
gaacugaaaacaagccau

SEQ ID NO: 1064796 - RNA, 22 nt, Homo sapiens
gaacugacaggcagccuggaca

SEQ ID NO: 1064797 - RNA, 16 nt, Homo sapiens
gaacugcagucagcau

SEQ ID NO: 1064798 - RNA, 17 nt, Homo sapiens
gaacugcauauguuucg

SEQ ID NO: 1064799 - RNA, 20 nt, Homo sapiens
gaacugggaccuuuaguggu

SEQ ID NO: 1064800 - RNA, 16 nt, Homo sapiens
gaacuggguacuugug

SEQ ID NO: 1064801 - RNA, 15 nt, Homo sapiens
gaacuguccagagag

SEQ ID NO: 1064802 - RNA, 12 nt, Homo sapiens
gaacuugcacaa

SEQ ID NO: 1064803 - RNA, 13 nt, Homo sapiens
gaacuugcacaaa

SEQ ID NO: 1064804 - RNA, 17 nt, Homo sapiens
gaacuuggcacacucuc

SEQ ID NO: 1064805 - RNA, 14 nt, Homo sapiens
gaagaaauucugca

SEQ ID NO: 1064806 - RNA, 13 nt, Homo sapiens
gaagaacauagaa

SEQ ID NO: 1064807 - RNA, 19 nt, Homo sapiens
gaagaacccucaggucaca

SEQ ID NO: 1064808 - RNA, 13 nt, Homo sapiens
gaagaacuugcau

SEQ ID NO: 1064809 - RNA, 20 nt, Homo sapiens
gaagaagucuaagagugaag

SEQ ID NO: 1064810 - RNA, 14 nt, Homo sapiens
gaagaaucuguuuc

SEQ ID NO: 1064811 - RNA, 17 nt, Homo sapiens
gaagaaucuguuuccca

SEQ ID NO: 1064812 - RNA, 15 nt, Homo sapiens
gaagaaugagcaaga

SEQ ID NO: 1064813 - RNA, 23 nt, Homo sapiens
gaagacaauggcuuacuccagga

SEQ ID NO: 1064814 - RNA, 13 nt, Homo sapiens
gaagacaauguga

SEQ ID NO: 1064815 - RNA, 21 nt, Homo sapiens
gaagaccaagacacagaucac

SEQ ID NO: 1064816 - RNA, 11 nt, Homo sapiens
gaagaccagcu

SEQ ID NO: 1064817 - RNA, 14 nt, Homo sapiens
gaagagaccaagac

SEQ ID NO: 1064818 - RNA, 14 nt, Homo sapiens
gaagagauccuucu

SEQ ID NO: 1064819 - RNA, 18 nt, Homo sapiens
gaagagauccuucuguaa

SEQ ID NO: 1064820 - RNA, 23 nt, Homo sapiens
gaagagccuugcggaagguucua

SEQ ID NO: 1064821 - RNA, 19 nt, Homo sapiens
gaagaguggguuucacaag

SEQ ID NO: 1064822 - RNA, 22 nt, Homo sapiens
gaagaguggguuucacaaguga

SEQ ID NO: 1064823 - RNA, 20 nt, Homo sapiens
gaagauaacuugagcaccgu

SEQ ID NO: 1064824 - RNA, 20 nt, Homo sapiens
gaagauauaacuauugccca

SEQ ID NO: 1064825 - RNA, 21 nt, Homo sapiens
gaagaucauauacgugaaaau

SEQ ID NO: 1064826 - RNA, 21 nt, Homo sapiens
gaagauggauugguguaaaag

SEQ ID NO: 1064827 - RNA, 20 nt, Homo sapiens
gaagauguuucaaaaaaucu

SEQ ID NO: 1064828 - RNA, 21 nt, Homo sapiens
gaagauugaacccuggcugaa

SEQ ID NO: 1064829 - RNA, 19 nt, Homo sapiens
gaagcaacccaaauguuca

SEQ ID NO: 1064830 - RNA, 15 nt, Homo sapiens
gaagcagugccuucc

SEQ ID NO: 1064831 - RNA, 20 nt, Homo sapiens
gaagcaucgcuccucuccag

SEQ ID NO: 1064832 - RNA, 20 nt, Homo sapiens
gaagccacuauuacugggac

SEQ ID NO: 1064833 - RNA, 20 nt, Homo sapiens
gaagccacugaagcugggau

SEQ ID NO: 1064834 - RNA, 17 nt, Homo sapiens
gaagccagcuuuccuca

SEQ ID NO: 1064835 - RNA, 20 nt, Homo sapiens
gaagccggaggguguuuaug

SEQ ID NO: 1064836 - RNA, 14 nt, Homo sapiens
gaagccgugcccug

SEQ ID NO: 1064837 - RNA, 23 nt, Homo sapiens
gaagccuuagccaggaggccagg

SEQ ID NO: 1064838 - RNA, 13 nt, Homo sapiens
gaagcuccacugu

SEQ ID NO: 1064839 - RNA, 14 nt, Homo sapiens
gaagcuccacuguc

SEQ ID NO: 1064840 - RNA, 15 nt, Homo sapiens
gaagcuccacuguca

SEQ ID NO: 1064841 - RNA, 13 nt, Homo sapiens
gaaggaagugaag

SEQ ID NO: 1064842 - RNA, 15 nt, Homo sapiens
gaaggaauuauuccc

SEQ ID NO: 1064843 - RNA, 12 nt, Homo sapiens
gaaggacugugc

SEQ ID NO: 1064844 - RNA, 22 nt, Homo sapiens
gaaggaggcuuaggacuuucca

SEQ ID NO: 1064845 - RNA, 12 nt, Homo sapiens
gaaggagggaga

SEQ ID NO: 1064846 - RNA, 17 nt, Homo sapiens
gaaggaggggaaccaga

SEQ ID NO: 1064847 - RNA, 14 nt, Homo sapiens
gaaggaguucacug

SEQ ID NO: 1064848 - RNA, 14 nt, Homo sapiens
gaaggcagagccau

SEQ ID NO: 1064849 - RNA, 13 nt, Homo sapiens
gaaggcaugccua

SEQ ID NO: 1064850 - RNA, 18 nt, Homo sapiens
gaaggccgagaagcaaga

SEQ ID NO: 1064851 - RNA, 14 nt, Homo sapiens
gaaggccuggccca

SEQ ID NO: 1064852 - RNA, 16 nt, Homo sapiens
gaaggcucuucugacu

SEQ ID NO: 1064853 - RNA, 10 nt, Homo sapiens
gaagggccag

SEQ ID NO: 1064854 - RNA, 23 nt, Homo sapiens
gaagggcuuggacucaagcaaga

SEQ ID NO: 1064855 - RNA, 23 nt, Homo sapiens
gaaggguaccuugaacacugggg

SEQ ID NO: 1064856 - RNA, 14 nt, Homo sapiens
gaaggucaccagca

SEQ ID NO: 1064857 - RNA, 19 nt, Homo sapiens
gaagguggggacagggaug

SEQ ID NO: 1064858 - RNA, 20 nt, Homo sapiens
gaagguggggacagggauga

SEQ ID NO: 1064859 - RNA, 16 nt, Homo sapiens
gaagguucucugugcu

SEQ ID NO: 1064860 - RNA, 15 nt, Homo sapiens
gaagguugugaugaa

SEQ ID NO: 1064861 - RNA, 15 nt, Homo sapiens
gaaguaacauuugcc

SEQ ID NO: 1064862 - RNA, 19 nt, Homo sapiens
gaaguacucauacauguua

SEQ ID NO: 1064863 - RNA, 18 nt, Homo sapiens
gaaguagaauuuguccaa

SEQ ID NO: 1064864 - RNA, 22 nt, Homo sapiens
gaaguagaauuuguccaauaac

SEQ ID NO: 1064865 - RNA, 19 nt, Homo sapiens
gaaguagauuaagagccau

SEQ ID NO: 1064866 - RNA, 20 nt, Homo sapiens
gaaguagcugagaaaacuaa

SEQ ID NO: 1064867 - RNA, 13 nt, Homo sapiens
gaaguagguguga

SEQ ID NO: 1064868 - RNA, 17 nt, Homo sapiens
gaaguaggugugacuug

SEQ ID NO: 1064869 - RNA, 21 nt, Homo sapiens
gaaguauccuucagccugaaa

SEQ ID NO: 1064870 - RNA, 20 nt, Homo sapiens
gaaguauuuuccuccaggca

SEQ ID NO: 1064871 - RNA, 14 nt, Homo sapiens
gaagucacacagua

SEQ ID NO: 1064872 - RNA, 20 nt, Homo sapiens
gaagucagagagggugacaa

SEQ ID NO: 1064873 - RNA, 19 nt, Homo sapiens
gaaguccccuuccauccca

SEQ ID NO: 1064874 - RNA, 17 nt, Homo sapiens
gaaguccuucaccucac

SEQ ID NO: 1064875 - RNA, 18 nt, Homo sapiens
gaagucuuagacuugaaa

SEQ ID NO: 1064876 - RNA, 14 nt, Homo sapiens
gaagugacucucac

SEQ ID NO: 1064877 - RNA, 13 nt, Homo sapiens
gaagugagcugag

SEQ ID NO: 1064878 - RNA, 15 nt, Homo sapiens
gaaguuaagaaccug

SEQ ID NO: 1064879 - RNA, 21 nt, Homo sapiens
gaaguuagggaugacugugau

SEQ ID NO: 1064880 - RNA, 20 nt, Homo sapiens
gaaguugcagugagcugaua

SEQ ID NO: 1064881 - RNA, 18 nt, Homo sapiens
gaaguuugcuuuguacug

SEQ ID NO: 1064882 - RNA, 13 nt, Homo sapiens
gaaguuuggcaau

SEQ ID NO: 1064883 - RNA, 20 nt, Homo sapiens
gaaguuuugacaucaaugau

SEQ ID NO: 1064884 - RNA, 17 nt, Homo sapiens
gaauaaaauuauuccuu

SEQ ID NO: 1064885 - RNA, 17 nt, Homo sapiens
gaauaaaauugcacuuu

SEQ ID NO: 1064886 - RNA, 16 nt, Homo sapiens
gaauaaacaggaaaau

SEQ ID NO: 1064887 - RNA, 19 nt, Homo sapiens
gaauaaagcccuugaacca

SEQ ID NO: 1064888 - RNA, 18 nt, Homo sapiens
gaauaaagccugcuuuuu

SEQ ID NO: 1064889 - RNA, 13 nt, Homo sapiens
gaauaaauaccuc

SEQ ID NO: 1064890 - RNA, 14 nt, Homo sapiens
gaauaaauaccucu

SEQ ID NO: 1064891 - RNA, 17 nt, Homo sapiens
gaauaaauugcuccuug

SEQ ID NO: 1064892 - RNA, 22 nt, Homo sapiens
gaauaacauggugugcuucuua

SEQ ID NO: 1064893 - RNA, 12 nt, Homo sapiens
gaauaagucaug

SEQ ID NO: 1064894 - RNA, 18 nt, Homo sapiens
gaauaauacaguaucuca

SEQ ID NO: 1064895 - RNA, 17 nt, Homo sapiens
gaauaaucuccuguuaa

SEQ ID NO: 1064896 - RNA, 23 nt, Homo sapiens
gaauaccaguguuauuaaugaca

SEQ ID NO: 1064897 - RNA, 23 nt, Homo sapiens
gaauaguguuggaaaaugugcaa

SEQ ID NO: 1064898 - RNA, 19 nt, Homo sapiens
gaauaguucccuagucuau

SEQ ID NO: 1064899 - RNA, 17 nt, Homo sapiens
gaauauaaacacuauau

SEQ ID NO: 1064900 - RNA, 16 nt, Homo sapiens
gaauauaauacuguau

SEQ ID NO: 1064901 - RNA, 22 nt, Homo sapiens
gaucaagcugugagacaguggg

SEQ ID NO: 1064902 - RNA, 15 nt, Homo sapiens
gaucaagucacucau

SEQ ID NO: 1064903 - RNA, 17 nt, Homo sapiens
gaucacgccacugcacu

SEQ ID NO: 1064904 - RNA, 20 nt, Homo sapiens
gaucacgccauugcacucca

SEQ ID NO: 1064905 - RNA, 16 nt, Homo sapiens
gaucacuggcaaugaa

SEQ ID NO: 1064906 - RNA, 19 nt, Homo sapiens
gaucacuuccuauaugcac

SEQ ID NO: 1064907 - RNA, 17 nt, Homo sapiens
gaucagauugcauguga

SEQ ID NO: 1064908 - RNA, 19 nt, Homo sapiens
gaucagccugggcaaugug

SEQ ID NO: 1064909 - RNA, 18 nt, Homo sapiens
gaucauagguauuucaaa

SEQ ID NO: 1064910 - RNA, 19 nt, Homo sapiens
gaucauagguauuucaaaa

SEQ ID NO: 1064911 - RNA, 21 nt, Homo sapiens
gaucauauuucacaauccugu

SEQ ID NO: 1064912 - RNA, 14 nt, Homo sapiens
gaucaucaagguga

SEQ ID NO: 1064913 - RNA, 22 nt, Homo sapiens
gaucauuaaagccugaguuugc

SEQ ID NO: 1064914 - RNA, 13 nt, Homo sapiens
gaucauugcaaac

SEQ ID NO: 1064915 - RNA, 21 nt, Homo sapiens
gaucauuuguuggaaugaauu

SEQ ID NO: 1064916 - RNA, 18 nt, Homo sapiens
gauccaaguuuacucaac

SEQ ID NO: 1064917 - RNA, 23 nt, Homo sapiens
gauccaaguuuacucaacccucu

SEQ ID NO: 1064918 - RNA, 21 nt, Homo sapiens
gauccaauggaauacugaaaa

SEQ ID NO: 1064919 - RNA, 21 nt, Homo sapiens
gauccaccugucucagccucc

SEQ ID NO: 1064920 - RNA, 15 nt, Homo sapiens
gauccaguugcacua

SEQ ID NO: 1064921 - RNA, 20 nt, Homo sapiens
gaucccaucucuccauauac

SEQ ID NO: 1064922 - RNA, 15 nt, Homo sapiens
gaucccguguugcca

SEQ ID NO: 1064923 - RNA, 12 nt, Homo sapiens
gauccucacccg

SEQ ID NO: 1064924 - RNA, 19 nt, Homo sapiens
gauccucacccgaaucucc

SEQ ID NO: 1064925 - RNA, 12 nt, Homo sapiens
gauccuccaggu

SEQ ID NO: 1064926 - RNA, 14 nt, Homo sapiens
gauccuccaggugc

SEQ ID NO: 1064927 - RNA, 18 nt, Homo sapiens
gauccuuccucccaccuc

SEQ ID NO: 1064928 - RNA, 18 nt, Homo sapiens
gaucgccaaccuuucccc

SEQ ID NO: 1064929 - RNA, 13 nt, Homo sapiens
gaucuaccagcau

SEQ ID NO: 1064930 - RNA, 18 nt, Homo sapiens
gaucuaggaagacuuugg

SEQ ID NO: 1064931 - RNA, 23 nt, Homo sapiens
gaucuagguuuaacucagaucac

SEQ ID NO: 1064932 - RNA, 17 nt, Homo sapiens
gaucuaucaauagucaa

SEQ ID NO: 1064933 - RNA, 20 nt, Homo sapiens
gaucucaauuugcaguauuc

SEQ ID NO: 1064934 - RNA, 21 nt, Homo sapiens
gaucucaauuugcaguauuca

SEQ ID NO: 1064935 - RNA, 17 nt, Homo sapiens
gaucuccauauguuaca

SEQ ID NO: 1064936 - RNA, 15 nt, Homo sapiens
gaucuccccacucua

SEQ ID NO: 1064937 - RNA, 14 nt, Homo sapiens
gaucugaaaucauu

SEQ ID NO: 1064938 - RNA, 18 nt, Homo sapiens
gaucugcaguuuuugccu

SEQ ID NO: 1064939 - RNA, 15 nt, Homo sapiens
gaucugguuugacuc

SEQ ID NO: 1064940 - RNA, 20 nt, Homo sapiens
gaucuguguuuuauugacau

SEQ ID NO: 1064941 - RNA, 23 nt, Homo sapiens
gaucuuaaauuuugugauaugga

SEQ ID NO: 1064942 - RNA, 14 nt, Homo sapiens
gaucuugguccugu

SEQ ID NO: 1064943 - RNA, 13 nt, Homo sapiens
gaucuuuacuacu

SEQ ID NO: 1064944 - RNA, 17 nt, Homo sapiens
gaucuuucuauuccaaa

SEQ ID NO: 1064945 - RNA, 15 nt, Homo sapiens
gaucuuucuuuccuu

SEQ ID NO: 1064946 - RNA, 14 nt, Homo sapiens
gaucuuuggacaga

SEQ ID NO: 1064947 - RNA, 15 nt, Homo sapiens
gaugacguccucuca

SEQ ID NO: 1064948 - RNA, 16 nt, Homo sapiens
gaugacguccucucaa

SEQ ID NO: 1064949 - RNA, 16 nt, Homo sapiens
gaugauacacuaugaa

SEQ ID NO: 1064950 - RNA, 13 nt, Homo sapiens
gaugaucuacuca

SEQ ID NO: 1064951 - RNA, 15 nt, Homo sapiens
gaugaugacguccuc

SEQ ID NO: 1064952 - RNA, 15 nt, Homo sapiens
gaugcaaugugcuac

SEQ ID NO: 1064953 - RNA, 14 nt, Homo sapiens
gaugcccacuuccc

SEQ ID NO: 1064954 - RNA, 14 nt, Homo sapiens
gaugcuaaaccuua

SEQ ID NO: 1064955 - RNA, 16 nt, Homo sapiens
gaugcugccugaguca

SEQ ID NO: 1064956 - RNA, 14 nt, Homo sapiens
gaugcuguuugaca

SEQ ID NO: 1064957 - RNA, 18 nt, Homo sapiens
gauggaaguugcagugag

SEQ ID NO: 1064958 - RNA, 21 nt, Homo sapiens
gauggaauaaagcccuugaac

SEQ ID NO: 1064959 - RNA, 17 nt, Homo sapiens
gauggaauaacucugug

SEQ ID NO: 1064960 - RNA, 22 nt, Homo sapiens
gauggaauauuccccuaucucu

SEQ ID NO: 1064961 - RNA, 21 nt, Homo sapiens
gauggacccaaugcacacaaa

SEQ ID NO: 1064962 - RNA, 16 nt, Homo sapiens
gauggagcgcaccugc

SEQ ID NO: 1064963 - RNA, 13 nt, Homo sapiens
gauggcaaaaaca

SEQ ID NO: 1064964 - RNA, 21 nt, Homo sapiens
gauggcaggaugggcacugcc

SEQ ID NO: 1064965 - RNA, 19 nt, Homo sapiens
gauggcuuuaccuuuauua

SEQ ID NO: 1064966 - RNA, 20 nt, Homo sapiens
gauggugguaaacauucucu

SEQ ID NO: 1064967 - RNA, 20 nt, Homo sapiens
gaugguuucaauaaaccuaa

SEQ ID NO: 1064968 - RNA, 19 nt, Homo sapiens
gaugucuucguacaguucu

SEQ ID NO: 1064969 - RNA, 21 nt, Homo sapiens
gaugugaauugccugcagaga

SEQ ID NO: 1064970 - RNA, 23 nt, Homo sapiens
gauguggcugaaccgagcuggag

SEQ ID NO: 1064971 - RNA, 15 nt, Homo sapiens
gauguucugggacac

SEQ ID NO: 1064972 - RNA, 20 nt, Homo sapiens
gauguuugaggcuuucagaa

SEQ ID NO: 1064973 - RNA, 20 nt, Homo sapiens
gauguuuuacgucugggaga

SEQ ID NO: 1064974 - RNA, 18 nt, Homo sapiens
gauuacaggugugaacca

SEQ ID NO: 1064975 - RNA, 20 nt, Homo sapiens
gauuagcucuggaccagccu

SEQ ID NO: 1064976 - RNA, 22 nt, Homo sapiens
gauuauuagccagguaauguga

SEQ ID NO: 1064977 - RNA, 14 nt, Homo sapiens
gauucaaaucuaug

SEQ ID NO: 1064978 - RNA, 17 nt, Homo sapiens
gauucaauucaacacuc

SEQ ID NO: 1064979 - RNA, 21 nt, Homo sapiens
gauucacaaugaaaugcucuc

SEQ ID NO: 1064980 - RNA, 14 nt, Homo sapiens
gauucacaguguga

SEQ ID NO: 1064981 - RNA, 21 nt, Homo sapiens
gauucacccccaaacagugac

SEQ ID NO: 1064982 - RNA, 15 nt, Homo sapiens
gauucaggggucuga

SEQ ID NO: 1064983 - RNA, 14 nt, Homo sapiens
gauucaguguuaaa

SEQ ID NO: 1064984 - RNA, 23 nt, Homo sapiens
gauucauuauuuuuccacuuugu

SEQ ID NO: 1064985 - RNA, 13 nt, Homo sapiens
gauuccacuuuua

SEQ ID NO: 1064986 - RNA, 18 nt, Homo sapiens
gauuccaggcgaugugca

SEQ ID NO: 1064987 - RNA, 15 nt, Homo sapiens
gauucccaccaaggu

SEQ ID NO: 1064988 - RNA, 23 nt, Homo sapiens
gauuccgcaccaauaaagccuuc

SEQ ID NO: 1064989 - RNA, 15 nt, Homo sapiens
gauucuaccacacag

SEQ ID NO: 1064990 - RNA, 20 nt, Homo sapiens
gauucuucucuuaauuucau

SEQ ID NO: 1064991 - RNA, 18 nt, Homo sapiens
gauucuuuccauuaugau

SEQ ID NO: 1064992 - RNA, 20 nt, Homo sapiens
gauugcaugugacucugaag

SEQ ID NO: 1064993 - RNA, 19 nt, Homo sapiens
gauugcgccauugcacucc

SEQ ID NO: 1064994 - RNA, 20 nt, Homo sapiens
gauugcgccauugcacucca

SEQ ID NO: 1064995 - RNA, 16 nt, Homo sapiens
gauugcuuaucaguag

SEQ ID NO: 1064996 - RNA, 14 nt, Homo sapiens
gauuggcucaccca

SEQ ID NO: 1064997 - RNA, 20 nt, Homo sapiens
gauugugccccugcacucca

SEQ ID NO: 1064998 - RNA, 15 nt, Homo sapiens
gauuguuguuugcca

SEQ ID NO: 1064999 - RNA, 20 nt, Homo sapiens
gauuuaauccuagagauuug

SEQ ID NO: 1065000 - RNA, 14 nt, Homo sapiens
gauuuacacuggga

SEQ ID NO: 1065001 - RNA, 17 nt, Homo sapiens
gauuuauucugccaaac

SEQ ID NO: 1065002 - RNA, 22 nt, Homo sapiens
gauuucaggauacucugucaga

SEQ ID NO: 1065003 - RNA, 12 nt, Homo sapiens
gauuucauucaa

SEQ ID NO: 1065004 - RNA, 20 nt, Homo sapiens
gauuuggggcagagggacag

SEQ ID NO: 1065005 - RNA, 16 nt, Homo sapiens
gauuuuaucugugaau

SEQ ID NO: 1065006 - RNA, 14 nt, Homo sapiens
gauuuuaugcugcu

SEQ ID NO: 1065007 - RNA, 17 nt, Homo sapiens
gauuuugcaaucugugu

SEQ ID NO: 1065008 - RNA, 19 nt, Homo sapiens
gauuuuguauucagggguu

SEQ ID NO: 1065009 - RNA, 13 nt, Homo sapiens
gcaaaaaguauug

SEQ ID NO: 1065010 - RNA, 13 nt, Homo sapiens
gcaaaaccaaaua

SEQ ID NO: 1065011 - RNA, 17 nt, Homo sapiens
gcaaaauccuggugaug

SEQ ID NO: 1065012 - RNA, 21 nt, Homo sapiens
gcaaaauuauguuugccacuu

SEQ ID NO: 1065013 - RNA, 17 nt, Homo sapiens
gcaaaauugggcuguga

SEQ ID NO: 1065014 - RNA, 13 nt, Homo sapiens
gcaaacaggcagu

SEQ ID NO: 1065015 - RNA, 17 nt, Homo sapiens
gcaaacuucagacugaa

SEQ ID NO: 1065016 - RNA, 14 nt, Homo sapiens
gcaaagacaggagg

SEQ ID NO: 1065017 - RNA, 12 nt, Homo sapiens
gcaaagagccag

SEQ ID NO: 1065018 - RNA, 14 nt, Homo sapiens
gcaaagagccagca

SEQ ID NO: 1065019 - RNA, 23 nt, Homo sapiens
gcaaaggcugggaccacgugaga

SEQ ID NO: 1065020 - RNA, 15 nt, Homo sapiens
gcaaagggagcagaa

SEQ ID NO: 1065021 - RNA, 20 nt, Homo sapiens
gcaaaggggggaagggacau

SEQ ID NO: 1065022 - RNA, 18 nt, Homo sapiens
gcaaauauuuauaagcua

SEQ ID NO: 1065023 - RNA, 15 nt, Homo sapiens
gcaaauccuauguga

SEQ ID NO: 1065024 - RNA, 14 nt, Homo sapiens
gcaaaugcuguauu

SEQ ID NO: 1065025 - RNA, 18 nt, Homo sapiens
gcaaauuuggggguuucu

SEQ ID NO: 1065026 - RNA, 17 nt, Homo sapiens
gcaacaauuuaugaauu

SEQ ID NO: 1065027 - RNA, 19 nt, Homo sapiens
gcaacagccacuacauuac

SEQ ID NO: 1065028 - RNA, 22 nt, Homo sapiens
gcaacagccacuacauuacuuc

SEQ ID NO: 1065029 - RNA, 22 nt, Homo sapiens
gcaacaguacuucaaacagaac

SEQ ID NO: 1065030 - RNA, 23 nt, Homo sapiens
gcaacaucaguuuaaacaaaggg

SEQ ID NO: 1065031 - RNA, 11 nt, Homo sapiens
gcaacccaaau

SEQ ID NO: 1065032 - RNA, 21 nt, Homo sapiens
gcaacccacguguaacuguca

SEQ ID NO: 1065033 - RNA, 22 nt, Homo sapiens
gcaaccuccacauguucaacua

SEQ ID NO: 1065034 - RNA, 22 nt, Homo sapiens
gcaacguagcuucuaccaugaa

SEQ ID NO: 1065035 - RNA, 18 nt, Homo sapiens
gcaacuggcucaaagaca

SEQ ID NO: 1065036 - RNA, 17 nt, Homo sapiens
gcaacuuguucgugggu

SEQ ID NO: 1065037 - RNA, 17 nt, Homo sapiens
gcaagacuguugcucaa

SEQ ID NO: 1065038 - RNA, 18 nt, Homo sapiens
gcaagacuguugcucaaa

SEQ ID NO: 1065039 - RNA, 19 nt, Homo sapiens
gcaagagcccccuugacac

SEQ ID NO: 1065040 - RNA, 23 nt, Homo sapiens
gcaagaugcgcacugcauuccac

SEQ ID NO: 1065041 - RNA, 15 nt, Homo sapiens
gcaagcacaucugca

SEQ ID NO: 1065042 - RNA, 17 nt, Homo sapiens
gcaaggacggccuucaa

SEQ ID NO: 1065043 - RNA, 16 nt, Homo sapiens
gcaaggggaaaaucuc

SEQ ID NO: 1065044 - RNA, 13 nt, Homo sapiens
gcaaggugacauu

SEQ ID NO: 1065045 - RNA, 16 nt, Homo sapiens
gcuccauucaaaguga

SEQ ID NO: 1065046 - RNA, 17 nt, Homo sapiens
gcuccauucaaagugag

SEQ ID NO: 1065047 - RNA, 20 nt, Homo sapiens
gcuccauugguguugacaua

SEQ ID NO: 1065048 - RNA, 12 nt, Homo sapiens
gcucccaugacc

SEQ ID NO: 1065049 - RNA, 17 nt, Homo sapiens
gcucccauuucuacucu

SEQ ID NO: 1065050 - RNA, 21 nt, Homo sapiens
gcucccauuucuacucuccca

SEQ ID NO: 1065051 - RNA, 13 nt, Homo sapiens
gcuccccaagaaa

SEQ ID NO: 1065052 - RNA, 14 nt, Homo sapiens
gcucccggguccug

SEQ ID NO: 1065053 - RNA, 17 nt, Homo sapiens
gcucccucccaucccuu

SEQ ID NO: 1065054 - RNA, 21 nt, Homo sapiens
gcuccgugcuuguuugcucac

SEQ ID NO: 1065055 - RNA, 14 nt, Homo sapiens
gcuccuaucugugu

SEQ ID NO: 1065056 - RNA, 13 nt, Homo sapiens
gcuccucacuucc

SEQ ID NO: 1065057 - RNA, 19 nt, Homo sapiens
gcuccucgagggcagggac

SEQ ID NO: 1065058 - RNA, 15 nt, Homo sapiens
gcuccugugcuacuu

SEQ ID NO: 1065059 - RNA, 22 nt, Homo sapiens
gcuccuucucucuuacauugaa

SEQ ID NO: 1065060 - RNA, 20 nt, Homo sapiens
gcucguugccugccacugag

SEQ ID NO: 1065061 - RNA, 23 nt, Homo sapiens
gcucguuuccccacacaugccua

SEQ ID NO: 1065062 - RNA, 22 nt, Homo sapiens
gcucuaaauagccaacacccau

SEQ ID NO: 1065063 - RNA, 22 nt, Homo sapiens
gcucuaacaaugacauuuauau

SEQ ID NO: 1065064 - RNA, 22 nt, Homo sapiens
gcucuacguggcaaauuaacuu

SEQ ID NO: 1065065 - RNA, 21 nt, Homo sapiens
gcucuagccugggcaacaaca

SEQ ID NO: 1065066 - RNA, 16 nt, Homo sapiens
gcucuauuaagauuuc

SEQ ID NO: 1065067 - RNA, 21 nt, Homo sapiens
gcucuccccaaacuugcuuua

SEQ ID NO: 1065068 - RNA, 13 nt, Homo sapiens
gcucuccuuugag

SEQ ID NO: 1065069 - RNA, 18 nt, Homo sapiens
gcucugaucauccacugu

SEQ ID NO: 1065070 - RNA, 21 nt, Homo sapiens
gcucugcaauuccccucugcu

SEQ ID NO: 1065071 - RNA, 14 nt, Homo sapiens
gcucugcaggcacc

SEQ ID NO: 1065072 - RNA, 19 nt, Homo sapiens
gcucugggagacuuugaag

SEQ ID NO: 1065073 - RNA, 18 nt, Homo sapiens
gcucuggugacaccagcc

SEQ ID NO: 1065074 - RNA, 16 nt, Homo sapiens
gcucugucuucuuugc

SEQ ID NO: 1065075 - RNA, 22 nt, Homo sapiens
gcucuuaggugcuucuucacuu

SEQ ID NO: 1065076 - RNA, 21 nt, Homo sapiens
gcucuucuguggaccacugca

SEQ ID NO: 1065077 - RNA, 12 nt, Homo sapiens
gcucuuguuauu

SEQ ID NO: 1065078 - RNA, 17 nt, Homo sapiens
gcucuuguucuacugag

SEQ ID NO: 1065079 - RNA, 15 nt, Homo sapiens
gcucuuuggggucag

SEQ ID NO: 1065080 - RNA, 20 nt, Homo sapiens
gcugaaaacugcaacuugua

SEQ ID NO: 1065081 - RNA, 14 nt, Homo sapiens
gcugaacauugcau

SEQ ID NO: 1065082 - RNA, 16 nt, Homo sapiens
gcugaacauugcauau

SEQ ID NO: 1065083 - RNA, 14 nt, Homo sapiens
gcugaagauggcau

SEQ ID NO: 1065084 - RNA, 15 nt, Homo sapiens
gcugaccuccacagc

SEQ ID NO: 1065085 - RNA, 16 nt, Homo sapiens
gcugagcaccagggga

SEQ ID NO: 1065086 - RNA, 16 nt, Homo sapiens
gcugagcugaacccau

SEQ ID NO: 1065087 - RNA, 17 nt, Homo sapiens
gcugaggcagaacugcu

SEQ ID NO: 1065088 - RNA, 19 nt, Homo sapiens
gcugaguagggacucaggg

SEQ ID NO: 1065089 - RNA, 16 nt, Homo sapiens
gcugagugcaccacuu

SEQ ID NO: 1065090 - RNA, 12 nt, Homo sapiens
gcugaguggacu

SEQ ID NO: 1065091 - RNA, 13 nt, Homo sapiens
gcugauguccuca

SEQ ID NO: 1065092 - RNA, 21 nt, Homo sapiens
gcugcacaucacaacauuuac

SEQ ID NO: 1065093 - RNA, 16 nt, Homo sapiens
gcugcacccacccagg

SEQ ID NO: 1065094 - RNA, 19 nt, Homo sapiens
gcugcaggucaacagcuau

SEQ ID NO: 1065095 - RNA, 18 nt, Homo sapiens
gcugccagcucuguauca

SEQ ID NO: 1065096 - RNA, 16 nt, Homo sapiens
gcugccucuaccugac

SEQ ID NO: 1065097 - RNA, 19 nt, Homo sapiens
gcugccucuaccugacacu

SEQ ID NO: 1065098 - RNA, 21 nt, Homo sapiens
gcugccuuuggaaguccagag

SEQ ID NO: 1065099 - RNA, 13 nt, Homo sapiens
gcugcuagcacuu

SEQ ID NO: 1065100 - RNA, 13 nt, Homo sapiens
gcugcuccagugc

SEQ ID NO: 1065101 - RNA, 17 nt, Homo sapiens
gcugcuuauaguuugcu

SEQ ID NO: 1065102 - RNA, 19 nt, Homo sapiens
gcugcuuccugucugagua

SEQ ID NO: 1065103 - RNA, 21 nt, Homo sapiens
gcuggaacagauucacacugu

SEQ ID NO: 1065104 - RNA, 12 nt, Homo sapiens
gcuggaagcaca

SEQ ID NO: 1065105 - RNA, 13 nt, Homo sapiens
gcuggaaucugaa

SEQ ID NO: 1065106 - RNA, 21 nt, Homo sapiens
gcuggacuacccacguucuca

SEQ ID NO: 1065107 - RNA, 21 nt, Homo sapiens
gcuggagguugagcucuucuu

SEQ ID NO: 1065108 - RNA, 19 nt, Homo sapiens
gcuggagugcaaugcacga

SEQ ID NO: 1065109 - RNA, 15 nt, Homo sapiens
gcuggagugcaguga

SEQ ID NO: 1065110 - RNA, 20 nt, Homo sapiens
gcuggagugcaguggcacga

SEQ ID NO: 1065111 - RNA, 22 nt, Homo sapiens
gcuggauuacaggcaugugcca

SEQ ID NO: 1065112 - RNA, 19 nt, Homo sapiens
gcuggcaccgccuucucua

SEQ ID NO: 1065113 - RNA, 14 nt, Homo sapiens
gcuggcaccucuca

SEQ ID NO: 1065114 - RNA, 15 nt, Homo sapiens
gcuggcccagccaaa

SEQ ID NO: 1065115 - RNA, 15 nt, Homo sapiens
gcuggcccgugacag

SEQ ID NO: 1065116 - RNA, 18 nt, Homo sapiens
gcuggccuccuaugccuc

SEQ ID NO: 1065117 - RNA, 21 nt, Homo sapiens
gcuggcgucaugcaaagucau

SEQ ID NO: 1065118 - RNA, 13 nt, Homo sapiens
gcuggcugcagug

SEQ ID NO: 1065119 - RNA, 19 nt, Homo sapiens
gcugggaauaagugccagg

SEQ ID NO: 1065120 - RNA, 15 nt, Homo sapiens
gcugggacuggccag

SEQ ID NO: 1065121 - RNA, 15 nt, Homo sapiens
gcugggcuucagugg

SEQ ID NO: 1065122 - RNA, 19 nt, Homo sapiens
gcuggucucugcugaaggu

SEQ ID NO: 1065123 - RNA, 22 nt, Homo sapiens
gcuggucuuggugaacacacau

SEQ ID NO: 1065124 - RNA, 16 nt, Homo sapiens
gcuggugccccacuga

SEQ ID NO: 1065125 - RNA, 19 nt, Homo sapiens
gcugugaggccccuggaca

SEQ ID NO: 1065126 - RNA, 15 nt, Homo sapiens
gcugugcgcuccccc

SEQ ID NO: 1065127 - RNA, 15 nt, Homo sapiens
gcuguggccagggug

SEQ ID NO: 1065128 - RNA, 19 nt, Homo sapiens
gcuguggguuuuggugugg

SEQ ID NO: 1065129 - RNA, 16 nt, Homo sapiens
gcuguuauucuuccac

SEQ ID NO: 1065130 - RNA, 23 nt, Homo sapiens
gcuguucacagccagacuggcac

SEQ ID NO: 1065131 - RNA, 20 nt, Homo sapiens
gcuguugcaugggcuaauga

SEQ ID NO: 1065132 - RNA, 22 nt, Homo sapiens
gcuguugcgcucccaccucagc

SEQ ID NO: 1065133 - RNA, 19 nt, Homo sapiens
gcuguuggccucugcaaag

SEQ ID NO: 1065134 - RNA, 15 nt, Homo sapiens
gcuguuuucuucuau

SEQ ID NO: 1065135 - RNA, 18 nt, Homo sapiens
gcuuacauuuuuacaaua

SEQ ID NO: 1065136 - RNA, 21 nt, Homo sapiens
gcuuauacacuuacacuuuau

SEQ ID NO: 1065137 - RNA, 12 nt, Homo sapiens
gcuuauauucau

SEQ ID NO: 1065138 - RNA, 12 nt, Homo sapiens
gcuuaugauuca

SEQ ID NO: 1065139 - RNA, 15 nt, Homo sapiens
gcuucaaaccccagg

SEQ ID NO: 1065140 - RNA, 20 nt, Homo sapiens
gcuucauaaaugaagcagcu

SEQ ID NO: 1065141 - RNA, 19 nt, Homo sapiens
gcuucaucccacaaucuua

SEQ ID NO: 1065142 - RNA, 11 nt, Homo sapiens
gcuuccaugau

SEQ ID NO: 1065143 - RNA, 23 nt, Homo sapiens
gcuucccggcgucccuaccuccu

SEQ ID NO: 1065144 - RNA, 15 nt, Homo sapiens
gcuucccugacucau

SEQ ID NO: 1065145 - RNA, 15 nt, Homo sapiens
gcuuccgacaccucu

SEQ ID NO: 1065146 - RNA, 14 nt, Homo sapiens
gcuuccuaacugcu

SEQ ID NO: 1065147 - RNA, 18 nt, Homo sapiens
gcuucgcaaaauguuuca

SEQ ID NO: 1065148 - RNA, 15 nt, Homo sapiens
gcuucuauuagccag

SEQ ID NO: 1065149 - RNA, 20 nt, Homo sapiens
gcuucuccaauucugcccaa

SEQ ID NO: 1065150 - RNA, 15 nt, Homo sapiens
gcuucuccaugagac

SEQ ID NO: 1065151 - RNA, 15 nt, Homo sapiens
gcuucuccauggcca

SEQ ID NO: 1065152 - RNA, 18 nt, Homo sapiens
gcuucugcuuaaucugag

SEQ ID NO: 1065153 - RNA, 18 nt, Homo sapiens
gcuucuuaaucuuuucac

SEQ ID NO: 1065154 - RNA, 22 nt, Homo sapiens
gcuucuuaaucuuuucacaaau

SEQ ID NO: 1065155 - RNA, 22 nt, Homo sapiens
gcuugauauuuuccaaauggau

SEQ ID NO: 1065156 - RNA, 22 nt, Homo sapiens
gcuugaucaauucccuugaaua

SEQ ID NO: 1065157 - RNA, 14 nt, Homo sapiens
gcuugcaugccaaa

SEQ ID NO: 1065158 - RNA, 17 nt, Homo sapiens
gcuuggaaaggaccagu

SEQ ID NO: 1065159 - RNA, 22 nt, Homo sapiens
gcuuggacugaagggguucuca

SEQ ID NO: 1065160 - RNA, 19 nt, Homo sapiens
gcuuggguggagaagccau

SEQ ID NO: 1065161 - RNA, 20 nt, Homo sapiens
gcuuggguggagaagccauu

SEQ ID NO: 1065162 - RNA, 22 nt, Homo sapiens
gcuuguccccuccucacucccu

SEQ ID NO: 1065163 - RNA, 14 nt, Homo sapiens
gcuuguguuuuuaa

SEQ ID NO: 1065164 - RNA, 20 nt, Homo sapiens
gcuuguuuacagcacuacuc

SEQ ID NO: 1065165 - RNA, 19 nt, Homo sapiens
gcuuuacccucaggugcua

SEQ ID NO: 1065166 - RNA, 15 nt, Homo sapiens
gcuuuacuuugccca

SEQ ID NO: 1065167 - RNA, 14 nt, Homo sapiens
gcuuuagcacagga

SEQ ID NO: 1065168 - RNA, 21 nt, Homo sapiens
gcuuuauuuuuuaaguauuua

SEQ ID NO: 1065169 - RNA, 13 nt, Homo sapiens
gcuuucacuuccu

SEQ ID NO: 1065170 - RNA, 13 nt, Homo sapiens
gcuuucaguauua

SEQ ID NO: 1065171 - RNA, 13 nt, Homo sapiens
gcuuucagucuuc

SEQ ID NO: 1065172 - RNA, 21 nt, Homo sapiens
gcuuucauguaaacugugcac

SEQ ID NO: 1065173 - RNA, 19 nt, Homo sapiens
gcuuucccggacugcaagc

SEQ ID NO: 1065174 - RNA, 15 nt, Homo sapiens
gcuuucuccauugua

SEQ ID NO: 1065175 - RNA, 19 nt, Homo sapiens
gcuuugaaugcggcccaac

SEQ ID NO: 1065176 - RNA, 13 nt, Homo sapiens
gcuuugacucacc

SEQ ID NO: 1065177 - RNA, 19 nt, Homo sapiens
gcuuugccccugagacaaa

SEQ ID NO: 1065178 - RNA, 12 nt, Homo sapiens
gcuuugugauuc

SEQ ID NO: 1065179 - RNA, 13 nt, Homo sapiens
gcuuuugaugaaa

SEQ ID NO: 1065180 - RNA, 13 nt, Homo sapiens
ggaaaacacugcc

SEQ ID NO: 1065181 - RNA, 22 nt, Homo sapiens
ggaaaacgguggaggccagggc

SEQ ID NO: 1065182 - RNA, 21 nt, Homo sapiens
ggaaaagagcgcaucaggccu

SEQ ID NO: 1065183 - RNA, 22 nt, Homo sapiens
ggaaaaguguaauagcauacau

SEQ ID NO: 1065184 - RNA, 13 nt, Homo sapiens
ggaaaaucucagc

SEQ ID NO: 1065185 - RNA, 15 nt, Homo sapiens
ggaaaaugugcaaua

SEQ ID NO: 1065186 - RNA, 14 nt, Homo sapiens
ggaaacaacagcuu

SEQ ID NO: 1065187 - RNA, 15 nt, Homo sapiens
ggaaaccacagcugc

SEQ ID NO: 1065188 - RNA, 14 nt, Homo sapiens
ggaaacccuuagga

SEQ ID NO: 1065189 - RNA, 17 nt, Homo sapiens
ggaaacuggaugagguc

SEQ ID NO: 1065190 - RNA, 20 nt, Homo sapiens
gucagaggauggccaguguc

SEQ ID NO: 1065191 - RNA, 13 nt, Homo sapiens
gucagaguagaag

SEQ ID NO: 1065192 - RNA, 20 nt, Homo sapiens
gucagauuugaacucuucaa

SEQ ID NO: 1065193 - RNA, 18 nt, Homo sapiens
gucagcaucagcucaggg

SEQ ID NO: 1065194 - RNA, 23 nt, Homo sapiens
gucaggaacagaaggaugaauga

SEQ ID NO: 1065195 - RNA, 16 nt, Homo sapiens
gucagguaguugcaau

SEQ ID NO: 1065196 - RNA, 16 nt, Homo sapiens
gucagucaugauggca

SEQ ID NO: 1065197 - RNA, 22 nt, Homo sapiens
gucagucugaugagaacucuga

SEQ ID NO: 1065198 - RNA, 19 nt, Homo sapiens
gucagugcccaacuguuau

SEQ ID NO: 1065199 - RNA, 10 nt, Homo sapiens
gucauagaaa

SEQ ID NO: 1065200 - RNA, 15 nt, Homo sapiens
gucauccugccaacu

SEQ ID NO: 1065201 - RNA, 16 nt, Homo sapiens
gucaucuguaccucug

SEQ ID NO: 1065202 - RNA, 23 nt, Homo sapiens
gucaugauggcaccacugcacuc

SEQ ID NO: 1065203 - RNA, 15 nt, Homo sapiens
gucauggcaccaaag

SEQ ID NO: 1065204 - RNA, 24 nt, Homo sapiens
gucauggcaccaaagccaccagac

SEQ ID NO: 1065205 - RNA, 22 nt, Homo sapiens
gucauguaugugaaacaaugug

SEQ ID NO: 1065206 - RNA, 14 nt, Homo sapiens
gucaugucagcucc

SEQ ID NO: 1065207 - RNA, 16 nt, Homo sapiens
gucauguuccuucaag

SEQ ID NO: 1065208 - RNA, 19 nt, Homo sapiens
gucauuauccuugcuauga

SEQ ID NO: 1065209 - RNA, 22 nt, Homo sapiens
gucauuuuuauaaaacuuugaa

SEQ ID NO: 1065210 - RNA, 21 nt, Homo sapiens
guccacggucuguucuugaag

SEQ ID NO: 1065211 - RNA, 14 nt, Homo sapiens
guccaguauucuac

SEQ ID NO: 1065212 - RNA, 15 nt, Homo sapiens
guccaguugcagcug

SEQ ID NO: 1065213 - RNA, 19 nt, Homo sapiens
guccauggaaugcuugaaa

SEQ ID NO: 1065214 - RNA, 19 nt, Homo sapiens
guccauguaauauucccau

SEQ ID NO: 1065215 - RNA, 19 nt, Homo sapiens
guccaugugguucuucaaa

SEQ ID NO: 1065216 - RNA, 19 nt, Homo sapiens
guccaugugugugcaagug

SEQ ID NO: 1065217 - RNA, 12 nt, Homo sapiens
guccauugaaag

SEQ ID NO: 1065218 - RNA, 19 nt, Homo sapiens
guccauuuugcccuuccau

SEQ ID NO: 1065219 - RNA, 23 nt, Homo sapiens
gucccagaaugccuccugcaggg

SEQ ID NO: 1065220 - RNA, 13 nt, Homo sapiens
gucccaugaccca

SEQ ID NO: 1065221 - RNA, 13 nt, Homo sapiens
guccccaccaauc

SEQ ID NO: 1065222 - RNA, 19 nt, Homo sapiens
gucccccugcuugucuuca

SEQ ID NO: 1065223 - RNA, 13 nt, Homo sapiens
gucccccuuccau

SEQ ID NO: 1065224 - RNA, 16 nt, Homo sapiens
guccccuccacuguca

SEQ ID NO: 1065225 - RNA, 17 nt, Homo sapiens
guccccucuugacccau

SEQ ID NO: 1065226 - RNA, 16 nt, Homo sapiens
guccccugacccagag

SEQ ID NO: 1065227 - RNA, 20 nt, Homo sapiens
gucccggggcuccacugaac

SEQ ID NO: 1065228 - RNA, 11 nt, Homo sapiens
gucccuaccuc

SEQ ID NO: 1065229 - RNA, 17 nt, Homo sapiens
gucccuauggaagcaua

SEQ ID NO: 1065230 - RNA, 21 nt, Homo sapiens
gucccucaaaugacccaaaga

SEQ ID NO: 1065231 - RNA, 13 nt, Homo sapiens
gucccucucaggc

SEQ ID NO: 1065232 - RNA, 22 nt, Homo sapiens
gucccuguuagcauaaugugag

SEQ ID NO: 1065233 - RNA, 18 nt, Homo sapiens
guccuaaggacacacuaa

SEQ ID NO: 1065234 - RNA, 17 nt, Homo sapiens
guccucacaucuuucac

SEQ ID NO: 1065235 - RNA, 17 nt, Homo sapiens
guccucacucccagucc

SEQ ID NO: 1065236 - RNA, 19 nt, Homo sapiens
guccuccacgccauuuccu

SEQ ID NO: 1065237 - RNA, 21 nt, Homo sapiens
guccucccaucucacacauga

SEQ ID NO: 1065238 - RNA, 14 nt, Homo sapiens
guccucgagcaacu

SEQ ID NO: 1065239 - RNA, 13 nt, Homo sapiens
guccucuugccuc

SEQ ID NO: 1065240 - RNA, 16 nt, Homo sapiens
guccugaccugucuca

SEQ ID NO: 1065241 - RNA, 20 nt, Homo sapiens
guccuguguuuuuucugcca

SEQ ID NO: 1065242 - RNA, 13 nt, Homo sapiens
guccuguuugcag

SEQ ID NO: 1065243 - RNA, 22 nt, Homo sapiens
guccuucaaguuagcucaggag

SEQ ID NO: 1065244 - RNA, 14 nt, Homo sapiens
guccuucaccucac

SEQ ID NO: 1065245 - RNA, 14 nt, Homo sapiens
guccuugaugcuca

SEQ ID NO: 1065246 - RNA, 11 nt, Homo sapiens
guccuuuaugu

SEQ ID NO: 1065247 - RNA, 14 nt, Homo sapiens
gucgcacagucucu

SEQ ID NO: 1065248 - RNA, 14 nt, Homo sapiens
gucgcaucucagug

SEQ ID NO: 1065249 - RNA, 15 nt, Homo sapiens
gucgcccuacucacc

SEQ ID NO: 1065250 - RNA, 19 nt, Homo sapiens
gucgucagcuggcacuguc

SEQ ID NO: 1065251 - RNA, 22 nt, Homo sapiens
gucuaaauaaaugaaguauuuc

SEQ ID NO: 1065252 - RNA, 15 nt, Homo sapiens
gucuaagagugaagu

SEQ ID NO: 1065253 - RNA, 18 nt, Homo sapiens
gucuacucuuaagccauc

SEQ ID NO: 1065254 - RNA, 17 nt, Homo sapiens
gucuagguacuucaggg

SEQ ID NO: 1065255 - RNA, 21 nt, Homo sapiens
gucucaaaccaagcaaaggaa

SEQ ID NO: 1065256 - RNA, 15 nt, Homo sapiens
gucucaguccaugaa

SEQ ID NO: 1065257 - RNA, 17 nt, Homo sapiens
gucucaguggcuucauc

SEQ ID NO: 1065258 - RNA, 15 nt, Homo sapiens
gucucaguuucacuu

SEQ ID NO: 1065259 - RNA, 18 nt, Homo sapiens
gucuccaacggcaaggga

SEQ ID NO: 1065260 - RNA, 17 nt, Homo sapiens
gucuccucugcagcuca

SEQ ID NO: 1065261 - RNA, 22 nt, Homo sapiens
gucuccucuuaaaaaauaaaaa

SEQ ID NO: 1065262 - RNA, 23 nt, Homo sapiens
gucuccuuugcacugagggccac

SEQ ID NO: 1065263 - RNA, 15 nt, Homo sapiens
gucucgaacuccugg

SEQ ID NO: 1065264 - RNA, 17 nt, Homo sapiens
gucucgcuuuguugccc

SEQ ID NO: 1065265 - RNA, 21 nt, Homo sapiens
gucucuauaauagaauucugu

SEQ ID NO: 1065266 - RNA, 21 nt, Homo sapiens
gucucugaagugaaacugcuu

SEQ ID NO: 1065267 - RNA, 15 nt, Homo sapiens
gucugauuggcucac

SEQ ID NO: 1065268 - RNA, 21 nt, Homo sapiens
gucugauuggcucacccaagc

SEQ ID NO: 1065269 - RNA, 18 nt, Homo sapiens
gucugccagccagcagcc

SEQ ID NO: 1065270 - RNA, 14 nt, Homo sapiens
gucugcccuuguca

SEQ ID NO: 1065271 - RNA, 20 nt, Homo sapiens
gucugggagaaauugacaga

SEQ ID NO: 1065272 - RNA, 16 nt, Homo sapiens
gucugggccacucagg

SEQ ID NO: 1065273 - RNA, 12 nt, Homo sapiens
gucugucuucaa

SEQ ID NO: 1065274 - RNA, 15 nt, Homo sapiens
gucuguggcuuucag

SEQ ID NO: 1065275 - RNA, 16 nt, Homo sapiens
gucugugugcaagugu

SEQ ID NO: 1065276 - RNA, 20 nt, Homo sapiens
gucuguguucgacucagccu

SEQ ID NO: 1065277 - RNA, 16 nt, Homo sapiens
gucuguuacacuggag

SEQ ID NO: 1065278 - RNA, 17 nt, Homo sapiens
gucuuaaucaugagaua

SEQ ID NO: 1065279 - RNA, 15 nt, Homo sapiens
gucuuagauguauau

SEQ ID NO: 1065280 - RNA, 13 nt, Homo sapiens
gucuuagcaagaa

SEQ ID NO: 1065281 - RNA, 13 nt, Homo sapiens
gucuucaacagcu

SEQ ID NO: 1065282 - RNA, 17 nt, Homo sapiens
gucuucagggaagguca

SEQ ID NO: 1065283 - RNA, 12 nt, Homo sapiens
gucuucauuaag

SEQ ID NO: 1065284 - RNA, 18 nt, Homo sapiens
gucuucauuucauuguau

SEQ ID NO: 1065285 - RNA, 19 nt, Homo sapiens
gucuucccugaucaaguca

SEQ ID NO: 1065286 - RNA, 16 nt, Homo sapiens
gucuucguauucccau

SEQ ID NO: 1065287 - RNA, 13 nt, Homo sapiens
gucuucuucaggg

SEQ ID NO: 1065288 - RNA, 16 nt, Homo sapiens
gucuucuuuugauaua

SEQ ID NO: 1065289 - RNA, 17 nt, Homo sapiens
gucuugcaauggcagcc

SEQ ID NO: 1065290 - RNA, 12 nt, Homo sapiens
gucuuggcuuuu

SEQ ID NO: 1065291 - RNA, 15 nt, Homo sapiens
gucuugugaaggcag

SEQ ID NO: 1065292 - RNA, 17 nt, Homo sapiens
gucuuguugauuuccuc

SEQ ID NO: 1065293 - RNA, 20 nt, Homo sapiens
gucuuucacagcuccuccca

SEQ ID NO: 1065294 - RNA, 12 nt, Homo sapiens
gucuuucacuga

SEQ ID NO: 1065295 - RNA, 23 nt, Homo sapiens
gucuuucugacaucagcagagaa

SEQ ID NO: 1065296 - RNA, 17 nt, Homo sapiens
gucuuucuuacaaggaa

SEQ ID NO: 1065297 - RNA, 19 nt, Homo sapiens
gucuuugcauggagacuug

SEQ ID NO: 1065298 - RNA, 17 nt, Homo sapiens
gucuuugcuguaaacuu

SEQ ID NO: 1065299 - RNA, 16 nt, Homo sapiens
gucuuuguucugugau

SEQ ID NO: 1065300 - RNA, 16 nt, Homo sapiens
gugaaacccugucucu

SEQ ID NO: 1065301 - RNA, 13 nt, Homo sapiens
gugaaacuaacag

SEQ ID NO: 1065302 - RNA, 23 nt, Homo sapiens
gugaaacucauaauagacuuccc

SEQ ID NO: 1065303 - RNA, 13 nt, Homo sapiens
gugaaacuggcac

SEQ ID NO: 1065304 - RNA, 20 nt, Homo sapiens
gugaaauaaaaguagaauaa

SEQ ID NO: 1065305 - RNA, 14 nt, Homo sapiens
gugaaauaagccag

SEQ ID NO: 1065306 - RNA, 19 nt, Homo sapiens
gugaaaugcuggcauuugc

SEQ ID NO: 1065307 - RNA, 18 nt, Homo sapiens
gugaaauguauagcugcu

SEQ ID NO: 1065308 - RNA, 13 nt, Homo sapiens
gugaaccaaagag

SEQ ID NO: 1065309 - RNA, 23 nt, Homo sapiens
gugaaccaccacacccagcccac

SEQ ID NO: 1065310 - RNA, 14 nt, Homo sapiens
gugaaccccaaagu

SEQ ID NO: 1065311 - RNA, 17 nt, Homo sapiens
gugaaccuuaguaccua

SEQ ID NO: 1065312 - RNA, 15 nt, Homo sapiens
gugaacugugagggu

SEQ ID NO: 1065313 - RNA, 19 nt, Homo sapiens
gugacaacacuuguguuau

SEQ ID NO: 1065314 - RNA, 23 nt, Homo sapiens
gugacaaccgaguggcugucauc

SEQ ID NO: 1065315 - RNA, 13 nt, Homo sapiens
gugacacauugua

SEQ ID NO: 1065316 - RNA, 20 nt, Homo sapiens
gugacagacuccugaggaca

SEQ ID NO: 1065317 - RNA, 18 nt, Homo sapiens
gugacagcucugccuguu

SEQ ID NO: 1065318 - RNA, 19 nt, Homo sapiens
gugacauuuccaugcauaa

SEQ ID NO: 1065319 - RNA, 11 nt, Homo sapiens
gugaccagcac

SEQ ID NO: 1065320 - RNA, 14 nt, Homo sapiens
gugaccuccacagc

SEQ ID NO: 1065321 - RNA, 22 nt, Homo sapiens
gugaccugccaggcacacugag

SEQ ID NO: 1065322 - RNA, 20 nt, Homo sapiens
gugacuugcccaguuucagg

SEQ ID NO: 1065323 - RNA, 20 nt, Homo sapiens
gugagaacuacucagggaau

SEQ ID NO: 1065324 - RNA, 20 nt, Homo sapiens
gugagaacucugcccaggug

SEQ ID NO: 1065325 - RNA, 20 nt, Homo sapiens
gugagaaucaaaacucuccu

SEQ ID NO: 1065326 - RNA, 17 nt, Homo sapiens
gugagacagcucugcau

SEQ ID NO: 1065327 - RNA, 14 nt, Homo sapiens
gugagaugcagcug

SEQ ID NO: 1065328 - RNA, 16 nt, Homo sapiens
gugagcaaagggcuca

SEQ ID NO: 1065329 - RNA, 18 nt, Homo sapiens
gugaggaugucacucaga

SEQ ID NO: 1065330 - RNA, 17 nt, Homo sapiens
gugaggugcccagcuag

SEQ ID NO: 1065331 - RNA, 18 nt, Homo sapiens
gugaguaagagcuggugu

SEQ ID NO: 1065332 - RNA, 14 nt, Homo sapiens
gugagugugugcaa

SEQ ID NO: 1065333 - RNA, 21 nt, Homo sapiens
gugaguuacagcgagaggcag

SEQ ID NO: 1065334 - RNA, 13 nt, Homo sapiens
gugaguucucagg

SEQ ID NO: 1065335 - RNA, 13 nt, Homo sapiens
uccuaaucaucca

SEQ ID NO: 1065336 - RNA, 14 nt, Homo sapiens
uccuacaagcuaaa

SEQ ID NO: 1065337 - RNA, 17 nt, Homo sapiens
uccuacagauagucaaa

SEQ ID NO: 1065338 - RNA, 15 nt, Homo sapiens
uccuacauuaauuau

SEQ ID NO: 1065339 - RNA, 13 nt, Homo sapiens
uccuagcauuugu

SEQ ID NO: 1065340 - RNA, 19 nt, Homo sapiens
uccuagccuuauccucuga

SEQ ID NO: 1065341 - RNA, 19 nt, Homo sapiens
uccuaggccacaccaucuc

SEQ ID NO: 1065342 - RNA, 20 nt, Homo sapiens
uccuaggccacaccaucucc

SEQ ID NO: 1065343 - RNA, 17 nt, Homo sapiens
uccuagggccacugaag

SEQ ID NO: 1065344 - RNA, 18 nt, Homo sapiens
uccuagucuacuugaggc

SEQ ID NO: 1065345 - RNA, 14 nt, Homo sapiens
uccuagugaaagag

SEQ ID NO: 1065346 - RNA, 15 nt, Homo sapiens
uccuauaugcacuua

SEQ ID NO: 1065347 - RNA, 19 nt, Homo sapiens
uccuauggcagagcauuca

SEQ ID NO: 1065348 - RNA, 16 nt, Homo sapiens
uccuauugucauuaaa

SEQ ID NO: 1065349 - RNA, 22 nt, Homo sapiens
uccuauuuauaagagugccgua

SEQ ID NO: 1065350 - RNA, 21 nt, Homo sapiens
uccucacaccacaaaucugaa

SEQ ID NO: 1065351 - RNA, 13 nt, Homo sapiens
uccucacuuccau

SEQ ID NO: 1065352 - RNA, 22 nt, Homo sapiens
uccucagagaauuucuaccauu

SEQ ID NO: 1065353 - RNA, 14 nt, Homo sapiens
uccucaguccacug

SEQ ID NO: 1065354 - RNA, 18 nt, Homo sapiens
uccucaguccacugcuga

SEQ ID NO: 1065355 - RNA, 21 nt, Homo sapiens
uccucauauggcccaguguca

SEQ ID NO: 1065356 - RNA, 20 nt, Homo sapiens
uccucaucagucuccauacc

SEQ ID NO: 1065357 - RNA, 22 nt, Homo sapiens
uccucaucugggggaguggaau

SEQ ID NO: 1065358 - RNA, 23 nt, Homo sapiens
uccucaucugggggaguggaaua

SEQ ID NO: 1065359 - RNA, 21 nt, Homo sapiens
uccucauuagcauuuugcuaa

SEQ ID NO: 1065360 - RNA, 14 nt, Homo sapiens
uccuccaugggaga

SEQ ID NO: 1065361 - RNA, 19 nt, Homo sapiens
uccucguauguguguuuac

SEQ ID NO: 1065362 - RNA, 18 nt, Homo sapiens
uccucuaugaacuaugga

SEQ ID NO: 1065363 - RNA, 20 nt, Homo sapiens
uccucucaaccaccuuucag

SEQ ID NO: 1065364 - RNA, 23 nt, Homo sapiens
uccucucaaccaccuuucagaua

SEQ ID NO: 1065365 - RNA, 14 nt, Homo sapiens
uccucugaacaaaa

SEQ ID NO: 1065366 - RNA, 11 nt, Homo sapiens
uccucugacau

SEQ ID NO: 1065367 - RNA, 12 nt, Homo sapiens
uccucugaucuc

SEQ ID NO: 1065368 - RNA, 23 nt, Homo sapiens
uccucugccucccauucugacca

SEQ ID NO: 1065369 - RNA, 19 nt, Homo sapiens
uccucuggauggcaccaga

SEQ ID NO: 1065370 - RNA, 22 nt, Homo sapiens
uccucuggguaggaaucagcaa

SEQ ID NO: 1065371 - RNA, 16 nt, Homo sapiens
uccucugugaccaaug

SEQ ID NO: 1065372 - RNA, 21 nt, Homo sapiens
uccugaaauuugagagacaaa

SEQ ID NO: 1065373 - RNA, 18 nt, Homo sapiens
uccugaccucaaguaauc

SEQ ID NO: 1065374 - RNA, 23 nt, Homo sapiens
uccugaccucaaguaauccaccu

SEQ ID NO: 1065375 - RNA, 19 nt, Homo sapiens
uccugaccucgugauccac

SEQ ID NO: 1065376 - RNA, 15 nt, Homo sapiens
uccugcaccgagaga

SEQ ID NO: 1065377 - RNA, 18 nt, Homo sapiens
uccugccaggauuaaaag

SEQ ID NO: 1065378 - RNA, 15 nt, Homo sapiens
uccugccuucugucc

SEQ ID NO: 1065379 - RNA, 16 nt, Homo sapiens
uccugccuucuguccu

SEQ ID NO: 1065380 - RNA, 17 nt, Homo sapiens
uccugcugccauccuca

SEQ ID NO: 1065381 - RNA, 15 nt, Homo sapiens
uccugcuucugauau

SEQ ID NO: 1065382 - RNA, 19 nt, Homo sapiens
uccuggccaacauggugaa

SEQ ID NO: 1065383 - RNA, 10 nt, Homo sapiens
uccugggcug

SEQ ID NO: 1065384 - RNA, 22 nt, Homo sapiens
uccuggucugaacucccgccac

SEQ ID NO: 1065385 - RNA, 23 nt, Homo sapiens
uccugguuaaauuugaauuucag

SEQ ID NO: 1065386 - RNA, 22 nt, Homo sapiens
uccuguaaaagauacugaggaa

SEQ ID NO: 1065387 - RNA, 22 nt, Homo sapiens
uccuguaagucaaaugugugcu

SEQ ID NO: 1065388 - RNA, 22 nt, Homo sapiens
uccuguauucuacagcagauac

SEQ ID NO: 1065389 - RNA, 16 nt, Homo sapiens
uccugucccucaucca

SEQ ID NO: 1065390 - RNA, 19 nt, Homo sapiens
uccugucccucauccauag

SEQ ID NO: 1065391 - RNA, 15 nt, Homo sapiens
uccuguccuuuacac

SEQ ID NO: 1065392 - RNA, 13 nt, Homo sapiens
uccugucugccag

SEQ ID NO: 1065393 - RNA, 17 nt, Homo sapiens
uccugugcuuucccuga

SEQ ID NO: 1065394 - RNA, 20 nt, Homo sapiens
uccuguggucucugaccagg

SEQ ID NO: 1065395 - RNA, 12 nt, Homo sapiens
uccuguguacag

SEQ ID NO: 1065396 - RNA, 19 nt, Homo sapiens
uccuguuagcauaauguga

SEQ ID NO: 1065397 - RNA, 11 nt, Homo sapiens
uccuguucucu

SEQ ID NO: 1065398 - RNA, 21 nt, Homo sapiens
uccuguugagaugggggacug

SEQ ID NO: 1065399 - RNA, 23 nt, Homo sapiens
uccuguugccuuuauauccaaaa

SEQ ID NO: 1065400 - RNA, 21 nt, Homo sapiens
uccuguuuuucacauuuuccu

SEQ ID NO: 1065401 - RNA, 18 nt, Homo sapiens
uccuguuuuuugaugcuu

SEQ ID NO: 1065402 - RNA, 18 nt, Homo sapiens
uccuuaaagguagucaag

SEQ ID NO: 1065403 - RNA, 21 nt, Homo sapiens
uccuuaacacugagcugucau

SEQ ID NO: 1065404 - RNA, 20 nt, Homo sapiens
uccuuacuaagcauagcaaa

SEQ ID NO: 1065405 - RNA, 18 nt, Homo sapiens
uccuuauuguuaaaaaca

SEQ ID NO: 1065406 - RNA, 18 nt, Homo sapiens
uccuucaagccuagcccu

SEQ ID NO: 1065407 - RNA, 13 nt, Homo sapiens
uccuucagccuga

SEQ ID NO: 1065408 - RNA, 18 nt, Homo sapiens
uccuucaugaucaucaca

SEQ ID NO: 1065409 - RNA, 14 nt, Homo sapiens
uccuuccucccacc

SEQ ID NO: 1065410 - RNA, 18 nt, Homo sapiens
uccuuccugucuuccugc

SEQ ID NO: 1065411 - RNA, 14 nt, Homo sapiens
uccuuccuuaucac

SEQ ID NO: 1065412 - RNA, 16 nt, Homo sapiens
uccuugaauguucucu

SEQ ID NO: 1065413 - RNA, 19 nt, Homo sapiens
uccuugauacuaaaaguuc

SEQ ID NO: 1065414 - RNA, 17 nt, Homo sapiens
uccuugauacugcucau

SEQ ID NO: 1065415 - RNA, 17 nt, Homo sapiens
uccuugcuacccagaaa

SEQ ID NO: 1065416 - RNA, 20 nt, Homo sapiens
uccuuggagggacaugacua

SEQ ID NO: 1065417 - RNA, 22 nt, Homo sapiens
uccuugggaggccccacugggg

SEQ ID NO: 1065418 - RNA, 17 nt, Homo sapiens
uccuuguaaagacugua

SEQ ID NO: 1065419 - RNA, 15 nt, Homo sapiens
uccuugugaacccca

SEQ ID NO: 1065420 - RNA, 17 nt, Homo sapiens
uccuuuccccucccuca

SEQ ID NO: 1065421 - RNA, 21 nt, Homo sapiens
uccuuuccccucccucaggcc

SEQ ID NO: 1065422 - RNA, 16 nt, Homo sapiens
uccuuugaacuuugaa

SEQ ID NO: 1065423 - RNA, 15 nt, Homo sapiens
ucgaacaauucauau

SEQ ID NO: 1065424 - RNA, 15 nt, Homo sapiens
ucgaaguugaugcaa

SEQ ID NO: 1065425 - RNA, 18 nt, Homo sapiens
ucgacugugaccuguggg

SEQ ID NO: 1065426 - RNA, 16 nt, Homo sapiens
ucgagaccaucuuggc

SEQ ID NO: 1065427 - RNA, 15 nt, Homo sapiens
ucgagcaacugcugu

SEQ ID NO: 1065428 - RNA, 23 nt, Homo sapiens
ucgaguaacuuuaaaaaaaucau

SEQ ID NO: 1065429 - RNA, 21 nt, Homo sapiens
ucgauccccugucacgugugg

SEQ ID NO: 1065430 - RNA, 19 nt, Homo sapiens
ucgauuauucccuguacaa

SEQ ID NO: 1065431 - RNA, 12 nt, Homo sapiens
ucgcaccuacca

SEQ ID NO: 1065432 - RNA, 14 nt, Homo sapiens
ucgcaccuuuccaa

SEQ ID NO: 1065433 - RNA, 15 nt, Homo sapiens
ucgcgccacugcacu

SEQ ID NO: 1065434 - RNA, 21 nt, Homo sapiens
ucgcggcucuccagggcuccc

SEQ ID NO: 1065435 - RNA, 22 nt, Homo sapiens
ucgcuccugugucuugcaaugg

SEQ ID NO: 1065436 - RNA, 14 nt, Homo sapiens
ucgcuucagccaca

SEQ ID NO: 1065437 - RNA, 16 nt, Homo sapiens
ucggaguugggggucc

SEQ ID NO: 1065438 - RNA, 19 nt, Homo sapiens
ucggccagagucuguuuca

SEQ ID NO: 1065439 - RNA, 14 nt, Homo sapiens
ucgggaacaguguu

SEQ ID NO: 1065440 - RNA, 23 nt, Homo sapiens
ucgggaagagaggaguucaauga

SEQ ID NO: 1065441 - RNA, 15 nt, Homo sapiens
ucgggacuaacccag

SEQ ID NO: 1065442 - RNA, 15 nt, Homo sapiens
ucgggucccagaugu

SEQ ID NO: 1065443 - RNA, 13 nt, Homo sapiens
ucguacaguucuu

SEQ ID NO: 1065444 - RNA, 14 nt, Homo sapiens
ucguauacccugga

SEQ ID NO: 1065445 - RNA, 13 nt, Homo sapiens
ucgugacaacaug

SEQ ID NO: 1065446 - RNA, 13 nt, Homo sapiens
ucguggccuuccc

SEQ ID NO: 1065447 - RNA, 23 nt, Homo sapiens
ucgugggagagagacguguacau

SEQ ID NO: 1065448 - RNA, 20 nt, Homo sapiens
ucguggguguguguagccaa

SEQ ID NO: 1065449 - RNA, 19 nt, Homo sapiens
ucgugguaggacuguagaa

SEQ ID NO: 1065450 - RNA, 19 nt, Homo sapiens
ucguuugaaucacaguaua

SEQ ID NO: 1065451 - RNA, 17 nt, Homo sapiens
ucuaaaacugccuucca

SEQ ID NO: 1065452 - RNA, 14 nt, Homo sapiens
ucuaaaauagccac

SEQ ID NO: 1065453 - RNA, 15 nt, Homo sapiens
ucuaaaaucugcuag

SEQ ID NO: 1065454 - RNA, 16 nt, Homo sapiens
ucuaaacuuuaauuca

SEQ ID NO: 1065455 - RNA, 20 nt, Homo sapiens
ucuaaagguggugaggcaau

SEQ ID NO: 1065456 - RNA, 19 nt, Homo sapiens
ucuaaaugaagugcaaauu

SEQ ID NO: 1065457 - RNA, 21 nt, Homo sapiens
ucuaaauguggagaaacugua

SEQ ID NO: 1065458 - RNA, 12 nt, Homo sapiens
ucuaacucuccc

SEQ ID NO: 1065459 - RNA, 21 nt, Homo sapiens
ucuaacugauagaacguuacu

SEQ ID NO: 1065460 - RNA, 12 nt, Homo sapiens
ucuaacugcugu

SEQ ID NO: 1065461 - RNA, 20 nt, Homo sapiens
ucuaagagaacaaugugcua

SEQ ID NO: 1065462 - RNA, 20 nt, Homo sapiens
ucuaagguaguaacuuucca

SEQ ID NO: 1065463 - RNA, 16 nt, Homo sapiens
ucuaaguaaaaccaca

SEQ ID NO: 1065464 - RNA, 15 nt, Homo sapiens
ucuaaguuccacuga

SEQ ID NO: 1065465 - RNA, 12 nt, Homo sapiens
ucuaaugucuuc

SEQ ID NO: 1065466 - RNA, 14 nt, Homo sapiens
ucuaaugugcauua

SEQ ID NO: 1065467 - RNA, 15 nt, Homo sapiens
ucuaaugugcauuaa

SEQ ID NO: 1065468 - RNA, 16 nt, Homo sapiens
ucuaaugugcauuaaa

SEQ ID NO: 1065469 - RNA, 21 nt, Homo sapiens
ucuacaaacucccacuuguca

SEQ ID NO: 1065470 - RNA, 17 nt, Homo sapiens
ucuacaauuugccauug

SEQ ID NO: 1065471 - RNA, 23 nt, Homo sapiens
ucuacauagucagcuacuucuga

SEQ ID NO: 1065472 - RNA, 18 nt, Homo sapiens
ucuaccaugaacagaaaa

SEQ ID NO: 1065473 - RNA, 17 nt, Homo sapiens
ucuaccccugcuaagga

SEQ ID NO: 1065474 - RNA, 20 nt, Homo sapiens
ucuaccucaggcagcucaag

SEQ ID NO: 1065475 - RNA, 16 nt, Homo sapiens
ucuaccugccacucac

SEQ ID NO: 1065476 - RNA, 15 nt, Homo sapiens
ucuacuaacaaucag

SEQ ID NO: 1065477 - RNA, 21 nt, Homo sapiens
ucuacuaacaaucagcuccuu

SEQ ID NO: 1065478 - RNA, 16 nt, Homo sapiens
ucuacucuuaagccau

SEQ ID NO: 1065479 - RNA, 21 nt, Homo sapiens
ugaaaacauauaaagcacuau

SEQ ID NO: 1065480 - RNA, 21 nt, Homo sapiens
ugaaaacaucuggaaggggau

SEQ ID NO: 1065481 - RNA, 16 nt, Homo sapiens
ugaaaaccucuccuca

SEQ ID NO: 1065482 - RNA, 21 nt, Homo sapiens
ugaaaacuuagagagguacaa

SEQ ID NO: 1065483 - RNA, 16 nt, Homo sapiens
ugaaaagacuccaaag

SEQ ID NO: 1065484 - RNA, 22 nt, Homo sapiens
ugaaaagagaggauauguucac

SEQ ID NO: 1065485 - RNA, 23 nt, Homo sapiens
ugaaaaggguguuagcuaaagga

SEQ ID NO: 1065486 - RNA, 18 nt, Homo sapiens
ugaaaauaauuguuccaa

SEQ ID NO: 1065487 - RNA, 22 nt, Homo sapiens
ugaaaauuauuugaaaacauau

SEQ ID NO: 1065488 - RNA, 15 nt, Homo sapiens
ugaaacauguucuca

SEQ ID NO: 1065489 - RNA, 16 nt, Homo sapiens
ugaaacauguucucaa

SEQ ID NO: 1065490 - RNA, 13 nt, Homo sapiens
ugaaacauuugca

SEQ ID NO: 1065491 - RNA, 13 nt, Homo sapiens
ugaaaccaggugg

SEQ ID NO: 1065492 - RNA, 15 nt, Homo sapiens
ugaaacccugucucu

SEQ ID NO: 1065493 - RNA, 23 nt, Homo sapiens
ugaaacugagaugugaacacauc

SEQ ID NO: 1065494 - RNA, 18 nt, Homo sapiens
ugaaacuggcacugaauu

SEQ ID NO: 1065495 - RNA, 23 nt, Homo sapiens
ugaaacuuaggaaggauccucuu

SEQ ID NO: 1065496 - RNA, 19 nt, Homo sapiens
ugaaagcagggacuugaac

SEQ ID NO: 1065497 - RNA, 18 nt, Homo sapiens
ugaaauaacauggccuug

SEQ ID NO: 1065498 - RNA, 18 nt, Homo sapiens
ugaaauaagaaagugcga

SEQ ID NO: 1065499 - RNA, 13 nt, Homo sapiens
ugaaauaccagug

SEQ ID NO: 1065500 - RNA, 21 nt, Homo sapiens
ugaaauaccagugaaccaaag

SEQ ID NO: 1065501 - RNA, 17 nt, Homo sapiens
ugaaauauacacacagc

SEQ ID NO: 1065502 - RNA, 21 nt, Homo sapiens
ugaaauauacacacagcagua

SEQ ID NO: 1065503 - RNA, 14 nt, Homo sapiens
ugaaauaugcaucu

SEQ ID NO: 1065504 - RNA, 15 nt, Homo sapiens
ugaaaugaaaacaug

SEQ ID NO: 1065505 - RNA, 24 nt, Homo sapiens
ugaaaugccagaaugacuucugac

SEQ ID NO: 1065506 - RNA, 15 nt, Homo sapiens
ugaaaugcuggcauu

SEQ ID NO: 1065507 - RNA, 16 nt, Homo sapiens
ugaaauuagggcccaa

SEQ ID NO: 1065508 - RNA, 16 nt, Homo sapiens
ugaaauuuuaauugaa

SEQ ID NO: 1065509 - RNA, 12 nt, Homo sapiens
ugaacacugggg

SEQ ID NO: 1065510 - RNA, 11 nt, Homo sapiens
ugaacagccaa

SEQ ID NO: 1065511 - RNA, 14 nt, Homo sapiens
ugaacauaaagccu

SEQ ID NO: 1065512 - RNA, 21 nt, Homo sapiens
ugaacaucuuuaggagacuaa

SEQ ID NO: 1065513 - RNA, 11 nt, Homo sapiens
ugaacauucca

SEQ ID NO: 1065514 - RNA, 12 nt, Homo sapiens
ugaacauuccag

SEQ ID NO: 1065515 - RNA, 22 nt, Homo sapiens
ugaacauuuaucaaucaguaua

SEQ ID NO: 1065516 - RNA, 13 nt, Homo sapiens
ugaaccaaagaga

SEQ ID NO: 1065517 - RNA, 13 nt, Homo sapiens
ugaaccacaucuu

SEQ ID NO: 1065518 - RNA, 16 nt, Homo sapiens
ugaaccuuccaucucg

SEQ ID NO: 1065519 - RNA, 14 nt, Homo sapiens
ugaaccuuguuuaa

SEQ ID NO: 1065520 - RNA, 16 nt, Homo sapiens
ugaacuagccaaucag

SEQ ID NO: 1065521 - RNA, 20 nt, Homo sapiens
ugaacucagccaagcacagu

SEQ ID NO: 1065522 - RNA, 15 nt, Homo sapiens
ugaacucuguaaaac

SEQ ID NO: 1065523 - RNA, 18 nt, Homo sapiens
ugaacugaaguuucacau

SEQ ID NO: 1065524 - RNA, 21 nt, Homo sapiens
ugaacuuuuuaagaugaggca

SEQ ID NO: 1065525 - RNA, 12 nt, Homo sapiens
ugaagaacugac

SEQ ID NO: 1065526 - RNA, 21 nt, Homo sapiens
ugaagaacuuggcacacucuc

SEQ ID NO: 1065527 - RNA, 15 nt, Homo sapiens
ugaagaaucuguuuc

SEQ ID NO: 1065528 - RNA, 14 nt, Homo sapiens
ugaagacaaugacu

SEQ ID NO: 1065529 - RNA, 19 nt, Homo sapiens
ugaagaguccucugaauga

SEQ ID NO: 1065530 - RNA, 19 nt, Homo sapiens
ugaagagugagagggcaug

SEQ ID NO: 1065531 - RNA, 15 nt, Homo sapiens
ugaagcaaacacauu

SEQ ID NO: 1065532 - RNA, 19 nt, Homo sapiens
ugaagcaggagaaucacuu

SEQ ID NO: 1065533 - RNA, 15 nt, Homo sapiens
ugaagccaaagccaa

SEQ ID NO: 1065534 - RNA, 13 nt, Homo sapiens
ugaagccacagca

SEQ ID NO: 1065535 - RNA, 13 nt, Homo sapiens
ugaagccacugaa

SEQ ID NO: 1065536 - RNA, 22 nt, Homo sapiens
ugaagcccuccaaaagcacuua

SEQ ID NO: 1065537 - RNA, 22 nt, Homo sapiens
ugaagcugccugcuuuucacug

SEQ ID NO: 1065538 - RNA, 16 nt, Homo sapiens
ugaaggaacauuccuu

SEQ ID NO: 1065539 - RNA, 18 nt, Homo sapiens
ugaaggaacauuccuuag

SEQ ID NO: 1065540 - RNA, 17 nt, Homo sapiens
ugaaggaggugagggau

SEQ ID NO: 1065541 - RNA, 19 nt, Homo sapiens
ugaaggaguccuugcauca

SEQ ID NO: 1065542 - RNA, 16 nt, Homo sapiens
ugaaggaucuugccug

SEQ ID NO: 1065543 - RNA, 21 nt, Homo sapiens
ugaaggcaaugccauccucaa

SEQ ID NO: 1065544 - RNA, 16 nt, Homo sapiens
ugaaggguaaagaagu

SEQ ID NO: 1065545 - RNA, 23 nt, Homo sapiens
ugaaguaaugaauuuuuaugaua

SEQ ID NO: 1065546 - RNA, 14 nt, Homo sapiens
ugaaguacauauua

SEQ ID NO: 1065547 - RNA, 16 nt, Homo sapiens
ugaaguagugugcagu

SEQ ID NO: 1065548 - RNA, 16 nt, Homo sapiens
ugaagucacacaguga

SEQ ID NO: 1065549 - RNA, 23 nt, Homo sapiens
ugaagucaugcguuuaaucacau

SEQ ID NO: 1065550 - RNA, 20 nt, Homo sapiens
ugaaguuaagaaccugaaua

SEQ ID NO: 1065551 - RNA, 19 nt, Homo sapiens
ugaauaaaguugaagcuaa

SEQ ID NO: 1065552 - RNA, 20 nt, Homo sapiens
ugaauaaauuugcccaaaau

SEQ ID NO: 1065553 - RNA, 22 nt, Homo sapiens
ugaauaacauuugugugguggg

SEQ ID NO: 1065554 - RNA, 13 nt, Homo sapiens
ugaauaaccacuu

SEQ ID NO: 1065555 - RNA, 16 nt, Homo sapiens
ugaauaaccacuuaaa

SEQ ID NO: 1065556 - RNA, 16 nt, Homo sapiens
ugaauacaaagugaug

SEQ ID NO: 1065557 - RNA, 17 nt, Homo sapiens
ugaauauaaacacuaua

SEQ ID NO: 1065558 - RNA, 22 nt, Homo sapiens
ugaauauaaauuuguguucuca

SEQ ID NO: 1065559 - RNA, 15 nt, Homo sapiens
ugaauaucaguuauu

SEQ ID NO: 1065560 - RNA, 20 nt, Homo sapiens
ugaauaugaacggugagcau

SEQ ID NO: 1065561 - RNA, 20 nt, Homo sapiens
ugaauauuuauauuucacua

SEQ ID NO: 1065562 - RNA, 14 nt, Homo sapiens
ugaaucacaguaua

SEQ ID NO: 1065563 - RNA, 22 nt, Homo sapiens
ugaaucacaguauacgcuccau

SEQ ID NO: 1065564 - RNA, 23 nt, Homo sapiens
ugaaucccucuaucucuaaagaa

SEQ ID NO: 1065565 - RNA, 17 nt, Homo sapiens
ugaaucuaaaagcuuuu

SEQ ID NO: 1065566 - RNA, 11 nt, Homo sapiens
ugaaucuacaa

SEQ ID NO: 1065567 - RNA, 15 nt, Homo sapiens
ugaaucucuaaucaa

SEQ ID NO: 1065568 - RNA, 12 nt, Homo sapiens
ugaaucuucaca

SEQ ID NO: 1065569 - RNA, 23 nt, Homo sapiens
ugaaucuuuuucagaaacaguga

SEQ ID NO: 1065570 - RNA, 21 nt, Homo sapiens
ugaaugaccuuguugcaugau

SEQ ID NO: 1065571 - RNA, 21 nt, Homo sapiens
ugaauggacucaaacugccuu

SEQ ID NO: 1065572 - RNA, 15 nt, Homo sapiens
ugaauggccugccuu

SEQ ID NO: 1065573 - RNA, 14 nt, Homo sapiens
ugaauguaguaagu

SEQ ID NO: 1065574 - RNA, 15 nt, Homo sapiens
ugaauuaaucaucua

SEQ ID NO: 1065575 - RNA, 15 nt, Homo sapiens
ugaauuagacuugua

SEQ ID NO: 1065576 - RNA, 16 nt, Homo sapiens
ugaauuagacuuguau

SEQ ID NO: 1065577 - RNA, 13 nt, Homo sapiens
ugaauuagcucac

SEQ ID NO: 1065578 - RNA, 14 nt, Homo sapiens
ugaauucaccaagu

SEQ ID NO: 1065579 - RNA, 17 nt, Homo sapiens
ugaauucugggaaucca

SEQ ID NO: 1065580 - RNA, 18 nt, Homo sapiens
ugaauucugucauuucaa

SEQ ID NO: 1065581 - RNA, 15 nt, Homo sapiens
ugaauucuuaugcuu

SEQ ID NO: 1065582 - RNA, 14 nt, Homo sapiens
ugaauugaggacua

SEQ ID NO: 1065583 - RNA, 17 nt, Homo sapiens
ugaauuggaccauccua

SEQ ID NO: 1065584 - RNA, 17 nt, Homo sapiens
ugaauuuucaaguaauu

SEQ ID NO: 1065585 - RNA, 14 nt, Homo sapiens
ugaauuuuguugcu

SEQ ID NO: 1065586 - RNA, 12 nt, Homo sapiens
ugacaaccucuu

SEQ ID NO: 1065587 - RNA, 14 nt, Homo sapiens
ugacaagcacugcu

SEQ ID NO: 1065588 - RNA, 14 nt, Homo sapiens
ugacaaucaacucu

SEQ ID NO: 1065589 - RNA, 12 nt, Homo sapiens
ugacacagcagc

SEQ ID NO: 1065590 - RNA, 13 nt, Homo sapiens
ugacacauaugca

SEQ ID NO: 1065591 - RNA, 16 nt, Homo sapiens
ugacacauaugcaccu

SEQ ID NO: 1065592 - RNA, 12 nt, Homo sapiens
ugacagaacaag

SEQ ID NO: 1065593 - RNA, 14 nt, Homo sapiens
ugacagaacacugu

SEQ ID NO: 1065594 - RNA, 18 nt, Homo sapiens
ugacagaacgagacucca

SEQ ID NO: 1065595 - RNA, 22 nt, Homo sapiens
ugacagaacgagacuccaccuc

SEQ ID NO: 1065596 - RNA, 16 nt, Homo sapiens
ugacagacacaggccc

SEQ ID NO: 1065597 - RNA, 12 nt, Homo sapiens
ugacagaucucu

SEQ ID NO: 1065598 - RNA, 18 nt, Homo sapiens
ugacaggcagccuggaca

SEQ ID NO: 1065599 - RNA, 20 nt, Homo sapiens
ugacaguaaaucucacaaau

SEQ ID NO: 1065600 - RNA, 11 nt, Homo sapiens
ugacauaaaaa

SEQ ID NO: 1065601 - RNA, 16 nt, Homo sapiens
ugacauacauccaaca

SEQ ID NO: 1065602 - RNA, 18 nt, Homo sapiens
ugacaucaccacaguuua

SEQ ID NO: 1065603 - RNA, 14 nt, Homo sapiens
ugacaucacuugua

SEQ ID NO: 1065604 - RNA, 18 nt, Homo sapiens
ugacaucagcaauacaga

SEQ ID NO: 1065605 - RNA, 17 nt, Homo sapiens
ugacauccccacucacg

SEQ ID NO: 1065606 - RNA, 19 nt, Homo sapiens
ugacaucucuuugauguca

SEQ ID NO: 1065607 - RNA, 15 nt, Homo sapiens
ugacaugcacucagc

SEQ ID NO: 1065608 - RNA, 17 nt, Homo sapiens
ugacauuauaugcacua

SEQ ID NO: 1065609 - RNA, 17 nt, Homo sapiens
ugacauucacacagaga

SEQ ID NO: 1065610 - RNA, 21 nt, Homo sapiens
ugacauugcuuuacugucaaa

SEQ ID NO: 1065611 - RNA, 22 nt, Homo sapiens
ugacauuuauuuuucucaugaa

SEQ ID NO: 1065612 - RNA, 22 nt, Homo sapiens
ugacauuuugccaaaauuauua

SEQ ID NO: 1065613 - RNA, 16 nt, Homo sapiens
ugaccagcaacuuguc

SEQ ID NO: 1065614 - RNA, 16 nt, Homo sapiens
ugaccauuucaggggu

SEQ ID NO: 1065615 - RNA, 13 nt, Homo sapiens
ugacccacaagaa

SEQ ID NO: 1065616 - RNA, 18 nt, Homo sapiens
ugacccaccccugugcuc

SEQ ID NO: 1065617 - RNA, 23 nt, Homo sapiens
ugaccucacuuuaggcagcugua

SEQ ID NO: 1065618 - RNA, 14 nt, Homo sapiens
ugaccucaggugau

SEQ ID NO: 1065619 - RNA, 16 nt, Homo sapiens
ugaccugccaggcaca

SEQ ID NO: 1065620 - RNA, 21 nt, Homo sapiens
ugaccugucaccgugagcagc

SEQ ID NO: 1065621 - RNA, 14 nt, Homo sapiens
ugaccugugaccag

SEQ ID NO: 1065622 - RNA, 14 nt, Homo sapiens
ugaccuugaucaag

SEQ ID NO: 1065623 - RNA, 22 nt, Homo sapiens
ugaccuuguugcaugauguauu

SEQ ID NO: 1065624 - RNA, 14 nt, Homo sapiens
ugacgacagugcau

SEQ ID NO: 1065625 - RNA, 16 nt, Homo sapiens
ugcccgagcuggugca

SEQ ID NO: 1065626 - RNA, 23 nt, Homo sapiens
ugcccggggcagcugccagagaa

SEQ ID NO: 1065627 - RNA, 13 nt, Homo sapiens
ugcccucauggcc

SEQ ID NO: 1065628 - RNA, 20 nt, Homo sapiens
ugcccuccccagagcacugg

SEQ ID NO: 1065629 - RNA, 21 nt, Homo sapiens
ugcccuccccagagcacuggg

SEQ ID NO: 1065630 - RNA, 19 nt, Homo sapiens
ugcccugauccaaguuuac

SEQ ID NO: 1065631 - RNA, 17 nt, Homo sapiens
ugcccuggauccaucag

SEQ ID NO: 1065632 - RNA, 18 nt, Homo sapiens
ugcccugggauguccaca

SEQ ID NO: 1065633 - RNA, 23 nt, Homo sapiens
ugcccuguuguguauagaugcaa

SEQ ID NO: 1065634 - RNA, 22 nt, Homo sapiens
ugcccuuuguggaaagucacag

SEQ ID NO: 1065635 - RNA, 19 nt, Homo sapiens
ugccggcucuuuccuugcu

SEQ ID NO: 1065636 - RNA, 18 nt, Homo sapiens
ugccgucuaccugagggg

SEQ ID NO: 1065637 - RNA, 14 nt, Homo sapiens
ugccuacuccaaaa

SEQ ID NO: 1065638 - RNA, 13 nt, Homo sapiens
ugccuagggccug

SEQ ID NO: 1065639 - RNA, 17 nt, Homo sapiens
ugccuauagucgcagcu

SEQ ID NO: 1065640 - RNA, 16 nt, Homo sapiens
ugccucacuuccuaca

SEQ ID NO: 1065641 - RNA, 14 nt, Homo sapiens
ugccucagccuccc

SEQ ID NO: 1065642 - RNA, 21 nt, Homo sapiens
ugccucauuaccuugugcuaa

SEQ ID NO: 1065643 - RNA, 15 nt, Homo sapiens
ugccuccaccaccac

SEQ ID NO: 1065644 - RNA, 18 nt, Homo sapiens
ugccuccaccccccagaa

SEQ ID NO: 1065645 - RNA, 17 nt, Homo sapiens
ugccuccagacaugugc

SEQ ID NO: 1065646 - RNA, 22 nt, Homo sapiens
ugccuccauucugaccauuuca

SEQ ID NO: 1065647 - RNA, 18 nt, Homo sapiens
ugccucccuucaugcaug

SEQ ID NO: 1065648 - RNA, 19 nt, Homo sapiens
ugccucccuucaugcaugg

SEQ ID NO: 1065649 - RNA, 17 nt, Homo sapiens
ugccucugccucugaca

SEQ ID NO: 1065650 - RNA, 23 nt, Homo sapiens
ugccucuugaaugcagggacaaa

SEQ ID NO: 1065651 - RNA, 15 nt, Homo sapiens
ugccugagaacacca

SEQ ID NO: 1065652 - RNA, 14 nt, Homo sapiens
ugccuggacacugu

SEQ ID NO: 1065653 - RNA, 16 nt, Homo sapiens
ugccuggacacuguac

SEQ ID NO: 1065654 - RNA, 20 nt, Homo sapiens
ugccuggccaggcagaucug

SEQ ID NO: 1065655 - RNA, 14 nt, Homo sapiens
ugccuggcucagag

SEQ ID NO: 1065656 - RNA, 14 nt, Homo sapiens
ugccuguaaucaca

SEQ ID NO: 1065657 - RNA, 16 nt, Homo sapiens
ugccuguaaucccagc

SEQ ID NO: 1065658 - RNA, 18 nt, Homo sapiens
ugccugugccuuuugcca

SEQ ID NO: 1065659 - RNA, 21 nt, Homo sapiens
ugccugugugggacugagaug

SEQ ID NO: 1065660 - RNA, 15 nt, Homo sapiens
ugccuucaccuccuc

SEQ ID NO: 1065661 - RNA, 23 nt, Homo sapiens
ugccuuccacgcugucuccagac

SEQ ID NO: 1065662 - RNA, 19 nt, Homo sapiens
ugccuucccaggaguacac

SEQ ID NO: 1065663 - RNA, 12 nt, Homo sapiens
ugccuuccucau

SEQ ID NO: 1065664 - RNA, 18 nt, Homo sapiens
ugccuucuccagacaaac

SEQ ID NO: 1065665 - RNA, 21 nt, Homo sapiens
ugccuugugaauuugcugcua

SEQ ID NO: 1065666 - RNA, 18 nt, Homo sapiens
ugccuuuaaaucugugau

SEQ ID NO: 1065667 - RNA, 18 nt, Homo sapiens
ugccuuuugcaaacuuua

SEQ ID NO: 1065668 - RNA, 17 nt, Homo sapiens
ugccuuuugcaccccuc

SEQ ID NO: 1065669 - RNA, 15 nt, Homo sapiens
ugcgaaagacccaca

SEQ ID NO: 1065670 - RNA, 18 nt, Homo sapiens
ugcgaauaagcuuuuaau

SEQ ID NO: 1065671 - RNA, 17 nt, Homo sapiens
ugcgaccgugaccagga

SEQ ID NO: 1065672 - RNA, 17 nt, Homo sapiens
ugcgaucuggguucacu

SEQ ID NO: 1065673 - RNA, 15 nt, Homo sapiens
ugcgccauugcacuc

SEQ ID NO: 1065674 - RNA, 23 nt, Homo sapiens
ugcgccugacauucacacagaga

SEQ ID NO: 1065675 - RNA, 17 nt, Homo sapiens
ugcggcauuaaagccau

SEQ ID NO: 1065676 - RNA, 18 nt, Homo sapiens
ugcggccuuuggcuucac

SEQ ID NO: 1065677 - RNA, 11 nt, Homo sapiens
ugcgucacugu

SEQ ID NO: 1065678 - RNA, 13 nt, Homo sapiens
ugcgucacuguga

SEQ ID NO: 1065679 - RNA, 15 nt, Homo sapiens
ugcgucgaagcuuug

SEQ ID NO: 1065680 - RNA, 14 nt, Homo sapiens
ugcgugcaugugca

SEQ ID NO: 1065681 - RNA, 15 nt, Homo sapiens
ugcgugcaugugcac

SEQ ID NO: 1065682 - RNA, 17 nt, Homo sapiens
ugcgugugcgugcaugu

SEQ ID NO: 1065683 - RNA, 13 nt, Homo sapiens
ugcgugugugcaa

SEQ ID NO: 1065684 - RNA, 15 nt, Homo sapiens
ugcgugugugcaagu

SEQ ID NO: 1065685 - RNA, 23 nt, Homo sapiens
ugcguguuuccugugcaagucag

SEQ ID NO: 1065686 - RNA, 15 nt, Homo sapiens
ugcguucuucauuca

SEQ ID NO: 1065687 - RNA, 16 nt, Homo sapiens
ugcuaaggaguucuca

SEQ ID NO: 1065688 - RNA, 19 nt, Homo sapiens
ugcuaauaacagugcauau

SEQ ID NO: 1065689 - RNA, 20 nt, Homo sapiens
ugcuaaucuucuuaugcaau

SEQ ID NO: 1065690 - RNA, 15 nt, Homo sapiens
ugcuaauucaaagcu

SEQ ID NO: 1065691 - RNA, 19 nt, Homo sapiens
ugcuacccaugacuuuaua

SEQ ID NO: 1065692 - RNA, 16 nt, Homo sapiens
ugcuaccucacugggg

SEQ ID NO: 1065693 - RNA, 17 nt, Homo sapiens
ugcuaccucacuggggu

SEQ ID NO: 1065694 - RNA, 19 nt, Homo sapiens
ugcuacguuccuauuguca

SEQ ID NO: 1065695 - RNA, 17 nt, Homo sapiens
ugcuagaaaggaagaca

SEQ ID NO: 1065696 - RNA, 22 nt, Homo sapiens
ugcuauucccuggggcugcugu

SEQ ID NO: 1065697 - RNA, 20 nt, Homo sapiens
ugcucaggcuugaaaugcau

SEQ ID NO: 1065698 - RNA, 22 nt, Homo sapiens
ugcucagggaauaauccagaaa

SEQ ID NO: 1065699 - RNA, 16 nt, Homo sapiens
ugcucauauugugauu

SEQ ID NO: 1065700 - RNA, 17 nt, Homo sapiens
ugcucauauugugauuc

SEQ ID NO: 1065701 - RNA, 22 nt, Homo sapiens
ugcucauccccaccugucuuca

SEQ ID NO: 1065702 - RNA, 14 nt, Homo sapiens
ugcuccagugcagg

SEQ ID NO: 1065703 - RNA, 19 nt, Homo sapiens
ugcucccugguucugauga

SEQ ID NO: 1065704 - RNA, 16 nt, Homo sapiens
ugcuccuccuacccuu

SEQ ID NO: 1065705 - RNA, 19 nt, Homo sapiens
ugcuccuugggcccuuuga

SEQ ID NO: 1065706 - RNA, 22 nt, Homo sapiens
ugcucgauuauucccuguacaa

SEQ ID NO: 1065707 - RNA, 17 nt, Homo sapiens
ugcucggccgucuucac

SEQ ID NO: 1065708 - RNA, 18 nt, Homo sapiens
ugcucuccaagucucagu

SEQ ID NO: 1065709 - RNA, 20 nt, Homo sapiens
ugcucugaggcuuccagaga

SEQ ID NO: 1065710 - RNA, 21 nt, Homo sapiens
ugcucugucuucuuugcccac

SEQ ID NO: 1065711 - RNA, 18 nt, Homo sapiens
ugcucuuucaucucugcu

SEQ ID NO: 1065712 - RNA, 15 nt, Homo sapiens
ugcugaacauugcau

SEQ ID NO: 1065713 - RNA, 13 nt, Homo sapiens
ugcugaccucugg

SEQ ID NO: 1065714 - RNA, 15 nt, Homo sapiens
ugcugagcauguacu

SEQ ID NO: 1065715 - RNA, 15 nt, Homo sapiens
ugcugaucgugcuaa

SEQ ID NO: 1065716 - RNA, 15 nt, Homo sapiens
ugcugauguccucac

SEQ ID NO: 1065717 - RNA, 21 nt, Homo sapiens
ugcugcagcggccacacugua

SEQ ID NO: 1065718 - RNA, 14 nt, Homo sapiens
ugcugccauccuca

SEQ ID NO: 1065719 - RNA, 14 nt, Homo sapiens
ugcugcucaucuga

SEQ ID NO: 1065720 - RNA, 14 nt, Homo sapiens
ugcugcuguuuaca

SEQ ID NO: 1065721 - RNA, 14 nt, Homo sapiens
ugcugcuucuccau

SEQ ID NO: 1065722 - RNA, 22 nt, Homo sapiens
ugcuggaaguagaauuugucca

SEQ ID NO: 1065723 - RNA, 17 nt, Homo sapiens
ugcuggaucacagcugc

SEQ ID NO: 1065724 - RNA, 22 nt, Homo sapiens
ugcuggcagaaagcaaauguga

SEQ ID NO: 1065725 - RNA, 20 nt, Homo sapiens
ugcuggcaguggaacuaaga

SEQ ID NO: 1065726 - RNA, 14 nt, Homo sapiens
ugcuggcauuugca

SEQ ID NO: 1065727 - RNA, 18 nt, Homo sapiens
ugcuggccuggaucuccc

SEQ ID NO: 1065728 - RNA, 23 nt, Homo sapiens
ugcugggaagacgccugagcuca

SEQ ID NO: 1065729 - RNA, 15 nt, Homo sapiens
ugcugggcuuggcag

SEQ ID NO: 1065730 - RNA, 17 nt, Homo sapiens
ugcuguaaaaacugugg

SEQ ID NO: 1065731 - RNA, 15 nt, Homo sapiens
ugcuguaaacuugua

SEQ ID NO: 1065732 - RNA, 16 nt, Homo sapiens
ugcuguacuugaugac

SEQ ID NO: 1065733 - RNA, 21 nt, Homo sapiens
ugcuguagaagauggcacuua

SEQ ID NO: 1065734 - RNA, 20 nt, Homo sapiens
ugcuguagacauuugcuaug

SEQ ID NO: 1065735 - RNA, 15 nt, Homo sapiens
ugcuguauccaucca

SEQ ID NO: 1065736 - RNA, 14 nt, Homo sapiens
ugcuguaugucucg

SEQ ID NO: 1065737 - RNA, 15 nt, Homo sapiens
ugcuguguaucugau

SEQ ID NO: 1065738 - RNA, 11 nt, Homo sapiens
ugcuguuccac

SEQ ID NO: 1065739 - RNA, 20 nt, Homo sapiens
ugcuguuguugaaauugaug

SEQ ID NO: 1065740 - RNA, 19 nt, Homo sapiens
ugcuuaagguaugguacaa

SEQ ID NO: 1065741 - RNA, 23 nt, Homo sapiens
ugcuuacuaagcuuugccagcug

SEQ ID NO: 1065742 - RNA, 16 nt, Homo sapiens
ugcuuaguaaugcuac

SEQ ID NO: 1065743 - RNA, 16 nt, Homo sapiens
ugcuuaugacaucacu

SEQ ID NO: 1065744 - RNA, 21 nt, Homo sapiens
ugcuucauaaaugaagcagcu

SEQ ID NO: 1065745 - RNA, 18 nt, Homo sapiens
ugcuucccauccuacccu

SEQ ID NO: 1065746 - RNA, 13 nt, Homo sapiens
ugcuucuccauga

SEQ ID NO: 1065747 - RNA, 19 nt, Homo sapiens
ugcuucuuaaaauagccau

SEQ ID NO: 1065748 - RNA, 14 nt, Homo sapiens
ugcuugaacccaag

SEQ ID NO: 1065749 - RNA, 13 nt, Homo sapiens
ugcuugcacuuug

SEQ ID NO: 1065750 - RNA, 14 nt, Homo sapiens
ugcuuggguguaac

SEQ ID NO: 1065751 - RNA, 21 nt, Homo sapiens
ugcuugugucccuccugggau

SEQ ID NO: 1065752 - RNA, 12 nt, Homo sapiens
ugcuuguucccu

SEQ ID NO: 1065753 - RNA, 18 nt, Homo sapiens
ugcuuguuuacagcacua

SEQ ID NO: 1065754 - RNA, 17 nt, Homo sapiens
ugcuuuacuuugcccag

SEQ ID NO: 1065755 - RNA, 16 nt, Homo sapiens
ugcuuuagaaguaaca

SEQ ID NO: 1065756 - RNA, 23 nt, Homo sapiens
ugcuuuccuuuuuuaaaaaugca

SEQ ID NO: 1065757 - RNA, 13 nt, Homo sapiens
ugcuuugacucac

SEQ ID NO: 1065758 - RNA, 13 nt, Homo sapiens
ugcuuugcaggaa

SEQ ID NO: 1065759 - RNA, 22 nt, Homo sapiens
ugcuuugcaggaagugucuaga

SEQ ID NO: 1065760 - RNA, 19 nt, Homo sapiens
ugcuuugcccagcauuuua

SEQ ID NO: 1065761 - RNA, 15 nt, Homo sapiens
ugcuuuuacuucucu

SEQ ID NO: 1065762 - RNA, 16 nt, Homo sapiens
uggaaaaagucacauu

SEQ ID NO: 1065763 - RNA, 19 nt, Homo sapiens
uggaaaacaguauuuucca

SEQ ID NO: 1065764 - RNA, 13 nt, Homo sapiens
uggaaaacuacaa

SEQ ID NO: 1065765 - RNA, 13 nt, Homo sapiens
uggaaaagcaaaa

SEQ ID NO: 1065766 - RNA, 19 nt, Homo sapiens
uggaaaagcaaaacuguag

SEQ ID NO: 1065767 - RNA, 17 nt, Homo sapiens
uggaaaaugugacccag

SEQ ID NO: 1065768 - RNA, 14 nt, Homo sapiens
uggaaaaugugcaa

SEQ ID NO: 1065769 - RNA, 15 nt, Homo sapiens
uggaaaaugugcaau

SEQ ID NO: 1065770 - RNA, 13 nt, Homo sapiens
uguuaaaauaacu

SEQ ID NO: 1065771 - RNA, 20 nt, Homo sapiens
uguuaaauauuuacauauga

SEQ ID NO: 1065772 - RNA, 15 nt, Homo sapiens
uguuaaggaaacucu

SEQ ID NO: 1065773 - RNA, 14 nt, Homo sapiens
uguuaauaucuuga

SEQ ID NO: 1065774 - RNA, 15 nt, Homo sapiens
uguuaauauggugua

SEQ ID NO: 1065775 - RNA, 21 nt, Homo sapiens
uguuaauaugguguacauucu

SEQ ID NO: 1065776 - RNA, 18 nt, Homo sapiens
uguuaauuauuuugacaa

SEQ ID NO: 1065777 - RNA, 17 nt, Homo sapiens
uguuaccguucaccagu

SEQ ID NO: 1065778 - RNA, 13 nt, Homo sapiens
uguuaccuacuuu

SEQ ID NO: 1065779 - RNA, 18 nt, Homo sapiens
uguuacugccuaucagca

SEQ ID NO: 1065780 - RNA, 21 nt, Homo sapiens
uguuauaacucugcacuacuc

SEQ ID NO: 1065781 - RNA, 20 nt, Homo sapiens
uguuaucuguguagcaagcu

SEQ ID NO: 1065782 - RNA, 22 nt, Homo sapiens
uguucaacuauuaauggaucau

SEQ ID NO: 1065783 - RNA, 18 nt, Homo sapiens
uguucaagagcacacuug

SEQ ID NO: 1065784 - RNA, 18 nt, Homo sapiens
uguucacuuauugacuau

SEQ ID NO: 1065785 - RNA, 15 nt, Homo sapiens
uguucagggcuguga

SEQ ID NO: 1065786 - RNA, 16 nt, Homo sapiens
uguucagggcugugau

SEQ ID NO: 1065787 - RNA, 17 nt, Homo sapiens
uguucagugucccgggc

SEQ ID NO: 1065788 - RNA, 15 nt, Homo sapiens
uguucauagcuucca

SEQ ID NO: 1065789 - RNA, 18 nt, Homo sapiens
uguucauguuacucauga

SEQ ID NO: 1065790 - RNA, 18 nt, Homo sapiens
uguuccaccuucccucau

SEQ ID NO: 1065791 - RNA, 16 nt, Homo sapiens
uguucccccugugcag

SEQ ID NO: 1065792 - RNA, 18 nt, Homo sapiens
uguuccccuuccacugag

SEQ ID NO: 1065793 - RNA, 20 nt, Homo sapiens
uguucccuccccgaucaucu

SEQ ID NO: 1065794 - RNA, 19 nt, Homo sapiens
uguuccuugucacugguag

SEQ ID NO: 1065795 - RNA, 13 nt, Homo sapiens
uguucuacacuca

SEQ ID NO: 1065796 - RNA, 14 nt, Homo sapiens
uguucuacugagaa

SEQ ID NO: 1065797 - RNA, 16 nt, Homo sapiens
uguucuauucaucuca

SEQ ID NO: 1065798 - RNA, 17 nt, Homo sapiens
uguucuuaauugcacuc

SEQ ID NO: 1065799 - RNA, 13 nt, Homo sapiens
uguucuugcuacc

SEQ ID NO: 1065800 - RNA, 13 nt, Homo sapiens
uguugacaugugc

SEQ ID NO: 1065801 - RNA, 14 nt, Homo sapiens
uguugacaugugcu

SEQ ID NO: 1065802 - RNA, 21 nt, Homo sapiens
uguugagacugauucagagga

SEQ ID NO: 1065803 - RNA, 21 nt, Homo sapiens
uguugagccaggccugggucu

SEQ ID NO: 1065804 - RNA, 11 nt, Homo sapiens
uguugauccca

SEQ ID NO: 1065805 - RNA, 12 nt, Homo sapiens
uguugaucccaa

SEQ ID NO: 1065806 - RNA, 21 nt, Homo sapiens
uguugaugaggccucuuggac

SEQ ID NO: 1065807 - RNA, 15 nt, Homo sapiens
uguugauugacugca

SEQ ID NO: 1065808 - RNA, 15 nt, Homo sapiens
uguugcaggcugugg

SEQ ID NO: 1065809 - RNA, 11 nt, Homo sapiens
uguugcaugga

SEQ ID NO: 1065810 - RNA, 21 nt, Homo sapiens
uguugcccaggcuggucucaa

SEQ ID NO: 1065811 - RNA, 20 nt, Homo sapiens
uguuggccaaagccaaagcu

SEQ ID NO: 1065812 - RNA, 20 nt, Homo sapiens
uguuguuuuaggaauacaua

SEQ ID NO: 1065813 - RNA, 17 nt, Homo sapiens
uguuuacaaggugacaa

SEQ ID NO: 1065814 - RNA, 17 nt, Homo sapiens
uguuuacagcacuacuc

SEQ ID NO: 1065815 - RNA, 19 nt, Homo sapiens
uguuuacagcacuacucug

SEQ ID NO: 1065816 - RNA, 20 nt, Homo sapiens
uguuuaccuaaacuauaugc

SEQ ID NO: 1065817 - RNA, 14 nt, Homo sapiens
uguuuauuccugau

SEQ ID NO: 1065818 - RNA, 20 nt, Homo sapiens
uguuucaauugcaucuccca

SEQ ID NO: 1065819 - RNA, 19 nt, Homo sapiens
uguuuccuagcacacacuu

SEQ ID NO: 1065820 - RNA, 22 nt, Homo sapiens
uguuuccuuuaauuuuuuacua

SEQ ID NO: 1065821 - RNA, 15 nt, Homo sapiens
uguuucuguuauuaa

SEQ ID NO: 1065822 - RNA, 12 nt, Homo sapiens
uguuucuuuagc

SEQ ID NO: 1065823 - RNA, 13 nt, Homo sapiens
uguuugagcucug

SEQ ID NO: 1065824 - RNA, 17 nt, Homo sapiens
uguuugucagauaugau

SEQ ID NO: 1065825 - RNA, 23 nt, Homo sapiens
uguuugucauagggcaguuggaa

SEQ ID NO: 1065826 - RNA, 12 nt, Homo sapiens
uguuuuagauau

SEQ ID NO: 1065827 - RNA, 14 nt, Homo sapiens
uguuuuauuuuggu

SEQ ID NO: 1065828 - RNA, 12 nt, Homo sapiens
uguuuuccauga

SEQ ID NO: 1065829 - RNA, 20 nt, Homo sapiens
uguuuucgcaccuaccauca

SEQ ID NO: 1065830 - RNA, 20 nt, Homo sapiens
uguuuucucuggaguauucu

SEQ ID NO: 1065831 - RNA, 14 nt, Homo sapiens
uguuuucucuugag

SEQ ID NO: 1065832 - RNA, 20 nt, Homo sapiens
uguuuucuugccaaugaggu

SEQ ID NO: 1065833 - RNA, 16 nt, Homo sapiens
uguuuugagcuuaaaa

SEQ ID NO: 1065834 - RNA, 18 nt, Homo sapiens
uguuuuuguaaagugugg

SEQ ID NO: 1065835 - RNA, 20 nt, Homo sapiens
uguuuuuguucaaagccagc

SEQ ID NO: 1065836 - RNA, 13 nt, Homo sapiens
uguuuuuuuccaa

SEQ ID NO: 1065837 - RNA, 17 nt, Homo sapiens
uuaaaaagucuucacuc

SEQ ID NO: 1065838 - RNA, 15 nt, Homo sapiens
uuaaaacaugcacaa

SEQ ID NO: 1065839 - RNA, 16 nt, Homo sapiens
uuaaaaggaaacugua

SEQ ID NO: 1065840 - RNA, 11 nt, Homo sapiens
uuaaaauaacu

SEQ ID NO: 1065841 - RNA, 17 nt, Homo sapiens
uuaaaauacauuuggcc

SEQ ID NO: 1065842 - RNA, 20 nt, Homo sapiens
uuaaaaucuaauucaaacua

SEQ ID NO: 1065843 - RNA, 13 nt, Homo sapiens
uuaaaaucuguca

SEQ ID NO: 1065844 - RNA, 15 nt, Homo sapiens
uuaaacaaaaacuag

SEQ ID NO: 1065845 - RNA, 21 nt, Homo sapiens
uuaaacaaaauagaagcugua

SEQ ID NO: 1065846 - RNA, 14 nt, Homo sapiens
uuaaacaccuccuc

SEQ ID NO: 1065847 - RNA, 13 nt, Homo sapiens
uuaaacagggcau

SEQ ID NO: 1065848 - RNA, 16 nt, Homo sapiens
uuaaacagugucauau

SEQ ID NO: 1065849 - RNA, 18 nt, Homo sapiens
uuaaacauugaaguaaug

SEQ ID NO: 1065850 - RNA, 14 nt, Homo sapiens
uuaaaccauguaaa

SEQ ID NO: 1065851 - RNA, 12 nt, Homo sapiens
uuaaacucaggg

SEQ ID NO: 1065852 - RNA, 12 nt, Homo sapiens
uuaaacugugua

SEQ ID NO: 1065853 - RNA, 20 nt, Homo sapiens
uuaaacuguguggacuguga

SEQ ID NO: 1065854 - RNA, 14 nt, Homo sapiens
uuaaacuuacuuag

SEQ ID NO: 1065855 - RNA, 20 nt, Homo sapiens
uuaaagaaaaaaaaagucag

SEQ ID NO: 1065856 - RNA, 18 nt, Homo sapiens
uuaaagacguucccuuuu

SEQ ID NO: 1065857 - RNA, 14 nt, Homo sapiens
uuaaagccuccuca

SEQ ID NO: 1065858 - RNA, 19 nt, Homo sapiens
uuaaaguaaugagcaugau

SEQ ID NO: 1065859 - RNA, 13 nt, Homo sapiens
uuaaaguucucaa

SEQ ID NO: 1065860 - RNA, 21 nt, Homo sapiens
uuaaauaagauuuaauucaca

SEQ ID NO: 1065861 - RNA, 13 nt, Homo sapiens
uuaaauaucagua

SEQ ID NO: 1065862 - RNA, 14 nt, Homo sapiens
uuaaaucaaaaggg

SEQ ID NO: 1065863 - RNA, 19 nt, Homo sapiens
uuaaaucugugaugauccu

SEQ ID NO: 1065864 - RNA, 15 nt, Homo sapiens
uuaaauggcuuuaug

SEQ ID NO: 1065865 - RNA, 15 nt, Homo sapiens
uuaaauguuucucaa

SEQ ID NO: 1065866 - RNA, 16 nt, Homo sapiens
uuaaauuguaaaugaa

SEQ ID NO: 1065867 - RNA, 16 nt, Homo sapiens
uuaaccagaaauccag

SEQ ID NO: 1065868 - RNA, 18 nt, Homo sapiens
uuaacucacacugcccag

SEQ ID NO: 1065869 - RNA, 21 nt, Homo sapiens
uuaacucagaucacuacugca

SEQ ID NO: 1065870 - RNA, 19 nt, Homo sapiens
uuaacuccuccugagcucu

SEQ ID NO: 1065871 - RNA, 21 nt, Homo sapiens
uuaacuuaaaagaacauguau

SEQ ID NO: 1065872 - RNA, 15 nt, Homo sapiens
uuaacuuaacauucu

SEQ ID NO: 1065873 - RNA, 18 nt, Homo sapiens
uuaacuuccaauuuacau

SEQ ID NO: 1065874 - RNA, 22 nt, Homo sapiens
uuaagaacuagggagggggaaa

SEQ ID NO: 1065875 - RNA, 15 nt, Homo sapiens
uuaagacaugcacua

SEQ ID NO: 1065876 - RNA, 20 nt, Homo sapiens
uuaagaggcagggucucacu

SEQ ID NO: 1065877 - RNA, 21 nt, Homo sapiens
uuaaggaggcugagagcccaa

SEQ ID NO: 1065878 - RNA, 19 nt, Homo sapiens
uuaaggauuuuaugcuuua

SEQ ID NO: 1065879 - RNA, 14 nt, Homo sapiens
uuaaggggcagcuu

SEQ ID NO: 1065880 - RNA, 22 nt, Homo sapiens
uuaaguauguuauuuucuguug

SEQ ID NO: 1065881 - RNA, 23 nt, Homo sapiens
uuaaguguaacuggcaguuuucc

SEQ ID NO: 1065882 - RNA, 20 nt, Homo sapiens
uuaaguugauggugaugaaa

SEQ ID NO: 1065883 - RNA, 16 nt, Homo sapiens
uuaaguuuucaugaau

SEQ ID NO: 1065884 - RNA, 14 nt, Homo sapiens
uuaauaaaaguaca

SEQ ID NO: 1065885 - RNA, 16 nt, Homo sapiens
uuaauaaagacagggu

SEQ ID NO: 1065886 - RNA, 20 nt, Homo sapiens
uuaauaaauuaaaacaugca

SEQ ID NO: 1065887 - RNA, 16 nt, Homo sapiens
uuaauaaauucagaua

SEQ ID NO: 1065888 - RNA, 20 nt, Homo sapiens
uuaauauaagaagcuuucag

SEQ ID NO: 1065889 - RNA, 20 nt, Homo sapiens
uuaaucaugaaauuacuuau

SEQ ID NO: 1065890 - RNA, 14 nt, Homo sapiens
uuaaucaugaaugu

SEQ ID NO: 1065891 - RNA, 20 nt, Homo sapiens
uuaaucuuucuuuaccugag

SEQ ID NO: 1065892 - RNA, 15 nt, Homo sapiens
uuaaugacagagcca

SEQ ID NO: 1065893 - RNA, 12 nt, Homo sapiens
uuaaugagauag

SEQ ID NO: 1065894 - RNA, 13 nt, Homo sapiens
uuaaugauaauau

SEQ ID NO: 1065895 - RNA, 22 nt, Homo sapiens
uuaaugcagagcuagaggacuu

SEQ ID NO: 1065896 - RNA, 19 nt, Homo sapiens
uuaaugccacaaaacugac

SEQ ID NO: 1065897 - RNA, 14 nt, Homo sapiens
uuaauuaaucauga

SEQ ID NO: 1065898 - RNA, 17 nt, Homo sapiens
uuaauucucaugugauc

SEQ ID NO: 1065899 - RNA, 23 nt, Homo sapiens
uuaauuugaaaacauaaucugca

SEQ ID NO: 1065900 - RNA, 15 nt, Homo sapiens
uuaauuuucaguaua

SEQ ID NO: 1065901 - RNA, 17 nt, Homo sapiens
uuaauuuucaguauaau

SEQ ID NO: 1065902 - RNA, 23 nt, Homo sapiens
uuacaaaacaugauuguuuacag

SEQ ID NO: 1065903 - RNA, 14 nt, Homo sapiens
uuacaaggugacaa

SEQ ID NO: 1065904 - RNA, 14 nt, Homo sapiens
uuacaaucauugcu

SEQ ID NO: 1065905 - RNA, 21 nt, Homo sapiens
uuacacugggagaggugccag

SEQ ID NO: 1065906 - RNA, 16 nt, Homo sapiens
uuacagacaugagccu

SEQ ID NO: 1065907 - RNA, 18 nt, Homo sapiens
uuacagacaugagccucc

SEQ ID NO: 1065908 - RNA, 20 nt, Homo sapiens
uuacagagaggagaaacaca

SEQ ID NO: 1065909 - RNA, 23 nt, Homo sapiens
uuacagagaggagaaacacaucu

SEQ ID NO: 1065910 - RNA, 15 nt, Homo sapiens
uuacagcacuacucu

SEQ ID NO: 1065911 - RNA, 15 nt, Homo sapiens
uuacagcugagcaca

SEQ ID NO: 1065912 - RNA, 15 nt, Homo sapiens
uuacaggcacaaaau

SEQ ID NO: 1065913 - RNA, 16 nt, Homo sapiens
uuacagggaaugccug

SEQ ID NO: 1065914 - RNA, 23 nt, Homo sapiens
uuacaguaggagcccagcucuga

SEQ ID NO: 1065915 - RNA, 19 nt, Homo sapiens
uuacaguuuaucuauggca

SEQ ID NO: 1065916 - RNA, 20 nt, Homo sapiens
uucacgaaguguugcaugga

SEQ ID NO: 1065917 - RNA, 20 nt, Homo sapiens
uucacgccuguaaucccagc

SEQ ID NO: 1065918 - RNA, 19 nt, Homo sapiens
uucacuuauccuguucucu

SEQ ID NO: 1065919 - RNA, 16 nt, Homo sapiens
uucacuuugugauuau

SEQ ID NO: 1065920 - RNA, 16 nt, Homo sapiens
uucagaaacagugagu

SEQ ID NO: 1065921 - RNA, 21 nt, Homo sapiens
uucagaaucacuucugagaac

SEQ ID NO: 1065922 - RNA, 21 nt, Homo sapiens
uucagagacuccugcaggcag

SEQ ID NO: 1065923 - RNA, 15 nt, Homo sapiens
uucagagagcuggua

SEQ ID NO: 1065924 - RNA, 19 nt, Homo sapiens
uucagaggagcaacccuau

SEQ ID NO: 1065925 - RNA, 17 nt, Homo sapiens
uucagauaacuguuauu

SEQ ID NO: 1065926 - RNA, 18 nt, Homo sapiens
uucagauggcaauuucac

SEQ ID NO: 1065927 - RNA, 16 nt, Homo sapiens
uucagcagacuaugaa

SEQ ID NO: 1065928 - RNA, 22 nt, Homo sapiens
uucagcaguaacaggaaaccac

SEQ ID NO: 1065929 - RNA, 13 nt, Homo sapiens
uucagccaaguga

SEQ ID NO: 1065930 - RNA, 13 nt, Homo sapiens
uucagccaccagc

SEQ ID NO: 1065931 - RNA, 14 nt, Homo sapiens
uucagccaccucuc

SEQ ID NO: 1065932 - RNA, 20 nt, Homo sapiens
uucagcuccagcucaccagc

SEQ ID NO: 1065933 - RNA, 14 nt, Homo sapiens
uucagcucugcaag

SEQ ID NO: 1065934 - RNA, 15 nt, Homo sapiens
uucagcugguugagg

SEQ ID NO: 1065935 - RNA, 22 nt, Homo sapiens
uucagcuguacauacucaguaa

SEQ ID NO: 1065936 - RNA, 18 nt, Homo sapiens
uucagggaauuucaggaa

SEQ ID NO: 1065937 - RNA, 13 nt, Homo sapiens
uucaguaugcaaa

SEQ ID NO: 1065938 - RNA, 22 nt, Homo sapiens
uucaguggcuaccuacauacaa

SEQ ID NO: 1065939 - RNA, 11 nt, Homo sapiens
uucaguuucag

SEQ ID NO: 1065940 - RNA, 18 nt, Homo sapiens
uucaguuuuacucugcug

SEQ ID NO: 1065941 - RNA, 21 nt, Homo sapiens
uucauaagguaauucauggca

SEQ ID NO: 1065942 - RNA, 16 nt, Homo sapiens
uucauacccuguuacc

SEQ ID NO: 1065943 - RNA, 13 nt, Homo sapiens
uucauauaacguc

SEQ ID NO: 1065944 - RNA, 17 nt, Homo sapiens
uucauauaccagcaaua

SEQ ID NO: 1065945 - RNA, 21 nt, Homo sapiens
uucauaugacauucaugccug

SEQ ID NO: 1065946 - RNA, 22 nt, Homo sapiens
uucauauuguggcacaagcaaa

SEQ ID NO: 1065947 - RNA, 22 nt, Homo sapiens
uucaucagacuccugugcaacu

SEQ ID NO: 1065948 - RNA, 15 nt, Homo sapiens
uucaucccacaaucu

SEQ ID NO: 1065949 - RNA, 11 nt, Homo sapiens
uucaucucuug

SEQ ID NO: 1065950 - RNA, 18 nt, Homo sapiens
uucauggugcacugagcu

SEQ ID NO: 1065951 - RNA, 14 nt, Homo sapiens
uucauguuacucau

SEQ ID NO: 1065952 - RNA, 20 nt, Homo sapiens
uucauguuugcuucauaaau

SEQ ID NO: 1065953 - RNA, 18 nt, Homo sapiens
uucauuaauacagggcau

SEQ ID NO: 1065954 - RNA, 12 nt, Homo sapiens
uucauuaccuca

SEQ ID NO: 1065955 - RNA, 21 nt, Homo sapiens
uucauuaucucaaaacugcac

SEQ ID NO: 1065956 - RNA, 20 nt, Homo sapiens
uucauucaaccccuucuggg

SEQ ID NO: 1065957 - RNA, 15 nt, Homo sapiens
uucauucacuuuaau

SEQ ID NO: 1065958 - RNA, 23 nt, Homo sapiens
uucauuccuaacacagcaugugu

SEQ ID NO: 1065959 - RNA, 16 nt, Homo sapiens
uucauugcacuuugau

SEQ ID NO: 1065960 - RNA, 18 nt, Homo sapiens
uucauuuaaaaugauuag

SEQ ID NO: 1065961 - RNA, 15 nt, Homo sapiens
uucauuuacuguggc

SEQ ID NO: 1065962 - RNA, 15 nt, Homo sapiens
uuccaaacacauaca

SEQ ID NO: 1065963 - RNA, 21 nt, Homo sapiens
uuccaaaccugacagauguca

SEQ ID NO: 1065964 - RNA, 15 nt, Homo sapiens
uuccaacaccacaga

SEQ ID NO: 1065965 - RNA, 20 nt, Homo sapiens
uuccaacuaacguacauuca

SEQ ID NO: 1065966 - RNA, 12 nt, Homo sapiens
uuccaagacagu

SEQ ID NO: 1065967 - RNA, 14 nt, Homo sapiens
uuccaagugccaau

SEQ ID NO: 1065968 - RNA, 13 nt, Homo sapiens
uuccaaugcauug

SEQ ID NO: 1065969 - RNA, 14 nt, Homo sapiens
uuccaauuuacaua

SEQ ID NO: 1065970 - RNA, 19 nt, Homo sapiens
uuccaccagccugcacuac

SEQ ID NO: 1065971 - RNA, 14 nt, Homo sapiens
uuccacuacugcua

SEQ ID NO: 1065972 - RNA, 12 nt, Homo sapiens
uuccacugcugc

SEQ ID NO: 1065973 - RNA, 18 nt, Homo sapiens
uuccagauccuucaaaga

SEQ ID NO: 1065974 - RNA, 14 nt, Homo sapiens
uuccagugaggcuc

SEQ ID NO: 1065975 - RNA, 19 nt, Homo sapiens
uuccauaaucuggacuccu

SEQ ID NO: 1065976 - RNA, 17 nt, Homo sapiens
uuccauaaugcuacugu

SEQ ID NO: 1065977 - RNA, 17 nt, Homo sapiens
uuccauauguuauauca

SEQ ID NO: 1065978 - RNA, 16 nt, Homo sapiens
uuccaugaaaaugcaa

SEQ ID NO: 1065979 - RNA, 21 nt, Homo sapiens
uuccauuuauucuuugaucuu

SEQ ID NO: 1065980 - RNA, 20 nt, Homo sapiens
uuccauuugugugugugcaa

SEQ ID NO: 1065981 - RNA, 22 nt, Homo sapiens
uuccauuugugugugugcaagu

SEQ ID NO: 1065982 - RNA, 14 nt, Homo sapiens
uucccaaaacugau

SEQ ID NO: 1065983 - RNA, 19 nt, Homo sapiens
uucccaaaagcccauucau

SEQ ID NO: 1065984 - RNA, 20 nt, Homo sapiens
uucccaaauaaacucuaaac

SEQ ID NO: 1065985 - RNA, 20 nt, Homo sapiens
uucccaagcucuagugggaa

SEQ ID NO: 1065986 - RNA, 16 nt, Homo sapiens
uucccacaggacauuu

SEQ ID NO: 1065987 - RNA, 11 nt, Homo sapiens
uucccacucac

SEQ ID NO: 1065988 - RNA, 18 nt, Homo sapiens
uucccagaaucaaagcaa

SEQ ID NO: 1065989 - RNA, 19 nt, Homo sapiens
uucccaucgcugucacagg

SEQ ID NO: 1065990 - RNA, 20 nt, Homo sapiens
uucccaucuuccaaggguac

SEQ ID NO: 1065991 - RNA, 17 nt, Homo sapiens
uucccauucuacauacu

SEQ ID NO: 1065992 - RNA, 19 nt, Homo sapiens
uucccauuuacaggucuuc

SEQ ID NO: 1065993 - RNA, 14 nt, Homo sapiens
uucccccacuacuu

SEQ ID NO: 1065994 - RNA, 13 nt, Homo sapiens
uucccccacugau

SEQ ID NO: 1065995 - RNA, 17 nt, Homo sapiens
uucccccagcccugugg

SEQ ID NO: 1065996 - RNA, 20 nt, Homo sapiens
uuccccuaguaagugccuuc

SEQ ID NO: 1065997 - RNA, 12 nt, Homo sapiens
uuccccucugcu

SEQ ID NO: 1065998 - RNA, 11 nt, Homo sapiens
uuccccugugg

SEQ ID NO: 1065999 - RNA, 17 nt, Homo sapiens
uucccuacaguugaaaa

SEQ ID NO: 1066000 - RNA, 22 nt, Homo sapiens
uucccuacaguugaaaaacagc

SEQ ID NO: 1066001 - RNA, 19 nt, Homo sapiens
uucccuacuuccugugacu

SEQ ID NO: 1066002 - RNA, 18 nt, Homo sapiens
uucccuagucuauucauu

SEQ ID NO: 1066003 - RNA, 19 nt, Homo sapiens
uucccuagucuauucauua

SEQ ID NO: 1066004 - RNA, 14 nt, Homo sapiens
uucccucacaccgc

SEQ ID NO: 1066005 - RNA, 22 nt, Homo sapiens
uucccugaauguauugaacuug

SEQ ID NO: 1066006 - RNA, 18 nt, Homo sapiens
uucccugaccucccucua

SEQ ID NO: 1066007 - RNA, 13 nt, Homo sapiens
uucccuucuccau

SEQ ID NO: 1066008 - RNA, 21 nt, Homo sapiens
uuccgcaccaauaaagccuuc

SEQ ID NO: 1066009 - RNA, 17 nt, Homo sapiens
uuccuaaaucuuaagaa

SEQ ID NO: 1066010 - RNA, 17 nt, Homo sapiens
uuccuacccuuccucac

SEQ ID NO: 1066011 - RNA, 20 nt, Homo sapiens
uuccuauggcuggccacugc

SEQ ID NO: 1066012 - RNA, 16 nt, Homo sapiens
uuccuauguaacugca

SEQ ID NO: 1066013 - RNA, 13 nt, Homo sapiens
uuccucagaucau

SEQ ID NO: 1066014 - RNA, 17 nt, Homo sapiens
uuccucagauggacaag

SEQ ID NO: 1066015 - RNA, 21 nt, Homo sapiens
uuccuccgaggccaguaccuu

SEQ ID NO: 1066016 - RNA, 23 nt, Homo sapiens
uuccucgcagagaggccaggugc

SEQ ID NO: 1066017 - RNA, 12 nt, Homo sapiens
uuccucugucaa

SEQ ID NO: 1066018 - RNA, 15 nt, Homo sapiens
uuccugaaugaaaua

SEQ ID NO: 1066019 - RNA, 18 nt, Homo sapiens
uuccuucagacagauucc

SEQ ID NO: 1066020 - RNA, 18 nt, Homo sapiens
uuccuucccuucuccauc

SEQ ID NO: 1066021 - RNA, 14 nt, Homo sapiens
uuccuucugaccac

SEQ ID NO: 1066022 - RNA, 16 nt, Homo sapiens
uuccuugaccagcaga

SEQ ID NO: 1066023 - RNA, 17 nt, Homo sapiens
uuccuugggaugaucuu

SEQ ID NO: 1066024 - RNA, 21 nt, Homo sapiens
uucgaccucgucuuucuccau

SEQ ID NO: 1066025 - RNA, 20 nt, Homo sapiens
uucgagaccagucuggccaa

SEQ ID NO: 1066026 - RNA, 12 nt, Homo sapiens
uucgauggcuca

SEQ ID NO: 1066027 - RNA, 23 nt, Homo sapiens
uucgcaccuaccaucagggacag

SEQ ID NO: 1066028 - RNA, 14 nt, Homo sapiens
uucguacaguucuu

SEQ ID NO: 1066029 - RNA, 20 nt, Homo sapiens
uucuaaaaauaaaaguauug

SEQ ID NO: 1066030 - RNA, 16 nt, Homo sapiens
uucuaaaggcuaccuu

SEQ ID NO: 1066031 - RNA, 14 nt, Homo sapiens
uucuaaaugcauau

SEQ ID NO: 1066032 - RNA, 20 nt, Homo sapiens
uucuaacauguuuugugcag

SEQ ID NO: 1066033 - RNA, 22 nt, Homo sapiens
uucuaagauaagaguugagauu

SEQ ID NO: 1066034 - RNA, 18 nt, Homo sapiens
uucuaaguauuuuauucc

SEQ ID NO: 1066035 - RNA, 14 nt, Homo sapiens
uucuaaugucuuca

SEQ ID NO: 1066036 - RNA, 15 nt, Homo sapiens
uucuaaugugugaau

SEQ ID NO: 1066037 - RNA, 21 nt, Homo sapiens
uucuaauuuuucagcuccuuc

SEQ ID NO: 1066038 - RNA, 23 nt, Homo sapiens
uucuaccuagaaauacauggaca

SEQ ID NO: 1066039 - RNA, 20 nt, Homo sapiens
uucuaccucuuggcugccuu

SEQ ID NO: 1066040 - RNA, 11 nt, Homo sapiens
uucuaggcauc

SEQ ID NO: 1066041 - RNA, 16 nt, Homo sapiens
uucuaguggucuuugu

SEQ ID NO: 1066042 - RNA, 17 nt, Homo sapiens
uucuauaggaacauaug

SEQ ID NO: 1066043 - RNA, 19 nt, Homo sapiens
uucuaucauuuuuguacag

SEQ ID NO: 1066044 - RNA, 14 nt, Homo sapiens
uucuaugaggcaac

SEQ ID NO: 1066045 - RNA, 14 nt, Homo sapiens
uucuauuaacuuua

SEQ ID NO: 1066046 - RNA, 22 nt, Homo sapiens
uucuauuacgugcaauacuuca

SEQ ID NO: 1066047 - RNA, 15 nt, Homo sapiens
uucuauuuauuuacu

SEQ ID NO: 1066048 - RNA, 16 nt, Homo sapiens
uucuauuuuuguagaa

SEQ ID NO: 1066049 - RNA, 23 nt, Homo sapiens
uucucaagcccugcagucacagc

SEQ ID NO: 1066050 - RNA, 21 nt, Homo sapiens
uucucacagugggagccaggg

SEQ ID NO: 1066051 - RNA, 22 nt, Homo sapiens
uucucagacuuuggaaaaugca

SEQ ID NO: 1066052 - RNA, 14 nt, Homo sapiens
uucucaucccacgc

SEQ ID NO: 1066053 - RNA, 20 nt, Homo sapiens
uucucauuucuguagccuga

SEQ ID NO: 1066054 - RNA, 17 nt, Homo sapiens
uucuccaagcaggacau

SEQ ID NO: 1066055 - RNA, 24 nt, Homo sapiens
uucuccaagcaggacauggacaag

SEQ ID NO: 1066056 - RNA, 20 nt, Homo sapiens
uucuccauacgcacugguau

SEQ ID NO: 1066057 - RNA, 12 nt, Homo sapiens
uucuccaucucu

SEQ ID NO: 1066058 - RNA, 23 nt, Homo sapiens
uucucccaggccaggcuccuucc

SEQ ID NO: 1066059 - RNA, 18 nt, Homo sapiens
uucucgggcugagaaccc

SEQ ID NO: 1066060 - RNA, 16 nt, Homo sapiens
uucucuaacucagaaa

SEQ ID NO: 1066061 - RNA, 20 nt, Homo sapiens
ggguuucaccauauugccca

SEQ ID NO: 1066062 - RNA, 13 nt, Homo sapiens
ggucacaguccac

SEQ ID NO: 1066063 - RNA, 21 nt, Homo sapiens
ggucagaaacaggaccgggug

SEQ ID NO: 1066064 - RNA, 11 nt, Homo sapiens
ggucauuugcu

SEQ ID NO: 1066065 - RNA, 23 nt, Homo sapiens
ggucuaugccaggcccauuuccu

SEQ ID NO: 1066066 - RNA, 13 nt, Homo sapiens
ggugaaacccagu

SEQ ID NO: 1066067 - RNA, 16 nt, Homo sapiens
ggugaacaagcaaacc

SEQ ID NO: 1066068 - RNA, 12 nt, Homo sapiens
ggugcuuuccag

SEQ ID NO: 1066069 - RNA, 23 nt, Homo sapiens
gguggcuaccaugcaggauuuga

SEQ ID NO: 1066070 - RNA, 18 nt, Homo sapiens
gguucuggaaacauucag

SEQ ID NO: 1066071 - RNA, 16 nt, Homo sapiens
gguuggauuugaagac

SEQ ID NO: 1066072 - RNA, 17 nt, Homo sapiens
gguuucuccagagggaa

SEQ ID NO: 1066073 - RNA, 11 nt, Homo sapiens
guaaacauacu

SEQ ID NO: 1066074 - RNA, 21 nt, Homo sapiens
guaaaccaaguucaaaggaaa

SEQ ID NO: 1066075 - RNA, 16 nt, Homo sapiens
guaaucccagcacuuu

SEQ ID NO: 1066076 - RNA, 18 nt, Homo sapiens
guaauccuagcacuuugg

SEQ ID NO: 1066077 - RNA, 18 nt, Homo sapiens
guacaccacaagggucac

SEQ ID NO: 1066078 - RNA, 18 nt, Homo sapiens
guaguuguugaguucaag

SEQ ID NO: 1066079 - RNA, 16 nt, Homo sapiens
guauauauaauacuga

SEQ ID NO: 1066080 - RNA, 22 nt, Homo sapiens
gucaauuggaaagacuauccaa

SEQ ID NO: 1066081 - RNA, 11 nt, Homo sapiens
gucacagggac

SEQ ID NO: 1066082 - RNA, 19 nt, Homo sapiens
gucacuucaugcaggugaa

SEQ ID NO: 1066083 - RNA, 22 nt, Homo sapiens
gucagucugaugagaacucuga

SEQ ID NO: 1066084 - RNA, 19 nt, Homo sapiens
gucauucuagaaacaggaa

SEQ ID NO: 1066085 - RNA, 17 nt, Homo sapiens
guccacagggcaccugc

SEQ ID NO: 1066086 - RNA, 20 nt, Homo sapiens
guccacccacccucucucug

SEQ ID NO: 1066087 - RNA, 18 nt, Homo sapiens
guccccuaaaccaaaaac

SEQ ID NO: 1066088 - RNA, 17 nt, Homo sapiens
guccuagagcuacaggg

SEQ ID NO: 1066089 - RNA, 22 nt, Homo sapiens
guccugcagaagcagaagugca

SEQ ID NO: 1066090 - RNA, 15 nt, Homo sapiens
gucucaaacuccugg

SEQ ID NO: 1066091 - RNA, 14 nt, Homo sapiens
gucucauucuguca

SEQ ID NO: 1066092 - RNA, 13 nt, Homo sapiens
gucucccagcuca

SEQ ID NO: 1066093 - RNA, 22 nt, Homo sapiens
gugaaggcuggcaugauccaag

SEQ ID NO: 1066094 - RNA, 14 nt, Homo sapiens
gugagaaaagaaua

SEQ ID NO: 1066095 - RNA, 16 nt, Homo sapiens
gugaggucacagucca

SEQ ID NO: 1066096 - RNA, 18 nt, Homo sapiens
gugaggugcuugagucuc

SEQ ID NO: 1066097 - RNA, 16 nt, Homo sapiens
gugccaguuugaaugc

SEQ ID NO: 1066098 - RNA, 14 nt, Homo sapiens
guggaaaagaaaua

SEQ ID NO: 1066099 - RNA, 23 nt, Homo sapiens
guggacaaacagggaacaaagaa

SEQ ID NO: 1066100 - RNA, 15 nt, Homo sapiens
guggagucauucuca

SEQ ID NO: 1066101 - RNA, 23 nt, Homo sapiens
guggccaugccucagcccugacc

SEQ ID NO: 1066102 - RNA, 18 nt, Homo sapiens
guggcuauuaaaacucuu

SEQ ID NO: 1066103 - RNA, 19 nt, Homo sapiens
guguaaggaaggugcucac

SEQ ID NO: 1066104 - RNA, 16 nt, Homo sapiens
guguauucauucucau

SEQ ID NO: 1066105 - RNA, 14 nt, Homo sapiens
gugugacucauuaa

SEQ ID NO: 1066106 - RNA, 17 nt, Homo sapiens
guguugacaugugcuuu

SEQ ID NO: 1066107 - RNA, 22 nt, Homo sapiens
guuaaacuaaggcccucuugaa

SEQ ID NO: 1066108 - RNA, 13 nt, Homo sapiens
guuaauaaagaag

SEQ ID NO: 1066109 - RNA, 14 nt, Homo sapiens
guuaauauggugua

SEQ ID NO: 1066110 - RNA, 23 nt, Homo sapiens
guuacuauaugccgcuacaaaaa

SEQ ID NO: 1066111 - RNA, 12 nt, Homo sapiens
guucacagugca

SEQ ID NO: 1066112 - RNA, 14 nt, Homo sapiens
guucacagugcaua

SEQ ID NO: 1066113 - RNA, 14 nt, Homo sapiens
guucauacagguga

SEQ ID NO: 1066114 - RNA, 17 nt, Homo sapiens
guucccuuacuguuuca

SEQ ID NO: 1066115 - RNA, 18 nt, Homo sapiens
guucugggacuacaggca

SEQ ID NO: 1066116 - RNA, 19 nt, Homo sapiens
guugguucuuagaccucaa

SEQ ID NO: 1066117 - RNA, 17 nt, Homo sapiens
guuuucugacacaguca

SEQ ID NO: 1066118 - RNA, 24 nt, Homo sapiens
guuuucuugauuuuuacguuugaa

SEQ ID NO: 1066119 - RNA, 19 nt, Homo sapiens
guuuuguggaggagcucag

SEQ ID NO: 1066120 - RNA, 15 nt, Homo sapiens
uaaaaagugugcuua

SEQ ID NO: 1066121 - RNA, 13 nt, Homo sapiens
uaaaacaguccuu

SEQ ID NO: 1066122 - RNA, 15 nt, Homo sapiens
uaaaacauuuucaca

SEQ ID NO: 1066123 - RNA, 19 nt, Homo sapiens
uaaaacucuuuuaacaguc

SEQ ID NO: 1066124 - RNA, 18 nt, Homo sapiens
uaaacaaauguaugauua

SEQ ID NO: 1066125 - RNA, 23 nt, Homo sapiens
uaaacaaauguaugauuacauca

SEQ ID NO: 1066126 - RNA, 18 nt, Homo sapiens
uaaacauuggacagugag

SEQ ID NO: 1066127 - RNA, 12 nt, Homo sapiens
uaaaccaaaaac

SEQ ID NO: 1066128 - RNA, 16 nt, Homo sapiens
uaaacgcugucccuag

SEQ ID NO: 1066129 - RNA, 20 nt, Homo sapiens
uaaagaaaaucucugugaaa

SEQ ID NO: 1066130 - RNA, 12 nt, Homo sapiens
uaaagccuucaa

SEQ ID NO: 1066131 - RNA, 16 nt, Homo sapiens
uaaagcuuugugcaga

SEQ ID NO: 1066132 - RNA, 13 nt, Homo sapiens
uaaauaaugcaua

SEQ ID NO: 1066133 - RNA, 22 nt, Homo sapiens
uaaauagcuuuugugucuuaca

SEQ ID NO: 1066134 - RNA, 14 nt, Homo sapiens
uaaaucgcuaccuu

SEQ ID NO: 1066135 - RNA, 20 nt, Homo sapiens
uaacacuggcuucaggcaaa

SEQ ID NO: 1066136 - RNA, 23 nt, Homo sapiens
uaagaaccacucauaauucuuca

SEQ ID NO: 1066137 - RNA, 15 nt, Homo sapiens
uaagacaacuacagc

SEQ ID NO: 1066138 - RNA, 17 nt, Homo sapiens
uaagccuuccacacuca

SEQ ID NO: 1066139 - RNA, 19 nt, Homo sapiens
uaaggcccucuugaaucuc

SEQ ID NO: 1066140 - RNA, 22 nt, Homo sapiens
uaagugugaguaaucugagaaa

SEQ ID NO: 1066141 - RNA, 20 nt, Homo sapiens
uaaguuuccuuccagcccag

SEQ ID NO: 1066142 - RNA, 21 nt, Homo sapiens
uaauacuauauuuauacugua

SEQ ID NO: 1066143 - RNA, 15 nt, Homo sapiens
uaauaugguguacau

SEQ ID NO: 1066144 - RNA, 18 nt, Homo sapiens
uaauaugguguacauucu

SEQ ID NO: 1066145 - RNA, 20 nt, Homo sapiens
uaauaugguguacauucuuc

SEQ ID NO: 1066146 - RNA, 20 nt, Homo sapiens
uaaucauuguaugugcuuca

SEQ ID NO: 1066147 - RNA, 14 nt, Homo sapiens
uaaucuuugcuuua

SEQ ID NO: 1066148 - RNA, 13 nt, Homo sapiens
uaaugcaccugaa

SEQ ID NO: 1066149 - RNA, 15 nt, Homo sapiens
uaaugcuuauaagac

SEQ ID NO: 1066150 - RNA, 19 nt, Homo sapiens
uaauuagcaucucagguua

SEQ ID NO: 1066151 - RNA, 17 nt, Homo sapiens
uaauuaguuaacaguuu

SEQ ID NO: 1066152 - RNA, 12 nt, Homo sapiens
uaauucugggaa

SEQ ID NO: 1066153 - RNA, 12 nt, Homo sapiens
uacaaacaugug

SEQ ID NO: 1066154 - RNA, 17 nt, Homo sapiens
uacaaaggcuugcuaag

SEQ ID NO: 1066155 - RNA, 17 nt, Homo sapiens
uacaaccugaugucaua

SEQ ID NO: 1066156 - RNA, 14 nt, Homo sapiens
uacaagcaaugccu

SEQ ID NO: 1066157 - RNA, 16 nt, Homo sapiens
uacaaggcccagaugu

SEQ ID NO: 1066158 - RNA, 14 nt, Homo sapiens
uacacacagcagua

SEQ ID NO: 1066159 - RNA, 15 nt, Homo sapiens
uacacauacauguaa

SEQ ID NO: 1066160 - RNA, 17 nt, Homo sapiens
uacacccacaguggaaa

SEQ ID NO: 1066161 - RNA, 22 nt, Homo sapiens
uacaggcaugaaauacugugcc

SEQ ID NO: 1066162 - RNA, 19 nt, Homo sapiens
uacaguauauguugcaaaa

SEQ ID NO: 1066163 - RNA, 15 nt, Homo sapiens
uacauaaaguaugug

SEQ ID NO: 1066164 - RNA, 18 nt, Homo sapiens
uacaugaaacuacucaua

SEQ ID NO: 1066165 - RNA, 18 nt, Homo sapiens
uacccuuucauucagccu

SEQ ID NO: 1066166 - RNA, 20 nt, Homo sapiens
uaccuacauuuuaaugcacc

SEQ ID NO: 1066167 - RNA, 13 nt, Homo sapiens
uaccucaaccaau

SEQ ID NO: 1066168 - RNA, 11 nt, Homo sapiens
uaccuuuuuga

SEQ ID NO: 1066169 - RNA, 14 nt, Homo sapiens
uacuguaugcagua

SEQ ID NO: 1066170 - RNA, 15 nt, Homo sapiens
uacuguuucacgugu

SEQ ID NO: 1066171 - RNA, 23 nt, Homo sapiens
uacuuaagcaaaagucagucuua

SEQ ID NO: 1066172 - RNA, 17 nt, Homo sapiens
uacuucugacauuccau

SEQ ID NO: 1066173 - RNA, 20 nt, Homo sapiens
uacuucuugauaccugggau

SEQ ID NO: 1066174 - RNA, 21 nt, Homo sapiens
uagaggaaggagauagggaaa

SEQ ID NO: 1066175 - RNA, 16 nt, Homo sapiens
uagaguuucaaccaug

SEQ ID NO: 1066176 - RNA, 16 nt, Homo sapiens
uagauuaccuagcuua

SEQ ID NO: 1066177 - RNA, 15 nt, Homo sapiens
uagauucacauacag

SEQ ID NO: 1066178 - RNA, 21 nt, Homo sapiens
uagcacaugcccuaaugucug

SEQ ID NO: 1066179 - RNA, 14 nt, Homo sapiens
uagcaucucagguu

SEQ ID NO: 1066180 - RNA, 22 nt, Homo sapiens
uguuuguuguauacuuccuuau

SEQ ID NO: 1066181 - RNA, 13 nt, Homo sapiens
uguuuuaucauua

SEQ ID NO: 1066182 - RNA, 12 nt, Homo sapiens
uguuuucugaca

SEQ ID NO: 1066183 - RNA, 16 nt, Homo sapiens
uuaaaaaacacuucau

SEQ ID NO: 1066184 - RNA, 16 nt, Homo sapiens
uuaaaaugaucauuag

SEQ ID NO: 1066185 - RNA, 17 nt, Homo sapiens
uuaaacaaauguaugau

SEQ ID NO: 1066186 - RNA, 16 nt, Homo sapiens
uuaaagaauuuggaag

SEQ ID NO: 1066187 - RNA, 16 nt, Homo sapiens
uuaagacaacuacagc

SEQ ID NO: 1066188 - RNA, 16 nt, Homo sapiens
uuaaugcagacaaaca

SEQ ID NO: 1066189 - RNA, 17 nt, Homo sapiens
uuaauuuuuaaugcuua

SEQ ID NO: 1066190 - RNA, 11 nt, Homo sapiens
uuacaagcccc

SEQ ID NO: 1066191 - RNA, 20 nt, Homo sapiens
uuacaaugcauucugaggua

SEQ ID NO: 1066192 - RNA, 12 nt, Homo sapiens
uuacacaugaca

SEQ ID NO: 1066193 - RNA, 15 nt, Homo sapiens
uuagaggggggaaau

SEQ ID NO: 1066194 - RNA, 21 nt, Homo sapiens
uuagcuccaaaccuucacaca

SEQ ID NO: 1066195 - RNA, 16 nt, Homo sapiens
uuaguacuuacaucag

SEQ ID NO: 1066196 - RNA, 19 nt, Homo sapiens
uuauaaaagccagcaggcu

SEQ ID NO: 1066197 - RNA, 17 nt, Homo sapiens
uuauaaauaaauaucuc

SEQ ID NO: 1066198 - RNA, 14 nt, Homo sapiens
uuauguacaggaug

SEQ ID NO: 1066199 - RNA, 19 nt, Homo sapiens
uuauucuuauucaaagaaa

SEQ ID NO: 1066200 - RNA, 19 nt, Homo sapiens
uucaaaaauggcuaggaag

SEQ ID NO: 1066201 - RNA, 14 nt, Homo sapiens
uucaacauauaccu

SEQ ID NO: 1066202 - RNA, 16 nt, Homo sapiens
uucacauugaaaccca

SEQ ID NO: 1066203 - RNA, 17 nt, Homo sapiens
uucacauugaaacccag

SEQ ID NO: 1066204 - RNA, 16 nt, Homo sapiens
uucacguguaccugug

SEQ ID NO: 1066205 - RNA, 18 nt, Homo sapiens
uucacugugaccuugaga

SEQ ID NO: 1066206 - RNA, 19 nt, Homo sapiens
uucacugugaccuugagaa

SEQ ID NO: 1066207 - RNA, 13 nt, Homo sapiens
uucagccagguga

SEQ ID NO: 1066208 - RNA, 20 nt, Homo sapiens
uucaggagaacucauguuau

SEQ ID NO: 1066209 - RNA, 13 nt, Homo sapiens
uucaugcagguga

SEQ ID NO: 1066210 - RNA, 15 nt, Homo sapiens
uucauucagccuuua

SEQ ID NO: 1066211 - RNA, 16 nt, Homo sapiens
uuccaaaaugccaaau

SEQ ID NO: 1066212 - RNA, 11 nt, Homo sapiens
uuccagccaca

SEQ ID NO: 1066213 - RNA, 23 nt, Homo sapiens
uuccaguggcuuggguucacagu

SEQ ID NO: 1066214 - RNA, 16 nt, Homo sapiens
uuccaugaaaaugcaa

SEQ ID NO: 1066215 - RNA, 19 nt, Homo sapiens
uucccaggaguucugcuca

SEQ ID NO: 1066216 - RNA, 12 nt, Homo sapiens
uuccugcuuauu

SEQ ID NO: 1066217 - RNA, 20 nt, Homo sapiens
uuccugcuuauucauaauaa

SEQ ID NO: 1066218 - RNA, 21 nt, Homo sapiens
uuccuugguguucaaaaacca

SEQ ID NO: 1066219 - RNA, 14 nt, Homo sapiens
uuccuuuccaggua

SEQ ID NO: 1066220 - RNA, 12 nt, Homo sapiens
uucgcuugagaa

SEQ ID NO: 1066221 - RNA, 20 nt, Homo sapiens
uucuaagagguagauaccag

SEQ ID NO: 1066222 - RNA, 14 nt, Homo sapiens
uucuauacauucua

SEQ ID NO: 1066223 - RNA, 15 nt, Homo sapiens
uucuauccuguucuu

SEQ ID NO: 1066224 - RNA, 14 nt, Homo sapiens
uucuguauucugac

SEQ ID NO: 1066225 - RNA, 13 nt, Homo sapiens
uucuuacaaacau

SEQ ID NO: 1066226 - RNA, 21 nt, Homo sapiens
uugaaaguuuauaugcuucua

SEQ ID NO: 1066227 - RNA, 22 nt, Homo sapiens
uugaacuguaccaugugcuaca

SEQ ID NO: 1066228 - RNA, 16 nt, Homo sapiens
uugaauauaaacacua

SEQ ID NO: 1066229 - RNA, 19 nt, Homo sapiens
uugagucuguuuuguaaag

SEQ ID NO: 1066230 - RNA, 19 nt, Homo sapiens
uugauauaaauaaaacauu

SEQ ID NO: 1066231 - RNA, 13 nt, Homo sapiens
uugauucacuuca

SEQ ID NO: 1066232 - RNA, 19 nt, Homo sapiens
uugcgauucugcagccaca

SEQ ID NO: 1066233 - RNA, 17 nt, Homo sapiens
uugcugugggccaaaau

SEQ ID NO: 1066234 - RNA, 14 nt, Homo sapiens
uuggaacagugaau

SEQ ID NO: 1066235 - RNA, 19 nt, Homo sapiens
uuggacauagcgaauacaa

SEQ ID NO: 1066236 - RNA, 13 nt, Homo sapiens
uuggccaaacaag

SEQ ID NO: 1066237 - RNA, 13 nt, Homo sapiens
uuggggcuuuuac

SEQ ID NO: 1066238 - RNA, 16 nt, Homo sapiens
uuggguucacagugca

SEQ ID NO: 1066239 - RNA, 17 nt, Homo sapiens
uugguuaagcuuugaca

SEQ ID NO: 1066240 - RNA, 15 nt, Homo sapiens
uuguacuaugcuguu

SEQ ID NO: 1066241 - RNA, 20 nt, Homo sapiens
uugugccacuacacuccagc

SEQ ID NO: 1066242 - RNA, 20 nt, Homo sapiens
uugugucaacaugaacaaau

SEQ ID NO: 1066243 - RNA, 17 nt, Homo sapiens
uuuaaaaagugugcuua

SEQ ID NO: 1066244 - RNA, 16 nt, Homo sapiens
uuuaagaguagcagua

SEQ ID NO: 1066245 - RNA, 16 nt, Homo sapiens
uuuaauuugauaguau

SEQ ID NO: 1066246 - RNA, 19 nt, Homo sapiens
uuuacaagaaguauguaag

SEQ ID NO: 1066247 - RNA, 18 nt, Homo sapiens
uuuagccuggauguugcu

SEQ ID NO: 1066248 - RNA, 15 nt, Homo sapiens
uuuagggaagacauu

SEQ ID NO: 1066249 - RNA, 17 nt, Homo sapiens
uuuaguacuuacaucag

SEQ ID NO: 1066250 - RNA, 13 nt, Homo sapiens
uuuauaaucuaua

SEQ ID NO: 1066251 - RNA, 16 nt, Homo sapiens
uuuaucuucauuugaa

SEQ ID NO: 1066252 - RNA, 15 nt, Homo sapiens
uuuauguacaggaug

SEQ ID NO: 1066253 - RNA, 13 nt, Homo sapiens
uuucaaagccauu

SEQ ID NO: 1066254 - RNA, 14 nt, Homo sapiens
uuucagcauugaua

SEQ ID NO: 1066255 - RNA, 15 nt, Homo sapiens
uuucauaguuggggu

SEQ ID NO: 1066256 - RNA, 20 nt, Homo sapiens
uuuccccuuuugcauucucc

SEQ ID NO: 1066257 - RNA, 20 nt, Homo sapiens
uuuccgaggccccugucuca

SEQ ID NO: 1066258 - RNA, 17 nt, Homo sapiens
uuuccuugccuuguuga

SEQ ID NO: 1066259 - RNA, 15 nt, Homo sapiens
uuucugacacaguca

SEQ ID NO: 1066260 - RNA, 24 nt, Homo sapiens
uuucuuguuucaucguaaacauac

SEQ ID NO: 1066261 - RNA, 16 nt, Homo sapiens
uuugagcauggguuca

SEQ ID NO: 1066262 - RNA, 16 nt, Homo sapiens
uuugaucuucaacaaa

SEQ ID NO: 1066263 - RNA, 20 nt, Homo sapiens
uuuggagauagucucauucu

SEQ ID NO: 1066264 - RNA, 22 nt, Homo sapiens
uuugguguaagccuucaaagaa

SEQ ID NO: 1066265 - RNA, 17 nt, Homo sapiens
uuuguaggggaacucau

SEQ ID NO: 1066266 - RNA, 15 nt, Homo sapiens
uuugugccaaccuau

SEQ ID NO: 1066267 - RNA, 12 nt, Homo sapiens
uuuuacaccagu

SEQ ID NO: 1066268 - RNA, 18 nt, Homo sapiens
uuuuaguagacaguagga

SEQ ID NO: 1066269 - RNA, 14 nt, Homo sapiens
uuuugagggagcaa

SEQ ID NO: 1066270 - RNA, 23 nt, Homo sapiens
uuuugggaaaaaaacauacacaa

SEQ ID NO: 1066271 - RNA, 16 nt, Homo sapiens
uuuuuaaaaaucuaua

SEQ ID NO: 1066272 - RNA, 18 nt, Homo sapiens
uuuuugguuaagcuuuga

SEQ ID NO: 1066273 - RNA, 21 nt, Homo sapiens
aaauagcuuuugugucuuaca

SEQ ID NO: 1066274 - RNA, 18 nt, Homo sapiens
aaauauaaucuaauacac

SEQ ID NO: 1066275 - RNA, 18 nt, Homo sapiens
aaauaugcaccaaaucau

SEQ ID NO: 1066276 - RNA, 18 nt, Homo sapiens
aaauauuuugaucuucaa

SEQ ID NO: 1066277 - RNA, 17 nt, Homo sapiens
aaaugcaacaacaugua

SEQ ID NO: 1066278 - RNA, 17 nt, Homo sapiens
aaaugcucagaccagcu

SEQ ID NO: 1066279 - RNA, 22 nt, Homo sapiens
aaaugucauuguucuugugaac

SEQ ID NO: 1066280 - RNA, 14 nt, Homo sapiens
aaauugagugguuu

SEQ ID NO: 1066281 - RNA, 13 nt, Homo sapiens
aaauuggucccaa

SEQ ID NO: 1066282 - RNA, 16 nt, Homo sapiens
aacaagcaaacccaga

SEQ ID NO: 1066283 - RNA, 13 nt, Homo sapiens
aacaaguacuucu

SEQ ID NO: 1066284 - RNA, 15 nt, Homo sapiens
aacaaguguucugua

SEQ ID NO: 1066285 - RNA, 20 nt, Homo sapiens
aacaaugacuaauucuugca

SEQ ID NO: 1066286 - RNA, 17 nt, Homo sapiens
aacaccacgucacuuca

SEQ ID NO: 1066287 - RNA, 18 nt, Homo sapiens
aacaccacgucacuucau

SEQ ID NO: 1066288 - RNA, 21 nt, Homo sapiens
aacaccguguuuucugacaca

SEQ ID NO: 1066289 - RNA, 18 nt, Homo sapiens
aacagacccacauuggaa

SEQ ID NO: 1066290 - RNA, 16 nt, Homo sapiens
aacagacucgauucau

SEQ ID NO: 1066291 - RNA, 17 nt, Homo sapiens
aacagccacuacauuac

SEQ ID NO: 1066292 - RNA, 20 nt, Homo sapiens
aacagccacuacauuacuuc

SEQ ID NO: 1066293 - RNA, 14 nt, Homo sapiens
aacaguccuucaaa

SEQ ID NO: 1066294 - RNA, 19 nt, Homo sapiens
aacaucucugcuuucacuc

SEQ ID NO: 1066295 - RNA, 22 nt, Homo sapiens
aacauguuccugggaucacuga

SEQ ID NO: 1066296 - RNA, 19 nt, Homo sapiens
aacccaaagugugacucau

SEQ ID NO: 1066297 - RNA, 17 nt, Homo sapiens
aacccaacaugacuguu

SEQ ID NO: 1066298 - RNA, 16 nt, Homo sapiens
aacccaggaguggaua

SEQ ID NO: 1066299 - RNA, 17 nt, Homo sapiens
aacccagucacugugag

SEQ ID NO: 1066300 - RNA, 19 nt, Homo sapiens
aaccugaugucauauucca

SEQ ID NO: 1066301 - RNA, 20 nt, Homo sapiens
aaccuucuggccucccacag

SEQ ID NO: 1066302 - RNA, 19 nt, Homo sapiens
aacucauuuggggugcaaa

SEQ ID NO: 1066303 - RNA, 13 nt, Homo sapiens
aacuggaaugccu

SEQ ID NO: 1066304 - RNA, 18 nt, Homo sapiens
aacuggggauauaauacu

SEQ ID NO: 1066305 - RNA, 20 nt, Homo sapiens
acaaaauuggaagcugucau

SEQ ID NO: 1066306 - RNA, 11 nt, Homo sapiens
acaaacaaaca

SEQ ID NO: 1066307 - RNA, 14 nt, Homo sapiens
acaaaggugaaaau

SEQ ID NO: 1066308 - RNA, 18 nt, Homo sapiens
acaaaugaacgauaugua

SEQ ID NO: 1066309 - RNA, 17 nt, Homo sapiens
acaacauagcaaauuaa

SEQ ID NO: 1066310 - RNA, 11 nt, Homo sapiens
acaacuuccug

SEQ ID NO: 1066311 - RNA, 16 nt, Homo sapiens
acaauauugacuuugu

SEQ ID NO: 1066312 - RNA, 19 nt, Homo sapiens
acaaugaggcugcuuauga

SEQ ID NO: 1066313 - RNA, 17 nt, Homo sapiens
acaauggcuuacuccag

SEQ ID NO: 1066314 - RNA, 22 nt, Homo sapiens
acacagcccuggccucugcuca

SEQ ID NO: 1066315 - RNA, 19 nt, Homo sapiens
acacucauccccucacuug

SEQ ID NO: 1066316 - RNA, 15 nt, Homo sapiens
acacugaaauauaca

SEQ ID NO: 1066317 - RNA, 15 nt, Homo sapiens
acacugucuugaaga

SEQ ID NO: 1066318 - RNA, 15 nt, Homo sapiens
acagaaaacauguaa

SEQ ID NO: 1066319 - RNA, 13 nt, Homo sapiens
acagacaacacug

SEQ ID NO: 1066320 - RNA, 19 nt, Homo sapiens
acagcaccaccuugcgauu

SEQ ID NO: 1066321 - RNA, 12 nt, Homo sapiens
acagcaguagca

SEQ ID NO: 1066322 - RNA, 18 nt, Homo sapiens
acaggacuuaaaaugaca

SEQ ID NO: 1066323 - RNA, 20 nt, Homo sapiens
acaggccauggauggaaaac

SEQ ID NO: 1066324 - RNA, 20 nt, Homo sapiens
acaguccucauuuacuggau

SEQ ID NO: 1066325 - RNA, 19 nt, Homo sapiens
acauaacagacuaggccag

SEQ ID NO: 1066326 - RNA, 14 nt, Homo sapiens
acauagcaaauuaa

SEQ ID NO: 1066327 - RNA, 13 nt, Homo sapiens
acaugcacucagc

SEQ ID NO: 1066328 - RNA, 17 nt, Homo sapiens
acaugcacucagcucuu

SEQ ID NO: 1066329 - RNA, 21 nt, Homo sapiens
acaugcacucagcucuuggcu

SEQ ID NO: 1066330 - RNA, 19 nt, Homo sapiens
acaugggaccuauaacugc

SEQ ID NO: 1066331 - RNA, 23 nt, Homo sapiens
acauguacaauaagaacuucuau

SEQ ID NO: 1066332 - RNA, 20 nt, Homo sapiens
acauucaggagcuuccuguc

SEQ ID NO: 1066333 - RNA, 13 nt, Homo sapiens
cucuugaaucucu

SEQ ID NO: 1066334 - RNA, 19 nt, Homo sapiens
cucuuuaagggaguguacu

SEQ ID NO: 1066335 - RNA, 14 nt, Homo sapiens
cugaaaaccucucc

SEQ ID NO: 1066336 - RNA, 16 nt, Homo sapiens
cugaaauauacacaca

SEQ ID NO: 1066337 - RNA, 16 nt, Homo sapiens
cugaacguggcacucu

SEQ ID NO: 1066338 - RNA, 22 nt, Homo sapiens
cugaacuggagccaugggcaca

SEQ ID NO: 1066339 - RNA, 13 nt, Homo sapiens
cugaagaaauugg

SEQ ID NO: 1066340 - RNA, 13 nt, Homo sapiens
cugaauuuugcuu

SEQ ID NO: 1066341 - RNA, 13 nt, Homo sapiens
cugacaguagccu

SEQ ID NO: 1066342 - RNA, 23 nt, Homo sapiens
cugaggccuggggaugugaacaa

SEQ ID NO: 1066343 - RNA, 15 nt, Homo sapiens
cugagggagcuccaa

SEQ ID NO: 1066344 - RNA, 21 nt, Homo sapiens
cugcagaagcagaagugcaau

SEQ ID NO: 1066345 - RNA, 19 nt, Homo sapiens
cugcgcccaguccuuccac

SEQ ID NO: 1066346 - RNA, 18 nt, Homo sapiens
cugcgucauuacagggca

SEQ ID NO: 1066347 - RNA, 14 nt, Homo sapiens
cugcucacaguccu

SEQ ID NO: 1066348 - RNA, 16 nt, Homo sapiens
cugcucacaguccuca

SEQ ID NO: 1066349 - RNA, 16 nt, Homo sapiens
cugcucugcaagcaga

SEQ ID NO: 1066350 - RNA, 20 nt, Homo sapiens
cugcugcgucauuacagggc

SEQ ID NO: 1066351 - RNA, 13 nt, Homo sapiens
cugcuuucacucu

SEQ ID NO: 1066352 - RNA, 19 nt, Homo sapiens
cuggcaauguuuauuucau

SEQ ID NO: 1066353 - RNA, 22 nt, Homo sapiens
cuggcccaguuaauuugcacag

SEQ ID NO: 1066354 - RNA, 20 nt, Homo sapiens
cugggauccgggaucaaagu

SEQ ID NO: 1066355 - RNA, 23 nt, Homo sapiens
cugggcacacgccucccacuggg

SEQ ID NO: 1066356 - RNA, 17 nt, Homo sapiens
cugggugcggugacuca

SEQ ID NO: 1066357 - RNA, 17 nt, Homo sapiens
cuggucagguauuucag

SEQ ID NO: 1066358 - RNA, 20 nt, Homo sapiens
cuguaaagcuuugugcagau

SEQ ID NO: 1066359 - RNA, 15 nt, Homo sapiens
cuguaccaugugcua

SEQ ID NO: 1066360 - RNA, 22 nt, Homo sapiens
cugucugacuuauaauuugcau

SEQ ID NO: 1066361 - RNA, 20 nt, Homo sapiens
cugugagcucccaggugcag

SEQ ID NO: 1066362 - RNA, 14 nt, Homo sapiens
cugugcccucagau

SEQ ID NO: 1066363 - RNA, 17 nt, Homo sapiens
cuguguauucauucuca

SEQ ID NO: 1066364 - RNA, 15 nt, Homo sapiens
cuguuacacaugaca

SEQ ID NO: 1066365 - RNA, 13 nt, Homo sapiens
cuguuuacugaaa

SEQ ID NO: 1066366 - RNA, 21 nt, Homo sapiens
cuguuuccuacagacacccau

SEQ ID NO: 1066367 - RNA, 14 nt, Homo sapiens
cuuacaaacaugug

SEQ ID NO: 1066368 - RNA, 14 nt, Homo sapiens
cuuauaauuugcau

SEQ ID NO: 1066369 - RNA, 16 nt, Homo sapiens
cuuauuaaauauucua

SEQ ID NO: 1066370 - RNA, 13 nt, Homo sapiens
cuuauuaaaugga

SEQ ID NO: 1066371 - RNA, 12 nt, Homo sapiens
cuucaaacuucc

SEQ ID NO: 1066372 - RNA, 14 nt, Homo sapiens
cuucacgcuuucag

SEQ ID NO: 1066373 - RNA, 22 nt, Homo sapiens
cuucaugcaggugaaacccagu

SEQ ID NO: 1066374 - RNA, 21 nt, Homo sapiens
cuuccacacucaccucuaaaa

SEQ ID NO: 1066375 - RNA, 12 nt, Homo sapiens
cuucccauucuc

SEQ ID NO: 1066376 - RNA, 22 nt, Homo sapiens
cuuccguauccaucgaagcaga

SEQ ID NO: 1066377 - RNA, 14 nt, Homo sapiens
cuuccuguccuccc

SEQ ID NO: 1066378 - RNA, 20 nt, Homo sapiens
cuuccuuaugcuucuuucaa

SEQ ID NO: 1066379 - RNA, 19 nt, Homo sapiens
cuucgaccuacugaaaagg

SEQ ID NO: 1066380 - RNA, 21 nt, Homo sapiens
cuucguguucuguauucugac

SEQ ID NO: 1066381 - RNA, 22 nt, Homo sapiens
gaauguagcucaacuugugaua

SEQ ID NO: 1066382 - RNA, 13 nt, Homo sapiens
gaauguugguuuu

SEQ ID NO: 1066383 - RNA, 16 nt, Homo sapiens
gaauuauaaaagccag

SEQ ID NO: 1066384 - RNA, 15 nt, Homo sapiens
gaauuucacacuguc

SEQ ID NO: 1066385 - RNA, 22 nt, Homo sapiens
gaauuuuguucucugggagaaa

SEQ ID NO: 1066386 - RNA, 12 nt, Homo sapiens
gacaaagcaaaa

SEQ ID NO: 1066387 - RNA, 13 nt, Homo sapiens
gacaacacuggga

SEQ ID NO: 1066388 - RNA, 12 nt, Homo sapiens
gacagaccuuca

SEQ ID NO: 1066389 - RNA, 14 nt, Homo sapiens
gacagagcugggau

SEQ ID NO: 1066390 - RNA, 19 nt, Homo sapiens
gacagcuugaucaaaggca

SEQ ID NO: 1066391 - RNA, 15 nt, Homo sapiens
gacagucaugcaguc

SEQ ID NO: 1066392 - RNA, 21 nt, Homo sapiens
gacagucaugcagucugggag

SEQ ID NO: 1066393 - RNA, 19 nt, Homo sapiens
gacauccccccgccaaaag

SEQ ID NO: 1066394 - RNA, 15 nt, Homo sapiens
gacaugagccauuug

SEQ ID NO: 1066395 - RNA, 13 nt, Homo sapiens
gaccuacugaaaa

SEQ ID NO: 1066396 - RNA, 18 nt, Homo sapiens
gaccucagggcacaaaga

SEQ ID NO: 1066397 - RNA, 16 nt, Homo sapiens
gaccugguccacaggg

SEQ ID NO: 1066398 - RNA, 18 nt, Homo sapiens
gaccuugaugagcugugc

SEQ ID NO: 1066399 - RNA, 13 nt, Homo sapiens
gacgaaaguggaa

SEQ ID NO: 1066400 - RNA, 14 nt, Homo sapiens
gacgaaaguggaaa

SEQ ID NO: 1066401 - RNA, 15 nt, Homo sapiens
gacuccggcccuccu

SEQ ID NO: 1066402 - RNA, 16 nt, Homo sapiens
gacuccuaacuacagg

SEQ ID NO: 1066403 - RNA, 20 nt, Homo sapiens
gacucugucuaaaaaacaaa

SEQ ID NO: 1066404 - RNA, 13 nt, Homo sapiens
gagaaacaaugac

SEQ ID NO: 1066405 - RNA, 17 nt, Homo sapiens
gagagagcuggaggcac

SEQ ID NO: 1066406 - RNA, 14 nt, Homo sapiens
gagaggcuguguca

SEQ ID NO: 1066407 - RNA, 13 nt, Homo sapiens
gagauagggaaaa

SEQ ID NO: 1066408 - RNA, 13 nt, Homo sapiens
gagauagucucau

SEQ ID NO: 1066409 - RNA, 17 nt, Homo sapiens
gagauagucucauucug

SEQ ID NO: 1066410 - RNA, 15 nt, Homo sapiens
gagauuccugagcca

SEQ ID NO: 1066411 - RNA, 18 nt, Homo sapiens
gagcaaggguucccucaa

SEQ ID NO: 1066412 - RNA, 23 nt, Homo sapiens
gagcagcugaacuuacuugccuc

SEQ ID NO: 1066413 - RNA, 21 nt, Homo sapiens
gagcagugcuugaaugaaguu

SEQ ID NO: 1066414 - RNA, 13 nt, Homo sapiens
gagcgaaacucca

SEQ ID NO: 1066415 - RNA, 21 nt, Homo sapiens
gagcucagacaccugugugcu

SEQ ID NO: 1066416 - RNA, 16 nt, Homo sapiens
gagcugggauguuucu

SEQ ID NO: 1066417 - RNA, 14 nt, Homo sapiens
gaggcaccucaaga

SEQ ID NO: 1066418 - RNA, 17 nt, Homo sapiens
gaggcaccucaagaaga

SEQ ID NO: 1066419 - RNA, 19 nt, Homo sapiens
gaggcagagguuacagguu

SEQ ID NO: 1066420 - RNA, 19 nt, Homo sapiens
gaggccccugucucagggu

SEQ ID NO: 1066421 - RNA, 15 nt, Homo sapiens
gaggcugugucagaa

SEQ ID NO: 1066422 - RNA, 21 nt, Homo sapiens
gagguauucaauauccuuugc

SEQ ID NO: 1066423 - RNA, 23 nt, Homo sapiens
gaggugaacaagcaaacccagac

SEQ ID NO: 1066424 - RNA, 19 nt, Homo sapiens
gagucaggaaaacuacagg

SEQ ID NO: 1066425 - RNA, 14 nt, Homo sapiens
gauaacacuggcuu

SEQ ID NO: 1066426 - RNA, 15 nt, Homo sapiens
gauaaggaaauaaga

SEQ ID NO: 1066427 - RNA, 17 nt, Homo sapiens
gcuuggguucacagugc

SEQ ID NO: 1066428 - RNA, 15 nt, Homo sapiens
gcuuuaggugguguu

SEQ ID NO: 1066429 - RNA, 20 nt, Homo sapiens
ggaaaccucccuuuacagca

SEQ ID NO: 1066430 - RNA, 17 nt, Homo sapiens
ggaaacuggaugagguc

SEQ ID NO: 1066431 - RNA, 19 nt, Homo sapiens
ggaaacuggaugaggucau

SEQ ID NO: 1066432 - RNA, 18 nt, Homo sapiens
ggaaaugagaggcauuuc

SEQ ID NO: 1066433 - RNA, 12 nt, Homo sapiens
ggaacauuucag

SEQ ID NO: 1066434 - RNA, 19 nt, Homo sapiens
ggaaccguaggacccaagc

SEQ ID NO: 1066435 - RNA, 16 nt, Homo sapiens
ggaagacauugcaaug

SEQ ID NO: 1066436 - RNA, 12 nt, Homo sapiens
ggaauaaucucc

SEQ ID NO: 1066437 - RNA, 13 nt, Homo sapiens
ggaauucaucucu

SEQ ID NO: 1066438 - RNA, 13 nt, Homo sapiens
ggacaaagcaaaa

SEQ ID NO: 1066439 - RNA, 18 nt, Homo sapiens
ggacacuaauacaccagg

SEQ ID NO: 1066440 - RNA, 19 nt, Homo sapiens
ggaccaugcgacacuggga

SEQ ID NO: 1066441 - RNA, 17 nt, Homo sapiens
ggacucaaucuacaggc

SEQ ID NO: 1066442 - RNA, 16 nt, Homo sapiens
ggaggaacagauuuga

SEQ ID NO: 1066443 - RNA, 14 nt, Homo sapiens
ggaggccagugagc

SEQ ID NO: 1066444 - RNA, 14 nt, Homo sapiens
ggauacugcugcgu

SEQ ID NO: 1066445 - RNA, 17 nt, Homo sapiens
ggcaaaggguccagaag

SEQ ID NO: 1066446 - RNA, 18 nt, Homo sapiens
ggcaauauagcaagaucc

SEQ ID NO: 1066447 - RNA, 19 nt, Homo sapiens
ggcacacgccucccacugg

SEQ ID NO: 1066448 - RNA, 13 nt, Homo sapiens
ggcacccaagacc

SEQ ID NO: 1066449 - RNA, 16 nt, Homo sapiens
ggcagagguuacaggu

SEQ ID NO: 1066450 - RNA, 20 nt, Homo sapiens
ggcaugagcuacuaugccca

SEQ ID NO: 1066451 - RNA, 16 nt, Homo sapiens
ggccagugagccacuc

SEQ ID NO: 1066452 - RNA, 13 nt, Homo sapiens
ggccaugccucag

SEQ ID NO: 1066453 - RNA, 18 nt, Homo sapiens
ggccucccacagacucaa

SEQ ID NO: 1066454 - RNA, 21 nt, Homo sapiens
ggccuuaucuccaagaccaga

SEQ ID NO: 1066455 - RNA, 22 nt, Homo sapiens
ggcggugggcacccacccuggg

SEQ ID NO: 1066456 - RNA, 20 nt, Homo sapiens
ggcucaagcgauccucccac

SEQ ID NO: 1066457 - RNA, 14 nt, Homo sapiens
ggcucaagcugucc

SEQ ID NO: 1066458 - RNA, 20 nt, Homo sapiens
ggcucaagcuguccucccac

SEQ ID NO: 1066459 - RNA, 19 nt, Homo sapiens
ggcucacuguagucucgac

SEQ ID NO: 1066460 - RNA, 21 nt, Homo sapiens
ggcuucuguugucaccuucac

SEQ ID NO: 1066461 - RNA, 18 nt, Homo sapiens
ggcuuggguucacagugc

SEQ ID NO: 1066462 - RNA, 21 nt, Homo sapiens
ggcuuuuacugaagccuuucu

SEQ ID NO: 1066463 - RNA, 16 nt, Homo sapiens
gggaagacauugcaau

SEQ ID NO: 1066464 - RNA, 21 nt, Homo sapiens
gggagaucaugucucacuuca

SEQ ID NO: 1066465 - RNA, 13 nt, Homo sapiens
gggauauguuaac

SEQ ID NO: 1066466 - RNA, 13 nt, Homo sapiens
gggcccacaaagg

SEQ ID NO: 1066467 - RNA, 12 nt, Homo sapiens
gggcuggcagau

SEQ ID NO: 1066468 - RNA, 19 nt, Homo sapiens
ggggagauaagaaacccuc

SEQ ID NO: 1066469 - RNA, 17 nt, Homo sapiens
ggggcauaaacuuuccu

SEQ ID NO: 1066470 - RNA, 16 nt, Homo sapiens
ggggugccaguuugaa

SEQ ID NO: 1066471 - RNA, 14 nt, Homo sapiens
ggguuccauucuca

SEQ ID NO: 1066472 - RNA, 19 nt, Homo sapiens
ggguuuacagucuauuuga

SEQ ID NO: 1066473 - RNA, 16 nt, Homo sapiens
ggucuggccacugucc

SEQ ID NO: 1066474 - RNA, 22 nt, Homo sapiens
ggugaaacccagucacugugag

SEQ ID NO: 1066475 - RNA, 20 nt, Homo sapiens
ggugaacaagcaaacccaga

SEQ ID NO: 1066476 - RNA, 14 nt, Homo sapiens
gguuccauucucac

SEQ ID NO: 1066477 - RNA, 17 nt, Homo sapiens
gguuguacuaugcuguu

SEQ ID NO: 1066478 - RNA, 19 nt, Homo sapiens
gguuucacuauguugccua

SEQ ID NO: 1066479 - RNA, 15 nt, Homo sapiens
guaaauccaggaaua

SEQ ID NO: 1066480 - RNA, 18 nt, Homo sapiens
guaaucccagcuacucga

SEQ ID NO: 1066481 - RNA, 18 nt, Homo sapiens
guacaaguggcaaccugc

SEQ ID NO: 1066482 - RNA, 23 nt, Homo sapiens
guacccuaaggucauuaccacag

SEQ ID NO: 1066483 - RNA, 14 nt, Homo sapiens
guacugggccaugu

SEQ ID NO: 1066484 - RNA, 16 nt, Homo sapiens
guagauucacauacag

SEQ ID NO: 1066485 - RNA, 14 nt, Homo sapiens
guaggcucauuuac

SEQ ID NO: 1066486 - RNA, 14 nt, Homo sapiens
guauauauaauacu

SEQ ID NO: 1066487 - RNA, 15 nt, Homo sapiens
guauauauaauacug

SEQ ID NO: 1066488 - RNA, 20 nt, Homo sapiens
guauaugugcauggacugug

SEQ ID NO: 1066489 - RNA, 15 nt, Homo sapiens
guauauguugcaaaa

SEQ ID NO: 1066490 - RNA, 18 nt, Homo sapiens
guaucaguggauuuccca

SEQ ID NO: 1066491 - RNA, 20 nt, Homo sapiens
guauucugacccaugggaga

SEQ ID NO: 1066492 - RNA, 19 nt, Homo sapiens
gucacugcucuggacugug

SEQ ID NO: 1066493 - RNA, 11 nt, Homo sapiens
gucacugugag

SEQ ID NO: 1066494 - RNA, 21 nt, Homo sapiens
gucagaauuagcugcuucuau

SEQ ID NO: 1066495 - RNA, 18 nt, Homo sapiens
gucuccaacggcaaggga

SEQ ID NO: 1066496 - RNA, 18 nt, Homo sapiens
gucucuacuaaaaauaca

SEQ ID NO: 1066497 - RNA, 18 nt, Homo sapiens
gucucucauucuaggccu

SEQ ID NO: 1066498 - RNA, 12 nt, Homo sapiens
gugaaacaaugu

SEQ ID NO: 1066499 - RNA, 21 nt, Homo sapiens
gugaaacccugucucuacuaa

SEQ ID NO: 1066500 - RNA, 18 nt, Homo sapiens
gugaaaccuccucucuac

SEQ ID NO: 1066501 - RNA, 15 nt, Homo sapiens
gugaaaugcagaguc

SEQ ID NO: 1066502 - RNA, 18 nt, Homo sapiens
gugaagagauacagccuu

SEQ ID NO: 1066503 - RNA, 15 nt, Homo sapiens
gugaaucagucccau

SEQ ID NO: 1066504 - RNA, 13 nt, Homo sapiens
gugagaaguucau

SEQ ID NO: 1066505 - RNA, 22 nt, Homo sapiens
gugagcagacugcaaaucugcc

SEQ ID NO: 1066506 - RNA, 13 nt, Homo sapiens
gugagcugucacu

SEQ ID NO: 1066507 - RNA, 14 nt, Homo sapiens
gugaucaaagccac

SEQ ID NO: 1066508 - RNA, 16 nt, Homo sapiens
gugcagggacaaagag

SEQ ID NO: 1066509 - RNA, 22 nt, Homo sapiens
gugccauuaagacaacuacagc

SEQ ID NO: 1066510 - RNA, 12 nt, Homo sapiens
gugcuacagggg

SEQ ID NO: 1066511 - RNA, 18 nt, Homo sapiens
gugcugggauuacaggca

SEQ ID NO: 1066512 - RNA, 14 nt, Homo sapiens
gugcuugagucucc

SEQ ID NO: 1066513 - RNA, 15 nt, Homo sapiens
guggaauugugcuga

SEQ ID NO: 1066514 - RNA, 17 nt, Homo sapiens
guggacaguccccaccu

SEQ ID NO: 1066515 - RNA, 13 nt, Homo sapiens
gugucaacaugaa

SEQ ID NO: 1066516 - RNA, 20 nt, Homo sapiens
gugugaauaaagugcugcgg

SEQ ID NO: 1066517 - RNA, 15 nt, Homo sapiens
guguuugacgggaaa

SEQ ID NO: 1066518 - RNA, 20 nt, Homo sapiens
guuaaaaaaaagaauaaagg

SEQ ID NO: 1066519 - RNA, 12 nt, Homo sapiens
guuaaguucaaa

SEQ ID NO: 1066520 - RNA, 14 nt, Homo sapiens
guuaaugguuugaa

SEQ ID NO: 1066521 - RNA, 13 nt, Homo sapiens
guuacuugggagg

SEQ ID NO: 1066522 - RNA, 21 nt, Homo sapiens
guuacuuuucauauuugcacu

SEQ ID NO: 1066523 - RNA, 14 nt, Homo sapiens
guuagcaucuggcu

SEQ ID NO: 1066524 - RNA, 14 nt, Homo sapiens
guucagggucauag

SEQ ID NO: 1066525 - RNA, 15 nt, Homo sapiens
guucugcucauucua

SEQ ID NO: 1066526 - RNA, 18 nt, Homo sapiens
guucuguaucuacuuuaa

SEQ ID NO: 1066527 - RNA, 17 nt, Homo sapiens
guucuuugugucaacau

SEQ ID NO: 1066528 - RNA, 12 nt, Homo sapiens
guugaguucaag

SEQ ID NO: 1066529 - RNA, 16 nt, Homo sapiens
guugauguggacauga

SEQ ID NO: 1066530 - RNA, 14 nt, Homo sapiens
guuggaacauuuca

SEQ ID NO: 1066531 - RNA, 14 nt, Homo sapiens
guuguauugcauau

SEQ ID NO: 1066532 - RNA, 22 nt, Homo sapiens
guugugacaacuuccugaggga

SEQ ID NO: 1066533 - RNA, 22 nt, Homo sapiens
guuuacaagcccccccuuccac

SEQ ID NO: 1066534 - RNA, 17 nt, Homo sapiens
guuucuccagagggaau

SEQ ID NO: 1066535 - RNA, 16 nt, Homo sapiens
guuuuaggucuagccu

SEQ ID NO: 1066536 - RNA, 13 nt, Homo sapiens
guuuugagacaaa

SEQ ID NO: 1066537 - RNA, 23 nt, Homo sapiens
uaaaaaaaaaacguauugcauuu

SEQ ID NO: 1066538 - RNA, 17 nt, Homo sapiens
uaaaacaccuaaauaac

SEQ ID NO: 1066539 - RNA, 18 nt, Homo sapiens
uaaaacauuuucacacaa

SEQ ID NO: 1066540 - RNA, 20 nt, Homo sapiens
uaaaacauuuucacacaaua

SEQ ID NO: 1066541 - RNA, 22 nt, Homo sapiens
uaaaagcacacucauccccuca

SEQ ID NO: 1066542 - RNA, 22 nt, Homo sapiens
uaaaaugaaguggugagcuuaa

SEQ ID NO: 1066543 - RNA, 14 nt, Homo sapiens
uaaaaugacauuca

SEQ ID NO: 1066544 - RNA, 22 nt, Homo sapiens
uaaaauuguauagaccuaaaau

SEQ ID NO: 1066545 - RNA, 14 nt, Homo sapiens
uaaacaaauguaug

SEQ ID NO: 1066546 - RNA, 18 nt, Homo sapiens
uaaacaauaucagacuuu

SEQ ID NO: 1066547 - RNA, 15 nt, Homo sapiens
uaaaccaaaaacuga

SEQ ID NO: 1066548 - RNA, 23 nt, Homo sapiens
uaaacuuuccucuuccugccuag

SEQ ID NO: 1066549 - RNA, 20 nt, Homo sapiens
uaaagaccugacaccuuuca

SEQ ID NO: 1066550 - RNA, 22 nt, Homo sapiens
uaaagagaaagcccgcuuuagu

SEQ ID NO: 1066551 - RNA, 17 nt, Homo sapiens
uaaagcuuugugcagau

SEQ ID NO: 1066552 - RNA, 20 nt, Homo sapiens
uaaauagcuuuugugucuua

SEQ ID NO: 1066553 - RNA, 17 nt, Homo sapiens
uaaauggaaacugaaac

SEQ ID NO: 1066554 - RNA, 19 nt, Homo sapiens
uaacaauaagccaguauaa

SEQ ID NO: 1066555 - RNA, 19 nt, Homo sapiens
uaacacuggcuucaggcaa

SEQ ID NO: 1066556 - RNA, 16 nt, Homo sapiens
uaacagaaaauguguc

SEQ ID NO: 1066557 - RNA, 22 nt, Homo sapiens
uaacauuuuugguagucuucaa

SEQ ID NO: 1066558 - RNA, 20 nt, Homo sapiens
uaaccugccaacauacuuua

SEQ ID NO: 1066559 - RNA, 11 nt, Homo sapiens
uaacuccucaa

SEQ ID NO: 1066560 - RNA, 21 nt, Homo sapiens
uaacugcaaagugaaguugcu

SEQ ID NO: 1066561 - RNA, 23 nt, Homo sapiens
uaacuggggauauaauacuauau

SEQ ID NO: 1066562 - RNA, 22 nt, Homo sapiens
uaagaaccacucauaauucuuc

SEQ ID NO: 1066563 - RNA, 13 nt, Homo sapiens
uaagccagggauu

SEQ ID NO: 1066564 - RNA, 18 nt, Homo sapiens
uaaguggggaaaauccua

SEQ ID NO: 1066565 - RNA, 15 nt, Homo sapiens
uaaguuuccuuccag

SEQ ID NO: 1066566 - RNA, 22 nt, Homo sapiens
uaaguuuccuuccagcccagaa

SEQ ID NO: 1066567 - RNA, 11 nt, Homo sapiens
uaauacuguau

SEQ ID NO: 1066568 - RNA, 19 nt, Homo sapiens
uaauauggggaugcagcau

SEQ ID NO: 1066569 - RNA, 12 nt, Homo sapiens
uaauauugcaag

SEQ ID NO: 1066570 - RNA, 21 nt, Homo sapiens
uaaucaaaacccaacaugacu

SEQ ID NO: 1066571 - RNA, 17 nt, Homo sapiens
uaaucccagcacuuugg

SEQ ID NO: 1066572 - RNA, 20 nt, Homo sapiens
uaaucccagcuacucgagag

SEQ ID NO: 1066573 - RNA, 20 nt, Homo sapiens
uaaucccagcuacucgggaa

SEQ ID NO: 1066574 - RNA, 19 nt, Homo sapiens
uaaucccaguacucuggga

SEQ ID NO: 1066575 - RNA, 15 nt, Homo sapiens
uaaucuaauacacuu

SEQ ID NO: 1066576 - RNA, 23 nt, Homo sapiens
uaaugaauaaacauuuguagcau

SEQ ID NO: 1066577 - RNA, 19 nt, Homo sapiens
uaauuaccuguauugugga

SEQ ID NO: 1066578 - RNA, 18 nt, Homo sapiens
uaauucaacauauaccuu

SEQ ID NO: 1066579 - RNA, 12 nt, Homo sapiens
uaauucuucacc

SEQ ID NO: 1066580 - RNA, 18 nt, Homo sapiens
uaauuggcaugugaauua

SEQ ID NO: 1066581 - RNA, 12 nt, Homo sapiens
uacaaacauguu

SEQ ID NO: 1066582 - RNA, 23 nt, Homo sapiens
uacaacccgguucacucuucuca

SEQ ID NO: 1066583 - RNA, 17 nt, Homo sapiens
uacaaucucccuucaca

SEQ ID NO: 1066584 - RNA, 11 nt, Homo sapiens
uacacaugaca

SEQ ID NO: 1066585 - RNA, 17 nt, Homo sapiens
uacagagaagugaauaa

SEQ ID NO: 1066586 - RNA, 21 nt, Homo sapiens
uacaggugauucguuggaaaa

SEQ ID NO: 1066587 - RNA, 14 nt, Homo sapiens
uauuuugaucuuca

SEQ ID NO: 1066588 - RNA, 23 nt, Homo sapiens
uauuuuuaaccugccaacauacu

SEQ ID NO: 1066589 - RNA, 14 nt, Homo sapiens
uauuuuuaccuuca

SEQ ID NO: 1066590 - RNA, 20 nt, Homo sapiens
uauuuuuuaaaaaucuauau

SEQ ID NO: 1066591 - RNA, 17 nt, Homo sapiens
ucaaagagcuugaaaag

SEQ ID NO: 1066592 - RNA, 22 nt, Homo sapiens
ucaaagcaccugaacaguuuau

SEQ ID NO: 1066593 - RNA, 12 nt, Homo sapiens
ucaaagcacugu

SEQ ID NO: 1066594 - RNA, 16 nt, Homo sapiens
ucaaaggcacacagca

SEQ ID NO: 1066595 - RNA, 14 nt, Homo sapiens
ucaaccagggauug

SEQ ID NO: 1066596 - RNA, 13 nt, Homo sapiens
ucaagaguuguga

SEQ ID NO: 1066597 - RNA, 14 nt, Homo sapiens
ucaagcgauccucc

SEQ ID NO: 1066598 - RNA, 15 nt, Homo sapiens
ucaagcuguccuccc

SEQ ID NO: 1066599 - RNA, 15 nt, Homo sapiens
ucaagguaacuguac

SEQ ID NO: 1066600 - RNA, 13 nt, Homo sapiens
ucaaucuacaggc

SEQ ID NO: 1066601 - RNA, 18 nt, Homo sapiens
ucacacaauacaauaagu

SEQ ID NO: 1066602 - RNA, 19 nt, Homo sapiens
ucacaccacugcacucuag

SEQ ID NO: 1066603 - RNA, 22 nt, Homo sapiens
ucacaguccucauuuacuggau

SEQ ID NO: 1066604 - RNA, 11 nt, Homo sapiens
ucacagugcau

SEQ ID NO: 1066605 - RNA, 18 nt, Homo sapiens
ucacaucagaacagacaa

SEQ ID NO: 1066606 - RNA, 19 nt, Homo sapiens
ucaccagauuuaaauaacu

SEQ ID NO: 1066607 - RNA, 16 nt, Homo sapiens
ucaccauauugcccag

SEQ ID NO: 1066608 - RNA, 19 nt, Homo sapiens
ucaccuuaggaauaaucuc

SEQ ID NO: 1066609 - RNA, 15 nt, Homo sapiens
ucacggcucacugua

SEQ ID NO: 1066610 - RNA, 19 nt, Homo sapiens
ucacucgaggucaggaguu

SEQ ID NO: 1066611 - RNA, 14 nt, Homo sapiens
ucacuugagaccag

SEQ ID NO: 1066612 - RNA, 17 nt, Homo sapiens
ucagaacagacaaucac

SEQ ID NO: 1066613 - RNA, 21 nt, Homo sapiens
ucagaagggagcuagccagag

SEQ ID NO: 1066614 - RNA, 15 nt, Homo sapiens
ucagauggcauaaau

SEQ ID NO: 1066615 - RNA, 18 nt, Homo sapiens
ucagccaggugaacugga

SEQ ID NO: 1066616 - RNA, 17 nt, Homo sapiens
ucagcccugacccugug

SEQ ID NO: 1066617 - RNA, 20 nt, Homo sapiens
ucagcgaaugacaaaaucau

SEQ ID NO: 1066618 - RNA, 13 nt, Homo sapiens
ucagcucuuggcu

SEQ ID NO: 1066619 - RNA, 21 nt, Homo sapiens
ucaggacacuaauacaccagg

SEQ ID NO: 1066620 - RNA, 22 nt, Homo sapiens
ucaguaggaacuguacaugugu

SEQ ID NO: 1066621 - RNA, 16 nt, Homo sapiens
ucaguugccauugaca

SEQ ID NO: 1066622 - RNA, 21 nt, Homo sapiens
ucauaaaaaaaugucaaggaa

SEQ ID NO: 1066623 - RNA, 17 nt, Homo sapiens
ucauaagagccacaggu

SEQ ID NO: 1066624 - RNA, 16 nt, Homo sapiens
ucauaauuaauguagu

SEQ ID NO: 1066625 - RNA, 20 nt, Homo sapiens
ucaugacaauggcagaugua

SEQ ID NO: 1066626 - RNA, 18 nt, Homo sapiens
ucauuacagggcacaggc

SEQ ID NO: 1066627 - RNA, 19 nt, Homo sapiens
ucauuacagggcacaggcc

SEQ ID NO: 1066628 - RNA, 21 nt, Homo sapiens
ucauuaggacauaacagacua

SEQ ID NO: 1066629 - RNA, 14 nt, Homo sapiens
ucauucagccuuua

SEQ ID NO: 1066630 - RNA, 16 nt, Homo sapiens
ucauucucauugaauu

SEQ ID NO: 1066631 - RNA, 17 nt, Homo sapiens
ucauuggcuauaaccuc

SEQ ID NO: 1066632 - RNA, 22 nt, Homo sapiens
uccaaaccuucacacacagacu

SEQ ID NO: 1066633 - RNA, 19 nt, Homo sapiens
uccaacggcaagggaacaa

SEQ ID NO: 1066634 - RNA, 22 nt, Homo sapiens
uggaaacauucaggagcuuccu

SEQ ID NO: 1066635 - RNA, 14 nt, Homo sapiens
uggaagcugucaua

SEQ ID NO: 1066636 - RNA, 21 nt, Homo sapiens
uggacagugaggucacagucc

SEQ ID NO: 1066637 - RNA, 15 nt, Homo sapiens
uggacaugagccauu

SEQ ID NO: 1066638 - RNA, 23 nt, Homo sapiens
uggagauccagaagagaauuaga

SEQ ID NO: 1066639 - RNA, 19 nt, Homo sapiens
uggaggcacccaugccauc

SEQ ID NO: 1066640 - RNA, 15 nt, Homo sapiens
uggagucauucucau

SEQ ID NO: 1066641 - RNA, 16 nt, Homo sapiens
uggauacugcugccaa

SEQ ID NO: 1066642 - RNA, 19 nt, Homo sapiens
uggcaaagaugaucaguau

SEQ ID NO: 1066643 - RNA, 13 nt, Homo sapiens
uggcacccaagac

SEQ ID NO: 1066644 - RNA, 15 nt, Homo sapiens
uggcaugauccaagc

SEQ ID NO: 1066645 - RNA, 19 nt, Homo sapiens
uggcaugauccaagcaaga

SEQ ID NO: 1066646 - RNA, 15 nt, Homo sapiens
uggccucccacagac

SEQ ID NO: 1066647 - RNA, 22 nt, Homo sapiens
uggccugaagaguccucugaau

SEQ ID NO: 1066648 - RNA, 16 nt, Homo sapiens
uggcucacaccuguaa

SEQ ID NO: 1066649 - RNA, 14 nt, Homo sapiens
uggcuccacuggga

SEQ ID NO: 1066650 - RNA, 17 nt, Homo sapiens
uggcuccaggacagacc

SEQ ID NO: 1066651 - RNA, 14 nt, Homo sapiens
uggcuuacuccagg

SEQ ID NO: 1066652 - RNA, 18 nt, Homo sapiens
ugggaaaaaaacauacac

SEQ ID NO: 1066653 - RNA, 15 nt, Homo sapiens
ugggaggccagugag

SEQ ID NO: 1066654 - RNA, 20 nt, Homo sapiens
ugggauccuauugaaccaug

SEQ ID NO: 1066655 - RNA, 16 nt, Homo sapiens
ugggcaauauagcaag

SEQ ID NO: 1066656 - RNA, 13 nt, Homo sapiens
ugggcccacaaag

SEQ ID NO: 1066657 - RNA, 20 nt, Homo sapiens
ugggcgagcgguaaauccua

SEQ ID NO: 1066658 - RNA, 17 nt, Homo sapiens
uggggagacuucuuggc

SEQ ID NO: 1066659 - RNA, 18 nt, Homo sapiens
uggggcuuuuacaccagu

SEQ ID NO: 1066660 - RNA, 18 nt, Homo sapiens
ugggguuggaacauuuca

SEQ ID NO: 1066661 - RNA, 13 nt, Homo sapiens
uggguucauccua

SEQ ID NO: 1066662 - RNA, 17 nt, Homo sapiens
ugguauauucagucucu

SEQ ID NO: 1066663 - RNA, 20 nt, Homo sapiens
ugguauauucagucucugug

SEQ ID NO: 1066664 - RNA, 18 nt, Homo sapiens
ugguccugcagaagcaga

SEQ ID NO: 1066665 - RNA, 14 nt, Homo sapiens
uggugaaaugcaga

SEQ ID NO: 1066666 - RNA, 21 nt, Homo sapiens
uggugagcuuaacccuggaaa

SEQ ID NO: 1066667 - RNA, 19 nt, Homo sapiens
ugguuaacgccuucauuua

SEQ ID NO: 1066668 - RNA, 17 nt, Homo sapiens
ugguucuuagaccucaa

SEQ ID NO: 1066669 - RNA, 22 nt, Homo sapiens
uguaaaaaaaaaaaacauacau

SEQ ID NO: 1066670 - RNA, 16 nt, Homo sapiens
uguaacuuccauguga

SEQ ID NO: 1066671 - RNA, 14 nt, Homo sapiens
uguaaggacgccuu

SEQ ID NO: 1066672 - RNA, 11 nt, Homo sapiens
uguacaggaug

SEQ ID NO: 1066673 - RNA, 18 nt, Homo sapiens
uguacauauuuacagacu

SEQ ID NO: 1066674 - RNA, 17 nt, Homo sapiens
uguagauucacauacag

SEQ ID NO: 1066675 - RNA, 18 nt, Homo sapiens
uguaguaguaauauugcu

SEQ ID NO: 1066676 - RNA, 17 nt, Homo sapiens
uguagucucgaccuccc

SEQ ID NO: 1066677 - RNA, 16 nt, Homo sapiens
ugucaacaugaacaaa

SEQ ID NO: 1066678 - RNA, 12 nt, Homo sapiens
ugucacagggac

SEQ ID NO: 1066679 - RNA, 18 nt, Homo sapiens
ugucaguaguuucuuauu

SEQ ID NO: 1066680 - RNA, 19 nt, Homo sapiens
ugucaucuuucuuguuuca

SEQ ID NO: 1066681 - RNA, 12 nt, Homo sapiens
ugucccuaguaa

SEQ ID NO: 1066682 - RNA, 16 nt, Homo sapiens
uguccucccaccucag

SEQ ID NO: 1066683 - RNA, 18 nt, Homo sapiens
ugucucacuucacagccc

SEQ ID NO: 1066684 - RNA, 18 nt, Homo sapiens
ugucucccagcucagggc

SEQ ID NO: 1066685 - RNA, 18 nt, Homo sapiens
ugucuuuuaauuuagcuu

SEQ ID NO: 1066686 - RNA, 16 nt, Homo sapiens
ugugaauaaagugcug

SEQ ID NO: 1066687 - RNA, 18 nt, Homo sapiens
ugugcugggauuacaggc

SEQ ID NO: 1066688 - RNA, 21 nt, Homo sapiens
ugugcuguagauucacauaca

SEQ ID NO: 1066689 - RNA, 18 nt, Homo sapiens
uguguauuuaacagggag

SEQ ID NO: 1066690 - RNA, 14 nt, Homo sapiens
uguuaacuauugua

SEQ ID NO: 1066691 - RNA, 15 nt, Homo sapiens
uguuaauauggugua

SEQ ID NO: 1066692 - RNA, 14 nt, Homo sapiens
uguuacacaugaca

SEQ ID NO: 1066693 - RNA, 20 nt, Homo sapiens
uguuacacaugacacucuuc

SEQ ID NO: 1066694 - RNA, 12 nt, Homo sapiens
uguucuugugaa

SEQ ID NO: 1066695 - RNA, 18 nt, Homo sapiens
uguugguucuuagaccuc

SEQ ID NO: 1066696 - RNA, 21 nt, Homo sapiens
uguuguuuuaggaauacauaa

SEQ ID NO: 1066697 - RNA, 20 nt, Homo sapiens
uguuuuaucauuaccauuaa

SEQ ID NO: 1066698 - RNA, 15 nt, Homo sapiens
uuaaaaucauaaaua

SEQ ID NO: 1066699 - RNA, 17 nt, Homo sapiens
uuaaacaaaugguccau

SEQ ID NO: 1066700 - RNA, 19 nt, Homo sapiens
uuaaacauaggaaagaaga

SEQ ID NO: 1066701 - RNA, 13 nt, Homo sapiens
uuaaaucuugaua

SEQ ID NO: 1066702 - RNA, 16 nt, Homo sapiens
uuaaauuacaguauau

SEQ ID NO: 1066703 - RNA, 11 nt, Homo sapiens
aaaaaaaagca

SEQ ID NO: 1066704 - RNA, 20 nt, Homo sapiens
aaaaaacguauugcauuuaa

SEQ ID NO: 1066705 - RNA, 12 nt, Homo sapiens
aaaaacaugugg

SEQ ID NO: 1066706 - RNA, 16 nt, Homo sapiens
aaaaagcaugaucuga

SEQ ID NO: 1066707 - RNA, 19 nt, Homo sapiens
aaaaagucauaaaauguau

SEQ ID NO: 1066708 - RNA, 17 nt, Homo sapiens
aaaaauacucacauggc

SEQ ID NO: 1066709 - RNA, 16 nt, Homo sapiens
aaaacaugugguuaca

SEQ ID NO: 1066710 - RNA, 23 nt, Homo sapiens
aaaacugaaagugaaaguccaga

SEQ ID NO: 1066711 - RNA, 13 nt, Homo sapiens
aaaagucagucuu

SEQ ID NO: 1066712 - RNA, 14 nt, Homo sapiens
aaaagucagucuua

SEQ ID NO: 1066713 - RNA, 19 nt, Homo sapiens
aaaaucaugccauugcacu

SEQ ID NO: 1066714 - RNA, 21 nt, Homo sapiens
aaaaugaagaaaagagucuau

SEQ ID NO: 1066715 - RNA, 19 nt, Homo sapiens
aaaauguuuugauggucuu

SEQ ID NO: 1066716 - RNA, 19 nt, Homo sapiens
aaacaaguguucuguaucu

SEQ ID NO: 1066717 - RNA, 23 nt, Homo sapiens
aaacaugugguuaaugccaugga

SEQ ID NO: 1066718 - RNA, 16 nt, Homo sapiens
aaacccagugucagga

SEQ ID NO: 1066719 - RNA, 13 nt, Homo sapiens
aaacgaaucauug

SEQ ID NO: 1066720 - RNA, 13 nt, Homo sapiens
aaacucucugaac

SEQ ID NO: 1066721 - RNA, 20 nt, Homo sapiens
aaacuuauccuccaugaaua

SEQ ID NO: 1066722 - RNA, 22 nt, Homo sapiens
aaacuuccagugcaacacugaa

SEQ ID NO: 1066723 - RNA, 22 nt, Homo sapiens
aaacuucuuuaguacuuacauc

SEQ ID NO: 1066724 - RNA, 19 nt, Homo sapiens
aaagaaaaucucugugaaa

SEQ ID NO: 1066725 - RNA, 22 nt, Homo sapiens
aaagccacacucugggcuccag

SEQ ID NO: 1066726 - RNA, 16 nt, Homo sapiens
aaagccccagaaauca

SEQ ID NO: 1066727 - RNA, 17 nt, Homo sapiens
aaagccuucaaacuccc

SEQ ID NO: 1066728 - RNA, 21 nt, Homo sapiens
aaagcggacaucagcugguca

SEQ ID NO: 1066729 - RNA, 16 nt, Homo sapiens
aaaggagccuaggcca

SEQ ID NO: 1066730 - RNA, 14 nt, Homo sapiens
aaagguccuggcaa

SEQ ID NO: 1066731 - RNA, 23 nt, Homo sapiens
aaaggugagcccucauagggaga

SEQ ID NO: 1066732 - RNA, 19 nt, Homo sapiens
aaauauacacacagcagua

SEQ ID NO: 1066733 - RNA, 14 nt, Homo sapiens
aaauauaucacuuu

SEQ ID NO: 1066734 - RNA, 16 nt, Homo sapiens
aaauauuaaguguuua

SEQ ID NO: 1066735 - RNA, 19 nt, Homo sapiens
aaaucaugccauugcacuc

SEQ ID NO: 1066736 - RNA, 21 nt, Homo sapiens
aaaucaugccauugcacucca

SEQ ID NO: 1066737 - RNA, 20 nt, Homo sapiens
aaauccuaaagaaggugaua

SEQ ID NO: 1066738 - RNA, 21 nt, Homo sapiens
aaauccuuuuaaaucuugaua

SEQ ID NO: 1066739 - RNA, 14 nt, Homo sapiens
aaaucugcucagga

SEQ ID NO: 1066740 - RNA, 19 nt, Homo sapiens
aaauguuguuuuaggaaua

SEQ ID NO: 1066741 - RNA, 16 nt, Homo sapiens
aaauucccaacaaaca

SEQ ID NO: 1066742 - RNA, 11 nt, Homo sapiens
aacacauuaag

SEQ ID NO: 1066743 - RNA, 23 nt, Homo sapiens
aacaccagacagacaacacuggg

SEQ ID NO: 1066744 - RNA, 15 nt, Homo sapiens
aacacugaagcucuu

SEQ ID NO: 1066745 - RNA, 14 nt, Homo sapiens
aacagaugccccag

SEQ ID NO: 1066746 - RNA, 23 nt, Homo sapiens
aacauacuucuaaaauucccauu

SEQ ID NO: 1066747 - RNA, 21 nt, Homo sapiens
aacaugugguuaaugccaugg

SEQ ID NO: 1066748 - RNA, 20 nt, Homo sapiens
aacauuggacagugagguca

SEQ ID NO: 1066749 - RNA, 23 nt, Homo sapiens
aacccaaagugugacucauuaaa

SEQ ID NO: 1066750 - RNA, 14 nt, Homo sapiens
aacccagucacugu

SEQ ID NO: 1066751 - RNA, 22 nt, Homo sapiens
aaccuauuucucuuucuuuaca

SEQ ID NO: 1066752 - RNA, 15 nt, Homo sapiens
aaccucauuaucagu

SEQ ID NO: 1066753 - RNA, 15 nt, Homo sapiens
aacgauauguagcag

SEQ ID NO: 1066754 - RNA, 13 nt, Homo sapiens
aacggcaagggaa

SEQ ID NO: 1066755 - RNA, 17 nt, Homo sapiens
aacuauuguauaauggg

SEQ ID NO: 1066756 - RNA, 20 nt, Homo sapiens
aacucaauauuuuccaugaa

SEQ ID NO: 1066757 - RNA, 18 nt, Homo sapiens
aacucucaguggugccug

SEQ ID NO: 1066758 - RNA, 23 nt, Homo sapiens
aacugcccagcggacaguggcag

SEQ ID NO: 1066759 - RNA, 16 nt, Homo sapiens
aacuggaugaggucau

SEQ ID NO: 1066760 - RNA, 16 nt, Homo sapiens
aacuguaccaugugcu

SEQ ID NO: 1066761 - RNA, 19 nt, Homo sapiens
aacuguauuuugaauccuu

SEQ ID NO: 1066762 - RNA, 18 nt, Homo sapiens
aacuucgaccuacugaaa

SEQ ID NO: 1066763 - RNA, 19 nt, Homo sapiens
aagaaaaaaggccuugaau

SEQ ID NO: 1066764 - RNA, 12 nt, Homo sapiens
aagaacauguag

SEQ ID NO: 1066765 - RNA, 13 nt, Homo sapiens
aagaagggcugca

SEQ ID NO: 1066766 - RNA, 17 nt, Homo sapiens
aagaaguucacaucaga

SEQ ID NO: 1066767 - RNA, 15 nt, Homo sapiens
aagaaguucauuuug

SEQ ID NO: 1066768 - RNA, 16 nt, Homo sapiens
aagaaucagucuugca

SEQ ID NO: 1066769 - RNA, 13 nt, Homo sapiens
aagacaauggcuu

SEQ ID NO: 1066770 - RNA, 17 nt, Homo sapiens
aagacuauugugccuua

SEQ ID NO: 1066771 - RNA, 22 nt, Homo sapiens
aagagagcaacauuuuacccac

SEQ ID NO: 1066772 - RNA, 18 nt, Homo sapiens
aagaguccucugaaugaa

SEQ ID NO: 1066773 - RNA, 23 nt, Homo sapiens
aagaugauggcucauuuacacuc

SEQ ID NO: 1066774 - RNA, 17 nt, Homo sapiens
aagcaaaaagugaugau

SEQ ID NO: 1066775 - RNA, 17 nt, Homo sapiens
aagcaaacccaguguca

SEQ ID NO: 1066776 - RNA, 21 nt, Homo sapiens
aagcaaauagacacagucaua

SEQ ID NO: 1066777 - RNA, 11 nt, Homo sapiens
aagcacacuca

SEQ ID NO: 1066778 - RNA, 14 nt, Homo sapiens
aagcagaagugcaa

SEQ ID NO: 1066779 - RNA, 14 nt, Homo sapiens
aaggaacaucucug

SEQ ID NO: 1066780 - RNA, 15 nt, Homo sapiens
aaggaagccacagcu

SEQ ID NO: 1066781 - RNA, 22 nt, Homo sapiens
aaggaaucauauuccuuuauga

SEQ ID NO: 1066782 - RNA, 20 nt, Homo sapiens
aaggcaggcagaucacuuga

SEQ ID NO: 1066783 - RNA, 17 nt, Homo sapiens
aagggagcuagccagag

SEQ ID NO: 1066784 - RNA, 21 nt, Homo sapiens
aagggcauuaggaguguuuca

SEQ ID NO: 1066785 - RNA, 15 nt, Homo sapiens
aaggggcaggccaga

SEQ ID NO: 1066786 - RNA, 18 nt, Homo sapiens
aagguuaaaaaguucaua

SEQ ID NO: 1066787 - RNA, 18 nt, Homo sapiens
auuaaauguacuuuuuga

SEQ ID NO: 1066788 - RNA, 23 nt, Homo sapiens
auuaaguuguuauuucaguuuua

SEQ ID NO: 1066789 - RNA, 16 nt, Homo sapiens
auuacaggcaugagcu

SEQ ID NO: 1066790 - RNA, 21 nt, Homo sapiens
auuagaguuucaaccaugaag

SEQ ID NO: 1066791 - RNA, 15 nt, Homo sapiens
auuaggacauaacag

SEQ ID NO: 1066792 - RNA, 15 nt, Homo sapiens
auucagucucugugu

SEQ ID NO: 1066793 - RNA, 14 nt, Homo sapiens
auuccgcaccaaua

SEQ ID NO: 1066794 - RNA, 16 nt, Homo sapiens
auuccugagccagugu

SEQ ID NO: 1066795 - RNA, 23 nt, Homo sapiens
auucuccauuuguuaucugggaa

SEQ ID NO: 1066796 - RNA, 15 nt, Homo sapiens
auucucccuccuucc

SEQ ID NO: 1066797 - RNA, 18 nt, Homo sapiens
auucugcucuuugauuca

SEQ ID NO: 1066798 - RNA, 20 nt, Homo sapiens
auucuguguccccucugcau

SEQ ID NO: 1066799 - RNA, 21 nt, Homo sapiens
auugcucucccagcccuugca

SEQ ID NO: 1066800 - RNA, 17 nt, Homo sapiens
auuggguuccauucuca

SEQ ID NO: 1066801 - RNA, 15 nt, Homo sapiens
auuguugauggcuuu

SEQ ID NO: 1066802 - RNA, 17 nt, Homo sapiens
auuuaaucaccacucaa

SEQ ID NO: 1066803 - RNA, 23 nt, Homo sapiens
auuuacuguuuuaggucuagccu

SEQ ID NO: 1066804 - RNA, 16 nt, Homo sapiens
auuuagauaugcaaaa

SEQ ID NO: 1066805 - RNA, 22 nt, Homo sapiens
auuuaugucucagaccacuauu

SEQ ID NO: 1066806 - RNA, 14 nt, Homo sapiens
auuucaccacucaa

SEQ ID NO: 1066807 - RNA, 18 nt, Homo sapiens
auuucucuccucacacac

SEQ ID NO: 1066808 - RNA, 20 nt, Homo sapiens
auuuggaaggcaaagacauu

SEQ ID NO: 1066809 - RNA, 18 nt, Homo sapiens
auuuguggaaaagaaaua

SEQ ID NO: 1066810 - RNA, 20 nt, Homo sapiens
auuuguuaaugguuugaaua

SEQ ID NO: 1066811 - RNA, 14 nt, Homo sapiens
auuuuaauuugaua

SEQ ID NO: 1066812 - RNA, 18 nt, Homo sapiens
auuuuacccacacacaga

SEQ ID NO: 1066813 - RNA, 21 nt, Homo sapiens
auuuuaguaagagauuccuga

SEQ ID NO: 1066814 - RNA, 14 nt, Homo sapiens
auuuuauacauuaa

SEQ ID NO: 1066815 - RNA, 23 nt, Homo sapiens
auuuuccuccaucgcaguguuca

SEQ ID NO: 1066816 - RNA, 17 nt, Homo sapiens
auuuucuaaugugccua

SEQ ID NO: 1066817 - RNA, 15 nt, Homo sapiens
auuuucuucaccucu

SEQ ID NO: 1066818 - RNA, 14 nt, Homo sapiens
auuuugaucuucaa

SEQ ID NO: 1066819 - RNA, 17 nt, Homo sapiens
auuuugggaaaaaaaca

SEQ ID NO: 1066820 - RNA, 18 nt, Homo sapiens
auuuuuuccagucuuccu

SEQ ID NO: 1066821 - RNA, 23 nt, Homo sapiens
auuuuuugguuaagcuuugacac

SEQ ID NO: 1066822 - RNA, 17 nt, Homo sapiens
caaaacaaaaaaaaacu

SEQ ID NO: 1066823 - RNA, 15 nt, Homo sapiens
caaaacuugggaaua

SEQ ID NO: 1066824 - RNA, 14 nt, Homo sapiens
caaaagucagucuu

SEQ ID NO: 1066825 - RNA, 22 nt, Homo sapiens
caaagagaaaaagaaaugcaaa

SEQ ID NO: 1066826 - RNA, 16 nt, Homo sapiens
caaagggggaggcuaa

SEQ ID NO: 1066827 - RNA, 22 nt, Homo sapiens
caaagggggaggcuaaagccca

SEQ ID NO: 1066828 - RNA, 12 nt, Homo sapiens
caacaugacugu

SEQ ID NO: 1066829 - RNA, 23 nt, Homo sapiens
caacaugaugugaaaacccaucu

SEQ ID NO: 1066830 - RNA, 16 nt, Homo sapiens
caaccuaauuaccugu

SEQ ID NO: 1066831 - RNA, 19 nt, Homo sapiens
caagaccuuucaaagccau

SEQ ID NO: 1066832 - RNA, 22 nt, Homo sapiens
caagauucccaggaguucugcu

SEQ ID NO: 1066833 - RNA, 23 nt, Homo sapiens
caaggcggguggaucacuugaga

SEQ ID NO: 1066834 - RNA, 13 nt, Homo sapiens
caagguaacugua

SEQ ID NO: 1066835 - RNA, 15 nt, Homo sapiens
caaguagcauuuacu

SEQ ID NO: 1066836 - RNA, 13 nt, Homo sapiens
caauaaagccuuc

SEQ ID NO: 1066837 - RNA, 15 nt, Homo sapiens
caauaaagccuucaa

SEQ ID NO: 1066838 - RNA, 15 nt, Homo sapiens
caauaccaaauagcu

SEQ ID NO: 1066839 - RNA, 12 nt, Homo sapiens
caauagucaaaa

SEQ ID NO: 1066840 - RNA, 18 nt, Homo sapiens
caauauagcaagauccca

SEQ ID NO: 1066841 - RNA, 15 nt, Homo sapiens
caauauugacuuugu

SEQ ID NO: 1066842 - RNA, 21 nt, Homo sapiens
caaucauauuaauacaaugau

SEQ ID NO: 1066843 - RNA, 18 nt, Homo sapiens
caaugaugcuauuugcaa

SEQ ID NO: 1066844 - RNA, 12 nt, Homo sapiens
caauggcuccuu

SEQ ID NO: 1066845 - RNA, 12 nt, Homo sapiens
caauuaaugaca

SEQ ID NO: 1066846 - RNA, 14 nt, Homo sapiens
cacacacagacugu

SEQ ID NO: 1066847 - RNA, 13 nt, Homo sapiens
cacaccuguaauc

SEQ ID NO: 1066848 - RNA, 16 nt, Homo sapiens
cacagauaaaguuuuc

SEQ ID NO: 1066849 - RNA, 19 nt, Homo sapiens
cacagcaguagcaguagau

SEQ ID NO: 1066850 - RNA, 17 nt, Homo sapiens
cacagcgcuaugcaauu

SEQ ID NO: 1066851 - RNA, 23 nt, Homo sapiens
cacaggccauggauggaaaacgc

SEQ ID NO: 1066852 - RNA, 17 nt, Homo sapiens
cacagggcaccugccac

SEQ ID NO: 1066853 - RNA, 16 nt, Homo sapiens
cacagucaauucugau

SEQ ID NO: 1066854 - RNA, 17 nt, Homo sapiens
cacaguccucauuuacu

SEQ ID NO: 1066855 - RNA, 11 nt, Homo sapiens
cacagugcaua

SEQ ID NO: 1066856 - RNA, 13 nt, Homo sapiens
cacagugugaaua

SEQ ID NO: 1066857 - RNA, 19 nt, Homo sapiens
cacauuggaacagugaauc

SEQ ID NO: 1066858 - RNA, 22 nt, Homo sapiens
caccaaaucaucucucaucacu

SEQ ID NO: 1066859 - RNA, 12 nt, Homo sapiens
caccuacuccag

SEQ ID NO: 1066860 - RNA, 14 nt, Homo sapiens
caccugucauucua

SEQ ID NO: 1066861 - RNA, 20 nt, Homo sapiens
cacgcaggagcacacccagc

SEQ ID NO: 1066862 - RNA, 13 nt, Homo sapiens
cacgccuguaauc

SEQ ID NO: 1066863 - RNA, 15 nt, Homo sapiens
cacggaccaugcgac

SEQ ID NO: 1066864 - RNA, 14 nt, Homo sapiens
cacuacauuacuuc

SEQ ID NO: 1066865 - RNA, 19 nt, Homo sapiens
cacuauucuuaacuauuca

SEQ ID NO: 1066866 - RNA, 16 nt, Homo sapiens
cacuccugcuguaaau

SEQ ID NO: 1066867 - RNA, 14 nt, Homo sapiens
cacugagcugaggg

SEQ ID NO: 1066868 - RNA, 15 nt, Homo sapiens
cacugggaaacagag

SEQ ID NO: 1066869 - RNA, 15 nt, Homo sapiens
cacuguagucucgac

SEQ ID NO: 1066870 - RNA, 14 nt, Homo sapiens
cacuucucuuccuu

SEQ ID NO: 1066871 - RNA, 12 nt, Homo sapiens
cacuucuuucag

SEQ ID NO: 1066872 - RNA, 22 nt, Homo sapiens
cagaacacugucuugaagacaa

SEQ ID NO: 1066873 - RNA, 16 nt, Homo sapiens
cagaagagaauuagaa

SEQ ID NO: 1066874 - RNA, 12 nt, Homo sapiens
cagaagugcaau

SEQ ID NO: 1066875 - RNA, 16 nt, Homo sapiens
cagaaucccguaacac

SEQ ID NO: 1066876 - RNA, 18 nt, Homo sapiens
cagaaucccguaacaccu

SEQ ID NO: 1066877 - RNA, 12 nt, Homo sapiens
cagacaacacug

SEQ ID NO: 1066878 - RNA, 16 nt, Homo sapiens
cagacaacacugggaa

SEQ ID NO: 1066879 - RNA, 18 nt, Homo sapiens
cagaccuucaacuuccaa

SEQ ID NO: 1066880 - RNA, 20 nt, Homo sapiens
cagaccuuuuaacuccucaa

SEQ ID NO: 1066881 - RNA, 19 nt, Homo sapiens
cagacggcuccacuaggac

SEQ ID NO: 1066882 - RNA, 18 nt, Homo sapiens
cagacuccuaacuacagg

SEQ ID NO: 1066883 - RNA, 20 nt, Homo sapiens
cagacugaucaggaccucca

SEQ ID NO: 1066884 - RNA, 14 nt, Homo sapiens
cagagacagcuuga

SEQ ID NO: 1066885 - RNA, 21 nt, Homo sapiens
cagaggauaauuagcaucuca

SEQ ID NO: 1066886 - RNA, 19 nt, Homo sapiens
cagaggcagcuucuuugcc

SEQ ID NO: 1066887 - RNA, 20 nt, Homo sapiens
cagauacugucucuuucaug

SEQ ID NO: 1066888 - RNA, 16 nt, Homo sapiens
cagaugcaaugacuca

SEQ ID NO: 1066889 - RNA, 20 nt, Homo sapiens
cagauuauccuuccuccuca

SEQ ID NO: 1066890 - RNA, 18 nt, Homo sapiens
cagauuccgcaccaauaa

SEQ ID NO: 1066891 - RNA, 20 nt, Homo sapiens
cagccacaucgccugagauu

SEQ ID NO: 1066892 - RNA, 19 nt, Homo sapiens
cagccucccaaguagcuga

SEQ ID NO: 1066893 - RNA, 20 nt, Homo sapiens
cagccucccaaguagcugag

SEQ ID NO: 1066894 - RNA, 14 nt, Homo sapiens
cagccucccagugu

SEQ ID NO: 1066895 - RNA, 15 nt, Homo sapiens
cagcggacaguggca

SEQ ID NO: 1066896 - RNA, 14 nt, Homo sapiens
cagcguacucauca

SEQ ID NO: 1066897 - RNA, 19 nt, Homo sapiens
cagcucuuccgaaaaccag

SEQ ID NO: 1066898 - RNA, 22 nt, Homo sapiens
caggaaucgguggucuccaccu

SEQ ID NO: 1066899 - RNA, 20 nt, Homo sapiens
caggacucaaucuacaggcc

SEQ ID NO: 1066900 - RNA, 23 nt, Homo sapiens
caggagauguaggaggggaacua

SEQ ID NO: 1066901 - RNA, 20 nt, Homo sapiens
caggaguucgagaccagccu

SEQ ID NO: 1066902 - RNA, 15 nt, Homo sapiens
caggccaggccagcu

SEQ ID NO: 1066903 - RNA, 16 nt, Homo sapiens
caggccuuaucuccaa

SEQ ID NO: 1066904 - RNA, 14 nt, Homo sapiens
caggcucgucauug

SEQ ID NO: 1066905 - RNA, 14 nt, Homo sapiens
caggcugcauuugu

SEQ ID NO: 1066906 - RNA, 16 nt, Homo sapiens
acccgcagaguucuca

SEQ ID NO: 1066907 - RNA, 20 nt, Homo sapiens
acccuaaggucauuaccaca

SEQ ID NO: 1066908 - RNA, 23 nt, Homo sapiens
acccugggccuggcagcucagcu

SEQ ID NO: 1066909 - RNA, 16 nt, Homo sapiens
accuccaagccacuga

SEQ ID NO: 1066910 - RNA, 18 nt, Homo sapiens
accugggcaauauagcaa

SEQ ID NO: 1066911 - RNA, 18 nt, Homo sapiens
accuguaauccuagcacu

SEQ ID NO: 1066912 - RNA, 13 nt, Homo sapiens
accuucaggaaau

SEQ ID NO: 1066913 - RNA, 16 nt, Homo sapiens
accuucaggaaauaua

SEQ ID NO: 1066914 - RNA, 16 nt, Homo sapiens
accuucauaugcagua

SEQ ID NO: 1066915 - RNA, 20 nt, Homo sapiens
accuugaugagcugugcaca

SEQ ID NO: 1066916 - RNA, 23 nt, Homo sapiens
accuuucuccuuuguacuuugug

SEQ ID NO: 1066917 - RNA, 18 nt, Homo sapiens
accuuuggugcuuuccag

SEQ ID NO: 1066918 - RNA, 16 nt, Homo sapiens
accuuuuaacuccuca

SEQ ID NO: 1066919 - RNA, 22 nt, Homo sapiens
accuuuuaacuccucaauucca

SEQ ID NO: 1066920 - RNA, 17 nt, Homo sapiens
acgcagacacugagauc

SEQ ID NO: 1066921 - RNA, 13 nt, Homo sapiens
acggcucacugua

SEQ ID NO: 1066922 - RNA, 14 nt, Homo sapiens
acgucacuucaugc

SEQ ID NO: 1066923 - RNA, 13 nt, Homo sapiens
acuaauugucaca

SEQ ID NO: 1066924 - RNA, 21 nt, Homo sapiens
acuaggauacugcugcgucau

SEQ ID NO: 1066925 - RNA, 17 nt, Homo sapiens
acuauauuuauacugua

SEQ ID NO: 1066926 - RNA, 18 nt, Homo sapiens
acuauauuuauacuguau

SEQ ID NO: 1066927 - RNA, 18 nt, Homo sapiens
acuauccaacuuaacaug

SEQ ID NO: 1066928 - RNA, 14 nt, Homo sapiens
acucaaaggccaga

SEQ ID NO: 1066929 - RNA, 23 nt, Homo sapiens
acucagaagggagcuagccagag

SEQ ID NO: 1066930 - RNA, 15 nt, Homo sapiens
acucagcucuuggcu

SEQ ID NO: 1066931 - RNA, 11 nt, Homo sapiens
acucucugaac

SEQ ID NO: 1066932 - RNA, 13 nt, Homo sapiens
acucugggcucca

SEQ ID NO: 1066933 - RNA, 19 nt, Homo sapiens
acucugugucugaguggcu

SEQ ID NO: 1066934 - RNA, 15 nt, Homo sapiens
acugaaaaccucucc

SEQ ID NO: 1066935 - RNA, 14 nt, Homo sapiens
acugaaagugaaag

SEQ ID NO: 1066936 - RNA, 16 nt, Homo sapiens
acugaagcuguucuca

SEQ ID NO: 1066937 - RNA, 13 nt, Homo sapiens
acugagaucuguu

SEQ ID NO: 1066938 - RNA, 19 nt, Homo sapiens
acugcaaaucugccugaua

SEQ ID NO: 1066939 - RNA, 20 nt, Homo sapiens
acugcauaccaaccugggca

SEQ ID NO: 1066940 - RNA, 21 nt, Homo sapiens
acuguaaagcuuugugcagau

SEQ ID NO: 1066941 - RNA, 13 nt, Homo sapiens
acugucagccuca

SEQ ID NO: 1066942 - RNA, 22 nt, Homo sapiens
acuuagucucuaaagaguuuau

SEQ ID NO: 1066943 - RNA, 23 nt, Homo sapiens
acuuauaauuugcauaccauuaa

SEQ ID NO: 1066944 - RNA, 14 nt, Homo sapiens
acuucacgcuuuca

SEQ ID NO: 1066945 - RNA, 16 nt, Homo sapiens
acuucagccaggugaa

SEQ ID NO: 1066946 - RNA, 11 nt, Homo sapiens
acuucagucuu

SEQ ID NO: 1066947 - RNA, 13 nt, Homo sapiens
acuuccagugcaa

SEQ ID NO: 1066948 - RNA, 19 nt, Homo sapiens
acuugagucacaaagaaca

SEQ ID NO: 1066949 - RNA, 13 nt, Homo sapiens
acuugcucuggac

SEQ ID NO: 1066950 - RNA, 21 nt, Homo sapiens
acuugggaauaaaucauagca

SEQ ID NO: 1066951 - RNA, 17 nt, Homo sapiens
acuuuacaaccugaugu

SEQ ID NO: 1066952 - RNA, 14 nt, Homo sapiens
agaaagucucucau

SEQ ID NO: 1066953 - RNA, 20 nt, Homo sapiens
agaaauucaacguuaauaau

SEQ ID NO: 1066954 - RNA, 23 nt, Homo sapiens
agaacuuuauuuccaaguuguuc

SEQ ID NO: 1066955 - RNA, 17 nt, Homo sapiens
agaagaguguggaguca

SEQ ID NO: 1066956 - RNA, 19 nt, Homo sapiens
agaagugcaauccagccca

SEQ ID NO: 1066957 - RNA, 23 nt, Homo sapiens
agaaguucacaucagaacagaca

SEQ ID NO: 1066958 - RNA, 14 nt, Homo sapiens
agaaucaaaaugca

SEQ ID NO: 1066959 - RNA, 16 nt, Homo sapiens
agaaugguauuugaau

SEQ ID NO: 1066960 - RNA, 18 nt, Homo sapiens
agacacugaaauauacac

SEQ ID NO: 1066961 - RNA, 15 nt, Homo sapiens
agacagcuucucauc

SEQ ID NO: 1066962 - RNA, 18 nt, Homo sapiens
agaccugacaccuuucau

SEQ ID NO: 1066963 - RNA, 19 nt, Homo sapiens
agaccuuuuaacuccucaa

SEQ ID NO: 1066964 - RNA, 17 nt, Homo sapiens
agacucaaaugcucaga

SEQ ID NO: 1066965 - RNA, 17 nt, Homo sapiens
agacuccucaguucuug

SEQ ID NO: 1066966 - RNA, 20 nt, Homo sapiens
agacugcaguggacaguccc

SEQ ID NO: 1066967 - RNA, 12 nt, Homo sapiens
agagaaccauga

SEQ ID NO: 1066968 - RNA, 20 nt, Homo sapiens
agaggauaauuagcaucuca

SEQ ID NO: 1066969 - RNA, 14 nt, Homo sapiens
agaguccucugaau

SEQ ID NO: 1066970 - RNA, 20 nt, Homo sapiens
agaguguggagucauucuca

SEQ ID NO: 1066971 - RNA, 18 nt, Homo sapiens
agauacagggaugaggca

SEQ ID NO: 1066972 - RNA, 18 nt, Homo sapiens
agauaccagaauguugcu

SEQ ID NO: 1066973 - RNA, 16 nt, Homo sapiens
agauagcuucacccca

SEQ ID NO: 1066974 - RNA, 23 nt, Homo sapiens
agauaguggggagacuucuuggc

SEQ ID NO: 1066975 - RNA, 19 nt, Homo sapiens
agaucaugucucacuucac

SEQ ID NO: 1066976 - RNA, 20 nt, Homo sapiens
agaucaugucucacuucaca

SEQ ID NO: 1066977 - RNA, 20 nt, Homo sapiens
agaugaagcaaacacauuaa

SEQ ID NO: 1066978 - RNA, 19 nt, Homo sapiens
agaugacacaacugcacuc

SEQ ID NO: 1066979 - RNA, 19 nt, Homo sapiens
agauuacuuuuucuuuaug

SEQ ID NO: 1066980 - RNA, 14 nt, Homo sapiens
agauugacaacgcc

SEQ ID NO: 1066981 - RNA, 17 nt, Homo sapiens
agcaaaagucagucuua

SEQ ID NO: 1066982 - RNA, 14 nt, Homo sapiens
agcaaagaagggaa

SEQ ID NO: 1066983 - RNA, 21 nt, Homo sapiens
agcaauaucauaauuaaugua

SEQ ID NO: 1066984 - RNA, 13 nt, Homo sapiens
agcaauguauaac

SEQ ID NO: 1066985 - RNA, 21 nt, Homo sapiens
agcacuaauucaacauauacc

SEQ ID NO: 1066986 - RNA, 15 nt, Homo sapiens
agcagaaacuuuaca

SEQ ID NO: 1066987 - RNA, 21 nt, Homo sapiens
agcaggcggugggcacccacc

SEQ ID NO: 1066988 - RNA, 21 nt, Homo sapiens
agcaucacuugggauuaauau

SEQ ID NO: 1066989 - RNA, 13 nt, Homo sapiens
aucaagaagggcu

SEQ ID NO: 1066990 - RNA, 16 nt, Homo sapiens
aucagauggcauaaau

SEQ ID NO: 1066991 - RNA, 20 nt, Homo sapiens
aucaggaccuccaagccacu

SEQ ID NO: 1066992 - RNA, 19 nt, Homo sapiens
aucaguguuggccaugaug

SEQ ID NO: 1066993 - RNA, 14 nt, Homo sapiens
aucaugcugagaga

SEQ ID NO: 1066994 - RNA, 15 nt, Homo sapiens
auccacuucuuucag

SEQ ID NO: 1066995 - RNA, 14 nt, Homo sapiens
auccaggaggcaga

SEQ ID NO: 1066996 - RNA, 20 nt, Homo sapiens
auccauccucacugcuguca

SEQ ID NO: 1066997 - RNA, 17 nt, Homo sapiens
aucccagcuacucgaga

SEQ ID NO: 1066998 - RNA, 21 nt, Homo sapiens
auccccuugucugaacuggag

SEQ ID NO: 1066999 - RNA, 15 nt, Homo sapiens
auccgggaucaaagu

SEQ ID NO: 1067000 - RNA, 20 nt, Homo sapiens
auccuaaagaaggugauaaa

SEQ ID NO: 1067001 - RNA, 15 nt, Homo sapiens
auccucccaccucag

SEQ ID NO: 1067002 - RNA, 20 nt, Homo sapiens
auccucccaccucagcuucu

SEQ ID NO: 1067003 - RNA, 15 nt, Homo sapiens
auccuuaaaggugag

SEQ ID NO: 1067004 - RNA, 17 nt, Homo sapiens
auccuuugccucaagga

SEQ ID NO: 1067005 - RNA, 12 nt, Homo sapiens
aucgaagcagau

SEQ ID NO: 1067006 - RNA, 17 nt, Homo sapiens
aucucccuucacaaguu

SEQ ID NO: 1067007 - RNA, 16 nt, Homo sapiens
aucucugcuuucacuc

SEQ ID NO: 1067008 - RNA, 15 nt, Homo sapiens
aucugagaaacaaug

SEQ ID NO: 1067009 - RNA, 20 nt, Homo sapiens
aucugaguugacuugacaga

SEQ ID NO: 1067010 - RNA, 16 nt, Homo sapiens
aucuuccaugcuacau

SEQ ID NO: 1067011 - RNA, 22 nt, Homo sapiens
aucuuugcuuuauaaaagaaca

SEQ ID NO: 1067012 - RNA, 18 nt, Homo sapiens
augaaaaagauauaugaa

SEQ ID NO: 1067013 - RNA, 23 nt, Homo sapiens
augaacgauauguagcagaaagg

SEQ ID NO: 1067014 - RNA, 14 nt, Homo sapiens
augaacuuuccaca

SEQ ID NO: 1067015 - RNA, 22 nt, Homo sapiens
augaagacaucuuauccauccu

SEQ ID NO: 1067016 - RNA, 16 nt, Homo sapiens
augacacucuucugaa

SEQ ID NO: 1067017 - RNA, 14 nt, Homo sapiens
augaggcugcuuau

SEQ ID NO: 1067018 - RNA, 14 nt, Homo sapiens
augaucaguaugaa

SEQ ID NO: 1067019 - RNA, 16 nt, Homo sapiens
augcaaugacucagga

SEQ ID NO: 1067020 - RNA, 20 nt, Homo sapiens
augcaccaaaucaucucuca

SEQ ID NO: 1067021 - RNA, 14 nt, Homo sapiens
augccaaauucuua

SEQ ID NO: 1067022 - RNA, 19 nt, Homo sapiens
augcuauuugcaauuccug

SEQ ID NO: 1067023 - RNA, 19 nt, Homo sapiens
augcugugauugugccuac

SEQ ID NO: 1067024 - RNA, 18 nt, Homo sapiens
augcuuuuggggggcaua

SEQ ID NO: 1067025 - RNA, 14 nt, Homo sapiens
auggcccauucuac

SEQ ID NO: 1067026 - RNA, 16 nt, Homo sapiens
augggaccuauaacug

SEQ ID NO: 1067027 - RNA, 18 nt, Homo sapiens
auguaaaguuauucuuga

SEQ ID NO: 1067028 - RNA, 12 nt, Homo sapiens
auguacaggaug

SEQ ID NO: 1067029 - RNA, 22 nt, Homo sapiens
auguacccuaaggucauuacca

SEQ ID NO: 1067030 - RNA, 18 nt, Homo sapiens
auguacuaggauacugcu

SEQ ID NO: 1067031 - RNA, 17 nt, Homo sapiens
augucucagaccacuau

SEQ ID NO: 1067032 - RNA, 22 nt, Homo sapiens
augugaaaacccaucucuacaa

SEQ ID NO: 1067033 - RNA, 15 nt, Homo sapiens
augugcuuauaucau

SEQ ID NO: 1067034 - RNA, 19 nt, Homo sapiens
augugggucaaggaauuaa

SEQ ID NO: 1067035 - RNA, 24 nt, Homo sapiens
augugguuaaugccauggacagaa

SEQ ID NO: 1067036 - RNA, 21 nt, Homo sapiens
auguugguuuuaauacuugau

SEQ ID NO: 1067037 - RNA, 21 nt, Homo sapiens
auguuguuccuuuugaaagaa

SEQ ID NO: 1067038 - RNA, 22 nt, Homo sapiens
auguuucugucacaucagcucc

SEQ ID NO: 1067039 - RNA, 17 nt, Homo sapiens
auguuuuagccagugau

SEQ ID NO: 1067040 - RNA, 14 nt, Homo sapiens
auuaaaacuaugaa

SEQ ID NO: 1067041 - RNA, 17 nt, Homo sapiens
auuaacaauaagccagu

SEQ ID NO: 1067042 - RNA, 20 nt, Homo sapiens
auuaauauggggaugcagca

SEQ ID NO: 1067043 - RNA, 18 nt, Homo sapiens
auuagaaacaacauagca

SEQ ID NO: 1067044 - RNA, 21 nt, Homo sapiens
auuaguaggcucauuuacugu

SEQ ID NO: 1067045 - RNA, 18 nt, Homo sapiens
auuaugagacacaggaug

SEQ ID NO: 1067046 - RNA, 16 nt, Homo sapiens
auucaaagagcuugaa

SEQ ID NO: 1067047 - RNA, 21 nt, Homo sapiens
auucaaauugacugaagcaaa

SEQ ID NO: 1067048 - RNA, 13 nt, Homo sapiens
auucagccuuuag

SEQ ID NO: 1067049 - RNA, 21 nt, Homo sapiens
auucaguuuucaguagaagaa

SEQ ID NO: 1067050 - RNA, 19 nt, Homo sapiens
auucaucucucuuuaauau

SEQ ID NO: 1067051 - RNA, 20 nt, Homo sapiens
auucauugucucuagagauu

SEQ ID NO: 1067052 - RNA, 16 nt, Homo sapiens
auucccacagcacuaa

SEQ ID NO: 1067053 - RNA, 20 nt, Homo sapiens
auucccaggaguucugcuca

SEQ ID NO: 1067054 - RNA, 21 nt, Homo sapiens
auucccaggaguucugcucau

SEQ ID NO: 1067055 - RNA, 14 nt, Homo sapiens
auuccugagccagu

SEQ ID NO: 1067056 - RNA, 16 nt, Homo sapiens
auuccuuagaaauuag

SEQ ID NO: 1067057 - RNA, 16 nt, Homo sapiens
auucgauccccuguca

SEQ ID NO: 1067058 - RNA, 14 nt, Homo sapiens
auucuacuugcucu

SEQ ID NO: 1067059 - RNA, 15 nt, Homo sapiens
auucuaggccuccug

SEQ ID NO: 1067060 - RNA, 12 nt, Homo sapiens
auucugacccau

SEQ ID NO: 1067061 - RNA, 14 nt, Homo sapiens
auucugcagccaca

SEQ ID NO: 1067062 - RNA, 12 nt, Homo sapiens
auucuuauucaa

SEQ ID NO: 1067063 - RNA, 14 nt, Homo sapiens
auugaacuguacca

SEQ ID NO: 1067064 - RNA, 22 nt, Homo sapiens
auugaagagggccaaacacuga

SEQ ID NO: 1067065 - RNA, 19 nt, Homo sapiens
auugaggcuuuaaaacuua

SEQ ID NO: 1067066 - RNA, 12 nt, Homo sapiens
auugcaccagau

SEQ ID NO: 1067067 - RNA, 19 nt, Homo sapiens
auugcagaggggcccauga

SEQ ID NO: 1067068 - RNA, 16 nt, Homo sapiens
auuggaagcugucaua

SEQ ID NO: 1067069 - RNA, 13 nt, Homo sapiens
auuggacagugag

SEQ ID NO: 1067070 - RNA, 21 nt, Homo sapiens
auuguccccuaaaccaaaaac

SEQ ID NO: 1067071 - RNA, 21 nt, Homo sapiens
auugugccuacgaauagccac

SEQ ID NO: 1067072 - RNA, 12 nt, Homo sapiens
auuuacacucag

SEQ ID NO: 1067073 - RNA, 16 nt, Homo sapiens
auuuacuguugaucag

SEQ ID NO: 1067074 - RNA, 22 nt, Homo sapiens
auuucaccacucaaaggccaga

SEQ ID NO: 1067075 - RNA, 16 nt, Homo sapiens
auuucccccaccccau

SEQ ID NO: 1067076 - RNA, 18 nt, Homo sapiens
auuucuagaggaacuuuu

SEQ ID NO: 1067077 - RNA, 20 nt, Homo sapiens
auuugacuucagccagguga

SEQ ID NO: 1067078 - RNA, 13 nt, Homo sapiens
auuugcauaccau

SEQ ID NO: 1067079 - RNA, 14 nt, Homo sapiens
auuuggccaaacaa

SEQ ID NO: 1067080 - RNA, 15 nt, Homo sapiens
auuuuauacauuaac

SEQ ID NO: 1067081 - RNA, 17 nt, Homo sapiens
auuuucacacaauacaa

SEQ ID NO: 1067082 - RNA, 15 nt, Homo sapiens
auuuuguaacuucca

SEQ ID NO: 1067083 - RNA, 21 nt, Homo sapiens
auuuuucagaccuuuuaacuc

SEQ ID NO: 1067084 - RNA, 17 nt, Homo sapiens
caaaaaaacagacccac

SEQ ID NO: 1067085 - RNA, 14 nt, Homo sapiens
caaaaaaagacagg

SEQ ID NO: 1067086 - RNA, 15 nt, Homo sapiens
caaaaaagcuguauu

SEQ ID NO: 1067087 - RNA, 17 nt, Homo sapiens
caaaacaaaaaaaccuc

SEQ ID NO: 1067088 - RNA, 17 nt, Homo sapiens
caaaacccaacaugacu

SEQ ID NO: 1067089 - RNA, 15 nt, Homo sapiens
caaaagucagucuua

SEQ ID NO: 1067090 - RNA, 20 nt, Homo sapiens
caaaaucaugccauugcacu

SEQ ID NO: 1067091 - RNA, 14 nt, Homo sapiens
caaaccuucacaca

SEQ ID NO: 1067092 - RNA, 14 nt, Homo sapiens
caaaccuucaggaa

SEQ ID NO: 1067093 - RNA, 16 nt, Homo sapiens
caaacuaggggacaaa

SEQ ID NO: 1067094 - RNA, 17 nt, Homo sapiens
caaacuugagucacaaa

SEQ ID NO: 1067095 - RNA, 16 nt, Homo sapiens
caaagacuauucccuu

SEQ ID NO: 1067096 - RNA, 20 nt, Homo sapiens
caaagcacuguuucucucac

SEQ ID NO: 1067097 - RNA, 23 nt, Homo sapiens
caaagccacacucugggcuccag

SEQ ID NO: 1067098 - RNA, 11 nt, Homo sapiens
caaaguuggcg

SEQ ID NO: 1067099 - RNA, 16 nt, Homo sapiens
caaauaaguuacaucu

SEQ ID NO: 1067100 - RNA, 17 nt, Homo sapiens
caaauaaguuacaucua

SEQ ID NO: 1067101 - RNA, 12 nt, Homo sapiens
caaaucaucucu

SEQ ID NO: 1067102 - RNA, 17 nt, Homo sapiens
caacaaauugcccuuua

SEQ ID NO: 1067103 - RNA, 21 nt, Homo sapiens
caacaaauugcccuuuagucu

SEQ ID NO: 1067104 - RNA, 12 nt, Homo sapiens
caacaacaugua

SEQ ID NO: 1067105 - RNA, 13 nt, Homo sapiens
caacaugacuguu

SEQ ID NO: 1067106 - RNA, 14 nt, Homo sapiens
aagcugcucaggga

SEQ ID NO: 1067107 - RNA, 23 nt, Homo sapiens
aagcugcucagggaaaagcagcu

SEQ ID NO: 1067108 - RNA, 13 nt, Homo sapiens
aagcuggucucaa

SEQ ID NO: 1067109 - RNA, 14 nt, Homo sapiens
aagcuguccuccca

SEQ ID NO: 1067110 - RNA, 17 nt, Homo sapiens
aagcuuccuuggcuuuu

SEQ ID NO: 1067111 - RNA, 20 nt, Homo sapiens
aaggaaaaaacuaguauucc

SEQ ID NO: 1067112 - RNA, 20 nt, Homo sapiens
aaggagggcagaucacuuca

SEQ ID NO: 1067113 - RNA, 13 nt, Homo sapiens
aaggcaaaaagca

SEQ ID NO: 1067114 - RNA, 19 nt, Homo sapiens
aaggcagcugguauauuca

SEQ ID NO: 1067115 - RNA, 20 nt, Homo sapiens
aaggcagcugguauauucag

SEQ ID NO: 1067116 - RNA, 19 nt, Homo sapiens
aaggcggguggaucacuug

SEQ ID NO: 1067117 - RNA, 20 nt, Homo sapiens
aaggcggguggaucacuuga

SEQ ID NO: 1067118 - RNA, 21 nt, Homo sapiens
aaggcuuacacccacagugga

SEQ ID NO: 1067119 - RNA, 23 nt, Homo sapiens
aaggcuuacacccacaguggaaa

SEQ ID NO: 1067120 - RNA, 21 nt, Homo sapiens
aagggauaaucaucucuguca

SEQ ID NO: 1067121 - RNA, 14 nt, Homo sapiens
aagggucacaauac

SEQ ID NO: 1067122 - RNA, 18 nt, Homo sapiens
aaguacauaaaguacaua

SEQ ID NO: 1067123 - RNA, 23 nt, Homo sapiens
aaguaugggaaaugagaggcauu

SEQ ID NO: 1067124 - RNA, 21 nt, Homo sapiens
aaguguguuuccugcugacua

SEQ ID NO: 1067125 - RNA, 21 nt, Homo sapiens
aaguucacaucagaacagaca

SEQ ID NO: 1067126 - RNA, 17 nt, Homo sapiens
aaguuuagugcccucau

SEQ ID NO: 1067127 - RNA, 16 nt, Homo sapiens
aaguuuauaugcuucu

SEQ ID NO: 1067128 - RNA, 17 nt, Homo sapiens
aauaaaggaguuauuug

SEQ ID NO: 1067129 - RNA, 12 nt, Homo sapiens
aauacaaaaauu

SEQ ID NO: 1067130 - RNA, 18 nt, Homo sapiens
aauacaauaaguuaacua

SEQ ID NO: 1067131 - RNA, 20 nt, Homo sapiens
aauacauaaaguaugugcau

SEQ ID NO: 1067132 - RNA, 14 nt, Homo sapiens
aauagaucuuuuca

SEQ ID NO: 1067133 - RNA, 13 nt, Homo sapiens
aauauaauacugu

SEQ ID NO: 1067134 - RNA, 21 nt, Homo sapiens
aauauaucacuuuugauacaa

SEQ ID NO: 1067135 - RNA, 17 nt, Homo sapiens
aauauuuuacaguuuuu

SEQ ID NO: 1067136 - RNA, 19 nt, Homo sapiens
aaucauaaauauaaucuaa

SEQ ID NO: 1067137 - RNA, 16 nt, Homo sapiens
aaucaugccauugcac

SEQ ID NO: 1067138 - RNA, 21 nt, Homo sapiens
aaucaugccauugcacuccag

SEQ ID NO: 1067139 - RNA, 16 nt, Homo sapiens
aaucccagcacuuugg

SEQ ID NO: 1067140 - RNA, 16 nt, Homo sapiens
aaucccagcuaccuca

SEQ ID NO: 1067141 - RNA, 17 nt, Homo sapiens
aaucuccaccagucauu

SEQ ID NO: 1067142 - RNA, 17 nt, Homo sapiens
aaucucugaauuugaga

SEQ ID NO: 1067143 - RNA, 18 nt, Homo sapiens
aaucucugaauuugagau

SEQ ID NO: 1067144 - RNA, 14 nt, Homo sapiens
aaucugauauguau

SEQ ID NO: 1067145 - RNA, 23 nt, Homo sapiens
aaucugccugauaggacccauau

SEQ ID NO: 1067146 - RNA, 16 nt, Homo sapiens
aaugaucauuaggaca

SEQ ID NO: 1067147 - RNA, 13 nt, Homo sapiens
aaugcaaaaaucu

SEQ ID NO: 1067148 - RNA, 15 nt, Homo sapiens
aaugcagucugucca

SEQ ID NO: 1067149 - RNA, 16 nt, Homo sapiens
aaugcagucuguccag

SEQ ID NO: 1067150 - RNA, 14 nt, Homo sapiens
aauggcagcugcca

SEQ ID NO: 1067151 - RNA, 14 nt, Homo sapiens
aauggggccuguua

SEQ ID NO: 1067152 - RNA, 17 nt, Homo sapiens
aauggugaaaugcagag

SEQ ID NO: 1067153 - RNA, 15 nt, Homo sapiens
aauguaaacaauauc

SEQ ID NO: 1067154 - RNA, 18 nt, Homo sapiens
aauguauuuucuucaccu

SEQ ID NO: 1067155 - RNA, 14 nt, Homo sapiens
aaugucaaacuuga

SEQ ID NO: 1067156 - RNA, 17 nt, Homo sapiens
aaugugacgaaagugga

SEQ ID NO: 1067157 - RNA, 19 nt, Homo sapiens
aaugugucuuucuuuuugg

SEQ ID NO: 1067158 - RNA, 15 nt, Homo sapiens
aauguugcuuucuga

SEQ ID NO: 1067159 - RNA, 15 nt, Homo sapiens
aauguuuuguaaaua

SEQ ID NO: 1067160 - RNA, 12 nt, Homo sapiens
aauuaacacugc

SEQ ID NO: 1067161 - RNA, 22 nt, Homo sapiens
aauuauuuaugugaaagucaaa

SEQ ID NO: 1067162 - RNA, 14 nt, Homo sapiens
aauuccaacacuga

SEQ ID NO: 1067163 - RNA, 21 nt, Homo sapiens
aauucugggaagcaaaaccca

SEQ ID NO: 1067164 - RNA, 14 nt, Homo sapiens
aauugccuaaagag

SEQ ID NO: 1067165 - RNA, 20 nt, Homo sapiens
aauuggucccaagacaugaa

SEQ ID NO: 1067166 - RNA, 22 nt, Homo sapiens
aauuuauuuuuaccuucacugu

SEQ ID NO: 1067167 - RNA, 19 nt, Homo sapiens
aauuuucaaggagaaucaa

SEQ ID NO: 1067168 - RNA, 17 nt, Homo sapiens
aauuuuguucucuggga

SEQ ID NO: 1067169 - RNA, 20 nt, Homo sapiens
aauuuuguucucugggagaa

SEQ ID NO: 1067170 - RNA, 15 nt, Homo sapiens
aauuuuuaaugcuua

SEQ ID NO: 1067171 - RNA, 13 nt, Homo sapiens
acaaaaaaaccuc

SEQ ID NO: 1067172 - RNA, 14 nt, Homo sapiens
acaaaacaaaacaa

SEQ ID NO: 1067173 - RNA, 19 nt, Homo sapiens
acaaaggcaaaggguccag

SEQ ID NO: 1067174 - RNA, 13 nt, Homo sapiens
acaacacugggaa

SEQ ID NO: 1067175 - RNA, 18 nt, Homo sapiens
acaagcccccccuuccac

SEQ ID NO: 1067176 - RNA, 11 nt, Homo sapiens
acaaguccagc

SEQ ID NO: 1067177 - RNA, 17 nt, Homo sapiens
acaaguggcaaccugcu

SEQ ID NO: 1067178 - RNA, 13 nt, Homo sapiens
acaauagucaaaa

SEQ ID NO: 1067179 - RNA, 18 nt, Homo sapiens
acaaugaugcuauuugca

SEQ ID NO: 1067180 - RNA, 21 nt, Homo sapiens
acacaacauauccguauauau

SEQ ID NO: 1067181 - RNA, 12 nt, Homo sapiens
acacaaggucau

SEQ ID NO: 1067182 - RNA, 15 nt, Homo sapiens
acacagacuguuguc

SEQ ID NO: 1067183 - RNA, 18 nt, Homo sapiens
acacaggccugcucucuu

SEQ ID NO: 1067184 - RNA, 17 nt, Homo sapiens
acacaugacacucuucu

SEQ ID NO: 1067185 - RNA, 14 nt, Homo sapiens
acacauuaagccuu

SEQ ID NO: 1067186 - RNA, 19 nt, Homo sapiens
acacauuaagccuuccaca

SEQ ID NO: 1067187 - RNA, 15 nt, Homo sapiens
acacuaauacaccag

SEQ ID NO: 1067188 - RNA, 17 nt, Homo sapiens
acacuaauacaccaggu

SEQ ID NO: 1067189 - RNA, 22 nt, Homo sapiens
acacucuucugaauugacugua

SEQ ID NO: 1067190 - RNA, 14 nt, Homo sapiens
acacugaagcucuu

SEQ ID NO: 1067191 - RNA, 15 nt, Homo sapiens
cuauuaaaacucuuu

SEQ ID NO: 1067192 - RNA, 21 nt, Homo sapiens
cuauucccuucuaaccugaac

SEQ ID NO: 1067193 - RNA, 18 nt, Homo sapiens
cuauucuugcugaugaaa

SEQ ID NO: 1067194 - RNA, 17 nt, Homo sapiens
cuauuugagacuccuca

SEQ ID NO: 1067195 - RNA, 21 nt, Homo sapiens
cucaaaggccagaccugcaga

SEQ ID NO: 1067196 - RNA, 23 nt, Homo sapiens
cucaagcgauccucccaccucag

SEQ ID NO: 1067197 - RNA, 21 nt, Homo sapiens
cucaaguagcauuuacugugu

SEQ ID NO: 1067198 - RNA, 14 nt, Homo sapiens
cucaccuacuccag

SEQ ID NO: 1067199 - RNA, 15 nt, Homo sapiens
cucagggcacaaaga

SEQ ID NO: 1067200 - RNA, 19 nt, Homo sapiens
cucaguggugccugcauuu

SEQ ID NO: 1067201 - RNA, 17 nt, Homo sapiens
cucauacuuaagcaaaa

SEQ ID NO: 1067202 - RNA, 11 nt, Homo sapiens
cucauuuacug

SEQ ID NO: 1067203 - RNA, 17 nt, Homo sapiens
cuccaagccacugagca

SEQ ID NO: 1067204 - RNA, 17 nt, Homo sapiens
cuccagggucagaaaca

SEQ ID NO: 1067205 - RNA, 18 nt, Homo sapiens
cuccucacucaccuucag

SEQ ID NO: 1067206 - RNA, 11 nt, Homo sapiens
cuccugaggga

SEQ ID NO: 1067207 - RNA, 20 nt, Homo sapiens
cuccuggcccaggugagucc

SEQ ID NO: 1067208 - RNA, 20 nt, Homo sapiens
cuccugggcucaagcgaucc

SEQ ID NO: 1067209 - RNA, 21 nt, Homo sapiens
cucuacuaaaacuacaaaaau

SEQ ID NO: 1067210 - RNA, 21 nt, Homo sapiens
cucuaugacauugauuggaau

SEQ ID NO: 1067211 - RNA, 20 nt, Homo sapiens
cucugaaugaaccuucuggc

SEQ ID NO: 1067212 - RNA, 19 nt, Homo sapiens
cucugaauuugagauacaa

SEQ ID NO: 1067213 - RNA, 15 nt, Homo sapiens
cucugggcuccagag

SEQ ID NO: 1067214 - RNA, 16 nt, Homo sapiens
cucuugaagacacuga

SEQ ID NO: 1067215 - RNA, 19 nt, Homo sapiens
cucuuggcuccacugggau

SEQ ID NO: 1067216 - RNA, 18 nt, Homo sapiens
cugaacuuacuugccuca

SEQ ID NO: 1067217 - RNA, 19 nt, Homo sapiens
cugaagcaaagaagggaau

SEQ ID NO: 1067218 - RNA, 20 nt, Homo sapiens
cugaagucaguuucuaucau

SEQ ID NO: 1067219 - RNA, 19 nt, Homo sapiens
cugaauguuagauaguuac

SEQ ID NO: 1067220 - RNA, 20 nt, Homo sapiens
cugaauguuagauaguuacu

SEQ ID NO: 1067221 - RNA, 12 nt, Homo sapiens
cugacacaguca

SEQ ID NO: 1067222 - RNA, 14 nt, Homo sapiens
cugaccugguccac

SEQ ID NO: 1067223 - RNA, 23 nt, Homo sapiens
cugagcagugcuugaaugaaguu

SEQ ID NO: 1067224 - RNA, 18 nt, Homo sapiens
cugaguccaacaauguug

SEQ ID NO: 1067225 - RNA, 19 nt, Homo sapiens
cugcaguggacagucccca

SEQ ID NO: 1067226 - RNA, 21 nt, Homo sapiens
cugcauaccaaccugggcaau

SEQ ID NO: 1067227 - RNA, 13 nt, Homo sapiens
cugccaaggugaa

SEQ ID NO: 1067228 - RNA, 22 nt, Homo sapiens
cugccacgccgcccuaaaagca

SEQ ID NO: 1067229 - RNA, 18 nt, Homo sapiens
cugccagggccagucuug

SEQ ID NO: 1067230 - RNA, 14 nt, Homo sapiens
cugcccagcacagg

SEQ ID NO: 1067231 - RNA, 17 nt, Homo sapiens
cugcccuuggcacccaa

SEQ ID NO: 1067232 - RNA, 15 nt, Homo sapiens
cugccuuccagccac

SEQ ID NO: 1067233 - RNA, 12 nt, Homo sapiens
cugcuccagaag

SEQ ID NO: 1067234 - RNA, 23 nt, Homo sapiens
cugcugccauacuguaugcagua

SEQ ID NO: 1067235 - RNA, 21 nt, Homo sapiens
cugcuggagugaaggggccaa

SEQ ID NO: 1067236 - RNA, 15 nt, Homo sapiens
cuggaaacauucagg

SEQ ID NO: 1067237 - RNA, 17 nt, Homo sapiens
cuggccaauacggcaaa

SEQ ID NO: 1067238 - RNA, 15 nt, Homo sapiens
cugggcaauauagca

SEQ ID NO: 1067239 - RNA, 17 nt, Homo sapiens
cugggccuggcagcuca

SEQ ID NO: 1067240 - RNA, 13 nt, Homo sapiens
cugggcugaggca

SEQ ID NO: 1067241 - RNA, 13 nt, Homo sapiens
cuguaaauuuggc

SEQ ID NO: 1067242 - RNA, 13 nt, Homo sapiens
cuguaccaugugc

SEQ ID NO: 1067243 - RNA, 15 nt, Homo sapiens
cugugggccaaaauc

SEQ ID NO: 1067244 - RNA, 17 nt, Homo sapiens
cuguggugagccaagau

SEQ ID NO: 1067245 - RNA, 18 nt, Homo sapiens
cuguggugguugugaucc

SEQ ID NO: 1067246 - RNA, 16 nt, Homo sapiens
cugugucagaaacuga

SEQ ID NO: 1067247 - RNA, 16 nt, Homo sapiens
cuguuuuguaaagucc

SEQ ID NO: 1067248 - RNA, 18 nt, Homo sapiens
cuuacaaacaugugguua

SEQ ID NO: 1067249 - RNA, 15 nt, Homo sapiens
cuuacaucaggaaau

SEQ ID NO: 1067250 - RNA, 13 nt, Homo sapiens
cuuagauugccuc

SEQ ID NO: 1067251 - RNA, 18 nt, Homo sapiens
cuuauaauuugcauacca

SEQ ID NO: 1067252 - RNA, 15 nt, Homo sapiens
cuuauccuccaugaa

SEQ ID NO: 1067253 - RNA, 16 nt, Homo sapiens
cuuaugcuucuuucaa

SEQ ID NO: 1067254 - RNA, 16 nt, Homo sapiens
cuucacaaaccagaga

SEQ ID NO: 1067255 - RNA, 14 nt, Homo sapiens
cuucaccuuaggaa

SEQ ID NO: 1067256 - RNA, 24 nt, Homo sapiens
cuuccagggguuuacagucuauuu

SEQ ID NO: 1067257 - RNA, 20 nt, Homo sapiens
cuuccagugcaacacugaag

SEQ ID NO: 1067258 - RNA, 13 nt, Homo sapiens
cuucccauucucc

SEQ ID NO: 1067259 - RNA, 14 nt, Homo sapiens
cuuccucacaccag

SEQ ID NO: 1067260 - RNA, 23 nt, Homo sapiens
cuuccugagggaucuauacuugc

SEQ ID NO: 1067261 - RNA, 18 nt, Homo sapiens
cuuccuuuugagggagca

SEQ ID NO: 1067262 - RNA, 16 nt, Homo sapiens
cuucgaccuacugaaa

SEQ ID NO: 1067263 - RNA, 20 nt, Homo sapiens
cuucuaaccugaacugaugg

SEQ ID NO: 1067264 - RNA, 20 nt, Homo sapiens
cuucuaagagguagauacca

SEQ ID NO: 1067265 - RNA, 22 nt, Homo sapiens
cuucuauauauuguauguauau

SEQ ID NO: 1067266 - RNA, 16 nt, Homo sapiens
cuucuuacaaugcauu

SEQ ID NO: 1067267 - RNA, 17 nt, Homo sapiens
cuucuuagcaccacaaa

SEQ ID NO: 1067268 - RNA, 22 nt, Homo sapiens
cuucuuugccaagaccuuucaa

SEQ ID NO: 1067269 - RNA, 18 nt, Homo sapiens
cuugaagacaauggcuua

SEQ ID NO: 1067270 - RNA, 20 nt, Homo sapiens
cuugaaucucugaauuugag

SEQ ID NO: 1067271 - RNA, 20 nt, Homo sapiens
cuugaugagcugugcacaaa

SEQ ID NO: 1067272 - RNA, 19 nt, Homo sapiens
cuuggccggauguccucag

SEQ ID NO: 1067273 - RNA, 22 nt, Homo sapiens
cuuggccggauguccucagggc

SEQ ID NO: 1067274 - RNA, 17 nt, Homo sapiens
cuuggcuccacugggau

SEQ ID NO: 1067275 - RNA, 14 nt, Homo sapiens
cuuguguuuuuaac

SEQ ID NO: 1067276 - RNA, 15 nt, Homo sapiens
cuuuaaaacuuaucc

SEQ ID NO: 1067277 - RNA, 17 nt, Homo sapiens
cuuuaaauuaugccguu

SEQ ID NO: 1067278 - RNA, 16 nt, Homo sapiens
cuuuaaccauggugcu

SEQ ID NO: 1067279 - RNA, 12 nt, Homo sapiens
cuuuaguacuua

SEQ ID NO: 1067280 - RNA, 18 nt, Homo sapiens
cuuucaugaguuuuuccc

SEQ ID NO: 1067281 - RNA, 23 nt, Homo sapiens
cuuucauuauagcagagaguuuu

SEQ ID NO: 1067282 - RNA, 17 nt, Homo sapiens
cuuucauucagccuuua

SEQ ID NO: 1067283 - RNA, 13 nt, Homo sapiens
cuuuccacauuca

SEQ ID NO: 1067284 - RNA, 22 nt, Homo sapiens
cuuucuuuuuuaaauaggguug

SEQ ID NO: 1067285 - RNA, 18 nt, Homo sapiens
cuuugcuucucucucuaa

SEQ ID NO: 1067286 - RNA, 14 nt, Homo sapiens
cuuuuaacuccuca

SEQ ID NO: 1067287 - RNA, 19 nt, Homo sapiens
cuuuugcacaucuagugag

SEQ ID NO: 1067288 - RNA, 19 nt, Homo sapiens
cuuuuggugguauguuggu

SEQ ID NO: 1067289 - RNA, 23 nt, Homo sapiens
cuuuuuauacuuuguaaagacaa

SEQ ID NO: 1067290 - RNA, 16 nt, Homo sapiens
gaaaagugaauuucac

SEQ ID NO: 1067291 - RNA, 19 nt, Homo sapiens
gaaacugaagcuguucuca

SEQ ID NO: 1067292 - RNA, 19 nt, Homo sapiens
gaaagaaguucacaucaga

SEQ ID NO: 1067293 - RNA, 18 nt, Homo sapiens
gaaagaaucagucuugca

SEQ ID NO: 1067294 - RNA, 18 nt, Homo sapiens
gaaagacagagcugggau

SEQ ID NO: 1067295 - RNA, 13 nt, Homo sapiens
gaaagauuacuuu

SEQ ID NO: 1067296 - RNA, 17 nt, Homo sapiens
gaaaguggaaauggaga

SEQ ID NO: 1067297 - RNA, 19 nt, Homo sapiens
gaaaguguuuaacuuguca

SEQ ID NO: 1067298 - RNA, 16 nt, Homo sapiens
gaaauaaaggaguuau

SEQ ID NO: 1067299 - RNA, 19 nt, Homo sapiens
gaaauaauuuuuagaaucu

SEQ ID NO: 1067300 - RNA, 12 nt, Homo sapiens
gaaaucuugcaa

SEQ ID NO: 1067301 - RNA, 14 nt, Homo sapiens
gaaaugcagaguca

SEQ ID NO: 1067302 - RNA, 17 nt, Homo sapiens
gaacaagcaaacccaga

SEQ ID NO: 1067303 - RNA, 15 nt, Homo sapiens
gaacacaaggucauu

SEQ ID NO: 1067304 - RNA, 19 nt, Homo sapiens
gaacagacaaucacagcaa

SEQ ID NO: 1067305 - RNA, 13 nt, Homo sapiens
gaacauguagaaa

SEQ ID NO: 1067306 - RNA, 21 nt, Homo sapiens
gaacauuucaguugccauuga

SEQ ID NO: 1067307 - RNA, 10 nt, Homo sapiens
gaaccaugaa

SEQ ID NO: 1067308 - RNA, 19 nt, Homo sapiens
ggagguggagguugcagug

SEQ ID NO: 1067309 - RNA, 19 nt, Homo sapiens
ggaggugucuguaucagug

SEQ ID NO: 1067310 - RNA, 15 nt, Homo sapiens
ggaguggcucuguaa

SEQ ID NO: 1067311 - RNA, 18 nt, Homo sapiens
ggaguucugcucauucua

SEQ ID NO: 1067312 - RNA, 16 nt, Homo sapiens
ggauaauuagcaucuc

SEQ ID NO: 1067313 - RNA, 20 nt, Homo sapiens
ggauccuauugaaccauguu

SEQ ID NO: 1067314 - RNA, 22 nt, Homo sapiens
ggaugugaacaaccugcucaca

SEQ ID NO: 1067315 - RNA, 15 nt, Homo sapiens
ggcacauagugaaag

SEQ ID NO: 1067316 - RNA, 14 nt, Homo sapiens
ggcacccacccugg

SEQ ID NO: 1067317 - RNA, 13 nt, Homo sapiens
ggcaccuguaauc

SEQ ID NO: 1067318 - RNA, 17 nt, Homo sapiens
ggcaccuguaaucccag

SEQ ID NO: 1067319 - RNA, 11 nt, Homo sapiens
ggccacugucc

SEQ ID NO: 1067320 - RNA, 22 nt, Homo sapiens
ggccaucugguuaggauggcag

SEQ ID NO: 1067321 - RNA, 20 nt, Homo sapiens
ggccuccuggcccaggugag

SEQ ID NO: 1067322 - RNA, 22 nt, Homo sapiens
ggcuauuguccccuaaaccaaa

SEQ ID NO: 1067323 - RNA, 13 nt, Homo sapiens
ggcuccacuggga

SEQ ID NO: 1067324 - RNA, 20 nt, Homo sapiens
ggcuuacacccacaguggaa

SEQ ID NO: 1067325 - RNA, 16 nt, Homo sapiens
gggagcaggcgguggg

SEQ ID NO: 1067326 - RNA, 14 nt, Homo sapiens
gggagcugcagggg

SEQ ID NO: 1067327 - RNA, 20 nt, Homo sapiens
gggagguggagguugcagug

SEQ ID NO: 1067328 - RNA, 18 nt, Homo sapiens
gggcaugggaaggugggc

SEQ ID NO: 1067329 - RNA, 18 nt, Homo sapiens
gggcucuucuuggcagag

SEQ ID NO: 1067330 - RNA, 16 nt, Homo sapiens
gggcuuuuacaccagu

SEQ ID NO: 1067331 - RNA, 17 nt, Homo sapiens
ggggcuuuuacaccagu

SEQ ID NO: 1067332 - RNA, 20 nt, Homo sapiens
gggggcuuggcugugcccuc

SEQ ID NO: 1067333 - RNA, 17 nt, Homo sapiens
gggucauagauguuucc

SEQ ID NO: 1067334 - RNA, 19 nt, Homo sapiens
ggguuucacuauguugccu

SEQ ID NO: 1067335 - RNA, 19 nt, Homo sapiens
ggucaaacaaacucucuga

SEQ ID NO: 1067336 - RNA, 16 nt, Homo sapiens
ggucauagauguuucc

SEQ ID NO: 1067337 - RNA, 19 nt, Homo sapiens
ggucauagauguuuccuug

SEQ ID NO: 1067338 - RNA, 12 nt, Homo sapiens
ggucuagccuau

SEQ ID NO: 1067339 - RNA, 16 nt, Homo sapiens
ggucuugggagcucuu

SEQ ID NO: 1067340 - RNA, 18 nt, Homo sapiens
ggugagagggccgggcag

SEQ ID NO: 1067341 - RNA, 12 nt, Homo sapiens
ggugagugcaag

SEQ ID NO: 1067342 - RNA, 16 nt, Homo sapiens
ggugcaaccagggagc

SEQ ID NO: 1067343 - RNA, 13 nt, Homo sapiens
ggugcagccagag

SEQ ID NO: 1067344 - RNA, 17 nt, Homo sapiens
ggugcaugaagguuucu

SEQ ID NO: 1067345 - RNA, 19 nt, Homo sapiens
ggugcaugaagguuucuga

SEQ ID NO: 1067346 - RNA, 16 nt, Homo sapiens
gguuauaaauucaaag

SEQ ID NO: 1067347 - RNA, 19 nt, Homo sapiens
gguuccugagcucacugaa

SEQ ID NO: 1067348 - RNA, 14 nt, Homo sapiens
gguuuacagucuau

SEQ ID NO: 1067349 - RNA, 23 nt, Homo sapiens
gguuuagggaagacauugcaaug

SEQ ID NO: 1067350 - RNA, 18 nt, Homo sapiens
guaaauauuaaguguuua

SEQ ID NO: 1067351 - RNA, 17 nt, Homo sapiens
guaaauccuaaagaagg

SEQ ID NO: 1067352 - RNA, 13 nt, Homo sapiens
guaaucugagaaa

SEQ ID NO: 1067353 - RNA, 13 nt, Homo sapiens
guacauucuuccu

SEQ ID NO: 1067354 - RNA, 12 nt, Homo sapiens
guaccaccaaaa

SEQ ID NO: 1067355 - RNA, 17 nt, Homo sapiens
guaccaugugcuacagg

SEQ ID NO: 1067356 - RNA, 14 nt, Homo sapiens
guacuuacaucagg

SEQ ID NO: 1067357 - RNA, 13 nt, Homo sapiens
guagauaaggaaa

SEQ ID NO: 1067358 - RNA, 20 nt, Homo sapiens
guaggaagaugauggcucau

SEQ ID NO: 1067359 - RNA, 20 nt, Homo sapiens
guaggaggaacagauuugag

SEQ ID NO: 1067360 - RNA, 19 nt, Homo sapiens
guagguaauauugcaaggc

SEQ ID NO: 1067361 - RNA, 14 nt, Homo sapiens
guauacuuccuuau

SEQ ID NO: 1067362 - RNA, 20 nt, Homo sapiens
guauacuuccuuaugcuucu

SEQ ID NO: 1067363 - RNA, 18 nt, Homo sapiens
guauauauguauaugugc

SEQ ID NO: 1067364 - RNA, 13 nt, Homo sapiens
guaucuacuuuaa

SEQ ID NO: 1067365 - RNA, 21 nt, Homo sapiens
guauuccccuuuauguacagg

SEQ ID NO: 1067366 - RNA, 13 nt, Homo sapiens
guauugugcauag

SEQ ID NO: 1067367 - RNA, 19 nt, Homo sapiens
guauuguuugggauccuau

SEQ ID NO: 1067368 - RNA, 11 nt, Homo sapiens
gucacagucca

SEQ ID NO: 1067369 - RNA, 22 nt, Homo sapiens
gucaggggcggggagggugaca

SEQ ID NO: 1067370 - RNA, 14 nt, Homo sapiens
gucauagauguuuc

SEQ ID NO: 1067371 - RNA, 15 nt, Homo sapiens
gucauuggaggugaa

SEQ ID NO: 1067372 - RNA, 20 nt, Homo sapiens
guccagaaggagacaggcag

SEQ ID NO: 1067373 - RNA, 15 nt, Homo sapiens
guccuccaagccagc

SEQ ID NO: 1067374 - RNA, 14 nt, Homo sapiens
gucuaacaguuaau

SEQ ID NO: 1067375 - RNA, 22 nt, Homo sapiens
gucuaacuggggauauaauacu

SEQ ID NO: 1067376 - RNA, 19 nt, Homo sapiens
gucuauuugagacuccuca

SEQ ID NO: 1067377 - RNA, 13 nt, Homo sapiens
gucucauucuguc

SEQ ID NO: 1067378 - RNA, 14 nt, Homo sapiens
gucucuacuaaaaa

SEQ ID NO: 1067379 - RNA, 19 nt, Homo sapiens
gucugaacggcugaauaug

SEQ ID NO: 1067380 - RNA, 18 nt, Homo sapiens
gugcauagagccacguau

SEQ ID NO: 1067381 - RNA, 19 nt, Homo sapiens
gugcuguagauucacauac

SEQ ID NO: 1067382 - RNA, 14 nt, Homo sapiens
gagcucuuugcacu

SEQ ID NO: 1067383 - RNA, 13 nt, Homo sapiens
gagcuggaggcac

SEQ ID NO: 1067384 - RNA, 19 nt, Homo sapiens
gaggaggccguugauucac

SEQ ID NO: 1067385 - RNA, 14 nt, Homo sapiens
gaggcccucauucc

SEQ ID NO: 1067386 - RNA, 19 nt, Homo sapiens
gaggccuuccagggacgaa

SEQ ID NO: 1067387 - RNA, 16 nt, Homo sapiens
gaggugaacaagcaaa

SEQ ID NO: 1067388 - RNA, 22 nt, Homo sapiens
gagucuccaacggcaagggaac

SEQ ID NO: 1067389 - RNA, 19 nt, Homo sapiens
gagugcaggggggcaauca

SEQ ID NO: 1067390 - RNA, 23 nt, Homo sapiens
gaguggcuucacuccugcuguaa

SEQ ID NO: 1067391 - RNA, 14 nt, Homo sapiens
gaguggggaugaca

SEQ ID NO: 1067392 - RNA, 22 nt, Homo sapiens
gaguuagaauaauaaauauuua

SEQ ID NO: 1067393 - RNA, 14 nt, Homo sapiens
gauacugcugccaa

SEQ ID NO: 1067394 - RNA, 19 nt, Homo sapiens
gaucacuucaggucaggag

SEQ ID NO: 1067395 - RNA, 13 nt, Homo sapiens
gauccaagcaaga

SEQ ID NO: 1067396 - RNA, 19 nt, Homo sapiens
gaucuuuuguucccauccu

SEQ ID NO: 1067397 - RNA, 21 nt, Homo sapiens
gaugauagugguggaguuaau

SEQ ID NO: 1067398 - RNA, 16 nt, Homo sapiens
gaugauggcucauuua

SEQ ID NO: 1067399 - RNA, 20 nt, Homo sapiens
gaugcucugaacccugagca

SEQ ID NO: 1067400 - RNA, 15 nt, Homo sapiens
gaugugcuuauauca

SEQ ID NO: 1067401 - RNA, 16 nt, Homo sapiens
gauguuuccuugccuu

SEQ ID NO: 1067402 - RNA, 15 nt, Homo sapiens
gauguuucugucaca

SEQ ID NO: 1067403 - RNA, 12 nt, Homo sapiens
gauucacauaca

SEQ ID NO: 1067404 - RNA, 23 nt, Homo sapiens
gauuccgcaccaauaaagccuuc

SEQ ID NO: 1067405 - RNA, 17 nt, Homo sapiens
gauugccucucuagaca

SEQ ID NO: 1067406 - RNA, 16 nt, Homo sapiens
gcaaaauauaucacuu

SEQ ID NO: 1067407 - RNA, 22 nt, Homo sapiens
gcaacagccacuacauuacuuc

SEQ ID NO: 1067408 - RNA, 20 nt, Homo sapiens
gcaaccagggagcugcaggg

SEQ ID NO: 1067409 - RNA, 18 nt, Homo sapiens
gcaagaucccaucucuuu

SEQ ID NO: 1067410 - RNA, 20 nt, Homo sapiens
gcaaucacggcucacuguag

SEQ ID NO: 1067411 - RNA, 20 nt, Homo sapiens
gcaaugacucaggacauccc

SEQ ID NO: 1067412 - RNA, 12 nt, Homo sapiens
gcacaaagaugg

SEQ ID NO: 1067413 - RNA, 17 nt, Homo sapiens
gcaccauugaacuguac

SEQ ID NO: 1067414 - RNA, 19 nt, Homo sapiens
gcaccauugaacuguacca

SEQ ID NO: 1067415 - RNA, 19 nt, Homo sapiens
gcacccaagaccucagggc

SEQ ID NO: 1067416 - RNA, 17 nt, Homo sapiens
gcaccgaaaaacuaaaa

SEQ ID NO: 1067417 - RNA, 15 nt, Homo sapiens
gcaccuguaauccca

SEQ ID NO: 1067418 - RNA, 16 nt, Homo sapiens
gcacuguuucucucac

SEQ ID NO: 1067419 - RNA, 18 nt, Homo sapiens
gcacuuugggaggccaag

SEQ ID NO: 1067420 - RNA, 14 nt, Homo sapiens
gcagaaacuuuaca

SEQ ID NO: 1067421 - RNA, 13 nt, Homo sapiens
gcagaagugcaau

SEQ ID NO: 1067422 - RNA, 16 nt, Homo sapiens
gcagaguacuggcuga

SEQ ID NO: 1067423 - RNA, 23 nt, Homo sapiens
gcagaguacuggcugauggagua

SEQ ID NO: 1067424 - RNA, 21 nt, Homo sapiens
gcagauacugucucuuucaug

SEQ ID NO: 1067425 - RNA, 20 nt, Homo sapiens
gcaggugaaacccagucacu

SEQ ID NO: 1067426 - RNA, 17 nt, Homo sapiens
gcaugaagguuucugaa

SEQ ID NO: 1067427 - RNA, 17 nt, Homo sapiens
gcaugauccaagcaaga

SEQ ID NO: 1067428 - RNA, 14 nt, Homo sapiens
gcauguuuguugua

SEQ ID NO: 1067429 - RNA, 16 nt, Homo sapiens
gcauguuuguuguaua

SEQ ID NO: 1067430 - RNA, 23 nt, Homo sapiens
gcauuucccccaccccauuucuc

SEQ ID NO: 1067431 - RNA, 20 nt, Homo sapiens
gccaagaugacacaacugca

SEQ ID NO: 1067432 - RNA, 21 nt, Homo sapiens
gccaaggagggcagaucacuu

SEQ ID NO: 1067433 - RNA, 16 nt, Homo sapiens
gccagaggcaccucaa

SEQ ID NO: 1067434 - RNA, 20 nt, Homo sapiens
gccagcugaugacucaagau

SEQ ID NO: 1067435 - RNA, 20 nt, Homo sapiens
gccaugaagaggaugcugug

SEQ ID NO: 1067436 - RNA, 18 nt, Homo sapiens
gccauugcacuccagccu

SEQ ID NO: 1067437 - RNA, 16 nt, Homo sapiens
gcccaaccuauccugu

SEQ ID NO: 1067438 - RNA, 15 nt, Homo sapiens
gcccaguccuuccac

SEQ ID NO: 1067439 - RNA, 13 nt, Homo sapiens
gccccaauucgau

SEQ ID NO: 1067440 - RNA, 15 nt, Homo sapiens
gccccaauucgaucc

SEQ ID NO: 1067441 - RNA, 16 nt, Homo sapiens
gcccccccuuccacuu

SEQ ID NO: 1067442 - RNA, 15 nt, Homo sapiens
gcccuaaaagcacac

SEQ ID NO: 1067443 - RNA, 20 nt, Homo sapiens
gcccuaaaagcacacucauc

SEQ ID NO: 1067444 - RNA, 14 nt, Homo sapiens
gcccucagauuccg

SEQ ID NO: 1067445 - RNA, 15 nt, Homo sapiens
gcccugcagugcccu

SEQ ID NO: 1067446 - RNA, 22 nt, Homo sapiens
gcccuuaaacauuggacaguga

SEQ ID NO: 1067447 - RNA, 19 nt, Homo sapiens
gccgcaaaccacacuggac

SEQ ID NO: 1067448 - RNA, 20 nt, Homo sapiens
gccgggcagaggggcagaug

SEQ ID NO: 1067449 - RNA, 12 nt, Homo sapiens
gccguguagaag

SEQ ID NO: 1067450 - RNA, 17 nt, Homo sapiens
gccucaggccucugugc

SEQ ID NO: 1067451 - RNA, 18 nt, Homo sapiens
gccucccacuggggucca

SEQ ID NO: 1067452 - RNA, 18 nt, Homo sapiens
gccuccuggcccagguga

SEQ ID NO: 1067453 - RNA, 19 nt, Homo sapiens
gccuccuggcccaggugag

SEQ ID NO: 1067454 - RNA, 16 nt, Homo sapiens
gccucuuucacauuga

SEQ ID NO: 1067455 - RNA, 22 nt, Homo sapiens
gccugcuuucacacuaaggaaa

SEQ ID NO: 1067456 - RNA, 22 nt, Homo sapiens
gccuggacuagagggaccucuc

SEQ ID NO: 1067457 - RNA, 16 nt, Homo sapiens
cuugggaauaaaucau

SEQ ID NO: 1067458 - RNA, 17 nt, Homo sapiens
cuuggguucacagugca

SEQ ID NO: 1067459 - RNA, 15 nt, Homo sapiens
aacaaccugcucaca

SEQ ID NO: 1067460 - RNA, 19 nt, Homo sapiens
aacaaugauuaaauugaau

SEQ ID NO: 1067461 - RNA, 21 nt, Homo sapiens
aacaccugauuaacugaggca

SEQ ID NO: 1067462 - RNA, 14 nt, Homo sapiens
aacagauuugagaa

SEQ ID NO: 1067463 - RNA, 18 nt, Homo sapiens
aacauaaaacuucuuuag

SEQ ID NO: 1067464 - RNA, 12 nt, Homo sapiens
aacauacuucua

SEQ ID NO: 1067465 - RNA, 14 nt, Homo sapiens
aacauagcagaccu

SEQ ID NO: 1067466 - RNA, 19 nt, Homo sapiens
aacaugugguuaaugccau

SEQ ID NO: 1067467 - RNA, 13 nt, Homo sapiens
aaccaaguucaaa

SEQ ID NO: 1067468 - RNA, 17 nt, Homo sapiens
aaccagagccugagugu

SEQ ID NO: 1067469 - RNA, 21 nt, Homo sapiens
aaccagagccugaguguugcc

SEQ ID NO: 1067470 - RNA, 11 nt, Homo sapiens
aacccaaagug

SEQ ID NO: 1067471 - RNA, 19 nt, Homo sapiens
aacccaggaguucaggguc

SEQ ID NO: 1067472 - RNA, 21 nt, Homo sapiens
aacccaggaguucagggucau

SEQ ID NO: 1067473 - RNA, 16 nt, Homo sapiens
aaccuauccuguucuu

SEQ ID NO: 1067474 - RNA, 15 nt, Homo sapiens
aacuagguuaccgcu

SEQ ID NO: 1067475 - RNA, 11 nt, Homo sapiens
aacucaauauu

SEQ ID NO: 1067476 - RNA, 19 nt, Homo sapiens
aacucaauauuuuccauga

SEQ ID NO: 1067477 - RNA, 16 nt, Homo sapiens
aacuccucaauuccaa

SEQ ID NO: 1067478 - RNA, 23 nt, Homo sapiens
aacucugagcagugcuugaauga

SEQ ID NO: 1067479 - RNA, 14 nt, Homo sapiens
aacuggaaugccuu

SEQ ID NO: 1067480 - RNA, 15 nt, Homo sapiens
aacugucugacuuau

SEQ ID NO: 1067481 - RNA, 14 nt, Homo sapiens
aacuuacuugccuc

SEQ ID NO: 1067482 - RNA, 16 nt, Homo sapiens
aagaaacccucacucu

SEQ ID NO: 1067483 - RNA, 21 nt, Homo sapiens
aagaaccacucauaauucuuc

SEQ ID NO: 1067484 - RNA, 14 nt, Homo sapiens
aagaaguuaaauga

SEQ ID NO: 1067485 - RNA, 13 nt, Homo sapiens
aagaaucagucuu

SEQ ID NO: 1067486 - RNA, 15 nt, Homo sapiens
aagacagcuucucau

SEQ ID NO: 1067487 - RNA, 19 nt, Homo sapiens
aagaccugacaccuuucau

SEQ ID NO: 1067488 - RNA, 20 nt, Homo sapiens
aagaccugacaccuuucaua

SEQ ID NO: 1067489 - RNA, 19 nt, Homo sapiens
aagacggaaaccucccuuu

SEQ ID NO: 1067490 - RNA, 18 nt, Homo sapiens
aagacuauucccuucuaa

SEQ ID NO: 1067491 - RNA, 15 nt, Homo sapiens
aagagccacagugag

SEQ ID NO: 1067492 - RNA, 20 nt, Homo sapiens
aagaguugugacaacuuccu

SEQ ID NO: 1067493 - RNA, 13 nt, Homo sapiens
aagauauaugaau

SEQ ID NO: 1067494 - RNA, 22 nt, Homo sapiens
aagaugauggcucauuuacacu

SEQ ID NO: 1067495 - RNA, 12 nt, Homo sapiens
aagauuacuuuu

SEQ ID NO: 1067496 - RNA, 21 nt, Homo sapiens
aagauuauauaguacuuaaau

SEQ ID NO: 1067497 - RNA, 19 nt, Homo sapiens
aagauucuucccauucucc

SEQ ID NO: 1067498 - RNA, 20 nt, Homo sapiens
aagauucuucccauucucca

SEQ ID NO: 1067499 - RNA, 14 nt, Homo sapiens
aagcagaugcucug

SEQ ID NO: 1067500 - RNA, 20 nt, Homo sapiens
aagccacagcuggugguauc

SEQ ID NO: 1067501 - RNA, 14 nt, Homo sapiens
aagcuacaguuuug

SEQ ID NO: 1067502 - RNA, 20 nt, Homo sapiens
aagcucuugaagacacugaa

SEQ ID NO: 1067503 - RNA, 12 nt, Homo sapiens
aagcugcucagg

SEQ ID NO: 1067504 - RNA, 20 nt, Homo sapiens
aagcuguccucccaccucag

SEQ ID NO: 1067505 - RNA, 13 nt, Homo sapiens
aaggagaaucaaa

SEQ ID NO: 1067506 - RNA, 18 nt, Homo sapiens
aaggagggugagugcaag

SEQ ID NO: 1067507 - RNA, 22 nt, Homo sapiens
aaggcacacagcaagucagggu

SEQ ID NO: 1067508 - RNA, 19 nt, Homo sapiens
aaggcaggcagaucacuug

SEQ ID NO: 1067509 - RNA, 17 nt, Homo sapiens
aagggauggggugccag

SEQ ID NO: 1067510 - RNA, 22 nt, Homo sapiens
aaggucaggaguucgagaccag

SEQ ID NO: 1067511 - RNA, 22 nt, Homo sapiens
aaguaggauucaucauuccaua

SEQ ID NO: 1067512 - RNA, 17 nt, Homo sapiens
aaguagggauuaauauu

SEQ ID NO: 1067513 - RNA, 19 nt, Homo sapiens
aaguagggauuaauauuua

SEQ ID NO: 1067514 - RNA, 17 nt, Homo sapiens
aagucaggguuggagca

SEQ ID NO: 1067515 - RNA, 22 nt, Homo sapiens
aaguuagggaauggcacagccc

SEQ ID NO: 1067516 - RNA, 21 nt, Homo sapiens
aaguuguucaaacauuuacca

SEQ ID NO: 1067517 - RNA, 20 nt, Homo sapiens
aaguuuagugcccucaucca

SEQ ID NO: 1067518 - RNA, 21 nt, Homo sapiens
aaguuuuguggaggagcucag

SEQ ID NO: 1067519 - RNA, 15 nt, Homo sapiens
acagggcaccugcca

SEQ ID NO: 1067520 - RNA, 19 nt, Homo sapiens
acagguuacagugagcaaa

SEQ ID NO: 1067521 - RNA, 14 nt, Homo sapiens
acagucaugcaguc

SEQ ID NO: 1067522 - RNA, 23 nt, Homo sapiens
acagucuauuugagacuccucag

SEQ ID NO: 1067523 - RNA, 22 nt, Homo sapiens
acaguggcaggacaggaaaaac

SEQ ID NO: 1067524 - RNA, 18 nt, Homo sapiens
acauauuuagaccaauau

SEQ ID NO: 1067525 - RNA, 16 nt, Homo sapiens
acauccugugccucca

SEQ ID NO: 1067526 - RNA, 17 nt, Homo sapiens
acauccugugccuccau

SEQ ID NO: 1067527 - RNA, 21 nt, Homo sapiens
acauguaaaauaugucuuucu

SEQ ID NO: 1067528 - RNA, 14 nt, Homo sapiens
accaaaaacugaaa

SEQ ID NO: 1067529 - RNA, 14 nt, Homo sapiens
accaaaucaucucu

SEQ ID NO: 1067530 - RNA, 17 nt, Homo sapiens
accaauaaagccuucaa

SEQ ID NO: 1067531 - RNA, 13 nt, Homo sapiens
accagacagacaa

SEQ ID NO: 1067532 - RNA, 19 nt, Homo sapiens
accagacagacaacacugg

SEQ ID NO: 1067533 - RNA, 15 nt, Homo sapiens
accagagaccaaaug

SEQ ID NO: 1067534 - RNA, 14 nt, Homo sapiens
accauauugcccag

SEQ ID NO: 1067535 - RNA, 19 nt, Homo sapiens
accauuuuugaaaccaaac

SEQ ID NO: 1067536 - RNA, 13 nt, Homo sapiens
acccaacaugacu

SEQ ID NO: 1067537 - RNA, 17 nt, Homo sapiens
acccaauucaaauugac

SEQ ID NO: 1067538 - RNA, 22 nt, Homo sapiens
acccagacacaucgcacugugg

SEQ ID NO: 1067539 - RNA, 16 nt, Homo sapiens
acccagucacugugag

SEQ ID NO: 1067540 - RNA, 19 nt, Homo sapiens
accccauuucucuccucac

SEQ ID NO: 1067541 - RNA, 20 nt, Homo sapiens
acccuaaaaagcagagcuuu

SEQ ID NO: 1067542 - RNA, 16 nt, Homo sapiens
acccucucucugaucu

SEQ ID NO: 1067543 - RNA, 22 nt, Homo sapiens
acccugcgcccaguccuuccac

SEQ ID NO: 1067544 - RNA, 20 nt, Homo sapiens
acccuuucauucagccuuua

SEQ ID NO: 1067545 - RNA, 14 nt, Homo sapiens
accguacuguggaa

SEQ ID NO: 1067546 - RNA, 14 nt, Homo sapiens
accguaggacccaa

SEQ ID NO: 1067547 - RNA, 14 nt, Homo sapiens
accuccaagccacu

SEQ ID NO: 1067548 - RNA, 19 nt, Homo sapiens
accuccaagccacugagca

SEQ ID NO: 1067549 - RNA, 15 nt, Homo sapiens
accuccucucuacua

SEQ ID NO: 1067550 - RNA, 16 nt, Homo sapiens
accucucccugacccu

SEQ ID NO: 1067551 - RNA, 14 nt, Homo sapiens
accugaacugaugg

SEQ ID NO: 1067552 - RNA, 16 nt, Homo sapiens
accugaacugaugggu

SEQ ID NO: 1067553 - RNA, 12 nt, Homo sapiens
accugugugcug

SEQ ID NO: 1067554 - RNA, 21 nt, Homo sapiens
accuucuaggaagcuccaguu

SEQ ID NO: 1067555 - RNA, 23 nt, Homo sapiens
accuugcgauucugcagccacaa

SEQ ID NO: 1067556 - RNA, 18 nt, Homo sapiens
acgaaaguggaaauggag

SEQ ID NO: 1067557 - RNA, 15 nt, Homo sapiens
acgccgcccuaaaag

SEQ ID NO: 1067558 - RNA, 15 nt, Homo sapiens
acgccuguaauccca

SEQ ID NO: 1067559 - RNA, 17 nt, Homo sapiens
acgccuguaaucccagc

SEQ ID NO: 1067560 - RNA, 19 nt, Homo sapiens
acggaccaugcgacacugg

SEQ ID NO: 1067561 - RNA, 16 nt, Homo sapiens
acguuuauagccgaaa

SEQ ID NO: 1067562 - RNA, 15 nt, Homo sapiens
acuagacaaguccag

SEQ ID NO: 1067563 - RNA, 18 nt, Homo sapiens
acuaggccagacauagca

SEQ ID NO: 1067564 - RNA, 22 nt, Homo sapiens
acuaugcccaaccuauccuguu

SEQ ID NO: 1067565 - RNA, 15 nt, Homo sapiens
acuauguugccuaag

SEQ ID NO: 1067566 - RNA, 22 nt, Homo sapiens
acuauguugccuaagcuggucu

SEQ ID NO: 1067567 - RNA, 15 nt, Homo sapiens
acucaaaugcucaga

SEQ ID NO: 1067568 - RNA, 18 nt, Homo sapiens
acucagcucuuggcucca

SEQ ID NO: 1067569 - RNA, 12 nt, Homo sapiens
acucauaauucu

SEQ ID NO: 1067570 - RNA, 17 nt, Homo sapiens
acuccugggcucaagcg

SEQ ID NO: 1067571 - RNA, 18 nt, Homo sapiens
acucucaccaaaugagaa

SEQ ID NO: 1067572 - RNA, 15 nt, Homo sapiens
acucuucugaauuga

SEQ ID NO: 1067573 - RNA, 19 nt, Homo sapiens
acugaagcaaagaagggaa

SEQ ID NO: 1067574 - RNA, 14 nt, Homo sapiens
acugaagccuuucu

SEQ ID NO: 1067575 - RNA, 22 nt, Homo sapiens
acugaccuugaugagcugugca

SEQ ID NO: 1067576 - RNA, 13 nt, Homo sapiens
acugagaauauaa

SEQ ID NO: 1067577 - RNA, 17 nt, Homo sapiens
acugaucaggaccucca

SEQ ID NO: 1067578 - RNA, 17 nt, Homo sapiens
caacacugggaaacaga

SEQ ID NO: 1067579 - RNA, 14 nt, Homo sapiens
caaccaugaagucu

SEQ ID NO: 1067580 - RNA, 15 nt, Homo sapiens
caacccuaaaaagca

SEQ ID NO: 1067581 - RNA, 19 nt, Homo sapiens
caacuacagaaaaaccaga

SEQ ID NO: 1067582 - RNA, 15 nt, Homo sapiens
caacuuccugaggga

SEQ ID NO: 1067583 - RNA, 23 nt, Homo sapiens
caagaccuuucaaagccauuuua

SEQ ID NO: 1067584 - RNA, 16 nt, Homo sapiens
caagaguugugacaac

SEQ ID NO: 1067585 - RNA, 20 nt, Homo sapiens
caagaugacacaacugcacu

SEQ ID NO: 1067586 - RNA, 18 nt, Homo sapiens
caagauuaucaacugugu

SEQ ID NO: 1067587 - RNA, 14 nt, Homo sapiens
caagcaagacugag

SEQ ID NO: 1067588 - RNA, 16 nt, Homo sapiens
caagccccugcuccag

SEQ ID NO: 1067589 - RNA, 21 nt, Homo sapiens
caagcgauccucccaccucag

SEQ ID NO: 1067590 - RNA, 20 nt, Homo sapiens
caaggagggcagaucacuuc

SEQ ID NO: 1067591 - RNA, 18 nt, Homo sapiens
caaggagggugagugcaa

SEQ ID NO: 1067592 - RNA, 17 nt, Homo sapiens
cauuuuauaaucuauau

SEQ ID NO: 1067593 - RNA, 16 nt, Homo sapiens
cauuuucaucuacuca

SEQ ID NO: 1067594 - RNA, 17 nt, Homo sapiens
ccaaaccuucaggaaau

SEQ ID NO: 1067595 - RNA, 12 nt, Homo sapiens
ccaacaauguug

SEQ ID NO: 1067596 - RNA, 23 nt, Homo sapiens
ccaaggagggcagaucacuucag

SEQ ID NO: 1067597 - RNA, 20 nt, Homo sapiens
ccaaggagggugagugcaag

SEQ ID NO: 1067598 - RNA, 22 nt, Homo sapiens
ccaauaaagccuucaaacuccc

SEQ ID NO: 1067599 - RNA, 21 nt, Homo sapiens
ccacagacucaaaugcucaga

SEQ ID NO: 1067600 - RNA, 13 nt, Homo sapiens
ccacagcacuaau

SEQ ID NO: 1067601 - RNA, 18 nt, Homo sapiens
ccacuagacaaguccagc

SEQ ID NO: 1067602 - RNA, 13 nt, Homo sapiens
ccagaaacuguuc

SEQ ID NO: 1067603 - RNA, 19 nt, Homo sapiens
ccagaauguugcuuucuga

SEQ ID NO: 1067604 - RNA, 15 nt, Homo sapiens
ccagaggcaccucaa

SEQ ID NO: 1067605 - RNA, 12 nt, Homo sapiens
ccagaugugguu

SEQ ID NO: 1067606 - RNA, 17 nt, Homo sapiens
ccagaugugguugcaua

SEQ ID NO: 1067607 - RNA, 20 nt, Homo sapiens
ccagcacuuugggaggccaa

SEQ ID NO: 1067608 - RNA, 22 nt, Homo sapiens
ccagccuggccaagagaccagc

SEQ ID NO: 1067609 - RNA, 16 nt, Homo sapiens
ccagcuacaccuuucu

SEQ ID NO: 1067610 - RNA, 19 nt, Homo sapiens
ccagcugaugacucaagau

SEQ ID NO: 1067611 - RNA, 15 nt, Homo sapiens
ccaggugaacuggaa

SEQ ID NO: 1067612 - RNA, 16 nt, Homo sapiens
ccaggugaacuggaau

SEQ ID NO: 1067613 - RNA, 15 nt, Homo sapiens
ccaguauaaaacacc

SEQ ID NO: 1067614 - RNA, 17 nt, Homo sapiens
ccagucacugugagcuc

SEQ ID NO: 1067615 - RNA, 19 nt, Homo sapiens
ccauauucccacagcacua

SEQ ID NO: 1067616 - RNA, 19 nt, Homo sapiens
ccaucagcuaaacaccacg

SEQ ID NO: 1067617 - RNA, 15 nt, Homo sapiens
ccaugaaaaugcaac

SEQ ID NO: 1067618 - RNA, 23 nt, Homo sapiens
ccaugaaaaugcaacaacaugua

SEQ ID NO: 1067619 - RNA, 21 nt, Homo sapiens
ccaugccucccccuagccauu

SEQ ID NO: 1067620 - RNA, 23 nt, Homo sapiens
ccaugugaggguuuucagcauug

SEQ ID NO: 1067621 - RNA, 14 nt, Homo sapiens
ccauugaacuguac

SEQ ID NO: 1067622 - RNA, 19 nt, Homo sapiens
cccaagcagagaagcucuc

SEQ ID NO: 1067623 - RNA, 13 nt, Homo sapiens
cccacaguggaaa

SEQ ID NO: 1067624 - RNA, 14 nt, Homo sapiens
cccacccugggacc

SEQ ID NO: 1067625 - RNA, 16 nt, Homo sapiens
cccagacggcuccacu

SEQ ID NO: 1067626 - RNA, 24 nt, Homo sapiens
cccaggaguggauaacacuggcuu

SEQ ID NO: 1067627 - RNA, 16 nt, Homo sapiens
cccaggugaguccuag

SEQ ID NO: 1067628 - RNA, 17 nt, Homo sapiens
cccaugggagauuugga

SEQ ID NO: 1067629 - RNA, 24 nt, Homo sapiens
ccccacccugagcgccugggucca

SEQ ID NO: 1067630 - RNA, 22 nt, Homo sapiens
ccccaucgccagcugaugacuc

SEQ ID NO: 1067631 - RNA, 13 nt, Homo sapiens
ccccuaaaccaaa

SEQ ID NO: 1067632 - RNA, 14 nt, Homo sapiens
ccccugucucaggg

SEQ ID NO: 1067633 - RNA, 21 nt, Homo sapiens
ccccuuaguuauaauucugug

SEQ ID NO: 1067634 - RNA, 14 nt, Homo sapiens
cccucagagugcaa

SEQ ID NO: 1067635 - RNA, 19 nt, Homo sapiens
cccucuccucucuuccucc

SEQ ID NO: 1067636 - RNA, 19 nt, Homo sapiens
cccucuugaaucucugaau

SEQ ID NO: 1067637 - RNA, 20 nt, Homo sapiens
cccugcccuccccucucugc

SEQ ID NO: 1067638 - RNA, 19 nt, Homo sapiens
cccuucuaaccugaacuga

SEQ ID NO: 1067639 - RNA, 19 nt, Homo sapiens
cccuucuuacaaugcauuc

SEQ ID NO: 1067640 - RNA, 18 nt, Homo sapiens
cccuugaggaaacaacag

SEQ ID NO: 1067641 - RNA, 21 nt, Homo sapiens
cccuuuacagcaccaccuugc

SEQ ID NO: 1067642 - RNA, 19 nt, Homo sapiens
ccgcaccaauaaagccuuc

SEQ ID NO: 1067643 - RNA, 20 nt, Homo sapiens
ccgcccuaaaagcacacuca

SEQ ID NO: 1067644 - RNA, 16 nt, Homo sapiens
ccuaaaagcacacuca

SEQ ID NO: 1067645 - RNA, 20 nt, Homo sapiens
ccuaaacucuuuuucaucca

SEQ ID NO: 1067646 - RNA, 17 nt, Homo sapiens
ccuaagcuggucucaaa

SEQ ID NO: 1067647 - RNA, 14 nt, Homo sapiens
ccuaauuaccugua

SEQ ID NO: 1067648 - RNA, 22 nt, Homo sapiens
ccuacauuuuaaugcaccugaa

SEQ ID NO: 1067649 - RNA, 21 nt, Homo sapiens
ccuagcacuuugggaggccaa

SEQ ID NO: 1067650 - RNA, 15 nt, Homo sapiens
ccucaaagcaccuga

SEQ ID NO: 1067651 - RNA, 20 nt, Homo sapiens
ccucaaccaaugccaaaaaa

SEQ ID NO: 1067652 - RNA, 14 nt, Homo sapiens
ccucacacagcccu

SEQ ID NO: 1067653 - RNA, 13 nt, Homo sapiens
ccucagagugcaa

SEQ ID NO: 1067654 - RNA, 14 nt, Homo sapiens
ccucagagugcaag

SEQ ID NO: 1067655 - RNA, 15 nt, Homo sapiens
ccucagcuucucaaa

SEQ ID NO: 1067656 - RNA, 15 nt, Homo sapiens
ccuccaagccacuga

SEQ ID NO: 1067657 - RNA, 20 nt, Homo sapiens
ccucccagugugcugggauu

SEQ ID NO: 1067658 - RNA, 13 nt, Homo sapiens
ccucugugccgca

SEQ ID NO: 1067659 - RNA, 14 nt, Homo sapiens
ccugccaacauacu

SEQ ID NO: 1067660 - RNA, 14 nt, Homo sapiens
ccuggcuucucuga

SEQ ID NO: 1067661 - RNA, 16 nt, Homo sapiens
ccugguacucaagccc

SEQ ID NO: 1067662 - RNA, 20 nt, Homo sapiens
ccuuaguuauaauucugugu

SEQ ID NO: 1067663 - RNA, 24 nt, Homo sapiens
ccuuccagggguuuacagucuauu

SEQ ID NO: 1067664 - RNA, 14 nt, Homo sapiens
ccuucgacagcauu

SEQ ID NO: 1067665 - RNA, 22 nt, Homo sapiens
ccuugcgauucugcagccacaa

SEQ ID NO: 1067666 - RNA, 14 nt, Homo sapiens
ccuugguguucaaa

SEQ ID NO: 1067667 - RNA, 17 nt, Homo sapiens
ccuuuuauuucuuaaac

SEQ ID NO: 1067668 - RNA, 15 nt, Homo sapiens
ccuuuugcauucucc

SEQ ID NO: 1067669 - RNA, 22 nt, Homo sapiens
ccuuuuugaaaaagaaaacacu

SEQ ID NO: 1067670 - RNA, 18 nt, Homo sapiens
cgaaagaagaaaauauca

SEQ ID NO: 1067671 - RNA, 23 nt, Homo sapiens
cgacacugggaggccagugagcc

SEQ ID NO: 1067672 - RNA, 19 nt, Homo sapiens
cgagaccagccuggccaac

SEQ ID NO: 1067673 - RNA, 20 nt, Homo sapiens
cgaggccccugucucagggu

SEQ ID NO: 1067674 - RNA, 14 nt, Homo sapiens
cgauccccugucac

SEQ ID NO: 1067675 - RNA, 16 nt, Homo sapiens
cgcaaaccacacugga

SEQ ID NO: 1067676 - RNA, 17 nt, Homo sapiens
cgcaccaauaaagccuu

SEQ ID NO: 1067677 - RNA, 17 nt, Homo sapiens
cgcauccccugccucca

SEQ ID NO: 1067678 - RNA, 13 nt, Homo sapiens
cgccgaauccugu

SEQ ID NO: 1067679 - RNA, 22 nt, Homo sapiens
cgccuguaaucccagcacuuug

SEQ ID NO: 1067680 - RNA, 18 nt, Homo sapiens
cggcucacgccuguaauc

SEQ ID NO: 1067681 - RNA, 13 nt, Homo sapiens
cgggcaccuguaa

SEQ ID NO: 1067682 - RNA, 18 nt, Homo sapiens
cgguaccuggcaauguuu

SEQ ID NO: 1067683 - RNA, 14 nt, Homo sapiens
cgucauuacagggc

SEQ ID NO: 1067684 - RNA, 13 nt, Homo sapiens
cguggaaaggggc

SEQ ID NO: 1067685 - RNA, 20 nt, Homo sapiens
cguggaauugugcugaguug

SEQ ID NO: 1067686 - RNA, 17 nt, Homo sapiens
cguguacuacaauuuaa

SEQ ID NO: 1067687 - RNA, 23 nt, Homo sapiens
cuaaaaacacaaaaauuagccag

SEQ ID NO: 1067688 - RNA, 18 nt, Homo sapiens
cuaaaaguuguacuucau

SEQ ID NO: 1067689 - RNA, 16 nt, Homo sapiens
cuaaaaugaguuaccu

SEQ ID NO: 1067690 - RNA, 19 nt, Homo sapiens
cuaaaaugaguuaccuaca

SEQ ID NO: 1067691 - RNA, 21 nt, Homo sapiens
cuaaaauuguauagaccuaaa

SEQ ID NO: 1067692 - RNA, 21 nt, Homo sapiens
cuaaagaggaaggaccaagga

SEQ ID NO: 1067693 - RNA, 23 nt, Homo sapiens
cuaaagccuuccuauuuugcaua

SEQ ID NO: 1067694 - RNA, 16 nt, Homo sapiens
cuaaagguuguauugc

SEQ ID NO: 1067695 - RNA, 19 nt, Homo sapiens
cuaaagguuguauugcaua

SEQ ID NO: 1067696 - RNA, 17 nt, Homo sapiens
cuaaauggugcuuuaua

SEQ ID NO: 1067697 - RNA, 14 nt, Homo sapiens
cuaaguggggaaaa

SEQ ID NO: 1067698 - RNA, 14 nt, Homo sapiens
cuaauucaacauau

SEQ ID NO: 1067699 - RNA, 22 nt, Homo sapiens
cuaauuuguuuucccuucuuac

SEQ ID NO: 1067700 - RNA, 17 nt, Homo sapiens
cuuccagccuaggccug

SEQ ID NO: 1067701 - RNA, 18 nt, Homo sapiens
cuuccagugcaacacuga

SEQ ID NO: 1067702 - RNA, 13 nt, Homo sapiens
cuuccgaaaacca

SEQ ID NO: 1067703 - RNA, 21 nt, Homo sapiens
cuucgaccacaucagaaagaa

SEQ ID NO: 1067704 - RNA, 15 nt, Homo sapiens
cuugaagacacugaa

SEQ ID NO: 1067705 - RNA, 16 nt, Homo sapiens
cuugaagacacugaaa

SEQ ID NO: 1067706 - RNA, 17 nt, Homo sapiens
cuugacagaacacuguc

SEQ ID NO: 1067707 - RNA, 14 nt, Homo sapiens
cuugaucaaaggca

SEQ ID NO: 1067708 - RNA, 22 nt, Homo sapiens
cuugaugagcugugcacaaagu

SEQ ID NO: 1067709 - RNA, 15 nt, Homo sapiens
cuugauuuaaucacc

SEQ ID NO: 1067710 - RNA, 21 nt, Homo sapiens
cuugcgauucugcagccacaa

SEQ ID NO: 1067711 - RNA, 21 nt, Homo sapiens
cuugcuccacagggcccuguu

SEQ ID NO: 1067712 - RNA, 16 nt, Homo sapiens
cuugcugaugaaaugg

SEQ ID NO: 1067713 - RNA, 22 nt, Homo sapiens
cuugggaauaaaucauagcaau

SEQ ID NO: 1067714 - RNA, 23 nt, Homo sapiens
cuuguggcuuugcaaccauuuuc

SEQ ID NO: 1067715 - RNA, 20 nt, Homo sapiens
cuuuaaaaauaugcaccaaa

SEQ ID NO: 1067716 - RNA, 14 nt, Homo sapiens
cuuuaaugaauaaa

SEQ ID NO: 1067717 - RNA, 22 nt, Homo sapiens
cuuuaaugaauaaacauuugua

SEQ ID NO: 1067718 - RNA, 19 nt, Homo sapiens
cuuuaugaauguguaaugg

SEQ ID NO: 1067719 - RNA, 13 nt, Homo sapiens
cuuucaaagccau

SEQ ID NO: 1067720 - RNA, 15 nt, Homo sapiens
cuuucaaagccauuu

SEQ ID NO: 1067721 - RNA, 17 nt, Homo sapiens
cuuucaaagccauuuua

SEQ ID NO: 1067722 - RNA, 18 nt, Homo sapiens
cuuucaagguaacuguac

SEQ ID NO: 1067723 - RNA, 16 nt, Homo sapiens
cuuucagcagacugau

SEQ ID NO: 1067724 - RNA, 19 nt, Homo sapiens
cuuucagccaaaacagauc

SEQ ID NO: 1067725 - RNA, 18 nt, Homo sapiens
cuuucauucagccuuuag

SEQ ID NO: 1067726 - RNA, 15 nt, Homo sapiens
cuuuguacuuugugc

SEQ ID NO: 1067727 - RNA, 19 nt, Homo sapiens
cuuugugcagauucuuuac

SEQ ID NO: 1067728 - RNA, 19 nt, Homo sapiens
cuuuguguucuuuguguca

SEQ ID NO: 1067729 - RNA, 14 nt, Homo sapiens
cuuuuacaccaguu

SEQ ID NO: 1067730 - RNA, 17 nt, Homo sapiens
cuuuuacugaagccuuu

SEQ ID NO: 1067731 - RNA, 15 nt, Homo sapiens
cuuuucucaguuugg

SEQ ID NO: 1067732 - RNA, 18 nt, Homo sapiens
cuuuugcacaucuaguga

SEQ ID NO: 1067733 - RNA, 15 nt, Homo sapiens
cuuuugcauucuccc

SEQ ID NO: 1067734 - RNA, 20 nt, Homo sapiens
cuuuuuaagaugucuauuau

SEQ ID NO: 1067735 - RNA, 14 nt, Homo sapiens
cuuuuuuucuuugg

SEQ ID NO: 1067736 - RNA, 21 nt, Homo sapiens
gaaaaaaugugccauuuugca

SEQ ID NO: 1067737 - RNA, 18 nt, Homo sapiens
gaaaaauaaagaugugcu

SEQ ID NO: 1067738 - RNA, 20 nt, Homo sapiens
gaaaaauaaagaugugcuua

SEQ ID NO: 1067739 - RNA, 12 nt, Homo sapiens
gaaaacuacagg

SEQ ID NO: 1067740 - RNA, 14 nt, Homo sapiens
gaaaaugugucauu

SEQ ID NO: 1067741 - RNA, 14 nt, Homo sapiens
gaaaauuaacacug

SEQ ID NO: 1067742 - RNA, 12 nt, Homo sapiens
gaaacaggaaac

SEQ ID NO: 1067743 - RNA, 17 nt, Homo sapiens
gaaacccaggaguggau

SEQ ID NO: 1067744 - RNA, 19 nt, Homo sapiens
gaaacuggaugaggucaua

SEQ ID NO: 1067745 - RNA, 18 nt, Homo sapiens
gaaagcuguuaaauucuc

SEQ ID NO: 1067746 - RNA, 14 nt, Homo sapiens
gaaagucaaauuca

SEQ ID NO: 1067747 - RNA, 14 nt, Homo sapiens
gaaauagaacuaca

SEQ ID NO: 1067748 - RNA, 19 nt, Homo sapiens
gaaauauuuuacaguuuuu

SEQ ID NO: 1067749 - RNA, 18 nt, Homo sapiens
gaaaugagaggcauuucc

SEQ ID NO: 1067750 - RNA, 16 nt, Homo sapiens
gaacaagcaaacccag

SEQ ID NO: 1067751 - RNA, 14 nt, Homo sapiens
gaacacaaggucau

SEQ ID NO: 1067752 - RNA, 14 nt, Homo sapiens
gaacagacugaccu

SEQ ID NO: 1067753 - RNA, 21 nt, Homo sapiens
gaaccguaggacccaagcaga

SEQ ID NO: 1067754 - RNA, 23 nt, Homo sapiens
gaaccuaaguggggaaaauccua

SEQ ID NO: 1067755 - RNA, 16 nt, Homo sapiens
gaacugucagccucag

SEQ ID NO: 1067756 - RNA, 15 nt, Homo sapiens
gaacuuuauuuccaa

SEQ ID NO: 1067757 - RNA, 13 nt, Homo sapiens
gaagaagagccac

SEQ ID NO: 1067758 - RNA, 12 nt, Homo sapiens
gaagacacugaa

SEQ ID NO: 1067759 - RNA, 17 nt, Homo sapiens
gaagacuauauuguaca

SEQ ID NO: 1067760 - RNA, 16 nt, Homo sapiens
gaagcagaagugcaau

SEQ ID NO: 1067761 - RNA, 15 nt, Homo sapiens
gaagcugggguucau

SEQ ID NO: 1067762 - RNA, 16 nt, Homo sapiens
gaagcuguucucagga

SEQ ID NO: 1067763 - RNA, 14 nt, Homo sapiens
gaaguucacaucag

SEQ ID NO: 1067764 - RNA, 18 nt, Homo sapiens
gaauacacuuaacauaga

SEQ ID NO: 1067765 - RNA, 14 nt, Homo sapiens
gaauaguugaaccu

SEQ ID NO: 1067766 - RNA, 18 nt, Homo sapiens
gaaucccucuaucucuaa

SEQ ID NO: 1067767 - RNA, 17 nt, Homo sapiens
gaaucuauuuaucuuca

SEQ ID NO: 1067768 - RNA, 14 nt, Homo sapiens
gaauggcagcugcc

SEQ ID NO: 1067769 - RNA, 19 nt, Homo sapiens
gaauggggugcaugaaggu

SEQ ID NO: 1067770 - RNA, 14 nt, Homo sapiens
gaaugucaguucau

SEQ ID NO: 1067771 - RNA, 13 nt, Homo sapiens
gaauugcagagua

SEQ ID NO: 1067772 - RNA, 15 nt, Homo sapiens
gaauuuaaaaucaua

SEQ ID NO: 1067773 - RNA, 14 nt, Homo sapiens
gaauuuauugccuc

SEQ ID NO: 1067774 - RNA, 16 nt, Homo sapiens
gacaaagacucacucu

SEQ ID NO: 1067775 - RNA, 14 nt, Homo sapiens
gacaacacugggaa

SEQ ID NO: 1067776 - RNA, 17 nt, Homo sapiens
gacaacucagaggccag

SEQ ID NO: 1067777 - RNA, 15 nt, Homo sapiens
gacaggaaaaacccg

SEQ ID NO: 1067778 - RNA, 20 nt, Homo sapiens
gacauccccccgccaaaagc

SEQ ID NO: 1067779 - RNA, 14 nt, Homo sapiens
gacauuacagauga

SEQ ID NO: 1067780 - RNA, 22 nt, Homo sapiens
gacccccgcccccugcccuccc

SEQ ID NO: 1067781 - RNA, 19 nt, Homo sapiens
gacuaaaugaaaucuugca

SEQ ID NO: 1067782 - RNA, 13 nt, Homo sapiens
gacuaacuaucaa

SEQ ID NO: 1067783 - RNA, 18 nt, Homo sapiens
gacuagagcuuucuuuca

SEQ ID NO: 1067784 - RNA, 23 nt, Homo sapiens
gacuauucccuucuaaccugaac

SEQ ID NO: 1067785 - RNA, 18 nt, Homo sapiens
gacucaagauucccagga

SEQ ID NO: 1067786 - RNA, 20 nt, Homo sapiens
gacuugacagaacacugucu

SEQ ID NO: 1067787 - RNA, 14 nt, Homo sapiens
gagaacucugagca

SEQ ID NO: 1067788 - RNA, 18 nt, Homo sapiens
gagaacucugagcagugc

SEQ ID NO: 1067789 - RNA, 22 nt, Homo sapiens
gagaacugccuuuggcagaguu

SEQ ID NO: 1067790 - RNA, 15 nt, Homo sapiens
gagacaaagacucac

SEQ ID NO: 1067791 - RNA, 21 nt, Homo sapiens
gagacuacaggugugugucca

SEQ ID NO: 1067792 - RNA, 14 nt, Homo sapiens
gagaucaugucuca

SEQ ID NO: 1067793 - RNA, 15 nt, Homo sapiens
gagaucaugucucac

SEQ ID NO: 1067794 - RNA, 21 nt, Homo sapiens
gagauccaaaguccugugguu

SEQ ID NO: 1067795 - RNA, 16 nt, Homo sapiens
gagauccugagucaug

SEQ ID NO: 1067796 - RNA, 19 nt, Homo sapiens
gagaugggguuucacuaug

SEQ ID NO: 1067797 - RNA, 14 nt, Homo sapiens
gagcaguagcugga

SEQ ID NO: 1067798 - RNA, 14 nt, Homo sapiens
gagcauggguucau

SEQ ID NO: 1067799 - RNA, 18 nt, Homo sapiens
gagcuauucuugcugaug

SEQ ID NO: 1067800 - RNA, 14 nt, Homo sapiens
gagcucccaggugc

SEQ ID NO: 1067801 - RNA, 15 nt, Homo sapiens
gagcugcaggggcau

SEQ ID NO: 1067802 - RNA, 16 nt, Homo sapiens
gagcuuagauugccuc

SEQ ID NO: 1067803 - RNA, 12 nt, Homo sapiens
gaggcugagaca

SEQ ID NO: 1067804 - RNA, 20 nt, Homo sapiens
gagguagguagauugcuuga

SEQ ID NO: 1067805 - RNA, 18 nt, Homo sapiens
gaggugucuguaucagug

SEQ ID NO: 1067806 - RNA, 16 nt, Homo sapiens
gaguccaacaauguug

SEQ ID NO: 1067807 - RNA, 11 nt, Homo sapiens
gaguuaccuac

SEQ ID NO: 1067808 - RNA, 18 nt, Homo sapiens
gauaagcuaacaccagac

SEQ ID NO: 1067809 - RNA, 22 nt, Homo sapiens
gauaauuuauuuuuaccuucac

SEQ ID NO: 1067810 - RNA, 15 nt, Homo sapiens
gauacaaacauguuc

SEQ ID NO: 1067811 - RNA, 20 nt, Homo sapiens
gauacagccuuccguaucca

SEQ ID NO: 1067812 - RNA, 17 nt, Homo sapiens
gauacugucucuuucau

SEQ ID NO: 1067813 - RNA, 21 nt, Homo sapiens
gauagcuucaccccaauccca

SEQ ID NO: 1067814 - RNA, 18 nt, Homo sapiens
gauagucucauucuguca

SEQ ID NO: 1067815 - RNA, 23 nt, Homo sapiens
gauaguggggagacuucuuggcu

SEQ ID NO: 1067816 - RNA, 16 nt, Homo sapiens
gauaugugaaacaaug

SEQ ID NO: 1067817 - RNA, 14 nt, Homo sapiens
gaucacaccacugc

SEQ ID NO: 1067818 - RNA, 17 nt, Homo sapiens
gaucaugucucacuuca

SEQ ID NO: 1067819 - RNA, 22 nt, Homo sapiens
uagccacugcauaccaaccugg

SEQ ID NO: 1067820 - RNA, 16 nt, Homo sapiens
uaggaagaucucugca

SEQ ID NO: 1067821 - RNA, 16 nt, Homo sapiens
uaggauacugcugcgu

SEQ ID NO: 1067822 - RNA, 22 nt, Homo sapiens
uagucagaauuagcugcuucua

SEQ ID NO: 1067823 - RNA, 21 nt, Homo sapiens
uaguggggagacuucuuggcu

SEQ ID NO: 1067824 - RNA, 17 nt, Homo sapiens
uauaagcagucuuucua

SEQ ID NO: 1067825 - RNA, 13 nt, Homo sapiens
uauaauacuguau

SEQ ID NO: 1067826 - RNA, 16 nt, Homo sapiens
uauagcaagaucccau

SEQ ID NO: 1067827 - RNA, 17 nt, Homo sapiens
uauagucacuaguugua

SEQ ID NO: 1067828 - RNA, 19 nt, Homo sapiens
uauauuggguuccauucuc

SEQ ID NO: 1067829 - RNA, 16 nt, Homo sapiens
uauauuuauacuguau

SEQ ID NO: 1067830 - RNA, 17 nt, Homo sapiens
uaucauaaaaaugagug

SEQ ID NO: 1067831 - RNA, 20 nt, Homo sapiens
uauccuauuuagauggccau

SEQ ID NO: 1067832 - RNA, 15 nt, Homo sapiens
uaugcaccaaaucau

SEQ ID NO: 1067833 - RNA, 14 nt, Homo sapiens
uaugcuucuuucaa

SEQ ID NO: 1067834 - RNA, 17 nt, Homo sapiens
uauggaggcaagccagu

SEQ ID NO: 1067835 - RNA, 20 nt, Homo sapiens
uauuggaugacuaacuauca

SEQ ID NO: 1067836 - RNA, 22 nt, Homo sapiens
uauugggguuggaacauuucag

SEQ ID NO: 1067837 - RNA, 20 nt, Homo sapiens
uauuuagaaauagaacuaca

SEQ ID NO: 1067838 - RNA, 12 nt, Homo sapiens
uauuuaucuuca

SEQ ID NO: 1067839 - RNA, 18 nt, Homo sapiens
uauuucucuuucuuuaca

SEQ ID NO: 1067840 - RNA, 17 nt, Homo sapiens
uauuugagacuccucag

SEQ ID NO: 1067841 - RNA, 19 nt, Homo sapiens
uauuuuuuaaaaaucuaua

SEQ ID NO: 1067842 - RNA, 20 nt, Homo sapiens
ucaaaaauacucacauggcu

SEQ ID NO: 1067843 - RNA, 20 nt, Homo sapiens
ucaaagcacuguuucucuca

SEQ ID NO: 1067844 - RNA, 23 nt, Homo sapiens
ucaaaugcucagaccagcucuuc

SEQ ID NO: 1067845 - RNA, 15 nt, Homo sapiens
ucaaccaaugccaaa

SEQ ID NO: 1067846 - RNA, 18 nt, Homo sapiens
ucaaccaaugccaaaaaa

SEQ ID NO: 1067847 - RNA, 19 nt, Homo sapiens
ucaacuagcagauacaggg

SEQ ID NO: 1067848 - RNA, 22 nt, Homo sapiens
ucaagaagaagaggggcauaaa

SEQ ID NO: 1067849 - RNA, 18 nt, Homo sapiens
ucaaggaaugaagaacaa

SEQ ID NO: 1067850 - RNA, 13 nt, Homo sapiens
ucacaauacuguu

SEQ ID NO: 1067851 - RNA, 16 nt, Homo sapiens
ucacagggacugaaaa

SEQ ID NO: 1067852 - RNA, 19 nt, Homo sapiens
ucacccagacuggagugca

SEQ ID NO: 1067853 - RNA, 15 nt, Homo sapiens
ucaccuacuccagag

SEQ ID NO: 1067854 - RNA, 10 nt, Homo sapiens
ucaccuucac

SEQ ID NO: 1067855 - RNA, 19 nt, Homo sapiens
ucacugcucuggacugugu

SEQ ID NO: 1067856 - RNA, 13 nt, Homo sapiens
ucacuguccucca

SEQ ID NO: 1067857 - RNA, 14 nt, Homo sapiens
ucacuucucuuccu

SEQ ID NO: 1067858 - RNA, 12 nt, Homo sapiens
ucagaacagaca

SEQ ID NO: 1067859 - RNA, 19 nt, Homo sapiens
ucagaagggagcuagccag

SEQ ID NO: 1067860 - RNA, 14 nt, Homo sapiens
ucagacaccugugu

SEQ ID NO: 1067861 - RNA, 17 nt, Homo sapiens
ucagaccuuuuaacucc

SEQ ID NO: 1067862 - RNA, 12 nt, Homo sapiens
ucagagugcaag

SEQ ID NO: 1067863 - RNA, 18 nt, Homo sapiens
ucagauuccgcaccaaua

SEQ ID NO: 1067864 - RNA, 14 nt, Homo sapiens
ucagcagacaagga

SEQ ID NO: 1067865 - RNA, 12 nt, Homo sapiens
ucagccagguga

SEQ ID NO: 1067866 - RNA, 18 nt, Homo sapiens
ucagcuggucaaacaaac

SEQ ID NO: 1067867 - RNA, 18 nt, Homo sapiens
ucaggaaaacuacaggug

SEQ ID NO: 1067868 - RNA, 19 nt, Homo sapiens
ucaggaggaaggcuuacac

SEQ ID NO: 1067869 - RNA, 16 nt, Homo sapiens
ucaggaucacugggcu

SEQ ID NO: 1067870 - RNA, 19 nt, Homo sapiens
ucauaaaauguaucuucca

SEQ ID NO: 1067871 - RNA, 22 nt, Homo sapiens
ucauaaaauguaucuuccaugc

SEQ ID NO: 1067872 - RNA, 20 nt, Homo sapiens
ucauagauguuuccuugccu

SEQ ID NO: 1067873 - RNA, 15 nt, Homo sapiens
ucauaguugggguca

SEQ ID NO: 1067874 - RNA, 14 nt, Homo sapiens
ucaugccauugcac

SEQ ID NO: 1067875 - RNA, 17 nt, Homo sapiens
ucaugucucacuucaca

SEQ ID NO: 1067876 - RNA, 17 nt, Homo sapiens
ucauuaucaguccaaag

SEQ ID NO: 1067877 - RNA, 15 nt, Homo sapiens
uccaaaauugcaaac

SEQ ID NO: 1067878 - RNA, 21 nt, Homo sapiens
uccaaagggcauggguuuuau

SEQ ID NO: 1067879 - RNA, 14 nt, Homo sapiens
uccaagaccagaga

SEQ ID NO: 1067880 - RNA, 18 nt, Homo sapiens
uccaagcaagacugaggg

SEQ ID NO: 1067881 - RNA, 14 nt, Homo sapiens
uccaccagucauuu

SEQ ID NO: 1067882 - RNA, 23 nt, Homo sapiens
uccagaaucccguaacaccugau

SEQ ID NO: 1067883 - RNA, 16 nt, Homo sapiens
uccaggcugcauuugu

SEQ ID NO: 1067884 - RNA, 19 nt, Homo sapiens
uccagguauuuuauaauuc

SEQ ID NO: 1067885 - RNA, 13 nt, Homo sapiens
uccaucagcuaaa

SEQ ID NO: 1067886 - RNA, 11 nt, Homo sapiens
ucccagugugc

SEQ ID NO: 1067887 - RNA, 15 nt, Homo sapiens
uccccagcagucaau

SEQ ID NO: 1067888 - RNA, 16 nt, Homo sapiens
uccccuaaaccaaaaa

SEQ ID NO: 1067889 - RNA, 23 nt, Homo sapiens
uccccuaaaccaaaaacugaaag

SEQ ID NO: 1067890 - RNA, 23 nt, Homo sapiens
uccccugucacgugugggcaaug

SEQ ID NO: 1067891 - RNA, 22 nt, Homo sapiens
ucccugggguggggauagggag

SEQ ID NO: 1067892 - RNA, 15 nt, Homo sapiens
ucccuuacuguuuca

SEQ ID NO: 1067893 - RNA, 16 nt, Homo sapiens
ucccuucaucugggca

SEQ ID NO: 1067894 - RNA, 17 nt, Homo sapiens
ucccuugaggaaacaac

SEQ ID NO: 1067895 - RNA, 19 nt, Homo sapiens
uccgaggccccugucucag

SEQ ID NO: 1067896 - RNA, 12 nt, Homo sapiens
uccuaacuacag

SEQ ID NO: 1067897 - RNA, 22 nt, Homo sapiens
uccucacccugccggguagcug

SEQ ID NO: 1067898 - RNA, 16 nt, Homo sapiens
uccucauuuacuggau

SEQ ID NO: 1067899 - RNA, 14 nt, Homo sapiens
uccugagggagcuc

SEQ ID NO: 1067900 - RNA, 23 nt, Homo sapiens
uccuggcaaagaugaucaguaug

SEQ ID NO: 1067901 - RNA, 16 nt, Homo sapiens
uccuggcccaggugag

SEQ ID NO: 1067902 - RNA, 22 nt, Homo sapiens
uccuuucaagguaacuguacug

SEQ ID NO: 1067903 - RNA, 15 nt, Homo sapiens
ucgaccuacugaaaa

SEQ ID NO: 1067904 - RNA, 21 nt, Homo sapiens
ucgauccccugucacgugugg

SEQ ID NO: 1067905 - RNA, 22 nt, Homo sapiens
ucggcauguggaggaaggcagc

SEQ ID NO: 1067906 - RNA, 17 nt, Homo sapiens
ucgggaggcugagacag

SEQ ID NO: 1067907 - RNA, 17 nt, Homo sapiens
ucuaaaaugaguuaccu

SEQ ID NO: 1067908 - RNA, 15 nt, Homo sapiens
ucuacuaaaaauaca

SEQ ID NO: 1067909 - RNA, 19 nt, Homo sapiens
ucuacuaaaaauacaaaaa

SEQ ID NO: 1067910 - RNA, 12 nt, Homo sapiens
ucuagacaacua

SEQ ID NO: 1067911 - RNA, 18 nt, Homo sapiens
ucuagacaacuaccccuu

SEQ ID NO: 1067912 - RNA, 23 nt, Homo sapiens
ucuaucaaaggcagaucaguaag

SEQ ID NO: 1067913 - RNA, 20 nt, Homo sapiens
ucucauccugcaggcagcuu

SEQ ID NO: 1067914 - RNA, 20 nt, Homo sapiens
ucuccagagggaauugcaga

SEQ ID NO: 1067915 - RNA, 13 nt, Homo sapiens
ucuccucuuguaa

SEQ ID NO: 1067916 - RNA, 20 nt, Homo sapiens
ucucuagacaacuaccccuu

SEQ ID NO: 1067917 - RNA, 17 nt, Homo sapiens
ucucugaauuugagaua

SEQ ID NO: 1067918 - RNA, 18 nt, Homo sapiens
ucugaaaauuaacacugc

SEQ ID NO: 1067919 - RNA, 16 nt, Homo sapiens
ucugaacccugagcag

SEQ ID NO: 1067920 - RNA, 18 nt, Homo sapiens
ucugaguggcuucacucc

SEQ ID NO: 1067921 - RNA, 19 nt, Homo sapiens
ucugcagggccgccaggga

SEQ ID NO: 1067922 - RNA, 14 nt, Homo sapiens
ucugcucauucuaa

SEQ ID NO: 1067923 - RNA, 20 nt, Homo sapiens
ucugcuuucacucuuuagaa

SEQ ID NO: 1067924 - RNA, 15 nt, Homo sapiens
ucugggagaaaauca

SEQ ID NO: 1067925 - RNA, 20 nt, Homo sapiens
ucugggcacugaagggauau

SEQ ID NO: 1067926 - RNA, 20 nt, Homo sapiens
ucuguaaggacgccuugaug

SEQ ID NO: 1067927 - RNA, 15 nt, Homo sapiens
ucugucauccugcua

SEQ ID NO: 1067928 - RNA, 16 nt, Homo sapiens
ucuuaacuauucaaug

SEQ ID NO: 1067929 - RNA, 18 nt, Homo sapiens
ucuuacaaaggugaaaau

SEQ ID NO: 1067930 - RNA, 14 nt, Homo sapiens
ucuuacuuaugugu

SEQ ID NO: 1067931 - RNA, 19 nt, Homo sapiens
ucuucaccucugcuacuca

SEQ ID NO: 1067932 - RNA, 14 nt, Homo sapiens
ucuuccucccugga

SEQ ID NO: 1067933 - RNA, 16 nt, Homo sapiens
ucuuccucccuggaau

SEQ ID NO: 1067934 - RNA, 18 nt, Homo sapiens
ucuucugaauugacugua

SEQ ID NO: 1067935 - RNA, 15 nt, Homo sapiens
ucuucuuagcaccac

SEQ ID NO: 1067936 - RNA, 17 nt, Homo sapiens
ucuugaagucagauuga

SEQ ID NO: 1067937 - RNA, 17 nt, Homo sapiens
aacuguaccaugugcua

SEQ ID NO: 1067938 - RNA, 19 nt, Homo sapiens
aacuguaccaugugcuaca

SEQ ID NO: 1067939 - RNA, 15 nt, Homo sapiens
aacuguacugggcca

SEQ ID NO: 1067940 - RNA, 15 nt, Homo sapiens
aacuucagccagcua

SEQ ID NO: 1067941 - RNA, 20 nt, Homo sapiens
aacuuccagugcaacacuga

SEQ ID NO: 1067942 - RNA, 21 nt, Homo sapiens
aacuucuugaaucuagggagg

SEQ ID NO: 1067943 - RNA, 18 nt, Homo sapiens
aagaagagaaccaugaaa

SEQ ID NO: 1067944 - RNA, 19 nt, Homo sapiens
aagaagcauacaacuuugg

SEQ ID NO: 1067945 - RNA, 21 nt, Homo sapiens
aagaagggaauuuauugccuc

SEQ ID NO: 1067946 - RNA, 23 nt, Homo sapiens
aagaaucaccaguggguauucaa

SEQ ID NO: 1067947 - RNA, 14 nt, Homo sapiens
aagaaucagucuug

SEQ ID NO: 1067948 - RNA, 16 nt, Homo sapiens
aagacagagcugggau

SEQ ID NO: 1067949 - RNA, 13 nt, Homo sapiens
aagacauugcacc

SEQ ID NO: 1067950 - RNA, 19 nt, Homo sapiens
aagacuucucuuuugcaca

SEQ ID NO: 1067951 - RNA, 21 nt, Homo sapiens
aagacuucucuuuugcacauc

SEQ ID NO: 1067952 - RNA, 15 nt, Homo sapiens
aagacuugcauuuaa

SEQ ID NO: 1067953 - RNA, 22 nt, Homo sapiens
aagaguguggagucauucucau

SEQ ID NO: 1067954 - RNA, 17 nt, Homo sapiens
aagauagcuucacccca

SEQ ID NO: 1067955 - RNA, 14 nt, Homo sapiens
aagauauuuacugu

SEQ ID NO: 1067956 - RNA, 20 nt, Homo sapiens
aagaugacacaacugcacuc

SEQ ID NO: 1067957 - RNA, 12 nt, Homo sapiens
aagaugugcuua

SEQ ID NO: 1067958 - RNA, 11 nt, Homo sapiens
aagauuacuuu

SEQ ID NO: 1067959 - RNA, 23 nt, Homo sapiens
aagauucuucccauucuccauuu

SEQ ID NO: 1067960 - RNA, 15 nt, Homo sapiens
aagcaaacacauuaa

SEQ ID NO: 1067961 - RNA, 13 nt, Homo sapiens
aagcaaacccaga

SEQ ID NO: 1067962 - RNA, 11 nt, Homo sapiens
aagcaaauaga

SEQ ID NO: 1067963 - RNA, 16 nt, Homo sapiens
aagcagaugcucugaa

SEQ ID NO: 1067964 - RNA, 12 nt, Homo sapiens
aagcauuuacaa

SEQ ID NO: 1067965 - RNA, 15 nt, Homo sapiens
aagccacacucuggg

SEQ ID NO: 1067966 - RNA, 16 nt, Homo sapiens
aagccacacucugggc

SEQ ID NO: 1067967 - RNA, 13 nt, Homo sapiens
aagccacugagca

SEQ ID NO: 1067968 - RNA, 16 nt, Homo sapiens
aagcccccccuuccac

SEQ ID NO: 1067969 - RNA, 20 nt, Homo sapiens
aagcccgcggggacauuggg

SEQ ID NO: 1067970 - RNA, 20 nt, Homo sapiens
aagcgauccucccaccucag

SEQ ID NO: 1067971 - RNA, 18 nt, Homo sapiens
aagcuaacaccagacaga

SEQ ID NO: 1067972 - RNA, 21 nt, Homo sapiens
aagcuguucucaggaucacug

SEQ ID NO: 1067973 - RNA, 23 nt, Homo sapiens
aagcuguuugucguaacuugaaa

SEQ ID NO: 1067974 - RNA, 19 nt, Homo sapiens
aaggaagaggcugacaaua

SEQ ID NO: 1067975 - RNA, 12 nt, Homo sapiens
aaggugcucaca

SEQ ID NO: 1067976 - RNA, 16 nt, Homo sapiens
aaguagcauuuacugu

SEQ ID NO: 1067977 - RNA, 14 nt, Homo sapiens
aaguagcugagacu

SEQ ID NO: 1067978 - RNA, 18 nt, Homo sapiens
aaguauugcugaguccaa

SEQ ID NO: 1067979 - RNA, 23 nt, Homo sapiens
aaguccagaaacuguucccaccu

SEQ ID NO: 1067980 - RNA, 14 nt, Homo sapiens
aaguuuccuuccag

SEQ ID NO: 1067981 - RNA, 22 nt, Homo sapiens
aauaaaaugaaguggugagcuu

SEQ ID NO: 1067982 - RNA, 18 nt, Homo sapiens
aauaaacauuuguagcau

SEQ ID NO: 1067983 - RNA, 15 nt, Homo sapiens
aauaaagaugugcuu

SEQ ID NO: 1067984 - RNA, 22 nt, Homo sapiens
aauaaugugacgaaaguggaaa

SEQ ID NO: 1067985 - RNA, 24 nt, Homo sapiens
aauacauaaaguaugugcauauuu

SEQ ID NO: 1067986 - RNA, 16 nt, Homo sapiens
aauacuauugcauuuu

SEQ ID NO: 1067987 - RNA, 15 nt, Homo sapiens
aauacuguauuugag

SEQ ID NO: 1067988 - RNA, 13 nt, Homo sapiens
aauagccacugca

SEQ ID NO: 1067989 - RNA, 14 nt, Homo sapiens
aauauaaacacuau

SEQ ID NO: 1067990 - RNA, 14 nt, Homo sapiens
aauauaauacugua

SEQ ID NO: 1067991 - RNA, 19 nt, Homo sapiens
aauaucauaaaaaugagug

SEQ ID NO: 1067992 - RNA, 21 nt, Homo sapiens
aauaucugagcucuuugcacu

SEQ ID NO: 1067993 - RNA, 23 nt, Homo sapiens
aauauuuuccaugaaaaugcaac

SEQ ID NO: 1067994 - RNA, 13 nt, Homo sapiens
aaucaccacucaa

SEQ ID NO: 1067995 - RNA, 16 nt, Homo sapiens
aaucaccacucaaaaa

SEQ ID NO: 1067996 - RNA, 14 nt, Homo sapiens
aaucacggcucacu

SEQ ID NO: 1067997 - RNA, 15 nt, Homo sapiens
aaucaucucucauca

SEQ ID NO: 1067998 - RNA, 22 nt, Homo sapiens
aaucaugccauugcacuccagc

SEQ ID NO: 1067999 - RNA, 13 nt, Homo sapiens
aauccuagcacuu

SEQ ID NO: 1068000 - RNA, 16 nt, Homo sapiens
aauccuagcacuuugg

SEQ ID NO: 1068001 - RNA, 20 nt, Homo sapiens
aauccuuuuaaaucuugaua

SEQ ID NO: 1068002 - RNA, 15 nt, Homo sapiens
aaucuauuuaucuuc

SEQ ID NO: 1068003 - RNA, 16 nt, Homo sapiens
aaucuugauaccaccu

SEQ ID NO: 1068004 - RNA, 12 nt, Homo sapiens
aauggaaccagg

SEQ ID NO: 1068005 - RNA, 15 nt, Homo sapiens
aauggggugcaugaa

SEQ ID NO: 1068006 - RNA, 11 nt, Homo sapiens
aauguauauau

SEQ ID NO: 1068007 - RNA, 13 nt, Homo sapiens
aauguaucuucca

SEQ ID NO: 1068008 - RNA, 21 nt, Homo sapiens
aaugucuguaucacucugugu

SEQ ID NO: 1068009 - RNA, 18 nt, Homo sapiens
aauguuagauaguuacua

SEQ ID NO: 1068010 - RNA, 16 nt, Homo sapiens
aauguuggagcuuuag

SEQ ID NO: 1068011 - RNA, 20 nt, Homo sapiens
aauguugguuuuaauacuug

SEQ ID NO: 1068012 - RNA, 20 nt, Homo sapiens
aauuacaguauauguugcaa

SEQ ID NO: 1068013 - RNA, 20 nt, Homo sapiens
aauuagaaacaacauagcaa

SEQ ID NO: 1068014 - RNA, 14 nt, Homo sapiens
aauuagccaggugu

SEQ ID NO: 1068015 - RNA, 18 nt, Homo sapiens
aauucaacauauaccuua

SEQ ID NO: 1068016 - RNA, 11 nt, Homo sapiens
aauucugggaa

SEQ ID NO: 1068017 - RNA, 23 nt, Homo sapiens
aauucugggaagcaaaacccaug

SEQ ID NO: 1068018 - RNA, 19 nt, Homo sapiens
aauucuuacaaacaugugg

SEQ ID NO: 1068019 - RNA, 22 nt, Homo sapiens
aauucuuauuuuuuaaaaagcu

SEQ ID NO: 1068020 - RNA, 19 nt, Homo sapiens
aauugaaaguuuauaugcu

SEQ ID NO: 1068021 - RNA, 20 nt, Homo sapiens
aauugcagaguacuggcuga

SEQ ID NO: 1068022 - RNA, 16 nt, Homo sapiens
aauuugagauacaaac

SEQ ID NO: 1068023 - RNA, 19 nt, Homo sapiens
aauuuggcuucuguuguca

SEQ ID NO: 1068024 - RNA, 13 nt, Homo sapiens
uugggauccuauu

SEQ ID NO: 1068025 - RNA, 17 nt, Homo sapiens
uugguauucgcuugaga

SEQ ID NO: 1068026 - RNA, 23 nt, Homo sapiens
uuggugaggaaaagcggacauca

SEQ ID NO: 1068027 - RNA, 16 nt, Homo sapiens
uugguggcuaccaugc

SEQ ID NO: 1068028 - RNA, 18 nt, Homo sapiens
uuguacuucuguaccugu

SEQ ID NO: 1068029 - RNA, 15 nt, Homo sapiens
uuguauugcauauau

SEQ ID NO: 1068030 - RNA, 21 nt, Homo sapiens
uugugaaggccucgcaggaag

SEQ ID NO: 1068031 - RNA, 12 nt, Homo sapiens
uuguuauuucag

SEQ ID NO: 1068032 - RNA, 15 nt, Homo sapiens
uuguuucacaaacag

SEQ ID NO: 1068033 - RNA, 13 nt, Homo sapiens
uuuaaaaagcuag

SEQ ID NO: 1068034 - RNA, 14 nt, Homo sapiens
uuuaaacauaggaa

SEQ ID NO: 1068035 - RNA, 14 nt, Homo sapiens
uuuaaucaccacuc

SEQ ID NO: 1068036 - RNA, 13 nt, Homo sapiens
uuuacaaaggggg

SEQ ID NO: 1068037 - RNA, 14 nt, Homo sapiens
uuuacaaccugaug

SEQ ID NO: 1068038 - RNA, 12 nt, Homo sapiens
uuuacaccaguu

SEQ ID NO: 1068039 - RNA, 16 nt, Homo sapiens
uuuacagucuauuuga

SEQ ID NO: 1068040 - RNA, 21 nt, Homo sapiens
uuuagaaagguuuugagcaug

SEQ ID NO: 1068041 - RNA, 19 nt, Homo sapiens
uuuagaaauagaacuacaa

SEQ ID NO: 1068042 - RNA, 19 nt, Homo sapiens
uuuagaaauuauauuuuag

SEQ ID NO: 1068043 - RNA, 23 nt, Homo sapiens
uuuaguaagagauuccugagcca

SEQ ID NO: 1068044 - RNA, 14 nt, Homo sapiens
uuuauaaucuauau

SEQ ID NO: 1068045 - RNA, 16 nt, Homo sapiens
uuuaucauuaccauua

SEQ ID NO: 1068046 - RNA, 22 nt, Homo sapiens
uuuaugucucagaccacuauuc

SEQ ID NO: 1068047 - RNA, 11 nt, Homo sapiens
uuuauugccuc

SEQ ID NO: 1068048 - RNA, 13 nt, Homo sapiens
uuucaaccaugaa

SEQ ID NO: 1068049 - RNA, 12 nt, Homo sapiens
uuucacacuguc

SEQ ID NO: 1068050 - RNA, 19 nt, Homo sapiens
uuucagugaaagcaucacu

SEQ ID NO: 1068051 - RNA, 18 nt, Homo sapiens
uuucaguugccauugaca

SEQ ID NO: 1068052 - RNA, 23 nt, Homo sapiens
uuucaucguaaacauacuucuaa

SEQ ID NO: 1068053 - RNA, 15 nt, Homo sapiens
uuucuccagggucag

SEQ ID NO: 1068054 - RNA, 20 nt, Homo sapiens
uuucugacacagucaauucu

SEQ ID NO: 1068055 - RNA, 14 nt, Homo sapiens
uuucuucauuaaga

SEQ ID NO: 1068056 - RNA, 20 nt, Homo sapiens
uuucuugugagaaaagaaua

SEQ ID NO: 1068057 - RNA, 20 nt, Homo sapiens
uuugcauuuucaucuacuca

SEQ ID NO: 1068058 - RNA, 15 nt, Homo sapiens
uuuggugcuuuccag

SEQ ID NO: 1068059 - RNA, 18 nt, Homo sapiens
uuugguuauaaauguaau

SEQ ID NO: 1068060 - RNA, 17 nt, Homo sapiens
uuugugggaaauccaca

SEQ ID NO: 1068061 - RNA, 24 nt, Homo sapiens
uuuguuuugagacaaagacucacu

SEQ ID NO: 1068062 - RNA, 23 nt, Homo sapiens
uuuuaaauaggguuguacuaugc

SEQ ID NO: 1068063 - RNA, 19 nt, Homo sapiens
uuuuaacaacugugcuuuu

SEQ ID NO: 1068064 - RNA, 19 nt, Homo sapiens
uuuuaaccccgucaacaaa

SEQ ID NO: 1068065 - RNA, 13 nt, Homo sapiens
uuuuaacuccuca

SEQ ID NO: 1068066 - RNA, 14 nt, Homo sapiens
uuuuaacuccucaa

SEQ ID NO: 1068067 - RNA, 18 nt, Homo sapiens
uuuuaucauuaccauuaa

SEQ ID NO: 1068068 - RNA, 13 nt, Homo sapiens
uuuucuccagggu

SEQ ID NO: 1068069 - RNA, 14 nt, Homo sapiens
uuuucuucaccucu

SEQ ID NO: 1068070 - RNA, 12 nt, Homo sapiens
uuuuuuaaucuc

SEQ ID NO: 1068071 - RNA, 20 nt, Homo sapiens
uuuuuuauaaucaagccuaa

SEQ ID NO: 1068072 - RNA, 21 nt, Homo sapiens
auaucugagcucuuugcacua

SEQ ID NO: 1068073 - RNA, 18 nt, Homo sapiens
auaugauuuuuauccaug

SEQ ID NO: 1068074 - RNA, 17 nt, Homo sapiens
auauuggguuccauucu

SEQ ID NO: 1068075 - RNA, 12 nt, Homo sapiens
auauuugcacua

SEQ ID NO: 1068076 - RNA, 14 nt, Homo sapiens
auauuuugaucuuc

SEQ ID NO: 1068077 - RNA, 16 nt, Homo sapiens
aucaaagccacacucu

SEQ ID NO: 1068078 - RNA, 15 nt, Homo sapiens
aucaacccuaaaaag

SEQ ID NO: 1068079 - RNA, 18 nt, Homo sapiens
aucaagaagggcugcaug

SEQ ID NO: 1068080 - RNA, 21 nt, Homo sapiens
aucacagcaaugcucuauucc

SEQ ID NO: 1068081 - RNA, 18 nt, Homo sapiens
aucaggaccuccaagcca

SEQ ID NO: 1068082 - RNA, 19 nt, Homo sapiens
aucauaauuaauguaguag

SEQ ID NO: 1068083 - RNA, 13 nt, Homo sapiens
aucauagcaauau

SEQ ID NO: 1068084 - RNA, 12 nt, Homo sapiens
aucaucucucau

SEQ ID NO: 1068085 - RNA, 15 nt, Homo sapiens
aucauucccuucgac

SEQ ID NO: 1068086 - RNA, 22 nt, Homo sapiens
aucauucccuucgacagcauuu

SEQ ID NO: 1068087 - RNA, 15 nt, Homo sapiens
auccagcccaugccg

SEQ ID NO: 1068088 - RNA, 15 nt, Homo sapiens
auccaucgaagcaga

SEQ ID NO: 1068089 - RNA, 14 nt, Homo sapiens
aucccaguacucug

SEQ ID NO: 1068090 - RNA, 15 nt, Homo sapiens
auccccugccuccau

SEQ ID NO: 1068091 - RNA, 16 nt, Homo sapiens
auccugagucaugugu

SEQ ID NO: 1068092 - RNA, 15 nt, Homo sapiens
auccugugccuccau

SEQ ID NO: 1068093 - RNA, 20 nt, Homo sapiens
auccuuccuuuugagggagc

SEQ ID NO: 1068094 - RNA, 14 nt, Homo sapiens
aucgcaguguucaa

SEQ ID NO: 1068095 - RNA, 14 nt, Homo sapiens
aucuaauacacuuu

SEQ ID NO: 1068096 - RNA, 18 nt, Homo sapiens
aucuccaagaccagagau

SEQ ID NO: 1068097 - RNA, 17 nt, Homo sapiens
aucucugugaaaccccu

SEQ ID NO: 1068098 - RNA, 20 nt, Homo sapiens
aucuuccaugcuacauguac

SEQ ID NO: 1068099 - RNA, 13 nt, Homo sapiens
augaaaaugucau

SEQ ID NO: 1068100 - RNA, 19 nt, Homo sapiens
augaagucucuaacaaugu

SEQ ID NO: 1068101 - RNA, 21 nt, Homo sapiens
augaauucuuaagacuugcau

SEQ ID NO: 1068102 - RNA, 19 nt, Homo sapiens
augacuucagcaguggcag

SEQ ID NO: 1068103 - RNA, 17 nt, Homo sapiens
augacuuuuuauacuuu

SEQ ID NO: 1068104 - RNA, 19 nt, Homo sapiens
augaucauuaggacauaac

SEQ ID NO: 1068105 - RNA, 23 nt, Homo sapiens
augauccaagcaagacugagggg

SEQ ID NO: 1068106 - RNA, 13 nt, Homo sapiens
augaucuuuucaa

SEQ ID NO: 1068107 - RNA, 15 nt, Homo sapiens
augcaacaacaugua

SEQ ID NO: 1068108 - RNA, 18 nt, Homo sapiens
augcaccuguagucucac

SEQ ID NO: 1068109 - RNA, 19 nt, Homo sapiens
augcacucagcucuuggcu

SEQ ID NO: 1068110 - RNA, 11 nt, Homo sapiens
augccaaaaaa

SEQ ID NO: 1068111 - RNA, 15 nt, Homo sapiens
augccuguaauccca

SEQ ID NO: 1068112 - RNA, 14 nt, Homo sapiens
augcucagaccagc

SEQ ID NO: 1068113 - RNA, 17 nt, Homo sapiens
augcucugaacccugag

SEQ ID NO: 1068114 - RNA, 23 nt, Homo sapiens
augcugagagagcuggaggcacc

SEQ ID NO: 1068115 - RNA, 22 nt, Homo sapiens
augcuguuaugaguggcuuuaa

SEQ ID NO: 1068116 - RNA, 21 nt, Homo sapiens
augcuuuuggggggcauauau

SEQ ID NO: 1068117 - RNA, 13 nt, Homo sapiens
auggcagcugcca

SEQ ID NO: 1068118 - RNA, 22 nt, Homo sapiens
augggaggagaggacaagggaa

SEQ ID NO: 1068119 - RNA, 18 nt, Homo sapiens
augggugaaggcuggcau

SEQ ID NO: 1068120 - RNA, 20 nt, Homo sapiens
auggguuuagggaagacauu

SEQ ID NO: 1068121 - RNA, 14 nt, Homo sapiens
auggugaaaugcag

SEQ ID NO: 1068122 - RNA, 19 nt, Homo sapiens
auguauuuucuucaccucu

SEQ ID NO: 1068123 - RNA, 14 nt, Homo sapiens
augucauauuccau

SEQ ID NO: 1068124 - RNA, 20 nt, Homo sapiens
augucuauuauauuuacuua

SEQ ID NO: 1068125 - RNA, 15 nt, Homo sapiens
augucucagaccacu

SEQ ID NO: 1068126 - RNA, 21 nt, Homo sapiens
augugaauuauuuccugcuua

SEQ ID NO: 1068127 - RNA, 19 nt, Homo sapiens
augugagcugucacugugg

SEQ ID NO: 1068128 - RNA, 14 nt, Homo sapiens
augugcuacagggg

SEQ ID NO: 1068129 - RNA, 14 nt, Homo sapiens
augugguugcauaa

SEQ ID NO: 1068130 - RNA, 23 nt, Homo sapiens
auguuuguuguauacuuccuuau

SEQ ID NO: 1068131 - RNA, 16 nt, Homo sapiens
auuaagccuuccacac

SEQ ID NO: 1068132 - RNA, 14 nt, Homo sapiens
auuaaguguuuaaa

SEQ ID NO: 1068133 - RNA, 14 nt, Homo sapiens
auuaauacaaugau

SEQ ID NO: 1068134 - RNA, 10 nt, Homo sapiens
auuaauuccu

SEQ ID NO: 1068135 - RNA, 13 nt, Homo sapiens
auuagccaggugu

SEQ ID NO: 1068136 - RNA, 21 nt, Homo sapiens
auuagcugcuucuauguuuca

SEQ ID NO: 1068137 - RNA, 14 nt, Homo sapiens
auuaggacauaaca

SEQ ID NO: 1068138 - RNA, 23 nt, Homo sapiens
auuagggcaaggugugguagcuc

SEQ ID NO: 1068139 - RNA, 22 nt, Homo sapiens
auuagugccacaaauaaguuac

SEQ ID NO: 1068140 - RNA, 19 nt, Homo sapiens
auuauuuaugugaaaguca

SEQ ID NO: 1068141 - RNA, 19 nt, Homo sapiens
auucaaauugacugaagca

SEQ ID NO: 1068142 - RNA, 20 nt, Homo sapiens
auucaucauuccauaugacu

SEQ ID NO: 1068143 - RNA, 18 nt, Homo sapiens
auucuaacuuuuuugcua

SEQ ID NO: 1068144 - RNA, 17 nt, Homo sapiens
auucuagaaacaggaaa

SEQ ID NO: 1068145 - RNA, 16 nt, Homo sapiens
auucucagguugucag

SEQ ID NO: 1068146 - RNA, 23 nt, Homo sapiens
auucugagguaaccucauuauca

SEQ ID NO: 1068147 - RNA, 15 nt, Homo sapiens
auucugucacccaga

SEQ ID NO: 1068148 - RNA, 22 nt, Homo sapiens
auucugucacccagacuggagu

SEQ ID NO: 1068149 - RNA, 20 nt, Homo sapiens
auucuuacaaacaugugguu

SEQ ID NO: 1068150 - RNA, 13 nt, Homo sapiens
auucuugaaguca

SEQ ID NO: 1068151 - RNA, 12 nt, Homo sapiens
auugaacuguac

SEQ ID NO: 1068152 - RNA, 23 nt, Homo sapiens
auugaacuguaccaugugcuaca

SEQ ID NO: 1068153 - RNA, 17 nt, Homo sapiens
auugacagaacacccaa

SEQ ID NO: 1068154 - RNA, 12 nt, Homo sapiens
auugacuuuguc

SEQ ID NO: 1068155 - RNA, 18 nt, Homo sapiens
auuguccccuaaaccaaa

SEQ ID NO: 1068156 - RNA, 21 nt, Homo sapiens
auugucucuagagauugucag

SEQ ID NO: 1068157 - RNA, 18 nt, Homo sapiens
auuuaaaucuuacagauc

SEQ ID NO: 1068158 - RNA, 20 nt, Homo sapiens
auuuaaucaccacucaaaaa

SEQ ID NO: 1068159 - RNA, 22 nt, Homo sapiens
auuuacaacccgguucacucuu

SEQ ID NO: 1068160 - RNA, 13 nt, Homo sapiens
auuuaugucucag

SEQ ID NO: 1068161 - RNA, 23 nt, Homo sapiens
auuucaccacucaaaggccagac

SEQ ID NO: 1068162 - RNA, 15 nt, Homo sapiens
auuucuucaccagau

SEQ ID NO: 1068163 - RNA, 16 nt, Homo sapiens
auuugcaauuccugcu

SEQ ID NO: 1068164 - RNA, 19 nt, Homo sapiens
auuugguuuuccuguauag

SEQ ID NO: 1068165 - RNA, 19 nt, Homo sapiens
auuuucuacacauacaugu

SEQ ID NO: 1068166 - RNA, 20 nt, Homo sapiens
auuuucuucaccucugcuac

SEQ ID NO: 1068167 - RNA, 20 nt, Homo sapiens
auuuugaaguaccaccaaaa

SEQ ID NO: 1068168 - RNA, 24 nt, Homo sapiens
auuuugggaaaaaaacauacacaa

SEQ ID NO: 1068169 - RNA, 14 nt, Homo sapiens
auuuuugaaaccaa

SEQ ID NO: 1068170 - RNA, 15 nt, Homo sapiens
auuuuuuaaagcuac

SEQ ID NO: 1068171 - RNA, 22 nt, Homo sapiens
auuuuuugguuaagcuuugaca

SEQ ID NO: 1068172 - RNA, 12 nt, Homo sapiens
caaaaacugaaa

SEQ ID NO: 1068173 - RNA, 20 nt, Homo sapiens
caaaagcugcucagggaaaa

SEQ ID NO: 1068174 - RNA, 17 nt, Homo sapiens
caaaauugcaaaccacg

SEQ ID NO: 1068175 - RNA, 20 nt, Homo sapiens
caaaauuggaagcugucaua

SEQ ID NO: 1068176 - RNA, 21 nt, Homo sapiens
caaacacauuaagccuuccac

SEQ ID NO: 1068177 - RNA, 17 nt, Homo sapiens
caaacagaaaacaugua

SEQ ID NO: 1068178 - RNA, 20 nt, Homo sapiens
caaacauguuccugggauca

SEQ ID NO: 1068179 - RNA, 12 nt, Homo sapiens
caaacauuuacc

SEQ ID NO: 1068180 - RNA, 14 nt, Homo sapiens
caaaccuacuguau

SEQ ID NO: 1068181 - RNA, 20 nt, Homo sapiens
caaacuaggggacaaagcaa

SEQ ID NO: 1068182 - RNA, 22 nt, Homo sapiens
caaacugcugucccaaacaugc

SEQ ID NO: 1068183 - RNA, 16 nt, Homo sapiens
caaacuuccagugcaa

SEQ ID NO: 1068184 - RNA, 13 nt, Homo sapiens
caaagaaauaucu

SEQ ID NO: 1068185 - RNA, 19 nt, Homo sapiens
caaagaugaucaguaugaa

SEQ ID NO: 1068186 - RNA, 14 nt, Homo sapiens
caaagccacacucu

SEQ ID NO: 1068187 - RNA, 11 nt, Homo sapiens
caaagugugac

SEQ ID NO: 1068188 - RNA, 18 nt, Homo sapiens
caaauagaauuugagcau

SEQ ID NO: 1068189 - RNA, 20 nt, Homo sapiens
caaaucaucucucaucacuu

SEQ ID NO: 1068190 - RNA, 16 nt, Homo sapiens
caaauuggauacugcu

SEQ ID NO: 1068191 - RNA, 15 nt, Homo sapiens
agauauaugaauaug

SEQ ID NO: 1068192 - RNA, 15 nt, Homo sapiens
agaucaugucucacu

SEQ ID NO: 1068193 - RNA, 18 nt, Homo sapiens
agaugauggcucauuuac

SEQ ID NO: 1068194 - RNA, 19 nt, Homo sapiens
agaugauggcucauuuaca

SEQ ID NO: 1068195 - RNA, 14 nt, Homo sapiens
agaugcagcauuuu

SEQ ID NO: 1068196 - RNA, 14 nt, Homo sapiens
agaugccccagccu

SEQ ID NO: 1068197 - RNA, 16 nt, Homo sapiens
agauguaaaguuauuc

SEQ ID NO: 1068198 - RNA, 15 nt, Homo sapiens
agauguggagcuauu

SEQ ID NO: 1068199 - RNA, 16 nt, Homo sapiens
agauuccgcaccaaua

SEQ ID NO: 1068200 - RNA, 18 nt, Homo sapiens
agauucuucccauucucc

SEQ ID NO: 1068201 - RNA, 21 nt, Homo sapiens
agauugagcuuagauugccuc

SEQ ID NO: 1068202 - RNA, 16 nt, Homo sapiens
agauuuggagcugucu

SEQ ID NO: 1068203 - RNA, 18 nt, Homo sapiens
agcaagaucccaucucuu

SEQ ID NO: 1068204 - RNA, 18 nt, Homo sapiens
agcacuaauucaacauau

SEQ ID NO: 1068205 - RNA, 17 nt, Homo sapiens
agcaggcacccacuucc

SEQ ID NO: 1068206 - RNA, 14 nt, Homo sapiens
agcagguggcagaa

SEQ ID NO: 1068207 - RNA, 20 nt, Homo sapiens
agccaagaugacacaacugc

SEQ ID NO: 1068208 - RNA, 12 nt, Homo sapiens
agccacacucug

SEQ ID NO: 1068209 - RNA, 21 nt, Homo sapiens
agccacuacauuacuucaaac

SEQ ID NO: 1068210 - RNA, 17 nt, Homo sapiens
agccagaggacugugau

SEQ ID NO: 1068211 - RNA, 17 nt, Homo sapiens
agccagaggcaccucaa

SEQ ID NO: 1068212 - RNA, 15 nt, Homo sapiens
agccccucacacagc

SEQ ID NO: 1068213 - RNA, 15 nt, Homo sapiens
agccggccacuuugg

SEQ ID NO: 1068214 - RNA, 20 nt, Homo sapiens
agccguugugcgaagacaga

SEQ ID NO: 1068215 - RNA, 20 nt, Homo sapiens
agccugaccaaaauggugaa

SEQ ID NO: 1068216 - RNA, 20 nt, Homo sapiens
agcggacaguggcaggacag

SEQ ID NO: 1068217 - RNA, 11 nt, Homo sapiens
agcggacauca

SEQ ID NO: 1068218 - RNA, 15 nt, Homo sapiens
agcuacuaugcccaa

SEQ ID NO: 1068219 - RNA, 10 nt, Homo sapiens
agcuccucac

SEQ ID NO: 1068220 - RNA, 13 nt, Homo sapiens
agcuccucacuca

SEQ ID NO: 1068221 - RNA, 19 nt, Homo sapiens
agcucuugaagacacugaa

SEQ ID NO: 1068222 - RNA, 20 nt, Homo sapiens
agcucuuggcuccacuggga

SEQ ID NO: 1068223 - RNA, 14 nt, Homo sapiens
agcugcaggggcau

SEQ ID NO: 1068224 - RNA, 13 nt, Homo sapiens
agcugcucaggga

SEQ ID NO: 1068225 - RNA, 15 nt, Homo sapiens
agcugucauaaaaag

SEQ ID NO: 1068226 - RNA, 17 nt, Homo sapiens
agcuuaggaaagaacau

SEQ ID NO: 1068227 - RNA, 15 nt, Homo sapiens
agcuucucauccugc

SEQ ID NO: 1068228 - RNA, 17 nt, Homo sapiens
agcuuugcuucucucuc

SEQ ID NO: 1068229 - RNA, 20 nt, Homo sapiens
aggaaaaaacuaguauuccc

SEQ ID NO: 1068230 - RNA, 17 nt, Homo sapiens
aggaaacaacagcuuua

SEQ ID NO: 1068231 - RNA, 15 nt, Homo sapiens
aggaaagaacaucac

SEQ ID NO: 1068232 - RNA, 20 nt, Homo sapiens
aggaaauauaucuuaaugca

SEQ ID NO: 1068233 - RNA, 21 nt, Homo sapiens
aggaacaucucugcuuucacu

SEQ ID NO: 1068234 - RNA, 17 nt, Homo sapiens
aggaagaugauggcuca

SEQ ID NO: 1068235 - RNA, 14 nt, Homo sapiens
aggaagcuccaguu

SEQ ID NO: 1068236 - RNA, 17 nt, Homo sapiens
aggaaguuaugggaaua

SEQ ID NO: 1068237 - RNA, 20 nt, Homo sapiens
aggacauccccccgccaaaa

SEQ ID NO: 1068238 - RNA, 18 nt, Homo sapiens
aggagaaucaaaaugcaa

SEQ ID NO: 1068239 - RNA, 15 nt, Homo sapiens
aggagacccacaggu

SEQ ID NO: 1068240 - RNA, 14 nt, Homo sapiens
aggagcacuacaga

SEQ ID NO: 1068241 - RNA, 18 nt, Homo sapiens
aggaggaacagauuugag

SEQ ID NO: 1068242 - RNA, 19 nt, Homo sapiens
aggaguucugcucauucua

SEQ ID NO: 1068243 - RNA, 14 nt, Homo sapiens
aggaucacugggcu

SEQ ID NO: 1068244 - RNA, 20 nt, Homo sapiens
aggcauccuuccucacacca

SEQ ID NO: 1068245 - RNA, 17 nt, Homo sapiens
aggccauggauggaaaa

SEQ ID NO: 1068246 - RNA, 16 nt, Homo sapiens
aggcccagaugugguu

SEQ ID NO: 1068247 - RNA, 19 nt, Homo sapiens
aggcgggcgcacugccucu

SEQ ID NO: 1068248 - RNA, 13 nt, Homo sapiens
agggaaaagcagc

SEQ ID NO: 1068249 - RNA, 18 nt, Homo sapiens
agggaagaagcauacaac

SEQ ID NO: 1068250 - RNA, 20 nt, Homo sapiens
agggaauggcacagcccaaa

SEQ ID NO: 1068251 - RNA, 17 nt, Homo sapiens
agggaccuugucuccca

SEQ ID NO: 1068252 - RNA, 18 nt, Homo sapiens
agggagcugcaggggcau

SEQ ID NO: 1068253 - RNA, 22 nt, Homo sapiens
agggcaaggugugguagcucac

SEQ ID NO: 1068254 - RNA, 20 nt, Homo sapiens
aggggaacagaagaaaauaa

SEQ ID NO: 1068255 - RNA, 16 nt, Homo sapiens
aggggcagauggaaag

SEQ ID NO: 1068256 - RNA, 20 nt, Homo sapiens
aggggccagaagaugaacag

SEQ ID NO: 1068257 - RNA, 21 nt, Homo sapiens
agggggaggcuaaagcccaga

SEQ ID NO: 1068258 - RNA, 13 nt, Homo sapiens
agggugagugcaa

SEQ ID NO: 1068259 - RNA, 13 nt, Homo sapiens
aggucuagccuau

SEQ ID NO: 1068260 - RNA, 14 nt, Homo sapiens
aggugaaacccagu

SEQ ID NO: 1068261 - RNA, 20 nt, Homo sapiens
aggugaaacccagucacugu

SEQ ID NO: 1068262 - RNA, 21 nt, Homo sapiens
aggugaacaagcaaacccaga

SEQ ID NO: 1068263 - RNA, 14 nt, Homo sapiens
aggugggguuucac

SEQ ID NO: 1068264 - RNA, 17 nt, Homo sapiens
agguguggcggcgagca

SEQ ID NO: 1068265 - RNA, 14 nt, Homo sapiens
aggugugguagcuc

SEQ ID NO: 1068266 - RNA, 15 nt, Homo sapiens
agguuuuuaugcaug

SEQ ID NO: 1068267 - RNA, 22 nt, Homo sapiens
aguaacccccacuggacugacc

SEQ ID NO: 1068268 - RNA, 12 nt, Homo sapiens
aguagauaagga

SEQ ID NO: 1068269 - RNA, 16 nt, Homo sapiens
aguauauguugcaaaa

SEQ ID NO: 1068270 - RNA, 21 nt, Homo sapiens
aguaugguaauuaaauguacu

SEQ ID NO: 1068271 - RNA, 22 nt, Homo sapiens
agucagaauuagcugcuucuau

SEQ ID NO: 1068272 - RNA, 13 nt, Homo sapiens
aguccucauuuac

SEQ ID NO: 1068273 - RNA, 16 nt, Homo sapiens
aguccuucaaacuucc

SEQ ID NO: 1068274 - RNA, 17 nt, Homo sapiens
aguccuucccuuucauu

SEQ ID NO: 1068275 - RNA, 20 nt, Homo sapiens
agucuauuugagacuccuca

SEQ ID NO: 1068276 - RNA, 14 nt, Homo sapiens
agucucauucuguc

SEQ ID NO: 1068277 - RNA, 19 nt, Homo sapiens
agucugaugagaacucuga

SEQ ID NO: 1068278 - RNA, 19 nt, Homo sapiens
agucuuugguaaauggcaa

SEQ ID NO: 1068279 - RNA, 13 nt, Homo sapiens
agugaaaaaucug

SEQ ID NO: 1068280 - RNA, 12 nt, Homo sapiens
agugaauauuca

SEQ ID NO: 1068281 - RNA, 16 nt, Homo sapiens
agugaggucacagucc

SEQ ID NO: 1068282 - RNA, 22 nt, Homo sapiens
aguggaaagacagcuucucauc

SEQ ID NO: 1068283 - RNA, 19 nt, Homo sapiens
aguggggagacuucuuggc

SEQ ID NO: 1068284 - RNA, 14 nt, Homo sapiens
aguggugccugcau

SEQ ID NO: 1068285 - RNA, 21 nt, Homo sapiens
agugugaauaaagugcugcgg

SEQ ID NO: 1068286 - RNA, 18 nt, Homo sapiens
aguguggagucauucuca

SEQ ID NO: 1068287 - RNA, 12 nt, Homo sapiens
aguuaauuugca

SEQ ID NO: 1068288 - RNA, 13 nt, Homo sapiens
aguucacaucaga

SEQ ID NO: 1068289 - RNA, 20 nt, Homo sapiens
aguuuuucccuucaucuggg

SEQ ID NO: 1068290 - RNA, 15 nt, Homo sapiens
auaaauaaaacauuu

SEQ ID NO: 1068291 - RNA, 22 nt, Homo sapiens
auaaccuccagccuccugccca

SEQ ID NO: 1068292 - RNA, 22 nt, Homo sapiens
auaacugcccagcggacagugg

SEQ ID NO: 1068293 - RNA, 22 nt, Homo sapiens
auaaguuacaucuacaaacagg

SEQ ID NO: 1068294 - RNA, 16 nt, Homo sapiens
auaauuauuuauguga

SEQ ID NO: 1068295 - RNA, 15 nt, Homo sapiens
auacaacacaaagag

SEQ ID NO: 1068296 - RNA, 23 nt, Homo sapiens
auacugcugcgucauuacagggc

SEQ ID NO: 1068297 - RNA, 23 nt, Homo sapiens
auacuuccuuaugcuucuuucaa

SEQ ID NO: 1068298 - RNA, 22 nt, Homo sapiens
auacuugauuuaaucaccacuc

SEQ ID NO: 1068299 - RNA, 19 nt, Homo sapiens
auagaaagugccagaaagu

SEQ ID NO: 1068300 - RNA, 15 nt, Homo sapiens
auagagccacguaug

SEQ ID NO: 1068301 - RNA, 13 nt, Homo sapiens
auagaucuuuuca

SEQ ID NO: 1068302 - RNA, 15 nt, Homo sapiens
auagcaagaucccau

SEQ ID NO: 1068303 - RNA, 19 nt, Homo sapiens
auagcaauaucauaauuaa

SEQ ID NO: 1068304 - RNA, 16 nt, Homo sapiens
auaggacccauauucc

SEQ ID NO: 1068305 - RNA, 14 nt, Homo sapiens
auaguauugugcau

SEQ ID NO: 1068306 - RNA, 15 nt, Homo sapiens
auauaaacacuauau

SEQ ID NO: 1068307 - RNA, 22 nt, Homo sapiens
auauaauacuauauuuauacug

SEQ ID NO: 1068308 - RNA, 13 nt, Homo sapiens
auauaauacugua

SEQ ID NO: 1068309 - RNA, 14 nt, Homo sapiens
auauaauacuguau

SEQ ID NO: 1068310 - RNA, 15 nt, Homo sapiens
auauaauacuguauu

SEQ ID NO: 1068311 - RNA, 21 nt, Homo sapiens
uguaccuguuuccuacagaca

SEQ ID NO: 1068312 - RNA, 23 nt, Homo sapiens
uguauacuuccuuaugcuucuuu

SEQ ID NO: 1068313 - RNA, 15 nt, Homo sapiens
uguauagaccuaaaa

SEQ ID NO: 1068314 - RNA, 15 nt, Homo sapiens
uguauauaugccuuu

SEQ ID NO: 1068315 - RNA, 23 nt, Homo sapiens
ugucagcuugguccacaucacca

SEQ ID NO: 1068316 - RNA, 13 nt, Homo sapiens
ugucauucuagaa

SEQ ID NO: 1068317 - RNA, 19 nt, Homo sapiens
uguccccucugcaugcccu

SEQ ID NO: 1068318 - RNA, 15 nt, Homo sapiens
uguccuccaagccag

SEQ ID NO: 1068319 - RNA, 19 nt, Homo sapiens
ugucuaaaaaacaaaacaa

SEQ ID NO: 1068320 - RNA, 19 nt, Homo sapiens
ugucucacuucacagcccu

SEQ ID NO: 1068321 - RNA, 16 nt, Homo sapiens
ugucucagaccacuau

SEQ ID NO: 1068322 - RNA, 17 nt, Homo sapiens
ugucucagaccacuauu

SEQ ID NO: 1068323 - RNA, 18 nt, Homo sapiens
ugucucagaccacuauuc

SEQ ID NO: 1068324 - RNA, 20 nt, Homo sapiens
ugucugaguggcuucacucc

SEQ ID NO: 1068325 - RNA, 14 nt, Homo sapiens
ugucuguaucagug

SEQ ID NO: 1068326 - RNA, 13 nt, Homo sapiens
ugugaacaaccug

SEQ ID NO: 1068327 - RNA, 18 nt, Homo sapiens
ugugaacccaaaguguga

SEQ ID NO: 1068328 - RNA, 20 nt, Homo sapiens
ugugccgcaccauugaacug

SEQ ID NO: 1068329 - RNA, 19 nt, Homo sapiens
ugugccuuaggaaaagcau

SEQ ID NO: 1068330 - RNA, 15 nt, Homo sapiens
ugugcuuaacauuga

SEQ ID NO: 1068331 - RNA, 13 nt, Homo sapiens
uguggagucauuc

SEQ ID NO: 1068332 - RNA, 16 nt, Homo sapiens
uguggagucauucuca

SEQ ID NO: 1068333 - RNA, 14 nt, Homo sapiens
ugugguagcucaca

SEQ ID NO: 1068334 - RNA, 15 nt, Homo sapiens
ugugguuaacgccuu

SEQ ID NO: 1068335 - RNA, 19 nt, Homo sapiens
ugugguuacacagugugaa

SEQ ID NO: 1068336 - RNA, 15 nt, Homo sapiens
uguguaaugugcaaa

SEQ ID NO: 1068337 - RNA, 22 nt, Homo sapiens
ugugucagaaacugaagcuguu

SEQ ID NO: 1068338 - RNA, 21 nt, Homo sapiens
uguuaauaugguguacauucu

SEQ ID NO: 1068339 - RNA, 12 nt, Homo sapiens
uguucaauguuu

SEQ ID NO: 1068340 - RNA, 14 nt, Homo sapiens
uguucccuuacugu

SEQ ID NO: 1068341 - RNA, 17 nt, Homo sapiens
uguucuguauucugacc

SEQ ID NO: 1068342 - RNA, 16 nt, Homo sapiens
uguucuuuuuauugaa

SEQ ID NO: 1068343 - RNA, 15 nt, Homo sapiens
uguuguauacuuccu

SEQ ID NO: 1068344 - RNA, 22 nt, Homo sapiens
uguuugggauccuauugaacca

SEQ ID NO: 1068345 - RNA, 16 nt, Homo sapiens
uguuuguuguauacuu

SEQ ID NO: 1068346 - RNA, 13 nt, Homo sapiens
uguuuuaggucua

SEQ ID NO: 1068347 - RNA, 22 nt, Homo sapiens
uuaaaaaaaagaauaaagguau

SEQ ID NO: 1068348 - RNA, 22 nt, Homo sapiens
uuaaacuuagacagcauguaug

SEQ ID NO: 1068349 - RNA, 14 nt, Homo sapiens
uuaaaugaacauca

SEQ ID NO: 1068350 - RNA, 20 nt, Homo sapiens
uuaaaugugacauucuuaaa

SEQ ID NO: 1068351 - RNA, 22 nt, Homo sapiens
uuaaccugccaacauacuuuaa

SEQ ID NO: 1068352 - RNA, 10 nt, Homo sapiens
uuaacuauug

SEQ ID NO: 1068353 - RNA, 19 nt, Homo sapiens
uuaagguaugguacaagca

SEQ ID NO: 1068354 - RNA, 16 nt, Homo sapiens
uuaaguuuccuuccag

SEQ ID NO: 1068355 - RNA, 13 nt, Homo sapiens
uuaauaaagaagu

SEQ ID NO: 1068356 - RNA, 13 nt, Homo sapiens
uuaauacuugauu

SEQ ID NO: 1068357 - RNA, 15 nt, Homo sapiens
uuaaucaccacucaa

SEQ ID NO: 1068358 - RNA, 17 nt, Homo sapiens
uuaaugcagacaaacaa

SEQ ID NO: 1068359 - RNA, 19 nt, Homo sapiens
uuacaacccgguucacucu

SEQ ID NO: 1068360 - RNA, 16 nt, Homo sapiens
uuacaaccugauguca

SEQ ID NO: 1068361 - RNA, 21 nt, Homo sapiens
uuacagacuccuaacuacagg

SEQ ID NO: 1068362 - RNA, 20 nt, Homo sapiens
uuacaguauauguugcaaaa

SEQ ID NO: 1068363 - RNA, 21 nt, Homo sapiens
uuacaguauauguugcaaaau

SEQ ID NO: 1068364 - RNA, 16 nt, Homo sapiens
uuacaugaaacuacuc

SEQ ID NO: 1068365 - RNA, 17 nt, Homo sapiens
uuaccuucauaugcagu

SEQ ID NO: 1068366 - RNA, 15 nt, Homo sapiens
uuagaggaaggagau

SEQ ID NO: 1068367 - RNA, 15 nt, Homo sapiens
uuagccagugaugcu

SEQ ID NO: 1068368 - RNA, 21 nt, Homo sapiens
uuaggaauaaucuccuguuaa

SEQ ID NO: 1068369 - RNA, 20 nt, Homo sapiens
uuaggugguguuugcuuguu

SEQ ID NO: 1068370 - RNA, 15 nt, Homo sapiens
uuaguacuuacauca

SEQ ID NO: 1068371 - RNA, 13 nt, Homo sapiens
uuaguuuugcaua

SEQ ID NO: 1068372 - RNA, 15 nt, Homo sapiens
uuauaagacaaugag

SEQ ID NO: 1068373 - RNA, 11 nt, Homo sapiens
uuauacuguau

SEQ ID NO: 1068374 - RNA, 18 nt, Homo sapiens
uuaucaauuaaugacaau

SEQ ID NO: 1068375 - RNA, 16 nt, Homo sapiens
uuaugaguggcuuuaa

SEQ ID NO: 1068376 - RNA, 10 nt, Homo sapiens
uuauucuuga

SEQ ID NO: 1068377 - RNA, 15 nt, Homo sapiens
uucaaaaaccacguu

SEQ ID NO: 1068378 - RNA, 23 nt, Homo sapiens
uucaaacuaggggacaaagcaaa

SEQ ID NO: 1068379 - RNA, 18 nt, Homo sapiens
uucaaacuuccagugcaa

SEQ ID NO: 1068380 - RNA, 17 nt, Homo sapiens
uucaaagagcuugaaaa

SEQ ID NO: 1068381 - RNA, 23 nt, Homo sapiens
uucacaaacagaaaacauguaaa

SEQ ID NO: 1068382 - RNA, 11 nt, Homo sapiens
uucacagugca

SEQ ID NO: 1068383 - RNA, 17 nt, Homo sapiens
uucacaucagaacagac

SEQ ID NO: 1068384 - RNA, 21 nt, Homo sapiens
uucaccugggcugaggcaucc

SEQ ID NO: 1068385 - RNA, 21 nt, Homo sapiens
uucacucuuuagaaauaaugg

SEQ ID NO: 1068386 - RNA, 14 nt, Homo sapiens
uucagaccuuuuaa

SEQ ID NO: 1068387 - RNA, 21 nt, Homo sapiens
uucagaccuuuuaacuccuca

SEQ ID NO: 1068388 - RNA, 22 nt, Homo sapiens
uucagauuauccuuccuccuca

SEQ ID NO: 1068389 - RNA, 21 nt, Homo sapiens
uucaugaguuuuucccagcua

SEQ ID NO: 1068390 - RNA, 14 nt, Homo sapiens
uucaugcaggugaa

SEQ ID NO: 1068391 - RNA, 19 nt, Homo sapiens
uuccaaauuggauacugcu

SEQ ID NO: 1068392 - RNA, 19 nt, Homo sapiens
uuccaacacugauuucccc

SEQ ID NO: 1068393 - RNA, 20 nt, Homo sapiens
uuccacacucaccucuaaaa

SEQ ID NO: 1068394 - RNA, 16 nt, Homo sapiens
uuccauucucaccuau

SEQ ID NO: 1068395 - RNA, 12 nt, Homo sapiens
uucccauucucc

SEQ ID NO: 1068396 - RNA, 21 nt, Homo sapiens
uuccuaacauaccuaagcaaa

SEQ ID NO: 1068397 - RNA, 23 nt, Homo sapiens
uuccuccucacccugccggguag

SEQ ID NO: 1068398 - RNA, 15 nt, Homo sapiens
uuccucugcuuugaa

SEQ ID NO: 1068399 - RNA, 15 nt, Homo sapiens
uuccugcuuauucau

SEQ ID NO: 1068400 - RNA, 16 nt, Homo sapiens
uucuacacauacaugu

SEQ ID NO: 1068401 - RNA, 17 nt, Homo sapiens
uucuaggaagcuccagu

SEQ ID NO: 1068402 - RNA, 15 nt, Homo sapiens
uucucagguugccag

SEQ ID NO: 1068403 - RNA, 11 nt, Homo sapiens
uucugacacag

SEQ ID NO: 1068404 - RNA, 16 nt, Homo sapiens
uucugcucauucuaau

SEQ ID NO: 1068405 - RNA, 16 nt, Homo sapiens
uucuggaaacauucag

SEQ ID NO: 1068406 - RNA, 21 nt, Homo sapiens
uucugucacccagacuggagu

SEQ ID NO: 1068407 - RNA, 17 nt, Homo sapiens
uucuguugucaccuuca

SEQ ID NO: 1068408 - RNA, 16 nt, Homo sapiens
uucuuacaaacaugug

SEQ ID NO: 1068409 - RNA, 17 nt, Homo sapiens
uucuuuaguacuuacau

SEQ ID NO: 1068410 - RNA, 20 nt, Homo sapiens
uugaagacauugcaccagau

SEQ ID NO: 1068411 - RNA, 23 nt, Homo sapiens
uugaauguugguuuuaauacuug

SEQ ID NO: 1068412 - RNA, 15 nt, Homo sapiens
uugacuuucauugga

SEQ ID NO: 1068413 - RNA, 19 nt, Homo sapiens
uugagcaucagugagguua

SEQ ID NO: 1068414 - RNA, 16 nt, Homo sapiens
uugauaguauugugca

SEQ ID NO: 1068415 - RNA, 17 nt, Homo sapiens
uugaugagcugugcaca

SEQ ID NO: 1068416 - RNA, 19 nt, Homo sapiens
uugauguggacaugagcca

SEQ ID NO: 1068417 - RNA, 23 nt, Homo sapiens
uugauuuaaucaccacucaaaaa

SEQ ID NO: 1068418 - RNA, 23 nt, Homo sapiens
uugccaagaccuuucaaagccau

SEQ ID NO: 1068419 - RNA, 17 nt, Homo sapiens
uugccgcgucgcccucc

SEQ ID NO: 1068420 - RNA, 18 nt, Homo sapiens
uugccucuuucacauuga

SEQ ID NO: 1068421 - RNA, 20 nt, Homo sapiens
uugccugggaaacauagcag

SEQ ID NO: 1068422 - RNA, 16 nt, Homo sapiens
uugcuucucucucuaa

SEQ ID NO: 1068423 - RNA, 23 nt, Homo sapiens
uuggaaaaauucauugucucuag

SEQ ID NO: 1068424 - RNA, 18 nt, Homo sapiens
uuggaaggcaaagacauu

SEQ ID NO: 1068425 - RNA, 12 nt, Homo sapiens
uuggacauuuac

SEQ ID NO: 1068426 - RNA, 12 nt, Homo sapiens
uuggagcugucu

SEQ ID NO: 1068427 - RNA, 21 nt, Homo sapiens
uuggcgggggcuuggcugugc

SEQ ID NO: 1068428 - RNA, 16 nt, Homo sapiens
uuggcuauaaccucca

SEQ ID NO: 1068429 - RNA, 22 nt, Homo sapiens
uuggcugugcccucagauuccg

SEQ ID NO: 1068430 - RNA, 21 nt, Homo sapiens
acauucuuccugauuauuuuc

SEQ ID NO: 1068431 - RNA, 19 nt, Homo sapiens
acauuggacagugagguca

SEQ ID NO: 1068432 - RNA, 19 nt, Homo sapiens
acauuuuacccacacacag

SEQ ID NO: 1068433 - RNA, 16 nt, Homo sapiens
acauuuuauaaucuau

SEQ ID NO: 1068434 - RNA, 15 nt, Homo sapiens
accaauaaagccuuc

SEQ ID NO: 1068435 - RNA, 14 nt, Homo sapiens
accacucaaaaaug

SEQ ID NO: 1068436 - RNA, 22 nt, Homo sapiens
accagacagacaacacugggaa

SEQ ID NO: 1068437 - RNA, 22 nt, Homo sapiens
accagccugggcaacaugaugu

SEQ ID NO: 1068438 - RNA, 21 nt, Homo sapiens
accagggagcugcaggggcau

SEQ ID NO: 1068439 - RNA, 17 nt, Homo sapiens
accauauugcccagggu

SEQ ID NO: 1068440 - RNA, 16 nt, Homo sapiens
accaugcgacacuggg

SEQ ID NO: 1068441 - RNA, 16 nt, Homo sapiens
accauuaaauaaugca

SEQ ID NO: 1068442 - RNA, 15 nt, Homo sapiens
acccaagaccucagg

SEQ ID NO: 1068443 - RNA, 20 nt, Homo sapiens
acccacaguggaaagacagc

SEQ ID NO: 1068444 - RNA, 18 nt, Homo sapiens
accccuuguuucuauaca

SEQ ID NO: 1068445 - RNA, 18 nt, Homo sapiens
acccucucucugaucucc

SEQ ID NO: 1068446 - RNA, 20 nt, Homo sapiens
acccugucucuacuaaaaau

SEQ ID NO: 1068447 - RNA, 16 nt, Homo sapiens
accggguggaagggau

SEQ ID NO: 1068448 - RNA, 17 nt, Homo sapiens
accguaggacccaagca

SEQ ID NO: 1068449 - RNA, 18 nt, Homo sapiens
accuauaaucccagcacu

SEQ ID NO: 1068450 - RNA, 19 nt, Homo sapiens
accuauccacacaacauau

SEQ ID NO: 1068451 - RNA, 21 nt, Homo sapiens
accuauuucucuuucuuuaca

SEQ ID NO: 1068452 - RNA, 12 nt, Homo sapiens
accucagccucc

SEQ ID NO: 1068453 - RNA, 12 nt, Homo sapiens
accucauuauca

SEQ ID NO: 1068454 - RNA, 19 nt, Homo sapiens
accuccagccuccugccca

SEQ ID NO: 1068455 - RNA, 22 nt, Homo sapiens
accuccuuucaagguaacugua

SEQ ID NO: 1068456 - RNA, 13 nt, Homo sapiens
accuguaauccca

SEQ ID NO: 1068457 - RNA, 13 nt, Homo sapiens
accuguauuccca

SEQ ID NO: 1068458 - RNA, 18 nt, Homo sapiens
accuguuuccuacagaca

SEQ ID NO: 1068459 - RNA, 14 nt, Homo sapiens
accuucaacuucca

SEQ ID NO: 1068460 - RNA, 13 nt, Homo sapiens
accuugaugagcu

SEQ ID NO: 1068461 - RNA, 13 nt, Homo sapiens
acgaaaguggaaa

SEQ ID NO: 1068462 - RNA, 21 nt, Homo sapiens
acgucacuucaugcaggugaa

SEQ ID NO: 1068463 - RNA, 16 nt, Homo sapiens
acuaaaaauacaaaaa

SEQ ID NO: 1068464 - RNA, 18 nt, Homo sapiens
acuacaauuuaaagcaaa

SEQ ID NO: 1068465 - RNA, 17 nt, Homo sapiens
acuacagguguugucca

SEQ ID NO: 1068466 - RNA, 13 nt, Homo sapiens
acuaggauacugc

SEQ ID NO: 1068467 - RNA, 19 nt, Homo sapiens
acuagguuaccgcuuauca

SEQ ID NO: 1068468 - RNA, 12 nt, Homo sapiens
acuaguaacaug

SEQ ID NO: 1068469 - RNA, 19 nt, Homo sapiens
acuauauuuauacuguaua

SEQ ID NO: 1068470 - RNA, 21 nt, Homo sapiens
acucaaaugcucagaccagcu

SEQ ID NO: 1068471 - RNA, 18 nt, Homo sapiens
acucacuucucuuccuug

SEQ ID NO: 1068472 - RNA, 17 nt, Homo sapiens
acucagcugcucugcaa

SEQ ID NO: 1068473 - RNA, 13 nt, Homo sapiens
acucaggacaucc

SEQ ID NO: 1068474 - RNA, 14 nt, Homo sapiens
acucugggcuccag

SEQ ID NO: 1068475 - RNA, 20 nt, Homo sapiens
acugaagcaaagaagggaau

SEQ ID NO: 1068476 - RNA, 15 nt, Homo sapiens
acugaggcauccacu

SEQ ID NO: 1068477 - RNA, 15 nt, Homo sapiens
acugcacucuagccu

SEQ ID NO: 1068478 - RNA, 21 nt, Homo sapiens
acugcaguggacaguccccac

SEQ ID NO: 1068479 - RNA, 12 nt, Homo sapiens
acugcauccuca

SEQ ID NO: 1068480 - RNA, 19 nt, Homo sapiens
acugggugcggugacucau

SEQ ID NO: 1068481 - RNA, 15 nt, Homo sapiens
acugucugacuuaua

SEQ ID NO: 1068482 - RNA, 16 nt, Homo sapiens
acugucuugaagacaa

SEQ ID NO: 1068483 - RNA, 22 nt, Homo sapiens
acugucuugaagacaauggcuu

SEQ ID NO: 1068484 - RNA, 14 nt, Homo sapiens
acuuauaauuugca

SEQ ID NO: 1068485 - RNA, 16 nt, Homo sapiens
acuucaaacugagauc

SEQ ID NO: 1068486 - RNA, 12 nt, Homo sapiens
acuucagucuuc

SEQ ID NO: 1068487 - RNA, 16 nt, Homo sapiens
acuucaugcaggugaa

SEQ ID NO: 1068488 - RNA, 23 nt, Homo sapiens
acuucaugcaggugaaacccagu

SEQ ID NO: 1068489 - RNA, 13 nt, Homo sapiens
acuucucuuccuu

SEQ ID NO: 1068490 - RNA, 20 nt, Homo sapiens
acuugccucacuggacucuu

SEQ ID NO: 1068491 - RNA, 18 nt, Homo sapiens
acuugggaauaaaucaua

SEQ ID NO: 1068492 - RNA, 22 nt, Homo sapiens
acuugggaauaaaucauagcaa

SEQ ID NO: 1068493 - RNA, 19 nt, Homo sapiens
acuuuacaaccugauguca

SEQ ID NO: 1068494 - RNA, 17 nt, Homo sapiens
agaaccacucauaauuc

SEQ ID NO: 1068495 - RNA, 18 nt, Homo sapiens
agaaccacucauaauucu

SEQ ID NO: 1068496 - RNA, 16 nt, Homo sapiens
agaagcauacaacuuu

SEQ ID NO: 1068497 - RNA, 18 nt, Homo sapiens
agaauauaauacuguauu

SEQ ID NO: 1068498 - RNA, 18 nt, Homo sapiens
agaaucucuugaaccugg

SEQ ID NO: 1068499 - RNA, 19 nt, Homo sapiens
agaauuaaaacuaugaaau

SEQ ID NO: 1068500 - RNA, 13 nt, Homo sapiens
agaauuagcugcu

SEQ ID NO: 1068501 - RNA, 14 nt, Homo sapiens
agaauuagcugcuu

SEQ ID NO: 1068502 - RNA, 20 nt, Homo sapiens
agacaaagacucacucuguc

SEQ ID NO: 1068503 - RNA, 14 nt, Homo sapiens
agacaacacuggga

SEQ ID NO: 1068504 - RNA, 21 nt, Homo sapiens
agacaauggcuuacuccagga

SEQ ID NO: 1068505 - RNA, 16 nt, Homo sapiens
agacacugagaucugu

SEQ ID NO: 1068506 - RNA, 18 nt, Homo sapiens
agacagacaacacuggga

SEQ ID NO: 1068507 - RNA, 19 nt, Homo sapiens
agacagagcgagacucuug

SEQ ID NO: 1068508 - RNA, 14 nt, Homo sapiens
agacagaguccugc

SEQ ID NO: 1068509 - RNA, 23 nt, Homo sapiens
agaccacuauucuuaacuauuca

SEQ ID NO: 1068510 - RNA, 19 nt, Homo sapiens
agaccagccuggccaagag

SEQ ID NO: 1068511 - RNA, 13 nt, Homo sapiens
agaccucagggca

SEQ ID NO: 1068512 - RNA, 17 nt, Homo sapiens
agacuauugugccuuag

SEQ ID NO: 1068513 - RNA, 17 nt, Homo sapiens
agacuugauggacaaac

SEQ ID NO: 1068514 - RNA, 16 nt, Homo sapiens
agagauuccugagcca

SEQ ID NO: 1068515 - RNA, 21 nt, Homo sapiens
agagccugaguguugccuaau

SEQ ID NO: 1068516 - RNA, 23 nt, Homo sapiens
agagcugggauguuucugucaca

SEQ ID NO: 1068517 - RNA, 22 nt, Homo sapiens
agagcuuugcuucucucucuaa

SEQ ID NO: 1068518 - RNA, 22 nt, Homo sapiens
agagguuacagguuacagugag

SEQ ID NO: 1068519 - RNA, 19 nt, Homo sapiens
agaguggggaugacaugca

SEQ ID NO: 1068520 - RNA, 18 nt, Homo sapiens
agaguuucaaccaugaag

SEQ ID NO: 1068521 - RNA, 16 nt, Homo sapiens
uggcuuggguucacag

SEQ ID NO: 1068522 - RNA, 21 nt, Homo sapiens
uggcuuggguucacagugcau

SEQ ID NO: 1068523 - RNA, 15 nt, Homo sapiens
ugggaagcaaaaccc

SEQ ID NO: 1068524 - RNA, 15 nt, Homo sapiens
ugggaauaaaucaua

SEQ ID NO: 1068525 - RNA, 18 nt, Homo sapiens
ugggccaaaaucaugcca

SEQ ID NO: 1068526 - RNA, 14 nt, Homo sapiens
uggggaccaggugc

SEQ ID NO: 1068527 - RNA, 14 nt, Homo sapiens
ugggguccagggag

SEQ ID NO: 1068528 - RNA, 21 nt, Homo sapiens
uggguucauccuauucuuucg

SEQ ID NO: 1068529 - RNA, 14 nt, Homo sapiens
uggguuccauucuc

SEQ ID NO: 1068530 - RNA, 13 nt, Homo sapiens
ugguagcucacac

SEQ ID NO: 1068531 - RNA, 21 nt, Homo sapiens
ugguccacagggcaccugcca

SEQ ID NO: 1068532 - RNA, 13 nt, Homo sapiens
uggucuggccacu

SEQ ID NO: 1068533 - RNA, 17 nt, Homo sapiens
uggucuggccacugucc

SEQ ID NO: 1068534 - RNA, 15 nt, Homo sapiens
uguaagccuucaaag

SEQ ID NO: 1068535 - RNA, 20 nt, Homo sapiens
aaguagcugagacuacaggu

SEQ ID NO: 1068536 - RNA, 14 nt, Homo sapiens
aaguaugugcauau

SEQ ID NO: 1068537 - RNA, 18 nt, Homo sapiens
aagucagucuuauagcaa

SEQ ID NO: 1068538 - RNA, 21 nt, Homo sapiens
aagucuuugguaaauggcaaa

SEQ ID NO: 1068539 - RNA, 19 nt, Homo sapiens
aaguucaaaagcugguggu

SEQ ID NO: 1068540 - RNA, 16 nt, Homo sapiens
aaguugagacuucuga

SEQ ID NO: 1068541 - RNA, 17 nt, Homo sapiens
aaguugcucugaaguca

SEQ ID NO: 1068542 - RNA, 20 nt, Homo sapiens
aaguuguuauuucaguuuua

SEQ ID NO: 1068543 - RNA, 18 nt, Homo sapiens
aauaauuuuuagaaucuc

SEQ ID NO: 1068544 - RNA, 20 nt, Homo sapiens
aauacuauauuuauacugua

SEQ ID NO: 1068545 - RNA, 21 nt, Homo sapiens
aauagauggauuuguaucaau

SEQ ID NO: 1068546 - RNA, 12 nt, Homo sapiens
aauauaauacug

SEQ ID NO: 1068547 - RNA, 15 nt, Homo sapiens
aauauaauacuguau

SEQ ID NO: 1068548 - RNA, 23 nt, Homo sapiens
aauauaucacuuuugauacaaua

SEQ ID NO: 1068549 - RNA, 19 nt, Homo sapiens
aauaugcaccaaaucaucu

SEQ ID NO: 1068550 - RNA, 17 nt, Homo sapiens
aauaugguguacauucu

SEQ ID NO: 1068551 - RNA, 21 nt, Homo sapiens
aauaugguguacauucuuccu

SEQ ID NO: 1068552 - RNA, 13 nt, Homo sapiens
aauaugucuuucu

SEQ ID NO: 1068553 - RNA, 15 nt, Homo sapiens
aauauucuggaguca

SEQ ID NO: 1068554 - RNA, 15 nt, Homo sapiens
aauauuuuccaugaa

SEQ ID NO: 1068555 - RNA, 20 nt, Homo sapiens
aaucaaaacccaacaugacu

SEQ ID NO: 1068556 - RNA, 23 nt, Homo sapiens
aaucauagcaauaucauaauuaa

SEQ ID NO: 1068557 - RNA, 21 nt, Homo sapiens
aaucaucucucaucacuuuuc

SEQ ID NO: 1068558 - RNA, 18 nt, Homo sapiens
aaucaugccauugcacuc

SEQ ID NO: 1068559 - RNA, 15 nt, Homo sapiens
aaucaugcugagaga

SEQ ID NO: 1068560 - RNA, 15 nt, Homo sapiens
aaucuaauacacuuu

SEQ ID NO: 1068561 - RNA, 22 nt, Homo sapiens
aaugaagaaaagagucuauaca

SEQ ID NO: 1068562 - RNA, 19 nt, Homo sapiens
aaugacauucaguauauaa

SEQ ID NO: 1068563 - RNA, 16 nt, Homo sapiens
aaugcaacaacaugua

SEQ ID NO: 1068564 - RNA, 22 nt, Homo sapiens
aaugcagacaaacaaacauaaa

SEQ ID NO: 1068565 - RNA, 12 nt, Homo sapiens
aaugccaaaaaa

SEQ ID NO: 1068566 - RNA, 19 nt, Homo sapiens
aaugcucagaccagcucuu

SEQ ID NO: 1068567 - RNA, 14 nt, Homo sapiens
aauggcuccuucac

SEQ ID NO: 1068568 - RNA, 23 nt, Homo sapiens
aauggggccuguuacacaugaca

SEQ ID NO: 1068569 - RNA, 13 nt, Homo sapiens
aaugucuguauca

SEQ ID NO: 1068570 - RNA, 21 nt, Homo sapiens
aauguuagauaguuacuauau

SEQ ID NO: 1068571 - RNA, 22 nt, Homo sapiens
aauguuguuuuaggaauacaua

SEQ ID NO: 1068572 - RNA, 19 nt, Homo sapiens
aauuacccuuucauucagc

SEQ ID NO: 1068573 - RNA, 20 nt, Homo sapiens
aauucagaaugaucugcaag

SEQ ID NO: 1068574 - RNA, 17 nt, Homo sapiens
aauucaucucucuuuaa

SEQ ID NO: 1068575 - RNA, 18 nt, Homo sapiens
aauucuuacaaacaugug

SEQ ID NO: 1068576 - RNA, 12 nt, Homo sapiens
acaaacaugugg

SEQ ID NO: 1068577 - RNA, 14 nt, Homo sapiens
acaaacaugugguu

SEQ ID NO: 1068578 - RNA, 15 nt, Homo sapiens
acaaagacucacucu

SEQ ID NO: 1068579 - RNA, 16 nt, Homo sapiens
acaaauaaguuacauc

SEQ ID NO: 1068580 - RNA, 11 nt, Homo sapiens
acaaugcauuc

SEQ ID NO: 1068581 - RNA, 13 nt, Homo sapiens
acacaaaaauuag

SEQ ID NO: 1068582 - RNA, 16 nt, Homo sapiens
acacauuaagccuucc

SEQ ID NO: 1068583 - RNA, 17 nt, Homo sapiens
acacauuaagccuucca

SEQ ID NO: 1068584 - RNA, 23 nt, Homo sapiens
acacauuaagccuuccacacuca

SEQ ID NO: 1068585 - RNA, 19 nt, Homo sapiens
acaccauucaggucuuucu

SEQ ID NO: 1068586 - RNA, 20 nt, Homo sapiens
acaccguguuuucugacaca

SEQ ID NO: 1068587 - RNA, 19 nt, Homo sapiens
acaccugauuaacugaggc

SEQ ID NO: 1068588 - RNA, 17 nt, Homo sapiens
acaccuguaaucccagc

SEQ ID NO: 1068589 - RNA, 14 nt, Homo sapiens
acaccugugugcug

SEQ ID NO: 1068590 - RNA, 16 nt, Homo sapiens
acaccugugugcugua

SEQ ID NO: 1068591 - RNA, 21 nt, Homo sapiens
acacucacuucucuuccuugg

SEQ ID NO: 1068592 - RNA, 21 nt, Homo sapiens
acacucauccccucacuugcc

SEQ ID NO: 1068593 - RNA, 22 nt, Homo sapiens
acacugaaauauacacacagca

SEQ ID NO: 1068594 - RNA, 23 nt, Homo sapiens
acacuuugcuccucuggcccaag

SEQ ID NO: 1068595 - RNA, 16 nt, Homo sapiens
acagaaaaaccagagg

SEQ ID NO: 1068596 - RNA, 21 nt, Homo sapiens
acagaacacugucuugaagac

SEQ ID NO: 1068597 - RNA, 18 nt, Homo sapiens
acaggccauggauggaaa

SEQ ID NO: 1068598 - RNA, 18 nt, Homo sapiens
acagggacugaaaaccuc

SEQ ID NO: 1068599 - RNA, 21 nt, Homo sapiens
acagguguuguccaagcucuu

SEQ ID NO: 1068600 - RNA, 15 nt, Homo sapiens
acaguauauguugca

SEQ ID NO: 1068601 - RNA, 19 nt, Homo sapiens
acaguccuucaaacuucca

SEQ ID NO: 1068602 - RNA, 19 nt, Homo sapiens
acaguggcaggacaggaaa

SEQ ID NO: 1068603 - RNA, 12 nt, Homo sapiens
acaucaggaaau

SEQ ID NO: 1068604 - RNA, 18 nt, Homo sapiens
acauccugugccuccauc

SEQ ID NO: 1068605 - RNA, 23 nt, Homo sapiens
acauccugugccuccaucagcua

SEQ ID NO: 1068606 - RNA, 14 nt, Homo sapiens
acaucuacaaacag

SEQ ID NO: 1068607 - RNA, 18 nt, Homo sapiens
acaugcccuaaugucugu

SEQ ID NO: 1068608 - RNA, 21 nt, Homo sapiens
acauguaugcuauuacauaca

SEQ ID NO: 1068609 - RNA, 13 nt, Homo sapiens
acauuaacuucag

SEQ ID NO: 1068610 - RNA, 17 nt, Homo sapiens
acauucagagcuuacuu

SEQ ID NO: 1068611 - RNA, 13 nt, Homo sapiens
acauugaugcuga

SEQ ID NO: 1068612 - RNA, 14 nt, Homo sapiens
acauugcaccagau

SEQ ID NO: 1068613 - RNA, 12 nt, Homo sapiens
accaaaaacuga

SEQ ID NO: 1068614 - RNA, 11 nt, Homo sapiens
accaaaucauc

SEQ ID NO: 1068615 - RNA, 14 nt, Homo sapiens
accaauaaagccuu

SEQ ID NO: 1068616 - RNA, 14 nt, Homo sapiens
accaaugccaaaaa

SEQ ID NO: 1068617 - RNA, 17 nt, Homo sapiens
accacucaaaggccaga

SEQ ID NO: 1068618 - RNA, 22 nt, Homo sapiens
accagguagaacacaaggucau

SEQ ID NO: 1068619 - RNA, 11 nt, Homo sapiens
accaguugaaa

SEQ ID NO: 1068620 - RNA, 19 nt, Homo sapiens
accauauugcccagggugg

SEQ ID NO: 1068621 - RNA, 24 nt, Homo sapiens
accaugaagucucuaacaauguau

SEQ ID NO: 1068622 - RNA, 17 nt, Homo sapiens
accaugcgacacuggga

SEQ ID NO: 1068623 - RNA, 20 nt, Homo sapiens
accauucaggucuuucuuuc

SEQ ID NO: 1068624 - RNA, 18 nt, Homo sapiens
accauuuuugaaaccaaa

SEQ ID NO: 1068625 - RNA, 21 nt, Homo sapiens
acccaagcagagaagcucucg

SEQ ID NO: 1068626 - RNA, 14 nt, Homo sapiens
acccaguguagcau

SEQ ID NO: 1068627 - RNA, 12 nt, Homo sapiens
accccaguuuuu

SEQ ID NO: 1068628 - RNA, 16 nt, Homo sapiens
accccgucaacaaauc

SEQ ID NO: 1068629 - RNA, 22 nt, Homo sapiens
acccuaaaaagcagagcuuugc

SEQ ID NO: 1068630 - RNA, 15 nt, Homo sapiens
acccucacucucuac

SEQ ID NO: 1068631 - RNA, 17 nt, Homo sapiens
acccugccggguagcug

SEQ ID NO: 1068632 - RNA, 14 nt, Homo sapiens
acccuuucauucag

SEQ ID NO: 1068633 - RNA, 16 nt, Homo sapiens
accguaggacccaagc

SEQ ID NO: 1068634 - RNA, 18 nt, Homo sapiens
accuacauuuuaaugcac

SEQ ID NO: 1068635 - RNA, 23 nt, Homo sapiens
accuacauuuuaaugcaccugaa

SEQ ID NO: 1068636 - RNA, 16 nt, Homo sapiens
accucaccaagacauc

SEQ ID NO: 1068637 - RNA, 17 nt, Homo sapiens
accucagggcacaaaga

SEQ ID NO: 1068638 - RNA, 22 nt, Homo sapiens
accucccaggcucaagcugucc

SEQ ID NO: 1068639 - RNA, 13 nt, Homo sapiens
accuccucucuac

SEQ ID NO: 1068640 - RNA, 17 nt, Homo sapiens
accugauuaacugaggc

SEQ ID NO: 1068641 - RNA, 18 nt, Homo sapiens
accugcucacaguccuca

SEQ ID NO: 1068642 - RNA, 22 nt, Homo sapiens
accugggcugaggcauccuucc

SEQ ID NO: 1068643 - RNA, 15 nt, Homo sapiens
accuguaaucccagc

SEQ ID NO: 1068644 - RNA, 22 nt, Homo sapiens
accuguaaucccagcuacucga

SEQ ID NO: 1068645 - RNA, 13 nt, Homo sapiens
accugucauucua

SEQ ID NO: 1068646 - RNA, 17 nt, Homo sapiens
accugucauucuagaaa

SEQ ID NO: 1068647 - RNA, 21 nt, Homo sapiens
accuugaacauuuuacaagaa

SEQ ID NO: 1068648 - RNA, 22 nt, Homo sapiens
accuugucucccagcucagggc

SEQ ID NO: 1068649 - RNA, 17 nt, Homo sapiens
accuuuuaacuccucaa

SEQ ID NO: 1068650 - RNA, 18 nt, Homo sapiens
acuaggggacaaagcaaa

SEQ ID NO: 1068651 - RNA, 18 nt, Homo sapiens
acuauucuuaacuauuca

SEQ ID NO: 1068652 - RNA, 17 nt, Homo sapiens
acucaagauucccagga

SEQ ID NO: 1068653 - RNA, 21 nt, Homo sapiens
aggccuccuggcccaggugag

SEQ ID NO: 1068654 - RNA, 13 nt, Homo sapiens
aggcuuccuucug

SEQ ID NO: 1068655 - RNA, 14 nt, Homo sapiens
agggaccuugucuc

SEQ ID NO: 1068656 - RNA, 21 nt, Homo sapiens
agggauaugugaaacaauguu

SEQ ID NO: 1068657 - RNA, 13 nt, Homo sapiens
agggauguaucaa

SEQ ID NO: 1068658 - RNA, 11 nt, Homo sapiens
aggggccagaa

SEQ ID NO: 1068659 - RNA, 17 nt, Homo sapiens
agggguuuacagucuau

SEQ ID NO: 1068660 - RNA, 15 nt, Homo sapiens
agggugagugcaagg

SEQ ID NO: 1068661 - RNA, 12 nt, Homo sapiens
agguaacuguac

SEQ ID NO: 1068662 - RNA, 23 nt, Homo sapiens
aggucaggaguucgagaccagcc

SEQ ID NO: 1068663 - RNA, 11 nt, Homo sapiens
aggucuagccu

SEQ ID NO: 1068664 - RNA, 14 nt, Homo sapiens
aggugagcccucau

SEQ ID NO: 1068665 - RNA, 19 nt, Homo sapiens
aggugaguuuucaccucga

SEQ ID NO: 1068666 - RNA, 17 nt, Homo sapiens
aggugcuugagucucca

SEQ ID NO: 1068667 - RNA, 20 nt, Homo sapiens
agguuccuugguguucaaaa

SEQ ID NO: 1068668 - RNA, 21 nt, Homo sapiens
agguuuugagcauggguucau

SEQ ID NO: 1068669 - RNA, 23 nt, Homo sapiens
aguaggcucauuuacuguuuuag

SEQ ID NO: 1068670 - RNA, 16 nt, Homo sapiens
aguauaaaacaccuaa

SEQ ID NO: 1068671 - RNA, 18 nt, Homo sapiens
aguauggugaaacccugu

SEQ ID NO: 1068672 - RNA, 19 nt, Homo sapiens
aguauuuuauucuuauuca

SEQ ID NO: 1068673 - RNA, 14 nt, Homo sapiens
agucaucauucccu

SEQ ID NO: 1068674 - RNA, 21 nt, Homo sapiens
aguccagccuggcaaggguuc

SEQ ID NO: 1068675 - RNA, 16 nt, Homo sapiens
agucucauucugucac

SEQ ID NO: 1068676 - RNA, 15 nt, Homo sapiens
agucucucauucuag

SEQ ID NO: 1068677 - RNA, 20 nt, Homo sapiens
agucucuguguaaucaucug

SEQ ID NO: 1068678 - RNA, 20 nt, Homo sapiens
agugaaagcaucacuuggga

SEQ ID NO: 1068679 - RNA, 14 nt, Homo sapiens
agugcccucaucca

SEQ ID NO: 1068680 - RNA, 21 nt, Homo sapiens
agugcuugauugcguggaauu

SEQ ID NO: 1068681 - RNA, 21 nt, Homo sapiens
aguggauuucccauccccugu

SEQ ID NO: 1068682 - RNA, 14 nt, Homo sapiens
aguggcucuguaag

SEQ ID NO: 1068683 - RNA, 20 nt, Homo sapiens
agugucaggaggaaggcuua

SEQ ID NO: 1068684 - RNA, 14 nt, Homo sapiens
aguguuuaaaugaa

SEQ ID NO: 1068685 - RNA, 12 nt, Homo sapiens
aguucacaucag

SEQ ID NO: 1068686 - RNA, 12 nt, Homo sapiens
aguucugcucau

SEQ ID NO: 1068687 - RNA, 18 nt, Homo sapiens
aguucugggacuacaggc

SEQ ID NO: 1068688 - RNA, 15 nt, Homo sapiens
aguuuauaugcuucu

SEQ ID NO: 1068689 - RNA, 16 nt, Homo sapiens
auaaacuuuccucuuc

SEQ ID NO: 1068690 - RNA, 15 nt, Homo sapiens
auaagaucugagauu

SEQ ID NO: 1068691 - RNA, 13 nt, Homo sapiens
auaauucugggaa

SEQ ID NO: 1068692 - RNA, 21 nt, Homo sapiens
auacaaacauguuccugggau

SEQ ID NO: 1068693 - RNA, 17 nt, Homo sapiens
auaccugggauacugug

SEQ ID NO: 1068694 - RNA, 21 nt, Homo sapiens
auaccuuacugagagcauguu

SEQ ID NO: 1068695 - RNA, 19 nt, Homo sapiens
auacuauauuuauacugua

SEQ ID NO: 1068696 - RNA, 14 nt, Homo sapiens
auacuguaugcagu

SEQ ID NO: 1068697 - RNA, 15 nt, Homo sapiens
auacuguaugcagua

SEQ ID NO: 1068698 - RNA, 16 nt, Homo sapiens
auagauguuuccuugc

SEQ ID NO: 1068699 - RNA, 19 nt, Homo sapiens
auagggagcagaugcaaug

SEQ ID NO: 1068700 - RNA, 15 nt, Homo sapiens
auaguauugugcaua

SEQ ID NO: 1068701 - RNA, 22 nt, Homo sapiens
auagucucauucugucacccag

SEQ ID NO: 1068702 - RNA, 14 nt, Homo sapiens
auauaccuuacuga

SEQ ID NO: 1068703 - RNA, 19 nt, Homo sapiens
auauccuuugccucaagga

SEQ ID NO: 1068704 - RNA, 14 nt, Homo sapiens
auaucugagcucuu

SEQ ID NO: 1068705 - RNA, 17 nt, Homo sapiens
auauguaaaaagucaua

SEQ ID NO: 1068706 - RNA, 22 nt, Homo sapiens
auauguugcaaaauauaucacu

SEQ ID NO: 1068707 - RNA, 23 nt, Homo sapiens
auauugggguuggaacauuucag

SEQ ID NO: 1068708 - RNA, 20 nt, Homo sapiens
auauuggguuccauucucac

SEQ ID NO: 1068709 - RNA, 22 nt, Homo sapiens
auauugucugaacggcugaaua

SEQ ID NO: 1068710 - RNA, 15 nt, Homo sapiens
aucaaaggcacacag

SEQ ID NO: 1068711 - RNA, 15 nt, Homo sapiens
aucaccacucaaaaa

SEQ ID NO: 1068712 - RNA, 16 nt, Homo sapiens
aucacuuuucucugag

SEQ ID NO: 1068713 - RNA, 16 nt, Homo sapiens
aucagcuaaacaccac

SEQ ID NO: 1068714 - RNA, 13 nt, Homo sapiens
aucaguccaaagg

SEQ ID NO: 1068715 - RNA, 19 nt, Homo sapiens
aucauaaccaugugaaaag

SEQ ID NO: 1068716 - RNA, 15 nt, Homo sapiens
aucaucaacccuaaa

SEQ ID NO: 1068717 - RNA, 17 nt, Homo sapiens
aucaugccauugcacuc

SEQ ID NO: 1068718 - RNA, 17 nt, Homo sapiens
auccagaagagaauuag

SEQ ID NO: 1068719 - RNA, 15 nt, Homo sapiens
aucccagcuacucga

SEQ ID NO: 1068720 - RNA, 23 nt, Homo sapiens
auccccccgccaaaagcugcuca

SEQ ID NO: 1068721 - RNA, 14 nt, Homo sapiens
auccccucuacucu

SEQ ID NO: 1068722 - RNA, 13 nt, Homo sapiens
auccucacugcug

SEQ ID NO: 1068723 - RNA, 16 nt, Homo sapiens
auccucccaccucagc

SEQ ID NO: 1068724 - RNA, 16 nt, Homo sapiens
aucgccagcugaugac

SEQ ID NO: 1068725 - RNA, 14 nt, Homo sapiens
aucucccaccuaaa

SEQ ID NO: 1068726 - RNA, 18 nt, Homo sapiens
aucucuaauacaguguga

SEQ ID NO: 1068727 - RNA, 13 nt, Homo sapiens
aucucucaucacu

SEQ ID NO: 1068728 - RNA, 18 nt, Homo sapiens
aucucugaauuugagaua

SEQ ID NO: 1068729 - RNA, 19 nt, Homo sapiens
aucucugcagggccgccag

SEQ ID NO: 1068730 - RNA, 12 nt, Homo sapiens
aucucugugaaa

SEQ ID NO: 1068731 - RNA, 15 nt, Homo sapiens
aucuguucaauguuu

SEQ ID NO: 1068732 - RNA, 14 nt, Homo sapiens
aucuucaacaaauu

SEQ ID NO: 1068733 - RNA, 13 nt, Homo sapiens
aucuucauuugaa

SEQ ID NO: 1068734 - RNA, 15 nt, Homo sapiens
aucuuucuuguuuca

SEQ ID NO: 1068735 - RNA, 16 nt, Homo sapiens
augaacagacugaccu

SEQ ID NO: 1068736 - RNA, 16 nt, Homo sapiens
augaauggcagaugug

SEQ ID NO: 1068737 - RNA, 16 nt, Homo sapiens
augacacaacugcacu

SEQ ID NO: 1068738 - RNA, 21 nt, Homo sapiens
augacaugcacucagcucuug

SEQ ID NO: 1068739 - RNA, 16 nt, Homo sapiens
augacuaauucuugca

SEQ ID NO: 1068740 - RNA, 16 nt, Homo sapiens
augacucaagauuccc

SEQ ID NO: 1068741 - RNA, 21 nt, Homo sapiens
augagaagaaaauggaaccag

SEQ ID NO: 1068742 - RNA, 18 nt, Homo sapiens
augaggcccucauuccca

SEQ ID NO: 1068743 - RNA, 22 nt, Homo sapiens
augaggucauagcagugcuuga

SEQ ID NO: 1068744 - RNA, 16 nt, Homo sapiens
augaguggcuuuaaug

SEQ ID NO: 1068745 - RNA, 15 nt, Homo sapiens
augauguuugcccaa

SEQ ID NO: 1068746 - RNA, 19 nt, Homo sapiens
augauuuccaaaauugcaa

SEQ ID NO: 1068747 - RNA, 16 nt, Homo sapiens
augcaacaacauguau

SEQ ID NO: 1068748 - RNA, 17 nt, Homo sapiens
augcaacaacauguaua

SEQ ID NO: 1068749 - RNA, 18 nt, Homo sapiens
augcaacaacauguauaa

SEQ ID NO: 1068750 - RNA, 14 nt, Homo sapiens
augcagacaaacaa

SEQ ID NO: 1068751 - RNA, 15 nt, Homo sapiens
augcagucuguccag

SEQ ID NO: 1068752 - RNA, 19 nt, Homo sapiens
augcauguuuguuguauac

SEQ ID NO: 1068753 - RNA, 12 nt, Homo sapiens
augcauucugag

SEQ ID NO: 1068754 - RNA, 14 nt, Homo sapiens
augccgcuacaaaa

SEQ ID NO: 1068755 - RNA, 14 nt, Homo sapiens
augcuauuugcaau

SEQ ID NO: 1068756 - RNA, 19 nt, Homo sapiens
augcucagaccagcucuuc

SEQ ID NO: 1068757 - RNA, 15 nt, Homo sapiens
auggacuguguuucc

SEQ ID NO: 1068758 - RNA, 19 nt, Homo sapiens
auggugaaacccugucucu

SEQ ID NO: 1068759 - RNA, 20 nt, Homo sapiens
augguggcgggcaccuguaa

SEQ ID NO: 1068760 - RNA, 21 nt, Homo sapiens
augguuugcaaggaagccaca

SEQ ID NO: 1068761 - RNA, 14 nt, Homo sapiens
auguauuuucuuca

SEQ ID NO: 1068762 - RNA, 19 nt, Homo sapiens
augucauuguucuugugaa

SEQ ID NO: 1068763 - RNA, 13 nt, Homo sapiens
auguccucagggc

SEQ ID NO: 1068764 - RNA, 17 nt, Homo sapiens
augucuguaucacucug

SEQ ID NO: 1068765 - RNA, 14 nt, Homo sapiens
augugaaagucaaa

SEQ ID NO: 1068766 - RNA, 20 nt, Homo sapiens
augugaacaaccugcucaca

SEQ ID NO: 1068767 - RNA, 20 nt, Homo sapiens
augugaauuauuuccugcuu

SEQ ID NO: 1068768 - RNA, 22 nt, Homo sapiens
auguucuacuuuguucugcugu

SEQ ID NO: 1068769 - RNA, 14 nt, Homo sapiens
auguuuccuugccu

SEQ ID NO: 1068770 - RNA, 20 nt, Homo sapiens
auguuuuuuuucugcuggaa

SEQ ID NO: 1068771 - RNA, 13 nt, Homo sapiens
auuaaauguacuu

SEQ ID NO: 1068772 - RNA, 12 nt, Homo sapiens
aaaaaaacguau

SEQ ID NO: 1068773 - RNA, 14 nt, Homo sapiens
aaaaacguauugca

SEQ ID NO: 1068774 - RNA, 17 nt, Homo sapiens
aaaaauuagccaggugu

SEQ ID NO: 1068775 - RNA, 16 nt, Homo sapiens
aaaacaaaacaaaaca

SEQ ID NO: 1068776 - RNA, 20 nt, Homo sapiens
aaaacauacacaaugugucu

SEQ ID NO: 1068777 - RNA, 20 nt, Homo sapiens
aaaacuaaauggugcuuuau

SEQ ID NO: 1068778 - RNA, 18 nt, Homo sapiens
aaaagaaacacgcacuua

SEQ ID NO: 1068779 - RNA, 18 nt, Homo sapiens
aaaagcacacucaucccc

SEQ ID NO: 1068780 - RNA, 13 nt, Homo sapiens
aaaauacauuuau

SEQ ID NO: 1068781 - RNA, 15 nt, Homo sapiens
aaaaugaguuaccua

SEQ ID NO: 1068782 - RNA, 15 nt, Homo sapiens
aaaaugcaacaacau

SEQ ID NO: 1068783 - RNA, 23 nt, Homo sapiens
aaaaugucauuguucuugugaac

SEQ ID NO: 1068784 - RNA, 23 nt, Homo sapiens
aaaaugugccauuuugcauuuuc

SEQ ID NO: 1068785 - RNA, 19 nt, Homo sapiens
aaacaauaucagacuuuuu

SEQ ID NO: 1068786 - RNA, 22 nt, Homo sapiens
aaacacuauauggcagugucuu

SEQ ID NO: 1068787 - RNA, 14 nt, Homo sapiens
aaacauacuucuaa

SEQ ID NO: 1068788 - RNA, 18 nt, Homo sapiens
aaacuacugcaccauuua

SEQ ID NO: 1068789 - RNA, 23 nt, Homo sapiens
aaacuagguaaaaucuacaguac

SEQ ID NO: 1068790 - RNA, 15 nt, Homo sapiens
aaagaaacacgcacu

SEQ ID NO: 1068791 - RNA, 21 nt, Homo sapiens
aaagaugugcuuauaucauug

SEQ ID NO: 1068792 - RNA, 12 nt, Homo sapiens
aaagcacacuca

SEQ ID NO: 1068793 - RNA, 12 nt, Homo sapiens
aaagcugcucag

SEQ ID NO: 1068794 - RNA, 14 nt, Homo sapiens
aaagcugcucaggg

SEQ ID NO: 1068795 - RNA, 11 nt, Homo sapiens
aaaggccagac

SEQ ID NO: 1068796 - RNA, 19 nt, Homo sapiens
aaagucauaaaauguaucu

SEQ ID NO: 1068797 - RNA, 22 nt, Homo sapiens
aaaguccugugguuaacgccuu

SEQ ID NO: 1068798 - RNA, 20 nt, Homo sapiens
aaauaaguuacaucuacaaa

SEQ ID NO: 1068799 - RNA, 16 nt, Homo sapiens
aaauagaauuugagca

SEQ ID NO: 1068800 - RNA, 13 nt, Homo sapiens
aaaucaucucuca

SEQ ID NO: 1068801 - RNA, 22 nt, Homo sapiens
aaaucugccugauaggacccau

SEQ ID NO: 1068802 - RNA, 23 nt, Homo sapiens
aaauggggauauguuaacuauug

SEQ ID NO: 1068803 - RNA, 23 nt, Homo sapiens
aaaugucaguaguuucuuauuaa

SEQ ID NO: 1068804 - RNA, 14 nt, Homo sapiens
aaauguuuugaugg

SEQ ID NO: 1068805 - RNA, 15 nt, Homo sapiens
aaauugccuaaagag

SEQ ID NO: 1068806 - RNA, 15 nt, Homo sapiens
aaauuggauacugcu

SEQ ID NO: 1068807 - RNA, 15 nt, Homo sapiens
aauaaaucauagcaa

SEQ ID NO: 1068808 - RNA, 15 nt, Homo sapiens
aauaauaugauuuau

SEQ ID NO: 1068809 - RNA, 22 nt, Homo sapiens
aauacauaaaguaugugcauau

SEQ ID NO: 1068810 - RNA, 17 nt, Homo sapiens
aauacggcaaaaccuca

SEQ ID NO: 1068811 - RNA, 22 nt, Homo sapiens
aauacgguaccuggcaauguuu

SEQ ID NO: 1068812 - RNA, 22 nt, Homo sapiens
aauacuauauuuauacuguaua

SEQ ID NO: 1068813 - RNA, 13 nt, Homo sapiens
aauagaacuacaa

SEQ ID NO: 1068814 - RNA, 22 nt, Homo sapiens
aauagaauuugagcaucaguga

SEQ ID NO: 1068815 - RNA, 13 nt, Homo sapiens
aauaguugaaccu

SEQ ID NO: 1068816 - RNA, 15 nt, Homo sapiens
aauaguugaaccuau

SEQ ID NO: 1068817 - RNA, 14 nt, Homo sapiens
aauauaagaucuga

SEQ ID NO: 1068818 - RNA, 22 nt, Homo sapiens
aauauaucuuaaugcagacaaa

SEQ ID NO: 1068819 - RNA, 13 nt, Homo sapiens
aauauccuuugcc

SEQ ID NO: 1068820 - RNA, 22 nt, Homo sapiens
aauaucugagcucuuugcacua

SEQ ID NO: 1068821 - RNA, 16 nt, Homo sapiens
aauauucuaauuuuag

SEQ ID NO: 1068822 - RNA, 23 nt, Homo sapiens
aaucauaaauauaaucuaauaca

SEQ ID NO: 1068823 - RNA, 15 nt, Homo sapiens
aauccuagcacuuug

SEQ ID NO: 1068824 - RNA, 16 nt, Homo sapiens
aaucucugaauuugag

SEQ ID NO: 1068825 - RNA, 15 nt, Homo sapiens
aaucugguaccaguu

SEQ ID NO: 1068826 - RNA, 13 nt, Homo sapiens
aaugaaccuucug

SEQ ID NO: 1068827 - RNA, 16 nt, Homo sapiens
aaugaaccuucuggcc

SEQ ID NO: 1068828 - RNA, 15 nt, Homo sapiens
aaugaaggaccucaa

SEQ ID NO: 1068829 - RNA, 19 nt, Homo sapiens
aaugacucaggacaucccc

SEQ ID NO: 1068830 - RNA, 17 nt, Homo sapiens
aaugauggcccauucua

SEQ ID NO: 1068831 - RNA, 16 nt, Homo sapiens
aaugcagagucaauga

SEQ ID NO: 1068832 - RNA, 17 nt, Homo sapiens
aauggggugcaugaagg

SEQ ID NO: 1068833 - RNA, 14 nt, Homo sapiens
aaugguuugaauau

SEQ ID NO: 1068834 - RNA, 18 nt, Homo sapiens
aauguagugaagggaugu

SEQ ID NO: 1068835 - RNA, 14 nt, Homo sapiens
aaugucuguaucac

SEQ ID NO: 1068836 - RNA, 22 nt, Homo sapiens
aaugugccauuuugcauuuuca

SEQ ID NO: 1068837 - RNA, 16 nt, Homo sapiens
aauuagcugcuucuau

SEQ ID NO: 1068838 - RNA, 22 nt, Homo sapiens
aauuaguaggcucauuuacugu

SEQ ID NO: 1068839 - RNA, 18 nt, Homo sapiens
aauuagugccacaaauaa

SEQ ID NO: 1068840 - RNA, 18 nt, Homo sapiens
aauuaguuaacaguuuuu

SEQ ID NO: 1068841 - RNA, 11 nt, Homo sapiens
aauuucuagag

SEQ ID NO: 1068842 - RNA, 19 nt, Homo sapiens
aauuuggggcagauuuuag

SEQ ID NO: 1068843 - RNA, 23 nt, Homo sapiens
aauuugucuuuuaauuuagcuua

SEQ ID NO: 1068844 - RNA, 21 nt, Homo sapiens
aauuuguucacauuacaugaa

SEQ ID NO: 1068845 - RNA, 15 nt, Homo sapiens
acaaaaaaacagacc

SEQ ID NO: 1068846 - RNA, 15 nt, Homo sapiens
acaaaaaaaccucuu

SEQ ID NO: 1068847 - RNA, 22 nt, Homo sapiens
acaaauaaucaaaacccaacau

SEQ ID NO: 1068848 - RNA, 13 nt, Homo sapiens
acaaauguaugau

SEQ ID NO: 1068849 - RNA, 17 nt, Homo sapiens
acaacauguauaauauu

SEQ ID NO: 1068850 - RNA, 22 nt, Homo sapiens
acaacccucuccuguuuacuga

SEQ ID NO: 1068851 - RNA, 15 nt, Homo sapiens
acaagcaaacccaga

SEQ ID NO: 1068852 - RNA, 19 nt, Homo sapiens
acaagggucacaauacugu

SEQ ID NO: 1068853 - RNA, 20 nt, Homo sapiens
acaaugaugcuauuugcaau

SEQ ID NO: 1068854 - RNA, 17 nt, Homo sapiens
acacaaaaauuagccag

SEQ ID NO: 1068855 - RNA, 14 nt, Homo sapiens
acacaauaauguga

SEQ ID NO: 1068856 - RNA, 16 nt, Homo sapiens
acaccagguagaacac

SEQ ID NO: 1068857 - RNA, 16 nt, Homo sapiens
acacccaauucaaauu

SEQ ID NO: 1068858 - RNA, 13 nt, Homo sapiens
acacccacagugg

SEQ ID NO: 1068859 - RNA, 15 nt, Homo sapiens
acaccuguaauccca

SEQ ID NO: 1068860 - RNA, 13 nt, Homo sapiens
acacugaugauuu

SEQ ID NO: 1068861 - RNA, 14 nt, Homo sapiens
acagauugagcuuu

SEQ ID NO: 1068862 - RNA, 16 nt, Homo sapiens
acagcaagucaggguu

SEQ ID NO: 1068863 - RNA, 15 nt, Homo sapiens
acagcacuaauucaa

SEQ ID NO: 1068864 - RNA, 19 nt, Homo sapiens
acaggaaucgguggucucc

SEQ ID NO: 1068865 - RNA, 17 nt, Homo sapiens
acagggcacaggccaug

SEQ ID NO: 1068866 - RNA, 14 nt, Homo sapiens
acugcaguggacag

SEQ ID NO: 1068867 - RNA, 15 nt, Homo sapiens
acuggaugaggucau

SEQ ID NO: 1068868 - RNA, 15 nt, Homo sapiens
acuggcaugcuaaag

SEQ ID NO: 1068869 - RNA, 18 nt, Homo sapiens
acuguauauauaauacug

SEQ ID NO: 1068870 - RNA, 21 nt, Homo sapiens
acugucuugaagacaauggcu

SEQ ID NO: 1068871 - RNA, 17 nt, Homo sapiens
acuuaaaaauuuguuca

SEQ ID NO: 1068872 - RNA, 19 nt, Homo sapiens
acuucacagcccugcagug

SEQ ID NO: 1068873 - RNA, 23 nt, Homo sapiens
acuucagccaggugaacuggaau

SEQ ID NO: 1068874 - RNA, 23 nt, Homo sapiens
acuuccagugcaacacugaagcu

SEQ ID NO: 1068875 - RNA, 15 nt, Homo sapiens
acuuccuugcuuaag

SEQ ID NO: 1068876 - RNA, 18 nt, Homo sapiens
acuucuuuaguacuuaca

SEQ ID NO: 1068877 - RNA, 22 nt, Homo sapiens
acuucuuuaguacuuacaucag

SEQ ID NO: 1068878 - RNA, 19 nt, Homo sapiens
acuucuuucagcagacuga

SEQ ID NO: 1068879 - RNA, 17 nt, Homo sapiens
acuugacagaacacugu

SEQ ID NO: 1068880 - RNA, 22 nt, Homo sapiens
acuugagucacaaagaacaugu

SEQ ID NO: 1068881 - RNA, 16 nt, Homo sapiens
acuugauuuaaucacc

SEQ ID NO: 1068882 - RNA, 22 nt, Homo sapiens
acuuggucuggccacuguccca

SEQ ID NO: 1068883 - RNA, 20 nt, Homo sapiens
acuuucauuauagcagagag

SEQ ID NO: 1068884 - RNA, 18 nt, Homo sapiens
acuuugggaggccaagga

SEQ ID NO: 1068885 - RNA, 18 nt, Homo sapiens
acuuuuaaguuuccuucc

SEQ ID NO: 1068886 - RNA, 12 nt, Homo sapiens
agaaaaaaucug

SEQ ID NO: 1068887 - RNA, 21 nt, Homo sapiens
agaaaaucaucaagaagggcu

SEQ ID NO: 1068888 - RNA, 21 nt, Homo sapiens
agaacacccaauucaaauuga

SEQ ID NO: 1068889 - RNA, 14 nt, Homo sapiens
agaaccacucauaa

SEQ ID NO: 1068890 - RNA, 16 nt, Homo sapiens
agaacucugagcagug

SEQ ID NO: 1068891 - RNA, 21 nt, Homo sapiens
agaagauucuucccauucucc

SEQ ID NO: 1068892 - RNA, 21 nt, Homo sapiens
agaagggaauuuauugccucu

SEQ ID NO: 1068893 - RNA, 21 nt, Homo sapiens
agaaguaggggaagacaugca

SEQ ID NO: 1068894 - RNA, 13 nt, Homo sapiens
agaaguaugggaa

SEQ ID NO: 1068895 - RNA, 13 nt, Homo sapiens
agaaguucacauc

SEQ ID NO: 1068896 - RNA, 16 nt, Homo sapiens
agaauauaauacugua

SEQ ID NO: 1068897 - RNA, 13 nt, Homo sapiens
agaaucagucuug

SEQ ID NO: 1068898 - RNA, 20 nt, Homo sapiens
agaauuagaaacaacauagc

SEQ ID NO: 1068899 - RNA, 22 nt, Homo sapiens
agaauuagaaacaacauagcaa

SEQ ID NO: 1068900 - RNA, 14 nt, Homo sapiens
agacaaagacucac

SEQ ID NO: 1068901 - RNA, 19 nt, Homo sapiens
agacagacaacacugggaa

SEQ ID NO: 1068902 - RNA, 21 nt, Homo sapiens
agacaucuuauccauccucac

SEQ ID NO: 1068903 - RNA, 15 nt, Homo sapiens
agacauugcaaugua

SEQ ID NO: 1068904 - RNA, 16 nt, Homo sapiens
agacauugcaccagau

SEQ ID NO: 1068905 - RNA, 14 nt, Homo sapiens
agaccacuauucuu

SEQ ID NO: 1068906 - RNA, 14 nt, Homo sapiens
agaccuggacacag

SEQ ID NO: 1068907 - RNA, 18 nt, Homo sapiens
agacuauucccuucuaac

SEQ ID NO: 1068908 - RNA, 19 nt, Homo sapiens
agacuauucccuucuaacc

SEQ ID NO: 1068909 - RNA, 13 nt, Homo sapiens
agacuucuuggcu

SEQ ID NO: 1068910 - RNA, 14 nt, Homo sapiens
agacuugcauuuaa

SEQ ID NO: 1068911 - RNA, 21 nt, Homo sapiens
agagacagcuugaucaaaggc

SEQ ID NO: 1068912 - RNA, 19 nt, Homo sapiens
agagcaaggguucccucaa

SEQ ID NO: 1068913 - RNA, 13 nt, Homo sapiens
agagcuggaggca

SEQ ID NO: 1068914 - RNA, 17 nt, Homo sapiens
agaggacaggcuacccc

SEQ ID NO: 1068915 - RNA, 14 nt, Homo sapiens
agaggcugugucag

SEQ ID NO: 1068916 - RNA, 22 nt, Homo sapiens
agagugcaagccccugcuccag

SEQ ID NO: 1068917 - RNA, 15 nt, Homo sapiens
agauacaaacauguu

SEQ ID NO: 1068918 - RNA, 19 nt, Homo sapiens
agauacugucucuuucaug

SEQ ID NO: 1068919 - RNA, 18 nt, Homo sapiens
agauagggaaaaggggcu

SEQ ID NO: 1068920 - RNA, 11 nt, Homo sapiens
agauaugcaaa

SEQ ID NO: 1068921 - RNA, 19 nt, Homo sapiens
agaucugagauugaauauu

SEQ ID NO: 1068922 - RNA, 21 nt, Homo sapiens
agaugaggugguaucuucacg

SEQ ID NO: 1068923 - RNA, 20 nt, Homo sapiens
agaugcagaaaauugccuaa

SEQ ID NO: 1068924 - RNA, 18 nt, Homo sapiens
agaugccauuacauuuau

SEQ ID NO: 1068925 - RNA, 23 nt, Homo sapiens
agaugccccagccugcuuucaca

SEQ ID NO: 1068926 - RNA, 16 nt, Homo sapiens
agggagcagaugcaau

SEQ ID NO: 1068927 - RNA, 22 nt, Homo sapiens
agggcucuuuccuccacaccau

SEQ ID NO: 1068928 - RNA, 22 nt, Homo sapiens
aggggaacuagguuaccgcuua

SEQ ID NO: 1068929 - RNA, 20 nt, Homo sapiens
agggguucuggaaacauuca

SEQ ID NO: 1068930 - RNA, 21 nt, Homo sapiens
agggugaggugcuugagucuc

SEQ ID NO: 1068931 - RNA, 17 nt, Homo sapiens
aggucauagcagugcuu

SEQ ID NO: 1068932 - RNA, 23 nt, Homo sapiens
aggugaaacccagucacugugag

SEQ ID NO: 1068933 - RNA, 15 nt, Homo sapiens
agguuuuaaagaccu

SEQ ID NO: 1068934 - RNA, 15 nt, Homo sapiens
aguacuuacaucagg

SEQ ID NO: 1068935 - RNA, 14 nt, Homo sapiens
aguagacugcagug

SEQ ID NO: 1068936 - RNA, 22 nt, Homo sapiens
aguauaugaauuacccuuucau

SEQ ID NO: 1068937 - RNA, 16 nt, Homo sapiens
aguaugaaaaugucau

SEQ ID NO: 1068938 - RNA, 18 nt, Homo sapiens
aguaugaaaaugucauug

SEQ ID NO: 1068939 - RNA, 15 nt, Homo sapiens
aguaugguaauuaaa

SEQ ID NO: 1068940 - RNA, 13 nt, Homo sapiens
aguaugugcauau

SEQ ID NO: 1068941 - RNA, 13 nt, Homo sapiens
agucaauucugau

SEQ ID NO: 1068942 - RNA, 18 nt, Homo sapiens
agucacaaagaacaugua

SEQ ID NO: 1068943 - RNA, 22 nt, Homo sapiens
agucaguuucuaucauucugcu

SEQ ID NO: 1068944 - RNA, 19 nt, Homo sapiens
agucauaaaauguaucuuc

SEQ ID NO: 1068945 - RNA, 18 nt, Homo sapiens
agucaugcagucugggag

SEQ ID NO: 1068946 - RNA, 15 nt, Homo sapiens
aguccaacaauguug

SEQ ID NO: 1068947 - RNA, 14 nt, Homo sapiens
aguccauauuucaa

SEQ ID NO: 1068948 - RNA, 12 nt, Homo sapiens
aguccucugaau

SEQ ID NO: 1068949 - RNA, 19 nt, Homo sapiens
agucuauuugagacuccuc

SEQ ID NO: 1068950 - RNA, 17 nt, Homo sapiens
agugaauuucacacugu

SEQ ID NO: 1068951 - RNA, 23 nt, Homo sapiens
agugaggucacaguccacccacc

SEQ ID NO: 1068952 - RNA, 16 nt, Homo sapiens
agugccuuuacuucag

SEQ ID NO: 1068953 - RNA, 21 nt, Homo sapiens
aguggcauaaaaaacaugugg

SEQ ID NO: 1068954 - RNA, 17 nt, Homo sapiens
aguggcucacaccugua

SEQ ID NO: 1068955 - RNA, 14 nt, Homo sapiens
aguggcuucacucc

SEQ ID NO: 1068956 - RNA, 22 nt, Homo sapiens
aguuaaguuuuucccuucaucu

SEQ ID NO: 1068957 - RNA, 22 nt, Homo sapiens
aguuagaauaauaaauauuuag

SEQ ID NO: 1068958 - RNA, 15 nt, Homo sapiens
aguuaggagaaagaa

SEQ ID NO: 1068959 - RNA, 21 nt, Homo sapiens
aguucugcucauucuaaugau

SEQ ID NO: 1068960 - RNA, 22 nt, Homo sapiens
aguugacuugacagaacacugu

SEQ ID NO: 1068961 - RNA, 19 nt, Homo sapiens
aguuguagguaauauugca

SEQ ID NO: 1068962 - RNA, 14 nt, Homo sapiens
aguuguucaaacau

SEQ ID NO: 1068963 - RNA, 15 nt, Homo sapiens
auaaaaaguaaaaac

SEQ ID NO: 1068964 - RNA, 14 nt, Homo sapiens
auaaaauauguaca

SEQ ID NO: 1068965 - RNA, 22 nt, Homo sapiens
auaagaacuucuauaauuguau

SEQ ID NO: 1068966 - RNA, 12 nt, Homo sapiens
auaauacuauau

SEQ ID NO: 1068967 - RNA, 12 nt, Homo sapiens
auaauacuguau

SEQ ID NO: 1068968 - RNA, 18 nt, Homo sapiens
auaaucaucucugucaca

SEQ ID NO: 1068969 - RNA, 12 nt, Homo sapiens
auaaucuuugcu

SEQ ID NO: 1068970 - RNA, 18 nt, Homo sapiens
auaauggggccuguuaca

SEQ ID NO: 1068971 - RNA, 20 nt, Homo sapiens
auacaaggcccagauguggu

SEQ ID NO: 1068972 - RNA, 16 nt, Homo sapiens
auaccagaauguugcu

SEQ ID NO: 1068973 - RNA, 11 nt, Homo sapiens
auaccuguggu

SEQ ID NO: 1068974 - RNA, 21 nt, Homo sapiens
auacuauauuuauacuguaua

SEQ ID NO: 1068975 - RNA, 11 nt, Homo sapiens
auauaauacug

SEQ ID NO: 1068976 - RNA, 16 nt, Homo sapiens
auauagcaagauccca

SEQ ID NO: 1068977 - RNA, 12 nt, Homo sapiens
auauauaugugu

SEQ ID NO: 1068978 - RNA, 15 nt, Homo sapiens
auauaugccuuugau

SEQ ID NO: 1068979 - RNA, 16 nt, Homo sapiens
auauggcagugucuuu

SEQ ID NO: 1068980 - RNA, 20 nt, Homo sapiens
auauguaaaaagucauaaaa

SEQ ID NO: 1068981 - RNA, 15 nt, Homo sapiens
auauguauaggagcu

SEQ ID NO: 1068982 - RNA, 15 nt, Homo sapiens
auauguauauauaug

SEQ ID NO: 1068983 - RNA, 19 nt, Homo sapiens
auauguguauauauauaug

SEQ ID NO: 1068984 - RNA, 18 nt, Homo sapiens
auauucccacagcacuaa

SEQ ID NO: 1068985 - RNA, 14 nt, Homo sapiens
auauucuggaguca

SEQ ID NO: 1068986 - RNA, 13 nt, Homo sapiens
auauuuuauacau

SEQ ID NO: 1068987 - RNA, 22 nt, Homo sapiens
aucacucugugucugaguggcu

SEQ ID NO: 1068988 - RNA, 15 nt, Homo sapiens
aucacuucaggucag

SEQ ID NO: 1068989 - RNA, 15 nt, Homo sapiens
auucuacuugcucug

SEQ ID NO: 1068990 - RNA, 21 nt, Homo sapiens
auucugagguaaccucauuau

SEQ ID NO: 1068991 - RNA, 15 nt, Homo sapiens
auucugcagccacaa

SEQ ID NO: 1068992 - RNA, 18 nt, Homo sapiens
auucuuuacccccuggga

SEQ ID NO: 1068993 - RNA, 14 nt, Homo sapiens
auucuuugcaagau

SEQ ID NO: 1068994 - RNA, 14 nt, Homo sapiens
auugagcugcagaa

SEQ ID NO: 1068995 - RNA, 15 nt, Homo sapiens
auugcagaguacugg

SEQ ID NO: 1068996 - RNA, 19 nt, Homo sapiens
auugcucucccagcccuug

SEQ ID NO: 1068997 - RNA, 14 nt, Homo sapiens
auuggaagaaagaa

SEQ ID NO: 1068998 - RNA, 22 nt, Homo sapiens
auuggaggugaacaagcaaacc

SEQ ID NO: 1068999 - RNA, 17 nt, Homo sapiens
auuguguuacucaugau

SEQ ID NO: 1069000 - RNA, 21 nt, Homo sapiens
auuuaaaaacaggcagcucau

SEQ ID NO: 1069001 - RNA, 14 nt, Homo sapiens
auuuagauaugcaa

SEQ ID NO: 1069002 - RNA, 20 nt, Homo sapiens
auuuagauaugcaaaagcug

SEQ ID NO: 1069003 - RNA, 20 nt, Homo sapiens
auuuagcuccaaaccuucac

SEQ ID NO: 1069004 - RNA, 13 nt, Homo sapiens
auuuauacuguau

SEQ ID NO: 1069005 - RNA, 12 nt, Homo sapiens
auuuauugccuc

SEQ ID NO: 1069006 - RNA, 21 nt, Homo sapiens
auuuccccuuuugcauucucc

SEQ ID NO: 1069007 - RNA, 14 nt, Homo sapiens
auuucucuccucac

SEQ ID NO: 1069008 - RNA, 15 nt, Homo sapiens
auuugagacuccuca

SEQ ID NO: 1069009 - RNA, 15 nt, Homo sapiens
auuugauaguauugu

SEQ ID NO: 1069010 - RNA, 14 nt, Homo sapiens
auuuguuugugcau

SEQ ID NO: 1069011 - RNA, 14 nt, Homo sapiens
auuuuagccuuuau

SEQ ID NO: 1069012 - RNA, 14 nt, Homo sapiens
auuuuccucugcuu

SEQ ID NO: 1069013 - RNA, 15 nt, Homo sapiens
auuuuuacguuugaa

SEQ ID NO: 1069014 - RNA, 15 nt, Homo sapiens
auuuuucagaccuuu

SEQ ID NO: 1069015 - RNA, 21 nt, Homo sapiens
auuuuuuccuaacauaccuaa

SEQ ID NO: 1069016 - RNA, 22 nt, Homo sapiens
auuuuuuugugggaaauccaca

SEQ ID NO: 1069017 - RNA, 18 nt, Homo sapiens
caaaaauacucacauggc

SEQ ID NO: 1069018 - RNA, 14 nt, Homo sapiens
caaaagcugcucag

SEQ ID NO: 1069019 - RNA, 14 nt, Homo sapiens
caaacauugaugcu

SEQ ID NO: 1069020 - RNA, 15 nt, Homo sapiens
caaacauugaugcug

SEQ ID NO: 1069021 - RNA, 14 nt, Homo sapiens
caaacauuuaccaa

SEQ ID NO: 1069022 - RNA, 13 nt, Homo sapiens
caaacugagaucc

SEQ ID NO: 1069023 - RNA, 14 nt, Homo sapiens
caaagacuauuccc

SEQ ID NO: 1069024 - RNA, 17 nt, Homo sapiens
caaagaugggugaaggc

SEQ ID NO: 1069025 - RNA, 19 nt, Homo sapiens
caaagcacuguuucucuca

SEQ ID NO: 1069026 - RNA, 14 nt, Homo sapiens
caaauaauuggcau

SEQ ID NO: 1069027 - RNA, 20 nt, Homo sapiens
caaauagaauuugagcauca

SEQ ID NO: 1069028 - RNA, 14 nt, Homo sapiens
caaaucaucucuca

SEQ ID NO: 1069029 - RNA, 21 nt, Homo sapiens
caaauugugugugcucugcuu

SEQ ID NO: 1069030 - RNA, 13 nt, Homo sapiens
caacauucuuugc

SEQ ID NO: 1069031 - RNA, 16 nt, Homo sapiens
caacccgguucacucu

SEQ ID NO: 1069032 - RNA, 21 nt, Homo sapiens
caacuguguguucgacaguga

SEQ ID NO: 1069033 - RNA, 13 nt, Homo sapiens
caagaugacacaa

SEQ ID NO: 1069034 - RNA, 13 nt, Homo sapiens
caagcaagacuga

SEQ ID NO: 1069035 - RNA, 18 nt, Homo sapiens
caagcagaaacuuuacaa

SEQ ID NO: 1069036 - RNA, 17 nt, Homo sapiens
caagccacugagcaaug

SEQ ID NO: 1069037 - RNA, 20 nt, Homo sapiens
caagccuaaaauuguauaga

SEQ ID NO: 1069038 - RNA, 21 nt, Homo sapiens
caagcuguccucccaccucag

SEQ ID NO: 1069039 - RNA, 18 nt, Homo sapiens
caaggcaaagacuauucc

SEQ ID NO: 1069040 - RNA, 21 nt, Homo sapiens
caaggcaaagacuauucccuu

SEQ ID NO: 1069041 - RNA, 18 nt, Homo sapiens
caaguagcauuuacugug

SEQ ID NO: 1069042 - RNA, 16 nt, Homo sapiens
caaugaggcugcuuau

SEQ ID NO: 1069043 - RNA, 23 nt, Homo sapiens
caaugccaaaaaaagacagggcu

SEQ ID NO: 1069044 - RNA, 16 nt, Homo sapiens
caauggcuuacuccag

SEQ ID NO: 1069045 - RNA, 22 nt, Homo sapiens
caaugguuugcaaggaagccac

SEQ ID NO: 1069046 - RNA, 18 nt, Homo sapiens
caauguuuuuaaaaaucu

SEQ ID NO: 1069047 - RNA, 19 nt, Homo sapiens
caauguuuuuaaaaaucug

SEQ ID NO: 1069048 - RNA, 20 nt, Homo sapiens
caauucuaacuuuuuugcua

SEQ ID NO: 1069049 - RNA, 20 nt, Homo sapiens
cacaaacagaaaacauguaa

SEQ ID NO: 1069050 - RNA, 13 nt, Homo sapiens
cacaauacaauaa

SEQ ID NO: 1069051 - RNA, 21 nt, Homo sapiens
cacacgccucccacugggguc

SEQ ID NO: 1069052 - RNA, 17 nt, Homo sapiens
cacacugagcugagggg

SEQ ID NO: 1069053 - RNA, 21 nt, Homo sapiens
cacagcccugcagugcccuag

SEQ ID NO: 1069054 - RNA, 15 nt, Homo sapiens
uccuggcccagguga

SEQ ID NO: 1069055 - RNA, 16 nt, Homo sapiens
uccuguuuacugaaaa

SEQ ID NO: 1069056 - RNA, 15 nt, Homo sapiens
uccuuuccagguauu

SEQ ID NO: 1069057 - RNA, 23 nt, Homo sapiens
uccuuuugaaagaaucagucuug

SEQ ID NO: 1069058 - RNA, 14 nt, Homo sapiens
ucgaccaguuugaa

SEQ ID NO: 1069059 - RNA, 20 nt, Homo sapiens
ucgcaguguucaaggccauc

SEQ ID NO: 1069060 - RNA, 19 nt, Homo sapiens
ucgccagcugaugacucaa

SEQ ID NO: 1069061 - RNA, 23 nt, Homo sapiens
ucgcuaccuuuugcuguggcaaa

SEQ ID NO: 1069062 - RNA, 14 nt, Homo sapiens
ucucagccacugaa

SEQ ID NO: 1069063 - RNA, 17 nt, Homo sapiens
ucuccaacggcaaggga

SEQ ID NO: 1069064 - RNA, 18 nt, Homo sapiens
ucuccccucagagugcaa

SEQ ID NO: 1069065 - RNA, 11 nt, Homo sapiens
ucucucugauc

SEQ ID NO: 1069066 - RNA, 21 nt, Homo sapiens
ucucugcagggccgccaggga

SEQ ID NO: 1069067 - RNA, 22 nt, Homo sapiens
ucucugcagggccgccagggag

SEQ ID NO: 1069068 - RNA, 17 nt, Homo sapiens
ucugaagucaguuucua

SEQ ID NO: 1069069 - RNA, 18 nt, Homo sapiens
ucugaauuugagauacaa

SEQ ID NO: 1069070 - RNA, 23 nt, Homo sapiens
ucugagcagugcuugaaugaagu

SEQ ID NO: 1069071 - RNA, 16 nt, Homo sapiens
ucugcucauucuaaug

SEQ ID NO: 1069072 - RNA, 24 nt, Homo sapiens
ucuggcagguauccccagcaguca

SEQ ID NO: 1069073 - RNA, 13 nt, Homo sapiens
ucuguuuaacuuc

SEQ ID NO: 1069074 - RNA, 22 nt, Homo sapiens
ucuguuuauaugacauuguuaa

SEQ ID NO: 1069075 - RNA, 19 nt, Homo sapiens
ucuguuuuguuuugcugaa

SEQ ID NO: 1069076 - RNA, 14 nt, Homo sapiens
ucuuaacuauucaa

SEQ ID NO: 1069077 - RNA, 17 nt, Homo sapiens
ucuuaaggaacaucucu

SEQ ID NO: 1069078 - RNA, 23 nt, Homo sapiens
ucuuaaugcagacaaacaaacau

SEQ ID NO: 1069079 - RNA, 19 nt, Homo sapiens
ucuuacaaugcauucugag

SEQ ID NO: 1069080 - RNA, 16 nt, Homo sapiens
ucuucaccucugcuac

SEQ ID NO: 1069081 - RNA, 20 nt, Homo sapiens
ucuugaaagaauaacagaaa

SEQ ID NO: 1069082 - RNA, 20 nt, Homo sapiens
ucuugaaucucugaauuuga

SEQ ID NO: 1069083 - RNA, 22 nt, Homo sapiens
ucuuguaaagguccuggcaaag

SEQ ID NO: 1069084 - RNA, 23 nt, Homo sapiens
ucuuguuucaucguaaacauacu

SEQ ID NO: 1069085 - RNA, 19 nt, Homo sapiens
ugaaauggugaaaugcaga

SEQ ID NO: 1069086 - RNA, 18 nt, Homo sapiens
ugaacaagcaaacccaga

SEQ ID NO: 1069087 - RNA, 15 nt, Homo sapiens
ugaagacacugaaau

SEQ ID NO: 1069088 - RNA, 17 nt, Homo sapiens
ugaagagauacagccuu

SEQ ID NO: 1069089 - RNA, 15 nt, Homo sapiens
ugaagaguccucuga

SEQ ID NO: 1069090 - RNA, 19 nt, Homo sapiens
ugaaucuauuuaucuucau

SEQ ID NO: 1069091 - RNA, 20 nt, Homo sapiens
ugaauuauuuccugcuuauu

SEQ ID NO: 1069092 - RNA, 23 nt, Homo sapiens
ugaauuugagauacaaacauguu

SEQ ID NO: 1069093 - RNA, 18 nt, Homo sapiens
ugacaacgcccuacagca

SEQ ID NO: 1069094 - RNA, 13 nt, Homo sapiens
ugacacagucaau

SEQ ID NO: 1069095 - RNA, 15 nt, Homo sapiens
ugacugagaauauaa

SEQ ID NO: 1069096 - RNA, 14 nt, Homo sapiens
ugacuuucauugga

SEQ ID NO: 1069097 - RNA, 24 nt, Homo sapiens
ugagaaacaaugacuaauucuugc

SEQ ID NO: 1069098 - RNA, 11 nt, Homo sapiens
ugagacaaaga

SEQ ID NO: 1069099 - RNA, 16 nt, Homo sapiens
ugagacacaggaugaa

SEQ ID NO: 1069100 - RNA, 16 nt, Homo sapiens
ugagccauuugagggg

SEQ ID NO: 1069101 - RNA, 21 nt, Homo sapiens
ugagcucccaggugcagccag

SEQ ID NO: 1069102 - RNA, 16 nt, Homo sapiens
ugagcucuuugcacua

SEQ ID NO: 1069103 - RNA, 21 nt, Homo sapiens
ugaggaaaagcggacaucagc

SEQ ID NO: 1069104 - RNA, 12 nt, Homo sapiens
ugagguaaccuc

SEQ ID NO: 1069105 - RNA, 23 nt, Homo sapiens
ugagucgaagaguggacaaacag

SEQ ID NO: 1069106 - RNA, 21 nt, Homo sapiens
ugaguugguguugacaugugc

SEQ ID NO: 1069107 - RNA, 17 nt, Homo sapiens
ugauaugugaaugcuca

SEQ ID NO: 1069108 - RNA, 23 nt, Homo sapiens
ugaucuuuuguucccauccucuu

SEQ ID NO: 1069109 - RNA, 16 nt, Homo sapiens
ugauugugccuacgaa

SEQ ID NO: 1069110 - RNA, 23 nt, Homo sapiens
ugauuuccccuuuugcauucucc

SEQ ID NO: 1069111 - RNA, 15 nt, Homo sapiens
ugcacaaaguggcau

SEQ ID NO: 1069112 - RNA, 17 nt, Homo sapiens
ugcacaaaguggcauaa

SEQ ID NO: 1069113 - RNA, 13 nt, Homo sapiens
ugcaccaaaucau

SEQ ID NO: 1069114 - RNA, 18 nt, Homo sapiens
ugcacucagcucuuggcu

SEQ ID NO: 1069115 - RNA, 20 nt, Homo sapiens
ugcacuccagcuugggcaac

SEQ ID NO: 1069116 - RNA, 17 nt, Homo sapiens
ugcagacaaacaaacau

SEQ ID NO: 1069117 - RNA, 21 nt, Homo sapiens
ugcauauuuuguaacuuccau

SEQ ID NO: 1069118 - RNA, 19 nt, Homo sapiens
ugcauguacccuaagguca

SEQ ID NO: 1069119 - RNA, 21 nt, Homo sapiens
ugcauguuuguuguauacuuc

SEQ ID NO: 1069120 - RNA, 20 nt, Homo sapiens
ugcauucucccuccuucccu

SEQ ID NO: 1069121 - RNA, 20 nt, Homo sapiens
ugcauucugagguaaccuca

SEQ ID NO: 1069122 - RNA, 24 nt, Homo sapiens
ugccaagaccuuucaaagccauuu

SEQ ID NO: 1069123 - RNA, 17 nt, Homo sapiens
ugccacuacacuccagc

SEQ ID NO: 1069124 - RNA, 14 nt, Homo sapiens
ugccauugcacucc

SEQ ID NO: 1069125 - RNA, 15 nt, Homo sapiens
ugccgcaccauugaa

SEQ ID NO: 1069126 - RNA, 16 nt, Homo sapiens
ugccgcuacaaaaagg

SEQ ID NO: 1069127 - RNA, 22 nt, Homo sapiens
ugccucaggccucugugccgca

SEQ ID NO: 1069128 - RNA, 17 nt, Homo sapiens
ugccucccccuagccau

SEQ ID NO: 1069129 - RNA, 19 nt, Homo sapiens
ugccugcaggcaugaguca

SEQ ID NO: 1069130 - RNA, 13 nt, Homo sapiens
ugcggagcaagag

SEQ ID NO: 1069131 - RNA, 22 nt, Homo sapiens
ugcuaacuagcuuggaaacugg

SEQ ID NO: 1069132 - RNA, 17 nt, Homo sapiens
ugcuacaggggccagaa

SEQ ID NO: 1069133 - RNA, 16 nt, Homo sapiens
ugcucacaguccucau

SEQ ID NO: 1069134 - RNA, 21 nt, Homo sapiens
ugcucuuugauucaaagcacu

SEQ ID NO: 1069135 - RNA, 18 nt, Homo sapiens
ugcugucccaaacaugca

SEQ ID NO: 1069136 - RNA, 22 nt, Homo sapiens
ugcugucccaaacaugcacuuc

SEQ ID NO: 1069137 - RNA, 16 nt, Homo sapiens
ugcugugaaauuccca

SEQ ID NO: 1069138 - RNA, 12 nt, Homo sapiens
ugcuuauaucau

SEQ ID NO: 1069139 - RNA, 17 nt, Homo sapiens
uggaagcugucauaaaa

SEQ ID NO: 1069140 - RNA, 13 nt, Homo sapiens
uggaaucuuguaa

SEQ ID NO: 1069141 - RNA, 13 nt, Homo sapiens
uggaauugugcug

SEQ ID NO: 1069142 - RNA, 22 nt, Homo sapiens
uggaggaucucacuuaauucuc

SEQ ID NO: 1069143 - RNA, 14 nt, Homo sapiens
uggagguagaauga

SEQ ID NO: 1069144 - RNA, 22 nt, Homo sapiens
uggagguauucaauauccuuug

SEQ ID NO: 1069145 - RNA, 24 nt, Homo sapiens
uggagguauucaauauccuuugcc

SEQ ID NO: 1069146 - RNA, 14 nt, Homo sapiens
uggagucauucuca

SEQ ID NO: 1069147 - RNA, 14 nt, Homo sapiens
uggaugcacuuuca

SEQ ID NO: 1069148 - RNA, 13 nt, Homo sapiens
uggauuauuucau

SEQ ID NO: 1069149 - RNA, 14 nt, Homo sapiens
uggcugauggagua

SEQ ID NO: 1069150 - RNA, 20 nt, Homo sapiens
uggcuuggguucacagugca

SEQ ID NO: 1069151 - RNA, 14 nt, Homo sapiens
ugggcccacaaagg

SEQ ID NO: 1069152 - RNA, 14 nt, Homo sapiens
uggggaaaauccua

SEQ ID NO: 1069153 - RNA, 18 nt, Homo sapiens
ugggguggggauagggag

SEQ ID NO: 1069154 - RNA, 13 nt, Homo sapiens
uggguaccuguau

SEQ ID NO: 1069155 - RNA, 14 nt, Homo sapiens
ugguauccaaguua

SEQ ID NO: 1069156 - RNA, 22 nt, Homo sapiens
uggucaaacaaacucucugaac

SEQ ID NO: 1069157 - RNA, 16 nt, Homo sapiens
uggucccaagacauga

SEQ ID NO: 1069158 - RNA, 19 nt, Homo sapiens
ugguggcgcgugccuguaa

SEQ ID NO: 1069159 - RNA, 18 nt, Homo sapiens
uguaaaccaaguucaaag

SEQ ID NO: 1069160 - RNA, 17 nt, Homo sapiens
uguaaggaaggugcuca

SEQ ID NO: 1069161 - RNA, 20 nt, Homo sapiens
uguauagguuuuaaagaccu

SEQ ID NO: 1069162 - RNA, 15 nt, Homo sapiens
uguaucaguggauuu

SEQ ID NO: 1069163 - RNA, 12 nt, Homo sapiens
ugucaccuucac

SEQ ID NO: 1069164 - RNA, 16 nt, Homo sapiens
ugucauaaaaagacaa

SEQ ID NO: 1069165 - RNA, 20 nt, Homo sapiens
ugucauagaaagugccagaa

SEQ ID NO: 1069166 - RNA, 17 nt, Homo sapiens
ugucccaaacaugcacu

SEQ ID NO: 1069167 - RNA, 18 nt, Homo sapiens
ugucccaaacaugcacuu

SEQ ID NO: 1069168 - RNA, 16 nt, Homo sapiens
uguccucccagcuccu

SEQ ID NO: 1069169 - RNA, 20 nt, Homo sapiens
ugucuaacuggggauauaau

SEQ ID NO: 1069170 - RNA, 19 nt, Homo sapiens
ugucucccagcucagggcu

SEQ ID NO: 1069171 - RNA, 23 nt, Homo sapiens
ugucuguaucaguggauuuccca

SEQ ID NO: 1069172 - RNA, 16 nt, Homo sapiens
ugugaacccaaagugu

SEQ ID NO: 1069173 - RNA, 20 nt, Homo sapiens
ugugaaggccucgcaggaag

SEQ ID NO: 1069174 - RNA, 23 nt, Homo sapiens
ugugacaacuuccugagggaucu

SEQ ID NO: 1069175 - RNA, 21 nt, Homo sapiens
ugugaguguacaggagaagaa

SEQ ID NO: 1069176 - RNA, 17 nt, Homo sapiens
ugugcacaaaguggcau

SEQ ID NO: 1069177 - RNA, 18 nt, Homo sapiens
ugugccacuacacuccag

SEQ ID NO: 1069178 - RNA, 13 nt, Homo sapiens
ugugcccucagau

SEQ ID NO: 1069179 - RNA, 22 nt, Homo sapiens
ugugccuuaggaaaagcauuug

SEQ ID NO: 1069180 - RNA, 18 nt, Homo sapiens
uguggaggagcucaggac

SEQ ID NO: 1069181 - RNA, 15 nt, Homo sapiens
uguggguaccuguau

SEQ ID NO: 1069182 - RNA, 19 nt, Homo sapiens
ugugguuaaugccauggac

SEQ ID NO: 1069183 - RNA, 22 nt, Homo sapiens
ugugguuaaugccauggacaga

SEQ ID NO: 1069184 - RNA, 11 nt, Homo sapiens
uguguguauau

SEQ ID NO: 1069185 - RNA, 13 nt, Homo sapiens
uguuaucugggaa

SEQ ID NO: 1069186 - RNA, 13 nt, Homo sapiens
uguugacaugugc

SEQ ID NO: 1069187 - RNA, 21 nt, Homo sapiens
uguugccuaagcuggucucaa

SEQ ID NO: 1069188 - RNA, 20 nt, Homo sapiens
uguuguuuuaggaauacaua

SEQ ID NO: 1069189 - RNA, 13 nt, Homo sapiens
uguuuccuugccu

SEQ ID NO: 1069190 - RNA, 19 nt, Homo sapiens
uguuuguuguauacuuccu

SEQ ID NO: 1069191 - RNA, 17 nt, Homo sapiens
uguuuuaaguugcuuua

SEQ ID NO: 1069192 - RNA, 18 nt, Homo sapiens
uguuuuaggucuagccua

SEQ ID NO: 1069193 - RNA, 18 nt, Homo sapiens
uuaaaaaaaaaauucaau

SEQ ID NO: 1069194 - RNA, 18 nt, Homo sapiens
uuaaaaaguucauaacag

SEQ ID NO: 1069195 - RNA, 18 nt, Homo sapiens
uuaaagaagagaacugcc

SEQ ID NO: 1069196 - RNA, 16 nt, Homo sapiens
uuaaaugugacauucu

SEQ ID NO: 1069197 - RNA, 18 nt, Homo sapiens
uuaaccugccaacauacu

SEQ ID NO: 1069198 - RNA, 23 nt, Homo sapiens
uuaacuauuuuauuuucuaaugu

SEQ ID NO: 1069199 - RNA, 17 nt, Homo sapiens
uuaaggaacaucucugc

SEQ ID NO: 1069200 - RNA, 16 nt, Homo sapiens
uuaaucaccacucaaa

SEQ ID NO: 1069201 - RNA, 17 nt, Homo sapiens
uuaaugcuuauaagaca

SEQ ID NO: 1069202 - RNA, 20 nt, Homo sapiens
uuaauuuauugaggcuuuaa

SEQ ID NO: 1069203 - RNA, 13 nt, Homo sapiens
uuaauuugcacag

SEQ ID NO: 1069204 - RNA, 18 nt, Homo sapiens
uuacaaagggggaggcua

SEQ ID NO: 1069205 - RNA, 16 nt, Homo sapiens
uuacaaaggugaaaau

SEQ ID NO: 1069206 - RNA, 15 nt, Homo sapiens
uuacaucuacaaaca

SEQ ID NO: 1069207 - RNA, 16 nt, Homo sapiens
uuacauguuguguaug

SEQ ID NO: 1069208 - RNA, 19 nt, Homo sapiens
uuacccacacacagauaaa

SEQ ID NO: 1069209 - RNA, 19 nt, Homo sapiens
uuacuggauuugacuucag

SEQ ID NO: 1069210 - RNA, 18 nt, Homo sapiens
uuagaaacaacauagcaa

SEQ ID NO: 1069211 - RNA, 17 nt, Homo sapiens
uuagaaauaauggucau

SEQ ID NO: 1069212 - RNA, 20 nt, Homo sapiens
uuagaguuucaaccaugaag

SEQ ID NO: 1069213 - RNA, 16 nt, Homo sapiens
uuagcaaccauaauau

SEQ ID NO: 1069214 - RNA, 12 nt, Homo sapiens
uuagccaggugu

SEQ ID NO: 1069215 - RNA, 10 nt, Homo sapiens
uuagccuuua

SEQ ID NO: 1069216 - RNA, 20 nt, Homo sapiens
uuauaauucugggaagcaaa

SEQ ID NO: 1069217 - RNA, 18 nt, Homo sapiens
uuauacauuaacuucagc

SEQ ID NO: 1069218 - RNA, 18 nt, Homo sapiens
uuauagccgaaaugaucu

SEQ ID NO: 1069219 - RNA, 22 nt, Homo sapiens
uuauaggaaaauauaugaagaa

SEQ ID NO: 1069220 - RNA, 14 nt, Homo sapiens
uuaucuucauuuga

SEQ ID NO: 1069221 - RNA, 16 nt, Homo sapiens
uuaugagacacaggau

SEQ ID NO: 1069222 - RNA, 20 nt, Homo sapiens
uuauuuagaaauagaacuac

SEQ ID NO: 1069223 - RNA, 17 nt, Homo sapiens
uucaaaaaccacguucu

SEQ ID NO: 1069224 - RNA, 18 nt, Homo sapiens
uucaagguaacuguacug

SEQ ID NO: 1069225 - RNA, 22 nt, Homo sapiens
uucacaaacagaaaacauguaa

SEQ ID NO: 1069226 - RNA, 21 nt, Homo sapiens
uucacaaaccagagaccaaau

SEQ ID NO: 1069227 - RNA, 14 nt, Homo sapiens
uucacacaauacaa

SEQ ID NO: 1069228 - RNA, 16 nt, Homo sapiens
uucacacuguccccca

SEQ ID NO: 1069229 - RNA, 22 nt, Homo sapiens
uucaccauauugcccagggugg

SEQ ID NO: 1069230 - RNA, 21 nt, Homo sapiens
uucagccaggugaacuggaau

SEQ ID NO: 1069231 - RNA, 19 nt, Homo sapiens
uucaguugccauugacaga

SEQ ID NO: 1069232 - RNA, 13 nt, Homo sapiens
uucauaugcagua

SEQ ID NO: 1069233 - RNA, 19 nt, Homo sapiens
uucaugcaggugaaaccca

SEQ ID NO: 1069234 - RNA, 23 nt, Homo sapiens
uuccagguauuuuauaauucugg

SEQ ID NO: 1069235 - RNA, 17 nt, Homo sapiens
uucccuuugagguugcu

SEQ ID NO: 1069236 - RNA, 21 nt, Homo sapiens
uuccgaggccccugucucagg

SEQ ID NO: 1069237 - RNA, 23 nt, Homo sapiens
uuccgaggccccugucucagggu

SEQ ID NO: 1069238 - RNA, 12 nt, Homo sapiens
uuccuuccagcc

SEQ ID NO: 1069239 - RNA, 14 nt, Homo sapiens
uucuaaugugccua

SEQ ID NO: 1069240 - RNA, 21 nt, Homo sapiens
uucuagaaacaggaaacaccg

SEQ ID NO: 1069241 - RNA, 16 nt, Homo sapiens
uucugaauugacugua

SEQ ID NO: 1069242 - RNA, 16 nt, Homo sapiens
uucugagguaaccuca

SEQ ID NO: 1069243 - RNA, 18 nt, Homo sapiens
uucuggagaucauuuaaa

SEQ ID NO: 1069244 - RNA, 21 nt, Homo sapiens
uucuggcccaguuaauuugca

SEQ ID NO: 1069245 - RNA, 13 nt, Homo sapiens
uucuuaacuauuc

SEQ ID NO: 1069246 - RNA, 22 nt, Homo sapiens
uucuuuugaaaauuaguauggu

SEQ ID NO: 1069247 - RNA, 19 nt, Homo sapiens
uugaaugcagucuguccag

SEQ ID NO: 1069248 - RNA, 23 nt, Homo sapiens
uugacacaacguaacaccagcau

SEQ ID NO: 1069249 - RNA, 15 nt, Homo sapiens
uugacagaacacugu

SEQ ID NO: 1069250 - RNA, 16 nt, Homo sapiens
uugacagaacacuguc

SEQ ID NO: 1069251 - RNA, 17 nt, Homo sapiens
uugacuugacagaacac

SEQ ID NO: 1069252 - RNA, 11 nt, Homo sapiens
uugacuuuguc

SEQ ID NO: 1069253 - RNA, 22 nt, Homo sapiens
uugagacuccucaguucuugcc

SEQ ID NO: 1069254 - RNA, 18 nt, Homo sapiens
uugaggaaacaacagcuu

SEQ ID NO: 1069255 - RNA, 23 nt, Homo sapiens
uugauccuuaccuuguauaucau

SEQ ID NO: 1069256 - RNA, 15 nt, Homo sapiens
uugaucuucaacaaa

SEQ ID NO: 1069257 - RNA, 17 nt, Homo sapiens
uugauucaaagcacugu

SEQ ID NO: 1069258 - RNA, 21 nt, Homo sapiens
uugcaaggcaaagacuauucc

SEQ ID NO: 1069259 - RNA, 19 nt, Homo sapiens
uugcagcugagugaaaaau

SEQ ID NO: 1069260 - RNA, 13 nt, Homo sapiens
uugcauugcagag

SEQ ID NO: 1069261 - RNA, 23 nt, Homo sapiens
uugcauuuaauuuauugaggcuu

SEQ ID NO: 1069262 - RNA, 22 nt, Homo sapiens
uugcugaguccaacaauguugu

SEQ ID NO: 1069263 - RNA, 22 nt, Homo sapiens
uugcuuucgcuucuacagugca

SEQ ID NO: 1069264 - RNA, 18 nt, Homo sapiens
uuggaagcugucauaaaa

SEQ ID NO: 1069265 - RNA, 23 nt, Homo sapiens
uuggacugggugcggugacucau

SEQ ID NO: 1069266 - RNA, 23 nt, Homo sapiens
uuggcuucuguugucaccuucac

SEQ ID NO: 1069267 - RNA, 19 nt, Homo sapiens
uuggggugcaaaugcuaau

SEQ ID NO: 1069268 - RNA, 17 nt, Homo sapiens
uuggguucacagugcau

SEQ ID NO: 1069269 - RNA, 17 nt, Homo sapiens
uuggugcuuuccagaau

SEQ ID NO: 1069270 - RNA, 14 nt, Homo sapiens
uugguguaagccuu

SEQ ID NO: 1069271 - RNA, 19 nt, Homo sapiens
uugucacagggacugaaaa

SEQ ID NO: 1069272 - RNA, 17 nt, Homo sapiens
uugucucccagcucagg

SEQ ID NO: 1069273 - RNA, 13 nt, Homo sapiens
uugugccaaccua

SEQ ID NO: 1069274 - RNA, 19 nt, Homo sapiens
uugugccacuacacuccag

SEQ ID NO: 1069275 - RNA, 16 nt, Homo sapiens
uuguuucacaaacaga

SEQ ID NO: 1069276 - RNA, 13 nt, Homo sapiens
uuguuuugugcca

SEQ ID NO: 1069277 - RNA, 19 nt, Homo sapiens
uuuaaaaagcuaguucuau

SEQ ID NO: 1069278 - RNA, 17 nt, Homo sapiens
uuuaaguuuccuuccag

SEQ ID NO: 1069279 - RNA, 14 nt, Homo sapiens
uuuaauuuauacug

SEQ ID NO: 1069280 - RNA, 23 nt, Homo sapiens
uuuacguuugaagacauugcacc

SEQ ID NO: 1069281 - RNA, 17 nt, Homo sapiens
uuuagguucccaaaccu

SEQ ID NO: 1069282 - RNA, 21 nt, Homo sapiens
uuuagguucccaaaccuucag

SEQ ID NO: 1069283 - RNA, 13 nt, Homo sapiens
uuuauuauauaua

SEQ ID NO: 1069284 - RNA, 18 nt, Homo sapiens
uuuauuucuucaccagau

SEQ ID NO: 1069285 - RNA, 16 nt, Homo sapiens
uuucaaagccauuuua

SEQ ID NO: 1069286 - RNA, 20 nt, Homo sapiens
uuucacacaauacaauaagu

SEQ ID NO: 1069287 - RNA, 12 nt, Homo sapiens
uuucacauugaa

SEQ ID NO: 1069288 - RNA, 22 nt, Homo sapiens
uuucaccauauugcccagggug

SEQ ID NO: 1069289 - RNA, 19 nt, Homo sapiens
uuucccuucuuacaaugca

SEQ ID NO: 1069290 - RNA, 13 nt, Homo sapiens
uuuccuacagaca

SEQ ID NO: 1069291 - RNA, 16 nt, Homo sapiens
uuucugucacaucagc

SEQ ID NO: 1069292 - RNA, 17 nt, Homo sapiens
uuucuuaucacaaaaaa

SEQ ID NO: 1069293 - RNA, 15 nt, Homo sapiens
uuucuugaaagaaua

SEQ ID NO: 1069294 - RNA, 17 nt, Homo sapiens
uuugaaaccaaaccaga

SEQ ID NO: 1069295 - RNA, 21 nt, Homo sapiens
uuugaaugcagucuguccagg

SEQ ID NO: 1069296 - RNA, 15 nt, Homo sapiens
uuuggaaggcaaaga

SEQ ID NO: 1069297 - RNA, 15 nt, Homo sapiens
uuuggagguauucaa

SEQ ID NO: 1069298 - RNA, 19 nt, Homo sapiens
uuugggaaaaaaacauaca

SEQ ID NO: 1069299 - RNA, 18 nt, Homo sapiens
uuuuaauuuauacuggca

SEQ ID NO: 1069300 - RNA, 12 nt, Homo sapiens
uuuuacugcuug

SEQ ID NO: 1069301 - RNA, 17 nt, Homo sapiens
uuuuagaaucucuuucg

SEQ ID NO: 1069302 - RNA, 17 nt, Homo sapiens
uuuugaaaaugcuuuag

SEQ ID NO: 1069303 - RNA, 20 nt, Homo sapiens
uuuugaaguaccaccaaaaa

SEQ ID NO: 1069304 - RNA, 11 nt, Homo sapiens
uuuuucaauuu

SEQ ID NO: 1069305 - RNA, 22 nt, Homo sapiens
uacagguuacagugagcaaaga

SEQ ID NO: 1069306 - RNA, 18 nt, Homo sapiens
uacaguauauguugcaaa

SEQ ID NO: 1069307 - RNA, 23 nt, Homo sapiens
uacagucuauuugagacuccuca

SEQ ID NO: 1069308 - RNA, 14 nt, Homo sapiens
uacauuaacuucag

SEQ ID NO: 1069309 - RNA, 18 nt, Homo sapiens
uaccaugugcuacagggg

SEQ ID NO: 1069310 - RNA, 13 nt, Homo sapiens
uaccgcuuaucag

SEQ ID NO: 1069311 - RNA, 21 nt, Homo sapiens
uaccucaaccaaugccaaaaa

SEQ ID NO: 1069312 - RNA, 16 nt, Homo sapiens
uacgaauuguuucaca

SEQ ID NO: 1069313 - RNA, 17 nt, Homo sapiens
uacgaauuguuucacaa

SEQ ID NO: 1069314 - RNA, 19 nt, Homo sapiens
uacuauauuuauacuguau

SEQ ID NO: 1069315 - RNA, 13 nt, Homo sapiens
uacucaucaucaa

SEQ ID NO: 1069316 - RNA, 19 nt, Homo sapiens
uacucgggaggcugagaca

SEQ ID NO: 1069317 - RNA, 23 nt, Homo sapiens
uacucgggaggcugagacaggag

SEQ ID NO: 1069318 - RNA, 14 nt, Homo sapiens
uacugagagcaugu

SEQ ID NO: 1069319 - RNA, 19 nt, Homo sapiens
uacugguaggaacuugaga

SEQ ID NO: 1069320 - RNA, 20 nt, Homo sapiens
uacuuggucuggccacuguc

SEQ ID NO: 1069321 - RNA, 14 nt, Homo sapiens
uacuuuguaaagac

SEQ ID NO: 1069322 - RNA, 20 nt, Homo sapiens
uagaauuugagcaucaguga

SEQ ID NO: 1069323 - RNA, 15 nt, Homo sapiens
uagacuggcugaaaa

SEQ ID NO: 1069324 - RNA, 22 nt, Homo sapiens
uagauugagcuuagauugccuc

SEQ ID NO: 1069325 - RNA, 17 nt, Homo sapiens
uaggaaaauauaugaag

SEQ ID NO: 1069326 - RNA, 16 nt, Homo sapiens
uaggacccaagcagag

SEQ ID NO: 1069327 - RNA, 13 nt, Homo sapiens
uaggccaggugca

SEQ ID NO: 1069328 - RNA, 20 nt, Homo sapiens
uaggcucuuugucaucuuau

SEQ ID NO: 1069329 - RNA, 19 nt, Homo sapiens
uaguacuuacaucaggaaa

SEQ ID NO: 1069330 - RNA, 22 nt, Homo sapiens
uaguuguaauuuuuuuguggga

SEQ ID NO: 1069331 - RNA, 14 nt, Homo sapiens
uauaauucugggaa

SEQ ID NO: 1069332 - RNA, 14 nt, Homo sapiens
uauaauuugcauac

SEQ ID NO: 1069333 - RNA, 20 nt, Homo sapiens
uauacuuccuuaugcuucuu

SEQ ID NO: 1069334 - RNA, 20 nt, Homo sapiens
uauaugccgcuacaaaaagg

SEQ ID NO: 1069335 - RNA, 16 nt, Homo sapiens
uauauuuuagccuuua

SEQ ID NO: 1069336 - RNA, 13 nt, Homo sapiens
uaugcaauucuua

SEQ ID NO: 1069337 - RNA, 19 nt, Homo sapiens
uaugcaccaaaucaucucu

SEQ ID NO: 1069338 - RNA, 20 nt, Homo sapiens
uaugguacaagcaaugccug

SEQ ID NO: 1069339 - RNA, 18 nt, Homo sapiens
uaugguguacauucuucc

SEQ ID NO: 1069340 - RNA, 15 nt, Homo sapiens
uaugucucagaccac

SEQ ID NO: 1069341 - RNA, 19 nt, Homo sapiens
uauguugcaaaauauauca

SEQ ID NO: 1069342 - RNA, 17 nt, Homo sapiens
uauucccacagcacuaa

SEQ ID NO: 1069343 - RNA, 19 nt, Homo sapiens
uauucccuucuaaccugaa

SEQ ID NO: 1069344 - RNA, 14 nt, Homo sapiens
uauucgcuugagaa

SEQ ID NO: 1069345 - RNA, 16 nt, Homo sapiens
uauucuuaacuauuca

SEQ ID NO: 1069346 - RNA, 15 nt, Homo sapiens
uauugccucuuucac

SEQ ID NO: 1069347 - RNA, 16 nt, Homo sapiens
uauugccucuuucaca

SEQ ID NO: 1069348 - RNA, 21 nt, Homo sapiens
uauuguaaaaggaaagucauu

SEQ ID NO: 1069349 - RNA, 22 nt, Homo sapiens
uauuguccccuaaaccaaaaac

SEQ ID NO: 1069350 - RNA, 19 nt, Homo sapiens
uauuuagaaauagaacuac

SEQ ID NO: 1069351 - RNA, 21 nt, Homo sapiens
uauuuagaaauagaacuacaa

SEQ ID NO: 1069352 - RNA, 16 nt, Homo sapiens
uauuugagacuccuca

SEQ ID NO: 1069353 - RNA, 14 nt, Homo sapiens
uauuuuagccuuua

SEQ ID NO: 1069354 - RNA, 14 nt, Homo sapiens
uauuuuccaugaaa

SEQ ID NO: 1069355 - RNA, 22 nt, Homo sapiens
uauuuuccccucaagauuauca

SEQ ID NO: 1069356 - RNA, 13 nt, Homo sapiens
uauuuucuucacc

SEQ ID NO: 1069357 - RNA, 23 nt, Homo sapiens
uauuuugggaaaaaaacauacac

SEQ ID NO: 1069358 - RNA, 13 nt, Homo sapiens
ucaaaaauacuca

SEQ ID NO: 1069359 - RNA, 17 nt, Homo sapiens
ucaaaauugagugguuu

SEQ ID NO: 1069360 - RNA, 18 nt, Homo sapiens
ucaaaauugagugguuua

SEQ ID NO: 1069361 - RNA, 17 nt, Homo sapiens
ucaaagccacacucugg

SEQ ID NO: 1069362 - RNA, 18 nt, Homo sapiens
ucaaaggccagaccugca

SEQ ID NO: 1069363 - RNA, 22 nt, Homo sapiens
ucaaaguucugggacuacaggc

SEQ ID NO: 1069364 - RNA, 21 nt, Homo sapiens
ucacaaaccagagaccaaaug

SEQ ID NO: 1069365 - RNA, 19 nt, Homo sapiens
ucacaaccugaaccuagga

SEQ ID NO: 1069366 - RNA, 23 nt, Homo sapiens
ucacaccaggcuugccugcaggc

SEQ ID NO: 1069367 - RNA, 22 nt, Homo sapiens
ucacaucagaacagacaaucac

SEQ ID NO: 1069368 - RNA, 14 nt, Homo sapiens
ucaccacucaaaaa

SEQ ID NO: 1069369 - RNA, 18 nt, Homo sapiens
ucaccugggcugaggcau

SEQ ID NO: 1069370 - RNA, 19 nt, Homo sapiens
ucacgccuguaaucccagc

SEQ ID NO: 1069371 - RNA, 15 nt, Homo sapiens
ucacuauguugccua

SEQ ID NO: 1069372 - RNA, 12 nt, Homo sapiens
ucacuucaugca

SEQ ID NO: 1069373 - RNA, 16 nt, Homo sapiens
ucacuucucuuccuug

SEQ ID NO: 1069374 - RNA, 17 nt, Homo sapiens
ucagaauuagcugcuuc

SEQ ID NO: 1069375 - RNA, 21 nt, Homo sapiens
ucagaccuuuuaacuccucaa

SEQ ID NO: 1069376 - RNA, 16 nt, Homo sapiens
ucagcugcucugcaag

SEQ ID NO: 1069377 - RNA, 18 nt, Homo sapiens
ucaggaguucgagaccag

SEQ ID NO: 1069378 - RNA, 19 nt, Homo sapiens
ucaggcaaagcuugaauca

SEQ ID NO: 1069379 - RNA, 18 nt, Homo sapiens
ucaggccucugugccgca

SEQ ID NO: 1069380 - RNA, 22 nt, Homo sapiens
ucaggggcggggagggugacag

SEQ ID NO: 1069381 - RNA, 19 nt, Homo sapiens
ucaguaacccccacuggac

SEQ ID NO: 1069382 - RNA, 17 nt, Homo sapiens
ucaguccaaagggcaug

SEQ ID NO: 1069383 - RNA, 17 nt, Homo sapiens
ugaaaaaaugugccauu

SEQ ID NO: 1069384 - RNA, 16 nt, Homo sapiens
ugaaaaccucuccuca

SEQ ID NO: 1069385 - RNA, 13 nt, Homo sapiens
ugaaacccaguca

SEQ ID NO: 1069386 - RNA, 20 nt, Homo sapiens
ugaaacccagucacugugag

SEQ ID NO: 1069387 - RNA, 23 nt, Homo sapiens
ugaaaguucagauuguguuacuc

SEQ ID NO: 1069388 - RNA, 19 nt, Homo sapiens
ugaaauggguuuagggaag

SEQ ID NO: 1069389 - RNA, 19 nt, Homo sapiens
ugaacuguaccaugugcua

SEQ ID NO: 1069390 - RNA, 20 nt, Homo sapiens
ugaagacuuuuaaguuuccu

SEQ ID NO: 1069391 - RNA, 19 nt, Homo sapiens
ugaagaguccucugaauga

SEQ ID NO: 1069392 - RNA, 15 nt, Homo sapiens
ugaagcaaacacauu

SEQ ID NO: 1069393 - RNA, 23 nt, Homo sapiens
ugaagucaguuucuaucauucug

SEQ ID NO: 1069394 - RNA, 16 nt, Homo sapiens
ugaauaaagugcugcg

SEQ ID NO: 1069395 - RNA, 17 nt, Homo sapiens
ugaauaaagugcugcgg

SEQ ID NO: 1069396 - RNA, 20 nt, Homo sapiens
ugaauccuuaaaggugagcc

SEQ ID NO: 1069397 - RNA, 17 nt, Homo sapiens
ugaaucucugaauuuga

SEQ ID NO: 1069398 - RNA, 14 nt, Homo sapiens
ugacaugugcuuug

SEQ ID NO: 1069399 - RNA, 22 nt, Homo sapiens
ugaccuugaugagcugugcaca

SEQ ID NO: 1069400 - RNA, 21 nt, Homo sapiens
ugacucacaccugaacugaac

SEQ ID NO: 1069401 - RNA, 23 nt, Homo sapiens
ugacugagaauauaauacuguau

SEQ ID NO: 1069402 - RNA, 19 nt, Homo sapiens
ugacuugacagaacacugu

SEQ ID NO: 1069403 - RNA, 18 nt, Homo sapiens
ugagaauauaauacugua

SEQ ID NO: 1069404 - RNA, 23 nt, Homo sapiens
ugagaauauaauacuguauuuga

SEQ ID NO: 1069405 - RNA, 13 nt, Homo sapiens
ugagacuacaggu

SEQ ID NO: 1069406 - RNA, 13 nt, Homo sapiens
ugagacuccucag

SEQ ID NO: 1069407 - RNA, 13 nt, Homo sapiens
ugagccaguguca

SEQ ID NO: 1069408 - RNA, 15 nt, Homo sapiens
ugagcucccaggugc

SEQ ID NO: 1069409 - RNA, 13 nt, Homo sapiens
ugagcugugcaca

SEQ ID NO: 1069410 - RNA, 15 nt, Homo sapiens
ugaggaaacaacagc

SEQ ID NO: 1069411 - RNA, 15 nt, Homo sapiens
ugaggucacagucca

SEQ ID NO: 1069412 - RNA, 15 nt, Homo sapiens
ugaguaaucugagaa

SEQ ID NO: 1069413 - RNA, 18 nt, Homo sapiens
ugaucaaaggcacacagc

SEQ ID NO: 1069414 - RNA, 15 nt, Homo sapiens
ugaucaggaccucca

SEQ ID NO: 1069415 - RNA, 23 nt, Homo sapiens
ugaucaggaccuccaagccacug

SEQ ID NO: 1069416 - RNA, 18 nt, Homo sapiens
ugaucaguaugaaaaugu

SEQ ID NO: 1069417 - RNA, 13 nt, Homo sapiens
ugaucugcaagaa

SEQ ID NO: 1069418 - RNA, 16 nt, Homo sapiens
ugaucuucaacaaauu

SEQ ID NO: 1069419 - RNA, 23 nt, Homo sapiens
ugauggacaaacaccaaucucuc

SEQ ID NO: 1069420 - RNA, 20 nt, Homo sapiens
ugauggcucauuuacacuca

SEQ ID NO: 1069421 - RNA, 10 nt, Homo sapiens
ugauguggac

SEQ ID NO: 1069422 - RNA, 14 nt, Homo sapiens
ugcaacaacaugua

SEQ ID NO: 1069423 - RNA, 20 nt, Homo sapiens
ugcaaugacucaggacaucc

SEQ ID NO: 1069424 - RNA, 16 nt, Homo sapiens
ugcacuccagccuggg

SEQ ID NO: 1069425 - RNA, 18 nt, Homo sapiens
ugcagaaaauugccuaaa

SEQ ID NO: 1069426 - RNA, 20 nt, Homo sapiens
ugcagaagcagaagugcaau

SEQ ID NO: 1069427 - RNA, 12 nt, Homo sapiens
ugcagagucaau

SEQ ID NO: 1069428 - RNA, 16 nt, Homo sapiens
ugcauauuuuauuaua

SEQ ID NO: 1069429 - RNA, 20 nt, Homo sapiens
ugcauauuuuauuauaguca

SEQ ID NO: 1069430 - RNA, 18 nt, Homo sapiens
ugcauauuuuguaacuuc

SEQ ID NO: 1069431 - RNA, 10 nt, Homo sapiens
ugccaaaaaa

SEQ ID NO: 1069432 - RNA, 14 nt, Homo sapiens
ugccagggccaguc

SEQ ID NO: 1069433 - RNA, 21 nt, Homo sapiens
ugcccaaccuauccuguucuu

SEQ ID NO: 1069434 - RNA, 16 nt, Homo sapiens
ugcccagcacaggaau

SEQ ID NO: 1069435 - RNA, 20 nt, Homo sapiens
ugcccagcggacaguggcag

SEQ ID NO: 1069436 - RNA, 14 nt, Homo sapiens
ugccccagccugcu

SEQ ID NO: 1069437 - RNA, 15 nt, Homo sapiens
ugcccucagauuccg

SEQ ID NO: 1069438 - RNA, 17 nt, Homo sapiens
ugcccuuaaacauugga

SEQ ID NO: 1069439 - RNA, 20 nt, Homo sapiens
ugcccuuaaacauuggacag

SEQ ID NO: 1069440 - RNA, 23 nt, Homo sapiens
ugccuggccuggggaccaggugc

SEQ ID NO: 1069441 - RNA, 13 nt, Homo sapiens
ugcgaagacagag

SEQ ID NO: 1069442 - RNA, 17 nt, Homo sapiens
ugcgcccaguccuucca

SEQ ID NO: 1069443 - RNA, 18 nt, Homo sapiens
ugcgcccaguccuuccac

SEQ ID NO: 1069444 - RNA, 12 nt, Homo sapiens
ugcucacagucc

SEQ ID NO: 1069445 - RNA, 16 nt, Homo sapiens
ugcucagggaaaagca

SEQ ID NO: 1069446 - RNA, 15 nt, Homo sapiens
ugcuccccucugcac

SEQ ID NO: 1069447 - RNA, 18 nt, Homo sapiens
ugcugaugaaauggguuu

SEQ ID NO: 1069448 - RNA, 21 nt, Homo sapiens
ugcugcacccacuuaaucuac

SEQ ID NO: 1069449 - RNA, 19 nt, Homo sapiens
ugcuguagauucacauaca

SEQ ID NO: 1069450 - RNA, 15 nt, Homo sapiens
ugcuuaacauugaca

SEQ ID NO: 1069451 - RNA, 14 nt, Homo sapiens
ugcuuauacaagac

SEQ ID NO: 1069452 - RNA, 22 nt, Homo sapiens
ugcuucuucuacuucagucuuc

SEQ ID NO: 1069453 - RNA, 19 nt, Homo sapiens
uggaaaaauucauugucuc

SEQ ID NO: 1069454 - RNA, 21 nt, Homo sapiens
uggaaagacagcuucucaucc

SEQ ID NO: 1069455 - RNA, 22 nt, Homo sapiens
uggacagugaggucacagucca

SEQ ID NO: 1069456 - RNA, 23 nt, Homo sapiens
uggcagaugcaguagacugcagu

SEQ ID NO: 1069457 - RNA, 23 nt, Homo sapiens
uggcagcucagcuuccccaacac

SEQ ID NO: 1069458 - RNA, 12 nt, Homo sapiens
uggcccagguga

SEQ ID NO: 1069459 - RNA, 16 nt, Homo sapiens
uggccggauguccuca

SEQ ID NO: 1069460 - RNA, 16 nt, Homo sapiens
uggcucacgccuguaa

SEQ ID NO: 1069461 - RNA, 17 nt, Homo sapiens
uggcugauggaguaaau

SEQ ID NO: 1069462 - RNA, 14 nt, Homo sapiens
uggcuucacuccug

SEQ ID NO: 1069463 - RNA, 16 nt, Homo sapiens
ugggaaagauuacuuu

SEQ ID NO: 1069464 - RNA, 17 nt, Homo sapiens
ugggaaugagaaugaau

SEQ ID NO: 1069465 - RNA, 18 nt, Homo sapiens
ugggcaauauagcaagau

SEQ ID NO: 1069466 - RNA, 17 nt, Homo sapiens
ugggccaaaaucaugcc

SEQ ID NO: 1069467 - RNA, 21 nt, Homo sapiens
uggggaaaagugaauuucaca

SEQ ID NO: 1069468 - RNA, 15 nt, Homo sapiens
ugguacucaagcccg

SEQ ID NO: 1069469 - RNA, 21 nt, Homo sapiens
ugguacuccaauucagaauga

SEQ ID NO: 1069470 - RNA, 15 nt, Homo sapiens
ugguauuuuuuacug

SEQ ID NO: 1069471 - RNA, 17 nt, Homo sapiens
uggucccaagacaugaa

SEQ ID NO: 1069472 - RNA, 17 nt, Homo sapiens
uggugaaaugcagaguc

SEQ ID NO: 1069473 - RNA, 17 nt, Homo sapiens
uggugaauaauuggaag

SEQ ID NO: 1069474 - RNA, 17 nt, Homo sapiens
ugguguugacaugugcu

SEQ ID NO: 1069475 - RNA, 13 nt, Homo sapiens
ugguuaacgccuu

SEQ ID NO: 1069476 - RNA, 17 nt, Homo sapiens
ugguuuuaauacuugau

SEQ ID NO: 1069477 - RNA, 17 nt, Homo sapiens
uguaaucccagcuacuc

SEQ ID NO: 1069478 - RNA, 20 nt, Homo sapiens
uguaaucccagcuacucgag

SEQ ID NO: 1069479 - RNA, 20 nt, Homo sapiens
uguaccaugugcuacagggg

SEQ ID NO: 1069480 - RNA, 20 nt, Homo sapiens
uguaugauuacaucaaggcu

SEQ ID NO: 1069481 - RNA, 19 nt, Homo sapiens
ugucagaaacugaagcugu

SEQ ID NO: 1069482 - RNA, 19 nt, Homo sapiens
uguccccuaaaccaaaaac

SEQ ID NO: 1069483 - RNA, 12 nt, Homo sapiens
ugucucagggug

SEQ ID NO: 1069484 - RNA, 16 nt, Homo sapiens
ugucucuacuaaaaau

SEQ ID NO: 1069485 - RNA, 19 nt, Homo sapiens
ugucugaacggcugaauau

SEQ ID NO: 1069486 - RNA, 22 nt, Homo sapiens
ugugaaggccucgcaggaagac

SEQ ID NO: 1069487 - RNA, 17 nt, Homo sapiens
ugugaucccuaggucuu

SEQ ID NO: 1069488 - RNA, 19 nt, Homo sapiens
ugugauuauaaaaucauga

SEQ ID NO: 1069489 - RNA, 14 nt, Homo sapiens
ugugcccucagauu

SEQ ID NO: 1069490 - RNA, 15 nt, Homo sapiens
ugugcccuguucaaa

SEQ ID NO: 1069491 - RNA, 22 nt, Homo sapiens
ugugcugaguugguguugacau

SEQ ID NO: 1069492 - RNA, 15 nt, Homo sapiens
ugugggaaauccaca

SEQ ID NO: 1069493 - RNA, 14 nt, Homo sapiens
uguggguaccugua

SEQ ID NO: 1069494 - RNA, 14 nt, Homo sapiens
uguggugguuguga

SEQ ID NO: 1069495 - RNA, 11 nt, Homo sapiens
uguguauauau

SEQ ID NO: 1069496 - RNA, 16 nt, Homo sapiens
uguuagcccaagguua

SEQ ID NO: 1069497 - RNA, 18 nt, Homo sapiens
uguucccuuacuguuuca

SEQ ID NO: 1069498 - RNA, 14 nt, Homo sapiens
uguugacaugugcu

SEQ ID NO: 1069499 - RNA, 18 nt, Homo sapiens
uguugccuaagcuggucu

SEQ ID NO: 1069500 - RNA, 17 nt, Homo sapiens
uguuugacgggaaacaa

SEQ ID NO: 1069501 - RNA, 19 nt, Homo sapiens
guggagucauucucauuga

SEQ ID NO: 1069502 - RNA, 22 nt, Homo sapiens
guggcagaauggggugcaugaa

SEQ ID NO: 1069503 - RNA, 16 nt, Homo sapiens
guggcuauuaaaacuc

SEQ ID NO: 1069504 - RNA, 17 nt, Homo sapiens
guggucuccaccuguca

SEQ ID NO: 1069505 - RNA, 14 nt, Homo sapiens
guguacauucuucc

SEQ ID NO: 1069506 - RNA, 14 nt, Homo sapiens
guuaaaaaguucau

SEQ ID NO: 1069507 - RNA, 15 nt, Homo sapiens
guuacacagugugaa

SEQ ID NO: 1069508 - RNA, 20 nt, Homo sapiens
guucaaguuauagauucaau

SEQ ID NO: 1069509 - RNA, 19 nt, Homo sapiens
guucacucuucucagccac

SEQ ID NO: 1069510 - RNA, 18 nt, Homo sapiens
guucccuuacuguuucac

SEQ ID NO: 1069511 - RNA, 15 nt, Homo sapiens
guucgagaccagccu

SEQ ID NO: 1069512 - RNA, 16 nt, Homo sapiens
guucugcucauucuaa

SEQ ID NO: 1069513 - RNA, 20 nt, Homo sapiens
guuuaaacauaggaaagaag

SEQ ID NO: 1069514 - RNA, 19 nt, Homo sapiens
guuuaucgaccaguuugaa

SEQ ID NO: 1069515 - RNA, 18 nt, Homo sapiens
guuuccuuccagcccaga

SEQ ID NO: 1069516 - RNA, 16 nt, Homo sapiens
guuugaagacauugca

SEQ ID NO: 1069517 - RNA, 14 nt, Homo sapiens
guuuuacaaagggg

SEQ ID NO: 1069518 - RNA, 22 nt, Homo sapiens
guuuucaguagaagaacuuaaa

SEQ ID NO: 1069519 - RNA, 18 nt, Homo sapiens
guuuuuaugcauguuugu

SEQ ID NO: 1069520 - RNA, 15 nt, Homo sapiens
uaaaaaaaaaauuca

SEQ ID NO: 1069521 - RNA, 14 nt, Homo sapiens
uaaaaagcagagcu

SEQ ID NO: 1069522 - RNA, 19 nt, Homo sapiens
uaaaaagugugcuuaacau

SEQ ID NO: 1069523 - RNA, 13 nt, Homo sapiens
uaaaaaguucaua

SEQ ID NO: 1069524 - RNA, 21 nt, Homo sapiens
uaaaacagguagaauuaucua

SEQ ID NO: 1069525 - RNA, 23 nt, Homo sapiens
uaaaagcacacucauccccucac

SEQ ID NO: 1069526 - RNA, 21 nt, Homo sapiens
uaaaaucauaaauauaaucua

SEQ ID NO: 1069527 - RNA, 19 nt, Homo sapiens
uaaaccaaaaacugaaagu

SEQ ID NO: 1069528 - RNA, 23 nt, Homo sapiens
uaaagaaggugauaaaugucagu

SEQ ID NO: 1069529 - RNA, 17 nt, Homo sapiens
uaaagaaguaugggaaa

SEQ ID NO: 1069530 - RNA, 17 nt, Homo sapiens
uaaagcuacaaucuguu

SEQ ID NO: 1069531 - RNA, 15 nt, Homo sapiens
uaaagcuuugugcag

SEQ ID NO: 1069532 - RNA, 17 nt, Homo sapiens
uaaagguccuggcaaag

SEQ ID NO: 1069533 - RNA, 17 nt, Homo sapiens
uaaaggugagcccucau

SEQ ID NO: 1069534 - RNA, 14 nt, Homo sapiens
uaaaguaugugcau

SEQ ID NO: 1069535 - RNA, 15 nt, Homo sapiens
uaaaguaugugcaua

SEQ ID NO: 1069536 - RNA, 16 nt, Homo sapiens
uaaaguaugugcauau

SEQ ID NO: 1069537 - RNA, 22 nt, Homo sapiens
uaaaguauuuuauucuuauuca

SEQ ID NO: 1069538 - RNA, 17 nt, Homo sapiens
uaaaucugcucaggaga

SEQ ID NO: 1069539 - RNA, 21 nt, Homo sapiens
uaaauucacagcgcuaugcaa

SEQ ID NO: 1069540 - RNA, 20 nt, Homo sapiens
uaaauuuggcuucuguuguc

SEQ ID NO: 1069541 - RNA, 21 nt, Homo sapiens
uaacaauguauuuucuucacc

SEQ ID NO: 1069542 - RNA, 22 nt, Homo sapiens
uaaccugccaacauacuuuaag

SEQ ID NO: 1069543 - RNA, 11 nt, Homo sapiens
uaacuauucaa

SEQ ID NO: 1069544 - RNA, 15 nt, Homo sapiens
uaacuggggauauaa

SEQ ID NO: 1069545 - RNA, 17 nt, Homo sapiens
uaacugggugugguggc

SEQ ID NO: 1069546 - RNA, 13 nt, Homo sapiens
uccaacuuaacau

SEQ ID NO: 1069547 - RNA, 17 nt, Homo sapiens
uccagagggaauugcag

SEQ ID NO: 1069548 - RNA, 10 nt, Homo sapiens
uccagccaca

SEQ ID NO: 1069549 - RNA, 20 nt, Homo sapiens
uccagcuugggcaacagggc

SEQ ID NO: 1069550 - RNA, 14 nt, Homo sapiens
uccauccucacugc

SEQ ID NO: 1069551 - RNA, 14 nt, Homo sapiens
ucccacagcacuaa

SEQ ID NO: 1069552 - RNA, 15 nt, Homo sapiens
ucccaggcucaagcu

SEQ ID NO: 1069553 - RNA, 15 nt, Homo sapiens
ucccaugugauuuaa

SEQ ID NO: 1069554 - RNA, 15 nt, Homo sapiens
uccccuaaaccaaaa

SEQ ID NO: 1069555 - RNA, 17 nt, Homo sapiens
ucccugcuuaaugaaaa

SEQ ID NO: 1069556 - RNA, 17 nt, Homo sapiens
ucccuuuacagcaccac

SEQ ID NO: 1069557 - RNA, 13 nt, Homo sapiens
uccgggaucaaag

SEQ ID NO: 1069558 - RNA, 16 nt, Homo sapiens
uccuacugauguuccu

SEQ ID NO: 1069559 - RNA, 20 nt, Homo sapiens
uccucaccccagacuccuga

SEQ ID NO: 1069560 - RNA, 21 nt, Homo sapiens
uccucauuuacuggauuugac

SEQ ID NO: 1069561 - RNA, 15 nt, Homo sapiens
uccucccaccucagc

SEQ ID NO: 1069562 - RNA, 23 nt, Homo sapiens
uccugagggagcuccaacucaga

SEQ ID NO: 1069563 - RNA, 18 nt, Homo sapiens
uccugcccagcacaggaa

SEQ ID NO: 1069564 - RNA, 16 nt, Homo sapiens
uccuuggcuuuuacug

SEQ ID NO: 1069565 - RNA, 18 nt, Homo sapiens
uccuuuuauuucuucacc

SEQ ID NO: 1069566 - RNA, 20 nt, Homo sapiens
ucgaaagcuguuaaauucuc

SEQ ID NO: 1069567 - RNA, 20 nt, Homo sapiens
ucgguggucuccaccuguca

SEQ ID NO: 1069568 - RNA, 20 nt, Homo sapiens
ucuaaaaugaguuaccuaca

SEQ ID NO: 1069569 - RNA, 13 nt, Homo sapiens
ucuacacauacau

SEQ ID NO: 1069570 - RNA, 19 nt, Homo sapiens
ucuacacauacauguaaaa

SEQ ID NO: 1069571 - RNA, 15 nt, Homo sapiens
ucuacucuuacuucc

SEQ ID NO: 1069572 - RNA, 16 nt, Homo sapiens
ucuauaaaauacuggu

SEQ ID NO: 1069573 - RNA, 14 nt, Homo sapiens
ucucaucacuuuuc

SEQ ID NO: 1069574 - RNA, 13 nt, Homo sapiens
ucucccugacccu

SEQ ID NO: 1069575 - RNA, 11 nt, Homo sapiens
ucucuccucac

SEQ ID NO: 1069576 - RNA, 19 nt, Homo sapiens
ucugaaaauuaacacugcu

SEQ ID NO: 1069577 - RNA, 18 nt, Homo sapiens
ucugaaccccucccucca

SEQ ID NO: 1069578 - RNA, 13 nt, Homo sapiens
ucugaauugacug

SEQ ID NO: 1069579 - RNA, 15 nt, Homo sapiens
ucugaauugacugua

SEQ ID NO: 1069580 - RNA, 15 nt, Homo sapiens
ucugaucugugaauu

SEQ ID NO: 1069581 - RNA, 22 nt, Homo sapiens
ucugccugauaggacccauauu

SEQ ID NO: 1069582 - RNA, 23 nt, Homo sapiens
ucuggcuagauuaccuagcuuag

SEQ ID NO: 1069583 - RNA, 13 nt, Homo sapiens
ucugggaagccaa

SEQ ID NO: 1069584 - RNA, 19 nt, Homo sapiens
ucugggaguggggaaguga

SEQ ID NO: 1069585 - RNA, 16 nt, Homo sapiens
ucuguaaggacgccuu

SEQ ID NO: 1069586 - RNA, 17 nt, Homo sapiens
ucuguaauacauaucau

SEQ ID NO: 1069587 - RNA, 17 nt, Homo sapiens
ucuguaucaguggauuu

SEQ ID NO: 1069588 - RNA, 20 nt, Homo sapiens
ucuucccauucuccauuugu

SEQ ID NO: 1069589 - RNA, 22 nt, Homo sapiens
ucuugcauauuuuguaacuucc

SEQ ID NO: 1069590 - RNA, 20 nt, Homo sapiens
ucuuggccggauguccucag

SEQ ID NO: 1069591 - RNA, 17 nt, Homo sapiens
ucuuugguuugugcuag

SEQ ID NO: 1069592 - RNA, 16 nt, Homo sapiens
ucuuuugaacccagga

SEQ ID NO: 1069593 - RNA, 14 nt, Homo sapiens
ugaaaagguggugu

SEQ ID NO: 1069594 - RNA, 17 nt, Homo sapiens
ugaaagaaucagucuug

SEQ ID NO: 1069595 - RNA, 21 nt, Homo sapiens
ugaaauauacacacagcagua

SEQ ID NO: 1069596 - RNA, 21 nt, Homo sapiens
ugaaaugcagagucaaugaac

SEQ ID NO: 1069597 - RNA, 21 nt, Homo sapiens
ugaacuguaccaugugcuaca

SEQ ID NO: 1069598 - RNA, 21 nt, Homo sapiens
ugaagcucuugaagacacuga

SEQ ID NO: 1069599 - RNA, 15 nt, Homo sapiens
ugaagcuuccuuggc

SEQ ID NO: 1069600 - RNA, 17 nt, Homo sapiens
ugaaguaccaccaaaaa

SEQ ID NO: 1069601 - RNA, 17 nt, Homo sapiens
ugaaguggugagcuuaa

SEQ ID NO: 1069602 - RNA, 15 nt, Homo sapiens
ugaauaucaguuauu

SEQ ID NO: 1069603 - RNA, 22 nt, Homo sapiens
ugaaucccucuaucucuaaaga

SEQ ID NO: 1069604 - RNA, 23 nt, Homo sapiens
ugaaucccucuaucucuaaagaa

SEQ ID NO: 1069605 - RNA, 17 nt, Homo sapiens
ugaauuauaaaagccag

SEQ ID NO: 1069606 - RNA, 15 nt, Homo sapiens
ugacagaacacuguc

SEQ ID NO: 1069607 - RNA, 15 nt, Homo sapiens
ugacaugcacucagc

SEQ ID NO: 1069608 - RNA, 18 nt, Homo sapiens
ugacauucaggcaauguc

SEQ ID NO: 1069609 - RNA, 20 nt, Homo sapiens
ugacauucaggcaaugucua

SEQ ID NO: 1069610 - RNA, 10 nt, Homo sapiens
ugacccugua

SEQ ID NO: 1069611 - RNA, 19 nt, Homo sapiens
ugaccugguccacagggca

SEQ ID NO: 1069612 - RNA, 20 nt, Homo sapiens
ugaccuugagaagauucuuc

SEQ ID NO: 1069613 - RNA, 14 nt, Homo sapiens
ugacuaauucuugc

SEQ ID NO: 1069614 - RNA, 15 nt, Homo sapiens
ugacuaauucuugca

SEQ ID NO: 1069615 - RNA, 15 nt, Homo sapiens
ugacucaagauuccc

SEQ ID NO: 1069616 - RNA, 15 nt, Homo sapiens
ugacucaggacaucc

SEQ ID NO: 1069617 - RNA, 16 nt, Homo sapiens
uucugggacuacaggc

SEQ ID NO: 1069618 - RNA, 21 nt, Homo sapiens
uucuuaaacaaauguaugauu

SEQ ID NO: 1069619 - RNA, 16 nt, Homo sapiens
uucuucuuagcaccac

SEQ ID NO: 1069620 - RNA, 17 nt, Homo sapiens
uucuuuuuggacauuua

SEQ ID NO: 1069621 - RNA, 15 nt, Homo sapiens
uugacucuacugauc

SEQ ID NO: 1069622 - RNA, 19 nt, Homo sapiens
uugagguggacucucacca

SEQ ID NO: 1069623 - RNA, 16 nt, Homo sapiens
uugauaccaccuauau

SEQ ID NO: 1069624 - RNA, 20 nt, Homo sapiens
uugauugcguggaauugugc

SEQ ID NO: 1069625 - RNA, 20 nt, Homo sapiens
uugcauaauaaaugcuucag

SEQ ID NO: 1069626 - RNA, 21 nt, Homo sapiens
uuggaagaaagaauuucaaaa

SEQ ID NO: 1069627 - RNA, 13 nt, Homo sapiens
uuggcacccaaga

SEQ ID NO: 1069628 - RNA, 14 nt, Homo sapiens
uuggcuuuuacuga

SEQ ID NO: 1069629 - RNA, 20 nt, Homo sapiens
uugggauccuauugaaccau

SEQ ID NO: 1069630 - RNA, 15 nt, Homo sapiens
uugguaaauggcaaa

SEQ ID NO: 1069631 - RNA, 14 nt, Homo sapiens
uuggugcuuuccag

SEQ ID NO: 1069632 - RNA, 17 nt, Homo sapiens
uugguuuuaauacuuga

SEQ ID NO: 1069633 - RNA, 20 nt, Homo sapiens
uuguaaauaaagcccuggga

SEQ ID NO: 1069634 - RNA, 13 nt, Homo sapiens
uuguucuugugaa

SEQ ID NO: 1069635 - RNA, 23 nt, Homo sapiens
uuuaaagcuacaaucuguucaau

SEQ ID NO: 1069636 - RNA, 22 nt, Homo sapiens
uuuacggacacccccucgcuug

SEQ ID NO: 1069637 - RNA, 11 nt, Homo sapiens
uuuagccuuua

SEQ ID NO: 1069638 - RNA, 23 nt, Homo sapiens
uuuauguguuugacgggaaacaa

SEQ ID NO: 1069639 - RNA, 20 nt, Homo sapiens
uuucaauuucuagaggaacu

SEQ ID NO: 1069640 - RNA, 13 nt, Homo sapiens
uuucacucuuuag

SEQ ID NO: 1069641 - RNA, 16 nt, Homo sapiens
uuucauauuugcacua

SEQ ID NO: 1069642 - RNA, 18 nt, Homo sapiens
uuucauccaggccugcca

SEQ ID NO: 1069643 - RNA, 18 nt, Homo sapiens
uuuccaggcugcauuugu

SEQ ID NO: 1069644 - RNA, 12 nt, Homo sapiens
uuucuaucauuc

SEQ ID NO: 1069645 - RNA, 15 nt, Homo sapiens
uuucucuugugcaau

SEQ ID NO: 1069646 - RNA, 12 nt, Homo sapiens
uuucugacacag

SEQ ID NO: 1069647 - RNA, 23 nt, Homo sapiens
uuucugacacagucaauucugau

SEQ ID NO: 1069648 - RNA, 22 nt, Homo sapiens
uuucugucacaucagcuccacu

SEQ ID NO: 1069649 - RNA, 18 nt, Homo sapiens
uuuguaacuuccauguga

SEQ ID NO: 1069650 - RNA, 14 nt, Homo sapiens
uuuguggaaaagaa

SEQ ID NO: 1069651 - RNA, 17 nt, Homo sapiens
uuuuaaaaagugugcuu

SEQ ID NO: 1069652 - RNA, 20 nt, Homo sapiens
uuuuaaccugccaacauacu

SEQ ID NO: 1069653 - RNA, 18 nt, Homo sapiens
uuuuaaguuuccuuccag

SEQ ID NO: 1069654 - RNA, 17 nt, Homo sapiens
uuuuacccacacacaga

SEQ ID NO: 1069655 - RNA, 21 nt, Homo sapiens
uuuugcauuuucaucuacuca

SEQ ID NO: 1069656 - RNA, 15 nt, Homo sapiens
uuuuggagguauuca

SEQ ID NO: 1069657 - RNA, 16 nt, Homo sapiens
cuucuagaauauguaa

SEQ ID NO: 1069658 - RNA, 17 nt, Homo sapiens
cuucuauaauuguauau

SEQ ID NO: 1069659 - RNA, 16 nt, Homo sapiens
cuucucuuccuuggga

SEQ ID NO: 1069660 - RNA, 22 nt, Homo sapiens
cuucuggccucccacagacuca

SEQ ID NO: 1069661 - RNA, 14 nt, Homo sapiens
cuucuucuuagcac

SEQ ID NO: 1069662 - RNA, 14 nt, Homo sapiens
cuugaaucaggacu

SEQ ID NO: 1069663 - RNA, 19 nt, Homo sapiens
cuugagucuccaacggcaa

SEQ ID NO: 1069664 - RNA, 14 nt, Homo sapiens
cuugccugcaggca

SEQ ID NO: 1069665 - RNA, 20 nt, Homo sapiens
cuuggcacccaagaccucag

SEQ ID NO: 1069666 - RNA, 15 nt, Homo sapiens
cuuggcugugcccuc

SEQ ID NO: 1069667 - RNA, 16 nt, Homo sapiens
cuuggguucacagugc

SEQ ID NO: 1069668 - RNA, 14 nt, Homo sapiens
cuuuaauggguaaa

SEQ ID NO: 1069669 - RNA, 20 nt, Homo sapiens
cuuuacaaauagaauuugag

SEQ ID NO: 1069670 - RNA, 14 nt, Homo sapiens
cuuucauaaucuuu

SEQ ID NO: 1069671 - RNA, 14 nt, Homo sapiens
cuuuccacauucag

SEQ ID NO: 1069672 - RNA, 21 nt, Homo sapiens
cuuuccgaggccccugucuca

SEQ ID NO: 1069673 - RNA, 14 nt, Homo sapiens
cuuucuuguuucau

SEQ ID NO: 1069674 - RNA, 19 nt, Homo sapiens
cuuuguuuuuuaauguugu

SEQ ID NO: 1069675 - RNA, 15 nt, Homo sapiens
cuuuugaacccagga

SEQ ID NO: 1069676 - RNA, 14 nt, Homo sapiens
cuuuugcauucucc

SEQ ID NO: 1069677 - RNA, 18 nt, Homo sapiens
cuuuuguucccauccucu

SEQ ID NO: 1069678 - RNA, 21 nt, Homo sapiens
cuuuuucauccaggccugcca

SEQ ID NO: 1069679 - RNA, 18 nt, Homo sapiens
cuuuuuuuuuuaaucucc

SEQ ID NO: 1069680 - RNA, 17 nt, Homo sapiens
gaaaaucaucaagaagg

SEQ ID NO: 1069681 - RNA, 23 nt, Homo sapiens
gaaaaucaucaagaagggcugca

SEQ ID NO: 1069682 - RNA, 15 nt, Homo sapiens
gaaaaucucugugaa

SEQ ID NO: 1069683 - RNA, 16 nt, Homo sapiens
gaaaaucucugugaaa

SEQ ID NO: 1069684 - RNA, 15 nt, Homo sapiens
gaaaauggaaccagg

SEQ ID NO: 1069685 - RNA, 15 nt, Homo sapiens
gaaaauuaacacugc

SEQ ID NO: 1069686 - RNA, 23 nt, Homo sapiens
gaaaauuaguaugguaauuaaau

SEQ ID NO: 1069687 - RNA, 13 nt, Homo sapiens
gaaacaacagcuu

SEQ ID NO: 1069688 - RNA, 18 nt, Homo sapiens
gaaacccucacucucuac

SEQ ID NO: 1069689 - RNA, 17 nt, Homo sapiens
gaaacugaaacuacugc

SEQ ID NO: 1069690 - RNA, 18 nt, Homo sapiens
gaaacuggaugaggucau

SEQ ID NO: 1069691 - RNA, 16 nt, Homo sapiens
gaaacuguucccaccu

SEQ ID NO: 1069692 - RNA, 17 nt, Homo sapiens
gaaacuuuacaaccuga

SEQ ID NO: 1069693 - RNA, 15 nt, Homo sapiens
gaaagaaucagucuu

SEQ ID NO: 1069694 - RNA, 12 nt, Homo sapiens
gaaagauuacuu

SEQ ID NO: 1069695 - RNA, 18 nt, Homo sapiens
gaaagcaucacuugggau

SEQ ID NO: 1069696 - RNA, 22 nt, Homo sapiens
gaaauuaguaggcucauuuacu

SEQ ID NO: 1069697 - RNA, 20 nt, Homo sapiens
gaaauuauauuuuagccuuu

SEQ ID NO: 1069698 - RNA, 15 nt, Homo sapiens
gaacaauauugacuu

SEQ ID NO: 1069699 - RNA, 19 nt, Homo sapiens
gaacaauauugacuuuguc

SEQ ID NO: 1069700 - RNA, 13 nt, Homo sapiens
gaacagacaauca

SEQ ID NO: 1069701 - RNA, 15 nt, Homo sapiens
gaacauaaagcaaau

SEQ ID NO: 1069702 - RNA, 18 nt, Homo sapiens
gaaccaugaaaaugggga

SEQ ID NO: 1069703 - RNA, 21 nt, Homo sapiens
gaaccuucuggccucccacag

SEQ ID NO: 1069704 - RNA, 12 nt, Homo sapiens
gaacucugagca

SEQ ID NO: 1069705 - RNA, 13 nt, Homo sapiens
gaacucugagcag

SEQ ID NO: 1069706 - RNA, 13 nt, Homo sapiens
gaacuggagccau

SEQ ID NO: 1069707 - RNA, 15 nt, Homo sapiens
gaagaaauucuguca

SEQ ID NO: 1069708 - RNA, 23 nt, Homo sapiens
gaagacaauggcuuacuccagga

SEQ ID NO: 1069709 - RNA, 23 nt, Homo sapiens
gaagacaucuuauccauccucac

SEQ ID NO: 1069710 - RNA, 18 nt, Homo sapiens
gaagacauugcaccagau

SEQ ID NO: 1069711 - RNA, 16 nt, Homo sapiens
gaagagaaaucugaua

SEQ ID NO: 1069712 - RNA, 22 nt, Homo sapiens
gaagaggggcauaaacuuuccu

SEQ ID NO: 1069713 - RNA, 21 nt, Homo sapiens
gaagaugauggcucauuuaca

SEQ ID NO: 1069714 - RNA, 18 nt, Homo sapiens
gaagcagaagugcaaucc

SEQ ID NO: 1069715 - RNA, 16 nt, Homo sapiens
gaagcuuccuuggcuu

SEQ ID NO: 1069716 - RNA, 15 nt, Homo sapiens
gaaggagacaggcag

SEQ ID NO: 1069717 - RNA, 19 nt, Homo sapiens
gaagggaauuuauugccuc

SEQ ID NO: 1069718 - RNA, 18 nt, Homo sapiens
gaagggagcuagccagag

SEQ ID NO: 1069719 - RNA, 18 nt, Homo sapiens
gaagucucuaacaaugua

SEQ ID NO: 1069720 - RNA, 17 nt, Homo sapiens
gaauaaucuccuguuaa

SEQ ID NO: 1069721 - RNA, 17 nt, Homo sapiens
gaauacauaaaguaugu

SEQ ID NO: 1069722 - RNA, 16 nt, Homo sapiens
gaauaccugugguggu

SEQ ID NO: 1069723 - RNA, 16 nt, Homo sapiens
gaauauaauacuguau

SEQ ID NO: 1069724 - RNA, 19 nt, Homo sapiens
gaauauaauacuguauuug

SEQ ID NO: 1069725 - RNA, 21 nt, Homo sapiens
gaauauaauacuguauuugag

SEQ ID NO: 1069726 - RNA, 21 nt, Homo sapiens
gaaugaaccuucuggccuccc

SEQ ID NO: 1069727 - RNA, 22 nt, Homo sapiens
gaaugaagaacaacaacucuca

SEQ ID NO: 1069728 - RNA, 14 nt, Homo sapiens
gaacuggagccaug

SEQ ID NO: 1069729 - RNA, 13 nt, Homo sapiens
gaagaaaagaucu

SEQ ID NO: 1069730 - RNA, 19 nt, Homo sapiens
gaagacuauauuguacaca

SEQ ID NO: 1069731 - RNA, 21 nt, Homo sapiens
gaagaguggacaaacagggaa

SEQ ID NO: 1069732 - RNA, 23 nt, Homo sapiens
gaagaguguggagucauucucau

SEQ ID NO: 1069733 - RNA, 18 nt, Homo sapiens
gaaggaaucauauuccuu

SEQ ID NO: 1069734 - RNA, 19 nt, Homo sapiens
gaagggaguggcucuguaa

SEQ ID NO: 1069735 - RNA, 16 nt, Homo sapiens
gaagugagaaguucau

SEQ ID NO: 1069736 - RNA, 13 nt, Homo sapiens
gaaguuaugggaa

SEQ ID NO: 1069737 - RNA, 15 nt, Homo sapiens
gaauacauaaaguau

SEQ ID NO: 1069738 - RNA, 18 nt, Homo sapiens
gaaugcagucuguccagg

SEQ ID NO: 1069739 - RNA, 18 nt, Homo sapiens
gaauuauuuaaauuacag

SEQ ID NO: 1069740 - RNA, 16 nt, Homo sapiens
gacaagggaaauguca

SEQ ID NO: 1069741 - RNA, 17 nt, Homo sapiens
gacacagucaauucuga

SEQ ID NO: 1069742 - RNA, 11 nt, Homo sapiens
gacagcauuuu

SEQ ID NO: 1069743 - RNA, 15 nt, Homo sapiens
gacauugcaccagau

SEQ ID NO: 1069744 - RNA, 17 nt, Homo sapiens
gaccaugcgacacuggg

SEQ ID NO: 1069745 - RNA, 22 nt, Homo sapiens
gaccuccaagccacugagcaau

SEQ ID NO: 1069746 - RNA, 15 nt, Homo sapiens
gaccugacaccuuuc

SEQ ID NO: 1069747 - RNA, 17 nt, Homo sapiens
gaccugacaccuuucau

SEQ ID NO: 1069748 - RNA, 17 nt, Homo sapiens
gaccuucaacuuccaaa

SEQ ID NO: 1069749 - RNA, 13 nt, Homo sapiens
gaccuucuaggaa

SEQ ID NO: 1069750 - RNA, 22 nt, Homo sapiens
gaccuugagaagauucuuccca

SEQ ID NO: 1069751 - RNA, 17 nt, Homo sapiens
gaccuuuuaacuccuca

SEQ ID NO: 1069752 - RNA, 17 nt, Homo sapiens
gacgaagaagagccaca

SEQ ID NO: 1069753 - RNA, 12 nt, Homo sapiens
gacucacucugu

SEQ ID NO: 1069754 - RNA, 16 nt, Homo sapiens
gacucaggacaucccc

SEQ ID NO: 1069755 - RNA, 14 nt, Homo sapiens
gacugaagcaaaga

SEQ ID NO: 1069756 - RNA, 16 nt, Homo sapiens
gacuucagccagguga

SEQ ID NO: 1069757 - RNA, 16 nt, Homo sapiens
gacuuccuacuugguc

SEQ ID NO: 1069758 - RNA, 19 nt, Homo sapiens
gacuucucuuuugcacauc

SEQ ID NO: 1069759 - RNA, 18 nt, Homo sapiens
gacuugacagaacacugu

SEQ ID NO: 1069760 - RNA, 12 nt, Homo sapiens
gagaaacaauga

SEQ ID NO: 1069761 - RNA, 22 nt, Homo sapiens
gagaagauucuucccauucucc

SEQ ID NO: 1069762 - RNA, 22 nt, Homo sapiens
gagacagcuugaucaaaggcac

SEQ ID NO: 1069763 - RNA, 20 nt, Homo sapiens
gagacuccucaguucuugcc

SEQ ID NO: 1069764 - RNA, 21 nt, Homo sapiens
gagagauggucagaaauaucc

SEQ ID NO: 1069765 - RNA, 18 nt, Homo sapiens
gagauccaaaguccugug

SEQ ID NO: 1069766 - RNA, 19 nt, Homo sapiens
gagauuccugagccagugu

SEQ ID NO: 1069767 - RNA, 22 nt, Homo sapiens
gagcagaugcaaugacucagga

SEQ ID NO: 1069768 - RNA, 20 nt, Homo sapiens
gagcagugcuugaaugaagu

SEQ ID NO: 1069769 - RNA, 21 nt, Homo sapiens
gagcucccaggugcagccaga

SEQ ID NO: 1069770 - RNA, 23 nt, Homo sapiens
gccuggacuagagggaccucucc

SEQ ID NO: 1069771 - RNA, 20 nt, Homo sapiens
gccuggccaauacggcaaaa

SEQ ID NO: 1069772 - RNA, 13 nt, Homo sapiens
gccuucaaacucc

SEQ ID NO: 1069773 - RNA, 16 nt, Homo sapiens
gccuuuagaaauuaua

SEQ ID NO: 1069774 - RNA, 16 nt, Homo sapiens
gcgcgugccuguaauc

SEQ ID NO: 1069775 - RNA, 20 nt, Homo sapiens
gcggugacucaugccuguaa

SEQ ID NO: 1069776 - RNA, 16 nt, Homo sapiens
gcgucucugcuuuaaa

SEQ ID NO: 1069777 - RNA, 20 nt, Homo sapiens
gcuacaccuuucuccuuugu

SEQ ID NO: 1069778 - RNA, 19 nt, Homo sapiens
gcuacucaaguagcauuua

SEQ ID NO: 1069779 - RNA, 16 nt, Homo sapiens
gcucaacuagcagaua

SEQ ID NO: 1069780 - RNA, 14 nt, Homo sapiens
gcucagaccagcuc

SEQ ID NO: 1069781 - RNA, 19 nt, Homo sapiens
gcucauucuaaugauggcc

SEQ ID NO: 1069782 - RNA, 22 nt, Homo sapiens
gcuccacuuucagugaaagcau

SEQ ID NO: 1069783 - RNA, 12 nt, Homo sapiens
gcuccucacuca

SEQ ID NO: 1069784 - RNA, 21 nt, Homo sapiens
gcucuccccucagagugcaag

SEQ ID NO: 1069785 - RNA, 20 nt, Homo sapiens
gcucucuuuuucuccagggu

SEQ ID NO: 1069786 - RNA, 20 nt, Homo sapiens
gcugaggcauccuuccucac

SEQ ID NO: 1069787 - RNA, 18 nt, Homo sapiens
gcugaguugguguugaca

SEQ ID NO: 1069788 - RNA, 18 nt, Homo sapiens
gcugcaucccccccaccu

SEQ ID NO: 1069789 - RNA, 23 nt, Homo sapiens
gcugggcgcagcggcucacgccu

SEQ ID NO: 1069790 - RNA, 23 nt, Homo sapiens
gcuguauuuugaaaaugcuuuag

SEQ ID NO: 1069791 - RNA, 22 nt, Homo sapiens
gcugugggccaaaaucaugcca

SEQ ID NO: 1069792 - RNA, 20 nt, Homo sapiens
gcuuaggaaagaacaucacu

SEQ ID NO: 1069793 - RNA, 19 nt, Homo sapiens
gcuucaacauucuuugcaa

SEQ ID NO: 1069794 - RNA, 23 nt, Homo sapiens
gcuuggcugugcccucagauucc

SEQ ID NO: 1069795 - RNA, 21 nt, Homo sapiens
gcuuuugguggcuaccaugca

SEQ ID NO: 1069796 - RNA, 15 nt, Homo sapiens
ggaaaacaggacuua

SEQ ID NO: 1069797 - RNA, 14 nt, Homo sapiens
ggaaaacuacaggu

SEQ ID NO: 1069798 - RNA, 23 nt, Homo sapiens
ggaaaacuacagguguuguccaa

SEQ ID NO: 1069799 - RNA, 17 nt, Homo sapiens
ggaaaagaaacacgcac

SEQ ID NO: 1069800 - RNA, 23 nt, Homo sapiens
ggaaaauauuuugaucuucaaca

SEQ ID NO: 1069801 - RNA, 16 nt, Homo sapiens
ggaaagaaguucacau

SEQ ID NO: 1069802 - RNA, 18 nt, Homo sapiens
ggaaagacagcuucucau

SEQ ID NO: 1069803 - RNA, 14 nt, Homo sapiens
ggaaagauuacuuu

SEQ ID NO: 1069804 - RNA, 21 nt, Homo sapiens
ggaaguuuuguggaggagcuc

SEQ ID NO: 1069805 - RNA, 15 nt, Homo sapiens
ggacagugaggucac

SEQ ID NO: 1069806 - RNA, 12 nt, Homo sapiens
ggacaguggcag

SEQ ID NO: 1069807 - RNA, 22 nt, Homo sapiens
ggacaucagcuggucaaacaaa

SEQ ID NO: 1069808 - RNA, 20 nt, Homo sapiens
ggaccaugcgacacugggag

SEQ ID NO: 1069809 - RNA, 20 nt, Homo sapiens
ggacugggugcggugacuca

SEQ ID NO: 1069810 - RNA, 14 nt, Homo sapiens
ggagcuagccagag

SEQ ID NO: 1069811 - RNA, 14 nt, Homo sapiens
ggagggucagccag

SEQ ID NO: 1069812 - RNA, 16 nt, Homo sapiens
ggaggugaagguugcu

SEQ ID NO: 1069813 - RNA, 21 nt, Homo sapiens
aggauggcuugcgcucaggag

SEQ ID NO: 1069814 - RNA, 22 nt, Homo sapiens
aggcacacagcaagucaggguu

SEQ ID NO: 1069815 - RNA, 17 nt, Homo sapiens
aggcaccucaagaagaa

SEQ ID NO: 1069816 - RNA, 23 nt, Homo sapiens
aggcagcugguauauucagucuc

SEQ ID NO: 1069817 - RNA, 17 nt, Homo sapiens
aggcaggagaaucucuu

SEQ ID NO: 1069818 - RNA, 20 nt, Homo sapiens
aggcaggagaaucucuugaa

SEQ ID NO: 1069819 - RNA, 23 nt, Homo sapiens
aggcaggugaauuguuugaaccu

SEQ ID NO: 1069820 - RNA, 16 nt, Homo sapiens
aggcauccuuccucac

SEQ ID NO: 1069821 - RNA, 20 nt, Homo sapiens
aggcccccgggugugaagca

SEQ ID NO: 1069822 - RNA, 18 nt, Homo sapiens
aggcugggugcagucacg

SEQ ID NO: 1069823 - RNA, 23 nt, Homo sapiens
aggcuuggaaccguaggacccaa

SEQ ID NO: 1069824 - RNA, 16 nt, Homo sapiens
agggaagacauugcaa

SEQ ID NO: 1069825 - RNA, 15 nt, Homo sapiens
agggacugaaaaccu

SEQ ID NO: 1069826 - RNA, 16 nt, Homo sapiens
agggagcuagccagag

SEQ ID NO: 1069827 - RNA, 11 nt, Homo sapiens
agggcacaaag

SEQ ID NO: 1069828 - RNA, 13 nt, Homo sapiens
agggucauagcau

SEQ ID NO: 1069829 - RNA, 14 nt, Homo sapiens
agggugagugcaag

SEQ ID NO: 1069830 - RNA, 13 nt, Homo sapiens
aggguggucucaa

SEQ ID NO: 1069831 - RNA, 20 nt, Homo sapiens
agguaacuguacugggccau

SEQ ID NO: 1069832 - RNA, 23 nt, Homo sapiens
agguccuggcaaagaugaucagu

SEQ ID NO: 1069833 - RNA, 17 nt, Homo sapiens
aggucuugggagcucuu

SEQ ID NO: 1069834 - RNA, 13 nt, Homo sapiens
aggugcagccaga

SEQ ID NO: 1069835 - RNA, 14 nt, Homo sapiens
aguaugguaauuaa

SEQ ID NO: 1069836 - RNA, 12 nt, Homo sapiens
aguauugugcau

SEQ ID NO: 1069837 - RNA, 18 nt, Homo sapiens
agucacuaguuguaauuu

SEQ ID NO: 1069838 - RNA, 12 nt, Homo sapiens
agucacugugag

SEQ ID NO: 1069839 - RNA, 15 nt, Homo sapiens
agucauacugucacu

SEQ ID NO: 1069840 - RNA, 18 nt, Homo sapiens
aguccucauuuacuggau

SEQ ID NO: 1069841 - RNA, 15 nt, Homo sapiens
aguccuucccuuuca

SEQ ID NO: 1069842 - RNA, 21 nt, Homo sapiens
agucuauuugagacuccucag

SEQ ID NO: 1069843 - RNA, 13 nt, Homo sapiens
agucucauucugu

SEQ ID NO: 1069844 - RNA, 15 nt, Homo sapiens
agucucauucuguca

SEQ ID NO: 1069845 - RNA, 19 nt, Homo sapiens
agucuuccucccuguguau

SEQ ID NO: 1069846 - RNA, 22 nt, Homo sapiens
agugaaaaaucuguggaaugua

SEQ ID NO: 1069847 - RNA, 14 nt, Homo sapiens
agugcaacacugaa

SEQ ID NO: 1069848 - RNA, 19 nt, Homo sapiens
agugcaagccccugcucca

SEQ ID NO: 1069849 - RNA, 21 nt, Homo sapiens
agugcaagccccugcuccaga

SEQ ID NO: 1069850 - RNA, 23 nt, Homo sapiens
aguggcucacaccuguaauccca

SEQ ID NO: 1069851 - RNA, 20 nt, Homo sapiens
aguggcuuggguucacagug

SEQ ID NO: 1069852 - RNA, 16 nt, Homo sapiens
agugucaggaugguaa

SEQ ID NO: 1069853 - RNA, 15 nt, Homo sapiens
agugugacucauuaa

SEQ ID NO: 1069854 - RNA, 19 nt, Homo sapiens
aguguggagucauucucau

SEQ ID NO: 1069855 - RNA, 15 nt, Homo sapiens
aguuauaauucugug

SEQ ID NO: 1069856 - RNA, 18 nt, Homo sapiens
aguuaugggaauaccugu

SEQ ID NO: 1069857 - RNA, 21 nt, Homo sapiens
aguucacaucagaacagacaa

SEQ ID NO: 1069858 - RNA, 16 nt, Homo sapiens
aguuccuuucaauggu

SEQ ID NO: 1069859 - RNA, 15 nt, Homo sapiens
aguugacuugacaga

SEQ ID NO: 1069860 - RNA, 21 nt, Homo sapiens
aguuguaacuuugccuucaca

SEQ ID NO: 1069861 - RNA, 19 nt, Homo sapiens
aguuuagugcccucaucca

SEQ ID NO: 1069862 - RNA, 19 nt, Homo sapiens
aguuucaaccaugaagucu

SEQ ID NO: 1069863 - RNA, 20 nt, Homo sapiens
aguuuccuuccagcccagaa

SEQ ID NO: 1069864 - RNA, 18 nt, Homo sapiens
aguuucuaucauucugcu

SEQ ID NO: 1069865 - RNA, 15 nt, Homo sapiens
auaaaguaugugcau

SEQ ID NO: 1069866 - RNA, 19 nt, Homo sapiens
auaacacuggcuucaggca

SEQ ID NO: 1069867 - RNA, 17 nt, Homo sapiens
auaauagagcucagaca

SEQ ID NO: 1069868 - RNA, 22 nt, Homo sapiens
auaaucaaaacccaacaugacu

SEQ ID NO: 1069869 - RNA, 18 nt, Homo sapiens
auacaaaggcuugcuaag

SEQ ID NO: 1069870 - RNA, 14 nt, Homo sapiens
auacaaugaugcua

SEQ ID NO: 1069871 - RNA, 18 nt, Homo sapiens
auacauauauguauauau

SEQ ID NO: 1069872 - RNA, 22 nt, Homo sapiens
auaccauuaaauaaugcauaau

SEQ ID NO: 1069873 - RNA, 16 nt, Homo sapiens
auaccugggauacugu

SEQ ID NO: 1069874 - RNA, 20 nt, Homo sapiens
auacuauauuuauacuguau

SEQ ID NO: 1069875 - RNA, 11 nt, Homo sapiens
auacuuccuua

SEQ ID NO: 1069876 - RNA, 16 nt, Homo sapiens
auagacagaaugauuu

SEQ ID NO: 1069877 - RNA, 21 nt, Homo sapiens
auagauggauuuguaucaaua

SEQ ID NO: 1069878 - RNA, 15 nt, Homo sapiens
auagcgaauacaaaa

SEQ ID NO: 1069879 - RNA, 22 nt, Homo sapiens
auaguauugugcauagagccac

SEQ ID NO: 1069880 - RNA, 21 nt, Homo sapiens
auagucucauucugucaccca

SEQ ID NO: 1069881 - RNA, 15 nt, Homo sapiens
auauaauacugacug

SEQ ID NO: 1069882 - RNA, 13 nt, Homo sapiens
auauauaauacug

SEQ ID NO: 1069883 - RNA, 21 nt, Homo sapiens
auauauuggguuccauucuca

SEQ ID NO: 1069884 - RNA, 20 nt, Homo sapiens
auaugcaccaaaucaucucu

SEQ ID NO: 1069885 - RNA, 19 nt, Homo sapiens
auaugguguacauucuucc

SEQ ID NO: 1069886 - RNA, 17 nt, Homo sapiens
auauguauaggagcucu

SEQ ID NO: 1069887 - RNA, 18 nt, Homo sapiens
auauucuggagucaucau

SEQ ID NO: 1069888 - RNA, 14 nt, Homo sapiens
auauugcuguuuau

SEQ ID NO: 1069889 - RNA, 15 nt, Homo sapiens
auauuuauacuguau

SEQ ID NO: 1069890 - RNA, 19 nt, Homo sapiens
auauuuuauuauagucacu

SEQ ID NO: 1069891 - RNA, 19 nt, Homo sapiens
auauuuuuuaaaaaucuau

SEQ ID NO: 1069892 - RNA, 19 nt, Homo sapiens
aucaaaacccaacaugacu

SEQ ID NO: 1069893 - RNA, 16 nt, Homo sapiens
aucaaaggcacacagc

SEQ ID NO: 1069894 - RNA, 14 nt, Homo sapiens
acagaacacccaau

SEQ ID NO: 1069895 - RNA, 14 nt, Homo sapiens
acagaacacugucu

SEQ ID NO: 1069896 - RNA, 16 nt, Homo sapiens
acagaguccugcagag

SEQ ID NO: 1069897 - RNA, 10 nt, Homo sapiens
acagauuuga

SEQ ID NO: 1069898 - RNA, 16 nt, Homo sapiens
acaggagaaucucuug

SEQ ID NO: 1069899 - RNA, 16 nt, Homo sapiens
acagucaauucugauu

SEQ ID NO: 1069900 - RNA, 14 nt, Homo sapiens
acaguccacccacc

SEQ ID NO: 1069901 - RNA, 18 nt, Homo sapiens
acagugaaucagucccau

SEQ ID NO: 1069902 - RNA, 15 nt, Homo sapiens
acauagcgaauacaa

SEQ ID NO: 1069903 - RNA, 16 nt, Homo sapiens
acaucagaacagacaa

SEQ ID NO: 1069904 - RNA, 16 nt, Homo sapiens
acaucucugcuuucac

SEQ ID NO: 1069905 - RNA, 22 nt, Homo sapiens
acaucucugcuuucacucuuua

SEQ ID NO: 1069906 - RNA, 19 nt, Homo sapiens
acaugaagacaucuuaucc

SEQ ID NO: 1069907 - RNA, 11 nt, Homo sapiens
acaugacuguu

SEQ ID NO: 1069908 - RNA, 12 nt, Homo sapiens
acaugacuguuu

SEQ ID NO: 1069909 - RNA, 14 nt, Homo sapiens
acaugcacucagcu

SEQ ID NO: 1069910 - RNA, 10 nt, Homo sapiens
acaugugcuu

SEQ ID NO: 1069911 - RNA, 21 nt, Homo sapiens
acauuacuucaaacugagauc

SEQ ID NO: 1069912 - RNA, 15 nt, Homo sapiens
acauugacacaauaa

SEQ ID NO: 1069913 - RNA, 19 nt, Homo sapiens
acauugaugcugacaguca

SEQ ID NO: 1069914 - RNA, 17 nt, Homo sapiens
accaaaucaucucucau

SEQ ID NO: 1069915 - RNA, 17 nt, Homo sapiens
accaaggagaugaagca

SEQ ID NO: 1069916 - RNA, 21 nt, Homo sapiens
accaaugccaaaaaaagacag

SEQ ID NO: 1069917 - RNA, 22 nt, Homo sapiens
accaaugccaaaaaaagacagg

SEQ ID NO: 1069918 - RNA, 14 nt, Homo sapiens
accacuauucuuaa

SEQ ID NO: 1069919 - RNA, 20 nt, Homo sapiens
accacuauucuuaacuauuc

SEQ ID NO: 1069920 - RNA, 21 nt, Homo sapiens
accacuauucuuaacuauuca

SEQ ID NO: 1069921 - RNA, 19 nt, Homo sapiens
accagagaccaaaugucac

SEQ ID NO: 1069922 - RNA, 21 nt, Homo sapiens
accagaugccauuacauuuau

SEQ ID NO: 1069923 - RNA, 15 nt, Homo sapiens
accauugaacuguac

SEQ ID NO: 1069924 - RNA, 15 nt, Homo sapiens
acccaacacauggga

SEQ ID NO: 1069925 - RNA, 13 nt, Homo sapiens
acccacauuggaa

SEQ ID NO: 1069926 - RNA, 14 nt, Homo sapiens
acccaggaguggau

SEQ ID NO: 1069927 - RNA, 15 nt, Homo sapiens
acccagucacuguga

SEQ ID NO: 1069928 - RNA, 18 nt, Homo sapiens
accccauuucucuccuca

SEQ ID NO: 1069929 - RNA, 17 nt, Homo sapiens
guacaccacaaggguca

SEQ ID NO: 1069930 - RNA, 13 nt, Homo sapiens
guacuuacaucag

SEQ ID NO: 1069931 - RNA, 16 nt, Homo sapiens
guagcauccucuuuaa

SEQ ID NO: 1069932 - RNA, 20 nt, Homo sapiens
guagcauuuacugugucuuu

SEQ ID NO: 1069933 - RNA, 12 nt, Homo sapiens
guagcugagacu

SEQ ID NO: 1069934 - RNA, 18 nt, Homo sapiens
guagcuggggcuacagga

SEQ ID NO: 1069935 - RNA, 13 nt, Homo sapiens
guaggacccaagc

SEQ ID NO: 1069936 - RNA, 16 nt, Homo sapiens
guaggacccaagcaga

SEQ ID NO: 1069937 - RNA, 12 nt, Homo sapiens
guauaauggggc

SEQ ID NO: 1069938 - RNA, 16 nt, Homo sapiens
guauucgcuugagaaa

SEQ ID NO: 1069939 - RNA, 12 nt, Homo sapiens
gucaaugaacuu

SEQ ID NO: 1069940 - RNA, 19 nt, Homo sapiens
gucaaugaacuuuccacau

SEQ ID NO: 1069941 - RNA, 13 nt, Homo sapiens
gucauuacagggc

SEQ ID NO: 1069942 - RNA, 23 nt, Homo sapiens
gucccaugugauuuaaacaaaca

SEQ ID NO: 1069943 - RNA, 17 nt, Homo sapiens
guccccuaaaccaaaaa

SEQ ID NO: 1069944 - RNA, 18 nt, Homo sapiens
guccucauuuacuggauu

SEQ ID NO: 1069945 - RNA, 12 nt, Homo sapiens
guccucuuuaca

SEQ ID NO: 1069946 - RNA, 23 nt, Homo sapiens
gucuaacuggggauauaauacua

SEQ ID NO: 1069947 - RNA, 22 nt, Homo sapiens
gucuauacaaaggcuugcuaag

SEQ ID NO: 1069948 - RNA, 17 nt, Homo sapiens
gucucagaccacuauuc

SEQ ID NO: 1069949 - RNA, 17 nt, Homo sapiens
gucucccagcucagggc

SEQ ID NO: 1069950 - RNA, 18 nt, Homo sapiens
gucugaugagaacucuga

SEQ ID NO: 1069951 - RNA, 14 nt, Homo sapiens
gucuuucuauccug

SEQ ID NO: 1069952 - RNA, 20 nt, Homo sapiens
gugaaagcaucacuugggau

SEQ ID NO: 1069953 - RNA, 13 nt, Homo sapiens
gugaacaagcaaa

SEQ ID NO: 1069954 - RNA, 12 nt, Homo sapiens
gugagugcaagg

SEQ ID NO: 1069955 - RNA, 16 nt, Homo sapiens
gugcacaaaguggcau

SEQ ID NO: 1069956 - RNA, 18 nt, Homo sapiens
gugccacuacacuccagc

SEQ ID NO: 1069957 - RNA, 16 nt, Homo sapiens
gugcccuagacuggcu

SEQ ID NO: 1069958 - RNA, 14 nt, Homo sapiens
gugcucacauagga

SEQ ID NO: 1069959 - RNA, 20 nt, Homo sapiens
guggaggcggaauugcucuc

SEQ ID NO: 1069960 - RNA, 12 nt, Homo sapiens
guggaucacuug

SEQ ID NO: 1069961 - RNA, 14 nt, Homo sapiens
guggcaaccugcuu

SEQ ID NO: 1069962 - RNA, 22 nt, Homo sapiens
guggggacauuuuauaaucuau

SEQ ID NO: 1069963 - RNA, 22 nt, Homo sapiens
guggguuuuuuugaauguuggu

SEQ ID NO: 1069964 - RNA, 19 nt, Homo sapiens
gugguaucuucacguagaa

SEQ ID NO: 1069965 - RNA, 22 nt, Homo sapiens
gugucaucuuucuuguuucauc

SEQ ID NO: 1069966 - RNA, 13 nt, Homo sapiens
guuaacaguuuuu

SEQ ID NO: 1069967 - RNA, 11 nt, Homo sapiens
guuaaugccau

SEQ ID NO: 1069968 - RNA, 15 nt, Homo sapiens
guucauccuauucuu

SEQ ID NO: 1069969 - RNA, 13 nt, Homo sapiens
guuccaguggcuu

SEQ ID NO: 1069970 - RNA, 18 nt, Homo sapiens
guucuuugucacagggac

SEQ ID NO: 1069971 - RNA, 19 nt, Homo sapiens
guuggaugcggaacccaaa

SEQ ID NO: 1069972 - RNA, 22 nt, Homo sapiens
guuggcgggggcuuggcugugc

SEQ ID NO: 1069973 - RNA, 22 nt, Homo sapiens
guugucuuuuaaaaagugugcu

SEQ ID NO: 1069974 - RNA, 13 nt, Homo sapiens
guugugcgcacau

SEQ ID NO: 1069975 - RNA, 19 nt, Homo sapiens
guuucaucguaaacauacu

SEQ ID NO: 1069976 - RNA, 21 nt, Homo sapiens
guuucuccagagggaauugca

SEQ ID NO: 1069977 - RNA, 15 nt, Homo sapiens
guuuucugacacagu

SEQ ID NO: 1069978 - RNA, 20 nt, Homo sapiens
guuuugagcauggguucauc

SEQ ID NO: 1069979 - RNA, 17 nt, Homo sapiens
guuuuuaaaaaucuguu

SEQ ID NO: 1069980 - RNA, 23 nt, Homo sapiens
uaaaaaaaaaaaauggcuucaga

SEQ ID NO: 1069981 - RNA, 22 nt, Homo sapiens
uaaaaaaaaaacguauugcauu

SEQ ID NO: 1069982 - RNA, 20 nt, Homo sapiens
uaaaacuucuuuaguacuua

SEQ ID NO: 1069983 - RNA, 14 nt, Homo sapiens
uaaaagcacacuca

SEQ ID NO: 1069984 - RNA, 16 nt, Homo sapiens
uaaaauagcugaggga

SEQ ID NO: 1069985 - RNA, 17 nt, Homo sapiens
uaaaauauaagaucuga

SEQ ID NO: 1069986 - RNA, 17 nt, Homo sapiens
uaaaauguaucuuccau

SEQ ID NO: 1069987 - RNA, 22 nt, Homo sapiens
uaaaauuuggccaaacaagugu

SEQ ID NO: 1069988 - RNA, 13 nt, Homo sapiens
uaaagguaugaaa

SEQ ID NO: 1069989 - RNA, 15 nt, Homo sapiens
uaaaguacauaacaa

SEQ ID NO: 1069990 - RNA, 12 nt, Homo sapiens
uaaagugcugcg

SEQ ID NO: 1069991 - RNA, 14 nt, Homo sapiens
uaaauaaauaucuc

SEQ ID NO: 1069992 - RNA, 17 nt, Homo sapiens
uaaauauuaaguguuua

SEQ ID NO: 1069993 - RNA, 23 nt, Homo sapiens
uaacaccagacagacaacacugg

SEQ ID NO: 1069994 - RNA, 17 nt, Homo sapiens
uaacucaauauuuucca

SEQ ID NO: 1069995 - RNA, 19 nt, Homo sapiens
uaacuuccaugugaggguu

SEQ ID NO: 1069996 - RNA, 19 nt, Homo sapiens
uaaguuagggaauggcaca

SEQ ID NO: 1069997 - RNA, 19 nt, Homo sapiens
uaaucccagcuacucggga

SEQ ID NO: 1069998 - RNA, 11 nt, Homo sapiens
uaaugcuuaua

SEQ ID NO: 1069999 - RNA, 13 nt, Homo sapiens
uaauucugggaag

SEQ ID NO: 1070000 - RNA, 16 nt, Homo sapiens
uacaaauagaauuuga

SEQ ID NO: 1070001 - RNA, 15 nt, Homo sapiens
uacaauaaguuaacu

SEQ ID NO: 1070002 - RNA, 13 nt, Homo sapiens
uacaauagucaaa

SEQ ID NO: 1070003 - RNA, 19 nt, Homo sapiens
uacaaugcauucugaggua

SEQ ID NO: 1070004 - RNA, 23 nt, Homo sapiens
uacacauacauguaaaauauguc

SEQ ID NO: 1070005 - RNA, 12 nt, Homo sapiens
uacagccuuccg

SEQ ID NO: 1070006 - RNA, 18 nt, Homo sapiens
uacauaaaguacauaaca

SEQ ID NO: 1070007 - RNA, 19 nt, Homo sapiens
uacauaaaguaugugcaua

SEQ ID NO: 1070008 - RNA, 18 nt, Homo sapiens
uacauucuuccugauuau

SEQ ID NO: 1070009 - RNA, 19 nt, Homo sapiens
uaccaccaaaaaagcugua

SEQ ID NO: 1070010 - RNA, 18 nt, Homo sapiens
uaccaugcaggauuugaa

SEQ ID NO: 1070011 - RNA, 15 nt, Homo sapiens
uaccccuuuacaaau

SEQ ID NO: 1070012 - RNA, 23 nt, Homo sapiens
uacccugcgcccaguccuuccac

SEQ ID NO: 1070013 - RNA, 14 nt, Homo sapiens
uacccuuucauuca

SEQ ID NO: 1070014 - RNA, 22 nt, Homo sapiens
uaccucaaccaaugccaaaaaa

SEQ ID NO: 1070015 - RNA, 18 nt, Homo sapiens
uaccuguuuccuacagac

SEQ ID NO: 1070016 - RNA, 15 nt, Homo sapiens
uaccuuguauaucau

SEQ ID NO: 1070017 - RNA, 20 nt, Homo sapiens
uacgguaccuggcaauguuu

SEQ ID NO: 1070018 - RNA, 15 nt, Homo sapiens
uacuaaaaauacaaa

SEQ ID NO: 1070019 - RNA, 12 nt, Homo sapiens
uacuguauauau

SEQ ID NO: 1070020 - RNA, 15 nt, Homo sapiens
uacuguauauauaau

SEQ ID NO: 1070021 - RNA, 13 nt, Homo sapiens
uacuuacaucagg

SEQ ID NO: 1070022 - RNA, 16 nt, Homo sapiens
uacuucaaacugagau

SEQ ID NO: 1070023 - RNA, 15 nt, Homo sapiens
uacuuugugcuugua

SEQ ID NO: 1070024 - RNA, 22 nt, Homo sapiens
uagaaauuauauuuuagccuuu

SEQ ID NO: 1070025 - RNA, 22 nt, Homo sapiens
uagaacauaaagcaaauagaca

SEQ ID NO: 1070026 - RNA, 13 nt, Homo sapiens
uagaccuaaaaua

SEQ ID NO: 1070027 - RNA, 20 nt, Homo sapiens
uagacugcaguggacagucc

SEQ ID NO: 1070028 - RNA, 18 nt, Homo sapiens
uagaugcauguacccuaa

SEQ ID NO: 1070029 - RNA, 16 nt, Homo sapiens
uagauggccaugaaga

SEQ ID NO: 1070030 - RNA, 18 nt, Homo sapiens
uagauguuuccuugccuu

SEQ ID NO: 1070031 - RNA, 18 nt, Homo sapiens
uagauuaccuagcuuagu

SEQ ID NO: 1070032 - RNA, 16 nt, Homo sapiens
uagauugccucucuag

SEQ ID NO: 1070033 - RNA, 22 nt, Homo sapiens
uagcagauacagggaugaggca

SEQ ID NO: 1070034 - RNA, 18 nt, Homo sapiens
uagccagaggacugugau

SEQ ID NO: 1070035 - RNA, 16 nt, Homo sapiens
uagccgaaaugaucuu

SEQ ID NO: 1070036 - RNA, 22 nt, Homo sapiens
uagccuuuauuuuuaaccugcc

SEQ ID NO: 1070037 - RNA, 23 nt, Homo sapiens
uagccuuuauuuuuaaccugcca

SEQ ID NO: 1070038 - RNA, 17 nt, Homo sapiens
uagcuccaaaccuucac

SEQ ID NO: 1070039 - RNA, 17 nt, Homo sapiens
uagcugagacuacaggu

SEQ ID NO: 1070040 - RNA, 20 nt, Homo sapiens
uagcugcccaggaugcugcu

SEQ ID NO: 1070041 - RNA, 15 nt, Homo sapiens
uagcuuggaaacugg

SEQ ID NO: 1070042 - RNA, 20 nt, Homo sapiens
uaggaggggaacuagguuac

SEQ ID NO: 1070043 - RNA, 16 nt, Homo sapiens
uaggccaggugcaacc

SEQ ID NO: 1070044 - RNA, 15 nt, Homo sapiens
uagugcccucaucca

SEQ ID NO: 1070045 - RNA, 14 nt, Homo sapiens
uauaauacuguauu

SEQ ID NO: 1070046 - RNA, 15 nt, Homo sapiens
uauacauuaacuuca

SEQ ID NO: 1070047 - RNA, 16 nt, Homo sapiens
uauauauauguguaua

SEQ ID NO: 1070048 - RNA, 15 nt, Homo sapiens
cuugugaacccaaag

SEQ ID NO: 1070049 - RNA, 15 nt, Homo sapiens
cuugugagaaaagaa

SEQ ID NO: 1070050 - RNA, 18 nt, Homo sapiens
cuuguuucuauacauucu

SEQ ID NO: 1070051 - RNA, 19 nt, Homo sapiens
cuuguuuuaaguugcuuua

SEQ ID NO: 1070052 - RNA, 22 nt, Homo sapiens
cuuuaaaaauaugcaccaaauc

SEQ ID NO: 1070053 - RNA, 19 nt, Homo sapiens
cuuuaaaacuuauccucca

SEQ ID NO: 1070054 - RNA, 22 nt, Homo sapiens
cuuuacaagauggguccaggau

SEQ ID NO: 1070055 - RNA, 18 nt, Homo sapiens
cuuucagcgaaugacaaa

SEQ ID NO: 1070056 - RNA, 18 nt, Homo sapiens
cuuucauuauagcagaga

SEQ ID NO: 1070057 - RNA, 19 nt, Homo sapiens
cuuucuucauuaagauuuu

SEQ ID NO: 1070058 - RNA, 16 nt, Homo sapiens
cuuugauucaaagcac

SEQ ID NO: 1070059 - RNA, 22 nt, Homo sapiens
cuuuggacauagcgaauacaaa

SEQ ID NO: 1070060 - RNA, 15 nt, Homo sapiens
cuuuggugcuuucca

SEQ ID NO: 1070061 - RNA, 20 nt, Homo sapiens
cuuuuauuucuucaccagau

SEQ ID NO: 1070062 - RNA, 16 nt, Homo sapiens
cuuuuggagguauuca

SEQ ID NO: 1070063 - RNA, 12 nt, Homo sapiens
gaaaaauucauu

SEQ ID NO: 1070064 - RNA, 19 nt, Homo sapiens
gaaaagcggacaucagcug

SEQ ID NO: 1070065 - RNA, 15 nt, Homo sapiens
gaaaaggaaguuaug

SEQ ID NO: 1070066 - RNA, 23 nt, Homo sapiens
gaaaaggugguguugguauccaa

SEQ ID NO: 1070067 - RNA, 18 nt, Homo sapiens
gaaaaugugucauucauu

SEQ ID NO: 1070068 - RNA, 20 nt, Homo sapiens
gaaaauuaauagaauuauuu

SEQ ID NO: 1070069 - RNA, 23 nt, Homo sapiens
gaaacaaaacuagguaaaaucua

SEQ ID NO: 1070070 - RNA, 23 nt, Homo sapiens
gaaacaccguguuuucugacaca

SEQ ID NO: 1070071 - RNA, 22 nt, Homo sapiens
gaaacuuuacaaccugauguca

SEQ ID NO: 1070072 - RNA, 13 nt, Homo sapiens
gaaagaaggaauc

SEQ ID NO: 1070073 - RNA, 17 nt, Homo sapiens
gaaagcuguuaaauucu

SEQ ID NO: 1070074 - RNA, 19 nt, Homo sapiens
gaaaggagccuaggccagg

SEQ ID NO: 1070075 - RNA, 21 nt, Homo sapiens
gaaauuaguaggcucauuuac

SEQ ID NO: 1070076 - RNA, 20 nt, Homo sapiens
gaaauuauaaauaaauaucu

SEQ ID NO: 1070077 - RNA, 21 nt, Homo sapiens
gaacagaagaaaauaauauga

SEQ ID NO: 1070078 - RNA, 14 nt, Homo sapiens
gaacauauucaguu

SEQ ID NO: 1070079 - RNA, 20 nt, Homo sapiens
gaacaucucugcuuucacuc

SEQ ID NO: 1070080 - RNA, 21 nt, Homo sapiens
gaaccacucauaauucuucac

SEQ ID NO: 1070081 - RNA, 12 nt, Homo sapiens
gaacccugagca

SEQ ID NO: 1070082 - RNA, 16 nt, Homo sapiens
gaacgucuaguacaau

SEQ ID NO: 1070083 - RNA, 17 nt, Homo sapiens
gaacuauuguggguuuu

SEQ ID NO: 1070084 - RNA, 22 nt, Homo sapiens
gaacuggagccaugggcacaaa

SEQ ID NO: 1070085 - RNA, 22 nt, Homo sapiens
gaagacaucuuauccauccuca

SEQ ID NO: 1070086 - RNA, 17 nt, Homo sapiens
gaagaguguggagucau

SEQ ID NO: 1070087 - RNA, 17 nt, Homo sapiens
gaagcaaagaagggaau

SEQ ID NO: 1070088 - RNA, 15 nt, Homo sapiens
gaaguucacaucaga

SEQ ID NO: 1070089 - RNA, 17 nt, Homo sapiens
gaauauaaacacuauau

SEQ ID NO: 1070090 - RNA, 14 nt, Homo sapiens
gaauauaauacugu

SEQ ID NO: 1070091 - RNA, 23 nt, Homo sapiens
gaauuaaguuagggaauggcaca

SEQ ID NO: 1070092 - RNA, 17 nt, Homo sapiens
gaauuuggaaggcaaag

SEQ ID NO: 1070093 - RNA, 19 nt, Homo sapiens
gacaaagcaaaaagugaug

SEQ ID NO: 1070094 - RNA, 20 nt, Homo sapiens
gacaauggcuuacuccagga

SEQ ID NO: 1070095 - RNA, 17 nt, Homo sapiens
gacacaggccugcucuc

SEQ ID NO: 1070096 - RNA, 17 nt, Homo sapiens
gacacugggaggccagu

SEQ ID NO: 1070097 - RNA, 18 nt, Homo sapiens
gacagaacacccaauuca

SEQ ID NO: 1070098 - RNA, 13 nt, Homo sapiens
gacagaacacugu

SEQ ID NO: 1070099 - RNA, 18 nt, Homo sapiens
gacagacaacacugggaa

SEQ ID NO: 1070100 - RNA, 13 nt, Homo sapiens
gacagcuucucau

SEQ ID NO: 1070101 - RNA, 21 nt, Homo sapiens
gacagcuugaucaaaggcaca

SEQ ID NO: 1070102 - RNA, 17 nt, Homo sapiens
gacauuuuauaaucuau

SEQ ID NO: 1070103 - RNA, 13 nt, Homo sapiens
gacccaugggaga

SEQ ID NO: 1070104 - RNA, 13 nt, Homo sapiens
gaccuaaaauaaa

SEQ ID NO: 1070105 - RNA, 14 nt, Homo sapiens
gaccugacaccuuu

SEQ ID NO: 1070106 - RNA, 14 nt, Homo sapiens
gaccuggacacagg

SEQ ID NO: 1070107 - RNA, 22 nt, Homo sapiens
gaccuucuaggaagcuccaguu

SEQ ID NO: 1070108 - RNA, 16 nt, Homo sapiens
gacucaaucuacaggc

SEQ ID NO: 1070109 - RNA, 15 nt, Homo sapiens
gacucaggacauccc

SEQ ID NO: 1070110 - RNA, 19 nt, Homo sapiens
gacugcaguggacaguccc

SEQ ID NO: 1070111 - RNA, 21 nt, Homo sapiens
gagaaacaaugacuaauucuu

SEQ ID NO: 1070112 - RNA, 22 nt, Homo sapiens
gagaagaaaauggaaccaggcu

SEQ ID NO: 1070113 - RNA, 15 nt, Homo sapiens
gagaaucaaaaugca

SEQ ID NO: 1070114 - RNA, 23 nt, Homo sapiens
gagaauuagaaacaacauagcaa

SEQ ID NO: 1070115 - RNA, 21 nt, Homo sapiens
gagacuccucaguucuugcca

SEQ ID NO: 1070116 - RNA, 18 nt, Homo sapiens
gagagggaacggaaauaa

SEQ ID NO: 1070117 - RNA, 18 nt, Homo sapiens
gagauccugagucaugug

SEQ ID NO: 1070118 - RNA, 14 nt, Homo sapiens
gagcaaguccuucc

SEQ ID NO: 1070119 - RNA, 12 nt, Homo sapiens
gagcacuacaga

SEQ ID NO: 1070120 - RNA, 16 nt, Homo sapiens
gagccacguauguuuu

SEQ ID NO: 1070121 - RNA, 17 nt, Homo sapiens
gagccuaggccaggugc

SEQ ID NO: 1070122 - RNA, 20 nt, Homo sapiens
gaggaacuuuuucucuguua

SEQ ID NO: 1070123 - RNA, 22 nt, Homo sapiens
gaggacaagggaaaugucaggg

SEQ ID NO: 1070124 - RNA, 15 nt, Homo sapiens
gaggcaauggcuccu

SEQ ID NO: 1070125 - RNA, 18 nt, Homo sapiens
gagggaccucucccaggg

SEQ ID NO: 1070126 - RNA, 16 nt, Homo sapiens
gagggcagaucacuuc

SEQ ID NO: 1070127 - RNA, 15 nt, Homo sapiens
gaggucacaguccac

SEQ ID NO: 1070128 - RNA, 18 nt, Homo sapiens
gagguggagguugcagug

SEQ ID NO: 1070129 - RNA, 19 nt, Homo sapiens
gaguacuggcugauggagu

SEQ ID NO: 1070130 - RNA, 18 nt, Homo sapiens
gagugaaggggccaagga

SEQ ID NO: 1070131 - RNA, 16 nt, Homo sapiens
gaguggggaagugauc

SEQ ID NO: 1070132 - RNA, 17 nt, Homo sapiens
gauaaucaucucuguca

SEQ ID NO: 1070133 - RNA, 19 nt, Homo sapiens
gauagccuaguuaaauauu

SEQ ID NO: 1070134 - RNA, 19 nt, Homo sapiens
gauagggagcagaugcaau

SEQ ID NO: 1070135 - RNA, 15 nt, Homo sapiens
gauccuauugaacca

SEQ ID NO: 1070136 - RNA, 13 nt, Homo sapiens
gaugagaaauuca

SEQ ID NO: 1070137 - RNA, 21 nt, Homo sapiens
gaugaggucauagcagugcuu

SEQ ID NO: 1070138 - RNA, 20 nt, Homo sapiens
gaugcagcauuuuguauuug

SEQ ID NO: 1070139 - RNA, 20 nt, Homo sapiens
gaugcugagauccugaguca

SEQ ID NO: 1070140 - RNA, 23 nt, Homo sapiens
gauggcccauucuacuugcucug

SEQ ID NO: 1070141 - RNA, 12 nt, Homo sapiens
gaugguccugca

SEQ ID NO: 1070142 - RNA, 13 nt, Homo sapiens
gauucauauugaa

SEQ ID NO: 1070143 - RNA, 15 nt, Homo sapiens
gauucuucccauucu

SEQ ID NO: 1070144 - RNA, 15 nt, Homo sapiens
gcaaaagucagucuu

SEQ ID NO: 1070145 - RNA, 18 nt, Homo sapiens
gcaagauuuaaauccuuu

SEQ ID NO: 1070146 - RNA, 22 nt, Homo sapiens
gcaaucacggcucacuguaguc

SEQ ID NO: 1070147 - RNA, 19 nt, Homo sapiens
gcaccaaaucaucucucau

SEQ ID NO: 1070148 - RNA, 15 nt, Homo sapiens
gcaccaauaaagccu

SEQ ID NO: 1070149 - RNA, 23 nt, Homo sapiens
gcaccagaugccauuacauuuau

SEQ ID NO: 1070150 - RNA, 14 nt, Homo sapiens
gcaccucaagaaga

SEQ ID NO: 1070151 - RNA, 21 nt, Homo sapiens
gcaccuguaaucccagcuacu

SEQ ID NO: 1070152 - RNA, 18 nt, Homo sapiens
gcagaagcagaagugcaa

SEQ ID NO: 1070153 - RNA, 14 nt, Homo sapiens
gcagaccugacucu

SEQ ID NO: 1070154 - RNA, 21 nt, Homo sapiens
gcagacugcaaaucugccuga

SEQ ID NO: 1070155 - RNA, 21 nt, Homo sapiens
gcagaggcuguggugagccaa

SEQ ID NO: 1070156 - RNA, 16 nt, Homo sapiens
gcagaguucuauaaug

SEQ ID NO: 1070157 - RNA, 16 nt, Homo sapiens
gcaggacaguauuccu

SEQ ID NO: 1070158 - RNA, 23 nt, Homo sapiens
gcaggcaugagucagucugauga

SEQ ID NO: 1070159 - RNA, 19 nt, Homo sapiens
gcagucugggaguggggaa

SEQ ID NO: 1070160 - RNA, 16 nt, Homo sapiens
gcagucuguccaggcu

SEQ ID NO: 1070161 - RNA, 16 nt, Homo sapiens
gcauaaaaaacaugug

SEQ ID NO: 1070162 - RNA, 15 nt, Homo sapiens
gcauauauacauaua

SEQ ID NO: 1070163 - RNA, 23 nt, Homo sapiens
gcauauauuggguuccauucuca

SEQ ID NO: 1070164 - RNA, 14 nt, Homo sapiens
ucuucaaccaggga

SEQ ID NO: 1070165 - RNA, 22 nt, Homo sapiens
ucuucaccuuaggaauaaucuc

SEQ ID NO: 1070166 - RNA, 19 nt, Homo sapiens
ucuucgaccacaucagaaa

SEQ ID NO: 1070167 - RNA, 14 nt, Homo sapiens
ucuugaaucucuga

SEQ ID NO: 1070168 - RNA, 17 nt, Homo sapiens
ucuugauaccugggaua

SEQ ID NO: 1070169 - RNA, 22 nt, Homo sapiens
ucuuuacaagauggguccagga

SEQ ID NO: 1070170 - RNA, 14 nt, Homo sapiens
ucuuucuuguuuca

SEQ ID NO: 1070171 - RNA, 20 nt, Homo sapiens
ucuuugauucaaagcacugu

SEQ ID NO: 1070172 - RNA, 21 nt, Homo sapiens
ucuuuuaaaaagugugcuuaa

SEQ ID NO: 1070173 - RNA, 12 nt, Homo sapiens
ugaaaaauacuu

SEQ ID NO: 1070174 - RNA, 16 nt, Homo sapiens
ugaaaauuaacacugc

SEQ ID NO: 1070175 - RNA, 17 nt, Homo sapiens
ugaaauauacacacagc

SEQ ID NO: 1070176 - RNA, 17 nt, Homo sapiens
ugaacaaccugcucaca

SEQ ID NO: 1070177 - RNA, 24 nt, Homo sapiens
ugaacaaccugcucacaguccuca

SEQ ID NO: 1070178 - RNA, 18 nt, Homo sapiens
ugaacggcugaauaugaa

SEQ ID NO: 1070179 - RNA, 23 nt, Homo sapiens
ugaagaacaacaacucucagugg

SEQ ID NO: 1070180 - RNA, 16 nt, Homo sapiens
ugaagcaaacacauua

SEQ ID NO: 1070181 - RNA, 19 nt, Homo sapiens
ugaagggaguggcucugua

SEQ ID NO: 1070182 - RNA, 17 nt, Homo sapiens
ugaauauaaacacuaua

SEQ ID NO: 1070183 - RNA, 14 nt, Homo sapiens
ugaauaugacaaag

SEQ ID NO: 1070184 - RNA, 18 nt, Homo sapiens
ugaaucuauuuaucuuca

SEQ ID NO: 1070185 - RNA, 22 nt, Homo sapiens
ugaauguguaaugggaaugaga

SEQ ID NO: 1070186 - RNA, 13 nt, Homo sapiens
ugaauuacccuuu

SEQ ID NO: 1070187 - RNA, 16 nt, Homo sapiens
ugaauuguuugaaccu

SEQ ID NO: 1070188 - RNA, 18 nt, Homo sapiens
ugacaagagcgaaacucc

SEQ ID NO: 1070189 - RNA, 15 nt, Homo sapiens
ugacacaacugcacu

SEQ ID NO: 1070190 - RNA, 14 nt, Homo sapiens
ugacaccuuucaua

SEQ ID NO: 1070191 - RNA, 14 nt, Homo sapiens
ugacagaacacugu

SEQ ID NO: 1070192 - RNA, 21 nt, Homo sapiens
ugacagucaugcagucuggga

SEQ ID NO: 1070193 - RNA, 12 nt, Homo sapiens
ugacaugugcuu

SEQ ID NO: 1070194 - RNA, 16 nt, Homo sapiens
ugaccagcaaauacuc

SEQ ID NO: 1070195 - RNA, 22 nt, Homo sapiens
ugacugagaauauaauacugua

SEQ ID NO: 1070196 - RNA, 22 nt, Homo sapiens
ugagcaauguauaaccccaaag

SEQ ID NO: 1070197 - RNA, 19 nt, Homo sapiens
ugagcagacugcaaaucug

SEQ ID NO: 1070198 - RNA, 21 nt, Homo sapiens
ugagcagugcuugaaugaagu

SEQ ID NO: 1070199 - RNA, 18 nt, Homo sapiens
ugagccaagaugacacaa

SEQ ID NO: 1070200 - RNA, 19 nt, Homo sapiens
ugagcucacugaaaagacu

SEQ ID NO: 1070201 - RNA, 19 nt, Homo sapiens
ugagcugcccccaaaucaa

SEQ ID NO: 1070202 - RNA, 17 nt, Homo sapiens
ugagcuuagauugccuc

SEQ ID NO: 1070203 - RNA, 22 nt, Homo sapiens
ugaggcaggagaaucucuugaa

SEQ ID NO: 1070204 - RNA, 20 nt, Homo sapiens
ugaggcauccuuccucacac

SEQ ID NO: 1070205 - RNA, 17 nt, Homo sapiens
ugaggcccucauuccca

SEQ ID NO: 1070206 - RNA, 14 nt, Homo sapiens
ugagucacaaagaa

SEQ ID NO: 1070207 - RNA, 22 nt, Homo sapiens
ugauagccuaguuaaauauuuc

SEQ ID NO: 1070208 - RNA, 19 nt, Homo sapiens
ugauaugugaaugcucaua

SEQ ID NO: 1070209 - RNA, 22 nt, Homo sapiens
ugauccaagcaagacugagggg

SEQ ID NO: 1070210 - RNA, 20 nt, Homo sapiens
ugaucccuaggucuugggag

SEQ ID NO: 1070211 - RNA, 18 nt, Homo sapiens
ugaucuucuaaucuguga

SEQ ID NO: 1070212 - RNA, 14 nt, Homo sapiens
ugaugagcugugca

SEQ ID NO: 1070213 - RNA, 16 nt, Homo sapiens
ugaugauaguggugga

SEQ ID NO: 1070214 - RNA, 19 nt, Homo sapiens
ugauggcucauuuacacuc

SEQ ID NO: 1070215 - RNA, 22 nt, Homo sapiens
ugauuuccccuuuugcauucuc

SEQ ID NO: 1070216 - RNA, 13 nt, Homo sapiens
ugcaacaacaugu

SEQ ID NO: 1070217 - RNA, 20 nt, Homo sapiens
ugcaacagccacuacauuac

SEQ ID NO: 1070218 - RNA, 18 nt, Homo sapiens
ugcaaccagggagcugca

SEQ ID NO: 1070219 - RNA, 15 nt, Homo sapiens
ugcacaucuagugag

SEQ ID NO: 1070220 - RNA, 17 nt, Homo sapiens
ugcaccaaaucaucucu

SEQ ID NO: 1070221 - RNA, 13 nt, Homo sapiens
ugcacucuagccu

SEQ ID NO: 1070222 - RNA, 16 nt, Homo sapiens
ugcagaaaauugccua

SEQ ID NO: 1070223 - RNA, 13 nt, Homo sapiens
ugcagaagcagaa

SEQ ID NO: 1070224 - RNA, 19 nt, Homo sapiens
ugcagcauuuuguauuugu

SEQ ID NO: 1070225 - RNA, 11 nt, Homo sapiens
ugcagccagag

SEQ ID NO: 1070226 - RNA, 20 nt, Homo sapiens
ugcaggccaggccagcugcc

SEQ ID NO: 1070227 - RNA, 21 nt, Homo sapiens
ugcauaagguuuuuaugcaug

SEQ ID NO: 1070228 - RNA, 19 nt, Homo sapiens
ugcauagagccacguaugu

SEQ ID NO: 1070229 - RNA, 23 nt, Homo sapiens
ugcauucugagguaaccucauua

SEQ ID NO: 1070230 - RNA, 17 nt, Homo sapiens
ugcauuuaauuuauuga

SEQ ID NO: 1070231 - RNA, 15 nt, Homo sapiens
ugccaaaaaaagaca

SEQ ID NO: 1070232 - RNA, 16 nt, Homo sapiens
ugccaacauacuuuaa

SEQ ID NO: 1070233 - RNA, 16 nt, Homo sapiens
ugccaagaccuuucaa

SEQ ID NO: 1070234 - RNA, 21 nt, Homo sapiens
ugccacgccgcccuaaaagca

SEQ ID NO: 1070235 - RNA, 14 nt, Homo sapiens
ugccauuuugcauu

SEQ ID NO: 1070236 - RNA, 16 nt, Homo sapiens
ugccccuggaugcacu

SEQ ID NO: 1070237 - RNA, 21 nt, Homo sapiens
ugccccuggaugcacuuucau

SEQ ID NO: 1070238 - RNA, 20 nt, Homo sapiens
ugccuccaucagcuaaacac

SEQ ID NO: 1070239 - RNA, 18 nt, Homo sapiens
ugccugcaggcaugaguc

SEQ ID NO: 1070240 - RNA, 17 nt, Homo sapiens
ugccuuguugaugugga

SEQ ID NO: 1070241 - RNA, 20 nt, Homo sapiens
ugcuaggcccccggguguga

SEQ ID NO: 1070242 - RNA, 16 nt, Homo sapiens
ugcucugcaagcagaa

SEQ ID NO: 1070243 - RNA, 23 nt, Homo sapiens
ugcucuuugauucaaagcacugu

SEQ ID NO: 1070244 - RNA, 19 nt, Homo sapiens
ugcuuaagguaugguacaa

SEQ ID NO: 1070245 - RNA, 15 nt, Homo sapiens
ugcuuucacucuuua

SEQ ID NO: 1070246 - RNA, 22 nt, Homo sapiens
ugcuuuugguggcuaccaugca

SEQ ID NO: 1070247 - RNA, 23 nt, Homo sapiens
ugcuuuuguguaaggaaggugcu

SEQ ID NO: 1070248 - RNA, 16 nt, Homo sapiens
ugcuuuuuuucuacug

SEQ ID NO: 1070249 - RNA, 18 nt, Homo sapiens
uggaagcugucauaaaaa

SEQ ID NO: 1070250 - RNA, 20 nt, Homo sapiens
uggacaaacaccaaucucuc

SEQ ID NO: 1070251 - RNA, 14 nt, Homo sapiens
uggacaugagccau

SEQ ID NO: 1070252 - RNA, 21 nt, Homo sapiens
uggagagccccucacacagcc

SEQ ID NO: 1070253 - RNA, 14 nt, Homo sapiens
uggagauagucuca

SEQ ID NO: 1070254 - RNA, 13 nt, Homo sapiens
uggagcugucuac

SEQ ID NO: 1070255 - RNA, 18 nt, Homo sapiens
uggaggaucucacuuaau

SEQ ID NO: 1070256 - RNA, 23 nt, Homo sapiens
uggaggcggaauugcucucccag

SEQ ID NO: 1070257 - RNA, 21 nt, Homo sapiens
uggagggaccuugucucccag

SEQ ID NO: 1070258 - RNA, 13 nt, Homo sapiens
uggagucauucuc

SEQ ID NO: 1070259 - RNA, 11 nt, Homo sapiens
uggagugcagg

SEQ ID NO: 1070260 - RNA, 15 nt, Homo sapiens
uggaguuaaucuuau

SEQ ID NO: 1070261 - RNA, 15 nt, Homo sapiens
uggauaaaaucugau

SEQ ID NO: 1070262 - RNA, 18 nt, Homo sapiens
uggaugacuaacuaucaa

SEQ ID NO: 1070263 - RNA, 17 nt, Homo sapiens
uggcagcucagcuuccc

SEQ ID NO: 1070264 - RNA, 18 nt, Homo sapiens
uggcaugcuaaagccuuc

SEQ ID NO: 1070265 - RNA, 17 nt, Homo sapiens
uggccaagagaccagcc

SEQ ID NO: 1070266 - RNA, 18 nt, Homo sapiens
uggcccaguuaauuugca

SEQ ID NO: 1070267 - RNA, 21 nt, Homo sapiens
uggcuccaggacagaccuuca

SEQ ID NO: 1070268 - RNA, 13 nt, Homo sapiens
cauugcaccagau

SEQ ID NO: 1070269 - RNA, 21 nt, Homo sapiens
cauuggaggugaacaagcaaa

SEQ ID NO: 1070270 - RNA, 13 nt, Homo sapiens
cauuguaugugcu

SEQ ID NO: 1070271 - RNA, 20 nt, Homo sapiens
cauuguucuugugaacccaa

SEQ ID NO: 1070272 - RNA, 21 nt, Homo sapiens
cauuguucuugugaacccaaa

SEQ ID NO: 1070273 - RNA, 21 nt, Homo sapiens
cauuuauaauuauuuauguga

SEQ ID NO: 1070274 - RNA, 22 nt, Homo sapiens
cauuuaugucucagaccacuau

SEQ ID NO: 1070275 - RNA, 17 nt, Homo sapiens
cauuucccccaccccau

SEQ ID NO: 1070276 - RNA, 22 nt, Homo sapiens
cauuucucuccucacacacaga

SEQ ID NO: 1070277 - RNA, 17 nt, Homo sapiens
cauuuuaaugcaccuga

SEQ ID NO: 1070278 - RNA, 22 nt, Homo sapiens
cuagcacaugcccuaaugucug

SEQ ID NO: 1070279 - RNA, 20 nt, Homo sapiens
cuagcacuuugggaggccaa

SEQ ID NO: 1070280 - RNA, 17 nt, Homo sapiens
cuauauuguacacaccu

SEQ ID NO: 1070281 - RNA, 18 nt, Homo sapiens
cuauauuuauacuguaua

SEQ ID NO: 1070282 - RNA, 15 nt, Homo sapiens
cuaucauucugcucu

SEQ ID NO: 1070283 - RNA, 20 nt, Homo sapiens
cuauuuaucuucauuugaau

SEQ ID NO: 1070284 - RNA, 18 nt, Homo sapiens
cuauuugagacuccucag

SEQ ID NO: 1070285 - RNA, 20 nt, Homo sapiens
cucaaagcaccugaacaguu

SEQ ID NO: 1070286 - RNA, 18 nt, Homo sapiens
cucaaccaaugccaaaaa

SEQ ID NO: 1070287 - RNA, 16 nt, Homo sapiens
cucaagcuguccuccc

SEQ ID NO: 1070288 - RNA, 15 nt, Homo sapiens
cucaaucuacaggcc

SEQ ID NO: 1070289 - RNA, 16 nt, Homo sapiens
cucaaucuacaggcca

SEQ ID NO: 1070290 - RNA, 13 nt, Homo sapiens
cucacaaccugaa

SEQ ID NO: 1070291 - RNA, 19 nt, Homo sapiens
cucacacacagacucauau

SEQ ID NO: 1070292 - RNA, 13 nt, Homo sapiens
cucacaccuguaa

SEQ ID NO: 1070293 - RNA, 19 nt, Homo sapiens
cucacaccuguaaucccag

SEQ ID NO: 1070294 - RNA, 20 nt, Homo sapiens
cucacaccuguaaucccagc

SEQ ID NO: 1070295 - RNA, 17 nt, Homo sapiens
cucacgccuguaauccc

SEQ ID NO: 1070296 - RNA, 22 nt, Homo sapiens
cucagacaccugugugcuguag

SEQ ID NO: 1070297 - RNA, 12 nt, Homo sapiens
cucagaccagcu

SEQ ID NO: 1070298 - RNA, 16 nt, Homo sapiens
cucagaccagcucuuc

SEQ ID NO: 1070299 - RNA, 12 nt, Homo sapiens
cucagaggccag

SEQ ID NO: 1070300 - RNA, 14 nt, Homo sapiens
cucagcucuuggcu

SEQ ID NO: 1070301 - RNA, 19 nt, Homo sapiens
cucagcucuuggcuccacu

SEQ ID NO: 1070302 - RNA, 22 nt, Homo sapiens
cucaggacacuaauacaccagg

SEQ ID NO: 1070303 - RNA, 18 nt, Homo sapiens
cucaugccuguaauccca

SEQ ID NO: 1070304 - RNA, 22 nt, Homo sapiens
cucauugaauuauaaaagccag

SEQ ID NO: 1070305 - RNA, 17 nt, Homo sapiens
cucauuuggggugcaaa

SEQ ID NO: 1070306 - RNA, 14 nt, Homo sapiens
cuccaccagucauu

SEQ ID NO: 1070307 - RNA, 16 nt, Homo sapiens
cuccaucgcaguguuc

SEQ ID NO: 1070308 - RNA, 18 nt, Homo sapiens
cuccccucagagugcaag

SEQ ID NO: 1070309 - RNA, 16 nt, Homo sapiens
cuccuaacuacaggua

SEQ ID NO: 1070310 - RNA, 19 nt, Homo sapiens
cuccucacucaccuucagu

SEQ ID NO: 1070311 - RNA, 15 nt, Homo sapiens
cuccucaguucuugc

SEQ ID NO: 1070312 - RNA, 23 nt, Homo sapiens
cucgaggagguaaugaauuaaag

SEQ ID NO: 1070313 - RNA, 19 nt, Homo sapiens
cucuacuaaaaauacaaaa

SEQ ID NO: 1070314 - RNA, 16 nt, Homo sapiens
cucuacucuuacuucc

SEQ ID NO: 1070315 - RNA, 13 nt, Homo sapiens
cucucugaucucc

SEQ ID NO: 1070316 - RNA, 20 nt, Homo sapiens
cucugaaccccucccuccau

SEQ ID NO: 1070317 - RNA, 19 nt, Homo sapiens
cucugcaccguacugugga

SEQ ID NO: 1070318 - RNA, 14 nt, Homo sapiens
cucuucucagccac

SEQ ID NO: 1070319 - RNA, 20 nt, Homo sapiens
cucuuggccggauguccuca

SEQ ID NO: 1070320 - RNA, 14 nt, Homo sapiens
cucuuucuuuacaa

SEQ ID NO: 1070321 - RNA, 13 nt, Homo sapiens
cucuuuugcacau

SEQ ID NO: 1070322 - RNA, 17 nt, Homo sapiens
cucuuuuucuccagggu

SEQ ID NO: 1070323 - RNA, 12 nt, Homo sapiens
cugaaagugaaa

SEQ ID NO: 1070324 - RNA, 21 nt, Homo sapiens
cugaaagugaaaguccagaaa

SEQ ID NO: 1070325 - RNA, 21 nt, Homo sapiens
cugaaauauacacacagcagu

SEQ ID NO: 1070326 - RNA, 13 nt, Homo sapiens
cugaagcaaagaa

SEQ ID NO: 1070327 - RNA, 14 nt, Homo sapiens
cugacaccuuucau

SEQ ID NO: 1070328 - RNA, 11 nt, Homo sapiens
cugacccugua

SEQ ID NO: 1070329 - RNA, 20 nt, Homo sapiens
cugagaauauaauacuguau

SEQ ID NO: 1070330 - RNA, 20 nt, Homo sapiens
cugagagcauguuuuaucau

SEQ ID NO: 1070331 - RNA, 13 nt, Homo sapiens
cugagauugacaa

SEQ ID NO: 1070332 - RNA, 13 nt, Homo sapiens
cugagcucacuga

SEQ ID NO: 1070333 - RNA, 14 nt, Homo sapiens
cugaggcauccacu

SEQ ID NO: 1070334 - RNA, 17 nt, Homo sapiens
cugaguggcuucacucc

SEQ ID NO: 1070335 - RNA, 19 nt, Homo sapiens
cugauaagcuaacaccaga

SEQ ID NO: 1070336 - RNA, 18 nt, Homo sapiens
cugauagccuaguuaaau

SEQ ID NO: 1070337 - RNA, 23 nt, Homo sapiens
cugaugacucaagauucccagga

SEQ ID NO: 1070338 - RNA, 15 nt, Homo sapiens
cugaugacuugcuua

SEQ ID NO: 1070339 - RNA, 20 nt, Homo sapiens
cugauuaacugaggcaucca

SEQ ID NO: 1070340 - RNA, 21 nt, Homo sapiens
cugauuauuuucuacacauac

SEQ ID NO: 1070341 - RNA, 20 nt, Homo sapiens
cugauuuccccuuuugcauu

SEQ ID NO: 1070342 - RNA, 17 nt, Homo sapiens
cugcaccguacugugga

SEQ ID NO: 1070343 - RNA, 17 nt, Homo sapiens
cugcaguggacaguccc

SEQ ID NO: 1070344 - RNA, 21 nt, Homo sapiens
cugccugccuuccagccacau

SEQ ID NO: 1070345 - RNA, 20 nt, Homo sapiens
cugcuacucaaguagcauuu

SEQ ID NO: 1070346 - RNA, 11 nt, Homo sapiens
cugcucaggag

SEQ ID NO: 1070347 - RNA, 23 nt, Homo sapiens
cugcucuuugauucaaagcacug

SEQ ID NO: 1070348 - RNA, 15 nt, Homo sapiens
cugcuuugaaagccc

SEQ ID NO: 1070349 - RNA, 12 nt, Homo sapiens
cuggacugaccu

SEQ ID NO: 1070350 - RNA, 14 nt, Homo sapiens
cuggcuugccugaa

SEQ ID NO: 1070351 - RNA, 12 nt, Homo sapiens
cugggaagcaaa

SEQ ID NO: 1070352 - RNA, 20 nt, Homo sapiens
cugggugcggugacucaugc

SEQ ID NO: 1070353 - RNA, 23 nt, Homo sapiens
cuguaaucccagcaauuugggag

SEQ ID NO: 1070354 - RNA, 21 nt, Homo sapiens
cuguaaucccagcacuuuggg

SEQ ID NO: 1070355 - RNA, 21 nt, Homo sapiens
cuguaaucccagcuacucggg

SEQ ID NO: 1070356 - RNA, 18 nt, Homo sapiens
cuguaauccuagcacuuu

SEQ ID NO: 1070357 - RNA, 17 nt, Homo sapiens
cuguagauucacauaca

SEQ ID NO: 1070358 - RNA, 22 nt, Homo sapiens
cuguauaggaaugagauuaauu

SEQ ID NO: 1070359 - RNA, 19 nt, Homo sapiens
cuguaucaguggauuuccc

SEQ ID NO: 1070360 - RNA, 21 nt, Homo sapiens
cuguauucccaguuacuuggg

SEQ ID NO: 1070361 - RNA, 15 nt, Homo sapiens
cuguauucugaccca

SEQ ID NO: 1070362 - RNA, 14 nt, Homo sapiens
cugucucaggguga

SEQ ID NO: 1070363 - RNA, 18 nt, Homo sapiens
cugugcccucagauuccg

SEQ ID NO: 1070364 - RNA, 18 nt, Homo sapiens
cugugccuccaucagcua

SEQ ID NO: 1070365 - RNA, 16 nt, Homo sapiens
cuguggauuauuucau

SEQ ID NO: 1070366 - RNA, 12 nt, Homo sapiens
cugugggaaauu

SEQ ID NO: 1070367 - RNA, 15 nt, Homo sapiens
cuguuaaauucucag

SEQ ID NO: 1070368 - RNA, 18 nt, Homo sapiens
cuguuaauuccuggaacu

SEQ ID NO: 1070369 - RNA, 18 nt, Homo sapiens
cuguuucucucacugggc

SEQ ID NO: 1070370 - RNA, 23 nt, Homo sapiens
cuuaaaaauuuguucacauuaca

SEQ ID NO: 1070371 - RNA, 13 nt, Homo sapiens
cuuaaaauuguau

SEQ ID NO: 1070372 - RNA, 17 nt, Homo sapiens
cuuaaguagauaaggaa

SEQ ID NO: 1070373 - RNA, 19 nt, Homo sapiens
cuuaccuucauaugcagua

SEQ ID NO: 1070374 - RNA, 16 nt, Homo sapiens
cuuagcaccacaaaua

SEQ ID NO: 1070375 - RNA, 19 nt, Homo sapiens
cuuaucaagaguugugaca

SEQ ID NO: 1070376 - RNA, 20 nt, Homo sapiens
cuuaucaagaguugugacaa

SEQ ID NO: 1070377 - RNA, 18 nt, Homo sapiens
cuuaucuccaagaccaga

SEQ ID NO: 1070378 - RNA, 19 nt, Homo sapiens
cuucaaacuaggggacaaa

SEQ ID NO: 1070379 - RNA, 14 nt, Homo sapiens
cuucaugcagguga

SEQ ID NO: 1070380 - RNA, 19 nt, Homo sapiens
cuuccagugcaacacugaa

SEQ ID NO: 1070381 - RNA, 17 nt, Homo sapiens
cuuccaugcuacaugua

SEQ ID NO: 1070382 - RNA, 22 nt, Homo sapiens
cuucccugucugccagggccag

SEQ ID NO: 1070383 - RNA, 13 nt, Homo sapiens
cuuccucacacca

SEQ ID NO: 1070384 - RNA, 16 nt, Homo sapiens
cuuccuuaugcuucuu

SEQ ID NO: 1070385 - RNA, 17 nt, Homo sapiens
cuucgacagcauuuucc

SEQ ID NO: 1070386 - RNA, 21 nt, Homo sapiens
cuucugaacguggcacucuuc

SEQ ID NO: 1070387 - RNA, 18 nt, Homo sapiens
cuucuucuuagcaccaca

SEQ ID NO: 1070388 - RNA, 17 nt, Homo sapiens
cuugagaagauucuucc

SEQ ID NO: 1070389 - RNA, 20 nt, Homo sapiens
cuuggaggugucuguaucag

SEQ ID NO: 1070390 - RNA, 10 nt, Homo sapiens
cuuggcugug

SEQ ID NO: 1070391 - RNA, 15 nt, Homo sapiens
aaaaacguauugcau

SEQ ID NO: 1070392 - RNA, 18 nt, Homo sapiens
aaaaauucauugucucua

SEQ ID NO: 1070393 - RNA, 20 nt, Homo sapiens
aaaacaguccuucaaacuuc

SEQ ID NO: 1070394 - RNA, 19 nt, Homo sapiens
aaaaccaggccuuaucucc

SEQ ID NO: 1070395 - RNA, 14 nt, Homo sapiens
aaaacguauugcau

SEQ ID NO: 1070396 - RNA, 11 nt, Homo sapiens
aaaacuacagg

SEQ ID NO: 1070397 - RNA, 15 nt, Homo sapiens
aaaagaaaacacuua

SEQ ID NO: 1070398 - RNA, 16 nt, Homo sapiens
aaaagcuacaguuuug

SEQ ID NO: 1070399 - RNA, 21 nt, Homo sapiens
aaaaggggcuccuugcuccac

SEQ ID NO: 1070400 - RNA, 15 nt, Homo sapiens
aaaauauuuugaucu

SEQ ID NO: 1070401 - RNA, 13 nt, Homo sapiens
aaaauucccauuu

SEQ ID NO: 1070402 - RNA, 12 nt, Homo sapiens
aaacaacagcuu

SEQ ID NO: 1070403 - RNA, 16 nt, Homo sapiens
aaacaacagcuuuaaa

SEQ ID NO: 1070404 - RNA, 13 nt, Homo sapiens
aaacaauuuaaac

SEQ ID NO: 1070405 - RNA, 21 nt, Homo sapiens
aaacacauuaagccuuccaca

SEQ ID NO: 1070406 - RNA, 15 nt, Homo sapiens
aaacagaugccccag

SEQ ID NO: 1070407 - RNA, 16 nt, Homo sapiens
aaacaugcacuuccuu

SEQ ID NO: 1070408 - RNA, 20 nt, Homo sapiens
aaacaugugguuaaugccau

SEQ ID NO: 1070409 - RNA, 18 nt, Homo sapiens
aaacauucaggagcuucc

SEQ ID NO: 1070410 - RNA, 17 nt, Homo sapiens
aaacauuggacagugag

SEQ ID NO: 1070411 - RNA, 14 nt, Homo sapiens
aaacauuuaccaau

SEQ ID NO: 1070412 - RNA, 20 nt, Homo sapiens
aaacauuuucacacaauaca

SEQ ID NO: 1070413 - RNA, 15 nt, Homo sapiens
aaaccaaaaacugaa

SEQ ID NO: 1070414 - RNA, 16 nt, Homo sapiens
aaacccagucacugug

SEQ ID NO: 1070415 - RNA, 14 nt, Homo sapiens
aaaccucuccucau

SEQ ID NO: 1070416 - RNA, 17 nt, Homo sapiens
aaacuacugcaccauuu

SEQ ID NO: 1070417 - RNA, 17 nt, Homo sapiens
aaacucuuuuucaucca

SEQ ID NO: 1070418 - RNA, 21 nt, Homo sapiens
aaacugcugucccaaacaugc

SEQ ID NO: 1070419 - RNA, 22 nt, Homo sapiens
aaacugcugucccaaacaugca

SEQ ID NO: 1070420 - RNA, 19 nt, Homo sapiens
aaacuuagacagcauguau

SEQ ID NO: 1070421 - RNA, 12 nt, Homo sapiens
aaagaacaugua

SEQ ID NO: 1070422 - RNA, 18 nt, Homo sapiens
aaagaaguucacaucaga

SEQ ID NO: 1070423 - RNA, 23 nt, Homo sapiens
aaagaauauuugguuuuccugua

SEQ ID NO: 1070424 - RNA, 20 nt, Homo sapiens
aaagaccugacaccuuucau

SEQ ID NO: 1070425 - RNA, 16 nt, Homo sapiens
aaagaggacaggcuac

SEQ ID NO: 1070426 - RNA, 20 nt, Homo sapiens
aaagauauaugaauaugaca

SEQ ID NO: 1070427 - RNA, 18 nt, Homo sapiens
aaagcacuguuucucuca

SEQ ID NO: 1070428 - RNA, 13 nt, Homo sapiens
aaagccacacucu

SEQ ID NO: 1070429 - RNA, 17 nt, Homo sapiens
aaagcggacaucagcug

SEQ ID NO: 1070430 - RNA, 13 nt, Homo sapiens
aaagcugcucagg

SEQ ID NO: 1070431 - RNA, 14 nt, Homo sapiens
aaagcuuugugcag

SEQ ID NO: 1070432 - RNA, 18 nt, Homo sapiens
aaaggaauguagcucaac

SEQ ID NO: 1070433 - RNA, 18 nt, Homo sapiens
aaaggagccuaggccagg

SEQ ID NO: 1070434 - RNA, 24 nt, Homo sapiens
aaaggcaaaaagcauguguuugca

SEQ ID NO: 1070435 - RNA, 16 nt, Homo sapiens
aaaggugagcccucau

SEQ ID NO: 1070436 - RNA, 18 nt, Homo sapiens
aaaguccccagagaaagc

SEQ ID NO: 1070437 - RNA, 16 nt, Homo sapiens
aaaguggaaauggaga

SEQ ID NO: 1070438 - RNA, 21 nt, Homo sapiens
aaagugugcuuaacauugaca

SEQ ID NO: 1070439 - RNA, 14 nt, Homo sapiens
aaaguucugggacu

SEQ ID NO: 1070440 - RNA, 15 nt, Homo sapiens
aaauaaaggaguuau

SEQ ID NO: 1070441 - RNA, 18 nt, Homo sapiens
ccuucauuuauagaugag

SEQ ID NO: 1070442 - RNA, 18 nt, Homo sapiens
ccuuccuuguagccuuuu

SEQ ID NO: 1070443 - RNA, 23 nt, Homo sapiens
ccuucgacagcauuuuccucugc

SEQ ID NO: 1070444 - RNA, 19 nt, Homo sapiens
ccuugaugagcugugcaca

SEQ ID NO: 1070445 - RNA, 21 nt, Homo sapiens
ccuugcgauucugcagccaca

SEQ ID NO: 1070446 - RNA, 17 nt, Homo sapiens
ccuuggcacccaagacc

SEQ ID NO: 1070447 - RNA, 22 nt, Homo sapiens
ccuuggcuuuuacugaagccuu

SEQ ID NO: 1070448 - RNA, 11 nt, Homo sapiens
ccuugucuccc

SEQ ID NO: 1070449 - RNA, 21 nt, Homo sapiens
ccuuuaaaaauaugcaccaaa

SEQ ID NO: 1070450 - RNA, 16 nt, Homo sapiens
ccuuucaaagccauuu

SEQ ID NO: 1070451 - RNA, 18 nt, Homo sapiens
cgcaccaauaaagccuuc

SEQ ID NO: 1070452 - RNA, 16 nt, Homo sapiens
cgcaccauugaacugu

SEQ ID NO: 1070453 - RNA, 21 nt, Homo sapiens
cggaaaccucccuuuacagca

SEQ ID NO: 1070454 - RNA, 15 nt, Homo sapiens
cggaauugcucuccc

SEQ ID NO: 1070455 - RNA, 22 nt, Homo sapiens
cgggagaucaugucucacuuca

SEQ ID NO: 1070456 - RNA, 15 nt, Homo sapiens
cgggugugaagcaca

SEQ ID NO: 1070457 - RNA, 11 nt, Homo sapiens
cgguucacucu

SEQ ID NO: 1070458 - RNA, 20 nt, Homo sapiens
cguccagggagcauuuuccu

SEQ ID NO: 1070459 - RNA, 16 nt, Homo sapiens
cgugaucaaagccaca

SEQ ID NO: 1070460 - RNA, 12 nt, Homo sapiens
cguuucuacuaa

SEQ ID NO: 1070461 - RNA, 15 nt, Homo sapiens
cuaaaauacauuuau

SEQ ID NO: 1070462 - RNA, 14 nt, Homo sapiens
cuaaaaugaguuac

SEQ ID NO: 1070463 - RNA, 15 nt, Homo sapiens
cuaaacaccacguca

SEQ ID NO: 1070464 - RNA, 12 nt, Homo sapiens
cuaaaccaaaaa

SEQ ID NO: 1070465 - RNA, 14 nt, Homo sapiens
cuaaagaguuuauu

SEQ ID NO: 1070466 - RNA, 16 nt, Homo sapiens
cuaaccugaacugaug

SEQ ID NO: 1070467 - RNA, 13 nt, Homo sapiens
cuaacuagcuugg

SEQ ID NO: 1070468 - RNA, 14 nt, Homo sapiens
cuaagcuggucuca

SEQ ID NO: 1070469 - RNA, 22 nt, Homo sapiens
cuaaggucauuaccacaggcca

SEQ ID NO: 1070470 - RNA, 20 nt, Homo sapiens
cuaaugauggcccauucuac

SEQ ID NO: 1070471 - RNA, 23 nt, Homo sapiens
cuacacuuugcuccucuggccca

SEQ ID NO: 1070472 - RNA, 14 nt, Homo sapiens
cuagacuggcugaa

SEQ ID NO: 1070473 - RNA, 15 nt, Homo sapiens
cuaggaagugaaagg

SEQ ID NO: 1070474 - RNA, 23 nt, Homo sapiens
cuaguuguaauuuuuuuguggga

SEQ ID NO: 1070475 - RNA, 16 nt, Homo sapiens
cuauauggcagugucu

SEQ ID NO: 1070476 - RNA, 21 nt, Homo sapiens
cuauguugccuaagcuggucu

SEQ ID NO: 1070477 - RNA, 12 nt, Homo sapiens
cuauuugcaauu

SEQ ID NO: 1070478 - RNA, 23 nt, Homo sapiens
cuauuuuuauuuguuugugcauu

SEQ ID NO: 1070479 - RNA, 20 nt, Homo sapiens
cucaagauuaucaacugugu

SEQ ID NO: 1070480 - RNA, 23 nt, Homo sapiens
cucaagcccgcggggacauuggg

SEQ ID NO: 1070481 - RNA, 12 nt, Homo sapiens
cucaagcugucc

SEQ ID NO: 1070482 - RNA, 23 nt, Homo sapiens
cucaagcuguccucccaccucag

SEQ ID NO: 1070483 - RNA, 23 nt, Homo sapiens
cucaaucuacaggccagcaccuu

SEQ ID NO: 1070484 - RNA, 18 nt, Homo sapiens
cucaccaaaugagaagaa

SEQ ID NO: 1070485 - RNA, 13 nt, Homo sapiens
cucacgccuguaa

SEQ ID NO: 1070486 - RNA, 20 nt, Homo sapiens
cucacgccuguaaucccagc

SEQ ID NO: 1070487 - RNA, 14 nt, Homo sapiens
cucacucaccuuca

SEQ ID NO: 1070488 - RNA, 21 nt, Homo sapiens
cucacugggccuccaaccaug

SEQ ID NO: 1070489 - RNA, 13 nt, Homo sapiens
cucagagugcaag

SEQ ID NO: 1070490 - RNA, 18 nt, Homo sapiens
cucagagugcaagccccu

SEQ ID NO: 1070491 - RNA, 16 nt, Homo sapiens
cucagccacugaagua

SEQ ID NO: 1070492 - RNA, 15 nt, Homo sapiens
cucauccugcaggca

SEQ ID NO: 1070493 - RNA, 14 nt, Homo sapiens
cucauucugucacc

SEQ ID NO: 1070494 - RNA, 20 nt, Homo sapiens
cucauuuacacucagcugcu

SEQ ID NO: 1070495 - RNA, 19 nt, Homo sapiens
cuccagagggaauugcaga

SEQ ID NO: 1070496 - RNA, 23 nt, Homo sapiens
cucccacugggguccagggagca

SEQ ID NO: 1070497 - RNA, 22 nt, Homo sapiens
cucccugggaggcgggcgcacu

SEQ ID NO: 1070498 - RNA, 16 nt, Homo sapiens
cuccucucuacuaaaa

SEQ ID NO: 1070499 - RNA, 16 nt, Homo sapiens
cuccugagggagcucc

SEQ ID NO: 1070500 - RNA, 19 nt, Homo sapiens
cuccugcccagcacaggaa

SEQ ID NO: 1070501 - RNA, 17 nt, Homo sapiens
cuccuguuuacugaaaa

SEQ ID NO: 1070502 - RNA, 19 nt, Homo sapiens
cucuaaaaugaguuaccua

SEQ ID NO: 1070503 - RNA, 20 nt, Homo sapiens
cucuccccucagagugcaag

SEQ ID NO: 1070504 - RNA, 21 nt, Homo sapiens
cucugagcagugcuugaauga

SEQ ID NO: 1070505 - RNA, 22 nt, Homo sapiens
cucugcuacucaaguagcauuu

SEQ ID NO: 1070506 - RNA, 16 nt, Homo sapiens
cucuucggaugaggcc

SEQ ID NO: 1070507 - RNA, 17 nt, Homo sapiens
cucuugaagacacugaa

SEQ ID NO: 1070508 - RNA, 17 nt, Homo sapiens
cugaaaauuaacacugc

SEQ ID NO: 1070509 - RNA, 12 nt, Homo sapiens
cugaacugaugg

SEQ ID NO: 1070510 - RNA, 18 nt, Homo sapiens
cugaagaaauugguccca

SEQ ID NO: 1070511 - RNA, 15 nt, Homo sapiens
cugaagcuguucuca

SEQ ID NO: 1070512 - RNA, 22 nt, Homo sapiens
cugagcagugcuugaaugaagu

SEQ ID NO: 1070513 - RNA, 19 nt, Homo sapiens
cugaguuguugagucuguu

SEQ ID NO: 1070514 - RNA, 16 nt, Homo sapiens
cugauaggacccauau

SEQ ID NO: 1070515 - RNA, 16 nt, Homo sapiens
cugaucaggaccucca

SEQ ID NO: 1070516 - RNA, 17 nt, Homo sapiens
cugcaaaucugccugau

SEQ ID NO: 1070517 - RNA, 18 nt, Homo sapiens
cugcaggccaggccagcu

SEQ ID NO: 1070518 - RNA, 23 nt, Homo sapiens
cugcaguggacaguccccaccuu

SEQ ID NO: 1070519 - RNA, 14 nt, Homo sapiens
cugccaacauacuu

SEQ ID NO: 1070520 - RNA, 13 nt, Homo sapiens
cugccagggccag

SEQ ID NO: 1070521 - RNA, 13 nt, Homo sapiens
cugcucacagucc

SEQ ID NO: 1070522 - RNA, 13 nt, Homo sapiens
cugcucauucuaa

SEQ ID NO: 1070523 - RNA, 16 nt, Homo sapiens
cugcuccccucugcac

SEQ ID NO: 1070524 - RNA, 23 nt, Homo sapiens
cugcuguaaauuuggcuucuguu

SEQ ID NO: 1070525 - RNA, 15 nt, Homo sapiens
cuggaaaaugaaucc

SEQ ID NO: 1070526 - RNA, 19 nt, Homo sapiens
cuggaaacauucaggagcu

SEQ ID NO: 1070527 - RNA, 18 nt, Homo sapiens
cuggaugcacuuucauua

SEQ ID NO: 1070528 - RNA, 14 nt, Homo sapiens
cuggcaugauccaa

SEQ ID NO: 1070529 - RNA, 14 nt, Homo sapiens
cuggcccaggugag

SEQ ID NO: 1070530 - RNA, 17 nt, Homo sapiens
cuggccuugggcccucu

SEQ ID NO: 1070531 - RNA, 15 nt, Homo sapiens
cugggcccacaaagg

SEQ ID NO: 1070532 - RNA, 22 nt, Homo sapiens
cugguccacagggcaccugcca

SEQ ID NO: 1070533 - RNA, 17 nt, Homo sapiens
cuguaaucccagcacuu

SEQ ID NO: 1070534 - RNA, 19 nt, Homo sapiens
cuguaaucccagcacuuug

SEQ ID NO: 1070535 - RNA, 21 nt, Homo sapiens
cuguacugggccauguugugc

SEQ ID NO: 1070536 - RNA, 18 nt, Homo sapiens
cuguauucccaguuacuu

SEQ ID NO: 1070537 - RNA, 23 nt, Homo sapiens
cugucacaucagcuccacuuuca

SEQ ID NO: 1070538 - RNA, 19 nt, Homo sapiens
cugucacccagacuggagu

SEQ ID NO: 1070539 - RNA, 18 nt, Homo sapiens
cugucacgugugggcaau

SEQ ID NO: 1070540 - RNA, 13 nt, Homo sapiens
cugucucagggug

SEQ ID NO: 1070541 - RNA, 16 nt, Homo sapiens
cugucucccgggacua

SEQ ID NO: 1070542 - RNA, 19 nt, Homo sapiens
cugucucuuucaugaguuu

SEQ ID NO: 1070543 - RNA, 17 nt, Homo sapiens
cugugaaaccccuaugu

SEQ ID NO: 1070544 - RNA, 18 nt, Homo sapiens
cugugcacaaaguggcau

SEQ ID NO: 1070545 - RNA, 13 nt, Homo sapiens
cuguuuaacuucu

SEQ ID NO: 1070546 - RNA, 14 nt, Homo sapiens
cuuaacuauucaau

SEQ ID NO: 1070547 - RNA, 15 nt, Homo sapiens
cuuaauauucuggag

SEQ ID NO: 1070548 - RNA, 22 nt, Homo sapiens
cuuaaugcagacaaacaaacau

SEQ ID NO: 1070549 - RNA, 13 nt, Homo sapiens
cuuacaucaggaa

SEQ ID NO: 1070550 - RNA, 22 nt, Homo sapiens
cuuaggugugauuauaaaauca

SEQ ID NO: 1070551 - RNA, 19 nt, Homo sapiens
cuuauaauuugcauaccau

SEQ ID NO: 1070552 - RNA, 12 nt, Homo sapiens
cuuaucacaaaa

SEQ ID NO: 1070553 - RNA, 23 nt, Homo sapiens
cuucacaaaccagagaccaaaug

SEQ ID NO: 1070554 - RNA, 18 nt, Homo sapiens
cuucacagcccugcagug

SEQ ID NO: 1070555 - RNA, 23 nt, Homo sapiens
cuucaccagauuuaaauaacugg

SEQ ID NO: 1070556 - RNA, 19 nt, Homo sapiens
cuucacuguccuccaagcc

SEQ ID NO: 1070557 - RNA, 22 nt, Homo sapiens
cuucacuguccuccaagccagc

SEQ ID NO: 1070558 - RNA, 23 nt, Homo sapiens
cuucacuguccuccaagccagcg

SEQ ID NO: 1070559 - RNA, 15 nt, Homo sapiens
gauccaaaguccugu

SEQ ID NO: 1070560 - RNA, 15 nt, Homo sapiens
gaugaagcauuuaca

SEQ ID NO: 1070561 - RNA, 20 nt, Homo sapiens
gaugacacaacugcacucca

SEQ ID NO: 1070562 - RNA, 22 nt, Homo sapiens
gaugacuuuuuauacuuuguaa

SEQ ID NO: 1070563 - RNA, 14 nt, Homo sapiens
gaugaggcccucau

SEQ ID NO: 1070564 - RNA, 18 nt, Homo sapiens
gaugcagaaaauugccua

SEQ ID NO: 1070565 - RNA, 19 nt, Homo sapiens
gaugcaguagacugcagug

SEQ ID NO: 1070566 - RNA, 20 nt, Homo sapiens
gauggacagacucacaaccu

SEQ ID NO: 1070567 - RNA, 15 nt, Homo sapiens
gauggcccauucuac

SEQ ID NO: 1070568 - RNA, 16 nt, Homo sapiens
gauucuucccauucuc

SEQ ID NO: 1070569 - RNA, 21 nt, Homo sapiens
gauuuaaucaccacucaaaaa

SEQ ID NO: 1070570 - RNA, 23 nt, Homo sapiens
gauuucaccacucaaaggccaga

SEQ ID NO: 1070571 - RNA, 22 nt, Homo sapiens
gauuuccccuuuugcauucucc

SEQ ID NO: 1070572 - RNA, 11 nt, Homo sapiens
gcaaaaaucuc

SEQ ID NO: 1070573 - RNA, 11 nt, Homo sapiens
gcaaacccaga

SEQ ID NO: 1070574 - RNA, 19 nt, Homo sapiens
gcaacagccacuacauuac

SEQ ID NO: 1070575 - RNA, 13 nt, Homo sapiens
gcaaugacucagg

SEQ ID NO: 1070576 - RNA, 21 nt, Homo sapiens
gcacauagugaaagauuacuu

SEQ ID NO: 1070577 - RNA, 16 nt, Homo sapiens
gcaccaauaaagccuu

SEQ ID NO: 1070578 - RNA, 12 nt, Homo sapiens
gcacucuagccu

SEQ ID NO: 1070579 - RNA, 17 nt, Homo sapiens
gcacuuugggaggccaa

SEQ ID NO: 1070580 - RNA, 20 nt, Homo sapiens
gcacuuugggaggccaagga

SEQ ID NO: 1070581 - RNA, 22 nt, Homo sapiens
gcagaagugcaauccagcccau

SEQ ID NO: 1070582 - RNA, 19 nt, Homo sapiens
gcagaccugacucucuuaa

SEQ ID NO: 1070583 - RNA, 15 nt, Homo sapiens
gcagaggcuguggug

SEQ ID NO: 1070584 - RNA, 18 nt, Homo sapiens
gcagccagaggcaccuca

SEQ ID NO: 1070585 - RNA, 21 nt, Homo sapiens
gcagccagaggcaccucaaga

SEQ ID NO: 1070586 - RNA, 19 nt, Homo sapiens
gcagugcuugaaugaaguu

SEQ ID NO: 1070587 - RNA, 17 nt, Homo sapiens
gcaguguucaaggccau

SEQ ID NO: 1070588 - RNA, 19 nt, Homo sapiens
gcaugagucagucugauga

SEQ ID NO: 1070589 - RNA, 20 nt, Homo sapiens
gcaugcaccuguagucucac

SEQ ID NO: 1070590 - RNA, 14 nt, Homo sapiens
gccaaaagcugcuc

SEQ ID NO: 1070591 - RNA, 16 nt, Homo sapiens
gccaacauacuuuaag

SEQ ID NO: 1070592 - RNA, 15 nt, Homo sapiens
gccaagagaccagcc

SEQ ID NO: 1070593 - RNA, 21 nt, Homo sapiens
gccaaggagggugagugcaag

SEQ ID NO: 1070594 - RNA, 18 nt, Homo sapiens
gccacaaauaaguuacau

SEQ ID NO: 1070595 - RNA, 21 nt, Homo sapiens
gccacaaauaaguuacaucua

SEQ ID NO: 1070596 - RNA, 13 nt, Homo sapiens
gccagaggcaccu

SEQ ID NO: 1070597 - RNA, 18 nt, Homo sapiens
gccauacuguaugcagua

SEQ ID NO: 1070598 - RNA, 15 nt, Homo sapiens
gccaucuuucuuugg

SEQ ID NO: 1070599 - RNA, 19 nt, Homo sapiens
gccauggauggaaaacgcu

SEQ ID NO: 1070600 - RNA, 19 nt, Homo sapiens
gcccaggcugggugcaguc

SEQ ID NO: 1070601 - RNA, 13 nt, Homo sapiens
gcccccccuucca

SEQ ID NO: 1070602 - RNA, 19 nt, Homo sapiens
gcccucagauuccgcacca

SEQ ID NO: 1070603 - RNA, 14 nt, Homo sapiens
gcccugacccugug

SEQ ID NO: 1070604 - RNA, 17 nt, Homo sapiens
gcccugacccuguggaa

SEQ ID NO: 1070605 - RNA, 13 nt, Homo sapiens
gccgccagggaga

SEQ ID NO: 1070606 - RNA, 18 nt, Homo sapiens
gccuccaucagcuaaaca

SEQ ID NO: 1070607 - RNA, 16 nt, Homo sapiens
gccucccaaguagcug

SEQ ID NO: 1070608 - RNA, 21 nt, Homo sapiens
gccuccugcccagcacaggaa

SEQ ID NO: 1070609 - RNA, 21 nt, Homo sapiens
gccucugugccgcaccauuga

SEQ ID NO: 1070610 - RNA, 18 nt, Homo sapiens
gccugaagaguccucuga

SEQ ID NO: 1070611 - RNA, 20 nt, Homo sapiens
gccuggccaguauggugaaa

SEQ ID NO: 1070612 - RNA, 19 nt, Homo sapiens
gccuuccagccacaucgcc

SEQ ID NO: 1070613 - RNA, 21 nt, Homo sapiens
gccuuuauuuuuaaccugcca

SEQ ID NO: 1070614 - RNA, 18 nt, Homo sapiens
gcgauccucccaccucag

SEQ ID NO: 1070615 - RNA, 14 nt, Homo sapiens
gcggacaguggcag

SEQ ID NO: 1070616 - RNA, 12 nt, Homo sapiens
gcgucaguuuuu

SEQ ID NO: 1070617 - RNA, 16 nt, Homo sapiens
gcuacaggggccagaa

SEQ ID NO: 1070618 - RNA, 20 nt, Homo sapiens
gcuacucaaguagcauuuac

SEQ ID NO: 1070619 - RNA, 16 nt, Homo sapiens
gcuauuugcaauuccu

SEQ ID NO: 1070620 - RNA, 12 nt, Homo sapiens
gcucacaguccu

SEQ ID NO: 1070621 - RNA, 21 nt, Homo sapiens
gcucagacaccugugugcugu

SEQ ID NO: 1070622 - RNA, 18 nt, Homo sapiens
gcucagggaaaagcagcu

SEQ ID NO: 1070623 - RNA, 16 nt, Homo sapiens
gcuccaaaccuucaca

SEQ ID NO: 1070624 - RNA, 15 nt, Homo sapiens
gcuccucacucaccu

SEQ ID NO: 1070625 - RNA, 17 nt, Homo sapiens
gcucugcuucaauguag

SEQ ID NO: 1070626 - RNA, 21 nt, Homo sapiens
gcucuuggaggugucuguauc

SEQ ID NO: 1070627 - RNA, 13 nt, Homo sapiens
gcugcucagggaa

SEQ ID NO: 1070628 - RNA, 21 nt, Homo sapiens
gcugggauguuucugucacau

SEQ ID NO: 1070629 - RNA, 18 nt, Homo sapiens
gcuguccucccaccucag

SEQ ID NO: 1070630 - RNA, 15 nt, Homo sapiens
gcugugggccaaaau

SEQ ID NO: 1070631 - RNA, 16 nt, Homo sapiens
gcuucaccccaauccc

SEQ ID NO: 1070632 - RNA, 14 nt, Homo sapiens
gcuucaggcaaagc

SEQ ID NO: 1070633 - RNA, 23 nt, Homo sapiens
gcuugauugcguggaauugugcu

SEQ ID NO: 1070634 - RNA, 16 nt, Homo sapiens
gcuuggcugugcccuc

SEQ ID NO: 1070635 - RNA, 14 nt, Homo sapiens
gcuuguguuuuuaa

SEQ ID NO: 1070636 - RNA, 19 nt, Homo sapiens
gcuuuaaaacuuauccucc

SEQ ID NO: 1070637 - RNA, 19 nt, Homo sapiens
gcuuuguuuugucuuacaa

SEQ ID NO: 1070638 - RNA, 12 nt, Homo sapiens
ggaaaaggaaug

SEQ ID NO: 1070639 - RNA, 17 nt, Homo sapiens
ggaaaggggcaggccag

SEQ ID NO: 1070640 - RNA, 11 nt, Homo sapiens
ggaauaaucuc

SEQ ID NO: 1070641 - RNA, 24 nt, Homo sapiens
ggaaucgguggucuccaccuguca

SEQ ID NO: 1070642 - RNA, 17 nt, Homo sapiens
ggaccuccaagccacug

SEQ ID NO: 1070643 - RNA, 18 nt, Homo sapiens
ggagaccuggacacaggc

SEQ ID NO: 1070644 - RNA, 16 nt, Homo sapiens
ggagcagaugcaauga

SEQ ID NO: 1070645 - RNA, 23 nt, Homo sapiens
ggagcuagccagaggacugugau

SEQ ID NO: 1070646 - RNA, 16 nt, Homo sapiens
ggagggugagugcaag

SEQ ID NO: 1070647 - RNA, 15 nt, Homo sapiens
ggagguaaugaauua

SEQ ID NO: 1070648 - RNA, 20 nt, Homo sapiens
ggauaacacuggcuucaggc

SEQ ID NO: 1070649 - RNA, 20 nt, Homo sapiens
ggcaaucacggcucacugua

SEQ ID NO: 1070650 - RNA, 21 nt, Homo sapiens
ggcaauguucccccucuccuc

SEQ ID NO: 1070651 - RNA, 16 nt, Homo sapiens
ggcacaaagaugggug

SEQ ID NO: 1070652 - RNA, 20 nt, Homo sapiens
ggcacacgccucccacuggg

SEQ ID NO: 1070653 - RNA, 19 nt, Homo sapiens
ggcagaguucuauaaugua

SEQ ID NO: 1070654 - RNA, 21 nt, Homo sapiens
ggcaugagcuacuaugcccaa

SEQ ID NO: 1070655 - RNA, 17 nt, Homo sapiens
ggcaugauccaagcaag

SEQ ID NO: 1070656 - RNA, 19 nt, Homo sapiens
ggcaugauccaagcaagac

SEQ ID NO: 1070657 - RNA, 18 nt, Homo sapiens
ggcauuaggaguguuuca

SEQ ID NO: 1070658 - RNA, 20 nt, Homo sapiens
ggccaaggagggcagaucac

SEQ ID NO: 1070659 - RNA, 20 nt, Homo sapiens
ggcccucuugaaucucugaa

SEQ ID NO: 1070660 - RNA, 15 nt, Homo sapiens
ggccuggcagcucag

SEQ ID NO: 1070661 - RNA, 20 nt, Homo sapiens
ggcgccgcaaaccacacugg

SEQ ID NO: 1070662 - RNA, 20 nt, Homo sapiens
ggcugcaugauguuugccca

SEQ ID NO: 1070663 - RNA, 24 nt, Homo sapiens
ggcuuuaaaacuuauccuccauga

SEQ ID NO: 1070664 - RNA, 16 nt, Homo sapiens
gggaaaaggggcuccu

SEQ ID NO: 1070665 - RNA, 15 nt, Homo sapiens
gggaauugcagagua

SEQ ID NO: 1070666 - RNA, 16 nt, Homo sapiens
gggaauuuauugccuc

SEQ ID NO: 1070667 - RNA, 20 nt, Homo sapiens
gggacauugggaaggggacc

SEQ ID NO: 1070668 - RNA, 15 nt, Homo sapiens
gggagcagaugcaau

SEQ ID NO: 1070669 - RNA, 22 nt, Homo sapiens
gggcacacgccucccacugggg

SEQ ID NO: 1070670 - RNA, 18 nt, Homo sapiens
gggcgaucgcggcggagc

SEQ ID NO: 1070671 - RNA, 14 nt, Homo sapiens
gggcuccugaggga

SEQ ID NO: 1070672 - RNA, 17 nt, Homo sapiens
ggggagacuucuuggcu

SEQ ID NO: 1070673 - RNA, 19 nt, Homo sapiens
ggggaugacaugcacucag

SEQ ID NO: 1070674 - RNA, 14 nt, Homo sapiens
ggggccuguuacac

SEQ ID NO: 1070675 - RNA, 15 nt, Homo sapiens
ggggguuggauuuga

SEQ ID NO: 1070676 - RNA, 13 nt, Homo sapiens
gggugagugcaag

SEQ ID NO: 1070677 - RNA, 13 nt, Homo sapiens
ccucaguucuugc

SEQ ID NO: 1070678 - RNA, 17 nt, Homo sapiens
ccucaguucuugccacu

SEQ ID NO: 1070679 - RNA, 18 nt, Homo sapiens
ccucgacguuuacaagcc

SEQ ID NO: 1070680 - RNA, 16 nt, Homo sapiens
ccucuaaaacaguccu

SEQ ID NO: 1070681 - RNA, 14 nt, Homo sapiens
ccugacaccuuuca

SEQ ID NO: 1070682 - RNA, 12 nt, Homo sapiens
ccugacccugua

SEQ ID NO: 1070683 - RNA, 15 nt, Homo sapiens
ccugagggagcucca

SEQ ID NO: 1070684 - RNA, 16 nt, Homo sapiens
ccugauuaacugaggc

SEQ ID NO: 1070685 - RNA, 15 nt, Homo sapiens
ccugauuauuuucua

SEQ ID NO: 1070686 - RNA, 14 nt, Homo sapiens
ccugcaggcagcuu

SEQ ID NO: 1070687 - RNA, 15 nt, Homo sapiens
ccugcuuaaugaaaa

SEQ ID NO: 1070688 - RNA, 21 nt, Homo sapiens
ccuggcaaagaugaucaguau

SEQ ID NO: 1070689 - RNA, 16 nt, Homo sapiens
ccugguccacagggca

SEQ ID NO: 1070690 - RNA, 13 nt, Homo sapiens
ccugucucagggu

SEQ ID NO: 1070691 - RNA, 13 nt, Homo sapiens
ccuguucuuuuaa

SEQ ID NO: 1070692 - RNA, 15 nt, Homo sapiens
ccuguuuuuuugcuu

SEQ ID NO: 1070693 - RNA, 13 nt, Homo sapiens
ccuucaaacuucc

SEQ ID NO: 1070694 - RNA, 13 nt, Homo sapiens
ccuuccagccaca

SEQ ID NO: 1070695 - RNA, 11 nt, Homo sapiens
ccuuccagggg

SEQ ID NO: 1070696 - RNA, 16 nt, Homo sapiens
ccuuccuaagacuucu

SEQ ID NO: 1070697 - RNA, 17 nt, Homo sapiens
ccuuccuuguagccuuu

SEQ ID NO: 1070698 - RNA, 19 nt, Homo sapiens
ccuuucaagguaacuguac

SEQ ID NO: 1070699 - RNA, 14 nt, Homo sapiens
ccuuuguacuuugu

SEQ ID NO: 1070700 - RNA, 15 nt, Homo sapiens
ccuuuguacuuugug

SEQ ID NO: 1070701 - RNA, 16 nt, Homo sapiens
cgaauagccacugcau

SEQ ID NO: 1070702 - RNA, 19 nt, Homo sapiens
cgagcaccuguaaucccag

SEQ ID NO: 1070703 - RNA, 19 nt, Homo sapiens
cgcaggaagacccaacaca

SEQ ID NO: 1070704 - RNA, 23 nt, Homo sapiens
cgcgugaucaaagccacacucug

SEQ ID NO: 1070705 - RNA, 18 nt, Homo sapiens
cggaccaugcgacacugg

SEQ ID NO: 1070706 - RNA, 22 nt, Homo sapiens
cgggcuaggaagaucucugcag

SEQ ID NO: 1070707 - RNA, 21 nt, Homo sapiens
cgugggcugggcccacaaagg

SEQ ID NO: 1070708 - RNA, 23 nt, Homo sapiens
cguuuacaagcccccccuuccac

SEQ ID NO: 1070709 - RNA, 21 nt, Homo sapiens
cuaaacaccacgucacuucau

SEQ ID NO: 1070710 - RNA, 16 nt, Homo sapiens
cuaacuaucaaauaga

SEQ ID NO: 1070711 - RNA, 21 nt, Homo sapiens
cuaacuuuuuugcuauccagc

SEQ ID NO: 1070712 - RNA, 18 nt, Homo sapiens
cuaaugucaaacuugagu

SEQ ID NO: 1070713 - RNA, 15 nt, Homo sapiens
cuaauucaacauaua

SEQ ID NO: 1070714 - RNA, 16 nt, Homo sapiens
cuaauucuugcauauu

SEQ ID NO: 1070715 - RNA, 15 nt, Homo sapiens
cuacauuuuaaugca

SEQ ID NO: 1070716 - RNA, 18 nt, Homo sapiens
cuaccuuuugcuguggca

SEQ ID NO: 1070717 - RNA, 19 nt, Homo sapiens
cuacucgagaggcugaggc

SEQ ID NO: 1070718 - RNA, 15 nt, Homo sapiens
cuacugcaccauuua

SEQ ID NO: 1070719 - RNA, 21 nt, Homo sapiens
cuagacuggcugaaaaaccua

SEQ ID NO: 1070720 - RNA, 16 nt, Homo sapiens
cuagagcuacaggggu

SEQ ID NO: 1070721 - RNA, 23 nt, Homo sapiens
cuagaguauggagagauggucag

SEQ ID NO: 1070722 - RNA, 18 nt, Homo sapiens
cuagccagaggacuguga

SEQ ID NO: 1070723 - RNA, 19 nt, Homo sapiens
cuagccagaggacugugau

SEQ ID NO: 1070724 - RNA, 18 nt, Homo sapiens
cuaggaagaucucugcag

SEQ ID NO: 1070725 - RNA, 13 nt, Homo sapiens
cuauaacugccca

SEQ ID NO: 1070726 - RNA, 22 nt, Homo sapiens
cuauaauuguauauaugccuuu

SEQ ID NO: 1070727 - RNA, 11 nt, Homo sapiens
cuauccagcua

SEQ ID NO: 1070728 - RNA, 15 nt, Homo sapiens
cuaugcaauucuuaa

SEQ ID NO: 1070729 - RNA, 22 nt, Homo sapiens
cuaugucuuguuuuaaguugcu

SEQ ID NO: 1070730 - RNA, 23 nt, Homo sapiens
cuauguugccuaagcuggucuca

SEQ ID NO: 1070731 - RNA, 23 nt, Homo sapiens
cuauuguggguuuuuuugaaugu

SEQ ID NO: 1070732 - RNA, 22 nt, Homo sapiens
cuauuuugaaguaccaccaaaa

SEQ ID NO: 1070733 - RNA, 22 nt, Homo sapiens
cuauuuuuauuuguuugugcau

SEQ ID NO: 1070734 - RNA, 18 nt, Homo sapiens
cucaagcccgcggggaca

SEQ ID NO: 1070735 - RNA, 11 nt, Homo sapiens
cucacaguccu

SEQ ID NO: 1070736 - RNA, 14 nt, Homo sapiens
cucacauaggaagu

SEQ ID NO: 1070737 - RNA, 15 nt, Homo sapiens
cucagcccugacccu

SEQ ID NO: 1070738 - RNA, 17 nt, Homo sapiens
cucaucaucaacccuaa

SEQ ID NO: 1070739 - RNA, 18 nt, Homo sapiens
cuccagagggaauugcag

SEQ ID NO: 1070740 - RNA, 22 nt, Homo sapiens
cuccagcuugggcaacagggcg

SEQ ID NO: 1070741 - RNA, 21 nt, Homo sapiens
cucccacugggguccagggag

SEQ ID NO: 1070742 - RNA, 15 nt, Homo sapiens
cucgggcuaggaaga

SEQ ID NO: 1070743 - RNA, 20 nt, Homo sapiens
cucuaacaauguauuuucuu

SEQ ID NO: 1070744 - RNA, 19 nt, Homo sapiens
cucuagacaacuaccccuu

SEQ ID NO: 1070745 - RNA, 17 nt, Homo sapiens
cucucccugacccugua

SEQ ID NO: 1070746 - RNA, 22 nt, Homo sapiens
gauacugcugcgucauuacagg

SEQ ID NO: 1070747 - RNA, 15 nt, Homo sapiens
gauagucucauucug

SEQ ID NO: 1070748 - RNA, 12 nt, Homo sapiens
gauauaauacua

SEQ ID NO: 1070749 - RNA, 21 nt, Homo sapiens
gaugauggcucauuuacacuc

SEQ ID NO: 1070750 - RNA, 17 nt, Homo sapiens
gaugauuuguggaaaag

SEQ ID NO: 1070751 - RNA, 18 nt, Homo sapiens
gaugcaaugacucaggac

SEQ ID NO: 1070752 - RNA, 14 nt, Homo sapiens
gaugcuauuugcaa

SEQ ID NO: 1070753 - RNA, 19 nt, Homo sapiens
gaugcugugaaauucccaa

SEQ ID NO: 1070754 - RNA, 18 nt, Homo sapiens
gauggaaaggagccuagg

SEQ ID NO: 1070755 - RNA, 18 nt, Homo sapiens
gaugucauauuccauuuu

SEQ ID NO: 1070756 - RNA, 14 nt, Homo sapiens
gaugugguugcaua

SEQ ID NO: 1070757 - RNA, 12 nt, Homo sapiens
gauuaacuauga

SEQ ID NO: 1070758 - RNA, 19 nt, Homo sapiens
gauuaugagacacaggaug

SEQ ID NO: 1070759 - RNA, 20 nt, Homo sapiens
gauuccucuuuucucugcca

SEQ ID NO: 1070760 - RNA, 15 nt, Homo sapiens
gauuuagauaugcaa

SEQ ID NO: 1070761 - RNA, 20 nt, Homo sapiens
gcaaaaccucaucauuacua

SEQ ID NO: 1070762 - RNA, 17 nt, Homo sapiens
gcaaaauauaucacuuu

SEQ ID NO: 1070763 - RNA, 17 nt, Homo sapiens
gcaaagaugaucaguau

SEQ ID NO: 1070764 - RNA, 20 nt, Homo sapiens
gcaagguuauaugcacuuuc

SEQ ID NO: 1070765 - RNA, 18 nt, Homo sapiens
gcaauggcuccuucacaa

SEQ ID NO: 1070766 - RNA, 22 nt, Homo sapiens
gcaauucuaacuuuuuugcuau

SEQ ID NO: 1070767 - RNA, 17 nt, Homo sapiens
gcacagaccccuuccag

SEQ ID NO: 1070768 - RNA, 13 nt, Homo sapiens
gcacaggccaugg

SEQ ID NO: 1070769 - RNA, 18 nt, Homo sapiens
gcaccaauaaagccuuca

SEQ ID NO: 1070770 - RNA, 17 nt, Homo sapiens
gcacccacuuaaucuac

SEQ ID NO: 1070771 - RNA, 16 nt, Homo sapiens
gcagaaaauugccuaa

SEQ ID NO: 1070772 - RNA, 22 nt, Homo sapiens
gcagaggauaauuagcaucuca

SEQ ID NO: 1070773 - RNA, 20 nt, Homo sapiens
gcagaguacuggcugaugga

SEQ ID NO: 1070774 - RNA, 23 nt, Homo sapiens
gcagcucuccccucagagugcaa

SEQ ID NO: 1070775 - RNA, 16 nt, Homo sapiens
gcaggugaaacccagu

SEQ ID NO: 1070776 - RNA, 21 nt, Homo sapiens
gcaguaaaauagcugagggaa

SEQ ID NO: 1070777 - RNA, 20 nt, Homo sapiens
gcauaccauuaaauaaugca

SEQ ID NO: 1070778 - RNA, 18 nt, Homo sapiens
gcauucucccuccuuccc

SEQ ID NO: 1070779 - RNA, 19 nt, Homo sapiens
gccaaaagcugcucaggga

SEQ ID NO: 1070780 - RNA, 20 nt, Homo sapiens
gccaaggagggugagugcaa

SEQ ID NO: 1070781 - RNA, 22 nt, Homo sapiens
gccaaggcggguggaucacuug

SEQ ID NO: 1070782 - RNA, 12 nt, Homo sapiens
gccacacucugg

SEQ ID NO: 1070783 - RNA, 21 nt, Homo sapiens
gccacguauguuuuuguguau

SEQ ID NO: 1070784 - RNA, 21 nt, Homo sapiens
gccagaagaugaacagacuga

SEQ ID NO: 1070785 - RNA, 16 nt, Homo sapiens
gccagaggacugugau

SEQ ID NO: 1070786 - RNA, 15 nt, Homo sapiens
gccauugcacuccag

SEQ ID NO: 1070787 - RNA, 15 nt, Homo sapiens
gcccaaccuauccug

SEQ ID NO: 1070788 - RNA, 17 nt, Homo sapiens
gcccagaaagucucuca

SEQ ID NO: 1070789 - RNA, 14 nt, Homo sapiens
gcccagaugugguu

SEQ ID NO: 1070790 - RNA, 15 nt, Homo sapiens
gcccagcacaggaau

SEQ ID NO: 1070791 - RNA, 17 nt, Homo sapiens
gcccagucgacgucagc

SEQ ID NO: 1070792 - RNA, 17 nt, Homo sapiens
gccccugcuccagaaga

SEQ ID NO: 1070793 - RNA, 16 nt, Homo sapiens
gcccuaaaagcacacu

SEQ ID NO: 1070794 - RNA, 16 nt, Homo sapiens
gcccucauccauuuau

SEQ ID NO: 1070795 - RNA, 18 nt, Homo sapiens
gcccuggccucugcucaa

SEQ ID NO: 1070796 - RNA, 14 nt, Homo sapiens
gccgcaccauugaa

SEQ ID NO: 1070797 - RNA, 17 nt, Homo sapiens
gccugguacucaagccc

SEQ ID NO: 1070798 - RNA, 21 nt, Homo sapiens
gccuuaggaaaagcauuugcu

SEQ ID NO: 1070799 - RNA, 13 nt, Homo sapiens
gcgacacugggag

SEQ ID NO: 1070800 - RNA, 19 nt, Homo sapiens
gcgcccaguccuuccaccu

SEQ ID NO: 1070801 - RNA, 11 nt, Homo sapiens
gcgggggcuug

SEQ ID NO: 1070802 - RNA, 22 nt, Homo sapiens
gcuaaauucacagcgcuaugca

SEQ ID NO: 1070803 - RNA, 21 nt, Homo sapiens
gcuacaaucuguucaauguuu

SEQ ID NO: 1070804 - RNA, 18 nt, Homo sapiens
gcuacaggagcauaccac

SEQ ID NO: 1070805 - RNA, 22 nt, Homo sapiens
gcuacccgcagaguucucagaa

SEQ ID NO: 1070806 - RNA, 22 nt, Homo sapiens
gcucacugaaaagacuauugug

SEQ ID NO: 1070807 - RNA, 19 nt, Homo sapiens
gcucauuuacacucagcug

SEQ ID NO: 1070808 - RNA, 14 nt, Homo sapiens
gcuccacuaggacu

SEQ ID NO: 1070809 - RNA, 13 nt, Homo sapiens
gcuccacugggau

SEQ ID NO: 1070810 - RNA, 12 nt, Homo sapiens
gcucccaggugc

SEQ ID NO: 1070811 - RNA, 18 nt, Homo sapiens
gcugcaggggcaugggaa

SEQ ID NO: 1070812 - RNA, 17 nt, Homo sapiens
gcugcuucuauguuuca

SEQ ID NO: 1070813 - RNA, 19 nt, Homo sapiens
gcuguuuauuaaugcugaa

SEQ ID NO: 1070814 - RNA, 15 nt, Homo sapiens
gcuuaacccuggaaa

SEQ ID NO: 1070815 - RNA, 16 nt, Homo sapiens
gcuuauaagacaauga

SEQ ID NO: 1070816 - RNA, 16 nt, Homo sapiens
gcuucuauguuucaua

SEQ ID NO: 1070817 - RNA, 20 nt, Homo sapiens
gcuugaucaaaggcacacag

SEQ ID NO: 1070818 - RNA, 18 nt, Homo sapiens
gcuuggcugugcccucag

SEQ ID NO: 1070819 - RNA, 17 nt, Homo sapiens
caacuacagaaaaacca

SEQ ID NO: 1070820 - RNA, 14 nt, Homo sapiens
caacuuaacaugaa

SEQ ID NO: 1070821 - RNA, 22 nt, Homo sapiens
caacuuccaaauuggauacugc

SEQ ID NO: 1070822 - RNA, 13 nt, Homo sapiens
caagagaccagcc

SEQ ID NO: 1070823 - RNA, 14 nt, Homo sapiens
caagagaccagccu

SEQ ID NO: 1070824 - RNA, 17 nt, Homo sapiens
caagcccccccuuccac

SEQ ID NO: 1070825 - RNA, 19 nt, Homo sapiens
caaggagggugagugcaag

SEQ ID NO: 1070826 - RNA, 14 nt, Homo sapiens
caagguaacuguac

SEQ ID NO: 1070827 - RNA, 23 nt, Homo sapiens
caagguaacuguacugggccaug

SEQ ID NO: 1070828 - RNA, 15 nt, Homo sapiens
caagguuauaugcac

SEQ ID NO: 1070829 - RNA, 17 nt, Homo sapiens
caagucuaacaguuaau

SEQ ID NO: 1070830 - RNA, 17 nt, Homo sapiens
caaguuauagauucaau

SEQ ID NO: 1070831 - RNA, 19 nt, Homo sapiens
caauaaagccuucaaacuc

SEQ ID NO: 1070832 - RNA, 23 nt, Homo sapiens
caauaaugugacgaaaguggaaa

SEQ ID NO: 1070833 - RNA, 16 nt, Homo sapiens
caaugcauucugaggu

SEQ ID NO: 1070834 - RNA, 23 nt, Homo sapiens
caaugugucuuucuuuuuggaca

SEQ ID NO: 1070835 - RNA, 18 nt, Homo sapiens
caauucaaauugacugaa

SEQ ID NO: 1070836 - RNA, 14 nt, Homo sapiens
cacaaaguggcaua

SEQ ID NO: 1070837 - RNA, 20 nt, Homo sapiens
cacacagcaagucaggguug

SEQ ID NO: 1070838 - RNA, 16 nt, Homo sapiens
cacacagcaguagcag

SEQ ID NO: 1070839 - RNA, 14 nt, Homo sapiens
cacaccauucaggu

SEQ ID NO: 1070840 - RNA, 18 nt, Homo sapiens
cacacucaccucuaaaac

SEQ ID NO: 1070841 - RNA, 21 nt, Homo sapiens
cacagacucauauuacuggua

SEQ ID NO: 1070842 - RNA, 15 nt, Homo sapiens
cacagggacugaaaa

SEQ ID NO: 1070843 - RNA, 12 nt, Homo sapiens
cacaguccucau

SEQ ID NO: 1070844 - RNA, 13 nt, Homo sapiens
cacauacauguaa

SEQ ID NO: 1070845 - RNA, 16 nt, Homo sapiens
caccacgucacuucau

SEQ ID NO: 1070846 - RNA, 22 nt, Homo sapiens
caccauugaacuguaccaugug

SEQ ID NO: 1070847 - RNA, 18 nt, Homo sapiens
cacccacuucccugcagg

SEQ ID NO: 1070848 - RNA, 16 nt, Homo sapiens
caccugcuggagugaa

SEQ ID NO: 1070849 - RNA, 21 nt, Homo sapiens
caccugugugcuguagauuca

SEQ ID NO: 1070850 - RNA, 23 nt, Homo sapiens
caccuuucauaaucuuugcuuua

SEQ ID NO: 1070851 - RNA, 18 nt, Homo sapiens
cacucauccccucacuug

SEQ ID NO: 1070852 - RNA, 21 nt, Homo sapiens
cacucuucugaauugacugua

SEQ ID NO: 1070853 - RNA, 13 nt, Homo sapiens
cacugcauaccaa

SEQ ID NO: 1070854 - RNA, 14 nt, Homo sapiens
cacugcauaccaac

SEQ ID NO: 1070855 - RNA, 18 nt, Homo sapiens
cagaacacccaauucaaa

SEQ ID NO: 1070856 - RNA, 16 nt, Homo sapiens
cagaacacugucuuga

SEQ ID NO: 1070857 - RNA, 21 nt, Homo sapiens
cagaaucccguaacaccugau

SEQ ID NO: 1070858 - RNA, 21 nt, Homo sapiens
cagacaacacugggaaacaga

SEQ ID NO: 1070859 - RNA, 23 nt, Homo sapiens
cagagaagcucucgggcuaggaa

SEQ ID NO: 1070860 - RNA, 17 nt, Homo sapiens
cagagaccaaaugucac

SEQ ID NO: 1070861 - RNA, 21 nt, Homo sapiens
cagagcugcuccccucugcac

SEQ ID NO: 1070862 - RNA, 16 nt, Homo sapiens
cagagucaaugaacuu

SEQ ID NO: 1070863 - RNA, 12 nt, Homo sapiens
cagagugcaagc

SEQ ID NO: 1070864 - RNA, 18 nt, Homo sapiens
cagaguggggaugacaug

SEQ ID NO: 1070865 - RNA, 22 nt, Homo sapiens
cagaucacuucaggucaggagu

SEQ ID NO: 1070866 - RNA, 12 nt, Homo sapiens
cagaugcaauga

SEQ ID NO: 1070867 - RNA, 14 nt, Homo sapiens
cagauggcauaaau

SEQ ID NO: 1070868 - RNA, 22 nt, Homo sapiens
cagauuuuagaggggggaaauu

SEQ ID NO: 1070869 - RNA, 16 nt, Homo sapiens
cagcaagucaggguug

SEQ ID NO: 1070870 - RNA, 14 nt, Homo sapiens
cagcacuaauucaa

SEQ ID NO: 1070871 - RNA, 15 nt, Homo sapiens
cagcacuaauucaac

SEQ ID NO: 1070872 - RNA, 17 nt, Homo sapiens
cagcacuaauucaacau

SEQ ID NO: 1070873 - RNA, 18 nt, Homo sapiens
cagccagaggcaccucaa

SEQ ID NO: 1070874 - RNA, 12 nt, Homo sapiens
cagccagggccu

SEQ ID NO: 1070875 - RNA, 15 nt, Homo sapiens
cagccugcuuucaca

SEQ ID NO: 1070876 - RNA, 22 nt, Homo sapiens
cagccuggccaagagaccagcc

SEQ ID NO: 1070877 - RNA, 19 nt, Homo sapiens
cagccuggccaguauggug

SEQ ID NO: 1070878 - RNA, 21 nt, Homo sapiens
cagcguggucugucauccugc

SEQ ID NO: 1070879 - RNA, 20 nt, Homo sapiens
cagcucagcuuccccaacac

SEQ ID NO: 1070880 - RNA, 11 nt, Homo sapiens
cagcucagggc

SEQ ID NO: 1070881 - RNA, 14 nt, Homo sapiens
cagcuucuuugcca

SEQ ID NO: 1070882 - RNA, 15 nt, Homo sapiens
caggacaguauuccu

SEQ ID NO: 1070883 - RNA, 15 nt, Homo sapiens
caggaccuccaagcc

SEQ ID NO: 1070884 - RNA, 15 nt, Homo sapiens
caggagcacuacaga

SEQ ID NO: 1070885 - RNA, 20 nt, Homo sapiens
caggcaugaaauacugugcc

SEQ ID NO: 1070886 - RNA, 13 nt, Homo sapiens
cagggcugauaag

SEQ ID NO: 1070887 - RNA, 17 nt, Homo sapiens
cagggugaggugcuuga

SEQ ID NO: 1070888 - RNA, 19 nt, Homo sapiens
caggugaauuguuugaacc

SEQ ID NO: 1070889 - RNA, 21 nt, Homo sapiens
caggugcagccagaggcaccu

SEQ ID NO: 1070890 - RNA, 14 nt, Homo sapiens
caggugguaaaaau

SEQ ID NO: 1070891 - RNA, 19 nt, Homo sapiens
cagguuaagugugaguaau

SEQ ID NO: 1070892 - RNA, 19 nt, Homo sapiens
caguauuaaaauuuggcca

SEQ ID NO: 1070893 - RNA, 15 nt, Homo sapiens
cagucaauuaacaau

SEQ ID NO: 1070894 - RNA, 13 nt, Homo sapiens
cagucacugugag

SEQ ID NO: 1070895 - RNA, 18 nt, Homo sapiens
caguccucauuuacugga

SEQ ID NO: 1070896 - RNA, 23 nt, Homo sapiens
cagucuuccucccuguguauuca

SEQ ID NO: 1070897 - RNA, 13 nt, Homo sapiens
caguucuugccac

SEQ ID NO: 1070898 - RNA, 22 nt, Homo sapiens
caguuuaucgaccaguuugaau

SEQ ID NO: 1070899 - RNA, 17 nt, Homo sapiens
cauaaaaagacaacuca

SEQ ID NO: 1070900 - RNA, 19 nt, Homo sapiens
cauaaaauguaucuuccau

SEQ ID NO: 1070901 - RNA, 21 nt, Homo sapiens
cauaaacuuuccucuuccugc

SEQ ID NO: 1070902 - RNA, 16 nt, Homo sapiens
cauaaaguaugugcau

SEQ ID NO: 1070903 - RNA, 17 nt, Homo sapiens
cauaaaguaugugcaua

SEQ ID NO: 1070904 - RNA, 15 nt, Homo sapiens
cauaaaugauuaauu

SEQ ID NO: 1070905 - RNA, 22 nt, Homo sapiens
cauaauuaauguaguaguaaua

SEQ ID NO: 1070906 - RNA, 13 nt, Homo sapiens
cauagauguuucc

SEQ ID NO: 1070907 - RNA, 21 nt, Homo sapiens
cauauauguauauauaugcac

SEQ ID NO: 1070908 - RNA, 22 nt, Homo sapiens
cauauauuggguuccauucuca

SEQ ID NO: 1070909 - RNA, 19 nt, Homo sapiens
cauauucccacagcacuaa

SEQ ID NO: 1070910 - RNA, 13 nt, Homo sapiens
cauauuucuuugg

SEQ ID NO: 1070911 - RNA, 19 nt, Homo sapiens
cauauuuuauuauagucac

SEQ ID NO: 1070912 - RNA, 17 nt, Homo sapiens
cauccucacugcuguca

SEQ ID NO: 1070913 - RNA, 19 nt, Homo sapiens
caucguuuucuucacuguc

SEQ ID NO: 1070914 - RNA, 14 nt, Homo sapiens
caucucucuuuaau

SEQ ID NO: 1070915 - RNA, 21 nt, Homo sapiens
caucugaagaaauugguccca

SEQ ID NO: 1070916 - RNA, 15 nt, Homo sapiens
caugaagaggaugcu

SEQ ID NO: 1070917 - RNA, 13 nt, Homo sapiens
caugauccaagca

SEQ ID NO: 1070918 - RNA, 15 nt, Homo sapiens
caugauccaagcaag

SEQ ID NO: 1070919 - RNA, 21 nt, Homo sapiens
caugauccaagcaagacugag

SEQ ID NO: 1070920 - RNA, 18 nt, Homo sapiens
caugcaccuguagucuca

SEQ ID NO: 1070921 - RNA, 15 nt, Homo sapiens
caugcagucugggag

SEQ ID NO: 1070922 - RNA, 20 nt, Homo sapiens
cauuacagggcacaggccau

SEQ ID NO: 1070923 - RNA, 13 nt, Homo sapiens
cauuaucagucca

SEQ ID NO: 1070924 - RNA, 16 nt, Homo sapiens
cauucugcucuuugau

SEQ ID NO: 1070925 - RNA, 12 nt, Homo sapiens
cauugaugcuga

SEQ ID NO: 1070926 - RNA, 23 nt, Homo sapiens
cauuuaaaaacaggcagcucaua

SEQ ID NO: 1070927 - RNA, 15 nt, Homo sapiens
cauuuaccaaucaua

SEQ ID NO: 1070928 - RNA, 14 nt, Homo sapiens
cauuugauauguga

SEQ ID NO: 1070929 - RNA, 15 nt, Homo sapiens
cauuuucuaaacaga

SEQ ID NO: 1070930 - RNA, 13 nt, Homo sapiens
cauuuuuacuguu

SEQ ID NO: 1070931 - RNA, 13 nt, Homo sapiens
ccaaacaugcacu

SEQ ID NO: 1070932 - RNA, 15 nt, Homo sapiens
ccaaaucaucucuca

SEQ ID NO: 1070933 - RNA, 22 nt, Homo sapiens
ccaaauuggauacugcugccaa

SEQ ID NO: 1070934 - RNA, 23 nt, Homo sapiens
ccaacacaugggaccuauaacug

SEQ ID NO: 1070935 - RNA, 16 nt, Homo sapiens
ccaaggagaugaagca

SEQ ID NO: 1070936 - RNA, 21 nt, Homo sapiens
ccaaggagggugagugcaagg

SEQ ID NO: 1070937 - RNA, 18 nt, Homo sapiens
ccaaugccaaaaaaagac

SEQ ID NO: 1070938 - RNA, 21 nt, Homo sapiens
ccacaguggaaagacagcuuc

SEQ ID NO: 1070939 - RNA, 19 nt, Homo sapiens
ccaccugcuggagugaagg

SEQ ID NO: 1070940 - RNA, 17 nt, Homo sapiens
ccacgucacuucaugca

SEQ ID NO: 1070941 - RNA, 14 nt, Homo sapiens
ccagacggcuccac

SEQ ID NO: 1070942 - RNA, 15 nt, Homo sapiens
ccagaggacugugau

SEQ ID NO: 1070943 - RNA, 16 nt, Homo sapiens
ccagagggaauugcag

SEQ ID NO: 1070944 - RNA, 12 nt, Homo sapiens
ccagccugcuuu

SEQ ID NO: 1070945 - RNA, 16 nt, Homo sapiens
ccagccuggccaauac

SEQ ID NO: 1070946 - RNA, 20 nt, Homo sapiens
ccagcuauugauauaaauaa

SEQ ID NO: 1070947 - RNA, 16 nt, Homo sapiens
ccaggaguucugcuca

SEQ ID NO: 1070948 - RNA, 23 nt, Homo sapiens
ccaguacucugggaagccaaggc

SEQ ID NO: 1070949 - RNA, 13 nt, Homo sapiens
ccaguauggugaa

SEQ ID NO: 1070950 - RNA, 14 nt, Homo sapiens
ccaguauggugaaa

SEQ ID NO: 1070951 - RNA, 20 nt, Homo sapiens
ccagucacugugagcuccca

SEQ ID NO: 1070952 - RNA, 11 nt, Homo sapiens
ccagucuuccu

SEQ ID NO: 1070953 - RNA, 15 nt, Homo sapiens
ccauccucacugcug

SEQ ID NO: 1070954 - RNA, 18 nt, Homo sapiens
ccaugaagaggaugcugu

SEQ ID NO: 1070955 - RNA, 21 nt, Homo sapiens
ccaugccaucucaaccucuuc

SEQ ID NO: 1070956 - RNA, 21 nt, Homo sapiens
ccauggacagaagaaggcagc

SEQ ID NO: 1070957 - RNA, 16 nt, Homo sapiens
ccaugugcuacagggg

SEQ ID NO: 1070958 - RNA, 20 nt, Homo sapiens
ccaugugcuacaggggccag

SEQ ID NO: 1070959 - RNA, 16 nt, Homo sapiens
ccauuucucuccucac

SEQ ID NO: 1070960 - RNA, 13 nt, Homo sapiens
cccaacaugacug

SEQ ID NO: 1070961 - RNA, 21 nt, Homo sapiens
cccaagacaugaagacaucuu

SEQ ID NO: 1070962 - RNA, 15 nt, Homo sapiens
cccacagcacuaauu

SEQ ID NO: 1070963 - RNA, 18 nt, Homo sapiens
cccacauccugugccucc

SEQ ID NO: 1070964 - RNA, 15 nt, Homo sapiens
cccagaaaucagugu

SEQ ID NO: 1070965 - RNA, 18 nt, Homo sapiens
cccagcuaccucaaccaa

SEQ ID NO: 1070966 - RNA, 23 nt, Homo sapiens
cccaucgccagcugaugacucaa

SEQ ID NO: 1070967 - RNA, 14 nt, Homo sapiens
ccccaacacgcagg

SEQ ID NO: 1070968 - RNA, 16 nt, Homo sapiens
ccccuaaaccaaaaac

SEQ ID NO: 1070969 - RNA, 15 nt, Homo sapiens
cccuaaaccaaaaac

SEQ ID NO: 1070970 - RNA, 21 nt, Homo sapiens
cccuaaaccaaaaacugaaag

SEQ ID NO: 1070971 - RNA, 22 nt, Homo sapiens
cccuagccauuuuuacuguuau

SEQ ID NO: 1070972 - RNA, 18 nt, Homo sapiens
cccucacucucuacaggu

SEQ ID NO: 1070973 - RNA, 15 nt, Homo sapiens
cccucagagugcaag

SEQ ID NO: 1070974 - RNA, 11 nt, Homo sapiens
cccucauuccc

SEQ ID NO: 1070975 - RNA, 14 nt, Homo sapiens
cccucuacucuuac

SEQ ID NO: 1070976 - RNA, 18 nt, Homo sapiens
cccugucucuacuaaaaa

SEQ ID NO: 1070977 - RNA, 22 nt, Homo sapiens
cccugucucuacuaaaaauaca

SEQ ID NO: 1070978 - RNA, 23 nt, Homo sapiens
uaagcaaacccagugucaggaug

SEQ ID NO: 1070979 - RNA, 20 nt, Homo sapiens
uaagcuucaaagcugcuuua

SEQ ID NO: 1070980 - RNA, 18 nt, Homo sapiens
uaaguuacaucuacaaac

SEQ ID NO: 1070981 - RNA, 20 nt, Homo sapiens
uaaguuacaucuacaaacag

SEQ ID NO: 1070982 - RNA, 16 nt, Homo sapiens
uaaguuguuauuucag

SEQ ID NO: 1070983 - RNA, 22 nt, Homo sapiens
uaauacuauauuuauacuguau

SEQ ID NO: 1070984 - RNA, 19 nt, Homo sapiens
uaaugauggcccauucuac

SEQ ID NO: 1070985 - RNA, 23 nt, Homo sapiens
uaaugauggcccauucuacuugc

SEQ ID NO: 1070986 - RNA, 21 nt, Homo sapiens
uaauuugauaguauugugcau

SEQ ID NO: 1070987 - RNA, 23 nt, Homo sapiens
uaauuuuuuugugggaaauccac

SEQ ID NO: 1070988 - RNA, 18 nt, Homo sapiens
uacaacccgguucacucu

SEQ ID NO: 1070989 - RNA, 23 nt, Homo sapiens
uacaagacuuguuauccauuuaa

SEQ ID NO: 1070990 - RNA, 13 nt, Homo sapiens
uacacauacaugu

SEQ ID NO: 1070991 - RNA, 22 nt, Homo sapiens
uacaggggccagaagaugaaca

SEQ ID NO: 1070992 - RNA, 20 nt, Homo sapiens
uacauaaaguaugugcauau

SEQ ID NO: 1070993 - RNA, 15 nt, Homo sapiens
uacccuuucauucag

SEQ ID NO: 1070994 - RNA, 20 nt, Homo sapiens
uaccucaaccaaugccaaaa

SEQ ID NO: 1070995 - RNA, 16 nt, Homo sapiens
uaccugggaccuccac

SEQ ID NO: 1070996 - RNA, 18 nt, Homo sapiens
uaccuuuugcuguggcaa

SEQ ID NO: 1070997 - RNA, 20 nt, Homo sapiens
uacuauauuuauacuguaua

SEQ ID NO: 1070998 - RNA, 15 nt, Homo sapiens
uacuauugcauuuua

SEQ ID NO: 1070999 - RNA, 17 nt, Homo sapiens
uacuauuugccauuuaa

SEQ ID NO: 1071000 - RNA, 17 nt, Homo sapiens
uacuccaggagacccac

SEQ ID NO: 1071001 - RNA, 12 nt, Homo sapiens
uacugacugaga

SEQ ID NO: 1071002 - RNA, 16 nt, Homo sapiens
uacuggauuugacuuc

SEQ ID NO: 1071003 - RNA, 17 nt, Homo sapiens
uacugucucuuucauga

SEQ ID NO: 1071004 - RNA, 21 nt, Homo sapiens
uagaaacaacauagcaaauua

SEQ ID NO: 1071005 - RNA, 18 nt, Homo sapiens
uagaaagguuuugagcau

SEQ ID NO: 1071006 - RNA, 15 nt, Homo sapiens
uagaaauaaugguca

SEQ ID NO: 1071007 - RNA, 14 nt, Homo sapiens
uagcaugcugugau

SEQ ID NO: 1071008 - RNA, 20 nt, Homo sapiens
uagcuccaaaccuucacaca

SEQ ID NO: 1071009 - RNA, 19 nt, Homo sapiens
uaggaaagaagagaaccau

SEQ ID NO: 1071010 - RNA, 14 nt, Homo sapiens
uaggaacuugagaa

SEQ ID NO: 1071011 - RNA, 17 nt, Homo sapiens
uaggaagaucucugcag

SEQ ID NO: 1071012 - RNA, 19 nt, Homo sapiens
uaggaagaugauggcucau

SEQ ID NO: 1071013 - RNA, 21 nt, Homo sapiens
uaggccuccuggcccagguga

SEQ ID NO: 1071014 - RNA, 16 nt, Homo sapiens
uaguaagagauuccug

SEQ ID NO: 1071015 - RNA, 14 nt, Homo sapiens
uaguacaauucuua

SEQ ID NO: 1071016 - RNA, 19 nt, Homo sapiens
uagucagaauuagcugcuu

SEQ ID NO: 1071017 - RNA, 18 nt, Homo sapiens
uagucucaccuacuccag

SEQ ID NO: 1071018 - RNA, 15 nt, Homo sapiens
uagucucauucuguc

SEQ ID NO: 1071019 - RNA, 20 nt, Homo sapiens
uagucugcgucucugcuuua

SEQ ID NO: 1071020 - RNA, 16 nt, Homo sapiens
uagugccuuuacuuca

SEQ ID NO: 1071021 - RNA, 15 nt, Homo sapiens
uaguuacuauaugcc

SEQ ID NO: 1071022 - RNA, 12 nt, Homo sapiens
uauaaaauacug

SEQ ID NO: 1071023 - RNA, 21 nt, Homo sapiens
uauaaaauauguacauaauau

SEQ ID NO: 1071024 - RNA, 22 nt, Homo sapiens
uauaaauaaaacauuuucacac

SEQ ID NO: 1071025 - RNA, 12 nt, Homo sapiens
uauaauacugua

SEQ ID NO: 1071026 - RNA, 13 nt, Homo sapiens
uauaauucuggga

SEQ ID NO: 1071027 - RNA, 14 nt, Homo sapiens
uauagaugaggcag

SEQ ID NO: 1071028 - RNA, 23 nt, Homo sapiens
uauaucuuaaugcagacaaacaa

SEQ ID NO: 1071029 - RNA, 15 nt, Homo sapiens
uauaugacauuguua

SEQ ID NO: 1071030 - RNA, 18 nt, Homo sapiens
uauauguauauacauaua

SEQ ID NO: 1071031 - RNA, 13 nt, Homo sapiens
uauauguguauau

SEQ ID NO: 1071032 - RNA, 17 nt, Homo sapiens
uauauguguguguauau

SEQ ID NO: 1071033 - RNA, 13 nt, Homo sapiens
uaucaguccaaag

SEQ ID NO: 1071034 - RNA, 18 nt, Homo sapiens
uauccuccaugaauauca

SEQ ID NO: 1071035 - RNA, 12 nt, Homo sapiens
uauccuguucuu

SEQ ID NO: 1071036 - RNA, 14 nt, Homo sapiens
uaucugaguugacu

SEQ ID NO: 1071037 - RNA, 21 nt, Homo sapiens
uaucuuaaugcagacaaacaa

SEQ ID NO: 1071038 - RNA, 15 nt, Homo sapiens
uaugaaaaugucauu

SEQ ID NO: 1071039 - RNA, 19 nt, Homo sapiens
uaugaauuacccuuucauu

SEQ ID NO: 1071040 - RNA, 22 nt, Homo sapiens
uaugccaggcccauuuccugcu

SEQ ID NO: 1071041 - RNA, 16 nt, Homo sapiens
uaugcuauuacauaca

SEQ ID NO: 1071042 - RNA, 18 nt, Homo sapiens
uaugucucagaccacuau

SEQ ID NO: 1071043 - RNA, 23 nt, Homo sapiens
uauucaauggugagcagacugca

SEQ ID NO: 1071044 - RNA, 18 nt, Homo sapiens
uauucuaauuuuagguuc

SEQ ID NO: 1071045 - RNA, 17 nt, Homo sapiens
uauucuugaagucagau

SEQ ID NO: 1071046 - RNA, 13 nt, Homo sapiens
uauugugcauaga

SEQ ID NO: 1071047 - RNA, 14 nt, Homo sapiens
uauuuauacuguau

SEQ ID NO: 1071048 - RNA, 15 nt, Homo sapiens
uauuuguuugugcau

SEQ ID NO: 1071049 - RNA, 13 nt, Homo sapiens
uauuuucuacaca

SEQ ID NO: 1071050 - RNA, 16 nt, Homo sapiens
ugacuuauaauuugca

SEQ ID NO: 1071051 - RNA, 14 nt, Homo sapiens
ugagaauauaaaaa

SEQ ID NO: 1071052 - RNA, 18 nt, Homo sapiens
ugagacuccucaguucuu

SEQ ID NO: 1071053 - RNA, 21 nt, Homo sapiens
ugagacuccucaguucuugcc

SEQ ID NO: 1071054 - RNA, 15 nt, Homo sapiens
ugagaggcauuuccc

SEQ ID NO: 1071055 - RNA, 16 nt, Homo sapiens
ugagaggcauuucccc

SEQ ID NO: 1071056 - RNA, 16 nt, Homo sapiens
ugagcucccaggugca

SEQ ID NO: 1071057 - RNA, 23 nt, Homo sapiens
ugagcucccaggugcagccagag

SEQ ID NO: 1071058 - RNA, 21 nt, Homo sapiens
ugaggcauccacuucuuucag

SEQ ID NO: 1071059 - RNA, 22 nt, Homo sapiens
ugaggcuuuaaaacuuauccuc

SEQ ID NO: 1071060 - RNA, 14 nt, Homo sapiens
ugaggucacagucc

SEQ ID NO: 1071061 - RNA, 20 nt, Homo sapiens
ugaggucaggaguucgagac

SEQ ID NO: 1071062 - RNA, 16 nt, Homo sapiens
ugagguggacucucac

SEQ ID NO: 1071063 - RNA, 11 nt, Homo sapiens
ugagugcaagg

SEQ ID NO: 1071064 - RNA, 19 nt, Homo sapiens
ugaguggcuuuaaugaaua

SEQ ID NO: 1071065 - RNA, 18 nt, Homo sapiens
ugaucaaagccacacucu

SEQ ID NO: 1071066 - RNA, 16 nt, Homo sapiens
ugauggcucauuuaca

SEQ ID NO: 1071067 - RNA, 21 nt, Homo sapiens
ugauggcucauuuacacucag

SEQ ID NO: 1071068 - RNA, 21 nt, Homo sapiens
ugauggucuuaaggaacaucu

SEQ ID NO: 1071069 - RNA, 13 nt, Homo sapiens
ugauuuaaucacc

SEQ ID NO: 1071070 - RNA, 15 nt, Homo sapiens
ugcaaaauauaucac

SEQ ID NO: 1071071 - RNA, 22 nt, Homo sapiens
ugcaagccccugcuccagaaga

SEQ ID NO: 1071072 - RNA, 20 nt, Homo sapiens
ugcaccaaaucaucucucau

SEQ ID NO: 1071073 - RNA, 21 nt, Homo sapiens
ugcagaggggcccaugaaaga

SEQ ID NO: 1071074 - RNA, 13 nt, Homo sapiens
ugcagaguacugg

SEQ ID NO: 1071075 - RNA, 13 nt, Homo sapiens
ugcaggauuugaa

SEQ ID NO: 1071076 - RNA, 18 nt, Homo sapiens
ugcagggccgccagggag

SEQ ID NO: 1071077 - RNA, 16 nt, Homo sapiens
ugcaguagacugcagu

SEQ ID NO: 1071078 - RNA, 17 nt, Homo sapiens
ugcauaauaaaugcuuc

SEQ ID NO: 1071079 - RNA, 13 nt, Homo sapiens
ugcauauauacau

SEQ ID NO: 1071080 - RNA, 17 nt, Homo sapiens
ugccauugcacuccagc

SEQ ID NO: 1071081 - RNA, 18 nt, Homo sapiens
ugccccuggaugcacuuu

SEQ ID NO: 1071082 - RNA, 14 nt, Homo sapiens
ugcccucagauucc

SEQ ID NO: 1071083 - RNA, 21 nt, Homo sapiens
ugcccugcccuuggcacccaa

SEQ ID NO: 1071084 - RNA, 22 nt, Homo sapiens
ugccuacgaauagccacugcau

SEQ ID NO: 1071085 - RNA, 16 nt, Homo sapiens
ugccuuccagccacau

SEQ ID NO: 1071086 - RNA, 19 nt, Homo sapiens
ugcgauucugcagccacaa

SEQ ID NO: 1071087 - RNA, 19 nt, Homo sapiens
ugcuacucaaguagcauuu

SEQ ID NO: 1071088 - RNA, 15 nt, Homo sapiens
ugcucauucuaauga

SEQ ID NO: 1071089 - RNA, 14 nt, Homo sapiens
ugcuccacagggcc

SEQ ID NO: 1071090 - RNA, 23 nt, Homo sapiens
ugcucucuuuuucuccaggguca

SEQ ID NO: 1071091 - RNA, 19 nt, Homo sapiens
ugcugacagucaugcaguc

SEQ ID NO: 1071092 - RNA, 16 nt, Homo sapiens
ugcugcggagcaagag

SEQ ID NO: 1071093 - RNA, 22 nt, Homo sapiens
ugcuuaagguaugguacaagca

SEQ ID NO: 1071094 - RNA, 14 nt, Homo sapiens
ugcuucaauguagu

SEQ ID NO: 1071095 - RNA, 14 nt, Homo sapiens
ugcuugaaugaagu

SEQ ID NO: 1071096 - RNA, 16 nt, Homo sapiens
ugcuuucacucuuuag

SEQ ID NO: 1071097 - RNA, 20 nt, Homo sapiens
uggaaaaauucauugucucu

SEQ ID NO: 1071098 - RNA, 19 nt, Homo sapiens
uuaacuaugaauucuuaag

SEQ ID NO: 1071099 - RNA, 15 nt, Homo sapiens
uuaacuucagccagc

SEQ ID NO: 1071100 - RNA, 21 nt, Homo sapiens
uuaaggaggcugagagcccaa

SEQ ID NO: 1071101 - RNA, 19 nt, Homo sapiens
uuaauacaaugaugcuauu

SEQ ID NO: 1071102 - RNA, 15 nt, Homo sapiens
uuaaugcagacaaac

SEQ ID NO: 1071103 - RNA, 14 nt, Homo sapiens
uuaauuuagcuuag

SEQ ID NO: 1071104 - RNA, 18 nt, Homo sapiens
uuaauuugauaguauugu

SEQ ID NO: 1071105 - RNA, 12 nt, Homo sapiens
uuacauacaaau

SEQ ID NO: 1071106 - RNA, 16 nt, Homo sapiens
uuacaucuacaaacag

SEQ ID NO: 1071107 - RNA, 20 nt, Homo sapiens
uuacccccugggagccccaa

SEQ ID NO: 1071108 - RNA, 14 nt, Homo sapiens
uuacuaaaaacaca

SEQ ID NO: 1071109 - RNA, 21 nt, Homo sapiens
uuacuuggacgcaacauugca

SEQ ID NO: 1071110 - RNA, 17 nt, Homo sapiens
uuagaaacaacauagca

SEQ ID NO: 1071111 - RNA, 14 nt, Homo sapiens
uuagcaucucaggu

SEQ ID NO: 1071112 - RNA, 18 nt, Homo sapiens
uuagcuccaaaccuucac

SEQ ID NO: 1071113 - RNA, 17 nt, Homo sapiens
uuaggauguaaaucugc

SEQ ID NO: 1071114 - RNA, 19 nt, Homo sapiens
uuauaauuugcauaccauu

SEQ ID NO: 1071115 - RNA, 12 nt, Homo sapiens
uuauacuguaua

SEQ ID NO: 1071116 - RNA, 12 nt, Homo sapiens
uuaucaguccaa

SEQ ID NO: 1071117 - RNA, 17 nt, Homo sapiens
uuaugagacacaggaug

SEQ ID NO: 1071118 - RNA, 16 nt, Homo sapiens
uuaugucucagaccac

SEQ ID NO: 1071119 - RNA, 14 nt, Homo sapiens
uuauuuccugcuua

SEQ ID NO: 1071120 - RNA, 21 nt, Homo sapiens
uucaaaaauacucacauggcu

SEQ ID NO: 1071121 - RNA, 22 nt, Homo sapiens
uucaaagcacuguuucucucac

SEQ ID NO: 1071122 - RNA, 21 nt, Homo sapiens
uucaaaggaaaauagacagaa

SEQ ID NO: 1071123 - RNA, 16 nt, Homo sapiens
uucaacaaauugcccu

SEQ ID NO: 1071124 - RNA, 19 nt, Homo sapiens
uucaaggguuguuggaaaa

SEQ ID NO: 1071125 - RNA, 21 nt, Homo sapiens
uucaagguaacuguacugggc

SEQ ID NO: 1071126 - RNA, 19 nt, Homo sapiens
uucacagcccugcagugcc

SEQ ID NO: 1071127 - RNA, 19 nt, Homo sapiens
uucacaucagaacagacaa

SEQ ID NO: 1071128 - RNA, 20 nt, Homo sapiens
uucagggaagaagcauacaa

SEQ ID NO: 1071129 - RNA, 19 nt, Homo sapiens
uucaguagaagaacuuaaa

SEQ ID NO: 1071130 - RNA, 23 nt, Homo sapiens
uucauccaggccugccaagguga

SEQ ID NO: 1071131 - RNA, 11 nt, Homo sapiens
uuccauucuca

SEQ ID NO: 1071132 - RNA, 19 nt, Homo sapiens
uucccacagcacuaauuca

SEQ ID NO: 1071133 - RNA, 20 nt, Homo sapiens
uucccaccugcuggagugaa

SEQ ID NO: 1071134 - RNA, 17 nt, Homo sapiens
uucccagcuacaccuuu

SEQ ID NO: 1071135 - RNA, 20 nt, Homo sapiens
uucccaggaguucugcucau

SEQ ID NO: 1071136 - RNA, 21 nt, Homo sapiens
uuccccgcccguuuuacaaag

SEQ ID NO: 1071137 - RNA, 15 nt, Homo sapiens
uucccugcuuaauga

SEQ ID NO: 1071138 - RNA, 13 nt, Homo sapiens
uuccgcaccaaua

SEQ ID NO: 1071139 - RNA, 21 nt, Homo sapiens
uuccgcaccaauaaagccuuc

SEQ ID NO: 1071140 - RNA, 23 nt, Homo sapiens
uuccuaacugucugacuuauaau

SEQ ID NO: 1071141 - RNA, 20 nt, Homo sapiens
uucgagaccagccuggccaa

SEQ ID NO: 1071142 - RNA, 21 nt, Homo sapiens
uucuaaugauggcccauucua

SEQ ID NO: 1071143 - RNA, 16 nt, Homo sapiens
uucuaggaagcuccag

SEQ ID NO: 1071144 - RNA, 20 nt, Homo sapiens
uucucauccugcaggcagcu

SEQ ID NO: 1071145 - RNA, 20 nt, Homo sapiens
uucucucacuuugauuugcu

SEQ ID NO: 1071146 - RNA, 20 nt, Homo sapiens
uucugccugccuuccagcca

SEQ ID NO: 1071147 - RNA, 17 nt, Homo sapiens
uucuggccucccacaga

SEQ ID NO: 1071148 - RNA, 15 nt, Homo sapiens
acucaaguagcauuu

SEQ ID NO: 1071149 - RNA, 15 nt, Homo sapiens
acucaaucuacaggc

SEQ ID NO: 1071150 - RNA, 19 nt, Homo sapiens
acucagcucuuggcuccac

SEQ ID NO: 1071151 - RNA, 14 nt, Homo sapiens
acucagcugcucug

SEQ ID NO: 1071152 - RNA, 23 nt, Homo sapiens
acucagcugcucugcaagcagaa

SEQ ID NO: 1071153 - RNA, 21 nt, Homo sapiens
acucugcuuuuuuucuacugu

SEQ ID NO: 1071154 - RNA, 15 nt, Homo sapiens
acucugggaagccaa

SEQ ID NO: 1071155 - RNA, 14 nt, Homo sapiens
acucuuacuucccc

SEQ ID NO: 1071156 - RNA, 16 nt, Homo sapiens
acugaaauauacacac

SEQ ID NO: 1071157 - RNA, 22 nt, Homo sapiens
acugagaauauaauacuguauu

SEQ ID NO: 1071158 - RNA, 23 nt, Homo sapiens
acugaucaggaccuccaagccac

SEQ ID NO: 1071159 - RNA, 14 nt, Homo sapiens
acugcaaaucugcc

SEQ ID NO: 1071160 - RNA, 21 nt, Homo sapiens
acugcugcgucauuacagggc

SEQ ID NO: 1071161 - RNA, 14 nt, Homo sapiens
acuggcugauggag

SEQ ID NO: 1071162 - RNA, 19 nt, Homo sapiens
acugggccuccaaccaugu

SEQ ID NO: 1071163 - RNA, 19 nt, Homo sapiens
acuguauauauaauacuga

SEQ ID NO: 1071164 - RNA, 19 nt, Homo sapiens
acugugagcucccaggugc

SEQ ID NO: 1071165 - RNA, 20 nt, Homo sapiens
acuguguguucgacagugaa

SEQ ID NO: 1071166 - RNA, 14 nt, Homo sapiens
acuguuucucucac

SEQ ID NO: 1071167 - RNA, 17 nt, Homo sapiens
acuucaggagaacucau

SEQ ID NO: 1071168 - RNA, 11 nt, Homo sapiens
acuucuuggcu

SEQ ID NO: 1071169 - RNA, 18 nt, Homo sapiens
acuugucaccaugagaua

SEQ ID NO: 1071170 - RNA, 17 nt, Homo sapiens
acuuuccucuuccugcc

SEQ ID NO: 1071171 - RNA, 22 nt, Homo sapiens
agaaaacacuuaaaaugaucau

SEQ ID NO: 1071172 - RNA, 12 nt, Homo sapiens
agaaacaaugac

SEQ ID NO: 1071173 - RNA, 17 nt, Homo sapiens
agaaacaaugacuaauu

SEQ ID NO: 1071174 - RNA, 20 nt, Homo sapiens
agaaaguguuuaacuuguca

SEQ ID NO: 1071175 - RNA, 21 nt, Homo sapiens
agaaauuagugccacaaauaa

SEQ ID NO: 1071176 - RNA, 16 nt, Homo sapiens
agaacacaaggucauu

SEQ ID NO: 1071177 - RNA, 15 nt, Homo sapiens
agaacuuuauuucca

SEQ ID NO: 1071178 - RNA, 15 nt, Homo sapiens
agaagaaaauaucau

SEQ ID NO: 1071179 - RNA, 18 nt, Homo sapiens
agaagaaauucugucaua

SEQ ID NO: 1071180 - RNA, 13 nt, Homo sapiens
agaagaaguucau

SEQ ID NO: 1071181 - RNA, 19 nt, Homo sapiens
agaagacuauauuguacac

SEQ ID NO: 1071182 - RNA, 13 nt, Homo sapiens
agaagauucuucc

SEQ ID NO: 1071183 - RNA, 20 nt, Homo sapiens
agaagggaauuuauugccuc

SEQ ID NO: 1071184 - RNA, 18 nt, Homo sapiens
agaaggugauaaauguca

SEQ ID NO: 1071185 - RNA, 16 nt, Homo sapiens
agaaguaugggaaaug

SEQ ID NO: 1071186 - RNA, 17 nt, Homo sapiens
agaauauaaaaaacuuu

SEQ ID NO: 1071187 - RNA, 17 nt, Homo sapiens
agaauauaauacuguau

SEQ ID NO: 1071188 - RNA, 15 nt, Homo sapiens
agaauguugcuuucu

SEQ ID NO: 1071189 - RNA, 16 nt, Homo sapiens
agaauuagaaacaaca

SEQ ID NO: 1071190 - RNA, 14 nt, Homo sapiens
agacagcuucucau

SEQ ID NO: 1071191 - RNA, 23 nt, Homo sapiens
agacauagcaucuuguggcuuug

SEQ ID NO: 1071192 - RNA, 19 nt, Homo sapiens
agaccugacaccuuucaua

SEQ ID NO: 1071193 - RNA, 18 nt, Homo sapiens
agaccuuucaaagccauu

SEQ ID NO: 1071194 - RNA, 17 nt, Homo sapiens
agaccuuuuaacuccuc

SEQ ID NO: 1071195 - RNA, 16 nt, Homo sapiens
agacucaaaugcucag

SEQ ID NO: 1071196 - RNA, 19 nt, Homo sapiens
agacuggcugaaaaaccua

SEQ ID NO: 1071197 - RNA, 22 nt, Homo sapiens
agagauuccugagccaguguca

SEQ ID NO: 1071198 - RNA, 19 nt, Homo sapiens
agagcuacccgcagaguuc

SEQ ID NO: 1071199 - RNA, 13 nt, Homo sapiens
agaggacugugau

SEQ ID NO: 1071200 - RNA, 12 nt, Homo sapiens
agaggaugcugu

SEQ ID NO: 1071201 - RNA, 13 nt, Homo sapiens
agaggaugcugug

SEQ ID NO: 1071202 - RNA, 14 nt, Homo sapiens
agaggcauuucccc

SEQ ID NO: 1071203 - RNA, 20 nt, Homo sapiens
agagucaaugaacuuuccac

SEQ ID NO: 1071204 - RNA, 15 nt, Homo sapiens
agaguuucaaccaug

SEQ ID NO: 1071205 - RNA, 18 nt, Homo sapiens
agauacugucucuuucau

SEQ ID NO: 1071206 - RNA, 22 nt, Homo sapiens
agauagcuucaccccaauccca

SEQ ID NO: 1071207 - RNA, 12 nt, Homo sapiens
agauagggaaaa

SEQ ID NO: 1071208 - RNA, 21 nt, Homo sapiens
agauagucucauucugucacc

SEQ ID NO: 1071209 - RNA, 22 nt, Homo sapiens
agaucacuucaggucaggaguu

SEQ ID NO: 1071210 - RNA, 17 nt, Homo sapiens
agauggauuuguaucaa

SEQ ID NO: 1071211 - RNA, 14 nt, Homo sapiens
agauucacauacag

SEQ ID NO: 1071212 - RNA, 17 nt, Homo sapiens
agauuccgcaccaauaa

SEQ ID NO: 1071213 - RNA, 19 nt, Homo sapiens
agauuuuuuuuggacuguu

SEQ ID NO: 1071214 - RNA, 12 nt, Homo sapiens
agcaaacccaga

SEQ ID NO: 1071215 - RNA, 19 nt, Homo sapiens
agcaaacccagugucagga

SEQ ID NO: 1071216 - RNA, 16 nt, Homo sapiens
agcaccuguaauccca

SEQ ID NO: 1071217 - RNA, 23 nt, Homo sapiens
agcacuaauucaacauauaccuu

SEQ ID NO: 1071218 - RNA, 16 nt, Homo sapiens
agcagaccucguuucu

SEQ ID NO: 1071219 - RNA, 14 nt, Homo sapiens
agcaggcacccacu

SEQ ID NO: 1071220 - RNA, 23 nt, Homo sapiens
agcagucuuucuauccuguucuu

SEQ ID NO: 1071221 - RNA, 14 nt, Homo sapiens
agcauccucuuuaa

SEQ ID NO: 1071222 - RNA, 21 nt, Homo sapiens
agccacugcauaccaaccugg

SEQ ID NO: 1071223 - RNA, 16 nt, Homo sapiens
agcccaagguuaaaaa

SEQ ID NO: 1071224 - RNA, 14 nt, Homo sapiens
agccccaauucgau

SEQ ID NO: 1071225 - RNA, 13 nt, Homo sapiens
agccugcuuucac

SEQ ID NO: 1071226 - RNA, 14 nt, Homo sapiens
agccugcuuucaca

SEQ ID NO: 1071227 - RNA, 19 nt, Homo sapiens
agccuggccaagagaccag

SEQ ID NO: 1071228 - RNA, 20 nt, Homo sapiens
agccuuccguauccaucgaa

SEQ ID NO: 1071229 - RNA, 17 nt, Homo sapiens
agcuaccucaaccaaug

SEQ ID NO: 1071230 - RNA, 23 nt, Homo sapiens
agcuaccucaaccaaugccaaaa

SEQ ID NO: 1071231 - RNA, 16 nt, Homo sapiens
agcuccaaaccuucac

SEQ ID NO: 1071232 - RNA, 15 nt, Homo sapiens
agcucuccccucaga

SEQ ID NO: 1071233 - RNA, 22 nt, Homo sapiens
agcucuccccucagagugcaag

SEQ ID NO: 1071234 - RNA, 14 nt, Homo sapiens
agcugagugaaaaa

SEQ ID NO: 1071235 - RNA, 21 nt, Homo sapiens
agcugaugacucaagauuccc

SEQ ID NO: 1071236 - RNA, 11 nt, Homo sapiens
agcugcucagg

SEQ ID NO: 1071237 - RNA, 19 nt, Homo sapiens
agcugcucugcaagcagaa

SEQ ID NO: 1071238 - RNA, 13 nt, Homo sapiens
agcuggagggacc

SEQ ID NO: 1071239 - RNA, 19 nt, Homo sapiens
agcuggagggaccuugucu

SEQ ID NO: 1071240 - RNA, 20 nt, Homo sapiens
agcuggagggaccuugucuc

SEQ ID NO: 1071241 - RNA, 20 nt, Homo sapiens
agcuuaggaaagaacaucac

SEQ ID NO: 1071242 - RNA, 20 nt, Homo sapiens
agcuuccuguccucccagcu

SEQ ID NO: 1071243 - RNA, 21 nt, Homo sapiens
agcuucuuugccaagaccuuu

SEQ ID NO: 1071244 - RNA, 22 nt, Homo sapiens
agcuuggaaacuggaugagguc

SEQ ID NO: 1071245 - RNA, 17 nt, Homo sapiens
agcuuugacacuggaau

SEQ ID NO: 1071246 - RNA, 14 nt, Homo sapiens
aggaaacaacagcu

SEQ ID NO: 1071247 - RNA, 21 nt, Homo sapiens
aggaaagaaguucacaucaga

SEQ ID NO: 1071248 - RNA, 22 nt, Homo sapiens
aggaaauguuucucuaacccuu

SEQ ID NO: 1071249 - RNA, 12 nt, Homo sapiens
aggaacuguaca

SEQ ID NO: 1071250 - RNA, 21 nt, Homo sapiens
aggaagacccaacacauggga

SEQ ID NO: 1071251 - RNA, 14 nt, Homo sapiens
aggaccaaggagau

SEQ ID NO: 1071252 - RNA, 15 nt, Homo sapiens
aggagcacuacagau

SEQ ID NO: 1071253 - RNA, 15 nt, Homo sapiens
aggagccuaggccag

SEQ ID NO: 1071254 - RNA, 17 nt, Homo sapiens
aggagggugagugcaag

SEQ ID NO: 1071255 - RNA, 14 nt, Homo sapiens
aggaguucugcuca

SEQ ID NO: 1071256 - RNA, 16 nt, Homo sapiens
aggauaauuagcaucu

SEQ ID NO: 1071257 - RNA, 16 nt, Homo sapiens
aggauuugaauuuguc

SEQ ID NO: 1071258 - RNA, 21 nt, Homo sapiens
aggcagaggcuguggugagcc

SEQ ID NO: 1071259 - RNA, 20 nt, Homo sapiens
aggcagcuuuuucucuccca

SEQ ID NO: 1071260 - RNA, 21 nt, Homo sapiens
aggcagcuuuuucucucccac

SEQ ID NO: 1071261 - RNA, 23 nt, Homo sapiens
aggcagcuuuuucucucccacua

SEQ ID NO: 1071262 - RNA, 20 nt, Homo sapiens
aggcaugaaauacugugccu

SEQ ID NO: 1071263 - RNA, 18 nt, Homo sapiens
aggcaugagucagucuga

SEQ ID NO: 1071264 - RNA, 18 nt, Homo sapiens
aggccaggccagcugccu

SEQ ID NO: 1071265 - RNA, 20 nt, Homo sapiens
aggccguugauucacuucac

SEQ ID NO: 1071266 - RNA, 13 nt, Homo sapiens
cagggcacaaaga

SEQ ID NO: 1071267 - RNA, 13 nt, Homo sapiens
cagggccagucuu

SEQ ID NO: 1071268 - RNA, 18 nt, Homo sapiens
caggggagggucagccag

SEQ ID NO: 1071269 - RNA, 15 nt, Homo sapiens
cagguagaccugucu

SEQ ID NO: 1071270 - RNA, 21 nt, Homo sapiens
cagguauuuuauaauucuggg

SEQ ID NO: 1071271 - RNA, 22 nt, Homo sapiens
caguaaaauagcugagggaaaa

SEQ ID NO: 1071272 - RNA, 15 nt, Homo sapiens
caguagacugcagug

SEQ ID NO: 1071273 - RNA, 18 nt, Homo sapiens
caguaggaacuguacaug

SEQ ID NO: 1071274 - RNA, 17 nt, Homo sapiens
caguauauguugcaaaa

SEQ ID NO: 1071275 - RNA, 15 nt, Homo sapiens
cagucacugugagcu

SEQ ID NO: 1071276 - RNA, 17 nt, Homo sapiens
cagucuauuugagacuc

SEQ ID NO: 1071277 - RNA, 21 nt, Homo sapiens
cagugcaacacugaagcucuu

SEQ ID NO: 1071278 - RNA, 17 nt, Homo sapiens
cagugucuuuccaccuu

SEQ ID NO: 1071279 - RNA, 19 nt, Homo sapiens
cauaaacuuuccucuuccu

SEQ ID NO: 1071280 - RNA, 13 nt, Homo sapiens
cauaagugcaaua

SEQ ID NO: 1071281 - RNA, 15 nt, Homo sapiens
cauagcagugcuuga

SEQ ID NO: 1071282 - RNA, 24 nt, Homo sapiens
cauauauguauauauaugcacaua

SEQ ID NO: 1071283 - RNA, 21 nt, Homo sapiens
cauauauuggguuccauucuc

SEQ ID NO: 1071284 - RNA, 20 nt, Homo sapiens
cauccugcuaguuugugaug

SEQ ID NO: 1071285 - RNA, 17 nt, Homo sapiens
caucucugcuuucacuc

SEQ ID NO: 1071286 - RNA, 18 nt, Homo sapiens
caugagucagucugauga

SEQ ID NO: 1071287 - RNA, 15 nt, Homo sapiens
caugcaggauuugaa

SEQ ID NO: 1071288 - RNA, 14 nt, Homo sapiens
caugugcuacaggg

SEQ ID NO: 1071289 - RNA, 15 nt, Homo sapiens
cauucaggucuuucu

SEQ ID NO: 1071290 - RNA, 20 nt, Homo sapiens
cauucccuucgacagcauuu

SEQ ID NO: 1071291 - RNA, 16 nt, Homo sapiens
cauucuagaaacagga

SEQ ID NO: 1071292 - RNA, 18 nt, Homo sapiens
cauucuagaaacaggaaa

SEQ ID NO: 1071293 - RNA, 13 nt, Homo sapiens
cauucucaccuau

SEQ ID NO: 1071294 - RNA, 16 nt, Homo sapiens
cauucucccuccuucc

SEQ ID NO: 1071295 - RNA, 21 nt, Homo sapiens
cauucugcucuuugauucaaa

SEQ ID NO: 1071296 - RNA, 12 nt, Homo sapiens
cauucugucacc

SEQ ID NO: 1071297 - RNA, 15 nt, Homo sapiens
cauugaacuguacca

SEQ ID NO: 1071298 - RNA, 19 nt, Homo sapiens
cauugcaccagaugccauu

SEQ ID NO: 1071299 - RNA, 13 nt, Homo sapiens
cauuggaggugaa

SEQ ID NO: 1071300 - RNA, 20 nt, Homo sapiens
cauuuaaaguauuuuauucu

SEQ ID NO: 1071301 - RNA, 11 nt, Homo sapiens
cauuuacuguu

SEQ ID NO: 1071302 - RNA, 16 nt, Homo sapiens
ccaaaaucaugccauu

SEQ ID NO: 1071303 - RNA, 20 nt, Homo sapiens
ccaaauuacguguacuacaa

SEQ ID NO: 1071304 - RNA, 15 nt, Homo sapiens
ccaacaaacauugau

SEQ ID NO: 1071305 - RNA, 15 nt, Homo sapiens
ccaacauacuuuaag

SEQ ID NO: 1071306 - RNA, 11 nt, Homo sapiens
ccaacaugacu

SEQ ID NO: 1071307 - RNA, 12 nt, Homo sapiens
ccaagaccucag

SEQ ID NO: 1071308 - RNA, 21 nt, Homo sapiens
ccaagaugacacaacugcacu

SEQ ID NO: 1071309 - RNA, 19 nt, Homo sapiens
ccaagcaagacugaggggu

SEQ ID NO: 1071310 - RNA, 19 nt, Homo sapiens
ccaagcagagaagcucucg

SEQ ID NO: 1071311 - RNA, 14 nt, Homo sapiens
ccaaggagggugag

SEQ ID NO: 1071312 - RNA, 20 nt, Homo sapiens
ccaauacggcaaaaccucau

SEQ ID NO: 1071313 - RNA, 18 nt, Homo sapiens
ccaaucccagcuaccuca

SEQ ID NO: 1071314 - RNA, 13 nt, Homo sapiens
ccacacuggacuc

SEQ ID NO: 1071315 - RNA, 18 nt, Homo sapiens
ccacagacucaaaugcuc

SEQ ID NO: 1071316 - RNA, 20 nt, Homo sapiens
ccacaguggaaagacagcuu

SEQ ID NO: 1071317 - RNA, 21 nt, Homo sapiens
ccagacagacaacacugggaa

SEQ ID NO: 1071318 - RNA, 17 nt, Homo sapiens
ccagacuggagugcagg

SEQ ID NO: 1071319 - RNA, 16 nt, Homo sapiens
ccagcacuuugggagg

SEQ ID NO: 1071320 - RNA, 20 nt, Homo sapiens
ccagcccagaaagucucuca

SEQ ID NO: 1071321 - RNA, 17 nt, Homo sapiens
ccagcggacaguggcag

SEQ ID NO: 1071322 - RNA, 22 nt, Homo sapiens
ccaggauuccucuuuucucugc

SEQ ID NO: 1071323 - RNA, 14 nt, Homo sapiens
ccaucgaagcagau

SEQ ID NO: 1071324 - RNA, 20 nt, Homo sapiens
ccaucguuuucuucacuguc

SEQ ID NO: 1071325 - RNA, 21 nt, Homo sapiens
ccaugaagucucuaacaaugu

SEQ ID NO: 1071326 - RNA, 17 nt, Homo sapiens
ccaugcaggauuugaau

SEQ ID NO: 1071327 - RNA, 22 nt, Homo sapiens
ccaugccgacggggacugcuuc

SEQ ID NO: 1071328 - RNA, 23 nt, Homo sapiens
ccaugggagauuuggagcugucu

SEQ ID NO: 1071329 - RNA, 20 nt, Homo sapiens
ccauucaggucuuucuuucc

SEQ ID NO: 1071330 - RNA, 21 nt, Homo sapiens
ccauucaggucuuucuuuccg

SEQ ID NO: 1071331 - RNA, 13 nt, Homo sapiens
ccauucuacuugc

SEQ ID NO: 1071332 - RNA, 22 nt, Homo sapiens
ccauugcucuucuuuugaaaau

SEQ ID NO: 1071333 - RNA, 16 nt, Homo sapiens
ccauuuuugaaaccaa

SEQ ID NO: 1071334 - RNA, 17 nt, Homo sapiens
ccauuuuugaaaccaaa

SEQ ID NO: 1071335 - RNA, 17 nt, Homo sapiens
cccaaacaugcacuucc

SEQ ID NO: 1071336 - RNA, 17 nt, Homo sapiens
cccaaagugugacucau

SEQ ID NO: 1071337 - RNA, 22 nt, Homo sapiens
cccagaaagucucucauucuag

SEQ ID NO: 1071338 - RNA, 13 nt, Homo sapiens
cccagacuccuga

SEQ ID NO: 1071339 - RNA, 15 nt, Homo sapiens
cccagucacugugag

SEQ ID NO: 1071340 - RNA, 19 nt, Homo sapiens
cccagucacugugagcucc

SEQ ID NO: 1071341 - RNA, 22 nt, Homo sapiens
cccaugccgacggggacugcuu

SEQ ID NO: 1071342 - RNA, 17 nt, Homo sapiens
ccccacuggacugaccu

SEQ ID NO: 1071343 - RNA, 23 nt, Homo sapiens
ccccacuggacugaccuggucca

SEQ ID NO: 1071344 - RNA, 13 nt, Homo sapiens
cccccgccaaaag

SEQ ID NO: 1071345 - RNA, 14 nt, Homo sapiens
ccccugcuccagaa

SEQ ID NO: 1071346 - RNA, 17 nt, Homo sapiens
cccuaaaagcacacuca

SEQ ID NO: 1071347 - RNA, 17 nt, Homo sapiens
cccucacaauaccuuau

SEQ ID NO: 1071348 - RNA, 18 nt, Homo sapiens
cccucagagugcaagccc

SEQ ID NO: 1071349 - RNA, 14 nt, Homo sapiens
cccuccuacccugc

SEQ ID NO: 1071350 - RNA, 23 nt, Homo sapiens
cccugggccuggcagcucagcuu

SEQ ID NO: 1071351 - RNA, 21 nt, Homo sapiens
cccuuaaacauuggacaguga

SEQ ID NO: 1071352 - RNA, 21 nt, Homo sapiens
cccuuguuucuauacauucua

SEQ ID NO: 1071353 - RNA, 17 nt, Homo sapiens
cccuuuauguacaggau

SEQ ID NO: 1071354 - RNA, 12 nt, Homo sapiens
cccuuuugcauu

SEQ ID NO: 1071355 - RNA, 17 nt, Homo sapiens
ccgcaaaccacacugga

SEQ ID NO: 1071356 - RNA, 19 nt, Homo sapiens
ccgcaccauugaacuguac

SEQ ID NO: 1071357 - RNA, 14 nt, Homo sapiens
ccgggacuaccugg

SEQ ID NO: 1071358 - RNA, 14 nt, Homo sapiens
ccguaacaccugau

SEQ ID NO: 1071359 - RNA, 13 nt, Homo sapiens
ccuaaaagcacac

SEQ ID NO: 1071360 - RNA, 23 nt, Homo sapiens
ccuaaggucauuaccacaggcca

SEQ ID NO: 1071361 - RNA, 21 nt, Homo sapiens
ccucaaacgaaucauuggcua

SEQ ID NO: 1071362 - RNA, 19 nt, Homo sapiens
ccucaauuccaacacugau

SEQ ID NO: 1071363 - RNA, 20 nt, Homo sapiens
ccucacacacagacucauau

SEQ ID NO: 1071364 - RNA, 21 nt, Homo sapiens
ccucagauuccgcaccaauaa

SEQ ID NO: 1071365 - RNA, 21 nt, Homo sapiens
ccucagggcuggcagaugcag

SEQ ID NO: 1071366 - RNA, 22 nt, Homo sapiens
ccucccaggcucaagcuguccu

SEQ ID NO: 1071367 - RNA, 19 nt, Homo sapiens
ccucgacguuuacaagccc

SEQ ID NO: 1071368 - RNA, 21 nt, Homo sapiens
ccucgcuuggacggcugggca

SEQ ID NO: 1071369 - RNA, 16 nt, Homo sapiens
ccucuuucacauugaa

SEQ ID NO: 1071370 - RNA, 20 nt, Homo sapiens
ccugauaggacccauauucc

SEQ ID NO: 1071371 - RNA, 22 nt, Homo sapiens
ccugauuaacugaggcauccac

SEQ ID NO: 1071372 - RNA, 19 nt, Homo sapiens
ccugauuuagauaugcaaa

SEQ ID NO: 1071373 - RNA, 15 nt, Homo sapiens
ccugcagaagcagaa

SEQ ID NO: 1071374 - RNA, 21 nt, Homo sapiens
ccugcagaagcagaagugcaa

SEQ ID NO: 1071375 - RNA, 22 nt, Homo sapiens
ccugcagaagcagaagugcaau

SEQ ID NO: 1071376 - RNA, 13 nt, Homo sapiens
ccugcgagggcag

SEQ ID NO: 1071377 - RNA, 22 nt, Homo sapiens
ccuggacuagagggaccucucc

SEQ ID NO: 1071378 - RNA, 13 nt, Homo sapiens
ccuggauguugcu

SEQ ID NO: 1071379 - RNA, 13 nt, Homo sapiens
ccuggcaauguuu

SEQ ID NO: 1071380 - RNA, 19 nt, Homo sapiens
ccugugccccuggaugcac

SEQ ID NO: 1071381 - RNA, 16 nt, Homo sapiens
ccuguuacacaugaca

SEQ ID NO: 1071382 - RNA, 18 nt, Homo sapiens
ccuuagaaauuagugcca

SEQ ID NO: 1071383 - RNA, 15 nt, Homo sapiens
ccuucauaugcagua

SEQ ID NO: 1071384 - RNA, 14 nt, Homo sapiens
aaaaagacaacuca

SEQ ID NO: 1071385 - RNA, 14 nt, Homo sapiens
aaaaagacagggcu

SEQ ID NO: 1071386 - RNA, 12 nt, Homo sapiens
aaaaagcuguau

SEQ ID NO: 1071387 - RNA, 16 nt, Homo sapiens
aaaaaucguccaggga

SEQ ID NO: 1071388 - RNA, 18 nt, Homo sapiens
aaaacagaggcacuuaau

SEQ ID NO: 1071389 - RNA, 13 nt, Homo sapiens
aaaaggggcuccu

SEQ ID NO: 1071390 - RNA, 18 nt, Homo sapiens
aaaaugcaacaacaugua

SEQ ID NO: 1071391 - RNA, 20 nt, Homo sapiens
aaacaccguguuuucugaca

SEQ ID NO: 1071392 - RNA, 22 nt, Homo sapiens
aaacaccguguuuucugacaca

SEQ ID NO: 1071393 - RNA, 23 nt, Homo sapiens
aaacaccguguuuucugacacag

SEQ ID NO: 1071394 - RNA, 14 nt, Homo sapiens
aaacaggcagcuca

SEQ ID NO: 1071395 - RNA, 21 nt, Homo sapiens
aaacaguccuucaaacuucca

SEQ ID NO: 1071396 - RNA, 17 nt, Homo sapiens
aaacauuuuucuggaga

SEQ ID NO: 1071397 - RNA, 21 nt, Homo sapiens
aaacccugucucuacuaaaaa

SEQ ID NO: 1071398 - RNA, 17 nt, Homo sapiens
aaacguauugcauuuaa

SEQ ID NO: 1071399 - RNA, 18 nt, Homo sapiens
aaacuaggggacaaagca

SEQ ID NO: 1071400 - RNA, 23 nt, Homo sapiens
aaacucuuuuaacagucugggcu

SEQ ID NO: 1071401 - RNA, 20 nt, Homo sapiens
aaacuuuccucuuccugccu

SEQ ID NO: 1071402 - RNA, 14 nt, Homo sapiens
aaagaaguucacau

SEQ ID NO: 1071403 - RNA, 14 nt, Homo sapiens
aaagaaucagucuu

SEQ ID NO: 1071404 - RNA, 15 nt, Homo sapiens
aaagaaucagucuug

SEQ ID NO: 1071405 - RNA, 22 nt, Homo sapiens
aaagaggacaggcuaccccuuu

SEQ ID NO: 1071406 - RNA, 21 nt, Homo sapiens
aaagcacacucauccccucac

SEQ ID NO: 1071407 - RNA, 19 nt, Homo sapiens
aaagcaccugaacaguuua

SEQ ID NO: 1071408 - RNA, 15 nt, Homo sapiens
aaagcauuugcugug

SEQ ID NO: 1071409 - RNA, 16 nt, Homo sapiens
aaagcuuugugcagau

SEQ ID NO: 1071410 - RNA, 23 nt, Homo sapiens
aaagguuuugagcauggguucau

SEQ ID NO: 1071411 - RNA, 13 nt, Homo sapiens
aaaguacauaaca

SEQ ID NO: 1071412 - RNA, 12 nt, Homo sapiens
aaagucagucuu

SEQ ID NO: 1071413 - RNA, 20 nt, Homo sapiens
aaagugccagaaaguguuua

SEQ ID NO: 1071414 - RNA, 13 nt, Homo sapiens
aaauaaguuacau

SEQ ID NO: 1071415 - RNA, 13 nt, Homo sapiens
aaauacugugccu

SEQ ID NO: 1071416 - RNA, 22 nt, Homo sapiens
aaauauccuguacauauuuaca

SEQ ID NO: 1071417 - RNA, 22 nt, Homo sapiens
aaauaugcaccaaaucaucucu

SEQ ID NO: 1071418 - RNA, 20 nt, Homo sapiens
aaaucaucucucaucacuuu

SEQ ID NO: 1071419 - RNA, 15 nt, Homo sapiens
aaaucaucuuuguga

SEQ ID NO: 1071420 - RNA, 14 nt, Homo sapiens
aaaucguccaggga

SEQ ID NO: 1071421 - RNA, 18 nt, Homo sapiens
aaaucuguuuauaugaca

SEQ ID NO: 1071422 - RNA, 19 nt, Homo sapiens
aaauggggauauguuaacu

SEQ ID NO: 1071423 - RNA, 14 nt, Homo sapiens
aaauuaauagaauu

SEQ ID NO: 1071424 - RNA, 12 nt, Homo sapiens
aaauucaauauu

SEQ ID NO: 1071425 - RNA, 21 nt, Homo sapiens
aaauucacagcgcuaugcaau

SEQ ID NO: 1071426 - RNA, 18 nt, Homo sapiens
aaauuggaagcugucaua

SEQ ID NO: 1071427 - RNA, 21 nt, Homo sapiens
aaauuuggcuucuguugucac

SEQ ID NO: 1071428 - RNA, 15 nt, Homo sapiens
aacacauuaagccuu

SEQ ID NO: 1071429 - RNA, 15 nt, Homo sapiens
aacaccacgucacuu

SEQ ID NO: 1071430 - RNA, 13 nt, Homo sapiens
aacagacugaccu

SEQ ID NO: 1071431 - RNA, 13 nt, Homo sapiens
aacaggcagcuca

SEQ ID NO: 1071432 - RNA, 16 nt, Homo sapiens
aacaugaaacuuguca

SEQ ID NO: 1071433 - RNA, 20 nt, Homo sapiens
aacaugaugugaaaacccau

SEQ ID NO: 1071434 - RNA, 22 nt, Homo sapiens
aacaugguaaacgcugucccua

SEQ ID NO: 1071435 - RNA, 20 nt, Homo sapiens
aacauguuugggaaguccua

SEQ ID NO: 1071436 - RNA, 18 nt, Homo sapiens
aacauuucaguugccauu

SEQ ID NO: 1071437 - RNA, 12 nt, Homo sapiens
aaccacacugga

SEQ ID NO: 1071438 - RNA, 19 nt, Homo sapiens
aaccacucauaauucuuca

SEQ ID NO: 1071439 - RNA, 15 nt, Homo sapiens
aaccaugaaaauggg

SEQ ID NO: 1071440 - RNA, 22 nt, Homo sapiens
aacccagucacugugagcuccc

SEQ ID NO: 1071441 - RNA, 22 nt, Homo sapiens
aacccucuccuguuuacugaaa

SEQ ID NO: 1071442 - RNA, 14 nt, Homo sapiens
aaccuccagccucc

SEQ ID NO: 1071443 - RNA, 18 nt, Homo sapiens
aacuagcuuggaaacugg

SEQ ID NO: 1071444 - RNA, 20 nt, Homo sapiens
aacuagguuaccgcuuauca

SEQ ID NO: 1071445 - RNA, 14 nt, Homo sapiens
aacuaguauucccu

SEQ ID NO: 1071446 - RNA, 20 nt, Homo sapiens
aacugccuuuggcagaguuc

SEQ ID NO: 1071447 - RNA, 23 nt, Homo sapiens
aacuguaccaugugcuacagggg

SEQ ID NO: 1071448 - RNA, 17 nt, Homo sapiens
aacugucugacuuauaa

SEQ ID NO: 1071449 - RNA, 18 nt, Homo sapiens
aacuguucccaccugcug

SEQ ID NO: 1071450 - RNA, 21 nt, Homo sapiens
aacuuccagugcaacacugaa

SEQ ID NO: 1071451 - RNA, 14 nt, Homo sapiens
aacuugagucacaa

SEQ ID NO: 1071452 - RNA, 18 nt, Homo sapiens
aacuugggaauaaaucau

SEQ ID NO: 1071453 - RNA, 23 nt, Homo sapiens
aacuugggaauaaaucauagcaa

SEQ ID NO: 1071454 - RNA, 19 nt, Homo sapiens
aagaaaaaaaaagucuuug

SEQ ID NO: 1071455 - RNA, 14 nt, Homo sapiens
aagaaaaaaucugc

SEQ ID NO: 1071456 - RNA, 21 nt, Homo sapiens
aagaaaauuagggcaaggugu

SEQ ID NO: 1071457 - RNA, 23 nt, Homo sapiens
aagaaauaucugagcucuuugca

SEQ ID NO: 1071458 - RNA, 14 nt, Homo sapiens
aagaaauucuguca

SEQ ID NO: 1071459 - RNA, 21 nt, Homo sapiens
aagaacaauauugacuuuguc

SEQ ID NO: 1071460 - RNA, 14 nt, Homo sapiens
aagaaguugcucug

SEQ ID NO: 1071461 - RNA, 20 nt, Homo sapiens
aagacacugaaauauacaca

SEQ ID NO: 1071462 - RNA, 17 nt, Homo sapiens
aagacuauauuguacac

SEQ ID NO: 1071463 - RNA, 23 nt, Homo sapiens
aagacuauucccuucuaaccuga

SEQ ID NO: 1071464 - RNA, 13 nt, Homo sapiens
aagagauuccuga

SEQ ID NO: 1071465 - RNA, 23 nt, Homo sapiens
aagagauuccugagccaguguca

SEQ ID NO: 1071466 - RNA, 19 nt, Homo sapiens
aagagcgaaacuccaucuc

SEQ ID NO: 1071467 - RNA, 21 nt, Homo sapiens
aagaguguggagucauucuca

SEQ ID NO: 1071468 - RNA, 13 nt, Homo sapiens
aagaucucugcag

SEQ ID NO: 1071469 - RNA, 14 nt, Homo sapiens
aagaugugcuuaua

SEQ ID NO: 1071470 - RNA, 18 nt, Homo sapiens
aagauucuucccauucuc

SEQ ID NO: 1071471 - RNA, 17 nt, Homo sapiens
aagcaaaagucagucuu

SEQ ID NO: 1071472 - RNA, 17 nt, Homo sapiens
aagcacuguuucucuca

SEQ ID NO: 1071473 - RNA, 21 nt, Homo sapiens
aagcagucuuucuauccuguu

SEQ ID NO: 1071474 - RNA, 16 nt, Homo sapiens
aagcaucacuugggau

SEQ ID NO: 1071475 - RNA, 15 nt, Homo sapiens
aagcgucauggauau

SEQ ID NO: 1071476 - RNA, 12 nt, Homo sapiens
agcaucucaggu

SEQ ID NO: 1071477 - RNA, 21 nt, Homo sapiens
agcaugcugugauugugccua

SEQ ID NO: 1071478 - RNA, 18 nt, Homo sapiens
agcauuaugauguggguc

SEQ ID NO: 1071479 - RNA, 12 nt, Homo sapiens
agccaaggcagg

SEQ ID NO: 1071480 - RNA, 22 nt, Homo sapiens
agccacacucugggcuccagag

SEQ ID NO: 1071481 - RNA, 15 nt, Homo sapiens
agccauuuuuacugu

SEQ ID NO: 1071482 - RNA, 19 nt, Homo sapiens
agccucccaaguagcugag

SEQ ID NO: 1071483 - RNA, 22 nt, Homo sapiens
agccucccaaguagcugagacu

SEQ ID NO: 1071484 - RNA, 23 nt, Homo sapiens
agccuccugcccagcacaggaau

SEQ ID NO: 1071485 - RNA, 16 nt, Homo sapiens
agccuggccaacaugg

SEQ ID NO: 1071486 - RNA, 21 nt, Homo sapiens
agccuuccacacucaccucua

SEQ ID NO: 1071487 - RNA, 19 nt, Homo sapiens
agcgauccucccaccucag

SEQ ID NO: 1071488 - RNA, 14 nt, Homo sapiens
agcggacaguggca

SEQ ID NO: 1071489 - RNA, 15 nt, Homo sapiens
agcggacaguggcag

SEQ ID NO: 1071490 - RNA, 22 nt, Homo sapiens
agcgggagccucccugccucag

SEQ ID NO: 1071491 - RNA, 13 nt, Homo sapiens
agcuaacaccaga

SEQ ID NO: 1071492 - RNA, 21 nt, Homo sapiens
agcuacaccuuucuccuuugu

SEQ ID NO: 1071493 - RNA, 23 nt, Homo sapiens
agcucuccccucagagugcaagc

SEQ ID NO: 1071494 - RNA, 16 nt, Homo sapiens
agcugaggcaggugaa

SEQ ID NO: 1071495 - RNA, 13 nt, Homo sapiens
agcugaugacuca

SEQ ID NO: 1071496 - RNA, 18 nt, Homo sapiens
agcugcuccccucugcac

SEQ ID NO: 1071497 - RNA, 12 nt, Homo sapiens
agcugcuucuau

SEQ ID NO: 1071498 - RNA, 17 nt, Homo sapiens
agcuggggcuacaggag

SEQ ID NO: 1071499 - RNA, 19 nt, Homo sapiens
agcuguccucccaccucag

SEQ ID NO: 1071500 - RNA, 20 nt, Homo sapiens
agcugugcacaaaguggcau

SEQ ID NO: 1071501 - RNA, 14 nt, Homo sapiens
agcuuagugaaaag

SEQ ID NO: 1071502 - RNA, 19 nt, Homo sapiens
aggaaaagcggacaucagc

SEQ ID NO: 1071503 - RNA, 19 nt, Homo sapiens
aggaauacauaaaguaugu

SEQ ID NO: 1071504 - RNA, 20 nt, Homo sapiens
aggaaugagauuaauuccuu

SEQ ID NO: 1071505 - RNA, 15 nt, Homo sapiens
aggacaagggaaaug

SEQ ID NO: 1071506 - RNA, 13 nt, Homo sapiens
aggacaguauucc

SEQ ID NO: 1071507 - RNA, 15 nt, Homo sapiens
aggacaguauuccug

SEQ ID NO: 1071508 - RNA, 17 nt, Homo sapiens
aggacccaagcagagaa

SEQ ID NO: 1071509 - RNA, 21 nt, Homo sapiens
aggaggccguugauucacuuc

SEQ ID NO: 1071510 - RNA, 18 nt, Homo sapiens
aggagggcagaucacuuc

SEQ ID NO: 1071511 - RNA, 17 nt, Homo sapiens
aggaucuuuugaaccca

SEQ ID NO: 1071512 - RNA, 15 nt, Homo sapiens
cccuuacuguuucac

SEQ ID NO: 1071513 - RNA, 15 nt, Homo sapiens
cccuuuacaaauaga

SEQ ID NO: 1071514 - RNA, 23 nt, Homo sapiens
ccgcgugaucaaagccacacucu

SEQ ID NO: 1071515 - RNA, 22 nt, Homo sapiens
ccgguggcucacgccuguaauc

SEQ ID NO: 1071516 - RNA, 19 nt, Homo sapiens
ccuaaugucuguaucacuc

SEQ ID NO: 1071517 - RNA, 24 nt, Homo sapiens
ccuagcuuagugaaaagauagcca

SEQ ID NO: 1071518 - RNA, 20 nt, Homo sapiens
ccuauauagaugcagcauuu

SEQ ID NO: 1071519 - RNA, 15 nt, Homo sapiens
ccucaaccaaugcca

SEQ ID NO: 1071520 - RNA, 13 nt, Homo sapiens
ccucaauuccaac

SEQ ID NO: 1071521 - RNA, 12 nt, Homo sapiens
ccucagauuccg

SEQ ID NO: 1071522 - RNA, 16 nt, Homo sapiens
ccucagggcacaaaga

SEQ ID NO: 1071523 - RNA, 19 nt, Homo sapiens
ccuccaugaauaucaguua

SEQ ID NO: 1071524 - RNA, 20 nt, Homo sapiens
ccuccugcccagcacaggaa

SEQ ID NO: 1071525 - RNA, 15 nt, Homo sapiens
ccugcacucuuuaag

SEQ ID NO: 1071526 - RNA, 14 nt, Homo sapiens
ccugcccuuggcac

SEQ ID NO: 1071527 - RNA, 16 nt, Homo sapiens
ccugccuuccagccac

SEQ ID NO: 1071528 - RNA, 20 nt, Homo sapiens
ccugcucacaguccucauuu

SEQ ID NO: 1071529 - RNA, 13 nt, Homo sapiens
ccugcuccagaag

SEQ ID NO: 1071530 - RNA, 20 nt, Homo sapiens
ccuggccaauacggcaaaac

SEQ ID NO: 1071531 - RNA, 14 nt, Homo sapiens
ccuggggaugugaa

SEQ ID NO: 1071532 - RNA, 12 nt, Homo sapiens
ccugggugacaa

SEQ ID NO: 1071533 - RNA, 18 nt, Homo sapiens
ccuguaauccuagcacuu

SEQ ID NO: 1071534 - RNA, 19 nt, Homo sapiens
ccuguaauccuagcacuuu

SEQ ID NO: 1071535 - RNA, 22 nt, Homo sapiens
ccugucauucuagaaacaggaa

SEQ ID NO: 1071536 - RNA, 12 nt, Homo sapiens
ccugugccucca

SEQ ID NO: 1071537 - RNA, 15 nt, Homo sapiens
ccugugccuccauca

SEQ ID NO: 1071538 - RNA, 18 nt, Homo sapiens
ccuguggugguugugauc

SEQ ID NO: 1071539 - RNA, 18 nt, Homo sapiens
ccuguguauucauucuca

SEQ ID NO: 1071540 - RNA, 14 nt, Homo sapiens
ccuguuaucaguag

SEQ ID NO: 1071541 - RNA, 13 nt, Homo sapiens
ccuuaugcuucuu

SEQ ID NO: 1071542 - RNA, 15 nt, Homo sapiens
ccuucaaacuuccag

SEQ ID NO: 1071543 - RNA, 20 nt, Homo sapiens
ccuuccacacucaccucuaa

SEQ ID NO: 1071544 - RNA, 14 nt, Homo sapiens
ccuuccagccacau

SEQ ID NO: 1071545 - RNA, 21 nt, Homo sapiens
ccuuccagggguuuacagucu

SEQ ID NO: 1071546 - RNA, 17 nt, Homo sapiens
ccuuccuauuuugcaua

SEQ ID NO: 1071547 - RNA, 16 nt, Homo sapiens
ccuucuuacaaugcau

SEQ ID NO: 1071548 - RNA, 20 nt, Homo sapiens
ccuucuucuuagcaccacaa

SEQ ID NO: 1071549 - RNA, 22 nt, Homo sapiens
ccuugagaagauucuucccauu

SEQ ID NO: 1071550 - RNA, 17 nt, Homo sapiens
ccuugaugagcugugca

SEQ ID NO: 1071551 - RNA, 20 nt, Homo sapiens
ccuugcgauucugcagccac

SEQ ID NO: 1071552 - RNA, 14 nt, Homo sapiens
ccuuguugaugugg

SEQ ID NO: 1071553 - RNA, 14 nt, Homo sapiens
ccuuuccagguauu

SEQ ID NO: 1071554 - RNA, 18 nt, Homo sapiens
ccuuucuccuuuguacuu

SEQ ID NO: 1071555 - RNA, 21 nt, Homo sapiens
ccuuugauaaauguauauaug

SEQ ID NO: 1071556 - RNA, 18 nt, Homo sapiens
ccuuugccucaaggacuu

SEQ ID NO: 1071557 - RNA, 17 nt, Homo sapiens
ccuuuggcagaguucua

SEQ ID NO: 1071558 - RNA, 12 nt, Homo sapiens
cgaaaguggaaa

SEQ ID NO: 1071559 - RNA, 14 nt, Homo sapiens
cgaagaguggacaa

SEQ ID NO: 1071560 - RNA, 14 nt, Homo sapiens
cgccagcugaugac

SEQ ID NO: 1071561 - RNA, 15 nt, Homo sapiens
cgcccaaggcccacg

SEQ ID NO: 1071562 - RNA, 22 nt, Homo sapiens
cgcugggauccgggaucaaagu

SEQ ID NO: 1071563 - RNA, 14 nt, Homo sapiens
cggacaguggcagg

SEQ ID NO: 1071564 - RNA, 23 nt, Homo sapiens
cggggacugcuucguguucugua

SEQ ID NO: 1071565 - RNA, 23 nt, Homo sapiens
cgggggcuuggcugugcccucag

SEQ ID NO: 1071566 - RNA, 18 nt, Homo sapiens
cggugacucaugccugua

SEQ ID NO: 1071567 - RNA, 17 nt, Homo sapiens
cgguucacucuucucag

SEQ ID NO: 1071568 - RNA, 23 nt, Homo sapiens
cguaacaccugauuaacugaggc

SEQ ID NO: 1071569 - RNA, 15 nt, Homo sapiens
cgugaucaaagccac

SEQ ID NO: 1071570 - RNA, 16 nt, Homo sapiens
cgugugggcaauguuc

SEQ ID NO: 1071571 - RNA, 13 nt, Homo sapiens
cuaaaacaguccu

SEQ ID NO: 1071572 - RNA, 15 nt, Homo sapiens
cuaaaagcacacuca

SEQ ID NO: 1071573 - RNA, 18 nt, Homo sapiens
cuaaaagcacacucaucc

SEQ ID NO: 1071574 - RNA, 23 nt, Homo sapiens
cuaaacucuuuuucauccaggcc

SEQ ID NO: 1071575 - RNA, 21 nt, Homo sapiens
cuaacuggggauauaauacua

SEQ ID NO: 1071576 - RNA, 16 nt, Homo sapiens
cuaacugucugacuua

SEQ ID NO: 1071577 - RNA, 23 nt, Homo sapiens
cuaagcaaacccagugucaggau

SEQ ID NO: 1071578 - RNA, 23 nt, Homo sapiens
cuaaggaaaaaacuaguauuccc

SEQ ID NO: 1071579 - RNA, 23 nt, Homo sapiens
cuaaugauggcccauucuacuug

SEQ ID NO: 1071580 - RNA, 16 nt, Homo sapiens
cuacauguacaauaag

SEQ ID NO: 1071581 - RNA, 19 nt, Homo sapiens
cuacuaaaaauacaaaaau

SEQ ID NO: 1071582 - RNA, 13 nt, Homo sapiens
cuacuucagucuu

SEQ ID NO: 1071583 - RNA, 15 nt, Homo sapiens
cuagagcuacagggg

SEQ ID NO: 1071584 - RNA, 17 nt, Homo sapiens
cuaggauacugcugcgu

SEQ ID NO: 1071585 - RNA, 19 nt, Homo sapiens
cuauaaucccagcacuuug

SEQ ID NO: 1071586 - RNA, 23 nt, Homo sapiens
cuauaauuguauauaugccuuug

SEQ ID NO: 1071587 - RNA, 22 nt, Homo sapiens
cuauaugccgcuacaaaaaggu

SEQ ID NO: 1071588 - RNA, 17 nt, Homo sapiens
cuauauuuauacuguau

SEQ ID NO: 1071589 - RNA, 20 nt, Homo sapiens
cuauguugucuuuuaaaaag

SEQ ID NO: 1071590 - RNA, 18 nt, Homo sapiens
agaugugcuuauaucauu

SEQ ID NO: 1071591 - RNA, 11 nt, Homo sapiens
agauucacaua

SEQ ID NO: 1071592 - RNA, 22 nt, Homo sapiens
agauugccucucuagacaacua

SEQ ID NO: 1071593 - RNA, 15 nt, Homo sapiens
agauuuaaauccuuu

SEQ ID NO: 1071594 - RNA, 15 nt, Homo sapiens
agcaaacacauuaag

SEQ ID NO: 1071595 - RNA, 20 nt, Homo sapiens
agcaaagauugugccacuac

SEQ ID NO: 1071596 - RNA, 15 nt, Homo sapiens
agcaagacugagggg

SEQ ID NO: 1071597 - RNA, 19 nt, Homo sapiens
agcaagaucccaucucuuu

SEQ ID NO: 1071598 - RNA, 16 nt, Homo sapiens
agcacuguuucucuca

SEQ ID NO: 1071599 - RNA, 13 nt, Homo sapiens
agcauacaacuuu

SEQ ID NO: 1071600 - RNA, 17 nt, Homo sapiens
agcauaccaccaugccu

SEQ ID NO: 1071601 - RNA, 22 nt, Homo sapiens
agccaaggcaggcagaucacuu

SEQ ID NO: 1071602 - RNA, 17 nt, Homo sapiens
agccaggugaacuggaa

SEQ ID NO: 1071603 - RNA, 18 nt, Homo sapiens
agcccagaaagucucuca

SEQ ID NO: 1071604 - RNA, 15 nt, Homo sapiens
agcccccccuuccac

SEQ ID NO: 1071605 - RNA, 16 nt, Homo sapiens
agccccugcuccagaa

SEQ ID NO: 1071606 - RNA, 14 nt, Homo sapiens
agcccugacccugu

SEQ ID NO: 1071607 - RNA, 20 nt, Homo sapiens
agcccuggccucugcucaac

SEQ ID NO: 1071608 - RNA, 17 nt, Homo sapiens
agcccugggaucacugu

SEQ ID NO: 1071609 - RNA, 14 nt, Homo sapiens
agccuaaggcugua

SEQ ID NO: 1071610 - RNA, 14 nt, Homo sapiens
agccucccagugug

SEQ ID NO: 1071611 - RNA, 16 nt, Homo sapiens
agcgaacugucagccu

SEQ ID NO: 1071612 - RNA, 14 nt, Homo sapiens
agcgggaauggcag

SEQ ID NO: 1071613 - RNA, 22 nt, Homo sapiens
agcuacaaucuguucaauguuu

SEQ ID NO: 1071614 - RNA, 15 nt, Homo sapiens
agcuaccucaaccaa

SEQ ID NO: 1071615 - RNA, 20 nt, Homo sapiens
agcuacucgggaggcugaga

SEQ ID NO: 1071616 - RNA, 12 nt, Homo sapiens
agcuagccagag

SEQ ID NO: 1071617 - RNA, 18 nt, Homo sapiens
agcuccacuuucagugaa

SEQ ID NO: 1071618 - RNA, 17 nt, Homo sapiens
agcucuuccgaaaacca

SEQ ID NO: 1071619 - RNA, 18 nt, Homo sapiens
agcucuugaagacacuga

SEQ ID NO: 1071620 - RNA, 14 nt, Homo sapiens
agcuggucugggug

SEQ ID NO: 1071621 - RNA, 16 nt, Homo sapiens
agcuggugguaucuga

SEQ ID NO: 1071622 - RNA, 20 nt, Homo sapiens
agcuggugguaucugaguug

SEQ ID NO: 1071623 - RNA, 15 nt, Homo sapiens
agcuuagauugccuc

SEQ ID NO: 1071624 - RNA, 15 nt, Homo sapiens
agcuucuuugccaag

SEQ ID NO: 1071625 - RNA, 16 nt, Homo sapiens
agcuugaucaaaggca

SEQ ID NO: 1071626 - RNA, 14 nt, Homo sapiens
agcuuggaaacugg

SEQ ID NO: 1071627 - RNA, 20 nt, Homo sapiens
aggaaaagcggacaucagcu

SEQ ID NO: 1071628 - RNA, 13 nt, Homo sapiens
aggaaacaacagc

SEQ ID NO: 1071629 - RNA, 17 nt, Homo sapiens
aggaauuaaguuaggga

SEQ ID NO: 1071630 - RNA, 21 nt, Homo sapiens
aggacaagggaaaugucaggg

SEQ ID NO: 1071631 - RNA, 11 nt, Homo sapiens
aggacccaagc

SEQ ID NO: 1071632 - RNA, 18 nt, Homo sapiens
aggagaaagaagagcagc

SEQ ID NO: 1071633 - RNA, 18 nt, Homo sapiens
aggagacccacagguaug

SEQ ID NO: 1071634 - RNA, 22 nt, Homo sapiens
aggaguuccagaccagccugac

SEQ ID NO: 1071635 - RNA, 18 nt, Homo sapiens
aggaguucgagaccagcc

SEQ ID NO: 1071636 - RNA, 15 nt, Homo sapiens
aggaguucugcucau

SEQ ID NO: 1071637 - RNA, 22 nt, Homo sapiens
aggcauaaagacuaauuagcaa

SEQ ID NO: 1071638 - RNA, 17 nt, Homo sapiens
aggcaugaaauacugug

SEQ ID NO: 1071639 - RNA, 23 nt, Homo sapiens
aggcaugagcuacuaugcccaac

SEQ ID NO: 1071640 - RNA, 16 nt, Homo sapiens
aggccagugagccacu

SEQ ID NO: 1071641 - RNA, 16 nt, Homo sapiens
aggccccugucucagg

SEQ ID NO: 1071642 - RNA, 18 nt, Homo sapiens
aggccccugucucagggu

SEQ ID NO: 1071643 - RNA, 12 nt, Homo sapiens
aggccucugugc

SEQ ID NO: 1071644 - RNA, 11 nt, Homo sapiens
aggccuuccag

SEQ ID NO: 1071645 - RNA, 20 nt, Homo sapiens
aggcggguggaucacuugag

SEQ ID NO: 1071646 - RNA, 18 nt, Homo sapiens
agggaacaaguacuucuu

SEQ ID NO: 1071647 - RNA, 14 nt, Homo sapiens
aucacuugagguca

SEQ ID NO: 1071648 - RNA, 23 nt, Homo sapiens
aucaggaaauuuggggcagauuu

SEQ ID NO: 1071649 - RNA, 16 nt, Homo sapiens
aucaggaccuccaagc

SEQ ID NO: 1071650 - RNA, 17 nt, Homo sapiens
aucaguccaaagggcau

SEQ ID NO: 1071651 - RNA, 15 nt, Homo sapiens
aucauaaccauguga

SEQ ID NO: 1071652 - RNA, 22 nt, Homo sapiens
aucauuugguuuuaaaauauga

SEQ ID NO: 1071653 - RNA, 16 nt, Homo sapiens
auccacacugagcuga

SEQ ID NO: 1071654 - RNA, 20 nt, Homo sapiens
auccaggccugccaagguga

SEQ ID NO: 1071655 - RNA, 18 nt, Homo sapiens
auccaugcgucaguuuuu

SEQ ID NO: 1071656 - RNA, 16 nt, Homo sapiens
auccauuuaugucuca

SEQ ID NO: 1071657 - RNA, 16 nt, Homo sapiens
aucccagcuaccucaa

SEQ ID NO: 1071658 - RNA, 12 nt, Homo sapiens
auccccuguggg

SEQ ID NO: 1071659 - RNA, 19 nt, Homo sapiens
auccuuuuaaaucuugaua

SEQ ID NO: 1071660 - RNA, 17 nt, Homo sapiens
aucgcaguguucaaggc

SEQ ID NO: 1071661 - RNA, 15 nt, Homo sapiens
aucuccaagaccaga

SEQ ID NO: 1071662 - RNA, 15 nt, Homo sapiens
aucuugauaccaccu

SEQ ID NO: 1071663 - RNA, 14 nt, Homo sapiens
aucuuugugcuuca

SEQ ID NO: 1071664 - RNA, 13 nt, Homo sapiens
augaaaucuugca

SEQ ID NO: 1071665 - RNA, 15 nt, Homo sapiens
augaaaucuugcaau

SEQ ID NO: 1071666 - RNA, 16 nt, Homo sapiens
augaagcaaacacauu

SEQ ID NO: 1071667 - RNA, 21 nt, Homo sapiens
augaagguuucugaaaauuaa

SEQ ID NO: 1071668 - RNA, 20 nt, Homo sapiens
augacuaauucuugcauauu

SEQ ID NO: 1071669 - RNA, 23 nt, Homo sapiens
augagcugugcacaaaguggcau

SEQ ID NO: 1071670 - RNA, 23 nt, Homo sapiens
augauagugguggaguuaaucuu

SEQ ID NO: 1071671 - RNA, 22 nt, Homo sapiens
augauccaagcaagacugaggg

SEQ ID NO: 1071672 - RNA, 22 nt, Homo sapiens
augauggcucauuuacacucag

SEQ ID NO: 1071673 - RNA, 18 nt, Homo sapiens
augaugugggucaaggaa

SEQ ID NO: 1071674 - RNA, 18 nt, Homo sapiens
augcagucuguccaggcu

SEQ ID NO: 1071675 - RNA, 16 nt, Homo sapiens
augcauguacccuaag

SEQ ID NO: 1071676 - RNA, 16 nt, Homo sapiens
augcccaaccuauccu

SEQ ID NO: 1071677 - RNA, 23 nt, Homo sapiens
augccucagcccugacccugugg

SEQ ID NO: 1071678 - RNA, 22 nt, Homo sapiens
auggcacagcccaaagaaggaa

SEQ ID NO: 1071679 - RNA, 11 nt, Homo sapiens
auggguucauc

SEQ ID NO: 1071680 - RNA, 21 nt, Homo sapiens
auggguuucuccagagggaau

SEQ ID NO: 1071681 - RNA, 16 nt, Homo sapiens
auggucauugcaggaa

SEQ ID NO: 1071682 - RNA, 20 nt, Homo sapiens
augguccugcagaagcagaa

SEQ ID NO: 1071683 - RNA, 21 nt, Homo sapiens
auggucuuaaggaacaucucu

SEQ ID NO: 1071684 - RNA, 18 nt, Homo sapiens
auguaaaucugcucagga

SEQ ID NO: 1071685 - RNA, 17 nt, Homo sapiens
auguauuuuccccucaa

SEQ ID NO: 1071686 - RNA, 21 nt, Homo sapiens
augucaaggaaugaagaacaa

SEQ ID NO: 1071687 - RNA, 14 nt, Homo sapiens
augugaacaaccug

SEQ ID NO: 1071688 - RNA, 12 nt, Homo sapiens
auguguauauau

SEQ ID NO: 1071689 - RNA, 16 nt, Homo sapiens
auguguguguauauau

SEQ ID NO: 1071690 - RNA, 13 nt, Homo sapiens
auguucugcuuuc

SEQ ID NO: 1071691 - RNA, 18 nt, Homo sapiens
auguugguuuuaauacuu

SEQ ID NO: 1071692 - RNA, 21 nt, Homo sapiens
auuaacugaggcauccacuuc

SEQ ID NO: 1071693 - RNA, 20 nt, Homo sapiens
auuacaugaaaguucagauu

SEQ ID NO: 1071694 - RNA, 19 nt, Homo sapiens
auuagaaacaacauagcaa

SEQ ID NO: 1071695 - RNA, 15 nt, Homo sapiens
auucaaagcacuguu

SEQ ID NO: 1071696 - RNA, 21 nt, Homo sapiens
auucagaaugaucugcaagaa

SEQ ID NO: 1071697 - RNA, 15 nt, Homo sapiens
auucagccuuuagaa

SEQ ID NO: 1071698 - RNA, 18 nt, Homo sapiens
auucccacagcacuaauu

SEQ ID NO: 1071699 - RNA, 21 nt, Homo sapiens
auucccacagcacuaauucaa

SEQ ID NO: 1071700 - RNA, 20 nt, Homo sapiens
auuccucuuuucucugccau

SEQ ID NO: 1071701 - RNA, 22 nt, Homo sapiens
cacaggaaucgguggucuccac

SEQ ID NO: 1071702 - RNA, 21 nt, Homo sapiens
cacauacauguaaaauauguc

SEQ ID NO: 1071703 - RNA, 17 nt, Homo sapiens
cacaugcccuaaugucu

SEQ ID NO: 1071704 - RNA, 20 nt, Homo sapiens
cacaugcccuaaugucugua

SEQ ID NO: 1071705 - RNA, 17 nt, Homo sapiens
cacauuggaacagugaa

SEQ ID NO: 1071706 - RNA, 16 nt, Homo sapiens
caccaauaaagccuuc

SEQ ID NO: 1071707 - RNA, 15 nt, Homo sapiens
caccacucaaaaaug

SEQ ID NO: 1071708 - RNA, 22 nt, Homo sapiens
caccagaugccauuacauuuau

SEQ ID NO: 1071709 - RNA, 16 nt, Homo sapiens
caccaguuccuuucaa

SEQ ID NO: 1071710 - RNA, 16 nt, Homo sapiens
caccauucaggucuuu

SEQ ID NO: 1071711 - RNA, 19 nt, Homo sapiens
cacccagacuggagugcag

SEQ ID NO: 1071712 - RNA, 16 nt, Homo sapiens
caccuaaauaaccaau

SEQ ID NO: 1071713 - RNA, 22 nt, Homo sapiens
caccuauauagaugcagcauuu

SEQ ID NO: 1071714 - RNA, 15 nt, Homo sapiens
caccucucccugacc

SEQ ID NO: 1071715 - RNA, 14 nt, Homo sapiens
caccuguaauccca

SEQ ID NO: 1071716 - RNA, 22 nt, Homo sapiens
caccuugcgauucugcagccac

SEQ ID NO: 1071717 - RNA, 19 nt, Homo sapiens
caccuuuggugcuuuccag

SEQ ID NO: 1071718 - RNA, 22 nt, Homo sapiens
cacgccuguaaucccagcaauu

SEQ ID NO: 1071719 - RNA, 13 nt, Homo sapiens
cacucagcucuug

SEQ ID NO: 1071720 - RNA, 21 nt, Homo sapiens
cacucuagccugggugacaga

SEQ ID NO: 1071721 - RNA, 13 nt, Homo sapiens
cacugauuucccc

SEQ ID NO: 1071722 - RNA, 19 nt, Homo sapiens
cacugcauaccaaccuggg

SEQ ID NO: 1071723 - RNA, 18 nt, Homo sapiens
cacuggaaugaguugaaa

SEQ ID NO: 1071724 - RNA, 13 nt, Homo sapiens
cacugugagcucc

SEQ ID NO: 1071725 - RNA, 14 nt, Homo sapiens
cacuguuucucuca

SEQ ID NO: 1071726 - RNA, 19 nt, Homo sapiens
cacuuugggaggccgaggu

SEQ ID NO: 1071727 - RNA, 21 nt, Homo sapiens
cacuuuuuuuuuuaaucucca

SEQ ID NO: 1071728 - RNA, 18 nt, Homo sapiens
cagaaacuuuacaaccug

SEQ ID NO: 1071729 - RNA, 17 nt, Homo sapiens
cagaagcagaagugcaa

SEQ ID NO: 1071730 - RNA, 15 nt, Homo sapiens
cagaauuagcugcuu

SEQ ID NO: 1071731 - RNA, 19 nt, Homo sapiens
cagaauuagcugcuucuau

SEQ ID NO: 1071732 - RNA, 15 nt, Homo sapiens
cagacaacacuggga

SEQ ID NO: 1071733 - RNA, 16 nt, Homo sapiens
cagacagacaacacug

SEQ ID NO: 1071734 - RNA, 15 nt, Homo sapiens
cagaccuuuuaacuc

SEQ ID NO: 1071735 - RNA, 19 nt, Homo sapiens
cagaccuuuuaacuccuca

SEQ ID NO: 1071736 - RNA, 21 nt, Homo sapiens
cagacugaccuugaugagcug

SEQ ID NO: 1071737 - RNA, 15 nt, Homo sapiens
cagacuggagugcag

SEQ ID NO: 1071738 - RNA, 14 nt, Homo sapiens
cagagcaagacucu

SEQ ID NO: 1071739 - RNA, 14 nt, Homo sapiens
cagaggacugugau

SEQ ID NO: 1071740 - RNA, 14 nt, Homo sapiens
cagaggcaccucaa

SEQ ID NO: 1071741 - RNA, 21 nt, Homo sapiens
cagaggcagcuucuuugccaa

SEQ ID NO: 1071742 - RNA, 18 nt, Homo sapiens
cagaggggcagauggaaa

SEQ ID NO: 1071743 - RNA, 19 nt, Homo sapiens
cagagucaaugaacuuucc

SEQ ID NO: 1071744 - RNA, 11 nt, Homo sapiens
cagagugcaag

SEQ ID NO: 1071745 - RNA, 24 nt, Homo sapiens
cagaguggggaugacaugcacuca

SEQ ID NO: 1071746 - RNA, 21 nt, Homo sapiens
cagaguucuauaauguaaaca

SEQ ID NO: 1071747 - RNA, 19 nt, Homo sapiens
cagauacugucucuuucau

SEQ ID NO: 1071748 - RNA, 21 nt, Homo sapiens
cagaugcagaaaauugccuaa

SEQ ID NO: 1071749 - RNA, 12 nt, Homo sapiens
cagcagacugau

SEQ ID NO: 1071750 - RNA, 22 nt, Homo sapiens
cagccaaccuaauuaccuguau

SEQ ID NO: 1071751 - RNA, 13 nt, Homo sapiens
cagcccugcagug

SEQ ID NO: 1071752 - RNA, 15 nt, Homo sapiens
cagcccugcagugcc

SEQ ID NO: 1071753 - RNA, 14 nt, Homo sapiens
cagccuggcaaggg

SEQ ID NO: 1071754 - RNA, 21 nt, Homo sapiens
cagccuggccaguauggugaa

SEQ ID NO: 1071755 - RNA, 20 nt, Homo sapiens
cagcuaaacaccacgucacu

SEQ ID NO: 1071756 - RNA, 22 nt, Homo sapiens
cagcuaaacaccacgucacuuc

SEQ ID NO: 1071757 - RNA, 23 nt, Homo sapiens
cagcucuccccucagagugcaag

SEQ ID NO: 1071758 - RNA, 14 nt, Homo sapiens
cagcugaugacuca

SEQ ID NO: 1071759 - RNA, 16 nt, Homo sapiens
caggaaaaacccguca

SEQ ID NO: 1071760 - RNA, 22 nt, Homo sapiens
caggaaauauaucuuaaugcag

SEQ ID NO: 1071761 - RNA, 22 nt, Homo sapiens
caggaccuccaagccacugagc

SEQ ID NO: 1071762 - RNA, 18 nt, Homo sapiens
caggaggaaggcuuacac

SEQ ID NO: 1071763 - RNA, 14 nt, Homo sapiens
caggaguucagggu

SEQ ID NO: 1071764 - RNA, 21 nt, Homo sapiens
caggaguucagggucauagca

SEQ ID NO: 1071765 - RNA, 22 nt, Homo sapiens
caggauuccucuuuucucugcc

SEQ ID NO: 1071766 - RNA, 19 nt, Homo sapiens
caggcagcuuuuucucucc

SEQ ID NO: 1071767 - RNA, 19 nt, Homo sapiens
caggcaugagucagucuga

SEQ ID NO: 1071768 - RNA, 14 nt, Homo sapiens
caggccagcugccu

SEQ ID NO: 1071769 - RNA, 16 nt, Homo sapiens
caggcucaagcugucc

SEQ ID NO: 1071770 - RNA, 15 nt, Homo sapiens
caggggcaugggaag

SEQ ID NO: 1071771 - RNA, 21 nt, Homo sapiens
caggggcucacaccuguaauc

SEQ ID NO: 1071772 - RNA, 20 nt, Homo sapiens
cagguagaacacaaggucau

SEQ ID NO: 1071773 - RNA, 21 nt, Homo sapiens
cagguagaacacaaggucauu

SEQ ID NO: 1071774 - RNA, 15 nt, Homo sapiens
caggugcagccagag

SEQ ID NO: 1071775 - RNA, 15 nt, Homo sapiens
caguaaaauagcuga

SEQ ID NO: 1071776 - RNA, 14 nt, Homo sapiens
caguagacugcagu

SEQ ID NO: 1071777 - RNA, 13 nt, Homo sapiens
cagucaauucuga

SEQ ID NO: 1071778 - RNA, 12 nt, Homo sapiens
cagucuuucuau

SEQ ID NO: 1071779 - RNA, 19 nt, Homo sapiens
cagugagcaaagauugugc

SEQ ID NO: 1071780 - RNA, 16 nt, Homo sapiens
cagugcuugaaugaag

SEQ ID NO: 1071781 - RNA, 14 nt, Homo sapiens
caguggauuuccca

SEQ ID NO: 1071782 - RNA, 14 nt, Homo sapiens
caguuaauuugcac

SEQ ID NO: 1071783 - RNA, 20 nt, Homo sapiens
caguuauuuuuaaacuguaa

SEQ ID NO: 1071784 - RNA, 16 nt, Homo sapiens
caguuccuuucaaugg

SEQ ID NO: 1071785 - RNA, 18 nt, Homo sapiens
caguugccauugacagaa

SEQ ID NO: 1071786 - RNA, 17 nt, Homo sapiens
caguuugaaucuauuua

SEQ ID NO: 1071787 - RNA, 19 nt, Homo sapiens
cauauacacaauaauguga

SEQ ID NO: 1071788 - RNA, 15 nt, Homo sapiens
cauauucccacagca

SEQ ID NO: 1071789 - RNA, 16 nt, Homo sapiens
caucagcuaaacacca

SEQ ID NO: 1071790 - RNA, 15 nt, Homo sapiens
caucaggaaauuugg

SEQ ID NO: 1071791 - RNA, 16 nt, Homo sapiens
cauccuauucuuucga

SEQ ID NO: 1071792 - RNA, 19 nt, Homo sapiens
cauccucacugcugucaac

SEQ ID NO: 1071793 - RNA, 18 nt, Homo sapiens
cauccugcaggcagcuuu

SEQ ID NO: 1071794 - RNA, 17 nt, Homo sapiens
caugaagaggaugcugu

SEQ ID NO: 1071795 - RNA, 16 nt, Homo sapiens
cauggguucauccuau

SEQ ID NO: 1071796 - RNA, 13 nt, Homo sapiens
cauuaaaagcuac

SEQ ID NO: 1071797 - RNA, 14 nt, Homo sapiens
cauuaaauaaugca

SEQ ID NO: 1071798 - RNA, 15 nt, Homo sapiens
cauuaaauaaugcau

SEQ ID NO: 1071799 - RNA, 23 nt, Homo sapiens
cauuagcugcccaggaugcugcu

SEQ ID NO: 1071800 - RNA, 20 nt, Homo sapiens
cauucaggagcuuccugucc

SEQ ID NO: 1071801 - RNA, 19 nt, Homo sapiens
cauucuaaugauggcccau

SEQ ID NO: 1071802 - RNA, 23 nt, Homo sapiens
cauucuaaugauggcccauucua

SEQ ID NO: 1071803 - RNA, 21 nt, Homo sapiens
cauucugucacccagacugga

SEQ ID NO: 1071804 - RNA, 20 nt, Homo sapiens
cauugaugcugacagucaug

SEQ ID NO: 1071805 - RNA, 22 nt, Homo sapiens
cauuggagagaaaaaacuuaag

SEQ ID NO: 1071806 - RNA, 22 nt, Homo sapiens
cauuuaaaaacaggcagcucau

SEQ ID NO: 1071807 - RNA, 23 nt, Homo sapiens
cauuugauaugugaaugcucaua

SEQ ID NO: 1071808 - RNA, 15 nt, Homo sapiens
cauuuguuaucuggg

SEQ ID NO: 1071809 - RNA, 22 nt, Homo sapiens
cauuuguuaucugggaacuuau

SEQ ID NO: 1071810 - RNA, 24 nt, Homo sapiens
cauuuugcauuuucaucuacucau

SEQ ID NO: 1071811 - RNA, 14 nt, Homo sapiens
cauuuugguuuaaa

SEQ ID NO: 1071812 - RNA, 17 nt, Homo sapiens
cauuuuuacguacuuga

SEQ ID NO: 1071813 - RNA, 16 nt, Homo sapiens
cauuuuugaaaccaaa

SEQ ID NO: 1071814 - RNA, 16 nt, Homo sapiens
ccaaaagcugcucagg

SEQ ID NO: 1071815 - RNA, 19 nt, Homo sapiens
ccaaaagcugcucagggaa

SEQ ID NO: 1071816 - RNA, 14 nt, Homo sapiens
ccaaauuacgugua

SEQ ID NO: 1071817 - RNA, 23 nt, Homo sapiens
ccaaccauguucccuucuucuua

SEQ ID NO: 1071818 - RNA, 16 nt, Homo sapiens
ccaacucagaagggag

SEQ ID NO: 1071819 - RNA, 23 nt, Homo sapiens
ccaagaccucagggcacaaagau

SEQ ID NO: 1071820 - RNA, 12 nt, Homo sapiens
ccaagagaccag

SEQ ID NO: 1071821 - RNA, 15 nt, Homo sapiens
ccaagcaagacugag

SEQ ID NO: 1071822 - RNA, 19 nt, Homo sapiens
ccaaggagggugagugcaa

SEQ ID NO: 1071823 - RNA, 13 nt, Homo sapiens
ccaauaaagccuu

SEQ ID NO: 1071824 - RNA, 16 nt, Homo sapiens
ccacacucaccucuaa

SEQ ID NO: 1071825 - RNA, 14 nt, Homo sapiens
ccacuacacuccag

SEQ ID NO: 1071826 - RNA, 15 nt, Homo sapiens
ccacuaggacuucaa

SEQ ID NO: 1071827 - RNA, 17 nt, Homo sapiens
ccagagaccaaauguca

SEQ ID NO: 1071828 - RNA, 18 nt, Homo sapiens
ccagaggcaccucaagaa

SEQ ID NO: 1071829 - RNA, 19 nt, Homo sapiens
ccagaggcagcuucuuugc

SEQ ID NO: 1071830 - RNA, 12 nt, Homo sapiens
ccagcacuuugg

SEQ ID NO: 1071831 - RNA, 16 nt, Homo sapiens
ccagccugaccaaaau

SEQ ID NO: 1071832 - RNA, 22 nt, Homo sapiens
ccagccuggccaguauggugaa

SEQ ID NO: 1071833 - RNA, 15 nt, Homo sapiens
ccagccugggugaca

SEQ ID NO: 1071834 - RNA, 17 nt, Homo sapiens
ccagcucagggcucuuu

SEQ ID NO: 1071835 - RNA, 19 nt, Homo sapiens
ccagcucagggcucuuucc

SEQ ID NO: 1071836 - RNA, 15 nt, Homo sapiens
ccagcuccucacuca

SEQ ID NO: 1071837 - RNA, 18 nt, Homo sapiens
ccagcuccucacucaccu

SEQ ID NO: 1071838 - RNA, 20 nt, Homo sapiens
ccaggcccauuuccugcuuu

SEQ ID NO: 1071839 - RNA, 14 nt, Homo sapiens
ccaggccugccaag

SEQ ID NO: 1071840 - RNA, 21 nt, Homo sapiens
ccagggagcugcaggggcaug

SEQ ID NO: 1071841 - RNA, 14 nt, Homo sapiens
ccagucacugugag

SEQ ID NO: 1071842 - RNA, 19 nt, Homo sapiens
ccagucacugugagcuccc

SEQ ID NO: 1071843 - RNA, 20 nt, Homo sapiens
ccagugcaacacugaagcuc

SEQ ID NO: 1071844 - RNA, 18 nt, Homo sapiens
ccaguuuuuguugcuuga

SEQ ID NO: 1071845 - RNA, 17 nt, Homo sapiens
ccaugaaaaugcaacaa

SEQ ID NO: 1071846 - RNA, 16 nt, Homo sapiens
ccauggugcuuguuaa

SEQ ID NO: 1071847 - RNA, 18 nt, Homo sapiens
ccauugcucuucuuuuga

SEQ ID NO: 1071848 - RNA, 18 nt, Homo sapiens
ccauuuguuaucugggaa

SEQ ID NO: 1071849 - RNA, 16 nt, Homo sapiens
ccauuuuuacuguuau

SEQ ID NO: 1071850 - RNA, 16 nt, Homo sapiens
cccaagcagagaagcu

SEQ ID NO: 1071851 - RNA, 13 nt, Homo sapiens
cccacagguauga

SEQ ID NO: 1071852 - RNA, 19 nt, Homo sapiens
cccagaugugguugcauaa

SEQ ID NO: 1071853 - RNA, 13 nt, Homo sapiens
cccagcacuuugg

SEQ ID NO: 1071854 - RNA, 18 nt, Homo sapiens
cccaggaguucugcucau

SEQ ID NO: 1071855 - RNA, 15 nt, Homo sapiens
cccaggcugggugca

SEQ ID NO: 1071856 - RNA, 14 nt, Homo sapiens
cccauuuccugcuu

SEQ ID NO: 1071857 - RNA, 14 nt, Homo sapiens
ccccuaaaccaaaa

SEQ ID NO: 1071858 - RNA, 15 nt, Homo sapiens
ccccucagagugcaa

SEQ ID NO: 1071859 - RNA, 17 nt, Homo sapiens
ccccugucucaggguga

SEQ ID NO: 1071860 - RNA, 22 nt, Homo sapiens
cccgccgccugguacucaagcc

SEQ ID NO: 1071861 - RNA, 14 nt, Homo sapiens
cccuaaaccaaaaa

SEQ ID NO: 1071862 - RNA, 17 nt, Homo sapiens
cccucagagugcaagcc

SEQ ID NO: 1071863 - RNA, 13 nt, Homo sapiens
cccucagauuccg

SEQ ID NO: 1071864 - RNA, 18 nt, Homo sapiens
cccugcccuuggcaccca

SEQ ID NO: 1071865 - RNA, 19 nt, Homo sapiens
ccgggcagaggggcagaug

SEQ ID NO: 1071866 - RNA, 17 nt, Homo sapiens
ccuaaaagcacacucau

SEQ ID NO: 1071867 - RNA, 11 nt, Homo sapiens
ccuaaauaacc

SEQ ID NO: 1071868 - RNA, 21 nt, Homo sapiens
ccuauuuagauggccaugaag

SEQ ID NO: 1071869 - RNA, 15 nt, Homo sapiens
ccucacaauaccuua

SEQ ID NO: 1071870 - RNA, 19 nt, Homo sapiens
ucaguguuggccaugauga

SEQ ID NO: 1071871 - RNA, 15 nt, Homo sapiens
ucaguuaugaaaugu

SEQ ID NO: 1071872 - RNA, 18 nt, Homo sapiens
ucauaaaaagacaacuca

SEQ ID NO: 1071873 - RNA, 20 nt, Homo sapiens
ucauaugcaaagcauauuaa

SEQ ID NO: 1071874 - RNA, 14 nt, Homo sapiens
ucauauuugcacua

SEQ ID NO: 1071875 - RNA, 13 nt, Homo sapiens
ucauccugcaggc

SEQ ID NO: 1071876 - RNA, 18 nt, Homo sapiens
ucaucuuucuuguuucau

SEQ ID NO: 1071877 - RNA, 14 nt, Homo sapiens
ucaugucucacuuc

SEQ ID NO: 1071878 - RNA, 12 nt, Homo sapiens
ucauuacagggc

SEQ ID NO: 1071879 - RNA, 17 nt, Homo sapiens
ucauuaggacauaacag

SEQ ID NO: 1071880 - RNA, 21 nt, Homo sapiens
ucauucccuucgacagcauuu

SEQ ID NO: 1071881 - RNA, 17 nt, Homo sapiens
ucauuguucuugugaac

SEQ ID NO: 1071882 - RNA, 19 nt, Homo sapiens
ucauuuuuuccagucuucc

SEQ ID NO: 1071883 - RNA, 14 nt, Homo sapiens
uccaaaccuucaca

SEQ ID NO: 1071884 - RNA, 14 nt, Homo sapiens
uccaauucagaaug

SEQ ID NO: 1071885 - RNA, 16 nt, Homo sapiens
uccacaucaccagaaa

SEQ ID NO: 1071886 - RNA, 16 nt, Homo sapiens
uccacuaggacuucaa

SEQ ID NO: 1071887 - RNA, 22 nt, Homo sapiens
uccagaagauagcuucacccca

SEQ ID NO: 1071888 - RNA, 14 nt, Homo sapiens
uccaggauuccucu

SEQ ID NO: 1071889 - RNA, 16 nt, Homo sapiens
uccagucugaucugug

SEQ ID NO: 1071890 - RNA, 23 nt, Homo sapiens
uccaucgcaguguucaaggccau

SEQ ID NO: 1071891 - RNA, 18 nt, Homo sapiens
ucccaaaccuucaggaaa

SEQ ID NO: 1071892 - RNA, 20 nt, Homo sapiens
ucccaccucagcuucucaaa

SEQ ID NO: 1071893 - RNA, 20 nt, Homo sapiens
ucccagcccuugcauugcag

SEQ ID NO: 1071894 - RNA, 18 nt, Homo sapiens
ucccagcuacaccuuucu

SEQ ID NO: 1071895 - RNA, 15 nt, Homo sapiens
ucccagcuacucggg

SEQ ID NO: 1071896 - RNA, 22 nt, Homo sapiens
ucccaugugauuuaaacaaaca

SEQ ID NO: 1071897 - RNA, 14 nt, Homo sapiens
uccccuaaaccaaa

SEQ ID NO: 1071898 - RNA, 17 nt, Homo sapiens
uccccuaaaccaaaaac

SEQ ID NO: 1071899 - RNA, 13 nt, Homo sapiens
uccccugugggaa

SEQ ID NO: 1071900 - RNA, 20 nt, Homo sapiens
ucccggauuuuuguuaauau

SEQ ID NO: 1071901 - RNA, 18 nt, Homo sapiens
ucccuuccuuguagccuu

SEQ ID NO: 1071902 - RNA, 16 nt, Homo sapiens
ucccuucuaaccugaa

SEQ ID NO: 1071903 - RNA, 21 nt, Homo sapiens
uccgaggccccugucucaggg

SEQ ID NO: 1071904 - RNA, 21 nt, Homo sapiens
uccuauuuagauggccaugaa

SEQ ID NO: 1071905 - RNA, 16 nt, Homo sapiens
uccucacucaccuuca

SEQ ID NO: 1071906 - RNA, 20 nt, Homo sapiens
uccugagggaucuauacuug

SEQ ID NO: 1071907 - RNA, 16 nt, Homo sapiens
uccugcuuauucauaa

SEQ ID NO: 1071908 - RNA, 15 nt, Homo sapiens
cuacacauacaugua

SEQ ID NO: 1071909 - RNA, 17 nt, Homo sapiens
cuacaggccagcaccuu

SEQ ID NO: 1071910 - RNA, 15 nt, Homo sapiens
cuaccccuuuacaaa

SEQ ID NO: 1071911 - RNA, 21 nt, Homo sapiens
cuaccucaaccaaugccaaaa

SEQ ID NO: 1071912 - RNA, 21 nt, Homo sapiens
cuacucaaguagcauuuacug

SEQ ID NO: 1071913 - RNA, 23 nt, Homo sapiens
cuacuugccugggaaacauagca

SEQ ID NO: 1071914 - RNA, 18 nt, Homo sapiens
uauauauguguguguaua

SEQ ID NO: 1071915 - RNA, 20 nt, Homo sapiens
uauauccccucuacucuuac

SEQ ID NO: 1071916 - RNA, 16 nt, Homo sapiens
uauaucuuaaugcaga

SEQ ID NO: 1071917 - RNA, 14 nt, Homo sapiens
uauaugcacauaua

SEQ ID NO: 1071918 - RNA, 16 nt, Homo sapiens
uaucaguagugccuuu

SEQ ID NO: 1071919 - RNA, 19 nt, Homo sapiens
uauccuucuagaucauaca

SEQ ID NO: 1071920 - RNA, 11 nt, Homo sapiens
uaucugggaac

SEQ ID NO: 1071921 - RNA, 17 nt, Homo sapiens
uaugcuuuugguggcua

SEQ ID NO: 1071922 - RNA, 21 nt, Homo sapiens
uauggagagauggucagaaau

SEQ ID NO: 1071923 - RNA, 19 nt, Homo sapiens
uauggcagugucuuuccac

SEQ ID NO: 1071924 - RNA, 21 nt, Homo sapiens
uaugggaaaugagaggcauuu

SEQ ID NO: 1071925 - RNA, 13 nt, Homo sapiens
uaugugaaugcuc

SEQ ID NO: 1071926 - RNA, 23 nt, Homo sapiens
uauuacugguaggaacuugagaa

SEQ ID NO: 1071927 - RNA, 13 nt, Homo sapiens
uauuuauacugua

SEQ ID NO: 1071928 - RNA, 14 nt, Homo sapiens
uauuuccugcuuau

SEQ ID NO: 1071929 - RNA, 16 nt, Homo sapiens
ucaaaaauacucacau

SEQ ID NO: 1071930 - RNA, 18 nt, Homo sapiens
ucaaaacccaacaugacu

SEQ ID NO: 1071931 - RNA, 21 nt, Homo sapiens
ucaaaacccaacaugacuguu

SEQ ID NO: 1071932 - RNA, 17 nt, Homo sapiens
ucaaaagcugguggugu

SEQ ID NO: 1071933 - RNA, 17 nt, Homo sapiens
ucaaacaaacucucuga

SEQ ID NO: 1071934 - RNA, 21 nt, Homo sapiens
ucaaagcacuguuucucucac

SEQ ID NO: 1071935 - RNA, 19 nt, Homo sapiens
ucaaauagauggauuugua

SEQ ID NO: 1071936 - RNA, 16 nt, Homo sapiens
ucaacaaauugcccuu

SEQ ID NO: 1071937 - RNA, 18 nt, Homo sapiens
ucaauauccuuugccuca

SEQ ID NO: 1071938 - RNA, 12 nt, Homo sapiens
ucacaccuguaa

SEQ ID NO: 1071939 - RNA, 13 nt, Homo sapiens
ucacaccuguaau

SEQ ID NO: 1071940 - RNA, 17 nt, Homo sapiens
ucacaucagaacagaca

SEQ ID NO: 1071941 - RNA, 15 nt, Homo sapiens
ucaccccagacuccu

SEQ ID NO: 1071942 - RNA, 14 nt, Homo sapiens
ucaccuacuccaga

SEQ ID NO: 1071943 - RNA, 16 nt, Homo sapiens
ucacugaaaagacuau

SEQ ID NO: 1071944 - RNA, 14 nt, Homo sapiens
ucacugcauccuca

SEQ ID NO: 1071945 - RNA, 13 nt, Homo sapiens
ucacugcugucaa

SEQ ID NO: 1071946 - RNA, 21 nt, Homo sapiens
ucacugggccuccaaccaugu

SEQ ID NO: 1071947 - RNA, 14 nt, Homo sapiens
ucacuguccuccaa

SEQ ID NO: 1071948 - RNA, 23 nt, Homo sapiens
ucacuucacagcccugcagugcc

SEQ ID NO: 1071949 - RNA, 13 nt, Homo sapiens
ucagagugcaagc

SEQ ID NO: 1071950 - RNA, 22 nt, Homo sapiens
ucagcauugauauuugugcauu

SEQ ID NO: 1071951 - RNA, 14 nt, Homo sapiens
ucagcuaaacacca

SEQ ID NO: 1071952 - RNA, 23 nt, Homo sapiens
ucagcucuuggcuccacugggau

SEQ ID NO: 1071953 - RNA, 18 nt, Homo sapiens
ucagcugcucugcaagca

SEQ ID NO: 1071954 - RNA, 15 nt, Homo sapiens
ucaggaaaacuacag

SEQ ID NO: 1071955 - RNA, 18 nt, Homo sapiens
ucaggaaauauaucuuaa

SEQ ID NO: 1071956 - RNA, 22 nt, Homo sapiens
ucaggaccuccaagccacugag

SEQ ID NO: 1071957 - RNA, 20 nt, Homo sapiens
ucaggacucaaucuacaggc

SEQ ID NO: 1071958 - RNA, 21 nt, Homo sapiens
ucaggacucaaucuacaggcc

SEQ ID NO: 1071959 - RNA, 20 nt, Homo sapiens
ucaggggcggggagggugac

SEQ ID NO: 1071960 - RNA, 15 nt, Homo sapiens
ucagucucuguguaa

SEQ ID NO: 1071961 - RNA, 18 nt, Homo sapiens
ucagucucuguguaauca

SEQ ID NO: 1071962 - RNA, 22 nt, Homo sapiens
ucagucugaugagaacucugag

SEQ ID NO: 1071963 - RNA, 15 nt, Homo sapiens
ucauaaauauaaucu

SEQ ID NO: 1071964 - RNA, 17 nt, Homo sapiens
ucauaaucuuugcuuua

SEQ ID NO: 1071965 - RNA, 22 nt, Homo sapiens
ucauacacaagucuaacaguua

SEQ ID NO: 1071966 - RNA, 11 nt, Homo sapiens
ucauacaggug

SEQ ID NO: 1071967 - RNA, 17 nt, Homo sapiens
ucauccuauucuuucga

SEQ ID NO: 1071968 - RNA, 17 nt, Homo sapiens
ucaucguaaacauacuu

SEQ ID NO: 1071969 - RNA, 16 nt, Homo sapiens
ucaucucucaucacuu

SEQ ID NO: 1071970 - RNA, 23 nt, Homo sapiens
ucaucuucgaccacaucagaaag

SEQ ID NO: 1071971 - RNA, 13 nt, Homo sapiens
ucaugcaggugaa

SEQ ID NO: 1071972 - RNA, 15 nt, Homo sapiens
ucaugcagucuggga

SEQ ID NO: 1071973 - RNA, 16 nt, Homo sapiens
ucaugucucacuucac

SEQ ID NO: 1071974 - RNA, 19 nt, Homo sapiens
ucaugucucacuucacagc

SEQ ID NO: 1071975 - RNA, 18 nt, Homo sapiens
ucauucuagaaacaggaa

SEQ ID NO: 1071976 - RNA, 22 nt, Homo sapiens
ucauuguucuugugaacccaaa

SEQ ID NO: 1071977 - RNA, 23 nt, Homo sapiens
uccaacggcaagggaacaaguac

SEQ ID NO: 1071978 - RNA, 14 nt, Homo sapiens
uccaagccacugag

SEQ ID NO: 1071979 - RNA, 16 nt, Homo sapiens
uccacaccauucaggu

SEQ ID NO: 1071980 - RNA, 12 nt, Homo sapiens
uccagucuuccu

SEQ ID NO: 1071981 - RNA, 17 nt, Homo sapiens
uccauccucacugcugu

SEQ ID NO: 1071982 - RNA, 20 nt, Homo sapiens
ucccaaguagcugagacuac

SEQ ID NO: 1071983 - RNA, 13 nt, Homo sapiens
ucccagcucaggg

SEQ ID NO: 1071984 - RNA, 21 nt, Homo sapiens
ucccauucgggagaucauguc

SEQ ID NO: 1071985 - RNA, 14 nt, Homo sapiens
ucccccuagccauu

SEQ ID NO: 1071986 - RNA, 19 nt, Homo sapiens
uccccgcccguuuuacaaa

SEQ ID NO: 1071987 - RNA, 16 nt, Homo sapiens
uccccucagagugcaa

SEQ ID NO: 1071988 - RNA, 17 nt, Homo sapiens
uccccucagagugcaag

SEQ ID NO: 1071989 - RNA, 14 nt, Homo sapiens
ucccgggacuaccu

SEQ ID NO: 1071990 - RNA, 20 nt, Homo sapiens
ucccuugaggaaacaacagc

SEQ ID NO: 1071991 - RNA, 22 nt, Homo sapiens
uccgaggccccugucucagggu

SEQ ID NO: 1071992 - RNA, 11 nt, Homo sapiens
uccuacugaug

SEQ ID NO: 1071993 - RNA, 22 nt, Homo sapiens
uccuccaugaauaucaguuauu

SEQ ID NO: 1071994 - RNA, 23 nt, Homo sapiens
uccugcagaagcagaagugcaau

SEQ ID NO: 1071995 - RNA, 19 nt, Homo sapiens
uccugcccagcacaggaau

SEQ ID NO: 1071996 - RNA, 13 nt, Homo sapiens
uccugcuguaaau

SEQ ID NO: 1071997 - RNA, 13 nt, Homo sapiens
uccugcuuauuca

SEQ ID NO: 1071998 - RNA, 18 nt, Homo sapiens
uccuggcccaggugaguc

SEQ ID NO: 1071999 - RNA, 15 nt, Homo sapiens
uccugggaucacuga

SEQ ID NO: 1072000 - RNA, 19 nt, Homo sapiens
uccuuggguauuagaguuu

SEQ ID NO: 1072001 - RNA, 14 nt, Homo sapiens
ucgaccuacugaaa

SEQ ID NO: 1072002 - RNA, 19 nt, Homo sapiens
ucgacuucgggcuggccau

SEQ ID NO: 1072003 - RNA, 15 nt, Homo sapiens
ucgccagcugaugac

SEQ ID NO: 1072004 - RNA, 17 nt, Homo sapiens
ucggaugaggcccucau

SEQ ID NO: 1072005 - RNA, 23 nt, Homo sapiens
ucgggcuaggaagaucucugcag

SEQ ID NO: 1072006 - RNA, 19 nt, Homo sapiens
ucuaaugugccuaguucuu

SEQ ID NO: 1072007 - RNA, 20 nt, Homo sapiens
ucuacaaucucccuucacaa

SEQ ID NO: 1072008 - RNA, 18 nt, Homo sapiens
ucuacaggccagcaccuu

SEQ ID NO: 1072009 - RNA, 23 nt, Homo sapiens
ucuacucugcuuuuuuucuacug

SEQ ID NO: 1072010 - RNA, 15 nt, Homo sapiens
ucuacuucagucuuc

SEQ ID NO: 1072011 - RNA, 20 nt, Homo sapiens
ucucaaacuccugggcucaa

SEQ ID NO: 1072012 - RNA, 12 nt, Homo sapiens
ucucacaaacau

SEQ ID NO: 1072013 - RNA, 16 nt, Homo sapiens
ucucaccuacuccaga

SEQ ID NO: 1072014 - RNA, 12 nt, Homo sapiens
ucucauccugca

SEQ ID NO: 1072015 - RNA, 14 nt, Homo sapiens
ucucaugauuauua

SEQ ID NO: 1072016 - RNA, 23 nt, Homo sapiens
ucuccagagggaauugcagagua

SEQ ID NO: 1072017 - RNA, 20 nt, Homo sapiens
ucuccauuuguuaucuggga

SEQ ID NO: 1072018 - RNA, 16 nt, Homo sapiens
ucucccagcucagggc

SEQ ID NO: 1072019 - RNA, 18 nt, Homo sapiens
ucucccgggacuaccugg

SEQ ID NO: 1072020 - RNA, 9 nt, Homo sapiens
ucuccucac

SEQ ID NO: 1072021 - RNA, 18 nt, Homo sapiens
ucucuaaagaaaaucucu

SEQ ID NO: 1072022 - RNA, 19 nt, Homo sapiens
ucucuaacccuuucaaaag

SEQ ID NO: 1072023 - RNA, 17 nt, Homo sapiens
ucucuagaaagaauauu

SEQ ID NO: 1072024 - RNA, 24 nt, Homo sapiens
ucucuguguaaucaucugaagaaa

SEQ ID NO: 1072025 - RNA, 15 nt, Homo sapiens
ucucuugaaccuggg

SEQ ID NO: 1072026 - RNA, 15 nt, Homo sapiens
ucugagauugaauau

SEQ ID NO: 1072027 - RNA, 22 nt, Homo sapiens
ucugccccaguugguguucaaa

SEQ ID NO: 1072028 - RNA, 23 nt, Homo sapiens
ucugcuggaaacagacucgauuc

SEQ ID NO: 1072029 - RNA, 20 nt, Homo sapiens
ucuggauuuucuuaucacaa

SEQ ID NO: 1072030 - RNA, 14 nt, Homo sapiens
ucuggccacugucc

SEQ ID NO: 1072031 - RNA, 15 nt, Homo sapiens
ucuggcccaguuaau

SEQ ID NO: 1072032 - RNA, 21 nt, Homo sapiens
ucugugccgcaccauugaacu

SEQ ID NO: 1072033 - RNA, 24 nt, Homo sapiens
gcauauauuggguuccauucucac

SEQ ID NO: 1072034 - RNA, 23 nt, Homo sapiens
gcauuaggaguguuucauuugau

SEQ ID NO: 1072035 - RNA, 18 nt, Homo sapiens
gccaagaaguugcucuga

SEQ ID NO: 1072036 - RNA, 22 nt, Homo sapiens
gccaagaugacacaacugcacu

SEQ ID NO: 1072037 - RNA, 21 nt, Homo sapiens
gccacagcuggugguaucuga

SEQ ID NO: 1072038 - RNA, 15 nt, Homo sapiens
gccagaggcaccuca

SEQ ID NO: 1072039 - RNA, 17 nt, Homo sapiens
gccaggugaacuggaau

SEQ ID NO: 1072040 - RNA, 23 nt, Homo sapiens
gccauguugugccucccugguga

SEQ ID NO: 1072041 - RNA, 16 nt, Homo sapiens
gccauugcacuccagc

SEQ ID NO: 1072042 - RNA, 22 nt, Homo sapiens
gccauuuuuacuguuauccuau

SEQ ID NO: 1072043 - RNA, 16 nt, Homo sapiens
gccccgccgccuggua

SEQ ID NO: 1072044 - RNA, 15 nt, Homo sapiens
gcccuagacuggcug

SEQ ID NO: 1072045 - RNA, 17 nt, Homo sapiens
gccgcaaaccacacugg

SEQ ID NO: 1072046 - RNA, 13 nt, Homo sapiens
gccucaaggacuu

SEQ ID NO: 1072047 - RNA, 17 nt, Homo sapiens
gccucagcccugacccu

SEQ ID NO: 1072048 - RNA, 20 nt, Homo sapiens
gccuccugcccagcacagga

SEQ ID NO: 1072049 - RNA, 17 nt, Homo sapiens
gccucuggaaagcaaag

SEQ ID NO: 1072050 - RNA, 18 nt, Homo sapiens
gccugauaggacccauau

SEQ ID NO: 1072051 - RNA, 19 nt, Homo sapiens
gccuggccaagagaccagc

SEQ ID NO: 1072052 - RNA, 17 nt, Homo sapiens
gccuggggaccaggugc

SEQ ID NO: 1072053 - RNA, 13 nt, Homo sapiens
gccuguaauccca

SEQ ID NO: 1072054 - RNA, 19 nt, Homo sapiens
gccuguaaucccagcacuu

SEQ ID NO: 1072055 - RNA, 17 nt, Homo sapiens
gccuguuacacaugaca

SEQ ID NO: 1072056 - RNA, 15 nt, Homo sapiens
gccuuccagccacau

SEQ ID NO: 1072057 - RNA, 17 nt, Homo sapiens
gccuuguugauguggac

SEQ ID NO: 1072058 - RNA, 16 nt, Homo sapiens
gcgaaugacaaaauca

SEQ ID NO: 1072059 - RNA, 14 nt, Homo sapiens
gcgagcaccuguaa

SEQ ID NO: 1072060 - RNA, 17 nt, Homo sapiens
gcgcccaguccuuccac

SEQ ID NO: 1072061 - RNA, 20 nt, Homo sapiens
gcgccgcaaaccacacugga

SEQ ID NO: 1072062 - RNA, 14 nt, Homo sapiens
gcggacaucagcug

SEQ ID NO: 1072063 - RNA, 22 nt, Homo sapiens
gcgggagccucccugccucagg

SEQ ID NO: 1072064 - RNA, 15 nt, Homo sapiens
gcgucauuacagggc

SEQ ID NO: 1072065 - RNA, 19 nt, Homo sapiens
gcuaauauugauacaauga

SEQ ID NO: 1072066 - RNA, 12 nt, Homo sapiens
gcuacaccuuuc

SEQ ID NO: 1072067 - RNA, 15 nt, Homo sapiens
gcuacccgcagaguu

SEQ ID NO: 1072068 - RNA, 15 nt, Homo sapiens
gcuaccucaaccaau

SEQ ID NO: 1072069 - RNA, 21 nt, Homo sapiens
gcucaagcgauccucccaccu

SEQ ID NO: 1072070 - RNA, 21 nt, Homo sapiens
gcucaagcuguccucccaccu

SEQ ID NO: 1072071 - RNA, 14 nt, Homo sapiens
gcucacaccuguaa

SEQ ID NO: 1072072 - RNA, 19 nt, Homo sapiens
gcucagggaaaagcagcuc

SEQ ID NO: 1072073 - RNA, 21 nt, Homo sapiens
gcucagggaaaagcagcucuc

SEQ ID NO: 1072074 - RNA, 21 nt, Homo sapiens
gcucauuuacacucagcugcu

SEQ ID NO: 1072075 - RNA, 18 nt, Homo sapiens
gcuccagaagauagcuuc

SEQ ID NO: 1072076 - RNA, 20 nt, Homo sapiens
gcuccccucugcacggacca

SEQ ID NO: 1072077 - RNA, 18 nt, Homo sapiens
gcuccucacucaccuuca

SEQ ID NO: 1072078 - RNA, 19 nt, Homo sapiens
gcucuuggcuccacuggga

SEQ ID NO: 1072079 - RNA, 15 nt, Homo sapiens
gcuggaggcacccau

SEQ ID NO: 1072080 - RNA, 22 nt, Homo sapiens
gcuguauuuugaaaaugcuuua

SEQ ID NO: 1072081 - RNA, 18 nt, Homo sapiens
gcugucaugagugaugcc

SEQ ID NO: 1072082 - RNA, 19 nt, Homo sapiens
gcugugggccaaaaucaug

SEQ ID NO: 1072083 - RNA, 16 nt, Homo sapiens
gcuucucucucuaaaa

SEQ ID NO: 1072084 - RNA, 14 nt, Homo sapiens
gcuucucugaggaa

SEQ ID NO: 1072085 - RNA, 23 nt, Homo sapiens
gcuuggaaacuggaugaggucau

SEQ ID NO: 1072086 - RNA, 13 nt, Homo sapiens
gcuuggcugugcc

SEQ ID NO: 1072087 - RNA, 19 nt, Homo sapiens
gcuuggguucacagugcau

SEQ ID NO: 1072088 - RNA, 19 nt, Homo sapiens
gcuuucugaagcuuuacca

SEQ ID NO: 1072089 - RNA, 14 nt, Homo sapiens
gcuuucuuucacaa

SEQ ID NO: 1072090 - RNA, 19 nt, Homo sapiens
gcuuuuacugaagccuuuc

SEQ ID NO: 1072091 - RNA, 17 nt, Homo sapiens
ggaaaaggggcuccuug

SEQ ID NO: 1072092 - RNA, 14 nt, Homo sapiens
ggaaacaacagcuu

SEQ ID NO: 1072093 - RNA, 20 nt, Homo sapiens
ggaaacuggaugaggucaua

SEQ ID NO: 1072094 - RNA, 21 nt, Homo sapiens
ggaacagugaaucagucccau

SEQ ID NO: 1072095 - RNA, 22 nt, Homo sapiens
ggaaccguaggacccaagcaga

SEQ ID NO: 1072096 - RNA, 14 nt, Homo sapiens
ggacaaacagggaa

SEQ ID NO: 1072097 - RNA, 21 nt, Homo sapiens
ggacagaccuucaacuuccaa

SEQ ID NO: 1072098 - RNA, 11 nt, Homo sapiens
ggaccaggugc

SEQ ID NO: 1072099 - RNA, 18 nt, Homo sapiens
ggaccaugcgacacuggg

SEQ ID NO: 1072100 - RNA, 13 nt, Homo sapiens
ggaccuccaagcc

SEQ ID NO: 1072101 - RNA, 20 nt, Homo sapiens
ggaccuccaagccacugagc

SEQ ID NO: 1072102 - RNA, 19 nt, Homo sapiens
ggacuagagggaccucucc

SEQ ID NO: 1072103 - RNA, 13 nt, Homo sapiens
ggagcuccaacuc

SEQ ID NO: 1072104 - RNA, 23 nt, Homo sapiens
ggagcuuccuguccucccagcuc

SEQ ID NO: 1072105 - RNA, 20 nt, Homo sapiens
ggaggauggcuugcgcucag

SEQ ID NO: 1072106 - RNA, 17 nt, Homo sapiens
ggaggcacccaugccau

SEQ ID NO: 1072107 - RNA, 19 nt, Homo sapiens
ggaguucugcucauucuaa

SEQ ID NO: 1072108 - RNA, 13 nt, Homo sapiens
ggaugaggucaua

SEQ ID NO: 1072109 - RNA, 11 nt, Homo sapiens
ggcacccaaga

SEQ ID NO: 1072110 - RNA, 18 nt, Homo sapiens
ggcacccaugccaucuca

SEQ ID NO: 1072111 - RNA, 20 nt, Homo sapiens
ggcagaccugacucucuuaa

SEQ ID NO: 1072112 - RNA, 21 nt, Homo sapiens
ggcagauacugucucuuucau

SEQ ID NO: 1072113 - RNA, 17 nt, Homo sapiens
ggcaguuuaaagcacaa

SEQ ID NO: 1072114 - RNA, 22 nt, Homo sapiens
ggccaaggagggugagugcaag

SEQ ID NO: 1072115 - RNA, 20 nt, Homo sapiens
ggccaugaagaggaugcugu

SEQ ID NO: 1072116 - RNA, 13 nt, Homo sapiens
ggcccaggugagu

SEQ ID NO: 1072117 - RNA, 14 nt, Homo sapiens
ggcuccacugggau

SEQ ID NO: 1072118 - RNA, 16 nt, Homo sapiens
ggcucucaacagggga

SEQ ID NO: 1072119 - RNA, 19 nt, Homo sapiens
ggcuuuaaaacuuauccuc

SEQ ID NO: 1072120 - RNA, 14 nt, Homo sapiens
gggaacucauuugg

SEQ ID NO: 1072121 - RNA, 11 nt, Homo sapiens
gggaagcaaaa

SEQ ID NO: 1072122 - RNA, 18 nt, Homo sapiens
gggaaggugggcgggcag

SEQ ID NO: 1072123 - RNA, 14 nt, Homo sapiens
gggacaaagcaaaa

SEQ ID NO: 1072124 - RNA, 21 nt, Homo sapiens
gggaccuugucucccagcuca

SEQ ID NO: 1072125 - RNA, 18 nt, Homo sapiens
gggacugaaaaccucucc

SEQ ID NO: 1072126 - RNA, 20 nt, Homo sapiens
gggaggccagugagccacuc

SEQ ID NO: 1072127 - RNA, 17 nt, Homo sapiens
gggauguuucugucaca

SEQ ID NO: 1072128 - RNA, 21 nt, Homo sapiens
gggcaaggugugguagcucac

SEQ ID NO: 1072129 - RNA, 19 nt, Homo sapiens
gggccuguuacacaugaca

SEQ ID NO: 1072130 - RNA, 21 nt, Homo sapiens
gggcggggcuccugagggagc

SEQ ID NO: 1072131 - RNA, 15 nt, Homo sapiens
gggcuccuugcucca

SEQ ID NO: 1072132 - RNA, 22 nt, Homo sapiens
gggcuuggcugugcccucagau

SEQ ID NO: 1072133 - RNA, 17 nt, Homo sapiens
ggggcgaucgcggcgga

SEQ ID NO: 1072134 - RNA, 19 nt, Homo sapiens
ggggcucacaccuguaauc

SEQ ID NO: 1072135 - RNA, 24 nt, Homo sapiens
ggggcugggcagcguacucaucau

SEQ ID NO: 1072136 - RNA, 19 nt, Homo sapiens
gguagcuggggcuacagga

SEQ ID NO: 1072137 - RNA, 18 nt, Homo sapiens
gguauuuuuuacugcuug

SEQ ID NO: 1072138 - RNA, 15 nt, Homo sapiens
gguccagaaggagac

SEQ ID NO: 1072139 - RNA, 24 nt, Homo sapiens
ggugcagccagaggcaccucaaga

SEQ ID NO: 1072140 - RNA, 22 nt, Homo sapiens
ggugcagucacggcucacugca

SEQ ID NO: 1072141 - RNA, 20 nt, Homo sapiens
ggugggcacccacccuggga

SEQ ID NO: 1072142 - RNA, 17 nt, Homo sapiens
gguguaagccuucaaag

SEQ ID NO: 1072143 - RNA, 13 nt, Homo sapiens
gguguugacaugu

SEQ ID NO: 1072144 - RNA, 19 nt, Homo sapiens
gguuaacgccuucauuuau

SEQ ID NO: 1072145 - RNA, 16 nt, Homo sapiens
guaaagcaguauuaaa

SEQ ID NO: 1072146 - RNA, 16 nt, Homo sapiens
guaaagcuuugugcag

SEQ ID NO: 1072147 - RNA, 17 nt, Homo sapiens
guaaagcuuugugcaga

SEQ ID NO: 1072148 - RNA, 17 nt, Homo sapiens
guaaauauuaaguguuu

SEQ ID NO: 1072149 - RNA, 18 nt, Homo sapiens
guaaucccagcacuuugg

SEQ ID NO: 1072150 - RNA, 16 nt, Homo sapiens
guaauccuagcacuuu

SEQ ID NO: 1072151 - RNA, 20 nt, Homo sapiens
caaggagggugagugcaagg

SEQ ID NO: 1072152 - RNA, 15 nt, Homo sapiens
caaggucauuugcua

SEQ ID NO: 1072153 - RNA, 14 nt, Homo sapiens
caauaccaaauagc

SEQ ID NO: 1072154 - RNA, 13 nt, Homo sapiens
caaucuguucaau

SEQ ID NO: 1072155 - RNA, 17 nt, Homo sapiens
caaucuguucaauguuu

SEQ ID NO: 1072156 - RNA, 11 nt, Homo sapiens
caaugaacuuu

SEQ ID NO: 1072157 - RNA, 17 nt, Homo sapiens
caaugacuaauucuugc

SEQ ID NO: 1072158 - RNA, 23 nt, Homo sapiens
caaugccuuuuugauuacagugu

SEQ ID NO: 1072159 - RNA, 20 nt, Homo sapiens
caauguauaaccccaaagaa

SEQ ID NO: 1072160 - RNA, 21 nt, Homo sapiens
caauguauuuucuucaccucu

SEQ ID NO: 1072161 - RNA, 14 nt, Homo sapiens
caauuaacaauaag

SEQ ID NO: 1072162 - RNA, 15 nt, Homo sapiens
caauuccaacacuga

SEQ ID NO: 1072163 - RNA, 19 nt, Homo sapiens
caauucuuacaaacaugug

SEQ ID NO: 1072164 - RNA, 18 nt, Homo sapiens
cacaaacagaaaacaugu

SEQ ID NO: 1072165 - RNA, 12 nt, Homo sapiens
cacaauacuguu

SEQ ID NO: 1072166 - RNA, 22 nt, Homo sapiens
cacacacagacuguugucccug

SEQ ID NO: 1072167 - RNA, 22 nt, Homo sapiens
cacaccuuauauuuacguauga

SEQ ID NO: 1072168 - RNA, 15 nt, Homo sapiens
cacagcacuaauuca

SEQ ID NO: 1072169 - RNA, 16 nt, Homo sapiens
cacagcacuaauucaa

SEQ ID NO: 1072170 - RNA, 15 nt, Homo sapiens
cacaguccucauuua

SEQ ID NO: 1072171 - RNA, 13 nt, Homo sapiens
cacaucuagugag

SEQ ID NO: 1072172 - RNA, 13 nt, Homo sapiens
cacauuaagccuu

SEQ ID NO: 1072173 - RNA, 22 nt, Homo sapiens
cacauuacaugaaaguucagau

SEQ ID NO: 1072174 - RNA, 15 nt, Homo sapiens
caccaaaucaucucu

SEQ ID NO: 1072175 - RNA, 18 nt, Homo sapiens
caccaaaucaucucucau

SEQ ID NO: 1072176 - RNA, 20 nt, Homo sapiens
caccaaaucaucucucauca

SEQ ID NO: 1072177 - RNA, 15 nt, Homo sapiens
caccacgucacuuca

SEQ ID NO: 1072178 - RNA, 14 nt, Homo sapiens
caccacucaaaaau

SEQ ID NO: 1072179 - RNA, 15 nt, Homo sapiens
caccagaugccauua

SEQ ID NO: 1072180 - RNA, 17 nt, Homo sapiens
caccagaugccauuaca

SEQ ID NO: 1072181 - RNA, 16 nt, Homo sapiens
cacccagacuggagug

SEQ ID NO: 1072182 - RNA, 19 nt, Homo sapiens
cacccagcccccacauccu

SEQ ID NO: 1072183 - RNA, 16 nt, Homo sapiens
caccugggcugaggca

SEQ ID NO: 1072184 - RNA, 11 nt, Homo sapiens
caccuguaauc

SEQ ID NO: 1072185 - RNA, 16 nt, Homo sapiens
cacgccuguaauccca

SEQ ID NO: 1072186 - RNA, 20 nt, Homo sapiens
cacucagcucuuggcuccac

SEQ ID NO: 1072187 - RNA, 16 nt, Homo sapiens
cacugagcaauguaua

SEQ ID NO: 1072188 - RNA, 19 nt, Homo sapiens
cacuggcuucaggcaaagc

SEQ ID NO: 1072189 - RNA, 18 nt, Homo sapiens
cacugggccuccaaccau

SEQ ID NO: 1072190 - RNA, 15 nt, Homo sapiens
cacuguuucucucac

SEQ ID NO: 1072191 - RNA, 19 nt, Homo sapiens
cacuuucauuauagcagag

SEQ ID NO: 1072192 - RNA, 13 nt, Homo sapiens
cagaacacugucu

SEQ ID NO: 1072193 - RNA, 15 nt, Homo sapiens
cagaagaugaacaga

SEQ ID NO: 1072194 - RNA, 18 nt, Homo sapiens
cagaagcagaagugcaau

SEQ ID NO: 1072195 - RNA, 17 nt, Homo sapiens
cagaauguugcuuucug

SEQ ID NO: 1072196 - RNA, 19 nt, Homo sapiens
cagacaacacugggaaaca

SEQ ID NO: 1072197 - RNA, 20 nt, Homo sapiens
cagacagacaacacugggaa

SEQ ID NO: 1072198 - RNA, 22 nt, Homo sapiens
cagaccacuauucuuaacuauu

SEQ ID NO: 1072199 - RNA, 16 nt, Homo sapiens
cagacucaaaugcuca

SEQ ID NO: 1072200 - RNA, 23 nt, Homo sapiens
cagagaucacaccacugcacucu

SEQ ID NO: 1072201 - RNA, 18 nt, Homo sapiens
cagaguacuggcugaugg

SEQ ID NO: 1072202 - RNA, 22 nt, Homo sapiens
cagccacaaaguugagacuucu

SEQ ID NO: 1072203 - RNA, 19 nt, Homo sapiens
cagccagggccugcgaggg

SEQ ID NO: 1072204 - RNA, 16 nt, Homo sapiens
cagccugcuuucacac

SEQ ID NO: 1072205 - RNA, 17 nt, Homo sapiens
cagccuggccaacaugg

SEQ ID NO: 1072206 - RNA, 16 nt, Homo sapiens
cagccuuccguaucca

SEQ ID NO: 1072207 - RNA, 18 nt, Homo sapiens
cagcuaccucaaccaaug

SEQ ID NO: 1072208 - RNA, 23 nt, Homo sapiens
cagcuaccucaaccaaugccaaa

SEQ ID NO: 1072209 - RNA, 14 nt, Homo sapiens
cagcuccucacuca

SEQ ID NO: 1072210 - RNA, 22 nt, Homo sapiens
cagcucuuggcuccacugggau

SEQ ID NO: 1072211 - RNA, 15 nt, Homo sapiens
cagcugaugacucaa

SEQ ID NO: 1072212 - RNA, 21 nt, Homo sapiens
cagcuggucaaacaaacucuc

SEQ ID NO: 1072213 - RNA, 16 nt, Homo sapiens
cagcuucuuugccaag

SEQ ID NO: 1072214 - RNA, 15 nt, Homo sapiens
caggacaggaaaaac

SEQ ID NO: 1072215 - RNA, 19 nt, Homo sapiens
caggaguucgagaccagcc

SEQ ID NO: 1072216 - RNA, 15 nt, Homo sapiens
caggaguucugcuca

SEQ ID NO: 1072217 - RNA, 20 nt, Homo sapiens
caggcagcuuuuucucuccc

SEQ ID NO: 1072218 - RNA, 17 nt, Homo sapiens
caggccauggauggaaa

SEQ ID NO: 1072219 - RNA, 16 nt, Homo sapiens
cagggcaccugccacc

SEQ ID NO: 1072220 - RNA, 14 nt, Homo sapiens
cagggucauagcau

SEQ ID NO: 1072221 - RNA, 15 nt, Homo sapiens
caggugaaacccagu

SEQ ID NO: 1072222 - RNA, 20 nt, Homo sapiens
caggugaaacccagucacug

SEQ ID NO: 1072223 - RNA, 19 nt, Homo sapiens
caguaacccccacuggacu

SEQ ID NO: 1072224 - RNA, 20 nt, Homo sapiens
caguagacugcaguggacag

SEQ ID NO: 1072225 - RNA, 14 nt, Homo sapiens
caguagugccuuua

SEQ ID NO: 1072226 - RNA, 17 nt, Homo sapiens
caguaugaaaaugucau

SEQ ID NO: 1072227 - RNA, 17 nt, Homo sapiens
cagucaugcagucuggg

SEQ ID NO: 1072228 - RNA, 12 nt, Homo sapiens
caguccuuccac

SEQ ID NO: 1072229 - RNA, 21 nt, Homo sapiens
cagucuauuugagacuccuca

SEQ ID NO: 1072230 - RNA, 19 nt, Homo sapiens
cagucuucucucacuuuga

SEQ ID NO: 1072231 - RNA, 15 nt, Homo sapiens
cagugaauauucaau

SEQ ID NO: 1072232 - RNA, 18 nt, Homo sapiens
cagugagguuaaacuaag

SEQ ID NO: 1072233 - RNA, 14 nt, Homo sapiens
cagugcaacacuga

SEQ ID NO: 1072234 - RNA, 19 nt, Homo sapiens
caguuucuaucauucugcu

SEQ ID NO: 1072235 - RNA, 15 nt, Homo sapiens
caguuuuuaaacuag

SEQ ID NO: 1072236 - RNA, 13 nt, Homo sapiens
cauaauuaaugua

SEQ ID NO: 1072237 - RNA, 15 nt, Homo sapiens
cauauauauauguau

SEQ ID NO: 1072238 - RNA, 17 nt, Homo sapiens
cauauuuuguaacuucc

SEQ ID NO: 1072239 - RNA, 21 nt, Homo sapiens
caucgcaguguucaaggccau

SEQ ID NO: 1072240 - RNA, 15 nt, Homo sapiens
caugaaauacugugc

SEQ ID NO: 1072241 - RNA, 16 nt, Homo sapiens
caugaauaucaguuau

SEQ ID NO: 1072242 - RNA, 15 nt, Homo sapiens
caugagucagucuga

SEQ ID NO: 1072243 - RNA, 22 nt, Homo sapiens
caugcaggugaaacccagucac

SEQ ID NO: 1072244 - RNA, 15 nt, Homo sapiens
caugccauugcacuc

SEQ ID NO: 1072245 - RNA, 13 nt, Homo sapiens
caugcuacaugua

SEQ ID NO: 1072246 - RNA, 14 nt, Homo sapiens
caugcuacauguac

SEQ ID NO: 1072247 - RNA, 20 nt, Homo sapiens
cauguaaaauaugucuuucu

SEQ ID NO: 1072248 - RNA, 20 nt, Homo sapiens
cauguagaaaacaaaaugga

SEQ ID NO: 1072249 - RNA, 17 nt, Homo sapiens
cauuaagacaacuacag

SEQ ID NO: 1072250 - RNA, 22 nt, Homo sapiens
cauucgggagaucaugucucac

SEQ ID NO: 1072251 - RNA, 16 nt, Homo sapiens
cauucuacuugcucug

SEQ ID NO: 1072252 - RNA, 19 nt, Homo sapiens
cauucuaggccuccuggcc

SEQ ID NO: 1072253 - RNA, 18 nt, Homo sapiens
cauugaacagcaaaguag

SEQ ID NO: 1072254 - RNA, 13 nt, Homo sapiens
cauugaacuguac

SEQ ID NO: 1072255 - RNA, 22 nt, Homo sapiens
cauugaacuguaccaugugcua

SEQ ID NO: 1072256 - RNA, 18 nt, Homo sapiens
uauuuaaagacaaagaca

SEQ ID NO: 1072257 - RNA, 20 nt, Homo sapiens
uauuuaacuaugaacugaag

SEQ ID NO: 1072258 - RNA, 13 nt, Homo sapiens
ucaaaaugcuuca

SEQ ID NO: 1072259 - RNA, 16 nt, Homo sapiens
ucaagagagauuugau

SEQ ID NO: 1072260 - RNA, 20 nt, Homo sapiens
ucaauaguguccuaugcaau

SEQ ID NO: 1072261 - RNA, 19 nt, Homo sapiens
ucacaaccacucauucaaa

SEQ ID NO: 1072262 - RNA, 18 nt, Homo sapiens
ucacuacucucuacucug

SEQ ID NO: 1072263 - RNA, 19 nt, Homo sapiens
ucaucuuggucacauacaa

SEQ ID NO: 1072264 - RNA, 16 nt, Homo sapiens
ucaugcaaaugcugua

SEQ ID NO: 1072265 - RNA, 20 nt, Homo sapiens
uccaaugccacauacuugca

SEQ ID NO: 1072266 - RNA, 21 nt, Homo sapiens
uccaaugccacauacuugcag

SEQ ID NO: 1072267 - RNA, 19 nt, Homo sapiens
uccagcaaacaaaauggac

SEQ ID NO: 1072268 - RNA, 14 nt, Homo sapiens
uccagcaguacaau

SEQ ID NO: 1072269 - RNA, 15 nt, Homo sapiens
ucccagcuacucggg

SEQ ID NO: 1072270 - RNA, 17 nt, Homo sapiens
ucccagcuacucgggag

SEQ ID NO: 1072271 - RNA, 19 nt, Homo sapiens
uccccuuuugccaaucuca

SEQ ID NO: 1072272 - RNA, 13 nt, Homo sapiens
uccuaugcaauaa

SEQ ID NO: 1072273 - RNA, 18 nt, Homo sapiens
uccugaugcuuuugucua

SEQ ID NO: 1072274 - RNA, 21 nt, Homo sapiens
uccuguacuuuuuccagacac

SEQ ID NO: 1072275 - RNA, 15 nt, Homo sapiens
ucuacuuuaucaauu

SEQ ID NO: 1072276 - RNA, 14 nt, Homo sapiens
ucucaucugugauu

SEQ ID NO: 1072277 - RNA, 21 nt, Homo sapiens
ucugagcucuggcuuugccuu

SEQ ID NO: 1072278 - RNA, 16 nt, Homo sapiens
ucuuaaaaugcaauau

SEQ ID NO: 1072279 - RNA, 23 nt, Homo sapiens
ucuuacaacaggcuuaugaauau

SEQ ID NO: 1072280 - RNA, 19 nt, Homo sapiens
ucuucccuuuuacauacug

SEQ ID NO: 1072281 - RNA, 18 nt, Homo sapiens
ugaaaaaucggcuuacca

SEQ ID NO: 1072282 - RNA, 18 nt, Homo sapiens
ugacccuguaaaauggag

SEQ ID NO: 1072283 - RNA, 15 nt, Homo sapiens
ugacuuuuaauguca

SEQ ID NO: 1072284 - RNA, 19 nt, Homo sapiens
ugagaguuuucuaaaguau

SEQ ID NO: 1072285 - RNA, 17 nt, Homo sapiens
ugaguagcucuccugac

SEQ ID NO: 1072286 - RNA, 14 nt, Homo sapiens
ugauuuuacaauug

SEQ ID NO: 1072287 - RNA, 19 nt, Homo sapiens
ugcaauaaaauuauuugca

SEQ ID NO: 1072288 - RNA, 17 nt, Homo sapiens
ugcaaugugaucuaugu

SEQ ID NO: 1072289 - RNA, 16 nt, Homo sapiens
ugccuuggcuuugcca

SEQ ID NO: 1072290 - RNA, 23 nt, Homo sapiens
ugcuuccccuuuugccaaucuca

SEQ ID NO: 1072291 - RNA, 16 nt, Homo sapiens
ugcuuuuuuucaggga

SEQ ID NO: 1072292 - RNA, 17 nt, Homo sapiens
uggaaagacaagcucaa

SEQ ID NO: 1072293 - RNA, 13 nt, Homo sapiens
uggcacugcauac

SEQ ID NO: 1072294 - RNA, 15 nt, Homo sapiens
uggccagguaugcau

SEQ ID NO: 1072295 - RNA, 19 nt, Homo sapiens
uggcccccuauuuugccau

SEQ ID NO: 1072296 - RNA, 14 nt, Homo sapiens
ugggaggcuucccc

SEQ ID NO: 1072297 - RNA, 19 nt, Homo sapiens
ugguggcucacgccuguaa

SEQ ID NO: 1072298 - RNA, 18 nt, Homo sapiens
guguuuuucacauuugcg

SEQ ID NO: 1072299 - RNA, 19 nt, Homo sapiens
guuauuuagggaacugcuu

SEQ ID NO: 1072300 - RNA, 20 nt, Homo sapiens
guuccagcaaacaaaaugga

SEQ ID NO: 1072301 - RNA, 21 nt, Homo sapiens
guuccagcaaacaaaauggac

SEQ ID NO: 1072302 - RNA, 18 nt, Homo sapiens
guuccuucacauccugug

SEQ ID NO: 1072303 - RNA, 12 nt, Homo sapiens
guucugucauau

SEQ ID NO: 1072304 - RNA, 21 nt, Homo sapiens
guuucgugaaguauacuguau

SEQ ID NO: 1072305 - RNA, 19 nt, Homo sapiens
guuuuuccacuacugcuac

SEQ ID NO: 1072306 - RNA, 23 nt, Homo sapiens
uaaaguauguuuucaauguuuca

SEQ ID NO: 1072307 - RNA, 23 nt, Homo sapiens
uaacucagaaacaucaguuacuc

SEQ ID NO: 1072308 - RNA, 12 nt, Homo sapiens
uaacucuacugu

SEQ ID NO: 1072309 - RNA, 14 nt, Homo sapiens
uaacugcauugaga

SEQ ID NO: 1072310 - RNA, 15 nt, Homo sapiens
uaacuggcaguuuuc

SEQ ID NO: 1072311 - RNA, 13 nt, Homo sapiens
uaaucccagcacu

SEQ ID NO: 1072312 - RNA, 14 nt, Homo sapiens
uaaugacaugccua

SEQ ID NO: 1072313 - RNA, 12 nt, Homo sapiens
uacauacugcug

SEQ ID NO: 1072314 - RNA, 16 nt, Homo sapiens
uacauuuccaaauuca

SEQ ID NO: 1072315 - RNA, 23 nt, Homo sapiens
uaccauuaaaguucucaaugcaa

SEQ ID NO: 1072316 - RNA, 14 nt, Homo sapiens
uaccuaaacuguau

SEQ ID NO: 1072317 - RNA, 17 nt, Homo sapiens
uaccuaaacuguaucau

SEQ ID NO: 1072318 - RNA, 19 nt, Homo sapiens
uacuauucuuacuaaucug

SEQ ID NO: 1072319 - RNA, 14 nt, Homo sapiens
uacugagacaaugu

SEQ ID NO: 1072320 - RNA, 21 nt, Homo sapiens
uagcaacuuguguuacaaaaa

SEQ ID NO: 1072321 - RNA, 14 nt, Homo sapiens
uaggcuauucacaa

SEQ ID NO: 1072322 - RNA, 11 nt, Homo sapiens
uauaauuuuga

SEQ ID NO: 1072323 - RNA, 21 nt, Homo sapiens
uauauccgccuggcauuucac

SEQ ID NO: 1072324 - RNA, 19 nt, Homo sapiens
uauauggcauuugcagauu

SEQ ID NO: 1072325 - RNA, 18 nt, Homo sapiens
uauauguguuuuucacau

SEQ ID NO: 1072326 - RNA, 22 nt, Homo sapiens
uaugcaauaaaauuauuugcag

SEQ ID NO: 1072327 - RNA, 14 nt, Homo sapiens
uauguggcuguauc

SEQ ID NO: 1072328 - RNA, 15 nt, Homo sapiens
uauucuuacuaaucu

SEQ ID NO: 1072329 - RNA, 17 nt, Homo sapiens
uauucuuacuaaucuga

SEQ ID NO: 1072330 - RNA, 16 nt, Homo sapiens
uauuuaagcaacaucu

SEQ ID NO: 1072331 - RNA, 19 nt, Homo sapiens
ucaauaguguccuaugcaa

SEQ ID NO: 1072332 - RNA, 21 nt, Homo sapiens
ucacaagugaaaaacauccag

SEQ ID NO: 1072333 - RNA, 19 nt, Homo sapiens
ucacaguguguuugugauu

SEQ ID NO: 1072334 - RNA, 11 nt, Homo sapiens
ucacauuugcg

SEQ ID NO: 1072335 - RNA, 14 nt, Homo sapiens
ucagggcugugauc

SEQ ID NO: 1072336 - RNA, 23 nt, Homo sapiens
ucaucugugauucccuccugcua

SEQ ID NO: 1072337 - RNA, 18 nt, Homo sapiens
ucaucuuggucacauaca

SEQ ID NO: 1072338 - RNA, 22 nt, Homo sapiens
ucauuacaaucgagacugcaau

SEQ ID NO: 1072339 - RNA, 13 nt, Homo sapiens
uccacuacugcua

SEQ ID NO: 1072340 - RNA, 16 nt, Homo sapiens
uccaugagacacaucu

SEQ ID NO: 1072341 - RNA, 12 nt, Homo sapiens
ucccuuuuacau

SEQ ID NO: 1072342 - RNA, 20 nt, Homo sapiens
uccgcaguuccugucccuuc

SEQ ID NO: 1072343 - RNA, 20 nt, Homo sapiens
uccguggcacugcauacaau

SEQ ID NO: 1072344 - RNA, 15 nt, Homo sapiens
uccuauguaacugca

SEQ ID NO: 1072345 - RNA, 23 nt, Homo sapiens
uccucuuucaaagguagccauca

SEQ ID NO: 1072346 - RNA, 23 nt, Homo sapiens
uccugcuacucuguuccuucaca

SEQ ID NO: 1072347 - RNA, 15 nt, Homo sapiens
ucgcgccacugcacu

SEQ ID NO: 1072348 - RNA, 19 nt, Homo sapiens
ucgggaagaaggggacaau

SEQ ID NO: 1072349 - RNA, 18 nt, Homo sapiens
ucuaacucagaaacauca

SEQ ID NO: 1072350 - RNA, 21 nt, Homo sapiens
ucuagcaaauguuaugcauaa

SEQ ID NO: 1072351 - RNA, 16 nt, Homo sapiens
ucuagguucugagcuc

SEQ ID NO: 1072352 - RNA, 15 nt, Homo sapiens
ucuaucuaaugacau

SEQ ID NO: 1072353 - RNA, 14 nt, Homo sapiens
ucuauguggcugua

SEQ ID NO: 1072354 - RNA, 23 nt, Homo sapiens
ucugaaacugcauaagugaaaau

SEQ ID NO: 1072355 - RNA, 22 nt, Homo sapiens
ucugaaauuugugauggaauca

SEQ ID NO: 1072356 - RNA, 15 nt, Homo sapiens
ucuuggucacauaca

SEQ ID NO: 1072357 - RNA, 23 nt, Homo sapiens
ugaaaaaguauaaauaaaaugag

SEQ ID NO: 1072358 - RNA, 13 nt, Homo sapiens
ugaaacugcauaa

SEQ ID NO: 1072359 - RNA, 20 nt, Homo sapiens
ugacaaccgaguggcuguca

SEQ ID NO: 1072360 - RNA, 19 nt, Homo sapiens
ugacacuagcuaauaucaa

SEQ ID NO: 1072361 - RNA, 14 nt, Homo sapiens
ugagaacugcauau

SEQ ID NO: 1072362 - RNA, 22 nt, Homo sapiens
ugaggcaggagaauggcgugaa

SEQ ID NO: 1072363 - RNA, 22 nt, Homo sapiens
ugauucccuccugcuacucugu

SEQ ID NO: 1072364 - RNA, 22 nt, Homo sapiens
ugcauaagugaaaaucuuacaa

SEQ ID NO: 1072365 - RNA, 22 nt, Homo sapiens
ugcauaccuucgggguacaagu

SEQ ID NO: 1072366 - RNA, 19 nt, Homo sapiens
ugcaucauuaauaccuaaa

SEQ ID NO: 1072367 - RNA, 18 nt, Homo sapiens
ugcauugagaacugcaua

SEQ ID NO: 1072368 - RNA, 15 nt, Homo sapiens
uggaggcugcaguga

SEQ ID NO: 1072369 - RNA, 17 nt, Homo sapiens
ugggaucgcauugcaua

SEQ ID NO: 1072370 - RNA, 17 nt, Homo sapiens
uggggaugguccacugu

SEQ ID NO: 1072371 - RNA, 19 nt, Homo sapiens
ugguagcgggcgccuguag

SEQ ID NO: 1072372 - RNA, 21 nt, Homo sapiens
ugguggcucacaccuguaauc

SEQ ID NO: 1072373 - RNA, 17 nt, Homo sapiens
uguauuuuauuacaucu

SEQ ID NO: 1072374 - RNA, 18 nt, Homo sapiens
aaccauguugguugcacu

SEQ ID NO: 1072375 - RNA, 17 nt, Homo sapiens
aacuggcaguuuuccau

SEQ ID NO: 1072376 - RNA, 9 nt, Homo sapiens
aacugucau

SEQ ID NO: 1072377 - RNA, 14 nt, Homo sapiens
aagacaaauucugu

SEQ ID NO: 1072378 - RNA, 22 nt, Homo sapiens
aagagaauauuagcuuuacugu

SEQ ID NO: 1072379 - RNA, 20 nt, Homo sapiens
aagauggguggaucacuuga

SEQ ID NO: 1072380 - RNA, 16 nt, Homo sapiens
aagauuuuuucauuuc

SEQ ID NO: 1072381 - RNA, 17 nt, Homo sapiens
aagcaacuuuacugaga

SEQ ID NO: 1072382 - RNA, 22 nt, Homo sapiens
aagccugacccuguaaaaugga

SEQ ID NO: 1072383 - RNA, 17 nt, Homo sapiens
aagcuuccgccgucuca

SEQ ID NO: 1072384 - RNA, 14 nt, Homo sapiens
aaggaauacaauau

SEQ ID NO: 1072385 - RNA, 18 nt, Homo sapiens
aaguucuuaguguugguu

SEQ ID NO: 1072386 - RNA, 19 nt, Homo sapiens
aauagaaggauguacauuu

SEQ ID NO: 1072387 - RNA, 20 nt, Homo sapiens
aauaguguccuaugcaauaa

SEQ ID NO: 1072388 - RNA, 19 nt, Homo sapiens
aauauaauaugcacacagu

SEQ ID NO: 1072389 - RNA, 22 nt, Homo sapiens
aaucugaggccuccucucucag

SEQ ID NO: 1072390 - RNA, 23 nt, Homo sapiens
aaucugaggccuccucucucagu

SEQ ID NO: 1072391 - RNA, 16 nt, Homo sapiens
aaucuuacaacaggcu

SEQ ID NO: 1072392 - RNA, 18 nt, Homo sapiens
aaugccacauacuugcag

SEQ ID NO: 1072393 - RNA, 15 nt, Homo sapiens
aaugguuccauucuc

SEQ ID NO: 1072394 - RNA, 20 nt, Homo sapiens
aaugucuguauuucauucuu

SEQ ID NO: 1072395 - RNA, 18 nt, Homo sapiens
aauuaaaacacuuucaaa

SEQ ID NO: 1072396 - RNA, 16 nt, Homo sapiens
aauuacauacuauucu

SEQ ID NO: 1072397 - RNA, 17 nt, Homo sapiens
acaaaccucaagccagc

SEQ ID NO: 1072398 - RNA, 14 nt, Homo sapiens
acaacaaaaagcuu

SEQ ID NO: 1072399 - RNA, 15 nt, Homo sapiens
acacaaauuugccug

SEQ ID NO: 1072400 - RNA, 23 nt, Homo sapiens
acacccaaguugaagacuuuguu

SEQ ID NO: 1072401 - RNA, 16 nt, Homo sapiens
acacugugggacucuu

SEQ ID NO: 1072402 - RNA, 23 nt, Homo sapiens
acagaagagugacauguuuacaa

SEQ ID NO: 1072403 - RNA, 21 nt, Homo sapiens
acagagcgagacuccgucuca

SEQ ID NO: 1072404 - RNA, 18 nt, Homo sapiens
acagccacacugugggac

SEQ ID NO: 1072405 - RNA, 23 nt, Homo sapiens
acaguuuuuaacucuacugugua

SEQ ID NO: 1072406 - RNA, 20 nt, Homo sapiens
acauagaaaguucauggaac

SEQ ID NO: 1072407 - RNA, 11 nt, Homo sapiens
acaucuuucac

SEQ ID NO: 1072408 - RNA, 14 nt, Homo sapiens
acaucuuucacauu

SEQ ID NO: 1072409 - RNA, 23 nt, Homo sapiens
acauguuaggaagguacugucau

SEQ ID NO: 1072410 - RNA, 18 nt, Homo sapiens
acguugccucuacuuuau

SEQ ID NO: 1072411 - RNA, 20 nt, Homo sapiens
acuaugaacugaaggcagca

SEQ ID NO: 1072412 - RNA, 16 nt, Homo sapiens
acuggcaguuuuccau

SEQ ID NO: 1072413 - RNA, 18 nt, Homo sapiens
acugucacuguuucucug

SEQ ID NO: 1072414 - RNA, 19 nt, Homo sapiens
acuuuacugagacaaugua

SEQ ID NO: 1072415 - RNA, 18 nt, Homo sapiens
acuuucuuucuguaggug

SEQ ID NO: 1072416 - RNA, 23 nt, Homo sapiens
acuuugacuuucuucugaauauu

SEQ ID NO: 1072417 - RNA, 11 nt, Homo sapiens
acuuuuuccag

SEQ ID NO: 1072418 - RNA, 20 nt, Homo sapiens
agaaggauguacauuuccaa

SEQ ID NO: 1072419 - RNA, 12 nt, Homo sapiens
agaaggggacaa

SEQ ID NO: 1072420 - RNA, 17 nt, Homo sapiens
agaaucagaucauuuca

SEQ ID NO: 1072421 - RNA, 17 nt, Homo sapiens
agacacaucuccuccau

SEQ ID NO: 1072422 - RNA, 21 nt, Homo sapiens
agacuuuuguuaugaggagcu

SEQ ID NO: 1072423 - RNA, 20 nt, Homo sapiens
agagcgagacuccgucucaa

SEQ ID NO: 1072424 - RNA, 16 nt, Homo sapiens
agaguggguuucacaa

SEQ ID NO: 1072425 - RNA, 16 nt, Homo sapiens
agauacauucacauuc

SEQ ID NO: 1072426 - RNA, 16 nt, Homo sapiens
agauccccguguuacu

SEQ ID NO: 1072427 - RNA, 20 nt, Homo sapiens
agaucgcgccacugcacucc

SEQ ID NO: 1072428 - RNA, 19 nt, Homo sapiens
agaucgugccauugcacuc

SEQ ID NO: 1072429 - RNA, 21 nt, Homo sapiens
agauguagauaaacucagaaa

SEQ ID NO: 1072430 - RNA, 18 nt, Homo sapiens
agauuagcuaggggacag

SEQ ID NO: 1072431 - RNA, 14 nt, Homo sapiens
agauucuaccacac

SEQ ID NO: 1072432 - RNA, 13 nt, Homo sapiens
agccacacugugg

SEQ ID NO: 1072433 - RNA, 16 nt, Homo sapiens
agccagccuugcuccu

SEQ ID NO: 1072434 - RNA, 22 nt, Homo sapiens
agcuaaauuuucugaaacugca

SEQ ID NO: 1072435 - RNA, 12 nt, Homo sapiens
aggaacacugca

SEQ ID NO: 1072436 - RNA, 14 nt, Homo sapiens
aggaacacugcacu

SEQ ID NO: 1072437 - RNA, 16 nt, Homo sapiens
aggaacacugcacucu

SEQ ID NO: 1072438 - RNA, 22 nt, Homo sapiens
aggaggggaggaacacugcacu

SEQ ID NO: 1072439 - RNA, 20 nt, Homo sapiens
aggagguggaggcugcagug

SEQ ID NO: 1072440 - RNA, 23 nt, Homo sapiens
aggaugaucaaaaauaaugcauc

SEQ ID NO: 1072441 - RNA, 15 nt, Homo sapiens
aggcauucucugaag

SEQ ID NO: 1072442 - RNA, 20 nt, Homo sapiens
agguauauaaauuuucccaa

SEQ ID NO: 1072443 - RNA, 17 nt, Homo sapiens
agucauggcaccaaagc

SEQ ID NO: 1072444 - RNA, 15 nt, Homo sapiens
agugaaaaacaucca

SEQ ID NO: 1072445 - RNA, 15 nt, Homo sapiens
agugacauguuuaca

SEQ ID NO: 1072446 - RNA, 18 nt, Homo sapiens
agugagacuccgucacaa

SEQ ID NO: 1072447 - RNA, 17 nt, Homo sapiens
agugcccaacuguuaua

SEQ ID NO: 1072448 - RNA, 17 nt, Homo sapiens
aguguucacaaccugga

SEQ ID NO: 1072449 - RNA, 21 nt, Homo sapiens
auaauaaaaagcuucagggaa

SEQ ID NO: 1072450 - RNA, 15 nt, Homo sapiens
auaaucuugcucaca

SEQ ID NO: 1072451 - RNA, 15 nt, Homo sapiens
auaaugcauccagca

SEQ ID NO: 1072452 - RNA, 15 nt, Homo sapiens
auacaauauauagcu

SEQ ID NO: 1072453 - RNA, 19 nt, Homo sapiens
auacaauuauuuuuacagu

SEQ ID NO: 1072454 - RNA, 15 nt, Homo sapiens
auagaggaacuugaa

SEQ ID NO: 1072455 - RNA, 16 nt, Homo sapiens
auagaggaacuugaaa

SEQ ID NO: 1072456 - RNA, 17 nt, Homo sapiens
auauaaauuuucccaaa

SEQ ID NO: 1072457 - RNA, 20 nt, Homo sapiens
auauaauaugcacacagugc

SEQ ID NO: 1072458 - RNA, 17 nt, Homo sapiens
auauuaguugcuuuguu

SEQ ID NO: 1072459 - RNA, 21 nt, Homo sapiens
aucaaggcaggagaugcagca

SEQ ID NO: 1072460 - RNA, 19 nt, Homo sapiens
aucaauagaaggauguaca

SEQ ID NO: 1072461 - RNA, 17 nt, Homo sapiens
aucagcauuuuacuacu

SEQ ID NO: 1072462 - RNA, 15 nt, Homo sapiens
aucgcgccacugcac

SEQ ID NO: 1072463 - RNA, 23 nt, Homo sapiens
aucuaaugacaugccuauaugag

SEQ ID NO: 1072464 - RNA, 13 nt, Homo sapiens
aucugaacauuua

SEQ ID NO: 1072465 - RNA, 19 nt, Homo sapiens
aucuguucuaacauguaau

SEQ ID NO: 1072466 - RNA, 24 nt, Homo sapiens
aucuuguuuuuccacuacugcuac

SEQ ID NO: 1072467 - RNA, 15 nt, Homo sapiens
augaaagugaugaca

SEQ ID NO: 1072468 - RNA, 21 nt, Homo sapiens
augaauauauuuaagcaacau

SEQ ID NO: 1072469 - RNA, 17 nt, Homo sapiens
augaggagcugcagauu

SEQ ID NO: 1072470 - RNA, 11 nt, Homo sapiens
augauguuucg

SEQ ID NO: 1072471 - RNA, 23 nt, Homo sapiens
augauuuaauuuuuuaaacugua

SEQ ID NO: 1072472 - RNA, 21 nt, Homo sapiens
augcaauaaaauuauuugcag

SEQ ID NO: 1072473 - RNA, 13 nt, Homo sapiens
augcaucauuaau

SEQ ID NO: 1072474 - RNA, 15 nt, Homo sapiens
auggcaccaaagcca

SEQ ID NO: 1072475 - RNA, 15 nt, Homo sapiens
augguuccauucucu

SEQ ID NO: 1072476 - RNA, 13 nt, Homo sapiens
auguaacugcauu

SEQ ID NO: 1072477 - RNA, 15 nt, Homo sapiens
auguggaaugcagcc

SEQ ID NO: 1072478 - RNA, 15 nt, Homo sapiens
auguguuuuucacau

SEQ ID NO: 1072479 - RNA, 20 nt, Homo sapiens
auguuguuccaggaugugga

SEQ ID NO: 1072480 - RNA, 16 nt, Homo sapiens
auuaaaacacuuucaa

SEQ ID NO: 1072481 - RNA, 22 nt, Homo sapiens
auuaaucucuaguaaaacauug

SEQ ID NO: 1072482 - RNA, 13 nt, Homo sapiens
auuaucaugcaaa

SEQ ID NO: 1072483 - RNA, 21 nt, Homo sapiens
auucgcugcaaccuguugaua

SEQ ID NO: 1072484 - RNA, 16 nt, Homo sapiens
auucuuguuggcuuuu

SEQ ID NO: 1072485 - RNA, 15 nt, Homo sapiens
auugagaacugcaua

SEQ ID NO: 1072486 - RNA, 20 nt, Homo sapiens
auugcagauaacuuugacuu

SEQ ID NO: 1072487 - RNA, 19 nt, Homo sapiens
auugugccacuucacucca

SEQ ID NO: 1072488 - RNA, 18 nt, Homo sapiens
auuguucuuguaagcuuu

SEQ ID NO: 1072489 - RNA, 19 nt, Homo sapiens
auuuaacuaugaacugaag

SEQ ID NO: 1072490 - RNA, 23 nt, Homo sapiens
auuucaaaacucauuuccuaugu

SEQ ID NO: 1072491 - RNA, 18 nt, Homo sapiens
auuuuauuacaucuuuca

SEQ ID NO: 1072492 - RNA, 16 nt, Homo sapiens
auuuugccauuuagcg

SEQ ID NO: 1072493 - RNA, 16 nt, Homo sapiens
auuuuucucuaacuca

SEQ ID NO: 1072494 - RNA, 16 nt, Homo sapiens
auuuuuuaaacuguag

SEQ ID NO: 1072495 - RNA, 15 nt, Homo sapiens
caaaaaccuucccca

SEQ ID NO: 1072496 - RNA, 20 nt, Homo sapiens
caaaacugauacccuuugaa

SEQ ID NO: 1072497 - RNA, 17 nt, Homo sapiens
caaaaucaagcaagccu

SEQ ID NO: 1072498 - RNA, 22 nt, Homo sapiens
caaauacauggauaacacauuu

SEQ ID NO: 1072499 - RNA, 19 nt, Homo sapiens
caacaggcuuaugaauaua

SEQ ID NO: 1072500 - RNA, 20 nt, Homo sapiens
caacauggcgaaaccccucu

SEQ ID NO: 1072501 - RNA, 15 nt, Homo sapiens
caaccacucauucaa

SEQ ID NO: 1072502 - RNA, 20 nt, Homo sapiens
caacuugaauaauacaccag

SEQ ID NO: 1072503 - RNA, 16 nt, Homo sapiens
caaguuguguuugaua

SEQ ID NO: 1072504 - RNA, 21 nt, Homo sapiens
caauagaaggauguacauuuc

SEQ ID NO: 1072505 - RNA, 18 nt, Homo sapiens
caaucgagacugcaaugu

SEQ ID NO: 1072506 - RNA, 15 nt, Homo sapiens
cacagcagcaguuac

SEQ ID NO: 1072507 - RNA, 13 nt, Homo sapiens
cacugcacuccag

SEQ ID NO: 1072508 - RNA, 18 nt, Homo sapiens
cagauuacuagaaauauu

SEQ ID NO: 1072509 - RNA, 13 nt, Homo sapiens
cagcacuuugcaa

SEQ ID NO: 1072510 - RNA, 18 nt, Homo sapiens
cagcgaccucggugggcc

SEQ ID NO: 1072511 - RNA, 13 nt, Homo sapiens
cagcuaaauuuuc

SEQ ID NO: 1072512 - RNA, 23 nt, Homo sapiens
caggagguggaggcugcagugag

SEQ ID NO: 1072513 - RNA, 20 nt, Homo sapiens
caggucuuuaaaucauuuua

SEQ ID NO: 1072514 - RNA, 15 nt, Homo sapiens
cagguguuggugaca

SEQ ID NO: 1072515 - RNA, 12 nt, Homo sapiens
uguaaaauggag

SEQ ID NO: 1072516 - RNA, 19 nt, Homo sapiens
uguaaucccagcuacuugg

SEQ ID NO: 1072517 - RNA, 20 nt, Homo sapiens
uguagcucuaggguauauau

SEQ ID NO: 1072518 - RNA, 19 nt, Homo sapiens
uguaggcagucauggcacc

SEQ ID NO: 1072519 - RNA, 21 nt, Homo sapiens
uguccugaugcuuuugucuaa

SEQ ID NO: 1072520 - RNA, 23 nt, Homo sapiens
ugucgguuugcuuugauuucccu

SEQ ID NO: 1072521 - RNA, 18 nt, Homo sapiens
ugugaccaggaaggaagu

SEQ ID NO: 1072522 - RNA, 22 nt, Homo sapiens
uguguguauucuuaaaaugcaa

SEQ ID NO: 1072523 - RNA, 17 nt, Homo sapiens
uguuaugaggagcugca

SEQ ID NO: 1072524 - RNA, 17 nt, Homo sapiens
uguucagggcugugauc

SEQ ID NO: 1072525 - RNA, 13 nt, Homo sapiens
uguugauagcaag

SEQ ID NO: 1072526 - RNA, 22 nt, Homo sapiens
uguuuucaauguuucacuacuc

SEQ ID NO: 1072527 - RNA, 14 nt, Homo sapiens
uuaaaacacuuuca

SEQ ID NO: 1072528 - RNA, 23 nt, Homo sapiens
uuaaaaugcaaaauaaugucuua

SEQ ID NO: 1072529 - RNA, 14 nt, Homo sapiens
uuaaauaaauggaa

SEQ ID NO: 1072530 - RNA, 13 nt, Homo sapiens
uuaaccugcaaaa

SEQ ID NO: 1072531 - RNA, 11 nt, Homo sapiens
uuaacuaugaa

SEQ ID NO: 1072532 - RNA, 19 nt, Homo sapiens
uuaagcuuccgccgucuca

SEQ ID NO: 1072533 - RNA, 18 nt, Homo sapiens
uuacaaucgagacugcaa

SEQ ID NO: 1072534 - RNA, 13 nt, Homo sapiens
uuagccaaaggau

SEQ ID NO: 1072535 - RNA, 15 nt, Homo sapiens
uuaggcuauucacaa

SEQ ID NO: 1072536 - RNA, 19 nt, Homo sapiens
uuaguguuugaaauugaau

SEQ ID NO: 1072537 - RNA, 14 nt, Homo sapiens
uuauauuaaucucu

SEQ ID NO: 1072538 - RNA, 13 nt, Homo sapiens
uucauggaacuca

SEQ ID NO: 1072539 - RNA, 16 nt, Homo sapiens
uuccguggcacugcau

SEQ ID NO: 1072540 - RNA, 15 nt, Homo sapiens
uuccuauguaacugc

SEQ ID NO: 1072541 - RNA, 19 nt, Homo sapiens
uuccuucucaucugugauu

SEQ ID NO: 1072542 - RNA, 22 nt, Homo sapiens
uucuucuuuaaucacuuaacau

SEQ ID NO: 1072543 - RNA, 18 nt, Homo sapiens
uugaaugccauagucaaa

SEQ ID NO: 1072544 - RNA, 17 nt, Homo sapiens
uugacaaauguaaacau

SEQ ID NO: 1072545 - RNA, 17 nt, Homo sapiens
uugcagauaacuuugac

SEQ ID NO: 1072546 - RNA, 14 nt, Homo sapiens
uugccaaacagcca

SEQ ID NO: 1072547 - RNA, 13 nt, Homo sapiens
uugccauguggac

SEQ ID NO: 1072548 - RNA, 22 nt, Homo sapiens
uugccauuuagcgaacaaccac

SEQ ID NO: 1072549 - RNA, 15 nt, Homo sapiens
uuggcuuugcaaaau

SEQ ID NO: 1072550 - RNA, 13 nt, Homo sapiens
uuggcuuugccag

SEQ ID NO: 1072551 - RNA, 23 nt, Homo sapiens
uugucuaauuaaaacacuuucaa

SEQ ID NO: 1072552 - RNA, 16 nt, Homo sapiens
uuguuggauaaaucag

SEQ ID NO: 1072553 - RNA, 15 nt, Homo sapiens
uuuaaauaaauggaa

SEQ ID NO: 1072554 - RNA, 16 nt, Homo sapiens
uuuaaauaucugaaca

SEQ ID NO: 1072555 - RNA, 20 nt, Homo sapiens
uuuaauuuuuuaaacuguag

SEQ ID NO: 1072556 - RNA, 15 nt, Homo sapiens
uuucagaaauauuca

SEQ ID NO: 1072557 - RNA, 14 nt, Homo sapiens
uuugaaaaguaaaa

SEQ ID NO: 1072558 - RNA, 19 nt, Homo sapiens
uuugccuuggcuuugccag

SEQ ID NO: 1072559 - RNA, 15 nt, Homo sapiens
uuuuaaaaugcauca

SEQ ID NO: 1072560 - RNA, 15 nt, Homo sapiens
uuuuacacacugaaa

SEQ ID NO: 1072561 - RNA, 23 nt, Homo sapiens
uuuucagggaagcugccaaagaa

SEQ ID NO: 1072562 - RNA, 17 nt, Homo sapiens
uuuuccuauuuacaugu

SEQ ID NO: 1072563 - RNA, 15 nt, Homo sapiens
uuuugccaaucucaa

SEQ ID NO: 1072564 - RNA, 23 nt, Homo sapiens
uuuuuccuuccuuaucacugaca

SEQ ID NO: 1072565 - RNA, 17 nt, Homo sapiens
guauucuuaaaaugcaa

SEQ ID NO: 1072566 - RNA, 20 nt, Homo sapiens
guauugcuguccuugaaugc

SEQ ID NO: 1072567 - RNA, 20 nt, Homo sapiens
gucacagaucacagugucuu

SEQ ID NO: 1072568 - RNA, 15 nt, Homo sapiens
gucauggcaccaaag

SEQ ID NO: 1072569 - RNA, 24 nt, Homo sapiens
gucauggcaccaaagccaccagac

SEQ ID NO: 1072570 - RNA, 23 nt, Homo sapiens
guccauuaagcugagagugcuau

SEQ ID NO: 1072571 - RNA, 17 nt, Homo sapiens
gucuaucuaaugacaug

SEQ ID NO: 1072572 - RNA, 17 nt, Homo sapiens
gucuucagggaagguca

SEQ ID NO: 1072573 - RNA, 23 nt, Homo sapiens
gugacaaccgaguggcugucauc

SEQ ID NO: 1072574 - RNA, 14 nt, Homo sapiens
gugaccuccacagc

SEQ ID NO: 1072575 - RNA, 15 nt, Homo sapiens
guggaugauguuucg

SEQ ID NO: 1072576 - RNA, 19 nt, Homo sapiens
gugguugaagagcaaugug

SEQ ID NO: 1072577 - RNA, 23 nt, Homo sapiens
guguaucggaugcuuuuguucag

SEQ ID NO: 1072578 - RNA, 16 nt, Homo sapiens
guucuaacauguaauu

SEQ ID NO: 1072579 - RNA, 14 nt, Homo sapiens
guugaagacuuugu

SEQ ID NO: 1072580 - RNA, 18 nt, Homo sapiens
guuuagccaaaggauaag

SEQ ID NO: 1072581 - RNA, 23 nt, Homo sapiens
guuuagccaaaggauaagugucc

SEQ ID NO: 1072582 - RNA, 18 nt, Homo sapiens
guuuuuccacuacugcua

SEQ ID NO: 1072583 - RNA, 14 nt, Homo sapiens
uaaaagaucuugca

SEQ ID NO: 1072584 - RNA, 17 nt, Homo sapiens
uaaaagaucuugcagaa

SEQ ID NO: 1072585 - RNA, 17 nt, Homo sapiens
uaaaauaaaaugcagac

SEQ ID NO: 1072586 - RNA, 20 nt, Homo sapiens
uaacauuccuaaaaugcuuc

SEQ ID NO: 1072587 - RNA, 22 nt, Homo sapiens
uaaccugcaaaaucuguucuaa

SEQ ID NO: 1072588 - RNA, 21 nt, Homo sapiens
uaacugcauugagaacugcau

SEQ ID NO: 1072589 - RNA, 13 nt, Homo sapiens
uaagcaacaucua

SEQ ID NO: 1072590 - RNA, 17 nt, Homo sapiens
uaauaccuaaacuguau

SEQ ID NO: 1072591 - RNA, 21 nt, Homo sapiens
uaauuugugcuacaguuuuuc

SEQ ID NO: 1072592 - RNA, 18 nt, Homo sapiens
uaauuuuuuaaacuguag

SEQ ID NO: 1072593 - RNA, 19 nt, Homo sapiens
uacaaucgagacugcaaug

SEQ ID NO: 1072594 - RNA, 20 nt, Homo sapiens
uacaaucgagacugcaaugu

SEQ ID NO: 1072595 - RNA, 22 nt, Homo sapiens
uacaauuauuuuuacaguucuc

SEQ ID NO: 1072596 - RNA, 12 nt, Homo sapiens
uacaucuuucac

SEQ ID NO: 1072597 - RNA, 18 nt, Homo sapiens
uacauuuccaaauucaca

SEQ ID NO: 1072598 - RNA, 20 nt, Homo sapiens
uagcucuaggguauauaucc

SEQ ID NO: 1072599 - RNA, 21 nt, Homo sapiens
uauaauaaaaagcuucaggga

SEQ ID NO: 1072600 - RNA, 16 nt, Homo sapiens
uauuacaucuuucaca

SEQ ID NO: 1072601 - RNA, 15 nt, Homo sapiens
uauuaccuaaugaaa

SEQ ID NO: 1072602 - RNA, 23 nt, Homo sapiens
uauucaugaagcggucacagauc

SEQ ID NO: 1072603 - RNA, 19 nt, Homo sapiens
uauucuuaaaaugcaauau

SEQ ID NO: 1072604 - RNA, 17 nt, Homo sapiens
ucaaccccucacaggag

SEQ ID NO: 1072605 - RNA, 21 nt, Homo sapiens
ucaauaguguccuaugcaaua

SEQ ID NO: 1072606 - RNA, 18 nt, Homo sapiens
ucaauguuucacuacucu

SEQ ID NO: 1072607 - RNA, 19 nt, Homo sapiens
ucacaccgcgucuggugac

SEQ ID NO: 1072608 - RNA, 14 nt, Homo sapiens
ucacauccuguguu

SEQ ID NO: 1072609 - RNA, 23 nt, Homo sapiens
ucacauuggcuauuuaaagacaa

SEQ ID NO: 1072610 - RNA, 23 nt, Homo sapiens
ucagaaauuuaauucauguuucu

SEQ ID NO: 1072611 - RNA, 20 nt, Homo sapiens
ucagcugagguucauuacaa

SEQ ID NO: 1072612 - RNA, 18 nt, Homo sapiens
ucaggaguucgagaccag

SEQ ID NO: 1072613 - RNA, 13 nt, Homo sapiens
ucaguuacucuga

SEQ ID NO: 1072614 - RNA, 17 nt, Homo sapiens
ucauagaaugaaaguau

SEQ ID NO: 1072615 - RNA, 21 nt, Homo sapiens
ucaucagccuguguaggcagu

SEQ ID NO: 1072616 - RNA, 17 nt, Homo sapiens
ucauggcaccaaagcca

SEQ ID NO: 1072617 - RNA, 14 nt, Homo sapiens
ucauguaaacauac

SEQ ID NO: 1072618 - RNA, 13 nt, Homo sapiens
uccaaauucacaa

SEQ ID NO: 1072619 - RNA, 14 nt, Homo sapiens
uccaggauguggaa

SEQ ID NO: 1072620 - RNA, 14 nt, Homo sapiens
uccauuauuuauau

SEQ ID NO: 1072621 - RNA, 19 nt, Homo sapiens
uccauugguuuaccuguga

SEQ ID NO: 1072622 - RNA, 23 nt, Homo sapiens
ucccucacaccgcgucuggugac

SEQ ID NO: 1072623 - RNA, 16 nt, Homo sapiens
uccuacuuauugccau

SEQ ID NO: 1072624 - RNA, 20 nt, Homo sapiens
uccuuccuuaucacugacac

SEQ ID NO: 1072625 - RNA, 16 nt, Homo sapiens
uccuucucaucuguga

SEQ ID NO: 1072626 - RNA, 15 nt, Homo sapiens
ucgagacugcaaugu

SEQ ID NO: 1072627 - RNA, 15 nt, Homo sapiens
ucuagaggcaaggag

SEQ ID NO: 1072628 - RNA, 20 nt, Homo sapiens
ucuaucuaaugacaugccua

SEQ ID NO: 1072629 - RNA, 17 nt, Homo sapiens
ucucauuucccuuugau

SEQ ID NO: 1072630 - RNA, 23 nt, Homo sapiens
ucucugauagguagcauuuucca

SEQ ID NO: 1072631 - RNA, 16 nt, Homo sapiens
ucugaaacugcauaag

SEQ ID NO: 1072632 - RNA, 18 nt, Homo sapiens
ucugcuuuuuuucaggga

SEQ ID NO: 1072633 - RNA, 15 nt, Homo sapiens
ucuuaaaaugcaaua

SEQ ID NO: 1072634 - RNA, 22 nt, Homo sapiens
ucuuaagcuuccgccgucucaa

SEQ ID NO: 1072635 - RNA, 23 nt, Homo sapiens
ucuucccuuuuacauacugcugu

SEQ ID NO: 1072636 - RNA, 22 nt, Homo sapiens
ucuucugaauauuuuaucuuuc

SEQ ID NO: 1072637 - RNA, 16 nt, Homo sapiens
aaccauguugguugca

SEQ ID NO: 1072638 - RNA, 23 nt, Homo sapiens
aacugcauaagugaaaaucuuac

SEQ ID NO: 1072639 - RNA, 14 nt, Homo sapiens
aacuggcaguuuuc

SEQ ID NO: 1072640 - RNA, 15 nt, Homo sapiens
aagaaggggacaaug

SEQ ID NO: 1072641 - RNA, 21 nt, Homo sapiens
aagaauagccuagauaugaau

SEQ ID NO: 1072642 - RNA, 19 nt, Homo sapiens
aagcaacuuuacugagaca

SEQ ID NO: 1072643 - RNA, 22 nt, Homo sapiens
aagcauggcuuuggcuuugcaa

SEQ ID NO: 1072644 - RNA, 19 nt, Homo sapiens
aagcgagacuccaucucaa

SEQ ID NO: 1072645 - RNA, 17 nt, Homo sapiens
aagcucaaguguucaca

SEQ ID NO: 1072646 - RNA, 23 nt, Homo sapiens
aagcugagucucccuaaggcaug

SEQ ID NO: 1072647 - RNA, 22 nt, Homo sapiens
aagggcccagauucuaccacac

SEQ ID NO: 1072648 - RNA, 20 nt, Homo sapiens
aagguggguggaucacuuga

SEQ ID NO: 1072649 - RNA, 19 nt, Homo sapiens
aagugagacuccgucacaa

SEQ ID NO: 1072650 - RNA, 15 nt, Homo sapiens
aagugaugacauauu

SEQ ID NO: 1072651 - RNA, 16 nt, Homo sapiens
aauaaaaugagcaaaa

SEQ ID NO: 1072652 - RNA, 11 nt, Homo sapiens
aauaaauggaa

SEQ ID NO: 1072653 - RNA, 14 nt, Homo sapiens
aauagcaugcaaaa

SEQ ID NO: 1072654 - RNA, 18 nt, Homo sapiens
aauauauggcauuugcag

SEQ ID NO: 1072655 - RNA, 14 nt, Homo sapiens
aaucagaucauuuc

SEQ ID NO: 1072656 - RNA, 15 nt, Homo sapiens
aaucagaucauuuca

SEQ ID NO: 1072657 - RNA, 22 nt, Homo sapiens
aaugacacuagcuaauaucaau

SEQ ID NO: 1072658 - RNA, 19 nt, Homo sapiens
aaugacuaaaaaacaaaga

SEQ ID NO: 1072659 - RNA, 21 nt, Homo sapiens
aaugcauccagcaguacaaua

SEQ ID NO: 1072660 - RNA, 13 nt, Homo sapiens
aauguaaacauuu

SEQ ID NO: 1072661 - RNA, 19 nt, Homo sapiens
aauguguuuuguacaugaa

SEQ ID NO: 1072662 - RNA, 15 nt, Homo sapiens
aauguuuaaacauuu

SEQ ID NO: 1072663 - RNA, 13 nt, Homo sapiens
aauguuucacuac

SEQ ID NO: 1072664 - RNA, 19 nt, Homo sapiens
aauuauuuuuacaguucuc

SEQ ID NO: 1072665 - RNA, 12 nt, Homo sapiens
aauucauguuuc

SEQ ID NO: 1072666 - RNA, 22 nt, Homo sapiens
aauucgcugcaaccuguugaua

SEQ ID NO: 1072667 - RNA, 14 nt, Homo sapiens
acaaaaugauggca

SEQ ID NO: 1072668 - RNA, 21 nt, Homo sapiens
acaauuauuuuuacaguucuc

SEQ ID NO: 1072669 - RNA, 20 nt, Homo sapiens
acagagcgagacuccgucuc

SEQ ID NO: 1072670 - RNA, 23 nt, Homo sapiens
acauaaaugucuguauuucauuc

SEQ ID NO: 1072671 - RNA, 11 nt, Homo sapiens
acauacugcug

SEQ ID NO: 1072672 - RNA, 18 nt, Homo sapiens
acaucaguuacucugaag

SEQ ID NO: 1072673 - RNA, 21 nt, Homo sapiens
acaucuccuccauacucagga

SEQ ID NO: 1072674 - RNA, 16 nt, Homo sapiens
acauucagcugagguu

SEQ ID NO: 1072675 - RNA, 14 nt, Homo sapiens
acccaaaguaucag

SEQ ID NO: 1072676 - RNA, 19 nt, Homo sapiens
acccaaguugaagacuuug

SEQ ID NO: 1072677 - RNA, 11 nt, Homo sapiens
accugacaaug

SEQ ID NO: 1072678 - RNA, 14 nt, Homo sapiens
acuauccuacccca

SEQ ID NO: 1072679 - RNA, 21 nt, Homo sapiens
acucauagauguuaugcaaaa

SEQ ID NO: 1072680 - RNA, 13 nt, Homo sapiens
acuuugacuuucu

SEQ ID NO: 1072681 - RNA, 20 nt, Homo sapiens
agaaagucuaucuaaugaca

SEQ ID NO: 1072682 - RNA, 14 nt, Homo sapiens
agaaauauuuaacu

SEQ ID NO: 1072683 - RNA, 15 nt, Homo sapiens
agaagacaacauuaa

SEQ ID NO: 1072684 - RNA, 18 nt, Homo sapiens
agaucgcgccacugcacu

SEQ ID NO: 1072685 - RNA, 23 nt, Homo sapiens
agauuaagagauggguuugacaa

SEQ ID NO: 1072686 - RNA, 22 nt, Homo sapiens
agauugugccacuucacuccag

SEQ ID NO: 1072687 - RNA, 17 nt, Homo sapiens
agcaaacaaaauggacu

SEQ ID NO: 1072688 - RNA, 22 nt, Homo sapiens
agcaacucagguuuuggcauua

SEQ ID NO: 1072689 - RNA, 16 nt, Homo sapiens
agcaacuuguguuaca

SEQ ID NO: 1072690 - RNA, 23 nt, Homo sapiens
agcaacuuguguuacaaaaauac

SEQ ID NO: 1072691 - RNA, 23 nt, Homo sapiens
agccgagaucgcgccacugcacu

SEQ ID NO: 1072692 - RNA, 19 nt, Homo sapiens
agccuagaagagcuucuga

SEQ ID NO: 1072693 - RNA, 14 nt, Homo sapiens
agccugggugacaa

SEQ ID NO: 1072694 - RNA, 16 nt, Homo sapiens
agcucuccugacuuuu

SEQ ID NO: 1072695 - RNA, 20 nt, Homo sapiens
agcugagucucccuaaggca

SEQ ID NO: 1072696 - RNA, 16 nt, Homo sapiens
agcuuccgccgucuca

SEQ ID NO: 1072697 - RNA, 16 nt, Homo sapiens
aggaaaggaugaucaa

SEQ ID NO: 1072698 - RNA, 11 nt, Homo sapiens
aggcauucucu

SEQ ID NO: 1072699 - RNA, 20 nt, Homo sapiens
aggcgugguggcgggugccu

SEQ ID NO: 1072700 - RNA, 15 nt, Homo sapiens
aggcuaaggcaggaa

SEQ ID NO: 1072701 - RNA, 12 nt, Homo sapiens
aggcugcaguga

SEQ ID NO: 1072702 - RNA, 22 nt, Homo sapiens
agguacugucaugggcuaggca

SEQ ID NO: 1072703 - RNA, 15 nt, Homo sapiens
gaaagugaugacaua

SEQ ID NO: 1072704 - RNA, 15 nt, Homo sapiens
gaacauuuacuacag

SEQ ID NO: 1072705 - RNA, 17 nt, Homo sapiens
gaagaaggggacaaugg

SEQ ID NO: 1072706 - RNA, 15 nt, Homo sapiens
gaaguccagaacaag

SEQ ID NO: 1072707 - RNA, 23 nt, Homo sapiens
gaauauauggcauuugcagauuu

SEQ ID NO: 1072708 - RNA, 16 nt, Homo sapiens
gaaucagauuuuaaca

SEQ ID NO: 1072709 - RNA, 20 nt, Homo sapiens
gaaucagauuuuaacagcuc

SEQ ID NO: 1072710 - RNA, 16 nt, Homo sapiens
gacaaagugagacucc

SEQ ID NO: 1072711 - RNA, 18 nt, Homo sapiens
gagaaucagaucauuuca

SEQ ID NO: 1072712 - RNA, 16 nt, Homo sapiens
gagacuccgucucaaa

SEQ ID NO: 1072713 - RNA, 19 nt, Homo sapiens
gagacuccgucucaaaaaa

SEQ ID NO: 1072714 - RNA, 17 nt, Homo sapiens
gagaucgcgccacugca

SEQ ID NO: 1072715 - RNA, 20 nt, Homo sapiens
gagaucgcgccacugcacuc

SEQ ID NO: 1072716 - RNA, 21 nt, Homo sapiens
gagaucgcgccacugcacucc

SEQ ID NO: 1072717 - RNA, 20 nt, Homo sapiens
gagccgagaucgugccauug

SEQ ID NO: 1072718 - RNA, 13 nt, Homo sapiens
gaggaacacugca

SEQ ID NO: 1072719 - RNA, 14 nt, Homo sapiens
gaggaacacugcac

SEQ ID NO: 1072720 - RNA, 20 nt, Homo sapiens
gaggcagagguugcagugag

SEQ ID NO: 1072721 - RNA, 14 nt, Homo sapiens
gagguugcagugag

SEQ ID NO: 1072722 - RNA, 21 nt, Homo sapiens
gagucucccuaaggcaugugu

SEQ ID NO: 1072723 - RNA, 13 nt, Homo sapiens
gauaauaugagaa

SEQ ID NO: 1072724 - RNA, 12 nt, Homo sapiens
gauagcaaguga

SEQ ID NO: 1072725 - RNA, 20 nt, Homo sapiens
gaucgcgccacugcacucca

SEQ ID NO: 1072726 - RNA, 15 nt, Homo sapiens
gauucuaccacacag

SEQ ID NO: 1072727 - RNA, 16 nt, Homo sapiens
gauuugauuaaugaau

SEQ ID NO: 1072728 - RNA, 14 nt, Homo sapiens
gcaaaugcuguauu

SEQ ID NO: 1072729 - RNA, 17 nt, Homo sapiens
gcaggagaauggcguga

SEQ ID NO: 1072730 - RNA, 13 nt, Homo sapiens
gcagugguuugaa

SEQ ID NO: 1072731 - RNA, 17 nt, Homo sapiens
gcaucauuaauaccuaa

SEQ ID NO: 1072732 - RNA, 18 nt, Homo sapiens
gcaugcaaaaaaugcuuu

SEQ ID NO: 1072733 - RNA, 21 nt, Homo sapiens
gcauuuuccagcacuuugcaa

SEQ ID NO: 1072734 - RNA, 21 nt, Homo sapiens
gcccagauucuaccacacagc

SEQ ID NO: 1072735 - RNA, 22 nt, Homo sapiens
gcccagauucuaccacacagca

SEQ ID NO: 1072736 - RNA, 21 nt, Homo sapiens
gccgagaucgcgccacugcac

SEQ ID NO: 1072737 - RNA, 22 nt, Homo sapiens
gccuagauaugaauauauggca

SEQ ID NO: 1072738 - RNA, 15 nt, Homo sapiens
gccuggcauuucaca

SEQ ID NO: 1072739 - RNA, 13 nt, Homo sapiens
gccuguaguccca

SEQ ID NO: 1072740 - RNA, 20 nt, Homo sapiens
gccuguugaagaugcuugua

SEQ ID NO: 1072741 - RNA, 14 nt, Homo sapiens
gcgaacaaccacag

SEQ ID NO: 1072742 - RNA, 15 nt, Homo sapiens
gcgccacugcacucc

SEQ ID NO: 1072743 - RNA, 14 nt, Homo sapiens
gcuaccucuucuau

SEQ ID NO: 1072744 - RNA, 17 nt, Homo sapiens
gcucuccugacuuuuaa

SEQ ID NO: 1072745 - RNA, 15 nt, Homo sapiens
gcuggaauuaugcug

SEQ ID NO: 1072746 - RNA, 20 nt, Homo sapiens
gcugugaucggccuggggaa

SEQ ID NO: 1072747 - RNA, 18 nt, Homo sapiens
gcuguucucugucgugag

SEQ ID NO: 1072748 - RNA, 22 nt, Homo sapiens
gcuuaccauuaaaguucucaau

SEQ ID NO: 1072749 - RNA, 16 nt, Homo sapiens
gcuuccgccgucucaa

SEQ ID NO: 1072750 - RNA, 14 nt, Homo sapiens
gcuuguuccaaugc

SEQ ID NO: 1072751 - RNA, 16 nt, Homo sapiens
ggaaagaacugucaug

SEQ ID NO: 1072752 - RNA, 14 nt, Homo sapiens
ggaacacugcacuc

SEQ ID NO: 1072753 - RNA, 22 nt, Homo sapiens
ggagcuugcagugagccgagau

SEQ ID NO: 1072754 - RNA, 18 nt, Homo sapiens
ggaggaacacugcacucu

SEQ ID NO: 1072755 - RNA, 20 nt, Homo sapiens
ggaggcagagguugcaguga

SEQ ID NO: 1072756 - RNA, 20 nt, Homo sapiens
ggcaggaaaauuguuugaac

SEQ ID NO: 1072757 - RNA, 20 nt, Homo sapiens
ggcaggagaauggcgugaac

SEQ ID NO: 1072758 - RNA, 13 nt, Homo sapiens
ggcgacaguuuuc

SEQ ID NO: 1072759 - RNA, 14 nt, Homo sapiens
ggcuuugcaaaaua

SEQ ID NO: 1072760 - RNA, 16 nt, Homo sapiens
ggcuuuucccuugcuu

SEQ ID NO: 1072761 - RNA, 17 nt, Homo sapiens
gguggcucacgccugua

SEQ ID NO: 1072762 - RNA, 16 nt, Homo sapiens
guaaucccagcacuuu

SEQ ID NO: 1072763 - RNA, 20 nt, Homo sapiens
guaauugcagauaacuuuga

SEQ ID NO: 1072764 - RNA, 19 nt, Homo sapiens
guauuaggugucauuucca

SEQ ID NO: 1072765 - RNA, 19 nt, Homo sapiens
guauucuuaaaaugcaaua

SEQ ID NO: 1072766 - RNA, 16 nt, Homo sapiens
guauuuuacuuuucca

SEQ ID NO: 1072767 - RNA, 23 nt, Homo sapiens
guauuuuauuacaucuuucacau

SEQ ID NO: 1072768 - RNA, 16 nt, Homo sapiens
gucagcaugccucuag

SEQ ID NO: 1072769 - RNA, 23 nt, Homo sapiens
gucaucaauaguguccuaugcaa

SEQ ID NO: 1072770 - RNA, 22 nt, Homo sapiens
guccauuaagcugagagugcua

SEQ ID NO: 1072771 - RNA, 23 nt, Homo sapiens
gugauucccuccugcuacucugu

SEQ ID NO: 1072772 - RNA, 14 nt, Homo sapiens
uguccuaugcaaua

SEQ ID NO: 1072773 - RNA, 18 nt, Homo sapiens
ugugaucggccuggggaa

SEQ ID NO: 1072774 - RNA, 15 nt, Homo sapiens
ugugcacccagaaga

SEQ ID NO: 1072775 - RNA, 18 nt, Homo sapiens
uguuacugccuaucagca

SEQ ID NO: 1072776 - RNA, 21 nt, Homo sapiens
uguuaggaagguacugucaug

SEQ ID NO: 1072777 - RNA, 12 nt, Homo sapiens
uguuggugacaa

SEQ ID NO: 1072778 - RNA, 21 nt, Homo sapiens
uguuguuccaggauguggaau

SEQ ID NO: 1072779 - RNA, 15 nt, Homo sapiens
uuaaauaaauggaau

SEQ ID NO: 1072780 - RNA, 17 nt, Homo sapiens
uuaacuaugaacugaag

SEQ ID NO: 1072781 - RNA, 21 nt, Homo sapiens
uuaagcuuccgccgucucaac

SEQ ID NO: 1072782 - RNA, 23 nt, Homo sapiens
uuaaguguaacuggcaguuuucc

SEQ ID NO: 1072783 - RNA, 17 nt, Homo sapiens
uuacaaaccucaagcca

SEQ ID NO: 1072784 - RNA, 17 nt, Homo sapiens
uuacacaaauuugccug

SEQ ID NO: 1072785 - RNA, 17 nt, Homo sapiens
uuacauacuauucuuac

SEQ ID NO: 1072786 - RNA, 11 nt, Homo sapiens
uuacucugaag

SEQ ID NO: 1072787 - RNA, 20 nt, Homo sapiens
uuaggaaaggaugaucaaaa

SEQ ID NO: 1072788 - RNA, 16 nt, Homo sapiens
uuauuacaucuuucac

SEQ ID NO: 1072789 - RNA, 19 nt, Homo sapiens
uuauuuagggaacugcuug

SEQ ID NO: 1072790 - RNA, 18 nt, Homo sapiens
uuauuugcaggucuuuaa

SEQ ID NO: 1072791 - RNA, 16 nt, Homo sapiens
uuauuuuuacaguucu

SEQ ID NO: 1072792 - RNA, 14 nt, Homo sapiens
uuccaaauucacaa

SEQ ID NO: 1072793 - RNA, 14 nt, Homo sapiens
uuccacuacugcua

SEQ ID NO: 1072794 - RNA, 16 nt, Homo sapiens
uuccucucauuucccu

SEQ ID NO: 1072795 - RNA, 19 nt, Homo sapiens
uucgugaaguauacuguau

SEQ ID NO: 1072796 - RNA, 19 nt, Homo sapiens
uucugcuuuuuuucaggga

SEQ ID NO: 1072797 - RNA, 22 nt, Homo sapiens
uucugugggagaauucuuacau

SEQ ID NO: 1072798 - RNA, 12 nt, Homo sapiens
uugauacaguca

SEQ ID NO: 1072799 - RNA, 18 nt, Homo sapiens
uuggcuuuuguuacccac

SEQ ID NO: 1072800 - RNA, 14 nt, Homo sapiens
uugggaggccaagg

SEQ ID NO: 1072801 - RNA, 11 nt, Homo sapiens
uuggugacaau

SEQ ID NO: 1072802 - RNA, 15 nt, Homo sapiens
uugucaaaaggaagu

SEQ ID NO: 1072803 - RNA, 18 nt, Homo sapiens
uuguucagggcugugauc

SEQ ID NO: 1072804 - RNA, 17 nt, Homo sapiens
uuguuccaaugccacau

SEQ ID NO: 1072805 - RNA, 11 nt, Homo sapiens
uuguugacaaa

SEQ ID NO: 1072806 - RNA, 14 nt, Homo sapiens
uuguugucuuuaug

SEQ ID NO: 1072807 - RNA, 18 nt, Homo sapiens
uuuaaaccugacaauggu

SEQ ID NO: 1072808 - RNA, 11 nt, Homo sapiens
uuuaaacugua

SEQ ID NO: 1072809 - RNA, 17 nt, Homo sapiens
uuuaaagaaagcaacuu

SEQ ID NO: 1072810 - RNA, 15 nt, Homo sapiens
uuuccacuacugcua

SEQ ID NO: 1072811 - RNA, 17 nt, Homo sapiens
uuucuaccaucucacgg

SEQ ID NO: 1072812 - RNA, 20 nt, Homo sapiens
uuugacuuucuucugaauau

SEQ ID NO: 1072813 - RNA, 14 nt, Homo sapiens
uuuggcuuugcaaa

SEQ ID NO: 1072814 - RNA, 16 nt, Homo sapiens
uuuuacauacugcugu

SEQ ID NO: 1072815 - RNA, 12 nt, Homo sapiens
aaaaaaagccaa

SEQ ID NO: 1072816 - RNA, 12 nt, Homo sapiens
aaaaagccaaaa

SEQ ID NO: 1072817 - RNA, 14 nt, Homo sapiens
aaaaccuuccccag

SEQ ID NO: 1072818 - RNA, 20 nt, Homo sapiens
aaaacucauuuccuauguaa

SEQ ID NO: 1072819 - RNA, 12 nt, Homo sapiens
aaaagccaaaaa

SEQ ID NO: 1072820 - RNA, 19 nt, Homo sapiens
aaaauggagguggaaagac

SEQ ID NO: 1072821 - RNA, 16 nt, Homo sapiens
aaacauccagauacac

SEQ ID NO: 1072822 - RNA, 23 nt, Homo sapiens
aaacauuguuuuuguugucuuua

SEQ ID NO: 1072823 - RNA, 14 nt, Homo sapiens
aaaccucaagccag

SEQ ID NO: 1072824 - RNA, 23 nt, Homo sapiens
aaacugauacccuuugaaaaagu

SEQ ID NO: 1072825 - RNA, 15 nt, Homo sapiens
aaagaaagaauaugu

SEQ ID NO: 1072826 - RNA, 21 nt, Homo sapiens
aaagccaccagacugacaaau

SEQ ID NO: 1072827 - RNA, 17 nt, Homo sapiens
aaagccuagaagagcuu

SEQ ID NO: 1072828 - RNA, 19 nt, Homo sapiens
aaagcgagacuccaucuca

SEQ ID NO: 1072829 - RNA, 13 nt, Homo sapiens
aaagcuucaggga

SEQ ID NO: 1072830 - RNA, 17 nt, Homo sapiens
aaaguaaaaauuuugac

SEQ ID NO: 1072831 - RNA, 22 nt, Homo sapiens
aaaguauauguuaaaaagugag

SEQ ID NO: 1072832 - RNA, 21 nt, Homo sapiens
aaaguauguuuucaauguuuc

SEQ ID NO: 1072833 - RNA, 22 nt, Homo sapiens
aaaguccacauuagaucagaua

SEQ ID NO: 1072834 - RNA, 19 nt, Homo sapiens
aaagugagacuccgucaca

SEQ ID NO: 1072835 - RNA, 20 nt, Homo sapiens
aaauagcaacuuguguuaca

SEQ ID NO: 1072836 - RNA, 17 nt, Homo sapiens
aaauauaauaugcacac

SEQ ID NO: 1072837 - RNA, 11 nt, Homo sapiens
aaaugcaaaau

SEQ ID NO: 1072838 - RNA, 19 nt, Homo sapiens
aaauugaaaggcauucucu

SEQ ID NO: 1072839 - RNA, 20 nt, Homo sapiens
aaauugggaaaggaguagaa

SEQ ID NO: 1072840 - RNA, 12 nt, Homo sapiens
aacaaaauggac

SEQ ID NO: 1072841 - RNA, 18 nt, Homo sapiens
aacacaucacucauuuua

SEQ ID NO: 1072842 - RNA, 10 nt, Homo sapiens
aacacugcac

SEQ ID NO: 1072843 - RNA, 15 nt, Homo sapiens
aacagauuacuagaa

SEQ ID NO: 1072844 - RNA, 19 nt, Homo sapiens
aacaucaguuacucugaag

SEQ ID NO: 1072845 - RNA, 16 nt, Homo sapiens
aacauguaauugcaga

SEQ ID NO: 1072846 - RNA, 16 nt, Homo sapiens
cugcuuugucaaaagg

SEQ ID NO: 1072847 - RNA, 17 nt, Homo sapiens
cugcuuuuuuucaggga

SEQ ID NO: 1072848 - RNA, 18 nt, Homo sapiens
cugcuuuuuuucagggaa

SEQ ID NO: 1072849 - RNA, 21 nt, Homo sapiens
cuguaaucccagcacuuuggg

SEQ ID NO: 1072850 - RNA, 18 nt, Homo sapiens
cuguaaucccagcauuuu

SEQ ID NO: 1072851 - RNA, 14 nt, Homo sapiens
cuguaaucccagcu

SEQ ID NO: 1072852 - RNA, 14 nt, Homo sapiens
cuguuccuucacau

SEQ ID NO: 1072853 - RNA, 12 nt, Homo sapiens
cuguuugucaau

SEQ ID NO: 1072854 - RNA, 15 nt, Homo sapiens
cuuaaaaugcaauau

SEQ ID NO: 1072855 - RNA, 14 nt, Homo sapiens
cuuccgccgucuca

SEQ ID NO: 1072856 - RNA, 14 nt, Homo sapiens
cuucuccaugagac

SEQ ID NO: 1072857 - RNA, 21 nt, Homo sapiens
cuugaaugccauagucaaaga

SEQ ID NO: 1072858 - RNA, 18 nt, Homo sapiens
cuugcucacagcugugcu

SEQ ID NO: 1072859 - RNA, 21 nt, Homo sapiens
cuugcuuccccuuuugccaau

SEQ ID NO: 1072860 - RNA, 16 nt, Homo sapiens
cuuuaaucacuuaaca

SEQ ID NO: 1072861 - RNA, 15 nt, Homo sapiens
cuuucuaccaucuca

SEQ ID NO: 1072862 - RNA, 19 nt, Homo sapiens
cuuuguaucauucaucuuc

SEQ ID NO: 1072863 - RNA, 22 nt, Homo sapiens
cuuuuaaugucauuuguuaaaa

SEQ ID NO: 1072864 - RNA, 20 nt, Homo sapiens
cuuuucuuuguaucauucau

SEQ ID NO: 1072865 - RNA, 17 nt, Homo sapiens
cuuuuuaaccugcaaaa

SEQ ID NO: 1072866 - RNA, 15 nt, Homo sapiens
gaaaaaaaaauggaa

SEQ ID NO: 1072867 - RNA, 16 nt, Homo sapiens
gaaaggcauucucuga

SEQ ID NO: 1072868 - RNA, 15 nt, Homo sapiens
gaaaguucauggaac

SEQ ID NO: 1072869 - RNA, 17 nt, Homo sapiens
gaacgguaaauuucugu

SEQ ID NO: 1072870 - RNA, 18 nt, Homo sapiens
gaagacuuuuguuaugag

SEQ ID NO: 1072871 - RNA, 19 nt, Homo sapiens
gaagaguggguuucacaag

SEQ ID NO: 1072872 - RNA, 13 nt, Homo sapiens
gaagcuuauagag

SEQ ID NO: 1072873 - RNA, 15 nt, Homo sapiens
gaaggggacaauggc

SEQ ID NO: 1072874 - RNA, 17 nt, Homo sapiens
gaaucagaucauuucaa

SEQ ID NO: 1072875 - RNA, 13 nt, Homo sapiens
gacaaauucuguu

SEQ ID NO: 1072876 - RNA, 14 nt, Homo sapiens
gagacacaucuccu

SEQ ID NO: 1072877 - RNA, 20 nt, Homo sapiens
gagacuccgucacaacaaca

SEQ ID NO: 1072878 - RNA, 13 nt, Homo sapiens
gagacugcaaugu

SEQ ID NO: 1072879 - RNA, 20 nt, Homo sapiens
gagaucgugccauugcacuc

SEQ ID NO: 1072880 - RNA, 17 nt, Homo sapiens
gaggaacacugcacucu

SEQ ID NO: 1072881 - RNA, 20 nt, Homo sapiens
gaggcaggagaauggcguga

SEQ ID NO: 1072882 - RNA, 16 nt, Homo sapiens
gaggcugaggcaagag

SEQ ID NO: 1072883 - RNA, 20 nt, Homo sapiens
gagguggaggcugcagugag

SEQ ID NO: 1072884 - RNA, 13 nt, Homo sapiens
gauaaacucagaa

SEQ ID NO: 1072885 - RNA, 17 nt, Homo sapiens
gaucgcgccacugcacu

SEQ ID NO: 1072886 - RNA, 13 nt, Homo sapiens
gaugguccacugu

SEQ ID NO: 1072887 - RNA, 20 nt, Homo sapiens
gauuuaauuuuuuaaacugu

SEQ ID NO: 1072888 - RNA, 23 nt, Homo sapiens
gcaucauuaauaccuaaacugua

SEQ ID NO: 1072889 - RNA, 19 nt, Homo sapiens
gcauuucacaaaacagccu

SEQ ID NO: 1072890 - RNA, 11 nt, Homo sapiens
gccaaucucaa

SEQ ID NO: 1072891 - RNA, 22 nt, Homo sapiens
gccacacugugggacucuucuu

SEQ ID NO: 1072892 - RNA, 21 nt, Homo sapiens
gcccacgccuguaaucccagc

SEQ ID NO: 1072893 - RNA, 14 nt, Homo sapiens
gccucuacuuuauc

SEQ ID NO: 1072894 - RNA, 13 nt, Homo sapiens
gccuguaauccca

SEQ ID NO: 1072895 - RNA, 19 nt, Homo sapiens
gccuguaaucccagcacuu

SEQ ID NO: 1072896 - RNA, 19 nt, Homo sapiens
gcgaacauaaaugucugua

SEQ ID NO: 1072897 - RNA, 20 nt, Homo sapiens
gcugucuauguggcuguauc

SEQ ID NO: 1072898 - RNA, 19 nt, Homo sapiens
gcuuauagaggaacuugaa

SEQ ID NO: 1072899 - RNA, 23 nt, Homo sapiens
gcuuccccuuuugccaaucucaa

SEQ ID NO: 1072900 - RNA, 14 nt, Homo sapiens
gcuuuaacuauauc

SEQ ID NO: 1072901 - RNA, 15 nt, Homo sapiens
ggaaagaacugucau

SEQ ID NO: 1072902 - RNA, 15 nt, Homo sapiens
ggaacaugcguguga

SEQ ID NO: 1072903 - RNA, 16 nt, Homo sapiens
ggaauuaagcaaaauc

SEQ ID NO: 1072904 - RNA, 18 nt, Homo sapiens
ggaggcuuccccucacua

SEQ ID NO: 1072905 - RNA, 14 nt, Homo sapiens
ggcauucucugaag

SEQ ID NO: 1072906 - RNA, 21 nt, Homo sapiens
ggccuguugaagaugcuugua

SEQ ID NO: 1072907 - RNA, 18 nt, Homo sapiens
ggcgcugcuuugucaaaa

SEQ ID NO: 1072908 - RNA, 17 nt, Homo sapiens
ggcggagcuugcaguga

SEQ ID NO: 1072909 - RNA, 22 nt, Homo sapiens
ggcgugguagcgggcgccugua

SEQ ID NO: 1072910 - RNA, 18 nt, Homo sapiens
ggcugucaucagccugug

SEQ ID NO: 1072911 - RNA, 19 nt, Homo sapiens
ggcuuaugaauauauuuaa

SEQ ID NO: 1072912 - RNA, 17 nt, Homo sapiens
gggaauguuguuccagg

SEQ ID NO: 1072913 - RNA, 18 nt, Homo sapiens
gguauauaaauuuuccca

SEQ ID NO: 1072914 - RNA, 13 nt, Homo sapiens
guaaaauugaaag

SEQ ID NO: 1072915 - RNA, 23 nt, Homo sapiens
guaaaauugaaaggcauucucug

SEQ ID NO: 1072916 - RNA, 20 nt, Homo sapiens
guaaucccagcuacuuggga

SEQ ID NO: 1072917 - RNA, 15 nt, Homo sapiens
guacuuuuuccagac

SEQ ID NO: 1072918 - RNA, 21 nt, Homo sapiens
guauauaaauuuucccaaaac

SEQ ID NO: 1072919 - RNA, 11 nt, Homo sapiens
aaaagccaaaa

SEQ ID NO: 1072920 - RNA, 18 nt, Homo sapiens
aaaagcuucagggaacaa

SEQ ID NO: 1072921 - RNA, 14 nt, Homo sapiens
aaaaucuguucuaa

SEQ ID NO: 1072922 - RNA, 11 nt, Homo sapiens
aaaaugcaaua

SEQ ID NO: 1072923 - RNA, 13 nt, Homo sapiens
aaaaugcuuuguu

SEQ ID NO: 1072924 - RNA, 17 nt, Homo sapiens
aaacauaccaacauguu

SEQ ID NO: 1072925 - RNA, 18 nt, Homo sapiens
aaacauuuuuaucuauca

SEQ ID NO: 1072926 - RNA, 18 nt, Homo sapiens
aaaccuugaaagacauuu

SEQ ID NO: 1072927 - RNA, 13 nt, Homo sapiens
aaacuaaaacaga

SEQ ID NO: 1072928 - RNA, 18 nt, Homo sapiens
aaagagacaaacuguaaa

SEQ ID NO: 1072929 - RNA, 14 nt, Homo sapiens
aaagcuucagggaa

SEQ ID NO: 1072930 - RNA, 11 nt, Homo sapiens
aaagcuucccc

SEQ ID NO: 1072931 - RNA, 13 nt, Homo sapiens
aaaggaugaucaa

SEQ ID NO: 1072932 - RNA, 22 nt, Homo sapiens
aaauaaacagauacauucacau

SEQ ID NO: 1072933 - RNA, 14 nt, Homo sapiens
aaaugagcaaaagu

SEQ ID NO: 1072934 - RNA, 12 nt, Homo sapiens
aaaugcaaaaua

SEQ ID NO: 1072935 - RNA, 20 nt, Homo sapiens
aaaugggcuacuuuguccuu

SEQ ID NO: 1072936 - RNA, 13 nt, Homo sapiens
aaauuauuugcag

SEQ ID NO: 1072937 - RNA, 23 nt, Homo sapiens
aaauucgcugcaaccuguugaua

SEQ ID NO: 1072938 - RNA, 14 nt, Homo sapiens
aacacugcacucuu

SEQ ID NO: 1072939 - RNA, 18 nt, Homo sapiens
aacagguguuggugacaa

SEQ ID NO: 1072940 - RNA, 21 nt, Homo sapiens
aacaucuuuuuaaccugcaaa

SEQ ID NO: 1072941 - RNA, 19 nt, Homo sapiens
aaccauguugguugcacuu

SEQ ID NO: 1072942 - RNA, 16 nt, Homo sapiens
aacgugcucaugggcu

SEQ ID NO: 1072943 - RNA, 21 nt, Homo sapiens
aacucagguuuuggcauuaaa

SEQ ID NO: 1072944 - RNA, 22 nt, Homo sapiens
aagaaaauuuugggguaaaaag

SEQ ID NO: 1072945 - RNA, 21 nt, Homo sapiens
aagaaagucuaucuaaugaca

SEQ ID NO: 1072946 - RNA, 15 nt, Homo sapiens
aagaaguuuuguucc

SEQ ID NO: 1072947 - RNA, 13 nt, Homo sapiens
aagagcaaugugu

SEQ ID NO: 1072948 - RNA, 20 nt, Homo sapiens
aagcaacaucuagcaaaugu

SEQ ID NO: 1072949 - RNA, 22 nt, Homo sapiens
aagcaacuuuacugagacaaug

SEQ ID NO: 1072950 - RNA, 18 nt, Homo sapiens
aaggcaggagaugcagca

SEQ ID NO: 1072951 - RNA, 18 nt, Homo sapiens
aagguacugucaugggcu

SEQ ID NO: 1072952 - RNA, 17 nt, Homo sapiens
aagucagcaugccucua

SEQ ID NO: 1072953 - RNA, 22 nt, Homo sapiens
aagucagugcccaacuguuaua

SEQ ID NO: 1072954 - RNA, 17 nt, Homo sapiens
aagugaaaaacauccag

SEQ ID NO: 1072955 - RNA, 16 nt, Homo sapiens
aagugaauuguugaca

SEQ ID NO: 1072956 - RNA, 21 nt, Homo sapiens
aaguguccccuauggggaugg

SEQ ID NO: 1072957 - RNA, 11 nt, Homo sapiens
aauaaaaagcu

SEQ ID NO: 1072958 - RNA, 19 nt, Homo sapiens
aauaauacaccagagauaa

SEQ ID NO: 1072959 - RNA, 22 nt, Homo sapiens
aauagaaggauguacauuucca

SEQ ID NO: 1072960 - RNA, 15 nt, Homo sapiens
aauagcaacuugugu

SEQ ID NO: 1072961 - RNA, 17 nt, Homo sapiens
aauagccuagauaugaa

SEQ ID NO: 1072962 - RNA, 19 nt, Homo sapiens
aauauaaaagaucuugcag

SEQ ID NO: 1072963 - RNA, 15 nt, Homo sapiens
aauauauagcuggca

SEQ ID NO: 1072964 - RNA, 16 nt, Homo sapiens
aaucuugcucacagcu

SEQ ID NO: 1072965 - RNA, 17 nt, Homo sapiens
aaugccacauacuugca

SEQ ID NO: 1072966 - RNA, 23 nt, Homo sapiens
aaugugguugaagagcaaugugu

SEQ ID NO: 1072967 - RNA, 17 nt, Homo sapiens
aauuaaaacacuuucaa

SEQ ID NO: 1072968 - RNA, 22 nt, Homo sapiens
aauuaaagugaauuguugacaa

SEQ ID NO: 1072969 - RNA, 15 nt, Homo sapiens
aauucgcugcaaccu

SEQ ID NO: 1072970 - RNA, 16 nt, Homo sapiens
aauuugugauggaauc

SEQ ID NO: 1072971 - RNA, 17 nt, Homo sapiens
aauuuuuuaaacuguag

SEQ ID NO: 1072972 - RNA, 19 nt, Homo sapiens
aauuuuuuaaauaaaugga

SEQ ID NO: 1072973 - RNA, 18 nt, Homo sapiens
acaacuugaauaauacac

SEQ ID NO: 1072974 - RNA, 15 nt, Homo sapiens
acacagcagcaguua

SEQ ID NO: 1072975 - RNA, 14 nt, Homo sapiens
acagcugugcucug

SEQ ID NO: 1072976 - RNA, 16 nt, Homo sapiens
acaguucugucauaug

SEQ ID NO: 1072977 - RNA, 12 nt, Homo sapiens
acauacaauuau

SEQ ID NO: 1072978 - RNA, 16 nt, Homo sapiens
acaucaguuacucuga

SEQ ID NO: 1072979 - RNA, 13 nt, Homo sapiens
acaucuuucacau

SEQ ID NO: 1072980 - RNA, 22 nt, Homo sapiens
acauguaauugcagauaacuuu

SEQ ID NO: 1072981 - RNA, 19 nt, Homo sapiens
accagagauaauaugagaa

SEQ ID NO: 1072982 - RNA, 16 nt, Homo sapiens
acccuguaaaauggag

SEQ ID NO: 1072983 - RNA, 16 nt, Homo sapiens
accgaguggcugucau

SEQ ID NO: 1072984 - RNA, 13 nt, Homo sapiens
accuaaacuguau

SEQ ID NO: 1072985 - RNA, 21 nt, Homo sapiens
accuguugauagcaagugaau

SEQ ID NO: 1072986 - RNA, 16 nt, Homo sapiens
accuugaaagacauuu

SEQ ID NO: 1072987 - RNA, 15 nt, Homo sapiens
acuauccuaccccac

SEQ ID NO: 1072988 - RNA, 19 nt, Homo sapiens
acuccagccugggugacaa

SEQ ID NO: 1072989 - RNA, 20 nt, Homo sapiens
acuccagccugggugacaaa

SEQ ID NO: 1072990 - RNA, 20 nt, Homo sapiens
acuccucuccgcaguuccug

SEQ ID NO: 1072991 - RNA, 14 nt, Homo sapiens
acugcauacaaucu

SEQ ID NO: 1072992 - RNA, 17 nt, Homo sapiens
acugguuguugccaaac

SEQ ID NO: 1072993 - RNA, 17 nt, Homo sapiens
acuuauugccaugugga

SEQ ID NO: 1072994 - RNA, 13 nt, Homo sapiens
acuuuaucaauua

SEQ ID NO: 1072995 - RNA, 15 nt, Homo sapiens
acuuucuucugaaua

SEQ ID NO: 1072996 - RNA, 21 nt, Homo sapiens
agaaagucuaucuaaugacau

SEQ ID NO: 1072997 - RNA, 19 nt, Homo sapiens
agaacagguguuggugaca

SEQ ID NO: 1072998 - RNA, 18 nt, Homo sapiens
agaacugucauguaaaca

SEQ ID NO: 1072999 - RNA, 17 nt, Homo sapiens
agaaggauguacauuuc

SEQ ID NO: 1073000 - RNA, 23 nt, Homo sapiens
agaaggggacaauggcagaacag

SEQ ID NO: 1073001 - RNA, 16 nt, Homo sapiens
agaauucuuacauguu

SEQ ID NO: 1073002 - RNA, 21 nt, Homo sapiens
agacaagcucaaguguucaca

SEQ ID NO: 1073003 - RNA, 22 nt, Homo sapiens
agacacaucuccuccauacuca

SEQ ID NO: 1073004 - RNA, 19 nt, Homo sapiens
agagcgagacuccgucuca

SEQ ID NO: 1073005 - RNA, 12 nt, Homo sapiens
agaucacagugu

SEQ ID NO: 1073006 - RNA, 17 nt, Homo sapiens
agaucgcgccacugcac

SEQ ID NO: 1073007 - RNA, 19 nt, Homo sapiens
agaucgcgccacugcacuc

SEQ ID NO: 1073008 - RNA, 13 nt, Homo sapiens
agauucuaccaca

SEQ ID NO: 1073009 - RNA, 22 nt, Homo sapiens
agcaacaucuuuuuaaccugca

SEQ ID NO: 1073010 - RNA, 21 nt, Homo sapiens
agcaagugaauuuuucucuaa

SEQ ID NO: 1073011 - RNA, 22 nt, Homo sapiens
agcaguuacaaaaaccuucccc

SEQ ID NO: 1073012 - RNA, 23 nt, Homo sapiens
agccaaaggauaaguguccccua

SEQ ID NO: 1073013 - RNA, 18 nt, Homo sapiens
agccaaguuuauauacaa

SEQ ID NO: 1073014 - RNA, 15 nt, Homo sapiens
agccacacuguggga

SEQ ID NO: 1073015 - RNA, 19 nt, Homo sapiens
agcccggaugcuucuccau

SEQ ID NO: 1073016 - RNA, 21 nt, Homo sapiens
agccgagaucgcgccacugca

SEQ ID NO: 1073017 - RNA, 17 nt, Homo sapiens
agccuggccaacaugau

SEQ ID NO: 1073018 - RNA, 17 nt, Homo sapiens
agccuugggaacaugcg

SEQ ID NO: 1073019 - RNA, 12 nt, Homo sapiens
agcuguucucug

SEQ ID NO: 1073020 - RNA, 20 nt, Homo sapiens
agcuuacuggcaaacaugaa

SEQ ID NO: 1073021 - RNA, 17 nt, Homo sapiens
agcuuccgccgucucaa

SEQ ID NO: 1073022 - RNA, 13 nt, Homo sapiens
agcuugcagugag

SEQ ID NO: 1073023 - RNA, 13 nt, Homo sapiens
aggaacacugcac

SEQ ID NO: 1073024 - RNA, 19 nt, Homo sapiens
aggaauacaauauauagcu

SEQ ID NO: 1073025 - RNA, 18 nt, Homo sapiens
aggcggagcuugcaguga

SEQ ID NO: 1073026 - RNA, 22 nt, Homo sapiens
aguauaaauaaaaugagcaaaa

SEQ ID NO: 1073027 - RNA, 14 nt, Homo sapiens
aguguccuaugcaa

SEQ ID NO: 1073028 - RNA, 17 nt, Homo sapiens
aguuuauauacaauuau

SEQ ID NO: 1073029 - RNA, 15 nt, Homo sapiens
auaaaauuauuugca

SEQ ID NO: 1073030 - RNA, 16 nt, Homo sapiens
auaaacagauacauuc

SEQ ID NO: 1073031 - RNA, 16 nt, Homo sapiens
auaaacucagaaauuu

SEQ ID NO: 1073032 - RNA, 14 nt, Homo sapiens
auaaagcagcucag

SEQ ID NO: 1073033 - RNA, 17 nt, Homo sapiens
auaauaaagaugcucuu

SEQ ID NO: 1073034 - RNA, 16 nt, Homo sapiens
auaauaugagaaucag

SEQ ID NO: 1073035 - RNA, 14 nt, Homo sapiens
auaccuaaacugua

SEQ ID NO: 1073036 - RNA, 22 nt, Homo sapiens
auacucaggacuccucuccgca

SEQ ID NO: 1073037 - RNA, 18 nt, Homo sapiens
auaguguccuaugcaaua

SEQ ID NO: 1073038 - RNA, 23 nt, Homo sapiens
auauaauuuugaaaaguaaaaau

SEQ ID NO: 1073039 - RNA, 20 nt, Homo sapiens
auauauggcauuugcagauu

SEQ ID NO: 1073040 - RNA, 20 nt, Homo sapiens
auauauguguuuuucacauu

SEQ ID NO: 1073041 - RNA, 15 nt, Homo sapiens
auauuaccuaaugaa

SEQ ID NO: 1073042 - RNA, 12 nt, Homo sapiens
auauuagcuuua

SEQ ID NO: 1073043 - RNA, 17 nt, Homo sapiens
auauuuaagcaacaucu

SEQ ID NO: 1073044 - RNA, 19 nt, Homo sapiens
aucaugcaaaugcuguauu

SEQ ID NO: 1073045 - RNA, 17 nt, Homo sapiens
auccagcaguacaauaa

SEQ ID NO: 1073046 - RNA, 12 nt, Homo sapiens
auccuaccccac

SEQ ID NO: 1073047 - RNA, 15 nt, Homo sapiens
aucugaacauuuacu

SEQ ID NO: 1073048 - RNA, 15 nt, Homo sapiens
aucuuguuuuuccac

SEQ ID NO: 1073049 - RNA, 19 nt, Homo sapiens
augcaaaaaaugcuuuguu

SEQ ID NO: 1073050 - RNA, 14 nt, Homo sapiens
augcauggaaaaug

SEQ ID NO: 1073051 - RNA, 23 nt, Homo sapiens
augcuuguauuuuacuuuuccau

SEQ ID NO: 1073052 - RNA, 18 nt, Homo sapiens
auggaagccaacacauca

SEQ ID NO: 1073053 - RNA, 13 nt, Homo sapiens
augucuuaagauu

SEQ ID NO: 1073054 - RNA, 20 nt, Homo sapiens
auuaaagugaauuguugaca

SEQ ID NO: 1073055 - RNA, 13 nt, Homo sapiens
auuacauacuauu

SEQ ID NO: 1073056 - RNA, 13 nt, Homo sapiens
auuaccuaaugaa

SEQ ID NO: 1073057 - RNA, 15 nt, Homo sapiens
auuaguugcuuuguu

SEQ ID NO: 1073058 - RNA, 16 nt, Homo sapiens
auucucucuccuguac

SEQ ID NO: 1073059 - RNA, 16 nt, Homo sapiens
auucuuaaaaugcaau

SEQ ID NO: 1073060 - RNA, 17 nt, Homo sapiens
auugaaaggcauucucu

SEQ ID NO: 1073061 - RNA, 21 nt, Homo sapiens
auugaaaggcauucucugaag

SEQ ID NO: 1073062 - RNA, 14 nt, Homo sapiens
auugccauguggac

SEQ ID NO: 1073063 - RNA, 20 nt, Homo sapiens
auuguuuuuguugucuuuau

SEQ ID NO: 1073064 - RNA, 17 nt, Homo sapiens
auuuccaaauucacaag

SEQ ID NO: 1073065 - RNA, 12 nt, Homo sapiens
auuugccuguuu

SEQ ID NO: 1073066 - RNA, 15 nt, Homo sapiens
caaaaagcuucccca

SEQ ID NO: 1073067 - RNA, 17 nt, Homo sapiens
caaagcugaauacauuc

SEQ ID NO: 1073068 - RNA, 20 nt, Homo sapiens
caaagugagacuccgucaca

SEQ ID NO: 1073069 - RNA, 16 nt, Homo sapiens
caaauguuaugcauaa

SEQ ID NO: 1073070 - RNA, 19 nt, Homo sapiens
caaauucuguuucuugaga

SEQ ID NO: 1073071 - RNA, 22 nt, Homo sapiens
caacaucuuuuuaaccugcaaa

SEQ ID NO: 1073072 - RNA, 21 nt, Homo sapiens
caacaugaugaaaccccaucu

SEQ ID NO: 1073073 - RNA, 21 nt, Homo sapiens
caagguucuucccuuuuacau

SEQ ID NO: 1073074 - RNA, 12 nt, Homo sapiens
aaaaaagccaaa

SEQ ID NO: 1073075 - RNA, 17 nt, Homo sapiens
aaaaauagcaacuugug

SEQ ID NO: 1073076 - RNA, 20 nt, Homo sapiens
aaaaccaaauuuguauuuaa

SEQ ID NO: 1073077 - RNA, 18 nt, Homo sapiens
aaaagcaguaacugacaa

SEQ ID NO: 1073078 - RNA, 15 nt, Homo sapiens
aaaauaaaaaaugug

SEQ ID NO: 1073079 - RNA, 12 nt, Homo sapiens
aaaaugcaauau

SEQ ID NO: 1073080 - RNA, 22 nt, Homo sapiens
aaaaugcaucauuaauaccuaa

SEQ ID NO: 1073081 - RNA, 15 nt, Homo sapiens
aaaaugcuucacugu

SEQ ID NO: 1073082 - RNA, 17 nt, Homo sapiens
aaaaugcuucacuguac

SEQ ID NO: 1073083 - RNA, 17 nt, Homo sapiens
aaaaugguuuguccuga

SEQ ID NO: 1073084 - RNA, 16 nt, Homo sapiens
aaacagauuacuagaa

SEQ ID NO: 1073085 - RNA, 19 nt, Homo sapiens
aaacagccuuugggaaaug

SEQ ID NO: 1073086 - RNA, 13 nt, Homo sapiens
aaagcuuccccaa

SEQ ID NO: 1073087 - RNA, 19 nt, Homo sapiens
aaagucuaucuaaugacau

SEQ ID NO: 1073088 - RNA, 17 nt, Homo sapiens
aaagugaauuguugaca

SEQ ID NO: 1073089 - RNA, 16 nt, Homo sapiens
aaaguucucaaugcaa

SEQ ID NO: 1073090 - RNA, 17 nt, Homo sapiens
aaauaaaaugcagacag

SEQ ID NO: 1073091 - RNA, 21 nt, Homo sapiens
aaauaaacagauacauucaca

SEQ ID NO: 1073092 - RNA, 14 nt, Homo sapiens
aaauaaauggaaua

SEQ ID NO: 1073093 - RNA, 21 nt, Homo sapiens
aaauaaugcauccagcaguac

SEQ ID NO: 1073094 - RNA, 13 nt, Homo sapiens
aaaugcaaaauaa

SEQ ID NO: 1073095 - RNA, 16 nt, Homo sapiens
aaaugucuguauuuca

SEQ ID NO: 1073096 - RNA, 17 nt, Homo sapiens
aaauucacaaguugugu

SEQ ID NO: 1073097 - RNA, 21 nt, Homo sapiens
aaauuuuuuaaaagagacaaa

SEQ ID NO: 1073098 - RNA, 13 nt, Homo sapiens
aacaaaauggacu

SEQ ID NO: 1073099 - RNA, 13 nt, Homo sapiens
aacaaagaagaca

SEQ ID NO: 1073100 - RNA, 11 nt, Homo sapiens
aacauguaauu

SEQ ID NO: 1073101 - RNA, 23 nt, Homo sapiens
aaccaaauuuguauuuaagguau

SEQ ID NO: 1073102 - RNA, 23 nt, Homo sapiens
aaccauguugguugcacuuugua

SEQ ID NO: 1073103 - RNA, 16 nt, Homo sapiens
aacucagaaacaucag

SEQ ID NO: 1073104 - RNA, 14 nt, Homo sapiens
aacugcauugagaa

SEQ ID NO: 1073105 - RNA, 13 nt, Homo sapiens
aacugucauguaa

SEQ ID NO: 1073106 - RNA, 14 nt, Homo sapiens
aacuuugacuuucu

SEQ ID NO: 1073107 - RNA, 19 nt, Homo sapiens
aagaaagcaacuuuacuga

SEQ ID NO: 1073108 - RNA, 18 nt, Homo sapiens
aagaaaggccagcaaauu

SEQ ID NO: 1073109 - RNA, 22 nt, Homo sapiens
aagaguggguuucacaagugaa

SEQ ID NO: 1073110 - RNA, 13 nt, Homo sapiens
aagaucuugcaga

SEQ ID NO: 1073111 - RNA, 13 nt, Homo sapiens
aagcaacaucuag

SEQ ID NO: 1073112 - RNA, 16 nt, Homo sapiens
aagccugacccuguaa

SEQ ID NO: 1073113 - RNA, 12 nt, Homo sapiens
aagcuucaggga

SEQ ID NO: 1073114 - RNA, 17 nt, Homo sapiens
aaggggacaauggcaga

SEQ ID NO: 1073115 - RNA, 15 nt, Homo sapiens
aaguaaaccacaaaa

SEQ ID NO: 1073116 - RNA, 16 nt, Homo sapiens
aagucuucagggaagg

SEQ ID NO: 1073117 - RNA, 16 nt, Homo sapiens
aaguucauggaacuca

SEQ ID NO: 1073118 - RNA, 17 nt, Homo sapiens
aauaaaauuauuugcag

SEQ ID NO: 1073119 - RNA, 16 nt, Homo sapiens
aauaauacaccagaga

SEQ ID NO: 1073120 - RNA, 18 nt, Homo sapiens
aauaguguccuaugcaau

SEQ ID NO: 1073121 - RNA, 15 nt, Homo sapiens
aauauuuuaucuuuc

SEQ ID NO: 1073122 - RNA, 21 nt, Homo sapiens
aaucacuuaacauuccuaaaa

SEQ ID NO: 1073123 - RNA, 14 nt, Homo sapiens
aaucccagcacuuu

SEQ ID NO: 1073124 - RNA, 16 nt, Homo sapiens
aaugguuccauucucu

SEQ ID NO: 1073125 - RNA, 17 nt, Homo sapiens
aauguguggcugaagac

SEQ ID NO: 1073126 - RNA, 13 nt, Homo sapiens
aauuacauacuau

SEQ ID NO: 1073127 - RNA, 17 nt, Homo sapiens
aauucuuacauguuuuc

SEQ ID NO: 1073128 - RNA, 17 nt, Homo sapiens
aauugaaaggcauucuc

SEQ ID NO: 1073129 - RNA, 20 nt, Homo sapiens
aauuuucugaaacugcauaa

SEQ ID NO: 1073130 - RNA, 21 nt, Homo sapiens
aauuuuucucuaacucagaaa

SEQ ID NO: 1073131 - RNA, 20 nt, Homo sapiens
aauuuuuuaaauaaauggaa

SEQ ID NO: 1073132 - RNA, 16 nt, Homo sapiens
acaaaaagcuucccca

SEQ ID NO: 1073133 - RNA, 14 nt, Homo sapiens
acaaaaauuugcca

SEQ ID NO: 1073134 - RNA, 21 nt, Homo sapiens
acaagucaguuucuacacugg

SEQ ID NO: 1073135 - RNA, 18 nt, Homo sapiens
acaauggcagaacaggug

SEQ ID NO: 1073136 - RNA, 18 nt, Homo sapiens
acaauuauaucaguccuc

SEQ ID NO: 1073137 - RNA, 17 nt, Homo sapiens
acagcagcaguuacaaa

SEQ ID NO: 1073138 - RNA, 14 nt, Homo sapiens
acagcugucauaua

SEQ ID NO: 1073139 - RNA, 17 nt, Homo sapiens
acagguguuggugacaa

SEQ ID NO: 1073140 - RNA, 18 nt, Homo sapiens
acauacuauucuuacuaa

SEQ ID NO: 1073141 - RNA, 22 nt, Homo sapiens
accaaagccaccagacugacaa

SEQ ID NO: 1073142 - RNA, 13 nt, Homo sapiens
accaaauuuguau

SEQ ID NO: 1073143 - RNA, 21 nt, Homo sapiens
accccucucuacuaaaaauac

SEQ ID NO: 1073144 - RNA, 21 nt, Homo sapiens
accucggugggcccagugggg

SEQ ID NO: 1073145 - RNA, 19 nt, Homo sapiens
acuacucucuacucuguua

SEQ ID NO: 1073146 - RNA, 22 nt, Homo sapiens
acugaguagcucuccugacuuu

SEQ ID NO: 1073147 - RNA, 21 nt, Homo sapiens
acuuuaucaauuaacugagua

SEQ ID NO: 1073148 - RNA, 13 nt, Homo sapiens
acuuuuaauguca

SEQ ID NO: 1073149 - RNA, 21 nt, Homo sapiens
agaacagguguuggugacaau

SEQ ID NO: 1073150 - RNA, 15 nt, Homo sapiens
agaauucuuacaugu

SEQ ID NO: 1073151 - RNA, 16 nt, Homo sapiens
agagugcuaugaagac

SEQ ID NO: 1073152 - RNA, 14 nt, Homo sapiens
agauaauaugagaa

SEQ ID NO: 1073153 - RNA, 23 nt, Homo sapiens
agauugugccacuucacuccagc

SEQ ID NO: 1073154 - RNA, 18 nt, Homo sapiens
agcaaauguuaugcauaa

SEQ ID NO: 1073155 - RNA, 12 nt, Homo sapiens
agcacuuugcaa

SEQ ID NO: 1073156 - RNA, 23 nt, Homo sapiens
agcaguuacaaaaaccuucccca

SEQ ID NO: 1073157 - RNA, 19 nt, Homo sapiens
agccgagaucgugccauug

SEQ ID NO: 1073158 - RNA, 23 nt, Homo sapiens
agccuguugggaucgcauugcau

SEQ ID NO: 1073159 - RNA, 19 nt, Homo sapiens
agcucucuucaaugacaua

SEQ ID NO: 1073160 - RNA, 15 nt, Homo sapiens
agcugaauacauucu

SEQ ID NO: 1073161 - RNA, 22 nt, Homo sapiens
agcugagauugugccacuucac

SEQ ID NO: 1073162 - RNA, 20 nt, Homo sapiens
aggaggcagagguugcagug

SEQ ID NO: 1073163 - RNA, 21 nt, Homo sapiens
aggaggggaggaacacugcac

SEQ ID NO: 1073164 - RNA, 13 nt, Homo sapiens
aggcugcagugag

SEQ ID NO: 1073165 - RNA, 15 nt, Homo sapiens
agguguuggugacaa

SEQ ID NO: 1073166 - RNA, 16 nt, Homo sapiens
agucucuagguucuga

SEQ ID NO: 1073167 - RNA, 15 nt, Homo sapiens
agugaauuguugaca

SEQ ID NO: 1073168 - RNA, 20 nt, Homo sapiens
aguuaggcuauucacaacca

SEQ ID NO: 1073169 - RNA, 18 nt, Homo sapiens
auaaaagaucuugcagaa

SEQ ID NO: 1073170 - RNA, 20 nt, Homo sapiens
auaauaugcacacagugcuu

SEQ ID NO: 1073171 - RNA, 21 nt, Homo sapiens
auagccuagauaugaauauau

SEQ ID NO: 1073172 - RNA, 18 nt, Homo sapiens
auauauggcauuugcaga

SEQ ID NO: 1073173 - RNA, 18 nt, Homo sapiens
auaucaguccucuuucaa

SEQ ID NO: 1073174 - RNA, 21 nt, Homo sapiens
aucaauaguguccuaugcaau

SEQ ID NO: 1073175 - RNA, 22 nt, Homo sapiens
aucaauaguguccuaugcaaua

SEQ ID NO: 1073176 - RNA, 15 nt, Homo sapiens
aucagcauuuuacua

SEQ ID NO: 1073177 - RNA, 13 nt, Homo sapiens
aucaggacgagaa

SEQ ID NO: 1073178 - RNA, 14 nt, Homo sapiens
aucaguuacucuga

SEQ ID NO: 1073179 - RNA, 17 nt, Homo sapiens
auccaaagcugaauaca

SEQ ID NO: 1073180 - RNA, 22 nt, Homo sapiens
aucuuguuuuuccacuacugcu

SEQ ID NO: 1073181 - RNA, 16 nt, Homo sapiens
augaaagugaugacau

SEQ ID NO: 1073182 - RNA, 19 nt, Homo sapiens
augaauuuuuuucaucuuc

SEQ ID NO: 1073183 - RNA, 11 nt, Homo sapiens
augacauauuu

SEQ ID NO: 1073184 - RNA, 20 nt, Homo sapiens
augagaaucagaucauuuca

SEQ ID NO: 1073185 - RNA, 19 nt, Homo sapiens
augaucaaaaauaaugcau

SEQ ID NO: 1073186 - RNA, 16 nt, Homo sapiens
augauggcagugguuu

SEQ ID NO: 1073187 - RNA, 20 nt, Homo sapiens
augcauccagcaguacaaua

SEQ ID NO: 1073188 - RNA, 18 nt, Homo sapiens
augcuuguauuuuacuuu

SEQ ID NO: 1073189 - RNA, 13 nt, Homo sapiens
auggaaucagauu

SEQ ID NO: 1073190 - RNA, 23 nt, Homo sapiens
auggcuuuggcuuugcaaaauaa

SEQ ID NO: 1073191 - RNA, 20 nt, Homo sapiens
augguggcucacaccuguaa

SEQ ID NO: 1073192 - RNA, 19 nt, Homo sapiens
augguuccauucucucucc

SEQ ID NO: 1073193 - RNA, 13 nt, Homo sapiens
auguuaugcauaa

SEQ ID NO: 1073194 - RNA, 19 nt, Homo sapiens
auguuucgcugauauaugu

SEQ ID NO: 1073195 - RNA, 23 nt, Homo sapiens
auguuucgugaaguauacuguau

SEQ ID NO: 1073196 - RNA, 19 nt, Homo sapiens
auuaauaccuaaacuguau

SEQ ID NO: 1073197 - RNA, 14 nt, Homo sapiens
auuacaucuuucac

SEQ ID NO: 1073198 - RNA, 13 nt, Homo sapiens
auuauuuuuacag

SEQ ID NO: 1073199 - RNA, 21 nt, Homo sapiens
auucuucuuugguggagauaa

SEQ ID NO: 1073200 - RNA, 20 nt, Homo sapiens
auuggccggcuaguguuucc

SEQ ID NO: 1073201 - RNA, 15 nt, Homo sapiens
auuguacaguuuaaa

SEQ ID NO: 1073202 - RNA, 23 nt, Homo sapiens
auuuguucucccaaaacagauua

SEQ ID NO: 1073203 - RNA, 19 nt, Homo sapiens
auuuuuacaguucucccaa

SEQ ID NO: 1073204 - RNA, 14 nt, Homo sapiens
caaacaaaauggac

SEQ ID NO: 1073205 - RNA, 12 nt, Homo sapiens
caaacuguaaaa

SEQ ID NO: 1073206 - RNA, 19 nt, Homo sapiens
caaacuguaaaaaaugugu

SEQ ID NO: 1073207 - RNA, 18 nt, Homo sapiens
caacacccaaguugaaga

SEQ ID NO: 1073208 - RNA, 20 nt, Homo sapiens
caacucagguuuuggcauua

SEQ ID NO: 1073209 - RNA, 19 nt, Homo sapiens
caagauuuuuucauuucaa

SEQ ID NO: 1073210 - RNA, 23 nt, Homo sapiens
caagccagccuugcuccuggcug

SEQ ID NO: 1073211 - RNA, 17 nt, Homo sapiens
caagugaaaaacaucca

SEQ ID NO: 1073212 - RNA, 18 nt, Homo sapiens
caauaaaauuauuugcag

SEQ ID NO: 1073213 - RNA, 17 nt, Homo sapiens
caaucgagacugcaaug

SEQ ID NO: 1073214 - RNA, 21 nt, Homo sapiens
caaugccacauacuugcagcu

SEQ ID NO: 1073215 - RNA, 14 nt, Homo sapiens
cacaaaauugggaa

SEQ ID NO: 1073216 - RNA, 20 nt, Homo sapiens
caccagagauaauaugagaa

SEQ ID NO: 1073217 - RNA, 20 nt, Homo sapiens
cagagcgagacuccgucuca

SEQ ID NO: 1073218 - RNA, 15 nt, Homo sapiens
cagaucacagugucu

SEQ ID NO: 1073219 - RNA, 18 nt, Homo sapiens
cagauuagcuaggggaca

SEQ ID NO: 1073220 - RNA, 21 nt, Homo sapiens
cagcuaccucuucuauggacu

SEQ ID NO: 1073221 - RNA, 14 nt, Homo sapiens
cagcugagguucau

SEQ ID NO: 1073222 - RNA, 18 nt, Homo sapiens
cagcugagguucauuaca

SEQ ID NO: 1073223 - RNA, 18 nt, Homo sapiens
caggaagucuucagggaa

SEQ ID NO: 1073224 - RNA, 22 nt, Homo sapiens
caggagguggaggcugcaguga

SEQ ID NO: 1073225 - RNA, 14 nt, Homo sapiens
caggcuuaugaaua

SEQ ID NO: 1073226 - RNA, 15 nt, Homo sapiens
caggcuuaugaauau

SEQ ID NO: 1073227 - RNA, 20 nt, Homo sapiens
cagggcucugugaccaggaa

SEQ ID NO: 1073228 - RNA, 12 nt, Homo sapiens
caguaacugaca

SEQ ID NO: 1073229 - RNA, 14 nt, Homo sapiens
caguccucuuucaa

SEQ ID NO: 1073230 - RNA, 19 nt, Homo sapiens
caguucugucauauguuaa

SEQ ID NO: 1073231 - RNA, 15 nt, Homo sapiens
cauaaagucagugcc

SEQ ID NO: 1073232 - RNA, 23 nt, Homo sapiens
cauacaauuauuuuuacaguucu

SEQ ID NO: 1073233 - RNA, 10 nt, Homo sapiens
cauacugcug

SEQ ID NO: 1073234 - RNA, 16 nt, Homo sapiens
cauagauguuaugcaa

SEQ ID NO: 1073235 - RNA, 22 nt, Homo sapiens
caucaauaguguccuaugcaau

SEQ ID NO: 1073236 - RNA, 17 nt, Homo sapiens
caucuuggucacauaca

SEQ ID NO: 1073237 - RNA, 17 nt, Homo sapiens
caugaugaaaccccauc

SEQ ID NO: 1073238 - RNA, 16 nt, Homo sapiens
cauguugguugcacuu

SEQ ID NO: 1073239 - RNA, 17 nt, Homo sapiens
cauucuuguuggcuuuu

SEQ ID NO: 1073240 - RNA, 19 nt, Homo sapiens
cauuugcgaaugguuccau

SEQ ID NO: 1073241 - RNA, 21 nt, Homo sapiens
cauuuuaggcaaauguuuaaa

SEQ ID NO: 1073242 - RNA, 20 nt, Homo sapiens
ccaaaguaucaggacgagaa

SEQ ID NO: 1073243 - RNA, 14 nt, Homo sapiens
ccaaguuuauauac

SEQ ID NO: 1073244 - RNA, 22 nt, Homo sapiens
ccacaauuacauacuauucuua

SEQ ID NO: 1073245 - RNA, 20 nt, Homo sapiens
ccacguugccucuacuuuau

SEQ ID NO: 1073246 - RNA, 12 nt, Homo sapiens
ccacuacugcua

SEQ ID NO: 1073247 - RNA, 20 nt, Homo sapiens
ccagcacuuugggaggccaa

SEQ ID NO: 1073248 - RNA, 22 nt, Homo sapiens
ccaggagguggaggcugcagug

SEQ ID NO: 1073249 - RNA, 11 nt, Homo sapiens
ccaugagacac

SEQ ID NO: 1073250 - RNA, 15 nt, Homo sapiens
ccauuaaaguucuca

SEQ ID NO: 1073251 - RNA, 21 nt, Homo sapiens
ccauuuagcgaacaaccacag

SEQ ID NO: 1073252 - RNA, 20 nt, Homo sapiens
ccauuuuaaaaugcaucauu

SEQ ID NO: 1073253 - RNA, 22 nt, Homo sapiens
ccccacguugccucuacuuuau

SEQ ID NO: 1073254 - RNA, 18 nt, Homo sapiens
cccuuuuacauacugcug

SEQ ID NO: 1073255 - RNA, 14 nt, Homo sapiens
ccuagauaugaaua

SEQ ID NO: 1073256 - RNA, 16 nt, Homo sapiens
ccuccauacucaggac

SEQ ID NO: 1073257 - RNA, 16 nt, Homo sapiens
ccucuccgcaguuccu

SEQ ID NO: 1073258 - RNA, 16 nt, Homo sapiens
ccugaacuuacacaaa

SEQ ID NO: 1073259 - RNA, 20 nt, Homo sapiens
ccuggccaacaugaugaaac

SEQ ID NO: 1073260 - RNA, 13 nt, Homo sapiens
ccuugaaugccau

SEQ ID NO: 1073261 - RNA, 18 nt, Homo sapiens
cgaaugguuccauucucu

SEQ ID NO: 1073262 - RNA, 15 nt, Homo sapiens
cgagacuccgucuca

SEQ ID NO: 1073263 - RNA, 17 nt, Homo sapiens
cgagacuccgucucaaa

SEQ ID NO: 1073264 - RNA, 22 nt, Homo sapiens
cgauuucacaguguguuuguga

SEQ ID NO: 1073265 - RNA, 20 nt, Homo sapiens
cggagcuugcagugagccga

SEQ ID NO: 1073266 - RNA, 22 nt, Homo sapiens
cgucgaaagaaagaauauguaa

SEQ ID NO: 1073267 - RNA, 23 nt, Homo sapiens
cuaaaacagaaaaaaaaauggaa

SEQ ID NO: 1073268 - RNA, 17 nt, Homo sapiens
cuaacauguaauugcag

SEQ ID NO: 1073269 - RNA, 20 nt, Homo sapiens
cuaacauguaauugcagaua

SEQ ID NO: 1073270 - RNA, 20 nt, Homo sapiens
cuagcaaauguuaugcauaa

SEQ ID NO: 1073271 - RNA, 19 nt, Homo sapiens
cucauagauguuaugcaaa

SEQ ID NO: 1073272 - RNA, 13 nt, Homo sapiens
cucaucugugauu

SEQ ID NO: 1073273 - RNA, 18 nt, Homo sapiens
cucauguuuuuaaagggc

SEQ ID NO: 1073274 - RNA, 15 nt, Homo sapiens
cucauuuuaggcaaa

SEQ ID NO: 1073275 - RNA, 23 nt, Homo sapiens
cucuaaauaaacagauacauuca

SEQ ID NO: 1073276 - RNA, 11 nt, Homo sapiens
cucucauuucc

SEQ ID NO: 1073277 - RNA, 19 nt, Homo sapiens
cucucuuuaaaaugcaaaa

SEQ ID NO: 1073278 - RNA, 22 nt, Homo sapiens
cucuuaagcuuccgccgucuca

SEQ ID NO: 1073279 - RNA, 16 nt, Homo sapiens
cugauacccuuugaaa

SEQ ID NO: 1073280 - RNA, 23 nt, Homo sapiens
cugauagguagcauuuuccagca

SEQ ID NO: 1073281 - RNA, 21 nt, Homo sapiens
cuguagucccagcuacucggg

SEQ ID NO: 1073282 - RNA, 14 nt, Homo sapiens
cuguauuucauucu

SEQ ID NO: 1073283 - RNA, 18 nt, Homo sapiens
cugugaccaggaaggaag

SEQ ID NO: 1073284 - RNA, 21 nt, Homo sapiens
cugugauucccuccugcuacu

SEQ ID NO: 1073285 - RNA, 18 nt, Homo sapiens
cuguuccuucacauccug

SEQ ID NO: 1073286 - RNA, 16 nt, Homo sapiens
cuuaacauuccuaaaa

SEQ ID NO: 1073287 - RNA, 23 nt, Homo sapiens
cuuaacauuccuaaaaugcuuca

SEQ ID NO: 1073288 - RNA, 15 nt, Homo sapiens
cuucgaggcccagcg

SEQ ID NO: 1073289 - RNA, 21 nt, Homo sapiens
cuucugaggcgcugcuuuguc

SEQ ID NO: 1073290 - RNA, 20 nt, Homo sapiens
cuucugcuuuuuuucaggga

SEQ ID NO: 1073291 - RNA, 12 nt, Homo sapiens
cuugaaugccau

SEQ ID NO: 1073292 - RNA, 20 nt, Homo sapiens
cuuguugagauccccguguu

SEQ ID NO: 1073293 - RNA, 23 nt, Homo sapiens
cuuguuuuuccacuacugcuacc

SEQ ID NO: 1073294 - RNA, 16 nt, Homo sapiens
cuuuaaaaugcaaaau

SEQ ID NO: 1073295 - RNA, 22 nt, Homo sapiens
cuuuaaucacuuaacauuccua

SEQ ID NO: 1073296 - RNA, 18 nt, Homo sapiens
cuuugccuuggcuuugcc

SEQ ID NO: 1073297 - RNA, 14 nt, Homo sapiens
cuuuguaucauuca

SEQ ID NO: 1073298 - RNA, 16 nt, Homo sapiens
cuuugucaaaaggaag

SEQ ID NO: 1073299 - RNA, 16 nt, Homo sapiens
cuuuuacauacugcug

SEQ ID NO: 1073300 - RNA, 19 nt, Homo sapiens
cuuuugguuacagcacaaa

SEQ ID NO: 1073301 - RNA, 14 nt, Homo sapiens
cuuuugucuaauua

SEQ ID NO: 1073302 - RNA, 21 nt, Homo sapiens
cuuuugucuaauuaaaacacu

SEQ ID NO: 1073303 - RNA, 19 nt, Homo sapiens
cuuuuguucagggcuguga

SEQ ID NO: 1073304 - RNA, 19 nt, Homo sapiens
gaaaccuugaaagacauuu

SEQ ID NO: 1073305 - RNA, 16 nt, Homo sapiens
gaaagacaagcucaag

SEQ ID NO: 1073306 - RNA, 22 nt, Homo sapiens
gaaagacaagcucaaguguuca

SEQ ID NO: 1073307 - RNA, 17 nt, Homo sapiens
gaacacugcacucuuaa

SEQ ID NO: 1073308 - RNA, 21 nt, Homo sapiens
gaaccauguugguugcacuuu

SEQ ID NO: 1073309 - RNA, 20 nt, Homo sapiens
gaacugaaggcagcauguau

SEQ ID NO: 1073310 - RNA, 22 nt, Homo sapiens
gaagaguggguuucacaaguga

SEQ ID NO: 1073311 - RNA, 18 nt, Homo sapiens
gaagcggucacagaucac

SEQ ID NO: 1073312 - RNA, 21 nt, Homo sapiens
gaaggaagucagcaugccucu

SEQ ID NO: 1073313 - RNA, 14 nt, Homo sapiens
gaagguacugucau

SEQ ID NO: 1073314 - RNA, 12 nt, Homo sapiens
gaauuaagcaaa

SEQ ID NO: 1073315 - RNA, 18 nt, Homo sapiens
gacaaagacaaauucugu

SEQ ID NO: 1073316 - RNA, 17 nt, Homo sapiens
gacaaagugagacuccg

SEQ ID NO: 1073317 - RNA, 16 nt, Homo sapiens
gacagagcgagacucc

SEQ ID NO: 1073318 - RNA, 14 nt, Homo sapiens
gagaaguuaagcaa

SEQ ID NO: 1073319 - RNA, 16 nt, Homo sapiens
gagacuccgucacaac

SEQ ID NO: 1073320 - RNA, 17 nt, Homo sapiens
gagauggguuugacaag

SEQ ID NO: 1073321 - RNA, 13 nt, Homo sapiens
gagcuugcaguga

SEQ ID NO: 1073322 - RNA, 16 nt, Homo sapiens
gaguggguuucacaag

SEQ ID NO: 1073323 - RNA, 23 nt, Homo sapiens
gaguuccagcaaacaaaauggac

SEQ ID NO: 1073324 - RNA, 15 nt, Homo sapiens
gauaaguguccccua

SEQ ID NO: 1073325 - RNA, 23 nt, Homo sapiens
gauacuccgcugucggcacauuc

SEQ ID NO: 1073326 - RNA, 20 nt, Homo sapiens
gaucgugccauugcacucca

SEQ ID NO: 1073327 - RNA, 17 nt, Homo sapiens
gaucuauguuucaucuu

SEQ ID NO: 1073328 - RNA, 22 nt, Homo sapiens
gauuaaugaaucguaaugaagu

SEQ ID NO: 1073329 - RNA, 22 nt, Homo sapiens
gauuuaauuuuuuaaacuguag

SEQ ID NO: 1073330 - RNA, 15 nt, Homo sapiens
gauuucacagugugu

SEQ ID NO: 1073331 - RNA, 18 nt, Homo sapiens
gcaaaaucuguucuaaca

SEQ ID NO: 1073332 - RNA, 15 nt, Homo sapiens
gcaaacaaaauggac

SEQ ID NO: 1073333 - RNA, 16 nt, Homo sapiens
gcaaauguuaugcaua

SEQ ID NO: 1073334 - RNA, 17 nt, Homo sapiens
gcaguuccugucccuuc

SEQ ID NO: 1073335 - RNA, 23 nt, Homo sapiens
gcauggcuuuggcuuugcaaaau

SEQ ID NO: 1073336 - RNA, 17 nt, Homo sapiens
gcauuuuccagcacuuu

SEQ ID NO: 1073337 - RNA, 18 nt, Homo sapiens
gccaccagacugacaaau

SEQ ID NO: 1073338 - RNA, 18 nt, Homo sapiens
gccauugcacuccagccu

SEQ ID NO: 1073339 - RNA, 13 nt, Homo sapiens
gccucuacuuuau

SEQ ID NO: 1073340 - RNA, 19 nt, Homo sapiens
gccuguaaucccagcuacu

SEQ ID NO: 1073341 - RNA, 19 nt, Homo sapiens
gccuguagucccagcuacu

SEQ ID NO: 1073342 - RNA, 19 nt, Homo sapiens
gcgaaaccccucucuacua

SEQ ID NO: 1073343 - RNA, 20 nt, Homo sapiens
gcuacucuguuccuucacau

SEQ ID NO: 1073344 - RNA, 21 nt, Homo sapiens
gcuacucuguuccuucacauc

SEQ ID NO: 1073345 - RNA, 12 nt, Homo sapiens
gcuaguguuucc

SEQ ID NO: 1073346 - RNA, 14 nt, Homo sapiens
gcugagagugcuau

SEQ ID NO: 1073347 - RNA, 21 nt, Homo sapiens
gcuuaccauuaaaguucucaa

SEQ ID NO: 1073348 - RNA, 13 nt, Homo sapiens
gcuuaugaauaua

SEQ ID NO: 1073349 - RNA, 17 nt, Homo sapiens
gcuuccgccgucucaac

SEQ ID NO: 1073350 - RNA, 13 nt, Homo sapiens
ggaacacugcacu

SEQ ID NO: 1073351 - RNA, 18 nt, Homo sapiens
ggaacacugcacucuuaa

SEQ ID NO: 1073352 - RNA, 11 nt, Homo sapiens
ggaagugcuuc

SEQ ID NO: 1073353 - RNA, 20 nt, Homo sapiens
ggaggcggagcuugcaguga

SEQ ID NO: 1073354 - RNA, 19 nt, Homo sapiens
ggagguggaggcugcagug

SEQ ID NO: 1073355 - RNA, 20 nt, Homo sapiens
ggagguggaggcugcaguga

SEQ ID NO: 1073356 - RNA, 18 nt, Homo sapiens
ggaguuaggcuauucaca

SEQ ID NO: 1073357 - RNA, 16 nt, Homo sapiens
ggauaacacauuugau

SEQ ID NO: 1073358 - RNA, 13 nt, Homo sapiens
ggaugauguuucg

SEQ ID NO: 1073359 - RNA, 15 nt, Homo sapiens
ggcauuucacaaaac

SEQ ID NO: 1073360 - RNA, 23 nt, Homo sapiens
ggccaagguggguggaucacuug

SEQ ID NO: 1073361 - RNA, 20 nt, Homo sapiens
ggcgacagagcgagacuccg

SEQ ID NO: 1073362 - RNA, 11 nt, Homo sapiens
ggcugcaguga

SEQ ID NO: 1073363 - RNA, 18 nt, Homo sapiens
gggcucugugaccaggaa

SEQ ID NO: 1073364 - RNA, 22 nt, Homo sapiens
ggucugaaauuugugauggaau

SEQ ID NO: 1073365 - RNA, 17 nt, Homo sapiens
gguggcccacgccugua

SEQ ID NO: 1073366 - RNA, 12 nt, Homo sapiens
guaaaauggagg

SEQ ID NO: 1073367 - RNA, 16 nt, Homo sapiens
guaacuggcaguuuuc

SEQ ID NO: 1073368 - RNA, 22 nt, Homo sapiens
guacaauaaaaguaaaccacaa

SEQ ID NO: 1073369 - RNA, 23 nt, Homo sapiens
guagaaaaagcaguaacugacaa

SEQ ID NO: 1073370 - RNA, 20 nt, Homo sapiens
guauuaggugucauuuccau

SEQ ID NO: 1073371 - RNA, 15 nt, Homo sapiens
gucaauagcaugcaa

SEQ ID NO: 1073372 - RNA, 22 nt, Homo sapiens
gucacaacaacaacaacaaaaa

SEQ ID NO: 1073373 - RNA, 13 nt, Homo sapiens
guccuaugcaaua

SEQ ID NO: 1073374 - RNA, 20 nt, Homo sapiens
guccugaugcuuuugucuaa

SEQ ID NO: 1073375 - RNA, 21 nt, Homo sapiens
gugcuuuccguggcacugcau

SEQ ID NO: 1073376 - RNA, 16 nt, Homo sapiens
guuacagcacaaaaug

SEQ ID NO: 1073377 - RNA, 21 nt, Homo sapiens
guuauuuagggaacugcuuga

SEQ ID NO: 1073378 - RNA, 16 nt, Homo sapiens
guuccaggauguggaa

SEQ ID NO: 1073379 - RNA, 23 nt, Homo sapiens
guucuucccuuuuacauacugcu

SEQ ID NO: 1073380 - RNA, 20 nt, Homo sapiens
guugcaaauacauggauaac

SEQ ID NO: 1073381 - RNA, 13 nt, Homo sapiens
guugcacuuugua

SEQ ID NO: 1073382 - RNA, 15 nt, Homo sapiens
guuugagaccagccu

SEQ ID NO: 1073383 - RNA, 19 nt, Homo sapiens
guuuuccuucucaucugug

SEQ ID NO: 1073384 - RNA, 13 nt, Homo sapiens
guuuucuaaagua

SEQ ID NO: 1073385 - RNA, 19 nt, Homo sapiens
uaaaagagacaaacuguaa

SEQ ID NO: 1073386 - RNA, 18 nt, Homo sapiens
uaaaaugcuucacuguac

SEQ ID NO: 1073387 - RNA, 13 nt, Homo sapiens
uaaauaaacagau

SEQ ID NO: 1073388 - RNA, 13 nt, Homo sapiens
uaaauaaauggaa

SEQ ID NO: 1073389 - RNA, 21 nt, Homo sapiens
uaacauuccuaaaaugcuuca

SEQ ID NO: 1073390 - RNA, 16 nt, Homo sapiens
uaacugacaacuugaa

SEQ ID NO: 1073391 - RNA, 20 nt, Homo sapiens
uaauaaaaagcuucagggaa

SEQ ID NO: 1073392 - RNA, 16 nt, Homo sapiens
uaaucugagaguuuuc

SEQ ID NO: 1073393 - RNA, 18 nt, Homo sapiens
uacaaucgagacugcaau

SEQ ID NO: 1073394 - RNA, 17 nt, Homo sapiens
uacaauugaaaugacua

SEQ ID NO: 1073395 - RNA, 15 nt, Homo sapiens
uacaguucugucaua

SEQ ID NO: 1073396 - RNA, 16 nt, Homo sapiens
uacaguucugucauau

SEQ ID NO: 1073397 - RNA, 13 nt, Homo sapiens
uacauacugcugu

SEQ ID NO: 1073398 - RNA, 16 nt, Homo sapiens
uacauucugcuuucau

SEQ ID NO: 1073399 - RNA, 18 nt, Homo sapiens
uacucuguuccuucacau

SEQ ID NO: 1073400 - RNA, 17 nt, Homo sapiens
uacugcuaccacaacua

SEQ ID NO: 1073401 - RNA, 13 nt, Homo sapiens
uaguuauauugaa

SEQ ID NO: 1073402 - RNA, 17 nt, Homo sapiens
uauaauaaaaagcuuca

SEQ ID NO: 1073403 - RNA, 18 nt, Homo sapiens
uauagaagaaaauuuugg

SEQ ID NO: 1073404 - RNA, 13 nt, Homo sapiens
uauaucaguccuc

SEQ ID NO: 1073405 - RNA, 22 nt, Homo sapiens
uauauccgccuggcauuucaca

SEQ ID NO: 1073406 - RNA, 18 nt, Homo sapiens
uaugaacauuagaaaaau

SEQ ID NO: 1073407 - RNA, 23 nt, Homo sapiens
uaugaacugaaggcagcauguau

SEQ ID NO: 1073408 - RNA, 16 nt, Homo sapiens
uauggcuuaaugacac

SEQ ID NO: 1073409 - RNA, 10 nt, Homo sapiens
caguaacuga

SEQ ID NO: 1073410 - RNA, 21 nt, Homo sapiens
cagucauggcaccaaagccac

SEQ ID NO: 1073411 - RNA, 19 nt, Homo sapiens
cauagauguuaugcaaaaa

SEQ ID NO: 1073412 - RNA, 23 nt, Homo sapiens
caucauuaauaccuaaacuguau

SEQ ID NO: 1073413 - RNA, 14 nt, Homo sapiens
caucuuggucacau

SEQ ID NO: 1073414 - RNA, 19 nt, Homo sapiens
caucuuggucacauacaau

SEQ ID NO: 1073415 - RNA, 16 nt, Homo sapiens
cauggcaccaaagcca

SEQ ID NO: 1073416 - RNA, 22 nt, Homo sapiens
cauguuaggaagguacugucau

SEQ ID NO: 1073417 - RNA, 19 nt, Homo sapiens
cauguuuuuaaagggcuau

SEQ ID NO: 1073418 - RNA, 18 nt, Homo sapiens
cauuaauaccuaaacugu

SEQ ID NO: 1073419 - RNA, 16 nt, Homo sapiens
cauuuguuaaaauaca

SEQ ID NO: 1073420 - RNA, 16 nt, Homo sapiens
ccagauucuaccacac

SEQ ID NO: 1073421 - RNA, 21 nt, Homo sapiens
cccaagauuuuuucauuucaa

SEQ ID NO: 1073422 - RNA, 18 nt, Homo sapiens
ccggaugcuucuccauga

SEQ ID NO: 1073423 - RNA, 19 nt, Homo sapiens
ccuaaugaaagugaugaca

SEQ ID NO: 1073424 - RNA, 21 nt, Homo sapiens
ccuaaugaaagugaugacaua

SEQ ID NO: 1073425 - RNA, 23 nt, Homo sapiens
ccuagauaugaauauauggcauu

SEQ ID NO: 1073426 - RNA, 19 nt, Homo sapiens
ccuccacagcuaccucuuc

SEQ ID NO: 1073427 - RNA, 14 nt, Homo sapiens
ccucuagaggcaag

SEQ ID NO: 1073428 - RNA, 20 nt, Homo sapiens
ccucucauuucccuuugaua

SEQ ID NO: 1073429 - RNA, 17 nt, Homo sapiens
ccugacuuuuaauguca

SEQ ID NO: 1073430 - RNA, 13 nt, Homo sapiens
ccugcaaaaucug

SEQ ID NO: 1073431 - RNA, 20 nt, Homo sapiens
ccuggcuggggccuguugaa

SEQ ID NO: 1073432 - RNA, 13 nt, Homo sapiens
ccugggugacaaa

SEQ ID NO: 1073433 - RNA, 15 nt, Homo sapiens
ccuguaaucccagcu

SEQ ID NO: 1073434 - RNA, 17 nt, Homo sapiens
ccuuuuacauacugcug

SEQ ID NO: 1073435 - RNA, 21 nt, Homo sapiens
cgagaucgcgccacugcacuc

SEQ ID NO: 1073436 - RNA, 13 nt, Homo sapiens
cggaguuccagca

SEQ ID NO: 1073437 - RNA, 17 nt, Homo sapiens
cgggaagaaggggacaa

SEQ ID NO: 1073438 - RNA, 19 nt, Homo sapiens
cuaaaaugcuucacuguac

SEQ ID NO: 1073439 - RNA, 11 nt, Homo sapiens
cuaaacuguau

SEQ ID NO: 1073440 - RNA, 16 nt, Homo sapiens
cuaaaguauguuuuca

SEQ ID NO: 1073441 - RNA, 20 nt, Homo sapiens
cuaaauuuucugaaacugca

SEQ ID NO: 1073442 - RNA, 16 nt, Homo sapiens
cuacacugggugcuga

SEQ ID NO: 1073443 - RNA, 20 nt, Homo sapiens
cuaccaucucacggugggga

SEQ ID NO: 1073444 - RNA, 23 nt, Homo sapiens
cuacucuguuccuucacauccug

SEQ ID NO: 1073445 - RNA, 16 nt, Homo sapiens
cuacuuuaucaauuaa

SEQ ID NO: 1073446 - RNA, 13 nt, Homo sapiens
cuaugaagacagg

SEQ ID NO: 1073447 - RNA, 16 nt, Homo sapiens
cucuaguuauauugaa

SEQ ID NO: 1073448 - RNA, 15 nt, Homo sapiens
cucuggcgacaguuu

SEQ ID NO: 1073449 - RNA, 17 nt, Homo sapiens
cucuggcgacaguuuuc

SEQ ID NO: 1073450 - RNA, 17 nt, Homo sapiens
cucugucgugagugucu

SEQ ID NO: 1073451 - RNA, 20 nt, Homo sapiens
cugaagggcaucaugcaucu

SEQ ID NO: 1073452 - RNA, 13 nt, Homo sapiens
cugaauacauucu

SEQ ID NO: 1073453 - RNA, 20 nt, Homo sapiens
cugaauacauucugcuuuca

SEQ ID NO: 1073454 - RNA, 19 nt, Homo sapiens
cugacccuguaaaauggag

SEQ ID NO: 1073455 - RNA, 17 nt, Homo sapiens
cugacuuuuaaugucau

SEQ ID NO: 1073456 - RNA, 19 nt, Homo sapiens
cugacuuuuaaugucauuu

SEQ ID NO: 1073457 - RNA, 21 nt, Homo sapiens
cugauaauuauuuuaaagggg

SEQ ID NO: 1073458 - RNA, 14 nt, Homo sapiens
cugauccuugcacg

SEQ ID NO: 1073459 - RNA, 15 nt, Homo sapiens
cugauccuugcacgc

SEQ ID NO: 1073460 - RNA, 18 nt, Homo sapiens
cuggcuggggccuguuga

SEQ ID NO: 1073461 - RNA, 21 nt, Homo sapiens
cugguuguugccaaacagcca

SEQ ID NO: 1073462 - RNA, 15 nt, Homo sapiens
cuguacuuuuuccag

SEQ ID NO: 1073463 - RNA, 18 nt, Homo sapiens
cuguagcaauuggauaga

SEQ ID NO: 1073464 - RNA, 15 nt, Homo sapiens
cugucaucagccugu

SEQ ID NO: 1073465 - RNA, 17 nt, Homo sapiens
cuguccuugaaugccau

SEQ ID NO: 1073466 - RNA, 17 nt, Homo sapiens
cuguguaauauaaaaga

SEQ ID NO: 1073467 - RNA, 16 nt, Homo sapiens
cuguucuaacauguaa

SEQ ID NO: 1073468 - RNA, 21 nt, Homo sapiens
cuuaagcuuccgccgucucaa

SEQ ID NO: 1073469 - RNA, 21 nt, Homo sapiens
cuucgggaagaaggggacaau

SEQ ID NO: 1073470 - RNA, 19 nt, Homo sapiens
cuucugaggcgcugcuuug

SEQ ID NO: 1073471 - RNA, 18 nt, Homo sapiens
cuugaaugccauagucaa

SEQ ID NO: 1073472 - RNA, 18 nt, Homo sapiens
cuuggucacauacaauua

SEQ ID NO: 1073473 - RNA, 21 nt, Homo sapiens
cuuguuuuuccacuacugcua

SEQ ID NO: 1073474 - RNA, 14 nt, Homo sapiens
cuuucuucugaaua

SEQ ID NO: 1073475 - RNA, 22 nt, Homo sapiens
cuuugauacagucaacaagccu

SEQ ID NO: 1073476 - RNA, 21 nt, Homo sapiens
cuuugcuuuaaguguaacugg

SEQ ID NO: 1073477 - RNA, 14 nt, Homo sapiens
cuuuggcuuugcaa

SEQ ID NO: 1073478 - RNA, 18 nt, Homo sapiens
cuuuuuaaccugcaaaau

SEQ ID NO: 1073479 - RNA, 16 nt, Homo sapiens
gaaaaaaaaauggaag

SEQ ID NO: 1073480 - RNA, 17 nt, Homo sapiens
gaaaaaaaaauggaagc

SEQ ID NO: 1073481 - RNA, 23 nt, Homo sapiens
gaaaaauagcaacuuguguuaca

SEQ ID NO: 1073482 - RNA, 21 nt, Homo sapiens
gaaaaaucggcuuaccauuaa

SEQ ID NO: 1073483 - RNA, 12 nt, Homo sapiens
gaaaaucuuaca

SEQ ID NO: 1073484 - RNA, 14 nt, Homo sapiens
gaaagaacugucau

SEQ ID NO: 1073485 - RNA, 21 nt, Homo sapiens
gaaagcaacuuuacugagaca

SEQ ID NO: 1073486 - RNA, 13 nt, Homo sapiens
gaaauuaaccaua

SEQ ID NO: 1073487 - RNA, 20 nt, Homo sapiens
gaaauuuaauucauguuucu

SEQ ID NO: 1073488 - RNA, 12 nt, Homo sapiens
gaacacugcacu

SEQ ID NO: 1073489 - RNA, 17 nt, Homo sapiens
gaacugcauauguuucg

SEQ ID NO: 1073490 - RNA, 23 nt, Homo sapiens
gaagagaauauuagcuuuacugu

SEQ ID NO: 1073491 - RNA, 23 nt, Homo sapiens
gaauucuuacauguuuucuuugc

SEQ ID NO: 1073492 - RNA, 22 nt, Homo sapiens
gacauagaaaguucauggaacu

SEQ ID NO: 1073493 - RNA, 17 nt, Homo sapiens
gacccuguaaaauggag

SEQ ID NO: 1073494 - RNA, 16 nt, Homo sapiens
gacuccgucucaaaaa

SEQ ID NO: 1073495 - RNA, 18 nt, Homo sapiens
gacugguuguugccaaac

SEQ ID NO: 1073496 - RNA, 21 nt, Homo sapiens
gacuuaacgugcucaugggcu

SEQ ID NO: 1073497 - RNA, 15 nt, Homo sapiens
gacuuuuaaugucau

SEQ ID NO: 1073498 - RNA, 19 nt, Homo sapiens
gagaacugcauauguuucg

SEQ ID NO: 1073499 - RNA, 21 nt, Homo sapiens
gagaucgugccauugcacucc

SEQ ID NO: 1073500 - RNA, 17 nt, Homo sapiens
gagauugugccacuuca

SEQ ID NO: 1073501 - RNA, 20 nt, Homo sapiens
gagauugugccacuucacuc

SEQ ID NO: 1073502 - RNA, 18 nt, Homo sapiens
gagcgagacuccgucuca

SEQ ID NO: 1073503 - RNA, 13 nt, Homo sapiens
gaggcugcaguga

SEQ ID NO: 1073504 - RNA, 24 nt, Homo sapiens
gagugcuaugaagacaggaucuag

SEQ ID NO: 1073505 - RNA, 18 nt, Homo sapiens
gaguuaggcuauucacaa

SEQ ID NO: 1073506 - RNA, 12 nt, Homo sapiens
gauaacuuugac

SEQ ID NO: 1073507 - RNA, 19 nt, Homo sapiens
gauuggccggcuaguguuu

SEQ ID NO: 1073508 - RNA, 20 nt, Homo sapiens
gauugugccacuucacucca

SEQ ID NO: 1073509 - RNA, 23 nt, Homo sapiens
gcaaaaucuguucuaacauguaa

SEQ ID NO: 1073510 - RNA, 23 nt, Homo sapiens
gcaaaugcuguauucuucuuugg

SEQ ID NO: 1073511 - RNA, 22 nt, Homo sapiens
gcaauguguggcugaagacuuu

SEQ ID NO: 1073512 - RNA, 21 nt, Homo sapiens
gcagugagccgagaucgugcc

SEQ ID NO: 1073513 - RNA, 17 nt, Homo sapiens
gcaugugugaaacauac

SEQ ID NO: 1073514 - RNA, 13 nt, Homo sapiens
gccacugcacucc

SEQ ID NO: 1073515 - RNA, 13 nt, Homo sapiens
gccuagauaugaa

SEQ ID NO: 1073516 - RNA, 16 nt, Homo sapiens
gccuaucagcauuuua

SEQ ID NO: 1073517 - RNA, 16 nt, Homo sapiens
gcugaggcaagagaau

SEQ ID NO: 1073518 - RNA, 15 nt, Homo sapiens
gcuucuccaugagac

SEQ ID NO: 1073519 - RNA, 10 nt, Homo sapiens
gcuugcucuu

SEQ ID NO: 1073520 - RNA, 19 nt, Homo sapiens
gcuuuccguggcacugcau

SEQ ID NO: 1073521 - RNA, 17 nt, Homo sapiens
ggaagucagcaugccuc

SEQ ID NO: 1073522 - RNA, 21 nt, Homo sapiens
ggagcaggagccugagccuug

SEQ ID NO: 1073523 - RNA, 17 nt, Homo sapiens
ggaggaacacugcacuc

SEQ ID NO: 1073524 - RNA, 19 nt, Homo sapiens
ggaggcggagcuugcagug

SEQ ID NO: 1073525 - RNA, 13 nt, Homo sapiens
ggaggcugcagug

SEQ ID NO: 1073526 - RNA, 14 nt, Homo sapiens
ggaggcugcaguga

SEQ ID NO: 1073527 - RNA, 22 nt, Homo sapiens
ggcauuucacaaaacagccuuu

SEQ ID NO: 1073528 - RNA, 11 nt, Homo sapiens
ggcauuugcag

SEQ ID NO: 1073529 - RNA, 22 nt, Homo sapiens
ggccagguaugcauggaaaaug

SEQ ID NO: 1073530 - RNA, 20 nt, Homo sapiens
ggccuccucucucaguuuuu

SEQ ID NO: 1073531 - RNA, 20 nt, Homo sapiens
ggcgacaguuuuccuucuca

SEQ ID NO: 1073532 - RNA, 19 nt, Homo sapiens
ggcugcagugagcugagau

SEQ ID NO: 1073533 - RNA, 20 nt, Homo sapiens
gggaggcggagcuugcagug

SEQ ID NO: 1073534 - RNA, 13 nt, Homo sapiens
gggaggcuucccc

SEQ ID NO: 1073535 - RNA, 11 nt, Homo sapiens
gggcugugauc

SEQ ID NO: 1073536 - RNA, 22 nt, Homo sapiens
ggggaaauaauaaagaugcucu

SEQ ID NO: 1073537 - RNA, 21 nt, Homo sapiens
gguaaaaaggagaauuuuucc

SEQ ID NO: 1073538 - RNA, 22 nt, Homo sapiens
ggucucugauagguagcauuuu

SEQ ID NO: 1073539 - RNA, 17 nt, Homo sapiens
gguggaggcugcaguga

SEQ ID NO: 1073540 - RNA, 16 nt, Homo sapiens
guagcauuuuccagca

SEQ ID NO: 1073541 - RNA, 16 nt, Homo sapiens
guagcucuccugacuu

SEQ ID NO: 1073542 - RNA, 19 nt, Homo sapiens
gucaaaaggaagucucuag

SEQ ID NO: 1073543 - RNA, 19 nt, Homo sapiens
gucagugcccaacuguuau

SEQ ID NO: 1073544 - RNA, 16 nt, Homo sapiens
guccuugaaugccaua

SEQ ID NO: 1073545 - RNA, 14 nt, Homo sapiens
gucgugagugucuc

SEQ ID NO: 1073546 - RNA, 20 nt, Homo sapiens
gucucaaccccucacaggag

SEQ ID NO: 1073547 - RNA, 16 nt, Homo sapiens
gugaaguauacuguau

SEQ ID NO: 1073548 - RNA, 23 nt, Homo sapiens
gugaauuuuucucuaacucagaa

SEQ ID NO: 1073549 - RNA, 21 nt, Homo sapiens
gugguuauuuagggaacugcu

SEQ ID NO: 1073550 - RNA, 19 nt, Homo sapiens
ugaaauuugugauggaauc

SEQ ID NO: 1073551 - RNA, 23 nt, Homo sapiens
ugacaugccuauaugagaagaau

SEQ ID NO: 1073552 - RNA, 13 nt, Homo sapiens
ugaccuccacagc

SEQ ID NO: 1073553 - RNA, 16 nt, Homo sapiens
ugagacuccgucacaa

SEQ ID NO: 1073554 - RNA, 18 nt, Homo sapiens
ugagcccggaugcuucuc

SEQ ID NO: 1073555 - RNA, 16 nt, Homo sapiens
ugauucccuccugcua

SEQ ID NO: 1073556 - RNA, 12 nt, Homo sapiens
ugcaaugugauc

SEQ ID NO: 1073557 - RNA, 23 nt, Homo sapiens
ugcacuccagccugggugacaaa

SEQ ID NO: 1073558 - RNA, 21 nt, Homo sapiens
ugcagauuagcuaggggacag

SEQ ID NO: 1073559 - RNA, 18 nt, Homo sapiens
ugcauccagcaguacaau

SEQ ID NO: 1073560 - RNA, 15 nt, Homo sapiens
ugccacauacuugca

SEQ ID NO: 1073561 - RNA, 16 nt, Homo sapiens
ugcuaucgccaucaca

SEQ ID NO: 1073562 - RNA, 17 nt, Homo sapiens
ugcuuuuuuucagggaa

SEQ ID NO: 1073563 - RNA, 16 nt, Homo sapiens
uggaaaaaugauuuaa

SEQ ID NO: 1073564 - RNA, 22 nt, Homo sapiens
uggauagauaauuuuauuugaa

SEQ ID NO: 1073565 - RNA, 16 nt, Homo sapiens
uggccaacaugaugaa

SEQ ID NO: 1073566 - RNA, 22 nt, Homo sapiens
uggcuuugccuuggcuuugcca

SEQ ID NO: 1073567 - RNA, 19 nt, Homo sapiens
ugggaacaugcgugugacc

SEQ ID NO: 1073568 - RNA, 17 nt, Homo sapiens
ugggaauuaagcaaaau

SEQ ID NO: 1073569 - RNA, 16 nt, Homo sapiens
ugggaucgcauugcau

SEQ ID NO: 1073570 - RNA, 11 nt, Homo sapiens
ugggugacaaa

SEQ ID NO: 1073571 - RNA, 16 nt, Homo sapiens
ugggugacaaagugag

SEQ ID NO: 1073572 - RNA, 13 nt, Homo sapiens
uggugcucauuua

SEQ ID NO: 1073573 - RNA, 14 nt, Homo sapiens
uggugcucauuuaa

SEQ ID NO: 1073574 - RNA, 23 nt, Homo sapiens
uguauuuuauuacaucuuucaca

SEQ ID NO: 1073575 - RNA, 17 nt, Homo sapiens
ugucaucagccugugua

SEQ ID NO: 1073576 - RNA, 17 nt, Homo sapiens
uguccuugaaugccaua

SEQ ID NO: 1073577 - RNA, 22 nt, Homo sapiens
ugucuaauuaaaacacuuucaa

SEQ ID NO: 1073578 - RNA, 14 nt, Homo sapiens
uguguuuuucacau

SEQ ID NO: 1073579 - RNA, 15 nt, Homo sapiens
uguucagggcuguga

SEQ ID NO: 1073580 - RNA, 16 nt, Homo sapiens
uguucagggcugugau

SEQ ID NO: 1073581 - RNA, 13 nt, Homo sapiens
uguuggugacaau

SEQ ID NO: 1073582 - RNA, 14 nt, Homo sapiens
uuaaaagagacaaa

SEQ ID NO: 1073583 - RNA, 11 nt, Homo sapiens
uuaaacuguag

SEQ ID NO: 1073584 - RNA, 13 nt, Homo sapiens
uuaaaguucucaa

SEQ ID NO: 1073585 - RNA, 22 nt, Homo sapiens
uuaaaguucucaaugcaaccau

SEQ ID NO: 1073586 - RNA, 14 nt, Homo sapiens
uuacauacuauucu

SEQ ID NO: 1073587 - RNA, 13 nt, Homo sapiens
uuacaucuuucac

SEQ ID NO: 1073588 - RNA, 18 nt, Homo sapiens
uuaggaagguacugucau

SEQ ID NO: 1073589 - RNA, 19 nt, Homo sapiens
uuaucaugcaaaugcugua

SEQ ID NO: 1073590 - RNA, 20 nt, Homo sapiens
uucacuccagccugggugac

SEQ ID NO: 1073591 - RNA, 16 nt, Homo sapiens
uuccagcacuuugcaa

SEQ ID NO: 1073592 - RNA, 14 nt, Homo sapiens
uucccaaaacugau

SEQ ID NO: 1073593 - RNA, 14 nt, Homo sapiens
uuccccucacuauc

SEQ ID NO: 1073594 - RNA, 14 nt, Homo sapiens
uucccucacaccgc

SEQ ID NO: 1073595 - RNA, 20 nt, Homo sapiens
uuccuaaaagagaauggaaa

SEQ ID NO: 1073596 - RNA, 16 nt, Homo sapiens
uuccuuaucacugaca

SEQ ID NO: 1073597 - RNA, 20 nt, Homo sapiens
uucgagaccagccuggccaa

SEQ ID NO: 1073598 - RNA, 16 nt, Homo sapiens
uucucuaacucagaaa

SEQ ID NO: 1073599 - RNA, 19 nt, Homo sapiens
uucucuggcgacaguuuuc

SEQ ID NO: 1073600 - RNA, 15 nt, Homo sapiens
uucugaaacugcaua

SEQ ID NO: 1073601 - RNA, 15 nt, Homo sapiens
uucuuacuaaucuga

SEQ ID NO: 1073602 - RNA, 13 nt, Homo sapiens
uugaaaaaguaua

SEQ ID NO: 1073603 - RNA, 21 nt, Homo sapiens
uugaagaugcuuguauuuuac

SEQ ID NO: 1073604 - RNA, 20 nt, Homo sapiens
uugccaaacagccacacugu

SEQ ID NO: 1073605 - RNA, 21 nt, Homo sapiens
uugucaaaaggaagucucuag

SEQ ID NO: 1073606 - RNA, 21 nt, Homo sapiens
uuuaaaagagacaaacuguaa

SEQ ID NO: 1073607 - RNA, 22 nt, Homo sapiens
uuuaaaagagacaaacuguaaa

SEQ ID NO: 1073608 - RNA, 21 nt, Homo sapiens
uuuaaacauuuuuaucuauca

SEQ ID NO: 1073609 - RNA, 14 nt, Homo sapiens
uuuaaauaaaugga

SEQ ID NO: 1073610 - RNA, 17 nt, Homo sapiens
uuuacugagacaaugua

SEQ ID NO: 1073611 - RNA, 23 nt, Homo sapiens
uuuauaauaaaaagcuucaggga

SEQ ID NO: 1073612 - RNA, 16 nt, Homo sapiens
uuucaaaaugcuucaa

SEQ ID NO: 1073613 - RNA, 12 nt, Homo sapiens
uuucauucuugu

SEQ ID NO: 1073614 - RNA, 18 nt, Homo sapiens
uuuccacuacugcuacca

SEQ ID NO: 1073615 - RNA, 21 nt, Homo sapiens
uuucccugggagcuguucucu

SEQ ID NO: 1073616 - RNA, 17 nt, Homo sapiens
uuuguucucccaaaaca

SEQ ID NO: 1073617 - RNA, 18 nt, Homo sapiens
caagugaaaaacauccag

SEQ ID NO: 1073618 - RNA, 13 nt, Homo sapiens
caaguguucacaa

SEQ ID NO: 1073619 - RNA, 14 nt, Homo sapiens
caauagcaugcaaa

SEQ ID NO: 1073620 - RNA, 21 nt, Homo sapiens
caauagcaugcaaaaaaugcu

SEQ ID NO: 1073621 - RNA, 15 nt, Homo sapiens
cacaaaacagccuuu

SEQ ID NO: 1073622 - RNA, 16 nt, Homo sapiens
cacaaccacucauuca

SEQ ID NO: 1073623 - RNA, 19 nt, Homo sapiens
cacaauuacauacuauucu

SEQ ID NO: 1073624 - RNA, 16 nt, Homo sapiens
cacagcugaacuuguu

SEQ ID NO: 1073625 - RNA, 16 nt, Homo sapiens
cacauacuugcagcuc

SEQ ID NO: 1073626 - RNA, 14 nt, Homo sapiens
cacauuugauucug

SEQ ID NO: 1073627 - RNA, 21 nt, Homo sapiens
cacccaaguugaagacuuugu

SEQ ID NO: 1073628 - RNA, 13 nt, Homo sapiens
cacugcauacaau

SEQ ID NO: 1073629 - RNA, 17 nt, Homo sapiens
cagaacaagaagcuuau

SEQ ID NO: 1073630 - RNA, 16 nt, Homo sapiens
cagacugacaaaugug

SEQ ID NO: 1073631 - RNA, 20 nt, Homo sapiens
cagcauuuuacuacuuuaaa

SEQ ID NO: 1073632 - RNA, 23 nt, Homo sapiens
caggaaaauuguuugaacccagg

SEQ ID NO: 1073633 - RNA, 20 nt, Homo sapiens
caggaggcagagguugcagu

SEQ ID NO: 1073634 - RNA, 17 nt, Homo sapiens
caggcuuaugaauauau

SEQ ID NO: 1073635 - RNA, 19 nt, Homo sapiens
cagggaacaagcccaaagc

SEQ ID NO: 1073636 - RNA, 14 nt, Homo sapiens
cagggcugugaucg

SEQ ID NO: 1073637 - RNA, 20 nt, Homo sapiens
cagugagccgagaucgugcc

SEQ ID NO: 1073638 - RNA, 19 nt, Homo sapiens
cagugagcugagauugugc

SEQ ID NO: 1073639 - RNA, 16 nt, Homo sapiens
cauaagugaaaaucuu

SEQ ID NO: 1073640 - RNA, 12 nt, Homo sapiens
caucaauagugu

SEQ ID NO: 1073641 - RNA, 23 nt, Homo sapiens
caucaauaguguccuaugcaaua

SEQ ID NO: 1073642 - RNA, 14 nt, Homo sapiens
caucagccugugua

SEQ ID NO: 1073643 - RNA, 12 nt, Homo sapiens
caucuuucacau

SEQ ID NO: 1073644 - RNA, 21 nt, Homo sapiens
caucuuuuuaaccugcaaaau

SEQ ID NO: 1073645 - RNA, 15 nt, Homo sapiens
cauggauaacacauu

SEQ ID NO: 1073646 - RNA, 19 nt, Homo sapiens
cauggcuuuggcuuugcaa

SEQ ID NO: 1073647 - RNA, 22 nt, Homo sapiens
cauggcuuuggcuuugcaaaau

SEQ ID NO: 1073648 - RNA, 15 nt, Homo sapiens
cauguaaacauacca

SEQ ID NO: 1073649 - RNA, 15 nt, Homo sapiens
cauguaauugcagau

SEQ ID NO: 1073650 - RNA, 20 nt, Homo sapiens
cauuaauaccuaaacuguau

SEQ ID NO: 1073651 - RNA, 23 nt, Homo sapiens
cauugagaacugcauauguuucg

SEQ ID NO: 1073652 - RNA, 22 nt, Homo sapiens
cauuuaaauaucugaacauuua

SEQ ID NO: 1073653 - RNA, 20 nt, Homo sapiens
cauuuagcgaacaaccacag

SEQ ID NO: 1073654 - RNA, 18 nt, Homo sapiens
cauuucacaaaacagccu

SEQ ID NO: 1073655 - RNA, 17 nt, Homo sapiens
cauuuccaaauucacaa

SEQ ID NO: 1073656 - RNA, 18 nt, Homo sapiens
ccaaaggauaaguguccc

SEQ ID NO: 1073657 - RNA, 18 nt, Homo sapiens
ccaaguugaagacuuugu

SEQ ID NO: 1073658 - RNA, 21 nt, Homo sapiens
ccacaacuauauuaucaugca

SEQ ID NO: 1073659 - RNA, 20 nt, Homo sapiens
ccagauucuaccacacagca

SEQ ID NO: 1073660 - RNA, 21 nt, Homo sapiens
ccaggcuggacgugguggcuc

SEQ ID NO: 1073661 - RNA, 16 nt, Homo sapiens
ccauuaaaguucucaa

SEQ ID NO: 1073662 - RNA, 22 nt, Homo sapiens
cccaaaacugauacccuuugaa

SEQ ID NO: 1073663 - RNA, 18 nt, Homo sapiens
cccagaagaagauggcug

SEQ ID NO: 1073664 - RNA, 11 nt, Homo sapiens
cccagcauuuu

SEQ ID NO: 1073665 - RNA, 15 nt, Homo sapiens
cccagcuacucggga

SEQ ID NO: 1073666 - RNA, 20 nt, Homo sapiens
cccauucuaugugucaucaa

SEQ ID NO: 1073667 - RNA, 23 nt, Homo sapiens
ccccacguugccucuacuuuauc

SEQ ID NO: 1073668 - RNA, 13 nt, Homo sapiens
ccuaaaaugcuuc

SEQ ID NO: 1073669 - RNA, 16 nt, Homo sapiens
ccuaaacuguaucaua

SEQ ID NO: 1073670 - RNA, 23 nt, Homo sapiens
ccuaaugaaagugaugacauauu

SEQ ID NO: 1073671 - RNA, 18 nt, Homo sapiens
ccuagcggaguuccagca

SEQ ID NO: 1073672 - RNA, 12 nt, Homo sapiens
ccuaugcaauaa

SEQ ID NO: 1073673 - RNA, 21 nt, Homo sapiens
ccucacaggagcuuacuggca

SEQ ID NO: 1073674 - RNA, 20 nt, Homo sapiens
cgagaucgcgccacugcacu

SEQ ID NO: 1073675 - RNA, 21 nt, Homo sapiens
cgagaucgugccauugcacuc

SEQ ID NO: 1073676 - RNA, 16 nt, Homo sapiens
cggagcuugcagugag

SEQ ID NO: 1073677 - RNA, 16 nt, Homo sapiens
cuaaaguaucuguauu

SEQ ID NO: 1073678 - RNA, 18 nt, Homo sapiens
cuauauuaucaugcaaau

SEQ ID NO: 1073679 - RNA, 12 nt, Homo sapiens
cucauucaaaag

SEQ ID NO: 1073680 - RNA, 16 nt, Homo sapiens
cucccaaaacagauua

SEQ ID NO: 1073681 - RNA, 20 nt, Homo sapiens
cucuaacucagaaacaucag

SEQ ID NO: 1073682 - RNA, 16 nt, Homo sapiens
cucuccugacuuuuaa

SEQ ID NO: 1073683 - RNA, 22 nt, Homo sapiens
cucuggcuuugccuuggcuuug

SEQ ID NO: 1073684 - RNA, 16 nt, Homo sapiens
cucuuguccuagcuug

SEQ ID NO: 1073685 - RNA, 17 nt, Homo sapiens
cugaagggcaucaugca

SEQ ID NO: 1073686 - RNA, 16 nt, Homo sapiens
cugacuuuuaauguca

SEQ ID NO: 1073687 - RNA, 15 nt, Homo sapiens
cugccgaauauagaa

SEQ ID NO: 1073688 - RNA, 15 nt, Homo sapiens
aggucaggaguucga

SEQ ID NO: 1073689 - RNA, 12 nt, Homo sapiens
aguaaaccacaa

SEQ ID NO: 1073690 - RNA, 11 nt, Homo sapiens
agucuauggcc

SEQ ID NO: 1073691 - RNA, 16 nt, Homo sapiens
aguguccuaugcaaua

SEQ ID NO: 1073692 - RNA, 16 nt, Homo sapiens
aguuaagcaacaucua

SEQ ID NO: 1073693 - RNA, 13 nt, Homo sapiens
aguuacaaaaacc

SEQ ID NO: 1073694 - RNA, 14 nt, Homo sapiens
aguugauuuuacaa

SEQ ID NO: 1073695 - RNA, 18 nt, Homo sapiens
aguugauuuuacaauuga

SEQ ID NO: 1073696 - RNA, 23 nt, Homo sapiens
aguuuuccuucucaucugugauu

SEQ ID NO: 1073697 - RNA, 15 nt, Homo sapiens
auaaaagaucuugca

SEQ ID NO: 1073698 - RNA, 17 nt, Homo sapiens
auaaaaguaaaccacaa

SEQ ID NO: 1073699 - RNA, 17 nt, Homo sapiens
auaauaaaaagcuucag

SEQ ID NO: 1073700 - RNA, 22 nt, Homo sapiens
auacaauuauuuuuacaguucu

SEQ ID NO: 1073701 - RNA, 16 nt, Homo sapiens
auacauucugcuuuca

SEQ ID NO: 1073702 - RNA, 16 nt, Homo sapiens
auacuguauuuuuacc

SEQ ID NO: 1073703 - RNA, 12 nt, Homo sapiens
auagcaagugaa

SEQ ID NO: 1073704 - RNA, 14 nt, Homo sapiens
auauaauaugcaca

SEQ ID NO: 1073705 - RNA, 17 nt, Homo sapiens
auauauggcauuugcag

SEQ ID NO: 1073706 - RNA, 23 nt, Homo sapiens
auauuguucuuguaagcuuuaac

SEQ ID NO: 1073707 - RNA, 15 nt, Homo sapiens
auauuuaacuaugaa

SEQ ID NO: 1073708 - RNA, 12 nt, Homo sapiens
aucauucaucuu

SEQ ID NO: 1073709 - RNA, 21 nt, Homo sapiens
aucauuucaaaacucauuucc

SEQ ID NO: 1073710 - RNA, 14 nt, Homo sapiens
aucgagacugcaau

SEQ ID NO: 1073711 - RNA, 14 nt, Homo sapiens
aucuuacugaaggu

SEQ ID NO: 1073712 - RNA, 23 nt, Homo sapiens
aucuuguuuuuccacuacugcua

SEQ ID NO: 1073713 - RNA, 13 nt, Homo sapiens
augcacacagugc

SEQ ID NO: 1073714 - RNA, 23 nt, Homo sapiens
augcauccagcaguacaauaaaa

SEQ ID NO: 1073715 - RNA, 18 nt, Homo sapiens
augcaugcgaacauaaau

SEQ ID NO: 1073716 - RNA, 23 nt, Homo sapiens
augucuguauuucauucuuguug

SEQ ID NO: 1073717 - RNA, 14 nt, Homo sapiens
auguuaugcaaaaa

SEQ ID NO: 1073718 - RNA, 15 nt, Homo sapiens
auguuucgcugauau

SEQ ID NO: 1073719 - RNA, 17 nt, Homo sapiens
auuaaauuguuccauuu

SEQ ID NO: 1073720 - RNA, 20 nt, Homo sapiens
auuacaaucgagacugcaau

SEQ ID NO: 1073721 - RNA, 20 nt, Homo sapiens
auuacuagaaauauuuaacu

SEQ ID NO: 1073722 - RNA, 19 nt, Homo sapiens
auuagaaaaauagcaacuu

SEQ ID NO: 1073723 - RNA, 23 nt, Homo sapiens
auucaugaagcggucacagauca

SEQ ID NO: 1073724 - RNA, 16 nt, Homo sapiens
auucccuccugcuacu

SEQ ID NO: 1073725 - RNA, 17 nt, Homo sapiens
auuccuaaaaugcuuca

SEQ ID NO: 1073726 - RNA, 17 nt, Homo sapiens
auucuuaaaaugcaaua

SEQ ID NO: 1073727 - RNA, 15 nt, Homo sapiens
auuuaaagacaaaga

SEQ ID NO: 1073728 - RNA, 21 nt, Homo sapiens
auuuaauuuuuuaaacuguag

SEQ ID NO: 1073729 - RNA, 15 nt, Homo sapiens
auuuacauguuuaua

SEQ ID NO: 1073730 - RNA, 14 nt, Homo sapiens
auuucacagugugu

SEQ ID NO: 1073731 - RNA, 16 nt, Homo sapiens
auuuccaaauucacaa

SEQ ID NO: 1073732 - RNA, 19 nt, Homo sapiens
caaaacagauuacuagaaa

SEQ ID NO: 1073733 - RNA, 20 nt, Homo sapiens
caaaauggacucaagagaga

SEQ ID NO: 1073734 - RNA, 16 nt, Homo sapiens
caaacagccacacugu

SEQ ID NO: 1073735 - RNA, 17 nt, Homo sapiens
caaacagccacacugug

SEQ ID NO: 1073736 - RNA, 17 nt, Homo sapiens
caaagugagacuccguc

SEQ ID NO: 1073737 - RNA, 22 nt, Homo sapiens
caaauucgcugcaaccuguuga

SEQ ID NO: 1073738 - RNA, 17 nt, Homo sapiens
caacaacaacaaaaagc

SEQ ID NO: 1073739 - RNA, 19 nt, Homo sapiens
caaccgaguggcugucauc

SEQ ID NO: 1073740 - RNA, 17 nt, Homo sapiens
caacuauauuaucaugc

SEQ ID NO: 1073741 - RNA, 20 nt, Homo sapiens
caacuauauuaucaugcaaa

SEQ ID NO: 1073742 - RNA, 16 nt, Homo sapiens
caaguguucacaaccu

SEQ ID NO: 1073743 - RNA, 17 nt, Homo sapiens
caaguuguguuugauau

SEQ ID NO: 1073744 - RNA, 15 nt, Homo sapiens
caauagcaugcaaaa

SEQ ID NO: 1073745 - RNA, 19 nt, Homo sapiens
caauaguguccuaugcaau

SEQ ID NO: 1073746 - RNA, 20 nt, Homo sapiens
caauaguguccuaugcaaua

SEQ ID NO: 1073747 - RNA, 22 nt, Homo sapiens
caaugccacauacuugcagcuc

SEQ ID NO: 1073748 - RNA, 23 nt, Homo sapiens
caauuauaucaguccucuuucaa

SEQ ID NO: 1073749 - RNA, 20 nt, Homo sapiens
cacagcugaacuuguugaga

SEQ ID NO: 1073750 - RNA, 13 nt, Homo sapiens
caccaaagccacc

SEQ ID NO: 1073751 - RNA, 17 nt, Homo sapiens
cagaaaaaaaaauggaa

SEQ ID NO: 1073752 - RNA, 15 nt, Homo sapiens
cagaaauuuaauuca

SEQ ID NO: 1073753 - RNA, 18 nt, Homo sapiens
cagaaauuuaauucaugu

SEQ ID NO: 1073754 - RNA, 20 nt, Homo sapiens
cagagguugcagugagccga

SEQ ID NO: 1073755 - RNA, 14 nt, Homo sapiens
cagauaacuuugac

SEQ ID NO: 1073756 - RNA, 14 nt, Homo sapiens
cagauuacuagaaa

SEQ ID NO: 1073757 - RNA, 19 nt, Homo sapiens
cagauuuuaacagcucucu

SEQ ID NO: 1073758 - RNA, 22 nt, Homo sapiens
cagccacacugugggacucuuc

SEQ ID NO: 1073759 - RNA, 12 nt, Homo sapiens
cagggcugugau

SEQ ID NO: 1073760 - RNA, 13 nt, Homo sapiens
cagggcugugauc

SEQ ID NO: 1073761 - RNA, 15 nt, Homo sapiens
caggucuuuaaauca

SEQ ID NO: 1073762 - RNA, 14 nt, Homo sapiens
caguucugucauau

SEQ ID NO: 1073763 - RNA, 21 nt, Homo sapiens
cauaagugaaaaucuuacaac

SEQ ID NO: 1073764 - RNA, 21 nt, Homo sapiens
caucacagcugaacuuguuga

SEQ ID NO: 1073765 - RNA, 16 nt, Homo sapiens
cauccagcaguacaau

SEQ ID NO: 1073766 - RNA, 23 nt, Homo sapiens
caugcgaacauaaaugucuguau

SEQ ID NO: 1073767 - RNA, 23 nt, Homo sapiens
cauggcgaaaccccucucuacua

SEQ ID NO: 1073768 - RNA, 17 nt, Homo sapiens
cauguuuaaaccugaca

SEQ ID NO: 1073769 - RNA, 20 nt, Homo sapiens
cauuaaauauaauaugcaca

SEQ ID NO: 1073770 - RNA, 16 nt, Homo sapiens
cauuucaaaaugcuuc

SEQ ID NO: 1073771 - RNA, 16 nt, Homo sapiens
cauuuccaaauucaca

SEQ ID NO: 1073772 - RNA, 16 nt, Homo sapiens
ccaaauuuguauuuaa

SEQ ID NO: 1073773 - RNA, 19 nt, Homo sapiens
ccaaguuuauauacaauua

SEQ ID NO: 1073774 - RNA, 15 nt, Homo sapiens
ccacacagcagcagu

SEQ ID NO: 1073775 - RNA, 19 nt, Homo sapiens
ccacguugccucuacuuua

SEQ ID NO: 1073776 - RNA, 10 nt, Homo sapiens
ccagcacuuu

SEQ ID NO: 1073777 - RNA, 15 nt, Homo sapiens
ccagcaguacaauaa

SEQ ID NO: 1073778 - RNA, 15 nt, Homo sapiens
ccagcuacucgggag

SEQ ID NO: 1073779 - RNA, 12 nt, Homo sapiens
cccagcuacucg

SEQ ID NO: 1073780 - RNA, 12 nt, Homo sapiens
cccucacaggag

SEQ ID NO: 1073781 - RNA, 13 nt, Homo sapiens
cccuuuuacauac

SEQ ID NO: 1073782 - RNA, 16 nt, Homo sapiens
ccuaaaaugcuucacu

SEQ ID NO: 1073783 - RNA, 12 nt, Homo sapiens
ccuaaacuguau

SEQ ID NO: 1073784 - RNA, 12 nt, Homo sapiens
ccugggugacaa

SEQ ID NO: 1073785 - RNA, 18 nt, Homo sapiens
ccuguaaucccagcacuu

SEQ ID NO: 1073786 - RNA, 18 nt, Homo sapiens
ccuguaaucccagcauuu

SEQ ID NO: 1073787 - RNA, 20 nt, Homo sapiens
ccuguaaucccagcuacucg

SEQ ID NO: 1073788 - RNA, 14 nt, Homo sapiens
ccuugaaugccaua

SEQ ID NO: 1073789 - RNA, 13 nt, Homo sapiens
ccuuuuacauacu

SEQ ID NO: 1073790 - RNA, 16 nt, Homo sapiens
ccuuuugccaaucuca

SEQ ID NO: 1073791 - RNA, 15 nt, Homo sapiens
ccuuuuuguuauuag

SEQ ID NO: 1073792 - RNA, 12 nt, Homo sapiens
cgacaguuuucc

SEQ ID NO: 1073793 - RNA, 19 nt, Homo sapiens
cgagaucgcgccacugcac

SEQ ID NO: 1073794 - RNA, 20 nt, Homo sapiens
cgagaucgugccauugcacu

SEQ ID NO: 1073795 - RNA, 16 nt, Homo sapiens
cgggaagaaggggaca

SEQ ID NO: 1073796 - RNA, 21 nt, Homo sapiens
cuaaauuuucugaaacugcau

SEQ ID NO: 1073797 - RNA, 16 nt, Homo sapiens
cuaacauguaauugca

SEQ ID NO: 1073798 - RNA, 18 nt, Homo sapiens
cuaaugaaagugaugaca

SEQ ID NO: 1073799 - RNA, 19 nt, Homo sapiens
cuacaguuuuuaacucuac

SEQ ID NO: 1073800 - RNA, 23 nt, Homo sapiens
cuaucagcauuuuacuacuuuaa

SEQ ID NO: 1073801 - RNA, 15 nt, Homo sapiens
cuauguggcuguauc

SEQ ID NO: 1073802 - RNA, 15 nt, Homo sapiens
cuauguuucaucuug

SEQ ID NO: 1073803 - RNA, 16 nt, Homo sapiens
cuccaugagacacauc

SEQ ID NO: 1073804 - RNA, 13 nt, Homo sapiens
cuccugacuuuua

SEQ ID NO: 1073805 - RNA, 14 nt, Homo sapiens
cuccugacuuuuaa

SEQ ID NO: 1073806 - RNA, 23 nt, Homo sapiens
cuccuggcuggggccuguugaag

SEQ ID NO: 1073807 - RNA, 22 nt, Homo sapiens
cucugaagaguggguuucacaa

SEQ ID NO: 1073808 - RNA, 18 nt, Homo sapiens
cucuuuaaaaugcaaaau

SEQ ID NO: 1073809 - RNA, 22 nt, Homo sapiens
cugaggcgcugcuuugucaaaa

SEQ ID NO: 1073810 - RNA, 17 nt, Homo sapiens
cugauagguagcauuuu

SEQ ID NO: 1073811 - RNA, 22 nt, Homo sapiens
cugcagauuagcuaggggacag

SEQ ID NO: 1073812 - RNA, 20 nt, Homo sapiens
cugcauugagaacugcauau

SEQ ID NO: 1073813 - RNA, 15 nt, Homo sapiens
cuggggccuguugaa

SEQ ID NO: 1073814 - RNA, 22 nt, Homo sapiens
cugguuguugccaaacagccac

SEQ ID NO: 1073815 - RNA, 21 nt, Homo sapiens
cuguaaucccagcuacucggg

SEQ ID NO: 1073816 - RNA, 19 nt, Homo sapiens
cuguagucccagcuacucg

SEQ ID NO: 1073817 - RNA, 19 nt, Homo sapiens
cuguaucuuguuuuuccac

SEQ ID NO: 1073818 - RNA, 18 nt, Homo sapiens
cugucauauaauuuugaa

SEQ ID NO: 1073819 - RNA, 18 nt, Homo sapiens
cugucaucagccugugua

SEQ ID NO: 1073820 - RNA, 22 nt, Homo sapiens
cuguccuugaaugccauaguca

SEQ ID NO: 1073821 - RNA, 16 nt, Homo sapiens
cugugcacccagaaga

SEQ ID NO: 1073822 - RNA, 17 nt, Homo sapiens
cuguuucugcuugcucu

SEQ ID NO: 1073823 - RNA, 14 nt, Homo sapiens
cuuaaaaugcaaua

SEQ ID NO: 1073824 - RNA, 20 nt, Homo sapiens
cuuaagcuuccgccgucuca

SEQ ID NO: 1073825 - RNA, 15 nt, Homo sapiens
cuuacuggcaaacau

SEQ ID NO: 1073826 - RNA, 19 nt, Homo sapiens
cuuauagaggaacuugaaa

SEQ ID NO: 1073827 - RNA, 16 nt, Homo sapiens
cuucccucacaccgcg

SEQ ID NO: 1073828 - RNA, 23 nt, Homo sapiens
cuucugaggcgcugcuuugucaa

SEQ ID NO: 1073829 - RNA, 15 nt, Homo sapiens
cuugaagggcccaga

SEQ ID NO: 1073830 - RNA, 13 nt, Homo sapiens
cuugaaugccaua

SEQ ID NO: 1073831 - RNA, 16 nt, Homo sapiens
cuuguuccaaugccac

SEQ ID NO: 1073832 - RNA, 18 nt, Homo sapiens
cuuugaucuguuugucaa

SEQ ID NO: 1073833 - RNA, 17 nt, Homo sapiens
cuuuggcuuugcaaaau

SEQ ID NO: 1073834 - RNA, 12 nt, Homo sapiens
aaaaaaauggaa

SEQ ID NO: 1073835 - RNA, 20 nt, Homo sapiens
aaaaaggaaagaacugucau

SEQ ID NO: 1073836 - RNA, 13 nt, Homo sapiens
aaaaccuucccca

SEQ ID NO: 1073837 - RNA, 13 nt, Homo sapiens
aaaacucauuucc

SEQ ID NO: 1073838 - RNA, 18 nt, Homo sapiens
aaaagagacaaacuguaa

SEQ ID NO: 1073839 - RNA, 14 nt, Homo sapiens
aaaagcuucaggga

SEQ ID NO: 1073840 - RNA, 15 nt, Homo sapiens
aaaaguaaaccacaa

SEQ ID NO: 1073841 - RNA, 14 nt, Homo sapiens
aaaaugagcaaaag

SEQ ID NO: 1073842 - RNA, 22 nt, Homo sapiens
aaaauuuugggguaaaaaggag

SEQ ID NO: 1073843 - RNA, 22 nt, Homo sapiens
aaacagaaaaaaaaauggaagc

SEQ ID NO: 1073844 - RNA, 21 nt, Homo sapiens
aaacagauuacuagaaauauu

SEQ ID NO: 1073845 - RNA, 21 nt, Homo sapiens
aaacauaccaacauguuuaaa

SEQ ID NO: 1073846 - RNA, 22 nt, Homo sapiens
aaacaucaguuacucugaaggg

SEQ ID NO: 1073847 - RNA, 13 nt, Homo sapiens
aaaccccaucucu

SEQ ID NO: 1073848 - RNA, 13 nt, Homo sapiens
aaaccuuccccag

SEQ ID NO: 1073849 - RNA, 21 nt, Homo sapiens
aaacugucgguuugcuuugau

SEQ ID NO: 1073850 - RNA, 22 nt, Homo sapiens
aaacuuuauauuguucuuguaa

SEQ ID NO: 1073851 - RNA, 21 nt, Homo sapiens
aaagacaagcucaaguguuca

SEQ ID NO: 1073852 - RNA, 19 nt, Homo sapiens
aaagacauuuguucuccca

SEQ ID NO: 1073853 - RNA, 22 nt, Homo sapiens
aaagacauuuguucucccaaaa

SEQ ID NO: 1073854 - RNA, 22 nt, Homo sapiens
aaagagaauggaaaaaugauuu

SEQ ID NO: 1073855 - RNA, 20 nt, Homo sapiens
aaagauuucuugaguuuugu

SEQ ID NO: 1073856 - RNA, 12 nt, Homo sapiens
aaagccaaaaac

SEQ ID NO: 1073857 - RNA, 17 nt, Homo sapiens
aaagcuaaaguaucugu

SEQ ID NO: 1073858 - RNA, 14 nt, Homo sapiens
aaaguaaaccacaa

SEQ ID NO: 1073859 - RNA, 23 nt, Homo sapiens
aaagucagugcccaacuguuaua

SEQ ID NO: 1073860 - RNA, 13 nt, Homo sapiens
aaagugaugacau

SEQ ID NO: 1073861 - RNA, 15 nt, Homo sapiens
aaauauaauaugcac

SEQ ID NO: 1073862 - RNA, 13 nt, Homo sapiens
aaauuuuacacac

SEQ ID NO: 1073863 - RNA, 14 nt, Homo sapiens
aacagauacauuca

SEQ ID NO: 1073864 - RNA, 22 nt, Homo sapiens
aacauuguuuuuguugucuuua

SEQ ID NO: 1073865 - RNA, 12 nt, Homo sapiens
gugguuugaaaa

SEQ ID NO: 1073866 - RNA, 21 nt, Homo sapiens
guguauucuuaaaaugcaaua

SEQ ID NO: 1073867 - RNA, 15 nt, Homo sapiens
guguccuaugcaaua

SEQ ID NO: 1073868 - RNA, 21 nt, Homo sapiens
guguuauuguauuagguguca

SEQ ID NO: 1073869 - RNA, 22 nt, Homo sapiens
guguuugugauuguuugcucug

SEQ ID NO: 1073870 - RNA, 14 nt, Homo sapiens
guuacagcacaaaa

SEQ ID NO: 1073871 - RNA, 16 nt, Homo sapiens
guucagggcugugauc

SEQ ID NO: 1073872 - RNA, 13 nt, Homo sapiens
guuggugacaauu

SEQ ID NO: 1073873 - RNA, 17 nt, Homo sapiens
uaaaaagcuucagggaa

SEQ ID NO: 1073874 - RNA, 12 nt, Homo sapiens
uaaaaugcaaua

SEQ ID NO: 1073875 - RNA, 16 nt, Homo sapiens
uaaaaugcuucacugu

SEQ ID NO: 1073876 - RNA, 15 nt, Homo sapiens
uaaaccugacaaugg

SEQ ID NO: 1073877 - RNA, 22 nt, Homo sapiens
uaaacguccauuaagcugagag

SEQ ID NO: 1073878 - RNA, 15 nt, Homo sapiens
uaaauaaauggaaua

SEQ ID NO: 1073879 - RNA, 16 nt, Homo sapiens
uaacuuugacuuucuu

SEQ ID NO: 1073880 - RNA, 21 nt, Homo sapiens
uaaggcuuguuccaaugccac

SEQ ID NO: 1073881 - RNA, 21 nt, Homo sapiens
uaagguauauaaauuuuccca

SEQ ID NO: 1073882 - RNA, 24 nt, Homo sapiens
uaagugaaaaucuuacaacaggcu

SEQ ID NO: 1073883 - RNA, 20 nt, Homo sapiens
uaaucccagcuacuugggag

SEQ ID NO: 1073884 - RNA, 14 nt, Homo sapiens
uacaucuuucacau

SEQ ID NO: 1073885 - RNA, 21 nt, Homo sapiens
uacauguuuauauuaaucucu

SEQ ID NO: 1073886 - RNA, 13 nt, Homo sapiens
uacauuuccaaau

SEQ ID NO: 1073887 - RNA, 19 nt, Homo sapiens
uacauuuccaaauucacaa

SEQ ID NO: 1073888 - RNA, 16 nt, Homo sapiens
uaccuaaugaaaguga

SEQ ID NO: 1073889 - RNA, 22 nt, Homo sapiens
uacucugaagggcaucaugcau

SEQ ID NO: 1073890 - RNA, 20 nt, Homo sapiens
uagaauaaucuugcucacag

SEQ ID NO: 1073891 - RNA, 16 nt, Homo sapiens
uagauaaacucagaaa

SEQ ID NO: 1073892 - RNA, 16 nt, Homo sapiens
uaggaacgguaaauuu

SEQ ID NO: 1073893 - RNA, 16 nt, Homo sapiens
uaguguccuaugcaau

SEQ ID NO: 1073894 - RNA, 23 nt, Homo sapiens
uauaaauuuucccaaaacugaua

SEQ ID NO: 1073895 - RNA, 19 nt, Homo sapiens
uauaucaguccucuuucaa

SEQ ID NO: 1073896 - RNA, 17 nt, Homo sapiens
uaucuuguuuuuccacu

SEQ ID NO: 1073897 - RNA, 14 nt, Homo sapiens
uauggcauuugcag

SEQ ID NO: 1073898 - RNA, 21 nt, Homo sapiens
uauucacaaccacucauucaa

SEQ ID NO: 1073899 - RNA, 17 nt, Homo sapiens
uauucuuaaaaugcaau

SEQ ID NO: 1073900 - RNA, 16 nt, Homo sapiens
ucacuguuucucugcu

SEQ ID NO: 1073901 - RNA, 17 nt, Homo sapiens
ucacuugaggucaggag

SEQ ID NO: 1073902 - RNA, 18 nt, Homo sapiens
ucagggaagcugccaaag

SEQ ID NO: 1073903 - RNA, 23 nt, Homo sapiens
ucagggugggguggucucugaua

SEQ ID NO: 1073904 - RNA, 14 nt, Homo sapiens
ucaguccucuuuca

SEQ ID NO: 1073905 - RNA, 21 nt, Homo sapiens
ucauuuccuauguaacugcau

SEQ ID NO: 1073906 - RNA, 14 nt, Homo sapiens
uccacuacugcuac

SEQ ID NO: 1073907 - RNA, 16 nt, Homo sapiens
ucccagcuacucggga

SEQ ID NO: 1073908 - RNA, 15 nt, Homo sapiens
ucccagcuacuuggg

SEQ ID NO: 1073909 - RNA, 16 nt, Homo sapiens
ucccauucuauguguc

SEQ ID NO: 1073910 - RNA, 19 nt, Homo sapiens
ucccuucucuuaauuuaau

SEQ ID NO: 1073911 - RNA, 20 nt, Homo sapiens
ucccuuuuacauacugcugu

SEQ ID NO: 1073912 - RNA, 20 nt, Homo sapiens
uccgcugucggcacauucag

SEQ ID NO: 1073913 - RNA, 20 nt, Homo sapiens
uccuacuuauugccaugugg

SEQ ID NO: 1073914 - RNA, 19 nt, Homo sapiens
uccugacuuuuaaugucau

SEQ ID NO: 1073915 - RNA, 17 nt, Homo sapiens
uccuguacuuuuuccag

SEQ ID NO: 1073916 - RNA, 15 nt, Homo sapiens
uccuuaucacugaca

SEQ ID NO: 1073917 - RNA, 14 nt, Homo sapiens
uccuuccuuaucac

SEQ ID NO: 1073918 - RNA, 19 nt, Homo sapiens
ucuacuaaaaauacaaaaa

SEQ ID NO: 1073919 - RNA, 16 nt, Homo sapiens
ucucuaacucagaaac

SEQ ID NO: 1073920 - RNA, 19 nt, Homo sapiens
ucugcuugcucuuguccua

SEQ ID NO: 1073921 - RNA, 14 nt, Homo sapiens
ucuuuguauugaca

SEQ ID NO: 1073922 - RNA, 17 nt, Homo sapiens
ugaaaggcauucucuga

SEQ ID NO: 1073923 - RNA, 20 nt, Homo sapiens
ugacaaugguguuauuugaa

SEQ ID NO: 1073924 - RNA, 23 nt, Homo sapiens
ugaguagcucuccugacuuuuaa

SEQ ID NO: 1073925 - RNA, 17 nt, Homo sapiens
ugaguggaugauguuuc

SEQ ID NO: 1073926 - RNA, 15 nt, Homo sapiens
ugccaaacagccaca

SEQ ID NO: 1073927 - RNA, 17 nt, Homo sapiens
ugccauagucaaagaga

SEQ ID NO: 1073928 - RNA, 19 nt, Homo sapiens
ugcuacaguuuuuccuaaa

SEQ ID NO: 1073929 - RNA, 22 nt, Homo sapiens
ugcuucgggaagaaggggacaa

SEQ ID NO: 1073930 - RNA, 13 nt, Homo sapiens
ugcuucuccauga

SEQ ID NO: 1073931 - RNA, 18 nt, Homo sapiens
uggaaagacaagcucaag

SEQ ID NO: 1073932 - RNA, 15 nt, Homo sapiens
uggaaguccagaaca

SEQ ID NO: 1073933 - RNA, 16 nt, Homo sapiens
uggaaucagauuuuaa

SEQ ID NO: 1073934 - RNA, 19 nt, Homo sapiens
uggaggcugcagugagcug

SEQ ID NO: 1073935 - RNA, 15 nt, Homo sapiens
uggcagugguuugaa

SEQ ID NO: 1073936 - RNA, 18 nt, Homo sapiens
uggcgggugccuguaauc

SEQ ID NO: 1073937 - RNA, 16 nt, Homo sapiens
ugggaggccaaggugg

SEQ ID NO: 1073938 - RNA, 19 nt, Homo sapiens
uggggaugguccacuguca

SEQ ID NO: 1073939 - RNA, 14 nt, Homo sapiens
uggucacauacaau

SEQ ID NO: 1073940 - RNA, 22 nt, Homo sapiens
uggucucugauagguagcauuu

SEQ ID NO: 1073941 - RNA, 19 nt, Homo sapiens
ugguggcccacgccuguaa

SEQ ID NO: 1073942 - RNA, 20 nt, Homo sapiens
uguaaucccagcauuuuggg

SEQ ID NO: 1073943 - RNA, 17 nt, Homo sapiens
uguagauaaacucagaa

SEQ ID NO: 1073944 - RNA, 19 nt, Homo sapiens
uguagauaaacucagaaau

SEQ ID NO: 1073945 - RNA, 20 nt, Homo sapiens
uguccugaugcuuuugucua

SEQ ID NO: 1073946 - RNA, 14 nt, Homo sapiens
uguuaugcaaaaaa

SEQ ID NO: 1073947 - RNA, 17 nt, Homo sapiens
uguuccaggauguggaa

SEQ ID NO: 1073948 - RNA, 12 nt, Homo sapiens
uguuugugauug

SEQ ID NO: 1073949 - RNA, 20 nt, Homo sapiens
uuaaaagagacaaacuguaa

SEQ ID NO: 1073950 - RNA, 14 nt, Homo sapiens
uuaaauaucugaac

SEQ ID NO: 1073951 - RNA, 16 nt, Homo sapiens
uuaaucucuaguaaaa

SEQ ID NO: 1073952 - RNA, 19 nt, Homo sapiens
uuacaaucgagacugcaau

SEQ ID NO: 1073953 - RNA, 23 nt, Homo sapiens
uuacaaucgagacugcaauguga

SEQ ID NO: 1073954 - RNA, 13 nt, Homo sapiens
uuacugagacaau

SEQ ID NO: 1073955 - RNA, 21 nt, Homo sapiens
uuaucaugcaaaugcuguauu

SEQ ID NO: 1073956 - RNA, 16 nt, Homo sapiens
uuaugcauaaagucag

SEQ ID NO: 1073957 - RNA, 18 nt, Homo sapiens
uucacaaaacagccuuug

SEQ ID NO: 1073958 - RNA, 12 nt, Homo sapiens
uucacagugugu

SEQ ID NO: 1073959 - RNA, 21 nt, Homo sapiens
uuccauuuuaaaaugcaucau

SEQ ID NO: 1073960 - RNA, 19 nt, Homo sapiens
uucccuuugauacagucaa

SEQ ID NO: 1073961 - RNA, 17 nt, Homo sapiens
uuccguggcacugcaua

SEQ ID NO: 1073962 - RNA, 21 nt, Homo sapiens
uuccuaaaagagaauggaaaa

SEQ ID NO: 1073963 - RNA, 16 nt, Homo sapiens
uuccuauguaacugca

SEQ ID NO: 1073964 - RNA, 16 nt, Homo sapiens
uucuaugugucaucaa

SEQ ID NO: 1073965 - RNA, 22 nt, Homo sapiens
uugaaaaacuaaaacagaaaaa

SEQ ID NO: 1073966 - RNA, 17 nt, Homo sapiens
uugaaauuaaccauaga

SEQ ID NO: 1073967 - RNA, 19 nt, Homo sapiens
uugacagcugucauauaau

SEQ ID NO: 1073968 - RNA, 21 nt, Homo sapiens
uugauuucccugggagcuguu

SEQ ID NO: 1073969 - RNA, 16 nt, Homo sapiens
uugcaaauacauggau

SEQ ID NO: 1073970 - RNA, 22 nt, Homo sapiens
uugccaaacagccacacugugg

SEQ ID NO: 1073971 - RNA, 22 nt, Homo sapiens
uugcuccuggcuggggccuguu

SEQ ID NO: 1073972 - RNA, 20 nt, Homo sapiens
uugcuuccccuuuugccaau

SEQ ID NO: 1073973 - RNA, 21 nt, Homo sapiens
uugcuuuugaaggaauacaau

SEQ ID NO: 1073974 - RNA, 21 nt, Homo sapiens
uugucaauagcaugcaaaaaa

SEQ ID NO: 1073975 - RNA, 16 nt, Homo sapiens
uuguucucccaaaaca

SEQ ID NO: 1073976 - RNA, 21 nt, Homo sapiens
uuguuuuaaaauuaaagcuaa

SEQ ID NO: 1073977 - RNA, 23 nt, Homo sapiens
uuuaaaaaaaaaaaaaaagccaa

SEQ ID NO: 1073978 - RNA, 14 nt, Homo sapiens
uuuaacagcucucu

SEQ ID NO: 1073979 - RNA, 21 nt, Homo sapiens
uuuacauacugcugucuaugu

SEQ ID NO: 1073980 - RNA, 16 nt, Homo sapiens
uuuauaucuggaauga

SEQ ID NO: 1073981 - RNA, 12 nt, Homo sapiens
uuucacuacucu

SEQ ID NO: 1073982 - RNA, 21 nt, Homo sapiens
uuucacuacucucuacucugu

SEQ ID NO: 1073983 - RNA, 14 nt, Homo sapiens
uuucauucuuguug

SEQ ID NO: 1073984 - RNA, 15 nt, Homo sapiens
uuuccaaauucacaa

SEQ ID NO: 1073985 - RNA, 16 nt, Homo sapiens
uuucuuuguaucauuc

SEQ ID NO: 1073986 - RNA, 19 nt, Homo sapiens
uuuuaggaaaggaugauca

SEQ ID NO: 1073987 - RNA, 13 nt, Homo sapiens
uuuuccuucucau

SEQ ID NO: 1073988 - RNA, 14 nt, Homo sapiens
uuuuuccuaaaaga

SEQ ID NO: 1073989 - RNA, 16 nt, Homo sapiens
aaaaauugucugcauu

SEQ ID NO: 1073990 - RNA, 12 nt, Homo sapiens
aaaacauaugca

SEQ ID NO: 1073991 - RNA, 16 nt, Homo sapiens
aaaagacuaagccaga

SEQ ID NO: 1073992 - RNA, 23 nt, Homo sapiens
aaaagacuugagccauccaaaga

SEQ ID NO: 1073993 - RNA, 14 nt, Homo sapiens
aaaaguuaaacuac

SEQ ID NO: 1073994 - RNA, 12 nt, Homo sapiens
aaacaaaaccac

SEQ ID NO: 1073995 - RNA, 22 nt, Homo sapiens
aaacaaaccauuuuuuuucucu

SEQ ID NO: 1073996 - RNA, 16 nt, Homo sapiens
aaacaggucgagcugu

SEQ ID NO: 1073997 - RNA, 14 nt, Homo sapiens
aaacauaugcauua

SEQ ID NO: 1073998 - RNA, 13 nt, Homo sapiens
aaaccacuguaua

SEQ ID NO: 1073999 - RNA, 13 nt, Homo sapiens
aaaccccaucucu

SEQ ID NO: 1074000 - RNA, 18 nt, Homo sapiens
aaacucuuuaacuuguaa

SEQ ID NO: 1074001 - RNA, 18 nt, Homo sapiens
aaacuuaugcuaguuuau

SEQ ID NO: 1074002 - RNA, 16 nt, Homo sapiens
aaagauaucagagcuc

SEQ ID NO: 1074003 - RNA, 18 nt, Homo sapiens
augcuacccacagcguca

SEQ ID NO: 1074004 - RNA, 22 nt, Homo sapiens
augcugaggccacccacugacc

SEQ ID NO: 1074005 - RNA, 18 nt, Homo sapiens
auggaaguggcagugaaa

SEQ ID NO: 1074006 - RNA, 18 nt, Homo sapiens
auggccagugugauccca

SEQ ID NO: 1074007 - RNA, 18 nt, Homo sapiens
augggaucccaggccagg

SEQ ID NO: 1074008 - RNA, 22 nt, Homo sapiens
auguaaaggucacuuuucacau

SEQ ID NO: 1074009 - RNA, 22 nt, Homo sapiens
auguauaucuauaucucuaaac

SEQ ID NO: 1074010 - RNA, 14 nt, Homo sapiens
augucaauugucag

SEQ ID NO: 1074011 - RNA, 22 nt, Homo sapiens
auguccgcccaccuagugcuuc

SEQ ID NO: 1074012 - RNA, 22 nt, Homo sapiens
auguuuguaaauuaauacuuca

SEQ ID NO: 1074013 - RNA, 23 nt, Homo sapiens
auuaguacuggauuauucaggcu

SEQ ID NO: 1074014 - RNA, 21 nt, Homo sapiens
auuauuucaaccgcuugccau

SEQ ID NO: 1074015 - RNA, 18 nt, Homo sapiens
auucaucugggaggcaga

SEQ ID NO: 1074016 - RNA, 13 nt, Homo sapiens
auuccacuggacu

SEQ ID NO: 1074017 - RNA, 15 nt, Homo sapiens
auuccuguagcaucu

SEQ ID NO: 1074018 - RNA, 17 nt, Homo sapiens
auuccuguugcucuguu

SEQ ID NO: 1074019 - RNA, 14 nt, Homo sapiens
auucuacacauaua

SEQ ID NO: 1074020 - RNA, 21 nt, Homo sapiens
auucuacacauauauguauau

SEQ ID NO: 1074021 - RNA, 15 nt, Homo sapiens
auucucaaccuacca

SEQ ID NO: 1074022 - RNA, 18 nt, Homo sapiens
auugaacuuucacauagc

SEQ ID NO: 1074023 - RNA, 21 nt, Homo sapiens
auugaauagggcuaggaauau

SEQ ID NO: 1074024 - RNA, 17 nt, Homo sapiens
auugaguccagcuuucc

SEQ ID NO: 1074025 - RNA, 20 nt, Homo sapiens
auugcccauuguuuuucuga

SEQ ID NO: 1074026 - RNA, 17 nt, Homo sapiens
auugcuuaaaagacauu

SEQ ID NO: 1074027 - RNA, 21 nt, Homo sapiens
auuggaaguguucaagaaaua

SEQ ID NO: 1074028 - RNA, 22 nt, Homo sapiens
auugggcuggcucugaagccaa

SEQ ID NO: 1074029 - RNA, 23 nt, Homo sapiens
auugucauuagugagacauauuu

SEQ ID NO: 1074030 - RNA, 16 nt, Homo sapiens
auugucgucuuuaugu

SEQ ID NO: 1074031 - RNA, 13 nt, Homo sapiens
auuuaaacuucuu

SEQ ID NO: 1074032 - RNA, 15 nt, Homo sapiens
auuuaccuguauuua

SEQ ID NO: 1074033 - RNA, 14 nt, Homo sapiens
auuuguucagagag

SEQ ID NO: 1074034 - RNA, 18 nt, Homo sapiens
auuuucucugauacuuuu

SEQ ID NO: 1074035 - RNA, 15 nt, Homo sapiens
auuuucugaccaaaa

SEQ ID NO: 1074036 - RNA, 20 nt, Homo sapiens
auuuuuuguuauguuugcac

SEQ ID NO: 1074037 - RNA, 17 nt, Homo sapiens
caaaaaauuagccagau

SEQ ID NO: 1074038 - RNA, 14 nt, Homo sapiens
caaaauguguuuca

SEQ ID NO: 1074039 - RNA, 18 nt, Homo sapiens
caaacuacagaauaaugu

SEQ ID NO: 1074040 - RNA, 20 nt, Homo sapiens
caaacugccuauauugauaa

SEQ ID NO: 1074041 - RNA, 22 nt, Homo sapiens
caaacugccuauauugauaaaa

SEQ ID NO: 1074042 - RNA, 12 nt, Homo sapiens
caaagacaugga

SEQ ID NO: 1074043 - RNA, 13 nt, Homo sapiens
caaagcaaagcca

SEQ ID NO: 1074044 - RNA, 17 nt, Homo sapiens
caaagcauuucuagucc

SEQ ID NO: 1074045 - RNA, 20 nt, Homo sapiens
caaagcgagaucccaucucu

SEQ ID NO: 1074046 - RNA, 15 nt, Homo sapiens
caacaagaauauugu

SEQ ID NO: 1074047 - RNA, 16 nt, Homo sapiens
caaccgcuugccauau

SEQ ID NO: 1074048 - RNA, 16 nt, Homo sapiens
caacucacaccuccuu

SEQ ID NO: 1074049 - RNA, 18 nt, Homo sapiens
caacucauugcaucauuu

SEQ ID NO: 1074050 - RNA, 23 nt, Homo sapiens
caacugugcuacacuugcaccug

SEQ ID NO: 1074051 - RNA, 19 nt, Homo sapiens
caagaaauaaaaaucaacu

SEQ ID NO: 1074052 - RNA, 19 nt, Homo sapiens
caagaagaccagacugugg

SEQ ID NO: 1074053 - RNA, 14 nt, Homo sapiens
caagcuagaaggcc

SEQ ID NO: 1074054 - RNA, 19 nt, Homo sapiens
caauucuccuguugcaaug

SEQ ID NO: 1074055 - RNA, 12 nt, Homo sapiens
cacaccaucucc

SEQ ID NO: 1074056 - RNA, 23 nt, Homo sapiens
cacaggguuuuguauucuuuacu

SEQ ID NO: 1074057 - RNA, 23 nt, Homo sapiens
caccagaggcugcagaaggccaa

SEQ ID NO: 1074058 - RNA, 18 nt, Homo sapiens
cacccaugaaucaaagac

SEQ ID NO: 1074059 - RNA, 20 nt, Homo sapiens
caccccagcgccugugcuga

SEQ ID NO: 1074060 - RNA, 23 nt, Homo sapiens
cacccuggaaucaagaugucaga

SEQ ID NO: 1074061 - RNA, 12 nt, Homo sapiens
caccgagaccaa

SEQ ID NO: 1074062 - RNA, 21 nt, Homo sapiens
caccuagugcuuccacuucua

SEQ ID NO: 1074063 - RNA, 22 nt, Homo sapiens
caccuccauuucucuccaggaa

SEQ ID NO: 1074064 - RNA, 14 nt, Homo sapiens
caccuccuuggcac

SEQ ID NO: 1074065 - RNA, 21 nt, Homo sapiens
caccuccuuuucuucuagcuu

SEQ ID NO: 1074066 - RNA, 23 nt, Homo sapiens
caccuuagacggaggugccugag

SEQ ID NO: 1074067 - RNA, 18 nt, Homo sapiens
cacgugauggaccaaagc

SEQ ID NO: 1074068 - RNA, 21 nt, Homo sapiens
cacgugauggaccaaagccac

SEQ ID NO: 1074069 - RNA, 15 nt, Homo sapiens
cacgugccugugauc

SEQ ID NO: 1074070 - RNA, 17 nt, Homo sapiens
cacucacucugggugcc

SEQ ID NO: 1074071 - RNA, 23 nt, Homo sapiens
cacucuuauucccaaacuacaga

SEQ ID NO: 1074072 - RNA, 16 nt, Homo sapiens
cacuucacuaccaaau

SEQ ID NO: 1074073 - RNA, 18 nt, Homo sapiens
cacuucuaugcaaaugcc

SEQ ID NO: 1074074 - RNA, 16 nt, Homo sapiens
cagaaaacauaugcau

SEQ ID NO: 1074075 - RNA, 22 nt, Homo sapiens
cagaaaacauaugcauuaugaa

SEQ ID NO: 1074076 - RNA, 19 nt, Homo sapiens
cagaaucaugcuguucucu

SEQ ID NO: 1074077 - RNA, 14 nt, Homo sapiens
cagaaucuguauga

SEQ ID NO: 1074078 - RNA, 18 nt, Homo sapiens
cagaccauugucuuccaa

SEQ ID NO: 1074079 - RNA, 19 nt, Homo sapiens
cagagaggggcagguugac

SEQ ID NO: 1074080 - RNA, 12 nt, Homo sapiens
cagagccaguga

SEQ ID NO: 1074081 - RNA, 20 nt, Homo sapiens
cagagccccuuaaagcugcu

SEQ ID NO: 1074082 - RNA, 14 nt, Homo sapiens
cagagccugaguca

SEQ ID NO: 1074083 - RNA, 20 nt, Homo sapiens
cagagcgagagucugucuca

SEQ ID NO: 1074084 - RNA, 16 nt, Homo sapiens
cagaucugaacacagu

SEQ ID NO: 1074085 - RNA, 16 nt, Homo sapiens
cagcagcacaccucag

SEQ ID NO: 1074086 - RNA, 17 nt, Homo sapiens
cagcaggaacugagcca

SEQ ID NO: 1074087 - RNA, 21 nt, Homo sapiens
cagcaucuuuuccauccugag

SEQ ID NO: 1074088 - RNA, 19 nt, Homo sapiens
cagcauuauucuucagaag

SEQ ID NO: 1074089 - RNA, 18 nt, Homo sapiens
cagccagguuagccuuug

SEQ ID NO: 1074090 - RNA, 18 nt, Homo sapiens
cagccauuaccauggaga

SEQ ID NO: 1074091 - RNA, 19 nt, Homo sapiens
cagccugggcaacauagua

SEQ ID NO: 1074092 - RNA, 22 nt, Homo sapiens
cagcuacuugggaggcugagcc

SEQ ID NO: 1074093 - RNA, 20 nt, Homo sapiens
cagcuauuuucugaccaaaa

SEQ ID NO: 1074094 - RNA, 13 nt, Homo sapiens
cagcugcaccugc

SEQ ID NO: 1074095 - RNA, 17 nt, Homo sapiens
caggaaaacaaaucacu

SEQ ID NO: 1074096 - RNA, 12 nt, Homo sapiens
caggaaccaaaa

SEQ ID NO: 1074097 - RNA, 14 nt, Homo sapiens
caggaacugagcca

SEQ ID NO: 1074098 - RNA, 19 nt, Homo sapiens
caggaucagcuccaucuca

SEQ ID NO: 1074099 - RNA, 19 nt, Homo sapiens
caggauuuccucuugaacc

SEQ ID NO: 1074100 - RNA, 12 nt, Homo sapiens
caggcaggccac

SEQ ID NO: 1074101 - RNA, 18 nt, Homo sapiens
caggcuccaugcaccucc

SEQ ID NO: 1074102 - RNA, 16 nt, Homo sapiens
caggcuggagugcagu

SEQ ID NO: 1074103 - RNA, 17 nt, Homo sapiens
caggcuucggacagugc

SEQ ID NO: 1074104 - RNA, 23 nt, Homo sapiens
cagggagcaguugcccucaggcc

SEQ ID NO: 1074105 - RNA, 17 nt, Homo sapiens
cagggcacugugccuga

SEQ ID NO: 1074106 - RNA, 22 nt, Homo sapiens
cagggggagcucccaagcugcc

SEQ ID NO: 1074107 - RNA, 21 nt, Homo sapiens
caggugcgccccuggugguca

SEQ ID NO: 1074108 - RNA, 13 nt, Homo sapiens
cagguuagccuuu

SEQ ID NO: 1074109 - RNA, 15 nt, Homo sapiens
cagguuagccuuugc

SEQ ID NO: 1074110 - RNA, 19 nt, Homo sapiens
caguaaauauuaaccugaa

SEQ ID NO: 1074111 - RNA, 20 nt, Homo sapiens
caguaggcaguagacuauaa

SEQ ID NO: 1074112 - RNA, 13 nt, Homo sapiens
aaaacaugacuuu

SEQ ID NO: 1074113 - RNA, 10 nt, Homo sapiens
aaaacaugca

SEQ ID NO: 1074114 - RNA, 14 nt, Homo sapiens
aaaaccccaucucu

SEQ ID NO: 1074115 - RNA, 18 nt, Homo sapiens
aaaaccccaucucuacua

SEQ ID NO: 1074116 - RNA, 21 nt, Homo sapiens
aaaagcuuuucuuuccuuuug

SEQ ID NO: 1074117 - RNA, 15 nt, Homo sapiens
ggagagcccagccau

SEQ ID NO: 1074118 - RNA, 14 nt, Homo sapiens
ggagcaaauguuuc

SEQ ID NO: 1074119 - RNA, 21 nt, Homo sapiens
ggagcaguugcccucaggccu

SEQ ID NO: 1074120 - RNA, 14 nt, Homo sapiens
ggagcuugcaguga

SEQ ID NO: 1074121 - RNA, 19 nt, Homo sapiens
ggaggaucgccugagccca

SEQ ID NO: 1074122 - RNA, 14 nt, Homo sapiens
ggaggcugagccag

SEQ ID NO: 1074123 - RNA, 20 nt, Homo sapiens
ggagguugcagugagccaaa

SEQ ID NO: 1074124 - RNA, 18 nt, Homo sapiens
ggaucccaggccagggaa

SEQ ID NO: 1074125 - RNA, 21 nt, Homo sapiens
ggauucagauuucucuuugaa

SEQ ID NO: 1074126 - RNA, 19 nt, Homo sapiens
ggauuggcuauaacauguc

SEQ ID NO: 1074127 - RNA, 23 nt, Homo sapiens
ggauuuuuuguuauguuugcacu

SEQ ID NO: 1074128 - RNA, 18 nt, Homo sapiens
ggcaacagaugaagaccc

SEQ ID NO: 1074129 - RNA, 20 nt, Homo sapiens
ggcacaaauuguacauuuga

SEQ ID NO: 1074130 - RNA, 12 nt, Homo sapiens
ggcaguacaaug

SEQ ID NO: 1074131 - RNA, 13 nt, Homo sapiens
ggccacccacuga

SEQ ID NO: 1074132 - RNA, 21 nt, Homo sapiens
ggccagggaaagcccguguca

SEQ ID NO: 1074133 - RNA, 22 nt, Homo sapiens
ggccuggcuugucggagcaagu

SEQ ID NO: 1074134 - RNA, 21 nt, Homo sapiens
ggcuaugaagggacagcugcu

SEQ ID NO: 1074135 - RNA, 17 nt, Homo sapiens
ggcucacaccuguaauc

SEQ ID NO: 1074136 - RNA, 19 nt, Homo sapiens
ggcugaauccgugguggca

SEQ ID NO: 1074137 - RNA, 19 nt, Homo sapiens
ggcugggcuccucauuuuu

SEQ ID NO: 1074138 - RNA, 23 nt, Homo sapiens
ggcugucaggacaccagccuggu

SEQ ID NO: 1074139 - RNA, 20 nt, Homo sapiens
ggcugugcuagcaacaccca

SEQ ID NO: 1074140 - RNA, 19 nt, Homo sapiens
ggcuuccagagaguccucu

SEQ ID NO: 1074141 - RNA, 16 nt, Homo sapiens
gggacuccaguucaca

SEQ ID NO: 1074142 - RNA, 17 nt, Homo sapiens
gggaggaagcagguuga

SEQ ID NO: 1074143 - RNA, 15 nt, Homo sapiens
gggaguguugucaca

SEQ ID NO: 1074144 - RNA, 17 nt, Homo sapiens
gggauaaacugagccug

SEQ ID NO: 1074145 - RNA, 16 nt, Homo sapiens
gggccagggcccugca

SEQ ID NO: 1074146 - RNA, 12 nt, Homo sapiens
gggccucugaaa

SEQ ID NO: 1074147 - RNA, 16 nt, Homo sapiens
gggcugagcccuggca

SEQ ID NO: 1074148 - RNA, 16 nt, Homo sapiens
gggcugggccaggucu

SEQ ID NO: 1074149 - RNA, 22 nt, Homo sapiens
ggggcgugccugccaagcucac

SEQ ID NO: 1074150 - RNA, 14 nt, Homo sapiens
gggugacaucccag

SEQ ID NO: 1074151 - RNA, 15 nt, Homo sapiens
ggguggaucaccuga

SEQ ID NO: 1074152 - RNA, 13 nt, Homo sapiens
ggguguguguagc

SEQ ID NO: 1074153 - RNA, 21 nt, Homo sapiens
uaucaggacugugaccaaagc

SEQ ID NO: 1074154 - RNA, 14 nt, Homo sapiens
uauccagaauggaa

SEQ ID NO: 1074155 - RNA, 13 nt, Homo sapiens
uaucuauaaacac

SEQ ID NO: 1074156 - RNA, 22 nt, Homo sapiens
uaucucaaauuguaauuaauaa

SEQ ID NO: 1074157 - RNA, 23 nt, Homo sapiens
uaugagucucuaugaucuuggca

SEQ ID NO: 1074158 - RNA, 21 nt, Homo sapiens
uaugaguggcuucugggagau

SEQ ID NO: 1074159 - RNA, 19 nt, Homo sapiens
uauguauauguauaucuau

SEQ ID NO: 1074160 - RNA, 20 nt, Homo sapiens
uauuagcaacugugcuacac

SEQ ID NO: 1074161 - RNA, 17 nt, Homo sapiens
uauuucaaccgcuugcc

SEQ ID NO: 1074162 - RNA, 21 nt, Homo sapiens
uauuucaaccgcuugccauau

SEQ ID NO: 1074163 - RNA, 17 nt, Homo sapiens
uauuuguauaauggugu

SEQ ID NO: 1074164 - RNA, 13 nt, Homo sapiens
ucaaagacagaga

SEQ ID NO: 1074165 - RNA, 20 nt, Homo sapiens
ucaaagacagagaagaccaa

SEQ ID NO: 1074166 - RNA, 18 nt, Homo sapiens
ucaagcuagaaggccaca

SEQ ID NO: 1074167 - RNA, 21 nt, Homo sapiens
ucacaagggauuggcaauugu

SEQ ID NO: 1074168 - RNA, 14 nt, Homo sapiens
ucacauauaaaagu

SEQ ID NO: 1074169 - RNA, 12 nt, Homo sapiens
ucaccucaggcc

SEQ ID NO: 1074170 - RNA, 18 nt, Homo sapiens
ucacugcagggcacugug

SEQ ID NO: 1074171 - RNA, 19 nt, Homo sapiens
ucacugucccucaaaugac

SEQ ID NO: 1074172 - RNA, 13 nt, Homo sapiens
ucagccccacuga

SEQ ID NO: 1074173 - RNA, 20 nt, Homo sapiens
ucagcuggguacgguggcac

SEQ ID NO: 1074174 - RNA, 14 nt, Homo sapiens
ucaggacugugacc

SEQ ID NO: 1074175 - RNA, 21 nt, Homo sapiens
ucaggacugugaccaaagcau

SEQ ID NO: 1074176 - RNA, 17 nt, Homo sapiens
ucaggagaucgagacca

SEQ ID NO: 1074177 - RNA, 18 nt, Homo sapiens
ucaggucuccaccaagga

SEQ ID NO: 1074178 - RNA, 22 nt, Homo sapiens
ucagugucugaacaaucuccaa

SEQ ID NO: 1074179 - RNA, 20 nt, Homo sapiens
ucauggggucccugcugcaa

SEQ ID NO: 1074180 - RNA, 23 nt, Homo sapiens
ucauucaccaaaugaugccacuu

SEQ ID NO: 1074181 - RNA, 17 nt, Homo sapiens
ucauugcaucauuuaca

SEQ ID NO: 1074182 - RNA, 19 nt, Homo sapiens
ucauuuuguuauagaaacu

SEQ ID NO: 1074183 - RNA, 20 nt, Homo sapiens
uccaauugaacuuucacaua

SEQ ID NO: 1074184 - RNA, 18 nt, Homo sapiens
uccagugacuuucaggaa

SEQ ID NO: 1074185 - RNA, 22 nt, Homo sapiens
uccagugggaggugagaccacc

SEQ ID NO: 1074186 - RNA, 15 nt, Homo sapiens
uccaguuuccaaagg

SEQ ID NO: 1074187 - RNA, 21 nt, Homo sapiens
uccauaaacacccaugaauca

SEQ ID NO: 1074188 - RNA, 22 nt, Homo sapiens
ucccaccucuucucuuccugua

SEQ ID NO: 1074189 - RNA, 13 nt, Homo sapiens
ucccagcacuuug

SEQ ID NO: 1074190 - RNA, 18 nt, Homo sapiens
ucccauggauaggggagg

SEQ ID NO: 1074191 - RNA, 20 nt, Homo sapiens
ucccucaaaugacccaaaga

SEQ ID NO: 1074192 - RNA, 22 nt, Homo sapiens
ucccugcccuccccugcuccca

SEQ ID NO: 1074193 - RNA, 18 nt, Homo sapiens
uccgugccaggcauucaa

SEQ ID NO: 1074194 - RNA, 12 nt, Homo sapiens
uccuaugcuuua

SEQ ID NO: 1074195 - RNA, 11 nt, Homo sapiens
uccuccugcuc

SEQ ID NO: 1074196 - RNA, 13 nt, Homo sapiens
uccucguagccau

SEQ ID NO: 1074197 - RNA, 12 nt, Homo sapiens
uccugaccaaag

SEQ ID NO: 1074198 - RNA, 13 nt, Homo sapiens
ucgccggccuugu

SEQ ID NO: 1074199 - RNA, 23 nt, Homo sapiens
ucgccguguuacuguugcacuga

SEQ ID NO: 1074200 - RNA, 17 nt, Homo sapiens
ucgggaggcugaggcag

SEQ ID NO: 1074201 - RNA, 13 nt, Homo sapiens
ucguagccaucuc

SEQ ID NO: 1074202 - RNA, 13 nt, Homo sapiens
ucguguccugcua

SEQ ID NO: 1074203 - RNA, 20 nt, Homo sapiens
ucuaacuagaaaucugccaa

SEQ ID NO: 1074204 - RNA, 15 nt, Homo sapiens
ucuaagccaacuuua

SEQ ID NO: 1074205 - RNA, 16 nt, Homo sapiens
ucuaauuccuguugcu

SEQ ID NO: 1074206 - RNA, 13 nt, Homo sapiens
ucuacacauauau

SEQ ID NO: 1074207 - RNA, 18 nt, Homo sapiens
ucuacugagacaugacua

SEQ ID NO: 1074208 - RNA, 14 nt, Homo sapiens
ucuauaaacacugu

SEQ ID NO: 1074209 - RNA, 15 nt, Homo sapiens
ucuauaacuacauau

SEQ ID NO: 1074210 - RNA, 13 nt, Homo sapiens
ucuaugccaggcu

SEQ ID NO: 1074211 - RNA, 17 nt, Homo sapiens
ucucccccugggcucug

SEQ ID NO: 1074212 - RNA, 13 nt, Homo sapiens
ucuccuugcacuu

SEQ ID NO: 1074213 - RNA, 22 nt, Homo sapiens
ucucuaauuggaagaaauuccu

SEQ ID NO: 1074214 - RNA, 20 nt, Homo sapiens
ucucuccaccgugacacaau

SEQ ID NO: 1074215 - RNA, 22 nt, Homo sapiens
ucucuuccugucuuuguugucu

SEQ ID NO: 1074216 - RNA, 17 nt, Homo sapiens
ucugaauaagcacuuuu

SEQ ID NO: 1074217 - RNA, 20 nt, Homo sapiens
ucugacucacaagaagacca

SEQ ID NO: 1074218 - RNA, 18 nt, Homo sapiens
ucugaggcuuccagagag

SEQ ID NO: 1074219 - RNA, 17 nt, Homo sapiens
ucuggagucuccagugg

SEQ ID NO: 1074220 - RNA, 20 nt, Homo sapiens
ucuggccugggcgacagagc

SEQ ID NO: 1074221 - RNA, 17 nt, Homo sapiens
ucugggccaaguuccuc

SEQ ID NO: 1074222 - RNA, 23 nt, Homo sapiens
ucugugcuuugacucaccuguua

SEQ ID NO: 1074223 - RNA, 19 nt, Homo sapiens
ucuuauucccaaacuacag

SEQ ID NO: 1074224 - RNA, 16 nt, Homo sapiens
ucuuccuaguauauua

SEQ ID NO: 1074225 - RNA, 19 nt, Homo sapiens
ucuuggaccucugcucuga

SEQ ID NO: 1074226 - RNA, 18 nt, Homo sapiens
ucuuucaacucauugcau

SEQ ID NO: 1074227 - RNA, 19 nt, Homo sapiens
ugaaaaacauuccaggaaa

SEQ ID NO: 1074228 - RNA, 17 nt, Homo sapiens
ugaaaaggaaguuaaua

SEQ ID NO: 1074229 - RNA, 18 nt, Homo sapiens
ugaaaauuaugagucucu

SEQ ID NO: 1074230 - RNA, 16 nt, Homo sapiens
ugaaagaaggagcaag

SEQ ID NO: 1074231 - RNA, 19 nt, Homo sapiens
aagagacuggagcaucuga

SEQ ID NO: 1074232 - RNA, 22 nt, Homo sapiens
aagagcuaaguucuaaguucau

SEQ ID NO: 1074233 - RNA, 18 nt, Homo sapiens
aagaugucacaagggauu

SEQ ID NO: 1074234 - RNA, 18 nt, Homo sapiens
aagcagguggcaucucua

SEQ ID NO: 1074235 - RNA, 16 nt, Homo sapiens
aagcaucaccucaggc

SEQ ID NO: 1074236 - RNA, 20 nt, Homo sapiens
aagcauggccuggacugacu

SEQ ID NO: 1074237 - RNA, 17 nt, Homo sapiens
aagccacagaagccagg

SEQ ID NO: 1074238 - RNA, 14 nt, Homo sapiens
aagcugcugucacu

SEQ ID NO: 1074239 - RNA, 17 nt, Homo sapiens
aaggcauggucggggga

SEQ ID NO: 1074240 - RNA, 15 nt, Homo sapiens
aaggucucugaacuc

SEQ ID NO: 1074241 - RNA, 22 nt, Homo sapiens
aagguuucuauuuucucugaua

SEQ ID NO: 1074242 - RNA, 16 nt, Homo sapiens
aaguaguagugucuuc

SEQ ID NO: 1074243 - RNA, 17 nt, Homo sapiens
aaguauauauucuacac

SEQ ID NO: 1074244 - RNA, 18 nt, Homo sapiens
aaguguugcucuuggaaa

SEQ ID NO: 1074245 - RNA, 19 nt, Homo sapiens
aaguucugguaugaacuug

SEQ ID NO: 1074246 - RNA, 14 nt, Homo sapiens
aaguuuugaugaaa

SEQ ID NO: 1074247 - RNA, 13 nt, Homo sapiens
aauaaaaauaccu

SEQ ID NO: 1074248 - RNA, 16 nt, Homo sapiens
aauaaauccuccaguc

SEQ ID NO: 1074249 - RNA, 13 nt, Homo sapiens
aauaacagugugu

SEQ ID NO: 1074250 - RNA, 18 nt, Homo sapiens
aauaccagugaaccaaag

SEQ ID NO: 1074251 - RNA, 21 nt, Homo sapiens
aauacuuuuuucuaguuucag

SEQ ID NO: 1074252 - RNA, 17 nt, Homo sapiens
aauaucgagaacugcca

SEQ ID NO: 1074253 - RNA, 22 nt, Homo sapiens
aauaucugagaaguguauauag

SEQ ID NO: 1074254 - RNA, 19 nt, Homo sapiens
aauaucuggguggcuuaaa

SEQ ID NO: 1074255 - RNA, 23 nt, Homo sapiens
aauauucaauaaagcugcugaga

SEQ ID NO: 1074256 - RNA, 12 nt, Homo sapiens
aaucaaagacau

SEQ ID NO: 1074257 - RNA, 14 nt, Homo sapiens
aaucccagcacuuu

SEQ ID NO: 1074258 - RNA, 15 nt, Homo sapiens
aaucccagcuacuug

SEQ ID NO: 1074259 - RNA, 19 nt, Homo sapiens
aaucgcuuuccuuccuccc

SEQ ID NO: 1074260 - RNA, 15 nt, Homo sapiens
aaucuauaacuacau

SEQ ID NO: 1074261 - RNA, 18 nt, Homo sapiens
aaucuauaacuacauauu

SEQ ID NO: 1074262 - RNA, 20 nt, Homo sapiens
aaucuguauauguuguaaua

SEQ ID NO: 1074263 - RNA, 16 nt, Homo sapiens
aaugacccaaagacca

SEQ ID NO: 1074264 - RNA, 15 nt, Homo sapiens
aaugaugccacuucc

SEQ ID NO: 1074265 - RNA, 16 nt, Homo sapiens
aauguuguccaggaaa

SEQ ID NO: 1074266 - RNA, 22 nt, Homo sapiens
aauguuugucuggauuggcuau

SEQ ID NO: 1074267 - RNA, 17 nt, Homo sapiens
aauuaauauuuaugucu

SEQ ID NO: 1074268 - RNA, 21 nt, Homo sapiens
aauuauacuguagcugaugaa

SEQ ID NO: 1074269 - RNA, 16 nt, Homo sapiens
aauucucaaccuacca

SEQ ID NO: 1074270 - RNA, 19 nt, Homo sapiens
acaaaaaacugcaguuuga

SEQ ID NO: 1074271 - RNA, 19 nt, Homo sapiens
acaagaagaccagacugug

SEQ ID NO: 1074272 - RNA, 18 nt, Homo sapiens
acaagucuugcugugcuu

SEQ ID NO: 1074273 - RNA, 19 nt, Homo sapiens
acacaagccacagaagcca

SEQ ID NO: 1074274 - RNA, 11 nt, Homo sapiens
acacaaugugg

SEQ ID NO: 1074275 - RNA, 11 nt, Homo sapiens
acaccaucucc

SEQ ID NO: 1074276 - RNA, 14 nt, Homo sapiens
acacccacuggcca

SEQ ID NO: 1074277 - RNA, 19 nt, Homo sapiens
acacgugauggaccaaagc

SEQ ID NO: 1074278 - RNA, 16 nt, Homo sapiens
acagaagccaggagca

SEQ ID NO: 1074279 - RNA, 17 nt, Homo sapiens
acagaaugaaucccaua

SEQ ID NO: 1074280 - RNA, 16 nt, Homo sapiens
acagcaggaacugagc

SEQ ID NO: 1074281 - RNA, 17 nt, Homo sapiens
acagccucuaguguccg

SEQ ID NO: 1074282 - RNA, 16 nt, Homo sapiens
acaggucgagcugugc

SEQ ID NO: 1074283 - RNA, 15 nt, Homo sapiens
acaguccugggagaa

SEQ ID NO: 1074284 - RNA, 13 nt, Homo sapiens
acaugacuaggaa

SEQ ID NO: 1074285 - RNA, 18 nt, Homo sapiens
acaugaggauaacuuccu

SEQ ID NO: 1074286 - RNA, 22 nt, Homo sapiens
acaugauggagcgcaccugccc

SEQ ID NO: 1074287 - RNA, 16 nt, Homo sapiens
acaugcaaggcacuga

SEQ ID NO: 1074288 - RNA, 14 nt, Homo sapiens
agccacgugaaugg

SEQ ID NO: 1074289 - RNA, 13 nt, Homo sapiens
agccaggagcaaa

SEQ ID NO: 1074290 - RNA, 20 nt, Homo sapiens
agccaugaucgagccacugc

SEQ ID NO: 1074291 - RNA, 21 nt, Homo sapiens
agccaugaucgagccacugca

SEQ ID NO: 1074292 - RNA, 19 nt, Homo sapiens
agcccauggccucuggcca

SEQ ID NO: 1074293 - RNA, 22 nt, Homo sapiens
agcccugcucuuucucugagaa

SEQ ID NO: 1074294 - RNA, 14 nt, Homo sapiens
agccucccuuccau

SEQ ID NO: 1074295 - RNA, 22 nt, Homo sapiens
agccuccuugccuggaacucac

SEQ ID NO: 1074296 - RNA, 21 nt, Homo sapiens
agccugaaugucuuacuguga

SEQ ID NO: 1074297 - RNA, 23 nt, Homo sapiens
agccugaaugucuuacugugauc

SEQ ID NO: 1074298 - RNA, 16 nt, Homo sapiens
agccugagucacuggu

SEQ ID NO: 1074299 - RNA, 15 nt, Homo sapiens
agcggcccugacacg

SEQ ID NO: 1074300 - RNA, 19 nt, Homo sapiens
agcuacucagaagccugag

SEQ ID NO: 1074301 - RNA, 18 nt, Homo sapiens
agcuacucgggaggcuga

SEQ ID NO: 1074302 - RNA, 22 nt, Homo sapiens
agcuacuugggaggcugagcca

SEQ ID NO: 1074303 - RNA, 17 nt, Homo sapiens
agcuauuuuaaaccaau

SEQ ID NO: 1074304 - RNA, 21 nt, Homo sapiens
agcucacacagcaggaacuga

SEQ ID NO: 1074305 - RNA, 14 nt, Homo sapiens
agcucaggcauuug

SEQ ID NO: 1074306 - RNA, 15 nt, Homo sapiens
agcucucuuccuguc

SEQ ID NO: 1074307 - RNA, 15 nt, Homo sapiens
agcucuggcuuccag

SEQ ID NO: 1074308 - RNA, 15 nt, Homo sapiens
agcucuuaauguugc

SEQ ID NO: 1074309 - RNA, 17 nt, Homo sapiens
agcugaacaaugaaugc

SEQ ID NO: 1074310 - RNA, 14 nt, Homo sapiens
agcugcaccugcca

SEQ ID NO: 1074311 - RNA, 22 nt, Homo sapiens
agcugugcucgggugcugccag

SEQ ID NO: 1074312 - RNA, 15 nt, Homo sapiens
agcuguuggauuuca

SEQ ID NO: 1074313 - RNA, 12 nt, Homo sapiens
agcuuggcacuu

SEQ ID NO: 1074314 - RNA, 20 nt, Homo sapiens
aggaaccaaaaaaccccagc

SEQ ID NO: 1074315 - RNA, 18 nt, Homo sapiens
aggacugugaccaaagca

SEQ ID NO: 1074316 - RNA, 16 nt, Homo sapiens
aggagaaaaugcauua

SEQ ID NO: 1074317 - RNA, 13 nt, Homo sapiens
aggagaacccaau

SEQ ID NO: 1074318 - RNA, 22 nt, Homo sapiens
aggagcaaauguuucugcagua

SEQ ID NO: 1074319 - RNA, 15 nt, Homo sapiens
aggcacugacugagc

SEQ ID NO: 1074320 - RNA, 16 nt, Homo sapiens
aggcacugacugagca

SEQ ID NO: 1074321 - RNA, 13 nt, Homo sapiens
aggcagagccuga

SEQ ID NO: 1074322 - RNA, 19 nt, Homo sapiens
aggcauaugcuucuuuaaa

SEQ ID NO: 1074323 - RNA, 16 nt, Homo sapiens
aggccaaggcuaugaa

SEQ ID NO: 1074324 - RNA, 16 nt, Homo sapiens
aggccacaccaucucc

SEQ ID NO: 1074325 - RNA, 15 nt, Homo sapiens
aggccagccuuggca

SEQ ID NO: 1074326 - RNA, 16 nt, Homo sapiens
aggccagccuuggcac

SEQ ID NO: 1074327 - RNA, 17 nt, Homo sapiens
aggccagccuuggcacg

SEQ ID NO: 1074328 - RNA, 19 nt, Homo sapiens
aggccgggcgcaguggcuc

SEQ ID NO: 1074329 - RNA, 16 nt, Homo sapiens
aggccugcaggggcaa

SEQ ID NO: 1074330 - RNA, 12 nt, Homo sapiens
aggcuaagcaug

SEQ ID NO: 1074331 - RNA, 14 nt, Homo sapiens
aggcugagccagga

SEQ ID NO: 1074332 - RNA, 14 nt, Homo sapiens
aggcugugccuugg

SEQ ID NO: 1074333 - RNA, 10 nt, Homo sapiens
aggcugugcu

SEQ ID NO: 1074334 - RNA, 12 nt, Homo sapiens
aggcugugcuag

SEQ ID NO: 1074335 - RNA, 21 nt, Homo sapiens
aggcugugcuagcaacaccca

SEQ ID NO: 1074336 - RNA, 21 nt, Homo sapiens
aggcuuccagagaguccucug

SEQ ID NO: 1074337 - RNA, 19 nt, Homo sapiens
agggacaaaacacuguguc

SEQ ID NO: 1074338 - RNA, 13 nt, Homo sapiens
agggacugacacg

SEQ ID NO: 1074339 - RNA, 16 nt, Homo sapiens
agggagccgagaucac

SEQ ID NO: 1074340 - RNA, 14 nt, Homo sapiens
aggggcuggcugga

SEQ ID NO: 1074341 - RNA, 11 nt, Homo sapiens
agggugacugu

SEQ ID NO: 1074342 - RNA, 16 nt, Homo sapiens
aggucgagcugugcuc

SEQ ID NO: 1074343 - RNA, 18 nt, Homo sapiens
aggucugaugccaaagcu

SEQ ID NO: 1074344 - RNA, 23 nt, Homo sapiens
agguggagguugcagugagccaa

SEQ ID NO: 1074345 - RNA, 23 nt, Homo sapiens
agguugaggugcgcucaccucag

SEQ ID NO: 1074346 - RNA, 13 nt, Homo sapiens
agguugcagugag

SEQ ID NO: 1074347 - RNA, 14 nt, Homo sapiens
agguuggugacuga

SEQ ID NO: 1074348 - RNA, 15 nt, Homo sapiens
aguaaacacugugua

SEQ ID NO: 1074349 - RNA, 16 nt, Homo sapiens
aguaacuggugauaua

SEQ ID NO: 1074350 - RNA, 20 nt, Homo sapiens
aguaaguaccacucaggcca

SEQ ID NO: 1074351 - RNA, 21 nt, Homo sapiens
aguaaguaccacucaggccaa

SEQ ID NO: 1074352 - RNA, 19 nt, Homo sapiens
aguacuuacccuaaaacau

SEQ ID NO: 1074353 - RNA, 13 nt, Homo sapiens
aguagaacccagg

SEQ ID NO: 1074354 - RNA, 18 nt, Homo sapiens
aguagaacccaggucuga

SEQ ID NO: 1074355 - RNA, 12 nt, Homo sapiens
aguagucucugu

SEQ ID NO: 1074356 - RNA, 20 nt, Homo sapiens
agucagacuuacuuacuccc

SEQ ID NO: 1074357 - RNA, 14 nt, Homo sapiens
agucagaugcccag

SEQ ID NO: 1074358 - RNA, 17 nt, Homo sapiens
agucauggggucccugc

SEQ ID NO: 1074359 - RNA, 16 nt, Homo sapiens
agucucagagcacaga

SEQ ID NO: 1074360 - RNA, 11 nt, Homo sapiens
agucucugugc

SEQ ID NO: 1074361 - RNA, 21 nt, Homo sapiens
agucugggauguagaacuuca

SEQ ID NO: 1074362 - RNA, 14 nt, Homo sapiens
agugaaccaaagag

SEQ ID NO: 1074363 - RNA, 20 nt, Homo sapiens
aguggugcgaucuuggcuca

SEQ ID NO: 1074364 - RNA, 14 nt, Homo sapiens
aguguacacagacu

SEQ ID NO: 1074365 - RNA, 22 nt, Homo sapiens
aguuuacuuauaccucucucaa

SEQ ID NO: 1074366 - RNA, 12 nt, Homo sapiens
auaaaaauaccu

SEQ ID NO: 1074367 - RNA, 12 nt, Homo sapiens
auaaacugagcc

SEQ ID NO: 1074368 - RNA, 19 nt, Homo sapiens
auaagcagaagcacauaug

SEQ ID NO: 1074369 - RNA, 15 nt, Homo sapiens
auaauugacaugggc

SEQ ID NO: 1074370 - RNA, 16 nt, Homo sapiens
auagaugugaucacug

SEQ ID NO: 1074371 - RNA, 18 nt, Homo sapiens
auaguuaaucuauaacua

SEQ ID NO: 1074372 - RNA, 18 nt, Homo sapiens
auaugaacuggaccugca

SEQ ID NO: 1074373 - RNA, 18 nt, Homo sapiens
auauucaauaaagcugcu

SEQ ID NO: 1074374 - RNA, 15 nt, Homo sapiens
auauuuauucaguga

SEQ ID NO: 1074375 - RNA, 14 nt, Homo sapiens
aucagaacaugagg

SEQ ID NO: 1074376 - RNA, 20 nt, Homo sapiens
aucaggaaaacaaaucacug

SEQ ID NO: 1074377 - RNA, 21 nt, Homo sapiens
aucaggacugugaccaaagca

SEQ ID NO: 1074378 - RNA, 15 nt, Homo sapiens
aucaucucugugacc

SEQ ID NO: 1074379 - RNA, 12 nt, Homo sapiens
aucccagcacuu

SEQ ID NO: 1074380 - RNA, 15 nt, Homo sapiens
auccucaggucucca

SEQ ID NO: 1074381 - RNA, 23 nt, Homo sapiens
aucgccguguuacuguugcacug

SEQ ID NO: 1074382 - RNA, 18 nt, Homo sapiens
aucgcugccuugccaugu

SEQ ID NO: 1074383 - RNA, 18 nt, Homo sapiens
aucuacugagacaugacu

SEQ ID NO: 1074384 - RNA, 23 nt, Homo sapiens
aucucccuagccugcuuuugucc

SEQ ID NO: 1074385 - RNA, 23 nt, Homo sapiens
aucucuaauuggaagaaauuccu

SEQ ID NO: 1074386 - RNA, 21 nt, Homo sapiens
aucucuuaaaaaaugaauuug

SEQ ID NO: 1074387 - RNA, 19 nt, Homo sapiens
augaaucaaagacauggaa

SEQ ID NO: 1074388 - RNA, 20 nt, Homo sapiens
augacuuuaucauuuuguua

SEQ ID NO: 1074389 - RNA, 13 nt, Homo sapiens
augcaaaugccuc

SEQ ID NO: 1074390 - RNA, 11 nt, Homo sapiens
augcaguaugc

SEQ ID NO: 1074391 - RNA, 14 nt, Homo sapiens
augcauggugcauc

SEQ ID NO: 1074392 - RNA, 17 nt, Homo sapiens
augccacugcuuuccag

SEQ ID NO: 1074393 - RNA, 16 nt, Homo sapiens
augccaggcugugcua

SEQ ID NO: 1074394 - RNA, 16 nt, Homo sapiens
augccggggacagaga

SEQ ID NO: 1074395 - RNA, 22 nt, Homo sapiens
augcuacccacagcgucauuuu

SEQ ID NO: 1074396 - RNA, 21 nt, Homo sapiens
augcugaggccacccacugac

SEQ ID NO: 1074397 - RNA, 21 nt, Homo sapiens
augcuuccgccuuuccggggc

SEQ ID NO: 1074398 - RNA, 17 nt, Homo sapiens
auggaaguggcagugaa

SEQ ID NO: 1074399 - RNA, 20 nt, Homo sapiens
auggacucugaaaaacauuc

SEQ ID NO: 1074400 - RNA, 20 nt, Homo sapiens
auggccagugugaucccaag

SEQ ID NO: 1074401 - RNA, 19 nt, Homo sapiens
auggccuggacugacugca

SEQ ID NO: 1074402 - RNA, 17 nt, Homo sapiens
auggggucccugcugca

SEQ ID NO: 1074403 - RNA, 20 nt, Homo sapiens
augguccuggggcucugugc

SEQ ID NO: 1074404 - RNA, 19 nt, Homo sapiens
auggugaaaccccgucucu

SEQ ID NO: 1074405 - RNA, 15 nt, Homo sapiens
auguacuauaacaua

SEQ ID NO: 1074406 - RNA, 20 nt, Homo sapiens
augucaccguggaccuuccu

SEQ ID NO: 1074407 - RNA, 22 nt, Homo sapiens
auguccauuugucccaauagcu

SEQ ID NO: 1074408 - RNA, 20 nt, Homo sapiens
auguccggagagacagugac

SEQ ID NO: 1074409 - RNA, 23 nt, Homo sapiens
auguccggagagacagugacagc

SEQ ID NO: 1074410 - RNA, 21 nt, Homo sapiens
augucucuaagccaacuuuaa

SEQ ID NO: 1074411 - RNA, 18 nt, Homo sapiens
augucucuguuauuguua

SEQ ID NO: 1074412 - RNA, 12 nt, Homo sapiens
auguugcuuaga

SEQ ID NO: 1074413 - RNA, 15 nt, Homo sapiens
auguuugcacuuugu

SEQ ID NO: 1074414 - RNA, 16 nt, Homo sapiens
auguuugguaccaaga

SEQ ID NO: 1074415 - RNA, 22 nt, Homo sapiens
auuaaaaaagcucaaugcauug

SEQ ID NO: 1074416 - RNA, 21 nt, Homo sapiens
auuaaaucauacuccuaugcu

SEQ ID NO: 1074417 - RNA, 13 nt, Homo sapiens
auuaagugccuga

SEQ ID NO: 1074418 - RNA, 15 nt, Homo sapiens
auuagcucuggacca

SEQ ID NO: 1074419 - RNA, 18 nt, Homo sapiens
auuaugagucucuaugau

SEQ ID NO: 1074420 - RNA, 15 nt, Homo sapiens
auuauuucaccagca

SEQ ID NO: 1074421 - RNA, 20 nt, Homo sapiens
auucaaacaggucgagcugu

SEQ ID NO: 1074422 - RNA, 20 nt, Homo sapiens
auucaauccucaggucucca

SEQ ID NO: 1074423 - RNA, 19 nt, Homo sapiens
auucaggcuuuaggcauau

SEQ ID NO: 1074424 - RNA, 22 nt, Homo sapiens
auucaucugggaggcagaacag

SEQ ID NO: 1074425 - RNA, 15 nt, Homo sapiens
auuccucuugcauuu

SEQ ID NO: 1074426 - RNA, 16 nt, Homo sapiens
auucuugaaguucaug

SEQ ID NO: 1074427 - RNA, 22 nt, Homo sapiens
auugaacuuucacauagcacag

SEQ ID NO: 1074428 - RNA, 22 nt, Homo sapiens
auugaaggagaaaaugcauuau

SEQ ID NO: 1074429 - RNA, 14 nt, Homo sapiens
auugcaaucuauaa

SEQ ID NO: 1074430 - RNA, 13 nt, Homo sapiens
auugcaccugcag

SEQ ID NO: 1074431 - RNA, 16 nt, Homo sapiens
auugcaucauuuacaa

SEQ ID NO: 1074432 - RNA, 13 nt, Homo sapiens
auugccugccaga

SEQ ID NO: 1074433 - RNA, 20 nt, Homo sapiens
auugcuuuuguugugacuuu

SEQ ID NO: 1074434 - RNA, 11 nt, Homo sapiens
auugucuucca

SEQ ID NO: 1074435 - RNA, 15 nt, Homo sapiens
auugugaauaaugau

SEQ ID NO: 1074436 - RNA, 19 nt, Homo sapiens
auuucaaccgcuugccaua

SEQ ID NO: 1074437 - RNA, 21 nt, Homo sapiens
auuucuagucccuucucucuu

SEQ ID NO: 1074438 - RNA, 19 nt, Homo sapiens
auuugcacccaugccauag

SEQ ID NO: 1074439 - RNA, 15 nt, Homo sapiens
auuuguguguucacu

SEQ ID NO: 1074440 - RNA, 13 nt, Homo sapiens
auuuguucagaga

SEQ ID NO: 1074441 - RNA, 16 nt, Homo sapiens
auuuucucugauacuu

SEQ ID NO: 1074442 - RNA, 16 nt, Homo sapiens
auuuucugaccaaaau

SEQ ID NO: 1074443 - RNA, 13 nt, Homo sapiens
auuuugcauuaga

SEQ ID NO: 1074444 - RNA, 22 nt, Homo sapiens
caaaaaacugcaguuugaucaa

SEQ ID NO: 1074445 - RNA, 12 nt, Homo sapiens
caaaacacugug

SEQ ID NO: 1074446 - RNA, 9 nt, Homo sapiens
caaaaccac

SEQ ID NO: 1074447 - RNA, 21 nt, Homo sapiens
caaacaggucgagcugugcuc

SEQ ID NO: 1074448 - RNA, 19 nt, Homo sapiens
caaacgggcugcccugcca

SEQ ID NO: 1074449 - RNA, 22 nt, Homo sapiens
ugauuaugccacugcuuuccag

SEQ ID NO: 1074450 - RNA, 20 nt, Homo sapiens
ugauuguuuaaagguuucua

SEQ ID NO: 1074451 - RNA, 15 nt, Homo sapiens
ugcaaaugccuccaa

SEQ ID NO: 1074452 - RNA, 18 nt, Homo sapiens
ugcaccuguacucaggag

SEQ ID NO: 1074453 - RNA, 14 nt, Homo sapiens
ugcaguuugaucaa

SEQ ID NO: 1074454 - RNA, 14 nt, Homo sapiens
ugcaucauuuacaa

SEQ ID NO: 1074455 - RNA, 18 nt, Homo sapiens
ugcaugcacugucucagc

SEQ ID NO: 1074456 - RNA, 13 nt, Homo sapiens
ugccaccagucac

SEQ ID NO: 1074457 - RNA, 21 nt, Homo sapiens
ugccaggcauucaauccucag

SEQ ID NO: 1074458 - RNA, 19 nt, Homo sapiens
ugccccaucauugcaccug

SEQ ID NO: 1074459 - RNA, 9 nt, Homo sapiens
ugcccuccc

SEQ ID NO: 1074460 - RNA, 18 nt, Homo sapiens
ugcgcucaccucagagca

SEQ ID NO: 1074461 - RNA, 22 nt, Homo sapiens
ugcggggagccaucaccuagga

SEQ ID NO: 1074462 - RNA, 22 nt, Homo sapiens
ugcuaaauaguucuaucaggaa

SEQ ID NO: 1074463 - RNA, 15 nt, Homo sapiens
ugcucuaugccaggc

SEQ ID NO: 1074464 - RNA, 13 nt, Homo sapiens
ugcugacacugug

SEQ ID NO: 1074465 - RNA, 21 nt, Homo sapiens
ugcugaggccacccacugacc

SEQ ID NO: 1074466 - RNA, 22 nt, Homo sapiens
ugcuuagaugagggugacuguc

SEQ ID NO: 1074467 - RNA, 17 nt, Homo sapiens
ugcuuucuucucugccu

SEQ ID NO: 1074468 - RNA, 18 nt, Homo sapiens
uggaaagcaucaccucag

SEQ ID NO: 1074469 - RNA, 22 nt, Homo sapiens
uggaaaggcucagucucaggag

SEQ ID NO: 1074470 - RNA, 20 nt, Homo sapiens
uggaacaugcaaggcacuga

SEQ ID NO: 1074471 - RNA, 21 nt, Homo sapiens
uggaauacuugaaaaccucau

SEQ ID NO: 1074472 - RNA, 14 nt, Homo sapiens
uggaccaaagccac

SEQ ID NO: 1074473 - RNA, 15 nt, Homo sapiens
uggaccaacccuguu

SEQ ID NO: 1074474 - RNA, 15 nt, Homo sapiens
uggacugugugcaac

SEQ ID NO: 1074475 - RNA, 14 nt, Homo sapiens
uggagguugcagug

SEQ ID NO: 1074476 - RNA, 14 nt, Homo sapiens
uggcaccgagacca

SEQ ID NO: 1074477 - RNA, 18 nt, Homo sapiens
uggcaguggaacaugcaa

SEQ ID NO: 1074478 - RNA, 15 nt, Homo sapiens
uggcaucacagggca

SEQ ID NO: 1074479 - RNA, 15 nt, Homo sapiens
uggcaucuagccaga

SEQ ID NO: 1074480 - RNA, 17 nt, Homo sapiens
uggccagugugauccca

SEQ ID NO: 1074481 - RNA, 18 nt, Homo sapiens
uggccagugugaucccaa

SEQ ID NO: 1074482 - RNA, 14 nt, Homo sapiens
uggccgugaggaca

SEQ ID NO: 1074483 - RNA, 23 nt, Homo sapiens
uggccuggcggagaugcuucuaa

SEQ ID NO: 1074484 - RNA, 14 nt, Homo sapiens
uggcuaacacguga

SEQ ID NO: 1074485 - RNA, 21 nt, Homo sapiens
uggcuauaacaugucuuucag

SEQ ID NO: 1074486 - RNA, 13 nt, Homo sapiens
ugggaugggaucc

SEQ ID NO: 1074487 - RNA, 16 nt, Homo sapiens
ugggauugugguacaa

SEQ ID NO: 1074488 - RNA, 15 nt, Homo sapiens
ugggcaacagaugaa

SEQ ID NO: 1074489 - RNA, 21 nt, Homo sapiens
uggggaagugucccugugauc

SEQ ID NO: 1074490 - RNA, 23 nt, Homo sapiens
uggguaucaggacugugaccaaa

SEQ ID NO: 1074491 - RNA, 22 nt, Homo sapiens
ugguacugcacauuuuguacaa

SEQ ID NO: 1074492 - RNA, 12 nt, Homo sapiens
uggucacaggcu

SEQ ID NO: 1074493 - RNA, 21 nt, Homo sapiens
ugguggcucacaccuguaauc

SEQ ID NO: 1074494 - RNA, 20 nt, Homo sapiens
uguaaaggucacuuuucaca

SEQ ID NO: 1074495 - RNA, 19 nt, Homo sapiens
uguaaucccagcacuuugg

SEQ ID NO: 1074496 - RNA, 19 nt, Homo sapiens
uguaaucccagcuacuugg

SEQ ID NO: 1074497 - RNA, 15 nt, Homo sapiens
uguacaaagauaugc

SEQ ID NO: 1074498 - RNA, 11 nt, Homo sapiens
uguacacugug

SEQ ID NO: 1074499 - RNA, 12 nt, Homo sapiens
uguacacugugu

SEQ ID NO: 1074500 - RNA, 21 nt, Homo sapiens
uguagccaccuccuuggcacc

SEQ ID NO: 1074501 - RNA, 12 nt, Homo sapiens
ugucccaaagaa

SEQ ID NO: 1074502 - RNA, 23 nt, Homo sapiens
ugucccucaaaugacccaaagac

SEQ ID NO: 1074503 - RNA, 19 nt, Homo sapiens
ugucccugugaucuuggca

SEQ ID NO: 1074504 - RNA, 23 nt, Homo sapiens
ugucuccccgaaagggacacaau

SEQ ID NO: 1074505 - RNA, 17 nt, Homo sapiens
ugugaauaaugauuugg

SEQ ID NO: 1074506 - RNA, 15 nt, Homo sapiens
ugugccucagccucc

SEQ ID NO: 1074507 - RNA, 17 nt, Homo sapiens
ugugucccccccagugc

SEQ ID NO: 1074508 - RNA, 14 nt, Homo sapiens
ugugugaccccaaa

SEQ ID NO: 1074509 - RNA, 12 nt, Homo sapiens
uguguguagcca

SEQ ID NO: 1074510 - RNA, 21 nt, Homo sapiens
uguuacuaaagucacauauaa

SEQ ID NO: 1074511 - RNA, 21 nt, Homo sapiens
uguuacuugaaauaccaguga

SEQ ID NO: 1074512 - RNA, 19 nt, Homo sapiens
uguuauguuugcacuuugu

SEQ ID NO: 1074513 - RNA, 18 nt, Homo sapiens
uguuauuauuuugcacug

SEQ ID NO: 1074514 - RNA, 18 nt, Homo sapiens
uguuauuuuuuauuucca

SEQ ID NO: 1074515 - RNA, 20 nt, Homo sapiens
uguucauuuuagugacugua

SEQ ID NO: 1074516 - RNA, 13 nt, Homo sapiens
uguuccgugccag

SEQ ID NO: 1074517 - RNA, 21 nt, Homo sapiens
uguucuguccaguuuccaaag

SEQ ID NO: 1074518 - RNA, 21 nt, Homo sapiens
uguucuuagcugaacaaugaa

SEQ ID NO: 1074519 - RNA, 18 nt, Homo sapiens
uguugccuggaagcacau

SEQ ID NO: 1074520 - RNA, 17 nt, Homo sapiens
uguuggauuucagugau

SEQ ID NO: 1074521 - RNA, 14 nt, Homo sapiens
uguuguccaggaaa

SEQ ID NO: 1074522 - RNA, 18 nt, Homo sapiens
uguuugaagucugcucau

SEQ ID NO: 1074523 - RNA, 12 nt, Homo sapiens
uguuugcacuuu

SEQ ID NO: 1074524 - RNA, 13 nt, Homo sapiens
uguuugcacuuug

SEQ ID NO: 1074525 - RNA, 20 nt, Homo sapiens
uuaaaaaaaguauauauucu

SEQ ID NO: 1074526 - RNA, 18 nt, Homo sapiens
uuaacagcaggugugacc

SEQ ID NO: 1074527 - RNA, 19 nt, Homo sapiens
uuaauauggugacuuuuua

SEQ ID NO: 1074528 - RNA, 18 nt, Homo sapiens
uuacuaaagucacauaua

SEQ ID NO: 1074529 - RNA, 14 nt, Homo sapiens
uuacucagcccagc

SEQ ID NO: 1074530 - RNA, 20 nt, Homo sapiens
auuucaaccgcuugccauau

SEQ ID NO: 1074531 - RNA, 15 nt, Homo sapiens
auuucccacacccca

SEQ ID NO: 1074532 - RNA, 23 nt, Homo sapiens
auuucccugggggcauccugcuu

SEQ ID NO: 1074533 - RNA, 19 nt, Homo sapiens
auuuccgugaaaaugcaag

SEQ ID NO: 1074534 - RNA, 15 nt, Homo sapiens
auuuguucagugacu

SEQ ID NO: 1074535 - RNA, 22 nt, Homo sapiens
auuuucccuucgauauaugacu

SEQ ID NO: 1074536 - RNA, 13 nt, Homo sapiens
auuuugcacuguu

SEQ ID NO: 1074537 - RNA, 23 nt, Homo sapiens
auuuugggggguaaucagcauua

SEQ ID NO: 1074538 - RNA, 21 nt, Homo sapiens
auuuugugaaagaaggagcaa

SEQ ID NO: 1074539 - RNA, 16 nt, Homo sapiens
auuuuuuauuuccaca

SEQ ID NO: 1074540 - RNA, 18 nt, Homo sapiens
caaaaaaaaaccaugcau

SEQ ID NO: 1074541 - RNA, 13 nt, Homo sapiens
caaaacacugugu

SEQ ID NO: 1074542 - RNA, 16 nt, Homo sapiens
caaaaugcauguaauc

SEQ ID NO: 1074543 - RNA, 16 nt, Homo sapiens
caaaauguguuucaua

SEQ ID NO: 1074544 - RNA, 13 nt, Homo sapiens
caaacaaaccauu

SEQ ID NO: 1074545 - RNA, 10 nt, Homo sapiens
caaagccaaa

SEQ ID NO: 1074546 - RNA, 19 nt, Homo sapiens
caaauaauaaauguucucg

SEQ ID NO: 1074547 - RNA, 18 nt, Homo sapiens
caaaugaugccacuuccc

SEQ ID NO: 1074548 - RNA, 19 nt, Homo sapiens
caacaaagcgagaucccau

SEQ ID NO: 1074549 - RNA, 17 nt, Homo sapiens
caacaauuuuugaucaa

SEQ ID NO: 1074550 - RNA, 23 nt, Homo sapiens
caacauggugaaaccccgucucu

SEQ ID NO: 1074551 - RNA, 15 nt, Homo sapiens
caacccuguuuccug

SEQ ID NO: 1074552 - RNA, 17 nt, Homo sapiens
caacugauccugcucca

SEQ ID NO: 1074553 - RNA, 12 nt, Homo sapiens
caacugugcuac

SEQ ID NO: 1074554 - RNA, 15 nt, Homo sapiens
caacuuuucuagacc

SEQ ID NO: 1074555 - RNA, 17 nt, Homo sapiens
caagccauucacuuccc

SEQ ID NO: 1074556 - RNA, 22 nt, Homo sapiens
caagcuagaaggccacauguca

SEQ ID NO: 1074557 - RNA, 23 nt, Homo sapiens
caagcuagaaggccacaugucac

SEQ ID NO: 1074558 - RNA, 17 nt, Homo sapiens
caaggcacugacugagc

SEQ ID NO: 1074559 - RNA, 19 nt, Homo sapiens
caauugaccuucucccuca

SEQ ID NO: 1074560 - RNA, 20 nt, Homo sapiens
cacaagaagaccagacugug

SEQ ID NO: 1074561 - RNA, 15 nt, Homo sapiens
cacaagccacagaag

SEQ ID NO: 1074562 - RNA, 18 nt, Homo sapiens
cacaagccacagaagcca

SEQ ID NO: 1074563 - RNA, 15 nt, Homo sapiens
cacaaggagaaccca

SEQ ID NO: 1074564 - RNA, 23 nt, Homo sapiens
cacacagcaggaacugagccaga

SEQ ID NO: 1074565 - RNA, 11 nt, Homo sapiens
cacagacugac

SEQ ID NO: 1074566 - RNA, 20 nt, Homo sapiens
cacagaggaagaaaccugga

SEQ ID NO: 1074567 - RNA, 13 nt, Homo sapiens
caccaaagcuggc

SEQ ID NO: 1074568 - RNA, 20 nt, Homo sapiens
caccaaaugaugccacuucc

SEQ ID NO: 1074569 - RNA, 15 nt, Homo sapiens
caccagucacugucc

SEQ ID NO: 1074570 - RNA, 14 nt, Homo sapiens
cacccaugccauag

SEQ ID NO: 1074571 - RNA, 14 nt, Homo sapiens
caccccuacuucac

SEQ ID NO: 1074572 - RNA, 22 nt, Homo sapiens
cacuguuuaacugggagugaua

SEQ ID NO: 1074573 - RNA, 21 nt, Homo sapiens
cacuucgaugacuggauacag

SEQ ID NO: 1074574 - RNA, 22 nt, Homo sapiens
gcaucuucuggagucuccagug

SEQ ID NO: 1074575 - RNA, 17 nt, Homo sapiens
gcauggagagccucuua

SEQ ID NO: 1074576 - RNA, 15 nt, Homo sapiens
gccaaacucugccag

SEQ ID NO: 1074577 - RNA, 18 nt, Homo sapiens
gccaagaaucaagcuaga

SEQ ID NO: 1074578 - RNA, 14 nt, Homo sapiens
gccacccacugacc

SEQ ID NO: 1074579 - RNA, 14 nt, Homo sapiens
gccaggcugugcua

SEQ ID NO: 1074580 - RNA, 23 nt, Homo sapiens
gccagggaaagcccgugucaaug

SEQ ID NO: 1074581 - RNA, 13 nt, Homo sapiens
gccaggugcagug

SEQ ID NO: 1074582 - RNA, 20 nt, Homo sapiens
gcccaggcuggagugcagug

SEQ ID NO: 1074583 - RNA, 22 nt, Homo sapiens
gccccacugacacccagugucc

SEQ ID NO: 1074584 - RNA, 23 nt, Homo sapiens
gcccccuauagucaugggguccc

SEQ ID NO: 1074585 - RNA, 16 nt, Homo sapiens
gccccuccagcacaca

SEQ ID NO: 1074586 - RNA, 14 nt, Homo sapiens
gccccugcucugua

SEQ ID NO: 1074587 - RNA, 21 nt, Homo sapiens
gccgagaucacgccacugcac

SEQ ID NO: 1074588 - RNA, 14 nt, Homo sapiens
gccgggcgcagugg

SEQ ID NO: 1074589 - RNA, 23 nt, Homo sapiens
gccucuagaacacccacuggcca

SEQ ID NO: 1074590 - RNA, 16 nt, Homo sapiens
gccucugaaaugccuc

SEQ ID NO: 1074591 - RNA, 18 nt, Homo sapiens
gccugccaagcucacaca

SEQ ID NO: 1074592 - RNA, 13 nt, Homo sapiens
gccugccuugaag

SEQ ID NO: 1074593 - RNA, 19 nt, Homo sapiens
gccuguaaucccagcacuu

SEQ ID NO: 1074594 - RNA, 20 nt, Homo sapiens
gccuguaaucccagcacuuu

SEQ ID NO: 1074595 - RNA, 22 nt, Homo sapiens
gccuguaaucccagcacuuugg

SEQ ID NO: 1074596 - RNA, 14 nt, Homo sapiens
gcgcaguggcucac

SEQ ID NO: 1074597 - RNA, 17 nt, Homo sapiens
gcgccuccuuccuugcu

SEQ ID NO: 1074598 - RNA, 20 nt, Homo sapiens
gcgucauuuugaaucaucau

SEQ ID NO: 1074599 - RNA, 20 nt, Homo sapiens
gcuacaaaaaacugcaguuu

SEQ ID NO: 1074600 - RNA, 18 nt, Homo sapiens
gcuacauggggucugggu

SEQ ID NO: 1074601 - RNA, 18 nt, Homo sapiens
gcuacucagaagccugag

SEQ ID NO: 1074602 - RNA, 22 nt, Homo sapiens
gcuacuugggaggcugagccag

SEQ ID NO: 1074603 - RNA, 13 nt, Homo sapiens
gcuagaaggccac

SEQ ID NO: 1074604 - RNA, 22 nt, Homo sapiens
gcuaguuuauuggaaguguuca

SEQ ID NO: 1074605 - RNA, 20 nt, Homo sapiens
gcucacaccuguaaucccag

SEQ ID NO: 1074606 - RNA, 11 nt, Homo sapiens
gcucaccucag

SEQ ID NO: 1074607 - RNA, 19 nt, Homo sapiens
gcucuuucucugagaacca

SEQ ID NO: 1074608 - RNA, 21 nt, Homo sapiens
gcugaggggaggaucacugga

SEQ ID NO: 1074609 - RNA, 17 nt, Homo sapiens
gcugaugaugucucuug

SEQ ID NO: 1074610 - RNA, 14 nt, Homo sapiens
gcugcagaaggcca

SEQ ID NO: 1074611 - RNA, 10 nt, Homo sapiens
gcugcugaga

SEQ ID NO: 1074612 - RNA, 19 nt, Homo sapiens
gcugcugagaaucuagccu

SEQ ID NO: 1074613 - RNA, 19 nt, Homo sapiens
gcugugcuagcaacaccca

SEQ ID NO: 1074614 - RNA, 20 nt, Homo sapiens
gcugugcuuuauuugugaaa

SEQ ID NO: 1074615 - RNA, 18 nt, Homo sapiens
gcuguugaugaggccucu

SEQ ID NO: 1074616 - RNA, 13 nt, Homo sapiens
gcuucagccugag

SEQ ID NO: 1074617 - RNA, 14 nt, Homo sapiens
gcuuccacuucuau

SEQ ID NO: 1074618 - RNA, 20 nt, Homo sapiens
gcuucugggccacucaggcc

SEQ ID NO: 1074619 - RNA, 12 nt, Homo sapiens
gcuugcucuccu

SEQ ID NO: 1074620 - RNA, 14 nt, Homo sapiens
gcuuucaacacaca

SEQ ID NO: 1074621 - RNA, 18 nt, Homo sapiens
gcuuuuaagaaacacagg

SEQ ID NO: 1074622 - RNA, 22 nt, Homo sapiens
ggaaaaaacaaauaauaaaugu

SEQ ID NO: 1074623 - RNA, 19 nt, Homo sapiens
ggaaaacacggcccuccug

SEQ ID NO: 1074624 - RNA, 16 nt, Homo sapiens
ggaaagcaucaccuca

SEQ ID NO: 1074625 - RNA, 20 nt, Homo sapiens
ggaagcggagcuugcaguga

SEQ ID NO: 1074626 - RNA, 17 nt, Homo sapiens
ggaagcucccucccuca

SEQ ID NO: 1074627 - RNA, 18 nt, Homo sapiens
ggacaaaacacugugucc

SEQ ID NO: 1074628 - RNA, 14 nt, Homo sapiens
ggaccaggaugaca

SEQ ID NO: 1074629 - RNA, 18 nt, Homo sapiens
cucccugauuaauggagg

SEQ ID NO: 1074630 - RNA, 11 nt, Homo sapiens
cuccugaccaa

SEQ ID NO: 1074631 - RNA, 23 nt, Homo sapiens
cuccuggaaaggcucagucucag

SEQ ID NO: 1074632 - RNA, 13 nt, Homo sapiens
cuccuugcacuuu

SEQ ID NO: 1074633 - RNA, 22 nt, Homo sapiens
cuccuugccuggaacucacuca

SEQ ID NO: 1074634 - RNA, 17 nt, Homo sapiens
cucuacuccuaccucag

SEQ ID NO: 1074635 - RNA, 18 nt, Homo sapiens
cucuacuccuaccucagc

SEQ ID NO: 1074636 - RNA, 17 nt, Homo sapiens
cucuaugaucuuggcac

SEQ ID NO: 1074637 - RNA, 15 nt, Homo sapiens
cucugagaaccaaaa

SEQ ID NO: 1074638 - RNA, 18 nt, Homo sapiens
cucuuguuccgugccagg

SEQ ID NO: 1074639 - RNA, 15 nt, Homo sapiens
cucuuucucugagaa

SEQ ID NO: 1074640 - RNA, 21 nt, Homo sapiens
cucuuucucugagaaccaaaa

SEQ ID NO: 1074641 - RNA, 16 nt, Homo sapiens
cugaaccgacuuuucu

SEQ ID NO: 1074642 - RNA, 23 nt, Homo sapiens
cugacacaggccagccuuggcac

SEQ ID NO: 1074643 - RNA, 20 nt, Homo sapiens
cugacagaaaugcaaucucc

SEQ ID NO: 1074644 - RNA, 23 nt, Homo sapiens
cugacaguguggggaaguguccc

SEQ ID NO: 1074645 - RNA, 21 nt, Homo sapiens
cugacucacaagaagaccaga

SEQ ID NO: 1074646 - RNA, 21 nt, Homo sapiens
cugacucucugugaccugccc

SEQ ID NO: 1074647 - RNA, 14 nt, Homo sapiens
cugagaaucuagcc

SEQ ID NO: 1074648 - RNA, 18 nt, Homo sapiens
cugagcuggaucacuuga

SEQ ID NO: 1074649 - RNA, 23 nt, Homo sapiens
cugauacuuuuuugaaaucagua

SEQ ID NO: 1074650 - RNA, 22 nt, Homo sapiens
cugaugaugucucuuguagaag

SEQ ID NO: 1074651 - RNA, 20 nt, Homo sapiens
cugcacuccagccugggcaa

SEQ ID NO: 1074652 - RNA, 20 nt, Homo sapiens
cugcagacuccaauggggcc

SEQ ID NO: 1074653 - RNA, 17 nt, Homo sapiens
cugcagggacaaacauc

SEQ ID NO: 1074654 - RNA, 21 nt, Homo sapiens
cugcagugacgugcaccugua

SEQ ID NO: 1074655 - RNA, 16 nt, Homo sapiens
cugccaaaacaaugcc

SEQ ID NO: 1074656 - RNA, 17 nt, Homo sapiens
cugccaccagucacugu

SEQ ID NO: 1074657 - RNA, 16 nt, Homo sapiens
cugccagccuggcuuc

SEQ ID NO: 1074658 - RNA, 11 nt, Homo sapiens
cugccagcugc

SEQ ID NO: 1074659 - RNA, 18 nt, Homo sapiens
cugcccugccaccugucu

SEQ ID NO: 1074660 - RNA, 18 nt, Homo sapiens
cugcccuuccuccaggag

SEQ ID NO: 1074661 - RNA, 23 nt, Homo sapiens
cuggaaaggcucagucucaggag

SEQ ID NO: 1074662 - RNA, 20 nt, Homo sapiens
cuggagugcaguggugcgau

SEQ ID NO: 1074663 - RNA, 20 nt, Homo sapiens
cugggaaggggaacacagac

SEQ ID NO: 1074664 - RNA, 15 nt, Homo sapiens
cugggagaaccucag

SEQ ID NO: 1074665 - RNA, 21 nt, Homo sapiens
cugggcaacagaugaagaccc

SEQ ID NO: 1074666 - RNA, 18 nt, Homo sapiens
cuguaaucccagcacuuu

SEQ ID NO: 1074667 - RNA, 21 nt, Homo sapiens
cuguaaucccagcacuuuggg

SEQ ID NO: 1074668 - RNA, 19 nt, Homo sapiens
cuguaauuaauaucuugcu

SEQ ID NO: 1074669 - RNA, 11 nt, Homo sapiens
cugugaccaaa

SEQ ID NO: 1074670 - RNA, 13 nt, Homo sapiens
cugugaccaaagc

SEQ ID NO: 1074671 - RNA, 15 nt, Homo sapiens
cugugaucccagcua

SEQ ID NO: 1074672 - RNA, 22 nt, Homo sapiens
cugugaucccagcuacuuggga

SEQ ID NO: 1074673 - RNA, 15 nt, Homo sapiens
cugugcccagcaugc

SEQ ID NO: 1074674 - RNA, 18 nt, Homo sapiens
cugugcucgggugcugcc

SEQ ID NO: 1074675 - RNA, 15 nt, Homo sapiens
cugugcuuugacuca

SEQ ID NO: 1074676 - RNA, 15 nt, Homo sapiens
cuguugcacugaugu

SEQ ID NO: 1074677 - RNA, 17 nt, Homo sapiens
cuuaaagcugcugucac

SEQ ID NO: 1074678 - RNA, 18 nt, Homo sapiens
cuugauaggacuuccuua

SEQ ID NO: 1074679 - RNA, 21 nt, Homo sapiens
cuugcucuccuggagcaagcu

SEQ ID NO: 1074680 - RNA, 19 nt, Homo sapiens
cuugggaguguugucacac

SEQ ID NO: 1074681 - RNA, 20 nt, Homo sapiens
cuuguaaaggugcugcacug

SEQ ID NO: 1074682 - RNA, 12 nt, Homo sapiens
cuuuaauguugu

SEQ ID NO: 1074683 - RNA, 17 nt, Homo sapiens
cuuucaacucauugcau

SEQ ID NO: 1074684 - RNA, 20 nt, Homo sapiens
cuuucaacucauugcaucau

SEQ ID NO: 1074685 - RNA, 18 nt, Homo sapiens
cuuucaggaauugcccau

SEQ ID NO: 1074686 - RNA, 16 nt, Homo sapiens
cuuucuaaggacccaa

SEQ ID NO: 1074687 - RNA, 13 nt, Homo sapiens
cuuucucugagaa

SEQ ID NO: 1074688 - RNA, 18 nt, Homo sapiens
cuuucucugagaaccaaa

SEQ ID NO: 1074689 - RNA, 21 nt, Homo sapiens
cuuucuggauggcaucuagcc

SEQ ID NO: 1074690 - RNA, 17 nt, Homo sapiens
cuuuuaagaaacacagg

SEQ ID NO: 1074691 - RNA, 18 nt, Homo sapiens
cuuuuaagaaacacaggg

SEQ ID NO: 1074692 - RNA, 19 nt, Homo sapiens
cuuuuaagaaacacagggu

SEQ ID NO: 1074693 - RNA, 16 nt, Homo sapiens
cuuuuucugagcuuuu

SEQ ID NO: 1074694 - RNA, 22 nt, Homo sapiens
cuuuuuuuugagaauacacuau

SEQ ID NO: 1074695 - RNA, 18 nt, Homo sapiens
gaaaaaaaauaauagaaa

SEQ ID NO: 1074696 - RNA, 19 nt, Homo sapiens
gaaaaacauuccaggaaac

SEQ ID NO: 1074697 - RNA, 15 nt, Homo sapiens
gaaaacauaugcauu

SEQ ID NO: 1074698 - RNA, 13 nt, Homo sapiens
gaaaacaugacuu

SEQ ID NO: 1074699 - RNA, 18 nt, Homo sapiens
gaaaagaaaaaaaauaau

SEQ ID NO: 1074700 - RNA, 18 nt, Homo sapiens
gaaaaugcaaguguuuga

SEQ ID NO: 1074701 - RNA, 16 nt, Homo sapiens
gaaacuguuaucacuu

SEQ ID NO: 1074702 - RNA, 19 nt, Homo sapiens
gaaagccucugcugccaug

SEQ ID NO: 1074703 - RNA, 14 nt, Homo sapiens
gaaagggacacaau

SEQ ID NO: 1074704 - RNA, 12 nt, Homo sapiens
gaaaggugcuga

SEQ ID NO: 1074705 - RNA, 15 nt, Homo sapiens
gaaauauucuaugac

SEQ ID NO: 1074706 - RNA, 21 nt, Homo sapiens
gaaccaaaaaaccccagcuau

SEQ ID NO: 1074707 - RNA, 19 nt, Homo sapiens
gaacuccaguacucaccca

SEQ ID NO: 1074708 - RNA, 14 nt, Homo sapiens
gaagaaaacaugac

SEQ ID NO: 1074709 - RNA, 14 nt, Homo sapiens
gaagauauuuauuc

SEQ ID NO: 1074710 - RNA, 20 nt, Homo sapiens
gaagccacugaagcugggau

SEQ ID NO: 1074711 - RNA, 18 nt, Homo sapiens
gaaggagcaagagaacau

SEQ ID NO: 1074712 - RNA, 14 nt, Homo sapiens
gacacaauccucaa

SEQ ID NO: 1074713 - RNA, 20 nt, Homo sapiens
gacacgugauggaccaaagc

SEQ ID NO: 1074714 - RNA, 19 nt, Homo sapiens
gacagugcccaugcaaugg

SEQ ID NO: 1074715 - RNA, 16 nt, Homo sapiens
gacauggaauuaccuu

SEQ ID NO: 1074716 - RNA, 17 nt, Homo sapiens
gacauggaauuaccuua

SEQ ID NO: 1074717 - RNA, 17 nt, Homo sapiens
gaccaaaauguguuuca

SEQ ID NO: 1074718 - RNA, 20 nt, Homo sapiens
gaccaaagacgauacagcuu

SEQ ID NO: 1074719 - RNA, 13 nt, Homo sapiens
gaccaauauucaa

SEQ ID NO: 1074720 - RNA, 21 nt, Homo sapiens
gaccaggaagcucggugagug

SEQ ID NO: 1074721 - RNA, 18 nt, Homo sapiens
gaccaggaugacaccucc

SEQ ID NO: 1074722 - RNA, 22 nt, Homo sapiens
gaccauccuggcuaacacguga

SEQ ID NO: 1074723 - RNA, 16 nt, Homo sapiens
gaccauugucuuccaa

SEQ ID NO: 1074724 - RNA, 19 nt, Homo sapiens
gacccacgaacgcucuuag

SEQ ID NO: 1074725 - RNA, 15 nt, Homo sapiens
gaccccaggcucuua

SEQ ID NO: 1074726 - RNA, 17 nt, Homo sapiens
gaccccuacccacuucc

SEQ ID NO: 1074727 - RNA, 16 nt, Homo sapiens
gaccgaaucucacucu

SEQ ID NO: 1074728 - RNA, 19 nt, Homo sapiens
gaccuuccugccaccaguc

SEQ ID NO: 1074729 - RNA, 23 nt, Homo sapiens
gaccuuccugccaccagucacug

SEQ ID NO: 1074730 - RNA, 14 nt, Homo sapiens
gacuaaguacuugc

SEQ ID NO: 1074731 - RNA, 17 nt, Homo sapiens
gacucacaagaagacca

SEQ ID NO: 1074732 - RNA, 16 nt, Homo sapiens
gacucccgcgugaaga

SEQ ID NO: 1074733 - RNA, 15 nt, Homo sapiens
gacugugaccaaagc

SEQ ID NO: 1074734 - RNA, 20 nt, Homo sapiens
gacuucuggcuuaugcucag

SEQ ID NO: 1074735 - RNA, 17 nt, Homo sapiens
gagacuggagcaucuga

SEQ ID NO: 1074736 - RNA, 21 nt, Homo sapiens
gagaggagggaugcugccuga

SEQ ID NO: 1074737 - RNA, 21 nt, Homo sapiens
gagaggggccugcaggugagc

SEQ ID NO: 1074738 - RNA, 21 nt, Homo sapiens
gagcaaaagacuugagccauc

SEQ ID NO: 1074739 - RNA, 20 nt, Homo sapiens
gagcaccagccccacccaag

SEQ ID NO: 1074740 - RNA, 13 nt, Homo sapiens
gagcacuucuaag

SEQ ID NO: 1074741 - RNA, 11 nt, Homo sapiens
gagccaguucu

SEQ ID NO: 1074742 - RNA, 13 nt, Homo sapiens
gagcccuccaggc

SEQ ID NO: 1074743 - RNA, 16 nt, Homo sapiens
gagcccuggcaggaug

SEQ ID NO: 1074744 - RNA, 12 nt, Homo sapiens
gagccucuuagu

SEQ ID NO: 1074745 - RNA, 18 nt, Homo sapiens
gagcuauuuuaaaccaau

SEQ ID NO: 1074746 - RNA, 15 nt, Homo sapiens
gagcuggaucacuug

SEQ ID NO: 1074747 - RNA, 16 nt, Homo sapiens
gagcuuggcagcugaa

SEQ ID NO: 1074748 - RNA, 19 nt, Homo sapiens
gaggaugguuugagcucag

SEQ ID NO: 1074749 - RNA, 14 nt, Homo sapiens
gaggcagggguccu

SEQ ID NO: 1074750 - RNA, 13 nt, Homo sapiens
gaggcaggugaga

SEQ ID NO: 1074751 - RNA, 16 nt, Homo sapiens
gaggcugagcuggauc

SEQ ID NO: 1074752 - RNA, 21 nt, Homo sapiens
gaggcugagcuggaucacuug

SEQ ID NO: 1074753 - RNA, 12 nt, Homo sapiens
gaggcugcagaa

SEQ ID NO: 1074754 - RNA, 16 nt, Homo sapiens
gaggcugcagaaggcc

SEQ ID NO: 1074755 - RNA, 20 nt, Homo sapiens
gaggggauggggaugcuucc

SEQ ID NO: 1074756 - RNA, 23 nt, Homo sapiens
gaggucaggaguucgaaaccagc

SEQ ID NO: 1074757 - RNA, 16 nt, Homo sapiens
gaggugagaccaccuc

SEQ ID NO: 1074758 - RNA, 18 nt, Homo sapiens
gagguugcagugagccau

SEQ ID NO: 1074759 - RNA, 23 nt, Homo sapiens
gagucacccaugaagacaggaca

SEQ ID NO: 1074760 - RNA, 19 nt, Homo sapiens
gagugagacccugucucaa

SEQ ID NO: 1074761 - RNA, 18 nt, Homo sapiens
gaguuguggaaagccucu

SEQ ID NO: 1074762 - RNA, 20 nt, Homo sapiens
gauaaaucaguuaugucaau

SEQ ID NO: 1074763 - RNA, 16 nt, Homo sapiens
gauacagaaugaaucc

SEQ ID NO: 1074764 - RNA, 14 nt, Homo sapiens
gauauuuuacuuga

SEQ ID NO: 1074765 - RNA, 23 nt, Homo sapiens
gaucaaauuuggguauaugcagu

SEQ ID NO: 1074766 - RNA, 14 nt, Homo sapiens
gaucacucucugcu

SEQ ID NO: 1074767 - RNA, 14 nt, Homo sapiens
gaucccaggccagg

SEQ ID NO: 1074768 - RNA, 14 nt, Homo sapiens
gaucugaacacagu

SEQ ID NO: 1074769 - RNA, 14 nt, Homo sapiens
gaugaaacuccuga

SEQ ID NO: 1074770 - RNA, 21 nt, Homo sapiens
gaugaagacccuauuucagaa

SEQ ID NO: 1074771 - RNA, 14 nt, Homo sapiens
gaugaugugugaaa

SEQ ID NO: 1074772 - RNA, 16 nt, Homo sapiens
gaugcugccugaguca

SEQ ID NO: 1074773 - RNA, 14 nt, Homo sapiens
gauggacucugaaa

SEQ ID NO: 1074774 - RNA, 21 nt, Homo sapiens
gauggcauuuuuugcaaguua

SEQ ID NO: 1074775 - RNA, 13 nt, Homo sapiens
gaugggaucccag

SEQ ID NO: 1074776 - RNA, 17 nt, Homo sapiens
gauguagaacuucaaga

SEQ ID NO: 1074777 - RNA, 15 nt, Homo sapiens
gaugucaggcccaga

SEQ ID NO: 1074778 - RNA, 17 nt, Homo sapiens
gaugucucuuguagaag

SEQ ID NO: 1074779 - RNA, 16 nt, Homo sapiens
gaugugaucacugaga

SEQ ID NO: 1074780 - RNA, 15 nt, Homo sapiens
gauuaauguuuugua

SEQ ID NO: 1074781 - RNA, 17 nt, Homo sapiens
gauuaguacuggauuau

SEQ ID NO: 1074782 - RNA, 17 nt, Homo sapiens
gauuaugccacugcuuu

SEQ ID NO: 1074783 - RNA, 13 nt, Homo sapiens
gauuauuugcacg

SEQ ID NO: 1074784 - RNA, 14 nt, Homo sapiens
gauuuccucuugaa

SEQ ID NO: 1074785 - RNA, 14 nt, Homo sapiens
gauuucucuuugaa

SEQ ID NO: 1074786 - RNA, 22 nt, Homo sapiens
gcaagccuugcuagacagccag

SEQ ID NO: 1074787 - RNA, 22 nt, Homo sapiens
gcaagcucugcccuggcugugg

SEQ ID NO: 1074788 - RNA, 13 nt, Homo sapiens
gcaaggcugugcu

SEQ ID NO: 1074789 - RNA, 14 nt, Homo sapiens
gcaccgagaccaaa

SEQ ID NO: 1074790 - RNA, 16 nt, Homo sapiens
gcacgugccugugauc

SEQ ID NO: 1074791 - RNA, 16 nt, Homo sapiens
gcacuuuaaagcauua

SEQ ID NO: 1074792 - RNA, 14 nt, Homo sapiens
gcagugugcagugg

SEQ ID NO: 1074793 - RNA, 11 nt, Homo sapiens
gcaucagagau

SEQ ID NO: 1074794 - RNA, 16 nt, Homo sapiens
gcaucuucccgcugag

SEQ ID NO: 1074795 - RNA, 15 nt, Homo sapiens
gcauuuuuugcaagu

SEQ ID NO: 1074796 - RNA, 21 nt, Homo sapiens
gccaaaaucccaccacugcac

SEQ ID NO: 1074797 - RNA, 19 nt, Homo sapiens
gccaagaaucaagcuagaa

SEQ ID NO: 1074798 - RNA, 17 nt, Homo sapiens
gccaccagucacugucc

SEQ ID NO: 1074799 - RNA, 18 nt, Homo sapiens
gccagacgugguggcuca

SEQ ID NO: 1074800 - RNA, 16 nt, Homo sapiens
gccagaugccucccca

SEQ ID NO: 1074801 - RNA, 17 nt, Homo sapiens
gccagaugugguggcac

SEQ ID NO: 1074802 - RNA, 15 nt, Homo sapiens
gccagccggacacaa

SEQ ID NO: 1074803 - RNA, 20 nt, Homo sapiens
gccaggagguuggugacuga

SEQ ID NO: 1074804 - RNA, 14 nt, Homo sapiens
gccauucacuuccc

SEQ ID NO: 1074805 - RNA, 20 nt, Homo sapiens
gcccaagguccccguggaug

SEQ ID NO: 1074806 - RNA, 14 nt, Homo sapiens
gcccagcaccugcu

SEQ ID NO: 1074807 - RNA, 14 nt, Homo sapiens
gcccagcugcaccu

SEQ ID NO: 1074808 - RNA, 15 nt, Homo sapiens
gcccagcugcaccug

SEQ ID NO: 1074809 - RNA, 15 nt, Homo sapiens
gcccaggcaggccac

SEQ ID NO: 1074810 - RNA, 19 nt, Homo sapiens
gcccaggcuggagugcagu

SEQ ID NO: 1074811 - RNA, 14 nt, Homo sapiens
gccccaggcugaga

SEQ ID NO: 1074812 - RNA, 14 nt, Homo sapiens
gccccuccagcaca

SEQ ID NO: 1074813 - RNA, 18 nt, Homo sapiens
gccccuccgaugcugagg

SEQ ID NO: 1074814 - RNA, 15 nt, Homo sapiens
gcccucacugcaggg

SEQ ID NO: 1074815 - RNA, 23 nt, Homo sapiens
gcccugacacgugauggaccaaa

SEQ ID NO: 1074816 - RNA, 15 nt, Homo sapiens
gcccugcccugccac

SEQ ID NO: 1074817 - RNA, 18 nt, Homo sapiens
gccguguuacuguugcac

SEQ ID NO: 1074818 - RNA, 18 nt, Homo sapiens
gccuccccauacuuccug

SEQ ID NO: 1074819 - RNA, 21 nt, Homo sapiens
gccugaaugucuuacugugau

SEQ ID NO: 1074820 - RNA, 14 nt, Homo sapiens
gccugagcucugac

SEQ ID NO: 1074821 - RNA, 13 nt, Homo sapiens
gccugccaagcuc

SEQ ID NO: 1074822 - RNA, 17 nt, Homo sapiens
gccuggcccuugagugg

SEQ ID NO: 1074823 - RNA, 15 nt, Homo sapiens
gccuggcuucuggag

SEQ ID NO: 1074824 - RNA, 19 nt, Homo sapiens
gccugugaucccagcuacu

SEQ ID NO: 1074825 - RNA, 15 nt, Homo sapiens
gccuugccaugucuu

SEQ ID NO: 1074826 - RNA, 15 nt, Homo sapiens
gcgccugugcugagg

SEQ ID NO: 1074827 - RNA, 13 nt, Homo sapiens
gcgcucaccucag

SEQ ID NO: 1074828 - RNA, 23 nt, Homo sapiens
gcggagaugcuucuaaggcaugg

SEQ ID NO: 1074829 - RNA, 13 nt, Homo sapiens
gcggcgugggcga

SEQ ID NO: 1074830 - RNA, 15 nt, Homo sapiens
gcgucccuguacaga

SEQ ID NO: 1074831 - RNA, 15 nt, Homo sapiens
gcuacacuugcaccu

SEQ ID NO: 1074832 - RNA, 14 nt, Homo sapiens
gcuacuugcuuuga

SEQ ID NO: 1074833 - RNA, 21 nt, Homo sapiens
gcuagaaggccacaugucacc

SEQ ID NO: 1074834 - RNA, 16 nt, Homo sapiens
gcuagcaacacccaaa

SEQ ID NO: 1074835 - RNA, 16 nt, Homo sapiens
gcuauuuucugaccaa

SEQ ID NO: 1074836 - RNA, 18 nt, Homo sapiens
gcuauuuucugaccaaaa

SEQ ID NO: 1074837 - RNA, 19 nt, Homo sapiens
gcuauuuucugaccaaaau

SEQ ID NO: 1074838 - RNA, 14 nt, Homo sapiens
gcuccagcagcaca

SEQ ID NO: 1074839 - RNA, 17 nt, Homo sapiens
gcucccagggacugaca

SEQ ID NO: 1074840 - RNA, 15 nt, Homo sapiens
gcucccgcuugcucu

SEQ ID NO: 1074841 - RNA, 14 nt, Homo sapiens
gcucgggugcugcc

SEQ ID NO: 1074842 - RNA, 20 nt, Homo sapiens
gcucuggaccaacccuguuu

SEQ ID NO: 1074843 - RNA, 16 nt, Homo sapiens
gcucuguagccaccuc

SEQ ID NO: 1074844 - RNA, 12 nt, Homo sapiens
gcugacacugug

SEQ ID NO: 1074845 - RNA, 21 nt, Homo sapiens
gcugaggcaggaggaucgccu

SEQ ID NO: 1074846 - RNA, 19 nt, Homo sapiens
gcugccccuggugcacugg

SEQ ID NO: 1074847 - RNA, 20 nt, Homo sapiens
gcugcugagaaucuagccuc

SEQ ID NO: 1074848 - RNA, 16 nt, Homo sapiens
gcuggagucucagagc

SEQ ID NO: 1074849 - RNA, 22 nt, Homo sapiens
gcuggaucacuugaguucagga

SEQ ID NO: 1074850 - RNA, 19 nt, Homo sapiens
gcuucaaguguugcucuug

SEQ ID NO: 1074851 - RNA, 16 nt, Homo sapiens
gcuucuggagcccuug

SEQ ID NO: 1074852 - RNA, 13 nt, Homo sapiens
gcuuuccuuccuc

SEQ ID NO: 1074853 - RNA, 16 nt, Homo sapiens
gcuuuccuucugcccu

SEQ ID NO: 1074854 - RNA, 21 nt, Homo sapiens
gcuuuccuucugcccuuccuc

SEQ ID NO: 1074855 - RNA, 19 nt, Homo sapiens
gcuuugacucaccuguuac

SEQ ID NO: 1074856 - RNA, 13 nt, Homo sapiens
ggaaaaccaaaca

SEQ ID NO: 1074857 - RNA, 19 nt, Homo sapiens
ggaaccuccuuaccuggag

SEQ ID NO: 1074858 - RNA, 12 nt, Homo sapiens
ggaauuaccuua

SEQ ID NO: 1074859 - RNA, 23 nt, Homo sapiens
ggacagugcccaugcaauggcuu

SEQ ID NO: 1074860 - RNA, 14 nt, Homo sapiens
ggaccaacccuguu

SEQ ID NO: 1074861 - RNA, 16 nt, Homo sapiens
ggacugugaccaaagc

SEQ ID NO: 1074862 - RNA, 23 nt, Homo sapiens
ggagaaccucaggcuuccuuggc

SEQ ID NO: 1074863 - RNA, 16 nt, Homo sapiens
ggagaacugggguuca

SEQ ID NO: 1074864 - RNA, 14 nt, Homo sapiens
ggagaaugaugucc

SEQ ID NO: 1074865 - RNA, 20 nt, Homo sapiens
ggagguggagguugcaguga

SEQ ID NO: 1074866 - RNA, 14 nt, Homo sapiens
ggagguugcaguga

SEQ ID NO: 1074867 - RNA, 15 nt, Homo sapiens
ggauaacuuccuugc

SEQ ID NO: 1074868 - RNA, 17 nt, Homo sapiens
ggauacagaaugaaucc

SEQ ID NO: 1074869 - RNA, 14 nt, Homo sapiens
ggauggcaccagag

SEQ ID NO: 1074870 - RNA, 17 nt, Homo sapiens
ggcagcuccugaccaaa

SEQ ID NO: 1074871 - RNA, 12 nt, Homo sapiens
ggcagggguccu

SEQ ID NO: 1074872 - RNA, 24 nt, Homo sapiens
ggccagggaaagcccgugucaaug

SEQ ID NO: 1074873 - RNA, 16 nt, Homo sapiens
ggcucagucucaggag

SEQ ID NO: 1074874 - RNA, 14 nt, Homo sapiens
ggcugggcuccuca

SEQ ID NO: 1074875 - RNA, 19 nt, Homo sapiens
ggcuuuuaagaaacacagg

SEQ ID NO: 1074876 - RNA, 14 nt, Homo sapiens
gggagaagggacaa

SEQ ID NO: 1074877 - RNA, 15 nt, Homo sapiens
gggaggcugagccag

SEQ ID NO: 1074878 - RNA, 22 nt, Homo sapiens
gggaugcugccugagucaccca

SEQ ID NO: 1074879 - RNA, 16 nt, Homo sapiens
gggcaagucccugacu

SEQ ID NO: 1074880 - RNA, 18 nt, Homo sapiens
gggcccacccacaugacu

SEQ ID NO: 1074881 - RNA, 22 nt, Homo sapiens
gggcugagcccuggcaggauga

SEQ ID NO: 1074882 - RNA, 14 nt, Homo sapiens
gggcugcccugcca

SEQ ID NO: 1074883 - RNA, 19 nt, Homo sapiens
ggggaccaggaugacaccu

SEQ ID NO: 1074884 - RNA, 14 nt, Homo sapiens
ggggcugcuggccu

SEQ ID NO: 1074885 - RNA, 22 nt, Homo sapiens
ggguaguuuuacccuauaucua

SEQ ID NO: 1074886 - RNA, 18 nt, Homo sapiens
gggucagcccagcaccug

SEQ ID NO: 1074887 - RNA, 14 nt, Homo sapiens
gguaaucagcauua

SEQ ID NO: 1074888 - RNA, 21 nt, Homo sapiens
gguaucaggacugugaccaaa

SEQ ID NO: 1074889 - RNA, 23 nt, Homo sapiens
ggucugggugggggcaaagagac

SEQ ID NO: 1074890 - RNA, 23 nt, Homo sapiens
ggugcaugcacugucucagccaa

SEQ ID NO: 1074891 - RNA, 19 nt, Homo sapiens
ggugcgcucaccucagagc

SEQ ID NO: 1074892 - RNA, 14 nt, Homo sapiens
ggugcugcauugag

SEQ ID NO: 1074893 - RNA, 12 nt, Homo sapiens
gguggcacgugc

SEQ ID NO: 1074894 - RNA, 17 nt, Homo sapiens
gguguuacuaaagucac

SEQ ID NO: 1074895 - RNA, 18 nt, Homo sapiens
guaaucccagcacuuugg

SEQ ID NO: 1074896 - RNA, 20 nt, Homo sapiens
guaaucccagcuacuuggga

SEQ ID NO: 1074897 - RNA, 18 nt, Homo sapiens
guacaaguuuuguauaaa

SEQ ID NO: 1074898 - RNA, 19 nt, Homo sapiens
guacagucagaauaguuau

SEQ ID NO: 1074899 - RNA, 16 nt, Homo sapiens
ugcgggggagccaguu

SEQ ID NO: 1074900 - RNA, 15 nt, Homo sapiens
ugcuacccacagcgu

SEQ ID NO: 1074901 - RNA, 17 nt, Homo sapiens
ugcucuccuggagcaag

SEQ ID NO: 1074902 - RNA, 20 nt, Homo sapiens
ugcugaggccacccacugac

SEQ ID NO: 1074903 - RNA, 12 nt, Homo sapiens
ugcugcgugaca

SEQ ID NO: 1074904 - RNA, 16 nt, Homo sapiens
ugcuggucuauuuuga

SEQ ID NO: 1074905 - RNA, 22 nt, Homo sapiens
ugcuucaaguguugcucuugga

SEQ ID NO: 1074906 - RNA, 12 nt, Homo sapiens
ugcuucagccug

SEQ ID NO: 1074907 - RNA, 20 nt, Homo sapiens
ugcuuuccagccugggcaac

SEQ ID NO: 1074908 - RNA, 13 nt, Homo sapiens
ugcuuugacucac

SEQ ID NO: 1074909 - RNA, 19 nt, Homo sapiens
uggaaagcaucaccucagg

SEQ ID NO: 1074910 - RNA, 18 nt, Homo sapiens
uggaaauauucuaugacc

SEQ ID NO: 1074911 - RNA, 17 nt, Homo sapiens
uggaccugcaccaaagc

SEQ ID NO: 1074912 - RNA, 22 nt, Homo sapiens
uggagaaauaaaaauaccucuu

SEQ ID NO: 1074913 - RNA, 18 nt, Homo sapiens
uggagugcaguggugcga

SEQ ID NO: 1074914 - RNA, 19 nt, Homo sapiens
uggcaauuguccccaggga

SEQ ID NO: 1074915 - RNA, 23 nt, Homo sapiens
uggcccucacugcagggcacugu

SEQ ID NO: 1074916 - RNA, 15 nt, Homo sapiens
uggcucugaagccaa

SEQ ID NO: 1074917 - RNA, 12 nt, Homo sapiens
uggcugcaguga

SEQ ID NO: 1074918 - RNA, 21 nt, Homo sapiens
ugggaaaaaaguuuugaugaa

SEQ ID NO: 1074919 - RNA, 17 nt, Homo sapiens
uggggauucagauuucu

SEQ ID NO: 1074920 - RNA, 18 nt, Homo sapiens
ugguaaaaccccaucucu

SEQ ID NO: 1074921 - RNA, 16 nt, Homo sapiens
uggucuccuugcacuu

SEQ ID NO: 1074922 - RNA, 17 nt, Homo sapiens
uggugacugaaacauuc

SEQ ID NO: 1074923 - RNA, 14 nt, Homo sapiens
uggugaucagugca

SEQ ID NO: 1074924 - RNA, 16 nt, Homo sapiens
uguaaaggucacuuuu

SEQ ID NO: 1074925 - RNA, 14 nt, Homo sapiens
uguaaucaacaugg

SEQ ID NO: 1074926 - RNA, 20 nt, Homo sapiens
uguaaucccagcacuuuggc

SEQ ID NO: 1074927 - RNA, 13 nt, Homo sapiens
uguacacugugua

SEQ ID NO: 1074928 - RNA, 17 nt, Homo sapiens
uguacauuugagugucu

SEQ ID NO: 1074929 - RNA, 15 nt, Homo sapiens
uguagaagauggacu

SEQ ID NO: 1074930 - RNA, 22 nt, Homo sapiens
uguagcaucuucuggagucucc

SEQ ID NO: 1074931 - RNA, 19 nt, Homo sapiens
ugucaccguggaccuuccu

SEQ ID NO: 1074932 - RNA, 14 nt, Homo sapiens
ugucaggacaccag

SEQ ID NO: 1074933 - RNA, 22 nt, Homo sapiens
uguccagaccauugucuuccaa

SEQ ID NO: 1074934 - RNA, 21 nt, Homo sapiens
uguccucccaggaaccaaaaa

SEQ ID NO: 1074935 - RNA, 12 nt, Homo sapiens
ugucggagcaag

SEQ ID NO: 1074936 - RNA, 13 nt, Homo sapiens
ugucuucagagca

SEQ ID NO: 1074937 - RNA, 19 nt, Homo sapiens
ugucuuccaaccccagcug

SEQ ID NO: 1074938 - RNA, 12 nt, Homo sapiens
ugugaaagucag

SEQ ID NO: 1074939 - RNA, 22 nt, Homo sapiens
ugugacuuuuuagccagugacu

SEQ ID NO: 1074940 - RNA, 21 nt, Homo sapiens
ugugcaguggugcaugcacug

SEQ ID NO: 1074941 - RNA, 14 nt, Homo sapiens
ugugcuacacuugc

SEQ ID NO: 1074942 - RNA, 19 nt, Homo sapiens
ugugcucgggugcugccag

SEQ ID NO: 1074943 - RNA, 16 nt, Homo sapiens
ugugguacaaucucaa

SEQ ID NO: 1074944 - RNA, 23 nt, Homo sapiens
ugugguggcacgcgccuguaauc

SEQ ID NO: 1074945 - RNA, 13 nt, Homo sapiens
uguguguagccaa

SEQ ID NO: 1074946 - RNA, 22 nt, Homo sapiens
uguguuauuauuuugcacuguu

SEQ ID NO: 1074947 - RNA, 16 nt, Homo sapiens
uguuauguuugcacuu

SEQ ID NO: 1074948 - RNA, 22 nt, Homo sapiens
uguuccgugccaggcauucaau

SEQ ID NO: 1074949 - RNA, 11 nt, Homo sapiens
uguugauccca

SEQ ID NO: 1074950 - RNA, 12 nt, Homo sapiens
uguugaucccaa

SEQ ID NO: 1074951 - RNA, 21 nt, Homo sapiens
uguugaugaggccucuuggac

SEQ ID NO: 1074952 - RNA, 16 nt, Homo sapiens
uguugucacaccugaa

SEQ ID NO: 1074953 - RNA, 20 nt, Homo sapiens
uguuuaccucuucuaugcaa

SEQ ID NO: 1074954 - RNA, 22 nt, Homo sapiens
uguuucaacaauuuuugaucaa

SEQ ID NO: 1074955 - RNA, 15 nt, Homo sapiens
uuaaaaaacuuucua

SEQ ID NO: 1074956 - RNA, 16 nt, Homo sapiens
uuaaaucauacuccua

SEQ ID NO: 1074957 - RNA, 21 nt, Homo sapiens
uuaaccugaauuauuccaacu

SEQ ID NO: 1074958 - RNA, 18 nt, Homo sapiens
uuaaucuauaacuacaua

SEQ ID NO: 1074959 - RNA, 22 nt, Homo sapiens
uuagaugugcugcuuugauaua

SEQ ID NO: 1074960 - RNA, 17 nt, Homo sapiens
uuagauuagcucuggac

SEQ ID NO: 1074961 - RNA, 13 nt, Homo sapiens
uuagcugaacaau

SEQ ID NO: 1074962 - RNA, 16 nt, Homo sapiens
uuagcugaacaaugaa

SEQ ID NO: 1074963 - RNA, 17 nt, Homo sapiens
uuauagguuuccacugc

SEQ ID NO: 1074964 - RNA, 18 nt, Homo sapiens
uucaaagacagagaagac

SEQ ID NO: 1074965 - RNA, 12 nt, Homo sapiens
uucaagcccagg

SEQ ID NO: 1074966 - RNA, 18 nt, Homo sapiens
uucagggaauuucaggaa

SEQ ID NO: 1074967 - RNA, 16 nt, Homo sapiens
uuccucuugaaccaga

SEQ ID NO: 1074968 - RNA, 23 nt, Homo sapiens
uuccugaaagcuguuggauuuca

SEQ ID NO: 1074969 - RNA, 13 nt, Homo sapiens
uuccugagaccuc

SEQ ID NO: 1074970 - RNA, 17 nt, Homo sapiens
uucuaugcaaaugccuc

SEQ ID NO: 1074971 - RNA, 16 nt, Homo sapiens
uucuaugcaagccuug

SEQ ID NO: 1074972 - RNA, 16 nt, Homo sapiens
uucuauuuucucugau

SEQ ID NO: 1074973 - RNA, 15 nt, Homo sapiens
uucuccuguugcaau

SEQ ID NO: 1074974 - RNA, 17 nt, Homo sapiens
uucucugccuccuccuc

SEQ ID NO: 1074975 - RNA, 13 nt, Homo sapiens
uucugaccaaaau

SEQ ID NO: 1074976 - RNA, 22 nt, Homo sapiens
uucugauuugaagguauaaccu

SEQ ID NO: 1074977 - RNA, 17 nt, Homo sapiens
uucugcccuuccuccag

SEQ ID NO: 1074978 - RNA, 18 nt, Homo sapiens
uucuggauggcaucuagc

SEQ ID NO: 1074979 - RNA, 18 nt, Homo sapiens
uucuuuaauguuguccag

SEQ ID NO: 1074980 - RNA, 21 nt, Homo sapiens
uugaaauaccagugaaccaaa

SEQ ID NO: 1074981 - RNA, 21 nt, Homo sapiens
uugaaggagaaaaugcauuau

SEQ ID NO: 1074982 - RNA, 16 nt, Homo sapiens
uugaguuucucuccac

SEQ ID NO: 1074983 - RNA, 14 nt, Homo sapiens
uugcaaucuauaau

SEQ ID NO: 1074984 - RNA, 16 nt, Homo sapiens
uugcacccaugccaua

SEQ ID NO: 1074985 - RNA, 21 nt, Homo sapiens
uugcccaggcuggagugcagu

SEQ ID NO: 1074986 - RNA, 16 nt, Homo sapiens
uugccuggaagcacau

SEQ ID NO: 1074987 - RNA, 16 nt, Homo sapiens
uugcugacacugugac

SEQ ID NO: 1074988 - RNA, 21 nt, Homo sapiens
uugcuugccgagccuaaugaa

SEQ ID NO: 1074989 - RNA, 17 nt, Homo sapiens
uuggaaagcaucaccuc

SEQ ID NO: 1074990 - RNA, 17 nt, Homo sapiens
uuggacccgcucuggac

SEQ ID NO: 1074991 - RNA, 21 nt, Homo sapiens
uuggacccgcucuggaccaac

SEQ ID NO: 1074992 - RNA, 16 nt, Homo sapiens
uuggccgugaggacac

SEQ ID NO: 1074993 - RNA, 18 nt, Homo sapiens
uugggaugggaucccagg

SEQ ID NO: 1074994 - RNA, 20 nt, Homo sapiens
uugggauuuugguuucuucc

SEQ ID NO: 1074995 - RNA, 21 nt, Homo sapiens
uugucauuagugagacauauu

SEQ ID NO: 1074996 - RNA, 22 nt, Homo sapiens
uuguguguguguguugauccca

SEQ ID NO: 1074997 - RNA, 16 nt, Homo sapiens
uuguucagaagacaca

SEQ ID NO: 1074998 - RNA, 20 nt, Homo sapiens
uuuaaaaaacuuucuacuca

SEQ ID NO: 1074999 - RNA, 15 nt, Homo sapiens
uuuaauaucugagaa

SEQ ID NO: 1075000 - RNA, 21 nt, Homo sapiens
uuuagaugugcugcuuugaua

SEQ ID NO: 1075001 - RNA, 19 nt, Homo sapiens
uuuaucguccagugacuuu

SEQ ID NO: 1075002 - RNA, 18 nt, Homo sapiens
uuucaaccgcuugccaua

SEQ ID NO: 1075003 - RNA, 15 nt, Homo sapiens
uuucaacucauugca

SEQ ID NO: 1075004 - RNA, 17 nt, Homo sapiens
uuucagagccagugaag

SEQ ID NO: 1075005 - RNA, 17 nt, Homo sapiens
uuucaggaauugcccau

SEQ ID NO: 1075006 - RNA, 22 nt, Homo sapiens
uuucauggaaguggcagugaaa

SEQ ID NO: 1075007 - RNA, 21 nt, Homo sapiens
uuuccauaaacacccaugaau

SEQ ID NO: 1075008 - RNA, 23 nt, Homo sapiens
uuucuaaagcucugaacaaaagc

SEQ ID NO: 1075009 - RNA, 17 nt, Homo sapiens
cuuggaaagcugaugau

SEQ ID NO: 1075010 - RNA, 21 nt, Homo sapiens
cuugguuuuuggcucuuucag

SEQ ID NO: 1075011 - RNA, 23 nt, Homo sapiens
cuuguguguguguguugauccca

SEQ ID NO: 1075012 - RNA, 18 nt, Homo sapiens
cuuucaacucauugcauc

SEQ ID NO: 1075013 - RNA, 17 nt, Homo sapiens
cuuucacauagcacaga

SEQ ID NO: 1075014 - RNA, 14 nt, Homo sapiens
cuuucagcauuagg

SEQ ID NO: 1075015 - RNA, 15 nt, Homo sapiens
cuuucugggccaagu

SEQ ID NO: 1075016 - RNA, 15 nt, Homo sapiens
cuuuuaagaaacaca

SEQ ID NO: 1075017 - RNA, 14 nt, Homo sapiens
cuuuuuaaaaaacu

SEQ ID NO: 1075018 - RNA, 19 nt, Homo sapiens
cuuuuugggagaaugaugu

SEQ ID NO: 1075019 - RNA, 22 nt, Homo sapiens
gaaaaccucauuuaccauaaaa

SEQ ID NO: 1075020 - RNA, 12 nt, Homo sapiens
gaaaaugcauua

SEQ ID NO: 1075021 - RNA, 20 nt, Homo sapiens
gaaaccuguccauaaaguaa

SEQ ID NO: 1075022 - RNA, 20 nt, Homo sapiens
gaaacuuuaaugaggaaaaa

SEQ ID NO: 1075023 - RNA, 16 nt, Homo sapiens
gaaagaaaaauaccau

SEQ ID NO: 1075024 - RNA, 13 nt, Homo sapiens
gaaaggcucaguc

SEQ ID NO: 1075025 - RNA, 15 nt, Homo sapiens
gaaaguuugcacugu

SEQ ID NO: 1075026 - RNA, 15 nt, Homo sapiens
gaaauaccagugaac

SEQ ID NO: 1075027 - RNA, 17 nt, Homo sapiens
gaaauaccagugaacca

SEQ ID NO: 1075028 - RNA, 20 nt, Homo sapiens
gaaaucaguaaacacugugu

SEQ ID NO: 1075029 - RNA, 12 nt, Homo sapiens
gaaaucugccaa

SEQ ID NO: 1075030 - RNA, 13 nt, Homo sapiens
gaaaucugccaau

SEQ ID NO: 1075031 - RNA, 20 nt, Homo sapiens
gaaauucaaccugugucuua

SEQ ID NO: 1075032 - RNA, 18 nt, Homo sapiens
gaaauuucccacacccca

SEQ ID NO: 1075033 - RNA, 21 nt, Homo sapiens
gaacacaguuuagugcuuuac

SEQ ID NO: 1075034 - RNA, 21 nt, Homo sapiens
gaacauuccucugcagcacuu

SEQ ID NO: 1075035 - RNA, 16 nt, Homo sapiens
gaacccuuccugagac

SEQ ID NO: 1075036 - RNA, 16 nt, Homo sapiens
gaaccgugauaagccu

SEQ ID NO: 1075037 - RNA, 13 nt, Homo sapiens
gaacgcucuuagc

SEQ ID NO: 1075038 - RNA, 15 nt, Homo sapiens
gaacuggacugugug

SEQ ID NO: 1075039 - RNA, 15 nt, Homo sapiens
gaagaaaacaugacu

SEQ ID NO: 1075040 - RNA, 19 nt, Homo sapiens
gaagcggagcuugcaguga

SEQ ID NO: 1075041 - RNA, 22 nt, Homo sapiens
gaagcucccucccucacugugg

SEQ ID NO: 1075042 - RNA, 12 nt, Homo sapiens
gaaggagaaaau

SEQ ID NO: 1075043 - RNA, 16 nt, Homo sapiens
gaagggugacauccca

SEQ ID NO: 1075044 - RNA, 22 nt, Homo sapiens
gaaguuuugaguuucucuccac

SEQ ID NO: 1075045 - RNA, 14 nt, Homo sapiens
gaauaagcacuuuu

SEQ ID NO: 1075046 - RNA, 17 nt, Homo sapiens
gaauauuuauucaguga

SEQ ID NO: 1075047 - RNA, 18 nt, Homo sapiens
gaauauuuauucagugac

SEQ ID NO: 1075048 - RNA, 15 nt, Homo sapiens
gaaucuguaugauuc

SEQ ID NO: 1075049 - RNA, 18 nt, Homo sapiens
gaaucuucugaaaccaaa

SEQ ID NO: 1075050 - RNA, 20 nt, Homo sapiens
gaauugcaaucuauaauauu

SEQ ID NO: 1075051 - RNA, 14 nt, Homo sapiens
gacaaaacacugug

SEQ ID NO: 1075052 - RNA, 15 nt, Homo sapiens
gacaaaacacugugu

SEQ ID NO: 1075053 - RNA, 20 nt, Homo sapiens
gacacaagcggcccugacac

SEQ ID NO: 1075054 - RNA, 15 nt, Homo sapiens
gacaccuccauuucu

SEQ ID NO: 1075055 - RNA, 21 nt, Homo sapiens
gacaccuccauuucucuccag

SEQ ID NO: 1075056 - RNA, 18 nt, Homo sapiens
gacacgugauggaccaaa

SEQ ID NO: 1075057 - RNA, 23 nt, Homo sapiens
gacagagugagacccugucucaa

SEQ ID NO: 1075058 - RNA, 15 nt, Homo sapiens
gacaugacuaggaag

SEQ ID NO: 1075059 - RNA, 19 nt, Homo sapiens
gaccaccucucaauauuca

SEQ ID NO: 1075060 - RNA, 14 nt, Homo sapiens
gaccagcucucuuc

SEQ ID NO: 1075061 - RNA, 20 nt, Homo sapiens
gacccaaagaccaauauuca

SEQ ID NO: 1075062 - RNA, 14 nt, Homo sapiens
gacccacccagugu

SEQ ID NO: 1075063 - RNA, 17 nt, Homo sapiens
gacccgcucuggaccaa

SEQ ID NO: 1075064 - RNA, 23 nt, Homo sapiens
gacccuaaauguggacaucauga

SEQ ID NO: 1075065 - RNA, 18 nt, Homo sapiens
gacucacaagaagaccag

SEQ ID NO: 1075066 - RNA, 15 nt, Homo sapiens
gacugugugcaacgc

SEQ ID NO: 1075067 - RNA, 12 nt, Homo sapiens
gagaaacaggcc

SEQ ID NO: 1075068 - RNA, 17 nt, Homo sapiens
gagaccaggccugagca

SEQ ID NO: 1075069 - RNA, 14 nt, Homo sapiens
gagacugcgggaug

SEQ ID NO: 1075070 - RNA, 14 nt, Homo sapiens
gagaucgagaccau

SEQ ID NO: 1075071 - RNA, 15 nt, Homo sapiens
gagcaccagccccac

SEQ ID NO: 1075072 - RNA, 17 nt, Homo sapiens
gagccucguguccugcu

SEQ ID NO: 1075073 - RNA, 19 nt, Homo sapiens
gagcgagacuccgucucaa

SEQ ID NO: 1075074 - RNA, 15 nt, Homo sapiens
gaggaaacaggccuc

SEQ ID NO: 1075075 - RNA, 22 nt, Homo sapiens
gaggaaacuaguguuuguuaaa

SEQ ID NO: 1075076 - RNA, 17 nt, Homo sapiens
gaggcagggguccugca

SEQ ID NO: 1075077 - RNA, 15 nt, Homo sapiens
gaggcuuccagagag

SEQ ID NO: 1075078 - RNA, 12 nt, Homo sapiens
gaggcuuggaaa

SEQ ID NO: 1075079 - RNA, 13 nt, Homo sapiens
gagguugcaguga

SEQ ID NO: 1075080 - RNA, 17 nt, Homo sapiens
ccucugcuuuugcacac

SEQ ID NO: 1075081 - RNA, 20 nt, Homo sapiens
ccucuuuauuuuuugauuga

SEQ ID NO: 1075082 - RNA, 12 nt, Homo sapiens
ccugaaagccag

SEQ ID NO: 1075083 - RNA, 21 nt, Homo sapiens
ccugaaagcuguuggauuuca

SEQ ID NO: 1075084 - RNA, 20 nt, Homo sapiens
ccugaagggugacaucccag

SEQ ID NO: 1075085 - RNA, 19 nt, Homo sapiens
ccugcaggugagcaggcag

SEQ ID NO: 1075086 - RNA, 17 nt, Homo sapiens
ccugcucccagguugag

SEQ ID NO: 1075087 - RNA, 15 nt, Homo sapiens
ccugcucugcuuccu

SEQ ID NO: 1075088 - RNA, 22 nt, Homo sapiens
ccugcucuuucucugagaacca

SEQ ID NO: 1075089 - RNA, 21 nt, Homo sapiens
ccugcugcgggggagccaguu

SEQ ID NO: 1075090 - RNA, 18 nt, Homo sapiens
ccuggagcaagcucugcc

SEQ ID NO: 1075091 - RNA, 21 nt, Homo sapiens
ccuggcacacccagucguccu

SEQ ID NO: 1075092 - RNA, 21 nt, Homo sapiens
ccuggcuguggguaucaggac

SEQ ID NO: 1075093 - RNA, 13 nt, Homo sapiens
ccuguaacacaag

SEQ ID NO: 1075094 - RNA, 15 nt, Homo sapiens
ccuguccauaaagua

SEQ ID NO: 1075095 - RNA, 13 nt, Homo sapiens
ccugugugucugc

SEQ ID NO: 1075096 - RNA, 12 nt, Homo sapiens
ccuuaagccagg

SEQ ID NO: 1075097 - RNA, 20 nt, Homo sapiens
ccuucaaguuagcucaggag

SEQ ID NO: 1075098 - RNA, 14 nt, Homo sapiens
ccuugccaugucuu

SEQ ID NO: 1075099 - RNA, 16 nt, Homo sapiens
ccuugccuggaacuca

SEQ ID NO: 1075100 - RNA, 13 nt, Homo sapiens
ccuuggccgugag

SEQ ID NO: 1075101 - RNA, 17 nt, Homo sapiens
ccuuuacucugcucuau

SEQ ID NO: 1075102 - RNA, 21 nt, Homo sapiens
ccuuuggcuaucuacugagac

SEQ ID NO: 1075103 - RNA, 12 nt, Homo sapiens
cgcaguggcuca

SEQ ID NO: 1075104 - RNA, 15 nt, Homo sapiens
cgccuaugaucccag

SEQ ID NO: 1075105 - RNA, 13 nt, Homo sapiens
cgcgccuguaauc

SEQ ID NO: 1075106 - RNA, 14 nt, Homo sapiens
cggacagugcccau

SEQ ID NO: 1075107 - RNA, 20 nt, Homo sapiens
cggagcuugcagugagccga

SEQ ID NO: 1075108 - RNA, 18 nt, Homo sapiens
cggcauccugaaagccag

SEQ ID NO: 1075109 - RNA, 22 nt, Homo sapiens
cggccacaugccgcgucccugc

SEQ ID NO: 1075110 - RNA, 12 nt, Homo sapiens
cgggaaaaccaa

SEQ ID NO: 1075111 - RNA, 22 nt, Homo sapiens
cgggacagaccagcagcaaucu

SEQ ID NO: 1075112 - RNA, 15 nt, Homo sapiens
cggggcccuguguag

SEQ ID NO: 1075113 - RNA, 15 nt, Homo sapiens
cggguggaucaccug

SEQ ID NO: 1075114 - RNA, 14 nt, Homo sapiens
cguguccugcuagc

SEQ ID NO: 1075115 - RNA, 21 nt, Homo sapiens
cuaaagucacauauaaaaguu

SEQ ID NO: 1075116 - RNA, 22 nt, Homo sapiens
cuaaauaguucuaucaggaaaa

SEQ ID NO: 1075117 - RNA, 19 nt, Homo sapiens
cuaauuggaagaaauuccu

SEQ ID NO: 1075118 - RNA, 21 nt, Homo sapiens
cuacaaaaaacugcaguuuga

SEQ ID NO: 1075119 - RNA, 11 nt, Homo sapiens
cuacacauaua

SEQ ID NO: 1075120 - RNA, 17 nt, Homo sapiens
cuacugagacaugacua

SEQ ID NO: 1075121 - RNA, 16 nt, Homo sapiens
cuacuuguaaaggugc

SEQ ID NO: 1075122 - RNA, 20 nt, Homo sapiens
cuacuuguaaaggugcugca

SEQ ID NO: 1075123 - RNA, 16 nt, Homo sapiens
cuagaaaucugccaau

SEQ ID NO: 1075124 - RNA, 19 nt, Homo sapiens
agagcgagacuccgucuca

SEQ ID NO: 1075125 - RNA, 14 nt, Homo sapiens
agagggcccaggca

SEQ ID NO: 1075126 - RNA, 19 nt, Homo sapiens
agagguggagguugcagug

SEQ ID NO: 1075127 - RNA, 23 nt, Homo sapiens
agagguggagguugcagugagcc

SEQ ID NO: 1075128 - RNA, 14 nt, Homo sapiens
agaguccucuggau

SEQ ID NO: 1075129 - RNA, 18 nt, Homo sapiens
agaguccucuggauggca

SEQ ID NO: 1075130 - RNA, 21 nt, Homo sapiens
agaucagagcugcagccaguc

SEQ ID NO: 1075131 - RNA, 20 nt, Homo sapiens
agaugugcugcuuugauaua

SEQ ID NO: 1075132 - RNA, 13 nt, Homo sapiens
agauuaaaucaua

SEQ ID NO: 1075133 - RNA, 16 nt, Homo sapiens
agauugcgccacugca

SEQ ID NO: 1075134 - RNA, 23 nt, Homo sapiens
agauuguucuguccaguuuccaa

SEQ ID NO: 1075135 - RNA, 14 nt, Homo sapiens
agcaacugugcuac

SEQ ID NO: 1075136 - RNA, 14 nt, Homo sapiens
agcaagauguacua

SEQ ID NO: 1075137 - RNA, 14 nt, Homo sapiens
agcaagcucugccc

SEQ ID NO: 1075138 - RNA, 12 nt, Homo sapiens
agcacaccucag

SEQ ID NO: 1075139 - RNA, 20 nt, Homo sapiens
agcagaagcacauaugaacu

SEQ ID NO: 1075140 - RNA, 16 nt, Homo sapiens
agcagacauuuaucuu

SEQ ID NO: 1075141 - RNA, 18 nt, Homo sapiens
uauuagcaacugugcuac

SEQ ID NO: 1075142 - RNA, 17 nt, Homo sapiens
uauucaauaaagcugcu

SEQ ID NO: 1075143 - RNA, 19 nt, Homo sapiens
uauuccucuugcauuucac

SEQ ID NO: 1075144 - RNA, 20 nt, Homo sapiens
uauugccucugaaaugccuc

SEQ ID NO: 1075145 - RNA, 15 nt, Homo sapiens
uauuuuaaaccaauu

SEQ ID NO: 1075146 - RNA, 16 nt, Homo sapiens
ucaaaugacccaaaga

SEQ ID NO: 1075147 - RNA, 17 nt, Homo sapiens
ucaaaugacccaaagac

SEQ ID NO: 1075148 - RNA, 22 nt, Homo sapiens
ucaaaugacccaaagaccaaua

SEQ ID NO: 1075149 - RNA, 12 nt, Homo sapiens
ucaccauucaaa

SEQ ID NO: 1075150 - RNA, 21 nt, Homo sapiens
ucaccguggaccuuccugcca

SEQ ID NO: 1075151 - RNA, 23 nt, Homo sapiens
ucacgugucuuuagaacuccagu

SEQ ID NO: 1075152 - RNA, 17 nt, Homo sapiens
ucacugcagggcacugu

SEQ ID NO: 1075153 - RNA, 15 nt, Homo sapiens
ucacuucugucuccu

SEQ ID NO: 1075154 - RNA, 17 nt, Homo sapiens
ucagacucccgcgugaa

SEQ ID NO: 1075155 - RNA, 21 nt, Homo sapiens
ucagacugcugggacuggcca

SEQ ID NO: 1075156 - RNA, 20 nt, Homo sapiens
ucagaucugaacacaguuua

SEQ ID NO: 1075157 - RNA, 17 nt, Homo sapiens
ucagauuucucuuugaa

SEQ ID NO: 1075158 - RNA, 18 nt, Homo sapiens
ucaggagaucgagaccau

SEQ ID NO: 1075159 - RNA, 17 nt, Homo sapiens
ucaggaguuggagacca

SEQ ID NO: 1075160 - RNA, 18 nt, Homo sapiens
ucaggccaggugcagugg

SEQ ID NO: 1075161 - RNA, 18 nt, Homo sapiens
ucagggcaguacaaugug

SEQ ID NO: 1075162 - RNA, 19 nt, Homo sapiens
ucagguucuuucugaaauc

SEQ ID NO: 1075163 - RNA, 20 nt, Homo sapiens
ucaucuccagcuaacugugg

SEQ ID NO: 1075164 - RNA, 19 nt, Homo sapiens
ucauggaaguggcagugaa

SEQ ID NO: 1075165 - RNA, 15 nt, Homo sapiens
ucauggggucccugc

SEQ ID NO: 1075166 - RNA, 12 nt, Homo sapiens
ucauugcaccug

SEQ ID NO: 1075167 - RNA, 17 nt, Homo sapiens
ucauuguagaaacacag

SEQ ID NO: 1075168 - RNA, 13 nt, Homo sapiens
ucauuuaccauaa

SEQ ID NO: 1075169 - RNA, 21 nt, Homo sapiens
ucauuuauucuucuuuuccaa

SEQ ID NO: 1075170 - RNA, 13 nt, Homo sapiens
uccaaaugccaac

SEQ ID NO: 1075171 - RNA, 19 nt, Homo sapiens
uccagaccauugucuucca

SEQ ID NO: 1075172 - RNA, 13 nt, Homo sapiens
uccagucuggauc

SEQ ID NO: 1075173 - RNA, 18 nt, Homo sapiens
uccauaaacacccaugaa

SEQ ID NO: 1075174 - RNA, 15 nt, Homo sapiens
ucccaaacuacagaa

SEQ ID NO: 1075175 - RNA, 10 nt, Homo sapiens
ucccaaagaa

SEQ ID NO: 1075176 - RNA, 23 nt, Homo sapiens
ucccaccucuucucuuccuguaa

SEQ ID NO: 1075177 - RNA, 15 nt, Homo sapiens
ucccagcuacucggg

SEQ ID NO: 1075178 - RNA, 16 nt, Homo sapiens
ucccaggaaccaaaaa

SEQ ID NO: 1075179 - RNA, 22 nt, Homo sapiens
uccccagguggaggugccagga

SEQ ID NO: 1075180 - RNA, 19 nt, Homo sapiens
ucccgcgugaagaugucac

SEQ ID NO: 1075181 - RNA, 19 nt, Homo sapiens
ucccucaaaugacccaaag

SEQ ID NO: 1075182 - RNA, 17 nt, Homo sapiens
ucccugaggcaggugag

SEQ ID NO: 1075183 - RNA, 19 nt, Homo sapiens
ucccuucgauauaugacuu

SEQ ID NO: 1075184 - RNA, 23 nt, Homo sapiens
uccgugguggcaccgagaccaaa

SEQ ID NO: 1075185 - RNA, 12 nt, Homo sapiens
uccuaccucagc

SEQ ID NO: 1075186 - RNA, 19 nt, Homo sapiens
uccuaggccacaccaucuc

SEQ ID NO: 1075187 - RNA, 20 nt, Homo sapiens
uccuaggccacaccaucucc

SEQ ID NO: 1075188 - RNA, 20 nt, Homo sapiens
uccuccauggugcugcauug

SEQ ID NO: 1075189 - RNA, 13 nt, Homo sapiens
uccugaccaaaga

SEQ ID NO: 1075190 - RNA, 21 nt, Homo sapiens
uccugcuccagcagcacaccu

SEQ ID NO: 1075191 - RNA, 16 nt, Homo sapiens
uccuggcuaacacgug

SEQ ID NO: 1075192 - RNA, 18 nt, Homo sapiens
uccugggagaaccucagg

SEQ ID NO: 1075193 - RNA, 20 nt, Homo sapiens
uccugggagaaccucaggcu

SEQ ID NO: 1075194 - RNA, 24 nt, Homo sapiens
uccuguugcaaugacacauaggaa

SEQ ID NO: 1075195 - RNA, 13 nt, Homo sapiens
ucgagcugugcuc

SEQ ID NO: 1075196 - RNA, 22 nt, Homo sapiens
ucgccguguuacuguugcacug

SEQ ID NO: 1075197 - RNA, 13 nt, Homo sapiens
cagucuuggaaua

SEQ ID NO: 1075198 - RNA, 14 nt, Homo sapiens
cagucuuucaacuc

SEQ ID NO: 1075199 - RNA, 15 nt, Homo sapiens
cagugaaccaaagag

SEQ ID NO: 1075200 - RNA, 20 nt, Homo sapiens
cagugagccgagauugcgcc

SEQ ID NO: 1075201 - RNA, 20 nt, Homo sapiens
cagugcagggaaccgugaua

SEQ ID NO: 1075202 - RNA, 17 nt, Homo sapiens
cagugcuucagccugag

SEQ ID NO: 1075203 - RNA, 22 nt, Homo sapiens
caguguggggaagugucccugu

SEQ ID NO: 1075204 - RNA, 16 nt, Homo sapiens
caguugcccucaggcc

SEQ ID NO: 1075205 - RNA, 14 nt, Homo sapiens
cauagaauugcaau

SEQ ID NO: 1075206 - RNA, 16 nt, Homo sapiens
cauaugcuucuuuaaa

SEQ ID NO: 1075207 - RNA, 13 nt, Homo sapiens
caucuagccagag

SEQ ID NO: 1075208 - RNA, 13 nt, Homo sapiens
caucucugugacc

SEQ ID NO: 1075209 - RNA, 14 nt, Homo sapiens
caucugacucacaa

SEQ ID NO: 1075210 - RNA, 15 nt, Homo sapiens
caucugacucacaag

SEQ ID NO: 1075211 - RNA, 14 nt, Homo sapiens
caucuucuggaguc

SEQ ID NO: 1075212 - RNA, 13 nt, Homo sapiens
caucuuuuccauc

SEQ ID NO: 1075213 - RNA, 15 nt, Homo sapiens
caugaugaauuacuu

SEQ ID NO: 1075214 - RNA, 13 nt, Homo sapiens
cauggaauuaccu

SEQ ID NO: 1075215 - RNA, 20 nt, Homo sapiens
caugguaaaaccccaucucu

SEQ ID NO: 1075216 - RNA, 20 nt, Homo sapiens
cauggugaaaccccgucucu

SEQ ID NO: 1075217 - RNA, 22 nt, Homo sapiens
cauguaaucaacauggcuacuu

SEQ ID NO: 1075218 - RNA, 17 nt, Homo sapiens
cauguuugguaccaaga

SEQ ID NO: 1075219 - RNA, 17 nt, Homo sapiens
cauuaccauggagacaa

SEQ ID NO: 1075220 - RNA, 17 nt, Homo sapiens
cauuauuucaaccgcuu

SEQ ID NO: 1075221 - RNA, 23 nt, Homo sapiens
cauuauuucaaccgcuugccaua

SEQ ID NO: 1075222 - RNA, 14 nt, Homo sapiens
cauugaguccagcu

SEQ ID NO: 1075223 - RNA, 17 nt, Homo sapiens
cauugucagccugaaga

SEQ ID NO: 1075224 - RNA, 19 nt, Homo sapiens
cauuguuuuucugauaugu

SEQ ID NO: 1075225 - RNA, 22 nt, Homo sapiens
cauuuguguuauuauuuugcac

SEQ ID NO: 1075226 - RNA, 20 nt, Homo sapiens
cauuuugaaucaucauguga

SEQ ID NO: 1075227 - RNA, 14 nt, Homo sapiens
cauuuuuuuucucu

SEQ ID NO: 1075228 - RNA, 16 nt, Homo sapiens
ccaaacacguucccua

SEQ ID NO: 1075229 - RNA, 18 nt, Homo sapiens
ccaaacacguucccuaau

SEQ ID NO: 1075230 - RNA, 11 nt, Homo sapiens
ccaaaugaugc

SEQ ID NO: 1075231 - RNA, 17 nt, Homo sapiens
ccaaccccccaccugcc

SEQ ID NO: 1075232 - RNA, 14 nt, Homo sapiens
ccacagaagccagg

SEQ ID NO: 1075233 - RNA, 12 nt, Homo sapiens
ccacccacugac

SEQ ID NO: 1075234 - RNA, 10 nt, Homo sapiens
ccaccucuca

SEQ ID NO: 1075235 - RNA, 18 nt, Homo sapiens
ccacgcaaggcugugcuc

SEQ ID NO: 1075236 - RNA, 19 nt, Homo sapiens
ccacuacccggcaggguac

SEQ ID NO: 1075237 - RNA, 11 nt, Homo sapiens
ccacucaggcc

SEQ ID NO: 1075238 - RNA, 21 nt, Homo sapiens
ccagaauggaauuuugcuaca

SEQ ID NO: 1075239 - RNA, 11 nt, Homo sapiens
ccagacugugg

SEQ ID NO: 1075240 - RNA, 18 nt, Homo sapiens
ccagaggcagagccugag

SEQ ID NO: 1075241 - RNA, 16 nt, Homo sapiens
ccagcacuuugggagg

SEQ ID NO: 1075242 - RNA, 19 nt, Homo sapiens
ccagcuauuuucugaccaa

SEQ ID NO: 1075243 - RNA, 22 nt, Homo sapiens
ccagcuauuuucugaccaaaau

SEQ ID NO: 1075244 - RNA, 14 nt, Homo sapiens
ccagcuuccugugu

SEQ ID NO: 1075245 - RNA, 18 nt, Homo sapiens
ccaggccugagcaacaaa

SEQ ID NO: 1075246 - RNA, 13 nt, Homo sapiens
ccagggguucuga

SEQ ID NO: 1075247 - RNA, 15 nt, Homo sapiens
ccagugaaccaaaga

SEQ ID NO: 1075248 - RNA, 16 nt, Homo sapiens
ccagugaaccaaagag

SEQ ID NO: 1075249 - RNA, 16 nt, Homo sapiens
ccauaaacacccauga

SEQ ID NO: 1075250 - RNA, 17 nt, Homo sapiens
ccaucuccuuucaggga

SEQ ID NO: 1075251 - RNA, 17 nt, Homo sapiens
ccaugcauggugcauca

SEQ ID NO: 1075252 - RNA, 14 nt, Homo sapiens
cccaggaaccaaaa

SEQ ID NO: 1075253 - RNA, 22 nt, Homo sapiens
ccccaccugccauuugcacccu

SEQ ID NO: 1075254 - RNA, 23 nt, Homo sapiens
ccccagcuauuuucugaccaaaa

SEQ ID NO: 1075255 - RNA, 23 nt, Homo sapiens
ccccagugcagggaaccgugaua

SEQ ID NO: 1075256 - RNA, 22 nt, Homo sapiens
cccuaaauguggacaucaugaa

SEQ ID NO: 1075257 - RNA, 20 nt, Homo sapiens
cccuauaucuauaaacacug

SEQ ID NO: 1075258 - RNA, 18 nt, Homo sapiens
cccucccaaggagccauu

SEQ ID NO: 1075259 - RNA, 15 nt, Homo sapiens
cccucccugaggcag

SEQ ID NO: 1075260 - RNA, 16 nt, Homo sapiens
cccucuacuccaugca

SEQ ID NO: 1075261 - RNA, 22 nt, Homo sapiens
cccucugccccaucauugcacc

SEQ ID NO: 1075262 - RNA, 23 nt, Homo sapiens
cccugacacgugauggaccaaag

SEQ ID NO: 1075263 - RNA, 16 nt, Homo sapiens
ccgauguccgugggca

SEQ ID NO: 1075264 - RNA, 18 nt, Homo sapiens
ccgccuccaaaugccaac

SEQ ID NO: 1075265 - RNA, 16 nt, Homo sapiens
ccgugccaggcauuca

SEQ ID NO: 1075266 - RNA, 16 nt, Homo sapiens
ccguuugagugucugc

SEQ ID NO: 1075267 - RNA, 23 nt, Homo sapiens
ccuaaaauaucuggguggcuuaa

SEQ ID NO: 1075268 - RNA, 17 nt, Homo sapiens
ccucagccccacugaca

SEQ ID NO: 1075269 - RNA, 16 nt, Homo sapiens
ccuccaaaugccaacu

SEQ ID NO: 1075270 - RNA, 15 nt, Homo sapiens
ccucccaggaaccaa

SEQ ID NO: 1075271 - RNA, 12 nt, Homo sapiens
ccuccuuggcac

SEQ ID NO: 1075272 - RNA, 13 nt, Homo sapiens
ccucuaguguccg

SEQ ID NO: 1075273 - RNA, 15 nt, Homo sapiens
ccucugaaaugccuc

SEQ ID NO: 1075274 - RNA, 19 nt, Homo sapiens
ccucugaaauuucccacac

SEQ ID NO: 1075275 - RNA, 14 nt, Homo sapiens
ccucuugaaccaga

SEQ ID NO: 1075276 - RNA, 21 nt, Homo sapiens
ccucuuggaccucugcucuga

SEQ ID NO: 1075277 - RNA, 17 nt, Homo sapiens
ccugaaaauuaugaguc

SEQ ID NO: 1075278 - RNA, 20 nt, Homo sapiens
ccugagcccaggagguggag

SEQ ID NO: 1075279 - RNA, 19 nt, Homo sapiens
ccugaguuugggauugugg

SEQ ID NO: 1075280 - RNA, 17 nt, Homo sapiens
ccugcaggcuccaugca

SEQ ID NO: 1075281 - RNA, 18 nt, Homo sapiens
ccugcaggcuuagguccu

SEQ ID NO: 1075282 - RNA, 18 nt, Homo sapiens
ccugccaccagucacugu

SEQ ID NO: 1075283 - RNA, 17 nt, Homo sapiens
ccugcuagcugucucuc

SEQ ID NO: 1075284 - RNA, 17 nt, Homo sapiens
ccugcuccagcagcaca

SEQ ID NO: 1075285 - RNA, 18 nt, Homo sapiens
ccugcucuguagccaccu

SEQ ID NO: 1075286 - RNA, 20 nt, Homo sapiens
ccuggaaucaagaugucaga

SEQ ID NO: 1075287 - RNA, 13 nt, Homo sapiens
ccugggucgggac

SEQ ID NO: 1075288 - RNA, 17 nt, Homo sapiens
ccugguggucacaggcu

SEQ ID NO: 1075289 - RNA, 19 nt, Homo sapiens
ccuguaaucccagcacuuu

SEQ ID NO: 1075290 - RNA, 17 nt, Homo sapiens
ccugugcccagcaugcc

SEQ ID NO: 1075291 - RNA, 23 nt, Homo sapiens
ccugugucuuauagguuuccacu

SEQ ID NO: 1075292 - RNA, 19 nt, Homo sapiens
ccugugugucugcagacaa

SEQ ID NO: 1075293 - RNA, 22 nt, Homo sapiens
ccuguuacuugaaauaccagug

SEQ ID NO: 1075294 - RNA, 17 nt, Homo sapiens
ccuguuuaaaaaaagua

SEQ ID NO: 1075295 - RNA, 22 nt, Homo sapiens
ccuuagauuagcucuggaccag

SEQ ID NO: 1075296 - RNA, 19 nt, Homo sapiens
ccuuccugucccaccucuu

SEQ ID NO: 1075297 - RNA, 18 nt, Homo sapiens
ccuuccuuaagccaggaa

SEQ ID NO: 1075298 - RNA, 13 nt, Homo sapiens
ccuugaagccacu

SEQ ID NO: 1075299 - RNA, 21 nt, Homo sapiens
ccuugaauauuuauucaguga

SEQ ID NO: 1075300 - RNA, 18 nt, Homo sapiens
ccuugcuagacagccagg

SEQ ID NO: 1075301 - RNA, 22 nt, Homo sapiens
cgaacgcucuuagcuuucucag

SEQ ID NO: 1075302 - RNA, 15 nt, Homo sapiens
cgaggccugacacag

SEQ ID NO: 1075303 - RNA, 20 nt, Homo sapiens
cgaggcggguggaucacuug

SEQ ID NO: 1075304 - RNA, 11 nt, Homo sapiens
cgaucuuggcu

SEQ ID NO: 1075305 - RNA, 14 nt, Homo sapiens
cgcaaggcugugcu

SEQ ID NO: 1075306 - RNA, 11 nt, Homo sapiens
cgcaccugccc

SEQ ID NO: 1075307 - RNA, 19 nt, Homo sapiens
ggagccccagcuuccugug

SEQ ID NO: 1075308 - RNA, 16 nt, Homo sapiens
ggaggcuuagcuuucu

SEQ ID NO: 1075309 - RNA, 13 nt, Homo sapiens
ggagucucagagc

SEQ ID NO: 1075310 - RNA, 14 nt, Homo sapiens
ggaguuggagacca

SEQ ID NO: 1075311 - RNA, 19 nt, Homo sapiens
ggaucacuugaguucagga

SEQ ID NO: 1075312 - RNA, 16 nt, Homo sapiens
ggaucaucucugugac

SEQ ID NO: 1075313 - RNA, 21 nt, Homo sapiens
ggauuaauguuuuguacaauu

SEQ ID NO: 1075314 - RNA, 13 nt, Homo sapiens
ggauucagauuuc

SEQ ID NO: 1075315 - RNA, 18 nt, Homo sapiens
ggcaacauaguaagaccc

SEQ ID NO: 1075316 - RNA, 20 nt, Homo sapiens
ggcaacauaguaagacccca

SEQ ID NO: 1075317 - RNA, 18 nt, Homo sapiens
ggcaauuguccccaggga

SEQ ID NO: 1075318 - RNA, 15 nt, Homo sapiens
ggcacugacugagca

SEQ ID NO: 1075319 - RNA, 18 nt, Homo sapiens
ggcacugugccugagcuc

SEQ ID NO: 1075320 - RNA, 22 nt, Homo sapiens
ggcagagccccuuaaagcugcu

SEQ ID NO: 1075321 - RNA, 21 nt, Homo sapiens
ggcaguagacuauaagcagaa

SEQ ID NO: 1075322 - RNA, 15 nt, Homo sapiens
ggcauggaacuuuuu

SEQ ID NO: 1075323 - RNA, 15 nt, Homo sapiens
ggccacaccaucucc

SEQ ID NO: 1075324 - RNA, 15 nt, Homo sapiens
ggccacucaggccag

SEQ ID NO: 1075325 - RNA, 15 nt, Homo sapiens
ggcccagagaagcaa

SEQ ID NO: 1075326 - RNA, 17 nt, Homo sapiens
ggccccuccagcacaca

SEQ ID NO: 1075327 - RNA, 23 nt, Homo sapiens
ggccugccuugaagccacugaag

SEQ ID NO: 1075328 - RNA, 20 nt, Homo sapiens
ggcgacagagcgagacuccg

SEQ ID NO: 1075329 - RNA, 15 nt, Homo sapiens
ggcgucggaaaugau

SEQ ID NO: 1075330 - RNA, 17 nt, Homo sapiens
ggcucugaagccaagcc

SEQ ID NO: 1075331 - RNA, 21 nt, Homo sapiens
ggcugaauccgugguggcacc

SEQ ID NO: 1075332 - RNA, 21 nt, Homo sapiens
ggcugcucgaagaacaauguc

SEQ ID NO: 1075333 - RNA, 22 nt, Homo sapiens
ggcuugucggagcaaguuucau

SEQ ID NO: 1075334 - RNA, 12 nt, Homo sapiens
gggaaaaccaaa

SEQ ID NO: 1075335 - RNA, 14 nt, Homo sapiens
gggaagaaacacuc

SEQ ID NO: 1075336 - RNA, 20 nt, Homo sapiens
gggaagcggagcuugcagug

SEQ ID NO: 1075337 - RNA, 19 nt, Homo sapiens
gggcagcuccugaccaaag

SEQ ID NO: 1075338 - RNA, 22 nt, Homo sapiens
gggccagcacuggaggggccca

SEQ ID NO: 1075339 - RNA, 15 nt, Homo sapiens
gggccugcaggugag

SEQ ID NO: 1075340 - RNA, 12 nt, Homo sapiens
ggggcagccucc

SEQ ID NO: 1075341 - RNA, 14 nt, Homo sapiens
gggggcgugccugc

SEQ ID NO: 1075342 - RNA, 17 nt, Homo sapiens
gggggcgugccugccaa

SEQ ID NO: 1075343 - RNA, 17 nt, Homo sapiens
gggugcugccagcugcu

SEQ ID NO: 1075344 - RNA, 19 nt, Homo sapiens
ggguguuaaggcagugacu

SEQ ID NO: 1075345 - RNA, 17 nt, Homo sapiens
gguaaaaccccaucucu

SEQ ID NO: 1075346 - RNA, 15 nt, Homo sapiens
ggucuccuugcacuu

SEQ ID NO: 1075347 - RNA, 16 nt, Homo sapiens
ggucuccuugcacuuu

SEQ ID NO: 1075348 - RNA, 17 nt, Homo sapiens
ggugaaacaaaauccaa

SEQ ID NO: 1075349 - RNA, 22 nt, Homo sapiens
gguggucacaggcugugccuug

SEQ ID NO: 1075350 - RNA, 15 nt, Homo sapiens
ggugugaaagucaga

SEQ ID NO: 1075351 - RNA, 21 nt, Homo sapiens
gguugaaacuguuaucacuua

SEQ ID NO: 1075352 - RNA, 11 nt, Homo sapiens
gguugcaguga

SEQ ID NO: 1075353 - RNA, 22 nt, Homo sapiens
gguugcuguauuuguucaguga

SEQ ID NO: 1075354 - RNA, 18 nt, Homo sapiens
gguuucuauuuucucuga

SEQ ID NO: 1075355 - RNA, 19 nt, Homo sapiens
guaacuugaagauauuuau

SEQ ID NO: 1075356 - RNA, 20 nt, Homo sapiens
guaagagagaugagcacuuc

SEQ ID NO: 1075357 - RNA, 20 nt, Homo sapiens
guaaguaccacucaggccaa

SEQ ID NO: 1075358 - RNA, 15 nt, Homo sapiens
guacaaugugacuuu

SEQ ID NO: 1075359 - RNA, 17 nt, Homo sapiens
guacaaugugacuuuga

SEQ ID NO: 1075360 - RNA, 17 nt, Homo sapiens
guacauuuggcauuugu

SEQ ID NO: 1075361 - RNA, 16 nt, Homo sapiens
guacgguggcacgugc

SEQ ID NO: 1075362 - RNA, 15 nt, Homo sapiens
guagaacccaggucu

SEQ ID NO: 1075363 - RNA, 21 nt, Homo sapiens
guauucuuuacuaaagauauc

SEQ ID NO: 1075364 - RNA, 22 nt, Homo sapiens
gucacaagggauuggcaauugu

SEQ ID NO: 1075365 - RNA, 13 nt, Homo sapiens
gucaugggguccc

SEQ ID NO: 1075366 - RNA, 18 nt, Homo sapiens
gucauuuugaaucaucau

SEQ ID NO: 1075367 - RNA, 17 nt, Homo sapiens
gucccagcuacucagaa

SEQ ID NO: 1075368 - RNA, 14 nt, Homo sapiens
gucccccccagugc

SEQ ID NO: 1075369 - RNA, 21 nt, Homo sapiens
gucccucaaaugacccaaaga

SEQ ID NO: 1075370 - RNA, 14 nt, Homo sapiens
gucccugcccuccc

SEQ ID NO: 1075371 - RNA, 13 nt, Homo sapiens
guccuccugcucu

SEQ ID NO: 1075372 - RNA, 21 nt, Homo sapiens
guccuccuuucuuauucugug

SEQ ID NO: 1075373 - RNA, 19 nt, Homo sapiens
guccucucuguugccuuuu

SEQ ID NO: 1075374 - RNA, 14 nt, Homo sapiens
guccugcuagcugu

SEQ ID NO: 1075375 - RNA, 16 nt, Homo sapiens
guccuuuuguaccaug

SEQ ID NO: 1075376 - RNA, 23 nt, Homo sapiens
gucuccggggaggcagggguccu

SEQ ID NO: 1075377 - RNA, 14 nt, Homo sapiens
gucuccuugcacuu

SEQ ID NO: 1075378 - RNA, 16 nt, Homo sapiens
gucugaugccaaagcu

SEQ ID NO: 1075379 - RNA, 14 nt, Homo sapiens
gucuuacugugauc

SEQ ID NO: 1075380 - RNA, 15 nt, Homo sapiens
gucuucagagcaaaa

SEQ ID NO: 1075381 - RNA, 12 nt, Homo sapiens
gugaaccaaaga

SEQ ID NO: 1075382 - RNA, 13 nt, Homo sapiens
gugcaguggugca

SEQ ID NO: 1075383 - RNA, 11 nt, Homo sapiens
gugccugagac

SEQ ID NO: 1075384 - RNA, 12 nt, Homo sapiens
gugccugugauc

SEQ ID NO: 1075385 - RNA, 22 nt, Homo sapiens
gugccuugguuuccugagccac

SEQ ID NO: 1075386 - RNA, 23 nt, Homo sapiens
gugcuagcaacacccaaaggugg

SEQ ID NO: 1075387 - RNA, 18 nt, Homo sapiens
gugcuguggccugggcaa

SEQ ID NO: 1075388 - RNA, 22 nt, Homo sapiens
gugcuuccacuucuaugcaaau

SEQ ID NO: 1075389 - RNA, 16 nt, Homo sapiens
guggcaccgagaccaa

SEQ ID NO: 1075390 - RNA, 17 nt, Homo sapiens
guggucuccuugcacuu

SEQ ID NO: 1075391 - RNA, 17 nt, Homo sapiens
gugugaaaccugacacc

SEQ ID NO: 1075392 - RNA, 17 nt, Homo sapiens
guguuacuguugcacug

SEQ ID NO: 1075393 - RNA, 19 nt, Homo sapiens
guguucacuaaacucugaa

SEQ ID NO: 1075394 - RNA, 12 nt, Homo sapiens
guguugauccca

SEQ ID NO: 1075395 - RNA, 22 nt, Homo sapiens
guguuuaaaacaugcacgguga

SEQ ID NO: 1075396 - RNA, 15 nt, Homo sapiens
guguuucauaacaaa

SEQ ID NO: 1075397 - RNA, 16 nt, Homo sapiens
guguuugaagucugcu

SEQ ID NO: 1075398 - RNA, 17 nt, Homo sapiens
guuaaacuacuuguaaa

SEQ ID NO: 1075399 - RNA, 19 nt, Homo sapiens
guuaaggcagugacuuuag

SEQ ID NO: 1075400 - RNA, 15 nt, Homo sapiens
guuacuguugcacug

SEQ ID NO: 1075401 - RNA, 16 nt, Homo sapiens
guuacuguugcacuga

SEQ ID NO: 1075402 - RNA, 17 nt, Homo sapiens
guuacuugaaauaccag

SEQ ID NO: 1075403 - RNA, 20 nt, Homo sapiens
guuacuugaaauaccaguga

SEQ ID NO: 1075404 - RNA, 12 nt, Homo sapiens
guuaucacuuau

SEQ ID NO: 1075405 - RNA, 16 nt, Homo sapiens
guuauuauuuugcacu

SEQ ID NO: 1075406 - RNA, 20 nt, Homo sapiens
guucaggaguuggagaccag

SEQ ID NO: 1075407 - RNA, 15 nt, Homo sapiens
guucuaaguucaugu

SEQ ID NO: 1075408 - RNA, 12 nt, Homo sapiens
guugaguguuca

SEQ ID NO: 1075409 - RNA, 15 nt, Homo sapiens
guugaucccaagaca

SEQ ID NO: 1075410 - RNA, 21 nt, Homo sapiens
guugcucuguuucuuccuuuc

SEQ ID NO: 1075411 - RNA, 15 nt, Homo sapiens
guuggauuucaguga

SEQ ID NO: 1075412 - RNA, 20 nt, Homo sapiens
guuggugacugaaacauuca

SEQ ID NO: 1075413 - RNA, 17 nt, Homo sapiens
guuguaauaaaacuuau

SEQ ID NO: 1075414 - RNA, 17 nt, Homo sapiens
guuuaaaaaaaguauau

SEQ ID NO: 1075415 - RNA, 18 nt, Homo sapiens
guuuaaaaaaaguauaua

SEQ ID NO: 1075416 - RNA, 14 nt, Homo sapiens
guuugagugucugc

SEQ ID NO: 1075417 - RNA, 18 nt, Homo sapiens
guuuuacccuauaucuau

SEQ ID NO: 1075418 - RNA, 13 nt, Homo sapiens
guuuuauauccau

SEQ ID NO: 1075419 - RNA, 16 nt, Homo sapiens
uaaaacuuaugcuagu

SEQ ID NO: 1075420 - RNA, 20 nt, Homo sapiens
uaaaauaucuggguggcuua

SEQ ID NO: 1075421 - RNA, 21 nt, Homo sapiens
uaaacacuguguauuguugua

SEQ ID NO: 1075422 - RNA, 17 nt, Homo sapiens
uaaacccuuaacuggca

SEQ ID NO: 1075423 - RNA, 15 nt, Homo sapiens
uaaacuacuuguaaa

SEQ ID NO: 1075424 - RNA, 20 nt, Homo sapiens
uaaacucugaauaagcacuu

SEQ ID NO: 1075425 - RNA, 18 nt, Homo sapiens
uaaaguaauuuugugaaa

SEQ ID NO: 1075426 - RNA, 23 nt, Homo sapiens
uaaauugcuuuuguugugacuuu

SEQ ID NO: 1075427 - RNA, 14 nt, Homo sapiens
uaacacaagccaca

SEQ ID NO: 1075428 - RNA, 17 nt, Homo sapiens
uaacacaagccacagaa

SEQ ID NO: 1075429 - RNA, 18 nt, Homo sapiens
uaacacaagccacagaag

SEQ ID NO: 1075430 - RNA, 15 nt, Homo sapiens
uaacuauguuuuauc

SEQ ID NO: 1075431 - RNA, 11 nt, Homo sapiens
uaagacacaaa

SEQ ID NO: 1075432 - RNA, 15 nt, Homo sapiens
uaagaccccaucucu

SEQ ID NO: 1075433 - RNA, 15 nt, Homo sapiens
uaagcagaagcacau

SEQ ID NO: 1075434 - RNA, 22 nt, Homo sapiens
uaagccaacuuuaauugcuuaa

SEQ ID NO: 1075435 - RNA, 14 nt, Homo sapiens
uaagugccugagac

SEQ ID NO: 1075436 - RNA, 13 nt, Homo sapiens
uaauaaaauaaua

SEQ ID NO: 1075437 - RNA, 19 nt, Homo sapiens
uaauauuuguguguucacu

SEQ ID NO: 1075438 - RNA, 14 nt, Homo sapiens
uaaucccagcacuu

SEQ ID NO: 1075439 - RNA, 21 nt, Homo sapiens
uaaucccagcacuuuggcagg

SEQ ID NO: 1075440 - RNA, 14 nt, Homo sapiens
uacaaucucaaauu

SEQ ID NO: 1075441 - RNA, 20 nt, Homo sapiens
uacacuccagccugagcaac

SEQ ID NO: 1075442 - RNA, 19 nt, Homo sapiens
uacagaaugaaucccauaa

SEQ ID NO: 1075443 - RNA, 13 nt, Homo sapiens
uacagcuuggcac

SEQ ID NO: 1075444 - RNA, 18 nt, Homo sapiens
uaccaccccuuccugucc

SEQ ID NO: 1075445 - RNA, 17 nt, Homo sapiens
uaccagugaaccaaaga

SEQ ID NO: 1075446 - RNA, 12 nt, Homo sapiens
uacccacuucca

SEQ ID NO: 1075447 - RNA, 23 nt, Homo sapiens
uaccuuagauuagcucuggacca

SEQ ID NO: 1075448 - RNA, 18 nt, Homo sapiens
uacuaaagucacauauaa

SEQ ID NO: 1075449 - RNA, 18 nt, Homo sapiens
uacucauuuuaaugauug

SEQ ID NO: 1075450 - RNA, 15 nt, Homo sapiens
uacucccauuuuccc

SEQ ID NO: 1075451 - RNA, 15 nt, Homo sapiens
uacuccuaccucagc

SEQ ID NO: 1075452 - RNA, 18 nt, Homo sapiens
uacucugcucuaugccag

SEQ ID NO: 1075453 - RNA, 19 nt, Homo sapiens
uacucugcucuaugccagg

SEQ ID NO: 1075454 - RNA, 20 nt, Homo sapiens
uacugagacaugacuaggaa

SEQ ID NO: 1075455 - RNA, 20 nt, Homo sapiens
uacugcacauuuuguacaaa

SEQ ID NO: 1075456 - RNA, 15 nt, Homo sapiens
uacuguugcacugau

SEQ ID NO: 1075457 - RNA, 12 nt, Homo sapiens
uagaaacacagu

SEQ ID NO: 1075458 - RNA, 17 nt, Homo sapiens
uagaaggccacauguca

SEQ ID NO: 1075459 - RNA, 13 nt, Homo sapiens
uagacagccaggu

SEQ ID NO: 1075460 - RNA, 21 nt, Homo sapiens
uagacggaggugccugagggu

SEQ ID NO: 1075461 - RNA, 23 nt, Homo sapiens
uagacuauaagcagaagcacaua

SEQ ID NO: 1075462 - RNA, 17 nt, Homo sapiens
uagccaccuccuuggca

SEQ ID NO: 1075463 - RNA, 18 nt, Homo sapiens
uagccaucucucuacucc

SEQ ID NO: 1075464 - RNA, 18 nt, Homo sapiens
uaggcauaugcuucuuua

SEQ ID NO: 1075465 - RNA, 15 nt, Homo sapiens
uagucaugggguccc

SEQ ID NO: 1075466 - RNA, 22 nt, Homo sapiens
uauaauauuuguguguucacua

SEQ ID NO: 1075467 - RNA, 19 nt, Homo sapiens
uauacuguagcugaugaaa

SEQ ID NO: 1075468 - RNA, 17 nt, Homo sapiens
uauauaguuugugguaa

SEQ ID NO: 1075469 - RNA, 19 nt, Homo sapiens
uauauauucuacacauaua

SEQ ID NO: 1075470 - RNA, 20 nt, Homo sapiens
uauauuuauucaucugggag

SEQ ID NO: 1075471 - RNA, 19 nt, Homo sapiens
uuggaauacuugaaaaccu

SEQ ID NO: 1075472 - RNA, 16 nt, Homo sapiens
uuggcucacugcaacu

SEQ ID NO: 1075473 - RNA, 14 nt, Homo sapiens
uuguacacugugua

SEQ ID NO: 1075474 - RNA, 21 nt, Homo sapiens
uuguauguuaaagcaucagag

SEQ ID NO: 1075475 - RNA, 21 nt, Homo sapiens
uugucuccccgaaagggacac

SEQ ID NO: 1075476 - RNA, 18 nt, Homo sapiens
uuguguguucacuaaacu

SEQ ID NO: 1075477 - RNA, 23 nt, Homo sapiens
uuguguguucacuaaacucugaa

SEQ ID NO: 1075478 - RNA, 15 nt, Homo sapiens
uuuaaaaaaaguaua

SEQ ID NO: 1075479 - RNA, 17 nt, Homo sapiens
uuuaaaccaauugcagg

SEQ ID NO: 1075480 - RNA, 17 nt, Homo sapiens
uuuaccucuucuaugca

SEQ ID NO: 1075481 - RNA, 20 nt, Homo sapiens
uuuacucugcucuaugccag

SEQ ID NO: 1075482 - RNA, 19 nt, Homo sapiens
uuuagaugugcugcuuuga

SEQ ID NO: 1075483 - RNA, 19 nt, Homo sapiens
uuuaucaggcuuucucugg

SEQ ID NO: 1075484 - RNA, 17 nt, Homo sapiens
uuucaccagcagcauag

SEQ ID NO: 1075485 - RNA, 21 nt, Homo sapiens
uuucagaauugaaggagaaaa

SEQ ID NO: 1075486 - RNA, 16 nt, Homo sapiens
uuuccaauugaacuuu

SEQ ID NO: 1075487 - RNA, 20 nt, Homo sapiens
uuuccauugaccagcucucu

SEQ ID NO: 1075488 - RNA, 19 nt, Homo sapiens
uuucuaaagcucugaacaa

SEQ ID NO: 1075489 - RNA, 22 nt, Homo sapiens
uuucuaaagcucugaacaaaag

SEQ ID NO: 1075490 - RNA, 20 nt, Homo sapiens
uuuuagugacuguaauuaau

SEQ ID NO: 1075491 - RNA, 18 nt, Homo sapiens
uuuuauuuccacauaaag

SEQ ID NO: 1075492 - RNA, 21 nt, Homo sapiens
uuuuccccccaccccccagca

SEQ ID NO: 1075493 - RNA, 18 nt, Homo sapiens
uuuugaaaucaguaaaca

SEQ ID NO: 1075494 - RNA, 15 nt, Homo sapiens
uuuuguaaacuguau

SEQ ID NO: 1075495 - RNA, 19 nt, Homo sapiens
uuuuuacggguaacaguga

SEQ ID NO: 1075496 - RNA, 22 nt, Homo sapiens
ugacggcugcucgaagaacaau

SEQ ID NO: 1075497 - RNA, 14 nt, Homo sapiens
ugacugaaacauuc

SEQ ID NO: 1075498 - RNA, 16 nt, Homo sapiens
ugagacauauuuacaa

SEQ ID NO: 1075499 - RNA, 16 nt, Homo sapiens
ugagaccgaaucucac

SEQ ID NO: 1075500 - RNA, 13 nt, Homo sapiens
ugagcacuucuaa

SEQ ID NO: 1075501 - RNA, 17 nt, Homo sapiens
ugaggaaacaggccuca

SEQ ID NO: 1075502 - RNA, 13 nt, Homo sapiens
ugaggcaggagaa

SEQ ID NO: 1075503 - RNA, 13 nt, Homo sapiens
ugaggcaggugag

SEQ ID NO: 1075504 - RNA, 11 nt, Homo sapiens
ugaggcucacc

SEQ ID NO: 1075505 - RNA, 11 nt, Homo sapiens
ugagggcuccu

SEQ ID NO: 1075506 - RNA, 16 nt, Homo sapiens
ugaguuauuuugcuaa

SEQ ID NO: 1075507 - RNA, 19 nt, Homo sapiens
ugaguuugggauuguggua

SEQ ID NO: 1075508 - RNA, 13 nt, Homo sapiens
ugauaagccuuuc

SEQ ID NO: 1075509 - RNA, 19 nt, Homo sapiens
ugauacuuuuuugaaauca

SEQ ID NO: 1075510 - RNA, 20 nt, Homo sapiens
ugaucuuggcaguggaacau

SEQ ID NO: 1075511 - RNA, 14 nt, Homo sapiens
ugaugaauuacuuc

SEQ ID NO: 1075512 - RNA, 18 nt, Homo sapiens
ugauuaaaaucuggcaaa

SEQ ID NO: 1075513 - RNA, 20 nt, Homo sapiens
ugcaaaugccuccaagccau

SEQ ID NO: 1075514 - RNA, 16 nt, Homo sapiens
ugcaacuucuaccucc

SEQ ID NO: 1075515 - RNA, 14 nt, Homo sapiens
ugcaaggcacugac

SEQ ID NO: 1075516 - RNA, 15 nt, Homo sapiens
ugcaaucuauaauau

SEQ ID NO: 1075517 - RNA, 14 nt, Homo sapiens
ugcacuccagccug

SEQ ID NO: 1075518 - RNA, 13 nt, Homo sapiens
ugcagaaggccaa

SEQ ID NO: 1075519 - RNA, 13 nt, Homo sapiens
ugcagugagccaa

SEQ ID NO: 1075520 - RNA, 20 nt, Homo sapiens
ugcaguggugcgaucuuggc

SEQ ID NO: 1075521 - RNA, 15 nt, Homo sapiens
ugccaccugucuguc

SEQ ID NO: 1075522 - RNA, 14 nt, Homo sapiens
ugccacuucccaga

SEQ ID NO: 1075523 - RNA, 16 nt, Homo sapiens
ugccgagccuaaugaa

SEQ ID NO: 1075524 - RNA, 15 nt, Homo sapiens
ugccuccaagccauu

SEQ ID NO: 1075525 - RNA, 16 nt, Homo sapiens
ugccugugaucccagc

SEQ ID NO: 1075526 - RNA, 13 nt, Homo sapiens
ugcuacauggggu

SEQ ID NO: 1075527 - RNA, 23 nt, Homo sapiens
ugcuacccacagcgucauuuuga

SEQ ID NO: 1075528 - RNA, 14 nt, Homo sapiens
ugcuagacagccag

SEQ ID NO: 1075529 - RNA, 15 nt, Homo sapiens
ugcuagcaacaccca

SEQ ID NO: 1075530 - RNA, 16 nt, Homo sapiens
ugcuagcugucucucu

SEQ ID NO: 1075531 - RNA, 16 nt, Homo sapiens
ugcucgggugcugcca

SEQ ID NO: 1075532 - RNA, 20 nt, Homo sapiens
ugcucugaggcuuccagaga

SEQ ID NO: 1075533 - RNA, 17 nt, Homo sapiens
ugcuuccacuucuaugc

SEQ ID NO: 1075534 - RNA, 19 nt, Homo sapiens
ugcuuccacuucuaugcaa

SEQ ID NO: 1075535 - RNA, 21 nt, Homo sapiens
uggaaagcagguggcaucucu

SEQ ID NO: 1075536 - RNA, 14 nt, Homo sapiens
uggaaagcugauga

SEQ ID NO: 1075537 - RNA, 17 nt, Homo sapiens
uggagcaucugacucac

SEQ ID NO: 1075538 - RNA, 12 nt, Homo sapiens
uggaggugccag

SEQ ID NO: 1075539 - RNA, 13 nt, Homo sapiens
uggauggucucca

SEQ ID NO: 1075540 - RNA, 23 nt, Homo sapiens
uggcacgcgccuguaaucccagc

SEQ ID NO: 1075541 - RNA, 19 nt, Homo sapiens
uggcacgugccugugaucc

SEQ ID NO: 1075542 - RNA, 18 nt, Homo sapiens
uggcagaacgaugccugc

SEQ ID NO: 1075543 - RNA, 16 nt, Homo sapiens
uggccuucgucuccau

SEQ ID NO: 1075544 - RNA, 15 nt, Homo sapiens
ugggauuugcagggu

SEQ ID NO: 1075545 - RNA, 23 nt, Homo sapiens
ugggcaacauaguaagaccccau

SEQ ID NO: 1075546 - RNA, 16 nt, Homo sapiens
ugggcgaagcuaaaag

SEQ ID NO: 1075547 - RNA, 14 nt, Homo sapiens
ugggucagcccagc

SEQ ID NO: 1075548 - RNA, 20 nt, Homo sapiens
ugguacaaucucaaauucuc

SEQ ID NO: 1075549 - RNA, 20 nt, Homo sapiens
ugguaugaacuugaggacac

SEQ ID NO: 1075550 - RNA, 16 nt, Homo sapiens
uggucacaggcugugc

SEQ ID NO: 1075551 - RNA, 21 nt, Homo sapiens
uggucccaaguaguagugucu

SEQ ID NO: 1075552 - RNA, 18 nt, Homo sapiens
uggucuccuugcacuuuc

SEQ ID NO: 1075553 - RNA, 15 nt, Homo sapiens
uggugcgaucuuggc

SEQ ID NO: 1075554 - RNA, 19 nt, Homo sapiens
ugguuuuuggcucuuucag

SEQ ID NO: 1075555 - RNA, 13 nt, Homo sapiens
uguagaacuucaa

SEQ ID NO: 1075556 - RNA, 13 nt, Homo sapiens
uguauaauggugu

SEQ ID NO: 1075557 - RNA, 14 nt, Homo sapiens
ugucacaccugaaa

SEQ ID NO: 1075558 - RNA, 13 nt, Homo sapiens
ugucguagccaag

SEQ ID NO: 1075559 - RNA, 14 nt, Homo sapiens
ugucgucuuuaugu

SEQ ID NO: 1075560 - RNA, 14 nt, Homo sapiens
ugucugucccaaag

SEQ ID NO: 1075561 - RNA, 15 nt, Homo sapiens
ugucuuacugugauc

SEQ ID NO: 1075562 - RNA, 22 nt, Homo sapiens
ugucuuugacuugguuaaagga

SEQ ID NO: 1075563 - RNA, 23 nt, Homo sapiens
ugugaaauucaaccugugucuua

SEQ ID NO: 1075564 - RNA, 12 nt, Homo sapiens
ugugaccaaagc

SEQ ID NO: 1075565 - RNA, 17 nt, Homo sapiens
uguggcugucaggacac

SEQ ID NO: 1075566 - RNA, 18 nt, Homo sapiens
uguucagagaggccuuuu

SEQ ID NO: 1075567 - RNA, 15 nt, Homo sapiens
uguucuuagcugaac

SEQ ID NO: 1075568 - RNA, 20 nt, Homo sapiens
uguugauaaauuccacugga

SEQ ID NO: 1075569 - RNA, 21 nt, Homo sapiens
uguugccuuuuuacagccaac

SEQ ID NO: 1075570 - RNA, 19 nt, Homo sapiens
uguuguaaaauguaaaggu

SEQ ID NO: 1075571 - RNA, 11 nt, Homo sapiens
uguuugcacuu

SEQ ID NO: 1075572 - RNA, 14 nt, Homo sapiens
uguuuguacaagau

SEQ ID NO: 1075573 - RNA, 12 nt, Homo sapiens
uuaaaagaauuu

SEQ ID NO: 1075574 - RNA, 20 nt, Homo sapiens
uuaaagaaaaaaaaagucag

SEQ ID NO: 1075575 - RNA, 18 nt, Homo sapiens
uuaacuggcauaggaaau

SEQ ID NO: 1075576 - RNA, 22 nt, Homo sapiens
uuaagaaacacaggguuuugua

SEQ ID NO: 1075577 - RNA, 16 nt, Homo sapiens
uuaaucuauaacuaca

SEQ ID NO: 1075578 - RNA, 13 nt, Homo sapiens
uuaauguacaagu

SEQ ID NO: 1075579 - RNA, 20 nt, Homo sapiens
uuacauguuugguaccaaga

SEQ ID NO: 1075580 - RNA, 17 nt, Homo sapiens
uuauaguuaaucuauaa

SEQ ID NO: 1075581 - RNA, 15 nt, Homo sapiens
uuauauuuacuuuaa

SEQ ID NO: 1075582 - RNA, 17 nt, Homo sapiens
uuauguuugcacuuugu

SEQ ID NO: 1075583 - RNA, 12 nt, Homo sapiens
uuauuuuugcaa

SEQ ID NO: 1075584 - RNA, 22 nt, Homo sapiens
uucaaagacagagaagaccaaa

SEQ ID NO: 1075585 - RNA, 18 nt, Homo sapiens
uucaaguuagcucaggag

SEQ ID NO: 1075586 - RNA, 19 nt, Homo sapiens
uucagaguuguacacugug

SEQ ID NO: 1075587 - RNA, 15 nt, Homo sapiens
uucagccugaggcug

SEQ ID NO: 1075588 - RNA, 15 nt, Homo sapiens
uuccacuucuaugca

SEQ ID NO: 1075589 - RNA, 18 nt, Homo sapiens
uuccauaaacacccauga

SEQ ID NO: 1075590 - RNA, 22 nt, Homo sapiens
uuccccucuacuccaugcacau

SEQ ID NO: 1075591 - RNA, 17 nt, Homo sapiens
uuccucagggcccagca

SEQ ID NO: 1075592 - RNA, 14 nt, Homo sapiens
uuccugccaccagu

SEQ ID NO: 1075593 - RNA, 13 nt, Homo sapiens
uuccuuaagccag

SEQ ID NO: 1075594 - RNA, 21 nt, Homo sapiens
uuccuucugcccuuccuccag

SEQ ID NO: 1075595 - RNA, 20 nt, Homo sapiens
uucgagaccagccuggccaa

SEQ ID NO: 1075596 - RNA, 19 nt, Homo sapiens
uucuaaagcucugaacaaa

SEQ ID NO: 1075597 - RNA, 21 nt, Homo sapiens
uucuaacuagaaaucugccaa

SEQ ID NO: 1075598 - RNA, 14 nt, Homo sapiens
uucuacacauauau

SEQ ID NO: 1075599 - RNA, 20 nt, Homo sapiens
uucucaguaaauauuaaccu

SEQ ID NO: 1075600 - RNA, 19 nt, Homo sapiens
uucucccucacuccugcca

SEQ ID NO: 1075601 - RNA, 22 nt, Homo sapiens
uucuccuguugcaaugacacau

SEQ ID NO: 1075602 - RNA, 18 nt, Homo sapiens
uucucugagaaccaaaag

SEQ ID NO: 1075603 - RNA, 17 nt, Homo sapiens
uucuguccaguuuccaa

SEQ ID NO: 1075604 - RNA, 23 nt, Homo sapiens
uugaaauaccagugaaccaaaga

SEQ ID NO: 1075605 - RNA, 19 nt, Homo sapiens
uugauuuaauaucugagaa

SEQ ID NO: 1075606 - RNA, 20 nt, Homo sapiens
uugcaacaagacaaagcaaa

SEQ ID NO: 1075607 - RNA, 19 nt, Homo sapiens
uaucguccagugacuuuca

SEQ ID NO: 1075608 - RNA, 13 nt, Homo sapiens
uaugaacuugagg

SEQ ID NO: 1075609 - RNA, 14 nt, Homo sapiens
uaugaacuugagga

SEQ ID NO: 1075610 - RNA, 21 nt, Homo sapiens
uaugcaagccuugcuagacag

SEQ ID NO: 1075611 - RNA, 15 nt, Homo sapiens
uaugcucagaagcca

SEQ ID NO: 1075612 - RNA, 19 nt, Homo sapiens
uauguuaaagcaucagaga

SEQ ID NO: 1075613 - RNA, 21 nt, Homo sapiens
uauguuuguacaagauuguca

SEQ ID NO: 1075614 - RNA, 13 nt, Homo sapiens
uauuaaccugaau

SEQ ID NO: 1075615 - RNA, 17 nt, Homo sapiens
uauuagcaacugugcua

SEQ ID NO: 1075616 - RNA, 16 nt, Homo sapiens
uauuauaauagauuag

SEQ ID NO: 1075617 - RNA, 17 nt, Homo sapiens
uauuauuuugcacuguu

SEQ ID NO: 1075618 - RNA, 23 nt, Homo sapiens
uauucaggcuuuaggcauaugcu

SEQ ID NO: 1075619 - RNA, 15 nt, Homo sapiens
uauuucagaaauaca

SEQ ID NO: 1075620 - RNA, 22 nt, Homo sapiens
uauuuguguguucacuaaacuc

SEQ ID NO: 1075621 - RNA, 13 nt, Homo sapiens
uauuuuacuugaa

SEQ ID NO: 1075622 - RNA, 12 nt, Homo sapiens
uauuuugcacug

SEQ ID NO: 1075623 - RNA, 19 nt, Homo sapiens
ucaaacaggucgagcugug

SEQ ID NO: 1075624 - RNA, 14 nt, Homo sapiens
ucaaagacauggaa

SEQ ID NO: 1075625 - RNA, 21 nt, Homo sapiens
ucaaauuuggguauaugcagu

SEQ ID NO: 1075626 - RNA, 18 nt, Homo sapiens
ucaacaauuuuugaucaa

SEQ ID NO: 1075627 - RNA, 15 nt, Homo sapiens
ucaaccgcuugccau

SEQ ID NO: 1075628 - RNA, 14 nt, Homo sapiens
ucaacucauugcau

SEQ ID NO: 1075629 - RNA, 15 nt, Homo sapiens
ucaagcuagaaggcc

SEQ ID NO: 1075630 - RNA, 17 nt, Homo sapiens
ucaagcuagaaggccac

SEQ ID NO: 1075631 - RNA, 18 nt, Homo sapiens
ucacacagggcucuuuga

SEQ ID NO: 1075632 - RNA, 15 nt, Homo sapiens
ucacauagcacagaa

SEQ ID NO: 1075633 - RNA, 16 nt, Homo sapiens
ucacauccuugacuuu

SEQ ID NO: 1075634 - RNA, 13 nt, Homo sapiens
ucaccguggaccu

SEQ ID NO: 1075635 - RNA, 21 nt, Homo sapiens
ucaccuaggacugacucggca

SEQ ID NO: 1075636 - RNA, 17 nt, Homo sapiens
ucaccuguuacuugaaa

SEQ ID NO: 1075637 - RNA, 18 nt, Homo sapiens
ucacuaaacucugaauaa

SEQ ID NO: 1075638 - RNA, 17 nt, Homo sapiens
ucacugucccucaaaug

SEQ ID NO: 1075639 - RNA, 19 nt, Homo sapiens
ucacuugaguggagguuua

SEQ ID NO: 1075640 - RNA, 13 nt, Homo sapiens
ucagaagccugag

SEQ ID NO: 1075641 - RNA, 18 nt, Homo sapiens
ucagaaggauggcauuuu

SEQ ID NO: 1075642 - RNA, 16 nt, Homo sapiens
ucagacuuacuuacuc

SEQ ID NO: 1075643 - RNA, 14 nt, Homo sapiens
ucagagccagugaa

SEQ ID NO: 1075644 - RNA, 15 nt, Homo sapiens
ucagagccagugaag

SEQ ID NO: 1075645 - RNA, 16 nt, Homo sapiens
ucagaucugaacacag

SEQ ID NO: 1075646 - RNA, 15 nt, Homo sapiens
ucagccccacugaca

SEQ ID NO: 1075647 - RNA, 14 nt, Homo sapiens
ucagcccuccaugg

SEQ ID NO: 1075648 - RNA, 19 nt, Homo sapiens
ucaggacugugaccaaagc

SEQ ID NO: 1075649 - RNA, 15 nt, Homo sapiens
ucaggagucaacgug

SEQ ID NO: 1075650 - RNA, 18 nt, Homo sapiens
ucaggaguuggagaccag

SEQ ID NO: 1075651 - RNA, 23 nt, Homo sapiens
ucaggcccagagaagcaaguggc

SEQ ID NO: 1075652 - RNA, 18 nt, Homo sapiens
ucaggguguuaaggcagu

SEQ ID NO: 1075653 - RNA, 20 nt, Homo sapiens
ucaguaaauauuaaccugaa

SEQ ID NO: 1075654 - RNA, 14 nt, Homo sapiens
ucauaacaaaccau

SEQ ID NO: 1075655 - RNA, 13 nt, Homo sapiens
ucaucucugugac

SEQ ID NO: 1075656 - RNA, 14 nt, Homo sapiens
ucaucucugugacc

SEQ ID NO: 1075657 - RNA, 19 nt, Homo sapiens
uccaaccccccaccugcca

SEQ ID NO: 1075658 - RNA, 12 nt, Homo sapiens
uccaauugaacu

SEQ ID NO: 1075659 - RNA, 22 nt, Homo sapiens
uccagcacacacacauaagcac

SEQ ID NO: 1075660 - RNA, 15 nt, Homo sapiens
uccagccugggcaac

SEQ ID NO: 1075661 - RNA, 14 nt, Homo sapiens
uccagugacuuuca

SEQ ID NO: 1075662 - RNA, 19 nt, Homo sapiens
uccauaaacacccaugaau

SEQ ID NO: 1075663 - RNA, 23 nt, Homo sapiens
uccauaaaguaauuuugugaaag

SEQ ID NO: 1075664 - RNA, 12 nt, Homo sapiens
ucccaagcugcc

SEQ ID NO: 1075665 - RNA, 22 nt, Homo sapiens
ucccagaggcagagccugaguc

SEQ ID NO: 1075666 - RNA, 15 nt, Homo sapiens
ucccagcuacuuggg

SEQ ID NO: 1075667 - RNA, 15 nt, Homo sapiens
uccccaccuacccag

SEQ ID NO: 1075668 - RNA, 17 nt, Homo sapiens
ucccugauuaauggagg

SEQ ID NO: 1075669 - RNA, 20 nt, Homo sapiens
uccgaugcugaggccaccca

SEQ ID NO: 1075670 - RNA, 11 nt, Homo sapiens
uccgugccagg

SEQ ID NO: 1075671 - RNA, 19 nt, Homo sapiens
uccugaaagccagcaaagc

SEQ ID NO: 1075672 - RNA, 19 nt, Homo sapiens
uccugccaccagucacugu

SEQ ID NO: 1075673 - RNA, 14 nt, Homo sapiens
uccugccaguugaa

SEQ ID NO: 1075674 - RNA, 20 nt, Homo sapiens
uccuucugcccuuccuccag

SEQ ID NO: 1075675 - RNA, 12 nt, Homo sapiens
uccuugcacuuu

SEQ ID NO: 1075676 - RNA, 22 nt, Homo sapiens
ucgagcugugcucgggugcugc

SEQ ID NO: 1075677 - RNA, 14 nt, Homo sapiens
ucguagccaucucu

SEQ ID NO: 1075678 - RNA, 19 nt, Homo sapiens
ucuaacuagaaaucugcca

SEQ ID NO: 1075679 - RNA, 17 nt, Homo sapiens
ucuacugagacaugacu

SEQ ID NO: 1075680 - RNA, 18 nt, Homo sapiens
ucucaaauuguaauuaau

SEQ ID NO: 1075681 - RNA, 15 nt, Homo sapiens
ucucacuaaaaugga

SEQ ID NO: 1075682 - RNA, 17 nt, Homo sapiens
ucucacuaaaauggaua

SEQ ID NO: 1075683 - RNA, 14 nt, Homo sapiens
ucuccuugcacuuu

SEQ ID NO: 1075684 - RNA, 22 nt, Homo sapiens
ucucugggggacagcagucucu

SEQ ID NO: 1075685 - RNA, 23 nt, Homo sapiens
ucucuuguugauuuccgugaaaa

SEQ ID NO: 1075686 - RNA, 12 nt, Homo sapiens
ucugaaaugccu

SEQ ID NO: 1075687 - RNA, 15 nt, Homo sapiens
ucugaauaagcacuu

SEQ ID NO: 1075688 - RNA, 21 nt, Homo sapiens
ucugagaaccaaaagaugccu

SEQ ID NO: 1075689 - RNA, 16 nt, Homo sapiens
ucugcucuaugccagg

SEQ ID NO: 1075690 - RNA, 14 nt, Homo sapiens
ucuggccaggcaug

SEQ ID NO: 1075691 - RNA, 16 nt, Homo sapiens
ucuggccaggcauggc

SEQ ID NO: 1075692 - RNA, 17 nt, Homo sapiens
ucugggccacucaggcc

SEQ ID NO: 1075693 - RNA, 14 nt, Homo sapiens
ucugucccaaagaa

SEQ ID NO: 1075694 - RNA, 12 nt, Homo sapiens
ucuuagcuuucu

SEQ ID NO: 1075695 - RNA, 13 nt, Homo sapiens
ucuugcugugcuu

SEQ ID NO: 1075696 - RNA, 22 nt, Homo sapiens
ucuuguuguggaggcugaaaag

SEQ ID NO: 1075697 - RNA, 21 nt, Homo sapiens
ucuuuaauguuguccaggaaa

SEQ ID NO: 1075698 - RNA, 20 nt, Homo sapiens
ucuuucucugagaaccaaaa

SEQ ID NO: 1075699 - RNA, 14 nt, Homo sapiens
ugaaagccagcaaa

SEQ ID NO: 1075700 - RNA, 13 nt, Homo sapiens
ugaaauaccagug

SEQ ID NO: 1075701 - RNA, 22 nt, Homo sapiens
ugaaauaccagugaaccaaaga

SEQ ID NO: 1075702 - RNA, 18 nt, Homo sapiens
ugaaaucaguaaacacug

SEQ ID NO: 1075703 - RNA, 19 nt, Homo sapiens
ugaaauuucccacacccca

SEQ ID NO: 1075704 - RNA, 14 nt, Homo sapiens
ugaagagauuucaa

SEQ ID NO: 1075705 - RNA, 19 nt, Homo sapiens
ugaagagauuucaacaaga

SEQ ID NO: 1075706 - RNA, 17 nt, Homo sapiens
ugaaggagaaaaugcau

SEQ ID NO: 1075707 - RNA, 14 nt, Homo sapiens
ugaaggauaagaga

SEQ ID NO: 1075708 - RNA, 18 nt, Homo sapiens
ugaauaagcacuuuuuaa

SEQ ID NO: 1075709 - RNA, 20 nt, Homo sapiens
ugaauaucgagaacugccau

SEQ ID NO: 1075710 - RNA, 20 nt, Homo sapiens
ugaauauuuauucagugacu

SEQ ID NO: 1075711 - RNA, 23 nt, Homo sapiens
ugacacaggccagccuuggcacg

SEQ ID NO: 1075712 - RNA, 14 nt, Homo sapiens
ugacagaaaugcaa

SEQ ID NO: 1075713 - RNA, 19 nt, Homo sapiens
ugacagagugagacccugu

SEQ ID NO: 1075714 - RNA, 16 nt, Homo sapiens
ugaccaaagcauuucu

SEQ ID NO: 1075715 - RNA, 12 nt, Homo sapiens
ugacccaaagac

SEQ ID NO: 1075716 - RNA, 19 nt, Homo sapiens
ugacccaacugauccugcu

SEQ ID NO: 1075717 - RNA, 15 nt, Homo sapiens
ggucuggugcugagg

SEQ ID NO: 1075718 - RNA, 14 nt, Homo sapiens
ggugauauaucuca

SEQ ID NO: 1075719 - RNA, 22 nt, Homo sapiens
ggugcgaucuuggcucacugca

SEQ ID NO: 1075720 - RNA, 23 nt, Homo sapiens
gguggccugcggggagccaucac

SEQ ID NO: 1075721 - RNA, 15 nt, Homo sapiens
gguggcgggcaccug

SEQ ID NO: 1075722 - RNA, 20 nt, Homo sapiens
gguggucacaggcugugccu

SEQ ID NO: 1075723 - RNA, 22 nt, Homo sapiens
gguucuuuccaugcagacuccu

SEQ ID NO: 1075724 - RNA, 16 nt, Homo sapiens
gguuucggagcacgua

SEQ ID NO: 1075725 - RNA, 20 nt, Homo sapiens
gguuucuauuuucucugaua

SEQ ID NO: 1075726 - RNA, 18 nt, Homo sapiens
guaacacaagccacagaa

SEQ ID NO: 1075727 - RNA, 12 nt, Homo sapiens
guaagacacaaa

SEQ ID NO: 1075728 - RNA, 23 nt, Homo sapiens
guaaguugaauggccugccuuga

SEQ ID NO: 1075729 - RNA, 15 nt, Homo sapiens
guaaucccagcacuu

SEQ ID NO: 1075730 - RNA, 18 nt, Homo sapiens
guaccuuccuuaagccag

SEQ ID NO: 1075731 - RNA, 12 nt, Homo sapiens
guagcugaugaa

SEQ ID NO: 1075732 - RNA, 17 nt, Homo sapiens
guaggggcugcagggac

SEQ ID NO: 1075733 - RNA, 14 nt, Homo sapiens
guauaugcaguaug

SEQ ID NO: 1075734 - RNA, 20 nt, Homo sapiens
guaucaggacugugaccaaa

SEQ ID NO: 1075735 - RNA, 12 nt, Homo sapiens
gucaggcacguc

SEQ ID NO: 1075736 - RNA, 15 nt, Homo sapiens
gucaggcccagagaa

SEQ ID NO: 1075737 - RNA, 12 nt, Homo sapiens
guccagugacuu

SEQ ID NO: 1075738 - RNA, 17 nt, Homo sapiens
gucccaauagcucuacu

SEQ ID NO: 1075739 - RNA, 20 nt, Homo sapiens
gucccaauagcucuacugcc

SEQ ID NO: 1075740 - RNA, 23 nt, Homo sapiens
gucccacaccgcuggucccugcc

SEQ ID NO: 1075741 - RNA, 13 nt, Homo sapiens
guccucccuccca

SEQ ID NO: 1075742 - RNA, 22 nt, Homo sapiens
guccuucaaguuagcucaggag

SEQ ID NO: 1075743 - RNA, 17 nt, Homo sapiens
gucgucaaguugcagau

SEQ ID NO: 1075744 - RNA, 12 nt, Homo sapiens
gucugucccaaa

SEQ ID NO: 1075745 - RNA, 23 nt, Homo sapiens
gugagaccaccucucaauauuca

SEQ ID NO: 1075746 - RNA, 14 nt, Homo sapiens
gugcugcuuugaua

SEQ ID NO: 1075747 - RNA, 16 nt, Homo sapiens
guggagguugcaguga

SEQ ID NO: 1075748 - RNA, 19 nt, Homo sapiens
guggcacgugccugugauc

SEQ ID NO: 1075749 - RNA, 22 nt, Homo sapiens
guggcaucucuaauuggaagaa

SEQ ID NO: 1075750 - RNA, 16 nt, Homo sapiens
guggucuccuugcacu

SEQ ID NO: 1075751 - RNA, 14 nt, Homo sapiens
guguguugauccca

SEQ ID NO: 1075752 - RNA, 19 nt, Homo sapiens
guguuauuauuuugcacug

SEQ ID NO: 1075753 - RNA, 16 nt, Homo sapiens
guguuuaaaacaugca

SEQ ID NO: 1075754 - RNA, 20 nt, Homo sapiens
guuaaucuauaacuacauau

SEQ ID NO: 1075755 - RNA, 21 nt, Homo sapiens
guuacuugaaauaccagugaa

SEQ ID NO: 1075756 - RNA, 15 nt, Homo sapiens
guuauagaaacugau

SEQ ID NO: 1075757 - RNA, 15 nt, Homo sapiens
guuauguuugcacuu

SEQ ID NO: 1075758 - RNA, 16 nt, Homo sapiens
guuauguuugcacuuu

SEQ ID NO: 1075759 - RNA, 17 nt, Homo sapiens
guuauguuugcacuuug

SEQ ID NO: 1075760 - RNA, 18 nt, Homo sapiens
guuauuauuuugcacugu

SEQ ID NO: 1075761 - RNA, 17 nt, Homo sapiens
guucauuuuagugacug

SEQ ID NO: 1075762 - RNA, 14 nt, Homo sapiens
guucugaacuggaa

SEQ ID NO: 1075763 - RNA, 13 nt, Homo sapiens
guucuuagcugaa

SEQ ID NO: 1075764 - RNA, 19 nt, Homo sapiens
guucuuagcugaacaauga

SEQ ID NO: 1075765 - RNA, 20 nt, Homo sapiens
guugauaaauuccacuggac

SEQ ID NO: 1075766 - RNA, 15 nt, Homo sapiens
guugcacugaugucc

SEQ ID NO: 1075767 - RNA, 22 nt, Homo sapiens
guuggacccgcucuggaccaac

SEQ ID NO: 1075768 - RNA, 15 nt, Homo sapiens
guugucacaccugaa

SEQ ID NO: 1075769 - RNA, 17 nt, Homo sapiens
guuugagcucaggcauu

SEQ ID NO: 1075770 - RNA, 15 nt, Homo sapiens
uaaaaacaaaaccac

SEQ ID NO: 1075771 - RNA, 12 nt, Homo sapiens
uaaaacaugugu

SEQ ID NO: 1075772 - RNA, 14 nt, Homo sapiens
uaaaauucuuggga

SEQ ID NO: 1075773 - RNA, 17 nt, Homo sapiens
uaaacacccaugaauca

SEQ ID NO: 1075774 - RNA, 21 nt, Homo sapiens
gcagugacuuuagaaacaaau

SEQ ID NO: 1075775 - RNA, 21 nt, Homo sapiens
gcaguggugcaugcacugucu

SEQ ID NO: 1075776 - RNA, 13 nt, Homo sapiens
gcagugugcagug

SEQ ID NO: 1075777 - RNA, 20 nt, Homo sapiens
gcaucauuuacaagacaaca

SEQ ID NO: 1075778 - RNA, 12 nt, Homo sapiens
gcaucuagccag

SEQ ID NO: 1075779 - RNA, 13 nt, Homo sapiens
gcauuagcuacuu

SEQ ID NO: 1075780 - RNA, 17 nt, Homo sapiens
gcauuucaccauucaaa

SEQ ID NO: 1075781 - RNA, 21 nt, Homo sapiens
gccacaugccgcgucccugcc

SEQ ID NO: 1075782 - RNA, 13 nt, Homo sapiens
gccacccacugac

SEQ ID NO: 1075783 - RNA, 13 nt, Homo sapiens
gccacugcacucc

SEQ ID NO: 1075784 - RNA, 23 nt, Homo sapiens
gccacuugguuuuuggcucuuuc

SEQ ID NO: 1075785 - RNA, 19 nt, Homo sapiens
gccagaaaacauaugcauu

SEQ ID NO: 1075786 - RNA, 18 nt, Homo sapiens
gccagaugugguggcacg

SEQ ID NO: 1075787 - RNA, 20 nt, Homo sapiens
gccaucaccuaggacugacu

SEQ ID NO: 1075788 - RNA, 16 nt, Homo sapiens
gccauccaaagaaaca

SEQ ID NO: 1075789 - RNA, 21 nt, Homo sapiens
gccaugaucgagccacugcac

SEQ ID NO: 1075790 - RNA, 23 nt, Homo sapiens
gccauuauuucaaccgcuugcca

SEQ ID NO: 1075791 - RNA, 20 nt, Homo sapiens
gcccagccauuaccauggag

SEQ ID NO: 1075792 - RNA, 16 nt, Homo sapiens
gcccagcugcaccugc

SEQ ID NO: 1075793 - RNA, 18 nt, Homo sapiens
gcccagggagaagggaca

SEQ ID NO: 1075794 - RNA, 16 nt, Homo sapiens
gccccaggaucacucu

SEQ ID NO: 1075795 - RNA, 17 nt, Homo sapiens
gccccaucauugcaccu

SEQ ID NO: 1075796 - RNA, 13 nt, Homo sapiens
gcccugcucuuuc

SEQ ID NO: 1075797 - RNA, 20 nt, Homo sapiens
gccuggccaacauggugaaa

SEQ ID NO: 1075798 - RNA, 21 nt, Homo sapiens
gccuggcccuugaguggggca

SEQ ID NO: 1075799 - RNA, 11 nt, Homo sapiens
gccuggugggc

SEQ ID NO: 1075800 - RNA, 21 nt, Homo sapiens
gccuucacuccggugugccug

SEQ ID NO: 1075801 - RNA, 15 nt, Homo sapiens
gccuugcaguaggca

SEQ ID NO: 1075802 - RNA, 14 nt, Homo sapiens
gccuugccaugucu

SEQ ID NO: 1075803 - RNA, 23 nt, Homo sapiens
gccuugucuucuuagcugucacc

SEQ ID NO: 1075804 - RNA, 14 nt, Homo sapiens
gcggcccugacacg

SEQ ID NO: 1075805 - RNA, 18 nt, Homo sapiens
gcggggagccaucaccua

SEQ ID NO: 1075806 - RNA, 19 nt, Homo sapiens
gcgugguggcgggcaccua

SEQ ID NO: 1075807 - RNA, 21 nt, Homo sapiens
gcuacuuuucagaauugaagg

SEQ ID NO: 1075808 - RNA, 17 nt, Homo sapiens
gcuauuuucugaccaaa

SEQ ID NO: 1075809 - RNA, 16 nt, Homo sapiens
gcucagaagccagucu

SEQ ID NO: 1075810 - RNA, 22 nt, Homo sapiens
gcucaggaggcuuggaaagcau

SEQ ID NO: 1075811 - RNA, 22 nt, Homo sapiens
gcuccacuacccggcaggguac

SEQ ID NO: 1075812 - RNA, 13 nt, Homo sapiens
gcuccaugcaccu

SEQ ID NO: 1075813 - RNA, 14 nt, Homo sapiens
gcuccaugcaccuc

SEQ ID NO: 1075814 - RNA, 14 nt, Homo sapiens
gcucccaagcugcc

SEQ ID NO: 1075815 - RNA, 19 nt, Homo sapiens
gcucccagggacugacacg

SEQ ID NO: 1075816 - RNA, 16 nt, Homo sapiens
gcuccuccauggugcu

SEQ ID NO: 1075817 - RNA, 15 nt, Homo sapiens
gcuccugaccaaaga

SEQ ID NO: 1075818 - RNA, 16 nt, Homo sapiens
gcuccugaccaaagac

SEQ ID NO: 1075819 - RNA, 12 nt, Homo sapiens
gcucgggugcug

SEQ ID NO: 1075820 - RNA, 21 nt, Homo sapiens
gcucucugggccuggguucca

SEQ ID NO: 1075821 - RNA, 14 nt, Homo sapiens
gcucugaagccaag

SEQ ID NO: 1075822 - RNA, 16 nt, Homo sapiens
gcucuucucagugucu

SEQ ID NO: 1075823 - RNA, 13 nt, Homo sapiens
gcucuuucagaga

SEQ ID NO: 1075824 - RNA, 23 nt, Homo sapiens
gcucuuucagagaggucucaggu

SEQ ID NO: 1075825 - RNA, 22 nt, Homo sapiens
gcucuuucucugagaaccaaaa

SEQ ID NO: 1075826 - RNA, 22 nt, Homo sapiens
gcugcagccucccuuccaugcc

SEQ ID NO: 1075827 - RNA, 20 nt, Homo sapiens
gcugcagugacgugcaccug

SEQ ID NO: 1075828 - RNA, 19 nt, Homo sapiens
gcugcauugaguccagcuu

SEQ ID NO: 1075829 - RNA, 21 nt, Homo sapiens
gcuggagucucagagcacaga

SEQ ID NO: 1075830 - RNA, 20 nt, Homo sapiens
gcugggaaaaaaguuuugau

SEQ ID NO: 1075831 - RNA, 18 nt, Homo sapiens
ugaugccaaagcugcuuu

SEQ ID NO: 1075832 - RNA, 21 nt, Homo sapiens
ugaugccaaagcugcuuucuu

SEQ ID NO: 1075833 - RNA, 19 nt, Homo sapiens
ugauggcccucaucuccag

SEQ ID NO: 1075834 - RNA, 20 nt, Homo sapiens
ugaugugugaaaccugacac

SEQ ID NO: 1075835 - RNA, 14 nt, Homo sapiens
ugauuaugccacug

SEQ ID NO: 1075836 - RNA, 19 nt, Homo sapiens
ugcacauuuuguacaaaga

SEQ ID NO: 1075837 - RNA, 16 nt, Homo sapiens
ugcaccugccagccug

SEQ ID NO: 1075838 - RNA, 10 nt, Homo sapiens
ugcacuuugu

SEQ ID NO: 1075839 - RNA, 13 nt, Homo sapiens
ugcagggcacugu

SEQ ID NO: 1075840 - RNA, 16 nt, Homo sapiens
ugcaguggugcaugca

SEQ ID NO: 1075841 - RNA, 14 nt, Homo sapiens
ugccaaaacaaugc

SEQ ID NO: 1075842 - RNA, 17 nt, Homo sapiens
ugccaugucuuguucag

SEQ ID NO: 1075843 - RNA, 20 nt, Homo sapiens
ugcccaggcuggagugcagu

SEQ ID NO: 1075844 - RNA, 14 nt, Homo sapiens
ugcccuuccuccag

SEQ ID NO: 1075845 - RNA, 17 nt, Homo sapiens
ugccucugaaaugccuc

SEQ ID NO: 1075846 - RNA, 23 nt, Homo sapiens
ugccugccaagcucacacagcag

SEQ ID NO: 1075847 - RNA, 15 nt, Homo sapiens
ugccuuccuguuuaa

SEQ ID NO: 1075848 - RNA, 22 nt, Homo sapiens
ugccuugaauauuuauucagug

SEQ ID NO: 1075849 - RNA, 16 nt, Homo sapiens
ugccuugccaugucuu

SEQ ID NO: 1075850 - RNA, 16 nt, Homo sapiens
ugcugacacugugacc

SEQ ID NO: 1075851 - RNA, 19 nt, Homo sapiens
ugcugaggccacccacuga

SEQ ID NO: 1075852 - RNA, 20 nt, Homo sapiens
ugcuuugaggcucaccagaa

SEQ ID NO: 1075853 - RNA, 17 nt, Homo sapiens
ugcuuuuguccuguuau

SEQ ID NO: 1075854 - RNA, 22 nt, Homo sapiens
uggaaagcaucaccucaggcca

SEQ ID NO: 1075855 - RNA, 20 nt, Homo sapiens
uggaaagccucugcugccau

SEQ ID NO: 1075856 - RNA, 14 nt, Homo sapiens
uggaagaaauuccu

SEQ ID NO: 1075857 - RNA, 15 nt, Homo sapiens
uggaagcacaugugu

SEQ ID NO: 1075858 - RNA, 19 nt, Homo sapiens
uggaaguguucaagaaaua

SEQ ID NO: 1075859 - RNA, 13 nt, Homo sapiens
uggaccagccugu

SEQ ID NO: 1075860 - RNA, 19 nt, Homo sapiens
uggagaaauaaaaauaccu

SEQ ID NO: 1075861 - RNA, 22 nt, Homo sapiens
uggagaccaggccugagcaaca

SEQ ID NO: 1075862 - RNA, 23 nt, Homo sapiens
uggagcccaggaguuugaggcug

SEQ ID NO: 1075863 - RNA, 15 nt, Homo sapiens
uggagguugcaguga

SEQ ID NO: 1075864 - RNA, 15 nt, Homo sapiens
uggagucucagagca

SEQ ID NO: 1075865 - RNA, 21 nt, Homo sapiens
uggauacagaaugaaucccau

SEQ ID NO: 1075866 - RNA, 18 nt, Homo sapiens
uggcacgugccugugauc

SEQ ID NO: 1075867 - RNA, 22 nt, Homo sapiens
uggccaggagguuggugacuga

SEQ ID NO: 1075868 - RNA, 14 nt, Homo sapiens
uggcccugccucau

SEQ ID NO: 1075869 - RNA, 13 nt, Homo sapiens
uggccuggcacac

SEQ ID NO: 1075870 - RNA, 20 nt, Homo sapiens
uggccuggcggagaugcuuc

SEQ ID NO: 1075871 - RNA, 19 nt, Homo sapiens
uggcugcucccugcuccca

SEQ ID NO: 1075872 - RNA, 18 nt, Homo sapiens
ugggcaacauaguaagac

SEQ ID NO: 1075873 - RNA, 17 nt, Homo sapiens
ugggcgaggccugacac

SEQ ID NO: 1075874 - RNA, 16 nt, Homo sapiens
uggggguuggggugcu

SEQ ID NO: 1075875 - RNA, 16 nt, Homo sapiens
uggugaucagugcaau

SEQ ID NO: 1075876 - RNA, 16 nt, Homo sapiens
uguaaauuaauacuuc

SEQ ID NO: 1075877 - RNA, 17 nt, Homo sapiens
uguaaucccagcacuuu

SEQ ID NO: 1075878 - RNA, 13 nt, Homo sapiens
uguagcugaugaa

SEQ ID NO: 1075879 - RNA, 22 nt, Homo sapiens
uguauaaugguguuacuaaagu

SEQ ID NO: 1075880 - RNA, 22 nt, Homo sapiens
uguauauugguugaaacuguua

SEQ ID NO: 1075881 - RNA, 22 nt, Homo sapiens
uguauuacaucuaaugcuucaa

SEQ ID NO: 1075882 - RNA, 14 nt, Homo sapiens
ugucaaguacaagc

SEQ ID NO: 1075883 - RNA, 18 nt, Homo sapiens
ugucagaaacucgaugaa

SEQ ID NO: 1075884 - RNA, 19 nt, Homo sapiens
ugucagggcaguacaaugu

SEQ ID NO: 1075885 - RNA, 13 nt, Homo sapiens
ugucgucuuuaug

SEQ ID NO: 1075886 - RNA, 22 nt, Homo sapiens
ugucuuauagguuuccacugcc

SEQ ID NO: 1075887 - RNA, 13 nt, Homo sapiens
uguguccuccugc

SEQ ID NO: 1075888 - RNA, 14 nt, Homo sapiens
acauggaauuaccu

SEQ ID NO: 1075889 - RNA, 20 nt, Homo sapiens
acauggccagugugauccca

SEQ ID NO: 1075890 - RNA, 14 nt, Homo sapiens
acauucacacaggg

SEQ ID NO: 1075891 - RNA, 13 nt, Homo sapiens
acauuccaggaaa

SEQ ID NO: 1075892 - RNA, 17 nt, Homo sapiens
acauuccaggaaaccau

SEQ ID NO: 1075893 - RNA, 14 nt, Homo sapiens
acauuuuguuauag

SEQ ID NO: 1075894 - RNA, 19 nt, Homo sapiens
accaaacucauucaccaaa

SEQ ID NO: 1075895 - RNA, 13 nt, Homo sapiens
accaaagagacug

SEQ ID NO: 1075896 - RNA, 18 nt, Homo sapiens
accaaaugaugccacuuc

SEQ ID NO: 1075897 - RNA, 18 nt, Homo sapiens
accaacccuguuuccuga

SEQ ID NO: 1075898 - RNA, 21 nt, Homo sapiens
accaacccuguuuccugaguu

SEQ ID NO: 1075899 - RNA, 23 nt, Homo sapiens
accacucaggccaacaagccaac

SEQ ID NO: 1075900 - RNA, 17 nt, Homo sapiens
accagaggcugcagaag

SEQ ID NO: 1075901 - RNA, 13 nt, Homo sapiens
accagucuuucaa

SEQ ID NO: 1075902 - RNA, 21 nt, Homo sapiens
accauccuggcuaacacguga

SEQ ID NO: 1075903 - RNA, 22 nt, Homo sapiens
acccaggccucccugcagacuc

SEQ ID NO: 1075904 - RNA, 22 nt, Homo sapiens
acccaugaaucaaagacaugga

SEQ ID NO: 1075905 - RNA, 21 nt, Homo sapiens
acccgguuaccuuggccguga

SEQ ID NO: 1075906 - RNA, 21 nt, Homo sapiens
accgggacuucaaagccguga

SEQ ID NO: 1075907 - RNA, 20 nt, Homo sapiens
accuaccaccccuuccuguc

SEQ ID NO: 1075908 - RNA, 18 nt, Homo sapiens
accuccauuucucuccag

SEQ ID NO: 1075909 - RNA, 15 nt, Homo sapiens
accuccuuggcaccg

SEQ ID NO: 1075910 - RNA, 22 nt, Homo sapiens
accuccuuuucuucuagcuuug

SEQ ID NO: 1075911 - RNA, 17 nt, Homo sapiens
accucucucaaaucuca

SEQ ID NO: 1075912 - RNA, 21 nt, Homo sapiens
accucugcucugaggcuucca

SEQ ID NO: 1075913 - RNA, 15 nt, Homo sapiens
accucuucuaugcaa

SEQ ID NO: 1075914 - RNA, 14 nt, Homo sapiens
accucuucucuucc

SEQ ID NO: 1075915 - RNA, 21 nt, Homo sapiens
accucuuuauuuuuugauuga

SEQ ID NO: 1075916 - RNA, 18 nt, Homo sapiens
accuguccauaaaguaau

SEQ ID NO: 1075917 - RNA, 14 nt, Homo sapiens
accuuagaaaucau

SEQ ID NO: 1075918 - RNA, 19 nt, Homo sapiens
accuuuuccccaggagcag

SEQ ID NO: 1075919 - RNA, 20 nt, Homo sapiens
acgcuuuuugggagaaugau

SEQ ID NO: 1075920 - RNA, 16 nt, Homo sapiens
acggaggugccugagg

SEQ ID NO: 1075921 - RNA, 21 nt, Homo sapiens
acgucuguccuccuuucuuau

SEQ ID NO: 1075922 - RNA, 17 nt, Homo sapiens
acgugauggaccaaagc

SEQ ID NO: 1075923 - RNA, 22 nt, Homo sapiens
acgugauggaccaaagccaccu

SEQ ID NO: 1075924 - RNA, 17 nt, Homo sapiens
acgugccugugauccca

SEQ ID NO: 1075925 - RNA, 15 nt, Homo sapiens
acguucuuaguuuac

SEQ ID NO: 1075926 - RNA, 20 nt, Homo sapiens
acucacaagaagaccagacu

SEQ ID NO: 1075927 - RNA, 18 nt, Homo sapiens
acucaggccaacaagcca

SEQ ID NO: 1075928 - RNA, 18 nt, Homo sapiens
acuccagccugggcaaca

SEQ ID NO: 1075929 - RNA, 14 nt, Homo sapiens
acucccauuuuccc

SEQ ID NO: 1075930 - RNA, 21 nt, Homo sapiens
acucugcucuaugccaggcug

SEQ ID NO: 1075931 - RNA, 13 nt, Homo sapiens
acucuuugcuaca

SEQ ID NO: 1075932 - RNA, 12 nt, Homo sapiens
acugagccagaa

SEQ ID NO: 1075933 - RNA, 18 nt, Homo sapiens
acuggacugugugcaacg

SEQ ID NO: 1075934 - RNA, 15 nt, Homo sapiens
acuggagcaucugac

SEQ ID NO: 1075935 - RNA, 20 nt, Homo sapiens
acuggaggggcccacccaca

SEQ ID NO: 1075936 - RNA, 21 nt, Homo sapiens
acugucccucaaaugacccaa

SEQ ID NO: 1075937 - RNA, 18 nt, Homo sapiens
acugugccugagcucuga

SEQ ID NO: 1075938 - RNA, 14 nt, Homo sapiens
acuguugcacugau

SEQ ID NO: 1075939 - RNA, 12 nt, Homo sapiens
acuuccauuccc

SEQ ID NO: 1075940 - RNA, 18 nt, Homo sapiens
acuucuaugcaaaugccu

SEQ ID NO: 1075941 - RNA, 20 nt, Homo sapiens
acuucugucuccugucuuca

SEQ ID NO: 1075942 - RNA, 23 nt, Homo sapiens
acuugaggacacauguccagugg

SEQ ID NO: 1075943 - RNA, 21 nt, Homo sapiens
acuugcaccugguacugcaca

SEQ ID NO: 1075944 - RNA, 19 nt, Homo sapiens
acuuugaaaauauauaccg

SEQ ID NO: 1075945 - RNA, 16 nt, Homo sapiens
acuuuuuagccaguga

SEQ ID NO: 1075946 - RNA, 19 nt, Homo sapiens
acuuuuucugagcuuuuca

SEQ ID NO: 1075947 - RNA, 14 nt, Homo sapiens
agaaaacaugacuu

SEQ ID NO: 1075948 - RNA, 12 nt, Homo sapiens
agaaaaugcauu

SEQ ID NO: 1075949 - RNA, 18 nt, Homo sapiens
agaaacacuaagcucucu

SEQ ID NO: 1075950 - RNA, 22 nt, Homo sapiens
agaaacgcagauugggcuggcu

SEQ ID NO: 1075951 - RNA, 15 nt, Homo sapiens
agaaaggaaccuguc

SEQ ID NO: 1075952 - RNA, 22 nt, Homo sapiens
agaacaugaggauaacuuccuu

SEQ ID NO: 1075953 - RNA, 13 nt, Homo sapiens
agaacccuuccug

SEQ ID NO: 1075954 - RNA, 16 nt, Homo sapiens
agaagcacauaugaac

SEQ ID NO: 1075955 - RNA, 20 nt, Homo sapiens
agaagccccugggggcuccc

SEQ ID NO: 1075956 - RNA, 22 nt, Homo sapiens
agaaggauggcauuuuuugcaa

SEQ ID NO: 1075957 - RNA, 14 nt, Homo sapiens
agaauacacuauca

SEQ ID NO: 1075958 - RNA, 15 nt, Homo sapiens
agaaucgcuuuccuu

SEQ ID NO: 1075959 - RNA, 14 nt, Homo sapiens
agacaaagcaaagc

SEQ ID NO: 1075960 - RNA, 18 nt, Homo sapiens
agacauggaauuaccuua

SEQ ID NO: 1075961 - RNA, 19 nt, Homo sapiens
agaccaaagcauugccugc

SEQ ID NO: 1075962 - RNA, 23 nt, Homo sapiens
agaccaggccugagcaacaaagc

SEQ ID NO: 1075963 - RNA, 17 nt, Homo sapiens
agaccauugucuuccaa

SEQ ID NO: 1075964 - RNA, 14 nt, Homo sapiens
agaccgaaucucac

SEQ ID NO: 1075965 - RNA, 13 nt, Homo sapiens
agacuaagccaga

SEQ ID NO: 1075966 - RNA, 17 nt, Homo sapiens
agacuaaggggcagcuc

SEQ ID NO: 1075967 - RNA, 17 nt, Homo sapiens
agacuccaauggggcca

SEQ ID NO: 1075968 - RNA, 19 nt, Homo sapiens
agagacuggagcaucugac

SEQ ID NO: 1075969 - RNA, 16 nt, Homo sapiens
agagaguccucuggau

SEQ ID NO: 1075970 - RNA, 21 nt, Homo sapiens
agagcagggccaaagcacagc

SEQ ID NO: 1075971 - RNA, 17 nt, Homo sapiens
agagccacgcuggccuu

SEQ ID NO: 1075972 - RNA, 19 nt, Homo sapiens
agaggcugcagaaggccaa

SEQ ID NO: 1075973 - RNA, 19 nt, Homo sapiens
agagggccaacaacugucc

SEQ ID NO: 1075974 - RNA, 20 nt, Homo sapiens
agagguggagguugcaguga

SEQ ID NO: 1075975 - RNA, 13 nt, Homo sapiens
agaguccucugga

SEQ ID NO: 1075976 - RNA, 19 nt, Homo sapiens
agagugagacccugucuca

SEQ ID NO: 1075977 - RNA, 16 nt, Homo sapiens
agaguuguacacugug

SEQ ID NO: 1075978 - RNA, 18 nt, Homo sapiens
agaucacgccacugcacu

SEQ ID NO: 1075979 - RNA, 12 nt, Homo sapiens
agaugugguggc

SEQ ID NO: 1075980 - RNA, 20 nt, Homo sapiens
agauuagcucuggaccagcc

SEQ ID NO: 1075981 - RNA, 22 nt, Homo sapiens
agauuguucuguccaguuucca

SEQ ID NO: 1075982 - RNA, 20 nt, Homo sapiens
agcaaauguuucugcaguag

SEQ ID NO: 1075983 - RNA, 17 nt, Homo sapiens
agcaagcagacauuuau

SEQ ID NO: 1075984 - RNA, 18 nt, Homo sapiens
agcaagcagacauuuauc

SEQ ID NO: 1075985 - RNA, 17 nt, Homo sapiens
agcaaucugucuuuaga

SEQ ID NO: 1075986 - RNA, 11 nt, Homo sapiens
agcacaugugu

SEQ ID NO: 1075987 - RNA, 22 nt, Homo sapiens
agcagcacaccucagccccacu

SEQ ID NO: 1075988 - RNA, 18 nt, Homo sapiens
agcaggaacugagccaga

SEQ ID NO: 1075989 - RNA, 17 nt, Homo sapiens
agcaucaccucaggcca

SEQ ID NO: 1075990 - RNA, 14 nt, Homo sapiens
agcaucugacucac

SEQ ID NO: 1075991 - RNA, 19 nt, Homo sapiens
agcaucugacucacaagaa

SEQ ID NO: 1075992 - RNA, 19 nt, Homo sapiens
agcaugacgggaaaaccaa

SEQ ID NO: 1075993 - RNA, 17 nt, Homo sapiens
agcauggagagccucuu

SEQ ID NO: 1075994 - RNA, 20 nt, Homo sapiens
agcauuaacagcagguguga

SEQ ID NO: 1075995 - RNA, 18 nt, Homo sapiens
agcauuagcuacuuuuca

SEQ ID NO: 1075996 - RNA, 16 nt, Homo sapiens
agccaaacucugccag

SEQ ID NO: 1075997 - RNA, 21 nt, Homo sapiens
agccaaacucugccagccaca

SEQ ID NO: 1075998 - RNA, 17 nt, Homo sapiens
agccacauuuugcauua

SEQ ID NO: 1075999 - RNA, 16 nt, Homo sapiens
agccaccuccuuggca

SEQ ID NO: 1076000 - RNA, 19 nt, Homo sapiens
ccugagcaacagagugaga

SEQ ID NO: 1076001 - RNA, 14 nt, Homo sapiens
ccugaguuucucuc

SEQ ID NO: 1076002 - RNA, 22 nt, Homo sapiens
ccugcacagccucuaguguccg

SEQ ID NO: 1076003 - RNA, 12 nt, Homo sapiens
ccugcagguccu

SEQ ID NO: 1076004 - RNA, 12 nt, Homo sapiens
ccugcaggugag

SEQ ID NO: 1076005 - RNA, 13 nt, Homo sapiens
ccugcggaugcau

SEQ ID NO: 1076006 - RNA, 19 nt, Homo sapiens
ccugcugcgggggagccag

SEQ ID NO: 1076007 - RNA, 18 nt, Homo sapiens
ccuggcuugucggagcaa

SEQ ID NO: 1076008 - RNA, 19 nt, Homo sapiens
ccuggcuugucggagcaag

SEQ ID NO: 1076009 - RNA, 19 nt, Homo sapiens
ccugggagaaccucaggcu

SEQ ID NO: 1076010 - RNA, 12 nt, Homo sapiens
ccuguaacacaa

SEQ ID NO: 1076011 - RNA, 16 nt, Homo sapiens
ccuguagucccagcua

SEQ ID NO: 1076012 - RNA, 23 nt, Homo sapiens
ccuguuacuugaaauaccaguga

SEQ ID NO: 1076013 - RNA, 14 nt, Homo sapiens
ccuuaacuggcaua

SEQ ID NO: 1076014 - RNA, 14 nt, Homo sapiens
ccuuaagcaugacg

SEQ ID NO: 1076015 - RNA, 12 nt, Homo sapiens
ccuucaugauga

SEQ ID NO: 1076016 - RNA, 18 nt, Homo sapiens
ccuuccugccaccaguca

SEQ ID NO: 1076017 - RNA, 17 nt, Homo sapiens
ccuucgauauaugacuu

SEQ ID NO: 1076018 - RNA, 17 nt, Homo sapiens
ccuucucccuugcccuc

SEQ ID NO: 1076019 - RNA, 22 nt, Homo sapiens
ccuuuuuacagccaacuuuucu

SEQ ID NO: 1076020 - RNA, 13 nt, Homo sapiens
cgacaaagccaaa

SEQ ID NO: 1076021 - RNA, 17 nt, Homo sapiens
cgagaucacgccacugc

SEQ ID NO: 1076022 - RNA, 21 nt, Homo sapiens
cgagaucacgccacugcacuc

SEQ ID NO: 1076023 - RNA, 17 nt, Homo sapiens
cgaguuguggaaagccu

SEQ ID NO: 1076024 - RNA, 23 nt, Homo sapiens
cgauuucucucucucccccucag

SEQ ID NO: 1076025 - RNA, 22 nt, Homo sapiens
cgcagauugggcuggcucugaa

SEQ ID NO: 1076026 - RNA, 21 nt, Homo sapiens
cgccuguaaucccagcacuuu

SEQ ID NO: 1076027 - RNA, 22 nt, Homo sapiens
cgccuguaaucccagcacuuug

SEQ ID NO: 1076028 - RNA, 15 nt, Homo sapiens
cggcagugugcagug

SEQ ID NO: 1076029 - RNA, 21 nt, Homo sapiens
cgggaagcgaugaauuuggag

SEQ ID NO: 1076030 - RNA, 20 nt, Homo sapiens
cggggaucaucucugugacc

SEQ ID NO: 1076031 - RNA, 13 nt, Homo sapiens
cguagccaucucu

SEQ ID NO: 1076032 - RNA, 17 nt, Homo sapiens
cgugaaaccccgucucu

SEQ ID NO: 1076033 - RNA, 14 nt, Homo sapiens
cgugccugccaagc

SEQ ID NO: 1076034 - RNA, 13 nt, Homo sapiens
cgugccugugauc

SEQ ID NO: 1076035 - RNA, 18 nt, Homo sapiens
cguggucuccuugcacuu

SEQ ID NO: 1076036 - RNA, 19 nt, Homo sapiens
cguggucuccuugcacuuu

SEQ ID NO: 1076037 - RNA, 21 nt, Homo sapiens
cuaagcauggccuggacugac

SEQ ID NO: 1076038 - RNA, 22 nt, Homo sapiens
cuaaggggcagcuccugaccaa

SEQ ID NO: 1076039 - RNA, 23 nt, Homo sapiens
cuaaggggcagcuccugaccaaa

SEQ ID NO: 1076040 - RNA, 20 nt, Homo sapiens
cuaaugcuucaaguguugcu

SEQ ID NO: 1076041 - RNA, 12 nt, Homo sapiens
cuacacauauau

SEQ ID NO: 1076042 - RNA, 19 nt, Homo sapiens
cuacauauugaauagggcu

SEQ ID NO: 1076043 - RNA, 13 nt, Homo sapiens
cuacccacuucca

SEQ ID NO: 1076044 - RNA, 19 nt, Homo sapiens
cuagaccuguuuugcuuuu

SEQ ID NO: 1076045 - RNA, 23 nt, Homo sapiens
cuagugcuuccacuucuaugcaa

SEQ ID NO: 1076046 - RNA, 17 nt, Homo sapiens
cucaaaugacccaaaga

SEQ ID NO: 1076047 - RNA, 18 nt, Homo sapiens
cucaaaugacccaaagac

SEQ ID NO: 1076048 - RNA, 22 nt, Homo sapiens
cucaaaugacccaaagaccaau

SEQ ID NO: 1076049 - RNA, 18 nt, Homo sapiens
cucaaauuguaauuaaua

SEQ ID NO: 1076050 - RNA, 15 nt, Homo sapiens
cucacaagaagacca

SEQ ID NO: 1076051 - RNA, 16 nt, Homo sapiens
cucacacagcaggaac

SEQ ID NO: 1076052 - RNA, 22 nt, Homo sapiens
cucacaccuccuuuucuucuag

SEQ ID NO: 1076053 - RNA, 18 nt, Homo sapiens
cucacgccuaugauccca

SEQ ID NO: 1076054 - RNA, 22 nt, Homo sapiens
cucagagcagggccaaagcaca

SEQ ID NO: 1076055 - RNA, 18 nt, Homo sapiens
cucagaucugaacacagu

SEQ ID NO: 1076056 - RNA, 14 nt, Homo sapiens
cucagccccacuga

SEQ ID NO: 1076057 - RNA, 21 nt, Homo sapiens
cuccaauggggccagcacugg

SEQ ID NO: 1076058 - RNA, 17 nt, Homo sapiens
cuccagcuaacugugga

SEQ ID NO: 1076059 - RNA, 17 nt, Homo sapiens
cucccaggaaccaaaaa

SEQ ID NO: 1076060 - RNA, 22 nt, Homo sapiens
aaaaguaaguaccacucaggcc

SEQ ID NO: 1076061 - RNA, 16 nt, Homo sapiens
aaaaguuuugaugaaa

SEQ ID NO: 1076062 - RNA, 12 nt, Homo sapiens
aaaauaccucuu

SEQ ID NO: 1076063 - RNA, 23 nt, Homo sapiens
aaaauuagccagaugugguggca

SEQ ID NO: 1076064 - RNA, 11 nt, Homo sapiens
aaacacuguuu

SEQ ID NO: 1076065 - RNA, 19 nt, Homo sapiens
aaacaugcuaaauaguucu

SEQ ID NO: 1076066 - RNA, 15 nt, Homo sapiens
aaacauuccaggaaa

SEQ ID NO: 1076067 - RNA, 23 nt, Homo sapiens
aaacuccugauuuuguaguuaau

SEQ ID NO: 1076068 - RNA, 16 nt, Homo sapiens
aaacuguuaucacuua

SEQ ID NO: 1076069 - RNA, 20 nt, Homo sapiens
aaagaccaauauucaaaugc

SEQ ID NO: 1076070 - RNA, 15 nt, Homo sapiens
aaagacuaagccaga

SEQ ID NO: 1076071 - RNA, 16 nt, Homo sapiens
aaagacuacacuguug

SEQ ID NO: 1076072 - RNA, 20 nt, Homo sapiens
aaagcacuguuuaacuggga

SEQ ID NO: 1076073 - RNA, 13 nt, Homo sapiens
aaagcaucaccuc

SEQ ID NO: 1076074 - RNA, 16 nt, Homo sapiens
aaagcaucaccucagg

SEQ ID NO: 1076075 - RNA, 14 nt, Homo sapiens
aaagcgagauccca

SEQ ID NO: 1076076 - RNA, 15 nt, Homo sapiens
aaagcugcugucacu

SEQ ID NO: 1076077 - RNA, 20 nt, Homo sapiens
aaaguuauauuuacuuuaaa

SEQ ID NO: 1076078 - RNA, 21 nt, Homo sapiens
aaauacaaaaaauuagccaga

SEQ ID NO: 1076079 - RNA, 16 nt, Homo sapiens
aaauaguguacacaga

SEQ ID NO: 1076080 - RNA, 15 nt, Homo sapiens
aaaucaacuugugua

SEQ ID NO: 1076081 - RNA, 20 nt, Homo sapiens
aaaucaguaaacacugugua

SEQ ID NO: 1076082 - RNA, 15 nt, Homo sapiens
aaaucaguuauguca

SEQ ID NO: 1076083 - RNA, 15 nt, Homo sapiens
aaaucauacuccuau

SEQ ID NO: 1076084 - RNA, 17 nt, Homo sapiens
aaaucucauuugguaca

SEQ ID NO: 1076085 - RNA, 14 nt, Homo sapiens
aaaugacccaaaga

SEQ ID NO: 1076086 - RNA, 20 nt, Homo sapiens
aaaugccuccaagccauuca

SEQ ID NO: 1076087 - RNA, 22 nt, Homo sapiens
aaaugccuccaagccauucacu

SEQ ID NO: 1076088 - RNA, 22 nt, Homo sapiens
aaaugguauccagaauggaauu

SEQ ID NO: 1076089 - RNA, 12 nt, Homo sapiens
aaauguguuuca

SEQ ID NO: 1076090 - RNA, 23 nt, Homo sapiens
aaauuauacuguagcugaugaaa

SEQ ID NO: 1076091 - RNA, 12 nt, Homo sapiens
aaauuccuguag

SEQ ID NO: 1076092 - RNA, 18 nt, Homo sapiens
aaauucucaaccuaccac

SEQ ID NO: 1076093 - RNA, 17 nt, Homo sapiens
aaauucuugaaguucau

SEQ ID NO: 1076094 - RNA, 22 nt, Homo sapiens
aaauuguauacauuuuguuaua

SEQ ID NO: 1076095 - RNA, 13 nt, Homo sapiens
aacaaaaccacac

SEQ ID NO: 1076096 - RNA, 13 nt, Homo sapiens
aacaaaauccaac

SEQ ID NO: 1076097 - RNA, 16 nt, Homo sapiens
aacacaagccacagaa

SEQ ID NO: 1076098 - RNA, 12 nt, Homo sapiens
aacacccaugaa

SEQ ID NO: 1076099 - RNA, 22 nt, Homo sapiens
aacaugguaaaaccccaucucu

SEQ ID NO: 1076100 - RNA, 17 nt, Homo sapiens
aacccaauuuuguuuca

SEQ ID NO: 1076101 - RNA, 23 nt, Homo sapiens
aacccaggucugaugccaaagcu

SEQ ID NO: 1076102 - RNA, 13 nt, Homo sapiens
aaccgacuuuucu

SEQ ID NO: 1076103 - RNA, 20 nt, Homo sapiens
aaccuaccaccccuuccugu

SEQ ID NO: 1076104 - RNA, 17 nt, Homo sapiens
aacgcuuuuugggagaa

SEQ ID NO: 1076105 - RNA, 14 nt, Homo sapiens
aacuaguguuuguu

SEQ ID NO: 1076106 - RNA, 15 nt, Homo sapiens
aacucacucacucug

SEQ ID NO: 1076107 - RNA, 18 nt, Homo sapiens
aacuccccuuguacucuu

SEQ ID NO: 1076108 - RNA, 19 nt, Homo sapiens
aacuugaggacacaugucc

SEQ ID NO: 1076109 - RNA, 18 nt, Homo sapiens
aacuugggggaggaggaa

SEQ ID NO: 1076110 - RNA, 12 nt, Homo sapiens
aagaaauuccug

SEQ ID NO: 1076111 - RNA, 13 nt, Homo sapiens
aagaagaccagac

SEQ ID NO: 1076112 - RNA, 17 nt, Homo sapiens
aagacaaagcaaagcca

SEQ ID NO: 1076113 - RNA, 18 nt, Homo sapiens
aagacauggaauuaccuu

SEQ ID NO: 1076114 - RNA, 14 nt, Homo sapiens
aagaccccaucucu

SEQ ID NO: 1076115 - RNA, 20 nt, Homo sapiens
cuuagauuagcucuggacca

SEQ ID NO: 1076116 - RNA, 15 nt, Homo sapiens
cuuauagguuuccac

SEQ ID NO: 1076117 - RNA, 16 nt, Homo sapiens
cuucaaguuagcucag

SEQ ID NO: 1076118 - RNA, 22 nt, Homo sapiens
cuucagguucuuucugaaaucg

SEQ ID NO: 1076119 - RNA, 17 nt, Homo sapiens
cuuccacuucuaugcaa

SEQ ID NO: 1076120 - RNA, 18 nt, Homo sapiens
cuuccucagggcccagca

SEQ ID NO: 1076121 - RNA, 16 nt, Homo sapiens
cuuccugccaccaguc

SEQ ID NO: 1076122 - RNA, 16 nt, Homo sapiens
cuugaaauaccaguga

SEQ ID NO: 1076123 - RNA, 22 nt, Homo sapiens
cuugaaauaccagugaaccaaa

SEQ ID NO: 1076124 - RNA, 21 nt, Homo sapiens
cuugaauauuuauucagugac

SEQ ID NO: 1076125 - RNA, 21 nt, Homo sapiens
cuugcagugagccgagauugc

SEQ ID NO: 1076126 - RNA, 21 nt, Homo sapiens
cuugcuagacagccagguuag

SEQ ID NO: 1076127 - RNA, 22 nt, Homo sapiens
cuuggaaagcaucaccucaggc

SEQ ID NO: 1076128 - RNA, 23 nt, Homo sapiens
cuugggggaggaggaacaaauaa

SEQ ID NO: 1076129 - RNA, 22 nt, Homo sapiens
cuuuaaaauaaaauaauuuuau

SEQ ID NO: 1076130 - RNA, 12 nt, Homo sapiens
cuuuagcuuauu

SEQ ID NO: 1076131 - RNA, 19 nt, Homo sapiens
cuuucucugagaaccaaaa

SEQ ID NO: 1076132 - RNA, 21 nt, Homo sapiens
cuuucuguagguuucucucuu

SEQ ID NO: 1076133 - RNA, 13 nt, Homo sapiens
cuuugaaacaugc

SEQ ID NO: 1076134 - RNA, 17 nt, Homo sapiens
cuuugacucaccuguua

SEQ ID NO: 1076135 - RNA, 15 nt, Homo sapiens
cuuuugggucugucc

SEQ ID NO: 1076136 - RNA, 16 nt, Homo sapiens
cuuuuuucuaguuuca

SEQ ID NO: 1076137 - RNA, 23 nt, Homo sapiens
cuuuuuugaaaucaguaaacacu

SEQ ID NO: 1076138 - RNA, 19 nt, Homo sapiens
gaaaaaaguuuugaugaaa

SEQ ID NO: 1076139 - RNA, 18 nt, Homo sapiens
gaaaaacauuccaggaaa

SEQ ID NO: 1076140 - RNA, 19 nt, Homo sapiens
gaaaaagacuaagccagac

SEQ ID NO: 1076141 - RNA, 12 nt, Homo sapiens
gaaaacauaugc

SEQ ID NO: 1076142 - RNA, 12 nt, Homo sapiens
gaaaacaugacu

SEQ ID NO: 1076143 - RNA, 13 nt, Homo sapiens
gaaaaugcauuau

SEQ ID NO: 1076144 - RNA, 15 nt, Homo sapiens
gaaauaaaaauaccu

SEQ ID NO: 1076145 - RNA, 20 nt, Homo sapiens
gaaauaccagugaaccaaag

SEQ ID NO: 1076146 - RNA, 22 nt, Homo sapiens
gaaauaccagugaaccaaagag

SEQ ID NO: 1076147 - RNA, 18 nt, Homo sapiens
gaaaucaguaaacacugu

SEQ ID NO: 1076148 - RNA, 19 nt, Homo sapiens
gaaaucaguaaacacugug

SEQ ID NO: 1076149 - RNA, 15 nt, Homo sapiens
gaaaucauuguagaa

SEQ ID NO: 1076150 - RNA, 17 nt, Homo sapiens
gaacucacucacucugg

SEQ ID NO: 1076151 - RNA, 15 nt, Homo sapiens
gaacuccaguacuca

SEQ ID NO: 1076152 - RNA, 19 nt, Homo sapiens
gaagaaaccuggaaccaga

SEQ ID NO: 1076153 - RNA, 20 nt, Homo sapiens
gaagaccaaagcauugccug

SEQ ID NO: 1076154 - RNA, 23 nt, Homo sapiens
gaaggagccacgugaauggcccu

SEQ ID NO: 1076155 - RNA, 15 nt, Homo sapiens
gaaggccacauguca

SEQ ID NO: 1076156 - RNA, 20 nt, Homo sapiens
gaauauuuauucagugacuu

SEQ ID NO: 1076157 - RNA, 13 nt, Homo sapiens
gaaucaaagacau

SEQ ID NO: 1076158 - RNA, 23 nt, Homo sapiens
gaaucaucaugugacgcuuucaa

SEQ ID NO: 1076159 - RNA, 18 nt, Homo sapiens
gaaugucuuacugugauc

SEQ ID NO: 1076160 - RNA, 22 nt, Homo sapiens
gaauugaaggagaaaaugcauu

SEQ ID NO: 1076161 - RNA, 12 nt, Homo sapiens
gaauugcaaucu

SEQ ID NO: 1076162 - RNA, 21 nt, Homo sapiens
gacaaagccaaacucugccag

SEQ ID NO: 1076163 - RNA, 15 nt, Homo sapiens
gacacaggugccuca

SEQ ID NO: 1076164 - RNA, 21 nt, Homo sapiens
gacagagaggggcagguugac

SEQ ID NO: 1076165 - RNA, 17 nt, Homo sapiens
gaccaggccugagcaac

SEQ ID NO: 1076166 - RNA, 14 nt, Homo sapiens
gaccuuccugccac

SEQ ID NO: 1076167 - RNA, 21 nt, Homo sapiens
gacggcugcucgaagaacaau

SEQ ID NO: 1076168 - RNA, 21 nt, Homo sapiens
gacuaacauaaaaucugugaa

SEQ ID NO: 1076169 - RNA, 13 nt, Homo sapiens
gacuaagccagac

SEQ ID NO: 1076170 - RNA, 16 nt, Homo sapiens
gacuccaauggggcca

SEQ ID NO: 1076171 - RNA, 23 nt, Homo sapiens
gacucugaaaaacauuccaggaa

SEQ ID NO: 1076172 - RNA, 13 nt, Homo sapiens
gacugaguccucg

SEQ ID NO: 1076173 - RNA, 16 nt, Homo sapiens
gacugugaccaaagca

SEQ ID NO: 1076174 - RNA, 16 nt, Homo sapiens
gacuugagcuuggcag

SEQ ID NO: 1076175 - RNA, 18 nt, Homo sapiens
gacuugucccucucucag

SEQ ID NO: 1076176 - RNA, 20 nt, Homo sapiens
gacuuuuuagccagugacuu

SEQ ID NO: 1076177 - RNA, 13 nt, Homo sapiens
gagaaccucaggc

SEQ ID NO: 1076178 - RNA, 17 nt, Homo sapiens
gagaagcaaguggcuuu

SEQ ID NO: 1076179 - RNA, 23 nt, Homo sapiens
gagaggucucagguucuuuccau

SEQ ID NO: 1076180 - RNA, 18 nt, Homo sapiens
gagauucuugugccucag

SEQ ID NO: 1076181 - RNA, 14 nt, Homo sapiens
gagcaacagaguga

SEQ ID NO: 1076182 - RNA, 17 nt, Homo sapiens
gagcaggggcaggguga

SEQ ID NO: 1076183 - RNA, 13 nt, Homo sapiens
gagccaccuuuac

SEQ ID NO: 1076184 - RNA, 17 nt, Homo sapiens
gagccagccuugcagua

SEQ ID NO: 1076185 - RNA, 21 nt, Homo sapiens
gagcucuuguuccgugccagg

SEQ ID NO: 1076186 - RNA, 22 nt, Homo sapiens
gaggagggaugcugccugaguc

SEQ ID NO: 1076187 - RNA, 12 nt, Homo sapiens
gaggcaggugag

SEQ ID NO: 1076188 - RNA, 18 nt, Homo sapiens
gaggggccugcaggugag

SEQ ID NO: 1076189 - RNA, 21 nt, Homo sapiens
gagggggcgguaggggcugca

SEQ ID NO: 1076190 - RNA, 18 nt, Homo sapiens
gaggugcgcucaccucag

SEQ ID NO: 1076191 - RNA, 18 nt, Homo sapiens
gagguggagguugcagug

SEQ ID NO: 1076192 - RNA, 22 nt, Homo sapiens
gagucucagagcacagagguag

SEQ ID NO: 1076193 - RNA, 16 nt, Homo sapiens
gaguuguacacugugu

SEQ ID NO: 1076194 - RNA, 16 nt, Homo sapiens
gauaggacuuccuuaa

SEQ ID NO: 1076195 - RNA, 17 nt, Homo sapiens
gauauauaggacauuga

SEQ ID NO: 1076196 - RNA, 19 nt, Homo sapiens
gauauaugacuuuuucuca

SEQ ID NO: 1076197 - RNA, 20 nt, Homo sapiens
gauauaugacuuuuucucag

SEQ ID NO: 1076198 - RNA, 18 nt, Homo sapiens
gauccugcuccagcagca

SEQ ID NO: 1076199 - RNA, 12 nt, Homo sapiens
gaugccaaagcu

SEQ ID NO: 1076200 - RNA, 17 nt, Homo sapiens
gaugcccaugguccagg

SEQ ID NO: 1076201 - RNA, 22 nt, Homo sapiens
gauggacucugaaaaacauucc

SEQ ID NO: 1076202 - RNA, 16 nt, Homo sapiens
gauggagcgcaccugc

SEQ ID NO: 1076203 - RNA, 18 nt, Homo sapiens
gauuagcucuggaccagc

SEQ ID NO: 1076204 - RNA, 19 nt, Homo sapiens
gauuggcuauaacaugucu

SEQ ID NO: 1076205 - RNA, 19 nt, Homo sapiens
gauuuccgugaaaaugcaa

SEQ ID NO: 1076206 - RNA, 21 nt, Homo sapiens
gauuucucuuugaaacaugcu

SEQ ID NO: 1076207 - RNA, 18 nt, Homo sapiens
gcaaauguuucugcagua

SEQ ID NO: 1076208 - RNA, 16 nt, Homo sapiens
gcaagcagacauuuau

SEQ ID NO: 1076209 - RNA, 14 nt, Homo sapiens
gcaaggcugugcuc

SEQ ID NO: 1076210 - RNA, 22 nt, Homo sapiens
gcacacacacauaagcacugaa

SEQ ID NO: 1076211 - RNA, 16 nt, Homo sapiens
gcagagccugagucac

SEQ ID NO: 1076212 - RNA, 14 nt, Homo sapiens
gcagcacaccucag

SEQ ID NO: 1076213 - RNA, 17 nt, Homo sapiens
gcagcagggggagcucc

SEQ ID NO: 1076214 - RNA, 17 nt, Homo sapiens
gcagcuccugaccaaag

SEQ ID NO: 1076215 - RNA, 18 nt, Homo sapiens
gcagcuccugaccaaaga

SEQ ID NO: 1076216 - RNA, 21 nt, Homo sapiens
gcaggcuauuuguucagagag

SEQ ID NO: 1076217 - RNA, 14 nt, Homo sapiens
gcaggcuccaugca

SEQ ID NO: 1076218 - RNA, 16 nt, Homo sapiens
gcaguacaaugugacu

SEQ ID NO: 1076219 - RNA, 16 nt, Homo sapiens
gcaguaugcugucaug

SEQ ID NO: 1076220 - RNA, 23 nt, Homo sapiens
gcagugacgugcaccuguacuca

SEQ ID NO: 1076221 - RNA, 15 nt, Homo sapiens
gcagugacuuuagaa

SEQ ID NO: 1076222 - RNA, 18 nt, Homo sapiens
gcagugugcaguggugca

SEQ ID NO: 1076223 - RNA, 22 nt, Homo sapiens
gcaucauuuacaagacaacauu

SEQ ID NO: 1076224 - RNA, 11 nt, Homo sapiens
cucuggaccaa

SEQ ID NO: 1076225 - RNA, 18 nt, Homo sapiens
cucugugcuuugacucac

SEQ ID NO: 1076226 - RNA, 16 nt, Homo sapiens
cucuguuucuuccuuu

SEQ ID NO: 1076227 - RNA, 15 nt, Homo sapiens
cucuucuuacuucac

SEQ ID NO: 1076228 - RNA, 19 nt, Homo sapiens
cucuuuauuuuuugauuga

SEQ ID NO: 1076229 - RNA, 19 nt, Homo sapiens
cugaagggugacaucccag

SEQ ID NO: 1076230 - RNA, 18 nt, Homo sapiens
cugaaugucuuacuguga

SEQ ID NO: 1076231 - RNA, 19 nt, Homo sapiens
cugacacgugauggaccaa

SEQ ID NO: 1076232 - RNA, 22 nt, Homo sapiens
cugacacgugauggaccaaagc

SEQ ID NO: 1076233 - RNA, 13 nt, Homo sapiens
cugacacugugac

SEQ ID NO: 1076234 - RNA, 15 nt, Homo sapiens
cugacacugugaccc

SEQ ID NO: 1076235 - RNA, 14 nt, Homo sapiens
cugacagaaaugca

SEQ ID NO: 1076236 - RNA, 22 nt, Homo sapiens
cugacccuaaauguggacauca

SEQ ID NO: 1076237 - RNA, 20 nt, Homo sapiens
cugacucacaagaagaccag

SEQ ID NO: 1076238 - RNA, 18 nt, Homo sapiens
cugagacaugacuaggaa

SEQ ID NO: 1076239 - RNA, 22 nt, Homo sapiens
cugagcaccagggagcaguugc

SEQ ID NO: 1076240 - RNA, 20 nt, Homo sapiens
cugaggcaggagaauggugu

SEQ ID NO: 1076241 - RNA, 20 nt, Homo sapiens
cugauggccccuccagcaca

SEQ ID NO: 1076242 - RNA, 14 nt, Homo sapiens
cugcagaaggccaa

SEQ ID NO: 1076243 - RNA, 23 nt, Homo sapiens
cugcagaggggaaaccaguguag

SEQ ID NO: 1076244 - RNA, 21 nt, Homo sapiens
cugcagcacuucacuaccaaa

SEQ ID NO: 1076245 - RNA, 13 nt, Homo sapiens
cugcagccaguca

SEQ ID NO: 1076246 - RNA, 21 nt, Homo sapiens
cugcaguagucucugugcuuu

SEQ ID NO: 1076247 - RNA, 16 nt, Homo sapiens
cugccagccacaucca

SEQ ID NO: 1076248 - RNA, 21 nt, Homo sapiens
cugccuugccaugucuuguuc

SEQ ID NO: 1076249 - RNA, 18 nt, Homo sapiens
cuggagcaucugacucac

SEQ ID NO: 1076250 - RNA, 20 nt, Homo sapiens
cuggcuguggguaucaggac

SEQ ID NO: 1076251 - RNA, 23 nt, Homo sapiens
cugggaaaaaaguuuugaugaaa

SEQ ID NO: 1076252 - RNA, 22 nt, Homo sapiens
cugggagugauaugauguguag

SEQ ID NO: 1076253 - RNA, 22 nt, Homo sapiens
cuggggguuggcccucacugca

SEQ ID NO: 1076254 - RNA, 13 nt, Homo sapiens
cugguugcuguau

SEQ ID NO: 1076255 - RNA, 15 nt, Homo sapiens
cuguaacacaagcca

SEQ ID NO: 1076256 - RNA, 17 nt, Homo sapiens
cuguaaucccagcacuu

SEQ ID NO: 1076257 - RNA, 20 nt, Homo sapiens
cuguaaucccagcacuuugg

SEQ ID NO: 1076258 - RNA, 23 nt, Homo sapiens
cuguaaucccagcacuuugggag

SEQ ID NO: 1076259 - RNA, 21 nt, Homo sapiens
cuguagccaccuccuuggcac

SEQ ID NO: 1076260 - RNA, 21 nt, Homo sapiens
cuguagucccagcuacucggg

SEQ ID NO: 1076261 - RNA, 13 nt, Homo sapiens
cuguauauguugu

SEQ ID NO: 1076262 - RNA, 20 nt, Homo sapiens
cuguaugauucuauggagcu

SEQ ID NO: 1076263 - RNA, 22 nt, Homo sapiens
cugucagaaucaugcuguucuc

SEQ ID NO: 1076264 - RNA, 15 nt, Homo sapiens
cugucaggacaccag

SEQ ID NO: 1076265 - RNA, 18 nt, Homo sapiens
cugucauguuaauguggg

SEQ ID NO: 1076266 - RNA, 15 nt, Homo sapiens
cuguccaguuuccaa

SEQ ID NO: 1076267 - RNA, 15 nt, Homo sapiens
cugucccuacccacu

SEQ ID NO: 1076268 - RNA, 12 nt, Homo sapiens
cugugaccaaag

SEQ ID NO: 1076269 - RNA, 22 nt, Homo sapiens
cuguuacuugaaauaccaguga

SEQ ID NO: 1076270 - RNA, 11 nt, Homo sapiens
cuguugcacug

SEQ ID NO: 1076271 - RNA, 12 nt, Homo sapiens
cuuaaagcugcu

SEQ ID NO: 1076272 - RNA, 22 nt, Homo sapiens
cuuagaugagggugacugucaa

SEQ ID NO: 1076273 - RNA, 15 nt, Homo sapiens
cuucacuaccaaaug

SEQ ID NO: 1076274 - RNA, 23 nt, Homo sapiens
cuucacuaccaaaugagcauuag

SEQ ID NO: 1076275 - RNA, 13 nt, Homo sapiens
cuuccaugcccca

SEQ ID NO: 1076276 - RNA, 12 nt, Homo sapiens
auuuugcauuag

SEQ ID NO: 1076277 - RNA, 22 nt, Homo sapiens
auuuugguuucuuccuuuccuc

SEQ ID NO: 1076278 - RNA, 21 nt, Homo sapiens
caaaaauaaaaacaaaaccac

SEQ ID NO: 1076279 - RNA, 23 nt, Homo sapiens
caaagcacagcugggcaugccau

SEQ ID NO: 1076280 - RNA, 14 nt, Homo sapiens
caaauaaauggagu

SEQ ID NO: 1076281 - RNA, 16 nt, Homo sapiens
caaaugacccaaagac

SEQ ID NO: 1076282 - RNA, 21 nt, Homo sapiens
caaaugccuccaagccauuca

SEQ ID NO: 1076283 - RNA, 20 nt, Homo sapiens
caaauuuggguauaugcagu

SEQ ID NO: 1076284 - RNA, 21 nt, Homo sapiens
caacaugguaaaaccccaucu

SEQ ID NO: 1076285 - RNA, 19 nt, Homo sapiens
caagaauauuguauguuaa

SEQ ID NO: 1076286 - RNA, 14 nt, Homo sapiens
caagcaagcagaca

SEQ ID NO: 1076287 - RNA, 18 nt, Homo sapiens
caagccacagaagccagg

SEQ ID NO: 1076288 - RNA, 17 nt, Homo sapiens
caagcccaggcuuccug

SEQ ID NO: 1076289 - RNA, 13 nt, Homo sapiens
caaggcacugacu

SEQ ID NO: 1076290 - RNA, 13 nt, Homo sapiens
caaggcugugcuc

SEQ ID NO: 1076291 - RNA, 13 nt, Homo sapiens
caaugacacauag

SEQ ID NO: 1076292 - RNA, 15 nt, Homo sapiens
caauuuuugaucaau

SEQ ID NO: 1076293 - RNA, 12 nt, Homo sapiens
cacaaauuguac

SEQ ID NO: 1076294 - RNA, 13 nt, Homo sapiens
cacaagaagacca

SEQ ID NO: 1076295 - RNA, 15 nt, Homo sapiens
cacacaacagcagau

SEQ ID NO: 1076296 - RNA, 13 nt, Homo sapiens
cacacagcaggaa

SEQ ID NO: 1076297 - RNA, 18 nt, Homo sapiens
cacaccgcuggucccugc

SEQ ID NO: 1076298 - RNA, 15 nt, Homo sapiens
cacagccucuagugu

SEQ ID NO: 1076299 - RNA, 13 nt, Homo sapiens
cacaggggagcag

SEQ ID NO: 1076300 - RNA, 12 nt, Homo sapiens
cacauagcacag

SEQ ID NO: 1076301 - RNA, 22 nt, Homo sapiens
cacauccaaccccccaccugcc

SEQ ID NO: 1076302 - RNA, 20 nt, Homo sapiens
cacauuuugcauuagacaga

SEQ ID NO: 1076303 - RNA, 23 nt, Homo sapiens
cacauuuugcauuagacagauga

SEQ ID NO: 1076304 - RNA, 17 nt, Homo sapiens
cacccacugacccaacu

SEQ ID NO: 1076305 - RNA, 17 nt, Homo sapiens
cacccaugaaucaaaga

SEQ ID NO: 1076306 - RNA, 13 nt, Homo sapiens
cacccaugccaua

SEQ ID NO: 1076307 - RNA, 22 nt, Homo sapiens
caccugcaggcuuagguccuca

SEQ ID NO: 1076308 - RNA, 16 nt, Homo sapiens
caccugccauuugcac

SEQ ID NO: 1076309 - RNA, 22 nt, Homo sapiens
cacgccuguaaucccagcacuu

SEQ ID NO: 1076310 - RNA, 19 nt, Homo sapiens
cacuacacuccagccugag

SEQ ID NO: 1076311 - RNA, 21 nt, Homo sapiens
cacucaggccaacaagccaac

SEQ ID NO: 1076312 - RNA, 17 nt, Homo sapiens
cagaaccagucuuucaa

SEQ ID NO: 1076313 - RNA, 23 nt, Homo sapiens
cagaauuauuuuuaagugguuuu

SEQ ID NO: 1076314 - RNA, 19 nt, Homo sapiens
cagacaagucuugcugugc

SEQ ID NO: 1076315 - RNA, 20 nt, Homo sapiens
cagagaggccuuuuguuuaa

SEQ ID NO: 1076316 - RNA, 17 nt, Homo sapiens
cagagaguccucuggau

SEQ ID NO: 1076317 - RNA, 18 nt, Homo sapiens
cagagcugcagccaguca

SEQ ID NO: 1076318 - RNA, 22 nt, Homo sapiens
cagaggcagcgaguuguggaaa

SEQ ID NO: 1076319 - RNA, 19 nt, Homo sapiens
cagaggcugcagaaggcca

SEQ ID NO: 1076320 - RNA, 15 nt, Homo sapiens
cagagggcccaggca

SEQ ID NO: 1076321 - RNA, 14 nt, Homo sapiens
cagaggggaaacca

SEQ ID NO: 1076322 - RNA, 17 nt, Homo sapiens
cagaguuguacacugug

SEQ ID NO: 1076323 - RNA, 18 nt, Homo sapiens
cagaguuguacacugugu

SEQ ID NO: 1076324 - RNA, 20 nt, Homo sapiens
cagcaaagccuccagcaucu

SEQ ID NO: 1076325 - RNA, 15 nt, Homo sapiens
cagcaccugcuccca

SEQ ID NO: 1076326 - RNA, 11 nt, Homo sapiens
cagcacuuugg

SEQ ID NO: 1076327 - RNA, 14 nt, Homo sapiens
cagcaucuuuucca

SEQ ID NO: 1076328 - RNA, 23 nt, Homo sapiens
cuucccucccugaggcaggugag

SEQ ID NO: 1076329 - RNA, 12 nt, Homo sapiens
cuuccuguaaca

SEQ ID NO: 1076330 - RNA, 20 nt, Homo sapiens
cuuccuguaacacaagccac

SEQ ID NO: 1076331 - RNA, 11 nt, Homo sapiens
cuucucagugu

SEQ ID NO: 1076332 - RNA, 19 nt, Homo sapiens
cuucuggagucuccagugg

SEQ ID NO: 1076333 - RNA, 14 nt, Homo sapiens
cuucuuuuccaauu

SEQ ID NO: 1076334 - RNA, 12 nt, Homo sapiens
cuugaaauacca

SEQ ID NO: 1076335 - RNA, 23 nt, Homo sapiens
cuugaaauaccagugaaccaaag

SEQ ID NO: 1076336 - RNA, 22 nt, Homo sapiens
cuugaguggagguuuauaguua

SEQ ID NO: 1076337 - RNA, 20 nt, Homo sapiens
cuugauaggacuuccuuaag

SEQ ID NO: 1076338 - RNA, 16 nt, Homo sapiens
cuugcauuucacuuga

SEQ ID NO: 1076339 - RNA, 15 nt, Homo sapiens
cuugcccucccuuuc

SEQ ID NO: 1076340 - RNA, 23 nt, Homo sapiens
cuuggaaagcaucaccucaggcc

SEQ ID NO: 1076341 - RNA, 22 nt, Homo sapiens
cuuuaccugcaggcuccaugca

SEQ ID NO: 1076342 - RNA, 20 nt, Homo sapiens
cuuuacucugcucuaugcca

SEQ ID NO: 1076343 - RNA, 19 nt, Homo sapiens
cuuucagcauuaggcuuuu

SEQ ID NO: 1076344 - RNA, 16 nt, Homo sapiens
cuuucaggccaaggcu

SEQ ID NO: 1076345 - RNA, 20 nt, Homo sapiens
cuuucgagguggguuuguac

SEQ ID NO: 1076346 - RNA, 19 nt, Homo sapiens
cuuucucaguucagaguug

SEQ ID NO: 1076347 - RNA, 19 nt, Homo sapiens
cuuugacucaccuguuacu

SEQ ID NO: 1076348 - RNA, 15 nt, Homo sapiens
cuuuuccauccugag

SEQ ID NO: 1076349 - RNA, 13 nt, Homo sapiens
cuuuucuucuagc

SEQ ID NO: 1076350 - RNA, 15 nt, Homo sapiens
cuuuugcaacaagac

SEQ ID NO: 1076351 - RNA, 15 nt, Homo sapiens
cuuuugcacaccuuu

SEQ ID NO: 1076352 - RNA, 15 nt, Homo sapiens
cuuuuuacagccaac

SEQ ID NO: 1076353 - RNA, 18 nt, Homo sapiens
gaaaaagacuaagccaga

SEQ ID NO: 1076354 - RNA, 16 nt, Homo sapiens
gaaaaauugucugcau

SEQ ID NO: 1076355 - RNA, 16 nt, Homo sapiens
gaaaacaugacuuuau

SEQ ID NO: 1076356 - RNA, 22 nt, Homo sapiens
gaaaaccaaacacguucccuaa

SEQ ID NO: 1076357 - RNA, 16 nt, Homo sapiens
gaaaaugcaaguguuu

SEQ ID NO: 1076358 - RNA, 15 nt, Homo sapiens
gaaaauuaugagucu

SEQ ID NO: 1076359 - RNA, 13 nt, Homo sapiens
gaaaccugacacc

SEQ ID NO: 1076360 - RNA, 21 nt, Homo sapiens
gaaacugaggccauuauuuca

SEQ ID NO: 1076361 - RNA, 18 nt, Homo sapiens
gaaagcaucaccucaggc

SEQ ID NO: 1076362 - RNA, 22 nt, Homo sapiens
gaaagcuguuggauuucaguga

SEQ ID NO: 1076363 - RNA, 21 nt, Homo sapiens
gaaaucaguaaacacugugua

SEQ ID NO: 1076364 - RNA, 14 nt, Homo sapiens
gaacaaugaaugcu

SEQ ID NO: 1076365 - RNA, 17 nt, Homo sapiens
gaacccuuccugagacc

SEQ ID NO: 1076366 - RNA, 13 nt, Homo sapiens
gaacugggguuca

SEQ ID NO: 1076367 - RNA, 15 nt, Homo sapiens
gaacuuucacauagc

SEQ ID NO: 1076368 - RNA, 18 nt, Homo sapiens
gaagcaucaaagcacugu

SEQ ID NO: 1076369 - RNA, 23 nt, Homo sapiens
gaaggcaaauauaagcugggaaa

SEQ ID NO: 1076370 - RNA, 20 nt, Homo sapiens
gaagucucccugcacagccu

SEQ ID NO: 1076371 - RNA, 15 nt, Homo sapiens
gaaguggcagugaaa

SEQ ID NO: 1076372 - RNA, 20 nt, Homo sapiens
gaagugucccugugaucuug

SEQ ID NO: 1076373 - RNA, 19 nt, Homo sapiens
gaauaucgagaacugccau

SEQ ID NO: 1076374 - RNA, 13 nt, Homo sapiens
gaaucaagcuaga

SEQ ID NO: 1076375 - RNA, 14 nt, Homo sapiens
gaaugccggggaca

SEQ ID NO: 1076376 - RNA, 12 nt, Homo sapiens
gacaaagccaaa

SEQ ID NO: 1076377 - RNA, 14 nt, Homo sapiens
gacaacauuguaag

SEQ ID NO: 1076378 - RNA, 23 nt, Homo sapiens
gacaaugaaaguuugcacuguau

SEQ ID NO: 1076379 - RNA, 17 nt, Homo sapiens
gacacgugauggaccaa

SEQ ID NO: 1076380 - RNA, 21 nt, Homo sapiens
gacacgugauggaccaaagcc

SEQ ID NO: 1076381 - RNA, 15 nt, Homo sapiens
gacagaaaugcaauc

SEQ ID NO: 1076382 - RNA, 18 nt, Homo sapiens
gacagaccagcagcaauc

SEQ ID NO: 1076383 - RNA, 16 nt, Homo sapiens
gacagagcgagacucc

SEQ ID NO: 1076384 - RNA, 16 nt, Homo sapiens
gacaugugcagugcug

SEQ ID NO: 1076385 - RNA, 17 nt, Homo sapiens
uugaggacacaugucca

SEQ ID NO: 1076386 - RNA, 20 nt, Homo sapiens
uugaggugcgcucaccucag

SEQ ID NO: 1076387 - RNA, 23 nt, Homo sapiens
uugaggugcgcucaccucagagc

SEQ ID NO: 1076388 - RNA, 11 nt, Homo sapiens
uugauggaccc

SEQ ID NO: 1076389 - RNA, 18 nt, Homo sapiens
uugauuaaaaucuggcaa

SEQ ID NO: 1076390 - RNA, 22 nt, Homo sapiens
uugcaaacccugguugcuguau

SEQ ID NO: 1076391 - RNA, 18 nt, Homo sapiens
uugcacuguuuucugucg

SEQ ID NO: 1076392 - RNA, 16 nt, Homo sapiens
uugcagugagccauga

SEQ ID NO: 1076393 - RNA, 18 nt, Homo sapiens
uugccaugucuuguucag

SEQ ID NO: 1076394 - RNA, 21 nt, Homo sapiens
uugcucuuggaaagcugauga

SEQ ID NO: 1076395 - RNA, 23 nt, Homo sapiens
uuggaaagcaucaccucaggcca

SEQ ID NO: 1076396 - RNA, 19 nt, Homo sapiens
uuggaaauauucuaugacc

SEQ ID NO: 1076397 - RNA, 20 nt, Homo sapiens
uuggcuaucuacugagacau

SEQ ID NO: 1076398 - RNA, 15 nt, Homo sapiens
uuggggugcuuccuu

SEQ ID NO: 1076399 - RNA, 23 nt, Homo sapiens
uugguuaaaggaaguuuguucac

SEQ ID NO: 1076400 - RNA, 16 nt, Homo sapiens
uuguacaagauuguca

SEQ ID NO: 1076401 - RNA, 13 nt, Homo sapiens
uuguacucuugcu

SEQ ID NO: 1076402 - RNA, 14 nt, Homo sapiens
uuguguacugauaa

SEQ ID NO: 1076403 - RNA, 14 nt, Homo sapiens
uuguuccgugccag

SEQ ID NO: 1076404 - RNA, 13 nt, Homo sapiens
uuguugucucccu

SEQ ID NO: 1076405 - RNA, 20 nt, Homo sapiens
uuuaauaucugagaagugua

SEQ ID NO: 1076406 - RNA, 22 nt, Homo sapiens
uuuaccauaaaaauccuucuca

SEQ ID NO: 1076407 - RNA, 16 nt, Homo sapiens
uuucaacucauugcau

SEQ ID NO: 1076408 - RNA, 19 nt, Homo sapiens
uuuccaaagggcaguaaag

SEQ ID NO: 1076409 - RNA, 21 nt, Homo sapiens
uuuccacauaaagguauuuag

SEQ ID NO: 1076410 - RNA, 21 nt, Homo sapiens
uuucuaaagcucugaacaaaa

SEQ ID NO: 1076411 - RNA, 12 nt, Homo sapiens
uuucugagcuuu

SEQ ID NO: 1076412 - RNA, 22 nt, Homo sapiens
uuucuggauggcaucuagccag

SEQ ID NO: 1076413 - RNA, 21 nt, Homo sapiens
uuucuuccuuucuguagguuu

SEQ ID NO: 1076414 - RNA, 21 nt, Homo sapiens
uuugaaaucaguaaacacugu

SEQ ID NO: 1076415 - RNA, 19 nt, Homo sapiens
uuugaagguauaaccuuca

SEQ ID NO: 1076416 - RNA, 15 nt, Homo sapiens
uuugaagucugcuca

SEQ ID NO: 1076417 - RNA, 14 nt, Homo sapiens
uuugguaccaagaa

SEQ ID NO: 1076418 - RNA, 20 nt, Homo sapiens
uuuguaaauuaauacuucau

SEQ ID NO: 1076419 - RNA, 18 nt, Homo sapiens
uuuguacaagauugucau

SEQ ID NO: 1076420 - RNA, 18 nt, Homo sapiens
uuuguacaauuacuaaau

SEQ ID NO: 1076421 - RNA, 19 nt, Homo sapiens
uuuguauuauuucaccagc

SEQ ID NO: 1076422 - RNA, 19 nt, Homo sapiens
uuuguucacuucgaugacu

SEQ ID NO: 1076423 - RNA, 19 nt, Homo sapiens
uuuuauucaaagacagaga

SEQ ID NO: 1076424 - RNA, 12 nt, Homo sapiens
uuuucugauuug

SEQ ID NO: 1076425 - RNA, 11 nt, Homo sapiens
uuuugaugaaa

SEQ ID NO: 1076426 - RNA, 16 nt, Homo sapiens
uuuuuaaaaaaguaag

SEQ ID NO: 1076427 - RNA, 12 nt, Homo sapiens
uuuuuugauuga

SEQ ID NO: 1076428 - RNA, 21 nt, Homo sapiens
uuuuuuguuauguuugcacuu

SEQ ID NO: 1076429 - RNA, 21 nt, Homo sapiens
guaccacucaggccaacaagc

SEQ ID NO: 1076430 - RNA, 13 nt, Homo sapiens
guagcugaugaaa

SEQ ID NO: 1076431 - RNA, 19 nt, Homo sapiens
guaggggguuauugccucu

SEQ ID NO: 1076432 - RNA, 14 nt, Homo sapiens
guaguagugucuuc

SEQ ID NO: 1076433 - RNA, 21 nt, Homo sapiens
guauaaccuucaugaugaauu

SEQ ID NO: 1076434 - RNA, 16 nt, Homo sapiens
guaucaggacugugac

SEQ ID NO: 1076435 - RNA, 21 nt, Homo sapiens
guaucaggacugugaccaaag

SEQ ID NO: 1076436 - RNA, 22 nt, Homo sapiens
guaucaggacugugaccaaagc

SEQ ID NO: 1076437 - RNA, 19 nt, Homo sapiens
guaugaguggcuucuggga

SEQ ID NO: 1076438 - RNA, 20 nt, Homo sapiens
guauuauuucaccagcagca

SEQ ID NO: 1076439 - RNA, 22 nt, Homo sapiens
gucacuuuuuaaaccacuguau

SEQ ID NO: 1076440 - RNA, 19 nt, Homo sapiens
gucagaaacucgaugaaug

SEQ ID NO: 1076441 - RNA, 13 nt, Homo sapiens
guccagugacuuu

SEQ ID NO: 1076442 - RNA, 13 nt, Homo sapiens
guccaguuuccaa

SEQ ID NO: 1076443 - RNA, 13 nt, Homo sapiens
guccccagggaca

SEQ ID NO: 1076444 - RNA, 18 nt, Homo sapiens
gucuccccgaaagggaca

SEQ ID NO: 1076445 - RNA, 22 nt, Homo sapiens
gucuccugucuucagagcaaaa

SEQ ID NO: 1076446 - RNA, 18 nt, Homo sapiens
gucucuacuaaaaauaca

SEQ ID NO: 1076447 - RNA, 18 nt, Homo sapiens
gucucuaugaucuuggca

SEQ ID NO: 1076448 - RNA, 13 nt, Homo sapiens
gugaaccaaagag

SEQ ID NO: 1076449 - RNA, 11 nt, Homo sapiens
gugacuuugaa

SEQ ID NO: 1076450 - RNA, 20 nt, Homo sapiens
gugacuuuuuagccagugac

SEQ ID NO: 1076451 - RNA, 22 nt, Homo sapiens
gugaucacugagacagccacuu

SEQ ID NO: 1076452 - RNA, 21 nt, Homo sapiens
gugcaacgcuuuuugggagaa

SEQ ID NO: 1076453 - RNA, 18 nt, Homo sapiens
gugcagggaaccgugaua

SEQ ID NO: 1076454 - RNA, 12 nt, Homo sapiens
gugccugagaca

SEQ ID NO: 1076455 - RNA, 18 nt, Homo sapiens
gugccugagacacccggu

SEQ ID NO: 1076456 - RNA, 12 nt, Homo sapiens
guggacaccugc

SEQ ID NO: 1076457 - RNA, 13 nt, Homo sapiens
gugguugcuguug

SEQ ID NO: 1076458 - RNA, 19 nt, Homo sapiens
guguaucgcugccuugcca

SEQ ID NO: 1076459 - RNA, 14 nt, Homo sapiens
guguugaucccaag

SEQ ID NO: 1076460 - RNA, 19 nt, Homo sapiens
guuauagaaacugauauau

SEQ ID NO: 1076461 - RNA, 17 nt, Homo sapiens
guuauuauuuugcacug

SEQ ID NO: 1076462 - RNA, 19 nt, Homo sapiens
guuauugccucugaaaugc

SEQ ID NO: 1076463 - RNA, 21 nt, Homo sapiens
guuccgugccaggcauucaau

SEQ ID NO: 1076464 - RNA, 21 nt, Homo sapiens
guucucuuugcugacacugug

SEQ ID NO: 1076465 - RNA, 14 nt, Homo sapiens
guugaaacuguuau

SEQ ID NO: 1076466 - RNA, 16 nt, Homo sapiens
guugauuuccgugaaa

SEQ ID NO: 1076467 - RNA, 22 nt, Homo sapiens
guuguccucccaggaaccaaaa

SEQ ID NO: 1076468 - RNA, 22 nt, Homo sapiens
guuuaacugggagugauaugau

SEQ ID NO: 1076469 - RNA, 15 nt, Homo sapiens
guuuaccucuucuau

SEQ ID NO: 1076470 - RNA, 12 nt, Homo sapiens
guuugcacuuug

SEQ ID NO: 1076471 - RNA, 14 nt, Homo sapiens
guuuuaagccuuaa

SEQ ID NO: 1076472 - RNA, 15 nt, Homo sapiens
uaaaaccccaucucu

SEQ ID NO: 1076473 - RNA, 15 nt, Homo sapiens
uaaaaucuggcaaag

SEQ ID NO: 1076474 - RNA, 13 nt, Homo sapiens
uaaaaucugugaa

SEQ ID NO: 1076475 - RNA, 14 nt, Homo sapiens
uaaacacccaugaa

SEQ ID NO: 1076476 - RNA, 13 nt, Homo sapiens
uaaacacugugua

SEQ ID NO: 1076477 - RNA, 18 nt, Homo sapiens
uaaacacuguuuguucca

SEQ ID NO: 1076478 - RNA, 19 nt, Homo sapiens
uaaagcucugaacaaaagc

SEQ ID NO: 1076479 - RNA, 12 nt, Homo sapiens
uaacuacauauu

SEQ ID NO: 1076480 - RNA, 15 nt, Homo sapiens
uaacuggcauaggaa

SEQ ID NO: 1076481 - RNA, 17 nt, Homo sapiens
uaacuggugauauaucu

SEQ ID NO: 1076482 - RNA, 18 nt, Homo sapiens
uaagccagacgugguggc

SEQ ID NO: 1076483 - RNA, 16 nt, Homo sapiens
uaagugccugagacac

SEQ ID NO: 1076484 - RNA, 18 nt, Homo sapiens
uaauauaaauaguguaca

SEQ ID NO: 1076485 - RNA, 17 nt, Homo sapiens
uaaucaacauggcuacu

SEQ ID NO: 1076486 - RNA, 12 nt, Homo sapiens
uaaucagcauua

SEQ ID NO: 1076487 - RNA, 13 nt, Homo sapiens
uaaucccagcacu

SEQ ID NO: 1076488 - RNA, 13 nt, Homo sapiens
uaauguugcuuag

SEQ ID NO: 1076489 - RNA, 17 nt, Homo sapiens
uaauuccuguugcucug

SEQ ID NO: 1076490 - RNA, 18 nt, Homo sapiens
uaauuggaagaaauuccu

SEQ ID NO: 1076491 - RNA, 16 nt, Homo sapiens
uacaaagauaugcuaa

SEQ ID NO: 1076492 - RNA, 14 nt, Homo sapiens
uacaaugugacuuu

SEQ ID NO: 1076493 - RNA, 14 nt, Homo sapiens
uacagcuuggcacu

SEQ ID NO: 1076494 - RNA, 14 nt, Homo sapiens
uacauauugaauag

SEQ ID NO: 1076495 - RNA, 19 nt, Homo sapiens
uacaugcugugcucuuuga

SEQ ID NO: 1076496 - RNA, 16 nt, Homo sapiens
uaccaaaugagcauua

SEQ ID NO: 1076497 - RNA, 18 nt, Homo sapiens
uaccagugaaccaaagag

SEQ ID NO: 1076498 - RNA, 14 nt, Homo sapiens
uacccuauaucuau

SEQ ID NO: 1076499 - RNA, 23 nt, Homo sapiens
uacgguggcacgugccugugauc

SEQ ID NO: 1076500 - RNA, 22 nt, Homo sapiens
uacuauaacauagaauugcaau

SEQ ID NO: 1076501 - RNA, 17 nt, Homo sapiens
uacucugcucuaugcca

SEQ ID NO: 1076502 - RNA, 19 nt, Homo sapiens
uacuuauaccucucucaaa

SEQ ID NO: 1076503 - RNA, 22 nt, Homo sapiens
uacuugggaggcugagccagga

SEQ ID NO: 1076504 - RNA, 20 nt, Homo sapiens
uacuugggaggcugaggcag

SEQ ID NO: 1076505 - RNA, 19 nt, Homo sapiens
uagaacacccacuggccag

SEQ ID NO: 1076506 - RNA, 14 nt, Homo sapiens
uagauugugaauaa

SEQ ID NO: 1076507 - RNA, 20 nt, Homo sapiens
uagccaacuucaagaauuaa

SEQ ID NO: 1076508 - RNA, 17 nt, Homo sapiens
uagcucuggaccagccu

SEQ ID NO: 1076509 - RNA, 16 nt, Homo sapiens
uaggacauugauuuga

SEQ ID NO: 1076510 - RNA, 19 nt, Homo sapiens
uagguuuccacugccaaaa

SEQ ID NO: 1076511 - RNA, 15 nt, Homo sapiens
uagguuucucucuuc

SEQ ID NO: 1076512 - RNA, 18 nt, Homo sapiens
uagucccagcuacucaga

SEQ ID NO: 1076513 - RNA, 17 nt, Homo sapiens
uagugacuguaauuaau

SEQ ID NO: 1076514 - RNA, 16 nt, Homo sapiens
uaguucuaucaggaaa

SEQ ID NO: 1076515 - RNA, 20 nt, Homo sapiens
uaguuuuacccuauaucuau

SEQ ID NO: 1076516 - RNA, 22 nt, Homo sapiens
uauaacaugucuuucagcauua

SEQ ID NO: 1076517 - RNA, 17 nt, Homo sapiens
uauagauuaaaucauac

SEQ ID NO: 1076518 - RNA, 22 nt, Homo sapiens
uauagauuaaaucauacuccua

SEQ ID NO: 1076519 - RNA, 19 nt, Homo sapiens
uauagguuuccacugccaa

SEQ ID NO: 1076520 - RNA, 23 nt, Homo sapiens
uauaguuaaucuauaacuacaua

SEQ ID NO: 1076521 - RNA, 21 nt, Homo sapiens
uauaucauaaaguaugccuuc

SEQ ID NO: 1076522 - RNA, 21 nt, Homo sapiens
uaucaaaucuguauauguugu

SEQ ID NO: 1076523 - RNA, 16 nt, Homo sapiens
uaucagagcucuuaau

SEQ ID NO: 1076524 - RNA, 15 nt, Homo sapiens
uaucgcugccuugcc

SEQ ID NO: 1076525 - RNA, 20 nt, Homo sapiens
uaugagucucuaugaucuug

SEQ ID NO: 1076526 - RNA, 19 nt, Homo sapiens
uaugaguggcuucugggag

SEQ ID NO: 1076527 - RNA, 14 nt, Homo sapiens
uaugcaaaugccuc

SEQ ID NO: 1076528 - RNA, 22 nt, Homo sapiens
uauguaugaguggcuucuggga

SEQ ID NO: 1076529 - RNA, 15 nt, Homo sapiens
uauguugaguguuca

SEQ ID NO: 1076530 - RNA, 19 nt, Homo sapiens
uauuaagugccugagacac

SEQ ID NO: 1076531 - RNA, 13 nt, Homo sapiens
uauuaaugcuuug

SEQ ID NO: 1076532 - RNA, 15 nt, Homo sapiens
uauuauuuugcacug

SEQ ID NO: 1076533 - RNA, 14 nt, Homo sapiens
uauugaaucuuaau

SEQ ID NO: 1076534 - RNA, 14 nt, Homo sapiens
ucaaagcacuguuu

SEQ ID NO: 1076535 - RNA, 15 nt, Homo sapiens
ucaaaugacccaaag

SEQ ID NO: 1076536 - RNA, 19 nt, Homo sapiens
ucaacauggcuacuugcuu

SEQ ID NO: 1076537 - RNA, 16 nt, Homo sapiens
ucaaccgcuugccaua

SEQ ID NO: 1076538 - RNA, 17 nt, Homo sapiens
ucaaccgcuugccauau

SEQ ID NO: 1076539 - RNA, 17 nt, Homo sapiens
uuucuauuuucucugau

SEQ ID NO: 1076540 - RNA, 17 nt, Homo sapiens
uuugaggcucaccagaa

SEQ ID NO: 1076541 - RNA, 19 nt, Homo sapiens
uuugagugucuuugacuug

SEQ ID NO: 1076542 - RNA, 15 nt, Homo sapiens
uuugaguuucucucc

SEQ ID NO: 1076543 - RNA, 12 nt, Homo sapiens
uuugcacuuugu

SEQ ID NO: 1076544 - RNA, 15 nt, Homo sapiens
uuugugaaacuuuaa

SEQ ID NO: 1076545 - RNA, 13 nt, Homo sapiens
uuuuaauguacaa

SEQ ID NO: 1076546 - RNA, 20 nt, Homo sapiens
uuuucuccacuuuguuggaa

SEQ ID NO: 1076547 - RNA, 21 nt, Homo sapiens
uuuucugagcuuuucauggaa

SEQ ID NO: 1076548 - RNA, 20 nt, Homo sapiens
uuuugagaauacacuaucaa

SEQ ID NO: 1076549 - RNA, 20 nt, Homo sapiens
uuuuugaaaucaguaaacac

SEQ ID NO: 1076550 - RNA, 18 nt, Homo sapiens
caggaggcuuggaaagca

SEQ ID NO: 1076551 - RNA, 22 nt, Homo sapiens
caggagguggagguugcaguga

SEQ ID NO: 1076552 - RNA, 23 nt, Homo sapiens
caggagguggagguugcagugag

SEQ ID NO: 1076553 - RNA, 19 nt, Homo sapiens
caggcaguaugcugucaug

SEQ ID NO: 1076554 - RNA, 23 nt, Homo sapiens
caggccagggaaagcccguguca

SEQ ID NO: 1076555 - RNA, 13 nt, Homo sapiens
caggcccagagaa

SEQ ID NO: 1076556 - RNA, 14 nt, Homo sapiens
cagggcacugugcc

SEQ ID NO: 1076557 - RNA, 16 nt, Homo sapiens
cagggcacugugccug

SEQ ID NO: 1076558 - RNA, 21 nt, Homo sapiens
caggguuagcucacgugucuu

SEQ ID NO: 1076559 - RNA, 18 nt, Homo sapiens
cagucuggaucguuugac

SEQ ID NO: 1076560 - RNA, 12 nt, Homo sapiens
cagucuuggaau

SEQ ID NO: 1076561 - RNA, 17 nt, Homo sapiens
cagugacgugcaccugu

SEQ ID NO: 1076562 - RNA, 23 nt, Homo sapiens
cagugacuuucaggaauugccca

SEQ ID NO: 1076563 - RNA, 18 nt, Homo sapiens
cagugcccaugcaauggc

SEQ ID NO: 1076564 - RNA, 14 nt, Homo sapiens
cauaaaaucuguga

SEQ ID NO: 1076565 - RNA, 17 nt, Homo sapiens
cauaaacacccaugaau

SEQ ID NO: 1076566 - RNA, 22 nt, Homo sapiens
cauaaacacccaugaaucaaag

SEQ ID NO: 1076567 - RNA, 16 nt, Homo sapiens
cauaaagguauuuaga

SEQ ID NO: 1076568 - RNA, 19 nt, Homo sapiens
cauaaaguaugccuuccug

SEQ ID NO: 1076569 - RNA, 22 nt, Homo sapiens
cauacuccuaugcuuuagcuua

SEQ ID NO: 1076570 - RNA, 12 nt, Homo sapiens
cauagaauugca

SEQ ID NO: 1076571 - RNA, 12 nt, Homo sapiens
cauaugcuucuu

SEQ ID NO: 1076572 - RNA, 14 nt, Homo sapiens
caucaaagcacugu

SEQ ID NO: 1076573 - RNA, 13 nt, Homo sapiens
cauccugcuuccu

SEQ ID NO: 1076574 - RNA, 20 nt, Homo sapiens
cauccuggcuaacacgugaa

SEQ ID NO: 1076575 - RNA, 12 nt, Homo sapiens
caucugacucac

SEQ ID NO: 1076576 - RNA, 20 nt, Homo sapiens
caucugacucacaagaagac

SEQ ID NO: 1076577 - RNA, 14 nt, Homo sapiens
caugaaucaaagac

SEQ ID NO: 1076578 - RNA, 17 nt, Homo sapiens
caugacgggaaaaccaa

SEQ ID NO: 1076579 - RNA, 21 nt, Homo sapiens
caugaucgagccacugcacuc

SEQ ID NO: 1076580 - RNA, 20 nt, Homo sapiens
caugauggagcgcaccugcc

SEQ ID NO: 1076581 - RNA, 15 nt, Homo sapiens
caugcaaggcacuga

SEQ ID NO: 1076582 - RNA, 18 nt, Homo sapiens
caugcaggaucagcucca

SEQ ID NO: 1076583 - RNA, 13 nt, Homo sapiens
caugcuggggcaa

SEQ ID NO: 1076584 - RNA, 17 nt, Homo sapiens
cauguguugccuggaag

SEQ ID NO: 1076585 - RNA, 22 nt, Homo sapiens
cauguguugccuggaagcacau

SEQ ID NO: 1076586 - RNA, 13 nt, Homo sapiens
cauuagagucagc

SEQ ID NO: 1076587 - RNA, 22 nt, Homo sapiens
cauuagugagacauauuuacaa

SEQ ID NO: 1076588 - RNA, 12 nt, Homo sapiens
cauuccaggaaa

SEQ ID NO: 1076589 - RNA, 13 nt, Homo sapiens
cauuccaggaaac

SEQ ID NO: 1076590 - RNA, 21 nt, Homo sapiens
cauucgcaccccuacuucaca

SEQ ID NO: 1076591 - RNA, 14 nt, Homo sapiens
cauugcaucauuua

SEQ ID NO: 1076592 - RNA, 17 nt, Homo sapiens
cauuguagaaacacagu

SEQ ID NO: 1076593 - RNA, 15 nt, Homo sapiens
cauuucaccauucaa

SEQ ID NO: 1076594 - RNA, 21 nt, Homo sapiens
cauuucaccauucaaacaggu

SEQ ID NO: 1076595 - RNA, 21 nt, Homo sapiens
cauuuugcauuagacagauga

SEQ ID NO: 1076596 - RNA, 19 nt, Homo sapiens
cuagaacacccacuggcca

SEQ ID NO: 1076597 - RNA, 18 nt, Homo sapiens
cuagccugggccagagaa

SEQ ID NO: 1076598 - RNA, 14 nt, Homo sapiens
cuaguguuuguuaa

SEQ ID NO: 1076599 - RNA, 21 nt, Homo sapiens
cuauaacauagaauugcaauc

SEQ ID NO: 1076600 - RNA, 17 nt, Homo sapiens
cuauaacaugucuuuca

SEQ ID NO: 1076601 - RNA, 18 nt, Homo sapiens
cuauaacaugucuuucag

SEQ ID NO: 1076602 - RNA, 19 nt, Homo sapiens
cuauuuuaaaccaauugca

SEQ ID NO: 1076603 - RNA, 15 nt, Homo sapiens
cuauuuucugaccaa

SEQ ID NO: 1076604 - RNA, 18 nt, Homo sapiens
cuauuuucugaccaaaau

SEQ ID NO: 1076605 - RNA, 21 nt, Homo sapiens
cucaaaagaaaaaaaaaagca

SEQ ID NO: 1076606 - RNA, 16 nt, Homo sapiens
cucaaaugacccaaag

SEQ ID NO: 1076607 - RNA, 20 nt, Homo sapiens
cucaaaugacccaaagacca

SEQ ID NO: 1076608 - RNA, 21 nt, Homo sapiens
cucaaaugacccaaagaccaa

SEQ ID NO: 1076609 - RNA, 19 nt, Homo sapiens
cucacaagaagaccagacu

SEQ ID NO: 1076610 - RNA, 21 nt, Homo sapiens
cucacaagaagaccagacugu

SEQ ID NO: 1076611 - RNA, 23 nt, Homo sapiens
cucaccuguuacuugaaauacca

SEQ ID NO: 1076612 - RNA, 15 nt, Homo sapiens
cucacucacucuggg

SEQ ID NO: 1076613 - RNA, 18 nt, Homo sapiens
cucacugcagggcacugu

SEQ ID NO: 1076614 - RNA, 13 nt, Homo sapiens
cucagagcacaga

SEQ ID NO: 1076615 - RNA, 16 nt, Homo sapiens
cucagccccacugaca

SEQ ID NO: 1076616 - RNA, 15 nt, Homo sapiens
cucagguucuuucca

SEQ ID NO: 1076617 - RNA, 20 nt, Homo sapiens
cucaucuccagcuaacugug

SEQ ID NO: 1076618 - RNA, 13 nt, Homo sapiens
cucccaagcugcc

SEQ ID NO: 1076619 - RNA, 16 nt, Homo sapiens
cucccaggaaccaaaa

SEQ ID NO: 1076620 - RNA, 14 nt, Homo sapiens
cuccccugcuccca

SEQ ID NO: 1076621 - RNA, 20 nt, Homo sapiens
cucccucuuucucaguuccu

SEQ ID NO: 1076622 - RNA, 21 nt, Homo sapiens
cuccucagaucugaacacagu

SEQ ID NO: 1076623 - RNA, 18 nt, Homo sapiens
cuccucauuuuuacgggu

SEQ ID NO: 1076624 - RNA, 14 nt, Homo sapiens
cuccugaccaaaga

SEQ ID NO: 1076625 - RNA, 18 nt, Homo sapiens
cuccugcucugcuuccuc

SEQ ID NO: 1076626 - RNA, 12 nt, Homo sapiens
cuccugucuuca

SEQ ID NO: 1076627 - RNA, 23 nt, Homo sapiens
cuccugucuucagagcaaaagac

SEQ ID NO: 1076628 - RNA, 12 nt, Homo sapiens
cuccuugcacuu

SEQ ID NO: 1076629 - RNA, 14 nt, Homo sapiens
cuccuugcacuuuc

SEQ ID NO: 1076630 - RNA, 17 nt, Homo sapiens
cucuaagccaacuuuaa

SEQ ID NO: 1076631 - RNA, 21 nt, Homo sapiens
cucuagaacacccacuggcca

SEQ ID NO: 1076632 - RNA, 15 nt, Homo sapiens
cucugaaauuuccca

SEQ ID NO: 1076633 - RNA, 14 nt, Homo sapiens
cucugaacaaaagc

SEQ ID NO: 1076634 - RNA, 16 nt, Homo sapiens
cucugaauaagcacuu

SEQ ID NO: 1076635 - RNA, 19 nt, Homo sapiens
cucugccagccacauccaa

SEQ ID NO: 1076636 - RNA, 19 nt, Homo sapiens
cucugccccaucauugcac

SEQ ID NO: 1076637 - RNA, 11 nt, Homo sapiens
cucuggaccag

SEQ ID NO: 1076638 - RNA, 15 nt, Homo sapiens
cucuggaccagccug

SEQ ID NO: 1076639 - RNA, 19 nt, Homo sapiens
cucuggaccagccuguugg

SEQ ID NO: 1076640 - RNA, 15 nt, Homo sapiens
cucuggauggcacca

SEQ ID NO: 1076641 - RNA, 12 nt, Homo sapiens
cucugugcuuug

SEQ ID NO: 1076642 - RNA, 19 nt, Homo sapiens
cucuuagcuuucucagggg

SEQ ID NO: 1076643 - RNA, 13 nt, Homo sapiens
cucuucuaugcaa

SEQ ID NO: 1076644 - RNA, 23 nt, Homo sapiens
cucuucucuuccuguaacacaag

SEQ ID NO: 1076645 - RNA, 14 nt, Homo sapiens
cucuucuuacuuca

SEQ ID NO: 1076646 - RNA, 17 nt, Homo sapiens
cucuugaaccagaacca

SEQ ID NO: 1076647 - RNA, 15 nt, Homo sapiens
cucuuugcugacacu

SEQ ID NO: 1076648 - RNA, 15 nt, Homo sapiens
cugaaaaacauucca

SEQ ID NO: 1076649 - RNA, 20 nt, Homo sapiens
cugaaacauucacacagggc

SEQ ID NO: 1076650 - RNA, 13 nt, Homo sapiens
cugaaagccagca

SEQ ID NO: 1076651 - RNA, 22 nt, Homo sapiens
cugaaagcuguuggauuucagu

SEQ ID NO: 1076652 - RNA, 12 nt, Homo sapiens
cugaaaugccuc

SEQ ID NO: 1076653 - RNA, 14 nt, Homo sapiens
cugaaucuucugaa

SEQ ID NO: 1076654 - RNA, 21 nt, Homo sapiens
cugaaugucuuacugugauca

SEQ ID NO: 1076655 - RNA, 21 nt, Homo sapiens
cugacacgugauggaccaaag

SEQ ID NO: 1076656 - RNA, 14 nt, Homo sapiens
cugacacugugacc

SEQ ID NO: 1076657 - RNA, 19 nt, Homo sapiens
cugaggccacccacugacc

SEQ ID NO: 1076658 - RNA, 16 nt, Homo sapiens
cugaggcuuccagaga

SEQ ID NO: 1076659 - RNA, 16 nt, Homo sapiens
cugagggcuccuccau

SEQ ID NO: 1076660 - RNA, 14 nt, Homo sapiens
cugaugccaaagcu

SEQ ID NO: 1076661 - RNA, 20 nt, Homo sapiens
cugcacauuuuguacaaaga

SEQ ID NO: 1076662 - RNA, 21 nt, Homo sapiens
cugcagccccgcgccuccuuc

SEQ ID NO: 1076663 - RNA, 18 nt, Homo sapiens
cugcaggggcaaggggcu

SEQ ID NO: 1076664 - RNA, 17 nt, Homo sapiens
cugcauugaguccagcu

SEQ ID NO: 1076665 - RNA, 22 nt, Homo sapiens
gaguguucauuuuagugacugu

SEQ ID NO: 1076666 - RNA, 11 nt, Homo sapiens
gauauguuugu

SEQ ID NO: 1076667 - RNA, 18 nt, Homo sapiens
gaucacuugaguucagga

SEQ ID NO: 1076668 - RNA, 18 nt, Homo sapiens
gaucccaagacaaugaaa

SEQ ID NO: 1076669 - RNA, 14 nt, Homo sapiens
gauccugcuccagc

SEQ ID NO: 1076670 - RNA, 18 nt, Homo sapiens
gaucgagccacugcacuc

SEQ ID NO: 1076671 - RNA, 20 nt, Homo sapiens
gaugaauagaugugaucacu

SEQ ID NO: 1076672 - RNA, 13 nt, Homo sapiens
gaugccacuuccc

SEQ ID NO: 1076673 - RNA, 17 nt, Homo sapiens
gaugccuccccaagacu

SEQ ID NO: 1076674 - RNA, 18 nt, Homo sapiens
gaugccuccccaagacug

SEQ ID NO: 1076675 - RNA, 20 nt, Homo sapiens
gaugcugaggccacccacug

SEQ ID NO: 1076676 - RNA, 13 nt, Homo sapiens
gauggaccaaagc

SEQ ID NO: 1076677 - RNA, 15 nt, Homo sapiens
gauggccccuccagc

SEQ ID NO: 1076678 - RNA, 22 nt, Homo sapiens
gaugggaucccaggccagggaa

SEQ ID NO: 1076679 - RNA, 23 nt, Homo sapiens
gaugggugucuggggagggucaa

SEQ ID NO: 1076680 - RNA, 18 nt, Homo sapiens
gauguacuauaacauaga

SEQ ID NO: 1076681 - RNA, 23 nt, Homo sapiens
gauuaaaaucuggcaaaguuaua

SEQ ID NO: 1076682 - RNA, 22 nt, Homo sapiens
gauuguucuguccaguuuccaa

SEQ ID NO: 1076683 - RNA, 20 nt, Homo sapiens
gauuugcacccaugccauag

SEQ ID NO: 1076684 - RNA, 23 nt, Homo sapiens
gauuuuuuguuauguuugcacuu

SEQ ID NO: 1076685 - RNA, 20 nt, Homo sapiens
gcaaagagacccagucaauu

SEQ ID NO: 1076686 - RNA, 19 nt, Homo sapiens
gcaaaugccuccaagccau

SEQ ID NO: 1076687 - RNA, 17 nt, Homo sapiens
gcaagccuugcuagaca

SEQ ID NO: 1076688 - RNA, 16 nt, Homo sapiens
gcaagucccugacucu

SEQ ID NO: 1076689 - RNA, 15 nt, Homo sapiens
gcaaguuaaagaaaa

SEQ ID NO: 1076690 - RNA, 15 nt, Homo sapiens
gcacaaauuguacau

SEQ ID NO: 1076691 - RNA, 21 nt, Homo sapiens
gcacaccucagccccacugac

SEQ ID NO: 1076692 - RNA, 18 nt, Homo sapiens
gcacccaugccauagaaa

SEQ ID NO: 1076693 - RNA, 17 nt, Homo sapiens
gcaccuguacucaggag

SEQ ID NO: 1076694 - RNA, 23 nt, Homo sapiens
gcacugaaaucacuuuaccugca

SEQ ID NO: 1076695 - RNA, 24 nt, Homo sapiens
gcacugaaaucacuuuaccugcag

SEQ ID NO: 1076696 - RNA, 21 nt, Homo sapiens
gcagaacgaugccugcaggca

SEQ ID NO: 1076697 - RNA, 17 nt, Homo sapiens
gcaggaacugagccaga

SEQ ID NO: 1076698 - RNA, 18 nt, Homo sapiens
gcagggcacugugccuga

SEQ ID NO: 1076699 - RNA, 21 nt, Homo sapiens
gcagguugaccgggacuucaa

SEQ ID NO: 1076700 - RNA, 20 nt, Homo sapiens
gcaguagacuauaagcagaa

SEQ ID NO: 1076701 - RNA, 18 nt, Homo sapiens
gcagugacgugcaccugu

SEQ ID NO: 1076702 - RNA, 13 nt, Homo sapiens
gcagugagccaaa

SEQ ID NO: 1076703 - RNA, 16 nt, Homo sapiens
aauucuugaaguucau

SEQ ID NO: 1076704 - RNA, 21 nt, Homo sapiens
aauuuggccagacacaggugc

SEQ ID NO: 1076705 - RNA, 14 nt, Homo sapiens
acaaaacacugugu

SEQ ID NO: 1076706 - RNA, 21 nt, Homo sapiens
acaaagcaaagccacauuuug

SEQ ID NO: 1076707 - RNA, 17 nt, Homo sapiens
acaaauuguacauuuga

SEQ ID NO: 1076708 - RNA, 21 nt, Homo sapiens
acaacguucuuaguuuacuua

SEQ ID NO: 1076709 - RNA, 16 nt, Homo sapiens
acaagaagaccagacu

SEQ ID NO: 1076710 - RNA, 17 nt, Homo sapiens
acacauguccaguggga

SEQ ID NO: 1076711 - RNA, 19 nt, Homo sapiens
acacccaguguccuuccau

SEQ ID NO: 1076712 - RNA, 11 nt, Homo sapiens
acacugugacc

SEQ ID NO: 1076713 - RNA, 19 nt, Homo sapiens
acaggccagccuuggcacg

SEQ ID NO: 1076714 - RNA, 13 nt, Homo sapiens
acaggugccucac

SEQ ID NO: 1076715 - RNA, 22 nt, Homo sapiens
acaguccugggagaaccucagg

SEQ ID NO: 1076716 - RNA, 13 nt, Homo sapiens
acauaagcacuga

SEQ ID NO: 1076717 - RNA, 15 nt, Homo sapiens
acauagaauugcaau

SEQ ID NO: 1076718 - RNA, 14 nt, Homo sapiens
acauauauguauau

SEQ ID NO: 1076719 - RNA, 21 nt, Homo sapiens
acauccaaccccccaccugcc

SEQ ID NO: 1076720 - RNA, 21 nt, Homo sapiens
acaugauggagcgcaccugcc

SEQ ID NO: 1076721 - RNA, 13 nt, Homo sapiens
acaugucuuucag

SEQ ID NO: 1076722 - RNA, 18 nt, Homo sapiens
acauguuugguaccaaga

SEQ ID NO: 1076723 - RNA, 15 nt, Homo sapiens
acauuuugcauuaga

SEQ ID NO: 1076724 - RNA, 15 nt, Homo sapiens
accaaaugagcauua

SEQ ID NO: 1076725 - RNA, 19 nt, Homo sapiens
accaacccuguuuccugag

SEQ ID NO: 1076726 - RNA, 13 nt, Homo sapiens
accagcagcaauc

SEQ ID NO: 1076727 - RNA, 17 nt, Homo sapiens
accaggccugagcaaca

SEQ ID NO: 1076728 - RNA, 18 nt, Homo sapiens
accagucccacaccgcug

SEQ ID NO: 1076729 - RNA, 18 nt, Homo sapiens
accagucuuucaacucau

SEQ ID NO: 1076730 - RNA, 13 nt, Homo sapiens
accaguguagccu

SEQ ID NO: 1076731 - RNA, 18 nt, Homo sapiens
accaugcauggugcauca

SEQ ID NO: 1076732 - RNA, 14 nt, Homo sapiens
accauugucuucca

SEQ ID NO: 1076733 - RNA, 20 nt, Homo sapiens
acccaggccugauucacugg

SEQ ID NO: 1076734 - RNA, 19 nt, Homo sapiens
accccuccaccucucucuc

SEQ ID NO: 1076735 - RNA, 15 nt, Homo sapiens
acccgcucuggacca

SEQ ID NO: 1076736 - RNA, 14 nt, Homo sapiens
accgcuugccauau

SEQ ID NO: 1076737 - RNA, 18 nt, Homo sapiens
accucagccccacugaca

SEQ ID NO: 1076738 - RNA, 21 nt, Homo sapiens
accucauuuaccauaaaaauc

SEQ ID NO: 1076739 - RNA, 14 nt, Homo sapiens
accuccuuaccugg

SEQ ID NO: 1076740 - RNA, 18 nt, Homo sapiens
accucuucucuuccugua

SEQ ID NO: 1076741 - RNA, 20 nt, Homo sapiens
accugaagggugacauccca

SEQ ID NO: 1076742 - RNA, 13 nt, Homo sapiens
accuggaaccaga

SEQ ID NO: 1076743 - RNA, 15 nt, Homo sapiens
accuguuacuugaaa

SEQ ID NO: 1076744 - RNA, 15 nt, Homo sapiens
acgccuaugauccca

SEQ ID NO: 1076745 - RNA, 18 nt, Homo sapiens
acgccuguaaucccagca

SEQ ID NO: 1076746 - RNA, 13 nt, Homo sapiens
acgucuccugcug

SEQ ID NO: 1076747 - RNA, 14 nt, Homo sapiens
acgugccugugauc

SEQ ID NO: 1076748 - RNA, 18 nt, Homo sapiens
acuaaggggcagcuccug

SEQ ID NO: 1076749 - RNA, 23 nt, Homo sapiens
acuaaggggcagcuccugaccaa

SEQ ID NO: 1076750 - RNA, 21 nt, Homo sapiens
acuacagaauaauguguuaaa

SEQ ID NO: 1076751 - RNA, 20 nt, Homo sapiens
acuaccaaaugagcauuagc

SEQ ID NO: 1076752 - RNA, 21 nt, Homo sapiens
acuauaagcagaagcacauau

SEQ ID NO: 1076753 - RNA, 14 nt, Homo sapiens
acucagcccagcug

SEQ ID NO: 1076754 - RNA, 21 nt, Homo sapiens
acucuuauucccaaacuacag

SEQ ID NO: 1076755 - RNA, 20 nt, Homo sapiens
acugcacuccagccugggug

SEQ ID NO: 1076756 - RNA, 21 nt, Homo sapiens
acugguuugccaggccaaugu

SEQ ID NO: 1076757 - RNA, 17 nt, Homo sapiens
acugucaaguacaagca

SEQ ID NO: 1076758 - RNA, 23 nt, Homo sapiens
acugucauugccccuccgaugcu

SEQ ID NO: 1076759 - RNA, 20 nt, Homo sapiens
acugugaccaaagcauuucu

SEQ ID NO: 1076760 - RNA, 23 nt, Homo sapiens
acuguggagaaauaaaaauaccu

SEQ ID NO: 1076761 - RNA, 15 nt, Homo sapiens
acuugaaaaccucau

SEQ ID NO: 1076762 - RNA, 13 nt, Homo sapiens
acuugaaauacca

SEQ ID NO: 1076763 - RNA, 22 nt, Homo sapiens
acuugaaauaccagugaaccaa

SEQ ID NO: 1076764 - RNA, 23 nt, Homo sapiens
acuugaaauaccagugaaccaaa

SEQ ID NO: 1076765 - RNA, 14 nt, Homo sapiens
acuugagccaucca

SEQ ID NO: 1076766 - RNA, 18 nt, Homo sapiens
acuugguuuuuggcucuu

SEQ ID NO: 1076767 - RNA, 23 nt, Homo sapiens
agaaacugaggccauuauuucaa

SEQ ID NO: 1076768 - RNA, 19 nt, Homo sapiens
agaaacugggcagcccuga

SEQ ID NO: 1076769 - RNA, 22 nt, Homo sapiens
agaaagguaaacaaacaaauaa

SEQ ID NO: 1076770 - RNA, 18 nt, Homo sapiens
agaaauaaaaauaccucu

SEQ ID NO: 1076771 - RNA, 19 nt, Homo sapiens
agaaauaaaaauaccucuu

SEQ ID NO: 1076772 - RNA, 12 nt, Homo sapiens
agaaaucugcca

SEQ ID NO: 1076773 - RNA, 19 nt, Homo sapiens
agaaauuccuguagcaucu

SEQ ID NO: 1076774 - RNA, 18 nt, Homo sapiens
agaaauuuuacugacaga

SEQ ID NO: 1076775 - RNA, 22 nt, Homo sapiens
agaacauuccucugcagcacuu

SEQ ID NO: 1076776 - RNA, 11 nt, Homo sapiens
agaaccaaaag

SEQ ID NO: 1076777 - RNA, 15 nt, Homo sapiens
agaagacacagggga

SEQ ID NO: 1076778 - RNA, 13 nt, Homo sapiens
agaagaccagacu

SEQ ID NO: 1076779 - RNA, 22 nt, Homo sapiens
agaaggguuuuccacccuggaa

SEQ ID NO: 1076780 - RNA, 16 nt, Homo sapiens
agaauugcaaucuaua

SEQ ID NO: 1076781 - RNA, 19 nt, Homo sapiens
agacaagucuugcugugcu

SEQ ID NO: 1076782 - RNA, 17 nt, Homo sapiens
agacagagaagaccaaa

SEQ ID NO: 1076783 - RNA, 14 nt, Homo sapiens
agacauauuuacaa

SEQ ID NO: 1076784 - RNA, 23 nt, Homo sapiens
agacuccaauggggccagcacug

SEQ ID NO: 1076785 - RNA, 23 nt, Homo sapiens
agagaagaccaaagcauugccug

SEQ ID NO: 1076786 - RNA, 16 nt, Homo sapiens
agagaagcaaguggcu

SEQ ID NO: 1076787 - RNA, 20 nt, Homo sapiens
agagagaugagcacuucuaa

SEQ ID NO: 1076788 - RNA, 20 nt, Homo sapiens
agagaggccuuuuguuuaaa

SEQ ID NO: 1076789 - RNA, 11 nt, Homo sapiens
agagccaguga

SEQ ID NO: 1076790 - RNA, 12 nt, Homo sapiens
agagccagugaa

SEQ ID NO: 1076791 - RNA, 13 nt, Homo sapiens
agagccagugaag

SEQ ID NO: 1076792 - RNA, 18 nt, Homo sapiens
agagccagugaaggagcc

SEQ ID NO: 1076793 - RNA, 19 nt, Homo sapiens
agagccccuuaaagcugcu

SEQ ID NO: 1076794 - RNA, 22 nt, Homo sapiens
gaccaccucucaauauucaaua

SEQ ID NO: 1076795 - RNA, 19 nt, Homo sapiens
gaccagcucucuuccuguc

SEQ ID NO: 1076796 - RNA, 14 nt, Homo sapiens
gaccauugucuucc

SEQ ID NO: 1076797 - RNA, 13 nt, Homo sapiens
gaccccaucucuu

SEQ ID NO: 1076798 - RNA, 14 nt, Homo sapiens
gaccugcaggccaa

SEQ ID NO: 1076799 - RNA, 16 nt, Homo sapiens
gaccuguuuugcuuuu

SEQ ID NO: 1076800 - RNA, 21 nt, Homo sapiens
gaccuucucccucacuccugc

SEQ ID NO: 1076801 - RNA, 15 nt, Homo sapiens
gacgggaaaaccaaa

SEQ ID NO: 1076802 - RNA, 14 nt, Homo sapiens
gacucacaagaaga

SEQ ID NO: 1076803 - RNA, 20 nt, Homo sapiens
gagaaauaaaaauaccucuu

SEQ ID NO: 1076804 - RNA, 21 nt, Homo sapiens
gagaacccaauuuuguuucaa

SEQ ID NO: 1076805 - RNA, 20 nt, Homo sapiens
gagaguccucuggauggcac

SEQ ID NO: 1076806 - RNA, 17 nt, Homo sapiens
gagcaggguuagcucac

SEQ ID NO: 1076807 - RNA, 18 nt, Homo sapiens
gagcaguugcccucaggc

SEQ ID NO: 1076808 - RNA, 21 nt, Homo sapiens
gagccaaaaucccaccacugc

SEQ ID NO: 1076809 - RNA, 13 nt, Homo sapiens
gagccauucugug

SEQ ID NO: 1076810 - RNA, 15 nt, Homo sapiens
gaggauaacuuccuu

SEQ ID NO: 1076811 - RNA, 13 nt, Homo sapiens
gaggaucacugga

SEQ ID NO: 1076812 - RNA, 15 nt, Homo sapiens
gaggcagaacaggcu

SEQ ID NO: 1076813 - RNA, 17 nt, Homo sapiens
gaggccgggcgcagugg

SEQ ID NO: 1076814 - RNA, 19 nt, Homo sapiens
gaggcggguggaucacuug

SEQ ID NO: 1076815 - RNA, 14 nt, Homo sapiens
gagggcuccuccau

SEQ ID NO: 1076816 - RNA, 12 nt, Homo sapiens
gagggugacugu

SEQ ID NO: 1076817 - RNA, 20 nt, Homo sapiens
gagguggagguugcagugag

SEQ ID NO: 1076818 - RNA, 14 nt, Homo sapiens
gagguugcagggag

SEQ ID NO: 1076819 - RNA, 18 nt, Homo sapiens
gaguagaacccaggucug

SEQ ID NO: 1076820 - RNA, 20 nt, Homo sapiens
gaguccucguagccaucucu

SEQ ID NO: 1076821 - RNA, 21 nt, Homo sapiens
gauaaaucaguuaugucaauu

SEQ ID NO: 1076822 - RNA, 16 nt, Homo sapiens
gauaaauuccacugga

SEQ ID NO: 1076823 - RNA, 12 nt, Homo sapiens
gauauaucucaa

SEQ ID NO: 1076824 - RNA, 17 nt, Homo sapiens
gauauguuuguacaaga

SEQ ID NO: 1076825 - RNA, 22 nt, Homo sapiens
gaugccacuucccagaggcaga

SEQ ID NO: 1076826 - RNA, 14 nt, Homo sapiens
gauggcaccagagg

SEQ ID NO: 1076827 - RNA, 18 nt, Homo sapiens
gauggcaucuagccagag

SEQ ID NO: 1076828 - RNA, 12 nt, Homo sapiens
gauguacuauaa

SEQ ID NO: 1076829 - RNA, 17 nt, Homo sapiens
gaugugaucacugagac

SEQ ID NO: 1076830 - RNA, 20 nt, Homo sapiens
gauuagcucuggaccagccu

SEQ ID NO: 1076831 - RNA, 13 nt, Homo sapiens
gauuauauaucau

SEQ ID NO: 1076832 - RNA, 19 nt, Homo sapiens
gauugugguacaaucucaa

SEQ ID NO: 1076833 - RNA, 16 nt, Homo sapiens
gcaagauguacuauaa

SEQ ID NO: 1076834 - RNA, 16 nt, Homo sapiens
gcaaggcacugacuga

SEQ ID NO: 1076835 - RNA, 12 nt, Homo sapiens
gcaaggcugugc

SEQ ID NO: 1076836 - RNA, 15 nt, Homo sapiens
gcaaguggcuuucaa

SEQ ID NO: 1076837 - RNA, 20 nt, Homo sapiens
gcacaccucagccccacuga

SEQ ID NO: 1076838 - RNA, 19 nt, Homo sapiens
gcaccagccccacccaagc

SEQ ID NO: 1076839 - RNA, 13 nt, Homo sapiens
gcaccgagaccaa

SEQ ID NO: 1076840 - RNA, 16 nt, Homo sapiens
gcaccuguacucagga

SEQ ID NO: 1076841 - RNA, 21 nt, Homo sapiens
gcaccuguagucccagcuacu

SEQ ID NO: 1076842 - RNA, 16 nt, Homo sapiens
gcagaagcacauauga

SEQ ID NO: 1076843 - RNA, 21 nt, Homo sapiens
gcagagccugagucacugguc

SEQ ID NO: 1076844 - RNA, 23 nt, Homo sapiens
gcagaucuuuuugugaaauucaa

SEQ ID NO: 1076845 - RNA, 16 nt, Homo sapiens
gcagguggcaucucua

SEQ ID NO: 1076846 - RNA, 19 nt, Homo sapiens
gcaguccgcagucuggccu

SEQ ID NO: 1076847 - RNA, 23 nt, Homo sapiens
gcugggaaaaaaguuuugaugaa

SEQ ID NO: 1076848 - RNA, 18 nt, Homo sapiens
gcugucaggacaccagcc

SEQ ID NO: 1076849 - RNA, 16 nt, Homo sapiens
gcuuccagaaaacccc

SEQ ID NO: 1076850 - RNA, 17 nt, Homo sapiens
gcuuccuggguccugcc

SEQ ID NO: 1076851 - RNA, 11 nt, Homo sapiens
gcuugccauau

SEQ ID NO: 1076852 - RNA, 20 nt, Homo sapiens
gcuuucuucucugccuccuc

SEQ ID NO: 1076853 - RNA, 19 nt, Homo sapiens
gcuuuuaagaaacacaggg

SEQ ID NO: 1076854 - RNA, 20 nt, Homo sapiens
ggaaaaaaguuuugaugaaa

SEQ ID NO: 1076855 - RNA, 22 nt, Homo sapiens
ggaaagcaucaccucaggccag

SEQ ID NO: 1076856 - RNA, 19 nt, Homo sapiens
ggaagcggagcuugcagug

SEQ ID NO: 1076857 - RNA, 17 nt, Homo sapiens
ggacaaaacacuguguc

SEQ ID NO: 1076858 - RNA, 17 nt, Homo sapiens
ggacaguccugggagaa

SEQ ID NO: 1076859 - RNA, 13 nt, Homo sapiens
ggaccucugcucu

SEQ ID NO: 1076860 - RNA, 19 nt, Homo sapiens
ggaccuuccugccaccagu

SEQ ID NO: 1076861 - RNA, 12 nt, Homo sapiens
ggagaugcuucu

SEQ ID NO: 1076862 - RNA, 15 nt, Homo sapiens
ggagcaaauguuucu

SEQ ID NO: 1076863 - RNA, 15 nt, Homo sapiens
ggagcaucugacuca

SEQ ID NO: 1076864 - RNA, 13 nt, Homo sapiens
ggagcgcaccugc

SEQ ID NO: 1076865 - RNA, 13 nt, Homo sapiens
ggagcuugcagug

SEQ ID NO: 1076866 - RNA, 15 nt, Homo sapiens
ggaucacucucugcu

SEQ ID NO: 1076867 - RNA, 20 nt, Homo sapiens
ggcacugugccugagcucug

SEQ ID NO: 1076868 - RNA, 18 nt, Homo sapiens
ggcacuuuaaagcauuaa

SEQ ID NO: 1076869 - RNA, 16 nt, Homo sapiens
ggcagccuccuugccu

SEQ ID NO: 1076870 - RNA, 16 nt, Homo sapiens
ggcagggggcaggccu

SEQ ID NO: 1076871 - RNA, 19 nt, Homo sapiens
ggcaggugagaacccagag

SEQ ID NO: 1076872 - RNA, 23 nt, Homo sapiens
ggcaggugggcuggccuggcaca

SEQ ID NO: 1076873 - RNA, 15 nt, Homo sapiens
ggccaaguuccucua

SEQ ID NO: 1076874 - RNA, 17 nt, Homo sapiens
ggccagccuuggcacga

SEQ ID NO: 1076875 - RNA, 17 nt, Homo sapiens
ggccagggaaagcccgu

SEQ ID NO: 1076876 - RNA, 14 nt, Homo sapiens
ggccugcaggugag

SEQ ID NO: 1076877 - RNA, 19 nt, Homo sapiens
ggcgacagagcgagacucc

SEQ ID NO: 1076878 - RNA, 15 nt, Homo sapiens
ggcucuuucagagag

SEQ ID NO: 1076879 - RNA, 23 nt, Homo sapiens
ggcugugcuagcaacacccaaag

SEQ ID NO: 1076880 - RNA, 22 nt, Homo sapiens
ggcuucggacagugcccaugca

SEQ ID NO: 1076881 - RNA, 14 nt, Homo sapiens
ggcuucugggagau

SEQ ID NO: 1076882 - RNA, 22 nt, Homo sapiens
ggcuuucuggagaggagggaug

SEQ ID NO: 1076883 - RNA, 22 nt, Homo sapiens
gggaaaccaguguagccuugcc

SEQ ID NO: 1076884 - RNA, 15 nt, Homo sapiens
gggaaccuccuuacc

SEQ ID NO: 1076885 - RNA, 22 nt, Homo sapiens
gggaagcgaugaauuuggagac

SEQ ID NO: 1076886 - RNA, 18 nt, Homo sapiens
gggcagccuccuugccug

SEQ ID NO: 1076887 - RNA, 15 nt, Homo sapiens
gggcaugccaugucu

SEQ ID NO: 1076888 - RNA, 22 nt, Homo sapiens
gggcaugcuggggcaagucccu

SEQ ID NO: 1076889 - RNA, 16 nt, Homo sapiens
gggccaaagcacagcu

SEQ ID NO: 1076890 - RNA, 19 nt, Homo sapiens
gggcugugucguagccaag

SEQ ID NO: 1076891 - RNA, 16 nt, Homo sapiens
ggggcucugugcaggg

SEQ ID NO: 1076892 - RNA, 11 nt, Homo sapiens
gggugggagag

SEQ ID NO: 1076893 - RNA, 18 nt, Homo sapiens
ggguuagcucacgugucu

SEQ ID NO: 1076894 - RNA, 14 nt, Homo sapiens
ggguuuuauaucca

SEQ ID NO: 1076895 - RNA, 11 nt, Homo sapiens
gguaaucagca

SEQ ID NO: 1076896 - RNA, 20 nt, Homo sapiens
gguaggggcugcagggacaa

SEQ ID NO: 1076897 - RNA, 17 nt, Homo sapiens
gguaucaggacugugac

SEQ ID NO: 1076898 - RNA, 16 nt, Homo sapiens
gguccuggugggucag

SEQ ID NO: 1076899 - RNA, 23 nt, Homo sapiens
uaaacacccaugaaucaaagaca

SEQ ID NO: 1076900 - RNA, 14 nt, Homo sapiens
uaaaccaauugcag

SEQ ID NO: 1076901 - RNA, 21 nt, Homo sapiens
uaaacuguaucaaaucuguau

SEQ ID NO: 1076902 - RNA, 13 nt, Homo sapiens
uaaagcugcugag

SEQ ID NO: 1076903 - RNA, 14 nt, Homo sapiens
uaaaggucacuuuu

SEQ ID NO: 1076904 - RNA, 17 nt, Homo sapiens
uaaaggugcugcacugg

SEQ ID NO: 1076905 - RNA, 22 nt, Homo sapiens
uaaaucauacuccuaugcuuua

SEQ ID NO: 1076906 - RNA, 14 nt, Homo sapiens
uaaauuauauuccu

SEQ ID NO: 1076907 - RNA, 22 nt, Homo sapiens
uaacauagaauugcaaucuaua

SEQ ID NO: 1076908 - RNA, 12 nt, Homo sapiens
uaaccugaauua

SEQ ID NO: 1076909 - RNA, 17 nt, Homo sapiens
uaaccugaauuauucca

SEQ ID NO: 1076910 - RNA, 19 nt, Homo sapiens
uaacuagaaaucugccaau

SEQ ID NO: 1076911 - RNA, 20 nt, Homo sapiens
uaacuggugauauaucucaa

SEQ ID NO: 1076912 - RNA, 12 nt, Homo sapiens
uaagacacaaac

SEQ ID NO: 1076913 - RNA, 20 nt, Homo sapiens
uaagacacaaacaaaccauu

SEQ ID NO: 1076914 - RNA, 19 nt, Homo sapiens
uaagcagaagcacauauga

SEQ ID NO: 1076915 - RNA, 21 nt, Homo sapiens
uaagcaugacgggaaaaccaa

SEQ ID NO: 1076916 - RNA, 17 nt, Homo sapiens
uaaguaccacucaggcc

SEQ ID NO: 1076917 - RNA, 19 nt, Homo sapiens
uaaugauuguuuaaagguu

SEQ ID NO: 1076918 - RNA, 21 nt, Homo sapiens
uaauuggaagaaauuccugua

SEQ ID NO: 1076919 - RNA, 19 nt, Homo sapiens
uaauuuugugaaagaagga

SEQ ID NO: 1076920 - RNA, 16 nt, Homo sapiens
uacaaaaaacugcagu

SEQ ID NO: 1076921 - RNA, 19 nt, Homo sapiens
uacaaaaaauuagccagau

SEQ ID NO: 1076922 - RNA, 16 nt, Homo sapiens
uacaaucucaaauucu

SEQ ID NO: 1076923 - RNA, 21 nt, Homo sapiens
uacauguuugguaccaagaaa

SEQ ID NO: 1076924 - RNA, 16 nt, Homo sapiens
uacccuauaucuauaa

SEQ ID NO: 1076925 - RNA, 23 nt, Homo sapiens
uacccuauaucuauaaacacugu

SEQ ID NO: 1076926 - RNA, 13 nt, Homo sapiens
uaccucagccuag

SEQ ID NO: 1076927 - RNA, 19 nt, Homo sapiens
uaccuuccuuaagccagga

SEQ ID NO: 1076928 - RNA, 23 nt, Homo sapiens
uacggguaacagugaggcuggga

SEQ ID NO: 1076929 - RNA, 16 nt, Homo sapiens
uacuaaaaauacagaa

SEQ ID NO: 1076930 - RNA, 21 nt, Homo sapiens
uacucacccagggacuccagu

SEQ ID NO: 1076931 - RNA, 15 nt, Homo sapiens
uacuugaaaaccuca

SEQ ID NO: 1076932 - RNA, 14 nt, Homo sapiens
uacuugaaauacca

SEQ ID NO: 1076933 - RNA, 22 nt, Homo sapiens
uacuugaaauaccagugaacca

SEQ ID NO: 1076934 - RNA, 16 nt, Homo sapiens
uacuuguaaaggugcu

SEQ ID NO: 1076935 - RNA, 16 nt, Homo sapiens
uagaaagcaagaugua

SEQ ID NO: 1076936 - RNA, 18 nt, Homo sapiens
uagaaagcaagauguacu

SEQ ID NO: 1076937 - RNA, 16 nt, Homo sapiens
uagaacuccaguacuc

SEQ ID NO: 1076938 - RNA, 20 nt, Homo sapiens
uagaacuucaagaaguaaga

SEQ ID NO: 1076939 - RNA, 17 nt, Homo sapiens
uagaauugcaaucuaua

SEQ ID NO: 1076940 - RNA, 13 nt, Homo sapiens
uaguagugucuuc

SEQ ID NO: 1076941 - RNA, 20 nt, Homo sapiens
uagugggguuuuauauccau

SEQ ID NO: 1076942 - RNA, 16 nt, Homo sapiens
uaguguccggggaccu

SEQ ID NO: 1076943 - RNA, 19 nt, Homo sapiens
uauaaauguuugucuggau

SEQ ID NO: 1076944 - RNA, 14 nt, Homo sapiens
uauagguuuccacu

SEQ ID NO: 1076945 - RNA, 20 nt, Homo sapiens
uauaguuaaucuauaacuac

SEQ ID NO: 1076946 - RNA, 18 nt, Homo sapiens
uauaucucaaauuguaau

SEQ ID NO: 1076947 - RNA, 19 nt, Homo sapiens
uaucaggacugugaccaaa

SEQ ID NO: 1076948 - RNA, 17 nt, Homo sapiens
uaucuauaaacacuguu

SEQ ID NO: 1076949 - RNA, 21 nt, Homo sapiens
uaucucaaauuguaauuaaua

SEQ ID NO: 1076950 - RNA, 13 nt, Homo sapiens
uauguuugcacuu

SEQ ID NO: 1076951 - RNA, 14 nt, Homo sapiens
uauguuugcacuuu

SEQ ID NO: 1076952 - RNA, 20 nt, Homo sapiens
ucguggguguguguagccaa

SEQ ID NO: 1076953 - RNA, 21 nt, Homo sapiens
ucguggguguguguagccaag

SEQ ID NO: 1076954 - RNA, 17 nt, Homo sapiens
ucuaaguucauguuugu

SEQ ID NO: 1076955 - RNA, 16 nt, Homo sapiens
ucuacuccaugcacau

SEQ ID NO: 1076956 - RNA, 17 nt, Homo sapiens
ucuacuccuaccucagc

SEQ ID NO: 1076957 - RNA, 13 nt, Homo sapiens
ucucaaauucuca

SEQ ID NO: 1076958 - RNA, 21 nt, Homo sapiens
ucucaaauucucaaccuacca

SEQ ID NO: 1076959 - RNA, 21 nt, Homo sapiens
ucuccccgaaagggacacaau

SEQ ID NO: 1076960 - RNA, 17 nt, Homo sapiens
ucucugagaaccaaaag

SEQ ID NO: 1076961 - RNA, 14 nt, Homo sapiens
ucugaaauuuccca

SEQ ID NO: 1076962 - RNA, 16 nt, Homo sapiens
ucugagagcacagcgu

SEQ ID NO: 1076963 - RNA, 20 nt, Homo sapiens
ucugccccagcucuggcuuc

SEQ ID NO: 1076964 - RNA, 22 nt, Homo sapiens
ucugcucuaugccaggcugugc

SEQ ID NO: 1076965 - RNA, 17 nt, Homo sapiens
ucugcuuuugcacaccu

SEQ ID NO: 1076966 - RNA, 17 nt, Homo sapiens
ucuggaccagccuguug

SEQ ID NO: 1076967 - RNA, 17 nt, Homo sapiens
ucuggauggcaccagag

SEQ ID NO: 1076968 - RNA, 14 nt, Homo sapiens
ucugguuucugugu

SEQ ID NO: 1076969 - RNA, 17 nt, Homo sapiens
ucugugcuuugacucac

SEQ ID NO: 1076970 - RNA, 15 nt, Homo sapiens
ucuuaaaauucuugg

SEQ ID NO: 1076971 - RNA, 18 nt, Homo sapiens
ucuuagcugaacaaugaa

SEQ ID NO: 1076972 - RNA, 14 nt, Homo sapiens
ucuuagcugucacc

SEQ ID NO: 1076973 - RNA, 21 nt, Homo sapiens
ucuucaggguguuaaggcagu

SEQ ID NO: 1076974 - RNA, 22 nt, Homo sapiens
ucuucaggguguuaaggcagug

SEQ ID NO: 1076975 - RNA, 12 nt, Homo sapiens
ucuucuaugcaa

SEQ ID NO: 1076976 - RNA, 18 nt, Homo sapiens
ucuucuuagcugucaccu

SEQ ID NO: 1076977 - RNA, 15 nt, Homo sapiens
ucuugaaguucaugg

SEQ ID NO: 1076978 - RNA, 12 nt, Homo sapiens
ucuuucagagag

SEQ ID NO: 1076979 - RNA, 18 nt, Homo sapiens
ucuuuccuuuugcaacaa

SEQ ID NO: 1076980 - RNA, 17 nt, Homo sapiens
ucuuugaagagauuuca

SEQ ID NO: 1076981 - RNA, 12 nt, Homo sapiens
ugaaaaacauuc

SEQ ID NO: 1076982 - RNA, 22 nt, Homo sapiens
ugaaacaaaauccaacccuguc

SEQ ID NO: 1076983 - RNA, 23 nt, Homo sapiens
ugaaagaaaaauaccaugucucu

SEQ ID NO: 1076984 - RNA, 21 nt, Homo sapiens
ugaaagggaaagucagcuuuc

SEQ ID NO: 1076985 - RNA, 14 nt, Homo sapiens
ugaaauaccaguga

SEQ ID NO: 1076986 - RNA, 21 nt, Homo sapiens
ugaaauaccagugaaccaaag

SEQ ID NO: 1076987 - RNA, 19 nt, Homo sapiens
ugaaaucaguaaacacugu

SEQ ID NO: 1076988 - RNA, 20 nt, Homo sapiens
ugaaaucaguaaacacugug

SEQ ID NO: 1076989 - RNA, 22 nt, Homo sapiens
ugaaaucaguaaacacugugua

SEQ ID NO: 1076990 - RNA, 20 nt, Homo sapiens
ugaaaucgccguguuacugu

SEQ ID NO: 1076991 - RNA, 18 nt, Homo sapiens
ugaacuuucacauagcac

SEQ ID NO: 1076992 - RNA, 22 nt, Homo sapiens
ugaagagauuucaacaagaaua

SEQ ID NO: 1076993 - RNA, 14 nt, Homo sapiens
ugaauaagcacuuu

SEQ ID NO: 1076994 - RNA, 19 nt, Homo sapiens
ugaauagggcuaggaauau

SEQ ID NO: 1076995 - RNA, 20 nt, Homo sapiens
ugaaucuucugaaaccaaau

SEQ ID NO: 1076996 - RNA, 19 nt, Homo sapiens
ugaauguguugauuugaga

SEQ ID NO: 1076997 - RNA, 14 nt, Homo sapiens
ugacaugugcagug

SEQ ID NO: 1076998 - RNA, 13 nt, Homo sapiens
ugagcucaggcau

SEQ ID NO: 1076999 - RNA, 22 nt, Homo sapiens
ugagcucuuguuccgugccagg

SEQ ID NO: 1077000 - RNA, 17 nt, Homo sapiens
ugagcuggaucacuuga

SEQ ID NO: 1077001 - RNA, 21 nt, Homo sapiens
ugaggccacccacugacccaa

SEQ ID NO: 1077002 - RNA, 22 nt, Homo sapiens
ugaggggcuccuggaaaggcuc

SEQ ID NO: 1077003 - RNA, 14 nt, Homo sapiens
ugauccugcuccag

SEQ ID NO: 1077004 - RNA, 21 nt, Homo sapiens
ugaucgcgccacuacacucca

SEQ ID NO: 1077005 - RNA, 17 nt, Homo sapiens
aaaaagacuaagccaga

SEQ ID NO: 1077006 - RNA, 21 nt, Homo sapiens
aaaaauauguugaguguucau

SEQ ID NO: 1077007 - RNA, 17 nt, Homo sapiens
aaaaaucagcuggguac

SEQ ID NO: 1077008 - RNA, 14 nt, Homo sapiens
aaaaauuagccaga

SEQ ID NO: 1077009 - RNA, 16 nt, Homo sapiens
aaaacugcaguuugau

SEQ ID NO: 1077010 - RNA, 15 nt, Homo sapiens
aaaagauuauauauc

SEQ ID NO: 1077011 - RNA, 18 nt, Homo sapiens
aaaaguaaguaccacuca

SEQ ID NO: 1077012 - RNA, 14 nt, Homo sapiens
aaaaguauauauuc

SEQ ID NO: 1077013 - RNA, 20 nt, Homo sapiens
aaaaugcauguaaucaacau

SEQ ID NO: 1077014 - RNA, 15 nt, Homo sapiens
aaacaugcacgguga

SEQ ID NO: 1077015 - RNA, 17 nt, Homo sapiens
aaacaugcuaaauaguu

SEQ ID NO: 1077016 - RNA, 24 nt, Homo sapiens
aaacaugcuaaauaguucuaucag

SEQ ID NO: 1077017 - RNA, 19 nt, Homo sapiens
aaacauucacacagggcuc

SEQ ID NO: 1077018 - RNA, 16 nt, Homo sapiens
aaaccagccuggccaa

SEQ ID NO: 1077019 - RNA, 18 nt, Homo sapiens
aaagaaaucuucauuuau

SEQ ID NO: 1077020 - RNA, 21 nt, Homo sapiens
aaagagacuggagcaucugac

SEQ ID NO: 1077021 - RNA, 10 nt, Homo sapiens
aaagcacagc

SEQ ID NO: 1077022 - RNA, 19 nt, Homo sapiens
aaagcagguggcaucucua

SEQ ID NO: 1077023 - RNA, 18 nt, Homo sapiens
aauaaaacuuaugcuagu

SEQ ID NO: 1077024 - RNA, 21 nt, Homo sapiens
aauaaagcugcugagaaucua

SEQ ID NO: 1077025 - RNA, 17 nt, Homo sapiens
aauaccagugaaccaaa

SEQ ID NO: 1077026 - RNA, 17 nt, Homo sapiens
aauagauuaguacugga

SEQ ID NO: 1077027 - RNA, 20 nt, Homo sapiens
aauagcucuacugcccuccc

SEQ ID NO: 1077028 - RNA, 12 nt, Homo sapiens
aauaucugggug

SEQ ID NO: 1077029 - RNA, 17 nt, Homo sapiens
aauauguugaguguuca

SEQ ID NO: 1077030 - RNA, 20 nt, Homo sapiens
aaucaagcuagaaggccaca

SEQ ID NO: 1077031 - RNA, 19 nt, Homo sapiens
aaucaguaaacacugugua

SEQ ID NO: 1077032 - RNA, 22 nt, Homo sapiens
aaucagucuuggaauacuugaa

SEQ ID NO: 1077033 - RNA, 20 nt, Homo sapiens
aaucauuguagaaacacagu

SEQ ID NO: 1077034 - RNA, 17 nt, Homo sapiens
aauccuucucacuaaaa

SEQ ID NO: 1077035 - RNA, 22 nt, Homo sapiens
aaucuauaacuacauauugaau

SEQ ID NO: 1077036 - RNA, 13 nt, Homo sapiens
aaugacccaaaga

SEQ ID NO: 1077037 - RNA, 17 nt, Homo sapiens
aaugacccaaagaccaa

SEQ ID NO: 1077038 - RNA, 18 nt, Homo sapiens
aaugccucuucuuuaugu

SEQ ID NO: 1077039 - RNA, 23 nt, Homo sapiens
aauuauauuccucuugcauuuca

SEQ ID NO: 1077040 - RNA, 18 nt, Homo sapiens
aauuccuguagcaucuuc

SEQ ID NO: 1077041 - RNA, 17 nt, Homo sapiens
ggguguguguagccaag

SEQ ID NO: 1077042 - RNA, 22 nt, Homo sapiens
ggguuggggugcuuccuuucag

SEQ ID NO: 1077043 - RNA, 22 nt, Homo sapiens
gguauccagaauggaauuuugc

SEQ ID NO: 1077044 - RNA, 22 nt, Homo sapiens
gguccucccucccaaggagcca

SEQ ID NO: 1077045 - RNA, 17 nt, Homo sapiens
ggucuccggggaggcag

SEQ ID NO: 1077046 - RNA, 17 nt, Homo sapiens
gguggagguugcaguga

SEQ ID NO: 1077047 - RNA, 17 nt, Homo sapiens
gguuagccuuugcccug

SEQ ID NO: 1077048 - RNA, 18 nt, Homo sapiens
gguuggcccucacugcag

SEQ ID NO: 1077049 - RNA, 15 nt, Homo sapiens
guaaacuguaucaaa

SEQ ID NO: 1077050 - RNA, 14 nt, Homo sapiens
guaagacacaaaca

SEQ ID NO: 1077051 - RNA, 16 nt, Homo sapiens
guaaucccagcacuuu

SEQ ID NO: 1077052 - RNA, 19 nt, Homo sapiens
guaauuuugugaaagaagg

SEQ ID NO: 1077053 - RNA, 12 nt, Homo sapiens
guacaaucucaa

SEQ ID NO: 1077054 - RNA, 18 nt, Homo sapiens
guacaaugugacuuugaa

SEQ ID NO: 1077055 - RNA, 22 nt, Homo sapiens
guacauuuggcauuuguguuau

SEQ ID NO: 1077056 - RNA, 19 nt, Homo sapiens
guagaaacacaguuuugaa

SEQ ID NO: 1077057 - RNA, 16 nt, Homo sapiens
guagguuucucucuuc

SEQ ID NO: 1077058 - RNA, 19 nt, Homo sapiens
guauaaugguguuacuaaa

SEQ ID NO: 1077059 - RNA, 21 nt, Homo sapiens
guauauauucuacacauauau

SEQ ID NO: 1077060 - RNA, 15 nt, Homo sapiens
guaucaggacuguga

SEQ ID NO: 1077061 - RNA, 17 nt, Homo sapiens
guaucaggacugugacc

SEQ ID NO: 1077062 - RNA, 17 nt, Homo sapiens
gucaauuacauguuugg

SEQ ID NO: 1077063 - RNA, 15 nt, Homo sapiens
gucacaggcugugcc

SEQ ID NO: 1077064 - RNA, 11 nt, Homo sapiens
guccaggaaac

SEQ ID NO: 1077065 - RNA, 20 nt, Homo sapiens
guccucccaggaaccaaaaa

SEQ ID NO: 1077066 - RNA, 22 nt, Homo sapiens
gucucccugcacagccucuagu

SEQ ID NO: 1077067 - RNA, 16 nt, Homo sapiens
gucuccuugcacuuuc

SEQ ID NO: 1077068 - RNA, 14 nt, Homo sapiens
gucugucccaaaga

SEQ ID NO: 1077069 - RNA, 19 nt, Homo sapiens
gugaaggauaagagaaaca

SEQ ID NO: 1077070 - RNA, 16 nt, Homo sapiens
gugacaugugcagugc

SEQ ID NO: 1077071 - RNA, 13 nt, Homo sapiens
gugagaccaccuc

SEQ ID NO: 1077072 - RNA, 14 nt, Homo sapiens
gugauggaccaaag

SEQ ID NO: 1077073 - RNA, 15 nt, Homo sapiens
gugauggaccaaagc

SEQ ID NO: 1077074 - RNA, 20 nt, Homo sapiens
gugcaacgcuuuuugggaga

SEQ ID NO: 1077075 - RNA, 19 nt, Homo sapiens
gugccuccuccccaggugg

SEQ ID NO: 1077076 - RNA, 19 nt, Homo sapiens
gugccuccugugugucugc

SEQ ID NO: 1077077 - RNA, 14 nt, Homo sapiens
gugccugagacacc

SEQ ID NO: 1077078 - RNA, 21 nt, Homo sapiens
gugccugagcucugacagugu

SEQ ID NO: 1077079 - RNA, 17 nt, Homo sapiens
gugcuacacuugcaccu

SEQ ID NO: 1077080 - RNA, 17 nt, Homo sapiens
gugcuguggccugggca

SEQ ID NO: 1077081 - RNA, 15 nt, Homo sapiens
gugcuucagccugag

SEQ ID NO: 1077082 - RNA, 13 nt, Homo sapiens
guggagguugcag

SEQ ID NO: 1077083 - RNA, 15 nt, Homo sapiens
guggagguugcagug

SEQ ID NO: 1077084 - RNA, 19 nt, Homo sapiens
gugggcgaggccugacaca

SEQ ID NO: 1077085 - RNA, 12 nt, Homo sapiens
guguccuuccau

SEQ ID NO: 1077086 - RNA, 22 nt, Homo sapiens
guguguaucgcugccuugccau

SEQ ID NO: 1077087 - RNA, 16 nt, Homo sapiens
guguuacuguugcacu

SEQ ID NO: 1077088 - RNA, 18 nt, Homo sapiens
guguuauuauuuugcacu

SEQ ID NO: 1077089 - RNA, 20 nt, Homo sapiens
guguuauuauuuugcacugu

SEQ ID NO: 1077090 - RNA, 19 nt, Homo sapiens
guuacuaaagucacauaua

SEQ ID NO: 1077091 - RNA, 17 nt, Homo sapiens
guuacuguugcacugau

SEQ ID NO: 1077092 - RNA, 14 nt, Homo sapiens
guuauguuugcacu

SEQ ID NO: 1077093 - RNA, 18 nt, Homo sapiens
guuauguuugcacuuugu

SEQ ID NO: 1077094 - RNA, 16 nt, Homo sapiens
guuauugaaucuuaau

SEQ ID NO: 1077095 - RNA, 22 nt, Homo sapiens
guucagaguuguacacugugua

SEQ ID NO: 1077096 - RNA, 20 nt, Homo sapiens
guucauguuuguaaauuaau

SEQ ID NO: 1077097 - RNA, 20 nt, Homo sapiens
guucgagaccagccuggcca

SEQ ID NO: 1077098 - RNA, 16 nt, Homo sapiens
guucugguaugaacuu

SEQ ID NO: 1077099 - RNA, 21 nt, Homo sapiens
guucuuuaauguuguccagga

SEQ ID NO: 1077100 - RNA, 18 nt, Homo sapiens
guugaggggcuccuggaa

SEQ ID NO: 1077101 - RNA, 14 nt, Homo sapiens
guugcagugagcca

SEQ ID NO: 1077102 - RNA, 18 nt, Homo sapiens
guuggacccgcucuggac

SEQ ID NO: 1077103 - RNA, 16 nt, Homo sapiens
guuuaaaaaaaguaua

SEQ ID NO: 1077104 - RNA, 19 nt, Homo sapiens
guuuaccucuucuaugcaa

SEQ ID NO: 1077105 - RNA, 19 nt, Homo sapiens
guuucuauuuucucugaua

SEQ ID NO: 1077106 - RNA, 15 nt, Homo sapiens
guuucuuccuuuccu

SEQ ID NO: 1077107 - RNA, 21 nt, Homo sapiens
guuuuuggcucuuucagagag

SEQ ID NO: 1077108 - RNA, 13 nt, Homo sapiens
uaaaaaagcuaua

SEQ ID NO: 1077109 - RNA, 14 nt, Homo sapiens
uaaaaaagcuauaa

SEQ ID NO: 1077110 - RNA, 16 nt, Homo sapiens
uaaaagaaaucuucau

SEQ ID NO: 1077111 - RNA, 15 nt, Homo sapiens
uaaaauguaaagguc

SEQ ID NO: 1077112 - RNA, 11 nt, Homo sapiens
uaaaauuccaa

SEQ ID NO: 1077113 - RNA, 16 nt, Homo sapiens
uaaagcugcugucacu

SEQ ID NO: 1077114 - RNA, 15 nt, Homo sapiens
uaaauaacagugugu

SEQ ID NO: 1077115 - RNA, 22 nt, Homo sapiens
uaaauauuaaccugaauuauuc

SEQ ID NO: 1077116 - RNA, 22 nt, Homo sapiens
uaaauuauauuccucuugcauu

SEQ ID NO: 1077117 - RNA, 20 nt, Homo sapiens
uaacaugucuuucagcauua

SEQ ID NO: 1077118 - RNA, 18 nt, Homo sapiens
uaacuagaaaucugccaa

SEQ ID NO: 1077119 - RNA, 13 nt, Homo sapiens
uaacuauguuuua

SEQ ID NO: 1077120 - RNA, 22 nt, Homo sapiens
uaagcugggaaaaaaguuuuga

SEQ ID NO: 1077121 - RNA, 16 nt, Homo sapiens
uaauaauagauuguga

SEQ ID NO: 1077122 - RNA, 21 nt, Homo sapiens
uaauaucugagaaguguauau

SEQ ID NO: 1077123 - RNA, 19 nt, Homo sapiens
uaaucccagcacuuuggca

SEQ ID NO: 1077124 - RNA, 20 nt, Homo sapiens
uaaucccagcuacuugggag

SEQ ID NO: 1077125 - RNA, 17 nt, Homo sapiens
uaaucuauaacuacaua

SEQ ID NO: 1077126 - RNA, 18 nt, Homo sapiens
uacaaucucaaauucuca

SEQ ID NO: 1077127 - RNA, 16 nt, Homo sapiens
uaccagugaaccaaag

SEQ ID NO: 1077128 - RNA, 13 nt, Homo sapiens
uaccagugugcuu

SEQ ID NO: 1077129 - RNA, 11 nt, Homo sapiens
uacccacuucc

SEQ ID NO: 1077130 - RNA, 16 nt, Homo sapiens
uacuccaugcacauag

SEQ ID NO: 1077131 - RNA, 17 nt, Homo sapiens
uacuguagcugaugaaa

SEQ ID NO: 1077132 - RNA, 19 nt, Homo sapiens
uacuguugcacugaugucc

SEQ ID NO: 1077133 - RNA, 19 nt, Homo sapiens
uacuugaaauaccagugaa

SEQ ID NO: 1077134 - RNA, 21 nt, Homo sapiens
uacuugggaggcugagccagg

SEQ ID NO: 1077135 - RNA, 20 nt, Homo sapiens
uacuuuucagaauugaagga

SEQ ID NO: 1077136 - RNA, 22 nt, Homo sapiens
uagaaacugaggccauuauuuc

SEQ ID NO: 1077137 - RNA, 13 nt, Homo sapiens
uagaacacccacu

SEQ ID NO: 1077138 - RNA, 16 nt, Homo sapiens
uagaacccaggucuga

SEQ ID NO: 1077139 - RNA, 18 nt, Homo sapiens
uagaauugcaaucuauaa

SEQ ID NO: 1077140 - RNA, 12 nt, Homo sapiens
uagaggagcaac

SEQ ID NO: 1077141 - RNA, 11 nt, Homo sapiens
uagcugucacc

SEQ ID NO: 1077142 - RNA, 22 nt, Homo sapiens
uaggaauauagauuaaaucaua

SEQ ID NO: 1077143 - RNA, 16 nt, Homo sapiens
uaggacucugaggcuc

SEQ ID NO: 1077144 - RNA, 13 nt, Homo sapiens
uauaaauguuugu

SEQ ID NO: 1077145 - RNA, 17 nt, Homo sapiens
uauaagcagaagcacau

SEQ ID NO: 1077146 - RNA, 20 nt, Homo sapiens
uauaagcagaagcacauaug

SEQ ID NO: 1077147 - RNA, 16 nt, Homo sapiens
uauaguuaaucuauaa

SEQ ID NO: 1077148 - RNA, 18 nt, Homo sapiens
uauaucuauaaacacugu

SEQ ID NO: 1077149 - RNA, 17 nt, Homo sapiens
uauauuccucuugcauu

SEQ ID NO: 1077150 - RNA, 20 nt, Homo sapiens
uaucaggacugugaccaaag

SEQ ID NO: 1077151 - RNA, 23 nt, Homo sapiens
caaagacagagaagaccaaagca

SEQ ID NO: 1077152 - RNA, 18 nt, Homo sapiens
caaagagacccagucaau

SEQ ID NO: 1077153 - RNA, 18 nt, Homo sapiens
caaagccaaacucugcca

SEQ ID NO: 1077154 - RNA, 14 nt, Homo sapiens
caaaugacccaaag

SEQ ID NO: 1077155 - RNA, 15 nt, Homo sapiens
caaaugacccaaaga

SEQ ID NO: 1077156 - RNA, 17 nt, Homo sapiens
caaccccccaccugcca

SEQ ID NO: 1077157 - RNA, 22 nt, Homo sapiens
caacucauugcaucauuuacaa

SEQ ID NO: 1077158 - RNA, 23 nt, Homo sapiens
caacuuuaauugcuuaaaagaca

SEQ ID NO: 1077159 - RNA, 20 nt, Homo sapiens
caagaauauuguauguuaaa

SEQ ID NO: 1077160 - RNA, 16 nt, Homo sapiens
caagauguacuauaac

SEQ ID NO: 1077161 - RNA, 16 nt, Homo sapiens
caagccccugccucca

SEQ ID NO: 1077162 - RNA, 18 nt, Homo sapiens
caaggcacugacugagca

SEQ ID NO: 1077163 - RNA, 21 nt, Homo sapiens
caaguaguagugucuuccuag

SEQ ID NO: 1077164 - RNA, 16 nt, Homo sapiens
caaguuagcucaggag

SEQ ID NO: 1077165 - RNA, 20 nt, Homo sapiens
caaugucagaaacucgauga

SEQ ID NO: 1077166 - RNA, 15 nt, Homo sapiens
caauguggcaugacu

SEQ ID NO: 1077167 - RNA, 18 nt, Homo sapiens
caauuguccccagggaca

SEQ ID NO: 1077168 - RNA, 22 nt, Homo sapiens
cacaagaagaccagacugugga

SEQ ID NO: 1077169 - RNA, 18 nt, Homo sapiens
cacacacauaagcacuga

SEQ ID NO: 1077170 - RNA, 13 nt, Homo sapiens
cacaccuguaauc

SEQ ID NO: 1077171 - RNA, 14 nt, Homo sapiens
cacagaagccagga

SEQ ID NO: 1077172 - RNA, 23 nt, Homo sapiens
cacagccgcagccucccucugac

SEQ ID NO: 1077173 - RNA, 12 nt, Homo sapiens
cacauaaaggua

SEQ ID NO: 1077174 - RNA, 19 nt, Homo sapiens
cacaugacuuuuccauuga

SEQ ID NO: 1077175 - RNA, 21 nt, Homo sapiens
cacauucgcaccccuacuuca

SEQ ID NO: 1077176 - RNA, 18 nt, Homo sapiens
caccagaggcugcagaag

SEQ ID NO: 1077177 - RNA, 21 nt, Homo sapiens
caccagaggcugcagaaggcc

SEQ ID NO: 1077178 - RNA, 13 nt, Homo sapiens
caccagggagcag

SEQ ID NO: 1077179 - RNA, 12 nt, Homo sapiens
cacccacugacc

SEQ ID NO: 1077180 - RNA, 15 nt, Homo sapiens
cacccaugaaucaaa

SEQ ID NO: 1077181 - RNA, 19 nt, Homo sapiens
cacccaugccauagaaacu

SEQ ID NO: 1077182 - RNA, 21 nt, Homo sapiens
caccguggaccuuccugccac

SEQ ID NO: 1077183 - RNA, 13 nt, Homo sapiens
caccuacccagcu

SEQ ID NO: 1077184 - RNA, 19 nt, Homo sapiens
caccucagccccacugaca

SEQ ID NO: 1077185 - RNA, 15 nt, Homo sapiens
caccuccuuggcacc

SEQ ID NO: 1077186 - RNA, 22 nt, Homo sapiens
caccucuucucuuccuguaaca

SEQ ID NO: 1077187 - RNA, 15 nt, Homo sapiens
caccuuuacucugcu

SEQ ID NO: 1077188 - RNA, 15 nt, Homo sapiens
cacgcgccuguaauc

SEQ ID NO: 1077189 - RNA, 17 nt, Homo sapiens
cacgugauggaccaaag

SEQ ID NO: 1077190 - RNA, 19 nt, Homo sapiens
cacgugauggaccaaagcc

SEQ ID NO: 1077191 - RNA, 22 nt, Homo sapiens
cacuugguuuuuggcucuuuca

SEQ ID NO: 1077192 - RNA, 20 nt, Homo sapiens
cacuuugggaggcugaggcg

SEQ ID NO: 1077193 - RNA, 19 nt, Homo sapiens
cagaacccuuccugagacc

SEQ ID NO: 1077194 - RNA, 15 nt, Homo sapiens
cagaagcacauauga

SEQ ID NO: 1077195 - RNA, 21 nt, Homo sapiens
cagaagcacauaugaacugga

SEQ ID NO: 1077196 - RNA, 22 nt, Homo sapiens
cagaaugacuuuuauugagcuc

SEQ ID NO: 1077197 - RNA, 16 nt, Homo sapiens
cagacauuuaucuuuu

SEQ ID NO: 1077198 - RNA, 17 nt, Homo sapiens
cagaccauugucuucca

SEQ ID NO: 1077199 - RNA, 22 nt, Homo sapiens
cagagaagauaauguucuuuaa

SEQ ID NO: 1077200 - RNA, 19 nt, Homo sapiens
cagauauuaaauaacagug

SEQ ID NO: 1077201 - RNA, 18 nt, Homo sapiens
cagaucuuuuugugaaau

SEQ ID NO: 1077202 - RNA, 16 nt, Homo sapiens
cagcauuauucuucag

SEQ ID NO: 1077203 - RNA, 19 nt, Homo sapiens
cagccuguuggacccgcuc

SEQ ID NO: 1077204 - RNA, 12 nt, Homo sapiens
cagccuuggcac

SEQ ID NO: 1077205 - RNA, 13 nt, Homo sapiens
cagcuaacugugg

SEQ ID NO: 1077206 - RNA, 14 nt, Homo sapiens
cagcugaugggggu

SEQ ID NO: 1077207 - RNA, 21 nt, Homo sapiens
cagcugcugggacccaccucc

SEQ ID NO: 1077208 - RNA, 21 nt, Homo sapiens
cagcuuggcacuuuaaagcau

SEQ ID NO: 1077209 - RNA, 13 nt, Homo sapiens
caggacugugacc

SEQ ID NO: 1077210 - RNA, 18 nt, Homo sapiens
caggacugugaccaaagc

SEQ ID NO: 1077211 - RNA, 19 nt, Homo sapiens
caggacugugaccaaagca

SEQ ID NO: 1077212 - RNA, 17 nt, Homo sapiens
caggagaucgagaccau

SEQ ID NO: 1077213 - RNA, 17 nt, Homo sapiens
caggagcauggggauaa

SEQ ID NO: 1077214 - RNA, 23 nt, Homo sapiens
ugaaauaccagugaaccaaagag

SEQ ID NO: 1077215 - RNA, 17 nt, Homo sapiens
ugaacuuucacauagca

SEQ ID NO: 1077216 - RNA, 13 nt, Homo sapiens
ugaagccacugaa

SEQ ID NO: 1077217 - RNA, 16 nt, Homo sapiens
ugaaggagaaaaugca

SEQ ID NO: 1077218 - RNA, 13 nt, Homo sapiens
ugaauaagcacuu

SEQ ID NO: 1077219 - RNA, 13 nt, Homo sapiens
ugaauaaugauuu

SEQ ID NO: 1077220 - RNA, 19 nt, Homo sapiens
ugaaugccggggacagaga

SEQ ID NO: 1077221 - RNA, 17 nt, Homo sapiens
ugaaugucuuacuguga

SEQ ID NO: 1077222 - RNA, 18 nt, Homo sapiens
ugaauuuggccagacaca

SEQ ID NO: 1077223 - RNA, 20 nt, Homo sapiens
ugacacgugauggaccaaag

SEQ ID NO: 1077224 - RNA, 21 nt, Homo sapiens
ugacacgugauggaccaaagc

SEQ ID NO: 1077225 - RNA, 13 nt, Homo sapiens
ugacacugugacc

SEQ ID NO: 1077226 - RNA, 15 nt, Homo sapiens
ugaccagcucucuuc

SEQ ID NO: 1077227 - RNA, 13 nt, Homo sapiens
ugacccaaagacc

SEQ ID NO: 1077228 - RNA, 15 nt, Homo sapiens
ugacccaaagaccaa

SEQ ID NO: 1077229 - RNA, 21 nt, Homo sapiens
ugaccugugauauuuuacuug

SEQ ID NO: 1077230 - RNA, 23 nt, Homo sapiens
ugacgugcaccuguacucaggag

SEQ ID NO: 1077231 - RNA, 15 nt, Homo sapiens
ugacugaaacauuca

SEQ ID NO: 1077232 - RNA, 17 nt, Homo sapiens
ugacuuuuuagaugugc

SEQ ID NO: 1077233 - RNA, 13 nt, Homo sapiens
ugagaaccaaaag

SEQ ID NO: 1077234 - RNA, 22 nt, Homo sapiens
ugagagccagaugccuccccaa

SEQ ID NO: 1077235 - RNA, 16 nt, Homo sapiens
ugagcauuagcuacuu

SEQ ID NO: 1077236 - RNA, 16 nt, Homo sapiens
ugagcucugacagugu

SEQ ID NO: 1077237 - RNA, 18 nt, Homo sapiens
ugaggugcgcucaccuca

SEQ ID NO: 1077238 - RNA, 15 nt, Homo sapiens
ugaguuucucuccac

SEQ ID NO: 1077239 - RNA, 19 nt, Homo sapiens
ugauccugcuccagcagca

SEQ ID NO: 1077240 - RNA, 16 nt, Homo sapiens
ugaucuuggcacaaau

SEQ ID NO: 1077241 - RNA, 18 nt, Homo sapiens
ugaugaggccucuuggac

SEQ ID NO: 1077242 - RNA, 23 nt, Homo sapiens
ugaugaggccucuuggaccucug

SEQ ID NO: 1077243 - RNA, 13 nt, Homo sapiens
ugaugaugucucu

SEQ ID NO: 1077244 - RNA, 20 nt, Homo sapiens
ugauggcagaacgaugccug

SEQ ID NO: 1077245 - RNA, 11 nt, Homo sapiens
uuacugugauc

SEQ ID NO: 1077246 - RNA, 21 nt, Homo sapiens
uuagaugagggugacugucaa

SEQ ID NO: 1077247 - RNA, 19 nt, Homo sapiens
uuauacuguagcugaugaa

SEQ ID NO: 1077248 - RNA, 21 nt, Homo sapiens
uuaucguccagugacuuucag

SEQ ID NO: 1077249 - RNA, 22 nt, Homo sapiens
uuauuaagugccugagacaccc

SEQ ID NO: 1077250 - RNA, 13 nt, Homo sapiens
uuauuccaacucc

SEQ ID NO: 1077251 - RNA, 11 nt, Homo sapiens
uuauuuccaca

SEQ ID NO: 1077252 - RNA, 20 nt, Homo sapiens
uucaaagacagagaagacca

SEQ ID NO: 1077253 - RNA, 16 nt, Homo sapiens
uucaagagauucuugu

SEQ ID NO: 1077254 - RNA, 20 nt, Homo sapiens
uucaauaaagcugcugagaa

SEQ ID NO: 1077255 - RNA, 20 nt, Homo sapiens
uucacacagggcucuuugau

SEQ ID NO: 1077256 - RNA, 13 nt, Homo sapiens
uucaccagcagca

SEQ ID NO: 1077257 - RNA, 13 nt, Homo sapiens
uucaccauucaaa

SEQ ID NO: 1077258 - RNA, 19 nt, Homo sapiens
uucacccggcugggcuccu

SEQ ID NO: 1077259 - RNA, 15 nt, Homo sapiens
uucagagccagugaa

SEQ ID NO: 1077260 - RNA, 19 nt, Homo sapiens
uuccauaaacacccaugaa

SEQ ID NO: 1077261 - RNA, 23 nt, Homo sapiens
uuccgacuugucccucucucagc

SEQ ID NO: 1077262 - RNA, 16 nt, Homo sapiens
uuccucuugcauuuca

SEQ ID NO: 1077263 - RNA, 15 nt, Homo sapiens
uuccuggguccugcc

SEQ ID NO: 1077264 - RNA, 22 nt, Homo sapiens
uuccuguaacacaagccacaga

SEQ ID NO: 1077265 - RNA, 20 nt, Homo sapiens
uucgaaaccuguccauaaag

SEQ ID NO: 1077266 - RNA, 20 nt, Homo sapiens
uucugaaaccaaauguaacu

SEQ ID NO: 1077267 - RNA, 14 nt, Homo sapiens
uucugaccaaaaug

SEQ ID NO: 1077268 - RNA, 18 nt, Homo sapiens
uucuggagucuccagugg

SEQ ID NO: 1077269 - RNA, 23 nt, Homo sapiens
uucuuuacuaaagauaucagagc

SEQ ID NO: 1077270 - RNA, 17 nt, Homo sapiens
uugaaauaccagugaac

SEQ ID NO: 1077271 - RNA, 23 nt, Homo sapiens
uugaaccagaaccagucuuucaa

SEQ ID NO: 1077272 - RNA, 14 nt, Homo sapiens
uugagcccuggacc

SEQ ID NO: 1077273 - RNA, 20 nt, Homo sapiens
aaaaaaguaaguaccacuca

SEQ ID NO: 1077274 - RNA, 23 nt, Homo sapiens
aaaaacucuuuaacuuguaauaa

SEQ ID NO: 1077275 - RNA, 12 nt, Homo sapiens
aaaacacugugu

SEQ ID NO: 1077276 - RNA, 11 nt, Homo sapiens
aaaacauaugc

SEQ ID NO: 1077277 - RNA, 22 nt, Homo sapiens
aaaacauaugcauuaugaaguu

SEQ ID NO: 1077278 - RNA, 19 nt, Homo sapiens
aaaaccucauuuaccauaa

SEQ ID NO: 1077279 - RNA, 20 nt, Homo sapiens
aaaagacauuuuuauuuagu

SEQ ID NO: 1077280 - RNA, 20 nt, Homo sapiens
aaaauucuugggaguguugu

SEQ ID NO: 1077281 - RNA, 20 nt, Homo sapiens
aaacacccaugaaucaaaga

SEQ ID NO: 1077282 - RNA, 19 nt, Homo sapiens
aaacaggucgagcugugcu

SEQ ID NO: 1077283 - RNA, 20 nt, Homo sapiens
aaacaggucgagcugugcuc

SEQ ID NO: 1077284 - RNA, 23 nt, Homo sapiens
aaacauucacacagggcucuuug

SEQ ID NO: 1077285 - RNA, 20 nt, Homo sapiens
aaacuuucuacucauuuuaa

SEQ ID NO: 1077286 - RNA, 15 nt, Homo sapiens
aaagacuacacuguu

SEQ ID NO: 1077287 - RNA, 12 nt, Homo sapiens
aaagcacuguuu

SEQ ID NO: 1077288 - RNA, 16 nt, Homo sapiens
aaagccagcaaagccu

SEQ ID NO: 1077289 - RNA, 19 nt, Homo sapiens
aaagcgagaucccaucucu

SEQ ID NO: 1077290 - RNA, 21 nt, Homo sapiens
aaagcuacaaaaaacugcagu

SEQ ID NO: 1077291 - RNA, 17 nt, Homo sapiens
aaagcucugaacaaaag

SEQ ID NO: 1077292 - RNA, 13 nt, Homo sapiens
aaagcugcuguca

SEQ ID NO: 1077293 - RNA, 15 nt, Homo sapiens
aaaguaagacacaaa

SEQ ID NO: 1077294 - RNA, 15 nt, Homo sapiens
aaaguuuugaugaaa

SEQ ID NO: 1077295 - RNA, 17 nt, Homo sapiens
aaauaccagugaaccaa

SEQ ID NO: 1077296 - RNA, 19 nt, Homo sapiens
aaauaccagugaaccaaag

SEQ ID NO: 1077297 - RNA, 16 nt, Homo sapiens
aaaucacuuuaccugc

SEQ ID NO: 1077298 - RNA, 16 nt, Homo sapiens
aaaugaugccacuucc

SEQ ID NO: 1077299 - RNA, 17 nt, Homo sapiens
aaauguggacaucauga

SEQ ID NO: 1077300 - RNA, 14 nt, Homo sapiens
aaauucaaacugcc

SEQ ID NO: 1077301 - RNA, 15 nt, Homo sapiens
aaauuguacauuuga

SEQ ID NO: 1077302 - RNA, 18 nt, Homo sapiens
aaauuuuacugacagaaa

SEQ ID NO: 1077303 - RNA, 11 nt, Homo sapiens
aacaaaaccac

SEQ ID NO: 1077304 - RNA, 15 nt, Homo sapiens
aacacccaugaauca

SEQ ID NO: 1077305 - RNA, 20 nt, Homo sapiens
aacauaaaaucugugaauua

SEQ ID NO: 1077306 - RNA, 18 nt, Homo sapiens
aacaugcaaggcacugac

SEQ ID NO: 1077307 - RNA, 16 nt, Homo sapiens
aacauggcuacuugcu

SEQ ID NO: 1077308 - RNA, 20 nt, Homo sapiens
aacauucacacagggcucuu

SEQ ID NO: 1077309 - RNA, 17 nt, Homo sapiens
acuuuuuagccagugac

SEQ ID NO: 1077310 - RNA, 19 nt, Homo sapiens
agaaacacucuuauuccca

SEQ ID NO: 1077311 - RNA, 21 nt, Homo sapiens
agaagauaauguucuuuaaug

SEQ ID NO: 1077312 - RNA, 22 nt, Homo sapiens
agaaggcaugaaauugucuagc

SEQ ID NO: 1077313 - RNA, 17 nt, Homo sapiens
agaaggccaagaaucaa

SEQ ID NO: 1077314 - RNA, 14 nt, Homo sapiens
agaagucucccugc

SEQ ID NO: 1077315 - RNA, 13 nt, Homo sapiens
agaaucuagccuc

SEQ ID NO: 1077316 - RNA, 14 nt, Homo sapiens
agaaugacuuuuau

SEQ ID NO: 1077317 - RNA, 16 nt, Homo sapiens
agaauggaauuuugcu

SEQ ID NO: 1077318 - RNA, 23 nt, Homo sapiens
agaauuauuuuuaagugguuuua

SEQ ID NO: 1077319 - RNA, 17 nt, Homo sapiens
agacaggaaaaagacua

SEQ ID NO: 1077320 - RNA, 21 nt, Homo sapiens
agacaggaaaaagacuaagcc

SEQ ID NO: 1077321 - RNA, 18 nt, Homo sapiens
agaccaaagcauugccug

SEQ ID NO: 1077322 - RNA, 13 nt, Homo sapiens
agaccaccucuca

SEQ ID NO: 1077323 - RNA, 18 nt, Homo sapiens
agaccaccucucaauauu

SEQ ID NO: 1077324 - RNA, 13 nt, Homo sapiens
agaccccaucucu

SEQ ID NO: 1077325 - RNA, 22 nt, Homo sapiens
agacuauaagcagaagcacaua

SEQ ID NO: 1077326 - RNA, 19 nt, Homo sapiens
agacugcugggacuggcca

SEQ ID NO: 1077327 - RNA, 17 nt, Homo sapiens
agacuuacuuacuccca

SEQ ID NO: 1077328 - RNA, 21 nt, Homo sapiens
agacuuuuaaaagacuuguua

SEQ ID NO: 1077329 - RNA, 13 nt, Homo sapiens
agagacuggagca

SEQ ID NO: 1077330 - RNA, 16 nt, Homo sapiens
agagauucuugugccu

SEQ ID NO: 1077331 - RNA, 24 nt, Homo sapiens
agagccuugucuucuuagcuguca

SEQ ID NO: 1077332 - RNA, 20 nt, Homo sapiens
agagcuccugucccuaccca

SEQ ID NO: 1077333 - RNA, 21 nt, Homo sapiens
agaggucucagguucuuucca

SEQ ID NO: 1077334 - RNA, 20 nt, Homo sapiens
agagugagacccugucucaa

SEQ ID NO: 1077335 - RNA, 12 nt, Homo sapiens
agaguggugggg

SEQ ID NO: 1077336 - RNA, 17 nt, Homo sapiens
agauaucagagcucuua

SEQ ID NO: 1077337 - RNA, 17 nt, Homo sapiens
agaucacgccacugcac

SEQ ID NO: 1077338 - RNA, 16 nt, Homo sapiens
agaugagggugacugu

SEQ ID NO: 1077339 - RNA, 15 nt, Homo sapiens
agaugggugucacuu

SEQ ID NO: 1077340 - RNA, 20 nt, Homo sapiens
agauguacuauaacauagaa

SEQ ID NO: 1077341 - RNA, 15 nt, Homo sapiens
agcagaagcacauau

SEQ ID NO: 1077342 - RNA, 16 nt, Homo sapiens
agcagguggcaucucu

SEQ ID NO: 1077343 - RNA, 13 nt, Homo sapiens
agcaucugacuca

SEQ ID NO: 1077344 - RNA, 16 nt, Homo sapiens
agccaacuuuaauugc

SEQ ID NO: 1077345 - RNA, 18 nt, Homo sapiens
agccaacuuuaauugcuu

SEQ ID NO: 1077346 - RNA, 15 nt, Homo sapiens
agccacagaagccag

SEQ ID NO: 1077347 - RNA, 22 nt, Homo sapiens
agccagcaaagccuccagcauc

SEQ ID NO: 1077348 - RNA, 18 nt, Homo sapiens
agccagguuagccuuugc

SEQ ID NO: 1077349 - RNA, 13 nt, Homo sapiens
agccagucaggca

SEQ ID NO: 1077350 - RNA, 19 nt, Homo sapiens
agccagucugcgucaggca

SEQ ID NO: 1077351 - RNA, 19 nt, Homo sapiens
agccaucaccuaggacuga

SEQ ID NO: 1077352 - RNA, 12 nt, Homo sapiens
agccccacugac

SEQ ID NO: 1077353 - RNA, 20 nt, Homo sapiens
agccgagauugcgccacugc

SEQ ID NO: 1077354 - RNA, 17 nt, Homo sapiens
agccucccucugaccug

SEQ ID NO: 1077355 - RNA, 21 nt, Homo sapiens
agccuccuugccuggaacuca

SEQ ID NO: 1077356 - RNA, 14 nt, Homo sapiens
agccucugcugcca

SEQ ID NO: 1077357 - RNA, 16 nt, Homo sapiens
agcgagcuaugaucgc

SEQ ID NO: 1077358 - RNA, 18 nt, Homo sapiens
agcuacuugggaggcuga

SEQ ID NO: 1077359 - RNA, 12 nt, Homo sapiens
agcuagaaggcc

SEQ ID NO: 1077360 - RNA, 16 nt, Homo sapiens
agcuaugaucgcgcca

SEQ ID NO: 1077361 - RNA, 15 nt, Homo sapiens
agcucuggaccagcc

SEQ ID NO: 1077362 - RNA, 18 nt, Homo sapiens
agcucuuguuccgugcca

SEQ ID NO: 1077363 - RNA, 21 nt, Homo sapiens
agcucuuguuccgugccaggc

SEQ ID NO: 1077364 - RNA, 13 nt, Homo sapiens
agcugcaccugcc

SEQ ID NO: 1077365 - RNA, 14 nt, Homo sapiens
agcugcucccaaug

SEQ ID NO: 1077366 - RNA, 13 nt, Homo sapiens
agcugcugucacu

SEQ ID NO: 1077367 - RNA, 14 nt, Homo sapiens
agcugggcaugcca

SEQ ID NO: 1077368 - RNA, 19 nt, Homo sapiens
agcuguuggauuucaguga

SEQ ID NO: 1077369 - RNA, 13 nt, Homo sapiens
agcuuucucaggg

SEQ ID NO: 1077370 - RNA, 12 nt, Homo sapiens
aggaaagggauu

SEQ ID NO: 1077371 - RNA, 15 nt, Homo sapiens
aggaacugagccaga

SEQ ID NO: 1077372 - RNA, 17 nt, Homo sapiens
aggacaccagccuggug

SEQ ID NO: 1077373 - RNA, 15 nt, Homo sapiens
aggagaaggggccca

SEQ ID NO: 1077374 - RNA, 20 nt, Homo sapiens
aggagaucgagaccauccug

SEQ ID NO: 1077375 - RNA, 10 nt, Homo sapiens
aggagccauu

SEQ ID NO: 1077376 - RNA, 19 nt, Homo sapiens
aggaggcuuggaaagcauc

SEQ ID NO: 1077377 - RNA, 22 nt, Homo sapiens
aggagggaugcugccugaguca

SEQ ID NO: 1077378 - RNA, 20 nt, Homo sapiens
aggagguggagguugcagug

SEQ ID NO: 1077379 - RNA, 14 nt, Homo sapiens
aggauaacuuccuu

SEQ ID NO: 1077380 - RNA, 20 nt, Homo sapiens
aggccaggugcaguggcuca

SEQ ID NO: 1077381 - RNA, 20 nt, Homo sapiens
aggccgggcgcaguggcuca

SEQ ID NO: 1077382 - RNA, 18 nt, Homo sapiens
aggccugauucacuggcc

SEQ ID NO: 1077383 - RNA, 20 nt, Homo sapiens
aggcugcagcgagcuaugau

SEQ ID NO: 1077384 - RNA, 16 nt, Homo sapiens
aggcuggagacaggug

SEQ ID NO: 1077385 - RNA, 15 nt, Homo sapiens
aggcugggaagggga

SEQ ID NO: 1077386 - RNA, 22 nt, Homo sapiens
aggcugggaaggggaacacaga

SEQ ID NO: 1077387 - RNA, 20 nt, Homo sapiens
aggcuuuuaagaaacacagg

SEQ ID NO: 1077388 - RNA, 17 nt, Homo sapiens
agggaugcugccugagu

SEQ ID NO: 1077389 - RNA, 13 nt, Homo sapiens
agggcuccuccau

SEQ ID NO: 1077390 - RNA, 14 nt, Homo sapiens
agggcucuuugaug

SEQ ID NO: 1077391 - RNA, 17 nt, Homo sapiens
aggggccugcaggugag

SEQ ID NO: 1077392 - RNA, 22 nt, Homo sapiens
aggguacacauucgcaccccua

SEQ ID NO: 1077393 - RNA, 19 nt, Homo sapiens
agguccccguggauggucu

SEQ ID NO: 1077394 - RNA, 16 nt, Homo sapiens
agguggaggugccagg

SEQ ID NO: 1077395 - RNA, 18 nt, Homo sapiens
agguugcagugagccaaa

SEQ ID NO: 1077396 - RNA, 20 nt, Homo sapiens
agguugcagugagccaugau

SEQ ID NO: 1077397 - RNA, 21 nt, Homo sapiens
agucacugucccucaaaugac

SEQ ID NO: 1077398 - RNA, 15 nt, Homo sapiens
aguccagcuuuccuu

SEQ ID NO: 1077399 - RNA, 12 nt, Homo sapiens
agucuccagugg

SEQ ID NO: 1077400 - RNA, 13 nt, Homo sapiens
agugaaccaaaga

SEQ ID NO: 1077401 - RNA, 13 nt, Homo sapiens
agugagacccugu

SEQ ID NO: 1077402 - RNA, 23 nt, Homo sapiens
agugauugugucugcauuguuau

SEQ ID NO: 1077403 - RNA, 18 nt, Homo sapiens
agugcagggaaccgugau

SEQ ID NO: 1077404 - RNA, 23 nt, Homo sapiens
agugcaguggugcgaucuuggcu

SEQ ID NO: 1077405 - RNA, 16 nt, Homo sapiens
agugcuuccacuucua

SEQ ID NO: 1077406 - RNA, 16 nt, Homo sapiens
aguguagccuugcccg

SEQ ID NO: 1077407 - RNA, 23 nt, Homo sapiens
aguguccagaccauugucuucca

SEQ ID NO: 1077408 - RNA, 12 nt, Homo sapiens
agugugauccca

SEQ ID NO: 1077409 - RNA, 20 nt, Homo sapiens
aguguuugaagucugcucau

SEQ ID NO: 1077410 - RNA, 14 nt, Homo sapiens
aguuauucucuaag

SEQ ID NO: 1077411 - RNA, 23 nt, Homo sapiens
aguucagaguuguacacugugua

SEQ ID NO: 1077412 - RNA, 20 nt, Homo sapiens
aguuccagauuguucugucc

SEQ ID NO: 1077413 - RNA, 21 nt, Homo sapiens
aguuccagauuguucugucca

SEQ ID NO: 1077414 - RNA, 13 nt, Homo sapiens
aguuggagaccag

SEQ ID NO: 1077415 - RNA, 14 nt, Homo sapiens
aguuguacacugug

SEQ ID NO: 1077416 - RNA, 19 nt, Homo sapiens
aguuuauuggaaguguuca

SEQ ID NO: 1077417 - RNA, 15 nt, Homo sapiens
auaaaaauaccucuu

SEQ ID NO: 1077418 - RNA, 18 nt, Homo sapiens
auaaacacccaugaauca

SEQ ID NO: 1077419 - RNA, 18 nt, Homo sapiens
aauaucugagaaguguau

SEQ ID NO: 1077420 - RNA, 11 nt, Homo sapiens
aauauucaaua

SEQ ID NO: 1077421 - RNA, 17 nt, Homo sapiens
aauauuuaaacuucuug

SEQ ID NO: 1077422 - RNA, 14 nt, Homo sapiens
aauccaacccuguc

SEQ ID NO: 1077423 - RNA, 15 nt, Homo sapiens
aaucccagcacuuug

SEQ ID NO: 1077424 - RNA, 14 nt, Homo sapiens
aaucucuaagccaa

SEQ ID NO: 1077425 - RNA, 14 nt, Homo sapiens
aaugacccaaagac

SEQ ID NO: 1077426 - RNA, 19 nt, Homo sapiens
aaugacuuuuauugagcuc

SEQ ID NO: 1077427 - RNA, 16 nt, Homo sapiens
aaugucuuacugugau

SEQ ID NO: 1077428 - RNA, 17 nt, Homo sapiens
aaugucuuacugugauc

SEQ ID NO: 1077429 - RNA, 15 nt, Homo sapiens
aauguuguccaggaa

SEQ ID NO: 1077430 - RNA, 19 nt, Homo sapiens
aauuaauaauagauuguga

SEQ ID NO: 1077431 - RNA, 15 nt, Homo sapiens
aauuaugagucucua

SEQ ID NO: 1077432 - RNA, 10 nt, Homo sapiens
aauuccuguu

SEQ ID NO: 1077433 - RNA, 19 nt, Homo sapiens
aauucuccuguugcaauga

SEQ ID NO: 1077434 - RNA, 18 nt, Homo sapiens
aauuuggagacucugugg

SEQ ID NO: 1077435 - RNA, 13 nt, Homo sapiens
aauuuugcuacau

SEQ ID NO: 1077436 - RNA, 17 nt, Homo sapiens
aauuuuugaucaaugua

SEQ ID NO: 1077437 - RNA, 14 nt, Homo sapiens
acaaacguuguccu

SEQ ID NO: 1077438 - RNA, 19 nt, Homo sapiens
acaaauaauaaauguucuc

SEQ ID NO: 1077439 - RNA, 20 nt, Homo sapiens
acaagccaacgacaaagcca

SEQ ID NO: 1077440 - RNA, 22 nt, Homo sapiens
acaauaaaugcugaaugaaucc

SEQ ID NO: 1077441 - RNA, 13 nt, Homo sapiens
acaaugugacuuu

SEQ ID NO: 1077442 - RNA, 15 nt, Homo sapiens
acacagggcucuuug

SEQ ID NO: 1077443 - RNA, 20 nt, Homo sapiens
acaccuccauuucucuccag

SEQ ID NO: 1077444 - RNA, 18 nt, Homo sapiens
acagaauaauguguuaaa

SEQ ID NO: 1077445 - RNA, 17 nt, Homo sapiens
acagagaagaccaaagc

SEQ ID NO: 1077446 - RNA, 17 nt, Homo sapiens
acagcucuucucagugu

SEQ ID NO: 1077447 - RNA, 21 nt, Homo sapiens
acaggguuuuguauucuuuac

SEQ ID NO: 1077448 - RNA, 21 nt, Homo sapiens
acagugcccaugcaauggcuu

SEQ ID NO: 1077449 - RNA, 20 nt, Homo sapiens
acaguuuagugcuuuacaug

SEQ ID NO: 1077450 - RNA, 24 nt, Homo sapiens
acaguuuugaaagaaaaauaccau

SEQ ID NO: 1077451 - RNA, 15 nt, Homo sapiens
acaugcugugcucuu

SEQ ID NO: 1077452 - RNA, 21 nt, Homo sapiens
acauggggucugggugggggc

SEQ ID NO: 1077453 - RNA, 19 nt, Homo sapiens
acauucacacagggcucuu

SEQ ID NO: 1077454 - RNA, 20 nt, Homo sapiens
acauuuuuauuuaguugaaa

SEQ ID NO: 1077455 - RNA, 22 nt, Homo sapiens
accaaagacgauacagcuuggc

SEQ ID NO: 1077456 - RNA, 14 nt, Homo sapiens
accaaagagacugg

SEQ ID NO: 1077457 - RNA, 16 nt, Homo sapiens
accaccccuuccuguc

SEQ ID NO: 1077458 - RNA, 18 nt, Homo sapiens
accagagggggcgugccu

SEQ ID NO: 1077459 - RNA, 13 nt, Homo sapiens
accagucacuguc

SEQ ID NO: 1077460 - RNA, 17 nt, Homo sapiens
accagugaaccaaagag

SEQ ID NO: 1077461 - RNA, 23 nt, Homo sapiens
accagugaaccaaagagacugga

SEQ ID NO: 1077462 - RNA, 20 nt, Homo sapiens
accauaaaaauccuucucac

SEQ ID NO: 1077463 - RNA, 12 nt, Homo sapiens
accaugcauggu

SEQ ID NO: 1077464 - RNA, 12 nt, Homo sapiens
acccaaagacca

SEQ ID NO: 1077465 - RNA, 21 nt, Homo sapiens
acccacccagugucuuucgag

SEQ ID NO: 1077466 - RNA, 22 nt, Homo sapiens
acccaggccugauucacuggcc

SEQ ID NO: 1077467 - RNA, 15 nt, Homo sapiens
acccaguguccuucc

SEQ ID NO: 1077468 - RNA, 17 nt, Homo sapiens
acccaugaaucaaagac

SEQ ID NO: 1077469 - RNA, 15 nt, Homo sapiens
acccaugccauagaa

SEQ ID NO: 1077470 - RNA, 11 nt, Homo sapiens
accccaucucu

SEQ ID NO: 1077471 - RNA, 15 nt, Homo sapiens
accccaucucuacua

SEQ ID NO: 1077472 - RNA, 17 nt, Homo sapiens
acccgcuccacuacccg

SEQ ID NO: 1077473 - RNA, 16 nt, Homo sapiens
acccgcucuggaccaa

SEQ ID NO: 1077474 - RNA, 15 nt, Homo sapiens
acccuaaauguggac

SEQ ID NO: 1077475 - RNA, 22 nt, Homo sapiens
acccuauaucuauaaacacugu

SEQ ID NO: 1077476 - RNA, 23 nt, Homo sapiens
accgauuugcacccaugccauag

SEQ ID NO: 1077477 - RNA, 18 nt, Homo sapiens
accgggacuucaaagccg

SEQ ID NO: 1077478 - RNA, 17 nt, Homo sapiens
accucagccccacugac

SEQ ID NO: 1077479 - RNA, 13 nt, Homo sapiens
accuccuuggcac

SEQ ID NO: 1077480 - RNA, 20 nt, Homo sapiens
accucuucuaugcaagccuu

SEQ ID NO: 1077481 - RNA, 19 nt, Homo sapiens
accucuucucuuccuguaa

SEQ ID NO: 1077482 - RNA, 13 nt, Homo sapiens
accugcaggccaa

SEQ ID NO: 1077483 - RNA, 21 nt, Homo sapiens
accugcaggcuuagguccuca

SEQ ID NO: 1077484 - RNA, 22 nt, Homo sapiens
accugcugcgggggagccaguu

SEQ ID NO: 1077485 - RNA, 17 nt, Homo sapiens
accugugcuuggaacca

SEQ ID NO: 1077486 - RNA, 23 nt, Homo sapiens
accugugucuuauagguuuccac

SEQ ID NO: 1077487 - RNA, 13 nt, Homo sapiens
accuguuacuuga

SEQ ID NO: 1077488 - RNA, 20 nt, Homo sapiens
accuguuacuugaaauacca

SEQ ID NO: 1077489 - RNA, 19 nt, Homo sapiens
accuuagauuagcucugga

SEQ ID NO: 1077490 - RNA, 15 nt, Homo sapiens
accuucaauuccugg

SEQ ID NO: 1077491 - RNA, 12 nt, Homo sapiens
acgaacuggacu

SEQ ID NO: 1077492 - RNA, 22 nt, Homo sapiens
acgacaaagccaaacucugcca

SEQ ID NO: 1077493 - RNA, 17 nt, Homo sapiens
acgauacagcuuggcac

SEQ ID NO: 1077494 - RNA, 19 nt, Homo sapiens
acgaugccugcaggcaugg

SEQ ID NO: 1077495 - RNA, 21 nt, Homo sapiens
acgccuguaaucccagcacuu

SEQ ID NO: 1077496 - RNA, 22 nt, Homo sapiens
acggcccuccugggaaccuccu

SEQ ID NO: 1077497 - RNA, 16 nt, Homo sapiens
acgugauggaccaaag

SEQ ID NO: 1077498 - RNA, 20 nt, Homo sapiens
acgugauggaccaaagccac

SEQ ID NO: 1077499 - RNA, 12 nt, Homo sapiens
acuaaacucuga

SEQ ID NO: 1077500 - RNA, 14 nt, Homo sapiens
acuaaacucugaau

SEQ ID NO: 1077501 - RNA, 14 nt, Homo sapiens
acuaaagauaucag

SEQ ID NO: 1077502 - RNA, 21 nt, Homo sapiens
acuaagccagacgugguggcu

SEQ ID NO: 1077503 - RNA, 12 nt, Homo sapiens
acuaagcucucu

SEQ ID NO: 1077504 - RNA, 18 nt, Homo sapiens
acuaccaaaugagcauua

SEQ ID NO: 1077505 - RNA, 15 nt, Homo sapiens
acuaggacucugagg

SEQ ID NO: 1077506 - RNA, 22 nt, Homo sapiens
acuccucagaucugaacacagu

SEQ ID NO: 1077507 - RNA, 16 nt, Homo sapiens
acuccugccaguugaa

SEQ ID NO: 1077508 - RNA, 22 nt, Homo sapiens
acucugaaaaacauuccaggaa

SEQ ID NO: 1077509 - RNA, 23 nt, Homo sapiens
acucugaggcucuuucugggcca

SEQ ID NO: 1077510 - RNA, 16 nt, Homo sapiens
acucugcucuaugcca

SEQ ID NO: 1077511 - RNA, 15 nt, Homo sapiens
acugaaacauucaca

SEQ ID NO: 1077512 - RNA, 14 nt, Homo sapiens
acugacacccagug

SEQ ID NO: 1077513 - RNA, 13 nt, Homo sapiens
acugagcaugcag

SEQ ID NO: 1077514 - RNA, 20 nt, Homo sapiens
acugauguccggagagacag

SEQ ID NO: 1077515 - RNA, 13 nt, Homo sapiens
acuggacugugug

SEQ ID NO: 1077516 - RNA, 20 nt, Homo sapiens
acuggacuugagcuuggcag

SEQ ID NO: 1077517 - RNA, 19 nt, Homo sapiens
acuggagcaucugacucac

SEQ ID NO: 1077518 - RNA, 18 nt, Homo sapiens
acugguuugccaggccaa

SEQ ID NO: 1077519 - RNA, 15 nt, Homo sapiens
acugucucagccaac

SEQ ID NO: 1077520 - RNA, 14 nt, Homo sapiens
acugugaccaaagc

SEQ ID NO: 1077521 - RNA, 20 nt, Homo sapiens
acuuacccuaaaacaugugu

SEQ ID NO: 1077522 - RNA, 17 nt, Homo sapiens
acuugaaauaccaguga

SEQ ID NO: 1077523 - RNA, 20 nt, Homo sapiens
acuugggaggcugagccagg

SEQ ID NO: 1077524 - RNA, 22 nt, Homo sapiens
acuugguuuuuggcucuuucag

SEQ ID NO: 1077525 - RNA, 17 nt, Homo sapiens
acuuugguacauggcca

SEQ ID NO: 1077526 - RNA, 22 nt, Homo sapiens
acuuuucacauccuugacuuuu

SEQ ID NO: 1077527 - RNA, 18 nt, Homo sapiens
acuuuuccauugaccagc

SEQ ID NO: 1077528 - RNA, 19 nt, Homo sapiens
acuuuuccauugaccagcu

SEQ ID NO: 1077529 - RNA, 14 nt, Homo sapiens
ccaagccauucacu

SEQ ID NO: 1077530 - RNA, 11 nt, Homo sapiens
ccaccuaccca

SEQ ID NO: 1077531 - RNA, 15 nt, Homo sapiens
ccacucuuugcuaca

SEQ ID NO: 1077532 - RNA, 12 nt, Homo sapiens
ccagcacuuugg

SEQ ID NO: 1077533 - RNA, 15 nt, Homo sapiens
ccagccuggccaaca

SEQ ID NO: 1077534 - RNA, 20 nt, Homo sapiens
ccagccugggcaacauagua

SEQ ID NO: 1077535 - RNA, 21 nt, Homo sapiens
ccagcuacucgggaggcugag

SEQ ID NO: 1077536 - RNA, 21 nt, Homo sapiens
ccagcuauuuucugaccaaaa

SEQ ID NO: 1077537 - RNA, 16 nt, Homo sapiens
ccaggccugagcaaca

SEQ ID NO: 1077538 - RNA, 17 nt, Homo sapiens
ccaggcuggagugcagu

SEQ ID NO: 1077539 - RNA, 16 nt, Homo sapiens
ccagggguucugagaa

SEQ ID NO: 1077540 - RNA, 14 nt, Homo sapiens
ccagguuagccuuu

SEQ ID NO: 1077541 - RNA, 14 nt, Homo sapiens
ccagugaaccaaag

SEQ ID NO: 1077542 - RNA, 17 nt, Homo sapiens
ccagugaaccaaagaga

SEQ ID NO: 1077543 - RNA, 11 nt, Homo sapiens
ccaguuuccaa

SEQ ID NO: 1077544 - RNA, 23 nt, Homo sapiens
ccauaaacacccaugaaucaaag

SEQ ID NO: 1077545 - RNA, 15 nt, Homo sapiens
ccaugaaucaaagac

SEQ ID NO: 1077546 - RNA, 23 nt, Homo sapiens
ccauuauuucaaccgcuugccau

SEQ ID NO: 1077547 - RNA, 17 nt, Homo sapiens
ccauucugugugugacu

SEQ ID NO: 1077548 - RNA, 22 nt, Homo sapiens
ccauugucgucuuuauguccgc

SEQ ID NO: 1077549 - RNA, 14 nt, Homo sapiens
cccacuggccaguc

SEQ ID NO: 1077550 - RNA, 20 nt, Homo sapiens
cccagagaagcaaguggcuu

SEQ ID NO: 1077551 - RNA, 17 nt, Homo sapiens
cccagcaccugcuccca

SEQ ID NO: 1077552 - RNA, 13 nt, Homo sapiens
cccagcacuuugg

SEQ ID NO: 1077553 - RNA, 16 nt, Homo sapiens
cccaggccucccugca

SEQ ID NO: 1077554 - RNA, 15 nt, Homo sapiens
cccagggacaaaaca

SEQ ID NO: 1077555 - RNA, 15 nt, Homo sapiens
cccagguguggcugu

SEQ ID NO: 1077556 - RNA, 15 nt, Homo sapiens
cccaguguccuucca

SEQ ID NO: 1077557 - RNA, 22 nt, Homo sapiens
ccccacugacacccaguguccu

SEQ ID NO: 1077558 - RNA, 15 nt, Homo sapiens
ccccaucauugcacc

SEQ ID NO: 1077559 - RNA, 13 nt, Homo sapiens
cccuaaucuuuuc

SEQ ID NO: 1077560 - RNA, 14 nt, Homo sapiens
cccuacccacuucc

SEQ ID NO: 1077561 - RNA, 22 nt, Homo sapiens
ccgggaagcggagguugcaggg

SEQ ID NO: 1077562 - RNA, 14 nt, Homo sapiens
ccuacccacuucca

SEQ ID NO: 1077563 - RNA, 18 nt, Homo sapiens
ccuagaagucucccugca

SEQ ID NO: 1077564 - RNA, 18 nt, Homo sapiens
ccuauaucuauaaacacu

SEQ ID NO: 1077565 - RNA, 17 nt, Homo sapiens
ccucaaaugacccaaag

SEQ ID NO: 1077566 - RNA, 18 nt, Homo sapiens
ccucaaaugacccaaaga

SEQ ID NO: 1077567 - RNA, 22 nt, Homo sapiens
ccucaaaugacccaaagaccaa

SEQ ID NO: 1077568 - RNA, 19 nt, Homo sapiens
ccucaggccaggugcagug

SEQ ID NO: 1077569 - RNA, 14 nt, Homo sapiens
ccucauuuaccaua

SEQ ID NO: 1077570 - RNA, 12 nt, Homo sapiens
ccuccagccuuc

SEQ ID NO: 1077571 - RNA, 20 nt, Homo sapiens
ccuccauuucucuccaggaa

SEQ ID NO: 1077572 - RNA, 17 nt, Homo sapiens
ccucccaggaaccaaaa

SEQ ID NO: 1077573 - RNA, 14 nt, Homo sapiens
ccucugaaaugccu

SEQ ID NO: 1077574 - RNA, 20 nt, Homo sapiens
ccugacacgugauggaccaa

SEQ ID NO: 1077575 - RNA, 23 nt, Homo sapiens
ccugacacgugauggaccaaagc

SEQ ID NO: 1077576 - RNA, 20 nt, Homo sapiens
uugcccauuguuuuucugau

SEQ ID NO: 1077577 - RNA, 19 nt, Homo sapiens
uugcccccguggggcuccc

SEQ ID NO: 1077578 - RNA, 17 nt, Homo sapiens
uugcucuguuucuuccu

SEQ ID NO: 1077579 - RNA, 14 nt, Homo sapiens
uuggaauacuugaa

SEQ ID NO: 1077580 - RNA, 16 nt, Homo sapiens
uuggcccucacugcag

SEQ ID NO: 1077581 - RNA, 18 nt, Homo sapiens
uuguacaaagauaugcua

SEQ ID NO: 1077582 - RNA, 23 nt, Homo sapiens
uugugaaagaaggagcaagagaa

SEQ ID NO: 1077583 - RNA, 14 nt, Homo sapiens
uuuaaaacaugcac

SEQ ID NO: 1077584 - RNA, 15 nt, Homo sapiens
uuuaaauuauacugu

SEQ ID NO: 1077585 - RNA, 19 nt, Homo sapiens
uuuacuuauaccucucuca

SEQ ID NO: 1077586 - RNA, 14 nt, Homo sapiens
uuuagccagugacu

SEQ ID NO: 1077587 - RNA, 16 nt, Homo sapiens
uuuagccagugacuuu

SEQ ID NO: 1077588 - RNA, 13 nt, Homo sapiens
uuuauucagugac

SEQ ID NO: 1077589 - RNA, 12 nt, Homo sapiens
uuuauuuccaca

SEQ ID NO: 1077590 - RNA, 15 nt, Homo sapiens
uuuccacugccaaaa

SEQ ID NO: 1077591 - RNA, 21 nt, Homo sapiens
uuuccacugccaaaacaaugc

SEQ ID NO: 1077592 - RNA, 14 nt, Homo sapiens
uuucccacacccca

SEQ ID NO: 1077593 - RNA, 18 nt, Homo sapiens
uuuccccaggagcagaag

SEQ ID NO: 1077594 - RNA, 18 nt, Homo sapiens
uuuccucuugaaccagaa

SEQ ID NO: 1077595 - RNA, 13 nt, Homo sapiens
uuucugaccaaaa

SEQ ID NO: 1077596 - RNA, 14 nt, Homo sapiens
uuucugaccaaaau

SEQ ID NO: 1077597 - RNA, 18 nt, Homo sapiens
uuucuggauggcaucuag

SEQ ID NO: 1077598 - RNA, 21 nt, Homo sapiens
uuucuggauggcaucuagcca

SEQ ID NO: 1077599 - RNA, 18 nt, Homo sapiens
uuugaggcucaccagaau

SEQ ID NO: 1077600 - RNA, 18 nt, Homo sapiens
uuugcaacaagacaaagc

SEQ ID NO: 1077601 - RNA, 16 nt, Homo sapiens
uuugcacccaugccau

SEQ ID NO: 1077602 - RNA, 13 nt, Homo sapiens
uuuguucagagag

SEQ ID NO: 1077603 - RNA, 19 nt, Homo sapiens
uuuuacccuauaucuauaa

SEQ ID NO: 1077604 - RNA, 16 nt, Homo sapiens
uuuuagugacuguaau

SEQ ID NO: 1077605 - RNA, 12 nt, Homo sapiens
uuuuugaucaau

SEQ ID NO: 1077606 - RNA, 23 nt, Homo sapiens
auaaacacccaugaaucaaagac

SEQ ID NO: 1077607 - RNA, 19 nt, Homo sapiens
auaaacacuguuuguucca

SEQ ID NO: 1077608 - RNA, 15 nt, Homo sapiens
auaaaucaguuaugu

SEQ ID NO: 1077609 - RNA, 13 nt, Homo sapiens
auaaauguuuaaa

SEQ ID NO: 1077610 - RNA, 16 nt, Homo sapiens
auacagcucuucucag

SEQ ID NO: 1077611 - RNA, 19 nt, Homo sapiens
auaccagugaaccaaagag

SEQ ID NO: 1077612 - RNA, 19 nt, Homo sapiens
auacuuuuuucuaguuuca

SEQ ID NO: 1077613 - RNA, 13 nt, Homo sapiens
auagaauugcaau

SEQ ID NO: 1077614 - RNA, 15 nt, Homo sapiens
auagauuaaaucaua

SEQ ID NO: 1077615 - RNA, 20 nt, Homo sapiens
auagauugugaauaaugauu

SEQ ID NO: 1077616 - RNA, 12 nt, Homo sapiens
auagguuuccac

SEQ ID NO: 1077617 - RNA, 17 nt, Homo sapiens
auagucccagcuacuca

SEQ ID NO: 1077618 - RNA, 18 nt, Homo sapiens
auauaugacuuuuucuca

SEQ ID NO: 1077619 - RNA, 13 nt, Homo sapiens
auaucagagcucu

SEQ ID NO: 1077620 - RNA, 16 nt, Homo sapiens
auaucgagaacugcca

SEQ ID NO: 1077621 - RNA, 17 nt, Homo sapiens
auauuuauucaucuggg

SEQ ID NO: 1077622 - RNA, 17 nt, Homo sapiens
aucaaaucagucuugga

SEQ ID NO: 1077623 - RNA, 15 nt, Homo sapiens
aucacuuuaccugca

SEQ ID NO: 1077624 - RNA, 19 nt, Homo sapiens
aucauuguagaaacacagu

SEQ ID NO: 1077625 - RNA, 22 nt, Homo sapiens
aucccaggaggggccucugaaa

SEQ ID NO: 1077626 - RNA, 14 nt, Homo sapiens
auccugaaagccag

SEQ ID NO: 1077627 - RNA, 20 nt, Homo sapiens
aucgcugccuugccaugucu

SEQ ID NO: 1077628 - RNA, 16 nt, Homo sapiens
aucgcuuuccuuccuc

SEQ ID NO: 1077629 - RNA, 16 nt, Homo sapiens
aucguuagaggagcaa

SEQ ID NO: 1077630 - RNA, 18 nt, Homo sapiens
aucuauaacuacauauug

SEQ ID NO: 1077631 - RNA, 12 nt, Homo sapiens
aucuauaucucu

SEQ ID NO: 1077632 - RNA, 17 nt, Homo sapiens
aucucacucuguugccc

SEQ ID NO: 1077633 - RNA, 19 nt, Homo sapiens
aucucauuugguacaguca

SEQ ID NO: 1077634 - RNA, 16 nt, Homo sapiens
aucugacucacaagaa

SEQ ID NO: 1077635 - RNA, 22 nt, Homo sapiens
aucuuaauuuuuuuuaauguac

SEQ ID NO: 1077636 - RNA, 15 nt, Homo sapiens
augacccaaagacca

SEQ ID NO: 1077637 - RNA, 16 nt, Homo sapiens
augacccaaagaccaa

SEQ ID NO: 1077638 - RNA, 14 nt, Homo sapiens
augacccacccagu

SEQ ID NO: 1077639 - RNA, 16 nt, Homo sapiens
augacgggaaaaccaa

SEQ ID NO: 1077640 - RNA, 14 nt, Homo sapiens
augagcacuucuaa

SEQ ID NO: 1077641 - RNA, 22 nt, Homo sapiens
augaucgcgccacuacacucca

SEQ ID NO: 1077642 - RNA, 17 nt, Homo sapiens
augcgucccuguacaga

SEQ ID NO: 1077643 - RNA, 15 nt, Homo sapiens
augcugaaugaaucc

SEQ ID NO: 1077644 - RNA, 23 nt, Homo sapiens
augcuguucucuuugcugacacu

SEQ ID NO: 1077645 - RNA, 12 nt, Homo sapiens
auggaccaaagc

SEQ ID NO: 1077646 - RNA, 14 nt, Homo sapiens
auggccucuggcca

SEQ ID NO: 1077647 - RNA, 18 nt, Homo sapiens
auggccucuggccaggca

SEQ ID NO: 1077648 - RNA, 23 nt, Homo sapiens
auggggauaaaggagaaggcaug

SEQ ID NO: 1077649 - RNA, 14 nt, Homo sapiens
auggggucugggug

SEQ ID NO: 1077650 - RNA, 19 nt, Homo sapiens
auggucuccaccugugcuu

SEQ ID NO: 1077651 - RNA, 17 nt, Homo sapiens
auguauauuuuugcuag

SEQ ID NO: 1077652 - RNA, 14 nt, Homo sapiens
augucagacuggcu

SEQ ID NO: 1077653 - RNA, 17 nt, Homo sapiens
augucucuuguagaaga

SEQ ID NO: 1077654 - RNA, 16 nt, Homo sapiens
auguguccuccugcuc

SEQ ID NO: 1077655 - RNA, 12 nt, Homo sapiens
auguuugcacuu

SEQ ID NO: 1077656 - RNA, 18 nt, Homo sapiens
auguuuucuaccagugug

SEQ ID NO: 1077657 - RNA, 20 nt, Homo sapiens
auuaaccugaauuauuccaa

SEQ ID NO: 1077658 - RNA, 16 nt, Homo sapiens
auuaauauuuaugucu

SEQ ID NO: 1077659 - RNA, 16 nt, Homo sapiens
auuagcucuggaccag

SEQ ID NO: 1077660 - RNA, 21 nt, Homo sapiens
auuauucaggcuuuaggcaua

SEQ ID NO: 1077661 - RNA, 13 nt, Homo sapiens
auuauuuugcacu

SEQ ID NO: 1077662 - RNA, 19 nt, Homo sapiens
auucaaccugugucuuaua

SEQ ID NO: 1077663 - RNA, 11 nt, Homo sapiens
auucacuuccc

SEQ ID NO: 1077664 - RNA, 20 nt, Homo sapiens
auucagauuucucuuugaaa

SEQ ID NO: 1077665 - RNA, 24 nt, Homo sapiens
auugaacuuucacauagcacagaa

SEQ ID NO: 1077666 - RNA, 15 nt, Homo sapiens
auugaccagcucucu

SEQ ID NO: 1077667 - RNA, 18 nt, Homo sapiens
auuggcuauaacaugucu

SEQ ID NO: 1077668 - RNA, 16 nt, Homo sapiens
auuguagaaacacagu

SEQ ID NO: 1077669 - RNA, 15 nt, Homo sapiens
auuguccccagggac

SEQ ID NO: 1077670 - RNA, 19 nt, Homo sapiens
auuguuguaaaauguaaag

SEQ ID NO: 1077671 - RNA, 22 nt, Homo sapiens
auuuauucaucugggaggcaga

SEQ ID NO: 1077672 - RNA, 15 nt, Homo sapiens
ucacaagaagaccag

SEQ ID NO: 1077673 - RNA, 16 nt, Homo sapiens
ucacaagaagaccaga

SEQ ID NO: 1077674 - RNA, 18 nt, Homo sapiens
ucacaagaagaccagacu

SEQ ID NO: 1077675 - RNA, 15 nt, Homo sapiens
ucacauccuugacuu

SEQ ID NO: 1077676 - RNA, 15 nt, Homo sapiens
ucaccauucaaacag

SEQ ID NO: 1077677 - RNA, 15 nt, Homo sapiens
ucacugucccucaaa

SEQ ID NO: 1077678 - RNA, 14 nt, Homo sapiens
ucacuucgaugacu

SEQ ID NO: 1077679 - RNA, 19 nt, Homo sapiens
ucacuucgaugacuggaua

SEQ ID NO: 1077680 - RNA, 13 nt, Homo sapiens
ucagaagccaguc

SEQ ID NO: 1077681 - RNA, 17 nt, Homo sapiens
ucagaucugaacacagu

SEQ ID NO: 1077682 - RNA, 21 nt, Homo sapiens
ucagcccagcaccugcuccca

SEQ ID NO: 1077683 - RNA, 19 nt, Homo sapiens
ucaggcacgucuccugcug

SEQ ID NO: 1077684 - RNA, 17 nt, Homo sapiens
ucaggccaacaagccaa

SEQ ID NO: 1077685 - RNA, 18 nt, Homo sapiens
ucaggccaacaagccaac

SEQ ID NO: 1077686 - RNA, 16 nt, Homo sapiens
ucaggccagugcaccc

SEQ ID NO: 1077687 - RNA, 14 nt, Homo sapiens
ucaguaaacacugu

SEQ ID NO: 1077688 - RNA, 15 nt, Homo sapiens
ucauucugaugucca

SEQ ID NO: 1077689 - RNA, 21 nt, Homo sapiens
uccaaccccccaccugccauu

SEQ ID NO: 1077690 - RNA, 22 nt, Homo sapiens
uccaagccauucacuuccccaa

SEQ ID NO: 1077691 - RNA, 22 nt, Homo sapiens
uccaauugaacuuucacauagc

SEQ ID NO: 1077692 - RNA, 14 nt, Homo sapiens
ucccaccacugcac

SEQ ID NO: 1077693 - RNA, 12 nt, Homo sapiens
ucccagcacuuu

SEQ ID NO: 1077694 - RNA, 13 nt, Homo sapiens
ucccagcuacuca

SEQ ID NO: 1077695 - RNA, 23 nt, Homo sapiens
ucccuacccacucuuugcuacaa

SEQ ID NO: 1077696 - RNA, 20 nt, Homo sapiens
ucccugggggcauccugcuu

SEQ ID NO: 1077697 - RNA, 19 nt, Homo sapiens
uccgugccaggcauucaau

SEQ ID NO: 1077698 - RNA, 18 nt, Homo sapiens
uccuaugcuuuagcuuau

SEQ ID NO: 1077699 - RNA, 19 nt, Homo sapiens
uccucuggauggcaccaga

SEQ ID NO: 1077700 - RNA, 16 nt, Homo sapiens
uccucuugaaccagaa

SEQ ID NO: 1077701 - RNA, 12 nt, Homo sapiens
uccugaguuucu

SEQ ID NO: 1077702 - RNA, 18 nt, Homo sapiens
uccuggcuaacacgugaa

SEQ ID NO: 1077703 - RNA, 15 nt, Homo sapiens
uccugucccuaccca

SEQ ID NO: 1077704 - RNA, 13 nt, Homo sapiens
uccuugacuuuuu

SEQ ID NO: 1077705 - RNA, 13 nt, Homo sapiens
ucgauauaugacu

SEQ ID NO: 1077706 - RNA, 22 nt, Homo sapiens
ucgauauaugacuuuuucucag

SEQ ID NO: 1077707 - RNA, 15 nt, Homo sapiens
ucggcagugugcagu

SEQ ID NO: 1077708 - RNA, 19 nt, Homo sapiens
ucgggacagaccagcagca

SEQ ID NO: 1077709 - RNA, 10 nt, Homo sapiens
ucguagccaa

SEQ ID NO: 1077710 - RNA, 16 nt, Homo sapiens
ucuaaacugcuguuaa

SEQ ID NO: 1077711 - RNA, 22 nt, Homo sapiens
ucuaaguugaguauauuauaau

SEQ ID NO: 1077712 - RNA, 17 nt, Homo sapiens
ucuacuccaugcacaua

SEQ ID NO: 1077713 - RNA, 14 nt, Homo sapiens
ucuauaacuacaua

SEQ ID NO: 1077714 - RNA, 20 nt, Homo sapiens
ucuauaacuacauauugaau

SEQ ID NO: 1077715 - RNA, 14 nt, Homo sapiens
ucuaugaucuuggc

SEQ ID NO: 1077716 - RNA, 17 nt, Homo sapiens
ucuaugccaggcugugc

SEQ ID NO: 1077717 - RNA, 16 nt, Homo sapiens
ucuauuuucucugaua

SEQ ID NO: 1077718 - RNA, 14 nt, Homo sapiens
ucucaaauucucaa

SEQ ID NO: 1077719 - RNA, 15 nt, Homo sapiens
ucucaaauuguaauu

SEQ ID NO: 1077720 - RNA, 14 nt, Homo sapiens
ucucaguucagagu

SEQ ID NO: 1077721 - RNA, 15 nt, Homo sapiens
ucuccaccugugcuu

SEQ ID NO: 1077722 - RNA, 14 nt, Homo sapiens
ucuccacuuuguug

SEQ ID NO: 1077723 - RNA, 22 nt, Homo sapiens
ucuccagugguugcuguugaug

SEQ ID NO: 1077724 - RNA, 21 nt, Homo sapiens
ucucccucuuucucaguuccu

SEQ ID NO: 1077725 - RNA, 17 nt, Homo sapiens
ucucccugggucugcgu

SEQ ID NO: 1077726 - RNA, 14 nt, Homo sapiens
ucucccuugcccuc

SEQ ID NO: 1077727 - RNA, 18 nt, Homo sapiens
ucucuaaacugcuguuaa

SEQ ID NO: 1077728 - RNA, 13 nt, Homo sapiens
ucucuaugaucuu

SEQ ID NO: 1077729 - RNA, 15 nt, Homo sapiens
ucucucaaaucucau

SEQ ID NO: 1077730 - RNA, 19 nt, Homo sapiens
ucucugugcuuugacucac

SEQ ID NO: 1077731 - RNA, 20 nt, Homo sapiens
ucugaaaaacauuccaggaa

SEQ ID NO: 1077732 - RNA, 21 nt, Homo sapiens
ucugaaucuucugaaaccaaa

SEQ ID NO: 1077733 - RNA, 16 nt, Homo sapiens
ucugacucacaagaag

SEQ ID NO: 1077734 - RNA, 15 nt, Homo sapiens
ucugcaguagucucu

SEQ ID NO: 1077735 - RNA, 22 nt, Homo sapiens
ucugcucugaggcuuccagaga

SEQ ID NO: 1077736 - RNA, 15 nt, Homo sapiens
ucuggaccagccugu

SEQ ID NO: 1077737 - RNA, 16 nt, Homo sapiens
ucugugcuuugacuca

SEQ ID NO: 1077738 - RNA, 15 nt, Homo sapiens
ucuuaguuuacuuau

SEQ ID NO: 1077739 - RNA, 15 nt, Homo sapiens
ucuucugaaaccaaa

SEQ ID NO: 1077740 - RNA, 13 nt, Homo sapiens
ucuugaaccagaa

SEQ ID NO: 1077741 - RNA, 16 nt, Homo sapiens
ucuuggaauacuugaa

SEQ ID NO: 1077742 - RNA, 19 nt, Homo sapiens
ucuuguugauuuccgugaa

SEQ ID NO: 1077743 - RNA, 18 nt, Homo sapiens
ucuuucuaaggacccaaa

SEQ ID NO: 1077744 - RNA, 12 nt, Homo sapiens
ucuuugcuacaa

SEQ ID NO: 1077745 - RNA, 17 nt, Homo sapiens
ugaaaccaaauguaacu

SEQ ID NO: 1077746 - RNA, 13 nt, Homo sapiens
ugaaaggugcuga

SEQ ID NO: 1077747 - RNA, 18 nt, Homo sapiens
ugaaauaccagugaacca

SEQ ID NO: 1077748 - RNA, 13 nt, Homo sapiens
ugaaccaaagaga

SEQ ID NO: 1077749 - RNA, 16 nt, Homo sapiens
ugaacuuucacauagc

SEQ ID NO: 1077750 - RNA, 22 nt, Homo sapiens
ugaagacccuauuucagaaaua

SEQ ID NO: 1077751 - RNA, 12 nt, Homo sapiens
ugaauaucgaga

SEQ ID NO: 1077752 - RNA, 18 nt, Homo sapiens
ugaauauuuauucaguga

SEQ ID NO: 1077753 - RNA, 15 nt, Homo sapiens
ugaauggccugccuu

SEQ ID NO: 1077754 - RNA, 19 nt, Homo sapiens
ugaaugucuuacugugauc

SEQ ID NO: 1077755 - RNA, 21 nt, Homo sapiens
ugacagccuccgucagacucc

SEQ ID NO: 1077756 - RNA, 15 nt, Homo sapiens
ugacccacccagugu

SEQ ID NO: 1077757 - RNA, 15 nt, Homo sapiens
ugacgggaaaaccaa

SEQ ID NO: 1077758 - RNA, 23 nt, Homo sapiens
ugacucacaagaagaccagacug

SEQ ID NO: 1077759 - RNA, 13 nt, Homo sapiens
ugacucaccuguu

SEQ ID NO: 1077760 - RNA, 15 nt, Homo sapiens
ugacuuuuccauuga

SEQ ID NO: 1077761 - RNA, 20 nt, Homo sapiens
ugagacauauuuacaaccua

SEQ ID NO: 1077762 - RNA, 23 nt, Homo sapiens
ugagagcaaaaugcauguaauca

SEQ ID NO: 1077763 - RNA, 22 nt, Homo sapiens
ugagccagccuugcaguaggca

SEQ ID NO: 1077764 - RNA, 20 nt, Homo sapiens
ugagccaugaucgagccacu

SEQ ID NO: 1077765 - RNA, 17 nt, Homo sapiens
ugagcucaggcauuuga

SEQ ID NO: 1077766 - RNA, 12 nt, Homo sapiens
ugaggacacgug

SEQ ID NO: 1077767 - RNA, 19 nt, Homo sapiens
ugaggccgggcgcaguggc

SEQ ID NO: 1077768 - RNA, 14 nt, Homo sapiens
ugaggcugcagcga

SEQ ID NO: 1077769 - RNA, 23 nt, Homo sapiens
ugaggcugucgugagcuaugauu

SEQ ID NO: 1077770 - RNA, 16 nt, Homo sapiens
ugaggggcuccuggaa

SEQ ID NO: 1077771 - RNA, 22 nt, Homo sapiens
ugagucucuaugaucuuggcac

SEQ ID NO: 1077772 - RNA, 16 nt, Homo sapiens
ugaguggagguuuaua

SEQ ID NO: 1077773 - RNA, 19 nt, Homo sapiens
ugaucagugcaauugaccu

SEQ ID NO: 1077774 - RNA, 13 nt, Homo sapiens
ugaucuuggcagu

SEQ ID NO: 1077775 - RNA, 14 nt, Homo sapiens
ugauggaccaaagc

SEQ ID NO: 1077776 - RNA, 22 nt, Homo sapiens
ugcaaacccugguugcuguauu

SEQ ID NO: 1077777 - RNA, 20 nt, Homo sapiens
ugcacuccagccugggcaac

SEQ ID NO: 1077778 - RNA, 20 nt, Homo sapiens
ugcaguccgcagucuggccu

SEQ ID NO: 1077779 - RNA, 15 nt, Homo sapiens
ugcaguuugaucaaa

SEQ ID NO: 1077780 - RNA, 15 nt, Homo sapiens
ugccucuucuuuaug

SEQ ID NO: 1077781 - RNA, 15 nt, Homo sapiens
ugccuugaagccacu

SEQ ID NO: 1077782 - RNA, 14 nt, Homo sapiens
ugcgcucaccucag

SEQ ID NO: 1077783 - RNA, 19 nt, Homo sapiens
aaagauaugcuaagcagua

SEQ ID NO: 1077784 - RNA, 18 nt, Homo sapiens
aaagccaaacucugccag

SEQ ID NO: 1077785 - RNA, 15 nt, Homo sapiens
aaaggcucagucuca

SEQ ID NO: 1077786 - RNA, 23 nt, Homo sapiens
aaagguuucuauuuucucugaua

SEQ ID NO: 1077787 - RNA, 19 nt, Homo sapiens
aaauaaaaacaaaaccaca

SEQ ID NO: 1077788 - RNA, 20 nt, Homo sapiens
aaauaccagugaaccaaaga

SEQ ID NO: 1077789 - RNA, 18 nt, Homo sapiens
aaauaucuggguggcuua

SEQ ID NO: 1077790 - RNA, 15 nt, Homo sapiens
aaaucauuguagaaa

SEQ ID NO: 1077791 - RNA, 17 nt, Homo sapiens
aaaucccaccacugcac

SEQ ID NO: 1077792 - RNA, 18 nt, Homo sapiens
aaaugacccaaagaccaa

SEQ ID NO: 1077793 - RNA, 17 nt, Homo sapiens
aaaugaugccacuuccc

SEQ ID NO: 1077794 - RNA, 14 nt, Homo sapiens
aaaugcauguaauc

SEQ ID NO: 1077795 - RNA, 19 nt, Homo sapiens
aacaaaagcuuuucuuucc

SEQ ID NO: 1077796 - RNA, 17 nt, Homo sapiens
aacaagacaaagcaaag

SEQ ID NO: 1077797 - RNA, 22 nt, Homo sapiens
aacaagccaacgacaaagccaa

SEQ ID NO: 1077798 - RNA, 21 nt, Homo sapiens
aacacaguuuagugcuuuaca

SEQ ID NO: 1077799 - RNA, 20 nt, Homo sapiens
aacacccaugaaucaaagac

SEQ ID NO: 1077800 - RNA, 16 nt, Homo sapiens
aacacuaagcucucug

SEQ ID NO: 1077801 - RNA, 20 nt, Homo sapiens
aacauaugcauuaugaaguu

SEQ ID NO: 1077802 - RNA, 12 nt, Homo sapiens
aacaugcacggu

SEQ ID NO: 1077803 - RNA, 14 nt, Homo sapiens
aacaugcacgguga

SEQ ID NO: 1077804 - RNA, 20 nt, Homo sapiens
aacaugcuaaauaguucuau

SEQ ID NO: 1077805 - RNA, 20 nt, Homo sapiens
aaccagagggggcgugccug

SEQ ID NO: 1077806 - RNA, 12 nt, Homo sapiens
aaccccaucucu

SEQ ID NO: 1077807 - RNA, 16 nt, Homo sapiens
aaccgugauaagccuu

SEQ ID NO: 1077808 - RNA, 15 nt, Homo sapiens
aaccuggaaccagag

SEQ ID NO: 1077809 - RNA, 23 nt, Homo sapiens
aacgacaaagccaaacucugcca

SEQ ID NO: 1077810 - RNA, 22 nt, Homo sapiens
aacgggacccccuggcccugcc

SEQ ID NO: 1077811 - RNA, 21 nt, Homo sapiens
aacuauuggagggugggagag

SEQ ID NO: 1077812 - RNA, 22 nt, Homo sapiens
aacuccugauuuuguaguuaau

SEQ ID NO: 1077813 - RNA, 13 nt, Homo sapiens
aacuggugauaua

SEQ ID NO: 1077814 - RNA, 17 nt, Homo sapiens
aacuggugauauaucuc

SEQ ID NO: 1077815 - RNA, 19 nt, Homo sapiens
aacuugaagauauuuauuc

SEQ ID NO: 1077816 - RNA, 20 nt, Homo sapiens
aacuugaggacacaugucca

SEQ ID NO: 1077817 - RNA, 14 nt, Homo sapiens
aacuuucuacucau

SEQ ID NO: 1077818 - RNA, 15 nt, Homo sapiens
aagaaacacuaagcu

SEQ ID NO: 1077819 - RNA, 21 nt, Homo sapiens
aagaaauuccuguagcaucuu

SEQ ID NO: 1077820 - RNA, 13 nt, Homo sapiens
aagaauauuguau

SEQ ID NO: 1077821 - RNA, 13 nt, Homo sapiens
aagacaaagcaaa

SEQ ID NO: 1077822 - RNA, 22 nt, Homo sapiens
aagaccaauauucaaaugcgua

SEQ ID NO: 1077823 - RNA, 15 nt, Homo sapiens
aagacuacacuguug

SEQ ID NO: 1077824 - RNA, 21 nt, Homo sapiens
aagagacccagucaauuacau

SEQ ID NO: 1077825 - RNA, 20 nt, Homo sapiens
aagagacuggagcaucugac

SEQ ID NO: 1077826 - RNA, 22 nt, Homo sapiens
aagaucagagcugcagccaguc

SEQ ID NO: 1077827 - RNA, 15 nt, Homo sapiens
aagcaaguggcuuuc

SEQ ID NO: 1077828 - RNA, 19 nt, Homo sapiens
aagcacauaugaacuggac

SEQ ID NO: 1077829 - RNA, 19 nt, Homo sapiens
aagcagguggcaucucuaa

SEQ ID NO: 1077830 - RNA, 19 nt, Homo sapiens
aagcaucaaagcacuguuu

SEQ ID NO: 1077831 - RNA, 15 nt, Homo sapiens
aagcaucaccucagg

SEQ ID NO: 1077832 - RNA, 16 nt, Homo sapiens
aagccaaacucugcca

SEQ ID NO: 1077833 - RNA, 16 nt, Homo sapiens
aagccauucacuuccc

SEQ ID NO: 1077834 - RNA, 17 nt, Homo sapiens
aagcuagaaggccacau

SEQ ID NO: 1077835 - RNA, 21 nt, Homo sapiens
aagcugcugagaaucuagccu

SEQ ID NO: 1077836 - RNA, 20 nt, Homo sapiens
aagcuguuggauuucaguga

SEQ ID NO: 1077837 - RNA, 14 nt, Homo sapiens
aaggagaaaaugca

SEQ ID NO: 1077838 - RNA, 13 nt, Homo sapiens
aaggagaacccaa

SEQ ID NO: 1077839 - RNA, 17 nt, Homo sapiens
aaggcacugacugagca

SEQ ID NO: 1077840 - RNA, 21 nt, Homo sapiens
aaggccaagaaucaagcuaga

SEQ ID NO: 1077841 - RNA, 15 nt, Homo sapiens
aaggccacaugucac

SEQ ID NO: 1077842 - RNA, 19 nt, Homo sapiens
aaggggaauguguccuccu

SEQ ID NO: 1077843 - RNA, 23 nt, Homo sapiens
aaggggcagcuccugaccaaaga

SEQ ID NO: 1077844 - RNA, 12 nt, Homo sapiens
aagucacauaua

SEQ ID NO: 1077845 - RNA, 23 nt, Homo sapiens
aagucugggauguagaacuucaa

SEQ ID NO: 1077846 - RNA, 17 nt, Homo sapiens
aauaaaaacaaaaccac

SEQ ID NO: 1077847 - RNA, 22 nt, Homo sapiens
aauaccagugaaccaaagagac

SEQ ID NO: 1077848 - RNA, 14 nt, Homo sapiens
aauagcucuacugc

SEQ ID NO: 1077849 - RNA, 18 nt, Homo sapiens
aauauagauuaaaucaua

SEQ ID NO: 1077850 - RNA, 16 nt, Homo sapiens
aaucccaccacugcac

SEQ ID NO: 1077851 - RNA, 14 nt, Homo sapiens
aaucuauaacuaca

SEQ ID NO: 1077852 - RNA, 17 nt, Homo sapiens
aaucuauaacuacauau

SEQ ID NO: 1077853 - RNA, 16 nt, Homo sapiens
aaugaugccacuuccc

SEQ ID NO: 1077854 - RNA, 14 nt, Homo sapiens
aaugauuguuuaaa

SEQ ID NO: 1077855 - RNA, 19 nt, Homo sapiens
aaugccuccaagccauuca

SEQ ID NO: 1077856 - RNA, 19 nt, Homo sapiens
aaugcuuugguucuggguu

SEQ ID NO: 1077857 - RNA, 12 nt, Homo sapiens
aauuacuucuuc

SEQ ID NO: 1077858 - RNA, 12 nt, Homo sapiens
aauuagccagau

SEQ ID NO: 1077859 - RNA, 22 nt, Homo sapiens
aauuauacuguagcugaugaaa

SEQ ID NO: 1077860 - RNA, 22 nt, Homo sapiens
aauuuccccuaaucuuuucuga

SEQ ID NO: 1077861 - RNA, 12 nt, Homo sapiens
aauuuuugauca

SEQ ID NO: 1077862 - RNA, 15 nt, Homo sapiens
acaaagauaugcuaa

SEQ ID NO: 1077863 - RNA, 18 nt, Homo sapiens
acaaagauuauuugcacg

SEQ ID NO: 1077864 - RNA, 16 nt, Homo sapiens
acaaagcgagauccca

SEQ ID NO: 1077865 - RNA, 19 nt, Homo sapiens
acaaauuuuuuucuuguuu

SEQ ID NO: 1077866 - RNA, 16 nt, Homo sapiens
acaaugugacuuugaa

SEQ ID NO: 1077867 - RNA, 18 nt, Homo sapiens
acaauuacuaaauuguau

SEQ ID NO: 1077868 - RNA, 14 nt, Homo sapiens
acacccaguguccu

SEQ ID NO: 1077869 - RNA, 17 nt, Homo sapiens
acacccaugaaucaaag

SEQ ID NO: 1077870 - RNA, 20 nt, Homo sapiens
acaccugaaaauuaugaguc

SEQ ID NO: 1077871 - RNA, 17 nt, Homo sapiens
acaccuguaaucccagc

SEQ ID NO: 1077872 - RNA, 20 nt, Homo sapiens
acacgugauggaccaaagcc

SEQ ID NO: 1077873 - RNA, 15 nt, Homo sapiens
acacuguuuguucca

SEQ ID NO: 1077874 - RNA, 12 nt, Homo sapiens
acagaagccagg

SEQ ID NO: 1077875 - RNA, 20 nt, Homo sapiens
acagagcgagacuccgucuc

SEQ ID NO: 1077876 - RNA, 20 nt, Homo sapiens
acagagcgagagucugucuc

SEQ ID NO: 1077877 - RNA, 19 nt, Homo sapiens
acagccagguuagccuuug

SEQ ID NO: 1077878 - RNA, 18 nt, Homo sapiens
acagccgcagaaggggaa

SEQ ID NO: 1077879 - RNA, 13 nt, Homo sapiens
acagcguuuacau

SEQ ID NO: 1077880 - RNA, 19 nt, Homo sapiens
acagcucuucucagugucu

SEQ ID NO: 1077881 - RNA, 13 nt, Homo sapiens
acagcuuggcacu

SEQ ID NO: 1077882 - RNA, 16 nt, Homo sapiens
acagcuuggcacuuua

SEQ ID NO: 1077883 - RNA, 19 nt, Homo sapiens
acaggaaaaagacuaagcc

SEQ ID NO: 1077884 - RNA, 19 nt, Homo sapiens
acaguuauagaaagcaaga

SEQ ID NO: 1077885 - RNA, 22 nt, Homo sapiens
acaguuuagugcuuuacaugcu

SEQ ID NO: 1077886 - RNA, 20 nt, Homo sapiens
acauagaauugcaaucuaua

SEQ ID NO: 1077887 - RNA, 12 nt, Homo sapiens
acauagcacaga

SEQ ID NO: 1077888 - RNA, 16 nt, Homo sapiens
acauaugcauuaugaa

SEQ ID NO: 1077889 - RNA, 22 nt, Homo sapiens
acauccaaccccccaccugcca

SEQ ID NO: 1077890 - RNA, 17 nt, Homo sapiens
acaugcugugcucuuug

SEQ ID NO: 1077891 - RNA, 20 nt, Homo sapiens
acauggaauuaccuuagauu

SEQ ID NO: 1077892 - RNA, 20 nt, Homo sapiens
acauuccucugcagcacuuc

SEQ ID NO: 1077893 - RNA, 14 nt, Homo sapiens
acauuuggcauuug

SEQ ID NO: 1077894 - RNA, 23 nt, Homo sapiens
acauuuugcauuagacagaugac

SEQ ID NO: 1077895 - RNA, 23 nt, Homo sapiens
acauuuuguacaaagauaugcua

SEQ ID NO: 1077896 - RNA, 15 nt, Homo sapiens
accaaagagacugga

SEQ ID NO: 1077897 - RNA, 21 nt, Homo sapiens
accaaagagacuggagcaucu

SEQ ID NO: 1077898 - RNA, 23 nt, Homo sapiens
accaaagagacuggagcaucuga

SEQ ID NO: 1077899 - RNA, 14 nt, Homo sapiens
accaaagcauuucu

SEQ ID NO: 1077900 - RNA, 13 nt, Homo sapiens
accaauauucaaa

SEQ ID NO: 1077901 - RNA, 12 nt, Homo sapiens
accaaucucuaa

SEQ ID NO: 1077902 - RNA, 21 nt, Homo sapiens
accacucaggccaacaagcca

SEQ ID NO: 1077903 - RNA, 22 nt, Homo sapiens
accagaggcugcagaaggccaa

SEQ ID NO: 1077904 - RNA, 17 nt, Homo sapiens
accagggagcaguugcc

SEQ ID NO: 1077905 - RNA, 14 nt, Homo sapiens
accagucacugucc

SEQ ID NO: 1077906 - RNA, 12 nt, Homo sapiens
acccacuggcca

SEQ ID NO: 1077907 - RNA, 17 nt, Homo sapiens
acccaguguccuuccau

SEQ ID NO: 1077908 - RNA, 16 nt, Homo sapiens
acccaugaaucaaaga

SEQ ID NO: 1077909 - RNA, 13 nt, Homo sapiens
acccaugccauag

SEQ ID NO: 1077910 - RNA, 18 nt, Homo sapiens
accccagcgccugugcug

SEQ ID NO: 1077911 - RNA, 16 nt, Homo sapiens
acccuaaaacaugugu

SEQ ID NO: 1077912 - RNA, 21 nt, Homo sapiens
acccuauaucuauaaacacug

SEQ ID NO: 1077913 - RNA, 14 nt, Homo sapiens
accguggaccuucc

SEQ ID NO: 1077914 - RNA, 19 nt, Homo sapiens
accguggaccuuccugcca

SEQ ID NO: 1077915 - RNA, 15 nt, Homo sapiens
accuagaaguaacug

SEQ ID NO: 1077916 - RNA, 13 nt, Homo sapiens
accucugcucuga

SEQ ID NO: 1077917 - RNA, 22 nt, Homo sapiens
accucuuuauuuuuugauugaa

SEQ ID NO: 1077918 - RNA, 20 nt, Homo sapiens
accugugauauuuuacuuga

SEQ ID NO: 1077919 - RNA, 19 nt, Homo sapiens
accuuccuuaagccaggaa

SEQ ID NO: 1077920 - RNA, 22 nt, Homo sapiens
acgaacgcucuuagcuuucuca

SEQ ID NO: 1077921 - RNA, 15 nt, Homo sapiens
acgccacugcacucc

SEQ ID NO: 1077922 - RNA, 17 nt, Homo sapiens
acgccuguaaucccagc

SEQ ID NO: 1077923 - RNA, 13 nt, Homo sapiens
acgggaaaaccaa

SEQ ID NO: 1077924 - RNA, 19 nt, Homo sapiens
acuaaacucugaauaagca

SEQ ID NO: 1077925 - RNA, 12 nt, Homo sapiens
acuaagccagac

SEQ ID NO: 1077926 - RNA, 20 nt, Homo sapiens
acuaaguacuugcucucuga

SEQ ID NO: 1077927 - RNA, 13 nt, Homo sapiens
acuacacuccagc

SEQ ID NO: 1077928 - RNA, 14 nt, Homo sapiens
acuaguguuuguua

SEQ ID NO: 1077929 - RNA, 13 nt, Homo sapiens
acuccagccugag

SEQ ID NO: 1077930 - RNA, 14 nt, Homo sapiens
acucccuccaugug

SEQ ID NO: 1077931 - RNA, 21 nt, Homo sapiens
acucuagccugggccagagaa

SEQ ID NO: 1077932 - RNA, 18 nt, Homo sapiens
acucucugugaccugccc

SEQ ID NO: 1077933 - RNA, 19 nt, Homo sapiens
acucugccagccacaucca

SEQ ID NO: 1077934 - RNA, 18 nt, Homo sapiens
acucugcucuaugccagg

SEQ ID NO: 1077935 - RNA, 19 nt, Homo sapiens
acucugcucuaugccaggc

SEQ ID NO: 1077936 - RNA, 13 nt, Homo sapiens
acugaaacauuca

SEQ ID NO: 1077937 - RNA, 20 nt, Homo sapiens
acugacucggcagugugcag

SEQ ID NO: 1077938 - RNA, 18 nt, Homo sapiens
acugaguccucguagcca

SEQ ID NO: 1077939 - RNA, 23 nt, Homo sapiens
acugaguccucguagccaucucu

SEQ ID NO: 1077940 - RNA, 20 nt, Homo sapiens
acugcacuccagccugggca

SEQ ID NO: 1077941 - RNA, 16 nt, Homo sapiens
acugcagggcacugug

SEQ ID NO: 1077942 - RNA, 20 nt, Homo sapiens
acugcuuuccagccugggca

SEQ ID NO: 1077943 - RNA, 21 nt, Homo sapiens
acuggagcaucugacucacaa

SEQ ID NO: 1077944 - RNA, 17 nt, Homo sapiens
acuggucccaaguagua

SEQ ID NO: 1077945 - RNA, 17 nt, Homo sapiens
acugguuugccaggcca

SEQ ID NO: 1077946 - RNA, 16 nt, Homo sapiens
acuguagcugaugaaa

SEQ ID NO: 1077947 - RNA, 14 nt, Homo sapiens
acugucucagccaa

SEQ ID NO: 1077948 - RNA, 13 nt, Homo sapiens
acugugaccaaag

SEQ ID NO: 1077949 - RNA, 16 nt, Homo sapiens
acugugaccaaagcau

SEQ ID NO: 1077950 - RNA, 12 nt, Homo sapiens
acuguugcacug

SEQ ID NO: 1077951 - RNA, 16 nt, Homo sapiens
acuucacuaccaaaug

SEQ ID NO: 1077952 - RNA, 20 nt, Homo sapiens
acuuccauucccguggucuc

SEQ ID NO: 1077953 - RNA, 23 nt, Homo sapiens
acuucuaacuagaaaucugccaa

SEQ ID NO: 1077954 - RNA, 12 nt, Homo sapiens
acuucuaugcaa

SEQ ID NO: 1077955 - RNA, 22 nt, Homo sapiens
acuugcaccugguacugcacau

SEQ ID NO: 1077956 - RNA, 22 nt, Homo sapiens
acuugggggaggaggaacaaau

SEQ ID NO: 1077957 - RNA, 18 nt, Homo sapiens
acuuguccuuuuguacca

SEQ ID NO: 1077958 - RNA, 16 nt, Homo sapiens
acuuuuauugagcucu

SEQ ID NO: 1077959 - RNA, 11 nt, Homo sapiens
agaaacacagg

SEQ ID NO: 1077960 - RNA, 19 nt, Homo sapiens
agaaacugaggccauuauu

SEQ ID NO: 1077961 - RNA, 13 nt, Homo sapiens
agaaauuccugua

SEQ ID NO: 1077962 - RNA, 22 nt, Homo sapiens
agaaauuccuguagcaucuucu

SEQ ID NO: 1077963 - RNA, 12 nt, Homo sapiens
agaacacccacu

SEQ ID NO: 1077964 - RNA, 11 nt, Homo sapiens
agaaccucagg

SEQ ID NO: 1077965 - RNA, 12 nt, Homo sapiens
agaaccucaggc

SEQ ID NO: 1077966 - RNA, 14 nt, Homo sapiens
agaacuucaagaag

SEQ ID NO: 1077967 - RNA, 19 nt, Homo sapiens
agaaggcacauagaaauaa

SEQ ID NO: 1077968 - RNA, 12 nt, Homo sapiens
agaauaaugugu

SEQ ID NO: 1077969 - RNA, 20 nt, Homo sapiens
agacaagucuugcugugcuu

SEQ ID NO: 1077970 - RNA, 23 nt, Homo sapiens
agaccagacuguggagaaauaaa

SEQ ID NO: 1077971 - RNA, 22 nt, Homo sapiens
agaccauugucuuccaacccca

SEQ ID NO: 1077972 - RNA, 16 nt, Homo sapiens
agacggaggugccuga

SEQ ID NO: 1077973 - RNA, 14 nt, Homo sapiens
agacuaagccagac

SEQ ID NO: 1077974 - RNA, 18 nt, Homo sapiens
agacuggagcaucugacu

SEQ ID NO: 1077975 - RNA, 11 nt, Homo sapiens
agagcccucca

SEQ ID NO: 1077976 - RNA, 17 nt, Homo sapiens
agagccugagucacugg

SEQ ID NO: 1077977 - RNA, 19 nt, Homo sapiens
agagccugagucacugguc

SEQ ID NO: 1077978 - RNA, 20 nt, Homo sapiens
agagcgagacuccgucucaa

SEQ ID NO: 1077979 - RNA, 11 nt, Homo sapiens
agagcucuuaa

SEQ ID NO: 1077980 - RNA, 20 nt, Homo sapiens
agaggggaaaccaguguagc

SEQ ID NO: 1077981 - RNA, 17 nt, Homo sapiens
agaugugaucacugaga

SEQ ID NO: 1077982 - RNA, 15 nt, Homo sapiens
agauuagcucuggac

SEQ ID NO: 1077983 - RNA, 23 nt, Homo sapiens
agauuauauaucauaaaguaugc

SEQ ID NO: 1077984 - RNA, 18 nt, Homo sapiens
agcaaguuucaucagccc

SEQ ID NO: 1077985 - RNA, 21 nt, Homo sapiens
agcacacacacauaagcacug

SEQ ID NO: 1077986 - RNA, 15 nt, Homo sapiens
agcaggaacugagcc

SEQ ID NO: 1077987 - RNA, 17 nt, Homo sapiens
agcaggcggggguuuga

SEQ ID NO: 1077988 - RNA, 19 nt, Homo sapiens
agcagguggcaucucuaau

SEQ ID NO: 1077989 - RNA, 14 nt, Homo sapiens
agcaucaaagcacu

SEQ ID NO: 1077990 - RNA, 16 nt, Homo sapiens
agcaucaccucaggcc

SEQ ID NO: 1077991 - RNA, 20 nt, Homo sapiens
agccaaaaucccaccacugc

SEQ ID NO: 1077992 - RNA, 18 nt, Homo sapiens
agccaccuccuuggcacc

SEQ ID NO: 1077993 - RNA, 14 nt, Homo sapiens
agcccagccauuac

SEQ ID NO: 1077994 - RNA, 21 nt, Homo sapiens
agccgagauugcgccacugca

SEQ ID NO: 1077995 - RNA, 18 nt, Homo sapiens
agccucuucuuacuucac

SEQ ID NO: 1077996 - RNA, 21 nt, Homo sapiens
agccugcuuuuguccuguuau

SEQ ID NO: 1077997 - RNA, 22 nt, Homo sapiens
agccuguuggacccgcucugga

SEQ ID NO: 1077998 - RNA, 17 nt, Homo sapiens
agcgagagucugucuca

SEQ ID NO: 1077999 - RNA, 18 nt, Homo sapiens
agcgaugaauuuggagac

SEQ ID NO: 1078000 - RNA, 14 nt, Homo sapiens
agcuagaaggccac

SEQ ID NO: 1078001 - RNA, 17 nt, Homo sapiens
agcuauuuucugaccaa

SEQ ID NO: 1078002 - RNA, 18 nt, Homo sapiens
agcuauuuucugaccaaa

SEQ ID NO: 1078003 - RNA, 21 nt, Homo sapiens
cgccuaugaucccagcacuuu

SEQ ID NO: 1078004 - RNA, 14 nt, Homo sapiens
cgcugccuugccau

SEQ ID NO: 1078005 - RNA, 22 nt, Homo sapiens
cggacacaagcggcccugacac

SEQ ID NO: 1078006 - RNA, 21 nt, Homo sapiens
cggggaggcagggguccugca

SEQ ID NO: 1078007 - RNA, 20 nt, Homo sapiens
cgucucuacuaaaaauacaa

SEQ ID NO: 1078008 - RNA, 15 nt, Homo sapiens
cgucuguccuccuuu

SEQ ID NO: 1078009 - RNA, 17 nt, Homo sapiens
cgugauggaccaaagcc

SEQ ID NO: 1078010 - RNA, 20 nt, Homo sapiens
cguggucuccuugcacuuuc

SEQ ID NO: 1078011 - RNA, 15 nt, Homo sapiens
cuaaagucacauaua

SEQ ID NO: 1078012 - RNA, 20 nt, Homo sapiens
cuaaggacccaaauuucccu

SEQ ID NO: 1078013 - RNA, 23 nt, Homo sapiens
cuacucucuccuuuuugcuuccu

SEQ ID NO: 1078014 - RNA, 15 nt, Homo sapiens
cuacugagacaugac

SEQ ID NO: 1078015 - RNA, 19 nt, Homo sapiens
cuacuugggaggcugaggc

SEQ ID NO: 1078016 - RNA, 17 nt, Homo sapiens
cuacuuguaaaggugcu

SEQ ID NO: 1078017 - RNA, 15 nt, Homo sapiens
cuagaaaucugccaa

SEQ ID NO: 1078018 - RNA, 12 nt, Homo sapiens
cuagaaggccac

SEQ ID NO: 1078019 - RNA, 18 nt, Homo sapiens
cuaggccacaccaucucc

SEQ ID NO: 1078020 - RNA, 21 nt, Homo sapiens
cuaguuuauuggaaguguuca

SEQ ID NO: 1078021 - RNA, 19 nt, Homo sapiens
cuauaacauagaauugcaa

SEQ ID NO: 1078022 - RNA, 17 nt, Homo sapiens
cuauaacuacauauuga

SEQ ID NO: 1078023 - RNA, 15 nt, Homo sapiens
cuauagucauggggu

SEQ ID NO: 1078024 - RNA, 21 nt, Homo sapiens
cuauagucccagcuacucaga

SEQ ID NO: 1078025 - RNA, 13 nt, Homo sapiens
cuaugaucuuggc

SEQ ID NO: 1078026 - RNA, 15 nt, Homo sapiens
cuaugcaaaugccuc

SEQ ID NO: 1078027 - RNA, 15 nt, Homo sapiens
cuaugcaagccuugc

SEQ ID NO: 1078028 - RNA, 21 nt, Homo sapiens
cuaugccaggcugugcuagca

SEQ ID NO: 1078029 - RNA, 15 nt, Homo sapiens
cuauuuguucagaga

SEQ ID NO: 1078030 - RNA, 17 nt, Homo sapiens
cuauuuucugaccaaaa

SEQ ID NO: 1078031 - RNA, 16 nt, Homo sapiens
cucacaagaagaccag

SEQ ID NO: 1078032 - RNA, 11 nt, Homo sapiens
cucagaagcca

SEQ ID NO: 1078033 - RNA, 15 nt, Homo sapiens
cucagccccacugac

SEQ ID NO: 1078034 - RNA, 14 nt, Homo sapiens
cucagucucaggag

SEQ ID NO: 1078035 - RNA, 21 nt, Homo sapiens
cucauuccgagggugaaacaa

SEQ ID NO: 1078036 - RNA, 20 nt, Homo sapiens
cuccaauggggccagcacug

SEQ ID NO: 1078037 - RNA, 15 nt, Homo sapiens
cucccaaugugccga

SEQ ID NO: 1078038 - RNA, 18 nt, Homo sapiens
cuccccuuguacucuugc

SEQ ID NO: 1078039 - RNA, 16 nt, Homo sapiens
cucccggcauccugaa

SEQ ID NO: 1078040 - RNA, 16 nt, Homo sapiens
cucccucugaccugca

SEQ ID NO: 1078041 - RNA, 16 nt, Homo sapiens
cuccucacgcaacuca

SEQ ID NO: 1078042 - RNA, 12 nt, Homo sapiens
cuccugaccaaa

SEQ ID NO: 1078043 - RNA, 16 nt, Homo sapiens
cuccuguugcaaugac

SEQ ID NO: 1078044 - RNA, 18 nt, Homo sapiens
cuccuuuucuucuagcuu

SEQ ID NO: 1078045 - RNA, 17 nt, Homo sapiens
cucuacaaaaaccaaaa

SEQ ID NO: 1078046 - RNA, 20 nt, Homo sapiens
cucuagccugggccagagaa

SEQ ID NO: 1078047 - RNA, 18 nt, Homo sapiens
cucuccuuuuugcuuccu

SEQ ID NO: 1078048 - RNA, 21 nt, Homo sapiens
cucugauacuuuuuugaaauc

SEQ ID NO: 1078049 - RNA, 13 nt, Homo sapiens
cucuggaccagcc

SEQ ID NO: 1078050 - RNA, 16 nt, Homo sapiens
cucuggaccagccugu

SEQ ID NO: 1078051 - RNA, 13 nt, Homo sapiens
cucugugcuuuga

SEQ ID NO: 1078052 - RNA, 14 nt, Homo sapiens
cucuuaauguugcu

SEQ ID NO: 1078053 - RNA, 13 nt, Homo sapiens
cucuucuuuaugu

SEQ ID NO: 1078054 - RNA, 14 nt, Homo sapiens
cucuugaaccagaa

SEQ ID NO: 1078055 - RNA, 21 nt, Homo sapiens
cucuugauaggacuuccuuaa

SEQ ID NO: 1078056 - RNA, 14 nt, Homo sapiens
cucuugcauuucac

SEQ ID NO: 1078057 - RNA, 14 nt, Homo sapiens
cugaauaagcacuu

SEQ ID NO: 1078058 - RNA, 22 nt, Homo sapiens
cugacacaggccagccuuggca

SEQ ID NO: 1078059 - RNA, 20 nt, Homo sapiens
cugacacgugauggaccaaa

SEQ ID NO: 1078060 - RNA, 17 nt, Homo sapiens
cugacagaaaugcaauc

SEQ ID NO: 1078061 - RNA, 13 nt, Homo sapiens
cugagaaccaaaa

SEQ ID NO: 1078062 - RNA, 14 nt, Homo sapiens
cugagaaccaaaag

SEQ ID NO: 1078063 - RNA, 15 nt, Homo sapiens
cugagaaccaaaaga

SEQ ID NO: 1078064 - RNA, 19 nt, Homo sapiens
cugagccagaaacgcagau

SEQ ID NO: 1078065 - RNA, 13 nt, Homo sapiens
cugagcccuggca

SEQ ID NO: 1078066 - RNA, 15 nt, Homo sapiens
cugaggccacccacu

SEQ ID NO: 1078067 - RNA, 18 nt, Homo sapiens
cugaggccacccacugac

SEQ ID NO: 1078068 - RNA, 19 nt, Homo sapiens
cugaguuauuuugcuaaac

SEQ ID NO: 1078069 - RNA, 17 nt, Homo sapiens
cugcagaaggccaagaa

SEQ ID NO: 1078070 - RNA, 13 nt, Homo sapiens
cugcaggccaaga

SEQ ID NO: 1078071 - RNA, 18 nt, Homo sapiens
cugccuugaagccacuga

SEQ ID NO: 1078072 - RNA, 13 nt, Homo sapiens
cugccuugccaug

SEQ ID NO: 1078073 - RNA, 16 nt, Homo sapiens
cugcucccaaugugcc

SEQ ID NO: 1078074 - RNA, 20 nt, Homo sapiens
cugcucgaagaacaauguca

SEQ ID NO: 1078075 - RNA, 21 nt, Homo sapiens
cugcucugaggcuuccagaga

SEQ ID NO: 1078076 - RNA, 17 nt, Homo sapiens
cuggagcaucugacuca

SEQ ID NO: 1078077 - RNA, 13 nt, Homo sapiens
cuggagugcagug

SEQ ID NO: 1078078 - RNA, 13 nt, Homo sapiens
cuggauggcacca

SEQ ID NO: 1078079 - RNA, 17 nt, Homo sapiens
cuggauggcaccagagg

SEQ ID NO: 1078080 - RNA, 13 nt, Homo sapiens
cuggccucuagaa

SEQ ID NO: 1078081 - RNA, 21 nt, Homo sapiens
cuggccucuagaacacccacu

SEQ ID NO: 1078082 - RNA, 13 nt, Homo sapiens
cuggcugcaguga

SEQ ID NO: 1078083 - RNA, 13 nt, Homo sapiens
cuggcugggcaug

SEQ ID NO: 1078084 - RNA, 22 nt, Homo sapiens
cugggaaggggaacacagacca

SEQ ID NO: 1078085 - RNA, 17 nt, Homo sapiens
cugggagaaccucaggc

SEQ ID NO: 1078086 - RNA, 14 nt, Homo sapiens
cugggauguagaac

SEQ ID NO: 1078087 - RNA, 22 nt, Homo sapiens
cugggccaaguuccucuagugc

SEQ ID NO: 1078088 - RNA, 20 nt, Homo sapiens
cugggcuccucauuuuuacg

SEQ ID NO: 1078089 - RNA, 14 nt, Homo sapiens
cuggggcucugugc

SEQ ID NO: 1078090 - RNA, 11 nt, Homo sapiens
cuggucccugc

SEQ ID NO: 1078091 - RNA, 13 nt, Homo sapiens
cugguccuuccag

SEQ ID NO: 1078092 - RNA, 22 nt, Homo sapiens
cuguagucccagcuacucggga

SEQ ID NO: 1078093 - RNA, 18 nt, Homo sapiens
cuguccaguuuccaaagg

SEQ ID NO: 1078094 - RNA, 12 nt, Homo sapiens
cugucccaaaga

SEQ ID NO: 1078095 - RNA, 12 nt, Homo sapiens
cuguccuaggcc

SEQ ID NO: 1078096 - RNA, 16 nt, Homo sapiens
cugucugucccaaaga

SEQ ID NO: 1078097 - RNA, 16 nt, Homo sapiens
cugugcuuugacucac

SEQ ID NO: 1078098 - RNA, 23 nt, Homo sapiens
cuguggguaucaggacugugacc

SEQ ID NO: 1078099 - RNA, 23 nt, Homo sapiens
cuguuacuugaaauaccagugaa

SEQ ID NO: 1078100 - RNA, 21 nt, Homo sapiens
cuguugccuuuuuacagccaa

SEQ ID NO: 1078101 - RNA, 18 nt, Homo sapiens
cuuaaaaaaaacucuuua

SEQ ID NO: 1078102 - RNA, 20 nt, Homo sapiens
cuuagaaaucauuguagaaa

SEQ ID NO: 1078103 - RNA, 23 nt, Homo sapiens
cuuagauuagcucuggaccagcc

SEQ ID NO: 1078104 - RNA, 12 nt, Homo sapiens
cuuagcugucac

SEQ ID NO: 1078105 - RNA, 21 nt, Homo sapiens
cuuauagguuuccacugccaa

SEQ ID NO: 1078106 - RNA, 19 nt, Homo sapiens
cuucaaguuagcucaggag

SEQ ID NO: 1078107 - RNA, 11 nt, Homo sapiens
cuuccaugccc

SEQ ID NO: 1078108 - RNA, 22 nt, Homo sapiens
cuuccugggaugaugugugaaa

SEQ ID NO: 1078109 - RNA, 13 nt, Homo sapiens
cuucgaugacugg

SEQ ID NO: 1078110 - RNA, 21 nt, Homo sapiens
cuucucccuugcccucccuuu

SEQ ID NO: 1078111 - RNA, 20 nt, Homo sapiens
cuucuggagucuccaguggu

SEQ ID NO: 1078112 - RNA, 15 nt, Homo sapiens
cuucuuagcugucac

SEQ ID NO: 1078113 - RNA, 18 nt, Homo sapiens
cuugagcuuggcagcuga

SEQ ID NO: 1078114 - RNA, 16 nt, Homo sapiens
agcuccugaccaaaga

SEQ ID NO: 1078115 - RNA, 16 nt, Homo sapiens
agcucugaacaaaagc

SEQ ID NO: 1078116 - RNA, 13 nt, Homo sapiens
agcuugcagugag

SEQ ID NO: 1078117 - RNA, 20 nt, Homo sapiens
aggaaaaucuuaaaauucuu

SEQ ID NO: 1078118 - RNA, 16 nt, Homo sapiens
aggagaucgagaccau

SEQ ID NO: 1078119 - RNA, 17 nt, Homo sapiens
aggaucgccugagccca

SEQ ID NO: 1078120 - RNA, 21 nt, Homo sapiens
aggauuuccucuugaaccaga

SEQ ID NO: 1078121 - RNA, 16 nt, Homo sapiens
aggcaaauauaagcug

SEQ ID NO: 1078122 - RNA, 17 nt, Homo sapiens
aggcaggagaauggugu

SEQ ID NO: 1078123 - RNA, 11 nt, Homo sapiens
aggcaggugag

SEQ ID NO: 1078124 - RNA, 21 nt, Homo sapiens
aggccggugugggcugugucg

SEQ ID NO: 1078125 - RNA, 18 nt, Homo sapiens
aggcggguggaucaccug

SEQ ID NO: 1078126 - RNA, 20 nt, Homo sapiens
aggcggguggaucacuugag

SEQ ID NO: 1078127 - RNA, 12 nt, Homo sapiens
aggcugguggga

SEQ ID NO: 1078128 - RNA, 19 nt, Homo sapiens
agggaaccgugauaagccu

SEQ ID NO: 1078129 - RNA, 18 nt, Homo sapiens
agggaacgggguccuuca

SEQ ID NO: 1078130 - RNA, 17 nt, Homo sapiens
agggacaaaacacugug

SEQ ID NO: 1078131 - RNA, 11 nt, Homo sapiens
agggacacaau

SEQ ID NO: 1078132 - RNA, 16 nt, Homo sapiens
agggacuccaguucac

SEQ ID NO: 1078133 - RNA, 17 nt, Homo sapiens
aggggaggaucacugga

SEQ ID NO: 1078134 - RNA, 13 nt, Homo sapiens
agggggcgugccu

SEQ ID NO: 1078135 - RNA, 21 nt, Homo sapiens
agggucaagggcuggggcuga

SEQ ID NO: 1078136 - RNA, 17 nt, Homo sapiens
agguaaacaaacaaaua

SEQ ID NO: 1078137 - RNA, 13 nt, Homo sapiens
aggucuccgggga

SEQ ID NO: 1078138 - RNA, 15 nt, Homo sapiens
aggugagaccaccuc

SEQ ID NO: 1078139 - RNA, 17 nt, Homo sapiens
agguggaggugccagga

SEQ ID NO: 1078140 - RNA, 16 nt, Homo sapiens
agguggccugcgggga

SEQ ID NO: 1078141 - RNA, 20 nt, Homo sapiens
agguggguuuguaccuuccu

SEQ ID NO: 1078142 - RNA, 14 nt, Homo sapiens
agguucuuuccaug

SEQ ID NO: 1078143 - RNA, 21 nt, Homo sapiens
agguuggugacugaaacauuc

SEQ ID NO: 1078144 - RNA, 14 nt, Homo sapiens
aguaaacacugugu

SEQ ID NO: 1078145 - RNA, 20 nt, Homo sapiens
aguaauuuugugaaagaagg

SEQ ID NO: 1078146 - RNA, 15 nt, Homo sapiens
aguaccacucaggcc

SEQ ID NO: 1078147 - RNA, 14 nt, Homo sapiens
aguagugucuuccu

SEQ ID NO: 1078148 - RNA, 19 nt, Homo sapiens
agucccgucccugcccaga

SEQ ID NO: 1078149 - RNA, 23 nt, Homo sapiens
agucccugacucucugugaccug

SEQ ID NO: 1078150 - RNA, 18 nt, Homo sapiens
aguccgcagucuggccug

SEQ ID NO: 1078151 - RNA, 23 nt, Homo sapiens
aguccucuggauggcaccagagg

SEQ ID NO: 1078152 - RNA, 18 nt, Homo sapiens
agucucuaugaucuuggc

SEQ ID NO: 1078153 - RNA, 18 nt, Homo sapiens
agucucugugcuuugacu

SEQ ID NO: 1078154 - RNA, 20 nt, Homo sapiens
agucuuuauuguguaucaua

SEQ ID NO: 1078155 - RNA, 20 nt, Homo sapiens
agugacuuuagaaacaaauu

SEQ ID NO: 1078156 - RNA, 17 nt, Homo sapiens
agugauaugauguguag

SEQ ID NO: 1078157 - RNA, 13 nt, Homo sapiens
agugccugagaca

SEQ ID NO: 1078158 - RNA, 14 nt, Homo sapiens
aguggaacaugcaa

SEQ ID NO: 1078159 - RNA, 23 nt, Homo sapiens
aguggaacaugcaaggcacugac

SEQ ID NO: 1078160 - RNA, 21 nt, Homo sapiens
aguggcucacgccuaugaucc

SEQ ID NO: 1078161 - RNA, 23 nt, Homo sapiens
aguggcucacgccuaugauccca

SEQ ID NO: 1078162 - RNA, 21 nt, Homo sapiens
aguggggcagccuccuugccu

SEQ ID NO: 1078163 - RNA, 22 nt, Homo sapiens
aguggggcagccuccuugccug

SEQ ID NO: 1078164 - RNA, 21 nt, Homo sapiens
agugggguuuuauauccauuu

SEQ ID NO: 1078165 - RNA, 18 nt, Homo sapiens
aguggugcaugcacuguc

SEQ ID NO: 1078166 - RNA, 13 nt, Homo sapiens
aguguucaagaaa

SEQ ID NO: 1078167 - RNA, 21 nt, Homo sapiens
aguguucauuuuagugacugu

SEQ ID NO: 1078168 - RNA, 13 nt, Homo sapiens
aguucuaucagga

SEQ ID NO: 1078169 - RNA, 16 nt, Homo sapiens
auaaaaacaaaaccac

SEQ ID NO: 1078170 - RNA, 20 nt, Homo sapiens
auaaacacccaugaaucaaa

SEQ ID NO: 1078171 - RNA, 16 nt, Homo sapiens
auaacauagaauugca

SEQ ID NO: 1078172 - RNA, 21 nt, Homo sapiens
auaacaugucuuucagcauua

SEQ ID NO: 1078173 - RNA, 20 nt, Homo sapiens
auaaccuucaugaugaauua

SEQ ID NO: 1078174 - RNA, 23 nt, Homo sapiens
auaaccuucaugaugaauuacuu

SEQ ID NO: 1078175 - RNA, 20 nt, Homo sapiens
auaauauuuguguguucacu

SEQ ID NO: 1078176 - RNA, 14 nt, Homo sapiens
auacagaaugaauc

SEQ ID NO: 1078177 - RNA, 18 nt, Homo sapiens
auaccagugaaccaaaga

SEQ ID NO: 1078178 - RNA, 12 nt, Homo sapiens
auagaaacugag

SEQ ID NO: 1078179 - RNA, 12 nt, Homo sapiens
auagaaacugau

SEQ ID NO: 1078180 - RNA, 17 nt, Homo sapiens
auaguuaaucuauaacu

SEQ ID NO: 1078181 - RNA, 22 nt, Homo sapiens
auauugaauagggcuaggaaua

SEQ ID NO: 1078182 - RNA, 14 nt, Homo sapiens
auauuuacaaccua

SEQ ID NO: 1078183 - RNA, 16 nt, Homo sapiens
auauuuacaaccuaga

SEQ ID NO: 1078184 - RNA, 21 nt, Homo sapiens
aucaaagacauggaauuaccu

SEQ ID NO: 1078185 - RNA, 15 nt, Homo sapiens
aucaccucaggccag

SEQ ID NO: 1078186 - RNA, 23 nt, Homo sapiens
aucacucucugcuggcaggauuc

SEQ ID NO: 1078187 - RNA, 19 nt, Homo sapiens
aucagagcugcagccaguc

SEQ ID NO: 1078188 - RNA, 14 nt, Homo sapiens
aucaggacugugac

SEQ ID NO: 1078189 - RNA, 15 nt, Homo sapiens
aucaggacugugacc

SEQ ID NO: 1078190 - RNA, 21 nt, Homo sapiens
aucagucuuggaauacuugaa

SEQ ID NO: 1078191 - RNA, 23 nt, Homo sapiens
aucaugacccacccagugucuuu

SEQ ID NO: 1078192 - RNA, 15 nt, Homo sapiens
aucauugcaccugca

SEQ ID NO: 1078193 - RNA, 19 nt, Homo sapiens
auccaaccccccaccugcc

SEQ ID NO: 1078194 - RNA, 24 nt, Homo sapiens
auccagaauggaauuuugcuacau

SEQ ID NO: 1078195 - RNA, 14 nt, Homo sapiens
aucccagcacuuug

SEQ ID NO: 1078196 - RNA, 15 nt, Homo sapiens
aucccagcacuuugg

SEQ ID NO: 1078197 - RNA, 19 nt, Homo sapiens
aucccaggaugggugucug

SEQ ID NO: 1078198 - RNA, 18 nt, Homo sapiens
auccuggcuaacacguga

SEQ ID NO: 1078199 - RNA, 14 nt, Homo sapiens
aucgagccacugca

SEQ ID NO: 1078200 - RNA, 16 nt, Homo sapiens
aucgcugccuugccau

SEQ ID NO: 1078201 - RNA, 16 nt, Homo sapiens
aucguccagugacuuu

SEQ ID NO: 1078202 - RNA, 17 nt, Homo sapiens
aucuacagcucaccucu

SEQ ID NO: 1078203 - RNA, 19 nt, Homo sapiens
aucuauaacuacauauuga

SEQ ID NO: 1078204 - RNA, 14 nt, Homo sapiens
aucucaaauucuca

SEQ ID NO: 1078205 - RNA, 19 nt, Homo sapiens
aucucacucuguugcccag

SEQ ID NO: 1078206 - RNA, 13 nt, Homo sapiens
aucucucuacucc

SEQ ID NO: 1078207 - RNA, 22 nt, Homo sapiens
augaaacuccugauuuuguagu

SEQ ID NO: 1078208 - RNA, 20 nt, Homo sapiens
augaaauucuugaaguucau

SEQ ID NO: 1078209 - RNA, 17 nt, Homo sapiens
augaacuggaccugcac

SEQ ID NO: 1078210 - RNA, 20 nt, Homo sapiens
augaauagaugugaucacug

SEQ ID NO: 1078211 - RNA, 14 nt, Homo sapiens
augaaucaaagaca

SEQ ID NO: 1078212 - RNA, 15 nt, Homo sapiens
augaauuuggccaga

SEQ ID NO: 1078213 - RNA, 23 nt, Homo sapiens
augacaccuccauuucucuccag

SEQ ID NO: 1078214 - RNA, 20 nt, Homo sapiens
augagcauuagcuacuuuuc

SEQ ID NO: 1078215 - RNA, 16 nt, Homo sapiens
augagggugacuguca

SEQ ID NO: 1078216 - RNA, 17 nt, Homo sapiens
augagggugacugucaa

SEQ ID NO: 1078217 - RNA, 19 nt, Homo sapiens
augaucgagccacugcacu

SEQ ID NO: 1078218 - RNA, 12 nt, Homo sapiens
augaucuuggca

SEQ ID NO: 1078219 - RNA, 15 nt, Homo sapiens
augauguguagggcu

SEQ ID NO: 1078220 - RNA, 20 nt, Homo sapiens
augcaaaugccuccaagcca

SEQ ID NO: 1078221 - RNA, 11 nt, Homo sapiens
augccacugcu

SEQ ID NO: 1078222 - RNA, 14 nt, Homo sapiens
augccacuucccag

SEQ ID NO: 1078223 - RNA, 16 nt, Homo sapiens
augccuccaagccauu

SEQ ID NO: 1078224 - RNA, 20 nt, Homo sapiens
aaagcgagaucccaucucua

SEQ ID NO: 1078225 - RNA, 22 nt, Homo sapiens
aaagcugcugagaaucuagccu

SEQ ID NO: 1078226 - RNA, 13 nt, Homo sapiens
aaagggacacaau

SEQ ID NO: 1078227 - RNA, 13 nt, Homo sapiens
aaaggucacuuuu

SEQ ID NO: 1078228 - RNA, 11 nt, Homo sapiens
aaaguauauau

SEQ ID NO: 1078229 - RNA, 22 nt, Homo sapiens
aaaguaugccuuccuguuuaaa

SEQ ID NO: 1078230 - RNA, 19 nt, Homo sapiens
aaauauguugaguguucau

SEQ ID NO: 1078231 - RNA, 18 nt, Homo sapiens
aaaucacuuuaccugcag

SEQ ID NO: 1078232 - RNA, 13 nt, Homo sapiens
aaaugacccaaag

SEQ ID NO: 1078233 - RNA, 16 nt, Homo sapiens
aaaugcaaguguuuga

SEQ ID NO: 1078234 - RNA, 14 nt, Homo sapiens
aaauuccuguagca

SEQ ID NO: 1078235 - RNA, 19 nt, Homo sapiens
aacaaaauccaacccuguc

SEQ ID NO: 1078236 - RNA, 21 nt, Homo sapiens
aacaacguucuuaguuuacuu

SEQ ID NO: 1078237 - RNA, 13 nt, Homo sapiens
aacacaagccaca

SEQ ID NO: 1078238 - RNA, 14 nt, Homo sapiens
aacacaagccacag

SEQ ID NO: 1078239 - RNA, 18 nt, Homo sapiens
aacacccaugaaucaaag

SEQ ID NO: 1078240 - RNA, 15 nt, Homo sapiens
aacacuaagcucucu

SEQ ID NO: 1078241 - RNA, 12 nt, Homo sapiens
aacaugcuugug

SEQ ID NO: 1078242 - RNA, 16 nt, Homo sapiens
aacaugguaaaacccc

SEQ ID NO: 1078243 - RNA, 16 nt, Homo sapiens
aaccaaagagacugga

SEQ ID NO: 1078244 - RNA, 19 nt, Homo sapiens
aaccaaauguaacuauguu

SEQ ID NO: 1078245 - RNA, 18 nt, Homo sapiens
aaccgacuuuucuaaagc

SEQ ID NO: 1078246 - RNA, 19 nt, Homo sapiens
aaccgcuugccauauuccg

SEQ ID NO: 1078247 - RNA, 20 nt, Homo sapiens
aaccgcuugccauauuccga

SEQ ID NO: 1078248 - RNA, 20 nt, Homo sapiens
aaccucaggcuuccuuggca

SEQ ID NO: 1078249 - RNA, 13 nt, Homo sapiens
aaccugugucuua

SEQ ID NO: 1078250 - RNA, 17 nt, Homo sapiens
aacuagaaaucugccaa

SEQ ID NO: 1078251 - RNA, 17 nt, Homo sapiens
aacuauguuuuaucguc

SEQ ID NO: 1078252 - RNA, 19 nt, Homo sapiens
aacugaggccauuauuuca

SEQ ID NO: 1078253 - RNA, 16 nt, Homo sapiens
aacugcaguuugauca

SEQ ID NO: 1078254 - RNA, 17 nt, Homo sapiens
aagaaauuccuguagca

SEQ ID NO: 1078255 - RNA, 22 nt, Homo sapiens
aagaaauuccuguagcaucuuc

SEQ ID NO: 1078256 - RNA, 15 nt, Homo sapiens
aagaaucaagcuaga

SEQ ID NO: 1078257 - RNA, 21 nt, Homo sapiens
aagacagagaagaccaaagca

SEQ ID NO: 1078258 - RNA, 15 nt, Homo sapiens
aagaccaaagcauug

SEQ ID NO: 1078259 - RNA, 14 nt, Homo sapiens
aagaccaauauuca

SEQ ID NO: 1078260 - RNA, 17 nt, Homo sapiens
aagacuugagccaucca

SEQ ID NO: 1078261 - RNA, 17 nt, Homo sapiens
aagauaucagagcucuu

SEQ ID NO: 1078262 - RNA, 15 nt, Homo sapiens
aagauuauuugcacg

SEQ ID NO: 1078263 - RNA, 12 nt, Homo sapiens
aagcacaugugu

SEQ ID NO: 1078264 - RNA, 15 nt, Homo sapiens
aagcagaagcacaua

SEQ ID NO: 1078265 - RNA, 13 nt, Homo sapiens
aagcaucagagau

SEQ ID NO: 1078266 - RNA, 17 nt, Homo sapiens
aagccaaacucugccag

SEQ ID NO: 1078267 - RNA, 11 nt, Homo sapiens
aagccacugaa

SEQ ID NO: 1078268 - RNA, 13 nt, Homo sapiens
aagccugaggcug

SEQ ID NO: 1078269 - RNA, 22 nt, Homo sapiens
aagcucacacagcaggaacuga

SEQ ID NO: 1078270 - RNA, 20 nt, Homo sapiens
aagcucccucccucacugug

SEQ ID NO: 1078271 - RNA, 14 nt, Homo sapiens
aaggccacauguca

SEQ ID NO: 1078272 - RNA, 19 nt, Homo sapiens
aaggccacaugucaccgug

SEQ ID NO: 1078273 - RNA, 13 nt, Homo sapiens
aaggcucagucuc

SEQ ID NO: 1078274 - RNA, 12 nt, Homo sapiens
aaggcugugcuc

SEQ ID NO: 1078275 - RNA, 18 nt, Homo sapiens
aaggcugugcucuuccuc

SEQ ID NO: 1078276 - RNA, 15 nt, Homo sapiens
aagggugacauccca

SEQ ID NO: 1078277 - RNA, 17 nt, Homo sapiens
aagguggccugcgggga

SEQ ID NO: 1078278 - RNA, 15 nt, Homo sapiens
aaguaaguaccacuc

SEQ ID NO: 1078279 - RNA, 18 nt, Homo sapiens
aaguaaguaccacucagg

SEQ ID NO: 1078280 - RNA, 15 nt, Homo sapiens
aaguaccacucaggc

SEQ ID NO: 1078281 - RNA, 18 nt, Homo sapiens
aaguauauauucuacaca

SEQ ID NO: 1078282 - RNA, 14 nt, Homo sapiens
aaguaugccuuccu

SEQ ID NO: 1078283 - RNA, 13 nt, Homo sapiens
aagucagcuuuca

SEQ ID NO: 1078284 - RNA, 15 nt, Homo sapiens
aaguucuaaguucau

SEQ ID NO: 1078285 - RNA, 17 nt, Homo sapiens
cagccagguuagccuuu

SEQ ID NO: 1078286 - RNA, 22 nt, Homo sapiens
cagccugagcaacagagugaga

SEQ ID NO: 1078287 - RNA, 19 nt, Homo sapiens
cagcuauuuucugaccaaa

SEQ ID NO: 1078288 - RNA, 14 nt, Homo sapiens
cagcuccugaccaa

SEQ ID NO: 1078289 - RNA, 17 nt, Homo sapiens
cagcuccugaccaaaga

SEQ ID NO: 1078290 - RNA, 18 nt, Homo sapiens
cagcuccugaccaaagac

SEQ ID NO: 1078291 - RNA, 12 nt, Homo sapiens
cagcuuggcacu

SEQ ID NO: 1078292 - RNA, 18 nt, Homo sapiens
caggaaaaagacuaagcc

SEQ ID NO: 1078293 - RNA, 19 nt, Homo sapiens
caggaauugcccauuguuu

SEQ ID NO: 1078294 - RNA, 23 nt, Homo sapiens
caggacaccagccuggugcccau

SEQ ID NO: 1078295 - RNA, 17 nt, Homo sapiens
caggacugugaccaaag

SEQ ID NO: 1078296 - RNA, 18 nt, Homo sapiens
caggagaauggugugaac

SEQ ID NO: 1078297 - RNA, 19 nt, Homo sapiens
caggagaauggugugaacc

SEQ ID NO: 1078298 - RNA, 18 nt, Homo sapiens
caggagguuggugacuga

SEQ ID NO: 1078299 - RNA, 22 nt, Homo sapiens
caggaguuugaggcugcagcga

SEQ ID NO: 1078300 - RNA, 17 nt, Homo sapiens
caggccaaggcuaugaa

SEQ ID NO: 1078301 - RNA, 18 nt, Homo sapiens
caggccagaaaacauaug

SEQ ID NO: 1078302 - RNA, 14 nt, Homo sapiens
caggcuuucucugg

SEQ ID NO: 1078303 - RNA, 18 nt, Homo sapiens
cagggaaagcccguguca

SEQ ID NO: 1078304 - RNA, 22 nt, Homo sapiens
cagggaaccgugauaagccuuu

SEQ ID NO: 1078305 - RNA, 13 nt, Homo sapiens
cagggaauuucag

SEQ ID NO: 1078306 - RNA, 21 nt, Homo sapiens
cagggacaaaacacugugucc

SEQ ID NO: 1078307 - RNA, 21 nt, Homo sapiens
cagggcccugcagaggggaaa

SEQ ID NO: 1078308 - RNA, 22 nt, Homo sapiens
caggguguuaaggcagugacuu

SEQ ID NO: 1078309 - RNA, 14 nt, Homo sapiens
cagguuagccuuug

SEQ ID NO: 1078310 - RNA, 12 nt, Homo sapiens
caguaaacacug

SEQ ID NO: 1078311 - RNA, 13 nt, Homo sapiens
caguaaacacugu

SEQ ID NO: 1078312 - RNA, 23 nt, Homo sapiens
caguccugggagaaccucaggcu

SEQ ID NO: 1078313 - RNA, 14 nt, Homo sapiens
cagugaaccaaaga

SEQ ID NO: 1078314 - RNA, 21 nt, Homo sapiens
cagugaaccaaagagacugga

SEQ ID NO: 1078315 - RNA, 17 nt, Homo sapiens
cagugacuuuagaaaca

SEQ ID NO: 1078316 - RNA, 13 nt, Homo sapiens
cagugcccaugca

SEQ ID NO: 1078317 - RNA, 21 nt, Homo sapiens
cagugcuguggccugggcaag

SEQ ID NO: 1078318 - RNA, 23 nt, Homo sapiens
cagugugaucccaagugccaguc

SEQ ID NO: 1078319 - RNA, 17 nt, Homo sapiens
cagugugcaguggugca

SEQ ID NO: 1078320 - RNA, 19 nt, Homo sapiens
cagugugcaguggugcaug

SEQ ID NO: 1078321 - RNA, 11 nt, Homo sapiens
cauacuuccug

SEQ ID NO: 1078322 - RNA, 11 nt, Homo sapiens
cauaugaacug

SEQ ID NO: 1078323 - RNA, 17 nt, Homo sapiens
cauauuuacaaccuaga

SEQ ID NO: 1078324 - RNA, 14 nt, Homo sapiens
cauccugcuuccug

SEQ ID NO: 1078325 - RNA, 16 nt, Homo sapiens
caucuagccagaggcu

SEQ ID NO: 1078326 - RNA, 23 nt, Homo sapiens
caucugacucacaagaagaccag

SEQ ID NO: 1078327 - RNA, 15 nt, Homo sapiens
caugaaucaaagaca

SEQ ID NO: 1078328 - RNA, 14 nt, Homo sapiens
caugcuggggcaag

SEQ ID NO: 1078329 - RNA, 16 nt, Homo sapiens
caugucuuguucagaa

SEQ ID NO: 1078330 - RNA, 19 nt, Homo sapiens
cauguggccccaggugcca

SEQ ID NO: 1078331 - RNA, 21 nt, Homo sapiens
cauuaacagcaggugugaccc

SEQ ID NO: 1078332 - RNA, 16 nt, Homo sapiens
cauuagcuacuuuuca

SEQ ID NO: 1078333 - RNA, 17 nt, Homo sapiens
cauugcaucauuuacaa

SEQ ID NO: 1078334 - RNA, 14 nt, Homo sapiens
cauuugagugucuu

SEQ ID NO: 1078335 - RNA, 15 nt, Homo sapiens
cauuuuagugacugu

SEQ ID NO: 1078336 - RNA, 13 nt, Homo sapiens
cauuuugcauuag

SEQ ID NO: 1078337 - RNA, 15 nt, Homo sapiens
cauuuuguuauagaa

SEQ ID NO: 1078338 - RNA, 14 nt, Homo sapiens
ccaaaagaugccuu

SEQ ID NO: 1078339 - RNA, 15 nt, Homo sapiens
ccaaaaguacuuacc

SEQ ID NO: 1078340 - RNA, 16 nt, Homo sapiens
ccaaagacuacacugu

SEQ ID NO: 1078341 - RNA, 18 nt, Homo sapiens
ccaaagacuacacuguug

SEQ ID NO: 1078342 - RNA, 16 nt, Homo sapiens
ccaaagagacuggagc

SEQ ID NO: 1078343 - RNA, 12 nt, Homo sapiens
ccaaagcacagc

SEQ ID NO: 1078344 - RNA, 13 nt, Homo sapiens
ccaaagcauugcc

SEQ ID NO: 1078345 - RNA, 14 nt, Homo sapiens
ccaaagcugcuuuc

SEQ ID NO: 1078346 - RNA, 15 nt, Homo sapiens
ccaacgacaaagcca

SEQ ID NO: 1078347 - RNA, 17 nt, Homo sapiens
ccaagccauucacuucc

SEQ ID NO: 1078348 - RNA, 17 nt, Homo sapiens
ccaagccccugccucca

SEQ ID NO: 1078349 - RNA, 23 nt, Homo sapiens
ccaaggaggcaggauucuuccca

SEQ ID NO: 1078350 - RNA, 12 nt, Homo sapiens
ccaccugccauu

SEQ ID NO: 1078351 - RNA, 15 nt, Homo sapiens
ccacucaggccaaca

SEQ ID NO: 1078352 - RNA, 20 nt, Homo sapiens
ccacugacacccaguguccu

SEQ ID NO: 1078353 - RNA, 18 nt, Homo sapiens
ccagaccauugucuucca

SEQ ID NO: 1078354 - RNA, 23 nt, Homo sapiens
ccagaugccuccccaagacuguc

SEQ ID NO: 1078355 - RNA, 12 nt, Homo sapiens
ccagauguggug

SEQ ID NO: 1078356 - RNA, 21 nt, Homo sapiens
ccagcuacuugggaggcugag

SEQ ID NO: 1078357 - RNA, 19 nt, Homo sapiens
ccagggacaaaacacugug

SEQ ID NO: 1078358 - RNA, 18 nt, Homo sapiens
ccagguggaggugccagg

SEQ ID NO: 1078359 - RNA, 22 nt, Homo sapiens
ccagucacugucccucaaauga

SEQ ID NO: 1078360 - RNA, 13 nt, Homo sapiens
ccagugacuuuca

SEQ ID NO: 1078361 - RNA, 13 nt, Homo sapiens
ccauagaaacuga

SEQ ID NO: 1078362 - RNA, 16 nt, Homo sapiens
ccauagaaacugaggc

SEQ ID NO: 1078363 - RNA, 14 nt, Homo sapiens
ccaugaaucaaaga

SEQ ID NO: 1078364 - RNA, 16 nt, Homo sapiens
ccaugaaucaaagaca

SEQ ID NO: 1078365 - RNA, 13 nt, Homo sapiens
ccauucaaacagg

SEQ ID NO: 1078366 - RNA, 15 nt, Homo sapiens
ccauucccguggucu

SEQ ID NO: 1078367 - RNA, 14 nt, Homo sapiens
ccauugaccagcuc

SEQ ID NO: 1078368 - RNA, 16 nt, Homo sapiens
cccacccacaugacuu

SEQ ID NO: 1078369 - RNA, 19 nt, Homo sapiens
cccaccuagugcuuccacu

SEQ ID NO: 1078370 - RNA, 12 nt, Homo sapiens
cccagcacuuug

SEQ ID NO: 1078371 - RNA, 12 nt, Homo sapiens
cccagcuuccug

SEQ ID NO: 1078372 - RNA, 17 nt, Homo sapiens
cccaggcuggagugcag

SEQ ID NO: 1078373 - RNA, 14 nt, Homo sapiens
cccaguguccuucc

SEQ ID NO: 1078374 - RNA, 21 nt, Homo sapiens
cccaugaaucaaagacaugga

SEQ ID NO: 1078375 - RNA, 21 nt, Homo sapiens
ccccagcuauuuucugaccaa

SEQ ID NO: 1078376 - RNA, 15 nt, Homo sapiens
cccuaaacucaggag

SEQ ID NO: 1078377 - RNA, 10 nt, Homo sapiens
cccucaggcc

SEQ ID NO: 1078378 - RNA, 22 nt, Homo sapiens
cccugacucucugugaccugcc

SEQ ID NO: 1078379 - RNA, 22 nt, Homo sapiens
cccuggcccugccucauccacc

SEQ ID NO: 1078380 - RNA, 23 nt, Homo sapiens
ccgaugcugaggccacccacuga

SEQ ID NO: 1078381 - RNA, 14 nt, Homo sapiens
ccgcucuggaccaa

SEQ ID NO: 1078382 - RNA, 22 nt, Homo sapiens
ccgcuugcucuccuggagcaag

SEQ ID NO: 1078383 - RNA, 17 nt, Homo sapiens
ccggagagacagugaca

SEQ ID NO: 1078384 - RNA, 21 nt, Homo sapiens
ccuaaauguggacaucaugaa

SEQ ID NO: 1078385 - RNA, 20 nt, Homo sapiens
ccuauagucccagcuacuca

SEQ ID NO: 1078386 - RNA, 12 nt, Homo sapiens
ccuaugauccca

SEQ ID NO: 1078387 - RNA, 15 nt, Homo sapiens
ccucagccccacuga

SEQ ID NO: 1078388 - RNA, 14 nt, Homo sapiens
ccucaggucuccac

SEQ ID NO: 1078389 - RNA, 14 nt, Homo sapiens
ccuccagcacacac

SEQ ID NO: 1078390 - RNA, 15 nt, Homo sapiens
ccucguguccugcua

SEQ ID NO: 1078391 - RNA, 14 nt, Homo sapiens
ccucugcagcacuu

SEQ ID NO: 1078392 - RNA, 14 nt, Homo sapiens
ccucugcugccaug

SEQ ID NO: 1078393 - RNA, 15 nt, Homo sapiens
ccugacacaggccag

SEQ ID NO: 1078394 - RNA, 12 nt, Homo sapiens
ccugaccaaaga

SEQ ID NO: 1078395 - RNA, 22 nt, Homo sapiens
ccugaccaaagacgauacagcu

SEQ ID NO: 1078396 - RNA, 13 nt, Homo sapiens
ccugagcucugac

SEQ ID NO: 1078397 - RNA, 19 nt, Homo sapiens
ccugcaggccaagagcaga

SEQ ID NO: 1078398 - RNA, 18 nt, Homo sapiens
ccugccucauccaccaau

SEQ ID NO: 1078399 - RNA, 15 nt, Homo sapiens
ccugcucccagggac

SEQ ID NO: 1078400 - RNA, 21 nt, Homo sapiens
ccugcucugcuuccucagggc

SEQ ID NO: 1078401 - RNA, 23 nt, Homo sapiens
ccugcucuuucucugagaaccaa

SEQ ID NO: 1078402 - RNA, 18 nt, Homo sapiens
ccuguaaucccagcacuu

SEQ ID NO: 1078403 - RNA, 14 nt, Homo sapiens
ccugugagagccac

SEQ ID NO: 1078404 - RNA, 20 nt, Homo sapiens
ccuguuuaaaaaaaguauau

SEQ ID NO: 1078405 - RNA, 16 nt, Homo sapiens
ccuuagauuagcucug

SEQ ID NO: 1078406 - RNA, 19 nt, Homo sapiens
ccuucaaguuagcucagga

SEQ ID NO: 1078407 - RNA, 21 nt, Homo sapiens
ccuucaugaugaauuacuucu

SEQ ID NO: 1078408 - RNA, 16 nt, Homo sapiens
ccuuccaucuucacac

SEQ ID NO: 1078409 - RNA, 22 nt, Homo sapiens
ccuuuugcaacaagacaaagca

SEQ ID NO: 1078410 - RNA, 22 nt, Homo sapiens
cgacaaagccaaacucugccag

SEQ ID NO: 1078411 - RNA, 22 nt, Homo sapiens
cgagcuaugaucgcgccacuac

SEQ ID NO: 1078412 - RNA, 17 nt, Homo sapiens
cgagcugugcucgggug

SEQ ID NO: 1078413 - RNA, 20 nt, Homo sapiens
cgaugaauguguugauuuga

SEQ ID NO: 1078414 - RNA, 19 nt, Homo sapiens
cgcccagcugcaccugcca

SEQ ID NO: 1078415 - RNA, 17 nt, Homo sapiens
cgcucaccucagagcag

SEQ ID NO: 1078416 - RNA, 10 nt, Homo sapiens
cgcucuggac

SEQ ID NO: 1078417 - RNA, 16 nt, Homo sapiens
cggagcuugcagugag

SEQ ID NO: 1078418 - RNA, 21 nt, Homo sapiens
cggggaucaucucugugaccg

SEQ ID NO: 1078419 - RNA, 18 nt, Homo sapiens
cguguuacuguugcacug

SEQ ID NO: 1078420 - RNA, 20 nt, Homo sapiens
cguuaucacccaggccugau

SEQ ID NO: 1078421 - RNA, 20 nt, Homo sapiens
cuaaacugcuguuaauugau

SEQ ID NO: 1078422 - RNA, 12 nt, Homo sapiens
cuaaagauauca

SEQ ID NO: 1078423 - RNA, 14 nt, Homo sapiens
cuaaaggacuaaca

SEQ ID NO: 1078424 - RNA, 16 nt, Homo sapiens
cuaaagucacauauaa

SEQ ID NO: 1078425 - RNA, 15 nt, Homo sapiens
cuaagccaacuuuaa

SEQ ID NO: 1078426 - RNA, 12 nt, Homo sapiens
cuaauuccuguu

SEQ ID NO: 1078427 - RNA, 19 nt, Homo sapiens
cuacucgggaggcugaggc

SEQ ID NO: 1078428 - RNA, 15 nt, Homo sapiens
cuacuuguaaaggug

SEQ ID NO: 1078429 - RNA, 22 nt, Homo sapiens
cuagaacacccacuggccaguc

SEQ ID NO: 1078430 - RNA, 18 nt, Homo sapiens
cuagaaggccacauguca

SEQ ID NO: 1078431 - RNA, 14 nt, Homo sapiens
cuagagaugacuga

SEQ ID NO: 1078432 - RNA, 13 nt, Homo sapiens
cuauaaacacugu

SEQ ID NO: 1078433 - RNA, 20 nt, Homo sapiens
cuauaacauagaauugcaau

SEQ ID NO: 1078434 - RNA, 23 nt, Homo sapiens
cuauaacaugucuuucagcauua

SEQ ID NO: 1078435 - RNA, 12 nt, Homo sapiens
cuauagucccag

SEQ ID NO: 1078436 - RNA, 20 nt, Homo sapiens
cuaucuacugagacaugacu

SEQ ID NO: 1078437 - RNA, 17 nt, Homo sapiens
cuaugcaagccuugcua

SEQ ID NO: 1078438 - RNA, 21 nt, Homo sapiens
cuauucucggggcccugugua

SEQ ID NO: 1078439 - RNA, 16 nt, Homo sapiens
cucacucacucugggu

SEQ ID NO: 1078440 - RNA, 17 nt, Homo sapiens
cucaggcuuccuuggca

SEQ ID NO: 1078441 - RNA, 20 nt, Homo sapiens
cucaguuuuuaucaggcuuu

SEQ ID NO: 1078442 - RNA, 19 nt, Homo sapiens
cuccaagccauucacuucc

SEQ ID NO: 1078443 - RNA, 17 nt, Homo sapiens
cuccagugguugcuguu

SEQ ID NO: 1078444 - RNA, 17 nt, Homo sapiens
cucccagggacugacac

SEQ ID NO: 1078445 - RNA, 13 nt, Homo sapiens
cuccccaccuuca

SEQ ID NO: 1078446 - RNA, 21 nt, Homo sapiens
cuccccauacuuccugggaug

SEQ ID NO: 1078447 - RNA, 15 nt, Homo sapiens
cucccucacuguggg

SEQ ID NO: 1078448 - RNA, 15 nt, Homo sapiens
cucccuuucucucuc

SEQ ID NO: 1078449 - RNA, 13 nt, Homo sapiens
cuccugaccaaag

SEQ ID NO: 1078450 - RNA, 14 nt, Homo sapiens
cucuaugccaggcu

SEQ ID NO: 1078451 - RNA, 17 nt, Homo sapiens
cucuaugccaggcugug

SEQ ID NO: 1078452 - RNA, 16 nt, Homo sapiens
cucugagaaccaaaag

SEQ ID NO: 1078453 - RNA, 20 nt, Homo sapiens
uguguuauuauuuugcacug

SEQ ID NO: 1078454 - RNA, 16 nt, Homo sapiens
uguuaaacaugcuaaa

SEQ ID NO: 1078455 - RNA, 18 nt, Homo sapiens
uguuaaagcaucagagau

SEQ ID NO: 1078456 - RNA, 20 nt, Homo sapiens
uguuacuugaaauaccagug

SEQ ID NO: 1078457 - RNA, 17 nt, Homo sapiens
uguuauguuugcacuuu

SEQ ID NO: 1078458 - RNA, 18 nt, Homo sapiens
uguuauguuugcacuuug

SEQ ID NO: 1078459 - RNA, 18 nt, Homo sapiens
uguucacuaaacucugaa

SEQ ID NO: 1078460 - RNA, 15 nt, Homo sapiens
uguuccgugccaggc

SEQ ID NO: 1078461 - RNA, 16 nt, Homo sapiens
uguugcaaugacacau

SEQ ID NO: 1078462 - RNA, 19 nt, Homo sapiens
uguuggacccgcucuggac

SEQ ID NO: 1078463 - RNA, 18 nt, Homo sapiens
uguuuaccucuucuaugc

SEQ ID NO: 1078464 - RNA, 16 nt, Homo sapiens
uguuugguaccaagaa

SEQ ID NO: 1078465 - RNA, 21 nt, Homo sapiens
uguuuugcuuuuguaacuuga

SEQ ID NO: 1078466 - RNA, 12 nt, Homo sapiens
uguuuuguacaa

SEQ ID NO: 1078467 - RNA, 15 nt, Homo sapiens
uuaaaaaagcuauaa

SEQ ID NO: 1078468 - RNA, 21 nt, Homo sapiens
uuaaaaucuggcaaaguuaua

SEQ ID NO: 1078469 - RNA, 15 nt, Homo sapiens
uuaaaccacuguaua

SEQ ID NO: 1078470 - RNA, 15 nt, Homo sapiens
uuaaagcugcuguca

SEQ ID NO: 1078471 - RNA, 14 nt, Homo sapiens
uuaagaaacacagg

SEQ ID NO: 1078472 - RNA, 15 nt, Homo sapiens
uuaagaaacacaggg

SEQ ID NO: 1078473 - RNA, 22 nt, Homo sapiens
uuaagcaugacgggaaaaccaa

SEQ ID NO: 1078474 - RNA, 16 nt, Homo sapiens
uuaagcccugcucuuu

SEQ ID NO: 1078475 - RNA, 15 nt, Homo sapiens
uuacccuauaucuau

SEQ ID NO: 1078476 - RNA, 17 nt, Homo sapiens
uuaccucuucuaugcaa

SEQ ID NO: 1078477 - RNA, 13 nt, Homo sapiens
uuagacagaugac

SEQ ID NO: 1078478 - RNA, 18 nt, Homo sapiens
uuagagacuaaggggcag

SEQ ID NO: 1078479 - RNA, 20 nt, Homo sapiens
uuagaugugcugcuuugaua

SEQ ID NO: 1078480 - RNA, 12 nt, Homo sapiens
uuagcugucacc

SEQ ID NO: 1078481 - RNA, 14 nt, Homo sapiens
uuauagguuuccac

SEQ ID NO: 1078482 - RNA, 15 nt, Homo sapiens
uuauagguuuccacu

SEQ ID NO: 1078483 - RNA, 23 nt, Homo sapiens
uuaugagucucuaugaucuuggc

SEQ ID NO: 1078484 - RNA, 23 nt, Homo sapiens
uuauugccucugaaaugccucuu

SEQ ID NO: 1078485 - RNA, 17 nt, Homo sapiens
uucaccaaaugaugcca

SEQ ID NO: 1078486 - RNA, 18 nt, Homo sapiens
uucaggaguuggagacca

SEQ ID NO: 1078487 - RNA, 16 nt, Homo sapiens
uucaggcuuuaggcau

SEQ ID NO: 1078488 - RNA, 16 nt, Homo sapiens
uucauucugaugucca

SEQ ID NO: 1078489 - RNA, 16 nt, Homo sapiens
uuccacuucuaugcaa

SEQ ID NO: 1078490 - RNA, 19 nt, Homo sapiens
uuccccccaccccccagca

SEQ ID NO: 1078491 - RNA, 15 nt, Homo sapiens
uuccuuucaggccaa

SEQ ID NO: 1078492 - RNA, 20 nt, Homo sapiens
uucggacagugcccaugcaa

SEQ ID NO: 1078493 - RNA, 21 nt, Homo sapiens
uucuagcuuuguuguccuccc

SEQ ID NO: 1078494 - RNA, 22 nt, Homo sapiens
uucucaguaaauauuaaccuga

SEQ ID NO: 1078495 - RNA, 23 nt, Homo sapiens
uucucaguaaauauuaaccugaa

SEQ ID NO: 1078496 - RNA, 22 nt, Homo sapiens
uucugaacuggaacaugggcau

SEQ ID NO: 1078497 - RNA, 21 nt, Homo sapiens
uucugauguccauuuguccca

SEQ ID NO: 1078498 - RNA, 21 nt, Homo sapiens
uucugggccacucaggccagu

SEQ ID NO: 1078499 - RNA, 13 nt, Homo sapiens
uucuuagcuguca

SEQ ID NO: 1078500 - RNA, 16 nt, Homo sapiens
uugaaauaccagugaa

SEQ ID NO: 1078501 - RNA, 22 nt, Homo sapiens
uugaaaucaguaaacacugugu

SEQ ID NO: 1078502 - RNA, 20 nt, Homo sapiens
uugaaggagaaaaugcauua

SEQ ID NO: 1078503 - RNA, 18 nt, Homo sapiens
uugaauagggcuaggaau

SEQ ID NO: 1078504 - RNA, 18 nt, Homo sapiens
uugagaauacacuaucaa

SEQ ID NO: 1078505 - RNA, 14 nt, Homo sapiens
auaugcauuaugaa

SEQ ID NO: 1078506 - RNA, 19 nt, Homo sapiens
auauugauaaaaccauaca

SEQ ID NO: 1078507 - RNA, 20 nt, Homo sapiens
aucaacuuguguacugauaa

SEQ ID NO: 1078508 - RNA, 21 nt, Homo sapiens
aucacgccacugcacuccagc

SEQ ID NO: 1078509 - RNA, 20 nt, Homo sapiens
aucaggacugugaccaaagc

SEQ ID NO: 1078510 - RNA, 15 nt, Homo sapiens
aucaguaaacacugu

SEQ ID NO: 1078511 - RNA, 19 nt, Homo sapiens
aucauacuccuaugcuuua

SEQ ID NO: 1078512 - RNA, 16 nt, Homo sapiens
aucaugcuguucucuu

SEQ ID NO: 1078513 - RNA, 21 nt, Homo sapiens
auccauuuuuaucaggauuuc

SEQ ID NO: 1078514 - RNA, 15 nt, Homo sapiens
aucccaccacugcac

SEQ ID NO: 1078515 - RNA, 13 nt, Homo sapiens
aucuauaaacacu

SEQ ID NO: 1078516 - RNA, 16 nt, Homo sapiens
aucuauaaacacuguu

SEQ ID NO: 1078517 - RNA, 20 nt, Homo sapiens
aucucuaaacugcuguuaau

SEQ ID NO: 1078518 - RNA, 13 nt, Homo sapiens
aucugaacacagu

SEQ ID NO: 1078519 - RNA, 23 nt, Homo sapiens
aucugacucacaagaagaccaga

SEQ ID NO: 1078520 - RNA, 21 nt, Homo sapiens
aucuucacacugguuugccag

SEQ ID NO: 1078521 - RNA, 17 nt, Homo sapiens
augaaucaaagacaugg

SEQ ID NO: 1078522 - RNA, 19 nt, Homo sapiens
augaaucccauaauugaca

SEQ ID NO: 1078523 - RNA, 13 nt, Homo sapiens
augacccaaagac

SEQ ID NO: 1078524 - RNA, 17 nt, Homo sapiens
augacccacccaguguc

SEQ ID NO: 1078525 - RNA, 22 nt, Homo sapiens
augacggcugcucgaagaacaa

SEQ ID NO: 1078526 - RNA, 12 nt, Homo sapiens
augaguggcuuc

SEQ ID NO: 1078527 - RNA, 15 nt, Homo sapiens
augaugccacuuccc

SEQ ID NO: 1078528 - RNA, 14 nt, Homo sapiens
augauuguuuaaag

SEQ ID NO: 1078529 - RNA, 15 nt, Homo sapiens
augcaaggcacugac

SEQ ID NO: 1078530 - RNA, 18 nt, Homo sapiens
augccuccaagccauuca

SEQ ID NO: 1078531 - RNA, 20 nt, Homo sapiens
augcuaaauaguucuaucag

SEQ ID NO: 1078532 - RNA, 17 nt, Homo sapiens
augcucagaagccaguc

SEQ ID NO: 1078533 - RNA, 20 nt, Homo sapiens
augcuggacggcauuccugc

SEQ ID NO: 1078534 - RNA, 15 nt, Homo sapiens
augcugugcucuuug

SEQ ID NO: 1078535 - RNA, 17 nt, Homo sapiens
augcuucuaaggcaugg

SEQ ID NO: 1078536 - RNA, 21 nt, Homo sapiens
auggggguuggggugcuuccu

SEQ ID NO: 1078537 - RNA, 18 nt, Homo sapiens
augguaaaaccccaucuc

SEQ ID NO: 1078538 - RNA, 21 nt, Homo sapiens
augguccuggggcucugugca

SEQ ID NO: 1078539 - RNA, 21 nt, Homo sapiens
auguaaaggucacuuuucaca

SEQ ID NO: 1078540 - RNA, 17 nt, Homo sapiens
auguauauguauaucua

SEQ ID NO: 1078541 - RNA, 15 nt, Homo sapiens
auguaugaguggcuu

SEQ ID NO: 1078542 - RNA, 16 nt, Homo sapiens
augucucuuguagaag

SEQ ID NO: 1078543 - RNA, 14 nt, Homo sapiens
augugacuuugaaa

SEQ ID NO: 1078544 - RNA, 14 nt, Homo sapiens
augugcagugcugu

SEQ ID NO: 1078545 - RNA, 11 nt, Homo sapiens
auguguugccu

SEQ ID NO: 1078546 - RNA, 20 nt, Homo sapiens
auguguugccuggaagcaca

SEQ ID NO: 1078547 - RNA, 16 nt, Homo sapiens
auguuaaagcaucaga

SEQ ID NO: 1078548 - RNA, 11 nt, Homo sapiens
auguuugcacu

SEQ ID NO: 1078549 - RNA, 14 nt, Homo sapiens
auguuugcacuuug

SEQ ID NO: 1078550 - RNA, 15 nt, Homo sapiens
auguuuguacaagau

SEQ ID NO: 1078551 - RNA, 11 nt, Homo sapiens
auuagccagau

SEQ ID NO: 1078552 - RNA, 23 nt, Homo sapiens
auuaggcuuuuaagaaacacagg

SEQ ID NO: 1078553 - RNA, 14 nt, Homo sapiens
auuauuuugcacug

SEQ ID NO: 1078554 - RNA, 17 nt, Homo sapiens
auucaaacugccuauau

SEQ ID NO: 1078555 - RNA, 21 nt, Homo sapiens
auucaauaaagcugcugagaa

SEQ ID NO: 1078556 - RNA, 19 nt, Homo sapiens
auucucggggcccugugua

SEQ ID NO: 1078557 - RNA, 17 nt, Homo sapiens
auucugauguccauuug

SEQ ID NO: 1078558 - RNA, 14 nt, Homo sapiens
auugucauuaguga

SEQ ID NO: 1078559 - RNA, 19 nt, Homo sapiens
auuuauucuucuuuuccaa

SEQ ID NO: 1078560 - RNA, 15 nt, Homo sapiens
auuucaacaagaaua

SEQ ID NO: 1078561 - RNA, 18 nt, Homo sapiens
auuugagugucuuugacu

SEQ ID NO: 1078562 - RNA, 20 nt, Homo sapiens
auuuguauaaugguguuacu

SEQ ID NO: 1078563 - RNA, 13 nt, Homo sapiens
cacuucuaugcaa

SEQ ID NO: 1078564 - RNA, 19 nt, Homo sapiens
cacuuuacagaugaggaaa

SEQ ID NO: 1078565 - RNA, 11 nt, Homo sapiens
cagaaaugcaa

SEQ ID NO: 1078566 - RNA, 13 nt, Homo sapiens
cagaacgaugccu

SEQ ID NO: 1078567 - RNA, 20 nt, Homo sapiens
cagacaagucuugcugugcu

SEQ ID NO: 1078568 - RNA, 21 nt, Homo sapiens
cagacaagucuugcugugcuu

SEQ ID NO: 1078569 - RNA, 16 nt, Homo sapiens
cagacucccgcgugaa

SEQ ID NO: 1078570 - RNA, 21 nt, Homo sapiens
cagagaagaccaaagcauugc

SEQ ID NO: 1078571 - RNA, 17 nt, Homo sapiens
cagagcaaaagacuuga

SEQ ID NO: 1078572 - RNA, 20 nt, Homo sapiens
cagagcgagacuccgucuca

SEQ ID NO: 1078573 - RNA, 18 nt, Homo sapiens
cagaggcugcagaaggcc

SEQ ID NO: 1078574 - RNA, 17 nt, Homo sapiens
cagagggggcgugccug

SEQ ID NO: 1078575 - RNA, 19 nt, Homo sapiens
cagagugagacccugucuc

SEQ ID NO: 1078576 - RNA, 20 nt, Homo sapiens
cagagugagacccugucuca

SEQ ID NO: 1078577 - RNA, 24 nt, Homo sapiens
cagauugggcuggcucugaagcca

SEQ ID NO: 1078578 - RNA, 23 nt, Homo sapiens
cagcacaccucagccccacugac

SEQ ID NO: 1078579 - RNA, 20 nt, Homo sapiens
cagccucccucugaccugca

SEQ ID NO: 1078580 - RNA, 21 nt, Homo sapiens
cagccuggccaacauggugaa

SEQ ID NO: 1078581 - RNA, 13 nt, Homo sapiens
cagccuuggcacg

SEQ ID NO: 1078582 - RNA, 21 nt, Homo sapiens
cagcgagcuaugaucgcgcca

SEQ ID NO: 1078583 - RNA, 18 nt, Homo sapiens
cagcuauuuucugaccaa

SEQ ID NO: 1078584 - RNA, 14 nt, Homo sapiens
cagcugcaccugcc

SEQ ID NO: 1078585 - RNA, 15 nt, Homo sapiens
cagcugcaccugcca

SEQ ID NO: 1078586 - RNA, 14 nt, Homo sapiens
caggacugugacca

SEQ ID NO: 1078587 - RNA, 23 nt, Homo sapiens
caggagcaaauguuucugcagua

SEQ ID NO: 1078588 - RNA, 20 nt, Homo sapiens
caggagguggagguugcagu

SEQ ID NO: 1078589 - RNA, 14 nt, Homo sapiens
caggaucugaguua

SEQ ID NO: 1078590 - RNA, 23 nt, Homo sapiens
caggaucugaguuauuuugcuaa

SEQ ID NO: 1078591 - RNA, 19 nt, Homo sapiens
caggcauggcgaggcugag

SEQ ID NO: 1078592 - RNA, 23 nt, Homo sapiens
caggcauuugaggcugucgugag

SEQ ID NO: 1078593 - RNA, 17 nt, Homo sapiens
caggccaggugcagugg

SEQ ID NO: 1078594 - RNA, 14 nt, Homo sapiens
cagggcaguacaau

SEQ ID NO: 1078595 - RNA, 17 nt, Homo sapiens
caggguguuaaggcagu

SEQ ID NO: 1078596 - RNA, 17 nt, Homo sapiens
caggucgagcugugcuc

SEQ ID NO: 1078597 - RNA, 16 nt, Homo sapiens
caggucugaugccaaa

SEQ ID NO: 1078598 - RNA, 23 nt, Homo sapiens
caggucugaugccaaagcugcuu

SEQ ID NO: 1078599 - RNA, 16 nt, Homo sapiens
cagguggcaucucuaa

SEQ ID NO: 1078600 - RNA, 21 nt, Homo sapiens
cagucucugagcaccagggag

SEQ ID NO: 1078601 - RNA, 22 nt, Homo sapiens
caguggaacaugcaaggcacug

SEQ ID NO: 1078602 - RNA, 18 nt, Homo sapiens
caguggugcgaucuuggc

SEQ ID NO: 1078603 - RNA, 12 nt, Homo sapiens
caguuauagaaa

SEQ ID NO: 1078604 - RNA, 17 nt, Homo sapiens
caguucugaacuggaac

SEQ ID NO: 1078605 - RNA, 13 nt, Homo sapiens
caguuugaucaaa

SEQ ID NO: 1078606 - RNA, 16 nt, Homo sapiens
cauaaaaucugugaau

SEQ ID NO: 1078607 - RNA, 23 nt, Homo sapiens
cauaaacacccaugaaucaaaga

SEQ ID NO: 1078608 - RNA, 22 nt, Homo sapiens
caucagagaugguaaucuacag

SEQ ID NO: 1078609 - RNA, 18 nt, Homo sapiens
caucugacucacaagaag

SEQ ID NO: 1078610 - RNA, 19 nt, Homo sapiens
caucuggugccuuuccaca

SEQ ID NO: 1078611 - RNA, 22 nt, Homo sapiens
caucuucuggagucuccagugg

SEQ ID NO: 1078612 - RNA, 19 nt, Homo sapiens
caugauggagcgcaccugc

SEQ ID NO: 1078613 - RNA, 13 nt, Homo sapiens
caugcacggugag

SEQ ID NO: 1078614 - RNA, 16 nt, Homo sapiens
caugccgcgucccugc

SEQ ID NO: 1078615 - RNA, 17 nt, Homo sapiens
cauggcgaggcugaggu

SEQ ID NO: 1078616 - RNA, 14 nt, Homo sapiens
cauggggucccugc

SEQ ID NO: 1078617 - RNA, 12 nt, Homo sapiens
caugucuuucag

SEQ ID NO: 1078618 - RNA, 20 nt, Homo sapiens
cauugauuugauuuuuauua

SEQ ID NO: 1078619 - RNA, 15 nt, Homo sapiens
cauuguagaaacaca

SEQ ID NO: 1078620 - RNA, 15 nt, Homo sapiens
ccaaaauguguuuca

SEQ ID NO: 1078621 - RNA, 16 nt, Homo sapiens
ccaaaauguguuucau

SEQ ID NO: 1078622 - RNA, 19 nt, Homo sapiens
ccaaacucauucaccaaau

SEQ ID NO: 1078623 - RNA, 13 nt, Homo sapiens
ccaaagacuacac

SEQ ID NO: 1078624 - RNA, 13 nt, Homo sapiens
ccaaagagacugg

SEQ ID NO: 1078625 - RNA, 18 nt, Homo sapiens
ccaaauguaacuauguuu

SEQ ID NO: 1078626 - RNA, 22 nt, Homo sapiens
aaccacacaaggagaacccaau

SEQ ID NO: 1078627 - RNA, 22 nt, Homo sapiens
aaccagagggggcgugccugcc

SEQ ID NO: 1078628 - RNA, 22 nt, Homo sapiens
aaccaugcauggugcaucagca

SEQ ID NO: 1078629 - RNA, 14 nt, Homo sapiens
aaccgcuugccaua

SEQ ID NO: 1078630 - RNA, 14 nt, Homo sapiens
aaccucauuuacca

SEQ ID NO: 1078631 - RNA, 16 nt, Homo sapiens
aaccugaauuauucca

SEQ ID NO: 1078632 - RNA, 18 nt, Homo sapiens
aaccuguccauaaaguaa

SEQ ID NO: 1078633 - RNA, 15 nt, Homo sapiens
aacgacaaagccaaa

SEQ ID NO: 1078634 - RNA, 20 nt, Homo sapiens
aacgaugccugcaggcaugg

SEQ ID NO: 1078635 - RNA, 22 nt, Homo sapiens
aacgcagauugggcuggcucug

SEQ ID NO: 1078636 - RNA, 16 nt, Homo sapiens
aacuagaaaucugcca

SEQ ID NO: 1078637 - RNA, 16 nt, Homo sapiens
aacucugccagccaca

SEQ ID NO: 1078638 - RNA, 12 nt, Homo sapiens
aacuucuuguug

SEQ ID NO: 1078639 - RNA, 23 nt, Homo sapiens
aacuugaggacacauguccagug

SEQ ID NO: 1078640 - RNA, 17 nt, Homo sapiens
aacuuguguacugauaa

SEQ ID NO: 1078641 - RNA, 18 nt, Homo sapiens
aagaaaccuggaaccaga

SEQ ID NO: 1078642 - RNA, 13 nt, Homo sapiens
aagaccagacugu

SEQ ID NO: 1078643 - RNA, 17 nt, Homo sapiens
aagaguagaacccaggu

SEQ ID NO: 1078644 - RNA, 15 nt, Homo sapiens
aagauuauauaucau

SEQ ID NO: 1078645 - RNA, 20 nt, Homo sapiens
aagccagacgugguggcuca

SEQ ID NO: 1078646 - RNA, 20 nt, Homo sapiens
aagcgagaucccaucucuac

SEQ ID NO: 1078647 - RNA, 18 nt, Homo sapiens
aagcggagcuugcaguga

SEQ ID NO: 1078648 - RNA, 18 nt, Homo sapiens
aagcggagguugcaggga

SEQ ID NO: 1078649 - RNA, 18 nt, Homo sapiens
aagcucggugagugaugg

SEQ ID NO: 1078650 - RNA, 15 nt, Homo sapiens
aagcuuaaauugcuu

SEQ ID NO: 1078651 - RNA, 15 nt, Homo sapiens
aaggagaaaaugcau

SEQ ID NO: 1078652 - RNA, 16 nt, Homo sapiens
aaggcaaauauaagcu

SEQ ID NO: 1078653 - RNA, 17 nt, Homo sapiens
aaggcucagucucagga

SEQ ID NO: 1078654 - RNA, 15 nt, Homo sapiens
aagggaaagucagcu

SEQ ID NO: 1078655 - RNA, 18 nt, Homo sapiens
aaggggaggggaugucag

SEQ ID NO: 1078656 - RNA, 20 nt, Homo sapiens
aagucccugacucucuguga

SEQ ID NO: 1078657 - RNA, 18 nt, Homo sapiens
aagucugggauguagaac

SEQ ID NO: 1078658 - RNA, 15 nt, Homo sapiens
aaguuccucuagugc

SEQ ID NO: 1078659 - RNA, 22 nt, Homo sapiens
aauaaacccuuaacuggcauag

SEQ ID NO: 1078660 - RNA, 20 nt, Homo sapiens
aauaccagugaaccaaagag

SEQ ID NO: 1078661 - RNA, 15 nt, Homo sapiens
aauagauugugaaua

SEQ ID NO: 1078662 - RNA, 16 nt, Homo sapiens
cauuuuguacaaagau

SEQ ID NO: 1078663 - RNA, 21 nt, Homo sapiens
cauuuuuacggguaacaguga

SEQ ID NO: 1078664 - RNA, 14 nt, Homo sapiens
ccaaacucugccag

SEQ ID NO: 1078665 - RNA, 15 nt, Homo sapiens
ccaaacucugccagc

SEQ ID NO: 1078666 - RNA, 17 nt, Homo sapiens
ccaaagaccaauauuca

SEQ ID NO: 1078667 - RNA, 23 nt, Homo sapiens
ccaaagagacuggagcaucugac

SEQ ID NO: 1078668 - RNA, 18 nt, Homo sapiens
ccaaaugaugccacuucc

SEQ ID NO: 1078669 - RNA, 19 nt, Homo sapiens
ccaaaugaugccacuuccc

SEQ ID NO: 1078670 - RNA, 16 nt, Homo sapiens
ccaagugccagucuug

SEQ ID NO: 1078671 - RNA, 13 nt, Homo sapiens
ccacaccaucucc

SEQ ID NO: 1078672 - RNA, 13 nt, Homo sapiens
ccacccacugacc

SEQ ID NO: 1078673 - RNA, 12 nt, Homo sapiens
ccaccugugcuu

SEQ ID NO: 1078674 - RNA, 16 nt, Homo sapiens
ccacuaggacucugag

SEQ ID NO: 1078675 - RNA, 16 nt, Homo sapiens
ccacucuuugcuacaa

SEQ ID NO: 1078676 - RNA, 14 nt, Homo sapiens
ccacuggacuugag

SEQ ID NO: 1078677 - RNA, 21 nt, Homo sapiens
ccacuucuaugcaaaugccuc

SEQ ID NO: 1078678 - RNA, 13 nt, Homo sapiens
ccagaaacgcaga

SEQ ID NO: 1078679 - RNA, 14 nt, Homo sapiens
ccagaacccuuccu

SEQ ID NO: 1078680 - RNA, 14 nt, Homo sapiens
ccagaggcugcaga

SEQ ID NO: 1078681 - RNA, 21 nt, Homo sapiens
ccagcacuuugggaggcugag

SEQ ID NO: 1078682 - RNA, 15 nt, Homo sapiens
ccagccugggcaaca

SEQ ID NO: 1078683 - RNA, 18 nt, Homo sapiens
ccagccugggcaacagau

SEQ ID NO: 1078684 - RNA, 13 nt, Homo sapiens
ccagccuuggcac

SEQ ID NO: 1078685 - RNA, 15 nt, Homo sapiens
ccagcuaacugugga

SEQ ID NO: 1078686 - RNA, 16 nt, Homo sapiens
ccagcugcaccugcca

SEQ ID NO: 1078687 - RNA, 18 nt, Homo sapiens
ccagcugcaccugccagc

SEQ ID NO: 1078688 - RNA, 19 nt, Homo sapiens
ccaggaagcucggugagug

SEQ ID NO: 1078689 - RNA, 23 nt, Homo sapiens
ccaggagguggagguugcaguga

SEQ ID NO: 1078690 - RNA, 15 nt, Homo sapiens
ccaggccugagcaac

SEQ ID NO: 1078691 - RNA, 20 nt, Homo sapiens
ccaggcuggagugcaguggu

SEQ ID NO: 1078692 - RNA, 18 nt, Homo sapiens
ccagucaauuacauguuu

SEQ ID NO: 1078693 - RNA, 13 nt, Homo sapiens
ccagugaaccaaa

SEQ ID NO: 1078694 - RNA, 13 nt, Homo sapiens
ccagugcagggaa

SEQ ID NO: 1078695 - RNA, 21 nt, Homo sapiens
ccaugcauggugcaucagcag

SEQ ID NO: 1078696 - RNA, 14 nt, Homo sapiens
cccaggaguuugag

SEQ ID NO: 1078697 - RNA, 13 nt, Homo sapiens
cccaggccaggga

SEQ ID NO: 1078698 - RNA, 15 nt, Homo sapiens
cccaugaaucaaaga

SEQ ID NO: 1078699 - RNA, 22 nt, Homo sapiens
ccccagcuauuuucugaccaaa

SEQ ID NO: 1078700 - RNA, 22 nt, Homo sapiens
ccccagcucuggcuuccagaaa

SEQ ID NO: 1078701 - RNA, 20 nt, Homo sapiens
ccccagguggaggugccagg

SEQ ID NO: 1078702 - RNA, 21 nt, Homo sapiens
cccccuccccggccacaugcc

SEQ ID NO: 1078703 - RNA, 20 nt, Homo sapiens
cccguggucuccuugcacuu

SEQ ID NO: 1078704 - RNA, 22 nt, Homo sapiens
cccguggucuccuugcacuuuc

SEQ ID NO: 1078705 - RNA, 14 nt, Homo sapiens
cccuaaaacaugug

SEQ ID NO: 1078706 - RNA, 21 nt, Homo sapiens
cccuauaucuauaaacacugu

SEQ ID NO: 1078707 - RNA, 20 nt, Homo sapiens
cccucaaaugacccaaagac

SEQ ID NO: 1078708 - RNA, 22 nt, Homo sapiens
cccucacuccugccaguugaaa

SEQ ID NO: 1078709 - RNA, 19 nt, Homo sapiens
cccugguggucacaggcug

SEQ ID NO: 1078710 - RNA, 14 nt, Homo sapiens
cccugucucaaaaa

SEQ ID NO: 1078711 - RNA, 17 nt, Homo sapiens
ccgaaagggacacaaug

SEQ ID NO: 1078712 - RNA, 13 nt, Homo sapiens
ccgcuugccauau

SEQ ID NO: 1078713 - RNA, 18 nt, Homo sapiens
ccggcauccugaaagcca

SEQ ID NO: 1078714 - RNA, 21 nt, Homo sapiens
ccgggacuucaaagccgugau

SEQ ID NO: 1078715 - RNA, 20 nt, Homo sapiens
ccggggccagccggacacaa

SEQ ID NO: 1078716 - RNA, 19 nt, Homo sapiens
ccguguuacuguugcacug

SEQ ID NO: 1078717 - RNA, 16 nt, Homo sapiens
ccuagaacugugccua

SEQ ID NO: 1078718 - RNA, 20 nt, Homo sapiens
ccucaaaugacccaaagacc

SEQ ID NO: 1078719 - RNA, 11 nt, Homo sapiens
ccucacugcag

SEQ ID NO: 1078720 - RNA, 13 nt, Homo sapiens
ccuccaaaugcca

SEQ ID NO: 1078721 - RNA, 21 nt, Homo sapiens
ccuccaagccauucacuuccc

SEQ ID NO: 1078722 - RNA, 23 nt, Homo sapiens
ccuccccagguggaggugccagg

SEQ ID NO: 1078723 - RNA, 15 nt, Homo sapiens
ccuccccuuuugccc

SEQ ID NO: 1078724 - RNA, 15 nt, Homo sapiens
ccucccuuccaugcc

SEQ ID NO: 1078725 - RNA, 16 nt, Homo sapiens
ccucguagccaucucu

SEQ ID NO: 1078726 - RNA, 17 nt, Homo sapiens
ccucucucaaaucucau

SEQ ID NO: 1078727 - RNA, 13 nt, Homo sapiens
ccucugcucugag

SEQ ID NO: 1078728 - RNA, 18 nt, Homo sapiens
cugccaagcucacacagc

SEQ ID NO: 1078729 - RNA, 14 nt, Homo sapiens
cugccagagcuuug

SEQ ID NO: 1078730 - RNA, 19 nt, Homo sapiens
cugccauugucgucuuuau

SEQ ID NO: 1078731 - RNA, 13 nt, Homo sapiens
cugcgucaggcac

SEQ ID NO: 1078732 - RNA, 22 nt, Homo sapiens
cugcgucaggcacgucuccugc

SEQ ID NO: 1078733 - RNA, 17 nt, Homo sapiens
cugcucugaggcuucca

SEQ ID NO: 1078734 - RNA, 20 nt, Homo sapiens
cuggaaaggcucagucucag

SEQ ID NO: 1078735 - RNA, 14 nt, Homo sapiens
cuggaccagccugu

SEQ ID NO: 1078736 - RNA, 17 nt, Homo sapiens
cuggacugugugcaacg

SEQ ID NO: 1078737 - RNA, 15 nt, Homo sapiens
cuggagucucagagc

SEQ ID NO: 1078738 - RNA, 20 nt, Homo sapiens
cuggaucguuugacgggacu

SEQ ID NO: 1078739 - RNA, 18 nt, Homo sapiens
cuggauggcaucuagcca

SEQ ID NO: 1078740 - RNA, 22 nt, Homo sapiens
cuggcuggagucucagagcaca

SEQ ID NO: 1078741 - RNA, 19 nt, Homo sapiens
cugggaaggggaacacaga

SEQ ID NO: 1078742 - RNA, 16 nt, Homo sapiens
cugggagaaccucagg

SEQ ID NO: 1078743 - RNA, 20 nt, Homo sapiens
cugggccaaguuccucuagu

SEQ ID NO: 1078744 - RNA, 15 nt, Homo sapiens
cugggccaggucucc

SEQ ID NO: 1078745 - RNA, 18 nt, Homo sapiens
cuguaaucccagcuacuu

SEQ ID NO: 1078746 - RNA, 13 nt, Homo sapiens
cuguacucaggag

SEQ ID NO: 1078747 - RNA, 19 nt, Homo sapiens
cugucccucaaaugaccca

SEQ ID NO: 1078748 - RNA, 23 nt, Homo sapiens
cugucccucaaaugacccaaaga

SEQ ID NO: 1078749 - RNA, 14 nt, Homo sapiens
cugucugucugucu

SEQ ID NO: 1078750 - RNA, 12 nt, Homo sapiens
cugugaucccag

SEQ ID NO: 1078751 - RNA, 22 nt, Homo sapiens
cuguggagaaauaaaaauaccu

SEQ ID NO: 1078752 - RNA, 14 nt, Homo sapiens
cuguggccugggca

SEQ ID NO: 1078753 - RNA, 15 nt, Homo sapiens
cugugucguagccaa

SEQ ID NO: 1078754 - RNA, 23 nt, Homo sapiens
cugugucuuauagguuuccacug

SEQ ID NO: 1078755 - RNA, 18 nt, Homo sapiens
cuguuacuugaaauacca

SEQ ID NO: 1078756 - RNA, 16 nt, Homo sapiens
cuguugccuuuuuaca

SEQ ID NO: 1078757 - RNA, 20 nt, Homo sapiens
cuuaaaaaaaacucuuuaac

SEQ ID NO: 1078758 - RNA, 23 nt, Homo sapiens
cuuaagcaugacgggaaaaccaa

SEQ ID NO: 1078759 - RNA, 17 nt, Homo sapiens
cuuagcugaacaaugaa

SEQ ID NO: 1078760 - RNA, 13 nt, Homo sapiens
cuuagcugucacc

SEQ ID NO: 1078761 - RNA, 19 nt, Homo sapiens
cuuauuuguauaauggugu

SEQ ID NO: 1078762 - RNA, 20 nt, Homo sapiens
cuuccucugguuucugugug

SEQ ID NO: 1078763 - RNA, 15 nt, Homo sapiens
cuucucuuccuguaa

SEQ ID NO: 1078764 - RNA, 16 nt, Homo sapiens
cuucuggagucuccag

SEQ ID NO: 1078765 - RNA, 22 nt, Homo sapiens
cuugaagauauuuauucugggu

SEQ ID NO: 1078766 - RNA, 11 nt, Homo sapiens
cuugagccauc

SEQ ID NO: 1078767 - RNA, 12 nt, Homo sapiens
cuugauucucuc

SEQ ID NO: 1078768 - RNA, 18 nt, Homo sapiens
cuugcucuccuggagcaa

SEQ ID NO: 1078769 - RNA, 18 nt, Homo sapiens
gcaguggaacaugcaagg

SEQ ID NO: 1078770 - RNA, 14 nt, Homo sapiens
gcaucugacucaca

SEQ ID NO: 1078771 - RNA, 18 nt, Homo sapiens
gcaugacgggaaaaccaa

SEQ ID NO: 1078772 - RNA, 20 nt, Homo sapiens
gcaugacgggaaaaccaaac

SEQ ID NO: 1078773 - RNA, 22 nt, Homo sapiens
gcauggucgggggagagggcca

SEQ ID NO: 1078774 - RNA, 15 nt, Homo sapiens
gccacagaagccagg

SEQ ID NO: 1078775 - RNA, 16 nt, Homo sapiens
gccacagaagccagga

SEQ ID NO: 1078776 - RNA, 14 nt, Homo sapiens
gccagaaaacauau

SEQ ID NO: 1078777 - RNA, 23 nt, Homo sapiens
gccaggcauucaauccucagguc

SEQ ID NO: 1078778 - RNA, 18 nt, Homo sapiens
gccagggcccugcagagg

SEQ ID NO: 1078779 - RNA, 11 nt, Homo sapiens
gccagugacuu

SEQ ID NO: 1078780 - RNA, 22 nt, Homo sapiens
gcccagagaagcaaguggcuuu

SEQ ID NO: 1078781 - RNA, 22 nt, Homo sapiens
gcccagcaccugcucccagugg

SEQ ID NO: 1078782 - RNA, 18 nt, Homo sapiens
gccccacugacacccagu

SEQ ID NO: 1078783 - RNA, 20 nt, Homo sapiens
gccccacugacacccagugu

SEQ ID NO: 1078784 - RNA, 13 nt, Homo sapiens
gcccucacugcag

SEQ ID NO: 1078785 - RNA, 21 nt, Homo sapiens
gccgagauugcgccacugcag

SEQ ID NO: 1078786 - RNA, 17 nt, Homo sapiens
gccuccaagccauucac

SEQ ID NO: 1078787 - RNA, 21 nt, Homo sapiens
gccuccaagccauucacuucc

SEQ ID NO: 1078788 - RNA, 22 nt, Homo sapiens
gccugaaugucuuacugugauc

SEQ ID NO: 1078789 - RNA, 13 nt, Homo sapiens
gccugagacaccc

SEQ ID NO: 1078790 - RNA, 11 nt, Homo sapiens
gccugagcaac

SEQ ID NO: 1078791 - RNA, 19 nt, Homo sapiens
gccugagucacccaugaag

SEQ ID NO: 1078792 - RNA, 16 nt, Homo sapiens
gccuggaacucacuca

SEQ ID NO: 1078793 - RNA, 16 nt, Homo sapiens
gccuggcacgagggga

SEQ ID NO: 1078794 - RNA, 14 nt, Homo sapiens
gccugggugacaga

SEQ ID NO: 1078795 - RNA, 21 nt, Homo sapiens
gccuugucuucuuagcuguca

SEQ ID NO: 1078796 - RNA, 18 nt, Homo sapiens
gcgaaggggcccuggucc

SEQ ID NO: 1078797 - RNA, 15 nt, Homo sapiens
gcgaggccugacaca

SEQ ID NO: 1078798 - RNA, 13 nt, Homo sapiens
gcgccugugcuga

SEQ ID NO: 1078799 - RNA, 21 nt, Homo sapiens
gcgcugcagccucccuuccau

SEQ ID NO: 1078800 - RNA, 16 nt, Homo sapiens
gcggagcuugcaguga

SEQ ID NO: 1078801 - RNA, 18 nt, Homo sapiens
gcgugucccucucggaag

SEQ ID NO: 1078802 - RNA, 18 nt, Homo sapiens
gcuacaaaaaacugcagu

SEQ ID NO: 1078803 - RNA, 13 nt, Homo sapiens
gcuacuugggagg

SEQ ID NO: 1078804 - RNA, 17 nt, Homo sapiens
gcuauuuguucagagag

SEQ ID NO: 1078805 - RNA, 17 nt, Homo sapiens
gcucacacagcaggaac

SEQ ID NO: 1078806 - RNA, 16 nt, Homo sapiens
gcucacgugucuuuag

SEQ ID NO: 1078807 - RNA, 14 nt, Homo sapiens
gcucaggcauuuga

SEQ ID NO: 1078808 - RNA, 15 nt, Homo sapiens
gcucagucucaggag

SEQ ID NO: 1078809 - RNA, 13 nt, Homo sapiens
gcuccacuacccg

SEQ ID NO: 1078810 - RNA, 12 nt, Homo sapiens
gcuccuccaugg

SEQ ID NO: 1078811 - RNA, 23 nt, Homo sapiens
gcucuuucucugagaaccaaaag

SEQ ID NO: 1078812 - RNA, 14 nt, Homo sapiens
gcugacacugugac

SEQ ID NO: 1078813 - RNA, 19 nt, Homo sapiens
gcugaggccacccacugac

SEQ ID NO: 1078814 - RNA, 23 nt, Homo sapiens
gcugaggcggguggaucaccuga

SEQ ID NO: 1078815 - RNA, 14 nt, Homo sapiens
gcugcccugugaga

SEQ ID NO: 1078816 - RNA, 19 nt, Homo sapiens
gcugcgggggagccaguuc

SEQ ID NO: 1078817 - RNA, 18 nt, Homo sapiens
gcugcugagaaucuagcc

SEQ ID NO: 1078818 - RNA, 15 nt, Homo sapiens
gcugcuuucuucucu

SEQ ID NO: 1078819 - RNA, 20 nt, Homo sapiens
gcuggagugcaguggugcga

SEQ ID NO: 1078820 - RNA, 12 nt, Homo sapiens
gcuggccucuag

SEQ ID NO: 1078821 - RNA, 14 nt, Homo sapiens
gcuggccuggcaca

SEQ ID NO: 1078822 - RNA, 13 nt, Homo sapiens
gcuggcugcagug

SEQ ID NO: 1078823 - RNA, 14 nt, Homo sapiens
gcuggcugcaguga

SEQ ID NO: 1078824 - RNA, 15 nt, Homo sapiens
gcugggacuggccag

SEQ ID NO: 1078825 - RNA, 18 nt, Homo sapiens
gcuguauuuguucaguga

SEQ ID NO: 1078826 - RNA, 22 nt, Homo sapiens
gcugucucucuuguugauuucc

SEQ ID NO: 1078827 - RNA, 21 nt, Homo sapiens
gcuguuggauuucagugauuu

SEQ ID NO: 1078828 - RNA, 22 nt, Homo sapiens
gcuuagaugagggugacuguca

SEQ ID NO: 1078829 - RNA, 12 nt, Homo sapiens
gcuuccucaguu

SEQ ID NO: 1078830 - RNA, 17 nt, Homo sapiens
gcuucugggccacucag

SEQ ID NO: 1078831 - RNA, 18 nt, Homo sapiens
gcuucugggccacucagg

SEQ ID NO: 1078832 - RNA, 23 nt, Homo sapiens
gcuuucuggauggcaucuagcca

SEQ ID NO: 1078833 - RNA, 13 nt, Homo sapiens
gcuuugacucacc

SEQ ID NO: 1078834 - RNA, 14 nt, Homo sapiens
ggaaaccaguguag

SEQ ID NO: 1078835 - RNA, 23 nt, Homo sapiens
ggaaaugguauccagaauggaau

SEQ ID NO: 1078836 - RNA, 14 nt, Homo sapiens
ggaacugagccaga

SEQ ID NO: 1078837 - RNA, 16 nt, Homo sapiens
ggaagaaauuccugua

SEQ ID NO: 1078838 - RNA, 15 nt, Homo sapiens
ggaaguuuguucacu

SEQ ID NO: 1078839 - RNA, 21 nt, Homo sapiens
ggaccaacccuguuuccugag

SEQ ID NO: 1078840 - RNA, 22 nt, Homo sapiens
ggacccccuggcccugccucau

SEQ ID NO: 1078841 - RNA, 15 nt, Homo sapiens
ggacugugaccaaag

SEQ ID NO: 1078842 - RNA, 14 nt, Homo sapiens
ggagagacagugac

SEQ ID NO: 1078843 - RNA, 19 nt, Homo sapiens
agcagggccaaagcacagc

SEQ ID NO: 1078844 - RNA, 19 nt, Homo sapiens
agcaggugugacccugagg

SEQ ID NO: 1078845 - RNA, 14 nt, Homo sapiens
agcaucaccucagg

SEQ ID NO: 1078846 - RNA, 14 nt, Homo sapiens
agccaaacucugcc

SEQ ID NO: 1078847 - RNA, 15 nt, Homo sapiens
agccaaacucugcca

SEQ ID NO: 1078848 - RNA, 21 nt, Homo sapiens
agccauucugugugugacucu

SEQ ID NO: 1078849 - RNA, 17 nt, Homo sapiens
agccccacccaagcaag

SEQ ID NO: 1078850 - RNA, 17 nt, Homo sapiens
agccccagcuuccugug

SEQ ID NO: 1078851 - RNA, 19 nt, Homo sapiens
agccucuaguguccgggga

SEQ ID NO: 1078852 - RNA, 17 nt, Homo sapiens
agccugggccagagaag

SEQ ID NO: 1078853 - RNA, 22 nt, Homo sapiens
agccuuccugaguuucucucuc

SEQ ID NO: 1078854 - RNA, 22 nt, Homo sapiens
agccuugucuucuuagcuguca

SEQ ID NO: 1078855 - RNA, 16 nt, Homo sapiens
agccuuugcccuguca

SEQ ID NO: 1078856 - RNA, 20 nt, Homo sapiens
agcuaaguucuaaguucaug

SEQ ID NO: 1078857 - RNA, 23 nt, Homo sapiens
agcuacuugggaggcugagccag

SEQ ID NO: 1078858 - RNA, 20 nt, Homo sapiens
agcuaugaucgcgccacuac

SEQ ID NO: 1078859 - RNA, 20 nt, Homo sapiens
agcuaugauuaugccacugc

SEQ ID NO: 1078860 - RNA, 22 nt, Homo sapiens
agcuaugauuaugccacugcuu

SEQ ID NO: 1078861 - RNA, 20 nt, Homo sapiens
agcuauuagcaacugugcua

SEQ ID NO: 1078862 - RNA, 15 nt, Homo sapiens
agcucugaacaaaag

SEQ ID NO: 1078863 - RNA, 14 nt, Homo sapiens
agcucuggaccagc

SEQ ID NO: 1078864 - RNA, 19 nt, Homo sapiens
agcucuuguuccgugccag

SEQ ID NO: 1078865 - RNA, 15 nt, Homo sapiens
agcugcaccugccag

SEQ ID NO: 1078866 - RNA, 16 nt, Homo sapiens
agcugcugucacuaga

SEQ ID NO: 1078867 - RNA, 14 nt, Homo sapiens
agcuuaaauugcuu

SEQ ID NO: 1078868 - RNA, 20 nt, Homo sapiens
agcuuggcacuuuaaagcau

SEQ ID NO: 1078869 - RNA, 19 nt, Homo sapiens
agcuuucagagccagugaa

SEQ ID NO: 1078870 - RNA, 22 nt, Homo sapiens
agcuuucagagccagugaagga

SEQ ID NO: 1078871 - RNA, 22 nt, Homo sapiens
agcuuuccuucugcccuuccuc

SEQ ID NO: 1078872 - RNA, 16 nt, Homo sapiens
aggacaccagccuggu

SEQ ID NO: 1078873 - RNA, 19 nt, Homo sapiens
aggacaccagccuggugcc

SEQ ID NO: 1078874 - RNA, 17 nt, Homo sapiens
aggacugugaccaaagc

SEQ ID NO: 1078875 - RNA, 20 nt, Homo sapiens
aggagucaacguguuuaccu

SEQ ID NO: 1078876 - RNA, 14 nt, Homo sapiens
aggccacaugucac

SEQ ID NO: 1078877 - RNA, 23 nt, Homo sapiens
aggccagaaaacauaugcauuau

SEQ ID NO: 1078878 - RNA, 22 nt, Homo sapiens
aggccagggaaagcccguguca

SEQ ID NO: 1078879 - RNA, 18 nt, Homo sapiens
aggccucuuggaccucug

SEQ ID NO: 1078880 - RNA, 19 nt, Homo sapiens
aggcugaggggaggaucac

SEQ ID NO: 1078881 - RNA, 20 nt, Homo sapiens
aggcugucgugagcuaugau

SEQ ID NO: 1078882 - RNA, 23 nt, Homo sapiens
aggcugucgugagcuaugauuau

SEQ ID NO: 1078883 - RNA, 17 nt, Homo sapiens
aggcugugcucuuccuc

SEQ ID NO: 1078884 - RNA, 19 nt, Homo sapiens
agggaugcugccugaguca

SEQ ID NO: 1078885 - RNA, 18 nt, Homo sapiens
agggcaguacaaugugac

SEQ ID NO: 1078886 - RNA, 16 nt, Homo sapiens
agggccaaagcacagc

SEQ ID NO: 1078887 - RNA, 19 nt, Homo sapiens
aggggcagcuccugaccaa

SEQ ID NO: 1078888 - RNA, 22 nt, Homo sapiens
aggggcagcuccugaccaaaga

SEQ ID NO: 1078889 - RNA, 20 nt, Homo sapiens
aggggcccacccacaugacu

SEQ ID NO: 1078890 - RNA, 20 nt, Homo sapiens
aggggggccagggguucuga

SEQ ID NO: 1078891 - RNA, 15 nt, Homo sapiens
aggucucugaacuca

SEQ ID NO: 1078892 - RNA, 20 nt, Homo sapiens
agguugaggggcuccuggaa

SEQ ID NO: 1078893 - RNA, 21 nt, Homo sapiens
agguuucuauuuucucugaua

SEQ ID NO: 1078894 - RNA, 13 nt, Homo sapiens
aguaaacacugug

SEQ ID NO: 1078895 - RNA, 22 nt, Homo sapiens
aguaacuggugauauaucucaa

SEQ ID NO: 1078896 - RNA, 13 nt, Homo sapiens
aguaagacacaaa

SEQ ID NO: 1078897 - RNA, 18 nt, Homo sapiens
aguagacuauaagcagaa

SEQ ID NO: 1078898 - RNA, 16 nt, Homo sapiens
agucagcuuucagagc

SEQ ID NO: 1078899 - RNA, 13 nt, Homo sapiens
agucccugacucu

SEQ ID NO: 1078900 - RNA, 19 nt, Homo sapiens
aguccucguagccaucucu

SEQ ID NO: 1078901 - RNA, 12 nt, Homo sapiens
agucucuaugau

SEQ ID NO: 1078902 - RNA, 14 nt, Homo sapiens
agucucuaugaucu

SEQ ID NO: 1078903 - RNA, 21 nt, Homo sapiens
agucucugugcuuugacucac

SEQ ID NO: 1078904 - RNA, 15 nt, Homo sapiens
agugcuuccacuucu

SEQ ID NO: 1078905 - RNA, 23 nt, Homo sapiens
aguggcucacgccuguaauccca

SEQ ID NO: 1078906 - RNA, 17 nt, Homo sapiens
aguggcuucugggagau

SEQ ID NO: 1078907 - RNA, 19 nt, Homo sapiens
agugggaggugagaccacc

SEQ ID NO: 1078908 - RNA, 17 nt, Homo sapiens
aguggugcgaucuuggc

SEQ ID NO: 1078909 - RNA, 14 nt, Homo sapiens
agugugaucccaag

SEQ ID NO: 1078910 - RNA, 21 nt, Homo sapiens
aguucacaggccagaaaacau

SEQ ID NO: 1078911 - RNA, 18 nt, Homo sapiens
aguucauggugaucagug

SEQ ID NO: 1078912 - RNA, 18 nt, Homo sapiens
aguuccccucuacuccau

SEQ ID NO: 1078913 - RNA, 15 nt, Homo sapiens
aguucugaacuggaa

SEQ ID NO: 1078914 - RNA, 16 nt, Homo sapiens
aguuguacacugugua

SEQ ID NO: 1078915 - RNA, 13 nt, Homo sapiens
aguuucucuccac

SEQ ID NO: 1078916 - RNA, 13 nt, Homo sapiens
aguuuugaugaaa

SEQ ID NO: 1078917 - RNA, 19 nt, Homo sapiens
auaaaaucugugaauuaaa

SEQ ID NO: 1078918 - RNA, 13 nt, Homo sapiens
auaaaauuucccc

SEQ ID NO: 1078919 - RNA, 14 nt, Homo sapiens
auaaacacccauga

SEQ ID NO: 1078920 - RNA, 22 nt, Homo sapiens
auaaacacccaugaaucaaaga

SEQ ID NO: 1078921 - RNA, 12 nt, Homo sapiens
auaaacacuguu

SEQ ID NO: 1078922 - RNA, 22 nt, Homo sapiens
auaaauaguguacacagacuga

SEQ ID NO: 1078923 - RNA, 19 nt, Homo sapiens
auaaccuucaugaugaauu

SEQ ID NO: 1078924 - RNA, 20 nt, Homo sapiens
auacaaaaaauuagccagau

SEQ ID NO: 1078925 - RNA, 16 nt, Homo sapiens
auaccagugaaccaaa

SEQ ID NO: 1078926 - RNA, 13 nt, Homo sapiens
auaccgugggggu

SEQ ID NO: 1078927 - RNA, 18 nt, Homo sapiens
auagaauugcaaucuaua

SEQ ID NO: 1078928 - RNA, 18 nt, Homo sapiens
auagauuaguacuggauu

SEQ ID NO: 1078929 - RNA, 18 nt, Homo sapiens
auaguucuaucaggaaaa

SEQ ID NO: 1078930 - RNA, 14 nt, Homo sapiens
auaucagagcucuu

SEQ ID NO: 1078931 - RNA, 17 nt, Homo sapiens
auaucuauaaacacugu

SEQ ID NO: 1078932 - RNA, 19 nt, Homo sapiens
auaucugagaaguguauau

SEQ ID NO: 1078933 - RNA, 17 nt, Homo sapiens
auaugacuuuuucucag

SEQ ID NO: 1078934 - RNA, 15 nt, Homo sapiens
auaugcaguaugcua

SEQ ID NO: 1078935 - RNA, 22 nt, Homo sapiens
uucuaagugguauauacauaug

SEQ ID NO: 1078936 - RNA, 11 nt, Homo sapiens
uucuacccuga

SEQ ID NO: 1078937 - RNA, 18 nt, Homo sapiens
uucuuaaucuccacuguu

SEQ ID NO: 1078938 - RNA, 21 nt, Homo sapiens
uucuuguuuuaagagacagag

SEQ ID NO: 1078939 - RNA, 17 nt, Homo sapiens
uucuuuuucacacugau

SEQ ID NO: 1078940 - RNA, 18 nt, Homo sapiens
uugaacugguugugaaua

SEQ ID NO: 1078941 - RNA, 18 nt, Homo sapiens
uugauuuuuacugaggaa

SEQ ID NO: 1078942 - RNA, 15 nt, Homo sapiens
uugcuguaugguaua

SEQ ID NO: 1078943 - RNA, 19 nt, Homo sapiens
uuggacagucugagcugua

SEQ ID NO: 1078944 - RNA, 19 nt, Homo sapiens
uuguaaacuaguacuauua

SEQ ID NO: 1078945 - RNA, 15 nt, Homo sapiens
uugucaauaguauua

SEQ ID NO: 1078946 - RNA, 20 nt, Homo sapiens
uuguggguuuuuucacauaa

SEQ ID NO: 1078947 - RNA, 15 nt, Homo sapiens
uuguguucaguucca

SEQ ID NO: 1078948 - RNA, 17 nt, Homo sapiens
uuguuuaacauugcuga

SEQ ID NO: 1078949 - RNA, 14 nt, Homo sapiens
uuguuuuauauucu

SEQ ID NO: 1078950 - RNA, 19 nt, Homo sapiens
uuuagagauggggucuugc

SEQ ID NO: 1078951 - RNA, 17 nt, Homo sapiens
uuucacauaaacacaua

SEQ ID NO: 1078952 - RNA, 20 nt, Homo sapiens
uuuccauguaucuaccucac

SEQ ID NO: 1078953 - RNA, 14 nt, Homo sapiens
uuucccacacccca

SEQ ID NO: 1078954 - RNA, 22 nt, Homo sapiens
uuugagaacaauggagauauca

SEQ ID NO: 1078955 - RNA, 10 nt, Homo sapiens
uuugaucaug

SEQ ID NO: 1078956 - RNA, 14 nt, Homo sapiens
uuuugauagauauc

SEQ ID NO: 1078957 - RNA, 14 nt, Homo sapiens
uuuuuguacacauc

SEQ ID NO: 1078958 - RNA, 23 nt, Homo sapiens
uuggaaagcaucaccucaggcca

SEQ ID NO: 1078959 - RNA, 16 nt, Homo sapiens
uuggacuugaggauuu

SEQ ID NO: 1078960 - RNA, 17 nt, Homo sapiens
uugggcgggacauccuc

SEQ ID NO: 1078961 - RNA, 16 nt, Homo sapiens
uuguaaacuaguacua

SEQ ID NO: 1078962 - RNA, 19 nt, Homo sapiens
uuguaaguuuaugucuaaa

SEQ ID NO: 1078963 - RNA, 22 nt, Homo sapiens
uuguguguguguguugauccca

SEQ ID NO: 1078964 - RNA, 15 nt, Homo sapiens
uuguuauuuguacag

SEQ ID NO: 1078965 - RNA, 23 nt, Homo sapiens
uuguuuucccgagcaaagucuaa

SEQ ID NO: 1078966 - RNA, 16 nt, Homo sapiens
uuuaacuugaggguaa

SEQ ID NO: 1078967 - RNA, 20 nt, Homo sapiens
uuuaccacuaugcaauauau

SEQ ID NO: 1078968 - RNA, 18 nt, Homo sapiens
uuuagcaggguacauauu

SEQ ID NO: 1078969 - RNA, 21 nt, Homo sapiens
uuuccaaagcauuuuugauca

SEQ ID NO: 1078970 - RNA, 15 nt, Homo sapiens
uuuuaaaaauugauu

SEQ ID NO: 1078971 - RNA, 19 nt, Homo sapiens
uuuucccgagcaaagucua

SEQ ID NO: 1078972 - RNA, 16 nt, Homo sapiens
uuuuuaaaaaaguaag

SEQ ID NO: 1078973 - RNA, 15 nt, Homo sapiens
uuuuuaaauggaauu

SEQ ID NO: 1078974 - RNA, 16 nt, Homo sapiens
ccucguagccaucucu

SEQ ID NO: 1078975 - RNA, 18 nt, Homo sapiens
ccugccucaggcuucuga

SEQ ID NO: 1078976 - RNA, 15 nt, Homo sapiens
ccuggacaccucuca

SEQ ID NO: 1078977 - RNA, 19 nt, Homo sapiens
ccugggagaaccucaggcu

SEQ ID NO: 1078978 - RNA, 15 nt, Homo sapiens
ccuggucauuucaaa

SEQ ID NO: 1078979 - RNA, 13 nt, Homo sapiens
ccuugaagccacu

SEQ ID NO: 1078980 - RNA, 21 nt, Homo sapiens
ccuuguucuauugcacaggcu

SEQ ID NO: 1078981 - RNA, 22 nt, Homo sapiens
cgacaaagccaaacucugccag

SEQ ID NO: 1078982 - RNA, 17 nt, Homo sapiens
cgagaucacgccacugc

SEQ ID NO: 1078983 - RNA, 21 nt, Homo sapiens
cgagaucacgccacugcacuc

SEQ ID NO: 1078984 - RNA, 22 nt, Homo sapiens
cgagcuaugaucgcgccacuac

SEQ ID NO: 1078985 - RNA, 11 nt, Homo sapiens
cgcaccugccc

SEQ ID NO: 1078986 - RNA, 13 nt, Homo sapiens
cguagccaucucu

SEQ ID NO: 1078987 - RNA, 12 nt, Homo sapiens
cuaaauaucuca

SEQ ID NO: 1078988 - RNA, 18 nt, Homo sapiens
cuaauagaaccaagaauu

SEQ ID NO: 1078989 - RNA, 12 nt, Homo sapiens
cuacugaucaac

SEQ ID NO: 1078990 - RNA, 18 nt, Homo sapiens
cuaggccacaccaucucc

SEQ ID NO: 1078991 - RNA, 13 nt, Homo sapiens
cuaguacuauuau

SEQ ID NO: 1078992 - RNA, 12 nt, Homo sapiens
cuaguacuauug

SEQ ID NO: 1078993 - RNA, 12 nt, Homo sapiens
cuauagucccag

SEQ ID NO: 1078994 - RNA, 23 nt, Homo sapiens
cuauggguugucaauaguauuaa

SEQ ID NO: 1078995 - RNA, 14 nt, Homo sapiens
cuauuacuaguacu

SEQ ID NO: 1078996 - RNA, 18 nt, Homo sapiens
cuauuacuaguacuauua

SEQ ID NO: 1078997 - RNA, 12 nt, Homo sapiens
cuauuacuauua

SEQ ID NO: 1078998 - RNA, 12 nt, Homo sapiens
cuauuacuauuu

SEQ ID NO: 1078999 - RNA, 13 nt, Homo sapiens
cuauuuauuucac

SEQ ID NO: 1079000 - RNA, 17 nt, Homo sapiens
cucaggcuuccuuggca

SEQ ID NO: 1079001 - RNA, 15 nt, Homo sapiens
cucaugcgcaaugag

SEQ ID NO: 1079002 - RNA, 18 nt, Homo sapiens
cuccaccaucaccucucu

SEQ ID NO: 1079003 - RNA, 19 nt, Homo sapiens
cucuguccuaaauaucuca

SEQ ID NO: 1079004 - RNA, 14 nt, Homo sapiens
cucuguguaucuca

SEQ ID NO: 1079005 - RNA, 16 nt, Homo sapiens
cugaaacccaguaauu

SEQ ID NO: 1079006 - RNA, 16 nt, Homo sapiens
cugaaaucagugccua

SEQ ID NO: 1079007 - RNA, 17 nt, Homo sapiens
cugaaggagauuuuccu

SEQ ID NO: 1079008 - RNA, 13 nt, Homo sapiens
cugagcccuggca

SEQ ID NO: 1079009 - RNA, 21 nt, Homo sapiens
cugcagugacgugcaccugua

SEQ ID NO: 1079010 - RNA, 16 nt, Homo sapiens
cugccagccacaucca

SEQ ID NO: 1079011 - RNA, 18 nt, Homo sapiens
cugccuugaagccacuga

SEQ ID NO: 1079012 - RNA, 13 nt, Homo sapiens
cuggcugggcaug

SEQ ID NO: 1079013 - RNA, 20 nt, Homo sapiens
cugggccaaguuccucuagu

SEQ ID NO: 1079014 - RNA, 17 nt, Homo sapiens
cugguaauuuguaucug

SEQ ID NO: 1079015 - RNA, 12 nt, Homo sapiens
cuguccuaggcc

SEQ ID NO: 1079016 - RNA, 16 nt, Homo sapiens
cugucugucccaaaga

SEQ ID NO: 1079017 - RNA, 22 nt, Homo sapiens
cugugaaaucauaaaguccuuu

SEQ ID NO: 1079018 - RNA, 13 nt, Homo sapiens
cuguguaucucag

SEQ ID NO: 1079019 - RNA, 16 nt, Homo sapiens
cuuaaucuccacuguu

SEQ ID NO: 1079020 - RNA, 22 nt, Homo sapiens
cuuaugcguaagugguaugcau

SEQ ID NO: 1079021 - RNA, 17 nt, Homo sapiens
cuuauuuuaccuucuca

SEQ ID NO: 1079022 - RNA, 18 nt, Homo sapiens
cuuauuuuaccuucucau

SEQ ID NO: 1079023 - RNA, 16 nt, Homo sapiens
cuucaaguuagcucag

SEQ ID NO: 1079024 - RNA, 22 nt, Homo sapiens
cuuggaaagcaucaccucaggc

SEQ ID NO: 1079025 - RNA, 23 nt, Homo sapiens
cuuggaaagcaucaccucaggcc

SEQ ID NO: 1079026 - RNA, 14 nt, Homo sapiens
cuuucacucaggcu

SEQ ID NO: 1079027 - RNA, 13 nt, Homo sapiens
cuuucagcuguga

SEQ ID NO: 1079028 - RNA, 16 nt, Homo sapiens
cuuucagcugugaaca

SEQ ID NO: 1079029 - RNA, 18 nt, Homo sapiens
gaaagcaucaccucaggc

SEQ ID NO: 1079030 - RNA, 13 nt, Homo sapiens
gaaaucugccaau

SEQ ID NO: 1079031 - RNA, 16 nt, Homo sapiens
gaaccuaauagcacca

SEQ ID NO: 1079032 - RNA, 18 nt, Homo sapiens
gaacuauuuauuucaccc

SEQ ID NO: 1079033 - RNA, 17 nt, Homo sapiens
gaagacccaguguaaag

SEQ ID NO: 1079034 - RNA, 18 nt, Homo sapiens
uauggguugucaauagua

SEQ ID NO: 1079035 - RNA, 19 nt, Homo sapiens
uauguaugcugauuuacua

SEQ ID NO: 1079036 - RNA, 19 nt, Homo sapiens
uauuaccuggucauuucaa

SEQ ID NO: 1079037 - RNA, 14 nt, Homo sapiens
uauugcuaguacua

SEQ ID NO: 1079038 - RNA, 15 nt, Homo sapiens
uauuguauuacauuu

SEQ ID NO: 1079039 - RNA, 19 nt, Homo sapiens
uauuugagagaaucuacua

SEQ ID NO: 1079040 - RNA, 13 nt, Homo sapiens
ucaaaaaugccac

SEQ ID NO: 1079041 - RNA, 20 nt, Homo sapiens
ucaaguauuagggguaauau

SEQ ID NO: 1079042 - RNA, 12 nt, Homo sapiens
ucaauaguauua

SEQ ID NO: 1079043 - RNA, 15 nt, Homo sapiens
ucaaucauuaauuca

SEQ ID NO: 1079044 - RNA, 17 nt, Homo sapiens
ucacaaaaaaaguaauu

SEQ ID NO: 1079045 - RNA, 12 nt, Homo sapiens
ucaccucaggcc

SEQ ID NO: 1079046 - RNA, 21 nt, Homo sapiens
ucagacugcugggacuggcca

SEQ ID NO: 1079047 - RNA, 15 nt, Homo sapiens
ucaggcuucugagua

SEQ ID NO: 1079048 - RNA, 14 nt, Homo sapiens
ucaguuguuuuccc

SEQ ID NO: 1079049 - RNA, 16 nt, Homo sapiens
ucauagcucacuguaa

SEQ ID NO: 1079050 - RNA, 14 nt, Homo sapiens
ucaugacuuuucca

SEQ ID NO: 1079051 - RNA, 16 nt, Homo sapiens
ucauucacaacuauga

SEQ ID NO: 1079052 - RNA, 20 nt, Homo sapiens
uccaaagcauuuuugaucaa

SEQ ID NO: 1079053 - RNA, 20 nt, Homo sapiens
uccauucaugccaaagcaaa

SEQ ID NO: 1079054 - RNA, 23 nt, Homo sapiens
ucccguguuguaccugacuucca

SEQ ID NO: 1079055 - RNA, 20 nt, Homo sapiens
uccugggagaaccucaggcu

SEQ ID NO: 1079056 - RNA, 16 nt, Homo sapiens
uccuggugauucugau

SEQ ID NO: 1079057 - RNA, 14 nt, Homo sapiens
ucguagccaucucu

SEQ ID NO: 1079058 - RNA, 16 nt, Homo sapiens
ucuaaaacucauacaa

SEQ ID NO: 1079059 - RNA, 19 nt, Homo sapiens
ucuaacuagaaaucugcca

SEQ ID NO: 1079060 - RNA, 18 nt, Homo sapiens
ucuaagugguauauacau

SEQ ID NO: 1079061 - RNA, 17 nt, Homo sapiens
ucuacugaucaacagac

SEQ ID NO: 1079062 - RNA, 14 nt, Homo sapiens
ucucaaugugcaau

SEQ ID NO: 1079063 - RNA, 17 nt, Homo sapiens
ucucccccugggcucug

SEQ ID NO: 1079064 - RNA, 21 nt, Homo sapiens
ucucggaccuuucagcuguga

SEQ ID NO: 1079065 - RNA, 14 nt, Homo sapiens
ucugaaauuuccca

SEQ ID NO: 1079066 - RNA, 17 nt, Homo sapiens
ucugagaucagugccua

SEQ ID NO: 1079067 - RNA, 20 nt, Homo sapiens
ucugccccagcucuggcuuc

SEQ ID NO: 1079068 - RNA, 16 nt, Homo sapiens
ucugcuauauuuucau

SEQ ID NO: 1079069 - RNA, 14 nt, Homo sapiens
ucuguguaucucag

SEQ ID NO: 1079070 - RNA, 20 nt, Homo sapiens
ucuugaaccccuggccucaa

SEQ ID NO: 1079071 - RNA, 21 nt, Homo sapiens
ucuuguauaaugaacauguua

SEQ ID NO: 1079072 - RNA, 17 nt, Homo sapiens
ucuuugagaacaaugga

SEQ ID NO: 1079073 - RNA, 14 nt, Homo sapiens
ucuuuuguucuaaa

SEQ ID NO: 1079074 - RNA, 15 nt, Homo sapiens
ucuuuuucacacuga

SEQ ID NO: 1079075 - RNA, 19 nt, Homo sapiens
ugaaauuucccacacccca

SEQ ID NO: 1079076 - RNA, 23 nt, Homo sapiens
ugaaccccuggccucaagcaauc

SEQ ID NO: 1079077 - RNA, 13 nt, Homo sapiens
ugaagacccagug

SEQ ID NO: 1079078 - RNA, 22 nt, Homo sapiens
ugaagacccaguguaaagaaua

SEQ ID NO: 1079079 - RNA, 23 nt, Homo sapiens
ugaagacccaguguaaagaauaa

SEQ ID NO: 1079080 - RNA, 15 nt, Homo sapiens
ugaaucaugaaguaa

SEQ ID NO: 1079081 - RNA, 15 nt, Homo sapiens
ugaauggccugccuu

SEQ ID NO: 1079082 - RNA, 15 nt, Homo sapiens
ugacagcacuacaaa

SEQ ID NO: 1079083 - RNA, 18 nt, Homo sapiens
ugaggacuuaauuuacuu

SEQ ID NO: 1079084 - RNA, 16 nt, Homo sapiens
ugaggggcuccuggaa

SEQ ID NO: 1079085 - RNA, 22 nt, Homo sapiens
ugaggggcuccuggaaaggcuc

SEQ ID NO: 1079086 - RNA, 16 nt, Homo sapiens
ugauaggaaaaaucca

SEQ ID NO: 1079087 - RNA, 20 nt, Homo sapiens
ugauuuaccacuuaugcaua

SEQ ID NO: 1079088 - RNA, 21 nt, Homo sapiens
ugauuuucucuggcagcauaa

SEQ ID NO: 1079089 - RNA, 14 nt, Homo sapiens
ugcaaacaucuuca

SEQ ID NO: 1079090 - RNA, 18 nt, Homo sapiens
ugcaccuguacucaggag

SEQ ID NO: 1079091 - RNA, 15 nt, Homo sapiens
ugcucccaugcucau

SEQ ID NO: 1079092 - RNA, 12 nt, Homo sapiens
ugcuucacauaa

SEQ ID NO: 1079093 - RNA, 12 nt, Homo sapiens
ugcuucagccug

SEQ ID NO: 1079094 - RNA, 18 nt, Homo sapiens
uggaaagcaucaccucag

SEQ ID NO: 1079095 - RNA, 17 nt, Homo sapiens
uggaauuuguaaguuua

SEQ ID NO: 1079096 - RNA, 18 nt, Homo sapiens
ugguaaaaccccaucucu

SEQ ID NO: 1079097 - RNA, 14 nt, Homo sapiens
ugguauauuuccau

SEQ ID NO: 1079098 - RNA, 22 nt, Homo sapiens
aacccauaggcacuugggaugu

SEQ ID NO: 1079099 - RNA, 23 nt, Homo sapiens
aacgacaaagccaaacucugcca

SEQ ID NO: 1079100 - RNA, 13 nt, Homo sapiens
aacugacuuccaa

SEQ ID NO: 1079101 - RNA, 16 nt, Homo sapiens
aagaauaaaugaaucu

SEQ ID NO: 1079102 - RNA, 14 nt, Homo sapiens
aagaauaccaauau

SEQ ID NO: 1079103 - RNA, 12 nt, Homo sapiens
aagacccagugu

SEQ ID NO: 1079104 - RNA, 13 nt, Homo sapiens
aagacccagugua

SEQ ID NO: 1079105 - RNA, 21 nt, Homo sapiens
aagacccaguguaaagaauaa

SEQ ID NO: 1079106 - RNA, 18 nt, Homo sapiens
aagagcauagaacucaaa

SEQ ID NO: 1079107 - RNA, 21 nt, Homo sapiens
aagcaauuacaauacaucuaa

SEQ ID NO: 1079108 - RNA, 20 nt, Homo sapiens
aagcauuuuuucauauucug

SEQ ID NO: 1079109 - RNA, 17 nt, Homo sapiens
aagccaaacucugccag

SEQ ID NO: 1079110 - RNA, 11 nt, Homo sapiens
aagccacugaa

SEQ ID NO: 1079111 - RNA, 15 nt, Homo sapiens
aagggugacauccca

SEQ ID NO: 1079112 - RNA, 15 nt, Homo sapiens
aaguaaguaccacuc

SEQ ID NO: 1079113 - RNA, 18 nt, Homo sapiens
aaguaaguaccacucagg

SEQ ID NO: 1079114 - RNA, 19 nt, Homo sapiens
aauaaaugauguacuacau

SEQ ID NO: 1079115 - RNA, 15 nt, Homo sapiens
aauaauguauacaca

SEQ ID NO: 1079116 - RNA, 16 nt, Homo sapiens
aauaauguauacacau

SEQ ID NO: 1079117 - RNA, 17 nt, Homo sapiens
aauauaucaauguaaca

SEQ ID NO: 1079118 - RNA, 14 nt, Homo sapiens
aaucuaaaaauccu

SEQ ID NO: 1079119 - RNA, 19 nt, Homo sapiens
aaucuccacuguuauucua

SEQ ID NO: 1079120 - RNA, 16 nt, Homo sapiens
aaugaagacccagugu

SEQ ID NO: 1079121 - RNA, 22 nt, Homo sapiens
aauuacaauacaucuaagcuau

SEQ ID NO: 1079122 - RNA, 18 nt, Homo sapiens
aauucuuuuucacacuga

SEQ ID NO: 1079123 - RNA, 13 nt, Homo sapiens
aauuuuuugcucu

SEQ ID NO: 1079124 - RNA, 21 nt, Homo sapiens
acaaauucuuuuucacacuga

SEQ ID NO: 1079125 - RNA, 15 nt, Homo sapiens
acaguccugggagaa

SEQ ID NO: 1079126 - RNA, 19 nt, Homo sapiens
acauaaacacauacauugc

SEQ ID NO: 1079127 - RNA, 20 nt, Homo sapiens
acauccucugcuaccaucuc

SEQ ID NO: 1079128 - RNA, 22 nt, Homo sapiens
acauccucugcuaccaucucau

SEQ ID NO: 1079129 - RNA, 19 nt, Homo sapiens
acauguuaacaccuaccuc

SEQ ID NO: 1079130 - RNA, 23 nt, Homo sapiens
accaaaaauaaaacuuuucaugu

SEQ ID NO: 1079131 - RNA, 18 nt, Homo sapiens
accaauauucuuuuguuc

SEQ ID NO: 1079132 - RNA, 23 nt, Homo sapiens
accacucaggccaacaagccaac

SEQ ID NO: 1079133 - RNA, 21 nt, Homo sapiens
accacuuaugcauagauauau

SEQ ID NO: 1079134 - RNA, 14 nt, Homo sapiens
accaucaccucucu

SEQ ID NO: 1079135 - RNA, 21 nt, Homo sapiens
acccccagccuggacaccucu

SEQ ID NO: 1079136 - RNA, 18 nt, Homo sapiens
accuucaugcuuacuauu

SEQ ID NO: 1079137 - RNA, 22 nt, Homo sapiens
accuuguuccuguaaaauccau

SEQ ID NO: 1079138 - RNA, 22 nt, Homo sapiens
acgauuuugcacaaauauccac

SEQ ID NO: 1079139 - RNA, 15 nt, Homo sapiens
acgccuaugauccca

SEQ ID NO: 1079140 - RNA, 21 nt, Homo sapiens
acggcuggaccugcacgccac

SEQ ID NO: 1079141 - RNA, 17 nt, Homo sapiens
acuaaacagacuauuua

SEQ ID NO: 1079142 - RNA, 18 nt, Homo sapiens
acuaaacagacuauuuaa

SEQ ID NO: 1079143 - RNA, 13 nt, Homo sapiens
acuacacuccagc

SEQ ID NO: 1079144 - RNA, 15 nt, Homo sapiens
acuacauuuucacaa

SEQ ID NO: 1079145 - RNA, 15 nt, Homo sapiens
acuaggacucugagg

SEQ ID NO: 1079146 - RNA, 13 nt, Homo sapiens
acuaggguguaaa

SEQ ID NO: 1079147 - RNA, 14 nt, Homo sapiens
acuaucuagguauu

SEQ ID NO: 1079148 - RNA, 14 nt, Homo sapiens
acuauuauggaauu

SEQ ID NO: 1079149 - RNA, 21 nt, Homo sapiens
acucacagccguccaacuuaa

SEQ ID NO: 1079150 - RNA, 17 nt, Homo sapiens
acuccaccaucaccucu

SEQ ID NO: 1079151 - RNA, 13 nt, Homo sapiens
acuccagccugag

SEQ ID NO: 1079152 - RNA, 23 nt, Homo sapiens
acucugaggcucuuucugggcca

SEQ ID NO: 1079153 - RNA, 18 nt, Homo sapiens
acugaggaaucagcucaa

SEQ ID NO: 1079154 - RNA, 17 nt, Homo sapiens
acuucuaagagcauaga

SEQ ID NO: 1079155 - RNA, 18 nt, Homo sapiens
acuuguccuuuuguacca

SEQ ID NO: 1079156 - RNA, 18 nt, Homo sapiens
guguaaagaauaaaugaa

SEQ ID NO: 1079157 - RNA, 20 nt, Homo sapiens
guucgagaccagccuggcca

SEQ ID NO: 1079158 - RNA, 16 nt, Homo sapiens
guucugguaugaacuu

SEQ ID NO: 1079159 - RNA, 15 nt, Homo sapiens
guugaucccaagaca

SEQ ID NO: 1079160 - RNA, 14 nt, Homo sapiens
uaaaauuguaaaau

SEQ ID NO: 1079161 - RNA, 18 nt, Homo sapiens
uaaacacauacauugcca

SEQ ID NO: 1079162 - RNA, 20 nt, Homo sapiens
uaaacauugguauauuucca

SEQ ID NO: 1079163 - RNA, 15 nt, Homo sapiens
uaaacuaaaagcaua

SEQ ID NO: 1079164 - RNA, 14 nt, Homo sapiens
uaaacuaguacuau

SEQ ID NO: 1079165 - RNA, 17 nt, Homo sapiens
uaaagaauaaaugaauc

SEQ ID NO: 1079166 - RNA, 18 nt, Homo sapiens
uaaagaauaaaugaaucu

SEQ ID NO: 1079167 - RNA, 22 nt, Homo sapiens
uaaagaauaaaugaaucuuacu

SEQ ID NO: 1079168 - RNA, 18 nt, Homo sapiens
uaaaugaaucuuacuccu

SEQ ID NO: 1079169 - RNA, 17 nt, Homo sapiens
uaaauuguuugaccaug

SEQ ID NO: 1079170 - RNA, 20 nt, Homo sapiens
uaacaaaacuauacuuguac

SEQ ID NO: 1079171 - RNA, 21 nt, Homo sapiens
uaacacuaauaauaguacuau

SEQ ID NO: 1079172 - RNA, 12 nt, Homo sapiens
uaaccaguacuu

SEQ ID NO: 1079173 - RNA, 18 nt, Homo sapiens
uaacuauuaguauuauua

SEQ ID NO: 1079174 - RNA, 13 nt, Homo sapiens
uaagcuguaaaaa

SEQ ID NO: 1079175 - RNA, 18 nt, Homo sapiens
uaagugguauauacauau

SEQ ID NO: 1079176 - RNA, 13 nt, Homo sapiens
uaaguucagucca

SEQ ID NO: 1079177 - RNA, 17 nt, Homo sapiens
uaauaauaguacuauua

SEQ ID NO: 1079178 - RNA, 15 nt, Homo sapiens
uaauaguacuauuac

SEQ ID NO: 1079179 - RNA, 14 nt, Homo sapiens
uaauaguacuauug

SEQ ID NO: 1079180 - RNA, 15 nt, Homo sapiens
uaauauaugcucaac

SEQ ID NO: 1079181 - RNA, 20 nt, Homo sapiens
uaauccagagauaauugcca

SEQ ID NO: 1079182 - RNA, 11 nt, Homo sapiens
uaaucucagga

SEQ ID NO: 1079183 - RNA, 16 nt, Homo sapiens
uaaugaagacccagug

SEQ ID NO: 1079184 - RNA, 18 nt, Homo sapiens
uaaugaagacccagugua

SEQ ID NO: 1079185 - RNA, 19 nt, Homo sapiens
uaaugaagacccaguguaa

SEQ ID NO: 1079186 - RNA, 17 nt, Homo sapiens
uaauuguaaacuaguac

SEQ ID NO: 1079187 - RNA, 14 nt, Homo sapiens
uaauuuguaucuga

SEQ ID NO: 1079188 - RNA, 17 nt, Homo sapiens
uacaguaaauaaauugu

SEQ ID NO: 1079189 - RNA, 18 nt, Homo sapiens
uacauaguucuuacuacu

SEQ ID NO: 1079190 - RNA, 18 nt, Homo sapiens
uacauugccaauuuucca

SEQ ID NO: 1079191 - RNA, 15 nt, Homo sapiens
uacauuuuuguacac

SEQ ID NO: 1079192 - RNA, 13 nt, Homo sapiens
uaccuccaugagc

SEQ ID NO: 1079193 - RNA, 15 nt, Homo sapiens
uacuauuacuaguac

SEQ ID NO: 1079194 - RNA, 17 nt, Homo sapiens
uacuauuacuauuacua

SEQ ID NO: 1079195 - RNA, 20 nt, Homo sapiens
uacuauuauggaauuacucu

SEQ ID NO: 1079196 - RNA, 21 nt, Homo sapiens
uacuauuauggaauuacucua

SEQ ID NO: 1079197 - RNA, 17 nt, Homo sapiens
uacuauugcuaguacua

SEQ ID NO: 1079198 - RNA, 17 nt, Homo sapiens
uacuauugcuauuacua

SEQ ID NO: 1079199 - RNA, 17 nt, Homo sapiens
uacucuuucacucaggc

SEQ ID NO: 1079200 - RNA, 19 nt, Homo sapiens
uacugaggaaucagcucaa

SEQ ID NO: 1079201 - RNA, 18 nt, Homo sapiens
uagagauaugcagaagga

SEQ ID NO: 1079202 - RNA, 18 nt, Homo sapiens
uagccaucucucuacucc

SEQ ID NO: 1079203 - RNA, 22 nt, Homo sapiens
uaguacuauuauggaauuacuc

SEQ ID NO: 1079204 - RNA, 20 nt, Homo sapiens
uagucgagcuugggcaauuu

SEQ ID NO: 1079205 - RNA, 21 nt, Homo sapiens
uaguggcaaaugaaagcauaa

SEQ ID NO: 1079206 - RNA, 22 nt, Homo sapiens
uauaaacauugguauauuucca

SEQ ID NO: 1079207 - RNA, 23 nt, Homo sapiens
uauaaacauugguauauuuccau

SEQ ID NO: 1079208 - RNA, 15 nt, Homo sapiens
uauauugcugcuggu

SEQ ID NO: 1079209 - RNA, 19 nt, Homo sapiens
uaucucggaccuuucagcu

SEQ ID NO: 1079210 - RNA, 15 nt, Homo sapiens
uaugugcuucacaua

SEQ ID NO: 1079211 - RNA, 12 nt, Homo sapiens
uauuaagauauc

SEQ ID NO: 1079212 - RNA, 14 nt, Homo sapiens
uauuacuaguacua

SEQ ID NO: 1079213 - RNA, 17 nt, Homo sapiens
uauucaauaaagcugcu

SEQ ID NO: 1079214 - RNA, 16 nt, Homo sapiens
uauucucaaccagaga

SEQ ID NO: 1079215 - RNA, 15 nt, Homo sapiens
uauugcugcugguaa

SEQ ID NO: 1079216 - RNA, 13 nt, Homo sapiens
uauuuucacauga

SEQ ID NO: 1079217 - RNA, 17 nt, Homo sapiens
ucaaacauuauucucaa

SEQ ID NO: 1079218 - RNA, 22 nt, Homo sapiens
ucaagcaauccuccugccucag

SEQ ID NO: 1079219 - RNA, 15 nt, Homo sapiens
ucacauguccauuau

SEQ ID NO: 1079220 - RNA, 11 nt, Homo sapiens
ucacucaggcu

SEQ ID NO: 1079221 - RNA, 12 nt, Homo sapiens
ucagaagauauc

SEQ ID NO: 1079222 - RNA, 13 nt, Homo sapiens
ucagaagccugag

SEQ ID NO: 1079223 - RNA, 17 nt, Homo sapiens
ucagcugugaacaugga

SEQ ID NO: 1079224 - RNA, 15 nt, Homo sapiens
ucaggaucaucugag

SEQ ID NO: 1079225 - RNA, 18 nt, Homo sapiens
ucaggccaacaagccaac

SEQ ID NO: 1079226 - RNA, 18 nt, Homo sapiens
ucaggccaggugcagugg

SEQ ID NO: 1079227 - RNA, 17 nt, Homo sapiens
ucaguuccucuuugcau

SEQ ID NO: 1079228 - RNA, 13 nt, Homo sapiens
ucauacaaugaua

SEQ ID NO: 1079229 - RNA, 17 nt, Homo sapiens
uccaauuacuccaccau

SEQ ID NO: 1079230 - RNA, 22 nt, Homo sapiens
uccagugggaggugagaccacc

SEQ ID NO: 1079231 - RNA, 13 nt, Homo sapiens
ucccagcuacuca

SEQ ID NO: 1079232 - RNA, 15 nt, Homo sapiens
uccuaaauaucucaa

SEQ ID NO: 1079233 - RNA, 21 nt, Homo sapiens
ucguggguguguguagccaag

SEQ ID NO: 1079234 - RNA, 19 nt, Homo sapiens
ucuaagugguauauacaua

SEQ ID NO: 1079235 - RNA, 17 nt, Homo sapiens
ucuacuccuaccucagc

SEQ ID NO: 1079236 - RNA, 14 nt, Homo sapiens
ucucuacugaucaa

SEQ ID NO: 1079237 - RNA, 12 nt, Homo sapiens
ucucuuuccaaa

SEQ ID NO: 1079238 - RNA, 14 nt, Homo sapiens
ucugaaggagauuu

SEQ ID NO: 1079239 - RNA, 19 nt, Homo sapiens
ucugcacaacugacuucca

SEQ ID NO: 1079240 - RNA, 13 nt, Homo sapiens
ucuuauuugcuca

SEQ ID NO: 1079241 - RNA, 14 nt, Homo sapiens
ucuuccugccucag

SEQ ID NO: 1079242 - RNA, 13 nt, Homo sapiens
ucuucuuacucca

SEQ ID NO: 1079243 - RNA, 19 nt, Homo sapiens
ugaaaucgcugcucaaaaa

SEQ ID NO: 1079244 - RNA, 13 nt, Homo sapiens
ugaagccacugaa

SEQ ID NO: 1079245 - RNA, 21 nt, Homo sapiens
ugaagcugacagcacuacaaa

SEQ ID NO: 1079246 - RNA, 22 nt, Homo sapiens
ugaauaauuuucuggcacuggu

SEQ ID NO: 1079247 - RNA, 15 nt, Homo sapiens
ugaaucuuacuccuu

SEQ ID NO: 1079248 - RNA, 16 nt, Homo sapiens
ugagcuggacauaaca

SEQ ID NO: 1079249 - RNA, 14 nt, Homo sapiens
ugaggcugcagcga

SEQ ID NO: 1079250 - RNA, 14 nt, Homo sapiens
ugcacuccagccug

SEQ ID NO: 1079251 - RNA, 14 nt, Homo sapiens
ugcauggaauuugu

SEQ ID NO: 1079252 - RNA, 15 nt, Homo sapiens
ugcuauuacuaguac

SEQ ID NO: 1079253 - RNA, 21 nt, Homo sapiens
ugcuauuacuaguacuauuac

SEQ ID NO: 1079254 - RNA, 19 nt, Homo sapiens
uggaaagcaucaccucagg

SEQ ID NO: 1079255 - RNA, 22 nt, Homo sapiens
uggaaagcaucaccucaggcca

SEQ ID NO: 1079256 - RNA, 12 nt, Homo sapiens
uggcugcaguga

SEQ ID NO: 1079257 - RNA, 19 nt, Homo sapiens
uggggucuugcuauauugc

SEQ ID NO: 1079258 - RNA, 16 nt, Homo sapiens
ugguaauuuguaucug

SEQ ID NO: 1079259 - RNA, 23 nt, Homo sapiens
ugguuacagcccagacuuuacca

SEQ ID NO: 1079260 - RNA, 18 nt, Homo sapiens
uguaaagaauaaaugaau

SEQ ID NO: 1079261 - RNA, 16 nt, Homo sapiens
uguaccugacuuccac

SEQ ID NO: 1079262 - RNA, 20 nt, Homo sapiens
uguaucuaccucacuauuca

SEQ ID NO: 1079263 - RNA, 21 nt, Homo sapiens
uguaugcugauuuacuacuua

SEQ ID NO: 1079264 - RNA, 20 nt, Homo sapiens
ugucauagaagaaaauccau

SEQ ID NO: 1079265 - RNA, 14 nt, Homo sapiens
ugucugucccaaag

SEQ ID NO: 1079266 - RNA, 20 nt, Homo sapiens
uguggguuuuuucacauaaa

SEQ ID NO: 1079267 - RNA, 12 nt, Homo sapiens
uguguguagcca

SEQ ID NO: 1079268 - RNA, 18 nt, Homo sapiens
uguuaguauuaacuauua

SEQ ID NO: 1079269 - RNA, 13 nt, Homo sapiens
uguucucacuuau

SEQ ID NO: 1079270 - RNA, 11 nt, Homo sapiens
uguugauccca

SEQ ID NO: 1079271 - RNA, 12 nt, Homo sapiens
uguugaucccaa

SEQ ID NO: 1079272 - RNA, 22 nt, Homo sapiens
uuaaauggaauuuucuaauaua

SEQ ID NO: 1079273 - RNA, 14 nt, Homo sapiens
uuaacaccuaccuc

SEQ ID NO: 1079274 - RNA, 22 nt, Homo sapiens
uuaaugaagacccaguguaaag

SEQ ID NO: 1079275 - RNA, 17 nt, Homo sapiens
uuacaggauuaauauau

SEQ ID NO: 1079276 - RNA, 13 nt, Homo sapiens
uuacuacuugcca

SEQ ID NO: 1079277 - RNA, 15 nt, Homo sapiens
cuacugaaaaugcau

SEQ ID NO: 1079278 - RNA, 12 nt, Homo sapiens
cuacuugccaca

SEQ ID NO: 1079279 - RNA, 18 nt, Homo sapiens
cuacuugccacacacugu

SEQ ID NO: 1079280 - RNA, 19 nt, Homo sapiens
cuaggagaacugcuguguu

SEQ ID NO: 1079281 - RNA, 23 nt, Homo sapiens
cuaggagaacugcuguguucuca

SEQ ID NO: 1079282 - RNA, 22 nt, Homo sapiens
cuaguacuauugcuauuacuag

SEQ ID NO: 1079283 - RNA, 21 nt, Homo sapiens
cuauagucccagcuacucaga

SEQ ID NO: 1079284 - RNA, 16 nt, Homo sapiens
cucaauuaccaauaug

SEQ ID NO: 1079285 - RNA, 13 nt, Homo sapiens
cucauacaaugau

SEQ ID NO: 1079286 - RNA, 16 nt, Homo sapiens
cucccucugaccugca

SEQ ID NO: 1079287 - RNA, 23 nt, Homo sapiens
cuccuggaaaggcucagucucag

SEQ ID NO: 1079288 - RNA, 17 nt, Homo sapiens
cucuacuccuaccucag

SEQ ID NO: 1079289 - RNA, 18 nt, Homo sapiens
cucuacuccuaccucagc

SEQ ID NO: 1079290 - RNA, 19 nt, Homo sapiens
cucuucccccacuccucuu

SEQ ID NO: 1079291 - RNA, 19 nt, Homo sapiens
cugaagggugacaucccag

SEQ ID NO: 1079292 - RNA, 21 nt, Homo sapiens
cugacucucugugaccugccc

SEQ ID NO: 1079293 - RNA, 14 nt, Homo sapiens
cugagaaucuagcc

SEQ ID NO: 1079294 - RNA, 21 nt, Homo sapiens
cugaguagcuaggacuauggg

SEQ ID NO: 1079295 - RNA, 19 nt, Homo sapiens
cugcacaacugacuuccaa

SEQ ID NO: 1079296 - RNA, 23 nt, Homo sapiens
cugcagaggggaaaccaguguag

SEQ ID NO: 1079297 - RNA, 21 nt, Homo sapiens
cugcagccccgcgccuccuuc

SEQ ID NO: 1079298 - RNA, 13 nt, Homo sapiens
cugcaggccaaga

SEQ ID NO: 1079299 - RNA, 16 nt, Homo sapiens
cugccagccuggcuuc

SEQ ID NO: 1079300 - RNA, 18 nt, Homo sapiens
cugcccugccaccugucu

SEQ ID NO: 1079301 - RNA, 13 nt, Homo sapiens
cugcggcgaccgc

SEQ ID NO: 1079302 - RNA, 20 nt, Homo sapiens
cugcugguaauuuguaucug

SEQ ID NO: 1079303 - RNA, 16 nt, Homo sapiens
cuggccucaagcaauc

SEQ ID NO: 1079304 - RNA, 13 nt, Homo sapiens
cuggcugcaguga

SEQ ID NO: 1079305 - RNA, 22 nt, Homo sapiens
cugggccaaguuccucuagugc

SEQ ID NO: 1079306 - RNA, 13 nt, Homo sapiens
cugguccuuccag

SEQ ID NO: 1079307 - RNA, 16 nt, Homo sapiens
cugguuuuacagagcu

SEQ ID NO: 1079308 - RNA, 13 nt, Homo sapiens
cuguaaaauccau

SEQ ID NO: 1079309 - RNA, 13 nt, Homo sapiens
cuguacucaggag

SEQ ID NO: 1079310 - RNA, 17 nt, Homo sapiens
cuguaugguauaugcau

SEQ ID NO: 1079311 - RNA, 12 nt, Homo sapiens
cugucccaaaga

SEQ ID NO: 1079312 - RNA, 14 nt, Homo sapiens
cugucugucugucu

SEQ ID NO: 1079313 - RNA, 18 nt, Homo sapiens
cuguguaucucagcauuu

SEQ ID NO: 1079314 - RNA, 15 nt, Homo sapiens
cugugucguagccaa

SEQ ID NO: 1079315 - RNA, 15 nt, Homo sapiens
cuguuaauaguacua

SEQ ID NO: 1079316 - RNA, 12 nt, Homo sapiens
cuguuaguauua

SEQ ID NO: 1079317 - RNA, 18 nt, Homo sapiens
cuuagaauaaaauuguaa

SEQ ID NO: 1079318 - RNA, 14 nt, Homo sapiens
cuugcuauauugcc

SEQ ID NO: 1079319 - RNA, 23 nt, Homo sapiens
cuuggaauuggaauuacuguaaa

SEQ ID NO: 1079320 - RNA, 13 nt, Homo sapiens
cuuggacuugagg

SEQ ID NO: 1079321 - RNA, 20 nt, Homo sapiens
cuuguauaaugaacauguua

SEQ ID NO: 1079322 - RNA, 17 nt, Homo sapiens
cuuuaaauggaauaauu

SEQ ID NO: 1079323 - RNA, 16 nt, Homo sapiens
cuuugagaacaaugga

SEQ ID NO: 1079324 - RNA, 14 nt, Homo sapiens
cuuuuucacacuga

SEQ ID NO: 1079325 - RNA, 15 nt, Homo sapiens
gaaaacuuauuugag

SEQ ID NO: 1079326 - RNA, 13 nt, Homo sapiens
gaaaggcucaguc

SEQ ID NO: 1079327 - RNA, 16 nt, Homo sapiens
gaaauaaaugauguac

SEQ ID NO: 1079328 - RNA, 12 nt, Homo sapiens
gaaaucugccaa

SEQ ID NO: 1079329 - RNA, 19 nt, Homo sapiens
gaacaauggagauaucagu

SEQ ID NO: 1079330 - RNA, 22 nt, Homo sapiens
gaaccccuggccucaagcaauc

SEQ ID NO: 1079331 - RNA, 14 nt, Homo sapiens
gaagacccagugua

SEQ ID NO: 1079332 - RNA, 18 nt, Homo sapiens
gaauaaaauuguaaaauu

SEQ ID NO: 1079333 - RNA, 19 nt, Homo sapiens
gaauguuauccaacuauua

SEQ ID NO: 1079334 - RNA, 12 nt, Homo sapiens
gacaaagccaaa

SEQ ID NO: 1079335 - RNA, 19 nt, Homo sapiens
gaccaccucucaauauuca

SEQ ID NO: 1079336 - RNA, 17 nt, Homo sapiens
gaccuuucagcugugaa

SEQ ID NO: 1079337 - RNA, 14 nt, Homo sapiens
gacuauggguacau

SEQ ID NO: 1079338 - RNA, 18 nt, Homo sapiens
gacucuucccccacuccu

SEQ ID NO: 1079339 - RNA, 13 nt, Homo sapiens
gacugaguccucg

SEQ ID NO: 1079340 - RNA, 22 nt, Homo sapiens
gagagaucauagcucacuguaa

SEQ ID NO: 1079341 - RNA, 14 nt, Homo sapiens
gagcaacagaguga

SEQ ID NO: 1079342 - RNA, 17 nt, Homo sapiens
gagcaggggcaggguga

SEQ ID NO: 1079343 - RNA, 16 nt, Homo sapiens
gagcccuggcaggaug

SEQ ID NO: 1079344 - RNA, 18 nt, Homo sapiens
gagcuugggcaauuuauc

SEQ ID NO: 1079345 - RNA, 16 nt, Homo sapiens
gaggugagaccaccuc

SEQ ID NO: 1079346 - RNA, 23 nt, Homo sapiens
gagucacccaugaagacaggaca

SEQ ID NO: 1079347 - RNA, 14 nt, Homo sapiens
gaguucugaagcug

SEQ ID NO: 1079348 - RNA, 18 nt, Homo sapiens
gaguuguggaaagccucu

SEQ ID NO: 1079349 - RNA, 22 nt, Homo sapiens
gauauaucuuuaauaaguaauc

SEQ ID NO: 1079350 - RNA, 20 nt, Homo sapiens
gauaucaguuaucaauguua

SEQ ID NO: 1079351 - RNA, 18 nt, Homo sapiens
gaucccaagacaaugaaa

SEQ ID NO: 1079352 - RNA, 12 nt, Homo sapiens
gauuacauguua

SEQ ID NO: 1079353 - RNA, 13 nt, Homo sapiens
gauuuuccuuccu

SEQ ID NO: 1079354 - RNA, 19 nt, Homo sapiens
gcaauuacaauacaucuaa

SEQ ID NO: 1079355 - RNA, 18 nt, Homo sapiens
gcagugacgugcaccugu

SEQ ID NO: 1079356 - RNA, 15 nt, Homo sapiens
gccaaacucugccag

SEQ ID NO: 1079357 - RNA, 14 nt, Homo sapiens
gccacacacuguuc

SEQ ID NO: 1079358 - RNA, 18 nt, Homo sapiens
gccagggcccugcagagg

SEQ ID NO: 1079359 - RNA, 14 nt, Homo sapiens
gcccagcugcaccu

SEQ ID NO: 1079360 - RNA, 15 nt, Homo sapiens
gcccugcccugccac

SEQ ID NO: 1079361 - RNA, 17 nt, Homo sapiens
gccucuguguaucucag

SEQ ID NO: 1079362 - RNA, 13 nt, Homo sapiens
gccugccuugaag

SEQ ID NO: 1079363 - RNA, 15 nt, Homo sapiens
gccuggcuucuggag

SEQ ID NO: 1079364 - RNA, 17 nt, Homo sapiens
gcgccuccuuccuugcu

SEQ ID NO: 1079365 - RNA, 13 nt, Homo sapiens
gcgccugugcuga

SEQ ID NO: 1079366 - RNA, 18 nt, Homo sapiens
gcgugucccucucggaag

SEQ ID NO: 1079367 - RNA, 20 nt, Homo sapiens
gcucccaugcucauaccucu

SEQ ID NO: 1079368 - RNA, 20 nt, Homo sapiens
gcugcagugacgugcaccug

SEQ ID NO: 1079369 - RNA, 19 nt, Homo sapiens
gcugcugagaaucuagccu

SEQ ID NO: 1079370 - RNA, 16 nt, Homo sapiens
gcugugaacauggacu

SEQ ID NO: 1079371 - RNA, 20 nt, Homo sapiens
ggacuauggguacauuccac

SEQ ID NO: 1079372 - RNA, 22 nt, Homo sapiens
gggaaaccaguguagccuugcc

SEQ ID NO: 1079373 - RNA, 16 nt, Homo sapiens
ggggcucugugcaggg

SEQ ID NO: 1079374 - RNA, 19 nt, Homo sapiens
ggguaauagaaaugcauac

SEQ ID NO: 1079375 - RNA, 22 nt, Homo sapiens
gguauauuuccauucaugccaa

SEQ ID NO: 1079376 - RNA, 20 nt, Homo sapiens
gguccugcaaucuccagggc

SEQ ID NO: 1079377 - RNA, 18 nt, Homo sapiens
guaaacuaguacuauuau

SEQ ID NO: 1079378 - RNA, 20 nt, Homo sapiens
guaaagaauaaaugaaucuu

SEQ ID NO: 1079379 - RNA, 23 nt, Homo sapiens
guaaguugaauggccugccuuga

SEQ ID NO: 1079380 - RNA, 16 nt, Homo sapiens
guacaauguacauuau

SEQ ID NO: 1079381 - RNA, 14 nt, Homo sapiens
guacuaguacuauu

SEQ ID NO: 1079382 - RNA, 14 nt, Homo sapiens
guacuauuacuauu

SEQ ID NO: 1079383 - RNA, 17 nt, Homo sapiens
guacuccuuaaauuuau

SEQ ID NO: 1079384 - RNA, 19 nt, Homo sapiens
guaucuaccucacuauuca

SEQ ID NO: 1079385 - RNA, 15 nt, Homo sapiens
guaugcaugggaugu

SEQ ID NO: 1079386 - RNA, 21 nt, Homo sapiens
guaugcugauuuacuacuuau

SEQ ID NO: 1079387 - RNA, 13 nt, Homo sapiens
guauuaacuauua

SEQ ID NO: 1079388 - RNA, 18 nt, Homo sapiens
guauuagauaucaauguu

SEQ ID NO: 1079389 - RNA, 19 nt, Homo sapiens
guauuuuagcaggguacau

SEQ ID NO: 1079390 - RNA, 21 nt, Homo sapiens
guauuuuaggcagggauuuga

SEQ ID NO: 1079391 - RNA, 17 nt, Homo sapiens
gucccagcuacucagaa

SEQ ID NO: 1079392 - RNA, 16 nt, Homo sapiens
guccuaaauaucucaa

SEQ ID NO: 1079393 - RNA, 16 nt, Homo sapiens
gucuaaagagcuuuag

SEQ ID NO: 1079394 - RNA, 18 nt, Homo sapiens
gucugaaaucagugccua

SEQ ID NO: 1079395 - RNA, 14 nt, Homo sapiens
gucugucccaaaga

SEQ ID NO: 1079396 - RNA, 13 nt, Homo sapiens
gugagaccaccuc

SEQ ID NO: 1079397 - RNA, 15 nt, Homo sapiens
gugcucuccuacccc

SEQ ID NO: 1079398 - RNA, 15 nt, Homo sapiens
aaaaaguaugugaau

SEQ ID NO: 1079399 - RNA, 21 nt, Homo sapiens
aaaaauaaaacuuuucaugua

SEQ ID NO: 1079400 - RNA, 18 nt, Homo sapiens
aaagaauaaaugaaucuu

SEQ ID NO: 1079401 - RNA, 15 nt, Homo sapiens
aaagacugagucaag

SEQ ID NO: 1079402 - RNA, 20 nt, Homo sapiens
aaaggcccuucaccucugga

SEQ ID NO: 1079403 - RNA, 20 nt, Homo sapiens
aaaguaauuguaaacuagua

SEQ ID NO: 1079404 - RNA, 16 nt, Homo sapiens
aaauacaaauuggaca

SEQ ID NO: 1079405 - RNA, 16 nt, Homo sapiens
aaaucuccaauccaca

SEQ ID NO: 1079406 - RNA, 22 nt, Homo sapiens
aaauugaaagcaggacauauga

SEQ ID NO: 1079407 - RNA, 16 nt, Homo sapiens
aacaauggagauauca

SEQ ID NO: 1079408 - RNA, 16 nt, Homo sapiens
aacaccuucaugcuua

SEQ ID NO: 1079409 - RNA, 16 nt, Homo sapiens
aacaugguaaaacccc

SEQ ID NO: 1079410 - RNA, 19 nt, Homo sapiens
aaccggcauauuauuccau

SEQ ID NO: 1079411 - RNA, 15 nt, Homo sapiens
aacgacaaagccaaa

SEQ ID NO: 1079412 - RNA, 14 nt, Homo sapiens
aacuaaaagcauag

SEQ ID NO: 1079413 - RNA, 16 nt, Homo sapiens
aacuagaaaucugcca

SEQ ID NO: 1079414 - RNA, 12 nt, Homo sapiens
aacugacuucca

SEQ ID NO: 1079415 - RNA, 21 nt, Homo sapiens
aacuguuaguauuaacuauua

SEQ ID NO: 1079416 - RNA, 20 nt, Homo sapiens
aacuugaggacacaugucca

SEQ ID NO: 1079417 - RNA, 12 nt, Homo sapiens
aagaaaauccau

SEQ ID NO: 1079418 - RNA, 14 nt, Homo sapiens
aagaaaauccauuc

SEQ ID NO: 1079419 - RNA, 17 nt, Homo sapiens
aagagcauagaacucaa

SEQ ID NO: 1079420 - RNA, 14 nt, Homo sapiens
aagaugcucuguga

SEQ ID NO: 1079421 - RNA, 17 nt, Homo sapiens
aagcauuuuugaucaaa

SEQ ID NO: 1079422 - RNA, 13 nt, Homo sapiens
aagccugaggcug

SEQ ID NO: 1079423 - RNA, 12 nt, Homo sapiens
aagcugacagca

SEQ ID NO: 1079424 - RNA, 13 nt, Homo sapiens
aaggcucagucuc

SEQ ID NO: 1079425 - RNA, 19 nt, Homo sapiens
aaggguaauagaaaugcau

SEQ ID NO: 1079426 - RNA, 12 nt, Homo sapiens
aagguuacugau

SEQ ID NO: 1079427 - RNA, 15 nt, Homo sapiens
aaguaccacucaggc

SEQ ID NO: 1079428 - RNA, 14 nt, Homo sapiens
aauaguacuauuaa

SEQ ID NO: 1079429 - RNA, 15 nt, Homo sapiens
aauaguacuauuacu

SEQ ID NO: 1079430 - RNA, 17 nt, Homo sapiens
aauaguauuaacuauua

SEQ ID NO: 1079431 - RNA, 14 nt, Homo sapiens
aauauccaccacuu

SEQ ID NO: 1079432 - RNA, 20 nt, Homo sapiens
aauaucucaauuaccaauau

SEQ ID NO: 1079433 - RNA, 14 nt, Homo sapiens
aauaugaauugaca

SEQ ID NO: 1079434 - RNA, 17 nt, Homo sapiens
aauauuuuagauuacag

SEQ ID NO: 1079435 - RNA, 21 nt, Homo sapiens
aauccauuuaaucaauauuua

SEQ ID NO: 1079436 - RNA, 19 nt, Homo sapiens
aaugauaggaaaaauccau

SEQ ID NO: 1079437 - RNA, 21 nt, Homo sapiens
aauggguacaauguacauuau

SEQ ID NO: 1079438 - RNA, 20 nt, Homo sapiens
aauuacuccaccaucaccuc

SEQ ID NO: 1079439 - RNA, 21 nt, Homo sapiens
aauuuauauaaaaauaccuua

SEQ ID NO: 1079440 - RNA, 18 nt, Homo sapiens
aauuuuaugugcuucaca

SEQ ID NO: 1079441 - RNA, 12 nt, Homo sapiens
acaaaugaacaa

SEQ ID NO: 1079442 - RNA, 14 nt, Homo sapiens
acaacugacuucca

SEQ ID NO: 1079443 - RNA, 15 nt, Homo sapiens
acaagcaauuacaau

SEQ ID NO: 1079444 - RNA, 20 nt, Homo sapiens
acacagacccaagauucaua

SEQ ID NO: 1079445 - RNA, 20 nt, Homo sapiens
acagagcgagagucugucuc

SEQ ID NO: 1079446 - RNA, 23 nt, Homo sapiens
acaguaaauaaauuguuugacca

SEQ ID NO: 1079447 - RNA, 21 nt, Homo sapiens
acauacauugccaauuuucca

SEQ ID NO: 1079448 - RNA, 14 nt, Homo sapiens
acauaugacauaua

SEQ ID NO: 1079449 - RNA, 21 nt, Homo sapiens
acauccaaccccccaccugcc

SEQ ID NO: 1079450 - RNA, 19 nt, Homo sapiens
acauccucugcuaccaucu

SEQ ID NO: 1079451 - RNA, 21 nt, Homo sapiens
acaugauggagcgcaccugcc

SEQ ID NO: 1079452 - RNA, 17 nt, Homo sapiens
acauuuucacaacucuu

SEQ ID NO: 1079453 - RNA, 15 nt, Homo sapiens
acauuuuuguacaca

SEQ ID NO: 1079454 - RNA, 19 nt, Homo sapiens
accacuaugcaauauauca

SEQ ID NO: 1079455 - RNA, 13 nt, Homo sapiens
acccaguguaaag

SEQ ID NO: 1079456 - RNA, 22 nt, Homo sapiens
acccaguguaaagaauaaauga

SEQ ID NO: 1079457 - RNA, 20 nt, Homo sapiens
accugaagggugacauccca

SEQ ID NO: 1079458 - RNA, 13 nt, Homo sapiens
accugacuuccac

SEQ ID NO: 1079459 - RNA, 13 nt, Homo sapiens
accugcaggccaa

SEQ ID NO: 1079460 - RNA, 15 nt, Homo sapiens
accuucaauuccugg

SEQ ID NO: 1079461 - RNA, 13 nt, Homo sapiens
acuaguacuauua

SEQ ID NO: 1079462 - RNA, 22 nt, Homo sapiens
acuauauugcuguaugguauau

SEQ ID NO: 1079463 - RNA, 23 nt, Homo sapiens
acuaugaaaucgcugcucaaaaa

SEQ ID NO: 1079464 - RNA, 18 nt, Homo sapiens
acucaggccaacaagcca

SEQ ID NO: 1079465 - RNA, 14 nt, Homo sapiens
acucccuccaugug

SEQ ID NO: 1079466 - RNA, 18 nt, Homo sapiens
acucucugugaccugccc

SEQ ID NO: 1079467 - RNA, 18 nt, Homo sapiens
acugaguccucguagcca

SEQ ID NO: 1079468 - RNA, 23 nt, Homo sapiens
acugaguccucguagccaucucu

SEQ ID NO: 1079469 - RNA, 20 nt, Homo sapiens
acuguuaauaguacuauuaa

SEQ ID NO: 1079470 - RNA, 20 nt, Homo sapiens
acuguuaguauuaacuauua

SEQ ID NO: 1079471 - RNA, 22 nt, Homo sapiens
acuguuauucuauuauaucaga

SEQ ID NO: 1079472 - RNA, 23 nt, Homo sapiens
acuucuaacuagaaaucugccaa

SEQ ID NO: 1079473 - RNA, 23 nt, Homo sapiens
acuugaggacacauguccagugg

SEQ ID NO: 1079474 - RNA, 16 nt, Homo sapiens
acuugccacacacugu

SEQ ID NO: 1079475 - RNA, 14 nt, Homo sapiens
acuuuaaccuuaga

SEQ ID NO: 1079476 - RNA, 21 nt, Homo sapiens
agaaaauccauucauucaauc

SEQ ID NO: 1079477 - RNA, 14 nt, Homo sapiens
agaaacuuaaacaa

SEQ ID NO: 1079478 - RNA, 20 nt, Homo sapiens
agaaaugcauaccaguaauu

SEQ ID NO: 1079479 - RNA, 12 nt, Homo sapiens
agaaccucaggc

SEQ ID NO: 1079480 - RNA, 22 nt, Homo sapiens
agaaggcaugaaauugucuagc

SEQ ID NO: 1079481 - RNA, 17 nt, Homo sapiens
agaaguaaaagcuaauu

SEQ ID NO: 1079482 - RNA, 14 nt, Homo sapiens
agaauaaaugaauc

SEQ ID NO: 1079483 - RNA, 20 nt, Homo sapiens
agacuuuaccacuaugcaau

SEQ ID NO: 1079484 - RNA, 14 nt, Homo sapiens
agagggcccaggca

SEQ ID NO: 1079485 - RNA, 23 nt, Homo sapiens
agauaaaaaaauuuuaauuccuu

SEQ ID NO: 1079486 - RNA, 16 nt, Homo sapiens
auuacaauacaucuaa

SEQ ID NO: 1079487 - RNA, 15 nt, Homo sapiens
auuacucuacuguuc

SEQ ID NO: 1079488 - RNA, 22 nt, Homo sapiens
auucaccuagagucuagaacac

SEQ ID NO: 1079489 - RNA, 13 nt, Homo sapiens
auuccacuggacu

SEQ ID NO: 1079490 - RNA, 20 nt, Homo sapiens
auuuaaugaagacccagugu

SEQ ID NO: 1079491 - RNA, 12 nt, Homo sapiens
auuuacuacuua

SEQ ID NO: 1079492 - RNA, 15 nt, Homo sapiens
auuucccaauacaua

SEQ ID NO: 1079493 - RNA, 21 nt, Homo sapiens
auuugauaaacuaaaagcaua

SEQ ID NO: 1079494 - RNA, 19 nt, Homo sapiens
auuugauuuuuacugagga

SEQ ID NO: 1079495 - RNA, 19 nt, Homo sapiens
auuuuccaaauuacagcau

SEQ ID NO: 1079496 - RNA, 23 nt, Homo sapiens
caaacaaaaauauuuugaucaug

SEQ ID NO: 1079497 - RNA, 20 nt, Homo sapiens
caaauucuuuuucacacuga

SEQ ID NO: 1079498 - RNA, 14 nt, Homo sapiens
caacugacuuccaa

SEQ ID NO: 1079499 - RNA, 16 nt, Homo sapiens
caaguuagcucaggag

SEQ ID NO: 1079500 - RNA, 16 nt, Homo sapiens
caaugcaaacaucuuc

SEQ ID NO: 1079501 - RNA, 22 nt, Homo sapiens
caauuacuccaccaucaccucu

SEQ ID NO: 1079502 - RNA, 17 nt, Homo sapiens
caauucauaauauguuc

SEQ ID NO: 1079503 - RNA, 12 nt, Homo sapiens
caauuuauccaa

SEQ ID NO: 1079504 - RNA, 18 nt, Homo sapiens
cacaaauauccaccacuu

SEQ ID NO: 1079505 - RNA, 12 nt, Homo sapiens
cacaccaucucc

SEQ ID NO: 1079506 - RNA, 21 nt, Homo sapiens
cacauaaacacauacauugcc

SEQ ID NO: 1079507 - RNA, 12 nt, Homo sapiens
cacauacauugc

SEQ ID NO: 1079508 - RNA, 14 nt, Homo sapiens
caccaucaccucuc

SEQ ID NO: 1079509 - RNA, 20 nt, Homo sapiens
caccccagcgccugugcuga

SEQ ID NO: 1079510 - RNA, 16 nt, Homo sapiens
caccugccauuugcac

SEQ ID NO: 1079511 - RNA, 20 nt, Homo sapiens
cacuaauaauaguacuauua

SEQ ID NO: 1079512 - RNA, 20 nt, Homo sapiens
cacuguuaauaguacuauua

SEQ ID NO: 1079513 - RNA, 20 nt, Homo sapiens
cagaaucgcuaauagaacca

SEQ ID NO: 1079514 - RNA, 14 nt, Homo sapiens
cagacuuuaccacu

SEQ ID NO: 1079515 - RNA, 16 nt, Homo sapiens
cagagauaauugccau

SEQ ID NO: 1079516 - RNA, 20 nt, Homo sapiens
cagagcgagagucugucuca

SEQ ID NO: 1079517 - RNA, 15 nt, Homo sapiens
cagagggcccaggca

SEQ ID NO: 1079518 - RNA, 18 nt, Homo sapiens
cagccauuaccauggaga

SEQ ID NO: 1079519 - RNA, 17 nt, Homo sapiens
cagccuggacaccucuc

SEQ ID NO: 1079520 - RNA, 17 nt, Homo sapiens
cagccuguuugggaugu

SEQ ID NO: 1079521 - RNA, 21 nt, Homo sapiens
cagcgagcuaugaucgcgcca

SEQ ID NO: 1079522 - RNA, 18 nt, Homo sapiens
caggaggcuuggaaagca

SEQ ID NO: 1079523 - RNA, 13 nt, Homo sapiens
cagggaauuucag

SEQ ID NO: 1079524 - RNA, 21 nt, Homo sapiens
cagggcccugcagaggggaaa

SEQ ID NO: 1079525 - RNA, 22 nt, Homo sapiens
caguauauuuguccagauaauu

SEQ ID NO: 1079526 - RNA, 17 nt, Homo sapiens
cagugcuucagccugag

SEQ ID NO: 1079527 - RNA, 19 nt, Homo sapiens
caguguaaagaauaaauga

SEQ ID NO: 1079528 - RNA, 20 nt, Homo sapiens
cauaacucauaauccagaga

SEQ ID NO: 1079529 - RNA, 15 nt, Homo sapiens
cauccccagggccau

SEQ ID NO: 1079530 - RNA, 19 nt, Homo sapiens
caucuaaaacucauacaau

SEQ ID NO: 1079531 - RNA, 20 nt, Homo sapiens
caugguaaaaccccaucucu

SEQ ID NO: 1079532 - RNA, 15 nt, Homo sapiens
cauguaacauucuuc

SEQ ID NO: 1079533 - RNA, 22 nt, Homo sapiens
cauuaaaaggcccuucaccucu

SEQ ID NO: 1079534 - RNA, 13 nt, Homo sapiens
cauuagagucagc

SEQ ID NO: 1079535 - RNA, 15 nt, Homo sapiens
cauucauucaaucau

SEQ ID NO: 1079536 - RNA, 10 nt, Homo sapiens
ccaccucuca

SEQ ID NO: 1079537 - RNA, 13 nt, Homo sapiens
ccaucaccucucu

SEQ ID NO: 1079538 - RNA, 17 nt, Homo sapiens
ccaucuccuuucaggga

SEQ ID NO: 1079539 - RNA, 16 nt, Homo sapiens
ccaugcucauaccucu

SEQ ID NO: 1079540 - RNA, 12 nt, Homo sapiens
ccauucauucaa

SEQ ID NO: 1079541 - RNA, 14 nt, Homo sapiens
cccaggaguuugag

SEQ ID NO: 1079542 - RNA, 12 nt, Homo sapiens
cccaguguaaag

SEQ ID NO: 1079543 - RNA, 22 nt, Homo sapiens
ccccagcucuggcuuccagaaa

SEQ ID NO: 1079544 - RNA, 22 nt, Homo sapiens
cccugacucucugugaccugcc

SEQ ID NO: 1079545 - RNA, 18 nt, Homo sapiens
ccgccuccaaaugccaac

SEQ ID NO: 1079546 - RNA, 20 nt, Homo sapiens
ccuauagucccagcuacuca

SEQ ID NO: 1079547 - RNA, 20 nt, Homo sapiens
guaaguaccacucaggccaa

SEQ ID NO: 1079548 - RNA, 21 nt, Homo sapiens
guaccacucaggccaacaagc

SEQ ID NO: 1079549 - RNA, 15 nt, Homo sapiens
guaccugacuuccac

SEQ ID NO: 1079550 - RNA, 18 nt, Homo sapiens
guacuaguacuauugcua

SEQ ID NO: 1079551 - RNA, 16 nt, Homo sapiens
guacuaugacacuguu

SEQ ID NO: 1079552 - RNA, 13 nt, Homo sapiens
guauauacauaug

SEQ ID NO: 1079553 - RNA, 14 nt, Homo sapiens
guauuaacuauuag

SEQ ID NO: 1079554 - RNA, 22 nt, Homo sapiens
guauuuuaggcagggauuugag

SEQ ID NO: 1079555 - RNA, 21 nt, Homo sapiens
gucaauaguauuaacuauuag

SEQ ID NO: 1079556 - RNA, 20 nt, Homo sapiens
guccuuuuauaaacauuggu

SEQ ID NO: 1079557 - RNA, 16 nt, Homo sapiens
guccuuuuguaccaug

SEQ ID NO: 1079558 - RNA, 23 nt, Homo sapiens
gugagaccaccucucaauauuca

SEQ ID NO: 1079559 - RNA, 19 nt, Homo sapiens
gugccuauggguugucaau

SEQ ID NO: 1079560 - RNA, 19 nt, Homo sapiens
gugccuauggguuguuaau

SEQ ID NO: 1079561 - RNA, 19 nt, Homo sapiens
guguaaagaauaaaugaau

SEQ ID NO: 1079562 - RNA, 15 nt, Homo sapiens
guguauuagauauca

SEQ ID NO: 1079563 - RNA, 14 nt, Homo sapiens
guguguugauccca

SEQ ID NO: 1079564 - RNA, 14 nt, Homo sapiens
guguugaucccaag

SEQ ID NO: 1079565 - RNA, 15 nt, Homo sapiens
guuaauaguacuauu

SEQ ID NO: 1079566 - RNA, 17 nt, Homo sapiens
guuccucuuugcaugga

SEQ ID NO: 1079567 - RNA, 22 nt, Homo sapiens
guucuaggagaacugucaugag

SEQ ID NO: 1079568 - RNA, 13 nt, Homo sapiens
guuuuuucacaua

SEQ ID NO: 1079569 - RNA, 17 nt, Homo sapiens
uaaaauaaguauuucca

SEQ ID NO: 1079570 - RNA, 19 nt, Homo sapiens
uaaagaauaaaugaaucuu

SEQ ID NO: 1079571 - RNA, 18 nt, Homo sapiens
uaaauaauguauacacau

SEQ ID NO: 1079572 - RNA, 19 nt, Homo sapiens
uaaauuuuaaguaucccau

SEQ ID NO: 1079573 - RNA, 12 nt, Homo sapiens
uaacauugcuga

SEQ ID NO: 1079574 - RNA, 15 nt, Homo sapiens
uaacuguuaguauua

SEQ ID NO: 1079575 - RNA, 16 nt, Homo sapiens
uaacuguuaguauuaa

SEQ ID NO: 1079576 - RNA, 23 nt, Homo sapiens
uaagagacagagccuuguucuau

SEQ ID NO: 1079577 - RNA, 16 nt, Homo sapiens
uaagagauuaagaaua

SEQ ID NO: 1079578 - RNA, 21 nt, Homo sapiens
uaauaauucuuuguguucagu

SEQ ID NO: 1079579 - RNA, 17 nt, Homo sapiens
uaauacuguauugcugu

SEQ ID NO: 1079580 - RNA, 12 nt, Homo sapiens
uaauauauugcu

SEQ ID NO: 1079581 - RNA, 15 nt, Homo sapiens
uaauauauugcugcu

SEQ ID NO: 1079582 - RNA, 17 nt, Homo sapiens
uaauguauacacaugga

SEQ ID NO: 1079583 - RNA, 22 nt, Homo sapiens
uacaaugauaggaaaaauccau

SEQ ID NO: 1079584 - RNA, 17 nt, Homo sapiens
uaccccaccucaugccu

SEQ ID NO: 1079585 - RNA, 17 nt, Homo sapiens
uacuaguacuaugacac

SEQ ID NO: 1079586 - RNA, 20 nt, Homo sapiens
uacuaguacuauugcuauua

SEQ ID NO: 1079587 - RNA, 18 nt, Homo sapiens
uacuaugacacuguuaau

SEQ ID NO: 1079588 - RNA, 12 nt, Homo sapiens
uacuauugcuag

SEQ ID NO: 1079589 - RNA, 19 nt, Homo sapiens
uagaauaaaauuguaaaau

SEQ ID NO: 1079590 - RNA, 14 nt, Homo sapiens
uagagauaugcaga

SEQ ID NO: 1079591 - RNA, 17 nt, Homo sapiens
uagauaucaauguuaau

SEQ ID NO: 1079592 - RNA, 16 nt, Homo sapiens
uaggacucugaggcuc

SEQ ID NO: 1079593 - RNA, 15 nt, Homo sapiens
uaggcagggauuuga

SEQ ID NO: 1079594 - RNA, 18 nt, Homo sapiens
uaguacuaguacuaugac

SEQ ID NO: 1079595 - RNA, 15 nt, Homo sapiens
uaguacuauugcuau

SEQ ID NO: 1079596 - RNA, 15 nt, Homo sapiens
uaguauuaacuauua

SEQ ID NO: 1079597 - RNA, 14 nt, Homo sapiens
uauagagauaugca

SEQ ID NO: 1079598 - RNA, 18 nt, Homo sapiens
uaucuaccucacuauuca

SEQ ID NO: 1079599 - RNA, 13 nt, Homo sapiens
uaucucagcauuu

SEQ ID NO: 1079600 - RNA, 16 nt, Homo sapiens
uaucucggaccuuuca

SEQ ID NO: 1079601 - RNA, 13 nt, Homo sapiens
uaugaacuugagg

SEQ ID NO: 1079602 - RNA, 14 nt, Homo sapiens
uaugaacuugagga

SEQ ID NO: 1079603 - RNA, 18 nt, Homo sapiens
uaugaauugacagacugu

SEQ ID NO: 1079604 - RNA, 20 nt, Homo sapiens
uaugcaauauaucaauguaa

SEQ ID NO: 1079605 - RNA, 17 nt, Homo sapiens
guguaucucagcauuuu

SEQ ID NO: 1079606 - RNA, 12 nt, Homo sapiens
guguugauccca

SEQ ID NO: 1079607 - RNA, 17 nt, Homo sapiens
guuaauaguacuauuaa

SEQ ID NO: 1079608 - RNA, 18 nt, Homo sapiens
guucaguuccacuaucua

SEQ ID NO: 1079609 - RNA, 18 nt, Homo sapiens
guucuuacuacuugccac

SEQ ID NO: 1079610 - RNA, 20 nt, Homo sapiens
guuuuacagagcuaauuguc

SEQ ID NO: 1079611 - RNA, 15 nt, Homo sapiens
uaaaaccccaucucu

SEQ ID NO: 1079612 - RNA, 22 nt, Homo sapiens
uaaaagaaaaaguaugugaaua

SEQ ID NO: 1079613 - RNA, 17 nt, Homo sapiens
uaaaagaauuugugaca

SEQ ID NO: 1079614 - RNA, 21 nt, Homo sapiens
uaaagaauaaaugaaucuuac

SEQ ID NO: 1079615 - RNA, 12 nt, Homo sapiens
uaaauaucucaa

SEQ ID NO: 1079616 - RNA, 17 nt, Homo sapiens
uaaaugaaucuuacucc

SEQ ID NO: 1079617 - RNA, 17 nt, Homo sapiens
uaaaugauguacuacau

SEQ ID NO: 1079618 - RNA, 18 nt, Homo sapiens
uaaaugauguacuacauu

SEQ ID NO: 1079619 - RNA, 19 nt, Homo sapiens
uaacagcuaauaagagaua

SEQ ID NO: 1079620 - RNA, 19 nt, Homo sapiens
uaacuagaaaucugccaau

SEQ ID NO: 1079621 - RNA, 12 nt, Homo sapiens
uaacuugagggu

SEQ ID NO: 1079622 - RNA, 14 nt, Homo sapiens
uaagagauaauugu

SEQ ID NO: 1079623 - RNA, 17 nt, Homo sapiens
uaaguaccacucaggcc

SEQ ID NO: 1079624 - RNA, 12 nt, Homo sapiens
uaaguauuucca

SEQ ID NO: 1079625 - RNA, 15 nt, Homo sapiens
uaauaaguaaucuaa

SEQ ID NO: 1079626 - RNA, 17 nt, Homo sapiens
uaauaguacuauuacua

SEQ ID NO: 1079627 - RNA, 14 nt, Homo sapiens
uaauauaugcucaa

SEQ ID NO: 1079628 - RNA, 16 nt, Homo sapiens
uaauauuuuagauuac

SEQ ID NO: 1079629 - RNA, 14 nt, Homo sapiens
uaaucuccacuguu

SEQ ID NO: 1079630 - RNA, 20 nt, Homo sapiens
uaaucuuugaaagcugaaua

SEQ ID NO: 1079631 - RNA, 17 nt, Homo sapiens
uaaugaagacccagugu

SEQ ID NO: 1079632 - RNA, 15 nt, Homo sapiens
uaauucuacccugaa

SEQ ID NO: 1079633 - RNA, 18 nt, Homo sapiens
uaauuuguaucugaagga

SEQ ID NO: 1079634 - RNA, 15 nt, Homo sapiens
uacagagcuaauugu

SEQ ID NO: 1079635 - RNA, 19 nt, Homo sapiens
uacauaccacuuugaauag

SEQ ID NO: 1079636 - RNA, 14 nt, Homo sapiens
uaccauacaauaua

SEQ ID NO: 1079637 - RNA, 21 nt, Homo sapiens
uacuacuugccacacacuguu

SEQ ID NO: 1079638 - RNA, 15 nt, Homo sapiens
uacuccuaccucagc

SEQ ID NO: 1079639 - RNA, 14 nt, Homo sapiens
uacuguauugcugu

SEQ ID NO: 1079640 - RNA, 19 nt, Homo sapiens
uacuuaauggguacaaugu

SEQ ID NO: 1079641 - RNA, 22 nt, Homo sapiens
uagacaaaugaacaagcaauua

SEQ ID NO: 1079642 - RNA, 19 nt, Homo sapiens
uagacucacagccguccaa

SEQ ID NO: 1079643 - RNA, 20 nt, Homo sapiens
uagagucuagaacacaauuu

SEQ ID NO: 1079644 - RNA, 15 nt, Homo sapiens
uagauaucaauguua

SEQ ID NO: 1079645 - RNA, 14 nt, Homo sapiens
uaggaaaaauccau

SEQ ID NO: 1079646 - RNA, 18 nt, Homo sapiens
uagucccagcuacucaga

SEQ ID NO: 1079647 - RNA, 19 nt, Homo sapiens
uaguucuuacuacuugcca

SEQ ID NO: 1079648 - RNA, 13 nt, Homo sapiens
uauaaacauuggu

SEQ ID NO: 1079649 - RNA, 22 nt, Homo sapiens
uaugacacuguuaauaguacua

SEQ ID NO: 1079650 - RNA, 20 nt, Homo sapiens
uaugccucuguguaucucag

SEQ ID NO: 1079651 - RNA, 19 nt, Homo sapiens
uaugcugauuuacuacuua

SEQ ID NO: 1079652 - RNA, 14 nt, Homo sapiens
uauggguacauucc

SEQ ID NO: 1079653 - RNA, 23 nt, Homo sapiens
uauuaacacuaauaauaguacua

SEQ ID NO: 1079654 - RNA, 20 nt, Homo sapiens
uauucaaacauuauucucaa

SEQ ID NO: 1079655 - RNA, 13 nt, Homo sapiens
uauucaaguauua

SEQ ID NO: 1079656 - RNA, 12 nt, Homo sapiens
uauugcuaguac

SEQ ID NO: 1079657 - RNA, 23 nt, Homo sapiens
ucaaacaaaaauauuuugaucau

SEQ ID NO: 1079658 - RNA, 16 nt, Homo sapiens
ucaaacauuauucuca

SEQ ID NO: 1079659 - RNA, 13 nt, Homo sapiens
ucaauaguauuaa

SEQ ID NO: 1079660 - RNA, 17 nt, Homo sapiens
ucacaacucuucuuucc

SEQ ID NO: 1079661 - RNA, 15 nt, Homo sapiens
ucacacgggguauuu

SEQ ID NO: 1079662 - RNA, 13 nt, Homo sapiens
ucagaagauaucu

SEQ ID NO: 1079663 - RNA, 17 nt, Homo sapiens
ucaggccaacaagccaa

SEQ ID NO: 1079664 - RNA, 22 nt, Homo sapiens
ucauagaagaaaauccauucau

SEQ ID NO: 1079665 - RNA, 22 nt, Homo sapiens
ucaugacuuuuccauguaucua

SEQ ID NO: 1079666 - RNA, 15 nt, Homo sapiens
ucaugcaaucuuccu

SEQ ID NO: 1079667 - RNA, 21 nt, Homo sapiens
uccaaccccccaccugccauu

SEQ ID NO: 1079668 - RNA, 14 nt, Homo sapiens
uccuaaauaucuca

SEQ ID NO: 1079669 - RNA, 21 nt, Homo sapiens
uccuacacccuuggacuugag

SEQ ID NO: 1079670 - RNA, 13 nt, Homo sapiens
uccucguagccau

SEQ ID NO: 1079671 - RNA, 15 nt, Homo sapiens
uccucuuugcaugga

SEQ ID NO: 1079672 - RNA, 14 nt, Homo sapiens
uccugccucaggcu

SEQ ID NO: 1079673 - RNA, 13 nt, Homo sapiens
ucguagccaucuc

SEQ ID NO: 1079674 - RNA, 20 nt, Homo sapiens
ucguggguguguguagccaa

SEQ ID NO: 1079675 - RNA, 23 nt, Homo sapiens
ucuauagguuuuuaaauggaauu

SEQ ID NO: 1079676 - RNA, 15 nt, Homo sapiens
ucuccuggucccugg

SEQ ID NO: 1079677 - RNA, 18 nt, Homo sapiens
ucugcucccaugcucaua

SEQ ID NO: 1079678 - RNA, 20 nt, Homo sapiens
ucuuaugggauuacauguua

SEQ ID NO: 1079679 - RNA, 21 nt, Homo sapiens
ucuugaacugguugugaauaa

SEQ ID NO: 1079680 - RNA, 12 nt, Homo sapiens
ucuuugcaugga

SEQ ID NO: 1079681 - RNA, 17 nt, Homo sapiens
ugaaaagcuacccugaa

SEQ ID NO: 1079682 - RNA, 14 nt, Homo sapiens
ugaaaucagugccu

SEQ ID NO: 1079683 - RNA, 23 nt, Homo sapiens
ugacaaauucuuuuucacacuga

SEQ ID NO: 1079684 - RNA, 15 nt, Homo sapiens
ugacaacuguuuaau

SEQ ID NO: 1079685 - RNA, 23 nt, Homo sapiens
ugacgugcaccuguacucaggag

SEQ ID NO: 1079686 - RNA, 21 nt, Homo sapiens
ugagacccucgccacggggag

SEQ ID NO: 1079687 - RNA, 21 nt, Homo sapiens
ugcaaaaucuccaauccacac

SEQ ID NO: 1079688 - RNA, 15 nt, Homo sapiens
ugccaccugucuguc

SEQ ID NO: 1079689 - RNA, 18 nt, Homo sapiens
ugcgcaaugagacuacaa

SEQ ID NO: 1079690 - RNA, 14 nt, Homo sapiens
ugcuaccaucucau

SEQ ID NO: 1079691 - RNA, 15 nt, Homo sapiens
ugcuaguacuaguac

SEQ ID NO: 1079692 - RNA, 13 nt, Homo sapiens
ugcuauauugccc

SEQ ID NO: 1079693 - RNA, 19 nt, Homo sapiens
ugcuccaaccaguccucag

SEQ ID NO: 1079694 - RNA, 22 nt, Homo sapiens
uggaaaggcucagucucaggag

SEQ ID NO: 1079695 - RNA, 18 nt, Homo sapiens
uggacuugaggauuuuga

SEQ ID NO: 1079696 - RNA, 14 nt, Homo sapiens
uggcacugguugua

SEQ ID NO: 1079697 - RNA, 17 nt, Homo sapiens
uggccagugugauccca

SEQ ID NO: 1079698 - RNA, 20 nt, Homo sapiens
ugguaugaacuugaggacac

SEQ ID NO: 1079699 - RNA, 14 nt, Homo sapiens
uguaaacuaguacu

SEQ ID NO: 1079700 - RNA, 15 nt, Homo sapiens
ugucaauaguauuaa

SEQ ID NO: 1079701 - RNA, 12 nt, Homo sapiens
ugugaaagucag

SEQ ID NO: 1079702 - RNA, 15 nt, Homo sapiens
ugugccuuacuuaag

SEQ ID NO: 1079703 - RNA, 15 nt, Homo sapiens
ugugcuucacauaau

SEQ ID NO: 1079704 - RNA, 16 nt, Homo sapiens
uguguauuagauauca

SEQ ID NO: 1079705 - RNA, 20 nt, Homo sapiens
ugugugaggcucuguccuaa

SEQ ID NO: 1079706 - RNA, 13 nt, Homo sapiens
uguguguagccaa

SEQ ID NO: 1079707 - RNA, 23 nt, Homo sapiens
uguuaacaccuaccucacagggu

SEQ ID NO: 1079708 - RNA, 16 nt, Homo sapiens
uguuauccaacuauua

SEQ ID NO: 1079709 - RNA, 18 nt, Homo sapiens
uguuauuuguacaguuca

SEQ ID NO: 1079710 - RNA, 22 nt, Homo sapiens
uuaaaucauuuuaacuucuaua

SEQ ID NO: 1079711 - RNA, 11 nt, Homo sapiens
uuaagauaucu

SEQ ID NO: 1079712 - RNA, 15 nt, Homo sapiens
uuaauaguacuauua

SEQ ID NO: 1079713 - RNA, 19 nt, Homo sapiens
uuaaugaagacccagugua

SEQ ID NO: 1079714 - RNA, 19 nt, Homo sapiens
uuacuccaccaucaccucu

SEQ ID NO: 1079715 - RNA, 14 nt, Homo sapiens
uuaggcagggauuu

SEQ ID NO: 1079716 - RNA, 19 nt, Homo sapiens
uuauagcuuccagauuaca

SEQ ID NO: 1079717 - RNA, 17 nt, Homo sapiens
uuauuuguacaguucag

SEQ ID NO: 1079718 - RNA, 18 nt, Homo sapiens
uucaaacauuauucucaa

SEQ ID NO: 1079719 - RNA, 18 nt, Homo sapiens
uucagcugugaacaugga

SEQ ID NO: 1079720 - RNA, 22 nt, Homo sapiens
uucaguuccucuuugcauggaa

SEQ ID NO: 1079721 - RNA, 20 nt, Homo sapiens
uucauacuauuaagauucua

SEQ ID NO: 1079722 - RNA, 20 nt, Homo sapiens
uucaugacuuuuccauguau

SEQ ID NO: 1079723 - RNA, 14 nt, Homo sapiens
uucccaauacauac

SEQ ID NO: 1079724 - RNA, 23 nt, Homo sapiens
uuccuacacccuuggacuugagg

SEQ ID NO: 1079725 - RNA, 20 nt, Homo sapiens
uucgagaccagccuggccaa

SEQ ID NO: 1079726 - RNA, 18 nt, Homo sapiens
aaaaccccaucucuacua

SEQ ID NO: 1079727 - RNA, 22 nt, Homo sapiens
aaaaguaaguaccacucaggcc

SEQ ID NO: 1079728 - RNA, 20 nt, Homo sapiens
aaacaaaaauauuuugauca

SEQ ID NO: 1079729 - RNA, 22 nt, Homo sapiens
aaacagacuauuuaacuugagg

SEQ ID NO: 1079730 - RNA, 19 nt, Homo sapiens
aaacauugguauauuucca

SEQ ID NO: 1079731 - RNA, 16 nt, Homo sapiens
aaacccaguaauucua

SEQ ID NO: 1079732 - RNA, 16 nt, Homo sapiens
aaacuaguacuauuau

SEQ ID NO: 1079733 - RNA, 19 nt, Homo sapiens
aaacuuauuugagugauua

SEQ ID NO: 1079734 - RNA, 22 nt, Homo sapiens
aaagcugcugagaaucuagccu

SEQ ID NO: 1079735 - RNA, 15 nt, Homo sapiens
aaaggcucagucuca

SEQ ID NO: 1079736 - RNA, 11 nt, Homo sapiens
aaauaucucaa

SEQ ID NO: 1079737 - RNA, 19 nt, Homo sapiens
aaauaucucaauuaccaau

SEQ ID NO: 1079738 - RNA, 13 nt, Homo sapiens
aaaugaaucuuac

SEQ ID NO: 1079739 - RNA, 15 nt, Homo sapiens
aaauucuuuuucaca

SEQ ID NO: 1079740 - RNA, 14 nt, Homo sapiens
aacagccuacugaa

SEQ ID NO: 1079741 - RNA, 20 nt, Homo sapiens
aaccucaggcuuccuuggca

SEQ ID NO: 1079742 - RNA, 21 nt, Homo sapiens
aacuauuggagggugggagag

SEQ ID NO: 1079743 - RNA, 16 nt, Homo sapiens
aacuauuuauuucacc

SEQ ID NO: 1079744 - RNA, 21 nt, Homo sapiens
aacucuagaugguaugccucu

SEQ ID NO: 1079745 - RNA, 16 nt, Homo sapiens
aacugcuguguucuca

SEQ ID NO: 1079746 - RNA, 19 nt, Homo sapiens
aacuugaggacacaugucc

SEQ ID NO: 1079747 - RNA, 23 nt, Homo sapiens
aacuugaggacacauguccagug

SEQ ID NO: 1079748 - RNA, 21 nt, Homo sapiens
aagaauguuauccaacuauua

SEQ ID NO: 1079749 - RNA, 11 nt, Homo sapiens
aagacccagug

SEQ ID NO: 1079750 - RNA, 16 nt, Homo sapiens
aagacccaguguaaag

SEQ ID NO: 1079751 - RNA, 19 nt, Homo sapiens
aagacccaguguaaagaau

SEQ ID NO: 1079752 - RNA, 15 nt, Homo sapiens
aagagugauguuuca

SEQ ID NO: 1079753 - RNA, 15 nt, Homo sapiens
aagaucuauauugua

SEQ ID NO: 1079754 - RNA, 15 nt, Homo sapiens
aagcaucaccucagg

SEQ ID NO: 1079755 - RNA, 16 nt, Homo sapiens
aagcaucaccucaggc

SEQ ID NO: 1079756 - RNA, 16 nt, Homo sapiens
aagccaaacucugcca

SEQ ID NO: 1079757 - RNA, 18 nt, Homo sapiens
aagcggagguugcaggga

SEQ ID NO: 1079758 - RNA, 19 nt, Homo sapiens
aagcugagacccucgccac

SEQ ID NO: 1079759 - RNA, 18 nt, Homo sapiens
aaguaugugaauaugaau

SEQ ID NO: 1079760 - RNA, 23 nt, Homo sapiens
aagucuaaaguuuacaguaaaua

SEQ ID NO: 1079761 - RNA, 21 nt, Homo sapiens
aauaaagcugcugagaaucua

SEQ ID NO: 1079762 - RNA, 17 nt, Homo sapiens
aauaaaugaaucuuacu

SEQ ID NO: 1079763 - RNA, 20 nt, Homo sapiens
aauaaaugaaucuuacuccu

SEQ ID NO: 1079764 - RNA, 13 nt, Homo sapiens
aauaauguauaca

SEQ ID NO: 1079765 - RNA, 17 nt, Homo sapiens
aauacugcguguucuca

SEQ ID NO: 1079766 - RNA, 11 nt, Homo sapiens
aauauucaaua

SEQ ID NO: 1079767 - RNA, 22 nt, Homo sapiens
aauauuuuagauuacaggauua

SEQ ID NO: 1079768 - RNA, 14 nt, Homo sapiens
aauccauucauuca

SEQ ID NO: 1079769 - RNA, 13 nt, Homo sapiens
aaucuuacuccuu

SEQ ID NO: 1079770 - RNA, 16 nt, Homo sapiens
aaucuuccugccucag

SEQ ID NO: 1079771 - RNA, 14 nt, Homo sapiens
aaugaacauguuaa

SEQ ID NO: 1079772 - RNA, 19 nt, Homo sapiens
aaugaagacccaguguaaa

SEQ ID NO: 1079773 - RNA, 23 nt, Homo sapiens
aaugaagacccaguguaaagaau

SEQ ID NO: 1079774 - RNA, 20 nt, Homo sapiens
aauggguacaauguacauua

SEQ ID NO: 1079775 - RNA, 19 nt, Homo sapiens
aauguuauccaacuauuaa

SEQ ID NO: 1079776 - RNA, 12 nt, Homo sapiens
aauuguuugacc

SEQ ID NO: 1079777 - RNA, 18 nt, Homo sapiens
aauuuggagacucugugg

SEQ ID NO: 1079778 - RNA, 20 nt, Homo sapiens
aauuuuccagggcucaaaaa

SEQ ID NO: 1079779 - RNA, 15 nt, Homo sapiens
acaaacaaugcaaac

SEQ ID NO: 1079780 - RNA, 20 nt, Homo sapiens
acaagccaacgacaaagcca

SEQ ID NO: 1079781 - RNA, 13 nt, Homo sapiens
acaauacaucuaa

SEQ ID NO: 1079782 - RNA, 15 nt, Homo sapiens
acacauacauugcca

SEQ ID NO: 1079783 - RNA, 11 nt, Homo sapiens
acaccaucucc

SEQ ID NO: 1079784 - RNA, 16 nt, Homo sapiens
acauaaacacauacau

SEQ ID NO: 1079785 - RNA, 22 nt, Homo sapiens
acauccaaccccccaccugcca

SEQ ID NO: 1079786 - RNA, 22 nt, Homo sapiens
acaugauggagcgcaccugccc

SEQ ID NO: 1079787 - RNA, 13 nt, Homo sapiens
acauugguauauu

SEQ ID NO: 1079788 - RNA, 21 nt, Homo sapiens
accacucaggccaacaagcca

SEQ ID NO: 1079789 - RNA, 13 nt, Homo sapiens
accaucaguauau

SEQ ID NO: 1079790 - RNA, 18 nt, Homo sapiens
accccagcgccugugcug

SEQ ID NO: 1079791 - RNA, 15 nt, Homo sapiens
accccaucucuacua

SEQ ID NO: 1079792 - RNA, 20 nt, Homo sapiens
accccuggccucaagcaauc

SEQ ID NO: 1079793 - RNA, 13 nt, Homo sapiens
accucacuauuca

SEQ ID NO: 1079794 - RNA, 22 nt, Homo sapiens
acgacaaagccaaacucugcca

SEQ ID NO: 1079795 - RNA, 20 nt, Homo sapiens
acuacuugccacacacuguu

SEQ ID NO: 1079796 - RNA, 14 nt, Homo sapiens
acuauuaguguuaa

SEQ ID NO: 1079797 - RNA, 20 nt, Homo sapiens
acuauugcuaguacuaguac

SEQ ID NO: 1079798 - RNA, 18 nt, Homo sapiens
acuccucuuauuugcuca

SEQ ID NO: 1079799 - RNA, 19 nt, Homo sapiens
acucugccagccacaucca

SEQ ID NO: 1079800 - RNA, 13 nt, Homo sapiens
acugaaaaugcau

SEQ ID NO: 1079801 - RNA, 23 nt, Homo sapiens
acuggucucuuuccaaagcauuu

SEQ ID NO: 1079802 - RNA, 22 nt, Homo sapiens
acuguauugcuguaugguauau

SEQ ID NO: 1079803 - RNA, 17 nt, Homo sapiens
acuuuaccacuaugcaa

SEQ ID NO: 1079804 - RNA, 19 nt, Homo sapiens
agaaaauccauucauucaa

SEQ ID NO: 1079805 - RNA, 21 nt, Homo sapiens
agaaacacaaauguaaaauaa

SEQ ID NO: 1079806 - RNA, 22 nt, Homo sapiens
agaagaaaauccauucauucaa

SEQ ID NO: 1079807 - RNA, 15 nt, Homo sapiens
agaauaaaugaaucu

SEQ ID NO: 1079808 - RNA, 22 nt, Homo sapiens
agaauaaaugaaucuuacuccu

SEQ ID NO: 1079809 - RNA, 13 nt, Homo sapiens
agaauaccaauau

SEQ ID NO: 1079810 - RNA, 13 nt, Homo sapiens
agaaucuagccuc

SEQ ID NO: 1079811 - RNA, 21 nt, Homo sapiens
agaauguuauccaacuauuaa

SEQ ID NO: 1079812 - RNA, 18 nt, Homo sapiens
agacagagccuuguucua

SEQ ID NO: 1079813 - RNA, 15 nt, Homo sapiens
agacccaguguaaag

SEQ ID NO: 1079814 - RNA, 19 nt, Homo sapiens
agacugcugggacuggcca

SEQ ID NO: 1079815 - RNA, 19 nt, Homo sapiens
agaggaccugagucugcua

SEQ ID NO: 1079816 - RNA, 23 nt, Homo sapiens
agauaacagcuuaacauuuacau

SEQ ID NO: 1079817 - RNA, 13 nt, Homo sapiens
agauaauugccau

SEQ ID NO: 1079818 - RNA, 15 nt, Homo sapiens
agaugcucugugaaa

SEQ ID NO: 1079819 - RNA, 16 nt, Homo sapiens
agcaucaccucaggcc

SEQ ID NO: 1079820 - RNA, 14 nt, Homo sapiens
agccaaacucugcc

SEQ ID NO: 1079821 - RNA, 19 nt, Homo sapiens
agccacaccuuuuccagga

SEQ ID NO: 1079822 - RNA, 16 nt, Homo sapiens
agccuguuugggaugu

SEQ ID NO: 1079823 - RNA, 20 nt, Homo sapiens
agcuaugaucgcgccacuac

SEQ ID NO: 1079824 - RNA, 18 nt, Homo sapiens
agcugacagcacuacaaa

SEQ ID NO: 1079825 - RNA, 23 nt, Homo sapiens
agcugagacccucgccacgggga

SEQ ID NO: 1079826 - RNA, 20 nt, Homo sapiens
agcuguaaaaagagagaaaa

SEQ ID NO: 1079827 - RNA, 14 nt, Homo sapiens
aggaaucagcucaa

SEQ ID NO: 1079828 - RNA, 19 nt, Homo sapiens
aggagauuuuccuuccuac

SEQ ID NO: 1079829 - RNA, 13 nt, Homo sapiens
aggagcagcuuca

SEQ ID NO: 1079830 - RNA, 19 nt, Homo sapiens
aggaggcuuggaaagcauc

SEQ ID NO: 1079831 - RNA, 19 nt, Homo sapiens
aggcugaggggaggaucac

SEQ ID NO: 1079832 - RNA, 18 nt, Homo sapiens
agggaacgggguccuuca

SEQ ID NO: 1079833 - RNA, 12 nt, Homo sapiens
agguaugcagag

SEQ ID NO: 1079834 - RNA, 20 nt, Homo sapiens
aaaaaaguaaguaccacuca

SEQ ID NO: 1079835 - RNA, 11 nt, Homo sapiens
aaacaaaaaua

SEQ ID NO: 1079836 - RNA, 15 nt, Homo sapiens
aaacagacuauuuaa

SEQ ID NO: 1079837 - RNA, 14 nt, Homo sapiens
aaacauuauucuca

SEQ ID NO: 1079838 - RNA, 16 nt, Homo sapiens
aaagcaucaccucagg

SEQ ID NO: 1079839 - RNA, 18 nt, Homo sapiens
aaagccaaacucugccag

SEQ ID NO: 1079840 - RNA, 14 nt, Homo sapiens
aaaugaaucuuacu

SEQ ID NO: 1079841 - RNA, 22 nt, Homo sapiens
aaauguaaaauaaguauuucca

SEQ ID NO: 1079842 - RNA, 16 nt, Homo sapiens
aaauuauuguauuaca

SEQ ID NO: 1079843 - RNA, 22 nt, Homo sapiens
aaauucuuuuucacacugaugu

SEQ ID NO: 1079844 - RNA, 22 nt, Homo sapiens
aacaagccaacgacaaagccaa

SEQ ID NO: 1079845 - RNA, 22 nt, Homo sapiens
aacacacagacccaagauucau

SEQ ID NO: 1079846 - RNA, 13 nt, Homo sapiens
aacauuauucuca

SEQ ID NO: 1079847 - RNA, 14 nt, Homo sapiens
aacauuauucucaa

SEQ ID NO: 1079848 - RNA, 21 nt, Homo sapiens
gaagacccaguguaaagaaua

SEQ ID NO: 1079849 - RNA, 20 nt, Homo sapiens
gaagccacugaagcugggau

SEQ ID NO: 1079850 - RNA, 14 nt, Homo sapiens
gaauaaaugaaucu

SEQ ID NO: 1079851 - RNA, 17 nt, Homo sapiens
gaauaaaugaaucuuac

SEQ ID NO: 1079852 - RNA, 22 nt, Homo sapiens
gaauaaaugaaucuuacuccuu

SEQ ID NO: 1079853 - RNA, 14 nt, Homo sapiens
gaaucuuacuccuu

SEQ ID NO: 1079854 - RNA, 23 nt, Homo sapiens
gacaaugaaaguuugcacuguau

SEQ ID NO: 1079855 - RNA, 23 nt, Homo sapiens
gacauccucugcuaccaucucau

SEQ ID NO: 1079856 - RNA, 22 nt, Homo sapiens
gaccaccucucaauauucaaua

SEQ ID NO: 1079857 - RNA, 14 nt, Homo sapiens
gaccugcaggccaa

SEQ ID NO: 1079858 - RNA, 13 nt, Homo sapiens
gagaaccucaggc

SEQ ID NO: 1079859 - RNA, 15 nt, Homo sapiens
gagaaugaauucuga

SEQ ID NO: 1079860 - RNA, 19 nt, Homo sapiens
gagacagagccuuguucua

SEQ ID NO: 1079861 - RNA, 14 nt, Homo sapiens
gagacugcgggaug

SEQ ID NO: 1079862 - RNA, 21 nt, Homo sapiens
gagaggagggaugcugccuga

SEQ ID NO: 1079863 - RNA, 21 nt, Homo sapiens
gagcaaagucuaaaguuuaca

SEQ ID NO: 1079864 - RNA, 14 nt, Homo sapiens
gagguugcagggag

SEQ ID NO: 1079865 - RNA, 20 nt, Homo sapiens
gaguccucguagccaucucu

SEQ ID NO: 1079866 - RNA, 16 nt, Homo sapiens
gaguucugaagcugac

SEQ ID NO: 1079867 - RNA, 16 nt, Homo sapiens
gaguucuuuauauuca

SEQ ID NO: 1079868 - RNA, 10 nt, Homo sapiens
gauaaacuaa

SEQ ID NO: 1079869 - RNA, 17 nt, Homo sapiens
gauaaacuaaaagcaua

SEQ ID NO: 1079870 - RNA, 16 nt, Homo sapiens
gcaaaaccuuaccuug

SEQ ID NO: 1079871 - RNA, 23 nt, Homo sapiens
gcaaagcgauuccuaccauacaa

SEQ ID NO: 1079872 - RNA, 15 nt, Homo sapiens
gcccaggcaggccac

SEQ ID NO: 1079873 - RNA, 17 nt, Homo sapiens
gcccaggcuggucuuga

SEQ ID NO: 1079874 - RNA, 16 nt, Homo sapiens
gccgcagggacgggga

SEQ ID NO: 1079875 - RNA, 20 nt, Homo sapiens
gccucugcucccaugcucau

SEQ ID NO: 1079876 - RNA, 18 nt, Homo sapiens
gcgaaggggcccuggucc

SEQ ID NO: 1079877 - RNA, 23 nt, Homo sapiens
gcgaccgccgcagggacggggac

SEQ ID NO: 1079878 - RNA, 19 nt, Homo sapiens
gcgugguggcgggcaccua

SEQ ID NO: 1079879 - RNA, 19 nt, Homo sapiens
gcuauuacuaguacuauua

SEQ ID NO: 1079880 - RNA, 22 nt, Homo sapiens
gcucaggaggcuuggaaagcau

SEQ ID NO: 1079881 - RNA, 15 nt, Homo sapiens
gcucagucucaggag

SEQ ID NO: 1079882 - RNA, 21 nt, Homo sapiens
gcucuguccuaaauaucucaa

SEQ ID NO: 1079883 - RNA, 23 nt, Homo sapiens
gcugaggcggguggaucaccuga

SEQ ID NO: 1079884 - RNA, 19 nt, Homo sapiens
gcugccccuggugcacugg

SEQ ID NO: 1079885 - RNA, 10 nt, Homo sapiens
gcugcugaga

SEQ ID NO: 1079886 - RNA, 18 nt, Homo sapiens
gcugcugagaaucuagcc

SEQ ID NO: 1079887 - RNA, 13 nt, Homo sapiens
gcuucagccugag

SEQ ID NO: 1079888 - RNA, 16 nt, Homo sapiens
gcuucuggagcccuug

SEQ ID NO: 1079889 - RNA, 20 nt, Homo sapiens
gcuuuaguccuagaggaccu

SEQ ID NO: 1079890 - RNA, 14 nt, Homo sapiens
ggaaaccaguguag

SEQ ID NO: 1079891 - RNA, 16 nt, Homo sapiens
ggaaagcaucaccuca

SEQ ID NO: 1079892 - RNA, 12 nt, Homo sapiens
ggacaccucuca

SEQ ID NO: 1079893 - RNA, 16 nt, Homo sapiens
ggaucagaagauaucu

SEQ ID NO: 1079894 - RNA, 11 nt, Homo sapiens
ggaugucauag

SEQ ID NO: 1079895 - RNA, 15 nt, Homo sapiens
ggccaaguuccucua

SEQ ID NO: 1079896 - RNA, 15 nt, Homo sapiens
ggccccccuccaggc

SEQ ID NO: 1079897 - RNA, 12 nt, Homo sapiens
ggcuaaucucag

SEQ ID NO: 1079898 - RNA, 16 nt, Homo sapiens
ggcucagucucaggag

SEQ ID NO: 1079899 - RNA, 17 nt, Homo sapiens
ggcuggauagguaugca

SEQ ID NO: 1079900 - RNA, 22 nt, Homo sapiens
ggcuuucuggagaggagggaug

SEQ ID NO: 1079901 - RNA, 22 nt, Homo sapiens
gggaagcgaugaauuuggagac

SEQ ID NO: 1079902 - RNA, 22 nt, Homo sapiens
gggaugcugccugagucaccca

SEQ ID NO: 1079903 - RNA, 19 nt, Homo sapiens
gggaugucugaaaucagug

SEQ ID NO: 1079904 - RNA, 19 nt, Homo sapiens
gggccucugcucccaugcu

SEQ ID NO: 1079905 - RNA, 16 nt, Homo sapiens
gggcugagcccuggca

SEQ ID NO: 1079906 - RNA, 14 nt, Homo sapiens
gggcugcccugcca

SEQ ID NO: 1079907 - RNA, 21 nt, Homo sapiens
gggguauuuuaggcagggauu

SEQ ID NO: 1079908 - RNA, 15 nt, Homo sapiens
ggguggaucaccuga

SEQ ID NO: 1079909 - RNA, 13 nt, Homo sapiens
gguauauuuccau

SEQ ID NO: 1079910 - RNA, 14 nt, Homo sapiens
aagacugagucaag

SEQ ID NO: 1079911 - RNA, 21 nt, Homo sapiens
aagcugcugagaaucuagccu

SEQ ID NO: 1079912 - RNA, 17 nt, Homo sapiens
aaggcucagucucagga

SEQ ID NO: 1079913 - RNA, 21 nt, Homo sapiens
aagggaucagaagauaucuuu

SEQ ID NO: 1079914 - RNA, 15 nt, Homo sapiens
aaguaucccaucuaa

SEQ ID NO: 1079915 - RNA, 20 nt, Homo sapiens
aagucccugacucucuguga

SEQ ID NO: 1079916 - RNA, 15 nt, Homo sapiens
aaguuccucuagugc

SEQ ID NO: 1079917 - RNA, 19 nt, Homo sapiens
aaguucugguaugaacuug

SEQ ID NO: 1079918 - RNA, 14 nt, Homo sapiens
aauaagaaacacaa

SEQ ID NO: 1079919 - RNA, 22 nt, Homo sapiens
aauaauagacacuggagacuug

SEQ ID NO: 1079920 - RNA, 15 nt, Homo sapiens
aauaauauaugcuca

SEQ ID NO: 1079921 - RNA, 19 nt, Homo sapiens
aauagaaccaagaauucua

SEQ ID NO: 1079922 - RNA, 17 nt, Homo sapiens
aauaguacuauugcuag

SEQ ID NO: 1079923 - RNA, 22 nt, Homo sapiens
aauauguucaccaggagauuac

SEQ ID NO: 1079924 - RNA, 23 nt, Homo sapiens
aauauucaauaaagcugcugaga

SEQ ID NO: 1079925 - RNA, 18 nt, Homo sapiens
aaucagcucaaucuucaa

SEQ ID NO: 1079926 - RNA, 21 nt, Homo sapiens
aaucauuaauucacaugucca

SEQ ID NO: 1079927 - RNA, 19 nt, Homo sapiens
aauccagagauaauugcca

SEQ ID NO: 1079928 - RNA, 23 nt, Homo sapiens
aaucucuuaugggauuacauguu

SEQ ID NO: 1079929 - RNA, 17 nt, Homo sapiens
aaugaaucuuacuccuu

SEQ ID NO: 1079930 - RNA, 18 nt, Homo sapiens
aauguuugaguaccugau

SEQ ID NO: 1079931 - RNA, 17 nt, Homo sapiens
aauuacaauacaucuaa

SEQ ID NO: 1079932 - RNA, 21 nt, Homo sapiens
aauuagcuuguuacaauucua

SEQ ID NO: 1079933 - RNA, 18 nt, Homo sapiens
aauuuguuuuauauucuc

SEQ ID NO: 1079934 - RNA, 19 nt, Homo sapiens
aauuuguuuuauauucucu

SEQ ID NO: 1079935 - RNA, 21 nt, Homo sapiens
acaaugauaggaaaaauccau

SEQ ID NO: 1079936 - RNA, 16 nt, Homo sapiens
acaauuuuuaagcauu

SEQ ID NO: 1079937 - RNA, 18 nt, Homo sapiens
acacauggacacaccaga

SEQ ID NO: 1079938 - RNA, 17 nt, Homo sapiens
acacauguccaguggga

SEQ ID NO: 1079939 - RNA, 18 nt, Homo sapiens
acagaagaucuauauugu

SEQ ID NO: 1079940 - RNA, 13 nt, Homo sapiens
acagacuacauuu

SEQ ID NO: 1079941 - RNA, 22 nt, Homo sapiens
acagacuacauuuucacaacuc

SEQ ID NO: 1079942 - RNA, 15 nt, Homo sapiens
acagcccagacuuua

SEQ ID NO: 1079943 - RNA, 16 nt, Homo sapiens
acagcuuaacauuuac

SEQ ID NO: 1079944 - RNA, 17 nt, Homo sapiens
acagcuuaacauuuaca

SEQ ID NO: 1079945 - RNA, 22 nt, Homo sapiens
acaguccugggagaaccucagg

SEQ ID NO: 1079946 - RNA, 17 nt, Homo sapiens
acagugcccagcuaauu

SEQ ID NO: 1079947 - RNA, 15 nt, Homo sapiens
acauaaacacauaca

SEQ ID NO: 1079948 - RNA, 22 nt, Homo sapiens
acauaguucuuacuacuugcca

SEQ ID NO: 1079949 - RNA, 19 nt, Homo sapiens
acauggacacaccagagug

SEQ ID NO: 1079950 - RNA, 20 nt, Homo sapiens
acauggccagugugauccca

SEQ ID NO: 1079951 - RNA, 21 nt, Homo sapiens
acauguuaacaccuaccucac

SEQ ID NO: 1079952 - RNA, 15 nt, Homo sapiens
acauuccacagugcc

SEQ ID NO: 1079953 - RNA, 13 nt, Homo sapiens
accaguguagccu

SEQ ID NO: 1079954 - RNA, 11 nt, Homo sapiens
accccaucucu

SEQ ID NO: 1079955 - RNA, 16 nt, Homo sapiens
acccuuggacuugagg

SEQ ID NO: 1079956 - RNA, 14 nt, Homo sapiens
accucacuauucaa

SEQ ID NO: 1079957 - RNA, 12 nt, Homo sapiens
accugacuucca

SEQ ID NO: 1079958 - RNA, 14 nt, Homo sapiens
accuggucauuuca

SEQ ID NO: 1079959 - RNA, 15 nt, Homo sapiens
acgccacugcacucc

SEQ ID NO: 1079960 - RNA, 12 nt, Homo sapiens
acuaaaagaauu

SEQ ID NO: 1079961 - RNA, 14 nt, Homo sapiens
acuaaaagaauuug

SEQ ID NO: 1079962 - RNA, 19 nt, Homo sapiens
acuacuugccacacacugu

SEQ ID NO: 1079963 - RNA, 17 nt, Homo sapiens
acuauggguacauucca

SEQ ID NO: 1079964 - RNA, 13 nt, Homo sapiens
acuauuaguauua

SEQ ID NO: 1079965 - RNA, 21 nt, Homo sapiens
acuccaauuacuccaccauca

SEQ ID NO: 1079966 - RNA, 21 nt, Homo sapiens
acucugagcaugccccaaaaa

SEQ ID NO: 1079967 - RNA, 20 nt, Homo sapiens
acuggacuugagcuuggcag

SEQ ID NO: 1079968 - RNA, 21 nt, Homo sapiens
acuggagacuuggaagaguug

SEQ ID NO: 1079969 - RNA, 19 nt, Homo sapiens
acuguuaauaguacuauua

SEQ ID NO: 1079970 - RNA, 15 nt, Homo sapiens
acuuuaaauggaaua

SEQ ID NO: 1079971 - RNA, 15 nt, Homo sapiens
acuuuaccacuaugc

SEQ ID NO: 1079972 - RNA, 11 nt, Homo sapiens
agaaccucagg

SEQ ID NO: 1079973 - RNA, 22 nt, Homo sapiens
agaaggguuuuccacccuggaa

SEQ ID NO: 1079974 - RNA, 18 nt, Homo sapiens
agaccaccucucaauauu

SEQ ID NO: 1079975 - RNA, 17 nt, Homo sapiens
agauaucaguuaucaau

SEQ ID NO: 1079976 - RNA, 17 nt, Homo sapiens
agaucacgccacugcac

SEQ ID NO: 1079977 - RNA, 20 nt, Homo sapiens
agauucuaguagaacucuag

SEQ ID NO: 1079978 - RNA, 21 nt, Homo sapiens
agcagcuucaguuguuuuccc

SEQ ID NO: 1079979 - RNA, 14 nt, Homo sapiens
agcaucaccucagg

SEQ ID NO: 1079980 - RNA, 16 nt, Homo sapiens
agccaaacucugccag

SEQ ID NO: 1079981 - RNA, 17 nt, Homo sapiens
agccucccucugaccug

SEQ ID NO: 1079982 - RNA, 16 nt, Homo sapiens
ucaauaguauuaacua

SEQ ID NO: 1079983 - RNA, 15 nt, Homo sapiens
ucaaucuucaaugaa

SEQ ID NO: 1079984 - RNA, 20 nt, Homo sapiens
ucacaaaaaaaguaauugua

SEQ ID NO: 1079985 - RNA, 14 nt, Homo sapiens
ucagucaacauuua

SEQ ID NO: 1079986 - RNA, 16 nt, Homo sapiens
ucauaauccagagaua

SEQ ID NO: 1079987 - RNA, 22 nt, Homo sapiens
ucaucugcacaacugacuucca

SEQ ID NO: 1079988 - RNA, 14 nt, Homo sapiens
ucauuaauucacau

SEQ ID NO: 1079989 - RNA, 13 nt, Homo sapiens
uccaaaugccaac

SEQ ID NO: 1079990 - RNA, 20 nt, Homo sapiens
uccaaauuacagcauauaua

SEQ ID NO: 1079991 - RNA, 19 nt, Homo sapiens
uccaaccccccaccugcca

SEQ ID NO: 1079992 - RNA, 15 nt, Homo sapiens
uccaccaucaccucu

SEQ ID NO: 1079993 - RNA, 17 nt, Homo sapiens
uccaccaucaccucucu

SEQ ID NO: 1079994 - RNA, 12 nt, Homo sapiens
uccauguaucua

SEQ ID NO: 1079995 - RNA, 10 nt, Homo sapiens
ucccaaagaa

SEQ ID NO: 1079996 - RNA, 22 nt, Homo sapiens
ucccaucuaaaacucauacaau

SEQ ID NO: 1079997 - RNA, 19 nt, Homo sapiens
ucccaugcucauaccucuu

SEQ ID NO: 1079998 - RNA, 12 nt, Homo sapiens
uccuaccucagc

SEQ ID NO: 1079999 - RNA, 19 nt, Homo sapiens
uccuaggccacaccaucuc

SEQ ID NO: 1080000 - RNA, 20 nt, Homo sapiens
uccuaggccacaccaucucc

SEQ ID NO: 1080001 - RNA, 18 nt, Homo sapiens
uccugggagaaccucagg

SEQ ID NO: 1080002 - RNA, 10 nt, Homo sapiens
ucguagccaa

SEQ ID NO: 1080003 - RNA, 20 nt, Homo sapiens
ucuaacuagaaaucugccaa

SEQ ID NO: 1080004 - RNA, 16 nt, Homo sapiens
ucucagugcucuccua

SEQ ID NO: 1080005 - RNA, 16 nt, Homo sapiens
ucucucuacugaucaa

SEQ ID NO: 1080006 - RNA, 17 nt, Homo sapiens
ucugaaaucagugccua

SEQ ID NO: 1080007 - RNA, 17 nt, Homo sapiens
ucugagaucagugccuc

SEQ ID NO: 1080008 - RNA, 17 nt, Homo sapiens
ucugggccaaguuccuc

SEQ ID NO: 1080009 - RNA, 14 nt, Homo sapiens
ucugucccaaagaa

SEQ ID NO: 1080010 - RNA, 19 nt, Homo sapiens
ucuguccuaaauaucucaa

SEQ ID NO: 1080011 - RNA, 16 nt, Homo sapiens
ugaagacccaguguaa

SEQ ID NO: 1080012 - RNA, 15 nt, Homo sapiens
ugaagaugcucugug

SEQ ID NO: 1080013 - RNA, 16 nt, Homo sapiens
ugaaucaugaaguaaa

SEQ ID NO: 1080014 - RNA, 21 nt, Homo sapiens
ugacacuguuaauaguacuau

SEQ ID NO: 1080015 - RNA, 14 nt, Homo sapiens
ugacagcacuacaa

SEQ ID NO: 1080016 - RNA, 17 nt, Homo sapiens
ugacuaauucacaaaaa

SEQ ID NO: 1080017 - RNA, 17 nt, Homo sapiens
ugagcaugccccaaaaa

SEQ ID NO: 1080018 - RNA, 21 nt, Homo sapiens
ugaucgcgccacuacacucca

SEQ ID NO: 1080019 - RNA, 16 nt, Homo sapiens
ugauguacuacauuaa

SEQ ID NO: 1080020 - RNA, 21 nt, Homo sapiens
ugauuuacuacuuaugcguaa

SEQ ID NO: 1080021 - RNA, 16 nt, Homo sapiens
ugcaccugccagccug

SEQ ID NO: 1080022 - RNA, 18 nt, Homo sapiens
ugcacuuuaaauggaaua

SEQ ID NO: 1080023 - RNA, 15 nt, Homo sapiens
ugccuugaagccacu

SEQ ID NO: 1080024 - RNA, 17 nt, Homo sapiens
ugcuaguacuaguacua

SEQ ID NO: 1080025 - RNA, 17 nt, Homo sapiens
ugcuauuacuaguacua

SEQ ID NO: 1080026 - RNA, 20 nt, Homo sapiens
uggaaagccucugcugccau

SEQ ID NO: 1080027 - RNA, 22 nt, Homo sapiens
uggagagaucauagcucacugu

SEQ ID NO: 1080028 - RNA, 23 nt, Homo sapiens
uggagcccaggaguuugaggcug

SEQ ID NO: 1080029 - RNA, 16 nt, Homo sapiens
uggcaaaugaaagcau

SEQ ID NO: 1080030 - RNA, 15 nt, Homo sapiens
uggcaucacagggca

SEQ ID NO: 1080031 - RNA, 18 nt, Homo sapiens
uggccagugugaucccaa

SEQ ID NO: 1080032 - RNA, 19 nt, Homo sapiens
uggguacaauguacauuau

SEQ ID NO: 1080033 - RNA, 13 nt, Homo sapiens
uguaaacuaguac

SEQ ID NO: 1080034 - RNA, 22 nt, Homo sapiens
uguaaagaauaaaugaaucuua

SEQ ID NO: 1080035 - RNA, 18 nt, Homo sapiens
uguaaguuuaugucuaaa

SEQ ID NO: 1080036 - RNA, 18 nt, Homo sapiens
uguacacuuucugucuca

SEQ ID NO: 1080037 - RNA, 15 nt, Homo sapiens
uguaccugacuucca

SEQ ID NO: 1080038 - RNA, 14 nt, Homo sapiens
uguauuagauauca

SEQ ID NO: 1080039 - RNA, 21 nt, Homo sapiens
ugucaauaguauuaacuauua

SEQ ID NO: 1080040 - RNA, 12 nt, Homo sapiens
ugucccaaagaa

SEQ ID NO: 1080041 - RNA, 13 nt, Homo sapiens
ugucguagccaag

SEQ ID NO: 1080042 - RNA, 18 nt, Homo sapiens
ugugaaaagcuacccuga

SEQ ID NO: 1080043 - RNA, 19 nt, Homo sapiens
ugugaacauggacucuucc

SEQ ID NO: 1080044 - RNA, 17 nt, Homo sapiens
uguggguuuuuucacau

SEQ ID NO: 1080045 - RNA, 16 nt, Homo sapiens
uguuauuuguacaguu

SEQ ID NO: 1080046 - RNA, 22 nt, Homo sapiens
uguuguggguuuuuucacauaa

SEQ ID NO: 1080047 - RNA, 20 nt, Homo sapiens
uuaaagaaaaaaaaagucag

SEQ ID NO: 1080048 - RNA, 15 nt, Homo sapiens
uuaacuugaggguaa

SEQ ID NO: 1080049 - RNA, 12 nt, Homo sapiens
uuaauacuguau

SEQ ID NO: 1080050 - RNA, 18 nt, Homo sapiens
uuaauggguacaauguac

SEQ ID NO: 1080051 - RNA, 11 nt, Homo sapiens
uuaauuacuuu

SEQ ID NO: 1080052 - RNA, 18 nt, Homo sapiens
uuacuaguacuauuacua

SEQ ID NO: 1080053 - RNA, 14 nt, Homo sapiens
uuauccaacuauua

SEQ ID NO: 1080054 - RNA, 12 nt, Homo sapiens
uuaugucuauau

SEQ ID NO: 1080055 - RNA, 19 nt, Homo sapiens
uucaaacauuauucucaac

SEQ ID NO: 1080056 - RNA, 10 nt, Homo sapiens
uucacauaaa

SEQ ID NO: 1080057 - RNA, 18 nt, Homo sapiens
uucagggaauuucaggaa

SEQ ID NO: 1080058 - RNA, 23 nt, Homo sapiens
uuccaggaguucugaagcugaca

SEQ ID NO: 1080059 - RNA, 15 nt, Homo sapiens
uuccuaccauacaau

SEQ ID NO: 1080060 - RNA, 21 nt, Homo sapiens
uucuaacuagaaaucugccaa

SEQ ID NO: 1080061 - RNA, 14 nt, Homo sapiens
uucucaaccagaga

SEQ ID NO: 1080062 - RNA, 21 nt, Homo sapiens
uucugaaagaaucauuugcau

SEQ ID NO: 1080063 - RNA, 15 nt, Homo sapiens
uucuggcacugguug

SEQ ID NO: 1080064 - RNA, 15 nt, Homo sapiens
uucuuuacauuugau

SEQ ID NO: 1080065 - RNA, 16 nt, Homo sapiens
uucuuuuucacacuga

SEQ ID NO: 1080066 - RNA, 15 nt, Homo sapiens
uugcuaguacuagua

SEQ ID NO: 1080067 - RNA, 15 nt, Homo sapiens
cugggagaaccucag

SEQ ID NO: 1080068 - RNA, 17 nt, Homo sapiens
cugggagaaccucaggc

SEQ ID NO: 1080069 - RNA, 19 nt, Homo sapiens
cugggggaggaacagggcu

SEQ ID NO: 1080070 - RNA, 13 nt, Homo sapiens
cuguuaguauuaa

SEQ ID NO: 1080071 - RNA, 19 nt, Homo sapiens
cuguuaguauuaacuauua

SEQ ID NO: 1080072 - RNA, 20 nt, Homo sapiens
cuuaaucuccacuguuauuc

SEQ ID NO: 1080073 - RNA, 14 nt, Homo sapiens
cuuaauggguacaa

SEQ ID NO: 1080074 - RNA, 19 nt, Homo sapiens
cuucaaguuagcucaggag

SEQ ID NO: 1080075 - RNA, 16 nt, Homo sapiens
cuucaguuguuuuccc

SEQ ID NO: 1080076 - RNA, 21 nt, Homo sapiens
cuugaggauuuugaguaucuc

SEQ ID NO: 1080077 - RNA, 22 nt, Homo sapiens
cuugaggguaauaaacuuagaa

SEQ ID NO: 1080078 - RNA, 21 nt, Homo sapiens
cuuggaauuggaauuacugua

SEQ ID NO: 1080079 - RNA, 23 nt, Homo sapiens
cuuguguguguguguugauccca

SEQ ID NO: 1080080 - RNA, 15 nt, Homo sapiens
cuuuaccacuaugca

SEQ ID NO: 1080081 - RNA, 15 nt, Homo sapiens
cuuuccaaagcauuu

SEQ ID NO: 1080082 - RNA, 15 nt, Homo sapiens
cuuucugggccaagu

SEQ ID NO: 1080083 - RNA, 21 nt, Homo sapiens
cuuuguguucaguuccacuau

SEQ ID NO: 1080084 - RNA, 22 nt, Homo sapiens
gaacacuaaacagacuauuuaa

SEQ ID NO: 1080085 - RNA, 16 nt, Homo sapiens
gaagacccaguguaaa

SEQ ID NO: 1080086 - RNA, 23 nt, Homo sapiens
gaagacccaguguaaagaauaaa

SEQ ID NO: 1080087 - RNA, 16 nt, Homo sapiens
gaagggugacauccca

SEQ ID NO: 1080088 - RNA, 16 nt, Homo sapiens
gaaguaaaagcuaauu

SEQ ID NO: 1080089 - RNA, 21 nt, Homo sapiens
gaauaauuagcuuguuacaau

SEQ ID NO: 1080090 - RNA, 20 nt, Homo sapiens
gaauguuauccaacuauuaa

SEQ ID NO: 1080091 - RNA, 19 nt, Homo sapiens
gaauucugaauguacacuu

SEQ ID NO: 1080092 - RNA, 17 nt, Homo sapiens
gacagaagaucuauauu

SEQ ID NO: 1080093 - RNA, 18 nt, Homo sapiens
gacccaguguaaagaaua

SEQ ID NO: 1080094 - RNA, 16 nt, Homo sapiens
gacuugaggauuuuga

SEQ ID NO: 1080095 - RNA, 22 nt, Homo sapiens
gaggagggaugcugccugaguc

SEQ ID NO: 1080096 - RNA, 13 nt, Homo sapiens
gaggaucacugga

SEQ ID NO: 1080097 - RNA, 12 nt, Homo sapiens
gaggcuuggaaa

SEQ ID NO: 1080098 - RNA, 15 nt, Homo sapiens
gauaggaaaaaucca

SEQ ID NO: 1080099 - RNA, 16 nt, Homo sapiens
gaugcugccugaguca

SEQ ID NO: 1080100 - RNA, 23 nt, Homo sapiens
gauuauuuguuauuuguacaguu

SEQ ID NO: 1080101 - RNA, 12 nt, Homo sapiens
gcaaagucuaaa

SEQ ID NO: 1080102 - RNA, 16 nt, Homo sapiens
gcaccuguacucagga

SEQ ID NO: 1080103 - RNA, 16 nt, Homo sapiens
gcauuaucagccuguu

SEQ ID NO: 1080104 - RNA, 11 nt, Homo sapiens
gccauucugau

SEQ ID NO: 1080105 - RNA, 20 nt, Homo sapiens
gcccagccauuaccauggag

SEQ ID NO: 1080106 - RNA, 15 nt, Homo sapiens
gcccagcugcaccug

SEQ ID NO: 1080107 - RNA, 21 nt, Homo sapiens
gccgagaucacgccacugcac

SEQ ID NO: 1080108 - RNA, 19 nt, Homo sapiens
gccugagucacccaugaag

SEQ ID NO: 1080109 - RNA, 21 nt, Homo sapiens
gccuucacuccggugugccug

SEQ ID NO: 1080110 - RNA, 20 nt, Homo sapiens
gcugcugagaaucuagccuc

SEQ ID NO: 1080111 - RNA, 14 nt, Homo sapiens
gcuggcugcaguga

SEQ ID NO: 1080112 - RNA, 16 nt, Homo sapiens
gcuuccagaaaacccc

SEQ ID NO: 1080113 - RNA, 22 nt, Homo sapiens
ggaaagcaucaccucaggccag

SEQ ID NO: 1080114 - RNA, 23 nt, Homo sapiens
ggaauaauuagcuuguuacaauu

SEQ ID NO: 1080115 - RNA, 17 nt, Homo sapiens
gggaggaagcagguuga

SEQ ID NO: 1080116 - RNA, 12 nt, Homo sapiens
gggccucugaaa

SEQ ID NO: 1080117 - RNA, 22 nt, Homo sapiens
gggcugagcccuggcaggauga

SEQ ID NO: 1080118 - RNA, 11 nt, Homo sapiens
gggugggagag

SEQ ID NO: 1080119 - RNA, 13 nt, Homo sapiens
ggguguguguagc

SEQ ID NO: 1080120 - RNA, 17 nt, Homo sapiens
ggguguguguagccaag

SEQ ID NO: 1080121 - RNA, 17 nt, Homo sapiens
gguaaaaccccaucucu

SEQ ID NO: 1080122 - RNA, 18 nt, Homo sapiens
gguaauuuguaucugaag

SEQ ID NO: 1080123 - RNA, 15 nt, Homo sapiens
ggugugaaagucaga

SEQ ID NO: 1080124 - RNA, 22 nt, Homo sapiens
gguucuaggagaacugucauga

SEQ ID NO: 1080125 - RNA, 13 nt, Homo sapiens
gguuuuuucacau

SEQ ID NO: 1080126 - RNA, 18 nt, Homo sapiens
guaauuguaaacuaguac

SEQ ID NO: 1080127 - RNA, 16 nt, Homo sapiens
guacuauuacuaguac

SEQ ID NO: 1080128 - RNA, 15 nt, Homo sapiens
guacuauuacuauua

SEQ ID NO: 1080129 - RNA, 16 nt, Homo sapiens
guacuauuacuauuac

SEQ ID NO: 1080130 - RNA, 18 nt, Homo sapiens
guaucucggaccuuucag

SEQ ID NO: 1080131 - RNA, 20 nt, Homo sapiens
guauuaccuggucauuucaa

SEQ ID NO: 1080132 - RNA, 17 nt, Homo sapiens
guccaccugccuaucca

SEQ ID NO: 1080133 - RNA, 22 nt, Homo sapiens
guccuucaaguuagcucaggag

SEQ ID NO: 1080134 - RNA, 18 nt, Homo sapiens
gugcuguggccugggcaa

SEQ ID NO: 1080135 - RNA, 15 nt, Homo sapiens
gugcuucagccugag

SEQ ID NO: 1080136 - RNA, 12 nt, Homo sapiens
guggacaccugc

SEQ ID NO: 1080137 - RNA, 13 nt, Homo sapiens
guuaauacuauau

SEQ ID NO: 1080138 - RNA, 16 nt, Homo sapiens
guuaauaguacuauua

SEQ ID NO: 1080139 - RNA, 15 nt, Homo sapiens
guuauccaacuauua

SEQ ID NO: 1080140 - RNA, 23 nt, Homo sapiens
guuauccaacuauuaagauaucu

SEQ ID NO: 1080141 - RNA, 18 nt, Homo sapiens
guugaggggcuccuggaa

SEQ ID NO: 1080142 - RNA, 20 nt, Homo sapiens
guugauaaauuccacuggac

SEQ ID NO: 1080143 - RNA, 19 nt, Homo sapiens
guuuccuaugacuaauuca

SEQ ID NO: 1080144 - RNA, 18 nt, Homo sapiens
uaaaaaaauuuuaauucc

SEQ ID NO: 1080145 - RNA, 23 nt, Homo sapiens
uaaaagaaaaaguaugugaauau

SEQ ID NO: 1080146 - RNA, 13 nt, Homo sapiens
auccaacuauuaa

SEQ ID NO: 1080147 - RNA, 17 nt, Homo sapiens
auccagagauaauugcc

SEQ ID NO: 1080148 - RNA, 22 nt, Homo sapiens
aucccaggaggggccucugaaa

SEQ ID NO: 1080149 - RNA, 13 nt, Homo sapiens
aucuccacuguua

SEQ ID NO: 1080150 - RNA, 16 nt, Homo sapiens
aucugagaaacuuaaa

SEQ ID NO: 1080151 - RNA, 21 nt, Homo sapiens
aucugcacaacugacuuccaa

SEQ ID NO: 1080152 - RNA, 16 nt, Homo sapiens
augaagacccagugua

SEQ ID NO: 1080153 - RNA, 19 nt, Homo sapiens
augaagacccaguguaaag

SEQ ID NO: 1080154 - RNA, 18 nt, Homo sapiens
augaauugacagacuguu

SEQ ID NO: 1080155 - RNA, 13 nt, Homo sapiens
augcucauaccuc

SEQ ID NO: 1080156 - RNA, 14 nt, Homo sapiens
augcucauaccucu

SEQ ID NO: 1080157 - RNA, 19 nt, Homo sapiens
augcuuugcucaugcgcaa

SEQ ID NO: 1080158 - RNA, 14 nt, Homo sapiens
auggacucuucccc

SEQ ID NO: 1080159 - RNA, 17 nt, Homo sapiens
auggacucuucccccac

SEQ ID NO: 1080160 - RNA, 18 nt, Homo sapiens
auggagaggggguacaau

SEQ ID NO: 1080161 - RNA, 21 nt, Homo sapiens
augguccuggggcucugugca

SEQ ID NO: 1080162 - RNA, 22 nt, Homo sapiens
auguaucuaccucacuauucaa

SEQ ID NO: 1080163 - RNA, 13 nt, Homo sapiens
auguaugcugauu

SEQ ID NO: 1080164 - RNA, 14 nt, Homo sapiens
augucagacuggcu

SEQ ID NO: 1080165 - RNA, 19 nt, Homo sapiens
augucugagaucagugccu

SEQ ID NO: 1080166 - RNA, 17 nt, Homo sapiens
auguuaacaccuaccuc

SEQ ID NO: 1080167 - RNA, 18 nt, Homo sapiens
auguuauccaacuauuaa

SEQ ID NO: 1080168 - RNA, 18 nt, Homo sapiens
auuaccuggucauuucaa

SEQ ID NO: 1080169 - RNA, 18 nt, Homo sapiens
auuauggaauuacucuac

SEQ ID NO: 1080170 - RNA, 18 nt, Homo sapiens
auucaaacauuauucuca

SEQ ID NO: 1080171 - RNA, 20 nt, Homo sapiens
auugcccaaauaauauuuua

SEQ ID NO: 1080172 - RNA, 22 nt, Homo sapiens
auugcuauuacuaguacuauua

SEQ ID NO: 1080173 - RNA, 20 nt, Homo sapiens
auuguaaacuaguacuauua

SEQ ID NO: 1080174 - RNA, 23 nt, Homo sapiens
auugugugugugaagaugcucug

SEQ ID NO: 1080175 - RNA, 15 nt, Homo sapiens
auuucccacacccca

SEQ ID NO: 1080176 - RNA, 16 nt, Homo sapiens
auuuuaaguaucccau

SEQ ID NO: 1080177 - RNA, 21 nt, Homo sapiens
auuuuaggcagggauuugagg

SEQ ID NO: 1080178 - RNA, 21 nt, Homo sapiens
auuuuaugugcuucacauaau

SEQ ID NO: 1080179 - RNA, 19 nt, Homo sapiens
auuuucucuggcagcauaa

SEQ ID NO: 1080180 - RNA, 14 nt, Homo sapiens
caaaaaaaguaauu

SEQ ID NO: 1080181 - RNA, 16 nt, Homo sapiens
caaaguaaagacugag

SEQ ID NO: 1080182 - RNA, 23 nt, Homo sapiens
caaauguaaaauaaguauuucca

SEQ ID NO: 1080183 - RNA, 15 nt, Homo sapiens
caaauugaggacuua

SEQ ID NO: 1080184 - RNA, 12 nt, Homo sapiens
caauaguauuaa

SEQ ID NO: 1080185 - RNA, 16 nt, Homo sapiens
caauauaucaauguaa

SEQ ID NO: 1080186 - RNA, 19 nt, Homo sapiens
caauauucuuuuguucuaa

SEQ ID NO: 1080187 - RNA, 21 nt, Homo sapiens
caaugauaggaaaaauccauu

SEQ ID NO: 1080188 - RNA, 13 nt, Homo sapiens
caauuaccaauau

SEQ ID NO: 1080189 - RNA, 19 nt, Homo sapiens
caauuuauccaacccauuu

SEQ ID NO: 1080190 - RNA, 23 nt, Homo sapiens
cacagccgcagccucccucugac

SEQ ID NO: 1080191 - RNA, 15 nt, Homo sapiens
caccaggagauuaca

SEQ ID NO: 1080192 - RNA, 23 nt, Homo sapiens
cacccuggaaucaagaugucaga

SEQ ID NO: 1080193 - RNA, 19 nt, Homo sapiens
cacuacacuccagccugag

SEQ ID NO: 1080194 - RNA, 22 nt, Homo sapiens
cagaggcagcgaguuguggaaa

SEQ ID NO: 1080195 - RNA, 14 nt, Homo sapiens
cagaggggaaacca

SEQ ID NO: 1080196 - RNA, 14 nt, Homo sapiens
cagcugcaccugcc

SEQ ID NO: 1080197 - RNA, 17 nt, Homo sapiens
caggagcauggggauaa

SEQ ID NO: 1080198 - RNA, 22 nt, Homo sapiens
caggaguuugaggcugcagcga

SEQ ID NO: 1080199 - RNA, 17 nt, Homo sapiens
caggccaggugcagugg

SEQ ID NO: 1080200 - RNA, 13 nt, Homo sapiens
cagucugagcugu

SEQ ID NO: 1080201 - RNA, 21 nt, Homo sapiens
cauaauccagagauaauugcc

SEQ ID NO: 1080202 - RNA, 14 nt, Homo sapiens
cauacauugccaau

SEQ ID NO: 1080203 - RNA, 17 nt, Homo sapiens
caucuaaaacucauaca

SEQ ID NO: 1080204 - RNA, 18 nt, Homo sapiens
caucuucuuauuuuccaa

SEQ ID NO: 1080205 - RNA, 19 nt, Homo sapiens
caugauggagcgcaccugc

SEQ ID NO: 1080206 - RNA, 19 nt, Homo sapiens
cauguggccccaggugcca

SEQ ID NO: 1080207 - RNA, 17 nt, Homo sapiens
cauuaccauggagacaa

SEQ ID NO: 1080208 - RNA, 18 nt, Homo sapiens
cauucaaucauuaauuca

SEQ ID NO: 1080209 - RNA, 15 nt, Homo sapiens
ccaaauuacagcaua

SEQ ID NO: 1080210 - RNA, 17 nt, Homo sapiens
ccaaccccccaccugcc

SEQ ID NO: 1080211 - RNA, 15 nt, Homo sapiens
ccaacgacaaagcca

SEQ ID NO: 1080212 - RNA, 17 nt, Homo sapiens
ccaauccacacauauug

SEQ ID NO: 1080213 - RNA, 13 nt, Homo sapiens
ccacaccaucucc

SEQ ID NO: 1080214 - RNA, 14 nt, Homo sapiens
ccacuggacuugag

SEQ ID NO: 1080215 - RNA, 13 nt, Homo sapiens
ccacuuaugcaua

SEQ ID NO: 1080216 - RNA, 17 nt, Homo sapiens
ccagccuggacaccucu

SEQ ID NO: 1080217 - RNA, 15 nt, Homo sapiens
ccagccuggccaaca

SEQ ID NO: 1080218 - RNA, 21 nt, Homo sapiens
ccaguguaaagaauaaaugaa

SEQ ID NO: 1080219 - RNA, 13 nt, Homo sapiens
cccagcacuuugg

SEQ ID NO: 1080220 - RNA, 16 nt, Homo sapiens
cccaggcuggucuuga

SEQ ID NO: 1080221 - RNA, 23 nt, Homo sapiens
cccccagccuggacaccucucau

SEQ ID NO: 1080222 - RNA, 19 nt, Homo sapiens
caucucauuaaaaggcccu

SEQ ID NO: 1080223 - RNA, 19 nt, Homo sapiens
caugaaaaagaauaccaau

SEQ ID NO: 1080224 - RNA, 17 nt, Homo sapiens
caugacuuuuccaugua

SEQ ID NO: 1080225 - RNA, 13 nt, Homo sapiens
caugcuggggcaa

SEQ ID NO: 1080226 - RNA, 14 nt, Homo sapiens
ccaaacucugccag

SEQ ID NO: 1080227 - RNA, 15 nt, Homo sapiens
ccaaacucugccagc

SEQ ID NO: 1080228 - RNA, 16 nt, Homo sapiens
ccaagugccagucuug

SEQ ID NO: 1080229 - RNA, 23 nt, Homo sapiens
ccagacuuuaccacuaugcaaua

SEQ ID NO: 1080230 - RNA, 19 nt, Homo sapiens
ccaggaguucugaagcuga

SEQ ID NO: 1080231 - RNA, 23 nt, Homo sapiens
ccaucuaaaacucauacaaugau

SEQ ID NO: 1080232 - RNA, 17 nt, Homo sapiens
ccauguaucuaccucac

SEQ ID NO: 1080233 - RNA, 13 nt, Homo sapiens
cccaagauucaua

SEQ ID NO: 1080234 - RNA, 21 nt, Homo sapiens
cccaauacauaccacuuugaa

SEQ ID NO: 1080235 - RNA, 14 nt, Homo sapiens
cccaguguaaagaa

SEQ ID NO: 1080236 - RNA, 17 nt, Homo sapiens
cccaucuaaaacucaua

SEQ ID NO: 1080237 - RNA, 22 nt, Homo sapiens
ccccaccugccauuugcacccu

SEQ ID NO: 1080238 - RNA, 22 nt, Homo sapiens
ccgggaagcggagguugcaggg

SEQ ID NO: 1080239 - RNA, 15 nt, Homo sapiens
ccuaccauacaauau

SEQ ID NO: 1080240 - RNA, 12 nt, Homo sapiens
ccuaugauccca

SEQ ID NO: 1080241 - RNA, 12 nt, Homo sapiens
ccucaguucucu

SEQ ID NO: 1080242 - RNA, 13 nt, Homo sapiens
ccuccaaaugcca

SEQ ID NO: 1080243 - RNA, 16 nt, Homo sapiens
ccuccaaaugccaacu

SEQ ID NO: 1080244 - RNA, 14 nt, Homo sapiens
ccucgccacgggga

SEQ ID NO: 1080245 - RNA, 16 nt, Homo sapiens
ccucuggacaagucau

SEQ ID NO: 1080246 - RNA, 20 nt, Homo sapiens
ccuggaaucaagaugucaga

SEQ ID NO: 1080247 - RNA, 23 nt, Homo sapiens
ccuuagagcuuggacagucugag

SEQ ID NO: 1080248 - RNA, 19 nt, Homo sapiens
ccuucaaguuagcucagga

SEQ ID NO: 1080249 - RNA, 22 nt, Homo sapiens
ccuuuuauucauauuuucacau

SEQ ID NO: 1080250 - RNA, 13 nt, Homo sapiens
cgacaaagccaaa

SEQ ID NO: 1080251 - RNA, 13 nt, Homo sapiens
cuaaagagcuuua

SEQ ID NO: 1080252 - RNA, 15 nt, Homo sapiens
cuaaagagcuuuagu

SEQ ID NO: 1080253 - RNA, 19 nt, Homo sapiens
cuaauaauaguacuauuac

SEQ ID NO: 1080254 - RNA, 14 nt, Homo sapiens
cuagagaugacuga

SEQ ID NO: 1080255 - RNA, 12 nt, Homo sapiens
cuaguacuagua

SEQ ID NO: 1080256 - RNA, 13 nt, Homo sapiens
cuaguacuaguac

SEQ ID NO: 1080257 - RNA, 13 nt, Homo sapiens
cuaguacuauuac

SEQ ID NO: 1080258 - RNA, 18 nt, Homo sapiens
cuaguacuauuacuagua

SEQ ID NO: 1080259 - RNA, 16 nt, Homo sapiens
cuauuaacaacccaua

SEQ ID NO: 1080260 - RNA, 19 nt, Homo sapiens
cuauucaaguauuaggggu

SEQ ID NO: 1080261 - RNA, 15 nt, Homo sapiens
cuauugcuaguacua

SEQ ID NO: 1080262 - RNA, 18 nt, Homo sapiens
cuauugcuaguacuagua

SEQ ID NO: 1080263 - RNA, 15 nt, Homo sapiens
cuauuuaacuugagg

SEQ ID NO: 1080264 - RNA, 17 nt, Homo sapiens
cuauuuaacuugagggu

SEQ ID NO: 1080265 - RNA, 17 nt, Homo sapiens
cucaaaugcugggggua

SEQ ID NO: 1080266 - RNA, 19 nt, Homo sapiens
cucacuauucaaguauuag

SEQ ID NO: 1080267 - RNA, 23 nt, Homo sapiens
cucacuauucaaguauuaggggu

SEQ ID NO: 1080268 - RNA, 14 nt, Homo sapiens
cucauacaaugaua

SEQ ID NO: 1080269 - RNA, 13 nt, Homo sapiens
cuccccaccuuca

SEQ ID NO: 1080270 - RNA, 19 nt, Homo sapiens
cucugccagccacauccaa

SEQ ID NO: 1080271 - RNA, 18 nt, Homo sapiens
cucugcuaccaucucauu

SEQ ID NO: 1080272 - RNA, 17 nt, Homo sapiens
cucuggacaagucaucu

SEQ ID NO: 1080273 - RNA, 19 nt, Homo sapiens
cucuuaugggauuacaugu

SEQ ID NO: 1080274 - RNA, 18 nt, Homo sapiens
cugaagcugacagcacua

SEQ ID NO: 1080275 - RNA, 21 nt, Homo sapiens
cugaagcugacagcacuacaa

SEQ ID NO: 1080276 - RNA, 22 nt, Homo sapiens
cugaagcugacagcacuacaaa

SEQ ID NO: 1080277 - RNA, 18 nt, Homo sapiens
cugacuuccaagauccuu

SEQ ID NO: 1080278 - RNA, 22 nt, Homo sapiens
cugauuaauccauuuuaacaaa

SEQ ID NO: 1080279 - RNA, 20 nt, Homo sapiens
cuggaaaggcucagucucag

SEQ ID NO: 1080280 - RNA, 16 nt, Homo sapiens
cugggagaaccucagg

SEQ ID NO: 1080281 - RNA, 14 nt, Homo sapiens
cuggggcucugugc

SEQ ID NO: 1080282 - RNA, 18 nt, Homo sapiens
cugggggcagauauuucc

SEQ ID NO: 1080283 - RNA, 19 nt, Homo sapiens
cugguaauuuguaucugaa

SEQ ID NO: 1080284 - RNA, 18 nt, Homo sapiens
cuguaugguauaugcaug

SEQ ID NO: 1080285 - RNA, 14 nt, Homo sapiens
cuguggccugggca

SEQ ID NO: 1080286 - RNA, 18 nt, Homo sapiens
cuguuaauaguacuauua

SEQ ID NO: 1080287 - RNA, 19 nt, Homo sapiens
cuuaauggguacaauguac

SEQ ID NO: 1080288 - RNA, 13 nt, Homo sapiens
cuuacuacuugcc

SEQ ID NO: 1080289 - RNA, 23 nt, Homo sapiens
cuuauuugagugauuauuuguua

SEQ ID NO: 1080290 - RNA, 14 nt, Homo sapiens
cuuccagauuacaa

SEQ ID NO: 1080291 - RNA, 18 nt, Homo sapiens
cuugagcuuggcagcuga

SEQ ID NO: 1080292 - RNA, 15 nt, Homo sapiens
cuugucauguacuga

SEQ ID NO: 1080293 - RNA, 17 nt, Homo sapiens
cuugugugaggcucugu

SEQ ID NO: 1080294 - RNA, 21 nt, Homo sapiens
cuuuggaauguugaauugcau

SEQ ID NO: 1080295 - RNA, 16 nt, Homo sapiens
cuuuuccauguaucua

SEQ ID NO: 1080296 - RNA, 22 nt, Homo sapiens
cuuuugacaaauucuuuuucac

SEQ ID NO: 1080297 - RNA, 11 nt, Homo sapiens
cuuuuucacac

SEQ ID NO: 1080298 - RNA, 20 nt, Homo sapiens
gaaaauccauucauucaauc

SEQ ID NO: 1080299 - RNA, 19 nt, Homo sapiens
gaaagccucugcugccaug

SEQ ID NO: 1080300 - RNA, 15 nt, Homo sapiens
gaaaguuugcacugu

SEQ ID NO: 1080301 - RNA, 18 nt, Homo sapiens
gaaauuucccacacccca

SEQ ID NO: 1080302 - RNA, 18 nt, Homo sapiens
gaacaagcaauuacaaua

SEQ ID NO: 1080303 - RNA, 15 nt, Homo sapiens
gaagacccaguguaa

SEQ ID NO: 1080304 - RNA, 22 nt, Homo sapiens
gaagagugauguuucagucaag

SEQ ID NO: 1080305 - RNA, 19 nt, Homo sapiens
gaaucagcucaaucuucaa

SEQ ID NO: 1080306 - RNA, 17 nt, Homo sapiens
gaaucaugaaguaaauu

SEQ ID NO: 1080307 - RNA, 21 nt, Homo sapiens
gacaaagccaaacucugccag

SEQ ID NO: 1080308 - RNA, 14 nt, Homo sapiens
gacaacuguuuaau

SEQ ID NO: 1080309 - RNA, 16 nt, Homo sapiens
gacuauuuaacuugag

SEQ ID NO: 1080310 - RNA, 16 nt, Homo sapiens
gacuugagcuuggcag

SEQ ID NO: 1080311 - RNA, 20 nt, Homo sapiens
gagaaaacuuauuugaguga

SEQ ID NO: 1080312 - RNA, 22 nt, Homo sapiens
gagaaaacuuauuugagugauu

SEQ ID NO: 1080313 - RNA, 20 nt, Homo sapiens
gagaguucuuuauauucaaa

SEQ ID NO: 1080314 - RNA, 19 nt, Homo sapiens
gagauggggucuugcuaua

SEQ ID NO: 1080315 - RNA, 20 nt, Homo sapiens
gagauggggucuugcuauau

SEQ ID NO: 1080316 - RNA, 21 nt, Homo sapiens
gagcuuggacagucugagcug

SEQ ID NO: 1080317 - RNA, 16 nt, Homo sapiens
gagcuuggcagcugaa

SEQ ID NO: 1080318 - RNA, 17 nt, Homo sapiens
gagcuuuaguccuagag

SEQ ID NO: 1080319 - RNA, 15 nt, Homo sapiens
gaggaaucagcucaa

SEQ ID NO: 1080320 - RNA, 16 nt, Homo sapiens
gaggaaucagcucaau

SEQ ID NO: 1080321 - RNA, 15 nt, Homo sapiens
gaggcucuguccuaa

SEQ ID NO: 1080322 - RNA, 16 nt, Homo sapiens
gauaaauuccacugga

SEQ ID NO: 1080323 - RNA, 23 nt, Homo sapiens
gauaugucuuggccacuauggac

SEQ ID NO: 1080324 - RNA, 22 nt, Homo sapiens
gauauuucccaauacauaccac

SEQ ID NO: 1080325 - RNA, 18 nt, Homo sapiens
gauggagaggggguacaa

SEQ ID NO: 1080326 - RNA, 16 nt, Homo sapiens
gauggagcgcaccugc

SEQ ID NO: 1080327 - RNA, 22 nt, Homo sapiens
gauucuuauuuuaccuucucau

SEQ ID NO: 1080328 - RNA, 21 nt, Homo sapiens
gauuuaaugaagacccagugu

SEQ ID NO: 1080329 - RNA, 22 nt, Homo sapiens
gcaaagucuaaaguuuacagua

SEQ ID NO: 1080330 - RNA, 18 nt, Homo sapiens
gcaacucuauagacuuuu

SEQ ID NO: 1080331 - RNA, 16 nt, Homo sapiens
gcaagucccugacucu

SEQ ID NO: 1080332 - RNA, 16 nt, Homo sapiens
gcaaugagacuacaac

SEQ ID NO: 1080333 - RNA, 17 nt, Homo sapiens
gcaccuguacucaggag

SEQ ID NO: 1080334 - RNA, 23 nt, Homo sapiens
gcagugacgugcaccuguacuca

SEQ ID NO: 1080335 - RNA, 13 nt, Homo sapiens
gccaggugcagug

SEQ ID NO: 1080336 - RNA, 16 nt, Homo sapiens
gcccagcugcaccugc

SEQ ID NO: 1080337 - RNA, 15 nt, Homo sapiens
gcgccugugcugagg

SEQ ID NO: 1080338 - RNA, 13 nt, Homo sapiens
gcuaccaucucau

SEQ ID NO: 1080339 - RNA, 18 nt, Homo sapiens
gcuacucagaagccugag

SEQ ID NO: 1080340 - RNA, 18 nt, Homo sapiens
gcuauuacuaguacuauu

SEQ ID NO: 1080341 - RNA, 20 nt, Homo sapiens
gcuauuacuaguacuauuac

SEQ ID NO: 1080342 - RNA, 17 nt, Homo sapiens
gcucccaugcucauacc

SEQ ID NO: 1080343 - RNA, 21 nt, Homo sapiens
gcugaggggaggaucacugga

SEQ ID NO: 1080344 - RNA, 13 nt, Homo sapiens
gcuggcugcagug

SEQ ID NO: 1080345 - RNA, 15 nt, Homo sapiens
gcugggacuggccag

SEQ ID NO: 1080346 - RNA, 17 nt, Homo sapiens
ggaagagugauguuuca

SEQ ID NO: 1080347 - RNA, 17 nt, Homo sapiens
ggacaguccugggagaa

SEQ ID NO: 1080348 - RNA, 23 nt, Homo sapiens
ggagaaccucaggcuuccuuggc

SEQ ID NO: 1080349 - RNA, 15 nt, Homo sapiens
ggagagcccagccau

SEQ ID NO: 1080350 - RNA, 13 nt, Homo sapiens
ggagcgcaccugc

SEQ ID NO: 1080351 - RNA, 15 nt, Homo sapiens
ggccacaccaucucc

SEQ ID NO: 1080352 - RNA, 23 nt, Homo sapiens
ggccugccuugaagccacugaag

SEQ ID NO: 1080353 - RNA, 13 nt, Homo sapiens
ggcucuguccuaa

SEQ ID NO: 1080354 - RNA, 19 nt, Homo sapiens
gggaugucugagaucagug

SEQ ID NO: 1080355 - RNA, 16 nt, Homo sapiens
gggcaagucccugacu

SEQ ID NO: 1080356 - RNA, 22 nt, Homo sapiens
gggcaugcuggggcaagucccu

SEQ ID NO: 1080357 - RNA, 16 nt, Homo sapiens
gggccagggcccugca

SEQ ID NO: 1080358 - RNA, 19 nt, Homo sapiens
gggcugugucguagccaag

SEQ ID NO: 1080359 - RNA, 14 nt, Homo sapiens
gggugacaucccag

SEQ ID NO: 1080360 - RNA, 21 nt, Homo sapiens
ggucucuuuccaaagcauuuu

SEQ ID NO: 1080361 - RNA, 22 nt, Homo sapiens
gguucccguguuguaccugacu

SEQ ID NO: 1080362 - RNA, 22 nt, Homo sapiens
guaauuguaaacuaguacuauu

SEQ ID NO: 1080363 - RNA, 17 nt, Homo sapiens
guaccagaacuauuuau

SEQ ID NO: 1080364 - RNA, 19 nt, Homo sapiens
guacuaugacacuguuaau

SEQ ID NO: 1080365 - RNA, 14 nt, Homo sapiens
guagauaacagcuu

SEQ ID NO: 1080366 - RNA, 15 nt, Homo sapiens
guauaugcaugcuga

SEQ ID NO: 1080367 - RNA, 20 nt, Homo sapiens
guaucuaccucacuauucaa

SEQ ID NO: 1080368 - RNA, 11 nt, Homo sapiens
guaugugaaua

SEQ ID NO: 1080369 - RNA, 12 nt, Homo sapiens
gucugucccaaa

SEQ ID NO: 1080370 - RNA, 22 nt, Homo sapiens
gucuuuaacaucuugaacuggu

SEQ ID NO: 1080371 - RNA, 17 nt, Homo sapiens
gugcuguggccugggca

SEQ ID NO: 1080372 - RNA, 14 nt, Homo sapiens
aaaaccccaucucu

SEQ ID NO: 1080373 - RNA, 18 nt, Homo sapiens
aaaaguaaguaccacuca

SEQ ID NO: 1080374 - RNA, 16 nt, Homo sapiens
aaaauaaguauuucca

SEQ ID NO: 1080375 - RNA, 18 nt, Homo sapiens
aaaaucuccaauccacac

SEQ ID NO: 1080376 - RNA, 20 nt, Homo sapiens
aaacauuauucucaaccaga

SEQ ID NO: 1080377 - RNA, 12 nt, Homo sapiens
aaaccaaaaaua

SEQ ID NO: 1080378 - RNA, 13 nt, Homo sapiens
aaaccccaucucu

SEQ ID NO: 1080379 - RNA, 12 nt, Homo sapiens
aaagacugaguc

SEQ ID NO: 1080380 - RNA, 13 nt, Homo sapiens
aaagcaucaccuc

SEQ ID NO: 1080381 - RNA, 14 nt, Homo sapiens
aaauaauaauagua

SEQ ID NO: 1080382 - RNA, 15 nt, Homo sapiens
aaaugaaucuuacuc

SEQ ID NO: 1080383 - RNA, 13 nt, Homo sapiens
aaauuguauagag

SEQ ID NO: 1080384 - RNA, 22 nt, Homo sapiens
aacacuaauaauaguacuauua

SEQ ID NO: 1080385 - RNA, 22 nt, Homo sapiens
aacaugguaaaaccccaucucu

SEQ ID NO: 1080386 - RNA, 13 nt, Homo sapiens
aacauugcugauu

SEQ ID NO: 1080387 - RNA, 12 nt, Homo sapiens
aaccccaucucu

SEQ ID NO: 1080388 - RNA, 17 nt, Homo sapiens
aacuagaaaucugccaa

SEQ ID NO: 1080389 - RNA, 14 nt, Homo sapiens
aacuauuuauuuca

SEQ ID NO: 1080390 - RNA, 16 nt, Homo sapiens
aacucugccagccaca

SEQ ID NO: 1080391 - RNA, 22 nt, Homo sapiens
aacuguuaguauuaacuauuag

SEQ ID NO: 1080392 - RNA, 12 nt, Homo sapiens
aagaauaccaau

SEQ ID NO: 1080393 - RNA, 22 nt, Homo sapiens
aguaagauauugugugugugaa

SEQ ID NO: 1080394 - RNA, 20 nt, Homo sapiens
aguaaguaccacucaggcca

SEQ ID NO: 1080395 - RNA, 21 nt, Homo sapiens
aguaaguaccacucaggccaa

SEQ ID NO: 1080396 - RNA, 14 nt, Homo sapiens
aguacuauugcuau

SEQ ID NO: 1080397 - RNA, 13 nt, Homo sapiens
aguaugugaauau

SEQ ID NO: 1080398 - RNA, 11 nt, Homo sapiens
aguauuuccau

SEQ ID NO: 1080399 - RNA, 23 nt, Homo sapiens
agucccugacucucugugaccug

SEQ ID NO: 1080400 - RNA, 14 nt, Homo sapiens
agucuaaaguuuac

SEQ ID NO: 1080401 - RNA, 21 nt, Homo sapiens
aguggcucacgccuaugaucc

SEQ ID NO: 1080402 - RNA, 19 nt, Homo sapiens
auaaaaaaauuuuaauucc

SEQ ID NO: 1080403 - RNA, 19 nt, Homo sapiens
auaaacacauacauugcca

SEQ ID NO: 1080404 - RNA, 12 nt, Homo sapiens
auacauugccaa

SEQ ID NO: 1080405 - RNA, 23 nt, Homo sapiens
auacuauauugcuguaugguaua

SEQ ID NO: 1080406 - RNA, 23 nt, Homo sapiens
auacuguauugcuguaugguaua

SEQ ID NO: 1080407 - RNA, 15 nt, Homo sapiens
auagaagaaaaucca

SEQ ID NO: 1080408 - RNA, 21 nt, Homo sapiens
auagcucacuguaaccucaaa

SEQ ID NO: 1080409 - RNA, 18 nt, Homo sapiens
auagcuuccagauuacaa

SEQ ID NO: 1080410 - RNA, 18 nt, Homo sapiens
auauaugcucaaccagaa

SEQ ID NO: 1080411 - RNA, 14 nt, Homo sapiens
auauauugcugcug

SEQ ID NO: 1080412 - RNA, 17 nt, Homo sapiens
auaucucaauuaccaau

SEQ ID NO: 1080413 - RNA, 20 nt, Homo sapiens
auauucaaacauuauucuca

SEQ ID NO: 1080414 - RNA, 18 nt, Homo sapiens
auauucaauaaagcugcu

SEQ ID NO: 1080415 - RNA, 16 nt, Homo sapiens
auauuuaagagauuaa

SEQ ID NO: 1080416 - RNA, 22 nt, Homo sapiens
auauuuuagauuacaggauuaa

SEQ ID NO: 1080417 - RNA, 20 nt, Homo sapiens
auccucugcuaccaucucau

SEQ ID NO: 1080418 - RNA, 21 nt, Homo sapiens
aucuccaauccacacauauug

SEQ ID NO: 1080419 - RNA, 13 nt, Homo sapiens
aucucucuacucc

SEQ ID NO: 1080420 - RNA, 19 nt, Homo sapiens
aucucuuaugggauuacau

SEQ ID NO: 1080421 - RNA, 15 nt, Homo sapiens
augaagacccagugu

SEQ ID NO: 1080422 - RNA, 17 nt, Homo sapiens
augaagacccaguguaa

SEQ ID NO: 1080423 - RNA, 22 nt, Homo sapiens
augaucgcgccacuacacucca

SEQ ID NO: 1080424 - RNA, 23 nt, Homo sapiens
auggggauaaaggagaaggcaug

SEQ ID NO: 1080425 - RNA, 21 nt, Homo sapiens
auggguuguuaauacuauauu

SEQ ID NO: 1080426 - RNA, 17 nt, Homo sapiens
augguaugccucugugu

SEQ ID NO: 1080427 - RNA, 17 nt, Homo sapiens
auguaccuccaugagcu

SEQ ID NO: 1080428 - RNA, 21 nt, Homo sapiens
auguaugcugauuuacuacuu

SEQ ID NO: 1080429 - RNA, 23 nt, Homo sapiens
auuacuaguacuauuacuaguac

SEQ ID NO: 1080430 - RNA, 23 nt, Homo sapiens
auuacuguaaacagccuacugaa

SEQ ID NO: 1080431 - RNA, 23 nt, Homo sapiens
auuauaaaaauaauauaugcuca

SEQ ID NO: 1080432 - RNA, 15 nt, Homo sapiens
auuauuguauuacau

SEQ ID NO: 1080433 - RNA, 13 nt, Homo sapiens
auucauaauaugu

SEQ ID NO: 1080434 - RNA, 17 nt, Homo sapiens
auucucagugcucuccu

SEQ ID NO: 1080435 - RNA, 16 nt, Homo sapiens
auuggaauuacuguaa

SEQ ID NO: 1080436 - RNA, 19 nt, Homo sapiens
auuguaaacuaguacuauu

SEQ ID NO: 1080437 - RNA, 22 nt, Homo sapiens
auuguauuuuagcaggguacau

SEQ ID NO: 1080438 - RNA, 12 nt, Homo sapiens
auuuaacuugag

SEQ ID NO: 1080439 - RNA, 22 nt, Homo sapiens
auuuaaugaagacccaguguaa

SEQ ID NO: 1080440 - RNA, 13 nt, Homo sapiens
auuuacuacuuau

SEQ ID NO: 1080441 - RNA, 20 nt, Homo sapiens
auuuacuuaauggguacaau

SEQ ID NO: 1080442 - RNA, 15 nt, Homo sapiens
auuucagcuaguuaa

SEQ ID NO: 1080443 - RNA, 19 nt, Homo sapiens
auuuccuggugauucugau

SEQ ID NO: 1080444 - RNA, 21 nt, Homo sapiens
auuugagagaaucuacuaagu

SEQ ID NO: 1080445 - RNA, 20 nt, Homo sapiens
auuuuagcaggguacauauu

SEQ ID NO: 1080446 - RNA, 15 nt, Homo sapiens
auuuuaugucuauau

SEQ ID NO: 1080447 - RNA, 16 nt, Homo sapiens
caaacauuauucucaa

SEQ ID NO: 1080448 - RNA, 19 nt, Homo sapiens
caaacgggcugcccugcca

SEQ ID NO: 1080449 - RNA, 18 nt, Homo sapiens
caaagccaaacucugcca

SEQ ID NO: 1080450 - RNA, 16 nt, Homo sapiens
caaauucuuuuucaca

SEQ ID NO: 1080451 - RNA, 21 nt, Homo sapiens
caacaugguaaaaccccaucu

SEQ ID NO: 1080452 - RNA, 16 nt, Homo sapiens
caacuauuaagauauc

SEQ ID NO: 1080453 - RNA, 22 nt, Homo sapiens
caacugacuuccaagauccuuu

SEQ ID NO: 1080454 - RNA, 19 nt, Homo sapiens
caauaguauuaacuauuag

SEQ ID NO: 1080455 - RNA, 15 nt, Homo sapiens
cacgauuuugcacaa

SEQ ID NO: 1080456 - RNA, 19 nt, Homo sapiens
cacuaaacagacuauuuaa

SEQ ID NO: 1080457 - RNA, 15 nt, Homo sapiens
cagagccuuguucua

SEQ ID NO: 1080458 - RNA, 17 nt, Homo sapiens
cagcauuuuuauuccca

SEQ ID NO: 1080459 - RNA, 20 nt, Homo sapiens
cagccucccucugaccugca

SEQ ID NO: 1080460 - RNA, 22 nt, Homo sapiens
cagccuggacaccucucaugca

SEQ ID NO: 1080461 - RNA, 15 nt, Homo sapiens
cagcugcaccugcca

SEQ ID NO: 1080462 - RNA, 23 nt, Homo sapiens
cagcugugaacauggacucuucc

SEQ ID NO: 1080463 - RNA, 12 nt, Homo sapiens
caggcaggccac

SEQ ID NO: 1080464 - RNA, 23 nt, Homo sapiens
caguccugggagaaccucaggcu

SEQ ID NO: 1080465 - RNA, 17 nt, Homo sapiens
cagugacgugcaccugu

SEQ ID NO: 1080466 - RNA, 20 nt, Homo sapiens
caguguaaagaauaaaugaa

SEQ ID NO: 1080467 - RNA, 18 nt, Homo sapiens
caguucucugccacccau

SEQ ID NO: 1080468 - RNA, 20 nt, Homo sapiens
cauaguucuuacuacuugcc

SEQ ID NO: 1080469 - RNA, 13 nt, Homo sapiens
cauauuuucacau

SEQ ID NO: 1080470 - RNA, 16 nt, Homo sapiens
caucuaagcuauacug

SEQ ID NO: 1080471 - RNA, 20 nt, Homo sapiens
caucuucuuauuuuccaaau

SEQ ID NO: 1080472 - RNA, 20 nt, Homo sapiens
caugauggagcgcaccugcc

SEQ ID NO: 1080473 - RNA, 14 nt, Homo sapiens
caugcuggggcaag

SEQ ID NO: 1080474 - RNA, 22 nt, Homo sapiens
cauguaucuaccucacuauuca

SEQ ID NO: 1080475 - RNA, 13 nt, Homo sapiens
cauucuucuacuu

SEQ ID NO: 1080476 - RNA, 21 nt, Homo sapiens
ccaaccaguccucaguucucu

SEQ ID NO: 1080477 - RNA, 11 nt, Homo sapiens
ccaacuauuaa

SEQ ID NO: 1080478 - RNA, 12 nt, Homo sapiens
ccaccugccauu

SEQ ID NO: 1080479 - RNA, 16 nt, Homo sapiens
ccacuaggacucugag

SEQ ID NO: 1080480 - RNA, 15 nt, Homo sapiens
ccacucaggccaaca

SEQ ID NO: 1080481 - RNA, 16 nt, Homo sapiens
ccagaacuauuuauuu

SEQ ID NO: 1080482 - RNA, 20 nt, Homo sapiens
ccagagauagggaugucaua

SEQ ID NO: 1080483 - RNA, 16 nt, Homo sapiens
ccagcugcaccugcca

SEQ ID NO: 1080484 - RNA, 18 nt, Homo sapiens
ccagcugcaccugccagc

SEQ ID NO: 1080485 - RNA, 19 nt, Homo sapiens
ccauaggcacuugggaugu

SEQ ID NO: 1080486 - RNA, 19 nt, Homo sapiens
ccaucuaaaacucauacaa

SEQ ID NO: 1080487 - RNA, 21 nt, Homo sapiens
cccaguguaaagaauaaauga

SEQ ID NO: 1080488 - RNA, 23 nt, Homo sapiens
ccuauggguugucaauaguauua

SEQ ID NO: 1080489 - RNA, 23 nt, Homo sapiens
ccucaaacuccuggacucaugca

SEQ ID NO: 1080490 - RNA, 21 nt, Homo sapiens
ccucaguucucugccacccau

SEQ ID NO: 1080491 - RNA, 19 nt, Homo sapiens
ccucugaaauuucccacac

SEQ ID NO: 1080492 - RNA, 18 nt, Homo sapiens
ccucugcuaccaucucau

SEQ ID NO: 1080493 - RNA, 15 nt, Homo sapiens
ccucuguguaucuca

SEQ ID NO: 1080494 - RNA, 12 nt, Homo sapiens
ccugacuuccac

SEQ ID NO: 1080495 - RNA, 15 nt, Homo sapiens
ccugcacgccaccgc

SEQ ID NO: 1080496 - RNA, 13 nt, Homo sapiens
ccugccucaggcu

SEQ ID NO: 1080497 - RNA, 17 nt, Homo sapiens
ccuuagagcuuggacag

SEQ ID NO: 1080498 - RNA, 20 nt, Homo sapiens
ccuucaaguuagcucaggag

SEQ ID NO: 1080499 - RNA, 17 nt, Homo sapiens
ccuucaugcuuacuauu

SEQ ID NO: 1080500 - RNA, 23 nt, Homo sapiens
ccuuuaaaauaauaauaguacua

SEQ ID NO: 1080501 - RNA, 17 nt, Homo sapiens
cgaguuguggaaagccu

SEQ ID NO: 1080502 - RNA, 19 nt, Homo sapiens
cgcccagcugcaccugcca

SEQ ID NO: 1080503 - RNA, 21 nt, Homo sapiens
cgccuaugaucccagcacuuu

SEQ ID NO: 1080504 - RNA, 21 nt, Homo sapiens
cgggaagcgaugaauuuggag

SEQ ID NO: 1080505 - RNA, 23 nt, Homo sapiens
cgggacauccucugcuaccaucu

SEQ ID NO: 1080506 - RNA, 15 nt, Homo sapiens
cggguggaucaccug

SEQ ID NO: 1080507 - RNA, 17 nt, Homo sapiens
cguaagugguaugcaug

SEQ ID NO: 1080508 - RNA, 23 nt, Homo sapiens
cguaagugguaugcaugggaugu

SEQ ID NO: 1080509 - RNA, 20 nt, Homo sapiens
cuaaacagacuauuuaacuu

SEQ ID NO: 1080510 - RNA, 22 nt, Homo sapiens
cuacaaaggagacgggggagca

SEQ ID NO: 1080511 - RNA, 13 nt, Homo sapiens
uaaagcugcugag

SEQ ID NO: 1080512 - RNA, 14 nt, Homo sapiens
uaacacuaauaaua

SEQ ID NO: 1080513 - RNA, 17 nt, Homo sapiens
uaacacuaauaauagua

SEQ ID NO: 1080514 - RNA, 18 nt, Homo sapiens
uaacuagaaaucugccaa

SEQ ID NO: 1080515 - RNA, 19 nt, Homo sapiens
uaagagcauagaacucaaa

SEQ ID NO: 1080516 - RNA, 17 nt, Homo sapiens
uaauacuauauugcugu

SEQ ID NO: 1080517 - RNA, 16 nt, Homo sapiens
uaauagaaaugcauac

SEQ ID NO: 1080518 - RNA, 14 nt, Homo sapiens
uaauagacacugga

SEQ ID NO: 1080519 - RNA, 17 nt, Homo sapiens
uaauauuuuagauuaca

SEQ ID NO: 1080520 - RNA, 19 nt, Homo sapiens
uaauuguaaacuaguacua

SEQ ID NO: 1080521 - RNA, 20 nt, Homo sapiens
uacacuccagccugagcaac

SEQ ID NO: 1080522 - RNA, 15 nt, Homo sapiens
uaccacuaugcaaua

SEQ ID NO: 1080523 - RNA, 13 nt, Homo sapiens
uaccucagccuag

SEQ ID NO: 1080524 - RNA, 13 nt, Homo sapiens
uaccugacuucca

SEQ ID NO: 1080525 - RNA, 24 nt, Homo sapiens
uaccuuggaauuggaauuacugua

SEQ ID NO: 1080526 - RNA, 16 nt, Homo sapiens
uacuaaaaauacagaa

SEQ ID NO: 1080527 - RNA, 15 nt, Homo sapiens
uacuauuauggaauu

SEQ ID NO: 1080528 - RNA, 17 nt, Homo sapiens
uacuugccacacacugu

SEQ ID NO: 1080529 - RNA, 18 nt, Homo sapiens
uacuugccacacacuguu

SEQ ID NO: 1080530 - RNA, 21 nt, Homo sapiens
uaggacuauggguacauucca

SEQ ID NO: 1080531 - RNA, 20 nt, Homo sapiens
uaggagaacugucaugagua

SEQ ID NO: 1080532 - RNA, 14 nt, Homo sapiens
uaguacuauugcua

SEQ ID NO: 1080533 - RNA, 18 nt, Homo sapiens
uauacauaugacauauau

SEQ ID NO: 1080534 - RNA, 17 nt, Homo sapiens
uauagcuuccagauuac

SEQ ID NO: 1080535 - RNA, 17 nt, Homo sapiens
uauauuuccauucaugc

SEQ ID NO: 1080536 - RNA, 12 nt, Homo sapiens
uaucucaaugug

SEQ ID NO: 1080537 - RNA, 16 nt, Homo sapiens
uaugugcuucacauaa

SEQ ID NO: 1080538 - RNA, 18 nt, Homo sapiens
uauuaacuauuaguguua

SEQ ID NO: 1080539 - RNA, 18 nt, Homo sapiens
uauuacuaguacuauuac

SEQ ID NO: 1080540 - RNA, 14 nt, Homo sapiens
uauucucuaagaua

SEQ ID NO: 1080541 - RNA, 17 nt, Homo sapiens
uauucucuaagauauau

SEQ ID NO: 1080542 - RNA, 23 nt, Homo sapiens
uauuuaaaucauuuuaacuucua

SEQ ID NO: 1080543 - RNA, 11 nt, Homo sapiens
uauuuugauca

SEQ ID NO: 1080544 - RNA, 17 nt, Homo sapiens
uauuuuuuuaagcugua

SEQ ID NO: 1080545 - RNA, 18 nt, Homo sapiens
uauuuuuuuaagcuguaa

SEQ ID NO: 1080546 - RNA, 21 nt, Homo sapiens
uauuuuuuuaagcuguaaaaa

SEQ ID NO: 1080547 - RNA, 20 nt, Homo sapiens
ucaaacuccuggacucaugc

SEQ ID NO: 1080548 - RNA, 21 nt, Homo sapiens
ccuaugacuaauucacaaaaa

SEQ ID NO: 1080549 - RNA, 13 nt, Homo sapiens
ccucacuauucaa

SEQ ID NO: 1080550 - RNA, 19 nt, Homo sapiens
ccucaggccaggugcagug

SEQ ID NO: 1080551 - RNA, 17 nt, Homo sapiens
ccucugcuaccaucuca

SEQ ID NO: 1080552 - RNA, 21 nt, Homo sapiens
ccucugcuaccaucucauuaa

SEQ ID NO: 1080553 - RNA, 14 nt, Homo sapiens
ccucugcugccaug

SEQ ID NO: 1080554 - RNA, 21 nt, Homo sapiens
ccucuggacaagucaucugca

SEQ ID NO: 1080555 - RNA, 23 nt, Homo sapiens
ccucuggguuguuaauacuguau

SEQ ID NO: 1080556 - RNA, 14 nt, Homo sapiens
ccucuuauuugcuc

SEQ ID NO: 1080557 - RNA, 20 nt, Homo sapiens
ccugaaaauaacagaauucu

SEQ ID NO: 1080558 - RNA, 19 nt, Homo sapiens
ccugaaacccaguaauucu

SEQ ID NO: 1080559 - RNA, 20 nt, Homo sapiens
ccugaagggugacaucccag

SEQ ID NO: 1080560 - RNA, 19 nt, Homo sapiens
ccugagcaacagagugaga

SEQ ID NO: 1080561 - RNA, 19 nt, Homo sapiens
ccugcaggccaagagcaga

SEQ ID NO: 1080562 - RNA, 23 nt, Homo sapiens
ccuuggaauuggaauuacuguaa

SEQ ID NO: 1080563 - RNA, 21 nt, Homo sapiens
ccuuuuauucauauuuucaca

SEQ ID NO: 1080564 - RNA, 20 nt, Homo sapiens
ccuuuuccaggaguucugaa

SEQ ID NO: 1080565 - RNA, 15 nt, Homo sapiens
cgccuaugaucccag

SEQ ID NO: 1080566 - RNA, 18 nt, Homo sapiens
cuaauaauaguacuauua

SEQ ID NO: 1080567 - RNA, 20 nt, Homo sapiens
cuacacccuuggacuugagg

SEQ ID NO: 1080568 - RNA, 15 nt, Homo sapiens
cuagaaaucugccaa

SEQ ID NO: 1080569 - RNA, 16 nt, Homo sapiens
cuagaaaucugccaau

SEQ ID NO: 1080570 - RNA, 12 nt, Homo sapiens
cuaguacuauua

SEQ ID NO: 1080571 - RNA, 24 nt, Homo sapiens
cuaguacuauuacuaguacuagua

SEQ ID NO: 1080572 - RNA, 13 nt, Homo sapiens
cuauuacuaguac

SEQ ID NO: 1080573 - RNA, 15 nt, Homo sapiens
cuauuacuaguacua

SEQ ID NO: 1080574 - RNA, 16 nt, Homo sapiens
cuauuacuauuacuau

SEQ ID NO: 1080575 - RNA, 14 nt, Homo sapiens
cuauugcuaguacu

SEQ ID NO: 1080576 - RNA, 21 nt, Homo sapiens
cucaaaagaaaaaaaaaagca

SEQ ID NO: 1080577 - RNA, 19 nt, Homo sapiens
cucacacgggguauuuuag

SEQ ID NO: 1080578 - RNA, 21 nt, Homo sapiens
cucacagccguccaacuuaaa

SEQ ID NO: 1080579 - RNA, 18 nt, Homo sapiens
cucacgccuaugauccca

SEQ ID NO: 1080580 - RNA, 14 nt, Homo sapiens
cucagucucaggag

SEQ ID NO: 1080581 - RNA, 15 nt, Homo sapiens
cucugaaauuuccca

SEQ ID NO: 1080582 - RNA, 15 nt, Homo sapiens
cucuuauuugcucac

SEQ ID NO: 1080583 - RNA, 16 nt, Homo sapiens
cugagaucagugccua

SEQ ID NO: 1080584 - RNA, 16 nt, Homo sapiens
cugagaucagugccuc

SEQ ID NO: 1080585 - RNA, 14 nt, Homo sapiens
cugcuaccaucuca

SEQ ID NO: 1080586 - RNA, 15 nt, Homo sapiens
cugcuguguucucac

SEQ ID NO: 1080587 - RNA, 23 nt, Homo sapiens
cuggaaaggcucagucucaggag

SEQ ID NO: 1080588 - RNA, 12 nt, Homo sapiens
cuggacaccucu

SEQ ID NO: 1080589 - RNA, 17 nt, Homo sapiens
agcgagagucugucuca

SEQ ID NO: 1080590 - RNA, 18 nt, Homo sapiens
agcgaugaauuuggagac

SEQ ID NO: 1080591 - RNA, 13 nt, Homo sapiens
agcuacccugaaa

SEQ ID NO: 1080592 - RNA, 19 nt, Homo sapiens
agcuacucagaagccugag

SEQ ID NO: 1080593 - RNA, 16 nt, Homo sapiens
agcuaugaucgcgcca

SEQ ID NO: 1080594 - RNA, 13 nt, Homo sapiens
agcugcaccugcc

SEQ ID NO: 1080595 - RNA, 22 nt, Homo sapiens
aggagggaugcugccugaguca

SEQ ID NO: 1080596 - RNA, 16 nt, Homo sapiens
aggccacaccaucucc

SEQ ID NO: 1080597 - RNA, 20 nt, Homo sapiens
aggccaggugcaguggcuca

SEQ ID NO: 1080598 - RNA, 21 nt, Homo sapiens
aggccggugugggcugugucg

SEQ ID NO: 1080599 - RNA, 16 nt, Homo sapiens
agggagccgagaucac

SEQ ID NO: 1080600 - RNA, 22 nt, Homo sapiens
agggcugccccuguagguugcu

SEQ ID NO: 1080601 - RNA, 17 nt, Homo sapiens
aggggaggaucacugga

SEQ ID NO: 1080602 - RNA, 21 nt, Homo sapiens
aguacuaugacacuguuaaua

SEQ ID NO: 1080603 - RNA, 16 nt, Homo sapiens
aguacuauuacuagua

SEQ ID NO: 1080604 - RNA, 20 nt, Homo sapiens
aguacuauuacuaguacuag

SEQ ID NO: 1080605 - RNA, 20 nt, Homo sapiens
aguacuauugcuaguacuag

SEQ ID NO: 1080606 - RNA, 21 nt, Homo sapiens
aguauuaacuauuaguguuaa

SEQ ID NO: 1080607 - RNA, 14 nt, Homo sapiens
agucagaugcccag

SEQ ID NO: 1080608 - RNA, 15 nt, Homo sapiens
aguccucaguucucu

SEQ ID NO: 1080609 - RNA, 23 nt, Homo sapiens
aguggcucacgccuaugauccca

SEQ ID NO: 1080610 - RNA, 19 nt, Homo sapiens
agugggaggugagaccacc

SEQ ID NO: 1080611 - RNA, 16 nt, Homo sapiens
agugguauauacauau

SEQ ID NO: 1080612 - RNA, 19 nt, Homo sapiens
aguguaaagaauaaaugaa

SEQ ID NO: 1080613 - RNA, 16 nt, Homo sapiens
aguguagccuugcccg

SEQ ID NO: 1080614 - RNA, 21 nt, Homo sapiens
auaaacauugguauauuucca

SEQ ID NO: 1080615 - RNA, 12 nt, Homo sapiens
auaaaugaaucu

SEQ ID NO: 1080616 - RNA, 17 nt, Homo sapiens
auaaaugaaucuuacuc

SEQ ID NO: 1080617 - RNA, 17 nt, Homo sapiens
auaaaugauguacuaca

SEQ ID NO: 1080618 - RNA, 13 nt, Homo sapiens
auaaguauuucca

SEQ ID NO: 1080619 - RNA, 14 nt, Homo sapiens
auaauaguacuauu

SEQ ID NO: 1080620 - RNA, 17 nt, Homo sapiens
auaauuagcuuguuaca

SEQ ID NO: 1080621 - RNA, 14 nt, Homo sapiens
auacauaccacuuu

SEQ ID NO: 1080622 - RNA, 22 nt, Homo sapiens
auagaagaaaauccauucauuc

SEQ ID NO: 1080623 - RNA, 13 nt, Homo sapiens
auaguacuauuaa

SEQ ID NO: 1080624 - RNA, 17 nt, Homo sapiens
auagucccagcuacuca

SEQ ID NO: 1080625 - RNA, 19 nt, Homo sapiens
auauccucucagcucucuu

SEQ ID NO: 1080626 - RNA, 18 nt, Homo sapiens
auauuuccauucaugcca

SEQ ID NO: 1080627 - RNA, 20 nt, Homo sapiens
auauuucccaauacauacca

SEQ ID NO: 1080628 - RNA, 15 nt, Homo sapiens
auauuuucacaugac

SEQ ID NO: 1080629 - RNA, 23 nt, Homo sapiens
auauuuucauucacaacuaugaa

SEQ ID NO: 1080630 - RNA, 18 nt, Homo sapiens
aucaaaaaugccacuuaa

SEQ ID NO: 1080631 - RNA, 21 nt, Homo sapiens
aucacgccacugcacuccagc

SEQ ID NO: 1080632 - RNA, 19 nt, Homo sapiens
auccaaccccccaccugcc

SEQ ID NO: 1080633 - RNA, 22 nt, Homo sapiens
agauaacagcuuaacauuuaca

SEQ ID NO: 1080634 - RNA, 17 nt, Homo sapiens
agaucagccacaccuuu

SEQ ID NO: 1080635 - RNA, 18 nt, Homo sapiens
agcacgauuuugcacaaa

SEQ ID NO: 1080636 - RNA, 18 nt, Homo sapiens
agcagcacgauuuugcac

SEQ ID NO: 1080637 - RNA, 21 nt, Homo sapiens
agccaaacucugccagccaca

SEQ ID NO: 1080638 - RNA, 17 nt, Homo sapiens
agccacaccuuuuccag

SEQ ID NO: 1080639 - RNA, 14 nt, Homo sapiens
agccucugcugcca

SEQ ID NO: 1080640 - RNA, 17 nt, Homo sapiens
agccuggacaccucuca

SEQ ID NO: 1080641 - RNA, 15 nt, Homo sapiens
agcucuggcuuccag

SEQ ID NO: 1080642 - RNA, 14 nt, Homo sapiens
agcuuggacagucu

SEQ ID NO: 1080643 - RNA, 22 nt, Homo sapiens
aggagacgggggagcagcacga

SEQ ID NO: 1080644 - RNA, 20 nt, Homo sapiens
aggcugcagcgagcuaugau

SEQ ID NO: 1080645 - RNA, 19 nt, Homo sapiens
agggaugcugccugaguca

SEQ ID NO: 1080646 - RNA, 15 nt, Homo sapiens
aggugagaccaccuc

SEQ ID NO: 1080647 - RNA, 22 nt, Homo sapiens
aguacuauugcuaguacuagua

SEQ ID NO: 1080648 - RNA, 15 nt, Homo sapiens
aguauuaacuauuag

SEQ ID NO: 1080649 - RNA, 13 nt, Homo sapiens
aguauuauuaaca

SEQ ID NO: 1080650 - RNA, 19 nt, Homo sapiens
aguccucguagccaucucu

SEQ ID NO: 1080651 - RNA, 13 nt, Homo sapiens
agucuaaaguuua

SEQ ID NO: 1080652 - RNA, 12 nt, Homo sapiens
agugugauccca

SEQ ID NO: 1080653 - RNA, 20 nt, Homo sapiens
auaaaauuguaaaauuguau

SEQ ID NO: 1080654 - RNA, 11 nt, Homo sapiens
auaacagcuaa

SEQ ID NO: 1080655 - RNA, 22 nt, Homo sapiens
auaaguauuuccauaacucaua

SEQ ID NO: 1080656 - RNA, 16 nt, Homo sapiens
auaauaguacuauuac

SEQ ID NO: 1080657 - RNA, 20 nt, Homo sapiens
auaauuagcuuguuacaauu

SEQ ID NO: 1080658 - RNA, 22 nt, Homo sapiens
auaccaauauucuuuuguucua

SEQ ID NO: 1080659 - RNA, 20 nt, Homo sapiens
auagacacuggagacuugga

SEQ ID NO: 1080660 - RNA, 15 nt, Homo sapiens
auaguucuuacuacu

SEQ ID NO: 1080661 - RNA, 14 nt, Homo sapiens
auauacauaugaca

SEQ ID NO: 1080662 - RNA, 16 nt, Homo sapiens
auauacauaugacaua

SEQ ID NO: 1080663 - RNA, 18 nt, Homo sapiens
auaucucaaugugcaaua

SEQ ID NO: 1080664 - RNA, 14 nt, Homo sapiens
auauuuccauucau

SEQ ID NO: 1080665 - RNA, 16 nt, Homo sapiens
auauuucccaauacau

SEQ ID NO: 1080666 - RNA, 15 nt, Homo sapiens
aucaccucaggccag

SEQ ID NO: 1080667 - RNA, 17 nt, Homo sapiens
aucauagcucacuguaa

SEQ ID NO: 1080668 - RNA, 17 nt, Homo sapiens
aucuaccucacuauuca

SEQ ID NO: 1080669 - RNA, 19 nt, Homo sapiens
aucucagcauuuuuauucc

SEQ ID NO: 1080670 - RNA, 18 nt, Homo sapiens
aucuuccugccucaggcu

SEQ ID NO: 1080671 - RNA, 18 nt, Homo sapiens
augaagacccaguguaaa

SEQ ID NO: 1080672 - RNA, 20 nt, Homo sapiens
augaauagagaguauguaau

SEQ ID NO: 1080673 - RNA, 13 nt, Homo sapiens
augacuuuuccau

SEQ ID NO: 1080674 - RNA, 21 nt, Homo sapiens
augagaguucuuuauauucaa

SEQ ID NO: 1080675 - RNA, 20 nt, Homo sapiens
augcuggacggcauuccugc

SEQ ID NO: 1080676 - RNA, 22 nt, Homo sapiens
auggacucuucccccacuccuc

SEQ ID NO: 1080677 - RNA, 18 nt, Homo sapiens
auggccagugugauccca

SEQ ID NO: 1080678 - RNA, 20 nt, Homo sapiens
auggccagugugaucccaag

SEQ ID NO: 1080679 - RNA, 18 nt, Homo sapiens
augguaaaaccccaucuc

SEQ ID NO: 1080680 - RNA, 21 nt, Homo sapiens
augucauagaagaaaauccau

SEQ ID NO: 1080681 - RNA, 15 nt, Homo sapiens
augugcuucacauaa

SEQ ID NO: 1080682 - RNA, 20 nt, Homo sapiens
auuaacuauuaguguuaacu

SEQ ID NO: 1080683 - RNA, 13 nt, Homo sapiens
auuaauucacaug

SEQ ID NO: 1080684 - RNA, 22 nt, Homo sapiens
auuacuaguacuaguacuauga

SEQ ID NO: 1080685 - RNA, 21 nt, Homo sapiens
auuauggaauuacucuacugu

SEQ ID NO: 1080686 - RNA, 21 nt, Homo sapiens
auucaauaaagcugcugagaa

SEQ ID NO: 1080687 - RNA, 16 nt, Homo sapiens
auuccuaccauacaau

SEQ ID NO: 1080688 - RNA, 14 nt, Homo sapiens
auucuacccugaaa

SEQ ID NO: 1080689 - RNA, 14 nt, Homo sapiens
auucuucuacuugu

SEQ ID NO: 1080690 - RNA, 14 nt, Homo sapiens
auucuuuuguucua

SEQ ID NO: 1080691 - RNA, 14 nt, Homo sapiens
auugccauucugau

SEQ ID NO: 1080692 - RNA, 12 nt, Homo sapiens
auugcuauuacu

SEQ ID NO: 1080693 - RNA, 19 nt, Homo sapiens
auugguauauuuccauuca

SEQ ID NO: 1080694 - RNA, 14 nt, Homo sapiens
auuguaaacuagua

SEQ ID NO: 1080695 - RNA, 13 nt, Homo sapiens
auuuaacuugagg

SEQ ID NO: 1080696 - RNA, 15 nt, Homo sapiens
auuuccauaacucau

SEQ ID NO: 1080697 - RNA, 19 nt, Homo sapiens
auuugagagaaucuacuaa

SEQ ID NO: 1080698 - RNA, 14 nt, Homo sapiens
auuuguaaguuuau

SEQ ID NO: 1080699 - RNA, 20 nt, Homo sapiens
auuuuaaguaucccaucuaa

SEQ ID NO: 1080700 - RNA, 19 nt, Homo sapiens
auuuuccuuccuacacccu

SEQ ID NO: 1080701 - RNA, 10 nt, Homo sapiens
caaagccaaa

SEQ ID NO: 1080702 - RNA, 20 nt, Homo sapiens
caaauaauauuuuagauuac

SEQ ID NO: 1080703 - RNA, 17 nt, Homo sapiens
caaauucuuuuucacac

SEQ ID NO: 1080704 - RNA, 17 nt, Homo sapiens
caaccccccaccugcca

SEQ ID NO: 1080705 - RNA, 17 nt, Homo sapiens
caaccucagcccugaaa

SEQ ID NO: 1080706 - RNA, 17 nt, Homo sapiens
caacuauuaagauaucu

SEQ ID NO: 1080707 - RNA, 18 nt, Homo sapiens
caauauuuaagagauuaa

SEQ ID NO: 1080708 - RNA, 13 nt, Homo sapiens
caauuuauccaac

SEQ ID NO: 1080709 - RNA, 22 nt, Homo sapiens
cacacugauguagauaacagcu

SEQ ID NO: 1080710 - RNA, 22 nt, Homo sapiens
cacauccaaccccccaccugcc

SEQ ID NO: 1080711 - RNA, 20 nt, Homo sapiens
cacgggguauuuuaggcagg

SEQ ID NO: 1080712 - RNA, 21 nt, Homo sapiens
cacucaggccaacaagccaac

SEQ ID NO: 1080713 - RNA, 20 nt, Homo sapiens
cacuuugggaggcugaggcg

SEQ ID NO: 1080714 - RNA, 21 nt, Homo sapiens
cagacuauuuaacuugagggu

SEQ ID NO: 1080715 - RNA, 22 nt, Homo sapiens
cagccugagcaacagagugaga

SEQ ID NO: 1080716 - RNA, 13 nt, Homo sapiens
cagcugcaccugc

SEQ ID NO: 1080717 - RNA, 13 nt, Homo sapiens
caggagauuacaa

SEQ ID NO: 1080718 - RNA, 21 nt, Homo sapiens
cagugcuguggccugggcaag

SEQ ID NO: 1080719 - RNA, 23 nt, Homo sapiens
cagugugaucccaagugccaguc

SEQ ID NO: 1080720 - RNA, 16 nt, Homo sapiens
caguucaguuccucuu

SEQ ID NO: 1080721 - RNA, 20 nt, Homo sapiens
cauaccucuucuuacuccaa

SEQ ID NO: 1080722 - RNA, 17 nt, Homo sapiens
cauagaagaaaauccau

SEQ ID NO: 1080723 - RNA, 15 nt, Homo sapiens
cauagauauaucuuu

SEQ ID NO: 1080724 - RNA, 13 nt, Homo sapiens
cauauuauuccau

SEQ ID NO: 1080725 - RNA, 21 nt, Homo sapiens
uggucucuuuccaaagcauuu

SEQ ID NO: 1080726 - RNA, 19 nt, Homo sapiens
uguaaaauaaguauuucca

SEQ ID NO: 1080727 - RNA, 20 nt, Homo sapiens
uguaaaauaaguauuuccau

SEQ ID NO: 1080728 - RNA, 18 nt, Homo sapiens
uguaaacuaguacuauua

SEQ ID NO: 1080729 - RNA, 17 nt, Homo sapiens
uguaaagaauaaaugaa

SEQ ID NO: 1080730 - RNA, 19 nt, Homo sapiens
uguaucuaccucacuauuc

SEQ ID NO: 1080731 - RNA, 15 nt, Homo sapiens
ugucccuaagagaug

SEQ ID NO: 1080732 - RNA, 16 nt, Homo sapiens
ugucuaaagagcuuua

SEQ ID NO: 1080733 - RNA, 19 nt, Homo sapiens
uguuaacuguuaguauuaa

SEQ ID NO: 1080734 - RNA, 20 nt, Homo sapiens
uguugauaaauuccacugga

SEQ ID NO: 1080735 - RNA, 23 nt, Homo sapiens
uguuguaaauaaaaguauuuaau

SEQ ID NO: 1080736 - RNA, 21 nt, Homo sapiens
uguuguggguuuuuucacaua

SEQ ID NO: 1080737 - RNA, 20 nt, Homo sapiens
uuaacaucuugaacugguug

SEQ ID NO: 1080738 - RNA, 14 nt, Homo sapiens
uuacuccaccauca

SEQ ID NO: 1080739 - RNA, 16 nt, Homo sapiens
uuagcaggguacauau

SEQ ID NO: 1080740 - RNA, 18 nt, Homo sapiens
uucaaguauuagggguaa

SEQ ID NO: 1080741 - RNA, 18 nt, Homo sapiens
uucaaguuagcucaggag

SEQ ID NO: 1080742 - RNA, 15 nt, Homo sapiens
uucagccugaggcug

SEQ ID NO: 1080743 - RNA, 14 nt, Homo sapiens
uuccagauuacaaa

SEQ ID NO: 1080744 - RNA, 14 nt, Homo sapiens
uucuuuauauucaa

SEQ ID NO: 1080745 - RNA, 15 nt, Homo sapiens
uugaacugguuguga

SEQ ID NO: 1080746 - RNA, 17 nt, Homo sapiens
uuggaaagcaucaccuc

SEQ ID NO: 1080747 - RNA, 13 nt, Homo sapiens
uugguauauuucc

SEQ ID NO: 1080748 - RNA, 22 nt, Homo sapiens
uugguucccguguuguaccuga

SEQ ID NO: 1080749 - RNA, 17 nt, Homo sapiens
uuguaccugacuuccac

SEQ ID NO: 1080750 - RNA, 22 nt, Homo sapiens
uugucaauaguauuaacuauua

SEQ ID NO: 1080751 - RNA, 19 nt, Homo sapiens
uuuuaaguaucccaucuaa

SEQ ID NO: 1080752 - RNA, 14 nt, Homo sapiens
uuuugaguaucucg

SEQ ID NO: 1080753 - RNA, 11 nt, Homo sapiens
uuuuguucuaa

SEQ ID NO: 1080754 - RNA, 17 nt, Homo sapiens
acuuugguacauggcca

SEQ ID NO: 1080755 - RNA, 12 nt, Homo sapiens
agaaaucugcca

SEQ ID NO: 1080756 - RNA, 20 nt, Homo sapiens
agaauaaaugaaucuuacuc

SEQ ID NO: 1080757 - RNA, 14 nt, Homo sapiens
agaaucuacuaagu

SEQ ID NO: 1080758 - RNA, 13 nt, Homo sapiens
agaccaccucuca

SEQ ID NO: 1080759 - RNA, 14 nt, Homo sapiens
agacccaguguaaa

SEQ ID NO: 1080760 - RNA, 21 nt, Homo sapiens
agacccaguguaaagaauaaa

SEQ ID NO: 1080761 - RNA, 13 nt, Homo sapiens
agagaaaacuuau

SEQ ID NO: 1080762 - RNA, 19 nt, Homo sapiens
agagauagggaugucauag

SEQ ID NO: 1080763 - RNA, 20 nt, Homo sapiens
agaggggaaaccaguguagc

SEQ ID NO: 1080764 - RNA, 20 nt, Homo sapiens
agauauuucccaauacauac

SEQ ID NO: 1080765 - RNA, 18 nt, Homo sapiens
agaucacgccacugcacu

SEQ ID NO: 1080766 - RNA, 13 nt, Homo sapiens
agaucagugccua

SEQ ID NO: 1080767 - RNA, 13 nt, Homo sapiens
agaucagugccuc

SEQ ID NO: 1080768 - RNA, 15 nt, Homo sapiens
agaugguaugccucu

SEQ ID NO: 1080769 - RNA, 17 nt, Homo sapiens
agcaucaccucaggcca

SEQ ID NO: 1080770 - RNA, 15 nt, Homo sapiens
agccaaacucugcca

SEQ ID NO: 1080771 - RNA, 14 nt, Homo sapiens
agcccagccauuac

SEQ ID NO: 1080772 - RNA, 16 nt, Homo sapiens
agcgagcuaugaucgc

SEQ ID NO: 1080773 - RNA, 14 nt, Homo sapiens
agcugcaccugcca

SEQ ID NO: 1080774 - RNA, 15 nt, Homo sapiens
agcugcaccugccag

SEQ ID NO: 1080775 - RNA, 15 nt, Homo sapiens
aggaagggcauccuu

SEQ ID NO: 1080776 - RNA, 17 nt, Homo sapiens
aggaccugagucugcua

SEQ ID NO: 1080777 - RNA, 21 nt, Homo sapiens
aggagaacugcuguguucuca

SEQ ID NO: 1080778 - RNA, 12 nt, Homo sapiens
aggagauuacaa

SEQ ID NO: 1080779 - RNA, 14 nt, Homo sapiens
aggagauuacaauu

SEQ ID NO: 1080780 - RNA, 18 nt, Homo sapiens
aggcggguggaucaccug

SEQ ID NO: 1080781 - RNA, 17 nt, Homo sapiens
agggaugcugccugagu

SEQ ID NO: 1080782 - RNA, 21 nt, Homo sapiens
agggguaauauauugcugcug

SEQ ID NO: 1080783 - RNA, 20 nt, Homo sapiens
agguugaggggcuccuggaa

SEQ ID NO: 1080784 - RNA, 15 nt, Homo sapiens
aguaccacucaggcc

SEQ ID NO: 1080785 - RNA, 13 nt, Homo sapiens
aguacuauuaaca

SEQ ID NO: 1080786 - RNA, 13 nt, Homo sapiens
agucccugacucu

SEQ ID NO: 1080787 - RNA, 14 nt, Homo sapiens
agugugaucccaag

SEQ ID NO: 1080788 - RNA, 19 nt, Homo sapiens
aguuguuuucccgagcaaa

SEQ ID NO: 1080789 - RNA, 20 nt, Homo sapiens
aguuguuuucccgagcaaag

SEQ ID NO: 1080790 - RNA, 14 nt, Homo sapiens
auaagaaacacaaa

SEQ ID NO: 1080791 - RNA, 19 nt, Homo sapiens
auaauaguacuauuacuau

SEQ ID NO: 1080792 - RNA, 19 nt, Homo sapiens
auaauuuucuggcacuggu

SEQ ID NO: 1080793 - RNA, 14 nt, Homo sapiens
auacaauauaacac

SEQ ID NO: 1080794 - RNA, 19 nt, Homo sapiens
auagaaaugcauaccagua

SEQ ID NO: 1080795 - RNA, 16 nt, Homo sapiens
auaggcugcauaugag

SEQ ID NO: 1080796 - RNA, 13 nt, Homo sapiens
auaguacuauuac

SEQ ID NO: 1080797 - RNA, 13 nt, Homo sapiens
auauacauaugac

SEQ ID NO: 1080798 - RNA, 19 nt, Homo sapiens
auaugugguuugguaguau

SEQ ID NO: 1080799 - RNA, 13 nt, Homo sapiens
auauuuucacaug

SEQ ID NO: 1080800 - RNA, 20 nt, Homo sapiens
aucagccacaccuuuuccag

SEQ ID NO: 1080801 - RNA, 15 nt, Homo sapiens
aucauuaauucacau

SEQ ID NO: 1080802 - RNA, 15 nt, Homo sapiens
auccuccugccucag

SEQ ID NO: 1080803 - RNA, 16 nt, Homo sapiens
auccugcgagcuccuu

SEQ ID NO: 1080804 - RNA, 15 nt, Homo sapiens
aucugauuaauccau

SEQ ID NO: 1080805 - RNA, 15 nt, Homo sapiens
augaaucuuacuccu

SEQ ID NO: 1080806 - RNA, 16 nt, Homo sapiens
augaaucuuacuccuu

SEQ ID NO: 1080807 - RNA, 16 nt, Homo sapiens
augauaauuuacuuaa

SEQ ID NO: 1080808 - RNA, 13 nt, Homo sapiens
augcaugcugauu

SEQ ID NO: 1080809 - RNA, 17 nt, Homo sapiens
augggauuacauguuau

SEQ ID NO: 1080810 - RNA, 13 nt, Homo sapiens
auggguacauucc

SEQ ID NO: 1080811 - RNA, 20 nt, Homo sapiens
augguccuggggcucugugc

SEQ ID NO: 1080812 - RNA, 21 nt, Homo sapiens
auguaaaauaaguauuuccau

SEQ ID NO: 1080813 - RNA, 15 nt, Homo sapiens
auguaucuaccucac

SEQ ID NO: 1080814 - RNA, 17 nt, Homo sapiens
auuaauccauuuuaaca

SEQ ID NO: 1080815 - RNA, 15 nt, Homo sapiens
uuacuaguacuauua

SEQ ID NO: 1080816 - RNA, 18 nt, Homo sapiens
uuauguaccuccaugagc

SEQ ID NO: 1080817 - RNA, 20 nt, Homo sapiens
uucaauaaagcugcugagaa

SEQ ID NO: 1080818 - RNA, 15 nt, Homo sapiens
uucaaugaauacugg

SEQ ID NO: 1080819 - RNA, 20 nt, Homo sapiens
uucacauaaacacauacauu

SEQ ID NO: 1080820 - RNA, 23 nt, Homo sapiens
uucaguuccucuuugcauggaau

SEQ ID NO: 1080821 - RNA, 16 nt, Homo sapiens
uucccaauacauacca

SEQ ID NO: 1080822 - RNA, 21 nt, Homo sapiens
uuccuacacccuuggacuuga

SEQ ID NO: 1080823 - RNA, 21 nt, Homo sapiens
uucucaucuucuuauuuucca

SEQ ID NO: 1080824 - RNA, 18 nt, Homo sapiens
uucugaaguuuccuauga

SEQ ID NO: 1080825 - RNA, 17 nt, Homo sapiens
uugaggacacaugucca

SEQ ID NO: 1080826 - RNA, 14 nt, Homo sapiens
uugccacacacugu

SEQ ID NO: 1080827 - RNA, 14 nt, Homo sapiens
uugguauauuucca

SEQ ID NO: 1080828 - RNA, 16 nt, Homo sapiens
uuguaccugacuucca

SEQ ID NO: 1080829 - RNA, 15 nt, Homo sapiens
uuguauaaugaacau

SEQ ID NO: 1080830 - RNA, 14 nt, Homo sapiens
uuguuaauacuaua

SEQ ID NO: 1080831 - RNA, 21 nt, Homo sapiens
uuguuaauacuauauugcugu

SEQ ID NO: 1080832 - RNA, 14 nt, Homo sapiens
uuguuaauacugua

SEQ ID NO: 1080833 - RNA, 21 nt, Homo sapiens
uuguuaauacuguauugcugu

SEQ ID NO: 1080834 - RNA, 18 nt, Homo sapiens
uuguuuaacauugcugau

SEQ ID NO: 1080835 - RNA, 13 nt, Homo sapiens
uuuaagcuguaaa

SEQ ID NO: 1080836 - RNA, 22 nt, Homo sapiens
uuuaaugaagacccaguguaaa

SEQ ID NO: 1080837 - RNA, 14 nt, Homo sapiens
uuuaccacuaugca

SEQ ID NO: 1080838 - RNA, 21 nt, Homo sapiens
uuuacguuuuaacacacagac

SEQ ID NO: 1080839 - RNA, 20 nt, Homo sapiens
uuucacauaaacacauacau

SEQ ID NO: 1080840 - RNA, 11 nt, Homo sapiens
uuucauguauu

SEQ ID NO: 1080841 - RNA, 15 nt, Homo sapiens
uuucccaauacauac

SEQ ID NO: 1080842 - RNA, 18 nt, Homo sapiens
uuugaggagcagcuucag

SEQ ID NO: 1080843 - RNA, 14 nt, Homo sapiens
uuuuaagcuguaaa

SEQ ID NO: 1080844 - RNA, 13 nt, Homo sapiens
uuuucacacugau

SEQ ID NO: 1080845 - RNA, 21 nt, Homo sapiens
uuuucccgagcaaagucuaaa

SEQ ID NO: 1080846 - RNA, 20 nt, Homo sapiens
aaaaaaguaaguaccacuca

SEQ ID NO: 1080847 - RNA, 20 nt, Homo sapiens
aaaaauaguguguccaugca

SEQ ID NO: 1080848 - RNA, 16 nt, Homo sapiens
aaaacaauguuuuaaa

SEQ ID NO: 1080849 - RNA, 14 nt, Homo sapiens
aaaaccccaucucu

SEQ ID NO: 1080850 - RNA, 16 nt, Homo sapiens
aaaagcaauacuguuu

SEQ ID NO: 1080851 - RNA, 21 nt, Homo sapiens
aaaagcuuuucuuuccuuuug

SEQ ID NO: 1080852 - RNA, 14 nt, Homo sapiens
aaaaguuaaacuac

SEQ ID NO: 1080853 - RNA, 14 nt, Homo sapiens
aaaauagcacauga

SEQ ID NO: 1080854 - RNA, 13 nt, Homo sapiens
aaaaucaaaugug

SEQ ID NO: 1080855 - RNA, 19 nt, Homo sapiens
aaacacccuccuggcacaa

SEQ ID NO: 1080856 - RNA, 12 nt, Homo sapiens
aaacaggugcua

SEQ ID NO: 1080857 - RNA, 15 nt, Homo sapiens
aaacaggugcuaaca

SEQ ID NO: 1080858 - RNA, 15 nt, Homo sapiens
aaacaucauuggaua

SEQ ID NO: 1080859 - RNA, 20 nt, Homo sapiens
aaacaucuuaguugaugcua

SEQ ID NO: 1080860 - RNA, 23 nt, Homo sapiens
aaacaucuuaguugaugcuacaa

SEQ ID NO: 1080861 - RNA, 11 nt, Homo sapiens
aaacauucucu

SEQ ID NO: 1080862 - RNA, 21 nt, Homo sapiens
aaacccuuccacguguaugca

SEQ ID NO: 1080863 - RNA, 21 nt, Homo sapiens
aaaccugugaaagcugcacuc

SEQ ID NO: 1080864 - RNA, 17 nt, Homo sapiens
aaacuaaggaacccugg

SEQ ID NO: 1080865 - RNA, 16 nt, Homo sapiens
aaacuacuuugaauag

SEQ ID NO: 1080866 - RNA, 23 nt, Homo sapiens
aaacucaugacugagucuggcaa

SEQ ID NO: 1080867 - RNA, 17 nt, Homo sapiens
aaacuccugacuuugug

SEQ ID NO: 1080868 - RNA, 21 nt, Homo sapiens
aaagaagagccuucacaugaa

SEQ ID NO: 1080869 - RNA, 23 nt, Homo sapiens
aaagaaucccacccccacuucau

SEQ ID NO: 1080870 - RNA, 11 nt, Homo sapiens
aaagacaucaa

SEQ ID NO: 1080871 - RNA, 12 nt, Homo sapiens
aaagacaucaau

SEQ ID NO: 1080872 - RNA, 15 nt, Homo sapiens
aaagcacaaucaacu

SEQ ID NO: 1080873 - RNA, 17 nt, Homo sapiens
aaagcagaugagcugug

SEQ ID NO: 1080874 - RNA, 20 nt, Homo sapiens
aaagcagaugagcuguggac

SEQ ID NO: 1080875 - RNA, 16 nt, Homo sapiens
aaagcaucaccucagg

SEQ ID NO: 1080876 - RNA, 14 nt, Homo sapiens
aaagcccuugaacc

SEQ ID NO: 1080877 - RNA, 22 nt, Homo sapiens
aaagcuagaggagauugcucug

SEQ ID NO: 1080878 - RNA, 20 nt, Homo sapiens
aaagcuuuggugccuggaaa

SEQ ID NO: 1080879 - RNA, 16 nt, Homo sapiens
aaaggaaaaacugaug

SEQ ID NO: 1080880 - RNA, 20 nt, Homo sapiens
aaaggauuuuaccaaagcau

SEQ ID NO: 1080881 - RNA, 15 nt, Homo sapiens
aaaggcucagucuca

SEQ ID NO: 1080882 - RNA, 17 nt, Homo sapiens
aaagucagauuuguaua

SEQ ID NO: 1080883 - RNA, 19 nt, Homo sapiens
aaauaugugaaaaugauua

SEQ ID NO: 1080884 - RNA, 17 nt, Homo sapiens
aaauauuugugauuuac

SEQ ID NO: 1080885 - RNA, 18 nt, Homo sapiens
aaaucaauucauugugua

SEQ ID NO: 1080886 - RNA, 16 nt, Homo sapiens
aaauccccuccccaaa

SEQ ID NO: 1080887 - RNA, 20 nt, Homo sapiens
aaaucuaggugauuguucau

SEQ ID NO: 1080888 - RNA, 11 nt, Homo sapiens
aaaugccucau

SEQ ID NO: 1080889 - RNA, 12 nt, Homo sapiens
aaaugccuuagu

SEQ ID NO: 1080890 - RNA, 21 nt, Homo sapiens
aaaugugacucaagacuucca

SEQ ID NO: 1080891 - RNA, 14 nt, Homo sapiens
aaaugugucugcaa

SEQ ID NO: 1080892 - RNA, 14 nt, Homo sapiens
aaauguuggugcaa

SEQ ID NO: 1080893 - RNA, 18 nt, Homo sapiens
aaauuauguuuucaucca

SEQ ID NO: 1080894 - RNA, 23 nt, Homo sapiens
aaauuauguuuucauccauuaaa

SEQ ID NO: 1080895 - RNA, 18 nt, Homo sapiens
aaauuucgagcauaagaa

SEQ ID NO: 1080896 - RNA, 19 nt, Homo sapiens
aaauuucucuacugucuca

SEQ ID NO: 1080897 - RNA, 23 nt, Homo sapiens
aacaaacuacauguaauccauca

SEQ ID NO: 1080898 - RNA, 19 nt, Homo sapiens
aacaaagacuugcuuuaaa

SEQ ID NO: 1080899 - RNA, 21 nt, Homo sapiens
aacaaagagagcucaucauca

SEQ ID NO: 1080900 - RNA, 16 nt, Homo sapiens
aacaagaucauuaucu

SEQ ID NO: 1080901 - RNA, 22 nt, Homo sapiens
aacaagccaacgacaaagccaa

SEQ ID NO: 1080902 - RNA, 19 nt, Homo sapiens
aacacaguguuuccugagu

SEQ ID NO: 1080903 - RNA, 20 nt, Homo sapiens
aacacaguguuuccugagua

SEQ ID NO: 1080904 - RNA, 15 nt, Homo sapiens
aacacucuucuugag

SEQ ID NO: 1080905 - RNA, 14 nt, Homo sapiens
aacagaaaacaauu

SEQ ID NO: 1080906 - RNA, 23 nt, Homo sapiens
aacagacaaagcugggauuucag

SEQ ID NO: 1080907 - RNA, 18 nt, Homo sapiens
aacagggaugcuaucucg

SEQ ID NO: 1080908 - RNA, 16 nt, Homo sapiens
aacagggcacauauuc

SEQ ID NO: 1080909 - RNA, 18 nt, Homo sapiens
aacagggcaccccagcug

SEQ ID NO: 1080910 - RNA, 17 nt, Homo sapiens
aacaugaaaacauugau

SEQ ID NO: 1080911 - RNA, 14 nt, Homo sapiens
aacauggugugugu

SEQ ID NO: 1080912 - RNA, 23 nt, Homo sapiens
aacauguauguggauacagucau

SEQ ID NO: 1080913 - RNA, 15 nt, Homo sapiens
aacauugcaauagaa

SEQ ID NO: 1080914 - RNA, 20 nt, Homo sapiens
aacauuucuggacaguaccu

SEQ ID NO: 1080915 - RNA, 18 nt, Homo sapiens
aacauuuggaagccccau

SEQ ID NO: 1080916 - RNA, 16 nt, Homo sapiens
aacauuuuguuuaugu

SEQ ID NO: 1080917 - RNA, 17 nt, Homo sapiens
aaccauaaaucaauuca

SEQ ID NO: 1080918 - RNA, 23 nt, Homo sapiens
aaccccuuuucaguuugaacucu

SEQ ID NO: 1080919 - RNA, 13 nt, Homo sapiens
aaccgacuuuucu

SEQ ID NO: 1080920 - RNA, 17 nt, Homo sapiens
aaccuccuccuccaguu

SEQ ID NO: 1080921 - RNA, 18 nt, Homo sapiens
aaccuguccauaaaguaa

SEQ ID NO: 1080922 - RNA, 23 nt, Homo sapiens
aacgacaaagccaaacucugcca

SEQ ID NO: 1080923 - RNA, 22 nt, Homo sapiens
aacuaagguacggugagacucu

SEQ ID NO: 1080924 - RNA, 16 nt, Homo sapiens
aacuagaaaucugcca

SEQ ID NO: 1080925 - RNA, 17 nt, Homo sapiens
aacuagaaaucugccaa

SEQ ID NO: 1080926 - RNA, 21 nt, Homo sapiens
aacuagcacuuuauaagccaa

SEQ ID NO: 1080927 - RNA, 14 nt, Homo sapiens
aacuaucuuuuugc

SEQ ID NO: 1080928 - RNA, 15 nt, Homo sapiens
aacuauguaaugcuu

SEQ ID NO: 1080929 - RNA, 15 nt, Homo sapiens
aacucagacauucca

SEQ ID NO: 1080930 - RNA, 22 nt, Homo sapiens
aacucaugacugagucuggcaa

SEQ ID NO: 1080931 - RNA, 15 nt, Homo sapiens
aacucuccacuccau

SEQ ID NO: 1080932 - RNA, 22 nt, Homo sapiens
aacucugcaacugaauacuuga

SEQ ID NO: 1080933 - RNA, 16 nt, Homo sapiens
aacucugccagccaca

SEQ ID NO: 1080934 - RNA, 21 nt, Homo sapiens
aacucugccugagacuuucag

SEQ ID NO: 1080935 - RNA, 21 nt, Homo sapiens
aacucuguugguuuacugugu

SEQ ID NO: 1080936 - RNA, 21 nt, Homo sapiens
aacucuuggccagagcugagu

SEQ ID NO: 1080937 - RNA, 18 nt, Homo sapiens
agggaagguauaucagga

SEQ ID NO: 1080938 - RNA, 22 nt, Homo sapiens
agggaauuccuagcuguaaaua

SEQ ID NO: 1080939 - RNA, 16 nt, Homo sapiens
agggaugacugugauu

SEQ ID NO: 1080940 - RNA, 17 nt, Homo sapiens
agggaugcugccugagu

SEQ ID NO: 1080941 - RNA, 12 nt, Homo sapiens
agggcacaagcu

SEQ ID NO: 1080942 - RNA, 13 nt, Homo sapiens
agggcugccugaa

SEQ ID NO: 1080943 - RNA, 20 nt, Homo sapiens
aggggcaggcacagcacagg

SEQ ID NO: 1080944 - RNA, 16 nt, Homo sapiens
aggggcccgcuugccu

SEQ ID NO: 1080945 - RNA, 21 nt, Homo sapiens
agggguaauauauugcugcug

SEQ ID NO: 1080946 - RNA, 18 nt, Homo sapiens
aggguaugggaagccaua

SEQ ID NO: 1080947 - RNA, 15 nt, Homo sapiens
aggguucagggcaug

SEQ ID NO: 1080948 - RNA, 23 nt, Homo sapiens
agguccuuggagugcugcagcuu

SEQ ID NO: 1080949 - RNA, 13 nt, Homo sapiens
aggucuccuccac

SEQ ID NO: 1080950 - RNA, 21 nt, Homo sapiens
aggucucgcugaugcugggcu

SEQ ID NO: 1080951 - RNA, 22 nt, Homo sapiens
aggucucgcugaugcugggcug

SEQ ID NO: 1080952 - RNA, 20 nt, Homo sapiens
aggucuuuuacauacaguga

SEQ ID NO: 1080953 - RNA, 11 nt, Homo sapiens
aggugcacaga

SEQ ID NO: 1080954 - RNA, 22 nt, Homo sapiens
aggugccgguaccagccugacu

SEQ ID NO: 1080955 - RNA, 20 nt, Homo sapiens
aggugggcgggcagcacagc

SEQ ID NO: 1080956 - RNA, 22 nt, Homo sapiens
aggugucaccuuccuaguucuu

SEQ ID NO: 1080957 - RNA, 19 nt, Homo sapiens
agguuucacuguucaugaa

SEQ ID NO: 1080958 - RNA, 14 nt, Homo sapiens
aguaaaaucaaaug

SEQ ID NO: 1080959 - RNA, 14 nt, Homo sapiens
aguaagacuugauu

SEQ ID NO: 1080960 - RNA, 20 nt, Homo sapiens
aguaaguaccacucaggcca

SEQ ID NO: 1080961 - RNA, 20 nt, Homo sapiens
aguaauuuugugaaagaagg

SEQ ID NO: 1080962 - RNA, 21 nt, Homo sapiens
aguacaauaauaaauccucag

SEQ ID NO: 1080963 - RNA, 12 nt, Homo sapiens
aguacugggaag

SEQ ID NO: 1080964 - RNA, 21 nt, Homo sapiens
aguagagcacuuuucacuuau

SEQ ID NO: 1080965 - RNA, 16 nt, Homo sapiens
aguagcuuuccuccca

SEQ ID NO: 1080966 - RNA, 15 nt, Homo sapiens
agucaacacucuucu

SEQ ID NO: 1080967 - RNA, 17 nt, Homo sapiens
agucagaacucuguguu

SEQ ID NO: 1080968 - RNA, 22 nt, Homo sapiens
agucauugucgcucagcaauag

SEQ ID NO: 1080969 - RNA, 17 nt, Homo sapiens
aguccaaauugucuguc

SEQ ID NO: 1080970 - RNA, 15 nt, Homo sapiens
aguccaaccugccug

SEQ ID NO: 1080971 - RNA, 22 nt, Homo sapiens
aguccacuuuuaaaacuauauu

SEQ ID NO: 1080972 - RNA, 12 nt, Homo sapiens
aguccauuuuaa

SEQ ID NO: 1080973 - RNA, 13 nt, Homo sapiens
agucccugacucu

SEQ ID NO: 1080974 - RNA, 23 nt, Homo sapiens
agucccugacucucugugaccug

SEQ ID NO: 1080975 - RNA, 13 nt, Homo sapiens
agucuaaaguuua

SEQ ID NO: 1080976 - RNA, 14 nt, Homo sapiens
agucucacaugucc

SEQ ID NO: 1080977 - RNA, 17 nt, Homo sapiens
agucuuauuuccucaac

SEQ ID NO: 1080978 - RNA, 19 nt, Homo sapiens
agucuugcauugaauuuag

SEQ ID NO: 1080979 - RNA, 21 nt, Homo sapiens
agugauaucccccagccucaa

SEQ ID NO: 1080980 - RNA, 19 nt, Homo sapiens
agugauuguuaugccuugc

SEQ ID NO: 1080981 - RNA, 12 nt, Homo sapiens
agugcaccacuu

SEQ ID NO: 1080982 - RNA, 16 nt, Homo sapiens
agugcacuguauauag

SEQ ID NO: 1080983 - RNA, 20 nt, Homo sapiens
agugcaguggcgugaucucg

SEQ ID NO: 1080984 - RNA, 18 nt, Homo sapiens
agugccaauauuucugau

SEQ ID NO: 1080985 - RNA, 20 nt, Homo sapiens
agugccaauauuucugauau

SEQ ID NO: 1080986 - RNA, 17 nt, Homo sapiens
agugccucagugcugca

SEQ ID NO: 1080987 - RNA, 15 nt, Homo sapiens
agugcugcagcuuug

SEQ ID NO: 1080988 - RNA, 22 nt, Homo sapiens
aguggcauguggguugugauau

SEQ ID NO: 1080989 - RNA, 23 nt, Homo sapiens
aguggcucacgccuaugauccca

SEQ ID NO: 1080990 - RNA, 19 nt, Homo sapiens
aguguaaccuugcaucuca

SEQ ID NO: 1080991 - RNA, 16 nt, Homo sapiens
aguguagccuugcccg

SEQ ID NO: 1080992 - RNA, 13 nt, Homo sapiens
agugucagcacuc

SEQ ID NO: 1080993 - RNA, 22 nt, Homo sapiens
aguguccuggacccuggccuaa

SEQ ID NO: 1080994 - RNA, 17 nt, Homo sapiens
agugucgaguccagucc

SEQ ID NO: 1080995 - RNA, 12 nt, Homo sapiens
agugugauccca

SEQ ID NO: 1080996 - RNA, 14 nt, Homo sapiens
agugugaucccaag

SEQ ID NO: 1080997 - RNA, 14 nt, Homo sapiens
agugugugcucagc

SEQ ID NO: 1080998 - RNA, 14 nt, Homo sapiens
aguguuuguauacc

SEQ ID NO: 1080999 - RNA, 22 nt, Homo sapiens
aguuagaaaggguucagggcau

SEQ ID NO: 1081000 - RNA, 21 nt, Homo sapiens
aguuccagauuguucugucca

SEQ ID NO: 1081001 - RNA, 14 nt, Homo sapiens
aguucccuccugca

SEQ ID NO: 1081002 - RNA, 15 nt, Homo sapiens
aguuugauaaaaaga

SEQ ID NO: 1081003 - RNA, 20 nt, Homo sapiens
aguuuguuuuagaaccagcc

SEQ ID NO: 1081004 - RNA, 23 nt, Homo sapiens
aguuuuguuuguucacacuccua

SEQ ID NO: 1081005 - RNA, 20 nt, Homo sapiens
auaaaaucuaauuaauucuu

SEQ ID NO: 1081006 - RNA, 15 nt, Homo sapiens
auaaagaaauaauac

SEQ ID NO: 1081007 - RNA, 14 nt, Homo sapiens
auaaagcagaguuu

SEQ ID NO: 1081008 - RNA, 15 nt, Homo sapiens
auaaagcccuugaac

SEQ ID NO: 1081009 - RNA, 17 nt, Homo sapiens
auaaagcccuugaacca

SEQ ID NO: 1081010 - RNA, 19 nt, Homo sapiens
auaaagguuagauaagucc

SEQ ID NO: 1081011 - RNA, 12 nt, Homo sapiens
auaaauauguga

SEQ ID NO: 1081012 - RNA, 14 nt, Homo sapiens
auaaaucaauucau

SEQ ID NO: 1081013 - RNA, 20 nt, Homo sapiens
auaaaugaaguauuucucac

SEQ ID NO: 1081014 - RNA, 20 nt, Homo sapiens
auaagaaacaugaugugaga

SEQ ID NO: 1081015 - RNA, 13 nt, Homo sapiens
auaaggcccagag

SEQ ID NO: 1081016 - RNA, 17 nt, Homo sapiens
auaauaaugaugaugau

SEQ ID NO: 1081017 - RNA, 20 nt, Homo sapiens
auaauaugcaauccuacuuc

SEQ ID NO: 1081018 - RNA, 15 nt, Homo sapiens
auacacuuuauuaau

SEQ ID NO: 1081019 - RNA, 13 nt, Homo sapiens
auacaugcugcua

SEQ ID NO: 1081020 - RNA, 23 nt, Homo sapiens
auaccagcuagaaucacuugacu

SEQ ID NO: 1081021 - RNA, 21 nt, Homo sapiens
auacggagccaugucaugugc

SEQ ID NO: 1081022 - RNA, 23 nt, Homo sapiens
auacgugaaagaugcaagcaccu

SEQ ID NO: 1081023 - RNA, 19 nt, Homo sapiens
auacuacaaauuaguguca

SEQ ID NO: 1081024 - RNA, 19 nt, Homo sapiens
auagggugcaguuuuccag

SEQ ID NO: 1081025 - RNA, 13 nt, Homo sapiens
auaguagcauuuc

SEQ ID NO: 1081026 - RNA, 20 nt, Homo sapiens
auauaaagaaaaucaaugaa

SEQ ID NO: 1081027 - RNA, 18 nt, Homo sapiens
auauaacuuauuugcccu

SEQ ID NO: 1081028 - RNA, 13 nt, Homo sapiens
auauaagccauag

SEQ ID NO: 1081029 - RNA, 14 nt, Homo sapiens
auauauugcugcug

SEQ ID NO: 1081030 - RNA, 16 nt, Homo sapiens
auauccauuguggaaa

SEQ ID NO: 1081031 - RNA, 17 nt, Homo sapiens
auaucuggccacacugg

SEQ ID NO: 1081032 - RNA, 22 nt, Homo sapiens
auaucuggccacacugggcuca

SEQ ID NO: 1081033 - RNA, 14 nt, Homo sapiens
auauguauauacau

SEQ ID NO: 1081034 - RNA, 13 nt, Homo sapiens
auauguaucuuug

SEQ ID NO: 1081035 - RNA, 22 nt, Homo sapiens
auauucccaugguagacuguga

SEQ ID NO: 1081036 - RNA, 17 nt, Homo sapiens
auauugcuaccaaaaac

SEQ ID NO: 1081037 - RNA, 21 nt, Homo sapiens
auauuguggguaacgugagaa

SEQ ID NO: 1081038 - RNA, 21 nt, Homo sapiens
auauuuaauaggauaaauuaa

SEQ ID NO: 1081039 - RNA, 12 nt, Homo sapiens
aucaagagucuc

SEQ ID NO: 1081040 - RNA, 16 nt, Homo sapiens
aucaagagucucucca

SEQ ID NO: 1081041 - RNA, 17 nt, Homo sapiens
aucaagcccuuuacuug

SEQ ID NO: 1081042 - RNA, 22 nt, Homo sapiens
aucaagucugugaaagucuccu

SEQ ID NO: 1081043 - RNA, 15 nt, Homo sapiens
aucaccucaggccag

SEQ ID NO: 1081044 - RNA, 23 nt, Homo sapiens
aucacuagccaugauaacugcaa

SEQ ID NO: 1081045 - RNA, 21 nt, Homo sapiens
aucagccuccgccauuccaag

SEQ ID NO: 1081046 - RNA, 18 nt, Homo sapiens
aucagucuccaacauguu

SEQ ID NO: 1081047 - RNA, 22 nt, Homo sapiens
aucauaaccacccuagcuuuau

SEQ ID NO: 1081048 - RNA, 18 nt, Homo sapiens
aucaugucagccucaugc

SEQ ID NO: 1081049 - RNA, 19 nt, Homo sapiens
auccaaccccccaccugcc

SEQ ID NO: 1081050 - RNA, 14 nt, Homo sapiens
auccaacuccucua

SEQ ID NO: 1081051 - RNA, 22 nt, Homo sapiens
auccaagaccuuacaaccacau

SEQ ID NO: 1081052 - RNA, 15 nt, Homo sapiens
auccacaagccauuu

SEQ ID NO: 1081053 - RNA, 22 nt, Homo sapiens
auccaucacuagccaugauaac

SEQ ID NO: 1081054 - RNA, 20 nt, Homo sapiens
auccaugugcugcuguggca

SEQ ID NO: 1081055 - RNA, 15 nt, Homo sapiens
aucccccagccucaa

SEQ ID NO: 1081056 - RNA, 18 nt, Homo sapiens
auccuacuucuauaucau

SEQ ID NO: 1081057 - RNA, 18 nt, Homo sapiens
auccuccucuccaugcaa

SEQ ID NO: 1081058 - RNA, 16 nt, Homo sapiens
auccuugauaaaugcc

SEQ ID NO: 1081059 - RNA, 16 nt, Homo sapiens
auccuuuauagcuuug

SEQ ID NO: 1081060 - RNA, 22 nt, Homo sapiens
ccacuccuaaucaagagucucu

SEQ ID NO: 1081061 - RNA, 16 nt, Homo sapiens
ccagaaggauauuuac

SEQ ID NO: 1081062 - RNA, 21 nt, Homo sapiens
ccagacugcggagcagccucc

SEQ ID NO: 1081063 - RNA, 19 nt, Homo sapiens
ccagagagacgcugugauu

SEQ ID NO: 1081064 - RNA, 17 nt, Homo sapiens
ccagagcugaguggcag

SEQ ID NO: 1081065 - RNA, 23 nt, Homo sapiens
ccagaggaaagaccaugugguuu

SEQ ID NO: 1081066 - RNA, 21 nt, Homo sapiens
ccagaggcuagucucuucuca

SEQ ID NO: 1081067 - RNA, 20 nt, Homo sapiens
ccagauugccccauugcuca

SEQ ID NO: 1081068 - RNA, 14 nt, Homo sapiens
ccagccacugcagc

SEQ ID NO: 1081069 - RNA, 20 nt, Homo sapiens
ccagccacugcagcacagga

SEQ ID NO: 1081070 - RNA, 16 nt, Homo sapiens
ccagccguauuuuaca

SEQ ID NO: 1081071 - RNA, 22 nt, Homo sapiens
ccagcugaucaugucagccuca

SEQ ID NO: 1081072 - RNA, 17 nt, Homo sapiens
ccagcuguuaccugaga

SEQ ID NO: 1081073 - RNA, 16 nt, Homo sapiens
ccaggaaggacugugc

SEQ ID NO: 1081074 - RNA, 15 nt, Homo sapiens
ccaggcuagagugca

SEQ ID NO: 1081075 - RNA, 13 nt, Homo sapiens
ccaggggagaccc

SEQ ID NO: 1081076 - RNA, 19 nt, Homo sapiens
ccagggugagaacgugccc

SEQ ID NO: 1081077 - RNA, 22 nt, Homo sapiens
ccaggugggcgggcagcacagc

SEQ ID NO: 1081078 - RNA, 20 nt, Homo sapiens
ccaguaaaaucaaaugugca

SEQ ID NO: 1081079 - RNA, 13 nt, Homo sapiens
ccaguacugggaa

SEQ ID NO: 1081080 - RNA, 21 nt, Homo sapiens
ccagucaaguucccuccugca

SEQ ID NO: 1081081 - RNA, 17 nt, Homo sapiens
ccagucccucagccacu

SEQ ID NO: 1081082 - RNA, 20 nt, Homo sapiens
ccaguccuggggagcuucac

SEQ ID NO: 1081083 - RNA, 19 nt, Homo sapiens
ccagugccucagugcugca

SEQ ID NO: 1081084 - RNA, 12 nt, Homo sapiens
ccagugcuccug

SEQ ID NO: 1081085 - RNA, 23 nt, Homo sapiens
ccaguguauuuucuguguuguuc

SEQ ID NO: 1081086 - RNA, 22 nt, Homo sapiens
ccaguuaaguaauaguuugaua

SEQ ID NO: 1081087 - RNA, 16 nt, Homo sapiens
ccauaaaucaauucau

SEQ ID NO: 1081088 - RNA, 21 nt, Homo sapiens
ccauaaaucaauucauugugu

SEQ ID NO: 1081089 - RNA, 20 nt, Homo sapiens
ccauagugcacuagcauuuu

SEQ ID NO: 1081090 - RNA, 18 nt, Homo sapiens
ccauauucuaaauucacu

SEQ ID NO: 1081091 - RNA, 15 nt, Homo sapiens
ccaucuaagcugcag

SEQ ID NO: 1081092 - RNA, 19 nt, Homo sapiens
ccaugauaacugcaauuuu

SEQ ID NO: 1081093 - RNA, 22 nt, Homo sapiens
ccaugggauuuuaucuguggau

SEQ ID NO: 1081094 - RNA, 17 nt, Homo sapiens
ccauguuggucaggcug

SEQ ID NO: 1081095 - RNA, 18 nt, Homo sapiens
ccauuauuuuauuuuaua

SEQ ID NO: 1081096 - RNA, 22 nt, Homo sapiens
ccauuccaagucaacacucuuc

SEQ ID NO: 1081097 - RNA, 14 nt, Homo sapiens
ccauugcaugaauu

SEQ ID NO: 1081098 - RNA, 17 nt, Homo sapiens
ccauuuuacuuccauga

SEQ ID NO: 1081099 - RNA, 16 nt, Homo sapiens
ccauuuuagaaaauca

SEQ ID NO: 1081100 - RNA, 17 nt, Homo sapiens
cccaaguagcugagauu

SEQ ID NO: 1081101 - RNA, 22 nt, Homo sapiens
cccagcaagaugaaacagggca

SEQ ID NO: 1081102 - RNA, 23 nt, Homo sapiens
cccagcaucucagaguccaguca

SEQ ID NO: 1081103 - RNA, 15 nt, Homo sapiens
cccagccacaucauc

SEQ ID NO: 1081104 - RNA, 11 nt, Homo sapiens
cccagcucucg

SEQ ID NO: 1081105 - RNA, 19 nt, Homo sapiens
cccaggagcaaaugcugga

SEQ ID NO: 1081106 - RNA, 21 nt, Homo sapiens
cccaggccacagccagccugu

SEQ ID NO: 1081107 - RNA, 19 nt, Homo sapiens
cccaggcuagagugcagug

SEQ ID NO: 1081108 - RNA, 19 nt, Homo sapiens
cccaggcuggagugcaaug

SEQ ID NO: 1081109 - RNA, 21 nt, Homo sapiens
cccaguaaaaucaaaugugca

SEQ ID NO: 1081110 - RNA, 19 nt, Homo sapiens
cccagugacaacaucgcaa

SEQ ID NO: 1081111 - RNA, 13 nt, Homo sapiens
cccauggccacuu

SEQ ID NO: 1081112 - RNA, 22 nt, Homo sapiens
ccccaccugccauuugcacccu

SEQ ID NO: 1081113 - RNA, 21 nt, Homo sapiens
ccccaccuuugggaucagccu

SEQ ID NO: 1081114 - RNA, 18 nt, Homo sapiens
ccccagaacacagugccu

SEQ ID NO: 1081115 - RNA, 17 nt, Homo sapiens
ccccagcugaccuggua

SEQ ID NO: 1081116 - RNA, 23 nt, Homo sapiens
ccccaguaaaaucaaaugugcau

SEQ ID NO: 1081117 - RNA, 14 nt, Homo sapiens
cccccaaguguccu

SEQ ID NO: 1081118 - RNA, 18 nt, Homo sapiens
cccccaggauucccagag

SEQ ID NO: 1081119 - RNA, 18 nt, Homo sapiens
cccccaggauugugcaau

SEQ ID NO: 1081120 - RNA, 24 nt, Homo sapiens
cccccaguaaaaucaaaugugcau

SEQ ID NO: 1081121 - RNA, 11 nt, Homo sapiens
cccccagugug

SEQ ID NO: 1081122 - RNA, 18 nt, Homo sapiens
ccccgcccaggcuggcca

SEQ ID NO: 1081123 - RNA, 11 nt, Homo sapiens
ccccucagcug

SEQ ID NO: 1081124 - RNA, 14 nt, Homo sapiens
ccccuccugcugca

SEQ ID NO: 1081125 - RNA, 15 nt, Homo sapiens
ccccuggccuuugag

SEQ ID NO: 1081126 - RNA, 21 nt, Homo sapiens
ccccuggccuuugaggcaaag

SEQ ID NO: 1081127 - RNA, 13 nt, Homo sapiens
ccccuguggucac

SEQ ID NO: 1081128 - RNA, 23 nt, Homo sapiens
ccccuuguccucucagagccuca

SEQ ID NO: 1081129 - RNA, 18 nt, Homo sapiens
cccgcaguugugccaaag

SEQ ID NO: 1081130 - RNA, 22 nt, Homo sapiens
cccgccgccuccugcaccgaga

SEQ ID NO: 1081131 - RNA, 14 nt, Homo sapiens
cccuaaagucucag

SEQ ID NO: 1081132 - RNA, 18 nt, Homo sapiens
cccuaaagucucagguga

SEQ ID NO: 1081133 - RNA, 17 nt, Homo sapiens
cccuaagaacuuugaga

SEQ ID NO: 1081134 - RNA, 20 nt, Homo sapiens
cccuacccccaguaaaauca

SEQ ID NO: 1081135 - RNA, 23 nt, Homo sapiens
cccuaccugccuguucuccagau

SEQ ID NO: 1081136 - RNA, 17 nt, Homo sapiens
cccuccccagaguucuu

SEQ ID NO: 1081137 - RNA, 17 nt, Homo sapiens
cccucugcugcuuucca

SEQ ID NO: 1081138 - RNA, 14 nt, Homo sapiens
cccugauccagaca

SEQ ID NO: 1081139 - RNA, 17 nt, Homo sapiens
cccugggccucagccuc

SEQ ID NO: 1081140 - RNA, 21 nt, Homo sapiens
cccuuccacuuugaguaccaa

SEQ ID NO: 1081141 - RNA, 20 nt, Homo sapiens
ccgagagagauggaauaaag

SEQ ID NO: 1081142 - RNA, 20 nt, Homo sapiens
ccggcccagcaagaugaaac

SEQ ID NO: 1081143 - RNA, 21 nt, Homo sapiens
ccgggucugcuucugcauuca

SEQ ID NO: 1081144 - RNA, 14 nt, Homo sapiens
ccuaaagaauccca

SEQ ID NO: 1081145 - RNA, 17 nt, Homo sapiens
ccuaaucaagagucucu

SEQ ID NO: 1081146 - RNA, 21 nt, Homo sapiens
ccuauggcccagccacugcag

SEQ ID NO: 1081147 - RNA, 18 nt, Homo sapiens
ccuauuuuggacguguga

SEQ ID NO: 1081148 - RNA, 22 nt, Homo sapiens
ccucaaaugagaaaaugucuuu

SEQ ID NO: 1081149 - RNA, 15 nt, Homo sapiens
ccucacagcaucucu

SEQ ID NO: 1081150 - RNA, 13 nt, Homo sapiens
ccucacuauucaa

SEQ ID NO: 1081151 - RNA, 14 nt, Homo sapiens
ccucagccacugaa

SEQ ID NO: 1081152 - RNA, 15 nt, Homo sapiens
ccucagguaguacug

SEQ ID NO: 1081153 - RNA, 21 nt, Homo sapiens
ccuccaaacacugggcucuga

SEQ ID NO: 1081154 - RNA, 13 nt, Homo sapiens
ccuccaaaugcca

SEQ ID NO: 1081155 - RNA, 13 nt, Homo sapiens
ccuccagccacuu

SEQ ID NO: 1081156 - RNA, 14 nt, Homo sapiens
ccucccacagugac

SEQ ID NO: 1081157 - RNA, 20 nt, Homo sapiens
ccucccaguuugcuggguuu

SEQ ID NO: 1081158 - RNA, 17 nt, Homo sapiens
ccuccccacaguccuca

SEQ ID NO: 1081159 - RNA, 14 nt, Homo sapiens
ccuccccaccagag

SEQ ID NO: 1081160 - RNA, 15 nt, Homo sapiens
ccucccuggucccuu

SEQ ID NO: 1081161 - RNA, 14 nt, Homo sapiens
ccuccucacacucc

SEQ ID NO: 1081162 - RNA, 17 nt, Homo sapiens
ccuccugaacuggccac

SEQ ID NO: 1081163 - RNA, 16 nt, Homo sapiens
ccuccugcagccugac

SEQ ID NO: 1081164 - RNA, 20 nt, Homo sapiens
ccuccuuuucuuucucucuc

SEQ ID NO: 1081165 - RNA, 13 nt, Homo sapiens
ccucuagucagca

SEQ ID NO: 1081166 - RNA, 17 nt, Homo sapiens
ccucuagucagcacuag

SEQ ID NO: 1081167 - RNA, 23 nt, Homo sapiens
ccucucagagccucagcuucugg

SEQ ID NO: 1081168 - RNA, 14 nt, Homo sapiens
ccucucuugccgac

SEQ ID NO: 1081169 - RNA, 14 nt, Homo sapiens
ccucugcagcacuu

SEQ ID NO: 1081170 - RNA, 14 nt, Homo sapiens
ccucugccugaccc

SEQ ID NO: 1081171 - RNA, 23 nt, Homo sapiens
ccucugcgccucuccacuguuuc

SEQ ID NO: 1081172 - RNA, 13 nt, Homo sapiens
ccucugugcagac

SEQ ID NO: 1081173 - RNA, 18 nt, Homo sapiens
ccucuguugccaggcuag

SEQ ID NO: 1081174 - RNA, 17 nt, Homo sapiens
ccucuuaccuauguccc

SEQ ID NO: 1081175 - RNA, 19 nt, Homo sapiens
ccucuucuuauucaugcuu

SEQ ID NO: 1081176 - RNA, 14 nt, Homo sapiens
ccugaaaaccaucc

SEQ ID NO: 1081177 - RNA, 16 nt, Homo sapiens
ccugaacuggccacuc

SEQ ID NO: 1081178 - RNA, 20 nt, Homo sapiens
ccugaagugucgaguccagu

SEQ ID NO: 1081179 - RNA, 16 nt, Homo sapiens
ccugagauucuuuaag

SEQ ID NO: 1081180 - RNA, 15 nt, Homo sapiens
ccugaggaguguccu

SEQ ID NO: 1081181 - RNA, 17 nt, Homo sapiens
ccugcaaagggaacuga

SEQ ID NO: 1081182 - RNA, 23 nt, Homo sapiens
ccugcaccgagagagauggaaua

SEQ ID NO: 1081183 - RNA, 21 nt, Homo sapiens
gauccuugauaaaugccucau

SEQ ID NO: 1081184 - RNA, 20 nt, Homo sapiens
gaucggagccuccucucuca

SEQ ID NO: 1081185 - RNA, 22 nt, Homo sapiens
gaucuaguucucaaucacugcu

SEQ ID NO: 1081186 - RNA, 22 nt, Homo sapiens
gaugaaaaauaugugcuugaaa

SEQ ID NO: 1081187 - RNA, 15 nt, Homo sapiens
gaugacagugaugcu

SEQ ID NO: 1081188 - RNA, 18 nt, Homo sapiens
gaugacagugaugcugcc

SEQ ID NO: 1081189 - RNA, 16 nt, Homo sapiens
gaugcauggaguguuu

SEQ ID NO: 1081190 - RNA, 22 nt, Homo sapiens
gaugcuaucucgcuagccauau

SEQ ID NO: 1081191 - RNA, 14 nt, Homo sapiens
gaugcugucaggag

SEQ ID NO: 1081192 - RNA, 16 nt, Homo sapiens
gauggaauaaagcccu

SEQ ID NO: 1081193 - RNA, 21 nt, Homo sapiens
gauggaauaaagcccuugaac

SEQ ID NO: 1081194 - RNA, 19 nt, Homo sapiens
gauggagauauuuacauga

SEQ ID NO: 1081195 - RNA, 18 nt, Homo sapiens
gauggagccagcucugca

SEQ ID NO: 1081196 - RNA, 15 nt, Homo sapiens
gauggugacuuccuc

SEQ ID NO: 1081197 - RNA, 21 nt, Homo sapiens
gauguggauggaggugaugaa

SEQ ID NO: 1081198 - RNA, 19 nt, Homo sapiens
gauguuuacagacugugag

SEQ ID NO: 1081199 - RNA, 18 nt, Homo sapiens
gauuacaggcgcacacca

SEQ ID NO: 1081200 - RNA, 12 nt, Homo sapiens
gauucagcaaaa

SEQ ID NO: 1081201 - RNA, 22 nt, Homo sapiens
gauuccauuuuacuuccaugau

SEQ ID NO: 1081202 - RNA, 17 nt, Homo sapiens
gauuccccuggacauau

SEQ ID NO: 1081203 - RNA, 15 nt, Homo sapiens
gauuccugcugccug

SEQ ID NO: 1081204 - RNA, 20 nt, Homo sapiens
gauucuacccuuauugcccc

SEQ ID NO: 1081205 - RNA, 17 nt, Homo sapiens
gauuguucaucaugaca

SEQ ID NO: 1081206 - RNA, 21 nt, Homo sapiens
gauuuguauaaggaaagccaa

SEQ ID NO: 1081207 - RNA, 13 nt, Homo sapiens
gauuuuaccaaag

SEQ ID NO: 1081208 - RNA, 15 nt, Homo sapiens
gauuuuaccaaagca

SEQ ID NO: 1081209 - RNA, 19 nt, Homo sapiens
gauuuuaccaaagcaucaa

SEQ ID NO: 1081210 - RNA, 13 nt, Homo sapiens
gauuuuccuuccu

SEQ ID NO: 1081211 - RNA, 14 nt, Homo sapiens
gcaaaaaucuccca

SEQ ID NO: 1081212 - RNA, 12 nt, Homo sapiens
gcaaaagucauu

SEQ ID NO: 1081213 - RNA, 14 nt, Homo sapiens
gcaaagaucucagc

SEQ ID NO: 1081214 - RNA, 15 nt, Homo sapiens
gcaaaggccagcagc

SEQ ID NO: 1081215 - RNA, 16 nt, Homo sapiens
gcaaaggccagcagca

SEQ ID NO: 1081216 - RNA, 15 nt, Homo sapiens
gcaacuccuguucuu

SEQ ID NO: 1081217 - RNA, 16 nt, Homo sapiens
gcaagacuucacugca

SEQ ID NO: 1081218 - RNA, 14 nt, Homo sapiens
gcaagaugaaacag

SEQ ID NO: 1081219 - RNA, 21 nt, Homo sapiens
gcaagauuucacaucagcuuu

SEQ ID NO: 1081220 - RNA, 14 nt, Homo sapiens
gcaagcgugcugcc

SEQ ID NO: 1081221 - RNA, 16 nt, Homo sapiens
gcaauccuacuucuau

SEQ ID NO: 1081222 - RNA, 17 nt, Homo sapiens
gcaaugcuucugccuca

SEQ ID NO: 1081223 - RNA, 14 nt, Homo sapiens
gcaauuaacucugg

SEQ ID NO: 1081224 - RNA, 17 nt, Homo sapiens
gcaauucuccugccuca

SEQ ID NO: 1081225 - RNA, 18 nt, Homo sapiens
gcaauucuccugccucag

SEQ ID NO: 1081226 - RNA, 16 nt, Homo sapiens
gcaauugagggcuaaa

SEQ ID NO: 1081227 - RNA, 20 nt, Homo sapiens
gcacauaucuccucuugggc

SEQ ID NO: 1081228 - RNA, 10 nt, Homo sapiens
gcaccaaaga

SEQ ID NO: 1081229 - RNA, 18 nt, Homo sapiens
gcaccaagaccccaaagg

SEQ ID NO: 1081230 - RNA, 16 nt, Homo sapiens
gcaccccagcugaccu

SEQ ID NO: 1081231 - RNA, 12 nt, Homo sapiens
gcacccuggauu

SEQ ID NO: 1081232 - RNA, 17 nt, Homo sapiens
gcaccuguacucaggag

SEQ ID NO: 1081233 - RNA, 13 nt, Homo sapiens
gcacuagcauuuu

SEQ ID NO: 1081234 - RNA, 20 nt, Homo sapiens
gcagaagccccaacugugau

SEQ ID NO: 1081235 - RNA, 18 nt, Homo sapiens
gcagaggugagcagagga

SEQ ID NO: 1081236 - RNA, 17 nt, Homo sapiens
gcagccccacacccgcc

SEQ ID NO: 1081237 - RNA, 23 nt, Homo sapiens
gcagcggggcaagcaaaaacaau

SEQ ID NO: 1081238 - RNA, 19 nt, Homo sapiens
gcaggcuuuuguguucucu

SEQ ID NO: 1081239 - RNA, 20 nt, Homo sapiens
gcaggcuuuuguguucucua

SEQ ID NO: 1081240 - RNA, 22 nt, Homo sapiens
gcaggggaccuggagcugccag

SEQ ID NO: 1081241 - RNA, 15 nt, Homo sapiens
gcaggggacugggcc

SEQ ID NO: 1081242 - RNA, 15 nt, Homo sapiens
gcagugauuguuaug

SEQ ID NO: 1081243 - RNA, 14 nt, Homo sapiens
gcaguggcgugauc

SEQ ID NO: 1081244 - RNA, 19 nt, Homo sapiens
gcagugggucccacuuccc

SEQ ID NO: 1081245 - RNA, 16 nt, Homo sapiens
gcaguguaggcuuuac

SEQ ID NO: 1081246 - RNA, 19 nt, Homo sapiens
gcauauauggacaccgacu

SEQ ID NO: 1081247 - RNA, 17 nt, Homo sapiens
gcaucaauacaaccagc

SEQ ID NO: 1081248 - RNA, 21 nt, Homo sapiens
gcaucaauacaaccagcccaa

SEQ ID NO: 1081249 - RNA, 21 nt, Homo sapiens
gcaucucagaguccagucaag

SEQ ID NO: 1081250 - RNA, 17 nt, Homo sapiens
gcaugaaaccacuggaa

SEQ ID NO: 1081251 - RNA, 19 nt, Homo sapiens
gcaugcaggucuccaugaa

SEQ ID NO: 1081252 - RNA, 14 nt, Homo sapiens
gcauggaguguuug

SEQ ID NO: 1081253 - RNA, 13 nt, Homo sapiens
gcauguacuguac

SEQ ID NO: 1081254 - RNA, 13 nt, Homo sapiens
gcauuagcuacuu

SEQ ID NO: 1081255 - RNA, 21 nt, Homo sapiens
gcauuccaccacacauggcua

SEQ ID NO: 1081256 - RNA, 23 nt, Homo sapiens
gcauucucucugcucagugaucu

SEQ ID NO: 1081257 - RNA, 19 nt, Homo sapiens
gcauuuggugagagucaaa

SEQ ID NO: 1081258 - RNA, 18 nt, Homo sapiens
gcauuuucauauugcuac

SEQ ID NO: 1081259 - RNA, 22 nt, Homo sapiens
gccacaaaugugucccagugaa

SEQ ID NO: 1081260 - RNA, 21 nt, Homo sapiens
gccacaucaucuuuaucuccu

SEQ ID NO: 1081261 - RNA, 15 nt, Homo sapiens
gccacgaacacgcau

SEQ ID NO: 1081262 - RNA, 19 nt, Homo sapiens
gccacuccccagugcuccu

SEQ ID NO: 1081263 - RNA, 18 nt, Homo sapiens
gccacugcagcacaggag

SEQ ID NO: 1081264 - RNA, 15 nt, Homo sapiens
gccagagcugagugg

SEQ ID NO: 1081265 - RNA, 23 nt, Homo sapiens
gccaucccuuuuuuuacauuuca

SEQ ID NO: 1081266 - RNA, 18 nt, Homo sapiens
gcccacugccgaugccca

SEQ ID NO: 1081267 - RNA, 20 nt, Homo sapiens
gcccagacucaaggccucca

SEQ ID NO: 1081268 - RNA, 15 nt, Homo sapiens
gcccagcugcaccug

SEQ ID NO: 1081269 - RNA, 16 nt, Homo sapiens
gcccagcugcaccugc

SEQ ID NO: 1081270 - RNA, 15 nt, Homo sapiens
gcccaggcaggccac

SEQ ID NO: 1081271 - RNA, 19 nt, Homo sapiens
gcccaggcuagagugcagu

SEQ ID NO: 1081272 - RNA, 19 nt, Homo sapiens
gcccaggcuggagugcaau

SEQ ID NO: 1081273 - RNA, 17 nt, Homo sapiens
gcccagucgauaucuca

SEQ ID NO: 1081274 - RNA, 20 nt, Homo sapiens
gccccaggccucgucuuuca

SEQ ID NO: 1081275 - RNA, 21 nt, Homo sapiens
gccccccccuugaaucugcag

SEQ ID NO: 1081276 - RNA, 14 nt, Homo sapiens
gcccugagcucucu

SEQ ID NO: 1081277 - RNA, 20 nt, Homo sapiens
gcccugcuuuaucaggggac

SEQ ID NO: 1081278 - RNA, 16 nt, Homo sapiens
gcccuggccagggccu

SEQ ID NO: 1081279 - RNA, 21 nt, Homo sapiens
gccgagaucacgccacugcac

SEQ ID NO: 1081280 - RNA, 22 nt, Homo sapiens
gccggggaaggaggccguccau

SEQ ID NO: 1081281 - RNA, 14 nt, Homo sapiens
gccuaaagaauccc

SEQ ID NO: 1081282 - RNA, 21 nt, Homo sapiens
gccuccucucucaaacugggg

SEQ ID NO: 1081283 - RNA, 14 nt, Homo sapiens
gccucuaacucccu

SEQ ID NO: 1081284 - RNA, 23 nt, Homo sapiens
gccucuagaacacccacuggcca

SEQ ID NO: 1081285 - RNA, 22 nt, Homo sapiens
gccucugccccuggccuuugag

SEQ ID NO: 1081286 - RNA, 12 nt, Homo sapiens
gccugaccucca

SEQ ID NO: 1081287 - RNA, 23 nt, Homo sapiens
gccugaugauggaagggccuucu

SEQ ID NO: 1081288 - RNA, 19 nt, Homo sapiens
gccuggcaagugggugaaa

SEQ ID NO: 1081289 - RNA, 16 nt, Homo sapiens
gccuucuccacaggga

SEQ ID NO: 1081290 - RNA, 22 nt, Homo sapiens
gccuugggccucaucugcuccu

SEQ ID NO: 1081291 - RNA, 14 nt, Homo sapiens
gccuuucacaggac

SEQ ID NO: 1081292 - RNA, 23 nt, Homo sapiens
gcgcugggacggcccaucuuggc

SEQ ID NO: 1081293 - RNA, 23 nt, Homo sapiens
gcgggagugggggcugugccgug

SEQ ID NO: 1081294 - RNA, 19 nt, Homo sapiens
gcgucugccccacccucaa

SEQ ID NO: 1081295 - RNA, 18 nt, Homo sapiens
gcguuuggcccugugacu

SEQ ID NO: 1081296 - RNA, 21 nt, Homo sapiens
gcuaaagaggaagugcacugg

SEQ ID NO: 1081297 - RNA, 19 nt, Homo sapiens
gcuaauugguccaacccag

SEQ ID NO: 1081298 - RNA, 13 nt, Homo sapiens
gcuaccaaaaacu

SEQ ID NO: 1081299 - RNA, 18 nt, Homo sapiens
gcuacucagaagccugag

SEQ ID NO: 1081300 - RNA, 21 nt, Homo sapiens
gcuacucucuugccagcauuu

SEQ ID NO: 1081301 - RNA, 22 nt, Homo sapiens
gcuacucucuugccagcauuuu

SEQ ID NO: 1081302 - RNA, 13 nt, Homo sapiens
gcuagagugcagu

SEQ ID NO: 1081303 - RNA, 18 nt, Homo sapiens
gcuauaugccuuaagcca

SEQ ID NO: 1081304 - RNA, 17 nt, Homo sapiens
gcuaucgcaccacugug

SEQ ID NO: 1081305 - RNA, 22 nt, Homo sapiens
gcuauuuuaauaaagauucuau

SEQ ID NO: 1081306 - RNA, 11 nt, Homo sapiens
uccacuuuuau

SEQ ID NO: 1081307 - RNA, 13 nt, Homo sapiens
uccagcucuaugu

SEQ ID NO: 1081308 - RNA, 18 nt, Homo sapiens
aaaaacuaacacccaguc

SEQ ID NO: 1081309 - RNA, 17 nt, Homo sapiens
aaaaagaaggugccgau

SEQ ID NO: 1081310 - RNA, 16 nt, Homo sapiens
aaaaaggccccugugg

SEQ ID NO: 1081311 - RNA, 11 nt, Homo sapiens
aaaacauuucu

SEQ ID NO: 1081312 - RNA, 14 nt, Homo sapiens
aaaagcaauacugu

SEQ ID NO: 1081313 - RNA, 16 nt, Homo sapiens
aaaagcacaaguacuu

SEQ ID NO: 1081314 - RNA, 15 nt, Homo sapiens
aaaaguaaacaacau

SEQ ID NO: 1081315 - RNA, 18 nt, Homo sapiens
aaaauaguguguccaugc

SEQ ID NO: 1081316 - RNA, 13 nt, Homo sapiens
aaaauauuuuaca

SEQ ID NO: 1081317 - RNA, 14 nt, Homo sapiens
aaaaucaauauuuc

SEQ ID NO: 1081318 - RNA, 22 nt, Homo sapiens
aaaaucacaaggcaacugugag

SEQ ID NO: 1081319 - RNA, 21 nt, Homo sapiens
aaaaucucccagugacaacau

SEQ ID NO: 1081320 - RNA, 15 nt, Homo sapiens
aaaaucuucagcugg

SEQ ID NO: 1081321 - RNA, 16 nt, Homo sapiens
aaaaugagcuuguaaa

SEQ ID NO: 1081322 - RNA, 13 nt, Homo sapiens
aaaaugcuuuaaa

SEQ ID NO: 1081323 - RNA, 13 nt, Homo sapiens
aaaaugucacuga

SEQ ID NO: 1081324 - RNA, 12 nt, Homo sapiens
aaaaugugacuc

SEQ ID NO: 1081325 - RNA, 15 nt, Homo sapiens
aaaauugcacuuuua

SEQ ID NO: 1081326 - RNA, 17 nt, Homo sapiens
aaacaaauggcuguaaa

SEQ ID NO: 1081327 - RNA, 17 nt, Homo sapiens
aaacacucgugugccca

SEQ ID NO: 1081328 - RNA, 14 nt, Homo sapiens
aaacacugggcucu

SEQ ID NO: 1081329 - RNA, 15 nt, Homo sapiens
aaacagggcacccca

SEQ ID NO: 1081330 - RNA, 20 nt, Homo sapiens
aaacagggcaccccagcuga

SEQ ID NO: 1081331 - RNA, 21 nt, Homo sapiens
aaacagggcaccccagcugac

SEQ ID NO: 1081332 - RNA, 22 nt, Homo sapiens
aaacauaugucugucuuugcaa

SEQ ID NO: 1081333 - RNA, 14 nt, Homo sapiens
aaacauuucuggac

SEQ ID NO: 1081334 - RNA, 15 nt, Homo sapiens
aaaccagaaaagcaa

SEQ ID NO: 1081335 - RNA, 23 nt, Homo sapiens
aaacccauuuccagcuccuagua

SEQ ID NO: 1081336 - RNA, 22 nt, Homo sapiens
aaaccccuuuucaguuugaacu

SEQ ID NO: 1081337 - RNA, 15 nt, Homo sapiens
aaguaagacuugauu

SEQ ID NO: 1081338 - RNA, 20 nt, Homo sapiens
aaguaagcagaguucuuugc

SEQ ID NO: 1081339 - RNA, 14 nt, Homo sapiens
aaguaugccuuccu

SEQ ID NO: 1081340 - RNA, 16 nt, Homo sapiens
aagucaugguccuggc

SEQ ID NO: 1081341 - RNA, 23 nt, Homo sapiens
aaguccaaccugccugugcauga

SEQ ID NO: 1081342 - RNA, 16 nt, Homo sapiens
aaguccacaguggaac

SEQ ID NO: 1081343 - RNA, 20 nt, Homo sapiens
aagucccugacucucuguga

SEQ ID NO: 1081344 - RNA, 23 nt, Homo sapiens
aagugcugggauuacagguguga

SEQ ID NO: 1081345 - RNA, 13 nt, Homo sapiens
aaguguccuggac

SEQ ID NO: 1081346 - RNA, 19 nt, Homo sapiens
aagugucucuugacuggcu

SEQ ID NO: 1081347 - RNA, 13 nt, Homo sapiens
aaguugagaacaa

SEQ ID NO: 1081348 - RNA, 17 nt, Homo sapiens
aaguuucuuaaagcaac

SEQ ID NO: 1081349 - RNA, 19 nt, Homo sapiens
aaguuucuuaaagcaacac

SEQ ID NO: 1081350 - RNA, 18 nt, Homo sapiens
aaguuugggaagggaugg

SEQ ID NO: 1081351 - RNA, 22 nt, Homo sapiens
aaguuuuguuuguucacacucc

SEQ ID NO: 1081352 - RNA, 13 nt, Homo sapiens
aauaaagcccuug

SEQ ID NO: 1081353 - RNA, 22 nt, Homo sapiens
aauaaagguuagauaaguccuu

SEQ ID NO: 1081354 - RNA, 11 nt, Homo sapiens
aauaacuaaua

SEQ ID NO: 1081355 - RNA, 16 nt, Homo sapiens
aauaagaaacaugaug

SEQ ID NO: 1081356 - RNA, 17 nt, Homo sapiens
aauaagaaacaugaugu

SEQ ID NO: 1081357 - RNA, 16 nt, Homo sapiens
aauaaggaucuuccca

SEQ ID NO: 1081358 - RNA, 22 nt, Homo sapiens
aauaagguauaaggaucuuuug

SEQ ID NO: 1081359 - RNA, 15 nt, Homo sapiens
aauaauaaauccuca

SEQ ID NO: 1081360 - RNA, 13 nt, Homo sapiens
aauacaaccagcc

SEQ ID NO: 1081361 - RNA, 14 nt, Homo sapiens
aauauaaccauaaa

SEQ ID NO: 1081362 - RNA, 22 nt, Homo sapiens
aauaucugagaaguguauauag

SEQ ID NO: 1081363 - RNA, 19 nt, Homo sapiens
aauaugcaauccuacuucu

SEQ ID NO: 1081364 - RNA, 13 nt, Homo sapiens
aauauuaaacacu

SEQ ID NO: 1081365 - RNA, 16 nt, Homo sapiens
aaucaaauacauacaa

SEQ ID NO: 1081366 - RNA, 14 nt, Homo sapiens
aaucaaaugugcau

SEQ ID NO: 1081367 - RNA, 12 nt, Homo sapiens
aaucaacaguga

SEQ ID NO: 1081368 - RNA, 24 nt, Homo sapiens
aaucaaggcauaaaauacaauuaa

SEQ ID NO: 1081369 - RNA, 20 nt, Homo sapiens
aaucaagucagcaacagagc

SEQ ID NO: 1081370 - RNA, 23 nt, Homo sapiens
aaucaagucugugaaagucuccu

SEQ ID NO: 1081371 - RNA, 21 nt, Homo sapiens
aaucagauucaggagcucagu

SEQ ID NO: 1081372 - RNA, 15 nt, Homo sapiens
aauccacaagccauu

SEQ ID NO: 1081373 - RNA, 15 nt, Homo sapiens
aaucccaagugucuc

SEQ ID NO: 1081374 - RNA, 23 nt, Homo sapiens
aaucccacccccacuucaugccc

SEQ ID NO: 1081375 - RNA, 23 nt, Homo sapiens
aauccucagguaguacugggaau

SEQ ID NO: 1081376 - RNA, 17 nt, Homo sapiens
aauccuuuauagcuuug

SEQ ID NO: 1081377 - RNA, 23 nt, Homo sapiens
aaugagaaacuuugaucucugcu

SEQ ID NO: 1081378 - RNA, 16 nt, Homo sapiens
aaugagcuuguaaaua

SEQ ID NO: 1081379 - RNA, 16 nt, Homo sapiens
aaugaucauaagucua

SEQ ID NO: 1081380 - RNA, 13 nt, Homo sapiens
aaugcagccuuaa

SEQ ID NO: 1081381 - RNA, 15 nt, Homo sapiens
aaugcuucugccuca

SEQ ID NO: 1081382 - RNA, 23 nt, Homo sapiens
aaugcuuuucuaaucugcagugg

SEQ ID NO: 1081383 - RNA, 15 nt, Homo sapiens
aauggacguacuggu

SEQ ID NO: 1081384 - RNA, 20 nt, Homo sapiens
aauggcacgaucucagcuca

SEQ ID NO: 1081385 - RNA, 18 nt, Homo sapiens
aauguagaaagugaucca

SEQ ID NO: 1081386 - RNA, 12 nt, Homo sapiens
aaugugccccau

SEQ ID NO: 1081387 - RNA, 13 nt, Homo sapiens
aauuaaaccagac

SEQ ID NO: 1081388 - RNA, 14 nt, Homo sapiens
aauuaaaguauaca

SEQ ID NO: 1081389 - RNA, 19 nt, Homo sapiens
aauuaacaaagaauuucag

SEQ ID NO: 1081390 - RNA, 22 nt, Homo sapiens
aauuauguuuucauccauuaaa

SEQ ID NO: 1081391 - RNA, 13 nt, Homo sapiens
aauucacucccac

SEQ ID NO: 1081392 - RNA, 19 nt, Homo sapiens
aauucuccugccucagccu

SEQ ID NO: 1081393 - RNA, 21 nt, Homo sapiens
aauugaugugcuauauacuua

SEQ ID NO: 1081394 - RNA, 13 nt, Homo sapiens
aauuggucauucc

SEQ ID NO: 1081395 - RNA, 20 nt, Homo sapiens
aauuguuaugaucuacucau

SEQ ID NO: 1081396 - RNA, 12 nt, Homo sapiens
aauuguuugacc

SEQ ID NO: 1081397 - RNA, 18 nt, Homo sapiens
aauuuggagacucugugg

SEQ ID NO: 1081398 - RNA, 23 nt, Homo sapiens
aauuuuguaaaaagaaauuguga

SEQ ID NO: 1081399 - RNA, 16 nt, Homo sapiens
aauuuugucuuuauga

SEQ ID NO: 1081400 - RNA, 17 nt, Homo sapiens
aauuuuuuaacauauug

SEQ ID NO: 1081401 - RNA, 21 nt, Homo sapiens
aauuuuuuuccagaauugaga

SEQ ID NO: 1081402 - RNA, 21 nt, Homo sapiens
acaaaaauguaaugaucauaa

SEQ ID NO: 1081403 - RNA, 21 nt, Homo sapiens
cacacccccaagccacaggga

SEQ ID NO: 1081404 - RNA, 20 nt, Homo sapiens
cacacccgccgccuccugca

SEQ ID NO: 1081405 - RNA, 20 nt, Homo sapiens
cacaccucacgcucuggaca

SEQ ID NO: 1081406 - RNA, 15 nt, Homo sapiens
cacaccugggcauuu

SEQ ID NO: 1081407 - RNA, 22 nt, Homo sapiens
cacaccugggcauuuggugaga

SEQ ID NO: 1081408 - RNA, 22 nt, Homo sapiens
cacacugcggugucugcagcuc

SEQ ID NO: 1081409 - RNA, 21 nt, Homo sapiens
cacacugggcucacauuccca

SEQ ID NO: 1081410 - RNA, 21 nt, Homo sapiens
cacagaaaggccacucaggau

SEQ ID NO: 1081411 - RNA, 16 nt, Homo sapiens
cacagcuuccugaguc

SEQ ID NO: 1081412 - RNA, 14 nt, Homo sapiens
cacaggacucugca

SEQ ID NO: 1081413 - RNA, 24 nt, Homo sapiens
cacaguguuuccugaguagcagug

SEQ ID NO: 1081414 - RNA, 15 nt, Homo sapiens
cacauuuucaaguga

SEQ ID NO: 1081415 - RNA, 15 nt, Homo sapiens
caccaaagacaucag

SEQ ID NO: 1081416 - RNA, 15 nt, Homo sapiens
caccaccagcuuaaa

SEQ ID NO: 1081417 - RNA, 17 nt, Homo sapiens
caccaugcccggccuaa

SEQ ID NO: 1081418 - RNA, 14 nt, Homo sapiens
cacccacaacaucu

SEQ ID NO: 1081419 - RNA, 19 nt, Homo sapiens
caccccagcugaccuggua

SEQ ID NO: 1081420 - RNA, 18 nt, Homo sapiens
cacccgccgccuccugca

SEQ ID NO: 1081421 - RNA, 23 nt, Homo sapiens
caccgguguccuguuccugccac

SEQ ID NO: 1081422 - RNA, 18 nt, Homo sapiens
caccuaauaaagaaauaa

SEQ ID NO: 1081423 - RNA, 19 nt, Homo sapiens
caccuaguggcuguccagu

SEQ ID NO: 1081424 - RNA, 22 nt, Homo sapiens
caccucacgcucuggacaugau

SEQ ID NO: 1081425 - RNA, 14 nt, Homo sapiens
caccucaugucauu

SEQ ID NO: 1081426 - RNA, 21 nt, Homo sapiens
caccugaauuucuguuugaau

SEQ ID NO: 1081427 - RNA, 17 nt, Homo sapiens
caccuguguacugagua

SEQ ID NO: 1081428 - RNA, 16 nt, Homo sapiens
caccuugucaaccucu

SEQ ID NO: 1081429 - RNA, 17 nt, Homo sapiens
cacgacucuuccugcaa

SEQ ID NO: 1081430 - RNA, 23 nt, Homo sapiens
cacgucugugcucuguccuugug

SEQ ID NO: 1081431 - RNA, 21 nt, Homo sapiens
cacgugaccagccccguguag

SEQ ID NO: 1081432 - RNA, 12 nt, Homo sapiens
cacguguaugca

SEQ ID NO: 1081433 - RNA, 12 nt, Homo sapiens
cacuagcauuuu

SEQ ID NO: 1081434 - RNA, 16 nt, Homo sapiens
cacucaggauguccuu

SEQ ID NO: 1081435 - RNA, 18 nt, Homo sapiens
cacuccccagugcuccug

SEQ ID NO: 1081436 - RNA, 19 nt, Homo sapiens
cacuccucgguacucccau

SEQ ID NO: 1081437 - RNA, 19 nt, Homo sapiens
cacugagacuagauucuca

SEQ ID NO: 1081438 - RNA, 22 nt, Homo sapiens
cacugagacuugaaucaaguca

SEQ ID NO: 1081439 - RNA, 16 nt, Homo sapiens
cacugcaaaguuuucu

SEQ ID NO: 1081440 - RNA, 17 nt, Homo sapiens
cacugccgaugcccaau

SEQ ID NO: 1081441 - RNA, 18 nt, Homo sapiens
cacugccgaugcccaauc

SEQ ID NO: 1081442 - RNA, 20 nt, Homo sapiens
cacugcggugucugcagcuc

SEQ ID NO: 1081443 - RNA, 13 nt, Homo sapiens
cacuggcaucucc

SEQ ID NO: 1081444 - RNA, 17 nt, Homo sapiens
cacuggcccucuuugaa

SEQ ID NO: 1081445 - RNA, 23 nt, Homo sapiens
cacugggcucugaggaguggagu

SEQ ID NO: 1081446 - RNA, 16 nt, Homo sapiens
cacuucacuaccaaau

SEQ ID NO: 1081447 - RNA, 15 nt, Homo sapiens
cacuugacuuugcca

SEQ ID NO: 1081448 - RNA, 16 nt, Homo sapiens
cacuugacuuugccac

SEQ ID NO: 1081449 - RNA, 20 nt, Homo sapiens
cacuuugggaggcugaggcg

SEQ ID NO: 1081450 - RNA, 23 nt, Homo sapiens
cagaaauacaacagaaguuauau

SEQ ID NO: 1081451 - RNA, 11 nt, Homo sapiens
cagaaaugcaa

SEQ ID NO: 1081452 - RNA, 15 nt, Homo sapiens
ccaaagugcugggau

SEQ ID NO: 1081453 - RNA, 14 nt, Homo sapiens
ccaaauacauucca

SEQ ID NO: 1081454 - RNA, 16 nt, Homo sapiens
ccaaauccacaagcca

SEQ ID NO: 1081455 - RNA, 18 nt, Homo sapiens
ccaaauccacaagccauu

SEQ ID NO: 1081456 - RNA, 13 nt, Homo sapiens
ccaaaucucagua

SEQ ID NO: 1081457 - RNA, 22 nt, Homo sapiens
ccaaaugcugugcaaacagugu

SEQ ID NO: 1081458 - RNA, 20 nt, Homo sapiens
ccaaauucaaagaaaacccu

SEQ ID NO: 1081459 - RNA, 23 nt, Homo sapiens
ccaaauugucugucugcucuuau

SEQ ID NO: 1081460 - RNA, 17 nt, Homo sapiens
ccaaccccccaccugcc

SEQ ID NO: 1081461 - RNA, 22 nt, Homo sapiens
ccaaccccucccccacgucucu

SEQ ID NO: 1081462 - RNA, 15 nt, Homo sapiens
ccaaggcaguucugu

SEQ ID NO: 1081463 - RNA, 21 nt, Homo sapiens
ccaaggguaugggaagccaua

SEQ ID NO: 1081464 - RNA, 16 nt, Homo sapiens
ccaagugaaugaguuu

SEQ ID NO: 1081465 - RNA, 23 nt, Homo sapiens
ccaagugaaugaguuuccagcua

SEQ ID NO: 1081466 - RNA, 15 nt, Homo sapiens
ccaaguguccuggac

SEQ ID NO: 1081467 - RNA, 16 nt, Homo sapiens
ccaagugucucuugac

SEQ ID NO: 1081468 - RNA, 14 nt, Homo sapiens
ccaauaaaacuuua

SEQ ID NO: 1081469 - RNA, 13 nt, Homo sapiens
ccacaaaugccac

SEQ ID NO: 1081470 - RNA, 21 nt, Homo sapiens
ccacagaaaggccacucagga

SEQ ID NO: 1081471 - RNA, 17 nt, Homo sapiens
ccacagacaacauggaa

SEQ ID NO: 1081472 - RNA, 16 nt, Homo sapiens
ccacauaugcaaugac

SEQ ID NO: 1081473 - RNA, 14 nt, Homo sapiens
ccacccuagcuuua

SEQ ID NO: 1081474 - RNA, 14 nt, Homo sapiens
ccaccgcaugcccc

SEQ ID NO: 1081475 - RNA, 12 nt, Homo sapiens
ccaccugccauu

SEQ ID NO: 1081476 - RNA, 20 nt, Homo sapiens
ccacggaccguugcacaaaa

SEQ ID NO: 1081477 - RNA, 12 nt, Homo sapiens
ccacgugcacag

SEQ ID NO: 1081478 - RNA, 15 nt, Homo sapiens
ccacucaggccaaca

SEQ ID NO: 1081479 - RNA, 15 nt, Homo sapiens
ccacucuuugcuaca

SEQ ID NO: 1081480 - RNA, 15 nt, Homo sapiens
ccagaagugaauuau

SEQ ID NO: 1081481 - RNA, 16 nt, Homo sapiens
ccagaaugugcugccu

SEQ ID NO: 1081482 - RNA, 18 nt, Homo sapiens
ccagaccauugucuucca

SEQ ID NO: 1081483 - RNA, 12 nt, Homo sapiens
ccagaggcaccu

SEQ ID NO: 1081484 - RNA, 20 nt, Homo sapiens
ccagauguuuacagacugug

SEQ ID NO: 1081485 - RNA, 16 nt, Homo sapiens
ccagcccuguccccua

SEQ ID NO: 1081486 - RNA, 17 nt, Homo sapiens
ccagccguauuuuacau

SEQ ID NO: 1081487 - RNA, 15 nt, Homo sapiens
ccagccugagugcac

SEQ ID NO: 1081488 - RNA, 19 nt, Homo sapiens
ccagcuccuaguagcuuuc

SEQ ID NO: 1081489 - RNA, 18 nt, Homo sapiens
ccagcugcaccugccagc

SEQ ID NO: 1081490 - RNA, 20 nt, Homo sapiens
ccagcuucccucugccugac

SEQ ID NO: 1081491 - RNA, 16 nt, Homo sapiens
ccaggaauaggcauuu

SEQ ID NO: 1081492 - RNA, 19 nt, Homo sapiens
ccaggagacuuuuucagaa

SEQ ID NO: 1081493 - RNA, 19 nt, Homo sapiens
ccaggagcaaaugcuggau

SEQ ID NO: 1081494 - RNA, 17 nt, Homo sapiens
ccaggccucgucuuuca

SEQ ID NO: 1081495 - RNA, 14 nt, Homo sapiens
ccaggcuagaggca

SEQ ID NO: 1081496 - RNA, 18 nt, Homo sapiens
ccaggcuagagugcagug

SEQ ID NO: 1081497 - RNA, 17 nt, Homo sapiens
ccaggcuggaguacagu

SEQ ID NO: 1081498 - RNA, 15 nt, Homo sapiens
ccaggcuggagugca

SEQ ID NO: 1081499 - RNA, 19 nt, Homo sapiens
ccagggccucugugcagac

SEQ ID NO: 1081500 - RNA, 20 nt, Homo sapiens
ccagguggggugaggcagug

SEQ ID NO: 1081501 - RNA, 19 nt, Homo sapiens
ccaguaaaaucaaaugugc

SEQ ID NO: 1081502 - RNA, 22 nt, Homo sapiens
ccaguaaaaucaaaugugcauc

SEQ ID NO: 1081503 - RNA, 14 nt, Homo sapiens
ccagugacaacauc

SEQ ID NO: 1081504 - RNA, 18 nt, Homo sapiens
ccaguguaacauguuuua

SEQ ID NO: 1081505 - RNA, 14 nt, Homo sapiens
ccaguuuuucacau

SEQ ID NO: 1081506 - RNA, 22 nt, Homo sapiens
ccaguuuuucacauuaucuuug

SEQ ID NO: 1081507 - RNA, 12 nt, Homo sapiens
ccauauucacac

SEQ ID NO: 1081508 - RNA, 15 nt, Homo sapiens
ccauauucacaccuc

SEQ ID NO: 1081509 - RNA, 15 nt, Homo sapiens
ccaucucauucaggu

SEQ ID NO: 1081510 - RNA, 17 nt, Homo sapiens
ccaucuccuuucaggga

SEQ ID NO: 1081511 - RNA, 22 nt, Homo sapiens
ccaugaaacuuuagagauuaac

SEQ ID NO: 1081512 - RNA, 22 nt, Homo sapiens
ccaugaaaggggaaauacuuag

SEQ ID NO: 1081513 - RNA, 15 nt, Homo sapiens
ccaugauacuuuaau

SEQ ID NO: 1081514 - RNA, 19 nt, Homo sapiens
ccauguuucauuaaucaag

SEQ ID NO: 1081515 - RNA, 15 nt, Homo sapiens
ccauuucuacuguau

SEQ ID NO: 1081516 - RNA, 10 nt, Homo sapiens
ccauuugcca

SEQ ID NO: 1081517 - RNA, 18 nt, Homo sapiens
ccauuuuacuuccaugau

SEQ ID NO: 1081518 - RNA, 18 nt, Homo sapiens
ccauuuuucuagacuguc

SEQ ID NO: 1081519 - RNA, 14 nt, Homo sapiens
cccaaaggcaucca

SEQ ID NO: 1081520 - RNA, 16 nt, Homo sapiens
cccaaauucaaagaaa

SEQ ID NO: 1081521 - RNA, 15 nt, Homo sapiens
cccaacgugaugcua

SEQ ID NO: 1081522 - RNA, 13 nt, Homo sapiens
cccacaguccuca

SEQ ID NO: 1081523 - RNA, 14 nt, Homo sapiens
cccacuggccaguc

SEQ ID NO: 1081524 - RNA, 13 nt, Homo sapiens
cccacuuugccac

SEQ ID NO: 1081525 - RNA, 10 nt, Homo sapiens
cccagaacac

SEQ ID NO: 1081526 - RNA, 16 nt, Homo sapiens
cccagaauuugcugca

SEQ ID NO: 1081527 - RNA, 16 nt, Homo sapiens
cccagccugagugcac

SEQ ID NO: 1081528 - RNA, 19 nt, Homo sapiens
cccagccuggccaccagcu

SEQ ID NO: 1081529 - RNA, 16 nt, Homo sapiens
cccagcgcuggcucca

SEQ ID NO: 1081530 - RNA, 16 nt, Homo sapiens
cuguagauaaaguggu

SEQ ID NO: 1081531 - RNA, 17 nt, Homo sapiens
cuguauauagcucuaca

SEQ ID NO: 1081532 - RNA, 21 nt, Homo sapiens
cugucaacacuucucacaucu

SEQ ID NO: 1081533 - RNA, 13 nt, Homo sapiens
cugucaugcuuuu

SEQ ID NO: 1081534 - RNA, 17 nt, Homo sapiens
cuguccaccaccaccug

SEQ ID NO: 1081535 - RNA, 15 nt, Homo sapiens
cuguccagugcccau

SEQ ID NO: 1081536 - RNA, 15 nt, Homo sapiens
cuguccaguuuccaa

SEQ ID NO: 1081537 - RNA, 15 nt, Homo sapiens
cuguccccuaccccc

SEQ ID NO: 1081538 - RNA, 19 nt, Homo sapiens
cuguccugcuccacagugu

SEQ ID NO: 1081539 - RNA, 23 nt, Homo sapiens
cugucuucucucccacgugcaca

SEQ ID NO: 1081540 - RNA, 21 nt, Homo sapiens
cugugauuucuuucuuugcac

SEQ ID NO: 1081541 - RNA, 17 nt, Homo sapiens
cugugcagacaguguca

SEQ ID NO: 1081542 - RNA, 15 nt, Homo sapiens
cugugcaugaccuga

SEQ ID NO: 1081543 - RNA, 16 nt, Homo sapiens
cuguggggccugaugg

SEQ ID NO: 1081544 - RNA, 20 nt, Homo sapiens
cugugggggaagagcacagc

SEQ ID NO: 1081545 - RNA, 14 nt, Homo sapiens
cuguguucugcaca

SEQ ID NO: 1081546 - RNA, 12 nt, Homo sapiens
cuguuaccaaau

SEQ ID NO: 1081547 - RNA, 15 nt, Homo sapiens
cuguuaucugcuaga

SEQ ID NO: 1081548 - RNA, 19 nt, Homo sapiens
cuguuaucugcuagaucua

SEQ ID NO: 1081549 - RNA, 15 nt, Homo sapiens
cuguuccugccacau

SEQ ID NO: 1081550 - RNA, 17 nt, Homo sapiens
cuguucuagagugacag

SEQ ID NO: 1081551 - RNA, 18 nt, Homo sapiens
cuguucugccuuccgcag

SEQ ID NO: 1081552 - RNA, 14 nt, Homo sapiens
cuguugcuguuggc

SEQ ID NO: 1081553 - RNA, 22 nt, Homo sapiens
cuguuggcaucuugcugcuaau

SEQ ID NO: 1081554 - RNA, 12 nt, Homo sapiens
cuguuucaugag

SEQ ID NO: 1081555 - RNA, 23 nt, Homo sapiens
cuguuuugugcuucuccuaacuc

SEQ ID NO: 1081556 - RNA, 18 nt, Homo sapiens
cuuaaccguggacucuuc

SEQ ID NO: 1081557 - RNA, 16 nt, Homo sapiens
cuuaaguuuaccaaau

SEQ ID NO: 1081558 - RNA, 16 nt, Homo sapiens
cuuaauucacucccac

SEQ ID NO: 1081559 - RNA, 15 nt, Homo sapiens
cuuaccauugugauu

SEQ ID NO: 1081560 - RNA, 14 nt, Homo sapiens
cuuauccagucaaa

SEQ ID NO: 1081561 - RNA, 19 nt, Homo sapiens
cuuauuuguauaauggugu

SEQ ID NO: 1081562 - RNA, 19 nt, Homo sapiens
cuucaaguuagcucaggag

SEQ ID NO: 1081563 - RNA, 17 nt, Homo sapiens
cuucacuuaaaaucaaa

SEQ ID NO: 1081564 - RNA, 17 nt, Homo sapiens
cuucagaauuguuuuua

SEQ ID NO: 1081565 - RNA, 16 nt, Homo sapiens
cuucagccaaacacaa

SEQ ID NO: 1081566 - RNA, 16 nt, Homo sapiens
cuucaguuguuuuccc

SEQ ID NO: 1081567 - RNA, 19 nt, Homo sapiens
cuuccacuuugaguaccaa

SEQ ID NO: 1081568 - RNA, 13 nt, Homo sapiens
cuuccaugauacu

SEQ ID NO: 1081569 - RNA, 17 nt, Homo sapiens
cuuccaugauacuuuaa

SEQ ID NO: 1081570 - RNA, 18 nt, Homo sapiens
cuucccaaguagcugaga

SEQ ID NO: 1081571 - RNA, 22 nt, Homo sapiens
cuuccugcaaagggaacugaag

SEQ ID NO: 1081572 - RNA, 19 nt, Homo sapiens
cuucuaccuuaaaauguaa

SEQ ID NO: 1081573 - RNA, 23 nt, Homo sapiens
cuucuccacaaccuccuccucca

SEQ ID NO: 1081574 - RNA, 14 nt, Homo sapiens
cuucuccacaggga

SEQ ID NO: 1081575 - RNA, 17 nt, Homo sapiens
cuucucccccccggggc

SEQ ID NO: 1081576 - RNA, 17 nt, Homo sapiens
cuucucgccccucagug

SEQ ID NO: 1081577 - RNA, 19 nt, Homo sapiens
cuucugcaucuuacaguca

SEQ ID NO: 1081578 - RNA, 16 nt, Homo sapiens
cuucuguaugugacaa

SEQ ID NO: 1081579 - RNA, 16 nt, Homo sapiens
cuucuuccuuaauuca

SEQ ID NO: 1081580 - RNA, 18 nt, Homo sapiens
cuucuuguguccugauga

SEQ ID NO: 1081581 - RNA, 18 nt, Homo sapiens
cuugaagaggcaggucug

SEQ ID NO: 1081582 - RNA, 23 nt, Homo sapiens
cuugaauguaagaacaugaccuc

SEQ ID NO: 1081583 - RNA, 22 nt, Homo sapiens
cuugaggguaauaaacuuagaa

SEQ ID NO: 1081584 - RNA, 14 nt, Homo sapiens
cuugagucugaggc

SEQ ID NO: 1081585 - RNA, 18 nt, Homo sapiens
cuugauggagauauuuac

SEQ ID NO: 1081586 - RNA, 22 nt, Homo sapiens
cuugccuuccugccuagucuca

SEQ ID NO: 1081587 - RNA, 17 nt, Homo sapiens
cuugcuggcagggccug

SEQ ID NO: 1081588 - RNA, 22 nt, Homo sapiens
cuuggaaagcaucaccucaggc

SEQ ID NO: 1081589 - RNA, 23 nt, Homo sapiens
cuuggaaagcaucaccucaggcc

SEQ ID NO: 1081590 - RNA, 19 nt, Homo sapiens
cuugggaggacagguccug

SEQ ID NO: 1081591 - RNA, 21 nt, Homo sapiens
cuugggccucaucugcuccua

SEQ ID NO: 1081592 - RNA, 17 nt, Homo sapiens
cuuggucuaagugugcu

SEQ ID NO: 1081593 - RNA, 12 nt, Homo sapiens
cuuguaaauacu

SEQ ID NO: 1081594 - RNA, 19 nt, Homo sapiens
cuuguggacucucugccug

SEQ ID NO: 1081595 - RNA, 19 nt, Homo sapiens
cuuguguaauggaaugcaa

SEQ ID NO: 1081596 - RNA, 22 nt, Homo sapiens
cuuguguguaccacacccugcc

SEQ ID NO: 1081597 - RNA, 18 nt, Homo sapiens
cuuguuguuuuuaagucc

SEQ ID NO: 1081598 - RNA, 18 nt, Homo sapiens
cuuuaaucuguuguuuga

SEQ ID NO: 1081599 - RNA, 23 nt, Homo sapiens
cuuuauaccccauuugauuucga

SEQ ID NO: 1081600 - RNA, 22 nt, Homo sapiens
cuuuaucaaaaaguacaauaau

SEQ ID NO: 1081601 - RNA, 14 nt, Homo sapiens
cuuuaucugugaua

SEQ ID NO: 1081602 - RNA, 11 nt, Homo sapiens
cuuuaugcaaa

SEQ ID NO: 1081603 - RNA, 16 nt, Homo sapiens
cuuucagcugugaaca

SEQ ID NO: 1081604 - RNA, 16 nt, Homo sapiens
cuuucauggaccaggu

SEQ ID NO: 1081605 - RNA, 13 nt, Homo sapiens
cuuucuccagugu

SEQ ID NO: 1081606 - RNA, 15 nt, Homo sapiens
cuuucugggccaagu

SEQ ID NO: 1081607 - RNA, 21 nt, Homo sapiens
cuuucuuuuuaagcucagugg

SEQ ID NO: 1081608 - RNA, 15 nt, Homo sapiens
cuuugaaguggcacc

SEQ ID NO: 1081609 - RNA, 20 nt, Homo sapiens
cuuugaauuuuuuuaauugc

SEQ ID NO: 1081610 - RNA, 15 nt, Homo sapiens
cuuugcaccaaagac

SEQ ID NO: 1081611 - RNA, 20 nt, Homo sapiens
cuuugcagaccgcauaguca

SEQ ID NO: 1081612 - RNA, 20 nt, Homo sapiens
cuuugcccacacacacuccu

SEQ ID NO: 1081613 - RNA, 14 nt, Homo sapiens
ucucaacuacucag

SEQ ID NO: 1081614 - RNA, 20 nt, Homo sapiens
ucucagaguccagucaaguu

SEQ ID NO: 1081615 - RNA, 18 nt, Homo sapiens
ucuccaccuuguuacaca

SEQ ID NO: 1081616 - RNA, 12 nt, Homo sapiens
ucuccacuccau

SEQ ID NO: 1081617 - RNA, 16 nt, Homo sapiens
ucuccccuccaaguga

SEQ ID NO: 1081618 - RNA, 13 nt, Homo sapiens
ucuccuuugaggg

SEQ ID NO: 1081619 - RNA, 17 nt, Homo sapiens
ucucgcuagccauauau

SEQ ID NO: 1081620 - RNA, 10 nt, Homo sapiens
ucucucugcc

SEQ ID NO: 1081621 - RNA, 15 nt, Homo sapiens
ucucuggguuuacaa

SEQ ID NO: 1081622 - RNA, 19 nt, Homo sapiens
ucucuugccgacaagggca

SEQ ID NO: 1081623 - RNA, 22 nt, Homo sapiens
ucugaaagucaugcacauaccu

SEQ ID NO: 1081624 - RNA, 21 nt, Homo sapiens
ucugagccagucccucagcca

SEQ ID NO: 1081625 - RNA, 20 nt, Homo sapiens
ucugaggaguggaguucucu

SEQ ID NO: 1081626 - RNA, 17 nt, Homo sapiens
ucugaguagcauauaua

SEQ ID NO: 1081627 - RNA, 12 nt, Homo sapiens
ucugaucuugga

SEQ ID NO: 1081628 - RNA, 20 nt, Homo sapiens
ucugcagggagcaacucucc

SEQ ID NO: 1081629 - RNA, 21 nt, Homo sapiens
ucugcauuaucugaggucaca

SEQ ID NO: 1081630 - RNA, 21 nt, Homo sapiens
ucugccagcguccccggccac

SEQ ID NO: 1081631 - RNA, 15 nt, Homo sapiens
ucugcgccucuccac

SEQ ID NO: 1081632 - RNA, 16 nt, Homo sapiens
ucugcuauauuuucau

SEQ ID NO: 1081633 - RNA, 15 nt, Homo sapiens
ucugcuucugcauuc

SEQ ID NO: 1081634 - RNA, 18 nt, Homo sapiens
ucuggacagcuugacucu

SEQ ID NO: 1081635 - RNA, 17 nt, Homo sapiens
ucuggccuccaagucca

SEQ ID NO: 1081636 - RNA, 19 nt, Homo sapiens
ucuguaugugacaacauuu

SEQ ID NO: 1081637 - RNA, 18 nt, Homo sapiens
ucugugccugucugucca

SEQ ID NO: 1081638 - RNA, 21 nt, Homo sapiens
ucuuacaaguuagauguuacu

SEQ ID NO: 1081639 - RNA, 14 nt, Homo sapiens
ucuuauuuccucaa

SEQ ID NO: 1081640 - RNA, 23 nt, Homo sapiens
ucuucuauauuccgggugccauu

SEQ ID NO: 1081641 - RNA, 22 nt, Homo sapiens
ucuugcuguaacucagacauuc

SEQ ID NO: 1081642 - RNA, 15 nt, Homo sapiens
ucuuguauugcucca

SEQ ID NO: 1081643 - RNA, 12 nt, Homo sapiens
ucuugugauuga

SEQ ID NO: 1081644 - RNA, 18 nt, Homo sapiens
ucuuuccaaaacauuucu

SEQ ID NO: 1081645 - RNA, 12 nt, Homo sapiens
ucuuuccaaucc

SEQ ID NO: 1081646 - RNA, 15 nt, Homo sapiens
ucuuucucauguugg

SEQ ID NO: 1081647 - RNA, 19 nt, Homo sapiens
uggagccgggaaagcuguu

SEQ ID NO: 1081648 - RNA, 22 nt, Homo sapiens
uggagccugaaccgugugcucc

SEQ ID NO: 1081649 - RNA, 13 nt, Homo sapiens
uggaggugaugaa

SEQ ID NO: 1081650 - RNA, 12 nt, Homo sapiens
uggagugcugca

SEQ ID NO: 1081651 - RNA, 17 nt, Homo sapiens
uggaguucucuguucua

SEQ ID NO: 1081652 - RNA, 18 nt, Homo sapiens
uggcacgaucucagcuca

SEQ ID NO: 1081653 - RNA, 19 nt, Homo sapiens
uggcacgaucucagcucac

SEQ ID NO: 1081654 - RNA, 15 nt, Homo sapiens
uggcaggaugcgcug

SEQ ID NO: 1081655 - RNA, 20 nt, Homo sapiens
uggcauucucucugcucagu

SEQ ID NO: 1081656 - RNA, 17 nt, Homo sapiens
uggccacacugggcuca

SEQ ID NO: 1081657 - RNA, 21 nt, Homo sapiens
uggccauuuaacuagcacuuu

SEQ ID NO: 1081658 - RNA, 13 nt, Homo sapiens
uggccuaaagaau

SEQ ID NO: 1081659 - RNA, 13 nt, Homo sapiens
uggcucugggaau

SEQ ID NO: 1081660 - RNA, 16 nt, Homo sapiens
uggcucuuuguguguc

SEQ ID NO: 1081661 - RNA, 12 nt, Homo sapiens
uggcugcaguga

SEQ ID NO: 1081662 - RNA, 22 nt, Homo sapiens
uggcugggggagggacugcuga

SEQ ID NO: 1081663 - RNA, 12 nt, Homo sapiens
uggcuuacuuac

SEQ ID NO: 1081664 - RNA, 17 nt, Homo sapiens
uggcuuccuuguuuaug

SEQ ID NO: 1081665 - RNA, 19 nt, Homo sapiens
ugggacggcccaucuuggc

SEQ ID NO: 1081666 - RNA, 20 nt, Homo sapiens
ugggaugcgggcauuuugaa

SEQ ID NO: 1081667 - RNA, 22 nt, Homo sapiens
ugggauuucaccguauuagcca

SEQ ID NO: 1081668 - RNA, 18 nt, Homo sapiens
ugggcauuuucccagaug

SEQ ID NO: 1081669 - RNA, 16 nt, Homo sapiens
ugggccccucagggga

SEQ ID NO: 1081670 - RNA, 20 nt, Homo sapiens
ugggccucagccuccaggca

SEQ ID NO: 1081671 - RNA, 17 nt, Homo sapiens
ugggcucacauucccaa

SEQ ID NO: 1081672 - RNA, 17 nt, Homo sapiens
uggggccccauuugcca

SEQ ID NO: 1081673 - RNA, 16 nt, Homo sapiens
uggguauuuaauaaga

SEQ ID NO: 1081674 - RNA, 14 nt, Homo sapiens
ugggugucugcuaa

SEQ ID NO: 1081675 - RNA, 23 nt, Homo sapiens
uggguuggggacccccucaggau

SEQ ID NO: 1081676 - RNA, 14 nt, Homo sapiens
ugguagacugugac

SEQ ID NO: 1081677 - RNA, 21 nt, Homo sapiens
uggucccaaguaguagugucu

SEQ ID NO: 1081678 - RNA, 14 nt, Homo sapiens
uggugacuuuugaa

SEQ ID NO: 1081679 - RNA, 16 nt, Homo sapiens
ugguucaccuguguac

SEQ ID NO: 1081680 - RNA, 21 nt, Homo sapiens
ugguucucacugccuccuaca

SEQ ID NO: 1081681 - RNA, 18 nt, Homo sapiens
uguaaaacuaaacauaca

SEQ ID NO: 1081682 - RNA, 20 nt, Homo sapiens
uguaagcagauuacaauaaa

SEQ ID NO: 1081683 - RNA, 16 nt, Homo sapiens
uguaauagugacauau

SEQ ID NO: 1081684 - RNA, 23 nt, Homo sapiens
uguacaagguauguacaguucau

SEQ ID NO: 1081685 - RNA, 13 nt, Homo sapiens
uguauaauggugu

SEQ ID NO: 1081686 - RNA, 16 nt, Homo sapiens
uguauacaaacaggug

SEQ ID NO: 1081687 - RNA, 17 nt, Homo sapiens
uguauacaaacaggugc

SEQ ID NO: 1081688 - RNA, 17 nt, Homo sapiens
uguaucacucacugcca

SEQ ID NO: 1081689 - RNA, 20 nt, Homo sapiens
uguaucacucacugccaaaa

SEQ ID NO: 1081690 - RNA, 21 nt, Homo sapiens
uguauuagccagucauuguaa

SEQ ID NO: 1081691 - RNA, 21 nt, Homo sapiens
uguauuuaaaugaaagugaga

SEQ ID NO: 1081692 - RNA, 13 nt, Homo sapiens
uguccauccuccu

SEQ ID NO: 1081693 - RNA, 14 nt, Homo sapiens
uguccccuaccccc

SEQ ID NO: 1081694 - RNA, 23 nt, Homo sapiens
ugucccuuccauuucuacuguau

SEQ ID NO: 1081695 - RNA, 17 nt, Homo sapiens
uguccuguuccugccac

SEQ ID NO: 1081696 - RNA, 19 nt, Homo sapiens
uguccuuuguguccauuga

SEQ ID NO: 1081697 - RNA, 16 nt, Homo sapiens
ugucuaguagaacaau

SEQ ID NO: 1081698 - RNA, 21 nt, Homo sapiens
ugucucaacuacucagcucuc

SEQ ID NO: 1081699 - RNA, 14 nt, Homo sapiens
ugucuuaccaaaca

SEQ ID NO: 1081700 - RNA, 10 nt, Homo sapiens
ugucuuuauu

SEQ ID NO: 1081701 - RNA, 12 nt, Homo sapiens
ugugaaagucag

SEQ ID NO: 1081702 - RNA, 14 nt, Homo sapiens
ugugcaaacagugu

SEQ ID NO: 1081703 - RNA, 15 nt, Homo sapiens
ugugccccaugucca

SEQ ID NO: 1081704 - RNA, 23 nt, Homo sapiens
ugugcugucagccucccacaggu

SEQ ID NO: 1081705 - RNA, 17 nt, Homo sapiens
uguggauacagucauua

SEQ ID NO: 1081706 - RNA, 22 nt, Homo sapiens
uguguauauauaguagcauuuc

SEQ ID NO: 1081707 - RNA, 13 nt, Homo sapiens
uguguuaguaaua

SEQ ID NO: 1081708 - RNA, 14 nt, Homo sapiens
uguguuucuuacag

SEQ ID NO: 1081709 - RNA, 19 nt, Homo sapiens
uguuaagccauguguucca

SEQ ID NO: 1081710 - RNA, 22 nt, Homo sapiens
uguuaggagaugucaucaagcu

SEQ ID NO: 1081711 - RNA, 16 nt, Homo sapiens
uguuauuuguacaguu

SEQ ID NO: 1081712 - RNA, 18 nt, Homo sapiens
uguuauuuguacaguuca

SEQ ID NO: 1081713 - RNA, 22 nt, Homo sapiens
uguucaguaguuccaggacuca

SEQ ID NO: 1081714 - RNA, 14 nt, Homo sapiens
uguuccugccacau

SEQ ID NO: 1081715 - RNA, 13 nt, Homo sapiens
uguugaaugccug

SEQ ID NO: 1081716 - RNA, 16 nt, Homo sapiens
uguugacuggccaaaa

SEQ ID NO: 1081717 - RNA, 16 nt, Homo sapiens
uguuucuuucauauga

SEQ ID NO: 1081718 - RNA, 16 nt, Homo sapiens
uguuuguucacacucc

SEQ ID NO: 1081719 - RNA, 14 nt, Homo sapiens
uguuuuuaaguccu

SEQ ID NO: 1081720 - RNA, 15 nt, Homo sapiens
uuaaaagucacauaa

SEQ ID NO: 1081721 - RNA, 22 nt, Homo sapiens
uuaaagaaaaugugucugcaac

SEQ ID NO: 1081722 - RNA, 17 nt, Homo sapiens
uuaaagaaacacuaaau

SEQ ID NO: 1081723 - RNA, 22 nt, Homo sapiens
uuaaaggaaaaaucauaaccac

SEQ ID NO: 1081724 - RNA, 14 nt, Homo sapiens
uuaaauacuacaaa

SEQ ID NO: 1081725 - RNA, 21 nt, Homo sapiens
uuaaaugguguuuuauuacaa

SEQ ID NO: 1081726 - RNA, 15 nt, Homo sapiens
uuaaguuuaccaaau

SEQ ID NO: 1081727 - RNA, 21 nt, Homo sapiens
uuaauaagaaacaugauguga

SEQ ID NO: 1081728 - RNA, 16 nt, Homo sapiens
uuaauucacucccaca

SEQ ID NO: 1081729 - RNA, 17 nt, Homo sapiens
uuaauugaggcuuacag

SEQ ID NO: 1081730 - RNA, 19 nt, Homo sapiens
uuacagaucauauaagcaa

SEQ ID NO: 1081731 - RNA, 16 nt, Homo sapiens
uuacauuuuguauauu

SEQ ID NO: 1081732 - RNA, 18 nt, Homo sapiens
uuacuaaagucacauaua

SEQ ID NO: 1081733 - RNA, 15 nt, Homo sapiens
uuacuuccaugauac

SEQ ID NO: 1081734 - RNA, 13 nt, Homo sapiens
uuagacagaugac

SEQ ID NO: 1081735 - RNA, 14 nt, Homo sapiens
uuagaggcaaagaa

SEQ ID NO: 1081736 - RNA, 20 nt, Homo sapiens
uuaggagagagaaaauaauu

SEQ ID NO: 1081737 - RNA, 14 nt, Homo sapiens
uuaggagaugucau

SEQ ID NO: 1081738 - RNA, 14 nt, Homo sapiens
uuaggcagggauuu

SEQ ID NO: 1081739 - RNA, 14 nt, Homo sapiens
uuaguaaacugugc

SEQ ID NO: 1081740 - RNA, 14 nt, Homo sapiens
ccuaucaucaguua

SEQ ID NO: 1081741 - RNA, 12 nt, Homo sapiens
ccuaugauccca

SEQ ID NO: 1081742 - RNA, 14 nt, Homo sapiens
ccucagccuccuga

SEQ ID NO: 1081743 - RNA, 18 nt, Homo sapiens
ccucagguaguacuggga

SEQ ID NO: 1081744 - RNA, 14 nt, Homo sapiens
ccucaucugcuccu

SEQ ID NO: 1081745 - RNA, 17 nt, Homo sapiens
ccucaugaggccaugca

SEQ ID NO: 1081746 - RNA, 15 nt, Homo sapiens
ccuccaaacacuggg

SEQ ID NO: 1081747 - RNA, 12 nt, Homo sapiens
ccuccacuccac

SEQ ID NO: 1081748 - RNA, 23 nt, Homo sapiens
ccuccaggacuggggcuugccag

SEQ ID NO: 1081749 - RNA, 14 nt, Homo sapiens
ccuccccaauccau

SEQ ID NO: 1081750 - RNA, 21 nt, Homo sapiens
ccuccccaauuccccagggaa

SEQ ID NO: 1081751 - RNA, 21 nt, Homo sapiens
ccucccuagauccaggcuucu

SEQ ID NO: 1081752 - RNA, 16 nt, Homo sapiens
ccuccguguagugucu

SEQ ID NO: 1081753 - RNA, 20 nt, Homo sapiens
ccuccguguagugucuguaa

SEQ ID NO: 1081754 - RNA, 22 nt, Homo sapiens
ccuccuaggaguacaagugccu

SEQ ID NO: 1081755 - RNA, 14 nt, Homo sapiens
ccuccugagccuca

SEQ ID NO: 1081756 - RNA, 16 nt, Homo sapiens
ccuccuggguuuacuc

SEQ ID NO: 1081757 - RNA, 16 nt, Homo sapiens
ccucguagccaucucu

SEQ ID NO: 1081758 - RNA, 21 nt, Homo sapiens
ccucguccaaggcaguucugu

SEQ ID NO: 1081759 - RNA, 13 nt, Homo sapiens
ccucucaaaugga

SEQ ID NO: 1081760 - RNA, 23 nt, Homo sapiens
ccucugaaugucccagaggcuag

SEQ ID NO: 1081761 - RNA, 14 nt, Homo sapiens
ccucugcuuccuga

SEQ ID NO: 1081762 - RNA, 14 nt, Homo sapiens
ccucuggacagcuu

SEQ ID NO: 1081763 - RNA, 20 nt, Homo sapiens
ccucuguccagccagcuccu

SEQ ID NO: 1081764 - RNA, 14 nt, Homo sapiens
ccucuuauuugcuc

SEQ ID NO: 1081765 - RNA, 14 nt, Homo sapiens
ccugaacucugcaa

SEQ ID NO: 1081766 - RNA, 20 nt, Homo sapiens
ccugacccuccuccacucca

SEQ ID NO: 1081767 - RNA, 19 nt, Homo sapiens
ccugaccuccaguccugcu

SEQ ID NO: 1081768 - RNA, 20 nt, Homo sapiens
ccugagauacugaagugcag

SEQ ID NO: 1081769 - RNA, 22 nt, Homo sapiens
ccugagauucuuuaaggagaua

SEQ ID NO: 1081770 - RNA, 21 nt, Homo sapiens
ccugagugcaccacccuuuga

SEQ ID NO: 1081771 - RNA, 21 nt, Homo sapiens
ccugcgcagucauuggcccaa

SEQ ID NO: 1081772 - RNA, 16 nt, Homo sapiens
ccugcucacucuucca

SEQ ID NO: 1081773 - RNA, 15 nt, Homo sapiens
ccugcuccacagugu

SEQ ID NO: 1081774 - RNA, 10 nt, Homo sapiens
ccugcuggaa

SEQ ID NO: 1081775 - RNA, 17 nt, Homo sapiens
ccuggccaccagcuucc

SEQ ID NO: 1081776 - RNA, 16 nt, Homo sapiens
ccuggcccaucagugu

SEQ ID NO: 1081777 - RNA, 14 nt, Homo sapiens
ccuggccuaaagaa

SEQ ID NO: 1081778 - RNA, 13 nt, Homo sapiens
ccugugacuaugg

SEQ ID NO: 1081779 - RNA, 23 nt, Homo sapiens
ccugugaugcuuugaaguacaau

SEQ ID NO: 1081780 - RNA, 21 nt, Homo sapiens
ccuuaaaaauuaaauucucuc

SEQ ID NO: 1081781 - RNA, 16 nt, Homo sapiens
ccuuaaucuauuuuca

SEQ ID NO: 1081782 - RNA, 22 nt, Homo sapiens
ccuuacagaacacgcuuucaca

SEQ ID NO: 1081783 - RNA, 15 nt, Homo sapiens
ccuuagaagaucugc

SEQ ID NO: 1081784 - RNA, 15 nt, Homo sapiens
ccuuagaaguggaag

SEQ ID NO: 1081785 - RNA, 19 nt, Homo sapiens
ccuucaaguuagcucagga

SEQ ID NO: 1081786 - RNA, 19 nt, Homo sapiens
ccuucccuccccacagucc

SEQ ID NO: 1081787 - RNA, 16 nt, Homo sapiens
ccuucuaauccaugug

SEQ ID NO: 1081788 - RNA, 16 nt, Homo sapiens
ccuucuccacagggac

SEQ ID NO: 1081789 - RNA, 14 nt, Homo sapiens
ccuugcucugccau

SEQ ID NO: 1081790 - RNA, 14 nt, Homo sapiens
ccuugggccucauc

SEQ ID NO: 1081791 - RNA, 22 nt, Homo sapiens
ccuuuagauauuauucauucau

SEQ ID NO: 1081792 - RNA, 14 nt, Homo sapiens
ccuuuauagcuuug

SEQ ID NO: 1081793 - RNA, 13 nt, Homo sapiens
ccuuucuccagug

SEQ ID NO: 1081794 - RNA, 16 nt, Homo sapiens
ccuuucuccaguguaa

SEQ ID NO: 1081795 - RNA, 22 nt, Homo sapiens
ccuuugcaggcccagcagacuu

SEQ ID NO: 1081796 - RNA, 16 nt, Homo sapiens
ccuuuugguuccucac

SEQ ID NO: 1081797 - RNA, 20 nt, Homo sapiens
ccuuuugguuccucacauau

SEQ ID NO: 1081798 - RNA, 22 nt, Homo sapiens
cgagagaggcgcgucugcccca

SEQ ID NO: 1081799 - RNA, 17 nt, Homo sapiens
cgcaaacuuuaacaggu

SEQ ID NO: 1081800 - RNA, 20 nt, Homo sapiens
cgcagcugcugccacucugc

SEQ ID NO: 1081801 - RNA, 14 nt, Homo sapiens
cgcaucauaugcag

SEQ ID NO: 1081802 - RNA, 23 nt, Homo sapiens
cgccauuccaagucaacacucuu

SEQ ID NO: 1081803 - RNA, 21 nt, Homo sapiens
cgccuaugaucccagcacuuu

SEQ ID NO: 1081804 - RNA, 23 nt, Homo sapiens
cgcuaguuaggaaguuaccugga

SEQ ID NO: 1081805 - RNA, 11 nt, Homo sapiens
cggacaaauca

SEQ ID NO: 1081806 - RNA, 19 nt, Homo sapiens
cggcaccagugccucagug

SEQ ID NO: 1081807 - RNA, 18 nt, Homo sapiens
cggcagaugcuguuguug

SEQ ID NO: 1081808 - RNA, 13 nt, Homo sapiens
cguaggaaaacca

SEQ ID NO: 1081809 - RNA, 20 nt, Homo sapiens
cgucacccuccugagccuca

SEQ ID NO: 1081810 - RNA, 15 nt, Homo sapiens
cgucccaugugcaug

SEQ ID NO: 1081811 - RNA, 17 nt, Homo sapiens
cgucccuccuguuguga

SEQ ID NO: 1081812 - RNA, 20 nt, Homo sapiens
cgucuuucauggaccagguc

SEQ ID NO: 1081813 - RNA, 13 nt, Homo sapiens
cguguagugucug

SEQ ID NO: 1081814 - RNA, 12 nt, Homo sapiens
cgugugcuccuc

SEQ ID NO: 1081815 - RNA, 18 nt, Homo sapiens
cguuuguucccccaugaa

SEQ ID NO: 1081816 - RNA, 20 nt, Homo sapiens
cuaaacugcuguuaauugau

SEQ ID NO: 1081817 - RNA, 15 nt, Homo sapiens
cuaaagucucaggug

SEQ ID NO: 1081818 - RNA, 23 nt, Homo sapiens
cuaacacccagucuguuccccau

SEQ ID NO: 1081819 - RNA, 17 nt, Homo sapiens
cuaacacuguccugucc

SEQ ID NO: 1081820 - RNA, 13 nt, Homo sapiens
aagaagguuucug

SEQ ID NO: 1081821 - RNA, 21 nt, Homo sapiens
aagaauaaaauugcacuuuua

SEQ ID NO: 1081822 - RNA, 20 nt, Homo sapiens
aagacaccugccuuaugcaa

SEQ ID NO: 1081823 - RNA, 15 nt, Homo sapiens
aagacaucagucucc

SEQ ID NO: 1081824 - RNA, 19 nt, Homo sapiens
aagaccgauagcaggugaa

SEQ ID NO: 1081825 - RNA, 20 nt, Homo sapiens
aagacuucacugcagccuuu

SEQ ID NO: 1081826 - RNA, 14 nt, Homo sapiens
aagagaccuagcua

SEQ ID NO: 1081827 - RNA, 19 nt, Homo sapiens
aagagaucuuucuuuccaa

SEQ ID NO: 1081828 - RNA, 11 nt, Homo sapiens
aagagcacagc

SEQ ID NO: 1081829 - RNA, 18 nt, Homo sapiens
aagagccuucacaugaaa

SEQ ID NO: 1081830 - RNA, 20 nt, Homo sapiens
aagaggcauucccagaauuu

SEQ ID NO: 1081831 - RNA, 21 nt, Homo sapiens
aagaguagaaaaggauugcuu

SEQ ID NO: 1081832 - RNA, 14 nt, Homo sapiens
aagagucucuccag

SEQ ID NO: 1081833 - RNA, 21 nt, Homo sapiens
aagaugcccuaguugugauca

SEQ ID NO: 1081834 - RNA, 19 nt, Homo sapiens
aagcaaacacacagacucu

SEQ ID NO: 1081835 - RNA, 16 nt, Homo sapiens
aagcaauacuguuucc

SEQ ID NO: 1081836 - RNA, 23 nt, Homo sapiens
aagcaaugcuucugccucagcuu

SEQ ID NO: 1081837 - RNA, 20 nt, Homo sapiens
aagcaggaguaaguuucuca

SEQ ID NO: 1081838 - RNA, 16 nt, Homo sapiens
aagcaucaccucaggc

SEQ ID NO: 1081839 - RNA, 21 nt, Homo sapiens
aagcauccuccccaccagagc

SEQ ID NO: 1081840 - RNA, 15 nt, Homo sapiens
aagcaugaaaacuga

SEQ ID NO: 1081841 - RNA, 19 nt, Homo sapiens
aagcauucugagcugggcu

SEQ ID NO: 1081842 - RNA, 21 nt, Homo sapiens
aagccaccgcagcugcugcca

SEQ ID NO: 1081843 - RNA, 13 nt, Homo sapiens
aagcccuugaacc

SEQ ID NO: 1081844 - RNA, 13 nt, Homo sapiens
aagccugaggcug

SEQ ID NO: 1081845 - RNA, 17 nt, Homo sapiens
aagccugguggcaauaa

SEQ ID NO: 1081846 - RNA, 15 nt, Homo sapiens
aagccuguugcugaa

SEQ ID NO: 1081847 - RNA, 23 nt, Homo sapiens
aagcuaaaaugaaaaauagugug

SEQ ID NO: 1081848 - RNA, 20 nt, Homo sapiens
aagcugugccacccugggcu

SEQ ID NO: 1081849 - RNA, 21 nt, Homo sapiens
aagcugugccacccugggcuc

SEQ ID NO: 1081850 - RNA, 16 nt, Homo sapiens
aaggacaaacagugaa

SEQ ID NO: 1081851 - RNA, 20 nt, Homo sapiens
aaggauauuuacuacuuuug

SEQ ID NO: 1081852 - RNA, 16 nt, Homo sapiens
aaggauuuuaccaaag

SEQ ID NO: 1081853 - RNA, 18 nt, Homo sapiens
aaggccucccacagugac

SEQ ID NO: 1081854 - RNA, 13 nt, Homo sapiens
aaggcucagucuc

SEQ ID NO: 1081855 - RNA, 15 nt, Homo sapiens
aaggcugaugcauuc

SEQ ID NO: 1081856 - RNA, 16 nt, Homo sapiens
aaggggcugucuccca

SEQ ID NO: 1081857 - RNA, 20 nt, Homo sapiens
aaggggcugucucccaauga

SEQ ID NO: 1081858 - RNA, 16 nt, Homo sapiens
aaggguucagggcaug

SEQ ID NO: 1081859 - RNA, 16 nt, Homo sapiens
aaggucucacacuccu

SEQ ID NO: 1081860 - RNA, 22 nt, Homo sapiens
aaggugccgauuucaugcauuc

SEQ ID NO: 1081861 - RNA, 18 nt, Homo sapiens
aagguuucugcacauugu

SEQ ID NO: 1081862 - RNA, 15 nt, Homo sapiens
aaguaccacucaggc

SEQ ID NO: 1081863 - RNA, 18 nt, Homo sapiens
aaguauaggauaaauuac

SEQ ID NO: 1081864 - RNA, 18 nt, Homo sapiens
aaguauauauucuacaca

SEQ ID NO: 1081865 - RNA, 14 nt, Homo sapiens
aagucaacacucuu

SEQ ID NO: 1081866 - RNA, 20 nt, Homo sapiens
aagucacauaaaaugcggca

SEQ ID NO: 1081867 - RNA, 13 nt, Homo sapiens
aagucacuuuuau

SEQ ID NO: 1081868 - RNA, 13 nt, Homo sapiens
aagucagcaacag

SEQ ID NO: 1081869 - RNA, 15 nt, Homo sapiens
aagucuccuguauca

SEQ ID NO: 1081870 - RNA, 16 nt, Homo sapiens
aagucuccuguaucau

SEQ ID NO: 1081871 - RNA, 17 nt, Homo sapiens
aagucuuauuuccucaa

SEQ ID NO: 1081872 - RNA, 14 nt, Homo sapiens
aagucuugcauuga

SEQ ID NO: 1081873 - RNA, 22 nt, Homo sapiens
aagugacaagggcacaagcuca

SEQ ID NO: 1081874 - RNA, 13 nt, Homo sapiens
aagugaguggcau

SEQ ID NO: 1081875 - RNA, 22 nt, Homo sapiens
aagugauaucccccagccucaa

SEQ ID NO: 1081876 - RNA, 20 nt, Homo sapiens
aagugcugggauuacaggca

SEQ ID NO: 1081877 - RNA, 13 nt, Homo sapiens
aaguggcaccuaa

SEQ ID NO: 1081878 - RNA, 17 nt, Homo sapiens
aaguggcaccuaauaaa

SEQ ID NO: 1081879 - RNA, 14 nt, Homo sapiens
aagugucucuugac

SEQ ID NO: 1081880 - RNA, 11 nt, Homo sapiens
aaguguggaau

SEQ ID NO: 1081881 - RNA, 16 nt, Homo sapiens
aaguuaagauagcuuu

SEQ ID NO: 1081882 - RNA, 22 nt, Homo sapiens
aaguuggucuuacuuugugcaa

SEQ ID NO: 1081883 - RNA, 13 nt, Homo sapiens
aauaaaagcacaa

SEQ ID NO: 1081884 - RNA, 16 nt, Homo sapiens
aauaaaauucuuucag

SEQ ID NO: 1081885 - RNA, 17 nt, Homo sapiens
aauaaacgucuugccac

SEQ ID NO: 1081886 - RNA, 15 nt, Homo sapiens
aauaaggcccagagc

SEQ ID NO: 1081887 - RNA, 17 nt, Homo sapiens
aauacaauuaaagcaaa

SEQ ID NO: 1081888 - RNA, 13 nt, Homo sapiens
aauacacuuuauu

SEQ ID NO: 1081889 - RNA, 19 nt, Homo sapiens
aauacaugcugcuaauuca

SEQ ID NO: 1081890 - RNA, 20 nt, Homo sapiens
aauacauuuuauaucuggau

SEQ ID NO: 1081891 - RNA, 22 nt, Homo sapiens
aauacgugaaagaugcaagcac

SEQ ID NO: 1081892 - RNA, 14 nt, Homo sapiens
aauacucucugaaa

SEQ ID NO: 1081893 - RNA, 17 nt, Homo sapiens
aauaguguguccaugca

SEQ ID NO: 1081894 - RNA, 12 nt, Homo sapiens
aauauauuugau

SEQ ID NO: 1081895 - RNA, 18 nt, Homo sapiens
aauaucugagaaguguau

SEQ ID NO: 1081896 - RNA, 14 nt, Homo sapiens
aauaugaaagccac

SEQ ID NO: 1081897 - RNA, 17 nt, Homo sapiens
aauaugggcucaaguca

SEQ ID NO: 1081898 - RNA, 12 nt, Homo sapiens
aauaugugaaaa

SEQ ID NO: 1081899 - RNA, 19 nt, Homo sapiens
aauaugugaaaaugauuag

SEQ ID NO: 1081900 - RNA, 11 nt, Homo sapiens
aauaugugcuu

SEQ ID NO: 1081901 - RNA, 16 nt, Homo sapiens
aauauuguuguuuacc

SEQ ID NO: 1081902 - RNA, 15 nt, Homo sapiens
aaucaaacagggaca

SEQ ID NO: 1081903 - RNA, 15 nt, Homo sapiens
aaucaagucugugaa

SEQ ID NO: 1081904 - RNA, 16 nt, Homo sapiens
aaucaauucauugugu

SEQ ID NO: 1081905 - RNA, 14 nt, Homo sapiens
aaucagauucagga

SEQ ID NO: 1081906 - RNA, 18 nt, Homo sapiens
aaucagauuuucuccugu

SEQ ID NO: 1081907 - RNA, 20 nt, Homo sapiens
aaucaggcuuugucugcucc

SEQ ID NO: 1081908 - RNA, 15 nt, Homo sapiens
aauccaugugcugcu

SEQ ID NO: 1081909 - RNA, 22 nt, Homo sapiens
aaucucaguagcugauucugaa

SEQ ID NO: 1081910 - RNA, 16 nt, Homo sapiens
aaugacagcggggaag

SEQ ID NO: 1081911 - RNA, 22 nt, Homo sapiens
aaugagcuccugcucauugugg

SEQ ID NO: 1081912 - RNA, 23 nt, Homo sapiens
aaugcauuagauuaucaaaaagu

SEQ ID NO: 1081913 - RNA, 22 nt, Homo sapiens
aaugcccuaccugccuguucuc

SEQ ID NO: 1081914 - RNA, 23 nt, Homo sapiens
aaugcguggcacaucuaaauuga

SEQ ID NO: 1081915 - RNA, 13 nt, Homo sapiens
aaugcuucaauca

SEQ ID NO: 1081916 - RNA, 17 nt, Homo sapiens
aaugcuucugccucagc

SEQ ID NO: 1081917 - RNA, 23 nt, Homo sapiens
aauggggguggggaggcaagaac

SEQ ID NO: 1081918 - RNA, 20 nt, Homo sapiens
aaugguaacuuuacaacugg

SEQ ID NO: 1081919 - RNA, 20 nt, Homo sapiens
aaugguuuucuaauaucuua

SEQ ID NO: 1081920 - RNA, 12 nt, Homo sapiens
aaugucauucac

SEQ ID NO: 1081921 - RNA, 14 nt, Homo sapiens
aaugucccagaggc

SEQ ID NO: 1081922 - RNA, 22 nt, Homo sapiens
aaugucccagaggcuagucucu

SEQ ID NO: 1081923 - RNA, 22 nt, Homo sapiens
aauguccuucuuuaucugugau

SEQ ID NO: 1081924 - RNA, 16 nt, Homo sapiens
aauguuauauaguuua

SEQ ID NO: 1081925 - RNA, 18 nt, Homo sapiens
aauguuuuaaacauucuu

SEQ ID NO: 1081926 - RNA, 20 nt, Homo sapiens
aauguuuuuggcaacaggag

SEQ ID NO: 1081927 - RNA, 22 nt, Homo sapiens
acaauaaaugcugaaugaaucc

SEQ ID NO: 1081928 - RNA, 23 nt, Homo sapiens
acaauacgugaaagaugcaagca

SEQ ID NO: 1081929 - RNA, 16 nt, Homo sapiens
acaauuguuaugaucu

SEQ ID NO: 1081930 - RNA, 12 nt, Homo sapiens
acacaacaugua

SEQ ID NO: 1081931 - RNA, 12 nt, Homo sapiens
acacacacuccu

SEQ ID NO: 1081932 - RNA, 11 nt, Homo sapiens
acaccaucucc

SEQ ID NO: 1081933 - RNA, 13 nt, Homo sapiens
acaccuaagagaa

SEQ ID NO: 1081934 - RNA, 12 nt, Homo sapiens
acacgcuuucac

SEQ ID NO: 1081935 - RNA, 14 nt, Homo sapiens
acacgugacacugu

SEQ ID NO: 1081936 - RNA, 17 nt, Homo sapiens
acacuuagcaucccaca

SEQ ID NO: 1081937 - RNA, 15 nt, Homo sapiens
acagaaacauuuuca

SEQ ID NO: 1081938 - RNA, 16 nt, Homo sapiens
acagaacacacugaga

SEQ ID NO: 1081939 - RNA, 12 nt, Homo sapiens
acagacucuucc

SEQ ID NO: 1081940 - RNA, 12 nt, Homo sapiens
acagacugugag

SEQ ID NO: 1081941 - RNA, 14 nt, Homo sapiens
acagccgugcacac

SEQ ID NO: 1081942 - RNA, 20 nt, Homo sapiens
acagcuggacccauuugcca

SEQ ID NO: 1081943 - RNA, 22 nt, Homo sapiens
acagcuggacccauuugccagg

SEQ ID NO: 1081944 - RNA, 13 nt, Homo sapiens
acaggacucugca

SEQ ID NO: 1081945 - RNA, 13 nt, Homo sapiens
acaggcucugaga

SEQ ID NO: 1081946 - RNA, 19 nt, Homo sapiens
acaggcucugagauuucac

SEQ ID NO: 1081947 - RNA, 20 nt, Homo sapiens
acagggaacaagcauucucc

SEQ ID NO: 1081948 - RNA, 15 nt, Homo sapiens
acagggcaccccagc

SEQ ID NO: 1081949 - RNA, 23 nt, Homo sapiens
acaguagagcacuuuucacuuau

SEQ ID NO: 1081950 - RNA, 22 nt, Homo sapiens
acaguccugggagaaccucagg

SEQ ID NO: 1081951 - RNA, 12 nt, Homo sapiens
acagugaugcug

SEQ ID NO: 1081952 - RNA, 14 nt, Homo sapiens
acaguguaagcuua

SEQ ID NO: 1081953 - RNA, 20 nt, Homo sapiens
acauaugucugucuuugcaa

SEQ ID NO: 1081954 - RNA, 17 nt, Homo sapiens
acaucagucuccaacau

SEQ ID NO: 1081955 - RNA, 22 nt, Homo sapiens
acauccaaccccccaccugcca

SEQ ID NO: 1081956 - RNA, 17 nt, Homo sapiens
acauccauugacugacc

SEQ ID NO: 1081957 - RNA, 21 nt, Homo sapiens
acaucgacaaccacguaccaa

SEQ ID NO: 1081958 - RNA, 17 nt, Homo sapiens
acaucuuaguugaugcu

SEQ ID NO: 1081959 - RNA, 14 nt, Homo sapiens
acaucuuguaagac

SEQ ID NO: 1081960 - RNA, 16 nt, Homo sapiens
acaugaaaacauugau

SEQ ID NO: 1081961 - RNA, 23 nt, Homo sapiens
acaugaauugcauuuuacuuuaa

SEQ ID NO: 1081962 - RNA, 22 nt, Homo sapiens
acaugauggagcgcaccugccc

SEQ ID NO: 1081963 - RNA, 14 nt, Homo sapiens
acaugaugugagau

SEQ ID NO: 1081964 - RNA, 20 nt, Homo sapiens
acaugcagaagauguuuaaa

SEQ ID NO: 1081965 - RNA, 18 nt, Homo sapiens
acaugcugcuaauucaaa

SEQ ID NO: 1081966 - RNA, 23 nt, Homo sapiens
acauggagcuugacuucaugcca

SEQ ID NO: 1081967 - RNA, 14 nt, Homo sapiens
acauguaucacuca

SEQ ID NO: 1081968 - RNA, 19 nt, Homo sapiens
acauuaauugaggcuuaca

SEQ ID NO: 1081969 - RNA, 20 nt, Homo sapiens
acauuccucugcagcacuuc

SEQ ID NO: 1081970 - RNA, 12 nt, Homo sapiens
acauuguaagag

SEQ ID NO: 1081971 - RNA, 15 nt, Homo sapiens
acauugucaccauuu

SEQ ID NO: 1081972 - RNA, 17 nt, Homo sapiens
acauuuuuaaaacaacu

SEQ ID NO: 1081973 - RNA, 17 nt, Homo sapiens
acauuuuucgacuguga

SEQ ID NO: 1081974 - RNA, 15 nt, Homo sapiens
accaaagcaucaaua

SEQ ID NO: 1081975 - RNA, 19 nt, Homo sapiens
accaagcgugauuccugcu

SEQ ID NO: 1081976 - RNA, 20 nt, Homo sapiens
accacagcaaggcaccugca

SEQ ID NO: 1081977 - RNA, 21 nt, Homo sapiens
accacucaggccaacaagcca

SEQ ID NO: 1081978 - RNA, 16 nt, Homo sapiens
accagaaaagcaauac

SEQ ID NO: 1081979 - RNA, 18 nt, Homo sapiens
accagaugggaugggcuu

SEQ ID NO: 1081980 - RNA, 17 nt, Homo sapiens
accagccguauuuuaca

SEQ ID NO: 1081981 - RNA, 21 nt, Homo sapiens
accagccguauuuuacaugaa

SEQ ID NO: 1081982 - RNA, 15 nt, Homo sapiens
accaggcagcuccag

SEQ ID NO: 1081983 - RNA, 18 nt, Homo sapiens
accaguggcccccacuca

SEQ ID NO: 1081984 - RNA, 22 nt, Homo sapiens
accauuauuuuacagucucugu

SEQ ID NO: 1081985 - RNA, 15 nt, Homo sapiens
acccaacgugaugcu

SEQ ID NO: 1081986 - RNA, 22 nt, Homo sapiens
acccaccaaggucucacacucc

SEQ ID NO: 1081987 - RNA, 23 nt, Homo sapiens
acccagggucccagccuggccac

SEQ ID NO: 1081988 - RNA, 23 nt, Homo sapiens
  misc_feature (7)..(7): n is a, c, g or u
acccagnagggcgucgcuggaca

SEQ ID NO: 1081989 - RNA, 18 nt, Homo sapiens
acccagugugugcucagc

SEQ ID NO: 1081990 - RNA, 11 nt, Homo sapiens
accccaucuca

SEQ ID NO: 1081991 - RNA, 12 nt, Homo sapiens
accccaucucau

SEQ ID NO: 1081992 - RNA, 12 nt, Homo sapiens
acccccagugug

SEQ ID NO: 1081993 - RNA, 20 nt, Homo sapiens
acccccuccuccagcaauag

SEQ ID NO: 1081994 - RNA, 18 nt, Homo sapiens
accccucccccacgucuc

SEQ ID NO: 1081995 - RNA, 15 nt, Homo sapiens
acccuaucaucaguu

SEQ ID NO: 1081996 - RNA, 11 nt, Homo sapiens
acccucagcug

SEQ ID NO: 1081997 - RNA, 17 nt, Homo sapiens
acccuccuccacuccac

SEQ ID NO: 1081998 - RNA, 23 nt, Homo sapiens
acccugggcaaugcagugcagca

SEQ ID NO: 1081999 - RNA, 23 nt, Homo sapiens
acccuguuuguugugucuugcua

SEQ ID NO: 1082000 - RNA, 21 nt, Homo sapiens
accgguguccuguuccugcca

SEQ ID NO: 1082001 - RNA, 15 nt, Homo sapiens
accguugcacaaaaa

SEQ ID NO: 1082002 - RNA, 22 nt, Homo sapiens
accuauggcccagccacugcag

SEQ ID NO: 1082003 - RNA, 23 nt, Homo sapiens
accuauggcccagccacugcagc

SEQ ID NO: 1082004 - RNA, 17 nt, Homo sapiens
accucacgcucuggaca

SEQ ID NO: 1082005 - RNA, 21 nt, Homo sapiens
accucacgcucuggacaugau

SEQ ID NO: 1082006 - RNA, 13 nt, Homo sapiens
accucccaaagug

SEQ ID NO: 1082007 - RNA, 15 nt, Homo sapiens
accucccaguuugcu

SEQ ID NO: 1082008 - RNA, 18 nt, Homo sapiens
accucguuacucucaccu

SEQ ID NO: 1082009 - RNA, 19 nt, Homo sapiens
accugagcagcaacugugu

SEQ ID NO: 1082010 - RNA, 14 nt, Homo sapiens
accugaucauuaca

SEQ ID NO: 1082011 - RNA, 13 nt, Homo sapiens
accugcaggccaa

SEQ ID NO: 1082012 - RNA, 15 nt, Homo sapiens
accugguacugaggu

SEQ ID NO: 1082013 - RNA, 19 nt, Homo sapiens
accuguuacugaaaguggu

SEQ ID NO: 1082014 - RNA, 14 nt, Homo sapiens
accuuaaaauguaa

SEQ ID NO: 1082015 - RNA, 13 nt, Homo sapiens
accuugcaucuca

SEQ ID NO: 1082016 - RNA, 15 nt, Homo sapiens
accuuuuacauauuu

SEQ ID NO: 1082017 - RNA, 15 nt, Homo sapiens
accuuuucccgggga

SEQ ID NO: 1082018 - RNA, 11 nt, Homo sapiens
acgacucuucc

SEQ ID NO: 1082019 - RNA, 13 nt, Homo sapiens
acgucugugcucu

SEQ ID NO: 1082020 - RNA, 12 nt, Homo sapiens
acgugcacagcu

SEQ ID NO: 1082021 - RNA, 19 nt, Homo sapiens
acuaaaaaggccccugugg

SEQ ID NO: 1082022 - RNA, 13 nt, Homo sapiens
acuaaacauacau

SEQ ID NO: 1082023 - RNA, 19 nt, Homo sapiens
acuacacacccccaagcca

SEQ ID NO: 1082024 - RNA, 17 nt, Homo sapiens
acuacaggcucaugcca

SEQ ID NO: 1082025 - RNA, 16 nt, Homo sapiens
acuacuagagcuccau

SEQ ID NO: 1082026 - RNA, 19 nt, Homo sapiens
acuacucagcucuccugcu

SEQ ID NO: 1082027 - RNA, 16 nt, Homo sapiens
acuacucuacuuccuc

SEQ ID NO: 1082028 - RNA, 17 nt, Homo sapiens
acuagagcuccauuucu

SEQ ID NO: 1082029 - RNA, 19 nt, Homo sapiens
acuagcuaaaaccaaagga

SEQ ID NO: 1082030 - RNA, 22 nt, Homo sapiens
acuaguguguguguguauauau

SEQ ID NO: 1082031 - RNA, 18 nt, Homo sapiens
acucaaggccuccagcca

SEQ ID NO: 1082032 - RNA, 19 nt, Homo sapiens
acucagagcugcgggcuga

SEQ ID NO: 1082033 - RNA, 20 nt, Homo sapiens
acucagaucaaaaaugggca

SEQ ID NO: 1082034 - RNA, 18 nt, Homo sapiens
acucaggccaacaagcca

SEQ ID NO: 1082035 - RNA, 21 nt, Homo sapiens
acucaugacugagucuggcaa

SEQ ID NO: 1082036 - RNA, 19 nt, Homo sapiens
agccucccgaguagcugag

SEQ ID NO: 1082037 - RNA, 14 nt, Homo sapiens
agccucguccaagg

SEQ ID NO: 1082038 - RNA, 14 nt, Homo sapiens
agccucugcugcca

SEQ ID NO: 1082039 - RNA, 18 nt, Homo sapiens
agccugguggcaauaagg

SEQ ID NO: 1082040 - RNA, 18 nt, Homo sapiens
agccuucucauuugccau

SEQ ID NO: 1082041 - RNA, 14 nt, Homo sapiens
agccuuucacagga

SEQ ID NO: 1082042 - RNA, 17 nt, Homo sapiens
agcgagagucugucuca

SEQ ID NO: 1082043 - RNA, 17 nt, Homo sapiens
agcuacucucuugccag

SEQ ID NO: 1082044 - RNA, 18 nt, Homo sapiens
agcucccgagcuacucuc

SEQ ID NO: 1082045 - RNA, 14 nt, Homo sapiens
agcucccuggugag

SEQ ID NO: 1082046 - RNA, 15 nt, Homo sapiens
agcucuggcuuccag

SEQ ID NO: 1082047 - RNA, 15 nt, Homo sapiens
agcucuugggccuga

SEQ ID NO: 1082048 - RNA, 13 nt, Homo sapiens
agcugacagagcc

SEQ ID NO: 1082049 - RNA, 19 nt, Homo sapiens
agcugacaguccucuccac

SEQ ID NO: 1082050 - RNA, 18 nt, Homo sapiens
agcugaccugguacugag

SEQ ID NO: 1082051 - RNA, 15 nt, Homo sapiens
agcugaucaugucag

SEQ ID NO: 1082052 - RNA, 13 nt, Homo sapiens
agcugcaccugcc

SEQ ID NO: 1082053 - RNA, 19 nt, Homo sapiens
agcuggcagccuccagugg

SEQ ID NO: 1082054 - RNA, 18 nt, Homo sapiens
agcuucucugaugugaua

SEQ ID NO: 1082055 - RNA, 15 nt, Homo sapiens
agcuucugcugggcu

SEQ ID NO: 1082056 - RNA, 17 nt, Homo sapiens
agcuugacuucaugcca

SEQ ID NO: 1082057 - RNA, 18 nt, Homo sapiens
aggaaagaccaugugguu

SEQ ID NO: 1082058 - RNA, 12 nt, Homo sapiens
aggaaagccaaa

SEQ ID NO: 1082059 - RNA, 16 nt, Homo sapiens
aggaaaggauuuuacc

SEQ ID NO: 1082060 - RNA, 23 nt, Homo sapiens
aggaacacccggaaagacugaaa

SEQ ID NO: 1082061 - RNA, 15 nt, Homo sapiens
aggaagggcauccuu

SEQ ID NO: 1082062 - RNA, 15 nt, Homo sapiens
aggacagguccugaa

SEQ ID NO: 1082063 - RNA, 16 nt, Homo sapiens
aggagagaacagggau

SEQ ID NO: 1082064 - RNA, 23 nt, Homo sapiens
aggaggugcuaucgcaccacugu

SEQ ID NO: 1082065 - RNA, 14 nt, Homo sapiens
aggagucuucacug

SEQ ID NO: 1082066 - RNA, 19 nt, Homo sapiens
aggauggucuugaucuccu

SEQ ID NO: 1082067 - RNA, 20 nt, Homo sapiens
aggcaaagagaaaagccacg

SEQ ID NO: 1082068 - RNA, 19 nt, Homo sapiens
aggcaagaaccaguguuua

SEQ ID NO: 1082069 - RNA, 19 nt, Homo sapiens
aggcagaucuuuaaauaca

SEQ ID NO: 1082070 - RNA, 16 nt, Homo sapiens
aggccacaccaucucc

SEQ ID NO: 1082071 - RNA, 12 nt, Homo sapiens
aggccacacugg

SEQ ID NO: 1082072 - RNA, 18 nt, Homo sapiens
aggcgggcggcacgccaa

SEQ ID NO: 1082073 - RNA, 18 nt, Homo sapiens
aggcggguggaucaccug

SEQ ID NO: 1082074 - RNA, 22 nt, Homo sapiens
aggcuccucaugaggccaugca

SEQ ID NO: 1082075 - RNA, 19 nt, Homo sapiens
aggcugaggggaggaucac

SEQ ID NO: 1082076 - RNA, 17 nt, Homo sapiens
aggcuggaguacaguga

SEQ ID NO: 1082077 - RNA, 19 nt, Homo sapiens
aggcuucaggggacuguuc

SEQ ID NO: 1082078 - RNA, 23 nt, Homo sapiens
aggcuucugcagcuuuggcugca

SEQ ID NO: 1082079 - RNA, 18 nt, Homo sapiens
agggaacaagcauucucc

SEQ ID NO: 1082080 - RNA, 16 nt, Homo sapiens
agggacagaagcagga

SEQ ID NO: 1082081 - RNA, 21 nt, Homo sapiens
agggagcaacucuccacucca

SEQ ID NO: 1082082 - RNA, 23 nt, Homo sapiens
agggcaacaauacaugcugcuaa

SEQ ID NO: 1082083 - RNA, 23 nt, Homo sapiens
agggcaccccagcugaccuggua

SEQ ID NO: 1082084 - RNA, 15 nt, Homo sapiens
agggccugcucugcu

SEQ ID NO: 1082085 - RNA, 20 nt, Homo sapiens
agggccuucuccacagggac

SEQ ID NO: 1082086 - RNA, 20 nt, Homo sapiens
aggggcugucucccaaugaa

SEQ ID NO: 1082087 - RNA, 17 nt, Homo sapiens
aggguauccugugcuau

SEQ ID NO: 1082088 - RNA, 19 nt, Homo sapiens
agguacucuggacuuucuc

SEQ ID NO: 1082089 - RNA, 15 nt, Homo sapiens
agguaguacugggaa

SEQ ID NO: 1082090 - RNA, 18 nt, Homo sapiens
aggucauuauuuuuuaca

SEQ ID NO: 1082091 - RNA, 14 nt, Homo sapiens
aggucucacacucc

SEQ ID NO: 1082092 - RNA, 14 nt, Homo sapiens
agguucugcacucc

SEQ ID NO: 1082093 - RNA, 20 nt, Homo sapiens
agguugaggggcuccuggaa

SEQ ID NO: 1082094 - RNA, 16 nt, Homo sapiens
aguaaaaucaaaugug

SEQ ID NO: 1082095 - RNA, 17 nt, Homo sapiens
aguaaaaucaaaugugc

SEQ ID NO: 1082096 - RNA, 20 nt, Homo sapiens
aguaaaaucaaaugugcauc

SEQ ID NO: 1082097 - RNA, 12 nt, Homo sapiens
aguaaacugugc

SEQ ID NO: 1082098 - RNA, 12 nt, Homo sapiens
aguaaacuuucu

SEQ ID NO: 1082099 - RNA, 19 nt, Homo sapiens
aguaauaaacgucuugcca

SEQ ID NO: 1082100 - RNA, 12 nt, Homo sapiens
aguagcauauau

SEQ ID NO: 1082101 - RNA, 20 nt, Homo sapiens
aguagcugggacuacaggca

SEQ ID NO: 1082102 - RNA, 14 nt, Homo sapiens
aguagugucuuccu

SEQ ID NO: 1082103 - RNA, 18 nt, Homo sapiens
aguauaguuuugacagag

SEQ ID NO: 1082104 - RNA, 17 nt, Homo sapiens
aguauuuggggucauau

SEQ ID NO: 1082105 - RNA, 20 nt, Homo sapiens
agucaauuaaaggcuuucag

SEQ ID NO: 1082106 - RNA, 21 nt, Homo sapiens
agucaccccucuguccagcca

SEQ ID NO: 1082107 - RNA, 21 nt, Homo sapiens
agucauugucgcucagcaaua

SEQ ID NO: 1082108 - RNA, 22 nt, Homo sapiens
aguccaaccugccugugcauga

SEQ ID NO: 1082109 - RNA, 19 nt, Homo sapiens
aguccucguagccaucucu

SEQ ID NO: 1082110 - RNA, 13 nt, Homo sapiens
agucuaaaacaca

SEQ ID NO: 1082111 - RNA, 16 nt, Homo sapiens
agucucacucugucac

SEQ ID NO: 1082112 - RNA, 14 nt, Homo sapiens
agucucuucucaga

SEQ ID NO: 1082113 - RNA, 14 nt, Homo sapiens
agucugaugacaca

SEQ ID NO: 1082114 - RNA, 17 nt, Homo sapiens
agucuggcaaacaugug

SEQ ID NO: 1082115 - RNA, 18 nt, Homo sapiens
agugaaagagaguaccau

SEQ ID NO: 1082116 - RNA, 21 nt, Homo sapiens
agugacaagggcacaagcuca

SEQ ID NO: 1082117 - RNA, 24 nt, Homo sapiens
agugagacuuugaggguguauauu

SEQ ID NO: 1082118 - RNA, 17 nt, Homo sapiens
agugauauuguggguaa

SEQ ID NO: 1082119 - RNA, 18 nt, Homo sapiens
agugaugaaaauuugccu

SEQ ID NO: 1082120 - RNA, 17 nt, Homo sapiens
agugccaauauuucuga

SEQ ID NO: 1082121 - RNA, 14 nt, Homo sapiens
agugccuggcaagg

SEQ ID NO: 1082122 - RNA, 12 nt, Homo sapiens
agugcugcaauu

SEQ ID NO: 1082123 - RNA, 18 nt, Homo sapiens
agugcuucuuguaauauu

SEQ ID NO: 1082124 - RNA, 21 nt, Homo sapiens
aguggcucacgccuaugaucc

SEQ ID NO: 1082125 - RNA, 13 nt, Homo sapiens
agugggcauguau

SEQ ID NO: 1082126 - RNA, 16 nt, Homo sapiens
agugggucccacuucc

SEQ ID NO: 1082127 - RNA, 17 nt, Homo sapiens
agugggucccacuuccc

SEQ ID NO: 1082128 - RNA, 14 nt, Homo sapiens
agugucgugucugc

SEQ ID NO: 1082129 - RNA, 18 nt, Homo sapiens
agugucucuugacuggcu

SEQ ID NO: 1082130 - RNA, 18 nt, Homo sapiens
aguucauaauucaccaaa

SEQ ID NO: 1082131 - RNA, 20 nt, Homo sapiens
aguuccagauuguucugucc

SEQ ID NO: 1082132 - RNA, 22 nt, Homo sapiens
aguucccuccugcagccugacc

SEQ ID NO: 1082133 - RNA, 18 nt, Homo sapiens
aguugaccccuccugaac

SEQ ID NO: 1082134 - RNA, 22 nt, Homo sapiens
aguugaugcuacaaaacaccuu

SEQ ID NO: 1082135 - RNA, 21 nt, Homo sapiens
aguugauugcgagaauuuuca

SEQ ID NO: 1082136 - RNA, 19 nt, Homo sapiens
aguuguuuucccgagcaaa

SEQ ID NO: 1082137 - RNA, 18 nt, Homo sapiens
aguuuaauagauguuacu

SEQ ID NO: 1082138 - RNA, 22 nt, Homo sapiens
aguuuccagcuaagccugauga

SEQ ID NO: 1082139 - RNA, 17 nt, Homo sapiens
aguuuggaacucuaccc

SEQ ID NO: 1082140 - RNA, 18 nt, Homo sapiens
aguuugggugucugcuaa

SEQ ID NO: 1082141 - RNA, 15 nt, Homo sapiens
aguuuuccaggaaua

SEQ ID NO: 1082142 - RNA, 18 nt, Homo sapiens
aguuuucuuuccaaaauc

SEQ ID NO: 1082143 - RNA, 21 nt, Homo sapiens
aguuuuguuuguucacacucc

SEQ ID NO: 1082144 - RNA, 12 nt, Homo sapiens
auaaacuuugaa

SEQ ID NO: 1082145 - RNA, 21 nt, Homo sapiens
auaaaucaauucauuguguau

SEQ ID NO: 1082146 - RNA, 22 nt, Homo sapiens
auaaauccucagguaguacugg

SEQ ID NO: 1082147 - RNA, 14 nt, Homo sapiens
auaaauuacauuaa

SEQ ID NO: 1082148 - RNA, 19 nt, Homo sapiens
auaaccacccuagcuuuau

SEQ ID NO: 1082149 - RNA, 15 nt, Homo sapiens
auaacuuauuugccc

SEQ ID NO: 1082150 - RNA, 15 nt, Homo sapiens
auaagaaacaugaug

SEQ ID NO: 1082151 - RNA, 22 nt, Homo sapiens
auaaggaucuucccacuuugcc

SEQ ID NO: 1082152 - RNA, 19 nt, Homo sapiens
auacaaacaggugcuaaca

SEQ ID NO: 1082153 - RNA, 16 nt, Homo sapiens
auacaacugagucucg

SEQ ID NO: 1082154 - RNA, 20 nt, Homo sapiens
auacacuuuauuaauauaac

SEQ ID NO: 1082155 - RNA, 19 nt, Homo sapiens
auacagaaagugacaaggg

SEQ ID NO: 1082156 - RNA, 18 nt, Homo sapiens
auacaugcugcuaauuca

SEQ ID NO: 1082157 - RNA, 14 nt, Homo sapiens
auaccccauuugau

SEQ ID NO: 1082158 - RNA, 16 nt, Homo sapiens
auacggagccauguca

SEQ ID NO: 1082159 - RNA, 23 nt, Homo sapiens
auagacggguugaaagacaucaa

SEQ ID NO: 1082160 - RNA, 20 nt, Homo sapiens
auagagcuuucaaguacaug

SEQ ID NO: 1082161 - RNA, 13 nt, Homo sapiens
auagagguacaug

SEQ ID NO: 1082162 - RNA, 23 nt, Homo sapiens
auagcuauggaaggucuugcgca

SEQ ID NO: 1082163 - RNA, 20 nt, Homo sapiens
auaguauucaggugagcaau

SEQ ID NO: 1082164 - RNA, 11 nt, Homo sapiens
auagugccucu

SEQ ID NO: 1082165 - RNA, 17 nt, Homo sapiens
auauaacuuauuugccc

SEQ ID NO: 1082166 - RNA, 22 nt, Homo sapiens
auauagcucuacacaacaugua

SEQ ID NO: 1082167 - RNA, 16 nt, Homo sapiens
auauauaaugcaacaa

SEQ ID NO: 1082168 - RNA, 19 nt, Homo sapiens
auaucugagaaguguauau

SEQ ID NO: 1082169 - RNA, 16 nt, Homo sapiens
auaugggcucaaguca

SEQ ID NO: 1082170 - RNA, 12 nt, Homo sapiens
auauucccaugg

SEQ ID NO: 1082171 - RNA, 20 nt, Homo sapiens
auauuccgggugccauuccc

SEQ ID NO: 1082172 - RNA, 12 nt, Homo sapiens
auauuuacuacu

SEQ ID NO: 1082173 - RNA, 16 nt, Homo sapiens
auauuucuucaaguga

SEQ ID NO: 1082174 - RNA, 19 nt, Homo sapiens
auauuugugugaggacuuc

SEQ ID NO: 1082175 - RNA, 21 nt, Homo sapiens
aucaaaaagguuucugcacau

SEQ ID NO: 1082176 - RNA, 17 nt, Homo sapiens
auuuccuuugcgcaaac

SEQ ID NO: 1082177 - RNA, 21 nt, Homo sapiens
auuuccuuugcgcaaacuuua

SEQ ID NO: 1082178 - RNA, 20 nt, Homo sapiens
auuucuauguaugugccaau

SEQ ID NO: 1082179 - RNA, 21 nt, Homo sapiens
auuucuucaagugaguggcau

SEQ ID NO: 1082180 - RNA, 18 nt, Homo sapiens
auuugugugugugauaua

SEQ ID NO: 1082181 - RNA, 16 nt, Homo sapiens
auuuuaaggauaugau

SEQ ID NO: 1082182 - RNA, 13 nt, Homo sapiens
auuuuaauuaucu

SEQ ID NO: 1082183 - RNA, 13 nt, Homo sapiens
auuuuaccaaagc

SEQ ID NO: 1082184 - RNA, 23 nt, Homo sapiens
auuuuacuuccaugauacuuuaa

SEQ ID NO: 1082185 - RNA, 20 nt, Homo sapiens
auuuuauagucucaaaucaa

SEQ ID NO: 1082186 - RNA, 23 nt, Homo sapiens
auuuuauagucucaaaucaaaua

SEQ ID NO: 1082187 - RNA, 13 nt, Homo sapiens
auuuucagcauca

SEQ ID NO: 1082188 - RNA, 19 nt, Homo sapiens
auuuuccuuccuacacccu

SEQ ID NO: 1082189 - RNA, 19 nt, Homo sapiens
auuuugauaccagugagca

SEQ ID NO: 1082190 - RNA, 13 nt, Homo sapiens
auuuugcauuaga

SEQ ID NO: 1082191 - RNA, 22 nt, Homo sapiens
auuuuggaaaaaugucacugaa

SEQ ID NO: 1082192 - RNA, 16 nt, Homo sapiens
auuuuggacgugugag

SEQ ID NO: 1082193 - RNA, 13 nt, Homo sapiens
auuuuuaaagcaa

SEQ ID NO: 1082194 - RNA, 19 nt, Homo sapiens
auuuuuguacauuauguua

SEQ ID NO: 1082195 - RNA, 17 nt, Homo sapiens
caaaaccugacuugaaa

SEQ ID NO: 1082196 - RNA, 15 nt, Homo sapiens
caaaauguccagcuu

SEQ ID NO: 1082197 - RNA, 15 nt, Homo sapiens
caaacaccuuauuug

SEQ ID NO: 1082198 - RNA, 16 nt, Homo sapiens
caaacaggugcuaaca

SEQ ID NO: 1082199 - RNA, 15 nt, Homo sapiens
caaacuacauguaau

SEQ ID NO: 1082200 - RNA, 20 nt, Homo sapiens
caaagaaaacuuccaaaaag

SEQ ID NO: 1082201 - RNA, 13 nt, Homo sapiens
caaagaucucagc

SEQ ID NO: 1082202 - RNA, 13 nt, Homo sapiens
caaagcaaagcca

SEQ ID NO: 1082203 - RNA, 18 nt, Homo sapiens
caaagggcccacagugac

SEQ ID NO: 1082204 - RNA, 17 nt, Homo sapiens
caaagugcuaggauuac

SEQ ID NO: 1082205 - RNA, 17 nt, Homo sapiens
caaagugcugggauuac

SEQ ID NO: 1082206 - RNA, 20 nt, Homo sapiens
caaaguuuuaaaccuguuaa

SEQ ID NO: 1082207 - RNA, 14 nt, Homo sapiens
caaauacacuuuau

SEQ ID NO: 1082208 - RNA, 22 nt, Homo sapiens
caaauagggcaaagaaucaaca

SEQ ID NO: 1082209 - RNA, 13 nt, Homo sapiens
caaauauucuccu

SEQ ID NO: 1082210 - RNA, 18 nt, Homo sapiens
caaaucaaauacauacaa

SEQ ID NO: 1082211 - RNA, 13 nt, Homo sapiens
caaaugcuauuca

SEQ ID NO: 1082212 - RNA, 14 nt, Homo sapiens
caaaugcugugcaa

SEQ ID NO: 1082213 - RNA, 22 nt, Homo sapiens
caaaugcugugcaaacagugua

SEQ ID NO: 1082214 - RNA, 17 nt, Homo sapiens
caaauuucgagcauaag

SEQ ID NO: 1082215 - RNA, 14 nt, Homo sapiens
caacaagaaaagaa

SEQ ID NO: 1082216 - RNA, 15 nt, Homo sapiens
caacaaggugcacag

SEQ ID NO: 1082217 - RNA, 18 nt, Homo sapiens
caacagaaaccagaaaag

SEQ ID NO: 1082218 - RNA, 23 nt, Homo sapiens
caacagaaaccagaaaagcaaua

SEQ ID NO: 1082219 - RNA, 22 nt, Homo sapiens
caacaggcccuugguagagcug

SEQ ID NO: 1082220 - RNA, 16 nt, Homo sapiens
caacaucgcaauaguu

SEQ ID NO: 1082221 - RNA, 18 nt, Homo sapiens
caacccagccugagugca

SEQ ID NO: 1082222 - RNA, 18 nt, Homo sapiens
caaccugccugugcauga

SEQ ID NO: 1082223 - RNA, 23 nt, Homo sapiens
caacugugcuacacuugcaccug

SEQ ID NO: 1082224 - RNA, 18 nt, Homo sapiens
caagaagguuucuguccu

SEQ ID NO: 1082225 - RNA, 15 nt, Homo sapiens
caagaccccaaaggg

SEQ ID NO: 1082226 - RNA, 15 nt, Homo sapiens
caagacucugucuca

SEQ ID NO: 1082227 - RNA, 19 nt, Homo sapiens
caagagaucuuucuuucca

SEQ ID NO: 1082228 - RNA, 16 nt, Homo sapiens
caagaggcuccugucc

SEQ ID NO: 1082229 - RNA, 16 nt, Homo sapiens
caagagucucuccagc

SEQ ID NO: 1082230 - RNA, 17 nt, Homo sapiens
caagcaauuauugugcc

SEQ ID NO: 1082231 - RNA, 16 nt, Homo sapiens
caagcgugauuccugc

SEQ ID NO: 1082232 - RNA, 18 nt, Homo sapiens
caaggccucccacaguga

SEQ ID NO: 1082233 - RNA, 18 nt, Homo sapiens
caaggucucacacuccuc

SEQ ID NO: 1082234 - RNA, 17 nt, Homo sapiens
caaguagcugagauuac

SEQ ID NO: 1082235 - RNA, 21 nt, Homo sapiens
caaguaguagugucuuccuag

SEQ ID NO: 1082236 - RNA, 15 nt, Homo sapiens
caagucaacacucuu

SEQ ID NO: 1082237 - RNA, 14 nt, Homo sapiens
caauacaaccagcc

SEQ ID NO: 1082238 - RNA, 15 nt, Homo sapiens
caauacuguuuccau

SEQ ID NO: 1082239 - RNA, 20 nt, Homo sapiens
caauacuguuuccauuuuaa

SEQ ID NO: 1082240 - RNA, 22 nt, Homo sapiens
caauauuuccauguuucauuaa

SEQ ID NO: 1082241 - RNA, 16 nt, Homo sapiens
caaugcccuaccugcc

SEQ ID NO: 1082242 - RNA, 23 nt, Homo sapiens
caauggccaacuuauuguauucc

SEQ ID NO: 1082243 - RNA, 16 nt, Homo sapiens
caauucuccugccuca

SEQ ID NO: 1082244 - RNA, 14 nt, Homo sapiens
cacaaacaaauggc

SEQ ID NO: 1082245 - RNA, 20 nt, Homo sapiens
cacaaacaaauggcuguaaa

SEQ ID NO: 1082246 - RNA, 13 nt, Homo sapiens
cacaaacauaugu

SEQ ID NO: 1082247 - RNA, 17 nt, Homo sapiens
cacaaccuccuccucca

SEQ ID NO: 1082248 - RNA, 14 nt, Homo sapiens
cacaagcucagguc

SEQ ID NO: 1082249 - RNA, 12 nt, Homo sapiens
cacaauguugca

SEQ ID NO: 1082250 - RNA, 21 nt, Homo sapiens
cacaauuaacuccguuuccaa

SEQ ID NO: 1082251 - RNA, 12 nt, Homo sapiens
cacacacuccuu

SEQ ID NO: 1082252 - RNA, 18 nt, Homo sapiens
cacacugagacuugaauc

SEQ ID NO: 1082253 - RNA, 20 nt, Homo sapiens
cacacugagacuugaaucaa

SEQ ID NO: 1082254 - RNA, 16 nt, Homo sapiens
cacagagggcgcuccu

SEQ ID NO: 1082255 - RNA, 23 nt, Homo sapiens
cacagccgcagccucccucugac

SEQ ID NO: 1082256 - RNA, 17 nt, Homo sapiens
cacaggaggcuccguga

SEQ ID NO: 1082257 - RNA, 13 nt, Homo sapiens
cacagggacacag

SEQ ID NO: 1082258 - RNA, 16 nt, Homo sapiens
cacaggucuugcccaa

SEQ ID NO: 1082259 - RNA, 22 nt, Homo sapiens
cacagucuggugcccagacuca

SEQ ID NO: 1082260 - RNA, 23 nt, Homo sapiens
cacaguguuuccugaguagcagu

SEQ ID NO: 1082261 - RNA, 13 nt, Homo sapiens
cacauaguuugau

SEQ ID NO: 1082262 - RNA, 22 nt, Homo sapiens
cacauccaaccccccaccugcc

SEQ ID NO: 1082263 - RNA, 17 nt, Homo sapiens
cacauuaaguggcuuuu

SEQ ID NO: 1082264 - RNA, 20 nt, Homo sapiens
cacauuuugcauuagacaga

SEQ ID NO: 1082265 - RNA, 19 nt, Homo sapiens
caccaggcagcuccagcug

SEQ ID NO: 1082266 - RNA, 21 nt, Homo sapiens
caccagugccucagugcugca

SEQ ID NO: 1082267 - RNA, 19 nt, Homo sapiens
cacccaccuggauucccug

SEQ ID NO: 1082268 - RNA, 21 nt, Homo sapiens
cacccauaccagcuagaauca

SEQ ID NO: 1082269 - RNA, 13 nt, Homo sapiens
caccccaacaucu

SEQ ID NO: 1082270 - RNA, 17 nt, Homo sapiens
cacccccacuucaugcc

SEQ ID NO: 1082271 - RNA, 14 nt, Homo sapiens
caccccucugucca

SEQ ID NO: 1082272 - RNA, 20 nt, Homo sapiens
cacccuccuggccucauaca

SEQ ID NO: 1082273 - RNA, 20 nt, Homo sapiens
caccuaguggcuguccagug

SEQ ID NO: 1082274 - RNA, 17 nt, Homo sapiens
caccuccucugugauuu

SEQ ID NO: 1082275 - RNA, 18 nt, Homo sapiens
cacgugcacagcuuccug

SEQ ID NO: 1082276 - RNA, 19 nt, Homo sapiens
cacuaaacagacuauuuaa

SEQ ID NO: 1082277 - RNA, 23 nt, Homo sapiens
cacucucucucuguuaaagauca

SEQ ID NO: 1082278 - RNA, 15 nt, Homo sapiens
cacucuucuugagca

SEQ ID NO: 1082279 - RNA, 15 nt, Homo sapiens
cacugcaagcucugc

SEQ ID NO: 1082280 - RNA, 21 nt, Homo sapiens
cacugggugagagaggaauaa

SEQ ID NO: 1082281 - RNA, 13 nt, Homo sapiens
cacuguuucauga

SEQ ID NO: 1082282 - RNA, 12 nt, Homo sapiens
cacuuaccuuau

SEQ ID NO: 1082283 - RNA, 15 nt, Homo sapiens
cacuucauagaugag

SEQ ID NO: 1082284 - RNA, 16 nt, Homo sapiens
cacuuccccuccuacc

SEQ ID NO: 1082285 - RNA, 17 nt, Homo sapiens
cacuucucacaucuuau

SEQ ID NO: 1082286 - RNA, 18 nt, Homo sapiens
cacuugacuuugccacau

SEQ ID NO: 1082287 - RNA, 19 nt, Homo sapiens
cacuugggucuucccugua

SEQ ID NO: 1082288 - RNA, 22 nt, Homo sapiens
cacuuugaagguaauaaauaca

SEQ ID NO: 1082289 - RNA, 19 nt, Homo sapiens
cauugcaauagaaauccaa

SEQ ID NO: 1082290 - RNA, 13 nt, Homo sapiens
cauuuagauuuug

SEQ ID NO: 1082291 - RNA, 13 nt, Homo sapiens
cauuucuacugua

SEQ ID NO: 1082292 - RNA, 15 nt, Homo sapiens
cauuucuacuguaua

SEQ ID NO: 1082293 - RNA, 15 nt, Homo sapiens
cauuugccagauugc

SEQ ID NO: 1082294 - RNA, 13 nt, Homo sapiens
cauuugccaggau

SEQ ID NO: 1082295 - RNA, 15 nt, Homo sapiens
cauuugccuaauucc

SEQ ID NO: 1082296 - RNA, 15 nt, Homo sapiens
cauuuuauaucugga

SEQ ID NO: 1082297 - RNA, 14 nt, Homo sapiens
cauuuucaagugau

SEQ ID NO: 1082298 - RNA, 18 nt, Homo sapiens
cauuuucuugucaaugga

SEQ ID NO: 1082299 - RNA, 23 nt, Homo sapiens
cauuuuuaaaggacaaacaguga

SEQ ID NO: 1082300 - RNA, 16 nt, Homo sapiens
gccauggaauaaacca

SEQ ID NO: 1082301 - RNA, 14 nt, Homo sapiens
gccaugucaugugc

SEQ ID NO: 1082302 - RNA, 17 nt, Homo sapiens
gccauucccacuaagcu

SEQ ID NO: 1082303 - RNA, 20 nt, Homo sapiens
gcccacugccgaugcccaau

SEQ ID NO: 1082304 - RNA, 20 nt, Homo sapiens
gcccacuucauagaugagaa

SEQ ID NO: 1082305 - RNA, 23 nt, Homo sapiens
gcccagcaagaugaaacagggca

SEQ ID NO: 1082306 - RNA, 14 nt, Homo sapiens
gcccagccacugca

SEQ ID NO: 1082307 - RNA, 20 nt, Homo sapiens
gcccauuuuucuagacuguc

SEQ ID NO: 1082308 - RNA, 16 nt, Homo sapiens
gcccgaccccaucuca

SEQ ID NO: 1082309 - RNA, 16 nt, Homo sapiens
gcccuaguugugauca

SEQ ID NO: 1082310 - RNA, 20 nt, Homo sapiens
gcccuggcuggaguucagug

SEQ ID NO: 1082311 - RNA, 13 nt, Homo sapiens
gccgaugcccaau

SEQ ID NO: 1082312 - RNA, 13 nt, Homo sapiens
gccucagccucca

SEQ ID NO: 1082313 - RNA, 19 nt, Homo sapiens
gccuccacucccacuuccc

SEQ ID NO: 1082314 - RNA, 18 nt, Homo sapiens
gccucugcaaacuaagga

SEQ ID NO: 1082315 - RNA, 19 nt, Homo sapiens
gccugagucacccaugaag

SEQ ID NO: 1082316 - RNA, 15 nt, Homo sapiens
gccugaugauggaag

SEQ ID NO: 1082317 - RNA, 23 nt, Homo sapiens
gccugauggugcucacgacucuu

SEQ ID NO: 1082318 - RNA, 13 nt, Homo sapiens
gccugccuugaag

SEQ ID NO: 1082319 - RNA, 15 nt, Homo sapiens
gccuggcuucuggag

SEQ ID NO: 1082320 - RNA, 15 nt, Homo sapiens
gccuuaguuguuauc

SEQ ID NO: 1082321 - RNA, 23 nt, Homo sapiens
gccuucuccacagggacacaguc

SEQ ID NO: 1082322 - RNA, 20 nt, Homo sapiens
gccuucuccccuccaaguga

SEQ ID NO: 1082323 - RNA, 14 nt, Homo sapiens
gccuuugaggcaaa

SEQ ID NO: 1082324 - RNA, 18 nt, Homo sapiens
gccuuuuauaaaccucua

SEQ ID NO: 1082325 - RNA, 17 nt, Homo sapiens
gcgccuccuuccuugcu

SEQ ID NO: 1082326 - RNA, 15 nt, Homo sapiens
gcggaaccauagcug

SEQ ID NO: 1082327 - RNA, 16 nt, Homo sapiens
gcggaugcuggccaca

SEQ ID NO: 1082328 - RNA, 13 nt, Homo sapiens
gcguccccggcca

SEQ ID NO: 1082329 - RNA, 14 nt, Homo sapiens
gcgugccuguaauc

SEQ ID NO: 1082330 - RNA, 18 nt, Homo sapiens
gcgugucccucucggaag

SEQ ID NO: 1082331 - RNA, 22 nt, Homo sapiens
gcuaaaaugaaaaauagugugu

SEQ ID NO: 1082332 - RNA, 14 nt, Homo sapiens
gcuaagccugauga

SEQ ID NO: 1082333 - RNA, 20 nt, Homo sapiens
gcuaaucauuaagguauuau

SEQ ID NO: 1082334 - RNA, 22 nt, Homo sapiens
gcuaccaaaaacuagacauuau

SEQ ID NO: 1082335 - RNA, 18 nt, Homo sapiens
gcuagaucuaguucucaa

SEQ ID NO: 1082336 - RNA, 13 nt, Homo sapiens
gcuagcauuacca

SEQ ID NO: 1082337 - RNA, 13 nt, Homo sapiens
gcuaggauuacag

SEQ ID NO: 1082338 - RNA, 19 nt, Homo sapiens
gcuauacagaaaaaccaca

SEQ ID NO: 1082339 - RNA, 20 nt, Homo sapiens
gcuauaugccuuaagccaau

SEQ ID NO: 1082340 - RNA, 18 nt, Homo sapiens
gcucacacuacuugagaa

SEQ ID NO: 1082341 - RNA, 13 nt, Homo sapiens
gcucacauuccca

SEQ ID NO: 1082342 - RNA, 16 nt, Homo sapiens
gcuccaggcuccucau

SEQ ID NO: 1082343 - RNA, 14 nt, Homo sapiens
gcuccugcacaaau

SEQ ID NO: 1082344 - RNA, 12 nt, Homo sapiens
gcuccugugcag

SEQ ID NO: 1082345 - RNA, 16 nt, Homo sapiens
gcucuacccugcagcu

SEQ ID NO: 1082346 - RNA, 15 nt, Homo sapiens
gcucugagauuucac

SEQ ID NO: 1082347 - RNA, 13 nt, Homo sapiens
gcugaagucauug

SEQ ID NO: 1082348 - RNA, 14 nt, Homo sapiens
gcugacccagugug

SEQ ID NO: 1082349 - RNA, 12 nt, Homo sapiens
gcugaccuggua

SEQ ID NO: 1082350 - RNA, 15 nt, Homo sapiens
gcugaccugguacug

SEQ ID NO: 1082351 - RNA, 15 nt, Homo sapiens
gcugaggcaccagaa

SEQ ID NO: 1082352 - RNA, 20 nt, Homo sapiens
gcugcagugacgugcaccug

SEQ ID NO: 1082353 - RNA, 16 nt, Homo sapiens
gcugcauuugugucau

SEQ ID NO: 1082354 - RNA, 21 nt, Homo sapiens
gcugcccaggcuagagugcag

SEQ ID NO: 1082355 - RNA, 18 nt, Homo sapiens
gcugccuguauucucuau

SEQ ID NO: 1082356 - RNA, 19 nt, Homo sapiens
gcuggaaaagggcucagag

SEQ ID NO: 1082357 - RNA, 19 nt, Homo sapiens
gcuggacccauuugccagg

SEQ ID NO: 1082358 - RNA, 19 nt, Homo sapiens
gcuggaguacagugacacg

SEQ ID NO: 1082359 - RNA, 18 nt, Homo sapiens
gcuggcagccuccagugg

SEQ ID NO: 1082360 - RNA, 12 nt, Homo sapiens
gcuggccucuag

SEQ ID NO: 1082361 - RNA, 13 nt, Homo sapiens
gcuggcugcagug

SEQ ID NO: 1082362 - RNA, 20 nt, Homo sapiens
gcugggggagggacugcuga

SEQ ID NO: 1082363 - RNA, 22 nt, Homo sapiens
gcuguagcucccgagcuacucu

SEQ ID NO: 1082364 - RNA, 15 nt, Homo sapiens
gcuguauacaaacag

SEQ ID NO: 1082365 - RNA, 22 nt, Homo sapiens
gcuguccagugcccauuccuca

SEQ ID NO: 1082366 - RNA, 16 nt, Homo sapiens
gcugucggugugcugu

SEQ ID NO: 1082367 - RNA, 14 nt, Homo sapiens
gcuuacuaaugugc

SEQ ID NO: 1082368 - RNA, 18 nt, Homo sapiens
gcuuaggugccaggcugu

SEQ ID NO: 1082369 - RNA, 20 nt, Homo sapiens
gcuuauaaauggcaccacau

SEQ ID NO: 1082370 - RNA, 16 nt, Homo sapiens
gcuuccagaaaacccc

SEQ ID NO: 1082371 - RNA, 20 nt, Homo sapiens
gcuucccucugccugacccc

SEQ ID NO: 1082372 - RNA, 23 nt, Homo sapiens
gcuucucuugaaaacuugguaua

SEQ ID NO: 1082373 - RNA, 20 nt, Homo sapiens
gcuucugccucagcuuccca

SEQ ID NO: 1082374 - RNA, 23 nt, Homo sapiens
gcuugccuguaaucccagcacuu

SEQ ID NO: 1082375 - RNA, 23 nt, Homo sapiens
gcuugucaaauagcaaggccagg

SEQ ID NO: 1082376 - RNA, 14 nt, Homo sapiens
gcuuucccucccca

SEQ ID NO: 1082377 - RNA, 16 nt, Homo sapiens
gcuuuccucccaaagg

SEQ ID NO: 1082378 - RNA, 21 nt, Homo sapiens
gcuuucucagugucagcacuc

SEQ ID NO: 1082379 - RNA, 17 nt, Homo sapiens
gcuuucuuuccaauccu

SEQ ID NO: 1082380 - RNA, 15 nt, Homo sapiens
ggaaaccacacuucu

SEQ ID NO: 1082381 - RNA, 18 nt, Homo sapiens
ggaaaccugugaaagcug

SEQ ID NO: 1082382 - RNA, 16 nt, Homo sapiens
ggaaagcaucaccuca

SEQ ID NO: 1082383 - RNA, 22 nt, Homo sapiens
ggaaagcaucaccucaggccag

SEQ ID NO: 1082384 - RNA, 19 nt, Homo sapiens
ggaaaguuugggaagggau

SEQ ID NO: 1082385 - RNA, 11 nt, Homo sapiens
ggaaccugggg

SEQ ID NO: 1082386 - RNA, 23 nt, Homo sapiens
ggaagcauguacuguacuuccca

SEQ ID NO: 1082387 - RNA, 14 nt, Homo sapiens
ggaauaaagcccuu

SEQ ID NO: 1082388 - RNA, 13 nt, Homo sapiens
ggacagguccuga

SEQ ID NO: 1082389 - RNA, 17 nt, Homo sapiens
ggacaguccugggagaa

SEQ ID NO: 1082390 - RNA, 16 nt, Homo sapiens
ggacucaggccaguca

SEQ ID NO: 1082391 - RNA, 17 nt, Homo sapiens
ggacucagggacucagg

SEQ ID NO: 1082392 - RNA, 14 nt, Homo sapiens
ggacugacauuucu

SEQ ID NO: 1082393 - RNA, 14 nt, Homo sapiens
ggacuucugcaucu

SEQ ID NO: 1082394 - RNA, 17 nt, Homo sapiens
ggagaaugaagacuguu

SEQ ID NO: 1082395 - RNA, 13 nt, Homo sapiens
ggagacaugcucu

SEQ ID NO: 1082396 - RNA, 15 nt, Homo sapiens
ggagagaaguggcca

SEQ ID NO: 1082397 - RNA, 18 nt, Homo sapiens
ggagaugacagugaugcu

SEQ ID NO: 1082398 - RNA, 23 nt, Homo sapiens
ggagcaguaaacuuucucugcaa

SEQ ID NO: 1082399 - RNA, 15 nt, Homo sapiens
ggagucaccaugcaa

SEQ ID NO: 1082400 - RNA, 22 nt, Homo sapiens
ggauugggccaacaaggacuca

SEQ ID NO: 1082401 - RNA, 15 nt, Homo sapiens
ggauuuuaccaaagc

SEQ ID NO: 1082402 - RNA, 17 nt, Homo sapiens
ggauuuuaccaaagcau

SEQ ID NO: 1082403 - RNA, 22 nt, Homo sapiens
ggcaaagaacugccccaucucc

SEQ ID NO: 1082404 - RNA, 20 nt, Homo sapiens
ggcaacucacgggugcauga

SEQ ID NO: 1082405 - RNA, 12 nt, Homo sapiens
ggcaacugugag

SEQ ID NO: 1082406 - RNA, 19 nt, Homo sapiens
ggcaagaaugaaauacucu

SEQ ID NO: 1082407 - RNA, 17 nt, Homo sapiens
ggcaaugcagugcagca

SEQ ID NO: 1082408 - RNA, 19 nt, Homo sapiens
ggcacccuccaaacacugg

SEQ ID NO: 1082409 - RNA, 21 nt, Homo sapiens
ggcacuaagucaugguccugg

SEQ ID NO: 1082410 - RNA, 20 nt, Homo sapiens
ggcagugggucccacuuccc

SEQ ID NO: 1082411 - RNA, 13 nt, Homo sapiens
ggcauaccaaaau

SEQ ID NO: 1082412 - RNA, 14 nt, Homo sapiens
ggcaugacacucua

SEQ ID NO: 1082413 - RNA, 11 nt, Homo sapiens
ggcauuugccu

SEQ ID NO: 1082414 - RNA, 18 nt, Homo sapiens
ggccaacaaggacucaga

SEQ ID NO: 1082415 - RNA, 12 nt, Homo sapiens
ggccacacuggg

SEQ ID NO: 1082416 - RNA, 16 nt, Homo sapiens
ggccagcagcagauaa

SEQ ID NO: 1082417 - RNA, 12 nt, Homo sapiens
ggccagggcaca

SEQ ID NO: 1082418 - RNA, 22 nt, Homo sapiens
ggccaucuccucccaccagugg

SEQ ID NO: 1082419 - RNA, 13 nt, Homo sapiens
ggcccaacaggcc

SEQ ID NO: 1082420 - RNA, 14 nt, Homo sapiens
ggccccaacuacac

SEQ ID NO: 1082421 - RNA, 19 nt, Homo sapiens
ggcccccacccaccuggau

SEQ ID NO: 1082422 - RNA, 17 nt, Homo sapiens
ggccccuucuccagcaa

SEQ ID NO: 1082423 - RNA, 19 nt, Homo sapiens
gugcaguggcgugaucucg

SEQ ID NO: 1082424 - RNA, 17 nt, Homo sapiens
gugcuaucgcaccacug

SEQ ID NO: 1082425 - RNA, 21 nt, Homo sapiens
gugcuccucggcagaugcugu

SEQ ID NO: 1082426 - RNA, 15 nt, Homo sapiens
gcaaacaugugcaac

SEQ ID NO: 1082427 - RNA, 15 nt, Homo sapiens
gcaaagaaucaacag

SEQ ID NO: 1082428 - RNA, 18 nt, Homo sapiens
gcaagaaccaguguuuag

SEQ ID NO: 1082429 - RNA, 14 nt, Homo sapiens
gcaagggugcugug

SEQ ID NO: 1082430 - RNA, 18 nt, Homo sapiens
gcaauaaggaucuuccca

SEQ ID NO: 1082431 - RNA, 21 nt, Homo sapiens
gcaauagggugcaguuuucca

SEQ ID NO: 1082432 - RNA, 15 nt, Homo sapiens
gcaaucuaugacuca

SEQ ID NO: 1082433 - RNA, 22 nt, Homo sapiens
gcaauggcacgaucucagcuca

SEQ ID NO: 1082434 - RNA, 14 nt, Homo sapiens
gcacaaaugcaccu

SEQ ID NO: 1082435 - RNA, 18 nt, Homo sapiens
gcacagggaacaagcauu

SEQ ID NO: 1082436 - RNA, 17 nt, Homo sapiens
gcaccaaagacaucagu

SEQ ID NO: 1082437 - RNA, 15 nt, Homo sapiens
gcaccacuguguauu

SEQ ID NO: 1082438 - RNA, 18 nt, Homo sapiens
gcaccccagcugaccugg

SEQ ID NO: 1082439 - RNA, 20 nt, Homo sapiens
gcaccccagcugaccuggua

SEQ ID NO: 1082440 - RNA, 22 nt, Homo sapiens
gcaccgagagagauggaauaaa

SEQ ID NO: 1082441 - RNA, 16 nt, Homo sapiens
gcaccugccuagcucu

SEQ ID NO: 1082442 - RNA, 16 nt, Homo sapiens
gcacuagaucauggga

SEQ ID NO: 1082443 - RNA, 20 nt, Homo sapiens
gcacucggcuucccaauguu

SEQ ID NO: 1082444 - RNA, 22 nt, Homo sapiens
gcacugauaucaucgauuagaa

SEQ ID NO: 1082445 - RNA, 21 nt, Homo sapiens
gcagagcccucaugugacaug

SEQ ID NO: 1082446 - RNA, 12 nt, Homo sapiens
gcagcacaggag

SEQ ID NO: 1082447 - RNA, 15 nt, Homo sapiens
aaaaugaauuugacu

SEQ ID NO: 1082448 - RNA, 14 nt, Homo sapiens
aaaaugcagccuua

SEQ ID NO: 1082449 - RNA, 20 nt, Homo sapiens
aaaaugggaauucugacuua

SEQ ID NO: 1082450 - RNA, 15 nt, Homo sapiens
aaaauguaaugauca

SEQ ID NO: 1082451 - RNA, 15 nt, Homo sapiens
aaaaugugucugcaa

SEQ ID NO: 1082452 - RNA, 20 nt, Homo sapiens
aaaaugugucugcaacaugg

SEQ ID NO: 1082453 - RNA, 15 nt, Homo sapiens
aaaauguuggugcaa

SEQ ID NO: 1082454 - RNA, 22 nt, Homo sapiens
aaacaauguuuuaaacauucuu

SEQ ID NO: 1082455 - RNA, 13 nt, Homo sapiens
aaacaccaaaaau

SEQ ID NO: 1082456 - RNA, 18 nt, Homo sapiens
aaacacugggcucugagg

SEQ ID NO: 1082457 - RNA, 16 nt, Homo sapiens
aaacaucuuaguugau

SEQ ID NO: 1082458 - RNA, 16 nt, Homo sapiens
aaacaugaaaacauug

SEQ ID NO: 1082459 - RNA, 18 nt, Homo sapiens
aaacaugaaaacauugau

SEQ ID NO: 1082460 - RNA, 22 nt, Homo sapiens
aaacaugcagaagauguuuaaa

SEQ ID NO: 1082461 - RNA, 11 nt, Homo sapiens
aaaccaugacg

SEQ ID NO: 1082462 - RNA, 13 nt, Homo sapiens
aaaccccaucucu

SEQ ID NO: 1082463 - RNA, 16 nt, Homo sapiens
aaagaaaaucaaugaa

SEQ ID NO: 1082464 - RNA, 15 nt, Homo sapiens
aaagaaauugugaaa

SEQ ID NO: 1082465 - RNA, 20 nt, Homo sapiens
aaagaaggugccgauuucau

SEQ ID NO: 1082466 - RNA, 11 nt, Homo sapiens
aaagacaucag

SEQ ID NO: 1082467 - RNA, 17 nt, Homo sapiens
aaagacaucagucucca

SEQ ID NO: 1082468 - RNA, 22 nt, Homo sapiens
aaagaucucagcagccagcucc

SEQ ID NO: 1082469 - RNA, 18 nt, Homo sapiens
aaagaugugcucccacca

SEQ ID NO: 1082470 - RNA, 13 nt, Homo sapiens
aaagcaguauuug

SEQ ID NO: 1082471 - RNA, 18 nt, Homo sapiens
aaagccaaacucugccag

SEQ ID NO: 1082472 - RNA, 17 nt, Homo sapiens
aaagcccuugaaccagc

SEQ ID NO: 1082473 - RNA, 17 nt, Homo sapiens
aaaggacaaacagugaa

SEQ ID NO: 1082474 - RNA, 22 nt, Homo sapiens
aaaggcauccauagugcacuag

SEQ ID NO: 1082475 - RNA, 17 nt, Homo sapiens
aaaggggaaauacuuag

SEQ ID NO: 1082476 - RNA, 13 nt, Homo sapiens
aaagguaggugca

SEQ ID NO: 1082477 - RNA, 22 nt, Homo sapiens
aaaguaugccuuccuguuuaaa

SEQ ID NO: 1082478 - RNA, 16 nt, Homo sapiens
aaagugauccauacuu

SEQ ID NO: 1082479 - RNA, 13 nt, Homo sapiens
aaauagauuucag

SEQ ID NO: 1082480 - RNA, 14 nt, Homo sapiens
aaauagcauucucu

SEQ ID NO: 1082481 - RNA, 12 nt, Homo sapiens
aaauaugugaaa

SEQ ID NO: 1082482 - RNA, 22 nt, Homo sapiens
aaauaugugcuugaaaugagaa

SEQ ID NO: 1082483 - RNA, 17 nt, Homo sapiens
aaaucaauucauugugu

SEQ ID NO: 1082484 - RNA, 19 nt, Homo sapiens
aaaucagauuuucuccugu

SEQ ID NO: 1082485 - RNA, 13 nt, Homo sapiens
aaaucccaagugu

SEQ ID NO: 1082486 - RNA, 15 nt, Homo sapiens
aaaugcagccuuaaa

SEQ ID NO: 1082487 - RNA, 20 nt, Homo sapiens
aaaugcaggagagcuucccc

SEQ ID NO: 1082488 - RNA, 20 nt, Homo sapiens
aaaugcugugcaaacagugu

SEQ ID NO: 1082489 - RNA, 21 nt, Homo sapiens
aaauggcuguaaaacuaaaca

SEQ ID NO: 1082490 - RNA, 22 nt, Homo sapiens
aaauguccuccaacaauaaaga

SEQ ID NO: 1082491 - RNA, 17 nt, Homo sapiens
aaaugugucugcaacau

SEQ ID NO: 1082492 - RNA, 13 nt, Homo sapiens
aaauuacauuaaa

SEQ ID NO: 1082493 - RNA, 17 nt, Homo sapiens
aaauucacuguugaaug

SEQ ID NO: 1082494 - RNA, 15 nt, Homo sapiens
aaauuucucuacugu

SEQ ID NO: 1082495 - RNA, 18 nt, Homo sapiens
aaauuuuacugacagaaa

SEQ ID NO: 1082496 - RNA, 14 nt, Homo sapiens
aaauuuuuuuccag

SEQ ID NO: 1082497 - RNA, 13 nt, Homo sapiens
aacaaaaggcuuu

SEQ ID NO: 1082498 - RNA, 22 nt, Homo sapiens
aacaaacacuuagcaucccaca

SEQ ID NO: 1082499 - RNA, 15 nt, Homo sapiens
aacaaacuacaugua

SEQ ID NO: 1082500 - RNA, 14 nt, Homo sapiens
aacaaauuagcaau

SEQ ID NO: 1082501 - RNA, 15 nt, Homo sapiens
aacaaggugcacaga

SEQ ID NO: 1082502 - RNA, 20 nt, Homo sapiens
aacaauacgugaaagaugca

SEQ ID NO: 1082503 - RNA, 17 nt, Homo sapiens
aacaauccaaaugcauu

SEQ ID NO: 1082504 - RNA, 19 nt, Homo sapiens
aacaauguuuuaaacauuc

SEQ ID NO: 1082505 - RNA, 14 nt, Homo sapiens
aacacaguguuucc

SEQ ID NO: 1082506 - RNA, 18 nt, Homo sapiens
aacacugggcucugagga

SEQ ID NO: 1082507 - RNA, 14 nt, Homo sapiens
aacagcaaagccau

SEQ ID NO: 1082508 - RNA, 18 nt, Homo sapiens
aacauaagauauuguaca

SEQ ID NO: 1082509 - RNA, 19 nt, Homo sapiens
aacaucuuaguugaugcua

SEQ ID NO: 1082510 - RNA, 20 nt, Homo sapiens
aacaugaaaaacacggcagc

SEQ ID NO: 1082511 - RNA, 20 nt, Homo sapiens
aacaugaaaacauugaugaa

SEQ ID NO: 1082512 - RNA, 22 nt, Homo sapiens
aacaugguaaaaccccaucucu

SEQ ID NO: 1082513 - RNA, 15 nt, Homo sapiens
aaccaacccauguau

SEQ ID NO: 1082514 - RNA, 13 nt, Homo sapiens
aaccauccaucug

SEQ ID NO: 1082515 - RNA, 18 nt, Homo sapiens
aaccaucgguccacaccu

SEQ ID NO: 1082516 - RNA, 17 nt, Homo sapiens
aacccaucuucacgccu

SEQ ID NO: 1082517 - RNA, 12 nt, Homo sapiens
aaccccaucucu

SEQ ID NO: 1082518 - RNA, 22 nt, Homo sapiens
aaccccucccccacgucucucu

SEQ ID NO: 1082519 - RNA, 18 nt, Homo sapiens
aaccgacuuuucuaaagc

SEQ ID NO: 1082520 - RNA, 13 nt, Homo sapiens
aaccgugugcucc

SEQ ID NO: 1082521 - RNA, 15 nt, Homo sapiens
aaccgugugcuccuc

SEQ ID NO: 1082522 - RNA, 20 nt, Homo sapiens
aaccucccccccaaauacuc

SEQ ID NO: 1082523 - RNA, 18 nt, Homo sapiens
aaccucucuucuaccuua

SEQ ID NO: 1082524 - RNA, 13 nt, Homo sapiens
aaccugugucuua

SEQ ID NO: 1082525 - RNA, 17 nt, Homo sapiens
aaccuucuaauccaugu

SEQ ID NO: 1082526 - RNA, 20 nt, Homo sapiens
aacgugaugcuaugcauguc

SEQ ID NO: 1082527 - RNA, 22 nt, Homo sapiens
aacuaccagugggcauguauua

SEQ ID NO: 1082528 - RNA, 21 nt, Homo sapiens
aacuauuggagggugggagag

SEQ ID NO: 1082529 - RNA, 13 nt, Homo sapiens
aacucccacuccu

SEQ ID NO: 1082530 - RNA, 20 nt, Homo sapiens
aacucccuccucacacucca

SEQ ID NO: 1082531 - RNA, 13 nt, Homo sapiens
aacuccuguucuu

SEQ ID NO: 1082532 - RNA, 14 nt, Homo sapiens
aacugagaugcuga

SEQ ID NO: 1082533 - RNA, 19 nt, Homo sapiens
aacuguuguguccaauccc

SEQ ID NO: 1082534 - RNA, 20 nt, Homo sapiens
aacuuccaaaaagauuuauu

SEQ ID NO: 1082535 - RNA, 18 nt, Homo sapiens
aacuugauucuugugauu

SEQ ID NO: 1082536 - RNA, 18 nt, Homo sapiens
aagaacugccccaucucc

SEQ ID NO: 1082537 - RNA, 17 nt, Homo sapiens
aagaauuccaaccgacc

SEQ ID NO: 1082538 - RNA, 21 nt, Homo sapiens
aagacaaauugaucagugcuu

SEQ ID NO: 1082539 - RNA, 15 nt, Homo sapiens
aagacaucaaugaaa

SEQ ID NO: 1082540 - RNA, 13 nt, Homo sapiens
acacacucugcau

SEQ ID NO: 1082541 - RNA, 19 nt, Homo sapiens
acacagacucugugagauu

SEQ ID NO: 1082542 - RNA, 19 nt, Homo sapiens
acacaguguuuccugagua

SEQ ID NO: 1082543 - RNA, 17 nt, Homo sapiens
acacauuuggcaguuua

SEQ ID NO: 1082544 - RNA, 23 nt, Homo sapiens
acacccaagaagaaaugcuuucc

SEQ ID NO: 1082545 - RNA, 19 nt, Homo sapiens
acacccagucuguucccca

SEQ ID NO: 1082546 - RNA, 18 nt, Homo sapiens
acacucuagugacuuccu

SEQ ID NO: 1082547 - RNA, 23 nt, Homo sapiens
acacugagacuugaaucaaguca

SEQ ID NO: 1082548 - RNA, 12 nt, Homo sapiens
acacugugaugu

SEQ ID NO: 1082549 - RNA, 16 nt, Homo sapiens
acagaaaggccacuca

SEQ ID NO: 1082550 - RNA, 20 nt, Homo sapiens
acagaacacacugagacuug

SEQ ID NO: 1082551 - RNA, 15 nt, Homo sapiens
acagacucugugaga

SEQ ID NO: 1082552 - RNA, 13 nt, Homo sapiens
acagacugugagu

SEQ ID NO: 1082553 - RNA, 22 nt, Homo sapiens
acagacugugaguacagcagaa

SEQ ID NO: 1082554 - RNA, 18 nt, Homo sapiens
acagagaugugcaugugg

SEQ ID NO: 1082555 - RNA, 20 nt, Homo sapiens
acagagcaagacucugucuc

SEQ ID NO: 1082556 - RNA, 21 nt, Homo sapiens
acagaguaaauagcauucucu

SEQ ID NO: 1082557 - RNA, 20 nt, Homo sapiens
acagaugcuggccucuuggc

SEQ ID NO: 1082558 - RNA, 13 nt, Homo sapiens
acagcucuuguuu

SEQ ID NO: 1082559 - RNA, 15 nt, Homo sapiens
acaggcucugagauu

SEQ ID NO: 1082560 - RNA, 16 nt, Homo sapiens
acagggacacagucug

SEQ ID NO: 1082561 - RNA, 23 nt, Homo sapiens
acaguaaauaaauuguuugacca

SEQ ID NO: 1082562 - RNA, 19 nt, Homo sapiens
acaguaugucuacuccuca

SEQ ID NO: 1082563 - RNA, 14 nt, Homo sapiens
uuugaggguguaua

SEQ ID NO: 1082564 - RNA, 14 nt, Homo sapiens
uuugauaaagcagu

SEQ ID NO: 1082565 - RNA, 12 nt, Homo sapiens
uuugauaccagu

SEQ ID NO: 1082566 - RNA, 22 nt, Homo sapiens
uuugcaaaggacuguaagcaga

SEQ ID NO: 1082567 - RNA, 18 nt, Homo sapiens
uuugcaacaagacaaagc

SEQ ID NO: 1082568 - RNA, 15 nt, Homo sapiens
uuugggggcuucccu

SEQ ID NO: 1082569 - RNA, 20 nt, Homo sapiens
uuuguaacuacccucucaaa

SEQ ID NO: 1082570 - RNA, 20 nt, Homo sapiens
uuuguauuugggccaguuga

SEQ ID NO: 1082571 - RNA, 21 nt, Homo sapiens
uuugugcuucuccuaacucaa

SEQ ID NO: 1082572 - RNA, 14 nt, Homo sapiens
uuuguuagcaaaga

SEQ ID NO: 1082573 - RNA, 22 nt, Homo sapiens
uuuuaaaguauguuauugcaua

SEQ ID NO: 1082574 - RNA, 17 nt, Homo sapiens
uuuuacgcuuugcagac

SEQ ID NO: 1082575 - RNA, 15 nt, Homo sapiens
uuuuauuggagauca

SEQ ID NO: 1082576 - RNA, 18 nt, Homo sapiens
uuuuauuuccacauaaag

SEQ ID NO: 1082577 - RNA, 17 nt, Homo sapiens
uuuucaacaaguaacuu

SEQ ID NO: 1082578 - RNA, 19 nt, Homo sapiens
uuuucucuaugaaaagcaa

SEQ ID NO: 1082579 - RNA, 23 nt, Homo sapiens
uuuucucuccuaagacaccugca

SEQ ID NO: 1082580 - RNA, 13 nt, Homo sapiens
uuuugcacauucu

SEQ ID NO: 1082581 - RNA, 19 nt, Homo sapiens
uuuugguuccucacauauu

SEQ ID NO: 1082582 - RNA, 16 nt, Homo sapiens
uuuuuaaaaaaguaag

SEQ ID NO: 1082583 - RNA, 23 nt, Homo sapiens
uuuuuauaaaaaauggugccuga

SEQ ID NO: 1082584 - RNA, 17 nt, Homo sapiens
uuuuucccccacugcga

SEQ ID NO: 1082585 - RNA, 12 nt, Homo sapiens
uacacaacaugu

SEQ ID NO: 1082586 - RNA, 20 nt, Homo sapiens
uacacuccagccugagcaac

SEQ ID NO: 1082587 - RNA, 23 nt, Homo sapiens
uacacuuuauuaauauaaccaua

SEQ ID NO: 1082588 - RNA, 16 nt, Homo sapiens
uacacuuugaaguauu

SEQ ID NO: 1082589 - RNA, 15 nt, Homo sapiens
uacagaucauauaag

SEQ ID NO: 1082590 - RNA, 16 nt, Homo sapiens
uacauacaaccuaugu

SEQ ID NO: 1082591 - RNA, 13 nt, Homo sapiens
uacauguaaucca

SEQ ID NO: 1082592 - RNA, 21 nt, Homo sapiens
uacauugggcacauaucuccu

SEQ ID NO: 1082593 - RNA, 14 nt, Homo sapiens
uacauuucauacaa

SEQ ID NO: 1082594 - RNA, 22 nt, Homo sapiens
uaccaaaaauaucccuuuuuca

SEQ ID NO: 1082595 - RNA, 14 nt, Homo sapiens
uaccaaagcaucaa

SEQ ID NO: 1082596 - RNA, 23 nt, Homo sapiens
uacccauccaacuccucuaguca

SEQ ID NO: 1082597 - RNA, 19 nt, Homo sapiens
uacccuugguuugcacaua

SEQ ID NO: 1082598 - RNA, 13 nt, Homo sapiens
uaccucagccuag

SEQ ID NO: 1082599 - RNA, 15 nt, Homo sapiens
uacgauccugcaggg

SEQ ID NO: 1082600 - RNA, 23 nt, Homo sapiens
uacggagccaugucaugugccac

SEQ ID NO: 1082601 - RNA, 16 nt, Homo sapiens
uacuagcaggaauauu

SEQ ID NO: 1082602 - RNA, 10 nt, Homo sapiens
uacucucuua

SEQ ID NO: 1082603 - RNA, 18 nt, Homo sapiens
uacucuuaaaugagaaag

SEQ ID NO: 1082604 - RNA, 14 nt, Homo sapiens
uacugaagugcagc

SEQ ID NO: 1082605 - RNA, 20 nt, Homo sapiens
uacugcacauuuuguacaaa

SEQ ID NO: 1082606 - RNA, 16 nt, Homo sapiens
uacuguuccaaaaaga

SEQ ID NO: 1082607 - RNA, 16 nt, Homo sapiens
uacuucccaauugcca

SEQ ID NO: 1082608 - RNA, 17 nt, Homo sapiens
uacuuuuuaaacagugu

SEQ ID NO: 1082609 - RNA, 14 nt, Homo sapiens
uagaaaugagccag

SEQ ID NO: 1082610 - RNA, 22 nt, Homo sapiens
uagaaccucgagguuucucaaa

SEQ ID NO: 1082611 - RNA, 18 nt, Homo sapiens
uagaaucaagucugugaa

SEQ ID NO: 1082612 - RNA, 23 nt, Homo sapiens
uagacccucuauuuaccugcgaa

SEQ ID NO: 1082613 - RNA, 18 nt, Homo sapiens
uagagauaugcagaagga

SEQ ID NO: 1082614 - RNA, 19 nt, Homo sapiens
uagagcacuuuucacuuau

SEQ ID NO: 1082615 - RNA, 12 nt, Homo sapiens
uagaggagcaac

SEQ ID NO: 1082616 - RNA, 18 nt, Homo sapiens
uagaggcaaagaacaauu

SEQ ID NO: 1082617 - RNA, 23 nt, Homo sapiens
uagcaaagauuaaaugugucauu

SEQ ID NO: 1082618 - RNA, 18 nt, Homo sapiens
uaggauaaauuacauuaa

SEQ ID NO: 1082619 - RNA, 21 nt, Homo sapiens
uaggaucugucaaagaaaacu

SEQ ID NO: 1082620 - RNA, 15 nt, Homo sapiens
uaggcagggauuuga

SEQ ID NO: 1082621 - RNA, 18 nt, Homo sapiens
ggaggagagaaguggcca

SEQ ID NO: 1082622 - RNA, 20 nt, Homo sapiens
ggaggcuccgugagcccuug

SEQ ID NO: 1082623 - RNA, 16 nt, Homo sapiens
ggagucaccaugcaag

SEQ ID NO: 1082624 - RNA, 14 nt, Homo sapiens
ggagugcugcagcu

SEQ ID NO: 1082625 - RNA, 21 nt, Homo sapiens
ggaucagccuccgccauucca

SEQ ID NO: 1082626 - RNA, 20 nt, Homo sapiens
ggaucuucccacuuugccac

SEQ ID NO: 1082627 - RNA, 17 nt, Homo sapiens
ggauggucuugaucucc

SEQ ID NO: 1082628 - RNA, 14 nt, Homo sapiens
ggaugugugucuca

SEQ ID NO: 1082629 - RNA, 15 nt, Homo sapiens
ggauuuaccaaauag

SEQ ID NO: 1082630 - RNA, 14 nt, Homo sapiens
ggauuuuaccaaag

SEQ ID NO: 1082631 - RNA, 24 nt, Homo sapiens
ggcaaagaucucagcagccagcuc

SEQ ID NO: 1082632 - RNA, 16 nt, Homo sapiens
ggcaacaaggugcaca

SEQ ID NO: 1082633 - RNA, 23 nt, Homo sapiens
ggcaacaaggugcacagaccuca

SEQ ID NO: 1082634 - RNA, 21 nt, Homo sapiens
ggcaacccucagcugccucau

SEQ ID NO: 1082635 - RNA, 15 nt, Homo sapiens
ggcaaccuguugaau

SEQ ID NO: 1082636 - RNA, 18 nt, Homo sapiens
ggcacgaucucagcucac

SEQ ID NO: 1082637 - RNA, 16 nt, Homo sapiens
ggcacgccaacagccc

SEQ ID NO: 1082638 - RNA, 14 nt, Homo sapiens
ggcagaaugaaaag

SEQ ID NO: 1082639 - RNA, 22 nt, Homo sapiens
ggcagcuguagcucccgagcua

SEQ ID NO: 1082640 - RNA, 18 nt, Homo sapiens
ggcaggagucaccaugca

SEQ ID NO: 1082641 - RNA, 20 nt, Homo sapiens
ggcauaucuuguuguucagu

SEQ ID NO: 1082642 - RNA, 22 nt, Homo sapiens
ggcauccuggcuggcugugucc

SEQ ID NO: 1082643 - RNA, 19 nt, Homo sapiens
ggccaagguuucccaguga

SEQ ID NO: 1082644 - RNA, 14 nt, Homo sapiens
ggccacacugggcu

SEQ ID NO: 1082645 - RNA, 21 nt, Homo sapiens
ggccauggaauaaaccauuuu

SEQ ID NO: 1082646 - RNA, 17 nt, Homo sapiens
ggccucccacagugacu

SEQ ID NO: 1082647 - RNA, 17 nt, Homo sapiens
ggccuggcaagugggug

SEQ ID NO: 1082648 - RNA, 20 nt, Homo sapiens
ggccuugaagaggcaggucu

SEQ ID NO: 1082649 - RNA, 14 nt, Homo sapiens
ggcugcaguucccu

SEQ ID NO: 1082650 - RNA, 21 nt, Homo sapiens
ggcugggggagggacugcuga

SEQ ID NO: 1082651 - RNA, 18 nt, Homo sapiens
ggcugucggugugcuguc

SEQ ID NO: 1082652 - RNA, 21 nt, Homo sapiens
ggcuuucuuuucucuaugaaa

SEQ ID NO: 1082653 - RNA, 21 nt, Homo sapiens
gggaucccagcaucucagagu

SEQ ID NO: 1082654 - RNA, 22 nt, Homo sapiens
gggaugcugccugagucaccca

SEQ ID NO: 1082655 - RNA, 11 nt, Homo sapiens
gggcacagcug

SEQ ID NO: 1082656 - RNA, 22 nt, Homo sapiens
gggcacccccaaauucaaagaa

SEQ ID NO: 1082657 - RNA, 22 nt, Homo sapiens
gggcaugcuggggcaagucccu

SEQ ID NO: 1082658 - RNA, 15 nt, Homo sapiens
gggccccauuugcca

SEQ ID NO: 1082659 - RNA, 17 nt, Homo sapiens
gggccccucagggcugu

SEQ ID NO: 1082660 - RNA, 16 nt, Homo sapiens
ggggcucugugcaggg

SEQ ID NO: 1082661 - RNA, 18 nt, Homo sapiens
ggguaugggaagccauau

SEQ ID NO: 1082662 - RNA, 23 nt, Homo sapiens
ggguauuguuaggagaugucauc

SEQ ID NO: 1082663 - RNA, 14 nt, Homo sapiens
gguaaacauucucu

SEQ ID NO: 1082664 - RNA, 14 nt, Homo sapiens
gguagacugugaca

SEQ ID NO: 1082665 - RNA, 23 nt, Homo sapiens
gguagcugaugaggaucagagcg

SEQ ID NO: 1082666 - RNA, 14 nt, Homo sapiens
gguaguacugggaa

SEQ ID NO: 1082667 - RNA, 21 nt, Homo sapiens
ggucuuuuacauacagugaua

SEQ ID NO: 1082668 - RNA, 19 nt, Homo sapiens
ggugauuucuagaaugguu

SEQ ID NO: 1082669 - RNA, 13 nt, Homo sapiens
ggugcaugccuuc

SEQ ID NO: 1082670 - RNA, 16 nt, Homo sapiens
ggugcucacgacucuu

SEQ ID NO: 1082671 - RNA, 17 nt, Homo sapiens
gguguuacuaaagucac

SEQ ID NO: 1082672 - RNA, 14 nt, Homo sapiens
gguugggcugagac

SEQ ID NO: 1082673 - RNA, 14 nt, Homo sapiens
gguuuaaaagucac

SEQ ID NO: 1082674 - RNA, 21 nt, Homo sapiens
guaacuacccucucaaaugga

SEQ ID NO: 1082675 - RNA, 19 nt, Homo sapiens
guaagcagaguucuuugca

SEQ ID NO: 1082676 - RNA, 17 nt, Homo sapiens
guaaguuucucauccca

SEQ ID NO: 1082677 - RNA, 18 nt, Homo sapiens
guacagagaaauucugug

SEQ ID NO: 1082678 - RNA, 19 nt, Homo sapiens
guacagcagggucuugcug

SEQ ID NO: 1082679 - RNA, 17 nt, Homo sapiens
guacaggcaagcuugug

SEQ ID NO: 1082680 - RNA, 20 nt, Homo sapiens
guacauugggcacauaucuc

SEQ ID NO: 1082681 - RNA, 21 nt, Homo sapiens
guacugaguauugauaaacuu

SEQ ID NO: 1082682 - RNA, 14 nt, Homo sapiens
guacuuugugcuga

SEQ ID NO: 1082683 - RNA, 15 nt, Homo sapiens
guagaaagugaucca

SEQ ID NO: 1082684 - RNA, 19 nt, Homo sapiens
guagaagccugcagcggca

SEQ ID NO: 1082685 - RNA, 16 nt, Homo sapiens
guagcugagauuacag

SEQ ID NO: 1082686 - RNA, 14 nt, Homo sapiens
guaggaucugucaa

SEQ ID NO: 1082687 - RNA, 19 nt, Homo sapiens
guauauaacuuauuugccc

SEQ ID NO: 1082688 - RNA, 19 nt, Homo sapiens
guaucuaccucacuauuca

SEQ ID NO: 1082689 - RNA, 18 nt, Homo sapiens
guaucucggaccuuucag

SEQ ID NO: 1082690 - RNA, 22 nt, Homo sapiens
guaucugcauguaaaaucuuca

SEQ ID NO: 1082691 - RNA, 18 nt, Homo sapiens
guauuacaacaugaaaua

SEQ ID NO: 1082692 - RNA, 21 nt, Homo sapiens
guauuuuaggcagggauuuga

SEQ ID NO: 1082693 - RNA, 12 nt, Homo sapiens
gucacugucuca

SEQ ID NO: 1082694 - RNA, 17 nt, Homo sapiens
gucacuuuuauuugaaa

SEQ ID NO: 1082695 - RNA, 19 nt, Homo sapiens
gucagaaacucgaugaaug

SEQ ID NO: 1082696 - RNA, 17 nt, Homo sapiens
gucagcaacagagcaaa

SEQ ID NO: 1082697 - RNA, 23 nt, Homo sapiens
gucagcacagaacacacugagac

SEQ ID NO: 1082698 - RNA, 16 nt, Homo sapiens
gucagccuugcaucaa

SEQ ID NO: 1082699 - RNA, 14 nt, Homo sapiens
gucauaacuagaac

SEQ ID NO: 1082700 - RNA, 21 nt, Homo sapiens
gucauuauuuuuguuagcaaa

SEQ ID NO: 1082701 - RNA, 14 nt, Homo sapiens
guccaccaccaccu

SEQ ID NO: 1082702 - RNA, 19 nt, Homo sapiens
guccacuuuuaaaacuaua

SEQ ID NO: 1082703 - RNA, 17 nt, Homo sapiens
guccagucaaguucccu

SEQ ID NO: 1082704 - RNA, 16 nt, Homo sapiens
gucccagccuggccac

SEQ ID NO: 1082705 - RNA, 17 nt, Homo sapiens
gucccagcuacucagaa

SEQ ID NO: 1082706 - RNA, 21 nt, Homo sapiens
guccccuacccccaguaaaau

SEQ ID NO: 1082707 - RNA, 15 nt, Homo sapiens
guccccucacgugac

SEQ ID NO: 1082708 - RNA, 12 nt, Homo sapiens
gucccuugccuu

SEQ ID NO: 1082709 - RNA, 20 nt, Homo sapiens
guccucgcacugcccaggga

SEQ ID NO: 1082710 - RNA, 15 nt, Homo sapiens
guccuguuccugcca

SEQ ID NO: 1082711 - RNA, 17 nt, Homo sapiens
guccuguuuauugagac

SEQ ID NO: 1082712 - RNA, 15 nt, Homo sapiens
guccuuacucagagc

SEQ ID NO: 1082713 - RNA, 20 nt, Homo sapiens
guccuucuuuaucugugaua

SEQ ID NO: 1082714 - RNA, 13 nt, Homo sapiens
gucucacacuccu

SEQ ID NO: 1082715 - RNA, 23 nt, Homo sapiens
gucucaguuuacauuuuguauau

SEQ ID NO: 1082716 - RNA, 24 nt, Homo sapiens
gucucaugcaagacuucacugcag

SEQ ID NO: 1082717 - RNA, 15 nt, Homo sapiens
gucucgaacuccugg

SEQ ID NO: 1082718 - RNA, 15 nt, Homo sapiens
gucuggcuaugcuca

SEQ ID NO: 1082719 - RNA, 16 nt, Homo sapiens
gucuuacuuugugcaa

SEQ ID NO: 1082720 - RNA, 14 nt, Homo sapiens
gucuuugcaaagga

SEQ ID NO: 1082721 - RNA, 21 nt, Homo sapiens
gucuuuggugaacauugcaau

SEQ ID NO: 1082722 - RNA, 19 nt, Homo sapiens
gugaaagaugcaagcaccu

SEQ ID NO: 1082723 - RNA, 20 nt, Homo sapiens
gugaaagucuccuguaucau

SEQ ID NO: 1082724 - RNA, 19 nt, Homo sapiens
gugaacauguguguguguu

SEQ ID NO: 1082725 - RNA, 16 nt, Homo sapiens
gugaacugcgugccag

SEQ ID NO: 1082726 - RNA, 20 nt, Homo sapiens
gugaauuuuugcacauucua

SEQ ID NO: 1082727 - RNA, 21 nt, Homo sapiens
gugacaagggcacaagcucag

SEQ ID NO: 1082728 - RNA, 22 nt, Homo sapiens
gugacacugugggucugacuuu

SEQ ID NO: 1082729 - RNA, 19 nt, Homo sapiens
gugacauauauauguauau

SEQ ID NO: 1082730 - RNA, 12 nt, Homo sapiens
gugagacucuga

SEQ ID NO: 1082731 - RNA, 23 nt, Homo sapiens
gugagacuuugaggguguauauu

SEQ ID NO: 1082732 - RNA, 16 nt, Homo sapiens
gugaggugacuugccu

SEQ ID NO: 1082733 - RNA, 17 nt, Homo sapiens
gugauuccugcugccug

SEQ ID NO: 1082734 - RNA, 14 nt, Homo sapiens
gugauuuuugaaca

SEQ ID NO: 1082735 - RNA, 23 nt, Homo sapiens
gugcacaguaauaugaaagccac

SEQ ID NO: 1082736 - RNA, 16 nt, Homo sapiens
gugcacccaacgugau

SEQ ID NO: 1082737 - RNA, 15 nt, Homo sapiens
gugcacuagcauuuu

SEQ ID NO: 1082738 - RNA, 11 nt, Homo sapiens
gugcauuuuau

SEQ ID NO: 1082739 - RNA, 17 nt, Homo sapiens
gugccaauauuucugau

SEQ ID NO: 1082740 - RNA, 18 nt, Homo sapiens
gugccaauauuucugaua

SEQ ID NO: 1082741 - RNA, 19 nt, Homo sapiens
gugccgguaccagccugac

SEQ ID NO: 1082742 - RNA, 14 nt, Homo sapiens
gugccguaguccuu

SEQ ID NO: 1082743 - RNA, 17 nt, Homo sapiens
gugcuacacuugcaccu

SEQ ID NO: 1082744 - RNA, 19 nt, Homo sapiens
gugcuggagcaaaagucau

SEQ ID NO: 1082745 - RNA, 22 nt, Homo sapiens
gcuggccucuuggcaccugccu

SEQ ID NO: 1082746 - RNA, 15 nt, Homo sapiens
gcugggacuggccag

SEQ ID NO: 1082747 - RNA, 23 nt, Homo sapiens
gcuguaaauauaaauuuuguccc

SEQ ID NO: 1082748 - RNA, 20 nt, Homo sapiens
gcuguaccuggugcccugug

SEQ ID NO: 1082749 - RNA, 20 nt, Homo sapiens
gcugucaggagauggaagag

SEQ ID NO: 1082750 - RNA, 14 nt, Homo sapiens
gcuguuaccugaga

SEQ ID NO: 1082751 - RNA, 23 nt, Homo sapiens
gcuuauaaauggcaccacaucuu

SEQ ID NO: 1082752 - RNA, 12 nt, Homo sapiens
gcuucagaauug

SEQ ID NO: 1082753 - RNA, 15 nt, Homo sapiens
gcuucugcauucaca

SEQ ID NO: 1082754 - RNA, 22 nt, Homo sapiens
gcuuguuguuuuuaaguccugu

SEQ ID NO: 1082755 - RNA, 19 nt, Homo sapiens
gcuuuacccucaggugcua

SEQ ID NO: 1082756 - RNA, 17 nt, Homo sapiens
gcuuuccucccaaaggc

SEQ ID NO: 1082757 - RNA, 22 nt, Homo sapiens
ggaaaauuagcuuuuaguuuua

SEQ ID NO: 1082758 - RNA, 17 nt, Homo sapiens
ggaaacuaacaauauga

SEQ ID NO: 1082759 - RNA, 22 nt, Homo sapiens
ggaaaucagagcuggcagccuc

SEQ ID NO: 1082760 - RNA, 18 nt, Homo sapiens
ggaauaaagcccuugaac

SEQ ID NO: 1082761 - RNA, 12 nt, Homo sapiens
ggaaugcaaaaa

SEQ ID NO: 1082762 - RNA, 17 nt, Homo sapiens
ggaccaggucuuguuca

SEQ ID NO: 1082763 - RNA, 15 nt, Homo sapiens
ggacucagggacuca

SEQ ID NO: 1082764 - RNA, 22 nt, Homo sapiens
ggacucucugccugcuuccugg

SEQ ID NO: 1082765 - RNA, 19 nt, Homo sapiens
ggagaaugaagacuguuaa

SEQ ID NO: 1082766 - RNA, 22 nt, Homo sapiens
ggagacaauaacuccagugaug

SEQ ID NO: 1082767 - RNA, 15 nt, Homo sapiens
ggagagcagcuggcu

SEQ ID NO: 1082768 - RNA, 15 nt, Homo sapiens
ggagagcccagccau

SEQ ID NO: 1082769 - RNA, 18 nt, Homo sapiens
ggagccccugcucuggug

SEQ ID NO: 1082770 - RNA, 13 nt, Homo sapiens
ggagcgcaccugc

SEQ ID NO: 1082771 - RNA, 20 nt, Homo sapiens
acuggacuugagcuuggcag

SEQ ID NO: 1082772 - RNA, 14 nt, Homo sapiens
acugggcucugagg

SEQ ID NO: 1082773 - RNA, 17 nt, Homo sapiens
acuggucccaaguagua

SEQ ID NO: 1082774 - RNA, 19 nt, Homo sapiens
acuguccugcuccacagug

SEQ ID NO: 1082775 - RNA, 14 nt, Homo sapiens
acugugacacagcu

SEQ ID NO: 1082776 - RNA, 11 nt, Homo sapiens
acugugcuccc

SEQ ID NO: 1082777 - RNA, 13 nt, Homo sapiens
acuguuccaaaaa

SEQ ID NO: 1082778 - RNA, 16 nt, Homo sapiens
acuuauuuccauggau

SEQ ID NO: 1082779 - RNA, 21 nt, Homo sapiens
acuucacugcagccuuucaca

SEQ ID NO: 1082780 - RNA, 17 nt, Homo sapiens
acuucaugccagcuaua

SEQ ID NO: 1082781 - RNA, 13 nt, Homo sapiens
acuugacuuugcc

SEQ ID NO: 1082782 - RNA, 23 nt, Homo sapiens
acuugauucuugugauugacuuu

SEQ ID NO: 1082783 - RNA, 22 nt, Homo sapiens
acuugcaccugguacugcacau

SEQ ID NO: 1082784 - RNA, 17 nt, Homo sapiens
acuuuaguaauagcuug

SEQ ID NO: 1082785 - RNA, 16 nt, Homo sapiens
acuuucaaaagcaaac

SEQ ID NO: 1082786 - RNA, 14 nt, Homo sapiens
acuuucucugcaaa

SEQ ID NO: 1082787 - RNA, 16 nt, Homo sapiens
acuuucucugcaaaga

SEQ ID NO: 1082788 - RNA, 16 nt, Homo sapiens
acuuucucuuggacau

SEQ ID NO: 1082789 - RNA, 17 nt, Homo sapiens
acuuuugcaugaaaaua

SEQ ID NO: 1082790 - RNA, 16 nt, Homo sapiens
cuggaagaacugcaug

SEQ ID NO: 1082791 - RNA, 22 nt, Homo sapiens
cuggaagguacugaaggcuucu

SEQ ID NO: 1082792 - RNA, 20 nt, Homo sapiens
cuggagaugacagugaugcu

SEQ ID NO: 1082793 - RNA, 17 nt, Homo sapiens
cuggagcaaaagucauu

SEQ ID NO: 1082794 - RNA, 20 nt, Homo sapiens
cuggauggggagucucaugc

SEQ ID NO: 1082795 - RNA, 14 nt, Homo sapiens
cuggauuccuguca

SEQ ID NO: 1082796 - RNA, 23 nt, Homo sapiens
cuggcacaacgcucuacccugca

SEQ ID NO: 1082797 - RNA, 15 nt, Homo sapiens
cuggcaugacacucu

SEQ ID NO: 1082798 - RNA, 14 nt, Homo sapiens
cuggccacacuggg

SEQ ID NO: 1082799 - RNA, 23 nt, Homo sapiens
cuggccacuccccagugcuccug

SEQ ID NO: 1082800 - RNA, 21 nt, Homo sapiens
cuggccauuuaacuagcacuu

SEQ ID NO: 1082801 - RNA, 14 nt, Homo sapiens
cuggcccaucagug

SEQ ID NO: 1082802 - RNA, 19 nt, Homo sapiens
cuggccccuucuccagcaa

SEQ ID NO: 1082803 - RNA, 13 nt, Homo sapiens
gugcuccugugca

SEQ ID NO: 1082804 - RNA, 15 nt, Homo sapiens
gugcugggauuacag

SEQ ID NO: 1082805 - RNA, 22 nt, Homo sapiens
gugcuucuccuaacucaaggac

SEQ ID NO: 1082806 - RNA, 20 nt, Homo sapiens
guggcagcggggcaagcaaa

SEQ ID NO: 1082807 - RNA, 14 nt, Homo sapiens
guggcaucaggaaa

SEQ ID NO: 1082808 - RNA, 20 nt, Homo sapiens
guggcauguggguugugaua

SEQ ID NO: 1082809 - RNA, 22 nt, Homo sapiens
guggcauucucucugcucagug

SEQ ID NO: 1082810 - RNA, 18 nt, Homo sapiens
guggcuuuuuaacaugaa

SEQ ID NO: 1082811 - RNA, 17 nt, Homo sapiens
gugggucccacuucccc

SEQ ID NO: 1082812 - RNA, 16 nt, Homo sapiens
guguaacauccagcuc

SEQ ID NO: 1082813 - RNA, 13 nt, Homo sapiens
gugucagcacuca

SEQ ID NO: 1082814 - RNA, 21 nt, Homo sapiens
guguccauugaugucauucag

SEQ ID NO: 1082815 - RNA, 13 nt, Homo sapiens
gugucgugucugc

SEQ ID NO: 1082816 - RNA, 13 nt, Homo sapiens
gugucucuguaua

SEQ ID NO: 1082817 - RNA, 13 nt, Homo sapiens
guguguccaugca

SEQ ID NO: 1082818 - RNA, 15 nt, Homo sapiens
guguuagaauugccu

SEQ ID NO: 1082819 - RNA, 15 nt, Homo sapiens
guguuggcaguguuu

SEQ ID NO: 1082820 - RNA, 12 nt, Homo sapiens
guguuguucaua

SEQ ID NO: 1082821 - RNA, 17 nt, Homo sapiens
guuagggaugacuguga

SEQ ID NO: 1082822 - RNA, 13 nt, Homo sapiens
guucaccuugccg

SEQ ID NO: 1082823 - RNA, 15 nt, Homo sapiens
guuccaguugcuuga

SEQ ID NO: 1082824 - RNA, 21 nt, Homo sapiens
guucccacucccucucuugcc

SEQ ID NO: 1082825 - RNA, 20 nt, Homo sapiens
guucgagaccagccuggcca

SEQ ID NO: 1082826 - RNA, 20 nt, Homo sapiens
guucucaccuuaacucagcc

SEQ ID NO: 1082827 - RNA, 18 nt, Homo sapiens
guucuuuaagaauuacag

SEQ ID NO: 1082828 - RNA, 18 nt, Homo sapiens
guuggcaucuugcugcua

SEQ ID NO: 1082829 - RNA, 14 nt, Homo sapiens
guugggcugagacc

SEQ ID NO: 1082830 - RNA, 13 nt, Homo sapiens
guugucacugaga

SEQ ID NO: 1082831 - RNA, 18 nt, Homo sapiens
guuuagaaucaagucugu

SEQ ID NO: 1082832 - RNA, 21 nt, Homo sapiens
guuuagaaucaagucugugaa

SEQ ID NO: 1082833 - RNA, 21 nt, Homo sapiens
guuucucggcaccagugccuc

SEQ ID NO: 1082834 - RNA, 21 nt, Homo sapiens
guuugaacucuucuuugccag

SEQ ID NO: 1082835 - RNA, 18 nt, Homo sapiens
guuugauaaaaagaucaa

SEQ ID NO: 1082836 - RNA, 11 nt, Homo sapiens
guuuggcacug

SEQ ID NO: 1082837 - RNA, 16 nt, Homo sapiens
guuuuagaaccagccg

SEQ ID NO: 1082838 - RNA, 21 nt, Homo sapiens
guuuucuucuaaucauaacau

SEQ ID NO: 1082839 - RNA, 17 nt, Homo sapiens
uaaaauaaaaguuuaca

SEQ ID NO: 1082840 - RNA, 18 nt, Homo sapiens
uaaaauguuggugcaauu

SEQ ID NO: 1082841 - RNA, 19 nt, Homo sapiens
uaaaauguuggugcaauua

SEQ ID NO: 1082842 - RNA, 16 nt, Homo sapiens
uaaaauguuuaauuca

SEQ ID NO: 1082843 - RNA, 18 nt, Homo sapiens
uaaaauuaauuugugcau

SEQ ID NO: 1082844 - RNA, 15 nt, Homo sapiens
uaaaauugcacuuuu

SEQ ID NO: 1082845 - RNA, 12 nt, Homo sapiens
uaaacauucucu

SEQ ID NO: 1082846 - RNA, 15 nt, Homo sapiens
uaaacuuucucugca

SEQ ID NO: 1082847 - RNA, 17 nt, Homo sapiens
uaaacuuucucugcaaa

SEQ ID NO: 1082848 - RNA, 13 nt, Homo sapiens
uaaagcccuugaa

SEQ ID NO: 1082849 - RNA, 15 nt, Homo sapiens
uaaagcuacaacaaa

SEQ ID NO: 1082850 - RNA, 19 nt, Homo sapiens
uaaaguauguuauugcaua

SEQ ID NO: 1082851 - RNA, 13 nt, Homo sapiens
uaaagucucaggu

SEQ ID NO: 1082852 - RNA, 15 nt, Homo sapiens
uaaauagcauucucu

SEQ ID NO: 1082853 - RNA, 14 nt, Homo sapiens
uaaauaugugaaaa

SEQ ID NO: 1082854 - RNA, 17 nt, Homo sapiens
uaaauaugugaaaauga

SEQ ID NO: 1082855 - RNA, 15 nt, Homo sapiens
uaaaucccaaguguc

SEQ ID NO: 1082856 - RNA, 19 nt, Homo sapiens
uaaaugccaggccuggcaa

SEQ ID NO: 1082857 - RNA, 18 nt, Homo sapiens
uaaauggcauaccaaaau

SEQ ID NO: 1082858 - RNA, 21 nt, Homo sapiens
uaaauguagaaagugauccau

SEQ ID NO: 1082859 - RNA, 12 nt, Homo sapiens
uaaauucacugu

SEQ ID NO: 1082860 - RNA, 22 nt, Homo sapiens
uaaauucucucuaacauaacaa

SEQ ID NO: 1082861 - RNA, 20 nt, Homo sapiens
uaaauuucucuacugucuca

SEQ ID NO: 1082862 - RNA, 13 nt, Homo sapiens
uaacaaaaguaua

SEQ ID NO: 1082863 - RNA, 17 nt, Homo sapiens
uaacaaccccggacaaa

SEQ ID NO: 1082864 - RNA, 21 nt, Homo sapiens
uaacaagaucauuaucuucau

SEQ ID NO: 1082865 - RNA, 19 nt, Homo sapiens
uaacauguuuuacucacaa

SEQ ID NO: 1082866 - RNA, 18 nt, Homo sapiens
uaacuacccucucaaaug

SEQ ID NO: 1082867 - RNA, 18 nt, Homo sapiens
uaacuagaaaucugccaa

SEQ ID NO: 1082868 - RNA, 19 nt, Homo sapiens
uaacuagaaaucugccaau

SEQ ID NO: 1082869 - RNA, 21 nt, Homo sapiens
uaacucuuagaagugacauug

SEQ ID NO: 1082870 - RNA, 22 nt, Homo sapiens
uaacuguagauaaagugguuug

SEQ ID NO: 1082871 - RNA, 14 nt, Homo sapiens
uaacuuauuugccc

SEQ ID NO: 1082872 - RNA, 22 nt, Homo sapiens
uaagcgggaucccagcaucuca

SEQ ID NO: 1082873 - RNA, 19 nt, Homo sapiens
uaagcuguagaacucugca

SEQ ID NO: 1082874 - RNA, 13 nt, Homo sapiens
uaaggaaagccaa

SEQ ID NO: 1082875 - RNA, 13 nt, Homo sapiens
uaaggcaggagaa

SEQ ID NO: 1082876 - RNA, 22 nt, Homo sapiens
uaaggucuauaaacaugaaggg

SEQ ID NO: 1082877 - RNA, 22 nt, Homo sapiens
uaaguggcuuuuuaacaugaaa

SEQ ID NO: 1082878 - RNA, 23 nt, Homo sapiens
uaaguuuuguuuguucacacucc

SEQ ID NO: 1082879 - RNA, 13 nt, Homo sapiens
uaauaggaugaau

SEQ ID NO: 1082880 - RNA, 12 nt, Homo sapiens
uaauauaaccau

SEQ ID NO: 1082881 - RNA, 18 nt, Homo sapiens
uaauaugcaauccuacuu

SEQ ID NO: 1082882 - RNA, 12 nt, Homo sapiens
uaaucauaacau

SEQ ID NO: 1082883 - RNA, 21 nt, Homo sapiens
uaaucauguuaccauuacaaa

SEQ ID NO: 1082884 - RNA, 13 nt, Homo sapiens
uaaucuuccauuc

SEQ ID NO: 1082885 - RNA, 18 nt, Homo sapiens
uaauggaaacaugcugua

SEQ ID NO: 1082886 - RNA, 19 nt, Homo sapiens
uaauuaggguccacgccca

SEQ ID NO: 1082887 - RNA, 19 nt, Homo sapiens
uaauuuugugaaagaagga

SEQ ID NO: 1082888 - RNA, 22 nt, Homo sapiens
uacaaacaggugcuaacacugu

SEQ ID NO: 1082889 - RNA, 15 nt, Homo sapiens
uacaaccuauguaau

SEQ ID NO: 1082890 - RNA, 14 nt, Homo sapiens
uacacaacauguau

SEQ ID NO: 1082891 - RNA, 12 nt, Homo sapiens
uacaggacauca

SEQ ID NO: 1082892 - RNA, 16 nt, Homo sapiens
uacauguaauccauca

SEQ ID NO: 1082893 - RNA, 16 nt, Homo sapiens
uacauuauauuccucu

SEQ ID NO: 1082894 - RNA, 18 nt, Homo sapiens
uacauuuuauaucuggau

SEQ ID NO: 1082895 - RNA, 15 nt, Homo sapiens
uaccaaaauguuaau

SEQ ID NO: 1082896 - RNA, 19 nt, Homo sapiens
uaccaaauccacaagccau

SEQ ID NO: 1082897 - RNA, 16 nt, Homo sapiens
uaccaaaugagcauua

SEQ ID NO: 1082898 - RNA, 17 nt, Homo sapiens
uacccuccucuauuucu

SEQ ID NO: 1082899 - RNA, 16 nt, Homo sapiens
uaccuggaugccauug

SEQ ID NO: 1082900 - RNA, 15 nt, Homo sapiens
uaccuuaauuugacu

SEQ ID NO: 1082901 - RNA, 14 nt, Homo sapiens
uacgacaacuugca

SEQ ID NO: 1082902 - RNA, 16 nt, Homo sapiens
uacuaaaaauacagaa

SEQ ID NO: 1082903 - RNA, 18 nt, Homo sapiens
uacuaaagucacauauaa

SEQ ID NO: 1082904 - RNA, 18 nt, Homo sapiens
uacuaauuuccaugugua

SEQ ID NO: 1082905 - RNA, 22 nt, Homo sapiens
uacuggagaugacagugaugcu

SEQ ID NO: 1082906 - RNA, 12 nt, Homo sapiens
uacuuccaugau

SEQ ID NO: 1082907 - RNA, 18 nt, Homo sapiens
uacuuccaugauacuuua

SEQ ID NO: 1082908 - RNA, 20 nt, Homo sapiens
uacuuuucagaauugaagga

SEQ ID NO: 1082909 - RNA, 16 nt, Homo sapiens
uagaaauccaauugga

SEQ ID NO: 1082910 - RNA, 11 nt, Homo sapiens
uagaaccagcc

SEQ ID NO: 1082911 - RNA, 11 nt, Homo sapiens
uagaaccucac

SEQ ID NO: 1082912 - RNA, 17 nt, Homo sapiens
uagaaccucaccuguua

SEQ ID NO: 1082913 - RNA, 20 nt, Homo sapiens
uagaagccaguacagagaaa

SEQ ID NO: 1082914 - RNA, 18 nt, Homo sapiens
uagaagccugcagcggca

SEQ ID NO: 1082915 - RNA, 19 nt, Homo sapiens
uagaaucaagucugugaaa

SEQ ID NO: 1082916 - RNA, 14 nt, Homo sapiens
uagaaugcauguaa

SEQ ID NO: 1082917 - RNA, 21 nt, Homo sapiens
uagacccccaagccccacuga

SEQ ID NO: 1082918 - RNA, 14 nt, Homo sapiens
uagagauaugcaga

SEQ ID NO: 1082919 - RNA, 17 nt, Homo sapiens
uagauuaguauuuucca

SEQ ID NO: 1082920 - RNA, 14 nt, Homo sapiens
uagauuuuugcucu

SEQ ID NO: 1082921 - RNA, 22 nt, Homo sapiens
uagcaaggccagggcacagcug

SEQ ID NO: 1082922 - RNA, 15 nt, Homo sapiens
uagcacaugauuuuc

SEQ ID NO: 1082923 - RNA, 12 nt, Homo sapiens
uagcacuuuaua

SEQ ID NO: 1082924 - RNA, 22 nt, Homo sapiens
uagcaggugaacucgaagccca

SEQ ID NO: 1082925 - RNA, 15 nt, Homo sapiens
uagcagucaaaucua

SEQ ID NO: 1082926 - RNA, 14 nt, Homo sapiens
uagcugaauugagc

SEQ ID NO: 1082927 - RNA, 13 nt, Homo sapiens
uaggaauacucuu

SEQ ID NO: 1082928 - RNA, 14 nt, Homo sapiens
uaugcuaacuguag

SEQ ID NO: 1082929 - RNA, 19 nt, Homo sapiens
uauggcucuggcaccacua

SEQ ID NO: 1082930 - RNA, 21 nt, Homo sapiens
uauuaaaauuuuuugauguca

SEQ ID NO: 1082931 - RNA, 15 nt, Homo sapiens
uauuaagauuuccaa

SEQ ID NO: 1082932 - RNA, 16 nt, Homo sapiens
uauuaauuaaaccaga

SEQ ID NO: 1082933 - RNA, 20 nt, Homo sapiens
uauuagcaacugugcuacac

SEQ ID NO: 1082934 - RNA, 14 nt, Homo sapiens
uauucccccaaagc

SEQ ID NO: 1082935 - RNA, 20 nt, Homo sapiens
uauucccuucugaucuugga

SEQ ID NO: 1082936 - RNA, 17 nt, Homo sapiens
uauucucuuaauuuuuc

SEQ ID NO: 1082937 - RNA, 23 nt, Homo sapiens
uauugccccaagagaccuagcua

SEQ ID NO: 1082938 - RNA, 23 nt, Homo sapiens
uauugcuaccaaaaacuagacau

SEQ ID NO: 1082939 - RNA, 22 nt, Homo sapiens
uauuguuaggagaugucaucaa

SEQ ID NO: 1082940 - RNA, 23 nt, Homo sapiens
uauuucuaaaacauuaauugagg

SEQ ID NO: 1082941 - RNA, 20 nt, Homo sapiens
uauuuguaauagugacauau

SEQ ID NO: 1082942 - RNA, 17 nt, Homo sapiens
uauuuuuuuaagcugua

SEQ ID NO: 1082943 - RNA, 13 nt, Homo sapiens
ucaaaacaaucaa

SEQ ID NO: 1082944 - RNA, 20 nt, Homo sapiens
ucaaaauggacguacugguu

SEQ ID NO: 1082945 - RNA, 19 nt, Homo sapiens
ucaaacagggacacuacaa

SEQ ID NO: 1082946 - RNA, 23 nt, Homo sapiens
ucaaagcucuauuaagauuucca

SEQ ID NO: 1082947 - RNA, 14 nt, Homo sapiens
ucaaaugugcaucc

SEQ ID NO: 1082948 - RNA, 10 nt, Homo sapiens
ucaacugagg

SEQ ID NO: 1082949 - RNA, 14 nt, Homo sapiens
ucaagagucucucc

SEQ ID NO: 1082950 - RNA, 21 nt, Homo sapiens
ucaagcgauucuucugccuca

SEQ ID NO: 1082951 - RNA, 20 nt, Homo sapiens
ucaaguaccaaaauguuaau

SEQ ID NO: 1082952 - RNA, 20 nt, Homo sapiens
ucaaguauuagggguaauau

SEQ ID NO: 1082953 - RNA, 15 nt, Homo sapiens
ucaauacaaccagcc

SEQ ID NO: 1082954 - RNA, 17 nt, Homo sapiens
ucaauauuaaaugacuu

SEQ ID NO: 1082955 - RNA, 18 nt, Homo sapiens
ucaauuaaaggcuuucag

SEQ ID NO: 1082956 - RNA, 23 nt, Homo sapiens
ucacaagaacaaauacacuuuau

SEQ ID NO: 1082957 - RNA, 15 nt, Homo sapiens
ucacaggucuugccc

SEQ ID NO: 1082958 - RNA, 14 nt, Homo sapiens
ucacauauaaaagu

SEQ ID NO: 1082959 - RNA, 15 nt, Homo sapiens
ucacauuuugccuuu

SEQ ID NO: 1082960 - RNA, 17 nt, Homo sapiens
ucaccaccucaugucau

SEQ ID NO: 1082961 - RNA, 19 nt, Homo sapiens
ucacccuccugagccucac

SEQ ID NO: 1082962 - RNA, 12 nt, Homo sapiens
ucaccucaggcc

SEQ ID NO: 1082963 - RNA, 17 nt, Homo sapiens
ucaccuccucugugauu

SEQ ID NO: 1082964 - RNA, 21 nt, Homo sapiens
ucaccuugcauuucaaaaugg

SEQ ID NO: 1082965 - RNA, 17 nt, Homo sapiens
ucaccuugcucugccau

SEQ ID NO: 1082966 - RNA, 17 nt, Homo sapiens
ucaccuuuucccgggga

SEQ ID NO: 1082967 - RNA, 14 nt, Homo sapiens
ucacuagacugugc

SEQ ID NO: 1082968 - RNA, 23 nt, Homo sapiens
ucacuagccaugauaacugcaau

SEQ ID NO: 1082969 - RNA, 14 nt, Homo sapiens
ucacugaagugauu

SEQ ID NO: 1082970 - RNA, 18 nt, Homo sapiens
ucacugcaagcucugccu

SEQ ID NO: 1082971 - RNA, 20 nt, Homo sapiens
ucacuguccaccaccaccug

SEQ ID NO: 1082972 - RNA, 16 nt, Homo sapiens
ucacuguucaugaaua

SEQ ID NO: 1082973 - RNA, 16 nt, Homo sapiens
ucacuugacuuugcca

SEQ ID NO: 1082974 - RNA, 22 nt, Homo sapiens
ucagaacucuguguugugaaug

SEQ ID NO: 1082975 - RNA, 21 nt, Homo sapiens
ucagcaaaaaucucccaguga

SEQ ID NO: 1082976 - RNA, 23 nt, Homo sapiens
ucaggauuaaugguccugugaug

SEQ ID NO: 1082977 - RNA, 17 nt, Homo sapiens
ucaggccaacaagccaa

SEQ ID NO: 1082978 - RNA, 19 nt, Homo sapiens
ucagggaccacagcaaggc

SEQ ID NO: 1082979 - RNA, 17 nt, Homo sapiens
ucagguaguacugggaa

SEQ ID NO: 1082980 - RNA, 16 nt, Homo sapiens
ucagugaucucacuua

SEQ ID NO: 1082981 - RNA, 23 nt, Homo sapiens
ucaucccaucuaagcugcagcuu

SEQ ID NO: 1082982 - RNA, 22 nt, Homo sapiens
ucaucccaugggcgaccagggc

SEQ ID NO: 1082983 - RNA, 14 nt, Homo sapiens
ucaucccuugcuua

SEQ ID NO: 1082984 - RNA, 21 nt, Homo sapiens
ucaugcaagacuucacugcag

SEQ ID NO: 1082985 - RNA, 22 nt, Homo sapiens
ucauucccucgggacccuccca

SEQ ID NO: 1082986 - RNA, 17 nt, Homo sapiens
ucauuguggccaguuua

SEQ ID NO: 1082987 - RNA, 19 nt, Homo sapiens
ucauuugcugacacaucag

SEQ ID NO: 1082988 - RNA, 13 nt, Homo sapiens
uccaaaacauuuc

SEQ ID NO: 1082989 - RNA, 14 nt, Homo sapiens
uccaaaacauuucu

SEQ ID NO: 1082990 - RNA, 21 nt, Homo sapiens
uccaacccagccugagugcac

SEQ ID NO: 1082991 - RNA, 21 nt, Homo sapiens
uccaaccccccaccugccauu

SEQ ID NO: 1082992 - RNA, 19 nt, Homo sapiens
uccaaccugccugugcaug

SEQ ID NO: 1082993 - RNA, 22 nt, Homo sapiens
uccaagugaaugaguuuccagc

SEQ ID NO: 1082994 - RNA, 22 nt, Homo sapiens
uccaaucccccagcgcuuagaa

SEQ ID NO: 1082995 - RNA, 18 nt, Homo sapiens
uccacaaaugcuauucag

SEQ ID NO: 1082996 - RNA, 18 nt, Homo sapiens
uccaccagagcaggggcu

SEQ ID NO: 1082997 - RNA, 18 nt, Homo sapiens
uccacguguaugcaagug

SEQ ID NO: 1082998 - RNA, 21 nt, Homo sapiens
uccacucaggucuguuuuccg

SEQ ID NO: 1082999 - RNA, 12 nt, Homo sapiens
uccacucccacu

SEQ ID NO: 1083000 - RNA, 19 nt, Homo sapiens
uccagauggagaaacaggc

SEQ ID NO: 1083001 - RNA, 18 nt, Homo sapiens
uccagcaagcagugcccu

SEQ ID NO: 1083002 - RNA, 20 nt, Homo sapiens
uccagcuguuaccugagaua

SEQ ID NO: 1083003 - RNA, 16 nt, Homo sapiens
uccaggacucagggac

SEQ ID NO: 1083004 - RNA, 22 nt, Homo sapiens
uccaggacuggggcuugccagg

SEQ ID NO: 1083005 - RNA, 14 nt, Homo sapiens
uccaguucugauga

SEQ ID NO: 1083006 - RNA, 15 nt, Homo sapiens
uccaguucugaugag

SEQ ID NO: 1083007 - RNA, 15 nt, Homo sapiens
uccaguuuccaaagg

SEQ ID NO: 1083008 - RNA, 21 nt, Homo sapiens
uccauagugcacuagcauuuu

SEQ ID NO: 1083009 - RNA, 19 nt, Homo sapiens
uccaucuguggaaaugaca

SEQ ID NO: 1083010 - RNA, 16 nt, Homo sapiens
uccauuucuacuguau

SEQ ID NO: 1083011 - RNA, 14 nt, Homo sapiens
uccauuuuacuucc

SEQ ID NO: 1083012 - RNA, 18 nt, Homo sapiens
ucccaaguagcugagauu

SEQ ID NO: 1083013 - RNA, 16 nt, Homo sapiens
ucccacgugcacagcu

SEQ ID NO: 1083014 - RNA, 18 nt, Homo sapiens
ucccacuaagcuuucucc

SEQ ID NO: 1083015 - RNA, 18 nt, Homo sapiens
ucccagaugccccagcaa

SEQ ID NO: 1083016 - RNA, 23 nt, Homo sapiens
ucccagccuggccaccagcuucc

SEQ ID NO: 1083017 - RNA, 13 nt, Homo sapiens
ucccagcuacuca

SEQ ID NO: 1083018 - RNA, 18 nt, Homo sapiens
ucccaugguagacuguga

SEQ ID NO: 1083019 - RNA, 23 nt, Homo sapiens
ucccaugugcauggaaauguccu

SEQ ID NO: 1083020 - RNA, 18 nt, Homo sapiens
ucccauuugggcaguaua

SEQ ID NO: 1083021 - RNA, 17 nt, Homo sapiens
uccccaaaggcauccau

SEQ ID NO: 1083022 - RNA, 16 nt, Homo sapiens
ucccccacgucucucu

SEQ ID NO: 1083023 - RNA, 22 nt, Homo sapiens
uccccuggggucucugcugcau

SEQ ID NO: 1083024 - RNA, 21 nt, Homo sapiens
ucccgagcuacucucuugcca

SEQ ID NO: 1083025 - RNA, 23 nt, Homo sapiens
ucccuacccacucuuugcuacaa

SEQ ID NO: 1083026 - RNA, 13 nt, Homo sapiens
ucccuccucacac

SEQ ID NO: 1083027 - RNA, 19 nt, Homo sapiens
ucccuguuaucugcuagau

SEQ ID NO: 1083028 - RNA, 13 nt, Homo sapiens
ucccuuucauaca

SEQ ID NO: 1083029 - RNA, 15 nt, Homo sapiens
ucccuuucauacaau

SEQ ID NO: 1083030 - RNA, 14 nt, Homo sapiens
uccguggauuuggc

SEQ ID NO: 1083031 - RNA, 23 nt, Homo sapiens
uccuaagccuguugcugaaguca

SEQ ID NO: 1083032 - RNA, 12 nt, Homo sapiens
uccuaccucagc

SEQ ID NO: 1083033 - RNA, 18 nt, Homo sapiens
uccuaguagcuuuccucc

SEQ ID NO: 1083034 - RNA, 20 nt, Homo sapiens
uccucacauauuauugguca

SEQ ID NO: 1083035 - RNA, 19 nt, Homo sapiens
uccucagguaguacuggga

SEQ ID NO: 1083036 - RNA, 20 nt, Homo sapiens
uccucagguaguacugggaa

SEQ ID NO: 1083037 - RNA, 15 nt, Homo sapiens
uccucaugucaucaa

SEQ ID NO: 1083038 - RNA, 16 nt, Homo sapiens
uccucaugucaucaaa

SEQ ID NO: 1083039 - RNA, 14 nt, Homo sapiens
uccucgggaugaaa

SEQ ID NO: 1083040 - RNA, 17 nt, Homo sapiens
uccucucccugcaccug

SEQ ID NO: 1083041 - RNA, 12 nt, Homo sapiens
uccucuucccug

SEQ ID NO: 1083042 - RNA, 15 nt, Homo sapiens
uccucuuugcaugga

SEQ ID NO: 1083043 - RNA, 15 nt, Homo sapiens
uccugagcucgugau

SEQ ID NO: 1083044 - RNA, 17 nt, Homo sapiens
uccugaggaguguccug

SEQ ID NO: 1083045 - RNA, 20 nt, Homo sapiens
uccugaggaguguccugucu

SEQ ID NO: 1083046 - RNA, 20 nt, Homo sapiens
uccugagggauuucuaacca

SEQ ID NO: 1083047 - RNA, 22 nt, Homo sapiens
uccugagucaccccucugucca

SEQ ID NO: 1083048 - RNA, 15 nt, Homo sapiens
uccugcaccgagaga

SEQ ID NO: 1083049 - RNA, 16 nt, Homo sapiens
uccugcuccacagugu

SEQ ID NO: 1083050 - RNA, 21 nt, Homo sapiens
uccuggacccuggccuaaaga

SEQ ID NO: 1083051 - RNA, 22 nt, Homo sapiens
ugauuuagggaagcagggacac

SEQ ID NO: 1083052 - RNA, 14 nt, Homo sapiens
ugauuugccugccu

SEQ ID NO: 1083053 - RNA, 22 nt, Homo sapiens
ugcaaaagcaggcuugugcuuu

SEQ ID NO: 1083054 - RNA, 22 nt, Homo sapiens
ugcaauggcacgaucucagcuc

SEQ ID NO: 1083055 - RNA, 20 nt, Homo sapiens
ugcacaaauggaacucccca

SEQ ID NO: 1083056 - RNA, 16 nt, Homo sapiens
ugcacaccagugucgu

SEQ ID NO: 1083057 - RNA, 19 nt, Homo sapiens
ugcacagcuuccugaguca

SEQ ID NO: 1083058 - RNA, 11 nt, Homo sapiens
ugcaccaaaga

SEQ ID NO: 1083059 - RNA, 17 nt, Homo sapiens
ugcaccacuucaaguga

SEQ ID NO: 1083060 - RNA, 23 nt, Homo sapiens
ugcaccauucuuucuuggugcau

SEQ ID NO: 1083061 - RNA, 16 nt, Homo sapiens
ugcacccccuccugcu

SEQ ID NO: 1083062 - RNA, 16 nt, Homo sapiens
ugcaccugccagccug

SEQ ID NO: 1083063 - RNA, 14 nt, Homo sapiens
ugcacuccagccug

SEQ ID NO: 1083064 - RNA, 14 nt, Homo sapiens
ugcacuguccugcu

SEQ ID NO: 1083065 - RNA, 18 nt, Homo sapiens
ugcacuuuuaaaccucuc

SEQ ID NO: 1083066 - RNA, 21 nt, Homo sapiens
ugcagaagccccaacugugau

SEQ ID NO: 1083067 - RNA, 15 nt, Homo sapiens
ugcagccacuguuaa

SEQ ID NO: 1083068 - RNA, 18 nt, Homo sapiens
ugcagccuuucacaggac

SEQ ID NO: 1083069 - RNA, 13 nt, Homo sapiens
ugcagcucaggag

SEQ ID NO: 1083070 - RNA, 15 nt, Homo sapiens
ugcagcuuccuguca

SEQ ID NO: 1083071 - RNA, 18 nt, Homo sapiens
ugcaugaauucacaaaca

SEQ ID NO: 1083072 - RNA, 15 nt, Homo sapiens
ugcaugaccugauca

SEQ ID NO: 1083073 - RNA, 16 nt, Homo sapiens
ugcauggaguguuuga

SEQ ID NO: 1083074 - RNA, 14 nt, Homo sapiens
ugccaaaacaaugc

SEQ ID NO: 1083075 - RNA, 20 nt, Homo sapiens
ugccagaugugggcucagau

SEQ ID NO: 1083076 - RNA, 15 nt, Homo sapiens
ugccaggccuggcaa

SEQ ID NO: 1083077 - RNA, 18 nt, Homo sapiens
ugccaggcuguaagcauu

SEQ ID NO: 1083078 - RNA, 20 nt, Homo sapiens
ugccaggcuguaagcauucu

SEQ ID NO: 1083079 - RNA, 18 nt, Homo sapiens
ugccauucccacuaagcu

SEQ ID NO: 1083080 - RNA, 17 nt, Homo sapiens
ugcccacacacacuccu

SEQ ID NO: 1083081 - RNA, 17 nt, Homo sapiens
ugcccgaccccaucuca

SEQ ID NO: 1083082 - RNA, 15 nt, Homo sapiens
ugccucagcuuccca

SEQ ID NO: 1083083 - RNA, 22 nt, Homo sapiens
ugccucccguguucacaccauu

SEQ ID NO: 1083084 - RNA, 11 nt, Homo sapiens
ugccuguucuc

SEQ ID NO: 1083085 - RNA, 14 nt, Homo sapiens
ugccuuaaggccac

SEQ ID NO: 1083086 - RNA, 15 nt, Homo sapiens
ugcuaauucaaagcu

SEQ ID NO: 1083087 - RNA, 18 nt, Homo sapiens
ugcuaauucaaagcucua

SEQ ID NO: 1083088 - RNA, 17 nt, Homo sapiens
ugcuaggauuacaggca

SEQ ID NO: 1083089 - RNA, 21 nt, Homo sapiens
ugcuauaugccuuaagccaau

SEQ ID NO: 1083090 - RNA, 17 nt, Homo sapiens
ugcuaugcuggacauua

SEQ ID NO: 1083091 - RNA, 14 nt, Homo sapiens
ugcucaccaagaag

SEQ ID NO: 1083092 - RNA, 14 nt, Homo sapiens
ugcuccacaguguu

SEQ ID NO: 1083093 - RNA, 18 nt, Homo sapiens
ugcucuggggcuugcuau

SEQ ID NO: 1083094 - RNA, 15 nt, Homo sapiens
ugcugcgucagacca

SEQ ID NO: 1083095 - RNA, 13 nt, Homo sapiens
ugcugcuguggaa

SEQ ID NO: 1083096 - RNA, 21 nt, Homo sapiens
ugcugggcaggaaaccccagc

SEQ ID NO: 1083097 - RNA, 11 nt, Homo sapiens
ugcuguugcug

SEQ ID NO: 1083098 - RNA, 23 nt, Homo sapiens
ugcuugaaaugagaaacuuugau

SEQ ID NO: 1083099 - RNA, 19 nt, Homo sapiens
ugcuugaauugcaaggcua

SEQ ID NO: 1083100 - RNA, 17 nt, Homo sapiens
ugcuuuucuaaucugca

SEQ ID NO: 1083101 - RNA, 17 nt, Homo sapiens
ugcuuuuguccuguuau

SEQ ID NO: 1083102 - RNA, 17 nt, Homo sapiens
uggaaagagguucugca

SEQ ID NO: 1083103 - RNA, 18 nt, Homo sapiens
uggaaagcaucaccucag

SEQ ID NO: 1083104 - RNA, 22 nt, Homo sapiens
uggaaaggcucagucucaggag

SEQ ID NO: 1083105 - RNA, 15 nt, Homo sapiens
uggaaccacagucau

SEQ ID NO: 1083106 - RNA, 13 nt, Homo sapiens
uggaaccagccca

SEQ ID NO: 1083107 - RNA, 14 nt, Homo sapiens
uggaaggugucauu

SEQ ID NO: 1083108 - RNA, 23 nt, Homo sapiens
uggacauuuuuguagaccacuuu

SEQ ID NO: 1083109 - RNA, 22 nt, Homo sapiens
uggacugguaaguaacuguggu

SEQ ID NO: 1083110 - RNA, 18 nt, Homo sapiens
uggagaaaagcacaauca

SEQ ID NO: 1083111 - RNA, 19 nt, Homo sapiens
uggagaaagggaaguggaa

SEQ ID NO: 1083112 - RNA, 23 nt, Homo sapiens
uggagcccaggaguuugaggcug

SEQ ID NO: 1083113 - RNA, 19 nt, Homo sapiens
uggaguugugaucauccca

SEQ ID NO: 1083114 - RNA, 17 nt, Homo sapiens
uggcaaacaugugcaac

SEQ ID NO: 1083115 - RNA, 20 nt, Homo sapiens
uggcaagaaugaaauacucu

SEQ ID NO: 1083116 - RNA, 17 nt, Homo sapiens
uggccagugugauccca

SEQ ID NO: 1083117 - RNA, 19 nt, Homo sapiens
uggcccucuuugaaagggc

SEQ ID NO: 1083118 - RNA, 14 nt, Homo sapiens
uggccgucgcugug

SEQ ID NO: 1083119 - RNA, 13 nt, Homo sapiens
uggcuguguccuc

SEQ ID NO: 1083120 - RNA, 21 nt, Homo sapiens
uggcuguguccucuccagcuu

SEQ ID NO: 1083121 - RNA, 15 nt, Homo sapiens
ugggaagcuauuucc

SEQ ID NO: 1083122 - RNA, 23 nt, Homo sapiens
ugggccuagggacagacugcaag

SEQ ID NO: 1083123 - RNA, 18 nt, Homo sapiens
ugggcucugugggcugca

SEQ ID NO: 1083124 - RNA, 17 nt, Homo sapiens
uggggacccccucagga

SEQ ID NO: 1083125 - RNA, 23 nt, Homo sapiens
uggggagaggagugggaaauuga

SEQ ID NO: 1083126 - RNA, 15 nt, Homo sapiens
uggggagucucaugc

SEQ ID NO: 1083127 - RNA, 20 nt, Homo sapiens
ugggguuugggggcuucccu

SEQ ID NO: 1083128 - RNA, 23 nt, Homo sapiens
uggguccucggcccaucugucca

SEQ ID NO: 1083129 - RNA, 15 nt, Homo sapiens
ugggugauuucuaga

SEQ ID NO: 1083130 - RNA, 18 nt, Homo sapiens
ugguaaaaccccaucucu

SEQ ID NO: 1083131 - RNA, 15 nt, Homo sapiens
ugguaaacauucucu

SEQ ID NO: 1083132 - RNA, 18 nt, Homo sapiens
ugguaaacauucucucag

SEQ ID NO: 1083133 - RNA, 18 nt, Homo sapiens
ugguaacuuuacaacugg

SEQ ID NO: 1083134 - RNA, 22 nt, Homo sapiens
ugguaccuuaauuugacugucc

SEQ ID NO: 1083135 - RNA, 16 nt, Homo sapiens
ugguacuaaggagaau

SEQ ID NO: 1083136 - RNA, 16 nt, Homo sapiens
ugguauacacacucgu

SEQ ID NO: 1083137 - RNA, 13 nt, Homo sapiens
ugguaucugcaug

SEQ ID NO: 1083138 - RNA, 13 nt, Homo sapiens
uggucuugaucuc

SEQ ID NO: 1083139 - RNA, 13 nt, Homo sapiens
uggugccuggaaa

SEQ ID NO: 1083140 - RNA, 17 nt, Homo sapiens
uggugggaacauucgag

SEQ ID NO: 1083141 - RNA, 17 nt, Homo sapiens
ugguuuuuguugagucu

SEQ ID NO: 1083142 - RNA, 20 nt, Homo sapiens
uguaaauaaccacacugaaa

SEQ ID NO: 1083143 - RNA, 21 nt, Homo sapiens
uguaaauuucucuacugucuc

SEQ ID NO: 1083144 - RNA, 18 nt, Homo sapiens
uguaagcauucugagcug

SEQ ID NO: 1083145 - RNA, 13 nt, Homo sapiens
uguaaugagcucc

SEQ ID NO: 1083146 - RNA, 15 nt, Homo sapiens
uguacaaagauaugc

SEQ ID NO: 1083147 - RNA, 22 nt, Homo sapiens
uguauaaugguguuacuaaagu

SEQ ID NO: 1083148 - RNA, 23 nt, Homo sapiens
uguauauuuucugugcagccacu

SEQ ID NO: 1083149 - RNA, 19 nt, Homo sapiens
uguaucacucacugccaaa

SEQ ID NO: 1083150 - RNA, 16 nt, Homo sapiens
uguauguuaauaucug

SEQ ID NO: 1083151 - RNA, 22 nt, Homo sapiens
ugucaaagaaaacuuccaaaaa

SEQ ID NO: 1083152 - RNA, 18 nt, Homo sapiens
ugucacccugcagagcua

SEQ ID NO: 1083153 - RNA, 18 nt, Homo sapiens
ugucagaaacucgaugaa

SEQ ID NO: 1083154 - RNA, 20 nt, Homo sapiens
ugucccuuuuugcaggggac

SEQ ID NO: 1083155 - RNA, 16 nt, Homo sapiens
uguccuguuccugcca

SEQ ID NO: 1083156 - RNA, 14 nt, Homo sapiens
ugucggugugcugu

SEQ ID NO: 1083157 - RNA, 13 nt, Homo sapiens
ugucguagccaag

SEQ ID NO: 1083158 - RNA, 16 nt, Homo sapiens
ugucuaaagagcuuua

SEQ ID NO: 1083159 - RNA, 15 nt, Homo sapiens
ugucucaacuacuca

SEQ ID NO: 1083160 - RNA, 18 nt, Homo sapiens
ugucucaacuacucagcu

SEQ ID NO: 1083161 - RNA, 24 nt, Homo sapiens
ugucucugacaaugcguggcacau

SEQ ID NO: 1083162 - RNA, 19 nt, Homo sapiens
ugucuuccaaccccagcug

SEQ ID NO: 1083163 - RNA, 23 nt, Homo sapiens
ugugaaauucaaccugugucuua

SEQ ID NO: 1083164 - RNA, 21 nt, Homo sapiens
ugugcaaauccccuccccaaa

SEQ ID NO: 1083165 - RNA, 12 nt, Homo sapiens
ugugcagggaua

SEQ ID NO: 1083166 - RNA, 14 nt, Homo sapiens
ugugcccaccagcg

SEQ ID NO: 1083167 - RNA, 14 nt, Homo sapiens
ugugcuacacuugc

SEQ ID NO: 1083168 - RNA, 13 nt, Homo sapiens
ugugguuuacuag

SEQ ID NO: 1083169 - RNA, 20 nt, Homo sapiens
uguguacugaguauugauaa

SEQ ID NO: 1083170 - RNA, 17 nt, Homo sapiens
uguguauuuaacugccu

SEQ ID NO: 1083171 - RNA, 20 nt, Homo sapiens
uguguccauugaugucauuc

SEQ ID NO: 1083172 - RNA, 11 nt, Homo sapiens
uguguuuacuu

SEQ ID NO: 1083173 - RNA, 15 nt, Homo sapiens
uguuaauucuuucuc

SEQ ID NO: 1083174 - RNA, 23 nt, Homo sapiens
uguuaauucuuucucauguuggg

SEQ ID NO: 1083175 - RNA, 13 nt, Homo sapiens
acaaaaggcuuug

SEQ ID NO: 1083176 - RNA, 17 nt, Homo sapiens
acaaacaccuuauuugu

SEQ ID NO: 1083177 - RNA, 11 nt, Homo sapiens
acaaacaguga

SEQ ID NO: 1083178 - RNA, 12 nt, Homo sapiens
acaaacagugaa

SEQ ID NO: 1083179 - RNA, 18 nt, Homo sapiens
acaaagaauuucagucuc

SEQ ID NO: 1083180 - RNA, 16 nt, Homo sapiens
acaaagagagcucauc

SEQ ID NO: 1083181 - RNA, 19 nt, Homo sapiens
acaaauggcuuacuuacaa

SEQ ID NO: 1083182 - RNA, 17 nt, Homo sapiens
acaacauguauguggau

SEQ ID NO: 1083183 - RNA, 21 nt, Homo sapiens
acaaccacauuucuggccauu

SEQ ID NO: 1083184 - RNA, 18 nt, Homo sapiens
acaacgcucuacccugca

SEQ ID NO: 1083185 - RNA, 13 nt, Homo sapiens
acaagcauucucc

SEQ ID NO: 1083186 - RNA, 15 nt, Homo sapiens
acaagggcacaagcu

SEQ ID NO: 1083187 - RNA, 14 nt, Homo sapiens
acaaggugcacaga

SEQ ID NO: 1083188 - RNA, 19 nt, Homo sapiens
acaaggugcacagaccuca

SEQ ID NO: 1083189 - RNA, 17 nt, Homo sapiens
acaauacaugcugcuaa

SEQ ID NO: 1083190 - RNA, 19 nt, Homo sapiens
acaauccucgucugaauca

SEQ ID NO: 1083191 - RNA, 22 nt, Homo sapiens
acaauuguuaugaucuacucau

SEQ ID NO: 1083192 - RNA, 14 nt, Homo sapiens
acacaaauucuaaa

SEQ ID NO: 1083193 - RNA, 13 nt, Homo sapiens
acacaacauguau

SEQ ID NO: 1083194 - RNA, 14 nt, Homo sapiens
acacaacauguaug

SEQ ID NO: 1083195 - RNA, 11 nt, Homo sapiens
acacacacucc

SEQ ID NO: 1083196 - RNA, 11 nt, Homo sapiens
acacacuccuu

SEQ ID NO: 1083197 - RNA, 18 nt, Homo sapiens
acacacugagacuugaau

SEQ ID NO: 1083198 - RNA, 22 nt, Homo sapiens
acacaggggcaaagaacugccc

SEQ ID NO: 1083199 - RNA, 19 nt, Homo sapiens
acacaguauuaagugacag

SEQ ID NO: 1083200 - RNA, 20 nt, Homo sapiens
acacaguguuuccugaguag

SEQ ID NO: 1083201 - RNA, 17 nt, Homo sapiens
acacccccaagccacag

SEQ ID NO: 1083202 - RNA, 23 nt, Homo sapiens
acacccgccgccuccugcaccga

SEQ ID NO: 1083203 - RNA, 17 nt, Homo sapiens
acacguccuuuccugaa

SEQ ID NO: 1083204 - RNA, 23 nt, Homo sapiens
acacuacuugagaaaaugcagga

SEQ ID NO: 1083205 - RNA, 22 nt, Homo sapiens
acacucaaggaaaagaugugcu

SEQ ID NO: 1083206 - RNA, 17 nt, Homo sapiens
acacugagacuugaauc

SEQ ID NO: 1083207 - RNA, 22 nt, Homo sapiens
acacugagacuugaaucaaguc

SEQ ID NO: 1083208 - RNA, 20 nt, Homo sapiens
acagaaaccagaaaagcaau

SEQ ID NO: 1083209 - RNA, 12 nt, Homo sapiens
acagaagcaaau

SEQ ID NO: 1083210 - RNA, 20 nt, Homo sapiens
acagagcgagagucugucuc

SEQ ID NO: 1083211 - RNA, 17 nt, Homo sapiens
acagaugcuggccucuu

SEQ ID NO: 1083212 - RNA, 20 nt, Homo sapiens
acagcagggucuugcuguaa

SEQ ID NO: 1083213 - RNA, 22 nt, Homo sapiens
acagcaugggccucaccuccuc

SEQ ID NO: 1083214 - RNA, 11 nt, Homo sapiens
acagcucugcu

SEQ ID NO: 1083215 - RNA, 21 nt, Homo sapiens
acagcuggagacgaucuugcu

SEQ ID NO: 1083216 - RNA, 19 nt, Homo sapiens
acaggucuugcccaaaguc

SEQ ID NO: 1083217 - RNA, 21 nt, Homo sapiens
acagguuuucuucuaaucaua

SEQ ID NO: 1083218 - RNA, 18 nt, Homo sapiens
acaguccucacagccucu

SEQ ID NO: 1083219 - RNA, 19 nt, Homo sapiens
acagugccuggcaaggccu

SEQ ID NO: 1083220 - RNA, 20 nt, Homo sapiens
acagugccuggcaaggccuc

SEQ ID NO: 1083221 - RNA, 17 nt, Homo sapiens
acaguguuuccugagua

SEQ ID NO: 1083222 - RNA, 20 nt, Homo sapiens
acaguuuggauguccucaaa

SEQ ID NO: 1083223 - RNA, 12 nt, Homo sapiens
acauacagugau

SEQ ID NO: 1083224 - RNA, 21 nt, Homo sapiens
acauaccuaugggauuuuaca

SEQ ID NO: 1083225 - RNA, 23 nt, Homo sapiens
acaucacuguccaccaccaccug

SEQ ID NO: 1083226 - RNA, 21 nt, Homo sapiens
acauccaaccccccaccugcc

SEQ ID NO: 1083227 - RNA, 12 nt, Homo sapiens
acaucuuguuaa

SEQ ID NO: 1083228 - RNA, 22 nt, Homo sapiens
acaugcucaucccaaaagcuag

SEQ ID NO: 1083229 - RNA, 16 nt, Homo sapiens
acauguaucacucacu

SEQ ID NO: 1083230 - RNA, 22 nt, Homo sapiens
acauguauguggauacagucau

SEQ ID NO: 1083231 - RNA, 18 nt, Homo sapiens
acaugucccugucccucu

SEQ ID NO: 1083232 - RNA, 23 nt, Homo sapiens
acaugucuuuggcuucagaauug

SEQ ID NO: 1083233 - RNA, 19 nt, Homo sapiens
aggcaucugagugugagac

SEQ ID NO: 1083234 - RNA, 12 nt, Homo sapiens
aggccagcagca

SEQ ID NO: 1083235 - RNA, 14 nt, Homo sapiens
aggccaucuuccag

SEQ ID NO: 1083236 - RNA, 16 nt, Homo sapiens
aggccccuguggucac

SEQ ID NO: 1083237 - RNA, 21 nt, Homo sapiens
aggccggugugggcugugucg

SEQ ID NO: 1083238 - RNA, 16 nt, Homo sapiens
aggccuggcacagugu

SEQ ID NO: 1083239 - RNA, 15 nt, Homo sapiens
aggcuagagugcagu

SEQ ID NO: 1083240 - RNA, 20 nt, Homo sapiens
aggcuagagugcaguggcgu

SEQ ID NO: 1083241 - RNA, 15 nt, Homo sapiens
aggcugcaacccugg

SEQ ID NO: 1083242 - RNA, 15 nt, Homo sapiens
aggcuggagugcaau

SEQ ID NO: 1083243 - RNA, 18 nt, Homo sapiens
agggaaacccaucuucac

SEQ ID NO: 1083244 - RNA, 18 nt, Homo sapiens
agggaacgggguccuuca

SEQ ID NO: 1083245 - RNA, 12 nt, Homo sapiens
agggaugggaga

SEQ ID NO: 1083246 - RNA, 24 nt, Homo sapiens
agggccucugugcagacaguguca

SEQ ID NO: 1083247 - RNA, 19 nt, Homo sapiens
agggcuaaaucccaagugu

SEQ ID NO: 1083248 - RNA, 17 nt, Homo sapiens
aggggaggaucacugga

SEQ ID NO: 1083249 - RNA, 22 nt, Homo sapiens
aggggcaggcccugcacugucc

SEQ ID NO: 1083250 - RNA, 15 nt, Homo sapiens
aggucucacacuccu

SEQ ID NO: 1083251 - RNA, 19 nt, Homo sapiens
aggucuucuuguguccuga

SEQ ID NO: 1083252 - RNA, 15 nt, Homo sapiens
aggugccgauuucau

SEQ ID NO: 1083253 - RNA, 18 nt, Homo sapiens
agguggagguugcaguga

SEQ ID NO: 1083254 - RNA, 17 nt, Homo sapiens
agguuucucaaagaaau

SEQ ID NO: 1083255 - RNA, 17 nt, Homo sapiens
aguaaauagcauucucu

SEQ ID NO: 1083256 - RNA, 16 nt, Homo sapiens
aguaacaaaaguauag

SEQ ID NO: 1083257 - RNA, 22 nt, Homo sapiens
aguaagacuugauugguuuaaa

SEQ ID NO: 1083258 - RNA, 19 nt, Homo sapiens
aguacaauuguuaugaucu

SEQ ID NO: 1083259 - RNA, 22 nt, Homo sapiens
aguacagagaaauucuguggug

SEQ ID NO: 1083260 - RNA, 15 nt, Homo sapiens
aguaccacucaggcc

SEQ ID NO: 1083261 - RNA, 23 nt, Homo sapiens
aguauaggauaaauuacauuaaa

SEQ ID NO: 1083262 - RNA, 13 nt, Homo sapiens
agucaccaugcaa

SEQ ID NO: 1083263 - RNA, 16 nt, Homo sapiens
agucaccccucugucc

SEQ ID NO: 1083264 - RNA, 13 nt, Homo sapiens
agucacccuguga

SEQ ID NO: 1083265 - RNA, 14 nt, Homo sapiens
agucagaugcccag

SEQ ID NO: 1083266 - RNA, 20 nt, Homo sapiens
aguccaguccuuuguugcug

SEQ ID NO: 1083267 - RNA, 21 nt, Homo sapiens
agucccuuagaagaucugcuu

SEQ ID NO: 1083268 - RNA, 10 nt, Homo sapiens
aguccucaca

SEQ ID NO: 1083269 - RNA, 15 nt, Homo sapiens
agucucacauguccc

SEQ ID NO: 1083270 - RNA, 21 nt, Homo sapiens
agucuggcaaacaugugcaac

SEQ ID NO: 1083271 - RNA, 16 nt, Homo sapiens
agugaauaaacuucag

SEQ ID NO: 1083272 - RNA, 18 nt, Homo sapiens
agugacaacaucgcaaua

SEQ ID NO: 1083273 - RNA, 19 nt, Homo sapiens
agugacaagggcacaagcu

SEQ ID NO: 1083274 - RNA, 22 nt, Homo sapiens
agugauaucccccagccucaag

SEQ ID NO: 1083275 - RNA, 15 nt, Homo sapiens
agugaucucacuuaa

SEQ ID NO: 1083276 - RNA, 16 nt, Homo sapiens
agugauuguuaugccu

SEQ ID NO: 1083277 - RNA, 20 nt, Homo sapiens
agugcaauggcacgaucuca

SEQ ID NO: 1083278 - RNA, 14 nt, Homo sapiens
agugccuggggugu

SEQ ID NO: 1083279 - RNA, 19 nt, Homo sapiens
agugcuccugugcagggau

SEQ ID NO: 1083280 - RNA, 18 nt, Homo sapiens
aguggcaccuaauaaaga

SEQ ID NO: 1083281 - RNA, 21 nt, Homo sapiens
aguggcccccacucacaggga

SEQ ID NO: 1083282 - RNA, 23 nt, Homo sapiens
aguguccagaccauugucuucca

SEQ ID NO: 1083283 - RNA, 21 nt, Homo sapiens
agugucucuugacuggcucaa

SEQ ID NO: 1083284 - RNA, 14 nt, Homo sapiens
agugucuugaaugu

SEQ ID NO: 1083285 - RNA, 20 nt, Homo sapiens
aguguggauguucagaauuu

SEQ ID NO: 1083286 - RNA, 13 nt, Homo sapiens
agugugugcucag

SEQ ID NO: 1083287 - RNA, 22 nt, Homo sapiens
aguguuaggccuggcacagugu

SEQ ID NO: 1083288 - RNA, 17 nt, Homo sapiens
aguuccagcacaccauu

SEQ ID NO: 1083289 - RNA, 15 nt, Homo sapiens
aguucccuacgugaa

SEQ ID NO: 1083290 - RNA, 23 nt, Homo sapiens
aguucccuacgugaaccugccuu

SEQ ID NO: 1083291 - RNA, 11 nt, Homo sapiens
aguucugauga

SEQ ID NO: 1083292 - RNA, 12 nt, Homo sapiens
aguucugaugag

SEQ ID NO: 1083293 - RNA, 20 nt, Homo sapiens
aguucuggugaauguucaau

SEQ ID NO: 1083294 - RNA, 17 nt, Homo sapiens
aguugaccccuccugaa

SEQ ID NO: 1083295 - RNA, 13 nt, Homo sapiens
aguugagaacaaa

SEQ ID NO: 1083296 - RNA, 14 nt, Homo sapiens
aguugcauuuucau

SEQ ID NO: 1083297 - RNA, 16 nt, Homo sapiens
aguugguguucauaau

SEQ ID NO: 1083298 - RNA, 14 nt, Homo sapiens
aguugugaucaaag

SEQ ID NO: 1083299 - RNA, 20 nt, Homo sapiens
aguuguuuucccgagcaaag

SEQ ID NO: 1083300 - RNA, 21 nt, Homo sapiens
aguuuaauccuuuguauuaca

SEQ ID NO: 1083301 - RNA, 16 nt, Homo sapiens
aguuuaguauagcuuc

SEQ ID NO: 1083302 - RNA, 14 nt, Homo sapiens
aguuuaucauguca

SEQ ID NO: 1083303 - RNA, 14 nt, Homo sapiens
aucccagcaucuca

SEQ ID NO: 1083304 - RNA, 17 nt, Homo sapiens
aucccaucuaagcugca

SEQ ID NO: 1083305 - RNA, 19 nt, Homo sapiens
aucccccaaguguccugga

SEQ ID NO: 1083306 - RNA, 15 nt, Homo sapiens
auccccuguccccug

SEQ ID NO: 1083307 - RNA, 16 nt, Homo sapiens
aucccuuuuuuuacau

SEQ ID NO: 1083308 - RNA, 23 nt, Homo sapiens
auccuccccaccagagcugccuc

SEQ ID NO: 1083309 - RNA, 21 nt, Homo sapiens
auccucccuuugguaccuuaa

SEQ ID NO: 1083310 - RNA, 14 nt, Homo sapiens
auccuccucuccau

SEQ ID NO: 1083311 - RNA, 14 nt, Homo sapiens
auccugcaggguag

SEQ ID NO: 1083312 - RNA, 20 nt, Homo sapiens
auccuugauaaaugccucau

SEQ ID NO: 1083313 - RNA, 15 nt, Homo sapiens
aucuauuaaaccauc

SEQ ID NO: 1083314 - RNA, 17 nt, Homo sapiens
aucucagaguccaguca

SEQ ID NO: 1083315 - RNA, 16 nt, Homo sapiens
aucucagcagccagcu

SEQ ID NO: 1083316 - RNA, 13 nt, Homo sapiens
aucuccaguaucc

SEQ ID NO: 1083317 - RNA, 23 nt, Homo sapiens
aucucccuagccugcuuuugucc

SEQ ID NO: 1083318 - RNA, 17 nt, Homo sapiens
aucuccugagcucguga

SEQ ID NO: 1083319 - RNA, 17 nt, Homo sapiens
aucucggcucacugcaa

SEQ ID NO: 1083320 - RNA, 13 nt, Homo sapiens
aucucucuacucc

SEQ ID NO: 1083321 - RNA, 16 nt, Homo sapiens
aucuguccauccuccu

SEQ ID NO: 1083322 - RNA, 15 nt, Homo sapiens
aucuguguuuacuua

SEQ ID NO: 1083323 - RNA, 15 nt, Homo sapiens
aucuuaggauuuacc

SEQ ID NO: 1083324 - RNA, 17 nt, Homo sapiens
aucuuaggauuuaccaa

SEQ ID NO: 1083325 - RNA, 15 nt, Homo sapiens
aucuuccccggaugu

SEQ ID NO: 1083326 - RNA, 17 nt, Homo sapiens
aucuuucuuuccaaaac

SEQ ID NO: 1083327 - RNA, 12 nt, Homo sapiens
aucuuuuccacu

SEQ ID NO: 1083328 - RNA, 20 nt, Homo sapiens
augaaaaaaaugcauuuuau

SEQ ID NO: 1083329 - RNA, 23 nt, Homo sapiens
augaaaaauaguguguccaugca

SEQ ID NO: 1083330 - RNA, 14 nt, Homo sapiens
augaaaccacugga

SEQ ID NO: 1083331 - RNA, 13 nt, Homo sapiens
augaaagaggcau

SEQ ID NO: 1083332 - RNA, 14 nt, Homo sapiens
augaacccauccaa

SEQ ID NO: 1083333 - RNA, 18 nt, Homo sapiens
augaacccauccaaugga

SEQ ID NO: 1083334 - RNA, 18 nt, Homo sapiens
augaauuugacugguuca

SEQ ID NO: 1083335 - RNA, 17 nt, Homo sapiens
augacagagaugugcau

SEQ ID NO: 1083336 - RNA, 14 nt, Homo sapiens
augagcaacuccug

SEQ ID NO: 1083337 - RNA, 14 nt, Homo sapiens
augaggccaugcaa

SEQ ID NO: 1083338 - RNA, 22 nt, Homo sapiens
augagguuggaaagaguugcca

SEQ ID NO: 1083339 - RNA, 21 nt, Homo sapiens
augaugaaaacuaaggauuuu

SEQ ID NO: 1083340 - RNA, 21 nt, Homo sapiens
augcaaaaacauaugucuguc

SEQ ID NO: 1083341 - RNA, 13 nt, Homo sapiens
augcagugcagca

SEQ ID NO: 1083342 - RNA, 18 nt, Homo sapiens
augcauucuagugcagaa

SEQ ID NO: 1083343 - RNA, 14 nt, Homo sapiens
augccacuaugaaa

SEQ ID NO: 1083344 - RNA, 13 nt, Homo sapiens
augccagcuauaa

SEQ ID NO: 1083345 - RNA, 21 nt, Homo sapiens
augcccaauccaggcccggug

SEQ ID NO: 1083346 - RNA, 23 nt, Homo sapiens
augcuaucucgcuagccauauau

SEQ ID NO: 1083347 - RNA, 18 nt, Homo sapiens
augcugugcaaacagugu

SEQ ID NO: 1083348 - RNA, 13 nt, Homo sapiens
augcuugugauuu

SEQ ID NO: 1083349 - RNA, 16 nt, Homo sapiens
auggaagggccuucuc

SEQ ID NO: 1083350 - RNA, 18 nt, Homo sapiens
auggaagggccuucucca

SEQ ID NO: 1083351 - RNA, 21 nt, Homo sapiens
auggagcuugacuucaugcca

SEQ ID NO: 1083352 - RNA, 18 nt, Homo sapiens
auggaggaaagugauauc

SEQ ID NO: 1083353 - RNA, 20 nt, Homo sapiens
auggccagugugaucccaag

SEQ ID NO: 1083354 - RNA, 18 nt, Homo sapiens
auggcucuggcaccacua

SEQ ID NO: 1083355 - RNA, 13 nt, Homo sapiens
auggcuuacuuac

SEQ ID NO: 1083356 - RNA, 23 nt, Homo sapiens
augggauuucaccguauuagcca

SEQ ID NO: 1083357 - RNA, 18 nt, Homo sapiens
augggcuuucucaguguc

SEQ ID NO: 1083358 - RNA, 16 nt, Homo sapiens
auggggaguacauuca

SEQ ID NO: 1083359 - RNA, 20 nt, Homo sapiens
augguccuggggcucugugc

SEQ ID NO: 1083360 - RNA, 21 nt, Homo sapiens
augguccuggggcucugugca

SEQ ID NO: 1083361 - RNA, 15 nt, Homo sapiens
auggucuugaucucc

SEQ ID NO: 1083362 - RNA, 19 nt, Homo sapiens
auggugguaaacauucucu

SEQ ID NO: 1083363 - RNA, 20 nt, Homo sapiens
auggugugugucucugacaa

SEQ ID NO: 1083364 - RNA, 24 nt, Homo sapiens
auguaaggucuucuuguguccuga

SEQ ID NO: 1083365 - RNA, 21 nt, Homo sapiens
auguaguaguuugggugugua

SEQ ID NO: 1083366 - RNA, 23 nt, Homo sapiens
augucaaguaccaaaauguuaau

SEQ ID NO: 1083367 - RNA, 16 nt, Homo sapiens
augucaucaagcucca

SEQ ID NO: 1083368 - RNA, 16 nt, Homo sapiens
augucuacuccucaca

SEQ ID NO: 1083369 - RNA, 17 nt, Homo sapiens
augugaucaucuuugcu

SEQ ID NO: 1083370 - RNA, 15 nt, Homo sapiens
auguggguugugaua

SEQ ID NO: 1083371 - RNA, 20 nt, Homo sapiens
auguguguguguuguguuaa

SEQ ID NO: 1083372 - RNA, 13 nt, Homo sapiens
auguguuccaagg

SEQ ID NO: 1083373 - RNA, 11 nt, Homo sapiens
auguguugcau

SEQ ID NO: 1083374 - RNA, 18 nt, Homo sapiens
auguuacuuaaacaucau

SEQ ID NO: 1083375 - RNA, 18 nt, Homo sapiens
gcuccauuuucuugucaa

SEQ ID NO: 1083376 - RNA, 22 nt, Homo sapiens
gcucccgagcuacucucuugcc

SEQ ID NO: 1083377 - RNA, 16 nt, Homo sapiens
gcuccuaguagcuuuc

SEQ ID NO: 1083378 - RNA, 15 nt, Homo sapiens
gcucgaagacuguga

SEQ ID NO: 1083379 - RNA, 18 nt, Homo sapiens
gcucuacccugcagcuug

SEQ ID NO: 1083380 - RNA, 14 nt, Homo sapiens
gcucuaucugcaau

SEQ ID NO: 1083381 - RNA, 16 nt, Homo sapiens
gcucuauuaagauuuc

SEQ ID NO: 1083382 - RNA, 15 nt, Homo sapiens
gcucuggcaccacua

SEQ ID NO: 1083383 - RNA, 20 nt, Homo sapiens
gcugacccagugugugcuca

SEQ ID NO: 1083384 - RNA, 19 nt, Homo sapiens
gcugaccugguacugaggu

SEQ ID NO: 1083385 - RNA, 16 nt, Homo sapiens
gcugagugcaccacuu

SEQ ID NO: 1083386 - RNA, 19 nt, Homo sapiens
gcugccucccuuucauaca

SEQ ID NO: 1083387 - RNA, 17 nt, Homo sapiens
gcugccuguauucucua

SEQ ID NO: 1083388 - RNA, 23 nt, Homo sapiens
gcugcgucagaccaguacuggga

SEQ ID NO: 1083389 - RNA, 13 nt, Homo sapiens
gcugcucugcuau

SEQ ID NO: 1083390 - RNA, 22 nt, Homo sapiens
gcugcuggcccacagcucugcu

SEQ ID NO: 1083391 - RNA, 20 nt, Homo sapiens
gcuggaagaacugcaugggg

SEQ ID NO: 1083392 - RNA, 18 nt, Homo sapiens
gcuggaggaacauuggga

SEQ ID NO: 1083393 - RNA, 18 nt, Homo sapiens
gcuggauggggagucuca

SEQ ID NO: 1083394 - RNA, 21 nt, Homo sapiens
gcuggcuggggccuaucagug

SEQ ID NO: 1083395 - RNA, 13 nt, Homo sapiens
gcugggauuacag

SEQ ID NO: 1083396 - RNA, 16 nt, Homo sapiens
gcugugaacauggacu

SEQ ID NO: 1083397 - RNA, 21 nt, Homo sapiens
gcuuacaguaggagugagaaa

SEQ ID NO: 1083398 - RNA, 23 nt, Homo sapiens
gcuuacuuacaaaagcagcuuuu

SEQ ID NO: 1083399 - RNA, 13 nt, Homo sapiens
gcuucagccugag

SEQ ID NO: 1083400 - RNA, 16 nt, Homo sapiens
gcuucuggagcccuug

SEQ ID NO: 1083401 - RNA, 12 nt, Homo sapiens
gcuuuccuccca

SEQ ID NO: 1083402 - RNA, 16 nt, Homo sapiens
gcuuucucagugucag

SEQ ID NO: 1083403 - RNA, 20 nt, Homo sapiens
gcuuuggagacgccucccca

SEQ ID NO: 1083404 - RNA, 20 nt, Homo sapiens
gcuuuucuaaucugcagugg

SEQ ID NO: 1083405 - RNA, 13 nt, Homo sapiens
gcuuuucucccag

SEQ ID NO: 1083406 - RNA, 12 nt, Homo sapiens
gcuuuugaacug

SEQ ID NO: 1083407 - RNA, 14 nt, Homo sapiens
gcuuuuugcuuucu

SEQ ID NO: 1083408 - RNA, 18 nt, Homo sapiens
ggaaaaaggcuucuccac

SEQ ID NO: 1083409 - RNA, 14 nt, Homo sapiens
ggaaaccaguguag

SEQ ID NO: 1083410 - RNA, 16 nt, Homo sapiens
ggaagcauguacugua

SEQ ID NO: 1083411 - RNA, 22 nt, Homo sapiens
ggaagcccucggccuccagacu

SEQ ID NO: 1083412 - RNA, 13 nt, Homo sapiens
guaccagccugac

SEQ ID NO: 1083413 - RNA, 12 nt, Homo sapiens
guaccuggugac

SEQ ID NO: 1083414 - RNA, 19 nt, Homo sapiens
guaccuuaauuugacuguc

SEQ ID NO: 1083415 - RNA, 20 nt, Homo sapiens
guagaaagugauccauacuu

SEQ ID NO: 1083416 - RNA, 12 nt, Homo sapiens
guagaagccagu

SEQ ID NO: 1083417 - RNA, 13 nt, Homo sapiens
guagagaugggau

SEQ ID NO: 1083418 - RNA, 12 nt, Homo sapiens
guagagcuggug

SEQ ID NO: 1083419 - RNA, 19 nt, Homo sapiens
guauauauaguagcauuuc

SEQ ID NO: 1083420 - RNA, 15 nt, Homo sapiens
guauuagccagucau

SEQ ID NO: 1083421 - RNA, 22 nt, Homo sapiens
guauuuuaggcagggauuugag

SEQ ID NO: 1083422 - RNA, 21 nt, Homo sapiens
gucaaagaaaacuuccaaaaa

SEQ ID NO: 1083423 - RNA, 24 nt, Homo sapiens
gucaaguucccuccugcagccuga

SEQ ID NO: 1083424 - RNA, 22 nt, Homo sapiens
gucaccccucuguccagccagc

SEQ ID NO: 1083425 - RNA, 19 nt, Homo sapiens
gucagaccaguacugggaa

SEQ ID NO: 1083426 - RNA, 16 nt, Homo sapiens
gucauuauuuuuguua

SEQ ID NO: 1083427 - RNA, 21 nt, Homo sapiens
gucauuuggugccaguauuuu

SEQ ID NO: 1083428 - RNA, 14 nt, Homo sapiens
guccacaguggaac

SEQ ID NO: 1083429 - RNA, 13 nt, Homo sapiens
guccagggcggga

SEQ ID NO: 1083430 - RNA, 21 nt, Homo sapiens
guccaucccgucgacguagaa

SEQ ID NO: 1083431 - RNA, 21 nt, Homo sapiens
guccccggccacgucugugcu

SEQ ID NO: 1083432 - RNA, 12 nt, Homo sapiens
guccccuacccc

SEQ ID NO: 1083433 - RNA, 19 nt, Homo sapiens
gucccucaggcuuguugcc

SEQ ID NO: 1083434 - RNA, 17 nt, Homo sapiens
gucccugaagucuugca

SEQ ID NO: 1083435 - RNA, 13 nt, Homo sapiens
guccugucagugc

SEQ ID NO: 1083436 - RNA, 14 nt, Homo sapiens
guccuuacucagag

SEQ ID NO: 1083437 - RNA, 23 nt, Homo sapiens
guccuuggagugcugcagcuuug

SEQ ID NO: 1083438 - RNA, 15 nt, Homo sapiens
gucgacuuugagcug

SEQ ID NO: 1083439 - RNA, 23 nt, Homo sapiens
gucguuuuguugccaaggcagaa

SEQ ID NO: 1083440 - RNA, 16 nt, Homo sapiens
gucuaaagagcuuuag

SEQ ID NO: 1083441 - RNA, 22 nt, Homo sapiens
gucuaaauaaaugaaguauuuc

SEQ ID NO: 1083442 - RNA, 15 nt, Homo sapiens
gucuauaaacaugaa

SEQ ID NO: 1083443 - RNA, 12 nt, Homo sapiens
gucucacacucc

SEQ ID NO: 1083444 - RNA, 23 nt, Homo sapiens
gucucaccccucauccuuuuacu

SEQ ID NO: 1083445 - RNA, 14 nt, Homo sapiens
gucucugcugcuaa

SEQ ID NO: 1083446 - RNA, 11 nt, Homo sapiens
gucugcagcuc

SEQ ID NO: 1083447 - RNA, 19 nt, Homo sapiens
gucuggcaaacaugugcaa

SEQ ID NO: 1083448 - RNA, 17 nt, Homo sapiens
uaggugucuguuuccca

SEQ ID NO: 1083449 - RNA, 13 nt, Homo sapiens
uaguacugggaau

SEQ ID NO: 1083450 - RNA, 18 nt, Homo sapiens
uagucaaucaaacaggga

SEQ ID NO: 1083451 - RNA, 18 nt, Homo sapiens
uagucccagcuacucaga

SEQ ID NO: 1083452 - RNA, 15 nt, Homo sapiens
uagucucaaaucaaa

SEQ ID NO: 1083453 - RNA, 11 nt, Homo sapiens
uagugcuucuu

SEQ ID NO: 1083454 - RNA, 22 nt, Homo sapiens
uaguggcuguccagugcccauu

SEQ ID NO: 1083455 - RNA, 16 nt, Homo sapiens
uaguugaugcuacaaa

SEQ ID NO: 1083456 - RNA, 18 nt, Homo sapiens
uaguugcauauauggaca

SEQ ID NO: 1083457 - RNA, 23 nt, Homo sapiens
uaguugcauauauggacaccgac

SEQ ID NO: 1083458 - RNA, 21 nt, Homo sapiens
uaguuuguuuuagaaccagcc

SEQ ID NO: 1083459 - RNA, 12 nt, Homo sapiens
uauaaauuuugu

SEQ ID NO: 1083460 - RNA, 15 nt, Homo sapiens
uauaacaaacuacau

SEQ ID NO: 1083461 - RNA, 18 nt, Homo sapiens
uauaacuuauuugcccua

SEQ ID NO: 1083462 - RNA, 12 nt, Homo sapiens
uauaauaugcaa

SEQ ID NO: 1083463 - RNA, 16 nt, Homo sapiens
uauaauuaauugucau

SEQ ID NO: 1083464 - RNA, 13 nt, Homo sapiens
uauacaaacaggu

SEQ ID NO: 1083465 - RNA, 18 nt, Homo sapiens
uauauaauuuuauugcug

SEQ ID NO: 1083466 - RNA, 20 nt, Homo sapiens
uauauagcucuacacaacau

SEQ ID NO: 1083467 - RNA, 13 nt, Homo sapiens
uauauaguagcau

SEQ ID NO: 1083468 - RNA, 19 nt, Homo sapiens
uauauaugauuguuugcac

SEQ ID NO: 1083469 - RNA, 19 nt, Homo sapiens
uauauauucuacacauaua

SEQ ID NO: 1083470 - RNA, 20 nt, Homo sapiens
uauauuugugugugugauau

SEQ ID NO: 1083471 - RNA, 20 nt, Homo sapiens
uaucaaaaaguacaauaaua

SEQ ID NO: 1083472 - RNA, 22 nt, Homo sapiens
uaucagugaugaaaauuugccu

SEQ ID NO: 1083473 - RNA, 19 nt, Homo sapiens
uauccacaaaugcuauuca

SEQ ID NO: 1083474 - RNA, 18 nt, Homo sapiens
uaucuaccucacuauuca

SEQ ID NO: 1083475 - RNA, 15 nt, Homo sapiens
uaucugauacuguau

SEQ ID NO: 1083476 - RNA, 19 nt, Homo sapiens
uaucugguaucugcaugua

SEQ ID NO: 1083477 - RNA, 16 nt, Homo sapiens
uaucuguuugcuucua

SEQ ID NO: 1083478 - RNA, 19 nt, Homo sapiens
uaugaaaaaucaaugucaa

SEQ ID NO: 1083479 - RNA, 22 nt, Homo sapiens
uaugacucaccuugcucugcca

SEQ ID NO: 1083480 - RNA, 15 nt, Homo sapiens
uaugccucuguauuu

SEQ ID NO: 1083481 - RNA, 16 nt, Homo sapiens
uaugccuuaagccaau

SEQ ID NO: 1083482 - RNA, 14 nt, Homo sapiens
uauggacaccgacu

SEQ ID NO: 1083483 - RNA, 10 nt, Homo sapiens
uaugugaaaa

SEQ ID NO: 1083484 - RNA, 17 nt, Homo sapiens
uauguuaggaauacucu

SEQ ID NO: 1083485 - RNA, 17 nt, Homo sapiens
uauuaaaaaaacacaaa

SEQ ID NO: 1083486 - RNA, 23 nt, Homo sapiens
uauuaagauuuccaagugccaau

SEQ ID NO: 1083487 - RNA, 18 nt, Homo sapiens
uauuaauauaaccauaaa

SEQ ID NO: 1083488 - RNA, 23 nt, Homo sapiens
uauuacccccuuuccucuugggc

SEQ ID NO: 1083489 - RNA, 13 nt, Homo sapiens
uauucaaguauua

SEQ ID NO: 1083490 - RNA, 21 nt, Homo sapiens
uauucagauaaggcagaacua

SEQ ID NO: 1083491 - RNA, 21 nt, Homo sapiens
uauuccacuggcgcaucauau

SEQ ID NO: 1083492 - RNA, 23 nt, Homo sapiens
uauuccgggugccauucccacua

SEQ ID NO: 1083493 - RNA, 15 nt, Homo sapiens
uauucugauuccacu

SEQ ID NO: 1083494 - RNA, 23 nt, Homo sapiens
uauuguacauugggcacauaucu

SEQ ID NO: 1083495 - RNA, 16 nt, Homo sapiens
uauuuuuguaccauau

SEQ ID NO: 1083496 - RNA, 18 nt, Homo sapiens
uauuuuuuacaauggcca

SEQ ID NO: 1083497 - RNA, 20 nt, Homo sapiens
ucaaaaaaaaaaaaauguga

SEQ ID NO: 1083498 - RNA, 19 nt, Homo sapiens
ucaaaaguaaugcuucaau

SEQ ID NO: 1083499 - RNA, 17 nt, Homo sapiens
ucaaagaaaacuuccaa

SEQ ID NO: 1083500 - RNA, 22 nt, Homo sapiens
ucaaagaaauuuccacucaggu

SEQ ID NO: 1083501 - RNA, 13 nt, Homo sapiens
ucaaauacauaca

SEQ ID NO: 1083502 - RNA, 19 nt, Homo sapiens
ucaaauggacaauaccaga

SEQ ID NO: 1083503 - RNA, 12 nt, Homo sapiens
ucaaaugugcau

SEQ ID NO: 1083504 - RNA, 17 nt, Homo sapiens
ucaacagugaacagcuu

SEQ ID NO: 1083505 - RNA, 14 nt, Homo sapiens
ucaacuacucagcu

SEQ ID NO: 1083506 - RNA, 23 nt, Homo sapiens
ucaagagaucuuucuuuccaaaa

SEQ ID NO: 1083507 - RNA, 23 nt, Homo sapiens
ucaaguggaaacaugcugaaauc

SEQ ID NO: 1083508 - RNA, 19 nt, Homo sapiens
ucacaccauucuccugccu

SEQ ID NO: 1083509 - RNA, 22 nt, Homo sapiens
ucacaccauuuuguuuagacaa

SEQ ID NO: 1083510 - RNA, 15 nt, Homo sapiens
ucacacgggguauuu

SEQ ID NO: 1083511 - RNA, 20 nt, Homo sapiens
ucacaggacucugcagauag

SEQ ID NO: 1083512 - RNA, 22 nt, Homo sapiens
ucaccaggggcaggcacagcac

SEQ ID NO: 1083513 - RNA, 12 nt, Homo sapiens
ucaccaugcaag

SEQ ID NO: 1083514 - RNA, 19 nt, Homo sapiens
ucaccuuaacucagccaga

SEQ ID NO: 1083515 - RNA, 22 nt, Homo sapiens
ucacuagccaugauaacugcaa

SEQ ID NO: 1083516 - RNA, 20 nt, Homo sapiens
ucacugcucccccgugugua

SEQ ID NO: 1083517 - RNA, 18 nt, Homo sapiens
ucacuuuuuauuuugcca

SEQ ID NO: 1083518 - RNA, 13 nt, Homo sapiens
ucagaaagucaua

SEQ ID NO: 1083519 - RNA, 13 nt, Homo sapiens
ucagaagccugag

SEQ ID NO: 1083520 - RNA, 13 nt, Homo sapiens
ucagacauuccaa

SEQ ID NO: 1083521 - RNA, 18 nt, Homo sapiens
ucagaccaguacugggaa

SEQ ID NO: 1083522 - RNA, 20 nt, Homo sapiens
ucagcacuagaucaugggau

SEQ ID NO: 1083523 - RNA, 13 nt, Homo sapiens
ucagcacucaggu

SEQ ID NO: 1083524 - RNA, 19 nt, Homo sapiens
ucagccuccgccauuccaa

SEQ ID NO: 1083525 - RNA, 17 nt, Homo sapiens
ucagcugugaacaugga

SEQ ID NO: 1083526 - RNA, 19 nt, Homo sapiens
ucaggaaaggaagauguaa

SEQ ID NO: 1083527 - RNA, 18 nt, Homo sapiens
ucaggccaacaagccaac

SEQ ID NO: 1083528 - RNA, 23 nt, Homo sapiens
ucaggcuggguugucacugagac

SEQ ID NO: 1083529 - RNA, 16 nt, Homo sapiens
ucagggaccacagcaa

SEQ ID NO: 1083530 - RNA, 14 nt, Homo sapiens
ucaggugcuacaca

SEQ ID NO: 1083531 - RNA, 13 nt, Homo sapiens
ucaguaaauacuc

SEQ ID NO: 1083532 - RNA, 14 nt, Homo sapiens
ucagucuuggaguu

SEQ ID NO: 1083533 - RNA, 22 nt, Homo sapiens
ucugcagauagugccucugcaa

SEQ ID NO: 1083534 - RNA, 14 nt, Homo sapiens
ucugccugagauuc

SEQ ID NO: 1083535 - RNA, 12 nt, Homo sapiens
ucugcucaguga

SEQ ID NO: 1083536 - RNA, 20 nt, Homo sapiens
ucuggcuaaauggacaucau

SEQ ID NO: 1083537 - RNA, 17 nt, Homo sapiens
ucugggccaaguuccuc

SEQ ID NO: 1083538 - RNA, 15 nt, Homo sapiens
ucuguauauaacuua

SEQ ID NO: 1083539 - RNA, 22 nt, Homo sapiens
ucuguauauaacuuauuugccc

SEQ ID NO: 1083540 - RNA, 17 nt, Homo sapiens
ucuguccagccagcucc

SEQ ID NO: 1083541 - RNA, 20 nt, Homo sapiens
ucuguccagccagcuccugc

SEQ ID NO: 1083542 - RNA, 21 nt, Homo sapiens
ucuguccagccagcuccugca

SEQ ID NO: 1083543 - RNA, 16 nt, Homo sapiens
ucuguguuuacuuaag

SEQ ID NO: 1083544 - RNA, 17 nt, Homo sapiens
ucuguuccccauggcca

SEQ ID NO: 1083545 - RNA, 16 nt, Homo sapiens
ucuguuucccaccuca

SEQ ID NO: 1083546 - RNA, 18 nt, Homo sapiens
ucuuacagucagcacaga

SEQ ID NO: 1083547 - RNA, 17 nt, Homo sapiens
ucuucagcugguggaug

SEQ ID NO: 1083548 - RNA, 17 nt, Homo sapiens
ucuucccacuuugccac

SEQ ID NO: 1083549 - RNA, 13 nt, Homo sapiens
ucuuccugcaaag

SEQ ID NO: 1083550 - RNA, 22 nt, Homo sapiens
ucuucucucccacgugcacagc

SEQ ID NO: 1083551 - RNA, 22 nt, Homo sapiens
ucuucucuguuacaaaacgaga

SEQ ID NO: 1083552 - RNA, 19 nt, Homo sapiens
ucuucuuguguccugauga

SEQ ID NO: 1083553 - RNA, 14 nt, Homo sapiens
ucuugcccaaaguc

SEQ ID NO: 1083554 - RNA, 16 nt, Homo sapiens
ucuuuaguucugucag

SEQ ID NO: 1083555 - RNA, 13 nt, Homo sapiens
ucuuuccaaaaca

SEQ ID NO: 1083556 - RNA, 17 nt, Homo sapiens
ucuuuccagaccccaca

SEQ ID NO: 1083557 - RNA, 18 nt, Homo sapiens
ucuuuccuuuugcaacaa

SEQ ID NO: 1083558 - RNA, 20 nt, Homo sapiens
ucuuucuuugcaccaaagac

SEQ ID NO: 1083559 - RNA, 15 nt, Homo sapiens
ugaaaaaaaugcauu

SEQ ID NO: 1083560 - RNA, 16 nt, Homo sapiens
ugaaaaaaaugcauuu

SEQ ID NO: 1083561 - RNA, 16 nt, Homo sapiens
ugaaaaauaugugcuu

SEQ ID NO: 1083562 - RNA, 12 nt, Homo sapiens
ugaaaaugauua

SEQ ID NO: 1083563 - RNA, 17 nt, Homo sapiens
ugaaacagggcacccca

SEQ ID NO: 1083564 - RNA, 14 nt, Homo sapiens
ugaaacauuuggaa

SEQ ID NO: 1083565 - RNA, 15 nt, Homo sapiens
ugaaaccgucccuga

SEQ ID NO: 1083566 - RNA, 17 nt, Homo sapiens
ugaaagacaucaaugaa

SEQ ID NO: 1083567 - RNA, 12 nt, Homo sapiens
ugaaagaugcaa

SEQ ID NO: 1083568 - RNA, 17 nt, Homo sapiens
ugaaagucaugcacaua

SEQ ID NO: 1083569 - RNA, 18 nt, Homo sapiens
ugaaagugaauaaacuuc

SEQ ID NO: 1083570 - RNA, 23 nt, Homo sapiens
ugaagacccucaaugccaagaaa

SEQ ID NO: 1083571 - RNA, 13 nt, Homo sapiens
ugaagccacugaa

SEQ ID NO: 1083572 - RNA, 11 nt, Homo sapiens
ugaaguggcac

SEQ ID NO: 1083573 - RNA, 19 nt, Homo sapiens
ugaaucccauaucuaccca

SEQ ID NO: 1083574 - RNA, 13 nt, Homo sapiens
ugaaugucauuau

SEQ ID NO: 1083575 - RNA, 12 nt, Homo sapiens
ugaauguucaau

SEQ ID NO: 1083576 - RNA, 18 nt, Homo sapiens
ugaauuacacucaaggaa

SEQ ID NO: 1083577 - RNA, 18 nt, Homo sapiens
ugaauuugccuuccucau

SEQ ID NO: 1083578 - RNA, 21 nt, Homo sapiens
uuagugucuugaauguaagaa

SEQ ID NO: 1083579 - RNA, 15 nt, Homo sapiens
uuaucuccugggauu

SEQ ID NO: 1083580 - RNA, 11 nt, Homo sapiens
uuaucugcuag

SEQ ID NO: 1083581 - RNA, 20 nt, Homo sapiens
uuaugacuccccccuuccaa

SEQ ID NO: 1083582 - RNA, 17 nt, Homo sapiens
uuauuaauuaaaccaga

SEQ ID NO: 1083583 - RNA, 15 nt, Homo sapiens
uuauuccuuugcaua

SEQ ID NO: 1083584 - RNA, 16 nt, Homo sapiens
uuauucugauuccacu

SEQ ID NO: 1083585 - RNA, 13 nt, Homo sapiens
uuauugugccuca

SEQ ID NO: 1083586 - RNA, 20 nt, Homo sapiens
uuauuugggggaggcuucag

SEQ ID NO: 1083587 - RNA, 19 nt, Homo sapiens
uuauuuuuguuagcaaaga

SEQ ID NO: 1083588 - RNA, 16 nt, Homo sapiens
uucacaaacaaauggc

SEQ ID NO: 1083589 - RNA, 23 nt, Homo sapiens
uucacaaacaaauggcuguaaaa

SEQ ID NO: 1083590 - RNA, 18 nt, Homo sapiens
uucacauaguuugauaaa

SEQ ID NO: 1083591 - RNA, 16 nt, Homo sapiens
uucaccuguguacuga

SEQ ID NO: 1083592 - RNA, 14 nt, Homo sapiens
uucacugcucugcc

SEQ ID NO: 1083593 - RNA, 13 nt, Homo sapiens
uucagcagucagu

SEQ ID NO: 1083594 - RNA, 18 nt, Homo sapiens
uucagcugugaacaugga

SEQ ID NO: 1083595 - RNA, 16 nt, Homo sapiens
uucaguggugugaucu

SEQ ID NO: 1083596 - RNA, 21 nt, Homo sapiens
uucaugccagcuauaaucucc

SEQ ID NO: 1083597 - RNA, 14 nt, Homo sapiens
uuccaacacacaau

SEQ ID NO: 1083598 - RNA, 17 nt, Homo sapiens
uuccaauaaaacuuuau

SEQ ID NO: 1083599 - RNA, 23 nt, Homo sapiens
uuccacuuugaguaccaaaucca

SEQ ID NO: 1083600 - RNA, 16 nt, Homo sapiens
uuccagauuaacauaa

SEQ ID NO: 1083601 - RNA, 19 nt, Homo sapiens
uuccagcacaccauugcau

SEQ ID NO: 1083602 - RNA, 15 nt, Homo sapiens
uuccaugauacuuua

SEQ ID NO: 1083603 - RNA, 15 nt, Homo sapiens
uuccauuuuacuucc

SEQ ID NO: 1083604 - RNA, 21 nt, Homo sapiens
uuccauuuuacuuccaugaua

SEQ ID NO: 1083605 - RNA, 16 nt, Homo sapiens
uucccaauugccacau

SEQ ID NO: 1083606 - RNA, 15 nt, Homo sapiens
uucccacuuugccac

SEQ ID NO: 1083607 - RNA, 21 nt, Homo sapiens
uuccccugcucacucuuccac

SEQ ID NO: 1083608 - RNA, 12 nt, Homo sapiens
uucccuccugca

SEQ ID NO: 1083609 - RNA, 22 nt, Homo sapiens
uucccuggggccccauuugcca

SEQ ID NO: 1083610 - RNA, 23 nt, Homo sapiens
uuccuacacccuuggacuugagg

SEQ ID NO: 1083611 - RNA, 16 nt, Homo sapiens
uuccucgccucuccca

SEQ ID NO: 1083612 - RNA, 19 nt, Homo sapiens
uucuaaagcucugaacaaa

SEQ ID NO: 1083613 - RNA, 14 nt, Homo sapiens
uucuaacauaagua

SEQ ID NO: 1083614 - RNA, 14 nt, Homo sapiens
uucuacacauauau

SEQ ID NO: 1083615 - RNA, 16 nt, Homo sapiens
uucuacuguauaaaca

SEQ ID NO: 1083616 - RNA, 15 nt, Homo sapiens
uucuccaguguaaca

SEQ ID NO: 1083617 - RNA, 12 nt, Homo sapiens
uucucuauucca

SEQ ID NO: 1083618 - RNA, 20 nt, Homo sapiens
uucucucccacgugcacagc

SEQ ID NO: 1083619 - RNA, 13 nt, Homo sapiens
uucugaacaaaga

SEQ ID NO: 1083620 - RNA, 21 nt, Homo sapiens
uucuucuaaugagucgacuuu

SEQ ID NO: 1083621 - RNA, 23 nt, Homo sapiens
uucuucuaaugagucgacuuuga

SEQ ID NO: 1083622 - RNA, 13 nt, Homo sapiens
uucuucugccuca

SEQ ID NO: 1083623 - RNA, 13 nt, Homo sapiens
uugaaagacauca

SEQ ID NO: 1083624 - RNA, 18 nt, Homo sapiens
uugaaagacaucaaugaa

SEQ ID NO: 1083625 - RNA, 19 nt, Homo sapiens
uugaacuuauuuacacaua

SEQ ID NO: 1083626 - RNA, 19 nt, Homo sapiens
uugaagacccucaaugcca

SEQ ID NO: 1083627 - RNA, 20 nt, Homo sapiens
uugaaggagaaaaugcauua

SEQ ID NO: 1083628 - RNA, 17 nt, Homo sapiens
uugaauguaagaacaug

SEQ ID NO: 1083629 - RNA, 18 nt, Homo sapiens
uugaccugaacucugcaa

SEQ ID NO: 1083630 - RNA, 17 nt, Homo sapiens
uugacucuacucccagc

SEQ ID NO: 1083631 - RNA, 16 nt, Homo sapiens
uugacuggccaaaaau

SEQ ID NO: 1083632 - RNA, 15 nt, Homo sapiens
ccucagcugccucau

SEQ ID NO: 1083633 - RNA, 15 nt, Homo sapiens
ccucagugcugcaau

SEQ ID NO: 1083634 - RNA, 19 nt, Homo sapiens
ccucaguuuuuccuaguca

SEQ ID NO: 1083635 - RNA, 13 nt, Homo sapiens
ccuccaaguccac

SEQ ID NO: 1083636 - RNA, 18 nt, Homo sapiens
ccuccacucccacuuccc

SEQ ID NO: 1083637 - RNA, 18 nt, Homo sapiens
ccucccaguuugcugggu

SEQ ID NO: 1083638 - RNA, 18 nt, Homo sapiens
ccuccugaacuggccacu

SEQ ID NO: 1083639 - RNA, 17 nt, Homo sapiens
ccucgguacucccauaa

SEQ ID NO: 1083640 - RNA, 12 nt, Homo sapiens
ccucucuugccg

SEQ ID NO: 1083641 - RNA, 19 nt, Homo sapiens
ccucugcgccucuccacug

SEQ ID NO: 1083642 - RNA, 14 nt, Homo sapiens
ccucugcugccaug

SEQ ID NO: 1083643 - RNA, 14 nt, Homo sapiens
ccucuguccagcca

SEQ ID NO: 1083644 - RNA, 13 nt, Homo sapiens
ccugaacauauua

SEQ ID NO: 1083645 - RNA, 15 nt, Homo sapiens
ccugaacucugcaac

SEQ ID NO: 1083646 - RNA, 22 nt, Homo sapiens
ccugaagugucgaguccagucc

SEQ ID NO: 1083647 - RNA, 16 nt, Homo sapiens
ccugaccuugugaucu

SEQ ID NO: 1083648 - RNA, 16 nt, Homo sapiens
ccugacuuugugaucc

SEQ ID NO: 1083649 - RNA, 21 nt, Homo sapiens
ccugagauacugaagugcagc

SEQ ID NO: 1083650 - RNA, 19 nt, Homo sapiens
ccugagcaacagagugaga

SEQ ID NO: 1083651 - RNA, 16 nt, Homo sapiens
ccugaggaguguccug

SEQ ID NO: 1083652 - RNA, 17 nt, Homo sapiens
ccugaugaaaaauaugu

SEQ ID NO: 1083653 - RNA, 16 nt, Homo sapiens
ccugcacuguccugcu

SEQ ID NO: 1083654 - RNA, 20 nt, Homo sapiens
ccugccuagucucacauguc

SEQ ID NO: 1083655 - RNA, 16 nt, Homo sapiens
ccugcugcagcaugaa

SEQ ID NO: 1083656 - RNA, 23 nt, Homo sapiens
ccugcuggaaaccacacuucuug

SEQ ID NO: 1083657 - RNA, 20 nt, Homo sapiens
ccuggaaucaagaugucaga

SEQ ID NO: 1083658 - RNA, 13 nt, Homo sapiens
ccuggcacagugu

SEQ ID NO: 1083659 - RNA, 22 nt, Homo sapiens
ccuggccuuguccccagcucca

SEQ ID NO: 1083660 - RNA, 21 nt, Homo sapiens
ccuggccuuugaggcaaaggc

SEQ ID NO: 1083661 - RNA, 14 nt, Homo sapiens
ccuggcucugccag

SEQ ID NO: 1083662 - RNA, 19 nt, Homo sapiens
ccugggagaaccucaggcu

SEQ ID NO: 1083663 - RNA, 12 nt, Homo sapiens
ccugguacugag

SEQ ID NO: 1083664 - RNA, 18 nt, Homo sapiens
ccuggucccuuggagaca

SEQ ID NO: 1083665 - RNA, 22 nt, Homo sapiens
ccuguggcccucgcucugccuc

SEQ ID NO: 1083666 - RNA, 16 nt, Homo sapiens
ccuguguucugcacau

SEQ ID NO: 1083667 - RNA, 10 nt, Homo sapiens
ccuguuaaau

SEQ ID NO: 1083668 - RNA, 12 nt, Homo sapiens
ccuguuccucaa

SEQ ID NO: 1083669 - RNA, 14 nt, Homo sapiens
ccuguuccugccac

SEQ ID NO: 1083670 - RNA, 20 nt, Homo sapiens
ccuguuuaaaaaaaguauau

SEQ ID NO: 1083671 - RNA, 17 nt, Homo sapiens
ccuuaauccuauuuuca

SEQ ID NO: 1083672 - RNA, 19 nt, Homo sapiens
ccuuauuuauauucaucaa

SEQ ID NO: 1083673 - RNA, 16 nt, Homo sapiens
ccuuccugccuagucu

SEQ ID NO: 1083674 - RNA, 11 nt, Homo sapiens
ccuugaaccag

SEQ ID NO: 1083675 - RNA, 14 nt, Homo sapiens
ccuuguuacacauu

SEQ ID NO: 1083676 - RNA, 22 nt, Homo sapiens
ccuuucucgugguagaagccag

SEQ ID NO: 1083677 - RNA, 22 nt, Homo sapiens
ccuuugggaggcagcaucaggg

SEQ ID NO: 1083678 - RNA, 22 nt, Homo sapiens
ccuuugguaccuuaauuugacu

SEQ ID NO: 1083679 - RNA, 22 nt, Homo sapiens
ccuuuugcaacaagacaaagca

SEQ ID NO: 1083680 - RNA, 13 nt, Homo sapiens
cgacaaagccaaa

SEQ ID NO: 1083681 - RNA, 15 nt, Homo sapiens
cgacaacuugcacgu

SEQ ID NO: 1083682 - RNA, 18 nt, Homo sapiens
cgagcgagaaccaggcug

SEQ ID NO: 1083683 - RNA, 22 nt, Homo sapiens
cgagcuaugaucgcgccacuac

SEQ ID NO: 1083684 - RNA, 18 nt, Homo sapiens
cgaucuuagauugccacu

SEQ ID NO: 1083685 - RNA, 16 nt, Homo sapiens
cgcaccacuguguauu

SEQ ID NO: 1083686 - RNA, 11 nt, Homo sapiens
cgcaccugccc

SEQ ID NO: 1083687 - RNA, 20 nt, Homo sapiens
cgccagacagauugcugaua

SEQ ID NO: 1083688 - RNA, 18 nt, Homo sapiens
cgccuuaugagaacaugg

SEQ ID NO: 1083689 - RNA, 20 nt, Homo sapiens
cgccuucucccccccggggc

SEQ ID NO: 1083690 - RNA, 13 nt, Homo sapiens
cggagggugaccc

SEQ ID NO: 1083691 - RNA, 23 nt, Homo sapiens
cggagggugacccauuucaggag

SEQ ID NO: 1083692 - RNA, 14 nt, Homo sapiens
cggaucccacugau

SEQ ID NO: 1083693 - RNA, 14 nt, Homo sapiens
cggccucccaaagu

SEQ ID NO: 1083694 - RNA, 17 nt, Homo sapiens
cgggcaagcgugcugcc

SEQ ID NO: 1083695 - RNA, 16 nt, Homo sapiens
cguauuuuacaugaag

SEQ ID NO: 1083696 - RNA, 23 nt, Homo sapiens
cguccaaggcaguucuguguccu

SEQ ID NO: 1083697 - RNA, 13 nt, Homo sapiens
cgucugugcucug

SEQ ID NO: 1083698 - RNA, 16 nt, Homo sapiens
cgugaaagcagaugag

SEQ ID NO: 1083699 - RNA, 21 nt, Homo sapiens
cgugaucucggcucacugcaa

SEQ ID NO: 1083700 - RNA, 17 nt, Homo sapiens
cguguaauauucucuga

SEQ ID NO: 1083701 - RNA, 18 nt, Homo sapiens
cguguagugucuguaaua

SEQ ID NO: 1083702 - RNA, 17 nt, Homo sapiens
cguugguucugcacuaa

SEQ ID NO: 1083703 - RNA, 20 nt, Homo sapiens
cguuguuaacacgugacacu

SEQ ID NO: 1083704 - RNA, 18 nt, Homo sapiens
cuaaaaaggccccugugg

SEQ ID NO: 1083705 - RNA, 20 nt, Homo sapiens
cuaaacagacuauuuaacuu

SEQ ID NO: 1083706 - RNA, 13 nt, Homo sapiens
cuaaagagcuuua

SEQ ID NO: 1083707 - RNA, 15 nt, Homo sapiens
cuaaagagcuuuagu

SEQ ID NO: 1083708 - RNA, 20 nt, Homo sapiens
cuaaaucccaagugucucuu

SEQ ID NO: 1083709 - RNA, 22 nt, Homo sapiens
cuaacucccuccucacacucca

SEQ ID NO: 1083710 - RNA, 13 nt, Homo sapiens
cuaagccuguugc

SEQ ID NO: 1083711 - RNA, 16 nt, Homo sapiens
cuaagccuguugcuga

SEQ ID NO: 1083712 - RNA, 17 nt, Homo sapiens
cuaauaaagaaauaaua

SEQ ID NO: 1083713 - RNA, 13 nt, Homo sapiens
cuaaucugcagug

SEQ ID NO: 1083714 - RNA, 11 nt, Homo sapiens
cuaaugcauua

SEQ ID NO: 1083715 - RNA, 19 nt, Homo sapiens
cuacacacccccaagccac

SEQ ID NO: 1083716 - RNA, 11 nt, Homo sapiens
cuacacauaua

SEQ ID NO: 1083717 - RNA, 20 nt, Homo sapiens
cuacacccuuggacuugagg

SEQ ID NO: 1083718 - RNA, 18 nt, Homo sapiens
cuaccaaaaacuagacau

SEQ ID NO: 1083719 - RNA, 18 nt, Homo sapiens
cuacccccaguaaaauca

SEQ ID NO: 1083720 - RNA, 21 nt, Homo sapiens
cuaccccucccagcugacagu

SEQ ID NO: 1083721 - RNA, 23 nt, Homo sapiens
cuaccccucccagcugacagucc

SEQ ID NO: 1083722 - RNA, 13 nt, Homo sapiens
cuacucauucccc

SEQ ID NO: 1083723 - RNA, 18 nt, Homo sapiens
cuacucuuaaaugagaaa

SEQ ID NO: 1083724 - RNA, 16 nt, Homo sapiens
cuacuucuauaucauu

SEQ ID NO: 1083725 - RNA, 17 nt, Homo sapiens
cuacuugagaaaaugca

SEQ ID NO: 1083726 - RNA, 20 nt, Homo sapiens
cuacuuguaaaggugcugca

SEQ ID NO: 1083727 - RNA, 16 nt, Homo sapiens
cuagaaaucugccaau

SEQ ID NO: 1083728 - RNA, 23 nt, Homo sapiens
cuagaaccuucuaauccaugugc

SEQ ID NO: 1083729 - RNA, 14 nt, Homo sapiens
cuagaaucacuuga

SEQ ID NO: 1083730 - RNA, 13 nt, Homo sapiens
cuagacauuauuu

SEQ ID NO: 1083731 - RNA, 13 nt, Homo sapiens
cuagagugcagug

SEQ ID NO: 1083732 - RNA, 16 nt, Homo sapiens
cuagagugcaguggcg

SEQ ID NO: 1083733 - RNA, 16 nt, Homo sapiens
cuagcauuuucuugaa

SEQ ID NO: 1083734 - RNA, 22 nt, Homo sapiens
cuagccaugauaacugcaauuu

SEQ ID NO: 1083735 - RNA, 21 nt, Homo sapiens
cuaggagucuucacugcucug

SEQ ID NO: 1083736 - RNA, 22 nt, Homo sapiens
cuaggauuacaggcaugagcca

SEQ ID NO: 1083737 - RNA, 22 nt, Homo sapiens
cuagucccuguguucugcacau

SEQ ID NO: 1083738 - RNA, 21 nt, Homo sapiens
cuaguuaggaaguuaccugga

SEQ ID NO: 1083739 - RNA, 12 nt, Homo sapiens
cuauagucccag

SEQ ID NO: 1083740 - RNA, 21 nt, Homo sapiens
cuauagucccagcuacucaga

SEQ ID NO: 1083741 - RNA, 14 nt, Homo sapiens
cuaucgcaccacug

SEQ ID NO: 1083742 - RNA, 14 nt, Homo sapiens
cuaucguaucuuua

SEQ ID NO: 1083743 - RNA, 21 nt, Homo sapiens
cucaaaagaaaaaaaaaagca

SEQ ID NO: 1083744 - RNA, 21 nt, Homo sapiens
cucaaacccuguggggccuga

SEQ ID NO: 1083745 - RNA, 16 nt, Homo sapiens
cucaaagaaauuucca

SEQ ID NO: 1083746 - RNA, 18 nt, Homo sapiens
cucaaagaaauuuccacu

SEQ ID NO: 1083747 - RNA, 18 nt, Homo sapiens
cucaacguugcuccccau

SEQ ID NO: 1083748 - RNA, 22 nt, Homo sapiens
cucacgggugcaugaaaccacu

SEQ ID NO: 1083749 - RNA, 17 nt, Homo sapiens
cucagugucagcacuca

SEQ ID NO: 1083750 - RNA, 20 nt, Homo sapiens
cucaguuucuuuuucacuug

SEQ ID NO: 1083751 - RNA, 14 nt, Homo sapiens
cucaucccuguucc

SEQ ID NO: 1083752 - RNA, 14 nt, Homo sapiens
cucaugaggccaug

SEQ ID NO: 1083753 - RNA, 22 nt, Homo sapiens
cucaugcaagacuucacugcag

SEQ ID NO: 1083754 - RNA, 21 nt, Homo sapiens
cucauucauuuauucauucau

SEQ ID NO: 1083755 - RNA, 20 nt, Homo sapiens
cuccaaaguuuuaaaccugu

SEQ ID NO: 1083756 - RNA, 22 nt, Homo sapiens
cuccaaaguuuuaaaccuguua

SEQ ID NO: 1083757 - RNA, 17 nt, Homo sapiens
cuccaccgccauggcuu

SEQ ID NO: 1083758 - RNA, 21 nt, Homo sapiens
cuccagcuguuaccugagaua

SEQ ID NO: 1083759 - RNA, 12 nt, Homo sapiens
cuccaggcuccu

SEQ ID NO: 1083760 - RNA, 17 nt, Homo sapiens
cuccauauuuauuuaaa

SEQ ID NO: 1083761 - RNA, 15 nt, Homo sapiens
cucccacauugucac

SEQ ID NO: 1083762 - RNA, 22 nt, Homo sapiens
cucccacauugucaccauuuca

SEQ ID NO: 1083763 - RNA, 12 nt, Homo sapiens
cucccaccaggc

SEQ ID NO: 1083764 - RNA, 15 nt, Homo sapiens
cucccacgugcacag

SEQ ID NO: 1083765 - RNA, 20 nt, Homo sapiens
cucccacgugcacagcuucc

SEQ ID NO: 1083766 - RNA, 23 nt, Homo sapiens
cucccacgugcacagcuuccuga

SEQ ID NO: 1083767 - RNA, 17 nt, Homo sapiens
cucccagcugacagucc

SEQ ID NO: 1083768 - RNA, 19 nt, Homo sapiens
cucccagcugacaguccuc

SEQ ID NO: 1083769 - RNA, 11 nt, Homo sapiens
cucccagugag

SEQ ID NO: 1083770 - RNA, 15 nt, Homo sapiens
cuccuaagacaccug

SEQ ID NO: 1083771 - RNA, 13 nt, Homo sapiens
cuccucacacucc

SEQ ID NO: 1083772 - RNA, 14 nt, Homo sapiens
cuccucccaccagu

SEQ ID NO: 1083773 - RNA, 15 nt, Homo sapiens
cuccucuccaugcaa

SEQ ID NO: 1083774 - RNA, 23 nt, Homo sapiens
cuccuggaccugaaggcaucuga

SEQ ID NO: 1083775 - RNA, 21 nt, Homo sapiens
cuccuuccccuugucccuggg

SEQ ID NO: 1083776 - RNA, 22 nt, Homo sapiens
cuccuuuaccccacauaugcaa

SEQ ID NO: 1083777 - RNA, 18 nt, Homo sapiens
cuccuuuuucuaccuuuu

SEQ ID NO: 1083778 - RNA, 22 nt, Homo sapiens
cucggcaccagugccucagugc

SEQ ID NO: 1083779 - RNA, 16 nt, Homo sapiens
cucggccucccaaagu

SEQ ID NO: 1083780 - RNA, 14 nt, Homo sapiens
cucgugauuugccu

SEQ ID NO: 1083781 - RNA, 19 nt, Homo sapiens
cucgugauuugccugccug

SEQ ID NO: 1083782 - RNA, 15 nt, Homo sapiens
cucuaaaacucucaa

SEQ ID NO: 1083783 - RNA, 12 nt, Homo sapiens
cucuaucugcaa

SEQ ID NO: 1083784 - RNA, 13 nt, Homo sapiens
cucuaucugcaau

SEQ ID NO: 1083785 - RNA, 13 nt, Homo sapiens
cucuccugcugca

SEQ ID NO: 1083786 - RNA, 18 nt, Homo sapiens
cucucggcuucaccaggg

SEQ ID NO: 1083787 - RNA, 13 nt, Homo sapiens
cucucugaaaguu

SEQ ID NO: 1083788 - RNA, 15 nt, Homo sapiens
cucugaaaguuguca

SEQ ID NO: 1083789 - RNA, 15 nt, Homo sapiens
cucugcuuccugagc

SEQ ID NO: 1083790 - RNA, 16 nt, Homo sapiens
cucuguccagccagcu

SEQ ID NO: 1083791 - RNA, 16 nt, Homo sapiens
cucuuaaguugaucua

SEQ ID NO: 1083792 - RNA, 16 nt, Homo sapiens
cucuuaaugcuguguu

SEQ ID NO: 1083793 - RNA, 22 nt, Homo sapiens
cucuuacuucccccacccuggg

SEQ ID NO: 1083794 - RNA, 19 nt, Homo sapiens
cucuugacuggcucaagaa

SEQ ID NO: 1083795 - RNA, 16 nt, Homo sapiens
cucuugccagcauuuu

SEQ ID NO: 1083796 - RNA, 21 nt, Homo sapiens
cucuugcccagccggcugcaa

SEQ ID NO: 1083797 - RNA, 15 nt, Homo sapiens
cucuuuccuuccuuc

SEQ ID NO: 1083798 - RNA, 13 nt, Homo sapiens
cugaaaaucaaua

SEQ ID NO: 1083799 - RNA, 15 nt, Homo sapiens
cugaaagugguuuga

SEQ ID NO: 1083800 - RNA, 21 nt, Homo sapiens
cugaacauugcacugauauca

SEQ ID NO: 1083801 - RNA, 16 nt, Homo sapiens
cugaaccgacuuuucu

SEQ ID NO: 1083802 - RNA, 13 nt, Homo sapiens
cugaagaccucca

SEQ ID NO: 1083803 - RNA, 18 nt, Homo sapiens
cugaagugcagcucagga

SEQ ID NO: 1083804 - RNA, 15 nt, Homo sapiens
cugaccugguacuga

SEQ ID NO: 1083805 - RNA, 13 nt, Homo sapiens
cugacuugaacuc

SEQ ID NO: 1083806 - RNA, 12 nt, Homo sapiens
cugagacuugaa

SEQ ID NO: 1083807 - RNA, 20 nt, Homo sapiens
cugagauacugaagugcagc

SEQ ID NO: 1083808 - RNA, 14 nt, Homo sapiens
cugaggaugcuuuu

SEQ ID NO: 1083809 - RNA, 20 nt, Homo sapiens
cugaguagcauauauaauuu

SEQ ID NO: 1083810 - RNA, 22 nt, Homo sapiens
cugaguauugauaaacuuugaa

SEQ ID NO: 1083811 - RNA, 16 nt, Homo sapiens
cugagugucucugccu

SEQ ID NO: 1083812 - RNA, 13 nt, Homo sapiens
cugauacuguauc

SEQ ID NO: 1083813 - RNA, 14 nt, Homo sapiens
cugaucauuacaug

SEQ ID NO: 1083814 - RNA, 22 nt, Homo sapiens
cugaugaaaaauaugugcuuga

SEQ ID NO: 1083815 - RNA, 17 nt, Homo sapiens
cugaugacacauuuggc

SEQ ID NO: 1083816 - RNA, 20 nt, Homo sapiens
cugcaauuuuaauugauuau

SEQ ID NO: 1083817 - RNA, 13 nt, Homo sapiens
cugcaccgagaga

SEQ ID NO: 1083818 - RNA, 15 nt, Homo sapiens
cugcagcggcacaaa

SEQ ID NO: 1083819 - RNA, 22 nt, Homo sapiens
cugcagcuuggagaacuccgcu

SEQ ID NO: 1083820 - RNA, 13 nt, Homo sapiens
cugcaggccaaga

SEQ ID NO: 1083821 - RNA, 19 nt, Homo sapiens
cugcauggagugagcagua

SEQ ID NO: 1083822 - RNA, 15 nt, Homo sapiens
cugcauggcacugac

SEQ ID NO: 1083823 - RNA, 18 nt, Homo sapiens
cugcauuugugucaucuu

SEQ ID NO: 1083824 - RNA, 14 nt, Homo sapiens
cugccugaccccag

SEQ ID NO: 1083825 - RNA, 12 nt, Homo sapiens
cugccugagauu

SEQ ID NO: 1083826 - RNA, 22 nt, Homo sapiens
cugccugggccucccaaagugc

SEQ ID NO: 1083827 - RNA, 22 nt, Homo sapiens
cugccuucuccccuccaaguga

SEQ ID NO: 1083828 - RNA, 14 nt, Homo sapiens
cugccuuguguaca

SEQ ID NO: 1083829 - RNA, 14 nt, Homo sapiens
cugcgaugcaaugc

SEQ ID NO: 1083830 - RNA, 13 nt, Homo sapiens
cugcgcagucauu

SEQ ID NO: 1083831 - RNA, 20 nt, Homo sapiens
cugcguccugaggagugucc

SEQ ID NO: 1083832 - RNA, 14 nt, Homo sapiens
cugcucugcuauau

SEQ ID NO: 1083833 - RNA, 14 nt, Homo sapiens
cugcugcuaaggcu

SEQ ID NO: 1083834 - RNA, 20 nt, Homo sapiens
cugcugguaauuuguaucug

SEQ ID NO: 1083835 - RNA, 11 nt, Homo sapiens
cugcuguggaa

SEQ ID NO: 1083836 - RNA, 15 nt, Homo sapiens
cugcuuuuccugucu

SEQ ID NO: 1083837 - RNA, 20 nt, Homo sapiens
cuggaaaccacacuucuuga

SEQ ID NO: 1083838 - RNA, 23 nt, Homo sapiens
cuggaaaggcucagucucaggag

SEQ ID NO: 1083839 - RNA, 18 nt, Homo sapiens
cuggacauauguuaggaa

SEQ ID NO: 1083840 - RNA, 14 nt, Homo sapiens
cuggcaaacaugug

SEQ ID NO: 1083841 - RNA, 22 nt, Homo sapiens
cuggcaaugcccuaccugccug

SEQ ID NO: 1083842 - RNA, 16 nt, Homo sapiens
cuggcaugacacucua

SEQ ID NO: 1083843 - RNA, 17 nt, Homo sapiens
cuggccuccaaguccac

SEQ ID NO: 1083844 - RNA, 13 nt, Homo sapiens
cuggccucuagaa

SEQ ID NO: 1083845 - RNA, 21 nt, Homo sapiens
cuggccucuagaacacccacu

SEQ ID NO: 1083846 - RNA, 23 nt, Homo sapiens
cuggcuuucuuuucucuaugaaa

SEQ ID NO: 1083847 - RNA, 20 nt, Homo sapiens
cugggugacccccacugccg

SEQ ID NO: 1083848 - RNA, 12 nt, Homo sapiens
cuggugagggag

SEQ ID NO: 1083849 - RNA, 17 nt, Homo sapiens
cugguggggcugccagg

SEQ ID NO: 1083850 - RNA, 20 nt, Homo sapiens
cuguaaaacuaaacauacau

SEQ ID NO: 1083851 - RNA, 18 nt, Homo sapiens
cuguaacucagacauucc

SEQ ID NO: 1083852 - RNA, 19 nt, Homo sapiens
cuguaacucagacauucca

SEQ ID NO: 1083853 - RNA, 17 nt, Homo sapiens
cuguaccuggugcccug

SEQ ID NO: 1083854 - RNA, 20 nt, Homo sapiens
cuguagauaaagugguuuga

SEQ ID NO: 1083855 - RNA, 16 nt, Homo sapiens
cuguaugauuccuuga

SEQ ID NO: 1083856 - RNA, 20 nt, Homo sapiens
cugucaaagaaaacuuccaa

SEQ ID NO: 1083857 - RNA, 22 nt, Homo sapiens
cugucaggagauggaagaguca

SEQ ID NO: 1083858 - RNA, 18 nt, Homo sapiens
cuguccaguuuccaaagg

SEQ ID NO: 1083859 - RNA, 16 nt, Homo sapiens
cuguccccuaccccca

SEQ ID NO: 1083860 - RNA, 15 nt, Homo sapiens
cuguccuaaucauau

SEQ ID NO: 1083861 - RNA, 16 nt, Homo sapiens
cugucucaacuacuca

SEQ ID NO: 1083862 - RNA, 14 nt, Homo sapiens
cugucugcucuuau

SEQ ID NO: 1083863 - RNA, 22 nt, Homo sapiens
cuguguccucgcacugcccagg

SEQ ID NO: 1083864 - RNA, 17 nt, Homo sapiens
cuguuacugaaaguggu

SEQ ID NO: 1083865 - RNA, 14 nt, Homo sapiens
cuguuuuguuguuu

SEQ ID NO: 1083866 - RNA, 15 nt, Homo sapiens
cuuaaacagugucca

SEQ ID NO: 1083867 - RNA, 12 nt, Homo sapiens
cuuaaacaucau

SEQ ID NO: 1083868 - RNA, 23 nt, Homo sapiens
cuucacuaccaaaugagcauuag

SEQ ID NO: 1083869 - RNA, 19 nt, Homo sapiens
cuucacugcucugccccca

SEQ ID NO: 1083870 - RNA, 11 nt, Homo sapiens
cuucaguauua

SEQ ID NO: 1083871 - RNA, 16 nt, Homo sapiens
cuuccaugauacuuua

SEQ ID NO: 1083872 - RNA, 18 nt, Homo sapiens
cuuccaugauacuuuaau

SEQ ID NO: 1083873 - RNA, 18 nt, Homo sapiens
cuuccauuucuacuguau

SEQ ID NO: 1083874 - RNA, 13 nt, Homo sapiens
cuucccugacacu

SEQ ID NO: 1083875 - RNA, 20 nt, Homo sapiens
cuuccuuaauucacucccac

SEQ ID NO: 1083876 - RNA, 19 nt, Homo sapiens
cuuccuuucuuucucucuc

SEQ ID NO: 1083877 - RNA, 12 nt, Homo sapiens
cuucgguuugua

SEQ ID NO: 1083878 - RNA, 22 nt, Homo sapiens
cuucgguuuguauuuagugucu

SEQ ID NO: 1083879 - RNA, 20 nt, Homo sapiens
cuucucagagcagcacuggg

SEQ ID NO: 1083880 - RNA, 17 nt, Homo sapiens
cuucuccacaaccuccu

SEQ ID NO: 1083881 - RNA, 23 nt, Homo sapiens
cuucuccacagggacacagucug

SEQ ID NO: 1083882 - RNA, 21 nt, Homo sapiens
cuucuuguaauauuucuucaa

SEQ ID NO: 1083883 - RNA, 16 nt, Homo sapiens
cuucuuuaucugugau

SEQ ID NO: 1083884 - RNA, 18 nt, Homo sapiens
cuugacuucaugccagcu

SEQ ID NO: 1083885 - RNA, 14 nt, Homo sapiens
cuugacuuugccac

SEQ ID NO: 1083886 - RNA, 21 nt, Homo sapiens
cuugaggauuuugaguaucuc

SEQ ID NO: 1083887 - RNA, 16 nt, Homo sapiens
cuugauaaaugccuca

SEQ ID NO: 1083888 - RNA, 22 nt, Homo sapiens
cuugauauuuccuucaccaccu

SEQ ID NO: 1083889 - RNA, 18 nt, Homo sapiens
cuugauucuugugauuga

SEQ ID NO: 1083890 - RNA, 18 nt, Homo sapiens
cuugcaucaagggcuuua

SEQ ID NO: 1083891 - RNA, 16 nt, Homo sapiens
cuugcugcugagugca

SEQ ID NO: 1083892 - RNA, 17 nt, Homo sapiens
cuuggaauuuuguaaaa

SEQ ID NO: 1083893 - RNA, 20 nt, Homo sapiens
cuuguaaaggugcugcacug

SEQ ID NO: 1083894 - RNA, 15 nt, Homo sapiens
cuuguguccugauga

SEQ ID NO: 1083895 - RNA, 15 nt, Homo sapiens
cuuuaaacagacucg

SEQ ID NO: 1083896 - RNA, 12 nt, Homo sapiens
cuuuaaaugccu

SEQ ID NO: 1083897 - RNA, 13 nt, Homo sapiens
cuuucagcuguga

SEQ ID NO: 1083898 - RNA, 21 nt, Homo sapiens
cuuucaugaguuucccagaga

SEQ ID NO: 1083899 - RNA, 21 nt, Homo sapiens
cuuucucgugguagaagccag

SEQ ID NO: 1083900 - RNA, 12 nt, Homo sapiens
cuuucucugcaa

SEQ ID NO: 1083901 - RNA, 18 nt, Homo sapiens
cuuucuuugcaccaaaga

SEQ ID NO: 1083902 - RNA, 20 nt, Homo sapiens
cuuucuuuuuaaucuuccau

SEQ ID NO: 1083903 - RNA, 20 nt, Homo sapiens
cuuugaaguggcaccuaaua

SEQ ID NO: 1083904 - RNA, 14 nt, Homo sapiens
cuuugcaccaaaga

SEQ ID NO: 1083905 - RNA, 17 nt, Homo sapiens
cuuugcaccaaagacau

SEQ ID NO: 1083906 - RNA, 19 nt, Homo sapiens
cuuugccacauccauugac

SEQ ID NO: 1083907 - RNA, 15 nt, Homo sapiens
cuuugcccacacaca

SEQ ID NO: 1083908 - RNA, 19 nt, Homo sapiens
cuuugcccacacacacucc

SEQ ID NO: 1083909 - RNA, 14 nt, Homo sapiens
cuuuggcaacagaa

SEQ ID NO: 1083910 - RNA, 15 nt, Homo sapiens
cuuugucugcuccca

SEQ ID NO: 1083911 - RNA, 12 nt, Homo sapiens
cuuuucaguuug

SEQ ID NO: 1083912 - RNA, 14 nt, Homo sapiens
cuuuuugcuuucuu

SEQ ID NO: 1083913 - RNA, 20 nt, Homo sapiens
cuuuuuuuuuuucugccuga

SEQ ID NO: 1083914 - RNA, 17 nt, Homo sapiens
gaaaaauaugugcuuga

SEQ ID NO: 1083915 - RNA, 18 nt, Homo sapiens
gaaaacccccagcauuac

SEQ ID NO: 1083916 - RNA, 15 nt, Homo sapiens
gaaaacuuauuugag

SEQ ID NO: 1083917 - RNA, 16 nt, Homo sapiens
gaaaacuucagagaaa

SEQ ID NO: 1083918 - RNA, 13 nt, Homo sapiens
gaaaagcaugaaa

SEQ ID NO: 1083919 - RNA, 12 nt, Homo sapiens
gaaaaugcauua

SEQ ID NO: 1083920 - RNA, 14 nt, Homo sapiens
gaaacaugauguga

SEQ ID NO: 1083921 - RNA, 18 nt, Homo sapiens
gaaaccagaaaagcaaua

SEQ ID NO: 1083922 - RNA, 20 nt, Homo sapiens
gaaaccuguccauaaaguaa

SEQ ID NO: 1083923 - RNA, 15 nt, Homo sapiens
gaaagagaguaccau

SEQ ID NO: 1083924 - RNA, 19 nt, Homo sapiens
gaaagaguugccauaauga

SEQ ID NO: 1083925 - RNA, 14 nt, Homo sapiens
gaaagauggaacuu

SEQ ID NO: 1083926 - RNA, 20 nt, Homo sapiens
gaaaggauuuuaccaaagca

SEQ ID NO: 1083927 - RNA, 13 nt, Homo sapiens
gaaaggcucaguc

SEQ ID NO: 1083928 - RNA, 14 nt, Homo sapiens
gaaagggaaagcug

SEQ ID NO: 1083929 - RNA, 18 nt, Homo sapiens
gaaagucuccuguaucau

SEQ ID NO: 1083930 - RNA, 12 nt, Homo sapiens
gaaagugauauc

SEQ ID NO: 1083931 - RNA, 15 nt, Homo sapiens
gaaaguuugcacugu

SEQ ID NO: 1083932 - RNA, 22 nt, Homo sapiens
gaaaucaccacauucugucucu

SEQ ID NO: 1083933 - RNA, 12 nt, Homo sapiens
gaaaucugccaa

SEQ ID NO: 1083934 - RNA, 13 nt, Homo sapiens
gaaaucugccaau

SEQ ID NO: 1083935 - RNA, 22 nt, Homo sapiens
gaacacacugagacuugaauca

SEQ ID NO: 1083936 - RNA, 14 nt, Homo sapiens
gaacuuauuuacac

SEQ ID NO: 1083937 - RNA, 16 nt, Homo sapiens
gaagaacuugucccuc

SEQ ID NO: 1083938 - RNA, 14 nt, Homo sapiens
gaagagucaugugg

SEQ ID NO: 1083939 - RNA, 17 nt, Homo sapiens
gaagauagaacaaugcu

SEQ ID NO: 1083940 - RNA, 18 nt, Homo sapiens
gaagauguaagaagcuaa

SEQ ID NO: 1083941 - RNA, 20 nt, Homo sapiens
gaagccacugaagcugggau

SEQ ID NO: 1083942 - RNA, 19 nt, Homo sapiens
gaagccauauucacaccuc

SEQ ID NO: 1083943 - RNA, 20 nt, Homo sapiens
gaagcccucggccuccagac

SEQ ID NO: 1083944 - RNA, 21 nt, Homo sapiens
gaagcccucggccuccagacu

SEQ ID NO: 1083945 - RNA, 12 nt, Homo sapiens
gaaggacugugc

SEQ ID NO: 1083946 - RNA, 18 nt, Homo sapiens
gaaggcaucugaguguga

SEQ ID NO: 1083947 - RNA, 18 nt, Homo sapiens
gaagggaaggaagcaagc

SEQ ID NO: 1083948 - RNA, 16 nt, Homo sapiens
gaagguaauaaauaca

SEQ ID NO: 1083949 - RNA, 19 nt, Homo sapiens
gaagguacugaaggcuucu

SEQ ID NO: 1083950 - RNA, 15 nt, Homo sapiens
gaaguggcaccuaau

SEQ ID NO: 1083951 - RNA, 21 nt, Homo sapiens
gaaguuagggaugacugugau

SEQ ID NO: 1083952 - RNA, 16 nt, Homo sapiens
gaauaaaccauuuuua

SEQ ID NO: 1083953 - RNA, 19 nt, Homo sapiens
gaaucacuugacuuugcca

SEQ ID NO: 1083954 - RNA, 13 nt, Homo sapiens
gaaugaagcaugu

SEQ ID NO: 1083955 - RNA, 17 nt, Homo sapiens
gaaugaguuuccagcua

SEQ ID NO: 1083956 - RNA, 15 nt, Homo sapiens
gaaugcggaaccaua

SEQ ID NO: 1083957 - RNA, 16 nt, Homo sapiens
gaaugcggaaccauag

SEQ ID NO: 1083958 - RNA, 21 nt, Homo sapiens
gaauguccuuucuccagugua

SEQ ID NO: 1083959 - RNA, 18 nt, Homo sapiens
gaauucugacuuacuuaa

SEQ ID NO: 1083960 - RNA, 15 nt, Homo sapiens
gaauugagcuagaaa

SEQ ID NO: 1083961 - RNA, 21 nt, Homo sapiens
gaauugagcuagaaaucacaa

SEQ ID NO: 1083962 - RNA, 18 nt, Homo sapiens
gaauuuuugcacauucua

SEQ ID NO: 1083963 - RNA, 23 nt, Homo sapiens
gacaccugccuuaugcaagggga

SEQ ID NO: 1083964 - RNA, 14 nt, Homo sapiens
gacacuacaaacau

SEQ ID NO: 1083965 - RNA, 16 nt, Homo sapiens
gacagacacugcugaa

SEQ ID NO: 1083966 - RNA, 21 nt, Homo sapiens
gacagcuggacccauuugcca

SEQ ID NO: 1083967 - RNA, 17 nt, Homo sapiens
gacagugacgugacuca

SEQ ID NO: 1083968 - RNA, 20 nt, Homo sapiens
gacaucaccaaguguggaau

SEQ ID NO: 1083969 - RNA, 22 nt, Homo sapiens
gaccacugggccccucagggga

SEQ ID NO: 1083970 - RNA, 16 nt, Homo sapiens
gaccaggucuuguuca

SEQ ID NO: 1083971 - RNA, 14 nt, Homo sapiens
gaccauugucuucc

SEQ ID NO: 1083972 - RNA, 16 nt, Homo sapiens
gaccauugucuuccaa

SEQ ID NO: 1083973 - RNA, 12 nt, Homo sapiens
gaccccaucuca

SEQ ID NO: 1083974 - RNA, 14 nt, Homo sapiens
gaccguugcacaaa

SEQ ID NO: 1083975 - RNA, 21 nt, Homo sapiens
gaccuagcuaaggucuauaaa

SEQ ID NO: 1083976 - RNA, 13 nt, Homo sapiens
gaccucccaaagu

SEQ ID NO: 1083977 - RNA, 22 nt, Homo sapiens
gaccugguacugagguugggcu

SEQ ID NO: 1083978 - RNA, 17 nt, Homo sapiens
gaccuuucagcugugaa

SEQ ID NO: 1083979 - RNA, 20 nt, Homo sapiens
gacuaaaaaggccccugugg

SEQ ID NO: 1083980 - RNA, 13 nt, Homo sapiens
gacucaggccagu

SEQ ID NO: 1083981 - RNA, 16 nt, Homo sapiens
gacucucugccugcuu

SEQ ID NO: 1083982 - RNA, 19 nt, Homo sapiens
gacuucacugcagccuuuc

SEQ ID NO: 1083983 - RNA, 19 nt, Homo sapiens
gacuuccucgccucuccca

SEQ ID NO: 1083984 - RNA, 13 nt, Homo sapiens
gacuugcuuuaaa

SEQ ID NO: 1083985 - RNA, 20 nt, Homo sapiens
gacuuucucuucuacacguc

SEQ ID NO: 1083986 - RNA, 12 nt, Homo sapiens
gacuuugccaca

SEQ ID NO: 1083987 - RNA, 20 nt, Homo sapiens
gacuuuuugaaaaaaguaua

SEQ ID NO: 1083988 - RNA, 21 nt, Homo sapiens
gagacaaaaucuuaaaugcca

SEQ ID NO: 1083989 - RNA, 15 nt, Homo sapiens
gagacccuacagaca

SEQ ID NO: 1083990 - RNA, 21 nt, Homo sapiens
gagagaacagggaugcuaucu

SEQ ID NO: 1083991 - RNA, 14 nt, Homo sapiens
gagagaaguggcca

SEQ ID NO: 1083992 - RNA, 21 nt, Homo sapiens
gagagacgcugugauuggcag

SEQ ID NO: 1083993 - RNA, 17 nt, Homo sapiens
gagaucuuucuuuccaa

SEQ ID NO: 1083994 - RNA, 16 nt, Homo sapiens
gagauggaagagucau

SEQ ID NO: 1083995 - RNA, 19 nt, Homo sapiens
gagauggaauaaagcccuu

SEQ ID NO: 1083996 - RNA, 12 nt, Homo sapiens
gagaugucauca

SEQ ID NO: 1083997 - RNA, 23 nt, Homo sapiens
gagauugcucuggggcuugcuau

SEQ ID NO: 1083998 - RNA, 14 nt, Homo sapiens
gagcaacagaguga

SEQ ID NO: 1083999 - RNA, 18 nt, Homo sapiens
gagcaagacucugucuca

SEQ ID NO: 1084000 - RNA, 22 nt, Homo sapiens
gagcaguaaacuuucucugcaa

SEQ ID NO: 1084001 - RNA, 21 nt, Homo sapiens
gagcaugggacugugccuuug

SEQ ID NO: 1084002 - RNA, 13 nt, Homo sapiens
gagccacuaccuu

SEQ ID NO: 1084003 - RNA, 16 nt, Homo sapiens
gagccagucccucagc

SEQ ID NO: 1084004 - RNA, 15 nt, Homo sapiens
gagccuucacaugaa

SEQ ID NO: 1084005 - RNA, 13 nt, Homo sapiens
gagcuugacuuca

SEQ ID NO: 1084006 - RNA, 17 nt, Homo sapiens
gagcuuuaguccuagag

SEQ ID NO: 1084007 - RNA, 19 nt, Homo sapiens
gaggaauucugaagccauu

SEQ ID NO: 1084008 - RNA, 18 nt, Homo sapiens
gaggaguggaguucucug

SEQ ID NO: 1084009 - RNA, 15 nt, Homo sapiens
gaggcaaagaacaau

SEQ ID NO: 1084010 - RNA, 23 nt, Homo sapiens
gaggcagcgugaaagcagaugag

SEQ ID NO: 1084011 - RNA, 20 nt, Homo sapiens
gaggcaggucugggccagau

SEQ ID NO: 1084012 - RNA, 21 nt, Homo sapiens
gaggccaagguuucccaguga

SEQ ID NO: 1084013 - RNA, 21 nt, Homo sapiens
gaggccuuucuagaauuuucu

SEQ ID NO: 1084014 - RNA, 12 nt, Homo sapiens
gaggcuuggaaa

SEQ ID NO: 1084015 - RNA, 21 nt, Homo sapiens
gagggaauuccuagcuguaaa

SEQ ID NO: 1084016 - RNA, 15 nt, Homo sapiens
gagggcugccugaaa

SEQ ID NO: 1084017 - RNA, 16 nt, Homo sapiens
gaggggcguguguucc

SEQ ID NO: 1084018 - RNA, 16 nt, Homo sapiens
gagguugggcugagac

SEQ ID NO: 1084019 - RNA, 21 nt, Homo sapiens
gaguacaauuguuaugaucua

SEQ ID NO: 1084020 - RNA, 23 nt, Homo sapiens
gagucacccaugaagacaggaca

SEQ ID NO: 1084021 - RNA, 20 nt, Homo sapiens
gaguccucguagccaucucu

SEQ ID NO: 1084022 - RNA, 14 nt, Homo sapiens
gagucgacuuugag

SEQ ID NO: 1084023 - RNA, 17 nt, Homo sapiens
gagucucugaacauccu

SEQ ID NO: 1084024 - RNA, 14 nt, Homo sapiens
gaguucuuugcaag

SEQ ID NO: 1084025 - RNA, 21 nt, Homo sapiens
gaguugguguucauaauuuca

SEQ ID NO: 1084026 - RNA, 13 nt, Homo sapiens
gaguugugaucau

SEQ ID NO: 1084027 - RNA, 23 nt, Homo sapiens
gaguuuccagcuaagccugauga

SEQ ID NO: 1084028 - RNA, 15 nt, Homo sapiens
gaguuugacaccguc

SEQ ID NO: 1084029 - RNA, 13 nt, Homo sapiens
gauagcaggugaa

SEQ ID NO: 1084030 - RNA, 19 nt, Homo sapiens
gauaucaaaaagacugugg

SEQ ID NO: 1084031 - RNA, 20 nt, Homo sapiens
gauauuuccuucaccaccuc

SEQ ID NO: 1084032 - RNA, 21 nt, Homo sapiens
gaucagccuccgccauuccaa

SEQ ID NO: 1084033 - RNA, 18 nt, Homo sapiens
gaucauugguaucugaua

SEQ ID NO: 1084034 - RNA, 13 nt, Homo sapiens
gaucuaguucuca

SEQ ID NO: 1084035 - RNA, 17 nt, Homo sapiens
gaucuguguuuacuuaa

SEQ ID NO: 1084036 - RNA, 14 nt, Homo sapiens
gaugcaagcaccug

SEQ ID NO: 1084037 - RNA, 19 nt, Homo sapiens
gaugcauucccggugcaga

SEQ ID NO: 1084038 - RNA, 16 nt, Homo sapiens
gaugcugccugaguca

SEQ ID NO: 1084039 - RNA, 18 nt, Homo sapiens
gauggaauaaagcccuug

SEQ ID NO: 1084040 - RNA, 20 nt, Homo sapiens
gauggaauaaagcccuugaa

SEQ ID NO: 1084041 - RNA, 16 nt, Homo sapiens
gauggagcgcaccugc

SEQ ID NO: 1084042 - RNA, 15 nt, Homo sapiens
gaugggauuucaccg

SEQ ID NO: 1084043 - RNA, 22 nt, Homo sapiens
gaugggucacuuguccucaguu

SEQ ID NO: 1084044 - RNA, 23 nt, Homo sapiens
gauuaaaaucuggcaaaguuaua

SEQ ID NO: 1084045 - RNA, 19 nt, Homo sapiens
gauuacaggugugagccac

SEQ ID NO: 1084046 - RNA, 13 nt, Homo sapiens
gauuauauaucau

SEQ ID NO: 1084047 - RNA, 12 nt, Homo sapiens
gauuauuugaac

SEQ ID NO: 1084048 - RNA, 23 nt, Homo sapiens
gauuccauuuuacuuccaugaua

SEQ ID NO: 1084049 - RNA, 17 nt, Homo sapiens
gauucccagaaauacaa

SEQ ID NO: 1084050 - RNA, 15 nt, Homo sapiens
gauuccccuggacau

SEQ ID NO: 1084051 - RNA, 19 nt, Homo sapiens
gauucucaccugccuucaa

SEQ ID NO: 1084052 - RNA, 16 nt, Homo sapiens
gauucuucugccucag

SEQ ID NO: 1084053 - RNA, 17 nt, Homo sapiens
gauugcgagaauuuuca

SEQ ID NO: 1084054 - RNA, 23 nt, Homo sapiens
gauuucuuucuuugcaccaaaga

SEQ ID NO: 1084055 - RNA, 18 nt, Homo sapiens
gcaaagacuagauccuuu

SEQ ID NO: 1084056 - RNA, 22 nt, Homo sapiens
gcaaagucuaaaguuuacagua

SEQ ID NO: 1084057 - RNA, 14 nt, Homo sapiens
gcaacagagcaaaa

SEQ ID NO: 1084058 - RNA, 23 nt, Homo sapiens
gcaacuccuguucuuugggcuca

SEQ ID NO: 1084059 - RNA, 22 nt, Homo sapiens
gcaacugaguacaauuguuaug

SEQ ID NO: 1084060 - RNA, 16 nt, Homo sapiens
gcaagacguccuggaa

SEQ ID NO: 1084061 - RNA, 17 nt, Homo sapiens
gcaagaugaaacagggc

SEQ ID NO: 1084062 - RNA, 10 nt, Homo sapiens
gcaagcaaaa

SEQ ID NO: 1084063 - RNA, 15 nt, Homo sapiens
gcaagcagugcccuc

SEQ ID NO: 1084064 - RNA, 15 nt, Homo sapiens
gcaagcucugccucc

SEQ ID NO: 1084065 - RNA, 16 nt, Homo sapiens
gcaagucccugacucu

SEQ ID NO: 1084066 - RNA, 16 nt, Homo sapiens
gcaauagaaauccaau

SEQ ID NO: 1084067 - RNA, 16 nt, Homo sapiens
gcaaugcagugcagca

SEQ ID NO: 1084068 - RNA, 19 nt, Homo sapiens
gcaauuagauuaguauuuu

SEQ ID NO: 1084069 - RNA, 21 nt, Homo sapiens
gcaauugagggcuaaauccca

SEQ ID NO: 1084070 - RNA, 12 nt, Homo sapiens
gcacaaguacuu

SEQ ID NO: 1084071 - RNA, 19 nt, Homo sapiens
gcacaccauugcaugaauu

SEQ ID NO: 1084072 - RNA, 14 nt, Homo sapiens
gcacaguaauauga

SEQ ID NO: 1084073 - RNA, 18 nt, Homo sapiens
gcacauaucuccucuugg

SEQ ID NO: 1084074 - RNA, 23 nt, Homo sapiens
gcaccaaagacaucagucuccaa

SEQ ID NO: 1084075 - RNA, 17 nt, Homo sapiens
gcaccaagcgugauucc

SEQ ID NO: 1084076 - RNA, 14 nt, Homo sapiens
gcaccagugccuca

SEQ ID NO: 1084077 - RNA, 21 nt, Homo sapiens
gcacccuggauugaucggagc

SEQ ID NO: 1084078 - RNA, 18 nt, Homo sapiens
gcaccgagagagauggaa

SEQ ID NO: 1084079 - RNA, 23 nt, Homo sapiens
gcaccuauggcccagccacugca

SEQ ID NO: 1084080 - RNA, 13 nt, Homo sapiens
gcacggcuuccca

SEQ ID NO: 1084081 - RNA, 19 nt, Homo sapiens
gcacuaaauaaacuacuuu

SEQ ID NO: 1084082 - RNA, 22 nt, Homo sapiens
gcacuguccugcuccacagugu

SEQ ID NO: 1084083 - RNA, 19 nt, Homo sapiens
gcagacagugucagaguca

SEQ ID NO: 1084084 - RNA, 22 nt, Homo sapiens
gcagacgugagugugacuuuuu

SEQ ID NO: 1084085 - RNA, 18 nt, Homo sapiens
gcagauagugccucugca

SEQ ID NO: 1084086 - RNA, 23 nt, Homo sapiens
gcagaucuuuuugugaaauucaa

SEQ ID NO: 1084087 - RNA, 16 nt, Homo sapiens
gcagccuuucacagga

SEQ ID NO: 1084088 - RNA, 18 nt, Homo sapiens
gcagccuuucacaggacu

SEQ ID NO: 1084089 - RNA, 21 nt, Homo sapiens
gcaggcagccccacacccgcc

SEQ ID NO: 1084090 - RNA, 18 nt, Homo sapiens
gcaggcuuuuguguucuc

SEQ ID NO: 1084091 - RNA, 12 nt, Homo sapiens
gcaggggacugg

SEQ ID NO: 1084092 - RNA, 22 nt, Homo sapiens
gcaguggcgugaucucggcuca

SEQ ID NO: 1084093 - RNA, 19 nt, Homo sapiens
gcaucaauacaaccagccc

SEQ ID NO: 1084094 - RNA, 18 nt, Homo sapiens
gcauccuccccaccagag

SEQ ID NO: 1084095 - RNA, 21 nt, Homo sapiens
gcauccuggcuggcugugucc

SEQ ID NO: 1084096 - RNA, 14 nt, Homo sapiens
gcaugaccugauca

SEQ ID NO: 1084097 - RNA, 14 nt, Homo sapiens
gcauggcacugacc

SEQ ID NO: 1084098 - RNA, 15 nt, Homo sapiens
gcauucuagugcaga

SEQ ID NO: 1084099 - RNA, 19 nt, Homo sapiens
gcauuuucacauuuugccu

SEQ ID NO: 1084100 - RNA, 18 nt, Homo sapiens
gccaaacagccccaaagu

SEQ ID NO: 1084101 - RNA, 20 nt, Homo sapiens
gccacagacaacauggaaau

SEQ ID NO: 1084102 - RNA, 19 nt, Homo sapiens
gccacauggagcuugacuu

SEQ ID NO: 1084103 - RNA, 21 nt, Homo sapiens
gccaccucggaucccacugau

SEQ ID NO: 1084104 - RNA, 22 nt, Homo sapiens
gccacgaccuggggugggcaca

SEQ ID NO: 1084105 - RNA, 16 nt, Homo sapiens
gccacuguuaagccau

SEQ ID NO: 1084106 - RNA, 16 nt, Homo sapiens
gccagaaagaugcccu

SEQ ID NO: 1084107 - RNA, 19 nt, Homo sapiens
gccaggcuagagugcagug

SEQ ID NO: 1084108 - RNA, 22 nt, Homo sapiens
aggaggugcuaucgcaccacug

SEQ ID NO: 1084109 - RNA, 16 nt, Homo sapiens
aggagugacuaggugg

SEQ ID NO: 1084110 - RNA, 22 nt, Homo sapiens
aggaucuucccacuuugccacu

SEQ ID NO: 1084111 - RNA, 15 nt, Homo sapiens
aggauuuaccaaaua

SEQ ID NO: 1084112 - RNA, 15 nt, Homo sapiens
aggcaaagaacaauu

SEQ ID NO: 1084113 - RNA, 13 nt, Homo sapiens
aggcaaaggccag

SEQ ID NO: 1084114 - RNA, 14 nt, Homo sapiens
aggcaacugugagu

SEQ ID NO: 1084115 - RNA, 14 nt, Homo sapiens
aggcagaucuuuaa

SEQ ID NO: 1084116 - RNA, 20 nt, Homo sapiens
aggcagugggucccacuucc

SEQ ID NO: 1084117 - RNA, 14 nt, Homo sapiens
aggcauuugccuaa

SEQ ID NO: 1084118 - RNA, 23 nt, Homo sapiens
aggccacacuggcaucucccuga

SEQ ID NO: 1084119 - RNA, 16 nt, Homo sapiens
aggccucccacaguga

SEQ ID NO: 1084120 - RNA, 20 nt, Homo sapiens
aggcuggaaaagggcucaga

SEQ ID NO: 1084121 - RNA, 15 nt, Homo sapiens
aggcuggauggcucc

SEQ ID NO: 1084122 - RNA, 20 nt, Homo sapiens
aggcuggguugucacugaga

SEQ ID NO: 1084123 - RNA, 16 nt, Homo sapiens
agggagccgagaucac

SEQ ID NO: 1084124 - RNA, 23 nt, Homo sapiens
agggauaggaagugccccagggu

SEQ ID NO: 1084125 - RNA, 19 nt, Homo sapiens
agggaugcugccugaguca

SEQ ID NO: 1084126 - RNA, 19 nt, Homo sapiens
agggaugggagaguggcuu

SEQ ID NO: 1084127 - RNA, 16 nt, Homo sapiens
agggcaaagaucucag

SEQ ID NO: 1084128 - RNA, 14 nt, Homo sapiens
agggcacaagcuca

SEQ ID NO: 1084129 - RNA, 17 nt, Homo sapiens
agggccuggccuugucc

SEQ ID NO: 1084130 - RNA, 22 nt, Homo sapiens
agggcuuguggacucucugccu

SEQ ID NO: 1084131 - RNA, 20 nt, Homo sapiens
aggggaccuggagcugccag

SEQ ID NO: 1084132 - RNA, 17 nt, Homo sapiens
aggggcaaagaacugcc

SEQ ID NO: 1084133 - RNA, 12 nt, Homo sapiens
aggggccuggaa

SEQ ID NO: 1084134 - RNA, 12 nt, Homo sapiens
aggguaacucuu

SEQ ID NO: 1084135 - RNA, 17 nt, Homo sapiens
agggugacccauuucag

SEQ ID NO: 1084136 - RNA, 20 nt, Homo sapiens
agggugcugugauuuugucc

SEQ ID NO: 1084137 - RNA, 21 nt, Homo sapiens
agguaucugguaucugcaugu

SEQ ID NO: 1084138 - RNA, 21 nt, Homo sapiens
aggucuccccugauccagaca

SEQ ID NO: 1084139 - RNA, 19 nt, Homo sapiens
aggucugggccagaugcug

SEQ ID NO: 1084140 - RNA, 21 nt, Homo sapiens
aggucuuuuacauacagugau

SEQ ID NO: 1084141 - RNA, 18 nt, Homo sapiens
aggugacggacucagacu

SEQ ID NO: 1084142 - RNA, 16 nt, Homo sapiens
aggugccaacaguguu

SEQ ID NO: 1084143 - RNA, 18 nt, Homo sapiens
aggugccgguaccagccu

SEQ ID NO: 1084144 - RNA, 19 nt, Homo sapiens
aggugcuaucgcaccacug

SEQ ID NO: 1084145 - RNA, 19 nt, Homo sapiens
aggugugaggacuucugca

SEQ ID NO: 1084146 - RNA, 15 nt, Homo sapiens
agguucacaccauuu

SEQ ID NO: 1084147 - RNA, 19 nt, Homo sapiens
aguaaaaucaaaugugcau

SEQ ID NO: 1084148 - RNA, 18 nt, Homo sapiens
aguaaacuuucucugcaa

SEQ ID NO: 1084149 - RNA, 21 nt, Homo sapiens
aguaaguaccacucaggccaa

SEQ ID NO: 1084150 - RNA, 16 nt, Homo sapiens
aguagagcacuuuuca

SEQ ID NO: 1084151 - RNA, 17 nt, Homo sapiens
aguaguugacagugcua

SEQ ID NO: 1084152 - RNA, 20 nt, Homo sapiens
aguauuaagugacagugcua

SEQ ID NO: 1084153 - RNA, 19 nt, Homo sapiens
agucagcaacagagcaaaa

SEQ ID NO: 1084154 - RNA, 17 nt, Homo sapiens
aguccagucaaguuccc

SEQ ID NO: 1084155 - RNA, 13 nt, Homo sapiens
agucccucagcca

SEQ ID NO: 1084156 - RNA, 15 nt, Homo sapiens
aguccugcuggccug

SEQ ID NO: 1084157 - RNA, 14 nt, Homo sapiens
agucuaaaguuuac

SEQ ID NO: 1084158 - RNA, 20 nt, Homo sapiens
agucucaugcaagacuucac

SEQ ID NO: 1084159 - RNA, 13 nt, Homo sapiens
agucucugcugcu

SEQ ID NO: 1084160 - RNA, 14 nt, Homo sapiens
agucucugcugcua

SEQ ID NO: 1084161 - RNA, 15 nt, Homo sapiens
agucugaguaaaauc

SEQ ID NO: 1084162 - RNA, 18 nt, Homo sapiens
agucuggcaaacaugugc

SEQ ID NO: 1084163 - RNA, 16 nt, Homo sapiens
agucuuaauauucaga

SEQ ID NO: 1084164 - RNA, 13 nt, Homo sapiens
agugaacacacuc

SEQ ID NO: 1084165 - RNA, 14 nt, Homo sapiens
agugaacacacuca

SEQ ID NO: 1084166 - RNA, 17 nt, Homo sapiens
agugaacacacucagca

SEQ ID NO: 1084167 - RNA, 23 nt, Homo sapiens
agugacaagggcacaagcucagg

SEQ ID NO: 1084168 - RNA, 12 nt, Homo sapiens
agugacagaucc

SEQ ID NO: 1084169 - RNA, 22 nt, Homo sapiens
agugacauauauauguauauac

SEQ ID NO: 1084170 - RNA, 16 nt, Homo sapiens
agugacuuccugguga

SEQ ID NO: 1084171 - RNA, 13 nt, Homo sapiens
agugcaguggcgu

SEQ ID NO: 1084172 - RNA, 23 nt, Homo sapiens
agugcccucuggacagcuugacu

SEQ ID NO: 1084173 - RNA, 18 nt, Homo sapiens
agugccuggcaaggccuc

SEQ ID NO: 1084174 - RNA, 13 nt, Homo sapiens
agugcuggcugcu

SEQ ID NO: 1084175 - RNA, 13 nt, Homo sapiens
agugcuucuugua

SEQ ID NO: 1084176 - RNA, 13 nt, Homo sapiens
aguggaguucucu

SEQ ID NO: 1084177 - RNA, 23 nt, Homo sapiens
aguggccagggcuuguggacucu

SEQ ID NO: 1084178 - RNA, 20 nt, Homo sapiens
aguggcgugaucucggcuca

SEQ ID NO: 1084179 - RNA, 13 nt, Homo sapiens
aguggcuuuuuaa

SEQ ID NO: 1084180 - RNA, 17 nt, Homo sapiens
agugggaggacagagcc

SEQ ID NO: 1084181 - RNA, 18 nt, Homo sapiens
agugggucccacuucccc

SEQ ID NO: 1084182 - RNA, 19 nt, Homo sapiens
aguggguuagcuaccugcu

SEQ ID NO: 1084183 - RNA, 18 nt, Homo sapiens
aguguagggcaacaauac

SEQ ID NO: 1084184 - RNA, 14 nt, Homo sapiens
aguguccaggagau

SEQ ID NO: 1084185 - RNA, 21 nt, Homo sapiens
aguguccaggagaugggaugg

SEQ ID NO: 1084186 - RNA, 19 nt, Homo sapiens
agugucgugucugcuguug

SEQ ID NO: 1084187 - RNA, 15 nt, Homo sapiens
agugugcugcaugga

SEQ ID NO: 1084188 - RNA, 23 nt, Homo sapiens
aguucccuccugcagccugaccc

SEQ ID NO: 1084189 - RNA, 13 nt, Homo sapiens
aguugcaccauuc

SEQ ID NO: 1084190 - RNA, 20 nt, Homo sapiens
aguugguguucauaauuuca

SEQ ID NO: 1084191 - RNA, 19 nt, Homo sapiens
aguuuacauuuuguauauu

SEQ ID NO: 1084192 - RNA, 23 nt, Homo sapiens
aguuuccagcuaagccugaugau

SEQ ID NO: 1084193 - RNA, 18 nt, Homo sapiens
aguuucuuuuauuuucau

SEQ ID NO: 1084194 - RNA, 20 nt, Homo sapiens
auaaaauuguaaaauuguau

SEQ ID NO: 1084195 - RNA, 15 nt, Homo sapiens
auaaacuuugaauuu

SEQ ID NO: 1084196 - RNA, 14 nt, Homo sapiens
auaaagcccuugaa

SEQ ID NO: 1084197 - RNA, 18 nt, Homo sapiens
auaaagcccuugaaccag

SEQ ID NO: 1084198 - RNA, 13 nt, Homo sapiens
auaaauaugugaa

SEQ ID NO: 1084199 - RNA, 16 nt, Homo sapiens
auaaauaugugaaaau

SEQ ID NO: 1084200 - RNA, 23 nt, Homo sapiens
auaaauccucagguaguacuggg

SEQ ID NO: 1084201 - RNA, 13 nt, Homo sapiens
auaaaugccucau

SEQ ID NO: 1084202 - RNA, 19 nt, Homo sapiens
auaacaaccccggacaaau

SEQ ID NO: 1084203 - RNA, 14 nt, Homo sapiens
auaaccauaaauca

SEQ ID NO: 1084204 - RNA, 21 nt, Homo sapiens
auaaccauaaaucaauucauu

SEQ ID NO: 1084205 - RNA, 17 nt, Homo sapiens
auaacuuauuugcccua

SEQ ID NO: 1084206 - RNA, 20 nt, Homo sapiens
auaaguccuuguguagcaaa

SEQ ID NO: 1084207 - RNA, 12 nt, Homo sapiens
auacaaccagcc

SEQ ID NO: 1084208 - RNA, 15 nt, Homo sapiens
auacaaccuauguaa

SEQ ID NO: 1084209 - RNA, 17 nt, Homo sapiens
auacagaaaaaccacau

SEQ ID NO: 1084210 - RNA, 21 nt, Homo sapiens
auagacggguugaaagacauc

SEQ ID NO: 1084211 - RNA, 17 nt, Homo sapiens
auagucccagcuacuca

SEQ ID NO: 1084212 - RNA, 18 nt, Homo sapiens
auagugcacuagcauuuu

SEQ ID NO: 1084213 - RNA, 17 nt, Homo sapiens
auaguuuuuuacuucuc

SEQ ID NO: 1084214 - RNA, 21 nt, Homo sapiens
auauaaccauaaaucaauuca

SEQ ID NO: 1084215 - RNA, 16 nt, Homo sapiens
auauauaguagcauuu

SEQ ID NO: 1084216 - RNA, 13 nt, Homo sapiens
auauauauuuauc

SEQ ID NO: 1084217 - RNA, 16 nt, Homo sapiens
auauauuaaauuugaa

SEQ ID NO: 1084218 - RNA, 18 nt, Homo sapiens
auaucuggccacacuggg

SEQ ID NO: 1084219 - RNA, 14 nt, Homo sapiens
auaugcagugauau

SEQ ID NO: 1084220 - RNA, 18 nt, Homo sapiens
auauguuaggaauacucu

SEQ ID NO: 1084221 - RNA, 15 nt, Homo sapiens
auauuaaaugacuuu

SEQ ID NO: 1084222 - RNA, 21 nt, Homo sapiens
auauuacugaucuuaccuuua

SEQ ID NO: 1084223 - RNA, 18 nt, Homo sapiens
auauuuucugaguagcau

SEQ ID NO: 1084224 - RNA, 12 nt, Homo sapiens
aucaaacaugaa

SEQ ID NO: 1084225 - RNA, 15 nt, Homo sapiens
aucaaauacauacaa

SEQ ID NO: 1084226 - RNA, 13 nt, Homo sapiens
aucaaaugugcau

SEQ ID NO: 1084227 - RNA, 15 nt, Homo sapiens
aucaauucauugugu

SEQ ID NO: 1084228 - RNA, 19 nt, Homo sapiens
aucacuugacuuugccaca

SEQ ID NO: 1084229 - RNA, 16 nt, Homo sapiens
aucagaaaaugcagcc

SEQ ID NO: 1084230 - RNA, 19 nt, Homo sapiens
aucagccuccgccauucca

SEQ ID NO: 1084231 - RNA, 20 nt, Homo sapiens
aucagccuccgccauuccaa

SEQ ID NO: 1084232 - RNA, 20 nt, Homo sapiens
aucauuucuugguaugauca

SEQ ID NO: 1084233 - RNA, 21 nt, Homo sapiens
auccaagaccuuacaaccaca

SEQ ID NO: 1084234 - RNA, 12 nt, Homo sapiens
auccaauggauu

SEQ ID NO: 1084235 - RNA, 21 nt, Homo sapiens
auccaugugcugcuguggcau

SEQ ID NO: 1084236 - RNA, 23 nt, Homo sapiens
auccaugugcugcuguggcauca

SEQ ID NO: 1084237 - RNA, 18 nt, Homo sapiens
aucccacccccacuucau

SEQ ID NO: 1084238 - RNA, 19 nt, Homo sapiens
auccccagggaaacccauc

SEQ ID NO: 1084239 - RNA, 19 nt, Homo sapiens
aucccccagccucaagucu

SEQ ID NO: 1084240 - RNA, 17 nt, Homo sapiens
aucccgucgacguagaa

SEQ ID NO: 1084241 - RNA, 18 nt, Homo sapiens
auccucccuuugguaccu

SEQ ID NO: 1084242 - RNA, 22 nt, Homo sapiens
auccugacacauuuucaaguga

SEQ ID NO: 1084243 - RNA, 16 nt, Homo sapiens
aucguuagaggagcaa

SEQ ID NO: 1084244 - RNA, 17 nt, Homo sapiens
aucuaccucacuauuca

SEQ ID NO: 1084245 - RNA, 21 nt, Homo sapiens
aucuacuagaaccuucuaauc

SEQ ID NO: 1084246 - RNA, 20 nt, Homo sapiens
aucuaguucucaaucacugc

SEQ ID NO: 1084247 - RNA, 14 nt, Homo sapiens
aucugauacuguau

SEQ ID NO: 1084248 - RNA, 14 nt, Homo sapiens
aucugauaucuguu

SEQ ID NO: 1084249 - RNA, 15 nt, Homo sapiens
aucuuacagucagca

SEQ ID NO: 1084250 - RNA, 23 nt, Homo sapiens
aucuuucuuuccaaaacauuucu

SEQ ID NO: 1084251 - RNA, 16 nt, Homo sapiens
aucuuuuuucccccac

SEQ ID NO: 1084252 - RNA, 20 nt, Homo sapiens
augaaaaccacccuaucauc

SEQ ID NO: 1084253 - RNA, 17 nt, Homo sapiens
augaaaacuaaggauuu

SEQ ID NO: 1084254 - RNA, 13 nt, Homo sapiens
augaaacagggca

SEQ ID NO: 1084255 - RNA, 18 nt, Homo sapiens
augaaacagggcacccca

SEQ ID NO: 1084256 - RNA, 15 nt, Homo sapiens
augaaaccacuggaa

SEQ ID NO: 1084257 - RNA, 13 nt, Homo sapiens
augaaguguuucc

SEQ ID NO: 1084258 - RNA, 15 nt, Homo sapiens
augaauuugacuggu

SEQ ID NO: 1084259 - RNA, 21 nt, Homo sapiens
augacacacugcggugucugc

SEQ ID NO: 1084260 - RNA, 17 nt, Homo sapiens
augacugagucuggcaa

SEQ ID NO: 1084261 - RNA, 21 nt, Homo sapiens
augacugagucuggcaaacau

SEQ ID NO: 1084262 - RNA, 13 nt, Homo sapiens
augagacuguguu

SEQ ID NO: 1084263 - RNA, 21 nt, Homo sapiens
augagcuccugcucauugugg

SEQ ID NO: 1084264 - RNA, 21 nt, Homo sapiens
augaggcacgccugccuucuc

SEQ ID NO: 1084265 - RNA, 17 nt, Homo sapiens
augaguuuaucauguca

SEQ ID NO: 1084266 - RNA, 16 nt, Homo sapiens
augauaacugcaauuu

SEQ ID NO: 1084267 - RNA, 20 nt, Homo sapiens
augaugaaaacuaaggauuu

SEQ ID NO: 1084268 - RNA, 14 nt, Homo sapiens
augcaagacuucac

SEQ ID NO: 1084269 - RNA, 12 nt, Homo sapiens
augcccacugcc

SEQ ID NO: 1084270 - RNA, 16 nt, Homo sapiens
augccucuguauuuaa

SEQ ID NO: 1084271 - RNA, 15 nt, Homo sapiens
augccuuaagccaau

SEQ ID NO: 1084272 - RNA, 22 nt, Homo sapiens
augcuguacuaaaauaugcagg

SEQ ID NO: 1084273 - RNA, 21 nt, Homo sapiens
augcuuauguguugcauaaac

SEQ ID NO: 1084274 - RNA, 14 nt, Homo sapiens
augcuuuucuaauc

SEQ ID NO: 1084275 - RNA, 17 nt, Homo sapiens
auggaagagucaugugg

SEQ ID NO: 1084276 - RNA, 18 nt, Homo sapiens
auggaucccuggggccaa

SEQ ID NO: 1084277 - RNA, 17 nt, Homo sapiens
auggcccagccacugca

SEQ ID NO: 1084278 - RNA, 19 nt, Homo sapiens
auggcccagccacugcagc

SEQ ID NO: 1084279 - RNA, 18 nt, Homo sapiens
augggcucaagucacuuu

SEQ ID NO: 1084280 - RNA, 23 nt, Homo sapiens
auggggauaaaggagaaggcaug

SEQ ID NO: 1084281 - RNA, 13 nt, Homo sapiens
augguaacuuuac

SEQ ID NO: 1084282 - RNA, 15 nt, Homo sapiens
augguagacugugac

SEQ ID NO: 1084283 - RNA, 16 nt, Homo sapiens
augguagacugugaca

SEQ ID NO: 1084284 - RNA, 19 nt, Homo sapiens
auggucugcaucagcuuuu

SEQ ID NO: 1084285 - RNA, 23 nt, Homo sapiens
auguaaaaucuucagcuggugga

SEQ ID NO: 1084286 - RNA, 19 nt, Homo sapiens
auguacuggagaguggcaa

SEQ ID NO: 1084287 - RNA, 15 nt, Homo sapiens
auguaucuaccucac

SEQ ID NO: 1084288 - RNA, 22 nt, Homo sapiens
auguaucuaccucacuauucaa

SEQ ID NO: 1084289 - RNA, 15 nt, Homo sapiens
auguccaaguccaac

SEQ ID NO: 1084290 - RNA, 20 nt, Homo sapiens
augucccugaagucuugcau

SEQ ID NO: 1084291 - RNA, 20 nt, Homo sapiens
auguccuuuguguccauuga

SEQ ID NO: 1084292 - RNA, 19 nt, Homo sapiens
augugacucaagacuucca

SEQ ID NO: 1084293 - RNA, 18 nt, Homo sapiens
augugcucccaccaggca

SEQ ID NO: 1084294 - RNA, 19 nt, Homo sapiens
augugucauuggaagccau

SEQ ID NO: 1084295 - RNA, 15 nt, Homo sapiens
augugucccagugaa

SEQ ID NO: 1084296 - RNA, 15 nt, Homo sapiens
auguuaauaucugau

SEQ ID NO: 1084297 - RNA, 17 nt, Homo sapiens
auguugggaagcuauuu

SEQ ID NO: 1084298 - RNA, 22 nt, Homo sapiens
auuaaauguagaaagugaucca

SEQ ID NO: 1084299 - RNA, 14 nt, Homo sapiens
auuaaaugugucau

SEQ ID NO: 1084300 - RNA, 24 nt, Homo sapiens
auuaagcgggaucccagcaucuca

SEQ ID NO: 1084301 - RNA, 14 nt, Homo sapiens
auuaaguggcuuuu

SEQ ID NO: 1084302 - RNA, 16 nt, Homo sapiens
auuaauauaaccauaa

SEQ ID NO: 1084303 - RNA, 15 nt, Homo sapiens
auuagaaugcaugua

SEQ ID NO: 1084304 - RNA, 11 nt, Homo sapiens
auuauucugau

SEQ ID NO: 1084305 - RNA, 19 nt, Homo sapiens
auucaaagaaaacccuaag

SEQ ID NO: 1084306 - RNA, 13 nt, Homo sapiens
auucaaagcucua

SEQ ID NO: 1084307 - RNA, 19 nt, Homo sapiens
auucaaccugugucuuaua

SEQ ID NO: 1084308 - RNA, 13 nt, Homo sapiens
auucacaccucac

SEQ ID NO: 1084309 - RNA, 16 nt, Homo sapiens
auucagaaagucauag

SEQ ID NO: 1084310 - RNA, 21 nt, Homo sapiens
auucaugcaacuugauucuug

SEQ ID NO: 1084311 - RNA, 18 nt, Homo sapiens
auuccacuuuuauucauu

SEQ ID NO: 1084312 - RNA, 22 nt, Homo sapiens
auuccaugcacucucucucugu

SEQ ID NO: 1084313 - RNA, 22 nt, Homo sapiens
auucccaugguagacugugaca

SEQ ID NO: 1084314 - RNA, 12 nt, Homo sapiens
auuccucauguc

SEQ ID NO: 1084315 - RNA, 13 nt, Homo sapiens
auucuacacacag

SEQ ID NO: 1084316 - RNA, 21 nt, Homo sapiens
auucuacacauauauguauau

SEQ ID NO: 1084317 - RNA, 14 nt, Homo sapiens
auucucaccugccu

SEQ ID NO: 1084318 - RNA, 15 nt, Homo sapiens
auucuccugccucag

SEQ ID NO: 1084319 - RNA, 23 nt, Homo sapiens
auucuguggugggaacauucgag

SEQ ID NO: 1084320 - RNA, 15 nt, Homo sapiens
auucuucugccucag

SEQ ID NO: 1084321 - RNA, 20 nt, Homo sapiens
auugaagacccucaaugcca

SEQ ID NO: 1084322 - RNA, 19 nt, Homo sapiens
auugcacuuuuaaaccucu

SEQ ID NO: 1084323 - RNA, 22 nt, Homo sapiens
auuggaauuuucuuucauacau

SEQ ID NO: 1084324 - RNA, 12 nt, Homo sapiens
auuggugcauuu

SEQ ID NO: 1084325 - RNA, 21 nt, Homo sapiens
auuguauuccucaugucauca

SEQ ID NO: 1084326 - RNA, 11 nt, Homo sapiens
auugucuucca

SEQ ID NO: 1084327 - RNA, 20 nt, Homo sapiens
auuguuacuauuauuugcua

SEQ ID NO: 1084328 - RNA, 16 nt, Homo sapiens
auuguucaucaugaca

SEQ ID NO: 1084329 - RNA, 19 nt, Homo sapiens
auuuaauaagaaacaugau

SEQ ID NO: 1084330 - RNA, 16 nt, Homo sapiens
auuuacugucccagga

SEQ ID NO: 1084331 - RNA, 12 nt, Homo sapiens
auuuagugucuu

SEQ ID NO: 1084332 - RNA, 13 nt, Homo sapiens
auuuagugucuug

SEQ ID NO: 1084333 - RNA, 20 nt, Homo sapiens
auuuaugccucuguauuuaa

SEQ ID NO: 1084334 - RNA, 14 nt, Homo sapiens
auuucuacucuuaa

SEQ ID NO: 1084335 - RNA, 19 nt, Homo sapiens
auuucuaucuugaauuuca

SEQ ID NO: 1084336 - RNA, 20 nt, Homo sapiens
auuucuaucuugaauuucau

SEQ ID NO: 1084337 - RNA, 15 nt, Homo sapiens
auuucugaacaaaga

SEQ ID NO: 1084338 - RNA, 24 nt, Homo sapiens
auuucuuucuuugcaccaaagaca

SEQ ID NO: 1084339 - RNA, 23 nt, Homo sapiens
auuugugugugugauauaugcau

SEQ ID NO: 1084340 - RNA, 21 nt, Homo sapiens
auuuuaggcagggauuugagg

SEQ ID NO: 1084341 - RNA, 19 nt, Homo sapiens
auuuuauugcuggaaucua

SEQ ID NO: 1084342 - RNA, 21 nt, Homo sapiens
auuuucucuaaaauuucaaca

SEQ ID NO: 1084343 - RNA, 19 nt, Homo sapiens
auuuucugcccaacuuuca

SEQ ID NO: 1084344 - RNA, 21 nt, Homo sapiens
cagacugggaguugcuagcaa

SEQ ID NO: 1084345 - RNA, 14 nt, Homo sapiens
cagagaaugugaac

SEQ ID NO: 1084346 - RNA, 15 nt, Homo sapiens
cagagccacuaccuu

SEQ ID NO: 1084347 - RNA, 15 nt, Homo sapiens
cagagccucaaauga

SEQ ID NO: 1084348 - RNA, 20 nt, Homo sapiens
cagagcgagagucugucuca

SEQ ID NO: 1084349 - RNA, 13 nt, Homo sapiens
cagagcugccucc

SEQ ID NO: 1084350 - RNA, 13 nt, Homo sapiens
cagaguccaguca

SEQ ID NO: 1084351 - RNA, 15 nt, Homo sapiens
cagaguucugcucua

SEQ ID NO: 1084352 - RNA, 12 nt, Homo sapiens
cagauagugccu

SEQ ID NO: 1084353 - RNA, 17 nt, Homo sapiens
cagauccugggcaugau

SEQ ID NO: 1084354 - RNA, 12 nt, Homo sapiens
cagaucuuuaaa

SEQ ID NO: 1084355 - RNA, 21 nt, Homo sapiens
cagaugggaugggcuuucuca

SEQ ID NO: 1084356 - RNA, 13 nt, Homo sapiens
cagauguguuugc

SEQ ID NO: 1084357 - RNA, 22 nt, Homo sapiens
cagcaaaaaucucccagugaca

SEQ ID NO: 1084358 - RNA, 21 nt, Homo sapiens
cagcagggucuugcuguaacu

SEQ ID NO: 1084359 - RNA, 21 nt, Homo sapiens
cagcaucucagaguccaguca

SEQ ID NO: 1084360 - RNA, 22 nt, Homo sapiens
cagcaucucagaguccagucaa

SEQ ID NO: 1084361 - RNA, 23 nt, Homo sapiens
cagcaugaaggcagccacagaca

SEQ ID NO: 1084362 - RNA, 12 nt, Homo sapiens
cagccacugcag

SEQ ID NO: 1084363 - RNA, 16 nt, Homo sapiens
cagccacuuauuucca

SEQ ID NO: 1084364 - RNA, 20 nt, Homo sapiens
cagcccccaccccagcacag

SEQ ID NO: 1084365 - RNA, 14 nt, Homo sapiens
cagccggcugcaag

SEQ ID NO: 1084366 - RNA, 16 nt, Homo sapiens
cagccuccaggcaccc

SEQ ID NO: 1084367 - RNA, 19 nt, Homo sapiens
cagccucccaaguagcugg

SEQ ID NO: 1084368 - RNA, 19 nt, Homo sapiens
cagccucccgaguagcuga

SEQ ID NO: 1084369 - RNA, 20 nt, Homo sapiens
cagccucccgaguagcugag

SEQ ID NO: 1084370 - RNA, 20 nt, Homo sapiens
cagccucccucugaccugca

SEQ ID NO: 1084371 - RNA, 18 nt, Homo sapiens
cagccuccgccauuccaa

SEQ ID NO: 1084372 - RNA, 23 nt, Homo sapiens
cagccuuucacaggacucugcag

SEQ ID NO: 1084373 - RNA, 14 nt, Homo sapiens
cagcgccuccugga

SEQ ID NO: 1084374 - RNA, 20 nt, Homo sapiens
cagcggcacaaaugcaccuc

SEQ ID NO: 1084375 - RNA, 21 nt, Homo sapiens
cagcuccagcuguuaccugag

SEQ ID NO: 1084376 - RNA, 16 nt, Homo sapiens
cagcucuccugcugca

SEQ ID NO: 1084377 - RNA, 19 nt, Homo sapiens
cagcugaccugguacugag

SEQ ID NO: 1084378 - RNA, 14 nt, Homo sapiens
cagcugcaccugcc

SEQ ID NO: 1084379 - RNA, 15 nt, Homo sapiens
cagcugcaccugcca

SEQ ID NO: 1084380 - RNA, 19 nt, Homo sapiens
cagcuggacccauuugcca

SEQ ID NO: 1084381 - RNA, 23 nt, Homo sapiens
cagcugugaacauggacucuucc

SEQ ID NO: 1084382 - RNA, 14 nt, Homo sapiens
cagcuguuaccuga

SEQ ID NO: 1084383 - RNA, 22 nt, Homo sapiens
cagcuucccaaguagcugagau

SEQ ID NO: 1084384 - RNA, 20 nt, Homo sapiens
cagcuucccucugccugacc

SEQ ID NO: 1084385 - RNA, 15 nt, Homo sapiens
caggacaugugcucu

SEQ ID NO: 1084386 - RNA, 20 nt, Homo sapiens
caggacuggggcuugccagg

SEQ ID NO: 1084387 - RNA, 17 nt, Homo sapiens
caggagcauggggauaa

SEQ ID NO: 1084388 - RNA, 23 nt, Homo sapiens
caggagcucaguuucuuuuucac

SEQ ID NO: 1084389 - RNA, 15 nt, Homo sapiens
caggaggcuccguga

SEQ ID NO: 1084390 - RNA, 18 nt, Homo sapiens
caggaggcugaggcacca

SEQ ID NO: 1084391 - RNA, 22 nt, Homo sapiens
caggaguuugaggcugcagcga

SEQ ID NO: 1084392 - RNA, 22 nt, Homo sapiens
caggauuguuucucggcaccag

SEQ ID NO: 1084393 - RNA, 21 nt, Homo sapiens
caggccaggagacuguuaaag

SEQ ID NO: 1084394 - RNA, 13 nt, Homo sapiens
caggccagucacc

SEQ ID NO: 1084395 - RNA, 20 nt, Homo sapiens
caggccagucacccugugac

SEQ ID NO: 1084396 - RNA, 20 nt, Homo sapiens
caggcccggugaggccaagg

SEQ ID NO: 1084397 - RNA, 14 nt, Homo sapiens
caggcucugagauu

SEQ ID NO: 1084398 - RNA, 22 nt, Homo sapiens
caggcuguaagcauucugagcu

SEQ ID NO: 1084399 - RNA, 17 nt, Homo sapiens
caggcuuugucugcucc

SEQ ID NO: 1084400 - RNA, 13 nt, Homo sapiens
cagggaauuucag

SEQ ID NO: 1084401 - RNA, 23 nt, Homo sapiens
cagggagcaacucuccacuccau

SEQ ID NO: 1084402 - RNA, 14 nt, Homo sapiens
caggggacuguucu

SEQ ID NO: 1084403 - RNA, 22 nt, Homo sapiens
caggggcaaagaacugccccau

SEQ ID NO: 1084404 - RNA, 13 nt, Homo sapiens
cagguaguacugg

SEQ ID NO: 1084405 - RNA, 16 nt, Homo sapiens
cagguaguacugggaa

SEQ ID NO: 1084406 - RNA, 23 nt, Homo sapiens
caggucuccuccaccgccauggc

SEQ ID NO: 1084407 - RNA, 15 nt, Homo sapiens
caggugccuaccacc

SEQ ID NO: 1084408 - RNA, 15 nt, Homo sapiens
cagguguguucagua

SEQ ID NO: 1084409 - RNA, 22 nt, Homo sapiens
cagguugcuuucccacccuggg

SEQ ID NO: 1084410 - RNA, 17 nt, Homo sapiens
caguaaacuuucucugc

SEQ ID NO: 1084411 - RNA, 18 nt, Homo sapiens
caguagagcacuuuucac

SEQ ID NO: 1084412 - RNA, 21 nt, Homo sapiens
caguagagcacuuuucacuua

SEQ ID NO: 1084413 - RNA, 21 nt, Homo sapiens
caguaguuccaggacucaggg

SEQ ID NO: 1084414 - RNA, 17 nt, Homo sapiens
caguauagguguuugcu

SEQ ID NO: 1084415 - RNA, 19 nt, Homo sapiens
cagucaaguucccuccugc

SEQ ID NO: 1084416 - RNA, 16 nt, Homo sapiens
caguccuuuguugcug

SEQ ID NO: 1084417 - RNA, 19 nt, Homo sapiens
caguccuuuguugcuguug

SEQ ID NO: 1084418 - RNA, 20 nt, Homo sapiens
cagucucaauuuuguauuua

SEQ ID NO: 1084419 - RNA, 14 nt, Homo sapiens
cagugacaacaucg

SEQ ID NO: 1084420 - RNA, 19 nt, Homo sapiens
cagugacaacaucgcaaua

SEQ ID NO: 1084421 - RNA, 19 nt, Homo sapiens
cagugaugaaaauuugccu

SEQ ID NO: 1084422 - RNA, 16 nt, Homo sapiens
cagugcccauuccuca

SEQ ID NO: 1084423 - RNA, 16 nt, Homo sapiens
cagugccuggcaaggc

SEQ ID NO: 1084424 - RNA, 17 nt, Homo sapiens
cagugcuucagccugag

SEQ ID NO: 1084425 - RNA, 15 nt, Homo sapiens
caguggugugaucuu

SEQ ID NO: 1084426 - RNA, 14 nt, Homo sapiens
cagugucagaguca

SEQ ID NO: 1084427 - RNA, 23 nt, Homo sapiens
cagugugaucccaagugccaguc

SEQ ID NO: 1084428 - RNA, 21 nt, Homo sapiens
caguguuuccugaguagcagu

SEQ ID NO: 1084429 - RNA, 19 nt, Homo sapiens
caguguuuguauaccauga

SEQ ID NO: 1084430 - RNA, 15 nt, Homo sapiens
caguucuguguccuc

SEQ ID NO: 1084431 - RNA, 18 nt, Homo sapiens
cauaaauuauuucuaaaa

SEQ ID NO: 1084432 - RNA, 16 nt, Homo sapiens
cauacaacagaaacca

SEQ ID NO: 1084433 - RNA, 15 nt, Homo sapiens
cauacaauggccaac

SEQ ID NO: 1084434 - RNA, 11 nt, Homo sapiens
cauacagugau

SEQ ID NO: 1084435 - RNA, 24 nt, Homo sapiens
cauauauaauuuuauugcuggaau

SEQ ID NO: 1084436 - RNA, 16 nt, Homo sapiens
cauauauauguauaua

SEQ ID NO: 1084437 - RNA, 18 nt, Homo sapiens
cauaucucuagucccugu

SEQ ID NO: 1084438 - RNA, 22 nt, Homo sapiens
cauauuaagaauagucucuggg

SEQ ID NO: 1084439 - RNA, 17 nt, Homo sapiens
cauauucuaaauucacu

SEQ ID NO: 1084440 - RNA, 20 nt, Homo sapiens
caucaaaaccugcgcaguca

SEQ ID NO: 1084441 - RNA, 14 nt, Homo sapiens
caucaauacaacca

SEQ ID NO: 1084442 - RNA, 15 nt, Homo sapiens
caucagaaauaguca

SEQ ID NO: 1084443 - RNA, 21 nt, Homo sapiens
caucagguuccaguugcuuga

SEQ ID NO: 1084444 - RNA, 13 nt, Homo sapiens
caucccaucuaag

SEQ ID NO: 1084445 - RNA, 20 nt, Homo sapiens
caucuaaauugaucauucau

SEQ ID NO: 1084446 - RNA, 18 nt, Homo sapiens
caucucagaguccaguca

SEQ ID NO: 1084447 - RNA, 16 nt, Homo sapiens
caucugacuugaacuc

SEQ ID NO: 1084448 - RNA, 12 nt, Homo sapiens
caucugcuccua

SEQ ID NO: 1084449 - RNA, 20 nt, Homo sapiens
caucuuaguugaugcuacaa

SEQ ID NO: 1084450 - RNA, 13 nt, Homo sapiens
caucuuccaggug

SEQ ID NO: 1084451 - RNA, 20 nt, Homo sapiens
caucuugcugcuaauccuga

SEQ ID NO: 1084452 - RNA, 17 nt, Homo sapiens
caucuuguugccaugga

SEQ ID NO: 1084453 - RNA, 24 nt, Homo sapiens
caugaccuccguguagugucugua

SEQ ID NO: 1084454 - RNA, 14 nt, Homo sapiens
caugaggccaugca

SEQ ID NO: 1084455 - RNA, 14 nt, Homo sapiens
caugcaacuugauu

SEQ ID NO: 1084456 - RNA, 14 nt, Homo sapiens
caugcaagacuuca

SEQ ID NO: 1084457 - RNA, 17 nt, Homo sapiens
caugcaggucuccauga

SEQ ID NO: 1084458 - RNA, 20 nt, Homo sapiens
caugguaaaaccccaucucu

SEQ ID NO: 1084459 - RNA, 13 nt, Homo sapiens
cauguaccugaaa

SEQ ID NO: 1084460 - RNA, 20 nt, Homo sapiens
cauguaucacucacugccaa

SEQ ID NO: 1084461 - RNA, 18 nt, Homo sapiens
caugugcugcuguggcau

SEQ ID NO: 1084462 - RNA, 22 nt, Homo sapiens
cauguuuuguauguuaaauuca

SEQ ID NO: 1084463 - RNA, 15 nt, Homo sapiens
cauuagggcaaagau

SEQ ID NO: 1084464 - RNA, 23 nt, Homo sapiens
cauuagugaauuacacucaagga

SEQ ID NO: 1084465 - RNA, 17 nt, Homo sapiens
cauuauguaauguccuu

SEQ ID NO: 1084466 - RNA, 16 nt, Homo sapiens
cauuauuauuacuuuu

SEQ ID NO: 1084467 - RNA, 16 nt, Homo sapiens
cauuauuugauaacau

SEQ ID NO: 1084468 - RNA, 14 nt, Homo sapiens
auuuuguaugaaaa

SEQ ID NO: 1084469 - RNA, 17 nt, Homo sapiens
auuuuucgacugugaac

SEQ ID NO: 1084470 - RNA, 14 nt, Homo sapiens
auuuuuguacauua

SEQ ID NO: 1084471 - RNA, 15 nt, Homo sapiens
auuuuuguacauuau

SEQ ID NO: 1084472 - RNA, 22 nt, Homo sapiens
auuuuuguguauccaguaugca

SEQ ID NO: 1084473 - RNA, 21 nt, Homo sapiens
auuuuuguuagcaaagauuaa

SEQ ID NO: 1084474 - RNA, 16 nt, Homo sapiens
auuuuuuaacauauug

SEQ ID NO: 1084475 - RNA, 12 nt, Homo sapiens
auuuuuuccaca

SEQ ID NO: 1084476 - RNA, 14 nt, Homo sapiens
caaaaagacugugg

SEQ ID NO: 1084477 - RNA, 14 nt, Homo sapiens
caaaaauaguauuc

SEQ ID NO: 1084478 - RNA, 16 nt, Homo sapiens
caaaaaugggcagcca

SEQ ID NO: 1084479 - RNA, 18 nt, Homo sapiens
caaaaauguaaugaucau

SEQ ID NO: 1084480 - RNA, 19 nt, Homo sapiens
caaaaauguaaugaucaua

SEQ ID NO: 1084481 - RNA, 14 nt, Homo sapiens
caaaagcagcuuuu

SEQ ID NO: 1084482 - RNA, 21 nt, Homo sapiens
caaaauggacguacugguuua

SEQ ID NO: 1084483 - RNA, 15 nt, Homo sapiens
caaaauuacuggaca

SEQ ID NO: 1084484 - RNA, 16 nt, Homo sapiens
caaacacacagacucu

SEQ ID NO: 1084485 - RNA, 11 nt, Homo sapiens
caaacagugaa

SEQ ID NO: 1084486 - RNA, 11 nt, Homo sapiens
caaacaugugc

SEQ ID NO: 1084487 - RNA, 18 nt, Homo sapiens
caaacccacccauaccag

SEQ ID NO: 1084488 - RNA, 20 nt, Homo sapiens
caaacccauuuccagcuccu

SEQ ID NO: 1084489 - RNA, 17 nt, Homo sapiens
caaagaaucaacaguga

SEQ ID NO: 1084490 - RNA, 18 nt, Homo sapiens
caaagaaucaacagugaa

SEQ ID NO: 1084491 - RNA, 18 nt, Homo sapiens
caaagacaucagucucca

SEQ ID NO: 1084492 - RNA, 15 nt, Homo sapiens
caaagagaaaagcca

SEQ ID NO: 1084493 - RNA, 16 nt, Homo sapiens
caaagagaaaagccac

SEQ ID NO: 1084494 - RNA, 10 nt, Homo sapiens
caaagccaaa

SEQ ID NO: 1084495 - RNA, 21 nt, Homo sapiens
caaaggcauccauagugcacu

SEQ ID NO: 1084496 - RNA, 21 nt, Homo sapiens
caaaggcuuucuuuccaaucc

SEQ ID NO: 1084497 - RNA, 21 nt, Homo sapiens
caaauacauacaaccuaugua

SEQ ID NO: 1084498 - RNA, 13 nt, Homo sapiens
caaauauauaaug

SEQ ID NO: 1084499 - RNA, 19 nt, Homo sapiens
caaauauauaaugcaacaa

SEQ ID NO: 1084500 - RNA, 15 nt, Homo sapiens
caaaucaggcugggu

SEQ ID NO: 1084501 - RNA, 19 nt, Homo sapiens
caacacuucucacaucuua

SEQ ID NO: 1084502 - RNA, 21 nt, Homo sapiens
caacaugguaaaaccccaucu

SEQ ID NO: 1084503 - RNA, 18 nt, Homo sapiens
caacauuuuuguacauua

SEQ ID NO: 1084504 - RNA, 19 nt, Homo sapiens
caacccagccugagugcac

SEQ ID NO: 1084505 - RNA, 16 nt, Homo sapiens
caaccugccugugcau

SEQ ID NO: 1084506 - RNA, 12 nt, Homo sapiens
caacugugcuac

SEQ ID NO: 1084507 - RNA, 19 nt, Homo sapiens
caagaaguaacaaaaguau

SEQ ID NO: 1084508 - RNA, 20 nt, Homo sapiens
caagagucucuccagccuca

SEQ ID NO: 1084509 - RNA, 21 nt, Homo sapiens
caagauccaaaugcugugcaa

SEQ ID NO: 1084510 - RNA, 16 nt, Homo sapiens
caagaugaaacagggc

SEQ ID NO: 1084511 - RNA, 17 nt, Homo sapiens
caagaugaaacagggca

SEQ ID NO: 1084512 - RNA, 20 nt, Homo sapiens
caagaugaaacagggcaccc

SEQ ID NO: 1084513 - RNA, 16 nt, Homo sapiens
caagauuucacaucag

SEQ ID NO: 1084514 - RNA, 16 nt, Homo sapiens
caagauuuucuacuuu

SEQ ID NO: 1084515 - RNA, 13 nt, Homo sapiens
caagcaagcaaaa

SEQ ID NO: 1084516 - RNA, 13 nt, Homo sapiens
caagcgugcugcc

SEQ ID NO: 1084517 - RNA, 16 nt, Homo sapiens
caaggacaaccugccc

SEQ ID NO: 1084518 - RNA, 15 nt, Homo sapiens
caaggcaacugugag

SEQ ID NO: 1084519 - RNA, 19 nt, Homo sapiens
caaggcugaugcauucccg

SEQ ID NO: 1084520 - RNA, 19 nt, Homo sapiens
caaggguaugggaagccau

SEQ ID NO: 1084521 - RNA, 17 nt, Homo sapiens
caagguuucccagugag

SEQ ID NO: 1084522 - RNA, 16 nt, Homo sapiens
caaguaacaauaugau

SEQ ID NO: 1084523 - RNA, 19 nt, Homo sapiens
caaguacauggcuagcuuu

SEQ ID NO: 1084524 - RNA, 20 nt, Homo sapiens
caagugauacaacugagucu

SEQ ID NO: 1084525 - RNA, 16 nt, Homo sapiens
caaguuagcucaggag

SEQ ID NO: 1084526 - RNA, 19 nt, Homo sapiens
caauaacacugcuuauaaa

SEQ ID NO: 1084527 - RNA, 16 nt, Homo sapiens
caauacaugcugcuaa

SEQ ID NO: 1084528 - RNA, 17 nt, Homo sapiens
caauacaugcugcuaau

SEQ ID NO: 1084529 - RNA, 21 nt, Homo sapiens
caauacaugcugcuaauucaa

SEQ ID NO: 1084530 - RNA, 13 nt, Homo sapiens
caauagcauccaa

SEQ ID NO: 1084531 - RNA, 20 nt, Homo sapiens
caauagggugcaguuuucca

SEQ ID NO: 1084532 - RNA, 16 nt, Homo sapiens
caauauuuacucauca

SEQ ID NO: 1084533 - RNA, 15 nt, Homo sapiens
caaugcagugcagca

SEQ ID NO: 1084534 - RNA, 20 nt, Homo sapiens
caaugucagaaacucgauga

SEQ ID NO: 1084535 - RNA, 20 nt, Homo sapiens
caauguuuuaaacauucuuc

SEQ ID NO: 1084536 - RNA, 14 nt, Homo sapiens
caauuaaagcaaaa

SEQ ID NO: 1084537 - RNA, 20 nt, Homo sapiens
caauugagggcuaaauccca

SEQ ID NO: 1084538 - RNA, 15 nt, Homo sapiens
caauugggagagaaa

SEQ ID NO: 1084539 - RNA, 12 nt, Homo sapiens
caauuuacuuuu

SEQ ID NO: 1084540 - RNA, 14 nt, Homo sapiens
caauuucuaccuuu

SEQ ID NO: 1084541 - RNA, 18 nt, Homo sapiens
cacaaauggaacucccca

SEQ ID NO: 1084542 - RNA, 20 nt, Homo sapiens
cacaaccuccuccuccaguu

SEQ ID NO: 1084543 - RNA, 20 nt, Homo sapiens
cacaagaacaaauacacuuu

SEQ ID NO: 1084544 - RNA, 19 nt, Homo sapiens
cacaagcucagguccugcu

SEQ ID NO: 1084545 - RNA, 18 nt, Homo sapiens
cacaccauugcaugaauu

SEQ ID NO: 1084546 - RNA, 10 nt, Homo sapiens
cacacuccua

SEQ ID NO: 1084547 - RNA, 13 nt, Homo sapiens
cacacuucuugaa

SEQ ID NO: 1084548 - RNA, 13 nt, Homo sapiens
cacacuuugaagg

SEQ ID NO: 1084549 - RNA, 16 nt, Homo sapiens
cacagaaacauuuuca

SEQ ID NO: 1084550 - RNA, 14 nt, Homo sapiens
cacagggacacagu

SEQ ID NO: 1084551 - RNA, 22 nt, Homo sapiens
cacagggaggcugcaguucccu

SEQ ID NO: 1084552 - RNA, 21 nt, Homo sapiens
cacaguuggcccgggugcagg

SEQ ID NO: 1084553 - RNA, 11 nt, Homo sapiens
cacauaugcaa

SEQ ID NO: 1084554 - RNA, 22 nt, Homo sapiens
cacaucagcuuuaggacugaca

SEQ ID NO: 1084555 - RNA, 18 nt, Homo sapiens
cacauuuuaaauaaagac

SEQ ID NO: 1084556 - RNA, 20 nt, Homo sapiens
caccaagcgugauuccugcu

SEQ ID NO: 1084557 - RNA, 23 nt, Homo sapiens
caccaagcgugauuccugcugcc

SEQ ID NO: 1084558 - RNA, 23 nt, Homo sapiens
caccagugccucagugcugcaau

SEQ ID NO: 1084559 - RNA, 15 nt, Homo sapiens
caccaugaaacuuua

SEQ ID NO: 1084560 - RNA, 14 nt, Homo sapiens
cacccaccuggauu

SEQ ID NO: 1084561 - RNA, 19 nt, Homo sapiens
cacccagggucccagccug

SEQ ID NO: 1084562 - RNA, 21 nt, Homo sapiens
caccccagcugaccugguacu

SEQ ID NO: 1084563 - RNA, 13 nt, Homo sapiens
cacccccagucuc

SEQ ID NO: 1084564 - RNA, 22 nt, Homo sapiens
caccccucuguccagccagcuc

SEQ ID NO: 1084565 - RNA, 15 nt, Homo sapiens
cacccuaucaucagu

SEQ ID NO: 1084566 - RNA, 17 nt, Homo sapiens
cacccuccuggcacaac

SEQ ID NO: 1084567 - RNA, 22 nt, Homo sapiens
cacccugggcaaugcagugcag

SEQ ID NO: 1084568 - RNA, 22 nt, Homo sapiens
caccuaguggcuguccagugcc

SEQ ID NO: 1084569 - RNA, 16 nt, Homo sapiens
caccugccauuugcac

SEQ ID NO: 1084570 - RNA, 14 nt, Homo sapiens
caccuugcauuuca

SEQ ID NO: 1084571 - RNA, 19 nt, Homo sapiens
cacggcagcuguagcuccc

SEQ ID NO: 1084572 - RNA, 13 nt, Homo sapiens
cacgggugcauga

SEQ ID NO: 1084573 - RNA, 19 nt, Homo sapiens
cacguaauuuuuuucacag

SEQ ID NO: 1084574 - RNA, 14 nt, Homo sapiens
cacgugcacagcuu

SEQ ID NO: 1084575 - RNA, 23 nt, Homo sapiens
cacgugcacagcuuccugaguca

SEQ ID NO: 1084576 - RNA, 22 nt, Homo sapiens
cacuagcauuuucuugaaccaa

SEQ ID NO: 1084577 - RNA, 22 nt, Homo sapiens
cacuagccaugauaacugcaau

SEQ ID NO: 1084578 - RNA, 20 nt, Homo sapiens
cacucaaggaaaagaugugc

SEQ ID NO: 1084579 - RNA, 21 nt, Homo sapiens
cacucaggccaacaagccaac

SEQ ID NO: 1084580 - RNA, 20 nt, Homo sapiens
cacugcugaaccuuuccucu

SEQ ID NO: 1084581 - RNA, 16 nt, Homo sapiens
cacuggcugccuccac

SEQ ID NO: 1084582 - RNA, 16 nt, Homo sapiens
cacuguccugcuccac

SEQ ID NO: 1084583 - RNA, 13 nt, Homo sapiens
cacuuauccugac

SEQ ID NO: 1084584 - RNA, 14 nt, Homo sapiens
cacuuuucacuuau

SEQ ID NO: 1084585 - RNA, 15 nt, Homo sapiens
cagaaagaugcccua

SEQ ID NO: 1084586 - RNA, 14 nt, Homo sapiens
cagaacacagugcc

SEQ ID NO: 1084587 - RNA, 20 nt, Homo sapiens
cagaacuuaaggauggagcc

SEQ ID NO: 1084588 - RNA, 16 nt, Homo sapiens
cagacagugucagagu

SEQ ID NO: 1084589 - RNA, 19 nt, Homo sapiens
cagacagugucagagucau

SEQ ID NO: 1084590 - RNA, 12 nt, Homo sapiens
cagacauuccaa

SEQ ID NO: 1084591 - RNA, 14 nt, Homo sapiens
cagaccaguacugg

SEQ ID NO: 1084592 - RNA, 17 nt, Homo sapiens
cagaccauugucuucca

SEQ ID NO: 1084593 - RNA, 18 nt, Homo sapiens
cagaccauugucuuccaa

SEQ ID NO: 1084594 - RNA, 22 nt, Homo sapiens
acauuaguaucccacuagccca

SEQ ID NO: 1084595 - RNA, 20 nt, Homo sapiens
acauucuacacacagugccu

SEQ ID NO: 1084596 - RNA, 22 nt, Homo sapiens
acauuggaagcucccaccccau

SEQ ID NO: 1084597 - RNA, 22 nt, Homo sapiens
acauuucuggacaguaccugau

SEQ ID NO: 1084598 - RNA, 15 nt, Homo sapiens
acauuuugcauuaga

SEQ ID NO: 1084599 - RNA, 14 nt, Homo sapiens
acauuuuguauauu

SEQ ID NO: 1084600 - RNA, 22 nt, Homo sapiens
acauuuuguuuauguuacuuaa

SEQ ID NO: 1084601 - RNA, 16 nt, Homo sapiens
accaaagacaucaguc

SEQ ID NO: 1084602 - RNA, 20 nt, Homo sapiens
accaaaucucaguagcugau

SEQ ID NO: 1084603 - RNA, 18 nt, Homo sapiens
accaaggucucacacucc

SEQ ID NO: 1084604 - RNA, 15 nt, Homo sapiens
accacacccugccug

SEQ ID NO: 1084605 - RNA, 14 nt, Homo sapiens
accacacuucuuga

SEQ ID NO: 1084606 - RNA, 19 nt, Homo sapiens
accacauucugucucugcu

SEQ ID NO: 1084607 - RNA, 23 nt, Homo sapiens
accacucaggccaacaagccaac

SEQ ID NO: 1084608 - RNA, 14 nt, Homo sapiens
accacugggugaga

SEQ ID NO: 1084609 - RNA, 11 nt, Homo sapiens
accacuuugaa

SEQ ID NO: 1084610 - RNA, 17 nt, Homo sapiens
accagaaaagcaauacu

SEQ ID NO: 1084611 - RNA, 21 nt, Homo sapiens
accagaauugcuugaacccag

SEQ ID NO: 1084612 - RNA, 17 nt, Homo sapiens
accagacucuguugcaa

SEQ ID NO: 1084613 - RNA, 14 nt, Homo sapiens
accagcccaaccau

SEQ ID NO: 1084614 - RNA, 16 nt, Homo sapiens
accagggccaucuccu

SEQ ID NO: 1084615 - RNA, 14 nt, Homo sapiens
accaguacugggaa

SEQ ID NO: 1084616 - RNA, 23 nt, Homo sapiens
accaguggcccccacucacaggg

SEQ ID NO: 1084617 - RNA, 13 nt, Homo sapiens
accaguguagccu

SEQ ID NO: 1084618 - RNA, 15 nt, Homo sapiens
accaugccaggcuaa

SEQ ID NO: 1084619 - RNA, 15 nt, Homo sapiens
accaugugguuugcu

SEQ ID NO: 1084620 - RNA, 12 nt, Homo sapiens
acccacuggcca

SEQ ID NO: 1084621 - RNA, 16 nt, Homo sapiens
acccagugugugcuca

SEQ ID NO: 1084622 - RNA, 12 nt, Homo sapiens
acccauuugcca

SEQ ID NO: 1084623 - RNA, 14 nt, Homo sapiens
acccauuugccagg

SEQ ID NO: 1084624 - RNA, 14 nt, Homo sapiens
accccacauaugca

SEQ ID NO: 1084625 - RNA, 17 nt, Homo sapiens
accccacauaugcaaug

SEQ ID NO: 1084626 - RNA, 17 nt, Homo sapiens
accccagcacagcuccu

SEQ ID NO: 1084627 - RNA, 19 nt, Homo sapiens
accccagcugaccugguac

SEQ ID NO: 1084628 - RNA, 23 nt, Homo sapiens
accccaggcagcucgagcaugcc

SEQ ID NO: 1084629 - RNA, 11 nt, Homo sapiens
accccaucucu

SEQ ID NO: 1084630 - RNA, 15 nt, Homo sapiens
accccaucucuacua

SEQ ID NO: 1084631 - RNA, 13 nt, Homo sapiens
acccccagcauua

SEQ ID NO: 1084632 - RNA, 14 nt, Homo sapiens
acccccagcauuac

SEQ ID NO: 1084633 - RNA, 19 nt, Homo sapiens
acccccaguaaaaucaaau

SEQ ID NO: 1084634 - RNA, 22 nt, Homo sapiens
accccucccagcugacaguccu

SEQ ID NO: 1084635 - RNA, 17 nt, Homo sapiens
acccuccaaacacuggg

SEQ ID NO: 1084636 - RNA, 19 nt, Homo sapiens
acccuguggggccugaugg

SEQ ID NO: 1084637 - RNA, 18 nt, Homo sapiens
acccuuccacguguaugc

SEQ ID NO: 1084638 - RNA, 16 nt, Homo sapiens
acccuucuccuuagaa

SEQ ID NO: 1084639 - RNA, 23 nt, Homo sapiens
acccuucuccuuagaaguggaag

SEQ ID NO: 1084640 - RNA, 16 nt, Homo sapiens
acccuuggacuugagg

SEQ ID NO: 1084641 - RNA, 17 nt, Homo sapiens
accguugcacaaaaagg

SEQ ID NO: 1084642 - RNA, 17 nt, Homo sapiens
accuaugucccuucuca

SEQ ID NO: 1084643 - RNA, 13 nt, Homo sapiens
accucacuauuca

SEQ ID NO: 1084644 - RNA, 22 nt, Homo sapiens
accucccccaagcagagcuucc

SEQ ID NO: 1084645 - RNA, 16 nt, Homo sapiens
accuccuccuccaguu

SEQ ID NO: 1084646 - RNA, 21 nt, Homo sapiens
accucgagguuucucaaagaa

SEQ ID NO: 1084647 - RNA, 22 nt, Homo sapiens
accucggcucacugcagccucc

SEQ ID NO: 1084648 - RNA, 14 nt, Homo sapiens
accuggagcugcca

SEQ ID NO: 1084649 - RNA, 13 nt, Homo sapiens
accuucuaaucca

SEQ ID NO: 1084650 - RNA, 23 nt, Homo sapiens
accuucuaauccaugugcugcug

SEQ ID NO: 1084651 - RNA, 19 nt, Homo sapiens
accuugcauuucaaaaugg

SEQ ID NO: 1084652 - RNA, 14 nt, Homo sapiens
accuugcucugcca

SEQ ID NO: 1084653 - RNA, 18 nt, Homo sapiens
accuugucaaccucuucc

SEQ ID NO: 1084654 - RNA, 19 nt, Homo sapiens
accuuuuuuaugaugcuau

SEQ ID NO: 1084655 - RNA, 17 nt, Homo sapiens
acgaaucguacuucuuu

SEQ ID NO: 1084656 - RNA, 22 nt, Homo sapiens
acgacaaagccaaacucugcca

SEQ ID NO: 1084657 - RNA, 18 nt, Homo sapiens
acgauucuucacuucuug

SEQ ID NO: 1084658 - RNA, 15 nt, Homo sapiens
acgccacugcacucc

SEQ ID NO: 1084659 - RNA, 12 nt, Homo sapiens
acgccuccccaa

SEQ ID NO: 1084660 - RNA, 13 nt, Homo sapiens
acgccuccccaau

SEQ ID NO: 1084661 - RNA, 16 nt, Homo sapiens
agaacuugucccucag

SEQ ID NO: 1084662 - RNA, 18 nt, Homo sapiens
agaagggccugcucugcu

SEQ ID NO: 1084663 - RNA, 24 nt, Homo sapiens
agaaguaagcagaguucuuugcaa

SEQ ID NO: 1084664 - RNA, 18 nt, Homo sapiens
agaaguuugggcuaacau

SEQ ID NO: 1084665 - RNA, 17 nt, Homo sapiens
agaaucaacagugaaca

SEQ ID NO: 1084666 - RNA, 21 nt, Homo sapiens
agaaucacuugacuuugccac

SEQ ID NO: 1084667 - RNA, 12 nt, Homo sapiens
agaaugcaugua

SEQ ID NO: 1084668 - RNA, 14 nt, Homo sapiens
agacaaagcaaagc

SEQ ID NO: 1084669 - RNA, 14 nt, Homo sapiens
agacagcuggaccc

SEQ ID NO: 1084670 - RNA, 21 nt, Homo sapiens
agacagcuggacccauuugcc

SEQ ID NO: 1084671 - RNA, 20 nt, Homo sapiens
agacaguaugucuacuccuc

SEQ ID NO: 1084672 - RNA, 22 nt, Homo sapiens
agacaucagucuccaacauguu

SEQ ID NO: 1084673 - RNA, 12 nt, Homo sapiens
agacauuccaag

SEQ ID NO: 1084674 - RNA, 13 nt, Homo sapiens
agaccaguacugg

SEQ ID NO: 1084675 - RNA, 17 nt, Homo sapiens
agaccaguacugggaag

SEQ ID NO: 1084676 - RNA, 21 nt, Homo sapiens
agaccaugugguuugcuguua

SEQ ID NO: 1084677 - RNA, 17 nt, Homo sapiens
agaccauugucuuccaa

SEQ ID NO: 1084678 - RNA, 15 nt, Homo sapiens
agacccucaaugcca

SEQ ID NO: 1084679 - RNA, 22 nt, Homo sapiens
agaccucagagauggcuuccuu

SEQ ID NO: 1084680 - RNA, 19 nt, Homo sapiens
agacggguugaaagacauc

SEQ ID NO: 1084681 - RNA, 17 nt, Homo sapiens
agacuagauucucaccu

SEQ ID NO: 1084682 - RNA, 20 nt, Homo sapiens
agacuccuggcuucaugugg

SEQ ID NO: 1084683 - RNA, 18 nt, Homo sapiens
agacucuuccaccagagc

SEQ ID NO: 1084684 - RNA, 14 nt, Homo sapiens
agacugaaagaaua

SEQ ID NO: 1084685 - RNA, 20 nt, Homo sapiens
agacuucaauauuaaaugac

SEQ ID NO: 1084686 - RNA, 13 nt, Homo sapiens
agagaaaacuuau

SEQ ID NO: 1084687 - RNA, 14 nt, Homo sapiens
agagagauggaaua

SEQ ID NO: 1084688 - RNA, 22 nt, Homo sapiens
agagagauggaauaaagcccuu

SEQ ID NO: 1084689 - RNA, 17 nt, Homo sapiens
agagaguuaagugaaug

SEQ ID NO: 1084690 - RNA, 21 nt, Homo sapiens
agagaucuuucuuuccaaaac

SEQ ID NO: 1084691 - RNA, 16 nt, Homo sapiens
agagaugggauuucac

SEQ ID NO: 1084692 - RNA, 14 nt, Homo sapiens
agagccuccuccag

SEQ ID NO: 1084693 - RNA, 18 nt, Homo sapiens
agagcgaggaaaggauuu

SEQ ID NO: 1084694 - RNA, 14 nt, Homo sapiens
agagcuauggugag

SEQ ID NO: 1084695 - RNA, 20 nt, Homo sapiens
agagcuccugucccuaccca

SEQ ID NO: 1084696 - RNA, 17 nt, Homo sapiens
agagcucucucuucucu

SEQ ID NO: 1084697 - RNA, 15 nt, Homo sapiens
agagcugaguggcag

SEQ ID NO: 1084698 - RNA, 15 nt, Homo sapiens
agagcuggugccaga

SEQ ID NO: 1084699 - RNA, 16 nt, Homo sapiens
agaggcaacugcccag

SEQ ID NO: 1084700 - RNA, 13 nt, Homo sapiens
agaggcaccugcu

SEQ ID NO: 1084701 - RNA, 20 nt, Homo sapiens
agaggggaaaccaguguagc

SEQ ID NO: 1084702 - RNA, 19 nt, Homo sapiens
agaguaaauagcauucucu

SEQ ID NO: 1084703 - RNA, 22 nt, Homo sapiens
agagugcaguggcgugaucucg

SEQ ID NO: 1084704 - RNA, 18 nt, Homo sapiens
agaguggcauuggcagca

SEQ ID NO: 1084705 - RNA, 19 nt, Homo sapiens
agaguuaagugaaugucua

SEQ ID NO: 1084706 - RNA, 15 nt, Homo sapiens
agaguucugcucuag

SEQ ID NO: 1084707 - RNA, 15 nt, Homo sapiens
agauagacggguuga

SEQ ID NO: 1084708 - RNA, 16 nt, Homo sapiens
agauagugccucugca

SEQ ID NO: 1084709 - RNA, 17 nt, Homo sapiens
agauauuauucauucau

SEQ ID NO: 1084710 - RNA, 20 nt, Homo sapiens
agauccaaaugcugugcaaa

SEQ ID NO: 1084711 - RNA, 19 nt, Homo sapiens
agaucgcgccaaugcacuc

SEQ ID NO: 1084712 - RNA, 21 nt, Homo sapiens
agaugaaacagggcaccccag

SEQ ID NO: 1084713 - RNA, 18 nt, Homo sapiens
agaugaaaccgucccuga

SEQ ID NO: 1084714 - RNA, 18 nt, Homo sapiens
agaugacagugaugcugc

SEQ ID NO: 1084715 - RNA, 17 nt, Homo sapiens
agaugucaucaagcucc

SEQ ID NO: 1084716 - RNA, 23 nt, Homo sapiens
agauuauauaucauaaaguaugc

SEQ ID NO: 1084717 - RNA, 22 nt, Homo sapiens
agauuguucuguccaguuucca

SEQ ID NO: 1084718 - RNA, 14 nt, Homo sapiens
agcaacaccaaaaa

SEQ ID NO: 1084719 - RNA, 20 nt, Homo sapiens
agcaauuagauuaguauuuu

SEQ ID NO: 1084720 - RNA, 19 nt, Homo sapiens
agcaauuauugugccucag

SEQ ID NO: 1084721 - RNA, 15 nt, Homo sapiens
agcacauuuugacac

SEQ ID NO: 1084722 - RNA, 13 nt, Homo sapiens
agcacucagguag

SEQ ID NO: 1084723 - RNA, 14 nt, Homo sapiens
agcagcaacugugu

SEQ ID NO: 1084724 - RNA, 20 nt, Homo sapiens
agcaguaaacuuucucugca

SEQ ID NO: 1084725 - RNA, 13 nt, Homo sapiens
agcaucaauacaa

SEQ ID NO: 1084726 - RNA, 14 nt, Homo sapiens
agcaucaccucagg

SEQ ID NO: 1084727 - RNA, 20 nt, Homo sapiens
agcaucucagaguccaguca

SEQ ID NO: 1084728 - RNA, 20 nt, Homo sapiens
agcaugggacugugccuuug

SEQ ID NO: 1084729 - RNA, 16 nt, Homo sapiens
aguuuaucaugucagu

SEQ ID NO: 1084730 - RNA, 16 nt, Homo sapiens
aguuucuaaccaaaga

SEQ ID NO: 1084731 - RNA, 22 nt, Homo sapiens
aguuucuuuuauuuucauuucu

SEQ ID NO: 1084732 - RNA, 22 nt, Homo sapiens
aguuuuguuuguucacacuccu

SEQ ID NO: 1084733 - RNA, 14 nt, Homo sapiens
aguuuuuccuaguc

SEQ ID NO: 1084734 - RNA, 14 nt, Homo sapiens
auaaaauugcacuu

SEQ ID NO: 1084735 - RNA, 16 nt, Homo sapiens
auaaagaaauaauacc

SEQ ID NO: 1084736 - RNA, 14 nt, Homo sapiens
auaacuuauuugcc

SEQ ID NO: 1084737 - RNA, 16 nt, Homo sapiens
auaagauauuguacau

SEQ ID NO: 1084738 - RNA, 14 nt, Homo sapiens
auaauauaagccau

SEQ ID NO: 1084739 - RNA, 14 nt, Homo sapiens
auaaugaacacgug

SEQ ID NO: 1084740 - RNA, 17 nt, Homo sapiens
auaauguuuauaaguca

SEQ ID NO: 1084741 - RNA, 18 nt, Homo sapiens
auacaacagaaaccagaa

SEQ ID NO: 1084742 - RNA, 14 nt, Homo sapiens
auacaacugagucu

SEQ ID NO: 1084743 - RNA, 13 nt, Homo sapiens
auacagugauaug

SEQ ID NO: 1084744 - RNA, 21 nt, Homo sapiens
auacauguugggcaugauucu

SEQ ID NO: 1084745 - RNA, 14 nt, Homo sapiens
auacauuauauucc

SEQ ID NO: 1084746 - RNA, 17 nt, Homo sapiens
auaccuuuagauuucag

SEQ ID NO: 1084747 - RNA, 17 nt, Homo sapiens
auacgauccugcagggu

SEQ ID NO: 1084748 - RNA, 13 nt, Homo sapiens
auacuguuuccau

SEQ ID NO: 1084749 - RNA, 13 nt, Homo sapiens
auaggagccacaa

SEQ ID NO: 1084750 - RNA, 12 nt, Homo sapiens
auagguuuccac

SEQ ID NO: 1084751 - RNA, 14 nt, Homo sapiens
auagucaaucaaac

SEQ ID NO: 1084752 - RNA, 17 nt, Homo sapiens
auagugcacuagcauuu

SEQ ID NO: 1084753 - RNA, 18 nt, Homo sapiens
auagugcuucuuguaaua

SEQ ID NO: 1084754 - RNA, 14 nt, Homo sapiens
auaguguguccaug

SEQ ID NO: 1084755 - RNA, 21 nt, Homo sapiens
auauauauguauauacauauc

SEQ ID NO: 1084756 - RNA, 15 nt, Homo sapiens
auaugcagugauaua

SEQ ID NO: 1084757 - RNA, 18 nt, Homo sapiens
auauguauauacauauca

SEQ ID NO: 1084758 - RNA, 20 nt, Homo sapiens
auauuccucuaaaacucuca

SEQ ID NO: 1084759 - RNA, 15 nt, Homo sapiens
auauugaccauguga

SEQ ID NO: 1084760 - RNA, 23 nt, Homo sapiens
auauugcucuuaaaaaucuuggu

SEQ ID NO: 1084761 - RNA, 19 nt, Homo sapiens
auauuuccuucaccaccuc

SEQ ID NO: 1084762 - RNA, 14 nt, Homo sapiens
aucaagggcuuuau

SEQ ID NO: 1084763 - RNA, 14 nt, Homo sapiens
aucaagucagcaac

SEQ ID NO: 1084764 - RNA, 15 nt, Homo sapiens
aucaaugucaaguac

SEQ ID NO: 1084765 - RNA, 16 nt, Homo sapiens
aucaccuugcauuuca

SEQ ID NO: 1084766 - RNA, 21 nt, Homo sapiens
aucacgccacugcacuccagc

SEQ ID NO: 1084767 - RNA, 17 nt, Homo sapiens
aucacuagccaugauaa

SEQ ID NO: 1084768 - RNA, 18 nt, Homo sapiens
aucagagcguuuguuccc

SEQ ID NO: 1084769 - RNA, 15 nt, Homo sapiens
aucaggucauuauuu

SEQ ID NO: 1084770 - RNA, 22 nt, Homo sapiens
aucaggucauuauuuuuuacaa

SEQ ID NO: 1084771 - RNA, 21 nt, Homo sapiens
aucauaaccacccuagcuuua

SEQ ID NO: 1084772 - RNA, 18 nt, Homo sapiens
aucauccgaggcaaagag

SEQ ID NO: 1084773 - RNA, 23 nt, Homo sapiens
aucaucuuugcugaaugucauua

SEQ ID NO: 1084774 - RNA, 19 nt, Homo sapiens
aucauguuaccauuacaaa

SEQ ID NO: 1084775 - RNA, 17 nt, Homo sapiens
auccaaaugcugugcaa

SEQ ID NO: 1084776 - RNA, 21 nt, Homo sapiens
auccaacuccucuagucagca

SEQ ID NO: 1084777 - RNA, 17 nt, Homo sapiens
auccaauggauugugca

SEQ ID NO: 1084778 - RNA, 14 nt, Homo sapiens
auccacaagccauu

SEQ ID NO: 1084779 - RNA, 22 nt, Homo sapiens
auccaggcccggugaggccaag

SEQ ID NO: 1084780 - RNA, 22 nt, Homo sapiens
auccauagugcacuagcauuuu

SEQ ID NO: 1084781 - RNA, 10 nt, Homo sapiens
aucccacuga

SEQ ID NO: 1084782 - RNA, 12 nt, Homo sapiens
aucccagcacuu

SEQ ID NO: 1084783 - RNA, 21 nt, Homo sapiens
ucauuagggcaaagaucucag

SEQ ID NO: 1084784 - RNA, 23 nt, Homo sapiens
ucauuagggcaaagaucucagca

SEQ ID NO: 1084785 - RNA, 22 nt, Homo sapiens
ucauuauuuuuguuagcaaaga

SEQ ID NO: 1084786 - RNA, 22 nt, Homo sapiens
ucauuauuuuuuacaauggcca

SEQ ID NO: 1084787 - RNA, 22 nt, Homo sapiens
ucauugaagacccucaaugcca

SEQ ID NO: 1084788 - RNA, 12 nt, Homo sapiens
uccaaaagcaaa

SEQ ID NO: 1084789 - RNA, 13 nt, Homo sapiens
uccaaacacuggg

SEQ ID NO: 1084790 - RNA, 22 nt, Homo sapiens
uccaaacacugggcucugagga

SEQ ID NO: 1084791 - RNA, 21 nt, Homo sapiens
uccaaaguuuuaaaccuguua

SEQ ID NO: 1084792 - RNA, 16 nt, Homo sapiens
uccaaccgaccagcuu

SEQ ID NO: 1084793 - RNA, 16 nt, Homo sapiens
uccaagucaacacucu

SEQ ID NO: 1084794 - RNA, 13 nt, Homo sapiens
uccaagugccaau

SEQ ID NO: 1084795 - RNA, 22 nt, Homo sapiens
uccacaaccuccuccuccaguu

SEQ ID NO: 1084796 - RNA, 17 nt, Homo sapiens
uccacaccugggcauuu

SEQ ID NO: 1084797 - RNA, 14 nt, Homo sapiens
uccaccaccaccug

SEQ ID NO: 1084798 - RNA, 15 nt, Homo sapiens
uccaccuuguuacac

SEQ ID NO: 1084799 - RNA, 20 nt, Homo sapiens
uccaccuuguuacacauuau

SEQ ID NO: 1084800 - RNA, 21 nt, Homo sapiens
uccagaaauguuuuuggcaac

SEQ ID NO: 1084801 - RNA, 20 nt, Homo sapiens
uccagcaagcagugcccucu

SEQ ID NO: 1084802 - RNA, 17 nt, Homo sapiens
uccagccacuuauuucc

SEQ ID NO: 1084803 - RNA, 22 nt, Homo sapiens
uccagccacuuauuuccaugga

SEQ ID NO: 1084804 - RNA, 19 nt, Homo sapiens
uccaggaauaggcauuugc

SEQ ID NO: 1084805 - RNA, 23 nt, Homo sapiens
uccaggacuggggcuugccaggc

SEQ ID NO: 1084806 - RNA, 19 nt, Homo sapiens
uccaggcuccucaugaggc

SEQ ID NO: 1084807 - RNA, 15 nt, Homo sapiens
uccaguuaaguaaua

SEQ ID NO: 1084808 - RNA, 23 nt, Homo sapiens
uccauaaaguaauuuugugaaag

SEQ ID NO: 1084809 - RNA, 18 nt, Homo sapiens
uccauagugcacuagcau

SEQ ID NO: 1084810 - RNA, 22 nt, Homo sapiens
uccauccuccucuccaugcaag

SEQ ID NO: 1084811 - RNA, 14 nt, Homo sapiens
uccaugauacuuua

SEQ ID NO: 1084812 - RNA, 22 nt, Homo sapiens
uccauuuuacuuccaugauacu

SEQ ID NO: 1084813 - RNA, 23 nt, Homo sapiens
uccauuuuacuuccaugauacuu

SEQ ID NO: 1084814 - RNA, 16 nt, Homo sapiens
ucccaaaggcuuucuu

SEQ ID NO: 1084815 - RNA, 20 nt, Homo sapiens
ucccaaagugcugggauuac

SEQ ID NO: 1084816 - RNA, 21 nt, Homo sapiens
ucccacggggaccacugggcc

SEQ ID NO: 1084817 - RNA, 19 nt, Homo sapiens
ucccacgugcacagcuucc

SEQ ID NO: 1084818 - RNA, 20 nt, Homo sapiens
ucccagagagacgcugugau

SEQ ID NO: 1084819 - RNA, 18 nt, Homo sapiens
ucccagaggcuagucucu

SEQ ID NO: 1084820 - RNA, 16 nt, Homo sapiens
ucccagugagccucug

SEQ ID NO: 1084821 - RNA, 11 nt, Homo sapiens
ucccagugucu

SEQ ID NO: 1084822 - RNA, 22 nt, Homo sapiens
ucccaugggcgaccagggccau

SEQ ID NO: 1084823 - RNA, 21 nt, Homo sapiens
ucccaugguagacugugacac

SEQ ID NO: 1084824 - RNA, 18 nt, Homo sapiens
uccccaaacccacccaua

SEQ ID NO: 1084825 - RNA, 17 nt, Homo sapiens
ucccccagccucaaguc

SEQ ID NO: 1084826 - RNA, 13 nt, Homo sapiens
ucccccuuucucc

SEQ ID NO: 1084827 - RNA, 11 nt, Homo sapiens
uccccucacag

SEQ ID NO: 1084828 - RNA, 14 nt, Homo sapiens
uccccuccaaguga

SEQ ID NO: 1084829 - RNA, 23 nt, Homo sapiens
uccccuggggucucugcugcauu

SEQ ID NO: 1084830 - RNA, 20 nt, Homo sapiens
ucccgaggaugcugucagga

SEQ ID NO: 1084831 - RNA, 23 nt, Homo sapiens
ucccgauaucaaaaagacugugg

SEQ ID NO: 1084832 - RNA, 21 nt, Homo sapiens
ucccucaggcuuguugcccuc

SEQ ID NO: 1084833 - RNA, 20 nt, Homo sapiens
ucccugcuggcuuucuuuuc

SEQ ID NO: 1084834 - RNA, 16 nt, Homo sapiens
ucccuguucuuugaag

SEQ ID NO: 1084835 - RNA, 19 nt, Homo sapiens
ucccuuuuuuuacauuuca

SEQ ID NO: 1084836 - RNA, 20 nt, Homo sapiens
uccgccauuccaagucaaca

SEQ ID NO: 1084837 - RNA, 20 nt, Homo sapiens
uccuaacaaguagcacccug

SEQ ID NO: 1084838 - RNA, 21 nt, Homo sapiens
uccuacacccuuggacuugag

SEQ ID NO: 1084839 - RNA, 15 nt, Homo sapiens
uccuaggaguacaag

SEQ ID NO: 1084840 - RNA, 19 nt, Homo sapiens
uccuaggccacaccaucuc

SEQ ID NO: 1084841 - RNA, 13 nt, Homo sapiens
uccucacacucca

SEQ ID NO: 1084842 - RNA, 16 nt, Homo sapiens
uccucaguuuuuccua

SEQ ID NO: 1084843 - RNA, 13 nt, Homo sapiens
uccuccacuccac

SEQ ID NO: 1084844 - RNA, 18 nt, Homo sapiens
uccuccacuccaccucca

SEQ ID NO: 1084845 - RNA, 14 nt, Homo sapiens
uccuccccaccaga

SEQ ID NO: 1084846 - RNA, 19 nt, Homo sapiens
uccucgcacugcccaggga

SEQ ID NO: 1084847 - RNA, 15 nt, Homo sapiens
uccugaacuggccac

SEQ ID NO: 1084848 - RNA, 17 nt, Homo sapiens
uccugaguagcagugau

SEQ ID NO: 1084849 - RNA, 22 nt, Homo sapiens
uccugcaaacccauuuccagcu

SEQ ID NO: 1084850 - RNA, 18 nt, Homo sapiens
uccuggaccugaaggcau

SEQ ID NO: 1084851 - RNA, 17 nt, Homo sapiens
uccuggccucauacaga

SEQ ID NO: 1084852 - RNA, 20 nt, Homo sapiens
uccugggagaaccucaggcu

SEQ ID NO: 1084853 - RNA, 17 nt, Homo sapiens
uccuuaccauugugauu

SEQ ID NO: 1084854 - RNA, 21 nt, Homo sapiens
uccuugucguaggaaaaccau

SEQ ID NO: 1084855 - RNA, 17 nt, Homo sapiens
uccuuuguugcuguugc

SEQ ID NO: 1084856 - RNA, 17 nt, Homo sapiens
uccuuuugguuccucac

SEQ ID NO: 1084857 - RNA, 19 nt, Homo sapiens
ucgagacuuggguguuugu

SEQ ID NO: 1084858 - RNA, 22 nt, Homo sapiens
ucgagcaugcccugagcucucu

SEQ ID NO: 1084859 - RNA, 23 nt, Homo sapiens
ucgccucucccaccccaugcauu

SEQ ID NO: 1084860 - RNA, 17 nt, Homo sapiens
ucggcucuggccuccaa

SEQ ID NO: 1084861 - RNA, 19 nt, Homo sapiens
ucggggaaugacacacugc

SEQ ID NO: 1084862 - RNA, 21 nt, Homo sapiens
ucguccaaggcaguucugugu

SEQ ID NO: 1084863 - RNA, 21 nt, Homo sapiens
ucguggguguguguagccaag

SEQ ID NO: 1084864 - RNA, 12 nt, Homo sapiens
ucguuuugacua

SEQ ID NO: 1084865 - RNA, 14 nt, Homo sapiens
ucuaaaacucucaa

SEQ ID NO: 1084866 - RNA, 15 nt, Homo sapiens
ucuaagugugcugca

SEQ ID NO: 1084867 - RNA, 14 nt, Homo sapiens
ucuaauccaugugc

SEQ ID NO: 1084868 - RNA, 21 nt, Homo sapiens
ucuaauccaugugcugcugug

SEQ ID NO: 1084869 - RNA, 20 nt, Homo sapiens
ucuacugucucaguuuacau

SEQ ID NO: 1084870 - RNA, 13 nt, Homo sapiens
ucuauaaacauga

SEQ ID NO: 1084871 - RNA, 12 nt, Homo sapiens
ucuaugacucac

SEQ ID NO: 1084872 - RNA, 20 nt, Homo sapiens
ucucaaauggacaauaccag

SEQ ID NO: 1084873 - RNA, 22 nt, Homo sapiens
aacuacacacccccaagccaca

SEQ ID NO: 1084874 - RNA, 12 nt, Homo sapiens
aacuacauguaa

SEQ ID NO: 1084875 - RNA, 16 nt, Homo sapiens
aacuacauguaaucca

SEQ ID NO: 1084876 - RNA, 16 nt, Homo sapiens
aacuaccagugggcau

SEQ ID NO: 1084877 - RNA, 21 nt, Homo sapiens
aacuacucagcucuccugcug

SEQ ID NO: 1084878 - RNA, 19 nt, Homo sapiens
aacuagcuaaaaccaaagg

SEQ ID NO: 1084879 - RNA, 16 nt, Homo sapiens
aacuauguaaugcuua

SEQ ID NO: 1084880 - RNA, 19 nt, Homo sapiens
aacucccuccucacacucc

SEQ ID NO: 1084881 - RNA, 21 nt, Homo sapiens
aacucccuccucacacuccag

SEQ ID NO: 1084882 - RNA, 14 nt, Homo sapiens
aacugaguacaauu

SEQ ID NO: 1084883 - RNA, 15 nt, Homo sapiens
aacugaugauuucac

SEQ ID NO: 1084884 - RNA, 15 nt, Homo sapiens
aacugccccaucucc

SEQ ID NO: 1084885 - RNA, 13 nt, Homo sapiens
aacugcgugccag

SEQ ID NO: 1084886 - RNA, 13 nt, Homo sapiens
aacuguauuugau

SEQ ID NO: 1084887 - RNA, 17 nt, Homo sapiens
aacuucagcaccaugga

SEQ ID NO: 1084888 - RNA, 20 nt, Homo sapiens
aacuugauucuugugauuga

SEQ ID NO: 1084889 - RNA, 15 nt, Homo sapiens
aagaaccaguguuua

SEQ ID NO: 1084890 - RNA, 21 nt, Homo sapiens
aagaaccccagaccucugaau

SEQ ID NO: 1084891 - RNA, 16 nt, Homo sapiens
aagaacuugucccuca

SEQ ID NO: 1084892 - RNA, 16 nt, Homo sapiens
aauuagaaauaucuuc

SEQ ID NO: 1084893 - RNA, 17 nt, Homo sapiens
aauuauguuuucaucca

SEQ ID NO: 1084894 - RNA, 19 nt, Homo sapiens
aauuauugugccucagccu

SEQ ID NO: 1084895 - RNA, 16 nt, Homo sapiens
aauucauuguguauga

SEQ ID NO: 1084896 - RNA, 15 nt, Homo sapiens
aauuccaugcacucu

SEQ ID NO: 1084897 - RNA, 12 nt, Homo sapiens
aauuccuagcug

SEQ ID NO: 1084898 - RNA, 21 nt, Homo sapiens
aauucuccugccucagccucc

SEQ ID NO: 1084899 - RNA, 21 nt, Homo sapiens
aauucucuuuaguucugucag

SEQ ID NO: 1084900 - RNA, 13 nt, Homo sapiens
aauugauuauucu

SEQ ID NO: 1084901 - RNA, 23 nt, Homo sapiens
aauugccuuaaggccacacuggc

SEQ ID NO: 1084902 - RNA, 15 nt, Homo sapiens
aauuuucccacugca

SEQ ID NO: 1084903 - RNA, 18 nt, Homo sapiens
acaaauaaguuacccuca

SEQ ID NO: 1084904 - RNA, 20 nt, Homo sapiens
acaaauuagcaaucauuuua

SEQ ID NO: 1084905 - RNA, 15 nt, Homo sapiens
acaacaaacacugug

SEQ ID NO: 1084906 - RNA, 17 nt, Homo sapiens
acaacaaacacugugau

SEQ ID NO: 1084907 - RNA, 14 nt, Homo sapiens
acaacaucgcaaua

SEQ ID NO: 1084908 - RNA, 13 nt, Homo sapiens
acaacaugaaaua

SEQ ID NO: 1084909 - RNA, 20 nt, Homo sapiens
acaagccaacgacaaagcca

SEQ ID NO: 1084910 - RNA, 23 nt, Homo sapiens
acucccagcgcuggcuccaggcu

SEQ ID NO: 1084911 - RNA, 16 nt, Homo sapiens
acucccucucuugccg

SEQ ID NO: 1084912 - RNA, 15 nt, Homo sapiens
acuccucacagcauc

SEQ ID NO: 1084913 - RNA, 14 nt, Homo sapiens
acuccuggcuucau

SEQ ID NO: 1084914 - RNA, 18 nt, Homo sapiens
acucucugugaccugccc

SEQ ID NO: 1084915 - RNA, 19 nt, Homo sapiens
acucucuugccagcauuuu

SEQ ID NO: 1084916 - RNA, 23 nt, Homo sapiens
acucugaggcucuuucugggcca

SEQ ID NO: 1084917 - RNA, 20 nt, Homo sapiens
acucuggaccucucuuguga

SEQ ID NO: 1084918 - RNA, 13 nt, Homo sapiens
acucuuugcuaca

SEQ ID NO: 1084919 - RNA, 13 nt, Homo sapiens
acugaagaccucc

SEQ ID NO: 1084920 - RNA, 16 nt, Homo sapiens
acugaauuuugucuuu

SEQ ID NO: 1084921 - RNA, 18 nt, Homo sapiens
acugaccgccgcuuccag

SEQ ID NO: 1084922 - RNA, 16 nt, Homo sapiens
acugcaagcucugccu

SEQ ID NO: 1084923 - RNA, 15 nt, Homo sapiens
acugccgaugcccaa

SEQ ID NO: 1084924 - RNA, 19 nt, Homo sapiens
acugcgagguuguuuuaaa

SEQ ID NO: 1084925 - RNA, 21 nt, Homo sapiens
acugcgugccaguguccccac

SEQ ID NO: 1084926 - RNA, 12 nt, Homo sapiens
aucaagucagca

SEQ ID NO: 1084927 - RNA, 14 nt, Homo sapiens
aucaagucugugaa

SEQ ID NO: 1084928 - RNA, 16 nt, Homo sapiens
aucaauacaaccagcc

SEQ ID NO: 1084929 - RNA, 15 nt, Homo sapiens
aucaaugaaggauuu

SEQ ID NO: 1084930 - RNA, 17 nt, Homo sapiens
aucacuugacuuugcca

SEQ ID NO: 1084931 - RNA, 12 nt, Homo sapiens
aucagucuuaau

SEQ ID NO: 1084932 - RNA, 13 nt, Homo sapiens
aucaucagucuua

SEQ ID NO: 1084933 - RNA, 19 nt, Homo sapiens
auccaaaugcugugcaaac

SEQ ID NO: 1084934 - RNA, 14 nt, Homo sapiens
auccaugugcugcu

SEQ ID NO: 1084935 - RNA, 18 nt, Homo sapiens
aucccaagugucucuuga

SEQ ID NO: 1084936 - RNA, 16 nt, Homo sapiens
aucccagcaucucaga

SEQ ID NO: 1084937 - RNA, 20 nt, Homo sapiens
aucccagcaucucagagucc

SEQ ID NO: 1084938 - RNA, 22 nt, Homo sapiens
aucccaggcgggcggcacgcca

SEQ ID NO: 1084939 - RNA, 19 nt, Homo sapiens
aucccuuuuuuuacauuuc

SEQ ID NO: 1084940 - RNA, 20 nt, Homo sapiens
aucccuuuuuuuacauuuca

SEQ ID NO: 1084941 - RNA, 23 nt, Homo sapiens
auccucaauucaauguggugaug

SEQ ID NO: 1084942 - RNA, 21 nt, Homo sapiens
auccucagguaguacugggaa

SEQ ID NO: 1084943 - RNA, 12 nt, Homo sapiens
auccuggcccau

SEQ ID NO: 1084944 - RNA, 17 nt, Homo sapiens
aucuacccagucaugua

SEQ ID NO: 1084945 - RNA, 14 nt, Homo sapiens
aucuaguucucaau

SEQ ID NO: 1084946 - RNA, 12 nt, Homo sapiens
aucuauaucucu

SEQ ID NO: 1084947 - RNA, 23 nt, Homo sapiens
aucucagcagccagcuccuggua

SEQ ID NO: 1084948 - RNA, 20 nt, Homo sapiens
aucucuaaacugcuguuaau

SEQ ID NO: 1084949 - RNA, 20 nt, Homo sapiens
aucugcaauguuuuugugua

SEQ ID NO: 1084950 - RNA, 22 nt, Homo sapiens
aucugcagggagcaacucucca

SEQ ID NO: 1084951 - RNA, 16 nt, Homo sapiens
aucugcuccuagccca

SEQ ID NO: 1084952 - RNA, 21 nt, Homo sapiens
aucugucaaagaaaacuucca

SEQ ID NO: 1084953 - RNA, 16 nt, Homo sapiens
aucuguuuuucaugua

SEQ ID NO: 1084954 - RNA, 14 nt, Homo sapiens
aucuuaaaugccag

SEQ ID NO: 1084955 - RNA, 19 nt, Homo sapiens
aucuuacagucagcacaga

SEQ ID NO: 1084956 - RNA, 21 nt, Homo sapiens
aucuuaggauuuaccaaauag

SEQ ID NO: 1084957 - RNA, 13 nt, Homo sapiens
aucuuccauuccu

SEQ ID NO: 1084958 - RNA, 17 nt, Homo sapiens
aucuucccacuuugcca

SEQ ID NO: 1084959 - RNA, 18 nt, Homo sapiens
aucuuguggcauauccau

SEQ ID NO: 1084960 - RNA, 12 nt, Homo sapiens
augaaaagccau

SEQ ID NO: 1084961 - RNA, 12 nt, Homo sapiens
augaaacagggc

SEQ ID NO: 1084962 - RNA, 20 nt, Homo sapiens
augaaacagggcaccccagc

SEQ ID NO: 1084963 - RNA, 17 nt, Homo sapiens
augaaagaggcauuccc

SEQ ID NO: 1084964 - RNA, 13 nt, Homo sapiens
augaaauacucuu

SEQ ID NO: 1084965 - RNA, 20 nt, Homo sapiens
augaacccauccaauggauu

SEQ ID NO: 1084966 - RNA, 21 nt, Homo sapiens
augaccuccguguagugucug

SEQ ID NO: 1084967 - RNA, 22 nt, Homo sapiens
augacggcugcucgaagaacaa

SEQ ID NO: 1084968 - RNA, 21 nt, Homo sapiens
augacucaccuugcucugcca

SEQ ID NO: 1084969 - RNA, 18 nt, Homo sapiens
augagaaaaugucuuuau

SEQ ID NO: 1084970 - RNA, 14 nt, Homo sapiens
augagaaguacuuu

SEQ ID NO: 1084971 - RNA, 16 nt, Homo sapiens
augagaaguacuuugu

SEQ ID NO: 1084972 - RNA, 18 nt, Homo sapiens
augagcaaggacaaccug

SEQ ID NO: 1084973 - RNA, 22 nt, Homo sapiens
augagcaauucuccugccucag

SEQ ID NO: 1084974 - RNA, 20 nt, Homo sapiens
augagcauuagcuacuuuuc

SEQ ID NO: 1084975 - RNA, 22 nt, Homo sapiens
augagcuguggacuagcaauau

SEQ ID NO: 1084976 - RNA, 18 nt, Homo sapiens
augauuuagggaagcagg

SEQ ID NO: 1084977 - RNA, 18 nt, Homo sapiens
augauuuuuguguaucca

SEQ ID NO: 1084978 - RNA, 19 nt, Homo sapiens
augcaagacuucacugcag

SEQ ID NO: 1084979 - RNA, 20 nt, Homo sapiens
augcaaggggaaaccuguga

SEQ ID NO: 1084980 - RNA, 20 nt, Homo sapiens
augcacauuggaagcuccca

SEQ ID NO: 1084981 - RNA, 19 nt, Homo sapiens
augcauucccggugcagaa

SEQ ID NO: 1084982 - RNA, 15 nt, Homo sapiens
augcccuaccugccu

SEQ ID NO: 1084983 - RNA, 22 nt, Homo sapiens
augcuguuguuguuacuucccu

SEQ ID NO: 1084984 - RNA, 17 nt, Homo sapiens
augcuuauguguugcau

SEQ ID NO: 1084985 - RNA, 22 nt, Homo sapiens
augcuugugauuuuugaacaau

SEQ ID NO: 1084986 - RNA, 15 nt, Homo sapiens
auggaauaaagcccu

SEQ ID NO: 1084987 - RNA, 22 nt, Homo sapiens
auggacucuucccccacuccuc

SEQ ID NO: 1084988 - RNA, 21 nt, Homo sapiens
auggagauauuuacaugaauu

SEQ ID NO: 1084989 - RNA, 18 nt, Homo sapiens
auggagucucgcucugcu

SEQ ID NO: 1084990 - RNA, 16 nt, Homo sapiens
auggaguguuugacga

SEQ ID NO: 1084991 - RNA, 13 nt, Homo sapiens
auggaguuucccu

SEQ ID NO: 1084992 - RNA, 18 nt, Homo sapiens
auggccagugugauccca

SEQ ID NO: 1084993 - RNA, 15 nt, Homo sapiens
auggcccagccacug

SEQ ID NO: 1084994 - RNA, 20 nt, Homo sapiens
auggggguggggaggcaaga

SEQ ID NO: 1084995 - RNA, 18 nt, Homo sapiens
augguaccuccuaggagu

SEQ ID NO: 1084996 - RNA, 20 nt, Homo sapiens
auggugcucacgacucuucc

SEQ ID NO: 1084997 - RNA, 20 nt, Homo sapiens
auguaaugaucauaagucua

SEQ ID NO: 1084998 - RNA, 17 nt, Homo sapiens
auguacaagguauguac

SEQ ID NO: 1084999 - RNA, 16 nt, Homo sapiens
auguauaauaugcaau

SEQ ID NO: 1085000 - RNA, 22 nt, Homo sapiens
auguauaucuauaucucuaaac

SEQ ID NO: 1085001 - RNA, 17 nt, Homo sapiens
auguauauguauaucua

SEQ ID NO: 1085002 - RNA, 14 nt, Homo sapiens
augucagacuggcu

SEQ ID NO: 1085003 - RNA, 18 nt, Homo sapiens
augucagguacauaacau

SEQ ID NO: 1085004 - RNA, 18 nt, Homo sapiens
augucccuucucaugccu

SEQ ID NO: 1085005 - RNA, 22 nt, Homo sapiens
auguccuucuuuaucugugaua

SEQ ID NO: 1085006 - RNA, 18 nt, Homo sapiens
augugagauuacuuuguc

SEQ ID NO: 1085007 - RNA, 15 nt, Homo sapiens
auguggauacaguca

SEQ ID NO: 1085008 - RNA, 16 nt, Homo sapiens
auguggauacagucau

SEQ ID NO: 1085009 - RNA, 23 nt, Homo sapiens
auguggcauucucucugcucagu

SEQ ID NO: 1085010 - RNA, 18 nt, Homo sapiens
auguggguugugauauug

SEQ ID NO: 1085011 - RNA, 19 nt, Homo sapiens
auguuccaauaaaacuuua

SEQ ID NO: 1085012 - RNA, 23 nt, Homo sapiens
auguuuuuguguagaguggcgau

SEQ ID NO: 1085013 - RNA, 15 nt, Homo sapiens
auuaaaagaguagaa

SEQ ID NO: 1085014 - RNA, 23 nt, Homo sapiens
auuaaguggcuuuuuaacaugaa

SEQ ID NO: 1085015 - RNA, 18 nt, Homo sapiens
auuacaggcgcacaccac

SEQ ID NO: 1085016 - RNA, 16 nt, Homo sapiens
auuacauggcuguggu

SEQ ID NO: 1085017 - RNA, 17 nt, Homo sapiens
auuacauggcugugguu

SEQ ID NO: 1085018 - RNA, 18 nt, Homo sapiens
auuaccacuucccugcuu

SEQ ID NO: 1085019 - RNA, 13 nt, Homo sapiens
auuagaaugcaug

SEQ ID NO: 1085020 - RNA, 17 nt, Homo sapiens
auuaucuauacauaaaa

SEQ ID NO: 1085021 - RNA, 21 nt, Homo sapiens
auuauucugauuccacuuuua

SEQ ID NO: 1085022 - RNA, 20 nt, Homo sapiens
auucacucccacacccaaga

SEQ ID NO: 1085023 - RNA, 18 nt, Homo sapiens
auucagcaaaaaucuccc

SEQ ID NO: 1085024 - RNA, 22 nt, Homo sapiens
auucagcaaaaaucucccagug

SEQ ID NO: 1085025 - RNA, 13 nt, Homo sapiens
auuccacuggacu

SEQ ID NO: 1085026 - RNA, 20 nt, Homo sapiens
auuccagguguguucaguag

SEQ ID NO: 1085027 - RNA, 16 nt, Homo sapiens
auuccagucucugcau

SEQ ID NO: 1085028 - RNA, 20 nt, Homo sapiens
auuccauuuuacuuccauga

SEQ ID NO: 1085029 - RNA, 17 nt, Homo sapiens
auuccucaugucaucaa

SEQ ID NO: 1085030 - RNA, 15 nt, Homo sapiens
auuccuggcaugaca

SEQ ID NO: 1085031 - RNA, 19 nt, Homo sapiens
auucucucugcucagugau

SEQ ID NO: 1085032 - RNA, 16 nt, Homo sapiens
auucuguucuacuuga

SEQ ID NO: 1085033 - RNA, 15 nt, Homo sapiens
auugaagacccucaa

SEQ ID NO: 1085034 - RNA, 14 nt, Homo sapiens
auugcuaccaaaaa

SEQ ID NO: 1085035 - RNA, 15 nt, Homo sapiens
auugcuaccaaaaac

SEQ ID NO: 1085036 - RNA, 21 nt, Homo sapiens
auuggcacaagcucccuggug

SEQ ID NO: 1085037 - RNA, 20 nt, Homo sapiens
auuguauuccucaugucauc

SEQ ID NO: 1085038 - RNA, 16 nt, Homo sapiens
auugucagaguucugc

SEQ ID NO: 1085039 - RNA, 19 nt, Homo sapiens
auugucagaguucugcucu

SEQ ID NO: 1085040 - RNA, 20 nt, Homo sapiens
auugucagaguucugcucua

SEQ ID NO: 1085041 - RNA, 17 nt, Homo sapiens
auugucgcucagcaaua

SEQ ID NO: 1085042 - RNA, 18 nt, Homo sapiens
auuguggguaacgugaga

SEQ ID NO: 1085043 - RNA, 19 nt, Homo sapiens
auuguuaggagaugucauc

SEQ ID NO: 1085044 - RNA, 17 nt, Homo sapiens
auuguucugggugauuu

SEQ ID NO: 1085045 - RNA, 21 nt, Homo sapiens
auuguucuuauccucaauuca

SEQ ID NO: 1085046 - RNA, 15 nt, Homo sapiens
auuuaaaagacaaac

SEQ ID NO: 1085047 - RNA, 21 nt, Homo sapiens
auuuacaugaauugcauuuua

SEQ ID NO: 1085048 - RNA, 16 nt, Homo sapiens
auuuauuuauguagga

SEQ ID NO: 1085049 - RNA, 14 nt, Homo sapiens
auuucacaucagcu

SEQ ID NO: 1085050 - RNA, 11 nt, Homo sapiens
acugcucugcc

SEQ ID NO: 1085051 - RNA, 15 nt, Homo sapiens
acuggagaguggcaa

SEQ ID NO: 1085052 - RNA, 13 nt, Homo sapiens
acuggccaaaaau

SEQ ID NO: 1085053 - RNA, 18 nt, Homo sapiens
acugggcucacauuccca

SEQ ID NO: 1085054 - RNA, 18 nt, Homo sapiens
acugucccaggagcaaau

SEQ ID NO: 1085055 - RNA, 20 nt, Homo sapiens
acuguccugcuccacagugu

SEQ ID NO: 1085056 - RNA, 16 nt, Homo sapiens
acugucucaacuacuc

SEQ ID NO: 1085057 - RNA, 20 nt, Homo sapiens
acuguguuaguaaacugugc

SEQ ID NO: 1085058 - RNA, 19 nt, Homo sapiens
acuuaaggauggagccagc

SEQ ID NO: 1085059 - RNA, 23 nt, Homo sapiens
acuuauuguauuccucaugucau

SEQ ID NO: 1085060 - RNA, 13 nt, Homo sapiens
acuucaugcccac

SEQ ID NO: 1085061 - RNA, 15 nt, Homo sapiens
acuuccaugauacuu

SEQ ID NO: 1085062 - RNA, 17 nt, Homo sapiens
acuucccaauugccaca

SEQ ID NO: 1085063 - RNA, 18 nt, Homo sapiens
acuuguccuuuuguacca

SEQ ID NO: 1085064 - RNA, 22 nt, Homo sapiens
acuuuaaaaaaaucauaugcua

SEQ ID NO: 1085065 - RNA, 15 nt, Homo sapiens
acuuuuaaaacuaua

SEQ ID NO: 1085066 - RNA, 17 nt, Homo sapiens
acuuuugaagaacaaaa

SEQ ID NO: 1085067 - RNA, 20 nt, Homo sapiens
acuuuuugaaaaaaguauag

SEQ ID NO: 1085068 - RNA, 11 nt, Homo sapiens
acuuuuugccc

SEQ ID NO: 1085069 - RNA, 12 nt, Homo sapiens
agaaaacuucag

SEQ ID NO: 1085070 - RNA, 19 nt, Homo sapiens
agaaaagcaauacuguuuc

SEQ ID NO: 1085071 - RNA, 17 nt, Homo sapiens
agaaaauaauugcaaau

SEQ ID NO: 1085072 - RNA, 17 nt, Homo sapiens
agaaaaugaauuugacu

SEQ ID NO: 1085073 - RNA, 20 nt, Homo sapiens
agaaaaugugucugcaacau

SEQ ID NO: 1085074 - RNA, 19 nt, Homo sapiens
agaaaccagaaaagcaaua

SEQ ID NO: 1085075 - RNA, 18 nt, Homo sapiens
agaaacuucugcuuuuaa

SEQ ID NO: 1085076 - RNA, 13 nt, Homo sapiens
agaaauccuagug

SEQ ID NO: 1085077 - RNA, 12 nt, Homo sapiens
agaaaucugcca

SEQ ID NO: 1085078 - RNA, 21 nt, Homo sapiens
agaaaugcuuuccaaaaccgc

SEQ ID NO: 1085079 - RNA, 20 nt, Homo sapiens
agaaauuauguuuucaucca

SEQ ID NO: 1085080 - RNA, 21 nt, Homo sapiens
agaaauugugaaaaaugagcu

SEQ ID NO: 1085081 - RNA, 15 nt, Homo sapiens
agaacaaauacacuu

SEQ ID NO: 1085082 - RNA, 15 nt, Homo sapiens
agaacaaugcuauaa

SEQ ID NO: 1085083 - RNA, 22 nt, Homo sapiens
agaacauuccucugcagcacuu

SEQ ID NO: 1085084 - RNA, 12 nt, Homo sapiens
agaaccucaggc

SEQ ID NO: 1085085 - RNA, 19 nt, Homo sapiens
agaaccucgagguuucuca

SEQ ID NO: 1085086 - RNA, 20 nt, Homo sapiens
agaaguaacucccacuccua

SEQ ID NO: 1085087 - RNA, 15 nt, Homo sapiens
agaauaaaauacucu

SEQ ID NO: 1085088 - RNA, 14 nt, Homo sapiens
agaaucaacaguga

SEQ ID NO: 1085089 - RNA, 14 nt, Homo sapiens
agaaucaagucugu

SEQ ID NO: 1085090 - RNA, 21 nt, Homo sapiens
agaauccugggcccccagaga

SEQ ID NO: 1085091 - RNA, 15 nt, Homo sapiens
agaaugaaauacucu

SEQ ID NO: 1085092 - RNA, 15 nt, Homo sapiens
agaaugaagacuguu

SEQ ID NO: 1085093 - RNA, 22 nt, Homo sapiens
agaauggggguggggaggcaag

SEQ ID NO: 1085094 - RNA, 12 nt, Homo sapiens
agaaugugaaca

SEQ ID NO: 1085095 - RNA, 20 nt, Homo sapiens
agaauugccuuaaggccaca

SEQ ID NO: 1085096 - RNA, 22 nt, Homo sapiens
agacaagaaauccuaguggccu

SEQ ID NO: 1085097 - RNA, 21 nt, Homo sapiens
agacauuauuuuguauggaau

SEQ ID NO: 1085098 - RNA, 15 nt, Homo sapiens
agagaaaacuucaga

SEQ ID NO: 1085099 - RNA, 12 nt, Homo sapiens
agagaaaagcca

SEQ ID NO: 1085100 - RNA, 14 nt, Homo sapiens
agagaaugugaaca

SEQ ID NO: 1085101 - RNA, 13 nt, Homo sapiens
agagaccuuugcc

SEQ ID NO: 1085102 - RNA, 22 nt, Homo sapiens
agagaucuuucuuuccaaaaca

SEQ ID NO: 1085103 - RNA, 21 nt, Homo sapiens
agagauggaauaaagcccuug

SEQ ID NO: 1085104 - RNA, 23 nt, Homo sapiens
agagcaagaagaagagugacucc

SEQ ID NO: 1085105 - RNA, 23 nt, Homo sapiens
agagcuauggugagguguggaua

SEQ ID NO: 1085106 - RNA, 16 nt, Homo sapiens
agaggcaaccuguuga

SEQ ID NO: 1085107 - RNA, 16 nt, Homo sapiens
agagguucugcacucc

SEQ ID NO: 1085108 - RNA, 13 nt, Homo sapiens
agaguccagucaa

SEQ ID NO: 1085109 - RNA, 16 nt, Homo sapiens
agaguucuugcacccu

SEQ ID NO: 1085110 - RNA, 14 nt, Homo sapiens
agauagacggguug

SEQ ID NO: 1085111 - RNA, 12 nt, Homo sapiens
agauagugccuc

SEQ ID NO: 1085112 - RNA, 22 nt, Homo sapiens
agauauugucagaguucugcuc

SEQ ID NO: 1085113 - RNA, 18 nt, Homo sapiens
agaucacgccacugcacu

SEQ ID NO: 1085114 - RNA, 13 nt, Homo sapiens
agauccuccauuu

SEQ ID NO: 1085115 - RNA, 20 nt, Homo sapiens
agaucgcgccacugcacugc

SEQ ID NO: 1085116 - RNA, 14 nt, Homo sapiens
agaugaaacagggc

SEQ ID NO: 1085117 - RNA, 18 nt, Homo sapiens
agauggaauaaagcccuu

SEQ ID NO: 1085118 - RNA, 14 nt, Homo sapiens
agaugggauuucac

SEQ ID NO: 1085119 - RNA, 15 nt, Homo sapiens
agaugucaucaagcu

SEQ ID NO: 1085120 - RNA, 15 nt, Homo sapiens
agaugugggcucaga

SEQ ID NO: 1085121 - RNA, 23 nt, Homo sapiens
agauuaguauuuuccacgucacu

SEQ ID NO: 1085122 - RNA, 14 nt, Homo sapiens
agauucucaccugc

SEQ ID NO: 1085123 - RNA, 23 nt, Homo sapiens
agauugcucuggggcuugcuauu

SEQ ID NO: 1085124 - RNA, 23 nt, Homo sapiens
agauuguucuguccaguuuccaa

SEQ ID NO: 1085125 - RNA, 16 nt, Homo sapiens
agcaaagauuaaaugu

SEQ ID NO: 1085126 - RNA, 19 nt, Homo sapiens
agcaaagauuaaauguguc

SEQ ID NO: 1085127 - RNA, 13 nt, Homo sapiens
agcaaauauauaa

SEQ ID NO: 1085128 - RNA, 17 nt, Homo sapiens
agcaagacucugucuca

SEQ ID NO: 1085129 - RNA, 13 nt, Homo sapiens
agcaagaugaaac

SEQ ID NO: 1085130 - RNA, 17 nt, Homo sapiens
agcaagaugaaacaggg

SEQ ID NO: 1085131 - RNA, 16 nt, Homo sapiens
agcaauacuguuucca

SEQ ID NO: 1085132 - RNA, 17 nt, Homo sapiens
agcaauagggugcaguu

SEQ ID NO: 1085133 - RNA, 18 nt, Homo sapiens
agcaaucauuuuauauaa

SEQ ID NO: 1085134 - RNA, 16 nt, Homo sapiens
agcagagcuuccucag

SEQ ID NO: 1085135 - RNA, 17 nt, Homo sapiens
agcagaguucuuugcaa

SEQ ID NO: 1085136 - RNA, 16 nt, Homo sapiens
agcagcccuuuuuaca

SEQ ID NO: 1085137 - RNA, 20 nt, Homo sapiens
agcaggcuuuuguguucucu

SEQ ID NO: 1085138 - RNA, 13 nt, Homo sapiens
agcagggacaccc

SEQ ID NO: 1085139 - RNA, 16 nt, Homo sapiens
agcaguaaacuuucuc

SEQ ID NO: 1085140 - RNA, 19 nt, Homo sapiens
agcaguuguuauuuaguga

SEQ ID NO: 1085141 - RNA, 19 nt, Homo sapiens
agcaucaauacaaccagcc

SEQ ID NO: 1085142 - RNA, 16 nt, Homo sapiens
agcaucaccucaggcc

SEQ ID NO: 1085143 - RNA, 14 nt, Homo sapiens
agcaugaaaacuga

SEQ ID NO: 1085144 - RNA, 19 nt, Homo sapiens
agcaugcccugagcucucu

SEQ ID NO: 1085145 - RNA, 14 nt, Homo sapiens
agcauguggggaag

SEQ ID NO: 1085146 - RNA, 15 nt, Homo sapiens
agcauuacgaucccc

SEQ ID NO: 1085147 - RNA, 16 nt, Homo sapiens
agccaaacucugccag

SEQ ID NO: 1085148 - RNA, 21 nt, Homo sapiens
agccaaacucugccagccaca

SEQ ID NO: 1085149 - RNA, 19 nt, Homo sapiens
agccaauauuuacucauca

SEQ ID NO: 1085150 - RNA, 21 nt, Homo sapiens
agccacgaacacgcaugccuc

SEQ ID NO: 1085151 - RNA, 20 nt, Homo sapiens
agccauauauuuucugagua

SEQ ID NO: 1085152 - RNA, 20 nt, Homo sapiens
agcccucugcugcuuuccaa

SEQ ID NO: 1085153 - RNA, 19 nt, Homo sapiens
agcccuguccccuaccccc

SEQ ID NO: 1085154 - RNA, 17 nt, Homo sapiens
agcccuugguuccuccc

SEQ ID NO: 1085155 - RNA, 21 nt, Homo sapiens
agccgccucccuuaugcagga

SEQ ID NO: 1085156 - RNA, 15 nt, Homo sapiens
agccguauuuuacau

SEQ ID NO: 1085157 - RNA, 12 nt, Homo sapiens
agccucaagucu

SEQ ID NO: 1085158 - RNA, 12 nt, Homo sapiens
agccucaugccc

SEQ ID NO: 1085159 - RNA, 17 nt, Homo sapiens
agccucccaaguagcug

SEQ ID NO: 1085160 - RNA, 18 nt, Homo sapiens
agccucccaaguagcugg

SEQ ID NO: 1085161 - RNA, 19 nt, Homo sapiens
cacuuugggaggccgaggu

SEQ ID NO: 1085162 - RNA, 19 nt, Homo sapiens
cacuuuuuuuuuuucugcc

SEQ ID NO: 1085163 - RNA, 17 nt, Homo sapiens
cagaaaagcaauacugu

SEQ ID NO: 1085164 - RNA, 21 nt, Homo sapiens
cagaagccccaacugugauca

SEQ ID NO: 1085165 - RNA, 21 nt, Homo sapiens
cagaaggauauuuacuacuuu

SEQ ID NO: 1085166 - RNA, 19 nt, Homo sapiens
cagaaguaacucccacucc

SEQ ID NO: 1085167 - RNA, 18 nt, Homo sapiens
cagaaucagauucaggag

SEQ ID NO: 1085168 - RNA, 15 nt, Homo sapiens
cagacagauugcuga

SEQ ID NO: 1085169 - RNA, 17 nt, Homo sapiens
cagacccagccccggug

SEQ ID NO: 1085170 - RNA, 23 nt, Homo sapiens
cagaccucagagauggcuuccuu

SEQ ID NO: 1085171 - RNA, 17 nt, Homo sapiens
cagagaaugugaacaug

SEQ ID NO: 1085172 - RNA, 20 nt, Homo sapiens
cagagcaagacucugucuca

SEQ ID NO: 1085173 - RNA, 22 nt, Homo sapiens
gcagcacaggaggcuccgugag

SEQ ID NO: 1085174 - RNA, 16 nt, Homo sapiens
gcagccccacacccgc

SEQ ID NO: 1085175 - RNA, 22 nt, Homo sapiens
gcagccuccagugggaggacag

SEQ ID NO: 1085176 - RNA, 15 nt, Homo sapiens
gcagcuucugccacu

SEQ ID NO: 1085177 - RNA, 22 nt, Homo sapiens
gcaggcugcaacccuggugugc

SEQ ID NO: 1085178 - RNA, 14 nt, Homo sapiens
gcagugaacugaga

SEQ ID NO: 1085179 - RNA, 18 nt, Homo sapiens
gcagugacgugcaccugu

SEQ ID NO: 1085180 - RNA, 23 nt, Homo sapiens
gcagugacgugcaccuguacuca

SEQ ID NO: 1085181 - RNA, 14 nt, Homo sapiens
gcaguugaucucca

SEQ ID NO: 1085182 - RNA, 18 nt, Homo sapiens
gcaucaauacaaccagcc

SEQ ID NO: 1085183 - RNA, 12 nt, Homo sapiens
gcaucagcuuuu

SEQ ID NO: 1085184 - RNA, 19 nt, Homo sapiens
gcaucucagaguccaguca

SEQ ID NO: 1085185 - RNA, 14 nt, Homo sapiens
gcaucuuuuccucc

SEQ ID NO: 1085186 - RNA, 20 nt, Homo sapiens
gcaugaaggcagccacagac

SEQ ID NO: 1085187 - RNA, 19 nt, Homo sapiens
gcauguaaaaucuucagcu

SEQ ID NO: 1085188 - RNA, 15 nt, Homo sapiens
gcauuaauauucuuu

SEQ ID NO: 1085189 - RNA, 18 nt, Homo sapiens
gccaauauuucugauaua

SEQ ID NO: 1085190 - RNA, 14 nt, Homo sapiens
gccacgaccugggg

SEQ ID NO: 1085191 - RNA, 13 nt, Homo sapiens
gccacuaccuuug

SEQ ID NO: 1085192 - RNA, 19 nt, Homo sapiens
gccagcaccaagcgugauu

SEQ ID NO: 1085193 - RNA, 11 nt, Homo sapiens
gccagcauuuu

SEQ ID NO: 1085194 - RNA, 19 nt, Homo sapiens
gccaggagcuucucugaug

SEQ ID NO: 1085195 - RNA, 18 nt, Homo sapiens
gccaggauggucuugauc

SEQ ID NO: 1085196 - RNA, 22 nt, Homo sapiens
gccaggauggucuugaucuccu

SEQ ID NO: 1085197 - RNA, 15 nt, Homo sapiens
gccaggauuggcaca

SEQ ID NO: 1085198 - RNA, 19 nt, Homo sapiens
gccaggauuggcacaagcu

SEQ ID NO: 1085199 - RNA, 17 nt, Homo sapiens
gccaggcuguaagcauu

SEQ ID NO: 1085200 - RNA, 13 nt, Homo sapiens
gccaggcuuguca

SEQ ID NO: 1085201 - RNA, 11 nt, Homo sapiens
gccaguauuuu

SEQ ID NO: 1085202 - RNA, 22 nt, Homo sapiens
gccauuccaagucaacacucuu

SEQ ID NO: 1085203 - RNA, 23 nt, Homo sapiens
gccauugaauuugccuuccucau

SEQ ID NO: 1085204 - RNA, 13 nt, Homo sapiens
gcccaaacacccu

SEQ ID NO: 1085205 - RNA, 22 nt, Homo sapiens
gcccagacccuucuccuuagaa

SEQ ID NO: 1085206 - RNA, 16 nt, Homo sapiens
gcccagcaagaugaaa

SEQ ID NO: 1085207 - RNA, 22 nt, Homo sapiens
gcccagcaagaugaaacagggc

SEQ ID NO: 1085208 - RNA, 20 nt, Homo sapiens
gcccagccauuaccauggag

SEQ ID NO: 1085209 - RNA, 14 nt, Homo sapiens
gcccagcugcaccu

SEQ ID NO: 1085210 - RNA, 20 nt, Homo sapiens
gcccaggcuagagugcagug

SEQ ID NO: 1085211 - RNA, 20 nt, Homo sapiens
gcccaggcuggagugcaaug

SEQ ID NO: 1085212 - RNA, 13 nt, Homo sapiens
gcccaucugucca

SEQ ID NO: 1085213 - RNA, 23 nt, Homo sapiens
gccccauuugccagauugcccca

SEQ ID NO: 1085214 - RNA, 14 nt, Homo sapiens
gccccucaggggaa

SEQ ID NO: 1085215 - RNA, 12 nt, Homo sapiens
gcccuccgccua

SEQ ID NO: 1085216 - RNA, 14 nt, Homo sapiens
gcccucugcugcuu

SEQ ID NO: 1085217 - RNA, 19 nt, Homo sapiens
gcccucugcugcuuuccaa

SEQ ID NO: 1085218 - RNA, 13 nt, Homo sapiens
gcccucuggacag

SEQ ID NO: 1085219 - RNA, 16 nt, Homo sapiens
gcccucuguccugacu

SEQ ID NO: 1085220 - RNA, 11 nt, Homo sapiens
gcccuggccag

SEQ ID NO: 1085221 - RNA, 23 nt, Homo sapiens
gcccuguccccuacccccaguaa

SEQ ID NO: 1085222 - RNA, 19 nt, Homo sapiens
gccuaacaugauuauuuga

SEQ ID NO: 1085223 - RNA, 19 nt, Homo sapiens
gccuacacccgucuugggg

SEQ ID NO: 1085224 - RNA, 20 nt, Homo sapiens
gccucaccuccucugugauu

SEQ ID NO: 1085225 - RNA, 21 nt, Homo sapiens
gccucaucugcuccuagccca

SEQ ID NO: 1085226 - RNA, 20 nt, Homo sapiens
gccuccaaguccacagugga

SEQ ID NO: 1085227 - RNA, 12 nt, Homo sapiens
gccucccaaagu

SEQ ID NO: 1085228 - RNA, 14 nt, Homo sapiens
gccucccacaguga

SEQ ID NO: 1085229 - RNA, 15 nt, Homo sapiens
gccucccacagugac

SEQ ID NO: 1085230 - RNA, 14 nt, Homo sapiens
gccucccuuucaua

SEQ ID NO: 1085231 - RNA, 21 nt, Homo sapiens
gccucuccacuguuucaugag

SEQ ID NO: 1085232 - RNA, 19 nt, Homo sapiens
gccugaaccgugugcuccu

SEQ ID NO: 1085233 - RNA, 20 nt, Homo sapiens
gccugagugcaccacccuuu

SEQ ID NO: 1085234 - RNA, 14 nt, Homo sapiens
gccuguaaucccag

SEQ ID NO: 1085235 - RNA, 13 nt, Homo sapiens
gccuguugcugaa

SEQ ID NO: 1085236 - RNA, 19 nt, Homo sapiens
gccuuaaggccacacuggc

SEQ ID NO: 1085237 - RNA, 14 nt, Homo sapiens
gccuucacaugaaa

SEQ ID NO: 1085238 - RNA, 21 nt, Homo sapiens
gccuucacuccggugugccug

SEQ ID NO: 1085239 - RNA, 19 nt, Homo sapiens
gccuucucccccccggggc

SEQ ID NO: 1085240 - RNA, 14 nt, Homo sapiens
gccuugggccucau

SEQ ID NO: 1085241 - RNA, 18 nt, Homo sapiens
gcgaaggggcccuggucc

SEQ ID NO: 1085242 - RNA, 15 nt, Homo sapiens
gcgaccccaucugcc

SEQ ID NO: 1085243 - RNA, 23 nt, Homo sapiens
gcgagcugcucugcuauaugccu

SEQ ID NO: 1085244 - RNA, 13 nt, Homo sapiens
gcggaaccauagc

SEQ ID NO: 1085245 - RNA, 14 nt, Homo sapiens
gcgggaucccagca

SEQ ID NO: 1085246 - RNA, 19 nt, Homo sapiens
gcgggaucccagcaucuca

SEQ ID NO: 1085247 - RNA, 15 nt, Homo sapiens
gcuaagccugaugau

SEQ ID NO: 1085248 - RNA, 13 nt, Homo sapiens
gcuaaggcucuau

SEQ ID NO: 1085249 - RNA, 16 nt, Homo sapiens
gcuacuaaccugacau

SEQ ID NO: 1085250 - RNA, 15 nt, Homo sapiens
gcuacucucuugcca

SEQ ID NO: 1085251 - RNA, 17 nt, Homo sapiens
gcuaucucgcuagccau

SEQ ID NO: 1085252 - RNA, 13 nt, Homo sapiens
gcucaccaagaag

SEQ ID NO: 1085253 - RNA, 22 nt, Homo sapiens
gcucaggaggcuuggaaagcau

SEQ ID NO: 1085254 - RNA, 15 nt, Homo sapiens
gcucagucucaggag

SEQ ID NO: 1085255 - RNA, 15 nt, Homo sapiens
gcucagugaucucac

SEQ ID NO: 1085256 - RNA, 12 nt, Homo sapiens
gcuccacagugu

SEQ ID NO: 1085257 - RNA, 16 nt, Homo sapiens
gcuccgugagcccuug

SEQ ID NO: 1085258 - RNA, 20 nt, Homo sapiens
gcuccuaguagcuuuccucc

SEQ ID NO: 1085259 - RNA, 17 nt, Homo sapiens
gcuccucaugaggccau

SEQ ID NO: 1085260 - RNA, 17 nt, Homo sapiens
gcuccugcucauugugg

SEQ ID NO: 1085261 - RNA, 23 nt, Homo sapiens
gcucgggcccaggccaucuucca

SEQ ID NO: 1085262 - RNA, 17 nt, Homo sapiens
gcucuacccugcagcuu

SEQ ID NO: 1085263 - RNA, 17 nt, Homo sapiens
gcucugaggaguggagu

SEQ ID NO: 1085264 - RNA, 18 nt, Homo sapiens
gcugacccagugugugcu

SEQ ID NO: 1085265 - RNA, 23 nt, Homo sapiens
gcugaggcggguggaucaccuga

SEQ ID NO: 1085266 - RNA, 15 nt, Homo sapiens
gcugaugcauucccg

SEQ ID NO: 1085267 - RNA, 18 nt, Homo sapiens
gcugcauggcacugaccg

SEQ ID NO: 1085268 - RNA, 22 nt, Homo sapiens
gcugcccaggcuagagugcagu

SEQ ID NO: 1085269 - RNA, 17 nt, Homo sapiens
gcugccuccacucccac

SEQ ID NO: 1085270 - RNA, 14 nt, Homo sapiens
gcugccucccuuuc

SEQ ID NO: 1085271 - RNA, 18 nt, Homo sapiens
gcugccucucuucugugu

SEQ ID NO: 1085272 - RNA, 15 nt, Homo sapiens
acaguccugggagaa

SEQ ID NO: 1085273 - RNA, 15 nt, Homo sapiens
acagugggggcacca

SEQ ID NO: 1085274 - RNA, 15 nt, Homo sapiens
acagugucugggcug

SEQ ID NO: 1085275 - RNA, 16 nt, Homo sapiens
acaguguuuccugagu

SEQ ID NO: 1085276 - RNA, 19 nt, Homo sapiens
acauaaaaccugagcagca

SEQ ID NO: 1085277 - RNA, 14 nt, Homo sapiens
acauauauguauau

SEQ ID NO: 1085278 - RNA, 14 nt, Homo sapiens
acauauuaagaaua

SEQ ID NO: 1085279 - RNA, 14 nt, Homo sapiens
acaucagucuccaa

SEQ ID NO: 1085280 - RNA, 13 nt, Homo sapiens
acaugaacccauc

SEQ ID NO: 1085281 - RNA, 19 nt, Homo sapiens
acaugaacccauccaaugg

SEQ ID NO: 1085282 - RNA, 21 nt, Homo sapiens
acaugauggagcgcaccugcc

SEQ ID NO: 1085283 - RNA, 20 nt, Homo sapiens
acauggccagugugauccca

SEQ ID NO: 1085284 - RNA, 23 nt, Homo sapiens
acauuuuguacaaagauaugcua

SEQ ID NO: 1085285 - RNA, 14 nt, Homo sapiens
accaaagacaucag

SEQ ID NO: 1085286 - RNA, 19 nt, Homo sapiens
accaagaccccaaagggcc

SEQ ID NO: 1085287 - RNA, 14 nt, Homo sapiens
accacuaggguccu

SEQ ID NO: 1085288 - RNA, 16 nt, Homo sapiens
accacuguguauuuaa

SEQ ID NO: 1085289 - RNA, 13 nt, Homo sapiens
accagaauugcuu

SEQ ID NO: 1085290 - RNA, 23 nt, Homo sapiens
accagaugggaugggcuuucuca

SEQ ID NO: 1085291 - RNA, 20 nt, Homo sapiens
accagccguauuuuacauga

SEQ ID NO: 1085292 - RNA, 16 nt, Homo sapiens
accauauugcucuuaa

SEQ ID NO: 1085293 - RNA, 14 nt, Homo sapiens
accauugucuucca

SEQ ID NO: 1085294 - RNA, 18 nt, Homo sapiens
acccaccuggauucccug

SEQ ID NO: 1085295 - RNA, 14 nt, Homo sapiens
acccagaacuggac

SEQ ID NO: 1085296 - RNA, 17 nt, Homo sapiens
acccagccugagugcac

SEQ ID NO: 1085297 - RNA, 17 nt, Homo sapiens
acccagugugugcucag

SEQ ID NO: 1085298 - RNA, 19 nt, Homo sapiens
acccagugugugcucagca

SEQ ID NO: 1085299 - RNA, 15 nt, Homo sapiens
acccaugacucugua

SEQ ID NO: 1085300 - RNA, 22 nt, Homo sapiens
acccauuucaggaggugccggu

SEQ ID NO: 1085301 - RNA, 18 nt, Homo sapiens
accccagcugaccuggua

SEQ ID NO: 1085302 - RNA, 18 nt, Homo sapiens
accccauauuguucuuca

SEQ ID NO: 1085303 - RNA, 20 nt, Homo sapiens
accccuccugaacuggccac

SEQ ID NO: 1085304 - RNA, 20 nt, Homo sapiens
acccuaaagucucaggugac

SEQ ID NO: 1085305 - RNA, 18 nt, Homo sapiens
acccucaaugccaagaaa

SEQ ID NO: 1085306 - RNA, 14 nt, Homo sapiens
acccucccagugag

SEQ ID NO: 1085307 - RNA, 19 nt, Homo sapiens
acccuccuggccucauaca

SEQ ID NO: 1085308 - RNA, 24 nt, Homo sapiens
acccuggaaacuaccagugggcau

SEQ ID NO: 1085309 - RNA, 19 nt, Homo sapiens
accgagagagauggaauaa

SEQ ID NO: 1085310 - RNA, 16 nt, Homo sapiens
accgauagcaggugaa

SEQ ID NO: 1085311 - RNA, 13 nt, Homo sapiens
accguugcacaaa

SEQ ID NO: 1085312 - RNA, 14 nt, Homo sapiens
accucacuauucaa

SEQ ID NO: 1085313 - RNA, 23 nt, Homo sapiens
accuccuauccuuggagagcagc

SEQ ID NO: 1085314 - RNA, 21 nt, Homo sapiens
accuccuccuccaguucugau

SEQ ID NO: 1085315 - RNA, 22 nt, Homo sapiens
accuccuccuccaguucugaug

SEQ ID NO: 1085316 - RNA, 13 nt, Homo sapiens
accuccucuguga

SEQ ID NO: 1085317 - RNA, 16 nt, Homo sapiens
accugaacucugcaac

SEQ ID NO: 1085318 - RNA, 19 nt, Homo sapiens
accugaacucugcaacuga

SEQ ID NO: 1085319 - RNA, 20 nt, Homo sapiens
accugcgaacuuguguuuau

SEQ ID NO: 1085320 - RNA, 22 nt, Homo sapiens
accugguacugagguugggcug

SEQ ID NO: 1085321 - RNA, 18 nt, Homo sapiens
accuguccauaaaguaau

SEQ ID NO: 1085322 - RNA, 19 nt, Homo sapiens
accuguuuuuaacauguga

SEQ ID NO: 1085323 - RNA, 15 nt, Homo sapiens
accuuaacucagcca

SEQ ID NO: 1085324 - RNA, 18 nt, Homo sapiens
accuuaacucagccagaa

SEQ ID NO: 1085325 - RNA, 23 nt, Homo sapiens
accuuugacacugacagaugugu

SEQ ID NO: 1085326 - RNA, 20 nt, Homo sapiens
accuuugcccacacacacuc

SEQ ID NO: 1085327 - RNA, 22 nt, Homo sapiens
accuuugcccacacacacuccu

SEQ ID NO: 1085328 - RNA, 16 nt, Homo sapiens
acgaucccccaagugu

SEQ ID NO: 1085329 - RNA, 19 nt, Homo sapiens
acgaucccccaaguguccu

SEQ ID NO: 1085330 - RNA, 14 nt, Homo sapiens
acgaucucagcuca

SEQ ID NO: 1085331 - RNA, 17 nt, Homo sapiens
acgaucucagcucacca

SEQ ID NO: 1085332 - RNA, 18 nt, Homo sapiens
acgcacucaacuuccuuu

SEQ ID NO: 1085333 - RNA, 15 nt, Homo sapiens
acgccuaugauccca

SEQ ID NO: 1085334 - RNA, 14 nt, Homo sapiens
acggagccauguca

SEQ ID NO: 1085335 - RNA, 15 nt, Homo sapiens
acggcagcuguagcu

SEQ ID NO: 1085336 - RNA, 13 nt, Homo sapiens
acguacugguuua

SEQ ID NO: 1085337 - RNA, 17 nt, Homo sapiens
acguagauuuuugcucu

SEQ ID NO: 1085338 - RNA, 14 nt, Homo sapiens
acguuaacagcgug

SEQ ID NO: 1085339 - RNA, 17 nt, Homo sapiens
acuaaacagacuauuua

SEQ ID NO: 1085340 - RNA, 13 nt, Homo sapiens
acuacacuccagc

SEQ ID NO: 1085341 - RNA, 16 nt, Homo sapiens
acuacaggcucaugcc

SEQ ID NO: 1085342 - RNA, 18 nt, Homo sapiens
acuaccaaaugagcauua

SEQ ID NO: 1085343 - RNA, 20 nt, Homo sapiens
acuaccagugggcauguauu

SEQ ID NO: 1085344 - RNA, 14 nt, Homo sapiens
acuacuugagaaaa

SEQ ID NO: 1085345 - RNA, 16 nt, Homo sapiens
acuagcaggcaugccg

SEQ ID NO: 1085346 - RNA, 21 nt, Homo sapiens
acuaugccugaugugacgcua

SEQ ID NO: 1085347 - RNA, 15 nt, Homo sapiens
acuauuauuugcuau

SEQ ID NO: 1085348 - RNA, 18 nt, Homo sapiens
acucaccuugcucugcca

SEQ ID NO: 1085349 - RNA, 13 nt, Homo sapiens
acucacugccaaa

SEQ ID NO: 1085350 - RNA, 15 nt, Homo sapiens
acucagggacucagg

SEQ ID NO: 1085351 - RNA, 18 nt, Homo sapiens
acucaucccuguuccuca

SEQ ID NO: 1085352 - RNA, 19 nt, Homo sapiens
acucaucccuguuccucaa

SEQ ID NO: 1085353 - RNA, 23 nt, Homo sapiens
acucaucccuguuccucaaggcc

SEQ ID NO: 1085354 - RNA, 21 nt, Homo sapiens
acucauuugcugacacaucag

SEQ ID NO: 1085355 - RNA, 13 nt, Homo sapiens
acucccacuuccc

SEQ ID NO: 1085356 - RNA, 20 nt, Homo sapiens
acucccccaggauugugcaa

SEQ ID NO: 1085357 - RNA, 17 nt, Homo sapiens
acuccguuuccaaauac

SEQ ID NO: 1085358 - RNA, 13 nt, Homo sapiens
acuccucuaguca

SEQ ID NO: 1085359 - RNA, 18 nt, Homo sapiens
acuccucuuauuugcuca

SEQ ID NO: 1085360 - RNA, 17 nt, Homo sapiens
acuccuggcuucaugug

SEQ ID NO: 1085361 - RNA, 14 nt, Homo sapiens
acucuaccugcaag

SEQ ID NO: 1085362 - RNA, 15 nt, Homo sapiens
acucuaccugcaaga

SEQ ID NO: 1085363 - RNA, 20 nt, Homo sapiens
acucuacuuccucuuaccua

SEQ ID NO: 1085364 - RNA, 15 nt, Homo sapiens
acucucaccucguga

SEQ ID NO: 1085365 - RNA, 19 nt, Homo sapiens
acucugccagccacaucca

SEQ ID NO: 1085366 - RNA, 18 nt, Homo sapiens
acucugugcccaugggca

SEQ ID NO: 1085367 - RNA, 14 nt, Homo sapiens
acucuuuaucccau

SEQ ID NO: 1085368 - RNA, 12 nt, Homo sapiens
acugaagugauu

SEQ ID NO: 1085369 - RNA, 23 nt, Homo sapiens
acugaguauugauaaacuuugaa

SEQ ID NO: 1085370 - RNA, 23 nt, Homo sapiens
acugaguccucguagccaucucu

SEQ ID NO: 1085371 - RNA, 18 nt, Homo sapiens
acugagucuggcaaacau

SEQ ID NO: 1085372 - RNA, 20 nt, Homo sapiens
acugccgaugcccaauccag

SEQ ID NO: 1085373 - RNA, 20 nt, Homo sapiens
acugcgccacggcacuccag

SEQ ID NO: 1085374 - RNA, 14 nt, Homo sapiens
aaggcaacugugag

SEQ ID NO: 1085375 - RNA, 13 nt, Homo sapiens
aaggcagcaacaa

SEQ ID NO: 1085376 - RNA, 20 nt, Homo sapiens
aaggcagugaacacacucag

SEQ ID NO: 1085377 - RNA, 14 nt, Homo sapiens
aaggccacacuggc

SEQ ID NO: 1085378 - RNA, 21 nt, Homo sapiens
aaggccacacuggcaucuccc

SEQ ID NO: 1085379 - RNA, 17 nt, Homo sapiens
aaggcucagucucagga

SEQ ID NO: 1085380 - RNA, 12 nt, Homo sapiens
aaggcugcagga

SEQ ID NO: 1085381 - RNA, 18 nt, Homo sapiens
aaggcuuugccaugggcc

SEQ ID NO: 1085382 - RNA, 22 nt, Homo sapiens
aagggcaacucacgggugcaug

SEQ ID NO: 1085383 - RNA, 15 nt, Homo sapiens
aagggcucagagcug

SEQ ID NO: 1085384 - RNA, 15 nt, Homo sapiens
aagguaauaaauaca

SEQ ID NO: 1085385 - RNA, 19 nt, Homo sapiens
aagguacucuggacuuucu

SEQ ID NO: 1085386 - RNA, 20 nt, Homo sapiens
aagguuucacuguucaugaa

SEQ ID NO: 1085387 - RNA, 18 nt, Homo sapiens
aaguaaguaccacucagg

SEQ ID NO: 1085388 - RNA, 16 nt, Homo sapiens
aaguaguagugucuuc

SEQ ID NO: 1085389 - RNA, 17 nt, Homo sapiens
aaguauauauucuacac

SEQ ID NO: 1085390 - RNA, 17 nt, Homo sapiens
aagucuaaauaaaugaa

SEQ ID NO: 1085391 - RNA, 15 nt, Homo sapiens
aaguguggaauugga

SEQ ID NO: 1085392 - RNA, 19 nt, Homo sapiens
aaguuagggaugacuguga

SEQ ID NO: 1085393 - RNA, 21 nt, Homo sapiens
aaguuagggaugacugugauu

SEQ ID NO: 1085394 - RNA, 15 nt, Homo sapiens
aaguuccucuagugc

SEQ ID NO: 1085395 - RNA, 14 nt, Homo sapiens
aauaaaccuuggaa

SEQ ID NO: 1085396 - RNA, 20 nt, Homo sapiens
aauaaagcccuugaaccagc

SEQ ID NO: 1085397 - RNA, 17 nt, Homo sapiens
aauaauugcaaauaucc

SEQ ID NO: 1085398 - RNA, 20 nt, Homo sapiens
aauacaugcugcuaauucaa

SEQ ID NO: 1085399 - RNA, 14 nt, Homo sapiens
aauacgauccugca

SEQ ID NO: 1085400 - RNA, 15 nt, Homo sapiens
aauaguggauaacau

SEQ ID NO: 1085401 - RNA, 19 nt, Homo sapiens
aauaguuccugaacauugc

SEQ ID NO: 1085402 - RNA, 22 nt, Homo sapiens
aauauaguugucuuucuuugcu

SEQ ID NO: 1085403 - RNA, 15 nt, Homo sapiens
aauaucagauuucau

SEQ ID NO: 1085404 - RNA, 19 nt, Homo sapiens
aauaugggcucaagucacu

SEQ ID NO: 1085405 - RNA, 16 nt, Homo sapiens
aaucaaaugugcaucc

SEQ ID NO: 1085406 - RNA, 18 nt, Homo sapiens
aaucaacuuuucugagcu

SEQ ID NO: 1085407 - RNA, 21 nt, Homo sapiens
aaucaagacccuuuucuguau

SEQ ID NO: 1085408 - RNA, 18 nt, Homo sapiens
aaucaagucagcaacaga

SEQ ID NO: 1085409 - RNA, 18 nt, Homo sapiens
aaucaccuugcauuucaa

SEQ ID NO: 1085410 - RNA, 15 nt, Homo sapiens
aauccaaaugcauuc

SEQ ID NO: 1085411 - RNA, 23 nt, Homo sapiens
aauccaggcccggugaggccaag

SEQ ID NO: 1085412 - RNA, 23 nt, Homo sapiens
aauccaucacuagccaugauaac

SEQ ID NO: 1085413 - RNA, 21 nt, Homo sapiens
aaucccaagugucucuugacu

SEQ ID NO: 1085414 - RNA, 13 nt, Homo sapiens
aaucucccaguga

SEQ ID NO: 1085415 - RNA, 22 nt, Homo sapiens
aaucucccagugacaacaucgc

SEQ ID NO: 1085416 - RNA, 15 nt, Homo sapiens
aaucugcaguggcuc

SEQ ID NO: 1085417 - RNA, 12 nt, Homo sapiens
aaugaaagugag

SEQ ID NO: 1085418 - RNA, 13 nt, Homo sapiens
aaugaagacuguu

SEQ ID NO: 1085419 - RNA, 23 nt, Homo sapiens
aaugaagcaauuuauaucuuuau

SEQ ID NO: 1085420 - RNA, 15 nt, Homo sapiens
aaugagacacauaca

SEQ ID NO: 1085421 - RNA, 23 nt, Homo sapiens
aaugaggucccucuagcuuuagc

SEQ ID NO: 1085422 - RNA, 15 nt, Homo sapiens
aaugagugugacuau

SEQ ID NO: 1085423 - RNA, 15 nt, Homo sapiens
aaugcaaaaaagcca

SEQ ID NO: 1085424 - RNA, 21 nt, Homo sapiens
aaugcaaaaaagccaagcccu

SEQ ID NO: 1085425 - RNA, 22 nt, Homo sapiens
aaugcaaaaaagccaagcccuc

SEQ ID NO: 1085426 - RNA, 14 nt, Homo sapiens
aaugcagccuuaaa

SEQ ID NO: 1085427 - RNA, 14 nt, Homo sapiens
aaugcagugcagca

SEQ ID NO: 1085428 - RNA, 15 nt, Homo sapiens
aaugcagugcagcau

SEQ ID NO: 1085429 - RNA, 13 nt, Homo sapiens
aaugcuucugccu

SEQ ID NO: 1085430 - RNA, 11 nt, Homo sapiens
aaugcuuuaaa

SEQ ID NO: 1085431 - RNA, 23 nt, Homo sapiens
aauggcacgaucucagcucacca

SEQ ID NO: 1085432 - RNA, 19 nt, Homo sapiens
aaugguuuucuaauaucuu

SEQ ID NO: 1085433 - RNA, 15 nt, Homo sapiens
aauguagaaagugau

SEQ ID NO: 1085434 - RNA, 13 nt, Homo sapiens
aaugucauaaaga

SEQ ID NO: 1085435 - RNA, 16 nt, Homo sapiens
aauguccagcuucucu

SEQ ID NO: 1085436 - RNA, 12 nt, Homo sapiens
aauguccuccaa

SEQ ID NO: 1085437 - RNA, 23 nt, Homo sapiens
aauguccuucuuuaucugugaua

SEQ ID NO: 1085438 - RNA, 12 nt, Homo sapiens
aaugucuuuauu

SEQ ID NO: 1085439 - RNA, 14 nt, Homo sapiens
aaugugucugcaac

SEQ ID NO: 1085440 - RNA, 22 nt, Homo sapiens
aauuaacuccguuuccaaauac

SEQ ID NO: 1085441 - RNA, 19 nt, Homo sapiens
aauuaauuugugcaucaga

SEQ ID NO: 1085442 - RNA, 10 nt, Homo sapiens
aauucaccuc

SEQ ID NO: 1085443 - RNA, 23 nt, Homo sapiens
aauucaccucguuacucucaccu

SEQ ID NO: 1085444 - RNA, 20 nt, Homo sapiens
aauugagggcuaaaucccaa

SEQ ID NO: 1085445 - RNA, 21 nt, Homo sapiens
aauugauuauucugauuccac

SEQ ID NO: 1085446 - RNA, 22 nt, Homo sapiens
aauuggucauuccuaaugcauu

SEQ ID NO: 1085447 - RNA, 21 nt, Homo sapiens
aauuuacuuuuuaaacagugu

SEQ ID NO: 1085448 - RNA, 14 nt, Homo sapiens
aauuuagcuuacau

SEQ ID NO: 1085449 - RNA, 15 nt, Homo sapiens
aauuuagucccuuaa

SEQ ID NO: 1085450 - RNA, 22 nt, Homo sapiens
aauuugacugguucaccugugu

SEQ ID NO: 1085451 - RNA, 13 nt, Homo sapiens
aauuugccuuugc

SEQ ID NO: 1085452 - RNA, 13 nt, Homo sapiens
aauuuuaauugau

SEQ ID NO: 1085453 - RNA, 19 nt, Homo sapiens
aauuuucuuucauacauua

SEQ ID NO: 1085454 - RNA, 13 nt, Homo sapiens
acaaaacgagaua

SEQ ID NO: 1085455 - RNA, 22 nt, Homo sapiens
acaaaaggcuuuggcaacagaa

SEQ ID NO: 1085456 - RNA, 17 nt, Homo sapiens
acaaacaggugcuaaca

SEQ ID NO: 1085457 - RNA, 21 nt, Homo sapiens
acaaagcaaagccacauuuug

SEQ ID NO: 1085458 - RNA, 22 nt, Homo sapiens
acaaagcugggauuucagucua

SEQ ID NO: 1085459 - RNA, 13 nt, Homo sapiens
acaaauacuacag

SEQ ID NO: 1085460 - RNA, 16 nt, Homo sapiens
acaacaaacacuguga

SEQ ID NO: 1085461 - RNA, 21 nt, Homo sapiens
acaacaugaaauauaguugca

SEQ ID NO: 1085462 - RNA, 20 nt, Homo sapiens
acaacauguauguggauaca

SEQ ID NO: 1085463 - RNA, 20 nt, Homo sapiens
acaaggugcacagaccucag

SEQ ID NO: 1085464 - RNA, 17 nt, Homo sapiens
acaauguugcacugaaa

SEQ ID NO: 1085465 - RNA, 15 nt, Homo sapiens
acaauuaaagcaaaa

SEQ ID NO: 1085466 - RNA, 22 nt, Homo sapiens
acaauucucucuuauaugugua

SEQ ID NO: 1085467 - RNA, 13 nt, Homo sapiens
acaauucuucucg

SEQ ID NO: 1085468 - RNA, 16 nt, Homo sapiens
acaauuuagcuuacau

SEQ ID NO: 1085469 - RNA, 15 nt, Homo sapiens
acacaacauguaugu

SEQ ID NO: 1085470 - RNA, 13 nt, Homo sapiens
acacacacuccuu

SEQ ID NO: 1085471 - RNA, 23 nt, Homo sapiens
cuggccuauuuuggacgugugag

SEQ ID NO: 1085472 - RNA, 14 nt, Homo sapiens
cuggccuccaaguc

SEQ ID NO: 1085473 - RNA, 18 nt, Homo sapiens
cuggcgcaucauaugcag

SEQ ID NO: 1085474 - RNA, 13 nt, Homo sapiens
cuggcugggcaug

SEQ ID NO: 1085475 - RNA, 20 nt, Homo sapiens
cugggacggcccaucuuggc

SEQ ID NO: 1085476 - RNA, 17 nt, Homo sapiens
cugggagaaccucaggc

SEQ ID NO: 1085477 - RNA, 22 nt, Homo sapiens
cugggauuacaggcaugagcca

SEQ ID NO: 1085478 - RNA, 22 nt, Homo sapiens
cugggauuacaggugugagcca

SEQ ID NO: 1085479 - RNA, 15 nt, Homo sapiens
cugggccucagccuc

SEQ ID NO: 1085480 - RNA, 22 nt, Homo sapiens
cugggguguaaugagcuccugc

SEQ ID NO: 1085481 - RNA, 17 nt, Homo sapiens
cugguaauuuguaucug

SEQ ID NO: 1085482 - RNA, 19 nt, Homo sapiens
cugguaauuuguaucugaa

SEQ ID NO: 1085483 - RNA, 14 nt, Homo sapiens
cugguacugagguu

SEQ ID NO: 1085484 - RNA, 16 nt, Homo sapiens
cugguaucugcaugua

SEQ ID NO: 1085485 - RNA, 13 nt, Homo sapiens
cugguccuuccag

SEQ ID NO: 1085486 - RNA, 17 nt, Homo sapiens
cuggugaugcccaaaga

SEQ ID NO: 1085487 - RNA, 15 nt, Homo sapiens
cugguuuaaccuccu

SEQ ID NO: 1085488 - RNA, 21 nt, Homo sapiens
cuguauauaacuuauuugccc

SEQ ID NO: 1085489 - RNA, 14 nt, Homo sapiens
cuguccagccagcu

SEQ ID NO: 1085490 - RNA, 22 nt, Homo sapiens
cugucccaggagcaaaugcugg

SEQ ID NO: 1085491 - RNA, 13 nt, Homo sapiens
cugucuuugcaaa

SEQ ID NO: 1085492 - RNA, 14 nt, Homo sapiens
cuguggucacuuau

SEQ ID NO: 1085493 - RNA, 21 nt, Homo sapiens
cuguguauuuaacugccuugu

SEQ ID NO: 1085494 - RNA, 15 nt, Homo sapiens
cugugucguagccaa

SEQ ID NO: 1085495 - RNA, 23 nt, Homo sapiens
cugugucuuauagguuuccacug

SEQ ID NO: 1085496 - RNA, 11 nt, Homo sapiens
cuguuccucaa

SEQ ID NO: 1085497 - RNA, 11 nt, Homo sapiens
cuguuccugcc

SEQ ID NO: 1085498 - RNA, 18 nt, Homo sapiens
cuguuucaugagcccaaa

SEQ ID NO: 1085499 - RNA, 15 nt, Homo sapiens
cuuaaaaaucuuggu

SEQ ID NO: 1085500 - RNA, 19 nt, Homo sapiens
cuuaaagcacagucugaug

SEQ ID NO: 1085501 - RNA, 20 nt, Homo sapiens
cuuaaaguugacauuuaacu

SEQ ID NO: 1085502 - RNA, 17 nt, Homo sapiens
cuuaacucagccagaaa

SEQ ID NO: 1085503 - RNA, 17 nt, Homo sapiens
cuuacagucagcacaga

SEQ ID NO: 1085504 - RNA, 22 nt, Homo sapiens
cuuacauuuuucgacugugaac

SEQ ID NO: 1085505 - RNA, 17 nt, Homo sapiens
cuuacuaaugugcccca

SEQ ID NO: 1085506 - RNA, 15 nt, Homo sapiens
cuuacuuugugcaaa

SEQ ID NO: 1085507 - RNA, 18 nt, Homo sapiens
cuuagaauaaaauuguaa

SEQ ID NO: 1085508 - RNA, 14 nt, Homo sapiens
cuuaguuguuauca

SEQ ID NO: 1085509 - RNA, 21 nt, Homo sapiens
cuuauccugacacauuuucaa

SEQ ID NO: 1085510 - RNA, 22 nt, Homo sapiens
cuuaugacuccccccuuccaaa

SEQ ID NO: 1085511 - RNA, 21 nt, Homo sapiens
cuuauuguauuccucauguca

SEQ ID NO: 1085512 - RNA, 19 nt, Homo sapiens
cuucaauauuaaaugacuu

SEQ ID NO: 1085513 - RNA, 12 nt, Homo sapiens
cuucaccaccuc

SEQ ID NO: 1085514 - RNA, 15 nt, Homo sapiens
cuucacuaccaaaug

SEQ ID NO: 1085515 - RNA, 18 nt, Homo sapiens
cuucacugcagccuuuca

SEQ ID NO: 1085516 - RNA, 23 nt, Homo sapiens
cuucauagaugagaaaacugaga

SEQ ID NO: 1085517 - RNA, 13 nt, Homo sapiens
cuuccaaaucagg

SEQ ID NO: 1085518 - RNA, 20 nt, Homo sapiens
cuucccaaguagcugagauu

SEQ ID NO: 1085519 - RNA, 17 nt, Homo sapiens
cuucccacuuugccacu

SEQ ID NO: 1085520 - RNA, 23 nt, Homo sapiens
cuucccccaaggcugaugcauuc

SEQ ID NO: 1085521 - RNA, 18 nt, Homo sapiens
cuucucagagcagcacug

SEQ ID NO: 1085522 - RNA, 15 nt, Homo sapiens
cuucuccacagggac

SEQ ID NO: 1085523 - RNA, 17 nt, Homo sapiens
cuucuccccuccaagug

SEQ ID NO: 1085524 - RNA, 14 nt, Homo sapiens
cuucugaucuugga

SEQ ID NO: 1085525 - RNA, 17 nt, Homo sapiens
cuucugcauucacagcg

SEQ ID NO: 1085526 - RNA, 22 nt, Homo sapiens
cuugaaucaagucagcaacaga

SEQ ID NO: 1085527 - RNA, 16 nt, Homo sapiens
cuugagaaaaugcagg

SEQ ID NO: 1085528 - RNA, 18 nt, Homo sapiens
cuugagcuuggcagcuga

SEQ ID NO: 1085529 - RNA, 21 nt, Homo sapiens
cuugcauugaauuuagucauu

SEQ ID NO: 1085530 - RNA, 13 nt, Homo sapiens
cuugccagcauuu

SEQ ID NO: 1085531 - RNA, 18 nt, Homo sapiens
cuugccuuccugccuagu

SEQ ID NO: 1085532 - RNA, 10 nt, Homo sapiens
cuugcugaug

SEQ ID NO: 1085533 - RNA, 16 nt, Homo sapiens
cuuggacccaugacuc

SEQ ID NO: 1085534 - RNA, 20 nt, Homo sapiens
cuuggagacaaaaucuuaaa

SEQ ID NO: 1085535 - RNA, 16 nt, Homo sapiens
cuuguggcauauccau

SEQ ID NO: 1085536 - RNA, 23 nt, Homo sapiens
cuuguguguguguguugauccca

SEQ ID NO: 1085537 - RNA, 19 nt, Homo sapiens
cuuguugcccucugcaguu

SEQ ID NO: 1085538 - RNA, 18 nt, Homo sapiens
cuuuaauuuuuauaaaua

SEQ ID NO: 1085539 - RNA, 11 nt, Homo sapiens
cuuuacuugac

SEQ ID NO: 1085540 - RNA, 13 nt, Homo sapiens
cuuuauagcuuug

SEQ ID NO: 1085541 - RNA, 21 nt, Homo sapiens
cuuucacaggacucugcagau

SEQ ID NO: 1085542 - RNA, 14 nt, Homo sapiens
cuuucauacauuau

SEQ ID NO: 1085543 - RNA, 15 nt, Homo sapiens
cuuuccaaaaucagg

SEQ ID NO: 1085544 - RNA, 14 nt, Homo sapiens
cuuuccaauccuuu

SEQ ID NO: 1085545 - RNA, 15 nt, Homo sapiens
cuuuccucccaaagg

SEQ ID NO: 1085546 - RNA, 20 nt, Homo sapiens
cuuucuuuccaaaacauuuc

SEQ ID NO: 1085547 - RNA, 21 nt, Homo sapiens
cuuugaaguggcaccuaauaa

SEQ ID NO: 1085548 - RNA, 19 nt, Homo sapiens
cuuuggaugggucacuugu

SEQ ID NO: 1085549 - RNA, 13 nt, Homo sapiens
cuuuggcugcacg

SEQ ID NO: 1085550 - RNA, 17 nt, Homo sapiens
cuuuggcuucagaauug

SEQ ID NO: 1085551 - RNA, 20 nt, Homo sapiens
cuuuuaguuuuaaaacucuu

SEQ ID NO: 1085552 - RNA, 12 nt, Homo sapiens
cuuuuccugucu

SEQ ID NO: 1085553 - RNA, 15 nt, Homo sapiens
cuuuuccugucugua

SEQ ID NO: 1085554 - RNA, 18 nt, Homo sapiens
cuuuuuaaacaguguuua

SEQ ID NO: 1085555 - RNA, 20 nt, Homo sapiens
cuuuuucacuugggucucug

SEQ ID NO: 1085556 - RNA, 14 nt, Homo sapiens
gaaaaaaagcaaaa

SEQ ID NO: 1085557 - RNA, 13 nt, Homo sapiens
gaaaaaggcuucu

SEQ ID NO: 1085558 - RNA, 16 nt, Homo sapiens
gaaaaggauugcuuaa

SEQ ID NO: 1085559 - RNA, 13 nt, Homo sapiens
gaaaaguuuugua

SEQ ID NO: 1085560 - RNA, 20 nt, Homo sapiens
gaaacaaaaaaguguucccu

SEQ ID NO: 1085561 - RNA, 16 nt, Homo sapiens
gaaacaugaugugaga

SEQ ID NO: 1085562 - RNA, 19 nt, Homo sapiens
gaaacauuuggaagcccca

SEQ ID NO: 1085563 - RNA, 21 nt, Homo sapiens
gaaagaccaugugguuugcug

SEQ ID NO: 1085564 - RNA, 20 nt, Homo sapiens
gaaagacugaaagaauacau

SEQ ID NO: 1085565 - RNA, 18 nt, Homo sapiens
gaaagcaccgcagcaugu

SEQ ID NO: 1085566 - RNA, 17 nt, Homo sapiens
gaaaggauuuuaccaaa

SEQ ID NO: 1085567 - RNA, 17 nt, Homo sapiens
gaaaggccacucaggau

SEQ ID NO: 1085568 - RNA, 20 nt, Homo sapiens
gaaauccuaguggccuccca

SEQ ID NO: 1085569 - RNA, 18 nt, Homo sapiens
gaaaugagaaacuuugau

SEQ ID NO: 1085570 - RNA, 21 nt, Homo sapiens
gaaauguugacuggccaaaaa

SEQ ID NO: 1085571 - RNA, 22 nt, Homo sapiens
gaaauguugacuggccaaaaau

SEQ ID NO: 1085572 - RNA, 20 nt, Homo sapiens
gaaauucaaccugugucuua

SEQ ID NO: 1085573 - RNA, 20 nt, Homo sapiens
gaaauuuuuuuccagaauug

SEQ ID NO: 1085574 - RNA, 12 nt, Homo sapiens
gaacaaauacac

SEQ ID NO: 1085575 - RNA, 14 nt, Homo sapiens
gaacaaugcuauaa

SEQ ID NO: 1085576 - RNA, 13 nt, Homo sapiens
gaacacacugaga

SEQ ID NO: 1085577 - RNA, 19 nt, Homo sapiens
gaacacacugagacuugaa

SEQ ID NO: 1085578 - RNA, 13 nt, Homo sapiens
gaacacagugccu

SEQ ID NO: 1085579 - RNA, 22 nt, Homo sapiens
ccaaaaagauuuauuaauuaaa

SEQ ID NO: 1085580 - RNA, 13 nt, Homo sapiens
ccaaaauguuaau

SEQ ID NO: 1085581 - RNA, 12 nt, Homo sapiens
ccaaacacccuc

SEQ ID NO: 1085582 - RNA, 12 nt, Homo sapiens
ccaaacacuggg

SEQ ID NO: 1085583 - RNA, 23 nt, Homo sapiens
ccaaacagugggagggaauuccu

SEQ ID NO: 1085584 - RNA, 20 nt, Homo sapiens
ccaaagagucucuggcucag

SEQ ID NO: 1085585 - RNA, 13 nt, Homo sapiens
ccaaagcaucaau

SEQ ID NO: 1085586 - RNA, 22 nt, Homo sapiens
ccaaagcaucaauacaaccagc

SEQ ID NO: 1085587 - RNA, 20 nt, Homo sapiens
ccaaaggcauccauagugca

SEQ ID NO: 1085588 - RNA, 22 nt, Homo sapiens
ccaacuccucuagucagcacua

SEQ ID NO: 1085589 - RNA, 16 nt, Homo sapiens
ccaagaaguaacaaaa

SEQ ID NO: 1085590 - RNA, 20 nt, Homo sapiens
ccaaggcaguucuguguccu

SEQ ID NO: 1085591 - RNA, 18 nt, Homo sapiens
ccaaggucucacacuccu

SEQ ID NO: 1085592 - RNA, 17 nt, Homo sapiens
ccaagguuucccaguga

SEQ ID NO: 1085593 - RNA, 15 nt, Homo sapiens
ccaaguagcugagau

SEQ ID NO: 1085594 - RNA, 18 nt, Homo sapiens
ccaaguccacaguggaac

SEQ ID NO: 1085595 - RNA, 16 nt, Homo sapiens
ccaagugccaauauuu

SEQ ID NO: 1085596 - RNA, 21 nt, Homo sapiens
ccaauacguagauuuuugcuc

SEQ ID NO: 1085597 - RNA, 20 nt, Homo sapiens
ccaaugaagcaaacacacag

SEQ ID NO: 1085598 - RNA, 15 nt, Homo sapiens
ccaauugcugccaau

SEQ ID NO: 1085599 - RNA, 13 nt, Homo sapiens
ccacaccaucucc

SEQ ID NO: 1085600 - RNA, 17 nt, Homo sapiens
ccacauaugcaaugacu

SEQ ID NO: 1085601 - RNA, 12 nt, Homo sapiens
ccacccuaucau

SEQ ID NO: 1085602 - RNA, 23 nt, Homo sapiens
ccaccgguguccuguuccugcca

SEQ ID NO: 1085603 - RNA, 16 nt, Homo sapiens
ccaccuggauucccug

SEQ ID NO: 1085604 - RNA, 18 nt, Homo sapiens
ccacguccugucagugcc

SEQ ID NO: 1085605 - RNA, 16 nt, Homo sapiens
ccacgugcacagcuuc

SEQ ID NO: 1085606 - RNA, 15 nt, Homo sapiens
ccacuccaccuccac

SEQ ID NO: 1085607 - RNA, 20 nt, Homo sapiens
ccacugcacccccuccugcu

SEQ ID NO: 1085608 - RNA, 15 nt, Homo sapiens
ccacuguguauuuaa

SEQ ID NO: 1085609 - RNA, 15 nt, Homo sapiens
ccacuguuucaugag

SEQ ID NO: 1085610 - RNA, 17 nt, Homo sapiens
ccacuuauuuccaugga

SEQ ID NO: 1085611 - RNA, 14 nt, Homo sapiens
ccagaaaagcaaua

SEQ ID NO: 1085612 - RNA, 19 nt, Homo sapiens
ccagagcuguggacuuugu

SEQ ID NO: 1085613 - RNA, 15 nt, Homo sapiens
ccagaugugggcuca

SEQ ID NO: 1085614 - RNA, 21 nt, Homo sapiens
ccagcaagaugaaacagggca

SEQ ID NO: 1085615 - RNA, 12 nt, Homo sapiens
ccagcacuuugg

SEQ ID NO: 1085616 - RNA, 13 nt, Homo sapiens
ccagccagcuccu

SEQ ID NO: 1085617 - RNA, 20 nt, Homo sapiens
ccagccguauuuuacaugaa

SEQ ID NO: 1085618 - RNA, 14 nt, Homo sapiens
ccagccugccccag

SEQ ID NO: 1085619 - RNA, 15 nt, Homo sapiens
ccagccuggccaaca

SEQ ID NO: 1085620 - RNA, 19 nt, Homo sapiens
ccagccuggccaccagcuu

SEQ ID NO: 1085621 - RNA, 22 nt, Homo sapiens
ccagcgcuggcuccaggcuccu

SEQ ID NO: 1085622 - RNA, 12 nt, Homo sapiens
ccagcugaccug

SEQ ID NO: 1085623 - RNA, 19 nt, Homo sapiens
ccagcugaccugguacuga

SEQ ID NO: 1085624 - RNA, 16 nt, Homo sapiens
ccagcugcaccugcca

SEQ ID NO: 1085625 - RNA, 21 nt, Homo sapiens
ccagcuuguuugugaaacaaa

SEQ ID NO: 1085626 - RNA, 20 nt, Homo sapiens
ccaggcgggcggcacgccaa

SEQ ID NO: 1085627 - RNA, 17 nt, Homo sapiens
ccaggcuagagugcagu

SEQ ID NO: 1085628 - RNA, 20 nt, Homo sapiens
ccaggcuagagugcaguggc

SEQ ID NO: 1085629 - RNA, 22 nt, Homo sapiens
ccaggcugcugcauggcacuga

SEQ ID NO: 1085630 - RNA, 17 nt, Homo sapiens
ccaggcuggagugcaau

SEQ ID NO: 1085631 - RNA, 19 nt, Homo sapiens
ccaggcuggagugcaaugg

SEQ ID NO: 1085632 - RNA, 20 nt, Homo sapiens
ccaggcuggagugcaauggc

SEQ ID NO: 1085633 - RNA, 18 nt, Homo sapiens
ccagggccucugugcaga

SEQ ID NO: 1085634 - RNA, 15 nt, Homo sapiens
ccaggggagcaguaa

SEQ ID NO: 1085635 - RNA, 16 nt, Homo sapiens
ccagguguguucagua

SEQ ID NO: 1085636 - RNA, 13 nt, Homo sapiens
ccaguaaaaucaa

SEQ ID NO: 1085637 - RNA, 12 nt, Homo sapiens
ccagucccucag

SEQ ID NO: 1085638 - RNA, 17 nt, Homo sapiens
ccaguccuuuguugcug

SEQ ID NO: 1085639 - RNA, 11 nt, Homo sapiens
ccaguuuccaa

SEQ ID NO: 1085640 - RNA, 12 nt, Homo sapiens
ccauaauuguuc

SEQ ID NO: 1085641 - RNA, 11 nt, Homo sapiens
ccauaccagcu

SEQ ID NO: 1085642 - RNA, 13 nt, Homo sapiens
ccauagcugguua

SEQ ID NO: 1085643 - RNA, 16 nt, Homo sapiens
ccauauucuaaauuca

SEQ ID NO: 1085644 - RNA, 15 nt, Homo sapiens
ccauauugcucuuaa

SEQ ID NO: 1085645 - RNA, 18 nt, Homo sapiens
ccaucuccucccaccagu

SEQ ID NO: 1085646 - RNA, 23 nt, Homo sapiens
ccaugauacuuuaauuuuuauaa

SEQ ID NO: 1085647 - RNA, 15 nt, Homo sapiens
ccaugguagacugug

SEQ ID NO: 1085648 - RNA, 18 nt, Homo sapiens
ccaugguagacugugaca

SEQ ID NO: 1085649 - RNA, 17 nt, Homo sapiens
ccauugcaugaauucac

SEQ ID NO: 1085650 - RNA, 18 nt, Homo sapiens
ccauuucuacucuuaaau

SEQ ID NO: 1085651 - RNA, 14 nt, Homo sapiens
ccauuuuacuucca

SEQ ID NO: 1085652 - RNA, 15 nt, Homo sapiens
cccaaaggcauccau

SEQ ID NO: 1085653 - RNA, 20 nt, Homo sapiens
cccaaccuguccuuacucag

SEQ ID NO: 1085654 - RNA, 12 nt, Homo sapiens
cccaacugugau

SEQ ID NO: 1085655 - RNA, 12 nt, Homo sapiens
cccaagccacag

SEQ ID NO: 1085656 - RNA, 17 nt, Homo sapiens
cccaaggcugaugcauu

SEQ ID NO: 1085657 - RNA, 15 nt, Homo sapiens
cccacgucucucugc

SEQ ID NO: 1085658 - RNA, 15 nt, Homo sapiens
cccacgugcacagcu

SEQ ID NO: 1085659 - RNA, 13 nt, Homo sapiens
cccagcacuuugg

SEQ ID NO: 1085660 - RNA, 19 nt, Homo sapiens
cccagccugccccagccuc

SEQ ID NO: 1085661 - RNA, 13 nt, Homo sapiens
cccagccuggcca

SEQ ID NO: 1085662 - RNA, 14 nt, Homo sapiens
cccaggaguuugag

SEQ ID NO: 1085663 - RNA, 18 nt, Homo sapiens
cccaggauugugcaauag

SEQ ID NO: 1085664 - RNA, 19 nt, Homo sapiens
cccaggcuggaguacagug

SEQ ID NO: 1085665 - RNA, 16 nt, Homo sapiens
cccagggccuccagga

SEQ ID NO: 1085666 - RNA, 13 nt, Homo sapiens
cccaguaaaauca

SEQ ID NO: 1085667 - RNA, 17 nt, Homo sapiens
cccagugacaacaucgc

SEQ ID NO: 1085668 - RNA, 18 nt, Homo sapiens
cccaugguagacugugac

SEQ ID NO: 1085669 - RNA, 21 nt, Homo sapiens
cccaugguagacugugacaca

SEQ ID NO: 1085670 - RNA, 24 nt, Homo sapiens
ccccagagccacuaccuuugucca

SEQ ID NO: 1085671 - RNA, 15 nt, Homo sapiens
ccccagcccuuugca

SEQ ID NO: 1085672 - RNA, 24 nt, Homo sapiens
ccccagcugaccugguacugaggu

SEQ ID NO: 1085673 - RNA, 15 nt, Homo sapiens
ccccauccuggccca

SEQ ID NO: 1085674 - RNA, 18 nt, Homo sapiens
cccccaauugcugccaau

SEQ ID NO: 1085675 - RNA, 15 nt, Homo sapiens
cccccaccuuuggga

SEQ ID NO: 1085676 - RNA, 17 nt, Homo sapiens
ccccucagugguuuccu

SEQ ID NO: 1085677 - RNA, 20 nt, Homo sapiens
ccccucccagcugacagucc

SEQ ID NO: 1085678 - RNA, 21 nt, Homo sapiens
ccccucccagcugacaguccu

SEQ ID NO: 1085679 - RNA, 17 nt, Homo sapiens
ccccuggacauauuccc

SEQ ID NO: 1085680 - RNA, 23 nt, Homo sapiens
ccccuguggucacuuauccugac

SEQ ID NO: 1085681 - RNA, 22 nt, Homo sapiens
cccgcaggcagccccacacccg

SEQ ID NO: 1085682 - RNA, 17 nt, Homo sapiens
cccguccaaaaagaaga

SEQ ID NO: 1085683 - RNA, 19 nt, Homo sapiens
cccuacccccaguaaaauc

SEQ ID NO: 1085684 - RNA, 19 nt, Homo sapiens
cccuccaagaggcuggaaa

SEQ ID NO: 1085685 - RNA, 14 nt, Homo sapiens
cccucccagugaga

SEQ ID NO: 1085686 - RNA, 16 nt, Homo sapiens
cccugaagucuugcau

SEQ ID NO: 1085687 - RNA, 15 nt, Homo sapiens
cccuggccuaaagaa

SEQ ID NO: 1085688 - RNA, 14 nt, Homo sapiens
cccuguaugauucc

SEQ ID NO: 1085689 - RNA, 14 nt, Homo sapiens
cccuguucuuugaa

SEQ ID NO: 1085690 - RNA, 21 nt, Homo sapiens
cccuguucuuugaaguggcac

SEQ ID NO: 1085691 - RNA, 13 nt, Homo sapiens
cccuuucauacaa

SEQ ID NO: 1085692 - RNA, 19 nt, Homo sapiens
cccuuuucuguauguccuu

SEQ ID NO: 1085693 - RNA, 18 nt, Homo sapiens
cccuuuuuuuacauuuca

SEQ ID NO: 1085694 - RNA, 21 nt, Homo sapiens
ccgauaucaaaaagacugugg

SEQ ID NO: 1085695 - RNA, 21 nt, Homo sapiens
gccaggcuguaagcauucuga

SEQ ID NO: 1085696 - RNA, 18 nt, Homo sapiens
gccagggcccugcagagg

SEQ ID NO: 1085697 - RNA, 13 nt, Homo sapiens
gccaggugcagug

SEQ ID NO: 1085698 - RNA, 20 nt, Homo sapiens
gccaucuccucccaccagug

SEQ ID NO: 1085699 - RNA, 19 nt, Homo sapiens
auguugacuggccaaaaau

SEQ ID NO: 1085700 - RNA, 18 nt, Homo sapiens
auuaaucaaggcauaaaa

SEQ ID NO: 1085701 - RNA, 15 nt, Homo sapiens
auuaauuaaaccaga

SEQ ID NO: 1085702 - RNA, 20 nt, Homo sapiens
auuacccccuuuccucuugg

SEQ ID NO: 1085703 - RNA, 24 nt, Homo sapiens
auuacccuuccucaucugugccug

SEQ ID NO: 1085704 - RNA, 19 nt, Homo sapiens
auuacgaucccccaagugu

SEQ ID NO: 1085705 - RNA, 14 nt, Homo sapiens
auuagaaugcaugu

SEQ ID NO: 1085706 - RNA, 17 nt, Homo sapiens
auuagaaugcauguaag

SEQ ID NO: 1085707 - RNA, 19 nt, Homo sapiens
auuagugaauuacacucaa

SEQ ID NO: 1085708 - RNA, 20 nt, Homo sapiens
auuauuuuuguuagcaaaga

SEQ ID NO: 1085709 - RNA, 13 nt, Homo sapiens
auucaggagcuca

SEQ ID NO: 1085710 - RNA, 19 nt, Homo sapiens
auucagguauuuguaauag

SEQ ID NO: 1085711 - RNA, 17 nt, Homo sapiens
auucaugcaacuugauu

SEQ ID NO: 1085712 - RNA, 19 nt, Homo sapiens
auucaugcaacuugauucu

SEQ ID NO: 1085713 - RNA, 13 nt, Homo sapiens
auuccaagucaac

SEQ ID NO: 1085714 - RNA, 14 nt, Homo sapiens
auuccaugcacucu

SEQ ID NO: 1085715 - RNA, 18 nt, Homo sapiens
auuccauuuuacuuccau

SEQ ID NO: 1085716 - RNA, 19 nt, Homo sapiens
auuccauuuuacuuccaug

SEQ ID NO: 1085717 - RNA, 21 nt, Homo sapiens
auuccauuuuacuuccaugau

SEQ ID NO: 1085718 - RNA, 15 nt, Homo sapiens
auuccuaaugcauua

SEQ ID NO: 1085719 - RNA, 13 nt, Homo sapiens
auuccugcugccu

SEQ ID NO: 1085720 - RNA, 21 nt, Homo sapiens
auuccuucacauaguuugaua

SEQ ID NO: 1085721 - RNA, 14 nt, Homo sapiens
auucuacacauaua

SEQ ID NO: 1085722 - RNA, 19 nt, Homo sapiens
auucucucuaacauaacaa

SEQ ID NO: 1085723 - RNA, 12 nt, Homo sapiens
auucucucugcu

SEQ ID NO: 1085724 - RNA, 19 nt, Homo sapiens
auucuucucgacuucagga

SEQ ID NO: 1085725 - RNA, 20 nt, Homo sapiens
auugagggcuaaaucccaag

SEQ ID NO: 1085726 - RNA, 16 nt, Homo sapiens
auugauggagccugaa

SEQ ID NO: 1085727 - RNA, 20 nt, Homo sapiens
auugcaugaauucacaaaca

SEQ ID NO: 1085728 - RNA, 20 nt, Homo sapiens
auugcuccauuuucuuguca

SEQ ID NO: 1085729 - RNA, 13 nt, Homo sapiens
auuggcacaagcu

SEQ ID NO: 1085730 - RNA, 15 nt, Homo sapiens
auuggcccaacaaga

SEQ ID NO: 1085731 - RNA, 22 nt, Homo sapiens
auuggucaagaaaagcaugaaa

SEQ ID NO: 1085732 - RNA, 16 nt, Homo sapiens
auuguaucuguuuaga

SEQ ID NO: 1085733 - RNA, 19 nt, Homo sapiens
auuguauuucuucaucccu

SEQ ID NO: 1085734 - RNA, 24 nt, Homo sapiens
auuguuaggagaugucaucaagcu

SEQ ID NO: 1085735 - RNA, 12 nt, Homo sapiens
auuuaacuugag

SEQ ID NO: 1085736 - RNA, 15 nt, Homo sapiens
auuuagugucuugaa

SEQ ID NO: 1085737 - RNA, 13 nt, Homo sapiens
auuuauuuaugua

SEQ ID NO: 1085738 - RNA, 23 nt, Homo sapiens
auuucauacaacagaaaccagaa

SEQ ID NO: 1085739 - RNA, 16 nt, Homo sapiens
auuucuaaaacauuaa

SEQ ID NO: 1085740 - RNA, 19 nt, Homo sapiens
auuucuaacauaaguaaga

SEQ ID NO: 1085741 - RNA, 17 nt, Homo sapiens
auuucucuacugucuca

SEQ ID NO: 1085742 - RNA, 21 nt, Homo sapiens
auuucugauauaacaaacuac

SEQ ID NO: 1085743 - RNA, 23 nt, Homo sapiens
auuucuuucuuugcaccaaagac

SEQ ID NO: 1085744 - RNA, 20 nt, Homo sapiens
auuuguauaaugguguuacu

SEQ ID NO: 1085745 - RNA, 18 nt, Homo sapiens
auuuuaaauaaagacaaa

SEQ ID NO: 1085746 - RNA, 14 nt, Homo sapiens
auuuuaauuaucuu

SEQ ID NO: 1085747 - RNA, 20 nt, Homo sapiens
auuuuaauugauuauucuga

SEQ ID NO: 1085748 - RNA, 19 nt, Homo sapiens
auuuuaccaaagcaucaau

SEQ ID NO: 1085749 - RNA, 13 nt, Homo sapiens
auuuuacuuccau

SEQ ID NO: 1085750 - RNA, 21 nt, Homo sapiens
cucaggccagucacccuguga

SEQ ID NO: 1085751 - RNA, 17 nt, Homo sapiens
cucaggcuuccuuggca

SEQ ID NO: 1085752 - RNA, 15 nt, Homo sapiens
cucagguaguacugg

SEQ ID NO: 1085753 - RNA, 19 nt, Homo sapiens
cucaguagcugauucugaa

SEQ ID NO: 1085754 - RNA, 13 nt, Homo sapiens
cucagugaucuca

SEQ ID NO: 1085755 - RNA, 18 nt, Homo sapiens
cucagugaucucacuuaa

SEQ ID NO: 1085756 - RNA, 13 nt, Homo sapiens
cucauacagaaag

SEQ ID NO: 1085757 - RNA, 13 nt, Homo sapiens
cucauaucaaucc

SEQ ID NO: 1085758 - RNA, 14 nt, Homo sapiens
cucaucccaaaagc

SEQ ID NO: 1085759 - RNA, 17 nt, Homo sapiens
cucaucccuguuccuca

SEQ ID NO: 1085760 - RNA, 21 nt, Homo sapiens
cucaugcaagacuucacugca

SEQ ID NO: 1085761 - RNA, 21 nt, Homo sapiens
cucauguugggagugagaaug

SEQ ID NO: 1085762 - RNA, 17 nt, Homo sapiens
cucauuagcugaauuga

SEQ ID NO: 1085763 - RNA, 21 nt, Homo sapiens
cuccaccuuguuacacauuau

SEQ ID NO: 1085764 - RNA, 19 nt, Homo sapiens
cuccaggcuccucaugagg

SEQ ID NO: 1085765 - RNA, 11 nt, Homo sapiens
cucccaaagug

SEQ ID NO: 1085766 - RNA, 19 nt, Homo sapiens
cucccaaagugcugggauu

SEQ ID NO: 1085767 - RNA, 15 nt, Homo sapiens
cucccacagugacuc

SEQ ID NO: 1085768 - RNA, 22 nt, Homo sapiens
cucccagcuuucugugugcaca

SEQ ID NO: 1085769 - RNA, 20 nt, Homo sapiens
cuccccacaggggggaggca

SEQ ID NO: 1085770 - RNA, 13 nt, Homo sapiens
cuccccaccuuca

SEQ ID NO: 1085771 - RNA, 21 nt, Homo sapiens
cuccccagcccuuugcaggcc

SEQ ID NO: 1085772 - RNA, 16 nt, Homo sapiens
cuccccugauccagac

SEQ ID NO: 1085773 - RNA, 18 nt, Homo sapiens
cucccucucuugccgaca

SEQ ID NO: 1085774 - RNA, 13 nt, Homo sapiens
cuccgccauucca

SEQ ID NO: 1085775 - RNA, 15 nt, Homo sapiens
cuccguguagugucu

SEQ ID NO: 1085776 - RNA, 19 nt, Homo sapiens
cuccucaugaggccaugca

SEQ ID NO: 1085777 - RNA, 22 nt, Homo sapiens
cuccucauucagaccaaucuua

SEQ ID NO: 1085778 - RNA, 18 nt, Homo sapiens
cuccucggcagaugcugu

SEQ ID NO: 1085779 - RNA, 17 nt, Homo sapiens
cuccugaccucgugauu

SEQ ID NO: 1085780 - RNA, 16 nt, Homo sapiens
cuccugcucauugugg

SEQ ID NO: 1085781 - RNA, 23 nt, Homo sapiens
cuccuggaaaggcucagucucag

SEQ ID NO: 1085782 - RNA, 14 nt, Homo sapiens
cuccuggccucaua

SEQ ID NO: 1085783 - RNA, 14 nt, Homo sapiens
cuccugggauuuuc

SEQ ID NO: 1085784 - RNA, 19 nt, Homo sapiens
cuccugggauuuucauuag

SEQ ID NO: 1085785 - RNA, 13 nt, Homo sapiens
cuccuuagacuga

SEQ ID NO: 1085786 - RNA, 22 nt, Homo sapiens
cuccuuuugguuccucacauau

SEQ ID NO: 1085787 - RNA, 18 nt, Homo sapiens
cucggcaccagugccuca

SEQ ID NO: 1085788 - RNA, 21 nt, Homo sapiens
cucguccaaggcaguucugug

SEQ ID NO: 1085789 - RNA, 12 nt, Homo sapiens
cucuauggauua

SEQ ID NO: 1085790 - RNA, 13 nt, Homo sapiens
cucuccacuccau

SEQ ID NO: 1085791 - RNA, 13 nt, Homo sapiens
cucuccaugcaag

SEQ ID NO: 1085792 - RNA, 17 nt, Homo sapiens
cucucccacgugcacag

SEQ ID NO: 1085793 - RNA, 17 nt, Homo sapiens
cucucggcuucaccagg

SEQ ID NO: 1085794 - RNA, 13 nt, Homo sapiens
cucucucucucuu

SEQ ID NO: 1085795 - RNA, 11 nt, Homo sapiens
cucugagauuu

SEQ ID NO: 1085796 - RNA, 16 nt, Homo sapiens
cucugcaguugaucuc

SEQ ID NO: 1085797 - RNA, 19 nt, Homo sapiens
cucugccagccacauccaa

SEQ ID NO: 1085798 - RNA, 19 nt, Homo sapiens
cucugcucagugaucucac

SEQ ID NO: 1085799 - RNA, 12 nt, Homo sapiens
cucugcuuccug

SEQ ID NO: 1085800 - RNA, 20 nt, Homo sapiens
cucugcuuccugagcugucc

SEQ ID NO: 1085801 - RNA, 19 nt, Homo sapiens
cucuggccuccaaguccac

SEQ ID NO: 1085802 - RNA, 13 nt, Homo sapiens
cucuguccugacu

SEQ ID NO: 1085803 - RNA, 18 nt, Homo sapiens
cucuuccugucuuaccaa

SEQ ID NO: 1085804 - RNA, 17 nt, Homo sapiens
cugaaagucaugcacau

SEQ ID NO: 1085805 - RNA, 21 nt, Homo sapiens
cugaaaguugucacccuggaa

SEQ ID NO: 1085806 - RNA, 17 nt, Homo sapiens
cugaacagugcucugcc

SEQ ID NO: 1085807 - RNA, 14 nt, Homo sapiens
cugaacauugcacu

SEQ ID NO: 1085808 - RNA, 23 nt, Homo sapiens
cugaacuggccacuccccagugc

SEQ ID NO: 1085809 - RNA, 14 nt, Homo sapiens
cugaagaccuccac

SEQ ID NO: 1085810 - RNA, 22 nt, Homo sapiens
cugaaguuagggaugacuguga

SEQ ID NO: 1085811 - RNA, 23 nt, Homo sapiens
cugaauauuaagaaacaauuuaa

SEQ ID NO: 1085812 - RNA, 14 nt, Homo sapiens
cugacagaaaugca

SEQ ID NO: 1085813 - RNA, 20 nt, Homo sapiens
cugacagaaaugcaaucucc

SEQ ID NO: 1085814 - RNA, 19 nt, Homo sapiens
cugacccagugugugcuca

SEQ ID NO: 1085815 - RNA, 17 nt, Homo sapiens
cugacgccuacuggggc

SEQ ID NO: 1085816 - RNA, 18 nt, Homo sapiens
cugacuuucucuucuaca

SEQ ID NO: 1085817 - RNA, 18 nt, Homo sapiens
cugagacuuucagugcac

SEQ ID NO: 1085818 - RNA, 19 nt, Homo sapiens
cugagcucgugaucugccc

SEQ ID NO: 1085819 - RNA, 14 nt, Homo sapiens
cugaggaguggagu

SEQ ID NO: 1085820 - RNA, 17 nt, Homo sapiens
cugaggaguguccuguc

SEQ ID NO: 1085821 - RNA, 19 nt, Homo sapiens
cugagguugggcugagacc

SEQ ID NO: 1085822 - RNA, 21 nt, Homo sapiens
cugaguagcagugauuguuau

SEQ ID NO: 1085823 - RNA, 15 nt, Homo sapiens
cugagugcaccacuu

SEQ ID NO: 1085824 - RNA, 22 nt, Homo sapiens
cugagugcaccacuucaaguga

SEQ ID NO: 1085825 - RNA, 16 nt, Homo sapiens
cugauccagacaagug

SEQ ID NO: 1085826 - RNA, 18 nt, Homo sapiens
cugauguuuaaaagucca

SEQ ID NO: 1085827 - RNA, 14 nt, Homo sapiens
cugcaacccuggug

SEQ ID NO: 1085828 - RNA, 22 nt, Homo sapiens
cugcaccgagagagauggaaua

SEQ ID NO: 1085829 - RNA, 17 nt, Homo sapiens
cugcacuaaaacccauc

SEQ ID NO: 1085830 - RNA, 23 nt, Homo sapiens
cugcagaggggaaaccaguguag

SEQ ID NO: 1085831 - RNA, 17 nt, Homo sapiens
gcaaggccucugccccu

SEQ ID NO: 1085832 - RNA, 14 nt, Homo sapiens
gcaaucauuuuaua

SEQ ID NO: 1085833 - RNA, 18 nt, Homo sapiens
gcaaugcuucugccucag

SEQ ID NO: 1085834 - RNA, 20 nt, Homo sapiens
gcaauggcacgaucucagcu

SEQ ID NO: 1085835 - RNA, 14 nt, Homo sapiens
gcacagaccucaga

SEQ ID NO: 1085836 - RNA, 21 nt, Homo sapiens
gcacaguaauaugaaagccac

SEQ ID NO: 1085837 - RNA, 16 nt, Homo sapiens
gcacagucugaugaca

SEQ ID NO: 1085838 - RNA, 11 nt, Homo sapiens
gcaccaaagac

SEQ ID NO: 1085839 - RNA, 19 nt, Homo sapiens
gcaccacuguguauuuaac

SEQ ID NO: 1085840 - RNA, 14 nt, Homo sapiens
gcaccagaugggau

SEQ ID NO: 1085841 - RNA, 18 nt, Homo sapiens
gcaccagugccucagugc

SEQ ID NO: 1085842 - RNA, 24 nt, Homo sapiens
gcaccagugccucagugcugcaau

SEQ ID NO: 1085843 - RNA, 19 nt, Homo sapiens
gcaccgagagagauggaau

SEQ ID NO: 1085844 - RNA, 16 nt, Homo sapiens
gcaccuguacucagga

SEQ ID NO: 1085845 - RNA, 24 nt, Homo sapiens
gcacgucacccuccugagccucac

SEQ ID NO: 1085846 - RNA, 22 nt, Homo sapiens
gcacuaagucaugguccuggcu

SEQ ID NO: 1085847 - RNA, 12 nt, Homo sapiens
gcacuagcauuu

SEQ ID NO: 1085848 - RNA, 13 nt, Homo sapiens
gcacucagaggga

SEQ ID NO: 1085849 - RNA, 15 nt, Homo sapiens
gcagagcuuccucag

SEQ ID NO: 1085850 - RNA, 14 nt, Homo sapiens
gcagccugacccca

SEQ ID NO: 1085851 - RNA, 22 nt, Homo sapiens
gcaggaaaccccagcggcagau

SEQ ID NO: 1085852 - RNA, 14 nt, Homo sapiens
gcaggcagccccac

SEQ ID NO: 1085853 - RNA, 20 nt, Homo sapiens
gcaggcagccccacacccgc

SEQ ID NO: 1085854 - RNA, 16 nt, Homo sapiens
gcagugaacacacuca

SEQ ID NO: 1085855 - RNA, 17 nt, Homo sapiens
gcaguucccuacgugaa

SEQ ID NO: 1085856 - RNA, 13 nt, Homo sapiens
gcaucaaacauga

SEQ ID NO: 1085857 - RNA, 19 nt, Homo sapiens
gcauccaaggggccuggaa

SEQ ID NO: 1085858 - RNA, 15 nt, Homo sapiens
gcaugaaaacugaga

SEQ ID NO: 1085859 - RNA, 13 nt, Homo sapiens
gcaugacacucua

SEQ ID NO: 1085860 - RNA, 14 nt, Homo sapiens
gcaugugugugaug

SEQ ID NO: 1085861 - RNA, 14 nt, Homo sapiens
gcauucuagugcag

SEQ ID NO: 1085862 - RNA, 15 nt, Homo sapiens
gcauuuacucucuua

SEQ ID NO: 1085863 - RNA, 15 nt, Homo sapiens
gccaaacucugccag

SEQ ID NO: 1085864 - RNA, 23 nt, Homo sapiens
gccaacagccccccccuugaauc

SEQ ID NO: 1085865 - RNA, 21 nt, Homo sapiens
gccacaaccuuuuacauauuu

SEQ ID NO: 1085866 - RNA, 11 nt, Homo sapiens
gccacacuggg

SEQ ID NO: 1085867 - RNA, 13 nt, Homo sapiens
gccacacuuugaa

SEQ ID NO: 1085868 - RNA, 14 nt, Homo sapiens
gccacggcacucca

SEQ ID NO: 1085869 - RNA, 16 nt, Homo sapiens
gccacgucugugcucu

SEQ ID NO: 1085870 - RNA, 17 nt, Homo sapiens
gccacugcagcacagga

SEQ ID NO: 1085871 - RNA, 22 nt, Homo sapiens
gccaguacagagaaauucugug

SEQ ID NO: 1085872 - RNA, 13 nt, Homo sapiens
gccagucccucag

SEQ ID NO: 1085873 - RNA, 18 nt, Homo sapiens
gccauauucacaccucac

SEQ ID NO: 1085874 - RNA, 22 nt, Homo sapiens
gccaugauaacugcaauuuuaa

SEQ ID NO: 1085875 - RNA, 13 nt, Homo sapiens
gcccaaagucauu

SEQ ID NO: 1085876 - RNA, 15 nt, Homo sapiens
gcccagccacugcag

SEQ ID NO: 1085877 - RNA, 17 nt, Homo sapiens
gcccaggccaucuucca

SEQ ID NO: 1085878 - RNA, 16 nt, Homo sapiens
gcccaugggcacugcu

SEQ ID NO: 1085879 - RNA, 20 nt, Homo sapiens
gcccauucuaaacuccuuuc

SEQ ID NO: 1085880 - RNA, 15 nt, Homo sapiens
gccccaacugugauc

SEQ ID NO: 1085881 - RNA, 16 nt, Homo sapiens
gccccauuugccagau

SEQ ID NO: 1085882 - RNA, 14 nt, Homo sapiens
gccccccacuuuuu

SEQ ID NO: 1085883 - RNA, 20 nt, Homo sapiens
gccccucagugguuuccucg

SEQ ID NO: 1085884 - RNA, 17 nt, Homo sapiens
gcccgaccccaucucau

SEQ ID NO: 1085885 - RNA, 22 nt, Homo sapiens
gcccggugaggccaagguuucc

SEQ ID NO: 1085886 - RNA, 15 nt, Homo sapiens
gcccuaguugugauc

SEQ ID NO: 1085887 - RNA, 18 nt, Homo sapiens
gccgguaccagccugacu

SEQ ID NO: 1085888 - RNA, 19 nt, Homo sapiens
gccuccagugggaggacag

SEQ ID NO: 1085889 - RNA, 16 nt, Homo sapiens
gccucccacagugacu

SEQ ID NO: 1085890 - RNA, 15 nt, Homo sapiens
gccuccugcaccgag

SEQ ID NO: 1085891 - RNA, 18 nt, Homo sapiens
gccuccuucuuaacucug

SEQ ID NO: 1085892 - RNA, 18 nt, Homo sapiens
gccucugugucacuggcu

SEQ ID NO: 1085893 - RNA, 15 nt, Homo sapiens
gccuggccaccagcu

SEQ ID NO: 1085894 - RNA, 20 nt, Homo sapiens
gccuguaaucccagcacuuu

SEQ ID NO: 1085895 - RNA, 15 nt, Homo sapiens
gccugucguguccag

SEQ ID NO: 1085896 - RNA, 17 nt, Homo sapiens
gccuuccugccuagucu

SEQ ID NO: 1085897 - RNA, 22 nt, Homo sapiens
gccuucuccacagggacacagu

SEQ ID NO: 1085898 - RNA, 21 nt, Homo sapiens
gccuuugccccggcuugccug

SEQ ID NO: 1085899 - RNA, 17 nt, Homo sapiens
gcgagcugcucugcuau

SEQ ID NO: 1085900 - RNA, 20 nt, Homo sapiens
gcgccacggcacuccagccu

SEQ ID NO: 1085901 - RNA, 16 nt, Homo sapiens
gcgccucuccacuguu

SEQ ID NO: 1085902 - RNA, 20 nt, Homo sapiens
gcguaggagagaacagggau

SEQ ID NO: 1085903 - RNA, 21 nt, Homo sapiens
gcgucagaccaguacugggaa

SEQ ID NO: 1085904 - RNA, 20 nt, Homo sapiens
gcgucgcuggacaacccaga

SEQ ID NO: 1085905 - RNA, 19 nt, Homo sapiens
gcgugguggcgggcaccua

SEQ ID NO: 1085906 - RNA, 18 nt, Homo sapiens
gcuaaaucccaagugucu

SEQ ID NO: 1085907 - RNA, 20 nt, Homo sapiens
gcuaaaucccaagugucucu

SEQ ID NO: 1085908 - RNA, 15 nt, Homo sapiens
gcuacacuugcaccu

SEQ ID NO: 1085909 - RNA, 21 nt, Homo sapiens
gcuacuuuucagaauugaagg

SEQ ID NO: 1085910 - RNA, 19 nt, Homo sapiens
gcuagagugcaguggcaug

SEQ ID NO: 1085911 - RNA, 17 nt, Homo sapiens
gcuagcauuaccacuuc

SEQ ID NO: 1085912 - RNA, 17 nt, Homo sapiens
gcuaugcaugucugacc

SEQ ID NO: 1085913 - RNA, 21 nt, Homo sapiens
gcucaagucacuuuuauuuga

SEQ ID NO: 1085914 - RNA, 13 nt, Homo sapiens
gcucacucuucca

SEQ ID NO: 1085915 - RNA, 16 nt, Homo sapiens
gcucagagcugcugag

SEQ ID NO: 1085916 - RNA, 14 nt, Homo sapiens
gcucagugaucuca

SEQ ID NO: 1085917 - RNA, 14 nt, Homo sapiens
uuauagguuuccac

SEQ ID NO: 1085918 - RNA, 14 nt, Homo sapiens
uuauccugacacau

SEQ ID NO: 1085919 - RNA, 20 nt, Homo sapiens
uuauuaaauguagaaaguga

SEQ ID NO: 1085920 - RNA, 16 nt, Homo sapiens
uuauuaauuaaaccag

SEQ ID NO: 1085921 - RNA, 13 nt, Homo sapiens
uuauuguauauau

SEQ ID NO: 1085922 - RNA, 14 nt, Homo sapiens
uuauugugccucag

SEQ ID NO: 1085923 - RNA, 20 nt, Homo sapiens
uucaagugaguggcaugugg

SEQ ID NO: 1085924 - RNA, 18 nt, Homo sapiens
uucaaguuagcucaggag

SEQ ID NO: 1085925 - RNA, 23 nt, Homo sapiens
uucacaccucacgcucuggacau

SEQ ID NO: 1085926 - RNA, 15 nt, Homo sapiens
uucacauaguuugau

SEQ ID NO: 1085927 - RNA, 16 nt, Homo sapiens
uucacaucagcuuuag

SEQ ID NO: 1085928 - RNA, 13 nt, Homo sapiens
uucacauuuugcc

SEQ ID NO: 1085929 - RNA, 20 nt, Homo sapiens
uucaccguauuagccaggau

SEQ ID NO: 1085930 - RNA, 18 nt, Homo sapiens
uucagggaauuucaggaa

SEQ ID NO: 1085931 - RNA, 18 nt, Homo sapiens
uucaggggacuguucuca

SEQ ID NO: 1085932 - RNA, 13 nt, Homo sapiens
uucauacaauggc

SEQ ID NO: 1085933 - RNA, 14 nt, Homo sapiens
uucaucaugacaac

SEQ ID NO: 1085934 - RNA, 10 nt, Homo sapiens
uucauugugu

SEQ ID NO: 1085935 - RNA, 11 nt, Homo sapiens
uuccaaaaaga

SEQ ID NO: 1085936 - RNA, 23 nt, Homo sapiens
uuccaaggguaugggaagccaua

SEQ ID NO: 1085937 - RNA, 17 nt, Homo sapiens
uuccaagucaacacucu

SEQ ID NO: 1085938 - RNA, 18 nt, Homo sapiens
uuccacuuugaguaccaa

SEQ ID NO: 1085939 - RNA, 20 nt, Homo sapiens
uuccagcuaagccugaugau

SEQ ID NO: 1085940 - RNA, 17 nt, Homo sapiens
uuccaugauacuuuaau

SEQ ID NO: 1085941 - RNA, 19 nt, Homo sapiens
uuccauuuuacuuccauga

SEQ ID NO: 1085942 - RNA, 24 nt, Homo sapiens
uucccacucccucucuugccgaca

SEQ ID NO: 1085943 - RNA, 16 nt, Homo sapiens
uucccacuuugccacu

SEQ ID NO: 1085944 - RNA, 17 nt, Homo sapiens
uuccccaaaggcaucca

SEQ ID NO: 1085945 - RNA, 23 nt, Homo sapiens
uucccucgggacccucccaguga

SEQ ID NO: 1085946 - RNA, 14 nt, Homo sapiens
uucccucugccuga

SEQ ID NO: 1085947 - RNA, 21 nt, Homo sapiens
uuccuacacccuuggacuuga

SEQ ID NO: 1085948 - RNA, 14 nt, Homo sapiens
cauauuguucuuca

SEQ ID NO: 1085949 - RNA, 13 nt, Homo sapiens
caucaagcuccac

SEQ ID NO: 1085950 - RNA, 20 nt, Homo sapiens
caucacuagccaugauaacu

SEQ ID NO: 1085951 - RNA, 18 nt, Homo sapiens
caucagucuccaacaugu

SEQ ID NO: 1085952 - RNA, 19 nt, Homo sapiens
caucagucuuaauauucag

SEQ ID NO: 1085953 - RNA, 22 nt, Homo sapiens
cauccaacuccucuagucagca

SEQ ID NO: 1085954 - RNA, 16 nt, Homo sapiens
caucccuuuuuuuaca

SEQ ID NO: 1085955 - RNA, 17 nt, Homo sapiens
cauccuccucuccaugc

SEQ ID NO: 1085956 - RNA, 21 nt, Homo sapiens
cauccuggcccaucaguguac

SEQ ID NO: 1085957 - RNA, 17 nt, Homo sapiens
caucuaaauugaucauu

SEQ ID NO: 1085958 - RNA, 17 nt, Homo sapiens
caucuaagcugcagcuu

SEQ ID NO: 1085959 - RNA, 19 nt, Homo sapiens
caucuguggaaaugacagc

SEQ ID NO: 1085960 - RNA, 15 nt, Homo sapiens
caucuugcugcuaau

SEQ ID NO: 1085961 - RNA, 21 nt, Homo sapiens
caucuuugcugaaugucauua

SEQ ID NO: 1085962 - RNA, 17 nt, Homo sapiens
caugacuuuuccaugua

SEQ ID NO: 1085963 - RNA, 22 nt, Homo sapiens
caugcugcuaauucaaagcucu

SEQ ID NO: 1085964 - RNA, 13 nt, Homo sapiens
caugcuggggcaa

SEQ ID NO: 1085965 - RNA, 17 nt, Homo sapiens
cauggaaauguccucca

SEQ ID NO: 1085966 - RNA, 23 nt, Homo sapiens
cauggagcuugacuucaugccag

SEQ ID NO: 1085967 - RNA, 14 nt, Homo sapiens
cauggaguguuuga

SEQ ID NO: 1085968 - RNA, 13 nt, Homo sapiens
caugggacugugc

SEQ ID NO: 1085969 - RNA, 22 nt, Homo sapiens
cauguaucuaccucacuauuca

SEQ ID NO: 1085970 - RNA, 19 nt, Homo sapiens
cauguauuagccagucauu

SEQ ID NO: 1085971 - RNA, 20 nt, Homo sapiens
cauguauuagccagucauug

SEQ ID NO: 1085972 - RNA, 13 nt, Homo sapiens
caugucagccuca

SEQ ID NO: 1085973 - RNA, 15 nt, Homo sapiens
caugucaugugccac

SEQ ID NO: 1085974 - RNA, 15 nt, Homo sapiens
cauguccaaguccaa

SEQ ID NO: 1085975 - RNA, 23 nt, Homo sapiens
cauuaaaauuuuuuaacauauug

SEQ ID NO: 1085976 - RNA, 17 nt, Homo sapiens
cauuaccauggagacaa

SEQ ID NO: 1085977 - RNA, 19 nt, Homo sapiens
cauucagcagucagucccc

SEQ ID NO: 1085978 - RNA, 21 nt, Homo sapiens
cauucccagaauuugcugcau

SEQ ID NO: 1085979 - RNA, 15 nt, Homo sapiens
cauucuccugccuca

SEQ ID NO: 1085980 - RNA, 15 nt, Homo sapiens
cauugaauuugccuu

SEQ ID NO: 1085981 - RNA, 20 nt, Homo sapiens
cauugauuuugaugauuaaa

SEQ ID NO: 1085982 - RNA, 13 nt, Homo sapiens
cauuggaagccau

SEQ ID NO: 1085983 - RNA, 19 nt, Homo sapiens
cauugucgcucagcaauag

SEQ ID NO: 1085984 - RNA, 23 nt, Homo sapiens
cauuucuuauuuaauuagaaugg

SEQ ID NO: 1085985 - RNA, 18 nt, Homo sapiens
cauuucuugguaugauca

SEQ ID NO: 1085986 - RNA, 14 nt, Homo sapiens
cauuuugaauguga

SEQ ID NO: 1085987 - RNA, 19 nt, Homo sapiens
cauuuugaaugugaucauc

SEQ ID NO: 1085988 - RNA, 13 nt, Homo sapiens
cauuuugcauuag

SEQ ID NO: 1085989 - RNA, 21 nt, Homo sapiens
cauuuugcauuagacagauga

SEQ ID NO: 1085990 - RNA, 16 nt, Homo sapiens
cauuuuguacaaagau

SEQ ID NO: 1085991 - RNA, 13 nt, Homo sapiens
ccaaaaauaucuu

SEQ ID NO: 1085992 - RNA, 14 nt, Homo sapiens
ccaaacucugccag

SEQ ID NO: 1085993 - RNA, 15 nt, Homo sapiens
ccaaacucugccagc

SEQ ID NO: 1085994 - RNA, 14 nt, Homo sapiens
ccaaagacaucagu

SEQ ID NO: 1085995 - RNA, 12 nt, Homo sapiens
ccaaagggccca

SEQ ID NO: 1085996 - RNA, 22 nt, Homo sapiens
guuuccagcuaagccugaugau

SEQ ID NO: 1085997 - RNA, 13 nt, Homo sapiens
guuucccagugag

SEQ ID NO: 1085998 - RNA, 22 nt, Homo sapiens
guuuuaaaacucuuuaucccau

SEQ ID NO: 1085999 - RNA, 16 nt, Homo sapiens
guuuucagauuguaaa

SEQ ID NO: 1086000 - RNA, 21 nt, Homo sapiens
uaaaagaauaaaauugcacuu

SEQ ID NO: 1086001 - RNA, 16 nt, Homo sapiens
uaaaauaaaccuugga

SEQ ID NO: 1086002 - RNA, 12 nt, Homo sapiens
uaaaauacucuu

SEQ ID NO: 1086003 - RNA, 18 nt, Homo sapiens
uaaaaucaaaugugcauc

SEQ ID NO: 1086004 - RNA, 21 nt, Homo sapiens
uaaaaugcggcacuauuucug

SEQ ID NO: 1086005 - RNA, 15 nt, Homo sapiens
uaaaauuaauuugug

SEQ ID NO: 1086006 - RNA, 14 nt, Homo sapiens
uaaaauugcacuuu

SEQ ID NO: 1086007 - RNA, 14 nt, Homo sapiens
uaaaauuguaaaau

SEQ ID NO: 1086008 - RNA, 13 nt, Homo sapiens
uaaaauuucaaca

SEQ ID NO: 1086009 - RNA, 18 nt, Homo sapiens
uaaacaguuuuggagaaa

SEQ ID NO: 1086010 - RNA, 15 nt, Homo sapiens
uaaacuacuuguaaa

SEQ ID NO: 1086011 - RNA, 22 nt, Homo sapiens
uaaagcugccggcacagaacuu

SEQ ID NO: 1086012 - RNA, 14 nt, Homo sapiens
uaaaggacaaacag

SEQ ID NO: 1086013 - RNA, 17 nt, Homo sapiens
uaaaggugcugcacugg

SEQ ID NO: 1086014 - RNA, 19 nt, Homo sapiens
uaaagguuucacuguucau

SEQ ID NO: 1086015 - RNA, 18 nt, Homo sapiens
uaaaguaauuuugugaaa

SEQ ID NO: 1086016 - RNA, 13 nt, Homo sapiens
uaaagucucugcu

SEQ ID NO: 1086017 - RNA, 16 nt, Homo sapiens
uaaauaaaagcacaag

SEQ ID NO: 1086018 - RNA, 16 nt, Homo sapiens
uaaauaaccacacuga

SEQ ID NO: 1086019 - RNA, 16 nt, Homo sapiens
uaaaucccaagugucu

SEQ ID NO: 1086020 - RNA, 20 nt, Homo sapiens
uaaaugagaaaggauuuccu

SEQ ID NO: 1086021 - RNA, 19 nt, Homo sapiens
uaaauuaaugaguuuuauc

SEQ ID NO: 1086022 - RNA, 18 nt, Homo sapiens
uaaccauaaaucaauuca

SEQ ID NO: 1086023 - RNA, 15 nt, Homo sapiens
uaacucagacauucc

SEQ ID NO: 1086024 - RNA, 12 nt, Homo sapiens
uaacugcaauuu

SEQ ID NO: 1086025 - RNA, 17 nt, Homo sapiens
uaacugccuuguguaca

SEQ ID NO: 1086026 - RNA, 12 nt, Homo sapiens
uaacuugagggu

SEQ ID NO: 1086027 - RNA, 18 nt, Homo sapiens
uaagauuuccaagugcca

SEQ ID NO: 1086028 - RNA, 18 nt, Homo sapiens
uaagcgggaucccagcau

SEQ ID NO: 1086029 - RNA, 18 nt, Homo sapiens
uaagcucuaucugcaaug

SEQ ID NO: 1086030 - RNA, 13 nt, Homo sapiens
uaagcuguaaaaa

SEQ ID NO: 1086031 - RNA, 19 nt, Homo sapiens
uaaggagauagacggguug

SEQ ID NO: 1086032 - RNA, 14 nt, Homo sapiens
uaaggauuuuucaa

SEQ ID NO: 1086033 - RNA, 16 nt, Homo sapiens
uaaggcuuaggugcca

SEQ ID NO: 1086034 - RNA, 19 nt, Homo sapiens
uaaguccuguauauguaug

SEQ ID NO: 1086035 - RNA, 16 nt, Homo sapiens
uaaguuuuauacauaa

SEQ ID NO: 1086036 - RNA, 15 nt, Homo sapiens
uaauaccuguccaca

SEQ ID NO: 1086037 - RNA, 22 nt, Homo sapiens
uaauaccuuaguuuuuuccaca

SEQ ID NO: 1086038 - RNA, 12 nt, Homo sapiens
uaauauauugcu

SEQ ID NO: 1086039 - RNA, 18 nt, Homo sapiens
uaaucaguuuuauccaca

SEQ ID NO: 1086040 - RNA, 16 nt, Homo sapiens
uaaucccagcuauuca

SEQ ID NO: 1086041 - RNA, 20 nt, Homo sapiens
uaaugaaccguuuacagugu

SEQ ID NO: 1086042 - RNA, 11 nt, Homo sapiens
uaaugagcucc

SEQ ID NO: 1086043 - RNA, 18 nt, Homo sapiens
uaaugcuugccaagaaau

SEQ ID NO: 1086044 - RNA, 15 nt, Homo sapiens
uaauuaauugucauu

SEQ ID NO: 1086045 - RNA, 20 nt, Homo sapiens
uaauugguccaacccagccu

SEQ ID NO: 1086046 - RNA, 14 nt, Homo sapiens
uacaaaacgagaua

SEQ ID NO: 1086047 - RNA, 22 nt, Homo sapiens
uacaaaagcagcuuuuaguuca

SEQ ID NO: 1086048 - RNA, 21 nt, Homo sapiens
uacaaggguauccugugcuau

SEQ ID NO: 1086049 - RNA, 17 nt, Homo sapiens
uacaauuguuaugaucu

SEQ ID NO: 1086050 - RNA, 13 nt, Homo sapiens
uacagacugugag

SEQ ID NO: 1086051 - RNA, 19 nt, Homo sapiens
uacagucagcacagaacac

SEQ ID NO: 1086052 - RNA, 14 nt, Homo sapiens
uacaguucauaaau

SEQ ID NO: 1086053 - RNA, 15 nt, Homo sapiens
uacauacagugauau

SEQ ID NO: 1086054 - RNA, 15 nt, Homo sapiens
uacaugaauugcauu

SEQ ID NO: 1086055 - RNA, 20 nt, Homo sapiens
uacauguugggcaugauucu

SEQ ID NO: 1086056 - RNA, 19 nt, Homo sapiens
uaccaaagcaucaauacaa

SEQ ID NO: 1086057 - RNA, 18 nt, Homo sapiens
uacccccaguaaaaucaa

SEQ ID NO: 1086058 - RNA, 15 nt, Homo sapiens
uaccugccuguucuc

SEQ ID NO: 1086059 - RNA, 13 nt, Homo sapiens
uaccugcuaugcg

SEQ ID NO: 1086060 - RNA, 18 nt, Homo sapiens
uacgaucccccaaguguc

SEQ ID NO: 1086061 - RNA, 13 nt, Homo sapiens
uacuaaugugccc

SEQ ID NO: 1086062 - RNA, 22 nt, Homo sapiens
uacuaguguguguguguauaua

SEQ ID NO: 1086063 - RNA, 23 nt, Homo sapiens
uacuaguguguguguguauauau

SEQ ID NO: 1086064 - RNA, 12 nt, Homo sapiens
uacucucuugcc

SEQ ID NO: 1086065 - RNA, 16 nt, Homo sapiens
uacugaaggcuucugc

SEQ ID NO: 1086066 - RNA, 15 nt, Homo sapiens
uacuucagucuugga

SEQ ID NO: 1086067 - RNA, 13 nt, Homo sapiens
uacuuccaugaua

SEQ ID NO: 1086068 - RNA, 14 nt, Homo sapiens
uacuuccaugauac

SEQ ID NO: 1086069 - RNA, 16 nt, Homo sapiens
uacuuccaugauacuu

SEQ ID NO: 1086070 - RNA, 21 nt, Homo sapiens
uacuucccaauugccacauuu

SEQ ID NO: 1086071 - RNA, 16 nt, Homo sapiens
uacuuguaaaggugcu

SEQ ID NO: 1086072 - RNA, 12 nt, Homo sapiens
uacuuuuugccc

SEQ ID NO: 1086073 - RNA, 19 nt, Homo sapiens
uagaacacccacuggccag

SEQ ID NO: 1086074 - RNA, 22 nt, Homo sapiens
uagaagccugcagcggcacaaa

SEQ ID NO: 1086075 - RNA, 17 nt, Homo sapiens
uagaaucaagucuguga

SEQ ID NO: 1086076 - RNA, 19 nt, Homo sapiens
uagaauugccuuaaggcca

SEQ ID NO: 1086077 - RNA, 18 nt, Homo sapiens
uagagcacuuuucacuua

SEQ ID NO: 1086078 - RNA, 15 nt, Homo sapiens
uagagcuggugccag

SEQ ID NO: 1086079 - RNA, 16 nt, Homo sapiens
uagauauuauucauuc

SEQ ID NO: 1086080 - RNA, 14 nt, Homo sapiens
uagaucuaguucuc

SEQ ID NO: 1086081 - RNA, 17 nt, Homo sapiens
uagauucucaccugccu

SEQ ID NO: 1086082 - RNA, 22 nt, Homo sapiens
uagcaaacaaauggcuuacuua

SEQ ID NO: 1086083 - RNA, 14 nt, Homo sapiens
uagcaaucauuuua

SEQ ID NO: 1086084 - RNA, 15 nt, Homo sapiens
uagcagaaugcacau

SEQ ID NO: 1086085 - RNA, 13 nt, Homo sapiens
uagcauauauaau

SEQ ID NO: 1086086 - RNA, 18 nt, Homo sapiens
uagccaucucucuacucc

SEQ ID NO: 1086087 - RNA, 19 nt, Homo sapiens
uagcggggaggggguuauc

SEQ ID NO: 1086088 - RNA, 14 nt, Homo sapiens
uaggaaaaccauga

SEQ ID NO: 1086089 - RNA, 16 nt, Homo sapiens
uaggacucugaggcuc

SEQ ID NO: 1086090 - RNA, 12 nt, Homo sapiens
uaggaguacaag

SEQ ID NO: 1086091 - RNA, 14 nt, Homo sapiens
uaggauuacaggca

SEQ ID NO: 1086092 - RNA, 17 nt, Homo sapiens
uaggccuggcacagugu

SEQ ID NO: 1086093 - RNA, 19 nt, Homo sapiens
uagggaagguauaucagga

SEQ ID NO: 1086094 - RNA, 15 nt, Homo sapiens
uagggaugacuguga

SEQ ID NO: 1086095 - RNA, 22 nt, Homo sapiens
uaggugccaggcuguaagcauu

SEQ ID NO: 1086096 - RNA, 21 nt, Homo sapiens
uagucaaucaaacagggacac

SEQ ID NO: 1086097 - RNA, 21 nt, Homo sapiens
uagucacugucucaacuacuc

SEQ ID NO: 1086098 - RNA, 16 nt, Homo sapiens
uagucucacauguccc

SEQ ID NO: 1086099 - RNA, 18 nt, Homo sapiens
uaguguguguguguauau

SEQ ID NO: 1086100 - RNA, 18 nt, Homo sapiens
uaguucuaggguuucccu

SEQ ID NO: 1086101 - RNA, 18 nt, Homo sapiens
uaguuuuaaaacucuuua

SEQ ID NO: 1086102 - RNA, 13 nt, Homo sapiens
uauaaauauguga

SEQ ID NO: 1086103 - RNA, 16 nt, Homo sapiens
uauaaauaugugaaaa

SEQ ID NO: 1086104 - RNA, 21 nt, Homo sapiens
uauaacaaacuacauguaauc

SEQ ID NO: 1086105 - RNA, 14 nt, Homo sapiens
uauacaaacaggug

SEQ ID NO: 1086106 - RNA, 13 nt, Homo sapiens
uauagguguuugc

SEQ ID NO: 1086107 - RNA, 14 nt, Homo sapiens
uauaguagcauuuc

SEQ ID NO: 1086108 - RNA, 14 nt, Homo sapiens
uauauauguauaua

SEQ ID NO: 1086109 - RNA, 21 nt, Homo sapiens
uauaucauaaaguaugccuuc

SEQ ID NO: 1086110 - RNA, 17 nt, Homo sapiens
uauaucuuuuuccauca

SEQ ID NO: 1086111 - RNA, 15 nt, Homo sapiens
uauauuugugugagg

SEQ ID NO: 1086112 - RNA, 21 nt, Homo sapiens
uauauuuucugaguagcauau

SEQ ID NO: 1086113 - RNA, 21 nt, Homo sapiens
uaucaaucaccuugcauuuca

SEQ ID NO: 1086114 - RNA, 21 nt, Homo sapiens
uaucuacccagucauguacug

SEQ ID NO: 1086115 - RNA, 15 nt, Homo sapiens
uaucuccucuugggc

SEQ ID NO: 1086116 - RNA, 19 nt, Homo sapiens
uaucucgcuagccauauau

SEQ ID NO: 1086117 - RNA, 11 nt, Homo sapiens
uaucugugaua

SEQ ID NO: 1086118 - RNA, 17 nt, Homo sapiens
uaucuuguuggacaucu

SEQ ID NO: 1086119 - RNA, 16 nt, Homo sapiens
uaugaaagccacacuu

SEQ ID NO: 1086120 - RNA, 19 nt, Homo sapiens
uaugcaggacaugugcucu

SEQ ID NO: 1086121 - RNA, 17 nt, Homo sapiens
uguucaguaguuccagg

SEQ ID NO: 1086122 - RNA, 13 nt, Homo sapiens
uguuccaaaaaga

SEQ ID NO: 1086123 - RNA, 14 nt, Homo sapiens
uguucccacucccu

SEQ ID NO: 1086124 - RNA, 23 nt, Homo sapiens
uguucccacucccucucuugccg

SEQ ID NO: 1086125 - RNA, 19 nt, Homo sapiens
uguuccuucuccaauuuga

SEQ ID NO: 1086126 - RNA, 23 nt, Homo sapiens
uguugauaagaguguaacaucca

SEQ ID NO: 1086127 - RNA, 15 nt, Homo sapiens
uguugucauguguau

SEQ ID NO: 1086128 - RNA, 15 nt, Homo sapiens
uguuguguccaaucc

SEQ ID NO: 1086129 - RNA, 12 nt, Homo sapiens
uguuuacuuaag

SEQ ID NO: 1086130 - RNA, 20 nt, Homo sapiens
uguuugugaaacaaaaaagu

SEQ ID NO: 1086131 - RNA, 17 nt, Homo sapiens
uguuuguucacacuccu

SEQ ID NO: 1086132 - RNA, 19 nt, Homo sapiens
uuaaaaauuaaauucucuc

SEQ ID NO: 1086133 - RNA, 16 nt, Homo sapiens
uuaaaaguccacuuuu

SEQ ID NO: 1086134 - RNA, 18 nt, Homo sapiens
uuaaaaguccacuuuuaa

SEQ ID NO: 1086135 - RNA, 21 nt, Homo sapiens
uuaaaaucuggcaaaguuaua

SEQ ID NO: 1086136 - RNA, 18 nt, Homo sapiens
uuaaaccucucuucuacc

SEQ ID NO: 1086137 - RNA, 20 nt, Homo sapiens
uuaaagaaaaaaaaagucag

SEQ ID NO: 1086138 - RNA, 11 nt, Homo sapiens
uuaaagcaaaa

SEQ ID NO: 1086139 - RNA, 16 nt, Homo sapiens
uuaaaucuauauacaa

SEQ ID NO: 1086140 - RNA, 15 nt, Homo sapiens
uuaaaugaaagugag

SEQ ID NO: 1086141 - RNA, 18 nt, Homo sapiens
uuaaauggcauaccaaaa

SEQ ID NO: 1086142 - RNA, 22 nt, Homo sapiens
uuaaauucugaacaauucucuc

SEQ ID NO: 1086143 - RNA, 15 nt, Homo sapiens
uuaacucagccagaa

SEQ ID NO: 1086144 - RNA, 20 nt, Homo sapiens
uuaacugcauaauagccuaa

SEQ ID NO: 1086145 - RNA, 23 nt, Homo sapiens
uuaagcgggaucccagcaucuca

SEQ ID NO: 1086146 - RNA, 19 nt, Homo sapiens
uuaauccuuuguauuacaa

SEQ ID NO: 1086147 - RNA, 15 nt, Homo sapiens
uuaaucuuccauucc

SEQ ID NO: 1086148 - RNA, 19 nt, Homo sapiens
uuaauuuuuauaaauaugu

SEQ ID NO: 1086149 - RNA, 22 nt, Homo sapiens
uuaauuuuuauaaauaugugaa

SEQ ID NO: 1086150 - RNA, 13 nt, Homo sapiens
uuacaacaaacac

SEQ ID NO: 1086151 - RNA, 17 nt, Homo sapiens
uuacaugaagcuguaua

SEQ ID NO: 1086152 - RNA, 18 nt, Homo sapiens
uuacauuucauacaacag

SEQ ID NO: 1086153 - RNA, 10 nt, Homo sapiens
uuaccaaagc

SEQ ID NO: 1086154 - RNA, 22 nt, Homo sapiens
uuacuaaugugccccaugucca

SEQ ID NO: 1086155 - RNA, 11 nt, Homo sapiens
uuacucagagc

SEQ ID NO: 1086156 - RNA, 19 nt, Homo sapiens
uuacugcaaccuuugccuc

SEQ ID NO: 1086157 - RNA, 13 nt, Homo sapiens
uuacuuccaugau

SEQ ID NO: 1086158 - RNA, 21 nt, Homo sapiens
uuacuuccaugauacuuuaau

SEQ ID NO: 1086159 - RNA, 13 nt, Homo sapiens
uuaggacugacau

SEQ ID NO: 1086160 - RNA, 20 nt, Homo sapiens
uuaggccuggcacagugucu

SEQ ID NO: 1086161 - RNA, 17 nt, Homo sapiens
uuauaaauaugugaaaa

SEQ ID NO: 1086162 - RNA, 16 nt, Homo sapiens
uuauaccccauuugau

SEQ ID NO: 1086163 - RNA, 15 nt, Homo sapiens
uuauagguuuccacu

SEQ ID NO: 1086164 - RNA, 17 nt, Homo sapiens
uuauagguuuccacugc

SEQ ID NO: 1086165 - RNA, 15 nt, Homo sapiens
uuauauuuacuuuaa

SEQ ID NO: 1086166 - RNA, 18 nt, Homo sapiens
uuauuaaaagaguagaaa

SEQ ID NO: 1086167 - RNA, 21 nt, Homo sapiens
uuauuaaauguagaaagugau

SEQ ID NO: 1086168 - RNA, 18 nt, Homo sapiens
uuauuauuguucuuuaag

SEQ ID NO: 1086169 - RNA, 15 nt, Homo sapiens
uuauucccccaaagc

SEQ ID NO: 1086170 - RNA, 14 nt, Homo sapiens
uuauucugauucca

SEQ ID NO: 1086171 - RNA, 15 nt, Homo sapiens
uuauucugauuccac

SEQ ID NO: 1086172 - RNA, 19 nt, Homo sapiens
uuauugcuggaaucuacua

SEQ ID NO: 1086173 - RNA, 20 nt, Homo sapiens
uuauuuaaaaagaacucuga

SEQ ID NO: 1086174 - RNA, 22 nt, Homo sapiens
uuauuuaguuggaggccuuuag

SEQ ID NO: 1086175 - RNA, 11 nt, Homo sapiens
uuauuuccaca

SEQ ID NO: 1086176 - RNA, 13 nt, Homo sapiens
uuauuuccaugga

SEQ ID NO: 1086177 - RNA, 14 nt, Homo sapiens
uuauuuccauggau

SEQ ID NO: 1086178 - RNA, 15 nt, Homo sapiens
uuauuuccauggauu

SEQ ID NO: 1086179 - RNA, 18 nt, Homo sapiens
uucaaguauuagggguaa

SEQ ID NO: 1086180 - RNA, 14 nt, Homo sapiens
uucaaguugagaac

SEQ ID NO: 1086181 - RNA, 17 nt, Homo sapiens
uucacauaguuugauaa

SEQ ID NO: 1086182 - RNA, 15 nt, Homo sapiens
uucacuagacugugc

SEQ ID NO: 1086183 - RNA, 17 nt, Homo sapiens
uucacugcagccuuuca

SEQ ID NO: 1086184 - RNA, 17 nt, Homo sapiens
uucacuugggucucugg

SEQ ID NO: 1086185 - RNA, 15 nt, Homo sapiens
uucagccugaggcug

SEQ ID NO: 1086186 - RNA, 23 nt, Homo sapiens
uucaguggugugaucuuggcuca

SEQ ID NO: 1086187 - RNA, 13 nt, Homo sapiens
uucaguguucuga

SEQ ID NO: 1086188 - RNA, 23 nt, Homo sapiens
uucaguuccucuuugcauggaau

SEQ ID NO: 1086189 - RNA, 18 nt, Homo sapiens
uucauauugcuaccaaaa

SEQ ID NO: 1086190 - RNA, 20 nt, Homo sapiens
uucaugcauucuagugcaga

SEQ ID NO: 1086191 - RNA, 13 nt, Homo sapiens
uuccaugauacuu

SEQ ID NO: 1086192 - RNA, 16 nt, Homo sapiens
uuccaugauacuuuaa

SEQ ID NO: 1086193 - RNA, 18 nt, Homo sapiens
uuccauggauuccccugg

SEQ ID NO: 1086194 - RNA, 22 nt, Homo sapiens
uucccuccucgggcuucucgcc

SEQ ID NO: 1086195 - RNA, 20 nt, Homo sapiens
uucccuguaugauuccuuga

SEQ ID NO: 1086196 - RNA, 17 nt, Homo sapiens
uuccucaugucaucaaa

SEQ ID NO: 1086197 - RNA, 19 nt, Homo sapiens
uuccucuugggcuuuugaa

SEQ ID NO: 1086198 - RNA, 18 nt, Homo sapiens
uuccugucuuaccaaaca

SEQ ID NO: 1086199 - RNA, 14 nt, Homo sapiens
uuccuuuaauccca

SEQ ID NO: 1086200 - RNA, 20 nt, Homo sapiens
uucgaaaccuguccauaaag

SEQ ID NO: 1086201 - RNA, 20 nt, Homo sapiens
uucgagaccagccuggccaa

SEQ ID NO: 1086202 - RNA, 17 nt, Homo sapiens
uucgauguacagucuca

SEQ ID NO: 1086203 - RNA, 15 nt, Homo sapiens
uucuaauccaugugc

SEQ ID NO: 1086204 - RNA, 16 nt, Homo sapiens
uucuaauccaugugcu

SEQ ID NO: 1086205 - RNA, 23 nt, Homo sapiens
uucuccucccuguuaucugcuag

SEQ ID NO: 1086206 - RNA, 14 nt, Homo sapiens
uucuccugccucag

SEQ ID NO: 1086207 - RNA, 19 nt, Homo sapiens
uucucgugguagaagccag

SEQ ID NO: 1086208 - RNA, 13 nt, Homo sapiens
uucugaguagcau

SEQ ID NO: 1086209 - RNA, 17 nt, Homo sapiens
uucugaguagcauauau

SEQ ID NO: 1086210 - RNA, 12 nt, Homo sapiens
uucuguguccuc

SEQ ID NO: 1086211 - RNA, 22 nt, Homo sapiens
uucuguuuuguuguuugauuca

SEQ ID NO: 1086212 - RNA, 21 nt, Homo sapiens
uucuuaaaauguuaacuggca

SEQ ID NO: 1086213 - RNA, 15 nt, Homo sapiens
uucuucucgacuuca

SEQ ID NO: 1086214 - RNA, 23 nt, Homo sapiens
uucuuuaaggagauagacggguu

SEQ ID NO: 1086215 - RNA, 16 nt, Homo sapiens
uucuuugcaccaaaga

SEQ ID NO: 1086216 - RNA, 22 nt, Homo sapiens
uucuuugcaccaaagacaucag

SEQ ID NO: 1086217 - RNA, 20 nt, Homo sapiens
uugaaaugagaaacuuugau

SEQ ID NO: 1086218 - RNA, 19 nt, Homo sapiens
uugaauuugccuuccucau

SEQ ID NO: 1086219 - RNA, 15 nt, Homo sapiens
uugacuggcucaaga

SEQ ID NO: 1086220 - RNA, 14 nt, Homo sapiens
uugacuucaugcca

SEQ ID NO: 1086221 - RNA, 17 nt, Homo sapiens
uugagcuaguuacauaa

SEQ ID NO: 1086222 - RNA, 16 nt, Homo sapiens
uugaugcuacaaaaca

SEQ ID NO: 1086223 - RNA, 23 nt, Homo sapiens
uugauuaaacagcaaagccauau

SEQ ID NO: 1086224 - RNA, 22 nt, Homo sapiens
uugauugguuuaaaagucacau

SEQ ID NO: 1086225 - RNA, 11 nt, Homo sapiens
uugcacauaaa

SEQ ID NO: 1086226 - RNA, 16 nt, Homo sapiens
uugcagugaacugaga

SEQ ID NO: 1086227 - RNA, 23 nt, Homo sapiens
uugcauugaauuuagucauuauu

SEQ ID NO: 1086228 - RNA, 18 nt, Homo sapiens
uugcccacacacacuccu

SEQ ID NO: 1086229 - RNA, 19 nt, Homo sapiens
uugcccaggcuggagugca

SEQ ID NO: 1086230 - RNA, 16 nt, Homo sapiens
uugcgagaauuuucaa

SEQ ID NO: 1086231 - RNA, 13 nt, Homo sapiens
uugcuaccaaaaa

SEQ ID NO: 1086232 - RNA, 21 nt, Homo sapiens
uugcuaccaaaaacuagacau

SEQ ID NO: 1086233 - RNA, 12 nt, Homo sapiens
uugcuccauuuu

SEQ ID NO: 1086234 - RNA, 18 nt, Homo sapiens
uugcuguaacucagacau

SEQ ID NO: 1086235 - RNA, 19 nt, Homo sapiens
uugcuguuggcaucuugcu

SEQ ID NO: 1086236 - RNA, 17 nt, Homo sapiens
uuggaaagcaucaccuc

SEQ ID NO: 1086237 - RNA, 16 nt, Homo sapiens
uuggacuugaggauuu

SEQ ID NO: 1086238 - RNA, 22 nt, Homo sapiens
uuggagagcagcuggcucucca

SEQ ID NO: 1086239 - RNA, 17 nt, Homo sapiens
uuggagggaucauuuuc

SEQ ID NO: 1086240 - RNA, 21 nt, Homo sapiens
uuggcgagaccagagcagucu

SEQ ID NO: 1086241 - RNA, 20 nt, Homo sapiens
uuggcugagagaguggcauu

SEQ ID NO: 1086242 - RNA, 20 nt, Homo sapiens
uuggucuuacuuugugcaaa

SEQ ID NO: 1086243 - RNA, 19 nt, Homo sapiens
uuguaggacaacuuugaau

SEQ ID NO: 1086244 - RNA, 19 nt, Homo sapiens
uuguauaaggaaagccaaa

SEQ ID NO: 1086245 - RNA, 18 nt, Homo sapiens
aacugaguacaauuguua

SEQ ID NO: 1086246 - RNA, 18 nt, Homo sapiens
aacuguagauaaaguggu

SEQ ID NO: 1086247 - RNA, 14 nt, Homo sapiens
aacuuauuugcccu

SEQ ID NO: 1086248 - RNA, 15 nt, Homo sapiens
aacuugcugcugagu

SEQ ID NO: 1086249 - RNA, 12 nt, Homo sapiens
aagaaacaugau

SEQ ID NO: 1086250 - RNA, 18 nt, Homo sapiens
aagaaauaaaaucuaauu

SEQ ID NO: 1086251 - RNA, 14 nt, Homo sapiens
aagaaauugugaaa

SEQ ID NO: 1086252 - RNA, 20 nt, Homo sapiens
aagaaccccagaccucugaa

SEQ ID NO: 1086253 - RNA, 18 nt, Homo sapiens
aagaagggccaauucccu

SEQ ID NO: 1086254 - RNA, 17 nt, Homo sapiens
aagaauaaaauugcacu

SEQ ID NO: 1086255 - RNA, 13 nt, Homo sapiens
aagacaaagcaaa

SEQ ID NO: 1086256 - RNA, 16 nt, Homo sapiens
aagagaucuuucuuuc

SEQ ID NO: 1086257 - RNA, 23 nt, Homo sapiens
aagagaucuuucuuuccaaaaca

SEQ ID NO: 1086258 - RNA, 15 nt, Homo sapiens
aagaggaagugcacu

SEQ ID NO: 1086259 - RNA, 13 nt, Homo sapiens
aagaggcuggaaa

SEQ ID NO: 1086260 - RNA, 16 nt, Homo sapiens
aagagguucugcacuc

SEQ ID NO: 1086261 - RNA, 20 nt, Homo sapiens
aagauaauuuguugggccau

SEQ ID NO: 1086262 - RNA, 13 nt, Homo sapiens
aagaucugcuucc

SEQ ID NO: 1086263 - RNA, 16 nt, Homo sapiens
aagaugaaacagggca

SEQ ID NO: 1086264 - RNA, 14 nt, Homo sapiens
aagauuaaaugugu

SEQ ID NO: 1086265 - RNA, 18 nt, Homo sapiens
aagcaagacguccuggaa

SEQ ID NO: 1086266 - RNA, 15 nt, Homo sapiens
aagcagagcuuccuc

SEQ ID NO: 1086267 - RNA, 16 nt, Homo sapiens
aagcauguacuguacu

SEQ ID NO: 1086268 - RNA, 15 nt, Homo sapiens
aagccauguguucca

SEQ ID NO: 1086269 - RNA, 23 nt, Homo sapiens
aagccucugugucacuggcugcc

SEQ ID NO: 1086270 - RNA, 17 nt, Homo sapiens
aagcgauucuucugccu

SEQ ID NO: 1086271 - RNA, 22 nt, Homo sapiens
aagcgggaucccagcaucucag

SEQ ID NO: 1086272 - RNA, 11 nt, Homo sapiens
aagcucucuuu

SEQ ID NO: 1086273 - RNA, 14 nt, Homo sapiens
aaggaaacauauuu

SEQ ID NO: 1086274 - RNA, 23 nt, Homo sapiens
aaggaggguugugcccacuucau

SEQ ID NO: 1086275 - RNA, 14 nt, Homo sapiens
aaggauauuuacua

SEQ ID NO: 1086276 - RNA, 18 nt, Homo sapiens
aaggauauuuacuacuuu

SEQ ID NO: 1086277 - RNA, 23 nt, Homo sapiens
aaggauggagccagcucugcauu

SEQ ID NO: 1086278 - RNA, 18 nt, Homo sapiens
aaggauuuuaccaaagca

SEQ ID NO: 1086279 - RNA, 19 nt, Homo sapiens
aaggauuuuaccaaagcau

SEQ ID NO: 1086280 - RNA, 20 nt, Homo sapiens
aaggcagaaugaaaaguccu

SEQ ID NO: 1086281 - RNA, 17 nt, Homo sapiens
aaggcugagagcucucu

SEQ ID NO: 1086282 - RNA, 21 nt, Homo sapiens
aaggcuucuccacaaccuccu

SEQ ID NO: 1086283 - RNA, 15 nt, Homo sapiens
aaggcuuugccaugg

SEQ ID NO: 1086284 - RNA, 14 nt, Homo sapiens
aaggggccuggaag

SEQ ID NO: 1086285 - RNA, 14 nt, Homo sapiens
aagggugcugugau

SEQ ID NO: 1086286 - RNA, 22 nt, Homo sapiens
aaggucacacaguauuaaguga

SEQ ID NO: 1086287 - RNA, 15 nt, Homo sapiens
aaggucucacacucc

SEQ ID NO: 1086288 - RNA, 16 nt, Homo sapiens
aaggugccgauuucau

SEQ ID NO: 1086289 - RNA, 18 nt, Homo sapiens
aagguuucacuguucaug

SEQ ID NO: 1086290 - RNA, 15 nt, Homo sapiens
aaguaaguaccacuc

SEQ ID NO: 1086291 - RNA, 14 nt, Homo sapiens
aaguaaugcuucaa

SEQ ID NO: 1086292 - RNA, 17 nt, Homo sapiens
aaguagcacccuggauu

SEQ ID NO: 1086293 - RNA, 21 nt, Homo sapiens
aaguauacauuuuugcauugc

SEQ ID NO: 1086294 - RNA, 12 nt, Homo sapiens
aagucacauaua

SEQ ID NO: 1086295 - RNA, 18 nt, Homo sapiens
aagucaugguccuggcug

SEQ ID NO: 1086296 - RNA, 18 nt, Homo sapiens
aaguccaaccugccugug

SEQ ID NO: 1086297 - RNA, 23 nt, Homo sapiens
aagucuaaaguuuacaguaaaua

SEQ ID NO: 1086298 - RNA, 23 nt, Homo sapiens
aagucuaaauaaaugaaguauuu

SEQ ID NO: 1086299 - RNA, 15 nt, Homo sapiens
aaguguagcacccug

SEQ ID NO: 1086300 - RNA, 15 nt, Homo sapiens
aaguucccuccugca

SEQ ID NO: 1086301 - RNA, 23 nt, Homo sapiens
aaguuuuguuuguucacacuccu

SEQ ID NO: 1086302 - RNA, 16 nt, Homo sapiens
aauaaaaguuuacaga

SEQ ID NO: 1086303 - RNA, 16 nt, Homo sapiens
aauaaaaucuaauuaa

SEQ ID NO: 1086304 - RNA, 13 nt, Homo sapiens
aauaauaaauuaa

SEQ ID NO: 1086305 - RNA, 22 nt, Homo sapiens
aauaauuacccacaaaugccac

SEQ ID NO: 1086306 - RNA, 20 nt, Homo sapiens
aauaccuuaguuuuuuccac

SEQ ID NO: 1086307 - RNA, 19 nt, Homo sapiens
aauacucccacuaugccug

SEQ ID NO: 1086308 - RNA, 13 nt, Homo sapiens
aauacuguuucca

SEQ ID NO: 1086309 - RNA, 12 nt, Homo sapiens
aauagauuucag

SEQ ID NO: 1086310 - RNA, 14 nt, Homo sapiens
aauauuaaaugacu

SEQ ID NO: 1086311 - RNA, 14 nt, Homo sapiens
aauauucagagaaa

SEQ ID NO: 1086312 - RNA, 22 nt, Homo sapiens
aaucaaauacauacaaccuaug

SEQ ID NO: 1086313 - RNA, 15 nt, Homo sapiens
aaucaaaugugcauc

SEQ ID NO: 1086314 - RNA, 20 nt, Homo sapiens
aaucacaaggcaacugugag

SEQ ID NO: 1086315 - RNA, 15 nt, Homo sapiens
aaucaccuugcauuu

SEQ ID NO: 1086316 - RNA, 15 nt, Homo sapiens
aaucagauucaggag

SEQ ID NO: 1086317 - RNA, 15 nt, Homo sapiens
aaucauauaccagag

SEQ ID NO: 1086318 - RNA, 16 nt, Homo sapiens
aaucauuccaggugug

SEQ ID NO: 1086319 - RNA, 21 nt, Homo sapiens
aauccaugugcugcuguggca

SEQ ID NO: 1086320 - RNA, 23 nt, Homo sapiens
aauccaugugcugcuguggcauc

SEQ ID NO: 1086321 - RNA, 22 nt, Homo sapiens
aauccucagguaguacugggaa

SEQ ID NO: 1086322 - RNA, 16 nt, Homo sapiens
aaugaagggucauuuc

SEQ ID NO: 1086323 - RNA, 22 nt, Homo sapiens
aaugacuuuuaauuuucacuuu

SEQ ID NO: 1086324 - RNA, 22 nt, Homo sapiens
aaugagcuuguaaauacuccau

SEQ ID NO: 1086325 - RNA, 23 nt, Homo sapiens
aaugcccuaccugccuguucucc

SEQ ID NO: 1086326 - RNA, 19 nt, Homo sapiens
aaugcugugcaaacagugu

SEQ ID NO: 1086327 - RNA, 19 nt, Homo sapiens
aauggcacgaucucagcuc

SEQ ID NO: 1086328 - RNA, 14 nt, Homo sapiens
aaugguaacuuuac

SEQ ID NO: 1086329 - RNA, 23 nt, Homo sapiens
aaugucuuuauuaaauguagaaa

SEQ ID NO: 1086330 - RNA, 15 nt, Homo sapiens
aaugugacucaagac

SEQ ID NO: 1086331 - RNA, 19 nt, Homo sapiens
aaugugucugcaacaugga

SEQ ID NO: 1086332 - RNA, 20 nt, Homo sapiens
aauuaaugaguuuuauccaa

SEQ ID NO: 1086333 - RNA, 22 nt, Homo sapiens
aauuaccagaguuguucugucu

SEQ ID NO: 1086334 - RNA, 14 nt, Homo sapiens
aauuccuggcauga

SEQ ID NO: 1086335 - RNA, 18 nt, Homo sapiens
aauucuucucgacuucag

SEQ ID NO: 1086336 - RNA, 15 nt, Homo sapiens
aauugaucauucaua

SEQ ID NO: 1086337 - RNA, 20 nt, Homo sapiens
aauugcacuuuuaaaccucu

SEQ ID NO: 1086338 - RNA, 14 nt, Homo sapiens
aauuggguuuuaaa

SEQ ID NO: 1086339 - RNA, 15 nt, Homo sapiens
aauuguuaugaucua

SEQ ID NO: 1086340 - RNA, 22 nt, Homo sapiens
aauuuacuuuuuaaacaguguu

SEQ ID NO: 1086341 - RNA, 13 nt, Homo sapiens
aauuuccaugugu

SEQ ID NO: 1086342 - RNA, 20 nt, Homo sapiens
aauuucuaccuuuacuacau

SEQ ID NO: 1086343 - RNA, 18 nt, Homo sapiens
aauuucucuacugucuca

SEQ ID NO: 1086344 - RNA, 18 nt, Homo sapiens
aauuugugcaucagaaaa

SEQ ID NO: 1086345 - RNA, 18 nt, Homo sapiens
aauuuuauugcuggaauc

SEQ ID NO: 1086346 - RNA, 19 nt, Homo sapiens
aauuuuuauaaauauguga

SEQ ID NO: 1086347 - RNA, 23 nt, Homo sapiens
acaaaaaaguguucccuuuucaa

SEQ ID NO: 1086348 - RNA, 19 nt, Homo sapiens
acaaacacuuagcauccca

SEQ ID NO: 1086349 - RNA, 16 nt, Homo sapiens
acaaacuacauguaau

SEQ ID NO: 1086350 - RNA, 15 nt, Homo sapiens
acaaagauaugcuaa

SEQ ID NO: 1086351 - RNA, 16 nt, Homo sapiens
acaaccuauguaauuu

SEQ ID NO: 1086352 - RNA, 23 nt, Homo sapiens
acaaccuccuccuccaguucuga

SEQ ID NO: 1086353 - RNA, 13 nt, Homo sapiens
acaaggugcacag

SEQ ID NO: 1086354 - RNA, 16 nt, Homo sapiens
acaauacgugaaagau

SEQ ID NO: 1086355 - RNA, 18 nt, Homo sapiens
acaauguacaagguaugu

SEQ ID NO: 1086356 - RNA, 12 nt, Homo sapiens
acaauguugcac

SEQ ID NO: 1086357 - RNA, 20 nt, Homo sapiens
acaauguuuuaaacauucuu

SEQ ID NO: 1086358 - RNA, 12 nt, Homo sapiens
acacacaauuaa

SEQ ID NO: 1086359 - RNA, 20 nt, Homo sapiens
acacagugccuguaaaucuc

SEQ ID NO: 1086360 - RNA, 18 nt, Homo sapiens
acacaugcucaucccaaa

SEQ ID NO: 1086361 - RNA, 11 nt, Homo sapiens
acaccaaaaau

SEQ ID NO: 1086362 - RNA, 20 nt, Homo sapiens
acaccauucuccugccucag

SEQ ID NO: 1086363 - RNA, 16 nt, Homo sapiens
acaccauugcaugaau

SEQ ID NO: 1086364 - RNA, 18 nt, Homo sapiens
acaccauugcaugaauuc

SEQ ID NO: 1086365 - RNA, 14 nt, Homo sapiens
acacccaagaagaa

SEQ ID NO: 1086366 - RNA, 14 nt, Homo sapiens
acacccacuggcca

SEQ ID NO: 1086367 - RNA, 22 nt, Homo sapiens
acaccuaagagaaaaagaucga

SEQ ID NO: 1086368 - RNA, 19 nt, Homo sapiens
acacgcaugccucagccag

SEQ ID NO: 1086369 - RNA, 17 nt, Homo sapiens
aucguaucccgcugaca

SEQ ID NO: 1086370 - RNA, 19 nt, Homo sapiens
aucuaguucucaaucacug

SEQ ID NO: 1086371 - RNA, 14 nt, Homo sapiens
aucuauauacaaag

SEQ ID NO: 1086372 - RNA, 18 nt, Homo sapiens
aucucauucagguguucu

SEQ ID NO: 1086373 - RNA, 18 nt, Homo sapiens
aucucccagugacaacau

SEQ ID NO: 1086374 - RNA, 16 nt, Homo sapiens
aucucugcuuacuaau

SEQ ID NO: 1086375 - RNA, 13 nt, Homo sapiens
aucugcuccuagc

SEQ ID NO: 1086376 - RNA, 17 nt, Homo sapiens
aucuggccacacugggc

SEQ ID NO: 1086377 - RNA, 22 nt, Homo sapiens
aucugucaaagaaaacuuccaa

SEQ ID NO: 1086378 - RNA, 14 nt, Homo sapiens
aucuguguuuacuu

SEQ ID NO: 1086379 - RNA, 23 nt, Homo sapiens
aucuuuggggaaacuaacaauau

SEQ ID NO: 1086380 - RNA, 19 nt, Homo sapiens
augaaacagggcaccccag

SEQ ID NO: 1086381 - RNA, 16 nt, Homo sapiens
augaaaccagaaggau

SEQ ID NO: 1086382 - RNA, 17 nt, Homo sapiens
augaagcaaacacacag

SEQ ID NO: 1086383 - RNA, 19 nt, Homo sapiens
augaauugcauuuuacuuu

SEQ ID NO: 1086384 - RNA, 18 nt, Homo sapiens
augaccugaucauuacau

SEQ ID NO: 1086385 - RNA, 13 nt, Homo sapiens
augacuuuuccau

SEQ ID NO: 1086386 - RNA, 22 nt, Homo sapiens
augagaaacuuugaucucugcu

SEQ ID NO: 1086387 - RNA, 20 nt, Homo sapiens
augagcaaggacaaccugcc

SEQ ID NO: 1086388 - RNA, 18 nt, Homo sapiens
augagccaccaugcccag

SEQ ID NO: 1086389 - RNA, 12 nt, Homo sapiens
augauacuuuaa

SEQ ID NO: 1086390 - RNA, 22 nt, Homo sapiens
augaucgcgccacuacacucca

SEQ ID NO: 1086391 - RNA, 19 nt, Homo sapiens
augauucagaaauuuucau

SEQ ID NO: 1086392 - RNA, 22 nt, Homo sapiens
augauucagaaauuuucauuca

SEQ ID NO: 1086393 - RNA, 22 nt, Homo sapiens
augauuuuuguguauccaguau

SEQ ID NO: 1086394 - RNA, 13 nt, Homo sapiens
augcaacuugauu

SEQ ID NO: 1086395 - RNA, 15 nt, Homo sapiens
augcaagacuucacu

SEQ ID NO: 1086396 - RNA, 20 nt, Homo sapiens
augcaagacuucacugcagc

SEQ ID NO: 1086397 - RNA, 14 nt, Homo sapiens
augcagcucugcag

SEQ ID NO: 1086398 - RNA, 13 nt, Homo sapiens
augcaugucugac

SEQ ID NO: 1086399 - RNA, 14 nt, Homo sapiens
augcauucccggug

SEQ ID NO: 1086400 - RNA, 13 nt, Homo sapiens
augcccuaccugc

SEQ ID NO: 1086401 - RNA, 16 nt, Homo sapiens
augcuaugcaugucug

SEQ ID NO: 1086402 - RNA, 15 nt, Homo sapiens
augcugaaugaaucc

SEQ ID NO: 1086403 - RNA, 15 nt, Homo sapiens
augcugcuaauucaa

SEQ ID NO: 1086404 - RNA, 19 nt, Homo sapiens
augcuggacauuaacaaga

SEQ ID NO: 1086405 - RNA, 20 nt, Homo sapiens
augcuggacggcauuccugc

SEQ ID NO: 1086406 - RNA, 15 nt, Homo sapiens
augcugucaggagau

SEQ ID NO: 1086407 - RNA, 15 nt, Homo sapiens
auggaauaaaccauu

SEQ ID NO: 1086408 - RNA, 16 nt, Homo sapiens
auggaauaaagcccuu

SEQ ID NO: 1086409 - RNA, 14 nt, Homo sapiens
auggacucuucccc

SEQ ID NO: 1086410 - RNA, 17 nt, Homo sapiens
auggacucuucccccac

SEQ ID NO: 1086411 - RNA, 18 nt, Homo sapiens
auggagccagcucugcau

SEQ ID NO: 1086412 - RNA, 23 nt, Homo sapiens
auggcccgggccuuauccaguca

SEQ ID NO: 1086413 - RNA, 18 nt, Homo sapiens
auggggagucucaugcaa

SEQ ID NO: 1086414 - RNA, 21 nt, Homo sapiens
auggggguggggaggcaagaa

SEQ ID NO: 1086415 - RNA, 18 nt, Homo sapiens
augguaaaaccccaucuc

SEQ ID NO: 1086416 - RNA, 15 nt, Homo sapiens
augguccuggcugga

SEQ ID NO: 1086417 - RNA, 14 nt, Homo sapiens
augguccugugaug

SEQ ID NO: 1086418 - RNA, 19 nt, Homo sapiens
auguaaaggaaacauauuu

SEQ ID NO: 1086419 - RNA, 17 nt, Homo sapiens
auguacagggguaguuu

SEQ ID NO: 1086420 - RNA, 17 nt, Homo sapiens
auguagaaagugaucca

SEQ ID NO: 1086421 - RNA, 18 nt, Homo sapiens
auguaggaucugucaaag

SEQ ID NO: 1086422 - RNA, 17 nt, Homo sapiens
auguauuagccagucau

SEQ ID NO: 1086423 - RNA, 23 nt, Homo sapiens
auguauugcagugcggcucacau

SEQ ID NO: 1086424 - RNA, 21 nt, Homo sapiens
augucuuuauuaaauguagaa

SEQ ID NO: 1086425 - RNA, 13 nt, Homo sapiens
augugggcucaga

SEQ ID NO: 1086426 - RNA, 14 nt, Homo sapiens
augugucccaguga

SEQ ID NO: 1086427 - RNA, 20 nt, Homo sapiens
auguuccaauaaaacuuuau

SEQ ID NO: 1086428 - RNA, 18 nt, Homo sapiens
auguuuacagacugugag

SEQ ID NO: 1086429 - RNA, 21 nt, Homo sapiens
auuaaaggggcugucucccaa

SEQ ID NO: 1086430 - RNA, 19 nt, Homo sapiens
auuaaauucucucuaacau

SEQ ID NO: 1086431 - RNA, 14 nt, Homo sapiens
auuaauauaaccau

SEQ ID NO: 1086432 - RNA, 19 nt, Homo sapiens
auuaaugaguuuuauccaa

SEQ ID NO: 1086433 - RNA, 17 nt, Homo sapiens
auuaauuaaaccagacu

SEQ ID NO: 1086434 - RNA, 17 nt, Homo sapiens
auuaauugucauuauuu

SEQ ID NO: 1086435 - RNA, 17 nt, Homo sapiens
auuacacuuugaaguau

SEQ ID NO: 1086436 - RNA, 14 nt, Homo sapiens
auuagaaauaucuu

SEQ ID NO: 1086437 - RNA, 19 nt, Homo sapiens
auuagggcaaagaucucag

SEQ ID NO: 1086438 - RNA, 14 nt, Homo sapiens
auuauccacugcaa

SEQ ID NO: 1086439 - RNA, 15 nt, Homo sapiens
auuauccacugcaaa

SEQ ID NO: 1086440 - RNA, 15 nt, Homo sapiens
auuauugugccucag

SEQ ID NO: 1086441 - RNA, 23 nt, Homo sapiens
auucaucuggaggcugcguccug

SEQ ID NO: 1086442 - RNA, 16 nt, Homo sapiens
auucaugcaacuugau

SEQ ID NO: 1086443 - RNA, 18 nt, Homo sapiens
auucauuuauucauucau

SEQ ID NO: 1086444 - RNA, 17 nt, Homo sapiens
auuccauuuuacuucca

SEQ ID NO: 1086445 - RNA, 22 nt, Homo sapiens
auuccauuuuacuuccaugaua

SEQ ID NO: 1086446 - RNA, 20 nt, Homo sapiens
auucccaugguagacuguga

SEQ ID NO: 1086447 - RNA, 13 nt, Homo sapiens
auucuaaacagau

SEQ ID NO: 1086448 - RNA, 16 nt, Homo sapiens
auucucucugcucagu

SEQ ID NO: 1086449 - RNA, 22 nt, Homo sapiens
auugaaggagaaaaugcauuau

SEQ ID NO: 1086450 - RNA, 20 nt, Homo sapiens
auugaauuugccuuccucau

SEQ ID NO: 1086451 - RNA, 19 nt, Homo sapiens
auugagcuagaaaucacaa

SEQ ID NO: 1086452 - RNA, 22 nt, Homo sapiens
auugaugaaugaggaacaauca

SEQ ID NO: 1086453 - RNA, 14 nt, Homo sapiens
auugauuauucuga

SEQ ID NO: 1086454 - RNA, 18 nt, Homo sapiens
auugcaauagaaauccaa

SEQ ID NO: 1086455 - RNA, 21 nt, Homo sapiens
auugcaugaauucacaaacaa

SEQ ID NO: 1086456 - RNA, 16 nt, Homo sapiens
auugccccauugcuca

SEQ ID NO: 1086457 - RNA, 19 nt, Homo sapiens
auugcuaccaaaaacuaga

SEQ ID NO: 1086458 - RNA, 21 nt, Homo sapiens
auugcuccauuuucuugucaa

SEQ ID NO: 1086459 - RNA, 18 nt, Homo sapiens
auuggaauuuucuuucau

SEQ ID NO: 1086460 - RNA, 20 nt, Homo sapiens
auuggagaaaagcacaauca

SEQ ID NO: 1086461 - RNA, 13 nt, Homo sapiens
auuguguaugaga

SEQ ID NO: 1086462 - RNA, 18 nt, Homo sapiens
auuguguuggcuuuacaa

SEQ ID NO: 1086463 - RNA, 20 nt, Homo sapiens
auuguuaggagaugucauca

SEQ ID NO: 1086464 - RNA, 21 nt, Homo sapiens
auuuaaaaaacuaacacccag

SEQ ID NO: 1086465 - RNA, 13 nt, Homo sapiens
auuuaaagcacau

SEQ ID NO: 1086466 - RNA, 15 nt, Homo sapiens
auuuaacuagcacuu

SEQ ID NO: 1086467 - RNA, 13 nt, Homo sapiens
auuuaacuugagg

SEQ ID NO: 1086468 - RNA, 13 nt, Homo sapiens
auuuaccaaauag

SEQ ID NO: 1086469 - RNA, 13 nt, Homo sapiens
auuuagcuuacau

SEQ ID NO: 1086470 - RNA, 17 nt, Homo sapiens
auuucacaucagcuuua

SEQ ID NO: 1086471 - RNA, 22 nt, Homo sapiens
auuucauacaacagaaaccaga

SEQ ID NO: 1086472 - RNA, 11 nt, Homo sapiens
auuuccaugga

SEQ ID NO: 1086473 - RNA, 16 nt, Homo sapiens
auuucgagcauaagaa

SEQ ID NO: 1086474 - RNA, 14 nt, Homo sapiens
auuucuaacauaag

SEQ ID NO: 1086475 - RNA, 16 nt, Homo sapiens
auuucuguuugaaugc

SEQ ID NO: 1086476 - RNA, 14 nt, Homo sapiens
auuugaaaugucau

SEQ ID NO: 1086477 - RNA, 16 nt, Homo sapiens
auuugcugacacauca

SEQ ID NO: 1086478 - RNA, 17 nt, Homo sapiens
auuugguuaugauggaa

SEQ ID NO: 1086479 - RNA, 14 nt, Homo sapiens
auuuguaaguuuau

SEQ ID NO: 1086480 - RNA, 18 nt, Homo sapiens
auuuuaccaaagcaucaa

SEQ ID NO: 1086481 - RNA, 16 nt, Homo sapiens
auuuuacuuccaugau

SEQ ID NO: 1086482 - RNA, 20 nt, Homo sapiens
auuuuacuuccaugauacuu

SEQ ID NO: 1086483 - RNA, 14 nt, Homo sapiens
auuuuauauaaaga

SEQ ID NO: 1086484 - RNA, 21 nt, Homo sapiens
auuuuauauaaagaaaaucaa

SEQ ID NO: 1086485 - RNA, 16 nt, Homo sapiens
auuuucagcaucaaac

SEQ ID NO: 1086486 - RNA, 21 nt, Homo sapiens
auuuuggaaaaaugucacuga

SEQ ID NO: 1086487 - RNA, 24 nt, Homo sapiens
auuuuguaugaaaaaucaauguca

SEQ ID NO: 1086488 - RNA, 21 nt, Homo sapiens
auuuugugaaagaaggagcaa

SEQ ID NO: 1086489 - RNA, 21 nt, Homo sapiens
auuuuuauaaauaugugaaaa

SEQ ID NO: 1086490 - RNA, 14 nt, Homo sapiens
auuuuucaagagau

SEQ ID NO: 1086491 - RNA, 18 nt, Homo sapiens
auuuuugcacauucuaca

SEQ ID NO: 1086492 - RNA, 16 nt, Homo sapiens
auuuuuuauuuccaca

SEQ ID NO: 1086493 - RNA, 24 nt, Homo sapiens
ccugcaccgagagagauggaauaa

SEQ ID NO: 1086494 - RNA, 17 nt, Homo sapiens
ccugcagccugacccca

SEQ ID NO: 1086495 - RNA, 19 nt, Homo sapiens
ccugcaggccaagagcaga

SEQ ID NO: 1086496 - RNA, 16 nt, Homo sapiens
ccugccuagucucaca

SEQ ID NO: 1086497 - RNA, 18 nt, Homo sapiens
ccugccuguucuccagau

SEQ ID NO: 1086498 - RNA, 19 nt, Homo sapiens
ccugcugcgucagaccagu

SEQ ID NO: 1086499 - RNA, 21 nt, Homo sapiens
ccuggaccugaaggcaucuga

SEQ ID NO: 1086500 - RNA, 18 nt, Homo sapiens
ccuggguuuaagcaaugc

SEQ ID NO: 1086501 - RNA, 18 nt, Homo sapiens
ccugguacugagguuggg

SEQ ID NO: 1086502 - RNA, 19 nt, Homo sapiens
ccuggucccuuggagacaa

SEQ ID NO: 1086503 - RNA, 15 nt, Homo sapiens
ccuguccauaaagua

SEQ ID NO: 1086504 - RNA, 21 nt, Homo sapiens
ccuguccccuacccccaguaa

SEQ ID NO: 1086505 - RNA, 21 nt, Homo sapiens
ccuguggggccugauggugcu

SEQ ID NO: 1086506 - RNA, 23 nt, Homo sapiens
ccugugucuuauagguuuccacu

SEQ ID NO: 1086507 - RNA, 23 nt, Homo sapiens
ccugugugcacccaacgugaugc

SEQ ID NO: 1086508 - RNA, 17 nt, Homo sapiens
ccuguucccaagcaaag

SEQ ID NO: 1086509 - RNA, 20 nt, Homo sapiens
ccuguucuuugaaguggcac

SEQ ID NO: 1086510 - RNA, 21 nt, Homo sapiens
ccuguucuuugggcucaaggg

SEQ ID NO: 1086511 - RNA, 17 nt, Homo sapiens
ccuguuuaaaaaaagua

SEQ ID NO: 1086512 - RNA, 16 nt, Homo sapiens
ccuuaaacagugucca

SEQ ID NO: 1086513 - RNA, 19 nt, Homo sapiens
ccuuaaauaucuuucacau

SEQ ID NO: 1086514 - RNA, 15 nt, Homo sapiens
ccuuaaccguggacu

SEQ ID NO: 1086515 - RNA, 21 nt, Homo sapiens
ccuuaagccaauauuuacuca

SEQ ID NO: 1086516 - RNA, 20 nt, Homo sapiens
ccuucaaguuagcucaggag

SEQ ID NO: 1086517 - RNA, 20 nt, Homo sapiens
ccuuccacuuugaguaccaa

SEQ ID NO: 1086518 - RNA, 22 nt, Homo sapiens
ccuuccauuucuacuguauaaa

SEQ ID NO: 1086519 - RNA, 14 nt, Homo sapiens
ccuucgguuuguau

SEQ ID NO: 1086520 - RNA, 22 nt, Homo sapiens
ccuugauggagauauuuacaug

SEQ ID NO: 1086521 - RNA, 20 nt, Homo sapiens
ccuugguuccuccccgaaaa

SEQ ID NO: 1086522 - RNA, 22 nt, Homo sapiens
ccuugucguaggaaaaccauga

SEQ ID NO: 1086523 - RNA, 13 nt, Homo sapiens
ccuuuccugcaaa

SEQ ID NO: 1086524 - RNA, 17 nt, Homo sapiens
ccuuucuuucuuccuuc

SEQ ID NO: 1086525 - RNA, 13 nt, Homo sapiens
ccuuugagggcag

SEQ ID NO: 1086526 - RNA, 14 nt, Homo sapiens
ccuuuuacauauuu

SEQ ID NO: 1086527 - RNA, 22 nt, Homo sapiens
ccuuuugguuccucacauauua

SEQ ID NO: 1086528 - RNA, 18 nt, Homo sapiens
ccuuuuuuuacauuucau

SEQ ID NO: 1086529 - RNA, 22 nt, Homo sapiens
cgaacucaucccuguuccucaa

SEQ ID NO: 1086530 - RNA, 13 nt, Homo sapiens
cgaccccaucuca

SEQ ID NO: 1086531 - RNA, 14 nt, Homo sapiens
cgaccccaucucau

SEQ ID NO: 1086532 - RNA, 19 nt, Homo sapiens
cgagaaccaggcugcugca

SEQ ID NO: 1086533 - RNA, 17 nt, Homo sapiens
cgagaucacgccacugc

SEQ ID NO: 1086534 - RNA, 21 nt, Homo sapiens
cgagaucacgccacugcacuc

SEQ ID NO: 1086535 - RNA, 18 nt, Homo sapiens
cgagcuacucucuugcca

SEQ ID NO: 1086536 - RNA, 21 nt, Homo sapiens
cgaggcaaagagaaaagccac

SEQ ID NO: 1086537 - RNA, 17 nt, Homo sapiens
cgaguuguggaaagccu

SEQ ID NO: 1086538 - RNA, 16 nt, Homo sapiens
cgccacggcacuccag

SEQ ID NO: 1086539 - RNA, 14 nt, Homo sapiens
cgccauuccaaguc

SEQ ID NO: 1086540 - RNA, 17 nt, Homo sapiens
cgccauuccaagucaac

SEQ ID NO: 1086541 - RNA, 19 nt, Homo sapiens
cgcccagcugcaccugcca

SEQ ID NO: 1086542 - RNA, 13 nt, Homo sapiens
cggagccauguca

SEQ ID NO: 1086543 - RNA, 17 nt, Homo sapiens
cggagccuccucucuca

SEQ ID NO: 1086544 - RNA, 22 nt, Homo sapiens
cggaugugugucucaccccuca

SEQ ID NO: 1086545 - RNA, 15 nt, Homo sapiens
cggcaccagugccuc

SEQ ID NO: 1086546 - RNA, 20 nt, Homo sapiens
cggugcacaguaauaugaaa

SEQ ID NO: 1086547 - RNA, 20 nt, Homo sapiens
cgguuuguauuuagugucuu

SEQ ID NO: 1086548 - RNA, 13 nt, Homo sapiens
cguagccaucucu

SEQ ID NO: 1086549 - RNA, 19 nt, Homo sapiens
cguauaauuuagucccuua

SEQ ID NO: 1086550 - RNA, 22 nt, Homo sapiens
cguccugaggaguguccugucu

SEQ ID NO: 1086551 - RNA, 16 nt, Homo sapiens
cgugaaccugccuugg

SEQ ID NO: 1086552 - RNA, 21 nt, Homo sapiens
cguguguauuagaaugcaugu

SEQ ID NO: 1086553 - RNA, 14 nt, Homo sapiens
cuaaagucucaggu

SEQ ID NO: 1086554 - RNA, 22 nt, Homo sapiens
cuaacaaguagcacccuggauu

SEQ ID NO: 1086555 - RNA, 23 nt, Homo sapiens
cuaacaauaugauugcacuaaau

SEQ ID NO: 1086556 - RNA, 18 nt, Homo sapiens
cuaaccugacaucaccaa

SEQ ID NO: 1086557 - RNA, 17 nt, Homo sapiens
cuaaggcucuauuuccu

SEQ ID NO: 1086558 - RNA, 22 nt, Homo sapiens
cuaauccugaagggaagcccau

SEQ ID NO: 1086559 - RNA, 23 nt, Homo sapiens
cuaauuccuggcaugacacucua

SEQ ID NO: 1086560 - RNA, 21 nt, Homo sapiens
cuacaacaaauacuacaggcc

SEQ ID NO: 1086561 - RNA, 20 nt, Homo sapiens
cuacacacccccaagccaca

SEQ ID NO: 1086562 - RNA, 19 nt, Homo sapiens
cuacucauuugcugacaca

SEQ ID NO: 1086563 - RNA, 14 nt, Homo sapiens
cuacucucuugcca

SEQ ID NO: 1086564 - RNA, 19 nt, Homo sapiens
cuagaacacccacuggcca

SEQ ID NO: 1086565 - RNA, 14 nt, Homo sapiens
cuagagaugacuga

SEQ ID NO: 1086566 - RNA, 12 nt, Homo sapiens
cuagagcuccau

SEQ ID NO: 1086567 - RNA, 16 nt, Homo sapiens
cuagcaggaauauuuc

SEQ ID NO: 1086568 - RNA, 12 nt, Homo sapiens
cuaguagcuuuc

SEQ ID NO: 1086569 - RNA, 19 nt, Homo sapiens
cuagucucuucucagagca

SEQ ID NO: 1086570 - RNA, 20 nt, Homo sapiens
cuauggcccagccacugcag

SEQ ID NO: 1086571 - RNA, 14 nt, Homo sapiens
cuauuauuugcuau

SEQ ID NO: 1086572 - RNA, 19 nt, Homo sapiens
cuauucaaguauuaggggu

SEQ ID NO: 1086573 - RNA, 20 nt, Homo sapiens
cucaaaucaaauacauacaa

SEQ ID NO: 1086574 - RNA, 20 nt, Homo sapiens
cucaaggccucccacaguga

SEQ ID NO: 1086575 - RNA, 11 nt, Homo sapiens
cucacacuccu

SEQ ID NO: 1086576 - RNA, 19 nt, Homo sapiens
cucacagauacccauccaa

SEQ ID NO: 1086577 - RNA, 17 nt, Homo sapiens
cucaccuugcucugcca

SEQ ID NO: 1086578 - RNA, 13 nt, Homo sapiens
cucacugccaaaa

SEQ ID NO: 1086579 - RNA, 15 nt, Homo sapiens
cucagagcagcacug

SEQ ID NO: 1086580 - RNA, 13 nt, Homo sapiens
cucagagccucag

SEQ ID NO: 1086581 - RNA, 15 nt, Homo sapiens
cucagaguccaguca

SEQ ID NO: 1086582 - RNA, 20 nt, Homo sapiens
cucagccucccaaguagcug

SEQ ID NO: 1086583 - RNA, 23 nt, Homo sapiens
cucagcuucccaaguagcugaga

SEQ ID NO: 1086584 - RNA, 14 nt, Homo sapiens
cucaggccagucac

SEQ ID NO: 1086585 - RNA, 23 nt, Homo sapiens
cucagggcugucggugugcuguc

SEQ ID NO: 1086586 - RNA, 16 nt, Homo sapiens
cucagugucagcacuc

SEQ ID NO: 1086587 - RNA, 23 nt, Homo sapiens
cucaugcaagacuucacugcagc

SEQ ID NO: 1086588 - RNA, 11 nt, Homo sapiens
cucaugccacu

SEQ ID NO: 1086589 - RNA, 20 nt, Homo sapiens
cuccaccuaguggcugucca

SEQ ID NO: 1086590 - RNA, 16 nt, Homo sapiens
cuccacuccaccucca

SEQ ID NO: 1086591 - RNA, 17 nt, Homo sapiens
cuccacuguuucaugag

SEQ ID NO: 1086592 - RNA, 16 nt, Homo sapiens
cuccaguucugaugag

SEQ ID NO: 1086593 - RNA, 20 nt, Homo sapiens
cucccaaagugcugggauua

SEQ ID NO: 1086594 - RNA, 12 nt, Homo sapiens
cucccacaguga

SEQ ID NO: 1086595 - RNA, 13 nt, Homo sapiens
cucccagacugca

SEQ ID NO: 1086596 - RNA, 18 nt, Homo sapiens
cucccuguuaucugcuag

SEQ ID NO: 1086597 - RNA, 16 nt, Homo sapiens
cuccuggcacaacgcu

SEQ ID NO: 1086598 - RNA, 19 nt, Homo sapiens
cuccuggccucauacagaa

SEQ ID NO: 1086599 - RNA, 15 nt, Homo sapiens
cuccuuagaagugga

SEQ ID NO: 1086600 - RNA, 14 nt, Homo sapiens
cuccuuuccugcaa

SEQ ID NO: 1086601 - RNA, 16 nt, Homo sapiens
cucgaccucccaaagu

SEQ ID NO: 1086602 - RNA, 15 nt, Homo sapiens
cucggcagaugcugu

SEQ ID NO: 1086603 - RNA, 17 nt, Homo sapiens
cucggccucccaaagug

SEQ ID NO: 1086604 - RNA, 17 nt, Homo sapiens
cucuacuccuaccucag

SEQ ID NO: 1086605 - RNA, 21 nt, Homo sapiens
cucuagaacacccacuggcca

SEQ ID NO: 1086606 - RNA, 23 nt, Homo sapiens
cucuagucccuguguucugcaca

SEQ ID NO: 1086607 - RNA, 16 nt, Homo sapiens
cucucugcucagugau

SEQ ID NO: 1086608 - RNA, 14 nt, Homo sapiens
cucugaacaaaagc

SEQ ID NO: 1086609 - RNA, 14 nt, Homo sapiens
cucugaauguccca

SEQ ID NO: 1086610 - RNA, 16 nt, Homo sapiens
cucugaggaguggagu

SEQ ID NO: 1086611 - RNA, 19 nt, Homo sapiens
cucugcagauagugccucu

SEQ ID NO: 1086612 - RNA, 20 nt, Homo sapiens
cucugccagcguccccggcc

SEQ ID NO: 1086613 - RNA, 19 nt, Homo sapiens
cucugccugagacuuucag

SEQ ID NO: 1086614 - RNA, 20 nt, Homo sapiens
cucugcuuuuccugucugua

SEQ ID NO: 1086615 - RNA, 16 nt, Homo sapiens
cucuggacaugauuua

SEQ ID NO: 1086616 - RNA, 17 nt, Homo sapiens
gcucagagcugcugagc

SEQ ID NO: 1086617 - RNA, 20 nt, Homo sapiens
gcucccaccaggcagcucca

SEQ ID NO: 1086618 - RNA, 15 nt, Homo sapiens
gcuccuagcccagca

SEQ ID NO: 1086619 - RNA, 19 nt, Homo sapiens
gcuccucggcagaugcugu

SEQ ID NO: 1086620 - RNA, 22 nt, Homo sapiens
gcucuggcaccacuaggguccu

SEQ ID NO: 1086621 - RNA, 10 nt, Homo sapiens
gcucugggaa

SEQ ID NO: 1086622 - RNA, 17 nt, Homo sapiens
gcucugugggcugcacu

SEQ ID NO: 1086623 - RNA, 19 nt, Homo sapiens
gcugaacagugcucugccu

SEQ ID NO: 1086624 - RNA, 16 nt, Homo sapiens
gcugaccugguacuga

SEQ ID NO: 1086625 - RNA, 21 nt, Homo sapiens
gcugagagaguuaagugaaug

SEQ ID NO: 1086626 - RNA, 21 nt, Homo sapiens
gcugaggggaggaucacugga

SEQ ID NO: 1086627 - RNA, 19 nt, Homo sapiens
gcugagugcaccacuucaa

SEQ ID NO: 1086628 - RNA, 18 nt, Homo sapiens
gcugcauuugugucaucu

SEQ ID NO: 1086629 - RNA, 22 nt, Homo sapiens
gcugccuccacucccacuuccc

SEQ ID NO: 1086630 - RNA, 21 nt, Homo sapiens
gcuggaagaacugcaugggga

SEQ ID NO: 1086631 - RNA, 21 nt, Homo sapiens
gcuggagcaaaagucauuaca

SEQ ID NO: 1086632 - RNA, 17 nt, Homo sapiens
gcuggaggaacauuggg

SEQ ID NO: 1086633 - RNA, 22 nt, Homo sapiens
gcuggcaaugcccuaccugccu

SEQ ID NO: 1086634 - RNA, 14 nt, Homo sapiens
gcuggcugcaguga

SEQ ID NO: 1086635 - RNA, 14 nt, Homo sapiens
gcuggggcugguga

SEQ ID NO: 1086636 - RNA, 17 nt, Homo sapiens
gcugggggagggacugc

SEQ ID NO: 1086637 - RNA, 19 nt, Homo sapiens
gcuggguggcccauccccc

SEQ ID NO: 1086638 - RNA, 20 nt, Homo sapiens
gcugugguuccuaagccugu

SEQ ID NO: 1086639 - RNA, 19 nt, Homo sapiens
gcuguguuugagcuuucau

SEQ ID NO: 1086640 - RNA, 12 nt, Homo sapiens
gcuucacuuaaa

SEQ ID NO: 1086641 - RNA, 20 nt, Homo sapiens
gcuucaggggacuguucuca

SEQ ID NO: 1086642 - RNA, 14 nt, Homo sapiens
gcuucccaauguua

SEQ ID NO: 1086643 - RNA, 16 nt, Homo sapiens
gcuucugccacuuccc

SEQ ID NO: 1086644 - RNA, 17 nt, Homo sapiens
gcuucugccacuuccca

SEQ ID NO: 1086645 - RNA, 13 nt, Homo sapiens
gcuucugccucag

SEQ ID NO: 1086646 - RNA, 20 nt, Homo sapiens
gcuugccaggcuugucaaau

SEQ ID NO: 1086647 - RNA, 22 nt, Homo sapiens
gcuugugauuuuugaacaauac

SEQ ID NO: 1086648 - RNA, 20 nt, Homo sapiens
gcuuuaguccuagaggaccu

SEQ ID NO: 1086649 - RNA, 19 nt, Homo sapiens
gcuuuauaccccauuugau

SEQ ID NO: 1086650 - RNA, 22 nt, Homo sapiens
gcuuuaucaaaaaguacaauaa

SEQ ID NO: 1086651 - RNA, 16 nt, Homo sapiens
gcuuucuucuuuccag

SEQ ID NO: 1086652 - RNA, 20 nt, Homo sapiens
gcuuucuuuucucuaugaaa

SEQ ID NO: 1086653 - RNA, 15 nt, Homo sapiens
gcuuuggcaacagaa

SEQ ID NO: 1086654 - RNA, 21 nt, Homo sapiens
gcuuugggauaauguuuauaa

SEQ ID NO: 1086655 - RNA, 14 nt, Homo sapiens
gcuuuggugccugg

SEQ ID NO: 1086656 - RNA, 21 nt, Homo sapiens
gcuuuguuucuuucauaugaa

SEQ ID NO: 1086657 - RNA, 17 nt, Homo sapiens
ggaaaaaucauaaccac

SEQ ID NO: 1086658 - RNA, 13 nt, Homo sapiens
ggaaaaaugucac

SEQ ID NO: 1086659 - RNA, 14 nt, Homo sapiens
ggaaacaauaucaa

SEQ ID NO: 1086660 - RNA, 19 nt, Homo sapiens
ggaaacuguuguguccaau

SEQ ID NO: 1086661 - RNA, 15 nt, Homo sapiens
ggaaagcagccguuu

SEQ ID NO: 1086662 - RNA, 21 nt, Homo sapiens
ggaaaggauuuuaccaaagca

SEQ ID NO: 1086663 - RNA, 13 nt, Homo sapiens
ggaaccagcccag

SEQ ID NO: 1086664 - RNA, 18 nt, Homo sapiens
ggaagaacuugucccuca

SEQ ID NO: 1086665 - RNA, 19 nt, Homo sapiens
ggaagacacagcccagaca

SEQ ID NO: 1086666 - RNA, 14 nt, Homo sapiens
ggacccauuugcca

SEQ ID NO: 1086667 - RNA, 22 nt, Homo sapiens
ggacuucugcaucuuacaguca

SEQ ID NO: 1086668 - RNA, 23 nt, Homo sapiens
ggagaaccucaggcuuccuuggc

SEQ ID NO: 1086669 - RNA, 19 nt, Homo sapiens
ggagagcccgugggggcag

SEQ ID NO: 1086670 - RNA, 16 nt, Homo sapiens
ggagcagccuccagug

SEQ ID NO: 1086671 - RNA, 16 nt, Homo sapiens
ggagccauaagggaca

SEQ ID NO: 1086672 - RNA, 23 nt, Homo sapiens
ggagccauaagggacaugucuuu

SEQ ID NO: 1086673 - RNA, 13 nt, Homo sapiens
ggagccaugucau

SEQ ID NO: 1086674 - RNA, 18 nt, Homo sapiens
ggagccucguccaaggca

SEQ ID NO: 1086675 - RNA, 14 nt, Homo sapiens
ggagcucaguuucu

SEQ ID NO: 1086676 - RNA, 20 nt, Homo sapiens
ggaggcuccucccucugccu

SEQ ID NO: 1086677 - RNA, 17 nt, Homo sapiens
ggaggcugcaguucccu

SEQ ID NO: 1086678 - RNA, 23 nt, Homo sapiens
ggaggugccgguaccagccugac

SEQ ID NO: 1086679 - RNA, 16 nt, Homo sapiens
ggagguuguugcagug

SEQ ID NO: 1086680 - RNA, 16 nt, Homo sapiens
ggagucucaugcaaga

SEQ ID NO: 1086681 - RNA, 18 nt, Homo sapiens
ggagucucaugcaagacu

SEQ ID NO: 1086682 - RNA, 15 nt, Homo sapiens
ggagugcugcagcuu

SEQ ID NO: 1086683 - RNA, 18 nt, Homo sapiens
ggauacgacaacuugcac

SEQ ID NO: 1086684 - RNA, 19 nt, Homo sapiens
ggaucuucccacuuugcca

SEQ ID NO: 1086685 - RNA, 14 nt, Homo sapiens
ggaugacugugauu

SEQ ID NO: 1086686 - RNA, 13 nt, Homo sapiens
ggauggaaaggga

SEQ ID NO: 1086687 - RNA, 19 nt, Homo sapiens
ggauggggagucucaugca

SEQ ID NO: 1086688 - RNA, 13 nt, Homo sapiens
ggcaaagaucuca

SEQ ID NO: 1086689 - RNA, 23 nt, Homo sapiens
ggcaacaauacaugcugcuaauu

SEQ ID NO: 1086690 - RNA, 17 nt, Homo sapiens
ggcacccccaaauucaa

SEQ ID NO: 1086691 - RNA, 20 nt, Homo sapiens
ggcacugcuggguggcccau

SEQ ID NO: 1086692 - RNA, 19 nt, Homo sapiens
ggcagcggggcaagcaaaa

SEQ ID NO: 1086693 - RNA, 19 nt, Homo sapiens
ggcagcucgagcaugcccu

SEQ ID NO: 1086694 - RNA, 17 nt, Homo sapiens
ggcaugauucuacccuu

SEQ ID NO: 1086695 - RNA, 24 nt, Homo sapiens
ggcauucucucugcucagugaucu

SEQ ID NO: 1086696 - RNA, 15 nt, Homo sapiens
ggccaaguuccucua

SEQ ID NO: 1086697 - RNA, 15 nt, Homo sapiens
ggccacaccaucucc

SEQ ID NO: 1086698 - RNA, 21 nt, Homo sapiens
ggccacuccccagugcuccug

SEQ ID NO: 1086699 - RNA, 20 nt, Homo sapiens
ggccagggccucugugcaga

SEQ ID NO: 1086700 - RNA, 15 nt, Homo sapiens
ggcccagccacugca

SEQ ID NO: 1086701 - RNA, 15 nt, Homo sapiens
ggccccagaacacag

SEQ ID NO: 1086702 - RNA, 19 nt, Homo sapiens
ggccucgucuuucauggac

SEQ ID NO: 1086703 - RNA, 13 nt, Homo sapiens
ggccucugugcag

SEQ ID NO: 1086704 - RNA, 23 nt, Homo sapiens
ggccugccuugaagccacugaag

SEQ ID NO: 1086705 - RNA, 18 nt, Homo sapiens
ggccuucuccacagggac

SEQ ID NO: 1086706 - RNA, 19 nt, Homo sapiens
ggcgaccagggccaucucc

SEQ ID NO: 1086707 - RNA, 12 nt, Homo sapiens
ggcguguguucc

SEQ ID NO: 1086708 - RNA, 16 nt, Homo sapiens
ggcucagucucaggag

SEQ ID NO: 1086709 - RNA, 18 nt, Homo sapiens
ggcucugaggaguggagu

SEQ ID NO: 1086710 - RNA, 13 nt, Homo sapiens
ggcugaagaggcu

SEQ ID NO: 1086711 - RNA, 21 nt, Homo sapiens
ggcugacccagugugugcuca

SEQ ID NO: 1086712 - RNA, 21 nt, Homo sapiens
ggcugcucgaagaacaauguc

SEQ ID NO: 1086713 - RNA, 15 nt, Homo sapiens
ggcuucccaggggaa

SEQ ID NO: 1086714 - RNA, 23 nt, Homo sapiens
ggcuuguugcccucugcaguuga

SEQ ID NO: 1086715 - RNA, 19 nt, Homo sapiens
ggcuuuuccaaaagcaaac

SEQ ID NO: 1086716 - RNA, 13 nt, Homo sapiens
ggcuuuugaacug

SEQ ID NO: 1086717 - RNA, 22 nt, Homo sapiens
gggaaaccaguguagccuugcc

SEQ ID NO: 1086718 - RNA, 22 nt, Homo sapiens
gggaagcgaugaauuuggagac

SEQ ID NO: 1086719 - RNA, 22 nt, Homo sapiens
gggaaggaggccguccaucccg

SEQ ID NO: 1086720 - RNA, 15 nt, Homo sapiens
gggacacaggggcaa

SEQ ID NO: 1086721 - RNA, 23 nt, Homo sapiens
gggagagaaagcuuuauauuugu

SEQ ID NO: 1086722 - RNA, 17 nt, Homo sapiens
gggaggaagcagguuga

SEQ ID NO: 1086723 - RNA, 14 nt, Homo sapiens
gggcaaagaucuca

SEQ ID NO: 1086724 - RNA, 18 nt, Homo sapiens
gggcaacaaggugcacag

SEQ ID NO: 1086725 - RNA, 16 nt, Homo sapiens
gggcacagcuggagac

SEQ ID NO: 1086726 - RNA, 21 nt, Homo sapiens
gggcacggcuucccaggggaa

SEQ ID NO: 1086727 - RNA, 14 nt, Homo sapiens
gggccagaugcugg

SEQ ID NO: 1086728 - RNA, 18 nt, Homo sapiens
gggccucaucugcuccua

SEQ ID NO: 1086729 - RNA, 22 nt, Homo sapiens
gggccugcugcgucagaccagu

SEQ ID NO: 1086730 - RNA, 16 nt, Homo sapiens
gggccuuauccaguca

SEQ ID NO: 1086731 - RNA, 14 nt, Homo sapiens
gggcugacugggac

SEQ ID NO: 1086732 - RNA, 16 nt, Homo sapiens
gggcugagcccuggca

SEQ ID NO: 1086733 - RNA, 22 nt, Homo sapiens
gggcugcccgcucccagugucu

SEQ ID NO: 1086734 - RNA, 20 nt, Homo sapiens
gggcuucucgccccucagug

SEQ ID NO: 1086735 - RNA, 17 nt, Homo sapiens
ggggcacccuccaaaca

SEQ ID NO: 1086736 - RNA, 11 nt, Homo sapiens
gggugccauuc

SEQ ID NO: 1086737 - RNA, 14 nt, Homo sapiens
gggugucugcuaaa

SEQ ID NO: 1086738 - RNA, 13 nt, Homo sapiens
ggguguguguagc

SEQ ID NO: 1086739 - RNA, 18 nt, Homo sapiens
uguaaaggaaacauauuu

SEQ ID NO: 1086740 - RNA, 19 nt, Homo sapiens
uguaaaugagacacauaca

SEQ ID NO: 1086741 - RNA, 22 nt, Homo sapiens
uguaacuacccucucaaaugga

SEQ ID NO: 1086742 - RNA, 18 nt, Homo sapiens
uguaaguuuaugucuaaa

SEQ ID NO: 1086743 - RNA, 15 nt, Homo sapiens
uguaaucccagcuau

SEQ ID NO: 1086744 - RNA, 19 nt, Homo sapiens
uguacuggagaguggcaaa

SEQ ID NO: 1086745 - RNA, 18 nt, Homo sapiens
uguagaacucugcaggca

SEQ ID NO: 1086746 - RNA, 20 nt, Homo sapiens
uguagccccgggcugaccca

SEQ ID NO: 1086747 - RNA, 22 nt, Homo sapiens
uguagugucuguaauaccuuag

SEQ ID NO: 1086748 - RNA, 13 nt, Homo sapiens
uguauaauaugca

SEQ ID NO: 1086749 - RNA, 16 nt, Homo sapiens
uguauaccaugaugca

SEQ ID NO: 1086750 - RNA, 19 nt, Homo sapiens
uguaucuaccucacuauuc

SEQ ID NO: 1086751 - RNA, 20 nt, Homo sapiens
uguaucuaccucacuauuca

SEQ ID NO: 1086752 - RNA, 19 nt, Homo sapiens
uguauuuaaaugaaaguga

SEQ ID NO: 1086753 - RNA, 19 nt, Homo sapiens
ugucaaguggaaacaugcu

SEQ ID NO: 1086754 - RNA, 23 nt, Homo sapiens
uguccauccuccucuccaugcaa

SEQ ID NO: 1086755 - RNA, 13 nt, Homo sapiens
uguccccuacccc

SEQ ID NO: 1086756 - RNA, 22 nt, Homo sapiens
ugucccuuccauuucuacugua

SEQ ID NO: 1086757 - RNA, 16 nt, Homo sapiens
uguccguccucuuccc

SEQ ID NO: 1086758 - RNA, 14 nt, Homo sapiens
uguccucgcacugc

SEQ ID NO: 1086759 - RNA, 21 nt, Homo sapiens
uguccuucuuuaucugugaua

SEQ ID NO: 1086760 - RNA, 15 nt, Homo sapiens
ugucugcaacaugga

SEQ ID NO: 1086761 - RNA, 20 nt, Homo sapiens
ugucuuuggugaacauugca

SEQ ID NO: 1086762 - RNA, 20 nt, Homo sapiens
ugugacaugaacccauccaa

SEQ ID NO: 1086763 - RNA, 15 nt, Homo sapiens
ugugacuauguucca

SEQ ID NO: 1086764 - RNA, 16 nt, Homo sapiens
ugugaucaucccaucu

SEQ ID NO: 1086765 - RNA, 14 nt, Homo sapiens
ugugauuuuguccc

SEQ ID NO: 1086766 - RNA, 16 nt, Homo sapiens
ugugcagacaguguca

SEQ ID NO: 1086767 - RNA, 17 nt, Homo sapiens
ugugcagacagugucag

SEQ ID NO: 1086768 - RNA, 22 nt, Homo sapiens
ugugccccauguccaaguccaa

SEQ ID NO: 1086769 - RNA, 15 nt, Homo sapiens
ugugcucccaccagg

SEQ ID NO: 1086770 - RNA, 18 nt, Homo sapiens
ugugcugaucgccuuauu

SEQ ID NO: 1086771 - RNA, 19 nt, Homo sapiens
uguggauacagucauuauu

SEQ ID NO: 1086772 - RNA, 13 nt, Homo sapiens
uguggccaguuua

SEQ ID NO: 1086773 - RNA, 13 nt, Homo sapiens
ugugucugcaaca

SEQ ID NO: 1086774 - RNA, 21 nt, Homo sapiens
ugugugaggacuucugcaucu

SEQ ID NO: 1086775 - RNA, 12 nt, Homo sapiens
ugugugcucagc

SEQ ID NO: 1086776 - RNA, 12 nt, Homo sapiens
uguguguagcca

SEQ ID NO: 1086777 - RNA, 13 nt, Homo sapiens
uguguguagccaa

SEQ ID NO: 1086778 - RNA, 13 nt, Homo sapiens
ugugugucucuga

SEQ ID NO: 1086779 - RNA, 22 nt, Homo sapiens
uguguguuagcagucaaaucua

SEQ ID NO: 1086780 - RNA, 18 nt, Homo sapiens
uguguuaguaaacugugc

SEQ ID NO: 1086781 - RNA, 21 nt, Homo sapiens
uguuacuaaagucacauauaa

SEQ ID NO: 1086782 - RNA, 16 nt, Homo sapiens
uguuacuuaaacauca

SEQ ID NO: 1086783 - RNA, 18 nt, Homo sapiens
uguuauuuuuuauuucca

SEQ ID NO: 1086784 - RNA, 18 nt, Homo sapiens
uguucagcuggacaauau

SEQ ID NO: 1086785 - RNA, 18 nt, Homo sapiens
uguuccccagcugaucau

SEQ ID NO: 1086786 - RNA, 18 nt, Homo sapiens
uguugacuggccaaaaau

SEQ ID NO: 1086787 - RNA, 20 nt, Homo sapiens
uguugauaaauuccacugga

SEQ ID NO: 1086788 - RNA, 12 nt, Homo sapiens
uguugaucccaa

SEQ ID NO: 1086789 - RNA, 17 nt, Homo sapiens
uguugcuguugcuguug

SEQ ID NO: 1086790 - RNA, 16 nt, Homo sapiens
uguugugucuugcuau

SEQ ID NO: 1086791 - RNA, 19 nt, Homo sapiens
uguuguucauagucaauca

SEQ ID NO: 1086792 - RNA, 14 nt, Homo sapiens
uguuucccaccuca

SEQ ID NO: 1086793 - RNA, 23 nt, Homo sapiens
uguuucucggcaccagugccuca

SEQ ID NO: 1086794 - RNA, 15 nt, Homo sapiens
uuaaaacucuuuauc

SEQ ID NO: 1086795 - RNA, 16 nt, Homo sapiens
uuaaagaaacacuaaa

SEQ ID NO: 1086796 - RNA, 22 nt, Homo sapiens
uuaaauguagaaagugauccau

SEQ ID NO: 1086797 - RNA, 19 nt, Homo sapiens
uuaacacgugacacugugg

SEQ ID NO: 1086798 - RNA, 21 nt, Homo sapiens
uuaacagcgugucaacuuuca

SEQ ID NO: 1086799 - RNA, 15 nt, Homo sapiens
uuaacuugaggguaa

SEQ ID NO: 1086800 - RNA, 15 nt, Homo sapiens
uuaaggccacacugg

SEQ ID NO: 1086801 - RNA, 20 nt, Homo sapiens
uuaauauuguuguuuaccaa

SEQ ID NO: 1086802 - RNA, 14 nt, Homo sapiens
uuaauuuucacuuu

SEQ ID NO: 1086803 - RNA, 19 nt, Homo sapiens
uuacaacaaacacugugau

SEQ ID NO: 1086804 - RNA, 14 nt, Homo sapiens
uuacauacagugau

SEQ ID NO: 1086805 - RNA, 15 nt, Homo sapiens
uuacauacagugaua

SEQ ID NO: 1086806 - RNA, 19 nt, Homo sapiens
uuaccaaagcaucaauaca

SEQ ID NO: 1086807 - RNA, 19 nt, Homo sapiens
uuagaagaucugcuucccu

SEQ ID NO: 1086808 - RNA, 14 nt, Homo sapiens
uuagauuaguauuu

SEQ ID NO: 1086809 - RNA, 16 nt, Homo sapiens
uuagucuucaguaugc

SEQ ID NO: 1086810 - RNA, 16 nt, Homo sapiens
ugaauuuuugcacauu

SEQ ID NO: 1086811 - RNA, 23 nt, Homo sapiens
ugacaacauuuuuguacauuaug

SEQ ID NO: 1086812 - RNA, 18 nt, Homo sapiens
ugacauauauauguauau

SEQ ID NO: 1086813 - RNA, 12 nt, Homo sapiens
ugaccaugugau

SEQ ID NO: 1086814 - RNA, 11 nt, Homo sapiens
ugaccauuuga

SEQ ID NO: 1086815 - RNA, 18 nt, Homo sapiens
ugacccagugugugcuca

SEQ ID NO: 1086816 - RNA, 14 nt, Homo sapiens
ugaccccuuuucag

SEQ ID NO: 1086817 - RNA, 14 nt, Homo sapiens
ugaccugguacuga

SEQ ID NO: 1086818 - RNA, 15 nt, Homo sapiens
ugaccugguacugag

SEQ ID NO: 1086819 - RNA, 17 nt, Homo sapiens
ugaccugguacugaggu

SEQ ID NO: 1086820 - RNA, 22 nt, Homo sapiens
ugacucaagacuuccagagccu

SEQ ID NO: 1086821 - RNA, 19 nt, Homo sapiens
ugacuccccccuuccaaau

SEQ ID NO: 1086822 - RNA, 14 nt, Homo sapiens
ugacucuacuccca

SEQ ID NO: 1086823 - RNA, 19 nt, Homo sapiens
ugacucuguagccagaaga

SEQ ID NO: 1086824 - RNA, 14 nt, Homo sapiens
ugacuggccaaaaa

SEQ ID NO: 1086825 - RNA, 21 nt, Homo sapiens
ugacuuugccacauccauuga

SEQ ID NO: 1086826 - RNA, 20 nt, Homo sapiens
ugacuuuuaauuuucacuuu

SEQ ID NO: 1086827 - RNA, 15 nt, Homo sapiens
ugagacccuguucua

SEQ ID NO: 1086828 - RNA, 22 nt, Homo sapiens
ugagacuuugaggguguauauu

SEQ ID NO: 1086829 - RNA, 19 nt, Homo sapiens
ugagauacugaagugcagc

SEQ ID NO: 1086830 - RNA, 18 nt, Homo sapiens
ugagcaacuccuguucuu

SEQ ID NO: 1086831 - RNA, 19 nt, Homo sapiens
ugaggaacaaucacaaaag

SEQ ID NO: 1086832 - RNA, 13 nt, Homo sapiens
ugaggaguggagu

SEQ ID NO: 1086833 - RNA, 15 nt, Homo sapiens
ugaggcaaaggccag

SEQ ID NO: 1086834 - RNA, 16 nt, Homo sapiens
ugaggggcuccuggaa

SEQ ID NO: 1086835 - RNA, 12 nt, Homo sapiens
ugaggguguaua

SEQ ID NO: 1086836 - RNA, 17 nt, Homo sapiens
ugaguuuuauugacuca

SEQ ID NO: 1086837 - RNA, 14 nt, Homo sapiens
ugauaaacuuugaa

SEQ ID NO: 1086838 - RNA, 15 nt, Homo sapiens
ugauaaagcaguauu

SEQ ID NO: 1086839 - RNA, 14 nt, Homo sapiens
ugauauaugccuau

SEQ ID NO: 1086840 - RNA, 18 nt, Homo sapiens
ugauaucccccagccuca

SEQ ID NO: 1086841 - RNA, 21 nt, Homo sapiens
ugaucgcgccacuacacucca

SEQ ID NO: 1086842 - RNA, 23 nt, Homo sapiens
ugaucggagccuccucucucaaa

SEQ ID NO: 1086843 - RNA, 15 nt, Homo sapiens
ugaugaaaaccaccc

SEQ ID NO: 1086844 - RNA, 15 nt, Homo sapiens
ugauuaaacagcaaa

SEQ ID NO: 1086845 - RNA, 22 nt, Homo sapiens
ugauuccauuuuacuuccauga

SEQ ID NO: 1086846 - RNA, 13 nt, Homo sapiens
ugauucccagaaa

SEQ ID NO: 1086847 - RNA, 20 nt, Homo sapiens
ugauuucuaguaucuauugu

SEQ ID NO: 1086848 - RNA, 18 nt, Homo sapiens
ugauuucuuucuuugcac

SEQ ID NO: 1086849 - RNA, 12 nt, Homo sapiens
ugcaaacagugu

SEQ ID NO: 1086850 - RNA, 17 nt, Homo sapiens
ugcaaauccccucccca

SEQ ID NO: 1086851 - RNA, 13 nt, Homo sapiens
ugcaagggugcug

SEQ ID NO: 1086852 - RNA, 14 nt, Homo sapiens
ugcaauguccugca

SEQ ID NO: 1086853 - RNA, 17 nt, Homo sapiens
ugcacaaauggaacucc

SEQ ID NO: 1086854 - RNA, 12 nt, Homo sapiens
ugcaccaaagac

SEQ ID NO: 1086855 - RNA, 15 nt, Homo sapiens
ugcaccacccuuuga

SEQ ID NO: 1086856 - RNA, 20 nt, Homo sapiens
ugcaccgagagagauggaau

SEQ ID NO: 1086857 - RNA, 16 nt, Homo sapiens
ugcacucucucucugu

SEQ ID NO: 1086858 - RNA, 23 nt, Homo sapiens
ugcacucugugcccaugggcacu

SEQ ID NO: 1086859 - RNA, 15 nt, Homo sapiens
ugcacuguccugcuc

SEQ ID NO: 1086860 - RNA, 23 nt, Homo sapiens
ugcacuguccugcuccacagugu

SEQ ID NO: 1086861 - RNA, 17 nt, Homo sapiens
ugcacuuuuaaaccucu

SEQ ID NO: 1086862 - RNA, 13 nt, Homo sapiens
ugcagaacagggg

SEQ ID NO: 1086863 - RNA, 14 nt, Homo sapiens
ugcagacaguguca

SEQ ID NO: 1086864 - RNA, 20 nt, Homo sapiens
ugcagacagugucagaguca

SEQ ID NO: 1086865 - RNA, 17 nt, Homo sapiens
ugcagauagugccucug

SEQ ID NO: 1086866 - RNA, 20 nt, Homo sapiens
ugcagauagugccucugcaa

SEQ ID NO: 1086867 - RNA, 22 nt, Homo sapiens
ugcagcuuccugucaacacuuc

SEQ ID NO: 1086868 - RNA, 17 nt, Homo sapiens
ugcaggagagcuucccc

SEQ ID NO: 1086869 - RNA, 17 nt, Homo sapiens
ugcaugaaaccacugga

SEQ ID NO: 1086870 - RNA, 15 nt, Homo sapiens
ugcaugugugugaug

SEQ ID NO: 1086871 - RNA, 16 nt, Homo sapiens
ugcauucuagugcaga

SEQ ID NO: 1086872 - RNA, 17 nt, Homo sapiens
ugcauuuucauauugcu

SEQ ID NO: 1086873 - RNA, 23 nt, Homo sapiens
ugccacauggagcuugacuucau

SEQ ID NO: 1086874 - RNA, 19 nt, Homo sapiens
ugccacugcuuucauugaa

SEQ ID NO: 1086875 - RNA, 18 nt, Homo sapiens
ugccccggcuugccugua

SEQ ID NO: 1086876 - RNA, 16 nt, Homo sapiens
ugccccuggccuuuga

SEQ ID NO: 1086877 - RNA, 18 nt, Homo sapiens
ugcccgaccccaucucau

SEQ ID NO: 1086878 - RNA, 14 nt, Homo sapiens
ugccucauccuccu

SEQ ID NO: 1086879 - RNA, 21 nt, Homo sapiens
ugccuccacucccacuucccu

SEQ ID NO: 1086880 - RNA, 12 nt, Homo sapiens
ugccucugcaaa

SEQ ID NO: 1086881 - RNA, 17 nt, Homo sapiens
ugccugcugggcucuua

SEQ ID NO: 1086882 - RNA, 15 nt, Homo sapiens
ugccuggcaaggccu

SEQ ID NO: 1086883 - RNA, 21 nt, Homo sapiens
ugccugugcaugaccugauca

SEQ ID NO: 1086884 - RNA, 15 nt, Homo sapiens
ugccuuaagccaaua

SEQ ID NO: 1086885 - RNA, 20 nt, Homo sapiens
ugccuuaguuguuaucaucu

SEQ ID NO: 1086886 - RNA, 22 nt, Homo sapiens
ucagugaugaaaauuugccuuu

SEQ ID NO: 1086887 - RNA, 23 nt, Homo sapiens
ucagugaugaaaauuugccuuug

SEQ ID NO: 1086888 - RNA, 18 nt, Homo sapiens
ucagugcacuguauauag

SEQ ID NO: 1086889 - RNA, 19 nt, Homo sapiens
ucaguuucuuuuucacuug

SEQ ID NO: 1086890 - RNA, 18 nt, Homo sapiens
ucauauugcuaccaaaaa

SEQ ID NO: 1086891 - RNA, 20 nt, Homo sapiens
ucaugacugagucuggcaaa

SEQ ID NO: 1086892 - RNA, 18 nt, Homo sapiens
ucaugaguuucccagaga

SEQ ID NO: 1086893 - RNA, 16 nt, Homo sapiens
ucaugcaagacuucac

SEQ ID NO: 1086894 - RNA, 21 nt, Homo sapiens
ucauuaagcgggaucccagca

SEQ ID NO: 1086895 - RNA, 16 nt, Homo sapiens
ucauucagcagucagu

SEQ ID NO: 1086896 - RNA, 14 nt, Homo sapiens
ucauuccccggggc

SEQ ID NO: 1086897 - RNA, 15 nt, Homo sapiens
ucauuggaagccauc

SEQ ID NO: 1086898 - RNA, 22 nt, Homo sapiens
uccaaggcaguucuguguccuc

SEQ ID NO: 1086899 - RNA, 22 nt, Homo sapiens
uccaaggguaugggaagccaua

SEQ ID NO: 1086900 - RNA, 19 nt, Homo sapiens
uccaagugaaugaguuucc

SEQ ID NO: 1086901 - RNA, 15 nt, Homo sapiens
uccacaccugggcau

SEQ ID NO: 1086902 - RNA, 13 nt, Homo sapiens
uccacaguggaac

SEQ ID NO: 1086903 - RNA, 19 nt, Homo sapiens
uccacccuaaagucucagg

SEQ ID NO: 1086904 - RNA, 20 nt, Homo sapiens
uccaccuaguggcuguccag

SEQ ID NO: 1086905 - RNA, 13 nt, Homo sapiens
uccacuguuucau

SEQ ID NO: 1086906 - RNA, 18 nt, Homo sapiens
uccagaaugugcugccuu

SEQ ID NO: 1086907 - RNA, 19 nt, Homo sapiens
uccagaccauugucuucca

SEQ ID NO: 1086908 - RNA, 18 nt, Homo sapiens
uccagcuaagccugauga

SEQ ID NO: 1086909 - RNA, 19 nt, Homo sapiens
uccagcuguuaccugagau

SEQ ID NO: 1086910 - RNA, 22 nt, Homo sapiens
uccaggcuccucaugaggccau

SEQ ID NO: 1086911 - RNA, 17 nt, Homo sapiens
uccagguguguucagua

SEQ ID NO: 1086912 - RNA, 13 nt, Homo sapiens
uccauagugcacu

SEQ ID NO: 1086913 - RNA, 14 nt, Homo sapiens
uccauagugcacua

SEQ ID NO: 1086914 - RNA, 18 nt, Homo sapiens
uccauauuuauuuaaaca

SEQ ID NO: 1086915 - RNA, 21 nt, Homo sapiens
uccaucacuagccaugauaac

SEQ ID NO: 1086916 - RNA, 21 nt, Homo sapiens
uccauccuccucuccaugcaa

SEQ ID NO: 1086917 - RNA, 16 nt, Homo sapiens
uccaugauacuuuaau

SEQ ID NO: 1086918 - RNA, 12 nt, Homo sapiens
uccauguaucua

SEQ ID NO: 1086919 - RNA, 15 nt, Homo sapiens
uccauguguaucugg

SEQ ID NO: 1086920 - RNA, 19 nt, Homo sapiens
uccauuguggaaacuggau

SEQ ID NO: 1086921 - RNA, 15 nt, Homo sapiens
uccauuuuacuucca

SEQ ID NO: 1086922 - RNA, 16 nt, Homo sapiens
uccauuuuacuuccau

SEQ ID NO: 1086923 - RNA, 19 nt, Homo sapiens
uccauuuuacuuccaugau

SEQ ID NO: 1086924 - RNA, 20 nt, Homo sapiens
uccauuuuacuuccaugaua

SEQ ID NO: 1086925 - RNA, 14 nt, Homo sapiens
agcauuuucuugaa

SEQ ID NO: 1086926 - RNA, 21 nt, Homo sapiens
agcauuuucuugaaccaauaa

SEQ ID NO: 1086927 - RNA, 17 nt, Homo sapiens
agccacauuuugcauua

SEQ ID NO: 1086928 - RNA, 20 nt, Homo sapiens
agccacugcagcacaggagg

SEQ ID NO: 1086929 - RNA, 13 nt, Homo sapiens
agccagcuccugc

SEQ ID NO: 1086930 - RNA, 15 nt, Homo sapiens
agccaguacagagaa

SEQ ID NO: 1086931 - RNA, 23 nt, Homo sapiens
agccaucccuuuuuuuacauuuc

SEQ ID NO: 1086932 - RNA, 18 nt, Homo sapiens
agcccuguccccuacccc

SEQ ID NO: 1086933 - RNA, 16 nt, Homo sapiens
agccuaaauuucccaa

SEQ ID NO: 1086934 - RNA, 12 nt, Homo sapiens
agccuccagugc

SEQ ID NO: 1086935 - RNA, 17 nt, Homo sapiens
agccucccucugaccug

SEQ ID NO: 1086936 - RNA, 17 nt, Homo sapiens
agccugaccccaggcag

SEQ ID NO: 1086937 - RNA, 22 nt, Homo sapiens
agccugacgccuacuggggcag

SEQ ID NO: 1086938 - RNA, 15 nt, Homo sapiens
agccugaugauggaa

SEQ ID NO: 1086939 - RNA, 21 nt, Homo sapiens
agccugcuuuuguccuguuau

SEQ ID NO: 1086940 - RNA, 16 nt, Homo sapiens
agcgagcuaugaucgc

SEQ ID NO: 1086941 - RNA, 20 nt, Homo sapiens
agcuauuagcaacugugcua

SEQ ID NO: 1086942 - RNA, 23 nt, Homo sapiens
agcuccagcuguuaccugagaua

SEQ ID NO: 1086943 - RNA, 15 nt, Homo sapiens
agcucgagcaugccc

SEQ ID NO: 1086944 - RNA, 22 nt, Homo sapiens
agcucucugagccagucccuca

SEQ ID NO: 1086945 - RNA, 14 nt, Homo sapiens
agcucucuuuccca

SEQ ID NO: 1086946 - RNA, 15 nt, Homo sapiens
agcucugaacaaaag

SEQ ID NO: 1086947 - RNA, 16 nt, Homo sapiens
agcugaauugagcuag

SEQ ID NO: 1086948 - RNA, 14 nt, Homo sapiens
agcugagauuacag

SEQ ID NO: 1086949 - RNA, 20 nt, Homo sapiens
agcugaucaugucagccuca

SEQ ID NO: 1086950 - RNA, 11 nt, Homo sapiens
agcugcacuca

SEQ ID NO: 1086951 - RNA, 21 nt, Homo sapiens
agcuggaggaacauugggaag

SEQ ID NO: 1086952 - RNA, 23 nt, Homo sapiens
agcuggugccagaugugggcuca

SEQ ID NO: 1086953 - RNA, 20 nt, Homo sapiens
agcugguggauggugacuuu

SEQ ID NO: 1086954 - RNA, 20 nt, Homo sapiens
agcuguaaaaagagagaaaa

SEQ ID NO: 1086955 - RNA, 15 nt, Homo sapiens
agcuguagaacucug

SEQ ID NO: 1086956 - RNA, 22 nt, Homo sapiens
agcuguagcucccgagcuacuc

SEQ ID NO: 1086957 - RNA, 23 nt, Homo sapiens
agcuguauaauuaauugucauua

SEQ ID NO: 1086958 - RNA, 21 nt, Homo sapiens
agcuucacuuaaaaucaaauu

SEQ ID NO: 1086959 - RNA, 14 nt, Homo sapiens
agcuuccugaguca

SEQ ID NO: 1086960 - RNA, 15 nt, Homo sapiens
agcuuccugucaaca

SEQ ID NO: 1086961 - RNA, 17 nt, Homo sapiens
agcuucugccacuuccc

SEQ ID NO: 1086962 - RNA, 19 nt, Homo sapiens
agcuuucaugaguuuccca

SEQ ID NO: 1086963 - RNA, 22 nt, Homo sapiens
aggaaaggauuuuaccaaagca

SEQ ID NO: 1086964 - RNA, 22 nt, Homo sapiens
aggaacacccggaaagacugaa

SEQ ID NO: 1086965 - RNA, 23 nt, Homo sapiens
aggacuggggcuugccaggcuug

SEQ ID NO: 1086966 - RNA, 13 nt, Homo sapiens
aggagcagcuuca

SEQ ID NO: 1086967 - RNA, 18 nt, Homo sapiens
aggagccagccaggacuc

SEQ ID NO: 1086968 - RNA, 19 nt, Homo sapiens
aggaggcuuggaaagcauc

SEQ ID NO: 1086969 - RNA, 19 nt, Homo sapiens
aggagggguuaaagcugcc

SEQ ID NO: 1086970 - RNA, 22 nt, Homo sapiens
aggaguggaguucucuguucua

SEQ ID NO: 1086971 - RNA, 20 nt, Homo sapiens
aggaucuucccacuuugcca

SEQ ID NO: 1086972 - RNA, 18 nt, Homo sapiens
aggaugcugucaggagau

SEQ ID NO: 1086973 - RNA, 20 nt, Homo sapiens
aggauuguuucucggcacca

SEQ ID NO: 1086974 - RNA, 14 nt, Homo sapiens
aggauuuuaccaaa

SEQ ID NO: 1086975 - RNA, 14 nt, Homo sapiens
aggcacagcacagg

SEQ ID NO: 1086976 - RNA, 15 nt, Homo sapiens
aggcagccacagaca

SEQ ID NO: 1086977 - RNA, 20 nt, Homo sapiens
aggcagcuccagcuguuacc

SEQ ID NO: 1086978 - RNA, 17 nt, Homo sapiens
aggcaguucuguguccu

SEQ ID NO: 1086979 - RNA, 14 nt, Homo sapiens
aggcaucugagugu

SEQ ID NO: 1086980 - RNA, 15 nt, Homo sapiens
acggagccaugucau

SEQ ID NO: 1086981 - RNA, 23 nt, Homo sapiens
acgggguuucaccacauucguca

SEQ ID NO: 1086982 - RNA, 21 nt, Homo sapiens
acgugcccagccacaucaucu

SEQ ID NO: 1086983 - RNA, 18 nt, Homo sapiens
acuaaacagacuauuuaa

SEQ ID NO: 1086984 - RNA, 12 nt, Homo sapiens
acuaaacauaca

SEQ ID NO: 1086985 - RNA, 19 nt, Homo sapiens
acuaccagugggcauguau

SEQ ID NO: 1086986 - RNA, 16 nt, Homo sapiens
acuacuacucaauggc

SEQ ID NO: 1086987 - RNA, 18 nt, Homo sapiens
acuauuucugaacaaaga

SEQ ID NO: 1086988 - RNA, 17 nt, Homo sapiens
acucaccccuucuaauc

SEQ ID NO: 1086989 - RNA, 13 nt, Homo sapiens
acuccagccugag

SEQ ID NO: 1086990 - RNA, 16 nt, Homo sapiens
acuccccagugcuccu

SEQ ID NO: 1086991 - RNA, 19 nt, Homo sapiens
acucccuccucacacucca

SEQ ID NO: 1086992 - RNA, 16 nt, Homo sapiens
acuccugaaagcccug

SEQ ID NO: 1086993 - RNA, 23 nt, Homo sapiens
acuccugaccucgugauuugccu

SEQ ID NO: 1086994 - RNA, 20 nt, Homo sapiens
acuccuguucuuugggcuca

SEQ ID NO: 1086995 - RNA, 13 nt, Homo sapiens
acucugcaggcag

SEQ ID NO: 1086996 - RNA, 17 nt, Homo sapiens
acucuuaaguugaucua

SEQ ID NO: 1086997 - RNA, 17 nt, Homo sapiens
acucuuagaagugacau

SEQ ID NO: 1086998 - RNA, 19 nt, Homo sapiens
acugcacccccuccugcug

SEQ ID NO: 1086999 - RNA, 21 nt, Homo sapiens
acugcagccuuucacaggacu

SEQ ID NO: 1087000 - RNA, 21 nt, Homo sapiens
acuggagaugacagugaugcu

SEQ ID NO: 1087001 - RNA, 21 nt, Homo sapiens
acuggaugaacaggauguaua

SEQ ID NO: 1087002 - RNA, 19 nt, Homo sapiens
acuggcugccuccacuccc

SEQ ID NO: 1087003 - RNA, 14 nt, Homo sapiens
acuguacuucccaa

SEQ ID NO: 1087004 - RNA, 18 nt, Homo sapiens
acuguauauagaagucua

SEQ ID NO: 1087005 - RNA, 20 nt, Homo sapiens
acuuagguaaucauuccagg

SEQ ID NO: 1087006 - RNA, 13 nt, Homo sapiens
acuuauccugaca

SEQ ID NO: 1087007 - RNA, 16 nt, Homo sapiens
acuucacuaccaaaug

SEQ ID NO: 1087008 - RNA, 15 nt, Homo sapiens
acuucagucuuggag

SEQ ID NO: 1087009 - RNA, 18 nt, Homo sapiens
acuuccaugauacuuuaa

SEQ ID NO: 1087010 - RNA, 18 nt, Homo sapiens
acuucccaauugccacau

SEQ ID NO: 1087011 - RNA, 23 nt, Homo sapiens
acuucuaacuagaaaucugccaa

SEQ ID NO: 1087012 - RNA, 14 nt, Homo sapiens
acuugacuuugcca

SEQ ID NO: 1087013 - RNA, 15 nt, Homo sapiens
acuugacuuugccac

SEQ ID NO: 1087014 - RNA, 21 nt, Homo sapiens
acuugcaccugguacugcaca

SEQ ID NO: 1087015 - RNA, 13 nt, Homo sapiens
acuuucauuugaa

SEQ ID NO: 1087016 - RNA, 14 nt, Homo sapiens
acuuugaguaccaa

SEQ ID NO: 1087017 - RNA, 14 nt, Homo sapiens
acuuugaucucugc

SEQ ID NO: 1087018 - RNA, 16 nt, Homo sapiens
acuuugaucucugcuu

SEQ ID NO: 1087019 - RNA, 17 nt, Homo sapiens
acuuugguacauggcca

SEQ ID NO: 1087020 - RNA, 12 nt, Homo sapiens
acuuuucacuua

SEQ ID NO: 1087021 - RNA, 21 nt, Homo sapiens
acuuuuugaaugucauaaaga

SEQ ID NO: 1087022 - RNA, 12 nt, Homo sapiens
agaaaagccacg

SEQ ID NO: 1087023 - RNA, 13 nt, Homo sapiens
agaaaaugaauuu

SEQ ID NO: 1087024 - RNA, 12 nt, Homo sapiens
agaaaaugcauu

SEQ ID NO: 1087025 - RNA, 24 nt, Homo sapiens
agaaacccuuccacguguaugcaa

SEQ ID NO: 1087026 - RNA, 20 nt, Homo sapiens
agaaauaaaaucuaauuaau

SEQ ID NO: 1087027 - RNA, 15 nt, Homo sapiens
agaaauaauacccug

SEQ ID NO: 1087028 - RNA, 14 nt, Homo sapiens
agaaauacaacaga

SEQ ID NO: 1087029 - RNA, 10 nt, Homo sapiens
agaaauaucu

SEQ ID NO: 1087030 - RNA, 14 nt, Homo sapiens
agaaauucuguggu

SEQ ID NO: 1087031 - RNA, 16 nt, Homo sapiens
agaacaaaaggcuuug

SEQ ID NO: 1087032 - RNA, 18 nt, Homo sapiens
agaacacacugagacuug

SEQ ID NO: 1087033 - RNA, 19 nt, Homo sapiens
agaacagggaugcuaucuc

SEQ ID NO: 1087034 - RNA, 17 nt, Homo sapiens
agaacugccccaucucc

SEQ ID NO: 1087035 - RNA, 18 nt, Homo sapiens
agaacugccccaucuccu

SEQ ID NO: 1087036 - RNA, 15 nt, Homo sapiens
agaacuugucccuca

SEQ ID NO: 1087037 - RNA, 21 nt, Homo sapiens
aaaccugagcagcaacugugu

SEQ ID NO: 1087038 - RNA, 23 nt, Homo sapiens
aaacuaacaauaugauugcacua

SEQ ID NO: 1087039 - RNA, 17 nt, Homo sapiens
aaacuaaggagugacua

SEQ ID NO: 1087040 - RNA, 23 nt, Homo sapiens
aaacucucaagcagacgugagug

SEQ ID NO: 1087041 - RNA, 19 nt, Homo sapiens
aaacuuauuugagugauua

SEQ ID NO: 1087042 - RNA, 13 nt, Homo sapiens
aaacuucagagaa

SEQ ID NO: 1087043 - RNA, 19 nt, Homo sapiens
aaagaaaaugugucugcaa

SEQ ID NO: 1087044 - RNA, 19 nt, Homo sapiens
aaagaagaagaaguuccgu

SEQ ID NO: 1087045 - RNA, 19 nt, Homo sapiens
aaagaaucaacagugaaca

SEQ ID NO: 1087046 - RNA, 23 nt, Homo sapiens
aaagaauuuuuuaagaacuguau

SEQ ID NO: 1087047 - RNA, 23 nt, Homo sapiens
aaagaggagagaggaagcucucu

SEQ ID NO: 1087048 - RNA, 14 nt, Homo sapiens
aaagauuaaaugug

SEQ ID NO: 1087049 - RNA, 19 nt, Homo sapiens
aaagauuaaaugugucauu

SEQ ID NO: 1087050 - RNA, 21 nt, Homo sapiens
aaagcaucaauacaaccagcc

SEQ ID NO: 1087051 - RNA, 13 nt, Homo sapiens
aaagcaucaccuc

SEQ ID NO: 1087052 - RNA, 20 nt, Homo sapiens
aaagccuuggucccgugaaa

SEQ ID NO: 1087053 - RNA, 22 nt, Homo sapiens
aaagcuacaacaaauacuacag

SEQ ID NO: 1087054 - RNA, 20 nt, Homo sapiens
aaagcucuauuaagauuucc

SEQ ID NO: 1087055 - RNA, 17 nt, Homo sapiens
aaagcucugaacaaaag

SEQ ID NO: 1087056 - RNA, 15 nt, Homo sapiens
aaaggauuuuaccaa

SEQ ID NO: 1087057 - RNA, 18 nt, Homo sapiens
aaaggauuuuaccaaagc

SEQ ID NO: 1087058 - RNA, 20 nt, Homo sapiens
aaaguuauauuuacuuuaaa

SEQ ID NO: 1087059 - RNA, 17 nt, Homo sapiens
aaaguuugggaagggau

SEQ ID NO: 1087060 - RNA, 13 nt, Homo sapiens
aaauacacuuuau

SEQ ID NO: 1087061 - RNA, 15 nt, Homo sapiens
aaauaguguguccau

SEQ ID NO: 1087062 - RNA, 14 nt, Homo sapiens
aaauauauuugaua

SEQ ID NO: 1087063 - RNA, 21 nt, Homo sapiens
aaauauuaaaauuuauuucac

SEQ ID NO: 1087064 - RNA, 13 nt, Homo sapiens
aaaucaaaugugc

SEQ ID NO: 1087065 - RNA, 14 nt, Homo sapiens
aaaucaaaugugca

SEQ ID NO: 1087066 - RNA, 19 nt, Homo sapiens
aaaucacaaggcaacugug

SEQ ID NO: 1087067 - RNA, 15 nt, Homo sapiens
aaauccccuccccaa

SEQ ID NO: 1087068 - RNA, 23 nt, Homo sapiens
aaauccucagguaguacugggaa

SEQ ID NO: 1087069 - RNA, 13 nt, Homo sapiens
aaaugcugugcaa

SEQ ID NO: 1087070 - RNA, 16 nt, Homo sapiens
aaauggcuuacuuaca

SEQ ID NO: 1087071 - RNA, 21 nt, Homo sapiens
aaaugugucauuggaagccau

SEQ ID NO: 1087072 - RNA, 21 nt, Homo sapiens
aaauuagcuuuuaguuuuaaa

SEQ ID NO: 1087073 - RNA, 19 nt, Homo sapiens
aaauugauuaaaggggcug

SEQ ID NO: 1087074 - RNA, 20 nt, Homo sapiens
aaauugcacuuuuaaaccuc

SEQ ID NO: 1087075 - RNA, 13 nt, Homo sapiens
aaauuguauagag

SEQ ID NO: 1087076 - RNA, 20 nt, Homo sapiens
aacaaaaauguaaugaucau

SEQ ID NO: 1087077 - RNA, 19 nt, Homo sapiens
aacaaaagcuuuucuuucc

SEQ ID NO: 1087078 - RNA, 13 nt, Homo sapiens
aacaaggacucag

SEQ ID NO: 1087079 - RNA, 14 nt, Homo sapiens
aacaaggugcacag

SEQ ID NO: 1087080 - RNA, 12 nt, Homo sapiens
aacaaguagcua

SEQ ID NO: 1087081 - RNA, 19 nt, Homo sapiens
aacacacugagacuugaau

SEQ ID NO: 1087082 - RNA, 15 nt, Homo sapiens
aacacgcaugccuca

SEQ ID NO: 1087083 - RNA, 18 nt, Homo sapiens
aacacguggguauuuaau

SEQ ID NO: 1087084 - RNA, 17 nt, Homo sapiens
aacacucuucuugagca

SEQ ID NO: 1087085 - RNA, 21 nt, Homo sapiens
aacagaaaccagaaaagcaau

SEQ ID NO: 1087086 - RNA, 21 nt, Homo sapiens
aacagcaugggccucaccucc

SEQ ID NO: 1087087 - RNA, 15 nt, Homo sapiens
aacagccccaaaguc

SEQ ID NO: 1087088 - RNA, 18 nt, Homo sapiens
aacagccccaaagucaau

SEQ ID NO: 1087089 - RNA, 15 nt, Homo sapiens
aacaggcucugagau

SEQ ID NO: 1087090 - RNA, 19 nt, Homo sapiens
aacauaaguaagacuugau

SEQ ID NO: 1087091 - RNA, 17 nt, Homo sapiens
aacaugcagcucugcag

SEQ ID NO: 1087092 - RNA, 20 nt, Homo sapiens
aacauguuuuguauguuaaa

SEQ ID NO: 1087093 - RNA, 20 nt, Homo sapiens
aacauuaccuugucuuucaa

SEQ ID NO: 1087094 - RNA, 16 nt, Homo sapiens
aaccagaaaagcaaua

SEQ ID NO: 1087095 - RNA, 15 nt, Homo sapiens
aaccagcccaaccau

SEQ ID NO: 1087096 - RNA, 23 nt, Homo sapiens
aaccauaaaucaauucauugugu

SEQ ID NO: 1087097 - RNA, 17 nt, Homo sapiens
aaccugccugugcauga

SEQ ID NO: 1087098 - RNA, 21 nt, Homo sapiens
aaccugugaaagcugcacuca

SEQ ID NO: 1087099 - RNA, 13 nt, Homo sapiens
aaccuuucuacuu

SEQ ID NO: 1087100 - RNA, 15 nt, Homo sapiens
aacgacaaagccaaa

SEQ ID NO: 1087101 - RNA, 20 nt, Homo sapiens
aacuaccagugggcauguau

SEQ ID NO: 1087102 - RNA, 21 nt, Homo sapiens
aacuacccucucaaauggaca

SEQ ID NO: 1087103 - RNA, 18 nt, Homo sapiens
cagaaauguuuuuggcaa

SEQ ID NO: 1087104 - RNA, 18 nt, Homo sapiens
cagaagccccaacuguga

SEQ ID NO: 1087105 - RNA, 19 nt, Homo sapiens
cagaauuaacuccauucca

SEQ ID NO: 1087106 - RNA, 15 nt, Homo sapiens
cagaauuacccuucc

SEQ ID NO: 1087107 - RNA, 19 nt, Homo sapiens
cagacucaaggccuccagc

SEQ ID NO: 1087108 - RNA, 18 nt, Homo sapiens
cagacucuuccaccagag

SEQ ID NO: 1087109 - RNA, 21 nt, Homo sapiens
cagacucuuuuuguaccuggu

SEQ ID NO: 1087110 - RNA, 21 nt, Homo sapiens
cagaggaaagaccaugugguu

SEQ ID NO: 1087111 - RNA, 20 nt, Homo sapiens
cagaggcacagagagaguca

SEQ ID NO: 1087112 - RNA, 21 nt, Homo sapiens
cagaugaguuuuauugacuca

SEQ ID NO: 1087113 - RNA, 13 nt, Homo sapiens
cagaugucccuga

SEQ ID NO: 1087114 - RNA, 13 nt, Homo sapiens
cagcaagaugaaa

SEQ ID NO: 1087115 - RNA, 14 nt, Homo sapiens
cagcaauagcaucc

SEQ ID NO: 1087116 - RNA, 18 nt, Homo sapiens
cagcagucagucccccaa

SEQ ID NO: 1087117 - RNA, 11 nt, Homo sapiens
cagcaucaggg

SEQ ID NO: 1087118 - RNA, 14 nt, Homo sapiens
cagcaucucagagu

SEQ ID NO: 1087119 - RNA, 21 nt, Homo sapiens
cagcauuuucacauuuugccu

SEQ ID NO: 1087120 - RNA, 21 nt, Homo sapiens
cagccaagaauaaaauacucu

SEQ ID NO: 1087121 - RNA, 13 nt, Homo sapiens
cagccuccagugc

SEQ ID NO: 1087122 - RNA, 18 nt, Homo sapiens
cagccucccaaguagcug

SEQ ID NO: 1087123 - RNA, 17 nt, Homo sapiens
cagccuggccaccagcu

SEQ ID NO: 1087124 - RNA, 17 nt, Homo sapiens
cagccuugcaucaaggg

SEQ ID NO: 1087125 - RNA, 14 nt, Homo sapiens
cagcgaugugucac

SEQ ID NO: 1087126 - RNA, 17 nt, Homo sapiens
cagcuaagccugaugau

SEQ ID NO: 1087127 - RNA, 20 nt, Homo sapiens
cagcuccagcuguuaccuga

SEQ ID NO: 1087128 - RNA, 19 nt, Homo sapiens
cagcucgagcaugcccuga

SEQ ID NO: 1087129 - RNA, 17 nt, Homo sapiens
cagcucuccugcugcag

SEQ ID NO: 1087130 - RNA, 17 nt, Homo sapiens
cagcugaccugguacug

SEQ ID NO: 1087131 - RNA, 18 nt, Homo sapiens
cagcuguuaccugagaua

SEQ ID NO: 1087132 - RNA, 16 nt, Homo sapiens
cagcuuccugagucac

SEQ ID NO: 1087133 - RNA, 13 nt, Homo sapiens
caggacucaggga

SEQ ID NO: 1087134 - RNA, 14 nt, Homo sapiens
caggagagcccucu

SEQ ID NO: 1087135 - RNA, 18 nt, Homo sapiens
caggagagcuucccccaa

SEQ ID NO: 1087136 - RNA, 15 nt, Homo sapiens
caggaggcugaggca

SEQ ID NO: 1087137 - RNA, 17 nt, Homo sapiens
caggaggugcuaucgca

SEQ ID NO: 1087138 - RNA, 13 nt, Homo sapiens
caggagucaccau

SEQ ID NO: 1087139 - RNA, 16 nt, Homo sapiens
caggauugggccaaca

SEQ ID NO: 1087140 - RNA, 19 nt, Homo sapiens
caggcaaguccccguccaa

SEQ ID NO: 1087141 - RNA, 19 nt, Homo sapiens
caggccaggagacuguuaa

SEQ ID NO: 1087142 - RNA, 17 nt, Homo sapiens
caggccaggugcagugg

SEQ ID NO: 1087143 - RNA, 16 nt, Homo sapiens
caggcuagagugcagu

SEQ ID NO: 1087144 - RNA, 16 nt, Homo sapiens
caggcuggagugcaau

SEQ ID NO: 1087145 - RNA, 23 nt, Homo sapiens
caggcuggguugucacugagacu

SEQ ID NO: 1087146 - RNA, 21 nt, Homo sapiens
caggcuuuuguguucucuaaa

SEQ ID NO: 1087147 - RNA, 19 nt, Homo sapiens
cagggaacaagcauucucc

SEQ ID NO: 1087148 - RNA, 19 nt, Homo sapiens
cagggacucaggccaguca

SEQ ID NO: 1087149 - RNA, 20 nt, Homo sapiens
cagggacucaggccagucac

SEQ ID NO: 1087150 - RNA, 18 nt, Homo sapiens
cagggcaccccagcugac

SEQ ID NO: 1087151 - RNA, 15 nt, Homo sapiens
cagggccuccaggac

SEQ ID NO: 1087152 - RNA, 19 nt, Homo sapiens
caggucauuauuuuuuaca

SEQ ID NO: 1087153 - RNA, 17 nt, Homo sapiens
caggucuuguucaagca

SEQ ID NO: 1087154 - RNA, 14 nt, Homo sapiens
caggugagcaauua

SEQ ID NO: 1087155 - RNA, 22 nt, Homo sapiens
caggugagcaauuagauuagua

SEQ ID NO: 1087156 - RNA, 12 nt, Homo sapiens
caguaaaaucaa

SEQ ID NO: 1087157 - RNA, 15 nt, Homo sapiens
caguaaaaucaaaug

SEQ ID NO: 1087158 - RNA, 14 nt, Homo sapiens
caguaguuccagga

SEQ ID NO: 1087159 - RNA, 18 nt, Homo sapiens
caguaguuccaggacuca

SEQ ID NO: 1087160 - RNA, 15 nt, Homo sapiens
cagugaacugagacu

SEQ ID NO: 1087161 - RNA, 17 nt, Homo sapiens
cagugacgugcaccugu

SEQ ID NO: 1087162 - RNA, 23 nt, Homo sapiens
cagugauauaugccuauaauaua

SEQ ID NO: 1087163 - RNA, 16 nt, Homo sapiens
cagugaucucacuuaa

SEQ ID NO: 1087164 - RNA, 16 nt, Homo sapiens
cagugcacuguauaua

SEQ ID NO: 1087165 - RNA, 11 nt, Homo sapiens
cagugcuccug

SEQ ID NO: 1087166 - RNA, 16 nt, Homo sapiens
cagugcuccugugcag

SEQ ID NO: 1087167 - RNA, 15 nt, Homo sapiens
cagugcucugccucu

SEQ ID NO: 1087168 - RNA, 23 nt, Homo sapiens
caguggcccauaaguguaaaaua

SEQ ID NO: 1087169 - RNA, 15 nt, Homo sapiens
cagugucagcacuca

SEQ ID NO: 1087170 - RNA, 17 nt, Homo sapiens
caguguuacaaggguau

SEQ ID NO: 1087171 - RNA, 16 nt, Homo sapiens
caguucaguuccucuu

SEQ ID NO: 1087172 - RNA, 13 nt, Homo sapiens
caguucugaugag

SEQ ID NO: 1087173 - RNA, 23 nt, Homo sapiens
caguuuuguuuugagggcuauua

SEQ ID NO: 1087174 - RNA, 15 nt, Homo sapiens
caguuuuuccuaguc

SEQ ID NO: 1087175 - RNA, 17 nt, Homo sapiens
cauaaauuauuucuaaa

SEQ ID NO: 1087176 - RNA, 13 nt, Homo sapiens
cauagugcacuag

SEQ ID NO: 1087177 - RNA, 18 nt, Homo sapiens
cauaugaaaaaaaugcau

SEQ ID NO: 1087178 - RNA, 16 nt, Homo sapiens
cauaugcagugauaua

SEQ ID NO: 1087179 - RNA, 15 nt, Homo sapiens
cccagcuauucagga

SEQ ID NO: 1087180 - RNA, 17 nt, Homo sapiens
cccagcugaucauguca

SEQ ID NO: 1087181 - RNA, 18 nt, Homo sapiens
cccaggcuagagugcagu

SEQ ID NO: 1087182 - RNA, 18 nt, Homo sapiens
cccaggcuggagugcaau

SEQ ID NO: 1087183 - RNA, 14 nt, Homo sapiens
cccagugugugcuc

SEQ ID NO: 1087184 - RNA, 17 nt, Homo sapiens
cccaguuugcuggguuu

SEQ ID NO: 1087185 - RNA, 11 nt, Homo sapiens
cccauuugcca

SEQ ID NO: 1087186 - RNA, 23 nt, Homo sapiens
ccccaacaucucccucccacauu

SEQ ID NO: 1087187 - RNA, 14 nt, Homo sapiens
ccccaacugugauc

SEQ ID NO: 1087188 - RNA, 15 nt, Homo sapiens
ccccaacugugauca

SEQ ID NO: 1087189 - RNA, 18 nt, Homo sapiens
ccccagcauuacgauccc

SEQ ID NO: 1087190 - RNA, 15 nt, Homo sapiens
ccccagccuggccca

SEQ ID NO: 1087191 - RNA, 22 nt, Homo sapiens
ccccagcucuggcuuccagaaa

SEQ ID NO: 1087192 - RNA, 18 nt, Homo sapiens
cccccuuuccucuugggc

SEQ ID NO: 1087193 - RNA, 23 nt, Homo sapiens
ccccgguggcugaagaggcugcc

SEQ ID NO: 1087194 - RNA, 13 nt, Homo sapiens
ccccucaggauug

SEQ ID NO: 1087195 - RNA, 18 nt, Homo sapiens
ccccuccugaacuggcca

SEQ ID NO: 1087196 - RNA, 16 nt, Homo sapiens
ccccugauccagacaa

SEQ ID NO: 1087197 - RNA, 21 nt, Homo sapiens
cccggccacgucugugcucug

SEQ ID NO: 1087198 - RNA, 18 nt, Homo sapiens
cccggcuugccuguaauc

SEQ ID NO: 1087199 - RNA, 20 nt, Homo sapiens
cccguccuuucugaagaaga

SEQ ID NO: 1087200 - RNA, 15 nt, Homo sapiens
cccgucgacguagaa

SEQ ID NO: 1087201 - RNA, 15 nt, Homo sapiens
cccuagguccaaaaa

SEQ ID NO: 1087202 - RNA, 18 nt, Homo sapiens
cccucuguccagccagcu

SEQ ID NO: 1087203 - RNA, 18 nt, Homo sapiens
cccucuugccccaacccc

SEQ ID NO: 1087204 - RNA, 22 nt, Homo sapiens
cccugacucucugugaccugcc

SEQ ID NO: 1087205 - RNA, 18 nt, Homo sapiens
cccugcucacucuuccac

SEQ ID NO: 1087206 - RNA, 22 nt, Homo sapiens
cccuggcugaacagugcucugc

SEQ ID NO: 1087207 - RNA, 17 nt, Homo sapiens
cccugggcaaugcagug

SEQ ID NO: 1087208 - RNA, 18 nt, Homo sapiens
cccuguggggccugaugg

SEQ ID NO: 1087209 - RNA, 16 nt, Homo sapiens
cccuguggucacuuau

SEQ ID NO: 1087210 - RNA, 13 nt, Homo sapiens
cccuugaaccagc

SEQ ID NO: 1087211 - RNA, 17 nt, Homo sapiens
ccgagagagauggaaua

SEQ ID NO: 1087212 - RNA, 22 nt, Homo sapiens
ccgggaagcggagguugcaggg

SEQ ID NO: 1087213 - RNA, 21 nt, Homo sapiens
ccgugggggcaggggaccugg

SEQ ID NO: 1087214 - RNA, 13 nt, Homo sapiens
ccgugugcuccuc

SEQ ID NO: 1087215 - RNA, 22 nt, Homo sapiens
ccguuguuaacacgugacacug

SEQ ID NO: 1087216 - RNA, 14 nt, Homo sapiens
ccguuuccaaauac

SEQ ID NO: 1087217 - RNA, 18 nt, Homo sapiens
ccuaaucauauaccagag

SEQ ID NO: 1087218 - RNA, 19 nt, Homo sapiens
ccuacccccaguaaaauca

SEQ ID NO: 1087219 - RNA, 18 nt, Homo sapiens
ccuacugcuuccucugaa

SEQ ID NO: 1087220 - RNA, 21 nt, Homo sapiens
ccuagagugacucuaccugca

SEQ ID NO: 1087221 - RNA, 22 nt, Homo sapiens
ccuagagugacucuaccugcaa

SEQ ID NO: 1087222 - RNA, 14 nt, Homo sapiens
ccuaggauuccucc

SEQ ID NO: 1087223 - RNA, 21 nt, Homo sapiens
ccuauauaugauuguuugcac

SEQ ID NO: 1087224 - RNA, 21 nt, Homo sapiens
cugcagccccgcgccuccuuc

SEQ ID NO: 1087225 - RNA, 18 nt, Homo sapiens
cugcaggguccccaagga

SEQ ID NO: 1087226 - RNA, 16 nt, Homo sapiens
cugccagccacaucca

SEQ ID NO: 1087227 - RNA, 13 nt, Homo sapiens
cugccccaucucc

SEQ ID NO: 1087228 - RNA, 18 nt, Homo sapiens
cugccucagccuccugag

SEQ ID NO: 1087229 - RNA, 15 nt, Homo sapiens
cugccucccuuucau

SEQ ID NO: 1087230 - RNA, 18 nt, Homo sapiens
cugccuugaagccacuga

SEQ ID NO: 1087231 - RNA, 15 nt, Homo sapiens
cugcuaauaauaaau

SEQ ID NO: 1087232 - RNA, 14 nt, Homo sapiens
cugcuaauccugag

SEQ ID NO: 1087233 - RNA, 14 nt, Homo sapiens
cugcuccuagccca

SEQ ID NO: 1087234 - RNA, 20 nt, Homo sapiens
cugcucgaagaacaauguca

SEQ ID NO: 1087235 - RNA, 18 nt, Homo sapiens
cugcugagugcaccacuu

SEQ ID NO: 1087236 - RNA, 19 nt, Homo sapiens
cugcugcagcaugaaggca

SEQ ID NO: 1087237 - RNA, 16 nt, Homo sapiens
cugcugcccaggcuag

SEQ ID NO: 1087238 - RNA, 17 nt, Homo sapiens
cugcugccucccuuuca

SEQ ID NO: 1087239 - RNA, 22 nt, Homo sapiens
cugcugccucccuuucauacaa

SEQ ID NO: 1087240 - RNA, 21 nt, Homo sapiens
cugcuggcccacagcucugcu

SEQ ID NO: 1087241 - RNA, 17 nt, Homo sapiens
cugcuguggcaucagga

SEQ ID NO: 1087242 - RNA, 15 nt, Homo sapiens
cugcuuccucugaau

SEQ ID NO: 1087243 - RNA, 16 nt, Homo sapiens
cuggaaaagggcucag

SEQ ID NO: 1087244 - RNA, 19 nt, Homo sapiens
cuggacccuggccuaaaga

SEQ ID NO: 1087245 - RNA, 12 nt, Homo sapiens
cuggagcugcca

SEQ ID NO: 1087246 - RNA, 18 nt, Homo sapiens
cuggaugagcaacuccug

SEQ ID NO: 1087247 - RNA, 19 nt, Homo sapiens
cuggauggggagucucaug

SEQ ID NO: 1087248 - RNA, 22 nt, Homo sapiens
cuggccauuuaacuagcacuuu

SEQ ID NO: 1087249 - RNA, 18 nt, Homo sapiens
cuggccccuucuccagca

SEQ ID NO: 1087250 - RNA, 13 nt, Homo sapiens
cuggcugcaguga

SEQ ID NO: 1087251 - RNA, 18 nt, Homo sapiens
cuggcuggcuguguccuc

SEQ ID NO: 1087252 - RNA, 18 nt, Homo sapiens
cuggcuuuguucuuguca

SEQ ID NO: 1087253 - RNA, 18 nt, Homo sapiens
cugggacuacaggcaccc

SEQ ID NO: 1087254 - RNA, 16 nt, Homo sapiens
cugggagaaccucagg

SEQ ID NO: 1087255 - RNA, 20 nt, Homo sapiens
cugggcaggaaaccccagcg

SEQ ID NO: 1087256 - RNA, 21 nt, Homo sapiens
cugggcauuuggugagaguca

SEQ ID NO: 1087257 - RNA, 20 nt, Homo sapiens
cugggccaaguuccucuagu

SEQ ID NO: 1087258 - RNA, 22 nt, Homo sapiens
cugggccaaguuccucuagugc

SEQ ID NO: 1087259 - RNA, 20 nt, Homo sapiens
cuggguuggcgcacccuccc

SEQ ID NO: 1087260 - RNA, 18 nt, Homo sapiens
cuggguuuaagcaaugcu

SEQ ID NO: 1087261 - RNA, 23 nt, Homo sapiens
cuggguuuaagcaaugcuucugc

SEQ ID NO: 1087262 - RNA, 23 nt, Homo sapiens
cugguugauacggagccauguca

SEQ ID NO: 1087263 - RNA, 21 nt, Homo sapiens
cuguaaaugaagggucauuuc

SEQ ID NO: 1087264 - RNA, 13 nt, Homo sapiens
cuguaagcauucu

SEQ ID NO: 1087265 - RNA, 13 nt, Homo sapiens
cuguacucaggag

SEQ ID NO: 1087266 - RNA, 21 nt, Homo sapiens
gagucucaugcaagacuucac

SEQ ID NO: 1087267 - RNA, 20 nt, Homo sapiens
gagugcaccacuucaaguga

SEQ ID NO: 1087268 - RNA, 16 nt, Homo sapiens
gagugcaguggcguga

SEQ ID NO: 1087269 - RNA, 14 nt, Homo sapiens
gagugcugcagcuu

SEQ ID NO: 1087270 - RNA, 17 nt, Homo sapiens
gaguugugaucauccca

SEQ ID NO: 1087271 - RNA, 18 nt, Homo sapiens
gaguuguggaaagccucu

SEQ ID NO: 1087272 - RNA, 20 nt, Homo sapiens
gaguuuccagcuaagccuga

SEQ ID NO: 1087273 - RNA, 18 nt, Homo sapiens
gaguuuuauugacucauu

SEQ ID NO: 1087274 - RNA, 13 nt, Homo sapiens
gauaaacuuugaa

SEQ ID NO: 1087275 - RNA, 14 nt, Homo sapiens
gauaaaugccucau

SEQ ID NO: 1087276 - RNA, 16 nt, Homo sapiens
gauaaauuccacugga

SEQ ID NO: 1087277 - RNA, 22 nt, Homo sapiens
gauaacauguaucacucacugc

SEQ ID NO: 1087278 - RNA, 15 nt, Homo sapiens
gauacaacugagucu

SEQ ID NO: 1087279 - RNA, 13 nt, Homo sapiens
gauacgacaacuu

SEQ ID NO: 1087280 - RNA, 21 nt, Homo sapiens
gaucauuacauggcugugguu

SEQ ID NO: 1087281 - RNA, 14 nt, Homo sapiens
gaucccccaagugu

SEQ ID NO: 1087282 - RNA, 17 nt, Homo sapiens
gaucucagcagccagcu

SEQ ID NO: 1087283 - RNA, 17 nt, Homo sapiens
gaucuuucuuuccaaaa

SEQ ID NO: 1087284 - RNA, 19 nt, Homo sapiens
gaucuuucuuuccaaaaca

SEQ ID NO: 1087285 - RNA, 14 nt, Homo sapiens
gaugaaaaccugca

SEQ ID NO: 1087286 - RNA, 13 nt, Homo sapiens
gaugaaaagccau

SEQ ID NO: 1087287 - RNA, 17 nt, Homo sapiens
gauggaauaaagcccuu

SEQ ID NO: 1087288 - RNA, 20 nt, Homo sapiens
gauggugguaaacauucucu

SEQ ID NO: 1087289 - RNA, 21 nt, Homo sapiens
gauuaacuuucaaaagcaaac

SEQ ID NO: 1087290 - RNA, 14 nt, Homo sapiens
gauuaauauuauua

SEQ ID NO: 1087291 - RNA, 19 nt, Homo sapiens
gauuacaggcaugagccac

SEQ ID NO: 1087292 - RNA, 23 nt, Homo sapiens
gauuauuuguuauuuguacaguu

SEQ ID NO: 1087293 - RNA, 19 nt, Homo sapiens
gauuccauuuuacuuccau

SEQ ID NO: 1087294 - RNA, 21 nt, Homo sapiens
gauuuauuaauuaaaccagac

SEQ ID NO: 1087295 - RNA, 15 nt, Homo sapiens
gauuucacaucagcu

SEQ ID NO: 1087296 - RNA, 22 nt, Homo sapiens
gauuucuuucuuugcaccaaag

SEQ ID NO: 1087297 - RNA, 18 nt, Homo sapiens
gauuuuacacaccaccag

SEQ ID NO: 1087298 - RNA, 16 nt, Homo sapiens
gcaaagagaaaagcca

SEQ ID NO: 1087299 - RNA, 12 nt, Homo sapiens
gcaaagucuaaa

SEQ ID NO: 1087300 - RNA, 19 nt, Homo sapiens
gcaagacaguggcacuaaa

SEQ ID NO: 1087301 - RNA, 16 nt, Homo sapiens
gcaagacucugucuca

SEQ ID NO: 1087302 - RNA, 17 nt, Homo sapiens
gcaagacuucacugcag

SEQ ID NO: 1087303 - RNA, 23 nt, Homo sapiens
gcaagacuucacugcagccuuuc

SEQ ID NO: 1087304 - RNA, 14 nt, Homo sapiens
gcaagcagugcccu

SEQ ID NO: 1087305 - RNA, 19 nt, Homo sapiens
ucuuucuuugcaccaaaga

SEQ ID NO: 1087306 - RNA, 17 nt, Homo sapiens
ucuuugcaccaaagaca

SEQ ID NO: 1087307 - RNA, 20 nt, Homo sapiens
ucuuugcaccaaagacauca

SEQ ID NO: 1087308 - RNA, 18 nt, Homo sapiens
ucuuuggcuucagaauug

SEQ ID NO: 1087309 - RNA, 18 nt, Homo sapiens
ucuuuggggaaacuaaca

SEQ ID NO: 1087310 - RNA, 14 nt, Homo sapiens
ucuuuuguuauuaa

SEQ ID NO: 1087311 - RNA, 17 nt, Homo sapiens
ugaaaaaaaaaagacaa

SEQ ID NO: 1087312 - RNA, 21 nt, Homo sapiens
ugaaaaauaguguguccaugc

SEQ ID NO: 1087313 - RNA, 13 nt, Homo sapiens
ugaaaaugauuag

SEQ ID NO: 1087314 - RNA, 11 nt, Homo sapiens
ugaaacagggc

SEQ ID NO: 1087315 - RNA, 13 nt, Homo sapiens
ugaaagacaucaa

SEQ ID NO: 1087316 - RNA, 14 nt, Homo sapiens
ugaaagacaucaau

SEQ ID NO: 1087317 - RNA, 18 nt, Homo sapiens
ugaaagucuccuguauca

SEQ ID NO: 1087318 - RNA, 13 nt, Homo sapiens
ugaaagugguuug

SEQ ID NO: 1087319 - RNA, 17 nt, Homo sapiens
ugaacaaagagagcuca

SEQ ID NO: 1087320 - RNA, 17 nt, Homo sapiens
ugaacaauucucucuua

SEQ ID NO: 1087321 - RNA, 13 nt, Homo sapiens
ugaacauugcaau

SEQ ID NO: 1087322 - RNA, 19 nt, Homo sapiens
ugaacauugcaauagaaau

SEQ ID NO: 1087323 - RNA, 17 nt, Homo sapiens
ugaacccauccaaugga

SEQ ID NO: 1087324 - RNA, 15 nt, Homo sapiens
ugaaccgugugcucc

SEQ ID NO: 1087325 - RNA, 17 nt, Homo sapiens
ugaaggagaaaaugcau

SEQ ID NO: 1087326 - RNA, 18 nt, Homo sapiens
ugaagugcagcucaggag

SEQ ID NO: 1087327 - RNA, 16 nt, Homo sapiens
ugaauggacaggagaa

SEQ ID NO: 1087328 - RNA, 15 nt, Homo sapiens
ugaauggccugccuu

SEQ ID NO: 1087329 - RNA, 23 nt, Homo sapiens
ugaaugucauuauuugauaacau

SEQ ID NO: 1087330 - RNA, 16 nt, Homo sapiens
ugaauuuagucauuau

SEQ ID NO: 1087331 - RNA, 11 nt, Homo sapiens
ugaauuugacu

SEQ ID NO: 1087332 - RNA, 17 nt, Homo sapiens
ugaauuugccuuccuca

SEQ ID NO: 1087333 - RNA, 17 nt, Homo sapiens
ugaauuuuuaagcaaau

SEQ ID NO: 1087334 - RNA, 21 nt, Homo sapiens
ugacacacugcggugucugca

SEQ ID NO: 1087335 - RNA, 21 nt, Homo sapiens
ugacagagaugugcauguggg

SEQ ID NO: 1087336 - RNA, 15 nt, Homo sapiens
ugacaggcaccagau

SEQ ID NO: 1087337 - RNA, 15 nt, Homo sapiens
ugacagugaugcugc

SEQ ID NO: 1087338 - RNA, 20 nt, Homo sapiens
ugaccugaacucugcaacug

SEQ ID NO: 1087339 - RNA, 13 nt, Homo sapiens
ugacggacucaga

SEQ ID NO: 1087340 - RNA, 22 nt, Homo sapiens
ugacggcugcucgaagaacaau

SEQ ID NO: 1087341 - RNA, 20 nt, Homo sapiens
ugacucaccuugcucugcca

SEQ ID NO: 1087342 - RNA, 14 nt, Homo sapiens
ugacuggcucaaga

SEQ ID NO: 1087343 - RNA, 19 nt, Homo sapiens
ugacuuuugaagaacaaaa

SEQ ID NO: 1087344 - RNA, 15 nt, Homo sapiens
ugagaaaacugagag

SEQ ID NO: 1087345 - RNA, 23 nt, Homo sapiens
ugagaaauuuuuuuccagaauug

SEQ ID NO: 1087346 - RNA, 16 nt, Homo sapiens
ugagauuacaggcgca

SEQ ID NO: 1087347 - RNA, 15 nt, Homo sapiens
ugagauuucacaggu

SEQ ID NO: 1087348 - RNA, 17 nt, Homo sapiens
ugagcagcaacuguguc

SEQ ID NO: 1087349 - RNA, 14 nt, Homo sapiens
ugaggcaaaggcca

SEQ ID NO: 1087350 - RNA, 14 nt, Homo sapiens
ugaggcugcagcga

SEQ ID NO: 1087351 - RNA, 13 nt, Homo sapiens
ugaguaaaaucua

SEQ ID NO: 1087352 - RNA, 20 nt, Homo sapiens
ugaguauugauaaacuuuga

SEQ ID NO: 1087353 - RNA, 18 nt, Homo sapiens
ugauaaagcaguauuugg

SEQ ID NO: 1087354 - RNA, 18 nt, Homo sapiens
ugauauugaccaugugau

SEQ ID NO: 1087355 - RNA, 17 nt, Homo sapiens
ugaucauuacauggcug

SEQ ID NO: 1087356 - RNA, 18 nt, Homo sapiens
ugaucuacucauuugcug

SEQ ID NO: 1087357 - RNA, 19 nt, Homo sapiens
ugaugaaaaauaugugcuu

SEQ ID NO: 1087358 - RNA, 21 nt, Homo sapiens
ugaugaaaacuaaggauuuuu

SEQ ID NO: 1087359 - RNA, 21 nt, Homo sapiens
ugauggagauauuuacaugaa

SEQ ID NO: 1087360 - RNA, 19 nt, Homo sapiens
ugauuccauuuuacuucca

SEQ ID NO: 1087361 - RNA, 19 nt, Homo sapiens
ugauucccagaaauacaac

SEQ ID NO: 1087362 - RNA, 19 nt, Homo sapiens
ugauugguuuaaaagucac

SEQ ID NO: 1087363 - RNA, 22 nt, Homo sapiens
ugcaaaccuuuuuuaugaugcu

SEQ ID NO: 1087364 - RNA, 14 nt, Homo sapiens
ugcaacaaugugug

SEQ ID NO: 1087365 - RNA, 17 nt, Homo sapiens
ugcaaccuuugccuccc

SEQ ID NO: 1087366 - RNA, 17 nt, Homo sapiens
ugcaagacuucacugca

SEQ ID NO: 1087367 - RNA, 19 nt, Homo sapiens
ugcaaggcuaagaaguacu

SEQ ID NO: 1087368 - RNA, 13 nt, Homo sapiens
ugcacagcuuccu

SEQ ID NO: 1087369 - RNA, 18 nt, Homo sapiens
ugcaccaaagacaucagu

SEQ ID NO: 1087370 - RNA, 14 nt, Homo sapiens
ugcacguauuuuaa

SEQ ID NO: 1087371 - RNA, 11 nt, Homo sapiens
ugcacuuuuaa

SEQ ID NO: 1087372 - RNA, 22 nt, Homo sapiens
ugcagucuuuugcugugcugua

SEQ ID NO: 1087373 - RNA, 16 nt, Homo sapiens
ugcagugaacugagac

SEQ ID NO: 1087374 - RNA, 21 nt, Homo sapiens
ugcauaaacaauccaaaugca

SEQ ID NO: 1087375 - RNA, 21 nt, Homo sapiens
ugcaucaagggcuuuaucaaa

SEQ ID NO: 1087376 - RNA, 22 nt, Homo sapiens
ugcaucagaaaaugcagccuua

SEQ ID NO: 1087377 - RNA, 13 nt, Homo sapiens
ugcaugaccugau

SEQ ID NO: 1087378 - RNA, 21 nt, Homo sapiens
ugcaugaccugaucauuacau

SEQ ID NO: 1087379 - RNA, 14 nt, Homo sapiens
ugcauuugugucau

SEQ ID NO: 1087380 - RNA, 19 nt, Homo sapiens
ugccacauuagccuuugca

SEQ ID NO: 1087381 - RNA, 20 nt, Homo sapiens
ugccacauuuuaaauaaaga

SEQ ID NO: 1087382 - RNA, 18 nt, Homo sapiens
ugccagcuauaaucuccc

SEQ ID NO: 1087383 - RNA, 21 nt, Homo sapiens
ugccaggauuggcacaagcuc

SEQ ID NO: 1087384 - RNA, 16 nt, Homo sapiens
ugccaggcuugucaaa

SEQ ID NO: 1087385 - RNA, 21 nt, Homo sapiens
ugcccacugccgaugcccaau

SEQ ID NO: 1087386 - RNA, 23 nt, Homo sapiens
ugcccagccacaucaucuuuauc

SEQ ID NO: 1087387 - RNA, 19 nt, Homo sapiens
ugcccaggcuagagugcag

SEQ ID NO: 1087388 - RNA, 20 nt, Homo sapiens
ugcccaggcuagagugcagu

SEQ ID NO: 1087389 - RNA, 19 nt, Homo sapiens
ugcccaggcuggagugcaa

SEQ ID NO: 1087390 - RNA, 20 nt, Homo sapiens
ugcccaggcuggagugcaau

SEQ ID NO: 1087391 - RNA, 24 nt, Homo sapiens
ugcccggcgcccucuguccugacu

SEQ ID NO: 1087392 - RNA, 16 nt, Homo sapiens
ugccuaauuccuggca

SEQ ID NO: 1087393 - RNA, 16 nt, Homo sapiens
ugccucagcuucccaa

SEQ ID NO: 1087394 - RNA, 16 nt, Homo sapiens
ugccuguauucucuau

SEQ ID NO: 1087395 - RNA, 14 nt, Homo sapiens
ugccugucugucca

SEQ ID NO: 1087396 - RNA, 18 nt, Homo sapiens
uuuuaauuagaaauaucu

SEQ ID NO: 1087397 - RNA, 12 nt, Homo sapiens
uuuuaauugauu

SEQ ID NO: 1087398 - RNA, 21 nt, Homo sapiens
uuuuacauuucauacaacaga

SEQ ID NO: 1087399 - RNA, 16 nt, Homo sapiens
uuuuacuuccaugaua

SEQ ID NO: 1087400 - RNA, 22 nt, Homo sapiens
uuuuacuuccaugauacuuuaa

SEQ ID NO: 1087401 - RNA, 16 nt, Homo sapiens
uuuuauaaauauguga

SEQ ID NO: 1087402 - RNA, 12 nt, Homo sapiens
uuuuauuaucaa

SEQ ID NO: 1087403 - RNA, 14 nt, Homo sapiens
uuuucaagaugcuu

SEQ ID NO: 1087404 - RNA, 22 nt, Homo sapiens
uuuucaaguugagaacaaaaau

SEQ ID NO: 1087405 - RNA, 15 nt, Homo sapiens
uuuucuagacugucu

SEQ ID NO: 1087406 - RNA, 19 nt, Homo sapiens
uuuuuaaaauguuggugca

SEQ ID NO: 1087407 - RNA, 15 nt, Homo sapiens
uuuuucugccugaga

SEQ ID NO: 1087408 - RNA, 11 nt, Homo sapiens
uuuuugcucuu

SEQ ID NO: 1087409 - RNA, 15 nt, Homo sapiens
cagagggcccaggca

SEQ ID NO: 1087410 - RNA, 21 nt, Homo sapiens
cagauaacaaccccggacaaa

SEQ ID NO: 1087411 - RNA, 22 nt, Homo sapiens
cagauacccauccaacuccucu

SEQ ID NO: 1087412 - RNA, 16 nt, Homo sapiens
cagaucuuuaaauaca

SEQ ID NO: 1087413 - RNA, 19 nt, Homo sapiens
cagaugcuguuguuguuac

SEQ ID NO: 1087414 - RNA, 12 nt, Homo sapiens
cagcaaagccau

SEQ ID NO: 1087415 - RNA, 21 nt, Homo sapiens
cagcaagcagugcccucugga

SEQ ID NO: 1087416 - RNA, 18 nt, Homo sapiens
cagcaauagggugcaguu

SEQ ID NO: 1087417 - RNA, 11 nt, Homo sapiens
cagcacagcaa

SEQ ID NO: 1087418 - RNA, 16 nt, Homo sapiens
cagcagaaaaucuuuu

SEQ ID NO: 1087419 - RNA, 18 nt, Homo sapiens
cagcaggcuuuuguguuc

SEQ ID NO: 1087420 - RNA, 19 nt, Homo sapiens
cagcaggcuuuuguguucu

SEQ ID NO: 1087421 - RNA, 21 nt, Homo sapiens
cagcaggcuuuuguguucucu

SEQ ID NO: 1087422 - RNA, 16 nt, Homo sapiens
cagcaucaaacaugaa

SEQ ID NO: 1087423 - RNA, 20 nt, Homo sapiens
cagccacuuauuuccaugga

SEQ ID NO: 1087424 - RNA, 23 nt, Homo sapiens
cagccccguguagccccgggcug

SEQ ID NO: 1087425 - RNA, 21 nt, Homo sapiens
cagccucccacaggugguaca

SEQ ID NO: 1087426 - RNA, 19 nt, Homo sapiens
cagccuccugaguagcugg

SEQ ID NO: 1087427 - RNA, 22 nt, Homo sapiens
cagccugagcaacagagugaga

SEQ ID NO: 1087428 - RNA, 22 nt, Homo sapiens
cagccuugcaucaagggcuuua

SEQ ID NO: 1087429 - RNA, 19 nt, Homo sapiens
cagcuagggcuggacucug

SEQ ID NO: 1087430 - RNA, 21 nt, Homo sapiens
cagcugaccugguacugaggu

SEQ ID NO: 1087431 - RNA, 22 nt, Homo sapiens
cagcugaccugguacugagguu

SEQ ID NO: 1087432 - RNA, 15 nt, Homo sapiens
cagcugaucauguca

SEQ ID NO: 1087433 - RNA, 13 nt, Homo sapiens
cagcugcaccugc

SEQ ID NO: 1087434 - RNA, 20 nt, Homo sapiens
cagcuucccaaguagcugag

SEQ ID NO: 1087435 - RNA, 18 nt, Homo sapiens
cagcuucccucugccuga

SEQ ID NO: 1087436 - RNA, 13 nt, Homo sapiens
cagcuugacucua

SEQ ID NO: 1087437 - RNA, 23 nt, Homo sapiens
cagcuuucccuccccagaguucu

SEQ ID NO: 1087438 - RNA, 21 nt, Homo sapiens
caggaaccggagggugaccca

SEQ ID NO: 1087439 - RNA, 19 nt, Homo sapiens
caggagauggaagagucau

SEQ ID NO: 1087440 - RNA, 21 nt, Homo sapiens
caggaggcugaggcaccagaa

SEQ ID NO: 1087441 - RNA, 21 nt, Homo sapiens
caggagggguuaaagcugccg

SEQ ID NO: 1087442 - RNA, 17 nt, Homo sapiens
caggaguaaguuucuca

SEQ ID NO: 1087443 - RNA, 15 nt, Homo sapiens
caggagucaccaugc

SEQ ID NO: 1087444 - RNA, 19 nt, Homo sapiens
caggagucaccaugcaagg

SEQ ID NO: 1087445 - RNA, 22 nt, Homo sapiens
caggauuaaugguccugugaug

SEQ ID NO: 1087446 - RNA, 14 nt, Homo sapiens
caggauugggccaa

SEQ ID NO: 1087447 - RNA, 15 nt, Homo sapiens
caggcacagcacagg

SEQ ID NO: 1087448 - RNA, 13 nt, Homo sapiens
caggcagccccac

SEQ ID NO: 1087449 - RNA, 17 nt, Homo sapiens
caggcaguucccagaaa

SEQ ID NO: 1087450 - RNA, 15 nt, Homo sapiens
caggccacaaaugug

SEQ ID NO: 1087451 - RNA, 18 nt, Homo sapiens
caggccaggagacuguua

SEQ ID NO: 1087452 - RNA, 18 nt, Homo sapiens
caggcgcacaccaccacg

SEQ ID NO: 1087453 - RNA, 22 nt, Homo sapiens
caggcugcugcauggcacugac

SEQ ID NO: 1087454 - RNA, 21 nt, Homo sapiens
cagggcccugcagaggggaaa

SEQ ID NO: 1087455 - RNA, 16 nt, Homo sapiens
cagggccucugugcag

SEQ ID NO: 1087456 - RNA, 14 nt, Homo sapiens
caggggcaggcaca

SEQ ID NO: 1087457 - RNA, 16 nt, Homo sapiens
cagggucuugcuguaa

SEQ ID NO: 1087458 - RNA, 15 nt, Homo sapiens
caggugaacucgaag

SEQ ID NO: 1087459 - RNA, 12 nt, Homo sapiens
cagguguguuca

SEQ ID NO: 1087460 - RNA, 20 nt, Homo sapiens
caguaaaaucaaaugugcau

SEQ ID NO: 1087461 - RNA, 21 nt, Homo sapiens
caguaaaaucaaaugugcauc

SEQ ID NO: 1087462 - RNA, 19 nt, Homo sapiens
caguaaacuuucucugcaa

SEQ ID NO: 1087463 - RNA, 17 nt, Homo sapiens
caguagucaccucuggg

SEQ ID NO: 1087464 - RNA, 14 nt, Homo sapiens
cagucccucagcca

SEQ ID NO: 1087465 - RNA, 23 nt, Homo sapiens
caguccugggagaaccucaggcu

SEQ ID NO: 1087466 - RNA, 14 nt, Homo sapiens
cagugaacaguuug

SEQ ID NO: 1087467 - RNA, 16 nt, Homo sapiens
cagugacgugacucag

SEQ ID NO: 1087468 - RNA, 17 nt, Homo sapiens
cagugcagcaugggaaa

SEQ ID NO: 1087469 - RNA, 18 nt, Homo sapiens
cagugcccauuccucacc

SEQ ID NO: 1087470 - RNA, 14 nt, Homo sapiens
cagugccucagugc

SEQ ID NO: 1087471 - RNA, 19 nt, Homo sapiens
cagugccucagugcugcaa

SEQ ID NO: 1087472 - RNA, 17 nt, Homo sapiens
cagugcuauuuugugcc

SEQ ID NO: 1087473 - RNA, 21 nt, Homo sapiens
cagugcuguggccugggcaag

SEQ ID NO: 1087474 - RNA, 19 nt, Homo sapiens
caguguuaggccuggcaca

SEQ ID NO: 1087475 - RNA, 21 nt, Homo sapiens
caguuuuggagaaaaauuaca

SEQ ID NO: 1087476 - RNA, 16 nt, Homo sapiens
cauaaaucaauucauu

SEQ ID NO: 1087477 - RNA, 22 nt, Homo sapiens
cauaaaucuuguaaucauguua

SEQ ID NO: 1087478 - RNA, 19 nt, Homo sapiens
cauaaccacccuagcuuua

SEQ ID NO: 1087479 - RNA, 21 nt, Homo sapiens
cauaagaaauaaaaucuaauu

SEQ ID NO: 1087480 - RNA, 18 nt, Homo sapiens
cauaaguaagacuugauu

SEQ ID NO: 1087481 - RNA, 19 nt, Homo sapiens
cauaagucuaaauaaauga

SEQ ID NO: 1087482 - RNA, 13 nt, Homo sapiens
cauacaacagaaa

SEQ ID NO: 1087483 - RNA, 23 nt, Homo sapiens
cauacauguugggcaugauucua

SEQ ID NO: 1087484 - RNA, 20 nt, Homo sapiens
cauagaugagaaaacugaga

SEQ ID NO: 1087485 - RNA, 21 nt, Homo sapiens
cauaguuugauaaaaagauca

SEQ ID NO: 1087486 - RNA, 22 nt, Homo sapiens
cauaucuuguuguucaguuugg

SEQ ID NO: 1087487 - RNA, 15 nt, Homo sapiens
cauauuaaucccucg

SEQ ID NO: 1087488 - RNA, 19 nt, Homo sapiens
cauauugcuaccaaaaacu

SEQ ID NO: 1087489 - RNA, 16 nt, Homo sapiens
caucaguuauaucuug

SEQ ID NO: 1087490 - RNA, 22 nt, Homo sapiens
cauccauagugcacuagcauuu

SEQ ID NO: 1087491 - RNA, 16 nt, Homo sapiens
caucucccucccacau

SEQ ID NO: 1087492 - RNA, 23 nt, Homo sapiens
caucucccugaccuucuccaggg

SEQ ID NO: 1087493 - RNA, 18 nt, Homo sapiens
caucuccucccaccagug

SEQ ID NO: 1087494 - RNA, 15 nt, Homo sapiens
caugaaaaacacggc

SEQ ID NO: 1087495 - RNA, 16 nt, Homo sapiens
caugaaaggggaaaua

SEQ ID NO: 1087496 - RNA, 18 nt, Homo sapiens
caugacacucuagugacu

SEQ ID NO: 1087497 - RNA, 15 nt, Homo sapiens
caugauaacugcaau

SEQ ID NO: 1087498 - RNA, 19 nt, Homo sapiens
caugauggagcgcaccugc

SEQ ID NO: 1087499 - RNA, 21 nt, Homo sapiens
caugcaagacuucacugcagc

SEQ ID NO: 1087500 - RNA, 14 nt, Homo sapiens
caugcccacugccg

SEQ ID NO: 1087501 - RNA, 19 nt, Homo sapiens
caugcccugagcucucuga

SEQ ID NO: 1087502 - RNA, 11 nt, Homo sapiens
caugcuuucuc

SEQ ID NO: 1087503 - RNA, 11 nt, Homo sapiens
cauggcacuga

SEQ ID NO: 1087504 - RNA, 14 nt, Homo sapiens
caugguagacugug

SEQ ID NO: 1087505 - RNA, 16 nt, Homo sapiens
caugguagacugugac

SEQ ID NO: 1087506 - RNA, 17 nt, Homo sapiens
caugguagacugugaca

SEQ ID NO: 1087507 - RNA, 14 nt, Homo sapiens
cauguaaaaucuuc

SEQ ID NO: 1087508 - RNA, 20 nt, Homo sapiens
cauguaccugaaacauuugg

SEQ ID NO: 1087509 - RNA, 19 nt, Homo sapiens
cauguauagcuagcuauuu

SEQ ID NO: 1087510 - RNA, 21 nt, Homo sapiens
cauguaucacucacugccaaa

SEQ ID NO: 1087511 - RNA, 22 nt, Homo sapiens
cauguauuagccagucauugua

SEQ ID NO: 1087512 - RNA, 22 nt, Homo sapiens
caugugacaugaacccauccaa

SEQ ID NO: 1087513 - RNA, 21 nt, Homo sapiens
cauguguguguguuguguuaa

SEQ ID NO: 1087514 - RNA, 16 nt, Homo sapiens
cauuaacaagaucauu

SEQ ID NO: 1087515 - RNA, 18 nt, Homo sapiens
cauuaagcgggaucccag

SEQ ID NO: 1087516 - RNA, 13 nt, Homo sapiens
cauuagagucagc

SEQ ID NO: 1087517 - RNA, 16 nt, Homo sapiens
cauuagcuacuuuuca

SEQ ID NO: 1087518 - RNA, 17 nt, Homo sapiens
cauuaggaaaacaucuu

SEQ ID NO: 1087519 - RNA, 15 nt, Homo sapiens
cauucagcagucagu

SEQ ID NO: 1087520 - RNA, 14 nt, Homo sapiens
cauucuagugcaga

SEQ ID NO: 1087521 - RNA, 17 nt, Homo sapiens
cauugauggagccugaa

SEQ ID NO: 1087522 - RNA, 17 nt, Homo sapiens
ggccucaucugcuccua

SEQ ID NO: 1087523 - RNA, 13 nt, Homo sapiens
ggccugauggugc

SEQ ID NO: 1087524 - RNA, 17 nt, Homo sapiens
ggccuggcacagugucu

SEQ ID NO: 1087525 - RNA, 17 nt, Homo sapiens
ggccuuggucccagaca

SEQ ID NO: 1087526 - RNA, 14 nt, Homo sapiens
ggcuagagugcagu

SEQ ID NO: 1087527 - RNA, 17 nt, Homo sapiens
ggcugaacagugcucug

SEQ ID NO: 1087528 - RNA, 17 nt, Homo sapiens
ggcugagagaguggcau

SEQ ID NO: 1087529 - RNA, 15 nt, Homo sapiens
ggcuggcuguguccu

SEQ ID NO: 1087530 - RNA, 22 nt, Homo sapiens
ggcuuucuggagaggagggaug

SEQ ID NO: 1087531 - RNA, 14 nt, Homo sapiens
ggcuuuuccaaaag

SEQ ID NO: 1087532 - RNA, 15 nt, Homo sapiens
gggagccucguccaa

SEQ ID NO: 1087533 - RNA, 15 nt, Homo sapiens
gggagggacugcuga

SEQ ID NO: 1087534 - RNA, 13 nt, Homo sapiens
gggagggagcuga

SEQ ID NO: 1087535 - RNA, 18 nt, Homo sapiens
gggauaggaagugcccca

SEQ ID NO: 1087536 - RNA, 23 nt, Homo sapiens
gggcaaagaacugccccaucucc

SEQ ID NO: 1087537 - RNA, 21 nt, Homo sapiens
gggcaccaagaccccaaaggg

SEQ ID NO: 1087538 - RNA, 23 nt, Homo sapiens
gggccaacaaggacucagaugag

SEQ ID NO: 1087539 - RNA, 12 nt, Homo sapiens
gggccaucuccu

SEQ ID NO: 1087540 - RNA, 14 nt, Homo sapiens
gggccuacacccgu

SEQ ID NO: 1087541 - RNA, 19 nt, Homo sapiens
gggccucagccuccaggca

SEQ ID NO: 1087542 - RNA, 17 nt, Homo sapiens
gggccuggccuuguccc

SEQ ID NO: 1087543 - RNA, 14 nt, Homo sapiens
gggcugcccugcca

SEQ ID NO: 1087544 - RNA, 20 nt, Homo sapiens
gggcuuuuccaaaagcaaac

SEQ ID NO: 1087545 - RNA, 23 nt, Homo sapiens
ggggcacccuccaaacacugggc

SEQ ID NO: 1087546 - RNA, 19 nt, Homo sapiens
ggggccuuggucccagaca

SEQ ID NO: 1087547 - RNA, 16 nt, Homo sapiens
gggggaagagcacagc

SEQ ID NO: 1087548 - RNA, 17 nt, Homo sapiens
gggugagaacgugccca

SEQ ID NO: 1087549 - RNA, 15 nt, Homo sapiens
ggguggaucaccuga

SEQ ID NO: 1087550 - RNA, 15 nt, Homo sapiens
gggugggaaccuggg

SEQ ID NO: 1087551 - RNA, 11 nt, Homo sapiens
gggugggagag

SEQ ID NO: 1087552 - RNA, 18 nt, Homo sapiens
ggguugaaagacaucaau

SEQ ID NO: 1087553 - RNA, 17 nt, Homo sapiens
gguaaaaccccaucucu

SEQ ID NO: 1087554 - RNA, 18 nt, Homo sapiens
gguaauuuguaucugaag

SEQ ID NO: 1087555 - RNA, 13 nt, Homo sapiens
gguaguacuggga

SEQ ID NO: 1087556 - RNA, 18 nt, Homo sapiens
ggucauuauuuuuuacaa

SEQ ID NO: 1087557 - RNA, 12 nt, Homo sapiens
ggucccagacag

SEQ ID NO: 1087558 - RNA, 18 nt, Homo sapiens
ggucugcuucugcauuca

SEQ ID NO: 1087559 - RNA, 21 nt, Homo sapiens
ggucugcuucugcauucacag

SEQ ID NO: 1087560 - RNA, 18 nt, Homo sapiens
ggucuuacuuugugcaaa

SEQ ID NO: 1087561 - RNA, 16 nt, Homo sapiens
ggugaaagauggaacu

SEQ ID NO: 1087562 - RNA, 20 nt, Homo sapiens
ggugcacagaccucagagau

SEQ ID NO: 1087563 - RNA, 15 nt, Homo sapiens
ggugcagaggugagc

SEQ ID NO: 1087564 - RNA, 19 nt, Homo sapiens
ggugguacagccgugcaca

SEQ ID NO: 1087565 - RNA, 17 nt, Homo sapiens
ggugguuucuacgguga

SEQ ID NO: 1087566 - RNA, 21 nt, Homo sapiens
gguguccuguuccugccacau

SEQ ID NO: 1087567 - RNA, 13 nt, Homo sapiens
ggugucugcagcu

SEQ ID NO: 1087568 - RNA, 14 nt, Homo sapiens
ggugucugcagcuc

SEQ ID NO: 1087569 - RNA, 15 nt, Homo sapiens
ggugugaaagucaga

SEQ ID NO: 1087570 - RNA, 14 nt, Homo sapiens
gguuagcuaccugc

SEQ ID NO: 1087571 - RNA, 21 nt, Homo sapiens
gguuggaaagaguugccauaa

SEQ ID NO: 1087572 - RNA, 15 nt, Homo sapiens
guaaaauaacaucag

SEQ ID NO: 1087573 - RNA, 14 nt, Homo sapiens
guaaacauucucuc

SEQ ID NO: 1087574 - RNA, 14 nt, Homo sapiens
guaagcauucugag

SEQ ID NO: 1087575 - RNA, 18 nt, Homo sapiens
guaauaaacgucuugcca

SEQ ID NO: 1087576 - RNA, 13 nt, Homo sapiens
guaauauucucug

SEQ ID NO: 1087577 - RNA, 15 nt, Homo sapiens
guaaucccagcacuu

SEQ ID NO: 1087578 - RNA, 18 nt, Homo sapiens
guaaucccagcuauucag

SEQ ID NO: 1087579 - RNA, 19 nt, Homo sapiens
guaauuuugugaaagaagg

SEQ ID NO: 1087580 - RNA, 15 nt, Homo sapiens
guacagccgugcaca

SEQ ID NO: 1087581 - RNA, 21 nt, Homo sapiens
guaccacucaggccaacaagc

SEQ ID NO: 1087582 - RNA, 22 nt, Homo sapiens
guacucaucugacuugaacucu

SEQ ID NO: 1087583 - RNA, 12 nt, Homo sapiens
guagaaagugau

SEQ ID NO: 1087584 - RNA, 20 nt, Homo sapiens
guagcgagcugcucugcuau

SEQ ID NO: 1087585 - RNA, 22 nt, Homo sapiens
guaggaaagcaccgcagcaugu

SEQ ID NO: 1087586 - RNA, 23 nt, Homo sapiens
guaggcccugcuuuaucagggga

SEQ ID NO: 1087587 - RNA, 18 nt, Homo sapiens
guagggagcuaaggaaga

SEQ ID NO: 1087588 - RNA, 14 nt, Homo sapiens
guaguagugucuuc

SEQ ID NO: 1087589 - RNA, 22 nt, Homo sapiens
guaguuuguuuuagaaccagcc

SEQ ID NO: 1087590 - RNA, 14 nt, Homo sapiens
guauaauaugcaau

SEQ ID NO: 1087591 - RNA, 18 nt, Homo sapiens
guauugauaaacuuugaa

SEQ ID NO: 1087592 - RNA, 16 nt, Homo sapiens
guauuuaagaaaggga

SEQ ID NO: 1087593 - RNA, 14 nt, Homo sapiens
guauuuagugucuu

SEQ ID NO: 1087594 - RNA, 16 nt, Homo sapiens
guauuuagugucuuga

SEQ ID NO: 1087595 - RNA, 18 nt, Homo sapiens
guauuuucaguuugcccu

SEQ ID NO: 1087596 - RNA, 18 nt, Homo sapiens
gucaaauagcaaggccag

SEQ ID NO: 1087597 - RNA, 17 nt, Homo sapiens
gucaacuuucauuugaa

SEQ ID NO: 1087598 - RNA, 15 nt, Homo sapiens
gucaaguucccuccu

SEQ ID NO: 1087599 - RNA, 15 nt, Homo sapiens
gucagaccaguacug

SEQ ID NO: 1087600 - RNA, 18 nt, Homo sapiens
gucagaccaguacuggga

SEQ ID NO: 1087601 - RNA, 15 nt, Homo sapiens
gucagaguucugcuc

SEQ ID NO: 1087602 - RNA, 16 nt, Homo sapiens
gucagcacagaacaca

SEQ ID NO: 1087603 - RNA, 16 nt, Homo sapiens
gucagcacuagaucau

SEQ ID NO: 1087604 - RNA, 13 nt, Homo sapiens
gucauaaugucau

SEQ ID NO: 1087605 - RNA, 18 nt, Homo sapiens
gucauacgaaccuaaaga

SEQ ID NO: 1087606 - RNA, 21 nt, Homo sapiens
gucauuaaaacagaagcaaau

SEQ ID NO: 1087607 - RNA, 21 nt, Homo sapiens
gucauuguaaccucgugucua

SEQ ID NO: 1087608 - RNA, 21 nt, Homo sapiens
guccaaggcaguucugugucc

SEQ ID NO: 1087609 - RNA, 22 nt, Homo sapiens
guccauccuccucuccaugcaa

SEQ ID NO: 1087610 - RNA, 19 nt, Homo sapiens
guccauugaugucauucag

SEQ ID NO: 1087611 - RNA, 23 nt, Homo sapiens
guccauuucuuauuuaauuagaa

SEQ ID NO: 1087612 - RNA, 20 nt, Homo sapiens
guccccggccacgucugugc

SEQ ID NO: 1087613 - RNA, 14 nt, Homo sapiens
guccccuaccccca

SEQ ID NO: 1087614 - RNA, 17 nt, Homo sapiens
guccccucacgugacca

SEQ ID NO: 1087615 - RNA, 22 nt, Homo sapiens
gucccgaggaugcugucaggag

SEQ ID NO: 1087616 - RNA, 13 nt, Homo sapiens
gucccuuggagac

SEQ ID NO: 1087617 - RNA, 15 nt, Homo sapiens
guccugacuucaggg

SEQ ID NO: 1087618 - RNA, 18 nt, Homo sapiens
guccugcuggccugcucu

SEQ ID NO: 1087619 - RNA, 20 nt, Homo sapiens
guccuggacccuggccuaaa

SEQ ID NO: 1087620 - RNA, 15 nt, Homo sapiens
guccuugucgcugug

SEQ ID NO: 1087621 - RNA, 20 nt, Homo sapiens
guccuuuccugaagugucga

SEQ ID NO: 1087622 - RNA, 14 nt, Homo sapiens
gucgcugugcccug

SEQ ID NO: 1087623 - RNA, 16 nt, Homo sapiens
gucggcacgucccaug

SEQ ID NO: 1087624 - RNA, 22 nt, Homo sapiens
gucggcacgucccaugugcaug

SEQ ID NO: 1087625 - RNA, 22 nt, Homo sapiens
gucucaacuacucagcucuccu

SEQ ID NO: 1087626 - RNA, 15 nt, Homo sapiens
gucucgaacuccuga

SEQ ID NO: 1087627 - RNA, 18 nt, Homo sapiens
gucucuugacuggcucaa

SEQ ID NO: 1087628 - RNA, 15 nt, Homo sapiens
gucugccccacccuc

SEQ ID NO: 1087629 - RNA, 19 nt, Homo sapiens
gucugccccacccucaaac

SEQ ID NO: 1087630 - RNA, 21 nt, Homo sapiens
gucugcucccaauucaccucg

SEQ ID NO: 1087631 - RNA, 17 nt, Homo sapiens
gucuuacuuugugcaaa

SEQ ID NO: 1087632 - RNA, 13 nt, Homo sapiens
gucuucccuguau

SEQ ID NO: 1087633 - RNA, 11 nt, Homo sapiens
gucuugcccaa

SEQ ID NO: 1087634 - RNA, 21 nt, Homo sapiens
gugaaaacacucgugugccca

SEQ ID NO: 1087635 - RNA, 13 nt, Homo sapiens
gugaaacaaaaaa

SEQ ID NO: 1087636 - RNA, 16 nt, Homo sapiens
gugaacacacucagca

SEQ ID NO: 1087637 - RNA, 13 nt, Homo sapiens
gugacgcuacuaa

SEQ ID NO: 1087638 - RNA, 14 nt, Homo sapiens
gugacggacucaga

SEQ ID NO: 1087639 - RNA, 22 nt, Homo sapiens
gugacuuccucgccucucccac

SEQ ID NO: 1087640 - RNA, 13 nt, Homo sapiens
gugauauaugcau

SEQ ID NO: 1087641 - RNA, 15 nt, Homo sapiens
gugaucaucuuugcu

SEQ ID NO: 1087642 - RNA, 18 nt, Homo sapiens
gugauuucuuucuuugca

SEQ ID NO: 1087643 - RNA, 19 nt, Homo sapiens
gugcaauggcacgaucuca

SEQ ID NO: 1087644 - RNA, 22 nt, Homo sapiens
gugcacaccagugucgugucug

SEQ ID NO: 1087645 - RNA, 18 nt, Homo sapiens
gugcaccacuucaaguga

SEQ ID NO: 1087646 - RNA, 19 nt, Homo sapiens
gugcacccaacgugaugcu

SEQ ID NO: 1087647 - RNA, 16 nt, Homo sapiens
gugcagacagugucag

SEQ ID NO: 1087648 - RNA, 17 nt, Homo sapiens
uaggagagaacagggau

SEQ ID NO: 1087649 - RNA, 22 nt, Homo sapiens
uccaggaauaggcauuugccua

SEQ ID NO: 1087650 - RNA, 20 nt, Homo sapiens
uccaggacucagggacucag

SEQ ID NO: 1087651 - RNA, 22 nt, Homo sapiens
uccaggacucagggacucaggc

SEQ ID NO: 1087652 - RNA, 14 nt, Homo sapiens
uccaggacuggggc

SEQ ID NO: 1087653 - RNA, 16 nt, Homo sapiens
uccaggacuggggcuu

SEQ ID NO: 1087654 - RNA, 14 nt, Homo sapiens
uccaggcuccucau

SEQ ID NO: 1087655 - RNA, 16 nt, Homo sapiens
uccagucaaguucccu

SEQ ID NO: 1087656 - RNA, 15 nt, Homo sapiens
uccaugauacuuuaa

SEQ ID NO: 1087657 - RNA, 21 nt, Homo sapiens
uccauuuggcagaacugcugg

SEQ ID NO: 1087658 - RNA, 18 nt, Homo sapiens
uccauuuuacuuccauga

SEQ ID NO: 1087659 - RNA, 20 nt, Homo sapiens
ucccaaagugcuaggauuac

SEQ ID NO: 1087660 - RNA, 20 nt, Homo sapiens
ucccaaguagcugagauuac

SEQ ID NO: 1087661 - RNA, 15 nt, Homo sapiens
ucccaauuauuuauu

SEQ ID NO: 1087662 - RNA, 12 nt, Homo sapiens
ucccaauuuccc

SEQ ID NO: 1087663 - RNA, 19 nt, Homo sapiens
ucccacaggugguacagcc

SEQ ID NO: 1087664 - RNA, 16 nt, Homo sapiens
ucccacccccacuuca

SEQ ID NO: 1087665 - RNA, 17 nt, Homo sapiens
ucccacccccacuucau

SEQ ID NO: 1087666 - RNA, 23 nt, Homo sapiens
ucccacugcacccccuccugcug

SEQ ID NO: 1087667 - RNA, 21 nt, Homo sapiens
ucccagagagacgcugugauu

SEQ ID NO: 1087668 - RNA, 20 nt, Homo sapiens
ucccagccuggccaccagcu

SEQ ID NO: 1087669 - RNA, 17 nt, Homo sapiens
uccccagcugaucaugu

SEQ ID NO: 1087670 - RNA, 21 nt, Homo sapiens
uccccugccuuccuuuaaucc

SEQ ID NO: 1087671 - RNA, 14 nt, Homo sapiens
uccccuggacauau

SEQ ID NO: 1087672 - RNA, 15 nt, Homo sapiens
uccccuggacauauu

SEQ ID NO: 1087673 - RNA, 14 nt, Homo sapiens
ucccgagcuacucu

SEQ ID NO: 1087674 - RNA, 16 nt, Homo sapiens
ucccgguucaccuugc

SEQ ID NO: 1087675 - RNA, 11 nt, Homo sapiens
ucccucuagcu

SEQ ID NO: 1087676 - RNA, 14 nt, Homo sapiens
ucccucucuugccg

SEQ ID NO: 1087677 - RNA, 16 nt, Homo sapiens
ucccuggggcacuccc

SEQ ID NO: 1087678 - RNA, 14 nt, Homo sapiens
ucccuguuccucaa

SEQ ID NO: 1087679 - RNA, 13 nt, Homo sapiens
uccgccauuccaa

SEQ ID NO: 1087680 - RNA, 16 nt, Homo sapiens
uccguuuccaaauaca

SEQ ID NO: 1087681 - RNA, 18 nt, Homo sapiens
uccuaaucaagagucucu

SEQ ID NO: 1087682 - RNA, 15 nt, Homo sapiens
uccuacuucuauauc

SEQ ID NO: 1087683 - RNA, 20 nt, Homo sapiens
uccuaggccacaccaucucc

SEQ ID NO: 1087684 - RNA, 21 nt, Homo sapiens
uccuauccuuggagagcagcu

SEQ ID NO: 1087685 - RNA, 14 nt, Homo sapiens
uccuccagcaauag

SEQ ID NO: 1087686 - RNA, 18 nt, Homo sapiens
uccuccaguucugaugag

SEQ ID NO: 1087687 - RNA, 15 nt, Homo sapiens
uccucgcagagaaug

SEQ ID NO: 1087688 - RNA, 15 nt, Homo sapiens
uccucuccaugcaag

SEQ ID NO: 1087689 - RNA, 12 nt, Homo sapiens
uccucugugauu

SEQ ID NO: 1087690 - RNA, 16 nt, Homo sapiens
uccugaguagcaguga

SEQ ID NO: 1087691 - RNA, 20 nt, Homo sapiens
uccugcacgccguggagcau

SEQ ID NO: 1087692 - RNA, 12 nt, Homo sapiens
uccugccguccc

SEQ ID NO: 1087693 - RNA, 13 nt, Homo sapiens
uccugccuagucu

SEQ ID NO: 1087694 - RNA, 23 nt, Homo sapiens
uccugccuagucucacauguccc

SEQ ID NO: 1087695 - RNA, 17 nt, Homo sapiens
uccugcuccacaguguu

SEQ ID NO: 1087696 - RNA, 20 nt, Homo sapiens
uccugcugccucccuuucau

SEQ ID NO: 1087697 - RNA, 18 nt, Homo sapiens
uccugggagaaccucagg

SEQ ID NO: 1087698 - RNA, 15 nt, Homo sapiens
uccugucccuaccca

SEQ ID NO: 1087699 - RNA, 18 nt, Homo sapiens
uccuuaccauugugauua

SEQ ID NO: 1087700 - RNA, 20 nt, Homo sapiens
uccuuggagugcugcagcuu

SEQ ID NO: 1087701 - RNA, 22 nt, Homo sapiens
uccuuggagugcugcagcuuug

SEQ ID NO: 1087702 - RNA, 21 nt, Homo sapiens
uccuuugcgcaaacuuuaaca

SEQ ID NO: 1087703 - RNA, 16 nt, Homo sapiens
uccuuuguguccauug

SEQ ID NO: 1087704 - RNA, 16 nt, Homo sapiens
ucggcaccagugccuc

SEQ ID NO: 1087705 - RNA, 13 nt, Homo sapiens
ucggcuccugcug

SEQ ID NO: 1087706 - RNA, 22 nt, Homo sapiens
ucguagagacgggguuucacca

SEQ ID NO: 1087707 - RNA, 10 nt, Homo sapiens
ucguagccaa

SEQ ID NO: 1087708 - RNA, 18 nt, Homo sapiens
ucguauccccaagccaca

SEQ ID NO: 1087709 - RNA, 13 nt, Homo sapiens
ucgugauuugccu

SEQ ID NO: 1087710 - RNA, 16 nt, Homo sapiens
ucuaaacugcuguuaa

SEQ ID NO: 1087711 - RNA, 18 nt, Homo sapiens
ucuaaauugaucauucau

SEQ ID NO: 1087712 - RNA, 14 nt, Homo sapiens
ucuaaccauguauc

SEQ ID NO: 1087713 - RNA, 20 nt, Homo sapiens
ucuaacuagaaaucugccaa

SEQ ID NO: 1087714 - RNA, 16 nt, Homo sapiens
ucuaauccaugugcug

SEQ ID NO: 1087715 - RNA, 14 nt, Homo sapiens
ucuaccugcaagau

SEQ ID NO: 1087716 - RNA, 22 nt, Homo sapiens
ucuacuagaaccuucuaaucca

SEQ ID NO: 1087717 - RNA, 18 nt, Homo sapiens
ucuagucagcacuagauc

SEQ ID NO: 1087718 - RNA, 16 nt, Homo sapiens
ucuauaaacaugaagg

SEQ ID NO: 1087719 - RNA, 12 nt, Homo sapiens
ucuaucugcaau

SEQ ID NO: 1087720 - RNA, 15 nt, Homo sapiens
ucucaacuacucagc

SEQ ID NO: 1087721 - RNA, 12 nt, Homo sapiens
ucucacacuccu

SEQ ID NO: 1087722 - RNA, 17 nt, Homo sapiens
ucucagagcagcacugg

SEQ ID NO: 1087723 - RNA, 19 nt, Homo sapiens
ucucaucaauccuuugaau

SEQ ID NO: 1087724 - RNA, 22 nt, Homo sapiens
ucucauuuguauuuucaguuug

SEQ ID NO: 1087725 - RNA, 13 nt, Homo sapiens
ucuccagggacag

SEQ ID NO: 1087726 - RNA, 17 nt, Homo sapiens
ucucccccugggcucug

SEQ ID NO: 1087727 - RNA, 17 nt, Homo sapiens
ucuccuaacucaaggac

SEQ ID NO: 1087728 - RNA, 16 nt, Homo sapiens
ucuccucccauggccu

SEQ ID NO: 1087729 - RNA, 17 nt, Homo sapiens
ucucuccagccucacag

SEQ ID NO: 1087730 - RNA, 16 nt, Homo sapiens
ucucugcugcauuugu

SEQ ID NO: 1087731 - RNA, 12 nt, Homo sapiens
ucucugcugcua

SEQ ID NO: 1087732 - RNA, 23 nt, Homo sapiens
ucucugcuuggcuuccccuccac

SEQ ID NO: 1087733 - RNA, 17 nt, Homo sapiens
ucucuugccagcauuuu

SEQ ID NO: 1087734 - RNA, 14 nt, Homo sapiens
ucugaaggagauuu

SEQ ID NO: 1087735 - RNA, 18 nt, Homo sapiens
ucugaccgggucugcuuc

SEQ ID NO: 1087736 - RNA, 14 nt, Homo sapiens
ucugacuuacuuaa

SEQ ID NO: 1087737 - RNA, 16 nt, Homo sapiens
ucugagugucucugcc

SEQ ID NO: 1087738 - RNA, 15 nt, Homo sapiens
ucugcaaacuaagga

SEQ ID NO: 1087739 - RNA, 23 nt, Homo sapiens
ucugcagauagugccucugcaaa

SEQ ID NO: 1087740 - RNA, 18 nt, Homo sapiens
ucugcaucuuacagucag

SEQ ID NO: 1087741 - RNA, 18 nt, Homo sapiens
ucugugcagacaguguca

SEQ ID NO: 1087742 - RNA, 15 nt, Homo sapiens
ucuuaaaauguuaac

SEQ ID NO: 1087743 - RNA, 19 nt, Homo sapiens
ucuuaaguugaucuaauga

SEQ ID NO: 1087744 - RNA, 19 nt, Homo sapiens
ucuuacagucagcacagaa

SEQ ID NO: 1087745 - RNA, 11 nt, Homo sapiens
ucuuacuuugu

SEQ ID NO: 1087746 - RNA, 16 nt, Homo sapiens
ucuuacuuugugcaaa

SEQ ID NO: 1087747 - RNA, 18 nt, Homo sapiens
ucuuauucaugcuuucuc

SEQ ID NO: 1087748 - RNA, 13 nt, Homo sapiens
ucuuauuugcuca

SEQ ID NO: 1087749 - RNA, 23 nt, Homo sapiens
ucuuccuaacagggcacauauuc

SEQ ID NO: 1087750 - RNA, 17 nt, Homo sapiens
ucuucucuguuacaaaa

SEQ ID NO: 1087751 - RNA, 13 nt, Homo sapiens
ucuucugccucag

SEQ ID NO: 1087752 - RNA, 22 nt, Homo sapiens
ucuucuuauucaugcuuucucc

SEQ ID NO: 1087753 - RNA, 24 nt, Homo sapiens
ucuugcuguaacucagacauucca

SEQ ID NO: 1087754 - RNA, 21 nt, Homo sapiens
ucuugggguuuucaguaugaa

SEQ ID NO: 1087755 - RNA, 18 nt, Homo sapiens
ucuuuaucccaucuugau

SEQ ID NO: 1087756 - RNA, 15 nt, Homo sapiens
ucuuucauacauuau

SEQ ID NO: 1087757 - RNA, 16 nt, Homo sapiens
ucuuucauacauuaua

SEQ ID NO: 1087758 - RNA, 15 nt, Homo sapiens
ucuuucuuugcugcu

SEQ ID NO: 1087759 - RNA, 14 nt, Homo sapiens
ucuuugaaagggcu

SEQ ID NO: 1087760 - RNA, 15 nt, Homo sapiens
ucuuugcaccaaaga

SEQ ID NO: 1087761 - RNA, 12 nt, Homo sapiens
ucuuugcaugga

SEQ ID NO: 1087762 - RNA, 12 nt, Homo sapiens
ucuuugcuacaa

SEQ ID NO: 1087763 - RNA, 14 nt, Homo sapiens
ucuuuggugaacau

SEQ ID NO: 1087764 - RNA, 14 nt, Homo sapiens
ucuuugucuaaaca

SEQ ID NO: 1087765 - RNA, 14 nt, Homo sapiens
ucuuuucucuauga

SEQ ID NO: 1087766 - RNA, 13 nt, Homo sapiens
ucuuuuucacuug

SEQ ID NO: 1087767 - RNA, 18 nt, Homo sapiens
ugaaacagggcaccccag

SEQ ID NO: 1087768 - RNA, 14 nt, Homo sapiens
ugaaaccacuggaa

SEQ ID NO: 1087769 - RNA, 22 nt, Homo sapiens
ugaaaccagaaggauauuuacu

SEQ ID NO: 1087770 - RNA, 16 nt, Homo sapiens
ugaaagaaggagcaag

SEQ ID NO: 1087771 - RNA, 16 nt, Homo sapiens
ugaaagagaguaccau

SEQ ID NO: 1087772 - RNA, 10 nt, Homo sapiens
ugaaagcaga

SEQ ID NO: 1087773 - RNA, 14 nt, Homo sapiens
ugaaagcagaugag

SEQ ID NO: 1087774 - RNA, 15 nt, Homo sapiens
ugaacucgaagccca

SEQ ID NO: 1087775 - RNA, 23 nt, Homo sapiens
ugaagcaaacacacagacucugu

SEQ ID NO: 1087776 - RNA, 15 nt, Homo sapiens
ugaaguauuucucac

SEQ ID NO: 1087777 - RNA, 15 nt, Homo sapiens
ugaagugcagcucag

SEQ ID NO: 1087778 - RNA, 17 nt, Homo sapiens
ugaaguggccagaugag

SEQ ID NO: 1087779 - RNA, 21 nt, Homo sapiens
ugaaguuagggaugacuguga

SEQ ID NO: 1087780 - RNA, 23 nt, Homo sapiens
ugaaguuagggaugacugugauu

SEQ ID NO: 1087781 - RNA, 22 nt, Homo sapiens
ugaauuuaagcaugaguggccu

SEQ ID NO: 1087782 - RNA, 17 nt, Homo sapiens
ugaauuuugucuuuaug

SEQ ID NO: 1087783 - RNA, 19 nt, Homo sapiens
ugacaagggcacaagcuca

SEQ ID NO: 1087784 - RNA, 18 nt, Homo sapiens
ugacacauuuucaaguga

SEQ ID NO: 1087785 - RNA, 14 nt, Homo sapiens
ugacagaaaugcaa

SEQ ID NO: 1087786 - RNA, 16 nt, Homo sapiens
ugacaguccucuccac

SEQ ID NO: 1087787 - RNA, 21 nt, Homo sapiens
ugacaucaccaaguguggaau

SEQ ID NO: 1087788 - RNA, 16 nt, Homo sapiens
ugaccgcagguugcuu

SEQ ID NO: 1087789 - RNA, 17 nt, Homo sapiens
ugacucuaccugcaaga

SEQ ID NO: 1087790 - RNA, 13 nt, Homo sapiens
ugacuggccaaaa

SEQ ID NO: 1087791 - RNA, 15 nt, Homo sapiens
ugacuggccaaaaau

SEQ ID NO: 1087792 - RNA, 13 nt, Homo sapiens
ugacuucaugcca

SEQ ID NO: 1087793 - RNA, 20 nt, Homo sapiens
ugacuuccucgccucuccca

SEQ ID NO: 1087794 - RNA, 18 nt, Homo sapiens
ugacuuuugaagaacaaa

SEQ ID NO: 1087795 - RNA, 22 nt, Homo sapiens
ugagaaacuuugaucucugcuu

SEQ ID NO: 1087796 - RNA, 14 nt, Homo sapiens
ugagacuugaauca

SEQ ID NO: 1087797 - RNA, 17 nt, Homo sapiens
ugagcaaggacaaccug

SEQ ID NO: 1087798 - RNA, 16 nt, Homo sapiens
ugagcagcaacugugu

SEQ ID NO: 1087799 - RNA, 16 nt, Homo sapiens
ugagcauuagcuacuu

SEQ ID NO: 1087800 - RNA, 18 nt, Homo sapiens
ugagcauuguaauuaaua

SEQ ID NO: 1087801 - RNA, 19 nt, Homo sapiens
ugaggucuuuuacauacag

SEQ ID NO: 1087802 - RNA, 22 nt, Homo sapiens
ugaguuugcuguauacaaacag

SEQ ID NO: 1087803 - RNA, 15 nt, Homo sapiens
ugauaaaaagaucaa

SEQ ID NO: 1087804 - RNA, 23 nt, Homo sapiens
ugauaauaaauuagguaagauaa

SEQ ID NO: 1087805 - RNA, 18 nt, Homo sapiens
ugauaaucaucagguuua

SEQ ID NO: 1087806 - RNA, 22 nt, Homo sapiens
ugauaaucaucagguuuacuca

SEQ ID NO: 1087807 - RNA, 14 nt, Homo sapiens
ugauauaugcaugu

SEQ ID NO: 1087808 - RNA, 21 nt, Homo sapiens
ugauauuuccuucaccaccuc

SEQ ID NO: 1087809 - RNA, 12 nt, Homo sapiens
ugaucaugucag

SEQ ID NO: 1087810 - RNA, 12 nt, Homo sapiens
ugaucuacucau

SEQ ID NO: 1087811 - RNA, 13 nt, Homo sapiens
ugaucuacucauu

SEQ ID NO: 1087812 - RNA, 18 nt, Homo sapiens
ugaugaaugaggaacaau

SEQ ID NO: 1087813 - RNA, 15 nt, Homo sapiens
ugauggagccugaac

SEQ ID NO: 1087814 - RNA, 21 nt, Homo sapiens
ugaugucauucagcagucagu

SEQ ID NO: 1087815 - RNA, 22 nt, Homo sapiens
ugaugugacgcuacuaaccuga

SEQ ID NO: 1087816 - RNA, 18 nt, Homo sapiens
ugauuaaaaucuggcaaa

SEQ ID NO: 1087817 - RNA, 19 nt, Homo sapiens
ugauuccugcugccuguau

SEQ ID NO: 1087818 - RNA, 19 nt, Homo sapiens
ugauuuggaagagaggcac

SEQ ID NO: 1087819 - RNA, 13 nt, Homo sapiens
ugcaaacuaagga

SEQ ID NO: 1087820 - RNA, 19 nt, Homo sapiens
ugcaagauuucacaucagc

SEQ ID NO: 1087821 - RNA, 15 nt, Homo sapiens
ugcacaccagugucg

SEQ ID NO: 1087822 - RNA, 22 nt, Homo sapiens
ugcacaccagugucgugucugc

SEQ ID NO: 1087823 - RNA, 18 nt, Homo sapiens
ugcacagaccucagagau

SEQ ID NO: 1087824 - RNA, 22 nt, Homo sapiens
ugcacaguaauaugaaagccac

SEQ ID NO: 1087825 - RNA, 19 nt, Homo sapiens
ugcacauuuuguacaaaga

SEQ ID NO: 1087826 - RNA, 13 nt, Homo sapiens
ugcaccaaagaca

SEQ ID NO: 1087827 - RNA, 20 nt, Homo sapiens
ugcacccucauucccucggg

SEQ ID NO: 1087828 - RNA, 18 nt, Homo sapiens
ugcaccuguacucaggag

SEQ ID NO: 1087829 - RNA, 21 nt, Homo sapiens
ugcacuguauauagaagucua

SEQ ID NO: 1087830 - RNA, 21 nt, Homo sapiens
ugcagaggaggagaaaaguga

SEQ ID NO: 1087831 - RNA, 20 nt, Homo sapiens
ugcagccacuguuaagccau

SEQ ID NO: 1087832 - RNA, 14 nt, Homo sapiens
ugcagccugacccc

SEQ ID NO: 1087833 - RNA, 21 nt, Homo sapiens
ugcagcggcacaaaugcaccu

SEQ ID NO: 1087834 - RNA, 19 nt, Homo sapiens
ugcagcuuugggaaagcug

SEQ ID NO: 1087835 - RNA, 15 nt, Homo sapiens
ugcaggguccccaag

SEQ ID NO: 1087836 - RNA, 17 nt, Homo sapiens
ugcaggguccccaagga

SEQ ID NO: 1087837 - RNA, 22 nt, Homo sapiens
ugcaggucugauucccagaaau

SEQ ID NO: 1087838 - RNA, 18 nt, Homo sapiens
ugcaucagaaaaugcagc

SEQ ID NO: 1087839 - RNA, 14 nt, Homo sapiens
ugcauggaauuugu

SEQ ID NO: 1087840 - RNA, 22 nt, Homo sapiens
ugccacauggagcuugacuuca

SEQ ID NO: 1087841 - RNA, 11 nt, Homo sapiens
ugccacuggau

SEQ ID NO: 1087842 - RNA, 18 nt, Homo sapiens
ugccagaugugggcucag

SEQ ID NO: 1087843 - RNA, 20 nt, Homo sapiens
ugcccagacucaaggccucc

SEQ ID NO: 1087844 - RNA, 15 nt, Homo sapiens
ugcccagagugccgu

SEQ ID NO: 1087845 - RNA, 17 nt, Homo sapiens
ugcccaugggcacugcu

SEQ ID NO: 1087846 - RNA, 21 nt, Homo sapiens
ugccccaggccucgucuuuca

SEQ ID NO: 1087847 - RNA, 14 nt, Homo sapiens
ugccccauugcuca

SEQ ID NO: 1087848 - RNA, 18 nt, Homo sapiens
ugccccuuccacuuugag

SEQ ID NO: 1087849 - RNA, 15 nt, Homo sapiens
ugcccuaagaacuuu

SEQ ID NO: 1087850 - RNA, 14 nt, Homo sapiens
ugccucagccuccc

SEQ ID NO: 1087851 - RNA, 17 nt, Homo sapiens
ugccucagugcugcaau

SEQ ID NO: 1087852 - RNA, 19 nt, Homo sapiens
ugccucugcaaacuaagga

SEQ ID NO: 1087853 - RNA, 15 nt, Homo sapiens
ugccucuguauuuaa

SEQ ID NO: 1087854 - RNA, 10 nt, Homo sapiens
ugccugagau

SEQ ID NO: 1087855 - RNA, 14 nt, Homo sapiens
ugccugagauucuu

SEQ ID NO: 1087856 - RNA, 19 nt, Homo sapiens
ugccugggguguaaugagc

SEQ ID NO: 1087857 - RNA, 21 nt, Homo sapiens
ugccuuccugccuagucucac

SEQ ID NO: 1087858 - RNA, 15 nt, Homo sapiens
ugccuuccuguuuaa

SEQ ID NO: 1087859 - RNA, 21 nt, Homo sapiens
ugcgggcauuuugaaugugau

SEQ ID NO: 1087860 - RNA, 15 nt, Homo sapiens
ugcuaucgcaccacu

SEQ ID NO: 1087861 - RNA, 13 nt, Homo sapiens
ugcucugccucua

SEQ ID NO: 1087862 - RNA, 11 nt, Homo sapiens
ugcucugcuau

SEQ ID NO: 1087863 - RNA, 22 nt, Homo sapiens
ugcucugcuuuuccugucugua

SEQ ID NO: 1087864 - RNA, 14 nt, Homo sapiens
ugcugagcaggaac

SEQ ID NO: 1087865 - RNA, 19 nt, Homo sapiens
ugcugcugagugcaccacu

SEQ ID NO: 1087866 - RNA, 21 nt, Homo sapiens
ugcuggccacagaaaggccac

SEQ ID NO: 1087867 - RNA, 17 nt, Homo sapiens
ugcuguaacucagacau

SEQ ID NO: 1087868 - RNA, 22 nt, Homo sapiens
ugcuguaacucagacauuccaa

SEQ ID NO: 1087869 - RNA, 14 nt, Homo sapiens
ugcuguacauuacu

SEQ ID NO: 1087870 - RNA, 12 nt, Homo sapiens
ugcuucagccug

SEQ ID NO: 1087871 - RNA, 20 nt, Homo sapiens
ugcuuuauaccccauuugau

SEQ ID NO: 1087872 - RNA, 12 nt, Homo sapiens
ugcuuuccaaca

SEQ ID NO: 1087873 - RNA, 17 nt, Homo sapiens
ugcuuucuauuaucuau

SEQ ID NO: 1087874 - RNA, 19 nt, Homo sapiens
uggaaagcaucaccucagg

SEQ ID NO: 1087875 - RNA, 22 nt, Homo sapiens
uggaaagcaucaccucaggcca

SEQ ID NO: 1087876 - RNA, 18 nt, Homo sapiens
uggaagggccuucuccac

SEQ ID NO: 1087877 - RNA, 22 nt, Homo sapiens
uggacaauaugaaucuuuucca

SEQ ID NO: 1087878 - RNA, 15 nt, Homo sapiens
uggacccaugacucu

SEQ ID NO: 1087879 - RNA, 18 nt, Homo sapiens
uggacuugaggauuuuga

SEQ ID NO: 1087880 - RNA, 21 nt, Homo sapiens
uggagaaacaggcucugagau

SEQ ID NO: 1087881 - RNA, 16 nt, Homo sapiens
uggagacgccucccca

SEQ ID NO: 1087882 - RNA, 18 nt, Homo sapiens
uggaggaaagugauaucc

SEQ ID NO: 1087883 - RNA, 15 nt, Homo sapiens
uggaguugugaucau

SEQ ID NO: 1087884 - RNA, 17 nt, Homo sapiens
uggcaacagaaaacaau

SEQ ID NO: 1087885 - RNA, 19 nt, Homo sapiens
uggcaauaaggaucuuccc

SEQ ID NO: 1087886 - RNA, 20 nt, Homo sapiens
uggcauauccauuguggaaa

SEQ ID NO: 1087887 - RNA, 15 nt, Homo sapiens
uggcaucacagggca

SEQ ID NO: 1087888 - RNA, 11 nt, Homo sapiens
uggcaucuccc

SEQ ID NO: 1087889 - RNA, 18 nt, Homo sapiens
uggccagugugaucccaa

SEQ ID NO: 1087890 - RNA, 21 nt, Homo sapiens
uggccuauuuuggacguguga

SEQ ID NO: 1087891 - RNA, 15 nt, Homo sapiens
uggcgcaucauaugc

SEQ ID NO: 1087892 - RNA, 16 nt, Homo sapiens
uggcgcaucauaugca

SEQ ID NO: 1087893 - RNA, 17 nt, Homo sapiens
uggcggcgcagagggaa

SEQ ID NO: 1087894 - RNA, 13 nt, Homo sapiens
uggcucauuagcu

SEQ ID NO: 1087895 - RNA, 22 nt, Homo sapiens
uggcugagagaguggcauuggc

SEQ ID NO: 1087896 - RNA, 16 nt, Homo sapiens
ugggccugugugcacc

SEQ ID NO: 1087897 - RNA, 20 nt, Homo sapiens
ugggcucugaggaguggagu

SEQ ID NO: 1087898 - RNA, 17 nt, Homo sapiens
uggggcagcagcugccu

SEQ ID NO: 1087899 - RNA, 11 nt, Homo sapiens
uggggccacau

SEQ ID NO: 1087900 - RNA, 14 nt, Homo sapiens
ugggggaggcuuca

SEQ ID NO: 1087901 - RNA, 22 nt, Homo sapiens
ugggggcaccaagaccccaaag

SEQ ID NO: 1087902 - RNA, 16 nt, Homo sapiens
ugggguuccccuggaa

SEQ ID NO: 1087903 - RNA, 15 nt, Homo sapiens
ugggucuucccugua

SEQ ID NO: 1087904 - RNA, 17 nt, Homo sapiens
uggguugucacugagac

SEQ ID NO: 1087905 - RNA, 13 nt, Homo sapiens
ugguaaguaacug

SEQ ID NO: 1087906 - RNA, 16 nt, Homo sapiens
ugguaauuuguaucug

SEQ ID NO: 1087907 - RNA, 22 nt, Homo sapiens
ugguacugcacauuuuguacaa

SEQ ID NO: 1087908 - RNA, 15 nt, Homo sapiens
ugguagacugugaca

SEQ ID NO: 1087909 - RNA, 17 nt, Homo sapiens
ugguauaucuuuuucca

SEQ ID NO: 1087910 - RNA, 21 nt, Homo sapiens
uggugauuccauuuuacuucc

SEQ ID NO: 1087911 - RNA, 23 nt, Homo sapiens
ugguguaagccaguuccagcaca

SEQ ID NO: 1087912 - RNA, 16 nt, Homo sapiens
ugguugauucacacuu

SEQ ID NO: 1087913 - RNA, 15 nt, Homo sapiens
ugguuuaaaagucac

SEQ ID NO: 1087914 - RNA, 14 nt, Homo sapiens
uguaaaacuaaaca

SEQ ID NO: 1087915 - RNA, 19 nt, Homo sapiens
uguaaaugaagggucauuu

SEQ ID NO: 1087916 - RNA, 18 nt, Homo sapiens
uguaaucaguuuuaucca

SEQ ID NO: 1087917 - RNA, 12 nt, Homo sapiens
uguaaugaucau

SEQ ID NO: 1087918 - RNA, 18 nt, Homo sapiens
uguaauuccucccuaaga

SEQ ID NO: 1087919 - RNA, 18 nt, Homo sapiens
uguacugaguauugauaa

SEQ ID NO: 1087920 - RNA, 12 nt, Homo sapiens
uguagaaaguga

SEQ ID NO: 1087921 - RNA, 14 nt, Homo sapiens
uguagaaagugauc

SEQ ID NO: 1087922 - RNA, 24 nt, Homo sapiens
uguagcaaauuucgagcauaagaa

SEQ ID NO: 1087923 - RNA, 13 nt, Homo sapiens
uguagcucuaugg

SEQ ID NO: 1087924 - RNA, 11 nt, Homo sapiens
uguaugugaca

SEQ ID NO: 1087925 - RNA, 19 nt, Homo sapiens
uguauuccucaugucauca

SEQ ID NO: 1087926 - RNA, 15 nt, Homo sapiens
uguauuuaacugccu

SEQ ID NO: 1087927 - RNA, 21 nt, Homo sapiens
ugucaaagaaaacuuccaaaa

SEQ ID NO: 1087928 - RNA, 15 nt, Homo sapiens
uguccaaguccaacc

SEQ ID NO: 1087929 - RNA, 16 nt, Homo sapiens
uguccaccaccaccug

SEQ ID NO: 1087930 - RNA, 22 nt, Homo sapiens
uguccagaccauugucuuccaa

SEQ ID NO: 1087931 - RNA, 22 nt, Homo sapiens
uguccuaaucauauaccagagg

SEQ ID NO: 1087932 - RNA, 16 nt, Homo sapiens
ugucguaggaaaacca

SEQ ID NO: 1087933 - RNA, 20 nt, Homo sapiens
ugucguaggaaaaccaugac

SEQ ID NO: 1087934 - RNA, 15 nt, Homo sapiens
ugucgugucugcugu

SEQ ID NO: 1087935 - RNA, 17 nt, Homo sapiens
ugucgugucugcuguug

SEQ ID NO: 1087936 - RNA, 17 nt, Homo sapiens
ugucucuauccaucaga

SEQ ID NO: 1087937 - RNA, 21 nt, Homo sapiens
ugucucuugacuggcucaaga

SEQ ID NO: 1087938 - RNA, 22 nt, Homo sapiens
ugucuuauagguuuccacugcc

SEQ ID NO: 1087939 - RNA, 15 nt, Homo sapiens
ugucuuuggcuucag

SEQ ID NO: 1087940 - RNA, 19 nt, Homo sapiens
ugugaacauggacucuucc

SEQ ID NO: 1087941 - RNA, 18 nt, Homo sapiens
ugugacuauguuccaaua

SEQ ID NO: 1087942 - RNA, 14 nt, Homo sapiens
ugugauauaugcau

SEQ ID NO: 1087943 - RNA, 12 nt, Homo sapiens
ugugauuuucag

SEQ ID NO: 1087944 - RNA, 18 nt, Homo sapiens
ugugauuuuugaacaaua

SEQ ID NO: 1087945 - RNA, 23 nt, Homo sapiens
ugugcaccuauggcccagccacu

SEQ ID NO: 1087946 - RNA, 12 nt, Homo sapiens
ugugcaugaccu

SEQ ID NO: 1087947 - RNA, 17 nt, Homo sapiens
ugugccaaagugcauag

SEQ ID NO: 1087948 - RNA, 15 nt, Homo sapiens
ugugcucucggcuuc

SEQ ID NO: 1087949 - RNA, 22 nt, Homo sapiens
uguggauaaggcuuaggugcca

SEQ ID NO: 1087950 - RNA, 18 nt, Homo sapiens
uguggccaaggcugagag

SEQ ID NO: 1087951 - RNA, 20 nt, Homo sapiens
uguguagcaaauuucgagca

SEQ ID NO: 1087952 - RNA, 20 nt, Homo sapiens
uguguaugagacuguguuuc

SEQ ID NO: 1087953 - RNA, 13 nt, Homo sapiens
uguguccugauga

SEQ ID NO: 1087954 - RNA, 12 nt, Homo sapiens
ugugucugcaac

SEQ ID NO: 1087955 - RNA, 18 nt, Homo sapiens
ugugugaggacuucugca

SEQ ID NO: 1087956 - RNA, 22 nt, Homo sapiens
ugugugcacccaacgugaugcu

SEQ ID NO: 1087957 - RNA, 12 nt, Homo sapiens
ugugugugauau

SEQ ID NO: 1087958 - RNA, 17 nt, Homo sapiens
uguguucaguaguucca

SEQ ID NO: 1087959 - RNA, 22 nt, Homo sapiens
uguguuugauggaucaguguga

SEQ ID NO: 1087960 - RNA, 23 nt, Homo sapiens
uguuaagccauguguuccaaggc

SEQ ID NO: 1087961 - RNA, 21 nt, Homo sapiens
uguuacuauaccuaccauuua

SEQ ID NO: 1087962 - RNA, 20 nt, Homo sapiens
uguuaggccuggcacagugu

SEQ ID NO: 1087963 - RNA, 14 nt, Homo sapiens
uguuauaacuucau

SEQ ID NO: 1087964 - RNA, 13 nt, Homo sapiens
uguuaucugcuag

SEQ ID NO: 1087965 - RNA, 13 nt, Homo sapiens
uguucacacuccu

SEQ ID NO: 1087966 - RNA, 14 nt, Homo sapiens
uguucucuucuaua

SEQ ID NO: 1087967 - RNA, 21 nt, Homo sapiens
uguucuguccaguuuccaaag

SEQ ID NO: 1087968 - RNA, 22 nt, Homo sapiens
uguugacuggccaaaaauaucu

SEQ ID NO: 1087969 - RNA, 11 nt, Homo sapiens
uguugauccca

SEQ ID NO: 1087970 - RNA, 16 nt, Homo sapiens
uguugccaaggcagaa

SEQ ID NO: 1087971 - RNA, 15 nt, Homo sapiens
uguuggcaguguuug

SEQ ID NO: 1087972 - RNA, 16 nt, Homo sapiens
uguuuaauucauuaau

SEQ ID NO: 1087973 - RNA, 15 nt, Homo sapiens
uguuuacagacugug

SEQ ID NO: 1087974 - RNA, 21 nt, Homo sapiens
uguuuauggggcucucacaga

SEQ ID NO: 1087975 - RNA, 15 nt, Homo sapiens
uguuucauuaaucaa

SEQ ID NO: 1087976 - RNA, 17 nt, Homo sapiens
uguuucuuucauaugaa

SEQ ID NO: 1087977 - RNA, 20 nt, Homo sapiens
uuaaaaaaaguauauauucu

SEQ ID NO: 1087978 - RNA, 14 nt, Homo sapiens
uuaaaaaucuuggu

SEQ ID NO: 1087979 - RNA, 15 nt, Homo sapiens
uuaaaagaguagaaa

SEQ ID NO: 1087980 - RNA, 18 nt, Homo sapiens
uuaaaggacaaacaguga

SEQ ID NO: 1087981 - RNA, 16 nt, Homo sapiens
uuaaauaaaagcacaa

SEQ ID NO: 1087982 - RNA, 19 nt, Homo sapiens
uuaaauguagaaagugauc

SEQ ID NO: 1087983 - RNA, 21 nt, Homo sapiens
uuaaauguagaaagugaucca

SEQ ID NO: 1087984 - RNA, 22 nt, Homo sapiens
uuaacagcgugucaacuuucau

SEQ ID NO: 1087985 - RNA, 20 nt, Homo sapiens
uuaacuccguuuccaaauac

SEQ ID NO: 1087986 - RNA, 18 nt, Homo sapiens
uuaagaaaaaaagcaaaa

SEQ ID NO: 1087987 - RNA, 18 nt, Homo sapiens
uuaagccauguguuccaa

SEQ ID NO: 1087988 - RNA, 16 nt, Homo sapiens
uuaagcucaguggcaa

SEQ ID NO: 1087989 - RNA, 23 nt, Homo sapiens
uuaaggccacacuggcaucuccc

SEQ ID NO: 1087990 - RNA, 17 nt, Homo sapiens
uuaagguagaaccucac

SEQ ID NO: 1087991 - RNA, 17 nt, Homo sapiens
uuacaaaagcagcuuuu

SEQ ID NO: 1087992 - RNA, 14 nt, Homo sapiens
uuacagacugugag

SEQ ID NO: 1087993 - RNA, 13 nt, Homo sapiens
uuacagaucauau

SEQ ID NO: 1087994 - RNA, 15 nt, Homo sapiens
uuaccaaagcaucaa

SEQ ID NO: 1087995 - RNA, 20 nt, Homo sapiens
uuaccaaagcaucaauacaa

SEQ ID NO: 1087996 - RNA, 20 nt, Homo sapiens
uuacgaucccccaagugucc

SEQ ID NO: 1087997 - RNA, 14 nt, Homo sapiens
uuacuuccaugaua

SEQ ID NO: 1087998 - RNA, 20 nt, Homo sapiens
uuacuuccaugauacuuuaa

SEQ ID NO: 1087999 - RNA, 23 nt, Homo sapiens
uuagaauugccuuaaggccacac

SEQ ID NO: 1088000 - RNA, 13 nt, Homo sapiens
uuagauugccacu

SEQ ID NO: 1088001 - RNA, 14 nt, Homo sapiens
uuagcuaccugcua

SEQ ID NO: 1088002 - RNA, 18 nt, Homo sapiens
uuaggauuuaccaaauag

SEQ ID NO: 1088003 - RNA, 16 nt, Homo sapiens
uuagggaugacuguga

SEQ ID NO: 1088004 - RNA, 18 nt, Homo sapiens
uuagggaugacugugauu

SEQ ID NO: 1088005 - RNA, 15 nt, Homo sapiens
uuaguuuuuuccaca

SEQ ID NO: 1088006 - RNA, 23 nt, Homo sapiens
uuauaaaagaauaaaauugcacu

SEQ ID NO: 1088007 - RNA, 20 nt, Homo sapiens
uuaucaaaaaguacaauaau

SEQ ID NO: 1088008 - RNA, 22 nt, Homo sapiens
uuaugauauaauaaauauauau

SEQ ID NO: 1088009 - RNA, 12 nt, Homo sapiens
uuauugcauaau

SEQ ID NO: 1088010 - RNA, 17 nt, Homo sapiens
uuauuuguacaguucag

SEQ ID NO: 1088011 - RNA, 11 nt, Homo sapiens
uucacacuccu

SEQ ID NO: 1088012 - RNA, 16 nt, Homo sapiens
uucaccacauucguca

SEQ ID NO: 1088013 - RNA, 15 nt, Homo sapiens
uucacgccuggguga

SEQ ID NO: 1088014 - RNA, 21 nt, Homo sapiens
uucagagaaaacuucagagaa

SEQ ID NO: 1088015 - RNA, 23 nt, Homo sapiens
uucaggggacuguucucaccuua

SEQ ID NO: 1088016 - RNA, 22 nt, Homo sapiens
uucaguuccucuuugcauggaa

SEQ ID NO: 1088017 - RNA, 18 nt, Homo sapiens
uuccaauaaagcagaguu

SEQ ID NO: 1088018 - RNA, 12 nt, Homo sapiens
uuccaccagagc

SEQ ID NO: 1088019 - RNA, 12 nt, Homo sapiens
uuccaugcacuc

SEQ ID NO: 1088020 - RNA, 16 nt, Homo sapiens
uuccauuuuacuucca

SEQ ID NO: 1088021 - RNA, 17 nt, Homo sapiens
uuccauuuuacuuccau

SEQ ID NO: 1088022 - RNA, 16 nt, Homo sapiens
uuccccagcugaucau

SEQ ID NO: 1088023 - RNA, 20 nt, Homo sapiens
uuccccagcugaucauguca

SEQ ID NO: 1088024 - RNA, 15 nt, Homo sapiens
uuccccuugucccug

SEQ ID NO: 1088025 - RNA, 17 nt, Homo sapiens
uucccugggccucagcc

SEQ ID NO: 1088026 - RNA, 15 nt, Homo sapiens
uucccuguucuuuga

SEQ ID NO: 1088027 - RNA, 20 nt, Homo sapiens
uuccuaagccuguugcugaa

SEQ ID NO: 1088028 - RNA, 15 nt, Homo sapiens
uuccuagcuguaaau

SEQ ID NO: 1088029 - RNA, 23 nt, Homo sapiens
uuccucccaaaggcuuucuuucc

SEQ ID NO: 1088030 - RNA, 15 nt, Homo sapiens
uuccugaguagcagu

SEQ ID NO: 1088031 - RNA, 15 nt, Homo sapiens
uuccuucaccaccuc

SEQ ID NO: 1088032 - RNA, 23 nt, Homo sapiens
uucuaacauaaguaagacuugau

SEQ ID NO: 1088033 - RNA, 21 nt, Homo sapiens
uucuaacuagaaaucugccaa

SEQ ID NO: 1088034 - RNA, 23 nt, Homo sapiens
uucucaccuuaacucagccagaa

SEQ ID NO: 1088035 - RNA, 15 nt, Homo sapiens
uucucuucuacacgu

SEQ ID NO: 1088036 - RNA, 14 nt, Homo sapiens
uucugccugagauu

SEQ ID NO: 1088037 - RNA, 22 nt, Homo sapiens
uucugggggagacaugcucucc

SEQ ID NO: 1088038 - RNA, 17 nt, Homo sapiens
uucuguccaguuuccaa

SEQ ID NO: 1088039 - RNA, 15 nt, Homo sapiens
uucuguccuaaucau

SEQ ID NO: 1088040 - RNA, 15 nt, Homo sapiens
uucugucucugcuug

SEQ ID NO: 1088041 - RNA, 13 nt, Homo sapiens
uucuugaaccaau

SEQ ID NO: 1088042 - RNA, 12 nt, Homo sapiens
uucuugugauug

SEQ ID NO: 1088043 - RNA, 14 nt, Homo sapiens
uucuuuuucacuug

SEQ ID NO: 1088044 - RNA, 15 nt, Homo sapiens
uugaaaccuuugaca

SEQ ID NO: 1088045 - RNA, 21 nt, Homo sapiens
uugaaagugaauaaacuucag

SEQ ID NO: 1088046 - RNA, 23 nt, Homo sapiens
uugaaaugagaaacuuugaucuc

SEQ ID NO: 1088047 - RNA, 13 nt, Homo sapiens
uugaaccaauaau

SEQ ID NO: 1088048 - RNA, 22 nt, Homo sapiens
uugacguaagcucuaucugcaa

SEQ ID NO: 1088049 - RNA, 15 nt, Homo sapiens
uugagcgugauucug

SEQ ID NO: 1088050 - RNA, 22 nt, Homo sapiens
uugagcuuucaugaguuuccca

SEQ ID NO: 1088051 - RNA, 11 nt, Homo sapiens
uugaguaccaa

SEQ ID NO: 1088052 - RNA, 16 nt, Homo sapiens
uugagucucugaacau

SEQ ID NO: 1088053 - RNA, 19 nt, Homo sapiens
uugauacggagccauguca

SEQ ID NO: 1088054 - RNA, 18 nt, Homo sapiens
uugauuaaaaucuggcaa

SEQ ID NO: 1088055 - RNA, 13 nt, Homo sapiens
uugcacaaaaagg

SEQ ID NO: 1088056 - RNA, 12 nt, Homo sapiens
uugcacauucua

SEQ ID NO: 1088057 - RNA, 16 nt, Homo sapiens
uugcagauccuugaua

SEQ ID NO: 1088058 - RNA, 21 nt, Homo sapiens
uugcaugaauucacaaacaaa

SEQ ID NO: 1088059 - RNA, 23 nt, Homo sapiens
uugcccagagugccguaguccuu

SEQ ID NO: 1088060 - RNA, 12 nt, Homo sapiens
uugcuaccaaaa

SEQ ID NO: 1088061 - RNA, 14 nt, Homo sapiens
uugcuaccaaaaac

SEQ ID NO: 1088062 - RNA, 17 nt, Homo sapiens
uugcucgaagacuguga

SEQ ID NO: 1088063 - RNA, 24 nt, Homo sapiens
uugcuguuggcaucuugcugcuaa

SEQ ID NO: 1088064 - RNA, 15 nt, Homo sapiens
uuggaagccccauaa

SEQ ID NO: 1088065 - RNA, 13 nt, Homo sapiens
uuggcaacagaaa

SEQ ID NO: 1088066 - RNA, 17 nt, Homo sapiens
uuggcacugaugcaaug

SEQ ID NO: 1088067 - RNA, 19 nt, Homo sapiens
uugggggaggcuucagggg

SEQ ID NO: 1088068 - RNA, 21 nt, Homo sapiens
uuguaagaaauauauuugaua

SEQ ID NO: 1088069 - RNA, 22 nt, Homo sapiens
uuguaagaaauauauuugauaa

SEQ ID NO: 1088070 - RNA, 19 nt, Homo sapiens
uuguaaguuuaugucuaaa

SEQ ID NO: 1088071 - RNA, 23 nt, Homo sapiens
uuguaaucauguuaccauuacaa

SEQ ID NO: 1088072 - RNA, 20 nt, Homo sapiens
uuguauuuaaaugaaaguga

SEQ ID NO: 1088073 - RNA, 17 nt, Homo sapiens
uuguuaggagaugucau

SEQ ID NO: 1088074 - RNA, 13 nt, Homo sapiens
uuguucacacucc

SEQ ID NO: 1088075 - RNA, 14 nt, Homo sapiens
uuguucacacuccu

SEQ ID NO: 1088076 - RNA, 18 nt, Homo sapiens
uuguucacuagacugugc

SEQ ID NO: 1088077 - RNA, 15 nt, Homo sapiens
uuguucugucuuuag

SEQ ID NO: 1088078 - RNA, 20 nt, Homo sapiens
uuguuuuuaaguccuguaua

SEQ ID NO: 1088079 - RNA, 21 nt, Homo sapiens
uuuaaaguauguuauugcaua

SEQ ID NO: 1088080 - RNA, 18 nt, Homo sapiens
uuuaaauaaaagcacaag

SEQ ID NO: 1088081 - RNA, 12 nt, Homo sapiens
uuuaauuaucuu

SEQ ID NO: 1088082 - RNA, 20 nt, Homo sapiens
uuuacaguguauuuaagaaa

SEQ ID NO: 1088083 - RNA, 14 nt, Homo sapiens
uuuacuagugugug

SEQ ID NO: 1088084 - RNA, 16 nt, Homo sapiens
uuuacuuccaugauac

SEQ ID NO: 1088085 - RNA, 13 nt, Homo sapiens
uuuagaaccagcc

SEQ ID NO: 1088086 - RNA, 14 nt, Homo sapiens
uuuagugucuugaa

SEQ ID NO: 1088087 - RNA, 15 nt, Homo sapiens
uuuauggggcucuca

SEQ ID NO: 1088088 - RNA, 22 nt, Homo sapiens
uuucacaggacucugcagauag

SEQ ID NO: 1088089 - RNA, 14 nt, Homo sapiens
uuucauacaacaga

SEQ ID NO: 1088090 - RNA, 16 nt, Homo sapiens
uuuccaaaacauuucu

SEQ ID NO: 1088091 - RNA, 20 nt, Homo sapiens
uuuccauguaucuaccucac

SEQ ID NO: 1088092 - RNA, 20 nt, Homo sapiens
uuucccuccccagaguucuu

SEQ ID NO: 1088093 - RNA, 22 nt, Homo sapiens
uuuccuaaagucucugcugcua

SEQ ID NO: 1088094 - RNA, 12 nt, Homo sapiens
uuuccuuaccau

SEQ ID NO: 1088095 - RNA, 17 nt, Homo sapiens
uuuccuuaccauuguga

SEQ ID NO: 1088096 - RNA, 15 nt, Homo sapiens
uuuccuuugcgcaaa

SEQ ID NO: 1088097 - RNA, 21 nt, Homo sapiens
uuucuaaagcucugaacaaaa

SEQ ID NO: 1088098 - RNA, 22 nt, Homo sapiens
uuucucggcaccagugccucag

SEQ ID NO: 1088099 - RNA, 22 nt, Homo sapiens
uuucucuugcucaccaagaagu

SEQ ID NO: 1088100 - RNA, 20 nt, Homo sapiens
uuucuggugaugcccaaaga

SEQ ID NO: 1088101 - RNA, 19 nt, Homo sapiens
uuucuuuuacccaguagga

SEQ ID NO: 1088102 - RNA, 20 nt, Homo sapiens
uuugacuguccucgcagaga

SEQ ID NO: 1088103 - RNA, 16 nt, Homo sapiens
uuugauucagcaaaaa

SEQ ID NO: 1088104 - RNA, 20 nt, Homo sapiens
uuugauucagcaaaaaucuc

SEQ ID NO: 1088105 - RNA, 14 nt, Homo sapiens
uuugcacaggagaa

SEQ ID NO: 1088106 - RNA, 20 nt, Homo sapiens
uuugccccuuccacuuugag

SEQ ID NO: 1088107 - RNA, 16 nt, Homo sapiens
uuuggcaacaggagag

SEQ ID NO: 1088108 - RNA, 18 nt, Homo sapiens
uuugggagaguucauuca

SEQ ID NO: 1088109 - RNA, 12 nt, Homo sapiens
uuuguacauuau

SEQ ID NO: 1088110 - RNA, 15 nt, Homo sapiens
uuugugugugugaua

SEQ ID NO: 1088111 - RNA, 15 nt, Homo sapiens
uuuguuagcaaagau

SEQ ID NO: 1088112 - RNA, 22 nt, Homo sapiens
uuuguuguuugauucagcaaaa

SEQ ID NO: 1088113 - RNA, 18 nt, Homo sapiens
uuuguuucuuucauauga

SEQ ID NO: 1088114 - RNA, 21 nt, Homo sapiens
uuuuaaagaaaaugugucugc

SEQ ID NO: 1088115 - RNA, 19 nt, Homo sapiens
uuuuaaauaaaagcacaag

SEQ ID NO: 1088116 - RNA, 17 nt, Homo sapiens
uuuuacauuucauacaa

SEQ ID NO: 1088117 - RNA, 17 nt, Homo sapiens
uuuuauaaauaugugaa

SEQ ID NO: 1088118 - RNA, 22 nt, Homo sapiens
uuuuauaaauucagaaagucau

SEQ ID NO: 1088119 - RNA, 13 nt, Homo sapiens
uuuuccaucaugu

SEQ ID NO: 1088120 - RNA, 21 nt, Homo sapiens
uuuucccgagcaaagucuaaa

SEQ ID NO: 1088121 - RNA, 14 nt, Homo sapiens
uuuugaguaucucg

SEQ ID NO: 1088122 - RNA, 14 nt, Homo sapiens
uuuugcacauucua

SEQ ID NO: 1088123 - RNA, 14 nt, Homo sapiens
uuuuuucugccuga

SEQ ID NO: 1088124 - RNA, 17 nt, Homo sapiens
uaggauuuaccaaauag

SEQ ID NO: 1088125 - RNA, 15 nt, Homo sapiens
uccuggccucauaca

SEQ ID NO: 1088126 - RNA, 20 nt, Homo sapiens
uccuggcuggcuguguccuc

SEQ ID NO: 1088127 - RNA, 22 nt, Homo sapiens
uccuggggagcuucacaaacau

SEQ ID NO: 1088128 - RNA, 12 nt, Homo sapiens
uccugucugcug

SEQ ID NO: 1088129 - RNA, 17 nt, Homo sapiens
uccugucuuaccaaaca

SEQ ID NO: 1088130 - RNA, 22 nt, Homo sapiens
uccugucuuggaaggacuacua

SEQ ID NO: 1088131 - RNA, 16 nt, Homo sapiens
uccuguuccugccaca

SEQ ID NO: 1088132 - RNA, 18 nt, Homo sapiens
uccuugauaaaugccuca

SEQ ID NO: 1088133 - RNA, 22 nt, Homo sapiens
uccuugucguaggaaaaccaug

SEQ ID NO: 1088134 - RNA, 13 nt, Homo sapiens
uccuuuaauccca

SEQ ID NO: 1088135 - RNA, 12 nt, Homo sapiens
uccuuuguugcu

SEQ ID NO: 1088136 - RNA, 17 nt, Homo sapiens
ucgcagagaaugugaac

SEQ ID NO: 1088137 - RNA, 22 nt, Homo sapiens
ucgcucagcaauagggugcagu

SEQ ID NO: 1088138 - RNA, 16 nt, Homo sapiens
ucggccuccagacugc

SEQ ID NO: 1088139 - RNA, 22 nt, Homo sapiens
ucgggaggcagagacaggagaa

SEQ ID NO: 1088140 - RNA, 18 nt, Homo sapiens
ucgggcuccugugcccuu

SEQ ID NO: 1088141 - RNA, 14 nt, Homo sapiens
ucguagccaucucu

SEQ ID NO: 1088142 - RNA, 20 nt, Homo sapiens
ucguggguguguguagccaa

SEQ ID NO: 1088143 - RNA, 16 nt, Homo sapiens
ucgugguagaagccag

SEQ ID NO: 1088144 - RNA, 18 nt, Homo sapiens
ucuaaccaaagagucucu

SEQ ID NO: 1088145 - RNA, 19 nt, Homo sapiens
ucuaacuagaaaucugcca

SEQ ID NO: 1088146 - RNA, 23 nt, Homo sapiens
ucuaacucccuccucacacucca

SEQ ID NO: 1088147 - RNA, 22 nt, Homo sapiens
ucuaagcugcagcuuccuguca

SEQ ID NO: 1088148 - RNA, 13 nt, Homo sapiens
ucuacuuugucua

SEQ ID NO: 1088149 - RNA, 23 nt, Homo sapiens
ucuaguugauugcgagaauuuuc

SEQ ID NO: 1088150 - RNA, 23 nt, Homo sapiens
ucuaucuugaauuucaugcuuuc

SEQ ID NO: 1088151 - RNA, 20 nt, Homo sapiens
ucucaaaucaaauacauaca

SEQ ID NO: 1088152 - RNA, 14 nt, Homo sapiens
ucucagagccucag

SEQ ID NO: 1088153 - RNA, 13 nt, Homo sapiens
ucuccacagggac

SEQ ID NO: 1088154 - RNA, 17 nt, Homo sapiens
ucuccuuagaaguggaa

SEQ ID NO: 1088155 - RNA, 21 nt, Homo sapiens
ucucggaccuuucagcuguga

SEQ ID NO: 1088156 - RNA, 18 nt, Homo sapiens
ucucuaaacugcuguuaa

SEQ ID NO: 1088157 - RNA, 11 nt, Homo sapiens
ucucuaugaaa

SEQ ID NO: 1088158 - RNA, 11 nt, Homo sapiens
ucucucucuuu

SEQ ID NO: 1088159 - RNA, 9 nt, Homo sapiens
ucucucuuu

SEQ ID NO: 1088160 - RNA, 17 nt, Homo sapiens
ucucugcaaagacuaga

SEQ ID NO: 1088161 - RNA, 17 nt, Homo sapiens
ucucugcucagugaucu

SEQ ID NO: 1088162 - RNA, 18 nt, Homo sapiens
ucucugcucagugaucuc

SEQ ID NO: 1088163 - RNA, 16 nt, Homo sapiens
ucucuucuacacgucc

SEQ ID NO: 1088164 - RNA, 15 nt, Homo sapiens
ucugaggaguggagu

SEQ ID NO: 1088165 - RNA, 18 nt, Homo sapiens
ucugcagggagcaacucu

SEQ ID NO: 1088166 - RNA, 15 nt, Homo sapiens
ucugcaucagcuuuu

SEQ ID NO: 1088167 - RNA, 12 nt, Homo sapiens
ucugccacuucc

SEQ ID NO: 1088168 - RNA, 16 nt, Homo sapiens
ucugccccacccucaa

SEQ ID NO: 1088169 - RNA, 20 nt, Homo sapiens
ucugccccagcucuggcuuc

SEQ ID NO: 1088170 - RNA, 14 nt, Homo sapiens
ucugccucagcuuc

SEQ ID NO: 1088171 - RNA, 13 nt, Homo sapiens
ucugccugagauu

SEQ ID NO: 1088172 - RNA, 16 nt, Homo sapiens
ucugcuauaugccuua

SEQ ID NO: 1088173 - RNA, 15 nt, Homo sapiens
ucugcugcuuuccaa

SEQ ID NO: 1088174 - RNA, 11 nt, Homo sapiens
ucugcuucugc

SEQ ID NO: 1088175 - RNA, 16 nt, Homo sapiens
ucugcuuuuccugucu

SEQ ID NO: 1088176 - RNA, 20 nt, Homo sapiens
ucugcuuuuccugucuguau

SEQ ID NO: 1088177 - RNA, 19 nt, Homo sapiens
ucuggcaaacaugugcaac

SEQ ID NO: 1088178 - RNA, 19 nt, Homo sapiens
ucuggccacacugggcuca

SEQ ID NO: 1088179 - RNA, 17 nt, Homo sapiens
ucugggccagaugcugg

SEQ ID NO: 1088180 - RNA, 14 nt, Homo sapiens
ucugggccagguug

SEQ ID NO: 1088181 - RNA, 18 nt, Homo sapiens
ucugguaucugcauguaa

SEQ ID NO: 1088182 - RNA, 21 nt, Homo sapiens
ucuguaaaugaagggucauuu

SEQ ID NO: 1088183 - RNA, 20 nt, Homo sapiens
ucuguauauagcucuacaca

SEQ ID NO: 1088184 - RNA, 21 nt, Homo sapiens
ucugucaaagaaaacuuccaa

SEQ ID NO: 1088185 - RNA, 18 nt, Homo sapiens
ucuguccuaaucauauac

SEQ ID NO: 1088186 - RNA, 23 nt, Homo sapiens
ucugugaaagucuccuguaucau

SEQ ID NO: 1088187 - RNA, 15 nt, Homo sapiens
ucuguguuuacuuaa

SEQ ID NO: 1088188 - RNA, 16 nt, Homo sapiens
ucuguucugccuuccg

SEQ ID NO: 1088189 - RNA, 16 nt, Homo sapiens
ucuuaaaaaucuuggu

SEQ ID NO: 1088190 - RNA, 15 nt, Homo sapiens
ucuuaaaugagaaag

SEQ ID NO: 1088191 - RNA, 15 nt, Homo sapiens
ucuuagaagugacau

SEQ ID NO: 1088192 - RNA, 16 nt, Homo sapiens
ucuucccacuuugcca

SEQ ID NO: 1088193 - RNA, 19 nt, Homo sapiens
ucuucccacuuugccacug

SEQ ID NO: 1088194 - RNA, 23 nt, Homo sapiens
ucuucccuguaugauuccuugau

SEQ ID NO: 1088195 - RNA, 16 nt, Homo sapiens
ucuuccuaguauauua

SEQ ID NO: 1088196 - RNA, 17 nt, Homo sapiens
ucuucuuauucaugcuu

SEQ ID NO: 1088197 - RNA, 15 nt, Homo sapiens
ucuugacuggcucaa

SEQ ID NO: 1088198 - RNA, 14 nt, Homo sapiens
ucuugcacccucau

SEQ ID NO: 1088199 - RNA, 17 nt, Homo sapiens
ucuugcacccucauucc

SEQ ID NO: 1088200 - RNA, 21 nt, Homo sapiens
ucuugccccaaaucacaaaca

SEQ ID NO: 1088201 - RNA, 16 nt, Homo sapiens
ucuuuaucuccuggga

SEQ ID NO: 1088202 - RNA, 18 nt, Homo sapiens
ucuuucccagaugcccca

SEQ ID NO: 1088203 - RNA, 13 nt, Homo sapiens
ucuuucuuuccaa

SEQ ID NO: 1088204 - RNA, 22 nt, Homo sapiens
ucuuucuuugcaccaaagacau

SEQ ID NO: 1088205 - RNA, 14 nt, Homo sapiens
ucuuugcaccaaag

SEQ ID NO: 1088206 - RNA, 13 nt, Homo sapiens
ugaaaaaaguaua

SEQ ID NO: 1088207 - RNA, 22 nt, Homo sapiens
ugaaaaauaguguguccaugca

SEQ ID NO: 1088208 - RNA, 20 nt, Homo sapiens
ugaaaaccacccuaucauca

SEQ ID NO: 1088209 - RNA, 15 nt, Homo sapiens
ugaaaaccugcauuu

SEQ ID NO: 1088210 - RNA, 16 nt, Homo sapiens
ugaaaccuuucuacuu

SEQ ID NO: 1088211 - RNA, 24 nt, Homo sapiens
ugaaacuuuagagauuaacgacaa

SEQ ID NO: 1088212 - RNA, 17 nt, Homo sapiens
ugaaagaggcauuccca

SEQ ID NO: 1088213 - RNA, 19 nt, Homo sapiens
ugaaagaugcaagcaccug

SEQ ID NO: 1088214 - RNA, 17 nt, Homo sapiens
ugaaagugagacuuuga

SEQ ID NO: 1088215 - RNA, 12 nt, Homo sapiens
ugaaauacucuu

SEQ ID NO: 1088216 - RNA, 15 nt, Homo sapiens
ugaacacacucagca

SEQ ID NO: 1088217 - RNA, 21 nt, Homo sapiens
ugaacucgaagcccacaaucc

SEQ ID NO: 1088218 - RNA, 16 nt, Homo sapiens
ugaaggagaaaaugca

SEQ ID NO: 1088219 - RNA, 19 nt, Homo sapiens
ugaauaaagggaacaugca

SEQ ID NO: 1088220 - RNA, 15 nt, Homo sapiens
ugaaucuuuuccacu

SEQ ID NO: 1088221 - RNA, 19 nt, Homo sapiens
ugaauguguugauuugaga

SEQ ID NO: 1088222 - RNA, 16 nt, Homo sapiens
ugaauugagcuagaaa

SEQ ID NO: 1088223 - RNA, 15 nt, Homo sapiens
ugaauuuuugcacau

SEQ ID NO: 1088224 - RNA, 15 nt, Homo sapiens
ugacaacacaugugg

SEQ ID NO: 1088225 - RNA, 12 nt, Homo sapiens
ugacaacaucgc

SEQ ID NO: 1088226 - RNA, 16 nt, Homo sapiens
ugacaacaucgcaaua

SEQ ID NO: 1088227 - RNA, 21 nt, Homo sapiens
ugacacagcugagcuggccua

SEQ ID NO: 1088228 - RNA, 20 nt, Homo sapiens
ugacacaucaguuauaucuu

SEQ ID NO: 1088229 - RNA, 13 nt, Homo sapiens
ugaccugguacug

SEQ ID NO: 1088230 - RNA, 14 nt, Homo sapiens
ugacggacucagac

SEQ ID NO: 1088231 - RNA, 23 nt, Homo sapiens
ugacgugcaccuguacucaggag

SEQ ID NO: 1088232 - RNA, 14 nt, Homo sapiens
ugagaaaaugucuu

SEQ ID NO: 1088233 - RNA, 12 nt, Homo sapiens
ugagacuugaau

SEQ ID NO: 1088234 - RNA, 14 nt, Homo sapiens
ugagagucaaagcu

SEQ ID NO: 1088235 - RNA, 17 nt, Homo sapiens
ugagcaguagaagccug

SEQ ID NO: 1088236 - RNA, 15 nt, Homo sapiens
ugagccaccaugccc

SEQ ID NO: 1088237 - RNA, 19 nt, Homo sapiens
ugagccagucccucagcca

SEQ ID NO: 1088238 - RNA, 14 nt, Homo sapiens
ugaggaguguccug

SEQ ID NO: 1088239 - RNA, 23 nt, Homo sapiens
ugaggaucagagcguuuguuccc

SEQ ID NO: 1088240 - RNA, 22 nt, Homo sapiens
ugaggggcuccuggaaaggcuc

SEQ ID NO: 1088241 - RNA, 16 nt, Homo sapiens
ugagguugggcugaga

SEQ ID NO: 1088242 - RNA, 15 nt, Homo sapiens
ugagugugacuaugu

SEQ ID NO: 1088243 - RNA, 17 nt, Homo sapiens
ugaguugcaccauucuu

SEQ ID NO: 1088244 - RNA, 21 nt, Homo sapiens
ugauaagaguguaacauccag

SEQ ID NO: 1088245 - RNA, 18 nt, Homo sapiens
ugauacaacugagucucg

SEQ ID NO: 1088246 - RNA, 12 nt, Homo sapiens
ugauagugcuuc

SEQ ID NO: 1088247 - RNA, 17 nt, Homo sapiens
ugaucaugucagccuca

SEQ ID NO: 1088248 - RNA, 14 nt, Homo sapiens
ugaucuaauuuaca

SEQ ID NO: 1088249 - RNA, 18 nt, Homo sapiens
ugauuccauuuuacuucc

SEQ ID NO: 1088250 - RNA, 13 nt, Homo sapiens
uugucacugagac

SEQ ID NO: 1088251 - RNA, 19 nt, Homo sapiens
uugucagaguucugcucua

SEQ ID NO: 1088252 - RNA, 14 nt, Homo sapiens
uuguccccagcucc

SEQ ID NO: 1088253 - RNA, 23 nt, Homo sapiens
uugugaaagaaggagcaagagaa

SEQ ID NO: 1088254 - RNA, 22 nt, Homo sapiens
uugugauugacuuuuuggcuca

SEQ ID NO: 1088255 - RNA, 15 nt, Homo sapiens
uuguguccugaugaa

SEQ ID NO: 1088256 - RNA, 22 nt, Homo sapiens
uuguguguguguguugauccca

SEQ ID NO: 1088257 - RNA, 17 nt, Homo sapiens
uuguuaacacgugacac

SEQ ID NO: 1088258 - RNA, 22 nt, Homo sapiens
uuguuaauaacuaauaacugga

SEQ ID NO: 1088259 - RNA, 19 nt, Homo sapiens
uuguuaugaucuacucauu

SEQ ID NO: 1088260 - RNA, 15 nt, Homo sapiens
uuguuauuuguacag

SEQ ID NO: 1088261 - RNA, 19 nt, Homo sapiens
uuguuugugaaacaaaaaa

SEQ ID NO: 1088262 - RNA, 15 nt, Homo sapiens
uuuaaaaaaaguaua

SEQ ID NO: 1088263 - RNA, 23 nt, Homo sapiens
uuuaaagaaaaugugucugcaac

SEQ ID NO: 1088264 - RNA, 15 nt, Homo sapiens
uuuaaauaaagacaa

SEQ ID NO: 1088265 - RNA, 16 nt, Homo sapiens
uuuaacuugaggguaa

SEQ ID NO: 1088266 - RNA, 14 nt, Homo sapiens
uuuaagaacuguau

SEQ ID NO: 1088267 - RNA, 15 nt, Homo sapiens
uuuaauagcgucaua

SEQ ID NO: 1088268 - RNA, 15 nt, Homo sapiens
uuuaauaucugagaa

SEQ ID NO: 1088269 - RNA, 18 nt, Homo sapiens
uuuaauuagaaauaucuu

SEQ ID NO: 1088270 - RNA, 17 nt, Homo sapiens
uuuaauuuaugauauaa

SEQ ID NO: 1088271 - RNA, 16 nt, Homo sapiens
uuuacauuucauacaa

SEQ ID NO: 1088272 - RNA, 17 nt, Homo sapiens
uuuacucaucaggucau

SEQ ID NO: 1088273 - RNA, 14 nt, Homo sapiens
uuuacuuccaugau

SEQ ID NO: 1088274 - RNA, 20 nt, Homo sapiens
uuuagaaucaagucugugaa

SEQ ID NO: 1088275 - RNA, 19 nt, Homo sapiens
uuuauagucucaaaucaaa

SEQ ID NO: 1088276 - RNA, 15 nt, Homo sapiens
uuuaucccaucuuga

SEQ ID NO: 1088277 - RNA, 15 nt, Homo sapiens
uuuauucccccaaag

SEQ ID NO: 1088278 - RNA, 12 nt, Homo sapiens
uuuauuuccaca

SEQ ID NO: 1088279 - RNA, 16 nt, Homo sapiens
uuucaacaaguaacuu

SEQ ID NO: 1088280 - RNA, 13 nt, Homo sapiens
uuucauacaacag

SEQ ID NO: 1088281 - RNA, 12 nt, Homo sapiens
uuucaugcauuc

SEQ ID NO: 1088282 - RNA, 22 nt, Homo sapiens
uuucauuagggcaaagaucuca

SEQ ID NO: 1088283 - RNA, 12 nt, Homo sapiens
uuuccaaaacau

SEQ ID NO: 1088284 - RNA, 15 nt, Homo sapiens
uuuccacugccaaaa

SEQ ID NO: 1088285 - RNA, 22 nt, Homo sapiens
uuuccagcuccuaguagcuuuc

SEQ ID NO: 1088286 - RNA, 17 nt, Homo sapiens
uuuccauuuuaaggaua

SEQ ID NO: 1088287 - RNA, 13 nt, Homo sapiens
uuuccucuugggc

SEQ ID NO: 1088288 - RNA, 22 nt, Homo sapiens
uuucuaaagcucugaacaaaag

SEQ ID NO: 1088289 - RNA, 23 nt, Homo sapiens
uuucuaaagcucugaacaaaagc

SEQ ID NO: 1088290 - RNA, 19 nt, Homo sapiens
uuucuaaccaaagagucuc

SEQ ID NO: 1088291 - RNA, 21 nt, Homo sapiens
uuucugaacaaagagagcuca

SEQ ID NO: 1088292 - RNA, 17 nt, Homo sapiens
uuucuuugcaccaaaga

SEQ ID NO: 1088293 - RNA, 18 nt, Homo sapiens
uuugaaguggccagauga

SEQ ID NO: 1088294 - RNA, 22 nt, Homo sapiens
uuugaaugguuuucuaauaucu

SEQ ID NO: 1088295 - RNA, 18 nt, Homo sapiens
uuugaggagcagcuucag

SEQ ID NO: 1088296 - RNA, 21 nt, Homo sapiens
uuugaggcaaaggccagcagc

SEQ ID NO: 1088297 - RNA, 15 nt, Homo sapiens
uuugaggguguauau

SEQ ID NO: 1088298 - RNA, 18 nt, Homo sapiens
uuugcccacacacacucc

SEQ ID NO: 1088299 - RNA, 22 nt, Homo sapiens
uuuggcucauuagcugaauuga

SEQ ID NO: 1088300 - RNA, 20 nt, Homo sapiens
uuugugcaaaagcaggcuug

SEQ ID NO: 1088301 - RNA, 19 nt, Homo sapiens
uuuguugugucuugcuaua

SEQ ID NO: 1088302 - RNA, 12 nt, Homo sapiens
uuuuaacugcau

SEQ ID NO: 1088303 - RNA, 17 nt, Homo sapiens
uuuuacacaccaccagc

SEQ ID NO: 1088304 - RNA, 12 nt, Homo sapiens
uuuuacauuuca

SEQ ID NO: 1088305 - RNA, 21 nt, Homo sapiens
uuuuaccaaagcaucaauaca

SEQ ID NO: 1088306 - RNA, 22 nt, Homo sapiens
uuuuaccaaagcaucaauacaa

SEQ ID NO: 1088307 - RNA, 21 nt, Homo sapiens
uuuuacuuccaugauacuuua

SEQ ID NO: 1088308 - RNA, 12 nt, Homo sapiens
uuuucaguauga

SEQ ID NO: 1088309 - RNA, 12 nt, Homo sapiens
uuuuccaggaau

SEQ ID NO: 1088310 - RNA, 23 nt, Homo sapiens
uuuuccccccaauugcugccaau

SEQ ID NO: 1088311 - RNA, 19 nt, Homo sapiens
uuuucccgagcaaagucua

SEQ ID NO: 1088312 - RNA, 17 nt, Homo sapiens
uuuucuggugaugccca

SEQ ID NO: 1088313 - RNA, 13 nt, Homo sapiens
uuuucuuacauaa

SEQ ID NO: 1088314 - RNA, 21 nt, Homo sapiens
uuuuggaaaaaugucacugaa

SEQ ID NO: 1088315 - RNA, 17 nt, Homo sapiens
uuuuuaacugcauaaua

SEQ ID NO: 1088316 - RNA, 19 nt, Homo sapiens
uuuuugaaaaaaguauagg

SEQ ID NO: 1088317 - RNA, 13 nt, Homo sapiens
uuuuuucccccac

SEQ ID NO: 1088318 - RNA, 16 nt, Homo sapiens
acacguggguauuuaa

SEQ ID NO: 1088319 - RNA, 17 nt, Homo sapiens
acagaaaacaauuguuc

SEQ ID NO: 1088320 - RNA, 15 nt, Homo sapiens
acagaaagugacaag

SEQ ID NO: 1088321 - RNA, 15 nt, Homo sapiens
acagagaugugcaug

SEQ ID NO: 1088322 - RNA, 19 nt, Homo sapiens
acagaguugguguucauaa

SEQ ID NO: 1088323 - RNA, 17 nt, Homo sapiens
acagccgugcacaccag

SEQ ID NO: 1088324 - RNA, 22 nt, Homo sapiens
acagcuucacuuaaaaucaaau

SEQ ID NO: 1088325 - RNA, 17 nt, Homo sapiens
acaggacucugcagaua

SEQ ID NO: 1088326 - RNA, 12 nt, Homo sapiens
acaguaccugau

SEQ ID NO: 1088327 - RNA, 18 nt, Homo sapiens
acagugaauuuaagcaug

SEQ ID NO: 1088328 - RNA, 19 nt, Homo sapiens
acauaaguaagacuugauu

SEQ ID NO: 1088329 - RNA, 21 nt, Homo sapiens
acauacaaaaaaaaucuuuaa

SEQ ID NO: 1088330 - RNA, 21 nt, Homo sapiens
acauacauguugggcaugauu

SEQ ID NO: 1088331 - RNA, 23 nt, Homo sapiens
acauauucccaugguagacugug

SEQ ID NO: 1088332 - RNA, 16 nt, Homo sapiens
acaucucccucccaca

SEQ ID NO: 1088333 - RNA, 15 nt, Homo sapiens
acaugaaaacauuga

SEQ ID NO: 1088334 - RNA, 23 nt, Homo sapiens
acaugaccuccguguagugucug

SEQ ID NO: 1088335 - RNA, 16 nt, Homo sapiens
acaugcagcucugcag

SEQ ID NO: 1088336 - RNA, 23 nt, Homo sapiens
acauguguguguguuguguuaau

SEQ ID NO: 1088337 - RNA, 19 nt, Homo sapiens
acauguugggcaugauucu

SEQ ID NO: 1088338 - RNA, 17 nt, Homo sapiens
acauuaaaauagcacau

SEQ ID NO: 1088339 - RNA, 18 nt, Homo sapiens
acauuggaagcucccacc

SEQ ID NO: 1088340 - RNA, 17 nt, Homo sapiens
acauugucaaguggaaa

SEQ ID NO: 1088341 - RNA, 23 nt, Homo sapiens
acauuuugcauuagacagaugac

SEQ ID NO: 1088342 - RNA, 18 nt, Homo sapiens
acauuuuuguagaccacu

SEQ ID NO: 1088343 - RNA, 20 nt, Homo sapiens
accaaagacaucagucucca

SEQ ID NO: 1088344 - RNA, 13 nt, Homo sapiens
accaaaucucagu

SEQ ID NO: 1088345 - RNA, 14 nt, Homo sapiens
accaaaucucagua

SEQ ID NO: 1088346 - RNA, 15 nt, Homo sapiens
accaaaugagcauua

SEQ ID NO: 1088347 - RNA, 15 nt, Homo sapiens
accaacccauguaua

SEQ ID NO: 1088348 - RNA, 19 nt, Homo sapiens
accaaggucucacacuccu

SEQ ID NO: 1088349 - RNA, 20 nt, Homo sapiens
accaaggucucacacuccuc

SEQ ID NO: 1088350 - RNA, 13 nt, Homo sapiens
accaauaauguau

SEQ ID NO: 1088351 - RNA, 15 nt, Homo sapiens
accacacuucuugaa

SEQ ID NO: 1088352 - RNA, 17 nt, Homo sapiens
accagaaucagauucag

SEQ ID NO: 1088353 - RNA, 21 nt, Homo sapiens
accagaggaaagaccaugugg

SEQ ID NO: 1088354 - RNA, 19 nt, Homo sapiens
accagcuuguuugugaaac

SEQ ID NO: 1088355 - RNA, 13 nt, Homo sapiens
accaggucuccuc

SEQ ID NO: 1088356 - RNA, 15 nt, Homo sapiens
accaguacugggaag

SEQ ID NO: 1088357 - RNA, 19 nt, Homo sapiens
accauaaaucaauucauug

SEQ ID NO: 1088358 - RNA, 20 nt, Homo sapiens
accaugcaggcaacauuacc

SEQ ID NO: 1088359 - RNA, 23 nt, Homo sapiens
accaugugauuauggacaucgau

SEQ ID NO: 1088360 - RNA, 13 nt, Homo sapiens
acccauuugccag

SEQ ID NO: 1088361 - RNA, 20 nt, Homo sapiens
accccagcuagggcuggacu

SEQ ID NO: 1088362 - RNA, 15 nt, Homo sapiens
accccagcugaccug

SEQ ID NO: 1088363 - RNA, 14 nt, Homo sapiens
accccaucugccca

SEQ ID NO: 1088364 - RNA, 12 nt, Homo sapiens
accccauuugau

SEQ ID NO: 1088365 - RNA, 21 nt, Homo sapiens
acccccaagccccacugaggc

SEQ ID NO: 1088366 - RNA, 21 nt, Homo sapiens
acccccacuucaugcccacug

SEQ ID NO: 1088367 - RNA, 17 nt, Homo sapiens
accccucuguccagcca

SEQ ID NO: 1088368 - RNA, 15 nt, Homo sapiens
acccuaaagucucag

SEQ ID NO: 1088369 - RNA, 19 nt, Homo sapiens
acccuaaagucucagguga

SEQ ID NO: 1088370 - RNA, 14 nt, Homo sapiens
acccucauucccuc

SEQ ID NO: 1088371 - RNA, 18 nt, Homo sapiens
accgagagagauggaaua

SEQ ID NO: 1088372 - RNA, 12 nt, Homo sapiens
accgugugcucc

SEQ ID NO: 1088373 - RNA, 22 nt, Homo sapiens
accuaaagaauaugaauggauu

SEQ ID NO: 1088374 - RNA, 21 nt, Homo sapiens
accuaugucccuucucaugcc

SEQ ID NO: 1088375 - RNA, 17 nt, Homo sapiens
accuccacccacugucc

SEQ ID NO: 1088376 - RNA, 17 nt, Homo sapiens
accuccuaggaguacaa

SEQ ID NO: 1088377 - RNA, 14 nt, Homo sapiens
accugaacucugca

SEQ ID NO: 1088378 - RNA, 22 nt, Homo sapiens
accugagauacugaagugcagc

SEQ ID NO: 1088379 - RNA, 23 nt, Homo sapiens
accugugucuuauagguuuccac

SEQ ID NO: 1088380 - RNA, 15 nt, Homo sapiens
accuucaauuccugg

SEQ ID NO: 1088381 - RNA, 22 nt, Homo sapiens
acgacaagauuuucuacuuuuu

SEQ ID NO: 1088382 - RNA, 13 nt, Homo sapiens
acgaucucagcuc

SEQ ID NO: 1088383 - RNA, 18 nt, Homo sapiens
acgaucuugcuggcaggg

SEQ ID NO: 1088384 - RNA, 16 nt, Homo sapiens
acggcccaucuuggca

SEQ ID NO: 1088385 - RNA, 16 nt, Homo sapiens
acgucccaugugcaug

SEQ ID NO: 1088386 - RNA, 20 nt, Homo sapiens
acgugacacugugggucuga

SEQ ID NO: 1088387 - RNA, 12 nt, Homo sapiens
acgugugaggau

SEQ ID NO: 1088388 - RNA, 22 nt, Homo sapiens
acguguuuuguuuggacuucac

SEQ ID NO: 1088389 - RNA, 18 nt, Homo sapiens
acguuccugaacauauua

SEQ ID NO: 1088390 - RNA, 21 nt, Homo sapiens
acuacaaacauggggagccau

SEQ ID NO: 1088391 - RNA, 20 nt, Homo sapiens
acuaccaaaugagcauuagc

SEQ ID NO: 1088392 - RNA, 22 nt, Homo sapiens
acuagaaccuucuaauccaugu

SEQ ID NO: 1088393 - RNA, 15 nt, Homo sapiens
acuaggacucugagg

SEQ ID NO: 1088394 - RNA, 22 nt, Homo sapiens
acuauguuccaauaaaacuuua

SEQ ID NO: 1088395 - RNA, 15 nt, Homo sapiens
acucagacauuccaa

SEQ ID NO: 1088396 - RNA, 16 nt, Homo sapiens
acucagacauuccaag

SEQ ID NO: 1088397 - RNA, 14 nt, Homo sapiens
acucaggccaguca

SEQ ID NO: 1088398 - RNA, 20 nt, Homo sapiens
acucauuugcugacacauca

SEQ ID NO: 1088399 - RNA, 12 nt, Homo sapiens
acucccacuucc

SEQ ID NO: 1088400 - RNA, 17 nt, Homo sapiens
acucccuccucacacuc

SEQ ID NO: 1088401 - RNA, 15 nt, Homo sapiens
acuccugaccucgug

SEQ ID NO: 1088402 - RNA, 16 nt, Homo sapiens
acuccugaccucguga

SEQ ID NO: 1088403 - RNA, 22 nt, Homo sapiens
acuccuuuccugcaaacccauu

SEQ ID NO: 1088404 - RNA, 20 nt, Homo sapiens
acucuaccugcaagauuuca

SEQ ID NO: 1088405 - RNA, 14 nt, Homo sapiens
acucucaccucgug

SEQ ID NO: 1088406 - RNA, 13 nt, Homo sapiens
acugaauacuuga

SEQ ID NO: 1088407 - RNA, 18 nt, Homo sapiens
acugaauuuugucuuuau

SEQ ID NO: 1088408 - RNA, 12 nt, Homo sapiens
acugacauuucu

SEQ ID NO: 1088409 - RNA, 14 nt, Homo sapiens
acugagacuagauu

SEQ ID NO: 1088410 - RNA, 13 nt, Homo sapiens
acugagacuugaa

SEQ ID NO: 1088411 - RNA, 20 nt, Homo sapiens
acugagguugggcugagacc

SEQ ID NO: 1088412 - RNA, 18 nt, Homo sapiens
acugaguccucguagcca

SEQ ID NO: 1088413 - RNA, 17 nt, Homo sapiens
acugcauaauagccuaa

SEQ ID NO: 1088414 - RNA, 23 nt, Homo sapiens
acugcguaggagagaacagggau

SEQ ID NO: 1088415 - RNA, 22 nt, Homo sapiens
acugcucugcccccaacucccg

SEQ ID NO: 1088416 - RNA, 13 nt, Homo sapiens
acuggacgcccag

SEQ ID NO: 1088417 - RNA, 13 nt, Homo sapiens
acuggggcuugcc

SEQ ID NO: 1088418 - RNA, 18 nt, Homo sapiens
acuguccaccaccaccug

SEQ ID NO: 1088419 - RNA, 12 nt, Homo sapiens
acuguccugcuc

SEQ ID NO: 1088420 - RNA, 13 nt, Homo sapiens
acuguucaugaau

SEQ ID NO: 1088421 - RNA, 23 nt, Homo sapiens
acuuaaaucuauauacaaagccu

SEQ ID NO: 1088422 - RNA, 21 nt, Homo sapiens
acuuagguaaucauuccaggu

SEQ ID NO: 1088423 - RNA, 15 nt, Homo sapiens
acuuauccugacaca

SEQ ID NO: 1088424 - RNA, 12 nt, Homo sapiens
acuuauuugccc

SEQ ID NO: 1088425 - RNA, 13 nt, Homo sapiens
acuucaagugacc

SEQ ID NO: 1088426 - RNA, 12 nt, Homo sapiens
acuuccaugaua

SEQ ID NO: 1088427 - RNA, 19 nt, Homo sapiens
acuuccaugauacuuuaau

SEQ ID NO: 1088428 - RNA, 20 nt, Homo sapiens
acuucugcaucuuacaguca

SEQ ID NO: 1088429 - RNA, 19 nt, Homo sapiens
acuugagaaaaugcaggag

SEQ ID NO: 1088430 - RNA, 23 nt, Homo sapiens
acuugcugcugagugcaccacuu

SEQ ID NO: 1088431 - RNA, 17 nt, Homo sapiens
acuuugaucucugcuua

SEQ ID NO: 1088432 - RNA, 15 nt, Homo sapiens
acuuugccacuggau

SEQ ID NO: 1088433 - RNA, 12 nt, Homo sapiens
acuuuuucacau

SEQ ID NO: 1088434 - RNA, 17 nt, Homo sapiens
agaaaagcaauacuguu

SEQ ID NO: 1088435 - RNA, 14 nt, Homo sapiens
agaaaagcaugaaa

SEQ ID NO: 1088436 - RNA, 14 nt, Homo sapiens
agaaaaucaaugaa

SEQ ID NO: 1088437 - RNA, 18 nt, Homo sapiens
agaaaggauuuccuuucu

SEQ ID NO: 1088438 - RNA, 15 nt, Homo sapiens
agaaagugauccaua

SEQ ID NO: 1088439 - RNA, 23 nt, Homo sapiens
agaacaaugcuauaauauauaau

SEQ ID NO: 1088440 - RNA, 12 nt, Homo sapiens
agaacacccacu

SEQ ID NO: 1088441 - RNA, 11 nt, Homo sapiens
agaaccucagg

SEQ ID NO: 1088442 - RNA, 17 nt, Homo sapiens
caaaaacuagacauuau

SEQ ID NO: 1088443 - RNA, 20 nt, Homo sapiens
caaaaagauuuauuaauuaa

SEQ ID NO: 1088444 - RNA, 22 nt, Homo sapiens
caaaaauaucuuuuuuccccca

SEQ ID NO: 1088445 - RNA, 12 nt, Homo sapiens
caaaaauguaau

SEQ ID NO: 1088446 - RNA, 13 nt, Homo sapiens
caaaaauguaaug

SEQ ID NO: 1088447 - RNA, 17 nt, Homo sapiens
caaaacugaaaaucaau

SEQ ID NO: 1088448 - RNA, 16 nt, Homo sapiens
caaacagccccaaagu

SEQ ID NO: 1088449 - RNA, 17 nt, Homo sapiens
caaacaugaaaacauug

SEQ ID NO: 1088450 - RNA, 14 nt, Homo sapiens
caaacuacauguaa

SEQ ID NO: 1088451 - RNA, 16 nt, Homo sapiens
caaacuacauguaauc

SEQ ID NO: 1088452 - RNA, 21 nt, Homo sapiens
caaacuggggccucccugguc

SEQ ID NO: 1088453 - RNA, 20 nt, Homo sapiens
caaagaacugccccaucucc

SEQ ID NO: 1088454 - RNA, 19 nt, Homo sapiens
caaagaucucagcagccag

SEQ ID NO: 1088455 - RNA, 16 nt, Homo sapiens
caaagauuaaaugugu

SEQ ID NO: 1088456 - RNA, 18 nt, Homo sapiens
caaagccaaacucugcca

SEQ ID NO: 1088457 - RNA, 18 nt, Homo sapiens
caaaggcuuucuuuccaa

SEQ ID NO: 1088458 - RNA, 23 nt, Homo sapiens
caaagggaacugaagaccuccac

SEQ ID NO: 1088459 - RNA, 23 nt, Homo sapiens
caaagucaauuaaaggcuuucag

SEQ ID NO: 1088460 - RNA, 19 nt, Homo sapiens
caaagugcuaggauuacag

SEQ ID NO: 1088461 - RNA, 15 nt, Homo sapiens
caaauaaguuacccu

SEQ ID NO: 1088462 - RNA, 18 nt, Homo sapiens
caaauaaguuacccucaa

SEQ ID NO: 1088463 - RNA, 13 nt, Homo sapiens
caaauacacuuua

SEQ ID NO: 1088464 - RNA, 14 nt, Homo sapiens
caacaaggugcaca

SEQ ID NO: 1088465 - RNA, 17 nt, Homo sapiens
caacaauacaugcugcu

SEQ ID NO: 1088466 - RNA, 15 nt, Homo sapiens
caacagaaaccagaa

SEQ ID NO: 1088467 - RNA, 12 nt, Homo sapiens
caacgugaugcu

SEQ ID NO: 1088468 - RNA, 15 nt, Homo sapiens
caacucuccacucca

SEQ ID NO: 1088469 - RNA, 23 nt, Homo sapiens
caacugcccaggaaggacugugc

SEQ ID NO: 1088470 - RNA, 14 nt, Homo sapiens
caagaacaaauaca

SEQ ID NO: 1088471 - RNA, 21 nt, Homo sapiens
caagaagaagagugacuccug

SEQ ID NO: 1088472 - RNA, 16 nt, Homo sapiens
caagaaguaacaaaag

SEQ ID NO: 1088473 - RNA, 17 nt, Homo sapiens
caagaauuagggcccca

SEQ ID NO: 1088474 - RNA, 14 nt, Homo sapiens
caagaccccaaagg

SEQ ID NO: 1088475 - RNA, 14 nt, Homo sapiens
caagcgugauuccu

SEQ ID NO: 1088476 - RNA, 11 nt, Homo sapiens
caagcucugcc

SEQ ID NO: 1088477 - RNA, 15 nt, Homo sapiens
caaggacucagauga

SEQ ID NO: 1088478 - RNA, 14 nt, Homo sapiens
caaggccagggcac

SEQ ID NO: 1088479 - RNA, 17 nt, Homo sapiens
caaggccucccacagug

SEQ ID NO: 1088480 - RNA, 16 nt, Homo sapiens
caaggucucacacucc

SEQ ID NO: 1088481 - RNA, 22 nt, Homo sapiens
caaggucucacacuccuccugc

SEQ ID NO: 1088482 - RNA, 17 nt, Homo sapiens
caagucaacacucuucu

SEQ ID NO: 1088483 - RNA, 18 nt, Homo sapiens
caaguggaaacaugcuga

SEQ ID NO: 1088484 - RNA, 17 nt, Homo sapiens
caagugucucuugacug

SEQ ID NO: 1088485 - RNA, 15 nt, Homo sapiens
caaguugagaacaaa

SEQ ID NO: 1088486 - RNA, 18 nt, Homo sapiens
caauaaauccuuuacuuu

SEQ ID NO: 1088487 - RNA, 15 nt, Homo sapiens
caauacaugcugcua

SEQ ID NO: 1088488 - RNA, 18 nt, Homo sapiens
caauacaugcugcuaauu

SEQ ID NO: 1088489 - RNA, 18 nt, Homo sapiens
caauaugggcucaaguca

SEQ ID NO: 1088490 - RNA, 16 nt, Homo sapiens
caauauuucugauaua

SEQ ID NO: 1088491 - RNA, 15 nt, Homo sapiens
caaugcccuaccugc

SEQ ID NO: 1088492 - RNA, 19 nt, Homo sapiens
caauguuuuaaacauucuu

SEQ ID NO: 1088493 - RNA, 17 nt, Homo sapiens
caauucuccugccucag

SEQ ID NO: 1088494 - RNA, 14 nt, Homo sapiens
caauugcugccaau

SEQ ID NO: 1088495 - RNA, 17 nt, Homo sapiens
cacaaaugcaccuccca

SEQ ID NO: 1088496 - RNA, 21 nt, Homo sapiens
cacaaauggaacuccccaggg

SEQ ID NO: 1088497 - RNA, 11 nt, Homo sapiens
cacacacuccu

SEQ ID NO: 1088498 - RNA, 15 nt, Homo sapiens
cacacagugccugua

SEQ ID NO: 1088499 - RNA, 13 nt, Homo sapiens
cacaccauucucc

SEQ ID NO: 1088500 - RNA, 20 nt, Homo sapiens
cacacuucuugaaacagccu

SEQ ID NO: 1088501 - RNA, 19 nt, Homo sapiens
cacagggaagcauguacug

SEQ ID NO: 1088502 - RNA, 12 nt, Homo sapiens
cacauaaaggua

SEQ ID NO: 1088503 - RNA, 13 nt, Homo sapiens
cacaucagcuuua

SEQ ID NO: 1088504 - RNA, 23 nt, Homo sapiens
cacauuuugcauuagacagauga

SEQ ID NO: 1088505 - RNA, 20 nt, Homo sapiens
caccacauucugucucugcu

SEQ ID NO: 1088506 - RNA, 17 nt, Homo sapiens
caccagcggccuugaag

SEQ ID NO: 1088507 - RNA, 11 nt, Homo sapiens
caccaugcaag

SEQ ID NO: 1088508 - RNA, 23 nt, Homo sapiens
caccauucuuucuuggugcauuc

SEQ ID NO: 1088509 - RNA, 21 nt, Homo sapiens
caccauuuuguuuagacaauu

SEQ ID NO: 1088510 - RNA, 15 nt, Homo sapiens
cacccauaccagcua

SEQ ID NO: 1088511 - RNA, 16 nt, Homo sapiens
caccccagcugaccug

SEQ ID NO: 1088512 - RNA, 21 nt, Homo sapiens
caccccauauuguucuucaaa

SEQ ID NO: 1088513 - RNA, 21 nt, Homo sapiens
cacccuccuggccucauacag

SEQ ID NO: 1088514 - RNA, 23 nt, Homo sapiens
cacccuggaaucaagaugucaga

SEQ ID NO: 1088515 - RNA, 16 nt, Homo sapiens
caccgagaggaaaaag

SEQ ID NO: 1088516 - RNA, 22 nt, Homo sapiens
caccgagaggaaaaaggcuucu

SEQ ID NO: 1088517 - RNA, 17 nt, Homo sapiens
caccgccauggcuucca

SEQ ID NO: 1088518 - RNA, 20 nt, Homo sapiens
caccuauggcccagccacug

SEQ ID NO: 1088519 - RNA, 16 nt, Homo sapiens
caccucaugucauuuc

SEQ ID NO: 1088520 - RNA, 22 nt, Homo sapiens
caccugcuggaaaccacacuuc

SEQ ID NO: 1088521 - RNA, 15 nt, Homo sapiens
caccuggauucccug

SEQ ID NO: 1088522 - RNA, 18 nt, Homo sapiens
caccuuguuacacauuau

SEQ ID NO: 1088523 - RNA, 14 nt, Homo sapiens
cacgccaacagccc

SEQ ID NO: 1088524 - RNA, 20 nt, Homo sapiens
cacgggguauuuuaggcagg

SEQ ID NO: 1088525 - RNA, 14 nt, Homo sapiens
cacgucugugcucu

SEQ ID NO: 1088526 - RNA, 16 nt, Homo sapiens
cacuaagcuuucuccu

SEQ ID NO: 1088527 - RNA, 19 nt, Homo sapiens
cacuacacuccagccugag

SEQ ID NO: 1088528 - RNA, 13 nt, Homo sapiens
cacuagacugugc

SEQ ID NO: 1088529 - RNA, 14 nt, Homo sapiens
cacuagacugugcc

SEQ ID NO: 1088530 - RNA, 23 nt, Homo sapiens
cacucaaggaaaagaugugcucc

SEQ ID NO: 1088531 - RNA, 13 nt, Homo sapiens
cacucacugccaa

SEQ ID NO: 1088532 - RNA, 14 nt, Homo sapiens
cacucugugcccau

SEQ ID NO: 1088533 - RNA, 20 nt, Homo sapiens
cacugacagauguguuugca

SEQ ID NO: 1088534 - RNA, 16 nt, Homo sapiens
cacugcaagcucugcc

SEQ ID NO: 1088535 - RNA, 16 nt, Homo sapiens
cacugccgaugcccaa

SEQ ID NO: 1088536 - RNA, 12 nt, Homo sapiens
cacugcucugcc

SEQ ID NO: 1088537 - RNA, 15 nt, Homo sapiens
cacuggcugccucca

SEQ ID NO: 1088538 - RNA, 14 nt, Homo sapiens
cacuguuaagccau

SEQ ID NO: 1088539 - RNA, 23 nt, Homo sapiens
cacuguuaagccauguguuccaa

SEQ ID NO: 1088540 - RNA, 22 nt, Homo sapiens
cacuguuucaugagcccaaaca

SEQ ID NO: 1088541 - RNA, 17 nt, Homo sapiens
cacuuaaaaaaaugccu

SEQ ID NO: 1088542 - RNA, 15 nt, Homo sapiens
cacuuauccugacac

SEQ ID NO: 1088543 - RNA, 15 nt, Homo sapiens
cacuuauuuccaugg

SEQ ID NO: 1088544 - RNA, 16 nt, Homo sapiens
cacuuauuuccaugga

SEQ ID NO: 1088545 - RNA, 16 nt, Homo sapiens
cacuuugccacuggau

SEQ ID NO: 1088546 - RNA, 23 nt, Homo sapiens
cacuuuuuuuuuuucugccugag

SEQ ID NO: 1088547 - RNA, 24 nt, Homo sapiens
cacuuuuuuuuuuucugccugaga

SEQ ID NO: 1088548 - RNA, 22 nt, Homo sapiens
cagaaaagcaauacuguuucca

SEQ ID NO: 1088549 - RNA, 15 nt, Homo sapiens
cagaacacacugaga

SEQ ID NO: 1088550 - RNA, 13 nt, Homo sapiens
cagaaugcacauu

SEQ ID NO: 1088551 - RNA, 16 nt, Homo sapiens
cagaccaguacuggga

SEQ ID NO: 1088552 - RNA, 17 nt, Homo sapiens
cagaccaguacugggaa

SEQ ID NO: 1088553 - RNA, 21 nt, Homo sapiens
cagacuauuuaacuugagggu

SEQ ID NO: 1088554 - RNA, 15 nt, Homo sapiens
cagagaaauucugug

SEQ ID NO: 1088555 - RNA, 20 nt, Homo sapiens
cagagaugugcaugugggua

SEQ ID NO: 1088556 - RNA, 16 nt, Homo sapiens
cagagccacuaccuuu

SEQ ID NO: 1088557 - RNA, 20 nt, Homo sapiens
cagagcgaggaaaggauuuu

SEQ ID NO: 1088558 - RNA, 20 nt, Homo sapiens
cagagcugccuccccaaucc

SEQ ID NO: 1088559 - RNA, 14 nt, Homo sapiens
cagagcuuccucag

SEQ ID NO: 1088560 - RNA, 22 nt, Homo sapiens
cagaggcagcgaguuguggaaa

SEQ ID NO: 1088561 - RNA, 20 nt, Homo sapiens
cagaggcuagucucuucuca

SEQ ID NO: 1088562 - RNA, 14 nt, Homo sapiens
cagaggggaaacca

SEQ ID NO: 1088563 - RNA, 20 nt, Homo sapiens
cagaguaaauagcauucucu

SEQ ID NO: 1088564 - RNA, 13 nt, Homo sapiens
cagaguuugacac

SEQ ID NO: 1088565 - RNA, 18 nt, Homo sapiens
cagauagugccucugcaa

SEQ ID NO: 1088566 - RNA, 19 nt, Homo sapiens
cucugugcagacaguguca

SEQ ID NO: 1088567 - RNA, 16 nt, Homo sapiens
cucuuagaagugacau

SEQ ID NO: 1088568 - RNA, 16 nt, Homo sapiens
cucuugacuggcucaa

SEQ ID NO: 1088569 - RNA, 23 nt, Homo sapiens
cugaaaaccauccaucuguggaa

SEQ ID NO: 1088570 - RNA, 18 nt, Homo sapiens
cugaaccgugugcuccuc

SEQ ID NO: 1088571 - RNA, 17 nt, Homo sapiens
cugaaggagauuuuccu

SEQ ID NO: 1088572 - RNA, 12 nt, Homo sapiens
cugaagugucga

SEQ ID NO: 1088573 - RNA, 14 nt, Homo sapiens
cugaaugucccaga

SEQ ID NO: 1088574 - RNA, 17 nt, Homo sapiens
cugacagaaaugcaauc

SEQ ID NO: 1088575 - RNA, 22 nt, Homo sapiens
cugaccgccgcuuccagcuucc

SEQ ID NO: 1088576 - RNA, 20 nt, Homo sapiens
cugaccuucuccagggacag

SEQ ID NO: 1088577 - RNA, 15 nt, Homo sapiens
cugaccuugugaucu

SEQ ID NO: 1088578 - RNA, 14 nt, Homo sapiens
cugacuucaggggc

SEQ ID NO: 1088579 - RNA, 15 nt, Homo sapiens
cugacuuugugaucc

SEQ ID NO: 1088580 - RNA, 22 nt, Homo sapiens
cugagacuucaggugcauucca

SEQ ID NO: 1088581 - RNA, 20 nt, Homo sapiens
cugagacuugaaucaaguca

SEQ ID NO: 1088582 - RNA, 16 nt, Homo sapiens
cugagagaaacugagg

SEQ ID NO: 1088583 - RNA, 13 nt, Homo sapiens
cugagcccuggca

SEQ ID NO: 1088584 - RNA, 11 nt, Homo sapiens
cugagccucac

SEQ ID NO: 1088585 - RNA, 22 nt, Homo sapiens
cugagcucucugaaaguuguca

SEQ ID NO: 1088586 - RNA, 16 nt, Homo sapiens
cugauaauguauugca

SEQ ID NO: 1088587 - RNA, 12 nt, Homo sapiens
cugauacuguau

SEQ ID NO: 1088588 - RNA, 22 nt, Homo sapiens
cugauauaacaaacuacaugua

SEQ ID NO: 1088589 - RNA, 14 nt, Homo sapiens
cugaugauuucacu

SEQ ID NO: 1088590 - RNA, 21 nt, Homo sapiens
cugauguccuaccacuuugaa

SEQ ID NO: 1088591 - RNA, 15 nt, Homo sapiens
cugcaagauuucaca

SEQ ID NO: 1088592 - RNA, 17 nt, Homo sapiens
cugcaccgagagagaug

SEQ ID NO: 1088593 - RNA, 24 nt, Homo sapiens
cugcaccgagagagauggaauaaa

SEQ ID NO: 1088594 - RNA, 16 nt, Homo sapiens
cugcagauagugccuc

SEQ ID NO: 1088595 - RNA, 21 nt, Homo sapiens
cugcagcacuucacuaccaaa

SEQ ID NO: 1088596 - RNA, 19 nt, Homo sapiens
cugcagcggcacaaaugca

SEQ ID NO: 1088597 - RNA, 16 nt, Homo sapiens
cugcagcuuccuguca

SEQ ID NO: 1088598 - RNA, 20 nt, Homo sapiens
cugcagcuuggagaacuccg

SEQ ID NO: 1088599 - RNA, 21 nt, Homo sapiens
cugcagugacgugcaccugua

SEQ ID NO: 1088600 - RNA, 16 nt, Homo sapiens
cugccaaaacaaugcc

SEQ ID NO: 1088601 - RNA, 16 nt, Homo sapiens
cugccagccuggcuuc

SEQ ID NO: 1088602 - RNA, 20 nt, Homo sapiens
cugcccaggaaggacugugc

SEQ ID NO: 1088603 - RNA, 20 nt, Homo sapiens
cugcccaggcuagagugcag

SEQ ID NO: 1088604 - RNA, 19 nt, Homo sapiens
cugcccgaccccaucucau

SEQ ID NO: 1088605 - RNA, 16 nt, Homo sapiens
cugccucccuuucaua

SEQ ID NO: 1088606 - RNA, 22 nt, Homo sapiens
cugcguaggagagaacagggau

SEQ ID NO: 1088607 - RNA, 24 nt, Homo sapiens
cugcuauaugccuuaagccaauau

SEQ ID NO: 1088608 - RNA, 17 nt, Homo sapiens
cugcucagugaucucac

SEQ ID NO: 1088609 - RNA, 12 nt, Homo sapiens
cugcucugcuau

SEQ ID NO: 1088610 - RNA, 23 nt, Homo sapiens
cuggaaaagggcucagagcugcu

SEQ ID NO: 1088611 - RNA, 21 nt, Homo sapiens
cuggagaaagggaaguggaag

SEQ ID NO: 1088612 - RNA, 22 nt, Homo sapiens
cuggagaugacagugaugcugc

SEQ ID NO: 1088613 - RNA, 13 nt, Homo sapiens
cuggagcugccag

SEQ ID NO: 1088614 - RNA, 15 nt, Homo sapiens
cuggagugcaauggc

SEQ ID NO: 1088615 - RNA, 13 nt, Homo sapiens
cuggcacaguguc

SEQ ID NO: 1088616 - RNA, 16 nt, Homo sapiens
cuggccaccagcuucc

SEQ ID NO: 1088617 - RNA, 22 nt, Homo sapiens
cuggccuauuuuggacguguga

SEQ ID NO: 1088618 - RNA, 20 nt, Homo sapiens
cuggcugcuggcccacagcu

SEQ ID NO: 1088619 - RNA, 16 nt, Homo sapiens
cuggcuggcugugucc

SEQ ID NO: 1088620 - RNA, 15 nt, Homo sapiens
cugggacucauucac

SEQ ID NO: 1088621 - RNA, 15 nt, Homo sapiens
cugggagaaccucag

SEQ ID NO: 1088622 - RNA, 16 nt, Homo sapiens
cugggccagaugcugg

SEQ ID NO: 1088623 - RNA, 14 nt, Homo sapiens
cugggccucccaaa

SEQ ID NO: 1088624 - RNA, 19 nt, Homo sapiens
cugggcuuguuguuuuuaa

SEQ ID NO: 1088625 - RNA, 14 nt, Homo sapiens
cuggggcucugugc

SEQ ID NO: 1088626 - RNA, 19 nt, Homo sapiens
cuguaaaacuaaacauaca

SEQ ID NO: 1088627 - RNA, 12 nt, Homo sapiens
cuguaagcauuc

SEQ ID NO: 1088628 - RNA, 17 nt, Homo sapiens
cuguacuaaaauaugca

SEQ ID NO: 1088629 - RNA, 15 nt, Homo sapiens
cuguauacaaacagg

SEQ ID NO: 1088630 - RNA, 18 nt, Homo sapiens
cuguccagccagcuccug

SEQ ID NO: 1088631 - RNA, 20 nt, Homo sapiens
cuguccagccagcuccugca

SEQ ID NO: 1088632 - RNA, 15 nt, Homo sapiens
cugucccuacccacu

SEQ ID NO: 1088633 - RNA, 12 nt, Homo sapiens
cuguccuaggcc

SEQ ID NO: 1088634 - RNA, 16 nt, Homo sapiens
cuguccucgcagagaa

SEQ ID NO: 1088635 - RNA, 23 nt, Homo sapiens
cuguccuugucgcugugcccugg

SEQ ID NO: 1088636 - RNA, 14 nt, Homo sapiens
cuguggccugggca

SEQ ID NO: 1088637 - RNA, 15 nt, Homo sapiens
cuguguccucuccag

SEQ ID NO: 1088638 - RNA, 12 nt, Homo sapiens
cuguugcuguug

SEQ ID NO: 1088639 - RNA, 15 nt, Homo sapiens
cuguugcuguugcug

SEQ ID NO: 1088640 - RNA, 21 nt, Homo sapiens
cuguuggcaucuugcugcuaa

SEQ ID NO: 1088641 - RNA, 17 nt, Homo sapiens
cuguuucaugagcccaa

SEQ ID NO: 1088642 - RNA, 14 nt, Homo sapiens
cuuaaaauguuaac

SEQ ID NO: 1088643 - RNA, 16 nt, Homo sapiens
cuuaacucagccagaa

SEQ ID NO: 1088644 - RNA, 21 nt, Homo sapiens
cuuacugcaaccuuugccucc

SEQ ID NO: 1088645 - RNA, 14 nt, Homo sapiens
cuuagauugccacu

SEQ ID NO: 1088646 - RNA, 19 nt, Homo sapiens
cuuaggauuuaccaaauag

SEQ ID NO: 1088647 - RNA, 21 nt, Homo sapiens
cuuauagguuuccacugccaa

SEQ ID NO: 1088648 - RNA, 12 nt, Homo sapiens
cuuauccugaca

SEQ ID NO: 1088649 - RNA, 23 nt, Homo sapiens
cuuaucuuaggauuuaccaaaua

SEQ ID NO: 1088650 - RNA, 16 nt, Homo sapiens
cuuauuguauuccuca

SEQ ID NO: 1088651 - RNA, 14 nt, Homo sapiens
cuuauuuccaugga

SEQ ID NO: 1088652 - RNA, 15 nt, Homo sapiens
cuucacgccugggug

SEQ ID NO: 1088653 - RNA, 18 nt, Homo sapiens
cuucauuucucuugcuca

SEQ ID NO: 1088654 - RNA, 13 nt, Homo sapiens
cuuccacuuugag

SEQ ID NO: 1088655 - RNA, 23 nt, Homo sapiens
cuuccagguggggugaggcagug

SEQ ID NO: 1088656 - RNA, 17 nt, Homo sapiens
cuucccaauugccacau

SEQ ID NO: 1088657 - RNA, 19 nt, Homo sapiens
cuucccacuuugccacugg

SEQ ID NO: 1088658 - RNA, 23 nt, Homo sapiens
cuuccucugagccgcagggccug

SEQ ID NO: 1088659 - RNA, 15 nt, Homo sapiens
cuuccugccuagucu

SEQ ID NO: 1088660 - RNA, 17 nt, Homo sapiens
cuuccugucaacacuuc

SEQ ID NO: 1088661 - RNA, 16 nt, Homo sapiens
cuucuaauccaugugc

SEQ ID NO: 1088662 - RNA, 22 nt, Homo sapiens
cuucuccagggacagaagcagg

SEQ ID NO: 1088663 - RNA, 18 nt, Homo sapiens
cuucuccccuccaaguga

SEQ ID NO: 1088664 - RNA, 13 nt, Homo sapiens
cuucuccuuagaa

SEQ ID NO: 1088665 - RNA, 15 nt, Homo sapiens
cuucugccucagcuu

SEQ ID NO: 1088666 - RNA, 16 nt, Homo sapiens
cuucuugaaacagccu

SEQ ID NO: 1088667 - RNA, 16 nt, Homo sapiens
cuugacuggcucaaga

SEQ ID NO: 1088668 - RNA, 15 nt, Homo sapiens
cuugacuuugccaca

SEQ ID NO: 1088669 - RNA, 21 nt, Homo sapiens
cuugagcagaccgugauuugg

SEQ ID NO: 1088670 - RNA, 16 nt, Homo sapiens
cuugaguuuuccugcu

SEQ ID NO: 1088671 - RNA, 22 nt, Homo sapiens
cuugccuguaaucccagcacuu

SEQ ID NO: 1088672 - RNA, 23 nt, Homo sapiens
cuugcucaccaagaaguaacaaa

SEQ ID NO: 1088673 - RNA, 13 nt, Homo sapiens
cuuggacuugagg

SEQ ID NO: 1088674 - RNA, 21 nt, Homo sapiens
cuugugauuuuugaacaauac

SEQ ID NO: 1088675 - RNA, 22 nt, Homo sapiens
cuuuaaaauaaaauaauuuuau

SEQ ID NO: 1088676 - RNA, 14 nt, Homo sapiens
cuuuauagcuuugg

SEQ ID NO: 1088677 - RNA, 18 nt, Homo sapiens
cuuucaugaguuucccag

SEQ ID NO: 1088678 - RNA, 20 nt, Homo sapiens
cuuucauggaccaggucuug

SEQ ID NO: 1088679 - RNA, 23 nt, Homo sapiens
cuuuccuaaagucucugcugcua

SEQ ID NO: 1088680 - RNA, 12 nt, Homo sapiens
cuuucucagugu

SEQ ID NO: 1088681 - RNA, 23 nt, Homo sapiens
cuuucucgugguagaagccagua

SEQ ID NO: 1088682 - RNA, 21 nt, Homo sapiens
cuuucugaagaagagcaagaa

SEQ ID NO: 1088683 - RNA, 14 nt, Homo sapiens
cuuugaaguggcac

SEQ ID NO: 1088684 - RNA, 13 nt, Homo sapiens
cuuugaguaccaa

SEQ ID NO: 1088685 - RNA, 16 nt, Homo sapiens
cuuugcaggcccagca

SEQ ID NO: 1088686 - RNA, 13 nt, Homo sapiens
cuuuggcaacaga

SEQ ID NO: 1088687 - RNA, 15 nt, Homo sapiens
cuuugggaucagccu

SEQ ID NO: 1088688 - RNA, 23 nt, Homo sapiens
cuuuggugaacauugcaauagaa

SEQ ID NO: 1088689 - RNA, 22 nt, Homo sapiens
cuuuuacuuuuugccccuucca

SEQ ID NO: 1088690 - RNA, 17 nt, Homo sapiens
ggguguguguagccaag

SEQ ID NO: 1088691 - RNA, 14 nt, Homo sapiens
gguaaucauuccag

SEQ ID NO: 1088692 - RNA, 23 nt, Homo sapiens
gguaaucauuccagguguguuca

SEQ ID NO: 1088693 - RNA, 13 nt, Homo sapiens
gguacagcagggu

SEQ ID NO: 1088694 - RNA, 17 nt, Homo sapiens
gguauaauuuuuaucca

SEQ ID NO: 1088695 - RNA, 19 nt, Homo sapiens
ggucacuuauccugacaca

SEQ ID NO: 1088696 - RNA, 16 nt, Homo sapiens
ggucucgaacuccuga

SEQ ID NO: 1088697 - RNA, 16 nt, Homo sapiens
ggucuugaucuccuga

SEQ ID NO: 1088698 - RNA, 24 nt, Homo sapiens
ggugagaacgugcccagccacauc

SEQ ID NO: 1088699 - RNA, 21 nt, Homo sapiens
ggugauuccauuuuacuucca

SEQ ID NO: 1088700 - RNA, 21 nt, Homo sapiens
ggugcaguuuuccaggaauag

SEQ ID NO: 1088701 - RNA, 18 nt, Homo sapiens
gguguccuguuccugcca

SEQ ID NO: 1088702 - RNA, 21 nt, Homo sapiens
gguuccucaggugaccaaaac

SEQ ID NO: 1088703 - RNA, 21 nt, Homo sapiens
gguugauacggagccauguca

SEQ ID NO: 1088704 - RNA, 18 nt, Homo sapiens
guaaaaucaaaugugcau

SEQ ID NO: 1088705 - RNA, 17 nt, Homo sapiens
guaaaggaaacauauuu

SEQ ID NO: 1088706 - RNA, 17 nt, Homo sapiens
guaaauagcauucucua

SEQ ID NO: 1088707 - RNA, 21 nt, Homo sapiens
guaacucagacauuccaaggg

SEQ ID NO: 1088708 - RNA, 22 nt, Homo sapiens
guaauggaaugcaaaaaagcca

SEQ ID NO: 1088709 - RNA, 17 nt, Homo sapiens
guaauuccucccuaaga

SEQ ID NO: 1088710 - RNA, 22 nt, Homo sapiens
guacaagguauguacaguucau

SEQ ID NO: 1088711 - RNA, 20 nt, Homo sapiens
guacugagguugggcugaga

SEQ ID NO: 1088712 - RNA, 17 nt, Homo sapiens
guagaacaauguacaag

SEQ ID NO: 1088713 - RNA, 17 nt, Homo sapiens
guagccccgggcugacc

SEQ ID NO: 1088714 - RNA, 13 nt, Homo sapiens
guagguaagggcc

SEQ ID NO: 1088715 - RNA, 13 nt, Homo sapiens
guaguuuguuuua

SEQ ID NO: 1088716 - RNA, 19 nt, Homo sapiens
guauaaugguguuacuaaa

SEQ ID NO: 1088717 - RNA, 15 nt, Homo sapiens
guauauagaagucua

SEQ ID NO: 1088718 - RNA, 21 nt, Homo sapiens
guauauauucuacacauauau

SEQ ID NO: 1088719 - RNA, 20 nt, Homo sapiens
guaucuaccucacuauucaa

SEQ ID NO: 1088720 - RNA, 15 nt, Homo sapiens
guaugggaagccaua

SEQ ID NO: 1088721 - RNA, 15 nt, Homo sapiens
guauguuauugcaua

SEQ ID NO: 1088722 - RNA, 17 nt, Homo sapiens
guauuacuaauuuccau

SEQ ID NO: 1088723 - RNA, 17 nt, Homo sapiens
guauuccucaugucauc

SEQ ID NO: 1088724 - RNA, 19 nt, Homo sapiens
guauuccucaugucaucaa

SEQ ID NO: 1088725 - RNA, 18 nt, Homo sapiens
guauugcuaaucauuaag

SEQ ID NO: 1088726 - RNA, 23 nt, Homo sapiens
guauuguuaggagaugucaucaa

SEQ ID NO: 1088727 - RNA, 16 nt, Homo sapiens
gucaacuuucauuuga

SEQ ID NO: 1088728 - RNA, 15 nt, Homo sapiens
gucacacaguauuaa

SEQ ID NO: 1088729 - RNA, 20 nt, Homo sapiens
gucacccuccugagccucac

SEQ ID NO: 1088730 - RNA, 17 nt, Homo sapiens
gucagaacucuguguug

SEQ ID NO: 1088731 - RNA, 13 nt, Homo sapiens
gucagaguucugc

SEQ ID NO: 1088732 - RNA, 17 nt, Homo sapiens
gucagaguucugcucua

SEQ ID NO: 1088733 - RNA, 20 nt, Homo sapiens
gucagccuugcaucaagggc

SEQ ID NO: 1088734 - RNA, 20 nt, Homo sapiens
gucauuaagcgggaucccag

SEQ ID NO: 1088735 - RNA, 23 nt, Homo sapiens
gucauuauuuuuguuagcaaaga

SEQ ID NO: 1088736 - RNA, 19 nt, Homo sapiens
gucauugauggagccugaa

SEQ ID NO: 1088737 - RNA, 16 nt, Homo sapiens
guccaaguccaaccug

SEQ ID NO: 1088738 - RNA, 15 nt, Homo sapiens
guccaccaccaccug

SEQ ID NO: 1088739 - RNA, 12 nt, Homo sapiens
guccagccagcu

SEQ ID NO: 1088740 - RNA, 21 nt, Homo sapiens
guccaguccuuuguugcuguu

SEQ ID NO: 1088741 - RNA, 13 nt, Homo sapiens
guccaguuuccaa

SEQ ID NO: 1088742 - RNA, 21 nt, Homo sapiens
guccauccuccucuccaugca

SEQ ID NO: 1088743 - RNA, 13 nt, Homo sapiens
guccccuggagaa

SEQ ID NO: 1088744 - RNA, 16 nt, Homo sapiens
gucccuccuguuguga

SEQ ID NO: 1088745 - RNA, 14 nt, Homo sapiens
guccucuccagcuu

SEQ ID NO: 1088746 - RNA, 17 nt, Homo sapiens
guccugcuccacagugu

SEQ ID NO: 1088747 - RNA, 22 nt, Homo sapiens
guccuucaaguuagcucaggag

SEQ ID NO: 1088748 - RNA, 16 nt, Homo sapiens
guccuuuuguaccaug

SEQ ID NO: 1088749 - RNA, 15 nt, Homo sapiens
gucggugugcuguca

SEQ ID NO: 1088750 - RNA, 17 nt, Homo sapiens
gucgucaaguugcagau

SEQ ID NO: 1088751 - RNA, 17 nt, Homo sapiens
gucucuccugaugcuca

SEQ ID NO: 1088752 - RNA, 23 nt, Homo sapiens
gucugaaucauccgaggcaaaga

SEQ ID NO: 1088753 - RNA, 23 nt, Homo sapiens
gucuguauauaacuuauuugccc

SEQ ID NO: 1088754 - RNA, 22 nt, Homo sapiens
gucugugaaagucuccuguauc

SEQ ID NO: 1088755 - RNA, 21 nt, Homo sapiens
gucuugaccugaacucugcaa

SEQ ID NO: 1088756 - RNA, 13 nt, Homo sapiens
gucuuucuuugcu

SEQ ID NO: 1088757 - RNA, 20 nt, Homo sapiens
gucuuuggcuucagaauugu

SEQ ID NO: 1088758 - RNA, 19 nt, Homo sapiens
gucuuuggugaacauugca

SEQ ID NO: 1088759 - RNA, 15 nt, Homo sapiens
gugaaccugccuugg

SEQ ID NO: 1088760 - RNA, 14 nt, Homo sapiens
gugaauaggcugcu

SEQ ID NO: 1088761 - RNA, 23 nt, Homo sapiens
gugacagugacgugacucagagc

SEQ ID NO: 1088762 - RNA, 23 nt, Homo sapiens
gugacaugaacccauccaaugga

SEQ ID NO: 1088763 - RNA, 12 nt, Homo sapiens
gugacucagagc

SEQ ID NO: 1088764 - RNA, 22 nt, Homo sapiens
gugaguauaaaauaaagcaaau

SEQ ID NO: 1088765 - RNA, 19 nt, Homo sapiens
gugaguccgggaaucucuu

SEQ ID NO: 1088766 - RNA, 15 nt, Homo sapiens
gugauauaugccuau

SEQ ID NO: 1088767 - RNA, 17 nt, Homo sapiens
gugaugaaaauuugccu

SEQ ID NO: 1088768 - RNA, 14 nt, Homo sapiens
gugaugcccaaaga

SEQ ID NO: 1088769 - RNA, 15 nt, Homo sapiens
gugauuccauuuuac

SEQ ID NO: 1088770 - RNA, 20 nt, Homo sapiens
gugauuguuaugccuugcua

SEQ ID NO: 1088771 - RNA, 19 nt, Homo sapiens
gugauuucuuucuuugcac

SEQ ID NO: 1088772 - RNA, 17 nt, Homo sapiens
gugauuuggaagagagg

SEQ ID NO: 1088773 - RNA, 18 nt, Homo sapiens
gugcagacagugucagag

SEQ ID NO: 1088774 - RNA, 19 nt, Homo sapiens
gugccauucccacuaagcu

SEQ ID NO: 1088775 - RNA, 13 nt, Homo sapiens
gugccucagugcu

SEQ ID NO: 1088776 - RNA, 15 nt, Homo sapiens
gugcuaggauuacag

SEQ ID NO: 1088777 - RNA, 17 nt, Homo sapiens
gugcuguggccugggca

SEQ ID NO: 1088778 - RNA, 21 nt, Homo sapiens
gugcuuuauaccccauuugau

SEQ ID NO: 1088779 - RNA, 18 nt, Homo sapiens
guggacucucugccugcu

SEQ ID NO: 1088780 - RNA, 18 nt, Homo sapiens
guggaguucucuguucua

SEQ ID NO: 1088781 - RNA, 17 nt, Homo sapiens
guggauacagucauuau

SEQ ID NO: 1088782 - RNA, 23 nt, Homo sapiens
guggguaacgugagaagauagaa

SEQ ID NO: 1088783 - RNA, 22 nt, Homo sapiens
guggugucgcgccuucuccccc

SEQ ID NO: 1088784 - RNA, 14 nt, Homo sapiens
gugucacccugcag

SEQ ID NO: 1088785 - RNA, 11 nt, Homo sapiens
gugucugcaac

SEQ ID NO: 1088786 - RNA, 20 nt, Homo sapiens
gugugccccccauccuggcc

SEQ ID NO: 1088787 - RNA, 14 nt, Homo sapiens
gugugugcucagca

SEQ ID NO: 1088788 - RNA, 14 nt, Homo sapiens
guguuccccagcug

SEQ ID NO: 1088789 - RNA, 14 nt, Homo sapiens
guguugaucccaag

SEQ ID NO: 1088790 - RNA, 21 nt, Homo sapiens
guguuuauaauaaaugaggaa

SEQ ID NO: 1088791 - RNA, 13 nt, Homo sapiens
guguuucuuacag

SEQ ID NO: 1088792 - RNA, 17 nt, Homo sapiens
guuaauaucugauacug

SEQ ID NO: 1088793 - RNA, 19 nt, Homo sapiens
guuacuaaagucacauaua

SEQ ID NO: 1088794 - RNA, 19 nt, Homo sapiens
guuaggccuggcacagugu

SEQ ID NO: 1088795 - RNA, 23 nt, Homo sapiens
guuaguaauaaacgucuugccac

SEQ ID NO: 1088796 - RNA, 19 nt, Homo sapiens
guuauuuaugccucuguau

SEQ ID NO: 1088797 - RNA, 20 nt, Homo sapiens
guucaccuguguacugagua

SEQ ID NO: 1088798 - RNA, 17 nt, Homo sapiens
guucaguggugugaucu

SEQ ID NO: 1088799 - RNA, 12 nt, Homo sapiens
guucauucaaaa

SEQ ID NO: 1088800 - RNA, 13 nt, Homo sapiens
guuccccuggaaa

SEQ ID NO: 1088801 - RNA, 21 nt, Homo sapiens
guuccuaagccuguugcugaa

SEQ ID NO: 1088802 - RNA, 17 nt, Homo sapiens
guuccucuuugcaugga

SEQ ID NO: 1088803 - RNA, 13 nt, Homo sapiens
guucuacuugaua

SEQ ID NO: 1088804 - RNA, 15 nt, Homo sapiens
guucuagagugacag

SEQ ID NO: 1088805 - RNA, 16 nt, Homo sapiens
guugacuggccaaaaa

SEQ ID NO: 1088806 - RNA, 19 nt, Homo sapiens
guugugccaaagugcauag

SEQ ID NO: 1088807 - RNA, 16 nt, Homo sapiens
guuguuuuaaagucag

SEQ ID NO: 1088808 - RNA, 17 nt, Homo sapiens
guuuaaaaaaaguauau

SEQ ID NO: 1088809 - RNA, 17 nt, Homo sapiens
guuuauggggcucucac

SEQ ID NO: 1088810 - RNA, 20 nt, Homo sapiens
guuuauggggcucucacaga

SEQ ID NO: 1088811 - RNA, 15 nt, Homo sapiens
guuucaaacuccuga

SEQ ID NO: 1088812 - RNA, 14 nt, Homo sapiens
guuucacuguucau

SEQ ID NO: 1088813 - RNA, 12 nt, Homo sapiens
agaacucugaau

SEQ ID NO: 1088814 - RNA, 18 nt, Homo sapiens
agaaggugccgauuucau

SEQ ID NO: 1088815 - RNA, 16 nt, Homo sapiens
agaaguaggcucugau

SEQ ID NO: 1088816 - RNA, 20 nt, Homo sapiens
agaaguuggucuuacuuugu

SEQ ID NO: 1088817 - RNA, 16 nt, Homo sapiens
agaauaaaauacucuu

SEQ ID NO: 1088818 - RNA, 12 nt, Homo sapiens
agaaucaagucu

SEQ ID NO: 1088819 - RNA, 17 nt, Homo sapiens
agaaucacuugacuuug

SEQ ID NO: 1088820 - RNA, 20 nt, Homo sapiens
agaaucacuugacuuugcca

SEQ ID NO: 1088821 - RNA, 23 nt, Homo sapiens
agaaucacuugacuuugccacau

SEQ ID NO: 1088822 - RNA, 18 nt, Homo sapiens
agaauuuucaaauaagga

SEQ ID NO: 1088823 - RNA, 13 nt, Homo sapiens
agacaaauugauc

SEQ ID NO: 1088824 - RNA, 14 nt, Homo sapiens
agacaucaaugaaa

SEQ ID NO: 1088825 - RNA, 15 nt, Homo sapiens
agacaucaaugaaac

SEQ ID NO: 1088826 - RNA, 22 nt, Homo sapiens
agaccauugucuuccaacccca

SEQ ID NO: 1088827 - RNA, 13 nt, Homo sapiens
agacccuguucua

SEQ ID NO: 1088828 - RNA, 19 nt, Homo sapiens
agacccuguucuaacucuu

SEQ ID NO: 1088829 - RNA, 22 nt, Homo sapiens
agacgauuauuuaaaccugccc

SEQ ID NO: 1088830 - RNA, 14 nt, Homo sapiens
agacgccuccccaa

SEQ ID NO: 1088831 - RNA, 21 nt, Homo sapiens
agacuagauucucaccugccu

SEQ ID NO: 1088832 - RNA, 13 nt, Homo sapiens
agacucugucuca

SEQ ID NO: 1088833 - RNA, 19 nt, Homo sapiens
agacugcugggacuggcca

SEQ ID NO: 1088834 - RNA, 13 nt, Homo sapiens
agagaaaauaauu

SEQ ID NO: 1088835 - RNA, 13 nt, Homo sapiens
agagaacagggau

SEQ ID NO: 1088836 - RNA, 17 nt, Homo sapiens
agagagacgcugugauu

SEQ ID NO: 1088837 - RNA, 12 nt, Homo sapiens
agagaguaccau

SEQ ID NO: 1088838 - RNA, 14 nt, Homo sapiens
agagaguuaaguga

SEQ ID NO: 1088839 - RNA, 12 nt, Homo sapiens
agagcagcacug

SEQ ID NO: 1088840 - RNA, 14 nt, Homo sapiens
agagcagcuggcuc

SEQ ID NO: 1088841 - RNA, 13 nt, Homo sapiens
agagcuggugcca

SEQ ID NO: 1088842 - RNA, 20 nt, Homo sapiens
agagcuggugccagaugugg

SEQ ID NO: 1088843 - RNA, 15 nt, Homo sapiens
agaggaagugcacug

SEQ ID NO: 1088844 - RNA, 19 nt, Homo sapiens
agaggaccugagucugcua

SEQ ID NO: 1088845 - RNA, 13 nt, Homo sapiens
agaggcuagucuc

SEQ ID NO: 1088846 - RNA, 14 nt, Homo sapiens
agagggcccaggca

SEQ ID NO: 1088847 - RNA, 18 nt, Homo sapiens
agagguagcgagcugcuc

SEQ ID NO: 1088848 - RNA, 22 nt, Homo sapiens
agaguguaacauccagcucuau

SEQ ID NO: 1088849 - RNA, 15 nt, Homo sapiens
agaguucuugcaccc

SEQ ID NO: 1088850 - RNA, 19 nt, Homo sapiens
agaguugaccccuccugaa

SEQ ID NO: 1088851 - RNA, 23 nt, Homo sapiens
agauacugaagugcagcucagga

SEQ ID NO: 1088852 - RNA, 17 nt, Homo sapiens
agaucacgccacugcac

SEQ ID NO: 1088853 - RNA, 23 nt, Homo sapiens
agauccuuuuuuacgcuuugcag

SEQ ID NO: 1088854 - RNA, 18 nt, Homo sapiens
agaugaguuuuauugacu

SEQ ID NO: 1088855 - RNA, 17 nt, Homo sapiens
agauggaauaaagcccu

SEQ ID NO: 1088856 - RNA, 21 nt, Homo sapiens
agaugucccugaagucuugca

SEQ ID NO: 1088857 - RNA, 12 nt, Homo sapiens
agauucucaccu

SEQ ID NO: 1088858 - RNA, 17 nt, Homo sapiens
agcaaaagucauuacac

SEQ ID NO: 1088859 - RNA, 17 nt, Homo sapiens
agcaaauauauaaugca

SEQ ID NO: 1088860 - RNA, 9 nt, Homo sapiens
agcaauacu

SEQ ID NO: 1088861 - RNA, 15 nt, Homo sapiens
agcacuuuucacuua

SEQ ID NO: 1088862 - RNA, 15 nt, Homo sapiens
agcagaccgugauuu

SEQ ID NO: 1088863 - RNA, 13 nt, Homo sapiens
agcagcacugggg

SEQ ID NO: 1088864 - RNA, 16 nt, Homo sapiens
agcagccuccagugcu

SEQ ID NO: 1088865 - RNA, 21 nt, Homo sapiens
agcagcuucaguuguuuuccc

SEQ ID NO: 1088866 - RNA, 19 nt, Homo sapiens
agcagguuucuugcuucug

SEQ ID NO: 1088867 - RNA, 15 nt, Homo sapiens
agcagugauuguuau

SEQ ID NO: 1088868 - RNA, 22 nt, Homo sapiens
agcagugauuguuaugccuugc

SEQ ID NO: 1088869 - RNA, 17 nt, Homo sapiens
agcaucaccucaggcca

SEQ ID NO: 1088870 - RNA, 20 nt, Homo sapiens
agcauggcccgggccuuauc

SEQ ID NO: 1088871 - RNA, 19 nt, Homo sapiens
agcauguggggaagcaaga

SEQ ID NO: 1088872 - RNA, 22 nt, Homo sapiens
agcauuacgaucccccaagugu

SEQ ID NO: 1088873 - RNA, 18 nt, Homo sapiens
agcauuagcuacuuuuca

SEQ ID NO: 1088874 - RNA, 15 nt, Homo sapiens
agccacugcagcaca

SEQ ID NO: 1088875 - RNA, 15 nt, Homo sapiens
agccagccaggacuc

SEQ ID NO: 1088876 - RNA, 19 nt, Homo sapiens
agccagcuccugcacaaau

SEQ ID NO: 1088877 - RNA, 16 nt, Homo sapiens
agccagcucugcauua

SEQ ID NO: 1088878 - RNA, 14 nt, Homo sapiens
agccagucccucag

SEQ ID NO: 1088879 - RNA, 13 nt, Homo sapiens
agccauuucccau

SEQ ID NO: 1088880 - RNA, 14 nt, Homo sapiens
agcccagccauuac

SEQ ID NO: 1088881 - RNA, 14 nt, Homo sapiens
agccccacagccca

SEQ ID NO: 1088882 - RNA, 15 nt, Homo sapiens
agcccuugaaccagc

SEQ ID NO: 1088883 - RNA, 21 nt, Homo sapiens
agccuccagugcuggcugcug

SEQ ID NO: 1088884 - RNA, 15 nt, Homo sapiens
agccuccucucucaa

SEQ ID NO: 1088885 - RNA, 11 nt, Homo sapiens
agccuggccac

SEQ ID NO: 1088886 - RNA, 16 nt, Homo sapiens
agccuggccaccagcu

SEQ ID NO: 1088887 - RNA, 12 nt, Homo sapiens
agccuggcccag

SEQ ID NO: 1088888 - RNA, 21 nt, Homo sapiens
agccuuucacaggacucugca

SEQ ID NO: 1088889 - RNA, 12 nt, Homo sapiens
agccuuugcacu

SEQ ID NO: 1088890 - RNA, 16 nt, Homo sapiens
agcgagcugcucugcu

SEQ ID NO: 1088891 - RNA, 15 nt, Homo sapiens
agcuaagccugauga

SEQ ID NO: 1088892 - RNA, 22 nt, Homo sapiens
agcuaagugaauuuuugcacau

SEQ ID NO: 1088893 - RNA, 19 nt, Homo sapiens
agcuacucagaagccugag

SEQ ID NO: 1088894 - RNA, 19 nt, Homo sapiens
agcuagaaucacuugacuu

SEQ ID NO: 1088895 - RNA, 13 nt, Homo sapiens
agcucaguggcaa

SEQ ID NO: 1088896 - RNA, 22 nt, Homo sapiens
agcucaguuucuuuuucacuug

SEQ ID NO: 1088897 - RNA, 19 nt, Homo sapiens
agcuccagcuguuaccuga

SEQ ID NO: 1088898 - RNA, 19 nt, Homo sapiens
agcuccauuucuacucuua

SEQ ID NO: 1088899 - RNA, 17 nt, Homo sapiens
agcuccuaguagcuuuc

SEQ ID NO: 1088900 - RNA, 13 nt, Homo sapiens
agcuccugcacaa

SEQ ID NO: 1088901 - RNA, 18 nt, Homo sapiens
agcuccugcucauugugg

SEQ ID NO: 1088902 - RNA, 18 nt, Homo sapiens
agcucuacacaacaugua

SEQ ID NO: 1088903 - RNA, 14 nt, Homo sapiens
agcucuaucugcaa

SEQ ID NO: 1088904 - RNA, 16 nt, Homo sapiens
agcucugaacaaaagc

SEQ ID NO: 1088905 - RNA, 14 nt, Homo sapiens
agcugcaccugcca

SEQ ID NO: 1088906 - RNA, 15 nt, Homo sapiens
agcugcaccugccag

SEQ ID NO: 1088907 - RNA, 20 nt, Homo sapiens
agcuggacccauuugccagg

SEQ ID NO: 1088908 - RNA, 15 nt, Homo sapiens
agcuuaaagagaaaa

SEQ ID NO: 1088909 - RNA, 22 nt, Homo sapiens
agcuucccucugccugacccca

SEQ ID NO: 1088910 - RNA, 19 nt, Homo sapiens
agcuuguaaauacuccauu

SEQ ID NO: 1088911 - RNA, 22 nt, Homo sapiens
aggaaacuguuguguccaaucc

SEQ ID NO: 1088912 - RNA, 22 nt, Homo sapiens
aggaaauguugacuggccaaaa

SEQ ID NO: 1088913 - RNA, 14 nt, Homo sapiens
aggaaggacugugc

SEQ ID NO: 1088914 - RNA, 20 nt, Homo sapiens
aggacaaacagugaauuuaa

SEQ ID NO: 1088915 - RNA, 13 nt, Homo sapiens
aggacaugugcuc

SEQ ID NO: 1088916 - RNA, 17 nt, Homo sapiens
aggaccugagucugcua

SEQ ID NO: 1088917 - RNA, 16 nt, Homo sapiens
aggagaaaaugcauua

SEQ ID NO: 1088918 - RNA, 21 nt, Homo sapiens
aggaggcuccgugagcccuug

SEQ ID NO: 1088919 - RNA, 22 nt, Homo sapiens
aggagggaugcugccugaguca

SEQ ID NO: 1088920 - RNA, 21 nt, Homo sapiens
aggauuaaugguccugugaug

SEQ ID NO: 1088921 - RNA, 23 nt, Homo sapiens
aggauugggccaacaaggacuca

SEQ ID NO: 1088922 - RNA, 16 nt, Homo sapiens
aggauuuaccaaauag

SEQ ID NO: 1088923 - RNA, 16 nt, Homo sapiens
aggauuuuaccaaagc

SEQ ID NO: 1088924 - RNA, 21 nt, Homo sapiens
aggcaacugugaguccgggaa

SEQ ID NO: 1088925 - RNA, 15 nt, Homo sapiens
aggcaccugcuggaa

SEQ ID NO: 1088926 - RNA, 19 nt, Homo sapiens
aggcaccugcuggaaacca

SEQ ID NO: 1088927 - RNA, 21 nt, Homo sapiens
aggccacacacucugcauccg

SEQ ID NO: 1088928 - RNA, 15 nt, Homo sapiens
aggccacacuggcau

SEQ ID NO: 1088929 - RNA, 19 nt, Homo sapiens
aggccacacuggcaucucc

SEQ ID NO: 1088930 - RNA, 21 nt, Homo sapiens
aggccaccuggccaggagcuu

SEQ ID NO: 1088931 - RNA, 20 nt, Homo sapiens
aggccaggugcaguggcuca

SEQ ID NO: 1088932 - RNA, 23 nt, Homo sapiens
aggccuccagccacuuauuucca

SEQ ID NO: 1088933 - RNA, 17 nt, Homo sapiens
aggcuagucucuucuca

SEQ ID NO: 1088934 - RNA, 20 nt, Homo sapiens
aggcugcagcgagcuaugau

SEQ ID NO: 1088935 - RNA, 22 nt, Homo sapiens
aggcugggggcgggggagccaa

SEQ ID NO: 1088936 - RNA, 13 nt, Homo sapiens
agggaagcaggga

SEQ ID NO: 1088937 - RNA, 18 nt, Homo sapiens
cagaucuuuuugugaaau

SEQ ID NO: 1088938 - RNA, 19 nt, Homo sapiens
cagauguuuacagacugug

SEQ ID NO: 1088939 - RNA, 19 nt, Homo sapiens
cagauuuacugucccagga

SEQ ID NO: 1088940 - RNA, 20 nt, Homo sapiens
cagcacagaacacacugaga

SEQ ID NO: 1088941 - RNA, 18 nt, Homo sapiens
cagccauuaccauggaga

SEQ ID NO: 1088942 - RNA, 15 nt, Homo sapiens
cagccguauuuuaca

SEQ ID NO: 1088943 - RNA, 13 nt, Homo sapiens
cagccucaagucu

SEQ ID NO: 1088944 - RNA, 20 nt, Homo sapiens
cagccucccaaguagcugga

SEQ ID NO: 1088945 - RNA, 18 nt, Homo sapiens
cagccucccgaguagcug

SEQ ID NO: 1088946 - RNA, 19 nt, Homo sapiens
cagccucccgaguagcugg

SEQ ID NO: 1088947 - RNA, 18 nt, Homo sapiens
cagccuggccaccagcuu

SEQ ID NO: 1088948 - RNA, 21 nt, Homo sapiens
cagcgagcuaugaucgcgcca

SEQ ID NO: 1088949 - RNA, 16 nt, Homo sapiens
cagcuaagccugauga

SEQ ID NO: 1088950 - RNA, 12 nt, Homo sapiens
cagcuccuagua

SEQ ID NO: 1088951 - RNA, 21 nt, Homo sapiens
cagcucugcauuaucugaggu

SEQ ID NO: 1088952 - RNA, 16 nt, Homo sapiens
cagcugacaguccucu

SEQ ID NO: 1088953 - RNA, 21 nt, Homo sapiens
cagcuggacaauaugaaucuu

SEQ ID NO: 1088954 - RNA, 23 nt, Homo sapiens
cagcuucccucugccugacccca

SEQ ID NO: 1088955 - RNA, 15 nt, Homo sapiens
caggaaggacugugc

SEQ ID NO: 1088956 - RNA, 21 nt, Homo sapiens
caggaauaggcauuugccuaa

SEQ ID NO: 1088957 - RNA, 12 nt, Homo sapiens
caggacaugugc

SEQ ID NO: 1088958 - RNA, 15 nt, Homo sapiens
caggagagacaggau

SEQ ID NO: 1088959 - RNA, 21 nt, Homo sapiens
caggagagacaggauugggcc

SEQ ID NO: 1088960 - RNA, 23 nt, Homo sapiens
caggaggaggugccaacaguguu

SEQ ID NO: 1088961 - RNA, 18 nt, Homo sapiens
caggaggcuuggaaagca

SEQ ID NO: 1088962 - RNA, 13 nt, Homo sapiens
caggauucccaga

SEQ ID NO: 1088963 - RNA, 17 nt, Homo sapiens
caggauuggcacaagcu

SEQ ID NO: 1088964 - RNA, 12 nt, Homo sapiens
caggcaggccac

SEQ ID NO: 1088965 - RNA, 17 nt, Homo sapiens
caggcugcugcauggca

SEQ ID NO: 1088966 - RNA, 19 nt, Homo sapiens
caggcuguaagcauucuga

SEQ ID NO: 1088967 - RNA, 17 nt, Homo sapiens
cagggagcuggcaaugc

SEQ ID NO: 1088968 - RNA, 14 nt, Homo sapiens
cagggcaccccagc

SEQ ID NO: 1088969 - RNA, 16 nt, Homo sapiens
cagggcaccccagcug

SEQ ID NO: 1088970 - RNA, 21 nt, Homo sapiens
caggguuucaccauauuggcc

SEQ ID NO: 1088971 - RNA, 18 nt, Homo sapiens
caguaaaaucaaaugugc

SEQ ID NO: 1088972 - RNA, 23 nt, Homo sapiens
caguaaacuuucucugcaaagac

SEQ ID NO: 1088973 - RNA, 15 nt, Homo sapiens
cagucuggugcccag

SEQ ID NO: 1088974 - RNA, 20 nt, Homo sapiens
cagucuggugcccagacuca

SEQ ID NO: 1088975 - RNA, 15 nt, Homo sapiens
cagucuuaauauuca

SEQ ID NO: 1088976 - RNA, 15 nt, Homo sapiens
cagugaucucacuua

SEQ ID NO: 1088977 - RNA, 20 nt, Homo sapiens
cagugcuccugugcagggau

SEQ ID NO: 1088978 - RNA, 14 nt, Homo sapiens
caguggcacuaaaa

SEQ ID NO: 1088979 - RNA, 19 nt, Homo sapiens
cagugggaggacagagccg

SEQ ID NO: 1088980 - RNA, 15 nt, Homo sapiens
cagugucuuccugug

SEQ ID NO: 1088981 - RNA, 22 nt, Homo sapiens
cagugugccccccauccuggcc

SEQ ID NO: 1088982 - RNA, 12 nt, Homo sapiens
caguucugauga

SEQ ID NO: 1088983 - RNA, 18 nt, Homo sapiens
caguuucuuuuucacuug

SEQ ID NO: 1088984 - RNA, 12 nt, Homo sapiens
caguuugaacuc

SEQ ID NO: 1088985 - RNA, 16 nt, Homo sapiens
cauaaagguauuuaga

SEQ ID NO: 1088986 - RNA, 19 nt, Homo sapiens
cauaaaguaugccuuccug

SEQ ID NO: 1088987 - RNA, 16 nt, Homo sapiens
cauaaugucauacgaa

SEQ ID NO: 1088988 - RNA, 18 nt, Homo sapiens
cauacauuauauuccucu

SEQ ID NO: 1088989 - RNA, 23 nt, Homo sapiens
cauacgaaccuaaagaauaugaa

SEQ ID NO: 1088990 - RNA, 21 nt, Homo sapiens
cauauaccagaggaaagacca

SEQ ID NO: 1088991 - RNA, 13 nt, Homo sapiens
cauauauauguau

SEQ ID NO: 1088992 - RNA, 22 nt, Homo sapiens
cauauugacuuaauugcagcuu

SEQ ID NO: 1088993 - RNA, 23 nt, Homo sapiens
cauauuuuaggacagguaaaaua

SEQ ID NO: 1088994 - RNA, 18 nt, Homo sapiens
caucagucuuaauauuca

SEQ ID NO: 1088995 - RNA, 16 nt, Homo sapiens
caucaguuaggauuag

SEQ ID NO: 1088996 - RNA, 19 nt, Homo sapiens
caucaucagucuuaauauu

SEQ ID NO: 1088997 - RNA, 17 nt, Homo sapiens
caucaucuuuaucuccu

SEQ ID NO: 1088998 - RNA, 21 nt, Homo sapiens
cauccaauggauugugcaaau

SEQ ID NO: 1088999 - RNA, 13 nt, Homo sapiens
cauccaucugugg

SEQ ID NO: 1089000 - RNA, 18 nt, Homo sapiens
caucccgucgacguagaa

SEQ ID NO: 1089001 - RNA, 22 nt, Homo sapiens
cauccuggcuggcuguguccuc

SEQ ID NO: 1089002 - RNA, 20 nt, Homo sapiens
cauccuuuuacuuuuugccc

SEQ ID NO: 1089003 - RNA, 20 nt, Homo sapiens
caucgcaauaguuuuuuacu

SEQ ID NO: 1089004 - RNA, 12 nt, Homo sapiens
caucuugcugcu

SEQ ID NO: 1089005 - RNA, 13 nt, Homo sapiens
caugaauucacaa

SEQ ID NO: 1089006 - RNA, 22 nt, Homo sapiens
caugaauucacaaacaaauggc

SEQ ID NO: 1089007 - RNA, 16 nt, Homo sapiens
caugacacucuaguga

SEQ ID NO: 1089008 - RNA, 15 nt, Homo sapiens
caugaggccaugcaa

SEQ ID NO: 1089009 - RNA, 13 nt, Homo sapiens
caugauacuuuaa

SEQ ID NO: 1089010 - RNA, 20 nt, Homo sapiens
caugauggagcgcaccugcc

SEQ ID NO: 1089011 - RNA, 18 nt, Homo sapiens
caugcaagacuucacugc

SEQ ID NO: 1089012 - RNA, 18 nt, Homo sapiens
caugcauucuagugcaga

SEQ ID NO: 1089013 - RNA, 14 nt, Homo sapiens
caugcuggggcaag

SEQ ID NO: 1089014 - RNA, 20 nt, Homo sapiens
caugcugguguggccaaggc

SEQ ID NO: 1089015 - RNA, 16 nt, Homo sapiens
cauggaauaaaccauu

SEQ ID NO: 1089016 - RNA, 17 nt, Homo sapiens
cauggaauaaaccauuu

SEQ ID NO: 1089017 - RNA, 15 nt, Homo sapiens
cauggccuucccucc

SEQ ID NO: 1089018 - RNA, 22 nt, Homo sapiens
caugguagacugugacacagcu

SEQ ID NO: 1089019 - RNA, 22 nt, Homo sapiens
cauguaaggucuucuugugucc

SEQ ID NO: 1089020 - RNA, 22 nt, Homo sapiens
cauguauguggauacagucauu

SEQ ID NO: 1089021 - RNA, 15 nt, Homo sapiens
caugucagccucaug

SEQ ID NO: 1089022 - RNA, 18 nt, Homo sapiens
cauguuuuguauguuaaa

SEQ ID NO: 1089023 - RNA, 13 nt, Homo sapiens
cauuacauggcug

SEQ ID NO: 1089024 - RNA, 20 nt, Homo sapiens
cauuagugaauuacacucaa

SEQ ID NO: 1089025 - RNA, 22 nt, Homo sapiens
cauuauuuuuguuagcaaagau

SEQ ID NO: 1089026 - RNA, 17 nt, Homo sapiens
cauucauuuauucauuc

SEQ ID NO: 1089027 - RNA, 20 nt, Homo sapiens
cauucccagaauuugcugca

SEQ ID NO: 1089028 - RNA, 15 nt, Homo sapiens
cauuccuucacauag

SEQ ID NO: 1089029 - RNA, 14 nt, Homo sapiens
cauugcucacacua

SEQ ID NO: 1089030 - RNA, 17 nt, Homo sapiens
cauugggcacauaucuc

SEQ ID NO: 1089031 - RNA, 14 nt, Homo sapiens
cauugguaucugau

SEQ ID NO: 1089032 - RNA, 23 nt, Homo sapiens
cauuuagauuuugauaccaguga

SEQ ID NO: 1089033 - RNA, 18 nt, Homo sapiens
cauuucauacaacagaaa

SEQ ID NO: 1089034 - RNA, 23 nt, Homo sapiens
cauuucuaacauaaguaagacuu

SEQ ID NO: 1089035 - RNA, 21 nt, Homo sapiens
cauuucucuugcucaccaaga

SEQ ID NO: 1089036 - RNA, 13 nt, Homo sapiens
cauuuuacuucca

SEQ ID NO: 1089037 - RNA, 20 nt, Homo sapiens
cauuuuacuuccaugauacu

SEQ ID NO: 1089038 - RNA, 20 nt, Homo sapiens
cauuuugacacaauguugca

SEQ ID NO: 1089039 - RNA, 13 nt, Homo sapiens
ccaaaacauuucu

SEQ ID NO: 1089040 - RNA, 22 nt, Homo sapiens
ccaaauuuuauuaaaagaguag

SEQ ID NO: 1089041 - RNA, 14 nt, Homo sapiens
ccaagccacaggga

SEQ ID NO: 1089042 - RNA, 14 nt, Homo sapiens
ccaagccccacuga

SEQ ID NO: 1089043 - RNA, 16 nt, Homo sapiens
ccaaggguaugggaag

SEQ ID NO: 1089044 - RNA, 20 nt, Homo sapiens
ccaaggguaugggaagccau

SEQ ID NO: 1089045 - RNA, 16 nt, Homo sapiens
ccaagugccagucuug

SEQ ID NO: 1089046 - RNA, 23 nt, Homo sapiens
ccaaucuuaguuucuaaccaaag

SEQ ID NO: 1089047 - RNA, 13 nt, Homo sapiens
ccacaagccauuu

SEQ ID NO: 1089048 - RNA, 16 nt, Homo sapiens
ccacacccugccugcu

SEQ ID NO: 1089049 - RNA, 14 nt, Homo sapiens
ccacacuucuugaa

SEQ ID NO: 1089050 - RNA, 19 nt, Homo sapiens
ccacagucauuagugaauu

SEQ ID NO: 1089051 - RNA, 14 nt, Homo sapiens
ccacaguggaacca

SEQ ID NO: 1089052 - RNA, 20 nt, Homo sapiens
ccacaucaucuuuaucuccu

SEQ ID NO: 1089053 - RNA, 22 nt, Homo sapiens
ccacauuagccuuugcacugua

SEQ ID NO: 1089054 - RNA, 23 nt, Homo sapiens
ccaccuaguggcuguccagugcc

SEQ ID NO: 1089055 - RNA, 19 nt, Homo sapiens
ccaccucggaucccacuga

SEQ ID NO: 1089056 - RNA, 22 nt, Homo sapiens
ccaccuggccccuucuccagca

SEQ ID NO: 1089057 - RNA, 14 nt, Homo sapiens
ccacgucugugcuc

SEQ ID NO: 1089058 - RNA, 16 nt, Homo sapiens
ccacuaggacucugag

SEQ ID NO: 1089059 - RNA, 18 nt, Homo sapiens
ccacuccccagugcuccu

SEQ ID NO: 1089060 - RNA, 16 nt, Homo sapiens
cuuuuauaaaccucua

SEQ ID NO: 1089061 - RNA, 19 nt, Homo sapiens
cuuuuauuugaaaugucau

SEQ ID NO: 1089062 - RNA, 16 nt, Homo sapiens
cuuuuccauguaucua

SEQ ID NO: 1089063 - RNA, 15 nt, Homo sapiens
cuuuugcaacaagac

SEQ ID NO: 1089064 - RNA, 14 nt, Homo sapiens
cuuuuucuaccuuu

SEQ ID NO: 1089065 - RNA, 21 nt, Homo sapiens
cuuuuuuuuuuucugccugag

SEQ ID NO: 1089066 - RNA, 14 nt, Homo sapiens
gaaaaaaguauagg

SEQ ID NO: 1089067 - RNA, 18 nt, Homo sapiens
gaaaaauaguguguccau

SEQ ID NO: 1089068 - RNA, 21 nt, Homo sapiens
gaaaagcaauacuguuuccau

SEQ ID NO: 1089069 - RNA, 20 nt, Homo sapiens
gaaaauaauugcaaauaucc

SEQ ID NO: 1089070 - RNA, 13 nt, Homo sapiens
gaaaaugcauuau

SEQ ID NO: 1089071 - RNA, 18 nt, Homo sapiens
gaaacacuaaauuaguuu

SEQ ID NO: 1089072 - RNA, 17 nt, Homo sapiens
gaaacagggcaccccag

SEQ ID NO: 1089073 - RNA, 23 nt, Homo sapiens
gaaaccagaaggauauuuacuac

SEQ ID NO: 1089074 - RNA, 15 nt, Homo sapiens
gaaaccuuugacacu

SEQ ID NO: 1089075 - RNA, 12 nt, Homo sapiens
gaaagacaucaa

SEQ ID NO: 1089076 - RNA, 19 nt, Homo sapiens
gaaagccucugcugccaug

SEQ ID NO: 1089077 - RNA, 17 nt, Homo sapiens
gaaagugguucuaugau

SEQ ID NO: 1089078 - RNA, 15 nt, Homo sapiens
gaaauacaacagaag

SEQ ID NO: 1089079 - RNA, 13 nt, Homo sapiens
gaaauauauuuga

SEQ ID NO: 1089080 - RNA, 17 nt, Homo sapiens
gaaaucagagcuggcag

SEQ ID NO: 1089081 - RNA, 22 nt, Homo sapiens
gaacacgcaugccucagccagc

SEQ ID NO: 1089082 - RNA, 22 nt, Homo sapiens
gaacacuaaacagacuauuuaa

SEQ ID NO: 1089083 - RNA, 22 nt, Homo sapiens
gaacagggaugcuaucucgcua

SEQ ID NO: 1089084 - RNA, 15 nt, Homo sapiens
gaacagugcucugcc

SEQ ID NO: 1089085 - RNA, 21 nt, Homo sapiens
gaacauuccucugcagcacuu

SEQ ID NO: 1089086 - RNA, 14 nt, Homo sapiens
gaaccaauaaugua

SEQ ID NO: 1089087 - RNA, 20 nt, Homo sapiens
gaaccuggggugugguucca

SEQ ID NO: 1089088 - RNA, 22 nt, Homo sapiens
gaacuccccagggccuccagga

SEQ ID NO: 1089089 - RNA, 20 nt, Homo sapiens
gaacugccccaucuccuccc

SEQ ID NO: 1089090 - RNA, 18 nt, Homo sapiens
gaacugcgugccaguguc

SEQ ID NO: 1089091 - RNA, 15 nt, Homo sapiens
gaacuggccacuccc

SEQ ID NO: 1089092 - RNA, 23 nt, Homo sapiens
gaagaccuccacauuaaguggcu

SEQ ID NO: 1089093 - RNA, 21 nt, Homo sapiens
gaagaggugagaguaagccuu

SEQ ID NO: 1089094 - RNA, 17 nt, Homo sapiens
gaagaucugcuucccug

SEQ ID NO: 1089095 - RNA, 23 nt, Homo sapiens
gaagcacuccucgguacucccau

SEQ ID NO: 1089096 - RNA, 17 nt, Homo sapiens
gaagccccaacugugau

SEQ ID NO: 1089097 - RNA, 14 nt, Homo sapiens
gaagggaugggaga

SEQ ID NO: 1089098 - RNA, 22 nt, Homo sapiens
gaagggccuucuccacagggac

SEQ ID NO: 1089099 - RNA, 23 nt, Homo sapiens
gaagggccuucuccacagggaca

SEQ ID NO: 1089100 - RNA, 17 nt, Homo sapiens
gaaguggcaccuaauaa

SEQ ID NO: 1089101 - RNA, 14 nt, Homo sapiens
gaauaaaauacucu

SEQ ID NO: 1089102 - RNA, 14 nt, Homo sapiens
gaauaaagcccuug

SEQ ID NO: 1089103 - RNA, 21 nt, Homo sapiens
gaauaaagcccuugaaccagc

SEQ ID NO: 1089104 - RNA, 13 nt, Homo sapiens
gaauaggcauuug

SEQ ID NO: 1089105 - RNA, 15 nt, Homo sapiens
gaauaugaauggauu

SEQ ID NO: 1089106 - RNA, 22 nt, Homo sapiens
gaauugaaggagaaaaugcauu

SEQ ID NO: 1089107 - RNA, 21 nt, Homo sapiens
gacaaagccaaacucugccag

SEQ ID NO: 1089108 - RNA, 22 nt, Homo sapiens
gacaagaaauccuaguggccuc

SEQ ID NO: 1089109 - RNA, 23 nt, Homo sapiens
gacaaugaaaguuugcacuguau

SEQ ID NO: 1089110 - RNA, 14 nt, Homo sapiens
gacaggcaccagau

SEQ ID NO: 1089111 - RNA, 22 nt, Homo sapiens
gacauagcuggaaaauuccuau

SEQ ID NO: 1089112 - RNA, 21 nt, Homo sapiens
gacaucagaaguaacucccac

SEQ ID NO: 1089113 - RNA, 18 nt, Homo sapiens
gaccacaggugccuacca

SEQ ID NO: 1089114 - RNA, 14 nt, Homo sapiens
gacccucccaguga

SEQ ID NO: 1089115 - RNA, 14 nt, Homo sapiens
gaccguuguuaaca

SEQ ID NO: 1089116 - RNA, 18 nt, Homo sapiens
gaccuccguguagugucu

SEQ ID NO: 1089117 - RNA, 14 nt, Homo sapiens
gaccugcaggccaa

SEQ ID NO: 1089118 - RNA, 18 nt, Homo sapiens
gaccuucuccagggacag

SEQ ID NO: 1089119 - RNA, 19 nt, Homo sapiens
gaccuucuccagggacaga

SEQ ID NO: 1089120 - RNA, 18 nt, Homo sapiens
gacggguugaaagacauc

SEQ ID NO: 1089121 - RNA, 19 nt, Homo sapiens
gacgugagugugacuuuuu

SEQ ID NO: 1089122 - RNA, 15 nt, Homo sapiens
gacuagguacaggca

SEQ ID NO: 1089123 - RNA, 22 nt, Homo sapiens
gacuauguuccaauaaaacuuu

SEQ ID NO: 1089124 - RNA, 16 nt, Homo sapiens
gacuauuuaacuugag

SEQ ID NO: 1089125 - RNA, 21 nt, Homo sapiens
gacucaagacuuccagagccu

SEQ ID NO: 1089126 - RNA, 18 nt, Homo sapiens
gacucuucccccacuccu

SEQ ID NO: 1089127 - RNA, 19 nt, Homo sapiens
gacuggacuauacaacuuu

SEQ ID NO: 1089128 - RNA, 14 nt, Homo sapiens
gacuggccaaaaau

SEQ ID NO: 1089129 - RNA, 11 nt, Homo sapiens
gacuggcucaa

SEQ ID NO: 1089130 - RNA, 21 nt, Homo sapiens
gacugugaacgugaauaggcu

SEQ ID NO: 1089131 - RNA, 15 nt, Homo sapiens
gacugugacacagcu

SEQ ID NO: 1089132 - RNA, 15 nt, Homo sapiens
gacuucacugcagcc

SEQ ID NO: 1089133 - RNA, 14 nt, Homo sapiens
gacuuccuggugag

SEQ ID NO: 1089134 - RNA, 17 nt, Homo sapiens
gacuucugcaucuuaca

SEQ ID NO: 1089135 - RNA, 16 nt, Homo sapiens
gacuugaaucaaguca

SEQ ID NO: 1089136 - RNA, 16 nt, Homo sapiens
gacuugagcuuggcag

SEQ ID NO: 1089137 - RNA, 16 nt, Homo sapiens
gacuugaggauuuuga

SEQ ID NO: 1089138 - RNA, 17 nt, Homo sapiens
gacuugauugguuuaaa

SEQ ID NO: 1089139 - RNA, 19 nt, Homo sapiens
gacuuugaggguguauauu

SEQ ID NO: 1089140 - RNA, 16 nt, Homo sapiens
gacuuugccacaucca

SEQ ID NO: 1089141 - RNA, 22 nt, Homo sapiens
gagaaaacuuauuugagugauu

SEQ ID NO: 1089142 - RNA, 18 nt, Homo sapiens
gagaaacaggcucugaga

SEQ ID NO: 1089143 - RNA, 12 nt, Homo sapiens
gagaacagggau

SEQ ID NO: 1089144 - RNA, 13 nt, Homo sapiens
gagaaccucaggc

SEQ ID NO: 1089145 - RNA, 16 nt, Homo sapiens
gagaagcuaaguaaua

SEQ ID NO: 1089146 - RNA, 18 nt, Homo sapiens
gagacuugaaucaaguca

SEQ ID NO: 1089147 - RNA, 14 nt, Homo sapiens
gagagaacagggau

SEQ ID NO: 1089148 - RNA, 13 nt, Homo sapiens
gagagauggaaua

SEQ ID NO: 1089149 - RNA, 20 nt, Homo sapiens
gagagcagcuggcucuccac

SEQ ID NO: 1089150 - RNA, 18 nt, Homo sapiens
gagagcccucugcugcuu

SEQ ID NO: 1089151 - RNA, 19 nt, Homo sapiens
gagaugacagugaugcugc

SEQ ID NO: 1089152 - RNA, 17 nt, Homo sapiens
gagauggaauaaagccc

SEQ ID NO: 1089153 - RNA, 17 nt, Homo sapiens
gagauggaggaaaguga

SEQ ID NO: 1089154 - RNA, 22 nt, Homo sapiens
gagauugcucuggggcuugcua

SEQ ID NO: 1089155 - RNA, 20 nt, Homo sapiens
gagcaauucuccugccucag

SEQ ID NO: 1089156 - RNA, 13 nt, Homo sapiens
gagcacuuuucac

SEQ ID NO: 1089157 - RNA, 17 nt, Homo sapiens
gagcaguagaagccugc

SEQ ID NO: 1089158 - RNA, 15 nt, Homo sapiens
gagccagucccucag

SEQ ID NO: 1089159 - RNA, 16 nt, Homo sapiens
gagcccuggcaggaug

SEQ ID NO: 1089160 - RNA, 16 nt, Homo sapiens
gagcgagaaccaggcu

SEQ ID NO: 1089161 - RNA, 13 nt, Homo sapiens
gagcugcucugcu

SEQ ID NO: 1089162 - RNA, 11 nt, Homo sapiens
gagcuugacuu

SEQ ID NO: 1089163 - RNA, 16 nt, Homo sapiens
gagcuuggcagcugaa

SEQ ID NO: 1089164 - RNA, 20 nt, Homo sapiens
gaggaagugcacuggcccuc

SEQ ID NO: 1089165 - RNA, 19 nt, Homo sapiens
gaggaguguccugucugcu

SEQ ID NO: 1089166 - RNA, 14 nt, Homo sapiens
gaggcaaaggccag

SEQ ID NO: 1089167 - RNA, 16 nt, Homo sapiens
gagggaaaagcuaaga

SEQ ID NO: 1089168 - RNA, 20 nt, Homo sapiens
gagggugacccauuucagga

SEQ ID NO: 1089169 - RNA, 14 nt, Homo sapiens
gaggguugugccca

SEQ ID NO: 1089170 - RNA, 17 nt, Homo sapiens
gagguugggcugagacc

SEQ ID NO: 1089171 - RNA, 23 nt, Homo sapiens
gaguaccaaauccacaagccauu

SEQ ID NO: 1089172 - RNA, 21 nt, Homo sapiens
gaguccaguccuuuguugcug

SEQ ID NO: 1089173 - RNA, 12 nt, Homo sapiens
gagucucugaac

SEQ ID NO: 1089174 - RNA, 16 nt, Homo sapiens
gauaaagcaguauuug

SEQ ID NO: 1089175 - RNA, 14 nt, Homo sapiens
gauaacugcaauuu

SEQ ID NO: 1089176 - RNA, 18 nt, Homo sapiens
gauagaacaaugcuauaa

SEQ ID NO: 1089177 - RNA, 20 nt, Homo sapiens
gauagaacaaugcuauaaua

SEQ ID NO: 1089178 - RNA, 15 nt, Homo sapiens
gauaggaagugcccc

SEQ ID NO: 1089179 - RNA, 19 nt, Homo sapiens
gauaggaagugccccaggg

SEQ ID NO: 1089180 - RNA, 23 nt, Homo sapiens
gauauauacauguuuaguauuau

SEQ ID NO: 1089181 - RNA, 20 nt, Homo sapiens
gauauuuaaaagacaaacac

SEQ ID NO: 1089182 - RNA, 23 nt, Homo sapiens
gaucagagcguuuguucccccau

SEQ ID NO: 1089183 - RNA, 18 nt, Homo sapiens
gaucccaagacaaugaaa

SEQ ID NO: 1089184 - RNA, 16 nt, Homo sapiens
aacuaggagucuucac

SEQ ID NO: 1089185 - RNA, 16 nt, Homo sapiens
aacucagacauuccaa

SEQ ID NO: 1089186 - RNA, 14 nt, Homo sapiens
aacucagagccucc

SEQ ID NO: 1089187 - RNA, 15 nt, Homo sapiens
aacucucaagcagac

SEQ ID NO: 1089188 - RNA, 23 nt, Homo sapiens
aacucuuggccagagcugagugg

SEQ ID NO: 1089189 - RNA, 21 nt, Homo sapiens
aacucuuguauugcuccauuu

SEQ ID NO: 1089190 - RNA, 15 nt, Homo sapiens
aacucuuuaucccau

SEQ ID NO: 1089191 - RNA, 13 nt, Homo sapiens
aacuuauuugccc

SEQ ID NO: 1089192 - RNA, 22 nt, Homo sapiens
aagaaaaguuuuguaaauuucu

SEQ ID NO: 1089193 - RNA, 18 nt, Homo sapiens
aagaaauaauacccugcc

SEQ ID NO: 1089194 - RNA, 22 nt, Homo sapiens
aagaaauugugaaaaaugagcu

SEQ ID NO: 1089195 - RNA, 23 nt, Homo sapiens
aagaacaaacacuuagcauccca

SEQ ID NO: 1089196 - RNA, 19 nt, Homo sapiens
aagaacugccccaucuccu

SEQ ID NO: 1089197 - RNA, 21 nt, Homo sapiens
aagaaucccacccccacuuca

SEQ ID NO: 1089198 - RNA, 17 nt, Homo sapiens
aagacaaagcaaagcca

SEQ ID NO: 1089199 - RNA, 14 nt, Homo sapiens
aagacaucaaugaa

SEQ ID NO: 1089200 - RNA, 20 nt, Homo sapiens
aagacccucaaugccaagaa

SEQ ID NO: 1089201 - RNA, 18 nt, Homo sapiens
aagacguccuggaaugaa

SEQ ID NO: 1089202 - RNA, 23 nt, Homo sapiens
aagacuguuaaaugaaaccagaa

SEQ ID NO: 1089203 - RNA, 14 nt, Homo sapiens
aagacuucacugca

SEQ ID NO: 1089204 - RNA, 17 nt, Homo sapiens
aagagaucuuucuuucc

SEQ ID NO: 1089205 - RNA, 17 nt, Homo sapiens
aagaucauuaucuucau

SEQ ID NO: 1089206 - RNA, 21 nt, Homo sapiens
aagaugaaacagggcacccca

SEQ ID NO: 1089207 - RNA, 22 nt, Homo sapiens
aagaugaaacagggcaccccag

SEQ ID NO: 1089208 - RNA, 21 nt, Homo sapiens
aagaugcuuuguuucuuucau

SEQ ID NO: 1089209 - RNA, 17 nt, Homo sapiens
aagaugugcucccacca

SEQ ID NO: 1089210 - RNA, 15 nt, Homo sapiens
aagauuauauaucau

SEQ ID NO: 1089211 - RNA, 23 nt, Homo sapiens
aagauuuauuaauuaaaccagac

SEQ ID NO: 1089212 - RNA, 12 nt, Homo sapiens
aagcaacugagu

SEQ ID NO: 1089213 - RNA, 17 nt, Homo sapiens
aagcacaaguacuuuug

SEQ ID NO: 1089214 - RNA, 18 nt, Homo sapiens
aagcagaguucuuugcaa

SEQ ID NO: 1089215 - RNA, 15 nt, Homo sapiens
aagcaugaguggccu

SEQ ID NO: 1089216 - RNA, 15 nt, Homo sapiens
aagcauguacuguac

SEQ ID NO: 1089217 - RNA, 21 nt, Homo sapiens
aagcauguacuguacuuccca

SEQ ID NO: 1089218 - RNA, 17 nt, Homo sapiens
aagccaaacucugccag

SEQ ID NO: 1089219 - RNA, 21 nt, Homo sapiens
aagccacggaccguugcacaa

SEQ ID NO: 1089220 - RNA, 12 nt, Homo sapiens
aagcccuugaac

SEQ ID NO: 1089221 - RNA, 18 nt, Homo sapiens
aagcggagguugcaggga

SEQ ID NO: 1089222 - RNA, 12 nt, Homo sapiens
aagcgugcugcc

SEQ ID NO: 1089223 - RNA, 22 nt, Homo sapiens
aagcugggacucauucacauuu

SEQ ID NO: 1089224 - RNA, 19 nt, Homo sapiens
aagcugguuaaaguggaug

SEQ ID NO: 1089225 - RNA, 19 nt, Homo sapiens
aagcuuauuuagcacauuu

SEQ ID NO: 1089226 - RNA, 19 nt, Homo sapiens
aaggaagauguaagaagcu

SEQ ID NO: 1089227 - RNA, 14 nt, Homo sapiens
aaggagaaaaugca

SEQ ID NO: 1089228 - RNA, 15 nt, Homo sapiens
aaggagaaaaugcau

SEQ ID NO: 1089229 - RNA, 18 nt, Homo sapiens
aaggauggaaagggaaug

SEQ ID NO: 1089230 - RNA, 18 nt, Homo sapiens
aaggauggagccagcucu

SEQ ID NO: 1089231 - RNA, 17 nt, Homo sapiens
aaggauuuuaccaaagc

SEQ ID NO: 1089232 - RNA, 17 nt, Homo sapiens
aaggcaguucugugucc

SEQ ID NO: 1089233 - RNA, 17 nt, Homo sapiens
aaggccucccacaguga

SEQ ID NO: 1089234 - RNA, 15 nt, Homo sapiens
aagggaaaauuagcu

SEQ ID NO: 1089235 - RNA, 23 nt, Homo sapiens
aagggggcuccaugcuggugugg

SEQ ID NO: 1089236 - RNA, 22 nt, Homo sapiens
aaggucccgaggaugcugucag

SEQ ID NO: 1089237 - RNA, 17 nt, Homo sapiens
aaggucucacacuccuc

SEQ ID NO: 1089238 - RNA, 16 nt, Homo sapiens
aagguuucacuguuca

SEQ ID NO: 1089239 - RNA, 15 nt, Homo sapiens
aagguuucccaguga

SEQ ID NO: 1089240 - RNA, 18 nt, Homo sapiens
aaguaacucccacuccua

SEQ ID NO: 1089241 - RNA, 19 nt, Homo sapiens
aaguaacugugguuuacua

SEQ ID NO: 1089242 - RNA, 17 nt, Homo sapiens
auuuuacuuccaugaua

SEQ ID NO: 1089243 - RNA, 18 nt, Homo sapiens
auuuuacuuccaugauac

SEQ ID NO: 1089244 - RNA, 22 nt, Homo sapiens
auuuucauauugcuaccaaaaa

SEQ ID NO: 1089245 - RNA, 14 nt, Homo sapiens
auuuucuugucaau

SEQ ID NO: 1089246 - RNA, 19 nt, Homo sapiens
auuuucuuucauacauuau

SEQ ID NO: 1089247 - RNA, 22 nt, Homo sapiens
auuuucuuugagcagguuuaca

SEQ ID NO: 1089248 - RNA, 12 nt, Homo sapiens
auuuugcauuag

SEQ ID NO: 1089249 - RNA, 19 nt, Homo sapiens
auuuuggaaaaaugucacu

SEQ ID NO: 1089250 - RNA, 15 nt, Homo sapiens
auuuuggacguguga

SEQ ID NO: 1089251 - RNA, 17 nt, Homo sapiens
auuuuuaaaggacaaac

SEQ ID NO: 1089252 - RNA, 17 nt, Homo sapiens
auuuuuguuagcaaaga

SEQ ID NO: 1089253 - RNA, 16 nt, Homo sapiens
auuuuuuuaaaacaca

SEQ ID NO: 1089254 - RNA, 22 nt, Homo sapiens
caaaaagaauuccaaccgacca

SEQ ID NO: 1089255 - RNA, 21 nt, Homo sapiens
caaaaucaggcuuugucugcu

SEQ ID NO: 1089256 - RNA, 19 nt, Homo sapiens
caaaauccagaaguuuaaa

SEQ ID NO: 1089257 - RNA, 19 nt, Homo sapiens
caaacgggcugcccugcca

SEQ ID NO: 1089258 - RNA, 17 nt, Homo sapiens
caaagaaaagacauuga

SEQ ID NO: 1089259 - RNA, 13 nt, Homo sapiens
caaagaaauuucc

SEQ ID NO: 1089260 - RNA, 21 nt, Homo sapiens
caaagaacugccccaucuccu

SEQ ID NO: 1089261 - RNA, 11 nt, Homo sapiens
caaagaucuca

SEQ ID NO: 1089262 - RNA, 21 nt, Homo sapiens
caaagauuaaaugugucauug

SEQ ID NO: 1089263 - RNA, 21 nt, Homo sapiens
caaagccuuggucccgugaaa

SEQ ID NO: 1089264 - RNA, 19 nt, Homo sapiens
caaagugcugggauuacag

SEQ ID NO: 1089265 - RNA, 22 nt, Homo sapiens
caaauacauacaaccuauguaa

SEQ ID NO: 1089266 - RNA, 17 nt, Homo sapiens
caaauccacaagccauu

SEQ ID NO: 1089267 - RNA, 16 nt, Homo sapiens
caaauccccuccccaa

SEQ ID NO: 1089268 - RNA, 15 nt, Homo sapiens
caaauggcuuacuua

SEQ ID NO: 1089269 - RNA, 18 nt, Homo sapiens
caaaugugucccagugaa

SEQ ID NO: 1089270 - RNA, 19 nt, Homo sapiens
caaauuauuuuuaucuuuc

SEQ ID NO: 1089271 - RNA, 13 nt, Homo sapiens
caacaauacaugc

SEQ ID NO: 1089272 - RNA, 19 nt, Homo sapiens
caacaauacaugcugcuaa

SEQ ID NO: 1089273 - RNA, 12 nt, Homo sapiens
caacaccaaaaa

SEQ ID NO: 1089274 - RNA, 13 nt, Homo sapiens
caacagagcaaaa

SEQ ID NO: 1089275 - RNA, 16 nt, Homo sapiens
caacagugaacagcuu

SEQ ID NO: 1089276 - RNA, 17 nt, Homo sapiens
caaccccccaccugcca

SEQ ID NO: 1089277 - RNA, 20 nt, Homo sapiens
caaccuguugaauuuacucu

SEQ ID NO: 1089278 - RNA, 18 nt, Homo sapiens
caacucacgggugcauga

SEQ ID NO: 1089279 - RNA, 23 nt, Homo sapiens
caacuuauuguauuccucauguc

SEQ ID NO: 1089280 - RNA, 15 nt, Homo sapiens
caacuuucauuugaa

SEQ ID NO: 1089281 - RNA, 16 nt, Homo sapiens
caagacuucacugcag

SEQ ID NO: 1089282 - RNA, 16 nt, Homo sapiens
caagaggcuggaaaag

SEQ ID NO: 1089283 - RNA, 12 nt, Homo sapiens
caagaugaaaca

SEQ ID NO: 1089284 - RNA, 14 nt, Homo sapiens
caagccccacugag

SEQ ID NO: 1089285 - RNA, 15 nt, Homo sapiens
caagcucccugguga

SEQ ID NO: 1089286 - RNA, 22 nt, Homo sapiens
caaggacuuggacccaugacuc

SEQ ID NO: 1089287 - RNA, 20 nt, Homo sapiens
caaggcaguucuguguccuc

SEQ ID NO: 1089288 - RNA, 20 nt, Homo sapiens
caagguauguacaguucaua

SEQ ID NO: 1089289 - RNA, 18 nt, Homo sapiens
caaggugcacagaccuca

SEQ ID NO: 1089290 - RNA, 22 nt, Homo sapiens
caaggugcacagaccucagaga

SEQ ID NO: 1089291 - RNA, 16 nt, Homo sapiens
caagguuucccaguga

SEQ ID NO: 1089292 - RNA, 15 nt, Homo sapiens
caaguagcacccugg

SEQ ID NO: 1089293 - RNA, 15 nt, Homo sapiens
caaguagcugagauu

SEQ ID NO: 1089294 - RNA, 19 nt, Homo sapiens
caaguagcugagauuacag

SEQ ID NO: 1089295 - RNA, 13 nt, Homo sapiens
caagucugugaaa

SEQ ID NO: 1089296 - RNA, 20 nt, Homo sapiens
caaguguaaccuugcaucuc

SEQ ID NO: 1089297 - RNA, 16 nt, Homo sapiens
caauaauaaauccuca

SEQ ID NO: 1089298 - RNA, 14 nt, Homo sapiens
caauagaaauccaa

SEQ ID NO: 1089299 - RNA, 19 nt, Homo sapiens
caauaguggauaacaugua

SEQ ID NO: 1089300 - RNA, 16 nt, Homo sapiens
caauauuaaaugacuu

SEQ ID NO: 1089301 - RNA, 23 nt, Homo sapiens
caauccauuuggcagaacugcug

SEQ ID NO: 1089302 - RNA, 18 nt, Homo sapiens
caauccuuuauagcuuug

SEQ ID NO: 1089303 - RNA, 23 nt, Homo sapiens
caaugacuuuuaauuuucacuuu

SEQ ID NO: 1089304 - RNA, 13 nt, Homo sapiens
caaugcagugcag

SEQ ID NO: 1089305 - RNA, 17 nt, Homo sapiens
caaugcagugcagcaug

SEQ ID NO: 1089306 - RNA, 11 nt, Homo sapiens
caaugcuauaa

SEQ ID NO: 1089307 - RNA, 16 nt, Homo sapiens
caauggcacgaucuca

SEQ ID NO: 1089308 - RNA, 22 nt, Homo sapiens
caauuaacuccguuuccaaaua

SEQ ID NO: 1089309 - RNA, 14 nt, Homo sapiens
caauuaacucugga

SEQ ID NO: 1089310 - RNA, 12 nt, Homo sapiens
caauucuucucg

SEQ ID NO: 1089311 - RNA, 15 nt, Homo sapiens
caauuuagcuuacau

SEQ ID NO: 1089312 - RNA, 23 nt, Homo sapiens
caauuuuaauugauuauucugau

SEQ ID NO: 1089313 - RNA, 12 nt, Homo sapiens
cacaccaucucc

SEQ ID NO: 1089314 - RNA, 14 nt, Homo sapiens
cacaccauucuccu

SEQ ID NO: 1089315 - RNA, 23 nt, Homo sapiens
cacaccauugcaugaauucacaa

SEQ ID NO: 1089316 - RNA, 21 nt, Homo sapiens
cuaacucccuccucacacucc

SEQ ID NO: 1089317 - RNA, 14 nt, Homo sapiens
cuaagacaccugca

SEQ ID NO: 1089318 - RNA, 21 nt, Homo sapiens
cuaagccuguugcugaaguca

SEQ ID NO: 1089319 - RNA, 22 nt, Homo sapiens
cuaauaaagaaauaauacccug

SEQ ID NO: 1089320 - RNA, 20 nt, Homo sapiens
cuaauaauaaauuaauaaca

SEQ ID NO: 1089321 - RNA, 18 nt, Homo sapiens
cuaauaucuuaaugaaua

SEQ ID NO: 1089322 - RNA, 13 nt, Homo sapiens
cuaaucauaacau

SEQ ID NO: 1089323 - RNA, 23 nt, Homo sapiens
cuaaugugccccauguccaaguc

SEQ ID NO: 1089324 - RNA, 22 nt, Homo sapiens
cuaauuccuggcaugacacucu

SEQ ID NO: 1089325 - RNA, 17 nt, Homo sapiens
cuaccuuuguccaggcc

SEQ ID NO: 1089326 - RNA, 15 nt, Homo sapiens
cuacuagagcuccau

SEQ ID NO: 1089327 - RNA, 15 nt, Homo sapiens
cuacuuguaaaggug

SEQ ID NO: 1089328 - RNA, 15 nt, Homo sapiens
cuagaaaucugccaa

SEQ ID NO: 1089329 - RNA, 19 nt, Homo sapiens
cuagagcuccauuucuacu

SEQ ID NO: 1089330 - RNA, 18 nt, Homo sapiens
cuagagugacaggcacca

SEQ ID NO: 1089331 - RNA, 12 nt, Homo sapiens
cuagagugcagu

SEQ ID NO: 1089332 - RNA, 18 nt, Homo sapiens
cuaggccacaccaucucc

SEQ ID NO: 1089333 - RNA, 22 nt, Homo sapiens
cuaguagcuuuccucccaaagg

SEQ ID NO: 1089334 - RNA, 18 nt, Homo sapiens
cuagugacuuccugguga

SEQ ID NO: 1089335 - RNA, 22 nt, Homo sapiens
cuaguugcauuuucauauugcu

SEQ ID NO: 1089336 - RNA, 13 nt, Homo sapiens
cuaguugugauca

SEQ ID NO: 1089337 - RNA, 18 nt, Homo sapiens
cuaucaaucaccuugcau

SEQ ID NO: 1089338 - RNA, 21 nt, Homo sapiens
cuauggcccagccacugcagc

SEQ ID NO: 1089339 - RNA, 19 nt, Homo sapiens
cuauucaggaggcugaggc

SEQ ID NO: 1089340 - RNA, 17 nt, Homo sapiens
cuauuuaacuugagggu

SEQ ID NO: 1089341 - RNA, 21 nt, Homo sapiens
cuauuuuaauaaagauucuau

SEQ ID NO: 1089342 - RNA, 16 nt, Homo sapiens
cuauuuuggacgugug

SEQ ID NO: 1089343 - RNA, 21 nt, Homo sapiens
cucaaggaaaagaugugcucc

SEQ ID NO: 1089344 - RNA, 23 nt, Homo sapiens
cucaaggaaaagaugugcuccca

SEQ ID NO: 1089345 - RNA, 17 nt, Homo sapiens
cucaaucacugcucccc

SEQ ID NO: 1089346 - RNA, 19 nt, Homo sapiens
cucacacgggguauuuuag

SEQ ID NO: 1089347 - RNA, 14 nt, Homo sapiens
cucacacuacuuga

SEQ ID NO: 1089348 - RNA, 18 nt, Homo sapiens
cucacgccuaugauccca

SEQ ID NO: 1089349 - RNA, 23 nt, Homo sapiens
cucacuauucaaguauuaggggu

SEQ ID NO: 1089350 - RNA, 13 nt, Homo sapiens
cucacucugucac

SEQ ID NO: 1089351 - RNA, 12 nt, Homo sapiens
cucacugccaaa

SEQ ID NO: 1089352 - RNA, 14 nt, Homo sapiens
cucagagcugcuga

SEQ ID NO: 1089353 - RNA, 14 nt, Homo sapiens
cucagaguccaguc

SEQ ID NO: 1089354 - RNA, 19 nt, Homo sapiens
cucagauccugggcaugau

SEQ ID NO: 1089355 - RNA, 14 nt, Homo sapiens
cucagcagccagcu

SEQ ID NO: 1089356 - RNA, 21 nt, Homo sapiens
cucagccagaaagaugcccua

SEQ ID NO: 1089357 - RNA, 20 nt, Homo sapiens
cucagccucccgaguagcug

SEQ ID NO: 1089358 - RNA, 18 nt, Homo sapiens
cucagcuucugggggaga

SEQ ID NO: 1089359 - RNA, 13 nt, Homo sapiens
cucaggagacaau

SEQ ID NO: 1089360 - RNA, 23 nt, Homo sapiens
cuuugcugaaugucauuauuuga

SEQ ID NO: 1089361 - RNA, 19 nt, Homo sapiens
cuuuguauuacaacaugaa

SEQ ID NO: 1089362 - RNA, 19 nt, Homo sapiens
cuuuguucacuagacugug

SEQ ID NO: 1089363 - RNA, 14 nt, Homo sapiens
cuuuguucuuguca

SEQ ID NO: 1089364 - RNA, 18 nt, Homo sapiens
cuuuuacauacagugaua

SEQ ID NO: 1089365 - RNA, 15 nt, Homo sapiens
cuuuuuaaacagugu

SEQ ID NO: 1089366 - RNA, 18 nt, Homo sapiens
gaaaagcacaaucaacuu

SEQ ID NO: 1089367 - RNA, 22 nt, Homo sapiens
gaaaaugcaggagagcuucccc

SEQ ID NO: 1089368 - RNA, 18 nt, Homo sapiens
gaaacaaaaaaguguucc

SEQ ID NO: 1089369 - RNA, 18 nt, Homo sapiens
gaaacagggcaccccagc

SEQ ID NO: 1089370 - RNA, 15 nt, Homo sapiens
gaaagaaaaugaauu

SEQ ID NO: 1089371 - RNA, 18 nt, Homo sapiens
gaaagcaucaccucaggc

SEQ ID NO: 1089372 - RNA, 19 nt, Homo sapiens
gaaaggauuuuaccaaagc

SEQ ID NO: 1089373 - RNA, 22 nt, Homo sapiens
gaaaggguucagggcaugggga

SEQ ID NO: 1089374 - RNA, 19 nt, Homo sapiens
gaaagucaugcacauaccu

SEQ ID NO: 1089375 - RNA, 22 nt, Homo sapiens
gaaauaaaaucuaauuaauucu

SEQ ID NO: 1089376 - RNA, 15 nt, Homo sapiens
gaaaucacaagaaca

SEQ ID NO: 1089377 - RNA, 14 nt, Homo sapiens
gaaauucuguggug

SEQ ID NO: 1089378 - RNA, 21 nt, Homo sapiens
gaaauuuuuuuccagaauuga

SEQ ID NO: 1089379 - RNA, 16 nt, Homo sapiens
gaacaaagagagcuca

SEQ ID NO: 1089380 - RNA, 16 nt, Homo sapiens
gaacaauucucucuua

SEQ ID NO: 1089381 - RNA, 14 nt, Homo sapiens
gaacacgcuuucac

SEQ ID NO: 1089382 - RNA, 14 nt, Homo sapiens
gaacacguggguau

SEQ ID NO: 1089383 - RNA, 17 nt, Homo sapiens
gaacauguguguguguu

SEQ ID NO: 1089384 - RNA, 22 nt, Homo sapiens
gaacauugggaaggaagcccgc

SEQ ID NO: 1089385 - RNA, 12 nt, Homo sapiens
gaaccaauaaug

SEQ ID NO: 1089386 - RNA, 13 nt, Homo sapiens
gaaccuuuccucu

SEQ ID NO: 1089387 - RNA, 21 nt, Homo sapiens
gaacucaucccuguuccucaa

SEQ ID NO: 1089388 - RNA, 17 nt, Homo sapiens
gaacucugaauaugccu

SEQ ID NO: 1089389 - RNA, 16 nt, Homo sapiens
gaacucugcaacugaa

SEQ ID NO: 1089390 - RNA, 17 nt, Homo sapiens
gaacugccccaucuccu

SEQ ID NO: 1089391 - RNA, 17 nt, Homo sapiens
gaacugcgugccagugu

SEQ ID NO: 1089392 - RNA, 20 nt, Homo sapiens
gaagaacuugucccucaggc

SEQ ID NO: 1089393 - RNA, 16 nt, Homo sapiens
gaagaucugcuucccu

SEQ ID NO: 1089394 - RNA, 13 nt, Homo sapiens
gaagcauccuccc

SEQ ID NO: 1089395 - RNA, 11 nt, Homo sapiens
gaagcauguac

SEQ ID NO: 1089396 - RNA, 21 nt, Homo sapiens
gaagcauguacuguacuuccc

SEQ ID NO: 1089397 - RNA, 13 nt, Homo sapiens
gaagccauauuca

SEQ ID NO: 1089398 - RNA, 16 nt, Homo sapiens
gaagccccaacuguga

SEQ ID NO: 1089399 - RNA, 15 nt, Homo sapiens
gaagcugcuagggga

SEQ ID NO: 1089400 - RNA, 12 nt, Homo sapiens
gaaggagaaaau

SEQ ID NO: 1089401 - RNA, 18 nt, Homo sapiens
gaaggagcaagagaacau

SEQ ID NO: 1089402 - RNA, 15 nt, Homo sapiens
gaagucuacuuuguc

SEQ ID NO: 1089403 - RNA, 13 nt, Homo sapiens
gaagugcagcuca

SEQ ID NO: 1089404 - RNA, 16 nt, Homo sapiens
gaaguguuuccuuacc

SEQ ID NO: 1089405 - RNA, 17 nt, Homo sapiens
gaauaaaauugcacuuu

SEQ ID NO: 1089406 - RNA, 18 nt, Homo sapiens
gaauaaaauuguaaaauu

SEQ ID NO: 1089407 - RNA, 16 nt, Homo sapiens
gaauaaagcccuugaa

SEQ ID NO: 1089408 - RNA, 22 nt, Homo sapiens
gaauauauuugugugugugaua

SEQ ID NO: 1089409 - RNA, 20 nt, Homo sapiens
gaaucaagucagcaacagag

SEQ ID NO: 1089410 - RNA, 16 nt, Homo sapiens
gaaucaagucugugaa

SEQ ID NO: 1089411 - RNA, 14 nt, Homo sapiens
gaaucacuugacuu

SEQ ID NO: 1089412 - RNA, 15 nt, Homo sapiens
gaaucagauucagga

SEQ ID NO: 1089413 - RNA, 21 nt, Homo sapiens
gaaucagauucaggagcucag

SEQ ID NO: 1089414 - RNA, 19 nt, Homo sapiens
gaaugaggaacaaucacaa

SEQ ID NO: 1089415 - RNA, 22 nt, Homo sapiens
gaaugaguuuccagcuaagccu

SEQ ID NO: 1089416 - RNA, 13 nt, Homo sapiens
gaauguucugcug

SEQ ID NO: 1089417 - RNA, 22 nt, Homo sapiens
gaauuagggccccaacuacaca

SEQ ID NO: 1089418 - RNA, 20 nt, Homo sapiens
gaauucacaaacaaauggcu

SEQ ID NO: 1089419 - RNA, 13 nt, Homo sapiens
gaauuccuagcug

SEQ ID NO: 1089420 - RNA, 16 nt, Homo sapiens
gaauuuuuaagcaaau

SEQ ID NO: 1089421 - RNA, 12 nt, Homo sapiens
gacaaacaguga

SEQ ID NO: 1089422 - RNA, 12 nt, Homo sapiens
gacaaagccaaa

SEQ ID NO: 1089423 - RNA, 19 nt, Homo sapiens
gacacaauguugcacugaa

SEQ ID NO: 1089424 - RNA, 20 nt, Homo sapiens
gacacucuagugacuuccug

SEQ ID NO: 1089425 - RNA, 11 nt, Homo sapiens
gacacuguggg

SEQ ID NO: 1089426 - RNA, 15 nt, Homo sapiens
gacagaaaugcaauc

SEQ ID NO: 1089427 - RNA, 19 nt, Homo sapiens
gacaggcaccagaugggau

SEQ ID NO: 1089428 - RNA, 13 nt, Homo sapiens
gacaggguuucac

SEQ ID NO: 1089429 - RNA, 13 nt, Homo sapiens
gacaguggcacua

SEQ ID NO: 1089430 - RNA, 21 nt, Homo sapiens
gacauauguuaggaauacucu

SEQ ID NO: 1089431 - RNA, 17 nt, Homo sapiens
gaccagggccaucuccu

SEQ ID NO: 1089432 - RNA, 17 nt, Homo sapiens
gacccagugugugcuca

SEQ ID NO: 1089433 - RNA, 15 nt, Homo sapiens
gacccucaaugccaa

SEQ ID NO: 1089434 - RNA, 15 nt, Homo sapiens
gaccguuguuaacac

SEQ ID NO: 1089435 - RNA, 14 nt, Homo sapiens
gaccuccacauuaa

SEQ ID NO: 1089436 - RNA, 20 nt, Homo sapiens
gaccucugaaugucccagag

SEQ ID NO: 1089437 - RNA, 14 nt, Homo sapiens
gaccugguacugag

SEQ ID NO: 1089438 - RNA, 20 nt, Homo sapiens
gacggaaaggaaaaacugau

SEQ ID NO: 1089439 - RNA, 23 nt, Homo sapiens
gacggacguugguucugcacuaa

SEQ ID NO: 1089440 - RNA, 21 nt, Homo sapiens
gacggcugcucgaagaacaau

SEQ ID NO: 1089441 - RNA, 15 nt, Homo sapiens
gacgugugaggaugu

SEQ ID NO: 1089442 - RNA, 21 nt, Homo sapiens
gacuacuagagcuccauuucu

SEQ ID NO: 1089443 - RNA, 19 nt, Homo sapiens
gacucaccuugcucugcca

SEQ ID NO: 1089444 - RNA, 20 nt, Homo sapiens
gacucagggacucaggccag

SEQ ID NO: 1089445 - RNA, 18 nt, Homo sapiens
gacuccccccuuccaaau

SEQ ID NO: 1089446 - RNA, 20 nt, Homo sapiens
gacucugcagauagugccuc

SEQ ID NO: 1089447 - RNA, 15 nt, Homo sapiens
gacucuuccaccaga

SEQ ID NO: 1089448 - RNA, 16 nt, Homo sapiens
gacucuuccaccagag

SEQ ID NO: 1089449 - RNA, 13 nt, Homo sapiens
gacuggcucaaga

SEQ ID NO: 1089450 - RNA, 18 nt, Homo sapiens
gacuguccucgcagagaa

SEQ ID NO: 1089451 - RNA, 14 nt, Homo sapiens
gacuucugcaucuu

SEQ ID NO: 1089452 - RNA, 21 nt, Homo sapiens
gacuucugcaucuuacaguca

SEQ ID NO: 1089453 - RNA, 22 nt, Homo sapiens
gacuuuguucacuagacugugc

SEQ ID NO: 1089454 - RNA, 19 nt, Homo sapiens
gacuuuugaagaacaaaag

SEQ ID NO: 1089455 - RNA, 16 nt, Homo sapiens
gacuuuuuuuuugccc

SEQ ID NO: 1089456 - RNA, 21 nt, Homo sapiens
gagaaacuuugaucucugcuu

SEQ ID NO: 1089457 - RNA, 19 nt, Homo sapiens
gagaacgugcccagccaca

SEQ ID NO: 1089458 - RNA, 14 nt, Homo sapiens
gagaaugugaacau

SEQ ID NO: 1089459 - RNA, 17 nt, Homo sapiens
gagacaggauugggcca

SEQ ID NO: 1089460 - RNA, 17 nt, Homo sapiens
gagacuagauucucacc

SEQ ID NO: 1089461 - RNA, 14 nt, Homo sapiens
gagacugcgggaug

SEQ ID NO: 1089462 - RNA, 16 nt, Homo sapiens
gagagaacagggaugc

SEQ ID NO: 1089463 - RNA, 20 nt, Homo sapiens
gagagauggaauaaagcccu

SEQ ID NO: 1089464 - RNA, 21 nt, Homo sapiens
gagaggagggaugcugccuga

SEQ ID NO: 1089465 - RNA, 20 nt, Homo sapiens
gagaguugaccccuccugaa

SEQ ID NO: 1089466 - RNA, 13 nt, Homo sapiens
gagauauuuacau

SEQ ID NO: 1089467 - RNA, 14 nt, Homo sapiens
gagaugacagugau

SEQ ID NO: 1089468 - RNA, 17 nt, Homo sapiens
gagauggaagagucaug

SEQ ID NO: 1089469 - RNA, 15 nt, Homo sapiens
gagcagcacuggggu

SEQ ID NO: 1089470 - RNA, 16 nt, Homo sapiens
gagcagcuucugccac

SEQ ID NO: 1089471 - RNA, 20 nt, Homo sapiens
gagccaugucaugugccacg

SEQ ID NO: 1089472 - RNA, 22 nt, Homo sapiens
gagcgagaaccaggcugcugca

SEQ ID NO: 1089473 - RNA, 18 nt, Homo sapiens
gagcguuuguucccccau

SEQ ID NO: 1089474 - RNA, 17 nt, Homo sapiens
gagcuguggacuuuguu

SEQ ID NO: 1089475 - RNA, 15 nt, Homo sapiens
gaggacuucugcauc

SEQ ID NO: 1089476 - RNA, 22 nt, Homo sapiens
gaggagggaugcugccugaguc

SEQ ID NO: 1089477 - RNA, 15 nt, Homo sapiens
gaggcaaaggccagc

SEQ ID NO: 1089478 - RNA, 18 nt, Homo sapiens
gaggcuagucucuucuca

SEQ ID NO: 1089479 - RNA, 15 nt, Homo sapiens
gaggcugcaguuccc

SEQ ID NO: 1089480 - RNA, 18 nt, Homo sapiens
gaggucaagauuucagga

SEQ ID NO: 1089481 - RNA, 15 nt, Homo sapiens
gaggugacuugccug

SEQ ID NO: 1089482 - RNA, 23 nt, Homo sapiens
gaggugacuugccuggggccaca

SEQ ID NO: 1089483 - RNA, 14 nt, Homo sapiens
gagguugcagggag

SEQ ID NO: 1089484 - RNA, 19 nt, Homo sapiens
gagguugggcugagacccu

SEQ ID NO: 1089485 - RNA, 20 nt, Homo sapiens
ugccuucgguuuguauuuag

SEQ ID NO: 1089486 - RNA, 15 nt, Homo sapiens
ugccuugaagccacu

SEQ ID NO: 1089487 - RNA, 20 nt, Homo sapiens
ugcgcagucauuggcccaac

SEQ ID NO: 1089488 - RNA, 15 nt, Homo sapiens
ugcgcuaacacuguc

SEQ ID NO: 1089489 - RNA, 21 nt, Homo sapiens
ugcguaggagagaacagggau

SEQ ID NO: 1089490 - RNA, 22 nt, Homo sapiens
ugcgucagaccaguacugggaa

SEQ ID NO: 1089491 - RNA, 17 nt, Homo sapiens
ugcuaauucaaagcucu

SEQ ID NO: 1089492 - RNA, 13 nt, Homo sapiens
ugcuaccaaaaac

SEQ ID NO: 1089493 - RNA, 19 nt, Homo sapiens
ugcuauaauauauaaugaa

SEQ ID NO: 1089494 - RNA, 20 nt, Homo sapiens
ugcuaucucgcuagccauau

SEQ ID NO: 1089495 - RNA, 17 nt, Homo sapiens
ugcuaugucucuaucca

SEQ ID NO: 1089496 - RNA, 15 nt, Homo sapiens
ugcucagugaucuca

SEQ ID NO: 1089497 - RNA, 20 nt, Homo sapiens
ugcuccauuuucuugucaau

SEQ ID NO: 1089498 - RNA, 16 nt, Homo sapiens
ugcuccugugcaggga

SEQ ID NO: 1089499 - RNA, 20 nt, Homo sapiens
ugcugaaugucauuauuuga

SEQ ID NO: 1089500 - RNA, 17 nt, Homo sapiens
ugcugcauggcacugac

SEQ ID NO: 1089501 - RNA, 21 nt, Homo sapiens
ugcugcccagggucaguguau

SEQ ID NO: 1089502 - RNA, 22 nt, Homo sapiens
ugcugccucccuuucauacaau

SEQ ID NO: 1089503 - RNA, 19 nt, Homo sapiens
ugcuggaagaacugcaugg

SEQ ID NO: 1089504 - RNA, 15 nt, Homo sapiens
ugcuggcccacagcu

SEQ ID NO: 1089505 - RNA, 21 nt, Homo sapiens
ugcuggcccacagcucugcug

SEQ ID NO: 1089506 - RNA, 11 nt, Homo sapiens
ugcugugcaaa

SEQ ID NO: 1089507 - RNA, 15 nt, Homo sapiens
ugcuuuaucagggga

SEQ ID NO: 1089508 - RNA, 20 nt, Homo sapiens
ugcuuucccacccugggcaa

SEQ ID NO: 1089509 - RNA, 22 nt, Homo sapiens
uggaaacaugcuguacuaaaau

SEQ ID NO: 1089510 - RNA, 14 nt, Homo sapiens
uggaauaaagcccu

SEQ ID NO: 1089511 - RNA, 17 nt, Homo sapiens
uggaauaaagcccuuga

SEQ ID NO: 1089512 - RNA, 17 nt, Homo sapiens
uggaauuuguaaguuua

SEQ ID NO: 1089513 - RNA, 24 nt, Homo sapiens
uggacaucauguuuucuggugaug

SEQ ID NO: 1089514 - RNA, 13 nt, Homo sapiens
uggacaugauuua

SEQ ID NO: 1089515 - RNA, 22 nt, Homo sapiens
uggacguacugguuuaaccucc

SEQ ID NO: 1089516 - RNA, 17 nt, Homo sapiens
uggagccgggaaagcug

SEQ ID NO: 1089517 - RNA, 18 nt, Homo sapiens
uuccuagucauaauguca

SEQ ID NO: 1089518 - RNA, 17 nt, Homo sapiens
uuccugccuagucucac

SEQ ID NO: 1089519 - RNA, 11 nt, Homo sapiens
uuccuggaccg

SEQ ID NO: 1089520 - RNA, 21 nt, Homo sapiens
uuccuugauggagauauuuac

SEQ ID NO: 1089521 - RNA, 21 nt, Homo sapiens
uucuacagacaucauguuacu

SEQ ID NO: 1089522 - RNA, 20 nt, Homo sapiens
uucucgugguagaagccagu

SEQ ID NO: 1089523 - RNA, 17 nt, Homo sapiens
uucucuuggacauugua

SEQ ID NO: 1089524 - RNA, 14 nt, Homo sapiens
uucugccacuuccc

SEQ ID NO: 1089525 - RNA, 17 nt, Homo sapiens
uucugccugagauucuu

SEQ ID NO: 1089526 - RNA, 22 nt, Homo sapiens
uucuguuugaaugcggaaccau

SEQ ID NO: 1089527 - RNA, 18 nt, Homo sapiens
uucuuacagacugcaugu

SEQ ID NO: 1089528 - RNA, 16 nt, Homo sapiens
uucuugaaccaauaau

SEQ ID NO: 1089529 - RNA, 14 nt, Homo sapiens
uugaaaccuuugac

SEQ ID NO: 1089530 - RNA, 12 nt, Homo sapiens
uugaaagacauc

SEQ ID NO: 1089531 - RNA, 15 nt, Homo sapiens
uugaaagacaucaau

SEQ ID NO: 1089532 - RNA, 21 nt, Homo sapiens
uugaaggagaaaaugcauuau

SEQ ID NO: 1089533 - RNA, 21 nt, Homo sapiens
uugaaguaggaaguaggaaau

SEQ ID NO: 1089534 - RNA, 18 nt, Homo sapiens
uugaaugcggaaccauag

SEQ ID NO: 1089535 - RNA, 13 nt, Homo sapiens
uugaccaugugau

SEQ ID NO: 1089536 - RNA, 16 nt, Homo sapiens
uugacuggcucaagaa

SEQ ID NO: 1089537 - RNA, 13 nt, Homo sapiens
uugacuuugccac

SEQ ID NO: 1089538 - RNA, 20 nt, Homo sapiens
uugacuuugccacauccauu

SEQ ID NO: 1089539 - RNA, 21 nt, Homo sapiens
uugagcuagaaaucacaagaa

SEQ ID NO: 1089540 - RNA, 20 nt, Homo sapiens
uugagggucguuuugacuac

SEQ ID NO: 1089541 - RNA, 15 nt, Homo sapiens
uugauggagccugaa

SEQ ID NO: 1089542 - RNA, 23 nt, Homo sapiens
uugauuauucugauuccacuuuu

SEQ ID NO: 1089543 - RNA, 19 nt, Homo sapiens
uugauuuaauaucugagaa

SEQ ID NO: 1089544 - RNA, 17 nt, Homo sapiens
uugcagugaacugagac

SEQ ID NO: 1089545 - RNA, 18 nt, Homo sapiens
uugccaggcuugucaaau

SEQ ID NO: 1089546 - RNA, 21 nt, Homo sapiens
uugcccaggcuggagugcaau

SEQ ID NO: 1089547 - RNA, 18 nt, Homo sapiens
uugccccuuccacuuuga

SEQ ID NO: 1089548 - RNA, 22 nt, Homo sapiens
uugccuggggccacauagcuca

SEQ ID NO: 1089549 - RNA, 22 nt, Homo sapiens
uugccuuccugccuagucucac

SEQ ID NO: 1089550 - RNA, 23 nt, Homo sapiens
uugcgcaaacuuuaacagguuuu

SEQ ID NO: 1089551 - RNA, 22 nt, Homo sapiens
uugcuguaacucagacauucca

SEQ ID NO: 1089552 - RNA, 23 nt, Homo sapiens
uuggaaagcaucaccucaggcca

SEQ ID NO: 1089553 - RNA, 21 nt, Homo sapiens
uuggacaacuagccucaucuc

SEQ ID NO: 1089554 - RNA, 19 nt, Homo sapiens
uuggauacgacaacuugca

SEQ ID NO: 1089555 - RNA, 18 nt, Homo sapiens
uuggcaucuugcugcuaa

SEQ ID NO: 1089556 - RNA, 22 nt, Homo sapiens
uugggcaggagucaccaugcaa

SEQ ID NO: 1089557 - RNA, 19 nt, Homo sapiens
uugguauaucuggccacac

SEQ ID NO: 1089558 - RNA, 12 nt, Homo sapiens
uuguaaauacuc

SEQ ID NO: 1089559 - RNA, 18 nt, Homo sapiens
uuguacaaagauaugcua

SEQ ID NO: 1089560 - RNA, 19 nt, Homo sapiens
uuguagaaaugagccagaa

SEQ ID NO: 1089561 - RNA, 22 nt, Homo sapiens
uugucaaauagcaaggccaggg

SEQ ID NO: 1089562 - RNA, 16 nt, Homo sapiens
uuguccuucagccaaa

SEQ ID NO: 1089563 - RNA, 22 nt, Homo sapiens
uuguguccauugaugucauuca

SEQ ID NO: 1089564 - RNA, 12 nt, Homo sapiens
uuuaaaagucac

SEQ ID NO: 1089565 - RNA, 12 nt, Homo sapiens
uuuaaacagugu

SEQ ID NO: 1089566 - RNA, 13 nt, Homo sapiens
uuuaaaggacaaa

SEQ ID NO: 1089567 - RNA, 13 nt, Homo sapiens
uuuaaagucagau

SEQ ID NO: 1089568 - RNA, 17 nt, Homo sapiens
uuuaaaugaaagugaga

SEQ ID NO: 1089569 - RNA, 12 nt, Homo sapiens
uuuaaggcagca

SEQ ID NO: 1089570 - RNA, 14 nt, Homo sapiens
uuuacagacuguga

SEQ ID NO: 1089571 - RNA, 11 nt, Homo sapiens
uuuaccaaagc

SEQ ID NO: 1089572 - RNA, 18 nt, Homo sapiens
uuuagaaucaagucugug

SEQ ID NO: 1089573 - RNA, 14 nt, Homo sapiens
uuuauacauaaaca

SEQ ID NO: 1089574 - RNA, 14 nt, Homo sapiens
uuuauagucucaaa

SEQ ID NO: 1089575 - RNA, 18 nt, Homo sapiens
uuuauagucucaaaucaa

SEQ ID NO: 1089576 - RNA, 22 nt, Homo sapiens
uuuauauaaagaaaaucaauga

SEQ ID NO: 1089577 - RNA, 18 nt, Homo sapiens
uuuauaucuuuaugcaaa

SEQ ID NO: 1089578 - RNA, 22 nt, Homo sapiens
uuuauccacagaaacauuuuca

SEQ ID NO: 1089579 - RNA, 16 nt, Homo sapiens
uuuauucccccaaagc

SEQ ID NO: 1089580 - RNA, 12 nt, Homo sapiens
uuucaagagauc

SEQ ID NO: 1089581 - RNA, 17 nt, Homo sapiens
uuucaccguauuagcca

SEQ ID NO: 1089582 - RNA, 15 nt, Homo sapiens
uuucacuguucauga

SEQ ID NO: 1089583 - RNA, 13 nt, Homo sapiens
uuucauacauuau

SEQ ID NO: 1089584 - RNA, 22 nt, Homo sapiens
uuucauacauuauauuccucua

SEQ ID NO: 1089585 - RNA, 20 nt, Homo sapiens
uuucauauuuauggacauga

SEQ ID NO: 1089586 - RNA, 18 nt, Homo sapiens
uuucauuucuaacauaag

SEQ ID NO: 1089587 - RNA, 19 nt, Homo sapiens
uuuccaaagggcaguaaag

SEQ ID NO: 1089588 - RNA, 22 nt, Homo sapiens
uuuccaauccuuuauagcuuug

SEQ ID NO: 1089589 - RNA, 21 nt, Homo sapiens
uuuccacauaaagguauuuag

SEQ ID NO: 1089590 - RNA, 21 nt, Homo sapiens
uuuccacugccaaaacaaugc

SEQ ID NO: 1089591 - RNA, 19 nt, Homo sapiens
uuucccaccucaccugaga

SEQ ID NO: 1089592 - RNA, 19 nt, Homo sapiens
uuucuacuguauaaacaaa

SEQ ID NO: 1089593 - RNA, 21 nt, Homo sapiens
uuucuucauuucucuugcuca

SEQ ID NO: 1089594 - RNA, 13 nt, Homo sapiens
uuucuuuccaaaa

SEQ ID NO: 1089595 - RNA, 13 nt, Homo sapiens
uuugaaaugucau

SEQ ID NO: 1089596 - RNA, 15 nt, Homo sapiens
uuugauucagcaaaa

SEQ ID NO: 1089597 - RNA, 12 nt, Homo sapiens
uuugccacugga

SEQ ID NO: 1089598 - RNA, 16 nt, Homo sapiens
uuugcugcuguggaaa

SEQ ID NO: 1089599 - RNA, 15 nt, Homo sapiens
uuuggacuucacuua

SEQ ID NO: 1089600 - RNA, 13 nt, Homo sapiens
uuuggcaacagaa

SEQ ID NO: 1089601 - RNA, 19 nt, Homo sapiens
uuuguauaccaugaugcau

SEQ ID NO: 1089602 - RNA, 16 nt, Homo sapiens
uuugucaguaaauacu

SEQ ID NO: 1089603 - RNA, 12 nt, Homo sapiens
uuugucuuuaug

SEQ ID NO: 1089604 - RNA, 14 nt, Homo sapiens
uuuguucacacucc

SEQ ID NO: 1089605 - RNA, 15 nt, Homo sapiens
uuuguucacacuccu

SEQ ID NO: 1089606 - RNA, 16 nt, Homo sapiens
uuuguugagucucuga

SEQ ID NO: 1089607 - RNA, 13 nt, Homo sapiens
uuuuaaacauucu

SEQ ID NO: 1089608 - RNA, 14 nt, Homo sapiens
uuuuaaacauucuu

SEQ ID NO: 1089609 - RNA, 12 nt, Homo sapiens
uuuuaaagucag

SEQ ID NO: 1089610 - RNA, 14 nt, Homo sapiens
uuuuaagcuguaaa

SEQ ID NO: 1089611 - RNA, 21 nt, Homo sapiens
uuuuaaucuuccauuccuuca

SEQ ID NO: 1089612 - RNA, 14 nt, Homo sapiens
aaaaaguauaggau

SEQ ID NO: 1089613 - RNA, 16 nt, Homo sapiens
aaaaaucucccaguga

SEQ ID NO: 1089614 - RNA, 14 nt, Homo sapiens
aaaaaugugacuca

SEQ ID NO: 1089615 - RNA, 17 nt, Homo sapiens
aaaaaugugacucaaga

SEQ ID NO: 1089616 - RNA, 18 nt, Homo sapiens
aaaacacucgugugccca

SEQ ID NO: 1089617 - RNA, 18 nt, Homo sapiens
aaaaccccaucucuacua

SEQ ID NO: 1089618 - RNA, 18 nt, Homo sapiens
aaaaccugagcagcaacu

SEQ ID NO: 1089619 - RNA, 21 nt, Homo sapiens
aaaaccuugaaaccuuugaca

SEQ ID NO: 1089620 - RNA, 17 nt, Homo sapiens
aaaacucucaagcagac

SEQ ID NO: 1089621 - RNA, 15 nt, Homo sapiens
aaaagauuauauauc

SEQ ID NO: 1089622 - RNA, 14 nt, Homo sapiens
aaaaguauauauuc

SEQ ID NO: 1089623 - RNA, 15 nt, Homo sapiens
aaaaguuuuguaaau

SEQ ID NO: 1089624 - RNA, 21 nt, Homo sapiens
aaaaguuuuguaaauuucucu

SEQ ID NO: 1089625 - RNA, 21 nt, Homo sapiens
aaaauacaauuaaagcaaaau

SEQ ID NO: 1089626 - RNA, 22 nt, Homo sapiens
aaaauacucuuaaguugaucua

SEQ ID NO: 1089627 - RNA, 21 nt, Homo sapiens
aaaauaugugcuugaaaugag

SEQ ID NO: 1089628 - RNA, 21 nt, Homo sapiens
agcuggcagccuccaguggga

SEQ ID NO: 1089629 - RNA, 23 nt, Homo sapiens
agcuggcucuccaccuuguuaca

SEQ ID NO: 1089630 - RNA, 20 nt, Homo sapiens
agcuucccucugccugaccc

SEQ ID NO: 1089631 - RNA, 21 nt, Homo sapiens
agcuuccugucaacacuucuc

SEQ ID NO: 1089632 - RNA, 18 nt, Homo sapiens
agcuucugccacuuccca

SEQ ID NO: 1089633 - RNA, 14 nt, Homo sapiens
agcuuuugcuucau

SEQ ID NO: 1089634 - RNA, 14 nt, Homo sapiens
aggaaaaccaugac

SEQ ID NO: 1089635 - RNA, 18 nt, Homo sapiens
aggaaagcaccgcagcau

SEQ ID NO: 1089636 - RNA, 22 nt, Homo sapiens
aggaaagccaaauuuuauuaaa

SEQ ID NO: 1089637 - RNA, 12 nt, Homo sapiens
aggaauacucuu

SEQ ID NO: 1089638 - RNA, 17 nt, Homo sapiens
aggacaaacagugaauu

SEQ ID NO: 1089639 - RNA, 12 nt, Homo sapiens
aggagaugucau

SEQ ID NO: 1089640 - RNA, 18 nt, Homo sapiens
aggagaugucaucaagcu

SEQ ID NO: 1089641 - RNA, 19 nt, Homo sapiens
aggagauuuuccuuccuac

SEQ ID NO: 1089642 - RNA, 19 nt, Homo sapiens
aagacuguggccugcccag

SEQ ID NO: 1089643 - RNA, 15 nt, Homo sapiens
aagacuucacugcag

SEQ ID NO: 1089644 - RNA, 23 nt, Homo sapiens
aagagagcucaucaucagucuua

SEQ ID NO: 1089645 - RNA, 13 nt, Homo sapiens
aagagaguaccau

SEQ ID NO: 1089646 - RNA, 14 nt, Homo sapiens
aagaggcauuccca

SEQ ID NO: 1089647 - RNA, 12 nt, Homo sapiens
aagagucucucc

SEQ ID NO: 1089648 - RNA, 16 nt, Homo sapiens
aagaugugcucccacc

SEQ ID NO: 1089649 - RNA, 20 nt, Homo sapiens
aagcaauuauugugccucag

SEQ ID NO: 1089650 - RNA, 23 nt, Homo sapiens
aagcaauuuauaucuuuaugcaa

SEQ ID NO: 1089651 - RNA, 15 nt, Homo sapiens
aagcacaaguacuuu

SEQ ID NO: 1089652 - RNA, 23 nt, Homo sapiens
aagcaguuguuauuuagugauau

SEQ ID NO: 1089653 - RNA, 15 nt, Homo sapiens
aagcaucaccucagg

SEQ ID NO: 1089654 - RNA, 16 nt, Homo sapiens
aagccaaacucugcca

SEQ ID NO: 1089655 - RNA, 14 nt, Homo sapiens
aagccaaauuuuau

SEQ ID NO: 1089656 - RNA, 21 nt, Homo sapiens
aagccacagggaagcauguac

SEQ ID NO: 1089657 - RNA, 11 nt, Homo sapiens
aagccacugaa

SEQ ID NO: 1089658 - RNA, 19 nt, Homo sapiens
aagccauguguuccaaggc

SEQ ID NO: 1089659 - RNA, 15 nt, Homo sapiens
aagcccuuuacuuga

SEQ ID NO: 1089660 - RNA, 20 nt, Homo sapiens
aagccucugugucacuggcu

SEQ ID NO: 1089661 - RNA, 12 nt, Homo sapiens
aagccugaugau

SEQ ID NO: 1089662 - RNA, 20 nt, Homo sapiens
aagcgauucuucugccucag

SEQ ID NO: 1089663 - RNA, 15 nt, Homo sapiens
aagcucuaucugcaa

SEQ ID NO: 1089664 - RNA, 17 nt, Homo sapiens
aagcucuauuaagauuu

SEQ ID NO: 1089665 - RNA, 20 nt, Homo sapiens
aaggaaaaacugauguuuaa

SEQ ID NO: 1089666 - RNA, 21 nt, Homo sapiens
aaggacuguaagcagauuaca

SEQ ID NO: 1089667 - RNA, 15 nt, Homo sapiens
aaggauaugauuaau

SEQ ID NO: 1089668 - RNA, 22 nt, Homo sapiens
aaggaucuucccacuuugccac

SEQ ID NO: 1089669 - RNA, 22 nt, Homo sapiens
aaggauuuuaccaaagcaucaa

SEQ ID NO: 1089670 - RNA, 22 nt, Homo sapiens
acuuuuuuuuuuucugccugag

SEQ ID NO: 1089671 - RNA, 17 nt, Homo sapiens
agaaaacuucagagaaa

SEQ ID NO: 1089672 - RNA, 16 nt, Homo sapiens
agaaaaucuuuuacua

SEQ ID NO: 1089673 - RNA, 17 nt, Homo sapiens
agaaacaggcucugaga

SEQ ID NO: 1089674 - RNA, 20 nt, Homo sapiens
agaaagucauagauuucuga

SEQ ID NO: 1089675 - RNA, 12 nt, Homo sapiens
agaaagugaucc

SEQ ID NO: 1089676 - RNA, 13 nt, Homo sapiens
agaaagugaucca

SEQ ID NO: 1089677 - RNA, 17 nt, Homo sapiens
agaaauaauacccugcc

SEQ ID NO: 1089678 - RNA, 15 nt, Homo sapiens
agaaauccaauugga

SEQ ID NO: 1089679 - RNA, 18 nt, Homo sapiens
agaaauuuuacugacaga

SEQ ID NO: 1089680 - RNA, 23 nt, Homo sapiens
agaaauuuucauucagguauuug

SEQ ID NO: 1089681 - RNA, 21 nt, Homo sapiens
agaaauuuuuuuccagaauug

SEQ ID NO: 1089682 - RNA, 19 nt, Homo sapiens
agaacaugaccuccgugua

SEQ ID NO: 1089683 - RNA, 22 nt, Homo sapiens
agaacauggugugugucucuga

SEQ ID NO: 1089684 - RNA, 17 nt, Homo sapiens
agaaccaggcugcugca

SEQ ID NO: 1089685 - RNA, 22 nt, Homo sapiens
agaaggcaugaaauugucuagc

SEQ ID NO: 1089686 - RNA, 22 nt, Homo sapiens
agaaggguuuuccacccuggaa

SEQ ID NO: 1089687 - RNA, 13 nt, Homo sapiens
agaaguacuuugu

SEQ ID NO: 1089688 - RNA, 11 nt, Homo sapiens
agaaguggaag

SEQ ID NO: 1089689 - RNA, 19 nt, Homo sapiens
agaaguuggucuuacuuug

SEQ ID NO: 1089690 - RNA, 15 nt, Homo sapiens
agaaucaagucugug

SEQ ID NO: 1089691 - RNA, 19 nt, Homo sapiens
agacaaaaucuuaaaugcc

SEQ ID NO: 1089692 - RNA, 14 nt, Homo sapiens
agacagauugcuga

SEQ ID NO: 1089693 - RNA, 13 nt, Homo sapiens
agacaucaaugaa

SEQ ID NO: 1089694 - RNA, 22 nt, Homo sapiens
agaccuagcuaaggucuauaaa

SEQ ID NO: 1089695 - RNA, 18 nt, Homo sapiens
agacugcaggguccccaa

SEQ ID NO: 1089696 - RNA, 16 nt, Homo sapiens
agacuugauugguuua

SEQ ID NO: 1089697 - RNA, 22 nt, Homo sapiens
agagaaauuauguuuucaucca

SEQ ID NO: 1089698 - RNA, 13 nt, Homo sapiens
agagagauggaau

SEQ ID NO: 1089699 - RNA, 19 nt, Homo sapiens
agagaucuuucuuuccaaa

SEQ ID NO: 1089700 - RNA, 19 nt, Homo sapiens
agagauggaauaaagcccu

SEQ ID NO: 1089701 - RNA, 23 nt, Homo sapiens
agagauggaauaaagcccuugaa

SEQ ID NO: 1089702 - RNA, 19 nt, Homo sapiens
agagcaagacucugucuca

SEQ ID NO: 1089703 - RNA, 14 nt, Homo sapiens
agagccacuaccuu

SEQ ID NO: 1089704 - RNA, 10 nt, Homo sapiens
agagccucag

SEQ ID NO: 1089705 - RNA, 17 nt, Homo sapiens
agagccuucacaugaaa

SEQ ID NO: 1089706 - RNA, 17 nt, Homo sapiens
agagcgaggaaaggauu

SEQ ID NO: 1089707 - RNA, 23 nt, Homo sapiens
agagcguuuguucccccaugaaa

SEQ ID NO: 1089708 - RNA, 14 nt, Homo sapiens
agagcucaucauca

SEQ ID NO: 1089709 - RNA, 21 nt, Homo sapiens
agagcucaucaucagucuuaa

SEQ ID NO: 1089710 - RNA, 13 nt, Homo sapiens
agagcuccauuuc

SEQ ID NO: 1089711 - RNA, 15 nt, Homo sapiens
agagcuuucaaguac

SEQ ID NO: 1089712 - RNA, 20 nt, Homo sapiens
agaggaaaaaggcuucucca

SEQ ID NO: 1089713 - RNA, 21 nt, Homo sapiens
agaggagugggaaauugauua

SEQ ID NO: 1089714 - RNA, 14 nt, Homo sapiens
agaggcuccugucc

SEQ ID NO: 1089715 - RNA, 21 nt, Homo sapiens
agaggcuggaaaagggcucag

SEQ ID NO: 1089716 - RNA, 19 nt, Homo sapiens
agagguggagguugcagug

SEQ ID NO: 1089717 - RNA, 23 nt, Homo sapiens
agagucauuaagcgggaucccag

SEQ ID NO: 1089718 - RNA, 18 nt, Homo sapiens
agaguucuauuagaagcu

SEQ ID NO: 1089719 - RNA, 17 nt, Homo sapiens
agauagugccucugcaa

SEQ ID NO: 1089720 - RNA, 20 nt, Homo sapiens
agaugcccuaguugugauca

SEQ ID NO: 1089721 - RNA, 19 nt, Homo sapiens
agaugggccugugugcacc

SEQ ID NO: 1089722 - RNA, 11 nt, Homo sapiens
agauugccacu

SEQ ID NO: 1089723 - RNA, 15 nt, Homo sapiens
agauuguaaagguag

SEQ ID NO: 1089724 - RNA, 20 nt, Homo sapiens
agauuucacaggucuugccc

SEQ ID NO: 1089725 - RNA, 22 nt, Homo sapiens
agcaaaguuuucagauuguaaa

SEQ ID NO: 1089726 - RNA, 14 nt, Homo sapiens
agcaacugugcuac

SEQ ID NO: 1089727 - RNA, 14 nt, Homo sapiens
agcaagcagugccc

SEQ ID NO: 1089728 - RNA, 18 nt, Homo sapiens
agcaaggacaaccugccc

SEQ ID NO: 1089729 - RNA, 20 nt, Homo sapiens
agcaaugcuucugccucagc

SEQ ID NO: 1089730 - RNA, 19 nt, Homo sapiens
agcacaggaggcuccguga

SEQ ID NO: 1089731 - RNA, 14 nt, Homo sapiens
agcagaaugcacau

SEQ ID NO: 1089732 - RNA, 22 nt, Homo sapiens
agcagagcccucaugugacaug

SEQ ID NO: 1089733 - RNA, 15 nt, Homo sapiens
agcagaggaguccag

SEQ ID NO: 1089734 - RNA, 15 nt, Homo sapiens
agcagcaacuguguc

SEQ ID NO: 1089735 - RNA, 22 nt, Homo sapiens
agcagcuucugccacuucccag

SEQ ID NO: 1089736 - RNA, 17 nt, Homo sapiens
agcaggcuugugcuuua

SEQ ID NO: 1089737 - RNA, 13 nt, Homo sapiens
agcaguaaacuuu

SEQ ID NO: 1089738 - RNA, 14 nt, Homo sapiens
agcauguacuguac

SEQ ID NO: 1089739 - RNA, 15 nt, Homo sapiens
agcauguacuguacu

SEQ ID NO: 1089740 - RNA, 17 nt, Homo sapiens
agcauuucaaaauggac

SEQ ID NO: 1089741 - RNA, 14 nt, Homo sapiens
agccaaacucugcc

SEQ ID NO: 1089742 - RNA, 15 nt, Homo sapiens
agccaaacucugcca

SEQ ID NO: 1089743 - RNA, 22 nt, Homo sapiens
agccacggaccguugcacaaaa

SEQ ID NO: 1089744 - RNA, 19 nt, Homo sapiens
agccacuuauuuccaugga

SEQ ID NO: 1089745 - RNA, 18 nt, Homo sapiens
agccagcuccugcacaaa

SEQ ID NO: 1089746 - RNA, 22 nt, Homo sapiens
agccaggauggucuugaucucc

SEQ ID NO: 1089747 - RNA, 20 nt, Homo sapiens
agccaguacagagaaauucu

SEQ ID NO: 1089748 - RNA, 18 nt, Homo sapiens
agccauauucacaccuca

SEQ ID NO: 1089749 - RNA, 22 nt, Homo sapiens
agccauauucuaaauucacugu

SEQ ID NO: 1089750 - RNA, 20 nt, Homo sapiens
agccaucccuuuuuuuacau

SEQ ID NO: 1089751 - RNA, 14 nt, Homo sapiens
agcccuuuacuuga

SEQ ID NO: 1089752 - RNA, 15 nt, Homo sapiens
agcccuuuacuugac

SEQ ID NO: 1089753 - RNA, 19 nt, Homo sapiens
agccuaacaugauuauuug

SEQ ID NO: 1089754 - RNA, 23 nt, Homo sapiens
agccucaagucuuauuuccucaa

SEQ ID NO: 1089755 - RNA, 17 nt, Homo sapiens
agccucacagaugcugg

SEQ ID NO: 1089756 - RNA, 17 nt, Homo sapiens
agccucccgaguagcug

SEQ ID NO: 1089757 - RNA, 18 nt, Homo sapiens
agccucccgaguagcugg

SEQ ID NO: 1089758 - RNA, 17 nt, Homo sapiens
agccuccgccauuccaa

SEQ ID NO: 1089759 - RNA, 18 nt, Homo sapiens
agccugggcgacagagca

SEQ ID NO: 1089760 - RNA, 21 nt, Homo sapiens
agccugggcgacagagcaaga

SEQ ID NO: 1089761 - RNA, 21 nt, Homo sapiens
agccuguccugguacagcagg

SEQ ID NO: 1089762 - RNA, 15 nt, Homo sapiens
agccuguugcugaag

SEQ ID NO: 1089763 - RNA, 18 nt, Homo sapiens
agccuugcaucaagggcu

SEQ ID NO: 1089764 - RNA, 18 nt, Homo sapiens
agcgaugaauuuggagac

SEQ ID NO: 1089765 - RNA, 15 nt, Homo sapiens
agcgugaaagcagau

SEQ ID NO: 1089766 - RNA, 19 nt, Homo sapiens
agcgugauuccugcugccu

SEQ ID NO: 1089767 - RNA, 16 nt, Homo sapiens
agcuaagccugaugau

SEQ ID NO: 1089768 - RNA, 16 nt, Homo sapiens
agcuaugaucgcgcca

SEQ ID NO: 1089769 - RNA, 20 nt, Homo sapiens
agcuaugaucgcgccacuac

SEQ ID NO: 1089770 - RNA, 18 nt, Homo sapiens
agcuccugguagcugaug

SEQ ID NO: 1089771 - RNA, 20 nt, Homo sapiens
agcucuauggauuauccacu

SEQ ID NO: 1089772 - RNA, 13 nt, Homo sapiens
agcugaccuggua

SEQ ID NO: 1089773 - RNA, 15 nt, Homo sapiens
agcugaccugguacu

SEQ ID NO: 1089774 - RNA, 17 nt, Homo sapiens
agcugaccugguacuga

SEQ ID NO: 1089775 - RNA, 13 nt, Homo sapiens
agcugaguggcag

SEQ ID NO: 1089776 - RNA, 22 nt, Homo sapiens
cuagaacacccacuggccaguc

SEQ ID NO: 1089777 - RNA, 16 nt, Homo sapiens
cuagagcuccauuucu

SEQ ID NO: 1089778 - RNA, 21 nt, Homo sapiens
cuagagugacaggcaccagau

SEQ ID NO: 1089779 - RNA, 22 nt, Homo sapiens
cuagcauuuucuugaaccaaua

SEQ ID NO: 1089780 - RNA, 17 nt, Homo sapiens
cuaguagaacaauguac

SEQ ID NO: 1089781 - RNA, 23 nt, Homo sapiens
cuaguagcuuuccucccaaaggc

SEQ ID NO: 1089782 - RNA, 17 nt, Homo sapiens
cuaguucuuaugagcua

SEQ ID NO: 1089783 - RNA, 21 nt, Homo sapiens
cuauauuuauuuauguaggau

SEQ ID NO: 1089784 - RNA, 15 nt, Homo sapiens
cuaucgcaccacugu

SEQ ID NO: 1089785 - RNA, 15 nt, Homo sapiens
cuaucuuuuugcuua

SEQ ID NO: 1089786 - RNA, 18 nt, Homo sapiens
cuaugcgcuaguuaggaa

SEQ ID NO: 1089787 - RNA, 15 nt, Homo sapiens
cuauuuaacuugagg

SEQ ID NO: 1089788 - RNA, 17 nt, Homo sapiens
cuauuuuggacguguga

SEQ ID NO: 1089789 - RNA, 17 nt, Homo sapiens
cucaaagaaauuuccac

SEQ ID NO: 1089790 - RNA, 22 nt, Homo sapiens
cucacaucacuguccaccacca

SEQ ID NO: 1089791 - RNA, 17 nt, Homo sapiens
cucaccuguuacugaaa

SEQ ID NO: 1089792 - RNA, 14 nt, Homo sapiens
cucagacauuccaa

SEQ ID NO: 1089793 - RNA, 21 nt, Homo sapiens
cucagacuccuggcuucaugu

SEQ ID NO: 1089794 - RNA, 17 nt, Homo sapiens
cucagcaauagggugca

SEQ ID NO: 1089795 - RNA, 17 nt, Homo sapiens
cucagccuccugaguag

SEQ ID NO: 1089796 - RNA, 23 nt, Homo sapiens
cucaggauuguuucucggcacca

SEQ ID NO: 1089797 - RNA, 12 nt, Homo sapiens
cucaggccaguc

SEQ ID NO: 1089798 - RNA, 14 nt, Homo sapiens
cucagucucaggag

SEQ ID NO: 1089799 - RNA, 12 nt, Homo sapiens
cucaucccaugg

SEQ ID NO: 1089800 - RNA, 15 nt, Homo sapiens
cucaucugacuugaa

SEQ ID NO: 1089801 - RNA, 14 nt, Homo sapiens
cucaucugcuccua

SEQ ID NO: 1089802 - RNA, 16 nt, Homo sapiens
cucaugaggccaugca

SEQ ID NO: 1089803 - RNA, 12 nt, Homo sapiens
cucaugcaagac

SEQ ID NO: 1089804 - RNA, 20 nt, Homo sapiens
cucaugcaagacuucacugc

SEQ ID NO: 1089805 - RNA, 21 nt, Homo sapiens
cucauuagcugaauugagcua

SEQ ID NO: 1089806 - RNA, 19 nt, Homo sapiens
cuccagcaagcagugcccu

SEQ ID NO: 1089807 - RNA, 19 nt, Homo sapiens
cuccaggcacccccaggau

SEQ ID NO: 1089808 - RNA, 20 nt, Homo sapiens
cuccagggacagaagcagga

SEQ ID NO: 1089809 - RNA, 15 nt, Homo sapiens
cuccaguucugauga

SEQ ID NO: 1089810 - RNA, 22 nt, Homo sapiens
cuccauuuucuugucaauggaa

SEQ ID NO: 1089811 - RNA, 13 nt, Homo sapiens
cucccacagugac

SEQ ID NO: 1089812 - RNA, 20 nt, Homo sapiens
cucccacggggaccacuggg

SEQ ID NO: 1089813 - RNA, 16 nt, Homo sapiens
cucccacgugcacagc

SEQ ID NO: 1089814 - RNA, 20 nt, Homo sapiens
cucccagugagaagggccug

SEQ ID NO: 1089815 - RNA, 18 nt, Homo sapiens
cuccccacaguccucaca

SEQ ID NO: 1089816 - RNA, 16 nt, Homo sapiens
cucccucugaccugca

SEQ ID NO: 1089817 - RNA, 20 nt, Homo sapiens
cucccuguuaucugcuagau

SEQ ID NO: 1089818 - RNA, 21 nt, Homo sapiens
cuccucaugaggccaugcaag

SEQ ID NO: 1089819 - RNA, 12 nt, Homo sapiens
cuccucuaguca

SEQ ID NO: 1089820 - RNA, 14 nt, Homo sapiens
cuccugccagcucu

SEQ ID NO: 1089821 - RNA, 21 nt, Homo sapiens
cuccuuagacugaucaagcca

SEQ ID NO: 1089822 - RNA, 23 nt, Homo sapiens
cuccuugaguuuuccugcugcga

SEQ ID NO: 1089823 - RNA, 20 nt, Homo sapiens
cuccuuggucuaagugugcu

SEQ ID NO: 1089824 - RNA, 13 nt, Homo sapiens
cucgaacuccuga

SEQ ID NO: 1089825 - RNA, 23 nt, Homo sapiens
cucgaacuccugaccucgugauu

SEQ ID NO: 1089826 - RNA, 20 nt, Homo sapiens
cucgaccagaaucagauuca

SEQ ID NO: 1089827 - RNA, 19 nt, Homo sapiens
cucgagguuucucaaagaa

SEQ ID NO: 1089828 - RNA, 18 nt, Homo sapiens
cucuacuccuaccucagc

SEQ ID NO: 1089829 - RNA, 20 nt, Homo sapiens
cucuagugacuuccugguga

SEQ ID NO: 1089830 - RNA, 18 nt, Homo sapiens
cucuccacuguuucauga

SEQ ID NO: 1089831 - RNA, 15 nt, Homo sapiens
cucucugcucaguga

SEQ ID NO: 1089832 - RNA, 22 nt, Homo sapiens
cucugcagauagugccucugca

SEQ ID NO: 1089833 - RNA, 21 nt, Homo sapiens
cucugcauccgacacccaccc

SEQ ID NO: 1089834 - RNA, 20 nt, Homo sapiens
cucugcauuaucugagguca

SEQ ID NO: 1089835 - RNA, 18 nt, Homo sapiens
cucugcucagugaucuca

SEQ ID NO: 1089836 - RNA, 13 nt, Homo sapiens
cucugcugcauuu

SEQ ID NO: 1089837 - RNA, 22 nt, Homo sapiens
cucuguccagccagcuccugca

SEQ ID NO: 1089838 - RNA, 15 nt, Homo sapiens
cucuuacaaaacucu

SEQ ID NO: 1089839 - RNA, 15 nt, Homo sapiens
cucuuauuugcucac

SEQ ID NO: 1089840 - RNA, 19 nt, Homo sapiens
cucuucccccacuccucuu

SEQ ID NO: 1089841 - RNA, 15 nt, Homo sapiens
cucuuggcaccugcc

SEQ ID NO: 1089842 - RNA, 22 nt, Homo sapiens
cugaaacauuuggaagccccau

SEQ ID NO: 1089843 - RNA, 18 nt, Homo sapiens
cugaacaaagagagcuca

SEQ ID NO: 1089844 - RNA, 12 nt, Homo sapiens
cugaacauauua

SEQ ID NO: 1089845 - RNA, 13 nt, Homo sapiens
cugaacucugcaa

SEQ ID NO: 1089846 - RNA, 12 nt, Homo sapiens
cugaagugcagc

SEQ ID NO: 1089847 - RNA, 23 nt, Homo sapiens
cugaaucauccgaggcaaagaga

SEQ ID NO: 1089848 - RNA, 12 nt, Homo sapiens
cugacagagcca

SEQ ID NO: 1089849 - RNA, 19 nt, Homo sapiens
cugacccaccaaggucuca

SEQ ID NO: 1089850 - RNA, 20 nt, Homo sapiens
cugacccuccuccacuccac

SEQ ID NO: 1089851 - RNA, 17 nt, Homo sapiens
cugaccugguacugagg

SEQ ID NO: 1089852 - RNA, 21 nt, Homo sapiens
cugacucucugugaccugccc

SEQ ID NO: 1089853 - RNA, 17 nt, Homo sapiens
cugacuuucucuucuac

SEQ ID NO: 1089854 - RNA, 20 nt, Homo sapiens
cugagagcucucucuucucu

SEQ ID NO: 1089855 - RNA, 24 nt, Homo sapiens
cugagaggugaggugacuugccug

SEQ ID NO: 1089856 - RNA, 13 nt, Homo sapiens
cugaggaguggag

SEQ ID NO: 1089857 - RNA, 15 nt, Homo sapiens
cugaggaguguccug

SEQ ID NO: 1089858 - RNA, 14 nt, Homo sapiens
cugaggcaccagaa

SEQ ID NO: 1089859 - RNA, 15 nt, Homo sapiens
cugaguauugauaaa

SEQ ID NO: 1089860 - RNA, 23 nt, Homo sapiens
cugauauaacaaacuacauguaa

SEQ ID NO: 1089861 - RNA, 16 nt, Homo sapiens
cugaucauuacauggc

SEQ ID NO: 1089862 - RNA, 15 nt, Homo sapiens
cugauuccacuuuua

SEQ ID NO: 1089863 - RNA, 17 nt, Homo sapiens
cugcaauuuuaauugau

SEQ ID NO: 1089864 - RNA, 20 nt, Homo sapiens
cugcacauuuuguacaaaga

SEQ ID NO: 1089865 - RNA, 18 nt, Homo sapiens
cugcacccagggucccag

SEQ ID NO: 1089866 - RNA, 20 nt, Homo sapiens
cugcaccgagagagauggaa

SEQ ID NO: 1089867 - RNA, 19 nt, Homo sapiens
cugcagcacaggaggcucc

SEQ ID NO: 1089868 - RNA, 17 nt, Homo sapiens
cugcagccugaccccag

SEQ ID NO: 1089869 - RNA, 12 nt, Homo sapiens
cugcaguucccu

SEQ ID NO: 1089870 - RNA, 16 nt, Homo sapiens
cugcauguaaaaucuu

SEQ ID NO: 1089871 - RNA, 19 nt, Homo sapiens
cugcauuugugucaucuug

SEQ ID NO: 1089872 - RNA, 12 nt, Homo sapiens
cugccacuuccc

SEQ ID NO: 1089873 - RNA, 16 nt, Homo sapiens
cugccagcaccaagcg

SEQ ID NO: 1089874 - RNA, 15 nt, Homo sapiens
cugccccacccucaa

SEQ ID NO: 1089875 - RNA, 14 nt, Homo sapiens
cugccugugcauga

SEQ ID NO: 1089876 - RNA, 22 nt, Homo sapiens
cugccugugcaugaccugauca

SEQ ID NO: 1089877 - RNA, 14 nt, Homo sapiens
cugccuuaugcaag

SEQ ID NO: 1089878 - RNA, 22 nt, Homo sapiens
cugcuauaugccuuaagccaau

SEQ ID NO: 1089879 - RNA, 13 nt, Homo sapiens
cugcucugcuaua

SEQ ID NO: 1089880 - RNA, 19 nt, Homo sapiens
cugcugagugcaccacuuc

SEQ ID NO: 1089881 - RNA, 18 nt, Homo sapiens
cugcuggcccacagcucu

SEQ ID NO: 1089882 - RNA, 13 nt, Homo sapiens
cugcuuacuaaug

SEQ ID NO: 1089883 - RNA, 16 nt, Homo sapiens
cugcuuacuaaugugc

SEQ ID NO: 1089884 - RNA, 16 nt, Homo sapiens
cugcuuuaucagggga

SEQ ID NO: 1089885 - RNA, 22 nt, Homo sapiens
cuggaaaccacacuucuugaaa

SEQ ID NO: 1089886 - RNA, 20 nt, Homo sapiens
cuggaaaggcucagucucag

SEQ ID NO: 1089887 - RNA, 14 nt, Homo sapiens
gaacacagugccug

SEQ ID NO: 1089888 - RNA, 15 nt, Homo sapiens
gaacauucgaggugu

SEQ ID NO: 1089889 - RNA, 23 nt, Homo sapiens
gaaccagccguauuuuacaugaa

SEQ ID NO: 1089890 - RNA, 23 nt, Homo sapiens
gaacuaggagucuucacugcucu

SEQ ID NO: 1089891 - RNA, 16 nt, Homo sapiens
gaacugaagaccucca

SEQ ID NO: 1089892 - RNA, 11 nt, Homo sapiens
gaacuggccac

SEQ ID NO: 1089893 - RNA, 21 nt, Homo sapiens
gaacuggccacuccccagugc

SEQ ID NO: 1089894 - RNA, 20 nt, Homo sapiens
gaacuugcugcugagugcac

SEQ ID NO: 1089895 - RNA, 22 nt, Homo sapiens
gaagacuucaauauuaaaugac

SEQ ID NO: 1089896 - RNA, 21 nt, Homo sapiens
gaagcaggaguaaguuucuca

SEQ ID NO: 1089897 - RNA, 17 nt, Homo sapiens
gaagcuguauaauuaau

SEQ ID NO: 1089898 - RNA, 18 nt, Homo sapiens
gaaggcuuugccaugggc

SEQ ID NO: 1089899 - RNA, 17 nt, Homo sapiens
gaagggccugcucugcu

SEQ ID NO: 1089900 - RNA, 15 nt, Homo sapiens
gaagguauaucagga

SEQ ID NO: 1089901 - RNA, 17 nt, Homo sapiens
gaaguuuaaagaugccu

SEQ ID NO: 1089902 - RNA, 14 nt, Homo sapiens
gaauaaaauugcac

SEQ ID NO: 1089903 - RNA, 15 nt, Homo sapiens
gaauaaaauugcacu

SEQ ID NO: 1089904 - RNA, 18 nt, Homo sapiens
cccuacccccaguaaaau

SEQ ID NO: 1089905 - RNA, 24 nt, Homo sapiens
cccucaaggccucccacagugacu

SEQ ID NO: 1089906 - RNA, 15 nt, Homo sapiens
cccucagcugccuca

SEQ ID NO: 1089907 - RNA, 15 nt, Homo sapiens
cccucaggauuguuu

SEQ ID NO: 1089908 - RNA, 19 nt, Homo sapiens
cccucauccuuuuacuuuu

SEQ ID NO: 1089909 - RNA, 18 nt, Homo sapiens
cccuccuggagcauccca

SEQ ID NO: 1089910 - RNA, 13 nt, Homo sapiens
cccucgugccagu

SEQ ID NO: 1089911 - RNA, 12 nt, Homo sapiens
cccucugccuca

SEQ ID NO: 1089912 - RNA, 24 nt, Homo sapiens
cccugcccgaccccaucucauuca

SEQ ID NO: 1089913 - RNA, 19 nt, Homo sapiens
cccugcucacucuuccaca

SEQ ID NO: 1089914 - RNA, 22 nt, Homo sapiens
cccugggcaaugcagugcagca

SEQ ID NO: 1089915 - RNA, 17 nt, Homo sapiens
cccuguggucacuuauc

SEQ ID NO: 1089916 - RNA, 16 nt, Homo sapiens
cccuuaaauaucuuuc

SEQ ID NO: 1089917 - RNA, 19 nt, Homo sapiens
cccuuccauuucuacugua

SEQ ID NO: 1089918 - RNA, 12 nt, Homo sapiens
cccuuuuccucu

SEQ ID NO: 1089919 - RNA, 14 nt, Homo sapiens
ccgaccccaucuca

SEQ ID NO: 1089920 - RNA, 16 nt, Homo sapiens
ccgagagagauggaau

SEQ ID NO: 1089921 - RNA, 18 nt, Homo sapiens
ccgccuccaaaugccaac

SEQ ID NO: 1089922 - RNA, 23 nt, Homo sapiens
ccgggucugcuucugcauucaca

SEQ ID NO: 1089923 - RNA, 21 nt, Homo sapiens
ccgguguccuguuccugccac

SEQ ID NO: 1089924 - RNA, 15 nt, Homo sapiens
ccgugcacaccagug

SEQ ID NO: 1089925 - RNA, 21 nt, Homo sapiens
ccguguagccccgggcugacc

SEQ ID NO: 1089926 - RNA, 16 nt, Homo sapiens
ccguugcacaaaaagg

SEQ ID NO: 1089927 - RNA, 13 nt, Homo sapiens
ccuaguagcuuuc

SEQ ID NO: 1089928 - RNA, 17 nt, Homo sapiens
ccuagucucacaugucc

SEQ ID NO: 1089929 - RNA, 15 nt, Homo sapiens
ccuauaguaucuuuu

SEQ ID NO: 1089930 - RNA, 16 nt, Homo sapiens
ccuauggcccagccac

SEQ ID NO: 1089931 - RNA, 14 nt, Homo sapiens
ccucacauauuauu

SEQ ID NO: 1089932 - RNA, 19 nt, Homo sapiens
ccucacgcucuggacauga

SEQ ID NO: 1089933 - RNA, 19 nt, Homo sapiens
ccucaggccaggugcagug

SEQ ID NO: 1089934 - RNA, 22 nt, Homo sapiens
ccucagggcugucggugugcug

SEQ ID NO: 1089935 - RNA, 14 nt, Homo sapiens
ccucaugucaucaa

SEQ ID NO: 1089936 - RNA, 13 nt, Homo sapiens
ccucaugucauuu

SEQ ID NO: 1089937 - RNA, 16 nt, Homo sapiens
ccuccaaaugccaacu

SEQ ID NO: 1089938 - RNA, 21 nt, Homo sapiens
ccuccaaguccacaguggaac

SEQ ID NO: 1089939 - RNA, 19 nt, Homo sapiens
ccuccaagugaaugaguuu

SEQ ID NO: 1089940 - RNA, 15 nt, Homo sapiens
ccuccugcaccgaga

SEQ ID NO: 1089941 - RNA, 23 nt, Homo sapiens
ccuccuggguuuacuccuugagu

SEQ ID NO: 1089942 - RNA, 19 nt, Homo sapiens
ccucucagagccucagcuu

SEQ ID NO: 1089943 - RNA, 13 nt, Homo sapiens
ccucuccagcuuu

SEQ ID NO: 1089944 - RNA, 15 nt, Homo sapiens
ccucuccaugcaagu

SEQ ID NO: 1089945 - RNA, 17 nt, Homo sapiens
ccucugcugcuuuccaa

SEQ ID NO: 1089946 - RNA, 17 nt, Homo sapiens
ccucuguccagccagcu

SEQ ID NO: 1089947 - RNA, 12 nt, Homo sapiens
ccucugugcaga

SEQ ID NO: 1089948 - RNA, 18 nt, Homo sapiens
ccugaaagcccugcgcua

SEQ ID NO: 1089949 - RNA, 15 nt, Homo sapiens
ccugaaccgugugcu

SEQ ID NO: 1089950 - RNA, 13 nt, Homo sapiens
ccugaacuggcca

SEQ ID NO: 1089951 - RNA, 14 nt, Homo sapiens
ccugaacuggccac

SEQ ID NO: 1089952 - RNA, 14 nt, Homo sapiens
ccugaagugucgag

SEQ ID NO: 1089953 - RNA, 12 nt, Homo sapiens
ccugauggugcu

SEQ ID NO: 1089954 - RNA, 13 nt, Homo sapiens
ccugcacuacucu

SEQ ID NO: 1089955 - RNA, 16 nt, Homo sapiens
ccuggacauauuccca

SEQ ID NO: 1089956 - RNA, 18 nt, Homo sapiens
ccuggcaagugggugaaa

SEQ ID NO: 1089957 - RNA, 15 nt, Homo sapiens
ccuggcccaucagug

SEQ ID NO: 1089958 - RNA, 15 nt, Homo sapiens
ccuggccucauacag

SEQ ID NO: 1089959 - RNA, 13 nt, Homo sapiens
ccugggcaaugca

SEQ ID NO: 1089960 - RNA, 21 nt, Homo sapiens
ccugggcaaugcagugcagca

SEQ ID NO: 1089961 - RNA, 19 nt, Homo sapiens
ccuggggccccauuugcca

SEQ ID NO: 1089962 - RNA, 15 nt, Homo sapiens
ccuggggugggcaca

SEQ ID NO: 1089963 - RNA, 16 nt, Homo sapiens
ccugggugacgguccu

SEQ ID NO: 1089964 - RNA, 14 nt, Homo sapiens
ccugguacugaggu

SEQ ID NO: 1089965 - RNA, 17 nt, Homo sapiens
ccugguacugagguugg

SEQ ID NO: 1089966 - RNA, 22 nt, Homo sapiens
ccugguacugagguugggcuga

SEQ ID NO: 1089967 - RNA, 23 nt, Homo sapiens
ccuguagcaaccuucugcauuca

SEQ ID NO: 1089968 - RNA, 12 nt, Homo sapiens
ccugugugcacc

SEQ ID NO: 1089969 - RNA, 15 nt, Homo sapiens
ccuguuccugccaca

SEQ ID NO: 1089970 - RNA, 17 nt, Homo sapiens
ccuguugaauuuacucu

SEQ ID NO: 1089971 - RNA, 18 nt, Homo sapiens
ccuuaaggccacacuggc

SEQ ID NO: 1089972 - RNA, 19 nt, Homo sapiens
ccuuaauucacucccacac

SEQ ID NO: 1089973 - RNA, 17 nt, Homo sapiens
ccuucuccacagggaca

SEQ ID NO: 1089974 - RNA, 13 nt, Homo sapiens
ccuugaagccacu

SEQ ID NO: 1089975 - RNA, 20 nt, Homo sapiens
ccuugcaucaagggcuuuau

SEQ ID NO: 1089976 - RNA, 15 nt, Homo sapiens
ccuugcucugccauc

SEQ ID NO: 1089977 - RNA, 20 nt, Homo sapiens
ccuugucguaggaaaaccau

SEQ ID NO: 1089978 - RNA, 21 nt, Homo sapiens
ccuuguguacaguuauuuaug

SEQ ID NO: 1089979 - RNA, 19 nt, Homo sapiens
ccuuugaggcaaaggccag

SEQ ID NO: 1089980 - RNA, 15 nt, Homo sapiens
ccuuuuucuaccuuu

SEQ ID NO: 1089981 - RNA, 22 nt, Homo sapiens
cgacaaagccaaacucugccag

SEQ ID NO: 1089982 - RNA, 16 nt, Homo sapiens
cgagaaccaggcugcu

SEQ ID NO: 1089983 - RNA, 22 nt, Homo sapiens
cgagcauaagaaauaaaaucua

SEQ ID NO: 1089984 - RNA, 23 nt, Homo sapiens
cgaggaaaggauuuuaccaaagc

SEQ ID NO: 1089985 - RNA, 20 nt, Homo sapiens
cgaugaauguguugauuuga

SEQ ID NO: 1089986 - RNA, 17 nt, Homo sapiens
cgcagagaaugugaaca

SEQ ID NO: 1089987 - RNA, 15 nt, Homo sapiens
cgccuaugaucccag

SEQ ID NO: 1089988 - RNA, 20 nt, Homo sapiens
cgccucucccaccccaugca

SEQ ID NO: 1089989 - RNA, 19 nt, Homo sapiens
cggagccaugucaugugcc

SEQ ID NO: 1089990 - RNA, 19 nt, Homo sapiens
cggcccagcaagaugaaac

SEQ ID NO: 1089991 - RNA, 22 nt, Homo sapiens
cggccuugaagaggcaggucug

SEQ ID NO: 1089992 - RNA, 21 nt, Homo sapiens
cgggaagcgaugaauuuggag

SEQ ID NO: 1089993 - RNA, 18 nt, Homo sapiens
cgggacccucccagugag

SEQ ID NO: 1089994 - RNA, 15 nt, Homo sapiens
cggguggaucaccug

SEQ ID NO: 1089995 - RNA, 16 nt, Homo sapiens
cgucagaccaguacug

SEQ ID NO: 1089996 - RNA, 17 nt, Homo sapiens
cgucagaccaguacugg

SEQ ID NO: 1089997 - RNA, 20 nt, Homo sapiens
cgucagaccaguacugggaa

SEQ ID NO: 1089998 - RNA, 19 nt, Homo sapiens
cguccugaggaguguccug

SEQ ID NO: 1089999 - RNA, 21 nt, Homo sapiens
cgucuacucauuccccggggc

SEQ ID NO: 1090000 - RNA, 19 nt, Homo sapiens
cgugaacugcgugccagug

SEQ ID NO: 1090001 - RNA, 14 nt, Homo sapiens
cgugcacaccagug

SEQ ID NO: 1090002 - RNA, 14 nt, Homo sapiens
cgugccaguguccc

SEQ ID NO: 1090003 - RNA, 15 nt, Homo sapiens
cgugguagaagccag

SEQ ID NO: 1090004 - RNA, 14 nt, Homo sapiens
cgugugaggaugug

SEQ ID NO: 1090005 - RNA, 22 nt, Homo sapiens
cguguguauuagaaugcaugua

SEQ ID NO: 1090006 - RNA, 19 nt, Homo sapiens
cguguucacaccauucucc

SEQ ID NO: 1090007 - RNA, 21 nt, Homo sapiens
cguuuuguugccaaggcagaa

SEQ ID NO: 1090008 - RNA, 17 nt, Homo sapiens
cuaaaaaauggugggag

SEQ ID NO: 1090009 - RNA, 18 nt, Homo sapiens
cuaaacuccuuuccugca

SEQ ID NO: 1090010 - RNA, 20 nt, Homo sapiens
cuaaagaguuuucuaugaau

SEQ ID NO: 1090011 - RNA, 15 nt, Homo sapiens
cuaaagucacauaua

SEQ ID NO: 1090012 - RNA, 16 nt, Homo sapiens
cuaaagucacauauaa

SEQ ID NO: 1090013 - RNA, 21 nt, Homo sapiens
cuaaagucacauauaaaaguu

SEQ ID NO: 1090014 - RNA, 13 nt, Homo sapiens
cuaaauaaaugaa

SEQ ID NO: 1090015 - RNA, 17 nt, Homo sapiens
cuaaccaaagagucucu

SEQ ID NO: 1090016 - RNA, 14 nt, Homo sapiens
cuaagccugaugau

SEQ ID NO: 1090017 - RNA, 12 nt, Homo sapiens
cuaagcuuucuc

SEQ ID NO: 1090018 - RNA, 15 nt, Homo sapiens
cuaagguacggugag

SEQ ID NO: 1090019 - RNA, 17 nt, Homo sapiens
cuaauaauaaauuaaua

SEQ ID NO: 1090020 - RNA, 13 nt, Homo sapiens
cuaauccaugugc

SEQ ID NO: 1090021 - RNA, 19 nt, Homo sapiens
cuaaugagucgacuuugag

SEQ ID NO: 1090022 - RNA, 12 nt, Homo sapiens
cuaauuaauucu

SEQ ID NO: 1090023 - RNA, 13 nt, Homo sapiens
cuacacaacaugu

SEQ ID NO: 1090024 - RNA, 12 nt, Homo sapiens
cuacacauauau

SEQ ID NO: 1090025 - RNA, 13 nt, Homo sapiens
cuaccacuuugaa

SEQ ID NO: 1090026 - RNA, 20 nt, Homo sapiens
cuacccucucaaauggacaa

SEQ ID NO: 1090027 - RNA, 18 nt, Homo sapiens
cuacucauuccccggggc

SEQ ID NO: 1090028 - RNA, 16 nt, Homo sapiens
cuacuuguaaaggugc

SEQ ID NO: 1090029 - RNA, 17 nt, Homo sapiens
cuacuuguaaaggugcu

SEQ ID NO: 1090030 - RNA, 19 nt, Homo sapiens
gaauaaaauugcacuuuua

SEQ ID NO: 1090031 - RNA, 17 nt, Homo sapiens
gaauaaagcccuugaac

SEQ ID NO: 1090032 - RNA, 19 nt, Homo sapiens
gaauaaagcccuugaacca

SEQ ID NO: 1090033 - RNA, 18 nt, Homo sapiens
gaauggaaggcuuugcca

SEQ ID NO: 1090034 - RNA, 22 nt, Homo sapiens
gaauuuuggaaaaaugucacug

SEQ ID NO: 1090035 - RNA, 14 nt, Homo sapiens
gaauuuuugcacau

SEQ ID NO: 1090036 - RNA, 20 nt, Homo sapiens
gacaaauaaguuacccucaa

SEQ ID NO: 1090037 - RNA, 13 nt, Homo sapiens
gacaacaucgcaa

SEQ ID NO: 1090038 - RNA, 15 nt, Homo sapiens
gacacaucaguuaua

SEQ ID NO: 1090039 - RNA, 18 nt, Homo sapiens
gacacugcugaaccuuuc

SEQ ID NO: 1090040 - RNA, 17 nt, Homo sapiens
gacagacacugcugaac

SEQ ID NO: 1090041 - RNA, 23 nt, Homo sapiens
gacagcuugacucuacucccagc

SEQ ID NO: 1090042 - RNA, 12 nt, Homo sapiens
gacaguaccuga

SEQ ID NO: 1090043 - RNA, 17 nt, Homo sapiens
gacagugucagagucau

SEQ ID NO: 1090044 - RNA, 18 nt, Homo sapiens
gacagugucagagucauu

SEQ ID NO: 1090045 - RNA, 23 nt, Homo sapiens
gacauuucuaucuugaauuucau

SEQ ID NO: 1090046 - RNA, 20 nt, Homo sapiens
gaccaggucuuguucaagca

SEQ ID NO: 1090047 - RNA, 15 nt, Homo sapiens
gaccaguacugggaa

SEQ ID NO: 1090048 - RNA, 13 nt, Homo sapiens
gaccccaucucau

SEQ ID NO: 1090049 - RNA, 21 nt, Homo sapiens
gacccuccuccacuccaccuc

SEQ ID NO: 1090050 - RNA, 19 nt, Homo sapiens
gacccucuauuuaccugcg

SEQ ID NO: 1090051 - RNA, 21 nt, Homo sapiens
gaccgauagcaggugaacucg

SEQ ID NO: 1090052 - RNA, 12 nt, Homo sapiens
gaccucagagau

SEQ ID NO: 1090053 - RNA, 13 nt, Homo sapiens
gaccugaacucug

SEQ ID NO: 1090054 - RNA, 23 nt, Homo sapiens
gaccuuugcccacacacacuccu

SEQ ID NO: 1090055 - RNA, 15 nt, Homo sapiens
gacucaggccaguca

SEQ ID NO: 1090056 - RNA, 21 nt, Homo sapiens
gacuccgggcacggcuuccca

SEQ ID NO: 1090057 - RNA, 15 nt, Homo sapiens
gacucucugccugcu

SEQ ID NO: 1090058 - RNA, 17 nt, Homo sapiens
gacucuuccugcaaagg

SEQ ID NO: 1090059 - RNA, 13 nt, Homo sapiens
gacugaguccucg

SEQ ID NO: 1090060 - RNA, 16 nt, Homo sapiens
gacugguaaguaacug

SEQ ID NO: 1090061 - RNA, 18 nt, Homo sapiens
gacuucaggagcugacag

SEQ ID NO: 1090062 - RNA, 19 nt, Homo sapiens
gacuucaggagcugacaga

SEQ ID NO: 1090063 - RNA, 20 nt, Homo sapiens
gagaaaacuuauuugaguga

SEQ ID NO: 1090064 - RNA, 19 nt, Homo sapiens
gagaagggccugcucugcu

SEQ ID NO: 1090065 - RNA, 21 nt, Homo sapiens
gagaaguaagcagaguucuuu

SEQ ID NO: 1090066 - RNA, 19 nt, Homo sapiens
gagacaagaaauccuagug

SEQ ID NO: 1090067 - RNA, 23 nt, Homo sapiens
gagacaagaaauccuaguggccu

SEQ ID NO: 1090068 - RNA, 17 nt, Homo sapiens
gagaccucagauguguu

SEQ ID NO: 1090069 - RNA, 14 nt, Homo sapiens
gagagauggaauaa

SEQ ID NO: 1090070 - RNA, 23 nt, Homo sapiens
gagagcagcuucugccacuuccc

SEQ ID NO: 1090071 - RNA, 18 nt, Homo sapiens
gagagcucucucuucucu

SEQ ID NO: 1090072 - RNA, 17 nt, Homo sapiens
gagaggaagcucucuuu

SEQ ID NO: 1090073 - RNA, 11 nt, Homo sapiens
gagaguaccau

SEQ ID NO: 1090074 - RNA, 13 nt, Homo sapiens
gagauaagcaagu

SEQ ID NO: 1090075 - RNA, 18 nt, Homo sapiens
gagauacugaagugcagc

SEQ ID NO: 1090076 - RNA, 21 nt, Homo sapiens
gagaucuuucuuuccaaaaca

SEQ ID NO: 1090077 - RNA, 22 nt, Homo sapiens
gagauggguugaguuugcugua

SEQ ID NO: 1090078 - RNA, 22 nt, Homo sapiens
gagauuucacaggucuugccca

SEQ ID NO: 1090079 - RNA, 21 nt, Homo sapiens
gagcaaagucuaaaguuuaca

SEQ ID NO: 1090080 - RNA, 14 nt, Homo sapiens
gagcaacucuccac

SEQ ID NO: 1090081 - RNA, 13 nt, Homo sapiens
gagcaagacucug

SEQ ID NO: 1090082 - RNA, 21 nt, Homo sapiens
gagcagcuucugccacuuccc

SEQ ID NO: 1090083 - RNA, 17 nt, Homo sapiens
gagcaggggcaggguga

SEQ ID NO: 1090084 - RNA, 16 nt, Homo sapiens
gagcaguaaacuuucu

SEQ ID NO: 1090085 - RNA, 18 nt, Homo sapiens
gagccaugucaugugcca

SEQ ID NO: 1090086 - RNA, 17 nt, Homo sapiens
gagcuauggugaggugu

SEQ ID NO: 1090087 - RNA, 23 nt, Homo sapiens
gagcucaguuucuuuuucacuug

SEQ ID NO: 1090088 - RNA, 17 nt, Homo sapiens
gagcugcucugcuauau

SEQ ID NO: 1090089 - RNA, 16 nt, Homo sapiens
gagcuguccccuggag

SEQ ID NO: 1090090 - RNA, 12 nt, Homo sapiens
gagcuuccucag

SEQ ID NO: 1090091 - RNA, 18 nt, Homo sapiens
gagcuugacuucaugcca

SEQ ID NO: 1090092 - RNA, 13 nt, Homo sapiens
gaggaucacugga

SEQ ID NO: 1090093 - RNA, 20 nt, Homo sapiens
gaggcaaccuguugaauuua

SEQ ID NO: 1090094 - RNA, 14 nt, Homo sapiens
gaggcaagaaccag

SEQ ID NO: 1090095 - RNA, 15 nt, Homo sapiens
gaggcaagaaccagu

SEQ ID NO: 1090096 - RNA, 21 nt, Homo sapiens
gaggcaccugcuggaaaccac

SEQ ID NO: 1090097 - RNA, 20 nt, Homo sapiens
gaggcauucccagaauuugc

SEQ ID NO: 1090098 - RNA, 18 nt, Homo sapiens
gaggcugcguccugagga

SEQ ID NO: 1090099 - RNA, 22 nt, Homo sapiens
gaggcuggcauccuggcuggcu

SEQ ID NO: 1090100 - RNA, 22 nt, Homo sapiens
gagggcaucucugagugucucu

SEQ ID NO: 1090101 - RNA, 17 nt, Homo sapiens
gagguguggauaaggcu

SEQ ID NO: 1090102 - RNA, 19 nt, Homo sapiens
gagguuguuuuaaagucag

SEQ ID NO: 1090103 - RNA, 22 nt, Homo sapiens
gaguucuauuagaagcuaucaa

SEQ ID NO: 1090104 - RNA, 16 nt, Homo sapiens
gauacugaagugcagc

SEQ ID NO: 1090105 - RNA, 12 nt, Homo sapiens
gauagugccucu

SEQ ID NO: 1090106 - RNA, 21 nt, Homo sapiens
gauauuguggguaacgugaga

SEQ ID NO: 1090107 - RNA, 14 nt, Homo sapiens
gaucuaauuuacau

SEQ ID NO: 1090108 - RNA, 19 nt, Homo sapiens
gaugaaaaccacccuauca

SEQ ID NO: 1090109 - RNA, 15 nt, Homo sapiens
gaugaaacagggcac

SEQ ID NO: 1090110 - RNA, 18 nt, Homo sapiens
gaugaguuuaucauguca

SEQ ID NO: 1090111 - RNA, 16 nt, Homo sapiens
gaugcccuaguuguga

SEQ ID NO: 1090112 - RNA, 17 nt, Homo sapiens
gaugcccuaguugugau

SEQ ID NO: 1090113 - RNA, 23 nt, Homo sapiens
gauggaauaaagcccuugaacca

SEQ ID NO: 1090114 - RNA, 13 nt, Homo sapiens
gauggagccugaa

SEQ ID NO: 1090115 - RNA, 22 nt, Homo sapiens
gauggagccugaaccgugugcu

SEQ ID NO: 1090116 - RNA, 19 nt, Homo sapiens
gauggagucucgcucugcu

SEQ ID NO: 1090117 - RNA, 23 nt, Homo sapiens
gauggugacuuuugaagaacaaa

SEQ ID NO: 1090118 - RNA, 20 nt, Homo sapiens
gaugugugucucaccccuca

SEQ ID NO: 1090119 - RNA, 13 nt, Homo sapiens
gauuauccacugc

SEQ ID NO: 1090120 - RNA, 12 nt, Homo sapiens
gauuauucugau

SEQ ID NO: 1090121 - RNA, 13 nt, Homo sapiens
gauuccacuuuua

SEQ ID NO: 1090122 - RNA, 18 nt, Homo sapiens
gauuccauuuuacuucca

SEQ ID NO: 1090123 - RNA, 19 nt, Homo sapiens
gauucccuguucuuugaag

SEQ ID NO: 1090124 - RNA, 17 nt, Homo sapiens
gauucuaaauguucaug

SEQ ID NO: 1090125 - RNA, 15 nt, Homo sapiens
gauucuucugccuca

SEQ ID NO: 1090126 - RNA, 20 nt, Homo sapiens
gauugaauuuuuaagcaaau

SEQ ID NO: 1090127 - RNA, 22 nt, Homo sapiens
gauuguucuguccaguuuccaa

SEQ ID NO: 1090128 - RNA, 20 nt, Homo sapiens
gauuucaccguauuagccag

SEQ ID NO: 1090129 - RNA, 14 nt, Homo sapiens
gauuuuaccaaagc

SEQ ID NO: 1090130 - RNA, 14 nt, Homo sapiens
gcaaaaacauaugu

SEQ ID NO: 1090131 - RNA, 16 nt, Homo sapiens
gcaaaagucauuacac

SEQ ID NO: 1090132 - RNA, 23 nt, Homo sapiens
gcaaacaaauggcuuacuuacaa

SEQ ID NO: 1090133 - RNA, 19 nt, Homo sapiens
cauuauuuuuuacaauggc

SEQ ID NO: 1090134 - RNA, 15 nt, Homo sapiens
cauucaaaaugucca

SEQ ID NO: 1090135 - RNA, 18 nt, Homo sapiens
cauucaugcaacuugauu

SEQ ID NO: 1090136 - RNA, 19 nt, Homo sapiens
cauucauuuauucauucau

SEQ ID NO: 1090137 - RNA, 19 nt, Homo sapiens
cauuccaaggguaugggaa

SEQ ID NO: 1090138 - RNA, 18 nt, Homo sapiens
cauucccuuuuccauaua

SEQ ID NO: 1090139 - RNA, 14 nt, Homo sapiens
cauucgagguguca

SEQ ID NO: 1090140 - RNA, 13 nt, Homo sapiens
cauugaauuugcc

SEQ ID NO: 1090141 - RNA, 16 nt, Homo sapiens
cauuguggaaacugga

SEQ ID NO: 1090142 - RNA, 20 nt, Homo sapiens
cauuucuggacaguaccuga

SEQ ID NO: 1090143 - RNA, 14 nt, Homo sapiens
cauuuuacuuccau

SEQ ID NO: 1090144 - RNA, 16 nt, Homo sapiens
cauuuuacuuccauga

SEQ ID NO: 1090145 - RNA, 17 nt, Homo sapiens
cauuuuacuuccaugau

SEQ ID NO: 1090146 - RNA, 15 nt, Homo sapiens
cauuuuauaaauuca

SEQ ID NO: 1090147 - RNA, 19 nt, Homo sapiens
cauuuucagcaucaaacau

SEQ ID NO: 1090148 - RNA, 15 nt, Homo sapiens
ccaacgacaaagcca

SEQ ID NO: 1090149 - RNA, 15 nt, Homo sapiens
ccaacggcaacagca

SEQ ID NO: 1090150 - RNA, 16 nt, Homo sapiens
ccaacuacacaccccc

SEQ ID NO: 1090151 - RNA, 16 nt, Homo sapiens
ccaacuccucuaguca

SEQ ID NO: 1090152 - RNA, 20 nt, Homo sapiens
ccaagaccuuacaaccacau

SEQ ID NO: 1090153 - RNA, 22 nt, Homo sapiens
ccaauaaagcagaguuugacac

SEQ ID NO: 1090154 - RNA, 19 nt, Homo sapiens
ccaauccuuuauagcuuug

SEQ ID NO: 1090155 - RNA, 15 nt, Homo sapiens
ccaaucuuaguuucu

SEQ ID NO: 1090156 - RNA, 15 nt, Homo sapiens
ccacacacacuccuu

SEQ ID NO: 1090157 - RNA, 16 nt, Homo sapiens
ccacaccugggcauuu

SEQ ID NO: 1090158 - RNA, 19 nt, Homo sapiens
ccacagaugcuugugauuu

SEQ ID NO: 1090159 - RNA, 12 nt, Homo sapiens
ccaccaggcuag

SEQ ID NO: 1090160 - RNA, 14 nt, Homo sapiens
ccacccauaccagc

SEQ ID NO: 1090161 - RNA, 16 nt, Homo sapiens
ccacccuaaagucuca

SEQ ID NO: 1090162 - RNA, 22 nt, Homo sapiens
ccacccugggcaaugcagugca

SEQ ID NO: 1090163 - RNA, 20 nt, Homo sapiens
ccaccuuugggaucagccuc

SEQ ID NO: 1090164 - RNA, 12 nt, Homo sapiens
ccacgucucucu

SEQ ID NO: 1090165 - RNA, 19 nt, Homo sapiens
ccacgucucucugccugcu

SEQ ID NO: 1090166 - RNA, 11 nt, Homo sapiens
ccacucagguc

SEQ ID NO: 1090167 - RNA, 16 nt, Homo sapiens
ccacucuuugcuacaa

SEQ ID NO: 1090168 - RNA, 14 nt, Homo sapiens
ccacuggacuugag

SEQ ID NO: 1090169 - RNA, 23 nt, Homo sapiens
ccacuguuaagccauguguucca

SEQ ID NO: 1090170 - RNA, 19 nt, Homo sapiens
ccacuuccccuccuacccc

SEQ ID NO: 1090171 - RNA, 16 nt, Homo sapiens
ccacuuugaguaccaa

SEQ ID NO: 1090172 - RNA, 16 nt, Homo sapiens
ccacuuuuaaaacuau

SEQ ID NO: 1090173 - RNA, 18 nt, Homo sapiens
ccagaauuugcugcauuu

SEQ ID NO: 1090174 - RNA, 17 nt, Homo sapiens
ccagagccacuaccuuu

SEQ ID NO: 1090175 - RNA, 17 nt, Homo sapiens
ccagagccucaaaugag

SEQ ID NO: 1090176 - RNA, 19 nt, Homo sapiens
ccagaguucuugcacccuc

SEQ ID NO: 1090177 - RNA, 22 nt, Homo sapiens
ccagaugggaugggcuuucuca

SEQ ID NO: 1090178 - RNA, 13 nt, Homo sapiens
ccagauugcccca

SEQ ID NO: 1090179 - RNA, 17 nt, Homo sapiens
ccagcaagaugaaacag

SEQ ID NO: 1090180 - RNA, 19 nt, Homo sapiens
ccagcaagaugaaacaggg

SEQ ID NO: 1090181 - RNA, 20 nt, Homo sapiens
ccagcaagaugaaacagggc

SEQ ID NO: 1090182 - RNA, 13 nt, Homo sapiens
ccagccacugcag

SEQ ID NO: 1090183 - RNA, 15 nt, Homo sapiens
ccagccacugcagca

SEQ ID NO: 1090184 - RNA, 14 nt, Homo sapiens
ccagccucacagau

SEQ ID NO: 1090185 - RNA, 19 nt, Homo sapiens
ccagccuggccaacauggc

SEQ ID NO: 1090186 - RNA, 22 nt, Homo sapiens
ccagcugaggcugggggcgggg

SEQ ID NO: 1090187 - RNA, 16 nt, Homo sapiens
ccagcugaucauguca

SEQ ID NO: 1090188 - RNA, 19 nt, Homo sapiens
ccagcuguuaccugagaua

SEQ ID NO: 1090189 - RNA, 22 nt, Homo sapiens
ccaggacuggggcuugccaggc

SEQ ID NO: 1090190 - RNA, 22 nt, Homo sapiens
ccaggagguggagguugcagug

SEQ ID NO: 1090191 - RNA, 23 nt, Homo sapiens
ccaggagguggagguugcaguga

SEQ ID NO: 1090192 - RNA, 16 nt, Homo sapiens
ccaggauugugcaaua

SEQ ID NO: 1090193 - RNA, 15 nt, Homo sapiens
ccaggccaucuucca

SEQ ID NO: 1090194 - RNA, 23 nt, Homo sapiens
ccaggcugcugcauggcacugac

SEQ ID NO: 1090195 - RNA, 13 nt, Homo sapiens
ccagggcacagcu

SEQ ID NO: 1090196 - RNA, 16 nt, Homo sapiens
ccagucccucagccac

SEQ ID NO: 1090197 - RNA, 12 nt, Homo sapiens
ccagugucccca

SEQ ID NO: 1090198 - RNA, 19 nt, Homo sapiens
ccagugucgugucugcugu

SEQ ID NO: 1090199 - RNA, 14 nt, Homo sapiens
ccaguucugaugag

SEQ ID NO: 1090200 - RNA, 16 nt, Homo sapiens
ccauaucuacccagaa

SEQ ID NO: 1090201 - RNA, 15 nt, Homo sapiens
ccauauuguucuuca

SEQ ID NO: 1090202 - RNA, 21 nt, Homo sapiens
ccauccaacuccucuagucag

SEQ ID NO: 1090203 - RNA, 20 nt, Homo sapiens
ccauccaauggauugugcaa

SEQ ID NO: 1090204 - RNA, 22 nt, Homo sapiens
ccauccaauggauugugcaaau

SEQ ID NO: 1090205 - RNA, 17 nt, Homo sapiens
ccaucccuuuuuuuaca

SEQ ID NO: 1090206 - RNA, 22 nt, Homo sapiens
ccaucccuuuuuuuacauuuca

SEQ ID NO: 1090207 - RNA, 14 nt, Homo sapiens
ccaugauacuuuaa

SEQ ID NO: 1090208 - RNA, 21 nt, Homo sapiens
ccaugguagacugugacacag

SEQ ID NO: 1090209 - RNA, 17 nt, Homo sapiens
ccauguaucuaccucac

SEQ ID NO: 1090210 - RNA, 11 nt, Homo sapiens
ccaugucaugu

SEQ ID NO: 1090211 - RNA, 19 nt, Homo sapiens
ccaugucaugugccacgac

SEQ ID NO: 1090212 - RNA, 16 nt, Homo sapiens
ccaugugcugcugugg

SEQ ID NO: 1090213 - RNA, 14 nt, Homo sapiens
ccauuccuucacau

SEQ ID NO: 1090214 - RNA, 21 nt, Homo sapiens
ccauugaauuugccuuccuca

SEQ ID NO: 1090215 - RNA, 21 nt, Homo sapiens
ccauugugauuauuguuacua

SEQ ID NO: 1090216 - RNA, 15 nt, Homo sapiens
ccauuuuacuuccau

SEQ ID NO: 1090217 - RNA, 21 nt, Homo sapiens
ccauuuuacuuccaugauacu

SEQ ID NO: 1090218 - RNA, 22 nt, Homo sapiens
ccauuuuacuuccaugauacuu

SEQ ID NO: 1090219 - RNA, 23 nt, Homo sapiens
cccaaagucauugauuuugauga

SEQ ID NO: 1090220 - RNA, 18 nt, Homo sapiens
cccaaguagcugagauua

SEQ ID NO: 1090221 - RNA, 14 nt, Homo sapiens
cccaauugccacau

SEQ ID NO: 1090222 - RNA, 15 nt, Homo sapiens
cccacccccacuuca

SEQ ID NO: 1090223 - RNA, 16 nt, Homo sapiens
cccacccccucuuugu

SEQ ID NO: 1090224 - RNA, 19 nt, Homo sapiens
cccacguccugucagugcc

SEQ ID NO: 1090225 - RNA, 23 nt, Homo sapiens
cccacuaagcuuucuccuuugag

SEQ ID NO: 1090226 - RNA, 10 nt, Homo sapiens
cccacuuccc

SEQ ID NO: 1090227 - RNA, 12 nt, Homo sapiens
cccacuuugcca

SEQ ID NO: 1090228 - RNA, 23 nt, Homo sapiens
cccagagcgaggaaaggauuuua

SEQ ID NO: 1090229 - RNA, 13 nt, Homo sapiens
cccagcaagauga

SEQ ID NO: 1090230 - RNA, 15 nt, Homo sapiens
cccagcagacuugag

SEQ ID NO: 1090231 - RNA, 22 nt, Homo sapiens
cccagcugacaguccucuccac

SEQ ID NO: 1090232 - RNA, 17 nt, Homo sapiens
cccaggaaggacugugc

SEQ ID NO: 1090233 - RNA, 21 nt, Homo sapiens
cccaggcccuaggauuccucc

SEQ ID NO: 1090234 - RNA, 17 nt, Homo sapiens
cccaggcuagagugcag

SEQ ID NO: 1090235 - RNA, 17 nt, Homo sapiens
cccaggcuggagugcaa

SEQ ID NO: 1090236 - RNA, 21 nt, Homo sapiens
cccagggucccagccuggcca

SEQ ID NO: 1090237 - RNA, 22 nt, Homo sapiens
cccaguaaaaucaaaugugcau

SEQ ID NO: 1090238 - RNA, 23 nt, Homo sapiens
cccaguaaaaucaaaugugcauc

SEQ ID NO: 1090239 - RNA, 16 nt, Homo sapiens
cccagucucccaccuu

SEQ ID NO: 1090240 - RNA, 19 nt, Homo sapiens
cccagugcuccugugcagg

SEQ ID NO: 1090241 - RNA, 13 nt, Homo sapiens
cccagugugugcu

SEQ ID NO: 1090242 - RNA, 15 nt, Homo sapiens
cccagugugugcuca

SEQ ID NO: 1090243 - RNA, 21 nt, Homo sapiens
cccauccaauggauugugcaa

SEQ ID NO: 1090244 - RNA, 19 nt, Homo sapiens
cccaucuaagcugcagcuu

SEQ ID NO: 1090245 - RNA, 21 nt, Homo sapiens
cccaucuugauuggggcaguu

SEQ ID NO: 1090246 - RNA, 19 nt, Homo sapiens
cccaugguagacugugaca

SEQ ID NO: 1090247 - RNA, 12 nt, Homo sapiens
ccccacagccca

SEQ ID NO: 1090248 - RNA, 13 nt, Homo sapiens
ccccaggccaccu

SEQ ID NO: 1090249 - RNA, 13 nt, Homo sapiens
ccccagugcuccu

SEQ ID NO: 1090250 - RNA, 17 nt, Homo sapiens
ccccaucucauucaggu

SEQ ID NO: 1090251 - RNA, 12 nt, Homo sapiens
ccccauugcuca

SEQ ID NO: 1090252 - RNA, 22 nt, Homo sapiens
cccccacccaccuggauucccu

SEQ ID NO: 1090253 - RNA, 23 nt, Homo sapiens
cccccaguaaaaucaaaugugca

SEQ ID NO: 1090254 - RNA, 19 nt, Homo sapiens
ccccuacccccaguaaaau

SEQ ID NO: 1090255 - RNA, 13 nt, Homo sapiens
ccccuacugaggc

SEQ ID NO: 1090256 - RNA, 12 nt, Homo sapiens
cccgaaaacccc

SEQ ID NO: 1090257 - RNA, 20 nt, Homo sapiens
cccgaaaacccccagcauua

SEQ ID NO: 1090258 - RNA, 16 nt, Homo sapiens
uugacuuuuuggcuca

SEQ ID NO: 1090259 - RNA, 21 nt, Homo sapiens
uugagacccuuuaaaugccug

SEQ ID NO: 1090260 - RNA, 15 nt, Homo sapiens
uugauaaacuuugaa

SEQ ID NO: 1090261 - RNA, 16 nt, Homo sapiens
uugauaaaugccucau

SEQ ID NO: 1090262 - RNA, 11 nt, Homo sapiens
uugauaccagu

SEQ ID NO: 1090263 - RNA, 17 nt, Homo sapiens
uugaucuccugagcucg

SEQ ID NO: 1090264 - RNA, 14 nt, Homo sapiens
uugaucucugcuua

SEQ ID NO: 1090265 - RNA, 22 nt, Homo sapiens
uugaugucauucagcagucagu

SEQ ID NO: 1090266 - RNA, 20 nt, Homo sapiens
uugcaacaagacaaagcaaa

SEQ ID NO: 1090267 - RNA, 12 nt, Homo sapiens
uugcaccaaaga

SEQ ID NO: 1090268 - RNA, 18 nt, Homo sapiens
uugcaccaaagacaucag

SEQ ID NO: 1090269 - RNA, 18 nt, Homo sapiens
uugcugaaugucauuauu

SEQ ID NO: 1090270 - RNA, 11 nt, Homo sapiens
uugcugccaau

SEQ ID NO: 1090271 - RNA, 17 nt, Homo sapiens
uugcuguugcuguugcu

SEQ ID NO: 1090272 - RNA, 16 nt, Homo sapiens
uuggcagaacugcugg

SEQ ID NO: 1090273 - RNA, 15 nt, Homo sapiens
uugggaaagcugccu

SEQ ID NO: 1090274 - RNA, 20 nt, Homo sapiens
uugggcaugauucuacccuu

SEQ ID NO: 1090275 - RNA, 22 nt, Homo sapiens
uugguacaguucauaauucacc

SEQ ID NO: 1090276 - RNA, 15 nt, Homo sapiens
uuggucccagacagc

SEQ ID NO: 1090277 - RNA, 15 nt, Homo sapiens
uuggugaacauugca

SEQ ID NO: 1090278 - RNA, 15 nt, Homo sapiens
uuguaaauacuccau

SEQ ID NO: 1090279 - RNA, 18 nt, Homo sapiens
uuguauuccucaugucau

SEQ ID NO: 1090280 - RNA, 14 nt, Homo sapiens
uugugaucauccca

SEQ ID NO: 1090281 - RNA, 18 nt, Homo sapiens
uugugauuuuugaacaau

SEQ ID NO: 1090282 - RNA, 14 nt, Homo sapiens
uugugcccacuuca

SEQ ID NO: 1090283 - RNA, 23 nt, Homo sapiens
uuguggcauauccauuguggaaa

SEQ ID NO: 1090284 - RNA, 20 nt, Homo sapiens
uuguuaggagaugucaucaa

SEQ ID NO: 1090285 - RNA, 17 nt, Homo sapiens
uuguugccaaggcagaa

SEQ ID NO: 1090286 - RNA, 23 nt, Homo sapiens
uuguuuucccgagcaaagucuaa

SEQ ID NO: 1090287 - RNA, 12 nt, Homo sapiens
uuuaaaacacaa

SEQ ID NO: 1090288 - RNA, 14 nt, Homo sapiens
uuuaaaagucacau

SEQ ID NO: 1090289 - RNA, 16 nt, Homo sapiens
uuuaaaagucacauaa

SEQ ID NO: 1090290 - RNA, 20 nt, Homo sapiens
uuuaaaguauguuauugcau

SEQ ID NO: 1090291 - RNA, 17 nt, Homo sapiens
uuuaaauaaaagcacaa

SEQ ID NO: 1090292 - RNA, 16 nt, Homo sapiens
uuuaaauaaagacaaa

SEQ ID NO: 1090293 - RNA, 18 nt, Homo sapiens
uuuaaaugaaagugagac

SEQ ID NO: 1090294 - RNA, 14 nt, Homo sapiens
uuuaacugcauaau

SEQ ID NO: 1090295 - RNA, 13 nt, Homo sapiens
uuuaagcuguaaa

SEQ ID NO: 1090296 - RNA, 23 nt, Homo sapiens
uuuaaggcagcaacaagaaaaga

SEQ ID NO: 1090297 - RNA, 20 nt, Homo sapiens
uuuaauaucugagaagugua

SEQ ID NO: 1090298 - RNA, 12 nt, Homo sapiens
uuuaaucuucca

SEQ ID NO: 1090299 - RNA, 16 nt, Homo sapiens
uuuaauugauuauucu

SEQ ID NO: 1090300 - RNA, 11 nt, Homo sapiens
uuuacauuuca

SEQ ID NO: 1090301 - RNA, 17 nt, Homo sapiens
uuuacuuccaugauacu

SEQ ID NO: 1090302 - RNA, 23 nt, Homo sapiens
uuuauaaaagaauaaaauugcac

SEQ ID NO: 1090303 - RNA, 19 nt, Homo sapiens
uuuauauaaagaaaaucaa

SEQ ID NO: 1090304 - RNA, 16 nt, Homo sapiens
uuuauauuugugugag

SEQ ID NO: 1090305 - RNA, 22 nt, Homo sapiens
uuuauuuauguaggaucuguca

SEQ ID NO: 1090306 - RNA, 22 nt, Homo sapiens
uuuauuuuuuuaaaacacaaau

SEQ ID NO: 1090307 - RNA, 21 nt, Homo sapiens
uuucagaauugaaggagaaaa

SEQ ID NO: 1090308 - RNA, 15 nt, Homo sapiens
uuucaugagcccaaa

SEQ ID NO: 1090309 - RNA, 17 nt, Homo sapiens
uuucaugcuuuccuaaa

SEQ ID NO: 1090310 - RNA, 17 nt, Homo sapiens
uuucauguaaauuuugu

SEQ ID NO: 1090311 - RNA, 18 nt, Homo sapiens
uuuccaaauacauuccag

SEQ ID NO: 1090312 - RNA, 14 nt, Homo sapiens
uuuccaacacacaa

SEQ ID NO: 1090313 - RNA, 12 nt, Homo sapiens
uuuccagaauug

SEQ ID NO: 1090314 - RNA, 19 nt, Homo sapiens
uuucuaaagcucugaacaa

SEQ ID NO: 1090315 - RNA, 16 nt, Homo sapiens
uuucuaccuuuacuac

SEQ ID NO: 1090316 - RNA, 13 nt, Homo sapiens
uuucuagacuguc

SEQ ID NO: 1090317 - RNA, 22 nt, Homo sapiens
uuucuccuuuuuuaugaugaca

SEQ ID NO: 1090318 - RNA, 20 nt, Homo sapiens
uuucucggcaccagugccuc

SEQ ID NO: 1090319 - RNA, 23 nt, Homo sapiens
uuucuggacaguaccugauugua

SEQ ID NO: 1090320 - RNA, 17 nt, Homo sapiens
uuucuugaaccaauaau

SEQ ID NO: 1090321 - RNA, 11 nt, Homo sapiens
uuucuuugaau

SEQ ID NO: 1090322 - RNA, 15 nt, Homo sapiens
uuugacuacuagagc

SEQ ID NO: 1090323 - RNA, 18 nt, Homo sapiens
uuugagcuggaaagcagc

SEQ ID NO: 1090324 - RNA, 16 nt, Homo sapiens
uuugaggcaaaggcca

SEQ ID NO: 1090325 - RNA, 15 nt, Homo sapiens
gugcuucagccugag

SEQ ID NO: 1090326 - RNA, 17 nt, Homo sapiens
guggaaggcagugaaca

SEQ ID NO: 1090327 - RNA, 21 nt, Homo sapiens
gugggaagaacuugucccuca

SEQ ID NO: 1090328 - RNA, 16 nt, Homo sapiens
gugggucccacuuccc

SEQ ID NO: 1090329 - RNA, 15 nt, Homo sapiens
guguagugucuguaa

SEQ ID NO: 1090330 - RNA, 13 nt, Homo sapiens
gugucugcagcuc

SEQ ID NO: 1090331 - RNA, 13 nt, Homo sapiens
gugugugugauau

SEQ ID NO: 1090332 - RNA, 14 nt, Homo sapiens
guguguguguauau

SEQ ID NO: 1090333 - RNA, 14 nt, Homo sapiens
guguguugauccca

SEQ ID NO: 1090334 - RNA, 16 nt, Homo sapiens
guguuccccagcugau

SEQ ID NO: 1090335 - RNA, 16 nt, Homo sapiens
guuaacacgugacacu

SEQ ID NO: 1090336 - RNA, 23 nt, Homo sapiens
guuacaaggguauccugugcuau

SEQ ID NO: 1090337 - RNA, 15 nt, Homo sapiens
guuacucucaccucg

SEQ ID NO: 1090338 - RNA, 14 nt, Homo sapiens
guuaguguuuagaa

SEQ ID NO: 1090339 - RNA, 11 nt, Homo sapiens
guucauauaau

SEQ ID NO: 1090340 - RNA, 22 nt, Homo sapiens
guucccacucccucucuugccg

SEQ ID NO: 1090341 - RNA, 21 nt, Homo sapiens
guuccccagcugaucauguca

SEQ ID NO: 1090342 - RNA, 22 nt, Homo sapiens
guuccucgggaugaaaagccau

SEQ ID NO: 1090343 - RNA, 17 nt, Homo sapiens
guucuccagauggagaa

SEQ ID NO: 1090344 - RNA, 14 nt, Homo sapiens
guugaaagacauca

SEQ ID NO: 1090345 - RNA, 19 nt, Homo sapiens
guugaaagacaucaaugaa

SEQ ID NO: 1090346 - RNA, 14 nt, Homo sapiens
guugagaacaaaaa

SEQ ID NO: 1090347 - RNA, 12 nt, Homo sapiens
guugaguuugcu

SEQ ID NO: 1090348 - RNA, 22 nt, Homo sapiens
guugauaagaguguaacaucca

SEQ ID NO: 1090349 - RNA, 12 nt, Homo sapiens
guugcacaaaaa

SEQ ID NO: 1090350 - RNA, 15 nt, Homo sapiens
guugcauauauggac

SEQ ID NO: 1090351 - RNA, 14 nt, Homo sapiens
guuggcaguguuug

SEQ ID NO: 1090352 - RNA, 14 nt, Homo sapiens
guugggcaugauuc

SEQ ID NO: 1090353 - RNA, 10 nt, Homo sapiens
guuggugcaa

SEQ ID NO: 1090354 - RNA, 18 nt, Homo sapiens
guuuaaaagucacauaaa

SEQ ID NO: 1090355 - RNA, 19 nt, Homo sapiens
guuuaaaaguccacuuuua

SEQ ID NO: 1090356 - RNA, 22 nt, Homo sapiens
guuuacaacaaacacugugaug

SEQ ID NO: 1090357 - RNA, 18 nt, Homo sapiens
guuuacauuuuguauauu

SEQ ID NO: 1090358 - RNA, 20 nt, Homo sapiens
guuuagaaucaagucuguga

SEQ ID NO: 1090359 - RNA, 18 nt, Homo sapiens
guuuaguauuaugucuua

SEQ ID NO: 1090360 - RNA, 22 nt, Homo sapiens
guuuauccacccacaacaucua

SEQ ID NO: 1090361 - RNA, 21 nt, Homo sapiens
guuuauuuuuuuaaaacacaa

SEQ ID NO: 1090362 - RNA, 14 nt, Homo sapiens
guuucucaucccau

SEQ ID NO: 1090363 - RNA, 15 nt, Homo sapiens
guuuuaaacauucuu

SEQ ID NO: 1090364 - RNA, 12 nt, Homo sapiens
guuuuagaacca

SEQ ID NO: 1090365 - RNA, 22 nt, Homo sapiens
guuuucauccauuaaaauuaau

SEQ ID NO: 1090366 - RNA, 22 nt, Homo sapiens
uaaaacucucaagcagacguga

SEQ ID NO: 1090367 - RNA, 22 nt, Homo sapiens
uaaaagaauaaaauugcacuuu

SEQ ID NO: 1090368 - RNA, 17 nt, Homo sapiens
uaaaagcacaaguacuu

SEQ ID NO: 1090369 - RNA, 20 nt, Homo sapiens
uaaaagcacaaguacuuuug

SEQ ID NO: 1090370 - RNA, 16 nt, Homo sapiens
uaaaagucacauaaaa

SEQ ID NO: 1090371 - RNA, 15 nt, Homo sapiens
uaaaaucauuucacu

SEQ ID NO: 1090372 - RNA, 15 nt, Homo sapiens
uaaaaucuggcaaag

SEQ ID NO: 1090373 - RNA, 19 nt, Homo sapiens
uaaaauuaauuugugcauc

SEQ ID NO: 1090374 - RNA, 24 nt, Homo sapiens
uaaaauuaauuugugcaucagaaa

SEQ ID NO: 1090375 - RNA, 16 nt, Homo sapiens
uaaaauuuauuucacu

SEQ ID NO: 1090376 - RNA, 21 nt, Homo sapiens
uaaacaaauuagcaaucauuu

SEQ ID NO: 1090377 - RNA, 15 nt, Homo sapiens
uaaacagacucgcuu

SEQ ID NO: 1090378 - RNA, 16 nt, Homo sapiens
uaaacagcaaagccau

SEQ ID NO: 1090379 - RNA, 20 nt, Homo sapiens
uaaagaaaaucaaugaagga

SEQ ID NO: 1090380 - RNA, 14 nt, Homo sapiens
uaaagcccuugaac

SEQ ID NO: 1090381 - RNA, 19 nt, Homo sapiens
uaaagcucugaacaaaagc

SEQ ID NO: 1090382 - RNA, 20 nt, Homo sapiens
uaaaggggcugucucccaau

SEQ ID NO: 1090383 - RNA, 20 nt, Homo sapiens
uaaaguauguuauugcauaa

SEQ ID NO: 1090384 - RNA, 12 nt, Homo sapiens
uaaauacaguca

SEQ ID NO: 1090385 - RNA, 16 nt, Homo sapiens
uaaauauauauuuauc

SEQ ID NO: 1090386 - RNA, 21 nt, Homo sapiens
uaaauaugugaaaaugauuag

SEQ ID NO: 1090387 - RNA, 18 nt, Homo sapiens
uaaaucaauucauugugu

SEQ ID NO: 1090388 - RNA, 14 nt, Homo sapiens
uaaaucccaagugu

SEQ ID NO: 1090389 - RNA, 21 nt, Homo sapiens
uaaauccucagguaguacugg

SEQ ID NO: 1090390 - RNA, 22 nt, Homo sapiens
uaaauuucucuacugucucagu

SEQ ID NO: 1090391 - RNA, 19 nt, Homo sapiens
uaacaauaugauugcacua

SEQ ID NO: 1090392 - RNA, 16 nt, Homo sapiens
uaaccauguaucuaau

SEQ ID NO: 1090393 - RNA, 16 nt, Homo sapiens
uaacucagacauucca

SEQ ID NO: 1090394 - RNA, 17 nt, Homo sapiens
uaacucagacauuccaa

SEQ ID NO: 1090395 - RNA, 20 nt, Homo sapiens
uaagaaauauauuugauaaa

SEQ ID NO: 1090396 - RNA, 18 nt, Homo sapiens
uaaguuuuguuuguucac

SEQ ID NO: 1090397 - RNA, 18 nt, Homo sapiens
uaauagauguuacucaaa

SEQ ID NO: 1090398 - RNA, 15 nt, Homo sapiens
uaauauauugcugcu

SEQ ID NO: 1090399 - RNA, 22 nt, Homo sapiens
uaaucaguuuuauccacagaaa

SEQ ID NO: 1090400 - RNA, 18 nt, Homo sapiens
uaaucccaauuuccccug

SEQ ID NO: 1090401 - RNA, 23 nt, Homo sapiens
uaauguauuuuuuagacccucua

SEQ ID NO: 1090402 - RNA, 19 nt, Homo sapiens
uaauucuuaggguacucau

SEQ ID NO: 1090403 - RNA, 14 nt, Homo sapiens
uaauuuguaucuga

SEQ ID NO: 1090404 - RNA, 18 nt, Homo sapiens
uaauuuguaucugaagga

SEQ ID NO: 1090405 - RNA, 13 nt, Homo sapiens
uaauuuucacuuu

SEQ ID NO: 1090406 - RNA, 20 nt, Homo sapiens
uaauuuuuauaaauauguga

SEQ ID NO: 1090407 - RNA, 16 nt, Homo sapiens
uaauuuuuugcagucu

SEQ ID NO: 1090408 - RNA, 16 nt, Homo sapiens
uacaaagauaugcuaa

SEQ ID NO: 1090409 - RNA, 15 nt, Homo sapiens
uacaacaaacacugu

SEQ ID NO: 1090410 - RNA, 20 nt, Homo sapiens
uacaacaaacacugugaugu

SEQ ID NO: 1090411 - RNA, 14 nt, Homo sapiens
uacaaccagcccaa

SEQ ID NO: 1090412 - RNA, 14 nt, Homo sapiens
uacaaccuauguaa

SEQ ID NO: 1090413 - RNA, 16 nt, Homo sapiens
uacaaccuauguaauu

SEQ ID NO: 1090414 - RNA, 14 nt, Homo sapiens
ugaaaggggaaaua

SEQ ID NO: 1090415 - RNA, 19 nt, Homo sapiens
ugaaaguugucacccugga

SEQ ID NO: 1090416 - RNA, 23 nt, Homo sapiens
ugaacaaagagagcucaucauca

SEQ ID NO: 1090417 - RNA, 12 nt, Homo sapiens
ugggaagccaua

SEQ ID NO: 1090418 - RNA, 21 nt, Homo sapiens
ugggacucauucacauuucaa

SEQ ID NO: 1090419 - RNA, 17 nt, Homo sapiens
ugggagaggagguccuu

SEQ ID NO: 1090420 - RNA, 22 nt, Homo sapiens
ugggcccaacaggcccuuggua

SEQ ID NO: 1090421 - RNA, 13 nt, Homo sapiens
uucauacaacaga

SEQ ID NO: 1090422 - RNA, 20 nt, Homo sapiens
uucaugacuuuuccauguau

SEQ ID NO: 1090423 - RNA, 15 nt, Homo sapiens
uucaugcccacugcc

SEQ ID NO: 1090424 - RNA, 22 nt, Homo sapiens
uucauuagggcaaagaucucag

SEQ ID NO: 1090425 - RNA, 15 nt, Homo sapiens
uuccaaaacauuucu

SEQ ID NO: 1090426 - RNA, 14 nt, Homo sapiens
uuccaagugccaau

SEQ ID NO: 1090427 - RNA, 17 nt, Homo sapiens
uagggaugacugugauu

SEQ ID NO: 1090428 - RNA, 22 nt, Homo sapiens
uagggcaaagaaucaacaguga

SEQ ID NO: 1090429 - RNA, 16 nt, Homo sapiens
uagggcaacaauacau

SEQ ID NO: 1090430 - RNA, 23 nt, Homo sapiens
uagggcaacaauacaugcugcua

SEQ ID NO: 1090431 - RNA, 23 nt, Homo sapiens
uaggguacucaucugacuugaac

SEQ ID NO: 1090432 - RNA, 17 nt, Homo sapiens
uaggguccuggcccucu

SEQ ID NO: 1090433 - RNA, 13 nt, Homo sapiens
uaguaaacugugc

SEQ ID NO: 1090434 - RNA, 22 nt, Homo sapiens
uaguaaagacaggguuucacca

SEQ ID NO: 1090435 - RNA, 14 nt, Homo sapiens
uaguagcauuucaa

SEQ ID NO: 1090436 - RNA, 13 nt, Homo sapiens
uaguagugucuuc

SEQ ID NO: 1090437 - RNA, 14 nt, Homo sapiens
uagugcacuagcau

SEQ ID NO: 1090438 - RNA, 23 nt, Homo sapiens
uagugucuugaauguaagaacau

SEQ ID NO: 1090439 - RNA, 14 nt, Homo sapiens
uaguuagaaagggu

SEQ ID NO: 1090440 - RNA, 21 nt, Homo sapiens
uaguuccaggacucagggacu

SEQ ID NO: 1090441 - RNA, 10 nt, Homo sapiens
uaguuugaua

SEQ ID NO: 1090442 - RNA, 21 nt, Homo sapiens
uauaaagaaaaucaaugaagg

SEQ ID NO: 1090443 - RNA, 17 nt, Homo sapiens
uauaaggaaagccaaau

SEQ ID NO: 1090444 - RNA, 20 nt, Homo sapiens
uauaauuuuauugcuggaau

SEQ ID NO: 1090445 - RNA, 15 nt, Homo sapiens
uauaccagaggaaag

SEQ ID NO: 1090446 - RNA, 20 nt, Homo sapiens
uauaggaaacauaauuuuga

SEQ ID NO: 1090447 - RNA, 14 nt, Homo sapiens
uauagguuuccacu

SEQ ID NO: 1090448 - RNA, 19 nt, Homo sapiens
uauagguuuccacugccaa

SEQ ID NO: 1090449 - RNA, 18 nt, Homo sapiens
uauauaacuuauuugccc

SEQ ID NO: 1090450 - RNA, 23 nt, Homo sapiens
uauauagcucuacacaacaugua

SEQ ID NO: 1090451 - RNA, 17 nt, Homo sapiens
uauauaguuugugguaa

SEQ ID NO: 1090452 - RNA, 19 nt, Homo sapiens
uauauauaguagcauuuca

SEQ ID NO: 1090453 - RNA, 15 nt, Homo sapiens
uauauugcugcuggu

SEQ ID NO: 1090454 - RNA, 17 nt, Homo sapiens
uaucaaaaagacugugg

SEQ ID NO: 1090455 - RNA, 19 nt, Homo sapiens
uaucaaaaaguacaauaau

SEQ ID NO: 1090456 - RNA, 22 nt, Homo sapiens
uauccaagaccuuacaaccaca

SEQ ID NO: 1090457 - RNA, 19 nt, Homo sapiens
uaucucggaccuuucagcu

SEQ ID NO: 1090458 - RNA, 22 nt, Homo sapiens
uaucuuaggauuuaccaaauag

SEQ ID NO: 1090459 - RNA, 13 nt, Homo sapiens
uaucuuguggcau

SEQ ID NO: 1090460 - RNA, 21 nt, Homo sapiens
uaucuuuaugcaaaaacauau

SEQ ID NO: 1090461 - RNA, 15 nt, Homo sapiens
uaugccuuaagccaa

SEQ ID NO: 1090462 - RNA, 14 nt, Homo sapiens
uaugggaagccaua

SEQ ID NO: 1090463 - RNA, 19 nt, Homo sapiens
uauguauauguauaucuau

SEQ ID NO: 1090464 - RNA, 17 nt, Homo sapiens
uaugugaaaaugauuag

SEQ ID NO: 1090465 - RNA, 15 nt, Homo sapiens
uauguuaauaucuga

SEQ ID NO: 1090466 - RNA, 16 nt, Homo sapiens
uauguuaauaucugau

SEQ ID NO: 1090467 - RNA, 13 nt, Homo sapiens
uauguuauugcau

SEQ ID NO: 1090468 - RNA, 18 nt, Homo sapiens
uauguuauuggaauuuuc

SEQ ID NO: 1090469 - RNA, 14 nt, Homo sapiens
uauuagaaugcaug

SEQ ID NO: 1090470 - RNA, 17 nt, Homo sapiens
uauuagcaacugugcua

SEQ ID NO: 1090471 - RNA, 18 nt, Homo sapiens
uauuagcaacugugcuac

SEQ ID NO: 1090472 - RNA, 16 nt, Homo sapiens
uauuauuuuuuccaca

SEQ ID NO: 1090473 - RNA, 15 nt, Homo sapiens
uauucagcacuaaaa

SEQ ID NO: 1090474 - RNA, 23 nt, Homo sapiens
uauucauucauuuacucauucau

SEQ ID NO: 1090475 - RNA, 21 nt, Homo sapiens
uauucccaugguagacuguga

SEQ ID NO: 1090476 - RNA, 13 nt, Homo sapiens
uauucugauaaug

SEQ ID NO: 1090477 - RNA, 17 nt, Homo sapiens
uauucugauuccacuuu

SEQ ID NO: 1090478 - RNA, 16 nt, Homo sapiens
uauugcauaauuuaua

SEQ ID NO: 1090479 - RNA, 16 nt, Homo sapiens
uauugcuaccaaaaac

SEQ ID NO: 1090480 - RNA, 15 nt, Homo sapiens
uauugcugcugguaa

SEQ ID NO: 1090481 - RNA, 20 nt, Homo sapiens
uauuguauuccucaugucau

SEQ ID NO: 1090482 - RNA, 20 nt, Homo sapiens
uauuguuacuauuauuugcu

SEQ ID NO: 1090483 - RNA, 13 nt, Homo sapiens
uauuuaaacaauu

SEQ ID NO: 1090484 - RNA, 14 nt, Homo sapiens
uauuuaugccucug

SEQ ID NO: 1090485 - RNA, 17 nt, Homo sapiens
uauuuaugccucuguau

SEQ ID NO: 1090486 - RNA, 18 nt, Homo sapiens
uauuuuuuuaagcuguaa

SEQ ID NO: 1090487 - RNA, 14 nt, Homo sapiens
ucaaaaaguacaau

SEQ ID NO: 1090488 - RNA, 20 nt, Homo sapiens
ucaaaauguccagcuucucu

SEQ ID NO: 1090489 - RNA, 14 nt, Homo sapiens
ucaaauacauacaa

SEQ ID NO: 1090490 - RNA, 23 nt, Homo sapiens
ucaaaugagaaaaugucuuuauu

SEQ ID NO: 1090491 - RNA, 21 nt, Homo sapiens
ucaacaaguaacuuuguagaa

SEQ ID NO: 1090492 - RNA, 13 nt, Homo sapiens
ucaacgugcauuu

SEQ ID NO: 1090493 - RNA, 20 nt, Homo sapiens
ucaagacccuuuucuguaug

SEQ ID NO: 1090494 - RNA, 22 nt, Homo sapiens
ucaagcagacgugagugugacu

SEQ ID NO: 1090495 - RNA, 18 nt, Homo sapiens
ucaagcccuuuacuugac

SEQ ID NO: 1090496 - RNA, 11 nt, Homo sapiens
ucaaggacuug

SEQ ID NO: 1090497 - RNA, 13 nt, Homo sapiens
ucaaucaaacagg

SEQ ID NO: 1090498 - RNA, 15 nt, Homo sapiens
ucaaucaaacaggga

SEQ ID NO: 1090499 - RNA, 23 nt, Homo sapiens
ucaauuuacuuuuuaaacagugu

SEQ ID NO: 1090500 - RNA, 20 nt, Homo sapiens
ucaccaaguguggaauugga

SEQ ID NO: 1090501 - RNA, 15 nt, Homo sapiens
ucaccuccucuguga

SEQ ID NO: 1090502 - RNA, 17 nt, Homo sapiens
ucaccucguuacucuca

SEQ ID NO: 1090503 - RNA, 14 nt, Homo sapiens
ucacgacucuuccu

SEQ ID NO: 1090504 - RNA, 17 nt, Homo sapiens
ucacgcuuauugcccag

SEQ ID NO: 1090505 - RNA, 14 nt, Homo sapiens
ucacugcuaccucu

SEQ ID NO: 1090506 - RNA, 18 nt, Homo sapiens
ucagaaaaugcagccuua

SEQ ID NO: 1090507 - RNA, 23 nt, Homo sapiens
ucagaauuuuggaaaaaugucac

SEQ ID NO: 1090508 - RNA, 15 nt, Homo sapiens
ucagaccaguacugg

SEQ ID NO: 1090509 - RNA, 16 nt, Homo sapiens
ucagaccaguacuggg

SEQ ID NO: 1090510 - RNA, 17 nt, Homo sapiens
ucagaccaguacuggga

SEQ ID NO: 1090511 - RNA, 21 nt, Homo sapiens
ucagacugcugggacuggcca

SEQ ID NO: 1090512 - RNA, 14 nt, Homo sapiens
ucagagcagcacug

SEQ ID NO: 1090513 - RNA, 21 nt, Homo sapiens
ucagagccucagcuucugggg

SEQ ID NO: 1090514 - RNA, 23 nt, Homo sapiens
ucagaugaguuuuauugacucau

SEQ ID NO: 1090515 - RNA, 21 nt, Homo sapiens
ucagaugauucagaaauuuuc

SEQ ID NO: 1090516 - RNA, 17 nt, Homo sapiens
ucagauucaggagcuca

SEQ ID NO: 1090517 - RNA, 13 nt, Homo sapiens
ucagcaacagagc

SEQ ID NO: 1090518 - RNA, 13 nt, Homo sapiens
ucagccucccaca

SEQ ID NO: 1090519 - RNA, 18 nt, Homo sapiens
ucagcuucugcugggcug

SEQ ID NO: 1090520 - RNA, 13 nt, Homo sapiens
ucaggccagucac

SEQ ID NO: 1090521 - RNA, 12 nt, Homo sapiens
ucagguauuugu

SEQ ID NO: 1090522 - RNA, 19 nt, Homo sapiens
ucaggugcauuccaccaca

SEQ ID NO: 1090523 - RNA, 17 nt, Homo sapiens
ucagugaaaaauaauua

SEQ ID NO: 1090524 - RNA, 15 nt, Homo sapiens
ucagugucagcacuc

SEQ ID NO: 1090525 - RNA, 17 nt, Homo sapiens
ucaguuccucuuugcau

SEQ ID NO: 1090526 - RNA, 20 nt, Homo sapiens
ucauaaccacccuagcuuua

SEQ ID NO: 1090527 - RNA, 22 nt, Homo sapiens
ucauagaugagaaaacugagag

SEQ ID NO: 1090528 - RNA, 22 nt, Homo sapiens
ucauauugcuaccaaaaacuag

SEQ ID NO: 1090529 - RNA, 22 nt, Homo sapiens
ucaucaaaaccugcgcagucau

SEQ ID NO: 1090530 - RNA, 21 nt, Homo sapiens
ucaucuuguugccauggaguu

SEQ ID NO: 1090531 - RNA, 22 nt, Homo sapiens
ucaugcaagacuucacugcagc

SEQ ID NO: 1090532 - RNA, 19 nt, Homo sapiens
ucaugcauucuagugcaga

SEQ ID NO: 1090533 - RNA, 16 nt, Homo sapiens
ucauuauuuuuuacaa

SEQ ID NO: 1090534 - RNA, 20 nt, Homo sapiens
ucauucagguauuuguaaua

SEQ ID NO: 1090535 - RNA, 21 nt, Homo sapiens
ucauuccagguguguucagua

SEQ ID NO: 1090536 - RNA, 17 nt, Homo sapiens
ucauugaagacccucaa

SEQ ID NO: 1090537 - RNA, 19 nt, Homo sapiens
ucauugucgcucagcaaua

SEQ ID NO: 1090538 - RNA, 15 nt, Homo sapiens
uccaaaagcaaacaa

SEQ ID NO: 1090539 - RNA, 14 nt, Homo sapiens
uccaaaaucaggcu

SEQ ID NO: 1090540 - RNA, 13 nt, Homo sapiens
uccaaaucaggcu

SEQ ID NO: 1090541 - RNA, 13 nt, Homo sapiens
uccaaaugccaac

SEQ ID NO: 1090542 - RNA, 17 nt, Homo sapiens
uccaaaugcugugcaaa

SEQ ID NO: 1090543 - RNA, 19 nt, Homo sapiens
uccaaccccccaccugcca

SEQ ID NO: 1090544 - RNA, 20 nt, Homo sapiens
uccaaccugccugugcauga

SEQ ID NO: 1090545 - RNA, 20 nt, Homo sapiens
uccaauccuuuauagcuuug

SEQ ID NO: 1090546 - RNA, 13 nt, Homo sapiens
uccacaagccauu

SEQ ID NO: 1090547 - RNA, 17 nt, Homo sapiens
uccacccacaacaucua

SEQ ID NO: 1090548 - RNA, 22 nt, Homo sapiens
uccaccuggccccuucuccagc

SEQ ID NO: 1090549 - RNA, 16 nt, Homo sapiens
uccacucccacuuccc

SEQ ID NO: 1090550 - RNA, 17 nt, Homo sapiens
uccacuuugaguaccaa

SEQ ID NO: 1090551 - RNA, 15 nt, Homo sapiens
aaaaaugucacugaa

SEQ ID NO: 1090552 - RNA, 20 nt, Homo sapiens
aaaacaucuuaguugaugcu

SEQ ID NO: 1090553 - RNA, 21 nt, Homo sapiens
aaaaccgcaaggguagacugg

SEQ ID NO: 1090554 - RNA, 18 nt, Homo sapiens
aaaaguaaguaccacuca

SEQ ID NO: 1090555 - RNA, 22 nt, Homo sapiens
aaaaguaaguaccacucaggcc

SEQ ID NO: 1090556 - RNA, 15 nt, Homo sapiens
aaaaucaaaugugca

SEQ ID NO: 1090557 - RNA, 16 nt, Homo sapiens
aaaaucaaaugugcau

SEQ ID NO: 1090558 - RNA, 16 nt, Homo sapiens
aaaaucuucagcuggu

SEQ ID NO: 1090559 - RNA, 22 nt, Homo sapiens
aaaaucuucagcugguggaugg

SEQ ID NO: 1090560 - RNA, 17 nt, Homo sapiens
aaaaugaauuugacugg

SEQ ID NO: 1090561 - RNA, 13 nt, Homo sapiens
aaaaugugacuca

SEQ ID NO: 1090562 - RNA, 20 nt, Homo sapiens
aaacaauuguaaauuucuuu

SEQ ID NO: 1090563 - RNA, 15 nt, Homo sapiens
aaacagacuauuuaa

SEQ ID NO: 1090564 - RNA, 22 nt, Homo sapiens
aaacagacuauuuaacuugagg

SEQ ID NO: 1090565 - RNA, 15 nt, Homo sapiens
aaacaggcucugaga

SEQ ID NO: 1090566 - RNA, 19 nt, Homo sapiens
aaacaucuuaguugaugcu

SEQ ID NO: 1090567 - RNA, 17 nt, Homo sapiens
aaacaugaaaacauuga

SEQ ID NO: 1090568 - RNA, 18 nt, Homo sapiens
aaacaugugcaacucuug

SEQ ID NO: 1090569 - RNA, 17 nt, Homo sapiens
aaaccagaaaagcaaua

SEQ ID NO: 1090570 - RNA, 15 nt, Homo sapiens
aaacccccagcauua

SEQ ID NO: 1090571 - RNA, 22 nt, Homo sapiens
aaaccucccccaagcagagcuu

SEQ ID NO: 1090572 - RNA, 14 nt, Homo sapiens
aaacguauuuugau

SEQ ID NO: 1090573 - RNA, 16 nt, Homo sapiens
aaacuaacacccaguc

SEQ ID NO: 1090574 - RNA, 12 nt, Homo sapiens
aaacuaaggauu

SEQ ID NO: 1090575 - RNA, 17 nt, Homo sapiens
aaacuauguaaugcuua

SEQ ID NO: 1090576 - RNA, 20 nt, Homo sapiens
aaacuugguauaucuggcca

SEQ ID NO: 1090577 - RNA, 23 nt, Homo sapiens
aaagaaauugugaaaaaugagcu

SEQ ID NO: 1090578 - RNA, 13 nt, Homo sapiens
aaagaaauuucca

SEQ ID NO: 1090579 - RNA, 19 nt, Homo sapiens
aaagaacugccccaucucc

SEQ ID NO: 1090580 - RNA, 12 nt, Homo sapiens
aaagacaucagu

SEQ ID NO: 1090581 - RNA, 19 nt, Homo sapiens
aaagauaugcuaagcagua

SEQ ID NO: 1090582 - RNA, 22 nt, Homo sapiens
aaagcaaauauauaaugcaaca

SEQ ID NO: 1090583 - RNA, 20 nt, Homo sapiens
aaagcaucaauacaaccagc

SEQ ID NO: 1090584 - RNA, 15 nt, Homo sapiens
aaagcccuugaacca

SEQ ID NO: 1090585 - RNA, 23 nt, Homo sapiens
aaagcuaagugaauuuuugcaca

SEQ ID NO: 1090586 - RNA, 16 nt, Homo sapiens
aaagcugggauuucag

SEQ ID NO: 1090587 - RNA, 21 nt, Homo sapiens
aaagcugugucucuguauaua

SEQ ID NO: 1090588 - RNA, 13 nt, Homo sapiens
aaaggaagaugua

SEQ ID NO: 1090589 - RNA, 16 nt, Homo sapiens
aaaguaaugcuucaau

SEQ ID NO: 1090590 - RNA, 11 nt, Homo sapiens
aaaguauauau

SEQ ID NO: 1090591 - RNA, 13 nt, Homo sapiens
aaagucacauaaa

SEQ ID NO: 1090592 - RNA, 21 nt, Homo sapiens
aaagucuggcuaugcucacag

SEQ ID NO: 1090593 - RNA, 23 nt, Homo sapiens
aaaguuugggaagggaugggaga

SEQ ID NO: 1090594 - RNA, 20 nt, Homo sapiens
aaauaaaaucuaauuaauuc

SEQ ID NO: 1090595 - RNA, 12 nt, Homo sapiens
aaauaaagacaa

SEQ ID NO: 1090596 - RNA, 20 nt, Homo sapiens
aaauaaagguuagauaaguc

SEQ ID NO: 1090597 - RNA, 15 nt, Homo sapiens
aaaucaaaugugcau

SEQ ID NO: 1090598 - RNA, 18 nt, Homo sapiens
aaaucacaagaacaaaua

SEQ ID NO: 1090599 - RNA, 16 nt, Homo sapiens
aaauccacaagccauu

SEQ ID NO: 1090600 - RNA, 19 nt, Homo sapiens
aaaucuauauacaaagccu

SEQ ID NO: 1090601 - RNA, 13 nt, Homo sapiens
aaaucuuuaaugg

SEQ ID NO: 1090602 - RNA, 13 nt, Homo sapiens
aaaugaaagugag

SEQ ID NO: 1090603 - RNA, 17 nt, Homo sapiens
aaaugaaguauuucuca

SEQ ID NO: 1090604 - RNA, 22 nt, Homo sapiens
aaaugugucauuggaagccauc

SEQ ID NO: 1090605 - RNA, 21 nt, Homo sapiens
aaaugugucugcaacauggau

SEQ ID NO: 1090606 - RNA, 14 nt, Homo sapiens
aaauuaaaguauac

SEQ ID NO: 1090607 - RNA, 20 nt, Homo sapiens
aaauucagaaagucauagau

SEQ ID NO: 1090608 - RNA, 15 nt, Homo sapiens
aaauuccaugcacuc

SEQ ID NO: 1090609 - RNA, 22 nt, Homo sapiens
aaauuuguugucauguguauga

SEQ ID NO: 1090610 - RNA, 19 nt, Homo sapiens
aacaaaaauguaaugauca

SEQ ID NO: 1090611 - RNA, 17 nt, Homo sapiens
aacaagacaaagcaaag

SEQ ID NO: 1090612 - RNA, 13 nt, Homo sapiens
aacaaggugcaca

SEQ ID NO: 1090613 - RNA, 21 nt, Homo sapiens
aacaaggugcacagaccucag

SEQ ID NO: 1090614 - RNA, 14 nt, Homo sapiens
aacaauaacacugc

SEQ ID NO: 1090615 - RNA, 21 nt, Homo sapiens
aacaauacaugcugcuaauuc

SEQ ID NO: 1090616 - RNA, 18 nt, Homo sapiens
aacaauccaaaugcauuc

SEQ ID NO: 1090617 - RNA, 14 nt, Homo sapiens
aacaauucucucuu

SEQ ID NO: 1090618 - RNA, 17 nt, Homo sapiens
aacaauuuuuuccccaa

SEQ ID NO: 1090619 - RNA, 12 nt, Homo sapiens
aacagaguaaau

SEQ ID NO: 1090620 - RNA, 14 nt, Homo sapiens
aacagauauuguca

SEQ ID NO: 1090621 - RNA, 20 nt, Homo sapiens
aacaggcucugagauuucac

SEQ ID NO: 1090622 - RNA, 20 nt, Homo sapiens
aacagggcaccccagcugac

SEQ ID NO: 1090623 - RNA, 16 nt, Homo sapiens
aacaugguaaaacccc

SEQ ID NO: 1090624 - RNA, 15 nt, Homo sapiens
aaccacacuucuuga

SEQ ID NO: 1090625 - RNA, 19 nt, Homo sapiens
aaccacccuaucaucaguu

SEQ ID NO: 1090626 - RNA, 14 nt, Homo sapiens
aaccacuaaugcuu

SEQ ID NO: 1090627 - RNA, 16 nt, Homo sapiens
aacccagccugagugc

SEQ ID NO: 1090628 - RNA, 22 nt, Homo sapiens
aaccccuuuucaguuugaacuc

SEQ ID NO: 1090629 - RNA, 20 nt, Homo sapiens
aacccuguggggccugaugg

SEQ ID NO: 1090630 - RNA, 12 nt, Homo sapiens
aaccgucccuga

SEQ ID NO: 1090631 - RNA, 20 nt, Homo sapiens
aaccucaggcuuccuuggca

SEQ ID NO: 1090632 - RNA, 18 nt, Homo sapiens
aaccucgagguuucucaa

SEQ ID NO: 1090633 - RNA, 14 nt, Homo sapiens
aacggguaucuuuu

SEQ ID NO: 1090634 - RNA, 18 nt, Homo sapiens
ccggccaggugggcgggc

SEQ ID NO: 1090635 - RNA, 14 nt, Homo sapiens
ccgggcucagggac

SEQ ID NO: 1090636 - RNA, 13 nt, Homo sapiens
ccgggugccauuc

SEQ ID NO: 1090637 - RNA, 11 nt, Homo sapiens
ccguugcacaa

SEQ ID NO: 1090638 - RNA, 14 nt, Homo sapiens
ccuaaagucucugc

SEQ ID NO: 1090639 - RNA, 19 nt, Homo sapiens
ccuaacagggcacauauuc

SEQ ID NO: 1090640 - RNA, 19 nt, Homo sapiens
ccuacugcuuccucugaau

SEQ ID NO: 1090641 - RNA, 19 nt, Homo sapiens
ccuaggaguacaagugccu

SEQ ID NO: 1090642 - RNA, 21 nt, Homo sapiens
ccuaguagcuuuccucccaaa

SEQ ID NO: 1090643 - RNA, 20 nt, Homo sapiens
ccuauagucccagcuacuca

SEQ ID NO: 1090644 - RNA, 19 nt, Homo sapiens
cucacuauucaaguauuag

SEQ ID NO: 1090645 - RNA, 13 nt, Homo sapiens
cucagacauucca

SEQ ID NO: 1090646 - RNA, 12 nt, Homo sapiens
cucagacuccug

SEQ ID NO: 1090647 - RNA, 18 nt, Homo sapiens
cucagcagccagcuccug

SEQ ID NO: 1090648 - RNA, 14 nt, Homo sapiens
cucagguaguacug

SEQ ID NO: 1090649 - RNA, 17 nt, Homo sapiens
cucagguaguacuggga

SEQ ID NO: 1090650 - RNA, 18 nt, Homo sapiens
cucagguaguacugggaa

SEQ ID NO: 1090651 - RNA, 16 nt, Homo sapiens
cucaggugaccaaaac

SEQ ID NO: 1090652 - RNA, 13 nt, Homo sapiens
gagaaaacugaga

SEQ ID NO: 1090653 - RNA, 16 nt, Homo sapiens
gagaacagggaugcua

SEQ ID NO: 1090654 - RNA, 15 nt, Homo sapiens
gagaaccaggcugcu

SEQ ID NO: 1090655 - RNA, 13 nt, Homo sapiens
gagaacgugccca

SEQ ID NO: 1090656 - RNA, 20 nt, Homo sapiens
gagaaguuggucuuacuuug

SEQ ID NO: 1090657 - RNA, 22 nt, Homo sapiens
gagaauggggguggggaggcaa

SEQ ID NO: 1090658 - RNA, 10 nt, Homo sapiens
ucccaaagug

SEQ ID NO: 1090659 - RNA, 13 nt, Homo sapiens
ucccaauuauuua

SEQ ID NO: 1090660 - RNA, 12 nt, Homo sapiens
ucccacaggugg

SEQ ID NO: 1090661 - RNA, 22 nt, Homo sapiens
ucccaccccauauuguucuuca

SEQ ID NO: 1090662 - RNA, 17 nt, Homo sapiens
ucccacccugggcaaug

SEQ ID NO: 1090663 - RNA, 19 nt, Homo sapiens
ucccacccugggcaaugca

SEQ ID NO: 1090664 - RNA, 17 nt, Homo sapiens
ucccaugguagacugug

SEQ ID NO: 1090665 - RNA, 19 nt, Homo sapiens
ucccauuugggcaguauag

SEQ ID NO: 1090666 - RNA, 22 nt, Homo sapiens
uccccggccacgucugugcucu

SEQ ID NO: 1090667 - RNA, 21 nt, Homo sapiens
uccccuacccccaguaaaauc

SEQ ID NO: 1090668 - RNA, 19 nt, Homo sapiens
ucccgagcuacucucuugc

SEQ ID NO: 1090669 - RNA, 19 nt, Homo sapiens
ucccugaagucuugcauug

SEQ ID NO: 1090670 - RNA, 20 nt, Homo sapiens
ucccugaagucuugcauuga

SEQ ID NO: 1090671 - RNA, 17 nt, Homo sapiens
ucccuguuaucugcuag

SEQ ID NO: 1090672 - RNA, 13 nt, Homo sapiens
ucccuuuuucaca

SEQ ID NO: 1090673 - RNA, 15 nt, Homo sapiens
uccgaggcaaagaga

SEQ ID NO: 1090674 - RNA, 22 nt, Homo sapiens
uccgaggcaaagagaaaagcca

SEQ ID NO: 1090675 - RNA, 22 nt, Homo sapiens
uccgcuggauggggagucucau

SEQ ID NO: 1090676 - RNA, 20 nt, Homo sapiens
uccuaaucaagagucucucc

SEQ ID NO: 1090677 - RNA, 15 nt, Homo sapiens
uccuaccacuuugaa

SEQ ID NO: 1090678 - RNA, 14 nt, Homo sapiens
uccuaguagcuuuc

SEQ ID NO: 1090679 - RNA, 15 nt, Homo sapiens
uccuaguucuuauga

SEQ ID NO: 1090680 - RNA, 22 nt, Homo sapiens
uccucaauucaauguggugaug

SEQ ID NO: 1090681 - RNA, 20 nt, Homo sapiens
uccucacagcaucucuauga

SEQ ID NO: 1090682 - RNA, 17 nt, Homo sapiens
uccucaggugaccaaaa

SEQ ID NO: 1090683 - RNA, 16 nt, Homo sapiens
uccuccccaccagagc

SEQ ID NO: 1090684 - RNA, 19 nt, Homo sapiens
uccucggcccaucugucca

SEQ ID NO: 1090685 - RNA, 16 nt, Homo sapiens
uccucgguacucccau

SEQ ID NO: 1090686 - RNA, 13 nt, Homo sapiens
uccucguagccau

SEQ ID NO: 1090687 - RNA, 23 nt, Homo sapiens
uccugcaccgagagagauggaau

SEQ ID NO: 1090688 - RNA, 19 nt, Homo sapiens
uccugcagccugaccccag

SEQ ID NO: 1090689 - RNA, 16 nt, Homo sapiens
uccugccuagucucac

SEQ ID NO: 1090690 - RNA, 15 nt, Homo sapiens
uccuggaaugaagca

SEQ ID NO: 1090691 - RNA, 16 nt, Homo sapiens
uccuggcaugacacuc

SEQ ID NO: 1090692 - RNA, 17 nt, Homo sapiens
uccuggcaugacacucu

SEQ ID NO: 1090693 - RNA, 18 nt, Homo sapiens
uccuggcaugacacucua

SEQ ID NO: 1090694 - RNA, 21 nt, Homo sapiens
uccuggcccucuucuuauuca

SEQ ID NO: 1090695 - RNA, 22 nt, Homo sapiens
uccugucuguauauaacuuauu

SEQ ID NO: 1090696 - RNA, 16 nt, Homo sapiens
uccuuagaaguggaag

SEQ ID NO: 1090697 - RNA, 14 nt, Homo sapiens
uccuucaccaccuc

SEQ ID NO: 1090698 - RNA, 17 nt, Homo sapiens
uccuucuuaacucugca

SEQ ID NO: 1090699 - RNA, 14 nt, Homo sapiens
uccuuuaccccaca

SEQ ID NO: 1090700 - RNA, 13 nt, Homo sapiens
uccuuuugguucc

SEQ ID NO: 1090701 - RNA, 18 nt, Homo sapiens
ucgaauuuuucagaugau

SEQ ID NO: 1090702 - RNA, 15 nt, Homo sapiens
ucgagcaugcccuga

SEQ ID NO: 1090703 - RNA, 23 nt, Homo sapiens
ucgaguaacuuuaaaaaaaucau

SEQ ID NO: 1090704 - RNA, 13 nt, Homo sapiens
ucgcccuggccag

SEQ ID NO: 1090705 - RNA, 13 nt, Homo sapiens
ucguagccaucuc

SEQ ID NO: 1090706 - RNA, 22 nt, Homo sapiens
ucgugauauccacaaaugcuau

SEQ ID NO: 1090707 - RNA, 24 nt, Homo sapiens
ucgugauauccacaaaugcuauuc

SEQ ID NO: 1090708 - RNA, 16 nt, Homo sapiens
ucguguccagccugac

SEQ ID NO: 1090709 - RNA, 22 nt, Homo sapiens
ucuaacucccuccucacacucc

SEQ ID NO: 1090710 - RNA, 14 nt, Homo sapiens
ucuacacaacaugu

SEQ ID NO: 1090711 - RNA, 13 nt, Homo sapiens
ucuacacauauau

SEQ ID NO: 1090712 - RNA, 16 nt, Homo sapiens
ucuaccuuuacuacau

SEQ ID NO: 1090713 - RNA, 21 nt, Homo sapiens
ucuaccuuuuuuucucuccua

SEQ ID NO: 1090714 - RNA, 17 nt, Homo sapiens
ucuacuccuaccucagc

SEQ ID NO: 1090715 - RNA, 22 nt, Homo sapiens
ucuagacugucucuguggaaua

SEQ ID NO: 1090716 - RNA, 14 nt, Homo sapiens
ucuagugacuuccu

SEQ ID NO: 1090717 - RNA, 16 nt, Homo sapiens
ucuauuuccuccccca

SEQ ID NO: 1090718 - RNA, 11 nt, Homo sapiens
ucucacacucc

SEQ ID NO: 1090719 - RNA, 15 nt, Homo sapiens
ucucacagauaccca

SEQ ID NO: 1090720 - RNA, 17 nt, Homo sapiens
ucucagaguccagucaa

SEQ ID NO: 1090721 - RNA, 18 nt, Homo sapiens
ucucaggugacggacuca

SEQ ID NO: 1090722 - RNA, 19 nt, Homo sapiens
ucucaugcaagacuucacu

SEQ ID NO: 1090723 - RNA, 14 nt, Homo sapiens
ucuccaauuugaag

SEQ ID NO: 1090724 - RNA, 21 nt, Homo sapiens
ucucccagugacaacaucgca

SEQ ID NO: 1090725 - RNA, 18 nt, Homo sapiens
ucucccauacuuuugaag

SEQ ID NO: 1090726 - RNA, 15 nt, Homo sapiens
ucuccugccucagcc

SEQ ID NO: 1090727 - RNA, 13 nt, Homo sapiens
ucuccugcugcag

SEQ ID NO: 1090728 - RNA, 23 nt, Homo sapiens
ucuccuuuaaacagacucgcuuu

SEQ ID NO: 1090729 - RNA, 23 nt, Homo sapiens
ucucuccuaagacaccugcaaua

SEQ ID NO: 1090730 - RNA, 15 nt, Homo sapiens
ucucugccugcuucc

SEQ ID NO: 1090731 - RNA, 14 nt, Homo sapiens
ucucuuaauuuuuc

SEQ ID NO: 1090732 - RNA, 21 nt, Homo sapiens
ucucuugccagcauuuucaca

SEQ ID NO: 1090733 - RNA, 18 nt, Homo sapiens
ucucuugcucaccaagaa

SEQ ID NO: 1090734 - RNA, 20 nt, Homo sapiens
ucugaacaaagagagcucau

SEQ ID NO: 1090735 - RNA, 18 nt, Homo sapiens
ucugacuuucucuucuac

SEQ ID NO: 1090736 - RNA, 16 nt, Homo sapiens
ucugauauaacaaacu

SEQ ID NO: 1090737 - RNA, 17 nt, Homo sapiens
ucugcaaagacuagauc

SEQ ID NO: 1090738 - RNA, 17 nt, Homo sapiens
ucugcagauagugccuc

SEQ ID NO: 1090739 - RNA, 12 nt, Homo sapiens
ugccuuccucau

SEQ ID NO: 1090740 - RNA, 21 nt, Homo sapiens
ugccuuugggaggcagcauca

SEQ ID NO: 1090741 - RNA, 22 nt, Homo sapiens
ugcguaggagagaacagggaug

SEQ ID NO: 1090742 - RNA, 21 nt, Homo sapiens
ugcgucagaccaguacuggga

SEQ ID NO: 1090743 - RNA, 12 nt, Homo sapiens
ugcuaccaaaaa

SEQ ID NO: 1090744 - RNA, 22 nt, Homo sapiens
ugcuaucucgcuagccauauau

SEQ ID NO: 1090745 - RNA, 15 nt, Homo sapiens
ugcucauuguggcca

SEQ ID NO: 1090746 - RNA, 23 nt, Homo sapiens
ugcugagugcaccacuucaagug

SEQ ID NO: 1090747 - RNA, 23 nt, Homo sapiens
ugcugcugagugcaccacuucaa

SEQ ID NO: 1090748 - RNA, 16 nt, Homo sapiens
ugcuggccugcucuua

SEQ ID NO: 1090749 - RNA, 23 nt, Homo sapiens
ugcuggcuuucuuuucucuauga

SEQ ID NO: 1090750 - RNA, 10 nt, Homo sapiens
ugcugugcaa

SEQ ID NO: 1090751 - RNA, 14 nt, Homo sapiens
ugcuguuaccaaau

SEQ ID NO: 1090752 - RNA, 21 nt, Homo sapiens
ugcuguuggcaucuugcugcu

SEQ ID NO: 1090753 - RNA, 23 nt, Homo sapiens
ugcuucccuggggccccauuugc

SEQ ID NO: 1090754 - RNA, 21 nt, Homo sapiens
ugcuucugccucagcuuccca

SEQ ID NO: 1090755 - RNA, 14 nt, Homo sapiens
ugcuugaauugcaa

SEQ ID NO: 1090756 - RNA, 14 nt, Homo sapiens
ugcuugauuaaaca

SEQ ID NO: 1090757 - RNA, 14 nt, Homo sapiens
uggaaaaaugucac

SEQ ID NO: 1090758 - RNA, 20 nt, Homo sapiens
uggaaagccucugcugccau

SEQ ID NO: 1090759 - RNA, 19 nt, Homo sapiens
uggaauaaagcccuugaac

SEQ ID NO: 1090760 - RNA, 15 nt, Homo sapiens
uggacccauuugcca

SEQ ID NO: 1090761 - RNA, 15 nt, Homo sapiens
uggauuugucuuugg

SEQ ID NO: 1090762 - RNA, 22 nt, Homo sapiens
uggauuugucuuuggugaacau

SEQ ID NO: 1090763 - RNA, 16 nt, Homo sapiens
uggcaacccucagcug

SEQ ID NO: 1090764 - RNA, 13 nt, Homo sapiens
uggcaguguuugu

SEQ ID NO: 1090765 - RNA, 20 nt, Homo sapiens
uggcauguggguugugauau

SEQ ID NO: 1090766 - RNA, 16 nt, Homo sapiens
uggccaccagcuuccc

SEQ ID NO: 1090767 - RNA, 18 nt, Homo sapiens
uggcccucgcucugccuc

SEQ ID NO: 1090768 - RNA, 15 nt, Homo sapiens
uggcccucuuugaaa

SEQ ID NO: 1090769 - RNA, 20 nt, Homo sapiens
uggcugcuggcccacagcuc

SEQ ID NO: 1090770 - RNA, 17 nt, Homo sapiens
uggcuggcuguguccuc

SEQ ID NO: 1090771 - RNA, 16 nt, Homo sapiens
uggcuuuacaaauaau

SEQ ID NO: 1090772 - RNA, 23 nt, Homo sapiens
ugggaagccauauucacaccuca

SEQ ID NO: 1090773 - RNA, 21 nt, Homo sapiens
ugggaagggaucccuuuguau

SEQ ID NO: 1090774 - RNA, 19 nt, Homo sapiens
ugggcucagauccugggca

SEQ ID NO: 1090775 - RNA, 17 nt, Homo sapiens
ugggcuuuugaacugua

SEQ ID NO: 1090776 - RNA, 20 nt, Homo sapiens
uggggagccauaagggacau

SEQ ID NO: 1090777 - RNA, 17 nt, Homo sapiens
uggggguuaccaaaaau

SEQ ID NO: 1090778 - RNA, 17 nt, Homo sapiens
ugggguuccccuggaaa

SEQ ID NO: 1090779 - RNA, 21 nt, Homo sapiens
ugggucuucccuguaugauuc

SEQ ID NO: 1090780 - RNA, 22 nt, Homo sapiens
uggguuggggacccccucagga

SEQ ID NO: 1090781 - RNA, 14 nt, Homo sapiens
ugguaccuccuagg

SEQ ID NO: 1090782 - RNA, 22 nt, Homo sapiens
ugguacugagguugggcugaga

SEQ ID NO: 1090783 - RNA, 18 nt, Homo sapiens
ugguggggaccagcuaau

SEQ ID NO: 1090784 - RNA, 15 nt, Homo sapiens
ugguuccuaagccug

SEQ ID NO: 1090785 - RNA, 14 nt, Homo sapiens
ugguuuacuguguu

SEQ ID NO: 1090786 - RNA, 23 nt, Homo sapiens
ugguuuuuguugagucucugaac

SEQ ID NO: 1090787 - RNA, 19 nt, Homo sapiens
uguaaaacuaaacauacau

SEQ ID NO: 1090788 - RNA, 18 nt, Homo sapiens
cuuacagucagcacagaa

SEQ ID NO: 1090789 - RNA, 14 nt, Homo sapiens
cuuagaggcaaaga

SEQ ID NO: 1090790 - RNA, 11 nt, Homo sapiens
cuuaggugcca

SEQ ID NO: 1090791 - RNA, 15 nt, Homo sapiens
cuuauagguuuccac

SEQ ID NO: 1090792 - RNA, 13 nt, Homo sapiens
cuuauguguugca

SEQ ID NO: 1090793 - RNA, 23 nt, Homo sapiens
cuuauuugagugauuauuuguua

SEQ ID NO: 1090794 - RNA, 16 nt, Homo sapiens
cuucaaguuagcucag

SEQ ID NO: 1090795 - RNA, 19 nt, Homo sapiens
ggaaguuauguuguucaaa

SEQ ID NO: 1090796 - RNA, 23 nt, Homo sapiens
ggaauauauuugugugugugaua

SEQ ID NO: 1090797 - RNA, 14 nt, Homo sapiens
ggacccccucagga

SEQ ID NO: 1090798 - RNA, 18 nt, Homo sapiens
ggacccuggccuaaagaa

SEQ ID NO: 1090799 - RNA, 21 nt, Homo sapiens
ggagagagcagcuucugccac

SEQ ID NO: 1090800 - RNA, 23 nt, Homo sapiens
ggaggagaaaagugacagauccu

SEQ ID NO: 1090801 - RNA, 23 nt, Homo sapiens
ggaggucuccccugauccagaca

SEQ ID NO: 1090802 - RNA, 12 nt, Homo sapiens
ggauacagucau

SEQ ID NO: 1090803 - RNA, 13 nt, Homo sapiens
ggauauuuacuac

SEQ ID NO: 1090804 - RNA, 20 nt, Homo sapiens
ggauuaaugguccugugaug

SEQ ID NO: 1090805 - RNA, 14 nt, Homo sapiens
ggcaaagaucucag

SEQ ID NO: 1090806 - RNA, 22 nt, Homo sapiens
ggcaaagaucucagcagccagc

SEQ ID NO: 1090807 - RNA, 16 nt, Homo sapiens
ggcacaaaugcaccuc

SEQ ID NO: 1090808 - RNA, 23 nt, Homo sapiens
ggcacaaaugcaccucccaguuu

SEQ ID NO: 1090809 - RNA, 16 nt, Homo sapiens
ggcacgucccaugugc

SEQ ID NO: 1090810 - RNA, 18 nt, Homo sapiens
ggcagcaucagggacaca

SEQ ID NO: 1090811 - RNA, 17 nt, Homo sapiens
ggcaguucuguguccuc

SEQ ID NO: 1090812 - RNA, 19 nt, Homo sapiens
ggcauucucucugcucagu

SEQ ID NO: 1090813 - RNA, 22 nt, Homo sapiens
ggcauucucucugcucagugau

SEQ ID NO: 1090814 - RNA, 17 nt, Homo sapiens
ggccaacggcaacagca

SEQ ID NO: 1090815 - RNA, 14 nt, Homo sapiens
ggccacacuggcau

SEQ ID NO: 1090816 - RNA, 13 nt, Homo sapiens
ggccaucuuccag

SEQ ID NO: 1090817 - RNA, 18 nt, Homo sapiens
ggcccagccacugcagca

SEQ ID NO: 1090818 - RNA, 20 nt, Homo sapiens
ggcccagccacugcagcaca

SEQ ID NO: 1090819 - RNA, 15 nt, Homo sapiens
ggcccucuucuuauu

SEQ ID NO: 1090820 - RNA, 12 nt, Homo sapiens
ggccuccaggac

SEQ ID NO: 1090821 - RNA, 16 nt, Homo sapiens
ggccucgucuuucaug

SEQ ID NO: 1090822 - RNA, 22 nt, Homo sapiens
ggccugcucugcuuuuccuguc

SEQ ID NO: 1090823 - RNA, 17 nt, Homo sapiens
ggccuucuccacaggga

SEQ ID NO: 1090824 - RNA, 15 nt, Homo sapiens
ggcgcaucauaugca

SEQ ID NO: 1090825 - RNA, 17 nt, Homo sapiens
ggcuaaaucccaagugu

SEQ ID NO: 1090826 - RNA, 20 nt, Homo sapiens
ggcuccaggcuccucaugag

SEQ ID NO: 1090827 - RNA, 21 nt, Homo sapiens
ggcucccuccuggagcauccc

SEQ ID NO: 1090828 - RNA, 18 nt, Homo sapiens
ggcugacccagugugugc

SEQ ID NO: 1090829 - RNA, 23 nt, Homo sapiens
ggcugccuccacucccacuuccc

SEQ ID NO: 1090830 - RNA, 16 nt, Homo sapiens
ggcuggaguucagugg

SEQ ID NO: 1090831 - RNA, 17 nt, Homo sapiens
gggaacaagcauucucc

SEQ ID NO: 1090832 - RNA, 15 nt, Homo sapiens
gggacccucccagug

SEQ ID NO: 1090833 - RNA, 22 nt, Homo sapiens
gggagcaugggacugugccuuu

SEQ ID NO: 1090834 - RNA, 23 nt, Homo sapiens
gggaucagccuccgccauuccaa

SEQ ID NO: 1090835 - RNA, 24 nt, Homo sapiens
gggaugggcuuucucagugucagc

SEQ ID NO: 1090836 - RNA, 20 nt, Homo sapiens
gggauuuucauuagggcaaa

SEQ ID NO: 1090837 - RNA, 21 nt, Homo sapiens
gggcaacaauacaugcugcua

SEQ ID NO: 1090838 - RNA, 16 nt, Homo sapiens
gggcaagucccugacu

SEQ ID NO: 1090839 - RNA, 12 nt, Homo sapiens
gggcacagggag

SEQ ID NO: 1090840 - RNA, 19 nt, Homo sapiens
gggcaccccagcugaccug

SEQ ID NO: 1090841 - RNA, 16 nt, Homo sapiens
gggccagggcccugca

SEQ ID NO: 1090842 - RNA, 14 nt, Homo sapiens
gggccauacuggcc

SEQ ID NO: 1090843 - RNA, 14 nt, Homo sapiens
gggcccaacaggcc

SEQ ID NO: 1090844 - RNA, 17 nt, Homo sapiens
gggccugauggugcuca

SEQ ID NO: 1090845 - RNA, 20 nt, Homo sapiens
gggcuaaaucccaagugucu

SEQ ID NO: 1090846 - RNA, 17 nt, Homo sapiens
gggcugacccagugugu

SEQ ID NO: 1090847 - RNA, 22 nt, Homo sapiens
gggcugagcccuggcaggauga

SEQ ID NO: 1090848 - RNA, 19 nt, Homo sapiens
gggcugugucguagccaag

SEQ ID NO: 1090849 - RNA, 19 nt, Homo sapiens
ggggagcaguaaacuuucu

SEQ ID NO: 1090850 - RNA, 15 nt, Homo sapiens
ggggagcaugggacu

SEQ ID NO: 1090851 - RNA, 21 nt, Homo sapiens
gggguauuuuaggcagggauu

SEQ ID NO: 1090852 - RNA, 13 nt, Homo sapiens
ggguccccaagga

SEQ ID NO: 1090853 - RNA, 22 nt, Homo sapiens
gggucucggugguaccaggucu

SEQ ID NO: 1090854 - RNA, 14 nt, Homo sapiens
ggguugaaagacau

SEQ ID NO: 1090855 - RNA, 14 nt, Homo sapiens
gguagcgagcugcu

SEQ ID NO: 1090856 - RNA, 23 nt, Homo sapiens
gguaguuuguuuuagaaccagcc

SEQ ID NO: 1090857 - RNA, 21 nt, Homo sapiens
ggucuuguucaagcagcgagu

SEQ ID NO: 1090858 - RNA, 23 nt, Homo sapiens
ggugacagugacgugacucagag

SEQ ID NO: 1090859 - RNA, 21 nt, Homo sapiens
ggugccaggcuguaagcauuc

SEQ ID NO: 1090860 - RNA, 20 nt, Homo sapiens
ggugcuaucgcaccacugug

SEQ ID NO: 1090861 - RNA, 20 nt, Homo sapiens
gguguaagccaguuccagca

SEQ ID NO: 1090862 - RNA, 18 nt, Homo sapiens
gguguaauuccucccuaa

SEQ ID NO: 1090863 - RNA, 20 nt, Homo sapiens
gguuggggacccccucagga

SEQ ID NO: 1090864 - RNA, 16 nt, Homo sapiens
gguuuacaacaaacac

SEQ ID NO: 1090865 - RNA, 23 nt, Homo sapiens
gguuuacaacaaacacugugaug

SEQ ID NO: 1090866 - RNA, 13 nt, Homo sapiens
gguuuagaaucaa

SEQ ID NO: 1090867 - RNA, 21 nt, Homo sapiens
guaaauuucucuacugucuca

SEQ ID NO: 1090868 - RNA, 16 nt, Homo sapiens
guaacaaaaguauagu

SEQ ID NO: 1090869 - RNA, 21 nt, Homo sapiens
guaaccaguagucaccucugg

SEQ ID NO: 1090870 - RNA, 16 nt, Homo sapiens
guaacuacccucucaa

SEQ ID NO: 1090871 - RNA, 14 nt, Homo sapiens
guaacucuuggcca

SEQ ID NO: 1090872 - RNA, 22 nt, Homo sapiens
guaaggucuucuuguguccuga

SEQ ID NO: 1090873 - RNA, 20 nt, Homo sapiens
guaaguaccacucaggccaa

SEQ ID NO: 1090874 - RNA, 23 nt, Homo sapiens
guaaguugaauggccugccuuga

SEQ ID NO: 1090875 - RNA, 21 nt, Homo sapiens
guaauaccuuaguuuuuucca

SEQ ID NO: 1090876 - RNA, 21 nt, Homo sapiens
guaauauacaagcaagcaaaa

SEQ ID NO: 1090877 - RNA, 17 nt, Homo sapiens
guaaucauuccaggugu

SEQ ID NO: 1090878 - RNA, 12 nt, Homo sapiens
guaaugagcucc

SEQ ID NO: 1090879 - RNA, 15 nt, Homo sapiens
guaauggaaugcaaa

SEQ ID NO: 1090880 - RNA, 11 nt, Homo sapiens
guacaauaaua

SEQ ID NO: 1090881 - RNA, 21 nt, Homo sapiens
guaccaaauccacaagccauu

SEQ ID NO: 1090882 - RNA, 12 nt, Homo sapiens
gucugugcucug

SEQ ID NO: 1090883 - RNA, 16 nt, Homo sapiens
gugacucuaccugcaa

SEQ ID NO: 1090884 - RNA, 16 nt, Homo sapiens
gugagacccuguucua

SEQ ID NO: 1090885 - RNA, 15 nt, Homo sapiens
gugauauaugcaugu

SEQ ID NO: 1090886 - RNA, 23 nt, Homo sapiens
gugaucaaagguaacucgaggug

SEQ ID NO: 1090887 - RNA, 13 nt, Homo sapiens
gugaucaucccau

SEQ ID NO: 1090888 - RNA, 14 nt, Homo sapiens
gugaucucacuuaa

SEQ ID NO: 1090889 - RNA, 20 nt, Homo sapiens
gugauuccauuuuacuucca

SEQ ID NO: 1090890 - RNA, 16 nt, Homo sapiens
gugauuccugcugccu

SEQ ID NO: 1090891 - RNA, 11 nt, Homo sapiens
gugauuugccu

SEQ ID NO: 1090892 - RNA, 20 nt, Homo sapiens
gugcaauggcacgaucucag

SEQ ID NO: 1090893 - RNA, 18 nt, Homo sapiens
gugcacagaccucagaga

SEQ ID NO: 1090894 - RNA, 11 nt, Homo sapiens
gugcacagcuu

SEQ ID NO: 1090895 - RNA, 21 nt, Homo sapiens
gugccaggcuguaagcauucu

SEQ ID NO: 1090896 - RNA, 21 nt, Homo sapiens
gugcccaccagcggccuugaa

SEQ ID NO: 1090897 - RNA, 21 nt, Homo sapiens
gugccucagugcugcaauuga

SEQ ID NO: 1090898 - RNA, 21 nt, Homo sapiens
gugccucugcaaacuaaggag

SEQ ID NO: 1090899 - RNA, 20 nt, Homo sapiens
gugcuaucgcaccacugugu

SEQ ID NO: 1090900 - RNA, 23 nt, Homo sapiens
gugcugcauggagugagcaguag

SEQ ID NO: 1090901 - RNA, 21 nt, Homo sapiens
gugcugcuguggcaucaggaa

SEQ ID NO: 1090902 - RNA, 18 nt, Homo sapiens
gugcuguggccugggcaa

SEQ ID NO: 1090903 - RNA, 20 nt, Homo sapiens
gugcuuuauaccccauuuga

SEQ ID NO: 1090904 - RNA, 16 nt, Homo sapiens
guggauuggauuuguc

SEQ ID NO: 1090905 - RNA, 15 nt, Homo sapiens
gugggcuccuuacag

SEQ ID NO: 1090906 - RNA, 23 nt, Homo sapiens
gugguagaagccaguacagagaa

SEQ ID NO: 1090907 - RNA, 17 nt, Homo sapiens
guguaauuccucccuaa

SEQ ID NO: 1090908 - RNA, 13 nt, Homo sapiens
guguagugucugu

SEQ ID NO: 1090909 - RNA, 21 nt, Homo sapiens
guguauauauaguagcauuuc

SEQ ID NO: 1090910 - RNA, 18 nt, Homo sapiens
gugucaacuuucauuuga

SEQ ID NO: 1090911 - RNA, 18 nt, Homo sapiens
gugucauuggaagccauc

SEQ ID NO: 1090912 - RNA, 14 nt, Homo sapiens
guguccucuccagc

SEQ ID NO: 1090913 - RNA, 14 nt, Homo sapiens
gugugugucucuga

SEQ ID NO: 1090914 - RNA, 12 nt, Homo sapiens
guguugauccca

SEQ ID NO: 1090915 - RNA, 13 nt, Homo sapiens
guguugcauaaac

SEQ ID NO: 1090916 - RNA, 17 nt, Homo sapiens
guuaaacuacuuguaaa

SEQ ID NO: 1090917 - RNA, 22 nt, Homo sapiens
guuaaagcuuuggugccuggaa

SEQ ID NO: 1090918 - RNA, 16 nt, Homo sapiens
guuaagugaaugucua

SEQ ID NO: 1090919 - RNA, 20 nt, Homo sapiens
guuaauaucugauacuguau

SEQ ID NO: 1090920 - RNA, 19 nt, Homo sapiens
guuagggaugacugugauu

SEQ ID NO: 1090921 - RNA, 12 nt, Homo sapiens
guuaucugcuag

SEQ ID NO: 1090922 - RNA, 11 nt, Homo sapiens
guuaugaucua

SEQ ID NO: 1090923 - RNA, 21 nt, Homo sapiens
guuauuucucccuuguguuag

SEQ ID NO: 1090924 - RNA, 15 nt, Homo sapiens
guuauuuuaauuauc

SEQ ID NO: 1090925 - RNA, 14 nt, Homo sapiens
guucacacuccuau

SEQ ID NO: 1090926 - RNA, 15 nt, Homo sapiens
guucaguaguuccag

SEQ ID NO: 1090927 - RNA, 18 nt, Homo sapiens
guucaguaguuccaggac

SEQ ID NO: 1090928 - RNA, 14 nt, Homo sapiens
guucccaagcaaag

SEQ ID NO: 1090929 - RNA, 19 nt, Homo sapiens
guucccagcaaaguuuuca

SEQ ID NO: 1090930 - RNA, 23 nt, Homo sapiens
guucucuguucuagagugacagg

SEQ ID NO: 1090931 - RNA, 18 nt, Homo sapiens
guugaggggcuccuggaa

SEQ ID NO: 1090932 - RNA, 16 nt, Homo sapiens
guugaguuugcuguau

SEQ ID NO: 1090933 - RNA, 20 nt, Homo sapiens
guugauaaauuccacuggac

SEQ ID NO: 1090934 - RNA, 15 nt, Homo sapiens
guugaucccaagaca

SEQ ID NO: 1090935 - RNA, 16 nt, Homo sapiens
guugggcugagacccu

SEQ ID NO: 1090936 - RNA, 20 nt, Homo sapiens
guuggggacccccucaggau

SEQ ID NO: 1090937 - RNA, 16 nt, Homo sapiens
guugguuuacuguguu

SEQ ID NO: 1090938 - RNA, 18 nt, Homo sapiens
guugugaaugucauucac

SEQ ID NO: 1090939 - RNA, 17 nt, Homo sapiens
guugugucuugcuauac

SEQ ID NO: 1090940 - RNA, 22 nt, Homo sapiens
guuguuaacacgugacacugug

SEQ ID NO: 1090941 - RNA, 10 nt, Homo sapiens
guuguucaua

SEQ ID NO: 1090942 - RNA, 16 nt, Homo sapiens
guuuaaaaaaaguaua

SEQ ID NO: 1090943 - RNA, 18 nt, Homo sapiens
guuuaaaaaaaguauaua

SEQ ID NO: 1090944 - RNA, 14 nt, Homo sapiens
guuuacagacugug

SEQ ID NO: 1090945 - RNA, 16 nt, Homo sapiens
guuucaugagcccaaa

SEQ ID NO: 1090946 - RNA, 22 nt, Homo sapiens
guuucucggcaccagugccuca

SEQ ID NO: 1090947 - RNA, 14 nt, Homo sapiens
guuugagcuuucau

SEQ ID NO: 1090948 - RNA, 15 nt, Homo sapiens
guuugauucagcaaa

SEQ ID NO: 1090949 - RNA, 17 nt, Homo sapiens
guuugggugucugcuaa

SEQ ID NO: 1090950 - RNA, 14 nt, Homo sapiens
guuugugaaacaaa

SEQ ID NO: 1090951 - RNA, 16 nt, Homo sapiens
guuuguucacacuccu

SEQ ID NO: 1090952 - RNA, 15 nt, Homo sapiens
guuuuagaaccagcc

SEQ ID NO: 1090953 - RNA, 15 nt, Homo sapiens
guuuucuaauaucuu

SEQ ID NO: 1090954 - RNA, 16 nt, Homo sapiens
uaaaaagaaauuguga

SEQ ID NO: 1090955 - RNA, 19 nt, Homo sapiens
uaaaacacaccuaagagaa

SEQ ID NO: 1090956 - RNA, 15 nt, Homo sapiens
uaaaaccccaucucu

SEQ ID NO: 1090957 - RNA, 17 nt, Homo sapiens
uaaaacuuuauggacac

SEQ ID NO: 1090958 - RNA, 16 nt, Homo sapiens
uaaaaucaaaugugca

SEQ ID NO: 1090959 - RNA, 17 nt, Homo sapiens
uaaaaucaaaugugcau

SEQ ID NO: 1090960 - RNA, 21 nt, Homo sapiens
uaaaaugggaauucugacuua

SEQ ID NO: 1090961 - RNA, 11 nt, Homo sapiens
uaaacauacau

SEQ ID NO: 1090962 - RNA, 21 nt, Homo sapiens
uaaacuuucucugcaaagacu

SEQ ID NO: 1090963 - RNA, 19 nt, Homo sapiens
uaaagaaaaguuuuguaaa

SEQ ID NO: 1090964 - RNA, 20 nt, Homo sapiens
uaaagaaauaauacccugcc

SEQ ID NO: 1090965 - RNA, 19 nt, Homo sapiens
uaaagcuuugucuuuuugu

SEQ ID NO: 1090966 - RNA, 17 nt, Homo sapiens
uaaaggacaaacaguga

SEQ ID NO: 1090967 - RNA, 15 nt, Homo sapiens
uaaagucucagguga

SEQ ID NO: 1090968 - RNA, 13 nt, Homo sapiens
uaaauaugugaaa

SEQ ID NO: 1090969 - RNA, 13 nt, Homo sapiens
uaaauguagaaag

SEQ ID NO: 1090970 - RNA, 12 nt, Homo sapiens
uaaauguuaaag

SEQ ID NO: 1090971 - RNA, 18 nt, Homo sapiens
uaaauucagaaagucaua

SEQ ID NO: 1090972 - RNA, 17 nt, Homo sapiens
uaaauuguuugaccaug

SEQ ID NO: 1090973 - RNA, 15 nt, Homo sapiens
uaacaaaaguauagu

SEQ ID NO: 1090974 - RNA, 19 nt, Homo sapiens
uaacaaacuacauguaauc

SEQ ID NO: 1090975 - RNA, 20 nt, Homo sapiens
uaacaaguagcacccuggau

SEQ ID NO: 1090976 - RNA, 17 nt, Homo sapiens
uaacagguuuucuucua

SEQ ID NO: 1090977 - RNA, 22 nt, Homo sapiens
uaacaugaaaaacacggcagcu

SEQ ID NO: 1090978 - RNA, 14 nt, Homo sapiens
uaacucagccagaa

SEQ ID NO: 1090979 - RNA, 20 nt, Homo sapiens
uaacucccuccucacacucc

SEQ ID NO: 1090980 - RNA, 21 nt, Homo sapiens
uaacucccuccucacacucca

SEQ ID NO: 1090981 - RNA, 15 nt, Homo sapiens
uaacuccguuuccaa

SEQ ID NO: 1090982 - RNA, 16 nt, Homo sapiens
uaagccauguguucca

SEQ ID NO: 1090983 - RNA, 13 nt, Homo sapiens
uaagccugaugau

SEQ ID NO: 1090984 - RNA, 18 nt, Homo sapiens
uaaggaagacacagccca

SEQ ID NO: 1090985 - RNA, 23 nt, Homo sapiens
uaaggaucuucccacuuugccac

SEQ ID NO: 1090986 - RNA, 17 nt, Homo sapiens
uaaguaccacucaggcc

SEQ ID NO: 1090987 - RNA, 23 nt, Homo sapiens
uaauaaagaaauaauacccugcc

SEQ ID NO: 1090988 - RNA, 12 nt, Homo sapiens
uaauaacuaaua

SEQ ID NO: 1090989 - RNA, 16 nt, Homo sapiens
uaauagugacauauau

SEQ ID NO: 1090990 - RNA, 14 nt, Homo sapiens
uaauauaagccaua

SEQ ID NO: 1090991 - RNA, 21 nt, Homo sapiens
uaauaucugagaaguguauau

SEQ ID NO: 1090992 - RNA, 17 nt, Homo sapiens
uaauccaucacuagcca

SEQ ID NO: 1090993 - RNA, 12 nt, Homo sapiens
uaauccaugugc

SEQ ID NO: 1090994 - RNA, 21 nt, Homo sapiens
uaauugauuauucugauucca

SEQ ID NO: 1090995 - RNA, 20 nt, Homo sapiens
uaauuuaaagaaacacuaaa

SEQ ID NO: 1090996 - RNA, 11 nt, Homo sapiens
uacaaccagcc

SEQ ID NO: 1090997 - RNA, 19 nt, Homo sapiens
uacaaguuaagguaucugg

SEQ ID NO: 1090998 - RNA, 23 nt, Homo sapiens
uacagcagaaaaucuuuuacuag

SEQ ID NO: 1090999 - RNA, 17 nt, Homo sapiens
uacaguaaauaaauugu

SEQ ID NO: 1091000 - RNA, 18 nt, Homo sapiens
uacaguucauaauucacc

SEQ ID NO: 1091001 - RNA, 15 nt, Homo sapiens
uacauguaauccauc

SEQ ID NO: 1091002 - RNA, 20 nt, Homo sapiens
uaccaaauccacaagccauu

SEQ ID NO: 1091003 - RNA, 16 nt, Homo sapiens
uaccagugggcaugua

SEQ ID NO: 1091004 - RNA, 16 nt, Homo sapiens
uaccauauugcucuua

SEQ ID NO: 1091005 - RNA, 16 nt, Homo sapiens
uaccaugaugcaugga

SEQ ID NO: 1091006 - RNA, 19 nt, Homo sapiens
uaccauuauuuuacagucu

SEQ ID NO: 1091007 - RNA, 18 nt, Homo sapiens
uaccccacauaugcaaug

SEQ ID NO: 1091008 - RNA, 23 nt, Homo sapiens
uaccugagauacugaagugcagc

SEQ ID NO: 1091009 - RNA, 22 nt, Homo sapiens
uaccuuaaaauguaaaacaaaa

SEQ ID NO: 1091010 - RNA, 17 nt, Homo sapiens
uacgaucccccaagugu

SEQ ID NO: 1091011 - RNA, 22 nt, Homo sapiens
uacuaaugugccccauguccaa

SEQ ID NO: 1091012 - RNA, 15 nt, Homo sapiens
uacuauuauuugcua

SEQ ID NO: 1091013 - RNA, 15 nt, Homo sapiens
uacuccuaccucagc

SEQ ID NO: 1091014 - RNA, 12 nt, Homo sapiens
uacuguuuccau

SEQ ID NO: 1091015 - RNA, 17 nt, Homo sapiens
uacuuccaugauacuuu

SEQ ID NO: 1091016 - RNA, 14 nt, Homo sapiens
uacuucuauaucau

SEQ ID NO: 1091017 - RNA, 19 nt, Homo sapiens
uagaaaucacaagaacaaa

SEQ ID NO: 1091018 - RNA, 17 nt, Homo sapiens
uagaacaaugcuauaau

SEQ ID NO: 1091019 - RNA, 13 nt, Homo sapiens
uagaacacccacu

SEQ ID NO: 1091020 - RNA, 19 nt, Homo sapiens
uagaauaaaauuguaaaau

SEQ ID NO: 1091021 - RNA, 13 nt, Homo sapiens
uagaauugccuua

SEQ ID NO: 1091022 - RNA, 14 nt, Homo sapiens
uagagugacaggca

SEQ ID NO: 1091023 - RNA, 17 nt, Homo sapiens
uagagugcaguggcaug

SEQ ID NO: 1091024 - RNA, 15 nt, Homo sapiens
uagaguggcgauuga

SEQ ID NO: 1091025 - RNA, 22 nt, Homo sapiens
uagaucuaguucucaaucacug

SEQ ID NO: 1091026 - RNA, 20 nt, Homo sapiens
uagcaaccuucugcauucau

SEQ ID NO: 1091027 - RNA, 18 nt, Homo sapiens
uagcacuuuauaagccaa

SEQ ID NO: 1091028 - RNA, 21 nt, Homo sapiens
uagcauccaaggggccuggaa

SEQ ID NO: 1091029 - RNA, 21 nt, Homo sapiens
uagcauuuucuugaaccaaua

SEQ ID NO: 1091030 - RNA, 19 nt, Homo sapiens
uagccaugauaacugcaau

SEQ ID NO: 1091031 - RNA, 11 nt, Homo sapiens
uagcuaccugc

SEQ ID NO: 1091032 - RNA, 15 nt, Homo sapiens
uagcuagcuauuucu

SEQ ID NO: 1091033 - RNA, 12 nt, Homo sapiens
uagcucuauggg

SEQ ID NO: 1091034 - RNA, 19 nt, Homo sapiens
uagguuuccacugccaaaa

SEQ ID NO: 1091035 - RNA, 17 nt, Homo sapiens
uagugacuuccugguga

SEQ ID NO: 1091036 - RNA, 19 nt, Homo sapiens
uaguucuuaugagcuagca

SEQ ID NO: 1091037 - RNA, 22 nt, Homo sapiens
uaguuuaauccuuuguauuaca

SEQ ID NO: 1091038 - RNA, 21 nt, Homo sapiens
uauaaaagaauaaaauugcac

SEQ ID NO: 1091039 - RNA, 19 nt, Homo sapiens
uauaaugaacacgugggua

SEQ ID NO: 1091040 - RNA, 14 nt, Homo sapiens
uauagagauaugca

SEQ ID NO: 1091041 - RNA, 14 nt, Homo sapiens
uauagucucaaauc

SEQ ID NO: 1091042 - RNA, 22 nt, Homo sapiens
uauauagcucuacacaacaugu

SEQ ID NO: 1091043 - RNA, 17 nt, Homo sapiens
uauauaguagcauuuca

SEQ ID NO: 1091044 - RNA, 19 nt, Homo sapiens
uauauuuauuuauguagga

SEQ ID NO: 1091045 - RNA, 23 nt, Homo sapiens
uaucaaaaagguuucugcacauu

SEQ ID NO: 1091046 - RNA, 17 nt, Homo sapiens
uaucacucacugccaaa

SEQ ID NO: 1091047 - RNA, 21 nt, Homo sapiens
uaucauuaggaaaacaucuua

SEQ ID NO: 1091048 - RNA, 19 nt, Homo sapiens
uauccugugcuaugcugga

SEQ ID NO: 1091049 - RNA, 16 nt, Homo sapiens
uaucucggaccuuuca

SEQ ID NO: 1091050 - RNA, 14 nt, Homo sapiens
uaucugaggucaca

SEQ ID NO: 1091051 - RNA, 19 nt, Homo sapiens
uaucuuguggcauauccau

SEQ ID NO: 1091052 - RNA, 17 nt, Homo sapiens
uaucuuuuugcuuacag

SEQ ID NO: 1091053 - RNA, 19 nt, Homo sapiens
uauggcccagccacugcag

SEQ ID NO: 1091054 - RNA, 13 nt, Homo sapiens
uaugggaagccau

SEQ ID NO: 1091055 - RNA, 13 nt, Homo sapiens
uauuaaauuugaa

SEQ ID NO: 1091056 - RNA, 19 nt, Homo sapiens
uauuagaagcuaucaauca

SEQ ID NO: 1091057 - RNA, 15 nt, Homo sapiens
uauucauucauucau

SEQ ID NO: 1091058 - RNA, 12 nt, Homo sapiens
uauuguaucugu

SEQ ID NO: 1091059 - RNA, 13 nt, Homo sapiens
uauugugccucag

SEQ ID NO: 1091060 - RNA, 18 nt, Homo sapiens
uauuuaaaagacaaacac

SEQ ID NO: 1091061 - RNA, 21 nt, Homo sapiens
uauuugaacuuauuuacacau

SEQ ID NO: 1091062 - RNA, 17 nt, Homo sapiens
uauuuguauaauggugu

SEQ ID NO: 1091063 - RNA, 20 nt, Homo sapiens
uauuugugugugugauauau

SEQ ID NO: 1091064 - RNA, 13 nt, Homo sapiens
uauuuucauuucu

SEQ ID NO: 1091065 - RNA, 19 nt, Homo sapiens
uauuuucuuggaauuuugu

SEQ ID NO: 1091066 - RNA, 16 nt, Homo sapiens
uauuuuggacguguga

SEQ ID NO: 1091067 - RNA, 21 nt, Homo sapiens
uauuuuuuuaagcuguaaaaa

SEQ ID NO: 1091068 - RNA, 15 nt, Homo sapiens
ucaaaaagacugugg

SEQ ID NO: 1091069 - RNA, 12 nt, Homo sapiens
ucaaaagcaaac

SEQ ID NO: 1091070 - RNA, 16 nt, Homo sapiens
ucaaaauguccagcuu

SEQ ID NO: 1091071 - RNA, 20 nt, Homo sapiens
ucaaacagggacacuacaaa

SEQ ID NO: 1091072 - RNA, 20 nt, Homo sapiens
ucaaacaugaaaacauugau

SEQ ID NO: 1091073 - RNA, 19 nt, Homo sapiens
ucaaagaaaacuuccaaaa

SEQ ID NO: 1091074 - RNA, 22 nt, Homo sapiens
ucaaagcggaugcuggccacag

SEQ ID NO: 1091075 - RNA, 11 nt, Homo sapiens
ucaaaugugca

SEQ ID NO: 1091076 - RNA, 13 nt, Homo sapiens
ucaaaugugcauc

SEQ ID NO: 1091077 - RNA, 16 nt, Homo sapiens
ucaacacucuucuuga

SEQ ID NO: 1091078 - RNA, 13 nt, Homo sapiens
ucaagaaaagcau

SEQ ID NO: 1091079 - RNA, 22 nt, Homo sapiens
ucaagagaucuuucuuuccaaa

SEQ ID NO: 1091080 - RNA, 13 nt, Homo sapiens
ucaagcagguuuc

SEQ ID NO: 1091081 - RNA, 22 nt, Homo sapiens
ucaagcgauucuucugccucag

SEQ ID NO: 1091082 - RNA, 15 nt, Homo sapiens
ucaaggccucccaca

SEQ ID NO: 1091083 - RNA, 19 nt, Homo sapiens
ucaaggccucccacaguga

SEQ ID NO: 1091084 - RNA, 17 nt, Homo sapiens
ucaaggggacuggugau

SEQ ID NO: 1091085 - RNA, 23 nt, Homo sapiens
ucaagucagcaacagagcaaaau

SEQ ID NO: 1091086 - RNA, 20 nt, Homo sapiens
ucaagugauacaacugaguc

SEQ ID NO: 1091087 - RNA, 19 nt, Homo sapiens
ucaaguugagaacaaaaau

SEQ ID NO: 1091088 - RNA, 19 nt, Homo sapiens
ucaauacaaccagcccaac

SEQ ID NO: 1091089 - RNA, 17 nt, Homo sapiens
ucacaaacaaauggcug

SEQ ID NO: 1091090 - RNA, 20 nt, Homo sapiens
ucacaacagaaaacccaaaa

SEQ ID NO: 1091091 - RNA, 18 nt, Homo sapiens
ucacaaggcaacugugag

SEQ ID NO: 1091092 - RNA, 13 nt, Homo sapiens
ucacaaguucaau

SEQ ID NO: 1091093 - RNA, 10 nt, Homo sapiens
ucacacuccu

SEQ ID NO: 1091094 - RNA, 11 nt, Homo sapiens
ucacacuccua

SEQ ID NO: 1091095 - RNA, 22 nt, Homo sapiens
ucacauauuauuggucaagaaa

SEQ ID NO: 1091096 - RNA, 23 nt, Homo sapiens
ucacaucuuaugcuaacuguaga

SEQ ID NO: 1091097 - RNA, 15 nt, Homo sapiens
ucacaugucccuguc

SEQ ID NO: 1091098 - RNA, 17 nt, Homo sapiens
ucaccacauucugucuc

SEQ ID NO: 1091099 - RNA, 21 nt, Homo sapiens
ucaccaggggcaggcacagca

SEQ ID NO: 1091100 - RNA, 11 nt, Homo sapiens
ucaccaugcaa

SEQ ID NO: 1091101 - RNA, 18 nt, Homo sapiens
ucaccuccucugugauuu

SEQ ID NO: 1091102 - RNA, 16 nt, Homo sapiens
ucaccuguuacugaaa

SEQ ID NO: 1091103 - RNA, 17 nt, Homo sapiens
ucaccuuccuaguucuu

SEQ ID NO: 1091104 - RNA, 13 nt, Homo sapiens
ucacgacucuucc

SEQ ID NO: 1091105 - RNA, 21 nt, Homo sapiens
ucacugcagccuuucacagga

SEQ ID NO: 1091106 - RNA, 22 nt, Homo sapiens
ucagaaguaacucccacuccua

SEQ ID NO: 1091107 - RNA, 18 nt, Homo sapiens
ucagagcagcacuggggu

SEQ ID NO: 1091108 - RNA, 17 nt, Homo sapiens
ucagauccugggcauga

SEQ ID NO: 1091109 - RNA, 17 nt, Homo sapiens
ucagcaacagagcaaaa

SEQ ID NO: 1091110 - RNA, 12 nt, Homo sapiens
ucagcagucagu

SEQ ID NO: 1091111 - RNA, 15 nt, Homo sapiens
ucagccagcccugga

SEQ ID NO: 1091112 - RNA, 15 nt, Homo sapiens
ucagccuccugagua

SEQ ID NO: 1091113 - RNA, 17 nt, Homo sapiens
ucagcucuccugcugca

SEQ ID NO: 1091114 - RNA, 18 nt, Homo sapiens
ucaggccaggugcagugg

SEQ ID NO: 1091115 - RNA, 14 nt, Homo sapiens
ucagguaguacugg

SEQ ID NO: 1091116 - RNA, 16 nt, Homo sapiens
ucagguaguacuggga

SEQ ID NO: 1091117 - RNA, 20 nt, Homo sapiens
ucagugaugaaaauuugccu

SEQ ID NO: 1091118 - RNA, 15 nt, Homo sapiens
ucagugcugcaauug

SEQ ID NO: 1091119 - RNA, 14 nt, Homo sapiens
ucaguuguuuuccc

SEQ ID NO: 1091120 - RNA, 12 nt, Homo sapiens
ucauacauuaua

SEQ ID NO: 1091121 - RNA, 20 nt, Homo sapiens
ucauaugaaaaaaaugcauu

SEQ ID NO: 1091122 - RNA, 14 nt, Homo sapiens
ucaucaagcuccac

SEQ ID NO: 1091123 - RNA, 14 nt, Homo sapiens
ucaucaggucauua

SEQ ID NO: 1091124 - RNA, 15 nt, Homo sapiens
ucaucaucagucuua

SEQ ID NO: 1091125 - RNA, 21 nt, Homo sapiens
ucaucugcuccuagcccagca

SEQ ID NO: 1091126 - RNA, 22 nt, Homo sapiens
ucaucuggaggcugcguccuga

SEQ ID NO: 1091127 - RNA, 14 nt, Homo sapiens
ucaugacuuuucca

SEQ ID NO: 1091128 - RNA, 22 nt, Homo sapiens
ucaugacuuuuccauguaucua

SEQ ID NO: 1091129 - RNA, 24 nt, Homo sapiens
ucauguggcauucucucugcucag

SEQ ID NO: 1091130 - RNA, 22 nt, Homo sapiens
ucauguggggugggaaccuggg

SEQ ID NO: 1091131 - RNA, 14 nt, Homo sapiens
aacauugcacuuua

SEQ ID NO: 1091132 - RNA, 15 nt, Homo sapiens
aaccucacucuugcc

SEQ ID NO: 1091133 - RNA, 16 nt, Homo sapiens
aagcuguauauauuau

SEQ ID NO: 1091134 - RNA, 19 nt, Homo sapiens
aaggaaauaacauugcacu

SEQ ID NO: 1091135 - RNA, 14 nt, Homo sapiens
aauaaacacugugu

SEQ ID NO: 1091136 - RNA, 24 nt, Homo sapiens
aauacuugaauauggaacauaugc

SEQ ID NO: 1091137 - RNA, 14 nt, Homo sapiens
aauauggaacauau

SEQ ID NO: 1091138 - RNA, 20 nt, Homo sapiens
aauauggaacauaugcacag

SEQ ID NO: 1091139 - RNA, 19 nt, Homo sapiens
aauauuacuaauugcccaa

SEQ ID NO: 1091140 - RNA, 20 nt, Homo sapiens
aaucaaucuuugugccucaa

SEQ ID NO: 1091141 - RNA, 22 nt, Homo sapiens
aaucucuauguagaaaucucau

SEQ ID NO: 1091142 - RNA, 16 nt, Homo sapiens
aauucuguggcaguuu

SEQ ID NO: 1091143 - RNA, 17 nt, Homo sapiens
aauugagcagcaugauu

SEQ ID NO: 1091144 - RNA, 19 nt, Homo sapiens
aauugagcagcaugauuau

SEQ ID NO: 1091145 - RNA, 13 nt, Homo sapiens
acaauccaucaaa

SEQ ID NO: 1091146 - RNA, 21 nt, Homo sapiens
acaauccaucaaagugaugau

SEQ ID NO: 1091147 - RNA, 11 nt, Homo sapiens
acacacugugc

SEQ ID NO: 1091148 - RNA, 16 nt, Homo sapiens
acaguguaucaacaaa

SEQ ID NO: 1091149 - RNA, 12 nt, Homo sapiens
acauugcacuuu

SEQ ID NO: 1091150 - RNA, 23 nt, Homo sapiens
acauuuucucugaugaugucaca

SEQ ID NO: 1091151 - RNA, 16 nt, Homo sapiens
acccugcccucaugcu

SEQ ID NO: 1091152 - RNA, 16 nt, Homo sapiens
acccuuggaccucucc

SEQ ID NO: 1091153 - RNA, 12 nt, Homo sapiens
accuaagcaaug

SEQ ID NO: 1091154 - RNA, 17 nt, Homo sapiens
accuaagcaaugagcca

SEQ ID NO: 1091155 - RNA, 17 nt, Homo sapiens
accucacucuugccaac

SEQ ID NO: 1091156 - RNA, 22 nt, Homo sapiens
accucacucuugccaaccugua

SEQ ID NO: 1091157 - RNA, 19 nt, Homo sapiens
accuccaucuucuuugcag

SEQ ID NO: 1091158 - RNA, 13 nt, Homo sapiens
accucuccacgug

SEQ ID NO: 1091159 - RNA, 17 nt, Homo sapiens
acgugguugccgucucu

SEQ ID NO: 1091160 - RNA, 12 nt, Homo sapiens
acuaaucuuucu

SEQ ID NO: 1091161 - RNA, 14 nt, Homo sapiens
acuaauugcccaaa

SEQ ID NO: 1091162 - RNA, 20 nt, Homo sapiens
acucuugccaaccuguaaua

SEQ ID NO: 1091163 - RNA, 14 nt, Homo sapiens
agaauaaagcaauu

SEQ ID NO: 1091164 - RNA, 23 nt, Homo sapiens
agagaaugaugcugugcauauca

SEQ ID NO: 1091165 - RNA, 23 nt, Homo sapiens
agagccaggcacacacugugcuu

SEQ ID NO: 1091166 - RNA, 16 nt, Homo sapiens
agauuuuguuagccaa

SEQ ID NO: 1091167 - RNA, 16 nt, Homo sapiens
agccacagcaaaaagu

SEQ ID NO: 1091168 - RNA, 15 nt, Homo sapiens
aggcacacacugugc

SEQ ID NO: 1091169 - RNA, 15 nt, Homo sapiens
agggaaggcugugca

SEQ ID NO: 1091170 - RNA, 20 nt, Homo sapiens
agucugggccccaucauuaa

SEQ ID NO: 1091171 - RNA, 21 nt, Homo sapiens
agucugggccccaucauuaaa

SEQ ID NO: 1091172 - RNA, 20 nt, Homo sapiens
aguguaacggccaacacuuu

SEQ ID NO: 1091173 - RNA, 20 nt, Homo sapiens
agugucaaauaaacacugug

SEQ ID NO: 1091174 - RNA, 22 nt, Homo sapiens
agugucaaauaaacacugugua

SEQ ID NO: 1091175 - RNA, 22 nt, Homo sapiens
aguucuuuucaugcaaguauaa

SEQ ID NO: 1091176 - RNA, 19 nt, Homo sapiens
aguuuuguaucaaccuaaa

SEQ ID NO: 1091177 - RNA, 15 nt, Homo sapiens
auaaggagugccuga

SEQ ID NO: 1091178 - RNA, 12 nt, Homo sapiens
auaccuacugaa

SEQ ID NO: 1091179 - RNA, 14 nt, Homo sapiens
auaguaacaacaaa

SEQ ID NO: 1091180 - RNA, 22 nt, Homo sapiens
auaguggacauuguuggcagca

SEQ ID NO: 1091181 - RNA, 22 nt, Homo sapiens
auccuacaguuggaaauccauc

SEQ ID NO: 1091182 - RNA, 15 nt, Homo sapiens
aucugaacuguggaa

SEQ ID NO: 1091183 - RNA, 17 nt, Homo sapiens
aucugaacuguggaauc

SEQ ID NO: 1091184 - RNA, 17 nt, Homo sapiens
augucccaccucucuga

SEQ ID NO: 1091185 - RNA, 13 nt, Homo sapiens
auuaaacgggcug

SEQ ID NO: 1091186 - RNA, 15 nt, Homo sapiens
auuaaacgggcugcg

SEQ ID NO: 1091187 - RNA, 15 nt, Homo sapiens
auuaauugagcagca

SEQ ID NO: 1091188 - RNA, 12 nt, Homo sapiens
auuccuaugcca

SEQ ID NO: 1091189 - RNA, 18 nt, Homo sapiens
auugagcagcaugauuau

SEQ ID NO: 1091190 - RNA, 20 nt, Homo sapiens
caaaaugucaauuugaugua

SEQ ID NO: 1091191 - RNA, 18 nt, Homo sapiens
caaacacaauuaaaucuc

SEQ ID NO: 1091192 - RNA, 21 nt, Homo sapiens
caaaguguaacggccaacacu

SEQ ID NO: 1091193 - RNA, 16 nt, Homo sapiens
caaauaaacacugugu

SEQ ID NO: 1091194 - RNA, 17 nt, Homo sapiens
caaauauuaccagagca

SEQ ID NO: 1091195 - RNA, 11 nt, Homo sapiens
caaauucugug

SEQ ID NO: 1091196 - RNA, 18 nt, Homo sapiens
caacaacaaaauaaagcu

SEQ ID NO: 1091197 - RNA, 23 nt, Homo sapiens
caaccuguaauaaauaugagugc

SEQ ID NO: 1091198 - RNA, 20 nt, Homo sapiens
caaucaugcuguguaauauc

SEQ ID NO: 1091199 - RNA, 20 nt, Homo sapiens
caauuaauugagcagcauga

SEQ ID NO: 1091200 - RNA, 22 nt, Homo sapiens
caauuugauguaguucuuuuca

SEQ ID NO: 1091201 - RNA, 17 nt, Homo sapiens
cacucuugccaaccugu

SEQ ID NO: 1091202 - RNA, 19 nt, Homo sapiens
cacucuugccaaccuguaa

SEQ ID NO: 1091203 - RNA, 17 nt, Homo sapiens
cacuugugucaaucaug

SEQ ID NO: 1091204 - RNA, 15 nt, Homo sapiens
cagaguggucccugc

SEQ ID NO: 1091205 - RNA, 15 nt, Homo sapiens
cagccaaugccuuug

SEQ ID NO: 1091206 - RNA, 18 nt, Homo sapiens
cagucugggccccaucau

SEQ ID NO: 1091207 - RNA, 17 nt, Homo sapiens
cauacuguugaugucua

SEQ ID NO: 1091208 - RNA, 14 nt, Homo sapiens
caucucccaugugu

SEQ ID NO: 1091209 - RNA, 17 nt, Homo sapiens
caugcuguguaauauca

SEQ ID NO: 1091210 - RNA, 23 nt, Homo sapiens
cauguaaauauuuuguuaucuga

SEQ ID NO: 1091211 - RNA, 22 nt, Homo sapiens
cauugcacuuuauaaacacugu

SEQ ID NO: 1091212 - RNA, 13 nt, Homo sapiens
cauuucaaucuuu

SEQ ID NO: 1091213 - RNA, 10 nt, Homo sapiens
ccaacacuuu

SEQ ID NO: 1091214 - RNA, 21 nt, Homo sapiens
ccaacauaauuaagcuguaua

SEQ ID NO: 1091215 - RNA, 14 nt, Homo sapiens
ccaaccuguaauaa

SEQ ID NO: 1091216 - RNA, 20 nt, Homo sapiens
ccaaccuguaauaaauauga

SEQ ID NO: 1091217 - RNA, 15 nt, Homo sapiens
ccaaguacagaauua

SEQ ID NO: 1091218 - RNA, 23 nt, Homo sapiens
ccacacauuuaaaacauuugaag

SEQ ID NO: 1091219 - RNA, 16 nt, Homo sapiens
ccagagcaaaguguaa

SEQ ID NO: 1091220 - RNA, 23 nt, Homo sapiens
ccauaguggacauuguuggcagc

SEQ ID NO: 1091221 - RNA, 14 nt, Homo sapiens
ccucacucuugcca

SEQ ID NO: 1091222 - RNA, 15 nt, Homo sapiens
ccucacucuugccaa

SEQ ID NO: 1091223 - RNA, 22 nt, Homo sapiens
ccucacucuugccaaccuguaa

SEQ ID NO: 1091224 - RNA, 21 nt, Homo sapiens
ccucucugagcucugcauuug

SEQ ID NO: 1091225 - RNA, 16 nt, Homo sapiens
ccugcucaacauuuaa

SEQ ID NO: 1091226 - RNA, 19 nt, Homo sapiens
ccuguaagcaacacuuuaa

SEQ ID NO: 1091227 - RNA, 16 nt, Homo sapiens
ccuguaauaaauauga

SEQ ID NO: 1091228 - RNA, 14 nt, Homo sapiens
ccugugacagcagc

SEQ ID NO: 1091229 - RNA, 22 nt, Homo sapiens
cgcccugggcucgucuuugcag

SEQ ID NO: 1091230 - RNA, 20 nt, Homo sapiens
aauguaauguuuuagugccu

SEQ ID NO: 1091231 - RNA, 15 nt, Homo sapiens
aauucucucuuguca

SEQ ID NO: 1091232 - RNA, 22 nt, Homo sapiens
acaaaauuaucaugacaaauau

SEQ ID NO: 1091233 - RNA, 21 nt, Homo sapiens
acacuguauuguaaguggaaa

SEQ ID NO: 1091234 - RNA, 17 nt, Homo sapiens
acauaauuaagcuguau

SEQ ID NO: 1091235 - RNA, 18 nt, Homo sapiens
acauacuguugaugucua

SEQ ID NO: 1091236 - RNA, 13 nt, Homo sapiens
accuaagcaauga

SEQ ID NO: 1091237 - RNA, 17 nt, Homo sapiens
accuguaauaaauauga

SEQ ID NO: 1091238 - RNA, 23 nt, Homo sapiens
accuguaauaaauaugagugcca

SEQ ID NO: 1091239 - RNA, 14 nt, Homo sapiens
acggccaacacuuu

SEQ ID NO: 1091240 - RNA, 11 nt, Homo sapiens
acucuugccaa

SEQ ID NO: 1091241 - RNA, 12 nt, Homo sapiens
acucuugccaac

SEQ ID NO: 1091242 - RNA, 20 nt, Homo sapiens
acuugauaugugcaccaaua

SEQ ID NO: 1091243 - RNA, 13 nt, Homo sapiens
agaaaaaaaagua

SEQ ID NO: 1091244 - RNA, 23 nt, Homo sapiens
agaaugaugcugugcauaucacu

SEQ ID NO: 1091245 - RNA, 21 nt, Homo sapiens
agagcaaaguguaacggccaa

SEQ ID NO: 1091246 - RNA, 15 nt, Homo sapiens
agauguagcauuguu

SEQ ID NO: 1091247 - RNA, 23 nt, Homo sapiens
agcauugaucugagugcuuucau

SEQ ID NO: 1091248 - RNA, 20 nt, Homo sapiens
agccacagcaaaaaguaaag

SEQ ID NO: 1091249 - RNA, 17 nt, Homo sapiens
agccaggcacacacugu

SEQ ID NO: 1091250 - RNA, 18 nt, Homo sapiens
agccaggcacacacugug

SEQ ID NO: 1091251 - RNA, 19 nt, Homo sapiens
agccagggaaggcugugca

SEQ ID NO: 1091252 - RNA, 16 nt, Homo sapiens
agcuauucaaguauuc

SEQ ID NO: 1091253 - RNA, 23 nt, Homo sapiens
aggaugacgguauuaugcuucuu

SEQ ID NO: 1091254 - RNA, 21 nt, Homo sapiens
aguaguuuuguaucaaccuaa

SEQ ID NO: 1091255 - RNA, 20 nt, Homo sapiens
agucuuccaaaccaccuucc

SEQ ID NO: 1091256 - RNA, 13 nt, Homo sapiens
auaaacacugugu

SEQ ID NO: 1091257 - RNA, 15 nt, Homo sapiens
auaauggcauguauu

SEQ ID NO: 1091258 - RNA, 22 nt, Homo sapiens
auaucacuugauaugugcacca

SEQ ID NO: 1091259 - RNA, 21 nt, Homo sapiens
auauuauacacaucuggcuca

SEQ ID NO: 1091260 - RNA, 19 nt, Homo sapiens
aucaugcuguguaauauca

SEQ ID NO: 1091261 - RNA, 13 nt, Homo sapiens
aucuaccuuccag

SEQ ID NO: 1091262 - RNA, 14 nt, Homo sapiens
aucuaccuuccagu

SEQ ID NO: 1091263 - RNA, 14 nt, Homo sapiens
aucugaacugugga

SEQ ID NO: 1091264 - RNA, 17 nt, Homo sapiens
aucuuucugaacuguaa

SEQ ID NO: 1091265 - RNA, 23 nt, Homo sapiens
aucuuuguaauacauguaaauau

SEQ ID NO: 1091266 - RNA, 15 nt, Homo sapiens
aucuuugugccucaa

SEQ ID NO: 1091267 - RNA, 15 nt, Homo sapiens
augaaaaugaaugcu

SEQ ID NO: 1091268 - RNA, 16 nt, Homo sapiens
auguagaaaucucauc

SEQ ID NO: 1091269 - RNA, 19 nt, Homo sapiens
augucuaaguaugccucag

SEQ ID NO: 1091270 - RNA, 20 nt, Homo sapiens
augucuuaaauaaaacuauu

SEQ ID NO: 1091271 - RNA, 14 nt, Homo sapiens
caaaccaccuuccc

SEQ ID NO: 1091272 - RNA, 11 nt, Homo sapiens
caacauacugu

SEQ ID NO: 1091273 - RNA, 20 nt, Homo sapiens
caaccuguaauaaauaugag

SEQ ID NO: 1091274 - RNA, 12 nt, Homo sapiens
caauccaucaaa

SEQ ID NO: 1091275 - RNA, 19 nt, Homo sapiens
cacaaaauuaucaugacaa

SEQ ID NO: 1091276 - RNA, 17 nt, Homo sapiens
cacaauuaaaucucucc

SEQ ID NO: 1091277 - RNA, 13 nt, Homo sapiens
cacacugugcuuu

SEQ ID NO: 1091278 - RNA, 14 nt, Homo sapiens
cacaucuggcucaa

SEQ ID NO: 1091279 - RNA, 22 nt, Homo sapiens
caccucucugagcucugcauuu

SEQ ID NO: 1091280 - RNA, 13 nt, Homo sapiens
cacucuugccaac

SEQ ID NO: 1091281 - RNA, 21 nt, Homo sapiens
aaaaccugggcaccuaagcaa

SEQ ID NO: 1091282 - RNA, 12 nt, Homo sapiens
aaacacugugua

SEQ ID NO: 1091283 - RNA, 14 nt, Homo sapiens
aaaccaccuucccu

SEQ ID NO: 1091284 - RNA, 20 nt, Homo sapiens
aaacuauuuaaaauuggcac

SEQ ID NO: 1091285 - RNA, 13 nt, Homo sapiens
aaagaaauaaucu

SEQ ID NO: 1091286 - RNA, 14 nt, Homo sapiens
aaauaaacacugug

SEQ ID NO: 1091287 - RNA, 14 nt, Homo sapiens
aaauaugagugcca

SEQ ID NO: 1091288 - RNA, 12 nt, Homo sapiens
aaauuaugugga

SEQ ID NO: 1091289 - RNA, 15 nt, Homo sapiens
aacaacaaaauaaag

SEQ ID NO: 1091290 - RNA, 16 nt, Homo sapiens
aacacaauuaaaucuc

SEQ ID NO: 1091291 - RNA, 11 nt, Homo sapiens
aacagcuccuu

SEQ ID NO: 1091292 - RNA, 14 nt, Homo sapiens
aacauacuguugau

SEQ ID NO: 1091293 - RNA, 22 nt, Homo sapiens
aaccucacucuugccaaccugu

SEQ ID NO: 1091294 - RNA, 12 nt, Homo sapiens
aacuguggaauc

SEQ ID NO: 1091295 - RNA, 21 nt, Homo sapiens
aaggaccuaaauucguagcaa

SEQ ID NO: 1091296 - RNA, 13 nt, Homo sapiens
aauaaauaugagu

SEQ ID NO: 1091297 - RNA, 17 nt, Homo sapiens
aauaaauaugagugcca

SEQ ID NO: 1091298 - RNA, 13 nt, Homo sapiens
aauaacauugcac

SEQ ID NO: 1091299 - RNA, 22 nt, Homo sapiens
aauaagauuuuguuagccaaca

SEQ ID NO: 1091300 - RNA, 19 nt, Homo sapiens
aauaaucucuauguagaaa

SEQ ID NO: 1091301 - RNA, 18 nt, Homo sapiens
aauauggaacauaugcac

SEQ ID NO: 1091302 - RNA, 19 nt, Homo sapiens
aaucaaucuuugugccuca

SEQ ID NO: 1091303 - RNA, 13 nt, Homo sapiens
aauggcauguauu

SEQ ID NO: 1091304 - RNA, 17 nt, Homo sapiens
aauggcauguauuccaa

SEQ ID NO: 1091305 - RNA, 13 nt, Homo sapiens
aauuauguggauc

SEQ ID NO: 1091306 - RNA, 19 nt, Homo sapiens
aauugcccaaaaugucaau

SEQ ID NO: 1091307 - RNA, 16 nt, Homo sapiens
acaaaaggagccaagc

SEQ ID NO: 1091308 - RNA, 14 nt, Homo sapiens
acaauuaaaucucu

SEQ ID NO: 1091309 - RNA, 16 nt, Homo sapiens
acaauuaaaucucucc

SEQ ID NO: 1091310 - RNA, 18 nt, Homo sapiens
acauaaggagugccugaa

SEQ ID NO: 1091311 - RNA, 13 nt, Homo sapiens
acauugcacuuua

SEQ ID NO: 1091312 - RNA, 17 nt, Homo sapiens
acauuugcuagugacau

SEQ ID NO: 1091313 - RNA, 21 nt, Homo sapiens
acauuugcuagugacauguac

SEQ ID NO: 1091314 - RNA, 14 nt, Homo sapiens
accuaaaugaguca

SEQ ID NO: 1091315 - RNA, 14 nt, Homo sapiens
accucacucuugcc

SEQ ID NO: 1091316 - RNA, 16 nt, Homo sapiens
accuguaauaaauaug

SEQ ID NO: 1091317 - RNA, 14 nt, Homo sapiens
acgggcugcguuua

SEQ ID NO: 1091318 - RNA, 21 nt, Homo sapiens
acgucuuacauuuucucugau

SEQ ID NO: 1091319 - RNA, 17 nt, Homo sapiens
acguucauccacucugc

SEQ ID NO: 1091320 - RNA, 16 nt, Homo sapiens
acucuugccaaccugu

SEQ ID NO: 1091321 - RNA, 17 nt, Homo sapiens
acugaaucagaaaugua

SEQ ID NO: 1091322 - RNA, 19 nt, Homo sapiens
acugccucgggaaccucac

SEQ ID NO: 1091323 - RNA, 12 nt, Homo sapiens
agaggccauguu

SEQ ID NO: 1091324 - RNA, 18 nt, Homo sapiens
agauuuuguuagccaaca

SEQ ID NO: 1091325 - RNA, 22 nt, Homo sapiens
agcagcaugauuauaagccaaa

SEQ ID NO: 1091326 - RNA, 16 nt, Homo sapiens
agccaggcacacacug

SEQ ID NO: 1091327 - RNA, 15 nt, Homo sapiens
gaucugcucagcccu

SEQ ID NO: 1091328 - RNA, 20 nt, Homo sapiens
gauguaguucuuuucaugca

SEQ ID NO: 1091329 - RNA, 21 nt, Homo sapiens
gcagcaugauuauaagccaaa

SEQ ID NO: 1091330 - RNA, 22 nt, Homo sapiens
gcagcaugauuauaagccaaac

SEQ ID NO: 1091331 - RNA, 19 nt, Homo sapiens
gcagugccaacucuuggag

SEQ ID NO: 1091332 - RNA, 14 nt, Homo sapiens
gcauaucacuugau

SEQ ID NO: 1091333 - RNA, 18 nt, Homo sapiens
gcauugaucugagugcuu

SEQ ID NO: 1091334 - RNA, 13 nt, Homo sapiens
gccaacacuuugu

SEQ ID NO: 1091335 - RNA, 21 nt, Homo sapiens
gccaaccuguaauaaauauga

SEQ ID NO: 1091336 - RNA, 16 nt, Homo sapiens
gccaggcacacacugu

SEQ ID NO: 1091337 - RNA, 23 nt, Homo sapiens
gccccaugcuggagccuguguaa

SEQ ID NO: 1091338 - RNA, 19 nt, Homo sapiens
ggaaccucacucuugccaa

SEQ ID NO: 1091339 - RNA, 20 nt, Homo sapiens
ggaaccucacucuugccaac

SEQ ID NO: 1091340 - RNA, 21 nt, Homo sapiens
ggagccuguguaacagcuccu

SEQ ID NO: 1091341 - RNA, 22 nt, Homo sapiens
ggaugucccaccucucugagcu

SEQ ID NO: 1091342 - RNA, 21 nt, Homo sapiens
ggccccucucaggcugugcuu

SEQ ID NO: 1091343 - RNA, 13 nt, Homo sapiens
guaauaaauauga

SEQ ID NO: 1091344 - RNA, 16 nt, Homo sapiens
gucaaauaaacacugu

SEQ ID NO: 1091345 - RNA, 16 nt, Homo sapiens
gucuaaguaugccuca

SEQ ID NO: 1091346 - RNA, 17 nt, Homo sapiens
gucuaaguaugccucag

SEQ ID NO: 1091347 - RNA, 10 nt, Homo sapiens
gucuuugcag

SEQ ID NO: 1091348 - RNA, 21 nt, Homo sapiens
gugcuuaccugugacagcagc

SEQ ID NO: 1091349 - RNA, 20 nt, Homo sapiens
gugcuuucauauuuuccaaa

SEQ ID NO: 1091350 - RNA, 13 nt, Homo sapiens
uaaaacauuugaa

SEQ ID NO: 1091351 - RNA, 23 nt, Homo sapiens
uaaacaauauuacuaauugccca

SEQ ID NO: 1091352 - RNA, 19 nt, Homo sapiens
uaaagcaagcuaucugcac

SEQ ID NO: 1091353 - RNA, 16 nt, Homo sapiens
uaaauuuuaaacaaua

SEQ ID NO: 1091354 - RNA, 13 nt, Homo sapiens
uaagcaacacuuu

SEQ ID NO: 1091355 - RNA, 19 nt, Homo sapiens
uaaguggaaaaugcaaugu

SEQ ID NO: 1091356 - RNA, 16 nt, Homo sapiens
uaauuguugaccuaag

SEQ ID NO: 1091357 - RNA, 13 nt, Homo sapiens
uagaaaucucauc

SEQ ID NO: 1091358 - RNA, 21 nt, Homo sapiens
uagaaaucucaucuuuguaau

SEQ ID NO: 1091359 - RNA, 17 nt, Homo sapiens
uaguucuuuucaugcaa

SEQ ID NO: 1091360 - RNA, 19 nt, Homo sapiens
uauccauaguggacauugu

SEQ ID NO: 1091361 - RNA, 15 nt, Homo sapiens
uaucugaacugugga

SEQ ID NO: 1091362 - RNA, 21 nt, Homo sapiens
uauucaaguauuccuaugcca

SEQ ID NO: 1091363 - RNA, 12 nt, Homo sapiens
uauucauuucaa

SEQ ID NO: 1091364 - RNA, 18 nt, Homo sapiens
uauuguacagaagcucuu

SEQ ID NO: 1091365 - RNA, 18 nt, Homo sapiens
uauuucugaaacaauuaa

SEQ ID NO: 1091366 - RNA, 15 nt, Homo sapiens
ucaacauuuaaucaa

SEQ ID NO: 1091367 - RNA, 16 nt, Homo sapiens
ucaacauuuaaucaau

SEQ ID NO: 1091368 - RNA, 17 nt, Homo sapiens
ucaauuguuaguuauaa

SEQ ID NO: 1091369 - RNA, 14 nt, Homo sapiens
ucacucuugccaac

SEQ ID NO: 1091370 - RNA, 21 nt, Homo sapiens
ucacucuugccaaccuguaau

SEQ ID NO: 1091371 - RNA, 14 nt, Homo sapiens
ucauccacucugcc

SEQ ID NO: 1091372 - RNA, 19 nt, Homo sapiens
ucauccacucugccugcuu

SEQ ID NO: 1091373 - RNA, 20 nt, Homo sapiens
ucaugcuaauauaaguuucu

SEQ ID NO: 1091374 - RNA, 15 nt, Homo sapiens
ucaugcuguguaaua

SEQ ID NO: 1091375 - RNA, 23 nt, Homo sapiens
uccacacauuuaaaacauuugaa

SEQ ID NO: 1091376 - RNA, 15 nt, Homo sapiens
uccaucuucuuugca

SEQ ID NO: 1091377 - RNA, 23 nt, Homo sapiens
ucccaccucucugagcucugcau

SEQ ID NO: 1091378 - RNA, 18 nt, Homo sapiens
ucccugcccucaucucuc

SEQ ID NO: 1091379 - RNA, 13 nt, Homo sapiens
ucccuucauuuaa

SEQ ID NO: 1091380 - RNA, 20 nt, Homo sapiens
uccuacaguguaucaacaaa

SEQ ID NO: 1091381 - RNA, 20 nt, Homo sapiens
uccuguaagcaacacuuuaa

SEQ ID NO: 1091382 - RNA, 18 nt, Homo sapiens
ucgggaaccucacucuug

SEQ ID NO: 1091383 - RNA, 20 nt, Homo sapiens
ucgggaaccucacucuugcc

SEQ ID NO: 1091384 - RNA, 13 nt, Homo sapiens
ucgucuuugcaga

SEQ ID NO: 1091385 - RNA, 15 nt, Homo sapiens
ucucucucuuagcau

SEQ ID NO: 1091386 - RNA, 20 nt, Homo sapiens
ucucucuuagcauccugccu

SEQ ID NO: 1091387 - RNA, 19 nt, Homo sapiens
ucuguuagccauguggcug

SEQ ID NO: 1091388 - RNA, 19 nt, Homo sapiens
ucuuacauuuucucugaug

SEQ ID NO: 1091389 - RNA, 18 nt, Homo sapiens
ucuuccaaaccaccuucc

SEQ ID NO: 1091390 - RNA, 14 nt, Homo sapiens
ucuucuuugcagcc

SEQ ID NO: 1091391 - RNA, 16 nt, Homo sapiens
ucuugccaaccuguaa

SEQ ID NO: 1091392 - RNA, 20 nt, Homo sapiens
ugaaaaaccugggcaccuaa

SEQ ID NO: 1091393 - RNA, 17 nt, Homo sapiens
ugacauguacauacugu

SEQ ID NO: 1091394 - RNA, 23 nt, Homo sapiens
ugcagucugggccccaucauuaa

SEQ ID NO: 1091395 - RNA, 23 nt, Homo sapiens
ugcauaucacuugauaugugcac

SEQ ID NO: 1091396 - RNA, 16 nt, Homo sapiens
ugccucaacauacugu

SEQ ID NO: 1091397 - RNA, 18 nt, Homo sapiens
ugccucgggaaccucacu

SEQ ID NO: 1091398 - RNA, 22 nt, Homo sapiens
ugcucagcccuggaggugccag

SEQ ID NO: 1091399 - RNA, 14 nt, Homo sapiens
uggaaucaucacuu

SEQ ID NO: 1091400 - RNA, 21 nt, Homo sapiens
uggagccuguguaacagcucc

SEQ ID NO: 1091401 - RNA, 13 nt, Homo sapiens
uggccccucucag

SEQ ID NO: 1091402 - RNA, 22 nt, Homo sapiens
uggcugccccauuuauccaccu

SEQ ID NO: 1091403 - RNA, 16 nt, Homo sapiens
uggcuuuagacacugg

SEQ ID NO: 1091404 - RNA, 18 nt, Homo sapiens
ugggaggaagcagaauaa

SEQ ID NO: 1091405 - RNA, 14 nt, Homo sapiens
ugggccccaucauu

SEQ ID NO: 1091406 - RNA, 22 nt, Homo sapiens
uggucccugcccucaucucucu

SEQ ID NO: 1091407 - RNA, 18 nt, Homo sapiens
uguaacggccaacacuuu

SEQ ID NO: 1091408 - RNA, 15 nt, Homo sapiens
uguaagcaacacuuu

SEQ ID NO: 1091409 - RNA, 21 nt, Homo sapiens
uguaucaacaaaaggagccaa

SEQ ID NO: 1091410 - RNA, 13 nt, Homo sapiens
uguguaacagcuc

SEQ ID NO: 1091411 - RNA, 18 nt, Homo sapiens
uguuaucugaacugugga

SEQ ID NO: 1091412 - RNA, 12 nt, Homo sapiens
uguuugcauuua

SEQ ID NO: 1091413 - RNA, 23 nt, Homo sapiens
uuacauuuucucugaugauguca

SEQ ID NO: 1091414 - RNA, 14 nt, Homo sapiens
uuacccuccuguaa

SEQ ID NO: 1091415 - RNA, 20 nt, Homo sapiens
uucacacggacuaaucuuuc

SEQ ID NO: 1091416 - RNA, 12 nt, Homo sapiens
uugaaacuaacu

SEQ ID NO: 1091417 - RNA, 17 nt, Homo sapiens
uugaaacuaacuguugg

SEQ ID NO: 1091418 - RNA, 22 nt, Homo sapiens
uugaugucuaaguaugccucag

SEQ ID NO: 1091419 - RNA, 18 nt, Homo sapiens
uugcccaaaaugucaauu

SEQ ID NO: 1091420 - RNA, 16 nt, Homo sapiens
uugcuagugacaugua

SEQ ID NO: 1091421 - RNA, 20 nt, Homo sapiens
uuuacccuccuguaagcaac

SEQ ID NO: 1091422 - RNA, 18 nt, Homo sapiens
uuugcuagugacauguac

SEQ ID NO: 1091423 - RNA, 16 nt, Homo sapiens
uuugucuauucuccag

SEQ ID NO: 1091424 - RNA, 13 nt, Homo sapiens
aaaaccugggcac

SEQ ID NO: 1091425 - RNA, 22 nt, Homo sapiens
aaaagagaaugaugcugugcau

SEQ ID NO: 1091426 - RNA, 14 nt, Homo sapiens
aaacccacaaucca

SEQ ID NO: 1091427 - RNA, 17 nt, Homo sapiens
aaaccugggcaccuaag

SEQ ID NO: 1091428 - RNA, 14 nt, Homo sapiens
aaagaaauaaucuc

SEQ ID NO: 1091429 - RNA, 22 nt, Homo sapiens
aaaugagucaaaguucaaaaau

SEQ ID NO: 1091430 - RNA, 18 nt, Homo sapiens
aaauucuguggcaguuuu

SEQ ID NO: 1091431 - RNA, 16 nt, Homo sapiens
aacaaaaggagccaag

SEQ ID NO: 1091432 - RNA, 14 nt, Homo sapiens
aacauaauuaagcu

SEQ ID NO: 1091433 - RNA, 13 nt, Homo sapiens
aacauacuguuga

SEQ ID NO: 1091434 - RNA, 19 nt, Homo sapiens
aaaacccuuggaccucucc

SEQ ID NO: 1091435 - RNA, 13 nt, Homo sapiens
aaaccaccuuccc

SEQ ID NO: 1091436 - RNA, 21 nt, Homo sapiens
aaaccugggcaccuaagcaau

SEQ ID NO: 1091437 - RNA, 21 nt, Homo sapiens
aaaguaaagaacaacaacaaa

SEQ ID NO: 1091438 - RNA, 12 nt, Homo sapiens
aaauaacauugc

SEQ ID NO: 1091439 - RNA, 21 nt, Homo sapiens
aacacaauuaaaucucuccuu

SEQ ID NO: 1091440 - RNA, 22 nt, Homo sapiens
aacacuuuaacgucuuacauuu

SEQ ID NO: 1091441 - RNA, 13 nt, Homo sapiens
aacauugcacuuu

SEQ ID NO: 1091442 - RNA, 18 nt, Homo sapiens
aaccucacucuugccaac

SEQ ID NO: 1091443 - RNA, 19 nt, Homo sapiens
aaccucacucuugccaacc

SEQ ID NO: 1091444 - RNA, 15 nt, Homo sapiens
aagaaauaaucucua

SEQ ID NO: 1091445 - RNA, 13 nt, Homo sapiens
aagcaacacuuua

SEQ ID NO: 1091446 - RNA, 19 nt, Homo sapiens
aagcagaauaaagcaauuu

SEQ ID NO: 1091447 - RNA, 17 nt, Homo sapiens
cuugccaaccuguaaua

SEQ ID NO: 1091448 - RNA, 21 nt, Homo sapiens
cuugccaaccuguaauaaaua

SEQ ID NO: 1091449 - RNA, 15 nt, Homo sapiens
cuugucuguuagcca

SEQ ID NO: 1091450 - RNA, 16 nt, Homo sapiens
gaaccucacucuugcc

SEQ ID NO: 1091451 - RNA, 17 nt, Homo sapiens
gaaccucacucuugcca

SEQ ID NO: 1091452 - RNA, 22 nt, Homo sapiens
gaaccucacucuugccaaccug

SEQ ID NO: 1091453 - RNA, 18 nt, Homo sapiens
gaacuguggaaucaucac

SEQ ID NO: 1091454 - RNA, 18 nt, Homo sapiens
gaauauggaacauaugca

SEQ ID NO: 1091455 - RNA, 15 nt, Homo sapiens
gaaugcuauuuucaa

SEQ ID NO: 1091456 - RNA, 18 nt, Homo sapiens
gacauaaggagugccuga

SEQ ID NO: 1091457 - RNA, 18 nt, Homo sapiens
gacauguacauacuguau

SEQ ID NO: 1091458 - RNA, 10 nt, Homo sapiens
gaucugcuca

SEQ ID NO: 1091459 - RNA, 11 nt, Homo sapiens
gcaaagcccca

SEQ ID NO: 1091460 - RNA, 12 nt, Homo sapiens
gcacacacugug

SEQ ID NO: 1091461 - RNA, 21 nt, Homo sapiens
gcauuugucuauucuccagcu

SEQ ID NO: 1091462 - RNA, 14 nt, Homo sapiens
gccaaccuguaaua

SEQ ID NO: 1091463 - RNA, 18 nt, Homo sapiens
gccugaauagcuuggaaa

SEQ ID NO: 1091464 - RNA, 23 nt, Homo sapiens
gcucauuuuacgcugucucugac

SEQ ID NO: 1091465 - RNA, 13 nt, Homo sapiens
gcucgucuuugca

SEQ ID NO: 1091466 - RNA, 23 nt, Homo sapiens
gcuuuagacacuggcugccagcu

SEQ ID NO: 1091467 - RNA, 20 nt, Homo sapiens
ggaaaaugcaaugucuuaaa

SEQ ID NO: 1091468 - RNA, 12 nt, Homo sapiens
ggaacauaugca

SEQ ID NO: 1091469 - RNA, 20 nt, Homo sapiens
ggaacgaauacccugcucaa

SEQ ID NO: 1091470 - RNA, 18 nt, Homo sapiens
gggaaccucacucuugcc

SEQ ID NO: 1091471 - RNA, 23 nt, Homo sapiens
guaaauauuuuguuaucugaacu

SEQ ID NO: 1091472 - RNA, 21 nt, Homo sapiens
guaccauuuauuuuaugacau

SEQ ID NO: 1091473 - RNA, 23 nt, Homo sapiens
guagaaaucucaucuuuguaaua

SEQ ID NO: 1091474 - RNA, 22 nt, Homo sapiens
gucacacaaaauuaucaugaca

SEQ ID NO: 1091475 - RNA, 20 nt, Homo sapiens
gugcaccaauaccuacugaa

SEQ ID NO: 1091476 - RNA, 18 nt, Homo sapiens
gugucaaauaaacacugu

SEQ ID NO: 1091477 - RNA, 14 nt, Homo sapiens
uaaaauuggcacca

SEQ ID NO: 1091478 - RNA, 12 nt, Homo sapiens
uaaacacugugu

SEQ ID NO: 1091479 - RNA, 19 nt, Homo sapiens
uaaaugagucaaaguucaa

SEQ ID NO: 1091480 - RNA, 16 nt, Homo sapiens
uaaccaagcuauucaa

SEQ ID NO: 1091481 - RNA, 13 nt, Homo sapiens
uaaguaugccuca

SEQ ID NO: 1091482 - RNA, 14 nt, Homo sapiens
uaauaaacuuccaa

SEQ ID NO: 1091483 - RNA, 20 nt, Homo sapiens
uaauuguugaccuaagaaua

SEQ ID NO: 1091484 - RNA, 15 nt, Homo sapiens
uacauuuucucugau

SEQ ID NO: 1091485 - RNA, 17 nt, Homo sapiens
uacgcugucucugacau

SEQ ID NO: 1091486 - RNA, 19 nt, Homo sapiens
uacuaauugcccaaaaugu

SEQ ID NO: 1091487 - RNA, 14 nt, Homo sapiens
uagaaaucucaucu

SEQ ID NO: 1091488 - RNA, 12 nt, Homo sapiens
ucacucuugcca

SEQ ID NO: 1091489 - RNA, 18 nt, Homo sapiens
ucacucuugccaaccugu

SEQ ID NO: 1091490 - RNA, 22 nt, Homo sapiens
ucauaauuguugaccuaagaau

SEQ ID NO: 1091491 - RNA, 13 nt, Homo sapiens
ucauauuuuccaa

SEQ ID NO: 1091492 - RNA, 16 nt, Homo sapiens
uccaaaccaccuuccc

SEQ ID NO: 1091493 - RNA, 14 nt, Homo sapiens
uccagaggccaugu

SEQ ID NO: 1091494 - RNA, 15 nt, Homo sapiens
uccaucuaccuucca

SEQ ID NO: 1091495 - RNA, 16 nt, Homo sapiens
ucccaugugugaugcu

SEQ ID NO: 1091496 - RNA, 22 nt, Homo sapiens
ucgggaaccucacucuugccaa

SEQ ID NO: 1091497 - RNA, 12 nt, Homo sapiens
ucuacacucauu

SEQ ID NO: 1091498 - RNA, 13 nt, Homo sapiens
ucucaggcugugc

SEQ ID NO: 1091499 - RNA, 17 nt, Homo sapiens
ucuccaucuaccuucca

SEQ ID NO: 1091500 - RNA, 18 nt, Homo sapiens
ucucuccaucuaccuucc

SEQ ID NO: 1091501 - RNA, 15 nt, Homo sapiens
ucucugaugauguca

SEQ ID NO: 1091502 - RNA, 15 nt, Homo sapiens
ucugaacuguggaau

SEQ ID NO: 1091503 - RNA, 14 nt, Homo sapiens
ucugccugcuuaca

SEQ ID NO: 1091504 - RNA, 14 nt, Homo sapiens
ucuugaucugcuca

SEQ ID NO: 1091505 - RNA, 14 nt, Homo sapiens
ucuugccaaccugu

SEQ ID NO: 1091506 - RNA, 19 nt, Homo sapiens
ugaaggaccuaaauucgua

SEQ ID NO: 1091507 - RNA, 21 nt, Homo sapiens
ugaauauggaacauaugcaca

SEQ ID NO: 1091508 - RNA, 19 nt, Homo sapiens
ugacauguacauacuguau

SEQ ID NO: 1091509 - RNA, 18 nt, Homo sapiens
ugacauuuuacaauguaa

SEQ ID NO: 1091510 - RNA, 16 nt, Homo sapiens
ugccaaccuguaauaa

SEQ ID NO: 1091511 - RNA, 19 nt, Homo sapiens
ugcuucuuggagucuucca

SEQ ID NO: 1091512 - RNA, 17 nt, Homo sapiens
ugcuuucuauuguacag

SEQ ID NO: 1091513 - RNA, 13 nt, Homo sapiens
uggaaaaugcaau

SEQ ID NO: 1091514 - RNA, 15 nt, Homo sapiens
ugggcaccuaagcaa

SEQ ID NO: 1091515 - RNA, 13 nt, Homo sapiens
ugggccccaucau

SEQ ID NO: 1091516 - RNA, 17 nt, Homo sapiens
ugggccccaucauuaaa

SEQ ID NO: 1091517 - RNA, 17 nt, Homo sapiens
uguaauaaauaugagug

SEQ ID NO: 1091518 - RNA, 14 nt, Homo sapiens
uguagaaaucucau

SEQ ID NO: 1091519 - RNA, 15 nt, Homo sapiens
ugucaauuugaugua

SEQ ID NO: 1091520 - RNA, 20 nt, Homo sapiens
ugucaccuuaaaauaagauu

SEQ ID NO: 1091521 - RNA, 16 nt, Homo sapiens
ugugugaugcugacac

SEQ ID NO: 1091522 - RNA, 14 nt, Homo sapiens
uguuugugcuucua

SEQ ID NO: 1091523 - RNA, 19 nt, Homo sapiens
uuaucaugacaaauauuac

SEQ ID NO: 1091524 - RNA, 14 nt, Homo sapiens
uugccaaccuguaa

SEQ ID NO: 1091525 - RNA, 16 nt, Homo sapiens
uugccaaccuguaaua

SEQ ID NO: 1091526 - RNA, 23 nt, Homo sapiens
uugugucaaucaugcuguguaau

SEQ ID NO: 1091527 - RNA, 23 nt, Homo sapiens
uuuaaucaaucuuugugccucaa

SEQ ID NO: 1091528 - RNA, 22 nt, Homo sapiens
uuuaauugcaccugaaaaaccu

SEQ ID NO: 1091529 - RNA, 14 nt, Homo sapiens
uuuaugacauuuua

SEQ ID NO: 1091530 - RNA, 18 nt, Homo sapiens
uuuuguuagccaacauaa

SEQ ID NO: 1091531 - RNA, 19 nt, Homo sapiens
cucucuccaucuaccuucc

SEQ ID NO: 1091532 - RNA, 22 nt, Homo sapiens
cucucuuagcauccugccuuag

SEQ ID NO: 1091533 - RNA, 22 nt, Homo sapiens
cucugaugaugucacacaaaau

SEQ ID NO: 1091534 - RNA, 16 nt, Homo sapiens
cucuugccaaccugua

SEQ ID NO: 1091535 - RNA, 19 nt, Homo sapiens
cucuugccaaccuguaaua

SEQ ID NO: 1091536 - RNA, 23 nt, Homo sapiens
cugaauagcuuggaaaaguaaca

SEQ ID NO: 1091537 - RNA, 20 nt, Homo sapiens
cugcagucugggccccauca

SEQ ID NO: 1091538 - RNA, 24 nt, Homo sapiens
cugccucgggaaccucacucuugc

SEQ ID NO: 1091539 - RNA, 15 nt, Homo sapiens
cuggagccuguguaa

SEQ ID NO: 1091540 - RNA, 19 nt, Homo sapiens
cuggaggugccagcaaagc

SEQ ID NO: 1091541 - RNA, 16 nt, Homo sapiens
cugggccccaucauua

SEQ ID NO: 1091542 - RNA, 17 nt, Homo sapiens
cuguaagcaacacuuua

SEQ ID NO: 1091543 - RNA, 18 nt, Homo sapiens
cuguaauaaauaugagug

SEQ ID NO: 1091544 - RNA, 21 nt, Homo sapiens
cuguaauaaauaugagugcca

SEQ ID NO: 1091545 - RNA, 17 nt, Homo sapiens
cugugcauaucacuuga

SEQ ID NO: 1091546 - RNA, 13 nt, Homo sapiens
cuugccaaccugu

SEQ ID NO: 1091547 - RNA, 15 nt, Homo sapiens
gaaauaacauugcac

SEQ ID NO: 1091548 - RNA, 12 nt, Homo sapiens
gaacuguggaau

SEQ ID NO: 1091549 - RNA, 16 nt, Homo sapiens
gaaggaaauaacauug

SEQ ID NO: 1091550 - RNA, 11 nt, Homo sapiens
gaaggcugugc

SEQ ID NO: 1091551 - RNA, 23 nt, Homo sapiens
gaaggcugugcagggacgucuca

SEQ ID NO: 1091552 - RNA, 19 nt, Homo sapiens
gaauauggaacauaugcac

SEQ ID NO: 1091553 - RNA, 22 nt, Homo sapiens
gagucuuccaaaccaccuuccc

SEQ ID NO: 1091554 - RNA, 19 nt, Homo sapiens
gaucuaauaaacuuccaaa

SEQ ID NO: 1091555 - RNA, 21 nt, Homo sapiens
gaucuaauaaacuuccaaaca

SEQ ID NO: 1091556 - RNA, 12 nt, Homo sapiens
gcauguauucca

SEQ ID NO: 1091557 - RNA, 19 nt, Homo sapiens
gcauucucaauacuugaau

SEQ ID NO: 1091558 - RNA, 16 nt, Homo sapiens
gccucaacauacuguu

SEQ ID NO: 1091559 - RNA, 13 nt, Homo sapiens
gcucaacauuuaa

SEQ ID NO: 1091560 - RNA, 14 nt, Homo sapiens
gcucgucuuugcag

SEQ ID NO: 1091561 - RNA, 15 nt, Homo sapiens
ggaaauaacauugca

SEQ ID NO: 1091562 - RNA, 17 nt, Homo sapiens
ggaaauaacauugcacu

SEQ ID NO: 1091563 - RNA, 13 nt, Homo sapiens
ggaaccucacucu

SEQ ID NO: 1091564 - RNA, 14 nt, Homo sapiens
ggaaccucacucuu

SEQ ID NO: 1091565 - RNA, 17 nt, Homo sapiens
ggaaccucacucuugcc

SEQ ID NO: 1091566 - RNA, 23 nt, Homo sapiens
ggaucuaauaaacuuccaaacag

SEQ ID NO: 1091567 - RNA, 19 nt, Homo sapiens
gggaaccucacucuugcca

SEQ ID NO: 1091568 - RNA, 13 nt, Homo sapiens
gguugccgucucu

SEQ ID NO: 1091569 - RNA, 14 nt, Homo sapiens
guaagcaacacuuu

SEQ ID NO: 1091570 - RNA, 19 nt, Homo sapiens
guacagaauuauaugacca

SEQ ID NO: 1091571 - RNA, 15 nt, Homo sapiens
guagauguagcauug

SEQ ID NO: 1091572 - RNA, 17 nt, Homo sapiens
gugaugcugacaccagc

SEQ ID NO: 1091573 - RNA, 14 nt, Homo sapiens
gugcuuaccuguga

SEQ ID NO: 1091574 - RNA, 15 nt, Homo sapiens
guggaaaaugcaaug

SEQ ID NO: 1091575 - RNA, 15 nt, Homo sapiens
uaaacgggcugcguu

SEQ ID NO: 1091576 - RNA, 13 nt, Homo sapiens
uaaacuuccaaac

SEQ ID NO: 1091577 - RNA, 16 nt, Homo sapiens
uaaagaaauaaucucu

SEQ ID NO: 1091578 - RNA, 23 nt, Homo sapiens
uaaauauuuaaagaaaaaaaagu

SEQ ID NO: 1091579 - RNA, 17 nt, Homo sapiens
uaaauuuuaauugcacc

SEQ ID NO: 1091580 - RNA, 23 nt, Homo sapiens
uaaguuuugaaacuaacuguugg

SEQ ID NO: 1091581 - RNA, 15 nt, Homo sapiens
uaauacauguaaaua

SEQ ID NO: 1091582 - RNA, 19 nt, Homo sapiens
uacccugcucaacauuuaa

SEQ ID NO: 1091583 - RNA, 22 nt, Homo sapiens
uagcauuguuccacacauuuaa

SEQ ID NO: 1091584 - RNA, 13 nt, Homo sapiens
uaguucuuuucau

SEQ ID NO: 1091585 - RNA, 20 nt, Homo sapiens
uaguuuuguaucaaccuaaa

SEQ ID NO: 1091586 - RNA, 22 nt, Homo sapiens
uaucaaacacaauuaaaucucu

SEQ ID NO: 1091587 - RNA, 20 nt, Homo sapiens
uauccaccuccaucuucuuu

SEQ ID NO: 1091588 - RNA, 18 nt, Homo sapiens
uauggaacauaugcacag

SEQ ID NO: 1091589 - RNA, 13 nt, Homo sapiens
uauucaaguauuc

SEQ ID NO: 1091590 - RNA, 18 nt, Homo sapiens
uauuuuaugacauuuuac

SEQ ID NO: 1091591 - RNA, 15 nt, Homo sapiens
ucaaauaaacacugu

SEQ ID NO: 1091592 - RNA, 20 nt, Homo sapiens
ucaacauacuguugaugucu

SEQ ID NO: 1091593 - RNA, 22 nt, Homo sapiens
ucaaucaugcuguguaauauca

SEQ ID NO: 1091594 - RNA, 19 nt, Homo sapiens
ucacacggacuaaucuuuc

SEQ ID NO: 1091595 - RNA, 20 nt, Homo sapiens
ucacucuugccaaccuguaa

SEQ ID NO: 1091596 - RNA, 13 nt, Homo sapiens
ucaggcugugcuu

SEQ ID NO: 1091597 - RNA, 22 nt, Homo sapiens
ucagugucaaauaaacacugug

SEQ ID NO: 1091598 - RNA, 22 nt, Homo sapiens
ucaugcaaguauaaauucaauu

SEQ ID NO: 1091599 - RNA, 18 nt, Homo sapiens
ucaugcuguguaauauca

SEQ ID NO: 1091600 - RNA, 13 nt, Homo sapiens
ucauuuaaccaag

SEQ ID NO: 1091601 - RNA, 18 nt, Homo sapiens
uccaaacagguccaccau

SEQ ID NO: 1091602 - RNA, 21 nt, Homo sapiens
uccagcugacccugguucucu

SEQ ID NO: 1091603 - RNA, 17 nt, Homo sapiens
uccauaguggacauugu

SEQ ID NO: 1091604 - RNA, 17 nt, Homo sapiens
ucccccgaguaccgccu

SEQ ID NO: 1091605 - RNA, 21 nt, Homo sapiens
ucgggaaccucacucuugcca

SEQ ID NO: 1091606 - RNA, 23 nt, Homo sapiens
ucgggaaccucacucuugccaac

SEQ ID NO: 1091607 - RNA, 21 nt, Homo sapiens
ucuccuggccaucccuucauu

SEQ ID NO: 1091608 - RNA, 23 nt, Homo sapiens
ucucuccaucuaccuuccaguca

SEQ ID NO: 1091609 - RNA, 22 nt, Homo sapiens
ucucucuuagcauccugccuua

SEQ ID NO: 1091610 - RNA, 23 nt, Homo sapiens
ucugagugcuuucauauuuucca

SEQ ID NO: 1091611 - RNA, 22 nt, Homo sapiens
ucuggccccucucaggcugugc

SEQ ID NO: 1091612 - RNA, 14 nt, Homo sapiens
ucuguuagccaugu

SEQ ID NO: 1091613 - RNA, 20 nt, Homo sapiens
ucuuugugccucaacauacu

SEQ ID NO: 1091614 - RNA, 20 nt, Homo sapiens
ugaauauggaacauaugcac

SEQ ID NO: 1091615 - RNA, 13 nt, Homo sapiens
ugccaaccuguaa

SEQ ID NO: 1091616 - RNA, 18 nt, Homo sapiens
ugccugcuuacacccugc

SEQ ID NO: 1091617 - RNA, 16 nt, Homo sapiens
ugcuuucauauuuucc

SEQ ID NO: 1091618 - RNA, 14 nt, Homo sapiens
uggaaaaugcaaug

SEQ ID NO: 1091619 - RNA, 16 nt, Homo sapiens
uggaucuaauaaacuu

SEQ ID NO: 1091620 - RNA, 14 nt, Homo sapiens
uguacauacuguau

SEQ ID NO: 1091621 - RNA, 19 nt, Homo sapiens
ccaggcacacacugugcuu

SEQ ID NO: 1091622 - RNA, 17 nt, Homo sapiens
ccagggaaggcugugca

SEQ ID NO: 1091623 - RNA, 21 nt, Homo sapiens
ccauccagaggccauguucca

SEQ ID NO: 1091624 - RNA, 20 nt, Homo sapiens
cccaugggccucaugaauaa

SEQ ID NO: 1091625 - RNA, 19 nt, Homo sapiens
cccuucauuuaaccaagcu

SEQ ID NO: 1091626 - RNA, 20 nt, Homo sapiens
ccuccuguaagcaacacuuu

SEQ ID NO: 1091627 - RNA, 20 nt, Homo sapiens
ccuuugugugguaguucuaa

SEQ ID NO: 1091628 - RNA, 15 nt, Homo sapiens
cggccaacacuuugu

SEQ ID NO: 1091629 - RNA, 19 nt, Homo sapiens
cuaaaagagaaugaugcug

SEQ ID NO: 1091630 - RNA, 17 nt, Homo sapiens
cuaaagaaauaaucucu

SEQ ID NO: 1091631 - RNA, 13 nt, Homo sapiens
cuacacucauucu

SEQ ID NO: 1091632 - RNA, 13 nt, Homo sapiens
cucacucuugcca

SEQ ID NO: 1091633 - RNA, 22 nt, Homo sapiens
cucacucuugccaaccuguaau

SEQ ID NO: 1091634 - RNA, 13 nt, Homo sapiens
cucgucuuugcag

SEQ ID NO: 1091635 - RNA, 13 nt, Homo sapiens
cugaacuguggaa

SEQ ID NO: 1091636 - RNA, 18 nt, Homo sapiens
cugggcucgucuuugcag

SEQ ID NO: 1091637 - RNA, 18 nt, Homo sapiens
cugguucucucucuuagc

SEQ ID NO: 1091638 - RNA, 13 nt, Homo sapiens
cugugacagcagc

SEQ ID NO: 1091639 - RNA, 18 nt, Homo sapiens
cugugcagggacgucuca

SEQ ID NO: 1091640 - RNA, 14 nt, Homo sapiens
cuuaccugugacag

SEQ ID NO: 1091641 - RNA, 22 nt, Homo sapiens
cuuagagccaggcacacacugu

SEQ ID NO: 1091642 - RNA, 15 nt, Homo sapiens
cuugaauauggaaca

SEQ ID NO: 1091643 - RNA, 18 nt, Homo sapiens
cuugagauaguaacaaca

SEQ ID NO: 1091644 - RNA, 14 nt, Homo sapiens
cuugccaaccugua

SEQ ID NO: 1091645 - RNA, 13 nt, Homo sapiens
uuaaacgggcugc

SEQ ID NO: 1091646 - RNA, 16 nt, Homo sapiens
uuaaauuuuaaacaau

SEQ ID NO: 1091647 - RNA, 14 nt, Homo sapiens
uuaaucaaucuuug

SEQ ID NO: 1091648 - RNA, 22 nt, Homo sapiens
uuagagccaggcacacacugug

SEQ ID NO: 1091649 - RNA, 18 nt, Homo sapiens
uuagcauccugccuuaga

SEQ ID NO: 1091650 - RNA, 17 nt, Homo sapiens
uuauuuuaugacauuuu

SEQ ID NO: 1091651 - RNA, 16 nt, Homo sapiens
uucaaaaauauucauu

SEQ ID NO: 1091652 - RNA, 16 nt, Homo sapiens
uucauuucaaucuuuu

SEQ ID NO: 1091653 - RNA, 21 nt, Homo sapiens
uucuuauggaacgaauacccu

SEQ ID NO: 1091654 - RNA, 23 nt, Homo sapiens
uugugccucaacauacuguugau

SEQ ID NO: 1091655 - RNA, 12 nt, Homo sapiens
uuuagacacugg

SEQ ID NO: 1091656 - RNA, 15 nt, Homo sapiens
uuucauaauuguuga

SEQ ID NO: 1091657 - RNA, 18 nt, Homo sapiens
uuuccaaauuauguggau

SEQ ID NO: 1091658 - RNA, 13 nt, Homo sapiens
uuucuuugcuuca

SEQ ID NO: 1091659 - RNA, 15 nt, Homo sapiens
cuugccaaccuguaa

SEQ ID NO: 1091660 - RNA, 21 nt, Homo sapiens
cuuuagacacuggcugccagc

SEQ ID NO: 1091661 - RNA, 20 nt, Homo sapiens
cuuucauauuuuccaaauua

SEQ ID NO: 1091662 - RNA, 13 nt, Homo sapiens
cuuugugccucaa

SEQ ID NO: 1091663 - RNA, 16 nt, Homo sapiens
gaaauaacauugcacu

SEQ ID NO: 1091664 - RNA, 12 nt, Homo sapiens
gaaauaaucucu

SEQ ID NO: 1091665 - RNA, 21 nt, Homo sapiens
gaaaucucaucuuuguaauac

SEQ ID NO: 1091666 - RNA, 13 nt, Homo sapiens
gaauaaagcaauu

SEQ ID NO: 1091667 - RNA, 20 nt, Homo sapiens
gaauauggaacauaugcaca

SEQ ID NO: 1091668 - RNA, 14 nt, Homo sapiens
gaaugcuauuuuca

SEQ ID NO: 1091669 - RNA, 16 nt, Homo sapiens
gacauaaggagugccu

SEQ ID NO: 1091670 - RNA, 23 nt, Homo sapiens
gagaccccuaaagaaauaaucuc

SEQ ID NO: 1091671 - RNA, 18 nt, Homo sapiens
gagccaggcacacacugu

SEQ ID NO: 1091672 - RNA, 19 nt, Homo sapiens
gagccaggcacacacugug

SEQ ID NO: 1091673 - RNA, 20 nt, Homo sapiens
gagugcuuucauauuuucca

SEQ ID NO: 1091674 - RNA, 17 nt, Homo sapiens
gcaaguauaaauucaau

SEQ ID NO: 1091675 - RNA, 13 nt, Homo sapiens
gcacacacugugc

SEQ ID NO: 1091676 - RNA, 14 nt, Homo sapiens
gcacacacugugcu

SEQ ID NO: 1091677 - RNA, 20 nt, Homo sapiens
gcacuuuauaaacacuguau

SEQ ID NO: 1091678 - RNA, 21 nt, Homo sapiens
gcagucugggccccaucauua

SEQ ID NO: 1091679 - RNA, 16 nt, Homo sapiens
gccaaccuguaauaaa

SEQ ID NO: 1091680 - RNA, 22 nt, Homo sapiens
gccaaccuguaauaaauaugag

SEQ ID NO: 1091681 - RNA, 17 nt, Homo sapiens
gccaucccuucauuuaa

SEQ ID NO: 1091682 - RNA, 20 nt, Homo sapiens
gccccucucaggcugugcuu

SEQ ID NO: 1091683 - RNA, 15 nt, Homo sapiens
gcccuggaggugcca

SEQ ID NO: 1091684 - RNA, 20 nt, Homo sapiens
gcccugggcucgucuuugca

SEQ ID NO: 1091685 - RNA, 16 nt, Homo sapiens
gccuguguaacagcuc

SEQ ID NO: 1091686 - RNA, 18 nt, Homo sapiens
gcucuguccccaccccau

SEQ ID NO: 1091687 - RNA, 18 nt, Homo sapiens
ggaaccucacucuugcca

SEQ ID NO: 1091688 - RNA, 23 nt, Homo sapiens
ggaaccucacucuugccaaccug

SEQ ID NO: 1091689 - RNA, 13 nt, Homo sapiens
ggcacacacugug

SEQ ID NO: 1091690 - RNA, 11 nt, Homo sapiens
gggaaccucac

SEQ ID NO: 1091691 - RNA, 21 nt, Homo sapiens
gggaaccucacucuugccaac

SEQ ID NO: 1091692 - RNA, 18 nt, Homo sapiens
ggugauguuugcauuuac

SEQ ID NO: 1091693 - RNA, 13 nt, Homo sapiens
guaacagcuccuu

SEQ ID NO: 1091694 - RNA, 18 nt, Homo sapiens
gucaaauaaacacugugu

SEQ ID NO: 1091695 - RNA, 14 nt, Homo sapiens
gucucaucucccau

SEQ ID NO: 1091696 - RNA, 19 nt, Homo sapiens
gucugggccccaucauuaa

SEQ ID NO: 1091697 - RNA, 16 nt, Homo sapiens
gucuguuagccaugug

SEQ ID NO: 1091698 - RNA, 20 nt, Homo sapiens
gugucaaucaugcuguguaa

SEQ ID NO: 1091699 - RNA, 18 nt, Homo sapiens
guuaucugaacuguggaa

SEQ ID NO: 1091700 - RNA, 20 nt, Homo sapiens
uaaaaaguuaagcugcuaua

SEQ ID NO: 1091701 - RNA, 13 nt, Homo sapiens
uaaacaauauuac

SEQ ID NO: 1091702 - RNA, 17 nt, Homo sapiens
uaaacacuguauuguaa

SEQ ID NO: 1091703 - RNA, 15 nt, Homo sapiens
uaaauaugagugcca

SEQ ID NO: 1091704 - RNA, 14 nt, Homo sapiens
uaacauugcacuuu

SEQ ID NO: 1091705 - RNA, 15 nt, Homo sapiens
uaacauugcacuuua

SEQ ID NO: 1091706 - RNA, 14 nt, Homo sapiens
uaaguaugccucag

SEQ ID NO: 1091707 - RNA, 15 nt, Homo sapiens
uaauauuuauugcuu

SEQ ID NO: 1091708 - RNA, 16 nt, Homo sapiens
uaaucucuauguagaa

SEQ ID NO: 1091709 - RNA, 19 nt, Homo sapiens
uguaacggccaacacuuug

SEQ ID NO: 1091710 - RNA, 18 nt, Homo sapiens
uguaauaaauaugagugc

SEQ ID NO: 1091711 - RNA, 21 nt, Homo sapiens
uguuggcagcauaaaggccuu

SEQ ID NO: 1091712 - RNA, 22 nt, Homo sapiens
uuacauuuucucugaugauguc

SEQ ID NO: 1091713 - RNA, 18 nt, Homo sapiens
uuauuagcauugaucuga

SEQ ID NO: 1091714 - RNA, 17 nt, Homo sapiens
uucuuggagucuuccaa

SEQ ID NO: 1091715 - RNA, 21 nt, Homo sapiens
uuguaucaaccuaaaugaguc

SEQ ID NO: 1091716 - RNA, 23 nt, Homo sapiens
uuuacuagaacacagaaagccua

SEQ ID NO: 1091717 - RNA, 17 nt, Homo sapiens
uuucauauuuuccaaau

SEQ ID NO: 1091718 - RNA, 18 nt, Homo sapiens
uuuucgcaaacguuucac

SEQ ID NO: 1091719 - RNA, 13 nt, Homo sapiens
uuuuguuaucuga

SEQ ID NO: 1091720 - RNA, 17 nt, Homo sapiens
ugucaaauaaacacugu

SEQ ID NO: 1091721 - RNA, 18 nt, Homo sapiens
ugucaaauaaacacugug

SEQ ID NO: 1091722 - RNA, 13 nt, Homo sapiens
ugugaugcugaca

SEQ ID NO: 1091723 - RNA, 18 nt, Homo sapiens
ugugaugcugacaccagc

SEQ ID NO: 1091724 - RNA, 10 nt, Homo sapiens
ugugccucaa

SEQ ID NO: 1091725 - RNA, 21 nt, Homo sapiens
ugugccucaacauacuguuga

SEQ ID NO: 1091726 - RNA, 16 nt, Homo sapiens
uguguucgcgugugug

SEQ ID NO: 1091727 - RNA, 22 nt, Homo sapiens
uuaaucaaucuuugugccucaa

SEQ ID NO: 1091728 - RNA, 12 nt, Homo sapiens
uuaccugugaca

SEQ ID NO: 1091729 - RNA, 11 nt, Homo sapiens
uuagacacugg

SEQ ID NO: 1091730 - RNA, 21 nt, Homo sapiens
uuagagccaggcacacacugu

SEQ ID NO: 1091731 - RNA, 13 nt, Homo sapiens
cggccaacacuuu

SEQ ID NO: 1091732 - RNA, 16 nt, Homo sapiens
cgugguugccgucucu

SEQ ID NO: 1091733 - RNA, 20 nt, Homo sapiens
cuaccuugucuguuagccau

SEQ ID NO: 1091734 - RNA, 21 nt, Homo sapiens
cucaacauacuguugaugucu

SEQ ID NO: 1091735 - RNA, 20 nt, Homo sapiens
cucacucuugccaaccugua

SEQ ID NO: 1091736 - RNA, 21 nt, Homo sapiens
cuccacgugguugccgucucu

SEQ ID NO: 1091737 - RNA, 20 nt, Homo sapiens
cuccuugggaggaagcagaa

SEQ ID NO: 1091738 - RNA, 22 nt, Homo sapiens
cucgggaaccucacucuugcca

SEQ ID NO: 1091739 - RNA, 19 nt, Homo sapiens
agccaggcacacacugugc

SEQ ID NO: 1091740 - RNA, 14 nt, Homo sapiens
agcuguauauauua

SEQ ID NO: 1091741 - RNA, 16 nt, Homo sapiens
agcuuggaaaaguaac

SEQ ID NO: 1091742 - RNA, 14 nt, Homo sapiens
aggcacacacugug

SEQ ID NO: 1091743 - RNA, 21 nt, Homo sapiens
aggcugugcagggacgucuca

SEQ ID NO: 1091744 - RNA, 19 nt, Homo sapiens
agguccaccauauuugaau

SEQ ID NO: 1091745 - RNA, 21 nt, Homo sapiens
aguaauuauuagcauugaucu

SEQ ID NO: 1091746 - RNA, 22 nt, Homo sapiens
agucuuccaaaccaccuucccu

SEQ ID NO: 1091747 - RNA, 21 nt, Homo sapiens
agugacauguacauacuguau

SEQ ID NO: 1091748 - RNA, 16 nt, Homo sapiens
aguggaaaaugcaaug

SEQ ID NO: 1091749 - RNA, 16 nt, Homo sapiens
aguguagauguagcau

SEQ ID NO: 1091750 - RNA, 18 nt, Homo sapiens
aguguagauguagcauug

SEQ ID NO: 1091751 - RNA, 18 nt, Homo sapiens
agugucaaauaaacacug

SEQ ID NO: 1091752 - RNA, 15 nt, Homo sapiens
aguucuuuucaugca

SEQ ID NO: 1091753 - RNA, 18 nt, Homo sapiens
auaaacacuguauuguaa

SEQ ID NO: 1091754 - RNA, 22 nt, Homo sapiens
auaaggagugccugaauagcuu

SEQ ID NO: 1091755 - RNA, 19 nt, Homo sapiens
auaauggcauguauuccaa

SEQ ID NO: 1091756 - RNA, 19 nt, Homo sapiens
auaucacuugauaugugca

SEQ ID NO: 1091757 - RNA, 21 nt, Homo sapiens
auauuuuccaaauuaugugga

SEQ ID NO: 1091758 - RNA, 22 nt, Homo sapiens
aucaaacacaauuaaaucucuc

SEQ ID NO: 1091759 - RNA, 19 nt, Homo sapiens
aucaacaaaaggagccaag

SEQ ID NO: 1091760 - RNA, 19 nt, Homo sapiens
aucaaucuuugugccucaa

SEQ ID NO: 1091761 - RNA, 19 nt, Homo sapiens
auccauaguggacauuguu

SEQ ID NO: 1091762 - RNA, 16 nt, Homo sapiens
aucuaauaaacuucca

SEQ ID NO: 1091763 - RNA, 12 nt, Homo sapiens
aucuaccuucca

SEQ ID NO: 1091764 - RNA, 15 nt, Homo sapiens
aucuugaucugcuca

SEQ ID NO: 1091765 - RNA, 14 nt, Homo sapiens
aucuuugugccuca

SEQ ID NO: 1091766 - RNA, 18 nt, Homo sapiens
augcacaggggaaggaaa

SEQ ID NO: 1091767 - RNA, 22 nt, Homo sapiens
augcagagauaauggcauguau

SEQ ID NO: 1091768 - RNA, 20 nt, Homo sapiens
auggguacuucguggccgca

SEQ ID NO: 1091769 - RNA, 12 nt, Homo sapiens
auuaucaugaca

SEQ ID NO: 1091770 - RNA, 13 nt, Homo sapiens
auucucaauacuu

SEQ ID NO: 1091771 - RNA, 20 nt, Homo sapiens
auugaagauguccuguccac

SEQ ID NO: 1091772 - RNA, 15 nt, Homo sapiens
auuguugaccuaaga

SEQ ID NO: 1091773 - RNA, 16 nt, Homo sapiens
auuucugaaacaauua

SEQ ID NO: 1091774 - RNA, 16 nt, Homo sapiens
auuuuaauugcaccug

SEQ ID NO: 1091775 - RNA, 23 nt, Homo sapiens
auuuuaugacauuuuacaaugua

SEQ ID NO: 1091776 - RNA, 19 nt, Homo sapiens
caaaguucaaaaauauuca

SEQ ID NO: 1091777 - RNA, 16 nt, Homo sapiens
caaucaugcuguguaa

SEQ ID NO: 1091778 - RNA, 15 nt, Homo sapiens
caaugagccacagca

SEQ ID NO: 1091779 - RNA, 20 nt, Homo sapiens
caaugagccacagcaaaaag

SEQ ID NO: 1091780 - RNA, 21 nt, Homo sapiens
caaugagccacagcaaaaagu

SEQ ID NO: 1091781 - RNA, 21 nt, Homo sapiens
cacauccuacaguuggaaauc

SEQ ID NO: 1091782 - RNA, 19 nt, Homo sapiens
caccucucugagcucugca

SEQ ID NO: 1091783 - RNA, 18 nt, Homo sapiens
cacgugguugccgucucu

SEQ ID NO: 1091784 - RNA, 14 nt, Homo sapiens
cacuugugucaauc

SEQ ID NO: 1091785 - RNA, 15 nt, Homo sapiens
cagaauaaagcaauu

SEQ ID NO: 1091786 - RNA, 15 nt, Homo sapiens
cagggaaggcugugc

SEQ ID NO: 1091787 - RNA, 16 nt, Homo sapiens
caucaaagugaugauu

SEQ ID NO: 1091788 - RNA, 16 nt, Homo sapiens
caucauuaaacgggcu

SEQ ID NO: 1091789 - RNA, 14 nt, Homo sapiens
cauccagaggccau

SEQ ID NO: 1091790 - RNA, 16 nt, Homo sapiens
caucuugaucugcuca

SEQ ID NO: 1091791 - RNA, 14 nt, Homo sapiens
caucuuuguaauac

SEQ ID NO: 1091792 - RNA, 20 nt, Homo sapiens
cauguaaauauuuuguuauc

SEQ ID NO: 1091793 - RNA, 14 nt, Homo sapiens
cauuguuggcagca

SEQ ID NO: 1091794 - RNA, 19 nt, Homo sapiens
cauuuaaccaagcuauuca

SEQ ID NO: 1091795 - RNA, 16 nt, Homo sapiens
cauuuaaucaaucuuu

SEQ ID NO: 1091796 - RNA, 16 nt, Homo sapiens
cauuucaaucuuuuca

SEQ ID NO: 1091797 - RNA, 17 nt, Homo sapiens
ccaagacuccugcaaaa

SEQ ID NO: 1091798 - RNA, 15 nt, Homo sapiens
ccagagcagugccaa

SEQ ID NO: 1091799 - RNA, 18 nt, Homo sapiens
ccaugugugaugcugaca

SEQ ID NO: 1091800 - RNA, 12 nt, Homo sapiens
cccaucauuaaa

SEQ ID NO: 1091801 - RNA, 21 nt, Homo sapiens
cccuaccuugucuguuagcca

SEQ ID NO: 1091802 - RNA, 20 nt, Homo sapiens
ccuaugccagagcagugcca

SEQ ID NO: 1091803 - RNA, 18 nt, Homo sapiens
ccuguaagcaacacuuua

SEQ ID NO: 1091804 - RNA, 22 nt, Homo sapiens
ccuguaauaaauaugagugcca

SEQ ID NO: 1091805 - RNA, 14 nt, Homo sapiens
cggccaacacuuug

SEQ ID NO: 1091806 - RNA, 21 nt, Homo sapiens
cuaaagaaauaaucucuaugu

SEQ ID NO: 1091807 - RNA, 16 nt, Homo sapiens
cuaaauuuuaauugca

SEQ ID NO: 1091808 - RNA, 20 nt, Homo sapiens
cuaauaaacuuccaaacagg

SEQ ID NO: 1091809 - RNA, 14 nt, Homo sapiens
cuaccuuccaguca

SEQ ID NO: 1091810 - RNA, 14 nt, Homo sapiens
cucaauacuugaau

SEQ ID NO: 1091811 - RNA, 18 nt, Homo sapiens
cucccaugugugaugcug

SEQ ID NO: 1091812 - RNA, 20 nt, Homo sapiens
cuccuguaagcaacacuuua

SEQ ID NO: 1091813 - RNA, 22 nt, Homo sapiens
cugccccauuuauccaccucca

SEQ ID NO: 1091814 - RNA, 19 nt, Homo sapiens
cugccucgggaaccucacu

SEQ ID NO: 1091815 - RNA, 17 nt, Homo sapiens
cugggcucgucuuugca

SEQ ID NO: 1091816 - RNA, 16 nt, Homo sapiens
cuguaagcaacacuuu

SEQ ID NO: 1091817 - RNA, 18 nt, Homo sapiens
cuguaagcaacacuuuaa

SEQ ID NO: 1091818 - RNA, 12 nt, Homo sapiens
cuguaauaaaua

SEQ ID NO: 1091819 - RNA, 16 nt, Homo sapiens
cugugcuuaccuguga

SEQ ID NO: 1091820 - RNA, 18 nt, Homo sapiens
cugugcuuaccugugaca

SEQ ID NO: 1091821 - RNA, 18 nt, Homo sapiens
cuguguaauaucaaacac

SEQ ID NO: 1091822 - RNA, 13 nt, Homo sapiens
cuuaccugugaca

SEQ ID NO: 1091823 - RNA, 23 nt, Homo sapiens
cuuagagccaggcacacacugug

SEQ ID NO: 1091824 - RNA, 17 nt, Homo sapiens
cuuggagucuuccaaac

SEQ ID NO: 1091825 - RNA, 15 nt, Homo sapiens
cuuucugaacuguaa

SEQ ID NO: 1091826 - RNA, 16 nt, Homo sapiens
gaaaauccccauugaa

SEQ ID NO: 1091827 - RNA, 23 nt, Homo sapiens
gaaagccuaucaaagaccuugug

SEQ ID NO: 1091828 - RNA, 14 nt, Homo sapiens
gaaauaacauugca

SEQ ID NO: 1091829 - RNA, 15 nt, Homo sapiens
gaacaacaacaaaau

SEQ ID NO: 1091830 - RNA, 18 nt, Homo sapiens
gaaccucacucuugccaa

SEQ ID NO: 1091831 - RNA, 22 nt, Homo sapiens
gaauacccugcucaacauuuaa

SEQ ID NO: 1091832 - RNA, 14 nt, Homo sapiens
gaauauaauacauu

SEQ ID NO: 1091833 - RNA, 21 nt, Homo sapiens
gaauauggaacauaugcacag

SEQ ID NO: 1091834 - RNA, 21 nt, Homo sapiens
gagcagcaugauuauaagcca

SEQ ID NO: 1091835 - RNA, 12 nt, Homo sapiens
gagcagugccaa

SEQ ID NO: 1091836 - RNA, 15 nt, Homo sapiens
gagucaaaguucaaa

SEQ ID NO: 1091837 - RNA, 19 nt, Homo sapiens
gauaugugcaccaauaccu

SEQ ID NO: 1091838 - RNA, 17 nt, Homo sapiens
gaucuaauaaacuucca

SEQ ID NO: 1091839 - RNA, 16 nt, Homo sapiens
aaaaguaacaucuccu

SEQ ID NO: 1091840 - RNA, 23 nt, Homo sapiens
aaacaauuaauugagcagcauga

SEQ ID NO: 1091841 - RNA, 16 nt, Homo sapiens
aaaccugggcaccuaa

SEQ ID NO: 1091842 - RNA, 14 nt, Homo sapiens
aaagaaaaaaaagu

SEQ ID NO: 1091843 - RNA, 22 nt, Homo sapiens
aaaguguaacggccaacacuuu

SEQ ID NO: 1091844 - RNA, 23 nt, Homo sapiens
aaaguguaacggccaacacuuug

SEQ ID NO: 1091845 - RNA, 17 nt, Homo sapiens
aaaguuuuguaccauuu

SEQ ID NO: 1091846 - RNA, 15 nt, Homo sapiens
aaauaaacacugugu

SEQ ID NO: 1091847 - RNA, 20 nt, Homo sapiens
aaauccccauugaagauguc

SEQ ID NO: 1091848 - RNA, 16 nt, Homo sapiens
aaauucucucuuguca

SEQ ID NO: 1091849 - RNA, 15 nt, Homo sapiens
aaccaagcuauucaa

SEQ ID NO: 1091850 - RNA, 16 nt, Homo sapiens
aaccucacucuugcca

SEQ ID NO: 1091851 - RNA, 16 nt, Homo sapiens
aaccuguaauaaauau

SEQ ID NO: 1091852 - RNA, 17 nt, Homo sapiens
aagcagaauaaagcaau

SEQ ID NO: 1091853 - RNA, 22 nt, Homo sapiens
aagccuaucaaagaccuugugu

SEQ ID NO: 1091854 - RNA, 17 nt, Homo sapiens
aaggaaauaacauugca

SEQ ID NO: 1091855 - RNA, 22 nt, Homo sapiens
aaggcugugcagggacgucuca

SEQ ID NO: 1091856 - RNA, 13 nt, Homo sapiens
aaguaugccucag

SEQ ID NO: 1091857 - RNA, 13 nt, Homo sapiens
aauaaacacugug

SEQ ID NO: 1091858 - RNA, 14 nt, Homo sapiens
aauaacauugcacu

SEQ ID NO: 1091859 - RNA, 13 nt, Homo sapiens
aauacauuugcua

SEQ ID NO: 1091860 - RNA, 23 nt, Homo sapiens
aauagcuuggaaaaguaacaucu

SEQ ID NO: 1091861 - RNA, 14 nt, Homo sapiens
aauauaauacauuu

SEQ ID NO: 1091862 - RNA, 13 nt, Homo sapiens
aauaugagugcca

SEQ ID NO: 1091863 - RNA, 17 nt, Homo sapiens
aaucaugcuguguaaua

SEQ ID NO: 1091864 - RNA, 19 nt, Homo sapiens
aauccaucaaagugaugau

SEQ ID NO: 1091865 - RNA, 16 nt, Homo sapiens
aaucuuugugccucaa

SEQ ID NO: 1091866 - RNA, 14 nt, Homo sapiens
aaugcagagauaau

SEQ ID NO: 1091867 - RNA, 21 nt, Homo sapiens
aauggcauguauuccaaguac

SEQ ID NO: 1091868 - RNA, 16 nt, Homo sapiens
uacacccugcccucau

SEQ ID NO: 1091869 - RNA, 15 nt, Homo sapiens
uacauacuguauaua

SEQ ID NO: 1091870 - RNA, 19 nt, Homo sapiens
uacccuccuguaagcaaca

SEQ ID NO: 1091871 - RNA, 15 nt, Homo sapiens
uacgcugucucugac

SEQ ID NO: 1091872 - RNA, 15 nt, Homo sapiens
uagacacuggcugcc

SEQ ID NO: 1091873 - RNA, 21 nt, Homo sapiens
uagagccaggcacacacugug

SEQ ID NO: 1091874 - RNA, 22 nt, Homo sapiens
uagagccaggcacacacugugc

SEQ ID NO: 1091875 - RNA, 16 nt, Homo sapiens
uagccauguggcugcc

SEQ ID NO: 1091876 - RNA, 19 nt, Homo sapiens
uaucaaccuaaaugaguca

SEQ ID NO: 1091877 - RNA, 21 nt, Homo sapiens
uaugcuucuuggagucuucca

SEQ ID NO: 1091878 - RNA, 15 nt, Homo sapiens
uauggaacauaugca

SEQ ID NO: 1091879 - RNA, 16 nt, Homo sapiens
uauguguacgugugug

SEQ ID NO: 1091880 - RNA, 19 nt, Homo sapiens
uauuccaaguacagaauua

SEQ ID NO: 1091881 - RNA, 23 nt, Homo sapiens
uauuguaaguggaaaaugcaaug

SEQ ID NO: 1091882 - RNA, 21 nt, Homo sapiens
ucaaacacaauuaaaucucuc

SEQ ID NO: 1091883 - RNA, 15 nt, Homo sapiens
ucaaaguucaaaaau

SEQ ID NO: 1091884 - RNA, 16 nt, Homo sapiens
ucaaauaaacacugug

SEQ ID NO: 1091885 - RNA, 15 nt, Homo sapiens
ucaacauacuguuga

SEQ ID NO: 1091886 - RNA, 21 nt, Homo sapiens
ucaacauuuaaucaaucuuug

SEQ ID NO: 1091887 - RNA, 13 nt, Homo sapiens
ucaaucuuuucau

SEQ ID NO: 1091888 - RNA, 13 nt, Homo sapiens
ucacucuugccaa

SEQ ID NO: 1091889 - RNA, 15 nt, Homo sapiens
ucacucuugccaacc

SEQ ID NO: 1091890 - RNA, 16 nt, Homo sapiens
ucacucuugccaaccu

SEQ ID NO: 1091891 - RNA, 19 nt, Homo sapiens
ucacucuugccaaccugua

SEQ ID NO: 1091892 - RNA, 20 nt, Homo sapiens
ucauaauuguugaccuaaga

SEQ ID NO: 1091893 - RNA, 20 nt, Homo sapiens
ucaucacuugugucaaucau

SEQ ID NO: 1091894 - RNA, 15 nt, Homo sapiens
ucauuucaaucuuuu

SEQ ID NO: 1091895 - RNA, 16 nt, Homo sapiens
ucauuucaaucuuuuc

SEQ ID NO: 1091896 - RNA, 18 nt, Homo sapiens
ucuaaauuuuaauugcac

SEQ ID NO: 1091897 - RNA, 13 nt, Homo sapiens
ucucugagcucug

SEQ ID NO: 1091898 - RNA, 14 nt, Homo sapiens
ucugagcucugcau

SEQ ID NO: 1091899 - RNA, 14 nt, Homo sapiens
ucugucccuaccuu

SEQ ID NO: 1091900 - RNA, 14 nt, Homo sapiens
ucuugucaccuuaa

SEQ ID NO: 1091901 - RNA, 14 nt, Homo sapiens
ucuuucaucaauca

SEQ ID NO: 1091902 - RNA, 23 nt, Homo sapiens
ucuuugcagccuggguggcuaug

SEQ ID NO: 1091903 - RNA, 22 nt, Homo sapiens
ugaaaaaccugggcaccuaagc

SEQ ID NO: 1091904 - RNA, 18 nt, Homo sapiens
ugaaugcuauuuucaaau

SEQ ID NO: 1091905 - RNA, 23 nt, Homo sapiens
ugaugauuucuuauuuguaaaau

SEQ ID NO: 1091906 - RNA, 14 nt, Homo sapiens
ugccaaccuguaau

SEQ ID NO: 1091907 - RNA, 21 nt, Homo sapiens
ugccacaucuugaucugcuca

SEQ ID NO: 1091908 - RNA, 22 nt, Homo sapiens
ugccccauuuauccaccuccau

SEQ ID NO: 1091909 - RNA, 23 nt, Homo sapiens
ugccucgggaaccucacucuugc

SEQ ID NO: 1091910 - RNA, 20 nt, Homo sapiens
ugcugugcauaucacuugau

SEQ ID NO: 1091911 - RNA, 20 nt, Homo sapiens
ugcuguguaauaucaaacac

SEQ ID NO: 1091912 - RNA, 13 nt, Homo sapiens
uggaaauccaucc

SEQ ID NO: 1091913 - RNA, 15 nt, Homo sapiens
uggaacauaugcaca

SEQ ID NO: 1091914 - RNA, 16 nt, Homo sapiens
uggaacauaugcacag

SEQ ID NO: 1091915 - RNA, 16 nt, Homo sapiens
uggagccuguguaaca

SEQ ID NO: 1091916 - RNA, 15 nt, Homo sapiens
ugggccccaucauua

SEQ ID NO: 1091917 - RNA, 19 nt, Homo sapiens
cacugcagucugggcccca

SEQ ID NO: 1091918 - RNA, 21 nt, Homo sapiens
cacugcagucugggccccauc

SEQ ID NO: 1091919 - RNA, 13 nt, Homo sapiens
cagcaugauuaua

SEQ ID NO: 1091920 - RNA, 16 nt, Homo sapiens
cagggaaggcugugca

SEQ ID NO: 1091921 - RNA, 12 nt, Homo sapiens
caucuaccuucc

SEQ ID NO: 1091922 - RNA, 13 nt, Homo sapiens
caucuaccuucca

SEQ ID NO: 1091923 - RNA, 17 nt, Homo sapiens
caucuuuguaauacaug

SEQ ID NO: 1091924 - RNA, 15 nt, Homo sapiens
caugcuguguaauau

SEQ ID NO: 1091925 - RNA, 17 nt, Homo sapiens
cauucucaauacuugaa

SEQ ID NO: 1091926 - RNA, 17 nt, Homo sapiens
cauuuauccaccuccau

SEQ ID NO: 1091927 - RNA, 13 nt, Homo sapiens
cauuuucucugau

SEQ ID NO: 1091928 - RNA, 17 nt, Homo sapiens
ccaaccuguaauaaaua

SEQ ID NO: 1091929 - RNA, 16 nt, Homo sapiens
ccacaucuugaucugc

SEQ ID NO: 1091930 - RNA, 19 nt, Homo sapiens
ccacaucuugaucugcuca

SEQ ID NO: 1091931 - RNA, 22 nt, Homo sapiens
ccaccuaaaagagaaugaugcu

SEQ ID NO: 1091932 - RNA, 14 nt, Homo sapiens
ccaucuucuuugca

SEQ ID NO: 1091933 - RNA, 12 nt, Homo sapiens
ccccaucauuaa

SEQ ID NO: 1091934 - RNA, 19 nt, Homo sapiens
ccgucucuggccccucuca

SEQ ID NO: 1091935 - RNA, 18 nt, Homo sapiens
ccuaaagaaauaaucucu

SEQ ID NO: 1091936 - RNA, 23 nt, Homo sapiens
ccucgggaaccucacucuugcca

SEQ ID NO: 1091937 - RNA, 13 nt, Homo sapiens
ccuggaggugcca

SEQ ID NO: 1091938 - RNA, 21 nt, Homo sapiens
ccuggccaucccuucauuuaa

SEQ ID NO: 1091939 - RNA, 14 nt, Homo sapiens
ccuuggaccucucc

SEQ ID NO: 1091940 - RNA, 20 nt, Homo sapiens
cgggaaccucacucuugcca

SEQ ID NO: 1091941 - RNA, 21 nt, Homo sapiens
cgggaaccucacucuugccaa

SEQ ID NO: 1091942 - RNA, 22 nt, Homo sapiens
cguuucacacggacuaaucuuu

SEQ ID NO: 1091943 - RNA, 20 nt, Homo sapiens
cuaagaauauaauacauuug

SEQ ID NO: 1091944 - RNA, 22 nt, Homo sapiens
cuauccauaguggacauuguug

SEQ ID NO: 1091945 - RNA, 13 nt, Homo sapiens
cucaauacuugaa

SEQ ID NO: 1091946 - RNA, 14 nt, Homo sapiens
cucacucuugccaa

SEQ ID NO: 1091947 - RNA, 15 nt, Homo sapiens
cucacucuugccaac

SEQ ID NO: 1091948 - RNA, 23 nt, Homo sapiens
cucacucuugccaaccuguaaua

SEQ ID NO: 1091949 - RNA, 20 nt, Homo sapiens
cucagcccuggaggugccag

SEQ ID NO: 1091950 - RNA, 17 nt, Homo sapiens
cucaggcugugcuuacc

SEQ ID NO: 1091951 - RNA, 21 nt, Homo sapiens
cucccaugugugaugcugaca

SEQ ID NO: 1091952 - RNA, 22 nt, Homo sapiens
cuccuggccaucccuucauuua

SEQ ID NO: 1091953 - RNA, 14 nt, Homo sapiens
cucugaugauguca

SEQ ID NO: 1091954 - RNA, 17 nt, Homo sapiens
cucuugccaaccuguaa

SEQ ID NO: 1091955 - RNA, 17 nt, Homo sapiens
cugaaucagaaauguaa

SEQ ID NO: 1091956 - RNA, 22 nt, Homo sapiens
cugcauuugucuauucuccagc

SEQ ID NO: 1091957 - RNA, 15 nt, Homo sapiens
cugcucaacauuuaa

SEQ ID NO: 1091958 - RNA, 19 nt, Homo sapiens
cuggagccuguguaacagc

SEQ ID NO: 1091959 - RNA, 20 nt, Homo sapiens
cuggccaucccuucauuuaa

SEQ ID NO: 1091960 - RNA, 19 nt, Homo sapiens
cugggcauucucaauacuu

SEQ ID NO: 1091961 - RNA, 16 nt, Homo sapiens
cuguaauaaauaugag

SEQ ID NO: 1091962 - RNA, 23 nt, Homo sapiens
cuguguaauaucaaacacaauua

SEQ ID NO: 1091963 - RNA, 19 nt, Homo sapiens
cuuauuuguaaaaugcaga

SEQ ID NO: 1091964 - RNA, 21 nt, Homo sapiens
cuuccaaaccaccuucccuca

SEQ ID NO: 1091965 - RNA, 16 nt, Homo sapiens
aaguggaaaaugcaau

SEQ ID NO: 1091966 - RNA, 24 nt, Homo sapiens
aauaaaacuauuuaaaauuggcac

SEQ ID NO: 1091967 - RNA, 23 nt, Homo sapiens
aauaaucucuauguagaaaucuc

SEQ ID NO: 1091968 - RNA, 20 nt, Homo sapiens
aauauauauauccucuguau

SEQ ID NO: 1091969 - RNA, 18 nt, Homo sapiens
aaucuuucugaacuguaa

SEQ ID NO: 1091970 - RNA, 16 nt, Homo sapiens
aaugcaaugucuuaaa

SEQ ID NO: 1091971 - RNA, 20 nt, Homo sapiens
aauucuguggcaguuuuaaa

SEQ ID NO: 1091972 - RNA, 19 nt, Homo sapiens
aauugcaccugaaaaaccu

SEQ ID NO: 1091973 - RNA, 15 nt, Homo sapiens
aauuuguuugugcuu

SEQ ID NO: 1091974 - RNA, 13 nt, Homo sapiens
acaucuggcucaa

SEQ ID NO: 1091975 - RNA, 14 nt, Homo sapiens
accaagcuauucaa

SEQ ID NO: 1091976 - RNA, 17 nt, Homo sapiens
accaauaccuacugaau

SEQ ID NO: 1091977 - RNA, 17 nt, Homo sapiens
accagagcaaaguguaa

SEQ ID NO: 1091978 - RNA, 18 nt, Homo sapiens
accaugaaaaugaaugcu

SEQ ID NO: 1091979 - RNA, 22 nt, Homo sapiens
accuacugaaucagaaauguaa

SEQ ID NO: 1091980 - RNA, 15 nt, Homo sapiens
accucacucuugcca

SEQ ID NO: 1091981 - RNA, 16 nt, Homo sapiens
accucacucuugccaa

SEQ ID NO: 1091982 - RNA, 23 nt, Homo sapiens
accucacucuugccaaccuguaa

SEQ ID NO: 1091983 - RNA, 14 nt, Homo sapiens
acgcugucucugac

SEQ ID NO: 1091984 - RNA, 21 nt, Homo sapiens
acucccucgucgagcuggaug

SEQ ID NO: 1091985 - RNA, 18 nt, Homo sapiens
acucuugccaaccuguaa

SEQ ID NO: 1091986 - RNA, 19 nt, Homo sapiens
acucuugccaaccuguaau

SEQ ID NO: 1091987 - RNA, 22 nt, Homo sapiens
acugccucgggaaccucacucu

SEQ ID NO: 1091988 - RNA, 21 nt, Homo sapiens
acuguugaugucuaaguaugc

SEQ ID NO: 1091989 - RNA, 21 nt, Homo sapiens
acuugauaugugcaccaauac

SEQ ID NO: 1091990 - RNA, 17 nt, Homo sapiens
agaacaacaacaaaaua

SEQ ID NO: 1091991 - RNA, 15 nt, Homo sapiens
agcuaucugcaccuc

SEQ ID NO: 1091992 - RNA, 16 nt, Homo sapiens
aggcacacacugugcu

SEQ ID NO: 1091993 - RNA, 10 nt, Homo sapiens
aggcugugcu

SEQ ID NO: 1091994 - RNA, 15 nt, Homo sapiens
aguaacaacaaaaua

SEQ ID NO: 1091995 - RNA, 19 nt, Homo sapiens
aguaccgccucugucccua

SEQ ID NO: 1091996 - RNA, 12 nt, Homo sapiens
aguaugccucag

SEQ ID NO: 1091997 - RNA, 23 nt, Homo sapiens
agucaaaguucaaaaauauucau

SEQ ID NO: 1091998 - RNA, 14 nt, Homo sapiens
auaaacacugugua

SEQ ID NO: 1091999 - RNA, 20 nt, Homo sapiens
auaaagcaauuuuccuugaa

SEQ ID NO: 1092000 - RNA, 14 nt, Homo sapiens
auaaauaugagugc

SEQ ID NO: 1092001 - RNA, 23 nt, Homo sapiens
auaacauugcacuuuauaaacac

SEQ ID NO: 1092002 - RNA, 19 nt, Homo sapiens
auaagauuuuguuagccaa

SEQ ID NO: 1092003 - RNA, 15 nt, Homo sapiens
auaauuguugaccua

SEQ ID NO: 1092004 - RNA, 17 nt, Homo sapiens
aucaugcuguguaauau

SEQ ID NO: 1092005 - RNA, 24 nt, Homo sapiens
aucucuauguagaaaucucaucuu

SEQ ID NO: 1092006 - RNA, 12 nt, Homo sapiens
aucuucuuugca

SEQ ID NO: 1092007 - RNA, 13 nt, Homo sapiens
aucuucuuugcag

SEQ ID NO: 1092008 - RNA, 17 nt, Homo sapiens
augaaugcuauuuucaa

SEQ ID NO: 1092009 - RNA, 17 nt, Homo sapiens
augacgguauuaugcuu

SEQ ID NO: 1092010 - RNA, 13 nt, Homo sapiens
augugcaccaaua

SEQ ID NO: 1092011 - RNA, 14 nt, Homo sapiens
auuaaacgggcugc

SEQ ID NO: 1092012 - RNA, 19 nt, Homo sapiens
auuaauugagcagcaugau

SEQ ID NO: 1092013 - RNA, 14 nt, Homo sapiens
auuauaagccaaac

SEQ ID NO: 1092014 - RNA, 19 nt, Homo sapiens
auuauacacaucuggcuca

SEQ ID NO: 1092015 - RNA, 16 nt, Homo sapiens
auuccaaguacagaau

SEQ ID NO: 1092016 - RNA, 13 nt, Homo sapiens
auuuauccaccuc

SEQ ID NO: 1092017 - RNA, 14 nt, Homo sapiens
caaauaaacacugu

SEQ ID NO: 1092018 - RNA, 15 nt, Homo sapiens
caaauaaacacugug

SEQ ID NO: 1092019 - RNA, 14 nt, Homo sapiens
caaauuauguggau

SEQ ID NO: 1092020 - RNA, 22 nt, Homo sapiens
caaguauuccuaugccagagca

SEQ ID NO: 1092021 - RNA, 23 nt, Homo sapiens
caaucuuugugccucaacauacu

SEQ ID NO: 1092022 - RNA, 12 nt, Homo sapiens
cacacacugugc

SEQ ID NO: 1092023 - RNA, 21 nt, Homo sapiens
cacacauuuaaaacauuugaa

SEQ ID NO: 1092024 - RNA, 21 nt, Homo sapiens
cacucuugccaaccuguaaua

SEQ ID NO: 1092025 - RNA, 18 nt, Homo sapiens
cagagcagugccaacucu

SEQ ID NO: 1092026 - RNA, 15 nt, Homo sapiens
caggcacacacugug

SEQ ID NO: 1092027 - RNA, 12 nt, Homo sapiens
caggcugugcuu

SEQ ID NO: 1092028 - RNA, 13 nt, Homo sapiens
cagggacgucuca

SEQ ID NO: 1092029 - RNA, 22 nt, Homo sapiens
cagucugggccccaucauuaaa

SEQ ID NO: 1092030 - RNA, 20 nt, Homo sapiens
cauaucacuugauaugugca

SEQ ID NO: 1092031 - RNA, 20 nt, Homo sapiens
cauccagaggccauguucca

SEQ ID NO: 1092032 - RNA, 13 nt, Homo sapiens
caucucccaugug

SEQ ID NO: 1092033 - RNA, 14 nt, Homo sapiens
caucuucuuugcag

SEQ ID NO: 1092034 - RNA, 14 nt, Homo sapiens
cauguacauacugu

SEQ ID NO: 1092035 - RNA, 14 nt, Homo sapiens
cauugcacuuuaua

SEQ ID NO: 1092036 - RNA, 23 nt, Homo sapiens
cauuguacaguuuguuuacacac

SEQ ID NO: 1092037 - RNA, 19 nt, Homo sapiens
cauuguuccacacauuuaa

SEQ ID NO: 1092038 - RNA, 15 nt, Homo sapiens
cauuugcuagugaca

SEQ ID NO: 1092039 - RNA, 13 nt, Homo sapiens
ccaaccuguaaua

SEQ ID NO: 1092040 - RNA, 14 nt, Homo sapiens
ccacagcaaaaagu

SEQ ID NO: 1092041 - RNA, 19 nt, Homo sapiens
aauauaaaagaucuugcag

SEQ ID NO: 1092042 - RNA, 22 nt, Homo sapiens
aauaucuacagcuucuauucau

SEQ ID NO: 1092043 - RNA, 19 nt, Homo sapiens
aauauuccuggcauaccuu

SEQ ID NO: 1092044 - RNA, 19 nt, Homo sapiens
aauauuuuaucuuuuagcu

SEQ ID NO: 1092045 - RNA, 17 nt, Homo sapiens
aauccgaaaucagcagg

SEQ ID NO: 1092046 - RNA, 13 nt, Homo sapiens
aaugaguguuaua

SEQ ID NO: 1092047 - RNA, 21 nt, Homo sapiens
aaugauacaguugcauguuau

SEQ ID NO: 1092048 - RNA, 19 nt, Homo sapiens
aaugauaccuacauucuaa

SEQ ID NO: 1092049 - RNA, 21 nt, Homo sapiens
aaugcauccagcaguacaaua

SEQ ID NO: 1092050 - RNA, 18 nt, Homo sapiens
aaugccacauacuugcag

SEQ ID NO: 1092051 - RNA, 19 nt, Homo sapiens
aauguauaguuagcuuuau

SEQ ID NO: 1092052 - RNA, 23 nt, Homo sapiens
aaugucuaguucuuacccaguua

SEQ ID NO: 1092053 - RNA, 13 nt, Homo sapiens
aauguuaaauuca

SEQ ID NO: 1092054 - RNA, 18 nt, Homo sapiens
aauguuaagauuuaucug

SEQ ID NO: 1092055 - RNA, 15 nt, Homo sapiens
aauguuauagcugca

SEQ ID NO: 1092056 - RNA, 17 nt, Homo sapiens
aauuaccuuuaaugcaa

SEQ ID NO: 1092057 - RNA, 17 nt, Homo sapiens
aauuaggauaacuaaaa

SEQ ID NO: 1092058 - RNA, 16 nt, Homo sapiens
aauuauaagagacuua

SEQ ID NO: 1092059 - RNA, 20 nt, Homo sapiens
aauuauaagagacuuaucuu

SEQ ID NO: 1092060 - RNA, 23 nt, Homo sapiens
aauucacucacuggaaucguggc

SEQ ID NO: 1092061 - RNA, 15 nt, Homo sapiens
aauuccccuacauca

SEQ ID NO: 1092062 - RNA, 18 nt, Homo sapiens
aauuccccuacaucaaau

SEQ ID NO: 1092063 - RNA, 20 nt, Homo sapiens
aauucguucaccuacauuug

SEQ ID NO: 1092064 - RNA, 19 nt, Homo sapiens
aauucugaccuuacaaaag

SEQ ID NO: 1092065 - RNA, 18 nt, Homo sapiens
aauucuggacacauuauu

SEQ ID NO: 1092066 - RNA, 14 nt, Homo sapiens
aauuuaccucucau

SEQ ID NO: 1092067 - RNA, 12 nt, Homo sapiens
aauuucacccau

SEQ ID NO: 1092068 - RNA, 15 nt, Homo sapiens
aauuuuacauauguc

SEQ ID NO: 1092069 - RNA, 17 nt, Homo sapiens
aauuuugauagucugaa

SEQ ID NO: 1092070 - RNA, 21 nt, Homo sapiens
acaaaauagcacauccaccaa

SEQ ID NO: 1092071 - RNA, 17 nt, Homo sapiens
aggacacaacccgucag

SEQ ID NO: 1092072 - RNA, 11 nt, Homo sapiens
aggacagcagu

SEQ ID NO: 1092073 - RNA, 17 nt, Homo sapiens
aggacccauaugggaau

SEQ ID NO: 1092074 - RNA, 20 nt, Homo sapiens
aggagaggcgcugaguggaa

SEQ ID NO: 1092075 - RNA, 21 nt, Homo sapiens
aggagucccugccaucauguu

SEQ ID NO: 1092076 - RNA, 18 nt, Homo sapiens
aggaugguucccuugaug

SEQ ID NO: 1092077 - RNA, 13 nt, Homo sapiens
aggcauucuugaa

SEQ ID NO: 1092078 - RNA, 15 nt, Homo sapiens
aggccauugucccug

SEQ ID NO: 1092079 - RNA, 20 nt, Homo sapiens
aggcgggaggaucacuugag

SEQ ID NO: 1092080 - RNA, 20 nt, Homo sapiens
aggcuggugguaacuuuuga

SEQ ID NO: 1092081 - RNA, 13 nt, Homo sapiens
agggaggggagca

SEQ ID NO: 1092082 - RNA, 18 nt, Homo sapiens
agggauuuggggcucaga

SEQ ID NO: 1092083 - RNA, 14 nt, Homo sapiens
aggggucauucaug

SEQ ID NO: 1092084 - RNA, 14 nt, Homo sapiens
agggugacuaugga

SEQ ID NO: 1092085 - RNA, 23 nt, Homo sapiens
agguaaguguaugaucuuaggga

SEQ ID NO: 1092086 - RNA, 19 nt, Homo sapiens
agguacauaagcuucucaa

SEQ ID NO: 1092087 - RNA, 20 nt, Homo sapiens
agguguucuucauuaccuca

SEQ ID NO: 1092088 - RNA, 18 nt, Homo sapiens
agguuggcaaacgggcuu

SEQ ID NO: 1092089 - RNA, 12 nt, Homo sapiens
aguaaaccacaa

SEQ ID NO: 1092090 - RNA, 20 nt, Homo sapiens
aguacaauauuucaguauug

SEQ ID NO: 1092091 - RNA, 20 nt, Homo sapiens
aguacauggcauugagacau

SEQ ID NO: 1092092 - RNA, 21 nt, Homo sapiens
aguauugagcuuugcauuuau

SEQ ID NO: 1092093 - RNA, 22 nt, Homo sapiens
agucaggaaagagaacuuccag

SEQ ID NO: 1092094 - RNA, 14 nt, Homo sapiens
agucucagcuacuu

SEQ ID NO: 1092095 - RNA, 21 nt, Homo sapiens
agucugaacacaagcauuuca

SEQ ID NO: 1092096 - RNA, 21 nt, Homo sapiens
agucuuucguuuccagccuuu

SEQ ID NO: 1092097 - RNA, 15 nt, Homo sapiens
agugcuauuguagag

SEQ ID NO: 1092098 - RNA, 17 nt, Homo sapiens
aguuaaaacagcuauuu

SEQ ID NO: 1092099 - RNA, 21 nt, Homo sapiens
aguuaaaauucuggacacauu

SEQ ID NO: 1092100 - RNA, 21 nt, Homo sapiens
aguuaagagaaagucaccugc

SEQ ID NO: 1092101 - RNA, 17 nt, Homo sapiens
aguuacucucaggcaug

SEQ ID NO: 1092102 - RNA, 13 nt, Homo sapiens
aguuagcuuuauu

SEQ ID NO: 1092103 - RNA, 23 nt, Homo sapiens
aguuauugcugcauaaauuugua

SEQ ID NO: 1092104 - RNA, 20 nt, Homo sapiens
aguucacauuaacucaggca

SEQ ID NO: 1092105 - RNA, 13 nt, Homo sapiens
aguuguauaaaag

SEQ ID NO: 1092106 - RNA, 16 nt, Homo sapiens
aguuuaaagcggcuuu

SEQ ID NO: 1092107 - RNA, 23 nt, Homo sapiens
aguuuagaaccuacaaaagcuug

SEQ ID NO: 1092108 - RNA, 19 nt, Homo sapiens
aguuucauuuacaauuuca

SEQ ID NO: 1092109 - RNA, 18 nt, Homo sapiens
auaaaagaucuugcagaa

SEQ ID NO: 1092110 - RNA, 20 nt, Homo sapiens
auaaaauguuuuuaaacagu

SEQ ID NO: 1092111 - RNA, 19 nt, Homo sapiens
auaaaauuggauuacagua

SEQ ID NO: 1092112 - RNA, 16 nt, Homo sapiens
auaaacagauacauuc

SEQ ID NO: 1092113 - RNA, 19 nt, Homo sapiens
auaaaguacuaaaucucac

SEQ ID NO: 1092114 - RNA, 15 nt, Homo sapiens
auaaauagauuuagu

SEQ ID NO: 1092115 - RNA, 17 nt, Homo sapiens
auaaaugagaccccuuu

SEQ ID NO: 1092116 - RNA, 19 nt, Homo sapiens
auaaauguuauagcugcau

SEQ ID NO: 1092117 - RNA, 19 nt, Homo sapiens
auaaauguuuuauuucuag

SEQ ID NO: 1092118 - RNA, 23 nt, Homo sapiens
auaacuucagugcaagagacuuu

SEQ ID NO: 1092119 - RNA, 15 nt, Homo sapiens
auaaucuuucacagg

SEQ ID NO: 1092120 - RNA, 19 nt, Homo sapiens
auacaaaugggaauucacu

SEQ ID NO: 1092121 - RNA, 22 nt, Homo sapiens
auacaaaugggaauucacucac

SEQ ID NO: 1092122 - RNA, 15 nt, Homo sapiens
auacaauauauagcu

SEQ ID NO: 1092123 - RNA, 18 nt, Homo sapiens
auaccaggaccaguuuau

SEQ ID NO: 1092124 - RNA, 18 nt, Homo sapiens
auaccaugcaauaauaca

SEQ ID NO: 1092125 - RNA, 20 nt, Homo sapiens
auaccuggcccugugccuug

SEQ ID NO: 1092126 - RNA, 15 nt, Homo sapiens
auagcaccuccacau

SEQ ID NO: 1092127 - RNA, 12 nt, Homo sapiens
auagcugcauuu

SEQ ID NO: 1092128 - RNA, 17 nt, Homo sapiens
auaggcuaaccacuuua

SEQ ID NO: 1092129 - RNA, 22 nt, Homo sapiens
auaggcugggccagguggcucc

SEQ ID NO: 1092130 - RNA, 15 nt, Homo sapiens
auaguuagcuuuauu

SEQ ID NO: 1092131 - RNA, 13 nt, Homo sapiens
auaguucuguuaa

SEQ ID NO: 1092132 - RNA, 17 nt, Homo sapiens
auauauggcauuugcag

SEQ ID NO: 1092133 - RNA, 18 nt, Homo sapiens
auauauggcauuugcaga

SEQ ID NO: 1092134 - RNA, 20 nt, Homo sapiens
auauauggcauuugcagauu

SEQ ID NO: 1092135 - RNA, 22 nt, Homo sapiens
auaugcaggacagcaguacuca

SEQ ID NO: 1092136 - RNA, 23 nt, Homo sapiens
auauuguuugcuaagcauuccaa

SEQ ID NO: 1092137 - RNA, 14 nt, Homo sapiens
aucaaaugcucaag

SEQ ID NO: 1092138 - RNA, 21 nt, Homo sapiens
aucaaggcaggagaugcagca

SEQ ID NO: 1092139 - RNA, 17 nt, Homo sapiens
aucaggggauacaggcc

SEQ ID NO: 1092140 - RNA, 18 nt, Homo sapiens
auccuucuggcuguagau

SEQ ID NO: 1092141 - RNA, 23 nt, Homo sapiens
aucuaaugacaugccuauaugag

SEQ ID NO: 1092142 - RNA, 17 nt, Homo sapiens
aucuauugauaguuuca

SEQ ID NO: 1092143 - RNA, 22 nt, Homo sapiens
aucuauugauaguuucauuuac

SEQ ID NO: 1092144 - RNA, 15 nt, Homo sapiens
aucugugcagggcug

SEQ ID NO: 1092145 - RNA, 19 nt, Homo sapiens
aucuuagggaacuuugaua

SEQ ID NO: 1092146 - RNA, 16 nt, Homo sapiens
aucuucauagcccaaa

SEQ ID NO: 1092147 - RNA, 15 nt, Homo sapiens
augacauagcacuug

SEQ ID NO: 1092148 - RNA, 16 nt, Homo sapiens
augacauagcacuugc

SEQ ID NO: 1092149 - RNA, 16 nt, Homo sapiens
augagagacacacuga

SEQ ID NO: 1092150 - RNA, 23 nt, Homo sapiens
augagcuggggaugucucucaug

SEQ ID NO: 1092151 - RNA, 14 nt, Homo sapiens
augauaacuggaaa

SEQ ID NO: 1092152 - RNA, 15 nt, Homo sapiens
augauaacuggaaac

SEQ ID NO: 1092153 - RNA, 23 nt, Homo sapiens
augauuuaauuuuuuaaacugua

SEQ ID NO: 1092154 - RNA, 18 nt, Homo sapiens
augcagggguggggagcg

SEQ ID NO: 1092155 - RNA, 13 nt, Homo sapiens
augcucugaugca

SEQ ID NO: 1092156 - RNA, 19 nt, Homo sapiens
auggcaauaucuacagcuu

SEQ ID NO: 1092157 - RNA, 18 nt, Homo sapiens
auggcuggaacacuguac

SEQ ID NO: 1092158 - RNA, 17 nt, Homo sapiens
auggcuucacacuguuu

SEQ ID NO: 1092159 - RNA, 15 nt, Homo sapiens
auggucuuaugcaca

SEQ ID NO: 1092160 - RNA, 19 nt, Homo sapiens
auguaguuuuauuacacau

SEQ ID NO: 1092161 - RNA, 23 nt, Homo sapiens
augucguaguuacucucaggcau

SEQ ID NO: 1092162 - RNA, 13 nt, Homo sapiens
augucucucauga

SEQ ID NO: 1092163 - RNA, 15 nt, Homo sapiens
auguggaaugcagcc

SEQ ID NO: 1092164 - RNA, 20 nt, Homo sapiens
auuacaaucgagacugcaau

SEQ ID NO: 1092165 - RNA, 13 nt, Homo sapiens
auuacacauuuau

SEQ ID NO: 1092166 - RNA, 12 nt, Homo sapiens
auuauucccaug

SEQ ID NO: 1092167 - RNA, 15 nt, Homo sapiens
auuauuuuaugcaca

SEQ ID NO: 1092168 - RNA, 14 nt, Homo sapiens
auucaaaguauuuu

SEQ ID NO: 1092169 - RNA, 13 nt, Homo sapiens
auucacagcaagu

SEQ ID NO: 1092170 - RNA, 16 nt, Homo sapiens
uucuaugugucaucaa

SEQ ID NO: 1092171 - RNA, 19 nt, Homo sapiens
uucuggacauguccaggag

SEQ ID NO: 1092172 - RNA, 23 nt, Homo sapiens
uucugggggaaaaagccauauca

SEQ ID NO: 1092173 - RNA, 19 nt, Homo sapiens
uucugucccccaugcucug

SEQ ID NO: 1092174 - RNA, 12 nt, Homo sapiens
uucuuaagcaag

SEQ ID NO: 1092175 - RNA, 15 nt, Homo sapiens
uucuuacuaaucuga

SEQ ID NO: 1092176 - RNA, 16 nt, Homo sapiens
uucuugaacugcugag

SEQ ID NO: 1092177 - RNA, 18 nt, Homo sapiens
uugagaaaggcacauauu

SEQ ID NO: 1092178 - RNA, 15 nt, Homo sapiens
uugaggccaggacuu

SEQ ID NO: 1092179 - RNA, 13 nt, Homo sapiens
uugcaagccagau

SEQ ID NO: 1092180 - RNA, 13 nt, Homo sapiens
uugccuguagucu

SEQ ID NO: 1092181 - RNA, 20 nt, Homo sapiens
uugccuuauuggcagcucua

SEQ ID NO: 1092182 - RNA, 13 nt, Homo sapiens
uugcuaagcauuc

SEQ ID NO: 1092183 - RNA, 21 nt, Homo sapiens
uugcuauaccacagucuuucg

SEQ ID NO: 1092184 - RNA, 20 nt, Homo sapiens
uugcugucuuggggucccac

SEQ ID NO: 1092185 - RNA, 18 nt, Homo sapiens
uacaguugcauguuauau

SEQ ID NO: 1092186 - RNA, 23 nt, Homo sapiens
uacaguuucuucaugcauuacuu

SEQ ID NO: 1092187 - RNA, 15 nt, Homo sapiens
uacaucaaaugcuca

SEQ ID NO: 1092188 - RNA, 16 nt, Homo sapiens
uacaucaaaugcucaa

SEQ ID NO: 1092189 - RNA, 13 nt, Homo sapiens
uacauucuugcua

SEQ ID NO: 1092190 - RNA, 14 nt, Homo sapiens
uacauucuugcuaa

SEQ ID NO: 1092191 - RNA, 15 nt, Homo sapiens
uaccagcaucuccca

SEQ ID NO: 1092192 - RNA, 23 nt, Homo sapiens
uaccaugucguaguuacucucag

SEQ ID NO: 1092193 - RNA, 16 nt, Homo sapiens
uaccucuaaauuucca

SEQ ID NO: 1092194 - RNA, 19 nt, Homo sapiens
uaccucuuggcugccuugu

SEQ ID NO: 1092195 - RNA, 15 nt, Homo sapiens
uaccuucuaccucuu

SEQ ID NO: 1092196 - RNA, 17 nt, Homo sapiens
uacgacucuuuuccaaa

SEQ ID NO: 1092197 - RNA, 13 nt, Homo sapiens
uacucacagucuu

SEQ ID NO: 1092198 - RNA, 23 nt, Homo sapiens
uacucucaggcauggaugaauaa

SEQ ID NO: 1092199 - RNA, 20 nt, Homo sapiens
uagaaauucuaacuuaaugu

SEQ ID NO: 1092200 - RNA, 14 nt, Homo sapiens
uagaauucccaaga

SEQ ID NO: 1092201 - RNA, 21 nt, Homo sapiens
uagagcaaccagucaaaacca

SEQ ID NO: 1092202 - RNA, 17 nt, Homo sapiens
uagcaauuccccuacau

SEQ ID NO: 1092203 - RNA, 18 nt, Homo sapiens
uagcaauuccccuacauc

SEQ ID NO: 1092204 - RNA, 20 nt, Homo sapiens
uagcaauuccccuacaucaa

SEQ ID NO: 1092205 - RNA, 21 nt, Homo sapiens
uagcaauuccccuacaucaaa

SEQ ID NO: 1092206 - RNA, 11 nt, Homo sapiens
uagcacuugca

SEQ ID NO: 1092207 - RNA, 12 nt, Homo sapiens
uagcacuugccg

SEQ ID NO: 1092208 - RNA, 16 nt, Homo sapiens
uagcugcacuguuuau

SEQ ID NO: 1092209 - RNA, 13 nt, Homo sapiens
uagcugcauuugu

SEQ ID NO: 1092210 - RNA, 21 nt, Homo sapiens
uagucagaaacugccauuuga

SEQ ID NO: 1092211 - RNA, 14 nt, Homo sapiens
uaguuagcuuuauu

SEQ ID NO: 1092212 - RNA, 13 nt, Homo sapiens
uaguuauauugaa

SEQ ID NO: 1092213 - RNA, 20 nt, Homo sapiens
uauaaaaacauugaaguauu

SEQ ID NO: 1092214 - RNA, 20 nt, Homo sapiens
uauaaauacaaaucuguaua

SEQ ID NO: 1092215 - RNA, 13 nt, Homo sapiens
uauaaaugucuag

SEQ ID NO: 1092216 - RNA, 17 nt, Homo sapiens
uauaauaaaaagcuuca

SEQ ID NO: 1092217 - RNA, 11 nt, Homo sapiens
uauaauuuuga

SEQ ID NO: 1092218 - RNA, 18 nt, Homo sapiens
uauacaauugucauguau

SEQ ID NO: 1092219 - RNA, 18 nt, Homo sapiens
uauacugugaaguuacau

SEQ ID NO: 1092220 - RNA, 13 nt, Homo sapiens
uauagcugcauuu

SEQ ID NO: 1092221 - RNA, 19 nt, Homo sapiens
uaucagccugugccacgau

SEQ ID NO: 1092222 - RNA, 15 nt, Homo sapiens
uauccagguucuaau

SEQ ID NO: 1092223 - RNA, 16 nt, Homo sapiens
uaucuuaacacugaaa

SEQ ID NO: 1092224 - RNA, 22 nt, Homo sapiens
uaugcaauaaaauuauuugcag

SEQ ID NO: 1092225 - RNA, 22 nt, Homo sapiens
uaugguaggaacugcugggcuu

SEQ ID NO: 1092226 - RNA, 15 nt, Homo sapiens
uaugguucucaggcc

SEQ ID NO: 1092227 - RNA, 22 nt, Homo sapiens
uauguaauuuuauuuacauucu

SEQ ID NO: 1092228 - RNA, 15 nt, Homo sapiens
uauuaccuaaugaaa

SEQ ID NO: 1092229 - RNA, 21 nt, Homo sapiens
uauucacugguuuauuugcag

SEQ ID NO: 1092230 - RNA, 17 nt, Homo sapiens
uauucuuaaaaugcaau

SEQ ID NO: 1092231 - RNA, 19 nt, Homo sapiens
uauucuuaaaaugcaauau

SEQ ID NO: 1092232 - RNA, 12 nt, Homo sapiens
uauugaaugccu

SEQ ID NO: 1092233 - RNA, 15 nt, Homo sapiens
uauuguauugcugcu

SEQ ID NO: 1092234 - RNA, 18 nt, Homo sapiens
uauuuaccuucuaccucu

SEQ ID NO: 1092235 - RNA, 15 nt, Homo sapiens
ucaaggaagucuuca

SEQ ID NO: 1092236 - RNA, 21 nt, Homo sapiens
ucaauaguguccuaugcaaua

SEQ ID NO: 1092237 - RNA, 18 nt, Homo sapiens
ucaaugaguuaccauucu

SEQ ID NO: 1092238 - RNA, 22 nt, Homo sapiens
ucaauguauaguuagcuuuauu

SEQ ID NO: 1092239 - RNA, 12 nt, Homo sapiens
ucacacugaaac

SEQ ID NO: 1092240 - RNA, 20 nt, Homo sapiens
ucacagcaagucacuggcca

SEQ ID NO: 1092241 - RNA, 14 nt, Homo sapiens
ucacauuaacucag

SEQ ID NO: 1092242 - RNA, 21 nt, Homo sapiens
ucaccuacauuugagaauuau

SEQ ID NO: 1092243 - RNA, 14 nt, Homo sapiens
ucaccucauggaau

SEQ ID NO: 1092244 - RNA, 21 nt, Homo sapiens
ucaccugcccaagaaacaccg

SEQ ID NO: 1092245 - RNA, 18 nt, Homo sapiens
ucacuacucucuacucug

SEQ ID NO: 1092246 - RNA, 13 nt, Homo sapiens
ucacuagucuuug

SEQ ID NO: 1092247 - RNA, 14 nt, Homo sapiens
ucagaucauuauca

SEQ ID NO: 1092248 - RNA, 16 nt, Homo sapiens
ucagcaggacgacugu

SEQ ID NO: 1092249 - RNA, 20 nt, Homo sapiens
ucagcugagguucauuacaa

SEQ ID NO: 1092250 - RNA, 13 nt, Homo sapiens
ucaggcauuucau

SEQ ID NO: 1092251 - RNA, 12 nt, Homo sapiens
ucaggcuuucag

SEQ ID NO: 1092252 - RNA, 20 nt, Homo sapiens
ucaggcuuucagcugugcuu

SEQ ID NO: 1092253 - RNA, 18 nt, Homo sapiens
ucagggaagcugccaaag

SEQ ID NO: 1092254 - RNA, 16 nt, Homo sapiens
ucaggggauacaggcc

SEQ ID NO: 1092255 - RNA, 18 nt, Homo sapiens
ucagucuuuaaucugaga

SEQ ID NO: 1092256 - RNA, 24 nt, Homo sapiens
ucagugcaagagacuuugucacuu

SEQ ID NO: 1092257 - RNA, 14 nt, Homo sapiens
ucaugcauuacuua

SEQ ID NO: 1092258 - RNA, 17 nt, Homo sapiens
ucauggaauuggagcuc

SEQ ID NO: 1092259 - RNA, 18 nt, Homo sapiens
uccaagugccacgugaac

SEQ ID NO: 1092260 - RNA, 21 nt, Homo sapiens
uccaaugccacauacuugcag

SEQ ID NO: 1092261 - RNA, 20 nt, Homo sapiens
uccaauucugaccuuacaaa

SEQ ID NO: 1092262 - RNA, 23 nt, Homo sapiens
uccacuauuauagaaauucugaa

SEQ ID NO: 1092263 - RNA, 17 nt, Homo sapiens
uccagauuucuguaaau

SEQ ID NO: 1092264 - RNA, 20 nt, Homo sapiens
uccagguucuaaugugugga

SEQ ID NO: 1092265 - RNA, 15 nt, Homo sapiens
uccauaaaauuggau

SEQ ID NO: 1092266 - RNA, 22 nt, Homo sapiens
uccaucagagaugggaaaacca

SEQ ID NO: 1092267 - RNA, 13 nt, Homo sapiens
uccaugugauaca

SEQ ID NO: 1092268 - RNA, 20 nt, Homo sapiens
uccauuuaaaaaugaucugu

SEQ ID NO: 1092269 - RNA, 20 nt, Homo sapiens
ucccaaaaagaugcuuuaau

SEQ ID NO: 1092270 - RNA, 10 nt, Homo sapiens
ucccaagaag

SEQ ID NO: 1092271 - RNA, 22 nt, Homo sapiens
ucccagcacuuugggaggcaaa

SEQ ID NO: 1092272 - RNA, 14 nt, Homo sapiens
ucccaggagaguac

SEQ ID NO: 1092273 - RNA, 14 nt, Homo sapiens
uccccuacaucaaa

SEQ ID NO: 1092274 - RNA, 15 nt, Homo sapiens
ucccuugagugaggc

SEQ ID NO: 1092275 - RNA, 16 nt, Homo sapiens
ucccuugagugaggca

SEQ ID NO: 1092276 - RNA, 18 nt, Homo sapiens
uccuaaacugaacacaug

SEQ ID NO: 1092277 - RNA, 13 nt, Homo sapiens
uccuaugcaauaa

SEQ ID NO: 1092278 - RNA, 21 nt, Homo sapiens
uccucuccccaugauguuuag

SEQ ID NO: 1092279 - RNA, 22 nt, Homo sapiens
uccugaggaagagggacuguuc

SEQ ID NO: 1092280 - RNA, 20 nt, Homo sapiens
uccugcccacuaaaagaauu

SEQ ID NO: 1092281 - RNA, 17 nt, Homo sapiens
uccuggcauaccuuuaa

SEQ ID NO: 1092282 - RNA, 13 nt, Homo sapiens
uccugucccucau

SEQ ID NO: 1092283 - RNA, 16 nt, Homo sapiens
uccugucccucaucca

SEQ ID NO: 1092284 - RNA, 16 nt, Homo sapiens
uccuuuauacugugaa

SEQ ID NO: 1092285 - RNA, 17 nt, Homo sapiens
uccuuuccccucccuca

SEQ ID NO: 1092286 - RNA, 14 nt, Homo sapiens
uccuuucuuccuug

SEQ ID NO: 1092287 - RNA, 18 nt, Homo sapiens
ucgagucacaaaaauuca

SEQ ID NO: 1092288 - RNA, 19 nt, Homo sapiens
ucguggcucugccuucaaa

SEQ ID NO: 1092289 - RNA, 13 nt, Homo sapiens
ucuaaaccacaaa

SEQ ID NO: 1092290 - RNA, 21 nt, Homo sapiens
ucuaauguguggaaugugcag

SEQ ID NO: 1092291 - RNA, 23 nt, Homo sapiens
ucuaccaaaaaucucaauauuuc

SEQ ID NO: 1092292 - RNA, 16 nt, Homo sapiens
ucucaggcauggauga

SEQ ID NO: 1092293 - RNA, 18 nt, Homo sapiens
ucucaggccugacucuca

SEQ ID NO: 1092294 - RNA, 13 nt, Homo sapiens
aacaaggaugaau

SEQ ID NO: 1092295 - RNA, 21 nt, Homo sapiens
aacaccgagugaggccauagc

SEQ ID NO: 1092296 - RNA, 18 nt, Homo sapiens
aacaguccaaucaguggg

SEQ ID NO: 1092297 - RNA, 23 nt, Homo sapiens
aacagugucauauacaauuguca

SEQ ID NO: 1092298 - RNA, 19 nt, Homo sapiens
aacaguuagcauggcuuca

SEQ ID NO: 1092299 - RNA, 20 nt, Homo sapiens
aacauaaaagagcccaucuu

SEQ ID NO: 1092300 - RNA, 17 nt, Homo sapiens
aacaugcuugcauuaua

SEQ ID NO: 1092301 - RNA, 15 nt, Homo sapiens
aacauuacuaacaau

SEQ ID NO: 1092302 - RNA, 13 nt, Homo sapiens
aacauugccugau

SEQ ID NO: 1092303 - RNA, 21 nt, Homo sapiens
aacauuucuagauacuuuuca

SEQ ID NO: 1092304 - RNA, 15 nt, Homo sapiens
aacucaggcauuuca

SEQ ID NO: 1092305 - RNA, 21 nt, Homo sapiens
aacucagguuuuggcauuaaa

SEQ ID NO: 1092306 - RNA, 15 nt, Homo sapiens
aagaaagacuuauca

SEQ ID NO: 1092307 - RNA, 21 nt, Homo sapiens
aagaaagucuaucuaaugaca

SEQ ID NO: 1092308 - RNA, 22 nt, Homo sapiens
aagaacauucuuauauuuuauc

SEQ ID NO: 1092309 - RNA, 23 nt, Homo sapiens
aagaacugaaaucauacuucuua

SEQ ID NO: 1092310 - RNA, 21 nt, Homo sapiens
aagaauagccuagauaugaau

SEQ ID NO: 1092311 - RNA, 18 nt, Homo sapiens
aagaauguuaagauuuau

SEQ ID NO: 1092312 - RNA, 19 nt, Homo sapiens
aagaauguuaagauuuauc

SEQ ID NO: 1092313 - RNA, 18 nt, Homo sapiens
aagagcccaucuuuguca

SEQ ID NO: 1092314 - RNA, 22 nt, Homo sapiens
aagauauuaagucccuuucaaa

SEQ ID NO: 1092315 - RNA, 21 nt, Homo sapiens
aagaugguaccaccagucuga

SEQ ID NO: 1092316 - RNA, 23 nt, Homo sapiens
aagcccaaauauaaaaacagacu

SEQ ID NO: 1092317 - RNA, 22 nt, Homo sapiens
aagcuauguauuuaaauuauca

SEQ ID NO: 1092318 - RNA, 22 nt, Homo sapiens
aagcuauucuuaugcuguaaca

SEQ ID NO: 1092319 - RNA, 22 nt, Homo sapiens
aagcuuguguaucuugauuaau

SEQ ID NO: 1092320 - RNA, 13 nt, Homo sapiens
aaggaacaaugcc

SEQ ID NO: 1092321 - RNA, 14 nt, Homo sapiens
aaggaauacaauau

SEQ ID NO: 1092322 - RNA, 14 nt, Homo sapiens
aaggagagcauagg

SEQ ID NO: 1092323 - RNA, 13 nt, Homo sapiens
aaggcaguggaaa

SEQ ID NO: 1092324 - RNA, 21 nt, Homo sapiens
aaggccagccauuuuucagua

SEQ ID NO: 1092325 - RNA, 19 nt, Homo sapiens
aagggacaccaagccuugg

SEQ ID NO: 1092326 - RNA, 21 nt, Homo sapiens
aagggccugcccagacaagau

SEQ ID NO: 1092327 - RNA, 15 nt, Homo sapiens
aaggugcaguugaau

SEQ ID NO: 1092328 - RNA, 14 nt, Homo sapiens
aaguauuuuaucuu

SEQ ID NO: 1092329 - RNA, 17 nt, Homo sapiens
aauaaaagcuauuacuu

SEQ ID NO: 1092330 - RNA, 17 nt, Homo sapiens
aauaaaauuauuugcag

SEQ ID NO: 1092331 - RNA, 16 nt, Homo sapiens
aauaaaauuuaacuca

SEQ ID NO: 1092332 - RNA, 14 nt, Homo sapiens
aauaaacuguuaug

SEQ ID NO: 1092333 - RNA, 17 nt, Homo sapiens
aauagccuagauaugaa

SEQ ID NO: 1092334 - RNA, 18 nt, Homo sapiens
aauauauggcauuugcag

SEQ ID NO: 1092335 - RNA, 21 nt, Homo sapiens
aauauugacuuuuuauggcac

SEQ ID NO: 1092336 - RNA, 22 nt, Homo sapiens
aauauuguauugcugcugugcg

SEQ ID NO: 1092337 - RNA, 13 nt, Homo sapiens
aauccaagacaaa

SEQ ID NO: 1092338 - RNA, 15 nt, Homo sapiens
aaucucaauauuuca

SEQ ID NO: 1092339 - RNA, 21 nt, Homo sapiens
aaucucaauauuucagauaau

SEQ ID NO: 1092340 - RNA, 23 nt, Homo sapiens
aaucugagaggccacagugcaau

SEQ ID NO: 1092341 - RNA, 22 nt, Homo sapiens
aaugcuaaacuuggcuguaugu

SEQ ID NO: 1092342 - RNA, 13 nt, Homo sapiens
aaugcucaagccc

SEQ ID NO: 1092343 - RNA, 21 nt, Homo sapiens
aaugcugcaacuuuuuuaugu

SEQ ID NO: 1092344 - RNA, 19 nt, Homo sapiens
aauguacuuuuuauugcau

SEQ ID NO: 1092345 - RNA, 20 nt, Homo sapiens
aauguccaagcuauguauuu

SEQ ID NO: 1092346 - RNA, 13 nt, Homo sapiens
aauguguggaaug

SEQ ID NO: 1092347 - RNA, 14 nt, Homo sapiens
aauguuuauucaaa

SEQ ID NO: 1092348 - RNA, 13 nt, Homo sapiens
aauguuuuauuuc

SEQ ID NO: 1092349 - RNA, 13 nt, Homo sapiens
aauuaaugcucua

SEQ ID NO: 1092350 - RNA, 16 nt, Homo sapiens
aauuccccuacaucaa

SEQ ID NO: 1092351 - RNA, 17 nt, Homo sapiens
aauuccccuacaucaaa

SEQ ID NO: 1092352 - RNA, 15 nt, Homo sapiens
aauugaggacacuga

SEQ ID NO: 1092353 - RNA, 18 nt, Homo sapiens
aauuggagaaaagcacuu

SEQ ID NO: 1092354 - RNA, 16 nt, Homo sapiens
aauuggauuacaguau

SEQ ID NO: 1092355 - RNA, 17 nt, Homo sapiens
aauuggcaguguaacau

SEQ ID NO: 1092356 - RNA, 17 nt, Homo sapiens
aauuguuuaaaaaccga

SEQ ID NO: 1092357 - RNA, 17 nt, Homo sapiens
ucucaugauagaaggcu

SEQ ID NO: 1092358 - RNA, 13 nt, Homo sapiens
ucucauuccagag

SEQ ID NO: 1092359 - RNA, 13 nt, Homo sapiens
ucucuaaacuguu

SEQ ID NO: 1092360 - RNA, 13 nt, Homo sapiens
ucucucaugacca

SEQ ID NO: 1092361 - RNA, 21 nt, Homo sapiens
ucugcagcacccagaacugag

SEQ ID NO: 1092362 - RNA, 16 nt, Homo sapiens
ucuggggcuuugccau

SEQ ID NO: 1092363 - RNA, 23 nt, Homo sapiens
ucugggggaaaaagccauaucau

SEQ ID NO: 1092364 - RNA, 18 nt, Homo sapiens
ucugucccccaugcucug

SEQ ID NO: 1092365 - RNA, 21 nt, Homo sapiens
ucugugaggggcucucucaug

SEQ ID NO: 1092366 - RNA, 16 nt, Homo sapiens
ucuuaaaaugcaauau

SEQ ID NO: 1092367 - RNA, 14 nt, Homo sapiens
ucuuagaugcaguu

SEQ ID NO: 1092368 - RNA, 21 nt, Homo sapiens
ucuuaugcacaggaacuaaag

SEQ ID NO: 1092369 - RNA, 18 nt, Homo sapiens
ucuuguaaacauugccug

SEQ ID NO: 1092370 - RNA, 19 nt, Homo sapiens
ucuuuaaacuuuagaauuc

SEQ ID NO: 1092371 - RNA, 18 nt, Homo sapiens
ucuuuguugaaguauuua

SEQ ID NO: 1092372 - RNA, 21 nt, Homo sapiens
ugaaaaaaaaauuauuugccu

SEQ ID NO: 1092373 - RNA, 12 nt, Homo sapiens
ugaaaauguauc

SEQ ID NO: 1092374 - RNA, 20 nt, Homo sapiens
ugaaaucucuagccucuuug

SEQ ID NO: 1092375 - RNA, 14 nt, Homo sapiens
ugaacuaaguuauu

SEQ ID NO: 1092376 - RNA, 12 nt, Homo sapiens
ugaagcauuuaa

SEQ ID NO: 1092377 - RNA, 15 nt, Homo sapiens
ugaaguuacaugcau

SEQ ID NO: 1092378 - RNA, 13 nt, Homo sapiens
ugacagagcaaua

SEQ ID NO: 1092379 - RNA, 16 nt, Homo sapiens
ugacauacauccaaca

SEQ ID NO: 1092380 - RNA, 16 nt, Homo sapiens
ugacauagcacuugcc

SEQ ID NO: 1092381 - RNA, 18 nt, Homo sapiens
ugacugcaaaaacugggu

SEQ ID NO: 1092382 - RNA, 20 nt, Homo sapiens
ugacugguccuaaucuguaa

SEQ ID NO: 1092383 - RNA, 13 nt, Homo sapiens
ugagacaucuggc

SEQ ID NO: 1092384 - RNA, 18 nt, Homo sapiens
ugagcuggggaugucucu

SEQ ID NO: 1092385 - RNA, 22 nt, Homo sapiens
ugagcuggggaugucucucaug

SEQ ID NO: 1092386 - RNA, 20 nt, Homo sapiens
ugaggaaaagacacccuguc

SEQ ID NO: 1092387 - RNA, 16 nt, Homo sapiens
ugaggccaggacuuug

SEQ ID NO: 1092388 - RNA, 14 nt, Homo sapiens
ugaggccauagcaa

SEQ ID NO: 1092389 - RNA, 13 nt, Homo sapiens
ugaggccucucau

SEQ ID NO: 1092390 - RNA, 16 nt, Homo sapiens
ugaggggcucucucau

SEQ ID NO: 1092391 - RNA, 19 nt, Homo sapiens
ugagggugacuauggagcu

SEQ ID NO: 1092392 - RNA, 19 nt, Homo sapiens
ugauacaguugcauguuau

SEQ ID NO: 1092393 - RNA, 13 nt, Homo sapiens
ugauuaugaauua

SEQ ID NO: 1092394 - RNA, 15 nt, Homo sapiens
ugauuguauuuaccu

SEQ ID NO: 1092395 - RNA, 22 nt, Homo sapiens
ugcaagagacuuugucacuuau

SEQ ID NO: 1092396 - RNA, 19 nt, Homo sapiens
ugcacaaaauagcacaucc

SEQ ID NO: 1092397 - RNA, 13 nt, Homo sapiens
ugcagaccugccu

SEQ ID NO: 1092398 - RNA, 19 nt, Homo sapiens
ugcagggugaaguguacag

SEQ ID NO: 1092399 - RNA, 15 nt, Homo sapiens
ugcaguaauuugcaa

SEQ ID NO: 1092400 - RNA, 22 nt, Homo sapiens
ugcauaccuucgggguacaagu

SEQ ID NO: 1092401 - RNA, 19 nt, Homo sapiens
ugcaucauuaauaccuaaa

SEQ ID NO: 1092402 - RNA, 22 nt, Homo sapiens
ugccaugugcuaguaauuggaa

SEQ ID NO: 1092403 - RNA, 16 nt, Homo sapiens
ugccugucacuacugg

SEQ ID NO: 1092404 - RNA, 23 nt, Homo sapiens
ugcuaaacuuggcuguaugucaa

SEQ ID NO: 1092405 - RNA, 19 nt, Homo sapiens
ugcuacaguuuuuccuaaa

SEQ ID NO: 1092406 - RNA, 22 nt, Homo sapiens
ugcucaagcccccagcuggaag

SEQ ID NO: 1092407 - RNA, 14 nt, Homo sapiens
ugcucugaugcagu

SEQ ID NO: 1092408 - RNA, 13 nt, Homo sapiens
ugcugugcugugu

SEQ ID NO: 1092409 - RNA, 20 nt, Homo sapiens
ugcuguguuuaaucagggga

SEQ ID NO: 1092410 - RNA, 16 nt, Homo sapiens
ugcuuuuuuucaggga

SEQ ID NO: 1092411 - RNA, 17 nt, Homo sapiens
ugcuuuuuuucagggaa

SEQ ID NO: 1092412 - RNA, 17 nt, Homo sapiens
uggaaaggcagcucuaa

SEQ ID NO: 1092413 - RNA, 14 nt, Homo sapiens
uggaauuggagcuc

SEQ ID NO: 1092414 - RNA, 15 nt, Homo sapiens
uggagauagugccag

SEQ ID NO: 1092415 - RNA, 17 nt, Homo sapiens
uggcaagaucauagcuc

SEQ ID NO: 1092416 - RNA, 19 nt, Homo sapiens
uggcacuugccuguagucu

SEQ ID NO: 1092417 - RNA, 14 nt, Homo sapiens
uggcauaccuuuaa

SEQ ID NO: 1092418 - RNA, 16 nt, Homo sapiens
uggcauugagacaucu

SEQ ID NO: 1092419 - RNA, 19 nt, Homo sapiens
uggcccccuauuuugccau

SEQ ID NO: 1092420 - RNA, 14 nt, Homo sapiens
uggcccuaugcuuc

SEQ ID NO: 1092421 - RNA, 22 nt, Homo sapiens
uggccuguucuucuauggguug

SEQ ID NO: 1092422 - RNA, 12 nt, Homo sapiens
uggcugccuugu

SEQ ID NO: 1092423 - RNA, 22 nt, Homo sapiens
ugggacagucaccucauggaau

SEQ ID NO: 1092424 - RNA, 17 nt, Homo sapiens
ugggagaaugucaguau

SEQ ID NO: 1092425 - RNA, 22 nt, Homo sapiens
ugggccacucaggggucauuca

SEQ ID NO: 1092426 - RNA, 18 nt, Homo sapiens
ugggcugaggccagggga

SEQ ID NO: 1092427 - RNA, 17 nt, Homo sapiens
ugggcugaguacaguca

SEQ ID NO: 1092428 - RNA, 19 nt, Homo sapiens
ugggcuuguuucuggcaga

SEQ ID NO: 1092429 - RNA, 16 nt, Homo sapiens
uggggcugaugcaguu

SEQ ID NO: 1092430 - RNA, 17 nt, Homo sapiens
ugguaaaucacacugaa

SEQ ID NO: 1092431 - RNA, 15 nt, Homo sapiens
uggucuguacuccuu

SEQ ID NO: 1092432 - RNA, 20 nt, Homo sapiens
uggugcuacgaccaggguga

SEQ ID NO: 1092433 - RNA, 21 nt, Homo sapiens
uggugcuacgaccagggugag

SEQ ID NO: 1092434 - RNA, 23 nt, Homo sapiens
ugguggaaauauccagguucuaa

SEQ ID NO: 1092435 - RNA, 16 nt, Homo sapiens
ugguguugacauacau

SEQ ID NO: 1092436 - RNA, 23 nt, Homo sapiens
ugguucucaacagacccagugag

SEQ ID NO: 1092437 - RNA, 15 nt, Homo sapiens
ugguuugcagaugau

SEQ ID NO: 1092438 - RNA, 15 nt, Homo sapiens
ugguuuugaauauua

SEQ ID NO: 1092439 - RNA, 23 nt, Homo sapiens
uguaagaaaauaucacuugucaa

SEQ ID NO: 1092440 - RNA, 23 nt, Homo sapiens
uguauauugcucagagcuuuuau

SEQ ID NO: 1092441 - RNA, 15 nt, Homo sapiens
ugucacagcuaccaa

SEQ ID NO: 1092442 - RNA, 14 nt, Homo sapiens
uguccaagugccac

SEQ ID NO: 1092443 - RNA, 20 nt, Homo sapiens
uguccauuuaaaaaugaucu

SEQ ID NO: 1092444 - RNA, 16 nt, Homo sapiens
ugucccagaaugccuc

SEQ ID NO: 1092445 - RNA, 18 nt, Homo sapiens
ugucccagaaugccuccu

SEQ ID NO: 1092446 - RNA, 22 nt, Homo sapiens
ugucccucauccauagcaccuc

SEQ ID NO: 1092447 - RNA, 18 nt, Homo sapiens
ugucuuuguugaaguauu

SEQ ID NO: 1092448 - RNA, 23 nt, Homo sapiens
ugugaaggaauuauucccaugag

SEQ ID NO: 1092449 - RNA, 20 nt, Homo sapiens
ugugauuauuuuaugcacac

SEQ ID NO: 1092450 - RNA, 18 nt, Homo sapiens
ugugcaauugauauugcc

SEQ ID NO: 1092451 - RNA, 17 nt, Homo sapiens
uguggaguuuucaugac

SEQ ID NO: 1092452 - RNA, 14 nt, Homo sapiens
uguguucacuacau

SEQ ID NO: 1092453 - RNA, 21 nt, Homo sapiens
uguguucacuacauugugcaa

SEQ ID NO: 1092454 - RNA, 14 nt, Homo sapiens
uguuaaaacuggga

SEQ ID NO: 1092455 - RNA, 18 nt, Homo sapiens
uguuaccacugguaacau

SEQ ID NO: 1092456 - RNA, 22 nt, Homo sapiens
uguuauaaucuuucacagggga

SEQ ID NO: 1092457 - RNA, 19 nt, Homo sapiens
uguuccuugaaaugcuaaa

SEQ ID NO: 1092458 - RNA, 23 nt, Homo sapiens
uguucuucauuaccucagugaga

SEQ ID NO: 1092459 - RNA, 18 nt, Homo sapiens
uguugcccacagcuguau

SEQ ID NO: 1092460 - RNA, 18 nt, Homo sapiens
uguuuauucaaaguauuu

SEQ ID NO: 1092461 - RNA, 17 nt, Homo sapiens
uguuuccaucaagggua

SEQ ID NO: 1092462 - RNA, 22 nt, Homo sapiens
uguuuucaauguuucacuacuc

SEQ ID NO: 1092463 - RNA, 15 nt, Homo sapiens
uuaaaacugcauuuu

SEQ ID NO: 1092464 - RNA, 20 nt, Homo sapiens
uuaaaagagacaaacuguaa

SEQ ID NO: 1092465 - RNA, 13 nt, Homo sapiens
uuaaagcuauucu

SEQ ID NO: 1092466 - RNA, 21 nt, Homo sapiens
uuaaauauuugaaaauuaccu

SEQ ID NO: 1092467 - RNA, 18 nt, Homo sapiens
uuaauaaguauaucuuaa

SEQ ID NO: 1092468 - RNA, 19 nt, Homo sapiens
uuaauauuguauugcugcu

SEQ ID NO: 1092469 - RNA, 18 nt, Homo sapiens
uuaaucagaguaucugaa

SEQ ID NO: 1092470 - RNA, 16 nt, Homo sapiens
uuaaucucuaguaaaa

SEQ ID NO: 1092471 - RNA, 18 nt, Homo sapiens
uuaaucugagaggccaca

SEQ ID NO: 1092472 - RNA, 14 nt, Homo sapiens
uuaauggcuguaug

SEQ ID NO: 1092473 - RNA, 21 nt, Homo sapiens
uuaauuguuuaaaaaccgaau

SEQ ID NO: 1092474 - RNA, 16 nt, Homo sapiens
cauuugcucauggaau

SEQ ID NO: 1092475 - RNA, 14 nt, Homo sapiens
cauuuguuccauga

SEQ ID NO: 1092476 - RNA, 13 nt, Homo sapiens
ccaaacucaggcu

SEQ ID NO: 1092477 - RNA, 17 nt, Homo sapiens
ccaaacucaggcuuuca

SEQ ID NO: 1092478 - RNA, 23 nt, Homo sapiens
ccaagaagauuccuucuaacuga

SEQ ID NO: 1092479 - RNA, 15 nt, Homo sapiens
ccaaggcaguggaaa

SEQ ID NO: 1092480 - RNA, 16 nt, Homo sapiens
ccaagggaggggagca

SEQ ID NO: 1092481 - RNA, 17 nt, Homo sapiens
ccaagugaggccauagc

SEQ ID NO: 1092482 - RNA, 19 nt, Homo sapiens
ccaagugaggccauagcaa

SEQ ID NO: 1092483 - RNA, 18 nt, Homo sapiens
ccaauaguuucuuguuaa

SEQ ID NO: 1092484 - RNA, 14 nt, Homo sapiens
ccaaucaugaauua

SEQ ID NO: 1092485 - RNA, 12 nt, Homo sapiens
ccacagucuuuc

SEQ ID NO: 1092486 - RNA, 18 nt, Homo sapiens
ccacucaggggucauuca

SEQ ID NO: 1092487 - RNA, 19 nt, Homo sapiens
ccacucaggggucauucau

SEQ ID NO: 1092488 - RNA, 21 nt, Homo sapiens
ccagaagagucaaaguaguua

SEQ ID NO: 1092489 - RNA, 20 nt, Homo sapiens
ccagaggaagggacaccaag

SEQ ID NO: 1092490 - RNA, 12 nt, Homo sapiens
ccagcacuuugg

SEQ ID NO: 1092491 - RNA, 22 nt, Homo sapiens
ccaggaacucgcaccugugcug

SEQ ID NO: 1092492 - RNA, 18 nt, Homo sapiens
ccaggagaguacauggca

SEQ ID NO: 1092493 - RNA, 16 nt, Homo sapiens
ccagucaaaaccagag

SEQ ID NO: 1092494 - RNA, 23 nt, Homo sapiens
ccauaaaauuggauuacaguaug

SEQ ID NO: 1092495 - RNA, 22 nt, Homo sapiens
ccauagcaacuccccuacauca

SEQ ID NO: 1092496 - RNA, 16 nt, Homo sapiens
ccauaucaugcuaaaa

SEQ ID NO: 1092497 - RNA, 16 nt, Homo sapiens
ccaucucuuuaccucc

SEQ ID NO: 1092498 - RNA, 20 nt, Homo sapiens
ccaugucguaguuacucuca

SEQ ID NO: 1092499 - RNA, 21 nt, Homo sapiens
ccauuuagcgaacaaccacag

SEQ ID NO: 1092500 - RNA, 21 nt, Homo sapiens
cccaagauuuuuucauuucaa

SEQ ID NO: 1092501 - RNA, 19 nt, Homo sapiens
cccacuuggcaucauucac

SEQ ID NO: 1092502 - RNA, 18 nt, Homo sapiens
cccagaaugccuccugca

SEQ ID NO: 1092503 - RNA, 20 nt, Homo sapiens
cccagcugacgcgacuauca

SEQ ID NO: 1092504 - RNA, 18 nt, Homo sapiens
cccaugcucugaugcagu

SEQ ID NO: 1092505 - RNA, 18 nt, Homo sapiens
cuugaaugccauagucaa

SEQ ID NO: 1092506 - RNA, 13 nt, Homo sapiens
cuuggccaagaga

SEQ ID NO: 1092507 - RNA, 18 nt, Homo sapiens
cuuggggcugaugcaguu

SEQ ID NO: 1092508 - RNA, 14 nt, Homo sapiens
cuuuauugaagucu

SEQ ID NO: 1092509 - RNA, 14 nt, Homo sapiens
cuuucauaguucug

SEQ ID NO: 1092510 - RNA, 22 nt, Homo sapiens
cuuugcuacgaagaaagacucc

SEQ ID NO: 1092511 - RNA, 12 nt, Homo sapiens
cuuuugcuauac

SEQ ID NO: 1092512 - RNA, 16 nt, Homo sapiens
gaaaaaaaaauuauuu

SEQ ID NO: 1092513 - RNA, 14 nt, Homo sapiens
gaaaaugccaccau

SEQ ID NO: 1092514 - RNA, 17 nt, Homo sapiens
gaaaaugccaccaucca

SEQ ID NO: 1092515 - RNA, 21 nt, Homo sapiens
gaaaaugccaccauccaauaa

SEQ ID NO: 1092516 - RNA, 18 nt, Homo sapiens
gaaauguuuuaaugccag

SEQ ID NO: 1092517 - RNA, 18 nt, Homo sapiens
gaaauuuaaucaguguga

SEQ ID NO: 1092518 - RNA, 22 nt, Homo sapiens
gaacaaugccgccugucaauaa

SEQ ID NO: 1092519 - RNA, 21 nt, Homo sapiens
gaacagcuucauguucccaaa

SEQ ID NO: 1092520 - RNA, 13 nt, Homo sapiens
gaacggggguaca

SEQ ID NO: 1092521 - RNA, 12 nt, Homo sapiens
gaagaacugaaa

SEQ ID NO: 1092522 - RNA, 14 nt, Homo sapiens
gaagaauugccaau

SEQ ID NO: 1092523 - RNA, 18 nt, Homo sapiens
gaagauuuaccacuugug

SEQ ID NO: 1092524 - RNA, 17 nt, Homo sapiens
gaagccagcuuuccuca

SEQ ID NO: 1092525 - RNA, 15 nt, Homo sapiens
gaaggaauuauuccc

SEQ ID NO: 1092526 - RNA, 12 nt, Homo sapiens
gaaggcuuuauu

SEQ ID NO: 1092527 - RNA, 23 nt, Homo sapiens
gaaggugcaguugaauucagugg

SEQ ID NO: 1092528 - RNA, 22 nt, Homo sapiens
gaaguauuaguuacuugcuaua

SEQ ID NO: 1092529 - RNA, 19 nt, Homo sapiens
gaaguuaagagaaagucac

SEQ ID NO: 1092530 - RNA, 15 nt, Homo sapiens
gaaguugauaugccu

SEQ ID NO: 1092531 - RNA, 16 nt, Homo sapiens
gaauaaauguuuuauu

SEQ ID NO: 1092532 - RNA, 23 nt, Homo sapiens
gaauauauggcauuugcagauuu

SEQ ID NO: 1092533 - RNA, 16 nt, Homo sapiens
gaaugauugcuuuuaa

SEQ ID NO: 1092534 - RNA, 15 nt, Homo sapiens
gacaaggucuugcua

SEQ ID NO: 1092535 - RNA, 12 nt, Homo sapiens
gacagagacgca

SEQ ID NO: 1092536 - RNA, 17 nt, Homo sapiens
gacaggucauccuugcc

SEQ ID NO: 1092537 - RNA, 13 nt, Homo sapiens
gacagucaccuca

SEQ ID NO: 1092538 - RNA, 20 nt, Homo sapiens
gacagugcccagagugacag

SEQ ID NO: 1092539 - RNA, 20 nt, Homo sapiens
gacauaacugguuugacucu

SEQ ID NO: 1092540 - RNA, 13 nt, Homo sapiens
gacauagcacuug

SEQ ID NO: 1092541 - RNA, 14 nt, Homo sapiens
gacauagcacuugc

SEQ ID NO: 1092542 - RNA, 15 nt, Homo sapiens
gacaugggacauuug

SEQ ID NO: 1092543 - RNA, 17 nt, Homo sapiens
gacauuccucuaggacu

SEQ ID NO: 1092544 - RNA, 22 nt, Homo sapiens
gaccugccugaacgcacaugac

SEQ ID NO: 1092545 - RNA, 22 nt, Homo sapiens
gacguggccccugcccacucac

SEQ ID NO: 1092546 - RNA, 12 nt, Homo sapiens
gacuaugcacua

SEQ ID NO: 1092547 - RNA, 16 nt, Homo sapiens
gacucuuuuccaaaca

SEQ ID NO: 1092548 - RNA, 13 nt, Homo sapiens
gacuguuuuccca

SEQ ID NO: 1092549 - RNA, 20 nt, Homo sapiens
gagaagccagcuuuccucau

SEQ ID NO: 1092550 - RNA, 16 nt, Homo sapiens
gagagagccacggaga

SEQ ID NO: 1092551 - RNA, 19 nt, Homo sapiens
gagaggccacagugcaauu

SEQ ID NO: 1092552 - RNA, 21 nt, Homo sapiens
gagcaucagauuuuaccuaau

SEQ ID NO: 1092553 - RNA, 16 nt, Homo sapiens
gagcccuuuugcuaua

SEQ ID NO: 1092554 - RNA, 15 nt, Homo sapiens
gagccugcuaaggaa

SEQ ID NO: 1092555 - RNA, 21 nt, Homo sapiens
gagcgagaacccucaacugac

SEQ ID NO: 1092556 - RNA, 12 nt, Homo sapiens
gaggaagggaca

SEQ ID NO: 1092557 - RNA, 16 nt, Homo sapiens
gaggccucucauucca

SEQ ID NO: 1092558 - RNA, 17 nt, Homo sapiens
gaggcucuguauuugcu

SEQ ID NO: 1092559 - RNA, 20 nt, Homo sapiens
gaguccagcacccagguaaa

SEQ ID NO: 1092560 - RNA, 23 nt, Homo sapiens
gauacuccgcugucggcacauuc

SEQ ID NO: 1092561 - RNA, 23 nt, Homo sapiens
gauaguaguuaggauaacuaaaa

SEQ ID NO: 1092562 - RNA, 22 nt, Homo sapiens
gauauuuugauucucauugcca

SEQ ID NO: 1092563 - RNA, 18 nt, Homo sapiens
gauggcuggaacacugua

SEQ ID NO: 1092564 - RNA, 17 nt, Homo sapiens
gauguaaagaauggaag

SEQ ID NO: 1092565 - RNA, 20 nt, Homo sapiens
gauguccaagugccacguga

SEQ ID NO: 1092566 - RNA, 22 nt, Homo sapiens
gauuaaguaaugauaacuggaa

SEQ ID NO: 1092567 - RNA, 21 nt, Homo sapiens
gauuauuuuaugcacaccuaa

SEQ ID NO: 1092568 - RNA, 15 nt, Homo sapiens
gauucacacccagcu

SEQ ID NO: 1092569 - RNA, 18 nt, Homo sapiens
gauucuuuaaacuacuga

SEQ ID NO: 1092570 - RNA, 14 nt, Homo sapiens
gauuuaauucacau

SEQ ID NO: 1092571 - RNA, 21 nt, Homo sapiens
gauuuccuuuauacugugaag

SEQ ID NO: 1092572 - RNA, 22 nt, Homo sapiens
gcaaaaacuggguaaugcaacu

SEQ ID NO: 1092573 - RNA, 18 nt, Homo sapiens
gcaacauaauaagacuuu

SEQ ID NO: 1092574 - RNA, 15 nt, Homo sapiens
gcaagcguuauuuug

SEQ ID NO: 1092575 - RNA, 21 nt, Homo sapiens
gcaaggcaggggcacgguggu

SEQ ID NO: 1092576 - RNA, 18 nt, Homo sapiens
gcaauaauuaacugcuuc

SEQ ID NO: 1092577 - RNA, 20 nt, Homo sapiens
gcaaugaauuaguugcauug

SEQ ID NO: 1092578 - RNA, 19 nt, Homo sapiens
gcaauuccccuacaucaaa

SEQ ID NO: 1092579 - RNA, 23 nt, Homo sapiens
gcacagccucuuagaugcaguuc

SEQ ID NO: 1092580 - RNA, 14 nt, Homo sapiens
uccagaaagugaca

SEQ ID NO: 1092581 - RNA, 19 nt, Homo sapiens
uccagaaauuuaccacaaa

SEQ ID NO: 1092582 - RNA, 21 nt, Homo sapiens
uccaggauaccagcaaaugga

SEQ ID NO: 1092583 - RNA, 14 nt, Homo sapiens
uccaggauguggaa

SEQ ID NO: 1092584 - RNA, 22 nt, Homo sapiens
uccauauccuucuggcuguaga

SEQ ID NO: 1092585 - RNA, 20 nt, Homo sapiens
uccauccauggggcugauug

SEQ ID NO: 1092586 - RNA, 21 nt, Homo sapiens
uccaucuauugauaguuucau

SEQ ID NO: 1092587 - RNA, 17 nt, Homo sapiens
uccauugguguugacau

SEQ ID NO: 1092588 - RNA, 21 nt, Homo sapiens
ucccaacacggguaaaucuag

SEQ ID NO: 1092589 - RNA, 16 nt, Homo sapiens
ucccauucuauguguc

SEQ ID NO: 1092590 - RNA, 13 nt, Homo sapiens
uccccagccuggg

SEQ ID NO: 1092591 - RNA, 12 nt, Homo sapiens
uccccuacauca

SEQ ID NO: 1092592 - RNA, 22 nt, Homo sapiens
uccccuacaucaaaugcucaag

SEQ ID NO: 1092593 - RNA, 11 nt, Homo sapiens
ucccucaggcc

SEQ ID NO: 1092594 - RNA, 14 nt, Homo sapiens
ucccucauccauag

SEQ ID NO: 1092595 - RNA, 18 nt, Homo sapiens
ucccugaagagaagggca

SEQ ID NO: 1092596 - RNA, 20 nt, Homo sapiens
uccgcugucggcacauucag

SEQ ID NO: 1092597 - RNA, 20 nt, Homo sapiens
uccggccuccugucccucau

SEQ ID NO: 1092598 - RNA, 16 nt, Homo sapiens
uccuacuuauugccau

SEQ ID NO: 1092599 - RNA, 20 nt, Homo sapiens
uccuacuuauugccaugugg

SEQ ID NO: 1092600 - RNA, 22 nt, Homo sapiens
uccucaaagggagagagugcua

SEQ ID NO: 1092601 - RNA, 17 nt, Homo sapiens
uccucagaucauuauca

SEQ ID NO: 1092602 - RNA, 22 nt, Homo sapiens
uccucaggacccucccaggaga

SEQ ID NO: 1092603 - RNA, 23 nt, Homo sapiens
uccugccugagaauguuaccaga

SEQ ID NO: 1092604 - RNA, 19 nt, Homo sapiens
uccugucccucauccauag

SEQ ID NO: 1092605 - RNA, 22 nt, Homo sapiens
uccuucuggggcuuugccauua

SEQ ID NO: 1092606 - RNA, 14 nt, Homo sapiens
uccuuuauacugug

SEQ ID NO: 1092607 - RNA, 18 nt, Homo sapiens
uccuuuccccucccucag

SEQ ID NO: 1092608 - RNA, 13 nt, Homo sapiens
ucgagacugaaag

SEQ ID NO: 1092609 - RNA, 15 nt, Homo sapiens
ucgagacugcaaugu

SEQ ID NO: 1092610 - RNA, 17 nt, Homo sapiens
ucggguccaccaugagg

SEQ ID NO: 1092611 - RNA, 15 nt, Homo sapiens
ucguaguuacucuca

SEQ ID NO: 1092612 - RNA, 16 nt, Homo sapiens
ucuaauguguggaaug

SEQ ID NO: 1092613 - RNA, 14 nt, Homo sapiens
ucuauuaguuucaa

SEQ ID NO: 1092614 - RNA, 23 nt, Homo sapiens
ucucaacuccaaacugacucuua

SEQ ID NO: 1092615 - RNA, 13 nt, Homo sapiens
ucucaaugaguca

SEQ ID NO: 1092616 - RNA, 18 nt, Homo sapiens
ucuccugggccguuacau

SEQ ID NO: 1092617 - RNA, 12 nt, Homo sapiens
ucucuacuuuaa

SEQ ID NO: 1092618 - RNA, 24 nt, Homo sapiens
ucucuaguaguuaaaacagcuauu

SEQ ID NO: 1092619 - RNA, 20 nt, Homo sapiens
ucugaauuguucuaaaugga

SEQ ID NO: 1092620 - RNA, 22 nt, Homo sapiens
ucugacacauaucauucuguga

SEQ ID NO: 1092621 - RNA, 18 nt, Homo sapiens
ucugcuuuuuuucaggga

SEQ ID NO: 1092622 - RNA, 23 nt, Homo sapiens
ucuguguguguguaugugggggu

SEQ ID NO: 1092623 - RNA, 20 nt, Homo sapiens
ucuuacccaguuaacaaaag

SEQ ID NO: 1092624 - RNA, 22 nt, Homo sapiens
ucuuagaugcaguucugaagaa

SEQ ID NO: 1092625 - RNA, 19 nt, Homo sapiens
ucuuauggccacaagcaaa

SEQ ID NO: 1092626 - RNA, 15 nt, Homo sapiens
ucuucauuaccucag

SEQ ID NO: 1092627 - RNA, 22 nt, Homo sapiens
ucuucuauggguuggacaaccu

SEQ ID NO: 1092628 - RNA, 16 nt, Homo sapiens
ucuugauuaauguacu

SEQ ID NO: 1092629 - RNA, 14 nt, Homo sapiens
ucuugccuuugaag

SEQ ID NO: 1092630 - RNA, 12 nt, Homo sapiens
ucuuuaccuccu

SEQ ID NO: 1092631 - RNA, 14 nt, Homo sapiens
ucuuugcccaaaug

SEQ ID NO: 1092632 - RNA, 14 nt, Homo sapiens
ucuuuguauugaca

SEQ ID NO: 1092633 - RNA, 16 nt, Homo sapiens
ucuuuugucccagaaa

SEQ ID NO: 1092634 - RNA, 17 nt, Homo sapiens
ugaaaaugccaccaucc

SEQ ID NO: 1092635 - RNA, 18 nt, Homo sapiens
ugaaggagagagucuuuu

SEQ ID NO: 1092636 - RNA, 22 nt, Homo sapiens
ugaauaaauguuauagcugcau

SEQ ID NO: 1092637 - RNA, 14 nt, Homo sapiens
ugaauguaccucua

SEQ ID NO: 1092638 - RNA, 18 nt, Homo sapiens
ugacaggucauccuugcc

SEQ ID NO: 1092639 - RNA, 19 nt, Homo sapiens
ugacaggucauccuugcca

SEQ ID NO: 1092640 - RNA, 15 nt, Homo sapiens
ugacauagcacuugc

SEQ ID NO: 1092641 - RNA, 15 nt, Homo sapiens
ugacgcgacuaucau

SEQ ID NO: 1092642 - RNA, 21 nt, Homo sapiens
ugacuagaauugguggugaga

SEQ ID NO: 1092643 - RNA, 16 nt, Homo sapiens
ugacucucagcagcua

SEQ ID NO: 1092644 - RNA, 22 nt, Homo sapiens
ugacugguccuaaucuguaaau

SEQ ID NO: 1092645 - RNA, 11 nt, Homo sapiens
ugagaauguua

SEQ ID NO: 1092646 - RNA, 19 nt, Homo sapiens
ugagaggccacagugcaau

SEQ ID NO: 1092647 - RNA, 11 nt, Homo sapiens
ugagcccuuca

SEQ ID NO: 1092648 - RNA, 17 nt, Homo sapiens
ugagcuggggaugucuc

SEQ ID NO: 1092649 - RNA, 20 nt, Homo sapiens
ugagcuggggaugucucuca

SEQ ID NO: 1092650 - RNA, 12 nt, Homo sapiens
ugaggacacuga

SEQ ID NO: 1092651 - RNA, 13 nt, Homo sapiens
ugaggacacugau

SEQ ID NO: 1092652 - RNA, 17 nt, Homo sapiens
ugaggccaggacuuuga

SEQ ID NO: 1092653 - RNA, 14 nt, Homo sapiens
ugaggccucucauu

SEQ ID NO: 1092654 - RNA, 15 nt, Homo sapiens
ugaggggcucucuca

SEQ ID NO: 1092655 - RNA, 17 nt, Homo sapiens
ugagugaaaaaagucac

SEQ ID NO: 1092656 - RNA, 17 nt, Homo sapiens
ugauaagcugagcuccu

SEQ ID NO: 1092657 - RNA, 17 nt, Homo sapiens
ugaucuccaacaguuga

SEQ ID NO: 1092658 - RNA, 17 nt, Homo sapiens
ugcaaugugaucuaugu

SEQ ID NO: 1092659 - RNA, 20 nt, Homo sapiens
ugcacaaaauagcacaucca

SEQ ID NO: 1092660 - RNA, 14 nt, Homo sapiens
ugcaggacagcagu

SEQ ID NO: 1092661 - RNA, 17 nt, Homo sapiens
ugcaguaauuugcaauu

SEQ ID NO: 1092662 - RNA, 18 nt, Homo sapiens
ugcauccagcaguacaau

SEQ ID NO: 1092663 - RNA, 13 nt, Homo sapiens
ugcauuuaugauu

SEQ ID NO: 1092664 - RNA, 17 nt, Homo sapiens
ugcauuuaugauuuauc

SEQ ID NO: 1092665 - RNA, 22 nt, Homo sapiens
ugccagggugcggccugagaua

SEQ ID NO: 1092666 - RNA, 21 nt, Homo sapiens
ugccauauguggaacaagcag

SEQ ID NO: 1092667 - RNA, 17 nt, Homo sapiens
ugccauggacaugaguu

SEQ ID NO: 1092668 - RNA, 18 nt, Homo sapiens
ugccugugccuuuugcca

SEQ ID NO: 1092669 - RNA, 19 nt, Homo sapiens
ugcuauuguagagccagag

SEQ ID NO: 1092670 - RNA, 21 nt, Homo sapiens
ugcuauuguagagccagaggu

SEQ ID NO: 1092671 - RNA, 14 nt, Homo sapiens
ugcuccaaggcagu

SEQ ID NO: 1092672 - RNA, 20 nt, Homo sapiens
ugcugcuugguagcacuuua

SEQ ID NO: 1092673 - RNA, 18 nt, Homo sapiens
ugcuguagacauuugcua

SEQ ID NO: 1092674 - RNA, 21 nt, Homo sapiens
ugcuguagacauuugcuauga

SEQ ID NO: 1092675 - RNA, 14 nt, Homo sapiens
ugcuuggugcuggu

SEQ ID NO: 1092676 - RNA, 20 nt, Homo sapiens
ugcuuuaauuguguggugcu

SEQ ID NO: 1092677 - RNA, 16 nt, Homo sapiens
ugcuuucugaaauuca

SEQ ID NO: 1092678 - RNA, 20 nt, Homo sapiens
ugcuuuuaauguuugcacug

SEQ ID NO: 1092679 - RNA, 22 nt, Homo sapiens
uggaaaaguauguuagugcaaa

SEQ ID NO: 1092680 - RNA, 21 nt, Homo sapiens
uggaacaagcagcuaagcaau

SEQ ID NO: 1092681 - RNA, 16 nt, Homo sapiens
uggagcauaguggcaa

SEQ ID NO: 1092682 - RNA, 24 nt, Homo sapiens
uggagcugagcagguguucuucau

SEQ ID NO: 1092683 - RNA, 22 nt, Homo sapiens
uggauagauaauuuuauuugaa

SEQ ID NO: 1092684 - RNA, 14 nt, Homo sapiens
uggauuacaguaug

SEQ ID NO: 1092685 - RNA, 14 nt, Homo sapiens
uggcaauagucaaa

SEQ ID NO: 1092686 - RNA, 20 nt, Homo sapiens
uggccacaagcaaaguaaug

SEQ ID NO: 1092687 - RNA, 15 nt, Homo sapiens
uggcucccaccugua

SEQ ID NO: 1092688 - RNA, 19 nt, Homo sapiens
uggcucccaccuguagucc

SEQ ID NO: 1092689 - RNA, 16 nt, Homo sapiens
ugggaucgcauugcau

SEQ ID NO: 1092690 - RNA, 18 nt, Homo sapiens
ugggcauaguggcacuug

SEQ ID NO: 1092691 - RNA, 13 nt, Homo sapiens
ugggccguuacau

SEQ ID NO: 1092692 - RNA, 18 nt, Homo sapiens
uggggaugucucucauga

SEQ ID NO: 1092693 - RNA, 13 nt, Homo sapiens
uggguaaugcaac

SEQ ID NO: 1092694 - RNA, 17 nt, Homo sapiens
uggguuggacaaccuca

SEQ ID NO: 1092695 - RNA, 12 nt, Homo sapiens
ugguacagagaa

SEQ ID NO: 1092696 - RNA, 12 nt, Homo sapiens
ugguagcacuuu

SEQ ID NO: 1092697 - RNA, 21 nt, Homo sapiens
ugguggggcacggagggcagu

SEQ ID NO: 1092698 - RNA, 13 nt, Homo sapiens
uggugugcuguau

SEQ ID NO: 1092699 - RNA, 21 nt, Homo sapiens
uguacagaguuuuguaacaaa

SEQ ID NO: 1092700 - RNA, 19 nt, Homo sapiens
uguagucccagcacuuugg

SEQ ID NO: 1092701 - RNA, 19 nt, Homo sapiens
ugucaagacaaggucuugc

SEQ ID NO: 1092702 - RNA, 22 nt, Homo sapiens
ugucaagacaaggucuugcuau

SEQ ID NO: 1092703 - RNA, 17 nt, Homo sapiens
ugucauauacaauuguc

SEQ ID NO: 1092704 - RNA, 18 nt, Homo sapiens
uguccaagugccacguga

SEQ ID NO: 1092705 - RNA, 15 nt, Homo sapiens
ugucccagaaaagca

SEQ ID NO: 1092706 - RNA, 16 nt, Homo sapiens
ugucccccaugcucug

SEQ ID NO: 1092707 - RNA, 19 nt, Homo sapiens
uagaauugguggugagaua

SEQ ID NO: 1092708 - RNA, 19 nt, Homo sapiens
uagacucucuaguuuuauc

SEQ ID NO: 1092709 - RNA, 23 nt, Homo sapiens
uagagcaaccagucaaaaccaga

SEQ ID NO: 1092710 - RNA, 14 nt, Homo sapiens
uagagcugccugug

SEQ ID NO: 1092711 - RNA, 17 nt, Homo sapiens
uagcaacuccccuacau

SEQ ID NO: 1092712 - RNA, 20 nt, Homo sapiens
uagcaacuccccuacaucaa

SEQ ID NO: 1092713 - RNA, 13 nt, Homo sapiens
uagcccaaaacaa

SEQ ID NO: 1092714 - RNA, 13 nt, Homo sapiens
uagcucauugcaa

SEQ ID NO: 1092715 - RNA, 15 nt, Homo sapiens
uagcugcacuguuua

SEQ ID NO: 1092716 - RNA, 11 nt, Homo sapiens
uagcugcauuu

SEQ ID NO: 1092717 - RNA, 20 nt, Homo sapiens
uaggccagcaccaucucuuu

SEQ ID NO: 1092718 - RNA, 19 nt, Homo sapiens
uaguaguuaaaacagcuau

SEQ ID NO: 1092719 - RNA, 15 nt, Homo sapiens
uaguauagaaaaugg

SEQ ID NO: 1092720 - RNA, 17 nt, Homo sapiens
uagucagaaacugccau

SEQ ID NO: 1092721 - RNA, 13 nt, Homo sapiens
uagucccagcacu

SEQ ID NO: 1092722 - RNA, 16 nt, Homo sapiens
uagucucagcuacuua

SEQ ID NO: 1092723 - RNA, 18 nt, Homo sapiens
uagucucucuaguaguua

SEQ ID NO: 1092724 - RNA, 17 nt, Homo sapiens
uaguuaaaacagcuauu

SEQ ID NO: 1092725 - RNA, 17 nt, Homo sapiens
uaguucuuacccaguua

SEQ ID NO: 1092726 - RNA, 23 nt, Homo sapiens
uauaaaauguuuuuaaacagugu

SEQ ID NO: 1092727 - RNA, 21 nt, Homo sapiens
uauaaauguuaguucuagcuc

SEQ ID NO: 1092728 - RNA, 21 nt, Homo sapiens
uauaagacacaugcaggguga

SEQ ID NO: 1092729 - RNA, 13 nt, Homo sapiens
uauccauccaugg

SEQ ID NO: 1092730 - RNA, 18 nt, Homo sapiens
uaucuaaacccagcaaaa

SEQ ID NO: 1092731 - RNA, 15 nt, Homo sapiens
uaucuuaacacugaa

SEQ ID NO: 1092732 - RNA, 15 nt, Homo sapiens
uaugacuaugcacua

SEQ ID NO: 1092733 - RNA, 13 nt, Homo sapiens
uaugauuucucaa

SEQ ID NO: 1092734 - RNA, 22 nt, Homo sapiens
uauggaaauaccaggaccaguu

SEQ ID NO: 1092735 - RNA, 15 nt, Homo sapiens
uaugguagcuuuuac

SEQ ID NO: 1092736 - RNA, 14 nt, Homo sapiens
uaugguucucaggc

SEQ ID NO: 1092737 - RNA, 17 nt, Homo sapiens
uaugguucucucgcaag

SEQ ID NO: 1092738 - RNA, 16 nt, Homo sapiens
uaugugggggucugug

SEQ ID NO: 1092739 - RNA, 18 nt, Homo sapiens
uauuacacauuuauguaa

SEQ ID NO: 1092740 - RNA, 16 nt, Homo sapiens
uauuaugacacuccca

SEQ ID NO: 1092741 - RNA, 17 nt, Homo sapiens
uauucuuacuaaucuga

SEQ ID NO: 1092742 - RNA, 15 nt, Homo sapiens
uauugccugcuuuga

SEQ ID NO: 1092743 - RNA, 22 nt, Homo sapiens
uauugugauuauuggauucaca

SEQ ID NO: 1092744 - RNA, 22 nt, Homo sapiens
uauuuuaucaaggaagucuuca

SEQ ID NO: 1092745 - RNA, 14 nt, Homo sapiens
uauuuuucucauga

SEQ ID NO: 1092746 - RNA, 15 nt, Homo sapiens
ucaaaagcagaauuu

SEQ ID NO: 1092747 - RNA, 13 nt, Homo sapiens
ucaaaaugcuuca

SEQ ID NO: 1092748 - RNA, 22 nt, Homo sapiens
ucaaaauggaaaauuaauucua

SEQ ID NO: 1092749 - RNA, 15 nt, Homo sapiens
ucaaaccuguagaug

SEQ ID NO: 1092750 - RNA, 12 nt, Homo sapiens
ucaaaugcucaa

SEQ ID NO: 1092751 - RNA, 13 nt, Homo sapiens
ucaaaugcucaag

SEQ ID NO: 1092752 - RNA, 15 nt, Homo sapiens
ucaaaugcucaagcc

SEQ ID NO: 1092753 - RNA, 15 nt, Homo sapiens
ucaacaucuagugag

SEQ ID NO: 1092754 - RNA, 17 nt, Homo sapiens
ucaagauccucuugcca

SEQ ID NO: 1092755 - RNA, 13 nt, Homo sapiens
ucaaggaagucuu

SEQ ID NO: 1092756 - RNA, 20 nt, Homo sapiens
ucaauaguguccuaugcaau

SEQ ID NO: 1092757 - RNA, 22 nt, Homo sapiens
ucaauauauaguuagcuuuauu

SEQ ID NO: 1092758 - RNA, 22 nt, Homo sapiens
ucacaagaacagaaccugcaaa

SEQ ID NO: 1092759 - RNA, 23 nt, Homo sapiens
ucacaagaacagaaccugcaaau

SEQ ID NO: 1092760 - RNA, 15 nt, Homo sapiens
ucacagcuaccaaag

SEQ ID NO: 1092761 - RNA, 15 nt, Homo sapiens
ucacaguuggcacuu

SEQ ID NO: 1092762 - RNA, 17 nt, Homo sapiens
ucacccagaugaugucc

SEQ ID NO: 1092763 - RNA, 20 nt, Homo sapiens
ucacuacauugugcaauuga

SEQ ID NO: 1092764 - RNA, 14 nt, Homo sapiens
ucacuccugagaaa

SEQ ID NO: 1092765 - RNA, 19 nt, Homo sapiens
ucagaaccaagaugccaac

SEQ ID NO: 1092766 - RNA, 15 nt, Homo sapiens
ucagauaccaugcaa

SEQ ID NO: 1092767 - RNA, 18 nt, Homo sapiens
ucagauaccaugcaauaa

SEQ ID NO: 1092768 - RNA, 19 nt, Homo sapiens
ucagcacguguggccuguu

SEQ ID NO: 1092769 - RNA, 20 nt, Homo sapiens
ucaggaacuauuaauuccau

SEQ ID NO: 1092770 - RNA, 14 nt, Homo sapiens
ucaggacacaagaa

SEQ ID NO: 1092771 - RNA, 15 nt, Homo sapiens
ucauaaucacaaccc

SEQ ID NO: 1092772 - RNA, 14 nt, Homo sapiens
ucauauacaauugu

SEQ ID NO: 1092773 - RNA, 17 nt, Homo sapiens
ucauauacaauugucau

SEQ ID NO: 1092774 - RNA, 18 nt, Homo sapiens
ucauauacaauugucaug

SEQ ID NO: 1092775 - RNA, 16 nt, Homo sapiens
ucaucgggguggugca

SEQ ID NO: 1092776 - RNA, 18 nt, Homo sapiens
ucaucgggguggugcagg

SEQ ID NO: 1092777 - RNA, 20 nt, Homo sapiens
ucaucgggguggugcaggcu

SEQ ID NO: 1092778 - RNA, 15 nt, Homo sapiens
ucaucuguaccucug

SEQ ID NO: 1092779 - RNA, 16 nt, Homo sapiens
ucaugcauuacuuacu

SEQ ID NO: 1092780 - RNA, 21 nt, Homo sapiens
ucaugccccaguauuagcaau

SEQ ID NO: 1092781 - RNA, 11 nt, Homo sapiens
ucauuaccuca

SEQ ID NO: 1092782 - RNA, 16 nt, Homo sapiens
ucauugcaagcucaag

SEQ ID NO: 1092783 - RNA, 22 nt, Homo sapiens
uccaacaaguaccugugaacag

SEQ ID NO: 1092784 - RNA, 11 nt, Homo sapiens
uccaagcauuu

SEQ ID NO: 1092785 - RNA, 12 nt, Homo sapiens
uccaaggcagug

SEQ ID NO: 1092786 - RNA, 13 nt, Homo sapiens
uccaaguguauaa

SEQ ID NO: 1092787 - RNA, 12 nt, Homo sapiens
uccaccaugagg

SEQ ID NO: 1092788 - RNA, 19 nt, Homo sapiens
ggagaguacauggcauuga

SEQ ID NO: 1092789 - RNA, 13 nt, Homo sapiens
ggagccuguccuu

SEQ ID NO: 1092790 - RNA, 16 nt, Homo sapiens
ggagcucgugggacag

SEQ ID NO: 1092791 - RNA, 22 nt, Homo sapiens
ggaguaaagagcauauucacug

SEQ ID NO: 1092792 - RNA, 14 nt, Homo sapiens
ggaguaacaaaaca

SEQ ID NO: 1092793 - RNA, 23 nt, Homo sapiens
ggagugaggaugucugggccacu

SEQ ID NO: 1092794 - RNA, 16 nt, Homo sapiens
ggauguaccagcaucu

SEQ ID NO: 1092795 - RNA, 15 nt, Homo sapiens
ggcacggagggcagu

SEQ ID NO: 1092796 - RNA, 15 nt, Homo sapiens
ggcagaauagcuuau

SEQ ID NO: 1092797 - RNA, 18 nt, Homo sapiens
ggcauucuugaacugcug

SEQ ID NO: 1092798 - RNA, 20 nt, Homo sapiens
ggccccucacccccagcugg

SEQ ID NO: 1092799 - RNA, 15 nt, Homo sapiens
ggcccugugccuugg

SEQ ID NO: 1092800 - RNA, 14 nt, Homo sapiens
ggccugcccagaca

SEQ ID NO: 1092801 - RNA, 20 nt, Homo sapiens
ggccuuacuucccagcccug

SEQ ID NO: 1092802 - RNA, 15 nt, Homo sapiens
ggcugagguggcaga

SEQ ID NO: 1092803 - RNA, 13 nt, Homo sapiens
ggcugaguacagu

SEQ ID NO: 1092804 - RNA, 16 nt, Homo sapiens
gggagaaugucaguau

SEQ ID NO: 1092805 - RNA, 19 nt, Homo sapiens
gggauccuucgugcuucaa

SEQ ID NO: 1092806 - RNA, 16 nt, Homo sapiens
gggcacggagggcagu

SEQ ID NO: 1092807 - RNA, 11 nt, Homo sapiens
gggcacggugg

SEQ ID NO: 1092808 - RNA, 15 nt, Homo sapiens
gggccugcccagaca

SEQ ID NO: 1092809 - RNA, 16 nt, Homo sapiens
gggcucagaguggggu

SEQ ID NO: 1092810 - RNA, 14 nt, Homo sapiens
gggcuuugccauua

SEQ ID NO: 1092811 - RNA, 15 nt, Homo sapiens
ggggcugaugcaguu

SEQ ID NO: 1092812 - RNA, 19 nt, Homo sapiens
ggguaaaaaugaagcagaa

SEQ ID NO: 1092813 - RNA, 21 nt, Homo sapiens
gguaaaaaggagaauuuuucc

SEQ ID NO: 1092814 - RNA, 21 nt, Homo sapiens
gguacagacacucccacuugg

SEQ ID NO: 1092815 - RNA, 14 nt, Homo sapiens
ggucauccuugcca

SEQ ID NO: 1092816 - RNA, 17 nt, Homo sapiens
gguguccccucagcgga

SEQ ID NO: 1092817 - RNA, 21 nt, Homo sapiens
gguugcuguugugcagugugc

SEQ ID NO: 1092818 - RNA, 16 nt, Homo sapiens
guaaaauuuugucaua

SEQ ID NO: 1092819 - RNA, 21 nt, Homo sapiens
guaaacauugccugauuuguu

SEQ ID NO: 1092820 - RNA, 23 nt, Homo sapiens
guaagaaaauaucacuugucaau

SEQ ID NO: 1092821 - RNA, 22 nt, Homo sapiens
guacaauaaaaguaaaccacaa

SEQ ID NO: 1092822 - RNA, 17 nt, Homo sapiens
guacaaugaguguuaua

SEQ ID NO: 1092823 - RNA, 12 nt, Homo sapiens
guacagacacuc

SEQ ID NO: 1092824 - RNA, 13 nt, Homo sapiens
guacagacacucc

SEQ ID NO: 1092825 - RNA, 22 nt, Homo sapiens
guacucagcauggucuuaugca

SEQ ID NO: 1092826 - RNA, 16 nt, Homo sapiens
guagacauuugcuaug

SEQ ID NO: 1092827 - RNA, 13 nt, Homo sapiens
guaguuacucuca

SEQ ID NO: 1092828 - RNA, 20 nt, Homo sapiens
guaguuuuauuacacauuua

SEQ ID NO: 1092829 - RNA, 22 nt, Homo sapiens
guaugaucuuagggaacuuuga

SEQ ID NO: 1092830 - RNA, 17 nt, Homo sapiens
guauuaugacacuccca

SEQ ID NO: 1092831 - RNA, 19 nt, Homo sapiens
guauucuuaaaaugcaaua

SEQ ID NO: 1092832 - RNA, 18 nt, Homo sapiens
guauugaaugauaauuca

SEQ ID NO: 1092833 - RNA, 15 nt, Homo sapiens
gucauaauguuuauu

SEQ ID NO: 1092834 - RNA, 13 nt, Homo sapiens
gucuccucaggac

SEQ ID NO: 1092835 - RNA, 19 nt, Homo sapiens
gucuguguguuuaugugug

SEQ ID NO: 1092836 - RNA, 13 nt, Homo sapiens
gugaaaaucugaa

SEQ ID NO: 1092837 - RNA, 14 nt, Homo sapiens
gugaggccauagca

SEQ ID NO: 1092838 - RNA, 17 nt, Homo sapiens
gugaggggcucucucau

SEQ ID NO: 1092839 - RNA, 23 nt, Homo sapiens
gugauauuaaccaggggccauga

SEQ ID NO: 1092840 - RNA, 17 nt, Homo sapiens
gugccugucacuacugg

SEQ ID NO: 1092841 - RNA, 18 nt, Homo sapiens
gugccuuggugugcugua

SEQ ID NO: 1092842 - RNA, 21 nt, Homo sapiens
guggaaugguagcaaugggau

SEQ ID NO: 1092843 - RNA, 17 nt, Homo sapiens
guggaguuuucaugaca

SEQ ID NO: 1092844 - RNA, 12 nt, Homo sapiens
guggcuuuuacc

SEQ ID NO: 1092845 - RNA, 18 nt, Homo sapiens
gugucauauacaauuguc

SEQ ID NO: 1092846 - RNA, 16 nt, Homo sapiens
gugugggaguguguaa

SEQ ID NO: 1092847 - RNA, 17 nt, Homo sapiens
guguuauaacagggaac

SEQ ID NO: 1092848 - RNA, 14 nt, Homo sapiens
guguucuucauuac

SEQ ID NO: 1092849 - RNA, 19 nt, Homo sapiens
guguucuucauuaccucag

SEQ ID NO: 1092850 - RNA, 15 nt, Homo sapiens
guuaaauucaaugua

SEQ ID NO: 1092851 - RNA, 12 nt, Homo sapiens
guuagcuuuauu

SEQ ID NO: 1092852 - RNA, 14 nt, Homo sapiens
guuauaacagggaa

SEQ ID NO: 1092853 - RNA, 22 nt, Homo sapiens
guucagaaccaagaugccaaca

SEQ ID NO: 1092854 - RNA, 16 nt, Homo sapiens
guuccaggauguggaa

SEQ ID NO: 1092855 - RNA, 18 nt, Homo sapiens
guucucaacagacccagu

SEQ ID NO: 1092856 - RNA, 20 nt, Homo sapiens
guucugucccccaugcucug

SEQ ID NO: 1092857 - RNA, 13 nt, Homo sapiens
guugcacuuugua

SEQ ID NO: 1092858 - RNA, 23 nt, Homo sapiens
guuuugcugcuugguagcacuuu

SEQ ID NO: 1092859 - RNA, 20 nt, Homo sapiens
uaaaaaacuccugucuugcu

SEQ ID NO: 1092860 - RNA, 12 nt, Homo sapiens
uaaaaaccgaau

SEQ ID NO: 1092861 - RNA, 17 nt, Homo sapiens
uaaaaauaaaagcuauu

SEQ ID NO: 1092862 - RNA, 17 nt, Homo sapiens
uaaaaauaaacuguuau

SEQ ID NO: 1092863 - RNA, 22 nt, Homo sapiens
uaaaacuuguuacaccacauua

SEQ ID NO: 1092864 - RNA, 16 nt, Homo sapiens
uaaaagaaugauuaug

SEQ ID NO: 1092865 - RNA, 16 nt, Homo sapiens
uaaaauacauaacuuc

SEQ ID NO: 1092866 - RNA, 12 nt, Homo sapiens
cuggcccugugc

SEQ ID NO: 1092867 - RNA, 16 nt, Homo sapiens
cuggcggccaagugag

SEQ ID NO: 1092868 - RNA, 20 nt, Homo sapiens
cugggaaauguuuuaaugcc

SEQ ID NO: 1092869 - RNA, 21 nt, Homo sapiens
cugggccguuacaucugugca

SEQ ID NO: 1092870 - RNA, 19 nt, Homo sapiens
cuggggaugucucucauga

SEQ ID NO: 1092871 - RNA, 21 nt, Homo sapiens
cuggggaugucucucaugacc

SEQ ID NO: 1092872 - RNA, 15 nt, Homo sapiens
cuggggcuuugccau

SEQ ID NO: 1092873 - RNA, 16 nt, Homo sapiens
cuggggcuuugccauu

SEQ ID NO: 1092874 - RNA, 13 nt, Homo sapiens
cuguacugaggaa

SEQ ID NO: 1092875 - RNA, 23 nt, Homo sapiens
cuguaguuuuuuuggugcuauaa

SEQ ID NO: 1092876 - RNA, 12 nt, Homo sapiens
cuguaugauucc

SEQ ID NO: 1092877 - RNA, 13 nt, Homo sapiens
cugucacuacugg

SEQ ID NO: 1092878 - RNA, 14 nt, Homo sapiens
cugucuacacuaag

SEQ ID NO: 1092879 - RNA, 13 nt, Homo sapiens
cugugauuaugcc

SEQ ID NO: 1092880 - RNA, 21 nt, Homo sapiens
cugugccuuggugugcuguau

SEQ ID NO: 1092881 - RNA, 14 nt, Homo sapiens
cugugccuuuugcc

SEQ ID NO: 1092882 - RNA, 17 nt, Homo sapiens
cuguguaauauaaaaga

SEQ ID NO: 1092883 - RNA, 23 nt, Homo sapiens
cuguuaaauuuucucuaaacugu

SEQ ID NO: 1092884 - RNA, 18 nt, Homo sapiens
cuuaaaagaacauguaua

SEQ ID NO: 1092885 - RNA, 16 nt, Homo sapiens
cuuaacauuccuaaaa

SEQ ID NO: 1092886 - RNA, 13 nt, Homo sapiens
cuuaauguaguua

SEQ ID NO: 1092887 - RNA, 13 nt, Homo sapiens
cuuacuguuaaaa

SEQ ID NO: 1092888 - RNA, 20 nt, Homo sapiens
cuucaagauccucuugccac

SEQ ID NO: 1092889 - RNA, 14 nt, Homo sapiens
cuucagauuugccu

SEQ ID NO: 1092890 - RNA, 11 nt, Homo sapiens
gcauagcacuu

SEQ ID NO: 1092891 - RNA, 13 nt, Homo sapiens
gcauggaugaaua

SEQ ID NO: 1092892 - RNA, 17 nt, Homo sapiens
gcauuccaacuaucuca

SEQ ID NO: 1092893 - RNA, 19 nt, Homo sapiens
gcauucuaucguuauuaua

SEQ ID NO: 1092894 - RNA, 21 nt, Homo sapiens
gcauugucacagcuaccaaag

SEQ ID NO: 1092895 - RNA, 20 nt, Homo sapiens
gccaaaacaagggauuauca

SEQ ID NO: 1092896 - RNA, 15 nt, Homo sapiens
gccaaucuuguuuua

SEQ ID NO: 1092897 - RNA, 19 nt, Homo sapiens
gccacucaggggucauuca

SEQ ID NO: 1092898 - RNA, 17 nt, Homo sapiens
gccagacgcauccugcc

SEQ ID NO: 1092899 - RNA, 20 nt, Homo sapiens
gccauaugcaggacagcagu

SEQ ID NO: 1092900 - RNA, 22 nt, Homo sapiens
gccauucuuauggccacaagca

SEQ ID NO: 1092901 - RNA, 23 nt, Homo sapiens
gccauucuuauggccacaagcaa

SEQ ID NO: 1092902 - RNA, 15 nt, Homo sapiens
gcccuucauugggga

SEQ ID NO: 1092903 - RNA, 14 nt, Homo sapiens
gccgccugucaaua

SEQ ID NO: 1092904 - RNA, 13 nt, Homo sapiens
gccuagauaugaa

SEQ ID NO: 1092905 - RNA, 19 nt, Homo sapiens
gccuaguuggucuuggaga

SEQ ID NO: 1092906 - RNA, 13 nt, Homo sapiens
gccucuuugccca

SEQ ID NO: 1092907 - RNA, 16 nt, Homo sapiens
gccugggggauguacc

SEQ ID NO: 1092908 - RNA, 20 nt, Homo sapiens
gccuuggggcugaugcaguu

SEQ ID NO: 1092909 - RNA, 21 nt, Homo sapiens
gccuuugucacuagucuuuga

SEQ ID NO: 1092910 - RNA, 19 nt, Homo sapiens
gcgaacauaaaugucugua

SEQ ID NO: 1092911 - RNA, 13 nt, Homo sapiens
aauuaacugcuuc

SEQ ID NO: 1092912 - RNA, 13 nt, Homo sapiens
aauuacauacuau

SEQ ID NO: 1092913 - RNA, 16 nt, Homo sapiens
aauucuaacuuaaugu

SEQ ID NO: 1092914 - RNA, 21 nt, Homo sapiens
aauucugaccuuacaaaagug

SEQ ID NO: 1092915 - RNA, 19 nt, Homo sapiens
aauuggagaaaagcacuua

SEQ ID NO: 1092916 - RNA, 20 nt, Homo sapiens
aauuggagaaaagcacuuaa

SEQ ID NO: 1092917 - RNA, 17 nt, Homo sapiens
aauuuaaaacacaguau

SEQ ID NO: 1092918 - RNA, 15 nt, Homo sapiens
aauuuaccacaaaag

SEQ ID NO: 1092919 - RNA, 17 nt, Homo sapiens
aauuucaaaagaacauu

SEQ ID NO: 1092920 - RNA, 16 nt, Homo sapiens
aauuuuuaaaacugca

SEQ ID NO: 1092921 - RNA, 23 nt, Homo sapiens
acaaaacagccucuuugcccaaa

SEQ ID NO: 1092922 - RNA, 22 nt, Homo sapiens
acaaaugcaucaugaguugcaa

SEQ ID NO: 1092923 - RNA, 18 nt, Homo sapiens
acaaaugggaauucacuc

SEQ ID NO: 1092924 - RNA, 21 nt, Homo sapiens
acaagucaguuucuacacugg

SEQ ID NO: 1092925 - RNA, 15 nt, Homo sapiens
acaaugaguguuaua

SEQ ID NO: 1092926 - RNA, 23 nt, Homo sapiens
acaaugaguguuauaacagggaa

SEQ ID NO: 1092927 - RNA, 21 nt, Homo sapiens
acaccgagugaggccauagca

SEQ ID NO: 1092928 - RNA, 22 nt, Homo sapiens
acaccuggggucggguccacca

SEQ ID NO: 1092929 - RNA, 18 nt, Homo sapiens
acacggugggcugaguac

SEQ ID NO: 1092930 - RNA, 17 nt, Homo sapiens
acacucccacuuggcau

SEQ ID NO: 1092931 - RNA, 16 nt, Homo sapiens
acagaaccugcaaaua

SEQ ID NO: 1092932 - RNA, 16 nt, Homo sapiens
acagccucuuugccca

SEQ ID NO: 1092933 - RNA, 23 nt, Homo sapiens
acagccucuuugcccaaauguga

SEQ ID NO: 1092934 - RNA, 14 nt, Homo sapiens
acagcugucauaua

SEQ ID NO: 1092935 - RNA, 18 nt, Homo sapiens
acagcuucauguucccaa

SEQ ID NO: 1092936 - RNA, 22 nt, Homo sapiens
acaguuaccucugccucagaaa

SEQ ID NO: 1092937 - RNA, 19 nt, Homo sapiens
acaguuggcacuucugcca

SEQ ID NO: 1092938 - RNA, 23 nt, Homo sapiens
acauaaaugucuguauuucauuc

SEQ ID NO: 1092939 - RNA, 16 nt, Homo sapiens
acauaauaagacuuuu

SEQ ID NO: 1092940 - RNA, 23 nt, Homo sapiens
acauaauaagacuuuucucuacu

SEQ ID NO: 1092941 - RNA, 12 nt, Homo sapiens
acauagcacuug

SEQ ID NO: 1092942 - RNA, 14 nt, Homo sapiens
acauagcacuugcc

SEQ ID NO: 1092943 - RNA, 16 nt, Homo sapiens
acaugacauagcacuu

SEQ ID NO: 1092944 - RNA, 17 nt, Homo sapiens
acaugacauagcacuug

SEQ ID NO: 1092945 - RNA, 15 nt, Homo sapiens
acauucuugcuaauu

SEQ ID NO: 1092946 - RNA, 13 nt, Homo sapiens
acauugauuggau

SEQ ID NO: 1092947 - RNA, 23 nt, Homo sapiens
accaagccuuggcucuacccuga

SEQ ID NO: 1092948 - RNA, 20 nt, Homo sapiens
accaagugaggccauagcaa

SEQ ID NO: 1092949 - RNA, 13 nt, Homo sapiens
accaaucaugaau

SEQ ID NO: 1092950 - RNA, 21 nt, Homo sapiens
accacaggaaccacaagacug

SEQ ID NO: 1092951 - RNA, 23 nt, Homo sapiens
accaccuguguagucucucuagu

SEQ ID NO: 1092952 - RNA, 17 nt, Homo sapiens
accagcaaauggaugcg

SEQ ID NO: 1092953 - RNA, 16 nt, Homo sapiens
accagggugagaauaa

SEQ ID NO: 1092954 - RNA, 13 nt, Homo sapiens
accauaaacauuu

SEQ ID NO: 1092955 - RNA, 16 nt, Homo sapiens
accauucccaccagcu

SEQ ID NO: 1092956 - RNA, 14 nt, Homo sapiens
acccucccaggaga

SEQ ID NO: 1092957 - RNA, 13 nt, Homo sapiens
accgggcaugucu

SEQ ID NO: 1092958 - RNA, 13 nt, Homo sapiens
accuaaacuguau

SEQ ID NO: 1092959 - RNA, 15 nt, Homo sapiens
accuaauacagcaga

SEQ ID NO: 1092960 - RNA, 23 nt, Homo sapiens
accuccuaauuccacacccucac

SEQ ID NO: 1092961 - RNA, 17 nt, Homo sapiens
accucuuggcugccuug

SEQ ID NO: 1092962 - RNA, 20 nt, Homo sapiens
accugccugaacgcacauga

SEQ ID NO: 1092963 - RNA, 20 nt, Homo sapiens
accugggagcaggggcaaug

SEQ ID NO: 1092964 - RNA, 23 nt, Homo sapiens
accuuaaggaaaaguaagggaau

SEQ ID NO: 1092965 - RNA, 17 nt, Homo sapiens
acgacuguuuucccaac

SEQ ID NO: 1092966 - RNA, 23 nt, Homo sapiens
acgcauugucacagcuaccaaag

SEQ ID NO: 1092967 - RNA, 22 nt, Homo sapiens
acuauaaauacaaaucuguaua

SEQ ID NO: 1092968 - RNA, 22 nt, Homo sapiens
acuaucucauuuccaagcaagu

SEQ ID NO: 1092969 - RNA, 16 nt, Homo sapiens
acucaggggucauuca

SEQ ID NO: 1092970 - RNA, 15 nt, Homo sapiens
acuccccuacaucaa

SEQ ID NO: 1092971 - RNA, 23 nt, Homo sapiens
acuccccuacaucaaaugcucaa

SEQ ID NO: 1092972 - RNA, 21 nt, Homo sapiens
acucuggagguuuguuuagaa

SEQ ID NO: 1092973 - RNA, 15 nt, Homo sapiens
acugaaggugcaguu

SEQ ID NO: 1092974 - RNA, 16 nt, Homo sapiens
acugaaggugcaguug

SEQ ID NO: 1092975 - RNA, 19 nt, Homo sapiens
acugaaggugcaguugaau

SEQ ID NO: 1092976 - RNA, 19 nt, Homo sapiens
acugccuucucaacuccaa

SEQ ID NO: 1092977 - RNA, 21 nt, Homo sapiens
acugcuccaaaccaacaugga

SEQ ID NO: 1092978 - RNA, 18 nt, Homo sapiens
acugugaaguuacaugca

SEQ ID NO: 1092979 - RNA, 22 nt, Homo sapiens
acuguuuauggaaauaccagga

SEQ ID NO: 1092980 - RNA, 13 nt, Homo sapiens
acuguuuucccaa

SEQ ID NO: 1092981 - RNA, 14 nt, Homo sapiens
acuuaaauauuuga

SEQ ID NO: 1092982 - RNA, 22 nt, Homo sapiens
acuuacuguuaaaacuguaccu

SEQ ID NO: 1092983 - RNA, 17 nt, Homo sapiens
acuucuaauuauuccaa

SEQ ID NO: 1092984 - RNA, 15 nt, Homo sapiens
acuucuggagucuau

SEQ ID NO: 1092985 - RNA, 18 nt, Homo sapiens
acuugaggccaggacuuu

SEQ ID NO: 1092986 - RNA, 18 nt, Homo sapiens
acuuuaguguauguucua

SEQ ID NO: 1092987 - RNA, 13 nt, Homo sapiens
acuuuaucgcucu

SEQ ID NO: 1092988 - RNA, 21 nt, Homo sapiens
acuuuguaaaaggacucuucc

SEQ ID NO: 1092989 - RNA, 16 nt, Homo sapiens
agaaaaaaaguugcaa

SEQ ID NO: 1092990 - RNA, 13 nt, Homo sapiens
agaaaagcacuua

SEQ ID NO: 1092991 - RNA, 21 nt, Homo sapiens
agaaaauaaaauuuaacucac

SEQ ID NO: 1092992 - RNA, 20 nt, Homo sapiens
agaaaaugugaguaguacaa

SEQ ID NO: 1092993 - RNA, 17 nt, Homo sapiens
agaaacacaacuauauu

SEQ ID NO: 1092994 - RNA, 21 nt, Homo sapiens
agaaacaccgagugaggccau

SEQ ID NO: 1092995 - RNA, 17 nt, Homo sapiens
agaaagugacaagcuca

SEQ ID NO: 1092996 - RNA, 14 nt, Homo sapiens
agaaauauuuaacu

SEQ ID NO: 1092997 - RNA, 20 nt, Homo sapiens
agaacagcuucauguuccca

SEQ ID NO: 1092998 - RNA, 13 nt, Homo sapiens
agaagaacugaaa

SEQ ID NO: 1092999 - RNA, 18 nt, Homo sapiens
agaagaugguaccaccag

SEQ ID NO: 1093000 - RNA, 14 nt, Homo sapiens
agaagcaccaauca

SEQ ID NO: 1093001 - RNA, 17 nt, Homo sapiens
agaagggcuuacaggca

SEQ ID NO: 1093002 - RNA, 20 nt, Homo sapiens
agaaguuuggcaguauuuaa

SEQ ID NO: 1093003 - RNA, 17 nt, Homo sapiens
agaaugauuaugaauua

SEQ ID NO: 1093004 - RNA, 23 nt, Homo sapiens
agaauggggugagcagccaccau

SEQ ID NO: 1093005 - RNA, 23 nt, Homo sapiens
agacacucccacuuggcaucauu

SEQ ID NO: 1093006 - RNA, 13 nt, Homo sapiens
agagacuuuguca

SEQ ID NO: 1093007 - RNA, 17 nt, Homo sapiens
agaguuuagcuggaaaa

SEQ ID NO: 1093008 - RNA, 22 nt, Homo sapiens
agaguuuuguaacaaaugacug

SEQ ID NO: 1093009 - RNA, 13 nt, Homo sapiens
agauccuggaaau

SEQ ID NO: 1093010 - RNA, 20 nt, Homo sapiens
agaugcagggguggggagcg

SEQ ID NO: 1093011 - RNA, 13 nt, Homo sapiens
agauuugccuuau

SEQ ID NO: 1093012 - RNA, 17 nt, Homo sapiens
agcaacuccccuacauc

SEQ ID NO: 1093013 - RNA, 18 nt, Homo sapiens
agcaacuccccuacauca

SEQ ID NO: 1093014 - RNA, 23 nt, Homo sapiens
agcaacuccccuacaucaaaugc

SEQ ID NO: 1093015 - RNA, 18 nt, Homo sapiens
agcaauuccccuacauca

SEQ ID NO: 1093016 - RNA, 23 nt, Homo sapiens
agcaauuccccuacaucaaaugc

SEQ ID NO: 1093017 - RNA, 23 nt, Homo sapiens
agcacauccaccaaacuccugcc

SEQ ID NO: 1093018 - RNA, 21 nt, Homo sapiens
agcaccaucucuuuaccuccu

SEQ ID NO: 1093019 - RNA, 21 nt, Homo sapiens
agcaggacgacuguuuuccca

SEQ ID NO: 1093020 - RNA, 21 nt, Homo sapiens
agcaggauggcuggaacacug

SEQ ID NO: 1093021 - RNA, 22 nt, Homo sapiens
agcaggauggcuggaacacugu

SEQ ID NO: 1093022 - RNA, 20 nt, Homo sapiens
agcauaggaaaccacacaga

SEQ ID NO: 1093023 - RNA, 15 nt, Homo sapiens
agcccccagcuggaa

SEQ ID NO: 1093024 - RNA, 18 nt, Homo sapiens
agccucuuagaugcaguu

SEQ ID NO: 1093025 - RNA, 19 nt, Homo sapiens
agccuguccuuccaugccc

SEQ ID NO: 1093026 - RNA, 18 nt, Homo sapiens
agcugugauuaugccauu

SEQ ID NO: 1093027 - RNA, 19 nt, Homo sapiens
agcuucagauaccaugcaa

SEQ ID NO: 1093028 - RNA, 19 nt, Homo sapiens
aggaauacaauauauagcu

SEQ ID NO: 1093029 - RNA, 16 nt, Homo sapiens
aggacacaagaacuaa

SEQ ID NO: 1093030 - RNA, 16 nt, Homo sapiens
aggacagcccuucuuu

SEQ ID NO: 1093031 - RNA, 21 nt, Homo sapiens
aggacccgcccaagaguggcc

SEQ ID NO: 1093032 - RNA, 20 nt, Homo sapiens
aggacgacuguuuucccaac

SEQ ID NO: 1093033 - RNA, 22 nt, Homo sapiens
aggagagauauuuugauucuca

SEQ ID NO: 1093034 - RNA, 23 nt, Homo sapiens
aggagagauauuuugauucucau

SEQ ID NO: 1093035 - RNA, 11 nt, Homo sapiens
caugcucugau

SEQ ID NO: 1093036 - RNA, 18 nt, Homo sapiens
cauggcauugagacaucu

SEQ ID NO: 1093037 - RNA, 14 nt, Homo sapiens
caugggacauuugc

SEQ ID NO: 1093038 - RNA, 16 nt, Homo sapiens
cauggggcugauugua

SEQ ID NO: 1093039 - RNA, 15 nt, Homo sapiens
cauguaaagcuguua

SEQ ID NO: 1093040 - RNA, 21 nt, Homo sapiens
caugucguaguuacucucagg

SEQ ID NO: 1093041 - RNA, 13 nt, Homo sapiens
cauuaacucaggc

SEQ ID NO: 1093042 - RNA, 19 nt, Homo sapiens
cauuagaaaggcuaacaaa

SEQ ID NO: 1093043 - RNA, 19 nt, Homo sapiens
cauuagugaauuauggaau

SEQ ID NO: 1093044 - RNA, 20 nt, Homo sapiens
cauucuuauggccacaagca

SEQ ID NO: 1093045 - RNA, 17 nt, Homo sapiens
cauucuuguuggcuuuu

SEQ ID NO: 1093046 - RNA, 13 nt, Homo sapiens
cauugaaguauua

SEQ ID NO: 1093047 - RNA, 13 nt, Homo sapiens
cauugcaagcuca

SEQ ID NO: 1093048 - RNA, 19 nt, Homo sapiens
cauugguguugacauacau

SEQ ID NO: 1093049 - RNA, 12 nt, Homo sapiens
cauugucccuga

SEQ ID NO: 1093050 - RNA, 15 nt, Homo sapiens
cauuguuggcgcuga

SEQ ID NO: 1093051 - RNA, 19 nt, Homo sapiens
cauuuuuguauuuuguaca

SEQ ID NO: 1093052 - RNA, 14 nt, Homo sapiens
ccaaaacaauuuca

SEQ ID NO: 1093053 - RNA, 13 nt, Homo sapiens
ccaaacacaggca

SEQ ID NO: 1093054 - RNA, 23 nt, Homo sapiens
ccaaacccaguaaaacagauucu

SEQ ID NO: 1093055 - RNA, 21 nt, Homo sapiens
ccaacauuaaaagccaccccc

SEQ ID NO: 1093056 - RNA, 12 nt, Homo sapiens
ccaaguagcuag

SEQ ID NO: 1093057 - RNA, 22 nt, Homo sapiens
ccacaauuacauacuauucuua

SEQ ID NO: 1093058 - RNA, 15 nt, Homo sapiens
ccacauuagugaauu

SEQ ID NO: 1093059 - RNA, 14 nt, Homo sapiens
ccacccacacagca

SEQ ID NO: 1093060 - RNA, 17 nt, Homo sapiens
ccaccuguguagucucu

SEQ ID NO: 1093061 - RNA, 16 nt, Homo sapiens
ccacgcacagccagac

SEQ ID NO: 1093062 - RNA, 17 nt, Homo sapiens
ccacugacgaucauucu

SEQ ID NO: 1093063 - RNA, 18 nt, Homo sapiens
ccagaaugccuccugcag

SEQ ID NO: 1093064 - RNA, 15 nt, Homo sapiens
ccagcaguacaauaa

SEQ ID NO: 1093065 - RNA, 19 nt, Homo sapiens
ccagcaucucccaguucau

SEQ ID NO: 1093066 - RNA, 15 nt, Homo sapiens
ccaucuuugucaguu

SEQ ID NO: 1093067 - RNA, 22 nt, Homo sapiens
ccaugcaauaauacaacuauca

SEQ ID NO: 1093068 - RNA, 21 nt, Homo sapiens
ccauggggcugauuguauuua

SEQ ID NO: 1093069 - RNA, 15 nt, Homo sapiens
ccauugguguugaca

SEQ ID NO: 1093070 - RNA, 22 nt, Homo sapiens
cccaagaguggccgcggcuuug

SEQ ID NO: 1093071 - RNA, 14 nt, Homo sapiens
cccacagcuguaug

SEQ ID NO: 1093072 - RNA, 20 nt, Homo sapiens
cccacuaaaagaauugugac

SEQ ID NO: 1093073 - RNA, 14 nt, Homo sapiens
cccacuuggcauca

SEQ ID NO: 1093074 - RNA, 14 nt, Homo sapiens
cccagaacugagga

SEQ ID NO: 1093075 - RNA, 12 nt, Homo sapiens
cccagcacuuug

SEQ ID NO: 1093076 - RNA, 21 nt, Homo sapiens
cccagcugacgcgacuaucau

SEQ ID NO: 1093077 - RNA, 16 nt, Homo sapiens
cccaggcuggucuuga

SEQ ID NO: 1093078 - RNA, 20 nt, Homo sapiens
cccccuccaaagucuugaua

SEQ ID NO: 1093079 - RNA, 12 nt, Homo sapiens
ccccuacaucaa

SEQ ID NO: 1093080 - RNA, 20 nt, Homo sapiens
ccccuacaucaaaugcucaa

SEQ ID NO: 1093081 - RNA, 21 nt, Homo sapiens
ccccuacaucaaaugcucaag

SEQ ID NO: 1093082 - RNA, 22 nt, Homo sapiens
cccuacaucaaaugcucaagcc

SEQ ID NO: 1093083 - RNA, 20 nt, Homo sapiens
cccucaacugacaugaaaua

SEQ ID NO: 1093084 - RNA, 11 nt, Homo sapiens
cccugccauca

SEQ ID NO: 1093085 - RNA, 15 nt, Homo sapiens
ccgagugaggccaua

SEQ ID NO: 1093086 - RNA, 12 nt, Homo sapiens
ccgccugucaau

SEQ ID NO: 1093087 - RNA, 18 nt, Homo sapiens
ccguacgacucuuuucca

SEQ ID NO: 1093088 - RNA, 13 nt, Homo sapiens
ccuaaaaugcuuc

SEQ ID NO: 1093089 - RNA, 17 nt, Homo sapiens
ccuaauuccacacccuc

SEQ ID NO: 1093090 - RNA, 17 nt, Homo sapiens
ccuacaucaaaugcuca

SEQ ID NO: 1093091 - RNA, 19 nt, Homo sapiens
ccuacaucaaaugcucaag

SEQ ID NO: 1093092 - RNA, 23 nt, Homo sapiens
ccuagauaugaauauauggcauu

SEQ ID NO: 1093093 - RNA, 13 nt, Homo sapiens
ccuaugccuucaa

SEQ ID NO: 1093094 - RNA, 21 nt, Homo sapiens
ccuaugccuucaaauaguaua

SEQ ID NO: 1093095 - RNA, 17 nt, Homo sapiens
ccucaacugacaugaaa

SEQ ID NO: 1093096 - RNA, 23 nt, Homo sapiens
ccucagaaaacaaggaugaauua

SEQ ID NO: 1093097 - RNA, 15 nt, Homo sapiens
ccuccugucccucau

SEQ ID NO: 1093098 - RNA, 19 nt, Homo sapiens
ccucuaaauuuccauaucc

SEQ ID NO: 1093099 - RNA, 16 nt, Homo sapiens
ccucuauuaguuucaa

SEQ ID NO: 1093100 - RNA, 17 nt, Homo sapiens
ccucuuggcugccuugu

SEQ ID NO: 1093101 - RNA, 19 nt, Homo sapiens
ccugcccaauaaagcuuga

SEQ ID NO: 1093102 - RNA, 13 nt, Homo sapiens
ccugcccagacaa

SEQ ID NO: 1093103 - RNA, 15 nt, Homo sapiens
ccuuaaggaaaagua

SEQ ID NO: 1093104 - RNA, 18 nt, Homo sapiens
ccuucuggggcuuugcca

SEQ ID NO: 1093105 - RNA, 20 nt, Homo sapiens
ccuucuggggcuuugccauu

SEQ ID NO: 1093106 - RNA, 22 nt, Homo sapiens
ccuugcaagcuaauucuuugac

SEQ ID NO: 1093107 - RNA, 17 nt, Homo sapiens
ccuuuccccucccucag

SEQ ID NO: 1093108 - RNA, 14 nt, Homo sapiens
cgacuguuuuccca

SEQ ID NO: 1093109 - RNA, 11 nt, Homo sapiens
cgcauagcacu

SEQ ID NO: 1093110 - RNA, 21 nt, Homo sapiens
cgccugucaauaaauguugaa

SEQ ID NO: 1093111 - RNA, 14 nt, Homo sapiens
cggugacaaauggc

SEQ ID NO: 1093112 - RNA, 20 nt, Homo sapiens
cguagccacgcacagccaga

SEQ ID NO: 1093113 - RNA, 19 nt, Homo sapiens
cuaaaauguagaaauucua

SEQ ID NO: 1093114 - RNA, 16 nt, Homo sapiens
cuaaggcuuggaaaca

SEQ ID NO: 1093115 - RNA, 19 nt, Homo sapiens
cuaaggcuuggaaacagaa

SEQ ID NO: 1093116 - RNA, 18 nt, Homo sapiens
cuaaugaaagugaugaca

SEQ ID NO: 1093117 - RNA, 23 nt, Homo sapiens
cuaauguguggaaugugcagauu

SEQ ID NO: 1093118 - RNA, 17 nt, Homo sapiens
cuacaucaaaugcucaa

SEQ ID NO: 1093119 - RNA, 16 nt, Homo sapiens
cuacauugugcaauug

SEQ ID NO: 1093120 - RNA, 19 nt, Homo sapiens
cuagauguccaagugccac

SEQ ID NO: 1093121 - RNA, 17 nt, Homo sapiens
cuaguugaucagcuuau

SEQ ID NO: 1093122 - RNA, 17 nt, Homo sapiens
cuaucguuauuauaaau

SEQ ID NO: 1093123 - RNA, 19 nt, Homo sapiens
cuauuaauuccaugugaua

SEQ ID NO: 1093124 - RNA, 15 nt, Homo sapiens
cuauuacagaaauuc

SEQ ID NO: 1093125 - RNA, 22 nt, Homo sapiens
cucaagugauccuccugacuca

SEQ ID NO: 1093126 - RNA, 23 nt, Homo sapiens
cucaauauauaguuagcuuuauu

SEQ ID NO: 1093127 - RNA, 15 nt, Homo sapiens
cucagaucauuauca

SEQ ID NO: 1093128 - RNA, 19 nt, Homo sapiens
cucaggcauggaugaauaa

SEQ ID NO: 1093129 - RNA, 19 nt, Homo sapiens
cucauggaauuggagcucg

SEQ ID NO: 1093130 - RNA, 18 nt, Homo sapiens
cuccaacuuuauuuugaa

SEQ ID NO: 1093131 - RNA, 17 nt, Homo sapiens
cuccaaggcaguggaaa

SEQ ID NO: 1093132 - RNA, 20 nt, Homo sapiens
cuccagaaauuuaccacaaa

SEQ ID NO: 1093133 - RNA, 14 nt, Homo sapiens
cucccaaacucagg

SEQ ID NO: 1093134 - RNA, 15 nt, Homo sapiens
cucgugggacaguca

SEQ ID NO: 1093135 - RNA, 20 nt, Homo sapiens
cucuacucuggagguuuguu

SEQ ID NO: 1093136 - RNA, 14 nt, Homo sapiens
cucuauuuacuucu

SEQ ID NO: 1093137 - RNA, 23 nt, Homo sapiens
cucucgcaagggaaguccuugca

SEQ ID NO: 1093138 - RNA, 12 nt, Homo sapiens
cucuuuaccucc

SEQ ID NO: 1093139 - RNA, 17 nt, Homo sapiens
cucuuuauucuggaguc

SEQ ID NO: 1093140 - RNA, 15 nt, Homo sapiens
cugaaaaaggacuuu

SEQ ID NO: 1093141 - RNA, 21 nt, Homo sapiens
cugaaccuuucaaaauggaaa

SEQ ID NO: 1093142 - RNA, 15 nt, Homo sapiens
cugaacgcacaugac

SEQ ID NO: 1093143 - RNA, 11 nt, Homo sapiens
cugaagggaau

SEQ ID NO: 1093144 - RNA, 14 nt, Homo sapiens
cugaaggugcaguu

SEQ ID NO: 1093145 - RNA, 23 nt, Homo sapiens
cugagcagguguucuucauuacc

SEQ ID NO: 1093146 - RNA, 21 nt, Homo sapiens
cugaggccaggggagacauca

SEQ ID NO: 1093147 - RNA, 14 nt, Homo sapiens
cugauccuugcacg

SEQ ID NO: 1093148 - RNA, 15 nt, Homo sapiens
cugauccuugcacgc

SEQ ID NO: 1093149 - RNA, 17 nt, Homo sapiens
cugcccagacaagauuu

SEQ ID NO: 1093150 - RNA, 20 nt, Homo sapiens
cugccuggagugcugugcug

SEQ ID NO: 1093151 - RNA, 18 nt, Homo sapiens
cugcuugguagcacuuua

SEQ ID NO: 1093152 - RNA, 18 nt, Homo sapiens
cugcuuuuuuucagggaa

SEQ ID NO: 1093153 - RNA, 19 nt, Homo sapiens
cuggcagagauucugguac

SEQ ID NO: 1093154 - RNA, 19 nt, Homo sapiens
cugggaccaucacccagau

SEQ ID NO: 1093155 - RNA, 14 nt, Homo sapiens
cugggggaaaaagc

SEQ ID NO: 1093156 - RNA, 18 nt, Homo sapiens
cuguagcaauuggauaga

SEQ ID NO: 1093157 - RNA, 14 nt, Homo sapiens
cuguauuucauucu

SEQ ID NO: 1093158 - RNA, 18 nt, Homo sapiens
cugucauauaauuuugaa

SEQ ID NO: 1093159 - RNA, 22 nt, Homo sapiens
cuguccuugaaugccauaguca

SEQ ID NO: 1093160 - RNA, 13 nt, Homo sapiens
cugucuacacuaa

SEQ ID NO: 1093161 - RNA, 19 nt, Homo sapiens
ucuauggguuggacaaccu

SEQ ID NO: 1093162 - RNA, 13 nt, Homo sapiens
ucuauuaguuuca

SEQ ID NO: 1093163 - RNA, 19 nt, Homo sapiens
ucucaggacccgcccaaga

SEQ ID NO: 1093164 - RNA, 17 nt, Homo sapiens
ucucaugaccaaaugcu

SEQ ID NO: 1093165 - RNA, 23 nt, Homo sapiens
ucuccuaaacugaacacaugacu

SEQ ID NO: 1093166 - RNA, 16 nt, Homo sapiens
ucucucgcaagggaag

SEQ ID NO: 1093167 - RNA, 17 nt, Homo sapiens
ucugaaggagagagucu

SEQ ID NO: 1093168 - RNA, 14 nt, Homo sapiens
ucugaguauugaau

SEQ ID NO: 1093169 - RNA, 22 nt, Homo sapiens
ucugccuggagugcugugcugu

SEQ ID NO: 1093170 - RNA, 14 nt, Homo sapiens
ucuggcagagauuc

SEQ ID NO: 1093171 - RNA, 23 nt, Homo sapiens
ucuguauuugcucccguggagcu

SEQ ID NO: 1093172 - RNA, 15 nt, Homo sapiens
ucuuaacacugaaac

SEQ ID NO: 1093173 - RNA, 12 nt, Homo sapiens
ucuucauuaccu

SEQ ID NO: 1093174 - RNA, 16 nt, Homo sapiens
ucuugcuaauucucag

SEQ ID NO: 1093175 - RNA, 18 nt, Homo sapiens
ucuugcuauguugcccag

SEQ ID NO: 1093176 - RNA, 17 nt, Homo sapiens
ucuuguuuuaagcaaau

SEQ ID NO: 1093177 - RNA, 18 nt, Homo sapiens
ucuuuuacuagucuuuca

SEQ ID NO: 1093178 - RNA, 12 nt, Homo sapiens
ucuuuuaucuag

SEQ ID NO: 1093179 - RNA, 14 nt, Homo sapiens
ucuuuugucccaga

SEQ ID NO: 1093180 - RNA, 20 nt, Homo sapiens
ugaaaauguaucugaguauu

SEQ ID NO: 1093181 - RNA, 16 nt, Homo sapiens
ugaaaguagcuguaug

SEQ ID NO: 1093182 - RNA, 15 nt, Homo sapiens
ugaaaucucuagccu

SEQ ID NO: 1093183 - RNA, 19 nt, Homo sapiens
ugaaccaccuguguagucu

SEQ ID NO: 1093184 - RNA, 19 nt, Homo sapiens
ugaacuauuagagcugccu

SEQ ID NO: 1093185 - RNA, 15 nt, Homo sapiens
ugaaggugcaguuga

SEQ ID NO: 1093186 - RNA, 15 nt, Homo sapiens
ugaagucuucuuauc

SEQ ID NO: 1093187 - RNA, 18 nt, Homo sapiens
ugacagcuguauauugcu

SEQ ID NO: 1093188 - RNA, 14 nt, Homo sapiens
ugacauagcacuug

SEQ ID NO: 1093189 - RNA, 17 nt, Homo sapiens
ugacauagcacuugccg

SEQ ID NO: 1093190 - RNA, 15 nt, Homo sapiens
ugaccuuacaaaagu

SEQ ID NO: 1093191 - RNA, 18 nt, Homo sapiens
ugagaagccagcuuuccu

SEQ ID NO: 1093192 - RNA, 19 nt, Homo sapiens
ugagagacacacugaagaa

SEQ ID NO: 1093193 - RNA, 19 nt, Homo sapiens
ugagaguuuucuaaaguau

SEQ ID NO: 1093194 - RNA, 15 nt, Homo sapiens
ugaggccaggggaga

SEQ ID NO: 1093195 - RNA, 20 nt, Homo sapiens
ugagggugacuauggagcug

SEQ ID NO: 1093196 - RNA, 15 nt, Homo sapiens
ugauaauucagucuu

SEQ ID NO: 1093197 - RNA, 23 nt, Homo sapiens
ugaucagcuuauugucuagugaa

SEQ ID NO: 1093198 - RNA, 14 nt, Homo sapiens
ugauuuaguugcau

SEQ ID NO: 1093199 - RNA, 16 nt, Homo sapiens
ugcaauugauauugcc

SEQ ID NO: 1093200 - RNA, 22 nt, Homo sapiens
ugcaggcucccaaacucaggcu

SEQ ID NO: 1093201 - RNA, 13 nt, Homo sapiens
ugcaucaugaguu

SEQ ID NO: 1093202 - RNA, 17 nt, Homo sapiens
ugccauagucaaagaga

SEQ ID NO: 1093203 - RNA, 14 nt, Homo sapiens
ugcccagacaagau

SEQ ID NO: 1093204 - RNA, 19 nt, Homo sapiens
ugcccagagugacagcugu

SEQ ID NO: 1093205 - RNA, 22 nt, Homo sapiens
ugcccgcccgcccgcauagcac

SEQ ID NO: 1093206 - RNA, 15 nt, Homo sapiens
ugccugagaauguua

SEQ ID NO: 1093207 - RNA, 15 nt, Homo sapiens
ugcggccugagauau

SEQ ID NO: 1093208 - RNA, 16 nt, Homo sapiens
ugcggugacaaauggc

SEQ ID NO: 1093209 - RNA, 16 nt, Homo sapiens
ugcuacgaagaaagac

SEQ ID NO: 1093210 - RNA, 23 nt, Homo sapiens
ugcuaguaauuggaaaggcagcu

SEQ ID NO: 1093211 - RNA, 12 nt, Homo sapiens
ugcuauugugau

SEQ ID NO: 1093212 - RNA, 16 nt, Homo sapiens
ugcucugaugcagugc

SEQ ID NO: 1093213 - RNA, 15 nt, Homo sapiens
ugcuguauccaucca

SEQ ID NO: 1093214 - RNA, 18 nt, Homo sapiens
ugcuguauccauccaugg

SEQ ID NO: 1093215 - RNA, 18 nt, Homo sapiens
ugcuguugugcagugugc

SEQ ID NO: 1093216 - RNA, 23 nt, Homo sapiens
ugcuuagcuugagggugacuaug

SEQ ID NO: 1093217 - RNA, 14 nt, Homo sapiens
uggaaaauauacaa

SEQ ID NO: 1093218 - RNA, 21 nt, Homo sapiens
uggaaauguccaagcuaugua

SEQ ID NO: 1093219 - RNA, 15 nt, Homo sapiens
uggaaguccagaaca

SEQ ID NO: 1093220 - RNA, 22 nt, Homo sapiens
uggaaugaaaaauaaacauucu

SEQ ID NO: 1093221 - RNA, 18 nt, Homo sapiens
uggaaugauuuuggugga

SEQ ID NO: 1093222 - RNA, 15 nt, Homo sapiens
uggacuacaggacaa

SEQ ID NO: 1093223 - RNA, 16 nt, Homo sapiens
uggagaaaagcacuua

SEQ ID NO: 1093224 - RNA, 17 nt, Homo sapiens
uggagcucgugggacag

SEQ ID NO: 1093225 - RNA, 14 nt, Homo sapiens
uggauucacaccca

SEQ ID NO: 1093226 - RNA, 23 nt, Homo sapiens
uggcacuaguauuucuaugaaau

SEQ ID NO: 1093227 - RNA, 14 nt, Homo sapiens
uggcaggacacugc

SEQ ID NO: 1093228 - RNA, 15 nt, Homo sapiens
uggcccuucuuucag

SEQ ID NO: 1093229 - RNA, 18 nt, Homo sapiens
uggccuccaauucugacc

SEQ ID NO: 1093230 - RNA, 22 nt, Homo sapiens
uggcuugggccucugacaugac

SEQ ID NO: 1093231 - RNA, 20 nt, Homo sapiens
ugggacauuugcucauggaa

SEQ ID NO: 1093232 - RNA, 17 nt, Homo sapiens
ugggaucgcauugcaua

SEQ ID NO: 1093233 - RNA, 18 nt, Homo sapiens
ugggcaggguacagacac

SEQ ID NO: 1093234 - RNA, 15 nt, Homo sapiens
ugggcugaguacagu

SEQ ID NO: 1093235 - RNA, 15 nt, Homo sapiens
uggggcugauuguau

SEQ ID NO: 1093236 - RNA, 23 nt, Homo sapiens
ugguaccaccagucugacuguuu

SEQ ID NO: 1093237 - RNA, 13 nt, Homo sapiens
uggugcucauuua

SEQ ID NO: 1093238 - RNA, 14 nt, Homo sapiens
uggugcucauuuaa

SEQ ID NO: 1093239 - RNA, 22 nt, Homo sapiens
ugguucucaacagacccaguga

SEQ ID NO: 1093240 - RNA, 23 nt, Homo sapiens
ugguuuauuugcaguaauuugca

SEQ ID NO: 1093241 - RNA, 18 nt, Homo sapiens
uguaauuuaaaauuguga

SEQ ID NO: 1093242 - RNA, 17 nt, Homo sapiens
uguagucccagcacuuu

SEQ ID NO: 1093243 - RNA, 19 nt, Homo sapiens
uguagucucagcuacuuag

SEQ ID NO: 1093244 - RNA, 20 nt, Homo sapiens
uguauaacuuguauuauuag

SEQ ID NO: 1093245 - RNA, 14 nt, Homo sapiens
uguauccauccaug

SEQ ID NO: 1093246 - RNA, 19 nt, Homo sapiens
uguauccauccauggggcu

SEQ ID NO: 1093247 - RNA, 20 nt, Homo sapiens
uguauuuaccuucuaccucu

SEQ ID NO: 1093248 - RNA, 17 nt, Homo sapiens
uguccaagcuauguauu

SEQ ID NO: 1093249 - RNA, 21 nt, Homo sapiens
ugucccagaaugccuccugca

SEQ ID NO: 1093250 - RNA, 15 nt, Homo sapiens
ugucccucauccaua

SEQ ID NO: 1093251 - RNA, 17 nt, Homo sapiens
uguccuugaaugccaua

SEQ ID NO: 1093252 - RNA, 17 nt, Homo sapiens
ugucguaguuacucuca

SEQ ID NO: 1093253 - RNA, 19 nt, Homo sapiens
ugucuuuguugaaguauuu

SEQ ID NO: 1093254 - RNA, 13 nt, Homo sapiens
ugugaaguuacau

SEQ ID NO: 1093255 - RNA, 16 nt, Homo sapiens
ugugauggcaaagaag

SEQ ID NO: 1093256 - RNA, 14 nt, Homo sapiens
ugugauguguccug

SEQ ID NO: 1093257 - RNA, 18 nt, Homo sapiens
ugugccuuggugugcugu

SEQ ID NO: 1093258 - RNA, 22 nt, Homo sapiens
uguguguauucuuaaaaugcaa

SEQ ID NO: 1093259 - RNA, 20 nt, Homo sapiens
uguguucacuacauugugca

SEQ ID NO: 1093260 - RNA, 21 nt, Homo sapiens
uguuaaaacugggacagggga

SEQ ID NO: 1093261 - RNA, 17 nt, Homo sapiens
uguuaaaauacauaacu

SEQ ID NO: 1093262 - RNA, 14 nt, Homo sapiens
uguuaagauuuauc

SEQ ID NO: 1093263 - RNA, 17 nt, Homo sapiens
uguuaguucuagcucua

SEQ ID NO: 1093264 - RNA, 17 nt, Homo sapiens
uguuccaggauguggaa

SEQ ID NO: 1093265 - RNA, 15 nt, Homo sapiens
uguugaguauuugcu

SEQ ID NO: 1093266 - RNA, 15 nt, Homo sapiens
uuaaaauguauuuac

SEQ ID NO: 1093267 - RNA, 17 nt, Homo sapiens
uuaaacuuuagaauucc

SEQ ID NO: 1093268 - RNA, 12 nt, Homo sapiens
uuaaagaaugca

SEQ ID NO: 1093269 - RNA, 20 nt, Homo sapiens
uuaaauaagauuuaauucac

SEQ ID NO: 1093270 - RNA, 16 nt, Homo sapiens
uuaacaacccuguuga

SEQ ID NO: 1093271 - RNA, 11 nt, Homo sapiens
uuaacuaugaa

SEQ ID NO: 1093272 - RNA, 18 nt, Homo sapiens
uuaacucacacugcccag

SEQ ID NO: 1093273 - RNA, 16 nt, Homo sapiens
uuaagugaaaaucuga

SEQ ID NO: 1093274 - RNA, 15 nt, Homo sapiens
uuaauaaguauaucu

SEQ ID NO: 1093275 - RNA, 19 nt, Homo sapiens
uuaaugucugacuguuaau

SEQ ID NO: 1093276 - RNA, 18 nt, Homo sapiens
uuacaaucgagacugcaa

SEQ ID NO: 1093277 - RNA, 23 nt, Homo sapiens
uuacaaucgagacugcaauguga

SEQ ID NO: 1093278 - RNA, 14 nt, Homo sapiens
uuacauacuauucu

SEQ ID NO: 1093279 - RNA, 18 nt, Homo sapiens
uuacucucaggcauggau

SEQ ID NO: 1093280 - RNA, 23 nt, Homo sapiens
uuagaaaauaaaauuuaacucac

SEQ ID NO: 1093281 - RNA, 20 nt, Homo sapiens
uuagagcugccugugccuuu

SEQ ID NO: 1093282 - RNA, 12 nt, Homo sapiens
uuagaugcaguu

SEQ ID NO: 1093283 - RNA, 16 nt, Homo sapiens
uuagcuacaaaugccu

SEQ ID NO: 1093284 - RNA, 21 nt, Homo sapiens
uuagcugcacuguuuauggaa

SEQ ID NO: 1093285 - RNA, 16 nt, Homo sapiens
uuaguugcaugauuag

SEQ ID NO: 1093286 - RNA, 22 nt, Homo sapiens
uuaguugggcauaguggcacuu

SEQ ID NO: 1093287 - RNA, 18 nt, Homo sapiens
aaaacagcuauuuuagua

SEQ ID NO: 1093288 - RNA, 18 nt, Homo sapiens
aaaacauugaaguauuag

SEQ ID NO: 1093289 - RNA, 22 nt, Homo sapiens
aaaaccauaaacauuugccaaa

SEQ ID NO: 1093290 - RNA, 13 nt, Homo sapiens
aaaacugcauuuu

SEQ ID NO: 1093291 - RNA, 13 nt, Homo sapiens
aaaagaaggaaaa

SEQ ID NO: 1093292 - RNA, 18 nt, Homo sapiens
aaaagagacaaacuguaa

SEQ ID NO: 1093293 - RNA, 14 nt, Homo sapiens
aaaagcuucaggga

SEQ ID NO: 1093294 - RNA, 15 nt, Homo sapiens
aaaaguaaaccacaa

SEQ ID NO: 1093295 - RNA, 13 nt, Homo sapiens
aaaaugcuuuguu

SEQ ID NO: 1093296 - RNA, 21 nt, Homo sapiens
aaaaugugaguaguacaauga

SEQ ID NO: 1093297 - RNA, 16 nt, Homo sapiens
aaaauucuggacacau

SEQ ID NO: 1093298 - RNA, 24 nt, Homo sapiens
aaaauuggauuacaguauggcaau

SEQ ID NO: 1093299 - RNA, 13 nt, Homo sapiens
aaacaauuucacc

SEQ ID NO: 1093300 - RNA, 19 nt, Homo sapiens
aaacaccgagugaggccau

SEQ ID NO: 1093301 - RNA, 23 nt, Homo sapiens
aaacaccgagugaggccauagca

SEQ ID NO: 1093302 - RNA, 13 nt, Homo sapiens
aaacagaacugga

SEQ ID NO: 1093303 - RNA, 16 nt, Homo sapiens
aaacagauuacuagaa

SEQ ID NO: 1093304 - RNA, 14 nt, Homo sapiens
aaacuaagauuuau

SEQ ID NO: 1093305 - RNA, 17 nt, Homo sapiens
aaacuacugaacuguua

SEQ ID NO: 1093306 - RNA, 13 nt, Homo sapiens
aaacuguucuuca

SEQ ID NO: 1093307 - RNA, 16 nt, Homo sapiens
aaacuuuaucgcucua

SEQ ID NO: 1093308 - RNA, 18 nt, Homo sapiens
aaagaacgcugcagcuuu

SEQ ID NO: 1093309 - RNA, 19 nt, Homo sapiens
aaagaacgcugcagcuuuu

SEQ ID NO: 1093310 - RNA, 16 nt, Homo sapiens
aaagaauugugacaua

SEQ ID NO: 1093311 - RNA, 18 nt, Homo sapiens
aaagacacccugucugca

SEQ ID NO: 1093312 - RNA, 21 nt, Homo sapiens
aaagacacccugucugcagca

SEQ ID NO: 1093313 - RNA, 22 nt, Homo sapiens
aaagauucuuuaaacuacugaa

SEQ ID NO: 1093314 - RNA, 16 nt, Homo sapiens
aaagcaccaugacuuu

SEQ ID NO: 1093315 - RNA, 14 nt, Homo sapiens
aaagcuucagggaa

SEQ ID NO: 1093316 - RNA, 17 nt, Homo sapiens
aaaguaaaaauuuugac

SEQ ID NO: 1093317 - RNA, 16 nt, Homo sapiens
aaaguaaugguucuca

SEQ ID NO: 1093318 - RNA, 17 nt, Homo sapiens
aaagucaccugcccaau

SEQ ID NO: 1093319 - RNA, 21 nt, Homo sapiens
aaauaaacagauacauucaca

SEQ ID NO: 1093320 - RNA, 21 nt, Homo sapiens
aaauaaaguacuaaaucucac

SEQ ID NO: 1093321 - RNA, 14 nt, Homo sapiens
aaauauacaaguaa

SEQ ID NO: 1093322 - RNA, 21 nt, Homo sapiens
aaauauuaguuacuugcuaua

SEQ ID NO: 1093323 - RNA, 23 nt, Homo sapiens
aaauauuuuaucuuuuagcuaga

SEQ ID NO: 1093324 - RNA, 19 nt, Homo sapiens
aaaucuccagcuuacuaua

SEQ ID NO: 1093325 - RNA, 17 nt, Homo sapiens
aaauggaugcggugaca

SEQ ID NO: 1093326 - RNA, 16 nt, Homo sapiens
aaaugucuguauuuca

SEQ ID NO: 1093327 - RNA, 19 nt, Homo sapiens
aaauguuauagcugcauuu

SEQ ID NO: 1093328 - RNA, 13 nt, Homo sapiens
aaauuaauucuaa

SEQ ID NO: 1093329 - RNA, 13 nt, Homo sapiens
aaauuauuugcag

SEQ ID NO: 1093330 - RNA, 17 nt, Homo sapiens
aaauucuggacacauua

SEQ ID NO: 1093331 - RNA, 21 nt, Homo sapiens
aaauuggucaggaacuauuaa

SEQ ID NO: 1093332 - RNA, 13 nt, Homo sapiens
aaauuuaugugau

SEQ ID NO: 1093333 - RNA, 15 nt, Homo sapiens
aaauuuuacauaugu

SEQ ID NO: 1093334 - RNA, 13 nt, Homo sapiens
aacaaaugcauca

SEQ ID NO: 1093335 - RNA, 21 nt, Homo sapiens
aacaacccuguugaguauuug

SEQ ID NO: 1093336 - RNA, 22 nt, Homo sapiens
aauuuaaauaagauuuaauuca

SEQ ID NO: 1093337 - RNA, 20 nt, Homo sapiens
aauuuaccacaaaagcaaaa

SEQ ID NO: 1093338 - RNA, 12 nt, Homo sapiens
aauuugcaauuu

SEQ ID NO: 1093339 - RNA, 18 nt, Homo sapiens
aauuuuacauaugucacu

SEQ ID NO: 1093340 - RNA, 17 nt, Homo sapiens
aauuuuauuuacauucu

SEQ ID NO: 1093341 - RNA, 15 nt, Homo sapiens
aauuuugucauauac

SEQ ID NO: 1093342 - RNA, 17 nt, Homo sapiens
aauuuugucauauaccc

SEQ ID NO: 1093343 - RNA, 17 nt, Homo sapiens
aauuuuuuaaacuguag

SEQ ID NO: 1093344 - RNA, 22 nt, Homo sapiens
acaaauggcagcuuagcuacaa

SEQ ID NO: 1093345 - RNA, 12 nt, Homo sapiens
acaaaugggaau

SEQ ID NO: 1093346 - RNA, 15 nt, Homo sapiens
acaagggauuaucac

SEQ ID NO: 1093347 - RNA, 20 nt, Homo sapiens
acaaugauacaguugcaugu

SEQ ID NO: 1093348 - RNA, 13 nt, Homo sapiens
acaaugcuguauu

SEQ ID NO: 1093349 - RNA, 17 nt, Homo sapiens
acaauugucauguaugu

SEQ ID NO: 1093350 - RNA, 21 nt, Homo sapiens
acaauuucaaaagaacauucu

SEQ ID NO: 1093351 - RNA, 17 nt, Homo sapiens
acacacaugaaguccaa

SEQ ID NO: 1093352 - RNA, 18 nt, Homo sapiens
acacaguauuaugacacu

SEQ ID NO: 1093353 - RNA, 16 nt, Homo sapiens
acacauaaaagcacaa

SEQ ID NO: 1093354 - RNA, 14 nt, Homo sapiens
acacauuucaucua

SEQ ID NO: 1093355 - RNA, 20 nt, Homo sapiens
acaccaagugaggccauagc

SEQ ID NO: 1093356 - RNA, 17 nt, Homo sapiens
acaccgagugaggccau

SEQ ID NO: 1093357 - RNA, 15 nt, Homo sapiens
acaccuaagcccaaa

SEQ ID NO: 1093358 - RNA, 20 nt, Homo sapiens
acacucccacuuggcaucau

SEQ ID NO: 1093359 - RNA, 14 nt, Homo sapiens
acagaaccugcaaa

SEQ ID NO: 1093360 - RNA, 20 nt, Homo sapiens
acagacacucccacuuggca

SEQ ID NO: 1093361 - RNA, 23 nt, Homo sapiens
acagacacucccacuuggcauca

SEQ ID NO: 1093362 - RNA, 16 nt, Homo sapiens
acagaccuuugaacua

SEQ ID NO: 1093363 - RNA, 17 nt, Homo sapiens
acagacucuucuugcaa

SEQ ID NO: 1093364 - RNA, 18 nt, Homo sapiens
acagaguuuuguaacaaa

SEQ ID NO: 1093365 - RNA, 17 nt, Homo sapiens
acagcaaaccaaugcua

SEQ ID NO: 1093366 - RNA, 16 nt, Homo sapiens
acagcuucauagagca

SEQ ID NO: 1093367 - RNA, 22 nt, Homo sapiens
acaggacagcccuucuuuccac

SEQ ID NO: 1093368 - RNA, 15 nt, Homo sapiens
acagggaacagcaaa

SEQ ID NO: 1093369 - RNA, 14 nt, Homo sapiens
acaguuggcacuuc

SEQ ID NO: 1093370 - RNA, 15 nt, Homo sapiens
acauaaaagcacaaa

SEQ ID NO: 1093371 - RNA, 18 nt, Homo sapiens
acauaacgcugacugcaa

SEQ ID NO: 1093372 - RNA, 15 nt, Homo sapiens
acauacauccaacau

SEQ ID NO: 1093373 - RNA, 22 nt, Homo sapiens
acauaccuggcccugugccuug

SEQ ID NO: 1093374 - RNA, 16 nt, Homo sapiens
acauaugucacuggga

SEQ ID NO: 1093375 - RNA, 15 nt, Homo sapiens
acaucacaaccucca

SEQ ID NO: 1093376 - RNA, 15 nt, Homo sapiens
acaucgcaaccucca

SEQ ID NO: 1093377 - RNA, 16 nt, Homo sapiens
acaugaaauacuuuaa

SEQ ID NO: 1093378 - RNA, 16 nt, Homo sapiens
acaugcuugcauuaua

SEQ ID NO: 1093379 - RNA, 20 nt, Homo sapiens
acauuaacucaggcauuuca

SEQ ID NO: 1093380 - RNA, 21 nt, Homo sapiens
acauuaacucaggcauuucau

SEQ ID NO: 1093381 - RNA, 14 nt, Homo sapiens
acauuagugaauua

SEQ ID NO: 1093382 - RNA, 22 nt, Homo sapiens
acauugugcaauugauauugcc

SEQ ID NO: 1093383 - RNA, 23 nt, Homo sapiens
acauuuauguaauuuuauuuaca

SEQ ID NO: 1093384 - RNA, 15 nt, Homo sapiens
acauuugcucaugga

SEQ ID NO: 1093385 - RNA, 12 nt, Homo sapiens
acauuuguucca

SEQ ID NO: 1093386 - RNA, 14 nt, Homo sapiens
acauuuguuccaug

SEQ ID NO: 1093387 - RNA, 15 nt, Homo sapiens
accaaucaugaauua

SEQ ID NO: 1093388 - RNA, 16 nt, Homo sapiens
accacaaaagcaaaau

SEQ ID NO: 1093389 - RNA, 13 nt, Homo sapiens
accagguaugacc

SEQ ID NO: 1093390 - RNA, 17 nt, Homo sapiens
accaucucuuuaccucc

SEQ ID NO: 1093391 - RNA, 21 nt, Homo sapiens
accaugaggauaaaaccuccu

SEQ ID NO: 1093392 - RNA, 17 nt, Homo sapiens
accaugucguaguuacu

SEQ ID NO: 1093393 - RNA, 12 nt, Homo sapiens
acccagcaaaac

SEQ ID NO: 1093394 - RNA, 22 nt, Homo sapiens
acccagcugacgcgacuaucau

SEQ ID NO: 1093395 - RNA, 12 nt, Homo sapiens
acccccagcugg

SEQ ID NO: 1093396 - RNA, 22 nt, Homo sapiens
acccuuaggccagcaccaucuc

SEQ ID NO: 1093397 - RNA, 12 nt, Homo sapiens
accuacauuuga

SEQ ID NO: 1093398 - RNA, 16 nt, Homo sapiens
augucuauuauuauga

SEQ ID NO: 1093399 - RNA, 22 nt, Homo sapiens
augucugcuucuuccccagccu

SEQ ID NO: 1093400 - RNA, 23 nt, Homo sapiens
augucuguauuucauucuuguug

SEQ ID NO: 1093401 - RNA, 15 nt, Homo sapiens
augugaaaauguauc

SEQ ID NO: 1093402 - RNA, 21 nt, Homo sapiens
augugggggucuguguguuua

SEQ ID NO: 1093403 - RNA, 16 nt, Homo sapiens
auguguguguguugug

SEQ ID NO: 1093404 - RNA, 20 nt, Homo sapiens
auguugguguggaguuuuca

SEQ ID NO: 1093405 - RNA, 19 nt, Homo sapiens
auguuuauguucuuauaga

SEQ ID NO: 1093406 - RNA, 15 nt, Homo sapiens
auuaauuccauguga

SEQ ID NO: 1093407 - RNA, 20 nt, Homo sapiens
auuacuagaaauauuuaacu

SEQ ID NO: 1093408 - RNA, 16 nt, Homo sapiens
auuagaauaccacagg

SEQ ID NO: 1093409 - RNA, 17 nt, Homo sapiens
auuaguuacuugcuaua

SEQ ID NO: 1093410 - RNA, 15 nt, Homo sapiens
auuaguugcuuuguu

SEQ ID NO: 1093411 - RNA, 16 nt, Homo sapiens
auucacacccagcuga

SEQ ID NO: 1093412 - RNA, 14 nt, Homo sapiens
auucccagccagca

SEQ ID NO: 1093413 - RNA, 14 nt, Homo sapiens
auucugguauauag

SEQ ID NO: 1093414 - RNA, 16 nt, Homo sapiens
auucuuaaaaugcaau

SEQ ID NO: 1093415 - RNA, 15 nt, Homo sapiens
auucuuugaccuguu

SEQ ID NO: 1093416 - RNA, 18 nt, Homo sapiens
auugagcuuugcauuuau

SEQ ID NO: 1093417 - RNA, 14 nt, Homo sapiens
auugccauguggac

SEQ ID NO: 1093418 - RNA, 11 nt, Homo sapiens
auugcuuuuaa

SEQ ID NO: 1093419 - RNA, 15 nt, Homo sapiens
auuggaaaggcagcu

SEQ ID NO: 1093420 - RNA, 17 nt, Homo sapiens
auuggagaaaagcacuu

SEQ ID NO: 1093421 - RNA, 14 nt, Homo sapiens
auuggggaggacua

SEQ ID NO: 1093422 - RNA, 18 nt, Homo sapiens
auugguguugacauacau

SEQ ID NO: 1093423 - RNA, 22 nt, Homo sapiens
auuguagaaagcuaauacaaaa

SEQ ID NO: 1093424 - RNA, 22 nt, Homo sapiens
auugucacagcuaccaaagugu

SEQ ID NO: 1093425 - RNA, 21 nt, Homo sapiens
auugugugaaagguacuucaa

SEQ ID NO: 1093426 - RNA, 19 nt, Homo sapiens
auuguuuaaaaaccgaaua

SEQ ID NO: 1093427 - RNA, 20 nt, Homo sapiens
auuguuuuuguugucuuuau

SEQ ID NO: 1093428 - RNA, 15 nt, Homo sapiens
auuuaaauuaucaca

SEQ ID NO: 1093429 - RNA, 15 nt, Homo sapiens
auuuaaucaguguga

SEQ ID NO: 1093430 - RNA, 21 nt, Homo sapiens
auuuaauuuuuuaaacuguag

SEQ ID NO: 1093431 - RNA, 15 nt, Homo sapiens
auuuacauguuuaua

SEQ ID NO: 1093432 - RNA, 17 nt, Homo sapiens
auuuaccacaaaagcaa

SEQ ID NO: 1093433 - RNA, 16 nt, Homo sapiens
auuuaugauuuaucua

SEQ ID NO: 1093434 - RNA, 15 nt, Homo sapiens
auuuaugguucucag

SEQ ID NO: 1093435 - RNA, 14 nt, Homo sapiens
auuugauuagggua

SEQ ID NO: 1093436 - RNA, 21 nt, Homo sapiens
auuugccaaaaauucaugccc

SEQ ID NO: 1093437 - RNA, 22 nt, Homo sapiens
auuugucaguguauaagacaca

SEQ ID NO: 1093438 - RNA, 23 nt, Homo sapiens
auuuguucucccaaaacagauua

SEQ ID NO: 1093439 - RNA, 21 nt, Homo sapiens
auuuuaucaaggaagucuuca

SEQ ID NO: 1093440 - RNA, 18 nt, Homo sapiens
auuuuauuuuucucauga

SEQ ID NO: 1093441 - RNA, 17 nt, Homo sapiens
auuuucuuuuccuuuau

SEQ ID NO: 1093442 - RNA, 16 nt, Homo sapiens
auuuugccauuuagcg

SEQ ID NO: 1093443 - RNA, 19 nt, Homo sapiens
caaaacagauuacuagaaa

SEQ ID NO: 1093444 - RNA, 21 nt, Homo sapiens
caaaacuauccuaugccuuca

SEQ ID NO: 1093445 - RNA, 20 nt, Homo sapiens
caaaauagcacauccaccaa

SEQ ID NO: 1093446 - RNA, 14 nt, Homo sapiens
caaacaguccaauc

SEQ ID NO: 1093447 - RNA, 12 nt, Homo sapiens
caaacuguaaaa

SEQ ID NO: 1093448 - RNA, 20 nt, Homo sapiens
caaauaaaguacuaaaucuc

SEQ ID NO: 1093449 - RNA, 18 nt, Homo sapiens
caaauacugacuuucaaa

SEQ ID NO: 1093450 - RNA, 18 nt, Homo sapiens
caaauauugaaugccuua

SEQ ID NO: 1093451 - RNA, 11 nt, Homo sapiens
caaaugcucaa

SEQ ID NO: 1093452 - RNA, 16 nt, Homo sapiens
caaaugcuuuuccuca

SEQ ID NO: 1093453 - RNA, 21 nt, Homo sapiens
caacauggaguaaagagcaua

SEQ ID NO: 1093454 - RNA, 16 nt, Homo sapiens
caacuaucauaccugg

SEQ ID NO: 1093455 - RNA, 18 nt, Homo sapiens
agcaggaccugccaagaa

SEQ ID NO: 1093456 - RNA, 13 nt, Homo sapiens
agcauaguggcaa

SEQ ID NO: 1093457 - RNA, 15 nt, Homo sapiens
agcauauucacuggu

SEQ ID NO: 1093458 - RNA, 19 nt, Homo sapiens
agcaucagauuuuaccuaa

SEQ ID NO: 1093459 - RNA, 22 nt, Homo sapiens
agcaucucccaguucauaauca

SEQ ID NO: 1093460 - RNA, 16 nt, Homo sapiens
agcauggucuuaugca

SEQ ID NO: 1093461 - RNA, 16 nt, Homo sapiens
agccaaacaccacuuu

SEQ ID NO: 1093462 - RNA, 17 nt, Homo sapiens
agccagaggucuggccc

SEQ ID NO: 1093463 - RNA, 11 nt, Homo sapiens
agccauaugca

SEQ ID NO: 1093464 - RNA, 12 nt, Homo sapiens
agccauaugcag

SEQ ID NO: 1093465 - RNA, 13 nt, Homo sapiens
agcccccagcugg

SEQ ID NO: 1093466 - RNA, 21 nt, Homo sapiens
agccuaggaggacugggguaa

SEQ ID NO: 1093467 - RNA, 19 nt, Homo sapiens
agccucuuagaugcaguuc

SEQ ID NO: 1093468 - RNA, 18 nt, Homo sapiens
agccugcuaaggaacaau

SEQ ID NO: 1093469 - RNA, 21 nt, Homo sapiens
agccuuggggcugaugcaguu

SEQ ID NO: 1093470 - RNA, 15 nt, Homo sapiens
agcgagaacccucaa

SEQ ID NO: 1093471 - RNA, 13 nt, Homo sapiens
agcuaccaaagug

SEQ ID NO: 1093472 - RNA, 13 nt, Homo sapiens
agcucuacucugg

SEQ ID NO: 1093473 - RNA, 16 nt, Homo sapiens
agcugaauuauuagua

SEQ ID NO: 1093474 - RNA, 18 nt, Homo sapiens
agcuggcccggccacucu

SEQ ID NO: 1093475 - RNA, 13 nt, Homo sapiens
agcuuagcuacaa

SEQ ID NO: 1093476 - RNA, 19 nt, Homo sapiens
aggaacucgcaccugugcu

SEQ ID NO: 1093477 - RNA, 16 nt, Homo sapiens
aggagaguacauggca

SEQ ID NO: 1093478 - RNA, 20 nt, Homo sapiens
aggagguugaggcugcagug

SEQ ID NO: 1093479 - RNA, 15 nt, Homo sapiens
aggagucccugccau

SEQ ID NO: 1093480 - RNA, 19 nt, Homo sapiens
aggaguggccguugcuaca

SEQ ID NO: 1093481 - RNA, 23 nt, Homo sapiens
aggaucacuugaggccaggacuu

SEQ ID NO: 1093482 - RNA, 21 nt, Homo sapiens
aggcaaauccgaaaucagcag

SEQ ID NO: 1093483 - RNA, 17 nt, Homo sapiens
aggccacagugcaauuu

SEQ ID NO: 1093484 - RNA, 15 nt, Homo sapiens
aggccagcaccaucu

SEQ ID NO: 1093485 - RNA, 18 nt, Homo sapiens
aggccaggggagacauca

SEQ ID NO: 1093486 - RNA, 13 nt, Homo sapiens
aggccauagcaac

SEQ ID NO: 1093487 - RNA, 17 nt, Homo sapiens
aggcucuguauuugcuc

SEQ ID NO: 1093488 - RNA, 12 nt, Homo sapiens
agggaacagcaa

SEQ ID NO: 1093489 - RNA, 19 nt, Homo sapiens
agggaacagcaaaccaaug

SEQ ID NO: 1093490 - RNA, 15 nt, Homo sapiens
agggaaguccuugca

SEQ ID NO: 1093491 - RNA, 20 nt, Homo sapiens
agggacaccaagccuuggcu

SEQ ID NO: 1093492 - RNA, 23 nt, Homo sapiens
agggcagggcugaggccucucau

SEQ ID NO: 1093493 - RNA, 14 nt, Homo sapiens
aggggcucucucau

SEQ ID NO: 1093494 - RNA, 15 nt, Homo sapiens
aggggcucucucaug

SEQ ID NO: 1093495 - RNA, 21 nt, Homo sapiens
aggugucuggccugaggucaa

SEQ ID NO: 1093496 - RNA, 19 nt, Homo sapiens
agguugcuguugugcagug

SEQ ID NO: 1093497 - RNA, 15 nt, Homo sapiens
aguaaugguucucau

SEQ ID NO: 1093498 - RNA, 12 nt, Homo sapiens
aguacauggcau

SEQ ID NO: 1093499 - RNA, 20 nt, Homo sapiens
aguagcaggaccugccaaga

SEQ ID NO: 1093500 - RNA, 15 nt, Homo sapiens
aguaguacaaugagu

SEQ ID NO: 1093501 - RNA, 21 nt, Homo sapiens
aguauggcaauaucuacagcu

SEQ ID NO: 1093502 - RNA, 15 nt, Homo sapiens
aguauguggaagugu

SEQ ID NO: 1093503 - RNA, 14 nt, Homo sapiens
agucaaaguaguua

SEQ ID NO: 1093504 - RNA, 14 nt, Homo sapiens
agucccagcacuuu

SEQ ID NO: 1093505 - RNA, 15 nt, Homo sapiens
agucuucaaauuuga

SEQ ID NO: 1093506 - RNA, 19 nt, Homo sapiens
agugaaaaaagucaccugc

SEQ ID NO: 1093507 - RNA, 20 nt, Homo sapiens
agugaaaaaagucaccugcc

SEQ ID NO: 1093508 - RNA, 16 nt, Homo sapiens
agugaggcagugacca

SEQ ID NO: 1093509 - RNA, 16 nt, Homo sapiens
agugaggccauagcaa

SEQ ID NO: 1093510 - RNA, 16 nt, Homo sapiens
aguggaaauaaaaaga

SEQ ID NO: 1093511 - RNA, 19 nt, Homo sapiens
aguggguucagaaccaaga

SEQ ID NO: 1093512 - RNA, 20 nt, Homo sapiens
agugugccugucacuacugg

SEQ ID NO: 1093513 - RNA, 14 nt, Homo sapiens
aguuacucucaggc

SEQ ID NO: 1093514 - RNA, 15 nt, Homo sapiens
aguuacuugcuauaa

SEQ ID NO: 1093515 - RNA, 22 nt, Homo sapiens
ugucuauuauuaugaagaauug

SEQ ID NO: 1093516 - RNA, 12 nt, Homo sapiens
ugucucucauga

SEQ ID NO: 1093517 - RNA, 19 nt, Homo sapiens
ugucugccuggagugcugu

SEQ ID NO: 1093518 - RNA, 15 nt, Homo sapiens
ugugcacccagaaga

SEQ ID NO: 1093519 - RNA, 23 nt, Homo sapiens
uguggguagacacacaugaaguc

SEQ ID NO: 1093520 - RNA, 16 nt, Homo sapiens
uguugacaugggacau

SEQ ID NO: 1093521 - RNA, 16 nt, Homo sapiens
uguuucauuuaccucu

SEQ ID NO: 1093522 - RNA, 20 nt, Homo sapiens
uuaaaaaccuauuuugaaag

SEQ ID NO: 1093523 - RNA, 17 nt, Homo sapiens
uuaaaaauuggcauuuu

SEQ ID NO: 1093524 - RNA, 14 nt, Homo sapiens
uuaaaagagacaaa

SEQ ID NO: 1093525 - RNA, 16 nt, Homo sapiens
uuaaaauacauaacuu

SEQ ID NO: 1093526 - RNA, 22 nt, Homo sapiens
uuaaaauuuucauucugaaucu

SEQ ID NO: 1093527 - RNA, 16 nt, Homo sapiens
uuaaacagugucauau

SEQ ID NO: 1093528 - RNA, 11 nt, Homo sapiens
uuaaacuguag

SEQ ID NO: 1093529 - RNA, 14 nt, Homo sapiens
uuaaagaaugcugc

SEQ ID NO: 1093530 - RNA, 14 nt, Homo sapiens
uuaaauaucugaac

SEQ ID NO: 1093531 - RNA, 17 nt, Homo sapiens
uuaacuaugaacugaag

SEQ ID NO: 1093532 - RNA, 15 nt, Homo sapiens
uuaagagaaagucac

SEQ ID NO: 1093533 - RNA, 12 nt, Homo sapiens
uuaagcacugua

SEQ ID NO: 1093534 - RNA, 14 nt, Homo sapiens
uuaauaaguuaaaa

SEQ ID NO: 1093535 - RNA, 14 nt, Homo sapiens
uuaauaauguuuca

SEQ ID NO: 1093536 - RNA, 18 nt, Homo sapiens
uuaauauuccuggcauac

SEQ ID NO: 1093537 - RNA, 11 nt, Homo sapiens
uuaaugcucua

SEQ ID NO: 1093538 - RNA, 19 nt, Homo sapiens
uuaauuguuuaaaaaccga

SEQ ID NO: 1093539 - RNA, 15 nt, Homo sapiens
uuacuaauugucuac

SEQ ID NO: 1093540 - RNA, 16 nt, Homo sapiens
uuacuuggcaaauucu

SEQ ID NO: 1093541 - RNA, 16 nt, Homo sapiens
uuagagcugccugugc

SEQ ID NO: 1093542 - RNA, 15 nt, Homo sapiens
uuaguguauguucua

SEQ ID NO: 1093543 - RNA, 22 nt, Homo sapiens
uuaguuuugguuauuucuaaac

SEQ ID NO: 1093544 - RNA, 14 nt, Homo sapiens
uuauauuaaucucu

SEQ ID NO: 1093545 - RNA, 19 nt, Homo sapiens
uuaucaaggaagucuucaa

SEQ ID NO: 1093546 - RNA, 13 nt, Homo sapiens
uuaugcacaggaa

SEQ ID NO: 1093547 - RNA, 20 nt, Homo sapiens
uuauggaaauaccaggacca

SEQ ID NO: 1093548 - RNA, 17 nt, Homo sapiens
uuauuccaauaugaccu

SEQ ID NO: 1093549 - RNA, 18 nt, Homo sapiens
uuauuggauucacaccca

SEQ ID NO: 1093550 - RNA, 11 nt, Homo sapiens
uucacugguuu

SEQ ID NO: 1093551 - RNA, 20 nt, Homo sapiens
uucagaaccaagaugccaac

SEQ ID NO: 1093552 - RNA, 15 nt, Homo sapiens
uucagauaccaugca

SEQ ID NO: 1093553 - RNA, 15 nt, Homo sapiens
uucagauuugccuua

SEQ ID NO: 1093554 - RNA, 12 nt, Homo sapiens
uucauuaccuca

SEQ ID NO: 1093555 - RNA, 18 nt, Homo sapiens
uucauuggggacauuccu

SEQ ID NO: 1093556 - RNA, 21 nt, Homo sapiens
uuccacacccucacugcugua

SEQ ID NO: 1093557 - RNA, 21 nt, Homo sapiens
uuccggccuccugucccucau

SEQ ID NO: 1093558 - RNA, 21 nt, Homo sapiens
uuacaaggaguaacaaaacag

SEQ ID NO: 1093559 - RNA, 19 nt, Homo sapiens
uuacaaucgagacugcaau

SEQ ID NO: 1093560 - RNA, 17 nt, Homo sapiens
uuacauacuauucuuac

SEQ ID NO: 1093561 - RNA, 12 nt, Homo sapiens
uuacauauguca

SEQ ID NO: 1093562 - RNA, 15 nt, Homo sapiens
uuacauugccugacu

SEQ ID NO: 1093563 - RNA, 14 nt, Homo sapiens
uuaccagacuucaa

SEQ ID NO: 1093564 - RNA, 20 nt, Homo sapiens
uuaccuucuaccucuuggcu

SEQ ID NO: 1093565 - RNA, 12 nt, Homo sapiens
uuagcuacaaau

SEQ ID NO: 1093566 - RNA, 20 nt, Homo sapiens
uuaggaaaggaugaucaaaa

SEQ ID NO: 1093567 - RNA, 15 nt, Homo sapiens
uuaggauaacuaaaa

SEQ ID NO: 1093568 - RNA, 15 nt, Homo sapiens
uuagugaauuaugga

SEQ ID NO: 1093569 - RNA, 21 nt, Homo sapiens
uuauacuugaaaugaaauccu

SEQ ID NO: 1093570 - RNA, 13 nt, Homo sapiens
uuaugacacuccc

SEQ ID NO: 1093571 - RNA, 23 nt, Homo sapiens
uuauggcucaaaauccacugacg

SEQ ID NO: 1093572 - RNA, 20 nt, Homo sapiens
uuauguuaaaacugggacag

SEQ ID NO: 1093573 - RNA, 21 nt, Homo sapiens
uuauucuggagucugccaaaa

SEQ ID NO: 1093574 - RNA, 15 nt, Homo sapiens
uucaacaucuaguga

SEQ ID NO: 1093575 - RNA, 22 nt, Homo sapiens
uucaacaucuagugagcaguca

SEQ ID NO: 1093576 - RNA, 12 nt, Homo sapiens
uucaagauccuc

SEQ ID NO: 1093577 - RNA, 22 nt, Homo sapiens
uucagcugugcuuuuugcaaaa

SEQ ID NO: 1093578 - RNA, 22 nt, Homo sapiens
uucaggcucugcccaggaacuc

SEQ ID NO: 1093579 - RNA, 17 nt, Homo sapiens
uucagugcaagagacuu

SEQ ID NO: 1093580 - RNA, 15 nt, Homo sapiens
uucaugcauuacuua

SEQ ID NO: 1093581 - RNA, 14 nt, Homo sapiens
uucauuuaccucua

SEQ ID NO: 1093582 - RNA, 16 nt, Homo sapiens
uuccaagcaaguauua

SEQ ID NO: 1093583 - RNA, 15 nt, Homo sapiens
uuccgacauacauca

SEQ ID NO: 1093584 - RNA, 21 nt, Homo sapiens
uuccuaaaagagaauggaaaa

SEQ ID NO: 1093585 - RNA, 13 nt, Homo sapiens
uucuaaauggaaa

SEQ ID NO: 1093586 - RNA, 22 nt, Homo sapiens
uucuaacugaaggugcaguuga

SEQ ID NO: 1093587 - RNA, 21 nt, Homo sapiens
uucuauggguuggacaaccuc

SEQ ID NO: 1093588 - RNA, 24 nt, Homo sapiens
uucuccuaaacugaacacaugacu

SEQ ID NO: 1093589 - RNA, 14 nt, Homo sapiens
uucucuucuggaca

SEQ ID NO: 1093590 - RNA, 13 nt, Homo sapiens
uucuggacauguc

SEQ ID NO: 1093591 - RNA, 22 nt, Homo sapiens
uucuuuuuuaagcgaaugauug

SEQ ID NO: 1093592 - RNA, 15 nt, Homo sapiens
uugaaauauuaguua

SEQ ID NO: 1093593 - RNA, 16 nt, Homo sapiens
uugaauuauaugguug

SEQ ID NO: 1093594 - RNA, 22 nt, Homo sapiens
uugacaugggacauuugcucau

SEQ ID NO: 1093595 - RNA, 13 nt, Homo sapiens
uugauuggauaaa

SEQ ID NO: 1093596 - RNA, 22 nt, Homo sapiens
uugccauuuagcgaacaaccac

SEQ ID NO: 1093597 - RNA, 20 nt, Homo sapiens
uugcuacgaagaaagacucc

SEQ ID NO: 1093598 - RNA, 22 nt, Homo sapiens
uugcuacgaagaaagacuccuu

SEQ ID NO: 1093599 - RNA, 14 nt, Homo sapiens
uugcucauggaauu

SEQ ID NO: 1093600 - RNA, 19 nt, Homo sapiens
uugcuguugugcagugugc

SEQ ID NO: 1093601 - RNA, 14 nt, Homo sapiens
uuggacaaccucau

SEQ ID NO: 1093602 - RNA, 16 nt, Homo sapiens
uuggagaaaagcacuu

SEQ ID NO: 1093603 - RNA, 17 nt, Homo sapiens
uuggagaaaagcacuua

SEQ ID NO: 1093604 - RNA, 21 nt, Homo sapiens
uugucaauagcaugcaaaaaa

SEQ ID NO: 1093605 - RNA, 17 nt, Homo sapiens
uugucaguuuacaccaa

SEQ ID NO: 1093606 - RNA, 17 nt, Homo sapiens
uugucauauacccagcu

SEQ ID NO: 1093607 - RNA, 16 nt, Homo sapiens
uuguguucacuacauu

SEQ ID NO: 1093608 - RNA, 17 nt, Homo sapiens
uuguuccaaugccacau

SEQ ID NO: 1093609 - RNA, 16 nt, Homo sapiens
uuuaaaagaaugauua

SEQ ID NO: 1093610 - RNA, 21 nt, Homo sapiens
uuuaaaagagacaaacuguaa

SEQ ID NO: 1093611 - RNA, 14 nt, Homo sapiens
uuuaaaauugugau

SEQ ID NO: 1093612 - RNA, 21 nt, Homo sapiens
uuuaaacagugucauauacaa

SEQ ID NO: 1093613 - RNA, 11 nt, Homo sapiens
uuuaaacugua

SEQ ID NO: 1093614 - RNA, 22 nt, Homo sapiens
uuuaauguuaaauucaauguag

SEQ ID NO: 1093615 - RNA, 21 nt, Homo sapiens
uuuauugcauggugugaacua

SEQ ID NO: 1093616 - RNA, 17 nt, Homo sapiens
uuucaaaacuaguucuu

SEQ ID NO: 1093617 - RNA, 17 nt, Homo sapiens
uuucaaaagaacauucu

SEQ ID NO: 1093618 - RNA, 16 nt, Homo sapiens
uuucaaaaugcuucaa

SEQ ID NO: 1093619 - RNA, 12 nt, Homo sapiens
uuucacuacucu

SEQ ID NO: 1093620 - RNA, 12 nt, Homo sapiens
uuucauucuugu

SEQ ID NO: 1093621 - RNA, 21 nt, Homo sapiens
uuucuuguaaacauugccuga

SEQ ID NO: 1093622 - RNA, 23 nt, Homo sapiens
uuugauacaaaugggaauucacu

SEQ ID NO: 1093623 - RNA, 15 nt, Homo sapiens
uuugcuauaccacag

SEQ ID NO: 1093624 - RNA, 20 nt, Homo sapiens
uuuggggcucagaguggggu

SEQ ID NO: 1093625 - RNA, 17 nt, Homo sapiens
uuuguucucccaaaaca

SEQ ID NO: 1093626 - RNA, 22 nt, Homo sapiens
uuuuaaacagugucauauacaa

SEQ ID NO: 1093627 - RNA, 15 nt, Homo sapiens
uuuuacacacugaaa

SEQ ID NO: 1093628 - RNA, 14 nt, Homo sapiens
uuuuacauauguca

SEQ ID NO: 1093629 - RNA, 19 nt, Homo sapiens
uuuuaggaaaggaugauca

SEQ ID NO: 1093630 - RNA, 13 nt, Homo sapiens
uuuuaucuuuuag

SEQ ID NO: 1093631 - RNA, 16 nt, Homo sapiens
uuuuauuacacauuua

SEQ ID NO: 1093632 - RNA, 22 nt, Homo sapiens
uuuucuuguaaacauugccuga

SEQ ID NO: 1093633 - RNA, 17 nt, Homo sapiens
uuuugucuauaugugcg

SEQ ID NO: 1093634 - RNA, 14 nt, Homo sapiens
uuuuuccuaaaaga

SEQ ID NO: 1093635 - RNA, 17 nt, Homo sapiens
uuuuuguacauuuggaa

SEQ ID NO: 1093636 - RNA, 16 nt, Homo sapiens
uuuuugucaagacaag

SEQ ID NO: 1093637 - RNA, 20 nt, Homo sapiens
aaaaagagaucgagucacaa

SEQ ID NO: 1093638 - RNA, 22 nt, Homo sapiens
aaaaauucaugccccaguauua

SEQ ID NO: 1093639 - RNA, 16 nt, Homo sapiens
aaaacagccucuuugc

SEQ ID NO: 1093640 - RNA, 13 nt, Homo sapiens
aaaacuaguucuu

SEQ ID NO: 1093641 - RNA, 15 nt, Homo sapiens
aaaacuccugucuug

SEQ ID NO: 1093642 - RNA, 13 nt, Homo sapiens
aaaacugggacag

SEQ ID NO: 1093643 - RNA, 20 nt, Homo sapiens
aaaagaaugauuaugaauua

SEQ ID NO: 1093644 - RNA, 16 nt, Homo sapiens
aaaaguuacagccaua

SEQ ID NO: 1093645 - RNA, 19 nt, Homo sapiens
aaaauagcacauccaccaa

SEQ ID NO: 1093646 - RNA, 18 nt, Homo sapiens
aaaauaucacuugucaau

SEQ ID NO: 1093647 - RNA, 16 nt, Homo sapiens
aaaauccauacauuug

SEQ ID NO: 1093648 - RNA, 11 nt, Homo sapiens
aaaaugcaaua

SEQ ID NO: 1093649 - RNA, 17 nt, Homo sapiens
aaaaugccaccauccaa

SEQ ID NO: 1093650 - RNA, 17 nt, Homo sapiens
aaaaugcuucacuguac

SEQ ID NO: 1093651 - RNA, 21 nt, Homo sapiens
ugacauaacgcugacugcaaa

SEQ ID NO: 1093652 - RNA, 23 nt, Homo sapiens
ugacaugccuauaugagaagaau

SEQ ID NO: 1093653 - RNA, 13 nt, Homo sapiens
ugaccccuaggca

SEQ ID NO: 1093654 - RNA, 23 nt, Homo sapiens
ugaccuuuuaagugaaaaucuga

SEQ ID NO: 1093655 - RNA, 15 nt, Homo sapiens
ugagagacacacuga

SEQ ID NO: 1093656 - RNA, 16 nt, Homo sapiens
ugagagacacacugaa

SEQ ID NO: 1093657 - RNA, 15 nt, Homo sapiens
ugagcagagaacuga

SEQ ID NO: 1093658 - RNA, 15 nt, Homo sapiens
ugagcagguguucuu

SEQ ID NO: 1093659 - RNA, 23 nt, Homo sapiens
ugagcagguguucuucauuaccu

SEQ ID NO: 1093660 - RNA, 18 nt, Homo sapiens
ugaggggcucucucauga

SEQ ID NO: 1093661 - RNA, 16 nt, Homo sapiens
ugaguauugaaugaua

SEQ ID NO: 1093662 - RNA, 17 nt, Homo sapiens
ugauaugggucuugaua

SEQ ID NO: 1093663 - RNA, 20 nt, Homo sapiens
ugaucuuagggaacuuugau

SEQ ID NO: 1093664 - RNA, 16 nt, Homo sapiens
ugaugcuuuaacugau

SEQ ID NO: 1093665 - RNA, 20 nt, Homo sapiens
ugauuagucagaaacugcca

SEQ ID NO: 1093666 - RNA, 19 nt, Homo sapiens
ugcaauaaaauuauuugca

SEQ ID NO: 1093667 - RNA, 20 nt, Homo sapiens
ugcaauaauacaacuaucau

SEQ ID NO: 1093668 - RNA, 12 nt, Homo sapiens
ugcaaugugauc

SEQ ID NO: 1093669 - RNA, 18 nt, Homo sapiens
ugcacaccuaagcccaaa

SEQ ID NO: 1093670 - RNA, 23 nt, Homo sapiens
ugcagaaaaagaaaaaaacuaua

SEQ ID NO: 1093671 - RNA, 21 nt, Homo sapiens
ugcaggagucccugccaucau

SEQ ID NO: 1093672 - RNA, 18 nt, Homo sapiens
ugcaguaauuugcaauuu

SEQ ID NO: 1093673 - RNA, 17 nt, Homo sapiens
ugcagugagcugugauu

SEQ ID NO: 1093674 - RNA, 15 nt, Homo sapiens
ugccacauacuugca

SEQ ID NO: 1093675 - RNA, 21 nt, Homo sapiens
ugccacaucuugaaaaugcca

SEQ ID NO: 1093676 - RNA, 12 nt, Homo sapiens
ugccauugcacu

SEQ ID NO: 1093677 - RNA, 15 nt, Homo sapiens
ugcccaaaugugauu

SEQ ID NO: 1093678 - RNA, 22 nt, Homo sapiens
ugcccacuaaaagaauugugac

SEQ ID NO: 1093679 - RNA, 11 nt, Homo sapiens
ugcccagacaa

SEQ ID NO: 1093680 - RNA, 13 nt, Homo sapiens
ugcccagacaaga

SEQ ID NO: 1093681 - RNA, 11 nt, Homo sapiens
ugcccaugugg

SEQ ID NO: 1093682 - RNA, 20 nt, Homo sapiens
ugccugagaauguuaccaga

SEQ ID NO: 1093683 - RNA, 23 nt, Homo sapiens
ugccugauuuguuccuucugggg

SEQ ID NO: 1093684 - RNA, 16 nt, Homo sapiens
ugccuuggugugcugu

SEQ ID NO: 1093685 - RNA, 22 nt, Homo sapiens
ugccuuugaaggguaugucaca

SEQ ID NO: 1093686 - RNA, 13 nt, Homo sapiens
ugcggcuuuucag

SEQ ID NO: 1093687 - RNA, 18 nt, Homo sapiens
ugcuacgaagaaagacuc

SEQ ID NO: 1093688 - RNA, 15 nt, Homo sapiens
ugcucugaugcagug

SEQ ID NO: 1093689 - RNA, 15 nt, Homo sapiens
ugcugggcuuggcag

SEQ ID NO: 1093690 - RNA, 20 nt, Homo sapiens
ugcuguagacauuugcuaug

SEQ ID NO: 1093691 - RNA, 16 nt, Homo sapiens
ugcuugguagcacuuu

SEQ ID NO: 1093692 - RNA, 16 nt, Homo sapiens
uggaaaaaugauuuaa

SEQ ID NO: 1093693 - RNA, 18 nt, Homo sapiens
uggaagugugggucugug

SEQ ID NO: 1093694 - RNA, 12 nt, Homo sapiens
uggacacauuau

SEQ ID NO: 1093695 - RNA, 15 nt, Homo sapiens
uggaggcucuguauu

SEQ ID NO: 1093696 - RNA, 21 nt, Homo sapiens
uggagguuuguuuagaagaag

SEQ ID NO: 1093697 - RNA, 12 nt, Homo sapiens
uggaucugugag

SEQ ID NO: 1093698 - RNA, 15 nt, Homo sapiens
uggcggccaagugag

SEQ ID NO: 1093699 - RNA, 13 nt, Homo sapiens
uggcuaccuugug

SEQ ID NO: 1093700 - RNA, 19 nt, Homo sapiens
uggcucaaaauccacugac

SEQ ID NO: 1093701 - RNA, 15 nt, Homo sapiens
uggcuggaucuguga

SEQ ID NO: 1093702 - RNA, 21 nt, Homo sapiens
uggcugggaauaagugccagg

SEQ ID NO: 1093703 - RNA, 16 nt, Homo sapiens
ugggaaagggcuguua

SEQ ID NO: 1093704 - RNA, 21 nt, Homo sapiens
ugggacagucaccucauggaa

SEQ ID NO: 1093705 - RNA, 21 nt, Homo sapiens
ugggacauuugcucauggaau

SEQ ID NO: 1093706 - RNA, 16 nt, Homo sapiens
uggggaugucucucau

SEQ ID NO: 1093707 - RNA, 14 nt, Homo sapiens
ugggucaguuguau

SEQ ID NO: 1093708 - RNA, 13 nt, Homo sapiens
ugguagcacuuua

SEQ ID NO: 1093709 - RNA, 22 nt, Homo sapiens
ugguauauaggcuaaccacuuu

SEQ ID NO: 1093710 - RNA, 16 nt, Homo sapiens
uguaaauuuaugugau

SEQ ID NO: 1093711 - RNA, 18 nt, Homo sapiens
uguauaguuagcuuuauu

SEQ ID NO: 1093712 - RNA, 15 nt, Homo sapiens
uguccagaaguggcc

SEQ ID NO: 1093713 - RNA, 14 nt, Homo sapiens
uguccuaugcaaua

SEQ ID NO: 1093714 - RNA, 19 nt, Homo sapiens
ugucgagggaaagagaccc

SEQ ID NO: 1093715 - RNA, 15 nt, Homo sapiens
ugucucucaugacca

SEQ ID NO: 1093716 - RNA, 21 nt, Homo sapiens
uguggaaaauuggcaguguaa

SEQ ID NO: 1093717 - RNA, 16 nt, Homo sapiens
uguggaacaagcagcu

SEQ ID NO: 1093718 - RNA, 21 nt, Homo sapiens
uguggggagggauuuggggcu

SEQ ID NO: 1093719 - RNA, 16 nt, Homo sapiens
ugugguuugcagauga

SEQ ID NO: 1093720 - RNA, 19 nt, Homo sapiens
uguguauaauuuaccucuc

SEQ ID NO: 1093721 - RNA, 12 nt, Homo sapiens
uguuaccagacu

SEQ ID NO: 1093722 - RNA, 22 nt, Homo sapiens
uguuauauuauuacuaauuguc

SEQ ID NO: 1093723 - RNA, 22 nt, Homo sapiens
uguuauauuuccuucuguaaaa

SEQ ID NO: 1093724 - RNA, 23 nt, Homo sapiens
uguuccuucuggggcuuugccau

SEQ ID NO: 1093725 - RNA, 21 nt, Homo sapiens
uguuguuccaggauguggaau

SEQ ID NO: 1093726 - RNA, 17 nt, Homo sapiens
uguuguuucuagauuag

SEQ ID NO: 1093727 - RNA, 19 nt, Homo sapiens
uguuuacagaggacaguau

SEQ ID NO: 1093728 - RNA, 17 nt, Homo sapiens
uguuucauuuaccucua

SEQ ID NO: 1093729 - RNA, 20 nt, Homo sapiens
uuaaaauucuggacacauua

SEQ ID NO: 1093730 - RNA, 19 nt, Homo sapiens
uuaaauaagauuuaauuca

SEQ ID NO: 1093731 - RNA, 21 nt, Homo sapiens
uuaaauaagauuuaauucaca

SEQ ID NO: 1093732 - RNA, 21 nt, Homo sapiens
uuaacuuaaaagaacauguau

SEQ ID NO: 1093733 - RNA, 19 nt, Homo sapiens
uuaaggaaaaguaagggaa

SEQ ID NO: 1093734 - RNA, 13 nt, Homo sapiens
uuaaucaguguga

SEQ ID NO: 1093735 - RNA, 17 nt, Homo sapiens
uuaauuccaugugauac

SEQ ID NO: 1093736 - RNA, 17 nt, Homo sapiens
uuaauucuuaagcaaga

SEQ ID NO: 1093737 - RNA, 20 nt, Homo sapiens
uuaccaacuuccccccaaaa

SEQ ID NO: 1093738 - RNA, 22 nt, Homo sapiens
uuaccugggaaagggcuguuau

SEQ ID NO: 1093739 - RNA, 21 nt, Homo sapiens
uuacucucaggcauggaugaa

SEQ ID NO: 1093740 - RNA, 13 nt, Homo sapiens
uuacuugcuauaa

SEQ ID NO: 1093741 - RNA, 21 nt, Homo sapiens
uuaggauaacuaaaauucugg

SEQ ID NO: 1093742 - RNA, 19 nt, Homo sapiens
uuaguguuugaaauugaau

SEQ ID NO: 1093743 - RNA, 12 nt, Homo sapiens
uuauaaucuuuc

SEQ ID NO: 1093744 - RNA, 23 nt, Homo sapiens
uuauauuuguaaauuuaugugau

SEQ ID NO: 1093745 - RNA, 14 nt, Homo sapiens
uuaucagccugugc

SEQ ID NO: 1093746 - RNA, 16 nt, Homo sapiens
uuaugacuaugcacua

SEQ ID NO: 1093747 - RNA, 21 nt, Homo sapiens
uuauguuugugguuuugggaa

SEQ ID NO: 1093748 - RNA, 17 nt, Homo sapiens
uuauuacuaauugucua

SEQ ID NO: 1093749 - RNA, 15 nt, Homo sapiens
uuauuggauucacac

SEQ ID NO: 1093750 - RNA, 18 nt, Homo sapiens
uucaaggccuggggagcc

SEQ ID NO: 1093751 - RNA, 14 nt, Homo sapiens
uucagauuugccuu

SEQ ID NO: 1093752 - RNA, 22 nt, Homo sapiens
uucaguagcaggaccugccaag

SEQ ID NO: 1093753 - RNA, 13 nt, Homo sapiens
uucauuggggaca

SEQ ID NO: 1093754 - RNA, 17 nt, Homo sapiens
uuccaagcaaguauuag

SEQ ID NO: 1093755 - RNA, 16 nt, Homo sapiens
uuccaguuucuguaag

SEQ ID NO: 1093756 - RNA, 22 nt, Homo sapiens
uucccaacuccagaaagugaca

SEQ ID NO: 1093757 - RNA, 16 nt, Homo sapiens
uuccucuguaagauau

SEQ ID NO: 1093758 - RNA, 19 nt, Homo sapiens
uuccuggcauaccuuuaag

SEQ ID NO: 1093759 - RNA, 11 nt, Homo sapiens
uucuaagggaa

SEQ ID NO: 1093760 - RNA, 21 nt, Homo sapiens
uucuagcucuauuuacuucua

SEQ ID NO: 1093761 - RNA, 21 nt, Homo sapiens
uugcuuuugaaggaauacaau

SEQ ID NO: 1093762 - RNA, 18 nt, Homo sapiens
uuggauucacacccagcu

SEQ ID NO: 1093763 - RNA, 23 nt, Homo sapiens
uuggcagcucuacucuggagguu

SEQ ID NO: 1093764 - RNA, 15 nt, Homo sapiens
uuggcucuacccuga

SEQ ID NO: 1093765 - RNA, 18 nt, Homo sapiens
uugguaaaucacacugaa

SEQ ID NO: 1093766 - RNA, 14 nt, Homo sapiens
uugguagcacuuua

SEQ ID NO: 1093767 - RNA, 14 nt, Homo sapiens
uuguacauuuggaa

SEQ ID NO: 1093768 - RNA, 16 nt, Homo sapiens
uuguuaauccuucuuu

SEQ ID NO: 1093769 - RNA, 22 nt, Homo sapiens
uuguucugacuuuuuguuucuu

SEQ ID NO: 1093770 - RNA, 20 nt, Homo sapiens
uuuaaaaauaaaagcuauua

SEQ ID NO: 1093771 - RNA, 20 nt, Homo sapiens
uuuaaacuacugaacuguua

SEQ ID NO: 1093772 - RNA, 23 nt, Homo sapiens
uuuaaauaagauuuaauucacau

SEQ ID NO: 1093773 - RNA, 13 nt, Homo sapiens
uuuaauauuccug

SEQ ID NO: 1093774 - RNA, 15 nt, Homo sapiens
uuuaauucacaucaa

SEQ ID NO: 1093775 - RNA, 20 nt, Homo sapiens
uuuaauuuuuuaaacuguag

SEQ ID NO: 1093776 - RNA, 16 nt, Homo sapiens
uuuauacuugaaauga

SEQ ID NO: 1093777 - RNA, 23 nt, Homo sapiens
uuucaguagcaggaccugccaag

SEQ ID NO: 1093778 - RNA, 13 nt, Homo sapiens
uuucauaguucug

SEQ ID NO: 1093779 - RNA, 14 nt, Homo sapiens
uuucucuacuuuaa

SEQ ID NO: 1093780 - RNA, 12 nt, Homo sapiens
uuugauucucau

SEQ ID NO: 1093781 - RNA, 21 nt, Homo sapiens
uuugauugggauaguaguuag

SEQ ID NO: 1093782 - RNA, 17 nt, Homo sapiens
uuuggucaacuuaccaa

SEQ ID NO: 1093783 - RNA, 13 nt, Homo sapiens
uuuguuccaugag

SEQ ID NO: 1093784 - RNA, 17 nt, Homo sapiens
uuuuaauuuuuugucaa

SEQ ID NO: 1093785 - RNA, 18 nt, Homo sapiens
uuuucaguagcaggaccu

SEQ ID NO: 1093786 - RNA, 14 nt, Homo sapiens
uuuuggugcuauaa

SEQ ID NO: 1093787 - RNA, 23 nt, Homo sapiens
uuuuucaguagcaggaccugcca

SEQ ID NO: 1093788 - RNA, 15 nt, Homo sapiens
uuuuuccaaguguau

SEQ ID NO: 1093789 - RNA, 16 nt, Homo sapiens
auuuuuuaaacuguag

SEQ ID NO: 1093790 - RNA, 22 nt, Homo sapiens
caaaaacuggguaaugcaacuc

SEQ ID NO: 1093791 - RNA, 15 nt, Homo sapiens
caaaaagaugcuuua

SEQ ID NO: 1093792 - RNA, 20 nt, Homo sapiens
caaaccaaugcuauugugau

SEQ ID NO: 1093793 - RNA, 16 nt, Homo sapiens
caaacucaggcuuuca

SEQ ID NO: 1093794 - RNA, 14 nt, Homo sapiens
caacagacccagug

SEQ ID NO: 1093795 - RNA, 16 nt, Homo sapiens
caacccuguugaguau

SEQ ID NO: 1093796 - RNA, 17 nt, Homo sapiens
caacuaucucauuucca

SEQ ID NO: 1093797 - RNA, 16 nt, Homo sapiens
caacuccccuacauca

SEQ ID NO: 1093798 - RNA, 15 nt, Homo sapiens
caagaaggcuuuauu

SEQ ID NO: 1093799 - RNA, 16 nt, Homo sapiens
caagaucauagcucau

SEQ ID NO: 1093800 - RNA, 16 nt, Homo sapiens
caagauccucuugcca

SEQ ID NO: 1093801 - RNA, 13 nt, Homo sapiens
caagaugcccuaa

SEQ ID NO: 1093802 - RNA, 16 nt, Homo sapiens
caagcauuuagaugua

SEQ ID NO: 1093803 - RNA, 12 nt, Homo sapiens
caagcauuucac

SEQ ID NO: 1093804 - RNA, 19 nt, Homo sapiens
caaggcaggggcacggugg

SEQ ID NO: 1093805 - RNA, 17 nt, Homo sapiens
caaggccuggggagccu

SEQ ID NO: 1093806 - RNA, 15 nt, Homo sapiens
caagugaggccauag

SEQ ID NO: 1093807 - RNA, 19 nt, Homo sapiens
caauaguguccuaugcaau

SEQ ID NO: 1093808 - RNA, 15 nt, Homo sapiens
caaugaguguuauaa

SEQ ID NO: 1093809 - RNA, 17 nt, Homo sapiens
caaugauacaguugcau

SEQ ID NO: 1093810 - RNA, 21 nt, Homo sapiens
caaugccacauacuugcagcu

SEQ ID NO: 1093811 - RNA, 21 nt, Homo sapiens
caauguaguuuuauuacacau

SEQ ID NO: 1093812 - RNA, 16 nt, Homo sapiens
caauuccccuacauca

SEQ ID NO: 1093813 - RNA, 18 nt, Homo sapiens
caauuccccuacaucaaa

SEQ ID NO: 1093814 - RNA, 16 nt, Homo sapiens
caauuugucaguguau

SEQ ID NO: 1093815 - RNA, 19 nt, Homo sapiens
cacacauaaaagcacaaag

SEQ ID NO: 1093816 - RNA, 11 nt, Homo sapiens
cacacccagcu

SEQ ID NO: 1093817 - RNA, 15 nt, Homo sapiens
cacaguuggcacuuc

SEQ ID NO: 1093818 - RNA, 22 nt, Homo sapiens
cacaucauuuuuaagcacugua

SEQ ID NO: 1093819 - RNA, 18 nt, Homo sapiens
caccaucucuuuaccucc

SEQ ID NO: 1093820 - RNA, 19 nt, Homo sapiens
caccaucucuuuaccuccu

SEQ ID NO: 1093821 - RNA, 21 nt, Homo sapiens
caccuguagucccagcacuuu

SEQ ID NO: 1093822 - RNA, 22 nt, Homo sapiens
cacguagccacgcacagccaga

SEQ ID NO: 1093823 - RNA, 20 nt, Homo sapiens
cacgugaacuaugcaauuua

SEQ ID NO: 1093824 - RNA, 21 nt, Homo sapiens
cacuaaaagaauugugacaua

SEQ ID NO: 1093825 - RNA, 20 nt, Homo sapiens
cacugccuggaggcucugua

SEQ ID NO: 1093826 - RNA, 16 nt, Homo sapiens
cacugguaacauguga

SEQ ID NO: 1093827 - RNA, 19 nt, Homo sapiens
cacuugaggccaggacuuu

SEQ ID NO: 1093828 - RNA, 14 nt, Homo sapiens
cagaaacugccauu

SEQ ID NO: 1093829 - RNA, 22 nt, Homo sapiens
cagaaagugacaagcucacaga

SEQ ID NO: 1093830 - RNA, 14 nt, Homo sapiens
cagaauuacaugaa

SEQ ID NO: 1093831 - RNA, 14 nt, Homo sapiens
cagagaugggaaaa

SEQ ID NO: 1093832 - RNA, 12 nt, Homo sapiens
cagauaaucaca

SEQ ID NO: 1093833 - RNA, 23 nt, Homo sapiens
cagcacguguggccuguucuucu

SEQ ID NO: 1093834 - RNA, 12 nt, Homo sapiens
cagcagaacucc

SEQ ID NO: 1093835 - RNA, 20 nt, Homo sapiens
cagccagacgcauccugcca

SEQ ID NO: 1093836 - RNA, 19 nt, Homo sapiens
cagccucuuagaugcaguu

SEQ ID NO: 1093837 - RNA, 13 nt, Homo sapiens
cagcuaagcaaua

SEQ ID NO: 1093838 - RNA, 18 nt, Homo sapiens
cagcugagguucauuaca

SEQ ID NO: 1093839 - RNA, 15 nt, Homo sapiens
cagcuuauugucuag

SEQ ID NO: 1093840 - RNA, 22 nt, Homo sapiens
cagcuuuuuuaugucacucaaa

SEQ ID NO: 1093841 - RNA, 16 nt, Homo sapiens
caggagaguacauggc

SEQ ID NO: 1093842 - RNA, 18 nt, Homo sapiens
caggagucccugccauca

SEQ ID NO: 1093843 - RNA, 20 nt, Homo sapiens
caggaguggccguugcuaca

SEQ ID NO: 1093844 - RNA, 19 nt, Homo sapiens
caggauaccagcaaaugga

SEQ ID NO: 1093845 - RNA, 15 nt, Homo sapiens
caggcauuucauuua

SEQ ID NO: 1093846 - RNA, 14 nt, Homo sapiens
caggcuagauguau

SEQ ID NO: 1093847 - RNA, 19 nt, Homo sapiens
cagggaacaagcccaaagc

SEQ ID NO: 1093848 - RNA, 18 nt, Homo sapiens
cagggauucuuccugcuu

SEQ ID NO: 1093849 - RNA, 16 nt, Homo sapiens
cagggugaaguguaca

SEQ ID NO: 1093850 - RNA, 19 nt, Homo sapiens
cagggugcggccugagaua

SEQ ID NO: 1093851 - RNA, 21 nt, Homo sapiens
caggucuaccaaaaaucucaa

SEQ ID NO: 1093852 - RNA, 21 nt, Homo sapiens
cagguguucuucauuaccuca

SEQ ID NO: 1093853 - RNA, 13 nt, Homo sapiens
caguaauuugcaa

SEQ ID NO: 1093854 - RNA, 16 nt, Homo sapiens
caguaauuugcaauuu

SEQ ID NO: 1093855 - RNA, 21 nt, Homo sapiens
caguauuguagaaagcuaaua

SEQ ID NO: 1093856 - RNA, 23 nt, Homo sapiens
caguuagcauggcuucacacugu

SEQ ID NO: 1093857 - RNA, 18 nt, Homo sapiens
caguuuagaaccuacaaa

SEQ ID NO: 1093858 - RNA, 15 nt, Homo sapiens
caguuucuucaugca

SEQ ID NO: 1093859 - RNA, 21 nt, Homo sapiens
cauaccuggcccugugccuug

SEQ ID NO: 1093860 - RNA, 20 nt, Homo sapiens
cauagcaacuccccuacauc

SEQ ID NO: 1093861 - RNA, 23 nt, Homo sapiens
cauagcaacuccccuacaucaaa

SEQ ID NO: 1093862 - RNA, 22 nt, Homo sapiens
cauagcaauuccccuacaucaa

SEQ ID NO: 1093863 - RNA, 23 nt, Homo sapiens
cauagcaauuccccuacaucaaa

SEQ ID NO: 1093864 - RNA, 11 nt, Homo sapiens
cauagcacuug

SEQ ID NO: 1093865 - RNA, 13 nt, Homo sapiens
cauagcacuugcc

SEQ ID NO: 1093866 - RNA, 16 nt, Homo sapiens
cauauacaauugucau

SEQ ID NO: 1093867 - RNA, 13 nt, Homo sapiens
cauauacccagcu

SEQ ID NO: 1093868 - RNA, 23 nt, Homo sapiens
cauaucuguuuauucugggaaau

SEQ ID NO: 1093869 - RNA, 13 nt, Homo sapiens
caucaaaugcuca

SEQ ID NO: 1093870 - RNA, 20 nt, Homo sapiens
caucaaggguacacugccuu

SEQ ID NO: 1093871 - RNA, 23 nt, Homo sapiens
caucaauaguguccuaugcaaua

SEQ ID NO: 1093872 - RNA, 14 nt, Homo sapiens
caucacaaccucca

SEQ ID NO: 1093873 - RNA, 21 nt, Homo sapiens
caucuuucauaguucuguuaa

SEQ ID NO: 1093874 - RNA, 16 nt, Homo sapiens
caugacauagcacuug

SEQ ID NO: 1093875 - RNA, 19 nt, Homo sapiens
caugacauagcacuugccg

SEQ ID NO: 1093876 - RNA, 18 nt, Homo sapiens
caugcaaagcaacgacua

SEQ ID NO: 1093877 - RNA, 18 nt, Homo sapiens
caugcauuacuuacuguu

SEQ ID NO: 1093878 - RNA, 16 nt, Homo sapiens
cauggaauuggagcuc

SEQ ID NO: 1093879 - RNA, 17 nt, Homo sapiens
cauggacauguguuuaa

SEQ ID NO: 1093880 - RNA, 16 nt, Homo sapiens
cauggucuuaugcaca

SEQ ID NO: 1093881 - RNA, 15 nt, Homo sapiens
caugugacaagcaca

SEQ ID NO: 1093882 - RNA, 16 nt, Homo sapiens
cauguugguugcacuu

SEQ ID NO: 1093883 - RNA, 22 nt, Homo sapiens
cauucacagcaagucacuggcc

SEQ ID NO: 1093884 - RNA, 15 nt, Homo sapiens
cauucugugauuaaa

SEQ ID NO: 1093885 - RNA, 23 nt, Homo sapiens
cauucuuauggccacaagcaaag

SEQ ID NO: 1093886 - RNA, 13 nt, Homo sapiens
cauucuugcuaau

SEQ ID NO: 1093887 - RNA, 21 nt, Homo sapiens
cauuggaccuuuccugaggaa

SEQ ID NO: 1093888 - RNA, 13 nt, Homo sapiens
cauugugcaauug

SEQ ID NO: 1093889 - RNA, 17 nt, Homo sapiens
ccaggggagacaucgca

SEQ ID NO: 1093890 - RNA, 17 nt, Homo sapiens
ccagguaugaccuuuua

SEQ ID NO: 1093891 - RNA, 22 nt, Homo sapiens
ccagguucuaauguguggaaug

SEQ ID NO: 1093892 - RNA, 21 nt, Homo sapiens
ccaguggcuggaucugugagg

SEQ ID NO: 1093893 - RNA, 12 nt, Homo sapiens
ccauacauuugu

SEQ ID NO: 1093894 - RNA, 23 nt, Homo sapiens
ccauagcaacuccccuacaucaa

SEQ ID NO: 1093895 - RNA, 22 nt, Homo sapiens
ccauagcaauuccccuacauca

SEQ ID NO: 1093896 - RNA, 23 nt, Homo sapiens
ccauagcaauuccccuacaucaa

SEQ ID NO: 1093897 - RNA, 19 nt, Homo sapiens
ccauauguggaacaagcag

SEQ ID NO: 1093898 - RNA, 17 nt, Homo sapiens
ccaucaaggguacacug

SEQ ID NO: 1093899 - RNA, 13 nt, Homo sapiens
ccaucucuuuacc

SEQ ID NO: 1093900 - RNA, 16 nt, Homo sapiens
cccaaauauaaaaaca

SEQ ID NO: 1093901 - RNA, 13 nt, Homo sapiens
cccagcacuuugg

SEQ ID NO: 1093902 - RNA, 14 nt, Homo sapiens
ccccuacaucaaau

SEQ ID NO: 1093903 - RNA, 23 nt, Homo sapiens
cccgaaacaccaagugaggccau

SEQ ID NO: 1093904 - RNA, 15 nt, Homo sapiens
cccuaauccaucuuc

SEQ ID NO: 1093905 - RNA, 19 nt, Homo sapiens
cccuacaucaaaugcucaa

SEQ ID NO: 1093906 - RNA, 14 nt, Homo sapiens
cccuugaugaagaa

SEQ ID NO: 1093907 - RNA, 11 nt, Homo sapiens
ccgaaacacca

SEQ ID NO: 1093908 - RNA, 22 nt, Homo sapiens
ccgaauaaauguuuuauuucua

SEQ ID NO: 1093909 - RNA, 17 nt, Homo sapiens
ccgagugaggccauagc

SEQ ID NO: 1093910 - RNA, 14 nt, Homo sapiens
ccgcauagcacuug

SEQ ID NO: 1093911 - RNA, 18 nt, Homo sapiens
ccgcauagcacuugcaga

SEQ ID NO: 1093912 - RNA, 19 nt, Homo sapiens
ccggccuccugucccucau

SEQ ID NO: 1093913 - RNA, 20 nt, Homo sapiens
ccgggucaucuguaccucug

SEQ ID NO: 1093914 - RNA, 13 nt, Homo sapiens
ccguggcuuuuac

SEQ ID NO: 1093915 - RNA, 14 nt, Homo sapiens
ccuaauacagcaga

SEQ ID NO: 1093916 - RNA, 21 nt, Homo sapiens
ccuaaugaaagugaugacaua

SEQ ID NO: 1093917 - RNA, 23 nt, Homo sapiens
ccuaaugaaagugaugacauauu

SEQ ID NO: 1093918 - RNA, 18 nt, Homo sapiens
ccuacauucuaaagaguu

SEQ ID NO: 1093919 - RNA, 14 nt, Homo sapiens
ccuagauaugaaua

SEQ ID NO: 1093920 - RNA, 18 nt, Homo sapiens
ccuaggcaaggggaugag

SEQ ID NO: 1093921 - RNA, 12 nt, Homo sapiens
ccuaugcaauaa

SEQ ID NO: 1093922 - RNA, 16 nt, Homo sapiens
ccucccaaguagcuag

SEQ ID NO: 1093923 - RNA, 14 nt, Homo sapiens
ccucucauuagaaa

SEQ ID NO: 1093924 - RNA, 16 nt, Homo sapiens
ccugauuuguuccuuc

SEQ ID NO: 1093925 - RNA, 21 nt, Homo sapiens
ccugauuuguuccuucugggg

SEQ ID NO: 1093926 - RNA, 16 nt, Homo sapiens
ccugcccagacaagau

SEQ ID NO: 1093927 - RNA, 19 nt, Homo sapiens
ccuguagucccagcacuuu

SEQ ID NO: 1093928 - RNA, 19 nt, Homo sapiens
ccuucaaauaguauagaaa

SEQ ID NO: 1093929 - RNA, 19 nt, Homo sapiens
ccuugagugaggcagugac

SEQ ID NO: 1093930 - RNA, 15 nt, Homo sapiens
ccuuggugugcugua

SEQ ID NO: 1093931 - RNA, 14 nt, Homo sapiens
ccuuugucccagaa

SEQ ID NO: 1093932 - RNA, 20 nt, Homo sapiens
ccuuuucuuguaaacauugc

SEQ ID NO: 1093933 - RNA, 17 nt, Homo sapiens
cgaaugauugcuuuuaa

SEQ ID NO: 1093934 - RNA, 14 nt, Homo sapiens
cgauuauaaucucc

SEQ ID NO: 1093935 - RNA, 18 nt, Homo sapiens
cgcacaugacauagcacu

SEQ ID NO: 1093936 - RNA, 13 nt, Homo sapiens
cgcauagcacuug

SEQ ID NO: 1093937 - RNA, 17 nt, Homo sapiens
cgcccgcccgcauagca

SEQ ID NO: 1093938 - RNA, 17 nt, Homo sapiens
cgcuucagagacacaca

SEQ ID NO: 1093939 - RNA, 20 nt, Homo sapiens
cggagagaauggggugagca

SEQ ID NO: 1093940 - RNA, 21 nt, Homo sapiens
cgggguggugcaggcucccaa

SEQ ID NO: 1093941 - RNA, 20 nt, Homo sapiens
cgucagagaccugggagcag

SEQ ID NO: 1093942 - RNA, 19 nt, Homo sapiens
cgugauaaaccugcuccaa

SEQ ID NO: 1093943 - RNA, 12 nt, Homo sapiens
cuaaaccacaaa

SEQ ID NO: 1093944 - RNA, 14 nt, Homo sapiens
cuaaaccacaaaag

SEQ ID NO: 1093945 - RNA, 11 nt, Homo sapiens
cuaaacuguau

SEQ ID NO: 1093946 - RNA, 17 nt, Homo sapiens
cuaaagagcuacuucua

SEQ ID NO: 1093947 - RNA, 14 nt, Homo sapiens
cuaaaugucaauca

SEQ ID NO: 1093948 - RNA, 15 nt, Homo sapiens
cuaauccaucuucau

SEQ ID NO: 1093949 - RNA, 16 nt, Homo sapiens
cuacaaaugccuguca

SEQ ID NO: 1093950 - RNA, 19 nt, Homo sapiens
cuacaguuuuuaacucuac

SEQ ID NO: 1093951 - RNA, 18 nt, Homo sapiens
cuagugagcagucaggaa

SEQ ID NO: 1093952 - RNA, 22 nt, Homo sapiens
cuaguuuuaucuuaacacugaa

SEQ ID NO: 1093953 - RNA, 15 nt, Homo sapiens
cuauguuucaucuug

SEQ ID NO: 1093954 - RNA, 21 nt, Homo sapiens
cuauuaauuccaugugauaca

SEQ ID NO: 1093955 - RNA, 12 nt, Homo sapiens
cuauuaguuuca

SEQ ID NO: 1093956 - RNA, 16 nt, Homo sapiens
cucaacagacccagug

SEQ ID NO: 1093957 - RNA, 15 nt, Homo sapiens
cucaauauauaguua

SEQ ID NO: 1093958 - RNA, 22 nt, Homo sapiens
cucacaagaacagaaccugcaa

SEQ ID NO: 1093959 - RNA, 23 nt, Homo sapiens
cucagaucauuaucagccugugc

SEQ ID NO: 1093960 - RNA, 23 nt, Homo sapiens
cucaucaggccauugucccugaa

SEQ ID NO: 1093961 - RNA, 15 nt, Homo sapiens
cucauuccagaggaa

SEQ ID NO: 1093962 - RNA, 17 nt, Homo sapiens
cuccaggauaccagcaa

SEQ ID NO: 1093963 - RNA, 18 nt, Homo sapiens
cuccauugguguugacau

SEQ ID NO: 1093964 - RNA, 22 nt, Homo sapiens
cuccauugguguugacauacau

SEQ ID NO: 1093965 - RNA, 14 nt, Homo sapiens
cuccccuacaucaa

SEQ ID NO: 1093966 - RNA, 22 nt, Homo sapiens
cuccucaggacccucccaggag

SEQ ID NO: 1093967 - RNA, 13 nt, Homo sapiens
cuccugcagggau

SEQ ID NO: 1093968 - RNA, 18 nt, Homo sapiens
cuccugucccucauccau

SEQ ID NO: 1093969 - RNA, 15 nt, Homo sapiens
cucguggaacaguua

SEQ ID NO: 1093970 - RNA, 23 nt, Homo sapiens
cucuaaauaaacagauacauuca

SEQ ID NO: 1093971 - RNA, 21 nt, Homo sapiens
cucucaggcauggaugaauaa

SEQ ID NO: 1093972 - RNA, 11 nt, Homo sapiens
cucucucauga

SEQ ID NO: 1093973 - RNA, 12 nt, Homo sapiens
cucugacaugac

SEQ ID NO: 1093974 - RNA, 13 nt, Homo sapiens
cucugaugcagug

SEQ ID NO: 1093975 - RNA, 12 nt, Homo sapiens
cugacugcaaaa

SEQ ID NO: 1093976 - RNA, 21 nt, Homo sapiens
cugacuguuuccaucaagggu

SEQ ID NO: 1093977 - RNA, 18 nt, Homo sapiens
cugagaauguuaccagac

SEQ ID NO: 1093978 - RNA, 19 nt, Homo sapiens
cugagcagguguucuucau

SEQ ID NO: 1093979 - RNA, 21 nt, Homo sapiens
cugaggccaggggagacaucg

SEQ ID NO: 1093980 - RNA, 23 nt, Homo sapiens
cugaggccaggggagacaucgca

SEQ ID NO: 1093981 - RNA, 18 nt, Homo sapiens
cugagugaaaaaagucac

SEQ ID NO: 1093982 - RNA, 15 nt, Homo sapiens
cugauuuaguugcau

SEQ ID NO: 1093983 - RNA, 21 nt, Homo sapiens
cugcaucuuaguuuacuggau

SEQ ID NO: 1093984 - RNA, 13 nt, Homo sapiens
cugcccagacaag

SEQ ID NO: 1093985 - RNA, 23 nt, Homo sapiens
cugcccgcccgcccgcauagcac

SEQ ID NO: 1093986 - RNA, 15 nt, Homo sapiens
cugccgaauauagaa

SEQ ID NO: 1093987 - RNA, 19 nt, Homo sapiens
cugccugagaauguuacca

SEQ ID NO: 1093988 - RNA, 17 nt, Homo sapiens
cugcuuugagcaguuug

SEQ ID NO: 1093989 - RNA, 17 nt, Homo sapiens
cugcuuuuuuucaggga

SEQ ID NO: 1093990 - RNA, 12 nt, Homo sapiens
cuggacaugucc

SEQ ID NO: 1093991 - RNA, 20 nt, Homo sapiens
gcggcuuugggacaccuggg

SEQ ID NO: 1093992 - RNA, 22 nt, Homo sapiens
gcuacgaccagggugagaauaa

SEQ ID NO: 1093993 - RNA, 18 nt, Homo sapiens
gcuaugguucucucgcaa

SEQ ID NO: 1093994 - RNA, 14 nt, Homo sapiens
gcuccaaggcagug

SEQ ID NO: 1093995 - RNA, 17 nt, Homo sapiens
gcugacgcgacuaucau

SEQ ID NO: 1093996 - RNA, 23 nt, Homo sapiens
gcugagcagguguucuucauuac

SEQ ID NO: 1093997 - RNA, 18 nt, Homo sapiens
gcugaggccucucauucc

SEQ ID NO: 1093998 - RNA, 22 nt, Homo sapiens
gcugaggccucucauuccagag

SEQ ID NO: 1093999 - RNA, 14 nt, Homo sapiens
gcugagguggcaga

SEQ ID NO: 1094000 - RNA, 15 nt, Homo sapiens
gcugaguacagucau

SEQ ID NO: 1094001 - RNA, 14 nt, Homo sapiens
gcuggggaugucuc

SEQ ID NO: 1094002 - RNA, 22 nt, Homo sapiens
gcuguggagauagugccagggu

SEQ ID NO: 1094003 - RNA, 19 nt, Homo sapiens
gcuuauagaggaacuugaa

SEQ ID NO: 1094004 - RNA, 19 nt, Homo sapiens
gcuuauugucuagugaaac

SEQ ID NO: 1094005 - RNA, 17 nt, Homo sapiens
gcuucuacacauuucau

SEQ ID NO: 1094006 - RNA, 16 nt, Homo sapiens
ggaaaaguaagggaau

SEQ ID NO: 1094007 - RNA, 23 nt, Homo sapiens
ggacagcccuucuuuccacagaa

SEQ ID NO: 1094008 - RNA, 15 nt, Homo sapiens
ggacugguuugggga

SEQ ID NO: 1094009 - RNA, 23 nt, Homo sapiens
ggagacauuguuuggauuuccuu

SEQ ID NO: 1094010 - RNA, 18 nt, Homo sapiens
ggaguaucugaaaggaau

SEQ ID NO: 1094011 - RNA, 18 nt, Homo sapiens
ggaugaauaaauguuaua

SEQ ID NO: 1094012 - RNA, 19 nt, Homo sapiens
ggcaacauaauaagacuuu

SEQ ID NO: 1094013 - RNA, 21 nt, Homo sapiens
ggcagggcugaggccucucau

SEQ ID NO: 1094014 - RNA, 14 nt, Homo sapiens
ggcauaguggcacu

SEQ ID NO: 1094015 - RNA, 11 nt, Homo sapiens
ggcauuugcag

SEQ ID NO: 1094016 - RNA, 13 nt, Homo sapiens
ggccaggacuuug

SEQ ID NO: 1094017 - RNA, 15 nt, Homo sapiens
ggccaggacuuugag

SEQ ID NO: 1094018 - RNA, 11 nt, Homo sapiens
ggccauagcaa

SEQ ID NO: 1094019 - RNA, 19 nt, Homo sapiens
ggcucgaugucugcuucuu

SEQ ID NO: 1094020 - RNA, 13 nt, Homo sapiens
ggcugaugcaguu

SEQ ID NO: 1094021 - RNA, 11 nt, Homo sapiens
ggcugccuugu

SEQ ID NO: 1094022 - RNA, 22 nt, Homo sapiens
gggaacagcaaaccaaugcuau

SEQ ID NO: 1094023 - RNA, 19 nt, Homo sapiens
gggacauuccucuaggacu

SEQ ID NO: 1094024 - RNA, 22 nt, Homo sapiens
gggaggaggcauucuugaacug

SEQ ID NO: 1094025 - RNA, 22 nt, Homo sapiens
gggccacucaggggucauucau

SEQ ID NO: 1094026 - RNA, 12 nt, Homo sapiens
gggccccagcca

SEQ ID NO: 1094027 - RNA, 23 nt, Homo sapiens
gggccccucacccccagcuggaa

SEQ ID NO: 1094028 - RNA, 14 nt, Homo sapiens
gggcucucucauga

SEQ ID NO: 1094029 - RNA, 17 nt, Homo sapiens
gggcugaggccagggga

SEQ ID NO: 1094030 - RNA, 13 nt, Homo sapiens
ggggcucucucau

SEQ ID NO: 1094031 - RNA, 10 nt, Homo sapiens
gggggaaaug

SEQ ID NO: 1094032 - RNA, 19 nt, Homo sapiens
ggggucggguccaccauga

SEQ ID NO: 1094033 - RNA, 13 nt, Homo sapiens
ggguacacggugg

SEQ ID NO: 1094034 - RNA, 17 nt, Homo sapiens
ggguagacacacaugaa

SEQ ID NO: 1094035 - RNA, 16 nt, Homo sapiens
gguaaaucacacugaa

SEQ ID NO: 1094036 - RNA, 23 nt, Homo sapiens
gguaaaucuaguaccaugucgua

SEQ ID NO: 1094037 - RNA, 11 nt, Homo sapiens
gguagcacuuu

SEQ ID NO: 1094038 - RNA, 12 nt, Homo sapiens
gguagcacuuua

SEQ ID NO: 1094039 - RNA, 17 nt, Homo sapiens
ggucaauggugcaaagg

SEQ ID NO: 1094040 - RNA, 17 nt, Homo sapiens
ggugggcugaguacagu

SEQ ID NO: 1094041 - RNA, 12 nt, Homo sapiens
ggugugcuguau

SEQ ID NO: 1094042 - RNA, 15 nt, Homo sapiens
guaaaacagauucua

SEQ ID NO: 1094043 - RNA, 17 nt, Homo sapiens
guaaaauuuugucauau

SEQ ID NO: 1094044 - RNA, 19 nt, Homo sapiens
guaaaauuuugucauauac

SEQ ID NO: 1094045 - RNA, 20 nt, Homo sapiens
guaaaauuuugucauauacc

SEQ ID NO: 1094046 - RNA, 23 nt, Homo sapiens
guaaugguucucauagugguaua

SEQ ID NO: 1094047 - RNA, 18 nt, Homo sapiens
guaauuuaaaauugugau

SEQ ID NO: 1094048 - RNA, 19 nt, Homo sapiens
guacaaugaguguuauaac

SEQ ID NO: 1094049 - RNA, 19 nt, Homo sapiens
guagcaggaccugccaaga

SEQ ID NO: 1094050 - RNA, 13 nt, Homo sapiens
guauaacugaaaa

SEQ ID NO: 1094051 - RNA, 17 nt, Homo sapiens
guauaguuagcuuuauu

SEQ ID NO: 1094052 - RNA, 21 nt, Homo sapiens
guaugauucccagccagcaca

SEQ ID NO: 1094053 - RNA, 23 nt, Homo sapiens
guauguuagugcaaauugucaca

SEQ ID NO: 1094054 - RNA, 17 nt, Homo sapiens
guauucuuaaaaugcaa

SEQ ID NO: 1094055 - RNA, 19 nt, Homo sapiens
gucaaaaccagagcgagaa

SEQ ID NO: 1094056 - RNA, 14 nt, Homo sapiens
gucacaaaaauuca

SEQ ID NO: 1094057 - RNA, 23 nt, Homo sapiens
gucaucaauaguguccuaugcaa

SEQ ID NO: 1094058 - RNA, 22 nt, Homo sapiens
gucauguaugugaaacaaugug

SEQ ID NO: 1094059 - RNA, 18 nt, Homo sapiens
gucccuugagugaggcag

SEQ ID NO: 1094060 - RNA, 17 nt, Homo sapiens
guccuuccaugcccuug

SEQ ID NO: 1094061 - RNA, 16 nt, Homo sapiens
guccuugaaugccaua

SEQ ID NO: 1094062 - RNA, 22 nt, Homo sapiens
gucgagggaaagagacccagaa

SEQ ID NO: 1094063 - RNA, 17 nt, Homo sapiens
gucuaucuaaugacaug

SEQ ID NO: 1094064 - RNA, 19 nt, Homo sapiens
gucuggccuuuucuuguaa

SEQ ID NO: 1094065 - RNA, 12 nt, Homo sapiens
gucuugaacucc

SEQ ID NO: 1094066 - RNA, 21 nt, Homo sapiens
gugaacaguacaauauuucag

SEQ ID NO: 1094067 - RNA, 14 nt, Homo sapiens
gugaggggcucucu

SEQ ID NO: 1094068 - RNA, 21 nt, Homo sapiens
gugauguguccugauaagcug

SEQ ID NO: 1094069 - RNA, 14 nt, Homo sapiens
gugauuaugccauu

SEQ ID NO: 1094070 - RNA, 20 nt, Homo sapiens
gugauuauuggauucacacc

SEQ ID NO: 1094071 - RNA, 18 nt, Homo sapiens
gugcuacgaccaggguga

SEQ ID NO: 1094072 - RNA, 16 nt, Homo sapiens
gugcuauaacauucug

SEQ ID NO: 1094073 - RNA, 17 nt, Homo sapiens
guggacuacaggacaag

SEQ ID NO: 1094074 - RNA, 20 nt, Homo sapiens
guggagauagugccagggug

SEQ ID NO: 1094075 - RNA, 23 nt, Homo sapiens
guggcucugccuucaaagggaaa

SEQ ID NO: 1094076 - RNA, 19 nt, Homo sapiens
guggggcacggagggcagu

SEQ ID NO: 1094077 - RNA, 20 nt, Homo sapiens
guuauaacagggaacagcaa

SEQ ID NO: 1094078 - RNA, 17 nt, Homo sapiens
guuauagcugcauuugu

SEQ ID NO: 1094079 - RNA, 17 nt, Homo sapiens
guucacauuaacucagg

SEQ ID NO: 1094080 - RNA, 17 nt, Homo sapiens
guucucauagugguaua

SEQ ID NO: 1094081 - RNA, 18 nt, Homo sapiens
guucuuaggaacagacuc

SEQ ID NO: 1094082 - RNA, 18 nt, Homo sapiens
uaaaacuuguuacaccac

SEQ ID NO: 1094083 - RNA, 14 nt, Homo sapiens
uaaaagaucuugca

SEQ ID NO: 1094084 - RNA, 17 nt, Homo sapiens
uaaaagaucuugcagaa

SEQ ID NO: 1094085 - RNA, 21 nt, Homo sapiens
uaaaagcuauuacuuggcaaa

SEQ ID NO: 1094086 - RNA, 16 nt, Homo sapiens
uaaaaugcuucacugu

SEQ ID NO: 1094087 - RNA, 14 nt, Homo sapiens
uaaaauugugaugu

SEQ ID NO: 1094088 - RNA, 17 nt, Homo sapiens
uaaacuuggcuguaugu

SEQ ID NO: 1094089 - RNA, 20 nt, Homo sapiens
uaaauaagauuuaauucaca

SEQ ID NO: 1094090 - RNA, 20 nt, Homo sapiens
uaaauauuugaaaauuaccu

SEQ ID NO: 1094091 - RNA, 14 nt, Homo sapiens
uaaaucacacugaa

SEQ ID NO: 1094092 - RNA, 20 nt, Homo sapiens
uaaauuuaaaacacaguauu

SEQ ID NO: 1094093 - RNA, 22 nt, Homo sapiens
uaaauuuaaaacacaguauugu

SEQ ID NO: 1094094 - RNA, 23 nt, Homo sapiens
uaaauuugaugcuuuaacugauc

SEQ ID NO: 1094095 - RNA, 15 nt, Homo sapiens
uaacaaugcuguauu

SEQ ID NO: 1094096 - RNA, 20 nt, Homo sapiens
uaacauuccuaaaaugcuuc

SEQ ID NO: 1094097 - RNA, 16 nt, Homo sapiens
cuuagggaacuuugau

SEQ ID NO: 1094098 - RNA, 22 nt, Homo sapiens
cuuaugcuguaacaguuagcau

SEQ ID NO: 1094099 - RNA, 17 nt, Homo sapiens
cuuauggccacaagcaa

SEQ ID NO: 1094100 - RNA, 16 nt, Homo sapiens
cuucagauuugccuua

SEQ ID NO: 1094101 - RNA, 18 nt, Homo sapiens
cuucaucgggguggugca

SEQ ID NO: 1094102 - RNA, 14 nt, Homo sapiens
cuucauuaccucag

SEQ ID NO: 1094103 - RNA, 17 nt, Homo sapiens
cuucauuaccucaguga

SEQ ID NO: 1094104 - RNA, 23 nt, Homo sapiens
cuucuaccucuuggcugccuugu

SEQ ID NO: 1094105 - RNA, 13 nt, Homo sapiens
cuucuccaagaag

SEQ ID NO: 1094106 - RNA, 20 nt, Homo sapiens
cuucugcuuuuuuucaggga

SEQ ID NO: 1094107 - RNA, 14 nt, Homo sapiens
cuucuggcuguaga

SEQ ID NO: 1094108 - RNA, 14 nt, Homo sapiens
cuugaaaugaaauc

SEQ ID NO: 1094109 - RNA, 21 nt, Homo sapiens
cuugaaugccauagucaaaga

SEQ ID NO: 1094110 - RNA, 15 nt, Homo sapiens
cuugauuaauguacu

SEQ ID NO: 1094111 - RNA, 16 nt, Homo sapiens
cuugccacaucuugaa

SEQ ID NO: 1094112 - RNA, 21 nt, Homo sapiens
cuugccuaaggccagccauuu

SEQ ID NO: 1094113 - RNA, 17 nt, Homo sapiens
cuugguagcacuuuaaa

SEQ ID NO: 1094114 - RNA, 13 nt, Homo sapiens
cuuguuggguaaa

SEQ ID NO: 1094115 - RNA, 21 nt, Homo sapiens
cuuuaaaaauaaaagcuauua

SEQ ID NO: 1094116 - RNA, 15 nt, Homo sapiens
cuuuaaaaugcacac

SEQ ID NO: 1094117 - RNA, 23 nt, Homo sapiens
cuuuaaacuacugaacuguuacc

SEQ ID NO: 1094118 - RNA, 16 nt, Homo sapiens
cuuuaaucacuuaaca

SEQ ID NO: 1094119 - RNA, 16 nt, Homo sapiens
cuuuccccucccucag

SEQ ID NO: 1094120 - RNA, 18 nt, Homo sapiens
cuuugaucuguuugucaa

SEQ ID NO: 1094121 - RNA, 14 nt, Homo sapiens
cuuuguaucauuca

SEQ ID NO: 1094122 - RNA, 13 nt, Homo sapiens
cuuugucccagaa

SEQ ID NO: 1094123 - RNA, 14 nt, Homo sapiens
cuuuguguuugcuu

SEQ ID NO: 1094124 - RNA, 22 nt, Homo sapiens
cuuuguguuugcuuggugcugg

SEQ ID NO: 1094125 - RNA, 20 nt, Homo sapiens
cuuuucuuuguaucauucau

SEQ ID NO: 1094126 - RNA, 13 nt, Homo sapiens
cuuuugucccaga

SEQ ID NO: 1094127 - RNA, 15 nt, Homo sapiens
gaaaaaaaguugcaa

SEQ ID NO: 1094128 - RNA, 20 nt, Homo sapiens
gaaaaaaaguugcaaucugu

SEQ ID NO: 1094129 - RNA, 19 nt, Homo sapiens
gaaaagcaguggcuccauu

SEQ ID NO: 1094130 - RNA, 16 nt, Homo sapiens
gaaaauaaaauuuaac

SEQ ID NO: 1094131 - RNA, 22 nt, Homo sapiens
gaaaaugccaccauccaauaaa

SEQ ID NO: 1094132 - RNA, 20 nt, Homo sapiens
gaaacaccaagugaggccau

SEQ ID NO: 1094133 - RNA, 18 nt, Homo sapiens
gaaaccacacagacuugg

SEQ ID NO: 1094134 - RNA, 19 nt, Homo sapiens
gaaaccuugaaagacauuu

SEQ ID NO: 1094135 - RNA, 23 nt, Homo sapiens
gaaagguacuucaaauccuugaa

SEQ ID NO: 1094136 - RNA, 16 nt, Homo sapiens
gaacccucaacugaca

SEQ ID NO: 1094137 - RNA, 18 nt, Homo sapiens
gaagaaguugauaugccu

SEQ ID NO: 1094138 - RNA, 13 nt, Homo sapiens
gaagagaagggca

SEQ ID NO: 1094139 - RNA, 17 nt, Homo sapiens
gaagcaccaaucaugaa

SEQ ID NO: 1094140 - RNA, 13 nt, Homo sapiens
gaagcuuauagag

SEQ ID NO: 1094141 - RNA, 14 nt, Homo sapiens
gaaggaauuauucc

SEQ ID NO: 1094142 - RNA, 19 nt, Homo sapiens
gaaggaggagucagggaga

SEQ ID NO: 1094143 - RNA, 12 nt, Homo sapiens
gaaggugcaguu

SEQ ID NO: 1094144 - RNA, 22 nt, Homo sapiens
gaaggugcaguugaauucagug

SEQ ID NO: 1094145 - RNA, 10 nt, Homo sapiens
gaaguauuua

SEQ ID NO: 1094146 - RNA, 22 nt, Homo sapiens
gaauauacacauuuuguaaauc

SEQ ID NO: 1094147 - RNA, 20 nt, Homo sapiens
gaauccaagacaaacuaaac

SEQ ID NO: 1094148 - RNA, 15 nt, Homo sapiens
gaaugagagacacac

SEQ ID NO: 1094149 - RNA, 16 nt, Homo sapiens
gacaaccucauuuuaa

SEQ ID NO: 1094150 - RNA, 19 nt, Homo sapiens
gacagcuguauauugcuca

SEQ ID NO: 1094151 - RNA, 21 nt, Homo sapiens
gacagugcccagagugacagc

SEQ ID NO: 1094152 - RNA, 20 nt, Homo sapiens
gacaucuggcggccaaguga

SEQ ID NO: 1094153 - RNA, 18 nt, Homo sapiens
gacaugaaauacuuuaaa

SEQ ID NO: 1094154 - RNA, 19 nt, Homo sapiens
gacauuugcucauggaauu

SEQ ID NO: 1094155 - RNA, 18 nt, Homo sapiens
gacccagaaaggacacaa

SEQ ID NO: 1094156 - RNA, 22 nt, Homo sapiens
gaccugggagcaggggcaauga

SEQ ID NO: 1094157 - RNA, 14 nt, Homo sapiens
gaccuguugggagu

SEQ ID NO: 1094158 - RNA, 16 nt, Homo sapiens
gacgacuguuuuccca

SEQ ID NO: 1094159 - RNA, 17 nt, Homo sapiens
gacgggugggaaugacc

SEQ ID NO: 1094160 - RNA, 22 nt, Homo sapiens
gacuaaaauguuucauuuaccu

SEQ ID NO: 1094161 - RNA, 12 nt, Homo sapiens
gacuauggagcu

SEQ ID NO: 1094162 - RNA, 23 nt, Homo sapiens
gagaagagggggcuaaauuugau

SEQ ID NO: 1094163 - RNA, 21 nt, Homo sapiens
gagaagccagcuuuccucauc

SEQ ID NO: 1094164 - RNA, 13 nt, Homo sapiens
gagaaugucagua

SEQ ID NO: 1094165 - RNA, 18 nt, Homo sapiens
gagagacacacugaagaa

SEQ ID NO: 1094166 - RNA, 14 nt, Homo sapiens
gagagagugcuauu

SEQ ID NO: 1094167 - RNA, 13 nt, Homo sapiens
gagaggaaaagca

SEQ ID NO: 1094168 - RNA, 14 nt, Homo sapiens
gagaguacauggca

SEQ ID NO: 1094169 - RNA, 21 nt, Homo sapiens
gagcccuucacuccugagaaa

SEQ ID NO: 1094170 - RNA, 20 nt, Homo sapiens
gagccuguccuuccaugccc

SEQ ID NO: 1094171 - RNA, 22 nt, Homo sapiens
gaggagagauauuuugauucuc

SEQ ID NO: 1094172 - RNA, 18 nt, Homo sapiens
gaguugcaagaugcccua

SEQ ID NO: 1094173 - RNA, 13 nt, Homo sapiens
gauaaaaccuccu

SEQ ID NO: 1094174 - RNA, 20 nt, Homo sapiens
gauaaucacaauacaucccu

SEQ ID NO: 1094175 - RNA, 20 nt, Homo sapiens
gauacaaaugggaauucacu

SEQ ID NO: 1094176 - RNA, 14 nt, Homo sapiens
gauaccaugcaaua

SEQ ID NO: 1094177 - RNA, 13 nt, Homo sapiens
gauccucuugcca

SEQ ID NO: 1094178 - RNA, 14 nt, Homo sapiens
gauccucuugccac

SEQ ID NO: 1094179 - RNA, 19 nt, Homo sapiens
gaucuuagggaacuuugau

SEQ ID NO: 1094180 - RNA, 22 nt, Homo sapiens
gaugcaguucugaagaagaugg

SEQ ID NO: 1094181 - RNA, 16 nt, Homo sapiens
gaugcuuuaacugauc

SEQ ID NO: 1094182 - RNA, 18 nt, Homo sapiens
gauggggaaggcuuucag

SEQ ID NO: 1094183 - RNA, 20 nt, Homo sapiens
gauguaccagcaucucccag

SEQ ID NO: 1094184 - RNA, 13 nt, Homo sapiens
gauguguggacac

SEQ ID NO: 1094185 - RNA, 20 nt, Homo sapiens
gauuagucagaaacugccau

SEQ ID NO: 1094186 - RNA, 16 nt, Homo sapiens
gauucuuccugcuuag

SEQ ID NO: 1094187 - RNA, 16 nt, Homo sapiens
gcaaaccaaugcuauu

SEQ ID NO: 1094188 - RNA, 21 nt, Homo sapiens
gcaaaggcgggaggaucacuu

SEQ ID NO: 1094189 - RNA, 21 nt, Homo sapiens
gcaaagggccugcccagacaa

SEQ ID NO: 1094190 - RNA, 22 nt, Homo sapiens
gcaaagggccugcccagacaag

SEQ ID NO: 1094191 - RNA, 19 nt, Homo sapiens
gcaaauccgaaaucagcag

SEQ ID NO: 1094192 - RNA, 14 nt, Homo sapiens
gcaacaaaugcauc

SEQ ID NO: 1094193 - RNA, 18 nt, Homo sapiens
gcaaccagucaaaaccag

SEQ ID NO: 1094194 - RNA, 13 nt, Homo sapiens
gcaacgacuacuu

SEQ ID NO: 1094195 - RNA, 14 nt, Homo sapiens
gcaacuccccuaca

SEQ ID NO: 1094196 - RNA, 19 nt, Homo sapiens
gcaacuccccuacaucaaa

SEQ ID NO: 1094197 - RNA, 13 nt, Homo sapiens
gcaagagacuuug

SEQ ID NO: 1094198 - RNA, 14 nt, Homo sapiens
gcaagucacuggcc

SEQ ID NO: 1094199 - RNA, 20 nt, Homo sapiens
gcaauaauacaacuaucaua

SEQ ID NO: 1094200 - RNA, 16 nt, Homo sapiens
gcacaaagacagagac

SEQ ID NO: 1094201 - RNA, 17 nt, Homo sapiens
gcacuguuuauggaaau

SEQ ID NO: 1094202 - RNA, 18 nt, Homo sapiens
gcaggacacugcagaaca

SEQ ID NO: 1094203 - RNA, 20 nt, Homo sapiens
gcaggacgacuguuuuccca

SEQ ID NO: 1094204 - RNA, 15 nt, Homo sapiens
gcaggggcacggugg

SEQ ID NO: 1094205 - RNA, 19 nt, Homo sapiens
gcagggugaaguguacaga

SEQ ID NO: 1094206 - RNA, 12 nt, Homo sapiens
gcauagcacuug

SEQ ID NO: 1094207 - RNA, 13 nt, Homo sapiens
gcauaguggcacu

SEQ ID NO: 1094208 - RNA, 11 nt, Homo sapiens
gcaucauucac

SEQ ID NO: 1094209 - RNA, 14 nt, Homo sapiens
gcaucuuaguuuac

SEQ ID NO: 1094210 - RNA, 19 nt, Homo sapiens
gcaucuuucauaguucugu

SEQ ID NO: 1094211 - RNA, 16 nt, Homo sapiens
gcauggucuuaugcac

SEQ ID NO: 1094212 - RNA, 18 nt, Homo sapiens
gcauuuuuaaucagugga

SEQ ID NO: 1094213 - RNA, 23 nt, Homo sapiens
gccaaaacaagggauuaucacau

SEQ ID NO: 1094214 - RNA, 14 nt, Homo sapiens
gccacagugcaauu

SEQ ID NO: 1094215 - RNA, 17 nt, Homo sapiens
gccacgugaacuaugca

SEQ ID NO: 1094216 - RNA, 21 nt, Homo sapiens
gccaguggcuggaucugugag

SEQ ID NO: 1094217 - RNA, 19 nt, Homo sapiens
gccccugcccacgcccuug

SEQ ID NO: 1094218 - RNA, 15 nt, Homo sapiens
gcccgcauagcacuu

SEQ ID NO: 1094219 - RNA, 16 nt, Homo sapiens
gcccgcauagcacuug

SEQ ID NO: 1094220 - RNA, 17 nt, Homo sapiens
gcccgcccgcauagcac

SEQ ID NO: 1094221 - RNA, 20 nt, Homo sapiens
gccgagcgccgaacucgcuc

SEQ ID NO: 1094222 - RNA, 12 nt, Homo sapiens
gccgccugucaa

SEQ ID NO: 1094223 - RNA, 19 nt, Homo sapiens
gccuacuucaucucaggac

SEQ ID NO: 1094224 - RNA, 21 nt, Homo sapiens
gccuccuuuccccucccucag

SEQ ID NO: 1094225 - RNA, 17 nt, Homo sapiens
gccugaacgcacaugac

SEQ ID NO: 1094226 - RNA, 13 nt, Homo sapiens
gccugcccagaca

SEQ ID NO: 1094227 - RNA, 20 nt, Homo sapiens
gccugcuaaggaacaaugcc

SEQ ID NO: 1094228 - RNA, 19 nt, Homo sapiens
gccugucaauaaauguuga

SEQ ID NO: 1094229 - RNA, 20 nt, Homo sapiens
gcgagaacccucaacugaca

SEQ ID NO: 1094230 - RNA, 21 nt, Homo sapiens
gcgauuucacaguuggcacuu

SEQ ID NO: 1094231 - RNA, 16 nt, Homo sapiens
gcgcugaguggaacca

SEQ ID NO: 1094232 - RNA, 22 nt, Homo sapiens
gcgggaacggggguacacggug

SEQ ID NO: 1094233 - RNA, 15 nt, Homo sapiens
gcuauuguagagcca

SEQ ID NO: 1094234 - RNA, 20 nt, Homo sapiens
gcucaggacacaagaacuaa

SEQ ID NO: 1094235 - RNA, 20 nt, Homo sapiens
gcucauugcaagcucaagug

SEQ ID NO: 1094236 - RNA, 21 nt, Homo sapiens
gcuccaaaccaacauggagua

SEQ ID NO: 1094237 - RNA, 17 nt, Homo sapiens
gcucccaccuguagucc

SEQ ID NO: 1094238 - RNA, 13 nt, Homo sapiens
gcucuauuuacuu

SEQ ID NO: 1094239 - RNA, 22 nt, Homo sapiens
gcugaggccaggggagacauca

SEQ ID NO: 1094240 - RNA, 13 nt, Homo sapiens
gcugaugcaguug

SEQ ID NO: 1094241 - RNA, 14 nt, Homo sapiens
gcugcacuguuuau

SEQ ID NO: 1094242 - RNA, 20 nt, Homo sapiens
gcuggagcauaguggcaaga

SEQ ID NO: 1094243 - RNA, 19 nt, Homo sapiens
gcuggcccggccacucuga

SEQ ID NO: 1094244 - RNA, 17 nt, Homo sapiens
gcuguauccauccaugg

SEQ ID NO: 1094245 - RNA, 19 nt, Homo sapiens
gcuucagagacacacaauu

SEQ ID NO: 1094246 - RNA, 18 nt, Homo sapiens
gcuucagauaccaugcaa

SEQ ID NO: 1094247 - RNA, 22 nt, Homo sapiens
gcuucauagagcaaccagucaa

SEQ ID NO: 1094248 - RNA, 14 nt, Homo sapiens
gcuugguagcacuu

SEQ ID NO: 1094249 - RNA, 15 nt, Homo sapiens
gcuugguagcacuuu

SEQ ID NO: 1094250 - RNA, 14 nt, Homo sapiens
gcuuguuccaaugc

SEQ ID NO: 1094251 - RNA, 23 nt, Homo sapiens
gcuuuacaaggaguaacaaaaca

SEQ ID NO: 1094252 - RNA, 15 nt, Homo sapiens
gcuuuuauaguuuag

SEQ ID NO: 1094253 - RNA, 20 nt, Homo sapiens
ggaaagaauuaaugcucuaa

SEQ ID NO: 1094254 - RNA, 16 nt, Homo sapiens
ggaauuauucccauga

SEQ ID NO: 1094255 - RNA, 16 nt, Homo sapiens
ggacaaccucauuuua

SEQ ID NO: 1094256 - RNA, 19 nt, Homo sapiens
ggacagucaccucauggaa

SEQ ID NO: 1094257 - RNA, 14 nt, Homo sapiens
ggacauguccagga

SEQ ID NO: 1094258 - RNA, 14 nt, Homo sapiens
ggacccaaagagga

SEQ ID NO: 1094259 - RNA, 21 nt, Homo sapiens
ggaccugccaagaagauuccu

SEQ ID NO: 1094260 - RNA, 19 nt, Homo sapiens
ggacgacuguuuucccaac

SEQ ID NO: 1094261 - RNA, 17 nt, Homo sapiens
ggagacaucacaaccuc

SEQ ID NO: 1094262 - RNA, 21 nt, Homo sapiens
ggagucugccaaaacaaggga

SEQ ID NO: 1094263 - RNA, 18 nt, Homo sapiens
ggauaccagcaaauggau

SEQ ID NO: 1094264 - RNA, 12 nt, Homo sapiens
ggaugucucuca

SEQ ID NO: 1094265 - RNA, 15 nt, Homo sapiens
ggaugucucucauga

SEQ ID NO: 1094266 - RNA, 14 nt, Homo sapiens
ggcaauagucaaau

SEQ ID NO: 1094267 - RNA, 22 nt, Homo sapiens
ggcacuaguauuucuaugaaau

SEQ ID NO: 1094268 - RNA, 11 nt, Homo sapiens
ggccagcacca

SEQ ID NO: 1094269 - RNA, 16 nt, Homo sapiens
ggccagcaccaucucu

SEQ ID NO: 1094270 - RNA, 22 nt, Homo sapiens
ggccguugcuacaagucaccug

SEQ ID NO: 1094271 - RNA, 14 nt, Homo sapiens
ggccugacucucag

SEQ ID NO: 1094272 - RNA, 19 nt, Homo sapiens
ggcucugccuucaaaggga

SEQ ID NO: 1094273 - RNA, 13 nt, Homo sapiens
ggcuuucagcuga

SEQ ID NO: 1094274 - RNA, 18 nt, Homo sapiens
gggaaugaccccuaggca

SEQ ID NO: 1094275 - RNA, 19 nt, Homo sapiens
gggaauugaggacacugau

SEQ ID NO: 1094276 - RNA, 16 nt, Homo sapiens
gggacagucaccucau

SEQ ID NO: 1094277 - RNA, 12 nt, Homo sapiens
gggauacaggcc

SEQ ID NO: 1094278 - RNA, 20 nt, Homo sapiens
gggcaaugaccguuugacug

SEQ ID NO: 1094279 - RNA, 16 nt, Homo sapiens
gggccugcccagacaa

SEQ ID NO: 1094280 - RNA, 15 nt, Homo sapiens
gggccuuacuuccca

SEQ ID NO: 1094281 - RNA, 17 nt, Homo sapiens
gggcugaggccucucau

SEQ ID NO: 1094282 - RNA, 14 nt, Homo sapiens
gggcugaugcaguu

SEQ ID NO: 1094283 - RNA, 15 nt, Homo sapiens
ggggaugucucucau

SEQ ID NO: 1094284 - RNA, 14 nt, Homo sapiens
ggggcauuguugcu

SEQ ID NO: 1094285 - RNA, 16 nt, Homo sapiens
ggggcugaugcaguug

SEQ ID NO: 1094286 - RNA, 14 nt, Homo sapiens
gguagguugggaga

SEQ ID NO: 1094287 - RNA, 15 nt, Homo sapiens
gguuuauuugcagua

SEQ ID NO: 1094288 - RNA, 21 nt, Homo sapiens
guaaaugauaccuacauucua

SEQ ID NO: 1094289 - RNA, 16 nt, Homo sapiens
guaauuuuauuuacau

SEQ ID NO: 1094290 - RNA, 16 nt, Homo sapiens
guacacugccuucuca

SEQ ID NO: 1094291 - RNA, 15 nt, Homo sapiens
guagcuuuuacuuuu

SEQ ID NO: 1094292 - RNA, 14 nt, Homo sapiens
guaggaacugcugg

SEQ ID NO: 1094293 - RNA, 15 nt, Homo sapiens
guagucccagcacuu

SEQ ID NO: 1094294 - RNA, 11 nt, Homo sapiens
guagucucucu

SEQ ID NO: 1094295 - RNA, 18 nt, Homo sapiens
guauaacugaaaaaggac

SEQ ID NO: 1094296 - RNA, 21 nt, Homo sapiens
guauaacugaaaaaggacuuu

SEQ ID NO: 1094297 - RNA, 20 nt, Homo sapiens
guauuagaauaccacaggaa

SEQ ID NO: 1094298 - RNA, 14 nt, Homo sapiens
guauuagcaaugaa

SEQ ID NO: 1094299 - RNA, 14 nt, Homo sapiens
gucaaaaccagagc

SEQ ID NO: 1094300 - RNA, 15 nt, Homo sapiens
gucagaaacugccau

SEQ ID NO: 1094301 - RNA, 15 nt, Homo sapiens
gucagagaccuggga

SEQ ID NO: 1094302 - RNA, 16 nt, Homo sapiens
gucaucuguaccucug

SEQ ID NO: 1094303 - RNA, 18 nt, Homo sapiens
guccagaaguggcccuug

SEQ ID NO: 1094304 - RNA, 19 nt, Homo sapiens
guccaggucuaccaaaaau

SEQ ID NO: 1094305 - RNA, 23 nt, Homo sapiens
gucccagaaugccuccugcaggg

SEQ ID NO: 1094306 - RNA, 13 nt, Homo sapiens
guccuaugcaaua

SEQ ID NO: 1094307 - RNA, 19 nt, Homo sapiens
gucugacuguuuccaucaa

SEQ ID NO: 1094308 - RNA, 16 nt, Homo sapiens
gucugggccacucagg

SEQ ID NO: 1094309 - RNA, 14 nt, Homo sapiens
gugaaaaaagucac

SEQ ID NO: 1094310 - RNA, 17 nt, Homo sapiens
gugacaagcucacagac

SEQ ID NO: 1094311 - RNA, 22 nt, Homo sapiens
gugaggaugucugggccacuca

SEQ ID NO: 1094312 - RNA, 22 nt, Homo sapiens
gugcaaggcaggggcacggugg

SEQ ID NO: 1094313 - RNA, 17 nt, Homo sapiens
guggaaaauuggcagug

SEQ ID NO: 1094314 - RNA, 21 nt, Homo sapiens
guggaaauaaaaagaaggaaa

SEQ ID NO: 1094315 - RNA, 13 nt, Homo sapiens
guggaacaagcag

SEQ ID NO: 1094316 - RNA, 20 nt, Homo sapiens
guggaacaagcagcuaagca

SEQ ID NO: 1094317 - RNA, 16 nt, Homo sapiens
guggcucccaaaaaga

SEQ ID NO: 1094318 - RNA, 16 nt, Homo sapiens
gugggcugaguacagu

SEQ ID NO: 1094319 - RNA, 13 nt, Homo sapiens
gugucacccuuag

SEQ ID NO: 1094320 - RNA, 15 nt, Homo sapiens
guguccuaugcaaua

SEQ ID NO: 1094321 - RNA, 19 nt, Homo sapiens
gugugugggaguguguaau

SEQ ID NO: 1094322 - RNA, 13 nt, Homo sapiens
guguguguguaug

SEQ ID NO: 1094323 - RNA, 17 nt, Homo sapiens
guguuuuaaaauugaug

SEQ ID NO: 1094324 - RNA, 16 nt, Homo sapiens
guuacagccauaugca

SEQ ID NO: 1094325 - RNA, 15 nt, Homo sapiens
guuacaucugugcag

SEQ ID NO: 1094326 - RNA, 17 nt, Homo sapiens
guuagcauggcuucaca

SEQ ID NO: 1094327 - RNA, 13 nt, Homo sapiens
guucuaaauggaa

SEQ ID NO: 1094328 - RNA, 12 nt, Homo sapiens
guugacauggga

SEQ ID NO: 1094329 - RNA, 13 nt, Homo sapiens
guuuacuggauaa

SEQ ID NO: 1094330 - RNA, 14 nt, Homo sapiens
guuuauuugcagua

SEQ ID NO: 1094331 - RNA, 15 nt, Homo sapiens
guuucaauugaguaa

SEQ ID NO: 1094332 - RNA, 15 nt, Homo sapiens
uaaaaaccgaauaaa

SEQ ID NO: 1094333 - RNA, 17 nt, Homo sapiens
uaaaaagcuucagggaa

SEQ ID NO: 1094334 - RNA, 22 nt, Homo sapiens
uaaaaauaaaagcuauuacuug

SEQ ID NO: 1094335 - RNA, 14 nt, Homo sapiens
uaaaagaauuguga

SEQ ID NO: 1094336 - RNA, 15 nt, Homo sapiens
uaaaauacauaacuu

SEQ ID NO: 1094337 - RNA, 18 nt, Homo sapiens
uaaaauauguccagaaga

SEQ ID NO: 1094338 - RNA, 12 nt, Homo sapiens
uaaaaugcaaua

SEQ ID NO: 1094339 - RNA, 18 nt, Homo sapiens
uaaaaugcuucacuguac

SEQ ID NO: 1094340 - RNA, 18 nt, Homo sapiens
uaaaauguagaaauucua

SEQ ID NO: 1094341 - RNA, 15 nt, Homo sapiens
uaaacagugucauau

SEQ ID NO: 1094342 - RNA, 12 nt, Homo sapiens
uaaacauugccu

SEQ ID NO: 1094343 - RNA, 15 nt, Homo sapiens
uaaacauuugccaaa

SEQ ID NO: 1094344 - RNA, 22 nt, Homo sapiens
uaaacauuugccaaaaauucau

SEQ ID NO: 1094345 - RNA, 17 nt, Homo sapiens
uaaacugaacacaugac

SEQ ID NO: 1094346 - RNA, 19 nt, Homo sapiens
uaaagacccaacauuacua

SEQ ID NO: 1094347 - RNA, 18 nt, Homo sapiens
uaaagagcauauucacug

SEQ ID NO: 1094348 - RNA, 18 nt, Homo sapiens
uaaaguacuaaaucucac

SEQ ID NO: 1094349 - RNA, 14 nt, Homo sapiens
uaaauaaacauaua

SEQ ID NO: 1094350 - RNA, 14 nt, Homo sapiens
uaaaucuguacuuu

SEQ ID NO: 1094351 - RNA, 19 nt, Homo sapiens
uaaaugauaccuacauucu

SEQ ID NO: 1094352 - RNA, 18 nt, Homo sapiens
uaagaagacugcauuaua

SEQ ID NO: 1094353 - RNA, 23 nt, Homo sapiens
uaagagaaagucaccugcccaag

SEQ ID NO: 1094354 - RNA, 20 nt, Homo sapiens
uaagcugagcuccuuagccu

SEQ ID NO: 1094355 - RNA, 19 nt, Homo sapiens
uaaggaaaaguaagggaau

SEQ ID NO: 1094356 - RNA, 21 nt, Homo sapiens
uaaggcuuguuccaaugccac

SEQ ID NO: 1094357 - RNA, 16 nt, Homo sapiens
uaaucgagacugaaag

SEQ ID NO: 1094358 - RNA, 16 nt, Homo sapiens
uaaucugagaguuuuc

SEQ ID NO: 1094359 - RNA, 13 nt, Homo sapiens
uaaugcaaugcau

SEQ ID NO: 1094360 - RNA, 10 nt, Homo sapiens
uaaugcucua

SEQ ID NO: 1094361 - RNA, 20 nt, Homo sapiens
uaauguacuuuuuauugcau

SEQ ID NO: 1094362 - RNA, 22 nt, Homo sapiens
uaauguguggaaugugcagauu

SEQ ID NO: 1094363 - RNA, 23 nt, Homo sapiens
uaauuccacacccucacugcugu

SEQ ID NO: 1094364 - RNA, 22 nt, Homo sapiens
uaauuugcaauuugucagugua

SEQ ID NO: 1094365 - RNA, 12 nt, Homo sapiens
uacaauugucau

SEQ ID NO: 1094366 - RNA, 15 nt, Homo sapiens
uacacagucacacaa

SEQ ID NO: 1094367 - RNA, 15 nt, Homo sapiens
uacacauuuuguaaa

SEQ ID NO: 1094368 - RNA, 18 nt, Homo sapiens
uacacggugggcugagua

SEQ ID NO: 1094369 - RNA, 16 nt, Homo sapiens
uacauaagcuucucaa

SEQ ID NO: 1094370 - RNA, 18 nt, Homo sapiens
uacaucccuuaccuggga

SEQ ID NO: 1094371 - RNA, 21 nt, Homo sapiens
uacauguuuauauuaaucucu

SEQ ID NO: 1094372 - RNA, 15 nt, Homo sapiens
uacauucuugcuaau

SEQ ID NO: 1094373 - RNA, 20 nt, Homo sapiens
uacauucuugcuaauucuca

SEQ ID NO: 1094374 - RNA, 16 nt, Homo sapiens
uacauuuggaacagug

SEQ ID NO: 1094375 - RNA, 11 nt, Homo sapiens
uaccacaggaa

SEQ ID NO: 1094376 - RNA, 15 nt, Homo sapiens
uaccagcaaauggau

SEQ ID NO: 1094377 - RNA, 22 nt, Homo sapiens
uaccaugucguaguuacucuca

SEQ ID NO: 1094378 - RNA, 16 nt, Homo sapiens
uaccuaauacagcaga

SEQ ID NO: 1094379 - RNA, 16 nt, Homo sapiens
uaccuaaugaaaguga

SEQ ID NO: 1094380 - RNA, 12 nt, Homo sapiens
uaccuacauucu

SEQ ID NO: 1094381 - RNA, 17 nt, Homo sapiens
uaccucuauuaguuuca

SEQ ID NO: 1094382 - RNA, 19 nt, Homo sapiens
uaccuggcccugugccuug

SEQ ID NO: 1094383 - RNA, 12 nt, Homo sapiens
uacuauguuaau

SEQ ID NO: 1094384 - RNA, 14 nt, Homo sapiens
uacugaacuguuac

SEQ ID NO: 1094385 - RNA, 16 nt, Homo sapiens
uacuucuggagucuau

SEQ ID NO: 1094386 - RNA, 18 nt, Homo sapiens
uagcaacuccccuacauc

SEQ ID NO: 1094387 - RNA, 21 nt, Homo sapiens
uagcaacuccccuacaucaaa

SEQ ID NO: 1094388 - RNA, 17 nt, Homo sapiens
uagcaggaccugccaag

SEQ ID NO: 1094389 - RNA, 22 nt, Homo sapiens
uagcauaaauacuuauggcuca

SEQ ID NO: 1094390 - RNA, 18 nt, Homo sapiens
uagccacgcacagccaga

SEQ ID NO: 1094391 - RNA, 22 nt, Homo sapiens
uagcuaaggcuuggaaacagaa

SEQ ID NO: 1094392 - RNA, 15 nt, Homo sapiens
uagcucuauuuacuu

SEQ ID NO: 1094393 - RNA, 14 nt, Homo sapiens
uagcugcacuguuu

SEQ ID NO: 1094394 - RNA, 17 nt, Homo sapiens
uagcuuuuacuuuuuau

SEQ ID NO: 1094395 - RNA, 20 nt, Homo sapiens
uaggaacagacucgaugcaa

SEQ ID NO: 1094396 - RNA, 21 nt, Homo sapiens
uaggaacugcugggcuuggca

SEQ ID NO: 1094397 - RNA, 17 nt, Homo sapiens
uaggccagcaccaucuc

SEQ ID NO: 1094398 - RNA, 22 nt, Homo sapiens
uaggccauuuguuacaguuucu

SEQ ID NO: 1094399 - RNA, 16 nt, Homo sapiens
uaguauugaaaacuag

SEQ ID NO: 1094400 - RNA, 15 nt, Homo sapiens
uagucccagcacuuu

SEQ ID NO: 1094401 - RNA, 16 nt, Homo sapiens
uaguguccuaugcaau

SEQ ID NO: 1094402 - RNA, 13 nt, Homo sapiens
uauaaaaacagac

SEQ ID NO: 1094403 - RNA, 16 nt, Homo sapiens
uauaagacacaugcag

SEQ ID NO: 1094404 - RNA, 16 nt, Homo sapiens
uauaguuagcuuuauu

SEQ ID NO: 1094405 - RNA, 19 nt, Homo sapiens
uauauggcauuugcagauu

SEQ ID NO: 1094406 - RNA, 18 nt, Homo sapiens
uauauuauuacuaauugu

SEQ ID NO: 1094407 - RNA, 17 nt, Homo sapiens
uaucaaggaagucuuca

SEQ ID NO: 1094408 - RNA, 14 nt, Homo sapiens
uaucauucucucac

SEQ ID NO: 1094409 - RNA, 12 nt, Homo sapiens
uaucgcucuaaa

SEQ ID NO: 1094410 - RNA, 23 nt, Homo sapiens
uaugaacugaaggcagcauguau

SEQ ID NO: 1094411 - RNA, 23 nt, Homo sapiens
uaugcacaccuaagcccaaauau

SEQ ID NO: 1094412 - RNA, 18 nt, Homo sapiens
uauggguuggacaaccuc

SEQ ID NO: 1094413 - RNA, 16 nt, Homo sapiens
uaugguugauguggaa

SEQ ID NO: 1094414 - RNA, 17 nt, Homo sapiens
uaugugcggcuuuucag

SEQ ID NO: 1094415 - RNA, 22 nt, Homo sapiens
uauguggaagugugggucugug

SEQ ID NO: 1094416 - RNA, 23 nt, Homo sapiens
uauguggaagugugggucugugu

SEQ ID NO: 1094417 - RNA, 17 nt, Homo sapiens
uauuaaagaacgcugca

SEQ ID NO: 1094418 - RNA, 18 nt, Homo sapiens
uauuagagcugccugugc

SEQ ID NO: 1094419 - RNA, 14 nt, Homo sapiens
uauuggcagcucua

SEQ ID NO: 1094420 - RNA, 13 nt, Homo sapiens
uauugucuaguga

SEQ ID NO: 1094421 - RNA, 16 nt, Homo sapiens
ucaaaagaacauucuu

SEQ ID NO: 1094422 - RNA, 16 nt, Homo sapiens
ucaaaauccacugacg

SEQ ID NO: 1094423 - RNA, 13 nt, Homo sapiens
ucaaaccuguaga

SEQ ID NO: 1094424 - RNA, 20 nt, Homo sapiens
ucaaagggagagagugcuau

SEQ ID NO: 1094425 - RNA, 22 nt, Homo sapiens
ucaaagggagagagugcuauug

SEQ ID NO: 1094426 - RNA, 14 nt, Homo sapiens
ucaaauauugaaug

SEQ ID NO: 1094427 - RNA, 13 nt, Homo sapiens
ucaaauccuugaa

SEQ ID NO: 1094428 - RNA, 22 nt, Homo sapiens
ucaagugauccuccugacucag

SEQ ID NO: 1094429 - RNA, 19 nt, Homo sapiens
ucaauaguguccuaugcaa

SEQ ID NO: 1094430 - RNA, 18 nt, Homo sapiens
ucaauguuucacuacucu

SEQ ID NO: 1094431 - RNA, 21 nt, Homo sapiens
ucacaaccuccaacaacacuu

SEQ ID NO: 1094432 - RNA, 13 nt, Homo sapiens
ucacagcuaccaa

SEQ ID NO: 1094433 - RNA, 20 nt, Homo sapiens
ucacaguuggcacuucugcc

SEQ ID NO: 1094434 - RNA, 12 nt, Homo sapiens
ucaccucaugga

SEQ ID NO: 1094435 - RNA, 16 nt, Homo sapiens
ucacuacauugugcaa

SEQ ID NO: 1094436 - RNA, 17 nt, Homo sapiens
ucacuacauugugcaau

SEQ ID NO: 1094437 - RNA, 14 nt, Homo sapiens
ucagauaccaugca

SEQ ID NO: 1094438 - RNA, 20 nt, Homo sapiens
ucagauaccaugcaauaaua

SEQ ID NO: 1094439 - RNA, 20 nt, Homo sapiens
ucagauuuuaccuaauacag

SEQ ID NO: 1094440 - RNA, 14 nt, Homo sapiens
ucaggaacuauuaa

SEQ ID NO: 1094441 - RNA, 19 nt, Homo sapiens
ucaggagccugcuaaggaa

SEQ ID NO: 1094442 - RNA, 16 nt, Homo sapiens
ucaggcauuucauuua

SEQ ID NO: 1094443 - RNA, 18 nt, Homo sapiens
ucaggccauugucccuga

SEQ ID NO: 1094444 - RNA, 17 nt, Homo sapiens
ucaguaccauuugaucu

SEQ ID NO: 1094445 - RNA, 19 nt, Homo sapiens
ucaguaccauuugaucugc

SEQ ID NO: 1094446 - RNA, 18 nt, Homo sapiens
ucaguagcaggaccugcc

SEQ ID NO: 1094447 - RNA, 11 nt, Homo sapiens
ucaguaugugg

SEQ ID NO: 1094448 - RNA, 12 nt, Homo sapiens
ucaguaugugga

SEQ ID NO: 1094449 - RNA, 15 nt, Homo sapiens
ucauagaaaauguga

SEQ ID NO: 1094450 - RNA, 12 nt, Homo sapiens
ucaucaggccau

SEQ ID NO: 1094451 - RNA, 16 nt, Homo sapiens
ucaugccccaguauua

SEQ ID NO: 1094452 - RNA, 22 nt, Homo sapiens
ucauuacaaucgagacugcaau

SEQ ID NO: 1094453 - RNA, 18 nt, Homo sapiens
uccaacuaucucauuucc

SEQ ID NO: 1094454 - RNA, 16 nt, Homo sapiens
uccaacucuguauuua

SEQ ID NO: 1094455 - RNA, 17 nt, Homo sapiens
uccacacccucacugcu

SEQ ID NO: 1094456 - RNA, 14 nt, Homo sapiens
uccagcaguacaau

SEQ ID NO: 1094457 - RNA, 18 nt, Homo sapiens
uccaucuucauagcccaa

SEQ ID NO: 1094458 - RNA, 18 nt, Homo sapiens
uccauuuaaaaaugaucu

SEQ ID NO: 1094459 - RNA, 18 nt, Homo sapiens
ucccaagaaggcuuuauu

SEQ ID NO: 1094460 - RNA, 18 nt, Homo sapiens
ucccaagagggcuuuauu

SEQ ID NO: 1094461 - RNA, 13 nt, Homo sapiens
ucccacuuggcau

SEQ ID NO: 1094462 - RNA, 13 nt, Homo sapiens
ucccccaugcucu

SEQ ID NO: 1094463 - RNA, 13 nt, Homo sapiens
uccccuacaucaa

SEQ ID NO: 1094464 - RNA, 19 nt, Homo sapiens
uccccuacaucaaaugcuc

SEQ ID NO: 1094465 - RNA, 21 nt, Homo sapiens
uccccuacaucaaaugcucaa

SEQ ID NO: 1094466 - RNA, 19 nt, Homo sapiens
ucccucaggccgaaggagg

SEQ ID NO: 1094467 - RNA, 20 nt, Homo sapiens
ucccugaagagaagggcagg

SEQ ID NO: 1094468 - RNA, 19 nt, Homo sapiens
uccggccuccugucccuca

SEQ ID NO: 1094469 - RNA, 22 nt, Homo sapiens
uccuucuaacugaaggugcagu

SEQ ID NO: 1094470 - RNA, 21 nt, Homo sapiens
uccuuuccccucccucaggcc

SEQ ID NO: 1094471 - RNA, 15 nt, Homo sapiens
ucgcaccugugcugg

SEQ ID NO: 1094472 - RNA, 17 nt, Homo sapiens
ucgcccgaaacaccaag

SEQ ID NO: 1094473 - RNA, 16 nt, Homo sapiens
ucggaguaucugaaag

SEQ ID NO: 1094474 - RNA, 19 nt, Homo sapiens
aggagaguacauggcauug

SEQ ID NO: 1094475 - RNA, 23 nt, Homo sapiens
aggaguggccguugcuacaaguc

SEQ ID NO: 1094476 - RNA, 13 nt, Homo sapiens
aggauaacuaaaa

SEQ ID NO: 1094477 - RNA, 23 nt, Homo sapiens
aggaugaucaaaaauaaugcauc

SEQ ID NO: 1094478 - RNA, 22 nt, Homo sapiens
aggaugggggguguccccucag

SEQ ID NO: 1094479 - RNA, 13 nt, Homo sapiens
aggccauagcaau

SEQ ID NO: 1094480 - RNA, 18 nt, Homo sapiens
aggcucccaaacucaggc

SEQ ID NO: 1094481 - RNA, 20 nt, Homo sapiens
aggcugcagugagcugugau

SEQ ID NO: 1094482 - RNA, 17 nt, Homo sapiens
aggcuuggaaacagaac

SEQ ID NO: 1094483 - RNA, 16 nt, Homo sapiens
agggagagagugcuau

SEQ ID NO: 1094484 - RNA, 17 nt, Homo sapiens
agggccugcccagacaa

SEQ ID NO: 1094485 - RNA, 12 nt, Homo sapiens
agggcuugccua

SEQ ID NO: 1094486 - RNA, 22 nt, Homo sapiens
aggggaaagaauuaaugcucua

SEQ ID NO: 1094487 - RNA, 13 nt, Homo sapiens
aggggucauucau

SEQ ID NO: 1094488 - RNA, 14 nt, Homo sapiens
aggguuaugauuaa

SEQ ID NO: 1094489 - RNA, 16 nt, Homo sapiens
agguaugaccuuuuaa

SEQ ID NO: 1094490 - RNA, 22 nt, Homo sapiens
agguggcucccaccuguagucc

SEQ ID NO: 1094491 - RNA, 21 nt, Homo sapiens
agguguucuucauuaccucag

SEQ ID NO: 1094492 - RNA, 23 nt, Homo sapiens
agguguucuucauuaccucagug

SEQ ID NO: 1094493 - RNA, 19 nt, Homo sapiens
agguucuaauguguggaau

SEQ ID NO: 1094494 - RNA, 20 nt, Homo sapiens
agguugcuguugugcagugu

SEQ ID NO: 1094495 - RNA, 21 nt, Homo sapiens
agguuuguuuagaagaagugu

SEQ ID NO: 1094496 - RNA, 19 nt, Homo sapiens
aguaaaaauaaacuguuau

SEQ ID NO: 1094497 - RNA, 15 nt, Homo sapiens
aguacuaaaucucac

SEQ ID NO: 1094498 - RNA, 17 nt, Homo sapiens
aguagcaggaccugcca

SEQ ID NO: 1094499 - RNA, 16 nt, Homo sapiens
aguaguuaaaacagcu

SEQ ID NO: 1094500 - RNA, 18 nt, Homo sapiens
aguauuaugacacuccca

SEQ ID NO: 1094501 - RNA, 18 nt, Homo sapiens
aguauuguagaaagcuaa

SEQ ID NO: 1094502 - RNA, 20 nt, Homo sapiens
aguauuuacaguauugagcu

SEQ ID NO: 1094503 - RNA, 14 nt, Homo sapiens
aguauuugcuguuu

SEQ ID NO: 1094504 - RNA, 15 nt, Homo sapiens
agucaccucauggaa

SEQ ID NO: 1094505 - RNA, 22 nt, Homo sapiens
agucagaaacugccauuugaaa

SEQ ID NO: 1094506 - RNA, 16 nt, Homo sapiens
agucauccucagauca

SEQ ID NO: 1094507 - RNA, 20 nt, Homo sapiens
aguccagcacccagguaaaa

SEQ ID NO: 1094508 - RNA, 16 nt, Homo sapiens
aguccugacugggcug

SEQ ID NO: 1094509 - RNA, 13 nt, Homo sapiens
agugaggccauag

SEQ ID NO: 1094510 - RNA, 15 nt, Homo sapiens
agugaggccauagca

SEQ ID NO: 1094511 - RNA, 16 nt, Homo sapiens
agugcaagagacuuug

SEQ ID NO: 1094512 - RNA, 22 nt, Homo sapiens
agugcaaggcaggggcacggug

SEQ ID NO: 1094513 - RNA, 11 nt, Homo sapiens
agugcugugcu

SEQ ID NO: 1094514 - RNA, 15 nt, Homo sapiens
agugggguagguugg

SEQ ID NO: 1094515 - RNA, 14 nt, Homo sapiens
aguguccuaugcaa

SEQ ID NO: 1094516 - RNA, 14 nt, Homo sapiens
aguguuucuguucu

SEQ ID NO: 1094517 - RNA, 22 nt, Homo sapiens
aguuaagagaaagucaccugcc

SEQ ID NO: 1094518 - RNA, 16 nt, Homo sapiens
aguuaauaaguuaaaa

SEQ ID NO: 1094519 - RNA, 18 nt, Homo sapiens
aguuacagccauaugcag

SEQ ID NO: 1094520 - RNA, 23 nt, Homo sapiens
aguucuagcucuauuuacuucua

SEQ ID NO: 1094521 - RNA, 13 nt, Homo sapiens
aguuuacuggaua

SEQ ID NO: 1094522 - RNA, 16 nt, Homo sapiens
aguuuggcaguauuua

SEQ ID NO: 1094523 - RNA, 15 nt, Homo sapiens
aguuuuauuacacau

SEQ ID NO: 1094524 - RNA, 16 nt, Homo sapiens
auaaaaagaaggaaaa

SEQ ID NO: 1094525 - RNA, 17 nt, Homo sapiens
auaaaagcacaaagaca

SEQ ID NO: 1094526 - RNA, 17 nt, Homo sapiens
auaaaaguaaaccacaa

SEQ ID NO: 1094527 - RNA, 15 nt, Homo sapiens
auaaaauuauuugca

SEQ ID NO: 1094528 - RNA, 15 nt, Homo sapiens
auaaaauuuaacuca

SEQ ID NO: 1094529 - RNA, 18 nt, Homo sapiens
auaaacaugcuugcauua

SEQ ID NO: 1094530 - RNA, 17 nt, Homo sapiens
auaaagacgucuccuca

SEQ ID NO: 1094531 - RNA, 13 nt, Homo sapiens
auaaaugucuagu

SEQ ID NO: 1094532 - RNA, 16 nt, Homo sapiens
auaacuggaaacuuca

SEQ ID NO: 1094533 - RNA, 13 nt, Homo sapiens
auaagagacuuau

SEQ ID NO: 1094534 - RNA, 20 nt, Homo sapiens
auaagcagucauccucagau

SEQ ID NO: 1094535 - RNA, 21 nt, Homo sapiens
auaauaaaaagcuucagggaa

SEQ ID NO: 1094536 - RNA, 22 nt, Homo sapiens
auaauaauuaaagaaugcaaua

SEQ ID NO: 1094537 - RNA, 15 nt, Homo sapiens
auaaugcauccagca

SEQ ID NO: 1094538 - RNA, 15 nt, Homo sapiens
auaauguuuauucaa

SEQ ID NO: 1094539 - RNA, 13 nt, Homo sapiens
auacaauugucau

SEQ ID NO: 1094540 - RNA, 16 nt, Homo sapiens
auaccaggaccaguuu

SEQ ID NO: 1094541 - RNA, 13 nt, Homo sapiens
auaccaugcaaua

SEQ ID NO: 1094542 - RNA, 13 nt, Homo sapiens
auacugacuuuca

SEQ ID NO: 1094543 - RNA, 19 nt, Homo sapiens
auagcaacuccccuacauc

SEQ ID NO: 1094544 - RNA, 20 nt, Homo sapiens
auagcaacuccccuacauca

SEQ ID NO: 1094545 - RNA, 23 nt, Homo sapiens
auagcaacuccccuacaucaaau

SEQ ID NO: 1094546 - RNA, 20 nt, Homo sapiens
auagcaauuccccuacauca

SEQ ID NO: 1094547 - RNA, 22 nt, Homo sapiens
auagcaauuccccuacaucaaa

SEQ ID NO: 1094548 - RNA, 10 nt, Homo sapiens
auagcacuug

SEQ ID NO: 1094549 - RNA, 21 nt, Homo sapiens
auaguaguuaggauaacuaaa

SEQ ID NO: 1094550 - RNA, 18 nt, Homo sapiens
auaguguccuaugcaaua

SEQ ID NO: 1094551 - RNA, 13 nt, Homo sapiens
auaguuagcuuua

SEQ ID NO: 1094552 - RNA, 23 nt, Homo sapiens
auauaauuuugaaaaguaaaaau

SEQ ID NO: 1094553 - RNA, 16 nt, Homo sapiens
auauaguuagcuuuau

SEQ ID NO: 1094554 - RNA, 17 nt, Homo sapiens
auauauaacaaugcugu

SEQ ID NO: 1094555 - RNA, 19 nt, Homo sapiens
auaucaugcuaaaauucua

SEQ ID NO: 1094556 - RNA, 19 nt, Homo sapiens
auaugaauauuacauguaa

SEQ ID NO: 1094557 - RNA, 20 nt, Homo sapiens
auaugucacugggaccauca

SEQ ID NO: 1094558 - RNA, 15 nt, Homo sapiens
auauuuaacuaugaa

SEQ ID NO: 1094559 - RNA, 16 nt, Homo sapiens
auauuuugauucucau

SEQ ID NO: 1094560 - RNA, 13 nt, Homo sapiens
auauuuuuguaca

SEQ ID NO: 1094561 - RNA, 18 nt, Homo sapiens
auauuuuuuauacuugaa

SEQ ID NO: 1094562 - RNA, 13 nt, Homo sapiens
aucaaaugcucaa

SEQ ID NO: 1094563 - RNA, 18 nt, Homo sapiens
aucaacauuuguuccaug

SEQ ID NO: 1094564 - RNA, 21 nt, Homo sapiens
aucaauaguguccuaugcaau

SEQ ID NO: 1094565 - RNA, 22 nt, Homo sapiens
aucaauaguguccuaugcaaua

SEQ ID NO: 1094566 - RNA, 21 nt, Homo sapiens
aucacaucauuuuuaagcacu

SEQ ID NO: 1094567 - RNA, 22 nt, Homo sapiens
aucaccguacgacucuuuucca

SEQ ID NO: 1094568 - RNA, 15 nt, Homo sapiens
aucauuaucagccug

SEQ ID NO: 1094569 - RNA, 22 nt, Homo sapiens
auccauagcaccuccacauacc

SEQ ID NO: 1094570 - RNA, 19 nt, Homo sapiens
auccauggggcugauugua

SEQ ID NO: 1094571 - RNA, 12 nt, Homo sapiens
auccuugccagu

SEQ ID NO: 1094572 - RNA, 15 nt, Homo sapiens
aucggaguaucugaa

SEQ ID NO: 1094573 - RNA, 19 nt, Homo sapiens
aucuaauuuaauauuccug

SEQ ID NO: 1094574 - RNA, 22 nt, Homo sapiens
aucuacacagucacacaauuau

SEQ ID NO: 1094575 - RNA, 23 nt, Homo sapiens
aucucaggacccgcccaagagug

SEQ ID NO: 1094576 - RNA, 19 nt, Homo sapiens
aucuccaacaguugacagg

SEQ ID NO: 1094577 - RNA, 15 nt, Homo sapiens
aucucuuuaccuccu

SEQ ID NO: 1094578 - RNA, 17 nt, Homo sapiens
aucugagaggccacagu

SEQ ID NO: 1094579 - RNA, 13 nt, Homo sapiens
aucuguaccucug

SEQ ID NO: 1094580 - RNA, 23 nt, Homo sapiens
aucugugaggggcucucucauga

SEQ ID NO: 1094581 - RNA, 17 nt, Homo sapiens
aucuuagggaacuuuga

SEQ ID NO: 1094582 - RNA, 18 nt, Homo sapiens
aucuugauuaauguacuu

SEQ ID NO: 1094583 - RNA, 19 nt, Homo sapiens
aucuugauuaauguacuuu

SEQ ID NO: 1094584 - RNA, 16 nt, Homo sapiens
augaaguccaagcauu

SEQ ID NO: 1094585 - RNA, 16 nt, Homo sapiens
augaauauuacaugua

SEQ ID NO: 1094586 - RNA, 21 nt, Homo sapiens
augcaauaaaauuauuugcag

SEQ ID NO: 1094587 - RNA, 23 nt, Homo sapiens
augcauccagcaguacaauaaaa

SEQ ID NO: 1094588 - RNA, 18 nt, Homo sapiens
augcaugcgaacauaaau

SEQ ID NO: 1094589 - RNA, 21 nt, Homo sapiens
augcauucuaucguuauuaua

SEQ ID NO: 1094590 - RNA, 12 nt, Homo sapiens
augccauugcac

SEQ ID NO: 1094591 - RNA, 21 nt, Homo sapiens
augcucaagcccccagcugga

SEQ ID NO: 1094592 - RNA, 21 nt, Homo sapiens
auggaaugauuuugguggaaa

SEQ ID NO: 1094593 - RNA, 23 nt, Homo sapiens
auggaugaauaaauguuauagcu

SEQ ID NO: 1094594 - RNA, 16 nt, Homo sapiens
auggaugcggugacaa

SEQ ID NO: 1094595 - RNA, 14 nt, Homo sapiens
auggccacaagcaa

SEQ ID NO: 1094596 - RNA, 24 nt, Homo sapiens
auggcuucuucccuaaaacgugga

SEQ ID NO: 1094597 - RNA, 19 nt, Homo sapiens
auguccaagugccacguga

SEQ ID NO: 1094598 - RNA, 21 nt, Homo sapiens
augugaaaauguaucugagua

SEQ ID NO: 1094599 - RNA, 19 nt, Homo sapiens
gccugaggucaauggugca

SEQ ID NO: 1094600 - RNA, 15 nt, Homo sapiens
gccugucacuacugg

SEQ ID NO: 1094601 - RNA, 14 nt, Homo sapiens
gcgaacaaccacag

SEQ ID NO: 1094602 - RNA, 21 nt, Homo sapiens
gcgaacaguccaaucaguggg

SEQ ID NO: 1094603 - RNA, 16 nt, Homo sapiens
gcgacuaucauucucu

SEQ ID NO: 1094604 - RNA, 16 nt, Homo sapiens
gcuaaggaacaaugcc

SEQ ID NO: 1094605 - RNA, 18 nt, Homo sapiens
gcuaauucucagcagaaa

SEQ ID NO: 1094606 - RNA, 21 nt, Homo sapiens
gcuacaagucaccuggugcua

SEQ ID NO: 1094607 - RNA, 19 nt, Homo sapiens
gcuauaccacagucuuucg

SEQ ID NO: 1094608 - RNA, 19 nt, Homo sapiens
gcucaaaauccacugacga

SEQ ID NO: 1094609 - RNA, 20 nt, Homo sapiens
gcuccauugguguugacaua

SEQ ID NO: 1094610 - RNA, 15 nt, Homo sapiens
gcucccaaacucagg

SEQ ID NO: 1094611 - RNA, 15 nt, Homo sapiens
gcucuaaaugucaau

SEQ ID NO: 1094612 - RNA, 19 nt, Homo sapiens
gcucuacccugaguucaua

SEQ ID NO: 1094613 - RNA, 12 nt, Homo sapiens
gcugaugcaguu

SEQ ID NO: 1094614 - RNA, 19 nt, Homo sapiens
gcuuacuauaaaugauauc

SEQ ID NO: 1094615 - RNA, 14 nt, Homo sapiens
gcuuagcuugaggg

SEQ ID NO: 1094616 - RNA, 19 nt, Homo sapiens
gcuucagauaccaugcaau

SEQ ID NO: 1094617 - RNA, 16 nt, Homo sapiens
gcuucuuccccagccu

SEQ ID NO: 1094618 - RNA, 17 nt, Homo sapiens
gcuuuauugaagucuua

SEQ ID NO: 1094619 - RNA, 13 nt, Homo sapiens
gcuuucagcugau

SEQ ID NO: 1094620 - RNA, 19 nt, Homo sapiens
gcuuugcauuuaugauuuc

SEQ ID NO: 1094621 - RNA, 15 nt, Homo sapiens
gcuuuuaccaggccu

SEQ ID NO: 1094622 - RNA, 16 nt, Homo sapiens
gcuuuuauuucuuaua

SEQ ID NO: 1094623 - RNA, 13 nt, Homo sapiens
ggaacagacucga

SEQ ID NO: 1094624 - RNA, 23 nt, Homo sapiens
ggaaccacaagacugcacaucaa

SEQ ID NO: 1094625 - RNA, 18 nt, Homo sapiens
ggaaugaccccuaggcaa

SEQ ID NO: 1094626 - RNA, 15 nt, Homo sapiens
ggacaccaagccuug

SEQ ID NO: 1094627 - RNA, 10 nt, Homo sapiens
ggacaugucc

SEQ ID NO: 1094628 - RNA, 23 nt, Homo sapiens
ggaccaucacccagaugaugucc

SEQ ID NO: 1094629 - RNA, 15 nt, Homo sapiens
ggagaaaagcacuua

SEQ ID NO: 1094630 - RNA, 15 nt, Homo sapiens
ggagagagugcuauu

SEQ ID NO: 1094631 - RNA, 21 nt, Homo sapiens
ggagagauauuuugauucuca

SEQ ID NO: 1094632 - RNA, 17 nt, Homo sapiens
ggcaacaaaugcaucau

SEQ ID NO: 1094633 - RNA, 20 nt, Homo sapiens
ggcacauauuggagggaaau

SEQ ID NO: 1094634 - RNA, 15 nt, Homo sapiens
ggcauaguggcacuu

SEQ ID NO: 1094635 - RNA, 18 nt, Homo sapiens
ggccacagugcaauuuua

SEQ ID NO: 1094636 - RNA, 22 nt, Homo sapiens
ggccccucacccccagcuggaa

SEQ ID NO: 1094637 - RNA, 17 nt, Homo sapiens
ggccuccugucccucau

SEQ ID NO: 1094638 - RNA, 20 nt, Homo sapiens
ggcucugccuucaaagggaa

SEQ ID NO: 1094639 - RNA, 20 nt, Homo sapiens
ggcugaggccucucauucca

SEQ ID NO: 1094640 - RNA, 15 nt, Homo sapiens
ggcuggaacacugua

SEQ ID NO: 1094641 - RNA, 21 nt, Homo sapiens
ggcuuucagcugauuugcaga

SEQ ID NO: 1094642 - RNA, 16 nt, Homo sapiens
ggcuuugggacaccug

SEQ ID NO: 1094643 - RNA, 19 nt, Homo sapiens
ggcuuugggacaccugggg

SEQ ID NO: 1094644 - RNA, 17 nt, Homo sapiens
gggaauguuguuccagg

SEQ ID NO: 1094645 - RNA, 16 nt, Homo sapiens
gggagagagugcuauu

SEQ ID NO: 1094646 - RNA, 17 nt, Homo sapiens
gggagccuguccuucca

SEQ ID NO: 1094647 - RNA, 14 nt, Homo sapiens
gggaguguguaauu

SEQ ID NO: 1094648 - RNA, 22 nt, Homo sapiens
gggccccucacccccagcugga

SEQ ID NO: 1094649 - RNA, 19 nt, Homo sapiens
gggcucucucaugauagaa

SEQ ID NO: 1094650 - RNA, 19 nt, Homo sapiens
gggcugauuguauuuaccu

SEQ ID NO: 1094651 - RNA, 13 nt, Homo sapiens
gggcuuacaggca

SEQ ID NO: 1094652 - RNA, 17 nt, Homo sapiens
ggggcacggagggcagu

SEQ ID NO: 1094653 - RNA, 10 nt, Homo sapiens
gggucugugu

SEQ ID NO: 1094654 - RNA, 17 nt, Homo sapiens
ggguuggacaaccucau

SEQ ID NO: 1094655 - RNA, 11 nt, Homo sapiens
gguucucaggc

SEQ ID NO: 1094656 - RNA, 17 nt, Homo sapiens
gguugaggcugcaguga

SEQ ID NO: 1094657 - RNA, 12 nt, Homo sapiens
guaaaaaugaag

SEQ ID NO: 1094658 - RNA, 19 nt, Homo sapiens
guaaagagcauauucacug

SEQ ID NO: 1094659 - RNA, 17 nt, Homo sapiens
guaaaucacacugaaac

SEQ ID NO: 1094660 - RNA, 16 nt, Homo sapiens
guaacaaaugacuggu

SEQ ID NO: 1094661 - RNA, 19 nt, Homo sapiens
guacauggcauugagacau

SEQ ID NO: 1094662 - RNA, 15 nt, Homo sapiens
guacuaaaucucacc

SEQ ID NO: 1094663 - RNA, 15 nt, Homo sapiens
guagauaggccaugg

SEQ ID NO: 1094664 - RNA, 16 nt, Homo sapiens
guagucccagcacuuu

SEQ ID NO: 1094665 - RNA, 20 nt, Homo sapiens
guaguuuuguuuaugcauuu

SEQ ID NO: 1094666 - RNA, 21 nt, Homo sapiens
guaguuuuuuuggugcuauaa

SEQ ID NO: 1094667 - RNA, 18 nt, Homo sapiens
guauuaugacacucccag

SEQ ID NO: 1094668 - RNA, 20 nt, Homo sapiens
guauugcuguccuugaaugc

SEQ ID NO: 1094669 - RNA, 18 nt, Homo sapiens
gucaauaaaauccauaca

SEQ ID NO: 1094670 - RNA, 15 nt, Homo sapiens
gucaauagcaugcaa

SEQ ID NO: 1094671 - RNA, 13 nt, Homo sapiens
gucaccucaugga

SEQ ID NO: 1094672 - RNA, 13 nt, Homo sapiens
gucagaaacugcc

SEQ ID NO: 1094673 - RNA, 15 nt, Homo sapiens
gucaguauguggaag

SEQ ID NO: 1094674 - RNA, 15 nt, Homo sapiens
gucauauacccagcu

SEQ ID NO: 1094675 - RNA, 16 nt, Homo sapiens
guccaaacuuucucug

SEQ ID NO: 1094676 - RNA, 16 nt, Homo sapiens
guccagcacccaggua

SEQ ID NO: 1094677 - RNA, 16 nt, Homo sapiens
guccugcccacuaaaa

SEQ ID NO: 1094678 - RNA, 17 nt, Homo sapiens
gucugggccacucaggg

SEQ ID NO: 1094679 - RNA, 13 nt, Homo sapiens
gugacagcuguau

SEQ ID NO: 1094680 - RNA, 19 nt, Homo sapiens
gugcaaauugucacaggac

SEQ ID NO: 1094681 - RNA, 21 nt, Homo sapiens
gugcagauuuagguuacuuua

SEQ ID NO: 1094682 - RNA, 16 nt, Homo sapiens
gugccaggauggaaug

SEQ ID NO: 1094683 - RNA, 16 nt, Homo sapiens
gugcccagagugacag

SEQ ID NO: 1094684 - RNA, 18 nt, Homo sapiens
gugcuauaacauucugac

SEQ ID NO: 1094685 - RNA, 14 nt, Homo sapiens
gugcugguuuauuu

SEQ ID NO: 1094686 - RNA, 22 nt, Homo sapiens
guggaaauaaaaagaaggaaaa

SEQ ID NO: 1094687 - RNA, 16 nt, Homo sapiens
guggagauagugccag

SEQ ID NO: 1094688 - RNA, 15 nt, Homo sapiens
guggaguuuucauga

SEQ ID NO: 1094689 - RNA, 22 nt, Homo sapiens
guggcuggaucugugaggggcu

SEQ ID NO: 1094690 - RNA, 21 nt, Homo sapiens
guguauucuuaaaaugcaaua

SEQ ID NO: 1094691 - RNA, 23 nt, Homo sapiens
guguucuucauuaccucagugag

SEQ ID NO: 1094692 - RNA, 23 nt, Homo sapiens
guuaaaauacauaacuucagugc

SEQ ID NO: 1094693 - RNA, 17 nt, Homo sapiens
guuaaugucugacuguu

SEQ ID NO: 1094694 - RNA, 21 nt, Homo sapiens
guuacagccauaugcaggaca

SEQ ID NO: 1094695 - RNA, 13 nt, Homo sapiens
guuacucucaggc

SEQ ID NO: 1094696 - RNA, 14 nt, Homo sapiens
guuacuugcuauaa

SEQ ID NO: 1094697 - RNA, 15 nt, Homo sapiens
guuauagcugcauuu

SEQ ID NO: 1094698 - RNA, 11 nt, Homo sapiens
guucucaggcc

SEQ ID NO: 1094699 - RNA, 16 nt, Homo sapiens
guucuucauuaccuca

SEQ ID NO: 1094700 - RNA, 20 nt, Homo sapiens
guuuaacauugauuggauaa

SEQ ID NO: 1094701 - RNA, 19 nt, Homo sapiens
guuuuaucuuaacacugaa

SEQ ID NO: 1094702 - RNA, 14 nt, Homo sapiens
guuuuauuacacau

SEQ ID NO: 1094703 - RNA, 13 nt, Homo sapiens
guuuucuaaagua

SEQ ID NO: 1094704 - RNA, 18 nt, Homo sapiens
uaaaaaauuaguugggca

SEQ ID NO: 1094705 - RNA, 20 nt, Homo sapiens
uaaaaaauuaguugggcaua

SEQ ID NO: 1094706 - RNA, 19 nt, Homo sapiens
uaaaaacagacucuucuug

SEQ ID NO: 1094707 - RNA, 13 nt, Homo sapiens
uaaaaaccgaaua

SEQ ID NO: 1094708 - RNA, 14 nt, Homo sapiens
uaaaacacaguauu

SEQ ID NO: 1094709 - RNA, 17 nt, Homo sapiens
uaaaacacaguauugua

SEQ ID NO: 1094710 - RNA, 13 nt, Homo sapiens
uaaaacagauucu

SEQ ID NO: 1094711 - RNA, 14 nt, Homo sapiens
uaaaaccuccuucu

SEQ ID NO: 1094712 - RNA, 20 nt, Homo sapiens
uaaaagaauugugacauaac

SEQ ID NO: 1094713 - RNA, 19 nt, Homo sapiens
uaaaagagacaaacuguaa

SEQ ID NO: 1094714 - RNA, 19 nt, Homo sapiens
uaaaagcuauuacuuggca

SEQ ID NO: 1094715 - RNA, 19 nt, Homo sapiens
uaaaauuggauuacaguau

SEQ ID NO: 1094716 - RNA, 14 nt, Homo sapiens
uaaaauuuaacuca

SEQ ID NO: 1094717 - RNA, 16 nt, Homo sapiens
uaaaauuuaacucaca

SEQ ID NO: 1094718 - RNA, 11 nt, Homo sapiens
uaaacauauau

SEQ ID NO: 1094719 - RNA, 16 nt, Homo sapiens
uaaacugaacacauga

SEQ ID NO: 1094720 - RNA, 16 nt, Homo sapiens
uaaacuuggcuguaug

SEQ ID NO: 1094721 - RNA, 19 nt, Homo sapiens
uaaagaaugcaauacugua

SEQ ID NO: 1094722 - RNA, 23 nt, Homo sapiens
uaaaguauguuuucaauguuuca

SEQ ID NO: 1094723 - RNA, 17 nt, Homo sapiens
uaaauacuuauggcuca

SEQ ID NO: 1094724 - RNA, 17 nt, Homo sapiens
uaaaucuccagauuucu

SEQ ID NO: 1094725 - RNA, 20 nt, Homo sapiens
uaaaugauaucuauauucua

SEQ ID NO: 1094726 - RNA, 14 nt, Homo sapiens
aaaaaauuauuugc

SEQ ID NO: 1094727 - RNA, 17 nt, Homo sapiens
aaaaaccgaauaaaugu

SEQ ID NO: 1094728 - RNA, 18 nt, Homo sapiens
aaaaaguccuucaguuua

SEQ ID NO: 1094729 - RNA, 15 nt, Homo sapiens
aaaaauuggcauuuu

SEQ ID NO: 1094730 - RNA, 17 nt, Homo sapiens
aaaacaaggaugaauua

SEQ ID NO: 1094731 - RNA, 18 nt, Homo sapiens
aaaacagacucuucuugc

SEQ ID NO: 1094732 - RNA, 19 nt, Homo sapiens
aaaacuuuaucgcucuaaa

SEQ ID NO: 1094733 - RNA, 16 nt, Homo sapiens
aaaagaaugauuauga

SEQ ID NO: 1094734 - RNA, 19 nt, Homo sapiens
aaaagcaaauacugacuuu

SEQ ID NO: 1094735 - RNA, 14 nt, Homo sapiens
aaaagcacaaagac

SEQ ID NO: 1094736 - RNA, 21 nt, Homo sapiens
aaaagggucaaaccuguagau

SEQ ID NO: 1094737 - RNA, 23 nt, Homo sapiens
aaaagugucccuugagugaggca

SEQ ID NO: 1094738 - RNA, 20 nt, Homo sapiens
aaaaguuguacugcaucuua

SEQ ID NO: 1094739 - RNA, 13 nt, Homo sapiens
aaaauacauaacu

SEQ ID NO: 1094740 - RNA, 12 nt, Homo sapiens
aaaauaucacuu

SEQ ID NO: 1094741 - RNA, 19 nt, Homo sapiens
aaaaucaggagccugcuaa

SEQ ID NO: 1094742 - RNA, 19 nt, Homo sapiens
aaaauccacugacgaucau

SEQ ID NO: 1094743 - RNA, 22 nt, Homo sapiens
aaaaugcaucauuaauaccuaa

SEQ ID NO: 1094744 - RNA, 15 nt, Homo sapiens
aaaaugcuucacugu

SEQ ID NO: 1094745 - RNA, 21 nt, Homo sapiens
aaaauguuuuuaaacaguguc

SEQ ID NO: 1094746 - RNA, 15 nt, Homo sapiens
aaaauuggcagugua

SEQ ID NO: 1094747 - RNA, 18 nt, Homo sapiens
aaaauuggcaguguaaca

SEQ ID NO: 1094748 - RNA, 13 nt, Homo sapiens
aaacaccaaguga

SEQ ID NO: 1094749 - RNA, 19 nt, Homo sapiens
aaacaccaagugaggccau

SEQ ID NO: 1094750 - RNA, 20 nt, Homo sapiens
aaacaccaagugaggccaua

SEQ ID NO: 1094751 - RNA, 21 nt, Homo sapiens
aaacaccaagugaggccauag

SEQ ID NO: 1094752 - RNA, 14 nt, Homo sapiens
aaacaccgagugag

SEQ ID NO: 1094753 - RNA, 21 nt, Homo sapiens
aaacaccgagugaggccauag

SEQ ID NO: 1094754 - RNA, 22 nt, Homo sapiens
aaacaccgagugaggccauagc

SEQ ID NO: 1094755 - RNA, 20 nt, Homo sapiens
aaacagccucuuugcccaaa

SEQ ID NO: 1094756 - RNA, 20 nt, Homo sapiens
aaacauugaaauauuaguua

SEQ ID NO: 1094757 - RNA, 14 nt, Homo sapiens
aaacauugccugau

SEQ ID NO: 1094758 - RNA, 23 nt, Homo sapiens
aaacauuguuuuuguugucuuua

SEQ ID NO: 1094759 - RNA, 20 nt, Homo sapiens
aaaccugcuccaaggcagug

SEQ ID NO: 1094760 - RNA, 23 nt, Homo sapiens
aaaccuguagaugcagaaaaaga

SEQ ID NO: 1094761 - RNA, 17 nt, Homo sapiens
aaacugcuccaaaccaa

SEQ ID NO: 1094762 - RNA, 17 nt, Homo sapiens
aaacuggguaaugcaac

SEQ ID NO: 1094763 - RNA, 15 nt, Homo sapiens
aaacuugcauuuuaa

SEQ ID NO: 1094764 - RNA, 12 nt, Homo sapiens
aaacuuucugua

SEQ ID NO: 1094765 - RNA, 16 nt, Homo sapiens
aaacuuuuuuucuuca

SEQ ID NO: 1094766 - RNA, 20 nt, Homo sapiens
aaagaaugaaaguagcugua

SEQ ID NO: 1094767 - RNA, 19 nt, Homo sapiens
aaagaauguuaagauuuau

SEQ ID NO: 1094768 - RNA, 22 nt, Homo sapiens
aaagacauuuguucucccaaaa

SEQ ID NO: 1094769 - RNA, 18 nt, Homo sapiens
aaagagacaaacuguaaa

SEQ ID NO: 1094770 - RNA, 20 nt, Homo sapiens
aaagcaguggcuccauuggu

SEQ ID NO: 1094771 - RNA, 21 nt, Homo sapiens
aaagcuauucuuaugcuguaa

SEQ ID NO: 1094772 - RNA, 23 nt, Homo sapiens
aaaguaaaacuuguuacaccaca

SEQ ID NO: 1094773 - RNA, 21 nt, Homo sapiens
aaaguauguuuucaauguuuc

SEQ ID NO: 1094774 - RNA, 19 nt, Homo sapiens
aaagucuaucuaaugacau

SEQ ID NO: 1094775 - RNA, 19 nt, Homo sapiens
aaaguggcaggacacugca

SEQ ID NO: 1094776 - RNA, 20 nt, Homo sapiens
aaaguuguuuaauaaguaua

SEQ ID NO: 1094777 - RNA, 13 nt, Homo sapiens
aaauaaacauaua

SEQ ID NO: 1094778 - RNA, 21 nt, Homo sapiens
aaauaaugcauccagcaguac

SEQ ID NO: 1094779 - RNA, 16 nt, Homo sapiens
aaauacugauuuucaa

SEQ ID NO: 1094780 - RNA, 16 nt, Homo sapiens
aaauacuuauggcuca

SEQ ID NO: 1094781 - RNA, 19 nt, Homo sapiens
aaauacuuauggcucaaaa

SEQ ID NO: 1094782 - RNA, 14 nt, Homo sapiens
aaauagcacaucca

SEQ ID NO: 1094783 - RNA, 23 nt, Homo sapiens
aaauccacugacgaucauucucc

SEQ ID NO: 1094784 - RNA, 15 nt, Homo sapiens
aaaugcuuuuccuca

SEQ ID NO: 1094785 - RNA, 22 nt, Homo sapiens
aaauguaucugaguauugaaug

SEQ ID NO: 1094786 - RNA, 19 nt, Homo sapiens
aaauuuucucuaaacuguu

SEQ ID NO: 1094787 - RNA, 16 nt, Homo sapiens
aaauuuuuugauuaau

SEQ ID NO: 1094788 - RNA, 20 nt, Homo sapiens
aacaacacuuuuuuucaugc

SEQ ID NO: 1094789 - RNA, 18 nt, Homo sapiens
aacaaugccgccugucaa

SEQ ID NO: 1094790 - RNA, 22 nt, Homo sapiens
aacaaugccgccugucaauaaa

SEQ ID NO: 1094791 - RNA, 24 nt, Homo sapiens
aacacaagcauuucacuucuccaa

SEQ ID NO: 1094792 - RNA, 22 nt, Homo sapiens
aacaccaagugaggccauagca

SEQ ID NO: 1094793 - RNA, 19 nt, Homo sapiens
aacaccgagugaggccaua

SEQ ID NO: 1094794 - RNA, 16 nt, Homo sapiens
aacagacucuucuugc

SEQ ID NO: 1094795 - RNA, 18 nt, Homo sapiens
aacagccucuuugcccaa

SEQ ID NO: 1094796 - RNA, 19 nt, Homo sapiens
aacagccucuuugcccaaa

SEQ ID NO: 1094797 - RNA, 22 nt, Homo sapiens
aacauuguuuuuguugucuuua

SEQ ID NO: 1094798 - RNA, 18 nt, Homo sapiens
aaccaaugcuauugugau

SEQ ID NO: 1094799 - RNA, 16 nt, Homo sapiens
aaccccaagaguuucu

SEQ ID NO: 1094800 - RNA, 11 nt, Homo sapiens
aaccgaauaaa

SEQ ID NO: 1094801 - RNA, 11 nt, Homo sapiens
aaccugcaaau

SEQ ID NO: 1094802 - RNA, 16 nt, Homo sapiens
aacgcugacugcaaaa

SEQ ID NO: 1094803 - RNA, 14 nt, Homo sapiens
aacuacugaacugu

SEQ ID NO: 1094804 - RNA, 17 nt, Homo sapiens
aacuacugaacuguuac

SEQ ID NO: 1094805 - RNA, 22 nt, Homo sapiens
aacuacugaacuguuaccuagg

SEQ ID NO: 1094806 - RNA, 17 nt, Homo sapiens
aacucaauauauaguua

SEQ ID NO: 1094807 - RNA, 16 nt, Homo sapiens
aacuccccuacaucaa

SEQ ID NO: 1094808 - RNA, 23 nt, Homo sapiens
aacuccuaaaaaguuacagccau

SEQ ID NO: 1094809 - RNA, 22 nt, Homo sapiens
aacugaucuccaacaguugaca

SEQ ID NO: 1094810 - RNA, 19 nt, Homo sapiens
aacuggaaauguccaagcu

SEQ ID NO: 1094811 - RNA, 21 nt, Homo sapiens
aacuucagugcaagagacuuu

SEQ ID NO: 1094812 - RNA, 16 nt, Homo sapiens
aacuuguuacaccaca

SEQ ID NO: 1094813 - RNA, 17 nt, Homo sapiens
aacuuuagaauucccaa

SEQ ID NO: 1094814 - RNA, 18 nt, Homo sapiens
aagaaaaaaaguugcaau

SEQ ID NO: 1094815 - RNA, 15 nt, Homo sapiens
aagaaagacuccuuu

SEQ ID NO: 1094816 - RNA, 12 nt, Homo sapiens
aagaauugccaa

SEQ ID NO: 1094817 - RNA, 16 nt, Homo sapiens
aagagucaaaguaguu

SEQ ID NO: 1094818 - RNA, 13 nt, Homo sapiens
aagauccucuugc

SEQ ID NO: 1094819 - RNA, 14 nt, Homo sapiens
aagauccucuugcc

SEQ ID NO: 1094820 - RNA, 13 nt, Homo sapiens
aagaucuugcaga

SEQ ID NO: 1094821 - RNA, 19 nt, Homo sapiens
aagaugcccuaauccaucu

SEQ ID NO: 1094822 - RNA, 23 nt, Homo sapiens
aagauucuuuaaacuacugaacu

SEQ ID NO: 1094823 - RNA, 16 nt, Homo sapiens
aagauuuuuucauuuc

SEQ ID NO: 1094824 - RNA, 16 nt, Homo sapiens
aagcaacgacuacuuu

SEQ ID NO: 1094825 - RNA, 18 nt, Homo sapiens
aagccagauuuuccugaa

SEQ ID NO: 1094826 - RNA, 16 nt, Homo sapiens
aagccagcuuuccuca

SEQ ID NO: 1094827 - RNA, 13 nt, Homo sapiens
aagcccacaagau

SEQ ID NO: 1094828 - RNA, 21 nt, Homo sapiens
aagccuuggggcugaugcagu

SEQ ID NO: 1094829 - RNA, 18 nt, Homo sapiens
aaggcaggagaugcagca

SEQ ID NO: 1094830 - RNA, 21 nt, Homo sapiens
aaggcuggugguaacuuuuga

SEQ ID NO: 1094831 - RNA, 20 nt, Homo sapiens
aaggggcaacaaaugcauca

SEQ ID NO: 1094832 - RNA, 21 nt, Homo sapiens
aaggugcaguugaauucagug

SEQ ID NO: 1094833 - RNA, 20 nt, Homo sapiens
aaguaaaaauaaacuguuau

SEQ ID NO: 1094834 - RNA, 15 nt, Homo sapiens
aaguaaaccacaaaa

SEQ ID NO: 1094835 - RNA, 15 nt, Homo sapiens
aaguacuaaaucuca

SEQ ID NO: 1094836 - RNA, 18 nt, Homo sapiens
aagucaccugcccaagaa

SEQ ID NO: 1094837 - RNA, 16 nt, Homo sapiens
aagucaccuggugcua

SEQ ID NO: 1094838 - RNA, 15 nt, Homo sapiens
aagucacuggccagu

SEQ ID NO: 1094839 - RNA, 20 nt, Homo sapiens
aagucacuggccaguggcug

SEQ ID NO: 1094840 - RNA, 19 nt, Homo sapiens
aagucccuuucaaaaugga

SEQ ID NO: 1094841 - RNA, 21 nt, Homo sapiens
aagucuucuuaucuaaaccca

SEQ ID NO: 1094842 - RNA, 15 nt, Homo sapiens
aagugaugacauauu

SEQ ID NO: 1094843 - RNA, 21 nt, Homo sapiens
aaguguauaauguuggugugg

SEQ ID NO: 1094844 - RNA, 12 nt, Homo sapiens
aauaagauuuaa

SEQ ID NO: 1094845 - RNA, 12 nt, Homo sapiens
aauaagucucua

SEQ ID NO: 1094846 - RNA, 16 nt, Homo sapiens
aauaauacaacuauca

SEQ ID NO: 1094847 - RNA, 14 nt, Homo sapiens
aauacaacuaucau

SEQ ID NO: 1094848 - RNA, 15 nt, Homo sapiens
aauacugacuuucaa

SEQ ID NO: 1094849 - RNA, 18 nt, Homo sapiens
aauaguguccuaugcaau

SEQ ID NO: 1094850 - RNA, 15 nt, Homo sapiens
aauauauagcuggca

SEQ ID NO: 1094851 - RNA, 14 nt, Homo sapiens
aauauuuuuguaca

SEQ ID NO: 1094852 - RNA, 21 nt, Homo sapiens
aaucacuuaacauuccuaaaa

SEQ ID NO: 1094853 - RNA, 23 nt, Homo sapiens
aaucagaauaaauuaauauugua

SEQ ID NO: 1094854 - RNA, 16 nt, Homo sapiens
aaucaggagccugcua

SEQ ID NO: 1094855 - RNA, 19 nt, Homo sapiens
aauccaagacaaacuaaac

SEQ ID NO: 1094856 - RNA, 18 nt, Homo sapiens
aaucuccagauuucugua

SEQ ID NO: 1094857 - RNA, 17 nt, Homo sapiens
aaugagagacacacuga

SEQ ID NO: 1094858 - RNA, 18 nt, Homo sapiens
aaugagagacacacugaa

SEQ ID NO: 1094859 - RNA, 21 nt, Homo sapiens
aaugagagacacacugaagaa

SEQ ID NO: 1094860 - RNA, 15 nt, Homo sapiens
aaugauaacuggaaa

SEQ ID NO: 1094861 - RNA, 22 nt, Homo sapiens
aaugauaauucagucuugccuu

SEQ ID NO: 1094862 - RNA, 14 nt, Homo sapiens
aaugaugggucagu

SEQ ID NO: 1094863 - RNA, 17 nt, Homo sapiens
aaugauuuugguggaaa

SEQ ID NO: 1094864 - RNA, 16 nt, Homo sapiens
aaugcacacguagcca

SEQ ID NO: 1094865 - RNA, 12 nt, Homo sapiens
aaugguucucau

SEQ ID NO: 1094866 - RNA, 21 nt, Homo sapiens
aaugguucucauagugguaua

SEQ ID NO: 1094867 - RNA, 21 nt, Homo sapiens
aaugugauuauuuuaugcaca

SEQ ID NO: 1094868 - RNA, 21 nt, Homo sapiens
aauguuauagcugcauuuguc

SEQ ID NO: 1094869 - RNA, 16 nt, Homo sapiens
aauuacauacuauucu

SEQ ID NO: 1094870 - RNA, 22 nt, Homo sapiens
aauuaccuuuaaugcaaugcau

SEQ ID NO: 1094871 - RNA, 14 nt, Homo sapiens
aauuaucacaucau

SEQ ID NO: 1094872 - RNA, 21 nt, Homo sapiens
aauucccaagagggcuuuauu

SEQ ID NO: 1094873 - RNA, 13 nt, Homo sapiens
aauucuaaacuga

SEQ ID NO: 1094874 - RNA, 20 nt, Homo sapiens
aauucugaccuuacaaaagu

SEQ ID NO: 1094875 - RNA, 19 nt, Homo sapiens
aauugaaacuugcauuuua

SEQ ID NO: 1094876 - RNA, 17 nt, Homo sapiens
aauugaggacacugaua

SEQ ID NO: 1094877 - RNA, 19 nt, Homo sapiens
aauuguuuaaaaaccgaau

SEQ ID NO: 1094878 - RNA, 16 nt, Homo sapiens
aauuuaauauuccugg

SEQ ID NO: 1094879 - RNA, 17 nt, Homo sapiens
aauuugucaguguauaa

SEQ ID NO: 1094880 - RNA, 15 nt, Homo sapiens
aauuuucauucugaa

SEQ ID NO: 1094881 - RNA, 16 nt, Homo sapiens
acaacccgucagagac

SEQ ID NO: 1094882 - RNA, 19 nt, Homo sapiens
acaaccucauuuuaacuca

SEQ ID NO: 1094883 - RNA, 17 nt, Homo sapiens
acaagcagcuaagcaau

SEQ ID NO: 1094884 - RNA, 21 nt, Homo sapiens
acaaggaguaacaaaacagcc

SEQ ID NO: 1094885 - RNA, 14 nt, Homo sapiens
acaaggaugaauua

SEQ ID NO: 1094886 - RNA, 15 nt, Homo sapiens
acaaugauacaguug

SEQ ID NO: 1094887 - RNA, 21 nt, Homo sapiens
acaaugauacaguugcauguu

SEQ ID NO: 1094888 - RNA, 20 nt, Homo sapiens
acacauaaaagcacaaagac

SEQ ID NO: 1094889 - RNA, 18 nt, Homo sapiens
acaccaagugaggccaua

SEQ ID NO: 1094890 - RNA, 13 nt, Homo sapiens
acaccuaagccca

SEQ ID NO: 1094891 - RNA, 12 nt, Homo sapiens
acagacccagug

SEQ ID NO: 1094892 - RNA, 20 nt, Homo sapiens
acagccucuuagaugcaguu

SEQ ID NO: 1094893 - RNA, 14 nt, Homo sapiens
acagcuaccaaagu

SEQ ID NO: 1094894 - RNA, 19 nt, Homo sapiens
acagcuucauguucccaaa

SEQ ID NO: 1094895 - RNA, 22 nt, Homo sapiens
acaggcaaauccgaaaucagca

SEQ ID NO: 1094896 - RNA, 21 nt, Homo sapiens
acaguuagcauggcuucacac

SEQ ID NO: 1094897 - RNA, 18 nt, Homo sapiens
acaguugcauguuauauu

SEQ ID NO: 1094898 - RNA, 13 nt, Homo sapiens
acaguuggcacuu

SEQ ID NO: 1094899 - RNA, 23 nt, Homo sapiens
acaguuuuuaacucuacugugua

SEQ ID NO: 1094900 - RNA, 14 nt, Homo sapiens
acauaauaagacuu

SEQ ID NO: 1094901 - RNA, 18 nt, Homo sapiens
acauacuauucuuacuaa

SEQ ID NO: 1094902 - RNA, 14 nt, Homo sapiens
acaucaaaugcuca

SEQ ID NO: 1094903 - RNA, 15 nt, Homo sapiens
acaucaaaugcucaa

SEQ ID NO: 1094904 - RNA, 16 nt, Homo sapiens
acaucaaaugcucaag

SEQ ID NO: 1094905 - RNA, 13 nt, Homo sapiens
acauguaaagcug

SEQ ID NO: 1094906 - RNA, 22 nt, Homo sapiens
acauguaaagcuguuaaaauac

SEQ ID NO: 1094907 - RNA, 16 nt, Homo sapiens
acauucagcugagguu

SEQ ID NO: 1094908 - RNA, 14 nt, Homo sapiens
acauugugcaauug

SEQ ID NO: 1094909 - RNA, 14 nt, Homo sapiens
accaaaaaucucaa

SEQ ID NO: 1094910 - RNA, 18 nt, Homo sapiens
accaaaugcuuuuccuca

SEQ ID NO: 1094911 - RNA, 16 nt, Homo sapiens
accaagugaggccaua

SEQ ID NO: 1094912 - RNA, 18 nt, Homo sapiens
accaaugcuauugugauu

SEQ ID NO: 1094913 - RNA, 20 nt, Homo sapiens
accaucucuuuaccuccuaa

SEQ ID NO: 1094914 - RNA, 21 nt, Homo sapiens
accaugucguaguuacucuca

SEQ ID NO: 1094915 - RNA, 16 nt, Homo sapiens
acccagcuaugguucu

SEQ ID NO: 1094916 - RNA, 19 nt, Homo sapiens
acccagcuucagauaccau

SEQ ID NO: 1094917 - RNA, 18 nt, Homo sapiens
acccgucagagaccuggg

SEQ ID NO: 1094918 - RNA, 14 nt, Homo sapiens
acccuuaggccagc

SEQ ID NO: 1094919 - RNA, 17 nt, Homo sapiens
acccuucagauuugccu

SEQ ID NO: 1094920 - RNA, 15 nt, Homo sapiens
accgagugaggccau

SEQ ID NO: 1094921 - RNA, 17 nt, Homo sapiens
accuggacccaaagagg

SEQ ID NO: 1094922 - RNA, 19 nt, Homo sapiens
accuggcccugugccuugg

SEQ ID NO: 1094923 - RNA, 22 nt, Homo sapiens
accugggagcaggggcaaugac

SEQ ID NO: 1094924 - RNA, 19 nt, Homo sapiens
accuguagucccagcacuu

SEQ ID NO: 1094925 - RNA, 15 nt, Homo sapiens
acgcugacugcaaaa

SEQ ID NO: 1094926 - RNA, 23 nt, Homo sapiens
acggccugccugcaaaccugcug

SEQ ID NO: 1094927 - RNA, 22 nt, Homo sapiens
acgugauaaaccugcuccaagg

SEQ ID NO: 1094928 - RNA, 15 nt, Homo sapiens
acguuuaacauugau

SEQ ID NO: 1094929 - RNA, 21 nt, Homo sapiens
acuaaggucuuauaguccaaa

SEQ ID NO: 1094930 - RNA, 21 nt, Homo sapiens
acuauggagcugagcaggugu

SEQ ID NO: 1094931 - RNA, 12 nt, Homo sapiens
acucaccugccc

SEQ ID NO: 1094932 - RNA, 14 nt, Homo sapiens
acucaggcuuucag

SEQ ID NO: 1094933 - RNA, 14 nt, Homo sapiens
acucaggggucauu

SEQ ID NO: 1094934 - RNA, 15 nt, Homo sapiens
acucccacuuggcau

SEQ ID NO: 1094935 - RNA, 15 nt, Homo sapiens
acucgaugcaagugu

SEQ ID NO: 1094936 - RNA, 20 nt, Homo sapiens
acucucagcagcuaugguag

SEQ ID NO: 1094937 - RNA, 22 nt, Homo sapiens
acucuuccaucagagaugggaa

SEQ ID NO: 1094938 - RNA, 13 nt, Homo sapiens
acugaacuguuac

SEQ ID NO: 1094939 - RNA, 17 nt, Homo sapiens
acuggaaucguggcucc

SEQ ID NO: 1094940 - RNA, 15 nt, Homo sapiens
acuuaauggcuguau

SEQ ID NO: 1094941 - RNA, 22 nt, Homo sapiens
acuucagugcaagagacuuugu

SEQ ID NO: 1094942 - RNA, 21 nt, Homo sapiens
acuucccagcccuggccucca

SEQ ID NO: 1094943 - RNA, 21 nt, Homo sapiens
acuugaggccaggacuuugag

SEQ ID NO: 1094944 - RNA, 16 nt, Homo sapiens
acuugcagaccugccu

SEQ ID NO: 1094945 - RNA, 15 nt, Homo sapiens
acuugccuguagucu

SEQ ID NO: 1094946 - RNA, 15 nt, Homo sapiens
agaaacaccgaguga

SEQ ID NO: 1094947 - RNA, 18 nt, Homo sapiens
agaaacuaagauuuaucu

SEQ ID NO: 1094948 - RNA, 22 nt, Homo sapiens
agaaagacuuaucaacauuugu

SEQ ID NO: 1094949 - RNA, 15 nt, Homo sapiens
agaaagucaccugcc

SEQ ID NO: 1094950 - RNA, 20 nt, Homo sapiens
agaaagucuaucuaaugaca

SEQ ID NO: 1094951 - RNA, 15 nt, Homo sapiens
agaaggcuaugggga

SEQ ID NO: 1094952 - RNA, 15 nt, Homo sapiens
agaaguggcccuugg

SEQ ID NO: 1094953 - RNA, 12 nt, Homo sapiens
agaauagcuuau

SEQ ID NO: 1094954 - RNA, 13 nt, Homo sapiens
agaaugaaaguag

SEQ ID NO: 1094955 - RNA, 18 nt, Homo sapiens
gcacaucaaaauaugccc

SEQ ID NO: 1094956 - RNA, 22 nt, Homo sapiens
gcacaugacauagcacuugccg

SEQ ID NO: 1094957 - RNA, 22 nt, Homo sapiens
gcacguguggccuguucuucua

SEQ ID NO: 1094958 - RNA, 17 nt, Homo sapiens
gcacuugccuguagucu

SEQ ID NO: 1094959 - RNA, 22 nt, Homo sapiens
gcagccaccauucccaccagcu

SEQ ID NO: 1094960 - RNA, 18 nt, Homo sapiens
gcaggacagcaguacuca

SEQ ID NO: 1094961 - RNA, 18 nt, Homo sapiens
gcaggacggcaguacuca

SEQ ID NO: 1094962 - RNA, 20 nt, Homo sapiens
gcagggcugguuuguucuga

SEQ ID NO: 1094963 - RNA, 19 nt, Homo sapiens
gcagguguucuucauuacc

SEQ ID NO: 1094964 - RNA, 14 nt, Homo sapiens
gcauagcacuugca

SEQ ID NO: 1094965 - RNA, 17 nt, Homo sapiens
gcaucucccaguucaua

SEQ ID NO: 1094966 - RNA, 23 nt, Homo sapiens
gcauugagacaucuggcggccaa

SEQ ID NO: 1094967 - RNA, 15 nt, Homo sapiens
gccacgcacagccag

SEQ ID NO: 1094968 - RNA, 22 nt, Homo sapiens
gccagauuuuccugaaaacccu

SEQ ID NO: 1094969 - RNA, 13 nt, Homo sapiens
gccagcacagccu

SEQ ID NO: 1094970 - RNA, 14 nt, Homo sapiens
gccaggacuuugag

SEQ ID NO: 1094971 - RNA, 19 nt, Homo sapiens
gccauauguggaacaagca

SEQ ID NO: 1094972 - RNA, 18 nt, Homo sapiens
gccaugggcacugugggu

SEQ ID NO: 1094973 - RNA, 13 nt, Homo sapiens
gcccagacaagau

SEQ ID NO: 1094974 - RNA, 17 nt, Homo sapiens
gcccaggcuggucuuga

SEQ ID NO: 1094975 - RNA, 17 nt, Homo sapiens
gcccgcauagcacuugc

SEQ ID NO: 1094976 - RNA, 19 nt, Homo sapiens
gcccuugucgagggaaaga

SEQ ID NO: 1094977 - RNA, 15 nt, Homo sapiens
gccucugacaugacu

SEQ ID NO: 1094978 - RNA, 12 nt, Homo sapiens
gccugugccuuu

SEQ ID NO: 1094979 - RNA, 15 nt, Homo sapiens
gccuuauuggcagcu

SEQ ID NO: 1094980 - RNA, 17 nt, Homo sapiens
gcggcuuugggacaccu

SEQ ID NO: 1094981 - RNA, 20 nt, Homo sapiens
gcuauggggauagaugugug

SEQ ID NO: 1094982 - RNA, 12 nt, Homo sapiens
gcuauucuuaug

SEQ ID NO: 1094983 - RNA, 14 nt, Homo sapiens
gcucugaugcagug

SEQ ID NO: 1094984 - RNA, 16 nt, Homo sapiens
gcugacgcgacuauca

SEQ ID NO: 1094985 - RNA, 13 nt, Homo sapiens
gcugacugcaaaa

SEQ ID NO: 1094986 - RNA, 21 nt, Homo sapiens
gcugcaacuuuuuuaugucuc

SEQ ID NO: 1094987 - RNA, 18 nt, Homo sapiens
gcugcuugguagcacuuu

SEQ ID NO: 1094988 - RNA, 23 nt, Homo sapiens
gcuggaaaaguauguuagugcaa

SEQ ID NO: 1094989 - RNA, 19 nt, Homo sapiens
gcugggaauaagugccagg

SEQ ID NO: 1094990 - RNA, 19 nt, Homo sapiens
gcuguagacauuugcuaug

SEQ ID NO: 1094991 - RNA, 10 nt, Homo sapiens
gcuguuaaaa

SEQ ID NO: 1094992 - RNA, 18 nt, Homo sapiens
gcuuacaggcauggacau

SEQ ID NO: 1094993 - RNA, 16 nt, Homo sapiens
gcuucaaggccugggg

SEQ ID NO: 1094994 - RNA, 16 nt, Homo sapiens
gcuucagagacacaca

SEQ ID NO: 1094995 - RNA, 20 nt, Homo sapiens
gcuucauguucccaaaauca

SEQ ID NO: 1094996 - RNA, 21 nt, Homo sapiens
ggaacaagcagcuaagcaaua

SEQ ID NO: 1094997 - RNA, 20 nt, Homo sapiens
ggaacggggguacacggugg

SEQ ID NO: 1094998 - RNA, 13 nt, Homo sapiens
ggaagggacacca

SEQ ID NO: 1094999 - RNA, 13 nt, Homo sapiens
ggacacaagaacu

SEQ ID NO: 1095000 - RNA, 17 nt, Homo sapiens
ggacauuccucuaggac

SEQ ID NO: 1095001 - RNA, 18 nt, Homo sapiens
ggacauuugcucauggaa

SEQ ID NO: 1095002 - RNA, 12 nt, Homo sapiens
ggaccaguuuau

SEQ ID NO: 1095003 - RNA, 14 nt, Homo sapiens
ggacccucccagga

SEQ ID NO: 1095004 - RNA, 21 nt, Homo sapiens
ggacuuuucuaccagguauga

SEQ ID NO: 1095005 - RNA, 12 nt, Homo sapiens
uaaauguuauag

SEQ ID NO: 1095006 - RNA, 22 nt, Homo sapiens
uaaauguuauagcugcauuugu

SEQ ID NO: 1095007 - RNA, 22 nt, Homo sapiens
aaaauguuuuuaaacaguguca

SEQ ID NO: 1095008 - RNA, 20 nt, Homo sapiens
aaaauuaccuuuaaugcaau

SEQ ID NO: 1095009 - RNA, 18 nt, Homo sapiens
aaaauucuggacacauua

SEQ ID NO: 1095010 - RNA, 16 nt, Homo sapiens
aaaauuuucauucuga

SEQ ID NO: 1095011 - RNA, 23 nt, Homo sapiens
aaacaccaagugaggccauagca

SEQ ID NO: 1095012 - RNA, 20 nt, Homo sapiens
aaacaccgagugaggccaua

SEQ ID NO: 1095013 - RNA, 22 nt, Homo sapiens
aaaccuccuucucuucuggaca

SEQ ID NO: 1095014 - RNA, 16 nt, Homo sapiens
aaacuacugaacuguu

SEQ ID NO: 1095015 - RNA, 15 nt, Homo sapiens
aaacugaacacauga

SEQ ID NO: 1095016 - RNA, 20 nt, Homo sapiens
aaacuuguuacaccacauua

SEQ ID NO: 1095017 - RNA, 15 nt, Homo sapiens
aaagaaagaauaugu

SEQ ID NO: 1095018 - RNA, 21 nt, Homo sapiens
aaagaaugaaaguagcuguau

SEQ ID NO: 1095019 - RNA, 17 nt, Homo sapiens
aaagaauuaccaagaga

SEQ ID NO: 1095020 - RNA, 19 nt, Homo sapiens
aaagacauuuguucuccca

SEQ ID NO: 1095021 - RNA, 21 nt, Homo sapiens
aaagauucuuuaaacuacuga

SEQ ID NO: 1095022 - RNA, 23 nt, Homo sapiens
aaagcaacgacuacuuugcuacg

SEQ ID NO: 1095023 - RNA, 23 nt, Homo sapiens
aaagcuauucuuaugcuguaaca

SEQ ID NO: 1095024 - RNA, 14 nt, Homo sapiens
aaaguaaaccacaa

SEQ ID NO: 1095025 - RNA, 14 nt, Homo sapiens
aaagucaccugccc

SEQ ID NO: 1095026 - RNA, 16 nt, Homo sapiens
aaagucaccugcccaa

SEQ ID NO: 1095027 - RNA, 17 nt, Homo sapiens
aaagucaccugcccaag

SEQ ID NO: 1095028 - RNA, 22 nt, Homo sapiens
aaaguccacauuagaucagaua

SEQ ID NO: 1095029 - RNA, 13 nt, Homo sapiens
aaagugaugacau

SEQ ID NO: 1095030 - RNA, 15 nt, Homo sapiens
aaagugugguuugca

SEQ ID NO: 1095031 - RNA, 17 nt, Homo sapiens
aaagugugguuugcaga

SEQ ID NO: 1095032 - RNA, 17 nt, Homo sapiens
aaaguucacauuaacuc

SEQ ID NO: 1095033 - RNA, 21 nt, Homo sapiens
aaaguucacauuaacucaggc

SEQ ID NO: 1095034 - RNA, 20 nt, Homo sapiens
aaauaagauuuaauucacau

SEQ ID NO: 1095035 - RNA, 17 nt, Homo sapiens
aaauagcacauccacca

SEQ ID NO: 1095036 - RNA, 22 nt, Homo sapiens
aaaugagaccccuuuaaacugu

SEQ ID NO: 1095037 - RNA, 15 nt, Homo sapiens
aaaugccaccaucca

SEQ ID NO: 1095038 - RNA, 16 nt, Homo sapiens
aaaugccaccauccaa

SEQ ID NO: 1095039 - RNA, 19 nt, Homo sapiens
aaauguaucugaguauuga

SEQ ID NO: 1095040 - RNA, 23 nt, Homo sapiens
aaaugucuauuauuaugaagaau

SEQ ID NO: 1095041 - RNA, 13 nt, Homo sapiens
aaauuuuacacac

SEQ ID NO: 1095042 - RNA, 18 nt, Homo sapiens
aaauuuucucuaaacugu

SEQ ID NO: 1095043 - RNA, 21 nt, Homo sapiens
aaauuuuuuaaaagagacaaa

SEQ ID NO: 1095044 - RNA, 22 nt, Homo sapiens
aacaacccuguugaguauuugc

SEQ ID NO: 1095045 - RNA, 14 nt, Homo sapiens
aacacaugacuaga

SEQ ID NO: 1095046 - RNA, 21 nt, Homo sapiens
aacaccaagugaggccauagc

SEQ ID NO: 1095047 - RNA, 13 nt, Homo sapiens
aacacuguacuga

SEQ ID NO: 1095048 - RNA, 15 nt, Homo sapiens
aacacuguacugagg

SEQ ID NO: 1095049 - RNA, 13 nt, Homo sapiens
aacagacccagug

SEQ ID NO: 1095050 - RNA, 14 nt, Homo sapiens
aacagccucuuugc

SEQ ID NO: 1095051 - RNA, 16 nt, Homo sapiens
aacaugcuugcauuau

SEQ ID NO: 1095052 - RNA, 13 nt, Homo sapiens
aacauggaguaaa

SEQ ID NO: 1095053 - RNA, 11 nt, Homo sapiens
aaccacaaaag

SEQ ID NO: 1095054 - RNA, 17 nt, Homo sapiens
aaccaggggccaugaau

SEQ ID NO: 1095055 - RNA, 19 nt, Homo sapiens
aaccauguugguugcacuu

SEQ ID NO: 1095056 - RNA, 23 nt, Homo sapiens
aaccauguugguugcacuuugua

SEQ ID NO: 1095057 - RNA, 19 nt, Homo sapiens
aacccucaacugacaugaa

SEQ ID NO: 1095058 - RNA, 18 nt, Homo sapiens
aaccgaauaaauguuuua

SEQ ID NO: 1095059 - RNA, 16 nt, Homo sapiens
aacguuuaacauugau

SEQ ID NO: 1095060 - RNA, 19 nt, Homo sapiens
aacuaaacuuuacuaggua

SEQ ID NO: 1095061 - RNA, 19 nt, Homo sapiens
aacuauuaauuccauguga

SEQ ID NO: 1095062 - RNA, 22 nt, Homo sapiens
aacucaggcuuucagcugugcu

SEQ ID NO: 1095063 - RNA, 15 nt, Homo sapiens
aacuccccuacauca

SEQ ID NO: 1095064 - RNA, 17 nt, Homo sapiens
aacuccccuacaucaaa

SEQ ID NO: 1095065 - RNA, 14 nt, Homo sapiens
aacuccugccugag

SEQ ID NO: 1095066 - RNA, 16 nt, Homo sapiens
aacuccugccugagaa

SEQ ID NO: 1095067 - RNA, 22 nt, Homo sapiens
aacugcauuuuuaaucagugga

SEQ ID NO: 1095068 - RNA, 22 nt, Homo sapiens
aacugcuccaaaccaacaugga

SEQ ID NO: 1095069 - RNA, 20 nt, Homo sapiens
aacuuguuacaccacauuag

SEQ ID NO: 1095070 - RNA, 20 nt, Homo sapiens
aagaaauuuaaucaguguga

SEQ ID NO: 1095071 - RNA, 21 nt, Homo sapiens
aagaaguuuggcaguauuuaa

SEQ ID NO: 1095072 - RNA, 16 nt, Homo sapiens
aagaaugauuaugaau

SEQ ID NO: 1095073 - RNA, 19 nt, Homo sapiens
aagaauuuuguauuuucau

SEQ ID NO: 1095074 - RNA, 17 nt, Homo sapiens
aagacuuuucucuacuu

SEQ ID NO: 1095075 - RNA, 15 nt, Homo sapiens
aagagcuacuucuaa

SEQ ID NO: 1095076 - RNA, 16 nt, Homo sapiens
aagaguuucuucucau

SEQ ID NO: 1095077 - RNA, 15 nt, Homo sapiens
aagauccucuugcca

SEQ ID NO: 1095078 - RNA, 18 nt, Homo sapiens
aagcaauaauuaacugcu

SEQ ID NO: 1095079 - RNA, 13 nt, Homo sapiens
aagcaccaaucau

SEQ ID NO: 1095080 - RNA, 14 nt, Homo sapiens
aagcccccagcugg

SEQ ID NO: 1095081 - RNA, 22 nt, Homo sapiens
aagccuuggggcugaugcaguu

SEQ ID NO: 1095082 - RNA, 12 nt, Homo sapiens
aagcuucaggga

SEQ ID NO: 1095083 - RNA, 13 nt, Homo sapiens
aaggaagucuuca

SEQ ID NO: 1095084 - RNA, 20 nt, Homo sapiens
aaggcgggaggaucacuuga

SEQ ID NO: 1095085 - RNA, 22 nt, Homo sapiens
aaggcuggugguaacuuuugaa

SEQ ID NO: 1095086 - RNA, 22 nt, Homo sapiens
aaggucuuauaguccaaacuuu

SEQ ID NO: 1095087 - RNA, 23 nt, Homo sapiens
aagguugcuguugugcagugugc

SEQ ID NO: 1095088 - RNA, 22 nt, Homo sapiens
aaguagcuguaugagcaguuca

SEQ ID NO: 1095089 - RNA, 10 nt, Homo sapiens
aaguauuuaa

SEQ ID NO: 1095090 - RNA, 17 nt, Homo sapiens
aagucuucaaauuugau

SEQ ID NO: 1095091 - RNA, 21 nt, Homo sapiens
aaguuacagccauaugcagga

SEQ ID NO: 1095092 - RNA, 18 nt, Homo sapiens
aaguucuuaguguugguu

SEQ ID NO: 1095093 - RNA, 12 nt, Homo sapiens
aauaaaagcuau

SEQ ID NO: 1095094 - RNA, 23 nt, Homo sapiens
aauaaaauuuaacucacacugcc

SEQ ID NO: 1095095 - RNA, 15 nt, Homo sapiens
aauaaacauucucaa

SEQ ID NO: 1095096 - RNA, 18 nt, Homo sapiens
aauaaauguuuuauuucu

SEQ ID NO: 1095097 - RNA, 16 nt, Homo sapiens
aauaagauuuaauuca

SEQ ID NO: 1095098 - RNA, 14 nt, Homo sapiens
aauacaaaucugua

SEQ ID NO: 1095099 - RNA, 16 nt, Homo sapiens
aauacugacuuucaaa

SEQ ID NO: 1095100 - RNA, 17 nt, Homo sapiens
aauacuuuaaaaugcac

SEQ ID NO: 1095101 - RNA, 20 nt, Homo sapiens
aauaguguccuaugcaauaa

SEQ ID NO: 1095102 - RNA, 14 nt, Homo sapiens
agagagugcuauug

SEQ ID NO: 1095103 - RNA, 20 nt, Homo sapiens
agagauagauauuguccuaa

SEQ ID NO: 1095104 - RNA, 19 nt, Homo sapiens
agagauauuuugauucuca

SEQ ID NO: 1095105 - RNA, 17 nt, Homo sapiens
agagcugaacuauuaga

SEQ ID NO: 1095106 - RNA, 23 nt, Homo sapiens
agagcugccugugccuuuugcca

SEQ ID NO: 1095107 - RNA, 23 nt, Homo sapiens
agaggcgcugaguggaaccacga

SEQ ID NO: 1095108 - RNA, 13 nt, Homo sapiens
agauaaucacaau

SEQ ID NO: 1095109 - RNA, 13 nt, Homo sapiens
agauacuuuucau

SEQ ID NO: 1095110 - RNA, 13 nt, Homo sapiens
agauccucuugcc

SEQ ID NO: 1095111 - RNA, 14 nt, Homo sapiens
agauccucuugcca

SEQ ID NO: 1095112 - RNA, 18 nt, Homo sapiens
agaucuacacagucacac

SEQ ID NO: 1095113 - RNA, 19 nt, Homo sapiens
agcaaaguaaugguucuca

SEQ ID NO: 1095114 - RNA, 17 nt, Homo sapiens
agcacguguggccuguu

SEQ ID NO: 1095115 - RNA, 16 nt, Homo sapiens
agcaguggcuccauug

SEQ ID NO: 1095116 - RNA, 16 nt, Homo sapiens
agcaucagagcccuuu

SEQ ID NO: 1095117 - RNA, 17 nt, Homo sapiens
agcaucucccaguucau

SEQ ID NO: 1095118 - RNA, 21 nt, Homo sapiens
agcauuguuucuagauuagcu

SEQ ID NO: 1095119 - RNA, 21 nt, Homo sapiens
agccauaugcaggacagcagu

SEQ ID NO: 1095120 - RNA, 22 nt, Homo sapiens
agcccaaauauaaaaacagacu

SEQ ID NO: 1095121 - RNA, 19 nt, Homo sapiens
agccuccaggauaccagca

SEQ ID NO: 1095122 - RNA, 18 nt, Homo sapiens
agcugacgcgacuaucau

SEQ ID NO: 1095123 - RNA, 19 nt, Homo sapiens
agcugcauuugucuggccu

SEQ ID NO: 1095124 - RNA, 12 nt, Homo sapiens
agcuuaugccua

SEQ ID NO: 1095125 - RNA, 21 nt, Homo sapiens
agcuugagggugacuauggag

SEQ ID NO: 1095126 - RNA, 19 nt, Homo sapiens
agcuuuccucaucaggcca

SEQ ID NO: 1095127 - RNA, 14 nt, Homo sapiens
aggaaaagacaccc

SEQ ID NO: 1095128 - RNA, 16 nt, Homo sapiens
aggaaaggaugaucaa

SEQ ID NO: 1095129 - RNA, 12 nt, Homo sapiens
aggaacaaugcc

SEQ ID NO: 1095130 - RNA, 21 nt, Homo sapiens
agauuuuccugaaaacccuug

SEQ ID NO: 1095131 - RNA, 20 nt, Homo sapiens
agauuuuuuuuuuaaucucc

SEQ ID NO: 1095132 - RNA, 16 nt, Homo sapiens
agcaaaccaaugcuau

SEQ ID NO: 1095133 - RNA, 19 nt, Homo sapiens
agcaacuccccuacaucaa

SEQ ID NO: 1095134 - RNA, 16 nt, Homo sapiens
agcaagucacuggcca

SEQ ID NO: 1095135 - RNA, 22 nt, Homo sapiens
agcaauuccccuacaucaaaug

SEQ ID NO: 1095136 - RNA, 20 nt, Homo sapiens
agcacacauaaaagcacaaa

SEQ ID NO: 1095137 - RNA, 18 nt, Homo sapiens
agcacccagaacugagga

SEQ ID NO: 1095138 - RNA, 22 nt, Homo sapiens
agcacuugcagaccugccugaa

SEQ ID NO: 1095139 - RNA, 16 nt, Homo sapiens
agcagaugcaggggug

SEQ ID NO: 1095140 - RNA, 16 nt, Homo sapiens
agcaggggcaaugacc

SEQ ID NO: 1095141 - RNA, 23 nt, Homo sapiens
agcccgggucaucuguaccucug

SEQ ID NO: 1095142 - RNA, 23 nt, Homo sapiens
agccuguugggaucgcauugcau

SEQ ID NO: 1095143 - RNA, 17 nt, Homo sapiens
agccuuggcucuacccu

SEQ ID NO: 1095144 - RNA, 18 nt, Homo sapiens
agccuuggcucuacccug

SEQ ID NO: 1095145 - RNA, 19 nt, Homo sapiens
agcgaaugauugcuuuuaa

SEQ ID NO: 1095146 - RNA, 14 nt, Homo sapiens
agcuacaaaugccu

SEQ ID NO: 1095147 - RNA, 19 nt, Homo sapiens
agcuggggaugucucucau

SEQ ID NO: 1095148 - RNA, 19 nt, Homo sapiens
agcuuauugucuagugaaa

SEQ ID NO: 1095149 - RNA, 23 nt, Homo sapiens
agcuuuacaaggaguaacaaaac

SEQ ID NO: 1095150 - RNA, 22 nt, Homo sapiens
aggaacagacucgaugcaagug

SEQ ID NO: 1095151 - RNA, 15 nt, Homo sapiens
aggaguaacaaaaca

SEQ ID NO: 1095152 - RNA, 14 nt, Homo sapiens
aggagucagggaga

SEQ ID NO: 1095153 - RNA, 13 nt, Homo sapiens
aggauacagucuu

SEQ ID NO: 1095154 - RNA, 17 nt, Homo sapiens
aggccagcaccaucucu

SEQ ID NO: 1095155 - RNA, 18 nt, Homo sapiens
aggccaggggagacaucg

SEQ ID NO: 1095156 - RNA, 16 nt, Homo sapiens
aggcgcugaguggaac

SEQ ID NO: 1095157 - RNA, 17 nt, Homo sapiens
aggcgggaggaucacuu

SEQ ID NO: 1095158 - RNA, 21 nt, Homo sapiens
aggcugcagugagcugugauu

SEQ ID NO: 1095159 - RNA, 14 nt, Homo sapiens
aggggagacaucac

SEQ ID NO: 1095160 - RNA, 19 nt, Homo sapiens
aggggcaacaaaugcauca

SEQ ID NO: 1095161 - RNA, 22 nt, Homo sapiens
agguugcuguugugcagugugc

SEQ ID NO: 1095162 - RNA, 16 nt, Homo sapiens
aguaaaacuuguuaca

SEQ ID NO: 1095163 - RNA, 19 nt, Homo sapiens
aguaauucuagacauaacu

SEQ ID NO: 1095164 - RNA, 17 nt, Homo sapiens
aguacaaugaguguuau

SEQ ID NO: 1095165 - RNA, 22 nt, Homo sapiens
aguacauggcauugagacaucu

SEQ ID NO: 1095166 - RNA, 13 nt, Homo sapiens
aguaccauuugau

SEQ ID NO: 1095167 - RNA, 23 nt, Homo sapiens
aguauguuagugcaaauugucac

SEQ ID NO: 1095168 - RNA, 14 nt, Homo sapiens
agucaccucaugga

SEQ ID NO: 1095169 - RNA, 13 nt, Homo sapiens
agucauccucaga

SEQ ID NO: 1095170 - RNA, 17 nt, Homo sapiens
agucccugccaucaugu

SEQ ID NO: 1095171 - RNA, 18 nt, Homo sapiens
agucuugauagcaagcgu

SEQ ID NO: 1095172 - RNA, 14 nt, Homo sapiens
agugaagcauuuaa

SEQ ID NO: 1095173 - RNA, 15 nt, Homo sapiens
agugaccacgcauug

SEQ ID NO: 1095174 - RNA, 13 nt, Homo sapiens
agugagaagccag

SEQ ID NO: 1095175 - RNA, 22 nt, Homo sapiens
aguggccguugcuacaagucac

SEQ ID NO: 1095176 - RNA, 16 nt, Homo sapiens
aguguccuaugcaaua

SEQ ID NO: 1095177 - RNA, 20 nt, Homo sapiens
aguguuggagaagaacugaa

SEQ ID NO: 1095178 - RNA, 17 nt, Homo sapiens
aguuaagagaaagucac

SEQ ID NO: 1095179 - RNA, 19 nt, Homo sapiens
aguucuuacccaguuaaca

SEQ ID NO: 1095180 - RNA, 13 nt, Homo sapiens
aguugcaaucugu

SEQ ID NO: 1095181 - RNA, 19 nt, Homo sapiens
aguugggcauaguggcacu

SEQ ID NO: 1095182 - RNA, 16 nt, Homo sapiens
aguuuuauaugcuucu

SEQ ID NO: 1095183 - RNA, 18 nt, Homo sapiens
aguuuuauuacacauuua

SEQ ID NO: 1095184 - RNA, 15 nt, Homo sapiens
auaaaagaucuugca

SEQ ID NO: 1095185 - RNA, 16 nt, Homo sapiens
auaaaagcuauuacuu

SEQ ID NO: 1095186 - RNA, 12 nt, Homo sapiens
auaaauacuuau

SEQ ID NO: 1095187 - RNA, 20 nt, Homo sapiens
auaaauguuauagcugcauu

SEQ ID NO: 1095188 - RNA, 17 nt, Homo sapiens
auaauaaaaagcuucag

SEQ ID NO: 1095189 - RNA, 14 nt, Homo sapiens
auaauaagacuuuu

SEQ ID NO: 1095190 - RNA, 15 nt, Homo sapiens
auaauaagacuuuuc

SEQ ID NO: 1095191 - RNA, 16 nt, Homo sapiens
auaauacaacuaucau

SEQ ID NO: 1095192 - RNA, 19 nt, Homo sapiens
auaauaccuuucuaaggga

SEQ ID NO: 1095193 - RNA, 18 nt, Homo sapiens
auaaucacaacccuucag

SEQ ID NO: 1095194 - RNA, 18 nt, Homo sapiens
auaaucuccaacuuuauu

SEQ ID NO: 1095195 - RNA, 19 nt, Homo sapiens
auaaucugaauccuguuaa

SEQ ID NO: 1095196 - RNA, 15 nt, Homo sapiens
auaauucagucuugc

SEQ ID NO: 1095197 - RNA, 21 nt, Homo sapiens
auacauuaggaagcugaauua

SEQ ID NO: 1095198 - RNA, 14 nt, Homo sapiens
auacugguauuaaa

SEQ ID NO: 1095199 - RNA, 16 nt, Homo sapiens
auagaggaacuugaaa

SEQ ID NO: 1095200 - RNA, 19 nt, Homo sapiens
auagcaauuccccuacauc

SEQ ID NO: 1095201 - RNA, 21 nt, Homo sapiens
auagcaauuccccuacaucaa

SEQ ID NO: 1095202 - RNA, 18 nt, Homo sapiens
auagcaccuccacauacc

SEQ ID NO: 1095203 - RNA, 11 nt, Homo sapiens
auagcacuugc

SEQ ID NO: 1095204 - RNA, 16 nt, Homo sapiens
auaggcuaaccacuuu

SEQ ID NO: 1095205 - RNA, 23 nt, Homo sapiens
auagucugaacacaagcauuuca

SEQ ID NO: 1095206 - RNA, 18 nt, Homo sapiens
auauaaacaugcuugcau

SEQ ID NO: 1095207 - RNA, 18 nt, Homo sapiens
auauauaguuagcuuuau

SEQ ID NO: 1095208 - RNA, 22 nt, Homo sapiens
auaugcaggacggcaguacuca

SEQ ID NO: 1095209 - RNA, 15 nt, Homo sapiens
auauuaccuaaugaa

SEQ ID NO: 1095210 - RNA, 16 nt, Homo sapiens
auauugaaugccuuau

SEQ ID NO: 1095211 - RNA, 15 nt, Homo sapiens
auauuucaguauuga

SEQ ID NO: 1095212 - RNA, 23 nt, Homo sapiens
auauuucaguauugagcuuugca

SEQ ID NO: 1095213 - RNA, 21 nt, Homo sapiens
auauuuugauucucauugcca

SEQ ID NO: 1095214 - RNA, 19 nt, Homo sapiens
auauuuuuuauacuugaaa

SEQ ID NO: 1095215 - RNA, 16 nt, Homo sapiens
aucaaaugcucaagcc

SEQ ID NO: 1095216 - RNA, 17 nt, Homo sapiens
aucaacauuuguuccau

SEQ ID NO: 1095217 - RNA, 12 nt, Homo sapiens
aucacacugaaa

SEQ ID NO: 1095218 - RNA, 12 nt, Homo sapiens
aucacaucauuu

SEQ ID NO: 1095219 - RNA, 18 nt, Homo sapiens
aucacccagaugaugucc

SEQ ID NO: 1095220 - RNA, 18 nt, Homo sapiens
aucauagaaaaugugagu

SEQ ID NO: 1095221 - RNA, 12 nt, Homo sapiens
auccaagacaaa

SEQ ID NO: 1095222 - RNA, 17 nt, Homo sapiens
auccaagacaaacuaaa

SEQ ID NO: 1095223 - RNA, 14 nt, Homo sapiens
aucgagacugcaau

SEQ ID NO: 1095224 - RNA, 20 nt, Homo sapiens
aucuagaaauuuaccucaaa

SEQ ID NO: 1095225 - RNA, 15 nt, Homo sapiens
aucuuagggaacuuu

SEQ ID NO: 1095226 - RNA, 15 nt, Homo sapiens
aucuugaaaaugcca

SEQ ID NO: 1095227 - RNA, 16 nt, Homo sapiens
aucuugaaaaugccac

SEQ ID NO: 1095228 - RNA, 21 nt, Homo sapiens
aucuuuuagcuagaauccaca

SEQ ID NO: 1095229 - RNA, 11 nt, Homo sapiens
augacauauuu

SEQ ID NO: 1095230 - RNA, 20 nt, Homo sapiens
augauuagucagaaacugcc

SEQ ID NO: 1095231 - RNA, 19 nt, Homo sapiens
augcaaaaaaugcuuuguu

SEQ ID NO: 1095232 - RNA, 20 nt, Homo sapiens
augcacaccuaagcccaaau

SEQ ID NO: 1095233 - RNA, 17 nt, Homo sapiens
augcauaaaagggucaa

SEQ ID NO: 1095234 - RNA, 13 nt, Homo sapiens
augcaucauuaau

SEQ ID NO: 1095235 - RNA, 13 nt, Homo sapiens
augccaccaucca

SEQ ID NO: 1095236 - RNA, 20 nt, Homo sapiens
augccuuuucccaacuccag

SEQ ID NO: 1095237 - RNA, 13 nt, Homo sapiens
augcucaagcccc

SEQ ID NO: 1095238 - RNA, 13 nt, Homo sapiens
augcucaagcccu

SEQ ID NO: 1095239 - RNA, 16 nt, Homo sapiens
augcucugaugcagug

SEQ ID NO: 1095240 - RNA, 22 nt, Homo sapiens
auggaugcggugacaaauggca

SEQ ID NO: 1095241 - RNA, 22 nt, Homo sapiens
auggcacuaguauuucuaugaa

SEQ ID NO: 1095242 - RNA, 23 nt, Homo sapiens
aaaaaauugaaacuugcauuuua

SEQ ID NO: 1095243 - RNA, 21 nt, Homo sapiens
aaaaauugaaacuugcauuuu

SEQ ID NO: 1095244 - RNA, 12 nt, Homo sapiens
aaaacaauuuca

SEQ ID NO: 1095245 - RNA, 12 nt, Homo sapiens
auguucuaguua

SEQ ID NO: 1095246 - RNA, 17 nt, Homo sapiens
auguugacaugggacau

SEQ ID NO: 1095247 - RNA, 20 nt, Homo sapiens
auguuguuccaggaugugga

SEQ ID NO: 1095248 - RNA, 20 nt, Homo sapiens
auguuuuuaaacagugucau

SEQ ID NO: 1095249 - RNA, 22 nt, Homo sapiens
auuaaucucuaguaaaacauug

SEQ ID NO: 1095250 - RNA, 12 nt, Homo sapiens
auuaccaagaga

SEQ ID NO: 1095251 - RNA, 13 nt, Homo sapiens
auuaccuaaugaa

SEQ ID NO: 1095252 - RNA, 13 nt, Homo sapiens
auuauucccauga

SEQ ID NO: 1095253 - RNA, 18 nt, Homo sapiens
auucacagcaagucacug

SEQ ID NO: 1095254 - RNA, 14 nt, Homo sapiens
auucauuaugcaac

SEQ ID NO: 1095255 - RNA, 15 nt, Homo sapiens
auuccacacccucac

SEQ ID NO: 1095256 - RNA, 23 nt, Homo sapiens
auuccacacccucacugcuguag

SEQ ID NO: 1095257 - RNA, 16 nt, Homo sapiens
auuccaugugauacau

SEQ ID NO: 1095258 - RNA, 19 nt, Homo sapiens
auuccaugugauacauuag

SEQ ID NO: 1095259 - RNA, 23 nt, Homo sapiens
auuccccuacaucaaaugcucaa

SEQ ID NO: 1095260 - RNA, 17 nt, Homo sapiens
auuccuaaaaugcuuca

SEQ ID NO: 1095261 - RNA, 17 nt, Homo sapiens
auucuuaaaaugcaaua

SEQ ID NO: 1095262 - RNA, 17 nt, Homo sapiens
auugaagucuuauccaa

SEQ ID NO: 1095263 - RNA, 13 nt, Homo sapiens
auugaaugauaau

SEQ ID NO: 1095264 - RNA, 17 nt, Homo sapiens
auugaaugauaauucag

SEQ ID NO: 1095265 - RNA, 15 nt, Homo sapiens
auugaggacacugau

SEQ ID NO: 1095266 - RNA, 18 nt, Homo sapiens
auuggagaaaagcacuua

SEQ ID NO: 1095267 - RNA, 12 nt, Homo sapiens
auuuacauucuu

SEQ ID NO: 1095268 - RNA, 16 nt, Homo sapiens
auuuagguuacuuuag

SEQ ID NO: 1095269 - RNA, 17 nt, Homo sapiens
auuuauuacuguaagaa

SEQ ID NO: 1095270 - RNA, 20 nt, Homo sapiens
auuucacaguuggcacuucu

SEQ ID NO: 1095271 - RNA, 23 nt, Homo sapiens
auuucuccagaaauuuaccacaa

SEQ ID NO: 1095272 - RNA, 14 nt, Homo sapiens
auuugaugcuuuaa

SEQ ID NO: 1095273 - RNA, 14 nt, Homo sapiens
auuugcucauggaa

SEQ ID NO: 1095274 - RNA, 21 nt, Homo sapiens
auuuuaaguguuuaaaagcaa

SEQ ID NO: 1095275 - RNA, 20 nt, Homo sapiens
auuuuguaaaucuguacuuu

SEQ ID NO: 1095276 - RNA, 14 nt, Homo sapiens
caaaaauucaggaa

SEQ ID NO: 1095277 - RNA, 17 nt, Homo sapiens
caaaaauucaugcccca

SEQ ID NO: 1095278 - RNA, 13 nt, Homo sapiens
caaaacaauuuca

SEQ ID NO: 1095279 - RNA, 11 nt, Homo sapiens
caaaacagccu

SEQ ID NO: 1095280 - RNA, 17 nt, Homo sapiens
caaaauagcacauccac

SEQ ID NO: 1095281 - RNA, 15 nt, Homo sapiens
caaaccaaugcuauu

SEQ ID NO: 1095282 - RNA, 13 nt, Homo sapiens
caaaccuguagau

SEQ ID NO: 1095283 - RNA, 19 nt, Homo sapiens
caaaccuguagaugcagaa

SEQ ID NO: 1095284 - RNA, 20 nt, Homo sapiens
caaagggccugcccagacaa

SEQ ID NO: 1095285 - RNA, 22 nt, Homo sapiens
caaaguaaaaauaaacuguuau

SEQ ID NO: 1095286 - RNA, 17 nt, Homo sapiens
caaaguaaugguucuca

SEQ ID NO: 1095287 - RNA, 12 nt, Homo sapiens
caaaugcucaag

SEQ ID NO: 1095288 - RNA, 21 nt, Homo sapiens
caacaucgguguggacuacag

SEQ ID NO: 1095289 - RNA, 13 nt, Homo sapiens
caacaucuaguga

SEQ ID NO: 1095290 - RNA, 18 nt, Homo sapiens
caacauuuguuccaugag

SEQ ID NO: 1095291 - RNA, 17 nt, Homo sapiens
caagaguuucuucucau

SEQ ID NO: 1095292 - RNA, 22 nt, Homo sapiens
caagcaaaguaaugguucucau

SEQ ID NO: 1095293 - RNA, 17 nt, Homo sapiens
caagcauuuagauguau

SEQ ID NO: 1095294 - RNA, 20 nt, Homo sapiens
caagggaggggagcagccua

SEQ ID NO: 1095295 - RNA, 14 nt, Homo sapiens
caagugaggccaua

SEQ ID NO: 1095296 - RNA, 15 nt, Homo sapiens
caauagcaugcaaaa

SEQ ID NO: 1095297 - RNA, 21 nt, Homo sapiens
caauagcaugcaaaaaaugcu

SEQ ID NO: 1095298 - RNA, 20 nt, Homo sapiens
caauaguguccuaugcaaua

SEQ ID NO: 1095299 - RNA, 18 nt, Homo sapiens
caauaguuucuuguuaau

SEQ ID NO: 1095300 - RNA, 17 nt, Homo sapiens
caaucgagacugcaaug

SEQ ID NO: 1095301 - RNA, 22 nt, Homo sapiens
caaugccacauacuugcagcuc

SEQ ID NO: 1095302 - RNA, 24 nt, Homo sapiens
caauuccccuacaucaaaugcuca

SEQ ID NO: 1095303 - RNA, 19 nt, Homo sapiens
caauuucacccauagcuaa

SEQ ID NO: 1095304 - RNA, 17 nt, Homo sapiens
caauuugucaguguaua

SEQ ID NO: 1095305 - RNA, 22 nt, Homo sapiens
cacaaugugaaaauguaucuga

SEQ ID NO: 1095306 - RNA, 19 nt, Homo sapiens
cacaauuacauacuauucu

SEQ ID NO: 1095307 - RNA, 15 nt, Homo sapiens
cacacuguuugugua

SEQ ID NO: 1095308 - RNA, 16 nt, Homo sapiens
cacacuguuuguguag

SEQ ID NO: 1095309 - RNA, 22 nt, Homo sapiens
cacagccagacgcauccugcca

SEQ ID NO: 1095310 - RNA, 19 nt, Homo sapiens
cacaggaaccacaagacug

SEQ ID NO: 1095311 - RNA, 15 nt, Homo sapiens
cacaugacauagcac

SEQ ID NO: 1095312 - RNA, 22 nt, Homo sapiens
cacaugacauagcacuugccga

SEQ ID NO: 1095313 - RNA, 22 nt, Homo sapiens
caccaagugaggccauagcaau

SEQ ID NO: 1095314 - RNA, 13 nt, Homo sapiens
caccacuuuguaa

SEQ ID NO: 1095315 - RNA, 12 nt, Homo sapiens
caccagucugac

SEQ ID NO: 1095316 - RNA, 20 nt, Homo sapiens
caccugcccaagaaacaccg

SEQ ID NO: 1095317 - RNA, 21 nt, Homo sapiens
caccuggugcuacgaccaggg

SEQ ID NO: 1095318 - RNA, 19 nt, Homo sapiens
cacugccuucucaacucca

SEQ ID NO: 1095319 - RNA, 20 nt, Homo sapiens
cacuguagcuuuacaaggag

SEQ ID NO: 1095320 - RNA, 12 nt, Homo sapiens
cacuucugccau

SEQ ID NO: 1095321 - RNA, 15 nt, Homo sapiens
cacuugcagaccugc

SEQ ID NO: 1095322 - RNA, 15 nt, Homo sapiens
cacuugccgaucugc

SEQ ID NO: 1095323 - RNA, 20 nt, Homo sapiens
cagaacuggaaauguccaag

SEQ ID NO: 1095324 - RNA, 23 nt, Homo sapiens
cagaagccccaaaguucacauua

SEQ ID NO: 1095325 - RNA, 14 nt, Homo sapiens
cagagaaaggagag

SEQ ID NO: 1095326 - RNA, 22 nt, Homo sapiens
cagagcgagaacccucaacuga

SEQ ID NO: 1095327 - RNA, 21 nt, Homo sapiens
cagcaccaucucuuuaccucc

SEQ ID NO: 1095328 - RNA, 18 nt, Homo sapiens
cagcuaagcaauagauaa

SEQ ID NO: 1095329 - RNA, 14 nt, Homo sapiens
cagcugagguucau

SEQ ID NO: 1095330 - RNA, 14 nt, Homo sapiens
cagcugauuugcag

SEQ ID NO: 1095331 - RNA, 18 nt, Homo sapiens
cagcuuauugucuaguga

SEQ ID NO: 1095332 - RNA, 20 nt, Homo sapiens
cagcuuuccucaucaggcca

SEQ ID NO: 1095333 - RNA, 20 nt, Homo sapiens
caggaaagagaacuuccaga

SEQ ID NO: 1095334 - RNA, 20 nt, Homo sapiens
caggacacugcagaacagcu

SEQ ID NO: 1095335 - RNA, 13 nt, Homo sapiens
caggacagcagua

SEQ ID NO: 1095336 - RNA, 17 nt, Homo sapiens
caggagaguacauggca

SEQ ID NO: 1095337 - RNA, 13 nt, Homo sapiens
caggauaccagca

SEQ ID NO: 1095338 - RNA, 23 nt, Homo sapiens
caggauggcuggaacacuguacu

SEQ ID NO: 1095339 - RNA, 18 nt, Homo sapiens
caggccauugucccugaa

SEQ ID NO: 1095340 - RNA, 20 nt, Homo sapiens
caggccauugucccugaaga

SEQ ID NO: 1095341 - RNA, 19 nt, Homo sapiens
cagggcugaggccucucau

SEQ ID NO: 1095342 - RNA, 16 nt, Homo sapiens
cagggcugguuuguuc

SEQ ID NO: 1095343 - RNA, 20 nt, Homo sapiens
caggggagacaucacaaccu

SEQ ID NO: 1095344 - RNA, 15 nt, Homo sapiens
caguaaaacagauuc

SEQ ID NO: 1095345 - RNA, 17 nt, Homo sapiens
caguaauuugcaauuug

SEQ ID NO: 1095346 - RNA, 15 nt, Homo sapiens
cagucaccucaugga

SEQ ID NO: 1095347 - RNA, 16 nt, Homo sapiens
cagucaccucauggaa

SEQ ID NO: 1095348 - RNA, 18 nt, Homo sapiens
cagucuugccuuugaagg

SEQ ID NO: 1095349 - RNA, 16 nt, Homo sapiens
cagugcaagagacuuu

SEQ ID NO: 1095350 - RNA, 18 nt, Homo sapiens
caguggcuggaucuguga

SEQ ID NO: 1095351 - RNA, 19 nt, Homo sapiens
caguggcuggaucugugag

SEQ ID NO: 1095352 - RNA, 20 nt, Homo sapiens
caguuaccucugccucagaa

SEQ ID NO: 1095353 - RNA, 16 nt, Homo sapiens
cauaaacauuugccaa

SEQ ID NO: 1095354 - RNA, 23 nt, Homo sapiens
cauaaagaauuuuguauuuucau

SEQ ID NO: 1095355 - RNA, 22 nt, Homo sapiens
cauaacgcugacugcaaaaacu

SEQ ID NO: 1095356 - RNA, 17 nt, Homo sapiens
cauacaucauucuguga

SEQ ID NO: 1095357 - RNA, 22 nt, Homo sapiens
cauaccuggcccugugccuugg

SEQ ID NO: 1095358 - RNA, 21 nt, Homo sapiens
cauagcaacuccccuacauca

SEQ ID NO: 1095359 - RNA, 20 nt, Homo sapiens
cauagcaauuccccuacauc

SEQ ID NO: 1095360 - RNA, 12 nt, Homo sapiens
cauagcacuugc

SEQ ID NO: 1095361 - RNA, 18 nt, Homo sapiens
cauauauaacaaugcugu

SEQ ID NO: 1095362 - RNA, 17 nt, Homo sapiens
cauauguauguccaauu

SEQ ID NO: 1095363 - RNA, 15 nt, Homo sapiens
caucaaaugcucaag

SEQ ID NO: 1095364 - RNA, 23 nt, Homo sapiens
caucucaggacccgcccaagagu

SEQ ID NO: 1095365 - RNA, 16 nt, Homo sapiens
caucucuuuaccuccu

SEQ ID NO: 1095366 - RNA, 23 nt, Homo sapiens
caucucuuuaccuccuaauucca

SEQ ID NO: 1095367 - RNA, 14 nt, Homo sapiens
caucuuucauaguu

SEQ ID NO: 1095368 - RNA, 14 nt, Homo sapiens
caugacauagcacu

SEQ ID NO: 1095369 - RNA, 20 nt, Homo sapiens
caugauguuuagaaacacaa

SEQ ID NO: 1095370 - RNA, 21 nt, Homo sapiens
uaaauuuaugguucucaggcc

SEQ ID NO: 1095371 - RNA, 15 nt, Homo sapiens
uaaauuuaugugaug

SEQ ID NO: 1095372 - RNA, 16 nt, Homo sapiens
uaaauuuaugugaugg

SEQ ID NO: 1095373 - RNA, 14 nt, Homo sapiens
uaaauuugaugcuu

SEQ ID NO: 1095374 - RNA, 20 nt, Homo sapiens
uaacaaaagaaaacuuuauc

SEQ ID NO: 1095375 - RNA, 13 nt, Homo sapiens
uaacaaaugacug

SEQ ID NO: 1095376 - RNA, 21 nt, Homo sapiens
uaacauuccuaaaaugcuuca

SEQ ID NO: 1095377 - RNA, 16 nt, Homo sapiens
uaacgcugacugcaaa

SEQ ID NO: 1095378 - RNA, 11 nt, Homo sapiens
uaacucaggca

SEQ ID NO: 1095379 - RNA, 16 nt, Homo sapiens
uaacucaggcauuuca

SEQ ID NO: 1095380 - RNA, 22 nt, Homo sapiens
uaacucagucuuuaaucugaga

SEQ ID NO: 1095381 - RNA, 12 nt, Homo sapiens
uaacucuacugu

SEQ ID NO: 1095382 - RNA, 20 nt, Homo sapiens
uaacugaaaaaggacuuuuc

SEQ ID NO: 1095383 - RNA, 17 nt, Homo sapiens
uaaggaaaaguaaggga

SEQ ID NO: 1095384 - RNA, 17 nt, Homo sapiens
uaaucuccugaguugua

SEQ ID NO: 1095385 - RNA, 16 nt, Homo sapiens
uaaucugagaggccac

SEQ ID NO: 1095386 - RNA, 16 nt, Homo sapiens
uaaucuuuuucaucau

SEQ ID NO: 1095387 - RNA, 17 nt, Homo sapiens
uaaugauaacuggaaac

SEQ ID NO: 1095388 - RNA, 17 nt, Homo sapiens
uaauucagucuugccuu

SEQ ID NO: 1095389 - RNA, 23 nt, Homo sapiens
uaauuuuuccuuccucuguaaga

SEQ ID NO: 1095390 - RNA, 23 nt, Homo sapiens
uacaaaagcuuguguaucuugau

SEQ ID NO: 1095391 - RNA, 16 nt, Homo sapiens
uacaacuaucauaccu

SEQ ID NO: 1095392 - RNA, 19 nt, Homo sapiens
uacaaucgagacugcaaug

SEQ ID NO: 1095393 - RNA, 10 nt, Homo sapiens
uacacggugg

SEQ ID NO: 1095394 - RNA, 14 nt, Homo sapiens
uacagaggacagua

SEQ ID NO: 1095395 - RNA, 14 nt, Homo sapiens
uacagccauaugca

SEQ ID NO: 1095396 - RNA, 18 nt, Homo sapiens
uacauaacuucagugcaa

SEQ ID NO: 1095397 - RNA, 15 nt, Homo sapiens
uacauugugcaauug

SEQ ID NO: 1095398 - RNA, 22 nt, Homo sapiens
uaccaaaaaucucaauauuuca

SEQ ID NO: 1095399 - RNA, 14 nt, Homo sapiens
uaccuaaacuguau

SEQ ID NO: 1095400 - RNA, 17 nt, Homo sapiens
uaccuaaacuguaucau

SEQ ID NO: 1095401 - RNA, 21 nt, Homo sapiens
uaccuucuaccucuuggcugc

SEQ ID NO: 1095402 - RNA, 12 nt, Homo sapiens
uacucucaggca

SEQ ID NO: 1095403 - RNA, 13 nt, Homo sapiens
uacucucaggcau

SEQ ID NO: 1095404 - RNA, 20 nt, Homo sapiens
uacucucaggcauggaugaa

SEQ ID NO: 1095405 - RNA, 13 nt, Homo sapiens
uacuuauggcuca

SEQ ID NO: 1095406 - RNA, 19 nt, Homo sapiens
uacuucuggagucuauaaa

SEQ ID NO: 1095407 - RNA, 23 nt, Homo sapiens
uagaaaggcuuccagaugucuaa

SEQ ID NO: 1095408 - RNA, 19 nt, Homo sapiens
uagaauaaauauaaaaugg

SEQ ID NO: 1095409 - RNA, 16 nt, Homo sapiens
uagaauaccacaggaa

SEQ ID NO: 1095410 - RNA, 15 nt, Homo sapiens
uagagcaaccaguca

SEQ ID NO: 1095411 - RNA, 21 nt, Homo sapiens
uagcaaugaauuaguugcauu

SEQ ID NO: 1095412 - RNA, 18 nt, Homo sapiens
uagcaccuccacauaccu

SEQ ID NO: 1095413 - RNA, 19 nt, Homo sapiens
uagcacuugcagaccugcc

SEQ ID NO: 1095414 - RNA, 19 nt, Homo sapiens
uagcauggcuucacacugu

SEQ ID NO: 1095415 - RNA, 20 nt, Homo sapiens
uagccaagaggacagaauua

SEQ ID NO: 1095416 - RNA, 15 nt, Homo sapiens
uagccuuugucccag

SEQ ID NO: 1095417 - RNA, 12 nt, Homo sapiens
uaggaacagacu

SEQ ID NO: 1095418 - RNA, 22 nt, Homo sapiens
uaguaccaugucguaguuacuc

SEQ ID NO: 1095419 - RNA, 15 nt, Homo sapiens
uagucucagcuacuu

SEQ ID NO: 1095420 - RNA, 21 nt, Homo sapiens
uaguuuuaucuuaacacugaa

SEQ ID NO: 1095421 - RNA, 17 nt, Homo sapiens
uauaaaauuaacauaaa

SEQ ID NO: 1095422 - RNA, 15 nt, Homo sapiens
uauaacaaugcugua

SEQ ID NO: 1095423 - RNA, 21 nt, Homo sapiens
uauaauaaaaagcuucaggga

SEQ ID NO: 1095424 - RNA, 14 nt, Homo sapiens
uauaccuagaauaa

SEQ ID NO: 1095425 - RNA, 18 nt, Homo sapiens
uauagaagaaaauuuugg

SEQ ID NO: 1095426 - RNA, 17 nt, Homo sapiens
uaucuuaacacugaaac

SEQ ID NO: 1095427 - RNA, 22 nt, Homo sapiens
uaugagcuggggaugucucuca

SEQ ID NO: 1095428 - RNA, 23 nt, Homo sapiens
uaugagcuggggaugucucucau

SEQ ID NO: 1095429 - RNA, 17 nt, Homo sapiens
uaugcauuuggaauuag

SEQ ID NO: 1095430 - RNA, 22 nt, Homo sapiens
uauggaaugauuuugguggaaa

SEQ ID NO: 1095431 - RNA, 14 nt, Homo sapiens
uauggcauuugcag

SEQ ID NO: 1095432 - RNA, 20 nt, Homo sapiens
uauggguuggacaaccucau

SEQ ID NO: 1095433 - RNA, 13 nt, Homo sapiens
uaugucacuggga

SEQ ID NO: 1095434 - RNA, 17 nt, Homo sapiens
uaugugggggucugugu

SEQ ID NO: 1095435 - RNA, 15 nt, Homo sapiens
uauuacagaaauucu

SEQ ID NO: 1095436 - RNA, 18 nt, Homo sapiens
uauuacagaaauucugaa

SEQ ID NO: 1095437 - RNA, 21 nt, Homo sapiens
uauuagagcugccugugccuu

SEQ ID NO: 1095438 - RNA, 12 nt, Homo sapiens
uauucccaugag

SEQ ID NO: 1095439 - RNA, 17 nt, Homo sapiens
uauucuggagucugcca

SEQ ID NO: 1095440 - RNA, 15 nt, Homo sapiens
uauucuuacuaaucu

SEQ ID NO: 1095441 - RNA, 20 nt, Homo sapiens
uauuuaacuaugaacugaag

SEQ ID NO: 1095442 - RNA, 15 nt, Homo sapiens
uauuucuaaaccaca

SEQ ID NO: 1095443 - RNA, 20 nt, Homo sapiens
uauuuugauucucauugcca

SEQ ID NO: 1095444 - RNA, 13 nt, Homo sapiens
ucaaaacuaguuc

SEQ ID NO: 1095445 - RNA, 14 nt, Homo sapiens
ucaaaccuguagau

SEQ ID NO: 1095446 - RNA, 14 nt, Homo sapiens
ucaaauaguauaga

SEQ ID NO: 1095447 - RNA, 13 nt, Homo sapiens
ucaaauauugaau

SEQ ID NO: 1095448 - RNA, 15 nt, Homo sapiens
ucaauguauaguuag

SEQ ID NO: 1095449 - RNA, 16 nt, Homo sapiens
ucacagcuaccaaagu

SEQ ID NO: 1095450 - RNA, 17 nt, Homo sapiens
ucacccccagcuggaaa

SEQ ID NO: 1095451 - RNA, 16 nt, Homo sapiens
ucacugcuguagacau

SEQ ID NO: 1095452 - RNA, 23 nt, Homo sapiens
ucacuugaggccaggacuuugag

SEQ ID NO: 1095453 - RNA, 21 nt, Homo sapiens
ucacuugucaauaaaauccau

SEQ ID NO: 1095454 - RNA, 14 nt, Homo sapiens
ucagaaauugaaag

SEQ ID NO: 1095455 - RNA, 17 nt, Homo sapiens
ucagaaccaagaugcca

SEQ ID NO: 1095456 - RNA, 12 nt, Homo sapiens
ucagauuugccu

SEQ ID NO: 1095457 - RNA, 17 nt, Homo sapiens
ucagcugauuugcagaa

SEQ ID NO: 1095458 - RNA, 18 nt, Homo sapiens
ucaggacccucccaggag

SEQ ID NO: 1095459 - RNA, 19 nt, Homo sapiens
ucaggacccucccaggaga

SEQ ID NO: 1095460 - RNA, 23 nt, Homo sapiens
ucaggacccucccaggagaguac

SEQ ID NO: 1095461 - RNA, 17 nt, Homo sapiens
ucauagaaugaaaguau

SEQ ID NO: 1095462 - RNA, 11 nt, Homo sapiens
ucauagcucau

SEQ ID NO: 1095463 - RNA, 18 nt, Homo sapiens
ucauagcucauugcaagc

SEQ ID NO: 1095464 - RNA, 16 nt, Homo sapiens
ucauauguuuauucaa

SEQ ID NO: 1095465 - RNA, 19 nt, Homo sapiens
ucaucauuguuguguauaa

SEQ ID NO: 1095466 - RNA, 13 nt, Homo sapiens
ucauggaauugga

SEQ ID NO: 1095467 - RNA, 19 nt, Homo sapiens
ucauguuuacagaggacag

SEQ ID NO: 1095468 - RNA, 13 nt, Homo sapiens
ucauucucucaca

SEQ ID NO: 1095469 - RNA, 23 nt, Homo sapiens
ucauuguuguguauaauuuaccu

SEQ ID NO: 1095470 - RNA, 18 nt, Homo sapiens
uccaacaaguaccuguga

SEQ ID NO: 1095471 - RNA, 17 nt, Homo sapiens
uccaacauuaaaagcca

SEQ ID NO: 1095472 - RNA, 15 nt, Homo sapiens
uccaagcuauguauu

SEQ ID NO: 1095473 - RNA, 14 nt, Homo sapiens
uccaaggcagugga

SEQ ID NO: 1095474 - RNA, 20 nt, Homo sapiens
uccaaugccacauacuugca

SEQ ID NO: 1095475 - RNA, 21 nt, Homo sapiens
uccaauucugaccuuacaaaa

SEQ ID NO: 1095476 - RNA, 20 nt, Homo sapiens
uccaucuauugauaguuuca

SEQ ID NO: 1095477 - RNA, 15 nt, Homo sapiens
ucccaccuguagucc

SEQ ID NO: 1095478 - RNA, 13 nt, Homo sapiens
ucccagcacuuug

SEQ ID NO: 1095479 - RNA, 21 nt, Homo sapiens
ucccccaugcucugaugcagu

SEQ ID NO: 1095480 - RNA, 20 nt, Homo sapiens
uccccuacaucaaaugcuca

SEQ ID NO: 1095481 - RNA, 13 nt, Homo sapiens
uccccucaaccca

SEQ ID NO: 1095482 - RNA, 13 nt, Homo sapiens
uccccucccucag

SEQ ID NO: 1095483 - RNA, 18 nt, Homo sapiens
uccgacauacaucauucu

SEQ ID NO: 1095484 - RNA, 14 nt, Homo sapiens
uccucaaagggaga

SEQ ID NO: 1095485 - RNA, 13 nt, Homo sapiens
uccucuugccaca

SEQ ID NO: 1095486 - RNA, 16 nt, Homo sapiens
uccuggcaauagucaa

SEQ ID NO: 1095487 - RNA, 22 nt, Homo sapiens
uccuuagccuuugucccagaau

SEQ ID NO: 1095488 - RNA, 18 nt, Homo sapiens
uccuucuggcuguagaua

SEQ ID NO: 1095489 - RNA, 19 nt, Homo sapiens
uccuugaagauuuaccacu

SEQ ID NO: 1095490 - RNA, 14 nt, Homo sapiens
ucgcaccugugcug

SEQ ID NO: 1095491 - RNA, 15 nt, Homo sapiens
ucgcccgaaacacca

SEQ ID NO: 1095492 - RNA, 16 nt, Homo sapiens
ucggagagaauggggu

SEQ ID NO: 1095493 - RNA, 20 nt, Homo sapiens
ucuaccucuuggcugccuug

SEQ ID NO: 1095494 - RNA, 23 nt, Homo sapiens
ucuaguuuuaucuuaacacugaa

SEQ ID NO: 1095495 - RNA, 20 nt, Homo sapiens
ucuaucuaaugacaugccua

SEQ ID NO: 1095496 - RNA, 13 nt, Homo sapiens
accucauggaauu

SEQ ID NO: 1095497 - RNA, 11 nt, Homo sapiens
accuguagucc

SEQ ID NO: 1095498 - RNA, 13 nt, Homo sapiens
accuguguagucu

SEQ ID NO: 1095499 - RNA, 16 nt, Homo sapiens
accuugaaagacauuu

SEQ ID NO: 1095500 - RNA, 19 nt, Homo sapiens
acuaaaguaguugaaacaa

SEQ ID NO: 1095501 - RNA, 18 nt, Homo sapiens
acuaaggggcaacaaaug

SEQ ID NO: 1095502 - RNA, 22 nt, Homo sapiens
acuauauuguuugcuaagcauu

SEQ ID NO: 1095503 - RNA, 22 nt, Homo sapiens
acuauccuaugccuucaaauag

SEQ ID NO: 1095504 - RNA, 20 nt, Homo sapiens
acuaugaacugaaggcagca

SEQ ID NO: 1095505 - RNA, 23 nt, Homo sapiens
acucaauguauaguuagcuuuau

SEQ ID NO: 1095506 - RNA, 23 nt, Homo sapiens
acucagcauggucuuaugcacag

SEQ ID NO: 1095507 - RNA, 18 nt, Homo sapiens
acucagucuuuaaucuga

SEQ ID NO: 1095508 - RNA, 18 nt, Homo sapiens
acuccccuacaucaaaug

SEQ ID NO: 1095509 - RNA, 16 nt, Homo sapiens
acucucaggcauggau

SEQ ID NO: 1095510 - RNA, 13 nt, Homo sapiens
acucuucuugcaa

SEQ ID NO: 1095511 - RNA, 14 nt, Homo sapiens
acugaacacaugac

SEQ ID NO: 1095512 - RNA, 17 nt, Homo sapiens
acugcaaaaacugggua

SEQ ID NO: 1095513 - RNA, 13 nt, Homo sapiens
acugcaucuuagu

SEQ ID NO: 1095514 - RNA, 13 nt, Homo sapiens
acugcuguagaca

SEQ ID NO: 1095515 - RNA, 20 nt, Homo sapiens
acugcuguagacauuugcua

SEQ ID NO: 1095516 - RNA, 14 nt, Homo sapiens
acuggaaacuucag

SEQ ID NO: 1095517 - RNA, 22 nt, Homo sapiens
acuguggguagacacacaugaa

SEQ ID NO: 1095518 - RNA, 17 nt, Homo sapiens
acuuauugccaugugga

SEQ ID NO: 1095519 - RNA, 15 nt, Homo sapiens
acuuggcaucauuca

SEQ ID NO: 1095520 - RNA, 14 nt, Homo sapiens
acuuugauacaaau

SEQ ID NO: 1095521 - RNA, 19 nt, Homo sapiens
agaaaagcaguggcuccau

SEQ ID NO: 1095522 - RNA, 23 nt, Homo sapiens
agaaacauuuuuuaaguaggcau

SEQ ID NO: 1095523 - RNA, 13 nt, Homo sapiens
agaaacugccauu

SEQ ID NO: 1095524 - RNA, 15 nt, Homo sapiens
agaaaggcacauauu

SEQ ID NO: 1095525 - RNA, 12 nt, Homo sapiens
agaaagugacaa

SEQ ID NO: 1095526 - RNA, 16 nt, Homo sapiens
agaaauuuaaucagug

SEQ ID NO: 1095527 - RNA, 14 nt, Homo sapiens
agaacagcuucaug

SEQ ID NO: 1095528 - RNA, 15 nt, Homo sapiens
agaaccaagaugcca

SEQ ID NO: 1095529 - RNA, 15 nt, Homo sapiens
agaaccuacaaaagc

SEQ ID NO: 1095530 - RNA, 16 nt, Homo sapiens
agaaccuacaaaagcu

SEQ ID NO: 1095531 - RNA, 23 nt, Homo sapiens
agaaccugcaaauaaaguacuaa

SEQ ID NO: 1095532 - RNA, 13 nt, Homo sapiens
agaagccagcuuu

SEQ ID NO: 1095533 - RNA, 15 nt, Homo sapiens
agaaguugcccaugu

SEQ ID NO: 1095534 - RNA, 15 nt, Homo sapiens
agaauuaaugcucua

SEQ ID NO: 1095535 - RNA, 19 nt, Homo sapiens
agaauugguggugagauau

SEQ ID NO: 1095536 - RNA, 18 nt, Homo sapiens
agacaaggucuugcuaug

SEQ ID NO: 1095537 - RNA, 22 nt, Homo sapiens
agacacacaugaaguccaagca

SEQ ID NO: 1095538 - RNA, 19 nt, Homo sapiens
agacauuugcuaugagcug

SEQ ID NO: 1095539 - RNA, 18 nt, Homo sapiens
agaccccuuuaaacuguc

SEQ ID NO: 1095540 - RNA, 15 nt, Homo sapiens
agacucuucuugcaa

SEQ ID NO: 1095541 - RNA, 22 nt, Homo sapiens
agagaccugggagcaggggcaa

SEQ ID NO: 1095542 - RNA, 18 nt, Homo sapiens
agagauggggaaggcuuu

SEQ ID NO: 1095543 - RNA, 15 nt, Homo sapiens
agagauucugguaca

SEQ ID NO: 1095544 - RNA, 17 nt, Homo sapiens
agagcccuuuugcuaua

SEQ ID NO: 1095545 - RNA, 14 nt, Homo sapiens
agaggacaguauuu

SEQ ID NO: 1095546 - RNA, 13 nt, Homo sapiens
agagucaaaguag

SEQ ID NO: 1095547 - RNA, 21 nt, Homo sapiens
agagugggguagguugggaga

SEQ ID NO: 1095548 - RNA, 15 nt, Homo sapiens
agaguuaaaaguuag

SEQ ID NO: 1095549 - RNA, 16 nt, Homo sapiens
agauacauucacauuc

SEQ ID NO: 1095550 - RNA, 15 nt, Homo sapiens
agauaccaugcaaua

SEQ ID NO: 1095551 - RNA, 17 nt, Homo sapiens
agauaggccaugggcac

SEQ ID NO: 1095552 - RNA, 17 nt, Homo sapiens
agauccucuugccacau

SEQ ID NO: 1095553 - RNA, 12 nt, Homo sapiens
agaugauguccu

SEQ ID NO: 1095554 - RNA, 10 nt, Homo sapiens
agaugcaguu

SEQ ID NO: 1095555 - RNA, 12 nt, Homo sapiens
agaugcccuaau

SEQ ID NO: 1095556 - RNA, 19 nt, Homo sapiens
agauguccaagugccacgu

SEQ ID NO: 1095557 - RNA, 23 nt, Homo sapiens
agcaaauggaugcggugacaaau

SEQ ID NO: 1095558 - RNA, 16 nt, Homo sapiens
agcaaccagucaaaac

SEQ ID NO: 1095559 - RNA, 22 nt, Homo sapiens
agcaacucagguuuuggcauua

SEQ ID NO: 1095560 - RNA, 19 nt, Homo sapiens
agcaagucacuggccagug

SEQ ID NO: 1095561 - RNA, 19 nt, Homo sapiens
agcaauuccccuacaucaa

SEQ ID NO: 1095562 - RNA, 17 nt, Homo sapiens
caacuccccuacaucaa

SEQ ID NO: 1095563 - RNA, 21 nt, Homo sapiens
caagaucauagcucauugcaa

SEQ ID NO: 1095564 - RNA, 17 nt, Homo sapiens
caagauccucuugccac

SEQ ID NO: 1095565 - RNA, 22 nt, Homo sapiens
caagauuuuuuaauuguuuaaa

SEQ ID NO: 1095566 - RNA, 19 nt, Homo sapiens
caagauuuuuucauuucaa

SEQ ID NO: 1095567 - RNA, 12 nt, Homo sapiens
caagcucaagug

SEQ ID NO: 1095568 - RNA, 17 nt, Homo sapiens
caaggaguaacaaaaca

SEQ ID NO: 1095569 - RNA, 16 nt, Homo sapiens
caaggccuggggagcc

SEQ ID NO: 1095570 - RNA, 15 nt, Homo sapiens
caagggaggggagca

SEQ ID NO: 1095571 - RNA, 18 nt, Homo sapiens
caagugaggccauagcaa

SEQ ID NO: 1095572 - RNA, 18 nt, Homo sapiens
caauaaaauuauuugcag

SEQ ID NO: 1095573 - RNA, 18 nt, Homo sapiens
caaucgagacugcaaugu

SEQ ID NO: 1095574 - RNA, 17 nt, Homo sapiens
caaugccgccugucaau

SEQ ID NO: 1095575 - RNA, 17 nt, Homo sapiens
caaugugaaaauguauc

SEQ ID NO: 1095576 - RNA, 13 nt, Homo sapiens
caauuucacccau

SEQ ID NO: 1095577 - RNA, 16 nt, Homo sapiens
caauuuugauagucug

SEQ ID NO: 1095578 - RNA, 23 nt, Homo sapiens
cacaacccuucagauuugccuua

SEQ ID NO: 1095579 - RNA, 18 nt, Homo sapiens
cacaauuauaagagacuu

SEQ ID NO: 1095580 - RNA, 21 nt, Homo sapiens
cacagccucuuagaugcaguu

SEQ ID NO: 1095581 - RNA, 23 nt, Homo sapiens
cacauaccuggcccugugccuug

SEQ ID NO: 1095582 - RNA, 16 nt, Homo sapiens
cacauacuugcagcuc

SEQ ID NO: 1095583 - RNA, 16 nt, Homo sapiens
cacauauugcggaguc

SEQ ID NO: 1095584 - RNA, 14 nt, Homo sapiens
cacaugacauagca

SEQ ID NO: 1095585 - RNA, 21 nt, Homo sapiens
caccaagugaggccauagcaa

SEQ ID NO: 1095586 - RNA, 14 nt, Homo sapiens
caccacauuaguga

SEQ ID NO: 1095587 - RNA, 17 nt, Homo sapiens
caccauucccaccagcu

SEQ ID NO: 1095588 - RNA, 18 nt, Homo sapiens
caccgagugaggccauag

SEQ ID NO: 1095589 - RNA, 21 nt, Homo sapiens
caccguacgacucuuuuccaa

SEQ ID NO: 1095590 - RNA, 20 nt, Homo sapiens
caccuguagucccagcacuu

SEQ ID NO: 1095591 - RNA, 13 nt, Homo sapiens
cacggagggcagu

SEQ ID NO: 1095592 - RNA, 22 nt, Homo sapiens
cacggugggcugaguacaguca

SEQ ID NO: 1095593 - RNA, 15 nt, Homo sapiens
cacuacauugugcaa

SEQ ID NO: 1095594 - RNA, 18 nt, Homo sapiens
cacuacauugugcaauug

SEQ ID NO: 1095595 - RNA, 20 nt, Homo sapiens
cacuacauugugcaauugau

SEQ ID NO: 1095596 - RNA, 10 nt, Homo sapiens
cacugaagaa

SEQ ID NO: 1095597 - RNA, 20 nt, Homo sapiens
cacugauuuaguugcaugau

SEQ ID NO: 1095598 - RNA, 18 nt, Homo sapiens
cacuguggguagacacac

SEQ ID NO: 1095599 - RNA, 17 nt, Homo sapiens
cacuuguguuuugcaag

SEQ ID NO: 1095600 - RNA, 14 nt, Homo sapiens
cagaaccugcaaau

SEQ ID NO: 1095601 - RNA, 13 nt, Homo sapiens
cagacccagugag

SEQ ID NO: 1095602 - RNA, 16 nt, Homo sapiens
cagagaccugggagca

SEQ ID NO: 1095603 - RNA, 13 nt, Homo sapiens
cagagaugggaaa

SEQ ID NO: 1095604 - RNA, 13 nt, Homo sapiens
cagaggacaguau

SEQ ID NO: 1095605 - RNA, 19 nt, Homo sapiens
cagaguaucugaagggaau

SEQ ID NO: 1095606 - RNA, 23 nt, Homo sapiens
cagagugacagcuguauauugcu

SEQ ID NO: 1095607 - RNA, 14 nt, Homo sapiens
cagaugaucugggc

SEQ ID NO: 1095608 - RNA, 21 nt, Homo sapiens
cagaugcagggguggggagcg

SEQ ID NO: 1095609 - RNA, 14 nt, Homo sapiens
cagauuacuagaaa

SEQ ID NO: 1095610 - RNA, 18 nt, Homo sapiens
cagauuacuagaaauauu

SEQ ID NO: 1095611 - RNA, 22 nt, Homo sapiens
cagcaaaccaaugcuauuguga

SEQ ID NO: 1095612 - RNA, 17 nt, Homo sapiens
cagcaguacucagcaug

SEQ ID NO: 1095613 - RNA, 19 nt, Homo sapiens
cagccagacgcauccugcc

SEQ ID NO: 1095614 - RNA, 13 nt, Homo sapiens
cagccauaugcag

SEQ ID NO: 1095615 - RNA, 13 nt, Homo sapiens
cagccauuuuuca

SEQ ID NO: 1095616 - RNA, 18 nt, Homo sapiens
cagcccgggucaucugua

SEQ ID NO: 1095617 - RNA, 14 nt, Homo sapiens
cagcuaagcaauag

SEQ ID NO: 1095618 - RNA, 19 nt, Homo sapiens
cagcuucagauaccaugca

SEQ ID NO: 1095619 - RNA, 18 nt, Homo sapiens
caggaaagagaacuucca

SEQ ID NO: 1095620 - RNA, 15 nt, Homo sapiens
caggaacuaaaggaa

SEQ ID NO: 1095621 - RNA, 17 nt, Homo sapiens
caggacagcaguacuca

SEQ ID NO: 1095622 - RNA, 15 nt, Homo sapiens
caggaccugccaaga

SEQ ID NO: 1095623 - RNA, 17 nt, Homo sapiens
caggacggcaguacuca

SEQ ID NO: 1095624 - RNA, 13 nt, Homo sapiens
caggagucccugc

SEQ ID NO: 1095625 - RNA, 20 nt, Homo sapiens
caggcucccaaacucaggcu

SEQ ID NO: 1095626 - RNA, 20 nt, Homo sapiens
cagggauucuuccugcuuag

SEQ ID NO: 1095627 - RNA, 22 nt, Homo sapiens
cagggcaacauaauaagacuuu

SEQ ID NO: 1095628 - RNA, 20 nt, Homo sapiens
cagguaaaauuuugucauau

SEQ ID NO: 1095629 - RNA, 20 nt, Homo sapiens
cagguucuaauguguggaau

SEQ ID NO: 1095630 - RNA, 14 nt, Homo sapiens
caguauuguagaaa

SEQ ID NO: 1095631 - RNA, 21 nt, Homo sapiens
cagugaccacgcauugucaca

SEQ ID NO: 1095632 - RNA, 20 nt, Homo sapiens
aguucuuaggaacagacucg

SEQ ID NO: 1095633 - RNA, 17 nt, Homo sapiens
aguuggcacuucugcca

SEQ ID NO: 1095634 - RNA, 14 nt, Homo sapiens
aguuucuucaugca

SEQ ID NO: 1095635 - RNA, 15 nt, Homo sapiens
aguuucuucaugcau

SEQ ID NO: 1095636 - RNA, 20 nt, Homo sapiens
aguuuuaucuuaacacugaa

SEQ ID NO: 1095637 - RNA, 14 nt, Homo sapiens
auaacaaugcugua

SEQ ID NO: 1095638 - RNA, 21 nt, Homo sapiens
auaacgcugacugcaaaaacu

SEQ ID NO: 1095639 - RNA, 14 nt, Homo sapiens
auaacuaaaauucu

SEQ ID NO: 1095640 - RNA, 15 nt, Homo sapiens
auaagauuuaauuca

SEQ ID NO: 1095641 - RNA, 18 nt, Homo sapiens
auaagauuuaauucacau

SEQ ID NO: 1095642 - RNA, 23 nt, Homo sapiens
auaagcagucauccucagaucau

SEQ ID NO: 1095643 - RNA, 13 nt, Homo sapiens
auaagucucuagc

SEQ ID NO: 1095644 - RNA, 23 nt, Homo sapiens
auaauguugguguggaguuuuca

SEQ ID NO: 1095645 - RNA, 19 nt, Homo sapiens
auacauaacuucagugcaa

SEQ ID NO: 1095646 - RNA, 14 nt, Homo sapiens
auaccuaaacugua

SEQ ID NO: 1095647 - RNA, 21 nt, Homo sapiens
auacugugaaguuacaugcau

SEQ ID NO: 1095648 - RNA, 15 nt, Homo sapiens
auagaggaacuugaa

SEQ ID NO: 1095649 - RNA, 21 nt, Homo sapiens
auagcaacuccccuacaucaa

SEQ ID NO: 1095650 - RNA, 22 nt, Homo sapiens
auagcaacuccccuacaucaaa

SEQ ID NO: 1095651 - RNA, 20 nt, Homo sapiens
auagcaccuccacauaccug

SEQ ID NO: 1095652 - RNA, 13 nt, Homo sapiens
auagcccaaaaca

SEQ ID NO: 1095653 - RNA, 21 nt, Homo sapiens
auagccuagauaugaauauau

SEQ ID NO: 1095654 - RNA, 18 nt, Homo sapiens
auagcgauuauaaucucc

SEQ ID NO: 1095655 - RNA, 22 nt, Homo sapiens
auaggaaaccacacagacuugg

SEQ ID NO: 1095656 - RNA, 15 nt, Homo sapiens
auaguggcaagauca

SEQ ID NO: 1095657 - RNA, 13 nt, Homo sapiens
auaguggcacuug

SEQ ID NO: 1095658 - RNA, 15 nt, Homo sapiens
auauaaccuucucaa

SEQ ID NO: 1095659 - RNA, 17 nt, Homo sapiens
auauauaguuagcuuua

SEQ ID NO: 1095660 - RNA, 14 nt, Homo sapiens
auauccagguucua

SEQ ID NO: 1095661 - RNA, 22 nt, Homo sapiens
auaucuacagcuucuauucauu

SEQ ID NO: 1095662 - RNA, 21 nt, Homo sapiens
auaugccuuuucccaacucca

SEQ ID NO: 1095663 - RNA, 17 nt, Homo sapiens
auauuaguugcuuuguu

SEQ ID NO: 1095664 - RNA, 21 nt, Homo sapiens
auauuggagggaaaucuuggu

SEQ ID NO: 1095665 - RNA, 21 nt, Homo sapiens
aucacuugaggccaggacuuu

SEQ ID NO: 1095666 - RNA, 15 nt, Homo sapiens
aucaguggaacucaa

SEQ ID NO: 1095667 - RNA, 12 nt, Homo sapiens
aucauucaucuu

SEQ ID NO: 1095668 - RNA, 19 nt, Homo sapiens
aucauucucucacaagaac

SEQ ID NO: 1095669 - RNA, 17 nt, Homo sapiens
auccagcaguacaauaa

SEQ ID NO: 1095670 - RNA, 14 nt, Homo sapiens
auccauacauuugu

SEQ ID NO: 1095671 - RNA, 12 nt, Homo sapiens
auccuauuugau

SEQ ID NO: 1095672 - RNA, 12 nt, Homo sapiens
auccucuugcca

SEQ ID NO: 1095673 - RNA, 19 nt, Homo sapiens
auccuucuggcuguagaua

SEQ ID NO: 1095674 - RNA, 17 nt, Homo sapiens
aucuaaacccagcaaaa

SEQ ID NO: 1095675 - RNA, 19 nt, Homo sapiens
aucucauuuccaagcaagu

SEQ ID NO: 1095676 - RNA, 14 nt, Homo sapiens
aucucuuuaccucc

SEQ ID NO: 1095677 - RNA, 13 nt, Homo sapiens
aucugaacauuua

SEQ ID NO: 1095678 - RNA, 15 nt, Homo sapiens
aucugaacauuuacu

SEQ ID NO: 1095679 - RNA, 13 nt, Homo sapiens
aucugaagggaau

SEQ ID NO: 1095680 - RNA, 20 nt, Homo sapiens
aucugagugaaaaaagucac

SEQ ID NO: 1095681 - RNA, 14 nt, Homo sapiens
aucuuaacacugaa

SEQ ID NO: 1095682 - RNA, 18 nt, Homo sapiens
aucuuagggaacuuugau

SEQ ID NO: 1095683 - RNA, 18 nt, Homo sapiens
aucuuaguuuacuggaua

SEQ ID NO: 1095684 - RNA, 15 nt, Homo sapiens
aucuuucacagggga

SEQ ID NO: 1095685 - RNA, 15 nt, Homo sapiens
augaaagugaugaca

SEQ ID NO: 1095686 - RNA, 16 nt, Homo sapiens
augaaagugaugacau

SEQ ID NO: 1095687 - RNA, 20 nt, Homo sapiens
augaauaaauguuauagcug

SEQ ID NO: 1095688 - RNA, 22 nt, Homo sapiens
augagcuggggaugucucucau

SEQ ID NO: 1095689 - RNA, 15 nt, Homo sapiens
augauacaguugcau

SEQ ID NO: 1095690 - RNA, 19 nt, Homo sapiens
augaucaaaaauaaugcau

SEQ ID NO: 1095691 - RNA, 22 nt, Homo sapiens
augaugagguuuucuuaacuua

SEQ ID NO: 1095692 - RNA, 19 nt, Homo sapiens
augcacaccuaagcccaaa

SEQ ID NO: 1095693 - RNA, 20 nt, Homo sapiens
augcauccagcaguacaaua

SEQ ID NO: 1095694 - RNA, 14 nt, Homo sapiens
augccaccauccaa

SEQ ID NO: 1095695 - RNA, 16 nt, Homo sapiens
augcccuaauccaucu

SEQ ID NO: 1095696 - RNA, 15 nt, Homo sapiens
augcuugcauuauau

SEQ ID NO: 1095697 - RNA, 18 nt, Homo sapiens
auggaugcggugacaaau

SEQ ID NO: 1095698 - RNA, 23 nt, Homo sapiens
auggcacuaguauuucuaugaaa

SEQ ID NO: 1095699 - RNA, 15 nt, Homo sapiens
auguaccagcaucuc

SEQ ID NO: 1095700 - RNA, 20 nt, Homo sapiens
uuccuaaaagagaauggaaa

SEQ ID NO: 1095701 - RNA, 17 nt, Homo sapiens
uuccuuuauacugugaa

SEQ ID NO: 1095702 - RNA, 19 nt, Homo sapiens
uucuaacugaaggugcagu

SEQ ID NO: 1095703 - RNA, 21 nt, Homo sapiens
uucuaauguguggaaugugca

SEQ ID NO: 1095704 - RNA, 20 nt, Homo sapiens
uucuaccucuuggcugccuu

SEQ ID NO: 1095705 - RNA, 20 nt, Homo sapiens
uucucaacuccaaacugacu

SEQ ID NO: 1095706 - RNA, 22 nt, Homo sapiens
uucuccagaaauuuaccacaaa

SEQ ID NO: 1095707 - RNA, 19 nt, Homo sapiens
uucugcuuuuuuucaggga

SEQ ID NO: 1095708 - RNA, 17 nt, Homo sapiens
uucuggggcuuugccau

SEQ ID NO: 1095709 - RNA, 15 nt, Homo sapiens
uucugguacagagaa

SEQ ID NO: 1095710 - RNA, 15 nt, Homo sapiens
uucuuaggaacagac

SEQ ID NO: 1095711 - RNA, 16 nt, Homo sapiens
uucuucauuaccucag

SEQ ID NO: 1095712 - RNA, 12 nt, Homo sapiens
uucuucuauggg

SEQ ID NO: 1095713 - RNA, 16 nt, Homo sapiens
uucuugcuaauucuca

SEQ ID NO: 1095714 - RNA, 17 nt, Homo sapiens
uucuuguaaacauugcc

SEQ ID NO: 1095715 - RNA, 17 nt, Homo sapiens
uugagcuuugcauuuau

SEQ ID NO: 1095716 - RNA, 14 nt, Homo sapiens
uugaggacacugau

SEQ ID NO: 1095717 - RNA, 17 nt, Homo sapiens
uugauauugccugcuuu

SEQ ID NO: 1095718 - RNA, 19 nt, Homo sapiens
uugaugaaaacaagucaga

SEQ ID NO: 1095719 - RNA, 20 nt, Homo sapiens
uugauguggaaaauuggcag

SEQ ID NO: 1095720 - RNA, 16 nt, Homo sapiens
uugauuaauguacuuu

SEQ ID NO: 1095721 - RNA, 21 nt, Homo sapiens
uugcaauuugucaguguauaa

SEQ ID NO: 1095722 - RNA, 13 nt, Homo sapiens
uugccauguggac

SEQ ID NO: 1095723 - RNA, 17 nt, Homo sapiens
uugcccacagcuguaug

SEQ ID NO: 1095724 - RNA, 20 nt, Homo sapiens
uugcuuggugcugguuuauu

SEQ ID NO: 1095725 - RNA, 15 nt, Homo sapiens
uuggagaaaagcacu

SEQ ID NO: 1095726 - RNA, 13 nt, Homo sapiens
uugguagcacuuu

SEQ ID NO: 1095727 - RNA, 14 nt, Homo sapiens
uuguauaacugaaa

SEQ ID NO: 1095728 - RNA, 23 nt, Homo sapiens
uugucuacuucuggagucuauaa

SEQ ID NO: 1095729 - RNA, 13 nt, Homo sapiens
uugugcagugugc

SEQ ID NO: 1095730 - RNA, 22 nt, Homo sapiens
uuuaaagcuauucuuaugcugu

SEQ ID NO: 1095731 - RNA, 16 nt, Homo sapiens
uuuaaauaucugaaca

SEQ ID NO: 1095732 - RNA, 23 nt, Homo sapiens
uuuaaauuggagaaaagcacuua

SEQ ID NO: 1095733 - RNA, 19 nt, Homo sapiens
uuuaaugcaaugcauaucu

SEQ ID NO: 1095734 - RNA, 18 nt, Homo sapiens
uuuaauguuaaauucaau

SEQ ID NO: 1095735 - RNA, 16 nt, Homo sapiens
uuuauaucuggaauga

SEQ ID NO: 1095736 - RNA, 20 nt, Homo sapiens
uuuaucgcucuaaaguaaaa

SEQ ID NO: 1095737 - RNA, 19 nt, Homo sapiens
uuucaaauauugaaugccu

SEQ ID NO: 1095738 - RNA, 14 nt, Homo sapiens
uuucauucuuguug

SEQ ID NO: 1095739 - RNA, 16 nt, Homo sapiens
uuucuuuguaucauuc

SEQ ID NO: 1095740 - RNA, 14 nt, Homo sapiens
uuugaaaaguaaaa

SEQ ID NO: 1095741 - RNA, 17 nt, Homo sapiens
uuugaacuagaguuuag

SEQ ID NO: 1095742 - RNA, 23 nt, Homo sapiens
uuugagaauuauaaaauuaacau

SEQ ID NO: 1095743 - RNA, 15 nt, Homo sapiens
uuugcaauuugucag

SEQ ID NO: 1095744 - RNA, 12 nt, Homo sapiens
uuugcagaugau

SEQ ID NO: 1095745 - RNA, 12 nt, Homo sapiens
uuugcucaugga

SEQ ID NO: 1095746 - RNA, 14 nt, Homo sapiens
uuuguaauauaucc

SEQ ID NO: 1095747 - RNA, 18 nt, Homo sapiens
uuuuaaaagaaugauuau

SEQ ID NO: 1095748 - RNA, 15 nt, Homo sapiens
uuuuaaaaugcauca

SEQ ID NO: 1095749 - RNA, 20 nt, Homo sapiens
uuuuaauuuuuugucaagac

SEQ ID NO: 1095750 - RNA, 16 nt, Homo sapiens
uuuuauuuacauucuu

SEQ ID NO: 1095751 - RNA, 17 nt, Homo sapiens
uuuuccuauuuacaugu

SEQ ID NO: 1095752 - RNA, 14 nt, Homo sapiens
uuuucucaugauga

SEQ ID NO: 1095753 - RNA, 19 nt, Homo sapiens
uuuugauucucauugccau

SEQ ID NO: 1095754 - RNA, 17 nt, Homo sapiens
uuuuuaaacagugucau

SEQ ID NO: 1095755 - RNA, 22 nt, Homo sapiens
caguugacaggucauccuugcc

SEQ ID NO: 1095756 - RNA, 14 nt, Homo sapiens
caguuucuucaugc

SEQ ID NO: 1095757 - RNA, 15 nt, Homo sapiens
cauaaaagagcccau

SEQ ID NO: 1095758 - RNA, 13 nt, Homo sapiens
cauaaaauuggau

SEQ ID NO: 1095759 - RNA, 23 nt, Homo sapiens
cauaaauuuaugguucucaggcc

SEQ ID NO: 1095760 - RNA, 17 nt, Homo sapiens
cauaccuggacccaaag

SEQ ID NO: 1095761 - RNA, 22 nt, Homo sapiens
cauagcaacuccccuacaucaa

SEQ ID NO: 1095762 - RNA, 10 nt, Homo sapiens
cauagcacuu

SEQ ID NO: 1095763 - RNA, 14 nt, Homo sapiens
cauagcacuugcag

SEQ ID NO: 1095764 - RNA, 14 nt, Homo sapiens
cauagcacuugccg

SEQ ID NO: 1095765 - RNA, 12 nt, Homo sapiens
cauagcccaaaa

SEQ ID NO: 1095766 - RNA, 17 nt, Homo sapiens
cauaguggcacuugccu

SEQ ID NO: 1095767 - RNA, 18 nt, Homo sapiens
cauauguggaacaagcag

SEQ ID NO: 1095768 - RNA, 12 nt, Homo sapiens
caucaauagugu

SEQ ID NO: 1095769 - RNA, 22 nt, Homo sapiens
caucaauaguguccuaugcaau

SEQ ID NO: 1095770 - RNA, 20 nt, Homo sapiens
caucacaaccuccaacaaca

SEQ ID NO: 1095771 - RNA, 19 nt, Homo sapiens
caucauuuuuaagcacugu

SEQ ID NO: 1095772 - RNA, 17 nt, Homo sapiens
cauccauagcaccucca

SEQ ID NO: 1095773 - RNA, 21 nt, Homo sapiens
cauccugccacccacacagca

SEQ ID NO: 1095774 - RNA, 18 nt, Homo sapiens
caucuggcggccaaguga

SEQ ID NO: 1095775 - RNA, 14 nt, Homo sapiens
caucuuaguuuacu

SEQ ID NO: 1095776 - RNA, 17 nt, Homo sapiens
caucuucauagcccaaa

SEQ ID NO: 1095777 - RNA, 16 nt, Homo sapiens
caucuugaaaaugcca

SEQ ID NO: 1095778 - RNA, 18 nt, Homo sapiens
caucuuugucaguuuaca

SEQ ID NO: 1095779 - RNA, 23 nt, Homo sapiens
caugcgaacauaaaugucuguau

SEQ ID NO: 1095780 - RNA, 22 nt, Homo sapiens
caugcuaaaauucuauagagau

SEQ ID NO: 1095781 - RNA, 22 nt, Homo sapiens
cauggaugaauaaauguuauag

SEQ ID NO: 1095782 - RNA, 20 nt, Homo sapiens
cauuaauaccuaaacuguau

SEQ ID NO: 1095783 - RNA, 20 nt, Homo sapiens
cauuaucagccugugccacg

SEQ ID NO: 1095784 - RNA, 15 nt, Homo sapiens
cauuccaacuaucuc

SEQ ID NO: 1095785 - RNA, 21 nt, Homo sapiens
cauucuuauggccacaagcaa

SEQ ID NO: 1095786 - RNA, 19 nt, Homo sapiens
cauucuugcuaauucucag

SEQ ID NO: 1095787 - RNA, 21 nt, Homo sapiens
cauugccugauuuguuccuuc

SEQ ID NO: 1095788 - RNA, 12 nt, Homo sapiens
cauugguguuga

SEQ ID NO: 1095789 - RNA, 21 nt, Homo sapiens
cauugugcaauugauauugcc

SEQ ID NO: 1095790 - RNA, 18 nt, Homo sapiens
cauuuaugauuuaucuag

SEQ ID NO: 1095791 - RNA, 20 nt, Homo sapiens
cauuugccaaaaauucaugc

SEQ ID NO: 1095792 - RNA, 23 nt, Homo sapiens
ccaaaacaagggauuaucacaua

SEQ ID NO: 1095793 - RNA, 18 nt, Homo sapiens
ccaaauauaaaaacagac

SEQ ID NO: 1095794 - RNA, 16 nt, Homo sapiens
ccaagacaaacuaaac

SEQ ID NO: 1095795 - RNA, 24 nt, Homo sapiens
ccaagcuauguauuuaaauuauca

SEQ ID NO: 1095796 - RNA, 15 nt, Homo sapiens
ccaaucagugaguca

SEQ ID NO: 1095797 - RNA, 16 nt, Homo sapiens
ccacacccucacugcu

SEQ ID NO: 1095798 - RNA, 15 nt, Homo sapiens
ccacaggaaccacaa

SEQ ID NO: 1095799 - RNA, 17 nt, Homo sapiens
ccacuuggcaucauuca

SEQ ID NO: 1095800 - RNA, 17 nt, Homo sapiens
ccagaaaagcaguggcu

SEQ ID NO: 1095801 - RNA, 18 nt, Homo sapiens
ccagaaagugacaagcuc

SEQ ID NO: 1095802 - RNA, 18 nt, Homo sapiens
ccagaggucuggcccuau

SEQ ID NO: 1095803 - RNA, 18 nt, Homo sapiens
ccagagugacagcuguau

SEQ ID NO: 1095804 - RNA, 20 nt, Homo sapiens
ccagccugggugacagagca

SEQ ID NO: 1095805 - RNA, 20 nt, Homo sapiens
ccagcugacgcgacuaucau

SEQ ID NO: 1095806 - RNA, 22 nt, Homo sapiens
ccagcugacgcgacuaucauuc

SEQ ID NO: 1095807 - RNA, 14 nt, Homo sapiens
ccagcuuuccucau

SEQ ID NO: 1095808 - RNA, 13 nt, Homo sapiens
ccaggacuuugag

SEQ ID NO: 1095809 - RNA, 23 nt, Homo sapiens
ccaggagaguacauggcauugag

SEQ ID NO: 1095810 - RNA, 15 nt, Homo sapiens
ccaggggccaugaau

SEQ ID NO: 1095811 - RNA, 22 nt, Homo sapiens
ccagguaugaccuuuuaaguga

SEQ ID NO: 1095812 - RNA, 17 nt, Homo sapiens
ccauaaacauuugccaa

SEQ ID NO: 1095813 - RNA, 14 nt, Homo sapiens
ccauagcaccucca

SEQ ID NO: 1095814 - RNA, 19 nt, Homo sapiens
ccauaugcaggacagcagu

SEQ ID NO: 1095815 - RNA, 20 nt, Homo sapiens
ccauaugcaggacagcagua

SEQ ID NO: 1095816 - RNA, 20 nt, Homo sapiens
ccaugugggccccagccauc

SEQ ID NO: 1095817 - RNA, 15 nt, Homo sapiens
ccauucccaccagcu

SEQ ID NO: 1095818 - RNA, 20 nt, Homo sapiens
ccauuuuaaaaugcaucauu

SEQ ID NO: 1095819 - RNA, 14 nt, Homo sapiens
cccacucaccugcc

SEQ ID NO: 1095820 - RNA, 18 nt, Homo sapiens
cccagaagaagauggcug

SEQ ID NO: 1095821 - RNA, 16 nt, Homo sapiens
cccagccugggauccu

SEQ ID NO: 1095822 - RNA, 21 nt, Homo sapiens
cccaggagaguacauggcauu

SEQ ID NO: 1095823 - RNA, 18 nt, Homo sapiens
cccaucuuugucaguuua

SEQ ID NO: 1095824 - RNA, 19 nt, Homo sapiens
cccaugcucugaugcagug

SEQ ID NO: 1095825 - RNA, 20 nt, Homo sapiens
cccauucuaugugucaucaa

SEQ ID NO: 1095826 - RNA, 14 nt, Homo sapiens
ccgaauaaauguuu

SEQ ID NO: 1095827 - RNA, 14 nt, Homo sapiens
ccgagugaggccau

SEQ ID NO: 1095828 - RNA, 15 nt, Homo sapiens
ccgcauagcacuugc

SEQ ID NO: 1095829 - RNA, 13 nt, Homo sapiens
ccguugcuacaag

SEQ ID NO: 1095830 - RNA, 23 nt, Homo sapiens
ccguugcuacaagucaccuggug

SEQ ID NO: 1095831 - RNA, 16 nt, Homo sapiens
ccuaaaaugcuucacu

SEQ ID NO: 1095832 - RNA, 16 nt, Homo sapiens
ccuaaacuguaucaua

SEQ ID NO: 1095833 - RNA, 14 nt, Homo sapiens
ccuaagcccaaaua

SEQ ID NO: 1095834 - RNA, 19 nt, Homo sapiens
ccuaaugaaagugaugaca

SEQ ID NO: 1095835 - RNA, 13 nt, Homo sapiens
ccuacaucaaaug

SEQ ID NO: 1095836 - RNA, 18 nt, Homo sapiens
ccuacaucaaaugcucaa

SEQ ID NO: 1095837 - RNA, 14 nt, Homo sapiens
ccucauccauagca

SEQ ID NO: 1095838 - RNA, 12 nt, Homo sapiens
ccucauggaauu

SEQ ID NO: 1095839 - RNA, 20 nt, Homo sapiens
ccucauggaauuggagcucg

SEQ ID NO: 1095840 - RNA, 23 nt, Homo sapiens
ccuccaggauaccagcaaaugga

SEQ ID NO: 1095841 - RNA, 18 nt, Homo sapiens
ccuccugucccucaucca

SEQ ID NO: 1095842 - RNA, 12 nt, Homo sapiens
ccucucauucca

SEQ ID NO: 1095843 - RNA, 21 nt, Homo sapiens
ccucuuagaugcaguucugaa

SEQ ID NO: 1095844 - RNA, 23 nt, Homo sapiens
ccugaacgcacaugacauagcac

SEQ ID NO: 1095845 - RNA, 20 nt, Homo sapiens
ccugccugagaauguuacca

SEQ ID NO: 1095846 - RNA, 20 nt, Homo sapiens
ccuguagucucagcuacuua

SEQ ID NO: 1095847 - RNA, 10 nt, Homo sapiens
ccuguuauau

SEQ ID NO: 1095848 - RNA, 18 nt, Homo sapiens
ccuuaaggaaaaguaaag

SEQ ID NO: 1095849 - RNA, 14 nt, Homo sapiens
ccuucagauuugcc

SEQ ID NO: 1095850 - RNA, 17 nt, Homo sapiens
ccuucuggggcuuugcc

SEQ ID NO: 1095851 - RNA, 13 nt, Homo sapiens
ccuugaaugccau

SEQ ID NO: 1095852 - RNA, 14 nt, Homo sapiens
ccuugaaugccaua

SEQ ID NO: 1095853 - RNA, 12 nt, Homo sapiens
ccuuuaaacugu

SEQ ID NO: 1095854 - RNA, 21 nt, Homo sapiens
ccuuuucuuguaaacauugcc

SEQ ID NO: 1095855 - RNA, 13 nt, Homo sapiens
ccuuuugccaucc

SEQ ID NO: 1095856 - RNA, 11 nt, Homo sapiens
cgcaaccucca

SEQ ID NO: 1095857 - RNA, 20 nt, Homo sapiens
cgcacaugacauagcacuug

SEQ ID NO: 1095858 - RNA, 16 nt, Homo sapiens
cgcccgcauagcacuu

SEQ ID NO: 1095859 - RNA, 18 nt, Homo sapiens
cggccuccugucccucau

SEQ ID NO: 1095860 - RNA, 18 nt, Homo sapiens
cggugggcugaguacagu

SEQ ID NO: 1095861 - RNA, 18 nt, Homo sapiens
cguaguuacucucaggca

SEQ ID NO: 1095862 - RNA, 16 nt, Homo sapiens
cuaaaagaauugugac

SEQ ID NO: 1095863 - RNA, 14 nt, Homo sapiens
cuaaaagauucuuu

SEQ ID NO: 1095864 - RNA, 19 nt, Homo sapiens
cuaaaaugcuucacuguac

SEQ ID NO: 1095865 - RNA, 21 nt, Homo sapiens
cuaaaauguagaaauucuaac

SEQ ID NO: 1095866 - RNA, 17 nt, Homo sapiens
cuaaacugaacacauga

SEQ ID NO: 1095867 - RNA, 16 nt, Homo sapiens
cuaaaguauguuuuca

SEQ ID NO: 1095868 - RNA, 17 nt, Homo sapiens
cuaacugaaggugcagu

SEQ ID NO: 1095869 - RNA, 23 nt, Homo sapiens
cuaacuuaauguaguuacuguga

SEQ ID NO: 1095870 - RNA, 21 nt, Homo sapiens
cuaagcccaaauauaaaaaca

SEQ ID NO: 1095871 - RNA, 19 nt, Homo sapiens
cuaaggggcaacaaaugca

SEQ ID NO: 1095872 - RNA, 17 nt, Homo sapiens
cuaauuuuuuuuguaca

SEQ ID NO: 1095873 - RNA, 16 nt, Homo sapiens
cuacaucaaaugcuca

SEQ ID NO: 1095874 - RNA, 18 nt, Homo sapiens
cuacaucaaaugcucaag

SEQ ID NO: 1095875 - RNA, 15 nt, Homo sapiens
cuacauugugcaauu

SEQ ID NO: 1095876 - RNA, 18 nt, Homo sapiens
cuaccaaagugugguuug

SEQ ID NO: 1095877 - RNA, 20 nt, Homo sapiens
cuacgaagaaagacuccuuu

SEQ ID NO: 1095878 - RNA, 15 nt, Homo sapiens
cuacugaacuguuac

SEQ ID NO: 1095879 - RNA, 20 nt, Homo sapiens
cuacuggucuguacuccuug

SEQ ID NO: 1095880 - RNA, 16 nt, Homo sapiens
cuagaauuggugguga

SEQ ID NO: 1095881 - RNA, 19 nt, Homo sapiens
cuagacaagguugcuguug

SEQ ID NO: 1095882 - RNA, 16 nt, Homo sapiens
agaauggggugagcag

SEQ ID NO: 1095883 - RNA, 20 nt, Homo sapiens
agaauucccaagagggcuuu

SEQ ID NO: 1095884 - RNA, 18 nt, Homo sapiens
agacauuugcuaugagcu

SEQ ID NO: 1095885 - RNA, 20 nt, Homo sapiens
agacccaacauuacuaacaa

SEQ ID NO: 1095886 - RNA, 14 nt, Homo sapiens
agaccugggagcag

SEQ ID NO: 1095887 - RNA, 15 nt, Homo sapiens
agagaacuuccagau

SEQ ID NO: 1095888 - RNA, 13 nt, Homo sapiens
agagggcuuuauu

SEQ ID NO: 1095889 - RNA, 22 nt, Homo sapiens
agagugacagcuguauauugcu

SEQ ID NO: 1095890 - RNA, 15 nt, Homo sapiens
agaguuuagcuggaa

SEQ ID NO: 1095891 - RNA, 16 nt, Homo sapiens
agaguuuagcuggaaa

SEQ ID NO: 1095892 - RNA, 13 nt, Homo sapiens
agauaaacugcuc

SEQ ID NO: 1095893 - RNA, 15 nt, Homo sapiens
agaugaucugggcuu

SEQ ID NO: 1095894 - RNA, 22 nt, Homo sapiens
agauguauguacuucaugcugu

SEQ ID NO: 1095895 - RNA, 19 nt, Homo sapiens
agauucuuuaaacuacuga

SEQ ID NO: 1095896 - RNA, 14 nt, Homo sapiens
agauuuaccacuug

SEQ ID NO: 1095897 - RNA, 14 nt, Homo sapiens
agauuuuccugaaa

SEQ ID NO: 1095898 - RNA, 14 nt, Homo sapiens
auguaaagcuguua

SEQ ID NO: 1095899 - RNA, 14 nt, Homo sapiens
auguaccagcaucu

SEQ ID NO: 1095900 - RNA, 15 nt, Homo sapiens
auguauguacuucau

SEQ ID NO: 1095901 - RNA, 17 nt, Homo sapiens
auguccagaagagucaa

SEQ ID NO: 1095902 - RNA, 22 nt, Homo sapiens
auguccugcccacuaaaagaau

SEQ ID NO: 1095903 - RNA, 20 nt, Homo sapiens
auguuaagauuuaucugcaa

SEQ ID NO: 1095904 - RNA, 12 nt, Homo sapiens
auguuagugcaa

SEQ ID NO: 1095905 - RNA, 14 nt, Homo sapiens
auguuugcacugau

SEQ ID NO: 1095906 - RNA, 22 nt, Homo sapiens
auguuuuaugguagcuuuuacu

SEQ ID NO: 1095907 - RNA, 17 nt, Homo sapiens
auuaaauuguuccauuu

SEQ ID NO: 1095908 - RNA, 19 nt, Homo sapiens
auuaauaccuaaacuguau

SEQ ID NO: 1095909 - RNA, 12 nt, Homo sapiens
auuaauuccaug

SEQ ID NO: 1095910 - RNA, 17 nt, Homo sapiens
auuaauuccaugugaua

SEQ ID NO: 1095911 - RNA, 13 nt, Homo sapiens
auuacauacuauu

SEQ ID NO: 1095912 - RNA, 13 nt, Homo sapiens
auuaucacaucau

SEQ ID NO: 1095913 - RNA, 18 nt, Homo sapiens
auuaugaauuacauuugu

SEQ ID NO: 1095914 - RNA, 13 nt, Homo sapiens
auuaugacacucc

SEQ ID NO: 1095915 - RNA, 16 nt, Homo sapiens
auuauuggauucacac

SEQ ID NO: 1095916 - RNA, 18 nt, Homo sapiens
auuauuggauucacaccc

SEQ ID NO: 1095917 - RNA, 18 nt, Homo sapiens
auucuuauggccacaagc

SEQ ID NO: 1095918 - RNA, 17 nt, Homo sapiens
auucuuuaaacuacuga

SEQ ID NO: 1095919 - RNA, 17 nt, Homo sapiens
auugagcuuugcauuua

SEQ ID NO: 1095920 - RNA, 14 nt, Homo sapiens
auugaggacacuga

SEQ ID NO: 1095921 - RNA, 14 nt, Homo sapiens
auugcaugguguga

SEQ ID NO: 1095922 - RNA, 19 nt, Homo sapiens
auugucacagcuaccaaag

SEQ ID NO: 1095923 - RNA, 17 nt, Homo sapiens
auuuaaaacacaguauu

SEQ ID NO: 1095924 - RNA, 19 nt, Homo sapiens
auuuaacuaugaacugaag

SEQ ID NO: 1095925 - RNA, 21 nt, Homo sapiens
auuuaugguucucaggccuga

SEQ ID NO: 1095926 - RNA, 13 nt, Homo sapiens
auuugcucaugga

SEQ ID NO: 1095927 - RNA, 16 nt, Homo sapiens
auuugcucauggaauu

SEQ ID NO: 1095928 - RNA, 16 nt, Homo sapiens
auuuguaucaguauca

SEQ ID NO: 1095929 - RNA, 15 nt, Homo sapiens
auuuuaugcacaccu

SEQ ID NO: 1095930 - RNA, 23 nt, Homo sapiens
auuuuaugcacaccuaagcccaa

SEQ ID NO: 1095931 - RNA, 14 nt, Homo sapiens
auuuugauucucau

SEQ ID NO: 1095932 - RNA, 16 nt, Homo sapiens
auuuugguaaaucaca

SEQ ID NO: 1095933 - RNA, 11 nt, Homo sapiens
auuuuuguaca

SEQ ID NO: 1095934 - RNA, 14 nt, Homo sapiens
caaaacuaguucuu

SEQ ID NO: 1095935 - RNA, 22 nt, Homo sapiens
caaaccaaugcuauugugauua

SEQ ID NO: 1095936 - RNA, 22 nt, Homo sapiens
caaacgcuucagagacacacaa

SEQ ID NO: 1095937 - RNA, 16 nt, Homo sapiens
caaacuccugccugag

SEQ ID NO: 1095938 - RNA, 19 nt, Homo sapiens
caaacuguaaaaaaugugu

SEQ ID NO: 1095939 - RNA, 16 nt, Homo sapiens
caaagcaacgacuacu

SEQ ID NO: 1095940 - RNA, 20 nt, Homo sapiens
caaauaaucgagacugaaag

SEQ ID NO: 1095941 - RNA, 18 nt, Homo sapiens
caaccucauuuuaacuca

SEQ ID NO: 1095942 - RNA, 12 nt, Homo sapiens
caacuaucauac

SEQ ID NO: 1095943 - RNA, 20 nt, Homo sapiens
caacucagguuuuggcauua

SEQ ID NO: 1095944 - RNA, 21 nt, Homo sapiens
caagaacagaaccugcaaaua

SEQ ID NO: 1095945 - RNA, 15 nt, Homo sapiens
caagagggcuuuauu

SEQ ID NO: 1095946 - RNA, 15 nt, Homo sapiens
caagaucauagcuca

SEQ ID NO: 1095947 - RNA, 21 nt, Homo sapiens
caagauuuuuuaauuguuuaa

SEQ ID NO: 1095948 - RNA, 14 nt, Homo sapiens
caaggaagucuuca

SEQ ID NO: 1095949 - RNA, 19 nt, Homo sapiens
caaggaguaacaaaacagc

SEQ ID NO: 1095950 - RNA, 13 nt, Homo sapiens
caauaauaauuaa

SEQ ID NO: 1095951 - RNA, 16 nt, Homo sapiens
caauacccugucuuua

SEQ ID NO: 1095952 - RNA, 14 nt, Homo sapiens
caauagcaugcaaa

SEQ ID NO: 1095953 - RNA, 15 nt, Homo sapiens
caauaucuacagcuu

SEQ ID NO: 1095954 - RNA, 17 nt, Homo sapiens
caaugaauuaguugcau

SEQ ID NO: 1095955 - RNA, 17 nt, Homo sapiens
caauuccccuacaucaa

SEQ ID NO: 1095956 - RNA, 16 nt, Homo sapiens
cacaagacugcacauc

SEQ ID NO: 1095957 - RNA, 12 nt, Homo sapiens
cacacugaagaa

SEQ ID NO: 1095958 - RNA, 21 nt, Homo sapiens
cacagcaagucacuggccagu

SEQ ID NO: 1095959 - RNA, 20 nt, Homo sapiens
cacaguauuaugacacuccc

SEQ ID NO: 1095960 - RNA, 19 nt, Homo sapiens
cacauauuggagggaaauc

SEQ ID NO: 1095961 - RNA, 18 nt, Homo sapiens
cacaugacauagcacuug

SEQ ID NO: 1095962 - RNA, 20 nt, Homo sapiens
cacaugacauagcacuugcc

SEQ ID NO: 1095963 - RNA, 14 nt, Homo sapiens
caccaugaggauaa

SEQ ID NO: 1095964 - RNA, 17 nt, Homo sapiens
caccgagugaggccaua

SEQ ID NO: 1095965 - RNA, 21 nt, Homo sapiens
caccgagugaggccauagcaa

SEQ ID NO: 1095966 - RNA, 14 nt, Homo sapiens
caccugcccaagaa

SEQ ID NO: 1095967 - RNA, 17 nt, Homo sapiens
cacgcauugucacagcu

SEQ ID NO: 1095968 - RNA, 15 nt, Homo sapiens
cacggagaggaaaag

SEQ ID NO: 1095969 - RNA, 20 nt, Homo sapiens
cacggugggcugaguacagu

SEQ ID NO: 1095970 - RNA, 22 nt, Homo sapiens
cacuaaaagaauugugacauaa

SEQ ID NO: 1095971 - RNA, 12 nt, Homo sapiens
cacucccagcgu

SEQ ID NO: 1095972 - RNA, 20 nt, Homo sapiens
cacugaaacuuucuguauaa

SEQ ID NO: 1095973 - RNA, 11 nt, Homo sapiens
cacugcuguag

SEQ ID NO: 1095974 - RNA, 11 nt, Homo sapiens
cacuugucaau

SEQ ID NO: 1095975 - RNA, 17 nt, Homo sapiens
cagaacaagaagcuuau

SEQ ID NO: 1095976 - RNA, 18 nt, Homo sapiens
cagaacuggaaaugucca

SEQ ID NO: 1095977 - RNA, 14 nt, Homo sapiens
cagaucgagucaca

SEQ ID NO: 1095978 - RNA, 22 nt, Homo sapiens
cagauuuagguuacuuuagugu

SEQ ID NO: 1095979 - RNA, 22 nt, Homo sapiens
cagcaggacgacuguuuuccca

SEQ ID NO: 1095980 - RNA, 17 nt, Homo sapiens
cagcauggucuuaugca

SEQ ID NO: 1095981 - RNA, 12 nt, Homo sapiens
cagccauaugca

SEQ ID NO: 1095982 - RNA, 14 nt, Homo sapiens
cagccucccaagua

SEQ ID NO: 1095983 - RNA, 19 nt, Homo sapiens
cagccugggugacagagca

SEQ ID NO: 1095984 - RNA, 17 nt, Homo sapiens
cagcugugcuuuuugca

SEQ ID NO: 1095985 - RNA, 15 nt, Homo sapiens
cagcuuagcuacaaa

SEQ ID NO: 1095986 - RNA, 18 nt, Homo sapiens
cagcuucagauaccaugc

SEQ ID NO: 1095987 - RNA, 16 nt, Homo sapiens
cagcuucauguuccca

SEQ ID NO: 1095988 - RNA, 20 nt, Homo sapiens
caggauggcuggaacacugu

SEQ ID NO: 1095989 - RNA, 18 nt, Homo sapiens
caggcuggucuugaacuc

SEQ ID NO: 1095990 - RNA, 15 nt, Homo sapiens
caggucuuuaaauca

SEQ ID NO: 1095991 - RNA, 20 nt, Homo sapiens
caggucuuuaaaucauuuua

SEQ ID NO: 1095992 - RNA, 17 nt, Homo sapiens
cagugagaagccagcuu

SEQ ID NO: 1095993 - RNA, 20 nt, Homo sapiens
cagugagcugugauuaugcc

SEQ ID NO: 1095994 - RNA, 13 nt, Homo sapiens
caguucugaagaa

SEQ ID NO: 1095995 - RNA, 15 nt, Homo sapiens
caguugaauucagug

SEQ ID NO: 1095996 - RNA, 16 nt, Homo sapiens
cauaaauguugacaug

SEQ ID NO: 1095997 - RNA, 17 nt, Homo sapiens
cauagaaaaugugagua

SEQ ID NO: 1095998 - RNA, 21 nt, Homo sapiens
cauagcaauuccccuacauca

SEQ ID NO: 1095999 - RNA, 13 nt, Homo sapiens
cauagcacuugca

SEQ ID NO: 1096000 - RNA, 22 nt, Homo sapiens
cauagcacuugcagaccugccu

SEQ ID NO: 1096001 - RNA, 22 nt, Homo sapiens
cauauucacugguuuauuugca

SEQ ID NO: 1096002 - RNA, 23 nt, Homo sapiens
cauauucacugguuuauuugcag

SEQ ID NO: 1096003 - RNA, 17 nt, Homo sapiens
caucagagaugggaaaa

SEQ ID NO: 1096004 - RNA, 23 nt, Homo sapiens
caucauuaauaccuaaacuguau

SEQ ID NO: 1096005 - RNA, 19 nt, Homo sapiens
cauccaacauuaaaagcca

SEQ ID NO: 1096006 - RNA, 16 nt, Homo sapiens
cauccagcaguacaau

SEQ ID NO: 1096007 - RNA, 22 nt, Homo sapiens
caucgcuucuuuuucaaaacua

SEQ ID NO: 1096008 - RNA, 20 nt, Homo sapiens
caucgguguggacuacagga

SEQ ID NO: 1096009 - RNA, 14 nt, Homo sapiens
caucuguaccucug

SEQ ID NO: 1096010 - RNA, 19 nt, Homo sapiens
caucuuugucaguuuacac

SEQ ID NO: 1096011 - RNA, 23 nt, Homo sapiens
caugaccaaaugcuuuuccucaa

SEQ ID NO: 1096012 - RNA, 19 nt, Homo sapiens
caugacuuuguccauuaaa

SEQ ID NO: 1096013 - RNA, 17 nt, Homo sapiens
caugaguuggcugggaa

SEQ ID NO: 1096014 - RNA, 22 nt, Homo sapiens
caugcuugcauuauauuuguaa

SEQ ID NO: 1096015 - RNA, 12 nt, Homo sapiens
cauggacaugca

SEQ ID NO: 1096016 - RNA, 19 nt, Homo sapiens
caugugggccccagccauc

SEQ ID NO: 1096017 - RNA, 19 nt, Homo sapiens
cauguuauauuauuacuaa

SEQ ID NO: 1096018 - RNA, 14 nt, Homo sapiens
cauguucccaaaau

SEQ ID NO: 1096019 - RNA, 14 nt, Homo sapiens
cauuaacucaggca

SEQ ID NO: 1096020 - RNA, 18 nt, Homo sapiens
cauuaauaccuaaacugu

SEQ ID NO: 1096021 - RNA, 22 nt, Homo sapiens
cauugucacagcuaccaaagug

SEQ ID NO: 1096022 - RNA, 14 nt, Homo sapiens
cauuuaauguauau

SEQ ID NO: 1096023 - RNA, 20 nt, Homo sapiens
cauuuagcgaacaaccacag

SEQ ID NO: 1096024 - RNA, 16 nt, Homo sapiens
cauuucaaaaugcuuc

SEQ ID NO: 1096025 - RNA, 21 nt, Homo sapiens
cauuugccaaaaauucaugcc

SEQ ID NO: 1096026 - RNA, 16 nt, Homo sapiens
ucuaaauagcgauuau

SEQ ID NO: 1096027 - RNA, 21 nt, Homo sapiens
ucuaacugaaggugcaguuga

SEQ ID NO: 1096028 - RNA, 19 nt, Homo sapiens
ucuagauguccaagugcca

SEQ ID NO: 1096029 - RNA, 21 nt, Homo sapiens
ucuaguaguuaaaacagcuau

SEQ ID NO: 1096030 - RNA, 15 nt, Homo sapiens
ucuaucuaaugacau

SEQ ID NO: 1096031 - RNA, 16 nt, Homo sapiens
ucuauugauaguuuca

SEQ ID NO: 1096032 - RNA, 13 nt, Homo sapiens
acaaaugacuggu

SEQ ID NO: 1096033 - RNA, 13 nt, Homo sapiens
acaaaugcaucau

SEQ ID NO: 1096034 - RNA, 18 nt, Homo sapiens
acaacccgucagagaccu

SEQ ID NO: 1096035 - RNA, 14 nt, Homo sapiens
acaaugaguguuau

SEQ ID NO: 1096036 - RNA, 13 nt, Homo sapiens
acaaugauacagu

SEQ ID NO: 1096037 - RNA, 14 nt, Homo sapiens
acaauugucaugua

SEQ ID NO: 1096038 - RNA, 18 nt, Homo sapiens
acacaacccgucagagac

SEQ ID NO: 1096039 - RNA, 22 nt, Homo sapiens
acacaauuauaagagacuuauc

SEQ ID NO: 1096040 - RNA, 19 nt, Homo sapiens
acacaugaaguccaagcau

SEQ ID NO: 1096041 - RNA, 17 nt, Homo sapiens
acaccaagugaggccau

SEQ ID NO: 1096042 - RNA, 21 nt, Homo sapiens
acaccaagugaggccauagca

SEQ ID NO: 1096043 - RNA, 17 nt, Homo sapiens
acacggugggcugagua

SEQ ID NO: 1096044 - RNA, 22 nt, Homo sapiens
acacugaagaagcaccaaucau

SEQ ID NO: 1096045 - RNA, 15 nt, Homo sapiens
acagacacucccacu

SEQ ID NO: 1096046 - RNA, 19 nt, Homo sapiens
acagccucuuugcccaaau

SEQ ID NO: 1096047 - RNA, 14 nt, Homo sapiens
acagcuguauauug

SEQ ID NO: 1096048 - RNA, 21 nt, Homo sapiens
acagguuuuaaggauucugca

SEQ ID NO: 1096049 - RNA, 13 nt, Homo sapiens
acaguauggcaau

SEQ ID NO: 1096050 - RNA, 23 nt, Homo sapiens
acaguauugagcuuugcauuuau

SEQ ID NO: 1096051 - RNA, 20 nt, Homo sapiens
acaguuagcauggcuucaca

SEQ ID NO: 1096052 - RNA, 12 nt, Homo sapiens
acaguuucuuca

SEQ ID NO: 1096053 - RNA, 15 nt, Homo sapiens
acauaauaagacuuu

SEQ ID NO: 1096054 - RNA, 23 nt, Homo sapiens
acauaccuggcccugugccuugg

SEQ ID NO: 1096055 - RNA, 18 nt, Homo sapiens
acaucuggcggccaagug

SEQ ID NO: 1096056 - RNA, 22 nt, Homo sapiens
acaucuggcggccaagugagga

SEQ ID NO: 1096057 - RNA, 17 nt, Homo sapiens
acaucuugaaaaugcca

SEQ ID NO: 1096058 - RNA, 16 nt, Homo sapiens
acauggcauugagaca

SEQ ID NO: 1096059 - RNA, 15 nt, Homo sapiens
acaugggacauuugc

SEQ ID NO: 1096060 - RNA, 14 nt, Homo sapiens
acauugaaguauua

SEQ ID NO: 1096061 - RNA, 20 nt, Homo sapiens
acauugugacaaacagcuag

SEQ ID NO: 1096062 - RNA, 13 nt, Homo sapiens
acauuucaucuaa

SEQ ID NO: 1096063 - RNA, 19 nt, Homo sapiens
accaaaugcuuuuccucaa

SEQ ID NO: 1096064 - RNA, 15 nt, Homo sapiens
accaagugaggccau

SEQ ID NO: 1096065 - RNA, 16 nt, Homo sapiens
accaccuguguagucu

SEQ ID NO: 1096066 - RNA, 19 nt, Homo sapiens
accagguaugaccuuuuaa

SEQ ID NO: 1096067 - RNA, 15 nt, Homo sapiens
accauaaacauuugc

SEQ ID NO: 1096068 - RNA, 13 nt, Homo sapiens
accauccaauaaa

SEQ ID NO: 1096069 - RNA, 13 nt, Homo sapiens
acccauaugggaa

SEQ ID NO: 1096070 - RNA, 13 nt, Homo sapiens
acccugaguucau

SEQ ID NO: 1096071 - RNA, 16 nt, Homo sapiens
accgagugaggccaua

SEQ ID NO: 1096072 - RNA, 20 nt, Homo sapiens
accgagugaggccauagcaa

SEQ ID NO: 1096073 - RNA, 14 nt, Homo sapiens
accuaauacagcag

SEQ ID NO: 1096074 - RNA, 19 nt, Homo sapiens
accuagguuaacaacccug

SEQ ID NO: 1096075 - RNA, 20 nt, Homo sapiens
accuagguuaacaacccugu

SEQ ID NO: 1096076 - RNA, 14 nt, Homo sapiens
accuauugcugaua

SEQ ID NO: 1096077 - RNA, 15 nt, Homo sapiens
accuccacauaccug

SEQ ID NO: 1096078 - RNA, 18 nt, Homo sapiens
accuggcccugugccuug

SEQ ID NO: 1096079 - RNA, 20 nt, Homo sapiens
accuguagucccagcacuuu

SEQ ID NO: 1096080 - RNA, 14 nt, Homo sapiens
accuucuaccucuu

SEQ ID NO: 1096081 - RNA, 19 nt, Homo sapiens
accuuuaaugcaaugcaua

SEQ ID NO: 1096082 - RNA, 15 nt, Homo sapiens
accuuuccugaggaa

SEQ ID NO: 1096083 - RNA, 16 nt, Homo sapiens
acgaagaaagacuccu

SEQ ID NO: 1096084 - RNA, 20 nt, Homo sapiens
acggagggcagucccgggug

SEQ ID NO: 1096085 - RNA, 12 nt, Homo sapiens
acuaaaagaauu

SEQ ID NO: 1096086 - RNA, 15 nt, Homo sapiens
acuaaaguaguugaa

SEQ ID NO: 1096087 - RNA, 23 nt, Homo sapiens
acuaaggggcaacaaaugcauca

SEQ ID NO: 1096088 - RNA, 17 nt, Homo sapiens
acuacauugugcaauug

SEQ ID NO: 1096089 - RNA, 19 nt, Homo sapiens
acuacucucuacucuguua

SEQ ID NO: 1096090 - RNA, 16 nt, Homo sapiens
acuacugaacuguuac

SEQ ID NO: 1096091 - RNA, 16 nt, Homo sapiens
acuaucauucucucac

SEQ ID NO: 1096092 - RNA, 21 nt, Homo sapiens
acuaucauucucucacaagaa

SEQ ID NO: 1096093 - RNA, 15 nt, Homo sapiens
acuauuaauuccaug

SEQ ID NO: 1096094 - RNA, 14 nt, Homo sapiens
acucaggcauuuca

SEQ ID NO: 1096095 - RNA, 17 nt, Homo sapiens
acucaggggucauucau

SEQ ID NO: 1096096 - RNA, 16 nt, Homo sapiens
acucgcaccugugcug

SEQ ID NO: 1096097 - RNA, 17 nt, Homo sapiens
acucucaggcauggaug

SEQ ID NO: 1096098 - RNA, 18 nt, Homo sapiens
acucucuaguuuuaucuu

SEQ ID NO: 1096099 - RNA, 20 nt, Homo sapiens
acucuuaagaagacugcauu

SEQ ID NO: 1096100 - RNA, 16 nt, Homo sapiens
acucuuccaucagaga

SEQ ID NO: 1096101 - RNA, 22 nt, Homo sapiens
acucuuuuccaaacacaggcaa

SEQ ID NO: 1096102 - RNA, 16 nt, Homo sapiens
acugcugggcuuggca

SEQ ID NO: 1096103 - RNA, 17 nt, Homo sapiens
acugcugggcuuggcag

SEQ ID NO: 1096104 - RNA, 22 nt, Homo sapiens
acugggacaggggagaaccuag

SEQ ID NO: 1096105 - RNA, 18 nt, Homo sapiens
acugggcuggguuugcug

SEQ ID NO: 1096106 - RNA, 19 nt, Homo sapiens
acugguuuggggacgggug

SEQ ID NO: 1096107 - RNA, 15 nt, Homo sapiens
acuguagcuuuacaa

SEQ ID NO: 1096108 - RNA, 17 nt, Homo sapiens
acuuaaaagaacaugua

SEQ ID NO: 1096109 - RNA, 14 nt, Homo sapiens
acuuaucaacauuu

SEQ ID NO: 1096110 - RNA, 20 nt, Homo sapiens
acuucaagauccucuugcca

SEQ ID NO: 1096111 - RNA, 23 nt, Homo sapiens
acuuuaucgcucuaaaguaaaac

SEQ ID NO: 1096112 - RNA, 18 nt, Homo sapiens
acuuucuuucuguaggug

SEQ ID NO: 1096113 - RNA, 16 nt, Homo sapiens
agaaaagcaguggcuc

SEQ ID NO: 1096114 - RNA, 12 nt, Homo sapiens
agaaacauuugg

SEQ ID NO: 1096115 - RNA, 22 nt, Homo sapiens
agaaacauuuuuuaaguaggca

SEQ ID NO: 1096116 - RNA, 16 nt, Homo sapiens
agaaagguauauauac

SEQ ID NO: 1096117 - RNA, 21 nt, Homo sapiens
agaaagucuaucuaaugacau

SEQ ID NO: 1096118 - RNA, 22 nt, Homo sapiens
agaacagcuucauguucccaaa

SEQ ID NO: 1096119 - RNA, 22 nt, Homo sapiens
agaacauucuuauauuuuauca

SEQ ID NO: 1096120 - RNA, 13 nt, Homo sapiens
agaaggcuuuauu

SEQ ID NO: 1096121 - RNA, 19 nt, Homo sapiens
agaaguuuggcaguauuua

SEQ ID NO: 1096122 - RNA, 16 nt, Homo sapiens
agaaugcaauacugua

SEQ ID NO: 1096123 - RNA, 19 nt, Homo sapiens
agaauggaaguagcuguau

SEQ ID NO: 1096124 - RNA, 18 nt, Homo sapiens
agaccagccagggcaaca

SEQ ID NO: 1096125 - RNA, 22 nt, Homo sapiens
agacuucaagauccucuugcca

SEQ ID NO: 1096126 - RNA, 17 nt, Homo sapiens
agacuuugucacuuauu

SEQ ID NO: 1096127 - RNA, 17 nt, Homo sapiens
agagaagagggggcuaa

SEQ ID NO: 1096128 - RNA, 17 nt, Homo sapiens
agagacuuaucuuuuag

SEQ ID NO: 1096129 - RNA, 19 nt, Homo sapiens
uaacgugauaaaccugcuc

SEQ ID NO: 1096130 - RNA, 12 nt, Homo sapiens
uaagaagacugc

SEQ ID NO: 1096131 - RNA, 17 nt, Homo sapiens
uaagcauuccaacuauc

SEQ ID NO: 1096132 - RNA, 20 nt, Homo sapiens
uaauaaaaagcuucagggaa

SEQ ID NO: 1096133 - RNA, 14 nt, Homo sapiens
uaauaccuuucuaa

SEQ ID NO: 1096134 - RNA, 20 nt, Homo sapiens
uaauauuccuggcauaccuu

SEQ ID NO: 1096135 - RNA, 17 nt, Homo sapiens
uaauauuguauugcugc

SEQ ID NO: 1096136 - RNA, 18 nt, Homo sapiens
uaauauuguauugcugcu

SEQ ID NO: 1096137 - RNA, 17 nt, Homo sapiens
uaaucggaguaucugaa

SEQ ID NO: 1096138 - RNA, 17 nt, Homo sapiens
uaaucuuucacagggga

SEQ ID NO: 1096139 - RNA, 19 nt, Homo sapiens
uaauuaaagaaugcaauac

SEQ ID NO: 1096140 - RNA, 20 nt, Homo sapiens
uaauuguuuaaaaaccgaau

SEQ ID NO: 1096141 - RNA, 19 nt, Homo sapiens
uaauuugcaauuugucagu

SEQ ID NO: 1096142 - RNA, 18 nt, Homo sapiens
uaauuuuuuaaacuguag

SEQ ID NO: 1096143 - RNA, 12 nt, Homo sapiens
uacaacuaucau

SEQ ID NO: 1096144 - RNA, 18 nt, Homo sapiens
uacaaucgagacugcaau

SEQ ID NO: 1096145 - RNA, 20 nt, Homo sapiens
uacaaucgagacugcaaugu

SEQ ID NO: 1096146 - RNA, 22 nt, Homo sapiens
uacacugccuucucaacuccaa

SEQ ID NO: 1096147 - RNA, 14 nt, Homo sapiens
uacaguauggcaau

SEQ ID NO: 1096148 - RNA, 15 nt, Homo sapiens
ucucuuuaccuccua

SEQ ID NO: 1096149 - RNA, 19 nt, Homo sapiens
ucuguguguguguaugugg

SEQ ID NO: 1096150 - RNA, 15 nt, Homo sapiens
ucuuaaaaugcaaua

SEQ ID NO: 1096151 - RNA, 22 nt, Homo sapiens
ucuuagaacuggugauguaaag

SEQ ID NO: 1096152 - RNA, 16 nt, Homo sapiens
ucuuaguuuacuggau

SEQ ID NO: 1096153 - RNA, 14 nt, Homo sapiens
ucuucauuaccuca

SEQ ID NO: 1096154 - RNA, 20 nt, Homo sapiens
ucuucauuaccucagugaga

SEQ ID NO: 1096155 - RNA, 16 nt, Homo sapiens
ucuuguaaacauugcc

SEQ ID NO: 1096156 - RNA, 18 nt, Homo sapiens
ucuuuuucaaaacuaguu

SEQ ID NO: 1096157 - RNA, 16 nt, Homo sapiens
ugaaaacccuugccau

SEQ ID NO: 1096158 - RNA, 11 nt, Homo sapiens
ugaaaaugcca

SEQ ID NO: 1096159 - RNA, 23 nt, Homo sapiens
ugaaaauuaccuuuaaugcaaug

SEQ ID NO: 1096160 - RNA, 14 nt, Homo sapiens
ugaacgcacaugac

SEQ ID NO: 1096161 - RNA, 15 nt, Homo sapiens
ugaacgcacaugaca

SEQ ID NO: 1096162 - RNA, 21 nt, Homo sapiens
ugaacgcacaugacauagcac

SEQ ID NO: 1096163 - RNA, 19 nt, Homo sapiens
ugaagaaaguaaaaccaua

SEQ ID NO: 1096164 - RNA, 11 nt, Homo sapiens
ugacaaauggc

SEQ ID NO: 1096165 - RNA, 20 nt, Homo sapiens
ccccaugcucugaugcagug

SEQ ID NO: 1096166 - RNA, 13 nt, Homo sapiens
cccccagcuggaa

SEQ ID NO: 1096167 - RNA, 16 nt, Homo sapiens
cccgcauagcacuugc

SEQ ID NO: 1096168 - RNA, 17 nt, Homo sapiens
cccgcauagcacuugca

SEQ ID NO: 1096169 - RNA, 14 nt, Homo sapiens
cccuggcuaccuug

SEQ ID NO: 1096170 - RNA, 16 nt, Homo sapiens
ccgagugaggccauag

SEQ ID NO: 1096171 - RNA, 14 nt, Homo sapiens
ccgcccgcauagca

SEQ ID NO: 1096172 - RNA, 23 nt, Homo sapiens
ccgcccgcauagcacuugcagac

SEQ ID NO: 1096173 - RNA, 23 nt, Homo sapiens
ccgccugucaauaaauguugaaa

SEQ ID NO: 1096174 - RNA, 12 nt, Homo sapiens
ccuaaacuguau

SEQ ID NO: 1096175 - RNA, 12 nt, Homo sapiens
ccuaagcccaaa

SEQ ID NO: 1096176 - RNA, 22 nt, Homo sapiens
ccuacaucaaaugcucaagccc

SEQ ID NO: 1096177 - RNA, 24 nt, Homo sapiens
ccuauugcugauacugucuuugca

SEQ ID NO: 1096178 - RNA, 22 nt, Homo sapiens
ccucacugcuguagacauuugc

SEQ ID NO: 1096179 - RNA, 23 nt, Homo sapiens
ccucacugcuguagacauuugcu

SEQ ID NO: 1096180 - RNA, 16 nt, Homo sapiens
ccucagugagaagcca

SEQ ID NO: 1096181 - RNA, 13 nt, Homo sapiens
ccucccucaggcc

SEQ ID NO: 1096182 - RNA, 15 nt, Homo sapiens
ccugaguuguauaaa

SEQ ID NO: 1096183 - RNA, 15 nt, Homo sapiens
ccuggaaaucagggu

SEQ ID NO: 1096184 - RNA, 17 nt, Homo sapiens
ccuggagugcugugcug

SEQ ID NO: 1096185 - RNA, 19 nt, Homo sapiens
ccugucaauaaauguugaa

SEQ ID NO: 1096186 - RNA, 14 nt, Homo sapiens
ccugucacuacugg

SEQ ID NO: 1096187 - RNA, 15 nt, Homo sapiens
ccugugccuuuugcc

SEQ ID NO: 1096188 - RNA, 24 nt, Homo sapiens
ccuguguagucucucuaguaguua

SEQ ID NO: 1096189 - RNA, 15 nt, Homo sapiens
ccuucaaauaguaua

SEQ ID NO: 1096190 - RNA, 12 nt, Homo sapiens
ccuucuaccucu

SEQ ID NO: 1096191 - RNA, 11 nt, Homo sapiens
ccuugaugaag

SEQ ID NO: 1096192 - RNA, 19 nt, Homo sapiens
ccuuggggcugaugcaguu

SEQ ID NO: 1096193 - RNA, 23 nt, Homo sapiens
ccuuggugugcuguauccaucca

SEQ ID NO: 1096194 - RNA, 13 nt, Homo sapiens
ccuugugaaggaa

SEQ ID NO: 1096195 - RNA, 13 nt, Homo sapiens
cgagcacacauaa

SEQ ID NO: 1096196 - RNA, 14 nt, Homo sapiens
cgagugaggccaua

SEQ ID NO: 1096197 - RNA, 18 nt, Homo sapiens
cgagugaggccauagcaa

SEQ ID NO: 1096198 - RNA, 23 nt, Homo sapiens
cgauguuuauguucuuauagaau

SEQ ID NO: 1096199 - RNA, 19 nt, Homo sapiens
cgauugcaggagucccugc

SEQ ID NO: 1096200 - RNA, 17 nt, Homo sapiens
cgcacaugacauagcac

SEQ ID NO: 1096201 - RNA, 15 nt, Homo sapiens
cgcauagcacuugca

SEQ ID NO: 1096202 - RNA, 14 nt, Homo sapiens
cgcccgcauagcac

SEQ ID NO: 1096203 - RNA, 15 nt, Homo sapiens
cgcccgcauagcacu

SEQ ID NO: 1096204 - RNA, 15 nt, Homo sapiens
cgcggcuuugggaca

SEQ ID NO: 1096205 - RNA, 16 nt, Homo sapiens
cggggaggaggcauuc

SEQ ID NO: 1096206 - RNA, 16 nt, Homo sapiens
cggguccaccaugagg

SEQ ID NO: 1096207 - RNA, 15 nt, Homo sapiens
cguaguuacucucag

SEQ ID NO: 1096208 - RNA, 22 nt, Homo sapiens
cgucgaaagaaagaauauguaa

SEQ ID NO: 1096209 - RNA, 14 nt, Homo sapiens
cgucuccucaggac

SEQ ID NO: 1096210 - RNA, 18 nt, Homo sapiens
cuaaaagaauugugacau

SEQ ID NO: 1096211 - RNA, 19 nt, Homo sapiens
cuaaaagaauugugacaua

SEQ ID NO: 1096212 - RNA, 13 nt, Homo sapiens
cuaauacagcaga

SEQ ID NO: 1096213 - RNA, 19 nt, Homo sapiens
cuaaucuguaaaugagaaa

SEQ ID NO: 1096214 - RNA, 15 nt, Homo sapiens
cuaauuccacacccu

SEQ ID NO: 1096215 - RNA, 17 nt, Homo sapiens
cuaauuccacacccuca

SEQ ID NO: 1096216 - RNA, 15 nt, Homo sapiens
cuacacagucacaca

SEQ ID NO: 1096217 - RNA, 16 nt, Homo sapiens
cuacacugggugcuga

SEQ ID NO: 1096218 - RNA, 20 nt, Homo sapiens
cuacagcuucuauucauuau

SEQ ID NO: 1096219 - RNA, 20 nt, Homo sapiens
cuaccaucucacggugggga

SEQ ID NO: 1096220 - RNA, 13 nt, Homo sapiens
cuaccucuuggcu

SEQ ID NO: 1096221 - RNA, 14 nt, Homo sapiens
cuacugaacuguua

SEQ ID NO: 1096222 - RNA, 20 nt, Homo sapiens
cuagaauugguggugagaua

SEQ ID NO: 1096223 - RNA, 18 nt, Homo sapiens
cuaguauugaaaacuaga

SEQ ID NO: 1096224 - RNA, 21 nt, Homo sapiens
cuaucauucucucacaagaac

SEQ ID NO: 1096225 - RNA, 18 nt, Homo sapiens
cuauccuaugccuucaaa

SEQ ID NO: 1096226 - RNA, 23 nt, Homo sapiens
cuauuagagcugccugugccuuu

SEQ ID NO: 1096227 - RNA, 15 nt, Homo sapiens
cucaacugacaugaa

SEQ ID NO: 1096228 - RNA, 16 nt, Homo sapiens
cucaacugacaugaaa

SEQ ID NO: 1096229 - RNA, 12 nt, Homo sapiens
cuccaaggcagu

SEQ ID NO: 1096230 - RNA, 16 nt, Homo sapiens
cucccaaaacagauua

SEQ ID NO: 1096231 - RNA, 20 nt, Homo sapiens
cuccuaaacugaacacauga

SEQ ID NO: 1096232 - RNA, 13 nt, Homo sapiens
cucucucaugaua

SEQ ID NO: 1096233 - RNA, 23 nt, Homo sapiens
cucuuagaugcaguucugaagaa

SEQ ID NO: 1096234 - RNA, 17 nt, Homo sapiens
cucuugccacaucuuga

SEQ ID NO: 1096235 - RNA, 13 nt, Homo sapiens
cucuuugcccaaa

SEQ ID NO: 1096236 - RNA, 17 nt, Homo sapiens
cugaaaucauacuucuu

SEQ ID NO: 1096237 - RNA, 19 nt, Homo sapiens
cugaauuguucuaaaugga

SEQ ID NO: 1096238 - RNA, 20 nt, Homo sapiens
cugaggucaauggugcaaag

SEQ ID NO: 1096239 - RNA, 15 nt, Homo sapiens
cugcaucuuaguuua

SEQ ID NO: 1096240 - RNA, 23 nt, Homo sapiens
cugccaucauguuuacagaggac

SEQ ID NO: 1096241 - RNA, 18 nt, Homo sapiens
cugcccacucaccugccc

SEQ ID NO: 1096242 - RNA, 17 nt, Homo sapiens
cugcuugguagcacuuu

SEQ ID NO: 1096243 - RNA, 13 nt, Homo sapiens
cuggacacauuau

SEQ ID NO: 1096244 - RNA, 18 nt, Homo sapiens
cuggagucugccaaaaca

SEQ ID NO: 1096245 - RNA, 20 nt, Homo sapiens
cuggaucugugaggggcucu

SEQ ID NO: 1096246 - RNA, 20 nt, Homo sapiens
cuggcagagauucugguaca

SEQ ID NO: 1096247 - RNA, 17 nt, Homo sapiens
cuggcccugugccuugg

SEQ ID NO: 1096248 - RNA, 15 nt, Homo sapiens
cuggugcuacgacca

SEQ ID NO: 1096249 - RNA, 22 nt, Homo sapiens
cuggugcuacgaccagggugag

SEQ ID NO: 1096250 - RNA, 18 nt, Homo sapiens
cugguucuuuguucuguc

SEQ ID NO: 1096251 - RNA, 18 nt, Homo sapiens
cuguagucccagcacuuu

SEQ ID NO: 1096252 - RNA, 16 nt, Homo sapiens
cuguccaacucuguau

SEQ ID NO: 1096253 - RNA, 19 nt, Homo sapiens
cugucccucauccauagca

SEQ ID NO: 1096254 - RNA, 14 nt, Homo sapiens
cugucuuugcauaa

SEQ ID NO: 1096255 - RNA, 15 nt, Homo sapiens
cugucuuugcauaaa

SEQ ID NO: 1096256 - RNA, 16 nt, Homo sapiens
cugugcacccagaaga

SEQ ID NO: 1096257 - RNA, 20 nt, Homo sapiens
cugugccuuggugugcugua

SEQ ID NO: 1096258 - RNA, 16 nt, Homo sapiens
cuguucuuuuguccca

SEQ ID NO: 1096259 - RNA, 17 nt, Homo sapiens
cuguugaaccaccugug

SEQ ID NO: 1096260 - RNA, 12 nt, Homo sapiens
cuguuugucaau

SEQ ID NO: 1096261 - RNA, 14 nt, Homo sapiens
cuuagagaacuaaa

SEQ ID NO: 1096262 - RNA, 18 nt, Homo sapiens
cuagaguuuagcuggaaa

SEQ ID NO: 1096263 - RNA, 23 nt, Homo sapiens
cuaguaccaugucguaguuacuc

SEQ ID NO: 1096264 - RNA, 14 nt, Homo sapiens
cuaguucuuaggaa

SEQ ID NO: 1096265 - RNA, 13 nt, Homo sapiens
cuauaacauucug

SEQ ID NO: 1096266 - RNA, 14 nt, Homo sapiens
cuauaacauucuga

SEQ ID NO: 1096267 - RNA, 11 nt, Homo sapiens
cuaugguucuc

SEQ ID NO: 1096268 - RNA, 14 nt, Homo sapiens
cuauuaauuccaug

SEQ ID NO: 1096269 - RNA, 15 nt, Homo sapiens
cuauugauaguuuca

SEQ ID NO: 1096270 - RNA, 17 nt, Homo sapiens
cucaacagacccaguga

SEQ ID NO: 1096271 - RNA, 22 nt, Homo sapiens
cucagaaaacaaggaugaauua

SEQ ID NO: 1096272 - RNA, 16 nt, Homo sapiens
cucaggggucauucau

SEQ ID NO: 1096273 - RNA, 14 nt, Homo sapiens
cucaucaggccauu

SEQ ID NO: 1096274 - RNA, 14 nt, Homo sapiens
cucauuuuaacuca

SEQ ID NO: 1096275 - RNA, 13 nt, Homo sapiens
cuccaaggcagug

SEQ ID NO: 1096276 - RNA, 12 nt, Homo sapiens
cuccacauaccu

SEQ ID NO: 1096277 - RNA, 15 nt, Homo sapiens
cuccccuacaucaaa

SEQ ID NO: 1096278 - RNA, 15 nt, Homo sapiens
cuccuaaacugaaca

SEQ ID NO: 1096279 - RNA, 23 nt, Homo sapiens
cuccucaggacccucccaggaga

SEQ ID NO: 1096280 - RNA, 21 nt, Homo sapiens
cucgcaagggaaguccuugca

SEQ ID NO: 1096281 - RNA, 15 nt, Homo sapiens
cucuaacgugauaaa

SEQ ID NO: 1096282 - RNA, 21 nt, Homo sapiens
cucuaacgugauaaaccugcu

SEQ ID NO: 1096283 - RNA, 12 nt, Homo sapiens
cucuacccugag

SEQ ID NO: 1096284 - RNA, 16 nt, Homo sapiens
cucuaguuauauugaa

SEQ ID NO: 1096285 - RNA, 13 nt, Homo sapiens
cucuuuaccuccu

SEQ ID NO: 1096286 - RNA, 21 nt, Homo sapiens
cugaaaucauacuucuuaggg

SEQ ID NO: 1096287 - RNA, 22 nt, Homo sapiens
cugaaaucauacuucuuagggu

SEQ ID NO: 1096288 - RNA, 22 nt, Homo sapiens
cugaaggagagagucuuuuaac

SEQ ID NO: 1096289 - RNA, 18 nt, Homo sapiens
cugaaggugcaguugaau

SEQ ID NO: 1096290 - RNA, 22 nt, Homo sapiens
cugcauuauauuuauuacugua

SEQ ID NO: 1096291 - RNA, 23 nt, Homo sapiens
cugccuccuuuccccucccucag

SEQ ID NO: 1096292 - RNA, 16 nt, Homo sapiens
cuggagugcugugcug

SEQ ID NO: 1096293 - RNA, 20 nt, Homo sapiens
cuggagugcugugcuguguu

SEQ ID NO: 1096294 - RNA, 24 nt, Homo sapiens
cuguaagaaaauaucacuugucaa

SEQ ID NO: 1096295 - RNA, 19 nt, Homo sapiens
cuguacuuuuuucaaauau

SEQ ID NO: 1096296 - RNA, 21 nt, Homo sapiens
cuguagacauuugcuaugagc

SEQ ID NO: 1096297 - RNA, 22 nt, Homo sapiens
cuguauuugcucccguggagcu

SEQ ID NO: 1096298 - RNA, 17 nt, Homo sapiens
cuguccuugaaugccau

SEQ ID NO: 1096299 - RNA, 17 nt, Homo sapiens
cugugaaguuacaugca

SEQ ID NO: 1096300 - RNA, 21 nt, Homo sapiens
cugugaggggcucucucauga

SEQ ID NO: 1096301 - RNA, 17 nt, Homo sapiens
cugugcagggcugguuu

SEQ ID NO: 1096302 - RNA, 17 nt, Homo sapiens
cugugcuguguuuaauc

SEQ ID NO: 1096303 - RNA, 15 nt, Homo sapiens
cuuaaaaugcaauau

SEQ ID NO: 1096304 - RNA, 23 nt, Homo sapiens
cuuaacauuccuaaaaugcuuca

SEQ ID NO: 1096305 - RNA, 21 nt, Homo sapiens
cuuaagaaugugcuagaguua

SEQ ID NO: 1096306 - RNA, 15 nt, Homo sapiens
cuuaggccagcacca

SEQ ID NO: 1096307 - RNA, 19 nt, Homo sapiens
cuuauagaggaacuugaaa

SEQ ID NO: 1096308 - RNA, 19 nt, Homo sapiens
cuucaaggguaaaagagug

SEQ ID NO: 1096309 - RNA, 17 nt, Homo sapiens
cuucagauaccaugcaa

SEQ ID NO: 1096310 - RNA, 15 nt, Homo sapiens
cuucauagcccaaaa

SEQ ID NO: 1096311 - RNA, 17 nt, Homo sapiens
cuucauagcccaaaaca

SEQ ID NO: 1096312 - RNA, 17 nt, Homo sapiens
cuucuggggcuuugcca

SEQ ID NO: 1096313 - RNA, 19 nt, Homo sapiens
cuucuggggcuuugccauu

SEQ ID NO: 1096314 - RNA, 19 nt, Homo sapiens
uaaaauucuggacacauua

SEQ ID NO: 1096315 - RNA, 23 nt, Homo sapiens
uaaaauuggauuacaguauggca

SEQ ID NO: 1096316 - RNA, 14 nt, Homo sapiens
uaaacaugcuugca

SEQ ID NO: 1096317 - RNA, 19 nt, Homo sapiens
uaaacauugccugauuugu

SEQ ID NO: 1096318 - RNA, 13 nt, Homo sapiens
uaaaccacaaaag

SEQ ID NO: 1096319 - RNA, 11 nt, Homo sapiens
uaaacuacuga

SEQ ID NO: 1096320 - RNA, 21 nt, Homo sapiens
uaaagaacgcugcagcuuuuu

SEQ ID NO: 1096321 - RNA, 19 nt, Homo sapiens
uaaaguacuaaaucucacc

SEQ ID NO: 1096322 - RNA, 19 nt, Homo sapiens
uaaaguucacacaguauua

SEQ ID NO: 1096323 - RNA, 13 nt, Homo sapiens
uaaauaaacagau

SEQ ID NO: 1096324 - RNA, 21 nt, Homo sapiens
uaaauaagauuuaauucacau

SEQ ID NO: 1096325 - RNA, 13 nt, Homo sapiens
uaaaucacacuga

SEQ ID NO: 1096326 - RNA, 22 nt, Homo sapiens
uaaaugucuaguucuuacccag

SEQ ID NO: 1096327 - RNA, 17 nt, Homo sapiens
uaaauguugacauggga

SEQ ID NO: 1096328 - RNA, 19 nt, Homo sapiens
uaaauuuaaaacacaguau

SEQ ID NO: 1096329 - RNA, 14 nt, Homo sapiens
uaagauuuaauuca

SEQ ID NO: 1096330 - RNA, 16 nt, Homo sapiens
uaagauuuaauucaca

SEQ ID NO: 1096331 - RNA, 14 nt, Homo sapiens
uaagucccuuucaa

SEQ ID NO: 1096332 - RNA, 17 nt, Homo sapiens
uaaguuaaaauucugga

SEQ ID NO: 1096333 - RNA, 20 nt, Homo sapiens
uaauaauuaaagaaugcaau

SEQ ID NO: 1096334 - RNA, 13 nt, Homo sapiens
uaauacagcagaa

SEQ ID NO: 1096335 - RNA, 17 nt, Homo sapiens
uaauaccuaaacuguau

SEQ ID NO: 1096336 - RNA, 17 nt, Homo sapiens
uaauauuccuggcauac

SEQ ID NO: 1096337 - RNA, 22 nt, Homo sapiens
uaauauuccuggcauaccuuua

SEQ ID NO: 1096338 - RNA, 21 nt, Homo sapiens
uaaucugagaggccacagugc

SEQ ID NO: 1096339 - RNA, 14 nt, Homo sapiens
uaaugacaugccua

SEQ ID NO: 1096340 - RNA, 15 nt, Homo sapiens
uaaugauaacuggaa

SEQ ID NO: 1096341 - RNA, 13 nt, Homo sapiens
uaauuugcaauuu

SEQ ID NO: 1096342 - RNA, 21 nt, Homo sapiens
uaauuugugcuacaguuuuuc

SEQ ID NO: 1096343 - RNA, 12 nt, Homo sapiens
uacaauuucaaa

SEQ ID NO: 1096344 - RNA, 13 nt, Homo sapiens
uacaccacauuag

SEQ ID NO: 1096345 - RNA, 14 nt, Homo sapiens
uacaccacauuagu

SEQ ID NO: 1096346 - RNA, 21 nt, Homo sapiens
uacagacacucccacuuggca

SEQ ID NO: 1096347 - RNA, 11 nt, Homo sapiens
uacaggacaag

SEQ ID NO: 1096348 - RNA, 17 nt, Homo sapiens
uacaucaaaugcucaag

SEQ ID NO: 1096349 - RNA, 20 nt, Homo sapiens
uacaucccuuaccugggaaa

SEQ ID NO: 1096350 - RNA, 16 nt, Homo sapiens
uacauugugcaauuga

SEQ ID NO: 1096351 - RNA, 23 nt, Homo sapiens
uaccuccuaauuccacacccuca

SEQ ID NO: 1096352 - RNA, 14 nt, Homo sapiens
uaccucuuggcugc

SEQ ID NO: 1096353 - RNA, 20 nt, Homo sapiens
uaccuggcccugugccuugg

SEQ ID NO: 1096354 - RNA, 14 nt, Homo sapiens
uaccuucuaccucu

SEQ ID NO: 1096355 - RNA, 13 nt, Homo sapiens
uacuaaaucucac

SEQ ID NO: 1096356 - RNA, 13 nt, Homo sapiens
uacuaauugucua

SEQ ID NO: 1096357 - RNA, 19 nt, Homo sapiens
uacuauucuuacuaaucug

SEQ ID NO: 1096358 - RNA, 22 nt, Homo sapiens
uacuucuuaggguuaugauuaa

SEQ ID NO: 1096359 - RNA, 22 nt, Homo sapiens
uagaaaaugugaguaguacaau

SEQ ID NO: 1096360 - RNA, 16 nt, Homo sapiens
uagaaacacaacuaua

SEQ ID NO: 1096361 - RNA, 15 nt, Homo sapiens
uagaaauucugaauu

SEQ ID NO: 1096362 - RNA, 20 nt, Homo sapiens
auucacagcaagucacuggc

SEQ ID NO: 1096363 - RNA, 14 nt, Homo sapiens
auucccaccagcug

SEQ ID NO: 1096364 - RNA, 13 nt, Homo sapiens
auuccccuacauc

SEQ ID NO: 1096365 - RNA, 15 nt, Homo sapiens
auuccccuacaucaa

SEQ ID NO: 1096366 - RNA, 21 nt, Homo sapiens
auucugaccuuacaaaagugu

SEQ ID NO: 1096367 - RNA, 22 nt, Homo sapiens
auucuguugaaccaccugugua

SEQ ID NO: 1096368 - RNA, 13 nt, Homo sapiens
auucuuccugcuu

SEQ ID NO: 1096369 - RNA, 16 nt, Homo sapiens
auucuuguuggcuuuu

SEQ ID NO: 1096370 - RNA, 14 nt, Homo sapiens
auucuuuaaacuac

SEQ ID NO: 1096371 - RNA, 15 nt, Homo sapiens
auugaaaacuagaua

SEQ ID NO: 1096372 - RNA, 13 nt, Homo sapiens
auugagacaucug

SEQ ID NO: 1096373 - RNA, 16 nt, Homo sapiens
auugcaggagucccug

SEQ ID NO: 1096374 - RNA, 20 nt, Homo sapiens
auuggagaaaagcacuuaaa

SEQ ID NO: 1096375 - RNA, 13 nt, Homo sapiens
auuggcaguguaa

SEQ ID NO: 1096376 - RNA, 21 nt, Homo sapiens
auuguauuuaccuucuaccuc

SEQ ID NO: 1096377 - RNA, 12 nt, Homo sapiens
auugucccugaa

SEQ ID NO: 1096378 - RNA, 10 nt, Homo sapiens
auugugaugu

SEQ ID NO: 1096379 - RNA, 17 nt, Homo sapiens
auuuaccuucuaccucu

SEQ ID NO: 1096380 - RNA, 18 nt, Homo sapiens
auuuaccuucuaccucuu

SEQ ID NO: 1096381 - RNA, 13 nt, Homo sapiens
auuuaugugaugg

SEQ ID NO: 1096382 - RNA, 20 nt, Homo sapiens
auuuccuuuauacugugaag

SEQ ID NO: 1096383 - RNA, 19 nt, Homo sapiens
auuuccuuuuguaaaguaa

SEQ ID NO: 1096384 - RNA, 13 nt, Homo sapiens
auuugcuaugagc

SEQ ID NO: 1096385 - RNA, 20 nt, Homo sapiens
auuuguaaauuuaugugaug

SEQ ID NO: 1096386 - RNA, 19 nt, Homo sapiens
auuuuaaaagaaugauuau

SEQ ID NO: 1096387 - RNA, 14 nt, Homo sapiens
auuuucauucugaa

SEQ ID NO: 1096388 - RNA, 13 nt, Homo sapiens
auuuuccugaaaa

SEQ ID NO: 1096389 - RNA, 21 nt, Homo sapiens
auuuugguaaaucacacugaa

SEQ ID NO: 1096390 - RNA, 14 nt, Homo sapiens
cauuuaaaagagua

SEQ ID NO: 1096391 - RNA, 22 nt, Homo sapiens
cauuuaaauaucugaacauuua

SEQ ID NO: 1096392 - RNA, 15 nt, Homo sapiens
cauuuaugauuuauc

SEQ ID NO: 1096393 - RNA, 15 nt, Homo sapiens
cauuucuagauacuu

SEQ ID NO: 1096394 - RNA, 14 nt, Homo sapiens
cauuugcucaugga

SEQ ID NO: 1096395 - RNA, 17 nt, Homo sapiens
ccaaacugacucuuaag

SEQ ID NO: 1096396 - RNA, 20 nt, Homo sapiens
ccaaaguucacauuaacuca

SEQ ID NO: 1096397 - RNA, 22 nt, Homo sapiens
ccaagagaagggcuuacaggca

SEQ ID NO: 1096398 - RNA, 17 nt, Homo sapiens
ccaagaguuucuucuca

SEQ ID NO: 1096399 - RNA, 14 nt, Homo sapiens
ccaagaugccaaca

SEQ ID NO: 1096400 - RNA, 15 nt, Homo sapiens
ccaagugaggccaua

SEQ ID NO: 1096401 - RNA, 16 nt, Homo sapiens
ccaagugaggccauag

SEQ ID NO: 1096402 - RNA, 17 nt, Homo sapiens
ccaagugccacgugaac

SEQ ID NO: 1096403 - RNA, 23 nt, Homo sapiens
ccaauaguuucuuguuaauccuu

SEQ ID NO: 1096404 - RNA, 14 nt, Homo sapiens
ccacauaccuggcc

SEQ ID NO: 1096405 - RNA, 12 nt, Homo sapiens
ccaccaugagga

SEQ ID NO: 1096406 - RNA, 22 nt, Homo sapiens
ccaccuguagucccagcacuuu

SEQ ID NO: 1096407 - RNA, 21 nt, Homo sapiens
ccacggagaggaaaagcagau

SEQ ID NO: 1096408 - RNA, 12 nt, Homo sapiens
ccagaaaggaca

SEQ ID NO: 1096409 - RNA, 20 nt, Homo sapiens
ccagaaauuuaccacaaaag

SEQ ID NO: 1096410 - RNA, 18 nt, Homo sapiens
ccagacgcauccugccac

SEQ ID NO: 1096411 - RNA, 19 nt, Homo sapiens
ccagcacagccucuuagau

SEQ ID NO: 1096412 - RNA, 12 nt, Homo sapiens
ccagcguaucau

SEQ ID NO: 1096413 - RNA, 14 nt, Homo sapiens
ccagcguaucauag

SEQ ID NO: 1096414 - RNA, 17 nt, Homo sapiens
ccagcuuuccucaucag

SEQ ID NO: 1096415 - RNA, 15 nt, Homo sapiens
ccaggauaccagcaa

SEQ ID NO: 1096416 - RNA, 14 nt, Homo sapiens
cuucauagcccaaa

SEQ ID NO: 1096417 - RNA, 17 nt, Homo sapiens
cuuccuuggccaagaga

SEQ ID NO: 1096418 - RNA, 14 nt, Homo sapiens
cuucuaacugaagg

SEQ ID NO: 1096419 - RNA, 19 nt, Homo sapiens
cuucuuaggguuaugauua

SEQ ID NO: 1096420 - RNA, 12 nt, Homo sapiens
cuugaaugccau

SEQ ID NO: 1096421 - RNA, 19 nt, Homo sapiens
cuuggcagcccgggucauc

SEQ ID NO: 1096422 - RNA, 15 nt, Homo sapiens
cuugguagcacuuua

SEQ ID NO: 1096423 - RNA, 23 nt, Homo sapiens
cuuguaaacauugccugauuugu

SEQ ID NO: 1096424 - RNA, 16 nt, Homo sapiens
cuuguuccaaugccac

SEQ ID NO: 1096425 - RNA, 17 nt, Homo sapiens
cuuuauaguggcacaaa

SEQ ID NO: 1096426 - RNA, 16 nt, Homo sapiens
cuuuaugacuaugcac

SEQ ID NO: 1096427 - RNA, 15 nt, Homo sapiens
cuuucuaccaucuca

SEQ ID NO: 1096428 - RNA, 21 nt, Homo sapiens
cuuucuuccuuggccaagaga

SEQ ID NO: 1096429 - RNA, 19 nt, Homo sapiens
cuuugaaggguaugucaca

SEQ ID NO: 1096430 - RNA, 19 nt, Homo sapiens
cuuuguaucauucaucuuc

SEQ ID NO: 1096431 - RNA, 13 nt, Homo sapiens
cuuuuagcauaaa

SEQ ID NO: 1096432 - RNA, 13 nt, Homo sapiens
cuuuuccaaacac

SEQ ID NO: 1096433 - RNA, 23 nt, Homo sapiens
cuuuugcgauuucacaguuggca

SEQ ID NO: 1096434 - RNA, 14 nt, Homo sapiens
cuuuugucccagaa

SEQ ID NO: 1096435 - RNA, 15 nt, Homo sapiens
cuuuuuuugaugaaa

SEQ ID NO: 1096436 - RNA, 17 nt, Homo sapiens
gaaaaaaaaagaauuac

SEQ ID NO: 1096437 - RNA, 20 nt, Homo sapiens
gaaaaaagucaccugcccaa

SEQ ID NO: 1096438 - RNA, 19 nt, Homo sapiens
gaaaacuagauaaacugcu

SEQ ID NO: 1096439 - RNA, 12 nt, Homo sapiens
gaaaagcacuua

SEQ ID NO: 1096440 - RNA, 14 nt, Homo sapiens
gaaaagcagaugca

SEQ ID NO: 1096441 - RNA, 19 nt, Homo sapiens
gaaaauaaaauuuaacuca

SEQ ID NO: 1096442 - RNA, 15 nt, Homo sapiens
gaaaaugccaccauc

SEQ ID NO: 1096443 - RNA, 22 nt, Homo sapiens
gaaaaugugaguaguacaauga

SEQ ID NO: 1096444 - RNA, 15 nt, Homo sapiens
gaaaauuaccuuuaa

SEQ ID NO: 1096445 - RNA, 20 nt, Homo sapiens
gaaacaccgagugaggccau

SEQ ID NO: 1096446 - RNA, 22 nt, Homo sapiens
gaaauauuaguuacuugcuaua

SEQ ID NO: 1096447 - RNA, 15 nt, Homo sapiens
gaaaucagcaggacg

SEQ ID NO: 1096448 - RNA, 20 nt, Homo sapiens
gaacaagcagcuaagcaaua

SEQ ID NO: 1096449 - RNA, 19 nt, Homo sapiens
gaacauucuuauauuuuau

SEQ ID NO: 1096450 - RNA, 22 nt, Homo sapiens
gaacccucaacugacaugaaau

SEQ ID NO: 1096451 - RNA, 20 nt, Homo sapiens
gaacugaaggcagcauguau

SEQ ID NO: 1096452 - RNA, 20 nt, Homo sapiens
gaagaagaugguaccaccag

SEQ ID NO: 1096453 - RNA, 22 nt, Homo sapiens
gaagauauuaagucccuuucaa

SEQ ID NO: 1096454 - RNA, 23 nt, Homo sapiens
gaagccuuggggcugaugcaguu

SEQ ID NO: 1096455 - RNA, 18 nt, Homo sapiens
gaagcugaauuauuagua

SEQ ID NO: 1096456 - RNA, 17 nt, Homo sapiens
gaaggccgaggucccau

SEQ ID NO: 1096457 - RNA, 16 nt, Homo sapiens
gaaggcuuucagcuga

SEQ ID NO: 1096458 - RNA, 11 nt, Homo sapiens
gaagucuucaa

SEQ ID NO: 1096459 - RNA, 17 nt, Homo sapiens
gaagugugggucugugu

SEQ ID NO: 1096460 - RNA, 15 nt, Homo sapiens
gaaguuacaugcaua

SEQ ID NO: 1096461 - RNA, 22 nt, Homo sapiens
gaaugauuaugaauuacauuug

SEQ ID NO: 1096462 - RNA, 16 nt, Homo sapiens
gaaugauuuuggugga

SEQ ID NO: 1096463 - RNA, 21 nt, Homo sapiens
gaauuaguugcauugguuuga

SEQ ID NO: 1096464 - RNA, 21 nt, Homo sapiens
gaauuaguuuuauaugcuucu

SEQ ID NO: 1096465 - RNA, 23 nt, Homo sapiens
gaauugcgccuuccgagcacaca

SEQ ID NO: 1096466 - RNA, 18 nt, Homo sapiens
gaauuguucuaaauggaa

SEQ ID NO: 1096467 - RNA, 23 nt, Homo sapiens
gacaagauuuuuuaauuguuuaa

SEQ ID NO: 1096468 - RNA, 19 nt, Homo sapiens
gacaaggucuugcuauguu

SEQ ID NO: 1096469 - RNA, 20 nt, Homo sapiens
gacagucaccucauggaauu

SEQ ID NO: 1096470 - RNA, 17 nt, Homo sapiens
gacaugaaauacuuuaa

SEQ ID NO: 1096471 - RNA, 14 nt, Homo sapiens
gacauguccaggag

SEQ ID NO: 1096472 - RNA, 20 nt, Homo sapiens
gaccaaaugcuuuuccucaa

SEQ ID NO: 1096473 - RNA, 17 nt, Homo sapiens
gaccccuuuaaacuguc

SEQ ID NO: 1096474 - RNA, 12 nt, Homo sapiens
gaccuuacaaaa

SEQ ID NO: 1096475 - RNA, 14 nt, Homo sapiens
gacucuuaagaaga

SEQ ID NO: 1096476 - RNA, 12 nt, Homo sapiens
gacuuaucaaca

SEQ ID NO: 1096477 - RNA, 14 nt, Homo sapiens
gacuuuucuaccag

SEQ ID NO: 1096478 - RNA, 14 nt, Homo sapiens
gagaaaagcacuua

SEQ ID NO: 1096479 - RNA, 13 nt, Homo sapiens
gagaaagucaccu

SEQ ID NO: 1096480 - RNA, 13 nt, Homo sapiens
gagacugcaaugu

SEQ ID NO: 1096481 - RNA, 20 nt, Homo sapiens
gagagauauuuugauucuca

SEQ ID NO: 1096482 - RNA, 21 nt, Homo sapiens
gagcacacauaaaagcacaaa

SEQ ID NO: 1096483 - RNA, 22 nt, Homo sapiens
gagcuggggaugucucucauga

SEQ ID NO: 1096484 - RNA, 11 nt, Homo sapiens
gagcuuugcau

SEQ ID NO: 1096485 - RNA, 19 nt, Homo sapiens
gaggacagaauuacaugaa

SEQ ID NO: 1096486 - RNA, 12 nt, Homo sapiens
gagggcuuuauu

SEQ ID NO: 1096487 - RNA, 15 nt, Homo sapiens
gagucugccaaaaca

SEQ ID NO: 1096488 - RNA, 18 nt, Homo sapiens
gagugaaaaaagucaccu

SEQ ID NO: 1096489 - RNA, 16 nt, Homo sapiens
gauaaaccugcuccaa

SEQ ID NO: 1096490 - RNA, 22 nt, Homo sapiens
gauaacuaaaauucugggccua

SEQ ID NO: 1096491 - RNA, 22 nt, Homo sapiens
gauauuaaccaggggccaugaa

SEQ ID NO: 1096492 - RNA, 18 nt, Homo sapiens
gaucauuaucagccugug

SEQ ID NO: 1096493 - RNA, 23 nt, Homo sapiens
gaucauuaucagccugugccacg

SEQ ID NO: 1096494 - RNA, 17 nt, Homo sapiens
gaucuauguuucaucuu

SEQ ID NO: 1096495 - RNA, 16 nt, Homo sapiens
gaugggcugaggccag

SEQ ID NO: 1096496 - RNA, 13 nt, Homo sapiens
gauuaauguacuu

SEQ ID NO: 1096497 - RNA, 21 nt, Homo sapiens
gauuauuggauucacacccag

SEQ ID NO: 1096498 - RNA, 17 nt, Homo sapiens
gauucacacccagcuga

SEQ ID NO: 1096499 - RNA, 20 nt, Homo sapiens
gauuuaauuuuuuaaacugu

SEQ ID NO: 1096500 - RNA, 20 nt, Homo sapiens
gcaaagcaacgacuacuuug

SEQ ID NO: 1096501 - RNA, 12 nt, Homo sapiens
gcaaaugcauuc

SEQ ID NO: 1096502 - RNA, 19 nt, Homo sapiens
gcaaccagucaaaaccaga

SEQ ID NO: 1096503 - RNA, 16 nt, Homo sapiens
gcaagagacuuuguca

SEQ ID NO: 1096504 - RNA, 17 nt, Homo sapiens
gcaagaucauagcucau

SEQ ID NO: 1096505 - RNA, 20 nt, Homo sapiens
gcaagaugcccuaauccauc

SEQ ID NO: 1096506 - RNA, 18 nt, Homo sapiens
gcaauaauacaacuauca

SEQ ID NO: 1096507 - RNA, 19 nt, Homo sapiens
gcaauaauacaacuaucau

SEQ ID NO: 1096508 - RNA, 15 nt, Homo sapiens
gcacagccagacgca

SEQ ID NO: 1096509 - RNA, 15 nt, Homo sapiens
gcacaugacauagca

SEQ ID NO: 1096510 - RNA, 13 nt, Homo sapiens
gcaccugugcugg

SEQ ID NO: 1096511 - RNA, 21 nt, Homo sapiens
gcacggagggcagucccgggu

SEQ ID NO: 1096512 - RNA, 19 nt, Homo sapiens
gcacuaguauuucuaugaa

SEQ ID NO: 1096513 - RNA, 22 nt, Homo sapiens
gcagaacagcuucauguuccca

SEQ ID NO: 1096514 - RNA, 21 nt, Homo sapiens
gcagccuccaggauaccagca

SEQ ID NO: 1096515 - RNA, 13 nt, Homo sapiens
gcagcucuacucu

SEQ ID NO: 1096516 - RNA, 14 nt, Homo sapiens
gcaggacacugcag

SEQ ID NO: 1096517 - RNA, 17 nt, Homo sapiens
gcaguaauuugcaauuu

SEQ ID NO: 1096518 - RNA, 16 nt, Homo sapiens
gcaguugaauucagug

SEQ ID NO: 1096519 - RNA, 18 nt, Homo sapiens
gcauaaauuuguaauaua

SEQ ID NO: 1096520 - RNA, 15 nt, Homo sapiens
aaaacagccucuuug

SEQ ID NO: 1096521 - RNA, 16 nt, Homo sapiens
aaaacuaguucuuagg

SEQ ID NO: 1096522 - RNA, 14 nt, Homo sapiens
aaaagaauuaccaa

SEQ ID NO: 1096523 - RNA, 13 nt, Homo sapiens
aaaagcagaauuu

SEQ ID NO: 1096524 - RNA, 14 nt, Homo sapiens
aaaagcuguggaau

SEQ ID NO: 1096525 - RNA, 18 nt, Homo sapiens
aaaagcuucagggaacaa

SEQ ID NO: 1096526 - RNA, 14 nt, Homo sapiens
aaaagucaccugcc

SEQ ID NO: 1096527 - RNA, 22 nt, Homo sapiens
aaaaguuuuuuuuuuguuuguu

SEQ ID NO: 1096528 - RNA, 14 nt, Homo sapiens
aaaauauacaagua

SEQ ID NO: 1096529 - RNA, 12 nt, Homo sapiens
aaaaugcaauau

SEQ ID NO: 1096530 - RNA, 23 nt, Homo sapiens
aaaauguuuuuaaacagugucau

SEQ ID NO: 1096531 - RNA, 22 nt, Homo sapiens
aaaauuuugggguaaaaaggag

SEQ ID NO: 1096532 - RNA, 19 nt, Homo sapiens
aaacaagucagaucuacac

SEQ ID NO: 1096533 - RNA, 14 nt, Homo sapiens
aaacaccaagugag

SEQ ID NO: 1096534 - RNA, 21 nt, Homo sapiens
aaacagauuacuagaaauauu

SEQ ID NO: 1096535 - RNA, 18 nt, Homo sapiens
aaacagugucauauacaa

SEQ ID NO: 1096536 - RNA, 14 nt, Homo sapiens
aaaccaacauggag

SEQ ID NO: 1096537 - RNA, 18 nt, Homo sapiens
aaaccuugaaagacauuu

SEQ ID NO: 1096538 - RNA, 22 nt, Homo sapiens
aaacuaaacuuuacuggguaua

SEQ ID NO: 1096539 - RNA, 19 nt, Homo sapiens
aaacuggguaaugcaacuc

SEQ ID NO: 1096540 - RNA, 18 nt, Homo sapiens
aaagaaaacuuuaucgcu

SEQ ID NO: 1096541 - RNA, 18 nt, Homo sapiens
aaagaaacuaagauuuau

SEQ ID NO: 1096542 - RNA, 21 nt, Homo sapiens
aaagaauggaaguagcuguau

SEQ ID NO: 1096543 - RNA, 18 nt, Homo sapiens
aaagaauuaaugcucuaa

SEQ ID NO: 1096544 - RNA, 19 nt, Homo sapiens
aaagacccaacauuacuaa

SEQ ID NO: 1096545 - RNA, 14 nt, Homo sapiens
aaagagaacuucca

SEQ ID NO: 1096546 - RNA, 22 nt, Homo sapiens
aaagagaauggaaaaaugauuu

SEQ ID NO: 1096547 - RNA, 20 nt, Homo sapiens
aaagagcauauucacugguu

SEQ ID NO: 1096548 - RNA, 14 nt, Homo sapiens
aaagaguaagggua

SEQ ID NO: 1096549 - RNA, 19 nt, Homo sapiens
aaagcaacgacuacuuugc

SEQ ID NO: 1096550 - RNA, 13 nt, Homo sapiens
aaagcuucaggga

SEQ ID NO: 1096551 - RNA, 13 nt, Homo sapiens
aaaggaugaucaa

SEQ ID NO: 1096552 - RNA, 21 nt, Homo sapiens
aaagggccugcccagacaaga

SEQ ID NO: 1096553 - RNA, 22 nt, Homo sapiens
aaaguauauguuaaaaagugag

SEQ ID NO: 1096554 - RNA, 13 nt, Homo sapiens
aaagucaccugcc

SEQ ID NO: 1096555 - RNA, 22 nt, Homo sapiens
aaauaaacagauacauucacau

SEQ ID NO: 1096556 - RNA, 13 nt, Homo sapiens
aaauaaacuguua

SEQ ID NO: 1096557 - RNA, 18 nt, Homo sapiens
aaauaugccccauucaac

SEQ ID NO: 1096558 - RNA, 22 nt, Homo sapiens
aaaucaggguuaguauugucca

SEQ ID NO: 1096559 - RNA, 14 nt, Homo sapiens
aaaucuccagauuu

SEQ ID NO: 1096560 - RNA, 18 nt, Homo sapiens
aaaugagaaagguauaua

SEQ ID NO: 1096561 - RNA, 18 nt, Homo sapiens
aaaugccaccauccaaua

SEQ ID NO: 1096562 - RNA, 16 nt, Homo sapiens
aaaugcuuuuccucaa

SEQ ID NO: 1096563 - RNA, 17 nt, Homo sapiens
aaauggcuuccuggcaa

SEQ ID NO: 1096564 - RNA, 18 nt, Homo sapiens
aaauguccaagcuaugua

SEQ ID NO: 1096565 - RNA, 21 nt, Homo sapiens
aaauguuauagcugcauuugu

SEQ ID NO: 1096566 - RNA, 15 nt, Homo sapiens
aaauuaguugggcau

SEQ ID NO: 1096567 - RNA, 15 nt, Homo sapiens
aaauuaucacaucau

SEQ ID NO: 1096568 - RNA, 20 nt, Homo sapiens
aaauucaugccccaguauua

SEQ ID NO: 1096569 - RNA, 19 nt, Homo sapiens
aaauuggagaaaagcacuu

SEQ ID NO: 1096570 - RNA, 15 nt, Homo sapiens
aacaaaacagccucu

SEQ ID NO: 1096571 - RNA, 19 nt, Homo sapiens
aacaauuucacccauagcu

SEQ ID NO: 1096572 - RNA, 15 nt, Homo sapiens
aacacaagcauuuca

SEQ ID NO: 1096573 - RNA, 18 nt, Homo sapiens
aacaccaagugaggccau

SEQ ID NO: 1096574 - RNA, 14 nt, Homo sapiens
aacaccacuuugua

SEQ ID NO: 1096575 - RNA, 18 nt, Homo sapiens
aacaccgagugaggccau

SEQ ID NO: 1096576 - RNA, 15 nt, Homo sapiens
aacagacccagugag

SEQ ID NO: 1096577 - RNA, 14 nt, Homo sapiens
aacagauacauuca

SEQ ID NO: 1096578 - RNA, 17 nt, Homo sapiens
aacagaucgagucacaa

SEQ ID NO: 1096579 - RNA, 15 nt, Homo sapiens
aacagauuacuagaa

SEQ ID NO: 1096580 - RNA, 17 nt, Homo sapiens
aacagcaaaccaaugcu

SEQ ID NO: 1096581 - RNA, 22 nt, Homo sapiens
aacaguacaguauuuacaguau

SEQ ID NO: 1096582 - RNA, 18 nt, Homo sapiens
aacagugucauauacaau

SEQ ID NO: 1096583 - RNA, 22 nt, Homo sapiens
aaccaccuguguagucucucua

SEQ ID NO: 1096584 - RNA, 16 nt, Homo sapiens
aaccauguugguugca

SEQ ID NO: 1096585 - RNA, 18 nt, Homo sapiens
aaccauguugguugcacu

SEQ ID NO: 1096586 - RNA, 20 nt, Homo sapiens
aacccuucagauuugccuua

SEQ ID NO: 1096587 - RNA, 22 nt, Homo sapiens
aacgcacaugacauagcacuug

SEQ ID NO: 1096588 - RNA, 23 nt, Homo sapiens
aacuaguucuuaggaacagacuc

SEQ ID NO: 1096589 - RNA, 14 nt, Homo sapiens
aacucaggcuuuca

SEQ ID NO: 1096590 - RNA, 15 nt, Homo sapiens
aacugcugaggaugg

SEQ ID NO: 1096591 - RNA, 17 nt, Homo sapiens
aacuggaaauguccaag

SEQ ID NO: 1096592 - RNA, 13 nt, Homo sapiens
aacuuaccaacuu

SEQ ID NO: 1096593 - RNA, 19 nt, Homo sapiens
aacuuccagauccuggaaa

SEQ ID NO: 1096594 - RNA, 15 nt, Homo sapiens
aagaaaauaucacuu

SEQ ID NO: 1096595 - RNA, 22 nt, Homo sapiens
aagaaaauuuugggguaaaaag

SEQ ID NO: 1096596 - RNA, 16 nt, Homo sapiens
aagaaacaccgaguga

SEQ ID NO: 1096597 - RNA, 17 nt, Homo sapiens
aagaaagacuccuuucc

SEQ ID NO: 1096598 - RNA, 13 nt, Homo sapiens
aagacacaugcag

SEQ ID NO: 1096599 - RNA, 16 nt, Homo sapiens
aagacacccugucugc

SEQ ID NO: 1096600 - RNA, 17 nt, Homo sapiens
aagacuuaucaacauuu

SEQ ID NO: 1096601 - RNA, 19 nt, Homo sapiens
aagagaacuuccagauccu

SEQ ID NO: 1096602 - RNA, 20 nt, Homo sapiens
aagagcccaucuuugucagu

SEQ ID NO: 1096603 - RNA, 22 nt, Homo sapiens
aagaguuucuucucauauccau

SEQ ID NO: 1096604 - RNA, 13 nt, Homo sapiens
aagaucugaguga

SEQ ID NO: 1096605 - RNA, 13 nt, Homo sapiens
aagaugcccuaau

SEQ ID NO: 1096606 - RNA, 18 nt, Homo sapiens
aagcaacgacuacuuugc

SEQ ID NO: 1096607 - RNA, 15 nt, Homo sapiens
aagcagcuaagcaau

SEQ ID NO: 1096608 - RNA, 19 nt, Homo sapiens
aagccagauuuuccugaaa

SEQ ID NO: 1096609 - RNA, 24 nt, Homo sapiens
aagcuauguauuuaaauuaucaca

SEQ ID NO: 1096610 - RNA, 18 nt, Homo sapiens
aaggaauuguuuuuauaa

SEQ ID NO: 1096611 - RNA, 23 nt, Homo sapiens
aaggauucugcagaaaaaaaaga

SEQ ID NO: 1096612 - RNA, 17 nt, Homo sapiens
aaggcagaaacuucuuu

SEQ ID NO: 1096613 - RNA, 22 nt, Homo sapiens
aaggcuuggaaacagaacugga

SEQ ID NO: 1096614 - RNA, 18 nt, Homo sapiens
aagggacaccaagccuug

SEQ ID NO: 1096615 - RNA, 17 nt, Homo sapiens
aagggccugcccagaca

SEQ ID NO: 1096616 - RNA, 21 nt, Homo sapiens
aagguacuucaaauccuugaa

SEQ ID NO: 1096617 - RNA, 22 nt, Homo sapiens
aaggucuugcuauguugcccag

SEQ ID NO: 1096618 - RNA, 13 nt, Homo sapiens
aaguagcuguaug

SEQ ID NO: 1096619 - RNA, 19 nt, Homo sapiens
aagugacaagcucacagac

SEQ ID NO: 1096620 - RNA, 12 nt, Homo sapiens
aagugaggccau

SEQ ID NO: 1096621 - RNA, 23 nt, Homo sapiens
aagugccacgugaacuaugcaau

SEQ ID NO: 1096622 - RNA, 13 nt, Homo sapiens
aaguucacacagu

SEQ ID NO: 1096623 - RNA, 14 nt, Homo sapiens
aaguugcaaucugu

SEQ ID NO: 1096624 - RNA, 11 nt, Homo sapiens
aauaaaaagcu

SEQ ID NO: 1096625 - RNA, 20 nt, Homo sapiens
aauaaaagcuauuacuuggc

SEQ ID NO: 1096626 - RNA, 12 nt, Homo sapiens
aauaagugccag

SEQ ID NO: 1096627 - RNA, 16 nt, Homo sapiens
aauacagcagaacucc

SEQ ID NO: 1096628 - RNA, 14 nt, Homo sapiens
aauagcaugcaaaa

SEQ ID NO: 1096629 - RNA, 18 nt, Homo sapiens
aauauaaaaacagacucu

SEQ ID NO: 1096630 - RNA, 14 nt, Homo sapiens
aauauuucagauaa

SEQ ID NO: 1096631 - RNA, 19 nt, Homo sapiens
aaucaguggaacucaauau

SEQ ID NO: 1096632 - RNA, 11 nt, Homo sapiens
aaucaguguga

SEQ ID NO: 1096633 - RNA, 22 nt, Homo sapiens
aauccuugaagauuuaccacuu

SEQ ID NO: 1096634 - RNA, 15 nt, Homo sapiens
aaucuccaacuuuau

SEQ ID NO: 1096635 - RNA, 13 nt, Homo sapiens
aaucuguauaaau

SEQ ID NO: 1096636 - RNA, 18 nt, Homo sapiens
aaugagaaagguauauau

SEQ ID NO: 1096637 - RNA, 15 nt, Homo sapiens
aaugauacaguugca

SEQ ID NO: 1096638 - RNA, 17 nt, Homo sapiens
aaugccacauacuugca

SEQ ID NO: 1096639 - RNA, 14 nt, Homo sapiens
aaugccaccaucca

SEQ ID NO: 1096640 - RNA, 14 nt, Homo sapiens
aaugccgccuguca

SEQ ID NO: 1096641 - RNA, 23 nt, Homo sapiens
aaugcucaagcccccagcuggaa

SEQ ID NO: 1096642 - RNA, 17 nt, Homo sapiens
aaugucaguauguggaa

SEQ ID NO: 1096643 - RNA, 12 nt, Homo sapiens
aaugucuaguuc

SEQ ID NO: 1096644 - RNA, 20 nt, Homo sapiens
aaugucuguauuucauucuu

SEQ ID NO: 1096645 - RNA, 13 nt, Homo sapiens
aauguuucacuac

SEQ ID NO: 1096646 - RNA, 22 nt, Homo sapiens
cugucuucggccgagcugguuu

SEQ ID NO: 1096647 - RNA, 21 nt, Homo sapiens
cugugaacaguacaguauuua

SEQ ID NO: 1096648 - RNA, 17 nt, Homo sapiens
cugugcguggaaaaaga

SEQ ID NO: 1096649 - RNA, 22 nt, Homo sapiens
cuguggguagacacacaugaag

SEQ ID NO: 1096650 - RNA, 19 nt, Homo sapiens
cuguuuauucugggaaaug

SEQ ID NO: 1096651 - RNA, 14 nt, Homo sapiens
cuuaaaaugcaaua

SEQ ID NO: 1096652 - RNA, 21 nt, Homo sapiens
cuuacaggcauggacaugcag

SEQ ID NO: 1096653 - RNA, 13 nt, Homo sapiens
cuuagaugcaguu

SEQ ID NO: 1096654 - RNA, 19 nt, Homo sapiens
cuuaucaacauuuguucca

SEQ ID NO: 1096655 - RNA, 23 nt, Homo sapiens
cuuaucaacauuuguuccaugag

SEQ ID NO: 1096656 - RNA, 21 nt, Homo sapiens
cuucaagauccucuugccaca

SEQ ID NO: 1096657 - RNA, 13 nt, Homo sapiens
cuucauuaccuca

SEQ ID NO: 1096658 - RNA, 13 nt, Homo sapiens
cuugaaugccaua

SEQ ID NO: 1096659 - RNA, 23 nt, Homo sapiens
cuugccacaucuugaaaaugcca

SEQ ID NO: 1096660 - RNA, 22 nt, Homo sapiens
cuugccaguuguauaacugaaa

SEQ ID NO: 1096661 - RNA, 14 nt, Homo sapiens
cuugguagcacuuu

SEQ ID NO: 1096662 - RNA, 14 nt, Homo sapiens
cuuggugcugguuu

SEQ ID NO: 1096663 - RNA, 16 nt, Homo sapiens
cuuguaaacauugccu

SEQ ID NO: 1096664 - RNA, 19 nt, Homo sapiens
cuugucaauaaaauccaua

SEQ ID NO: 1096665 - RNA, 20 nt, Homo sapiens
cuugucaauaaaauccauac

SEQ ID NO: 1096666 - RNA, 14 nt, Homo sapiens
cuuuaaacuacuga

SEQ ID NO: 1096667 - RNA, 22 nt, Homo sapiens
cuuuaaucacuuaacauuccua

SEQ ID NO: 1096668 - RNA, 16 nt, Homo sapiens
cuuuaaugcaaugcau

SEQ ID NO: 1096669 - RNA, 16 nt, Homo sapiens
cuuuccucaucaggcc

SEQ ID NO: 1096670 - RNA, 14 nt, Homo sapiens
cuuucuaagggaaa

SEQ ID NO: 1096671 - RNA, 12 nt, Homo sapiens
cuuucuguauaa

SEQ ID NO: 1096672 - RNA, 20 nt, Homo sapiens
cuuuuaccaggccugcucug

SEQ ID NO: 1096673 - RNA, 17 nt, Homo sapiens
cuuuucucuacuuuaaa

SEQ ID NO: 1096674 - RNA, 16 nt, Homo sapiens
gaaaaauaaacauucu

SEQ ID NO: 1096675 - RNA, 15 nt, Homo sapiens
gaaaaauuauuugug

SEQ ID NO: 1096676 - RNA, 16 nt, Homo sapiens
gaaaaugugaguagua

SEQ ID NO: 1096677 - RNA, 14 nt, Homo sapiens
gaaaauuaauucua

SEQ ID NO: 1096678 - RNA, 22 nt, Homo sapiens
gaaaauuaccuuuaaugcaaug

SEQ ID NO: 1096679 - RNA, 21 nt, Homo sapiens
gaaacaccaagugaggccaua

SEQ ID NO: 1096680 - RNA, 21 nt, Homo sapiens
gaaacaccgagugaggccaua

SEQ ID NO: 1096681 - RNA, 15 nt, Homo sapiens
gaaagugaugacaua

SEQ ID NO: 1096682 - RNA, 15 nt, Homo sapiens
gaaauaaaaagaagg

SEQ ID NO: 1096683 - RNA, 19 nt, Homo sapiens
gaaauuuaaauaagauuua

SEQ ID NO: 1096684 - RNA, 19 nt, Homo sapiens
gaacaagcagcuaagcaau

SEQ ID NO: 1096685 - RNA, 17 nt, Homo sapiens
gaacacaagcauuucac

SEQ ID NO: 1096686 - RNA, 15 nt, Homo sapiens
gaacagaaccugcaa

SEQ ID NO: 1096687 - RNA, 18 nt, Homo sapiens
gaacagcaaaccaaugcu

SEQ ID NO: 1096688 - RNA, 15 nt, Homo sapiens
gaacauuuacuacag

SEQ ID NO: 1096689 - RNA, 21 nt, Homo sapiens
gaaccauguugguugcacuuu

SEQ ID NO: 1096690 - RNA, 14 nt, Homo sapiens
gaacgcacaugaca

SEQ ID NO: 1096691 - RNA, 20 nt, Homo sapiens
gaacggggguacacgguggg

SEQ ID NO: 1096692 - RNA, 15 nt, Homo sapiens
gaacuauuaauucca

SEQ ID NO: 1096693 - RNA, 21 nt, Homo sapiens
gaacuauuaauuccaugugau

SEQ ID NO: 1096694 - RNA, 14 nt, Homo sapiens
gaagaaagacuccu

SEQ ID NO: 1096695 - RNA, 16 nt, Homo sapiens
gaagaaagacuccuuu

SEQ ID NO: 1096696 - RNA, 22 nt, Homo sapiens
gaagaacugaaaucauacuucu

SEQ ID NO: 1096697 - RNA, 14 nt, Homo sapiens
gaaggcuaugggga

SEQ ID NO: 1096698 - RNA, 15 nt, Homo sapiens
gaaguccagaacaag

SEQ ID NO: 1096699 - RNA, 22 nt, Homo sapiens
gaagugugucacccuuaggcca

SEQ ID NO: 1096700 - RNA, 17 nt, Homo sapiens
gaauagaaaggcuucca

SEQ ID NO: 1096701 - RNA, 14 nt, Homo sapiens
gaauggggugagca

SEQ ID NO: 1096702 - RNA, 14 nt, Homo sapiens
gaauuaaugcucua

SEQ ID NO: 1096703 - RNA, 14 nt, Homo sapiens
gaauuaccaagaga

SEQ ID NO: 1096704 - RNA, 15 nt, Homo sapiens
gacaaccucauuuua

SEQ ID NO: 1096705 - RNA, 19 nt, Homo sapiens
gacacaacccgucagagac

SEQ ID NO: 1096706 - RNA, 15 nt, Homo sapiens
gacacugauaugggu

SEQ ID NO: 1096707 - RNA, 14 nt, Homo sapiens
gacagaauggauau

SEQ ID NO: 1096708 - RNA, 19 nt, Homo sapiens
gacaggucauccuugccag

SEQ ID NO: 1096709 - RNA, 17 nt, Homo sapiens
gaccaucacccagauga

SEQ ID NO: 1096710 - RNA, 14 nt, Homo sapiens
gacccagaaaggac

SEQ ID NO: 1096711 - RNA, 15 nt, Homo sapiens
gacccucccaggaga

SEQ ID NO: 1096712 - RNA, 16 nt, Homo sapiens
gaccgcaggaggaaau

SEQ ID NO: 1096713 - RNA, 17 nt, Homo sapiens
gaccuuuuaagugaaaa

SEQ ID NO: 1096714 - RNA, 18 nt, Homo sapiens
gacgcgacuaucauucuc

SEQ ID NO: 1096715 - RNA, 18 nt, Homo sapiens
gacuagaauuggugguga

SEQ ID NO: 1096716 - RNA, 14 nt, Homo sapiens
gacucucagcagcu

SEQ ID NO: 1096717 - RNA, 15 nt, Homo sapiens
gacuuugucacuuau

SEQ ID NO: 1096718 - RNA, 21 nt, Homo sapiens
gagaaugagagacacacugaa

SEQ ID NO: 1096719 - RNA, 20 nt, Homo sapiens
gagcccuucacuccugagaa

SEQ ID NO: 1096720 - RNA, 17 nt, Homo sapiens
gagcuccuuagccuuug

SEQ ID NO: 1096721 - RNA, 14 nt, Homo sapiens
gaggauaaaaccuc

SEQ ID NO: 1096722 - RNA, 18 nt, Homo sapiens
gaggcugagguggcagaa

SEQ ID NO: 1096723 - RNA, 21 nt, Homo sapiens
gaggcugcgugugccccgugg

SEQ ID NO: 1096724 - RNA, 11 nt, Homo sapiens
gaggggagcag

SEQ ID NO: 1096725 - RNA, 12 nt, Homo sapiens
gagugaggccau

SEQ ID NO: 1096726 - RNA, 16 nt, Homo sapiens
gagugaggccauagca

SEQ ID NO: 1096727 - RNA, 20 nt, Homo sapiens
gagugggguagguugggaga

SEQ ID NO: 1096728 - RNA, 11 nt, Homo sapiens
gauaacuaaaa

SEQ ID NO: 1096729 - RNA, 16 nt, Homo sapiens
gauacugucuuugcau

SEQ ID NO: 1096730 - RNA, 14 nt, Homo sapiens
gauagaaggcuaug

SEQ ID NO: 1096731 - RNA, 21 nt, Homo sapiens
gauauaaucugaauccuguua

SEQ ID NO: 1096732 - RNA, 23 nt, Homo sapiens
gaucacuugaggccaggacuuug

SEQ ID NO: 1096733 - RNA, 19 nt, Homo sapiens
gaucauagcucauugcaag

SEQ ID NO: 1096734 - RNA, 14 nt, Homo sapiens
gaugcagugcccua

SEQ ID NO: 1096735 - RNA, 11 nt, Homo sapiens
gaugcuuuaac

SEQ ID NO: 1096736 - RNA, 14 nt, Homo sapiens
gaugcuuuaacuga

SEQ ID NO: 1096737 - RNA, 22 nt, Homo sapiens
gauuuaauuuuuuaaacuguag

SEQ ID NO: 1096738 - RNA, 19 nt, Homo sapiens
gauuuuuuaauuguuuaaa

SEQ ID NO: 1096739 - RNA, 15 nt, Homo sapiens
gcaaaccaaugcuau

SEQ ID NO: 1096740 - RNA, 19 nt, Homo sapiens
gcaaagcaacgacuacuuu

SEQ ID NO: 1096741 - RNA, 14 nt, Homo sapiens
gcaaauugucacag

SEQ ID NO: 1096742 - RNA, 22 nt, Homo sapiens
gcaagaucauagcucauugcaa

SEQ ID NO: 1096743 - RNA, 19 nt, Homo sapiens
gcaaggggaugagaccgca

SEQ ID NO: 1096744 - RNA, 13 nt, Homo sapiens
gcaaugcauaucu

SEQ ID NO: 1096745 - RNA, 14 nt, Homo sapiens
gcaauuccccuaca

SEQ ID NO: 1096746 - RNA, 19 nt, Homo sapiens
gcacaccuaagcccaaaua

SEQ ID NO: 1096747 - RNA, 22 nt, Homo sapiens
gcacagccucuuagaugcaguu

SEQ ID NO: 1096748 - RNA, 16 nt, Homo sapiens
gcacaugacauagcac

SEQ ID NO: 1096749 - RNA, 18 nt, Homo sapiens
gcacaugacauagcacuu

SEQ ID NO: 1096750 - RNA, 19 nt, Homo sapiens
gcacaugacauagcacuug

SEQ ID NO: 1096751 - RNA, 14 nt, Homo sapiens
gcacggagggcagu

SEQ ID NO: 1096752 - RNA, 18 nt, Homo sapiens
gcacuugcagaccugccu

SEQ ID NO: 1096753 - RNA, 21 nt, Homo sapiens
gcagaacagcuucauguuccc

SEQ ID NO: 1096754 - RNA, 14 nt, Homo sapiens
gcagggauucuucc

SEQ ID NO: 1096755 - RNA, 14 nt, Homo sapiens
gcagucccgggugg

SEQ ID NO: 1096756 - RNA, 16 nt, Homo sapiens
gcaguucugaagaaga

SEQ ID NO: 1096757 - RNA, 16 nt, Homo sapiens
gcauagcacuugcaga

SEQ ID NO: 1096758 - RNA, 17 nt, Homo sapiens
gcaucaugaguugcaag

SEQ ID NO: 1096759 - RNA, 17 nt, Homo sapiens
gcaucauuaauaccuaa

SEQ ID NO: 1096760 - RNA, 23 nt, Homo sapiens
gcaucauuaauaccuaaacugua

SEQ ID NO: 1096761 - RNA, 18 nt, Homo sapiens
gcaugcaaaaaaugcuuu

SEQ ID NO: 1096762 - RNA, 19 nt, Homo sapiens
gcauggcuucacacuguuu

SEQ ID NO: 1096763 - RNA, 20 nt, Homo sapiens
gcauugucacagcuaccaaa

SEQ ID NO: 1096764 - RNA, 17 nt, Homo sapiens
gccacgcacagccagac

SEQ ID NO: 1096765 - RNA, 11 nt, Homo sapiens
gccauagcaac

SEQ ID NO: 1096766 - RNA, 16 nt, Homo sapiens
gcccacuaaaagaauu

SEQ ID NO: 1096767 - RNA, 14 nt, Homo sapiens
gcccagacaagauu

SEQ ID NO: 1096768 - RNA, 16 nt, Homo sapiens
gcccagacaagauuuu

SEQ ID NO: 1096769 - RNA, 22 nt, Homo sapiens
gccuagauaugaauauauggca

SEQ ID NO: 1096770 - RNA, 16 nt, Homo sapiens
gccuccugucccucau

SEQ ID NO: 1096771 - RNA, 17 nt, Homo sapiens
gccucuuagaugcaguu

SEQ ID NO: 1096772 - RNA, 13 nt, Homo sapiens
uuauaaaugucua

SEQ ID NO: 1096773 - RNA, 20 nt, Homo sapiens
uuauaacagggaacagcaaa

SEQ ID NO: 1096774 - RNA, 15 nt, Homo sapiens
uuauagaaauucuga

SEQ ID NO: 1096775 - RNA, 22 nt, Homo sapiens
uuauagaauaaaagcuguggaa

SEQ ID NO: 1096776 - RNA, 14 nt, Homo sapiens
uuauauuauuacua

SEQ ID NO: 1096777 - RNA, 14 nt, Homo sapiens
uuauggaaauacca

SEQ ID NO: 1096778 - RNA, 14 nt, Homo sapiens
uuauuggauucaca

SEQ ID NO: 1096779 - RNA, 18 nt, Homo sapiens
uuauuugcaggucuuuaa

SEQ ID NO: 1096780 - RNA, 13 nt, Homo sapiens
uucaaaauggaaa

SEQ ID NO: 1096781 - RNA, 18 nt, Homo sapiens
uucaagauccucuugcca

SEQ ID NO: 1096782 - RNA, 20 nt, Homo sapiens
uucaagauccucuugccaca

SEQ ID NO: 1096783 - RNA, 17 nt, Homo sapiens
uucacuacauugugcaa

SEQ ID NO: 1096784 - RNA, 23 nt, Homo sapiens
uucagcugugcuuuuugcaaaag

SEQ ID NO: 1096785 - RNA, 18 nt, Homo sapiens
uucagucuugccuuugaa

SEQ ID NO: 1096786 - RNA, 16 nt, Homo sapiens
uucauucugaaucuga

SEQ ID NO: 1096787 - RNA, 14 nt, Homo sapiens
uuccaagcaaguau

SEQ ID NO: 1096788 - RNA, 14 nt, Homo sapiens
uuccaugcccuugu

SEQ ID NO: 1096789 - RNA, 21 nt, Homo sapiens
uuccauuuuaaaaugcaucau

SEQ ID NO: 1096790 - RNA, 13 nt, Homo sapiens
uucccaacuccag

SEQ ID NO: 1096791 - RNA, 13 nt, Homo sapiens
uuccccuacauca

SEQ ID NO: 1096792 - RNA, 21 nt, Homo sapiens
uuccgagcacacauaaaagca

SEQ ID NO: 1096793 - RNA, 20 nt, Homo sapiens
uuccuucuggggcuuugcca

SEQ ID NO: 1096794 - RNA, 14 nt, Homo sapiens
uucuaaaccacaaa

SEQ ID NO: 1096795 - RNA, 16 nt, Homo sapiens
uucuacacauuucauc

SEQ ID NO: 1096796 - RNA, 23 nt, Homo sapiens
uucucuucuggacauguccagga

SEQ ID NO: 1096797 - RNA, 14 nt, Homo sapiens
uucugaccuuacaa

SEQ ID NO: 1096798 - RNA, 13 nt, Homo sapiens
uucuggcuguaga

SEQ ID NO: 1096799 - RNA, 13 nt, Homo sapiens
uucugguacagag

SEQ ID NO: 1096800 - RNA, 22 nt, Homo sapiens
uucuucuuuaaucacuuaacau

SEQ ID NO: 1096801 - RNA, 22 nt, Homo sapiens
uucuuuuccuuuauaaaugucu

SEQ ID NO: 1096802 - RNA, 18 nt, Homo sapiens
uugaaauauaguugaaag

SEQ ID NO: 1096803 - RNA, 12 nt, Homo sapiens
uugaaguauuag

SEQ ID NO: 1096804 - RNA, 18 nt, Homo sapiens
uugaaugccauagucaaa

SEQ ID NO: 1096805 - RNA, 19 nt, Homo sapiens
uugacagcugucauauaau

SEQ ID NO: 1096806 - RNA, 18 nt, Homo sapiens
uugaguaauucuagacau

SEQ ID NO: 1096807 - RNA, 16 nt, Homo sapiens
uugagugaggcaguga

SEQ ID NO: 1096808 - RNA, 19 nt, Homo sapiens
uugcaguaauuugcaauuu

SEQ ID NO: 1096809 - RNA, 23 nt, Homo sapiens
uugccaaucuuguuuuaagcaaa

SEQ ID NO: 1096810 - RNA, 15 nt, Homo sapiens
uugcuuggugcuggu

SEQ ID NO: 1096811 - RNA, 15 nt, Homo sapiens
uuggauucacaccca

SEQ ID NO: 1096812 - RNA, 16 nt, Homo sapiens
uuggcagcucuacucu

SEQ ID NO: 1096813 - RNA, 18 nt, Homo sapiens
uuggcuuuuguuacccac

SEQ ID NO: 1096814 - RNA, 16 nt, Homo sapiens
uugggaaaaauuauuu

SEQ ID NO: 1096815 - RNA, 11 nt, Homo sapiens
uugggggaaau

SEQ ID NO: 1096816 - RNA, 15 nt, Homo sapiens
uuggggguauuuucu

SEQ ID NO: 1096817 - RNA, 21 nt, Homo sapiens
uugguuugagaaaggcacaua

SEQ ID NO: 1096818 - RNA, 16 nt, Homo sapiens
uuguauuuaccuucua

SEQ ID NO: 1096819 - RNA, 20 nt, Homo sapiens
uuguauuuaccuucuaccuc

SEQ ID NO: 1096820 - RNA, 12 nt, Homo sapiens
uugucacaggac

SEQ ID NO: 1096821 - RNA, 18 nt, Homo sapiens
uugucacuagucuuugag

SEQ ID NO: 1096822 - RNA, 19 nt, Homo sapiens
uugucaguuuacaccaaua

SEQ ID NO: 1096823 - RNA, 16 nt, Homo sapiens
uugucauguaugugaa

SEQ ID NO: 1096824 - RNA, 22 nt, Homo sapiens
uuguccauuuaaaaaugaucug

SEQ ID NO: 1096825 - RNA, 16 nt, Homo sapiens
uugugauguguccuga

SEQ ID NO: 1096826 - RNA, 16 nt, Homo sapiens
uuguuacaccacauua

SEQ ID NO: 1096827 - RNA, 16 nt, Homo sapiens
uuguucucccaaaaca

SEQ ID NO: 1096828 - RNA, 14 nt, Homo sapiens
uuguugucuuuaug

SEQ ID NO: 1096829 - RNA, 13 nt, Homo sapiens
uuuaaaaaccgaa

SEQ ID NO: 1096830 - RNA, 22 nt, Homo sapiens
uuuaaaagagacaaacuguaaa

SEQ ID NO: 1096831 - RNA, 12 nt, Homo sapiens
uuuaaguaggca

SEQ ID NO: 1096832 - RNA, 17 nt, Homo sapiens
uuuaauguuugcacuga

SEQ ID NO: 1096833 - RNA, 13 nt, Homo sapiens
uuuacuggauaaa

SEQ ID NO: 1096834 - RNA, 23 nt, Homo sapiens
uuuauaauaaaaagcuucaggga

SEQ ID NO: 1096835 - RNA, 16 nt, Homo sapiens
uuuaucuuaacacuga

SEQ ID NO: 1096836 - RNA, 11 nt, Homo sapiens
uuuaugguucu

SEQ ID NO: 1096837 - RNA, 12 nt, Homo sapiens
uuuaugguucuc

SEQ ID NO: 1096838 - RNA, 16 nt, Homo sapiens
uuuauuuuucucauga

SEQ ID NO: 1096839 - RNA, 21 nt, Homo sapiens
uuucacuacucucuacucugu

SEQ ID NO: 1096840 - RNA, 19 nt, Homo sapiens
uuucaugacagaauauaca

SEQ ID NO: 1096841 - RNA, 17 nt, Homo sapiens
uuucuaccaucucacgg

SEQ ID NO: 1096842 - RNA, 22 nt, Homo sapiens
uuucugggggaaaaagccauau

SEQ ID NO: 1096843 - RNA, 19 nt, Homo sapiens
uuucuuguaaacauugccu

SEQ ID NO: 1096844 - RNA, 13 nt, Homo sapiens
uuugcucauggaa

SEQ ID NO: 1096845 - RNA, 11 nt, Homo sapiens
uuuggggcuca

SEQ ID NO: 1096846 - RNA, 13 nt, Homo sapiens
uuugucaguguau

SEQ ID NO: 1096847 - RNA, 14 nt, Homo sapiens
uuuuauacuugaaa

SEQ ID NO: 1096848 - RNA, 18 nt, Homo sapiens
uuuuauuuacauucuugc

SEQ ID NO: 1096849 - RNA, 23 nt, Homo sapiens
uuuucagggaagcugccaaagaa

SEQ ID NO: 1096850 - RNA, 18 nt, Homo sapiens
uuuuccaaacacaggcaa

SEQ ID NO: 1096851 - RNA, 14 nt, Homo sapiens
uuuuguuggucuga

SEQ ID NO: 1096852 - RNA, 19 nt, Homo sapiens
uuuuuaauuuuuugucaag

SEQ ID NO: 1096853 - RNA, 12 nt, Homo sapiens
aaaaaaauugca

SEQ ID NO: 1096854 - RNA, 12 nt, Homo sapiens
aaaaaacagagg

SEQ ID NO: 1096855 - RNA, 20 nt, Homo sapiens
aaaaaaguaaguaccacuca

SEQ ID NO: 1096856 - RNA, 20 nt, Homo sapiens
aaaaaauuaaauugcagaug

SEQ ID NO: 1096857 - RNA, 13 nt, Homo sapiens
aaaaacauuugua

SEQ ID NO: 1096858 - RNA, 13 nt, Homo sapiens
aaaaagucacaaa

SEQ ID NO: 1096859 - RNA, 23 nt, Homo sapiens
aaaaaguccuugauuuagcacua

SEQ ID NO: 1096860 - RNA, 13 nt, Homo sapiens
aaaaauauuauaa

SEQ ID NO: 1096861 - RNA, 13 nt, Homo sapiens
aaaacacuuccau

SEQ ID NO: 1096862 - RNA, 18 nt, Homo sapiens
aaaacagagaugugauaa

SEQ ID NO: 1096863 - RNA, 19 nt, Homo sapiens
aaaacauugauuauaagca

SEQ ID NO: 1096864 - RNA, 14 nt, Homo sapiens
aaaacauuuguaca

SEQ ID NO: 1096865 - RNA, 23 nt, Homo sapiens
aaaacauuuuacuuuaaaaggag

SEQ ID NO: 1096866 - RNA, 11 nt, Homo sapiens
aaaaccaauga

SEQ ID NO: 1096867 - RNA, 17 nt, Homo sapiens
aaaaccacuagaacucu

SEQ ID NO: 1096868 - RNA, 16 nt, Homo sapiens
aaaaccucacuugaag

SEQ ID NO: 1096869 - RNA, 14 nt, Homo sapiens
aaaacugacagagg

SEQ ID NO: 1096870 - RNA, 21 nt, Homo sapiens
aaaagaagacaacauuucuca

SEQ ID NO: 1096871 - RNA, 22 nt, Homo sapiens
aaaagcaagacuguugcucaaa

SEQ ID NO: 1096872 - RNA, 11 nt, Homo sapiens
aaaagcacuua

SEQ ID NO: 1096873 - RNA, 12 nt, Homo sapiens
aaaagggcaaua

SEQ ID NO: 1096874 - RNA, 22 nt, Homo sapiens
aaaaguaauuguagauggaaau

SEQ ID NO: 1096875 - RNA, 19 nt, Homo sapiens
aaaaguagguuuacauuca

SEQ ID NO: 1096876 - RNA, 18 nt, Homo sapiens
aaaagucuacgcucuccu

SEQ ID NO: 1096877 - RNA, 22 nt, Homo sapiens
aaaauauaagaacuugauauau

SEQ ID NO: 1096878 - RNA, 14 nt, Homo sapiens
aaaauauauuucag

SEQ ID NO: 1096879 - RNA, 14 nt, Homo sapiens
aaaauaugaaagac

SEQ ID NO: 1096880 - RNA, 17 nt, Homo sapiens
aaaauaugaaagacuua

SEQ ID NO: 1096881 - RNA, 19 nt, Homo sapiens
aaaauauuuuuaugugcaa

SEQ ID NO: 1096882 - RNA, 22 nt, Homo sapiens
aaaauauuuuuaugugcaauaa

SEQ ID NO: 1096883 - RNA, 22 nt, Homo sapiens
aaaaugaaaauuaggauuucau

SEQ ID NO: 1096884 - RNA, 18 nt, Homo sapiens
aaaaugcaacaacaugua

SEQ ID NO: 1096885 - RNA, 16 nt, Homo sapiens
aaaauggccauuugcu

SEQ ID NO: 1096886 - RNA, 17 nt, Homo sapiens
aaucccagcccuacccu

SEQ ID NO: 1096887 - RNA, 17 nt, Homo sapiens
aaucccagcuacucaag

SEQ ID NO: 1096888 - RNA, 17 nt, Homo sapiens
aauccuaaauaauguua

SEQ ID NO: 1096889 - RNA, 21 nt, Homo sapiens
aauccugucgauuagacugga

SEQ ID NO: 1096890 - RNA, 17 nt, Homo sapiens
aauccuucucacuaaaa

SEQ ID NO: 1096891 - RNA, 20 nt, Homo sapiens
aauccuuugugucgauuuca

SEQ ID NO: 1096892 - RNA, 17 nt, Homo sapiens
aaucgaccucacuguca

SEQ ID NO: 1096893 - RNA, 15 nt, Homo sapiens
aaucucuugucucac

SEQ ID NO: 1096894 - RNA, 17 nt, Homo sapiens
aaucugagagauuugaa

SEQ ID NO: 1096895 - RNA, 17 nt, Homo sapiens
aaucugaggaaggugcu

SEQ ID NO: 1096896 - RNA, 17 nt, Homo sapiens
aaucugauuggacauuu

SEQ ID NO: 1096897 - RNA, 19 nt, Homo sapiens
aaucuuuggguaacuucaa

SEQ ID NO: 1096898 - RNA, 13 nt, Homo sapiens
aaugaaagccaaa

SEQ ID NO: 1096899 - RNA, 13 nt, Homo sapiens
aaugaaccacgug

SEQ ID NO: 1096900 - RNA, 23 nt, Homo sapiens
aaugacaucuucaaagcuugaag

SEQ ID NO: 1096901 - RNA, 14 nt, Homo sapiens
aaugacccaaagac

SEQ ID NO: 1096902 - RNA, 14 nt, Homo sapiens
aaugaccucaagau

SEQ ID NO: 1096903 - RNA, 21 nt, Homo sapiens
aaugagaagaaugacuaugca

SEQ ID NO: 1096904 - RNA, 14 nt, Homo sapiens
aaugauuaucuccu

SEQ ID NO: 1096905 - RNA, 22 nt, Homo sapiens
aaugauuuagguacgucaaagc

SEQ ID NO: 1096906 - RNA, 13 nt, Homo sapiens
aaugcacaucuca

SEQ ID NO: 1096907 - RNA, 14 nt, Homo sapiens
aaugcacaucucau

SEQ ID NO: 1096908 - RNA, 22 nt, Homo sapiens
aaugcacugacauuguuggcca

SEQ ID NO: 1096909 - RNA, 20 nt, Homo sapiens
aaugcaguagccagcacguu

SEQ ID NO: 1096910 - RNA, 22 nt, Homo sapiens
aaugcaguccagaauaagugcu

SEQ ID NO: 1096911 - RNA, 20 nt, Homo sapiens
aaugccaaucuucaguauuu

SEQ ID NO: 1096912 - RNA, 16 nt, Homo sapiens
aaugccucaaugugac

SEQ ID NO: 1096913 - RNA, 21 nt, Homo sapiens
aaugcuuccuccuuggaagag

SEQ ID NO: 1096914 - RNA, 16 nt, Homo sapiens
aaugguaauuguugcu

SEQ ID NO: 1096915 - RNA, 22 nt, Homo sapiens
aaugguauggaacucucuccac

SEQ ID NO: 1096916 - RNA, 14 nt, Homo sapiens
aaugguuuacugcu

SEQ ID NO: 1096917 - RNA, 23 nt, Homo sapiens
aauguaauacuccuaagacuuau

SEQ ID NO: 1096918 - RNA, 23 nt, Homo sapiens
aauguaucuuauuuauauaugaa

SEQ ID NO: 1096919 - RNA, 20 nt, Homo sapiens
aauguauuuguuugcaauuu

SEQ ID NO: 1096920 - RNA, 11 nt, Homo sapiens
aaugucacaau

SEQ ID NO: 1096921 - RNA, 16 nt, Homo sapiens
aaugucacauaaugaa

SEQ ID NO: 1096922 - RNA, 12 nt, Homo sapiens
aaugucacuuaa

SEQ ID NO: 1096923 - RNA, 19 nt, Homo sapiens
aaugucagaaaccaguuau

SEQ ID NO: 1096924 - RNA, 13 nt, Homo sapiens
aaugucuguuuca

SEQ ID NO: 1096925 - RNA, 21 nt, Homo sapiens
aaugugauauuugaagcauca

SEQ ID NO: 1096926 - RNA, 14 nt, Homo sapiens
aauguguggugcua

SEQ ID NO: 1096927 - RNA, 23 nt, Homo sapiens
aauguucucuggguagguguuga

SEQ ID NO: 1096928 - RNA, 21 nt, Homo sapiens
aauuaaacaagugcacuugaa

SEQ ID NO: 1096929 - RNA, 18 nt, Homo sapiens
aauuaaguaaaccaaaaa

SEQ ID NO: 1096930 - RNA, 22 nt, Homo sapiens
aauuacuucucucuaucuggaa

SEQ ID NO: 1096931 - RNA, 12 nt, Homo sapiens
aauuacuucuuc

SEQ ID NO: 1096932 - RNA, 21 nt, Homo sapiens
aauuaggagaggcagagauag

SEQ ID NO: 1096933 - RNA, 16 nt, Homo sapiens
aauuaguacaguagcu

SEQ ID NO: 1096934 - RNA, 18 nt, Homo sapiens
aauucaacauauaccuua

SEQ ID NO: 1096935 - RNA, 12 nt, Homo sapiens
aauucaaccacu

SEQ ID NO: 1096936 - RNA, 23 nt, Homo sapiens
aauucauucucugugguauccaa

SEQ ID NO: 1096937 - RNA, 18 nt, Homo sapiens
aauuccaucccaucaucu

SEQ ID NO: 1096938 - RNA, 22 nt, Homo sapiens
aauuccuaauaaguuugaucaa

SEQ ID NO: 1096939 - RNA, 22 nt, Homo sapiens
aauuccuguauucuacagcaga

SEQ ID NO: 1096940 - RNA, 23 nt, Homo sapiens
aauuccuuagcuuagaccucagc

SEQ ID NO: 1096941 - RNA, 15 nt, Homo sapiens
aauucuacuaaauau

SEQ ID NO: 1096942 - RNA, 14 nt, Homo sapiens
aauucuaugagaua

SEQ ID NO: 1096943 - RNA, 16 nt, Homo sapiens
aauucucaaccuacca

SEQ ID NO: 1096944 - RNA, 16 nt, Homo sapiens
aauucucaugugaucc

SEQ ID NO: 1096945 - RNA, 23 nt, Homo sapiens
aauucucaugugauccuuuuaug

SEQ ID NO: 1096946 - RNA, 17 nt, Homo sapiens
aauucucauuugucaca

SEQ ID NO: 1096947 - RNA, 18 nt, Homo sapiens
aauucucauuugucacac

SEQ ID NO: 1096948 - RNA, 15 nt, Homo sapiens
aauucugcucagaua

SEQ ID NO: 1096949 - RNA, 19 nt, Homo sapiens
aauugaaauauaaugcaaa

SEQ ID NO: 1096950 - RNA, 18 nt, Homo sapiens
aauugacugagacuggaa

SEQ ID NO: 1096951 - RNA, 23 nt, Homo sapiens
aauugauguugcuggacugucau

SEQ ID NO: 1096952 - RNA, 22 nt, Homo sapiens
aauugcagaugguuaaauauca

SEQ ID NO: 1096953 - RNA, 16 nt, Homo sapiens
aauugcauuucugcuc

SEQ ID NO: 1096954 - RNA, 21 nt, Homo sapiens
aauugucauuuauaaaaccau

SEQ ID NO: 1096955 - RNA, 20 nt, Homo sapiens
aauugucuuuugucaugugg

SEQ ID NO: 1096956 - RNA, 11 nt, Homo sapiens
aauuguugcua

SEQ ID NO: 1096957 - RNA, 15 nt, Homo sapiens
aauuuaaaaucauuc

SEQ ID NO: 1096958 - RNA, 19 nt, Homo sapiens
aauuuaaaauuaaaugcau

SEQ ID NO: 1096959 - RNA, 17 nt, Homo sapiens
aauuuaaaccagcagaa

SEQ ID NO: 1096960 - RNA, 15 nt, Homo sapiens
aauuuaauauagcua

SEQ ID NO: 1096961 - RNA, 21 nt, Homo sapiens
aauuuauauaaaaauaccuua

SEQ ID NO: 1096962 - RNA, 20 nt, Homo sapiens
aauuuauuucaaaaagggaa

SEQ ID NO: 1096963 - RNA, 23 nt, Homo sapiens
aauuucacauuaauauuugcuga

SEQ ID NO: 1096964 - RNA, 18 nt, Homo sapiens
aauuucacgucgucuucu

SEQ ID NO: 1096965 - RNA, 15 nt, Homo sapiens
aauuucaguaaacaa

SEQ ID NO: 1096966 - RNA, 20 nt, Homo sapiens
aauuucaguaaacaaugaau

SEQ ID NO: 1096967 - RNA, 23 nt, Homo sapiens
aauuucugaacaccauagguaga

SEQ ID NO: 1096968 - RNA, 12 nt, Homo sapiens
aauuugccugua

SEQ ID NO: 1096969 - RNA, 19 nt, Homo sapiens
aauuuguuuuauauucucu

SEQ ID NO: 1096970 - RNA, 13 nt, Homo sapiens
aauuuuaccaaaa

SEQ ID NO: 1096971 - RNA, 16 nt, Homo sapiens
aauuuuagcgugcuca

SEQ ID NO: 1096972 - RNA, 18 nt, Homo sapiens
aauuuuaugugcuucaca

SEQ ID NO: 1096973 - RNA, 15 nt, Homo sapiens
aauuuucaguauaau

SEQ ID NO: 1096974 - RNA, 14 nt, Homo sapiens
aauuuugcauugug

SEQ ID NO: 1096975 - RNA, 21 nt, Homo sapiens
aauuuuguaguaguugaugac

SEQ ID NO: 1096976 - RNA, 17 nt, Homo sapiens
auaaauucagauauauu

SEQ ID NO: 1096977 - RNA, 20 nt, Homo sapiens
auaacaagaucuuucaggaa

SEQ ID NO: 1096978 - RNA, 23 nt, Homo sapiens
auaacauaaauuuaucaucucga

SEQ ID NO: 1096979 - RNA, 16 nt, Homo sapiens
auaaccccaccuugcc

SEQ ID NO: 1096980 - RNA, 20 nt, Homo sapiens
auaaccuucaugaugaauua

SEQ ID NO: 1096981 - RNA, 21 nt, Homo sapiens
auaacuuauaucaucagcaua

SEQ ID NO: 1096982 - RNA, 13 nt, Homo sapiens
auaacuugauaua

SEQ ID NO: 1096983 - RNA, 13 nt, Homo sapiens
auaagaagcaaau

SEQ ID NO: 1096984 - RNA, 16 nt, Homo sapiens
auaagauuaaaggaag

SEQ ID NO: 1096985 - RNA, 17 nt, Homo sapiens
auaagcaaagacuauga

SEQ ID NO: 1096986 - RNA, 13 nt, Homo sapiens
auaaguacauuau

SEQ ID NO: 1096987 - RNA, 14 nt, Homo sapiens
auaauaauuuuccu

SEQ ID NO: 1096988 - RNA, 19 nt, Homo sapiens
auaaucacauuaucaucug

SEQ ID NO: 1096989 - RNA, 21 nt, Homo sapiens
auaaucacauuaucaucugaa

SEQ ID NO: 1096990 - RNA, 14 nt, Homo sapiens
auaaucacauugac

SEQ ID NO: 1096991 - RNA, 17 nt, Homo sapiens
auaaugcuguugccuca

SEQ ID NO: 1096992 - RNA, 18 nt, Homo sapiens
auaaugguugacuggguu

SEQ ID NO: 1096993 - RNA, 16 nt, Homo sapiens
auaauguuacauuauu

SEQ ID NO: 1096994 - RNA, 21 nt, Homo sapiens
auaauguuacauuauuaucaa

SEQ ID NO: 1096995 - RNA, 22 nt, Homo sapiens
auaauguuaucuguguagcaag

SEQ ID NO: 1096996 - RNA, 19 nt, Homo sapiens
auaauuuucuggcacuggu

SEQ ID NO: 1096997 - RNA, 18 nt, Homo sapiens
auacaauuaaagcuguua

SEQ ID NO: 1096998 - RNA, 14 nt, Homo sapiens
auacaccuauguca

SEQ ID NO: 1096999 - RNA, 16 nt, Homo sapiens
auacagaaaaugcuuu

SEQ ID NO: 1097000 - RNA, 20 nt, Homo sapiens
auacauucuuuaucuugaca

SEQ ID NO: 1097001 - RNA, 18 nt, Homo sapiens
auaccagugaaccaaaga

SEQ ID NO: 1097002 - RNA, 17 nt, Homo sapiens
auacccugaauuuggcc

SEQ ID NO: 1097003 - RNA, 21 nt, Homo sapiens
auaccucaacccccauuucua

SEQ ID NO: 1097004 - RNA, 19 nt, Homo sapiens
auaccuguguuucuugccu

SEQ ID NO: 1097005 - RNA, 22 nt, Homo sapiens
auaccuguguuucuugccucau

SEQ ID NO: 1097006 - RNA, 21 nt, Homo sapiens
auaccuuacugagagcauguu

SEQ ID NO: 1097007 - RNA, 21 nt, Homo sapiens
auacgccuguaguccuagcca

SEQ ID NO: 1097008 - RNA, 19 nt, Homo sapiens
auacugacacuuugccaga

SEQ ID NO: 1097009 - RNA, 12 nt, Homo sapiens
auacugcaugcu

SEQ ID NO: 1097010 - RNA, 15 nt, Homo sapiens
auacugcaugcucag

SEQ ID NO: 1097011 - RNA, 17 nt, Homo sapiens
auacugcaugcucagga

SEQ ID NO: 1097012 - RNA, 21 nt, Homo sapiens
auacugcucaucauuccuuga

SEQ ID NO: 1097013 - RNA, 15 nt, Homo sapiens
auacuuaacauugau

SEQ ID NO: 1097014 - RNA, 16 nt, Homo sapiens
auacuucuaccaacau

SEQ ID NO: 1097015 - RNA, 21 nt, Homo sapiens
auagacuguacuuauuuucca

SEQ ID NO: 1097016 - RNA, 18 nt, Homo sapiens
auagcaguugaaacaaga

SEQ ID NO: 1097017 - RNA, 23 nt, Homo sapiens
auagcaguugaaacaagaagcca

SEQ ID NO: 1097018 - RNA, 14 nt, Homo sapiens
auagccaacugcug

SEQ ID NO: 1097019 - RNA, 18 nt, Homo sapiens
auagccacuuaccuucaa

SEQ ID NO: 1097020 - RNA, 17 nt, Homo sapiens
auagccuacguuaaccc

SEQ ID NO: 1097021 - RNA, 23 nt, Homo sapiens
auagcugggaacccgacugugaa

SEQ ID NO: 1097022 - RNA, 21 nt, Homo sapiens
auaggagagauaccuugaaaa

SEQ ID NO: 1097023 - RNA, 16 nt, Homo sapiens
auaggcugcauaugag

SEQ ID NO: 1097024 - RNA, 23 nt, Homo sapiens
auaguaauagggcccuuagcucu

SEQ ID NO: 1097025 - RNA, 19 nt, Homo sapiens
auaguacuggcaugguacg

SEQ ID NO: 1097026 - RNA, 15 nt, Homo sapiens
auaguauugugcaua

SEQ ID NO: 1097027 - RNA, 22 nt, Homo sapiens
auaguauugugcauagagccac

SEQ ID NO: 1097028 - RNA, 14 nt, Homo sapiens
auagucacaaaaau

SEQ ID NO: 1097029 - RNA, 14 nt, Homo sapiens
auagucacaagagc

SEQ ID NO: 1097030 - RNA, 23 nt, Homo sapiens
auagugauugauagaguguuauc

SEQ ID NO: 1097031 - RNA, 15 nt, Homo sapiens
auauaaaaugcuuua

SEQ ID NO: 1097032 - RNA, 15 nt, Homo sapiens
auauaaaguguaaua

SEQ ID NO: 1097033 - RNA, 22 nt, Homo sapiens
auauacagcucagaaguuucuu

SEQ ID NO: 1097034 - RNA, 16 nt, Homo sapiens
auauagaggagcacua

SEQ ID NO: 1097035 - RNA, 19 nt, Homo sapiens
auauagaggagcacuauua

SEQ ID NO: 1097036 - RNA, 22 nt, Homo sapiens
auauaguauauuuauacucuag

SEQ ID NO: 1097037 - RNA, 15 nt, Homo sapiens
auauauauauaguaa

SEQ ID NO: 1097038 - RNA, 18 nt, Homo sapiens
auauaugacuuuuucuca

SEQ ID NO: 1097039 - RNA, 18 nt, Homo sapiens
auauaugcucaaccagaa

SEQ ID NO: 1097040 - RNA, 22 nt, Homo sapiens
auauauuuauuuaagcuuaugu

SEQ ID NO: 1097041 - RNA, 21 nt, Homo sapiens
auauauuuuugguugucaaua

SEQ ID NO: 1097042 - RNA, 13 nt, Homo sapiens
auaucaucagcau

SEQ ID NO: 1097043 - RNA, 15 nt, Homo sapiens
auaucaucagcauac

SEQ ID NO: 1097044 - RNA, 16 nt, Homo sapiens
auaucaucagcauacc

SEQ ID NO: 1097045 - RNA, 18 nt, Homo sapiens
auaucaucagcauaccuu

SEQ ID NO: 1097046 - RNA, 17 nt, Homo sapiens
auaucauuuuuuuaaca

SEQ ID NO: 1097047 - RNA, 18 nt, Homo sapiens
auaucuauaguagucaau

SEQ ID NO: 1097048 - RNA, 21 nt, Homo sapiens
auaucugacaguuacucuuca

SEQ ID NO: 1097049 - RNA, 19 nt, Homo sapiens
auaucuucauacaaugaca

SEQ ID NO: 1097050 - RNA, 15 nt, Homo sapiens
auaucuugaaacaua

SEQ ID NO: 1097051 - RNA, 17 nt, Homo sapiens
auaucuugaaagggguu

SEQ ID NO: 1097052 - RNA, 17 nt, Homo sapiens
auaugacuuuuucucag

SEQ ID NO: 1097053 - RNA, 21 nt, Homo sapiens
auaugaucauguaaaugauua

SEQ ID NO: 1097054 - RNA, 13 nt, Homo sapiens
auaugcacaugua

SEQ ID NO: 1097055 - RNA, 20 nt, Homo sapiens
auaugcaccaaaucaucucu

SEQ ID NO: 1097056 - RNA, 17 nt, Homo sapiens
auauggacucugcacau

SEQ ID NO: 1097057 - RNA, 21 nt, Homo sapiens
auauggacucugcacaugaau

SEQ ID NO: 1097058 - RNA, 16 nt, Homo sapiens
auauggugggcacaga

SEQ ID NO: 1097059 - RNA, 19 nt, Homo sapiens
auauguacaguuauacaua

SEQ ID NO: 1097060 - RNA, 22 nt, Homo sapiens
auauguaggugucugcacccag

SEQ ID NO: 1097061 - RNA, 14 nt, Homo sapiens
auauguucauuaaa

SEQ ID NO: 1097062 - RNA, 13 nt, Homo sapiens
auauguugcugaa

SEQ ID NO: 1097063 - RNA, 18 nt, Homo sapiens
auauuauaaauaaaugcc

SEQ ID NO: 1097064 - RNA, 18 nt, Homo sapiens
auauuauuugcuaauuaa

SEQ ID NO: 1097065 - RNA, 18 nt, Homo sapiens
auauuccugcauuuguga

SEQ ID NO: 1097066 - RNA, 18 nt, Homo sapiens
auuaugagucucuaugau

SEQ ID NO: 1097067 - RNA, 18 nt, Homo sapiens
auuauuauucuucauaac

SEQ ID NO: 1097068 - RNA, 12 nt, Homo sapiens
auuauuguugca

SEQ ID NO: 1097069 - RNA, 15 nt, Homo sapiens
auuauuuacaaugca

SEQ ID NO: 1097070 - RNA, 21 nt, Homo sapiens
auuauuucaaccgcuugccau

SEQ ID NO: 1097071 - RNA, 17 nt, Homo sapiens
auuauuuuagucuguca

SEQ ID NO: 1097072 - RNA, 17 nt, Homo sapiens
auucaaacugccuauau

SEQ ID NO: 1097073 - RNA, 16 nt, Homo sapiens
auucaaacugcuccaa

SEQ ID NO: 1097074 - RNA, 15 nt, Homo sapiens
auucaaagcacuguu

SEQ ID NO: 1097075 - RNA, 18 nt, Homo sapiens
auucaacuaguaccacag

SEQ ID NO: 1097076 - RNA, 20 nt, Homo sapiens
auucacacaccccucaaaaa

SEQ ID NO: 1097077 - RNA, 14 nt, Homo sapiens
auucacagagccuu

SEQ ID NO: 1097078 - RNA, 15 nt, Homo sapiens
auucacaucucaugu

SEQ ID NO: 1097079 - RNA, 22 nt, Homo sapiens
auucaccuuccagugucucgga

SEQ ID NO: 1097080 - RNA, 15 nt, Homo sapiens
auucacuagaccaga

SEQ ID NO: 1097081 - RNA, 18 nt, Homo sapiens
auucacuagaccagaagu

SEQ ID NO: 1097082 - RNA, 17 nt, Homo sapiens
auucagaucguauuaau

SEQ ID NO: 1097083 - RNA, 23 nt, Homo sapiens
auucagugcuguacuugaugaca

SEQ ID NO: 1097084 - RNA, 20 nt, Homo sapiens
auucauccaguugcaauaaa

SEQ ID NO: 1097085 - RNA, 19 nt, Homo sapiens
auucaucucucuuuaauau

SEQ ID NO: 1097086 - RNA, 22 nt, Homo sapiens
auucaugccagggacugacaaa

SEQ ID NO: 1097087 - RNA, 16 nt, Homo sapiens
auucauuuaacagagc

SEQ ID NO: 1097088 - RNA, 18 nt, Homo sapiens
auucauuuuaacaucuga

SEQ ID NO: 1097089 - RNA, 23 nt, Homo sapiens
auucauuuuucuuucugauguca

SEQ ID NO: 1097090 - RNA, 15 nt, Homo sapiens
auuccaaaguuuuga

SEQ ID NO: 1097091 - RNA, 14 nt, Homo sapiens
auuccaacagcuca

SEQ ID NO: 1097092 - RNA, 16 nt, Homo sapiens
auuccaccuucccaug

SEQ ID NO: 1097093 - RNA, 13 nt, Homo sapiens
auuccacuggacu

SEQ ID NO: 1097094 - RNA, 16 nt, Homo sapiens
auucccacagcacuaa

SEQ ID NO: 1097095 - RNA, 21 nt, Homo sapiens
auucccacagcacuaauucaa

SEQ ID NO: 1097096 - RNA, 20 nt, Homo sapiens
auucccagcugucuguguca

SEQ ID NO: 1097097 - RNA, 19 nt, Homo sapiens
auucccuaucuuuuaguuu

SEQ ID NO: 1097098 - RNA, 14 nt, Homo sapiens
auucccucuugcua

SEQ ID NO: 1097099 - RNA, 15 nt, Homo sapiens
auuccuguagcaucu

SEQ ID NO: 1097100 - RNA, 14 nt, Homo sapiens
auuccuuacuguaa

SEQ ID NO: 1097101 - RNA, 15 nt, Homo sapiens
auucggauuugacaa

SEQ ID NO: 1097102 - RNA, 16 nt, Homo sapiens
auucuaagauuguaca

SEQ ID NO: 1097103 - RNA, 15 nt, Homo sapiens
auucuagcuuucaaa

SEQ ID NO: 1097104 - RNA, 19 nt, Homo sapiens
auucuauuacgugcaauac

SEQ ID NO: 1097105 - RNA, 14 nt, Homo sapiens
auucucaccaggaa

SEQ ID NO: 1097106 - RNA, 17 nt, Homo sapiens
auucucagugcucuccu

SEQ ID NO: 1097107 - RNA, 17 nt, Homo sapiens
auucucauuugucacac

SEQ ID NO: 1097108 - RNA, 15 nt, Homo sapiens
auucugaccauuuca

SEQ ID NO: 1097109 - RNA, 22 nt, Homo sapiens
auucugccuccauucugaccau

SEQ ID NO: 1097110 - RNA, 22 nt, Homo sapiens
auucugcucagauagaaugaca

SEQ ID NO: 1097111 - RNA, 17 nt, Homo sapiens
auucuggaaaagcaaaa

SEQ ID NO: 1097112 - RNA, 22 nt, Homo sapiens
auucuggaaaagcaaaacugua

SEQ ID NO: 1097113 - RNA, 21 nt, Homo sapiens
auucugggcuccuggaaccaa

SEQ ID NO: 1097114 - RNA, 23 nt, Homo sapiens
auucugggcuccuggaaccaauc

SEQ ID NO: 1097115 - RNA, 20 nt, Homo sapiens
auucuuacaaacaugugguu

SEQ ID NO: 1097116 - RNA, 17 nt, Homo sapiens
auucuucaucagcauuu

SEQ ID NO: 1097117 - RNA, 13 nt, Homo sapiens
auucuucugcuuc

SEQ ID NO: 1097118 - RNA, 12 nt, Homo sapiens
auucuucuguac

SEQ ID NO: 1097119 - RNA, 15 nt, Homo sapiens
auucuugacauucac

SEQ ID NO: 1097120 - RNA, 19 nt, Homo sapiens
auucuuguauauuauggaa

SEQ ID NO: 1097121 - RNA, 22 nt, Homo sapiens
auucuuugaauuucccagucuc

SEQ ID NO: 1097122 - RNA, 20 nt, Homo sapiens
auucuuuucuuuuccauuua

SEQ ID NO: 1097123 - RNA, 12 nt, Homo sapiens
auugaacuacuu

SEQ ID NO: 1097124 - RNA, 19 nt, Homo sapiens
auugaaucugauuggacau

SEQ ID NO: 1097125 - RNA, 14 nt, Homo sapiens
auugacacacagca

SEQ ID NO: 1097126 - RNA, 17 nt, Homo sapiens
auugacacacagcacuc

SEQ ID NO: 1097127 - RNA, 19 nt, Homo sapiens
auugagauaauaucuguga

SEQ ID NO: 1097128 - RNA, 21 nt, Homo sapiens
auugagauaauaucugugagg

SEQ ID NO: 1097129 - RNA, 18 nt, Homo sapiens
auugauagaguguuauca

SEQ ID NO: 1097130 - RNA, 13 nt, Homo sapiens
auugauguugcug

SEQ ID NO: 1097131 - RNA, 11 nt, Homo sapiens
auugcacucag

SEQ ID NO: 1097132 - RNA, 14 nt, Homo sapiens
auugccauucugau

SEQ ID NO: 1097133 - RNA, 16 nt, Homo sapiens
auugcgccacugcacu

SEQ ID NO: 1097134 - RNA, 19 nt, Homo sapiens
auuggaccauccuauuuaa

SEQ ID NO: 1097135 - RNA, 22 nt, Homo sapiens
auugggaagcugggggaagggu

SEQ ID NO: 1097136 - RNA, 18 nt, Homo sapiens
auuggggaagacuguggc

SEQ ID NO: 1097137 - RNA, 19 nt, Homo sapiens
auuggguacccaguuaaau

SEQ ID NO: 1097138 - RNA, 19 nt, Homo sapiens
auugguauauuuccauuca

SEQ ID NO: 1097139 - RNA, 22 nt, Homo sapiens
auugguccagcuugcucuucag

SEQ ID NO: 1097140 - RNA, 13 nt, Homo sapiens
auuguacacuauc

SEQ ID NO: 1097141 - RNA, 15 nt, Homo sapiens
auuguaguguucaaa

SEQ ID NO: 1097142 - RNA, 13 nt, Homo sapiens
auugucaccuaac

SEQ ID NO: 1097143 - RNA, 18 nt, Homo sapiens
auugugauauuuuuacuu

SEQ ID NO: 1097144 - RNA, 18 nt, Homo sapiens
auugugaucagaccauaa

SEQ ID NO: 1097145 - RNA, 15 nt, Homo sapiens
auugugccucuggcu

SEQ ID NO: 1097146 - RNA, 22 nt, Homo sapiens
auuguguucucuauugcugcuc

SEQ ID NO: 1097147 - RNA, 21 nt, Homo sapiens
auuguuccaaaugaauguugu

SEQ ID NO: 1097148 - RNA, 18 nt, Homo sapiens
auuguuuuugcucaaggc

SEQ ID NO: 1097149 - RNA, 21 nt, Homo sapiens
auuuaaaaaacuaacacccag

SEQ ID NO: 1097150 - RNA, 18 nt, Homo sapiens
auuuaaaagcaucucagc

SEQ ID NO: 1097151 - RNA, 13 nt, Homo sapiens
auuuaaaccagca

SEQ ID NO: 1097152 - RNA, 15 nt, Homo sapiens
auuuaacacuaaaaa

SEQ ID NO: 1097153 - RNA, 13 nt, Homo sapiens
auuuaacagagcu

SEQ ID NO: 1097154 - RNA, 21 nt, Homo sapiens
auuuacugaaguuauuuauua

SEQ ID NO: 1097155 - RNA, 20 nt, Homo sapiens
auuuacuuaauggguacaau

SEQ ID NO: 1097156 - RNA, 20 nt, Homo sapiens
auuuagaaaacauucaucca

SEQ ID NO: 1097157 - RNA, 14 nt, Homo sapiens
cagaagacacugca

SEQ ID NO: 1097158 - RNA, 16 nt, Homo sapiens
cagaagacacugcaaa

SEQ ID NO: 1097159 - RNA, 21 nt, Homo sapiens
cagaagcacauaugaacugga

SEQ ID NO: 1097160 - RNA, 16 nt, Homo sapiens
cagaagucuugucuca

SEQ ID NO: 1097161 - RNA, 14 nt, Homo sapiens
cagaaguuccucaa

SEQ ID NO: 1097162 - RNA, 13 nt, Homo sapiens
cagaauccaaaga

SEQ ID NO: 1097163 - RNA, 15 nt, Homo sapiens
cagaauguacggaaa

SEQ ID NO: 1097164 - RNA, 17 nt, Homo sapiens
cagaauucuaagcuggu

SEQ ID NO: 1097165 - RNA, 13 nt, Homo sapiens
cagacaccugugc

SEQ ID NO: 1097166 - RNA, 20 nt, Homo sapiens
cagacccccacucucauucc

SEQ ID NO: 1097167 - RNA, 18 nt, Homo sapiens
cagaccuucaacuuccaa

SEQ ID NO: 1097168 - RNA, 22 nt, Homo sapiens
cagacuacagccagaagcccau

SEQ ID NO: 1097169 - RNA, 18 nt, Homo sapiens
cagacucaauaaaaucau

SEQ ID NO: 1097170 - RNA, 16 nt, Homo sapiens
cagacucagacuccau

SEQ ID NO: 1097171 - RNA, 19 nt, Homo sapiens
cagacucagacuccauuug

SEQ ID NO: 1097172 - RNA, 16 nt, Homo sapiens
cagacucaguuuguca

SEQ ID NO: 1097173 - RNA, 20 nt, Homo sapiens
cagacucuacagaggccaug

SEQ ID NO: 1097174 - RNA, 14 nt, Homo sapiens
cagacuuuaccacu

SEQ ID NO: 1097175 - RNA, 21 nt, Homo sapiens
cagagaaguucuggcugaaca

SEQ ID NO: 1097176 - RNA, 20 nt, Homo sapiens
cagagacaauaaaacauucc

SEQ ID NO: 1097177 - RNA, 19 nt, Homo sapiens
cagagacaggcccaagaga

SEQ ID NO: 1097178 - RNA, 22 nt, Homo sapiens
cagagacauacaccuaugucau

SEQ ID NO: 1097179 - RNA, 21 nt, Homo sapiens
cagagacccagaucucaugga

SEQ ID NO: 1097180 - RNA, 14 nt, Homo sapiens
cagagacuaucuga

SEQ ID NO: 1097181 - RNA, 14 nt, Homo sapiens
cagagcagaaccaa

SEQ ID NO: 1097182 - RNA, 14 nt, Homo sapiens
cagagccuucacaa

SEQ ID NO: 1097183 - RNA, 20 nt, Homo sapiens
cagagcgagauuccgucuua

SEQ ID NO: 1097184 - RNA, 14 nt, Homo sapiens
cagagcuggaacac

SEQ ID NO: 1097185 - RNA, 23 nt, Homo sapiens
cagaggcgucucacauuuuuacu

SEQ ID NO: 1097186 - RNA, 15 nt, Homo sapiens
cagagggcccaggca

SEQ ID NO: 1097187 - RNA, 14 nt, Homo sapiens
cagaggggaaacca

SEQ ID NO: 1097188 - RNA, 18 nt, Homo sapiens
cagagguaaaagugugag

SEQ ID NO: 1097189 - RNA, 12 nt, Homo sapiens
cagagucucacu

SEQ ID NO: 1097190 - RNA, 20 nt, Homo sapiens
cagagugagacucugucuca

SEQ ID NO: 1097191 - RNA, 15 nt, Homo sapiens
cagauaaacaacaaa

SEQ ID NO: 1097192 - RNA, 21 nt, Homo sapiens
cagauaacaaccccggacaaa

SEQ ID NO: 1097193 - RNA, 14 nt, Homo sapiens
cagauaacucuccu

SEQ ID NO: 1097194 - RNA, 22 nt, Homo sapiens
cagauagcaucuuauacgagua

SEQ ID NO: 1097195 - RNA, 23 nt, Homo sapiens
cagauaucagaaucauugaagua

SEQ ID NO: 1097196 - RNA, 22 nt, Homo sapiens
cagaucacccggggcuuacuua

SEQ ID NO: 1097197 - RNA, 20 nt, Homo sapiens
cagaucagauucuucucuua

SEQ ID NO: 1097198 - RNA, 16 nt, Homo sapiens
cagaugagcagucaca

SEQ ID NO: 1097199 - RNA, 21 nt, Homo sapiens
cagaugcaaucucuugucuca

SEQ ID NO: 1097200 - RNA, 14 nt, Homo sapiens
cagaugcaccagcc

SEQ ID NO: 1097201 - RNA, 19 nt, Homo sapiens
cagaugcagccgugcagga

SEQ ID NO: 1097202 - RNA, 17 nt, Homo sapiens
cagauggaaagaaagca

SEQ ID NO: 1097203 - RNA, 15 nt, Homo sapiens
cagauggagacauug

SEQ ID NO: 1097204 - RNA, 16 nt, Homo sapiens
cagauggaguaccaug

SEQ ID NO: 1097205 - RNA, 17 nt, Homo sapiens
cagaugguuaaauauca

SEQ ID NO: 1097206 - RNA, 21 nt, Homo sapiens
cagauuugcaaaguuuaaugg

SEQ ID NO: 1097207 - RNA, 14 nt, Homo sapiens
cagauuuguguuau

SEQ ID NO: 1097208 - RNA, 21 nt, Homo sapiens
cagcaaaagaagacaacauuu

SEQ ID NO: 1097209 - RNA, 18 nt, Homo sapiens
cagcaagugagagcuggg

SEQ ID NO: 1097210 - RNA, 23 nt, Homo sapiens
cagcaauacuaagggaagaaaca

SEQ ID NO: 1097211 - RNA, 21 nt, Homo sapiens
cagcacuaaagcaguggacac

SEQ ID NO: 1097212 - RNA, 14 nt, Homo sapiens
cagcacuaauucaa

SEQ ID NO: 1097213 - RNA, 17 nt, Homo sapiens
cagcacuaauucaacau

SEQ ID NO: 1097214 - RNA, 15 nt, Homo sapiens
cagcagaaagguuag

SEQ ID NO: 1097215 - RNA, 24 nt, Homo sapiens
cagcagaaagguuaguaucaucag

SEQ ID NO: 1097216 - RNA, 17 nt, Homo sapiens
cagcaggaggcuagcaa

SEQ ID NO: 1097217 - RNA, 22 nt, Homo sapiens
cagcagugugucaggugcugca

SEQ ID NO: 1097218 - RNA, 17 nt, Homo sapiens
cagcaugcugagauuac

SEQ ID NO: 1097219 - RNA, 14 nt, Homo sapiens
cagccacacuucuc

SEQ ID NO: 1097220 - RNA, 12 nt, Homo sapiens
cagccaccucuc

SEQ ID NO: 1097221 - RNA, 21 nt, Homo sapiens
cagccaucaagagacugaguc

SEQ ID NO: 1097222 - RNA, 18 nt, Homo sapiens
cagccauuaccauggaga

SEQ ID NO: 1097223 - RNA, 16 nt, Homo sapiens
cagccccagugcccac

SEQ ID NO: 1097224 - RNA, 23 nt, Homo sapiens
cagccccuccuccccuuccugca

SEQ ID NO: 1097225 - RNA, 16 nt, Homo sapiens
cagcccgacaggcaug

SEQ ID NO: 1097226 - RNA, 13 nt, Homo sapiens
cagccucaagucu

SEQ ID NO: 1097227 - RNA, 20 nt, Homo sapiens
cagccuccccccgcugggga

SEQ ID NO: 1097228 - RNA, 17 nt, Homo sapiens
cagccuccuccugacca

SEQ ID NO: 1097229 - RNA, 21 nt, Homo sapiens
cagccugcagacucacugugg

SEQ ID NO: 1097230 - RNA, 17 nt, Homo sapiens
cagccuggccaacaugg

SEQ ID NO: 1097231 - RNA, 20 nt, Homo sapiens
cagccugggcaacagagcaa

SEQ ID NO: 1097232 - RNA, 19 nt, Homo sapiens
cagccugggcagcauagca

SEQ ID NO: 1097233 - RNA, 19 nt, Homo sapiens
cagccugggugacagagca

SEQ ID NO: 1097234 - RNA, 20 nt, Homo sapiens
cagccugguuuucacauaca

SEQ ID NO: 1097235 - RNA, 17 nt, Homo sapiens
cagcgaaaggauguaaa

SEQ ID NO: 1097236 - RNA, 14 nt, Homo sapiens
cagcgaacaugccu

SEQ ID NO: 1097237 - RNA, 21 nt, Homo sapiens
cagcgagcuaugaucgcgcca

SEQ ID NO: 1097238 - RNA, 14 nt, Homo sapiens
cagcgccaccucuu

SEQ ID NO: 1097239 - RNA, 22 nt, Homo sapiens
cagcuaagcccccuacugagaa

SEQ ID NO: 1097240 - RNA, 15 nt, Homo sapiens
cagcucagaggccca

SEQ ID NO: 1097241 - RNA, 15 nt, Homo sapiens
cagcuccuucugucc

SEQ ID NO: 1097242 - RNA, 13 nt, Homo sapiens
cagcucugaugag

SEQ ID NO: 1097243 - RNA, 18 nt, Homo sapiens
cagcugcagaugccacac

SEQ ID NO: 1097244 - RNA, 22 nt, Homo sapiens
cagcugcagucaacaguucaaa

SEQ ID NO: 1097245 - RNA, 19 nt, Homo sapiens
cagcugcgguccacccagg

SEQ ID NO: 1097246 - RNA, 17 nt, Homo sapiens
cagcugcucccaaauaa

SEQ ID NO: 1097247 - RNA, 13 nt, Homo sapiens
cccuacugagaaa

SEQ ID NO: 1097248 - RNA, 19 nt, Homo sapiens
cccucaaaaaaagccuuua

SEQ ID NO: 1097249 - RNA, 17 nt, Homo sapiens
cccucagggaucuugca

SEQ ID NO: 1097250 - RNA, 11 nt, Homo sapiens
cccucccacac

SEQ ID NO: 1097251 - RNA, 20 nt, Homo sapiens
cccucccaccuccgcuggga

SEQ ID NO: 1097252 - RNA, 18 nt, Homo sapiens
cccucuggcacuccagaa

SEQ ID NO: 1097253 - RNA, 17 nt, Homo sapiens
cccugaaaacccagaga

SEQ ID NO: 1097254 - RNA, 15 nt, Homo sapiens
cccugaagauuucag

SEQ ID NO: 1097255 - RNA, 22 nt, Homo sapiens
cccugacucucugugaccugcc

SEQ ID NO: 1097256 - RNA, 14 nt, Homo sapiens
cccugcacaaagcc

SEQ ID NO: 1097257 - RNA, 13 nt, Homo sapiens
cccugcccggcug

SEQ ID NO: 1097258 - RNA, 19 nt, Homo sapiens
cccugcuaaggaguucuca

SEQ ID NO: 1097259 - RNA, 14 nt, Homo sapiens
cccuggcucugcca

SEQ ID NO: 1097260 - RNA, 20 nt, Homo sapiens
cccuggcugaccccaaagag

SEQ ID NO: 1097261 - RNA, 18 nt, Homo sapiens
cccuguaucuacuaaaaa

SEQ ID NO: 1097262 - RNA, 18 nt, Homo sapiens
cccuuacuaugaucucag

SEQ ID NO: 1097263 - RNA, 20 nt, Homo sapiens
cccuuacuaugaucucagga

SEQ ID NO: 1097264 - RNA, 13 nt, Homo sapiens
cccuugaaccagc

SEQ ID NO: 1097265 - RNA, 12 nt, Homo sapiens
cccuuuccagcc

SEQ ID NO: 1097266 - RNA, 16 nt, Homo sapiens
ccgaaguaugagggaa

SEQ ID NO: 1097267 - RNA, 17 nt, Homo sapiens
ccgaauagcugggacua

SEQ ID NO: 1097268 - RNA, 21 nt, Homo sapiens
ccgacugcuagggaguggucu

SEQ ID NO: 1097269 - RNA, 19 nt, Homo sapiens
ccgacugugaaaguaugug

SEQ ID NO: 1097270 - RNA, 20 nt, Homo sapiens
ccgagagagauggaauaaag

SEQ ID NO: 1097271 - RNA, 14 nt, Homo sapiens
ccgcagagcucccu

SEQ ID NO: 1097272 - RNA, 17 nt, Homo sapiens
ccgcagcacccugcaga

SEQ ID NO: 1097273 - RNA, 16 nt, Homo sapiens
ccgcccccagcagcuc

SEQ ID NO: 1097274 - RNA, 22 nt, Homo sapiens
ccgcccuucccacagcauuccu

SEQ ID NO: 1097275 - RNA, 20 nt, Homo sapiens
ccgccuggccggcuccaguu

SEQ ID NO: 1097276 - RNA, 19 nt, Homo sapiens
ccgcuuucaugaacacagc

SEQ ID NO: 1097277 - RNA, 15 nt, Homo sapiens
ccgggccacuccuuc

SEQ ID NO: 1097278 - RNA, 12 nt, Homo sapiens
ccguaacaacug

SEQ ID NO: 1097279 - RNA, 17 nt, Homo sapiens
ccguaacaacugugguc

SEQ ID NO: 1097280 - RNA, 16 nt, Homo sapiens
ccgucaaaagagucuu

SEQ ID NO: 1097281 - RNA, 21 nt, Homo sapiens
ccgugagugaaccaucauuau

SEQ ID NO: 1097282 - RNA, 17 nt, Homo sapiens
ccguguccagcacagaa

SEQ ID NO: 1097283 - RNA, 17 nt, Homo sapiens
ccuaaacaucauucauu

SEQ ID NO: 1097284 - RNA, 22 nt, Homo sapiens
ccuaaaucugccuuuucaucua

SEQ ID NO: 1097285 - RNA, 21 nt, Homo sapiens
ccuaacacugggcugcagaga

SEQ ID NO: 1097286 - RNA, 22 nt, Homo sapiens
ccuaauaaacauccuucaagaa

SEQ ID NO: 1097287 - RNA, 20 nt, Homo sapiens
ccuaaucaggcugagguguc

SEQ ID NO: 1097288 - RNA, 12 nt, Homo sapiens
ccuaaugaaguu

SEQ ID NO: 1097289 - RNA, 14 nt, Homo sapiens
ccuaccacaguguc

SEQ ID NO: 1097290 - RNA, 11 nt, Homo sapiens
ccuaccccaga

SEQ ID NO: 1097291 - RNA, 14 nt, Homo sapiens
ccuacguuaaccca

SEQ ID NO: 1097292 - RNA, 15 nt, Homo sapiens
ccuacugaaugcucu

SEQ ID NO: 1097293 - RNA, 13 nt, Homo sapiens
ccuagaggugcuc

SEQ ID NO: 1097294 - RNA, 23 nt, Homo sapiens
ccuagcaaggcaugauguuaacc

SEQ ID NO: 1097295 - RNA, 19 nt, Homo sapiens
ccuagcaccuggcuaguuu

SEQ ID NO: 1097296 - RNA, 22 nt, Homo sapiens
ccuagcaucucaugagugccaa

SEQ ID NO: 1097297 - RNA, 12 nt, Homo sapiens
ccuagcuaccuu

SEQ ID NO: 1097298 - RNA, 20 nt, Homo sapiens
ccuaggauuucaugauuuca

SEQ ID NO: 1097299 - RNA, 23 nt, Homo sapiens
ccuauacauuucuguucaucuua

SEQ ID NO: 1097300 - RNA, 19 nt, Homo sapiens
ccuauauguaguauaaaga

SEQ ID NO: 1097301 - RNA, 14 nt, Homo sapiens
ccuaugcacauaug

SEQ ID NO: 1097302 - RNA, 16 nt, Homo sapiens
ccuaugcacauaugga

SEQ ID NO: 1097303 - RNA, 21 nt, Homo sapiens
ccuauggagagcccugggacc

SEQ ID NO: 1097304 - RNA, 14 nt, Homo sapiens
ccuaugucauuuca

SEQ ID NO: 1097305 - RNA, 22 nt, Homo sapiens
ccuauguccuaaggacacacua

SEQ ID NO: 1097306 - RNA, 11 nt, Homo sapiens
ccuauuugcac

SEQ ID NO: 1097307 - RNA, 20 nt, Homo sapiens
ccuauuuggggcuugcaugc

SEQ ID NO: 1097308 - RNA, 20 nt, Homo sapiens
ccucaaagcccccacuucuc

SEQ ID NO: 1097309 - RNA, 22 nt, Homo sapiens
ccucaaagcccccacuucucuc

SEQ ID NO: 1097310 - RNA, 18 nt, Homo sapiens
ccucaaaugacccaaaga

SEQ ID NO: 1097311 - RNA, 22 nt, Homo sapiens
ccucacuccuguuacuuaccua

SEQ ID NO: 1097312 - RNA, 17 nt, Homo sapiens
ccucacugaaugccuca

SEQ ID NO: 1097313 - RNA, 15 nt, Homo sapiens
ccucacugauauauu

SEQ ID NO: 1097314 - RNA, 20 nt, Homo sapiens
ccucagcugcucgcacagau

SEQ ID NO: 1097315 - RNA, 15 nt, Homo sapiens
ccucagggacagaga

SEQ ID NO: 1097316 - RNA, 23 nt, Homo sapiens
ccucagggacagagacaccugca

SEQ ID NO: 1097317 - RNA, 16 nt, Homo sapiens
ccucaggugcuaggga

SEQ ID NO: 1097318 - RNA, 20 nt, Homo sapiens
ccucauuccccaaccacuuc

SEQ ID NO: 1097319 - RNA, 14 nt, Homo sapiens
ccucauuuaccaua

SEQ ID NO: 1097320 - RNA, 20 nt, Homo sapiens
ccuccaagcuccaucuccac

SEQ ID NO: 1097321 - RNA, 14 nt, Homo sapiens
ccuccagcuuuccu

SEQ ID NO: 1097322 - RNA, 17 nt, Homo sapiens
ccuccaguaguggacaa

SEQ ID NO: 1097323 - RNA, 17 nt, Homo sapiens
ccuccauucugaccauu

SEQ ID NO: 1097324 - RNA, 12 nt, Homo sapiens
ccuccauuugca

SEQ ID NO: 1097325 - RNA, 21 nt, Homo sapiens
ccucccaaagugcugggauua

SEQ ID NO: 1097326 - RNA, 22 nt, Homo sapiens
ccucccaggaacugggccaacu

SEQ ID NO: 1097327 - RNA, 19 nt, Homo sapiens
ccuccucggaucaccgaga

SEQ ID NO: 1097328 - RNA, 15 nt, Homo sapiens
ccuccuuuugcuuga

SEQ ID NO: 1097329 - RNA, 16 nt, Homo sapiens
ccucguagccaucucu

SEQ ID NO: 1097330 - RNA, 13 nt, Homo sapiens
ccucuaagccacu

SEQ ID NO: 1097331 - RNA, 18 nt, Homo sapiens
ccucuaagccacucuucc

SEQ ID NO: 1097332 - RNA, 16 nt, Homo sapiens
ccucuacuuaaugaga

SEQ ID NO: 1097333 - RNA, 19 nt, Homo sapiens
ccucuaguuuuaagacuga

SEQ ID NO: 1097334 - RNA, 20 nt, Homo sapiens
ccucuaguuuuaagacugaa

SEQ ID NO: 1097335 - RNA, 12 nt, Homo sapiens
ccucucucuaua

SEQ ID NO: 1097336 - RNA, 16 nt, Homo sapiens
ccucucuuauagaaua

SEQ ID NO: 1097337 - RNA, 15 nt, Homo sapiens
ccucugaucaguuuc

SEQ ID NO: 1097338 - RNA, 16 nt, Homo sapiens
gacacaggcccggcuc

SEQ ID NO: 1097339 - RNA, 19 nt, Homo sapiens
gacacauaugcaccuugug

SEQ ID NO: 1097340 - RNA, 17 nt, Homo sapiens
gacaccuugacagggca

SEQ ID NO: 1097341 - RNA, 21 nt, Homo sapiens
gacacuauuuaucugugcaaa

SEQ ID NO: 1097342 - RNA, 16 nt, Homo sapiens
gacagaagucuugucu

SEQ ID NO: 1097343 - RNA, 14 nt, Homo sapiens
gacagaccuggaca

SEQ ID NO: 1097344 - RNA, 12 nt, Homo sapiens
gacagaccuuca

SEQ ID NO: 1097345 - RNA, 19 nt, Homo sapiens
gacagagugagacucuguc

SEQ ID NO: 1097346 - RNA, 22 nt, Homo sapiens
gacagccacggccaggccagag

SEQ ID NO: 1097347 - RNA, 20 nt, Homo sapiens
gacaggaagcccaaggcagu

SEQ ID NO: 1097348 - RNA, 16 nt, Homo sapiens
gacaggaauacuuaac

SEQ ID NO: 1097349 - RNA, 23 nt, Homo sapiens
gacaggcccaagagaugaagagu

SEQ ID NO: 1097350 - RNA, 20 nt, Homo sapiens
gacagucucaagcacuaaaa

SEQ ID NO: 1097351 - RNA, 18 nt, Homo sapiens
gacauacaccuaugucau

SEQ ID NO: 1097352 - RNA, 15 nt, Homo sapiens
gacaugacuaggaag

SEQ ID NO: 1097353 - RNA, 23 nt, Homo sapiens
gacauggguagcaauucuaccca

SEQ ID NO: 1097354 - RNA, 18 nt, Homo sapiens
gacauugcggacagccac

SEQ ID NO: 1097355 - RNA, 21 nt, Homo sapiens
gacauuggauguggagcuccu

SEQ ID NO: 1097356 - RNA, 21 nt, Homo sapiens
gaccacgcuuucuagcuguug

SEQ ID NO: 1097357 - RNA, 14 nt, Homo sapiens
gaccagaaguggac

SEQ ID NO: 1097358 - RNA, 14 nt, Homo sapiens
gaccagccugggca

SEQ ID NO: 1097359 - RNA, 16 nt, Homo sapiens
gaccauccuauuuaac

SEQ ID NO: 1097360 - RNA, 21 nt, Homo sapiens
gaccccaaagagccuggagaa

SEQ ID NO: 1097361 - RNA, 21 nt, Homo sapiens
gacccucugaaugguccaggg

SEQ ID NO: 1097362 - RNA, 14 nt, Homo sapiens
gaccucagccugug

SEQ ID NO: 1097363 - RNA, 18 nt, Homo sapiens
gaccuccguguagugucu

SEQ ID NO: 1097364 - RNA, 17 nt, Homo sapiens
gaccuguaaucauauaa

SEQ ID NO: 1097365 - RNA, 17 nt, Homo sapiens
gaccuucaacuuccaaa

SEQ ID NO: 1097366 - RNA, 22 nt, Homo sapiens
gaccuuucugagugacaugggu

SEQ ID NO: 1097367 - RNA, 21 nt, Homo sapiens
gaccuuuuuuaggaagcaagc

SEQ ID NO: 1097368 - RNA, 15 nt, Homo sapiens
gacgaacaggggcca

SEQ ID NO: 1097369 - RNA, 18 nt, Homo sapiens
gacgaacaggggccaaac

SEQ ID NO: 1097370 - RNA, 20 nt, Homo sapiens
gacgcaacuuaagcugggau

SEQ ID NO: 1097371 - RNA, 21 nt, Homo sapiens
gacgccacucauuucaucuca

SEQ ID NO: 1097372 - RNA, 16 nt, Homo sapiens
gacggucccacacugg

SEQ ID NO: 1097373 - RNA, 15 nt, Homo sapiens
gacgugucucaggag

SEQ ID NO: 1097374 - RNA, 21 nt, Homo sapiens
gacguuggccuaacacugggc

SEQ ID NO: 1097375 - RNA, 14 nt, Homo sapiens
gacuacagccagaa

SEQ ID NO: 1097376 - RNA, 20 nt, Homo sapiens
gacuagugcuuuaccuuuau

SEQ ID NO: 1097377 - RNA, 19 nt, Homo sapiens
gacuaguugaacaucucac

SEQ ID NO: 1097378 - RNA, 14 nt, Homo sapiens
gacuauggguacau

SEQ ID NO: 1097379 - RNA, 18 nt, Homo sapiens
gacuauuaaaacuaauaa

SEQ ID NO: 1097380 - RNA, 12 nt, Homo sapiens
gacucaaugcac

SEQ ID NO: 1097381 - RNA, 17 nt, Homo sapiens
gacucacaagaagacca

SEQ ID NO: 1097382 - RNA, 12 nt, Homo sapiens
gacucacugugg

SEQ ID NO: 1097383 - RNA, 22 nt, Homo sapiens
gacucaguuuucuugcagauca

SEQ ID NO: 1097384 - RNA, 17 nt, Homo sapiens
gacuccugugcaacuuu

SEQ ID NO: 1097385 - RNA, 15 nt, Homo sapiens
gacucugcacauguc

SEQ ID NO: 1097386 - RNA, 18 nt, Homo sapiens
gacucugcacaugucuug

SEQ ID NO: 1097387 - RNA, 13 nt, Homo sapiens
gacugaguccucg

SEQ ID NO: 1097388 - RNA, 17 nt, Homo sapiens
gacugauguuacaucac

SEQ ID NO: 1097389 - RNA, 23 nt, Homo sapiens
gacugauguuacaucacaguguu

SEQ ID NO: 1097390 - RNA, 19 nt, Homo sapiens
gacuggaccccgcccagca

SEQ ID NO: 1097391 - RNA, 16 nt, Homo sapiens
gacuggaucucagccu

SEQ ID NO: 1097392 - RNA, 13 nt, Homo sapiens
gacuguugcucaa

SEQ ID NO: 1097393 - RNA, 17 nt, Homo sapiens
gacuucacaaaaugcaa

SEQ ID NO: 1097394 - RNA, 19 nt, Homo sapiens
gacuuccucgccucuccca

SEQ ID NO: 1097395 - RNA, 19 nt, Homo sapiens
gagaaaauaaaagcacuua

SEQ ID NO: 1097396 - RNA, 23 nt, Homo sapiens
gagaaacagagacaggcccaaga

SEQ ID NO: 1097397 - RNA, 22 nt, Homo sapiens
gagaaaccuuauuguaccucuc

SEQ ID NO: 1097398 - RNA, 15 nt, Homo sapiens
gagaaaugacuuuga

SEQ ID NO: 1097399 - RNA, 12 nt, Homo sapiens
gagaaccuucca

SEQ ID NO: 1097400 - RNA, 13 nt, Homo sapiens
gagaacuuuccau

SEQ ID NO: 1097401 - RNA, 18 nt, Homo sapiens
gagaagaaugacuaugca

SEQ ID NO: 1097402 - RNA, 19 nt, Homo sapiens
gagaaggaaggagacucac

SEQ ID NO: 1097403 - RNA, 16 nt, Homo sapiens
gagaaggcccacugag

SEQ ID NO: 1097404 - RNA, 19 nt, Homo sapiens
gagaaguucaggaagguac

SEQ ID NO: 1097405 - RNA, 14 nt, Homo sapiens
gagacagauaacuc

SEQ ID NO: 1097406 - RNA, 23 nt, Homo sapiens
gagacagauauacugggagaaau

SEQ ID NO: 1097407 - RNA, 20 nt, Homo sapiens
gagacagcgaacuagaagaa

SEQ ID NO: 1097408 - RNA, 15 nt, Homo sapiens
gagacaggcccaaga

SEQ ID NO: 1097409 - RNA, 22 nt, Homo sapiens
gagacagguggccuagcaggca

SEQ ID NO: 1097410 - RNA, 21 nt, Homo sapiens
gagacauacaccuaugucauu

SEQ ID NO: 1097411 - RNA, 22 nt, Homo sapiens
gagaccaagacucugaaaucuc

SEQ ID NO: 1097412 - RNA, 23 nt, Homo sapiens
gagaccagccugggcaacaaagu

SEQ ID NO: 1097413 - RNA, 15 nt, Homo sapiens
gagacccagaucuca

SEQ ID NO: 1097414 - RNA, 20 nt, Homo sapiens
gagaccccuuccuuuccucu

SEQ ID NO: 1097415 - RNA, 17 nt, Homo sapiens
gagacggccaagugaag

SEQ ID NO: 1097416 - RNA, 20 nt, Homo sapiens
gagacucaccucugccucaa

SEQ ID NO: 1097417 - RNA, 18 nt, Homo sapiens
gagacugcaucucaaaaa

SEQ ID NO: 1097418 - RNA, 14 nt, Homo sapiens
gagacugcgggaug

SEQ ID NO: 1097419 - RNA, 13 nt, Homo sapiens
gagagacccaagg

SEQ ID NO: 1097420 - RNA, 19 nt, Homo sapiens
gagaggaaaggacaugggu

SEQ ID NO: 1097421 - RNA, 18 nt, Homo sapiens
gagaggccuuuuggaaug

SEQ ID NO: 1097422 - RNA, 20 nt, Homo sapiens
gagaguacagugagccaaga

SEQ ID NO: 1097423 - RNA, 19 nt, Homo sapiens
gagaguaguuuuucagcua

SEQ ID NO: 1097424 - RNA, 24 nt, Homo sapiens
gagagugcugagaaggacaccucc

SEQ ID NO: 1097425 - RNA, 17 nt, Homo sapiens
gagauaauaucugugag

SEQ ID NO: 1097426 - RNA, 14 nt, Homo sapiens
gagauagaaccugg

SEQ ID NO: 1097427 - RNA, 17 nt, Homo sapiens
gagauagguacuauuau

SEQ ID NO: 1097428 - RNA, 17 nt, Homo sapiens
gcccuagagcacacugu

SEQ ID NO: 1097429 - RNA, 15 nt, Homo sapiens
gcccugcccugccac

SEQ ID NO: 1097430 - RNA, 19 nt, Homo sapiens
gcccugggcucaucagccu

SEQ ID NO: 1097431 - RNA, 18 nt, Homo sapiens
gcccuggggccuguacug

SEQ ID NO: 1097432 - RNA, 15 nt, Homo sapiens
gcccuucaugcauuu

SEQ ID NO: 1097433 - RNA, 18 nt, Homo sapiens
gcccuucccacagcauuc

SEQ ID NO: 1097434 - RNA, 19 nt, Homo sapiens
gcccuugcccugaccuccc

SEQ ID NO: 1097435 - RNA, 13 nt, Homo sapiens
gccgacucaggga

SEQ ID NO: 1097436 - RNA, 21 nt, Homo sapiens
gccgagaucacgccacugcac

SEQ ID NO: 1097437 - RNA, 20 nt, Homo sapiens
gccggcuccaguuuccccau

SEQ ID NO: 1097438 - RNA, 13 nt, Homo sapiens
gccuaacacuggg

SEQ ID NO: 1097439 - RNA, 16 nt, Homo sapiens
gccuagccgaccucag

SEQ ID NO: 1097440 - RNA, 16 nt, Homo sapiens
gccuaggaggccuucu

SEQ ID NO: 1097441 - RNA, 16 nt, Homo sapiens
gccuauggagagcccu

SEQ ID NO: 1097442 - RNA, 15 nt, Homo sapiens
gccuauugugccucu

SEQ ID NO: 1097443 - RNA, 19 nt, Homo sapiens
gccucaaugugaccagggg

SEQ ID NO: 1097444 - RNA, 21 nt, Homo sapiens
gccucaugcugacuugcagag

SEQ ID NO: 1097445 - RNA, 20 nt, Homo sapiens
gccucccaaggaaaauggac

SEQ ID NO: 1097446 - RNA, 21 nt, Homo sapiens
gccuccucuguccagggcccu

SEQ ID NO: 1097447 - RNA, 15 nt, Homo sapiens
gccuccugcaccgag

SEQ ID NO: 1097448 - RNA, 22 nt, Homo sapiens
gccucuuccgugacgucacugg

SEQ ID NO: 1097449 - RNA, 19 nt, Homo sapiens
gccucuuuucucugugcuu

SEQ ID NO: 1097450 - RNA, 17 nt, Homo sapiens
gccugaagaacaguaac

SEQ ID NO: 1097451 - RNA, 22 nt, Homo sapiens
gccugacuuggggagauggagu

SEQ ID NO: 1097452 - RNA, 16 nt, Homo sapiens
gccugaggcaugagaa

SEQ ID NO: 1097453 - RNA, 15 nt, Homo sapiens
gccugcagacucacu

SEQ ID NO: 1097454 - RNA, 21 nt, Homo sapiens
gccugccaaggaugacacugc

SEQ ID NO: 1097455 - RNA, 13 nt, Homo sapiens
gccugccuugaag

SEQ ID NO: 1097456 - RNA, 13 nt, Homo sapiens
gccugcugcugag

SEQ ID NO: 1097457 - RNA, 21 nt, Homo sapiens
gccuggaucucacaagcacuu

SEQ ID NO: 1097458 - RNA, 22 nt, Homo sapiens
gccuggaucucacaagcacuuu

SEQ ID NO: 1097459 - RNA, 17 nt, Homo sapiens
gccuggccaacauggug

SEQ ID NO: 1097460 - RNA, 20 nt, Homo sapiens
gccuggccaacauggugaaa

SEQ ID NO: 1097461 - RNA, 16 nt, Homo sapiens
gccuggggcaucccag

SEQ ID NO: 1097462 - RNA, 16 nt, Homo sapiens
gccugucacgugguca

SEQ ID NO: 1097463 - RNA, 13 nt, Homo sapiens
gccugugcaugua

SEQ ID NO: 1097464 - RNA, 17 nt, Homo sapiens
gccuguuacacaugaca

SEQ ID NO: 1097465 - RNA, 21 nt, Homo sapiens
gccuuaggaaaagcauuugcu

SEQ ID NO: 1097466 - RNA, 20 nt, Homo sapiens
gccuucauaagccuaccaau

SEQ ID NO: 1097467 - RNA, 23 nt, Homo sapiens
gccuucauggaacucagcugucu

SEQ ID NO: 1097468 - RNA, 15 nt, Homo sapiens
gccuuccacaauuca

SEQ ID NO: 1097469 - RNA, 20 nt, Homo sapiens
gccuuccauaauuaugacag

SEQ ID NO: 1097470 - RNA, 15 nt, Homo sapiens
gccuugccaugucuu

SEQ ID NO: 1097471 - RNA, 14 nt, Homo sapiens
gccuuugaggcaaa

SEQ ID NO: 1097472 - RNA, 17 nt, Homo sapiens
gcgagucuuacuuugag

SEQ ID NO: 1097473 - RNA, 20 nt, Homo sapiens
gcgaucuggguucacugcaa

SEQ ID NO: 1097474 - RNA, 19 nt, Homo sapiens
gcgcccugcagacccugcc

SEQ ID NO: 1097475 - RNA, 19 nt, Homo sapiens
gcgcuauugcacuccaguc

SEQ ID NO: 1097476 - RNA, 15 nt, Homo sapiens
gcggaaccauagcug

SEQ ID NO: 1097477 - RNA, 16 nt, Homo sapiens
gcgguuuccaggccac

SEQ ID NO: 1097478 - RNA, 17 nt, Homo sapiens
gcgugacucacccaagc

SEQ ID NO: 1097479 - RNA, 19 nt, Homo sapiens
gcguggaccccgacaaagg

SEQ ID NO: 1097480 - RNA, 16 nt, Homo sapiens
gcguggacucugcaca

SEQ ID NO: 1097481 - RNA, 18 nt, Homo sapiens
gcguggacucugcacaug

SEQ ID NO: 1097482 - RNA, 20 nt, Homo sapiens
gcuaaaauuagaugaacuca

SEQ ID NO: 1097483 - RNA, 19 nt, Homo sapiens
gcuaaaauugaacuacuug

SEQ ID NO: 1097484 - RNA, 15 nt, Homo sapiens
gcuaauucaauuuau

SEQ ID NO: 1097485 - RNA, 15 nt, Homo sapiens
gcuacacuugcaccu

SEQ ID NO: 1097486 - RNA, 22 nt, Homo sapiens
gcuaccuucucuacccaucucc

SEQ ID NO: 1097487 - RNA, 15 nt, Homo sapiens
gcuacucuaguauuc

SEQ ID NO: 1097488 - RNA, 21 nt, Homo sapiens
gcuacuuuucagaauugaagg

SEQ ID NO: 1097489 - RNA, 14 nt, Homo sapiens
gcuagcagaaguau

SEQ ID NO: 1097490 - RNA, 17 nt, Homo sapiens
gcuagcagaaguauaaa

SEQ ID NO: 1097491 - RNA, 13 nt, Homo sapiens
gcuaggagcaaag

SEQ ID NO: 1097492 - RNA, 15 nt, Homo sapiens
gcuagggaaggcggg

SEQ ID NO: 1097493 - RNA, 14 nt, Homo sapiens
gcuagggagugguc

SEQ ID NO: 1097494 - RNA, 16 nt, Homo sapiens
gcuaguuugaccucau

SEQ ID NO: 1097495 - RNA, 11 nt, Homo sapiens
gcuaucucugu

SEQ ID NO: 1097496 - RNA, 11 nt, Homo sapiens
gcuaugaauga

SEQ ID NO: 1097497 - RNA, 23 nt, Homo sapiens
gcuaugguuuucuccaagagcua

SEQ ID NO: 1097498 - RNA, 15 nt, Homo sapiens
gcucaauauuccuga

SEQ ID NO: 1097499 - RNA, 19 nt, Homo sapiens
gcucacaaaccaugcaaau

SEQ ID NO: 1097500 - RNA, 14 nt, Homo sapiens
gcucacugcagccu

SEQ ID NO: 1097501 - RNA, 23 nt, Homo sapiens
gcucagaggcccaggaaucggag

SEQ ID NO: 1097502 - RNA, 19 nt, Homo sapiens
gcucagcggggacagcucc

SEQ ID NO: 1097503 - RNA, 20 nt, Homo sapiens
gcucaggugucccugcacuu

SEQ ID NO: 1097504 - RNA, 20 nt, Homo sapiens
gcucauucauuuaacagagc

SEQ ID NO: 1097505 - RNA, 20 nt, Homo sapiens
gcuccccagugcuaccucuc

SEQ ID NO: 1097506 - RNA, 17 nt, Homo sapiens
gcucccccugcuucuca

SEQ ID NO: 1097507 - RNA, 14 nt, Homo sapiens
gcuccuggaaccaa

SEQ ID NO: 1097508 - RNA, 14 nt, Homo sapiens
gcuccuugacuccu

SEQ ID NO: 1097509 - RNA, 21 nt, Homo sapiens
gcucuagccugggcaacaaca

SEQ ID NO: 1097510 - RNA, 22 nt, Homo sapiens
gcucugcccucccuggccucac

SEQ ID NO: 1097511 - RNA, 16 nt, Homo sapiens
gcucugcugacagaca

SEQ ID NO: 1097512 - RNA, 16 nt, Homo sapiens
gcucuguccacucuga

SEQ ID NO: 1097513 - RNA, 13 nt, Homo sapiens
gcucuuaggugcu

SEQ ID NO: 1097514 - RNA, 22 nt, Homo sapiens
gcucuuaggugcuucuucacuu

SEQ ID NO: 1097515 - RNA, 14 nt, Homo sapiens
gcucuucuaaggaa

SEQ ID NO: 1097516 - RNA, 17 nt, Homo sapiens
gcucuucugucaucccg

SEQ ID NO: 1097517 - RNA, 17 nt, Homo sapiens
gcucuuucccuuuauca

SEQ ID NO: 1097518 - RNA, 15 nt, Homo sapiens
gcucuuuggggucag

SEQ ID NO: 1097519 - RNA, 20 nt, Homo sapiens
guagagacaggguuuugcca

SEQ ID NO: 1097520 - RNA, 16 nt, Homo sapiens
guagagggcacugggu

SEQ ID NO: 1097521 - RNA, 17 nt, Homo sapiens
guagccugugcauguau

SEQ ID NO: 1097522 - RNA, 19 nt, Homo sapiens
guagcucuguccacucuga

SEQ ID NO: 1097523 - RNA, 19 nt, Homo sapiens
guagcugggacuacaggca

SEQ ID NO: 1097524 - RNA, 22 nt, Homo sapiens
guaggaaagcaccgcagcaugu

SEQ ID NO: 1097525 - RNA, 14 nt, Homo sapiens
guaggggcaaaaau

SEQ ID NO: 1097526 - RNA, 15 nt, Homo sapiens
guaggugucugcacc

SEQ ID NO: 1097527 - RNA, 16 nt, Homo sapiens
guagucccagccacuc

SEQ ID NO: 1097528 - RNA, 15 nt, Homo sapiens
guaguccguuaacac

SEQ ID NO: 1097529 - RNA, 13 nt, Homo sapiens
guaguucuugucu

SEQ ID NO: 1097530 - RNA, 18 nt, Homo sapiens
guauaaagugaucaguau

SEQ ID NO: 1097531 - RNA, 19 nt, Homo sapiens
guauaaugguguuacuaaa

SEQ ID NO: 1097532 - RNA, 19 nt, Homo sapiens
guauaaugguugacugggu

SEQ ID NO: 1097533 - RNA, 13 nt, Homo sapiens
guauauacauaug

SEQ ID NO: 1097534 - RNA, 13 nt, Homo sapiens
guauauacauauu

SEQ ID NO: 1097535 - RNA, 20 nt, Homo sapiens
guauauucugguuacugugg

SEQ ID NO: 1097536 - RNA, 14 nt, Homo sapiens
guauauugucagau

SEQ ID NO: 1097537 - RNA, 17 nt, Homo sapiens
guaucacguuaccccaa

SEQ ID NO: 1097538 - RNA, 15 nt, Homo sapiens
guauccaauuaugug

SEQ ID NO: 1097539 - RNA, 18 nt, Homo sapiens
guaucccaugagccucag

SEQ ID NO: 1097540 - RNA, 21 nt, Homo sapiens
guaucucuuuugaauccaugc

SEQ ID NO: 1097541 - RNA, 17 nt, Homo sapiens
guaugaucacggcucac

SEQ ID NO: 1097542 - RNA, 17 nt, Homo sapiens
guauguacuaagcagua

SEQ ID NO: 1097543 - RNA, 20 nt, Homo sapiens
guauucuacagcagauacuu

SEQ ID NO: 1097544 - RNA, 17 nt, Homo sapiens
guauuuaccacagcagc

SEQ ID NO: 1097545 - RNA, 19 nt, Homo sapiens
guauuuuagcaggguacau

SEQ ID NO: 1097546 - RNA, 23 nt, Homo sapiens
guauuuuccauacacauccccag

SEQ ID NO: 1097547 - RNA, 20 nt, Homo sapiens
gucaaaccgcacucacccau

SEQ ID NO: 1097548 - RNA, 22 nt, Homo sapiens
gucaaaguaaaacuugcugccu

SEQ ID NO: 1097549 - RNA, 12 nt, Homo sapiens
gucaacaucuaa

SEQ ID NO: 1097550 - RNA, 14 nt, Homo sapiens
gucaaccaggaaca

SEQ ID NO: 1097551 - RNA, 17 nt, Homo sapiens
gucaauuaguacaguag

SEQ ID NO: 1097552 - RNA, 11 nt, Homo sapiens
gucacacuggu

SEQ ID NO: 1097553 - RNA, 16 nt, Homo sapiens
gucaccuaacucugaa

SEQ ID NO: 1097554 - RNA, 23 nt, Homo sapiens
gucagaauuucuuugucauucaa

SEQ ID NO: 1097555 - RNA, 14 nt, Homo sapiens
gucaggaacagaag

SEQ ID NO: 1097556 - RNA, 20 nt, Homo sapiens
gucaucaaauauuaccaaaa

SEQ ID NO: 1097557 - RNA, 22 nt, Homo sapiens
gucaucaaauauuaccaaaaaa

SEQ ID NO: 1097558 - RNA, 23 nt, Homo sapiens
gucaucaauuaaaggcaaaggca

SEQ ID NO: 1097559 - RNA, 23 nt, Homo sapiens
guccaaggcuauauuucugggau

SEQ ID NO: 1097560 - RNA, 18 nt, Homo sapiens
guccagaagaauauucag

SEQ ID NO: 1097561 - RNA, 24 nt, Homo sapiens
gucccaaccugaucccacgaggga

SEQ ID NO: 1097562 - RNA, 13 nt, Homo sapiens
gucccaacucgau

SEQ ID NO: 1097563 - RNA, 17 nt, Homo sapiens
guccccaguuugcagaa

SEQ ID NO: 1097564 - RNA, 15 nt, Homo sapiens
gucccccuaugcucc

SEQ ID NO: 1097565 - RNA, 16 nt, Homo sapiens
guccccucuugaccca

SEQ ID NO: 1097566 - RNA, 17 nt, Homo sapiens
gucccugccaguguuua

SEQ ID NO: 1097567 - RNA, 18 nt, Homo sapiens
gucccuguuguaacugcc

SEQ ID NO: 1097568 - RNA, 15 nt, Homo sapiens
guccgaucuuugacu

SEQ ID NO: 1097569 - RNA, 20 nt, Homo sapiens
guccucaguguccucagggg

SEQ ID NO: 1097570 - RNA, 18 nt, Homo sapiens
guccuuucuaaguauuuu

SEQ ID NO: 1097571 - RNA, 20 nt, Homo sapiens
gucgagcccugcagccaaac

SEQ ID NO: 1097572 - RNA, 21 nt, Homo sapiens
gucguuuuuuucuugugcuga

SEQ ID NO: 1097573 - RNA, 21 nt, Homo sapiens
gucuagacuuucucaguggga

SEQ ID NO: 1097574 - RNA, 19 nt, Homo sapiens
gucucaaaaaaagggcaau

SEQ ID NO: 1097575 - RNA, 18 nt, Homo sapiens
gucucccuaaaauaaaaa

SEQ ID NO: 1097576 - RNA, 21 nt, Homo sapiens
gucugauuggcucacccaagc

SEQ ID NO: 1097577 - RNA, 23 nt, Homo sapiens
gucugcccccgucuucucuccau

SEQ ID NO: 1097578 - RNA, 16 nt, Homo sapiens
gucugcuagccaggau

SEQ ID NO: 1097579 - RNA, 14 nt, Homo sapiens
gucugggugucuca

SEQ ID NO: 1097580 - RNA, 15 nt, Homo sapiens
gucuguccaccccau

SEQ ID NO: 1097581 - RNA, 14 nt, Homo sapiens
gucugucccaaaga

SEQ ID NO: 1097582 - RNA, 13 nt, Homo sapiens
gucuguuaacuua

SEQ ID NO: 1097583 - RNA, 21 nt, Homo sapiens
gucuguuucaaugaccuguau

SEQ ID NO: 1097584 - RNA, 19 nt, Homo sapiens
gucuucccugaucaaguca

SEQ ID NO: 1097585 - RNA, 15 nt, Homo sapiens
gucuugaaaagccua

SEQ ID NO: 1097586 - RNA, 12 nt, Homo sapiens
gucuugaacucc

SEQ ID NO: 1097587 - RNA, 17 nt, Homo sapiens
gucuugcaauggcagcc

SEQ ID NO: 1097588 - RNA, 15 nt, Homo sapiens
gucuugucucaagaa

SEQ ID NO: 1097589 - RNA, 23 nt, Homo sapiens
gucuuucugacaucagcagagaa

SEQ ID NO: 1097590 - RNA, 17 nt, Homo sapiens
gugaaaccucaucucua

SEQ ID NO: 1097591 - RNA, 19 nt, Homo sapiens
gugaaagaaaauucuugga

SEQ ID NO: 1097592 - RNA, 19 nt, Homo sapiens
gugaaagaugcaagcaccu

SEQ ID NO: 1097593 - RNA, 19 nt, Homo sapiens
gugacaugggugugccagg

SEQ ID NO: 1097594 - RNA, 17 nt, Homo sapiens
gugagaaggagauucaa

SEQ ID NO: 1097595 - RNA, 21 nt, Homo sapiens
gugaguuacagcgagaggcag

SEQ ID NO: 1097596 - RNA, 13 nt, Homo sapiens
gugauacccaagu

SEQ ID NO: 1097597 - RNA, 13 nt, Homo sapiens
gugauccacccac

SEQ ID NO: 1097598 - RNA, 20 nt, Homo sapiens
gugaucuaucaauagucaag

SEQ ID NO: 1097599 - RNA, 16 nt, Homo sapiens
gugaugggaucuguaa

SEQ ID NO: 1097600 - RNA, 16 nt, Homo sapiens
gugauugacacacagc

SEQ ID NO: 1097601 - RNA, 14 nt, Homo sapiens
gugauuuuugaaca

SEQ ID NO: 1097602 - RNA, 19 nt, Homo sapiens
gugcaaaguucccuacuuc

SEQ ID NO: 1097603 - RNA, 13 nt, Homo sapiens
gugcaauauguga

SEQ ID NO: 1097604 - RNA, 23 nt, Homo sapiens
gugcaccccuccccauucacaga

SEQ ID NO: 1097605 - RNA, 12 nt, Homo sapiens
gugcaugcucuc

SEQ ID NO: 1097606 - RNA, 18 nt, Homo sapiens
gugcauuuaugagcucuu

SEQ ID NO: 1097607 - RNA, 21 nt, Homo sapiens
gugcccaggggcccacaggga

SEQ ID NO: 1097608 - RNA, 20 nt, Homo sapiens
gugcuccuccuuggugccug

SEQ ID NO: 1097609 - RNA, 23 nt, Homo sapiens
uagugcuuuaccuuuauuaauga

SEQ ID NO: 1097610 - RNA, 22 nt, Homo sapiens
uagugguauagaguacugcaga

SEQ ID NO: 1097611 - RNA, 21 nt, Homo sapiens
uaguguuggaaaaugugcaau

SEQ ID NO: 1097612 - RNA, 22 nt, Homo sapiens
uaguguuggaaaaugugcaaua

SEQ ID NO: 1097613 - RNA, 23 nt, Homo sapiens
uaguguuggaaaaugugcaauau

SEQ ID NO: 1097614 - RNA, 22 nt, Homo sapiens
uaguucccugaaaacccagaga

SEQ ID NO: 1097615 - RNA, 19 nt, Homo sapiens
uaguucuuacuacuugcca

SEQ ID NO: 1097616 - RNA, 20 nt, Homo sapiens
uaguugagaaagaagagaag

SEQ ID NO: 1097617 - RNA, 20 nt, Homo sapiens
uaguugcguggacucugcac

SEQ ID NO: 1097618 - RNA, 22 nt, Homo sapiens
uaguugcguggacucugcacau

SEQ ID NO: 1097619 - RNA, 22 nt, Homo sapiens
uaguuugauacucccagucuug

SEQ ID NO: 1097620 - RNA, 20 nt, Homo sapiens
uaguuuuauaaaacucaguu

SEQ ID NO: 1097621 - RNA, 14 nt, Homo sapiens
uauaaaaucuagau

SEQ ID NO: 1097622 - RNA, 15 nt, Homo sapiens
uauaaagauggcuga

SEQ ID NO: 1097623 - RNA, 16 nt, Homo sapiens
uauaaagucaggaccu

SEQ ID NO: 1097624 - RNA, 13 nt, Homo sapiens
uauaaagugauca

SEQ ID NO: 1097625 - RNA, 19 nt, Homo sapiens
uauaaauguguggugcuaa

SEQ ID NO: 1097626 - RNA, 19 nt, Homo sapiens
uauaaccccaccuugccaa

SEQ ID NO: 1097627 - RNA, 22 nt, Homo sapiens
uauaaucuuccauacuucuuca

SEQ ID NO: 1097628 - RNA, 16 nt, Homo sapiens
uauaaugcaaaccaua

SEQ ID NO: 1097629 - RNA, 15 nt, Homo sapiens
uauaaugguuuacug

SEQ ID NO: 1097630 - RNA, 11 nt, Homo sapiens
uauacauauca

SEQ ID NO: 1097631 - RNA, 12 nt, Homo sapiens
uauacauaucag

SEQ ID NO: 1097632 - RNA, 17 nt, Homo sapiens
uauacauguauagugag

SEQ ID NO: 1097633 - RNA, 18 nt, Homo sapiens
uauacuguggcuaugcaa

SEQ ID NO: 1097634 - RNA, 20 nt, Homo sapiens
uauagcaauguaacauuaau

SEQ ID NO: 1097635 - RNA, 19 nt, Homo sapiens
uauagguuuccacugccaa

SEQ ID NO: 1097636 - RNA, 23 nt, Homo sapiens
uauaguauucauuuuccuaccua

SEQ ID NO: 1097637 - RNA, 14 nt, Homo sapiens
uauagucacaagag

SEQ ID NO: 1097638 - RNA, 16 nt, Homo sapiens
uauaguuuauugacaa

SEQ ID NO: 1097639 - RNA, 13 nt, Homo sapiens
uauauacauucuu

SEQ ID NO: 1097640 - RNA, 13 nt, Homo sapiens
uauauaccaagcu

SEQ ID NO: 1097641 - RNA, 17 nt, Homo sapiens
uauauaguuugugguaa

SEQ ID NO: 1097642 - RNA, 11 nt, Homo sapiens
uauauauagua

SEQ ID NO: 1097643 - RNA, 14 nt, Homo sapiens
uauauaucaaggau

SEQ ID NO: 1097644 - RNA, 20 nt, Homo sapiens
uauauauugguaacauccuu

SEQ ID NO: 1097645 - RNA, 17 nt, Homo sapiens
uauauauuuuguguaua

SEQ ID NO: 1097646 - RNA, 13 nt, Homo sapiens
uauaucaucagca

SEQ ID NO: 1097647 - RNA, 19 nt, Homo sapiens
uaucaaccccagacacugg

SEQ ID NO: 1097648 - RNA, 14 nt, Homo sapiens
uaucaauagucaag

SEQ ID NO: 1097649 - RNA, 14 nt, Homo sapiens
uaucaggugcugcc

SEQ ID NO: 1097650 - RNA, 19 nt, Homo sapiens
uauccaauuaugugacaac

SEQ ID NO: 1097651 - RNA, 18 nt, Homo sapiens
uaucccauugaaacaaaa

SEQ ID NO: 1097652 - RNA, 15 nt, Homo sapiens
uauccgaacuuuaau

SEQ ID NO: 1097653 - RNA, 15 nt, Homo sapiens
uaucgcugccuugcc

SEQ ID NO: 1097654 - RNA, 15 nt, Homo sapiens
uaucgggaacagugu

SEQ ID NO: 1097655 - RNA, 21 nt, Homo sapiens
uaucgggagcagugucuucca

SEQ ID NO: 1097656 - RNA, 12 nt, Homo sapiens
uaucuaugcauu

SEQ ID NO: 1097657 - RNA, 20 nt, Homo sapiens
uaucuccuuuauagccugua

SEQ ID NO: 1097658 - RNA, 15 nt, Homo sapiens
uaucuggacaagcca

SEQ ID NO: 1097659 - RNA, 17 nt, Homo sapiens
uaucugugaggugcuga

SEQ ID NO: 1097660 - RNA, 13 nt, Homo sapiens
uaucuucauacaa

SEQ ID NO: 1097661 - RNA, 22 nt, Homo sapiens
uaucuugaaacauagagaucua

SEQ ID NO: 1097662 - RNA, 23 nt, Homo sapiens
uaugaaaaaauuaguugagaaag

SEQ ID NO: 1097663 - RNA, 18 nt, Homo sapiens
uaugaaaagaggggacca

SEQ ID NO: 1097664 - RNA, 13 nt, Homo sapiens
uaugaacauggag

SEQ ID NO: 1097665 - RNA, 14 nt, Homo sapiens
uaugaacuacaaag

SEQ ID NO: 1097666 - RNA, 19 nt, Homo sapiens
uaugaaggcuguacacugc

SEQ ID NO: 1097667 - RNA, 18 nt, Homo sapiens
uaugaauugacagacugu

SEQ ID NO: 1097668 - RNA, 21 nt, Homo sapiens
uaugacuguuuuuguaguggu

SEQ ID NO: 1097669 - RNA, 18 nt, Homo sapiens
uaugagggaaaaugagua

SEQ ID NO: 1097670 - RNA, 20 nt, Homo sapiens
uaugagucucuaugaucuug

SEQ ID NO: 1097671 - RNA, 12 nt, Homo sapiens
uaugaugccuuu

SEQ ID NO: 1097672 - RNA, 23 nt, Homo sapiens
uaugcaaccuuuggaugcacuuu

SEQ ID NO: 1097673 - RNA, 15 nt, Homo sapiens
uaugcaccaaaucau

SEQ ID NO: 1097674 - RNA, 21 nt, Homo sapiens
uaugcaccuugugucuguaca

SEQ ID NO: 1097675 - RNA, 14 nt, Homo sapiens
uaugccuacuugua

SEQ ID NO: 1097676 - RNA, 19 nt, Homo sapiens
uaugcuguaaccaaauuau

SEQ ID NO: 1097677 - RNA, 19 nt, Homo sapiens
uauggaaaaaaugaacuuu

SEQ ID NO: 1097678 - RNA, 16 nt, Homo sapiens
uauggaauacaguguu

SEQ ID NO: 1097679 - RNA, 13 nt, Homo sapiens
uauggcagccauc

SEQ ID NO: 1097680 - RNA, 21 nt, Homo sapiens
uauggcccugggagagccaga

SEQ ID NO: 1097681 - RNA, 20 nt, Homo sapiens
uaugguaaaaguuacuuauu

SEQ ID NO: 1097682 - RNA, 23 nt, Homo sapiens
uauguaauuuagcaguccaaaga

SEQ ID NO: 1097683 - RNA, 12 nt, Homo sapiens
uauguagauaac

SEQ ID NO: 1097684 - RNA, 15 nt, Homo sapiens
uaugucucagaccac

SEQ ID NO: 1097685 - RNA, 18 nt, Homo sapiens
uaugucucagaccacuau

SEQ ID NO: 1097686 - RNA, 14 nt, Homo sapiens
uaugucuuggacac

SEQ ID NO: 1097687 - RNA, 19 nt, Homo sapiens
uaugucuuggacacuguac

SEQ ID NO: 1097688 - RNA, 14 nt, Homo sapiens
uaugugauguggca

SEQ ID NO: 1097689 - RNA, 9 nt, Homo sapiens
uaugugcaa

SEQ ID NO: 1097690 - RNA, 15 nt, Homo sapiens
uauuaaaacacagcu

SEQ ID NO: 1097691 - RNA, 16 nt, Homo sapiens
uauuaaacuugucaga

SEQ ID NO: 1097692 - RNA, 13 nt, Homo sapiens
uauuaaccugaau

SEQ ID NO: 1097693 - RNA, 19 nt, Homo sapiens
uauuaaugaacugugacag

SEQ ID NO: 1097694 - RNA, 22 nt, Homo sapiens
uauuacuuauuuuugacagugu

SEQ ID NO: 1097695 - RNA, 14 nt, Homo sapiens
uauuagacaugaaa

SEQ ID NO: 1097696 - RNA, 17 nt, Homo sapiens
uauuagauaaauuucaa

SEQ ID NO: 1097697 - RNA, 20 nt, Homo sapiens
uauuagcaacugugcuacac

SEQ ID NO: 1097698 - RNA, 24 nt, Homo sapiens
uauuagcuguaaauacaugugugg

SEQ ID NO: 1097699 - RNA, 21 nt, Homo sapiens
uauuccugguauuauuuacaa

SEQ ID NO: 1097700 - RNA, 18 nt, Homo sapiens
uggucuugagaugucuuc

SEQ ID NO: 1097701 - RNA, 23 nt, Homo sapiens
uggugaaagaaaauucuuggaau

SEQ ID NO: 1097702 - RNA, 19 nt, Homo sapiens
uggugagccgagauugcac

SEQ ID NO: 1097703 - RNA, 15 nt, Homo sapiens
uggugcgaucuuggc

SEQ ID NO: 1097704 - RNA, 20 nt, Homo sapiens
uggugcuguggccaggguga

SEQ ID NO: 1097705 - RNA, 17 nt, Homo sapiens
ugguguggccagcacuc

SEQ ID NO: 1097706 - RNA, 20 nt, Homo sapiens
ugguguggccagcacucuga

SEQ ID NO: 1097707 - RNA, 13 nt, Homo sapiens
ugguuuaugucau

SEQ ID NO: 1097708 - RNA, 18 nt, Homo sapiens
ugguuucaguugacaaaa

SEQ ID NO: 1097709 - RNA, 19 nt, Homo sapiens
uguaaacauaauucuugua

SEQ ID NO: 1097710 - RNA, 21 nt, Homo sapiens
uguaaacauagauagugcuuu

SEQ ID NO: 1097711 - RNA, 16 nt, Homo sapiens
uguaacacugcaagaa

SEQ ID NO: 1097712 - RNA, 19 nt, Homo sapiens
uguaacaugcaauuuugca

SEQ ID NO: 1097713 - RNA, 15 nt, Homo sapiens
uguaauaaacucucu

SEQ ID NO: 1097714 - RNA, 21 nt, Homo sapiens
uguaauuaaguaaaccaaaaa

SEQ ID NO: 1097715 - RNA, 19 nt, Homo sapiens
uguacaguuauacauaccu

SEQ ID NO: 1097716 - RNA, 10 nt, Homo sapiens
uguacauuuc

SEQ ID NO: 1097717 - RNA, 15 nt, Homo sapiens
uguaccacaaacaca

SEQ ID NO: 1097718 - RNA, 13 nt, Homo sapiens
uguaccauguaca

SEQ ID NO: 1097719 - RNA, 19 nt, Homo sapiens
uguacccuuccuacagaua

SEQ ID NO: 1097720 - RNA, 15 nt, Homo sapiens
uguacuaagcaguaa

SEQ ID NO: 1097721 - RNA, 15 nt, Homo sapiens
uguagaaugauuuca

SEQ ID NO: 1097722 - RNA, 14 nt, Homo sapiens
uguagccugugcau

SEQ ID NO: 1097723 - RNA, 16 nt, Homo sapiens
uguaggguaaggugcc

SEQ ID NO: 1097724 - RNA, 18 nt, Homo sapiens
uguaguccuagccacuca

SEQ ID NO: 1097725 - RNA, 22 nt, Homo sapiens
uguagugucuguaauaccuuag

SEQ ID NO: 1097726 - RNA, 13 nt, Homo sapiens
uguauaauggugu

SEQ ID NO: 1097727 - RNA, 22 nt, Homo sapiens
uguauaaugguguuacuaaagu

SEQ ID NO: 1097728 - RNA, 12 nt, Homo sapiens
uguauacugugg

SEQ ID NO: 1097729 - RNA, 20 nt, Homo sapiens
uguauaucaugaaacacuuc

SEQ ID NO: 1097730 - RNA, 17 nt, Homo sapiens
uguaucggagacaguga

SEQ ID NO: 1097731 - RNA, 20 nt, Homo sapiens
uguaugauuacaucaaggcu

SEQ ID NO: 1097732 - RNA, 17 nt, Homo sapiens
uguauuuuuguacccuu

SEQ ID NO: 1097733 - RNA, 19 nt, Homo sapiens
ugucaccguggaccuuccu

SEQ ID NO: 1097734 - RNA, 17 nt, Homo sapiens
ugucagaguagaagauu

SEQ ID NO: 1097735 - RNA, 20 nt, Homo sapiens
ugucaggaaucaugaucuga

SEQ ID NO: 1097736 - RNA, 19 nt, Homo sapiens
ugucauucaagccugugaa

SEQ ID NO: 1097737 - RNA, 23 nt, Homo sapiens
uguccaaauggacauaagacaga

SEQ ID NO: 1097738 - RNA, 17 nt, Homo sapiens
uguccaacaacuccagg

SEQ ID NO: 1097739 - RNA, 17 nt, Homo sapiens
uguccauguauucacac

SEQ ID NO: 1097740 - RNA, 12 nt, Homo sapiens
ugucccauuucc

SEQ ID NO: 1097741 - RNA, 18 nt, Homo sapiens
ugucccccuaugcuccag

SEQ ID NO: 1097742 - RNA, 19 nt, Homo sapiens
uguccgacucuucugagca

SEQ ID NO: 1097743 - RNA, 18 nt, Homo sapiens
uguccgcuuucaugaaca

SEQ ID NO: 1097744 - RNA, 17 nt, Homo sapiens
uguccuacccacccucc

SEQ ID NO: 1097745 - RNA, 12 nt, Homo sapiens
uguccucagggg

SEQ ID NO: 1097746 - RNA, 17 nt, Homo sapiens
uguccucccuuguggcu

SEQ ID NO: 1097747 - RNA, 15 nt, Homo sapiens
uguccucuugcucaa

SEQ ID NO: 1097748 - RNA, 16 nt, Homo sapiens
ugucucagaccacuau

SEQ ID NO: 1097749 - RNA, 17 nt, Homo sapiens
ugucucagaccacuauu

SEQ ID NO: 1097750 - RNA, 18 nt, Homo sapiens
ugucucagaccacuauuc

SEQ ID NO: 1097751 - RNA, 19 nt, Homo sapiens
ugucuccaucucugucuca

SEQ ID NO: 1097752 - RNA, 16 nt, Homo sapiens
ugucucucucuguccu

SEQ ID NO: 1097753 - RNA, 19 nt, Homo sapiens
ugucugccagccagcagcc

SEQ ID NO: 1097754 - RNA, 17 nt, Homo sapiens
ugucugcucaguaauuu

SEQ ID NO: 1097755 - RNA, 14 nt, Homo sapiens
ugucugucccaaag

SEQ ID NO: 1097756 - RNA, 19 nt, Homo sapiens
ugucuugaugugucaucua

SEQ ID NO: 1097757 - RNA, 19 nt, Homo sapiens
ugucuuggacacuguacaa

SEQ ID NO: 1097758 - RNA, 18 nt, Homo sapiens
ugucuuuuuaagcuuauu

SEQ ID NO: 1097759 - RNA, 18 nt, Homo sapiens
ugucuuuuuucacuacau

SEQ ID NO: 1097760 - RNA, 23 nt, Homo sapiens
ugugaaagaaccaaaagagauca

SEQ ID NO: 1097761 - RNA, 16 nt, Homo sapiens
ugugaauaaaaacccu

SEQ ID NO: 1097762 - RNA, 21 nt, Homo sapiens
ugugacaaccuuuguguaaua

SEQ ID NO: 1097763 - RNA, 17 nt, Homo sapiens
ugugagcagugaguuac

SEQ ID NO: 1097764 - RNA, 16 nt, Homo sapiens
ugugaucaucccaucu

SEQ ID NO: 1097765 - RNA, 22 nt, Homo sapiens
ugugcacggcagcuugagccug

SEQ ID NO: 1097766 - RNA, 17 nt, Homo sapiens
ugugcgacuucacaaaa

SEQ ID NO: 1097767 - RNA, 14 nt, Homo sapiens
ugugcuacacuugc

SEQ ID NO: 1097768 - RNA, 14 nt, Homo sapiens
uguggcccaagaca

SEQ ID NO: 1097769 - RNA, 19 nt, Homo sapiens
uguggcuaucugcauuuau

SEQ ID NO: 1097770 - RNA, 18 nt, Homo sapiens
uguggcuucccaugucuu

SEQ ID NO: 1097771 - RNA, 13 nt, Homo sapiens
uguggucaauccg

SEQ ID NO: 1097772 - RNA, 21 nt, Homo sapiens
uguggucaauccgaaguauga

SEQ ID NO: 1097773 - RNA, 22 nt, Homo sapiens
ugugguuaaugccauggacaga

SEQ ID NO: 1097774 - RNA, 14 nt, Homo sapiens
ugugguuagaaaag

SEQ ID NO: 1097775 - RNA, 14 nt, Homo sapiens
ugugguuuauguca

SEQ ID NO: 1097776 - RNA, 15 nt, Homo sapiens
ugugguuuaugucau

SEQ ID NO: 1097777 - RNA, 20 nt, Homo sapiens
uguguaccugugacuaaaca

SEQ ID NO: 1097778 - RNA, 14 nt, Homo sapiens
uguguagauugcgu

SEQ ID NO: 1097779 - RNA, 23 nt, Homo sapiens
uguguauuuugagauaaugucaa

SEQ ID NO: 1097780 - RNA, 18 nt, Homo sapiens
uguguccuugugugcauu

SEQ ID NO: 1097781 - RNA, 21 nt, Homo sapiens
ugugucgauuucaccaagaag

SEQ ID NO: 1097782 - RNA, 23 nt, Homo sapiens
ugugucucuggaacccaggaccu

SEQ ID NO: 1097783 - RNA, 11 nt, Homo sapiens
ugugugcauuu

SEQ ID NO: 1097784 - RNA, 21 nt, Homo sapiens
uguguugggaauugcaugcca

SEQ ID NO: 1097785 - RNA, 14 nt, Homo sapiens
uguguuuccuucag

SEQ ID NO: 1097786 - RNA, 17 nt, Homo sapiens
uguguuuggaagacuau
